United States Patent 11,421,016 (CANCER NEOEPITOPES) - sequence listing, part 10

SEQ ID NO: 416367 - protein, 9 aa, Homo Sapiens
SYSAVMPQM

SEQ ID NO: 416368 - protein, 9 aa, Homo Sapiens
TAACPLPGA

SEQ ID NO: 416369 - protein, 9 aa, Homo Sapiens
QVIVRPVQL

SEQ ID NO: 416370 - protein, 9 aa, Homo Sapiens
IIPAGSMDC

SEQ ID NO: 416371 - protein, 9 aa, Homo Sapiens
NFLIGHLLD

SEQ ID NO: 416372 - protein, 9 aa, Homo Sapiens
PDRQIPGPA

SEQ ID NO: 416373 - protein, 9 aa, Homo Sapiens
GKKCGFGFV

SEQ ID NO: 416374 - protein, 9 aa, Homo Sapiens
GGRGQKIAH

SEQ ID NO: 416375 - protein, 9 aa, Homo Sapiens
RPPFFTIDL

SEQ ID NO: 416376 - protein, 9 aa, Homo Sapiens
GPVSESEPG

SEQ ID NO: 416377 - protein, 9 aa, Homo Sapiens
FVLDQDDNA

SEQ ID NO: 416378 - protein, 9 aa, Homo Sapiens
GRGGAAQPN

SEQ ID NO: 416379 - protein, 9 aa, Homo Sapiens
KTATPRSLF

SEQ ID NO: 416380 - protein, 9 aa, Homo Sapiens
MSDNAGFCI

SEQ ID NO: 416381 - protein, 9 aa, Homo Sapiens
TLKSPSCLM

SEQ ID NO: 416382 - protein, 9 aa, Homo Sapiens
AGWAGSGHP

SEQ ID NO: 416383 - protein, 9 aa, Homo Sapiens
LEAFPLPRA

SEQ ID NO: 416384 - protein, 9 aa, Homo Sapiens
PHNQNISSK

SEQ ID NO: 416385 - protein, 9 aa, Homo Sapiens
NTATTPTAT

SEQ ID NO: 416386 - protein, 9 aa, Homo Sapiens
SLYLFRASD

SEQ ID NO: 416387 - protein, 9 aa, Homo Sapiens
PFNQVAQCF

SEQ ID NO: 416388 - protein, 9 aa, Homo Sapiens
LPLKLQLRG

SEQ ID NO: 416389 - protein, 9 aa, Homo Sapiens
LRYIVCLVW

SEQ ID NO: 416390 - protein, 9 aa, Homo Sapiens
SFPQHCAGR

SEQ ID NO: 416391 - protein, 9 aa, Homo Sapiens
PPTSCPPLL

SEQ ID NO: 416392 - protein, 9 aa, Homo Sapiens
APRCWRCWS

SEQ ID NO: 416393 - protein, 9 aa, Homo Sapiens
LKIDEYMHN

SEQ ID NO: 416394 - protein, 9 aa, Homo Sapiens
QPKTAPSLS

SEQ ID NO: 416395 - protein, 9 aa, Homo Sapiens
LEDQLEGTH

SEQ ID NO: 416396 - protein, 9 aa, Homo Sapiens
YIVANVELT

SEQ ID NO: 416397 - protein, 9 aa, Homo Sapiens
YYGTQEAVI

SEQ ID NO: 416398 - protein, 9 aa, Homo Sapiens
GKPDKSSRP

SEQ ID NO: 416399 - protein, 9 aa, Homo Sapiens
LEVESVEVH

SEQ ID NO: 416400 - protein, 9 aa, Homo Sapiens
TMESGESTS

SEQ ID NO: 416401 - protein, 9 aa, Homo Sapiens
QVLAYPFFW

SEQ ID NO: 416402 - protein, 9 aa, Homo Sapiens
DAQSPSPAH

SEQ ID NO: 416403 - protein, 9 aa, Homo Sapiens
DWCLKVSFR

SEQ ID NO: 416404 - protein, 9 aa, Homo Sapiens
LSPGACRPA

SEQ ID NO: 416405 - protein, 9 aa, Homo Sapiens
HQNLNLNML

SEQ ID NO: 416406 - protein, 9 aa, Homo Sapiens
PALPSRPAQ

SEQ ID NO: 416407 - protein, 9 aa, Homo Sapiens
PGLSDDSPT

SEQ ID NO: 416408 - protein, 9 aa, Homo Sapiens
ERERGNGSN

SEQ ID NO: 416409 - protein, 9 aa, Homo Sapiens
QLNALHREK

SEQ ID NO: 416410 - protein, 9 aa, Homo Sapiens
ISNQIFPRE

SEQ ID NO: 416411 - protein, 9 aa, Homo Sapiens
ILQLLAASS

SEQ ID NO: 416412 - protein, 9 aa, Homo Sapiens
VGCRKSSLL

SEQ ID NO: 416413 - protein, 9 aa, Homo Sapiens
TECFSASMD

SEQ ID NO: 416414 - protein, 9 aa, Homo Sapiens
PRLIPDGVS

SEQ ID NO: 416415 - protein, 9 aa, Homo Sapiens
GRQDLPPVP

SEQ ID NO: 416416 - protein, 9 aa, Homo Sapiens
FQLIQSTNN

SEQ ID NO: 416417 - protein, 9 aa, Homo Sapiens
QPLGAALGV

SEQ ID NO: 416418 - protein, 9 aa, Homo Sapiens
QPALLDLPG

SEQ ID NO: 416419 - protein, 9 aa, Homo Sapiens
TPRLTGSII

SEQ ID NO: 416420 - protein, 9 aa, Homo Sapiens
PWGSGISIC

SEQ ID NO: 416421 - protein, 9 aa, Homo Sapiens
DAHANEEID

SEQ ID NO: 416422 - protein, 9 aa, Homo Sapiens
RIYMYVKRK

SEQ ID NO: 416423 - protein, 9 aa, Homo Sapiens
ITGNTIDVD

SEQ ID NO: 416424 - protein, 9 aa, Homo Sapiens
EGWHWGAAP

SEQ ID NO: 416425 - protein, 9 aa, Homo Sapiens
TLLEYTETQ

SEQ ID NO: 416426 - protein, 9 aa, Homo Sapiens
CYYVTHLPV

SEQ ID NO: 416427 - protein, 9 aa, Homo Sapiens
RTTSEPITG

SEQ ID NO: 416428 - protein, 9 aa, Homo Sapiens
WEVMPRTLE

SEQ ID NO: 416429 - protein, 9 aa, Homo Sapiens
CCTWAPEPR

SEQ ID NO: 416430 - protein, 9 aa, Homo Sapiens
DSQNCEDAQ

SEQ ID NO: 416431 - protein, 9 aa, Homo Sapiens
EHYWTYDAY

SEQ ID NO: 416432 - protein, 9 aa, Homo Sapiens
RRLLLDCLV

SEQ ID NO: 416433 - protein, 9 aa, Homo Sapiens
LPMVFCILL

SEQ ID NO: 416434 - protein, 9 aa, Homo Sapiens
HGRWWRPAP

SEQ ID NO: 416435 - protein, 9 aa, Homo Sapiens
QGCREGRMA

SEQ ID NO: 416436 - protein, 9 aa, Homo Sapiens
PLRACYHCR

SEQ ID NO: 416437 - protein, 9 aa, Homo Sapiens
GHQSPVQLL

SEQ ID NO: 416438 - protein, 9 aa, Homo Sapiens
LGRCCCSGN

SEQ ID NO: 416439 - protein, 9 aa, Homo Sapiens
HPQKSYKMN

SEQ ID NO: 416440 - protein, 9 aa, Homo Sapiens
HLGTFGFNT

SEQ ID NO: 416441 - protein, 9 aa, Homo Sapiens
AGAPHLPLK

SEQ ID NO: 416442 - protein, 9 aa, Homo Sapiens
SCSQGRQQH

SEQ ID NO: 416443 - protein, 9 aa, Homo Sapiens
WRGPGGAEG

SEQ ID NO: 416444 - protein, 9 aa, Homo Sapiens
TAHKAAHLG

SEQ ID NO: 416445 - protein, 9 aa, Homo Sapiens
GAWTKTMRA

SEQ ID NO: 416446 - protein, 9 aa, Homo Sapiens
PLGRGLHQA

SEQ ID NO: 416447 - protein, 9 aa, Homo Sapiens
SFLKKVGFN

SEQ ID NO: 416448 - protein, 9 aa, Homo Sapiens
DSPLKLELW

SEQ ID NO: 416449 - protein, 9 aa, Homo Sapiens
SATLRGLLQ

SEQ ID NO: 416450 - protein, 9 aa, Homo Sapiens
LMIMIAKNW

SEQ ID NO: 416451 - protein, 9 aa, Homo Sapiens
ENGQTWTRG

SEQ ID NO: 416452 - protein, 9 aa, Homo Sapiens
AMYSSSYCK

SEQ ID NO: 416453 - protein, 9 aa, Homo Sapiens
ITLAKNKPN

SEQ ID NO: 416454 - protein, 9 aa, Homo Sapiens
IWHNEQNLS

SEQ ID NO: 416455 - protein, 9 aa, Homo Sapiens
LFALNPHSG

SEQ ID NO: 416456 - protein, 9 aa, Homo Sapiens
WGTPNRERK

SEQ ID NO: 416457 - protein, 9 aa, Homo Sapiens
LKAGELHTH

SEQ ID NO: 416458 - protein, 9 aa, Homo Sapiens
SSTFSHQLA

SEQ ID NO: 416459 - protein, 9 aa, Homo Sapiens
MISLKNGVS

SEQ ID NO: 416460 - protein, 9 aa, Homo Sapiens
PPKMPPPRS

SEQ ID NO: 416461 - protein, 9 aa, Homo Sapiens
GCTQTMVMG

SEQ ID NO: 416462 - protein, 9 aa, Homo Sapiens
RMLYLCTSH

SEQ ID NO: 416463 - protein, 9 aa, Homo Sapiens
RRSHCQMSC

SEQ ID NO: 416464 - protein, 9 aa, Homo Sapiens
LNPRSSLRI

SEQ ID NO: 416465 - protein, 9 aa, Homo Sapiens
QCCSGQELV

SEQ ID NO: 416466 - protein, 9 aa, Homo Sapiens
TLTFLCKAG

SEQ ID NO: 416467 - protein, 9 aa, Homo Sapiens
SMHFAFGNG

SEQ ID NO: 416468 - protein, 9 aa, Homo Sapiens
LKQDGDDQP

SEQ ID NO: 416469 - protein, 9 aa, Homo Sapiens
WHWGAAPMM

SEQ ID NO: 416470 - protein, 9 aa, Homo Sapiens
SVMSCSLLT

SEQ ID NO: 416471 - protein, 9 aa, Homo Sapiens
RAESQSCQR

SEQ ID NO: 416472 - protein, 9 aa, Homo Sapiens
LAPASSHPL

SEQ ID NO: 416473 - protein, 9 aa, Homo Sapiens
IGLQKKRQP

SEQ ID NO: 416474 - protein, 9 aa, Homo Sapiens
CYTAVAVAH

SEQ ID NO: 416475 - protein, 9 aa, Homo Sapiens
RLQRQIKWD

SEQ ID NO: 416476 - protein, 9 aa, Homo Sapiens
YQKLTSATV

SEQ ID NO: 416477 - protein, 9 aa, Homo Sapiens
DVDHVVMGT

SEQ ID NO: 416478 - protein, 9 aa, Homo Sapiens
DNRKCPPLH

SEQ ID NO: 416479 - protein, 9 aa, Homo Sapiens
SKHGRCSSG

SEQ ID NO: 416480 - protein, 9 aa, Homo Sapiens
GSVWWKIAK

SEQ ID NO: 416481 - protein, 9 aa, Homo Sapiens
LMETEMQIT

SEQ ID NO: 416482 - protein, 9 aa, Homo Sapiens
TWPHSRAST

SEQ ID NO: 416483 - protein, 9 aa, Homo Sapiens
GSINTMPPK

SEQ ID NO: 416484 - protein, 9 aa, Homo Sapiens
NTTPEPTPT

SEQ ID NO: 416485 - protein, 9 aa, Homo Sapiens
LGRGLHQAV

SEQ ID NO: 416486 - protein, 9 aa, Homo Sapiens
AMCVNSRTC

SEQ ID NO: 416487 - protein, 9 aa, Homo Sapiens
ETESATTED

SEQ ID NO: 416488 - protein, 9 aa, Homo Sapiens
FLKQMVGGS

SEQ ID NO: 416489 - protein, 9 aa, Homo Sapiens
ETAQTIASY

SEQ ID NO: 416490 - protein, 9 aa, Homo Sapiens
WESRDHYEE

SEQ ID NO: 416491 - protein, 9 aa, Homo Sapiens
FCLSWILHR

SEQ ID NO: 416492 - protein, 9 aa, Homo Sapiens
CQAGWMGAH

SEQ ID NO: 416493 - protein, 9 aa, Homo Sapiens
SGPQGPPGP

SEQ ID NO: 416494 - protein, 9 aa, Homo Sapiens
PRLRMCSGP

SEQ ID NO: 416495 - protein, 9 aa, Homo Sapiens
ITTRTAVDN

SEQ ID NO: 416496 - protein, 9 aa, Homo Sapiens
LAVRMCGGP

SEQ ID NO: 416497 - protein, 9 aa, Homo Sapiens
WKHQVMVGK

SEQ ID NO: 416498 - protein, 9 aa, Homo Sapiens
LHMGFSTPA

SEQ ID NO: 416499 - protein, 9 aa, Homo Sapiens
PVVEQDKLL

SEQ ID NO: 416500 - protein, 9 aa, Homo Sapiens
PPQPPPALP

SEQ ID NO: 416501 - protein, 9 aa, Homo Sapiens
APRSRAGRQ

SEQ ID NO: 416502 - protein, 9 aa, Homo Sapiens
VTFNKKNLP

SEQ ID NO: 416503 - protein, 9 aa, Homo Sapiens
LNVQNLFEQ

SEQ ID NO: 416504 - protein, 9 aa, Homo Sapiens
MPNLQELWL

SEQ ID NO: 416505 - protein, 9 aa, Homo Sapiens
TCPPPRRGS

SEQ ID NO: 416506 - protein, 9 aa, Homo Sapiens
GILHSVSHL

SEQ ID NO: 416507 - protein, 9 aa, Homo Sapiens
VRHCPRALC

SEQ ID NO: 416508 - protein, 9 aa, Homo Sapiens
RCSQMRARC

SEQ ID NO: 416509 - protein, 9 aa, Homo Sapiens
ASGLRTCPQ

SEQ ID NO: 416510 - protein, 9 aa, Homo Sapiens
KESVWEQWQ

SEQ ID NO: 416511 - protein, 9 aa, Homo Sapiens
AVPAAACPP

SEQ ID NO: 416512 - protein, 9 aa, Homo Sapiens
GHLYYENTH

SEQ ID NO: 416513 - protein, 9 aa, Homo Sapiens
GKKPSPVPH

SEQ ID NO: 416514 - protein, 9 aa, Homo Sapiens
AGHAAAAAR

SEQ ID NO: 416515 - protein, 9 aa, Homo Sapiens
LHSNVNGSK

SEQ ID NO: 416516 - protein, 9 aa, Homo Sapiens
PPEASHLFP

SEQ ID NO: 416517 - protein, 9 aa, Homo Sapiens
PHPIHIGCT

SEQ ID NO: 416518 - protein, 9 aa, Homo Sapiens
WEGNEPGRP

SEQ ID NO: 416519 - protein, 9 aa, Homo Sapiens
LPHCSHTGS

SEQ ID NO: 416520 - protein, 9 aa, Homo Sapiens
GGQRLELTQ

SEQ ID NO: 416521 - protein, 9 aa, Homo Sapiens
QTHSQLAQF

SEQ ID NO: 416522 - protein, 9 aa, Homo Sapiens
GGGRPGPCS

SEQ ID NO: 416523 - protein, 9 aa, Homo Sapiens
TLRVTKIET

SEQ ID NO: 416524 - protein, 9 aa, Homo Sapiens
ALQAANEDI

SEQ ID NO: 416525 - protein, 9 aa, Homo Sapiens
MMSSMACGS

SEQ ID NO: 416526 - protein, 9 aa, Homo Sapiens
PSAEVELIF

SEQ ID NO: 416527 - protein, 9 aa, Homo Sapiens
PVPSNLQAQ

SEQ ID NO: 416528 - protein, 9 aa, Homo Sapiens
WGSLPLRSS

SEQ ID NO: 416529 - protein, 9 aa, Homo Sapiens
KKAEMNILE

SEQ ID NO: 416530 - protein, 9 aa, Homo Sapiens
SNHTPHKII

SEQ ID NO: 416531 - protein, 9 aa, Homo Sapiens
LMDSAWSLT

SEQ ID NO: 416532 - protein, 9 aa, Homo Sapiens
DRCERSRSF

SEQ ID NO: 416533 - protein, 9 aa, Homo Sapiens
RLEISLLHV

SEQ ID NO: 416534 - protein, 9 aa, Homo Sapiens
DTCGLPSRS

SEQ ID NO: 416535 - protein, 9 aa, Homo Sapiens
LSQGGYHRS

SEQ ID NO: 416536 - protein, 9 aa, Homo Sapiens
FSVAKILHK

SEQ ID NO: 416537 - protein, 9 aa, Homo Sapiens
KHCKRFFKF

SEQ ID NO: 416538 - protein, 9 aa, Homo Sapiens
TFDQNGMVG

SEQ ID NO: 416539 - protein, 9 aa, Homo Sapiens
SINHFQQVE

SEQ ID NO: 416540 - protein, 9 aa, Homo Sapiens
CARTCWTAS

SEQ ID NO: 416541 - protein, 9 aa, Homo Sapiens
LMHLLHSHL

SEQ ID NO: 416542 - protein, 9 aa, Homo Sapiens
FAQKSNMKL

SEQ ID NO: 416543 - protein, 9 aa, Homo Sapiens
RKTRSAPFS

SEQ ID NO: 416544 - protein, 9 aa, Homo Sapiens
WRQPVNVFI

SEQ ID NO: 416545 - protein, 9 aa, Homo Sapiens
SLLTQPSPA

SEQ ID NO: 416546 - protein, 9 aa, Homo Sapiens
QPPGPAPWW

SEQ ID NO: 416547 - protein, 9 aa, Homo Sapiens
NLSVTTSPA

SEQ ID NO: 416548 - protein, 9 aa, Homo Sapiens
GETKKAAAG

SEQ ID NO: 416549 - protein, 9 aa, Homo Sapiens
ITLLIVTII

SEQ ID NO: 416550 - protein, 9 aa, Homo Sapiens
IEETSLVKV

SEQ ID NO: 416551 - protein, 9 aa, Homo Sapiens
DTLHVFKMT

SEQ ID NO: 416552 - protein, 9 aa, Homo Sapiens
ASLVQKHLT

SEQ ID NO: 416553 - protein, 9 aa, Homo Sapiens
YLRIYMYVK

SEQ ID NO: 416554 - protein, 9 aa, Homo Sapiens
EVLTDMSYT

SEQ ID NO: 416555 - protein, 9 aa, Homo Sapiens
PFQSPTKRL

SEQ ID NO: 416556 - protein, 9 aa, Homo Sapiens
LDILADSCH

SEQ ID NO: 416557 - protein, 9 aa, Homo Sapiens
PPATATWRM

SEQ ID NO: 416558 - protein, 9 aa, Homo Sapiens
SMTTLPSWA

SEQ ID NO: 416559 - protein, 9 aa, Homo Sapiens
FQKKIYIGG

SEQ ID NO: 416560 - protein, 9 aa, Homo Sapiens
ITEKAMFDV

SEQ ID NO: 416561 - protein, 9 aa, Homo Sapiens
DLTSEEQIV

SEQ ID NO: 416562 - protein, 9 aa, Homo Sapiens
DEVGFINRT

SEQ ID NO: 416563 - protein, 9 aa, Homo Sapiens
ESRCQVLPT

SEQ ID NO: 416564 - protein, 9 aa, Homo Sapiens
KTDPRGGTQ

SEQ ID NO: 416565 - protein, 9 aa, Homo Sapiens
IRVPFLFVV

SEQ ID NO: 416566 - protein, 9 aa, Homo Sapiens
GCQPHRCPS

SEQ ID NO: 416567 - protein, 9 aa, Homo Sapiens
PPPGHPPRP

SEQ ID NO: 416568 - protein, 9 aa, Homo Sapiens
QVAQCFRLK

SEQ ID NO: 416569 - protein, 9 aa, Homo Sapiens
PHSRASTRS

SEQ ID NO: 416570 - protein, 9 aa, Homo Sapiens
EEIWLLHTL

SEQ ID NO: 416571 - protein, 9 aa, Homo Sapiens
AQTPRNTRA

SEQ ID NO: 416572 - protein, 9 aa, Homo Sapiens
QPGEKKSQA

SEQ ID NO: 416573 - protein, 9 aa, Homo Sapiens
ALQNDSESS

SEQ ID NO: 416574 - protein, 9 aa, Homo Sapiens
QHPNHLGTG

SEQ ID NO: 416575 - protein, 9 aa, Homo Sapiens
QSLMSLKRK

SEQ ID NO: 416576 - protein, 9 aa, Homo Sapiens
LVSSSAQAA

SEQ ID NO: 416577 - protein, 9 aa, Homo Sapiens
SVEIRSLEP

SEQ ID NO: 416578 - protein, 9 aa, Homo Sapiens
RKLRENLAG

SEQ ID NO: 416579 - protein, 9 aa, Homo Sapiens
CDTCLNGLV

SEQ ID NO: 416580 - protein, 9 aa, Homo Sapiens
PFLPPPPSP

SEQ ID NO: 416581 - protein, 9 aa, Homo Sapiens
AKACNEGHC

SEQ ID NO: 416582 - protein, 9 aa, Homo Sapiens
FKMAVTASS

SEQ ID NO: 416583 - protein, 9 aa, Homo Sapiens
CEDAQAIQN

SEQ ID NO: 416584 - protein, 9 aa, Homo Sapiens
ATHPQEGRS

SEQ ID NO: 416585 - protein, 9 aa, Homo Sapiens
NELFTRFDK

SEQ ID NO: 416586 - protein, 9 aa, Homo Sapiens
LLSVCPTVS

SEQ ID NO: 416587 - protein, 9 aa, Homo Sapiens
DFVVTDMSP

SEQ ID NO: 416588 - protein, 9 aa, Homo Sapiens
SCCYFCGMV

SEQ ID NO: 416589 - protein, 9 aa, Homo Sapiens
PPKRPRLQW

SEQ ID NO: 416590 - protein, 9 aa, Homo Sapiens
SQGSQCTKE

SEQ ID NO: 416591 - protein, 9 aa, Homo Sapiens
LFLQGLSLV

SEQ ID NO: 416592 - protein, 9 aa, Homo Sapiens
IPRATSTIS

SEQ ID NO: 416593 - protein, 9 aa, Homo Sapiens
WCRPWLEQM

SEQ ID NO: 416594 - protein, 9 aa, Homo Sapiens
MTLIRTKSV

SEQ ID NO: 416595 - protein, 9 aa, Homo Sapiens
YSPLREDWS

SEQ ID NO: 416596 - protein, 9 aa, Homo Sapiens
SLVQKHLTT

SEQ ID NO: 416597 - protein, 9 aa, Homo Sapiens
FAYLSGGQG

SEQ ID NO: 416598 - protein, 9 aa, Homo Sapiens
SPFPRQRRR

SEQ ID NO: 416599 - protein, 9 aa, Homo Sapiens
VRHVASGLR

SEQ ID NO: 416600 - protein, 9 aa, Homo Sapiens
EGGGSGGHY

SEQ ID NO: 416601 - protein, 9 aa, Homo Sapiens
QRPFDIHVY

SEQ ID NO: 416602 - protein, 9 aa, Homo Sapiens
VHVWVQDGR

SEQ ID NO: 416603 - protein, 9 aa, Homo Sapiens
QIQSQSSTS

SEQ ID NO: 416604 - protein, 9 aa, Homo Sapiens
ATGSANVTK

SEQ ID NO: 416605 - protein, 9 aa, Homo Sapiens
THGGSRPMP

SEQ ID NO: 416606 - protein, 9 aa, Homo Sapiens
YLHIQSLLP

SEQ ID NO: 416607 - protein, 9 aa, Homo Sapiens
VEWALGLQR

SEQ ID NO: 416608 - protein, 9 aa, Homo Sapiens
ELGHRHQST

SEQ ID NO: 416609 - protein, 9 aa, Homo Sapiens
VPALATLYV

SEQ ID NO: 416610 - protein, 9 aa, Homo Sapiens
GHRVPGRRL

SEQ ID NO: 416611 - protein, 9 aa, Homo Sapiens
STGLPSQKP

SEQ ID NO: 416612 - protein, 9 aa, Homo Sapiens
IYIVAGIFI

SEQ ID NO: 416613 - protein, 9 aa, Homo Sapiens
KKEKGNSMT

SEQ ID NO: 416614 - protein, 9 aa, Homo Sapiens
VNVLFRQRS

SEQ ID NO: 416615 - protein, 9 aa, Homo Sapiens
PHSPGVRSP

SEQ ID NO: 416616 - protein, 9 aa, Homo Sapiens
FKGIQLEPL

SEQ ID NO: 416617 - protein, 9 aa, Homo Sapiens
DEYKKTYME

SEQ ID NO: 416618 - protein, 9 aa, Homo Sapiens
GGVGEPRHC

SEQ ID NO: 416619 - protein, 9 aa, Homo Sapiens
PLWESRDHY

SEQ ID NO: 416620 - protein, 9 aa, Homo Sapiens
WTAATLRCP

SEQ ID NO: 416621 - protein, 9 aa, Homo Sapiens
CFSKAMYLP

SEQ ID NO: 416622 - protein, 9 aa, Homo Sapiens
TSNNRWVSW

SEQ ID NO: 416623 - protein, 9 aa, Homo Sapiens
QVWNCPWKA

SEQ ID NO: 416624 - protein, 9 aa, Homo Sapiens
TRWPAAPRA

SEQ ID NO: 416625 - protein, 9 aa, Homo Sapiens
LRCPQLSAS

SEQ ID NO: 416626 - protein, 9 aa, Homo Sapiens
TSWMSWECC

SEQ ID NO: 416627 - protein, 9 aa, Homo Sapiens
PKQLVHIQP

SEQ ID NO: 416628 - protein, 9 aa, Homo Sapiens
YPPFMPQRL

SEQ ID NO: 416629 - protein, 9 aa, Homo Sapiens
SFDHMPKIR

SEQ ID NO: 416630 - protein, 9 aa, Homo Sapiens
DMAHVINGG

SEQ ID NO: 416631 - protein, 9 aa, Homo Sapiens
QGWRDTVEV

SEQ ID NO: 416632 - protein, 9 aa, Homo Sapiens
LQPPSRQAE

SEQ ID NO: 416633 - protein, 9 aa, Homo Sapiens
SPKEIHGSL

SEQ ID NO: 416634 - protein, 9 aa, Homo Sapiens
DIVTEISDE

SEQ ID NO: 416635 - protein, 9 aa, Homo Sapiens
LYLCTSHPG

SEQ ID NO: 416636 - protein, 9 aa, Homo Sapiens
KIDFMDLAS

SEQ ID NO: 416637 - protein, 9 aa, Homo Sapiens
TQKAMCMKM

SEQ ID NO: 416638 - protein, 9 aa, Homo Sapiens
KDRHRECVI

SEQ ID NO: 416639 - protein, 9 aa, Homo Sapiens
NVAKACNEG

SEQ ID NO: 416640 - protein, 9 aa, Homo Sapiens
DFEAHLAYK

SEQ ID NO: 416641 - protein, 9 aa, Homo Sapiens
GQWAQKCEL

SEQ ID NO: 416642 - protein, 9 aa, Homo Sapiens
FLRPRGRCK

SEQ ID NO: 416643 - protein, 9 aa, Homo Sapiens
PGALKAPAA

SEQ ID NO: 416644 - protein, 9 aa, Homo Sapiens
QGARMTVLQ

SEQ ID NO: 416645 - protein, 9 aa, Homo Sapiens
SFPLQCVGR

SEQ ID NO: 416646 - protein, 9 aa, Homo Sapiens
RLKIDFMDL

SEQ ID NO: 416647 - protein, 9 aa, Homo Sapiens
TNDKPATTI

SEQ ID NO: 416648 - protein, 9 aa, Homo Sapiens
LVRAHFSPG

SEQ ID NO: 416649 - protein, 9 aa, Homo Sapiens
LTLATLCTQ

SEQ ID NO: 416650 - protein, 9 aa, Homo Sapiens
QKIEAYMED

SEQ ID NO: 416651 - protein, 9 aa, Homo Sapiens
GPVYLLSVS

SEQ ID NO: 416652 - protein, 9 aa, Homo Sapiens
HLHRQISLP

SEQ ID NO: 416653 - protein, 9 aa, Homo Sapiens
QAQLQQSFP

SEQ ID NO: 416654 - protein, 9 aa, Homo Sapiens
IREIPFLLL

SEQ ID NO: 416655 - protein, 9 aa, Homo Sapiens
RAHCPANGA

SEQ ID NO: 416656 - protein, 9 aa, Homo Sapiens
PAQIPTSTR

SEQ ID NO: 416657 - protein, 9 aa, Homo Sapiens
LHFKKTENL

SEQ ID NO: 416658 - protein, 9 aa, Homo Sapiens
KWHWKKLPS

SEQ ID NO: 416659 - protein, 9 aa, Homo Sapiens
TITTLLLQI

SEQ ID NO: 416660 - protein, 9 aa, Homo Sapiens
LGGGALSSH

SEQ ID NO: 416661 - protein, 9 aa, Homo Sapiens
SWAATPKSL

SEQ ID NO: 416662 - protein, 9 aa, Homo Sapiens
VATQQDANA

SEQ ID NO: 416663 - protein, 9 aa, Homo Sapiens
YHTVLHQNA

SEQ ID NO: 416664 - protein, 9 aa, Homo Sapiens
CLSRPGWAA

SEQ ID NO: 416665 - protein, 9 aa, Homo Sapiens
SGVSTQDQL

SEQ ID NO: 416666 - protein, 9 aa, Homo Sapiens
SFSVAPQPG

SEQ ID NO: 416667 - protein, 9 aa, Homo Sapiens
GVSLDLDLL

SEQ ID NO: 416668 - protein, 9 aa, Homo Sapiens
RRWLALVMG

SEQ ID NO: 416669 - protein, 9 aa, Homo Sapiens
SRGPRTTEL

SEQ ID NO: 416670 - protein, 9 aa, Homo Sapiens
CCSLQSWSS

SEQ ID NO: 416671 - protein, 9 aa, Homo Sapiens
RKQRAVSVT

SEQ ID NO: 416672 - protein, 9 aa, Homo Sapiens
LIREQPAEA

SEQ ID NO: 416673 - protein, 9 aa, Homo Sapiens
INTMPPKIH

SEQ ID NO: 416674 - protein, 9 aa, Homo Sapiens
LPLLRDQDL

SEQ ID NO: 416675 - protein, 9 aa, Homo Sapiens
PASSTKDRL

SEQ ID NO: 416676 - protein, 9 aa, Homo Sapiens
CSEDCAADL

SEQ ID NO: 416677 - protein, 9 aa, Homo Sapiens
SVCNACGLY

SEQ ID NO: 416678 - protein, 9 aa, Homo Sapiens
VPVKTTDGI

SEQ ID NO: 416679 - protein, 9 aa, Homo Sapiens
YHHPLNPDW

SEQ ID NO: 416680 - protein, 9 aa, Homo Sapiens
GRGAPRHPH

SEQ ID NO: 416681 - protein, 9 aa, Homo Sapiens
KSRVSTPLA

SEQ ID NO: 416682 - protein, 9 aa, Homo Sapiens
ALQLLAATE

SEQ ID NO: 416683 - protein, 9 aa, Homo Sapiens
QPRRTSASP

SEQ ID NO: 416684 - protein, 9 aa, Homo Sapiens
DQTVKEFII

SEQ ID NO: 416685 - protein, 9 aa, Homo Sapiens
EGLLYPQCR

SEQ ID NO: 416686 - protein, 9 aa, Homo Sapiens
IRKNGETKK

SEQ ID NO: 416687 - protein, 9 aa, Homo Sapiens
QDEDQCLIE

SEQ ID NO: 416688 - protein, 9 aa, Homo Sapiens
EGRTLVLVS

SEQ ID NO: 416689 - protein, 9 aa, Homo Sapiens
INHVHVRVD

SEQ ID NO: 416690 - protein, 9 aa, Homo Sapiens
TTATSTESL

SEQ ID NO: 416691 - protein, 9 aa, Homo Sapiens
HPGVGPGPH

SEQ ID NO: 416692 - protein, 9 aa, Homo Sapiens
SQLPASSPT

SEQ ID NO: 416693 - protein, 9 aa, Homo Sapiens
SMGFFFRIF

SEQ ID NO: 416694 - protein, 9 aa, Homo Sapiens
EEDKNCHLA

SEQ ID NO: 416695 - protein, 9 aa, Homo Sapiens
KRKLYSAMP

SEQ ID NO: 416696 - protein, 9 aa, Homo Sapiens
GTAGGDGHA

SEQ ID NO: 416697 - protein, 9 aa, Homo Sapiens
KRKIQKKRS

SEQ ID NO: 416698 - protein, 9 aa, Homo Sapiens
TWVKLPIYI

SEQ ID NO: 416699 - protein, 9 aa, Homo Sapiens
TENLEYLVI

SEQ ID NO: 416700 - protein, 9 aa, Homo Sapiens
RLRLHSRQY

SEQ ID NO: 416701 - protein, 9 aa, Homo Sapiens
CSACHSDET

SEQ ID NO: 416702 - protein, 9 aa, Homo Sapiens
DQEGNISSS

SEQ ID NO: 416703 - protein, 9 aa, Homo Sapiens
QLQKLPPDP

SEQ ID NO: 416704 - protein, 9 aa, Homo Sapiens
PRTARGVTA

SEQ ID NO: 416705 - protein, 9 aa, Homo Sapiens
SGLILKRCL

SEQ ID NO: 416706 - protein, 9 aa, Homo Sapiens
RRGSSQGCR

SEQ ID NO: 416707 - protein, 9 aa, Homo Sapiens
DNGADDWWI

SEQ ID NO: 416708 - protein, 9 aa, Homo Sapiens
RSSNKPLRG

SEQ ID NO: 416709 - protein, 9 aa, Homo Sapiens
PGTDQWQLP

SEQ ID NO: 416710 - protein, 9 aa, Homo Sapiens
LFSFFSGHR

SEQ ID NO: 416711 - protein, 9 aa, Homo Sapiens
LHLSECRDS

SEQ ID NO: 416712 - protein, 9 aa, Homo Sapiens
RHEFIHTGK

SEQ ID NO: 416713 - protein, 9 aa, Homo Sapiens
NLPAWTLTS

SEQ ID NO: 416714 - protein, 9 aa, Homo Sapiens
YLLCELLSS

SEQ ID NO: 416715 - protein, 9 aa, Homo Sapiens
VEPSNEPSP

SEQ ID NO: 416716 - protein, 9 aa, Homo Sapiens
WIFFFFALC

SEQ ID NO: 416717 - protein, 9 aa, Homo Sapiens
ASAFGDHPI

SEQ ID NO: 416718 - protein, 9 aa, Homo Sapiens
IGICTTLLV

SEQ ID NO: 416719 - protein, 9 aa, Homo Sapiens
PPPPSPCPA

SEQ ID NO: 416720 - protein, 9 aa, Homo Sapiens
GPHPPLWSR

SEQ ID NO: 416721 - protein, 9 aa, Homo Sapiens
WLPCVALCT

SEQ ID NO: 416722 - protein, 9 aa, Homo Sapiens
GTGAVAGAW

SEQ ID NO: 416723 - protein, 9 aa, Homo Sapiens
LWSRVGPRR

SEQ ID NO: 416724 - protein, 9 aa, Homo Sapiens
YAFLDQLTV

SEQ ID NO: 416725 - protein, 9 aa, Homo Sapiens
HLYYENTHR

SEQ ID NO: 416726 - protein, 9 aa, Homo Sapiens
GNNALRDIQ

SEQ ID NO: 416727 - protein, 9 aa, Homo Sapiens
KTSCARAQI

SEQ ID NO: 416728 - protein, 9 aa, Homo Sapiens
RRGPDGVMV

SEQ ID NO: 416729 - protein, 9 aa, Homo Sapiens
GPGAPNPDR

SEQ ID NO: 416730 - protein, 9 aa, Homo Sapiens
NPTISCPFQ

SEQ ID NO: 416731 - protein, 9 aa, Homo Sapiens
ATFKTRVRI

SEQ ID NO: 416732 - protein, 9 aa, Homo Sapiens
QERSPDPSP

SEQ ID NO: 416733 - protein, 9 aa, Homo Sapiens
EAVWALSNV

SEQ ID NO: 416734 - protein, 9 aa, Homo Sapiens
HTAPCEVRM

SEQ ID NO: 416735 - protein, 9 aa, Homo Sapiens
EFKMPKQLV

SEQ ID NO: 416736 - protein, 9 aa, Homo Sapiens
SLMMTDTCG

SEQ ID NO: 416737 - protein, 9 aa, Homo Sapiens
RSKAFLPRV

SEQ ID NO: 416738 - protein, 9 aa, Homo Sapiens
GGGLGGKRS

SEQ ID NO: 416739 - protein, 9 aa, Homo Sapiens
YQPPAKKNK

SEQ ID NO: 416740 - protein, 9 aa, Homo Sapiens
PAPPSFSVA

SEQ ID NO: 416741 - protein, 9 aa, Homo Sapiens
TKNLYFKQI

SEQ ID NO: 416742 - protein, 9 aa, Homo Sapiens
GKLLYGKKA

SEQ ID NO: 416743 - protein, 9 aa, Homo Sapiens
NNDHKLPPE

SEQ ID NO: 416744 - protein, 9 aa, Homo Sapiens
NAHPDNWFC

SEQ ID NO: 416745 - protein, 9 aa, Homo Sapiens
SLLHVWKVT

SEQ ID NO: 416746 - protein, 9 aa, Homo Sapiens
PAEQHPLGV

SEQ ID NO: 416747 - protein, 9 aa, Homo Sapiens
YHVMVWMMA

SEQ ID NO: 416748 - protein, 9 aa, Homo Sapiens
QISPVPGAL

SEQ ID NO: 416749 - protein, 9 aa, Homo Sapiens
EAASPRKRR

SEQ ID NO: 416750 - protein, 9 aa, Homo Sapiens
AGRQDILDN

SEQ ID NO: 416751 - protein, 9 aa, Homo Sapiens
QSPVQLLQP

SEQ ID NO: 416752 - protein, 9 aa, Homo Sapiens
TQSQPHDFV

SEQ ID NO: 416753 - protein, 9 aa, Homo Sapiens
IEVHFVLND

SEQ ID NO: 416754 - protein, 9 aa, Homo Sapiens
KKKLEKTTP

SEQ ID NO: 416755 - protein, 9 aa, Homo Sapiens
CVQVLWYDI

SEQ ID NO: 416756 - protein, 9 aa, Homo Sapiens
SECPGPKVC

SEQ ID NO: 416757 - protein, 9 aa, Homo Sapiens
LCTSHPGGS

SEQ ID NO: 416758 - protein, 9 aa, Homo Sapiens
GDPEAAAAS

SEQ ID NO: 416759 - protein, 9 aa, Homo Sapiens
PPPAQWETP

SEQ ID NO: 416760 - protein, 9 aa, Homo Sapiens
QPVQIQSQS

SEQ ID NO: 416761 - protein, 9 aa, Homo Sapiens
AQIPTSTRS

SEQ ID NO: 416762 - protein, 9 aa, Homo Sapiens
LNFFFQVEL

SEQ ID NO: 416763 - protein, 9 aa, Homo Sapiens
CAHLAKQTP

SEQ ID NO: 416764 - protein, 9 aa, Homo Sapiens
DRRPGPSRA

SEQ ID NO: 416765 - protein, 9 aa, Homo Sapiens
WGLRRGRSC

SEQ ID NO: 416766 - protein, 9 aa, Homo Sapiens
KRQVSKEWG

SEQ ID NO: 416767 - protein, 9 aa, Homo Sapiens
PVLLECAAV

SEQ ID NO: 416768 - protein, 9 aa, Homo Sapiens
CYILHGSEE

SEQ ID NO: 416769 - protein, 9 aa, Homo Sapiens
PIRSHCSST

SEQ ID NO: 416770 - protein, 9 aa, Homo Sapiens
RTGCPRVNC

SEQ ID NO: 416771 - protein, 9 aa, Homo Sapiens
GGHMERAFS

SEQ ID NO: 416772 - protein, 9 aa, Homo Sapiens
KQTFLSEVV

SEQ ID NO: 416773 - protein, 9 aa, Homo Sapiens
YSNTFYLAD

SEQ ID NO: 416774 - protein, 9 aa, Homo Sapiens
ASINLSTIK

SEQ ID NO: 416775 - protein, 9 aa, Homo Sapiens
ALTNIMGFI

SEQ ID NO: 416776 - protein, 9 aa, Homo Sapiens
LGVSGVGAE

SEQ ID NO: 416777 - protein, 9 aa, Homo Sapiens
MVSFLLRQV

SEQ ID NO: 416778 - protein, 9 aa, Homo Sapiens
LMRCYIAMC

SEQ ID NO: 416779 - protein, 9 aa, Homo Sapiens
RMAKRVCKD

SEQ ID NO: 416780 - protein, 9 aa, Homo Sapiens
HAERVTIMP

SEQ ID NO: 416781 - protein, 9 aa, Homo Sapiens
MLLSYPSED

SEQ ID NO: 416782 - protein, 9 aa, Homo Sapiens
SPGEARAPL

SEQ ID NO: 416783 - protein, 9 aa, Homo Sapiens
GILSNDVHV

SEQ ID NO: 416784 - protein, 9 aa, Homo Sapiens
SHCSSTVTV

SEQ ID NO: 416785 - protein, 9 aa, Homo Sapiens
GKKAETMGF

SEQ ID NO: 416786 - protein, 9 aa, Homo Sapiens
LGVMMMMIL

SEQ ID NO: 416787 - protein, 9 aa, Homo Sapiens
NTHRPYFPV

SEQ ID NO: 416788 - protein, 9 aa, Homo Sapiens
HGRIEEIQY

SEQ ID NO: 416789 - protein, 9 aa, Homo Sapiens
SQRIAAVAS

SEQ ID NO: 416790 - protein, 9 aa, Homo Sapiens
RPRAVCVGG

SEQ ID NO: 416791 - protein, 9 aa, Homo Sapiens
ALPVMPLEN

SEQ ID NO: 416792 - protein, 9 aa, Homo Sapiens
ACALQLLAA

SEQ ID NO: 416793 - protein, 9 aa, Homo Sapiens
PKPRGGGWA

SEQ ID NO: 416794 - protein, 9 aa, Homo Sapiens
GAPLAPGAQ

SEQ ID NO: 416795 - protein, 9 aa, Homo Sapiens
DSNEGPSGG

SEQ ID NO: 416796 - protein, 9 aa, Homo Sapiens
GIQWLQRAS

SEQ ID NO: 416797 - protein, 9 aa, Homo Sapiens
SPAWPAVLP

SEQ ID NO: 416798 - protein, 9 aa, Homo Sapiens
LSSSSRVRH

SEQ ID NO: 416799 - protein, 9 aa, Homo Sapiens
PMSSTLGTD

SEQ ID NO: 416800 - protein, 9 aa, Homo Sapiens
QCSGPGGGL

SEQ ID NO: 416801 - protein, 9 aa, Homo Sapiens
MDPAVHSAL

SEQ ID NO: 416802 - protein, 9 aa, Homo Sapiens
RKTLKMIRR

SEQ ID NO: 416803 - protein, 9 aa, Homo Sapiens
QGINKDQPT

SEQ ID NO: 416804 - protein, 9 aa, Homo Sapiens
EFIIFLKQD

SEQ ID NO: 416805 - protein, 9 aa, Homo Sapiens
PAVCGEGGG

SEQ ID NO: 416806 - protein, 9 aa, Homo Sapiens
TWAPEPRWR

SEQ ID NO: 416807 - protein, 9 aa, Homo Sapiens
DMLLTPATD

SEQ ID NO: 416808 - protein, 9 aa, Homo Sapiens
DYIRVHKAI

SEQ ID NO: 416809 - protein, 9 aa, Homo Sapiens
GLHMGFSTP

SEQ ID NO: 416810 - protein, 9 aa, Homo Sapiens
HLINNDHKL

SEQ ID NO: 416811 - protein, 9 aa, Homo Sapiens
ALTRTTSEP

SEQ ID NO: 416812 - protein, 9 aa, Homo Sapiens
YNPLPEEQP

SEQ ID NO: 416813 - protein, 9 aa, Homo Sapiens
ACEKESECE

SEQ ID NO: 416814 - protein, 9 aa, Homo Sapiens
HPFQVPHPG

SEQ ID NO: 416815 - protein, 9 aa, Homo Sapiens
GVDQLVEIT

SEQ ID NO: 416816 - protein, 9 aa, Homo Sapiens
NKFATLSVR

SEQ ID NO: 416817 - protein, 9 aa, Homo Sapiens
RERDLPQEQ

SEQ ID NO: 416818 - protein, 9 aa, Homo Sapiens
RDASPTRSS

SEQ ID NO: 416819 - protein, 9 aa, Homo Sapiens
MKNRSRIPL

SEQ ID NO: 416820 - protein, 9 aa, Homo Sapiens
AVSGEVWVL

SEQ ID NO: 416821 - protein, 9 aa, Homo Sapiens
ACPISTTLR

SEQ ID NO: 416822 - protein, 9 aa, Homo Sapiens
IETGCCTWA

SEQ ID NO: 416823 - protein, 9 aa, Homo Sapiens
SSGWMPGMN

SEQ ID NO: 416824 - protein, 9 aa, Homo Sapiens
CRCMPPYPG

SEQ ID NO: 416825 - protein, 9 aa, Homo Sapiens
MEKPAKWTC

SEQ ID NO: 416826 - protein, 9 aa, Homo Sapiens
QKAFQLIQS

SEQ ID NO: 416827 - protein, 9 aa, Homo Sapiens
RALPSLLSR

SEQ ID NO: 416828 - protein, 9 aa, Homo Sapiens
PRKCVDSPM

SEQ ID NO: 416829 - protein, 9 aa, Homo Sapiens
ILATRDARS

SEQ ID NO: 416830 - protein, 9 aa, Homo Sapiens
LLWICSQAE

SEQ ID NO: 416831 - protein, 9 aa, Homo Sapiens
LYYRIYSLV

SEQ ID NO: 416832 - protein, 9 aa, Homo Sapiens
TTTAIPSPK

SEQ ID NO: 416833 - protein, 9 aa, Homo Sapiens
AWLRERRQQ

SEQ ID NO: 416834 - protein, 9 aa, Homo Sapiens
AEVKESLAQ

SEQ ID NO: 416835 - protein, 9 aa, Homo Sapiens
SECVLSDYT

SEQ ID NO: 416836 - protein, 9 aa, Homo Sapiens
AAKAAGFGT

SEQ ID NO: 416837 - protein, 9 aa, Homo Sapiens
LNYLRRGQL

SEQ ID NO: 416838 - protein, 9 aa, Homo Sapiens
RVDTNDMVD

SEQ ID NO: 416839 - protein, 9 aa, Homo Sapiens
SSSQQSLPF

SEQ ID NO: 416840 - protein, 9 aa, Homo Sapiens
GHTRWPAAP

SEQ ID NO: 416841 - protein, 9 aa, Homo Sapiens
RKTKLKLYH

SEQ ID NO: 416842 - protein, 9 aa, Homo Sapiens
KCRYQQEVD

SEQ ID NO: 416843 - protein, 9 aa, Homo Sapiens
SLSSSSRVR

SEQ ID NO: 416844 - protein, 9 aa, Homo Sapiens
INYCLSYIT

SEQ ID NO: 416845 - protein, 9 aa, Homo Sapiens
NTSTVEGRG

SEQ ID NO: 416846 - protein, 9 aa, Homo Sapiens
SNISNTNHH

SEQ ID NO: 416847 - protein, 9 aa, Homo Sapiens
MSSKVRQLD

SEQ ID NO: 416848 - protein, 9 aa, Homo Sapiens
GYGVCMGPG

SEQ ID NO: 416849 - protein, 9 aa, Homo Sapiens
RYIVCLVWR

SEQ ID NO: 416850 - protein, 9 aa, Homo Sapiens
KDQRGGRML

SEQ ID NO: 416851 - protein, 9 aa, Homo Sapiens
VGCVEFFSR

SEQ ID NO: 416852 - protein, 9 aa, Homo Sapiens
VRAAAAPLQ

SEQ ID NO: 416853 - protein, 9 aa, Homo Sapiens
DAILTSATM

SEQ ID NO: 416854 - protein, 9 aa, Homo Sapiens
FGNGCTFKI

SEQ ID NO: 416855 - protein, 9 aa, Homo Sapiens
PGPCSTRPV

SEQ ID NO: 416856 - protein, 9 aa, Homo Sapiens
SAQFKHTVL

SEQ ID NO: 416857 - protein, 9 aa, Homo Sapiens
ECFNIICDL

SEQ ID NO: 416858 - protein, 9 aa, Homo Sapiens
EHRPPAPGS

SEQ ID NO: 416859 - protein, 9 aa, Homo Sapiens
HIKLHTRDK

SEQ ID NO: 416860 - protein, 9 aa, Homo Sapiens
WVIGFHSVE

SEQ ID NO: 416861 - protein, 9 aa, Homo Sapiens
GLLYPQCRL

SEQ ID NO: 416862 - protein, 9 aa, Homo Sapiens
LLLLLLVVL

SEQ ID NO: 416863 - protein, 9 aa, Homo Sapiens
PVQELRKLR

SEQ ID NO: 416864 - protein, 9 aa, Homo Sapiens
ISVKDHRTS

SEQ ID NO: 416865 - protein, 9 aa, Homo Sapiens
NSSLTLHMK

SEQ ID NO: 416866 - protein, 9 aa, Homo Sapiens
QDNACVGDR

SEQ ID NO: 416867 - protein, 9 aa, Homo Sapiens
KLPSCPLAT

SEQ ID NO: 416868 - protein, 9 aa, Homo Sapiens
SPVPGALKA

SEQ ID NO: 416869 - protein, 9 aa, Homo Sapiens
LNEGNHTLT

SEQ ID NO: 416870 - protein, 9 aa, Homo Sapiens
SVHGRTRTS

SEQ ID NO: 416871 - protein, 9 aa, Homo Sapiens
GSWNKLCLV

SEQ ID NO: 416872 - protein, 9 aa, Homo Sapiens
PLRGRLGSG

SEQ ID NO: 416873 - protein, 9 aa, Homo Sapiens
PPSPRPPPP

SEQ ID NO: 416874 - protein, 9 aa, Homo Sapiens
MPAIHIEDL

SEQ ID NO: 416875 - protein, 9 aa, Homo Sapiens
LVIGKISQQ

SEQ ID NO: 416876 - protein, 9 aa, Homo Sapiens
CTSKAWTPR

SEQ ID NO: 416877 - protein, 9 aa, Homo Sapiens
SPTKCEICV

SEQ ID NO: 416878 - protein, 9 aa, Homo Sapiens
TGKKEKLPG

SEQ ID NO: 416879 - protein, 9 aa, Homo Sapiens
FTTMVVTSS

SEQ ID NO: 416880 - protein, 9 aa, Homo Sapiens
SHLFPPFEE

SEQ ID NO: 416881 - protein, 9 aa, Homo Sapiens
LFLFTFLFL

SEQ ID NO: 416882 - protein, 9 aa, Homo Sapiens
HYTLVMNQT

SEQ ID NO: 416883 - protein, 9 aa, Homo Sapiens
YYLPPLPPP

SEQ ID NO: 416884 - protein, 9 aa, Homo Sapiens
DRGPAAPPG

SEQ ID NO: 416885 - protein, 9 aa, Homo Sapiens
RLMRRLVCR

SEQ ID NO: 416886 - protein, 9 aa, Homo Sapiens
QIQLKGILM

SEQ ID NO: 416887 - protein, 9 aa, Homo Sapiens
LQLLAATEQ

SEQ ID NO: 416888 - protein, 9 aa, Homo Sapiens
QAPSTGLPS

SEQ ID NO: 416889 - protein, 9 aa, Homo Sapiens
CHPGCYTCA

SEQ ID NO: 416890 - protein, 9 aa, Homo Sapiens
FSFELVVHF

SEQ ID NO: 416891 - protein, 9 aa, Homo Sapiens
TEPAGAPPP

SEQ ID NO: 416892 - protein, 9 aa, Homo Sapiens
PIKIVIMMS

SEQ ID NO: 416893 - protein, 9 aa, Homo Sapiens
ISFSVKNKE

SEQ ID NO: 416894 - protein, 9 aa, Homo Sapiens
LSDEHISLG

SEQ ID NO: 416895 - protein, 9 aa, Homo Sapiens
EGKGLHWGH

SEQ ID NO: 416896 - protein, 9 aa, Homo Sapiens
PRPLALPCR

SEQ ID NO: 416897 - protein, 9 aa, Homo Sapiens
YSLGRSSPT

SEQ ID NO: 416898 - protein, 9 aa, Homo Sapiens
GALRLRPHL

SEQ ID NO: 416899 - protein, 9 aa, Homo Sapiens
ICAVGLLTV

SEQ ID NO: 416900 - protein, 9 aa, Homo Sapiens
PMVFCILLI

SEQ ID NO: 416901 - protein, 9 aa, Homo Sapiens
MGGTCQQPA

SEQ ID NO: 416902 - protein, 9 aa, Homo Sapiens
LLVWPPWEP

SEQ ID NO: 416903 - protein, 9 aa, Homo Sapiens
GSQNSHASL

SEQ ID NO: 416904 - protein, 9 aa, Homo Sapiens
EEDLETLIA

SEQ ID NO: 416905 - protein, 9 aa, Homo Sapiens
FELVVHFFA

SEQ ID NO: 416906 - protein, 9 aa, Homo Sapiens
ACTWAERRE

SEQ ID NO: 416907 - protein, 9 aa, Homo Sapiens
EQTCLEMNT

SEQ ID NO: 416908 - protein, 9 aa, Homo Sapiens
SRTPENYSN

SEQ ID NO: 416909 - protein, 9 aa, Homo Sapiens
YLFPHSTHG

SEQ ID NO: 416910 - protein, 9 aa, Homo Sapiens
LPPPLPPLP

SEQ ID NO: 416911 - protein, 9 aa, Homo Sapiens
RIGRILCLI

SEQ ID NO: 416912 - protein, 9 aa, Homo Sapiens
LRTCPQGAR

SEQ ID NO: 416913 - protein, 9 aa, Homo Sapiens
AIWNELHSS

SEQ ID NO: 416914 - protein, 9 aa, Homo Sapiens
NTAVPQEMK

SEQ ID NO: 416915 - protein, 9 aa, Homo Sapiens
DNDPPAQLR

SEQ ID NO: 416916 - protein, 9 aa, Homo Sapiens
RGGQRLELT

SEQ ID NO: 416917 - protein, 9 aa, Homo Sapiens
TDCHGQQYV

SEQ ID NO: 416918 - protein, 9 aa, Homo Sapiens
HHKQVQGGI

SEQ ID NO: 416919 - protein, 9 aa, Homo Sapiens
NSTGEKDQL

SEQ ID NO: 416920 - protein, 9 aa, Homo Sapiens
MHYGHQAPQ

SEQ ID NO: 416921 - protein, 9 aa, Homo Sapiens
SNNRWVSWS

SEQ ID NO: 416922 - protein, 9 aa, Homo Sapiens
QRLQDQQQA

SEQ ID NO: 416923 - protein, 9 aa, Homo Sapiens
EETNSFVNK

SEQ ID NO: 416924 - protein, 9 aa, Homo Sapiens
EEVNINCKK

SEQ ID NO: 416925 - protein, 9 aa, Homo Sapiens
FSRLARVLM

SEQ ID NO: 416926 - protein, 9 aa, Homo Sapiens
GVCMGPGAQ

SEQ ID NO: 416927 - protein, 9 aa, Homo Sapiens
AARTRYIPC

SEQ ID NO: 416928 - protein, 9 aa, Homo Sapiens
PGGSRPGWK

SEQ ID NO: 416929 - protein, 9 aa, Homo Sapiens
PRSSLRIAL

SEQ ID NO: 416930 - protein, 9 aa, Homo Sapiens
PSRWCQPRS

SEQ ID NO: 416931 - protein, 9 aa, Homo Sapiens
VNCFQKANC

SEQ ID NO: 416932 - protein, 9 aa, Homo Sapiens
SEREAISWL

SEQ ID NO: 416933 - protein, 9 aa, Homo Sapiens
CEWNPCPMD

SEQ ID NO: 416934 - protein, 9 aa, Homo Sapiens
DTIRQALVQ

SEQ ID NO: 416935 - protein, 9 aa, Homo Sapiens
FGTSRHISM

SEQ ID NO: 416936 - protein, 9 aa, Homo Sapiens
FAPFFVPMS

SEQ ID NO: 416937 - protein, 9 aa, Homo Sapiens
RASVDAKKD

SEQ ID NO: 416938 - protein, 9 aa, Homo Sapiens
QQDEMTVKI

SEQ ID NO: 416939 - protein, 9 aa, Homo Sapiens
HRHIELGVT

SEQ ID NO: 416940 - protein, 9 aa, Homo Sapiens
SEYVKLVKQ

SEQ ID NO: 416941 - protein, 9 aa, Homo Sapiens
CMKNHHCKL

SEQ ID NO: 416942 - protein, 9 aa, Homo Sapiens
LVWPPWEPK

SEQ ID NO: 416943 - protein, 9 aa, Homo Sapiens
TLVMNQTVC

SEQ ID NO: 416944 - protein, 9 aa, Homo Sapiens
HIYCLDLPL

SEQ ID NO: 416945 - protein, 9 aa, Homo Sapiens
FRDPLSWSK

SEQ ID NO: 416946 - protein, 9 aa, Homo Sapiens
LLCEGLLYP

SEQ ID NO: 416947 - protein, 9 aa, Homo Sapiens
DNVNQACLE

SEQ ID NO: 416948 - protein, 9 aa, Homo Sapiens
STEGAVPKL

SEQ ID NO: 416949 - protein, 9 aa, Homo Sapiens
KEEARQVEF

SEQ ID NO: 416950 - protein, 9 aa, Homo Sapiens
SVISLLDED

SEQ ID NO: 416951 - protein, 9 aa, Homo Sapiens
PSPITPHLP

SEQ ID NO: 416952 - protein, 9 aa, Homo Sapiens
VHALVLHHA

SEQ ID NO: 416953 - protein, 9 aa, Homo Sapiens
HVHLNVFQD

SEQ ID NO: 416954 - protein, 9 aa, Homo Sapiens
GPLARVQAP

SEQ ID NO: 416955 - protein, 9 aa, Homo Sapiens
LIELTAFLM

SEQ ID NO: 416956 - protein, 9 aa, Homo Sapiens
AAQDGARCP

SEQ ID NO: 416957 - protein, 9 aa, Homo Sapiens
ASGFFQSLM

SEQ ID NO: 416958 - protein, 9 aa, Homo Sapiens
LPDRQIPGP

SEQ ID NO: 416959 - protein, 9 aa, Homo Sapiens
PRFMTILRC

SEQ ID NO: 416960 - protein, 9 aa, Homo Sapiens
SGPQERDGA

SEQ ID NO: 416961 - protein, 9 aa, Homo Sapiens
AMEHFREDE

SEQ ID NO: 416962 - protein, 9 aa, Homo Sapiens
GKRNTIASI

SEQ ID NO: 416963 - protein, 9 aa, Homo Sapiens
KWRKQDEGQ

SEQ ID NO: 416964 - protein, 9 aa, Homo Sapiens
HTASQDDRS

SEQ ID NO: 416965 - protein, 9 aa, Homo Sapiens
LLPMVFCIL

SEQ ID NO: 416966 - protein, 9 aa, Homo Sapiens
PAQPPARLP

SEQ ID NO: 416967 - protein, 9 aa, Homo Sapiens
ETSSHSHAV

SEQ ID NO: 416968 - protein, 9 aa, Homo Sapiens
TRLLSTKGM

SEQ ID NO: 416969 - protein, 9 aa, Homo Sapiens
PGSEIPPPA

SEQ ID NO: 416970 - protein, 9 aa, Homo Sapiens
LDCAVVNCF

SEQ ID NO: 416971 - protein, 9 aa, Homo Sapiens
REGRMATLE

SEQ ID NO: 416972 - protein, 9 aa, Homo Sapiens
AFEEGQALI

SEQ ID NO: 416973 - protein, 9 aa, Homo Sapiens
DLATGDKGG

SEQ ID NO: 416974 - protein, 9 aa, Homo Sapiens
CQPHRCPSC

SEQ ID NO: 416975 - protein, 9 aa, Homo Sapiens
SPRKDAGCA

SEQ ID NO: 416976 - protein, 9 aa, Homo Sapiens
TLSQCKGLN

SEQ ID NO: 416977 - protein, 9 aa, Homo Sapiens
LIFLGPDSQ

SEQ ID NO: 416978 - protein, 9 aa, Homo Sapiens
GEDNRGYGR

SEQ ID NO: 416979 - protein, 9 aa, Homo Sapiens
PCSTRPVPT

SEQ ID NO: 416980 - protein, 9 aa, Homo Sapiens
GGSPSRSAA

SEQ ID NO: 416981 - protein, 9 aa, Homo Sapiens
SGVQFVLGR

SEQ ID NO: 416982 - protein, 9 aa, Homo Sapiens
PPRALQTST

SEQ ID NO: 416983 - protein, 9 aa, Homo Sapiens
PTSSSFSKW

SEQ ID NO: 416984 - protein, 9 aa, Homo Sapiens
KLYHLNLKY

SEQ ID NO: 416985 - protein, 9 aa, Homo Sapiens
RCRDDPGVG

SEQ ID NO: 416986 - protein, 9 aa, Homo Sapiens
CGRGWQAEE

SEQ ID NO: 416987 - protein, 9 aa, Homo Sapiens
SMAKPKSQA

SEQ ID NO: 416988 - protein, 9 aa, Homo Sapiens
GCREGRMAT

SEQ ID NO: 416989 - protein, 9 aa, Homo Sapiens
DSAGATHFY

SEQ ID NO: 416990 - protein, 9 aa, Homo Sapiens
TARSTGAGP

SEQ ID NO: 416991 - protein, 9 aa, Homo Sapiens
EKPTPSPSV

SEQ ID NO: 416992 - protein, 9 aa, Homo Sapiens
EPPAILDDT

SEQ ID NO: 416993 - protein, 9 aa, Homo Sapiens
CFSLQLGDA

SEQ ID NO: 416994 - protein, 9 aa, Homo Sapiens
CNVVCWEFK

SEQ ID NO: 416995 - protein, 9 aa, Homo Sapiens
NNHLEYLPI

SEQ ID NO: 416996 - protein, 9 aa, Homo Sapiens
SAEIWDWDL

SEQ ID NO: 416997 - protein, 9 aa, Homo Sapiens
QDPCVEMPL

SEQ ID NO: 416998 - protein, 9 aa, Homo Sapiens
PHPPLWSRW

SEQ ID NO: 416999 - protein, 9 aa, Homo Sapiens
SAVPIPGRT

SEQ ID NO: 417000 - protein, 9 aa, Homo Sapiens
TLSPGEARA

SEQ ID NO: 417001 - protein, 9 aa, Homo Sapiens
QMDNLESCV

SEQ ID NO: 417002 - protein, 9 aa, Homo Sapiens
QLHRNFRRG

SEQ ID NO: 417003 - protein, 9 aa, Homo Sapiens
NLSGLQQQT

SEQ ID NO: 417004 - protein, 9 aa, Homo Sapiens
SLVQGPGIL

SEQ ID NO: 417005 - protein, 9 aa, Homo Sapiens
LAEGSECPG

SEQ ID NO: 417006 - protein, 9 aa, Homo Sapiens
PPHPPSSGF

SEQ ID NO: 417007 - protein, 9 aa, Homo Sapiens
PDLIYLHYV

SEQ ID NO: 417008 - protein, 9 aa, Homo Sapiens
IPTSAASLL

SEQ ID NO: 417009 - protein, 9 aa, Homo Sapiens
SLWNLVVSL

SEQ ID NO: 417010 - protein, 9 aa, Homo Sapiens
HVVQQAPTI

SEQ ID NO: 417011 - protein, 9 aa, Homo Sapiens
SSMAGTKPC

SEQ ID NO: 417012 - protein, 9 aa, Homo Sapiens
FGVNSSDIP

SEQ ID NO: 417013 - protein, 9 aa, Homo Sapiens
SKSISAPVI

SEQ ID NO: 417014 - protein, 9 aa, Homo Sapiens
TTPNKFATL

SEQ ID NO: 417015 - protein, 9 aa, Homo Sapiens
RRHIHHLGD

SEQ ID NO: 417016 - protein, 9 aa, Homo Sapiens
HLGDQLQLN

SEQ ID NO: 417017 - protein, 9 aa, Homo Sapiens
PTTTPPSPT

SEQ ID NO: 417018 - protein, 9 aa, Homo Sapiens
RSWRPSARI

SEQ ID NO: 417019 - protein, 9 aa, Homo Sapiens
MKKMIGMRK

SEQ ID NO: 417020 - protein, 9 aa, Homo Sapiens
VSYLDNLTY

SEQ ID NO: 417021 - protein, 9 aa, Homo Sapiens
SPPSACTRP

SEQ ID NO: 417022 - protein, 9 aa, Homo Sapiens
PVSALIAIL

SEQ ID NO: 417023 - protein, 9 aa, Homo Sapiens
IFMPFVNTS

SEQ ID NO: 417024 - protein, 9 aa, Homo Sapiens
KGQKQSFSK

SEQ ID NO: 417025 - protein, 9 aa, Homo Sapiens
SRRLQAYAR

SEQ ID NO: 417026 - protein, 9 aa, Homo Sapiens
MKDKCRYQQ

SEQ ID NO: 417027 - protein, 9 aa, Homo Sapiens
SCHCVIGKV

SEQ ID NO: 417028 - protein, 9 aa, Homo Sapiens
VRIKELALC

SEQ ID NO: 417029 - protein, 9 aa, Homo Sapiens
RLNIAVKEK

SEQ ID NO: 417030 - protein, 9 aa, Homo Sapiens
TRPPVLPWC

SEQ ID NO: 417031 - protein, 9 aa, Homo Sapiens
MFLRILEQK

SEQ ID NO: 417032 - protein, 9 aa, Homo Sapiens
PPLPTPDGG

SEQ ID NO: 417033 - protein, 9 aa, Homo Sapiens
NNLWGCGLY

SEQ ID NO: 417034 - protein, 9 aa, Homo Sapiens
AKILHKTVN

SEQ ID NO: 417035 - protein, 9 aa, Homo Sapiens
SSDSFSVLN

SEQ ID NO: 417036 - protein, 9 aa, Homo Sapiens
HDPDTGENG

SEQ ID NO: 417037 - protein, 9 aa, Homo Sapiens
QWDSDEGVL

SEQ ID NO: 417038 - protein, 9 aa, Homo Sapiens
SALLHRVII

SEQ ID NO: 417039 - protein, 9 aa, Homo Sapiens
PEPRWRMLY

SEQ ID NO: 417040 - protein, 9 aa, Homo Sapiens
AEWSHSNLD

SEQ ID NO: 417041 - protein, 9 aa, Homo Sapiens
VTQALTEWY

SEQ ID NO: 417042 - protein, 9 aa, Homo Sapiens
YSQPPGTPQ

SEQ ID NO: 417043 - protein, 9 aa, Homo Sapiens
TGVCPARSP

SEQ ID NO: 417044 - protein, 9 aa, Homo Sapiens
CVKRRRRRK

SEQ ID NO: 417045 - protein, 9 aa, Homo Sapiens
MEKGNCGKD

SEQ ID NO: 417046 - protein, 9 aa, Homo Sapiens
GHWDMDVFI

SEQ ID NO: 417047 - protein, 9 aa, Homo Sapiens
DERGLLSLT

SEQ ID NO: 417048 - protein, 9 aa, Homo Sapiens
MTTGKCIGA

SEQ ID NO: 417049 - protein, 9 aa, Homo Sapiens
LHRNAILCS

SEQ ID NO: 417050 - protein, 9 aa, Homo Sapiens
TRGETVVLQ

SEQ ID NO: 417051 - protein, 9 aa, Homo Sapiens
HLSGSKPKS

SEQ ID NO: 417052 - protein, 9 aa, Homo Sapiens
DLCRSQSRG

SEQ ID NO: 417053 - protein, 9 aa, Homo Sapiens
CIPKEQLRG

SEQ ID NO: 417054 - protein, 9 aa, Homo Sapiens
FFPSTWELT

SEQ ID NO: 417055 - protein, 9 aa, Homo Sapiens
QTGSGSVVW

SEQ ID NO: 417056 - protein, 9 aa, Homo Sapiens
APSTKKEDT

SEQ ID NO: 417057 - protein, 9 aa, Homo Sapiens
KRDKDEHYW

SEQ ID NO: 417058 - protein, 9 aa, Homo Sapiens
KVRELVTGT

SEQ ID NO: 417059 - protein, 9 aa, Homo Sapiens
ALISDLIAV

SEQ ID NO: 417060 - protein, 9 aa, Homo Sapiens
QRHHPGKQG

SEQ ID NO: 417061 - protein, 9 aa, Homo Sapiens
RPVDCADHW

SEQ ID NO: 417062 - protein, 9 aa, Homo Sapiens
SAMNVERVL

SEQ ID NO: 417063 - protein, 9 aa, Homo Sapiens
TEVTDAQCS

SEQ ID NO: 417064 - protein, 9 aa, Homo Sapiens
LQQIIVNLT

SEQ ID NO: 417065 - protein, 9 aa, Homo Sapiens
GFHSTQDSA

SEQ ID NO: 417066 - protein, 9 aa, Homo Sapiens
TDSPPALWM

SEQ ID NO: 417067 - protein, 9 aa, Homo Sapiens
NYRKKIGKL

SEQ ID NO: 417068 - protein, 9 aa, Homo Sapiens
HPEPHHTLG

SEQ ID NO: 417069 - protein, 9 aa, Homo Sapiens
CLNKDPRFQ

SEQ ID NO: 417070 - protein, 9 aa, Homo Sapiens
QLMAPLSPG

SEQ ID NO: 417071 - protein, 9 aa, Homo Sapiens
LSSCVSTPG

SEQ ID NO: 417072 - protein, 9 aa, Homo Sapiens
PILRGSNYH

SEQ ID NO: 417073 - protein, 9 aa, Homo Sapiens
SGASKEGSA

SEQ ID NO: 417074 - protein, 9 aa, Homo Sapiens
TIDSDAVST

SEQ ID NO: 417075 - protein, 9 aa, Homo Sapiens
ILSTCLVAM

SEQ ID NO: 417076 - protein, 9 aa, Homo Sapiens
QRIEAKSKR

SEQ ID NO: 417077 - protein, 9 aa, Homo Sapiens
QRHPQGPCP

SEQ ID NO: 417078 - protein, 9 aa, Homo Sapiens
SPLSILSCL

SEQ ID NO: 417079 - protein, 9 aa, Homo Sapiens
ERVLDRDEE

SEQ ID NO: 417080 - protein, 9 aa, Homo Sapiens
PPRMLGLAL

SEQ ID NO: 417081 - protein, 9 aa, Homo Sapiens
SSHSHAVFN

SEQ ID NO: 417082 - protein, 9 aa, Homo Sapiens
SRRWRMSTW

SEQ ID NO: 417083 - protein, 9 aa, Homo Sapiens
TTTTCRSCS

SEQ ID NO: 417084 - protein, 9 aa, Homo Sapiens
TLPRCVSTM

SEQ ID NO: 417085 - protein, 9 aa, Homo Sapiens
YGNIIVITI

SEQ ID NO: 417086 - protein, 9 aa, Homo Sapiens
RIKGDTMGR

SEQ ID NO: 417087 - protein, 9 aa, Homo Sapiens
GCSAPWQKS

SEQ ID NO: 417088 - protein, 9 aa, Homo Sapiens
WWLGALKKG

SEQ ID NO: 417089 - protein, 9 aa, Homo Sapiens
AGKYSATIA

SEQ ID NO: 417090 - protein, 9 aa, Homo Sapiens
WNKLCLVTL

SEQ ID NO: 417091 - protein, 9 aa, Homo Sapiens
LLLGPSICV

SEQ ID NO: 417092 - protein, 9 aa, Homo Sapiens
NQIRSGMGQ

SEQ ID NO: 417093 - protein, 9 aa, Homo Sapiens
VQDIFEKYN

SEQ ID NO: 417094 - protein, 9 aa, Homo Sapiens
GGPSSSHRD

SEQ ID NO: 417095 - protein, 9 aa, Homo Sapiens
RKRRRRKMT

SEQ ID NO: 417096 - protein, 9 aa, Homo Sapiens
LPAARTRYI

SEQ ID NO: 417097 - protein, 9 aa, Homo Sapiens
PKVDRLEVW

SEQ ID NO: 417098 - protein, 9 aa, Homo Sapiens
RLEKTTKEL

SEQ ID NO: 417099 - protein, 9 aa, Homo Sapiens
VGHRHHALV

SEQ ID NO: 417100 - protein, 9 aa, Homo Sapiens
SDLIAVRQV

SEQ ID NO: 417101 - protein, 9 aa, Homo Sapiens
GKVSLRHPR

SEQ ID NO: 417102 - protein, 9 aa, Homo Sapiens
TRWYRAPKV

SEQ ID NO: 417103 - protein, 9 aa, Homo Sapiens
FELDPEDMM

SEQ ID NO: 417104 - protein, 9 aa, Homo Sapiens
LRDMVDFLK

SEQ ID NO: 417105 - protein, 9 aa, Homo Sapiens
RVQAPVLLE

SEQ ID NO: 417106 - protein, 9 aa, Homo Sapiens
VDPELSPVM

SEQ ID NO: 417107 - protein, 9 aa, Homo Sapiens
TVGPLGLRP

SEQ ID NO: 417108 - protein, 9 aa, Homo Sapiens
YPFFWSRAK

SEQ ID NO: 417109 - protein, 9 aa, Homo Sapiens
FTIVMPNIV

SEQ ID NO: 417110 - protein, 9 aa, Homo Sapiens
EGLGAQVRA

SEQ ID NO: 417111 - protein, 9 aa, Homo Sapiens
PPPSPPSPS

SEQ ID NO: 417112 - protein, 9 aa, Homo Sapiens
CSMCCVIIP

SEQ ID NO: 417113 - protein, 9 aa, Homo Sapiens
DCPQDFVAQ

SEQ ID NO: 417114 - protein, 9 aa, Homo Sapiens
SCLRLSIRI

SEQ ID NO: 417115 - protein, 9 aa, Homo Sapiens
PAHHRRWSE

SEQ ID NO: 417116 - protein, 9 aa, Homo Sapiens
KVLTNTATT

SEQ ID NO: 417117 - protein, 9 aa, Homo Sapiens
ATWWTSGAG

SEQ ID NO: 417118 - protein, 9 aa, Homo Sapiens
YVVNIIQVI

SEQ ID NO: 417119 - protein, 9 aa, Homo Sapiens
YTPSSPSID

SEQ ID NO: 417120 - protein, 9 aa, Homo Sapiens
LDCPLSRLH

SEQ ID NO: 417121 - protein, 9 aa, Homo Sapiens
SPQCSRPGR

SEQ ID NO: 417122 - protein, 9 aa, Homo Sapiens
TVSLDFNLR

SEQ ID NO: 417123 - protein, 9 aa, Homo Sapiens
PGPAPWWHP

SEQ ID NO: 417124 - protein, 9 aa, Homo Sapiens
CVNVWMLDL

SEQ ID NO: 417125 - protein, 9 aa, Homo Sapiens
RIQAKTQEF

SEQ ID NO: 417126 - protein, 9 aa, Homo Sapiens
NEEEIWLLH

SEQ ID NO: 417127 - protein, 9 aa, Homo Sapiens
KAAPGGHPI

SEQ ID NO: 417128 - protein, 9 aa, Homo Sapiens
PPSWREEVQ

SEQ ID NO: 417129 - protein, 9 aa, Homo Sapiens
NFWEMGDMG

SEQ ID NO: 417130 - protein, 9 aa, Homo Sapiens
SILSALRVS

SEQ ID NO: 417131 - protein, 9 aa, Homo Sapiens
DRLKPPRRQ

SEQ ID NO: 417132 - protein, 9 aa, Homo Sapiens
GALLLGPPP

SEQ ID NO: 417133 - protein, 9 aa, Homo Sapiens
RGQLIVNDG

SEQ ID NO: 417134 - protein, 9 aa, Homo Sapiens
IHWSCLEHW

SEQ ID NO: 417135 - protein, 9 aa, Homo Sapiens
MLNVQNLFE

SEQ ID NO: 417136 - protein, 9 aa, Homo Sapiens
PGCLAWLPC

SEQ ID NO: 417137 - protein, 9 aa, Homo Sapiens
DKPATTIGV

SEQ ID NO: 417138 - protein, 9 aa, Homo Sapiens
SGCTRCTCT

SEQ ID NO: 417139 - protein, 9 aa, Homo Sapiens
EKPVWTVHR

SEQ ID NO: 417140 - protein, 9 aa, Homo Sapiens
NHGENLKVL

SEQ ID NO: 417141 - protein, 9 aa, Homo Sapiens
MMNHILLKE

SEQ ID NO: 417142 - protein, 9 aa, Homo Sapiens
ATEQQPGNQ

SEQ ID NO: 417143 - protein, 9 aa, Homo Sapiens
ARDNKVREL

SEQ ID NO: 417144 - protein, 9 aa, Homo Sapiens
EAFLPSAEV

SEQ ID NO: 417145 - protein, 9 aa, Homo Sapiens
LSSWSHLFP

SEQ ID NO: 417146 - protein, 9 aa, Homo Sapiens
GVNSSDIPG

SEQ ID NO: 417147 - protein, 9 aa, Homo Sapiens
PAGAPPPRG

SEQ ID NO: 417148 - protein, 9 aa, Homo Sapiens
EGLRASVDA

SEQ ID NO: 417149 - protein, 9 aa, Homo Sapiens
SPHHPQRCG

SEQ ID NO: 417150 - protein, 9 aa, Homo Sapiens
YSATGAPRG

SEQ ID NO: 417151 - protein, 9 aa, Homo Sapiens
QEGEQIYQH

SEQ ID NO: 417152 - protein, 9 aa, Homo Sapiens
VALCTASMC

SEQ ID NO: 417153 - protein, 9 aa, Homo Sapiens
CEETLPACQ

SEQ ID NO: 417154 - protein, 9 aa, Homo Sapiens
PFKVWLHLA

SEQ ID NO: 417155 - protein, 9 aa, Homo Sapiens
EEDILASSA

SEQ ID NO: 417156 - protein, 9 aa, Homo Sapiens
SEQWSETGA

SEQ ID NO: 417157 - protein, 9 aa, Homo Sapiens
QTMVMGIIF

SEQ ID NO: 417158 - protein, 9 aa, Homo Sapiens
PNLHTDLDV

SEQ ID NO: 417159 - protein, 9 aa, Homo Sapiens
GTVTAAAAG

SEQ ID NO: 417160 - protein, 9 aa, Homo Sapiens
SGKRCPPRA

SEQ ID NO: 417161 - protein, 9 aa, Homo Sapiens
HFLSSQVID

SEQ ID NO: 417162 - protein, 9 aa, Homo Sapiens
HYQSFGNNH

SEQ ID NO: 417163 - protein, 9 aa, Homo Sapiens
CQELRLDEP

SEQ ID NO: 417164 - protein, 9 aa, Homo Sapiens
PMLPQQLQV

SEQ ID NO: 417165 - protein, 9 aa, Homo Sapiens
LSSISRPCP

SEQ ID NO: 417166 - protein, 9 aa, Homo Sapiens
TAKAFKIPD

SEQ ID NO: 417167 - protein, 9 aa, Homo Sapiens
ISQADLLDG

SEQ ID NO: 417168 - protein, 9 aa, Homo Sapiens
TISVSSSDS

SEQ ID NO: 417169 - protein, 9 aa, Homo Sapiens
FTSFNSSTL

SEQ ID NO: 417170 - protein, 9 aa, Homo Sapiens
TDKKEWVKW

SEQ ID NO: 417171 - protein, 9 aa, Homo Sapiens
IGPAPGSSS

SEQ ID NO: 417172 - protein, 9 aa, Homo Sapiens
PGPFLHCVA

SEQ ID NO: 417173 - protein, 9 aa, Homo Sapiens
LSAGAIRVY

SEQ ID NO: 417174 - protein, 9 aa, Homo Sapiens
CEEDKNCHL

SEQ ID NO: 417175 - protein, 9 aa, Homo Sapiens
APSTCRISV

SEQ ID NO: 417176 - protein, 9 aa, Homo Sapiens
RDSRRWAGR

SEQ ID NO: 417177 - protein, 9 aa, Homo Sapiens
YKCLDESSG

SEQ ID NO: 417178 - protein, 9 aa, Homo Sapiens
ESVPSSSPT

SEQ ID NO: 417179 - protein, 9 aa, Homo Sapiens
PSWFRSCSW

SEQ ID NO: 417180 - protein, 9 aa, Homo Sapiens
NGGQHIDYV

SEQ ID NO: 417181 - protein, 9 aa, Homo Sapiens
RVYLHVQKS

SEQ ID NO: 417182 - protein, 9 aa, Homo Sapiens
HGNSTGEKD

SEQ ID NO: 417183 - protein, 9 aa, Homo Sapiens
QLHAAWHDG

SEQ ID NO: 417184 - protein, 9 aa, Homo Sapiens
KLGLLCDSV

SEQ ID NO: 417185 - protein, 9 aa, Homo Sapiens
KETWREEKN

SEQ ID NO: 417186 - protein, 9 aa, Homo Sapiens
VPREVYHEE

SEQ ID NO: 417187 - protein, 9 aa, Homo Sapiens
WGPRATLTR

SEQ ID NO: 417188 - protein, 9 aa, Homo Sapiens
LYRGGQRCR

SEQ ID NO: 417189 - protein, 9 aa, Homo Sapiens
QQLPTFLPE

SEQ ID NO: 417190 - protein, 9 aa, Homo Sapiens
AGPGTGAEA

SEQ ID NO: 417191 - protein, 9 aa, Homo Sapiens
EITKVLGTP

SEQ ID NO: 417192 - protein, 9 aa, Homo Sapiens
CGLVQPGAV

SEQ ID NO: 417193 - protein, 9 aa, Homo Sapiens
ELKVKQGLR

SEQ ID NO: 417194 - protein, 9 aa, Homo Sapiens
VEANPAAVQ

SEQ ID NO: 417195 - protein, 9 aa, Homo Sapiens
KSITHNMTT

SEQ ID NO: 417196 - protein, 9 aa, Homo Sapiens
KADLTNKRA

SEQ ID NO: 417197 - protein, 9 aa, Homo Sapiens
RDEERVHHL

SEQ ID NO: 417198 - protein, 9 aa, Homo Sapiens
GAASRLTAR

SEQ ID NO: 417199 - protein, 9 aa, Homo Sapiens
IYTGLFLFT

SEQ ID NO: 417200 - protein, 9 aa, Homo Sapiens
GPKCPAGER

SEQ ID NO: 417201 - protein, 9 aa, Homo Sapiens
MLEPEGMPP

SEQ ID NO: 417202 - protein, 9 aa, Homo Sapiens
QKDLQHLSR

SEQ ID NO: 417203 - protein, 9 aa, Homo Sapiens
QCRQPLPTQ

SEQ ID NO: 417204 - protein, 9 aa, Homo Sapiens
CRSCCWATT

SEQ ID NO: 417205 - protein, 9 aa, Homo Sapiens
HSTLLLVSY

SEQ ID NO: 417206 - protein, 9 aa, Homo Sapiens
ISAYDDKLA

SEQ ID NO: 417207 - protein, 9 aa, Homo Sapiens
EFTTSALLH

SEQ ID NO: 417208 - protein, 9 aa, Homo Sapiens
GGAAQPNGP

SEQ ID NO: 417209 - protein, 9 aa, Homo Sapiens
VKDHRTSQN

SEQ ID NO: 417210 - protein, 9 aa, Homo Sapiens
ADDPRRSPF

SEQ ID NO: 417211 - protein, 9 aa, Homo Sapiens
YKVYTFNSM

SEQ ID NO: 417212 - protein, 9 aa, Homo Sapiens
LHDLSGRKM

SEQ ID NO: 417213 - protein, 9 aa, Homo Sapiens
SRRWRCLPH

SEQ ID NO: 417214 - protein, 9 aa, Homo Sapiens
VDEVACAAL

SEQ ID NO: 417215 - protein, 9 aa, Homo Sapiens
RWCQPRSPL

SEQ ID NO: 417216 - protein, 9 aa, Homo Sapiens
VQLLLQGPD

SEQ ID NO: 417217 - protein, 9 aa, Homo Sapiens
PTTTTSSPR

SEQ ID NO: 417218 - protein, 9 aa, Homo Sapiens
HLLMEWGAD

SEQ ID NO: 417219 - protein, 9 aa, Homo Sapiens
LECAAVGVG

SEQ ID NO: 417220 - protein, 9 aa, Homo Sapiens
QKKRSKKVS

SEQ ID NO: 417221 - protein, 9 aa, Homo Sapiens
SHSHLEKNS

SEQ ID NO: 417222 - protein, 9 aa, Homo Sapiens
HIVSTGQLQ

SEQ ID NO: 417223 - protein, 9 aa, Homo Sapiens
SSHKYDREP

SEQ ID NO: 417224 - protein, 9 aa, Homo Sapiens
LLPRAVSGN

SEQ ID NO: 417225 - protein, 9 aa, Homo Sapiens
PGASTSSRK

SEQ ID NO: 417226 - protein, 9 aa, Homo Sapiens
LVYAFLDQL

SEQ ID NO: 417227 - protein, 9 aa, Homo Sapiens
LDVEITTYR

SEQ ID NO: 417228 - protein, 9 aa, Homo Sapiens
HALVVGAAQ

SEQ ID NO: 417229 - protein, 9 aa, Homo Sapiens
QYNVLTLTF

SEQ ID NO: 417230 - protein, 9 aa, Homo Sapiens
EPRELQLLN

SEQ ID NO: 417231 - protein, 9 aa, Homo Sapiens
VVHLHIDVV

SEQ ID NO: 417232 - protein, 9 aa, Homo Sapiens
GYNHSSGGY

SEQ ID NO: 417233 - protein, 9 aa, Homo Sapiens
RQCCRCMRA

SEQ ID NO: 417234 - protein, 9 aa, Homo Sapiens
TGAVAGAWS

SEQ ID NO: 417235 - protein, 9 aa, Homo Sapiens
GEGPLARVH

SEQ ID NO: 417236 - protein, 9 aa, Homo Sapiens
SSSRRWRCL

SEQ ID NO: 417237 - protein, 9 aa, Homo Sapiens
DFSRLGRYF

SEQ ID NO: 417238 - protein, 9 aa, Homo Sapiens
MKWRKQDEG

SEQ ID NO: 417239 - protein, 9 aa, Homo Sapiens
TAMLALLHL

SEQ ID NO: 417240 - protein, 9 aa, Homo Sapiens
GLLLCRVDN

SEQ ID NO: 417241 - protein, 9 aa, Homo Sapiens
STLIDALCR

SEQ ID NO: 417242 - protein, 9 aa, Homo Sapiens
MRVPSTPWA

SEQ ID NO: 417243 - protein, 9 aa, Homo Sapiens
LYYENTHRP

SEQ ID NO: 417244 - protein, 9 aa, Homo Sapiens
SFKRYEELE

SEQ ID NO: 417245 - protein, 9 aa, Homo Sapiens
KAFAMITYK

SEQ ID NO: 417246 - protein, 9 aa, Homo Sapiens
GSYRFSPLP

SEQ ID NO: 417247 - protein, 9 aa, Homo Sapiens
HLYGSYPPA

SEQ ID NO: 417248 - protein, 9 aa, Homo Sapiens
DETTEPPPV

SEQ ID NO: 417249 - protein, 9 aa, Homo Sapiens
HDYQELMNV

SEQ ID NO: 417250 - protein, 9 aa, Homo Sapiens
LPGSWSMRR

SEQ ID NO: 417251 - protein, 9 aa, Homo Sapiens
GEDSGGSFP

SEQ ID NO: 417252 - protein, 9 aa, Homo Sapiens
STSCSTMSC

SEQ ID NO: 417253 - protein, 9 aa, Homo Sapiens
MDKRRNLQQ

SEQ ID NO: 417254 - protein, 9 aa, Homo Sapiens
ENALTGSQN

SEQ ID NO: 417255 - protein, 9 aa, Homo Sapiens
PPTAADSTA

SEQ ID NO: 417256 - protein, 9 aa, Homo Sapiens
QVLLPRVSA

SEQ ID NO: 417257 - protein, 9 aa, Homo Sapiens
GKLQRRKNP

SEQ ID NO: 417258 - protein, 9 aa, Homo Sapiens
FVANMLVVL

SEQ ID NO: 417259 - protein, 9 aa, Homo Sapiens
LAYVLANTS

SEQ ID NO: 417260 - protein, 9 aa, Homo Sapiens
DLTSNQLQK

SEQ ID NO: 417261 - protein, 9 aa, Homo Sapiens
PGSLPAPPS

SEQ ID NO: 417262 - protein, 9 aa, Homo Sapiens
VRDCGIRTS

SEQ ID NO: 417263 - protein, 9 aa, Homo Sapiens
QNPQAPEAP

SEQ ID NO: 417264 - protein, 9 aa, Homo Sapiens
DNLESCVAL

SEQ ID NO: 417265 - protein, 9 aa, Homo Sapiens
SSEQWSETG

SEQ ID NO: 417266 - protein, 9 aa, Homo Sapiens
QVLLDVKAW

SEQ ID NO: 417267 - protein, 9 aa, Homo Sapiens
PELVKQVRD

SEQ ID NO: 417268 - protein, 9 aa, Homo Sapiens
TLQQRHPQG

SEQ ID NO: 417269 - protein, 9 aa, Homo Sapiens
FGWCSSLQR

SEQ ID NO: 417270 - protein, 9 aa, Homo Sapiens
TSHGSSESS

SEQ ID NO: 417271 - protein, 9 aa, Homo Sapiens
IPGRTGSSS

SEQ ID NO: 417272 - protein, 9 aa, Homo Sapiens
RRPIFEGHI

SEQ ID NO: 417273 - protein, 9 aa, Homo Sapiens
RVAITEHAE

SEQ ID NO: 417274 - protein, 9 aa, Homo Sapiens
APHLPLKLQ

SEQ ID NO: 417275 - protein, 9 aa, Homo Sapiens
PKTAPSLST

SEQ ID NO: 417276 - protein, 9 aa, Homo Sapiens
PRAPPRTAR

SEQ ID NO: 417277 - protein, 9 aa, Homo Sapiens
PPFSSSSSV

SEQ ID NO: 417278 - protein, 9 aa, Homo Sapiens
SPITPHLPH

SEQ ID NO: 417279 - protein, 9 aa, Homo Sapiens
KREKIINPT

SEQ ID NO: 417280 - protein, 9 aa, Homo Sapiens
ETLPACQTL

SEQ ID NO: 417281 - protein, 9 aa, Homo Sapiens
RQVSKEWGE

SEQ ID NO: 417282 - protein, 9 aa, Homo Sapiens
HLEYLPISL

SEQ ID NO: 417283 - protein, 9 aa, Homo Sapiens
RLTARLLAA

SEQ ID NO: 417284 - protein, 9 aa, Homo Sapiens
CGLDCFKVY

SEQ ID NO: 417285 - protein, 9 aa, Homo Sapiens
ECCMLVGYP

SEQ ID NO: 417286 - protein, 9 aa, Homo Sapiens
CLIKGAKGI

SEQ ID NO: 417287 - protein, 9 aa, Homo Sapiens
PKCIIHGPA

SEQ ID NO: 417288 - protein, 9 aa, Homo Sapiens
LIQSTNNNT

SEQ ID NO: 417289 - protein, 9 aa, Homo Sapiens
SSWSRLSLH

SEQ ID NO: 417290 - protein, 9 aa, Homo Sapiens
IQLKGILMH

SEQ ID NO: 417291 - protein, 9 aa, Homo Sapiens
SKCAFLRTP

SEQ ID NO: 417292 - protein, 9 aa, Homo Sapiens
FRRFQRDNE

SEQ ID NO: 417293 - protein, 9 aa, Homo Sapiens
EGDHITSVN

SEQ ID NO: 417294 - protein, 9 aa, Homo Sapiens
VHYTFSGWR

SEQ ID NO: 417295 - protein, 9 aa, Homo Sapiens
DRQIPGPAI

SEQ ID NO: 417296 - protein, 9 aa, Homo Sapiens
LGGKRSLGN

SEQ ID NO: 417297 - protein, 9 aa, Homo Sapiens
ILTQAITGQ

SEQ ID NO: 417298 - protein, 9 aa, Homo Sapiens
VLFSSEATH

SEQ ID NO: 417299 - protein, 9 aa, Homo Sapiens
PHPARTQTQ

SEQ ID NO: 417300 - protein, 9 aa, Homo Sapiens
CRCMRAAAS

SEQ ID NO: 417301 - protein, 9 aa, Homo Sapiens
RMRTFSATV

SEQ ID NO: 417302 - protein, 9 aa, Homo Sapiens
ALLILLQFF

SEQ ID NO: 417303 - protein, 9 aa, Homo Sapiens
WCLHRYNSL

SEQ ID NO: 417304 - protein, 9 aa, Homo Sapiens
SKTLQDFLY

SEQ ID NO: 417305 - protein, 9 aa, Homo Sapiens
EHISLGQLS

SEQ ID NO: 417306 - protein, 9 aa, Homo Sapiens
YKGTMPVPE

SEQ ID NO: 417307 - protein, 9 aa, Homo Sapiens
VTSLGVMVD

SEQ ID NO: 417308 - protein, 9 aa, Homo Sapiens
TMVVTSSII

SEQ ID NO: 417309 - protein, 9 aa, Homo Sapiens
IIQMYLTTM

SEQ ID NO: 417310 - protein, 9 aa, Homo Sapiens
KDDIEVHFV

SEQ ID NO: 417311 - protein, 9 aa, Homo Sapiens
FEPGERAGA

SEQ ID NO: 417312 - protein, 9 aa, Homo Sapiens
RRPSRLWSP

SEQ ID NO: 417313 - protein, 9 aa, Homo Sapiens
TRSGSGSAA

SEQ ID NO: 417314 - protein, 9 aa, Homo Sapiens
SFSINTSPG

SEQ ID NO: 417315 - protein, 9 aa, Homo Sapiens
ERTKEGISI

SEQ ID NO: 417316 - protein, 9 aa, Homo Sapiens
SPDERHVKL

SEQ ID NO: 417317 - protein, 9 aa, Homo Sapiens
TDMWKKNDQ

SEQ ID NO: 417318 - protein, 9 aa, Homo Sapiens
PSPELVKQV

SEQ ID NO: 417319 - protein, 9 aa, Homo Sapiens
CMLVGYPST

SEQ ID NO: 417320 - protein, 9 aa, Homo Sapiens
LDDSDREGP

SEQ ID NO: 417321 - protein, 9 aa, Homo Sapiens
MQYTVLVAG

SEQ ID NO: 417322 - protein, 9 aa, Homo Sapiens
PLVLVQLLE

SEQ ID NO: 417323 - protein, 9 aa, Homo Sapiens
LSPGTDPDA

SEQ ID NO: 417324 - protein, 9 aa, Homo Sapiens
VAVRSPSTN

SEQ ID NO: 417325 - protein, 9 aa, Homo Sapiens
TMVQLFERG

SEQ ID NO: 417326 - protein, 9 aa, Homo Sapiens
AFGNGCTFK

SEQ ID NO: 417327 - protein, 9 aa, Homo Sapiens
LHQPLPGQH

SEQ ID NO: 417328 - protein, 9 aa, Homo Sapiens
VWMLLGAAS

SEQ ID NO: 417329 - protein, 9 aa, Homo Sapiens
APGCTLVLD

SEQ ID NO: 417330 - protein, 9 aa, Homo Sapiens
TESRLFLMD

SEQ ID NO: 417331 - protein, 9 aa, Homo Sapiens
DLPEGEKNQ

SEQ ID NO: 417332 - protein, 9 aa, Homo Sapiens
VACAALVRP

SEQ ID NO: 417333 - protein, 9 aa, Homo Sapiens
CLEEPRKGL

SEQ ID NO: 417334 - protein, 9 aa, Homo Sapiens
GSMHFALHY

SEQ ID NO: 417335 - protein, 9 aa, Homo Sapiens
VQVQGMPVT

SEQ ID NO: 417336 - protein, 9 aa, Homo Sapiens
NLHIQCEGG

SEQ ID NO: 417337 - protein, 9 aa, Homo Sapiens
SAFVAQIHG

SEQ ID NO: 417338 - protein, 9 aa, Homo Sapiens
SEPEKTLHT

SEQ ID NO: 417339 - protein, 9 aa, Homo Sapiens
PSCPRPTSS

SEQ ID NO: 417340 - protein, 9 aa, Homo Sapiens
RTAEWSHSN

SEQ ID NO: 417341 - protein, 9 aa, Homo Sapiens
SSSSRVRHV

SEQ ID NO: 417342 - protein, 9 aa, Homo Sapiens
LRPHLRGQG

SEQ ID NO: 417343 - protein, 9 aa, Homo Sapiens
RILLCRPGW

SEQ ID NO: 417344 - protein, 9 aa, Homo Sapiens
SCVPRPPQP

SEQ ID NO: 417345 - protein, 9 aa, Homo Sapiens
SECRDSFKK

SEQ ID NO: 417346 - protein, 9 aa, Homo Sapiens
EEMEEEKSK

SEQ ID NO: 417347 - protein, 9 aa, Homo Sapiens
ETFWGYCVQ

SEQ ID NO: 417348 - protein, 9 aa, Homo Sapiens
AVGILHSVS

SEQ ID NO: 417349 - protein, 9 aa, Homo Sapiens
VQGVDPRVG

SEQ ID NO: 417350 - protein, 9 aa, Homo Sapiens
DHFTAESYT

SEQ ID NO: 417351 - protein, 9 aa, Homo Sapiens
ASPTRSSRG

SEQ ID NO: 417352 - protein, 9 aa, Homo Sapiens
ACPACALQL

SEQ ID NO: 417353 - protein, 9 aa, Homo Sapiens
GGDSCLCSM

SEQ ID NO: 417354 - protein, 9 aa, Homo Sapiens
SLQSWSSPL

SEQ ID NO: 417355 - protein, 9 aa, Homo Sapiens
LLRDFEECR

SEQ ID NO: 417356 - protein, 9 aa, Homo Sapiens
QALVLGPGL

SEQ ID NO: 417357 - protein, 9 aa, Homo Sapiens
LMSHKICWL

SEQ ID NO: 417358 - protein, 9 aa, Homo Sapiens
RWRGPGGAE

SEQ ID NO: 417359 - protein, 9 aa, Homo Sapiens
TTQTTSGPT

SEQ ID NO: 417360 - protein, 9 aa, Homo Sapiens
STGSRQSRS

SEQ ID NO: 417361 - protein, 9 aa, Homo Sapiens
VAKACNEGH

SEQ ID NO: 417362 - protein, 9 aa, Homo Sapiens
VLVRQVDRM

SEQ ID NO: 417363 - protein, 9 aa, Homo Sapiens
VLWRNPISP

SEQ ID NO: 417364 - protein, 9 aa, Homo Sapiens
AQLTSLVML

SEQ ID NO: 417365 - protein, 9 aa, Homo Sapiens
NPPQGNRKM

SEQ ID NO: 417366 - protein, 9 aa, Homo Sapiens
ILASRWKPC

SEQ ID NO: 417367 - protein, 9 aa, Homo Sapiens
PSSSSTSMG

SEQ ID NO: 417368 - protein, 9 aa, Homo Sapiens
REPLVDSPA

SEQ ID NO: 417369 - protein, 9 aa, Homo Sapiens
LRLWMFLRI

SEQ ID NO: 417370 - protein, 9 aa, Homo Sapiens
DLASTAGLS

SEQ ID NO: 417371 - protein, 9 aa, Homo Sapiens
LTGLRAPCT

SEQ ID NO: 417372 - protein, 9 aa, Homo Sapiens
KNWKIKIQN

SEQ ID NO: 417373 - protein, 9 aa, Homo Sapiens
HEYFFLIGL

SEQ ID NO: 417374 - protein, 9 aa, Homo Sapiens
LHCFSLQLG

SEQ ID NO: 417375 - protein, 9 aa, Homo Sapiens
ARHQNNIFT

SEQ ID NO: 417376 - protein, 9 aa, Homo Sapiens
EHQCRAVRY

SEQ ID NO: 417377 - protein, 9 aa, Homo Sapiens
EQRGCQQRE

SEQ ID NO: 417378 - protein, 9 aa, Homo Sapiens
IDKNAVKFL

SEQ ID NO: 417379 - protein, 9 aa, Homo Sapiens
APVGNGCAG

SEQ ID NO: 417380 - protein, 9 aa, Homo Sapiens
YESCNHVHV

SEQ ID NO: 417381 - protein, 9 aa, Homo Sapiens
TTSTGGIFE

SEQ ID NO: 417382 - protein, 9 aa, Homo Sapiens
LRPPAQIPT

SEQ ID NO: 417383 - protein, 9 aa, Homo Sapiens
LQHHFLVTS

SEQ ID NO: 417384 - protein, 9 aa, Homo Sapiens
FHLLGGDRI

SEQ ID NO: 417385 - protein, 9 aa, Homo Sapiens
QGYLFPHST

SEQ ID NO: 417386 - protein, 9 aa, Homo Sapiens
AAVTFVEQG

SEQ ID NO: 417387 - protein, 9 aa, Homo Sapiens
VYLHVQKST

SEQ ID NO: 417388 - protein, 9 aa, Homo Sapiens
EGQAALGAR

SEQ ID NO: 417389 - protein, 9 aa, Homo Sapiens
TAIISLVQG

SEQ ID NO: 417390 - protein, 9 aa, Homo Sapiens
PTPPAPRLL

SEQ ID NO: 417391 - protein, 9 aa, Homo Sapiens
FGPTLMRPL

SEQ ID NO: 417392 - protein, 9 aa, Homo Sapiens
PPLSSPLPS

SEQ ID NO: 417393 - protein, 9 aa, Homo Sapiens
SGWMPGMNM

SEQ ID NO: 417394 - protein, 9 aa, Homo Sapiens
KCHAGFQMT

SEQ ID NO: 417395 - protein, 9 aa, Homo Sapiens
GISQADLLD

SEQ ID NO: 417396 - protein, 9 aa, Homo Sapiens
LECNSSKLC

SEQ ID NO: 417397 - protein, 9 aa, Homo Sapiens
IRQALVQQG

SEQ ID NO: 417398 - protein, 9 aa, Homo Sapiens
LLHLTEEKQ

SEQ ID NO: 417399 - protein, 9 aa, Homo Sapiens
ASRWKPCDN

SEQ ID NO: 417400 - protein, 9 aa, Homo Sapiens
GQALISDLI

SEQ ID NO: 417401 - protein, 9 aa, Homo Sapiens
CRPLSTAWA

SEQ ID NO: 417402 - protein, 9 aa, Homo Sapiens
TTRWSACPV

SEQ ID NO: 417403 - protein, 9 aa, Homo Sapiens
RFCRPSRAC

SEQ ID NO: 417404 - protein, 9 aa, Homo Sapiens
EALGVGEVV

SEQ ID NO: 417405 - protein, 9 aa, Homo Sapiens
LHVGHTPMH

SEQ ID NO: 417406 - protein, 9 aa, Homo Sapiens
KASSPGHPL

SEQ ID NO: 417407 - protein, 9 aa, Homo Sapiens
YLHDLSGRK

SEQ ID NO: 417408 - protein, 9 aa, Homo Sapiens
ETAKAPLSR

SEQ ID NO: 417409 - protein, 9 aa, Homo Sapiens
YTYVASDSE

SEQ ID NO: 417410 - protein, 9 aa, Homo Sapiens
ELWVLAPPR

SEQ ID NO: 417411 - protein, 9 aa, Homo Sapiens
EMVQCLTLD

SEQ ID NO: 417412 - protein, 9 aa, Homo Sapiens
RQHLAMMER

SEQ ID NO: 417413 - protein, 9 aa, Homo Sapiens
PLSLQQHLL

SEQ ID NO: 417414 - protein, 9 aa, Homo Sapiens
DSKRVFGEH

SEQ ID NO: 417415 - protein, 9 aa, Homo Sapiens
CHQQLPTFL

SEQ ID NO: 417416 - protein, 9 aa, Homo Sapiens
PVVDPDAHP

SEQ ID NO: 417417 - protein, 9 aa, Homo Sapiens
ALQSPCIST

SEQ ID NO: 417418 - protein, 9 aa, Homo Sapiens
IRKDGLHGD

SEQ ID NO: 417419 - protein, 9 aa, Homo Sapiens
KISVDFHVD

SEQ ID NO: 417420 - protein, 9 aa, Homo Sapiens
ALFYALEKD

SEQ ID NO: 417421 - protein, 9 aa, Homo Sapiens
KCIHITGMS

SEQ ID NO: 417422 - protein, 9 aa, Homo Sapiens
PQPTEARGR

SEQ ID NO: 417423 - protein, 9 aa, Homo Sapiens
KKFIILERG

SEQ ID NO: 417424 - protein, 9 aa, Homo Sapiens
RSTPVDTPD

SEQ ID NO: 417425 - protein, 9 aa, Homo Sapiens
GVCPARSPR

SEQ ID NO: 417426 - protein, 9 aa, Homo Sapiens
GTNGQVQPI

SEQ ID NO: 417427 - protein, 9 aa, Homo Sapiens
ARTGCPRVN

SEQ ID NO: 417428 - protein, 9 aa, Homo Sapiens
AAAPLQPAF

SEQ ID NO: 417429 - protein, 9 aa, Homo Sapiens
TNSHNSEPW

SEQ ID NO: 417430 - protein, 9 aa, Homo Sapiens
QRFRTEATA

SEQ ID NO: 417431 - protein, 9 aa, Homo Sapiens
NPQLREILD

SEQ ID NO: 417432 - protein, 9 aa, Homo Sapiens
VCKDYKYVQ

SEQ ID NO: 417433 - protein, 9 aa, Homo Sapiens
LQQHLLVWP

SEQ ID NO: 417434 - protein, 9 aa, Homo Sapiens
YTYSMVVAP

SEQ ID NO: 417435 - protein, 9 aa, Homo Sapiens
KKRERMMLP

SEQ ID NO: 417436 - protein, 9 aa, Homo Sapiens
GEDPPQTSL

SEQ ID NO: 417437 - protein, 9 aa, Homo Sapiens
QVASKDLLI

SEQ ID NO: 417438 - protein, 9 aa, Homo Sapiens
LQKDRHREC

SEQ ID NO: 417439 - protein, 9 aa, Homo Sapiens
VTFIITNGV

SEQ ID NO: 417440 - protein, 9 aa, Homo Sapiens
TILRPRFRW

SEQ ID NO: 417441 - protein, 9 aa, Homo Sapiens
LLAASSHVP

SEQ ID NO: 417442 - protein, 9 aa, Homo Sapiens
HLELGFKHN

SEQ ID NO: 417443 - protein, 9 aa, Homo Sapiens
ACTANMPAS

SEQ ID NO: 417444 - protein, 9 aa, Homo Sapiens
QNGLDVTQR

SEQ ID NO: 417445 - protein, 9 aa, Homo Sapiens
RKDAGCAKD

SEQ ID NO: 417446 - protein, 9 aa, Homo Sapiens
QQFKDFQQR

SEQ ID NO: 417447 - protein, 9 aa, Homo Sapiens
LLPGRARDL

SEQ ID NO: 417448 - protein, 9 aa, Homo Sapiens
YYRIYSLVR

SEQ ID NO: 417449 - protein, 9 aa, Homo Sapiens
LLSLTFHPN

SEQ ID NO: 417450 - protein, 9 aa, Homo Sapiens
GPAAPPGGP

SEQ ID NO: 417451 - protein, 9 aa, Homo Sapiens
SMAGTKPCM

SEQ ID NO: 417452 - protein, 9 aa, Homo Sapiens
EPDISLVAL

SEQ ID NO: 417453 - protein, 9 aa, Homo Sapiens
TAATQDFFT

SEQ ID NO: 417454 - protein, 9 aa, Homo Sapiens
WVYYESCNH

SEQ ID NO: 417455 - protein, 9 aa, Homo Sapiens
KTRYDMSLG

SEQ ID NO: 417456 - protein, 9 aa, Homo Sapiens
GNGSNSFRK

SEQ ID NO: 417457 - protein, 9 aa, Homo Sapiens
GSRQSRSPS

SEQ ID NO: 417458 - protein, 9 aa, Homo Sapiens
LEHYEQMEY

SEQ ID NO: 417459 - protein, 9 aa, Homo Sapiens
HCHLSCPEG

SEQ ID NO: 417460 - protein, 9 aa, Homo Sapiens
RPTGPAPLR

SEQ ID NO: 417461 - protein, 9 aa, Homo Sapiens
VSSVHSLSS

SEQ ID NO: 417462 - protein, 9 aa, Homo Sapiens
AILQLLAAS

SEQ ID NO: 417463 - protein, 9 aa, Homo Sapiens
PMVLVASQY

SEQ ID NO: 417464 - protein, 9 aa, Homo Sapiens
PKSGELRVP

SEQ ID NO: 417465 - protein, 9 aa, Homo Sapiens
GLHLHRQIS

SEQ ID NO: 417466 - protein, 9 aa, Homo Sapiens
NRRTDVSDP

SEQ ID NO: 417467 - protein, 9 aa, Homo Sapiens
QGCCCTPGP

SEQ ID NO: 417468 - protein, 9 aa, Homo Sapiens
EIRSLEPGS

SEQ ID NO: 417469 - protein, 9 aa, Homo Sapiens
YRIYSLVRT

SEQ ID NO: 417470 - protein, 9 aa, Homo Sapiens
RRWRMSTWP

SEQ ID NO: 417471 - protein, 9 aa, Homo Sapiens
ERGEDPPQT

SEQ ID NO: 417472 - protein, 9 aa, Homo Sapiens
TVSWAATPK

SEQ ID NO: 417473 - protein, 9 aa, Homo Sapiens
AICLICGDH

SEQ ID NO: 417474 - protein, 9 aa, Homo Sapiens
QAIWQLCAL

SEQ ID NO: 417475 - protein, 9 aa, Homo Sapiens
TFHPNYKKN

SEQ ID NO: 417476 - protein, 9 aa, Homo Sapiens
AQQNGLDVT

SEQ ID NO: 417477 - protein, 9 aa, Homo Sapiens
QDCARPSPS

SEQ ID NO: 417478 - protein, 9 aa, Homo Sapiens
MRTVVLTPT

SEQ ID NO: 417479 - protein, 9 aa, Homo Sapiens
CFFIFFIFG

SEQ ID NO: 417480 - protein, 9 aa, Homo Sapiens
RYEELEIND

SEQ ID NO: 417481 - protein, 9 aa, Homo Sapiens
NGIWEVMPR

SEQ ID NO: 417482 - protein, 9 aa, Homo Sapiens
DDKLYFFRE

SEQ ID NO: 417483 - protein, 9 aa, Homo Sapiens
HSPCSVWGG

SEQ ID NO: 417484 - protein, 9 aa, Homo Sapiens
SSGSGEPTP

SEQ ID NO: 417485 - protein, 9 aa, Homo Sapiens
QACPPTCLA

SEQ ID NO: 417486 - protein, 9 aa, Homo Sapiens
NYLLKWHWK

SEQ ID NO: 417487 - protein, 9 aa, Homo Sapiens
LETRRPIFE

SEQ ID NO: 417488 - protein, 9 aa, Homo Sapiens
VYRDACGRA

SEQ ID NO: 417489 - protein, 9 aa, Homo Sapiens
HTVIVSPVF

SEQ ID NO: 417490 - protein, 9 aa, Homo Sapiens
VPLHQVIVR

SEQ ID NO: 417491 - protein, 9 aa, Homo Sapiens
VEPPPKGCV

SEQ ID NO: 417492 - protein, 9 aa, Homo Sapiens
SDIGASKNS

SEQ ID NO: 417493 - protein, 9 aa, Homo Sapiens
VQHLRNIRV

SEQ ID NO: 417494 - protein, 9 aa, Homo Sapiens
YGDMLQIRI

SEQ ID NO: 417495 - protein, 9 aa, Homo Sapiens
RAASAVGVT

SEQ ID NO: 417496 - protein, 9 aa, Homo Sapiens
LHLFPLTHC

SEQ ID NO: 417497 - protein, 9 aa, Homo Sapiens
PQTSLQLLI

SEQ ID NO: 417498 - protein, 9 aa, Homo Sapiens
SLSSCGWAP

SEQ ID NO: 417499 - protein, 9 aa, Homo Sapiens
VLVDDASTE

SEQ ID NO: 417500 - protein, 9 aa, Homo Sapiens
ATPRGRPAA

SEQ ID NO: 417501 - protein, 9 aa, Homo Sapiens
PTRTHGTLG

SEQ ID NO: 417502 - protein, 9 aa, Homo Sapiens
MGMRTSQYT

SEQ ID NO: 417503 - protein, 9 aa, Homo Sapiens
ALNAYKSKL

SEQ ID NO: 417504 - protein, 9 aa, Homo Sapiens
TACEKESEC

SEQ ID NO: 417505 - protein, 9 aa, Homo Sapiens
VQLLVQLND

SEQ ID NO: 417506 - protein, 9 aa, Homo Sapiens
RSRAQDDGR

SEQ ID NO: 417507 - protein, 9 aa, Homo Sapiens
RGALPSTMR

SEQ ID NO: 417508 - protein, 9 aa, Homo Sapiens
WSESAWRRR

SEQ ID NO: 417509 - protein, 9 aa, Homo Sapiens
QQGVQRLLL

SEQ ID NO: 417510 - protein, 9 aa, Homo Sapiens
SSADEKRYQ

SEQ ID NO: 417511 - protein, 9 aa, Homo Sapiens
QVTSESQDE

SEQ ID NO: 417512 - protein, 9 aa, Homo Sapiens
SPVMLLSPT

SEQ ID NO: 417513 - protein, 9 aa, Homo Sapiens
VWSHPSDHL

SEQ ID NO: 417514 - protein, 9 aa, Homo Sapiens
TPYWMVPEV

SEQ ID NO: 417515 - protein, 9 aa, Homo Sapiens
IAVRQVDLG

SEQ ID NO: 417516 - protein, 9 aa, Homo Sapiens
IPCTSRPGQ

SEQ ID NO: 417517 - protein, 9 aa, Homo Sapiens
HDDTRVHTD

SEQ ID NO: 417518 - protein, 9 aa, Homo Sapiens
ILLKEMKLI

SEQ ID NO: 417519 - protein, 9 aa, Homo Sapiens
LMVIRLRGM

SEQ ID NO: 417520 - protein, 9 aa, Homo Sapiens
LLWRQNGGS

SEQ ID NO: 417521 - protein, 9 aa, Homo Sapiens
FAICGLHYD

SEQ ID NO: 417522 - protein, 9 aa, Homo Sapiens
QEGPGPDDA

SEQ ID NO: 417523 - protein, 9 aa, Homo Sapiens
ATPYSATGA

SEQ ID NO: 417524 - protein, 9 aa, Homo Sapiens
GGHDTPASN

SEQ ID NO: 417525 - protein, 9 aa, Homo Sapiens
QHIQELEWA

SEQ ID NO: 417526 - protein, 9 aa, Homo Sapiens
NEAPQCPSC

SEQ ID NO: 417527 - protein, 9 aa, Homo Sapiens
LHLHRQISL

SEQ ID NO: 417528 - protein, 9 aa, Homo Sapiens
NEEAIRKKA

SEQ ID NO: 417529 - protein, 9 aa, Homo Sapiens
IVGQIVRRY

SEQ ID NO: 417530 - protein, 9 aa, Homo Sapiens
PCVRTWPHS

SEQ ID NO: 417531 - protein, 9 aa, Homo Sapiens
PYYRGLTIN

SEQ ID NO: 417532 - protein, 9 aa, Homo Sapiens
PPKIVHGHY

SEQ ID NO: 417533 - protein, 9 aa, Homo Sapiens
PGAPNPDRF

SEQ ID NO: 417534 - protein, 9 aa, Homo Sapiens
KAFSSEQWS

SEQ ID NO: 417535 - protein, 9 aa, Homo Sapiens
MRCYIAMCR

SEQ ID NO: 417536 - protein, 9 aa, Homo Sapiens
GHSPCSVWG

SEQ ID NO: 417537 - protein, 9 aa, Homo Sapiens
SPYCLLASR

SEQ ID NO: 417538 - protein, 9 aa, Homo Sapiens
QAPEPPTQV

SEQ ID NO: 417539 - protein, 9 aa, Homo Sapiens
NYYTRWMQK

SEQ ID NO: 417540 - protein, 9 aa, Homo Sapiens
GTPGCPRAR

SEQ ID NO: 417541 - protein, 9 aa, Homo Sapiens
VGLAPGELQ

SEQ ID NO: 417542 - protein, 9 aa, Homo Sapiens
QNPRKKHKR

SEQ ID NO: 417543 - protein, 9 aa, Homo Sapiens
ERVVAALLI

SEQ ID NO: 417544 - protein, 9 aa, Homo Sapiens
TWGRAPRTE

SEQ ID NO: 417545 - protein, 9 aa, Homo Sapiens
DMLLSYPSE

SEQ ID NO: 417546 - protein, 9 aa, Homo Sapiens
SSWPMHPLV

SEQ ID NO: 417547 - protein, 9 aa, Homo Sapiens
LQCHLAKLG

SEQ ID NO: 417548 - protein, 9 aa, Homo Sapiens
PDTGENGLR

SEQ ID NO: 417549 - protein, 9 aa, Homo Sapiens
ETDDDDSHC

SEQ ID NO: 417550 - protein, 9 aa, Homo Sapiens
STSMGFFFR

SEQ ID NO: 417551 - protein, 9 aa, Homo Sapiens
HPEEHNLYQ

SEQ ID NO: 417552 - protein, 9 aa, Homo Sapiens
GVLTWRFCR

SEQ ID NO: 417553 - protein, 9 aa, Homo Sapiens
GHLLDDGCV

SEQ ID NO: 417554 - protein, 9 aa, Homo Sapiens
LISVLHILG

SEQ ID NO: 417555 - protein, 9 aa, Homo Sapiens
GPSRAHCPA

SEQ ID NO: 417556 - protein, 9 aa, Homo Sapiens
LYQCGRDQR

SEQ ID NO: 417557 - protein, 9 aa, Homo Sapiens
PAARPPQPP

SEQ ID NO: 417558 - protein, 9 aa, Homo Sapiens
KQSGKKCGF

SEQ ID NO: 417559 - protein, 9 aa, Homo Sapiens
HFYNNRYAG

SEQ ID NO: 417560 - protein, 9 aa, Homo Sapiens
VAAGPPMRE

SEQ ID NO: 417561 - protein, 9 aa, Homo Sapiens
CPANGAGWP

SEQ ID NO: 417562 - protein, 9 aa, Homo Sapiens
QPGAAGGGN

SEQ ID NO: 417563 - protein, 9 aa, Homo Sapiens
HPRKPGVVV

SEQ ID NO: 417564 - protein, 9 aa, Homo Sapiens
THLWSRVGP

SEQ ID NO: 417565 - protein, 9 aa, Homo Sapiens
PPPAPATQA

SEQ ID NO: 417566 - protein, 9 aa, Homo Sapiens
GAPVPSNLQ

SEQ ID NO: 417567 - protein, 9 aa, Homo Sapiens
EKPYKCKQR

SEQ ID NO: 417568 - protein, 9 aa, Homo Sapiens
SHLEKNSYS

SEQ ID NO: 417569 - protein, 9 aa, Homo Sapiens
YCLVNITLG

SEQ ID NO: 417570 - protein, 9 aa, Homo Sapiens
AKATVATQQ

SEQ ID NO: 417571 - protein, 9 aa, Homo Sapiens
GVDAARLPL

SEQ ID NO: 417572 - protein, 9 aa, Homo Sapiens
DVTVYDGSW

SEQ ID NO: 417573 - protein, 9 aa, Homo Sapiens
SQGCREGRM

SEQ ID NO: 417574 - protein, 9 aa, Homo Sapiens
HLPQPPQHQ

SEQ ID NO: 417575 - protein, 9 aa, Homo Sapiens
ACTCISMTT

SEQ ID NO: 417576 - protein, 9 aa, Homo Sapiens
VAFLQGLQD

SEQ ID NO: 417577 - protein, 9 aa, Homo Sapiens
HAQQNGLDV

SEQ ID NO: 417578 - protein, 9 aa, Homo Sapiens
LPHCSSPSC

SEQ ID NO: 417579 - protein, 9 aa, Homo Sapiens
DEERVHHLV

SEQ ID NO: 417580 - protein, 9 aa, Homo Sapiens
HVTTVRTAG

SEQ ID NO: 417581 - protein, 9 aa, Homo Sapiens
HTPHKIIHT

SEQ ID NO: 417582 - protein, 9 aa, Homo Sapiens
QRQIKWDPQ

SEQ ID NO: 417583 - protein, 9 aa, Homo Sapiens
TSSLNSPDK

SEQ ID NO: 417584 - protein, 9 aa, Homo Sapiens
SLVWIFFFF

SEQ ID NO: 417585 - protein, 9 aa, Homo Sapiens
SSNHTPHKI

SEQ ID NO: 417586 - protein, 9 aa, Homo Sapiens
MSKTLQDFL

SEQ ID NO: 417587 - protein, 9 aa, Homo Sapiens
STKLSRVTF

SEQ ID NO: 417588 - protein, 9 aa, Homo Sapiens
PVHAARRLG

SEQ ID NO: 417589 - protein, 9 aa, Homo Sapiens
RGHTRWPAA

SEQ ID NO: 417590 - protein, 9 aa, Homo Sapiens
RAVSGNEVN

SEQ ID NO: 417591 - protein, 9 aa, Homo Sapiens
TTLRPPAQI

SEQ ID NO: 417592 - protein, 9 aa, Homo Sapiens
HQACPPTCL

SEQ ID NO: 417593 - protein, 9 aa, Homo Sapiens
TEIPAEFPH

SEQ ID NO: 417594 - protein, 9 aa, Homo Sapiens
YCCSACHSD

SEQ ID NO: 417595 - protein, 9 aa, Homo Sapiens
FPEIVTPLL

SEQ ID NO: 417596 - protein, 9 aa, Homo Sapiens
WRDTVEVAL

SEQ ID NO: 417597 - protein, 9 aa, Homo Sapiens
RIAAVASCF

SEQ ID NO: 417598 - protein, 9 aa, Homo Sapiens
QDFLYAQQV

SEQ ID NO: 417599 - protein, 9 aa, Homo Sapiens
VNRANSGQV

SEQ ID NO: 417600 - protein, 9 aa, Homo Sapiens
HMRHLAIWL

SEQ ID NO: 417601 - protein, 9 aa, Homo Sapiens
RGEWLGGGA

SEQ ID NO: 417602 - protein, 9 aa, Homo Sapiens
GWPCPAVPL

SEQ ID NO: 417603 - protein, 9 aa, Homo Sapiens
MPIFLLLDK

SEQ ID NO: 417604 - protein, 9 aa, Homo Sapiens
FVLVNLEVT

SEQ ID NO: 417605 - protein, 9 aa, Homo Sapiens
GWRSASQPR

SEQ ID NO: 417606 - protein, 9 aa, Homo Sapiens
CCSGNDGRT

SEQ ID NO: 417607 - protein, 9 aa, Homo Sapiens
AYVLANTSV

SEQ ID NO: 417608 - protein, 9 aa, Homo Sapiens
PSFAICGLH

SEQ ID NO: 417609 - protein, 9 aa, Homo Sapiens
ADLGAYLNL

SEQ ID NO: 417610 - protein, 9 aa, Homo Sapiens
RGQAPEDLE

SEQ ID NO: 417611 - protein, 9 aa, Homo Sapiens
KKIVHSIIS

SEQ ID NO: 417612 - protein, 9 aa, Homo Sapiens
PFLYGLPQR

SEQ ID NO: 417613 - protein, 9 aa, Homo Sapiens
PSWARSFVR

SEQ ID NO: 417614 - protein, 9 aa, Homo Sapiens
QQQTMAVKF

SEQ ID NO: 417615 - protein, 9 aa, Homo Sapiens
NLAENMSSK

SEQ ID NO: 417616 - protein, 9 aa, Homo Sapiens
CLMDSAWSL

SEQ ID NO: 417617 - protein, 9 aa, Homo Sapiens
ARMLQEQQK

SEQ ID NO: 417618 - protein, 9 aa, Homo Sapiens
VVNTYQKMP

SEQ ID NO: 417619 - protein, 9 aa, Homo Sapiens
MPQVVYCIH

SEQ ID NO: 417620 - protein, 9 aa, Homo Sapiens
VPKDTPSSA

SEQ ID NO: 417621 - protein, 9 aa, Homo Sapiens
KKAVIFVSV

SEQ ID NO: 417622 - protein, 9 aa, Homo Sapiens
HVRKVNHFH

SEQ ID NO: 417623 - protein, 9 aa, Homo Sapiens
TSSRKIRRP

SEQ ID NO: 417624 - protein, 9 aa, Homo Sapiens
AAGPPMREV

SEQ ID NO: 417625 - protein, 9 aa, Homo Sapiens
LPVAGGAAE

SEQ ID NO: 417626 - protein, 9 aa, Homo Sapiens
ADYGAFGTD

SEQ ID NO: 417627 - protein, 9 aa, Homo Sapiens
YGLGGLRSA

SEQ ID NO: 417628 - protein, 9 aa, Homo Sapiens
HQAPQVAML

SEQ ID NO: 417629 - protein, 9 aa, Homo Sapiens
ASKVPGGSR

SEQ ID NO: 417630 - protein, 9 aa, Homo Sapiens
YDLLIAAME

SEQ ID NO: 417631 - protein, 9 aa, Homo Sapiens
GGHPIVKLL

SEQ ID NO: 417632 - protein, 9 aa, Homo Sapiens
SNFLRKFPL

SEQ ID NO: 417633 - protein, 9 aa, Homo Sapiens
TIAHYDPAT

SEQ ID NO: 417634 - protein, 9 aa, Homo Sapiens
SFQAISSMV

SEQ ID NO: 417635 - protein, 9 aa, Homo Sapiens
QTQLQDNKD

SEQ ID NO: 417636 - protein, 9 aa, Homo Sapiens
HQNLGTPGL

SEQ ID NO: 417637 - protein, 9 aa, Homo Sapiens
KPEWKHQVM

SEQ ID NO: 417638 - protein, 9 aa, Homo Sapiens
RRPATGVCP

SEQ ID NO: 417639 - protein, 9 aa, Homo Sapiens
ATVPGHKSV

SEQ ID NO: 417640 - protein, 9 aa, Homo Sapiens
GALTASGAD

SEQ ID NO: 417641 - protein, 9 aa, Homo Sapiens
VATYSDCCL

SEQ ID NO: 417642 - protein, 9 aa, Homo Sapiens
IKSILIHDR

SEQ ID NO: 417643 - protein, 9 aa, Homo Sapiens
GPACPISTT

SEQ ID NO: 417644 - protein, 9 aa, Homo Sapiens
ALGTTSHHM

SEQ ID NO: 417645 - protein, 9 aa, Homo Sapiens
PIHIGCTQT

SEQ ID NO: 417646 - protein, 9 aa, Homo Sapiens
RFQRDNEVN

SEQ ID NO: 417647 - protein, 9 aa, Homo Sapiens
PEAAAASTR

SEQ ID NO: 417648 - protein, 9 aa, Homo Sapiens
YPRGKQVIE

SEQ ID NO: 417649 - protein, 9 aa, Homo Sapiens
CKMKRARAE

SEQ ID NO: 417650 - protein, 9 aa, Homo Sapiens
PLLRDQDLC

SEQ ID NO: 417651 - protein, 9 aa, Homo Sapiens
NIAVKEKSQ

SEQ ID NO: 417652 - protein, 9 aa, Homo Sapiens
AGAGLEAEA

SEQ ID NO: 417653 - protein, 9 aa, Homo Sapiens
RLKRGQPWV

SEQ ID NO: 417654 - protein, 9 aa, Homo Sapiens
VKFLVIGKI

SEQ ID NO: 417655 - protein, 9 aa, Homo Sapiens
HGQSSAQDI

SEQ ID NO: 417656 - protein, 9 aa, Homo Sapiens
TSLVKVELD

SEQ ID NO: 417657 - protein, 9 aa, Homo Sapiens
RTQQRPPWR

SEQ ID NO: 417658 - protein, 9 aa, Homo Sapiens
PVQLLQPQV

SEQ ID NO: 417659 - protein, 9 aa, Homo Sapiens
AVSGGGGVN

SEQ ID NO: 417660 - protein, 9 aa, Homo Sapiens
LKVKQGLRT

SEQ ID NO: 417661 - protein, 9 aa, Homo Sapiens
FRWEVEKTA

SEQ ID NO: 417662 - protein, 9 aa, Homo Sapiens
EIVQQMMEM

SEQ ID NO: 417663 - protein, 9 aa, Homo Sapiens
TRSSGWMPG

SEQ ID NO: 417664 - protein, 9 aa, Homo Sapiens
LFISLFWEK

SEQ ID NO: 417665 - protein, 9 aa, Homo Sapiens
LNPDWCLKV

SEQ ID NO: 417666 - protein, 9 aa, Homo Sapiens
FSNNGHLSQ

SEQ ID NO: 417667 - protein, 9 aa, Homo Sapiens
RVCTGMARS

SEQ ID NO: 417668 - protein, 9 aa, Homo Sapiens
SVASVTRRC

SEQ ID NO: 417669 - protein, 9 aa, Homo Sapiens
PCLDCVAKL

SEQ ID NO: 417670 - protein, 9 aa, Homo Sapiens
RVPRCLGPH

SEQ ID NO: 417671 - protein, 9 aa, Homo Sapiens
PPAPATQAP

SEQ ID NO: 417672 - protein, 9 aa, Homo Sapiens
AQAIQNPQA

SEQ ID NO: 417673 - protein, 9 aa, Homo Sapiens
PEGKLGITE

SEQ ID NO: 417674 - protein, 9 aa, Homo Sapiens
DLGGVGLLG

SEQ ID NO: 417675 - protein, 9 aa, Homo Sapiens
ALCVACCLL

SEQ ID NO: 417676 - protein, 9 aa, Homo Sapiens
RARAGVCCE

SEQ ID NO: 417677 - protein, 9 aa, Homo Sapiens
KNSPTTATS

SEQ ID NO: 417678 - protein, 9 aa, Homo Sapiens
PTPSPSVNG

SEQ ID NO: 417679 - protein, 9 aa, Homo Sapiens
CTRLARGSG

SEQ ID NO: 417680 - protein, 9 aa, Homo Sapiens
AAQPNGPAA

SEQ ID NO: 417681 - protein, 9 aa, Homo Sapiens
AVSVCRWRG

SEQ ID NO: 417682 - protein, 9 aa, Homo Sapiens
VLVLLSRVR

SEQ ID NO: 417683 - protein, 9 aa, Homo Sapiens
EQLHAAWHD

SEQ ID NO: 417684 - protein, 9 aa, Homo Sapiens
SSHACVQKV

SEQ ID NO: 417685 - protein, 9 aa, Homo Sapiens
MMTSGTWSG

SEQ ID NO: 417686 - protein, 9 aa, Homo Sapiens
TATMIYVGC

SEQ ID NO: 417687 - protein, 9 aa, Homo Sapiens
TQCRQLEAR

SEQ ID NO: 417688 - protein, 9 aa, Homo Sapiens
SAGLSPGAC

SEQ ID NO: 417689 - protein, 9 aa, Homo Sapiens
VLSVNVTDY

SEQ ID NO: 417690 - protein, 9 aa, Homo Sapiens
DKNSFFIMI

SEQ ID NO: 417691 - protein, 9 aa, Homo Sapiens
NNIKPDLIQ

SEQ ID NO: 417692 - protein, 9 aa, Homo Sapiens
RQSWLRPSD

SEQ ID NO: 417693 - protein, 9 aa, Homo Sapiens
CYSDLTKHK

SEQ ID NO: 417694 - protein, 9 aa, Homo Sapiens
FRFFHVLFF

SEQ ID NO: 417695 - protein, 9 aa, Homo Sapiens
SSPQCSRPG

SEQ ID NO: 417696 - protein, 9 aa, Homo Sapiens
HLVKPRVLH

SEQ ID NO: 417697 - protein, 9 aa, Homo Sapiens
FSTGHGRWW

SEQ ID NO: 417698 - protein, 9 aa, Homo Sapiens
CKISVDFHV

SEQ ID NO: 417699 - protein, 9 aa, Homo Sapiens
VDPQGWRDT

SEQ ID NO: 417700 - protein, 9 aa, Homo Sapiens
VRHGLASCT

SEQ ID NO: 417701 - protein, 9 aa, Homo Sapiens
QPLWESRDH

SEQ ID NO: 417702 - protein, 9 aa, Homo Sapiens
LIAAMEGGL

SEQ ID NO: 417703 - protein, 9 aa, Homo Sapiens
DHITSVNEY

SEQ ID NO: 417704 - protein, 9 aa, Homo Sapiens
TLGDLLTGA

SEQ ID NO: 417705 - protein, 9 aa, Homo Sapiens
ATPGGASGR

SEQ ID NO: 417706 - protein, 9 aa, Homo Sapiens
FTDDISDIV

SEQ ID NO: 417707 - protein, 9 aa, Homo Sapiens
KQLLHLTEE

SEQ ID NO: 417708 - protein, 9 aa, Homo Sapiens
QQCLKIQGE

SEQ ID NO: 417709 - protein, 9 aa, Homo Sapiens
ICTTLLVYV

SEQ ID NO: 417710 - protein, 9 aa, Homo Sapiens
FAFFPSTWE

SEQ ID NO: 417711 - protein, 9 aa, Homo Sapiens
VESDTGDHK

SEQ ID NO: 417712 - protein, 9 aa, Homo Sapiens
PAPETRVPV

SEQ ID NO: 417713 - protein, 9 aa, Homo Sapiens
TSKMISRII

SEQ ID NO: 417714 - protein, 9 aa, Homo Sapiens
AGLHGQSSA

SEQ ID NO: 417715 - protein, 9 aa, Homo Sapiens
LQDKGASIS

SEQ ID NO: 417716 - protein, 9 aa, Homo Sapiens
YYTRWMQKW

SEQ ID NO: 417717 - protein, 9 aa, Homo Sapiens
SNEGPSGGP

SEQ ID NO: 417718 - protein, 9 aa, Homo Sapiens
ALDALSQFL

SEQ ID NO: 417719 - protein, 9 aa, Homo Sapiens
ASLSDFKGP

SEQ ID NO: 417720 - protein, 9 aa, Homo Sapiens
PVGAGTGGG

SEQ ID NO: 417721 - protein, 9 aa, Homo Sapiens
IWFQNHRCK

SEQ ID NO: 417722 - protein, 9 aa, Homo Sapiens
RYRLGDRVL

SEQ ID NO: 417723 - protein, 9 aa, Homo Sapiens
VRSRESESF

SEQ ID NO: 417724 - protein, 9 aa, Homo Sapiens
ASCTPLCTP

SEQ ID NO: 417725 - protein, 9 aa, Homo Sapiens
RLHSRQYVS

SEQ ID NO: 417726 - protein, 9 aa, Homo Sapiens
GKQGCCCTP

SEQ ID NO: 417727 - protein, 9 aa, Homo Sapiens
CYHCRVMCR

SEQ ID NO: 417728 - protein, 9 aa, Homo Sapiens
PAPPYTPRM

SEQ ID NO: 417729 - protein, 9 aa, Homo Sapiens
PLVPILQLV

SEQ ID NO: 417730 - protein, 9 aa, Homo Sapiens
IVAGIFIAI

SEQ ID NO: 417731 - protein, 9 aa, Homo Sapiens
FTCNLAENM

SEQ ID NO: 417732 - protein, 9 aa, Homo Sapiens
CKCHAGFQM

SEQ ID NO: 417733 - protein, 9 aa, Homo Sapiens
FCILLIMVM

SEQ ID NO: 417734 - protein, 9 aa, Homo Sapiens
SCLSRPGWA

SEQ ID NO: 417735 - protein, 9 aa, Homo Sapiens
IEMKGRKKI

SEQ ID NO: 417736 - protein, 9 aa, Homo Sapiens
DFLPSHSTL

SEQ ID NO: 417737 - protein, 9 aa, Homo Sapiens
CTPLCTPGV

SEQ ID NO: 417738 - protein, 9 aa, Homo Sapiens
RGEEQEQSK

SEQ ID NO: 417739 - protein, 9 aa, Homo Sapiens
PQLFYFFFI

SEQ ID NO: 417740 - protein, 9 aa, Homo Sapiens
NTSLAALFM

SEQ ID NO: 417741 - protein, 9 aa, Homo Sapiens
AAAASTRTH

SEQ ID NO: 417742 - protein, 9 aa, Homo Sapiens
CSMAVCQIF

SEQ ID NO: 417743 - protein, 9 aa, Homo Sapiens
EKMILKMMM

SEQ ID NO: 417744 - protein, 9 aa, Homo Sapiens
TVETMQSTL

SEQ ID NO: 417745 - protein, 9 aa, Homo Sapiens
HSSGGYEPR

SEQ ID NO: 417746 - protein, 9 aa, Homo Sapiens
VVGGHDTPA

SEQ ID NO: 417747 - protein, 9 aa, Homo Sapiens
FTIICTISI

SEQ ID NO: 417748 - protein, 9 aa, Homo Sapiens
TQTQTRTRM

SEQ ID NO: 417749 - protein, 9 aa, Homo Sapiens
LKKLQNWNF

SEQ ID NO: 417750 - protein, 9 aa, Homo Sapiens
SLHGAHWTL

SEQ ID NO: 417751 - protein, 9 aa, Homo Sapiens
SRFLNLERV

SEQ ID NO: 417752 - protein, 9 aa, Homo Sapiens
QSPSPAHIV

SEQ ID NO: 417753 - protein, 9 aa, Homo Sapiens
IQEKSTMES

SEQ ID NO: 417754 - protein, 9 aa, Homo Sapiens
MCPRDYWYL

SEQ ID NO: 417755 - protein, 9 aa, Homo Sapiens
GDRILPSGC

SEQ ID NO: 417756 - protein, 9 aa, Homo Sapiens
KQLLALESQ

SEQ ID NO: 417757 - protein, 9 aa, Homo Sapiens
HLLRLWMFL

SEQ ID NO: 417758 - protein, 9 aa, Homo Sapiens
TPPPACTSK

SEQ ID NO: 417759 - protein, 9 aa, Homo Sapiens
ETAVSVCRW

SEQ ID NO: 417760 - protein, 9 aa, Homo Sapiens
GVRPGPCEG

SEQ ID NO: 417761 - protein, 9 aa, Homo Sapiens
AGFRFFHVL

SEQ ID NO: 417762 - protein, 9 aa, Homo Sapiens
RDIPEKKKT

SEQ ID NO: 417763 - protein, 9 aa, Homo Sapiens
HPGSREWAI

SEQ ID NO: 417764 - protein, 9 aa, Homo Sapiens
RVTKCVELG

SEQ ID NO: 417765 - protein, 9 aa, Homo Sapiens
RAQASGTLI

SEQ ID NO: 417766 - protein, 9 aa, Homo Sapiens
ILPMLPQQL

SEQ ID NO: 417767 - protein, 9 aa, Homo Sapiens
LTEEKQTKS

SEQ ID NO: 417768 - protein, 9 aa, Homo Sapiens
LLTDQAPEP

SEQ ID NO: 417769 - protein, 9 aa, Homo Sapiens
KSVSQKVVA

SEQ ID NO: 417770 - protein, 9 aa, Homo Sapiens
VVNIIQVIE

SEQ ID NO: 417771 - protein, 9 aa, Homo Sapiens
GSPYSPLRE

SEQ ID NO: 417772 - protein, 9 aa, Homo Sapiens
PRSLTLIQS

SEQ ID NO: 417773 - protein, 9 aa, Homo Sapiens
RVLMGNAIA

SEQ ID NO: 417774 - protein, 9 aa, Homo Sapiens
TLVNTTQRP

SEQ ID NO: 417775 - protein, 9 aa, Homo Sapiens
PGSWSMRRT

SEQ ID NO: 417776 - protein, 9 aa, Homo Sapiens
SLHVSAAGA

SEQ ID NO: 417777 - protein, 9 aa, Homo Sapiens
GGGYNHSSG

SEQ ID NO: 417778 - protein, 9 aa, Homo Sapiens
IAHFFRISL

SEQ ID NO: 417779 - protein, 9 aa, Homo Sapiens
EWENVELRG

SEQ ID NO: 417780 - protein, 9 aa, Homo Sapiens
AHLIAVTLY

SEQ ID NO: 417781 - protein, 9 aa, Homo Sapiens
TVKKIATMM

SEQ ID NO: 417782 - protein, 9 aa, Homo Sapiens
EKGQQILMK

SEQ ID NO: 417783 - protein, 9 aa, Homo Sapiens
GGSRPMPMP

SEQ ID NO: 417784 - protein, 9 aa, Homo Sapiens
WMLIDFYDN

SEQ ID NO: 417785 - protein, 9 aa, Homo Sapiens
NGDYKGTMP

SEQ ID NO: 417786 - protein, 9 aa, Homo Sapiens
EIKKSQRHP

SEQ ID NO: 417787 - protein, 9 aa, Homo Sapiens
YLDQLNALH

SEQ ID NO: 417788 - protein, 9 aa, Homo Sapiens
YLLAFKKSK

SEQ ID NO: 417789 - protein, 9 aa, Homo Sapiens
GTLGTIHWS

SEQ ID NO: 417790 - protein, 9 aa, Homo Sapiens
SRWCQPRSP

SEQ ID NO: 417791 - protein, 9 aa, Homo Sapiens
LGTFGFNTT

SEQ ID NO: 417792 - protein, 9 aa, Homo Sapiens
AQHLARHQL

SEQ ID NO: 417793 - protein, 9 aa, Homo Sapiens
KLDNSQDLN

SEQ ID NO: 417794 - protein, 9 aa, Homo Sapiens
QERLECMDS

SEQ ID NO: 417795 - protein, 9 aa, Homo Sapiens
RYYDRIIDQ

SEQ ID NO: 417796 - protein, 9 aa, Homo Sapiens
ALRARGGTT

SEQ ID NO: 417797 - protein, 9 aa, Homo Sapiens
PRALPSLLS

SEQ ID NO: 417798 - protein, 9 aa, Homo Sapiens
DGGKLPGSE

SEQ ID NO: 417799 - protein, 9 aa, Homo Sapiens
TRLYAARQA

SEQ ID NO: 417800 - protein, 9 aa, Homo Sapiens
LPGETHSQQ

SEQ ID NO: 417801 - protein, 9 aa, Homo Sapiens
DSPSILSTC

SEQ ID NO: 417802 - protein, 9 aa, Homo Sapiens
IATMLVLAV

SEQ ID NO: 417803 - protein, 9 aa, Homo Sapiens
LLKHFLVLN

SEQ ID NO: 417804 - protein, 9 aa, Homo Sapiens
ASIMCPLNP

SEQ ID NO: 417805 - protein, 9 aa, Homo Sapiens
TIKLTFEDF

SEQ ID NO: 417806 - protein, 9 aa, Homo Sapiens
PHSTHGIFE

SEQ ID NO: 417807 - protein, 9 aa, Homo Sapiens
TKKAAAGST

SEQ ID NO: 417808 - protein, 9 aa, Homo Sapiens
GAAVDPDML

SEQ ID NO: 417809 - protein, 9 aa, Homo Sapiens
LAKVTENLH

SEQ ID NO: 417810 - protein, 9 aa, Homo Sapiens
VLKKFPEEN

SEQ ID NO: 417811 - protein, 9 aa, Homo Sapiens
LGGLWEPRE

SEQ ID NO: 417812 - protein, 9 aa, Homo Sapiens
SGPVPPDWE

SEQ ID NO: 417813 - protein, 9 aa, Homo Sapiens
TCDLFDELV

SEQ ID NO: 417814 - protein, 9 aa, Homo Sapiens
GRKNVLFMT

SEQ ID NO: 417815 - protein, 9 aa, Homo Sapiens
PWAIAVLEY

SEQ ID NO: 417816 - protein, 9 aa, Homo Sapiens
REAISWLKD

SEQ ID NO: 417817 - protein, 9 aa, Homo Sapiens
HFQQVESRW

SEQ ID NO: 417818 - protein, 9 aa, Homo Sapiens
QVRRAHEGL

SEQ ID NO: 417819 - protein, 9 aa, Homo Sapiens
RMMLPVRAR

SEQ ID NO: 417820 - protein, 9 aa, Homo Sapiens
LGPVKMSDE

SEQ ID NO: 417821 - protein, 9 aa, Homo Sapiens
QQSLPFAAS

SEQ ID NO: 417822 - protein, 9 aa, Homo Sapiens
AWSGPSATC

SEQ ID NO: 417823 - protein, 9 aa, Homo Sapiens
ARGRRGLVA

SEQ ID NO: 417824 - protein, 9 aa, Homo Sapiens
RGDVPQTVK

SEQ ID NO: 417825 - protein, 9 aa, Homo Sapiens
RTKSVTKSV

SEQ ID NO: 417826 - protein, 9 aa, Homo Sapiens
PRGTDPRPP

SEQ ID NO: 417827 - protein, 9 aa, Homo Sapiens
PVQQWPGPG

SEQ ID NO: 417828 - protein, 9 aa, Homo Sapiens
LGYMDDQLF

SEQ ID NO: 417829 - protein, 9 aa, Homo Sapiens
DSEYVKLVK

SEQ ID NO: 417830 - protein, 9 aa, Homo Sapiens
YLSIVRTAR

SEQ ID NO: 417831 - protein, 9 aa, Homo Sapiens
GDHKQIYNI

SEQ ID NO: 417832 - protein, 9 aa, Homo Sapiens
FEVLMTQQP

SEQ ID NO: 417833 - protein, 9 aa, Homo Sapiens
WPCPAVPLG

SEQ ID NO: 417834 - protein, 9 aa, Homo Sapiens
PDRKTTSFS

SEQ ID NO: 417835 - protein, 9 aa, Homo Sapiens
ALKKASSPG

SEQ ID NO: 417836 - protein, 9 aa, Homo Sapiens
LQGSLHVSA

SEQ ID NO: 417837 - protein, 9 aa, Homo Sapiens
TNFLKKLKG

SEQ ID NO: 417838 - protein, 9 aa, Homo Sapiens
DTMGRVDEE

SEQ ID NO: 417839 - protein, 9 aa, Homo Sapiens
DFRIGDRED

SEQ ID NO: 417840 - protein, 9 aa, Homo Sapiens
SQCKGLNYR

SEQ ID NO: 417841 - protein, 9 aa, Homo Sapiens
GPAQTPRNT

SEQ ID NO: 417842 - protein, 9 aa, Homo Sapiens
PEDMMLEEN

SEQ ID NO: 417843 - protein, 9 aa, Homo Sapiens
GHKSVRVCR

SEQ ID NO: 417844 - protein, 9 aa, Homo Sapiens
TNKRAVDFQ

SEQ ID NO: 417845 - protein, 9 aa, Homo Sapiens
ALLPSATLS

SEQ ID NO: 417846 - protein, 9 aa, Homo Sapiens
LPLPPRVGL

SEQ ID NO: 417847 - protein, 9 aa, Homo Sapiens
CQPGCYGCC

SEQ ID NO: 417848 - protein, 9 aa, Homo Sapiens
TLGSWPGQF

SEQ ID NO: 417849 - protein, 9 aa, Homo Sapiens
TTTTSSPRR

SEQ ID NO: 417850 - protein, 9 aa, Homo Sapiens
DSGFWEIEN

SEQ ID NO: 417851 - protein, 9 aa, Homo Sapiens
LLVSTEGEV

SEQ ID NO: 417852 - protein, 9 aa, Homo Sapiens
CLCSSPGTT

SEQ ID NO: 417853 - protein, 9 aa, Homo Sapiens
RMLPTYICG

SEQ ID NO: 417854 - protein, 9 aa, Homo Sapiens
VSLPTALPS

SEQ ID NO: 417855 - protein, 9 aa, Homo Sapiens
YTPRMTARA

SEQ ID NO: 417856 - protein, 9 aa, Homo Sapiens
YWMVPEVVT

SEQ ID NO: 417857 - protein, 9 aa, Homo Sapiens
GRTAGRLES

SEQ ID NO: 417858 - protein, 9 aa, Homo Sapiens
ALGAREGLI

SEQ ID NO: 417859 - protein, 9 aa, Homo Sapiens
VMKESVWEQ

SEQ ID NO: 417860 - protein, 9 aa, Homo Sapiens
LPSQPAVPW

SEQ ID NO: 417861 - protein, 9 aa, Homo Sapiens
ELRVPEEAA

SEQ ID NO: 417862 - protein, 9 aa, Homo Sapiens
MAQSLSQCN

SEQ ID NO: 417863 - protein, 9 aa, Homo Sapiens
TGCCATRES

SEQ ID NO: 417864 - protein, 9 aa, Homo Sapiens
SGRGSLRKW

SEQ ID NO: 417865 - protein, 9 aa, Homo Sapiens
YFFRMVIQK

SEQ ID NO: 417866 - protein, 9 aa, Homo Sapiens
AKGTLHHHD

SEQ ID NO: 417867 - protein, 9 aa, Homo Sapiens
SPVRNSPCS

SEQ ID NO: 417868 - protein, 9 aa, Homo Sapiens
ECVGTWIND

SEQ ID NO: 417869 - protein, 9 aa, Homo Sapiens
CHQDHPEEH

SEQ ID NO: 417870 - protein, 9 aa, Homo Sapiens
DTPSSARPA

SEQ ID NO: 417871 - protein, 9 aa, Homo Sapiens
RNTRAGPEP

SEQ ID NO: 417872 - protein, 9 aa, Homo Sapiens
CCRCMRAAA

SEQ ID NO: 417873 - protein, 9 aa, Homo Sapiens
QCWELNPQD

SEQ ID NO: 417874 - protein, 9 aa, Homo Sapiens
AWAGFELLQ

SEQ ID NO: 417875 - protein, 9 aa, Homo Sapiens
TSAVPIPGR

SEQ ID NO: 417876 - protein, 9 aa, Homo Sapiens
PRGGGRPGP

SEQ ID NO: 417877 - protein, 9 aa, Homo Sapiens
KPLKDKRAG

SEQ ID NO: 417878 - protein, 9 aa, Homo Sapiens
GHHHPHDQA

SEQ ID NO: 417879 - protein, 9 aa, Homo Sapiens
RGQPWVTDF

SEQ ID NO: 417880 - protein, 9 aa, Homo Sapiens
GAAEGLGAQ

SEQ ID NO: 417881 - protein, 9 aa, Homo Sapiens
SVSVGCVAS

SEQ ID NO: 417882 - protein, 9 aa, Homo Sapiens
GSLPLRSSG

SEQ ID NO: 417883 - protein, 9 aa, Homo Sapiens
TKFAATIRL

SEQ ID NO: 417884 - protein, 9 aa, Homo Sapiens
LVIERERGN

SEQ ID NO: 417885 - protein, 9 aa, Homo Sapiens
MKLMNQNPN

SEQ ID NO: 417886 - protein, 9 aa, Homo Sapiens
FFSRPTMAF

SEQ ID NO: 417887 - protein, 9 aa, Homo Sapiens
QPPRERDLP

SEQ ID NO: 417888 - protein, 9 aa, Homo Sapiens
RTDWDDYVN

SEQ ID NO: 417889 - protein, 9 aa, Homo Sapiens
GGEQRKRRR

SEQ ID NO: 417890 - protein, 9 aa, Homo Sapiens
PAHTTLLLK

SEQ ID NO: 417891 - protein, 9 aa, Homo Sapiens
DFEECRRLF

SEQ ID NO: 417892 - protein, 9 aa, Homo Sapiens
RTLYAASCL

SEQ ID NO: 417893 - protein, 9 aa, Homo Sapiens
VLLPRVSAV

SEQ ID NO: 417894 - protein, 9 aa, Homo Sapiens
HSHLEKNSY

SEQ ID NO: 417895 - protein, 9 aa, Homo Sapiens
PLAPGAQNP

SEQ ID NO: 417896 - protein, 9 aa, Homo Sapiens
ETYVKWLHL

SEQ ID NO: 417897 - protein, 9 aa, Homo Sapiens
AEDGDHGIN

SEQ ID NO: 417898 - protein, 9 aa, Homo Sapiens
EKSASCTPL

SEQ ID NO: 417899 - protein, 9 aa, Homo Sapiens
PAILRPGHL

SEQ ID NO: 417900 - protein, 9 aa, Homo Sapiens
PEDPVLLAF

SEQ ID NO: 417901 - protein, 9 aa, Homo Sapiens
HDNIYEVQP

SEQ ID NO: 417902 - protein, 9 aa, Homo Sapiens
SRRRCIPLA

SEQ ID NO: 417903 - protein, 9 aa, Homo Sapiens
HPHDQATSP

SEQ ID NO: 417904 - protein, 9 aa, Homo Sapiens
MQMDNLESC

SEQ ID NO: 417905 - protein, 9 aa, Homo Sapiens
RLPSQPAVP

SEQ ID NO: 417906 - protein, 9 aa, Homo Sapiens
AMELAVAHR

SEQ ID NO: 417907 - protein, 9 aa, Homo Sapiens
SVEVHPFNQ

SEQ ID NO: 417908 - protein, 9 aa, Homo Sapiens
FSMMCKEDL

SEQ ID NO: 417909 - protein, 9 aa, Homo Sapiens
AGIFIAISL

SEQ ID NO: 417910 - protein, 9 aa, Homo Sapiens
ATPSPWSPS

SEQ ID NO: 417911 - protein, 9 aa, Homo Sapiens
YDMSLGLLT

SEQ ID NO: 417912 - protein, 9 aa, Homo Sapiens
NYPHAIVYP

SEQ ID NO: 417913 - protein, 9 aa, Homo Sapiens
TATWRMRSS

SEQ ID NO: 417914 - protein, 9 aa, Homo Sapiens
EWALCAVST

SEQ ID NO: 417915 - protein, 9 aa, Homo Sapiens
AGPLYGWEQ

SEQ ID NO: 417916 - protein, 9 aa, Homo Sapiens
KQVRDLYHK

SEQ ID NO: 417917 - protein, 9 aa, Homo Sapiens
SPAQVTMMT

SEQ ID NO: 417918 - protein, 9 aa, Homo Sapiens
GITLSEYFC

SEQ ID NO: 417919 - protein, 9 aa, Homo Sapiens
PTTAPRRAG

SEQ ID NO: 417920 - protein, 9 aa, Homo Sapiens
GGGLLVLTG

SEQ ID NO: 417921 - protein, 9 aa, Homo Sapiens
KVLDSGFWE

SEQ ID NO: 417922 - protein, 9 aa, Homo Sapiens
SGFPCPARA

SEQ ID NO: 417923 - protein, 9 aa, Homo Sapiens
LHRVIIISM

SEQ ID NO: 417924 - protein, 9 aa, Homo Sapiens
PLEEEEEDL

SEQ ID NO: 417925 - protein, 9 aa, Homo Sapiens
KLSRVTFII

SEQ ID NO: 417926 - protein, 9 aa, Homo Sapiens
LLLIGGRGQ

SEQ ID NO: 417927 - protein, 9 aa, Homo Sapiens
DCHIFTRCI

SEQ ID NO: 417928 - protein, 9 aa, Homo Sapiens
IQSGQKLRK

SEQ ID NO: 417929 - protein, 9 aa, Homo Sapiens
TTRPSRRPA

SEQ ID NO: 417930 - protein, 9 aa, Homo Sapiens
AMEGGLMHS

SEQ ID NO: 417931 - protein, 9 aa, Homo Sapiens
VPPDWECRI

SEQ ID NO: 417932 - protein, 9 aa, Homo Sapiens
QNESCRLYQ

SEQ ID NO: 417933 - protein, 9 aa, Homo Sapiens
DGMSLLVQR

SEQ ID NO: 417934 - protein, 9 aa, Homo Sapiens
CLDCVAKLA

SEQ ID NO: 417935 - protein, 9 aa, Homo Sapiens
APTTAPRRA

SEQ ID NO: 417936 - protein, 9 aa, Homo Sapiens
PLSTAWASA

SEQ ID NO: 417937 - protein, 9 aa, Homo Sapiens
TDIGICTTL

SEQ ID NO: 417938 - protein, 9 aa, Homo Sapiens
CSQGRQQHT

SEQ ID NO: 417939 - protein, 9 aa, Homo Sapiens
PNLLPLAGS

SEQ ID NO: 417940 - protein, 9 aa, Homo Sapiens
LSPDERHVK

SEQ ID NO: 417941 - protein, 9 aa, Homo Sapiens
RQEVSSVHS

SEQ ID NO: 417942 - protein, 9 aa, Homo Sapiens
FTAPSTKKE

SEQ ID NO: 417943 - protein, 9 aa, Homo Sapiens
HEALMHLLH

SEQ ID NO: 417944 - protein, 9 aa, Homo Sapiens
ILTSATMGC

SEQ ID NO: 417945 - protein, 9 aa, Homo Sapiens
FLRSLVWLP

SEQ ID NO: 417946 - protein, 9 aa, Homo Sapiens
DIMGRNQTA

SEQ ID NO: 417947 - protein, 9 aa, Homo Sapiens
GNHTLTLAL

SEQ ID NO: 417948 - protein, 9 aa, Homo Sapiens
RPDAVDVKA

SEQ ID NO: 417949 - protein, 9 aa, Homo Sapiens
WFVSWTPCL

SEQ ID NO: 417950 - protein, 9 aa, Homo Sapiens
ASYFYAASS

SEQ ID NO: 417951 - protein, 9 aa, Homo Sapiens
TSGLVKTTN

SEQ ID NO: 417952 - protein, 9 aa, Homo Sapiens
EVESVEVHP

SEQ ID NO: 417953 - protein, 9 aa, Homo Sapiens
QGRAPLEGM

SEQ ID NO: 417954 - protein, 9 aa, Homo Sapiens
ISTTLRPPA

SEQ ID NO: 417955 - protein, 9 aa, Homo Sapiens
DTFNDASPP

SEQ ID NO: 417956 - protein, 9 aa, Homo Sapiens
AVLIPTSAA

SEQ ID NO: 417957 - protein, 9 aa, Homo Sapiens
HPMKLQRKL

SEQ ID NO: 417958 - protein, 9 aa, Homo Sapiens
DSPGILTRE

SEQ ID NO: 417959 - protein, 9 aa, Homo Sapiens
IMGVVGCAP

SEQ ID NO: 417960 - protein, 9 aa, Homo Sapiens
DWDRKRRSS

SEQ ID NO: 417961 - protein, 9 aa, Homo Sapiens
LNVEGVDST

SEQ ID NO: 417962 - protein, 9 aa, Homo Sapiens
FGPMPNLQE

SEQ ID NO: 417963 - protein, 9 aa, Homo Sapiens
VCCEPATCP

SEQ ID NO: 417964 - protein, 9 aa, Homo Sapiens
AASVGTSAV

SEQ ID NO: 417965 - protein, 9 aa, Homo Sapiens
PSWRRCARA

SEQ ID NO: 417966 - protein, 9 aa, Homo Sapiens
LPIINLAIV

SEQ ID NO: 417967 - protein, 9 aa, Homo Sapiens
KEWVKWTKE

SEQ ID NO: 417968 - protein, 9 aa, Homo Sapiens
LQMKRWEAE

SEQ ID NO: 417969 - protein, 9 aa, Homo Sapiens
LQALNAYKS

SEQ ID NO: 417970 - protein, 9 aa, Homo Sapiens
RDFEECRRL

SEQ ID NO: 417971 - protein, 9 aa, Homo Sapiens
AGVFGPEDL

SEQ ID NO: 417972 - protein, 9 aa, Homo Sapiens
IHKKYIDKI

SEQ ID NO: 417973 - protein, 9 aa, Homo Sapiens
NLCAIHAER

SEQ ID NO: 417974 - protein, 9 aa, Homo Sapiens
FIESISLLS

SEQ ID NO: 417975 - protein, 9 aa, Homo Sapiens
DKYYRVNLH

SEQ ID NO: 417976 - protein, 9 aa, Homo Sapiens
PSPSVNGMA

SEQ ID NO: 417977 - protein, 9 aa, Homo Sapiens
NNRWVSWSA

SEQ ID NO: 417978 - protein, 9 aa, Homo Sapiens
RVFKLIYLD

SEQ ID NO: 417979 - protein, 9 aa, Homo Sapiens
YQVLEVGGN

SEQ ID NO: 417980 - protein, 9 aa, Homo Sapiens
TETHPLPIW

SEQ ID NO: 417981 - protein, 9 aa, Homo Sapiens
EAHLAYKLS

SEQ ID NO: 417982 - protein, 9 aa, Homo Sapiens
KSHQGMVIA

SEQ ID NO: 417983 - protein, 9 aa, Homo Sapiens
IWLNDGHVA

SEQ ID NO: 417984 - protein, 9 aa, Homo Sapiens
GYYLSQRCH

SEQ ID NO: 417985 - protein, 9 aa, Homo Sapiens
KDQPTGRLS

SEQ ID NO: 417986 - protein, 9 aa, Homo Sapiens
VNLEADMEW

SEQ ID NO: 417987 - protein, 9 aa, Homo Sapiens
VSSMSLRSA

SEQ ID NO: 417988 - protein, 9 aa, Homo Sapiens
KTAVLREYK

SEQ ID NO: 417989 - protein, 9 aa, Homo Sapiens
IYQMSVSEA

SEQ ID NO: 417990 - protein, 9 aa, Homo Sapiens
KLLLTLSSS

SEQ ID NO: 417991 - protein, 9 aa, Homo Sapiens
DSGGHSPCS

SEQ ID NO: 417992 - protein, 9 aa, Homo Sapiens
KIADENRAY

SEQ ID NO: 417993 - protein, 9 aa, Homo Sapiens
CFGTFITNM

SEQ ID NO: 417994 - protein, 9 aa, Homo Sapiens
VYWQIVDAQ

SEQ ID NO: 417995 - protein, 9 aa, Homo Sapiens
VYSLGRSSP

SEQ ID NO: 417996 - protein, 9 aa, Homo Sapiens
LLEQERWQV

SEQ ID NO: 417997 - protein, 9 aa, Homo Sapiens
SGSGEPTPS

SEQ ID NO: 417998 - protein, 9 aa, Homo Sapiens
SLQENEPTA

SEQ ID NO: 417999 - protein, 9 aa, Homo Sapiens
KMMMKLKKI

SEQ ID NO: 418000 - protein, 9 aa, Homo Sapiens
PMAMVTRRR

SEQ ID NO: 418001 - protein, 9 aa, Homo Sapiens
SDMYTPLTM

SEQ ID NO: 418002 - protein, 9 aa, Homo Sapiens
GVEWALGLQ

SEQ ID NO: 418003 - protein, 9 aa, Homo Sapiens
LQLLIPRSP

SEQ ID NO: 418004 - protein, 9 aa, Homo Sapiens
RTGSSSSAP

SEQ ID NO: 418005 - protein, 9 aa, Homo Sapiens
AIRVYAILT

SEQ ID NO: 418006 - protein, 9 aa, Homo Sapiens
VSQKVVAAM

SEQ ID NO: 418007 - protein, 9 aa, Homo Sapiens
SEQRGCQQR

SEQ ID NO: 418008 - protein, 9 aa, Homo Sapiens
VMVVMSDLS

SEQ ID NO: 418009 - protein, 9 aa, Homo Sapiens
SHYLHIQSL

SEQ ID NO: 418010 - protein, 9 aa, Homo Sapiens
PACALQLLA

SEQ ID NO: 418011 - protein, 9 aa, Homo Sapiens
FIFGFVANM

SEQ ID NO: 418012 - protein, 9 aa, Homo Sapiens
NKFAKATVA

SEQ ID NO: 418013 - protein, 9 aa, Homo Sapiens
VRGLDLSRV

SEQ ID NO: 418014 - protein, 9 aa, Homo Sapiens
QKDSRTAFS

SEQ ID NO: 418015 - protein, 9 aa, Homo Sapiens
YLHYVPLWK

SEQ ID NO: 418016 - protein, 9 aa, Homo Sapiens
AKAFKIPDF

SEQ ID NO: 418017 - protein, 9 aa, Homo Sapiens
DRKLGPEEL

SEQ ID NO: 418018 - protein, 9 aa, Homo Sapiens
GHHSSHKYD

SEQ ID NO: 418019 - protein, 9 aa, Homo Sapiens
HEGRTLVLV

SEQ ID NO: 418020 - protein, 9 aa, Homo Sapiens
LKGSTYRRQ

SEQ ID NO: 418021 - protein, 9 aa, Homo Sapiens
ERGVHIVSR

SEQ ID NO: 418022 - protein, 9 aa, Homo Sapiens
CGQTFRVTF

SEQ ID NO: 418023 - protein, 9 aa, Homo Sapiens
SGPSATCPW

SEQ ID NO: 418024 - protein, 9 aa, Homo Sapiens
QNCEDAQAI

SEQ ID NO: 418025 - protein, 9 aa, Homo Sapiens
NCSCFKCKE

SEQ ID NO: 418026 - protein, 9 aa, Homo Sapiens
IERERGNGS

SEQ ID NO: 418027 - protein, 9 aa, Homo Sapiens
SQTESLKVR

SEQ ID NO: 418028 - protein, 9 aa, Homo Sapiens
GDHYSHLLP

SEQ ID NO: 418029 - protein, 9 aa, Homo Sapiens
HNIPHMSEN

SEQ ID NO: 418030 - protein, 9 aa, Homo Sapiens
DEGEDRDGH

SEQ ID NO: 418031 - protein, 9 aa, Homo Sapiens
KLVKQGGRP

SEQ ID NO: 418032 - protein, 9 aa, Homo Sapiens
EAMEHFRED

SEQ ID NO: 418033 - protein, 9 aa, Homo Sapiens
YHSCWLSSP

SEQ ID NO: 418034 - protein, 9 aa, Homo Sapiens
WTTHLWSRV

SEQ ID NO: 418035 - protein, 9 aa, Homo Sapiens
RLGKGSYWT

SEQ ID NO: 418036 - protein, 9 aa, Homo Sapiens
IQPRKMAPT

SEQ ID NO: 418037 - protein, 9 aa, Homo Sapiens
CVIIPPGSS

SEQ ID NO: 418038 - protein, 9 aa, Homo Sapiens
TGPNRQILQ

SEQ ID NO: 418039 - protein, 9 aa, Homo Sapiens
DTPKSGELR

SEQ ID NO: 418040 - protein, 9 aa, Homo Sapiens
GAHWTLPPR

SEQ ID NO: 418041 - protein, 9 aa, Homo Sapiens
VHAIPLHSS

SEQ ID NO: 418042 - protein, 9 aa, Homo Sapiens
DEHISLGQL

SEQ ID NO: 418043 - protein, 9 aa, Homo Sapiens
PHAIVYPFI

SEQ ID NO: 418044 - protein, 9 aa, Homo Sapiens
WLSKIQRDL

SEQ ID NO: 418045 - protein, 9 aa, Homo Sapiens
LQFVTGTCC

SEQ ID NO: 418046 - protein, 9 aa, Homo Sapiens
RVWVRTTEG

SEQ ID NO: 418047 - protein, 9 aa, Homo Sapiens
TSCARAQIK

SEQ ID NO: 418048 - protein, 9 aa, Homo Sapiens
PILNYLRRG

SEQ ID NO: 418049 - protein, 9 aa, Homo Sapiens
AKKQLLHLT

SEQ ID NO: 418050 - protein, 9 aa, Homo Sapiens
WSHLFPMAS

SEQ ID NO: 418051 - protein, 9 aa, Homo Sapiens
ERYCCSIWQ

SEQ ID NO: 418052 - protein, 9 aa, Homo Sapiens
GEVVLPGQG

SEQ ID NO: 418053 - protein, 9 aa, Homo Sapiens
AHEGLPAVW

SEQ ID NO: 418054 - protein, 9 aa, Homo Sapiens
VTLLNTEVS

SEQ ID NO: 418055 - protein, 9 aa, Homo Sapiens
CGCHQTAII

SEQ ID NO: 418056 - protein, 9 aa, Homo Sapiens
VRESDAGHV

SEQ ID NO: 418057 - protein, 9 aa, Homo Sapiens
TWHVTTVRT

SEQ ID NO: 418058 - protein, 9 aa, Homo Sapiens
GPLCVSPKH

SEQ ID NO: 418059 - protein, 9 aa, Homo Sapiens
KIAHLGLQW

SEQ ID NO: 418060 - protein, 9 aa, Homo Sapiens
QLQHSLHLL

SEQ ID NO: 418061 - protein, 9 aa, Homo Sapiens
KSPEDLPLC

SEQ ID NO: 418062 - protein, 9 aa, Homo Sapiens
RDPLNLALH

SEQ ID NO: 418063 - protein, 9 aa, Homo Sapiens
MSDAADDIV

SEQ ID NO: 418064 - protein, 9 aa, Homo Sapiens
VPGGSRPGW

SEQ ID NO: 418065 - protein, 9 aa, Homo Sapiens
CRDSFKKQE

SEQ ID NO: 418066 - protein, 9 aa, Homo Sapiens
LGAFIGATF

SEQ ID NO: 418067 - protein, 9 aa, Homo Sapiens
TEESPPVRL

SEQ ID NO: 418068 - protein, 9 aa, Homo Sapiens
REVYHEETP

SEQ ID NO: 418069 - protein, 9 aa, Homo Sapiens
LTGSQNSHA

SEQ ID NO: 418070 - protein, 9 aa, Homo Sapiens
SSTSPAARP

SEQ ID NO: 418071 - protein, 9 aa, Homo Sapiens
TSPAARPPQ

SEQ ID NO: 418072 - protein, 9 aa, Homo Sapiens
SSYSAVMPQ

SEQ ID NO: 418073 - protein, 9 aa, Homo Sapiens
ENMKVYHLE

SEQ ID NO: 418074 - protein, 9 aa, Homo Sapiens
LILSKNLIV

SEQ ID NO: 418075 - protein, 9 aa, Homo Sapiens
HRYNSLSIL

SEQ ID NO: 418076 - protein, 9 aa, Homo Sapiens
HGIFEPGER

SEQ ID NO: 418077 - protein, 9 aa, Homo Sapiens
KIAKGTTVA

SEQ ID NO: 418078 - protein, 9 aa, Homo Sapiens
STHPGMWSS

SEQ ID NO: 418079 - protein, 9 aa, Homo Sapiens
HGTMEKSEG

SEQ ID NO: 418080 - protein, 9 aa, Homo Sapiens
RTMVQLFER

SEQ ID NO: 418081 - protein, 9 aa, Homo Sapiens
GVVGCAPTH

SEQ ID NO: 418082 - protein, 9 aa, Homo Sapiens
KAWTPRKLV

SEQ ID NO: 418083 - protein, 9 aa, Homo Sapiens
ASSTKDRLL

SEQ ID NO: 418084 - protein, 9 aa, Homo Sapiens
WLRTNWLSF

SEQ ID NO: 418085 - protein, 9 aa, Homo Sapiens
CLLSHLNSY

SEQ ID NO: 418086 - protein, 9 aa, Homo Sapiens
VLPNKVDEE

SEQ ID NO: 418087 - protein, 9 aa, Homo Sapiens
GHSPCPLVA

SEQ ID NO: 418088 - protein, 9 aa, Homo Sapiens
AHLLRLWMF

SEQ ID NO: 418089 - protein, 9 aa, Homo Sapiens
QVLGITVLG

SEQ ID NO: 418090 - protein, 9 aa, Homo Sapiens
AMTEMNGHI

SEQ ID NO: 418091 - protein, 9 aa, Homo Sapiens
SQYAQGYEG

SEQ ID NO: 418092 - protein, 9 aa, Homo Sapiens
LLQAEIREI

SEQ ID NO: 418093 - protein, 9 aa, Homo Sapiens
SKEWGEKLA

SEQ ID NO: 418094 - protein, 9 aa, Homo Sapiens
GGHGQGNPG

SEQ ID NO: 418095 - protein, 9 aa, Homo Sapiens
WFQGNNMQL

SEQ ID NO: 418096 - protein, 9 aa, Homo Sapiens
KAASHVRHV

SEQ ID NO: 418097 - protein, 9 aa, Homo Sapiens
VGYPSTTLP

SEQ ID NO: 418098 - protein, 9 aa, Homo Sapiens
VQGHQSPVQ

SEQ ID NO: 418099 - protein, 9 aa, Homo Sapiens
AGPPMREVA

SEQ ID NO: 418100 - protein, 9 aa, Homo Sapiens
KQEGPGPDD

SEQ ID NO: 418101 - protein, 9 aa, Homo Sapiens
PRRCPEEAG

SEQ ID NO: 418102 - protein, 9 aa, Homo Sapiens
ACGGRERRD

SEQ ID NO: 418103 - protein, 9 aa, Homo Sapiens
SNLEEPVSP

SEQ ID NO: 418104 - protein, 9 aa, Homo Sapiens
ATLYVLVLL

SEQ ID NO: 418105 - protein, 9 aa, Homo Sapiens
MTVLQPPKP

SEQ ID NO: 418106 - protein, 9 aa, Homo Sapiens
TRVGFLACV

SEQ ID NO: 418107 - protein, 9 aa, Homo Sapiens
PMPMAMVTR

SEQ ID NO: 418108 - protein, 9 aa, Homo Sapiens
IREFAVTTT

SEQ ID NO: 418109 - protein, 9 aa, Homo Sapiens
SQAFSCLRL

SEQ ID NO: 418110 - protein, 9 aa, Homo Sapiens
LQAAVTFVE

SEQ ID NO: 418111 - protein, 9 aa, Homo Sapiens
IGATFFVAT

SEQ ID NO: 418112 - protein, 9 aa, Homo Sapiens
LETRDQAFK

SEQ ID NO: 418113 - protein, 9 aa, Homo Sapiens
SELAEGSEC

SEQ ID NO: 418114 - protein, 9 aa, Homo Sapiens
IPDGVSRTD

SEQ ID NO: 418115 - protein, 9 aa, Homo Sapiens
PIVKLLGYS

SEQ ID NO: 418116 - protein, 9 aa, Homo Sapiens
YDLSVDMLD

SEQ ID NO: 418117 - protein, 9 aa, Homo Sapiens
GLHCEADIN

SEQ ID NO: 418118 - protein, 9 aa, Homo Sapiens
GFNIQGGKA

SEQ ID NO: 418119 - protein, 9 aa, Homo Sapiens
HLPSCHPLP

SEQ ID NO: 418120 - protein, 9 aa, Homo Sapiens
VDDNGVWML

SEQ ID NO: 418121 - protein, 9 aa, Homo Sapiens
ATLWLHEHN

SEQ ID NO: 418122 - protein, 9 aa, Homo Sapiens
MKRWEAESK

SEQ ID NO: 418123 - protein, 9 aa, Homo Sapiens
YVWFSGETL

SEQ ID NO: 418124 - protein, 9 aa, Homo Sapiens
SLPPAPLLH

SEQ ID NO: 418125 - protein, 9 aa, Homo Sapiens
SNMSEETVT

SEQ ID NO: 418126 - protein, 9 aa, Homo Sapiens
PQPVVDSYS

SEQ ID NO: 418127 - protein, 9 aa, Homo Sapiens
PAVAQDEVP

SEQ ID NO: 418128 - protein, 9 aa, Homo Sapiens
INANWGEFW

SEQ ID NO: 418129 - protein, 9 aa, Homo Sapiens
FPHWTTTAI

SEQ ID NO: 418130 - protein, 9 aa, Homo Sapiens
HELIHNHFS

SEQ ID NO: 418131 - protein, 9 aa, Homo Sapiens
TRTHGTLGV

SEQ ID NO: 418132 - protein, 9 aa, Homo Sapiens
RKRWKRKDK

SEQ ID NO: 418133 - protein, 9 aa, Homo Sapiens
PRAVMGALP

SEQ ID NO: 418134 - protein, 9 aa, Homo Sapiens
CPLNPAAQD

SEQ ID NO: 418135 - protein, 9 aa, Homo Sapiens
HIMKNRNGG

SEQ ID NO: 418136 - protein, 9 aa, Homo Sapiens
GSAVGKQSA

SEQ ID NO: 418137 - protein, 9 aa, Homo Sapiens
GSVLGSPDK

SEQ ID NO: 418138 - protein, 9 aa, Homo Sapiens
GRARAGVCC

SEQ ID NO: 418139 - protein, 9 aa, Homo Sapiens
EAPQCPSCM

SEQ ID NO: 418140 - protein, 9 aa, Homo Sapiens
VLGSPDKLG

SEQ ID NO: 418141 - protein, 9 aa, Homo Sapiens
SCANLAKSR

SEQ ID NO: 418142 - protein, 9 aa, Homo Sapiens
TSLVSLSSS

SEQ ID NO: 418143 - protein, 9 aa, Homo Sapiens
APEKHTIKL

SEQ ID NO: 418144 - protein, 9 aa, Homo Sapiens
QSMAKPKSQ

SEQ ID NO: 418145 - protein, 9 aa, Homo Sapiens
PRKDAGCAK

SEQ ID NO: 418146 - protein, 9 aa, Homo Sapiens
PPENEAPQC

SEQ ID NO: 418147 - protein, 9 aa, Homo Sapiens
LLALGLGSD

SEQ ID NO: 418148 - protein, 9 aa, Homo Sapiens
AAPRSRAGR

SEQ ID NO: 418149 - protein, 9 aa, Homo Sapiens
DLVYVNYTR

SEQ ID NO: 418150 - protein, 9 aa, Homo Sapiens
EQLGLSTGK

SEQ ID NO: 418151 - protein, 9 aa, Homo Sapiens
PSAHPPPPL

SEQ ID NO: 418152 - protein, 9 aa, Homo Sapiens
EGRPPSPRP

SEQ ID NO: 418153 - protein, 9 aa, Homo Sapiens
GVGEVVLPG

SEQ ID NO: 418154 - protein, 9 aa, Homo Sapiens
GKPMVLVAS

SEQ ID NO: 418155 - protein, 9 aa, Homo Sapiens
SGNDGRTRS

SEQ ID NO: 418156 - protein, 9 aa, Homo Sapiens
CWEFVTDDY

SEQ ID NO: 418157 - protein, 9 aa, Homo Sapiens
VLPGVDASL

SEQ ID NO: 418158 - protein, 9 aa, Homo Sapiens
GIFIAISLL

SEQ ID NO: 418159 - protein, 9 aa, Homo Sapiens
RPSRRPATG

SEQ ID NO: 418160 - protein, 9 aa, Homo Sapiens
DHQDLEQPD

SEQ ID NO: 418161 - protein, 9 aa, Homo Sapiens
VALPDEQTA

SEQ ID NO: 418162 - protein, 9 aa, Homo Sapiens
PWEAALRPS

SEQ ID NO: 418163 - protein, 9 aa, Homo Sapiens
QRIAAVASC

SEQ ID NO: 418164 - protein, 9 aa, Homo Sapiens
NTRDTSKKN

SEQ ID NO: 418165 - protein, 9 aa, Homo Sapiens
LTCFSKAMY

SEQ ID NO: 418166 - protein, 9 aa, Homo Sapiens
WGSPYSPLR

SEQ ID NO: 418167 - protein, 9 aa, Homo Sapiens
FRPQQALQD

SEQ ID NO: 418168 - protein, 9 aa, Homo Sapiens
EQEIRLAQE

SEQ ID NO: 418169 - protein, 9 aa, Homo Sapiens
QAEIREIPF

SEQ ID NO: 418170 - protein, 9 aa, Homo Sapiens
AFLRTPLNI

SEQ ID NO: 418171 - protein, 9 aa, Homo Sapiens
EGLKTATPR

SEQ ID NO: 418172 - protein, 9 aa, Homo Sapiens
FLPRVRGRG

SEQ ID NO: 418173 - protein, 9 aa, Homo Sapiens
TVSFVGQIS

SEQ ID NO: 418174 - protein, 9 aa, Homo Sapiens
AAIHKKYID

SEQ ID NO: 418175 - protein, 9 aa, Homo Sapiens
SMVDFWDFA

SEQ ID NO: 418176 - protein, 9 aa, Homo Sapiens
KFATLSVRA

SEQ ID NO: 418177 - protein, 9 aa, Homo Sapiens
RMTVLQPPK

SEQ ID NO: 418178 - protein, 9 aa, Homo Sapiens
HHPQRCGRT

SEQ ID NO: 418179 - protein, 9 aa, Homo Sapiens
PGSAVGKQS

SEQ ID NO: 418180 - protein, 9 aa, Homo Sapiens
RGPDGVMVR

SEQ ID NO: 418181 - protein, 9 aa, Homo Sapiens
ALGDPEAAA

SEQ ID NO: 418182 - protein, 9 aa, Homo Sapiens
SYSQQIFWP

SEQ ID NO: 418183 - protein, 9 aa, Homo Sapiens
DAEVGLAPG

SEQ ID NO: 418184 - protein, 9 aa, Homo Sapiens
SIHGMGELM

SEQ ID NO: 418185 - protein, 9 aa, Homo Sapiens
GGCMNPAHA

SEQ ID NO: 418186 - protein, 9 aa, Homo Sapiens
PHRRRPSFP

SEQ ID NO: 418187 - protein, 9 aa, Homo Sapiens
WWRRGALPS

SEQ ID NO: 418188 - protein, 9 aa, Homo Sapiens
YSVVCIIGL

SEQ ID NO: 418189 - protein, 9 aa, Homo Sapiens
MRSIHGMGE

SEQ ID NO: 418190 - protein, 9 aa, Homo Sapiens
LSHGLKSLS

SEQ ID NO: 418191 - protein, 9 aa, Homo Sapiens
IMLIFLGPD

SEQ ID NO: 418192 - protein, 9 aa, Homo Sapiens
RSSRGTSWM

SEQ ID NO: 418193 - protein, 9 aa, Homo Sapiens
SACTMPPLL

SEQ ID NO: 418194 - protein, 9 aa, Homo Sapiens
PNKFATLSV

SEQ ID NO: 418195 - protein, 9 aa, Homo Sapiens
PLLRGRLQH

SEQ ID NO: 418196 - protein, 9 aa, Homo Sapiens
CSCSWLSLF

SEQ ID NO: 418197 - protein, 9 aa, Homo Sapiens
PTVSQGILC

SEQ ID NO: 418198 - protein, 9 aa, Homo Sapiens
AIISLVQGP

SEQ ID NO: 418199 - protein, 9 aa, Homo Sapiens
RRGDVPQTV

SEQ ID NO: 418200 - protein, 9 aa, Homo Sapiens
SPGALEVLS

SEQ ID NO: 418201 - protein, 9 aa, Homo Sapiens
EPHHFMAIF

SEQ ID NO: 418202 - protein, 9 aa, Homo Sapiens
AVGCRRCSG

SEQ ID NO: 418203 - protein, 9 aa, Homo Sapiens
HCSHTGSAG

SEQ ID NO: 418204 - protein, 9 aa, Homo Sapiens
RIVVSSAPF

SEQ ID NO: 418205 - protein, 9 aa, Homo Sapiens
TCSSGPAVM

SEQ ID NO: 418206 - protein, 9 aa, Homo Sapiens
CEAIVNTGT

SEQ ID NO: 418207 - protein, 9 aa, Homo Sapiens
VAPQPGGAG

SEQ ID NO: 418208 - protein, 9 aa, Homo Sapiens
WKEMDEYIT

SEQ ID NO: 418209 - protein, 9 aa, Homo Sapiens
LQDKNSFFI

SEQ ID NO: 418210 - protein, 9 aa, Homo Sapiens
LTREELETR

SEQ ID NO: 418211 - protein, 9 aa, Homo Sapiens
LLEAFPLPR

SEQ ID NO: 418212 - protein, 9 aa, Homo Sapiens
GIRTSVVSE

SEQ ID NO: 418213 - protein, 9 aa, Homo Sapiens
PSVHPRAPP

SEQ ID NO: 418214 - protein, 9 aa, Homo Sapiens
VLWYDIYCF

SEQ ID NO: 418215 - protein, 9 aa, Homo Sapiens
ASCLLPPAP

SEQ ID NO: 418216 - protein, 9 aa, Homo Sapiens
PDLSIMPPL

SEQ ID NO: 418217 - protein, 9 aa, Homo Sapiens
DELLRGLND

SEQ ID NO: 418218 - protein, 9 aa, Homo Sapiens
CGLPSRSMT

SEQ ID NO: 418219 - protein, 9 aa, Homo Sapiens
RPRRQAMAM

SEQ ID NO: 418220 - protein, 9 aa, Homo Sapiens
IAEKYFGPS

SEQ ID NO: 418221 - protein, 9 aa, Homo Sapiens
KEVTIFLSK

SEQ ID NO: 418222 - protein, 9 aa, Homo Sapiens
EEHFPVVEQ

SEQ ID NO: 418223 - protein, 9 aa, Homo Sapiens
ISMTTISRA

SEQ ID NO: 418224 - protein, 9 aa, Homo Sapiens
DMLDVHADR

SEQ ID NO: 418225 - protein, 9 aa, Homo Sapiens
SCPHPRNAG

SEQ ID NO: 418226 - protein, 9 aa, Homo Sapiens
SAYDDKLAF

SEQ ID NO: 418227 - protein, 9 aa, Homo Sapiens
GHVAAVAPV

SEQ ID NO: 418228 - protein, 9 aa, Homo Sapiens
MMLPVRART

SEQ ID NO: 418229 - protein, 9 aa, Homo Sapiens
LRGRLQHHL

SEQ ID NO: 418230 - protein, 9 aa, Homo Sapiens
TPGGASGRS

SEQ ID NO: 418231 - protein, 9 aa, Homo Sapiens
WTETTTWHV

SEQ ID NO: 418232 - protein, 9 aa, Homo Sapiens
CSCFKCKES

SEQ ID NO: 418233 - protein, 9 aa, Homo Sapiens
DYTFIRVFK

SEQ ID NO: 418234 - protein, 9 aa, Homo Sapiens
CQSGVQFVL

SEQ ID NO: 418235 - protein, 9 aa, Homo Sapiens
LQELQYHCS

SEQ ID NO: 418236 - protein, 9 aa, Homo Sapiens
RPKSAKGQT

SEQ ID NO: 418237 - protein, 9 aa, Homo Sapiens
KVKDTLKLL

SEQ ID NO: 418238 - protein, 9 aa, Homo Sapiens
LALLYHEPL

SEQ ID NO: 418239 - protein, 9 aa, Homo Sapiens
ASLVSEAVP

SEQ ID NO: 418240 - protein, 9 aa, Homo Sapiens
QDFFRKKVE

SEQ ID NO: 418241 - protein, 9 aa, Homo Sapiens
RDSPAWAWH

SEQ ID NO: 418242 - protein, 9 aa, Homo Sapiens
GSLPAPPSF

SEQ ID NO: 418243 - protein, 9 aa, Homo Sapiens
QLVRQRGRL

SEQ ID NO: 418244 - protein, 9 aa, Homo Sapiens
LAMDIDQLP

SEQ ID NO: 418245 - protein, 9 aa, Homo Sapiens
SAPWQKSPG

SEQ ID NO: 418246 - protein, 9 aa, Homo Sapiens
EPTPTPTVV

SEQ ID NO: 418247 - protein, 9 aa, Homo Sapiens
RESPWGDYP

SEQ ID NO: 418248 - protein, 9 aa, Homo Sapiens
RKSEGGKRR

SEQ ID NO: 418249 - protein, 9 aa, Homo Sapiens
VMPLENYQI

SEQ ID NO: 418250 - protein, 9 aa, Homo Sapiens
AARQASLSI

SEQ ID NO: 418251 - protein, 9 aa, Homo Sapiens
PDRTYGDMA

SEQ ID NO: 418252 - protein, 9 aa, Homo Sapiens
KPTTGHAPR

SEQ ID NO: 418253 - protein, 9 aa, Homo Sapiens
GPQWDSDEG

SEQ ID NO: 418254 - protein, 9 aa, Homo Sapiens
NVTFNKKNL

SEQ ID NO: 418255 - protein, 9 aa, Homo Sapiens
TEPHHFMAI

SEQ ID NO: 418256 - protein, 9 aa, Homo Sapiens
SLEAPPVGG

SEQ ID NO: 418257 - protein, 9 aa, Homo Sapiens
RQQQEVEER

SEQ ID NO: 418258 - protein, 9 aa, Homo Sapiens
EGEGLKMSF

SEQ ID NO: 418259 - protein, 9 aa, Homo Sapiens
SRAQYNVLT

SEQ ID NO: 418260 - protein, 9 aa, Homo Sapiens
HAVSGCGRA

SEQ ID NO: 418261 - protein, 9 aa, Homo Sapiens
CRIQKSDFS

SEQ ID NO: 418262 - protein, 9 aa, Homo Sapiens
RLMIQHEQE

SEQ ID NO: 418263 - protein, 9 aa, Homo Sapiens
YVPNQKVKS

SEQ ID NO: 418264 - protein, 9 aa, Homo Sapiens
WSCLEHWLS

SEQ ID NO: 418265 - protein, 9 aa, Homo Sapiens
SPAEPLLSW

SEQ ID NO: 418266 - protein, 9 aa, Homo Sapiens
ILYYRIYSL

SEQ ID NO: 418267 - protein, 9 aa, Homo Sapiens
FQSLMSLKR

SEQ ID NO: 418268 - protein, 9 aa, Homo Sapiens
ESQSCQRPP

SEQ ID NO: 418269 - protein, 9 aa, Homo Sapiens
KMSDEAGVT

SEQ ID NO: 418270 - protein, 9 aa, Homo Sapiens
LLKWHWKKL

SEQ ID NO: 418271 - protein, 9 aa, Homo Sapiens
QLPASSPTK

SEQ ID NO: 418272 - protein, 9 aa, Homo Sapiens
PLGLRPPHL

SEQ ID NO: 418273 - protein, 9 aa, Homo Sapiens
GPSTQLVRQ

SEQ ID NO: 418274 - protein, 9 aa, Homo Sapiens
DKLSTVHHC

SEQ ID NO: 418275 - protein, 9 aa, Homo Sapiens
CQFVILRKK

SEQ ID NO: 418276 - protein, 9 aa, Homo Sapiens
NLHSSSQQS

SEQ ID NO: 418277 - protein, 9 aa, Homo Sapiens
PTSTSQDSF

SEQ ID NO: 418278 - protein, 9 aa, Homo Sapiens
KRCPPRAPA

SEQ ID NO: 418279 - protein, 9 aa, Homo Sapiens
IKQTGIMFG

SEQ ID NO: 418280 - protein, 9 aa, Homo Sapiens
TMPPKIHYE

SEQ ID NO: 418281 - protein, 9 aa, Homo Sapiens
PPPPTKKGA

SEQ ID NO: 418282 - protein, 9 aa, Homo Sapiens
LATFKTRVR

SEQ ID NO: 418283 - protein, 9 aa, Homo Sapiens
LTNKRAVDF

SEQ ID NO: 418284 - protein, 9 aa, Homo Sapiens
MKVYHLELG

SEQ ID NO: 418285 - protein, 9 aa, Homo Sapiens
YEMPYAGGV

SEQ ID NO: 418286 - protein, 9 aa, Homo Sapiens
SGAGGSTAS

SEQ ID NO: 418287 - protein, 9 aa, Homo Sapiens
ANMSDNAGF

SEQ ID NO: 418288 - protein, 9 aa, Homo Sapiens
GHGRARPTG

SEQ ID NO: 418289 - protein, 9 aa, Homo Sapiens
TPGPASTAA

SEQ ID NO: 418290 - protein, 9 aa, Homo Sapiens
PDGWAAAAG

SEQ ID NO: 418291 - protein, 9 aa, Homo Sapiens
VPQVNMTDV

SEQ ID NO: 418292 - protein, 9 aa, Homo Sapiens
HSAGLSPGA

SEQ ID NO: 418293 - protein, 9 aa, Homo Sapiens
VTIFLSKEK

SEQ ID NO: 418294 - protein, 9 aa, Homo Sapiens
EPRLWAGPA

SEQ ID NO: 418295 - protein, 9 aa, Homo Sapiens
QKQSFSKAF

SEQ ID NO: 418296 - protein, 9 aa, Homo Sapiens
PPGSPVVNV

SEQ ID NO: 418297 - protein, 9 aa, Homo Sapiens
DQLPERMKA

SEQ ID NO: 418298 - protein, 9 aa, Homo Sapiens
AGPPGTVGP

SEQ ID NO: 418299 - protein, 9 aa, Homo Sapiens
VELKVKQGL

SEQ ID NO: 418300 - protein, 9 aa, Homo Sapiens
TILRCARPI

SEQ ID NO: 418301 - protein, 9 aa, Homo Sapiens
RSNWNILNN

SEQ ID NO: 418302 - protein, 9 aa, Homo Sapiens
GPNRQILQG

SEQ ID NO: 418303 - protein, 9 aa, Homo Sapiens
WTPCLDCVA

SEQ ID NO: 418304 - protein, 9 aa, Homo Sapiens
EWAICWELL

SEQ ID NO: 418305 - protein, 9 aa, Homo Sapiens
GSLHVSAAG

SEQ ID NO: 418306 - protein, 9 aa, Homo Sapiens
AQVRRAHEG

SEQ ID NO: 418307 - protein, 9 aa, Homo Sapiens
DANWDSPSH

SEQ ID NO: 418308 - protein, 9 aa, Homo Sapiens
FAHDSTHVI

SEQ ID NO: 418309 - protein, 9 aa, Homo Sapiens
KTLKMIRRG

SEQ ID NO: 418310 - protein, 9 aa, Homo Sapiens
ERKSEGGKR

SEQ ID NO: 418311 - protein, 9 aa, Homo Sapiens
PYCLLASRR

SEQ ID NO: 418312 - protein, 9 aa, Homo Sapiens
DVLPGVDAS

SEQ ID NO: 418313 - protein, 9 aa, Homo Sapiens
HHVCTLKIM

SEQ ID NO: 418314 - protein, 9 aa, Homo Sapiens
VGKRKTKLK

SEQ ID NO: 418315 - protein, 9 aa, Homo Sapiens
TLWKQKKLR

SEQ ID NO: 418316 - protein, 9 aa, Homo Sapiens
LGVSEQQVY

SEQ ID NO: 418317 - protein, 9 aa, Homo Sapiens
SEIPPPAPA

SEQ ID NO: 418318 - protein, 9 aa, Homo Sapiens
VWGNLRQAA

SEQ ID NO: 418319 - protein, 9 aa, Homo Sapiens
RTAMIPFPR

SEQ ID NO: 418320 - protein, 9 aa, Homo Sapiens
AFKIPDFQG

SEQ ID NO: 418321 - protein, 9 aa, Homo Sapiens
FVLGRLMIQ

SEQ ID NO: 418322 - protein, 9 aa, Homo Sapiens
MCCVIIPPG

SEQ ID NO: 418323 - protein, 9 aa, Homo Sapiens
LLWGRPCSS

SEQ ID NO: 418324 - protein, 9 aa, Homo Sapiens
LHDVLSSNE

SEQ ID NO: 418325 - protein, 9 aa, Homo Sapiens
CQQPANTFD

SEQ ID NO: 418326 - protein, 9 aa, Homo Sapiens
TWVPGVLTW

SEQ ID NO: 418327 - protein, 9 aa, Homo Sapiens
PKENWVQMV

SEQ ID NO: 418328 - protein, 9 aa, Homo Sapiens
YMIVDEGHC

SEQ ID NO: 418329 - protein, 9 aa, Homo Sapiens
DPPQTSLQL

SEQ ID NO: 418330 - protein, 9 aa, Homo Sapiens
YHRSGKQLN

SEQ ID NO: 418331 - protein, 9 aa, Homo Sapiens
WAGSGHPEP

SEQ ID NO: 418332 - protein, 9 aa, Homo Sapiens
AHGRIEEIQ

SEQ ID NO: 418333 - protein, 9 aa, Homo Sapiens
HHQQQQQQM

SEQ ID NO: 418334 - protein, 9 aa, Homo Sapiens
FSRPTMAFV

SEQ ID NO: 418335 - protein, 9 aa, Homo Sapiens
RWYRAPKVI

SEQ ID NO: 418336 - protein, 9 aa, Homo Sapiens
TGAGPATMP

SEQ ID NO: 418337 - protein, 9 aa, Homo Sapiens
IFGFVANML

SEQ ID NO: 418338 - protein, 9 aa, Homo Sapiens
PATMPALGD

SEQ ID NO: 418339 - protein, 9 aa, Homo Sapiens
RYERKNETF

SEQ ID NO: 418340 - protein, 9 aa, Homo Sapiens
QACLEQVIA

SEQ ID NO: 418341 - protein, 9 aa, Homo Sapiens
TISASFMQY

SEQ ID NO: 418342 - protein, 9 aa, Homo Sapiens
IGCTQTMVM

SEQ ID NO: 418343 - protein, 9 aa, Homo Sapiens
TGTVTAAAA

SEQ ID NO: 418344 - protein, 9 aa, Homo Sapiens
DIEVHFVLN

SEQ ID NO: 418345 - protein, 9 aa, Homo Sapiens
LKLELWVLA

SEQ ID NO: 418346 - protein, 9 aa, Homo Sapiens
RCARLSPSS

SEQ ID NO: 418347 - protein, 9 aa, Homo Sapiens
ARHQVLGIT

SEQ ID NO: 418348 - protein, 9 aa, Homo Sapiens
QEEDEGGDE

SEQ ID NO: 418349 - protein, 9 aa, Homo Sapiens
HRYAGMTLT

SEQ ID NO: 418350 - protein, 9 aa, Homo Sapiens
RLSWATHYI

SEQ ID NO: 418351 - protein, 9 aa, Homo Sapiens
FPASTPSTS

SEQ ID NO: 418352 - protein, 9 aa, Homo Sapiens
RCSLFTCLQ

SEQ ID NO: 418353 - protein, 9 aa, Homo Sapiens
QLEALATEQ

SEQ ID NO: 418354 - protein, 9 aa, Homo Sapiens
EDGDHGINQ

SEQ ID NO: 418355 - protein, 9 aa, Homo Sapiens
WQGMGSLNQ

SEQ ID NO: 418356 - protein, 9 aa, Homo Sapiens
VMGFAQKSN

SEQ ID NO: 418357 - protein, 9 aa, Homo Sapiens
GSFPQHCAG

SEQ ID NO: 418358 - protein, 9 aa, Homo Sapiens
IVILYYRIY

SEQ ID NO: 418359 - protein, 9 aa, Homo Sapiens
QGSCTTIHL

SEQ ID NO: 418360 - protein, 9 aa, Homo Sapiens
MVTASASSL

SEQ ID NO: 418361 - protein, 9 aa, Homo Sapiens
LPRVSAVSG

SEQ ID NO: 418362 - protein, 9 aa, Homo Sapiens
GAGEHLPQP

SEQ ID NO: 418363 - protein, 9 aa, Homo Sapiens
KTYSLVDRE

SEQ ID NO: 418364 - protein, 9 aa, Homo Sapiens
PRLAPERAR

SEQ ID NO: 418365 - protein, 9 aa, Homo Sapiens
PTHGGSRPM

SEQ ID NO: 418366 - protein, 9 aa, Homo Sapiens
LEHFNKLVV

SEQ ID NO: 418367 - protein, 9 aa, Homo Sapiens
GPDFCHCPN

SEQ ID NO: 418368 - protein, 9 aa, Homo Sapiens
EVLKKFPEE

SEQ ID NO: 418369 - protein, 9 aa, Homo Sapiens
KVPGGSRPG

SEQ ID NO: 418370 - protein, 9 aa, Homo Sapiens
TRNGDLSAM

SEQ ID NO: 418371 - protein, 9 aa, Homo Sapiens
PRRSPFPRQ

SEQ ID NO: 418372 - protein, 9 aa, Homo Sapiens
VVLLHKGCT

SEQ ID NO: 418373 - protein, 9 aa, Homo Sapiens
EMNGHILGS

SEQ ID NO: 418374 - protein, 9 aa, Homo Sapiens
GVMVRVGSC

SEQ ID NO: 418375 - protein, 9 aa, Homo Sapiens
QLLALESQL

SEQ ID NO: 418376 - protein, 9 aa, Homo Sapiens
DTCYILHGS

SEQ ID NO: 418377 - protein, 9 aa, Homo Sapiens
LSAGHYLGA

SEQ ID NO: 418378 - protein, 9 aa, Homo Sapiens
CQWRQPPRE

SEQ ID NO: 418379 - protein, 9 aa, Homo Sapiens
QPQSRFHRR

SEQ ID NO: 418380 - protein, 9 aa, Homo Sapiens
GRLMIQHEQ

SEQ ID NO: 418381 - protein, 9 aa, Homo Sapiens
SVVSEETLL

SEQ ID NO: 418382 - protein, 9 aa, Homo Sapiens
AVVGVFFGD

SEQ ID NO: 418383 - protein, 9 aa, Homo Sapiens
LVFAQVRRA

SEQ ID NO: 418384 - protein, 9 aa, Homo Sapiens
IYSEHNYCR

SEQ ID NO: 418385 - protein, 9 aa, Homo Sapiens
ESRVRGLGM

SEQ ID NO: 418386 - protein, 9 aa, Homo Sapiens
SAGATHFYL

SEQ ID NO: 418387 - protein, 9 aa, Homo Sapiens
LGGGRRGAP

SEQ ID NO: 418388 - protein, 9 aa, Homo Sapiens
LLQEVEVVW

SEQ ID NO: 418389 - protein, 9 aa, Homo Sapiens
ILRPRFRWE

SEQ ID NO: 418390 - protein, 9 aa, Homo Sapiens
PCSVLGGGG

SEQ ID NO: 418391 - protein, 9 aa, Homo Sapiens
LDPYKFCYE

SEQ ID NO: 418392 - protein, 9 aa, Homo Sapiens
LTRDKYTYT

SEQ ID NO: 418393 - protein, 9 aa, Homo Sapiens
TTVFDNTNS

SEQ ID NO: 418394 - protein, 9 aa, Homo Sapiens
VKKGEEGGR

SEQ ID NO: 418395 - protein, 9 aa, Homo Sapiens
ARAGVLGIQ

SEQ ID NO: 418396 - protein, 9 aa, Homo Sapiens
TSTGGIFEP

SEQ ID NO: 418397 - protein, 9 aa, Homo Sapiens
AGPATMPAL

SEQ ID NO: 418398 - protein, 9 aa, Homo Sapiens
NPQPQSRFH

SEQ ID NO: 418399 - protein, 9 aa, Homo Sapiens
ETHSQQIAE

SEQ ID NO: 418400 - protein, 9 aa, Homo Sapiens
KPLRGDPGV

SEQ ID NO: 418401 - protein, 9 aa, Homo Sapiens
ASQDDRSTW

SEQ ID NO: 418402 - protein, 9 aa, Homo Sapiens
SHQNLGTPG

SEQ ID NO: 418403 - protein, 9 aa, Homo Sapiens
RTHGAPAPS

SEQ ID NO: 418404 - protein, 9 aa, Homo Sapiens
QGLQDDGFQ

SEQ ID NO: 418405 - protein, 9 aa, Homo Sapiens
LGGVGLLGH

SEQ ID NO: 418406 - protein, 9 aa, Homo Sapiens
PSPHPQLQP

SEQ ID NO: 418407 - protein, 9 aa, Homo Sapiens
PDKSSRPIS

SEQ ID NO: 418408 - protein, 9 aa, Homo Sapiens
GSGGCQYLR

SEQ ID NO: 418409 - protein, 9 aa, Homo Sapiens
MGDMGPCGP

SEQ ID NO: 418410 - protein, 9 aa, Homo Sapiens
KDRRAKNRV

SEQ ID NO: 418411 - protein, 9 aa, Homo Sapiens
TLIPLAFFW

SEQ ID NO: 418412 - protein, 9 aa, Homo Sapiens
RVTFDVEIH

SEQ ID NO: 418413 - protein, 9 aa, Homo Sapiens
LRIALHDCV

SEQ ID NO: 418414 - protein, 9 aa, Homo Sapiens
CEGKGLHWG

SEQ ID NO: 418415 - protein, 9 aa, Homo Sapiens
EWFEQEAVA

SEQ ID NO: 418416 - protein, 9 aa, Homo Sapiens
RSAQFKHTV

SEQ ID NO: 418417 - protein, 9 aa, Homo Sapiens
YQDWAAQEP

SEQ ID NO: 418418 - protein, 9 aa, Homo Sapiens
MQVMVEPSN

SEQ ID NO: 418419 - protein, 9 aa, Homo Sapiens
IHMRHLAIW

SEQ ID NO: 418420 - protein, 9 aa, Homo Sapiens
GGVFVNGQP

SEQ ID NO: 418421 - protein, 9 aa, Homo Sapiens
TIDLVTTCI

SEQ ID NO: 418422 - protein, 9 aa, Homo Sapiens
KTNMHAQNL

SEQ ID NO: 418423 - protein, 9 aa, Homo Sapiens
SCPLATWWT

SEQ ID NO: 418424 - protein, 9 aa, Homo Sapiens
VGTVLLDII

SEQ ID NO: 418425 - protein, 9 aa, Homo Sapiens
KMLSVHNIP

SEQ ID NO: 418426 - protein, 9 aa, Homo Sapiens
KKIKEKMIL

SEQ ID NO: 418427 - protein, 9 aa, Homo Sapiens
KSKRVNEVI

SEQ ID NO: 418428 - protein, 9 aa, Homo Sapiens
FLVIGKISQ

SEQ ID NO: 418429 - protein, 9 aa, Homo Sapiens
IGQVHSTGH

SEQ ID NO: 418430 - protein, 9 aa, Homo Sapiens
ELEWALCAV

SEQ ID NO: 418431 - protein, 9 aa, Homo Sapiens
TKSYLLQLS

SEQ ID NO: 418432 - protein, 9 aa, Homo Sapiens
ITEIDLIPR

SEQ ID NO: 418433 - protein, 9 aa, Homo Sapiens
GHAAAAARL

SEQ ID NO: 418434 - protein, 9 aa, Homo Sapiens
GLSRWGPRA

SEQ ID NO: 418435 - protein, 9 aa, Homo Sapiens
QQGEVALSD

SEQ ID NO: 418436 - protein, 9 aa, Homo Sapiens
IDQLPERMK

SEQ ID NO: 418437 - protein, 9 aa, Homo Sapiens
GCMNPAHAF

SEQ ID NO: 418438 - protein, 9 aa, Homo Sapiens
PSHSTLLLV

SEQ ID NO: 418439 - protein, 9 aa, Homo Sapiens
EVTVAVDVL

SEQ ID NO: 418440 - protein, 9 aa, Homo Sapiens
DLFHPMKLQ

SEQ ID NO: 418441 - protein, 9 aa, Homo Sapiens
HAHYYPPIL

SEQ ID NO: 418442 - protein, 9 aa, Homo Sapiens
FLGNFLKPR

SEQ ID NO: 418443 - protein, 9 aa, Homo Sapiens
PTLMRPLRT

SEQ ID NO: 418444 - protein, 9 aa, Homo Sapiens
SNAGLTRNY

SEQ ID NO: 418445 - protein, 9 aa, Homo Sapiens
PLEGMLLPR

SEQ ID NO: 418446 - protein, 9 aa, Homo Sapiens
QAVPRGQGI

SEQ ID NO: 418447 - protein, 9 aa, Homo Sapiens
RVHALVLHH

SEQ ID NO: 418448 - protein, 9 aa, Homo Sapiens
ITYKFEEDI

SEQ ID NO: 418449 - protein, 9 aa, Homo Sapiens
HPAPTQERS

SEQ ID NO: 418450 - protein, 9 aa, Homo Sapiens
SPMQQQLQA

SEQ ID NO: 418451 - protein, 9 aa, Homo Sapiens
LRHPRKPGV

SEQ ID NO: 418452 - protein, 9 aa, Homo Sapiens
QGVMYSFPR

SEQ ID NO: 418453 - protein, 9 aa, Homo Sapiens
EAQISTGGI

SEQ ID NO: 418454 - protein, 9 aa, Homo Sapiens
YIRKALALD

SEQ ID NO: 418455 - protein, 9 aa, Homo Sapiens
AALGVDAAR

SEQ ID NO: 418456 - protein, 9 aa, Homo Sapiens
MTMGMQTGF

SEQ ID NO: 418457 - protein, 9 aa, Homo Sapiens
AVAGAWSGA

SEQ ID NO: 418458 - protein, 9 aa, Homo Sapiens
MLCMNQLSP

SEQ ID NO: 418459 - protein, 9 aa, Homo Sapiens
GGGNPCSAS

SEQ ID NO: 418460 - protein, 9 aa, Homo Sapiens
ESGGPHLLQ

SEQ ID NO: 418461 - protein, 9 aa, Homo Sapiens
AFTMDYNYP

SEQ ID NO: 418462 - protein, 9 aa, Homo Sapiens
WEFPLGGTT

SEQ ID NO: 418463 - protein, 9 aa, Homo Sapiens
GGTTIGEVT

SEQ ID NO: 418464 - protein, 9 aa, Homo Sapiens
FWDTEETYI

SEQ ID NO: 418465 - protein, 9 aa, Homo Sapiens
TTASFGSFT

SEQ ID NO: 418466 - protein, 9 aa, Homo Sapiens
LSPDGDQVA

SEQ ID NO: 418467 - protein, 9 aa, Homo Sapiens
LVVLTLPIS

SEQ ID NO: 418468 - protein, 9 aa, Homo Sapiens
EMHFAEVVG

SEQ ID NO: 418469 - protein, 9 aa, Homo Sapiens
FSGKKPPSR

SEQ ID NO: 418470 - protein, 9 aa, Homo Sapiens
WIIKENKKK

SEQ ID NO: 418471 - protein, 9 aa, Homo Sapiens
GDPHSQLYI

SEQ ID NO: 418472 - protein, 9 aa, Homo Sapiens
ESLRPVMNH

SEQ ID NO: 418473 - protein, 9 aa, Homo Sapiens
RKFYGSEGP

SEQ ID NO: 418474 - protein, 9 aa, Homo Sapiens
LLPLLHSNV

SEQ ID NO: 418475 - protein, 9 aa, Homo Sapiens
DGDPDAEVG

SEQ ID NO: 418476 - protein, 9 aa, Homo Sapiens
ESVHGRTRT

SEQ ID NO: 418477 - protein, 9 aa, Homo Sapiens
CGKCFIYRQ

SEQ ID NO: 418478 - protein, 9 aa, Homo Sapiens
LMVSAHQQP

SEQ ID NO: 418479 - protein, 9 aa, Homo Sapiens
ACVGADVLP

SEQ ID NO: 418480 - protein, 9 aa, Homo Sapiens
KWTRSQKGK

SEQ ID NO: 418481 - protein, 9 aa, Homo Sapiens
DPRYRFDPR

SEQ ID NO: 418482 - protein, 9 aa, Homo Sapiens
LRRHYDGAV

SEQ ID NO: 418483 - protein, 9 aa, Homo Sapiens
KAGYSPLMR

SEQ ID NO: 418484 - protein, 9 aa, Homo Sapiens
MLAQRLPYN

SEQ ID NO: 418485 - protein, 9 aa, Homo Sapiens
GTAGGGGSW

SEQ ID NO: 418486 - protein, 9 aa, Homo Sapiens
DENREKQAP

SEQ ID NO: 418487 - protein, 9 aa, Homo Sapiens
ANVLLLFIS

SEQ ID NO: 418488 - protein, 9 aa, Homo Sapiens
NTGITVFLT

SEQ ID NO: 418489 - protein, 9 aa, Homo Sapiens
ALRPGNPTS

SEQ ID NO: 418490 - protein, 9 aa, Homo Sapiens
DHDERFDLD

SEQ ID NO: 418491 - protein, 9 aa, Homo Sapiens
ILQELKLWV

SEQ ID NO: 418492 - protein, 9 aa, Homo Sapiens
QAIQNPQAP

SEQ ID NO: 418493 - protein, 9 aa, Homo Sapiens
PLDFEAHLA

SEQ ID NO: 418494 - protein, 9 aa, Homo Sapiens
GLRRLLLDC

SEQ ID NO: 418495 - protein, 9 aa, Homo Sapiens
LRPVMNHIC

SEQ ID NO: 418496 - protein, 9 aa, Homo Sapiens
LFEMVQCLT

SEQ ID NO: 418497 - protein, 9 aa, Homo Sapiens
SHRDLSIIK

SEQ ID NO: 418498 - protein, 9 aa, Homo Sapiens
RKIQKKRSK

SEQ ID NO: 418499 - protein, 9 aa, Homo Sapiens
WSSPLPGRG

SEQ ID NO: 418500 - protein, 9 aa, Homo Sapiens
QRKQKMPQE

SEQ ID NO: 418501 - protein, 9 aa, Homo Sapiens
GNCQSPFSQ

SEQ ID NO: 418502 - protein, 9 aa, Homo Sapiens
SALRLWEGP

SEQ ID NO: 418503 - protein, 9 aa, Homo Sapiens
PRSSLPLLR

SEQ ID NO: 418504 - protein, 9 aa, Homo Sapiens
TEDLAEVTV

SEQ ID NO: 418505 - protein, 9 aa, Homo Sapiens
PRGLQIQEK

SEQ ID NO: 418506 - protein, 9 aa, Homo Sapiens
KKSPFLSST

SEQ ID NO: 418507 - protein, 9 aa, Homo Sapiens
KNHYQSFGN

SEQ ID NO: 418508 - protein, 9 aa, Homo Sapiens
RLSLHGAHW

SEQ ID NO: 418509 - protein, 9 aa, Homo Sapiens
CPLATWWTS

SEQ ID NO: 418510 - protein, 9 aa, Homo Sapiens
VEVVWTVAL

SEQ ID NO: 418511 - protein, 9 aa, Homo Sapiens
LKEMKLIEL

SEQ ID NO: 418512 - protein, 9 aa, Homo Sapiens
QEMCALITC

SEQ ID NO: 418513 - protein, 9 aa, Homo Sapiens
RGGAGPAGW

SEQ ID NO: 418514 - protein, 9 aa, Homo Sapiens
VVLQCIAGG

SEQ ID NO: 418515 - protein, 9 aa, Homo Sapiens
QPQPRSSDL

SEQ ID NO: 418516 - protein, 9 aa, Homo Sapiens
VFGPEDLGG

SEQ ID NO: 418517 - protein, 9 aa, Homo Sapiens
EGNEPGRPL

SEQ ID NO: 418518 - protein, 9 aa, Homo Sapiens
IVHQPARVN

SEQ ID NO: 418519 - protein, 9 aa, Homo Sapiens
CHNRIRQLA

SEQ ID NO: 418520 - protein, 9 aa, Homo Sapiens
AGRRRQDCA

SEQ ID NO: 418521 - protein, 9 aa, Homo Sapiens
PWKALGPML

SEQ ID NO: 418522 - protein, 9 aa, Homo Sapiens
PNTGITVFL

SEQ ID NO: 418523 - protein, 9 aa, Homo Sapiens
DNQPIVKKG

SEQ ID NO: 418524 - protein, 9 aa, Homo Sapiens
GSQMQGEKP

SEQ ID NO: 418525 - protein, 9 aa, Homo Sapiens
LNLKYNLEA

SEQ ID NO: 418526 - protein, 9 aa, Homo Sapiens
VSFLKKVGF

SEQ ID NO: 418527 - protein, 9 aa, Homo Sapiens
TPYQDWAAQ

SEQ ID NO: 418528 - protein, 9 aa, Homo Sapiens
RDHLLADGV

SEQ ID NO: 418529 - protein, 9 aa, Homo Sapiens
RAQDDGRGG

SEQ ID NO: 418530 - protein, 9 aa, Homo Sapiens
RTWPHSRAS

SEQ ID NO: 418531 - protein, 9 aa, Homo Sapiens
NQLQKLPPD

SEQ ID NO: 418532 - protein, 9 aa, Homo Sapiens
LKYNLEANK

SEQ ID NO: 418533 - protein, 9 aa, Homo Sapiens
GTDMWKKND

SEQ ID NO: 418534 - protein, 9 aa, Homo Sapiens
DILDNSGYV

SEQ ID NO: 418535 - protein, 9 aa, Homo Sapiens
EVSLPTALP

SEQ ID NO: 418536 - protein, 9 aa, Homo Sapiens
LEFQNESCR

SEQ ID NO: 418537 - protein, 9 aa, Homo Sapiens
LDQLNALHR

SEQ ID NO: 418538 - protein, 9 aa, Homo Sapiens
LPSISRESP

SEQ ID NO: 418539 - protein, 9 aa, Homo Sapiens
RTSFTCLQI

SEQ ID NO: 418540 - protein, 9 aa, Homo Sapiens
MSSMACGSA

SEQ ID NO: 418541 - protein, 9 aa, Homo Sapiens
MWMDMFPKD

SEQ ID NO: 418542 - protein, 9 aa, Homo Sapiens
EIMELVLAT

SEQ ID NO: 418543 - protein, 9 aa, Homo Sapiens
TREELETRD

SEQ ID NO: 418544 - protein, 9 aa, Homo Sapiens
MLLTPATDA

SEQ ID NO: 418545 - protein, 9 aa, Homo Sapiens
DQRRHAAAR

SEQ ID NO: 418546 - protein, 9 aa, Homo Sapiens
YSLASGAGA

SEQ ID NO: 418547 - protein, 9 aa, Homo Sapiens
MGCVMFEMH

SEQ ID NO: 418548 - protein, 9 aa, Homo Sapiens
FYALVIVCD

SEQ ID NO: 418549 - protein, 9 aa, Homo Sapiens
DYCPQFDAI

SEQ ID NO: 418550 - protein, 9 aa, Homo Sapiens
VNVVVPSMI

SEQ ID NO: 418551 - protein, 9 aa, Homo Sapiens
INTAWSQVI

SEQ ID NO: 418552 - protein, 9 aa, Homo Sapiens
VIPPAVCGE

SEQ ID NO: 418553 - protein, 9 aa, Homo Sapiens
RSSSSNLGV

SEQ ID NO: 418554 - protein, 9 aa, Homo Sapiens
HIFTRCIQV

SEQ ID NO: 418555 - protein, 9 aa, Homo Sapiens
DNGQWAQKC

SEQ ID NO: 418556 - protein, 9 aa, Homo Sapiens
VWALSNVAA

SEQ ID NO: 418557 - protein, 9 aa, Homo Sapiens
LLKVCGRGW

SEQ ID NO: 418558 - protein, 9 aa, Homo Sapiens
GCCTWAPEP

SEQ ID NO: 418559 - protein, 9 aa, Homo Sapiens
FSGETLSFS

SEQ ID NO: 418560 - protein, 9 aa, Homo Sapiens
VPSHKPDQP

SEQ ID NO: 418561 - protein, 9 aa, Homo Sapiens
SLRPVMNHI

SEQ ID NO: 418562 - protein, 9 aa, Homo Sapiens
AILLKEIVL

SEQ ID NO: 418563 - protein, 9 aa, Homo Sapiens
TRGKVDIHL

SEQ ID NO: 418564 - protein, 9 aa, Homo Sapiens
GSDPTAFSI

SEQ ID NO: 418565 - protein, 9 aa, Homo Sapiens
KPKRLSRGV

SEQ ID NO: 418566 - protein, 9 aa, Homo Sapiens
FAVTIGQVH

SEQ ID NO: 418567 - protein, 9 aa, Homo Sapiens
GMPSTHTMA

SEQ ID NO: 418568 - protein, 9 aa, Homo Sapiens
AFKKSKKSS

SEQ ID NO: 418569 - protein, 9 aa, Homo Sapiens
LRPGNPTSH

SEQ ID NO: 418570 - protein, 9 aa, Homo Sapiens
EASHLFPPF

SEQ ID NO: 418571 - protein, 9 aa, Homo Sapiens
LKHFLVLNP

SEQ ID NO: 418572 - protein, 9 aa, Homo Sapiens
KQQDWLEER

SEQ ID NO: 418573 - protein, 9 aa, Homo Sapiens
RGNLRIHEL

SEQ ID NO: 418574 - protein, 9 aa, Homo Sapiens
VVLACQVEH

SEQ ID NO: 418575 - protein, 9 aa, Homo Sapiens
GAPRPKGAK

SEQ ID NO: 418576 - protein, 9 aa, Homo Sapiens
SLASGAGAA

SEQ ID NO: 418577 - protein, 9 aa, Homo Sapiens
VVFFTSPFV

SEQ ID NO: 418578 - protein, 9 aa, Homo Sapiens
ALQAVSDED

SEQ ID NO: 418579 - protein, 9 aa, Homo Sapiens
TSRETCSSS

SEQ ID NO: 418580 - protein, 9 aa, Homo Sapiens
RGASLSGTP

SEQ ID NO: 418581 - protein, 9 aa, Homo Sapiens
GCAKDRKDP

SEQ ID NO: 418582 - protein, 9 aa, Homo Sapiens
LRDTELRQH

SEQ ID NO: 418583 - protein, 9 aa, Homo Sapiens
TMDLFHPMK

SEQ ID NO: 418584 - protein, 9 aa, Homo Sapiens
LQNISDAES

SEQ ID NO: 418585 - protein, 9 aa, Homo Sapiens
DSPSHVPFS

SEQ ID NO: 418586 - protein, 9 aa, Homo Sapiens
LASYGNIIV

SEQ ID NO: 418587 - protein, 9 aa, Homo Sapiens
QISLPLRGF

SEQ ID NO: 418588 - protein, 9 aa, Homo Sapiens
LLVRHCPRA

SEQ ID NO: 418589 - protein, 9 aa, Homo Sapiens
GERRWLALV

SEQ ID NO: 418590 - protein, 9 aa, Homo Sapiens
ERDLPQEQH

SEQ ID NO: 418591 - protein, 9 aa, Homo Sapiens
ALCASSQDE

SEQ ID NO: 418592 - protein, 9 aa, Homo Sapiens
HQAPLTVRH

SEQ ID NO: 418593 - protein, 9 aa, Homo Sapiens
LAPDCEASV

SEQ ID NO: 418594 - protein, 9 aa, Homo Sapiens
RKKIKEKMI

SEQ ID NO: 418595 - protein, 9 aa, Homo Sapiens
CLEHVVEEE

SEQ ID NO: 418596 - protein, 9 aa, Homo Sapiens
QQDWLEERE

SEQ ID NO: 418597 - protein, 9 aa, Homo Sapiens
NVERVLLKA

SEQ ID NO: 418598 - protein, 9 aa, Homo Sapiens
CGGHSPCPL

SEQ ID NO: 418599 - protein, 9 aa, Homo Sapiens
WWKIAKQLC

SEQ ID NO: 418600 - protein, 9 aa, Homo Sapiens
HFFRISLFL

SEQ ID NO: 418601 - protein, 9 aa, Homo Sapiens
IAHRHIELG

SEQ ID NO: 418602 - protein, 9 aa, Homo Sapiens
DEISRQQYC

SEQ ID NO: 418603 - protein, 9 aa, Homo Sapiens
LDQLAAQGA

SEQ ID NO: 418604 - protein, 9 aa, Homo Sapiens
VNKKLGLLC

SEQ ID NO: 418605 - protein, 9 aa, Homo Sapiens
VLVEGGCTQ

SEQ ID NO: 418606 - protein, 9 aa, Homo Sapiens
RSKDKDWDR

SEQ ID NO: 418607 - protein, 9 aa, Homo Sapiens
TRCTCTTTR

SEQ ID NO: 418608 - protein, 9 aa, Homo Sapiens
LTRPPRTWV

SEQ ID NO: 418609 - protein, 9 aa, Homo Sapiens
YWYLLAPRN

SEQ ID NO: 418610 - protein, 9 aa, Homo Sapiens
KNKENQKEQ

SEQ ID NO: 418611 - protein, 9 aa, Homo Sapiens
ALQTSTTRY

SEQ ID NO: 418612 - protein, 9 aa, Homo Sapiens
TKSVASFPK

SEQ ID NO: 418613 - protein, 9 aa, Homo Sapiens
GPVAGTSLQ

SEQ ID NO: 418614 - protein, 9 aa, Homo Sapiens
YPPPSHTCE

SEQ ID NO: 418615 - protein, 9 aa, Homo Sapiens
KSKSGFRLR

SEQ ID NO: 418616 - protein, 9 aa, Homo Sapiens
WCSSLQRHE

SEQ ID NO: 418617 - protein, 9 aa, Homo Sapiens
VQSGPEGRE

SEQ ID NO: 418618 - protein, 9 aa, Homo Sapiens
PYYHHPLNP

SEQ ID NO: 418619 - protein, 9 aa, Homo Sapiens
IFLESPNLP

SEQ ID NO: 418620 - protein, 9 aa, Homo Sapiens
HPATLDTAH

SEQ ID NO: 418621 - protein, 9 aa, Homo Sapiens
VWGGEDSGG

SEQ ID NO: 418622 - protein, 9 aa, Homo Sapiens
EQEEELPQV

SEQ ID NO: 418623 - protein, 9 aa, Homo Sapiens
RNFLPEDPV

SEQ ID NO: 418624 - protein, 9 aa, Homo Sapiens
LCLQNRYLV

SEQ ID NO: 418625 - protein, 9 aa, Homo Sapiens
EFLRQRWAA

SEQ ID NO: 418626 - protein, 9 aa, Homo Sapiens
KGLWERSPG

SEQ ID NO: 418627 - protein, 9 aa, Homo Sapiens
VELPCKVLG

SEQ ID NO: 418628 - protein, 9 aa, Homo Sapiens
QCKGLNYRY

SEQ ID NO: 418629 - protein, 9 aa, Homo Sapiens
WCPPRTPWA

SEQ ID NO: 418630 - protein, 9 aa, Homo Sapiens
SSERCRPLS

SEQ ID NO: 418631 - protein, 9 aa, Homo Sapiens
QLLPLLHSN

SEQ ID NO: 418632 - protein, 9 aa, Homo Sapiens
IAPVAIRDG

SEQ ID NO: 418633 - protein, 9 aa, Homo Sapiens
LTFLLWYLS

SEQ ID NO: 418634 - protein, 9 aa, Homo Sapiens
CNFPPKIVH

SEQ ID NO: 418635 - protein, 9 aa, Homo Sapiens
HVINGGDKP

SEQ ID NO: 418636 - protein, 9 aa, Homo Sapiens
LHGAHWTLP

SEQ ID NO: 418637 - protein, 9 aa, Homo Sapiens
APTPGNNER

SEQ ID NO: 418638 - protein, 9 aa, Homo Sapiens
DHGGWGISP

SEQ ID NO: 418639 - protein, 9 aa, Homo Sapiens
MHFALHYEP

SEQ ID NO: 418640 - protein, 9 aa, Homo Sapiens
WNGKKNAVI

SEQ ID NO: 418641 - protein, 9 aa, Homo Sapiens
KATVATQQD

SEQ ID NO: 418642 - protein, 9 aa, Homo Sapiens
PDFCHCPNT

SEQ ID NO: 418643 - protein, 9 aa, Homo Sapiens
RTGLLPGEA

SEQ ID NO: 418644 - protein, 9 aa, Homo Sapiens
PLKLELWVL

SEQ ID NO: 418645 - protein, 9 aa, Homo Sapiens
CHVSDYSDD

SEQ ID NO: 418646 - protein, 9 aa, Homo Sapiens
EYGMPSTHT

SEQ ID NO: 418647 - protein, 9 aa, Homo Sapiens
STLKSILSA

SEQ ID NO: 418648 - protein, 9 aa, Homo Sapiens
DAVDVKAQH

SEQ ID NO: 418649 - protein, 9 aa, Homo Sapiens
AETMGFPVS

SEQ ID NO: 418650 - protein, 9 aa, Homo Sapiens
FRVGLKVTV

SEQ ID NO: 418651 - protein, 9 aa, Homo Sapiens
SLLVRHCPR

SEQ ID NO: 418652 - protein, 9 aa, Homo Sapiens
YGQSYRVTL

SEQ ID NO: 418653 - protein, 9 aa, Homo Sapiens
INKLESTAC

SEQ ID NO: 418654 - protein, 9 aa, Homo Sapiens
WPSRASSGC

SEQ ID NO: 418655 - protein, 9 aa, Homo Sapiens
PWPLEEVVL

SEQ ID NO: 418656 - protein, 9 aa, Homo Sapiens
VFHLAFRSG

SEQ ID NO: 418657 - protein, 9 aa, Homo Sapiens
GVDSTKNRK

SEQ ID NO: 418658 - protein, 9 aa, Homo Sapiens
VEFLSNLAH

SEQ ID NO: 418659 - protein, 9 aa, Homo Sapiens
APSLGGGRG

SEQ ID NO: 418660 - protein, 9 aa, Homo Sapiens
WRLGLRKMG

SEQ ID NO: 418661 - protein, 9 aa, Homo Sapiens
ALVAQQRQR

SEQ ID NO: 418662 - protein, 9 aa, Homo Sapiens
DEKRYQALK

SEQ ID NO: 418663 - protein, 9 aa, Homo Sapiens
SWGFQEVRK

SEQ ID NO: 418664 - protein, 9 aa, Homo Sapiens
DHKQIYNIL

SEQ ID NO: 418665 - protein, 9 aa, Homo Sapiens
RVNALANNI

SEQ ID NO: 418666 - protein, 9 aa, Homo Sapiens
ANEDIRTKL

SEQ ID NO: 418667 - protein, 9 aa, Homo Sapiens
TTTWHVTTV

SEQ ID NO: 418668 - protein, 9 aa, Homo Sapiens
LHCAHLAKQ

SEQ ID NO: 418669 - protein, 9 aa, Homo Sapiens
PQSRFHRRC

SEQ ID NO: 418670 - protein, 9 aa, Homo Sapiens
GSAAGGGAA

SEQ ID NO: 418671 - protein, 9 aa, Homo Sapiens
SLLPVLQPP

SEQ ID NO: 418672 - protein, 9 aa, Homo Sapiens
CDSVDIFKG

SEQ ID NO: 418673 - protein, 9 aa, Homo Sapiens
ATLEREQWE

SEQ ID NO: 418674 - protein, 9 aa, Homo Sapiens
FRNLKALTH

SEQ ID NO: 418675 - protein, 9 aa, Homo Sapiens
GHHAWAGFE

SEQ ID NO: 418676 - protein, 9 aa, Homo Sapiens
RGTAGGDGH

SEQ ID NO: 418677 - protein, 9 aa, Homo Sapiens
HPALSSCGC

SEQ ID NO: 418678 - protein, 9 aa, Homo Sapiens
DLLLIGGRG

SEQ ID NO: 418679 - protein, 9 aa, Homo Sapiens
EGCISVKDH

SEQ ID NO: 418680 - protein, 9 aa, Homo Sapiens
RSGSGSAAP

SEQ ID NO: 418681 - protein, 9 aa, Homo Sapiens
CIVGCSLAV

SEQ ID NO: 418682 - protein, 9 aa, Homo Sapiens
YIRVHKAIT

SEQ ID NO: 418683 - protein, 9 aa, Homo Sapiens
ETRRPIFEG

SEQ ID NO: 418684 - protein, 9 aa, Homo Sapiens
LPNKVDEEY

SEQ ID NO: 418685 - protein, 9 aa, Homo Sapiens
RDKYTYTKQ

SEQ ID NO: 418686 - protein, 9 aa, Homo Sapiens
PQSIYQMSV

SEQ ID NO: 418687 - protein, 9 aa, Homo Sapiens
IASLNRYRL

SEQ ID NO: 418688 - protein, 9 aa, Homo Sapiens
LLYPQCRLE

SEQ ID NO: 418689 - protein, 9 aa, Homo Sapiens
LSSGNTLQA

SEQ ID NO: 418690 - protein, 9 aa, Homo Sapiens
DWGTMAEER

SEQ ID NO: 418691 - protein, 9 aa, Homo Sapiens
DPWSFVSVG

SEQ ID NO: 418692 - protein, 9 aa, Homo Sapiens
MNTTKTQSN

SEQ ID NO: 418693 - protein, 9 aa, Homo Sapiens
NDMVDDNGV

SEQ ID NO: 418694 - protein, 9 aa, Homo Sapiens
VISKQTFLS

SEQ ID NO: 418695 - protein, 9 aa, Homo Sapiens
KLKLYHLNL

SEQ ID NO: 418696 - protein, 9 aa, Homo Sapiens
TRTHGAPAP

SEQ ID NO: 418697 - protein, 9 aa, Homo Sapiens
ATIALLEPA

SEQ ID NO: 418698 - protein, 9 aa, Homo Sapiens
SQDEPWEEE

SEQ ID NO: 418699 - protein, 9 aa, Homo Sapiens
NMQLARSSF

SEQ ID NO: 418700 - protein, 9 aa, Homo Sapiens
SPEVWALYP

SEQ ID NO: 418701 - protein, 9 aa, Homo Sapiens
VGTGKVTVE

SEQ ID NO: 418702 - protein, 9 aa, Homo Sapiens
SKICRGAQN

SEQ ID NO: 418703 - protein, 9 aa, Homo Sapiens
RRGLSRWGP

SEQ ID NO: 418704 - protein, 9 aa, Homo Sapiens
ASSSCCQQP

SEQ ID NO: 418705 - protein, 9 aa, Homo Sapiens
DYNPSFAIC

SEQ ID NO: 418706 - protein, 9 aa, Homo Sapiens
AVVGQVGCR

SEQ ID NO: 418707 - protein, 9 aa, Homo Sapiens
HLASSSPHT

SEQ ID NO: 418708 - protein, 9 aa, Homo Sapiens
SYYLPPLPP

SEQ ID NO: 418709 - protein, 9 aa, Homo Sapiens
EGETLTFLC

SEQ ID NO: 418710 - protein, 9 aa, Homo Sapiens
QNKGQKQSF

SEQ ID NO: 418711 - protein, 9 aa, Homo Sapiens
SCYFFLPLA

SEQ ID NO: 418712 - protein, 9 aa, Homo Sapiens
QQVLEVESV

SEQ ID NO: 418713 - protein, 9 aa, Homo Sapiens
PSSWTSPPH

SEQ ID NO: 418714 - protein, 9 aa, Homo Sapiens
VVEQDKLLK

SEQ ID NO: 418715 - protein, 9 aa, Homo Sapiens
HLEGEGLKM

SEQ ID NO: 418716 - protein, 9 aa, Homo Sapiens
DYLRRHYDG

SEQ ID NO: 418717 - protein, 9 aa, Homo Sapiens
GYPGIPMGA

SEQ ID NO: 418718 - protein, 9 aa, Homo Sapiens
ELLSPPKHT

SEQ ID NO: 418719 - protein, 9 aa, Homo Sapiens
LSLLPVLQP

SEQ ID NO: 418720 - protein, 9 aa, Homo Sapiens
STLKAGELH

SEQ ID NO: 418721 - protein, 9 aa, Homo Sapiens
VAQGTTGTA

SEQ ID NO: 418722 - protein, 9 aa, Homo Sapiens
VGRRGPDGV

SEQ ID NO: 418723 - protein, 9 aa, Homo Sapiens
KFAKATVAT

SEQ ID NO: 418724 - protein, 9 aa, Homo Sapiens
DTLKLLYSG

SEQ ID NO: 418725 - protein, 9 aa, Homo Sapiens
LDAYPYPLP

SEQ ID NO: 418726 - protein, 9 aa, Homo Sapiens
ASGGSGGCQ

SEQ ID NO: 418727 - protein, 9 aa, Homo Sapiens
DTKNLYLLA

SEQ ID NO: 418728 - protein, 9 aa, Homo Sapiens
ERAADDPRR

SEQ ID NO: 418729 - protein, 9 aa, Homo Sapiens
VKEITCDIK

SEQ ID NO: 418730 - protein, 9 aa, Homo Sapiens
SKWCRPWLE

SEQ ID NO: 418731 - protein, 9 aa, Homo Sapiens
HQAIHGIWK

SEQ ID NO: 418732 - protein, 9 aa, Homo Sapiens
MTTLPSWAR

SEQ ID NO: 418733 - protein, 9 aa, Homo Sapiens
THTHTHALQ

SEQ ID NO: 418734 - protein, 9 aa, Homo Sapiens
VTDMSPGGG

SEQ ID NO: 418735 - protein, 9 aa, Homo Sapiens
YHHSSLVKR

SEQ ID NO: 418736 - protein, 9 aa, Homo Sapiens
TNIGRVCDT

SEQ ID NO: 418737 - protein, 9 aa, Homo Sapiens
EGGGTSAMN

SEQ ID NO: 418738 - protein, 9 aa, Homo Sapiens
QAICGVGHL

SEQ ID NO: 418739 - protein, 9 aa, Homo Sapiens
GVRSLWVIV

SEQ ID NO: 418740 - protein, 9 aa, Homo Sapiens
SISAPVIFD

SEQ ID NO: 418741 - protein, 9 aa, Homo Sapiens
GMGSLNQLQ

SEQ ID NO: 418742 - protein, 9 aa, Homo Sapiens
GVFVNGQPL

SEQ ID NO: 418743 - protein, 9 aa, Homo Sapiens
ELPVVLLHK

SEQ ID NO: 418744 - protein, 9 aa, Homo Sapiens
PDIQFHFLS

SEQ ID NO: 418745 - protein, 9 aa, Homo Sapiens
DEKDYPTST

SEQ ID NO: 418746 - protein, 9 aa, Homo Sapiens
NISDAESCY

SEQ ID NO: 418747 - protein, 9 aa, Homo Sapiens
QIYPPSTCS

SEQ ID NO: 418748 - protein, 9 aa, Homo Sapiens
SLGRSSPTD

SEQ ID NO: 418749 - protein, 9 aa, Homo Sapiens
TARASEKSP

SEQ ID NO: 418750 - protein, 9 aa, Homo Sapiens
IRRQSWLRP

SEQ ID NO: 418751 - protein, 9 aa, Homo Sapiens
NLESCVALE

SEQ ID NO: 418752 - protein, 9 aa, Homo Sapiens
LRVPPPSWP

SEQ ID NO: 418753 - protein, 9 aa, Homo Sapiens
LIHDRSVSR

SEQ ID NO: 418754 - protein, 9 aa, Homo Sapiens
YVLANTSVF

SEQ ID NO: 418755 - protein, 9 aa, Homo Sapiens
ASSLSGASK

SEQ ID NO: 418756 - protein, 9 aa, Homo Sapiens
FSTPATSLH

SEQ ID NO: 418757 - protein, 9 aa, Homo Sapiens
NHFFVTPQL

SEQ ID NO: 418758 - protein, 9 aa, Homo Sapiens
MHFAFGNGC

SEQ ID NO: 418759 - protein, 9 aa, Homo Sapiens
FIAHRHIEL

SEQ ID NO: 418760 - protein, 9 aa, Homo Sapiens
CYLQLAGIM

SEQ ID NO: 418761 - protein, 9 aa, Homo Sapiens
GAGPAGWAG

SEQ ID NO: 418762 - protein, 9 aa, Homo Sapiens
VMRGISCLV

SEQ ID NO: 418763 - protein, 9 aa, Homo Sapiens
VVTAWDGGS

SEQ ID NO: 418764 - protein, 9 aa, Homo Sapiens
LVKIWKEKL

SEQ ID NO: 418765 - protein, 9 aa, Homo Sapiens
WGCLPSPIT

SEQ ID NO: 418766 - protein, 9 aa, Homo Sapiens
LLDVKAWLE

SEQ ID NO: 418767 - protein, 9 aa, Homo Sapiens
GNHTHSRDI

SEQ ID NO: 418768 - protein, 9 aa, Homo Sapiens
NKENQKEQT

SEQ ID NO: 418769 - protein, 9 aa, Homo Sapiens
RDRCERSRS

SEQ ID NO: 418770 - protein, 9 aa, Homo Sapiens
SAGPCVRTW

SEQ ID NO: 418771 - protein, 9 aa, Homo Sapiens
LGLTISVSS

SEQ ID NO: 418772 - protein, 9 aa, Homo Sapiens
QWCNVVCWE

SEQ ID NO: 418773 - protein, 9 aa, Homo Sapiens
QGGLGGHGQ

SEQ ID NO: 418774 - protein, 9 aa, Homo Sapiens
MVVTSSIIL

SEQ ID NO: 418775 - protein, 9 aa, Homo Sapiens
PEKHTIKLT

SEQ ID NO: 418776 - protein, 9 aa, Homo Sapiens
EPGDGGEKC

SEQ ID NO: 418777 - protein, 9 aa, Homo Sapiens
TGQECFNII

SEQ ID NO: 418778 - protein, 9 aa, Homo Sapiens
ALRDIQTGA

SEQ ID NO: 418779 - protein, 9 aa, Homo Sapiens
SAWSLTSSL

SEQ ID NO: 418780 - protein, 9 aa, Homo Sapiens
GKAFGRFSH

SEQ ID NO: 418781 - protein, 9 aa, Homo Sapiens
TTPKPRGGG

SEQ ID NO: 418782 - protein, 9 aa, Homo Sapiens
AVAHIAGFL

SEQ ID NO: 418783 - protein, 9 aa, Homo Sapiens
LPGKPDKSS

SEQ ID NO: 418784 - protein, 9 aa, Homo Sapiens
QELQYHCSH

SEQ ID NO: 418785 - protein, 9 aa, Homo Sapiens
GTTIGEVTS

SEQ ID NO: 418786 - protein, 9 aa, Homo Sapiens
SVKTNPQCH

SEQ ID NO: 418787 - protein, 9 aa, Homo Sapiens
SMINYVLFY

SEQ ID NO: 418788 - protein, 9 aa, Homo Sapiens
LYSAMPGRL

SEQ ID NO: 418789 - protein, 9 aa, Homo Sapiens
PFPNRLEWR

SEQ ID NO: 418790 - protein, 9 aa, Homo Sapiens
RGHHRDRCE

SEQ ID NO: 418791 - protein, 9 aa, Homo Sapiens
QVPQQEAAL

SEQ ID NO: 418792 - protein, 9 aa, Homo Sapiens
DNFWEMGDM

SEQ ID NO: 418793 - protein, 9 aa, Homo Sapiens
RGPHWRGAL

SEQ ID NO: 418794 - protein, 9 aa, Homo Sapiens
PALQNPAPV

SEQ ID NO: 418795 - protein, 9 aa, Homo Sapiens
PFELDPEDM

SEQ ID NO: 418796 - protein, 9 aa, Homo Sapiens
VQCAIRKYT

SEQ ID NO: 418797 - protein, 9 aa, Homo Sapiens
GLWERSPGH

SEQ ID NO: 418798 - protein, 9 aa, Homo Sapiens
SGMAQDCSK

SEQ ID NO: 418799 - protein, 9 aa, Homo Sapiens
PARTQTQTR

SEQ ID NO: 418800 - protein, 9 aa, Homo Sapiens
KDEEIVSPP

SEQ ID NO: 418801 - protein, 9 aa, Homo Sapiens
PLPQLLGPP

SEQ ID NO: 418802 - protein, 9 aa, Homo Sapiens
RYGKPILAT

SEQ ID NO: 418803 - protein, 9 aa, Homo Sapiens
NYTSSLNSP

SEQ ID NO: 418804 - protein, 9 aa, Homo Sapiens
VRSPSTNVA

SEQ ID NO: 418805 - protein, 9 aa, Homo Sapiens
MFEDMEKCF

SEQ ID NO: 418806 - protein, 9 aa, Homo Sapiens
GGVRPGPCE

SEQ ID NO: 418807 - protein, 9 aa, Homo Sapiens
TKIYYCSQT

SEQ ID NO: 418808 - protein, 9 aa, Homo Sapiens
AHTTLLLKA

SEQ ID NO: 418809 - protein, 9 aa, Homo Sapiens
DKKKKEMMK

SEQ ID NO: 418810 - protein, 9 aa, Homo Sapiens
NFPPKIVHG

SEQ ID NO: 418811 - protein, 9 aa, Homo Sapiens
RNAGKLSPS

SEQ ID NO: 418812 - protein, 9 aa, Homo Sapiens
SVVVLYSVE

SEQ ID NO: 418813 - protein, 9 aa, Homo Sapiens
PGCPRARCA

SEQ ID NO: 418814 - protein, 9 aa, Homo Sapiens
RCWSSSRRW

SEQ ID NO: 418815 - protein, 9 aa, Homo Sapiens
NDSLCQGGN

SEQ ID NO: 418816 - protein, 9 aa, Homo Sapiens
GCPAHPQDP

SEQ ID NO: 418817 - protein, 9 aa, Homo Sapiens
PYPPFMPQR

SEQ ID NO: 418818 - protein, 9 aa, Homo Sapiens
SVCQDVRCR

SEQ ID NO: 418819 - protein, 9 aa, Homo Sapiens
QQIFWPCDL

SEQ ID NO: 418820 - protein, 9 aa, Homo Sapiens
GQTRPSLQK

SEQ ID NO: 418821 - protein, 9 aa, Homo Sapiens
KAELAKKQK

SEQ ID NO: 418822 - protein, 9 aa, Homo Sapiens
SICVFLVRR

SEQ ID NO: 418823 - protein, 9 aa, Homo Sapiens
RGSPEESRW

SEQ ID NO: 418824 - protein, 9 aa, Homo Sapiens
LHWCSDDFD

SEQ ID NO: 418825 - protein, 9 aa, Homo Sapiens
IFFRVMRGI

SEQ ID NO: 418826 - protein, 9 aa, Homo Sapiens
VNMGGNRSI

SEQ ID NO: 418827 - protein, 9 aa, Homo Sapiens
ACVPVAEAS

SEQ ID NO: 418828 - protein, 9 aa, Homo Sapiens
LGLALPWEL

SEQ ID NO: 418829 - protein, 9 aa, Homo Sapiens
IQTTGPVTL

SEQ ID NO: 418830 - protein, 9 aa, Homo Sapiens
PAKKNKENQ

SEQ ID NO: 418831 - protein, 9 aa, Homo Sapiens
IIAITIFFC

SEQ ID NO: 418832 - protein, 9 aa, Homo Sapiens
SILIHDRSV

SEQ ID NO: 418833 - protein, 9 aa, Homo Sapiens
HQLVVHAGC

SEQ ID NO: 418834 - protein, 9 aa, Homo Sapiens
TMRAPETAA

SEQ ID NO: 418835 - protein, 9 aa, Homo Sapiens
VCVTLLNCL

SEQ ID NO: 418836 - protein, 9 aa, Homo Sapiens
RRLSVYWQI

SEQ ID NO: 418837 - protein, 9 aa, Homo Sapiens
VELRGQLLG

SEQ ID NO: 418838 - protein, 9 aa, Homo Sapiens
TFWGYCVQV

SEQ ID NO: 418839 - protein, 9 aa, Homo Sapiens
EERERAWLR

SEQ ID NO: 418840 - protein, 9 aa, Homo Sapiens
RLCPHILDR

SEQ ID NO: 418841 - protein, 9 aa, Homo Sapiens
CCQQPSCQP

SEQ ID NO: 418842 - protein, 9 aa, Homo Sapiens
VSRHSQEPP

SEQ ID NO: 418843 - protein, 9 aa, Homo Sapiens
RATASRGPS

SEQ ID NO: 418844 - protein, 9 aa, Homo Sapiens
HLPNMNQLV

SEQ ID NO: 418845 - protein, 9 aa, Homo Sapiens
NSGYVSAYK

SEQ ID NO: 418846 - protein, 9 aa, Homo Sapiens
EGSPLELEH

SEQ ID NO: 418847 - protein, 9 aa, Homo Sapiens
LPWSRSWWW

SEQ ID NO: 418848 - protein, 9 aa, Homo Sapiens
EPTVALLHW

SEQ ID NO: 418849 - protein, 9 aa, Homo Sapiens
SEGPYGVFA

SEQ ID NO: 418850 - protein, 9 aa, Homo Sapiens
QLLSCANLA

SEQ ID NO: 418851 - protein, 9 aa, Homo Sapiens
RLDGLTPPT

SEQ ID NO: 418852 - protein, 9 aa, Homo Sapiens
FFCMDKDIQ

SEQ ID NO: 418853 - protein, 9 aa, Homo Sapiens
DSLKQRLNI

SEQ ID NO: 418854 - protein, 9 aa, Homo Sapiens
RATSNTEEI

SEQ ID NO: 418855 - protein, 9 aa, Homo Sapiens
HRSGKQLNL

SEQ ID NO: 418856 - protein, 9 aa, Homo Sapiens
LPISLGSMP

SEQ ID NO: 418857 - protein, 9 aa, Homo Sapiens
SNAVGRRGP

SEQ ID NO: 418858 - protein, 9 aa, Homo Sapiens
ARTRYIPCT

SEQ ID NO: 418859 - protein, 9 aa, Homo Sapiens
HNLNLDTWE

SEQ ID NO: 418860 - protein, 9 aa, Homo Sapiens
QVRDLYHKR

SEQ ID NO: 418861 - protein, 9 aa, Homo Sapiens
ASTKLSRVT

SEQ ID NO: 418862 - protein, 9 aa, Homo Sapiens
QLLLHLEEL

SEQ ID NO: 418863 - protein, 9 aa, Homo Sapiens
GRMATLERQ

SEQ ID NO: 418864 - protein, 9 aa, Homo Sapiens
PPPVTPLRV

SEQ ID NO: 418865 - protein, 9 aa, Homo Sapiens
KGMLQKFLD

SEQ ID NO: 418866 - protein, 9 aa, Homo Sapiens
LSGASKEGS

SEQ ID NO: 418867 - protein, 9 aa, Homo Sapiens
SPLMWGMGM

SEQ ID NO: 418868 - protein, 9 aa, Homo Sapiens
QELSHTLYQ

SEQ ID NO: 418869 - protein, 9 aa, Homo Sapiens
DYGAFGTDT

SEQ ID NO: 418870 - protein, 9 aa, Homo Sapiens
ASFWPFGPI

SEQ ID NO: 418871 - protein, 9 aa, Homo Sapiens
PGLELPVVL

SEQ ID NO: 418872 - protein, 9 aa, Homo Sapiens
QNLALVWAP

SEQ ID NO: 418873 - protein, 9 aa, Homo Sapiens
LCGLKRKWI

SEQ ID NO: 418874 - protein, 9 aa, Homo Sapiens
PRTSFTCLQ

SEQ ID NO: 418875 - protein, 9 aa, Homo Sapiens
PVVVPTPIP

SEQ ID NO: 418876 - protein, 9 aa, Homo Sapiens
PRASLRATV

SEQ ID NO: 418877 - protein, 9 aa, Homo Sapiens
GGTDTMSAS

SEQ ID NO: 418878 - protein, 9 aa, Homo Sapiens
VMLLSPTCL

SEQ ID NO: 418879 - protein, 9 aa, Homo Sapiens
VSWTPCLDC

SEQ ID NO: 418880 - protein, 9 aa, Homo Sapiens
WYRAPKVIL

SEQ ID NO: 418881 - protein, 9 aa, Homo Sapiens
VLPVVGGPG

SEQ ID NO: 418882 - protein, 9 aa, Homo Sapiens
VPQQEAALR

SEQ ID NO: 418883 - protein, 9 aa, Homo Sapiens
TCPWTTHLW

SEQ ID NO: 418884 - protein, 9 aa, Homo Sapiens
TSPHSPGVR

SEQ ID NO: 418885 - protein, 9 aa, Homo Sapiens
VPQNHLLGP

SEQ ID NO: 418886 - protein, 9 aa, Homo Sapiens
ERYDIMGRN

SEQ ID NO: 418887 - protein, 9 aa, Homo Sapiens
QQALQDDGS

SEQ ID NO: 418888 - protein, 9 aa, Homo Sapiens
SRVTFIITN

SEQ ID NO: 418889 - protein, 9 aa, Homo Sapiens
AGTKPCMAP

SEQ ID NO: 418890 - protein, 9 aa, Homo Sapiens
IGGRGQKIA

SEQ ID NO: 418891 - protein, 9 aa, Homo Sapiens
MLIDFYDNQ

SEQ ID NO: 418892 - protein, 9 aa, Homo Sapiens
FPQSIYQMS

SEQ ID NO: 418893 - protein, 9 aa, Homo Sapiens
CVDVRKNHH

SEQ ID NO: 418894 - protein, 9 aa, Homo Sapiens
TEDKKNGIW

SEQ ID NO: 418895 - protein, 9 aa, Homo Sapiens
FCICTIPKF

SEQ ID NO: 418896 - protein, 9 aa, Homo Sapiens
MDELHRELP

SEQ ID NO: 418897 - protein, 9 aa, Homo Sapiens
PKIVHGHYK

SEQ ID NO: 418898 - protein, 9 aa, Homo Sapiens
RKNGGGLKR

SEQ ID NO: 418899 - protein, 9 aa, Homo Sapiens
PLVFALKAL

SEQ ID NO: 418900 - protein, 9 aa, Homo Sapiens
NNNELLLQN

SEQ ID NO: 418901 - protein, 9 aa, Homo Sapiens
LPGEAAQPL

SEQ ID NO: 418902 - protein, 9 aa, Homo Sapiens
KLKNQIRSG

SEQ ID NO: 418903 - protein, 9 aa, Homo Sapiens
FSSPGALEV

SEQ ID NO: 418904 - protein, 9 aa, Homo Sapiens
ALKIWEELL

SEQ ID NO: 418905 - protein, 9 aa, Homo Sapiens
FVLAPLFMY

SEQ ID NO: 418906 - protein, 9 aa, Homo Sapiens
SHNLDFAPG

SEQ ID NO: 418907 - protein, 9 aa, Homo Sapiens
VGSVLGSPD

SEQ ID NO: 418908 - protein, 9 aa, Homo Sapiens
GGQRCRCVC

SEQ ID NO: 418909 - protein, 9 aa, Homo Sapiens
KEIERRKLE

SEQ ID NO: 418910 - protein, 9 aa, Homo Sapiens
ADENRAYLM

SEQ ID NO: 418911 - protein, 9 aa, Homo Sapiens
DLDLEDIVH

SEQ ID NO: 418912 - protein, 9 aa, Homo Sapiens
ATSPHSPGV

SEQ ID NO: 418913 - protein, 9 aa, Homo Sapiens
LRASVDAKK

SEQ ID NO: 418914 - protein, 9 aa, Homo Sapiens
IGGGVARVE

SEQ ID NO: 418915 - protein, 9 aa, Homo Sapiens
RTEATAAAP

SEQ ID NO: 418916 - protein, 9 aa, Homo Sapiens
PIGLQKKRQ

SEQ ID NO: 418917 - protein, 9 aa, Homo Sapiens
LVTSHYVTT

SEQ ID NO: 418918 - protein, 9 aa, Homo Sapiens
SSRRWRCLP

SEQ ID NO: 418919 - protein, 9 aa, Homo Sapiens
LGIVSVPAP

SEQ ID NO: 418920 - protein, 9 aa, Homo Sapiens
YKETVGLNF

SEQ ID NO: 418921 - protein, 9 aa, Homo Sapiens
RPPPPLKSA

SEQ ID NO: 418922 - protein, 9 aa, Homo Sapiens
VLREYKALK

SEQ ID NO: 418923 - protein, 9 aa, Homo Sapiens
PFSQLICMK

SEQ ID NO: 418924 - protein, 9 aa, Homo Sapiens
RHISMESLC

SEQ ID NO: 418925 - protein, 9 aa, Homo Sapiens
PLSLQWNMM

SEQ ID NO: 418926 - protein, 9 aa, Homo Sapiens
HQNLDPTSS

SEQ ID NO: 418927 - protein, 9 aa, Homo Sapiens
VLHILGTQE

SEQ ID NO: 418928 - protein, 9 aa, Homo Sapiens
ERNCCSEDC

SEQ ID NO: 418929 - protein, 9 aa, Homo Sapiens
DTMMLNVQN

SEQ ID NO: 418930 - protein, 9 aa, Homo Sapiens
RIPDATRSG

SEQ ID NO: 418931 - protein, 9 aa, Homo Sapiens
WQHQELEHA

SEQ ID NO: 418932 - protein, 9 aa, Homo Sapiens
PVPKKRERM

SEQ ID NO: 418933 - protein, 9 aa, Homo Sapiens
VCRSCCWAT

SEQ ID NO: 418934 - protein, 9 aa, Homo Sapiens
TLLAAKKSF

SEQ ID NO: 418935 - protein, 9 aa, Homo Sapiens
SVKFTSGNT

SEQ ID NO: 418936 - protein, 9 aa, Homo Sapiens
RCPPRAPAP

SEQ ID NO: 418937 - protein, 9 aa, Homo Sapiens
GGLGGKRSL

SEQ ID NO: 418938 - protein, 9 aa, Homo Sapiens
SMTTISRAT

SEQ ID NO: 418939 - protein, 9 aa, Homo Sapiens
VLCCKQLSI

SEQ ID NO: 418940 - protein, 9 aa, Homo Sapiens
CCKQLSIRS

SEQ ID NO: 418941 - protein, 9 aa, Homo Sapiens
EGHGGGGSA

SEQ ID NO: 418942 - protein, 9 aa, Homo Sapiens
LPGRLFRLL

SEQ ID NO: 418943 - protein, 9 aa, Homo Sapiens
ACTSKAWTP

SEQ ID NO: 418944 - protein, 9 aa, Homo Sapiens
RSSQSRSPV

SEQ ID NO: 418945 - protein, 9 aa, Homo Sapiens
PPPISKSEI

SEQ ID NO: 418946 - protein, 9 aa, Homo Sapiens
DPELSPVML

SEQ ID NO: 418947 - protein, 9 aa, Homo Sapiens
GPPRALQTS

SEQ ID NO: 418948 - protein, 9 aa, Homo Sapiens
PLRGDPGVI

SEQ ID NO: 418949 - protein, 9 aa, Homo Sapiens
SRDGGWGWR

SEQ ID NO: 418950 - protein, 9 aa, Homo Sapiens
YMKEDIPWM

SEQ ID NO: 418951 - protein, 9 aa, Homo Sapiens
PAAPLAPPA

SEQ ID NO: 418952 - protein, 9 aa, Homo Sapiens
GAAGGGNPC

SEQ ID NO: 418953 - protein, 9 aa, Homo Sapiens
RELQLLNVT

SEQ ID NO: 418954 - protein, 9 aa, Homo Sapiens
SSPLPGRGA

SEQ ID NO: 418955 - protein, 9 aa, Homo Sapiens
GMMGGVRPG

SEQ ID NO: 418956 - protein, 9 aa, Homo Sapiens
DCDANVLLL

SEQ ID NO: 418957 - protein, 9 aa, Homo Sapiens
GVQFVLGRL

SEQ ID NO: 418958 - protein, 9 aa, Homo Sapiens
ELFSFFSGH

SEQ ID NO: 418959 - protein, 9 aa, Homo Sapiens
CKRFFKFCI

SEQ ID NO: 418960 - protein, 9 aa, Homo Sapiens
LGVLQAKAD

SEQ ID NO: 418961 - protein, 9 aa, Homo Sapiens
TECVRTALN

SEQ ID NO: 418962 - protein, 9 aa, Homo Sapiens
RPTGRTPTT

SEQ ID NO: 418963 - protein, 9 aa, Homo Sapiens
GRSCVSSRG

SEQ ID NO: 418964 - protein, 9 aa, Homo Sapiens
HQILAINHG

SEQ ID NO: 418965 - protein, 9 aa, Homo Sapiens
YESLKAGGC

SEQ ID NO: 418966 - protein, 9 aa, Homo Sapiens
VATWAVSHE

SEQ ID NO: 418967 - protein, 9 aa, Homo Sapiens
VYCQCRQPL

SEQ ID NO: 418968 - protein, 9 aa, Homo Sapiens
LVGCVEFFS

SEQ ID NO: 418969 - protein, 9 aa, Homo Sapiens
SPSRRRAPP

SEQ ID NO: 418970 - protein, 9 aa, Homo Sapiens
QKEAVWALS

SEQ ID NO: 418971 - protein, 9 aa, Homo Sapiens
CAFLRTPLN

SEQ ID NO: 418972 - protein, 9 aa, Homo Sapiens
NNISNFLRK

SEQ ID NO: 418973 - protein, 9 aa, Homo Sapiens
REGPVKSFS

SEQ ID NO: 418974 - protein, 9 aa, Homo Sapiens
PCASLLSTL

SEQ ID NO: 418975 - protein, 9 aa, Homo Sapiens
SELLMVPDG

SEQ ID NO: 418976 - protein, 9 aa, Homo Sapiens
WSSEAWDSE

SEQ ID NO: 418977 - protein, 9 aa, Homo Sapiens
VHSLSSTGS

SEQ ID NO: 418978 - protein, 9 aa, Homo Sapiens
GHSMNPRAM

SEQ ID NO: 418979 - protein, 9 aa, Homo Sapiens
VLANTSVFG

SEQ ID NO: 418980 - protein, 9 aa, Homo Sapiens
YVFFTTMVV

SEQ ID NO: 418981 - protein, 9 aa, Homo Sapiens
LSHLRCRDD

SEQ ID NO: 418982 - protein, 9 aa, Homo Sapiens
FSLQLGDAG

SEQ ID NO: 418983 - protein, 9 aa, Homo Sapiens
LEEPRKGLW

SEQ ID NO: 418984 - protein, 9 aa, Homo Sapiens
RLRLRLPRT

SEQ ID NO: 418985 - protein, 9 aa, Homo Sapiens
LLQDLEKER

SEQ ID NO: 418986 - protein, 9 aa, Homo Sapiens
QPNGPAAGN

SEQ ID NO: 418987 - protein, 9 aa, Homo Sapiens
GLHNQYTEN

SEQ ID NO: 418988 - protein, 9 aa, Homo Sapiens
GVFLENMGA

SEQ ID NO: 418989 - protein, 9 aa, Homo Sapiens
ARQLQAICG

SEQ ID NO: 418990 - protein, 9 aa, Homo Sapiens
FIILERGQI

SEQ ID NO: 418991 - protein, 9 aa, Homo Sapiens
MSNGENAIE

SEQ ID NO: 418992 - protein, 9 aa, Homo Sapiens
VATSPPATA

SEQ ID NO: 418993 - protein, 9 aa, Homo Sapiens
WKIKIQNQK

SEQ ID NO: 418994 - protein, 9 aa, Homo Sapiens
LHLLLICDN

SEQ ID NO: 418995 - protein, 9 aa, Homo Sapiens
ESDAGHVAA

SEQ ID NO: 418996 - protein, 9 aa, Homo Sapiens
SKCVSSAMF

SEQ ID NO: 418997 - protein, 9 aa, Homo Sapiens
GGYISSEEF

SEQ ID NO: 418998 - protein, 9 aa, Homo Sapiens
ITKVLGTPT

SEQ ID NO: 418999 - protein, 9 aa, Homo Sapiens
GFAQKSNMK

SEQ ID NO: 419000 - protein, 9 aa, Homo Sapiens
NPPSWREEV

SEQ ID NO: 419001 - protein, 9 aa, Homo Sapiens
LHQVIVRPV

SEQ ID NO: 419002 - protein, 9 aa, Homo Sapiens
EKQGCSVQH

SEQ ID NO: 419003 - protein, 9 aa, Homo Sapiens
KPPGASTSS

SEQ ID NO: 419004 - protein, 9 aa, Homo Sapiens
RKWRPGASR

SEQ ID NO: 419005 - protein, 9 aa, Homo Sapiens
LSLVESFAV

SEQ ID NO: 419006 - protein, 9 aa, Homo Sapiens
HNIQASERV

SEQ ID NO: 419007 - protein, 9 aa, Homo Sapiens
YAEDGDHGI

SEQ ID NO: 419008 - protein, 9 aa, Homo Sapiens
PPRAPIGME

SEQ ID NO: 419009 - protein, 9 aa, Homo Sapiens
VELDVQELL

SEQ ID NO: 419010 - protein, 9 aa, Homo Sapiens
HSRASTRSR

SEQ ID NO: 419011 - protein, 9 aa, Homo Sapiens
HKQVQGGID

SEQ ID NO: 419012 - protein, 9 aa, Homo Sapiens
SCPPLLEAF

SEQ ID NO: 419013 - protein, 9 aa, Homo Sapiens
RATLTRPPR

SEQ ID NO: 419014 - protein, 9 aa, Homo Sapiens
IPRSPSPRS

SEQ ID NO: 419015 - protein, 9 aa, Homo Sapiens
KFAPFFVPM

SEQ ID NO: 419016 - protein, 9 aa, Homo Sapiens
EAEAASPRK

SEQ ID NO: 419017 - protein, 9 aa, Homo Sapiens
AATRRPSRL

SEQ ID NO: 419018 - protein, 9 aa, Homo Sapiens
AFLQGLQDD

SEQ ID NO: 419019 - protein, 9 aa, Homo Sapiens
SPPRAPIGM

SEQ ID NO: 419020 - protein, 9 aa, Homo Sapiens
YRECNQYSW

SEQ ID NO: 419021 - protein, 9 aa, Homo Sapiens
RAPLNVTST

SEQ ID NO: 419022 - protein, 9 aa, Homo Sapiens
RQVEFVRIG

SEQ ID NO: 419023 - protein, 9 aa, Homo Sapiens
LDLRQLRTV

SEQ ID NO: 419024 - protein, 9 aa, Homo Sapiens
DIKQTGIMF

SEQ ID NO: 419025 - protein, 9 aa, Homo Sapiens
LLGKDTMSD

SEQ ID NO: 419026 - protein, 9 aa, Homo Sapiens
VMRSIHGMG

SEQ ID NO: 419027 - protein, 9 aa, Homo Sapiens
EFRRFQRDN

SEQ ID NO: 419028 - protein, 9 aa, Homo Sapiens
ARATASRGP

SEQ ID NO: 419029 - protein, 9 aa, Homo Sapiens
PRLPSQPAV

SEQ ID NO: 419030 - protein, 9 aa, Homo Sapiens
KMQRSPGPM

SEQ ID NO: 419031 - protein, 9 aa, Homo Sapiens
AASTSYYRR

SEQ ID NO: 419032 - protein, 9 aa, Homo Sapiens
IRIFCLASA

SEQ ID NO: 419033 - protein, 9 aa, Homo Sapiens
QSRFHRRCW

SEQ ID NO: 419034 - protein, 9 aa, Homo Sapiens
TLNSHFMRL

SEQ ID NO: 419035 - protein, 9 aa, Homo Sapiens
SDGGKLPGS

SEQ ID NO: 419036 - protein, 9 aa, Homo Sapiens
HYVPLWKVH

SEQ ID NO: 419037 - protein, 9 aa, Homo Sapiens
SPSCLMDSA

SEQ ID NO: 419038 - protein, 9 aa, Homo Sapiens
QGWAPPAAS

SEQ ID NO: 419039 - protein, 9 aa, Homo Sapiens
GALVGPLAR

SEQ ID NO: 419040 - protein, 9 aa, Homo Sapiens
SGAGAAAAR

SEQ ID NO: 419041 - protein, 9 aa, Homo Sapiens
ALPSTAAPR

SEQ ID NO: 419042 - protein, 9 aa, Homo Sapiens
GMGNFKLIS

SEQ ID NO: 419043 - protein, 9 aa, Homo Sapiens
NSSDQEGNI

SEQ ID NO: 419044 - protein, 9 aa, Homo Sapiens
FSSEQWSET

SEQ ID NO: 419045 - protein, 9 aa, Homo Sapiens
SCPFQSPTK

SEQ ID NO: 419046 - protein, 9 aa, Homo Sapiens
WLGHPLRSA

SEQ ID NO: 419047 - protein, 9 aa, Homo Sapiens
KHSSQKIIF

SEQ ID NO: 419048 - protein, 9 aa, Homo Sapiens
TLKLLYSGV

SEQ ID NO: 419049 - protein, 9 aa, Homo Sapiens
SCITAATQD

SEQ ID NO: 419050 - protein, 9 aa, Homo Sapiens
ALLCLTLQE

SEQ ID NO: 419051 - protein, 9 aa, Homo Sapiens
LRGLNDLLL

SEQ ID NO: 419052 - protein, 9 aa, Homo Sapiens
MPSEQVLQE

SEQ ID NO: 419053 - protein, 9 aa, Homo Sapiens
LKKLMADLL

SEQ ID NO: 419054 - protein, 9 aa, Homo Sapiens
CDLKNYNKN

SEQ ID NO: 419055 - protein, 9 aa, Homo Sapiens
GHSPCSVGG

SEQ ID NO: 419056 - protein, 9 aa, Homo Sapiens
SWATHYIGD

SEQ ID NO: 419057 - protein, 9 aa, Homo Sapiens
EISRQQYCR

SEQ ID NO: 419058 - protein, 9 aa, Homo Sapiens
TKGRKFYGS

SEQ ID NO: 419059 - protein, 9 aa, Homo Sapiens
RSAPGATPR

SEQ ID NO: 419060 - protein, 9 aa, Homo Sapiens
TSKEEEERH

SEQ ID NO: 419061 - protein, 9 aa, Homo Sapiens
NLQMEQLTL

SEQ ID NO: 419062 - protein, 9 aa, Homo Sapiens
RRRAPQHES

SEQ ID NO: 419063 - protein, 9 aa, Homo Sapiens
LKMSFLPTV

SEQ ID NO: 419064 - protein, 9 aa, Homo Sapiens
VASGLRTCP

SEQ ID NO: 419065 - protein, 9 aa, Homo Sapiens
ERLECMDSN

SEQ ID NO: 419066 - protein, 9 aa, Homo Sapiens
EELPQVWTG

SEQ ID NO: 419067 - protein, 9 aa, Homo Sapiens
FSLLCLLGE

SEQ ID NO: 419068 - protein, 9 aa, Homo Sapiens
LSQPPPQAP

SEQ ID NO: 419069 - protein, 9 aa, Homo Sapiens
PGLQCLPLP

SEQ ID NO: 419070 - protein, 9 aa, Homo Sapiens
FLRQRWAAV

SEQ ID NO: 419071 - protein, 9 aa, Homo Sapiens
RALVAQQRQ

SEQ ID NO: 419072 - protein, 9 aa, Homo Sapiens
RDIQTGAFN

SEQ ID NO: 419073 - protein, 9 aa, Homo Sapiens
SSRDSPQSV

SEQ ID NO: 419074 - protein, 9 aa, Homo Sapiens
CISMTTISR

SEQ ID NO: 419075 - protein, 9 aa, Homo Sapiens
PVPVLSSLH

SEQ ID NO: 419076 - protein, 9 aa, Homo Sapiens
LERQTLGVT

SEQ ID NO: 419077 - protein, 9 aa, Homo Sapiens
PRAHEHVVA

SEQ ID NO: 419078 - protein, 9 aa, Homo Sapiens
SGTAAASAA

SEQ ID NO: 419079 - protein, 9 aa, Homo Sapiens
NSYSAYISD

SEQ ID NO: 419080 - protein, 9 aa, Homo Sapiens
KFLLGHRVV

SEQ ID NO: 419081 - protein, 9 aa, Homo Sapiens
AARLPLGQG

SEQ ID NO: 419082 - protein, 9 aa, Homo Sapiens
DLSVDMLDV

SEQ ID NO: 419083 - protein, 9 aa, Homo Sapiens
KVELQSAVE

SEQ ID NO: 419084 - protein, 9 aa, Homo Sapiens
AHPDNWFCY

SEQ ID NO: 419085 - protein, 9 aa, Homo Sapiens
LHLTCAHGH

SEQ ID NO: 419086 - protein, 9 aa, Homo Sapiens
NETIGSVWW

SEQ ID NO: 419087 - protein, 9 aa, Homo Sapiens
SSVLATGLH

SEQ ID NO: 419088 - protein, 9 aa, Homo Sapiens
AGELHTHVS

SEQ ID NO: 419089 - protein, 9 aa, Homo Sapiens
VAQPKDYAN

SEQ ID NO: 419090 - protein, 9 aa, Homo Sapiens
DEDEFPHVL

SEQ ID NO: 419091 - protein, 9 aa, Homo Sapiens
VNALANNIV

SEQ ID NO: 419092 - protein, 9 aa, Homo Sapiens
PPGHPPRPH

SEQ ID NO: 419093 - protein, 9 aa, Homo Sapiens
LVMNQTVCA

SEQ ID NO: 419094 - protein, 9 aa, Homo Sapiens
GKGESLRPV

SEQ ID NO: 419095 - protein, 9 aa, Homo Sapiens
SKLQPQPTE

SEQ ID NO: 419096 - protein, 9 aa, Homo Sapiens
FGSPTSNDD

SEQ ID NO: 419097 - protein, 9 aa, Homo Sapiens
KIKIQNQKR

SEQ ID NO: 419098 - protein, 9 aa, Homo Sapiens
ESLCEDSND

SEQ ID NO: 419099 - protein, 9 aa, Homo Sapiens
PWKRKQRAV

SEQ ID NO: 419100 - protein, 9 aa, Homo Sapiens
PPPPLKSAS

SEQ ID NO: 419101 - protein, 9 aa, Homo Sapiens
PSVWCPWTE

SEQ ID NO: 419102 - protein, 9 aa, Homo Sapiens
DLQQIIVNL

SEQ ID NO: 419103 - protein, 9 aa, Homo Sapiens
YVHSSVSPE

SEQ ID NO: 419104 - protein, 9 aa, Homo Sapiens
HQLREPQLL

SEQ ID NO: 419105 - protein, 9 aa, Homo Sapiens
SQQIFWPCD

SEQ ID NO: 419106 - protein, 9 aa, Homo Sapiens
RHLAIWLFI

SEQ ID NO: 419107 - protein, 9 aa, Homo Sapiens
GEVRVYLHV

SEQ ID NO: 419108 - protein, 9 aa, Homo Sapiens
TSHPGGSAR

SEQ ID NO: 419109 - protein, 9 aa, Homo Sapiens
LLGAGEHLP

SEQ ID NO: 419110 - protein, 9 aa, Homo Sapiens
STFSHQLAG

SEQ ID NO: 419111 - protein, 9 aa, Homo Sapiens
NQGAPARMG

SEQ ID NO: 419112 - protein, 9 aa, Homo Sapiens
LRKAEEQAR

SEQ ID NO: 419113 - protein, 9 aa, Homo Sapiens
LSVKRWLGV

SEQ ID NO: 419114 - protein, 9 aa, Homo Sapiens
TSGAGGSLV

SEQ ID NO: 419115 - protein, 9 aa, Homo Sapiens
HILGSKPLS

SEQ ID NO: 419116 - protein, 9 aa, Homo Sapiens
GPRGLKGEW

SEQ ID NO: 419117 - protein, 9 aa, Homo Sapiens
GLKVTVVDG

SEQ ID NO: 419118 - protein, 9 aa, Homo Sapiens
PWSSEAWDS

SEQ ID NO: 419119 - protein, 9 aa, Homo Sapiens
LPSVPSLYL

SEQ ID NO: 419120 - protein, 9 aa, Homo Sapiens
NTNSHNSEP

SEQ ID NO: 419121 - protein, 9 aa, Homo Sapiens
LLCLTLQER

SEQ ID NO: 419122 - protein, 9 aa, Homo Sapiens
SNTKAIRTI

SEQ ID NO: 419123 - protein, 9 aa, Homo Sapiens
ASLSGTPPV

SEQ ID NO: 419124 - protein, 9 aa, Homo Sapiens
MRRNSEYEH

SEQ ID NO: 419125 - protein, 9 aa, Homo Sapiens
LHRAARQPS

SEQ ID NO: 419126 - protein, 9 aa, Homo Sapiens
LCHLYYNWL

SEQ ID NO: 419127 - protein, 9 aa, Homo Sapiens
KETFHHFVP

SEQ ID NO: 419128 - protein, 9 aa, Homo Sapiens
PAICVPVLR

SEQ ID NO: 419129 - protein, 9 aa, Homo Sapiens
IVRTARGPR

SEQ ID NO: 419130 - protein, 9 aa, Homo Sapiens
ESEPGTQEV

SEQ ID NO: 419131 - protein, 9 aa, Homo Sapiens
TCGLPSRSM

SEQ ID NO: 419132 - protein, 9 aa, Homo Sapiens
LSIIATNSI

SEQ ID NO: 419133 - protein, 9 aa, Homo Sapiens
TNPQCHQDH

SEQ ID NO: 419134 - protein, 9 aa, Homo Sapiens
LNEEEIWLL

SEQ ID NO: 419135 - protein, 9 aa, Homo Sapiens
SWRPSARIP

SEQ ID NO: 419136 - protein, 9 aa, Homo Sapiens
TDSEYVKLV

SEQ ID NO: 419137 - protein, 9 aa, Homo Sapiens
MESGESTST

SEQ ID NO: 419138 - protein, 9 aa, Homo Sapiens
CTAVVCRSC

SEQ ID NO: 419139 - protein, 9 aa, Homo Sapiens
EPLLSWAGF

SEQ ID NO: 419140 - protein, 9 aa, Homo Sapiens
ATPRSLFTL

SEQ ID NO: 419141 - protein, 9 aa, Homo Sapiens
WSRLSLHGA

SEQ ID NO: 419142 - protein, 9 aa, Homo Sapiens
ASKMVDLLV

SEQ ID NO: 419143 - protein, 9 aa, Homo Sapiens
VKEFIIFLK

SEQ ID NO: 419144 - protein, 9 aa, Homo Sapiens
SRRRAPPRS

SEQ ID NO: 419145 - protein, 9 aa, Homo Sapiens
HNLYQCGRD

SEQ ID NO: 419146 - protein, 9 aa, Homo Sapiens
KKSPRGLQI

SEQ ID NO: 419147 - protein, 9 aa, Homo Sapiens
TLPSWARSF

SEQ ID NO: 419148 - protein, 9 aa, Homo Sapiens
NGMVGPHPL

SEQ ID NO: 419149 - protein, 9 aa, Homo Sapiens
KDERKDKKK

SEQ ID NO: 419150 - protein, 9 aa, Homo Sapiens
DTGQECFNI

SEQ ID NO: 419151 - protein, 9 aa, Homo Sapiens
TGKCIGAIA

SEQ ID NO: 419152 - protein, 9 aa, Homo Sapiens
STNEAKKGR

SEQ ID NO: 419153 - protein, 9 aa, Homo Sapiens
RERRDRRPG

SEQ ID NO: 419154 - protein, 9 aa, Homo Sapiens
LSRKSPSHS

SEQ ID NO: 419155 - protein, 9 aa, Homo Sapiens
LAVGPQQDE

SEQ ID NO: 419156 - protein, 9 aa, Homo Sapiens
PNAATGGGS

SEQ ID NO: 419157 - protein, 9 aa, Homo Sapiens
DWLGHPLRS

SEQ ID NO: 419158 - protein, 9 aa, Homo Sapiens
LLGRKEQLR

SEQ ID NO: 419159 - protein, 9 aa, Homo Sapiens
ISRESPWEA

SEQ ID NO: 419160 - protein, 9 aa, Homo Sapiens
KFSLHEQQC

SEQ ID NO: 419161 - protein, 9 aa, Homo Sapiens
DKVNYWWLR

SEQ ID NO: 419162 - protein, 9 aa, Homo Sapiens
TKKSPRGLQ

SEQ ID NO: 419163 - protein, 9 aa, Homo Sapiens
TSGAGGSTA

SEQ ID NO: 419164 - protein, 9 aa, Homo Sapiens
PGYTGLHCE

SEQ ID NO: 419165 - protein, 9 aa, Homo Sapiens
RATWSESAW

SEQ ID NO: 419166 - protein, 9 aa, Homo Sapiens
TVLLDIIQK

SEQ ID NO: 419167 - protein, 9 aa, Homo Sapiens
VERAADDPR

SEQ ID NO: 419168 - protein, 9 aa, Homo Sapiens
QHEQEGALD

SEQ ID NO: 419169 - protein, 9 aa, Homo Sapiens
LNELFTRFD

SEQ ID NO: 419170 - protein, 9 aa, Homo Sapiens
RPPHLPSCH

SEQ ID NO: 419171 - protein, 9 aa, Homo Sapiens
TKFVGGVST

SEQ ID NO: 419172 - protein, 9 aa, Homo Sapiens
EKVPCLCLE

SEQ ID NO: 419173 - protein, 9 aa, Homo Sapiens
VCHQQLPTF

SEQ ID NO: 419174 - protein, 9 aa, Homo Sapiens
LQAICGVGH

SEQ ID NO: 419175 - protein, 9 aa, Homo Sapiens
ASSTFSISS

SEQ ID NO: 419176 - protein, 9 aa, Homo Sapiens
SSRTDSPPA

SEQ ID NO: 419177 - protein, 9 aa, Homo Sapiens
NQRSAQFKH

SEQ ID NO: 419178 - protein, 9 aa, Homo Sapiens
DVEILGYYM

SEQ ID NO: 419179 - protein, 9 aa, Homo Sapiens
VDEGHCMKN

SEQ ID NO: 419180 - protein, 9 aa, Homo Sapiens
QNISDAESC

SEQ ID NO: 419181 - protein, 9 aa, Homo Sapiens
HPSPHPQLQ

SEQ ID NO: 419182 - protein, 9 aa, Homo Sapiens
AGPWSSEAW

SEQ ID NO: 419183 - protein, 9 aa, Homo Sapiens
PCVPGYQCP

SEQ ID NO: 419184 - protein, 9 aa, Homo Sapiens
LALLHLEPH

SEQ ID NO: 419185 - protein, 9 aa, Homo Sapiens
EMGDMGPCG

SEQ ID NO: 419186 - protein, 9 aa, Homo Sapiens
ATGERTKEG

SEQ ID NO: 419187 - protein, 9 aa, Homo Sapiens
RATWRSRAQ

SEQ ID NO: 419188 - protein, 9 aa, Homo Sapiens
MDVFVSTPV

SEQ ID NO: 419189 - protein, 9 aa, Homo Sapiens
PRMTARASE

SEQ ID NO: 419190 - protein, 9 aa, Homo Sapiens
LDEDPLSQD

SEQ ID NO: 419191 - protein, 9 aa, Homo Sapiens
AHHRRWSET

SEQ ID NO: 419192 - protein, 9 aa, Homo Sapiens
RWSACLSTT

SEQ ID NO: 419193 - protein, 9 aa, Homo Sapiens
AFSSQGSQC

SEQ ID NO: 419194 - protein, 9 aa, Homo Sapiens
ICRGAQNME

SEQ ID NO: 419195 - protein, 9 aa, Homo Sapiens
GDTMGRVDE

SEQ ID NO: 419196 - protein, 9 aa, Homo Sapiens
AASPRKRRL

SEQ ID NO: 419197 - protein, 9 aa, Homo Sapiens
RGYGRSQGG

SEQ ID NO: 419198 - protein, 9 aa, Homo Sapiens
ASLFEMVQC

SEQ ID NO: 419199 - protein, 9 aa, Homo Sapiens
TPTSQPKSK

SEQ ID NO: 419200 - protein, 9 aa, Homo Sapiens
LLGAFIGAT

SEQ ID NO: 419201 - protein, 9 aa, Homo Sapiens
LTAHLLRLW

SEQ ID NO: 419202 - protein, 9 aa, Homo Sapiens
MLSVHNIPH

SEQ ID NO: 419203 - protein, 9 aa, Homo Sapiens
HENCGYKFC

SEQ ID NO: 419204 - protein, 9 aa, Homo Sapiens
TPISAFSHD

SEQ ID NO: 419205 - protein, 9 aa, Homo Sapiens
TQEAVIAQI

SEQ ID NO: 419206 - protein, 9 aa, Homo Sapiens
RYRFDPRLM

SEQ ID NO: 419207 - protein, 9 aa, Homo Sapiens
ASHLFPPFE

SEQ ID NO: 419208 - protein, 9 aa, Homo Sapiens
IQHEQEGAL

SEQ ID NO: 419209 - protein, 9 aa, Homo Sapiens
AEGSECPGP

SEQ ID NO: 419210 - protein, 9 aa, Homo Sapiens
EEATDPVPA

SEQ ID NO: 419211 - protein, 9 aa, Homo Sapiens
VKKLKSVQE

SEQ ID NO: 419212 - protein, 9 aa, Homo Sapiens
MDEYITKVS

SEQ ID NO: 419213 - protein, 9 aa, Homo Sapiens
YMSHPKEKL

SEQ ID NO: 419214 - protein, 9 aa, Homo Sapiens
AHKAAHLGI

SEQ ID NO: 419215 - protein, 9 aa, Homo Sapiens
NLNLDTWEW

SEQ ID NO: 419216 - protein, 9 aa, Homo Sapiens
MDSNEGPSG

SEQ ID NO: 419217 - protein, 9 aa, Homo Sapiens
LEQERWQVT

SEQ ID NO: 419218 - protein, 9 aa, Homo Sapiens
PTSSSHQAC

SEQ ID NO: 419219 - protein, 9 aa, Homo Sapiens
QLLWGRPCS

SEQ ID NO: 419220 - protein, 9 aa, Homo Sapiens
VPVQPSSSV

SEQ ID NO: 419221 - protein, 9 aa, Homo Sapiens
RTDSPPALW

SEQ ID NO: 419222 - protein, 9 aa, Homo Sapiens
KYKGKSVDT

SEQ ID NO: 419223 - protein, 9 aa, Homo Sapiens
HVAAVAPVH

SEQ ID NO: 419224 - protein, 9 aa, Homo Sapiens
SSSTPSGHA

SEQ ID NO: 419225 - protein, 9 aa, Homo Sapiens
LCSICGLPV

SEQ ID NO: 419226 - protein, 9 aa, Homo Sapiens
HQDHPEEHN

SEQ ID NO: 419227 - protein, 9 aa, Homo Sapiens
WALGLQRVS

SEQ ID NO: 419228 - protein, 9 aa, Homo Sapiens
CCIPKEQLR

SEQ ID NO: 419229 - protein, 9 aa, Homo Sapiens
TPVVDPDAH

SEQ ID NO: 419230 - protein, 9 aa, Homo Sapiens
IWLLHTLTV

SEQ ID NO: 419231 - protein, 9 aa, Homo Sapiens
GSQSALGTA

SEQ ID NO: 419232 - protein, 9 aa, Homo Sapiens
RRRPSFPAQ

SEQ ID NO: 419233 - protein, 9 aa, Homo Sapiens
IVLVEGGCT

SEQ ID NO: 419234 - protein, 9 aa, Homo Sapiens
YFGPSFMGM

SEQ ID NO: 419235 - protein, 9 aa, Homo Sapiens
RGTEWPSTC

SEQ ID NO: 419236 - protein, 9 aa, Homo Sapiens
PRHCIEFRP

SEQ ID NO: 419237 - protein, 9 aa, Homo Sapiens
NRKWKCTLG

SEQ ID NO: 419238 - protein, 9 aa, Homo Sapiens
YTSSLNSPD

SEQ ID NO: 419239 - protein, 9 aa, Homo Sapiens
MNDLHNLNL

SEQ ID NO: 419240 - protein, 9 aa, Homo Sapiens
PPLIAPVAI

SEQ ID NO: 419241 - protein, 9 aa, Homo Sapiens
SDGVEWALG

SEQ ID NO: 419242 - protein, 9 aa, Homo Sapiens
PTLPPGNSF

SEQ ID NO: 419243 - protein, 9 aa, Homo Sapiens
GVCQQEGES

SEQ ID NO: 419244 - protein, 9 aa, Homo Sapiens
NPKVDRLEV

SEQ ID NO: 419245 - protein, 9 aa, Homo Sapiens
QDWLEEREQ

SEQ ID NO: 419246 - protein, 9 aa, Homo Sapiens
ATHFYLHTS

SEQ ID NO: 419247 - protein, 9 aa, Homo Sapiens
LQWVVHLHI

SEQ ID NO: 419248 - protein, 9 aa, Homo Sapiens
KYWLQFRES

SEQ ID NO: 419249 - protein, 9 aa, Homo Sapiens
AVVMVVRPV

SEQ ID NO: 419250 - protein, 9 aa, Homo Sapiens
QSSVAETYY

SEQ ID NO: 419251 - protein, 9 aa, Homo Sapiens
SFQKQQWEK

SEQ ID NO: 419252 - protein, 9 aa, Homo Sapiens
PRTPSGDRP

SEQ ID NO: 419253 - protein, 9 aa, Homo Sapiens
SESTKSYLL

SEQ ID NO: 419254 - protein, 9 aa, Homo Sapiens
GSLFVKKCK

SEQ ID NO: 419255 - protein, 9 aa, Homo Sapiens
EKGNSMTDN

SEQ ID NO: 419256 - protein, 9 aa, Homo Sapiens
KYIDLYLVP

SEQ ID NO: 419257 - protein, 9 aa, Homo Sapiens
HSHGAGRDE

SEQ ID NO: 419258 - protein, 9 aa, Homo Sapiens
LYHSRFEVL

SEQ ID NO: 419259 - protein, 9 aa, Homo Sapiens
IYNSLLPIR

SEQ ID NO: 419260 - protein, 9 aa, Homo Sapiens
SLNSPDKTL

SEQ ID NO: 419261 - protein, 9 aa, Homo Sapiens
SMRKSMSTV

SEQ ID NO: 419262 - protein, 9 aa, Homo Sapiens
QWSETGATE

SEQ ID NO: 419263 - protein, 9 aa, Homo Sapiens
QSVLLLGVP

SEQ ID NO: 419264 - protein, 9 aa, Homo Sapiens
KGSTYRRQA

SEQ ID NO: 419265 - protein, 9 aa, Homo Sapiens
WSESVNKVF

SEQ ID NO: 419266 - protein, 9 aa, Homo Sapiens
KYTSKMISR

SEQ ID NO: 419267 - protein, 9 aa, Homo Sapiens
NLHTRRVDT

SEQ ID NO: 419268 - protein, 9 aa, Homo Sapiens
QYILPMLPQ

SEQ ID NO: 419269 - protein, 9 aa, Homo Sapiens
LLLGVPQTA

SEQ ID NO: 419270 - protein, 9 aa, Homo Sapiens
HAQNLALVW

SEQ ID NO: 419271 - protein, 9 aa, Homo Sapiens
GTGSRGSRR

SEQ ID NO: 419272 - protein, 9 aa, Homo Sapiens
VLLLCFFIF

SEQ ID NO: 419273 - protein, 9 aa, Homo Sapiens
TIGSVWWKI

SEQ ID NO: 419274 - protein, 9 aa, Homo Sapiens
FWSKCVSSA

SEQ ID NO: 419275 - protein, 9 aa, Homo Sapiens
RSTPSMRTA

SEQ ID NO: 419276 - protein, 9 aa, Homo Sapiens
RQQHTRECN

SEQ ID NO: 419277 - protein, 9 aa, Homo Sapiens
AGTAGGGGS

SEQ ID NO: 419278 - protein, 9 aa, Homo Sapiens
LPRAVSGNE

SEQ ID NO: 419279 - protein, 9 aa, Homo Sapiens
LIGHLLDDG

SEQ ID NO: 419280 - protein, 9 aa, Homo Sapiens
SKMVDLLVS

SEQ ID NO: 419281 - protein, 9 aa, Homo Sapiens
GRPKPEWKH

SEQ ID NO: 419282 - protein, 9 aa, Homo Sapiens
SVEGQKKAF

SEQ ID NO: 419283 - protein, 9 aa, Homo Sapiens
APCRPPPVP

SEQ ID NO: 419284 - protein, 9 aa, Homo Sapiens
YQAQLQQSF

SEQ ID NO: 419285 - protein, 9 aa, Homo Sapiens
PSLLSRMPA

SEQ ID NO: 419286 - protein, 9 aa, Homo Sapiens
QITNEIVQQ

SEQ ID NO: 419287 - protein, 9 aa, Homo Sapiens
VGPRRCPEE

SEQ ID NO: 419288 - protein, 9 aa, Homo Sapiens
KQLLHWCSD

SEQ ID NO: 419289 - protein, 9 aa, Homo Sapiens
VMTLNELFT

SEQ ID NO: 419290 - protein, 9 aa, Homo Sapiens
GLTINSLAQ

SEQ ID NO: 419291 - protein, 9 aa, Homo Sapiens
NTFIVNGCA

SEQ ID NO: 419292 - protein, 9 aa, Homo Sapiens
QRWAAVTLQ

SEQ ID NO: 419293 - protein, 9 aa, Homo Sapiens
VSVIANMVE

SEQ ID NO: 419294 - protein, 9 aa, Homo Sapiens
TKNPTSPRR

SEQ ID NO: 419295 - protein, 9 aa, Homo Sapiens
YNTFDQNGM

SEQ ID NO: 419296 - protein, 9 aa, Homo Sapiens
GELRVPEEA

SEQ ID NO: 419297 - protein, 9 aa, Homo Sapiens
ATCYCRTGC

SEQ ID NO: 419298 - protein, 9 aa, Homo Sapiens
AFPLPRASL

SEQ ID NO: 419299 - protein, 9 aa, Homo Sapiens
GYYMLRWLC

SEQ ID NO: 419300 - protein, 9 aa, Homo Sapiens
RVAEDAFTM

SEQ ID NO: 419301 - protein, 9 aa, Homo Sapiens
TRIMGVVGC

SEQ ID NO: 419302 - protein, 9 aa, Homo Sapiens
DSAVTVAVG

SEQ ID NO: 419303 - protein, 9 aa, Homo Sapiens
ATWRSRAQD

SEQ ID NO: 419304 - protein, 9 aa, Homo Sapiens
PPGYTGLHC

SEQ ID NO: 419305 - protein, 9 aa, Homo Sapiens
SQKGKASLT

SEQ ID NO: 419306 - protein, 9 aa, Homo Sapiens
MVDFLKGQL

SEQ ID NO: 419307 - protein, 9 aa, Homo Sapiens
DQYQASQTH

SEQ ID NO: 419308 - protein, 9 aa, Homo Sapiens
PRLITTCEK

SEQ ID NO: 419309 - protein, 9 aa, Homo Sapiens
PGVGLVAEG

SEQ ID NO: 419310 - protein, 9 aa, Homo Sapiens
SRFHRRCWR

SEQ ID NO: 419311 - protein, 9 aa, Homo Sapiens
YPHIKDSED

SEQ ID NO: 419312 - protein, 9 aa, Homo Sapiens
YVVGGHDTP

SEQ ID NO: 419313 - protein, 9 aa, Homo Sapiens
EILPRPPQA

SEQ ID NO: 419314 - protein, 9 aa, Homo Sapiens
CVEMPLGIQ

SEQ ID NO: 419315 - protein, 9 aa, Homo Sapiens
QRWHMASKM

SEQ ID NO: 419316 - protein, 9 aa, Homo Sapiens
VDHRDARQL

SEQ ID NO: 419317 - protein, 9 aa, Homo Sapiens
NMQYFLTIP

SEQ ID NO: 419318 - protein, 9 aa, Homo Sapiens
PPGRSLPAG

SEQ ID NO: 419319 - protein, 9 aa, Homo Sapiens
SRLHLFPLT

SEQ ID NO: 419320 - protein, 9 aa, Homo Sapiens
PPVPRQASH

SEQ ID NO: 419321 - protein, 9 aa, Homo Sapiens
FLTEDKKNG

SEQ ID NO: 419322 - protein, 9 aa, Homo Sapiens
VAQDEVPAS

SEQ ID NO: 419323 - protein, 9 aa, Homo Sapiens
LLRYIVCLV

SEQ ID NO: 419324 - protein, 9 aa, Homo Sapiens
TGVSLDLDL

SEQ ID NO: 419325 - protein, 9 aa, Homo Sapiens
NFSFLMKKK

SEQ ID NO: 419326 - protein, 9 aa, Homo Sapiens
VRMLPTYIC

SEQ ID NO: 419327 - protein, 9 aa, Homo Sapiens
IFKMAVTAS

SEQ ID NO: 419328 - protein, 9 aa, Homo Sapiens
PQHESSDRC

SEQ ID NO: 419329 - protein, 9 aa, Homo Sapiens
RWWLGALKK

SEQ ID NO: 419330 - protein, 9 aa, Homo Sapiens
WRKQDEGQR

SEQ ID NO: 419331 - protein, 9 aa, Homo Sapiens
CSWLLSKHG

SEQ ID NO: 419332 - protein, 9 aa, Homo Sapiens
TSSSHQACP

SEQ ID NO: 419333 - protein, 9 aa, Homo Sapiens
RNITVFVPR

SEQ ID NO: 419334 - protein, 9 aa, Homo Sapiens
SSSASGGES

SEQ ID NO: 419335 - protein, 9 aa, Homo Sapiens
DSPERGVPM

SEQ ID NO: 419336 - protein, 9 aa, Homo Sapiens
AAGALTRTT

SEQ ID NO: 419337 - protein, 9 aa, Homo Sapiens
TMGRVDEEP

SEQ ID NO: 419338 - protein, 9 aa, Homo Sapiens
LGYELLTAF

SEQ ID NO: 419339 - protein, 9 aa, Homo Sapiens
MRGLQQWVQ

SEQ ID NO: 419340 - protein, 9 aa, Homo Sapiens
ETHPLPIWT

SEQ ID NO: 419341 - protein, 9 aa, Homo Sapiens
GESYEEKAM

SEQ ID NO: 419342 - protein, 9 aa, Homo Sapiens
QCLKIQGEQ

SEQ ID NO: 419343 - protein, 9 aa, Homo Sapiens
RWEAESKLS

SEQ ID NO: 419344 - protein, 9 aa, Homo Sapiens
NHRAWVTTR

SEQ ID NO: 419345 - protein, 9 aa, Homo Sapiens
SLRHPRKPG

SEQ ID NO: 419346 - protein, 9 aa, Homo Sapiens
GEGLKMSFL

SEQ ID NO: 419347 - protein, 9 aa, Homo Sapiens
RSRAGRQRS

SEQ ID NO: 419348 - protein, 9 aa, Homo Sapiens
SYVHSSVSP

SEQ ID NO: 419349 - protein, 9 aa, Homo Sapiens
PSSSHRDLS

SEQ ID NO: 419350 - protein, 9 aa, Homo Sapiens
RRMRTFSAT

SEQ ID NO: 419351 - protein, 9 aa, Homo Sapiens
VFCILLIMV

SEQ ID NO: 419352 - protein, 9 aa, Homo Sapiens
PCVALCTAS

SEQ ID NO: 419353 - protein, 9 aa, Homo Sapiens
GSNSFRKSK

SEQ ID NO: 419354 - protein, 9 aa, Homo Sapiens
TDQAPEPPT

SEQ ID NO: 419355 - protein, 9 aa, Homo Sapiens
GDNDDGGGS

SEQ ID NO: 419356 - protein, 9 aa, Homo Sapiens
QMNGPVAGT

SEQ ID NO: 419357 - protein, 9 aa, Homo Sapiens
LTAFLGDLL

SEQ ID NO: 419358 - protein, 9 aa, Homo Sapiens
GCQQREQEQ

SEQ ID NO: 419359 - protein, 9 aa, Homo Sapiens
AVLTFIYSV

SEQ ID NO: 419360 - protein, 9 aa, Homo Sapiens
KYYGTQEAV

SEQ ID NO: 419361 - protein, 9 aa, Homo Sapiens
FSTTPVDSN

SEQ ID NO: 419362 - protein, 9 aa, Homo Sapiens
PPAPSMPRC

SEQ ID NO: 419363 - protein, 9 aa, Homo Sapiens
AINHGENLK

SEQ ID NO: 419364 - protein, 9 aa, Homo Sapiens
MKNRNGGGS

SEQ ID NO: 419365 - protein, 9 aa, Homo Sapiens
EQTETLRDM

SEQ ID NO: 419366 - protein, 9 aa, Homo Sapiens
MNPAHAFGP

SEQ ID NO: 419367 - protein, 9 aa, Homo Sapiens
YDIMGRNQT

SEQ ID NO: 419368 - protein, 9 aa, Homo Sapiens
IQPEQQAVF

SEQ ID NO: 419369 - protein, 9 aa, Homo Sapiens
HILGTQESD

SEQ ID NO: 419370 - protein, 9 aa, Homo Sapiens
REKQAPAFK

SEQ ID NO: 419371 - protein, 9 aa, Homo Sapiens
TMTAEVQPQ

SEQ ID NO: 419372 - protein, 9 aa, Homo Sapiens
RPGASRRWR

SEQ ID NO: 419373 - protein, 9 aa, Homo Sapiens
GAGWPCPAV

SEQ ID NO: 419374 - protein, 9 aa, Homo Sapiens
ALYPLYPAE

SEQ ID NO: 419375 - protein, 9 aa, Homo Sapiens
GPRPLPHAP

SEQ ID NO: 419376 - protein, 9 aa, Homo Sapiens
PHKIIHTGE

SEQ ID NO: 419377 - protein, 9 aa, Homo Sapiens
TTTPDQYSL

SEQ ID NO: 419378 - protein, 9 aa, Homo Sapiens
NHRLHHHHR

SEQ ID NO: 419379 - protein, 9 aa, Homo Sapiens
VWTVALLVS

SEQ ID NO: 419380 - protein, 9 aa, Homo Sapiens
SYEEKAMRA

SEQ ID NO: 419381 - protein, 9 aa, Homo Sapiens
LEEMHFAEV

SEQ ID NO: 419382 - protein, 9 aa, Homo Sapiens
FFTTMVVTS

SEQ ID NO: 419383 - protein, 9 aa, Homo Sapiens
LKVRGLDLS

SEQ ID NO: 419384 - protein, 9 aa, Homo Sapiens
FFVATWAVS

SEQ ID NO: 419385 - protein, 9 aa, Homo Sapiens
RRNIALQND

SEQ ID NO: 419386 - protein, 9 aa, Homo Sapiens
SQEMCPRDY

SEQ ID NO: 419387 - protein, 9 aa, Homo Sapiens
TTVTGTPYQ

SEQ ID NO: 419388 - protein, 9 aa, Homo Sapiens
NTAWSQVID

SEQ ID NO: 419389 - protein, 9 aa, Homo Sapiens
FMKWYTAED

SEQ ID NO: 419390 - protein, 9 aa, Homo Sapiens
IPILGPVKM

SEQ ID NO: 419391 - protein, 9 aa, Homo Sapiens
RIITEKAMF

SEQ ID NO: 419392 - protein, 9 aa, Homo Sapiens
LSPERGGVW

SEQ ID NO: 419393 - protein, 9 aa, Homo Sapiens
TVIELMASE

SEQ ID NO: 419394 - protein, 9 aa, Homo Sapiens
DAARLPLGQ

SEQ ID NO: 419395 - protein, 9 aa, Homo Sapiens
WVKWTKEEL

SEQ ID NO: 419396 - protein, 9 aa, Homo Sapiens
ESSQPRGSS

SEQ ID NO: 419397 - protein, 9 aa, Homo Sapiens
WAGFELLQG

SEQ ID NO: 419398 - protein, 9 aa, Homo Sapiens
RDQDLCRGP

SEQ ID NO: 419399 - protein, 9 aa, Homo Sapiens
HQTAIIGGL

SEQ ID NO: 419400 - protein, 9 aa, Homo Sapiens
IYCLDLPLS

SEQ ID NO: 419401 - protein, 9 aa, Homo Sapiens
TEMNGHILG

SEQ ID NO: 419402 - protein, 9 aa, Homo Sapiens
VGTKPLYMA

SEQ ID NO: 419403 - protein, 9 aa, Homo Sapiens
SPYTYVASD

SEQ ID NO: 419404 - protein, 9 aa, Homo Sapiens
PVAEASTGA

SEQ ID NO: 419405 - protein, 9 aa, Homo Sapiens
QKRRPYHKR

SEQ ID NO: 419406 - protein, 9 aa, Homo Sapiens
TFIVNGCAA

SEQ ID NO: 419407 - protein, 9 aa, Homo Sapiens
KTTKELEEE

SEQ ID NO: 419408 - protein, 9 aa, Homo Sapiens
KNQERSPDP

SEQ ID NO: 419409 - protein, 9 aa, Homo Sapiens
PSDHLEILP

SEQ ID NO: 419410 - protein, 9 aa, Homo Sapiens
GDTPQPSLP

SEQ ID NO: 419411 - protein, 9 aa, Homo Sapiens
RVPGRRLPQ

SEQ ID NO: 419412 - protein, 9 aa, Homo Sapiens
WCLKVSFRV

SEQ ID NO: 419413 - protein, 9 aa, Homo Sapiens
RQELSHTLY

SEQ ID NO: 419414 - protein, 9 aa, Homo Sapiens
LSIVGTVLL

SEQ ID NO: 419415 - protein, 9 aa, Homo Sapiens
QKKGVAGEN

SEQ ID NO: 419416 - protein, 9 aa, Homo Sapiens
SPQASSPRA

SEQ ID NO: 419417 - protein, 9 aa, Homo Sapiens
IPPPAPATQ

SEQ ID NO: 419418 - protein, 9 aa, Homo Sapiens
APPVPVLSS

SEQ ID NO: 419419 - protein, 9 aa, Homo Sapiens
GEWLGGGAL

SEQ ID NO: 419420 - protein, 9 aa, Homo Sapiens
YWDSAGATH

SEQ ID NO: 419421 - protein, 9 aa, Homo Sapiens
PVPHGNSTG

SEQ ID NO: 419422 - protein, 9 aa, Homo Sapiens
RDTCVGKVS

SEQ ID NO: 419423 - protein, 9 aa, Homo Sapiens
LSLFYLWLI

SEQ ID NO: 419424 - protein, 9 aa, Homo Sapiens
IKGDTMGRV

SEQ ID NO: 419425 - protein, 9 aa, Homo Sapiens
LAGPWSSEA

SEQ ID NO: 419426 - protein, 9 aa, Homo Sapiens
LARVHALVL

SEQ ID NO: 419427 - protein, 9 aa, Homo Sapiens
EVENGRGHH

SEQ ID NO: 419428 - protein, 9 aa, Homo Sapiens
YQKMPKVLP

SEQ ID NO: 419429 - protein, 9 aa, Homo Sapiens
KYWASLWNL

SEQ ID NO: 419430 - protein, 9 aa, Homo Sapiens
ESDSAERLQ

SEQ ID NO: 419431 - protein, 9 aa, Homo Sapiens
SMDGQVMWW

SEQ ID NO: 419432 - protein, 9 aa, Homo Sapiens
DVLPVVGGP

SEQ ID NO: 419433 - protein, 9 aa, Homo Sapiens
SLPAGPSAL

SEQ ID NO: 419434 - protein, 9 aa, Homo Sapiens
DKYHKKQAQ

SEQ ID NO: 419435 - protein, 9 aa, Homo Sapiens
ESAAPAARE

SEQ ID NO: 419436 - protein, 9 aa, Homo Sapiens
IDENTTWLY

SEQ ID NO: 419437 - protein, 9 aa, Homo Sapiens
GGVSTVARF

SEQ ID NO: 419438 - protein, 9 aa, Homo Sapiens
QPTEARGRP

SEQ ID NO: 419439 - protein, 9 aa, Homo Sapiens
EKHASQQFC

SEQ ID NO: 419440 - protein, 9 aa, Homo Sapiens
QDIFEKYNW

SEQ ID NO: 419441 - protein, 9 aa, Homo Sapiens
LTPATPYSA

SEQ ID NO: 419442 - protein, 9 aa, Homo Sapiens
TIFLSKEKA

SEQ ID NO: 419443 - protein, 9 aa, Homo Sapiens
NWKIKIQNQ

SEQ ID NO: 419444 - protein, 9 aa, Homo Sapiens
VKNNCKISV

SEQ ID NO: 419445 - protein, 9 aa, Homo Sapiens
VINHVHVRV

SEQ ID NO: 419446 - protein, 9 aa, Homo Sapiens
EQRLQDQQQ

SEQ ID NO: 419447 - protein, 9 aa, Homo Sapiens
TGLHCEADI

SEQ ID NO: 419448 - protein, 9 aa, Homo Sapiens
ILGELFTKN

SEQ ID NO: 419449 - protein, 9 aa, Homo Sapiens
SYLLWESNR

SEQ ID NO: 419450 - protein, 9 aa, Homo Sapiens
EKWCFRLSY

SEQ ID NO: 419451 - protein, 9 aa, Homo Sapiens
EGQKLAPEN

SEQ ID NO: 419452 - protein, 9 aa, Homo Sapiens
FTCLQICEL

SEQ ID NO: 419453 - protein, 9 aa, Homo Sapiens
RGHHHPHDQ

SEQ ID NO: 419454 - protein, 9 aa, Homo Sapiens
TIKMNMTLW

SEQ ID NO: 419455 - protein, 9 aa, Homo Sapiens
KQSAPRNLV

SEQ ID NO: 419456 - protein, 9 aa, Homo Sapiens
GLGSDLVQL

SEQ ID NO: 419457 - protein, 9 aa, Homo Sapiens
LKETTGPNR

SEQ ID NO: 419458 - protein, 9 aa, Homo Sapiens
ILRDPSECV

SEQ ID NO: 419459 - protein, 9 aa, Homo Sapiens
GTMPVPEGC

SEQ ID NO: 419460 - protein, 9 aa, Homo Sapiens
PGRRLPQCG

SEQ ID NO: 419461 - protein, 9 aa, Homo Sapiens
IAAFRPDLI

SEQ ID NO: 419462 - protein, 9 aa, Homo Sapiens
FVRGQSRAR

SEQ ID NO: 419463 - protein, 9 aa, Homo Sapiens
ALRPSTSSR

SEQ ID NO: 419464 - protein, 9 aa, Homo Sapiens
LCLLGEITY

SEQ ID NO: 419465 - protein, 9 aa, Homo Sapiens
SFWDTEETY

SEQ ID NO: 419466 - protein, 9 aa, Homo Sapiens
DPGVGSVLG

SEQ ID NO: 419467 - protein, 9 aa, Homo Sapiens
SSHQACPPT

SEQ ID NO: 419468 - protein, 9 aa, Homo Sapiens
VPREKGRLG

SEQ ID NO: 419469 - protein, 9 aa, Homo Sapiens
RDLVNAFLL

SEQ ID NO: 419470 - protein, 9 aa, Homo Sapiens
CVALECKEA

SEQ ID NO: 419471 - protein, 9 aa, Homo Sapiens
GHLAVQGVD

SEQ ID NO: 419472 - protein, 9 aa, Homo Sapiens
GPGPHAVSG

SEQ ID NO: 419473 - protein, 9 aa, Homo Sapiens
FHLAFRSGA

SEQ ID NO: 419474 - protein, 9 aa, Homo Sapiens
ELQKVLLLG

SEQ ID NO: 419475 - protein, 9 aa, Homo Sapiens
LQIQEKSTM

SEQ ID NO: 419476 - protein, 9 aa, Homo Sapiens
YWKVSTIDD

SEQ ID NO: 419477 - protein, 9 aa, Homo Sapiens
AVATVLGLK

SEQ ID NO: 419478 - protein, 9 aa, Homo Sapiens
DQLEGTHAR

SEQ ID NO: 419479 - protein, 9 aa, Homo Sapiens
PIPSEVPGR

SEQ ID NO: 419480 - protein, 9 aa, Homo Sapiens
RQPLPTQIH

SEQ ID NO: 419481 - protein, 9 aa, Homo Sapiens
TGCLLLVVR

SEQ ID NO: 419482 - protein, 9 aa, Homo Sapiens
SDAVSTSSP

SEQ ID NO: 419483 - protein, 9 aa, Homo Sapiens
ECHVSDYSD

SEQ ID NO: 419484 - protein, 9 aa, Homo Sapiens
AILCSCSWL

SEQ ID NO: 419485 - protein, 9 aa, Homo Sapiens
QLVLLRRQR

SEQ ID NO: 419486 - protein, 9 aa, Homo Sapiens
FIGATFFVA

SEQ ID NO: 419487 - protein, 9 aa, Homo Sapiens
VGCAPTHMG

SEQ ID NO: 419488 - protein, 9 aa, Homo Sapiens
EPGRPLRSH

SEQ ID NO: 419489 - protein, 9 aa, Homo Sapiens
MYEVHTASQ

SEQ ID NO: 419490 - protein, 9 aa, Homo Sapiens
QLQTAPPAW

SEQ ID NO: 419491 - protein, 9 aa, Homo Sapiens
GPPGTVGPL

SEQ ID NO: 419492 - protein, 9 aa, Homo Sapiens
TLLKTQSDV

SEQ ID NO: 419493 - protein, 9 aa, Homo Sapiens
ISLLSEPEK

SEQ ID NO: 419494 - protein, 9 aa, Homo Sapiens
IESISLLSE

SEQ ID NO: 419495 - protein, 9 aa, Homo Sapiens
WTTLLLILL

SEQ ID NO: 419496 - protein, 9 aa, Homo Sapiens
PILCRLVMT

SEQ ID NO: 419497 - protein, 9 aa, Homo Sapiens
QLLGPPPPH

SEQ ID NO: 419498 - protein, 9 aa, Homo Sapiens
GNGCAGGGV

SEQ ID NO: 419499 - protein, 9 aa, Homo Sapiens
FVIFLESPN

SEQ ID NO: 419500 - protein, 9 aa, Homo Sapiens
PPPTKKGAK

SEQ ID NO: 419501 - protein, 9 aa, Homo Sapiens
VAKILHKTV

SEQ ID NO: 419502 - protein, 9 aa, Homo Sapiens
TVLLQEVEV

SEQ ID NO: 419503 - protein, 9 aa, Homo Sapiens
LLRFHVLPD

SEQ ID NO: 419504 - protein, 9 aa, Homo Sapiens
WTYDAYSTF

SEQ ID NO: 419505 - protein, 9 aa, Homo Sapiens
EEQIVLLKS

SEQ ID NO: 419506 - protein, 9 aa, Homo Sapiens
GDLATGDKG

SEQ ID NO: 419507 - protein, 9 aa, Homo Sapiens
LQEEVNINC

SEQ ID NO: 419508 - protein, 9 aa, Homo Sapiens
RSPKCIIHG

SEQ ID NO: 419509 - protein, 9 aa, Homo Sapiens
RAPRTESSQ

SEQ ID NO: 419510 - protein, 9 aa, Homo Sapiens
GSRPMPMPV

SEQ ID NO: 419511 - protein, 9 aa, Homo Sapiens
WKCTLGVMM

SEQ ID NO: 419512 - protein, 9 aa, Homo Sapiens
DADIEFRKW

SEQ ID NO: 419513 - protein, 9 aa, Homo Sapiens
GGSLSSCGW

SEQ ID NO: 419514 - protein, 9 aa, Homo Sapiens
TQRDTCVGK

SEQ ID NO: 419515 - protein, 9 aa, Homo Sapiens
NNCKISVDF

SEQ ID NO: 419516 - protein, 9 aa, Homo Sapiens
PTISCPFQS

SEQ ID NO: 419517 - protein, 9 aa, Homo Sapiens
MSPGGGAAE

SEQ ID NO: 419518 - protein, 9 aa, Homo Sapiens
WHWKKLPSC

SEQ ID NO: 419519 - protein, 9 aa, Homo Sapiens
WAGRGPHWR

SEQ ID NO: 419520 - protein, 9 aa, Homo Sapiens
VVVLYSVEE

SEQ ID NO: 419521 - protein, 9 aa, Homo Sapiens
EMPYAGGVG

SEQ ID NO: 419522 - protein, 9 aa, Homo Sapiens
CHPLCHAAV

SEQ ID NO: 419523 - protein, 9 aa, Homo Sapiens
CQGDYIRVH

SEQ ID NO: 419524 - protein, 9 aa, Homo Sapiens
SAHHLLLPG

SEQ ID NO: 419525 - protein, 9 aa, Homo Sapiens
AGLVGGGRG

SEQ ID NO: 419526 - protein, 9 aa, Homo Sapiens
TVINYYTRW

SEQ ID NO: 419527 - protein, 9 aa, Homo Sapiens
PSTGLPSQK

SEQ ID NO: 419528 - protein, 9 aa, Homo Sapiens
QIPDGFLPI

SEQ ID NO: 419529 - protein, 9 aa, Homo Sapiens
AAAAPLQPA

SEQ ID NO: 419530 - protein, 9 aa, Homo Sapiens
IWNKINHHG

SEQ ID NO: 419531 - protein, 9 aa, Homo Sapiens
ILLGAFIGA

SEQ ID NO: 419532 - protein, 9 aa, Homo Sapiens
HAARRLGTS

SEQ ID NO: 419533 - protein, 9 aa, Homo Sapiens
VQNPRKKHK

SEQ ID NO: 419534 - protein, 9 aa, Homo Sapiens
LWFTGDNGQ

SEQ ID NO: 419535 - protein, 9 aa, Homo Sapiens
NVKWEYDHM

SEQ ID NO: 419536 - protein, 9 aa, Homo Sapiens
RMLMLLYSS

SEQ ID NO: 419537 - protein, 9 aa, Homo Sapiens
VQALRPTGP

SEQ ID NO: 419538 - protein, 9 aa, Homo Sapiens
YLLKWHWKK

SEQ ID NO: 419539 - protein, 9 aa, Homo Sapiens
GTAAASAAR

SEQ ID NO: 419540 - protein, 9 aa, Homo Sapiens
GRPPSPRPP

SEQ ID NO: 419541 - protein, 9 aa, Homo Sapiens
SVFPLLAGL

SEQ ID NO: 419542 - protein, 9 aa, Homo Sapiens
DPAVHSALQ

SEQ ID NO: 419543 - protein, 9 aa, Homo Sapiens
IFVETSAKT

SEQ ID NO: 419544 - protein, 9 aa, Homo Sapiens
ELPNVLEFT

SEQ ID NO: 419545 - protein, 9 aa, Homo Sapiens
CLEQVIAGA

SEQ ID NO: 419546 - protein, 9 aa, Homo Sapiens
PALHLVKPR

SEQ ID NO: 419547 - protein, 9 aa, Homo Sapiens
VYLLSVSTA

SEQ ID NO: 419548 - protein, 9 aa, Homo Sapiens
PQASSPRAI

SEQ ID NO: 419549 - protein, 9 aa, Homo Sapiens
HGRARPTGA

SEQ ID NO: 419550 - protein, 9 aa, Homo Sapiens
TAPPGDGYM

SEQ ID NO: 419551 - protein, 9 aa, Homo Sapiens
LKQRLNIAV

SEQ ID NO: 419552 - protein, 9 aa, Homo Sapiens
FLIGLPLLI

SEQ ID NO: 419553 - protein, 9 aa, Homo Sapiens
FFHLLGGDR

SEQ ID NO: 419554 - protein, 9 aa, Homo Sapiens
QSVFPLLAG

SEQ ID NO: 419555 - protein, 9 aa, Homo Sapiens
APPAPPPWR

SEQ ID NO: 419556 - protein, 9 aa, Homo Sapiens
LRRSRSARQ

SEQ ID NO: 419557 - protein, 9 aa, Homo Sapiens
ANVELTGGV

SEQ ID NO: 419558 - protein, 9 aa, Homo Sapiens
QAFCSALGE

SEQ ID NO: 419559 - protein, 9 aa, Homo Sapiens
YWESTDMVS

SEQ ID NO: 419560 - protein, 9 aa, Homo Sapiens
RGSKPKPLV

SEQ ID NO: 419561 - protein, 9 aa, Homo Sapiens
QQPCQLHGN

SEQ ID NO: 419562 - protein, 9 aa, Homo Sapiens
ILNNNELLL

SEQ ID NO: 419563 - protein, 9 aa, Homo Sapiens
ERIDGRVWG

SEQ ID NO: 419564 - protein, 9 aa, Homo Sapiens
SEPITGPTT

SEQ ID NO: 419565 - protein, 9 aa, Homo Sapiens
HGAHWTLPP

SEQ ID NO: 419566 - protein, 9 aa, Homo Sapiens
KYHKKQAQV

SEQ ID NO: 419567 - protein, 9 aa, Homo Sapiens
APMVSSRML

SEQ ID NO: 419568 - protein, 9 aa, Homo Sapiens
ASHVPVQPS

SEQ ID NO: 419569 - protein, 9 aa, Homo Sapiens
PNHLGTGGG

SEQ ID NO: 419570 - protein, 9 aa, Homo Sapiens
WTWRSWPTW

SEQ ID NO: 419571 - protein, 9 aa, Homo Sapiens
SFTCLQICE

SEQ ID NO: 419572 - protein, 9 aa, Homo Sapiens
KPYQCPKCE

SEQ ID NO: 419573 - protein, 9 aa, Homo Sapiens
QDLEKERKR

SEQ ID NO: 419574 - protein, 9 aa, Homo Sapiens
NSQDLNMDC

SEQ ID NO: 419575 - protein, 9 aa, Homo Sapiens
FWRSFCLEY

SEQ ID NO: 419576 - protein, 9 aa, Homo Sapiens
TTSSAAPPH

SEQ ID NO: 419577 - protein, 9 aa, Homo Sapiens
LDVSSISHW

SEQ ID NO: 419578 - protein, 9 aa, Homo Sapiens
SILQELKLW

SEQ ID NO: 419579 - protein, 9 aa, Homo Sapiens
VQYILPMLP

SEQ ID NO: 419580 - protein, 9 aa, Homo Sapiens
TSNDDMTLT

SEQ ID NO: 419581 - protein, 9 aa, Homo Sapiens
PLLPAPMCN

SEQ ID NO: 419582 - protein, 9 aa, Homo Sapiens
SHPFRARIL

SEQ ID NO: 419583 - protein, 9 aa, Homo Sapiens
PFQCEWNPC

SEQ ID NO: 419584 - protein, 9 aa, Homo Sapiens
NGCTFKILV

SEQ ID NO: 419585 - protein, 9 aa, Homo Sapiens
ISPVSIATR

SEQ ID NO: 419586 - protein, 9 aa, Homo Sapiens
YLRRGQLIV

SEQ ID NO: 419587 - protein, 9 aa, Homo Sapiens
PVQIQSQSS

SEQ ID NO: 419588 - protein, 9 aa, Homo Sapiens
IPSVIAAGP

SEQ ID NO: 419589 - protein, 9 aa, Homo Sapiens
GHAPRLWLL

SEQ ID NO: 419590 - protein, 9 aa, Homo Sapiens
NSQRIAAVA

SEQ ID NO: 419591 - protein, 9 aa, Homo Sapiens
PASGFFQSL

SEQ ID NO: 419592 - protein, 9 aa, Homo Sapiens
LVCFLFFCQ

SEQ ID NO: 419593 - protein, 9 aa, Homo Sapiens
LQLLLHLEE

SEQ ID NO: 419594 - protein, 9 aa, Homo Sapiens
CLRLSIRIP

SEQ ID NO: 419595 - protein, 9 aa, Homo Sapiens
KRKTKLKLY

SEQ ID NO: 419596 - protein, 9 aa, Homo Sapiens
GGRPGPCST

SEQ ID NO: 419597 - protein, 9 aa, Homo Sapiens
RGLELALAC

SEQ ID NO: 419598 - protein, 9 aa, Homo Sapiens
APPSFSVAP

SEQ ID NO: 419599 - protein, 9 aa, Homo Sapiens
KGKKKGQTQ

SEQ ID NO: 419600 - protein, 9 aa, Homo Sapiens
SSISRPCPR

SEQ ID NO: 419601 - protein, 9 aa, Homo Sapiens
ETIHPQKSY

SEQ ID NO: 419602 - protein, 9 aa, Homo Sapiens
LPYASPYTY

SEQ ID NO: 419603 - protein, 9 aa, Homo Sapiens
RKDRRAKNR

SEQ ID NO: 419604 - protein, 9 aa, Homo Sapiens
EQSAGVIQN

SEQ ID NO: 419605 - protein, 9 aa, Homo Sapiens
GFVAAFRFY

SEQ ID NO: 419606 - protein, 9 aa, Homo Sapiens
RPRTLQKKI

SEQ ID NO: 419607 - protein, 9 aa, Homo Sapiens
WSYEEDSHY

SEQ ID NO: 419608 - protein, 9 aa, Homo Sapiens
FAPSLWLLT

SEQ ID NO: 419609 - protein, 9 aa, Homo Sapiens
AVDPDMLLS

SEQ ID NO: 419610 - protein, 9 aa, Homo Sapiens
PSATLSSTP

SEQ ID NO: 419611 - protein, 9 aa, Homo Sapiens
RERAWLRER

SEQ ID NO: 419612 - protein, 9 aa, Homo Sapiens
PPKPPLPTP

SEQ ID NO: 419613 - protein, 9 aa, Homo Sapiens
VWCPWTETT

SEQ ID NO: 419614 - protein, 9 aa, Homo Sapiens
SPELVKQVR

SEQ ID NO: 419615 - protein, 9 aa, Homo Sapiens
ASYGNIIVI

SEQ ID NO: 419616 - protein, 9 aa, Homo Sapiens
GAIDENTTW

SEQ ID NO: 419617 - protein, 9 aa, Homo Sapiens
YHLASSSPH

SEQ ID NO: 419618 - protein, 9 aa, Homo Sapiens
TYSDCCLAV

SEQ ID NO: 419619 - protein, 9 aa, Homo Sapiens
AEQHPLGVT

SEQ ID NO: 419620 - protein, 9 aa, Homo Sapiens
MHLLHSHLL

SEQ ID NO: 419621 - protein, 9 aa, Homo Sapiens
LSGINAIYY

SEQ ID NO: 419622 - protein, 9 aa, Homo Sapiens
RAYLMADMA

SEQ ID NO: 419623 - protein, 9 aa, Homo Sapiens
GVYECHVSD

SEQ ID NO: 419624 - protein, 9 aa, Homo Sapiens
SALGTASEG

SEQ ID NO: 419625 - protein, 9 aa, Homo Sapiens
LPIRSHCSS

SEQ ID NO: 419626 - protein, 9 aa, Homo Sapiens
QELEHAGAR

SEQ ID NO: 419627 - protein, 9 aa, Homo Sapiens
RMGTEPHHF

SEQ ID NO: 419628 - protein, 9 aa, Homo Sapiens
EKVLDSGFW

SEQ ID NO: 419629 - protein, 9 aa, Homo Sapiens
GLEAEAASP

SEQ ID NO: 419630 - protein, 9 aa, Homo Sapiens
FNQVAQCFR

SEQ ID NO: 419631 - protein, 9 aa, Homo Sapiens
VPPPSWPDG

SEQ ID NO: 419632 - protein, 9 aa, Homo Sapiens
THTAAKAAG

SEQ ID NO: 419633 - protein, 9 aa, Homo Sapiens
PSRACDINT

SEQ ID NO: 419634 - protein, 9 aa, Homo Sapiens
LKAEFGNQW

SEQ ID NO: 419635 - protein, 9 aa, Homo Sapiens
LRPPHLPSC

SEQ ID NO: 419636 - protein, 9 aa, Homo Sapiens
DPGVIKQKV

SEQ ID NO: 419637 - protein, 9 aa, Homo Sapiens
GMAQDCSKG

SEQ ID NO: 419638 - protein, 9 aa, Homo Sapiens
AVTTTPDQY

SEQ ID NO: 419639 - protein, 9 aa, Homo Sapiens
PASSHPLVL

SEQ ID NO: 419640 - protein, 9 aa, Homo Sapiens
GCRPMRKTA

SEQ ID NO: 419641 - protein, 9 aa, Homo Sapiens
LQRNMETRK

SEQ ID NO: 419642 - protein, 9 aa, Homo Sapiens
LRPGHLDQL

SEQ ID NO: 419643 - protein, 9 aa, Homo Sapiens
LNALHREKQ

SEQ ID NO: 419644 - protein, 9 aa, Homo Sapiens
SESVNKVFV

SEQ ID NO: 419645 - protein, 9 aa, Homo Sapiens
RVSWGQRHH

SEQ ID NO: 419646 - protein, 9 aa, Homo Sapiens
FPSDFSRVF

SEQ ID NO: 419647 - protein, 9 aa, Homo Sapiens
PHPHGDGQQ

SEQ ID NO: 419648 - protein, 9 aa, Homo Sapiens
GGGEDSGGH

SEQ ID NO: 419649 - protein, 9 aa, Homo Sapiens
PEKKKTRMF

SEQ ID NO: 419650 - protein, 9 aa, Homo Sapiens
EGALDVEVS

SEQ ID NO: 419651 - protein, 9 aa, Homo Sapiens
GLCKPKIVR

SEQ ID NO: 419652 - protein, 9 aa, Homo Sapiens
GGDRILPSG

SEQ ID NO: 419653 - protein, 9 aa, Homo Sapiens
SESQDEPWE

SEQ ID NO: 419654 - protein, 9 aa, Homo Sapiens
MGIIFMCLR

SEQ ID NO: 419655 - protein, 9 aa, Homo Sapiens
MGNAIALVL

SEQ ID NO: 419656 - protein, 9 aa, Homo Sapiens
RGDPGVIKQ

SEQ ID NO: 419657 - protein, 9 aa, Homo Sapiens
GKQVIEQLG

SEQ ID NO: 419658 - protein, 9 aa, Homo Sapiens
RPDDKYHKK

SEQ ID NO: 419659 - protein, 9 aa, Homo Sapiens
GHMERAFSS

SEQ ID NO: 419660 - protein, 9 aa, Homo Sapiens
DFHGVAPST

SEQ ID NO: 419661 - protein, 9 aa, Homo Sapiens
LGIRAQGTR

SEQ ID NO: 419662 - protein, 9 aa, Homo Sapiens
GQHIDYVLQ

SEQ ID NO: 419663 - protein, 9 aa, Homo Sapiens
VVPLIVGQI

SEQ ID NO: 419664 - protein, 9 aa, Homo Sapiens
VCPTVSQGI

SEQ ID NO: 419665 - protein, 9 aa, Homo Sapiens
VPRPPQPWR

SEQ ID NO: 419666 - protein, 9 aa, Homo Sapiens
PLWSRWRPT

SEQ ID NO: 419667 - protein, 9 aa, Homo Sapiens
GSSTFSHQL

SEQ ID NO: 419668 - protein, 9 aa, Homo Sapiens
MSVKCVDVR

SEQ ID NO: 419669 - protein, 9 aa, Homo Sapiens
AAPPGGPGD

SEQ ID NO: 419670 - protein, 9 aa, Homo Sapiens
QGTRRSSNK

SEQ ID NO: 419671 - protein, 9 aa, Homo Sapiens
FCRQHRFLL

SEQ ID NO: 419672 - protein, 9 aa, Homo Sapiens
LSLHGAHWT

SEQ ID NO: 419673 - protein, 9 aa, Homo Sapiens
VPGVLTWRF

SEQ ID NO: 419674 - protein, 9 aa, Homo Sapiens
SECIDWGGK

SEQ ID NO: 419675 - protein, 9 aa, Homo Sapiens
QLREQRSVA

SEQ ID NO: 419676 - protein, 9 aa, Homo Sapiens
QHPLGVTKI

SEQ ID NO: 419677 - protein, 9 aa, Homo Sapiens
DRVLMYGQS

SEQ ID NO: 419678 - protein, 9 aa, Homo Sapiens
KNLYLLAFK

SEQ ID NO: 419679 - protein, 9 aa, Homo Sapiens
LPTYICGLP

SEQ ID NO: 419680 - protein, 9 aa, Homo Sapiens
MFYALVIVC

SEQ ID NO: 419681 - protein, 9 aa, Homo Sapiens
PSARIPDAT

SEQ ID NO: 419682 - protein, 9 aa, Homo Sapiens
RKCPPLHPE

SEQ ID NO: 419683 - protein, 9 aa, Homo Sapiens
RMATLERQT

SEQ ID NO: 419684 - protein, 9 aa, Homo Sapiens
QPSGTGKTV

SEQ ID NO: 419685 - protein, 9 aa, Homo Sapiens
VLMGNAIAL

SEQ ID NO: 419686 - protein, 9 aa, Homo Sapiens
LLGLHGTME

SEQ ID NO: 419687 - protein, 9 aa, Homo Sapiens
MIDSKLLKS

SEQ ID NO: 419688 - protein, 9 aa, Homo Sapiens
ALSAGHYLG

SEQ ID NO: 419689 - protein, 9 aa, Homo Sapiens
GTLHHHDRN

SEQ ID NO: 419690 - protein, 9 aa, Homo Sapiens
MSEETVTIE

SEQ ID NO: 419691 - protein, 9 aa, Homo Sapiens
YGCCGSCCG

SEQ ID NO: 419692 - protein, 9 aa, Homo Sapiens
HFVPEHHLI

SEQ ID NO: 419693 - protein, 9 aa, Homo Sapiens
ERLTRDKYT

SEQ ID NO: 419694 - protein, 9 aa, Homo Sapiens
VAVDVLPLV

SEQ ID NO: 419695 - protein, 9 aa, Homo Sapiens
LEGCISVKD

SEQ ID NO: 419696 - protein, 9 aa, Homo Sapiens
NGKIIDTKN

SEQ ID NO: 419697 - protein, 9 aa, Homo Sapiens
EIDKRMNNI

SEQ ID NO: 419698 - protein, 9 aa, Homo Sapiens
ALGYMDDQL

SEQ ID NO: 419699 - protein, 9 aa, Homo Sapiens
TSGNTVDGY

SEQ ID NO: 419700 - protein, 9 aa, Homo Sapiens
WEMGDMGPC

SEQ ID NO: 419701 - protein, 9 aa, Homo Sapiens
CSSNHTPHK

SEQ ID NO: 419702 - protein, 9 aa, Homo Sapiens
PDRFYQQVT

SEQ ID NO: 419703 - protein, 9 aa, Homo Sapiens
TIETGCCTW

SEQ ID NO: 419704 - protein, 9 aa, Homo Sapiens
QKSTLIDAL

SEQ ID NO: 419705 - protein, 9 aa, Homo Sapiens
RKSSLLSAL

SEQ ID NO: 419706 - protein, 9 aa, Homo Sapiens
YKVDHDERF

SEQ ID NO: 419707 - protein, 9 aa, Homo Sapiens
WQRIDLLTF

SEQ ID NO: 419708 - protein, 9 aa, Homo Sapiens
IMVPPVQQW

SEQ ID NO: 419709 - protein, 9 aa, Homo Sapiens
SISLLSEPE

SEQ ID NO: 419710 - protein, 9 aa, Homo Sapiens
RKWYSTKGG

SEQ ID NO: 419711 - protein, 9 aa, Homo Sapiens
LLWYLSWLD

SEQ ID NO: 419712 - protein, 9 aa, Homo Sapiens
PGERAGALR

SEQ ID NO: 419713 - protein, 9 aa, Homo Sapiens
GEQLREQRS

SEQ ID NO: 419714 - protein, 9 aa, Homo Sapiens
YLLWESNRR

SEQ ID NO: 419715 - protein, 9 aa, Homo Sapiens
SDRCALHGP

SEQ ID NO: 419716 - protein, 9 aa, Homo Sapiens
PEVSLPTAL

SEQ ID NO: 419717 - protein, 9 aa, Homo Sapiens
IAAMEGGLM

SEQ ID NO: 419718 - protein, 9 aa, Homo Sapiens
VVVTAGVCQ

SEQ ID NO: 419719 - protein, 9 aa, Homo Sapiens
ATLRGLLQD

SEQ ID NO: 419720 - protein, 9 aa, Homo Sapiens
YLLAPRNKM

SEQ ID NO: 419721 - protein, 9 aa, Homo Sapiens
PLYPPPSHT

SEQ ID NO: 419722 - protein, 9 aa, Homo Sapiens
LKGILMHRL

SEQ ID NO: 419723 - protein, 9 aa, Homo Sapiens
SFSVKNKER

SEQ ID NO: 419724 - protein, 9 aa, Homo Sapiens
IYDKKNMPQ

SEQ ID NO: 419725 - protein, 9 aa, Homo Sapiens
KWRPGASRR

SEQ ID NO: 419726 - protein, 9 aa, Homo Sapiens
ASFGSFTVH

SEQ ID NO: 419727 - protein, 9 aa, Homo Sapiens
RGSSSCSAR

SEQ ID NO: 419728 - protein, 9 aa, Homo Sapiens
DVDVVLKVE

SEQ ID NO: 419729 - protein, 9 aa, Homo Sapiens
HFPVVEQDK

SEQ ID NO: 419730 - protein, 9 aa, Homo Sapiens
KKVSTRKNG

SEQ ID NO: 419731 - protein, 9 aa, Homo Sapiens
LAQTFILLF

SEQ ID NO: 419732 - protein, 9 aa, Homo Sapiens
IFSMMCKED

SEQ ID NO: 419733 - protein, 9 aa, Homo Sapiens
ELLLQKCKE

SEQ ID NO: 419734 - protein, 9 aa, Homo Sapiens
EVCLSIIAT

SEQ ID NO: 419735 - protein, 9 aa, Homo Sapiens
HGENLKVLT

SEQ ID NO: 419736 - protein, 9 aa, Homo Sapiens
SGSRRRCIP

SEQ ID NO: 419737 - protein, 9 aa, Homo Sapiens
RAGVCCEPA

SEQ ID NO: 419738 - protein, 9 aa, Homo Sapiens
TRDQAFKKE

SEQ ID NO: 419739 - protein, 9 aa, Homo Sapiens
KVYHLELGF

SEQ ID NO: 419740 - protein, 9 aa, Homo Sapiens
LTFHPNYKK

SEQ ID NO: 419741 - protein, 9 aa, Homo Sapiens
MFIPAAAAP

SEQ ID NO: 419742 - protein, 9 aa, Homo Sapiens
CKHKKKGRQ

SEQ ID NO: 419743 - protein, 9 aa, Homo Sapiens
CDANVLLLF

SEQ ID NO: 419744 - protein, 9 aa, Homo Sapiens
PKRLSRGVQ

SEQ ID NO: 419745 - protein, 9 aa, Homo Sapiens
EWVTTIGAH

SEQ ID NO: 419746 - protein, 9 aa, Homo Sapiens
WTKTMRAPE

SEQ ID NO: 419747 - protein, 9 aa, Homo Sapiens
PNVVDSFFV

SEQ ID NO: 419748 - protein, 9 aa, Homo Sapiens
QENEPTATR

SEQ ID NO: 419749 - protein, 9 aa, Homo Sapiens
MAMVTRRRA

SEQ ID NO: 419750 - protein, 9 aa, Homo Sapiens
APLNVTSTA

SEQ ID NO: 419751 - protein, 9 aa, Homo Sapiens
LKTQSDVII

SEQ ID NO: 419752 - protein, 9 aa, Homo Sapiens
VRVVVRESD

SEQ ID NO: 419753 - protein, 9 aa, Homo Sapiens
TGERTKEGI

SEQ ID NO: 419754 - protein, 9 aa, Homo Sapiens
LHIQCEGGS

SEQ ID NO: 419755 - protein, 9 aa, Homo Sapiens
APEDLEARV

SEQ ID NO: 419756 - protein, 9 aa, Homo Sapiens
TAVPQEMKS

SEQ ID NO: 419757 - protein, 9 aa, Homo Sapiens
IILTVSLDF

SEQ ID NO: 419758 - protein, 9 aa, Homo Sapiens
VGCDLKNYN

SEQ ID NO: 419759 - protein, 9 aa, Homo Sapiens
GMPVTITNT

SEQ ID NO: 419760 - protein, 9 aa, Homo Sapiens
YYVFFTTMV

SEQ ID NO: 419761 - protein, 9 aa, Homo Sapiens
KWGRNTSLA

SEQ ID NO: 419762 - protein, 9 aa, Homo Sapiens
RSSLPLLRD

SEQ ID NO: 419763 - protein, 9 aa, Homo Sapiens
FRKSKSKSG

SEQ ID NO: 419764 - protein, 9 aa, Homo Sapiens
PSRSMTTLP

SEQ ID NO: 419765 - protein, 9 aa, Homo Sapiens
LAVVGVFFG

SEQ ID NO: 419766 - protein, 9 aa, Homo Sapiens
RATGSANVT

SEQ ID NO: 419767 - protein, 9 aa, Homo Sapiens
TYTVAVSGG

SEQ ID NO: 419768 - protein, 9 aa, Homo Sapiens
FWEIENKAI

SEQ ID NO: 419769 - protein, 9 aa, Homo Sapiens
LSTIKSILI

SEQ ID NO: 419770 - protein, 9 aa, Homo Sapiens
DVCTTKFGS

SEQ ID NO: 419771 - protein, 9 aa, Homo Sapiens
SQPPGTPQP

SEQ ID NO: 419772 - protein, 9 aa, Homo Sapiens
QQEAALRPM

SEQ ID NO: 419773 - protein, 9 aa, Homo Sapiens
CLSYITKIK

SEQ ID NO: 419774 - protein, 9 aa, Homo Sapiens
FPLKKLMAD

SEQ ID NO: 419775 - protein, 9 aa, Homo Sapiens
RVGPRRCPE

SEQ ID NO: 419776 - protein, 9 aa, Homo Sapiens
IPYFAVVVV

SEQ ID NO: 419777 - protein, 9 aa, Homo Sapiens
TEEKQTKSF

SEQ ID NO: 419778 - protein, 9 aa, Homo Sapiens
DGLTPPTLP

SEQ ID NO: 419779 - protein, 9 aa, Homo Sapiens
VVGVRSLWV

SEQ ID NO: 419780 - protein, 9 aa, Homo Sapiens
TLKSILSAL

SEQ ID NO: 419781 - protein, 9 aa, Homo Sapiens
YALEKDEGE

SEQ ID NO: 419782 - protein, 9 aa, Homo Sapiens
TPTGSCTDS

SEQ ID NO: 419783 - protein, 9 aa, Homo Sapiens
DLVCVNVWM

SEQ ID NO: 419784 - protein, 9 aa, Homo Sapiens
PAAAAPPPA

SEQ ID NO: 419785 - protein, 9 aa, Homo Sapiens
GGQQLSGIN

SEQ ID NO: 419786 - protein, 9 aa, Homo Sapiens
PALKIWEEL

SEQ ID NO: 419787 - protein, 9 aa, Homo Sapiens
WLSHRLRLR

SEQ ID NO: 419788 - protein, 9 aa, Homo Sapiens
QALLVPPGH

SEQ ID NO: 419789 - protein, 9 aa, Homo Sapiens
EMHYGHQAP

SEQ ID NO: 419790 - protein, 9 aa, Homo Sapiens
RLIPDGVSR

SEQ ID NO: 419791 - protein, 9 aa, Homo Sapiens
VGRGLAPWQ

SEQ ID NO: 419792 - protein, 9 aa, Homo Sapiens
RLRPHLRGQ

SEQ ID NO: 419793 - protein, 9 aa, Homo Sapiens
LRCLEAQIS

SEQ ID NO: 419794 - protein, 9 aa, Homo Sapiens
NGCAGGGVG

SEQ ID NO: 419795 - protein, 9 aa, Homo Sapiens
QQVLLPRVS

SEQ ID NO: 419796 - protein, 9 aa, Homo Sapiens
VRTARVSWG

SEQ ID NO: 419797 - protein, 9 aa, Homo Sapiens
LKMMMKLKK

SEQ ID NO: 419798 - protein, 9 aa, Homo Sapiens
EKTTKELEE

SEQ ID NO: 419799 - protein, 9 aa, Homo Sapiens
SPSTNVALY

SEQ ID NO: 419800 - protein, 9 aa, Homo Sapiens
LVFIFGFVA

SEQ ID NO: 419801 - protein, 9 aa, Homo Sapiens
AQKQRKHGE

SEQ ID NO: 419802 - protein, 9 aa, Homo Sapiens
ITSEGDHIT

SEQ ID NO: 419803 - protein, 9 aa, Homo Sapiens
ATLPGRLFR

SEQ ID NO: 419804 - protein, 9 aa, Homo Sapiens
LMIQHEQEG

SEQ ID NO: 419805 - protein, 9 aa, Homo Sapiens
SPCPLVAPA

SEQ ID NO: 419806 - protein, 9 aa, Homo Sapiens
LRRLLLDCL

SEQ ID NO: 419807 - protein, 9 aa, Homo Sapiens
PTSQPKSKP

SEQ ID NO: 419808 - protein, 9 aa, Homo Sapiens
LATRDARSS

SEQ ID NO: 419809 - protein, 9 aa, Homo Sapiens
IIMPIFLLL

SEQ ID NO: 419810 - protein, 9 aa, Homo Sapiens
TFNDASPPS

SEQ ID NO: 419811 - protein, 9 aa, Homo Sapiens
MPPYPGNFC

SEQ ID NO: 419812 - protein, 9 aa, Homo Sapiens
NAAIHKKYI

SEQ ID NO: 419813 - protein, 9 aa, Homo Sapiens
PVVMHWTTL

SEQ ID NO: 419814 - protein, 9 aa, Homo Sapiens
PKPPGASTS

SEQ ID NO: 419815 - protein, 9 aa, Homo Sapiens
LMTALLPSA

SEQ ID NO: 419816 - protein, 9 aa, Homo Sapiens
AGTGAVAGA

SEQ ID NO: 419817 - protein, 9 aa, Homo Sapiens
SRHSQEPPA

SEQ ID NO: 419818 - protein, 9 aa, Homo Sapiens
LAALSAGHY

SEQ ID NO: 419819 - protein, 9 aa, Homo Sapiens
PGALEVLSI

SEQ ID NO: 419820 - protein, 9 aa, Homo Sapiens
FERNCCSED

SEQ ID NO: 419821 - protein, 9 aa, Homo Sapiens
LLEQYQVLE

SEQ ID NO: 419822 - protein, 9 aa, Homo Sapiens
ASAPPAPPP

SEQ ID NO: 419823 - protein, 9 aa, Homo Sapiens
KGCEEDKNC

SEQ ID NO: 419824 - protein, 9 aa, Homo Sapiens
SRSPVPKKR

SEQ ID NO: 419825 - protein, 9 aa, Homo Sapiens
SAGLHNQYT

SEQ ID NO: 419826 - protein, 9 aa, Homo Sapiens
KLAEVKESL

SEQ ID NO: 419827 - protein, 9 aa, Homo Sapiens
STTTTCRSC

SEQ ID NO: 419828 - protein, 9 aa, Homo Sapiens
LAVPQVNMT

SEQ ID NO: 419829 - protein, 9 aa, Homo Sapiens
IVRSNWNIL

SEQ ID NO: 419830 - protein, 9 aa, Homo Sapiens
SEEQIVLLK

SEQ ID NO: 419831 - protein, 9 aa, Homo Sapiens
STSSPEKES

SEQ ID NO: 419832 - protein, 9 aa, Homo Sapiens
EGENCRYLH

SEQ ID NO: 419833 - protein, 9 aa, Homo Sapiens
KLNVEGVDS

SEQ ID NO: 419834 - protein, 9 aa, Homo Sapiens
QQRHPQGPC

SEQ ID NO: 419835 - protein, 9 aa, Homo Sapiens
VKALKKASS

SEQ ID NO: 419836 - protein, 9 aa, Homo Sapiens
ELALCNPVV

SEQ ID NO: 419837 - protein, 9 aa, Homo Sapiens
AGMWEGLAA

SEQ ID NO: 419838 - protein, 9 aa, Homo Sapiens
VIITQQLVK

SEQ ID NO: 419839 - protein, 9 aa, Homo Sapiens
AAWSTCCCT

SEQ ID NO: 419840 - protein, 9 aa, Homo Sapiens
DEGEEDSSN

SEQ ID NO: 419841 - protein, 9 aa, Homo Sapiens
LGVDAARLP

SEQ ID NO: 419842 - protein, 9 aa, Homo Sapiens
LATPRHQYY

SEQ ID NO: 419843 - protein, 9 aa, Homo Sapiens
RRAHERPHP

SEQ ID NO: 419844 - protein, 9 aa, Homo Sapiens
DLPPVPLLR

SEQ ID NO: 419845 - protein, 9 aa, Homo Sapiens
KTRGKVDIH

SEQ ID NO: 419846 - protein, 9 aa, Homo Sapiens
LHGQSSAQD

SEQ ID NO: 419847 - protein, 9 aa, Homo Sapiens
VAQCFRLKR

SEQ ID NO: 419848 - protein, 9 aa, Homo Sapiens
TRSSRGTSW

SEQ ID NO: 419849 - protein, 9 aa, Homo Sapiens
TSCPPLLEA

SEQ ID NO: 419850 - protein, 9 aa, Homo Sapiens
GRDEPWPGP

SEQ ID NO: 419851 - protein, 9 aa, Homo Sapiens
RAPLEGMLL

SEQ ID NO: 419852 - protein, 9 aa, Homo Sapiens
EVMDYTFIR

SEQ ID NO: 419853 - protein, 9 aa, Homo Sapiens
RLWSPPRLR

SEQ ID NO: 419854 - protein, 9 aa, Homo Sapiens
GMGELMTQV

SEQ ID NO: 419855 - protein, 9 aa, Homo Sapiens
VFDPRYRFD

SEQ ID NO: 419856 - protein, 9 aa, Homo Sapiens
LRLLSHLRC

SEQ ID NO: 419857 - protein, 9 aa, Homo Sapiens
MHELNVLAP

SEQ ID NO: 419858 - protein, 9 aa, Homo Sapiens
KRRRRKMTT

SEQ ID NO: 419859 - protein, 9 aa, Homo Sapiens
QGDFMSALL

SEQ ID NO: 419860 - protein, 9 aa, Homo Sapiens
LLAPRNKMP

SEQ ID NO: 419861 - protein, 9 aa, Homo Sapiens
LICGDHQDL

SEQ ID NO: 419862 - protein, 9 aa, Homo Sapiens
GATHFYLHT

SEQ ID NO: 419863 - protein, 9 aa, Homo Sapiens
ACGRASSEP

SEQ ID NO: 419864 - protein, 9 aa, Homo Sapiens
VLSPGTDPD

SEQ ID NO: 419865 - protein, 9 aa, Homo Sapiens
NTLLQRNME

SEQ ID NO: 419866 - protein, 9 aa, Homo Sapiens
PLPPPLPPL

SEQ ID NO: 419867 - protein, 9 aa, Homo Sapiens
HYHCTHENC

SEQ ID NO: 419868 - protein, 9 aa, Homo Sapiens
VGHLAVQGV

SEQ ID NO: 419869 - protein, 9 aa, Homo Sapiens
IPRLIPDGV

SEQ ID NO: 419870 - protein, 9 aa, Homo Sapiens
ASGRSCPEP

SEQ ID NO: 419871 - protein, 9 aa, Homo Sapiens
KTQLQHSLH

SEQ ID NO: 419872 - protein, 9 aa, Homo Sapiens
QHSYHLSGS

SEQ ID NO: 419873 - protein, 9 aa, Homo Sapiens
GSRAARGAI

SEQ ID NO: 419874 - protein, 9 aa, Homo Sapiens
AITIFFCMD

SEQ ID NO: 419875 - protein, 9 aa, Homo Sapiens
LLTAHLLRL

SEQ ID NO: 419876 - protein, 9 aa, Homo Sapiens
VPNQKVKSL

SEQ ID NO: 419877 - protein, 9 aa, Homo Sapiens
SKKDLHDVP

SEQ ID NO: 419878 - protein, 9 aa, Homo Sapiens
AFMMRVPST

SEQ ID NO: 419879 - protein, 9 aa, Homo Sapiens
QGPDLSLDL

SEQ ID NO: 419880 - protein, 9 aa, Homo Sapiens
VQCLTLDHR

SEQ ID NO: 419881 - protein, 9 aa, Homo Sapiens
TQALWKAFH

SEQ ID NO: 419882 - protein, 9 aa, Homo Sapiens
HKCSVVDSL

SEQ ID NO: 419883 - protein, 9 aa, Homo Sapiens
PRVRSIRFV

SEQ ID NO: 419884 - protein, 9 aa, Homo Sapiens
WKLYKCNDC

SEQ ID NO: 419885 - protein, 9 aa, Homo Sapiens
LLEKVSKKD

SEQ ID NO: 419886 - protein, 9 aa, Homo Sapiens
RLELTQRLS

SEQ ID NO: 419887 - protein, 9 aa, Homo Sapiens
QRGCQQREQ

SEQ ID NO: 419888 - protein, 9 aa, Homo Sapiens
LHKTVNSSH

SEQ ID NO: 419889 - protein, 9 aa, Homo Sapiens
IAVKEKSQY

SEQ ID NO: 419890 - protein, 9 aa, Homo Sapiens
ISAFSHDNI

SEQ ID NO: 419891 - protein, 9 aa, Homo Sapiens
LEAEAASPR

SEQ ID NO: 419892 - protein, 9 aa, Homo Sapiens
RGKECSINH

SEQ ID NO: 419893 - protein, 9 aa, Homo Sapiens
ELRDSALYL

SEQ ID NO: 419894 - protein, 9 aa, Homo Sapiens
LSPKSTSPH

SEQ ID NO: 419895 - protein, 9 aa, Homo Sapiens
TTSPAPRTL

SEQ ID NO: 419896 - protein, 9 aa, Homo Sapiens
AGFGTITGN

SEQ ID NO: 419897 - protein, 9 aa, Homo Sapiens
GLTPPTLPR

SEQ ID NO: 419898 - protein, 9 aa, Homo Sapiens
ATFFVATWA

SEQ ID NO: 419899 - protein, 9 aa, Homo Sapiens
TVLGLKSLT

SEQ ID NO: 419900 - protein, 9 aa, Homo Sapiens
CRPMRKTAP

SEQ ID NO: 419901 - protein, 9 aa, Homo Sapiens
MGVVGCAPT

SEQ ID NO: 419902 - protein, 9 aa, Homo Sapiens
CIHITGMSL

SEQ ID NO: 419903 - protein, 9 aa, Homo Sapiens
QSGVQFVLG

SEQ ID NO: 419904 - protein, 9 aa, Homo Sapiens
CWREESSFV

SEQ ID NO: 419905 - protein, 9 aa, Homo Sapiens
QSRSPVPKK

SEQ ID NO: 419906 - protein, 9 aa, Homo Sapiens
YMLRWLCGK

SEQ ID NO: 419907 - protein, 9 aa, Homo Sapiens
GRVWGNLRQ

SEQ ID NO: 419908 - protein, 9 aa, Homo Sapiens
VCQQEGESR

SEQ ID NO: 419909 - protein, 9 aa, Homo Sapiens
GPRLPSQPA

SEQ ID NO: 419910 - protein, 9 aa, Homo Sapiens
GSDGGKLPG

SEQ ID NO: 419911 - protein, 9 aa, Homo Sapiens
LSYITKIKL

SEQ ID NO: 419912 - protein, 9 aa, Homo Sapiens
EENVILVWL

SEQ ID NO: 419913 - protein, 9 aa, Homo Sapiens
ELTQRLSNR

SEQ ID NO: 419914 - protein, 9 aa, Homo Sapiens
KNVLFMTMG

SEQ ID NO: 419915 - protein, 9 aa, Homo Sapiens
ALPSRPAQP

SEQ ID NO: 419916 - protein, 9 aa, Homo Sapiens
GELHTHVSR

SEQ ID NO: 419917 - protein, 9 aa, Homo Sapiens
CGWNSTHPG

SEQ ID NO: 419918 - protein, 9 aa, Homo Sapiens
EPRHCIEFR

SEQ ID NO: 419919 - protein, 9 aa, Homo Sapiens
PISLGSMPN

SEQ ID NO: 419920 - protein, 9 aa, Homo Sapiens
RPFCADQFC

SEQ ID NO: 419921 - protein, 9 aa, Homo Sapiens
ENPFTAPST

SEQ ID NO: 419922 - protein, 9 aa, Homo Sapiens
HRTSQNHSK

SEQ ID NO: 419923 - protein, 9 aa, Homo Sapiens
LQQPCQLHG

SEQ ID NO: 419924 - protein, 9 aa, Homo Sapiens
FMLEPEGMP

SEQ ID NO: 419925 - protein, 9 aa, Homo Sapiens
PRVSLTPAT

SEQ ID NO: 419926 - protein, 9 aa, Homo Sapiens
CNSSKLCGL

SEQ ID NO: 419927 - protein, 9 aa, Homo Sapiens
LTISVSSSD

SEQ ID NO: 419928 - protein, 9 aa, Homo Sapiens
HDGEAEEVA

SEQ ID NO: 419929 - protein, 9 aa, Homo Sapiens
EKNSYSAYI

SEQ ID NO: 419930 - protein, 9 aa, Homo Sapiens
FQQYALLRE

SEQ ID NO: 419931 - protein, 9 aa, Homo Sapiens
QSRTDWDDY

SEQ ID NO: 419932 - protein, 9 aa, Homo Sapiens
QSARHPAPT

SEQ ID NO: 419933 - protein, 9 aa, Homo Sapiens
ERGYGKDAA

SEQ ID NO: 419934 - protein, 9 aa, Homo Sapiens
TKSSSSASG

SEQ ID NO: 419935 - protein, 9 aa, Homo Sapiens
RGPSPSVHP

SEQ ID NO: 419936 - protein, 9 aa, Homo Sapiens
VHLPQPRLA

SEQ ID NO: 419937 - protein, 9 aa, Homo Sapiens
DCLVFAPAF

SEQ ID NO: 419938 - protein, 9 aa, Homo Sapiens
RAVDSSAPE

SEQ ID NO: 419939 - protein, 9 aa, Homo Sapiens
GPEGEAGVD

SEQ ID NO: 419940 - protein, 9 aa, Homo Sapiens
LALCASSQD

SEQ ID NO: 419941 - protein, 9 aa, Homo Sapiens
LHHAAGHSE

SEQ ID NO: 419942 - protein, 9 aa, Homo Sapiens
TVRYACDTC

SEQ ID NO: 419943 - protein, 9 aa, Homo Sapiens
PSVPSLYLF

SEQ ID NO: 419944 - protein, 9 aa, Homo Sapiens
RGAPRHPHR

SEQ ID NO: 419945 - protein, 9 aa, Homo Sapiens
QLFERGYGK

SEQ ID NO: 419946 - protein, 9 aa, Homo Sapiens
GESPPASLK

SEQ ID NO: 419947 - protein, 9 aa, Homo Sapiens
TLSPQLCRP

SEQ ID NO: 419948 - protein, 9 aa, Homo Sapiens
LPRALPSLL

SEQ ID NO: 419949 - protein, 9 aa, Homo Sapiens
TYQAQLQQS

SEQ ID NO: 419950 - protein, 9 aa, Homo Sapiens
SQVWTAATL

SEQ ID NO: 419951 - protein, 9 aa, Homo Sapiens
RISLFLGSH

SEQ ID NO: 419952 - protein, 9 aa, Homo Sapiens
PREPKQEDL

SEQ ID NO: 419953 - protein, 9 aa, Homo Sapiens
PTNATGAFR

SEQ ID NO: 419954 - protein, 9 aa, Homo Sapiens
AALQRLTWV

SEQ ID NO: 419955 - protein, 9 aa, Homo Sapiens
GLFPLFYVF

SEQ ID NO: 419956 - protein, 9 aa, Homo Sapiens
CAVYVVNII

SEQ ID NO: 419957 - protein, 9 aa, Homo Sapiens
HLALATDQA

SEQ ID NO: 419958 - protein, 9 aa, Homo Sapiens
KNCVLLNRP

SEQ ID NO: 419959 - protein, 9 aa, Homo Sapiens
WGRPCSSPQ

SEQ ID NO: 419960 - protein, 9 aa, Homo Sapiens
CPKTGRDSW

SEQ ID NO: 419961 - protein, 9 aa, Homo Sapiens
GHEHGYHKM

SEQ ID NO: 419962 - protein, 9 aa, Homo Sapiens
PVMPLENYQ

SEQ ID NO: 419963 - protein, 9 aa, Homo Sapiens
SSQGSQCTK

SEQ ID NO: 419964 - protein, 9 aa, Homo Sapiens
THTHTHTHA

SEQ ID NO: 419965 - protein, 9 aa, Homo Sapiens
RWGPRATLT

SEQ ID NO: 419966 - protein, 9 aa, Homo Sapiens
PSTSSRISS

SEQ ID NO: 419967 - protein, 9 aa, Homo Sapiens
SRWNFVYWA

SEQ ID NO: 419968 - protein, 9 aa, Homo Sapiens
LHAHYYPPI

SEQ ID NO: 419969 - protein, 9 aa, Homo Sapiens
VLLKKLQNW

SEQ ID NO: 419970 - protein, 9 aa, Homo Sapiens
LVYVNYTRT

SEQ ID NO: 419971 - protein, 9 aa, Homo Sapiens
HAPLTVLLQ

SEQ ID NO: 419972 - protein, 9 aa, Homo Sapiens
TDFWLAGLD

SEQ ID NO: 419973 - protein, 9 aa, Homo Sapiens
TPTPTVVTT

SEQ ID NO: 419974 - protein, 9 aa, Homo Sapiens
AHEYQEQKQ

SEQ ID NO: 419975 - protein, 9 aa, Homo Sapiens
SKHALMVVL

SEQ ID NO: 419976 - protein, 9 aa, Homo Sapiens
PKSTSPHHP

SEQ ID NO: 419977 - protein, 9 aa, Homo Sapiens
VEIEMDYSR

SEQ ID NO: 419978 - protein, 9 aa, Homo Sapiens
RLHSPHPHG

SEQ ID NO: 419979 - protein, 9 aa, Homo Sapiens
NGENQAMIK

SEQ ID NO: 419980 - protein, 9 aa, Homo Sapiens
DAVNTKSYP

SEQ ID NO: 419981 - protein, 9 aa, Homo Sapiens
QPPPALPSR

SEQ ID NO: 419982 - protein, 9 aa, Homo Sapiens
GLGVDSDAI

SEQ ID NO: 419983 - protein, 9 aa, Homo Sapiens
KDKRAGSQF

SEQ ID NO: 419984 - protein, 9 aa, Homo Sapiens
EDLGGVGLL

SEQ ID NO: 419985 - protein, 9 aa, Homo Sapiens
STPVDTPDI

SEQ ID NO: 419986 - protein, 9 aa, Homo Sapiens
NAGIKLATE

SEQ ID NO: 419987 - protein, 9 aa, Homo Sapiens
RQQIMSNGE

SEQ ID NO: 419988 - protein, 9 aa, Homo Sapiens
WLMTALLPS

SEQ ID NO: 419989 - protein, 9 aa, Homo Sapiens
APRIESKSI

SEQ ID NO: 419990 - protein, 9 aa, Homo Sapiens
HDLVVRLHE

SEQ ID NO: 419991 - protein, 9 aa, Homo Sapiens
GGKRNTIAS

SEQ ID NO: 419992 - protein, 9 aa, Homo Sapiens
GHGRWWRPA

SEQ ID NO: 419993 - protein, 9 aa, Homo Sapiens
GEDRVQDIF

SEQ ID NO: 419994 - protein, 9 aa, Homo Sapiens
KNTKYVCLA

SEQ ID NO: 419995 - protein, 9 aa, Homo Sapiens
GRLGSGWRS

SEQ ID NO: 419996 - protein, 9 aa, Homo Sapiens
EGLRPTPPM

SEQ ID NO: 419997 - protein, 9 aa, Homo Sapiens
GFHSVEVCL

SEQ ID NO: 419998 - protein, 9 aa, Homo Sapiens
SASSTFSIS

SEQ ID NO: 419999 - protein, 9 aa, Homo Sapiens
ERKDKKKKE

SEQ ID NO: 420000 - protein, 9 aa, Homo Sapiens
SPFTIVMPN

SEQ ID NO: 420001 - protein, 9 aa, Homo Sapiens
LTVQIVADL

SEQ ID NO: 420002 - protein, 9 aa, Homo Sapiens
MATGCRACD

SEQ ID NO: 420003 - protein, 9 aa, Homo Sapiens
WRCWSSSRR

SEQ ID NO: 420004 - protein, 9 aa, Homo Sapiens
KSASLQPKT

SEQ ID NO: 420005 - protein, 9 aa, Homo Sapiens
VEMPLGIQT

SEQ ID NO: 420006 - protein, 9 aa, Homo Sapiens
PFDIVFLIA

SEQ ID NO: 420007 - protein, 9 aa, Homo Sapiens
VQGPGILGE

SEQ ID NO: 420008 - protein, 9 aa, Homo Sapiens
GVGGFYYEL

SEQ ID NO: 420009 - protein, 9 aa, Homo Sapiens
HPLGSQHIS

SEQ ID NO: 420010 - protein, 9 aa, Homo Sapiens
FSPIIIGRK

SEQ ID NO: 420011 - protein, 9 aa, Homo Sapiens
TRRMRTFSA

SEQ ID NO: 420012 - protein, 9 aa, Homo Sapiens
GNEPGRPLR

SEQ ID NO: 420013 - protein, 9 aa, Homo Sapiens
GALTRTTSE

SEQ ID NO: 420014 - protein, 9 aa, Homo Sapiens
LELLLQKCK

SEQ ID NO: 420015 - protein, 9 aa, Homo Sapiens
ALRHRFSCI

SEQ ID NO: 420016 - protein, 9 aa, Homo Sapiens
LEKRASFYE

SEQ ID NO: 420017 - protein, 9 aa, Homo Sapiens
YCLSYITKI

SEQ ID NO: 420018 - protein, 9 aa, Homo Sapiens
RVSTPLASF

SEQ ID NO: 420019 - protein, 9 aa, Homo Sapiens
GPLGLRPPH

SEQ ID NO: 420020 - protein, 9 aa, Homo Sapiens
SQDDRSTWI

SEQ ID NO: 420021 - protein, 9 aa, Homo Sapiens
NLGNNALRD

SEQ ID NO: 420022 - protein, 9 aa, Homo Sapiens
NAILCSCSW

SEQ ID NO: 420023 - protein, 9 aa, Homo Sapiens
VNMQYFLTI

SEQ ID NO: 420024 - protein, 9 aa, Homo Sapiens
PVRLCVPQN

SEQ ID NO: 420025 - protein, 9 aa, Homo Sapiens
SKGKKKGQT

SEQ ID NO: 420026 - protein, 9 aa, Homo Sapiens
RTPLNIIDI

SEQ ID NO: 420027 - protein, 9 aa, Homo Sapiens
ALHREKQKL

SEQ ID NO: 420028 - protein, 9 aa, Homo Sapiens
FPREVHLPQ

SEQ ID NO: 420029 - protein, 9 aa, Homo Sapiens
VAEGALVGP

SEQ ID NO: 420030 - protein, 9 aa, Homo Sapiens
RGGRDHFTA

SEQ ID NO: 420031 - protein, 9 aa, Homo Sapiens
KSDFSNNWN

SEQ ID NO: 420032 - protein, 9 aa, Homo Sapiens
VPGHKSVRV

SEQ ID NO: 420033 - protein, 9 aa, Homo Sapiens
VLWLIGAKS

SEQ ID NO: 420034 - protein, 9 aa, Homo Sapiens
KEDLSWARM

SEQ ID NO: 420035 - protein, 9 aa, Homo Sapiens
PPQHQLSAP

SEQ ID NO: 420036 - protein, 9 aa, Homo Sapiens
YEKLNIEGM

SEQ ID NO: 420037 - protein, 9 aa, Homo Sapiens
RGETVVLQC

SEQ ID NO: 420038 - protein, 9 aa, Homo Sapiens
YWASLWNLV

SEQ ID NO: 420039 - protein, 9 aa, Homo Sapiens
EYFCDMGYH

SEQ ID NO: 420040 - protein, 9 aa, Homo Sapiens
LFFLPLVFA

SEQ ID NO: 420041 - protein, 9 aa, Homo Sapiens
WKRTQQRPP

SEQ ID NO: 420042 - protein, 9 aa, Homo Sapiens
NLSTIKSIL

SEQ ID NO: 420043 - protein, 9 aa, Homo Sapiens
TKIETSLPK

SEQ ID NO: 420044 - protein, 9 aa, Homo Sapiens
PALSSWSHL

SEQ ID NO: 420045 - protein, 9 aa, Homo Sapiens
KCIIHGPAP

SEQ ID NO: 420046 - protein, 9 aa, Homo Sapiens
QRGGRMLKH

SEQ ID NO: 420047 - protein, 9 aa, Homo Sapiens
YLQLAGIMG

SEQ ID NO: 420048 - protein, 9 aa, Homo Sapiens
KWYTAEDMY

SEQ ID NO: 420049 - protein, 9 aa, Homo Sapiens
PAVLIPTSA

SEQ ID NO: 420050 - protein, 9 aa, Homo Sapiens
STAAPRSRA

SEQ ID NO: 420051 - protein, 9 aa, Homo Sapiens
QLLIPRSPS

SEQ ID NO: 420052 - protein, 9 aa, Homo Sapiens
HHPGKQGCC

SEQ ID NO: 420053 - protein, 9 aa, Homo Sapiens
TRDTSKKNK

SEQ ID NO: 420054 - protein, 9 aa, Homo Sapiens
VIGKISQQD

SEQ ID NO: 420055 - protein, 9 aa, Homo Sapiens
TDAQCSGPG

SEQ ID NO: 420056 - protein, 9 aa, Homo Sapiens
FPHVLSPVS

SEQ ID NO: 420057 - protein, 9 aa, Homo Sapiens
HQDLEQPDR

SEQ ID NO: 420058 - protein, 9 aa, Homo Sapiens
HISLGQLSS

SEQ ID NO: 420059 - protein, 9 aa, Homo Sapiens
GGRQDLPPV

SEQ ID NO: 420060 - protein, 9 aa, Homo Sapiens
IQVIELLDG

SEQ ID NO: 420061 - protein, 9 aa, Homo Sapiens
GIIPAGSMD

SEQ ID NO: 420062 - protein, 9 aa, Homo Sapiens
DSAERLQIS

SEQ ID NO: 420063 - protein, 9 aa, Homo Sapiens
AGKLSPSLP

SEQ ID NO: 420064 - protein, 9 aa, Homo Sapiens
TGLTISDLW

SEQ ID NO: 420065 - protein, 9 aa, Homo Sapiens
HVRVDHRDA

SEQ ID NO: 420066 - protein, 9 aa, Homo Sapiens
MLKSALGPD

SEQ ID NO: 420067 - protein, 9 aa, Homo Sapiens
GRWWRPAPS

SEQ ID NO: 420068 - protein, 9 aa, Homo Sapiens
VGTWINDIS

SEQ ID NO: 420069 - protein, 9 aa, Homo Sapiens
HPVPLHQVI

SEQ ID NO: 420070 - protein, 9 aa, Homo Sapiens
PKPPLPTPD

SEQ ID NO: 420071 - protein, 9 aa, Homo Sapiens
SEGDHITSV

SEQ ID NO: 420072 - protein, 9 aa, Homo Sapiens
DIRVPFLFV

SEQ ID NO: 420073 - protein, 9 aa, Homo Sapiens
QSGQKLRKK

SEQ ID NO: 420074 - protein, 9 aa, Homo Sapiens
KMNMTLWKQ

SEQ ID NO: 420075 - protein, 9 aa, Homo Sapiens
RALHELIHN

SEQ ID NO: 420076 - protein, 9 aa, Homo Sapiens
EESSFVAPN

SEQ ID NO: 420077 - protein, 9 aa, Homo Sapiens
GQAPEDLEA

SEQ ID NO: 420078 - protein, 9 aa, Homo Sapiens
CSSGSGEPT

SEQ ID NO: 420079 - protein, 9 aa, Homo Sapiens
YHKMELPDY

SEQ ID NO: 420080 - protein, 9 aa, Homo Sapiens
FMPFVNTSV

SEQ ID NO: 420081 - protein, 9 aa, Homo Sapiens
IGKTSCARA

SEQ ID NO: 420082 - protein, 9 aa, Homo Sapiens
IDAHANEEI

SEQ ID NO: 420083 - protein, 9 aa, Homo Sapiens
QHIVSTGQL

SEQ ID NO: 420084 - protein, 9 aa, Homo Sapiens
VSRPFYLEA

SEQ ID NO: 420085 - protein, 9 aa, Homo Sapiens
NGVYWSESV

SEQ ID NO: 420086 - protein, 9 aa, Homo Sapiens
RRTAQGLLV

SEQ ID NO: 420087 - protein, 9 aa, Homo Sapiens
CSPVVVPTP

SEQ ID NO: 420088 - protein, 9 aa, Homo Sapiens
PAPHPARTQ

SEQ ID NO: 420089 - protein, 9 aa, Homo Sapiens
GELQSLQCH

SEQ ID NO: 420090 - protein, 9 aa, Homo Sapiens
HREKQKLVE

SEQ ID NO: 420091 - protein, 9 aa, Homo Sapiens
PRHSSVLAT

SEQ ID NO: 420092 - protein, 9 aa, Homo Sapiens
NHLGTGGGF

SEQ ID NO: 420093 - protein, 9 aa, Homo Sapiens
DESIPIIYR

SEQ ID NO: 420094 - protein, 9 aa, Homo Sapiens
LEEGWGGCP

SEQ ID NO: 420095 - protein, 9 aa, Homo Sapiens
PSRASSGCT

SEQ ID NO: 420096 - protein, 9 aa, Homo Sapiens
SQHPLQASS

SEQ ID NO: 420097 - protein, 9 aa, Homo Sapiens
HHFLVTSHY

SEQ ID NO: 420098 - protein, 9 aa, Homo Sapiens
LKEMKRDRE

SEQ ID NO: 420099 - protein, 9 aa, Homo Sapiens
NTQENFSLS

SEQ ID NO: 420100 - protein, 9 aa, Homo Sapiens
VLQDKGASI

SEQ ID NO: 420101 - protein, 9 aa, Homo Sapiens
QLLLQGPDL

SEQ ID NO: 420102 - protein, 9 aa, Homo Sapiens
RGILEELSC

SEQ ID NO: 420103 - protein, 9 aa, Homo Sapiens
QDDGRGGSL

SEQ ID NO: 420104 - protein, 9 aa, Homo Sapiens
TPGVFDPRY

SEQ ID NO: 420105 - protein, 9 aa, Homo Sapiens
AVYVVNIIQ

SEQ ID NO: 420106 - protein, 9 aa, Homo Sapiens
KLQLRGKLE

SEQ ID NO: 420107 - protein, 9 aa, Homo Sapiens
PLARVQAPV

SEQ ID NO: 420108 - protein, 9 aa, Homo Sapiens
PRKRFAFFP

SEQ ID NO: 420109 - protein, 9 aa, Homo Sapiens
SLTIYNSLL

SEQ ID NO: 420110 - protein, 9 aa, Homo Sapiens
PWEPKPPAG

SEQ ID NO: 420111 - protein, 9 aa, Homo Sapiens
GQTCQCRAP

SEQ ID NO: 420112 - protein, 9 aa, Homo Sapiens
QAPSQVWTA

SEQ ID NO: 420113 - protein, 9 aa, Homo Sapiens
LRTVVALGL

SEQ ID NO: 420114 - protein, 9 aa, Homo Sapiens
KKSQKGASW

SEQ ID NO: 420115 - protein, 9 aa, Homo Sapiens
GSANVTKKK

SEQ ID NO: 420116 - protein, 9 aa, Homo Sapiens
ASRRWRMST

SEQ ID NO: 420117 - protein, 9 aa, Homo Sapiens
ATQAPCMMT

SEQ ID NO: 420118 - protein, 9 aa, Homo Sapiens
IERRKLEKK

SEQ ID NO: 420119 - protein, 9 aa, Homo Sapiens
KTVTRGETV

SEQ ID NO: 420120 - protein, 9 aa, Homo Sapiens
GTTPKPRGG

SEQ ID NO: 420121 - protein, 9 aa, Homo Sapiens
TITGNTIDV

SEQ ID NO: 420122 - protein, 9 aa, Homo Sapiens
SSDIPGPAG

SEQ ID NO: 420123 - protein, 9 aa, Homo Sapiens
EKCIHITGM

SEQ ID NO: 420124 - protein, 9 aa, Homo Sapiens
HNRQIYPPS

SEQ ID NO: 420125 - protein, 9 aa, Homo Sapiens
CPALQNPAP

SEQ ID NO: 420126 - protein, 9 aa, Homo Sapiens
ACVGDRFMR

SEQ ID NO: 420127 - protein, 9 aa, Homo Sapiens
PLVREQLWV

SEQ ID NO: 420128 - protein, 9 aa, Homo Sapiens
PSPMQQQLQ

SEQ ID NO: 420129 - protein, 9 aa, Homo Sapiens
RKQKMPQEG

SEQ ID NO: 420130 - protein, 9 aa, Homo Sapiens
VLGLKSLTK

SEQ ID NO: 420131 - protein, 9 aa, Homo Sapiens
SLHRAARQP

SEQ ID NO: 420132 - protein, 9 aa, Homo Sapiens
EASVTAETT

SEQ ID NO: 420133 - protein, 9 aa, Homo Sapiens
KFTWKRLRL

SEQ ID NO: 420134 - protein, 9 aa, Homo Sapiens
LEPERYCLA

SEQ ID NO: 420135 - protein, 9 aa, Homo Sapiens
LRLLWICSQ

SEQ ID NO: 420136 - protein, 9 aa, Homo Sapiens
AVQQGVQRL

SEQ ID NO: 420137 - protein, 9 aa, Homo Sapiens
APQVLAYPF

SEQ ID NO: 420138 - protein, 9 aa, Homo Sapiens
KQKKLRMKK

SEQ ID NO: 420139 - protein, 9 aa, Homo Sapiens
FFKFCIPRP

SEQ ID NO: 420140 - protein, 9 aa, Homo Sapiens
CLLTAHLLR

SEQ ID NO: 420141 - protein, 9 aa, Homo Sapiens
FTSVTQALT

SEQ ID NO: 420142 - protein, 9 aa, Homo Sapiens
VGFMDTRKH

SEQ ID NO: 420143 - protein, 9 aa, Homo Sapiens
KLNIEGMEK

SEQ ID NO: 420144 - protein, 9 aa, Homo Sapiens
EKKEEAENQ

SEQ ID NO: 420145 - protein, 9 aa, Homo Sapiens
PREKGRLGK

SEQ ID NO: 420146 - protein, 9 aa, Homo Sapiens
RCALHGPVQ

SEQ ID NO: 420147 - protein, 9 aa, Homo Sapiens
NASAPNDSL

SEQ ID NO: 420148 - protein, 9 aa, Homo Sapiens
LFVKKCKTS

SEQ ID NO: 420149 - protein, 9 aa, Homo Sapiens
SLNEEEIWL

SEQ ID NO: 420150 - protein, 9 aa, Homo Sapiens
LHPLLIRII

SEQ ID NO: 420151 - protein, 9 aa, Homo Sapiens
TQSARHPAP

SEQ ID NO: 420152 - protein, 9 aa, Homo Sapiens
PRTLEGCIS

SEQ ID NO: 420153 - protein, 9 aa, Homo Sapiens
RCRCVCLRF

SEQ ID NO: 420154 - protein, 9 aa, Homo Sapiens
VVRVDTNDM

SEQ ID NO: 420155 - protein, 9 aa, Homo Sapiens
KWSWMTLPG

SEQ ID NO: 420156 - protein, 9 aa, Homo Sapiens
TKKEDTLEA

SEQ ID NO: 420157 - protein, 9 aa, Homo Sapiens
ARPSPSWFR

SEQ ID NO: 420158 - protein, 9 aa, Homo Sapiens
TWTRCRGHK

SEQ ID NO: 420159 - protein, 9 aa, Homo Sapiens
VPWKRKQRA

SEQ ID NO: 420160 - protein, 9 aa, Homo Sapiens
GLPSRSMTT

SEQ ID NO: 420161 - protein, 9 aa, Homo Sapiens
GAAPRAHEH

SEQ ID NO: 420162 - protein, 9 aa, Homo Sapiens
GGDFSGMAQ

SEQ ID NO: 420163 - protein, 9 aa, Homo Sapiens
SAFDRSHRD

SEQ ID NO: 420164 - protein, 9 aa, Homo Sapiens
PGNWELKLE

SEQ ID NO: 420165 - protein, 9 aa, Homo Sapiens
MDIDQLPER

SEQ ID NO: 420166 - protein, 9 aa, Homo Sapiens
NGQTWTRGD

SEQ ID NO: 420167 - protein, 9 aa, Homo Sapiens
VLDQDDNAP

SEQ ID NO: 420168 - protein, 9 aa, Homo Sapiens
IGRVCDTCL

SEQ ID NO: 420169 - protein, 9 aa, Homo Sapiens
VAGGAAEGL

SEQ ID NO: 420170 - protein, 9 aa, Homo Sapiens
RVIHSFKGR

SEQ ID NO: 420171 - protein, 9 aa, Homo Sapiens
TNLCAIHAE

SEQ ID NO: 420172 - protein, 9 aa, Homo Sapiens
GRTAHKAAH

SEQ ID NO: 420173 - protein, 9 aa, Homo Sapiens
YCKLPSLSP

SEQ ID NO: 420174 - protein, 9 aa, Homo Sapiens
RIKELALCN

SEQ ID NO: 420175 - protein, 9 aa, Homo Sapiens
HHRDRCERS

SEQ ID NO: 420176 - protein, 9 aa, Homo Sapiens
CTTTRWSAC

SEQ ID NO: 420177 - protein, 9 aa, Homo Sapiens
LLASRRTWS

SEQ ID NO: 420178 - protein, 9 aa, Homo Sapiens
RIQDEDQCL

SEQ ID NO: 420179 - protein, 9 aa, Homo Sapiens
MPQRLTGRS

SEQ ID NO: 420180 - protein, 9 aa, Homo Sapiens
YTETQNQFL

SEQ ID NO: 420181 - protein, 9 aa, Homo Sapiens
PYKFCYEVA

SEQ ID NO: 420182 - protein, 9 aa, Homo Sapiens
CLILADESD

SEQ ID NO: 420183 - protein, 9 aa, Homo Sapiens
PPSPTCFST

SEQ ID NO: 420184 - protein, 9 aa, Homo Sapiens
RPTRRPRRR

SEQ ID NO: 420185 - protein, 9 aa, Homo Sapiens
KFWQPELFL

SEQ ID NO: 420186 - protein, 9 aa, Homo Sapiens
YWQIVDAQA

SEQ ID NO: 420187 - protein, 9 aa, Homo Sapiens
EDAQAIQNP

SEQ ID NO: 420188 - protein, 9 aa, Homo Sapiens
ILTVSLDFN

SEQ ID NO: 420189 - protein, 9 aa, Homo Sapiens
VAQQRQRLV

SEQ ID NO: 420190 - protein, 9 aa, Homo Sapiens
MAPTTAPRR

SEQ ID NO: 420191 - protein, 9 aa, Homo Sapiens
TQKNLYQDV

SEQ ID NO: 420192 - protein, 9 aa, Homo Sapiens
GALQGVFRG

SEQ ID NO: 420193 - protein, 9 aa, Homo Sapiens
MVQLFERGY

SEQ ID NO: 420194 - protein, 9 aa, Homo Sapiens
CRTAGHAAT

SEQ ID NO: 420195 - protein, 9 aa, Homo Sapiens
HCSHLAMEL

SEQ ID NO: 420196 - protein, 9 aa, Homo Sapiens
NVMKTYSLV

SEQ ID NO: 420197 - protein, 9 aa, Homo Sapiens
FGPDFCHCP

SEQ ID NO: 420198 - protein, 9 aa, Homo Sapiens
DREFRIIFD

SEQ ID NO: 420199 - protein, 9 aa, Homo Sapiens
AKAAGFGTI

SEQ ID NO: 420200 - protein, 9 aa, Homo Sapiens
LPTNQLCHC

SEQ ID NO: 420201 - protein, 9 aa, Homo Sapiens
QASLSILVA

SEQ ID NO: 420202 - protein, 9 aa, Homo Sapiens
LEKERKRLK

SEQ ID NO: 420203 - protein, 9 aa, Homo Sapiens
GSVDALWIE

SEQ ID NO: 420204 - protein, 9 aa, Homo Sapiens
NPVQGVMYS

SEQ ID NO: 420205 - protein, 9 aa, Homo Sapiens
REAEALKRQ

SEQ ID NO: 420206 - protein, 9 aa, Homo Sapiens
VLEEPDDQN

SEQ ID NO: 420207 - protein, 9 aa, Homo Sapiens
RVSVQQTQA

SEQ ID NO: 420208 - protein, 9 aa, Homo Sapiens
VGADVLPVV

SEQ ID NO: 420209 - protein, 9 aa, Homo Sapiens
QYRLKIDFM

SEQ ID NO: 420210 - protein, 9 aa, Homo Sapiens
RLRLRSRSV

SEQ ID NO: 420211 - protein, 9 aa, Homo Sapiens
DRSHRDASP

SEQ ID NO: 420212 - protein, 9 aa, Homo Sapiens
ARAPLESVR

SEQ ID NO: 420213 - protein, 9 aa, Homo Sapiens
QERLSQMPA

SEQ ID NO: 420214 - protein, 9 aa, Homo Sapiens
AAQGVDVGP

SEQ ID NO: 420215 - protein, 9 aa, Homo Sapiens
LDQDNACVG

SEQ ID NO: 420216 - protein, 9 aa, Homo Sapiens
DCYYVTHLP

SEQ ID NO: 420217 - protein, 9 aa, Homo Sapiens
LAVAHRETV

SEQ ID NO: 420218 - protein, 9 aa, Homo Sapiens
PVGNGCAGG

SEQ ID NO: 420219 - protein, 9 aa, Homo Sapiens
GQRHHPGKQ

SEQ ID NO: 420220 - protein, 9 aa, Homo Sapiens
GVIWTCQNS

SEQ ID NO: 420221 - protein, 9 aa, Homo Sapiens
HLAKQTPAQ

SEQ ID NO: 420222 - protein, 9 aa, Homo Sapiens
GRQDILDNS

SEQ ID NO: 420223 - protein, 9 aa, Homo Sapiens
LLQLQQQQQ

SEQ ID NO: 420224 - protein, 9 aa, Homo Sapiens
PSTMRSTPS

SEQ ID NO: 420225 - protein, 9 aa, Homo Sapiens
QEPDISLVA

SEQ ID NO: 420226 - protein, 9 aa, Homo Sapiens
LSSSGSRRR

SEQ ID NO: 420227 - protein, 9 aa, Homo Sapiens
GRRLLPLVR

SEQ ID NO: 420228 - protein, 9 aa, Homo Sapiens
EEEERERAW

SEQ ID NO: 420229 - protein, 9 aa, Homo Sapiens
MLDHNCDTG

SEQ ID NO: 420230 - protein, 9 aa, Homo Sapiens
DELMLADCN

SEQ ID NO: 420231 - protein, 9 aa, Homo Sapiens
TCSSSPWKA

SEQ ID NO: 420232 - protein, 9 aa, Homo Sapiens
ALEYSKCRT

SEQ ID NO: 420233 - protein, 9 aa, Homo Sapiens
TMVMGIIFM

SEQ ID NO: 420234 - protein, 9 aa, Homo Sapiens
PTKNPTSPR

SEQ ID NO: 420235 - protein, 9 aa, Homo Sapiens
AIHGIWKLY

SEQ ID NO: 420236 - protein, 9 aa, Homo Sapiens
RYACDTCYI

SEQ ID NO: 420237 - protein, 9 aa, Homo Sapiens
AHPFLYGLP

SEQ ID NO: 420238 - protein, 9 aa, Homo Sapiens
MPFVNTSVL

SEQ ID NO: 420239 - protein, 9 aa, Homo Sapiens
MECVGTWIN

SEQ ID NO: 420240 - protein, 9 aa, Homo Sapiens
SMGCVMFEM

SEQ ID NO: 420241 - protein, 9 aa, Homo Sapiens
LSGHWDMDV

SEQ ID NO: 420242 - protein, 9 aa, Homo Sapiens
VRDYHTVLH

SEQ ID NO: 420243 - protein, 9 aa, Homo Sapiens
QYGDMLQIR

SEQ ID NO: 420244 - protein, 9 aa, Homo Sapiens
SGHPEPHHT

SEQ ID NO: 420245 - protein, 9 aa, Homo Sapiens
IMMMNHILL

SEQ ID NO: 420246 - protein, 9 aa, Homo Sapiens
FLLVCFLFF

SEQ ID NO: 420247 - protein, 9 aa, Homo Sapiens
VKTTNMLAS

SEQ ID NO: 420248 - protein, 9 aa, Homo Sapiens
HRNAILCSC

SEQ ID NO: 420249 - protein, 9 aa, Homo Sapiens
HLHFKKTEN

SEQ ID NO: 420250 - protein, 9 aa, Homo Sapiens
NEVNSQLYS

SEQ ID NO: 420251 - protein, 9 aa, Homo Sapiens
GHILGSKPL

SEQ ID NO: 420252 - protein, 9 aa, Homo Sapiens
CTQLHRNFR

SEQ ID NO: 420253 - protein, 9 aa, Homo Sapiens
QCHQDHPEE

SEQ ID NO: 420254 - protein, 9 aa, Homo Sapiens
ILVTSFDHM

SEQ ID NO: 420255 - protein, 9 aa, Homo Sapiens
VATAATNGY

SEQ ID NO: 420256 - protein, 9 aa, Homo Sapiens
STGHHAWAG

SEQ ID NO: 420257 - protein, 9 aa, Homo Sapiens
ETYCACRAC

SEQ ID NO: 420258 - protein, 9 aa, Homo Sapiens
KQLVHIQPF

SEQ ID NO: 420259 - protein, 9 aa, Homo Sapiens
GWNSTHPGM

SEQ ID NO: 420260 - protein, 9 aa, Homo Sapiens
ADQFCRQHR

SEQ ID NO: 420261 - protein, 9 aa, Homo Sapiens
PCRCCSLQS

SEQ ID NO: 420262 - protein, 9 aa, Homo Sapiens
QHLLVWPPW

SEQ ID NO: 420263 - protein, 9 aa, Homo Sapiens
ELQLCHNRI

SEQ ID NO: 420264 - protein, 9 aa, Homo Sapiens
MVVAPLYDT

SEQ ID NO: 420265 - protein, 9 aa, Homo Sapiens
CLNDSDDYS

SEQ ID NO: 420266 - protein, 9 aa, Homo Sapiens
SRPLVREQL

SEQ ID NO: 420267 - protein, 9 aa, Homo Sapiens
ITGMSLLGL

SEQ ID NO: 420268 - protein, 9 aa, Homo Sapiens
PWVTDFRVG

SEQ ID NO: 420269 - protein, 9 aa, Homo Sapiens
KGNSMTDNS

SEQ ID NO: 420270 - protein, 9 aa, Homo Sapiens
RSSTLEHRP

SEQ ID NO: 420271 - protein, 9 aa, Homo Sapiens
NTTKTQSNC

SEQ ID NO: 420272 - protein, 9 aa, Homo Sapiens
RLSVYWQIV

SEQ ID NO: 420273 - protein, 9 aa, Homo Sapiens
LAPGERRWL

SEQ ID NO: 420274 - protein, 9 aa, Homo Sapiens
SLCIAENLV

SEQ ID NO: 420275 - protein, 9 aa, Homo Sapiens
NQKEQTALY

SEQ ID NO: 420276 - protein, 9 aa, Homo Sapiens
FEAHLAYKL

SEQ ID NO: 420277 - protein, 9 aa, Homo Sapiens
DLRVEVTQF

SEQ ID NO: 420278 - protein, 9 aa, Homo Sapiens
EFLKNPKVD

SEQ ID NO: 420279 - protein, 9 aa, Homo Sapiens
GAAQPNGPA

SEQ ID NO: 420280 - protein, 9 aa, Homo Sapiens
KSASCTPLC

SEQ ID NO: 420281 - protein, 9 aa, Homo Sapiens
SRLGGGRRG

SEQ ID NO: 420282 - protein, 9 aa, Homo Sapiens
AGATHFYLH

SEQ ID NO: 420283 - protein, 9 aa, Homo Sapiens
KEKMILKMM

SEQ ID NO: 420284 - protein, 9 aa, Homo Sapiens
AMVTRRRAA

SEQ ID NO: 420285 - protein, 9 aa, Homo Sapiens
HLARHQLRE

SEQ ID NO: 420286 - protein, 9 aa, Homo Sapiens
ESIPIIYRN

SEQ ID NO: 420287 - protein, 9 aa, Homo Sapiens
HPPPPLREE

SEQ ID NO: 420288 - protein, 9 aa, Homo Sapiens
LRAPCTRLA

SEQ ID NO: 420289 - protein, 9 aa, Homo Sapiens
QAPAFKYFI

SEQ ID NO: 420290 - protein, 9 aa, Homo Sapiens
DHKLPPEYN

SEQ ID NO: 420291 - protein, 9 aa, Homo Sapiens
SSSVLGTGL

SEQ ID NO: 420292 - protein, 9 aa, Homo Sapiens
GSTYRRQAS

SEQ ID NO: 420293 - protein, 9 aa, Homo Sapiens
VMYSFPRVQ

SEQ ID NO: 420294 - protein, 9 aa, Homo Sapiens
SLVSEAVPS

SEQ ID NO: 420295 - protein, 9 aa, Homo Sapiens
FAFGNGCTF

SEQ ID NO: 420296 - protein, 9 aa, Homo Sapiens
DKILTHVHL

SEQ ID NO: 420297 - protein, 9 aa, Homo Sapiens
PNPQVPQQE

SEQ ID NO: 420298 - protein, 9 aa, Homo Sapiens
LFEALGYMD

SEQ ID NO: 420299 - protein, 9 aa, Homo Sapiens
GCTLVLDTM

SEQ ID NO: 420300 - protein, 9 aa, Homo Sapiens
NMLSLFFAG

SEQ ID NO: 420301 - protein, 9 aa, Homo Sapiens
MHWTTLLLI

SEQ ID NO: 420302 - protein, 9 aa, Homo Sapiens
SRDHYEELK

SEQ ID NO: 420303 - protein, 9 aa, Homo Sapiens
KLCLVTLLN

SEQ ID NO: 420304 - protein, 9 aa, Homo Sapiens
IHGMGELMT

SEQ ID NO: 420305 - protein, 9 aa, Homo Sapiens
QEPPAILDD

SEQ ID NO: 420306 - protein, 9 aa, Homo Sapiens
GVDPRVGVS

SEQ ID NO: 420307 - protein, 9 aa, Homo Sapiens
TAIPSPKTL

SEQ ID NO: 420308 - protein, 9 aa, Homo Sapiens
PQVTRSWYN

SEQ ID NO: 420309 - protein, 9 aa, Homo Sapiens
SSLMMTDTC

SEQ ID NO: 420310 - protein, 9 aa, Homo Sapiens
NQLVSLGKT

SEQ ID NO: 420311 - protein, 9 aa, Homo Sapiens
VRQRGRLEI

SEQ ID NO: 420312 - protein, 9 aa, Homo Sapiens
LARHQLREP

SEQ ID NO: 420313 - protein, 9 aa, Homo Sapiens
ALQRLTWVC

SEQ ID NO: 420314 - protein, 9 aa, Homo Sapiens
YHCRVMCRC

SEQ ID NO: 420315 - protein, 9 aa, Homo Sapiens
VKRWLGVSE

SEQ ID NO: 420316 - protein, 9 aa, Homo Sapiens
TAQLTSLVM

SEQ ID NO: 420317 - protein, 9 aa, Homo Sapiens
FPSTWELTE

SEQ ID NO: 420318 - protein, 9 aa, Homo Sapiens
IQNQKRLQN

SEQ ID NO: 420319 - protein, 9 aa, Homo Sapiens
DVNAIIAHV

SEQ ID NO: 420320 - protein, 9 aa, Homo Sapiens
SHVPVKNLI

SEQ ID NO: 420321 - protein, 9 aa, Homo Sapiens
PQTVKSASL

SEQ ID NO: 420322 - protein, 9 aa, Homo Sapiens
GQQVLLPRV

SEQ ID NO: 420323 - protein, 9 aa, Homo Sapiens
AASSPAWPA

SEQ ID NO: 420324 - protein, 9 aa, Homo Sapiens
VSTAFEEGQ

SEQ ID NO: 420325 - protein, 9 aa, Homo Sapiens
SWKYPTNAT

SEQ ID NO: 420326 - protein, 9 aa, Homo Sapiens
NGTIMAKYT

SEQ ID NO: 420327 - protein, 9 aa, Homo Sapiens
QKGASWFAF

SEQ ID NO: 420328 - protein, 9 aa, Homo Sapiens
SRLWSPPRL

SEQ ID NO: 420329 - protein, 9 aa, Homo Sapiens
PLLPSPSCP

SEQ ID NO: 420330 - protein, 9 aa, Homo Sapiens
AVTTPATET

SEQ ID NO: 420331 - protein, 9 aa, Homo Sapiens
NTMPPKIHY

SEQ ID NO: 420332 - protein, 9 aa, Homo Sapiens
FCEEHFPVV

SEQ ID NO: 420333 - protein, 9 aa, Homo Sapiens
GDRRGNLRI

SEQ ID NO: 420334 - protein, 9 aa, Homo Sapiens
SRHISMESL

SEQ ID NO: 420335 - protein, 9 aa, Homo Sapiens
DKGDCHIFT

SEQ ID NO: 420336 - protein, 9 aa, Homo Sapiens
KKDDFKMVI

SEQ ID NO: 420337 - protein, 9 aa, Homo Sapiens
NSTHPGMWS

SEQ ID NO: 420338 - protein, 9 aa, Homo Sapiens
NVHRQPVQI

SEQ ID NO: 420339 - protein, 9 aa, Homo Sapiens
RTAHKAAHL

SEQ ID NO: 420340 - protein, 9 aa, Homo Sapiens
QRGKAFIYY

SEQ ID NO: 420341 - protein, 9 aa, Homo Sapiens
PGATLTSTS

SEQ ID NO: 420342 - protein, 9 aa, Homo Sapiens
VTRSWYNYM

SEQ ID NO: 420343 - protein, 9 aa, Homo Sapiens
GPALTFRIW

SEQ ID NO: 420344 - protein, 9 aa, Homo Sapiens
SITHNMTTP

SEQ ID NO: 420345 - protein, 9 aa, Homo Sapiens
LRLLRYIVC

SEQ ID NO: 420346 - protein, 9 aa, Homo Sapiens
AILTSATMG

SEQ ID NO: 420347 - protein, 9 aa, Homo Sapiens
AQGYEGGFP

SEQ ID NO: 420348 - protein, 9 aa, Homo Sapiens
ESFAVTIGQ

SEQ ID NO: 420349 - protein, 9 aa, Homo Sapiens
VFDNTNSHN

SEQ ID NO: 420350 - protein, 9 aa, Homo Sapiens
GKIIDTKNL

SEQ ID NO: 420351 - protein, 9 aa, Homo Sapiens
PVLLAFHKG

SEQ ID NO: 420352 - protein, 9 aa, Homo Sapiens
AHPPPPLRE

SEQ ID NO: 420353 - protein, 9 aa, Homo Sapiens
PRLTGSIIS

SEQ ID NO: 420354 - protein, 9 aa, Homo Sapiens
FLLLAILLP

SEQ ID NO: 420355 - protein, 9 aa, Homo Sapiens
CGIRTSVVS

SEQ ID NO: 420356 - protein, 9 aa, Homo Sapiens
HFIPQMTTG

SEQ ID NO: 420357 - protein, 9 aa, Homo Sapiens
CLSFPLPRA

SEQ ID NO: 420358 - protein, 9 aa, Homo Sapiens
AEKWCFRLS

SEQ ID NO: 420359 - protein, 9 aa, Homo Sapiens
RICAVGLLT

SEQ ID NO: 420360 - protein, 9 aa, Homo Sapiens
EEDSHYLHI

SEQ ID NO: 420361 - protein, 9 aa, Homo Sapiens
GEGGGSGGH

SEQ ID NO: 420362 - protein, 9 aa, Homo Sapiens
TPRMTARAS

SEQ ID NO: 420363 - protein, 9 aa, Homo Sapiens
PFPRAWAGL

SEQ ID NO: 420364 - protein, 9 aa, Homo Sapiens
SGISICPGR

SEQ ID NO: 420365 - protein, 9 aa, Homo Sapiens
RPPEPLEPP

SEQ ID NO: 420366 - protein, 9 aa, Homo Sapiens
LGNIAVEEN

SEQ ID NO: 420367 - protein, 9 aa, Homo Sapiens
KEMKRDREF

SEQ ID NO: 420368 - protein, 9 aa, Homo Sapiens
LGHMNLADS

SEQ ID NO: 420369 - protein, 9 aa, Homo Sapiens
SAHPPPPLR

SEQ ID NO: 420370 - protein, 9 aa, Homo Sapiens
FGTLGSWPG

SEQ ID NO: 420371 - protein, 9 aa, Homo Sapiens
LQLPGCLAW

SEQ ID NO: 420372 - protein, 9 aa, Homo Sapiens
MGYRKRGSK

SEQ ID NO: 420373 - protein, 9 aa, Homo Sapiens
SWNKLCLVT

SEQ ID NO: 420374 - protein, 9 aa, Homo Sapiens
TVPGHKSVR

SEQ ID NO: 420375 - protein, 9 aa, Homo Sapiens
NNIFTDDIS

SEQ ID NO: 420376 - protein, 9 aa, Homo Sapiens
LSRMPARRE

SEQ ID NO: 420377 - protein, 9 aa, Homo Sapiens
SRPGWKRTQ

SEQ ID NO: 420378 - protein, 9 aa, Homo Sapiens
TQPKQAAEA

SEQ ID NO: 420379 - protein, 9 aa, Homo Sapiens
GKKSITHNM

SEQ ID NO: 420380 - protein, 9 aa, Homo Sapiens
LTEDKKNGI

SEQ ID NO: 420381 - protein, 9 aa, Homo Sapiens
VVVHDLVVR

SEQ ID NO: 420382 - protein, 9 aa, Homo Sapiens
SLFVKKCKT

SEQ ID NO: 420383 - protein, 9 aa, Homo Sapiens
LAYKLSIRA

SEQ ID NO: 420384 - protein, 9 aa, Homo Sapiens
GLHDGGPRL

SEQ ID NO: 420385 - protein, 9 aa, Homo Sapiens
VGFINRTVL

SEQ ID NO: 420386 - protein, 9 aa, Homo Sapiens
FPRQRRRRG

SEQ ID NO: 420387 - protein, 9 aa, Homo Sapiens
SVHSLSSTG

SEQ ID NO: 420388 - protein, 9 aa, Homo Sapiens
SATSLVSLS

SEQ ID NO: 420389 - protein, 9 aa, Homo Sapiens
HLNGTIMAK

SEQ ID NO: 420390 - protein, 9 aa, Homo Sapiens
YRGLTINSL

SEQ ID NO: 420391 - protein, 9 aa, Homo Sapiens
PWRTSRGQA

SEQ ID NO: 420392 - protein, 9 aa, Homo Sapiens
DSAWSLTSS

SEQ ID NO: 420393 - protein, 9 aa, Homo Sapiens
RYLADDRLY

SEQ ID NO: 420394 - protein, 9 aa, Homo Sapiens
FSRVFSGKK

SEQ ID NO: 420395 - protein, 9 aa, Homo Sapiens
AEGESVCNA

SEQ ID NO: 420396 - protein, 9 aa, Homo Sapiens
FFFALCSRK

SEQ ID NO: 420397 - protein, 9 aa, Homo Sapiens
SDDYSPDLD

SEQ ID NO: 420398 - protein, 9 aa, Homo Sapiens
VRQTWQVVQ

SEQ ID NO: 420399 - protein, 9 aa, Homo Sapiens
DDGGGSFST

SEQ ID NO: 420400 - protein, 9 aa, Homo Sapiens
LPMLPQQLQ

SEQ ID NO: 420401 - protein, 9 aa, Homo Sapiens
MHRLSDEVG

SEQ ID NO: 420402 - protein, 9 aa, Homo Sapiens
PPPVPAPSQ

SEQ ID NO: 420403 - protein, 9 aa, Homo Sapiens
RVRHVASGL

SEQ ID NO: 420404 - protein, 9 aa, Homo Sapiens
HEHVVAQGW

SEQ ID NO: 420405 - protein, 9 aa, Homo Sapiens
WSETGATEL

SEQ ID NO: 420406 - protein, 9 aa, Homo Sapiens
WASLWNLVV

SEQ ID NO: 420407 - protein, 9 aa, Homo Sapiens
HSTHGIFEP

SEQ ID NO: 420408 - protein, 9 aa, Homo Sapiens
LHSASGRRL

SEQ ID NO: 420409 - protein, 9 aa, Homo Sapiens
PLCVSPKHG

SEQ ID NO: 420410 - protein, 9 aa, Homo Sapiens
GKRKTKLKL

SEQ ID NO: 420411 - protein, 9 aa, Homo Sapiens
PDGVSRTDL

SEQ ID NO: 420412 - protein, 9 aa, Homo Sapiens
TPATPYSAT

SEQ ID NO: 420413 - protein, 9 aa, Homo Sapiens
NMNETSSHS

SEQ ID NO: 420414 - protein, 9 aa, Homo Sapiens
FVASVVVLY

SEQ ID NO: 420415 - protein, 9 aa, Homo Sapiens
EQRKRRRRK

SEQ ID NO: 420416 - protein, 9 aa, Homo Sapiens
SPPWLRPRR

SEQ ID NO: 420417 - protein, 9 aa, Homo Sapiens
TTKTQSNCS

SEQ ID NO: 420418 - protein, 9 aa, Homo Sapiens
LGVDDGYMP

SEQ ID NO: 420419 - protein, 9 aa, Homo Sapiens
LSSPLPSKS

SEQ ID NO: 420420 - protein, 9 aa, Homo Sapiens
SRRWAGRGP

SEQ ID NO: 420421 - protein, 9 aa, Homo Sapiens
HHQAIHGIW

SEQ ID NO: 420422 - protein, 9 aa, Homo Sapiens
VAPARTGCP

SEQ ID NO: 420423 - protein, 9 aa, Homo Sapiens
PEGLRASVD

SEQ ID NO: 420424 - protein, 9 aa, Homo Sapiens
GIIFMCLRL

SEQ ID NO: 420425 - protein, 9 aa, Homo Sapiens
PLSSHYPPG

SEQ ID NO: 420426 - protein, 9 aa, Homo Sapiens
QRRRRGLSR

SEQ ID NO: 420427 - protein, 9 aa, Homo Sapiens
YQQFKDFQQ

SEQ ID NO: 420428 - protein, 9 aa, Homo Sapiens
SQQYGDMLQ

SEQ ID NO: 420429 - protein, 9 aa, Homo Sapiens
NYTRTEDFF

SEQ ID NO: 420430 - protein, 9 aa, Homo Sapiens
YVGCRATVA

SEQ ID NO: 420431 - protein, 9 aa, Homo Sapiens
QYQASQTHP

SEQ ID NO: 420432 - protein, 9 aa, Homo Sapiens
YDLKDEEGR

SEQ ID NO: 420433 - protein, 9 aa, Homo Sapiens
SLENQSILV

SEQ ID NO: 420434 - protein, 9 aa, Homo Sapiens
PRPLPHAPM

SEQ ID NO: 420435 - protein, 9 aa, Homo Sapiens
SKAMYLPPA

SEQ ID NO: 420436 - protein, 9 aa, Homo Sapiens
FGEHRRNDS

SEQ ID NO: 420437 - protein, 9 aa, Homo Sapiens
HPATFVAHT

SEQ ID NO: 420438 - protein, 9 aa, Homo Sapiens
RDEVRVVVR

SEQ ID NO: 420439 - protein, 9 aa, Homo Sapiens
GHPGTGTVT

SEQ ID NO: 420440 - protein, 9 aa, Homo Sapiens
ATMMAKTIK

SEQ ID NO: 420441 - protein, 9 aa, Homo Sapiens
EGIGAHQQQ

SEQ ID NO: 420442 - protein, 9 aa, Homo Sapiens
RGAIRKDGL

SEQ ID NO: 420443 - protein, 9 aa, Homo Sapiens
FQEEDEGGD

SEQ ID NO: 420444 - protein, 9 aa, Homo Sapiens
DISLVALAF

SEQ ID NO: 420445 - protein, 9 aa, Homo Sapiens
NCVLLNRPE

SEQ ID NO: 420446 - protein, 9 aa, Homo Sapiens
MKAGDLLKL

SEQ ID NO: 420447 - protein, 9 aa, Homo Sapiens
RLGTSARVL

SEQ ID NO: 420448 - protein, 9 aa, Homo Sapiens
MGSYGALAE

SEQ ID NO: 420449 - protein, 9 aa, Homo Sapiens
VSALGPRGG

SEQ ID NO: 420450 - protein, 9 aa, Homo Sapiens
SNCQELRLD

SEQ ID NO: 420451 - protein, 9 aa, Homo Sapiens
ECKEKLVSF

SEQ ID NO: 420452 - protein, 9 aa, Homo Sapiens
KFAATIRLL

SEQ ID NO: 420453 - protein, 9 aa, Homo Sapiens
SLGSMSPFN

SEQ ID NO: 420454 - protein, 9 aa, Homo Sapiens
KPVRVIHSF

SEQ ID NO: 420455 - protein, 9 aa, Homo Sapiens
LVMGSPFPA

SEQ ID NO: 420456 - protein, 9 aa, Homo Sapiens
MPLENYQIP

SEQ ID NO: 420457 - protein, 9 aa, Homo Sapiens
PSTHTMAAT

SEQ ID NO: 420458 - protein, 9 aa, Homo Sapiens
SLFTLRVTK

SEQ ID NO: 420459 - protein, 9 aa, Homo Sapiens
EESRWWLGA

SEQ ID NO: 420460 - protein, 9 aa, Homo Sapiens
AARIKGDTM

SEQ ID NO: 420461 - protein, 9 aa, Homo Sapiens
THALQSPCI

SEQ ID NO: 420462 - protein, 9 aa, Homo Sapiens
IEDQGLVVV

SEQ ID NO: 420463 - protein, 9 aa, Homo Sapiens
VVVVPINIT

SEQ ID NO: 420464 - protein, 9 aa, Homo Sapiens
SRESPWEAA

SEQ ID NO: 420465 - protein, 9 aa, Homo Sapiens
LCQFVILRK

SEQ ID NO: 420466 - protein, 9 aa, Homo Sapiens
LVQPGIVQC

SEQ ID NO: 420467 - protein, 9 aa, Homo Sapiens
KLALDVEIT

SEQ ID NO: 420468 - protein, 9 aa, Homo Sapiens
PPILRSATV

SEQ ID NO: 420469 - protein, 9 aa, Homo Sapiens
KKSKKSSHC

SEQ ID NO: 420470 - protein, 9 aa, Homo Sapiens
DTESRLFLM

SEQ ID NO: 420471 - protein, 9 aa, Homo Sapiens
MRAPETAAV

SEQ ID NO: 420472 - protein, 9 aa, Homo Sapiens
QWGSFPLQC

SEQ ID NO: 420473 - protein, 9 aa, Homo Sapiens
EPGLLDPAQ

SEQ ID NO: 420474 - protein, 9 aa, Homo Sapiens
EEEPGLLDP

SEQ ID NO: 420475 - protein, 9 aa, Homo Sapiens
RNGDLSAMK

SEQ ID NO: 420476 - protein, 9 aa, Homo Sapiens
LGAQVRALV

SEQ ID NO: 420477 - protein, 9 aa, Homo Sapiens
KNFSFLMKK

SEQ ID NO: 420478 - protein, 9 aa, Homo Sapiens
VDFHVDLNP

SEQ ID NO: 420479 - protein, 9 aa, Homo Sapiens
KRKKREKII

SEQ ID NO: 420480 - protein, 9 aa, Homo Sapiens
YFYAASSLD

SEQ ID NO: 420481 - protein, 9 aa, Homo Sapiens
EVTDAQCSG

SEQ ID NO: 420482 - protein, 9 aa, Homo Sapiens
SGGCQYLRC

SEQ ID NO: 420483 - protein, 9 aa, Homo Sapiens
EVQLPEVEL

SEQ ID NO: 420484 - protein, 9 aa, Homo Sapiens
LESSLRPRP

SEQ ID NO: 420485 - protein, 9 aa, Homo Sapiens
QEAVIAQIS

SEQ ID NO: 420486 - protein, 9 aa, Homo Sapiens
EPTQPKQAA

SEQ ID NO: 420487 - protein, 9 aa, Homo Sapiens
HGNLGETES

SEQ ID NO: 420488 - protein, 9 aa, Homo Sapiens
SSRLILSNM

SEQ ID NO: 420489 - protein, 9 aa, Homo Sapiens
YWTYDAYST

SEQ ID NO: 420490 - protein, 9 aa, Homo Sapiens
FFLSSSPVS

SEQ ID NO: 420491 - protein, 9 aa, Homo Sapiens
CRKDGPVVT

SEQ ID NO: 420492 - protein, 9 aa, Homo Sapiens
KRDREFRII

SEQ ID NO: 420493 - protein, 9 aa, Homo Sapiens
LSEVVGKMV

SEQ ID NO: 420494 - protein, 9 aa, Homo Sapiens
ALVSCLFLR

SEQ ID NO: 420495 - protein, 9 aa, Homo Sapiens
YMQADARGP

SEQ ID NO: 420496 - protein, 9 aa, Homo Sapiens
QHLWLSHRL

SEQ ID NO: 420497 - protein, 9 aa, Homo Sapiens
TSDVSSMSL

SEQ ID NO: 420498 - protein, 9 aa, Homo Sapiens
WDVAAGMEL

SEQ ID NO: 420499 - protein, 9 aa, Homo Sapiens
HKPDQPSLT

SEQ ID NO: 420500 - protein, 9 aa, Homo Sapiens
PEDLGGVGL

SEQ ID NO: 420501 - protein, 9 aa, Homo Sapiens
LTPELMVPC

SEQ ID NO: 420502 - protein, 9 aa, Homo Sapiens
RILCLIKGA

SEQ ID NO: 420503 - protein, 9 aa, Homo Sapiens
AMIPFPRAW

SEQ ID NO: 420504 - protein, 9 aa, Homo Sapiens
SIRFVAGHD

SEQ ID NO: 420505 - protein, 9 aa, Homo Sapiens
IARKLQEKI

SEQ ID NO: 420506 - protein, 9 aa, Homo Sapiens
SFVAPNSLK

SEQ ID NO: 420507 - protein, 9 aa, Homo Sapiens
TVKKLKSVQ

SEQ ID NO: 420508 - protein, 9 aa, Homo Sapiens
RERGNGSNS

SEQ ID NO: 420509 - protein, 9 aa, Homo Sapiens
MTQTGSGSV

SEQ ID NO: 420510 - protein, 9 aa, Homo Sapiens
YCRTGCCAT

SEQ ID NO: 420511 - protein, 9 aa, Homo Sapiens
EAWSMLLRT

SEQ ID NO: 420512 - protein, 9 aa, Homo Sapiens
GRRALGTTS

SEQ ID NO: 420513 - protein, 9 aa, Homo Sapiens
LFYFFFIYS

SEQ ID NO: 420514 - protein, 9 aa, Homo Sapiens
GDLVYVNYT

SEQ ID NO: 420515 - protein, 9 aa, Homo Sapiens
LWLLTRWKC

SEQ ID NO: 420516 - protein, 9 aa, Homo Sapiens
MPARRESRF

SEQ ID NO: 420517 - protein, 9 aa, Homo Sapiens
GPRPATAAA

SEQ ID NO: 420518 - protein, 9 aa, Homo Sapiens
LQTQCRQLE

SEQ ID NO: 420519 - protein, 9 aa, Homo Sapiens
VYHEETPEL

SEQ ID NO: 420520 - protein, 9 aa, Homo Sapiens
QLKAEFGNQ

SEQ ID NO: 420521 - protein, 9 aa, Homo Sapiens
VRMCGGPAP

SEQ ID NO: 420522 - protein, 9 aa, Homo Sapiens
EMDEYITKV

SEQ ID NO: 420523 - protein, 9 aa, Homo Sapiens
FELLQGSLH

SEQ ID NO: 420524 - protein, 9 aa, Homo Sapiens
PGVIKQKVL

SEQ ID NO: 420525 - protein, 9 aa, Homo Sapiens
PDFQGQISF

SEQ ID NO: 420526 - protein, 9 aa, Homo Sapiens
LQSNPQLRE

SEQ ID NO: 420527 - protein, 9 aa, Homo Sapiens
PGLGGPRRV

SEQ ID NO: 420528 - protein, 9 aa, Homo Sapiens
LTISDLWTE

SEQ ID NO: 420529 - protein, 9 aa, Homo Sapiens
SQPKSKPTT

SEQ ID NO: 420530 - protein, 9 aa, Homo Sapiens
ETPIEQEIR

SEQ ID NO: 420531 - protein, 9 aa, Homo Sapiens
ERGVPMSGP

SEQ ID NO: 420532 - protein, 9 aa, Homo Sapiens
VTIIATMLV

SEQ ID NO: 420533 - protein, 9 aa, Homo Sapiens
VATVLGLKS

SEQ ID NO: 420534 - protein, 9 aa, Homo Sapiens
SAKGQTRPS

SEQ ID NO: 420535 - protein, 9 aa, Homo Sapiens
IELMASEGL

SEQ ID NO: 420536 - protein, 9 aa, Homo Sapiens
RATVPRHSS

SEQ ID NO: 420537 - protein, 9 aa, Homo Sapiens
IQGTRTIIV

SEQ ID NO: 420538 - protein, 9 aa, Homo Sapiens
GRDHFTAES

SEQ ID NO: 420539 - protein, 9 aa, Homo Sapiens
MMMMILTNF

SEQ ID NO: 420540 - protein, 9 aa, Homo Sapiens
TIGAHKTLV

SEQ ID NO: 420541 - protein, 9 aa, Homo Sapiens
NPNFQEEDE

SEQ ID NO: 420542 - protein, 9 aa, Homo Sapiens
KVTSSLGIR

SEQ ID NO: 420543 - protein, 9 aa, Homo Sapiens
TLLRFHVLP

SEQ ID NO: 420544 - protein, 9 aa, Homo Sapiens
RHCPRALCH

SEQ ID NO: 420545 - protein, 9 aa, Homo Sapiens
CKVLGHPEP

SEQ ID NO: 420546 - protein, 9 aa, Homo Sapiens
FGPILCRLV

SEQ ID NO: 420547 - protein, 9 aa, Homo Sapiens
PRPATAAAA

SEQ ID NO: 420548 - protein, 9 aa, Homo Sapiens
SATTEDLAE

SEQ ID NO: 420549 - protein, 9 aa, Homo Sapiens
YIVTQTADY

SEQ ID NO: 420550 - protein, 9 aa, Homo Sapiens
RRCPEEAGA

SEQ ID NO: 420551 - protein, 9 aa, Homo Sapiens
YTFIRVFKL

SEQ ID NO: 420552 - protein, 9 aa, Homo Sapiens
DNACVGDRF

SEQ ID NO: 420553 - protein, 9 aa, Homo Sapiens
MVGTPYWMV

SEQ ID NO: 420554 - protein, 9 aa, Homo Sapiens
PRRGSSQGC

SEQ ID NO: 420555 - protein, 9 aa, Homo Sapiens
PLESVRQIY

SEQ ID NO: 420556 - protein, 9 aa, Homo Sapiens
PGPSTGACT

SEQ ID NO: 420557 - protein, 9 aa, Homo Sapiens
GFGFMTMTN

SEQ ID NO: 420558 - protein, 9 aa, Homo Sapiens
TIKKRFEVL

SEQ ID NO: 420559 - protein, 9 aa, Homo Sapiens
RQHRFLLPA

SEQ ID NO: 420560 - protein, 9 aa, Homo Sapiens
LEDDTSYFD

SEQ ID NO: 420561 - protein, 9 aa, Homo Sapiens
MSLLGLHGT

SEQ ID NO: 420562 - protein, 9 aa, Homo Sapiens
VNINCKKRI

SEQ ID NO: 420563 - protein, 9 aa, Homo Sapiens
MAKYTYGKP

SEQ ID NO: 420564 - protein, 9 aa, Homo Sapiens
ISWLKDRPP

SEQ ID NO: 420565 - protein, 9 aa, Homo Sapiens
ACLAACAPS

SEQ ID NO: 420566 - protein, 9 aa, Homo Sapiens
ATWRCCGGH

SEQ ID NO: 420567 - protein, 9 aa, Homo Sapiens
HLAYKLSIR

SEQ ID NO: 420568 - protein, 9 aa, Homo Sapiens
VPLLTDQAP

SEQ ID NO: 420569 - protein, 9 aa, Homo Sapiens
LALHRYAGM

SEQ ID NO: 420570 - protein, 9 aa, Homo Sapiens
NGADDWWIA

SEQ ID NO: 420571 - protein, 9 aa, Homo Sapiens
IKGGDLLLI

SEQ ID NO: 420572 - protein, 9 aa, Homo Sapiens
IDEKWDFRT

SEQ ID NO: 420573 - protein, 9 aa, Homo Sapiens
DALEYSKCR

SEQ ID NO: 420574 - protein, 9 aa, Homo Sapiens
ALRLWEGPV

SEQ ID NO: 420575 - protein, 9 aa, Homo Sapiens
QARSHFPGS

SEQ ID NO: 420576 - protein, 9 aa, Homo Sapiens
AFGFVQSSS

SEQ ID NO: 420577 - protein, 9 aa, Homo Sapiens
QALNAYKSK

SEQ ID NO: 420578 - protein, 9 aa, Homo Sapiens
LHPPPISKS

SEQ ID NO: 420579 - protein, 9 aa, Homo Sapiens
ALSALLPRA

SEQ ID NO: 420580 - protein, 9 aa, Homo Sapiens
QKSYKMNSS

SEQ ID NO: 420581 - protein, 9 aa, Homo Sapiens
SGGCMNPAH

SEQ ID NO: 420582 - protein, 9 aa, Homo Sapiens
EDILASSAC

SEQ ID NO: 420583 - protein, 9 aa, Homo Sapiens
RMHHQQQQQ

SEQ ID NO: 420584 - protein, 9 aa, Homo Sapiens
VAEKYVFVS

SEQ ID NO: 420585 - protein, 9 aa, Homo Sapiens
LCLEEPRKG

SEQ ID NO: 420586 - protein, 9 aa, Homo Sapiens
PQRPVRLAL

SEQ ID NO: 420587 - protein, 9 aa, Homo Sapiens
GFVANMLVV

SEQ ID NO: 420588 - protein, 9 aa, Homo Sapiens
VSSRMLGLH

SEQ ID NO: 420589 - protein, 9 aa, Homo Sapiens
LGGTTPKPR

SEQ ID NO: 420590 - protein, 9 aa, Homo Sapiens
LCLVTLLNT

SEQ ID NO: 420591 - protein, 9 aa, Homo Sapiens
CRRLFVEGC

SEQ ID NO: 420592 - protein, 9 aa, Homo Sapiens
ASEREAISW

SEQ ID NO: 420593 - protein, 9 aa, Homo Sapiens
ALATEQQPG

SEQ ID NO: 420594 - protein, 9 aa, Homo Sapiens
PPSSTGALP

SEQ ID NO: 420595 - protein, 9 aa, Homo Sapiens
GLWEPRELQ

SEQ ID NO: 420596 - protein, 9 aa, Homo Sapiens
PQSTCARRK

SEQ ID NO: 420597 - protein, 9 aa, Homo Sapiens
AGLTAEVNW

SEQ ID NO: 420598 - protein, 9 aa, Homo Sapiens
TGDYLRRHY

SEQ ID NO: 420599 - protein, 9 aa, Homo Sapiens
PESIRVDTH

SEQ ID NO: 420600 - protein, 9 aa, Homo Sapiens
QVLPTDTWL

SEQ ID NO: 420601 - protein, 9 aa, Homo Sapiens
PSLSTATST

SEQ ID NO: 420602 - protein, 9 aa, Homo Sapiens
FAWEIRDHL

SEQ ID NO: 420603 - protein, 9 aa, Homo Sapiens
RVHKAITAG

SEQ ID NO: 420604 - protein, 9 aa, Homo Sapiens
ARPGQLRGR

SEQ ID NO: 420605 - protein, 9 aa, Homo Sapiens
INHFFVTPQ

SEQ ID NO: 420606 - protein, 9 aa, Homo Sapiens
LYMALAQRK

SEQ ID NO: 420607 - protein, 9 aa, Homo Sapiens
VTKCVELGI

SEQ ID NO: 420608 - protein, 9 aa, Homo Sapiens
EAVVHLLME

SEQ ID NO: 420609 - protein, 9 aa, Homo Sapiens
MGPRPATAA

SEQ ID NO: 420610 - protein, 9 aa, Homo Sapiens
PSILSTCLV

SEQ ID NO: 420611 - protein, 9 aa, Homo Sapiens
SDAIWNELH

SEQ ID NO: 420612 - protein, 9 aa, Homo Sapiens
SISPLSILS

SEQ ID NO: 420613 - protein, 9 aa, Homo Sapiens
CVPQNHLLG

SEQ ID NO: 420614 - protein, 9 aa, Homo Sapiens
CGEKPLKDK

SEQ ID NO: 420615 - protein, 9 aa, Homo Sapiens
CGGPAPETR

SEQ ID NO: 420616 - protein, 9 aa, Homo Sapiens
PPTTTTSSP

SEQ ID NO: 420617 - protein, 9 aa, Homo Sapiens
YVKWLHLLD

SEQ ID NO: 420618 - protein, 9 aa, Homo Sapiens
APNPDRFYQ

SEQ ID NO: 420619 - protein, 9 aa, Homo Sapiens
LCVACCLLT

SEQ ID NO: 420620 - protein, 9 aa, Homo Sapiens
GTGGGFGPV

SEQ ID NO: 420621 - protein, 9 aa, Homo Sapiens
LIPTSAASL

SEQ ID NO: 420622 - protein, 9 aa, Homo Sapiens
HPARTQTQT

SEQ ID NO: 420623 - protein, 9 aa, Homo Sapiens
MKDLALFSL

SEQ ID NO: 420624 - protein, 9 aa, Homo Sapiens
SRASTHWPS

SEQ ID NO: 420625 - protein, 9 aa, Homo Sapiens
TFILLFLVS

SEQ ID NO: 420626 - protein, 9 aa, Homo Sapiens
GPQILCRMR

SEQ ID NO: 420627 - protein, 9 aa, Homo Sapiens
GQLKAEFGN

SEQ ID NO: 420628 - protein, 9 aa, Homo Sapiens
LDEDDSEEL

SEQ ID NO: 420629 - protein, 9 aa, Homo Sapiens
SQPLHYTLV

SEQ ID NO: 420630 - protein, 9 aa, Homo Sapiens
IQSNTSTLL

SEQ ID NO: 420631 - protein, 9 aa, Homo Sapiens
MEKSEGMKS

SEQ ID NO: 420632 - protein, 9 aa, Homo Sapiens
KLTSATVLC

SEQ ID NO: 420633 - protein, 9 aa, Homo Sapiens
SQKIIFSYV

SEQ ID NO: 420634 - protein, 9 aa, Homo Sapiens
EEITDNYPH

SEQ ID NO: 420635 - protein, 9 aa, Homo Sapiens
GLSTGKKEK

SEQ ID NO: 420636 - protein, 9 aa, Homo Sapiens
FCQKSIIDA

SEQ ID NO: 420637 - protein, 9 aa, Homo Sapiens
IPAPRPVCI

SEQ ID NO: 420638 - protein, 9 aa, Homo Sapiens
VIERERGNG

SEQ ID NO: 420639 - protein, 9 aa, Homo Sapiens
VVLPGQGGL

SEQ ID NO: 420640 - protein, 9 aa, Homo Sapiens
RITVKKLKS

SEQ ID NO: 420641 - protein, 9 aa, Homo Sapiens
QLGDAGVFG

SEQ ID NO: 420642 - protein, 9 aa, Homo Sapiens
SPFSQLICM

SEQ ID NO: 420643 - protein, 9 aa, Homo Sapiens
AGGSTASSL

SEQ ID NO: 420644 - protein, 9 aa, Homo Sapiens
PSHVPFSSG

SEQ ID NO: 420645 - protein, 9 aa, Homo Sapiens
GNISSSSGH

SEQ ID NO: 420646 - protein, 9 aa, Homo Sapiens
VKWEYDHMN

SEQ ID NO: 420647 - protein, 9 aa, Homo Sapiens
GKYSATIAL

SEQ ID NO: 420648 - protein, 9 aa, Homo Sapiens
LVVIGSGGV

SEQ ID NO: 420649 - protein, 9 aa, Homo Sapiens
GQKDLQHLS

SEQ ID NO: 420650 - protein, 9 aa, Homo Sapiens
CPLSRLHLF

SEQ ID NO: 420651 - protein, 9 aa, Homo Sapiens
LVFALKALV

SEQ ID NO: 420652 - protein, 9 aa, Homo Sapiens
NYHLSPWTF

SEQ ID NO: 420653 - protein, 9 aa, Homo Sapiens
LLKKRAVFT

SEQ ID NO: 420654 - protein, 9 aa, Homo Sapiens
LLSPDERHV

SEQ ID NO: 420655 - protein, 9 aa, Homo Sapiens
HAWAGFELL

SEQ ID NO: 420656 - protein, 9 aa, Homo Sapiens
NAVIDTSFP

SEQ ID NO: 420657 - protein, 9 aa, Homo Sapiens
DTVITTATY

SEQ ID NO: 420658 - protein, 9 aa, Homo Sapiens
VGTSAVPIP

SEQ ID NO: 420659 - protein, 9 aa, Homo Sapiens
IIANNLWGC

SEQ ID NO: 420660 - protein, 9 aa, Homo Sapiens
ASPPRAPIG

SEQ ID NO: 420661 - protein, 9 aa, Homo Sapiens
TDQWQLPGP

SEQ ID NO: 420662 - protein, 9 aa, Homo Sapiens
VMMMMILTN

SEQ ID NO: 420663 - protein, 9 aa, Homo Sapiens
VTDDYDIGF

SEQ ID NO: 420664 - protein, 9 aa, Homo Sapiens
ECAAVGVGL

SEQ ID NO: 420665 - protein, 9 aa, Homo Sapiens
SNRPASSTK

SEQ ID NO: 420666 - protein, 9 aa, Homo Sapiens
LTAEVNWKV

SEQ ID NO: 420667 - protein, 9 aa, Homo Sapiens
SSLVLPVLV

SEQ ID NO: 420668 - protein, 9 aa, Homo Sapiens
EVALQAVSD

SEQ ID NO: 420669 - protein, 9 aa, Homo Sapiens
GMKRSSTLE

SEQ ID NO: 420670 - protein, 9 aa, Homo Sapiens
AHQAGAAPR

SEQ ID NO: 420671 - protein, 9 aa, Homo Sapiens
WLRERRQQR

SEQ ID NO: 420672 - protein, 9 aa, Homo Sapiens
TPSMRTAMI

SEQ ID NO: 420673 - protein, 9 aa, Homo Sapiens
RLLRYIVCL

SEQ ID NO: 420674 - protein, 9 aa, Homo Sapiens
MDLVRRIKM

SEQ ID NO: 420675 - protein, 9 aa, Homo Sapiens
CGRDQRRGR

SEQ ID NO: 420676 - protein, 9 aa, Homo Sapiens
KTMRAPETA

SEQ ID NO: 420677 - protein, 9 aa, Homo Sapiens
PFNMEGYSK

SEQ ID NO: 420678 - protein, 9 aa, Homo Sapiens
HVPVKNLIV

SEQ ID NO: 420679 - protein, 9 aa, Homo Sapiens
VIKQKVLRE

SEQ ID NO: 420680 - protein, 9 aa, Homo Sapiens
APLAPGAQN

SEQ ID NO: 420681 - protein, 9 aa, Homo Sapiens
CRASRAPCR

SEQ ID NO: 420682 - protein, 9 aa, Homo Sapiens
AGTRCRASR

SEQ ID NO: 420683 - protein, 9 aa, Homo Sapiens
HIKDSEDLK

SEQ ID NO: 420684 - protein, 9 aa, Homo Sapiens
PTVPRKTLK

SEQ ID NO: 420685 - protein, 9 aa, Homo Sapiens
LVVVGAFMV

SEQ ID NO: 420686 - protein, 9 aa, Homo Sapiens
PALRARGGT

SEQ ID NO: 420687 - protein, 9 aa, Homo Sapiens
DSEDLKDHS

SEQ ID NO: 420688 - protein, 9 aa, Homo Sapiens
SPGTTQSAR

SEQ ID NO: 420689 - protein, 9 aa, Homo Sapiens
IKDSEDLKD

SEQ ID NO: 420690 - protein, 9 aa, Homo Sapiens
RIWHNEQNL

SEQ ID NO: 420691 - protein, 9 aa, Homo Sapiens
LVKQVRDLY

SEQ ID NO: 420692 - protein, 9 aa, Homo Sapiens
PPAQIPTST

SEQ ID NO: 420693 - protein, 9 aa, Homo Sapiens
LSTLQQRHP

SEQ ID NO: 420694 - protein, 9 aa, Homo Sapiens
LPQVWTGPP

SEQ ID NO: 420695 - protein, 9 aa, Homo Sapiens
QASHQNLGT

SEQ ID NO: 420696 - protein, 9 aa, Homo Sapiens
QFVLGRLMI

SEQ ID NO: 420697 - protein, 9 aa, Homo Sapiens
PGATTRPSR

SEQ ID NO: 420698 - protein, 9 aa, Homo Sapiens
VHHCIVGCS

SEQ ID NO: 420699 - protein, 9 aa, Homo Sapiens
RPCPRTRWS

SEQ ID NO: 420700 - protein, 9 aa, Homo Sapiens
LSRSAPTPP

SEQ ID NO: 420701 - protein, 9 aa, Homo Sapiens
RIIQMYLTT

SEQ ID NO: 420702 - protein, 9 aa, Homo Sapiens
HFLEELQLC

SEQ ID NO: 420703 - protein, 9 aa, Homo Sapiens
PALATLYVL

SEQ ID NO: 420704 - protein, 9 aa, Homo Sapiens
RVFGKDRKL

SEQ ID NO: 420705 - protein, 9 aa, Homo Sapiens
SLCLQNRYL

SEQ ID NO: 420706 - protein, 9 aa, Homo Sapiens
SKNSDGDMV

SEQ ID NO: 420707 - protein, 9 aa, Homo Sapiens
RARTARSAL

SEQ ID NO: 420708 - protein, 9 aa, Homo Sapiens
EVLQNISDA

SEQ ID NO: 420709 - protein, 9 aa, Homo Sapiens
DGRVDRLAV

SEQ ID NO: 420710 - protein, 9 aa, Homo Sapiens
PQERDGAGS

SEQ ID NO: 420711 - protein, 9 aa, Homo Sapiens
VLTGVSLDL

SEQ ID NO: 420712 - protein, 9 aa, Homo Sapiens
SRLGRYFVA

SEQ ID NO: 420713 - protein, 9 aa, Homo Sapiens
LACQVEHDG

SEQ ID NO: 420714 - protein, 9 aa, Homo Sapiens
KVLPGTLKG

SEQ ID NO: 420715 - protein, 9 aa, Homo Sapiens
DMEKCFLLV

SEQ ID NO: 420716 - protein, 9 aa, Homo Sapiens
YERKNETFV

SEQ ID NO: 420717 - protein, 9 aa, Homo Sapiens
GVPRTNPVL

SEQ ID NO: 420718 - protein, 9 aa, Homo Sapiens
LQTQFSLLY

SEQ ID NO: 420719 - protein, 9 aa, Homo Sapiens
LPSPSCPHP

SEQ ID NO: 420720 - protein, 9 aa, Homo Sapiens
SPLPVGGQG

SEQ ID NO: 420721 - protein, 9 aa, Homo Sapiens
PSPRSSLPL

SEQ ID NO: 420722 - protein, 9 aa, Homo Sapiens
LVLDVSSIS

SEQ ID NO: 420723 - protein, 9 aa, Homo Sapiens
SCRIQKSDF

SEQ ID NO: 420724 - protein, 9 aa, Homo Sapiens
KEKGNSMTD

SEQ ID NO: 420725 - protein, 9 aa, Homo Sapiens
SPKKDDFKM

SEQ ID NO: 420726 - protein, 9 aa, Homo Sapiens
KRPEGYDLK

SEQ ID NO: 420727 - protein, 9 aa, Homo Sapiens
GSGPQWDSD

SEQ ID NO: 420728 - protein, 9 aa, Homo Sapiens
HGQAPSTGL

SEQ ID NO: 420729 - protein, 9 aa, Homo Sapiens
LIILFIIMP

SEQ ID NO: 420730 - protein, 9 aa, Homo Sapiens
KADSTSEGL

SEQ ID NO: 420731 - protein, 9 aa, Homo Sapiens
AIASLNRYR

SEQ ID NO: 420732 - protein, 9 aa, Homo Sapiens
LRKAARVKM

SEQ ID NO: 420733 - protein, 9 aa, Homo Sapiens
LGITELAVG

SEQ ID NO: 420734 - protein, 9 aa, Homo Sapiens
KKAETMGFP

SEQ ID NO: 420735 - protein, 9 aa, Homo Sapiens
LISDLIAVR

SEQ ID NO: 420736 - protein, 9 aa, Homo Sapiens
LRTNWLSFN

SEQ ID NO: 420737 - protein, 9 aa, Homo Sapiens
SCLFLRSLV

SEQ ID NO: 420738 - protein, 9 aa, Homo Sapiens
VGVIPPAVC

SEQ ID NO: 420739 - protein, 9 aa, Homo Sapiens
PSPKTLTSP

SEQ ID NO: 420740 - protein, 9 aa, Homo Sapiens
RRLRGILEE

SEQ ID NO: 420741 - protein, 9 aa, Homo Sapiens
RRRCIPLAN

SEQ ID NO: 420742 - protein, 9 aa, Homo Sapiens
CRPACTCIS

SEQ ID NO: 420743 - protein, 9 aa, Homo Sapiens
KKIQPKLLL

SEQ ID NO: 420744 - protein, 9 aa, Homo Sapiens
FSDVNEGGK

SEQ ID NO: 420745 - protein, 9 aa, Homo Sapiens
EDDLKKKAL

SEQ ID NO: 420746 - protein, 9 aa, Homo Sapiens
YCLDLPLSS

SEQ ID NO: 420747 - protein, 9 aa, Homo Sapiens
GPVTLRRAS

SEQ ID NO: 420748 - protein, 9 aa, Homo Sapiens
WRRNAEGES

SEQ ID NO: 420749 - protein, 9 aa, Homo Sapiens
QPNAVHPQR

SEQ ID NO: 420750 - protein, 9 aa, Homo Sapiens
DLLAVALFV

SEQ ID NO: 420751 - protein, 9 aa, Homo Sapiens
DSLTIYNSL

SEQ ID NO: 420752 - protein, 9 aa, Homo Sapiens
FLMKKKKLE

SEQ ID NO: 420753 - protein, 9 aa, Homo Sapiens
CATLEREQW

SEQ ID NO: 420754 - protein, 9 aa, Homo Sapiens
APRPKGAKG

SEQ ID NO: 420755 - protein, 9 aa, Homo Sapiens
KLMRCYIAM

SEQ ID NO: 420756 - protein, 9 aa, Homo Sapiens
GGGTSAMNV

SEQ ID NO: 420757 - protein, 9 aa, Homo Sapiens
HCGEKPLKD

SEQ ID NO: 420758 - protein, 9 aa, Homo Sapiens
IPQMTTGKC

SEQ ID NO: 420759 - protein, 9 aa, Homo Sapiens
LGTSARVLE

SEQ ID NO: 420760 - protein, 9 aa, Homo Sapiens
LSALLPRAV

SEQ ID NO: 420761 - protein, 9 aa, Homo Sapiens
CTKEEDILA

SEQ ID NO: 420762 - protein, 9 aa, Homo Sapiens
TPAHTTLLL

SEQ ID NO: 420763 - protein, 9 aa, Homo Sapiens
TWTRGDFVS

SEQ ID NO: 420764 - protein, 9 aa, Homo Sapiens
LGVMVDGVA

SEQ ID NO: 420765 - protein, 9 aa, Homo Sapiens
TAQVVRDTA

SEQ ID NO: 420766 - protein, 9 aa, Homo Sapiens
EGKLGITEL

SEQ ID NO: 420767 - protein, 9 aa, Homo Sapiens
GANWVRPDL

SEQ ID NO: 420768 - protein, 9 aa, Homo Sapiens
CQGALQGVF

SEQ ID NO: 420769 - protein, 9 aa, Homo Sapiens
QGEAPGDPI

SEQ ID NO: 420770 - protein, 9 aa, Homo Sapiens
SPDPSPDLH

SEQ ID NO: 420771 - protein, 9 aa, Homo Sapiens
QDESELLMV

SEQ ID NO: 420772 - protein, 9 aa, Homo Sapiens
KIINPTISC

SEQ ID NO: 420773 - protein, 9 aa, Homo Sapiens
SGLDVDVVL

SEQ ID NO: 420774 - protein, 9 aa, Homo Sapiens
SDINYLLKW

SEQ ID NO: 420775 - protein, 9 aa, Homo Sapiens
ARVPGTDQW

SEQ ID NO: 420776 - protein, 9 aa, Homo Sapiens
ECSPVVVPT

SEQ ID NO: 420777 - protein, 9 aa, Homo Sapiens
LQLTVGRAQ

SEQ ID NO: 420778 - protein, 9 aa, Homo Sapiens
GKKDSGLDV

SEQ ID NO: 420779 - protein, 9 aa, Homo Sapiens
HSAMECTPP

SEQ ID NO: 420780 - protein, 9 aa, Homo Sapiens
LRARGGTTI

SEQ ID NO: 420781 - protein, 9 aa, Homo Sapiens
SERKWSWMT

SEQ ID NO: 420782 - protein, 9 aa, Homo Sapiens
TKCEICVKR

SEQ ID NO: 420783 - protein, 9 aa, Homo Sapiens
ASVGTSAVP

SEQ ID NO: 420784 - protein, 9 aa, Homo Sapiens
GSQCTKEPR

SEQ ID NO: 420785 - protein, 9 aa, Homo Sapiens
STRSLPSIS

SEQ ID NO: 420786 - protein, 9 aa, Homo Sapiens
LWYLSWLDL

SEQ ID NO: 420787 - protein, 9 aa, Homo Sapiens
RCWRCWSSS

SEQ ID NO: 420788 - protein, 9 aa, Homo Sapiens
GRGGSLLGR

SEQ ID NO: 420789 - protein, 9 aa, Homo Sapiens
FGFHSTQDS

SEQ ID NO: 420790 - protein, 9 aa, Homo Sapiens
MGELMTQVV

SEQ ID NO: 420791 - protein, 9 aa, Homo Sapiens
SIISSYKET

SEQ ID NO: 420792 - protein, 9 aa, Homo Sapiens
VSRRLQAYA

SEQ ID NO: 420793 - protein, 9 aa, Homo Sapiens
HIQELEWAL

SEQ ID NO: 420794 - protein, 9 aa, Homo Sapiens
FRDEKDYPT

SEQ ID NO: 420795 - protein, 9 aa, Homo Sapiens
YTAHFLQAS

SEQ ID NO: 420796 - protein, 9 aa, Homo Sapiens
PRIESKSIS

SEQ ID NO: 420797 - protein, 9 aa, Homo Sapiens
GQKIAHLGL

SEQ ID NO: 420798 - protein, 9 aa, Homo Sapiens
LWESRDHYE

SEQ ID NO: 420799 - protein, 9 aa, Homo Sapiens
HAPRLWLLW

SEQ ID NO: 420800 - protein, 9 aa, Homo Sapiens
YYNSSLTLH

SEQ ID NO: 420801 - protein, 9 aa, Homo Sapiens
YHCTHENCG

SEQ ID NO: 420802 - protein, 9 aa, Homo Sapiens
CSVGGGEDS

SEQ ID NO: 420803 - protein, 9 aa, Homo Sapiens
ICLICGDHQ

SEQ ID NO: 420804 - protein, 9 aa, Homo Sapiens
GPHGTHSPR

SEQ ID NO: 420805 - protein, 9 aa, Homo Sapiens
MAVCQIFQQ

SEQ ID NO: 420806 - protein, 9 aa, Homo Sapiens
VSIPLLINY

SEQ ID NO: 420807 - protein, 9 aa, Homo Sapiens
QDDRSTWIR

SEQ ID NO: 420808 - protein, 9 aa, Homo Sapiens
SRVNALANN

SEQ ID NO: 420809 - protein, 9 aa, Homo Sapiens
VAHRETVTT

SEQ ID NO: 420810 - protein, 9 aa, Homo Sapiens
LGHDEDNTH

SEQ ID NO: 420811 - protein, 9 aa, Homo Sapiens
RCERSRSFE

SEQ ID NO: 420812 - protein, 9 aa, Homo Sapiens
SVAQGTTGT

SEQ ID NO: 420813 - protein, 9 aa, Homo Sapiens
HLRQPAFGI

SEQ ID NO: 420814 - protein, 9 aa, Homo Sapiens
LSAEIWDWD

SEQ ID NO: 420815 - protein, 9 aa, Homo Sapiens
YHKITAPGL

SEQ ID NO: 420816 - protein, 9 aa, Homo Sapiens
GRGHHHPHD

SEQ ID NO: 420817 - protein, 9 aa, Homo Sapiens
AVHVALVFA

SEQ ID NO: 420818 - protein, 9 aa, Homo Sapiens
FRLRLRSRS

SEQ ID NO: 420819 - protein, 9 aa, Homo Sapiens
QDLPPVPLL

SEQ ID NO: 420820 - protein, 9 aa, Homo Sapiens
CRRSGKWTS

SEQ ID NO: 420821 - protein, 9 aa, Homo Sapiens
ENLKMDLVR

SEQ ID NO: 420822 - protein, 9 aa, Homo Sapiens
ACYHCRVMC

SEQ ID NO: 420823 - protein, 9 aa, Homo Sapiens
EYKKTYMEM

SEQ ID NO: 420824 - protein, 9 aa, Homo Sapiens
FSINTSPGV

SEQ ID NO: 420825 - protein, 9 aa, Homo Sapiens
LTNIMGFIM

SEQ ID NO: 420826 - protein, 9 aa, Homo Sapiens
KQKRRPYHK

SEQ ID NO: 420827 - protein, 9 aa, Homo Sapiens
SVGCVASIN

SEQ ID NO: 420828 - protein, 9 aa, Homo Sapiens
FTELNEICM

SEQ ID NO: 420829 - protein, 9 aa, Homo Sapiens
RGHLVCVMC

SEQ ID NO: 420830 - protein, 9 aa, Homo Sapiens
LPHQPPLSL

SEQ ID NO: 420831 - protein, 9 aa, Homo Sapiens
TGPTTQTTS

SEQ ID NO: 420832 - protein, 9 aa, Homo Sapiens
VKDTLKLLY

SEQ ID NO: 420833 - protein, 9 aa, Homo Sapiens
FFGDRRRAP

SEQ ID NO: 420834 - protein, 9 aa, Homo Sapiens
HEAVPCYRE

SEQ ID NO: 420835 - protein, 9 aa, Homo Sapiens
KKQLLHLTE

SEQ ID NO: 420836 - protein, 9 aa, Homo Sapiens
LSNSHRATS

SEQ ID NO: 420837 - protein, 9 aa, Homo Sapiens
SRSVLRRSR

SEQ ID NO: 420838 - protein, 9 aa, Homo Sapiens
CNASIMCPL

SEQ ID NO: 420839 - protein, 9 aa, Homo Sapiens
QRRHAAARS

SEQ ID NO: 420840 - protein, 9 aa, Homo Sapiens
IGYHVMVWM

SEQ ID NO: 420841 - protein, 9 aa, Homo Sapiens
IGHDEIPIL

SEQ ID NO: 420842 - protein, 9 aa, Homo Sapiens
SVVWKKWQL

SEQ ID NO: 420843 - protein, 9 aa, Homo Sapiens
ENFQEPDIS

SEQ ID NO: 420844 - protein, 9 aa, Homo Sapiens
LHQAVPRGQ

SEQ ID NO: 420845 - protein, 9 aa, Homo Sapiens
PPTTTPPSP

SEQ ID NO: 420846 - protein, 9 aa, Homo Sapiens
AATIRLLVG

SEQ ID NO: 420847 - protein, 9 aa, Homo Sapiens
NVELTGGVD

SEQ ID NO: 420848 - protein, 9 aa, Homo Sapiens
RHYPRGKQV

SEQ ID NO: 420849 - protein, 9 aa, Homo Sapiens
TSSRISSSS

SEQ ID NO: 420850 - protein, 9 aa, Homo Sapiens
QQRQRLVEG

SEQ ID NO: 420851 - protein, 9 aa, Homo Sapiens
SPEESRWWL

SEQ ID NO: 420852 - protein, 9 aa, Homo Sapiens
TEPLGRGLH

SEQ ID NO: 420853 - protein, 9 aa, Homo Sapiens
WKRKQRAVS

SEQ ID NO: 420854 - protein, 9 aa, Homo Sapiens
VFFTTMVVT

SEQ ID NO: 420855 - protein, 9 aa, Homo Sapiens
SDFSRVFSG

SEQ ID NO: 420856 - protein, 9 aa, Homo Sapiens
SEISPKEIH

SEQ ID NO: 420857 - protein, 9 aa, Homo Sapiens
LLQELEHFN

SEQ ID NO: 420858 - protein, 9 aa, Homo Sapiens
QIHGANRVH

SEQ ID NO: 420859 - protein, 9 aa, Homo Sapiens
VSSAPFAPS

SEQ ID NO: 420860 - protein, 9 aa, Homo Sapiens
TLSEYFCDM

SEQ ID NO: 420861 - protein, 9 aa, Homo Sapiens
LLPVQEPMK

SEQ ID NO: 420862 - protein, 9 aa, Homo Sapiens
PKCPAGERG

SEQ ID NO: 420863 - protein, 9 aa, Homo Sapiens
DVQELLILQ

SEQ ID NO: 420864 - protein, 9 aa, Homo Sapiens
SGKKCGFGF

SEQ ID NO: 420865 - protein, 9 aa, Homo Sapiens
RFAYLSGGQ

SEQ ID NO: 420866 - protein, 9 aa, Homo Sapiens
DVPQTVKSA

SEQ ID NO: 420867 - protein, 9 aa, Homo Sapiens
VSQQLSSLM

SEQ ID NO: 420868 - protein, 9 aa, Homo Sapiens
LLAILLPGR

SEQ ID NO: 420869 - protein, 9 aa, Homo Sapiens
YCLNGQEMC

SEQ ID NO: 420870 - protein, 9 aa, Homo Sapiens
HWDMDVFIK

SEQ ID NO: 420871 - protein, 9 aa, Homo Sapiens
KPVWTVHRI

SEQ ID NO: 420872 - protein, 9 aa, Homo Sapiens
KDKKKKEMM

SEQ ID NO: 420873 - protein, 9 aa, Homo Sapiens
PIRPVSQKE

SEQ ID NO: 420874 - protein, 9 aa, Homo Sapiens
LITTCEKVP

SEQ ID NO: 420875 - protein, 9 aa, Homo Sapiens
LSFPLPRAG

SEQ ID NO: 420876 - protein, 9 aa, Homo Sapiens
LLKEIVLVD

SEQ ID NO: 420877 - protein, 9 aa, Homo Sapiens
WMDMFPKDM

SEQ ID NO: 420878 - protein, 9 aa, Homo Sapiens
FCPKTGRDS

SEQ ID NO: 420879 - protein, 9 aa, Homo Sapiens
ASKEVVGKR

SEQ ID NO: 420880 - protein, 9 aa, Homo Sapiens
STKSYLLQL

SEQ ID NO: 420881 - protein, 9 aa, Homo Sapiens
SYWESTDMV

SEQ ID NO: 420882 - protein, 9 aa, Homo Sapiens
VQEMQEKLA

SEQ ID NO: 420883 - protein, 9 aa, Homo Sapiens
LAPPALVAP

SEQ ID NO: 420884 - protein, 9 aa, Homo Sapiens
ETMGFPVSS

SEQ ID NO: 420885 - protein, 9 aa, Homo Sapiens
TSRGQAQDT

SEQ ID NO: 420886 - protein, 9 aa, Homo Sapiens
PPPACTSKA

SEQ ID NO: 420887 - protein, 9 aa, Homo Sapiens
SSCSKRAAG

SEQ ID NO: 420888 - protein, 9 aa, Homo Sapiens
IFPREVHLP

SEQ ID NO: 420889 - protein, 9 aa, Homo Sapiens
LPGRARDLN

SEQ ID NO: 420890 - protein, 9 aa, Homo Sapiens
RGNAGRIRS

SEQ ID NO: 420891 - protein, 9 aa, Homo Sapiens
QALFCLTLE

SEQ ID NO: 420892 - protein, 9 aa, Homo Sapiens
EVNSPPPSP

SEQ ID NO: 420893 - protein, 9 aa, Homo Sapiens
PTAADSTAP

SEQ ID NO: 420894 - protein, 9 aa, Homo Sapiens
PPAKKNKEN

SEQ ID NO: 420895 - protein, 9 aa, Homo Sapiens
STAVDTSVA

SEQ ID NO: 420896 - protein, 9 aa, Homo Sapiens
PTSWMSWEC

SEQ ID NO: 420897 - protein, 9 aa, Homo Sapiens
LTPPAVPPV

SEQ ID NO: 420898 - protein, 9 aa, Homo Sapiens
IVKLLGYSE

SEQ ID NO: 420899 - protein, 9 aa, Homo Sapiens
TYLIREQPA

SEQ ID NO: 420900 - protein, 9 aa, Homo Sapiens
SCHPLPQLL

SEQ ID NO: 420901 - protein, 9 aa, Homo Sapiens
RVKMRTVVL

SEQ ID NO: 420902 - protein, 9 aa, Homo Sapiens
EARQVRLED

SEQ ID NO: 420903 - protein, 9 aa, Homo Sapiens
VQQWPGPGF

SEQ ID NO: 420904 - protein, 9 aa, Homo Sapiens
KNFTKLAKN

SEQ ID NO: 420905 - protein, 9 aa, Homo Sapiens
KAPLSRSAP

SEQ ID NO: 420906 - protein, 9 aa, Homo Sapiens
ICLLSHLNS

SEQ ID NO: 420907 - protein, 9 aa, Homo Sapiens
SQYTQTTLS

SEQ ID NO: 420908 - protein, 9 aa, Homo Sapiens
RVEVAAGPP

SEQ ID NO: 420909 - protein, 9 aa, Homo Sapiens
PARAGATRC

SEQ ID NO: 420910 - protein, 9 aa, Homo Sapiens
LPWCPPRTP

SEQ ID NO: 420911 - protein, 9 aa, Homo Sapiens
KKNDQSCEI

SEQ ID NO: 420912 - protein, 9 aa, Homo Sapiens
PEEAGAGLE

SEQ ID NO: 420913 - protein, 9 aa, Homo Sapiens
RKKVEIEMD

SEQ ID NO: 420914 - protein, 9 aa, Homo Sapiens
TDVSTAFEE

SEQ ID NO: 420915 - protein, 9 aa, Homo Sapiens
SDVSSMSLR

SEQ ID NO: 420916 - protein, 9 aa, Homo Sapiens
HLDQLIYIP

SEQ ID NO: 420917 - protein, 9 aa, Homo Sapiens
SQQLSSLMM

SEQ ID NO: 420918 - protein, 9 aa, Homo Sapiens
AGVCQQEGE

SEQ ID NO: 420919 - protein, 9 aa, Homo Sapiens
APSLWLLTR

SEQ ID NO: 420920 - protein, 9 aa, Homo Sapiens
CPRDYWYLL

SEQ ID NO: 420921 - protein, 9 aa, Homo Sapiens
LRPRFRWEV

SEQ ID NO: 420922 - protein, 9 aa, Homo Sapiens
ILLPMVFCI

SEQ ID NO: 420923 - protein, 9 aa, Homo Sapiens
VFAQVRRAH

SEQ ID NO: 420924 - protein, 9 aa, Homo Sapiens
PAGSMDCVC

SEQ ID NO: 420925 - protein, 9 aa, Homo Sapiens
HKAFRCYSD

SEQ ID NO: 420926 - protein, 9 aa, Homo Sapiens
VGLFKTQNA

SEQ ID NO: 420927 - protein, 9 aa, Homo Sapiens
SRPGWAALQ

SEQ ID NO: 420928 - protein, 9 aa, Homo Sapiens
NCKKRIPDT

SEQ ID NO: 420929 - protein, 9 aa, Homo Sapiens
ARICAVGLL

SEQ ID NO: 420930 - protein, 9 aa, Homo Sapiens
RDEPWPGPA

SEQ ID NO: 420931 - protein, 9 aa, Homo Sapiens
YCVMGFAQK

SEQ ID NO: 420932 - protein, 9 aa, Homo Sapiens
SRQSRSPSL

SEQ ID NO: 420933 - protein, 9 aa, Homo Sapiens
DQAPEPPTQ

SEQ ID NO: 420934 - protein, 9 aa, Homo Sapiens
RFLMDGLYH

SEQ ID NO: 420935 - protein, 9 aa, Homo Sapiens
PDAMCVNSR

SEQ ID NO: 420936 - protein, 9 aa, Homo Sapiens
RIDGMSLLV

SEQ ID NO: 420937 - protein, 9 aa, Homo Sapiens
TFDVEIHMR

SEQ ID NO: 420938 - protein, 9 aa, Homo Sapiens
THPQEGRSH

SEQ ID NO: 420939 - protein, 9 aa, Homo Sapiens
DEDEGEEDS

SEQ ID NO: 420940 - protein, 9 aa, Homo Sapiens
QQYALLREE

SEQ ID NO: 420941 - protein, 9 aa, Homo Sapiens
VDGHVSETP

SEQ ID NO: 420942 - protein, 9 aa, Homo Sapiens
NQYTENSLR

SEQ ID NO: 420943 - protein, 9 aa, Homo Sapiens
ATLCTQLHR

SEQ ID NO: 420944 - protein, 9 aa, Homo Sapiens
ARQASLSIL

SEQ ID NO: 420945 - protein, 9 aa, Homo Sapiens
VNATGHQLQ

SEQ ID NO: 420946 - protein, 9 aa, Homo Sapiens
TLEREQWEL

SEQ ID NO: 420947 - protein, 9 aa, Homo Sapiens
KDSEDLKDH

SEQ ID NO: 420948 - protein, 9 aa, Homo Sapiens
MKRSSTLEH

SEQ ID NO: 420949 - protein, 9 aa, Homo Sapiens
IYMYVKRKT

SEQ ID NO: 420950 - protein, 9 aa, Homo Sapiens
FTSGNTVDG

SEQ ID NO: 420951 - protein, 9 aa, Homo Sapiens
SSMVDFWDF

SEQ ID NO: 420952 - protein, 9 aa, Homo Sapiens
EGPVQELRK

SEQ ID NO: 420953 - protein, 9 aa, Homo Sapiens
RDQRRGRLL

SEQ ID NO: 420954 - protein, 9 aa, Homo Sapiens
FHNGKKSIT

SEQ ID NO: 420955 - protein, 9 aa, Homo Sapiens
YQALKRTAE

SEQ ID NO: 420956 - protein, 9 aa, Homo Sapiens
SAKPLTQYM

SEQ ID NO: 420957 - protein, 9 aa, Homo Sapiens
HCSSTVTVL

SEQ ID NO: 420958 - protein, 9 aa, Homo Sapiens
KDVCTTKFG

SEQ ID NO: 420959 - protein, 9 aa, Homo Sapiens
PHGTHSPRA

SEQ ID NO: 420960 - protein, 9 aa, Homo Sapiens
VASCFGASG

SEQ ID NO: 420961 - protein, 9 aa, Homo Sapiens
GINKDQPTG

SEQ ID NO: 420962 - protein, 9 aa, Homo Sapiens
IATMMAKTI

SEQ ID NO: 420963 - protein, 9 aa, Homo Sapiens
SASLQPKTA

SEQ ID NO: 420964 - protein, 9 aa, Homo Sapiens
STFRNLQGN

SEQ ID NO: 420965 - protein, 9 aa, Homo Sapiens
SHSTLLLVS

SEQ ID NO: 420966 - protein, 9 aa, Homo Sapiens
GGHSPCSVG

SEQ ID NO: 420967 - protein, 9 aa, Homo Sapiens
VEIRSLEPG

SEQ ID NO: 420968 - protein, 9 aa, Homo Sapiens
VTFVEQGHV

SEQ ID NO: 420969 - protein, 9 aa, Homo Sapiens
DVLEEPDDQ

SEQ ID NO: 420970 - protein, 9 aa, Homo Sapiens
GGHSPCSVL

SEQ ID NO: 420971 - protein, 9 aa, Homo Sapiens
FFFHLLGGD

SEQ ID NO: 420972 - protein, 9 aa, Homo Sapiens
PGAAHQAGA

SEQ ID NO: 420973 - protein, 9 aa, Homo Sapiens
TDMVSFLLR

SEQ ID NO: 420974 - protein, 9 aa, Homo Sapiens
AEKYFGPSF

SEQ ID NO: 420975 - protein, 9 aa, Homo Sapiens
MIDFVVTDM

SEQ ID NO: 420976 - protein, 9 aa, Homo Sapiens
IPDCYYVTH

SEQ ID NO: 420977 - protein, 9 aa, Homo Sapiens
TINSLAQLC

SEQ ID NO: 420978 - protein, 9 aa, Homo Sapiens
KGLHWGHTK

SEQ ID NO: 420979 - protein, 9 aa, Homo Sapiens
ETAAVAGAW

SEQ ID NO: 420980 - protein, 9 aa, Homo Sapiens
TEKKIFFQK

SEQ ID NO: 420981 - protein, 9 aa, Homo Sapiens
LSRWGPRAT

SEQ ID NO: 420982 - protein, 9 aa, Homo Sapiens
RGPRLPSQP

SEQ ID NO: 420983 - protein, 9 aa, Homo Sapiens
LGNPIPSEV

SEQ ID NO: 420984 - protein, 9 aa, Homo Sapiens
KFFEENMIF

SEQ ID NO: 420985 - protein, 9 aa, Homo Sapiens
QPTGRLSTC

SEQ ID NO: 420986 - protein, 9 aa, Homo Sapiens
QLPERMKAG

SEQ ID NO: 420987 - protein, 9 aa, Homo Sapiens
DGQQVLLPR

SEQ ID NO: 420988 - protein, 9 aa, Homo Sapiens
RLQDQQQAQ

SEQ ID NO: 420989 - protein, 9 aa, Homo Sapiens
PFRPQQALQ

SEQ ID NO: 420990 - protein, 9 aa, Homo Sapiens
TLCTQLHRN

SEQ ID NO: 420991 - protein, 9 aa, Homo Sapiens
ERYELPNVL

SEQ ID NO: 420992 - protein, 9 aa, Homo Sapiens
VVSEEDFWR

SEQ ID NO: 420993 - protein, 9 aa, Homo Sapiens
QLLHLTEEK

SEQ ID NO: 420994 - protein, 9 aa, Homo Sapiens
QRELLHCAH

SEQ ID NO: 420995 - protein, 9 aa, Homo Sapiens
TELAVGLTS

SEQ ID NO: 420996 - protein, 9 aa, Homo Sapiens
WDFRTYRLS

SEQ ID NO: 420997 - protein, 9 aa, Homo Sapiens
NAPPVPVLS

SEQ ID NO: 420998 - protein, 9 aa, Homo Sapiens
LDLTLCRAY

SEQ ID NO: 420999 - protein, 9 aa, Homo Sapiens
PGPGSGPQW

SEQ ID NO: 421000 - protein, 9 aa, Homo Sapiens
DIVGNLVSY

SEQ ID NO: 421001 - protein, 9 aa, Homo Sapiens
TPRNTRAGP

SEQ ID NO: 421002 - protein, 9 aa, Homo Sapiens
PKMQRSPGP

SEQ ID NO: 421003 - protein, 9 aa, Homo Sapiens
AASLLGPPP

SEQ ID NO: 421004 - protein, 9 aa, Homo Sapiens
PTAACPLPG

SEQ ID NO: 421005 - protein, 9 aa, Homo Sapiens
SGAWTTTLG

SEQ ID NO: 421006 - protein, 9 aa, Homo Sapiens
WPFGPILCR

SEQ ID NO: 421007 - protein, 9 aa, Homo Sapiens
GRGQIKQKR

SEQ ID NO: 421008 - protein, 9 aa, Homo Sapiens
PAAEYFEHG

SEQ ID NO: 421009 - protein, 9 aa, Homo Sapiens
CSVLGGEDS

SEQ ID NO: 421010 - protein, 9 aa, Homo Sapiens
TLATLCTQL

SEQ ID NO: 421011 - protein, 9 aa, Homo Sapiens
STVERAADD

SEQ ID NO: 421012 - protein, 9 aa, Homo Sapiens
ALVLGPGLK

SEQ ID NO: 421013 - protein, 9 aa, Homo Sapiens
YFAVVVVPI

SEQ ID NO: 421014 - protein, 9 aa, Homo Sapiens
EGGQLVLLR

SEQ ID NO: 421015 - protein, 9 aa, Homo Sapiens
FSSSSSVLG

SEQ ID NO: 421016 - protein, 9 aa, Homo Sapiens
EIPAEFPHW

SEQ ID NO: 421017 - protein, 9 aa, Homo Sapiens
PHSAGLSPG

SEQ ID NO: 421018 - protein, 9 aa, Homo Sapiens
ALRLRPHLR

SEQ ID NO: 421019 - protein, 9 aa, Homo Sapiens
SSGSPSVLD

SEQ ID NO: 421020 - protein, 9 aa, Homo Sapiens
VKENMKVYH

SEQ ID NO: 421021 - protein, 9 aa, Homo Sapiens
LGDAGVFGP

SEQ ID NO: 421022 - protein, 9 aa, Homo Sapiens
GSPTSNDDM

SEQ ID NO: 421023 - protein, 9 aa, Homo Sapiens
HERPHPIHI

SEQ ID NO: 421024 - protein, 9 aa, Homo Sapiens
WRVIGYHVM

SEQ ID NO: 421025 - protein, 9 aa, Homo Sapiens
LWSRWRPTR

SEQ ID NO: 421026 - protein, 9 aa, Homo Sapiens
EVGFINRTV

SEQ ID NO: 421027 - protein, 9 aa, Homo Sapiens
ISIQYRLKI

SEQ ID NO: 421028 - protein, 9 aa, Homo Sapiens
NEPGRPLRS

SEQ ID NO: 421029 - protein, 9 aa, Homo Sapiens
LRSLVWLPS

SEQ ID NO: 421030 - protein, 9 aa, Homo Sapiens
LQNPAPVAF

SEQ ID NO: 421031 - protein, 9 aa, Homo Sapiens
RPDLIIFLE

SEQ ID NO: 421032 - protein, 9 aa, Homo Sapiens
KVTENLHVL

SEQ ID NO: 421033 - protein, 9 aa, Homo Sapiens
QDEVPASPA

SEQ ID NO: 421034 - protein, 9 aa, Homo Sapiens
VRNSPCSMC

SEQ ID NO: 421035 - protein, 9 aa, Homo Sapiens
KHTIKLTFE

SEQ ID NO: 421036 - protein, 9 aa, Homo Sapiens
APFSPIIIG

SEQ ID NO: 421037 - protein, 9 aa, Homo Sapiens
LLLAILLPG

SEQ ID NO: 421038 - protein, 9 aa, Homo Sapiens
PVPSHKPDQ

SEQ ID NO: 421039 - protein, 9 aa, Homo Sapiens
SHVPVQPSS

SEQ ID NO: 421040 - protein, 9 aa, Homo Sapiens
NKDQPTGRL

SEQ ID NO: 421041 - protein, 9 aa, Homo Sapiens
QSALGTASE

SEQ ID NO: 421042 - protein, 9 aa, Homo Sapiens
LFKTQNAPS

SEQ ID NO: 421043 - protein, 9 aa, Homo Sapiens
LLHSNVNGS

SEQ ID NO: 421044 - protein, 9 aa, Homo Sapiens
PQLCRPPTP

SEQ ID NO: 421045 - protein, 9 aa, Homo Sapiens
HSGTLVTAG

SEQ ID NO: 421046 - protein, 9 aa, Homo Sapiens
LLWESNRRT

SEQ ID NO: 421047 - protein, 9 aa, Homo Sapiens
MLHSCRIQK

SEQ ID NO: 421048 - protein, 9 aa, Homo Sapiens
TAIGGGVAR

SEQ ID NO: 421049 - protein, 9 aa, Homo Sapiens
VLGHMNLAD

SEQ ID NO: 421050 - protein, 9 aa, Homo Sapiens
FMCLRLCPH

SEQ ID NO: 421051 - protein, 9 aa, Homo Sapiens
QPPPVPSHK

SEQ ID NO: 421052 - protein, 9 aa, Homo Sapiens
LWSDPDDHG

SEQ ID NO: 421053 - protein, 9 aa, Homo Sapiens
VAGSLAAAT

SEQ ID NO: 421054 - protein, 9 aa, Homo Sapiens
AKTQEFRER

SEQ ID NO: 421055 - protein, 9 aa, Homo Sapiens
LHEQQCLKI

SEQ ID NO: 421056 - protein, 9 aa, Homo Sapiens
SETFWGYCV

SEQ ID NO: 421057 - protein, 9 aa, Homo Sapiens
MLPVRARTA

SEQ ID NO: 421058 - protein, 9 aa, Homo Sapiens
GLQSRMVHH

SEQ ID NO: 421059 - protein, 9 aa, Homo Sapiens
SPRAIFQRP

SEQ ID NO: 421060 - protein, 9 aa, Homo Sapiens
APPPLSSPL

SEQ ID NO: 421061 - protein, 9 aa, Homo Sapiens
ILSNMSEET

SEQ ID NO: 421062 - protein, 9 aa, Homo Sapiens
IPFSLQLLD

SEQ ID NO: 421063 - protein, 9 aa, Homo Sapiens
TSSPEKESQ

SEQ ID NO: 421064 - protein, 9 aa, Homo Sapiens
MGSPFPAST

SEQ ID NO: 421065 - protein, 9 aa, Homo Sapiens
SRLFLMDFF

SEQ ID NO: 421066 - protein, 9 aa, Homo Sapiens
KNQIRSGMG

SEQ ID NO: 421067 - protein, 9 aa, Homo Sapiens
DRKHALEWF

SEQ ID NO: 421068 - protein, 9 aa, Homo Sapiens
WTRVGFLAC

SEQ ID NO: 421069 - protein, 9 aa, Homo Sapiens
LLLQLQQQQ

SEQ ID NO: 421070 - protein, 9 aa, Homo Sapiens
PRKMAPTTA

SEQ ID NO: 421071 - protein, 9 aa, Homo Sapiens
PGTGTVTAA

SEQ ID NO: 421072 - protein, 9 aa, Homo Sapiens
RRGRLLGRH

SEQ ID NO: 421073 - protein, 9 aa, Homo Sapiens
GKQSAPRNL

SEQ ID NO: 421074 - protein, 9 aa, Homo Sapiens
GNSLENQSI

SEQ ID NO: 421075 - protein, 9 aa, Homo Sapiens
YLWIWQEWT

SEQ ID NO: 421076 - protein, 9 aa, Homo Sapiens
MRTAMIPFP

SEQ ID NO: 421077 - protein, 9 aa, Homo Sapiens
NQDESELLM

SEQ ID NO: 421078 - protein, 9 aa, Homo Sapiens
PSMINYVLF

SEQ ID NO: 421079 - protein, 9 aa, Homo Sapiens
WLAVGPQQD

SEQ ID NO: 421080 - protein, 9 aa, Homo Sapiens
LTGSIISSY

SEQ ID NO: 421081 - protein, 9 aa, Homo Sapiens
QSGKKCGFG

SEQ ID NO: 421082 - protein, 9 aa, Homo Sapiens
PWQAIWQLC

SEQ ID NO: 421083 - protein, 9 aa, Homo Sapiens
EKEDEKDEE

SEQ ID NO: 421084 - protein, 9 aa, Homo Sapiens
ARRQEQLLR

SEQ ID NO: 421085 - protein, 9 aa, Homo Sapiens
PDVTVYDGS

SEQ ID NO: 421086 - protein, 9 aa, Homo Sapiens
VRHVRSRES

SEQ ID NO: 421087 - protein, 9 aa, Homo Sapiens
IDFRIGDRE

SEQ ID NO: 421088 - protein, 9 aa, Homo Sapiens
VVLTLPISI

SEQ ID NO: 421089 - protein, 9 aa, Homo Sapiens
PSACTRPQS

SEQ ID NO: 421090 - protein, 9 aa, Homo Sapiens
EDLAEVTVA

SEQ ID NO: 421091 - protein, 9 aa, Homo Sapiens
KIASVEGQK

SEQ ID NO: 421092 - protein, 9 aa, Homo Sapiens
KPTVKKIAT

SEQ ID NO: 421093 - protein, 9 aa, Homo Sapiens
CLDLPLSSV

SEQ ID NO: 421094 - protein, 9 aa, Homo Sapiens
QIPTSTRSL

SEQ ID NO: 421095 - protein, 9 aa, Homo Sapiens
NMYIVTQTA

SEQ ID NO: 421096 - protein, 9 aa, Homo Sapiens
PHTVSYLDN

SEQ ID NO: 421097 - protein, 9 aa, Homo Sapiens
FFFTIGITW

SEQ ID NO: 421098 - protein, 9 aa, Homo Sapiens
LLEFQNESC

SEQ ID NO: 421099 - protein, 9 aa, Homo Sapiens
CQDVRCRRL

SEQ ID NO: 421100 - protein, 9 aa, Homo Sapiens
SDKSIEHQC

SEQ ID NO: 421101 - protein, 9 aa, Homo Sapiens
LLLSVCPTV

SEQ ID NO: 421102 - protein, 9 aa, Homo Sapiens
KGRKKIKEK

SEQ ID NO: 421103 - protein, 9 aa, Homo Sapiens
VHSQQPCQS

SEQ ID NO: 421104 - protein, 9 aa, Homo Sapiens
ELPVAGGAA

SEQ ID NO: 421105 - protein, 9 aa, Homo Sapiens
TSPGAAHQA

SEQ ID NO: 421106 - protein, 9 aa, Homo Sapiens
SDVNEGGKE

SEQ ID NO: 421107 - protein, 9 aa, Homo Sapiens
FQEPDISLV

SEQ ID NO: 421108 - protein, 9 aa, Homo Sapiens
LGAALGVDA

SEQ ID NO: 421109 - protein, 9 aa, Homo Sapiens
RDRRPGPSR

SEQ ID NO: 421110 - protein, 9 aa, Homo Sapiens
LQLLDTAGQ

SEQ ID NO: 421111 - protein, 9 aa, Homo Sapiens
THVHLNVFQ

SEQ ID NO: 421112 - protein, 9 aa, Homo Sapiens
WAATPKSLG

SEQ ID NO: 421113 - protein, 9 aa, Homo Sapiens
AEVGLAPGE

SEQ ID NO: 421114 - protein, 9 aa, Homo Sapiens
TNMNETSSH

SEQ ID NO: 421115 - protein, 9 aa, Homo Sapiens
KNKEESDSA

SEQ ID NO: 421116 - protein, 9 aa, Homo Sapiens
YELLTAFLG

SEQ ID NO: 421117 - protein, 9 aa, Homo Sapiens
ILSNDVHVW

SEQ ID NO: 421118 - protein, 9 aa, Homo Sapiens
PTRSSRGTS

SEQ ID NO: 421119 - protein, 9 aa, Homo Sapiens
RRRRAAQQA

SEQ ID NO: 421120 - protein, 9 aa, Homo Sapiens
QLGFNIQGG

SEQ ID NO: 421121 - protein, 9 aa, Homo Sapiens
LQSATHPQE

SEQ ID NO: 421122 - protein, 9 aa, Homo Sapiens
SPTCFSTGH

SEQ ID NO: 421123 - protein, 9 aa, Homo Sapiens
YICGLPDGT

SEQ ID NO: 421124 - protein, 9 aa, Homo Sapiens
LATEQQPGN

SEQ ID NO: 421125 - protein, 9 aa, Homo Sapiens
VTTIGAHKT

SEQ ID NO: 421126 - protein, 9 aa, Homo Sapiens
YGKKAETMG

SEQ ID NO: 421127 - protein, 9 aa, Homo Sapiens
TYTKQKATG

SEQ ID NO: 421128 - protein, 9 aa, Homo Sapiens
ATRSPAPIT

SEQ ID NO: 421129 - protein, 9 aa, Homo Sapiens
RAARQPSVW

SEQ ID NO: 421130 - protein, 9 aa, Homo Sapiens
KIERTALDG

SEQ ID NO: 421131 - protein, 9 aa, Homo Sapiens
ILRGSNYHK

SEQ ID NO: 421132 - protein, 9 aa, Homo Sapiens
ECVLSDYTQ

SEQ ID NO: 421133 - protein, 9 aa, Homo Sapiens
HVPVQPSSS

SEQ ID NO: 421134 - protein, 9 aa, Homo Sapiens
VCFLFFCQK

SEQ ID NO: 421135 - protein, 9 aa, Homo Sapiens
MMVMADDNV

SEQ ID NO: 421136 - protein, 9 aa, Homo Sapiens
ESFPIKYHD

SEQ ID NO: 421137 - protein, 9 aa, Homo Sapiens
SYTDCHGQQ

SEQ ID NO: 421138 - protein, 9 aa, Homo Sapiens
CRVLWRNPI

SEQ ID NO: 421139 - protein, 9 aa, Homo Sapiens
FAVVVVPIN

SEQ ID NO: 421140 - protein, 9 aa, Homo Sapiens
SVNKVFVDN

SEQ ID NO: 421141 - protein, 9 aa, Homo Sapiens
YNMYIVTQT

SEQ ID NO: 421142 - protein, 9 aa, Homo Sapiens
VNTKSYPPP

SEQ ID NO: 421143 - protein, 9 aa, Homo Sapiens
AAASTRTHG

SEQ ID NO: 421144 - protein, 9 aa, Homo Sapiens
TMPPLLHPQ

SEQ ID NO: 421145 - protein, 9 aa, Homo Sapiens
AREEGYYYR

SEQ ID NO: 421146 - protein, 9 aa, Homo Sapiens
EIVHQPARV

SEQ ID NO: 421147 - protein, 9 aa, Homo Sapiens
WTCQNSHWP

SEQ ID NO: 421148 - protein, 9 aa, Homo Sapiens
IDALCRKGC

SEQ ID NO: 421149 - protein, 9 aa, Homo Sapiens
LLGHRVVTC

SEQ ID NO: 421150 - protein, 9 aa, Homo Sapiens
STYRRQASQ

SEQ ID NO: 421151 - protein, 9 aa, Homo Sapiens
GALSSHGSS

SEQ ID NO: 421152 - protein, 9 aa, Homo Sapiens
CAYCVMGFA

SEQ ID NO: 421153 - protein, 9 aa, Homo Sapiens
GEPTPSWRR

SEQ ID NO: 421154 - protein, 9 aa, Homo Sapiens
DKNCHLAMD

SEQ ID NO: 421155 - protein, 9 aa, Homo Sapiens
SFLMKKKKL

SEQ ID NO: 421156 - protein, 9 aa, Homo Sapiens
DDWWIAMTY

SEQ ID NO: 421157 - protein, 9 aa, Homo Sapiens
SAHPSFFLH

SEQ ID NO: 421158 - protein, 9 aa, Homo Sapiens
MNMKMKTFM

SEQ ID NO: 421159 - protein, 9 aa, Homo Sapiens
DGVSRTDLI

SEQ ID NO: 421160 - protein, 9 aa, Homo Sapiens
NSSDIPGPA

SEQ ID NO: 421161 - protein, 9 aa, Homo Sapiens
QHLRNIRVR

SEQ ID NO: 421162 - protein, 9 aa, Homo Sapiens
NIVLLPDPL

SEQ ID NO: 421163 - protein, 9 aa, Homo Sapiens
FPLQCWGRR

SEQ ID NO: 421164 - protein, 9 aa, Homo Sapiens
NNQPMQVMV

SEQ ID NO: 421165 - protein, 9 aa, Homo Sapiens
ISRAQYNVL

SEQ ID NO: 421166 - protein, 9 aa, Homo Sapiens
SGSTTTTCR

SEQ ID NO: 421167 - protein, 9 aa, Homo Sapiens
GTSWMSSCS

SEQ ID NO: 421168 - protein, 9 aa, Homo Sapiens
DFCHCPNTS

SEQ ID NO: 421169 - protein, 9 aa, Homo Sapiens
MECTPPHLL

SEQ ID NO: 421170 - protein, 9 aa, Homo Sapiens
SVDFHVDLN

SEQ ID NO: 421171 - protein, 9 aa, Homo Sapiens
SWGTPNRER

SEQ ID NO: 421172 - protein, 9 aa, Homo Sapiens
IGKISQQDV

SEQ ID NO: 421173 - protein, 9 aa, Homo Sapiens
AWTCSSGPA

SEQ ID NO: 421174 - protein, 9 aa, Homo Sapiens
IVQCGLVQP

SEQ ID NO: 421175 - protein, 9 aa, Homo Sapiens
CVLLNRPEI

SEQ ID NO: 421176 - protein, 9 aa, Homo Sapiens
AQTIASYGS

SEQ ID NO: 421177 - protein, 9 aa, Homo Sapiens
HDHNHRLHH

SEQ ID NO: 421178 - protein, 9 aa, Homo Sapiens
HTRWPAAPR

SEQ ID NO: 421179 - protein, 9 aa, Homo Sapiens
EPRWRMLYL

SEQ ID NO: 421180 - protein, 9 aa, Homo Sapiens
STSILSALR

SEQ ID NO: 421181 - protein, 9 aa, Homo Sapiens
GAPATPRGR

SEQ ID NO: 421182 - protein, 9 aa, Homo Sapiens
ASLSQRQDQ

SEQ ID NO: 421183 - protein, 9 aa, Homo Sapiens
PQPSGTGKT

SEQ ID NO: 421184 - protein, 9 aa, Homo Sapiens
APAPHPART

SEQ ID NO: 421185 - protein, 9 aa, Homo Sapiens
RPVSKKDLH

SEQ ID NO: 421186 - protein, 9 aa, Homo Sapiens
KRGQPWVTD

SEQ ID NO: 421187 - protein, 9 aa, Homo Sapiens
LQSRMVHHT

SEQ ID NO: 421188 - protein, 9 aa, Homo Sapiens
QDVEVDEVA

SEQ ID NO: 421189 - protein, 9 aa, Homo Sapiens
TDTCGLPSR

SEQ ID NO: 421190 - protein, 9 aa, Homo Sapiens
CIVGRLTWV

SEQ ID NO: 421191 - protein, 9 aa, Homo Sapiens
LQYHCSHLA

SEQ ID NO: 421192 - protein, 9 aa, Homo Sapiens
YPPARQPSR

SEQ ID NO: 421193 - protein, 9 aa, Homo Sapiens
PTKCEICVK

SEQ ID NO: 421194 - protein, 9 aa, Homo Sapiens
PVPLLRGRL

SEQ ID NO: 421195 - protein, 9 aa, Homo Sapiens
RIPRATSTI

SEQ ID NO: 421196 - protein, 9 aa, Homo Sapiens
TISCPFQSP

SEQ ID NO: 421197 - protein, 9 aa, Homo Sapiens
ELMLADCNL

SEQ ID NO: 421198 - protein, 9 aa, Homo Sapiens
AQPSPPWLR

SEQ ID NO: 421199 - protein, 9 aa, Homo Sapiens
WVEVVHDGE

SEQ ID NO: 421200 - protein, 9 aa, Homo Sapiens
SRGSRRRGS

SEQ ID NO: 421201 - protein, 9 aa, Homo Sapiens
MIKIKKKIE

SEQ ID NO: 421202 - protein, 9 aa, Homo Sapiens
PVSQKEVTI

SEQ ID NO: 421203 - protein, 9 aa, Homo Sapiens
PSAAWSTCC

SEQ ID NO: 421204 - protein, 9 aa, Homo Sapiens
STAQKQRKH

SEQ ID NO: 421205 - protein, 9 aa, Homo Sapiens
IAHYDPATE

SEQ ID NO: 421206 - protein, 9 aa, Homo Sapiens
LFMKWYTAE

SEQ ID NO: 421207 - protein, 9 aa, Homo Sapiens
SRFWLALQA

SEQ ID NO: 421208 - protein, 9 aa, Homo Sapiens
VLQAKADST

SEQ ID NO: 421209 - protein, 9 aa, Homo Sapiens
IPFLLLAIL

SEQ ID NO: 421210 - protein, 9 aa, Homo Sapiens
FQAISSMVD

SEQ ID NO: 421211 - protein, 9 aa, Homo Sapiens
KQMTDMLLT

SEQ ID NO: 421212 - protein, 9 aa, Homo Sapiens
LWLLWRQNG

SEQ ID NO: 421213 - protein, 9 aa, Homo Sapiens
MLVIFTMSF

SEQ ID NO: 421214 - protein, 9 aa, Homo Sapiens
LDLTSNQLQ

SEQ ID NO: 421215 - protein, 9 aa, Homo Sapiens
DPSTAGGCP

SEQ ID NO: 421216 - protein, 9 aa, Homo Sapiens
LSLAWKICE

SEQ ID NO: 421217 - protein, 9 aa, Homo Sapiens
QPPQHQLSA

SEQ ID NO: 421218 - protein, 9 aa, Homo Sapiens
APETAAVAG

SEQ ID NO: 421219 - protein, 9 aa, Homo Sapiens
TYQKMPKVL

SEQ ID NO: 421220 - protein, 9 aa, Homo Sapiens
APGSSCYFF

SEQ ID NO: 421221 - protein, 9 aa, Homo Sapiens
RDTPRSERK

SEQ ID NO: 421222 - protein, 9 aa, Homo Sapiens
TSSPRRSPA

SEQ ID NO: 421223 - protein, 9 aa, Homo Sapiens
LSPSSWTSP

SEQ ID NO: 421224 - protein, 9 aa, Homo Sapiens
QWETPAHTT

SEQ ID NO: 421225 - protein, 9 aa, Homo Sapiens
VKLQLLLHL

SEQ ID NO: 421226 - protein, 9 aa, Homo Sapiens
RRTAEWSHS

SEQ ID NO: 421227 - protein, 9 aa, Homo Sapiens
GNKADLTNK

SEQ ID NO: 421228 - protein, 9 aa, Homo Sapiens
NQNPNGENQ

SEQ ID NO: 421229 - protein, 9 aa, Homo Sapiens
QGGYHRSGK

SEQ ID NO: 421230 - protein, 9 aa, Homo Sapiens
LDSGFWEIE

SEQ ID NO: 421231 - protein, 9 aa, Homo Sapiens
HFISLPPAP

SEQ ID NO: 421232 - protein, 9 aa, Homo Sapiens
DFWRWASFR

SEQ ID NO: 421233 - protein, 9 aa, Homo Sapiens
RHPRKPGVV

SEQ ID NO: 421234 - protein, 9 aa, Homo Sapiens
SWMSWECCM

SEQ ID NO: 421235 - protein, 9 aa, Homo Sapiens
DCGIRTSVV

SEQ ID NO: 421236 - protein, 9 aa, Homo Sapiens
IFEPSIRGS

SEQ ID NO: 421237 - protein, 9 aa, Homo Sapiens
VVLAAVGVV

SEQ ID NO: 421238 - protein, 9 aa, Homo Sapiens
GSQTESLKV

SEQ ID NO: 421239 - protein, 9 aa, Homo Sapiens
LRGLLQDHG

SEQ ID NO: 421240 - protein, 9 aa, Homo Sapiens
NKHLRGGGS

SEQ ID NO: 421241 - protein, 9 aa, Homo Sapiens
ASTFSTTPV

SEQ ID NO: 421242 - protein, 9 aa, Homo Sapiens
TVYDGSWSE

SEQ ID NO: 421243 - protein, 9 aa, Homo Sapiens
RVDRLAVLG

SEQ ID NO: 421244 - protein, 9 aa, Homo Sapiens
HDVLSSNEA

SEQ ID NO: 421245 - protein, 9 aa, Homo Sapiens
RLECMDSNE

SEQ ID NO: 421246 - protein, 9 aa, Homo Sapiens
SWTWGRAPR

SEQ ID NO: 421247 - protein, 9 aa, Homo Sapiens
ISISQLLGS

SEQ ID NO: 421248 - protein, 9 aa, Homo Sapiens
EEQSAGVIQ

SEQ ID NO: 421249 - protein, 9 aa, Homo Sapiens
RRLGTSARV

SEQ ID NO: 421250 - protein, 9 aa, Homo Sapiens
PHKNTQENF

SEQ ID NO: 421251 - protein, 9 aa, Homo Sapiens
RACDINTEQ

SEQ ID NO: 421252 - protein, 9 aa, Homo Sapiens
HFMRLAAEL

SEQ ID NO: 421253 - protein, 9 aa, Homo Sapiens
RLPGAWSGP

SEQ ID NO: 421254 - protein, 9 aa, Homo Sapiens
KAFTYTVAV

SEQ ID NO: 421255 - protein, 9 aa, Homo Sapiens
LQKLQKDRH

SEQ ID NO: 421256 - protein, 9 aa, Homo Sapiens
STAGGCPLA

SEQ ID NO: 421257 - protein, 9 aa, Homo Sapiens
PPTPPAPRL

SEQ ID NO: 421258 - protein, 9 aa, Homo Sapiens
SAACGGRER

SEQ ID NO: 421259 - protein, 9 aa, Homo Sapiens
GPRRVRGVK

SEQ ID NO: 421260 - protein, 9 aa, Homo Sapiens
NTRLEKTTK

SEQ ID NO: 421261 - protein, 9 aa, Homo Sapiens
CCQPGCYGC

SEQ ID NO: 421262 - protein, 9 aa, Homo Sapiens
RLSQRLHSP

SEQ ID NO: 421263 - protein, 9 aa, Homo Sapiens
KPRVLHQNL

SEQ ID NO: 421264 - protein, 9 aa, Homo Sapiens
ATTSSNVSI

SEQ ID NO: 421265 - protein, 9 aa, Homo Sapiens
ENMSSKVRQ

SEQ ID NO: 421266 - protein, 9 aa, Homo Sapiens
MNPRAMKNR

SEQ ID NO: 421267 - protein, 9 aa, Homo Sapiens
WLPSNIYTG

SEQ ID NO: 421268 - protein, 9 aa, Homo Sapiens
ESCNHVHVS

SEQ ID NO: 421269 - protein, 9 aa, Homo Sapiens
VMGSPFPAS

SEQ ID NO: 421270 - protein, 9 aa, Homo Sapiens
QGMGSLNQL

SEQ ID NO: 421271 - protein, 9 aa, Homo Sapiens
NKHQGGWTY

SEQ ID NO: 421272 - protein, 9 aa, Homo Sapiens
ELIQKIEAY

SEQ ID NO: 421273 - protein, 9 aa, Homo Sapiens
SVHNIPHMS

SEQ ID NO: 421274 - protein, 9 aa, Homo Sapiens
EMGGKLQRR

SEQ ID NO: 421275 - protein, 9 aa, Homo Sapiens
GASKNSDGD

SEQ ID NO: 421276 - protein, 9 aa, Homo Sapiens
LTLIQSNTS

SEQ ID NO: 421277 - protein, 9 aa, Homo Sapiens
HLAIWLFIF

SEQ ID NO: 421278 - protein, 9 aa, Homo Sapiens
APVAIRDGE

SEQ ID NO: 421279 - protein, 9 aa, Homo Sapiens
QVQYILPML

SEQ ID NO: 421280 - protein, 9 aa, Homo Sapiens
DKKEWVKWT

SEQ ID NO: 421281 - protein, 9 aa, Homo Sapiens
TQISHSRGI

SEQ ID NO: 421282 - protein, 9 aa, Homo Sapiens
GWAPPAASV

SEQ ID NO: 421283 - protein, 9 aa, Homo Sapiens
CWTELRDVL

SEQ ID NO: 421284 - protein, 9 aa, Homo Sapiens
GTMEKSEGM

SEQ ID NO: 421285 - protein, 9 aa, Homo Sapiens
SAGPLSSKK

SEQ ID NO: 421286 - protein, 9 aa, Homo Sapiens
KTMTAEVQP

SEQ ID NO: 421287 - protein, 9 aa, Homo Sapiens
MLQTQFSLL

SEQ ID NO: 421288 - protein, 9 aa, Homo Sapiens
TLYQHDAAC

SEQ ID NO: 421289 - protein, 9 aa, Homo Sapiens
GGGGGYNHS

SEQ ID NO: 421290 - protein, 9 aa, Homo Sapiens
FFRMVIQKD

SEQ ID NO: 421291 - protein, 9 aa, Homo Sapiens
TSKAWTPRK

SEQ ID NO: 421292 - protein, 9 aa, Homo Sapiens
VAAAAQPQS

SEQ ID NO: 421293 - protein, 9 aa, Homo Sapiens
PATGVCPAR

SEQ ID NO: 421294 - protein, 9 aa, Homo Sapiens
HFLQASYDV

SEQ ID NO: 421295 - protein, 9 aa, Homo Sapiens
VWEQWQIHL

SEQ ID NO: 421296 - protein, 9 aa, Homo Sapiens
SSWDCRCMP

SEQ ID NO: 421297 - protein, 9 aa, Homo Sapiens
TEKNQWCEE

SEQ ID NO: 421298 - protein, 9 aa, Homo Sapiens
CRPSLGTGF

SEQ ID NO: 421299 - protein, 9 aa, Homo Sapiens
RYELPNVLE

SEQ ID NO: 421300 - protein, 9 aa, Homo Sapiens
YVVFFTSPF

SEQ ID NO: 421301 - protein, 9 aa, Homo Sapiens
TRSQKGKAS

SEQ ID NO: 421302 - protein, 9 aa, Homo Sapiens
TELTVQIVA

SEQ ID NO: 421303 - protein, 9 aa, Homo Sapiens
RGGGRPGPC

SEQ ID NO: 421304 - protein, 9 aa, Homo Sapiens
AVIDTSFPC

SEQ ID NO: 421305 - protein, 9 aa, Homo Sapiens
RENLAGPWS

SEQ ID NO: 421306 - protein, 9 aa, Homo Sapiens
HLHIDVVTG

SEQ ID NO: 421307 - protein, 9 aa, Homo Sapiens
SSTGALPTA

SEQ ID NO: 421308 - protein, 9 aa, Homo Sapiens
TDMSYTRAV

SEQ ID NO: 421309 - protein, 9 aa, Homo Sapiens
VVVRESDAG

SEQ ID NO: 421310 - protein, 9 aa, Homo Sapiens
DPKENWVQM

SEQ ID NO: 421311 - protein, 9 aa, Homo Sapiens
AHDPDTGEN

SEQ ID NO: 421312 - protein, 9 aa, Homo Sapiens
PPQTSLQLL

SEQ ID NO: 421313 - protein, 9 aa, Homo Sapiens
PKLLCRQML

SEQ ID NO: 421314 - protein, 9 aa, Homo Sapiens
PVSILLHSN

SEQ ID NO: 421315 - protein, 9 aa, Homo Sapiens
STPGPASTA

SEQ ID NO: 421316 - protein, 9 aa, Homo Sapiens
TRSPAPITL

SEQ ID NO: 421317 - protein, 9 aa, Homo Sapiens
QSLSQCNLA

SEQ ID NO: 421318 - protein, 9 aa, Homo Sapiens
QKLTSATVL

SEQ ID NO: 421319 - protein, 9 aa, Homo Sapiens
AGGGAASRL

SEQ ID NO: 421320 - protein, 9 aa, Homo Sapiens
ATAAAAATP

SEQ ID NO: 421321 - protein, 9 aa, Homo Sapiens
WYYVVFFTS

SEQ ID NO: 421322 - protein, 9 aa, Homo Sapiens
QMVKEITCD

SEQ ID NO: 421323 - protein, 9 aa, Homo Sapiens
HCIEFRPVD

SEQ ID NO: 421324 - protein, 9 aa, Homo Sapiens
RCPQLSASS

SEQ ID NO: 421325 - protein, 9 aa, Homo Sapiens
SHMDVFVST

SEQ ID NO: 421326 - protein, 9 aa, Homo Sapiens
RTGCCATRE

SEQ ID NO: 421327 - protein, 9 aa, Homo Sapiens
YPERRLRGI

SEQ ID NO: 421328 - protein, 9 aa, Homo Sapiens
GDLLLIGGR

SEQ ID NO: 421329 - protein, 9 aa, Homo Sapiens
QDNKDPMLI

SEQ ID NO: 421330 - protein, 9 aa, Homo Sapiens
PQKSYKMNS

SEQ ID NO: 421331 - protein, 9 aa, Homo Sapiens
DMKGALWKV

SEQ ID NO: 421332 - protein, 9 aa, Homo Sapiens
LQGLQDDGF

SEQ ID NO: 421333 - protein, 9 aa, Homo Sapiens
PHCSHTGSA

SEQ ID NO: 421334 - protein, 9 aa, Homo Sapiens
QLRTVVALG

SEQ ID NO: 421335 - protein, 9 aa, Homo Sapiens
SCSARWCLG

SEQ ID NO: 421336 - protein, 9 aa, Homo Sapiens
GAFGTDTLI

SEQ ID NO: 421337 - protein, 9 aa, Homo Sapiens
STKKEDTLE

SEQ ID NO: 421338 - protein, 9 aa, Homo Sapiens
HRLHHHHRL

SEQ ID NO: 421339 - protein, 9 aa, Homo Sapiens
LLQPQVPPA

SEQ ID NO: 421340 - protein, 9 aa, Homo Sapiens
KNLQECLSK

SEQ ID NO: 421341 - protein, 9 aa, Homo Sapiens
TARICAVGL

SEQ ID NO: 421342 - protein, 9 aa, Homo Sapiens
TAPCEVRML

SEQ ID NO: 421343 - protein, 9 aa, Homo Sapiens
LNDSDDYSP

SEQ ID NO: 421344 - protein, 9 aa, Homo Sapiens
IVVVTAGVC

SEQ ID NO: 421345 - protein, 9 aa, Homo Sapiens
IRRWHRSDR

SEQ ID NO: 421346 - protein, 9 aa, Homo Sapiens
LHVFKMTKR

SEQ ID NO: 421347 - protein, 9 aa, Homo Sapiens
LLAAKKSFT

SEQ ID NO: 421348 - protein, 9 aa, Homo Sapiens
DSCLCSMAV

SEQ ID NO: 421349 - protein, 9 aa, Homo Sapiens
GRLEISLLH

SEQ ID NO: 421350 - protein, 9 aa, Homo Sapiens
GTPPVNATG

SEQ ID NO: 421351 - protein, 9 aa, Homo Sapiens
PSRPTGRTP

SEQ ID NO: 421352 - protein, 9 aa, Homo Sapiens
FLPLVFALK

SEQ ID NO: 421353 - protein, 9 aa, Homo Sapiens
GMSLQHLSG

SEQ ID NO: 421354 - protein, 9 aa, Homo Sapiens
CALHGPVQG

SEQ ID NO: 421355 - protein, 9 aa, Homo Sapiens
VDTIRSSVI

SEQ ID NO: 421356 - protein, 9 aa, Homo Sapiens
HHLSHYLKD

SEQ ID NO: 421357 - protein, 9 aa, Homo Sapiens
MMRVPSTPW

SEQ ID NO: 421358 - protein, 9 aa, Homo Sapiens
RAAAAPLQP

SEQ ID NO: 421359 - protein, 9 aa, Homo Sapiens
SSSFSKWCR

SEQ ID NO: 421360 - protein, 9 aa, Homo Sapiens
IRWLQPNAA

SEQ ID NO: 421361 - protein, 9 aa, Homo Sapiens
SGSDGGKLP

SEQ ID NO: 421362 - protein, 9 aa, Homo Sapiens
ATDQAFCSA

SEQ ID NO: 421363 - protein, 9 aa, Homo Sapiens
QGVDPRVGV

SEQ ID NO: 421364 - protein, 9 aa, Homo Sapiens
SLGGGRGPS

SEQ ID NO: 421365 - protein, 9 aa, Homo Sapiens
HRDDVVLAC

SEQ ID NO: 421366 - protein, 9 aa, Homo Sapiens
AVNVVVPSM

SEQ ID NO: 421367 - protein, 9 aa, Homo Sapiens
VKFWQPELF

SEQ ID NO: 421368 - protein, 9 aa, Homo Sapiens
IFEKYNWPN

SEQ ID NO: 421369 - protein, 9 aa, Homo Sapiens
VQVRGSMHF

SEQ ID NO: 421370 - protein, 9 aa, Homo Sapiens
TLGVTLKSP

SEQ ID NO: 421371 - protein, 9 aa, Homo Sapiens
IMGKNECMQ

SEQ ID NO: 421372 - protein, 9 aa, Homo Sapiens
VPSLYLFRA

SEQ ID NO: 421373 - protein, 9 aa, Homo Sapiens
FVAQPKDYA

SEQ ID NO: 421374 - protein, 9 aa, Homo Sapiens
GTFITNMDV

SEQ ID NO: 421375 - protein, 9 aa, Homo Sapiens
EWEHLEPTQ

SEQ ID NO: 421376 - protein, 9 aa, Homo Sapiens
LVIVCDDFF

SEQ ID NO: 421377 - protein, 9 aa, Homo Sapiens
HKKYIDKII

SEQ ID NO: 421378 - protein, 9 aa, Homo Sapiens
SSVHSLSST

SEQ ID NO: 421379 - protein, 9 aa, Homo Sapiens
GCTQDLPGV

SEQ ID NO: 421380 - protein, 9 aa, Homo Sapiens
KWDFRTYRL

SEQ ID NO: 421381 - protein, 9 aa, Homo Sapiens
RLEDYLREP

SEQ ID NO: 421382 - protein, 9 aa, Homo Sapiens
PSPLPTRRM

SEQ ID NO: 421383 - protein, 9 aa, Homo Sapiens
ATAEKWCFR

SEQ ID NO: 421384 - protein, 9 aa, Homo Sapiens
TPGGSSSGS

SEQ ID NO: 421385 - protein, 9 aa, Homo Sapiens
SHLRCRDDP

SEQ ID NO: 421386 - protein, 9 aa, Homo Sapiens
FFFQVELDV

SEQ ID NO: 421387 - protein, 9 aa, Homo Sapiens
MISRIIQMY

SEQ ID NO: 421388 - protein, 9 aa, Homo Sapiens
SNQLQKLPP

SEQ ID NO: 421389 - protein, 9 aa, Homo Sapiens
PLCLKVVKY

SEQ ID NO: 421390 - protein, 9 aa, Homo Sapiens
MLMGPPPAP

SEQ ID NO: 421391 - protein, 9 aa, Homo Sapiens
PVQGVMYSF

SEQ ID NO: 421392 - protein, 9 aa, Homo Sapiens
LGELFTKNL

SEQ ID NO: 421393 - protein, 9 aa, Homo Sapiens
RMLGLALPW

SEQ ID NO: 421394 - protein, 9 aa, Homo Sapiens
GVHPATFVA

SEQ ID NO: 421395 - protein, 9 aa, Homo Sapiens
SCARAQIKK

SEQ ID NO: 421396 - protein, 9 aa, Homo Sapiens
LGIHMRHLA

SEQ ID NO: 421397 - protein, 9 aa, Homo Sapiens
GPGAGSGTS

SEQ ID NO: 421398 - protein, 9 aa, Homo Sapiens
EASTFSTTP

SEQ ID NO: 421399 - protein, 9 aa, Homo Sapiens
LSHTLYQHD

SEQ ID NO: 421400 - protein, 9 aa, Homo Sapiens
CIIHGPAPA

SEQ ID NO: 421401 - protein, 9 aa, Homo Sapiens
QGDYIRVHK

SEQ ID NO: 421402 - protein, 9 aa, Homo Sapiens
NGQVQPIWA

SEQ ID NO: 421403 - protein, 9 aa, Homo Sapiens
FGTITGNTI

SEQ ID NO: 421404 - protein, 9 aa, Homo Sapiens
LWMFLRILE

SEQ ID NO: 421405 - protein, 9 aa, Homo Sapiens
SRLTARLLA

SEQ ID NO: 421406 - protein, 9 aa, Homo Sapiens
VFLENMGAL

SEQ ID NO: 421407 - protein, 9 aa, Homo Sapiens
WFTGDNGQW

SEQ ID NO: 421408 - protein, 9 aa, Homo Sapiens
DTPQPSLPG

SEQ ID NO: 421409 - protein, 9 aa, Homo Sapiens
KLAPENRCQ

SEQ ID NO: 421410 - protein, 9 aa, Homo Sapiens
QAWRLFCWW

SEQ ID NO: 421411 - protein, 9 aa, Homo Sapiens
EAGEVRVYL

SEQ ID NO: 421412 - protein, 9 aa, Homo Sapiens
VKIWKEKLA

SEQ ID NO: 421413 - protein, 9 aa, Homo Sapiens
ATGAPRGTD

SEQ ID NO: 421414 - protein, 9 aa, Homo Sapiens
PGAGSGTSA

SEQ ID NO: 421415 - protein, 9 aa, Homo Sapiens
EPLGRGLHQ

SEQ ID NO: 421416 - protein, 9 aa, Homo Sapiens
SAPTPGNNE

SEQ ID NO: 421417 - protein, 9 aa, Homo Sapiens
KGFGFMTMT

SEQ ID NO: 421418 - protein, 9 aa, Homo Sapiens
RVTKIETSL

SEQ ID NO: 421419 - protein, 9 aa, Homo Sapiens
QLQDNKDPM

SEQ ID NO: 421420 - protein, 9 aa, Homo Sapiens
LGETESATT

SEQ ID NO: 421421 - protein, 9 aa, Homo Sapiens
PSPTCFSTG

SEQ ID NO: 421422 - protein, 9 aa, Homo Sapiens
EGALVGPLA

SEQ ID NO: 421423 - protein, 9 aa, Homo Sapiens
AEEVVPVSI

SEQ ID NO: 421424 - protein, 9 aa, Homo Sapiens
APSLNGISQ

SEQ ID NO: 421425 - protein, 9 aa, Homo Sapiens
GQYLALIED

SEQ ID NO: 421426 - protein, 9 aa, Homo Sapiens
SGAGGSLVG

SEQ ID NO: 421427 - protein, 9 aa, Homo Sapiens
LPEGEKNQL

SEQ ID NO: 421428 - protein, 9 aa, Homo Sapiens
KPKVDGHVS

SEQ ID NO: 421429 - protein, 9 aa, Homo Sapiens
QQLDLTLCR

SEQ ID NO: 421430 - protein, 9 aa, Homo Sapiens
IHGIWKLYK

SEQ ID NO: 421431 - protein, 9 aa, Homo Sapiens
QPPARLPGA

SEQ ID NO: 421432 - protein, 9 aa, Homo Sapiens
ERQTLGVTL

SEQ ID NO: 421433 - protein, 9 aa, Homo Sapiens
GSLAAATGT

SEQ ID NO: 421434 - protein, 9 aa, Homo Sapiens
VIGSGGVGK

SEQ ID NO: 421435 - protein, 9 aa, Homo Sapiens
YYIVANVEL

SEQ ID NO: 421436 - protein, 9 aa, Homo Sapiens
FVFTSDMAH

SEQ ID NO: 421437 - protein, 9 aa, Homo Sapiens
AQFKHTVLI

SEQ ID NO: 421438 - protein, 9 aa, Homo Sapiens
APHSAGLSP

SEQ ID NO: 421439 - protein, 9 aa, Homo Sapiens
PDCYYVTHL

SEQ ID NO: 421440 - protein, 9 aa, Homo Sapiens
PRPPQPWRP

SEQ ID NO: 421441 - protein, 9 aa, Homo Sapiens
VRALHELIH

SEQ ID NO: 421442 - protein, 9 aa, Homo Sapiens
IMRLQLFIH

SEQ ID NO: 421443 - protein, 9 aa, Homo Sapiens
KSIEHQCRA

SEQ ID NO: 421444 - protein, 9 aa, Homo Sapiens
IPLANLSWC

SEQ ID NO: 421445 - protein, 9 aa, Homo Sapiens
LDELLRGLN

SEQ ID NO: 421446 - protein, 9 aa, Homo Sapiens
GPCSTRPVP

SEQ ID NO: 421447 - protein, 9 aa, Homo Sapiens
EHFNKLVVR

SEQ ID NO: 421448 - protein, 9 aa, Homo Sapiens
QVRGSMHFA

SEQ ID NO: 421449 - protein, 9 aa, Homo Sapiens
AALNKAAAG

SEQ ID NO: 421450 - protein, 9 aa, Homo Sapiens
SPKCIIHGP

SEQ ID NO: 421451 - protein, 9 aa, Homo Sapiens
GALLLSVCP

SEQ ID NO: 421452 - protein, 9 aa, Homo Sapiens
LYAASCLLP

SEQ ID NO: 421453 - protein, 9 aa, Homo Sapiens
PADATFAAT

SEQ ID NO: 421454 - protein, 9 aa, Homo Sapiens
RGRLGSGWR

SEQ ID NO: 421455 - protein, 9 aa, Homo Sapiens
TPDGGPYVS

SEQ ID NO: 421456 - protein, 9 aa, Homo Sapiens
STGHGRWWR

SEQ ID NO: 421457 - protein, 9 aa, Homo Sapiens
YITKIKLPK

SEQ ID NO: 421458 - protein, 9 aa, Homo Sapiens
IKELALCNP

SEQ ID NO: 421459 - protein, 9 aa, Homo Sapiens
CTGMARSED

SEQ ID NO: 421460 - protein, 9 aa, Homo Sapiens
PLTVRHGLA

SEQ ID NO: 421461 - protein, 9 aa, Homo Sapiens
KEWGEKLAL

SEQ ID NO: 421462 - protein, 9 aa, Homo Sapiens
LSASAHHLL

SEQ ID NO: 421463 - protein, 9 aa, Homo Sapiens
VMTQGDFMS

SEQ ID NO: 421464 - protein, 9 aa, Homo Sapiens
RSCSWDSAL

SEQ ID NO: 421465 - protein, 9 aa, Homo Sapiens
GTPDQYQAS

SEQ ID NO: 421466 - protein, 9 aa, Homo Sapiens
YVNYTRTED

SEQ ID NO: 421467 - protein, 9 aa, Homo Sapiens
PYFAVVVVP

SEQ ID NO: 421468 - protein, 9 aa, Homo Sapiens
TNMDVFIAM

SEQ ID NO: 421469 - protein, 9 aa, Homo Sapiens
MASGGSGGC

SEQ ID NO: 421470 - protein, 9 aa, Homo Sapiens
GGPAPETRV

SEQ ID NO: 421471 - protein, 9 aa, Homo Sapiens
RCRASRAPC

SEQ ID NO: 421472 - protein, 9 aa, Homo Sapiens
KPTSWMSWE

SEQ ID NO: 421473 - protein, 9 aa, Homo Sapiens
HAIPLHSSW

SEQ ID NO: 421474 - protein, 9 aa, Homo Sapiens
NNERYCCSI

SEQ ID NO: 421475 - protein, 9 aa, Homo Sapiens
MEIKKSQRH

SEQ ID NO: 421476 - protein, 9 aa, Homo Sapiens
TTPATETKK

SEQ ID NO: 421477 - protein, 9 aa, Homo Sapiens
PGSWGFQEV

SEQ ID NO: 421478 - protein, 9 aa, Homo Sapiens
QKVTSSLGI

SEQ ID NO: 421479 - protein, 9 aa, Homo Sapiens
IYQHVHSAT

SEQ ID NO: 421480 - protein, 9 aa, Homo Sapiens
AFVAQIHGA

SEQ ID NO: 421481 - protein, 9 aa, Homo Sapiens
FWPRSLTLI

SEQ ID NO: 421482 - protein, 9 aa, Homo Sapiens
QRRRPLAAS

SEQ ID NO: 421483 - protein, 9 aa, Homo Sapiens
LHCVALPDE

SEQ ID NO: 421484 - protein, 9 aa, Homo Sapiens
EGRYCHPGC

SEQ ID NO: 421485 - protein, 9 aa, Homo Sapiens
GMPETYQAQ

SEQ ID NO: 421486 - protein, 9 aa, Homo Sapiens
LMREWPVSM

SEQ ID NO: 421487 - protein, 9 aa, Homo Sapiens
QHISLSLSV

SEQ ID NO: 421488 - protein, 9 aa, Homo Sapiens
PGASPPRAP

SEQ ID NO: 421489 - protein, 9 aa, Homo Sapiens
LVNTTQRPF

SEQ ID NO: 421490 - protein, 9 aa, Homo Sapiens
QEGNISSSS

SEQ ID NO: 421491 - protein, 9 aa, Homo Sapiens
AWAGPHPEG

SEQ ID NO: 421492 - protein, 9 aa, Homo Sapiens
AGVCCEPAT

SEQ ID NO: 421493 - protein, 9 aa, Homo Sapiens
WMGAHCHLS

SEQ ID NO: 421494 - protein, 9 aa, Homo Sapiens
AIREFAVTT

SEQ ID NO: 421495 - protein, 9 aa, Homo Sapiens
LEMDLDEDD

SEQ ID NO: 421496 - protein, 9 aa, Homo Sapiens
RNSPCSMCC

SEQ ID NO: 421497 - protein, 9 aa, Homo Sapiens
MSCLSRPGW

SEQ ID NO: 421498 - protein, 9 aa, Homo Sapiens
LLPRALPSL

SEQ ID NO: 421499 - protein, 9 aa, Homo Sapiens
EGVRENYSR

SEQ ID NO: 421500 - protein, 9 aa, Homo Sapiens
GKTSCARAQ

SEQ ID NO: 421501 - protein, 9 aa, Homo Sapiens
TGHHAWAGF

SEQ ID NO: 421502 - protein, 9 aa, Homo Sapiens
PPLHPETEP

SEQ ID NO: 421503 - protein, 9 aa, Homo Sapiens
AGGSLVGVP

SEQ ID NO: 421504 - protein, 9 aa, Homo Sapiens
SWFAFFCIC

SEQ ID NO: 421505 - protein, 9 aa, Homo Sapiens
TMRRNSEYE

SEQ ID NO: 421506 - protein, 9 aa, Homo Sapiens
PGHKSVRVC

SEQ ID NO: 421507 - protein, 9 aa, Homo Sapiens
ALGGLWEPR

SEQ ID NO: 421508 - protein, 9 aa, Homo Sapiens
FCHCPNTSA

SEQ ID NO: 421509 - protein, 9 aa, Homo Sapiens
RNPISPVSI

SEQ ID NO: 421510 - protein, 9 aa, Homo Sapiens
MVIASDWLV

SEQ ID NO: 421511 - protein, 9 aa, Homo Sapiens
VIDTSFPCF

SEQ ID NO: 421512 - protein, 9 aa, Homo Sapiens
FLAEEATDP

SEQ ID NO: 421513 - protein, 9 aa, Homo Sapiens
ANKFAKATV

SEQ ID NO: 421514 - protein, 9 aa, Homo Sapiens
ARWWQLIQW

SEQ ID NO: 421515 - protein, 9 aa, Homo Sapiens
WRNPISPVS

SEQ ID NO: 421516 - protein, 9 aa, Homo Sapiens
LHYPVLMSH

SEQ ID NO: 421517 - protein, 9 aa, Homo Sapiens
NGVSTSSSM

SEQ ID NO: 421518 - protein, 9 aa, Homo Sapiens
HLPQIFFRV

SEQ ID NO: 421519 - protein, 9 aa, Homo Sapiens
SRDSPQSVF

SEQ ID NO: 421520 - protein, 9 aa, Homo Sapiens
RRWSETFWG

SEQ ID NO: 421521 - protein, 9 aa, Homo Sapiens
VRGVKQPNA

SEQ ID NO: 421522 - protein, 9 aa, Homo Sapiens
ASQPPLHLM

SEQ ID NO: 421523 - protein, 9 aa, Homo Sapiens
GGKEVMKLW

SEQ ID NO: 421524 - protein, 9 aa, Homo Sapiens
RRRAATRRP

SEQ ID NO: 421525 - protein, 9 aa, Homo Sapiens
GTGTVTAAA

SEQ ID NO: 421526 - protein, 9 aa, Homo Sapiens
CKWQKNINM

SEQ ID NO: 421527 - protein, 9 aa, Homo Sapiens
DPYKFCYEV

SEQ ID NO: 421528 - protein, 9 aa, Homo Sapiens
QLVVHAGCQ

SEQ ID NO: 421529 - protein, 9 aa, Homo Sapiens
LPMSSTLGT

SEQ ID NO: 421530 - protein, 9 aa, Homo Sapiens
HRVLLRFCR

SEQ ID NO: 421531 - protein, 9 aa, Homo Sapiens
NAEGESVCN

SEQ ID NO: 421532 - protein, 9 aa, Homo Sapiens
VLLECAAVG

SEQ ID NO: 421533 - protein, 9 aa, Homo Sapiens
KEVEPPPKG

SEQ ID NO: 421534 - protein, 9 aa, Homo Sapiens
HACVQKVTS

SEQ ID NO: 421535 - protein, 9 aa, Homo Sapiens
TPSGDRPLH

SEQ ID NO: 421536 - protein, 9 aa, Homo Sapiens
SSQNWGSLP

SEQ ID NO: 421537 - protein, 9 aa, Homo Sapiens
KKMIGMRKK

SEQ ID NO: 421538 - protein, 9 aa, Homo Sapiens
SRQALKDAQ

SEQ ID NO: 421539 - protein, 9 aa, Homo Sapiens
FNCSSNHTP

SEQ ID NO: 421540 - protein, 9 aa, Homo Sapiens
TCVGKVSLR

SEQ ID NO: 421541 - protein, 9 aa, Homo Sapiens
VQAPVLLEC

SEQ ID NO: 421542 - protein, 9 aa, Homo Sapiens
PLPHCSHTG

SEQ ID NO: 421543 - protein, 9 aa, Homo Sapiens
PSSSPTNVS

SEQ ID NO: 421544 - protein, 9 aa, Homo Sapiens
GIHMRHLAI

SEQ ID NO: 421545 - protein, 9 aa, Homo Sapiens
MFIIWNKIN

SEQ ID NO: 421546 - protein, 9 aa, Homo Sapiens
KLQRRKNPQ

SEQ ID NO: 421547 - protein, 9 aa, Homo Sapiens
PERARVPGT

SEQ ID NO: 421548 - protein, 9 aa, Homo Sapiens
APPGGPGDK

SEQ ID NO: 421549 - protein, 9 aa, Homo Sapiens
EEEVLIPPL

SEQ ID NO: 421550 - protein, 9 aa, Homo Sapiens
PSRRPATGV

SEQ ID NO: 421551 - protein, 9 aa, Homo Sapiens
DIPGPAGLP

SEQ ID NO: 421552 - protein, 9 aa, Homo Sapiens
SYPPARQPS

SEQ ID NO: 421553 - protein, 9 aa, Homo Sapiens
PLHQVIVRP

SEQ ID NO: 421554 - protein, 9 aa, Homo Sapiens
ASKKFIILE

SEQ ID NO: 421555 - protein, 9 aa, Homo Sapiens
RAAGTATCP

SEQ ID NO: 421556 - protein, 9 aa, Homo Sapiens
IVCLVWRMH

SEQ ID NO: 421557 - protein, 9 aa, Homo Sapiens
QCCRCMRAA

SEQ ID NO: 421558 - protein, 9 aa, Homo Sapiens
KKQKFRPTL

SEQ ID NO: 421559 - protein, 9 aa, Homo Sapiens
CYCRTGCCA

SEQ ID NO: 421560 - protein, 9 aa, Homo Sapiens
VHDLVVRLH

SEQ ID NO: 421561 - protein, 9 aa, Homo Sapiens
DLTLCRAYE

SEQ ID NO: 421562 - protein, 9 aa, Homo Sapiens
SPTRTHGTL

SEQ ID NO: 421563 - protein, 9 aa, Homo Sapiens
YKGKSVDTI

SEQ ID NO: 421564 - protein, 9 aa, Homo Sapiens
KAFRCYSDL

SEQ ID NO: 421565 - protein, 9 aa, Homo Sapiens
IDPWSFVSV

SEQ ID NO: 421566 - protein, 9 aa, Homo Sapiens
SNAHPDNWF

SEQ ID NO: 421567 - protein, 9 aa, Homo Sapiens
TKPLYMALA

SEQ ID NO: 421568 - protein, 9 aa, Homo Sapiens
AASAVGVTA

SEQ ID NO: 421569 - protein, 9 aa, Homo Sapiens
KKIGKLLYG

SEQ ID NO: 421570 - protein, 9 aa, Homo Sapiens
VYYESCNHV

SEQ ID NO: 421571 - protein, 9 aa, Homo Sapiens
VKAQHTGVG

SEQ ID NO: 421572 - protein, 9 aa, Homo Sapiens
KRKGRGTRP

SEQ ID NO: 421573 - protein, 9 aa, Homo Sapiens
PGAGLAQVP

SEQ ID NO: 421574 - protein, 9 aa, Homo Sapiens
CEEHFPVVE

SEQ ID NO: 421575 - protein, 9 aa, Homo Sapiens
WNSSTQWGS

SEQ ID NO: 421576 - protein, 9 aa, Homo Sapiens
CFKCKESLE

SEQ ID NO: 421577 - protein, 9 aa, Homo Sapiens
HPLGDTPQP

SEQ ID NO: 421578 - protein, 9 aa, Homo Sapiens
AGIFWFWFW

SEQ ID NO: 421579 - protein, 9 aa, Homo Sapiens
CHPLPQLLG

SEQ ID NO: 421580 - protein, 9 aa, Homo Sapiens
PHPSPHPQL

SEQ ID NO: 421581 - protein, 9 aa, Homo Sapiens
STEGEVENG

SEQ ID NO: 421582 - protein, 9 aa, Homo Sapiens
GQGLPDRQI

SEQ ID NO: 421583 - protein, 9 aa, Homo Sapiens
VDGSRWNFV

SEQ ID NO: 421584 - protein, 9 aa, Homo Sapiens
RTAVDNFST

SEQ ID NO: 421585 - protein, 9 aa, Homo Sapiens
LQSLSLQCC

SEQ ID NO: 421586 - protein, 9 aa, Homo Sapiens
ILASSACVS

SEQ ID NO: 421587 - protein, 9 aa, Homo Sapiens
EIAKKGFCH

SEQ ID NO: 421588 - protein, 9 aa, Homo Sapiens
LQAVSDEDG

SEQ ID NO: 421589 - protein, 9 aa, Homo Sapiens
TQNQFLDEL

SEQ ID NO: 421590 - protein, 9 aa, Homo Sapiens
SNDDMTLTS

SEQ ID NO: 421591 - protein, 9 aa, Homo Sapiens
KCKGFGFMT

SEQ ID NO: 421592 - protein, 9 aa, Homo Sapiens
RRVRGVKQP

SEQ ID NO: 421593 - protein, 9 aa, Homo Sapiens
ELFTELNEI

SEQ ID NO: 421594 - protein, 9 aa, Homo Sapiens
AKKGFCHSA

SEQ ID NO: 421595 - protein, 9 aa, Homo Sapiens
KGTLHHHDR

SEQ ID NO: 421596 - protein, 9 aa, Homo Sapiens
LSWAGFSPD

SEQ ID NO: 421597 - protein, 9 aa, Homo Sapiens
ASSLSSSSR

SEQ ID NO: 421598 - protein, 9 aa, Homo Sapiens
VAHIAGFLL

SEQ ID NO: 421599 - protein, 9 aa, Homo Sapiens
TWLRTNWLS

SEQ ID NO: 421600 - protein, 9 aa, Homo Sapiens
PRFLHIQRS

SEQ ID NO: 421601 - protein, 9 aa, Homo Sapiens
GRFECRCLP

SEQ ID NO: 421602 - protein, 9 aa, Homo Sapiens
PLPVGGQGK

SEQ ID NO: 421603 - protein, 9 aa, Homo Sapiens
QRRMRITVK

SEQ ID NO: 421604 - protein, 9 aa, Homo Sapiens
EMCPRDYWY

SEQ ID NO: 421605 - protein, 9 aa, Homo Sapiens
DQLQLNQHC

SEQ ID NO: 421606 - protein, 9 aa, Homo Sapiens
PRVSAVSGE

SEQ ID NO: 421607 - protein, 9 aa, Homo Sapiens
ANMLVVLIL

SEQ ID NO: 421608 - protein, 9 aa, Homo Sapiens
GPSALPSPP

SEQ ID NO: 421609 - protein, 9 aa, Homo Sapiens
SNVSILQQF

SEQ ID NO: 421610 - protein, 9 aa, Homo Sapiens
ATSTISASF

SEQ ID NO: 421611 - protein, 9 aa, Homo Sapiens
HKFGTLGSW

SEQ ID NO: 421612 - protein, 9 aa, Homo Sapiens
YLMIDSKLL

SEQ ID NO: 421613 - protein, 9 aa, Homo Sapiens
GQALLKVCG

SEQ ID NO: 421614 - protein, 9 aa, Homo Sapiens
TWAERREVE

SEQ ID NO: 421615 - protein, 9 aa, Homo Sapiens
AVMPPTTTP

SEQ ID NO: 421616 - protein, 9 aa, Homo Sapiens
ESPWGDYPL

SEQ ID NO: 421617 - protein, 9 aa, Homo Sapiens
KRASKEVVG

SEQ ID NO: 421618 - protein, 9 aa, Homo Sapiens
LEPEGMPPM

SEQ ID NO: 421619 - protein, 9 aa, Homo Sapiens
DPVGQARHT

SEQ ID NO: 421620 - protein, 9 aa, Homo Sapiens
ICNFPPKIV

SEQ ID NO: 421621 - protein, 9 aa, Homo Sapiens
LMGPPPAPP

SEQ ID NO: 421622 - protein, 9 aa, Homo Sapiens
KAQHTGVGS

SEQ ID NO: 421623 - protein, 9 aa, Homo Sapiens
PHDQATSPG

SEQ ID NO: 421624 - protein, 9 aa, Homo Sapiens
EVRVYLHVQ

SEQ ID NO: 421625 - protein, 9 aa, Homo Sapiens
RPSPSWFRS

SEQ ID NO: 421626 - protein, 9 aa, Homo Sapiens
PPAGCGTPG

SEQ ID NO: 421627 - protein, 9 aa, Homo Sapiens
TPSWRRCAR

SEQ ID NO: 421628 - protein, 9 aa, Homo Sapiens
VLTLTFQRA

SEQ ID NO: 421629 - protein, 9 aa, Homo Sapiens
RRPGPSRAH

SEQ ID NO: 421630 - protein, 9 aa, Homo Sapiens
RLLLDCLVF

SEQ ID NO: 421631 - protein, 9 aa, Homo Sapiens
ANGEVLPIP

SEQ ID NO: 421632 - protein, 9 aa, Homo Sapiens
HKLPPEYNL

SEQ ID NO: 421633 - protein, 9 aa, Homo Sapiens
NWLSFNADK

SEQ ID NO: 421634 - protein, 9 aa, Homo Sapiens
DVVLACQVE

SEQ ID NO: 421635 - protein, 9 aa, Homo Sapiens
MFGSFLLLL

SEQ ID NO: 421636 - protein, 9 aa, Homo Sapiens
TPGNNERYC

SEQ ID NO: 421637 - protein, 9 aa, Homo Sapiens
DMVSFLLRQ

SEQ ID NO: 421638 - protein, 9 aa, Homo Sapiens
ALLLAQTFI

SEQ ID NO: 421639 - protein, 9 aa, Homo Sapiens
SPGNSRSWR

SEQ ID NO: 421640 - protein, 9 aa, Homo Sapiens
GKDTMSDLT

SEQ ID NO: 421641 - protein, 9 aa, Homo Sapiens
AAAQPQSSV

SEQ ID NO: 421642 - protein, 9 aa, Homo Sapiens
LRIYMYVKR

SEQ ID NO: 421643 - protein, 9 aa, Homo Sapiens
KVSTIDDTV

SEQ ID NO: 421644 - protein, 9 aa, Homo Sapiens
LRGDNDDGG

SEQ ID NO: 421645 - protein, 9 aa, Homo Sapiens
GGTCQQPAN

SEQ ID NO: 421646 - protein, 9 aa, Homo Sapiens
LEWALCAVS

SEQ ID NO: 421647 - protein, 9 aa, Homo Sapiens
LCRSQSRGT

SEQ ID NO: 421648 - protein, 9 aa, Homo Sapiens
TGAEADRWA

SEQ ID NO: 421649 - protein, 9 aa, Homo Sapiens
QTCLEMNTT

SEQ ID NO: 421650 - protein, 9 aa, Homo Sapiens
CSSSPWKAL

SEQ ID NO: 421651 - protein, 9 aa, Homo Sapiens
FEGTDMWKK

SEQ ID NO: 421652 - protein, 9 aa, Homo Sapiens
VVSRHSQEP

SEQ ID NO: 421653 - protein, 9 aa, Homo Sapiens
LQRKQKMPQ

SEQ ID NO: 421654 - protein, 9 aa, Homo Sapiens
HSPRATAAG

SEQ ID NO: 421655 - protein, 9 aa, Homo Sapiens
PGLLDPAQR

SEQ ID NO: 421656 - protein, 9 aa, Homo Sapiens
WRCCGGHSP

SEQ ID NO: 421657 - protein, 9 aa, Homo Sapiens
KSPSCLMDS

SEQ ID NO: 421658 - protein, 9 aa, Homo Sapiens
LCLIKGAKG

SEQ ID NO: 421659 - protein, 9 aa, Homo Sapiens
DQAFCSALG

SEQ ID NO: 421660 - protein, 9 aa, Homo Sapiens
IHITGMSLL

SEQ ID NO: 421661 - protein, 9 aa, Homo Sapiens
KSPRGLQIQ

SEQ ID NO: 421662 - protein, 9 aa, Homo Sapiens
SFGLSDEHI

SEQ ID NO: 421663 - protein, 9 aa, Homo Sapiens
KVNHFHKIR

SEQ ID NO: 421664 - protein, 9 aa, Homo Sapiens
HAAGHSELP

SEQ ID NO: 421665 - protein, 9 aa, Homo Sapiens
HEPIKIVIM

SEQ ID NO: 421666 - protein, 9 aa, Homo Sapiens
GRSGPQGPP

SEQ ID NO: 421667 - protein, 9 aa, Homo Sapiens
SRPISFMVV

SEQ ID NO: 421668 - protein, 9 aa, Homo Sapiens
QTLVNTTQR

SEQ ID NO: 421669 - protein, 9 aa, Homo Sapiens
WGGKRNTIA

SEQ ID NO: 421670 - protein, 9 aa, Homo Sapiens
QVGFVSTDF

SEQ ID NO: 421671 - protein, 9 aa, Homo Sapiens
FLSSQVIDH

SEQ ID NO: 421672 - protein, 9 aa, Homo Sapiens
TPTPAVAQD

SEQ ID NO: 421673 - protein, 9 aa, Homo Sapiens
VVVYLRIYM

SEQ ID NO: 421674 - protein, 9 aa, Homo Sapiens
ILGTQESDF

SEQ ID NO: 421675 - protein, 9 aa, Homo Sapiens
VRRTAQGLL

SEQ ID NO: 421676 - protein, 9 aa, Homo Sapiens
GRGLHQAVP

SEQ ID NO: 421677 - protein, 9 aa, Homo Sapiens
TRPPRTWVP

SEQ ID NO: 421678 - protein, 9 aa, Homo Sapiens
TAAAAGALT

SEQ ID NO: 421679 - protein, 9 aa, Homo Sapiens
GLSVSVGCV

SEQ ID NO: 421680 - protein, 9 aa, Homo Sapiens
ELQSLSLQC

SEQ ID NO: 421681 - protein, 9 aa, Homo Sapiens
FISSSLGVS

SEQ ID NO: 421682 - protein, 9 aa, Homo Sapiens
QAMAMTVRT

SEQ ID NO: 421683 - protein, 9 aa, Homo Sapiens
ERIQSGLFD

SEQ ID NO: 421684 - protein, 9 aa, Homo Sapiens
CMPPYPGNF

SEQ ID NO: 421685 - protein, 9 aa, Homo Sapiens
LVSLSSSST

SEQ ID NO: 421686 - protein, 9 aa, Homo Sapiens
VRVYLHVQK

SEQ ID NO: 421687 - protein, 9 aa, Homo Sapiens
NLLTEETNS

SEQ ID NO: 421688 - protein, 9 aa, Homo Sapiens
SSDKGDCHI

SEQ ID NO: 421689 - protein, 9 aa, Homo Sapiens
KPATTIGVI

SEQ ID NO: 421690 - protein, 9 aa, Homo Sapiens
KAGDLLKLI

SEQ ID NO: 421691 - protein, 9 aa, Homo Sapiens
EEGQALISD

SEQ ID NO: 421692 - protein, 9 aa, Homo Sapiens
KVDGHVSET

SEQ ID NO: 421693 - protein, 9 aa, Homo Sapiens
GFQEVRKKM

SEQ ID NO: 421694 - protein, 9 aa, Homo Sapiens
QLLAASSHV

SEQ ID NO: 421695 - protein, 9 aa, Homo Sapiens
PPPWQAIWQ

SEQ ID NO: 421696 - protein, 9 aa, Homo Sapiens
QRLNIAVKE

SEQ ID NO: 421697 - protein, 9 aa, Homo Sapiens
LLVCFLFFC

SEQ ID NO: 421698 - protein, 9 aa, Homo Sapiens
TFFVATWAV

SEQ ID NO: 421699 - protein, 9 aa, Homo Sapiens
QILCRMRSR

SEQ ID NO: 421700 - protein, 9 aa, Homo Sapiens
SRAHCPANG

SEQ ID NO: 421701 - protein, 9 aa, Homo Sapiens
LKKLKGKLK

SEQ ID NO: 421702 - protein, 9 aa, Homo Sapiens
TSAASLLGP

SEQ ID NO: 421703 - protein, 9 aa, Homo Sapiens
QDGPPRALQ

SEQ ID NO: 421704 - protein, 9 aa, Homo Sapiens
FSIFSMMCK

SEQ ID NO: 421705 - protein, 9 aa, Homo Sapiens
HSQEPPAIL

SEQ ID NO: 421706 - protein, 9 aa, Homo Sapiens
DRILPSGCH

SEQ ID NO: 421707 - protein, 9 aa, Homo Sapiens
MNNKLAEVK

SEQ ID NO: 421708 - protein, 9 aa, Homo Sapiens
FCMDKDIQI

SEQ ID NO: 421709 - protein, 9 aa, Homo Sapiens
HPKNCSCFK

SEQ ID NO: 421710 - protein, 9 aa, Homo Sapiens
EDFKGIQLE

SEQ ID NO: 421711 - protein, 9 aa, Homo Sapiens
SNKPLRGDP

SEQ ID NO: 421712 - protein, 9 aa, Homo Sapiens
VCTTKFGSK

SEQ ID NO: 421713 - protein, 9 aa, Homo Sapiens
IAKTRGKVD

SEQ ID NO: 421714 - protein, 9 aa, Homo Sapiens
VRYACDTCY

SEQ ID NO: 421715 - protein, 9 aa, Homo Sapiens
HQNNIFTDD

SEQ ID NO: 421716 - protein, 9 aa, Homo Sapiens
GSAFVAQIH

SEQ ID NO: 421717 - protein, 9 aa, Homo Sapiens
KEMDEYITK

SEQ ID NO: 421718 - protein, 9 aa, Homo Sapiens
ILFIIMPIF

SEQ ID NO: 421719 - protein, 9 aa, Homo Sapiens
DDSDREGPV

SEQ ID NO: 421720 - protein, 9 aa, Homo Sapiens
RLCFWLLIW

SEQ ID NO: 421721 - protein, 9 aa, Homo Sapiens
QPGGFAWGE

SEQ ID NO: 421722 - protein, 9 aa, Homo Sapiens
CLHRYNSLS

SEQ ID NO: 421723 - protein, 9 aa, Homo Sapiens
VKAWLENEI

SEQ ID NO: 421724 - protein, 9 aa, Homo Sapiens
VSWGTPNRE

SEQ ID NO: 421725 - protein, 9 aa, Homo Sapiens
PPELLDTPF

SEQ ID NO: 421726 - protein, 9 aa, Homo Sapiens
KTSPFQCEW

SEQ ID NO: 421727 - protein, 9 aa, Homo Sapiens
VDGVAPVFK

SEQ ID NO: 421728 - protein, 9 aa, Homo Sapiens
SDTSSNEEI

SEQ ID NO: 421729 - protein, 9 aa, Homo Sapiens
NLQAQRHPT

SEQ ID NO: 421730 - protein, 9 aa, Homo Sapiens
MLALLHLEP

SEQ ID NO: 421731 - protein, 9 aa, Homo Sapiens
LVSCLFLRS

SEQ ID NO: 421732 - protein, 9 aa, Homo Sapiens
SDVEILGYY

SEQ ID NO: 421733 - protein, 9 aa, Homo Sapiens
KKQAQVEAT

SEQ ID NO: 421734 - protein, 9 aa, Homo Sapiens
EPKQEDLRV

SEQ ID NO: 421735 - protein, 9 aa, Homo Sapiens
AYDLSVDML

SEQ ID NO: 421736 - protein, 9 aa, Homo Sapiens
CQQSNQKCI

SEQ ID NO: 421737 - protein, 9 aa, Homo Sapiens
QRCGRTAGR

SEQ ID NO: 421738 - protein, 9 aa, Homo Sapiens
GAPPPRGQA

SEQ ID NO: 421739 - protein, 9 aa, Homo Sapiens
PGSPVVNVL

SEQ ID NO: 421740 - protein, 9 aa, Homo Sapiens
RWPAAPRAT

SEQ ID NO: 421741 - protein, 9 aa, Homo Sapiens
EDLTRLLHD

SEQ ID NO: 421742 - protein, 9 aa, Homo Sapiens
VRSIRFVAG

SEQ ID NO: 421743 - protein, 9 aa, Homo Sapiens
HLPQPRLAP

SEQ ID NO: 421744 - protein, 9 aa, Homo Sapiens
SGPTARSTG

SEQ ID NO: 421745 - protein, 9 aa, Homo Sapiens
RKMAPTTAP

SEQ ID NO: 421746 - protein, 9 aa, Homo Sapiens
PAGRGAPRH

SEQ ID NO: 421747 - protein, 9 aa, Homo Sapiens
KETTGPNRQ

SEQ ID NO: 421748 - protein, 9 aa, Homo Sapiens
QCTKEPRLW

SEQ ID NO: 421749 - protein, 9 aa, Homo Sapiens
SYPCCCEEP

SEQ ID NO: 421750 - protein, 9 aa, Homo Sapiens
THLLQSNPQ

SEQ ID NO: 421751 - protein, 9 aa, Homo Sapiens
SRLNPKMQR

SEQ ID NO: 421752 - protein, 9 aa, Homo Sapiens
LQTEKEDPV

SEQ ID NO: 421753 - protein, 9 aa, Homo Sapiens
RCYIAMCRE

SEQ ID NO: 421754 - protein, 9 aa, Homo Sapiens
SQMRARCHL

SEQ ID NO: 421755 - protein, 9 aa, Homo Sapiens
GPASGFFQS

SEQ ID NO: 421756 - protein, 9 aa, Homo Sapiens
ALRCLEAQI

SEQ ID NO: 421757 - protein, 9 aa, Homo Sapiens
VQKHLTTPS

SEQ ID NO: 421758 - protein, 9 aa, Homo Sapiens
KSTSPHHPQ

SEQ ID NO: 421759 - protein, 9 aa, Homo Sapiens
VVFTEEEPG

SEQ ID NO: 421760 - protein, 9 aa, Homo Sapiens
RRFCCFGNF

SEQ ID NO: 421761 - protein, 9 aa, Homo Sapiens
VPVPRVSLT

SEQ ID NO: 421762 - protein, 9 aa, Homo Sapiens
HPHRSPPTS

SEQ ID NO: 421763 - protein, 9 aa, Homo Sapiens
KNYNKNYHF

SEQ ID NO: 421764 - protein, 9 aa, Homo Sapiens
PRPTSSSHQ

SEQ ID NO: 421765 - protein, 9 aa, Homo Sapiens
CPEEAGAGL

SEQ ID NO: 421766 - protein, 9 aa, Homo Sapiens
RWKRKDKKR

SEQ ID NO: 421767 - protein, 9 aa, Homo Sapiens
EKRASFYEN

SEQ ID NO: 421768 - protein, 9 aa, Homo Sapiens
KWEYDHMNG

SEQ ID NO: 421769 - protein, 9 aa, Homo Sapiens
ANVTKKKVS

SEQ ID NO: 421770 - protein, 9 aa, Homo Sapiens
HHQILAINH

SEQ ID NO: 421771 - protein, 9 aa, Homo Sapiens
LVQRYLADD

SEQ ID NO: 421772 - protein, 9 aa, Homo Sapiens
CPAGERGSP

SEQ ID NO: 421773 - protein, 9 aa, Homo Sapiens
GKDRKLGPE

SEQ ID NO: 421774 - protein, 9 aa, Homo Sapiens
QELQKVLLL

SEQ ID NO: 421775 - protein, 9 aa, Homo Sapiens
HLLQSNPQL

SEQ ID NO: 421776 - protein, 9 aa, Homo Sapiens
TLLLKAPTL

SEQ ID NO: 421777 - protein, 9 aa, Homo Sapiens
AGYSPLMRQ

SEQ ID NO: 421778 - protein, 9 aa, Homo Sapiens
SAYISDKSI

SEQ ID NO: 421779 - protein, 9 aa, Homo Sapiens
RPPTPPAPR

SEQ ID NO: 421780 - protein, 9 aa, Homo Sapiens
KMPQEGGGT

SEQ ID NO: 421781 - protein, 9 aa, Homo Sapiens
VCVGGKESE

SEQ ID NO: 421782 - protein, 9 aa, Homo Sapiens
GPAYGAAEE

SEQ ID NO: 421783 - protein, 9 aa, Homo Sapiens
FGTFITNMD

SEQ ID NO: 421784 - protein, 9 aa, Homo Sapiens
SSGPQERDG

SEQ ID NO: 421785 - protein, 9 aa, Homo Sapiens
HFLVTSHYV

SEQ ID NO: 421786 - protein, 9 aa, Homo Sapiens
CCKPLCLIL

SEQ ID NO: 421787 - protein, 9 aa, Homo Sapiens
VVCWEFKHP

SEQ ID NO: 421788 - protein, 9 aa, Homo Sapiens
QLMPYFAME

SEQ ID NO: 421789 - protein, 9 aa, Homo Sapiens
DCENLLKHF

SEQ ID NO: 421790 - protein, 9 aa, Homo Sapiens
FTELDAKTM

SEQ ID NO: 421791 - protein, 9 aa, Homo Sapiens
LSSHYPPGG

SEQ ID NO: 421792 - protein, 9 aa, Homo Sapiens
EIRDHLLAD

SEQ ID NO: 421793 - protein, 9 aa, Homo Sapiens
TATPRSLFT

SEQ ID NO: 421794 - protein, 9 aa, Homo Sapiens
RWHMASKMV

SEQ ID NO: 421795 - protein, 9 aa, Homo Sapiens
LHWLSQPLD

SEQ ID NO: 421796 - protein, 9 aa, Homo Sapiens
QEAEVSVAQ

SEQ ID NO: 421797 - protein, 9 aa, Homo Sapiens
ICVKRRRRR

SEQ ID NO: 421798 - protein, 9 aa, Homo Sapiens
PMQVLFSSE

SEQ ID NO: 421799 - protein, 9 aa, Homo Sapiens
REQEEELPQ

SEQ ID NO: 421800 - protein, 9 aa, Homo Sapiens
PTGPAPLRV

SEQ ID NO: 421801 - protein, 9 aa, Homo Sapiens
SPLQPHRRR

SEQ ID NO: 421802 - protein, 9 aa, Homo Sapiens
IAYIRKALA

SEQ ID NO: 421803 - protein, 9 aa, Homo Sapiens
PTCFSTGHG

SEQ ID NO: 421804 - protein, 9 aa, Homo Sapiens
LEKTTKELE

SEQ ID NO: 421805 - protein, 9 aa, Homo Sapiens
PRERDLPQE

SEQ ID NO: 421806 - protein, 9 aa, Homo Sapiens
LGTTSHHMS

SEQ ID NO: 421807 - protein, 9 aa, Homo Sapiens
VSTPGPAST

SEQ ID NO: 421808 - protein, 9 aa, Homo Sapiens
RQVTSESQD

SEQ ID NO: 421809 - protein, 9 aa, Homo Sapiens
TPRGRPAAE

SEQ ID NO: 421810 - protein, 9 aa, Homo Sapiens
GPQQDEMTV

SEQ ID NO: 421811 - protein, 9 aa, Homo Sapiens
SEMLGVGGF

SEQ ID NO: 421812 - protein, 9 aa, Homo Sapiens
NVKRCLSSF

SEQ ID NO: 421813 - protein, 9 aa, Homo Sapiens
PRIGHDEIP

SEQ ID NO: 421814 - protein, 9 aa, Homo Sapiens
AFLDQLTVS

SEQ ID NO: 421815 - protein, 9 aa, Homo Sapiens
AEPTQPKQA

SEQ ID NO: 421816 - protein, 9 aa, Homo Sapiens
TIICTISIL

SEQ ID NO: 421817 - protein, 9 aa, Homo Sapiens
SRKIRRPLR

SEQ ID NO: 421818 - protein, 9 aa, Homo Sapiens
GPDLSLDLR

SEQ ID NO: 421819 - protein, 9 aa, Homo Sapiens
EGPGPDDAR

SEQ ID NO: 421820 - protein, 9 aa, Homo Sapiens
PAAREEPSK

SEQ ID NO: 421821 - protein, 9 aa, Homo Sapiens
PTCLAGHRV

SEQ ID NO: 421822 - protein, 9 aa, Homo Sapiens
ECRRLFVEG

SEQ ID NO: 421823 - protein, 9 aa, Homo Sapiens
LPLSQHPLQ

SEQ ID NO: 421824 - protein, 9 aa, Homo Sapiens
YRRQASQKE

SEQ ID NO: 421825 - protein, 9 aa, Homo Sapiens
NLHTDLDVK

SEQ ID NO: 421826 - protein, 9 aa, Homo Sapiens
LQLAGIMGK

SEQ ID NO: 421827 - protein, 9 aa, Homo Sapiens
PLDNSFYVR

SEQ ID NO: 421828 - protein, 9 aa, Homo Sapiens
HHQSDGNEI

SEQ ID NO: 421829 - protein, 9 aa, Homo Sapiens
AMTVRTARV

SEQ ID NO: 421830 - protein, 9 aa, Homo Sapiens
NLQEISFGD

SEQ ID NO: 421831 - protein, 9 aa, Homo Sapiens
MMSSTPNSM

SEQ ID NO: 421832 - protein, 9 aa, Homo Sapiens
FVAAFRFYF

SEQ ID NO: 421833 - protein, 9 aa, Homo Sapiens
AGPASGFFQ

SEQ ID NO: 421834 - protein, 9 aa, Homo Sapiens
VCGRGWQAE

SEQ ID NO: 421835 - protein, 9 aa, Homo Sapiens
DNKDPMLIL

SEQ ID NO: 421836 - protein, 9 aa, Homo Sapiens
RFCCFGNFI

SEQ ID NO: 421837 - protein, 9 aa, Homo Sapiens
CVRPCVPGY

SEQ ID NO: 421838 - protein, 9 aa, Homo Sapiens
SPASACTMP

SEQ ID NO: 421839 - protein, 9 aa, Homo Sapiens
LDWLGHPLR

SEQ ID NO: 421840 - protein, 9 aa, Homo Sapiens
RTCDLFDEL

SEQ ID NO: 421841 - protein, 9 aa, Homo Sapiens
ISSGRPPSV

SEQ ID NO: 421842 - protein, 9 aa, Homo Sapiens
AAGVPRTNP

SEQ ID NO: 421843 - protein, 9 aa, Homo Sapiens
PPWQAIWQL

SEQ ID NO: 421844 - protein, 9 aa, Homo Sapiens
ISFGDAFFR

SEQ ID NO: 421845 - protein, 9 aa, Homo Sapiens
YIPCTSRPG

SEQ ID NO: 421846 - protein, 9 aa, Homo Sapiens
INHHGRSSR

SEQ ID NO: 421847 - protein, 9 aa, Homo Sapiens
TARGVTARS

SEQ ID NO: 421848 - protein, 9 aa, Homo Sapiens
ASPYTYVAS

SEQ ID NO: 421849 - protein, 9 aa, Homo Sapiens
GYMDDQLFV

SEQ ID NO: 421850 - protein, 9 aa, Homo Sapiens
SSDRCALHG

SEQ ID NO: 421851 - protein, 9 aa, Homo Sapiens
SQSALGTAS

SEQ ID NO: 421852 - protein, 9 aa, Homo Sapiens
QPELFLLQA

SEQ ID NO: 421853 - protein, 9 aa, Homo Sapiens
GTVGPLGLR

SEQ ID NO: 421854 - protein, 9 aa, Homo Sapiens
PPQALFCLT

SEQ ID NO: 421855 - protein, 9 aa, Homo Sapiens
WPAAPRATP

SEQ ID NO: 421856 - protein, 9 aa, Homo Sapiens
SVQHLRNIR

SEQ ID NO: 421857 - protein, 9 aa, Homo Sapiens
GILEELSCG

SEQ ID NO: 421858 - protein, 9 aa, Homo Sapiens
LFNVMKTYS

SEQ ID NO: 421859 - protein, 9 aa, Homo Sapiens
VPLLPSPSC

SEQ ID NO: 421860 - protein, 9 aa, Homo Sapiens
SLDIPYFAV

SEQ ID NO: 421861 - protein, 9 aa, Homo Sapiens
KEEMEEEKS

SEQ ID NO: 421862 - protein, 9 aa, Homo Sapiens
LPHQAPLTV

SEQ ID NO: 421863 - protein, 9 aa, Homo Sapiens
IIVNLTESC

SEQ ID NO: 421864 - protein, 9 aa, Homo Sapiens
NKVRELVTG

SEQ ID NO: 421865 - protein, 9 aa, Homo Sapiens
FVGQISTLV

SEQ ID NO: 421866 - protein, 9 aa, Homo Sapiens
DIPEKKKTR

SEQ ID NO: 421867 - protein, 9 aa, Homo Sapiens
LRLHSRQYV

SEQ ID NO: 421868 - protein, 9 aa, Homo Sapiens
LVVHFFACP

SEQ ID NO: 421869 - protein, 9 aa, Homo Sapiens
GAFIGATFF

SEQ ID NO: 421870 - protein, 9 aa, Homo Sapiens
QIPNDLKKK

SEQ ID NO: 421871 - protein, 9 aa, Homo Sapiens
PTGLAAAAA

SEQ ID NO: 421872 - protein, 9 aa, Homo Sapiens
KEEEERHIA

SEQ ID NO: 421873 - protein, 9 aa, Homo Sapiens
CPRARCARL

SEQ ID NO: 421874 - protein, 9 aa, Homo Sapiens
QPKLLLTLS

SEQ ID NO: 421875 - protein, 9 aa, Homo Sapiens
THLETTQAG

SEQ ID NO: 421876 - protein, 9 aa, Homo Sapiens
EVYHEETPE

SEQ ID NO: 421877 - protein, 9 aa, Homo Sapiens
VQKDDIEVH

SEQ ID NO: 421878 - protein, 9 aa, Homo Sapiens
QLREPQLLE

SEQ ID NO: 421879 - protein, 9 aa, Homo Sapiens
WVWSHPSDH

SEQ ID NO: 421880 - protein, 9 aa, Homo Sapiens
AWELGHRHQ

SEQ ID NO: 421881 - protein, 9 aa, Homo Sapiens
GHTPMHFTD

SEQ ID NO: 421882 - protein, 9 aa, Homo Sapiens
QMTTGKCIG

SEQ ID NO: 421883 - protein, 9 aa, Homo Sapiens
HEPLEDDKA

SEQ ID NO: 421884 - protein, 9 aa, Homo Sapiens
ELRQHRQLF

SEQ ID NO: 421885 - protein, 9 aa, Homo Sapiens
VQGVMYSFP

SEQ ID NO: 421886 - protein, 9 aa, Homo Sapiens
ERGKTPAHR

SEQ ID NO: 421887 - protein, 9 aa, Homo Sapiens
WYFPFDIVF

SEQ ID NO: 421888 - protein, 9 aa, Homo Sapiens
HHTLGDSQH

SEQ ID NO: 421889 - protein, 9 aa, Homo Sapiens
CEKHASQQF

SEQ ID NO: 421890 - protein, 9 aa, Homo Sapiens
RCLEAQIST

SEQ ID NO: 421891 - protein, 9 aa, Homo Sapiens
PGPMWQGMG

SEQ ID NO: 421892 - protein, 9 aa, Homo Sapiens
HSRFEVLLV

SEQ ID NO: 421893 - protein, 9 aa, Homo Sapiens
KKIEMKGRK

SEQ ID NO: 421894 - protein, 9 aa, Homo Sapiens
IISDGSVDA

SEQ ID NO: 421895 - protein, 9 aa, Homo Sapiens
YSPDLDLDG

SEQ ID NO: 421896 - protein, 9 aa, Homo Sapiens
LFGLFPLFY

SEQ ID NO: 421897 - protein, 9 aa, Homo Sapiens
RRGHTRWPA

SEQ ID NO: 421898 - protein, 9 aa, Homo Sapiens
AHCPANGAG

SEQ ID NO: 421899 - protein, 9 aa, Homo Sapiens
CTSRPGQTC

SEQ ID NO: 421900 - protein, 9 aa, Homo Sapiens
GYPSTTLPE

SEQ ID NO: 421901 - protein, 9 aa, Homo Sapiens
GGSSSGSPS

SEQ ID NO: 421902 - protein, 9 aa, Homo Sapiens
LTSDVSSMS

SEQ ID NO: 421903 - protein, 9 aa, Homo Sapiens
IRVYAILTH

SEQ ID NO: 421904 - protein, 9 aa, Homo Sapiens
PFLSSTEGA

SEQ ID NO: 421905 - protein, 9 aa, Homo Sapiens
SWTSPPHPA

SEQ ID NO: 421906 - protein, 9 aa, Homo Sapiens
QCAIRKYTS

SEQ ID NO: 421907 - protein, 9 aa, Homo Sapiens
VVNCFQKAN

SEQ ID NO: 421908 - protein, 9 aa, Homo Sapiens
TSQNHSKCI

SEQ ID NO: 421909 - protein, 9 aa, Homo Sapiens
FSGSDGGKL

SEQ ID NO: 421910 - protein, 9 aa, Homo Sapiens
SVWCPWTET

SEQ ID NO: 421911 - protein, 9 aa, Homo Sapiens
DVLTVIMRL

SEQ ID NO: 421912 - protein, 9 aa, Homo Sapiens
RKRSSQSRS

SEQ ID NO: 421913 - protein, 9 aa, Homo Sapiens
EYFEHGVLH

SEQ ID NO: 421914 - protein, 9 aa, Homo Sapiens
PETYQAQLQ

SEQ ID NO: 421915 - protein, 9 aa, Homo Sapiens
GKEVMKLWN

SEQ ID NO: 421916 - protein, 9 aa, Homo Sapiens
MRLQLFIHC

SEQ ID NO: 421917 - protein, 9 aa, Homo Sapiens
LSVEIRSLE

SEQ ID NO: 421918 - protein, 9 aa, Homo Sapiens
KSQGEAPGD

SEQ ID NO: 421919 - protein, 9 aa, Homo Sapiens
TWRSWPTWP

SEQ ID NO: 421920 - protein, 9 aa, Homo Sapiens
LVQGPGILG

SEQ ID NO: 421921 - protein, 9 aa, Homo Sapiens
LPSAEVELI

SEQ ID NO: 421922 - protein, 9 aa, Homo Sapiens
LPSLLSRMP

SEQ ID NO: 421923 - protein, 9 aa, Homo Sapiens
ASSWPMHPL

SEQ ID NO: 421924 - protein, 9 aa, Homo Sapiens
PLKKLMADL

SEQ ID NO: 421925 - protein, 9 aa, Homo Sapiens
HSYHLSGSK

SEQ ID NO: 421926 - protein, 9 aa, Homo Sapiens
PPRRQALPV

SEQ ID NO: 421927 - protein, 9 aa, Homo Sapiens
IYVHLHFKK

SEQ ID NO: 421928 - protein, 9 aa, Homo Sapiens
EQTALYRGG

SEQ ID NO: 421929 - protein, 9 aa, Homo Sapiens
KIFFQKCIY

SEQ ID NO: 421930 - protein, 9 aa, Homo Sapiens
RVPGTDQWQ

SEQ ID NO: 421931 - protein, 9 aa, Homo Sapiens
NYHKITAPG

SEQ ID NO: 421932 - protein, 9 aa, Homo Sapiens
VNQACLEQV

SEQ ID NO: 421933 - protein, 9 aa, Homo Sapiens
HGPELAVRM

SEQ ID NO: 421934 - protein, 9 aa, Homo Sapiens
IHGANRVHL

SEQ ID NO: 421935 - protein, 9 aa, Homo Sapiens
AAGKYSATI

SEQ ID NO: 421936 - protein, 9 aa, Homo Sapiens
QNSHASLRN

SEQ ID NO: 421937 - protein, 9 aa, Homo Sapiens
PLAFFWLPG

SEQ ID NO: 421938 - protein, 9 aa, Homo Sapiens
AAMEGGLMH

SEQ ID NO: 421939 - protein, 9 aa, Homo Sapiens
GTIHWSCLE

SEQ ID NO: 421940 - protein, 9 aa, Homo Sapiens
LEGMLLPRA

SEQ ID NO: 421941 - protein, 9 aa, Homo Sapiens
LQSLQCHLA

SEQ ID NO: 421942 - protein, 9 aa, Homo Sapiens
SMNPRAMKN

SEQ ID NO: 421943 - protein, 9 aa, Homo Sapiens
RHPQGPCPP

SEQ ID NO: 421944 - protein, 9 aa, Homo Sapiens
LHEEDSNFH

SEQ ID NO: 421945 - protein, 9 aa, Homo Sapiens
ARSQGYLFP

SEQ ID NO: 421946 - protein, 9 aa, Homo Sapiens
TRGLNISCL

SEQ ID NO: 421947 - protein, 9 aa, Homo Sapiens
GQSYRVTLE

SEQ ID NO: 421948 - protein, 9 aa, Homo Sapiens
AEFPHWTTT

SEQ ID NO: 421949 - protein, 9 aa, Homo Sapiens
ATIRLLVGG

SEQ ID NO: 421950 - protein, 9 aa, Homo Sapiens
LPYNIAACP

SEQ ID NO: 421951 - protein, 9 aa, Homo Sapiens
PGNSRSWRP

SEQ ID NO: 421952 - protein, 9 aa, Homo Sapiens
LQQWVQDPP

SEQ ID NO: 421953 - protein, 9 aa, Homo Sapiens
SAVGVTAVE

SEQ ID NO: 421954 - protein, 9 aa, Homo Sapiens
SREPPRVLS

SEQ ID NO: 421955 - protein, 9 aa, Homo Sapiens
AFTYTVAVS

SEQ ID NO: 421956 - protein, 9 aa, Homo Sapiens
QRSAQFKHT

SEQ ID NO: 421957 - protein, 9 aa, Homo Sapiens
KYIDKIIGR

SEQ ID NO: 421958 - protein, 9 aa, Homo Sapiens
PHILDRLQR

SEQ ID NO: 421959 - protein, 9 aa, Homo Sapiens
ITHNMTTPN

SEQ ID NO: 421960 - protein, 9 aa, Homo Sapiens
KELALCNPV

SEQ ID NO: 421961 - protein, 9 aa, Homo Sapiens
PEIVTPLLT

SEQ ID NO: 421962 - protein, 9 aa, Homo Sapiens
AAVAPVHAA

SEQ ID NO: 421963 - protein, 9 aa, Homo Sapiens
TWRMRSSTS

SEQ ID NO: 421964 - protein, 9 aa, Homo Sapiens
VAAFQKERA

SEQ ID NO: 421965 - protein, 9 aa, Homo Sapiens
HFREDEGFI

SEQ ID NO: 421966 - protein, 9 aa, Homo Sapiens
YNYMCNCVI

SEQ ID NO: 421967 - protein, 9 aa, Homo Sapiens
VLTGLRAPC

SEQ ID NO: 421968 - protein, 9 aa, Homo Sapiens
PTPSWRRCA

SEQ ID NO: 421969 - protein, 9 aa, Homo Sapiens
LSPPKHTFE

SEQ ID NO: 421970 - protein, 9 aa, Homo Sapiens
RASKEVVGK

SEQ ID NO: 421971 - protein, 9 aa, Homo Sapiens
KNLHIQCEG

SEQ ID NO: 421972 - protein, 9 aa, Homo Sapiens
GHESFRLFT

SEQ ID NO: 421973 - protein, 9 aa, Homo Sapiens
FCRRSGKWT

SEQ ID NO: 421974 - protein, 9 aa, Homo Sapiens
LCRPPTPPA

SEQ ID NO: 421975 - protein, 9 aa, Homo Sapiens
RRQASQKER

SEQ ID NO: 421976 - protein, 9 aa, Homo Sapiens
CCCTATSCG

SEQ ID NO: 421977 - protein, 9 aa, Homo Sapiens
FFRDPLSWS

SEQ ID NO: 421978 - protein, 9 aa, Homo Sapiens
SGWNPPQGN

SEQ ID NO: 421979 - protein, 9 aa, Homo Sapiens
GLRTCPQGA

SEQ ID NO: 421980 - protein, 9 aa, Homo Sapiens
QVVRDTATL

SEQ ID NO: 421981 - protein, 9 aa, Homo Sapiens
TRTTSEPIT

SEQ ID NO: 421982 - protein, 9 aa, Homo Sapiens
GQPWVTDFR

SEQ ID NO: 421983 - protein, 9 aa, Homo Sapiens
QISHSRGIR

SEQ ID NO: 421984 - protein, 9 aa, Homo Sapiens
WLQFRESPW

SEQ ID NO: 421985 - protein, 9 aa, Homo Sapiens
YNKNYHFFC

SEQ ID NO: 421986 - protein, 9 aa, Homo Sapiens
RLHEGVINH

SEQ ID NO: 421987 - protein, 9 aa, Homo Sapiens
KKKEMMKLM

SEQ ID NO: 421988 - protein, 9 aa, Homo Sapiens
PAEPLLSWA

SEQ ID NO: 421989 - protein, 9 aa, Homo Sapiens
PGTTQSARH

SEQ ID NO: 421990 - protein, 9 aa, Homo Sapiens
INCKKRIPD

SEQ ID NO: 421991 - protein, 9 aa, Homo Sapiens
TSQYTQTTL

SEQ ID NO: 421992 - protein, 9 aa, Homo Sapiens
VRKVNHFHK

SEQ ID NO: 421993 - protein, 9 aa, Homo Sapiens
AAREEPSKE

SEQ ID NO: 421994 - protein, 9 aa, Homo Sapiens
MDLDEDDSE

SEQ ID NO: 421995 - protein, 9 aa, Homo Sapiens
NFCDANNLI

SEQ ID NO: 421996 - protein, 9 aa, Homo Sapiens
MAMTVRTAR

SEQ ID NO: 421997 - protein, 9 aa, Homo Sapiens
RLPQCGAGS

SEQ ID NO: 421998 - protein, 9 aa, Homo Sapiens
VVFWMTSGL

SEQ ID NO: 421999 - protein, 9 aa, Homo Sapiens
VNAFLLKMA

SEQ ID NO: 422000 - protein, 9 aa, Homo Sapiens
TAVLREYKA

SEQ ID NO: 422001 - protein, 9 aa, Homo Sapiens
KIPLEDGVP

SEQ ID NO: 422002 - protein, 9 aa, Homo Sapiens
MLMLLYSSK

SEQ ID NO: 422003 - protein, 9 aa, Homo Sapiens
LSHYLKDVK

SEQ ID NO: 422004 - protein, 9 aa, Homo Sapiens
LTQRLSNRI

SEQ ID NO: 422005 - protein, 9 aa, Homo Sapiens
VTIETGCCT

SEQ ID NO: 422006 - protein, 9 aa, Homo Sapiens
KIWFQNHRC

SEQ ID NO: 422007 - protein, 9 aa, Homo Sapiens
TGHGRWWRP

SEQ ID NO: 422008 - protein, 9 aa, Homo Sapiens
HSPCPLVAP

SEQ ID NO: 422009 - protein, 9 aa, Homo Sapiens
KPYKCKQRG

SEQ ID NO: 422010 - protein, 9 aa, Homo Sapiens
QAPTITMVR

SEQ ID NO: 422011 - protein, 9 aa, Homo Sapiens
FDPRYRFDP

SEQ ID NO: 422012 - protein, 9 aa, Homo Sapiens
PRWRMLYLC

SEQ ID NO: 422013 - protein, 9 aa, Homo Sapiens
RPAQPTVPR

SEQ ID NO: 422014 - protein, 9 aa, Homo Sapiens
FIFFIFGIV

SEQ ID NO: 422015 - protein, 9 aa, Homo Sapiens
RHIAEMGRP

SEQ ID NO: 422016 - protein, 9 aa, Homo Sapiens
EQVKNSPTT

SEQ ID NO: 422017 - protein, 9 aa, Homo Sapiens
CEGLLYPQC

SEQ ID NO: 422018 - protein, 9 aa, Homo Sapiens
ERGGVWTGA

SEQ ID NO: 422019 - protein, 9 aa, Homo Sapiens
ATMGCLLLG

SEQ ID NO: 422020 - protein, 9 aa, Homo Sapiens
SQQSLPFAA

SEQ ID NO: 422021 - protein, 9 aa, Homo Sapiens
TRSAPFSPI

SEQ ID NO: 422022 - protein, 9 aa, Homo Sapiens
LPGPPGPEG

SEQ ID NO: 422023 - protein, 9 aa, Homo Sapiens
FVAGHDAEG

SEQ ID NO: 422024 - protein, 9 aa, Homo Sapiens
EAKKGRCYQ

SEQ ID NO: 422025 - protein, 9 aa, Homo Sapiens
LTEETNSFV

SEQ ID NO: 422026 - protein, 9 aa, Homo Sapiens
NFSTPTGSC

SEQ ID NO: 422027 - protein, 9 aa, Homo Sapiens
VQRLLLVLP

SEQ ID NO: 422028 - protein, 9 aa, Homo Sapiens
KKNLPEGKR

SEQ ID NO: 422029 - protein, 9 aa, Homo Sapiens
WHPLTTSAS

SEQ ID NO: 422030 - protein, 9 aa, Homo Sapiens
DLLAVPQVN

SEQ ID NO: 422031 - protein, 9 aa, Homo Sapiens
HMERAFSSQ

SEQ ID NO: 422032 - protein, 9 aa, Homo Sapiens
VPLIVGQIV

SEQ ID NO: 422033 - protein, 9 aa, Homo Sapiens
INHFQQVES

SEQ ID NO: 422034 - protein, 9 aa, Homo Sapiens
CVPGYQCPA

SEQ ID NO: 422035 - protein, 9 aa, Homo Sapiens
ETVVLQCIA

SEQ ID NO: 422036 - protein, 9 aa, Homo Sapiens
LLLTLSSSV

SEQ ID NO: 422037 - protein, 9 aa, Homo Sapiens
PPLLEAFPL

SEQ ID NO: 422038 - protein, 9 aa, Homo Sapiens
PLPEEQPGG

SEQ ID NO: 422039 - protein, 9 aa, Homo Sapiens
DCARPSPSW

SEQ ID NO: 422040 - protein, 9 aa, Homo Sapiens
LCGKPDVTV

SEQ ID NO: 422041 - protein, 9 aa, Homo Sapiens
CCYFCGMVC

SEQ ID NO: 422042 - protein, 9 aa, Homo Sapiens
LLSLVESFA

SEQ ID NO: 422043 - protein, 9 aa, Homo Sapiens
TLERQTLGV

SEQ ID NO: 422044 - protein, 9 aa, Homo Sapiens
PPSPPSPSS

SEQ ID NO: 422045 - protein, 9 aa, Homo Sapiens
KQRGKAFIY

SEQ ID NO: 422046 - protein, 9 aa, Homo Sapiens
SQGEAPGDP

SEQ ID NO: 422047 - protein, 9 aa, Homo Sapiens
TFSTTPVDS

SEQ ID NO: 422048 - protein, 9 aa, Homo Sapiens
QAQDTSGHR

SEQ ID NO: 422049 - protein, 9 aa, Homo Sapiens
SSAMFSENR

SEQ ID NO: 422050 - protein, 9 aa, Homo Sapiens
CSSPSCLCS

SEQ ID NO: 422051 - protein, 9 aa, Homo Sapiens
SLLWMVATL

SEQ ID NO: 422052 - protein, 9 aa, Homo Sapiens
KQKSTLIDA

SEQ ID NO: 422053 - protein, 9 aa, Homo Sapiens
LCAIHAERV

SEQ ID NO: 422054 - protein, 9 aa, Homo Sapiens
EGEAGVDGQ

SEQ ID NO: 422055 - protein, 9 aa, Homo Sapiens
LYPLYPAEL

SEQ ID NO: 422056 - protein, 9 aa, Homo Sapiens
VDLCGCLLT

SEQ ID NO: 422057 - protein, 9 aa, Homo Sapiens
AVISTVERA

SEQ ID NO: 422058 - protein, 9 aa, Homo Sapiens
PEILPRPPQ

SEQ ID NO: 422059 - protein, 9 aa, Homo Sapiens
EDSNFHQSF

SEQ ID NO: 422060 - protein, 9 aa, Homo Sapiens
LSEYFCDMG

SEQ ID NO: 422061 - protein, 9 aa, Homo Sapiens
WATEQPCAA

SEQ ID NO: 422062 - protein, 9 aa, Homo Sapiens
TMRSTPSMR

SEQ ID NO: 422063 - protein, 9 aa, Homo Sapiens
GERAGALRL

SEQ ID NO: 422064 - protein, 9 aa, Homo Sapiens
HVETKVRTK

SEQ ID NO: 422065 - protein, 9 aa, Homo Sapiens
PHIKDSEDL

SEQ ID NO: 422066 - protein, 9 aa, Homo Sapiens
RPKPEWKHQ

SEQ ID NO: 422067 - protein, 9 aa, Homo Sapiens
TVLVAGSLA

SEQ ID NO: 422068 - protein, 9 aa, Homo Sapiens
DLLPVQEPM

SEQ ID NO: 422069 - protein, 9 aa, Homo Sapiens
RVHTDIQND

SEQ ID NO: 422070 - protein, 9 aa, Homo Sapiens
CSITVSFVG

SEQ ID NO: 422071 - protein, 9 aa, Homo Sapiens
LAYPFFWSR

SEQ ID NO: 422072 - protein, 9 aa, Homo Sapiens
GGQHIDYVL

SEQ ID NO: 422073 - protein, 9 aa, Homo Sapiens
VWTRVGFLA

SEQ ID NO: 422074 - protein, 9 aa, Homo Sapiens
HALMVVLAT

SEQ ID NO: 422075 - protein, 9 aa, Homo Sapiens
KALQMKRWE

SEQ ID NO: 422076 - protein, 9 aa, Homo Sapiens
HSSWVMTCA

SEQ ID NO: 422077 - protein, 9 aa, Homo Sapiens
DLPGLSDDS

SEQ ID NO: 422078 - protein, 9 aa, Homo Sapiens
AKIERTALD

SEQ ID NO: 422079 - protein, 9 aa, Homo Sapiens
QLSSPALLC

SEQ ID NO: 422080 - protein, 9 aa, Homo Sapiens
KGDTMGRVD

SEQ ID NO: 422081 - protein, 9 aa, Homo Sapiens
PDNAFYKNY

SEQ ID NO: 422082 - protein, 9 aa, Homo Sapiens
SQVCEKHAS

SEQ ID NO: 422083 - protein, 9 aa, Homo Sapiens
VWTAATLRC

SEQ ID NO: 422084 - protein, 9 aa, Homo Sapiens
TEISDESGE

SEQ ID NO: 422085 - protein, 9 aa, Homo Sapiens
TTSSNVSIL

SEQ ID NO: 422086 - protein, 9 aa, Homo Sapiens
LFLRSLVWL

SEQ ID NO: 422087 - protein, 9 aa, Homo Sapiens
RMRSSTSPA

SEQ ID NO: 422088 - protein, 9 aa, Homo Sapiens
STSGALCAA

SEQ ID NO: 422089 - protein, 9 aa, Homo Sapiens
FLRTPLNII

SEQ ID NO: 422090 - protein, 9 aa, Homo Sapiens
VQNGAPAPH

SEQ ID NO: 422091 - protein, 9 aa, Homo Sapiens
VLLAFHKGD

SEQ ID NO: 422092 - protein, 9 aa, Homo Sapiens
CEASVTAET

SEQ ID NO: 422093 - protein, 9 aa, Homo Sapiens
AESQSCQRP

SEQ ID NO: 422094 - protein, 9 aa, Homo Sapiens
PRPPPPLKS

SEQ ID NO: 422095 - protein, 9 aa, Homo Sapiens
IVADLKHAI

SEQ ID NO: 422096 - protein, 9 aa, Homo Sapiens
SPSEVVFWM

SEQ ID NO: 422097 - protein, 9 aa, Homo Sapiens
IGVDEKLSL

SEQ ID NO: 422098 - protein, 9 aa, Homo Sapiens
QAQDLAQSY

SEQ ID NO: 422099 - protein, 9 aa, Homo Sapiens
YSSSYCKLP

SEQ ID NO: 422100 - protein, 9 aa, Homo Sapiens
CPALRILLC

SEQ ID NO: 422101 - protein, 9 aa, Homo Sapiens
PGWAALQRL

SEQ ID NO: 422102 - protein, 9 aa, Homo Sapiens
EAVPCYREC

SEQ ID NO: 422103 - protein, 9 aa, Homo Sapiens
EHNLYQCGR

SEQ ID NO: 422104 - protein, 9 aa, Homo Sapiens
ARAGVCCEP

SEQ ID NO: 422105 - protein, 9 aa, Homo Sapiens
PPQQPFIAH

SEQ ID NO: 422106 - protein, 9 aa, Homo Sapiens
LAVALFVEA

SEQ ID NO: 422107 - protein, 9 aa, Homo Sapiens
YNHSSGGYE

SEQ ID NO: 422108 - protein, 9 aa, Homo Sapiens
TLIRTKSVT

SEQ ID NO: 422109 - protein, 9 aa, Homo Sapiens
RRLVCRLRR

SEQ ID NO: 422110 - protein, 9 aa, Homo Sapiens
NHEDYGLSV

SEQ ID NO: 422111 - protein, 9 aa, Homo Sapiens
LSQCNLAAG

SEQ ID NO: 422112 - protein, 9 aa, Homo Sapiens
RPRFLHIQR

SEQ ID NO: 422113 - protein, 9 aa, Homo Sapiens
CRGSWRYKR

SEQ ID NO: 422114 - protein, 9 aa, Homo Sapiens
KLKGKLKNQ

SEQ ID NO: 422115 - protein, 9 aa, Homo Sapiens
LLMHPDVLE

SEQ ID NO: 422116 - protein, 9 aa, Homo Sapiens
NPTSPRRNS

SEQ ID NO: 422117 - protein, 9 aa, Homo Sapiens
KDTLKLLYS

SEQ ID NO: 422118 - protein, 9 aa, Homo Sapiens
LSIRCGLDC

SEQ ID NO: 422119 - protein, 9 aa, Homo Sapiens
HLYYNWLGI

SEQ ID NO: 422120 - protein, 9 aa, Homo Sapiens
RSLPSISRE

SEQ ID NO: 422121 - protein, 9 aa, Homo Sapiens
EQGRLQMWM

SEQ ID NO: 422122 - protein, 9 aa, Homo Sapiens
FQEVRKKMA

SEQ ID NO: 422123 - protein, 9 aa, Homo Sapiens
LIYLHYVPL

SEQ ID NO: 422124 - protein, 9 aa, Homo Sapiens
AHLAKQTPA

SEQ ID NO: 422125 - protein, 9 aa, Homo Sapiens
WRMLYLCTS

SEQ ID NO: 422126 - protein, 9 aa, Homo Sapiens
PPRERDLPQ

SEQ ID NO: 422127 - protein, 9 aa, Homo Sapiens
SKDKKRKDR

SEQ ID NO: 422128 - protein, 9 aa, Homo Sapiens
HPVVMHWTT

SEQ ID NO: 422129 - protein, 9 aa, Homo Sapiens
GLPGPPGPE

SEQ ID NO: 422130 - protein, 9 aa, Homo Sapiens
KELFFLPLV

SEQ ID NO: 422131 - protein, 9 aa, Homo Sapiens
KPSPVPHGN

SEQ ID NO: 422132 - protein, 9 aa, Homo Sapiens
YSLFFLSSS

SEQ ID NO: 422133 - protein, 9 aa, Homo Sapiens
LASGAGAAA

SEQ ID NO: 422134 - protein, 9 aa, Homo Sapiens
PRTRPRTAS

SEQ ID NO: 422135 - protein, 9 aa, Homo Sapiens
EQCWTARIC

SEQ ID NO: 422136 - protein, 9 aa, Homo Sapiens
LDTPFVRLQ

SEQ ID NO: 422137 - protein, 9 aa, Homo Sapiens
KNLIVLEII

SEQ ID NO: 422138 - protein, 9 aa, Homo Sapiens
PTTSSLVAS

SEQ ID NO: 422139 - protein, 9 aa, Homo Sapiens
SPHPQLQPL

SEQ ID NO: 422140 - protein, 9 aa, Homo Sapiens
CNLAAGPPP

SEQ ID NO: 422141 - protein, 9 aa, Homo Sapiens
RLFCWWSWL

SEQ ID NO: 422142 - protein, 9 aa, Homo Sapiens
QPEPPRMLG

SEQ ID NO: 422143 - protein, 9 aa, Homo Sapiens
SFAICGLHY

SEQ ID NO: 422144 - protein, 9 aa, Homo Sapiens
HGSNAVGRR

SEQ ID NO: 422145 - protein, 9 aa, Homo Sapiens
SLIELTAFL

SEQ ID NO: 422146 - protein, 9 aa, Homo Sapiens
CVGKVSLRH

SEQ ID NO: 422147 - protein, 9 aa, Homo Sapiens
KINHHGRSS

SEQ ID NO: 422148 - protein, 9 aa, Homo Sapiens
RAMSKTLQD

SEQ ID NO: 422149 - protein, 9 aa, Homo Sapiens
VQLPEVELP

SEQ ID NO: 422150 - protein, 9 aa, Homo Sapiens
STQDQLSAL

SEQ ID NO: 422151 - protein, 9 aa, Homo Sapiens
LQWPASTTV

SEQ ID NO: 422152 - protein, 9 aa, Homo Sapiens
TPPTLPRCV

SEQ ID NO: 422153 - protein, 9 aa, Homo Sapiens
FKTRVRISP

SEQ ID NO: 422154 - protein, 9 aa, Homo Sapiens
SFAVTIGQV

SEQ ID NO: 422155 - protein, 9 aa, Homo Sapiens
IKIKKKIEM

SEQ ID NO: 422156 - protein, 9 aa, Homo Sapiens
SPSVNGMAA

SEQ ID NO: 422157 - protein, 9 aa, Homo Sapiens
LLLIGDSGG

SEQ ID NO: 422158 - protein, 9 aa, Homo Sapiens
RQLRTVVAL

SEQ ID NO: 422159 - protein, 9 aa, Homo Sapiens
QISTLVLDV

SEQ ID NO: 422160 - protein, 9 aa, Homo Sapiens
GRTALSVRG

SEQ ID NO: 422161 - protein, 9 aa, Homo Sapiens
KTENLEYLV

SEQ ID NO: 422162 - protein, 9 aa, Homo Sapiens
HPLCHAAVL

SEQ ID NO: 422163 - protein, 9 aa, Homo Sapiens
FGDAFFRCS

SEQ ID NO: 422164 - protein, 9 aa, Homo Sapiens
TMIYVGCRA

SEQ ID NO: 422165 - protein, 9 aa, Homo Sapiens
ISLVALAFL

SEQ ID NO: 422166 - protein, 9 aa, Homo Sapiens
SPVPHGNST

SEQ ID NO: 422167 - protein, 9 aa, Homo Sapiens
LQHIQELEW

SEQ ID NO: 422168 - protein, 9 aa, Homo Sapiens
PPPKVLTNT

SEQ ID NO: 422169 - protein, 9 aa, Homo Sapiens
RLQNRKWKC

SEQ ID NO: 422170 - protein, 9 aa, Homo Sapiens
DTEETYIGS

SEQ ID NO: 422171 - protein, 9 aa, Homo Sapiens
KASKVPGGS

SEQ ID NO: 422172 - protein, 9 aa, Homo Sapiens
EQLEHVQEM

SEQ ID NO: 422173 - protein, 9 aa, Homo Sapiens
ESATTEDLA

SEQ ID NO: 422174 - protein, 9 aa, Homo Sapiens
PKTPVSSLC

SEQ ID NO: 422175 - protein, 9 aa, Homo Sapiens
CTCISMTTI

SEQ ID NO: 422176 - protein, 9 aa, Homo Sapiens
RAQYNVLTL

SEQ ID NO: 422177 - protein, 9 aa, Homo Sapiens
AQPNGPAAG

SEQ ID NO: 422178 - protein, 9 aa, Homo Sapiens
PIINLAIVH

SEQ ID NO: 422179 - protein, 9 aa, Homo Sapiens
PKVILSWMH

SEQ ID NO: 422180 - protein, 9 aa, Homo Sapiens
EDVSIPIYF

SEQ ID NO: 422181 - protein, 9 aa, Homo Sapiens
PVRNSPCSM

SEQ ID NO: 422182 - protein, 9 aa, Homo Sapiens
DIKDVLTVI

SEQ ID NO: 422183 - protein, 9 aa, Homo Sapiens
MVCWAPIHI

SEQ ID NO: 422184 - protein, 9 aa, Homo Sapiens
KEGSASERR

SEQ ID NO: 422185 - protein, 9 aa, Homo Sapiens
TKSVTKSVA

SEQ ID NO: 422186 - protein, 9 aa, Homo Sapiens
HEGLPAVWT

SEQ ID NO: 422187 - protein, 9 aa, Homo Sapiens
LSDEVGFIN

SEQ ID NO: 422188 - protein, 9 aa, Homo Sapiens
PDCEASVTA

SEQ ID NO: 422189 - protein, 9 aa, Homo Sapiens
STFSTTPVD

SEQ ID NO: 422190 - protein, 9 aa, Homo Sapiens
LDESTDIGI

SEQ ID NO: 422191 - protein, 9 aa, Homo Sapiens
SLPGGTDTM

SEQ ID NO: 422192 - protein, 9 aa, Homo Sapiens
CFRLKRGQP

SEQ ID NO: 422193 - protein, 9 aa, Homo Sapiens
SYHLSGSKP

SEQ ID NO: 422194 - protein, 9 aa, Homo Sapiens
VELNPRSSL

SEQ ID NO: 422195 - protein, 9 aa, Homo Sapiens
LQKMSDAAD

SEQ ID NO: 422196 - protein, 9 aa, Homo Sapiens
SDIPGPAGL

SEQ ID NO: 422197 - protein, 9 aa, Homo Sapiens
KNSDGDMVV

SEQ ID NO: 422198 - protein, 9 aa, Homo Sapiens
LHLVKPRVL

SEQ ID NO: 422199 - protein, 9 aa, Homo Sapiens
DHYSHLLPN

SEQ ID NO: 422200 - protein, 9 aa, Homo Sapiens
TAAKAAGFG

SEQ ID NO: 422201 - protein, 9 aa, Homo Sapiens
RPPPVPAPS

SEQ ID NO: 422202 - protein, 9 aa, Homo Sapiens
HYLGAAFPL

SEQ ID NO: 422203 - protein, 9 aa, Homo Sapiens
VPQEMKSNT

SEQ ID NO: 422204 - protein, 9 aa, Homo Sapiens
IFMCLRLCP

SEQ ID NO: 422205 - protein, 9 aa, Homo Sapiens
KRVCWEFVT

SEQ ID NO: 422206 - protein, 9 aa, Homo Sapiens
REPKQEDLR

SEQ ID NO: 422207 - protein, 9 aa, Homo Sapiens
FWEKRYQTS

SEQ ID NO: 422208 - protein, 9 aa, Homo Sapiens
MDSQDHKSE

SEQ ID NO: 422209 - protein, 9 aa, Homo Sapiens
VGRCSQMRA

SEQ ID NO: 422210 - protein, 9 aa, Homo Sapiens
PWWHPGRRR

SEQ ID NO: 422211 - protein, 9 aa, Homo Sapiens
SPVPKKRER

SEQ ID NO: 422212 - protein, 9 aa, Homo Sapiens
GHGQGNPGG

SEQ ID NO: 422213 - protein, 9 aa, Homo Sapiens
HDNRQHLAM

SEQ ID NO: 422214 - protein, 9 aa, Homo Sapiens
HKAVAPLVC

SEQ ID NO: 422215 - protein, 9 aa, Homo Sapiens
WEGPVQELR

SEQ ID NO: 422216 - protein, 9 aa, Homo Sapiens
VSFVGQIST

SEQ ID NO: 422217 - protein, 9 aa, Homo Sapiens
HLGYELLTA

SEQ ID NO: 422218 - protein, 9 aa, Homo Sapiens
VLVVVGAFM

SEQ ID NO: 422219 - protein, 9 aa, Homo Sapiens
KFVGGVSTV

SEQ ID NO: 422220 - protein, 9 aa, Homo Sapiens
LRPRPPEPL

SEQ ID NO: 422221 - protein, 9 aa, Homo Sapiens
PAVHSALQE

SEQ ID NO: 422222 - protein, 9 aa, Homo Sapiens
SNWQRIDLL

SEQ ID NO: 422223 - protein, 9 aa, Homo Sapiens
HLAFRSGAL

SEQ ID NO: 422224 - protein, 9 aa, Homo Sapiens
VGFLACVGA

SEQ ID NO: 422225 - protein, 9 aa, Homo Sapiens
APLEGMLLP

SEQ ID NO: 422226 - protein, 9 aa, Homo Sapiens
DPQAVTTPA

SEQ ID NO: 422227 - protein, 9 aa, Homo Sapiens
GPPPAGCGT

SEQ ID NO: 422228 - protein, 9 aa, Homo Sapiens
KRCLSSFLC

SEQ ID NO: 422229 - protein, 9 aa, Homo Sapiens
AGCQPHRCP

SEQ ID NO: 422230 - protein, 9 aa, Homo Sapiens
VLEEMHFAE

SEQ ID NO: 422231 - protein, 9 aa, Homo Sapiens
FTWKRLRLH

SEQ ID NO: 422232 - protein, 9 aa, Homo Sapiens
PILATRDAR

SEQ ID NO: 422233 - protein, 9 aa, Homo Sapiens
MAPVGSVMS

SEQ ID NO: 422234 - protein, 9 aa, Homo Sapiens
DANNLIFIP

SEQ ID NO: 422235 - protein, 9 aa, Homo Sapiens
PPTWTRCRG

SEQ ID NO: 422236 - protein, 9 aa, Homo Sapiens
GLPGNWELK

SEQ ID NO: 422237 - protein, 9 aa, Homo Sapiens
SWGQRHHPG

SEQ ID NO: 422238 - protein, 9 aa, Homo Sapiens
SMRTAMIPF

SEQ ID NO: 422239 - protein, 9 aa, Homo Sapiens
HYEELKRID

SEQ ID NO: 422240 - protein, 9 aa, Homo Sapiens
LRGFLLHQP

SEQ ID NO: 422241 - protein, 9 aa, Homo Sapiens
FNYRKKIGK

SEQ ID NO: 422242 - protein, 9 aa, Homo Sapiens
NLNLNMLSL

SEQ ID NO: 422243 - protein, 9 aa, Homo Sapiens
VGCRATVAS

SEQ ID NO: 422244 - protein, 9 aa, Homo Sapiens
GKPILATRD

SEQ ID NO: 422245 - protein, 9 aa, Homo Sapiens
CRATVASFL

SEQ ID NO: 422246 - protein, 9 aa, Homo Sapiens
GQVQPIWAV

SEQ ID NO: 422247 - protein, 9 aa, Homo Sapiens
LGGHGQGNP

SEQ ID NO: 422248 - protein, 9 aa, Homo Sapiens
LGYYMLRWL

SEQ ID NO: 422249 - protein, 9 aa, Homo Sapiens
ISLFWEKRY

SEQ ID NO: 422250 - protein, 9 aa, Homo Sapiens
RTSRASKKF

SEQ ID NO: 422251 - protein, 9 aa, Homo Sapiens
FRLKRGQPW

SEQ ID NO: 422252 - protein, 9 aa, Homo Sapiens
EELVRQTWQ

SEQ ID NO: 422253 - protein, 9 aa, Homo Sapiens
CPEPRVPRC

SEQ ID NO: 422254 - protein, 9 aa, Homo Sapiens
GFLDMLNNF

SEQ ID NO: 422255 - protein, 9 aa, Homo Sapiens
AVDSSAPED

SEQ ID NO: 422256 - protein, 9 aa, Homo Sapiens
NAGKLSPSL

SEQ ID NO: 422257 - protein, 9 aa, Homo Sapiens
QTVSWAATP

SEQ ID NO: 422258 - protein, 9 aa, Homo Sapiens
ELMASEGLR

SEQ ID NO: 422259 - protein, 9 aa, Homo Sapiens
CPARAGATR

SEQ ID NO: 422260 - protein, 9 aa, Homo Sapiens
PRPKGAKGD

SEQ ID NO: 422261 - protein, 9 aa, Homo Sapiens
WSDPDDHGG

SEQ ID NO: 422262 - protein, 9 aa, Homo Sapiens
TSGSTTTTC

SEQ ID NO: 422263 - protein, 9 aa, Homo Sapiens
LLSTLSQPP

SEQ ID NO: 422264 - protein, 9 aa, Homo Sapiens
LPLSSVPSE

SEQ ID NO: 422265 - protein, 9 aa, Homo Sapiens
QGNRKMHGD

SEQ ID NO: 422266 - protein, 9 aa, Homo Sapiens
RCGLDCFKV

SEQ ID NO: 422267 - protein, 9 aa, Homo Sapiens
YHKKQAQVE

SEQ ID NO: 422268 - protein, 9 aa, Homo Sapiens
SHSHAVFNI

SEQ ID NO: 422269 - protein, 9 aa, Homo Sapiens
ITEDTPPPA

SEQ ID NO: 422270 - protein, 9 aa, Homo Sapiens
PQELQKVLL

SEQ ID NO: 422271 - protein, 9 aa, Homo Sapiens
KGYDSMGYE

SEQ ID NO: 422272 - protein, 9 aa, Homo Sapiens
AVPQVNMTD

SEQ ID NO: 422273 - protein, 9 aa, Homo Sapiens
TAADSTAPW

SEQ ID NO: 422274 - protein, 9 aa, Homo Sapiens
AHFSPGCPL

SEQ ID NO: 422275 - protein, 9 aa, Homo Sapiens
YIVCLVWRM

SEQ ID NO: 422276 - protein, 9 aa, Homo Sapiens
LLEYQGEPD

SEQ ID NO: 422277 - protein, 9 aa, Homo Sapiens
SFHEALMHL

SEQ ID NO: 422278 - protein, 9 aa, Homo Sapiens
SSMLKSALG

SEQ ID NO: 422279 - protein, 9 aa, Homo Sapiens
QPAEAERFA

SEQ ID NO: 422280 - protein, 9 aa, Homo Sapiens
GDQGWAPPA

SEQ ID NO: 422281 - protein, 9 aa, Homo Sapiens
CKPKIVRSN

SEQ ID NO: 422282 - protein, 9 aa, Homo Sapiens
GGWGWRSPK

SEQ ID NO: 422283 - protein, 9 aa, Homo Sapiens
IYLHYVPLW

SEQ ID NO: 422284 - protein, 9 aa, Homo Sapiens
HRELPPDQA

SEQ ID NO: 422285 - protein, 9 aa, Homo Sapiens
RSIHSAMEC

SEQ ID NO: 422286 - protein, 9 aa, Homo Sapiens
HLSECRDSF

SEQ ID NO: 422287 - protein, 9 aa, Homo Sapiens
PSHTCEDSL

SEQ ID NO: 422288 - protein, 9 aa, Homo Sapiens
RNAEGESVC

SEQ ID NO: 422289 - protein, 9 aa, Homo Sapiens
SSSAPTPGN

SEQ ID NO: 422290 - protein, 9 aa, Homo Sapiens
SGPGAPNPD

SEQ ID NO: 422291 - protein, 9 aa, Homo Sapiens
GRPRFLHIQ

SEQ ID NO: 422292 - protein, 9 aa, Homo Sapiens
RPTFIPAQM

SEQ ID NO: 422293 - protein, 9 aa, Homo Sapiens
LYAVLPNKV

SEQ ID NO: 422294 - protein, 9 aa, Homo Sapiens
PLDMKLMRC

SEQ ID NO: 422295 - protein, 9 aa, Homo Sapiens
LQDDGFQPT

SEQ ID NO: 422296 - protein, 9 aa, Homo Sapiens
STRTHGAPA

SEQ ID NO: 422297 - protein, 9 aa, Homo Sapiens
STRSRVVGR

SEQ ID NO: 422298 - protein, 9 aa, Homo Sapiens
LLVVRVDTN

SEQ ID NO: 422299 - protein, 9 aa, Homo Sapiens
INYLLKWHW

SEQ ID NO: 422300 - protein, 9 aa, Homo Sapiens
RGKAFIYYQ

SEQ ID NO: 422301 - protein, 9 aa, Homo Sapiens
PQNHLLGPR

SEQ ID NO: 422302 - protein, 9 aa, Homo Sapiens
LCGCLLTAH

SEQ ID NO: 422303 - protein, 9 aa, Homo Sapiens
DATRSGSGS

SEQ ID NO: 422304 - protein, 9 aa, Homo Sapiens
QVMVEPSNE

SEQ ID NO: 422305 - protein, 9 aa, Homo Sapiens
NLEEPVSPA

SEQ ID NO: 422306 - protein, 9 aa, Homo Sapiens
CSKRAAGTA

SEQ ID NO: 422307 - protein, 9 aa, Homo Sapiens
PEDFKGIQL

SEQ ID NO: 422308 - protein, 9 aa, Homo Sapiens
LAWELGHRH

SEQ ID NO: 422309 - protein, 9 aa, Homo Sapiens
LPQPRLAPE

SEQ ID NO: 422310 - protein, 9 aa, Homo Sapiens
FILVQAYTP

SEQ ID NO: 422311 - protein, 9 aa, Homo Sapiens
LTLYLWIWQ

SEQ ID NO: 422312 - protein, 9 aa, Homo Sapiens
VSRDGGWGW

SEQ ID NO: 422313 - protein, 9 aa, Homo Sapiens
ITSGITSSS

SEQ ID NO: 422314 - protein, 9 aa, Homo Sapiens
QASQKEREK

SEQ ID NO: 422315 - protein, 9 aa, Homo Sapiens
LLLGPPPGC

SEQ ID NO: 422316 - protein, 9 aa, Homo Sapiens
PAPVAFLAE

SEQ ID NO: 422317 - protein, 9 aa, Homo Sapiens
KKNGIWEVM

SEQ ID NO: 422318 - protein, 9 aa, Homo Sapiens
SKMISRIIQ

SEQ ID NO: 422319 - protein, 9 aa, Homo Sapiens
MWKKNDQSC

SEQ ID NO: 422320 - protein, 9 aa, Homo Sapiens
EQYQVLEVG

SEQ ID NO: 422321 - protein, 9 aa, Homo Sapiens
NLKMDLVRR

SEQ ID NO: 422322 - protein, 9 aa, Homo Sapiens
TSKQMPPVM

SEQ ID NO: 422323 - protein, 9 aa, Homo Sapiens
DHQLLWGRP

SEQ ID NO: 422324 - protein, 9 aa, Homo Sapiens
RTKEGISIN

SEQ ID NO: 422325 - protein, 9 aa, Homo Sapiens
NFLKKLKGK

SEQ ID NO: 422326 - protein, 9 aa, Homo Sapiens
KKNAVIDTS

SEQ ID NO: 422327 - protein, 9 aa, Homo Sapiens
QVRALVAQQ

SEQ ID NO: 422328 - protein, 9 aa, Homo Sapiens
NMDYCPQFD

SEQ ID NO: 422329 - protein, 9 aa, Homo Sapiens
AYELVVTAW

SEQ ID NO: 422330 - protein, 9 aa, Homo Sapiens
ESMAPALSC

SEQ ID NO: 422331 - protein, 9 aa, Homo Sapiens
SLPSISRES

SEQ ID NO: 422332 - protein, 9 aa, Homo Sapiens
VDTYSSSIL

SEQ ID NO: 422333 - protein, 9 aa, Homo Sapiens
SARVLEEMH

SEQ ID NO: 422334 - protein, 9 aa, Homo Sapiens
KRVCKDYKY

SEQ ID NO: 422335 - protein, 9 aa, Homo Sapiens
KGVAGENTS

SEQ ID NO: 422336 - protein, 9 aa, Homo Sapiens
NRAYLMADM

SEQ ID NO: 422337 - protein, 9 aa, Homo Sapiens
SRVRHVASG

SEQ ID NO: 422338 - protein, 9 aa, Homo Sapiens
GLWSQGKKP

SEQ ID NO: 422339 - protein, 9 aa, Homo Sapiens
TSDMAHVIN

SEQ ID NO: 422340 - protein, 9 aa, Homo Sapiens
LLLILSKNL

SEQ ID NO: 422341 - protein, 9 aa, Homo Sapiens
KMAPTTAPR

SEQ ID NO: 422342 - protein, 9 aa, Homo Sapiens
HLRGGGSPS

SEQ ID NO: 422343 - protein, 9 aa, Homo Sapiens
GRKRWKRKD

SEQ ID NO: 422344 - protein, 9 aa, Homo Sapiens
PSHKPDQPS

SEQ ID NO: 422345 - protein, 9 aa, Homo Sapiens
RGQALLKVC

SEQ ID NO: 422346 - protein, 9 aa, Homo Sapiens
VAAFRFYFC

SEQ ID NO: 422347 - protein, 9 aa, Homo Sapiens
MVTRRRAAV

SEQ ID NO: 422348 - protein, 9 aa, Homo Sapiens
CFQKANCSA

SEQ ID NO: 422349 - protein, 9 aa, Homo Sapiens
SRCPRVLLK

SEQ ID NO: 422350 - protein, 9 aa, Homo Sapiens
DSHYLHIQS

SEQ ID NO: 422351 - protein, 9 aa, Homo Sapiens
KLISTSTKM

SEQ ID NO: 422352 - protein, 9 aa, Homo Sapiens
NAFLLKMAQ

SEQ ID NO: 422353 - protein, 9 aa, Homo Sapiens
AGHYLGAAF

SEQ ID NO: 422354 - protein, 9 aa, Homo Sapiens
PRVRGRGWT

SEQ ID NO: 422355 - protein, 9 aa, Homo Sapiens
KTVNLSVTT

SEQ ID NO: 422356 - protein, 9 aa, Homo Sapiens
VAPSTCRIS

SEQ ID NO: 422357 - protein, 9 aa, Homo Sapiens
LSTVHHCIV

SEQ ID NO: 422358 - protein, 9 aa, Homo Sapiens
RAISHMDVF

SEQ ID NO: 422359 - protein, 9 aa, Homo Sapiens
MGGDFSGMA

SEQ ID NO: 422360 - protein, 9 aa, Homo Sapiens
PDLSLDLRQ

SEQ ID NO: 422361 - protein, 9 aa, Homo Sapiens
VHPFNQVAQ

SEQ ID NO: 422362 - protein, 9 aa, Homo Sapiens
VRPGPCEGL

SEQ ID NO: 422363 - protein, 9 aa, Homo Sapiens
MYLTTMDLF

SEQ ID NO: 422364 - protein, 9 aa, Homo Sapiens
RCCGGHSPC

SEQ ID NO: 422365 - protein, 9 aa, Homo Sapiens
RACYHCRVM

SEQ ID NO: 422366 - protein, 9 aa, Homo Sapiens
DLPLCLKVV

SEQ ID NO: 422367 - protein, 9 aa, Homo Sapiens
SRPTGRTPT

SEQ ID NO: 422368 - protein, 9 aa, Homo Sapiens
HPGLELPVV

SEQ ID NO: 422369 - protein, 9 aa, Homo Sapiens
NSLENQSIL

SEQ ID NO: 422370 - protein, 9 aa, Homo Sapiens
CPPLHPETE

SEQ ID NO: 422371 - protein, 9 aa, Homo Sapiens
FSSVISLLD

SEQ ID NO: 422372 - protein, 9 aa, Homo Sapiens
TMVKQMTDM

SEQ ID NO: 422373 - protein, 9 aa, Homo Sapiens
SSRPISFMV

SEQ ID NO: 422374 - protein, 9 aa, Homo Sapiens
YLALIEDQG

SEQ ID NO: 422375 - protein, 9 aa, Homo Sapiens
QKGIWLNDG

SEQ ID NO: 422376 - protein, 9 aa, Homo Sapiens
ASRLTARLL

SEQ ID NO: 422377 - protein, 9 aa, Homo Sapiens
LVLHPPPIS

SEQ ID NO: 422378 - protein, 9 aa, Homo Sapiens
GHYLGAAFP

SEQ ID NO: 422379 - protein, 9 aa, Homo Sapiens
FPLPRASLR

SEQ ID NO: 422380 - protein, 9 aa, Homo Sapiens
RSPPTSCPP

SEQ ID NO: 422381 - protein, 9 aa, Homo Sapiens
STHGIFEPG

SEQ ID NO: 422382 - protein, 9 aa, Homo Sapiens
DQPTGRLST

SEQ ID NO: 422383 - protein, 9 aa, Homo Sapiens
RRLLPLVRT

SEQ ID NO: 422384 - protein, 9 aa, Homo Sapiens
EVLWLIGAK

SEQ ID NO: 422385 - protein, 9 aa, Homo Sapiens
HPQRCGRTA

SEQ ID NO: 422386 - protein, 9 aa, Homo Sapiens
AQYNVLTLT

SEQ ID NO: 422387 - protein, 9 aa, Homo Sapiens
PATWRCCGG

SEQ ID NO: 422388 - protein, 9 aa, Homo Sapiens
PFRARILCL

SEQ ID NO: 422389 - protein, 9 aa, Homo Sapiens
ISILMSAPN

SEQ ID NO: 422390 - protein, 9 aa, Homo Sapiens
NKLNVEGVD

SEQ ID NO: 422391 - protein, 9 aa, Homo Sapiens
KRRPLDNSF

SEQ ID NO: 422392 - protein, 9 aa, Homo Sapiens
STLSPQLCR

SEQ ID NO: 422393 - protein, 9 aa, Homo Sapiens
GQECFNIIC

SEQ ID NO: 422394 - protein, 9 aa, Homo Sapiens
VYFVASVVV

SEQ ID NO: 422395 - protein, 9 aa, Homo Sapiens
HQELEHAGA

SEQ ID NO: 422396 - protein, 9 aa, Homo Sapiens
RKPKVDGHV

SEQ ID NO: 422397 - protein, 9 aa, Homo Sapiens
NPLSSHYPP

SEQ ID NO: 422398 - protein, 9 aa, Homo Sapiens
LKNGVSTSS

SEQ ID NO: 422399 - protein, 9 aa, Homo Sapiens
AGGCPLAST

SEQ ID NO: 422400 - protein, 9 aa, Homo Sapiens
LGSGWRSAS

SEQ ID NO: 422401 - protein, 9 aa, Homo Sapiens
GLRKMGSYG

SEQ ID NO: 422402 - protein, 9 aa, Homo Sapiens
QSWLRPSDP

SEQ ID NO: 422403 - protein, 9 aa, Homo Sapiens
GRNLADLCR

SEQ ID NO: 422404 - protein, 9 aa, Homo Sapiens
YCLLASRRT

SEQ ID NO: 422405 - protein, 9 aa, Homo Sapiens
GFSTPATSL

SEQ ID NO: 422406 - protein, 9 aa, Homo Sapiens
SRWWLGALK

SEQ ID NO: 422407 - protein, 9 aa, Homo Sapiens
RVVGRCSQM

SEQ ID NO: 422408 - protein, 9 aa, Homo Sapiens
PCISTVSKA

SEQ ID NO: 422409 - protein, 9 aa, Homo Sapiens
PRWRTRRDP

SEQ ID NO: 422410 - protein, 9 aa, Homo Sapiens
GAAPMMSSM

SEQ ID NO: 422411 - protein, 9 aa, Homo Sapiens
ISRPCPRTR

SEQ ID NO: 422412 - protein, 9 aa, Homo Sapiens
LSPCNASIM

SEQ ID NO: 422413 - protein, 9 aa, Homo Sapiens
YATLWLHEH

SEQ ID NO: 422414 - protein, 9 aa, Homo Sapiens
LNSPDKTLQ

SEQ ID NO: 422415 - protein, 9 aa, Homo Sapiens
HATFRAVDS

SEQ ID NO: 422416 - protein, 9 aa, Homo Sapiens
SWAVGILHS

SEQ ID NO: 422417 - protein, 9 aa, Homo Sapiens
PCMAPEVFQ

SEQ ID NO: 422418 - protein, 9 aa, Homo Sapiens
APVPSNLQA

SEQ ID NO: 422419 - protein, 9 aa, Homo Sapiens
YSLLMHPDV

SEQ ID NO: 422420 - protein, 9 aa, Homo Sapiens
LEPTVALLH

SEQ ID NO: 422421 - protein, 9 aa, Homo Sapiens
ALYRGGQRC

SEQ ID NO: 422422 - protein, 9 aa, Homo Sapiens
PSPPSPSSL

SEQ ID NO: 422423 - protein, 9 aa, Homo Sapiens
KKRKKREKI

SEQ ID NO: 422424 - protein, 9 aa, Homo Sapiens
RRGALPSTM

SEQ ID NO: 422425 - protein, 9 aa, Homo Sapiens
CLLLVVRVD

SEQ ID NO: 422426 - protein, 9 aa, Homo Sapiens
IMGRNQTAV

SEQ ID NO: 422427 - protein, 9 aa, Homo Sapiens
THFYLHTSF

SEQ ID NO: 422428 - protein, 9 aa, Homo Sapiens
TIKSILIHD

SEQ ID NO: 422429 - protein, 9 aa, Homo Sapiens
WTRCRGHKP

SEQ ID NO: 422430 - protein, 9 aa, Homo Sapiens
DGRTRSSGW

SEQ ID NO: 422431 - protein, 9 aa, Homo Sapiens
VLTLPISIQ

SEQ ID NO: 422432 - protein, 9 aa, Homo Sapiens
RRCARATWS

SEQ ID NO: 422433 - protein, 9 aa, Homo Sapiens
VPEILYPAL

SEQ ID NO: 422434 - protein, 9 aa, Homo Sapiens
EPAGAPPPR

SEQ ID NO: 422435 - protein, 9 aa, Homo Sapiens
SKRAAGTAT

SEQ ID NO: 422436 - protein, 9 aa, Homo Sapiens
CWIIKENKK

SEQ ID NO: 422437 - protein, 9 aa, Homo Sapiens
VLPGQGGLP

SEQ ID NO: 422438 - protein, 9 aa, Homo Sapiens
GEARQVRLE

SEQ ID NO: 422439 - protein, 9 aa, Homo Sapiens
LATWWTSGA

SEQ ID NO: 422440 - protein, 9 aa, Homo Sapiens
PGERRWLAL

SEQ ID NO: 422441 - protein, 9 aa, Homo Sapiens
PERGVPMSG

SEQ ID NO: 422442 - protein, 9 aa, Homo Sapiens
ATSPPATAT

SEQ ID NO: 422443 - protein, 9 aa, Homo Sapiens
LRKFPLKKL

SEQ ID NO: 422444 - protein, 9 aa, Homo Sapiens
ATVLGLKSL

SEQ ID NO: 422445 - protein, 9 aa, Homo Sapiens
RGQKIAHLG

SEQ ID NO: 422446 - protein, 9 aa, Homo Sapiens
TRGAQQSCR

SEQ ID NO: 422447 - protein, 9 aa, Homo Sapiens
GYTGLHCEA

SEQ ID NO: 422448 - protein, 9 aa, Homo Sapiens
DEHKCSVVD

SEQ ID NO: 422449 - protein, 9 aa, Homo Sapiens
SQGYLFPHS

SEQ ID NO: 422450 - protein, 9 aa, Homo Sapiens
RDNEVNSQL

SEQ ID NO: 422451 - protein, 9 aa, Homo Sapiens
IWQLCALGQ

SEQ ID NO: 422452 - protein, 9 aa, Homo Sapiens
CLKIQGEQR

SEQ ID NO: 422453 - protein, 9 aa, Homo Sapiens
LQCLPLPPR

SEQ ID NO: 422454 - protein, 9 aa, Homo Sapiens
APVLLECAA

SEQ ID NO: 422455 - protein, 9 aa, Homo Sapiens
KNPKVDRLE

SEQ ID NO: 422456 - protein, 9 aa, Homo Sapiens
EPLEPPGPA

SEQ ID NO: 422457 - protein, 9 aa, Homo Sapiens
GHSELPVAG

SEQ ID NO: 422458 - protein, 9 aa, Homo Sapiens
KCITECVRT

SEQ ID NO: 422459 - protein, 9 aa, Homo Sapiens
PSPCPAPPL

SEQ ID NO: 422460 - protein, 9 aa, Homo Sapiens
IPAGSMDCV

SEQ ID NO: 422461 - protein, 9 aa, Homo Sapiens
WMVPEVVTR

SEQ ID NO: 422462 - protein, 9 aa, Homo Sapiens
IPPTGLAAA

SEQ ID NO: 422463 - protein, 9 aa, Homo Sapiens
RAGVLGIQW

SEQ ID NO: 422464 - protein, 9 aa, Homo Sapiens
KKKIEMKGR

SEQ ID NO: 422465 - protein, 9 aa, Homo Sapiens
AMPGRLFVA

SEQ ID NO: 422466 - protein, 9 aa, Homo Sapiens
RSSTSPAAR

SEQ ID NO: 422467 - protein, 9 aa, Homo Sapiens
DRIIDQTNT

SEQ ID NO: 422468 - protein, 9 aa, Homo Sapiens
GAPMVSSRM

SEQ ID NO: 422469 - protein, 9 aa, Homo Sapiens
SNNWNSSTQ

SEQ ID NO: 422470 - protein, 9 aa, Homo Sapiens
ERFDLDDGR

SEQ ID NO: 422471 - protein, 9 aa, Homo Sapiens
HRVIIISMH

SEQ ID NO: 422472 - protein, 9 aa, Homo Sapiens
FLTGQGCLL

SEQ ID NO: 422473 - protein, 9 aa, Homo Sapiens
VIAKTRGKV

SEQ ID NO: 422474 - protein, 9 aa, Homo Sapiens
TIRSSVIPR

SEQ ID NO: 422475 - protein, 9 aa, Homo Sapiens
CTRLAGDKV

SEQ ID NO: 422476 - protein, 9 aa, Homo Sapiens
NFSLSQESS

SEQ ID NO: 422477 - protein, 9 aa, Homo Sapiens
YSGDLATGD

SEQ ID NO: 422478 - protein, 9 aa, Homo Sapiens
GAGPATMPA

SEQ ID NO: 422479 - protein, 9 aa, Homo Sapiens
KGKPKPRSL

SEQ ID NO: 422480 - protein, 9 aa, Homo Sapiens
LMKQQDWLE

SEQ ID NO: 422481 - protein, 9 aa, Homo Sapiens
QRPPWRTSR

SEQ ID NO: 422482 - protein, 9 aa, Homo Sapiens
STGEKDQLE

SEQ ID NO: 422483 - protein, 9 aa, Homo Sapiens
VGDRGPAAP

SEQ ID NO: 422484 - protein, 9 aa, Homo Sapiens
SGWLGTRRQ

SEQ ID NO: 422485 - protein, 9 aa, Homo Sapiens
ASCCYFCGM

SEQ ID NO: 422486 - protein, 9 aa, Homo Sapiens
RSFCLEYHS

SEQ ID NO: 422487 - protein, 9 aa, Homo Sapiens
VDVGPIGAV

SEQ ID NO: 422488 - protein, 9 aa, Homo Sapiens
TSGITSSST

SEQ ID NO: 422489 - protein, 9 aa, Homo Sapiens
AFGWCSSLQ

SEQ ID NO: 422490 - protein, 9 aa, Homo Sapiens
AGGPAYGAA

SEQ ID NO: 422491 - protein, 9 aa, Homo Sapiens
NIFLRPRGR

SEQ ID NO: 422492 - protein, 9 aa, Homo Sapiens
HAAWHDGLD

SEQ ID NO: 422493 - protein, 9 aa, Homo Sapiens
VKGYDSMGY

SEQ ID NO: 422494 - protein, 9 aa, Homo Sapiens
QVESDTGDH

SEQ ID NO: 422495 - protein, 9 aa, Homo Sapiens
RSLVWLPSW

SEQ ID NO: 422496 - protein, 9 aa, Homo Sapiens
PWSFVSVGP

SEQ ID NO: 422497 - protein, 9 aa, Homo Sapiens
PGIPMGASG

SEQ ID NO: 422498 - protein, 9 aa, Homo Sapiens
PEMGGKLQR

SEQ ID NO: 422499 - protein, 9 aa, Homo Sapiens
PQPPPALPS

SEQ ID NO: 422500 - protein, 9 aa, Homo Sapiens
GAPAPSLGG

SEQ ID NO: 422501 - protein, 9 aa, Homo Sapiens
AGWMGAHCH

SEQ ID NO: 422502 - protein, 9 aa, Homo Sapiens
SSYLLWESN

SEQ ID NO: 422503 - protein, 9 aa, Homo Sapiens
AGDKVNYWW

SEQ ID NO: 422504 - protein, 9 aa, Homo Sapiens
LGHPLRSAS

SEQ ID NO: 422505 - protein, 9 aa, Homo Sapiens
DFKGPWPLE

SEQ ID NO: 422506 - protein, 9 aa, Homo Sapiens
FVTGTCCLP

SEQ ID NO: 422507 - protein, 9 aa, Homo Sapiens
EQPKKWTRS

SEQ ID NO: 422508 - protein, 9 aa, Homo Sapiens
LHTHVSRCQ

SEQ ID NO: 422509 - protein, 9 aa, Homo Sapiens
AVTIETGCC

SEQ ID NO: 422510 - protein, 9 aa, Homo Sapiens
LATDQAFCS

SEQ ID NO: 422511 - protein, 9 aa, Homo Sapiens
PSLWLLTRW

SEQ ID NO: 422512 - protein, 9 aa, Homo Sapiens
KQKFRPTLP

SEQ ID NO: 422513 - protein, 9 aa, Homo Sapiens
YYRRDRSPL

SEQ ID NO: 422514 - protein, 9 aa, Homo Sapiens
SQPRGSSSC

SEQ ID NO: 422515 - protein, 9 aa, Homo Sapiens
SLLGLHGTM

SEQ ID NO: 422516 - protein, 9 aa, Homo Sapiens
EEDIKDVLT

SEQ ID NO: 422517 - protein, 9 aa, Homo Sapiens
RSPVPKKRE

SEQ ID NO: 422518 - protein, 9 aa, Homo Sapiens
NLKALTHLD

SEQ ID NO: 422519 - protein, 9 aa, Homo Sapiens
QHHFLVTSH

SEQ ID NO: 422520 - protein, 9 aa, Homo Sapiens
GVGRGLAPW

SEQ ID NO: 422521 - protein, 9 aa, Homo Sapiens
MQADARGPP

SEQ ID NO: 422522 - protein, 9 aa, Homo Sapiens
PQAVTTPAT

SEQ ID NO: 422523 - protein, 9 aa, Homo Sapiens
CHRAVMADG

SEQ ID NO: 422524 - protein, 9 aa, Homo Sapiens
EGWGGCPAH

SEQ ID NO: 422525 - protein, 9 aa, Homo Sapiens
RLARVLMGN

SEQ ID NO: 422526 - protein, 9 aa, Homo Sapiens
IIFMCLRLC

SEQ ID NO: 422527 - protein, 9 aa, Homo Sapiens
PCPRTRWSA

SEQ ID NO: 422528 - protein, 9 aa, Homo Sapiens
GNGFVAAFR

SEQ ID NO: 422529 - protein, 9 aa, Homo Sapiens
FLDQLTVSP

SEQ ID NO: 422530 - protein, 9 aa, Homo Sapiens
PLRGGAGPA

SEQ ID NO: 422531 - protein, 9 aa, Homo Sapiens
LQNRKWKCT

SEQ ID NO: 422532 - protein, 9 aa, Homo Sapiens
CPLVAPART

SEQ ID NO: 422533 - protein, 9 aa, Homo Sapiens
SSSSAPTPG

SEQ ID NO: 422534 - protein, 9 aa, Homo Sapiens
DLLKLIMMM

SEQ ID NO: 422535 - protein, 9 aa, Homo Sapiens
APMSVPLLP

SEQ ID NO: 422536 - protein, 9 aa, Homo Sapiens
QLKPNEEHF

SEQ ID NO: 422537 - protein, 9 aa, Homo Sapiens
VGKQSAPRN

SEQ ID NO: 422538 - protein, 9 aa, Homo Sapiens
PFGPILCRL

SEQ ID NO: 422539 - protein, 9 aa, Homo Sapiens
RLTWVKLPI

SEQ ID NO: 422540 - protein, 9 aa, Homo Sapiens
GWGGCPAHP

SEQ ID NO: 422541 - protein, 9 aa, Homo Sapiens
QTPLCKHKK

SEQ ID NO: 422542 - protein, 9 aa, Homo Sapiens
LHEHNRVCD

SEQ ID NO: 422543 - protein, 9 aa, Homo Sapiens
ILCRMRSRG

SEQ ID NO: 422544 - protein, 9 aa, Homo Sapiens
CERSRSFER

SEQ ID NO: 422545 - protein, 9 aa, Homo Sapiens
LQYKCLDES

SEQ ID NO: 422546 - protein, 9 aa, Homo Sapiens
DPGTPDQYQ

SEQ ID NO: 422547 - protein, 9 aa, Homo Sapiens
TASASSLVL

SEQ ID NO: 422548 - protein, 9 aa, Homo Sapiens
LLCDSVDIF

SEQ ID NO: 422549 - protein, 9 aa, Homo Sapiens
CCRCLHFAV

SEQ ID NO: 422550 - protein, 9 aa, Homo Sapiens
GLGAQVRAL

SEQ ID NO: 422551 - protein, 9 aa, Homo Sapiens
NLKYNLEAN

SEQ ID NO: 422552 - protein, 9 aa, Homo Sapiens
APLVCYLKS

SEQ ID NO: 422553 - protein, 9 aa, Homo Sapiens
HNSMCITEI

SEQ ID NO: 422554 - protein, 9 aa, Homo Sapiens
TEETYVKWL

SEQ ID NO: 422555 - protein, 9 aa, Homo Sapiens
TTLPSWARS

SEQ ID NO: 422556 - protein, 9 aa, Homo Sapiens
PELYAVLPN

SEQ ID NO: 422557 - protein, 9 aa, Homo Sapiens
GKKLALCAS

SEQ ID NO: 422558 - protein, 9 aa, Homo Sapiens
QKIAHLGLQ

SEQ ID NO: 422559 - protein, 9 aa, Homo Sapiens
QPRSSDLSG

SEQ ID NO: 422560 - protein, 9 aa, Homo Sapiens
TPPTWTRCR

SEQ ID NO: 422561 - protein, 9 aa, Homo Sapiens
ALLVPPGHE

SEQ ID NO: 422562 - protein, 9 aa, Homo Sapiens
LSSPYYHHP

SEQ ID NO: 422563 - protein, 9 aa, Homo Sapiens
DTSKKNKRP

SEQ ID NO: 422564 - protein, 9 aa, Homo Sapiens
TGLHLHRQI

SEQ ID NO: 422565 - protein, 9 aa, Homo Sapiens
CPPRAPAPR

SEQ ID NO: 422566 - protein, 9 aa, Homo Sapiens
RISSSSHPS

SEQ ID NO: 422567 - protein, 9 aa, Homo Sapiens
HEETPELGA

SEQ ID NO: 422568 - protein, 9 aa, Homo Sapiens
KLLLTCFSK

SEQ ID NO: 422569 - protein, 9 aa, Homo Sapiens
ELDPEDMML

SEQ ID NO: 422570 - protein, 9 aa, Homo Sapiens
PLHPETEPA

SEQ ID NO: 422571 - protein, 9 aa, Homo Sapiens
TSSHSHAVF

SEQ ID NO: 422572 - protein, 9 aa, Homo Sapiens
EAAAASTRT

SEQ ID NO: 422573 - protein, 9 aa, Homo Sapiens
YNWLGIVSV

SEQ ID NO: 422574 - protein, 9 aa, Homo Sapiens
LEKDEGEDR

SEQ ID NO: 422575 - protein, 9 aa, Homo Sapiens
VREGPVSES

SEQ ID NO: 422576 - protein, 9 aa, Homo Sapiens
CLQNRYLVI

SEQ ID NO: 422577 - protein, 9 aa, Homo Sapiens
SCGCSAPWQ

SEQ ID NO: 422578 - protein, 9 aa, Homo Sapiens
TLSSMMTSG

SEQ ID NO: 422579 - protein, 9 aa, Homo Sapiens
WVPGVLTWR

SEQ ID NO: 422580 - protein, 9 aa, Homo Sapiens
AQNPATAGA

SEQ ID NO: 422581 - protein, 9 aa, Homo Sapiens
GGGVARVEV

SEQ ID NO: 422582 - protein, 9 aa, Homo Sapiens
DLSIPSAAT

SEQ ID NO: 422583 - protein, 9 aa, Homo Sapiens
EWSHSNLDT

SEQ ID NO: 422584 - protein, 9 aa, Homo Sapiens
EEDFWRWAS

SEQ ID NO: 422585 - protein, 9 aa, Homo Sapiens
CTMPPLLHP

SEQ ID NO: 422586 - protein, 9 aa, Homo Sapiens
RGLLCPALH

SEQ ID NO: 422587 - protein, 9 aa, Homo Sapiens
EPPRMLGLA

SEQ ID NO: 422588 - protein, 9 aa, Homo Sapiens
SPSILSTCL

SEQ ID NO: 422589 - protein, 9 aa, Homo Sapiens
IQSDIGASK

SEQ ID NO: 422590 - protein, 9 aa, Homo Sapiens
QRGRLEISL

SEQ ID NO: 422591 - protein, 9 aa, Homo Sapiens
PTNPPSGGG

SEQ ID NO: 422592 - protein, 9 aa, Homo Sapiens
KQQWEKTRW

SEQ ID NO: 422593 - protein, 9 aa, Homo Sapiens
MMTDTCGLP

SEQ ID NO: 422594 - protein, 9 aa, Homo Sapiens
KYSATIALL

SEQ ID NO: 422595 - protein, 9 aa, Homo Sapiens
DPEDMMLEE

SEQ ID NO: 422596 - protein, 9 aa, Homo Sapiens
ICWELLWAQ

SEQ ID NO: 422597 - protein, 9 aa, Homo Sapiens
GPMLSSISR

SEQ ID NO: 422598 - protein, 9 aa, Homo Sapiens
RDGAGSPAA

SEQ ID NO: 422599 - protein, 9 aa, Homo Sapiens
CQRPPLERT

SEQ ID NO: 422600 - protein, 9 aa, Homo Sapiens
TPTTRLMAP

SEQ ID NO: 422601 - protein, 9 aa, Homo Sapiens
APAAREEPS

SEQ ID NO: 422602 - protein, 9 aa, Homo Sapiens
FEMVQCLTL

SEQ ID NO: 422603 - protein, 9 aa, Homo Sapiens
QPKDYANTL

SEQ ID NO: 422604 - protein, 9 aa, Homo Sapiens
CPSESSEEF

SEQ ID NO: 422605 - protein, 9 aa, Homo Sapiens
DAYVFNTET

SEQ ID NO: 422606 - protein, 9 aa, Homo Sapiens
WTGADVPQS

SEQ ID NO: 422607 - protein, 9 aa, Homo Sapiens
KKREKIINP

SEQ ID NO: 422608 - protein, 9 aa, Homo Sapiens
PPEPASGLP

SEQ ID NO: 422609 - protein, 9 aa, Homo Sapiens
SQRQDQKPI

SEQ ID NO: 422610 - protein, 9 aa, Homo Sapiens
ELVKQVRDL

SEQ ID NO: 422611 - protein, 9 aa, Homo Sapiens
HTGKKHYKC

SEQ ID NO: 422612 - protein, 9 aa, Homo Sapiens
KEESDSAER

SEQ ID NO: 422613 - protein, 9 aa, Homo Sapiens
SSQVIDHGR

SEQ ID NO: 422614 - protein, 9 aa, Homo Sapiens
PMSVPLLPS

SEQ ID NO: 422615 - protein, 9 aa, Homo Sapiens
SLHEQQCLK

SEQ ID NO: 422616 - protein, 9 aa, Homo Sapiens
WTELRDVLP

SEQ ID NO: 422617 - protein, 9 aa, Homo Sapiens
SNQIFPREV

SEQ ID NO: 422618 - protein, 9 aa, Homo Sapiens
ESQVCEKHA

SEQ ID NO: 422619 - protein, 9 aa, Homo Sapiens
KQKMPQEGG

SEQ ID NO: 422620 - protein, 9 aa, Homo Sapiens
VLATGLHLH

SEQ ID NO: 422621 - protein, 9 aa, Homo Sapiens
QKVVAAMPV

SEQ ID NO: 422622 - protein, 9 aa, Homo Sapiens
HQSFWKEPS

SEQ ID NO: 422623 - protein, 9 aa, Homo Sapiens
GTDYVGISH

SEQ ID NO: 422624 - protein, 9 aa, Homo Sapiens
SHACVQKVT

SEQ ID NO: 422625 - protein, 9 aa, Homo Sapiens
ILQPGHSHF

SEQ ID NO: 422626 - protein, 9 aa, Homo Sapiens
QIRSGMGQR

SEQ ID NO: 422627 - protein, 9 aa, Homo Sapiens
SSDTSSNEE

SEQ ID NO: 422628 - protein, 9 aa, Homo Sapiens
NQWCNVVCW

SEQ ID NO: 422629 - protein, 9 aa, Homo Sapiens
LVRQVDRME

SEQ ID NO: 422630 - protein, 9 aa, Homo Sapiens
LSGTPPVNA

SEQ ID NO: 422631 - protein, 9 aa, Homo Sapiens
AGAAAARAT

SEQ ID NO: 422632 - protein, 9 aa, Homo Sapiens
CLEAQISTG

SEQ ID NO: 422633 - protein, 9 aa, Homo Sapiens
WLLSKHGRC

SEQ ID NO: 422634 - protein, 9 aa, Homo Sapiens
RVPPPSWPD

SEQ ID NO: 422635 - protein, 9 aa, Homo Sapiens
AREGLIVAV

SEQ ID NO: 422636 - protein, 9 aa, Homo Sapiens
SAPPAPPPW

SEQ ID NO: 422637 - protein, 9 aa, Homo Sapiens
SFWSKCVSS

SEQ ID NO: 422638 - protein, 9 aa, Homo Sapiens
AEADRWAGG

SEQ ID NO: 422639 - protein, 9 aa, Homo Sapiens
LDNSFYVRT

SEQ ID NO: 422640 - protein, 9 aa, Homo Sapiens
VFQKKIYIG

SEQ ID NO: 422641 - protein, 9 aa, Homo Sapiens
CPPGYTGLH

SEQ ID NO: 422642 - protein, 9 aa, Homo Sapiens
IILERGQIQ

SEQ ID NO: 422643 - protein, 9 aa, Homo Sapiens
TLYLWIWQE

SEQ ID NO: 422644 - protein, 9 aa, Homo Sapiens
GLQQWVQDP

SEQ ID NO: 422645 - protein, 9 aa, Homo Sapiens
EEEDIKDVL

SEQ ID NO: 422646 - protein, 9 aa, Homo Sapiens
SYKLTDLRG

SEQ ID NO: 422647 - protein, 9 aa, Homo Sapiens
ESCRLYQFH

SEQ ID NO: 422648 - protein, 9 aa, Homo Sapiens
GAQLMAPLS

SEQ ID NO: 422649 - protein, 9 aa, Homo Sapiens
GPARDLVNA

SEQ ID NO: 422650 - protein, 9 aa, Homo Sapiens
KDEHYWTYD

SEQ ID NO: 422651 - protein, 9 aa, Homo Sapiens
AICHPLCHA

SEQ ID NO: 422652 - protein, 9 aa, Homo Sapiens
GGIRKDQRG

SEQ ID NO: 422653 - protein, 9 aa, Homo Sapiens
HIDVVTGCL

SEQ ID NO: 422654 - protein, 9 aa, Homo Sapiens
SVYWQIVDA

SEQ ID NO: 422655 - protein, 9 aa, Homo Sapiens
VEERIQDED

SEQ ID NO: 422656 - protein, 9 aa, Homo Sapiens
VDTHDQELF

SEQ ID NO: 422657 - protein, 9 aa, Homo Sapiens
PAPATQAPC

SEQ ID NO: 422658 - protein, 9 aa, Homo Sapiens
IFLGPDSQF

SEQ ID NO: 422659 - protein, 9 aa, Homo Sapiens
IREQPAEAE

SEQ ID NO: 422660 - protein, 9 aa, Homo Sapiens
KILHKTVNS

SEQ ID NO: 422661 - protein, 9 aa, Homo Sapiens
VPAVLIPTS

SEQ ID NO: 422662 - protein, 9 aa, Homo Sapiens
APLYDTLGP

SEQ ID NO: 422663 - protein, 9 aa, Homo Sapiens
YYRGLTINS

SEQ ID NO: 422664 - protein, 9 aa, Homo Sapiens
RLPYNIAAC

SEQ ID NO: 422665 - protein, 9 aa, Homo Sapiens
APRATPSPW

SEQ ID NO: 422666 - protein, 9 aa, Homo Sapiens
RKDQRGGRM

SEQ ID NO: 422667 - protein, 9 aa, Homo Sapiens
SCTAVVCRS

SEQ ID NO: 422668 - protein, 9 aa, Homo Sapiens
VHFVLNDWE

SEQ ID NO: 422669 - protein, 9 aa, Homo Sapiens
AAGSTDKTD

SEQ ID NO: 422670 - protein, 9 aa, Homo Sapiens
PLKLQLRGK

SEQ ID NO: 422671 - protein, 9 aa, Homo Sapiens
LTDQAPEPP

SEQ ID NO: 422672 - protein, 9 aa, Homo Sapiens
PCQLHGNLG

SEQ ID NO: 422673 - protein, 9 aa, Homo Sapiens
FSFHEALMH

SEQ ID NO: 422674 - protein, 9 aa, Homo Sapiens
VKQGGRPDL

SEQ ID NO: 422675 - protein, 9 aa, Homo Sapiens
QGLHDGGPR

SEQ ID NO: 422676 - protein, 9 aa, Homo Sapiens
IRVFKLIYL

SEQ ID NO: 422677 - protein, 9 aa, Homo Sapiens
RLQRKQKMP

SEQ ID NO: 422678 - protein, 9 aa, Homo Sapiens
DPDAHPSPP

SEQ ID NO: 422679 - protein, 9 aa, Homo Sapiens
LVKGYDSMG

SEQ ID NO: 422680 - protein, 9 aa, Homo Sapiens
RMVHHTGRF

SEQ ID NO: 422681 - protein, 9 aa, Homo Sapiens
IVGTVLLDI

SEQ ID NO: 422682 - protein, 9 aa, Homo Sapiens
PSRSAACGG

SEQ ID NO: 422683 - protein, 9 aa, Homo Sapiens
GGSAAGGGA

SEQ ID NO: 422684 - protein, 9 aa, Homo Sapiens
QQHLLVWPP

SEQ ID NO: 422685 - protein, 9 aa, Homo Sapiens
NSHWPRDVH

SEQ ID NO: 422686 - protein, 9 aa, Homo Sapiens
VYECHVSDY

SEQ ID NO: 422687 - protein, 9 aa, Homo Sapiens
APLTVRHGL

SEQ ID NO: 422688 - protein, 9 aa, Homo Sapiens
SSTSMGFFF

SEQ ID NO: 422689 - protein, 9 aa, Homo Sapiens
QAEPTQPKQ

SEQ ID NO: 422690 - protein, 9 aa, Homo Sapiens
STDKTDPRG

SEQ ID NO: 422691 - protein, 9 aa, Homo Sapiens
KEQVEWENV

SEQ ID NO: 422692 - protein, 9 aa, Homo Sapiens
GVGPGPHAV

SEQ ID NO: 422693 - protein, 9 aa, Homo Sapiens
LVAPARTGC

SEQ ID NO: 422694 - protein, 9 aa, Homo Sapiens
KDFQQRILV

SEQ ID NO: 422695 - protein, 9 aa, Homo Sapiens
PSVIAAGPA

SEQ ID NO: 422696 - protein, 9 aa, Homo Sapiens
TSAHDPDTG

SEQ ID NO: 422697 - protein, 9 aa, Homo Sapiens
QKMPQEGGG

SEQ ID NO: 422698 - protein, 9 aa, Homo Sapiens
GRGGRDHFT

SEQ ID NO: 422699 - protein, 9 aa, Homo Sapiens
GTDTMSAST

SEQ ID NO: 422700 - protein, 9 aa, Homo Sapiens
LWLAVGPQQ

SEQ ID NO: 422701 - protein, 9 aa, Homo Sapiens
AVPEVQLPE

SEQ ID NO: 422702 - protein, 9 aa, Homo Sapiens
AVQGVDPRV

SEQ ID NO: 422703 - protein, 9 aa, Homo Sapiens
GKPVRVIHS

SEQ ID NO: 422704 - protein, 9 aa, Homo Sapiens
YSPLMRQYG

SEQ ID NO: 422705 - protein, 9 aa, Homo Sapiens
VGMLNGGQH

SEQ ID NO: 422706 - protein, 9 aa, Homo Sapiens
EKYFGPSFM

SEQ ID NO: 422707 - protein, 9 aa, Homo Sapiens
HPLVSAGPC

SEQ ID NO: 422708 - protein, 9 aa, Homo Sapiens
RPHPIHIGC

SEQ ID NO: 422709 - protein, 9 aa, Homo Sapiens
ELNPRSSLR

SEQ ID NO: 422710 - protein, 9 aa, Homo Sapiens
RNYEVKLQL

SEQ ID NO: 422711 - protein, 9 aa, Homo Sapiens
SSNVSILQQ

SEQ ID NO: 422712 - protein, 9 aa, Homo Sapiens
EVHLPQPRL

SEQ ID NO: 422713 - protein, 9 aa, Homo Sapiens
HGQQYVKRT

SEQ ID NO: 422714 - protein, 9 aa, Homo Sapiens
QPSLPGPCA

SEQ ID NO: 422715 - protein, 9 aa, Homo Sapiens
GSVMSCSLL

SEQ ID NO: 422716 - protein, 9 aa, Homo Sapiens
LRGILEELS

SEQ ID NO: 422717 - protein, 9 aa, Homo Sapiens
TAGALLFCG

SEQ ID NO: 422718 - protein, 9 aa, Homo Sapiens
SSPTNVSAL

SEQ ID NO: 422719 - protein, 9 aa, Homo Sapiens
WQKNINMKG

SEQ ID NO: 422720 - protein, 9 aa, Homo Sapiens
VKWGRNTSL

SEQ ID NO: 422721 - protein, 9 aa, Homo Sapiens
TTPEPTPTP

SEQ ID NO: 422722 - protein, 9 aa, Homo Sapiens
DRRAKNRVL

SEQ ID NO: 422723 - protein, 9 aa, Homo Sapiens
RARGGTTIG

SEQ ID NO: 422724 - protein, 9 aa, Homo Sapiens
ADSPSILST

SEQ ID NO: 422725 - protein, 9 aa, Homo Sapiens
KPGVVVHDL

SEQ ID NO: 422726 - protein, 9 aa, Homo Sapiens
WKVTVLRVW

SEQ ID NO: 422727 - protein, 9 aa, Homo Sapiens
DVSTAFEEG

SEQ ID NO: 422728 - protein, 9 aa, Homo Sapiens
SKSYELIQK

SEQ ID NO: 422729 - protein, 9 aa, Homo Sapiens
MDMFPKDMP

SEQ ID NO: 422730 - protein, 9 aa, Homo Sapiens
LYRQCCSGQ

SEQ ID NO: 422731 - protein, 9 aa, Homo Sapiens
PEATSPHSP

SEQ ID NO: 422732 - protein, 9 aa, Homo Sapiens
QYLALIEDQ

SEQ ID NO: 422733 - protein, 9 aa, Homo Sapiens
KEIHGSLGQ

SEQ ID NO: 422734 - protein, 9 aa, Homo Sapiens
YALMSQCWE

SEQ ID NO: 422735 - protein, 9 aa, Homo Sapiens
LQPGAAGGG

SEQ ID NO: 422736 - protein, 9 aa, Homo Sapiens
LGLRKMGSY

SEQ ID NO: 422737 - protein, 9 aa, Homo Sapiens
FKFCIPRPI

SEQ ID NO: 422738 - protein, 9 aa, Homo Sapiens
MGHRVSRLN

SEQ ID NO: 422739 - protein, 9 aa, Homo Sapiens
KHQVMVGKM

SEQ ID NO: 422740 - protein, 9 aa, Homo Sapiens
TQENFSLSQ

SEQ ID NO: 422741 - protein, 9 aa, Homo Sapiens
TAAAAATPA

SEQ ID NO: 422742 - protein, 9 aa, Homo Sapiens
LWYDIYCFQ

SEQ ID NO: 422743 - protein, 9 aa, Homo Sapiens
RDLTGVQNP

SEQ ID NO: 422744 - protein, 9 aa, Homo Sapiens
TQTRTRMGR

SEQ ID NO: 422745 - protein, 9 aa, Homo Sapiens
TALLPSATL

SEQ ID NO: 422746 - protein, 9 aa, Homo Sapiens
AFQLIQSTN

SEQ ID NO: 422747 - protein, 9 aa, Homo Sapiens
FRGGNHTHS

SEQ ID NO: 422748 - protein, 9 aa, Homo Sapiens
TLHHHDRNL

SEQ ID NO: 422749 - protein, 9 aa, Homo Sapiens
RPAHHRRWS

SEQ ID NO: 422750 - protein, 9 aa, Homo Sapiens
APWWEFPLG

SEQ ID NO: 422751 - protein, 9 aa, Homo Sapiens
LESPNLPAW

SEQ ID NO: 422752 - protein, 9 aa, Homo Sapiens
SHYGTPEEL

SEQ ID NO: 422753 - protein, 9 aa, Homo Sapiens
LRGQGLPDR

SEQ ID NO: 422754 - protein, 9 aa, Homo Sapiens
SDLSIPSAA

SEQ ID NO: 422755 - protein, 9 aa, Homo Sapiens
PPPEASHLF

SEQ ID NO: 422756 - protein, 9 aa, Homo Sapiens
VTASASSLV

SEQ ID NO: 422757 - protein, 9 aa, Homo Sapiens
FKHTVLITS

SEQ ID NO: 422758 - protein, 9 aa, Homo Sapiens
SDEDGVSAE

SEQ ID NO: 422759 - protein, 9 aa, Homo Sapiens
IRPKSAKGQ

SEQ ID NO: 422760 - protein, 9 aa, Homo Sapiens
TTSNTFIVN

SEQ ID NO: 422761 - protein, 9 aa, Homo Sapiens
TAFSILTQA

SEQ ID NO: 422762 - protein, 9 aa, Homo Sapiens
LHRYNSLSI

SEQ ID NO: 422763 - protein, 9 aa, Homo Sapiens
EVSHLGNIA

SEQ ID NO: 422764 - protein, 9 aa, Homo Sapiens
LESCVALEC

SEQ ID NO: 422765 - protein, 9 aa, Homo Sapiens
KMPTWLSSS

SEQ ID NO: 422766 - protein, 9 aa, Homo Sapiens
QNRYLVISE

SEQ ID NO: 422767 - protein, 9 aa, Homo Sapiens
LLYGKKAET

SEQ ID NO: 422768 - protein, 9 aa, Homo Sapiens
LPALKIWEE

SEQ ID NO: 422769 - protein, 9 aa, Homo Sapiens
KKLGLLCDS

SEQ ID NO: 422770 - protein, 9 aa, Homo Sapiens
EVKESLAQP

SEQ ID NO: 422771 - protein, 9 aa, Homo Sapiens
FQECSPVVV

SEQ ID NO: 422772 - protein, 9 aa, Homo Sapiens
DAFTMDYNY

SEQ ID NO: 422773 - protein, 9 aa, Homo Sapiens
FPHSTHGIF

SEQ ID NO: 422774 - protein, 9 aa, Homo Sapiens
VATLPGRLF

SEQ ID NO: 422775 - protein, 9 aa, Homo Sapiens
KRWKRKDKK

SEQ ID NO: 422776 - protein, 9 aa, Homo Sapiens
KKNKRPAHH

SEQ ID NO: 422777 - protein, 9 aa, Homo Sapiens
RARVPGTDQ

SEQ ID NO: 422778 - protein, 9 aa, Homo Sapiens
VHLHFKKTE

SEQ ID NO: 422779 - protein, 9 aa, Homo Sapiens
AADDIVDIR

SEQ ID NO: 422780 - protein, 9 aa, Homo Sapiens
ACPSESSEE

SEQ ID NO: 422781 - protein, 9 aa, Homo Sapiens
EVRIWNCTK

SEQ ID NO: 422782 - protein, 9 aa, Homo Sapiens
GYELLTAFL

SEQ ID NO: 422783 - protein, 9 aa, Homo Sapiens
FSGMAQDCS

SEQ ID NO: 422784 - protein, 9 aa, Homo Sapiens
LLNRPEIST

SEQ ID NO: 422785 - protein, 9 aa, Homo Sapiens
RAGTCNIYY

SEQ ID NO: 422786 - protein, 9 aa, Homo Sapiens
MPCMSSGSL

SEQ ID NO: 422787 - protein, 9 aa, Homo Sapiens
DNDRLKPPR

SEQ ID NO: 422788 - protein, 9 aa, Homo Sapiens
GSSCAPPSS

SEQ ID NO: 422789 - protein, 9 aa, Homo Sapiens
MAIASLNRY

SEQ ID NO: 422790 - protein, 9 aa, Homo Sapiens
YHSRFEVLL

SEQ ID NO: 422791 - protein, 9 aa, Homo Sapiens
QISESTKSY

SEQ ID NO: 422792 - protein, 9 aa, Homo Sapiens
SSLLSPCNA

SEQ ID NO: 422793 - protein, 9 aa, Homo Sapiens
PARTGCPRV

SEQ ID NO: 422794 - protein, 9 aa, Homo Sapiens
FCRVSALGP

SEQ ID NO: 422795 - protein, 9 aa, Homo Sapiens
VILNNNELL

SEQ ID NO: 422796 - protein, 9 aa, Homo Sapiens
SSSLGVSGV

SEQ ID NO: 422797 - protein, 9 aa, Homo Sapiens
SIEHQCRAV

SEQ ID NO: 422798 - protein, 9 aa, Homo Sapiens
MDKQKSTLI

SEQ ID NO: 422799 - protein, 9 aa, Homo Sapiens
PLPYASPYT

SEQ ID NO: 422800 - protein, 9 aa, Homo Sapiens
PQGRAPLEG

SEQ ID NO: 422801 - protein, 9 aa, Homo Sapiens
LKYKDFLIQ

SEQ ID NO: 422802 - protein, 9 aa, Homo Sapiens
QPRGSSSCS

SEQ ID NO: 422803 - protein, 9 aa, Homo Sapiens
DQDLCRGPR

SEQ ID NO: 422804 - protein, 9 aa, Homo Sapiens
VYHLELGFK

SEQ ID NO: 422805 - protein, 9 aa, Homo Sapiens
SRRTWSSLR

SEQ ID NO: 422806 - protein, 9 aa, Homo Sapiens
PYTPRMTAR

SEQ ID NO: 422807 - protein, 9 aa, Homo Sapiens
KPAEEVVPV

SEQ ID NO: 422808 - protein, 9 aa, Homo Sapiens
EAKSKRVNE

SEQ ID NO: 422809 - protein, 9 aa, Homo Sapiens
NYQMEMGSA

SEQ ID NO: 422810 - protein, 9 aa, Homo Sapiens
VCVNVWMLD

SEQ ID NO: 422811 - protein, 9 aa, Homo Sapiens
RSCVSSRGQ

SEQ ID NO: 422812 - protein, 9 aa, Homo Sapiens
VLTFIYSVV

SEQ ID NO: 422813 - protein, 9 aa, Homo Sapiens
KRRIRREGI

SEQ ID NO: 422814 - protein, 9 aa, Homo Sapiens
VSVQTKSAS

SEQ ID NO: 422815 - protein, 9 aa, Homo Sapiens
EARGRPFCA

SEQ ID NO: 422816 - protein, 9 aa, Homo Sapiens
AFRCYSDLT

SEQ ID NO: 422817 - protein, 9 aa, Homo Sapiens
SSRMLGLHF

SEQ ID NO: 422818 - protein, 9 aa, Homo Sapiens
PKAEVLWLI

SEQ ID NO: 422819 - protein, 9 aa, Homo Sapiens
TPHKIIHTG

SEQ ID NO: 422820 - protein, 9 aa, Homo Sapiens
INSLAQLCV

SEQ ID NO: 422821 - protein, 9 aa, Homo Sapiens
TSPPATATW

SEQ ID NO: 422822 - protein, 9 aa, Homo Sapiens
AYCVMGFAQ

SEQ ID NO: 422823 - protein, 9 aa, Homo Sapiens
FALCSRKNL

SEQ ID NO: 422824 - protein, 9 aa, Homo Sapiens
QGLQSRMVH

SEQ ID NO: 422825 - protein, 9 aa, Homo Sapiens
APAPSLGGG

SEQ ID NO: 422826 - protein, 9 aa, Homo Sapiens
TKCVELGIK

SEQ ID NO: 422827 - protein, 9 aa, Homo Sapiens
RCPRVLLKK

SEQ ID NO: 422828 - protein, 9 aa, Homo Sapiens
SSKKAEMNI

SEQ ID NO: 422829 - protein, 9 aa, Homo Sapiens
GTMAEERMT

SEQ ID NO: 422830 - protein, 9 aa, Homo Sapiens
SGGESEGKR

SEQ ID NO: 422831 - protein, 9 aa, Homo Sapiens
CDANNLIFI

SEQ ID NO: 422832 - protein, 9 aa, Homo Sapiens
QCQWRQPPR

SEQ ID NO: 422833 - protein, 9 aa, Homo Sapiens
MSQCWELNP

SEQ ID NO: 422834 - protein, 9 aa, Homo Sapiens
PCPARAGAT

SEQ ID NO: 422835 - protein, 9 aa, Homo Sapiens
LVVLAAVGV

SEQ ID NO: 422836 - protein, 9 aa, Homo Sapiens
HSSVLATGL

SEQ ID NO: 422837 - protein, 9 aa, Homo Sapiens
VPRTPSGDR

SEQ ID NO: 422838 - protein, 9 aa, Homo Sapiens
GGCPAHPQD

SEQ ID NO: 422839 - protein, 9 aa, Homo Sapiens
ILVWLSKIQ

SEQ ID NO: 422840 - protein, 9 aa, Homo Sapiens
CGRTAGRLE

SEQ ID NO: 422841 - protein, 9 aa, Homo Sapiens
SAGPLYGWE

SEQ ID NO: 422842 - protein, 9 aa, Homo Sapiens
HQPPLSLQQ

SEQ ID NO: 422843 - protein, 9 aa, Homo Sapiens
LGGEQRKRR

SEQ ID NO: 422844 - protein, 9 aa, Homo Sapiens
SKEEEERHI

SEQ ID NO: 422845 - protein, 9 aa, Homo Sapiens
EAGAGLEAE

SEQ ID NO: 422846 - protein, 9 aa, Homo Sapiens
AVAPLVCYL

SEQ ID NO: 422847 - protein, 9 aa, Homo Sapiens
NDRLKPPRR

SEQ ID NO: 422848 - protein, 9 aa, Homo Sapiens
STPDFSRLG

SEQ ID NO: 422849 - protein, 9 aa, Homo Sapiens
RASEKSPST

SEQ ID NO: 422850 - protein, 9 aa, Homo Sapiens
HWKKLPSCP

SEQ ID NO: 422851 - protein, 9 aa, Homo Sapiens
AQRLPYNIA

SEQ ID NO: 422852 - protein, 9 aa, Homo Sapiens
LPSTMRSTP

SEQ ID NO: 422853 - protein, 9 aa, Homo Sapiens
MRRLVCRLR

SEQ ID NO: 422854 - protein, 9 aa, Homo Sapiens
DELHRELPP

SEQ ID NO: 422855 - protein, 9 aa, Homo Sapiens
RLCVPQNHL

SEQ ID NO: 422856 - protein, 9 aa, Homo Sapiens
IRVHKAITA

SEQ ID NO: 422857 - protein, 9 aa, Homo Sapiens
LRDPSECVL

SEQ ID NO: 422858 - protein, 9 aa, Homo Sapiens
MCLRLCPHI

SEQ ID NO: 422859 - protein, 9 aa, Homo Sapiens
LMLADCNLL

SEQ ID NO: 422860 - protein, 9 aa, Homo Sapiens
DSTHVIQCY

SEQ ID NO: 422861 - protein, 9 aa, Homo Sapiens
TSARVLEEM

SEQ ID NO: 422862 - protein, 9 aa, Homo Sapiens
EALPAWHPL

SEQ ID NO: 422863 - protein, 9 aa, Homo Sapiens
QEVRGSPEE

SEQ ID NO: 422864 - protein, 9 aa, Homo Sapiens
HERGKTPAH

SEQ ID NO: 422865 - protein, 9 aa, Homo Sapiens
ASTRSRVVG

SEQ ID NO: 422866 - protein, 9 aa, Homo Sapiens
GIRKDQRGG

SEQ ID NO: 422867 - protein, 9 aa, Homo Sapiens
VMLMLDGYY

SEQ ID NO: 422868 - protein, 9 aa, Homo Sapiens
SLPFAASPA

SEQ ID NO: 422869 - protein, 9 aa, Homo Sapiens
AERLQISNP

SEQ ID NO: 422870 - protein, 9 aa, Homo Sapiens
QMVVEKFLK

SEQ ID NO: 422871 - protein, 9 aa, Homo Sapiens
SHLGNIAVE

SEQ ID NO: 422872 - protein, 9 aa, Homo Sapiens
NAVLTFIYS

SEQ ID NO: 422873 - protein, 9 aa, Homo Sapiens
SWMSSCSKR

SEQ ID NO: 422874 - protein, 9 aa, Homo Sapiens
SKRVFGEHR

SEQ ID NO: 422875 - protein, 9 aa, Homo Sapiens
MDLFHPMKL

SEQ ID NO: 422876 - protein, 9 aa, Homo Sapiens
CSGLSVSVG

SEQ ID NO: 422877 - protein, 9 aa, Homo Sapiens
TKIKLPKKR

SEQ ID NO: 422878 - protein, 9 aa, Homo Sapiens
DLKNYNKNY

SEQ ID NO: 422879 - protein, 9 aa, Homo Sapiens
QTWTRGDFV

SEQ ID NO: 422880 - protein, 9 aa, Homo Sapiens
HRHHALVVG

SEQ ID NO: 422881 - protein, 9 aa, Homo Sapiens
ACVVLCLPC

SEQ ID NO: 422882 - protein, 9 aa, Homo Sapiens
PLQCVGRRR

SEQ ID NO: 422883 - protein, 9 aa, Homo Sapiens
EANKNFSFL

SEQ ID NO: 422884 - protein, 9 aa, Homo Sapiens
GKPKPRSLQ

SEQ ID NO: 422885 - protein, 9 aa, Homo Sapiens
AALLILLQF

SEQ ID NO: 422886 - protein, 9 aa, Homo Sapiens
LSVSTAVDT

SEQ ID NO: 422887 - protein, 9 aa, Homo Sapiens
PRTWVPGVL

SEQ ID NO: 422888 - protein, 9 aa, Homo Sapiens
SATKLCQFV

SEQ ID NO: 422889 - protein, 9 aa, Homo Sapiens
SPVQLLQPQ

SEQ ID NO: 422890 - protein, 9 aa, Homo Sapiens
GSYPPARQP

SEQ ID NO: 422891 - protein, 9 aa, Homo Sapiens
NSMCITEID

SEQ ID NO: 422892 - protein, 9 aa, Homo Sapiens
KELFSFFSG

SEQ ID NO: 422893 - protein, 9 aa, Homo Sapiens
GSTASSLSV

SEQ ID NO: 422894 - protein, 9 aa, Homo Sapiens
GGHSPCPLV

SEQ ID NO: 422895 - protein, 9 aa, Homo Sapiens
HPGRRRARP

SEQ ID NO: 422896 - protein, 9 aa, Homo Sapiens
VPEVVTRKA

SEQ ID NO: 422897 - protein, 9 aa, Homo Sapiens
QDPGLGGPR

SEQ ID NO: 422898 - protein, 9 aa, Homo Sapiens
VTTTPDQYS

SEQ ID NO: 422899 - protein, 9 aa, Homo Sapiens
SDPGTPDQY

SEQ ID NO: 422900 - protein, 9 aa, Homo Sapiens
GVGEPRHCI

SEQ ID NO: 422901 - protein, 9 aa, Homo Sapiens
WYLLAPRNK

SEQ ID NO: 422902 - protein, 9 aa, Homo Sapiens
GRGQKIAHL

SEQ ID NO: 422903 - protein, 9 aa, Homo Sapiens
LQRHEMTHT

SEQ ID NO: 422904 - protein, 9 aa, Homo Sapiens
AYIRKALAL

SEQ ID NO: 422905 - protein, 9 aa, Homo Sapiens
QELEWALCA

SEQ ID NO: 422906 - protein, 9 aa, Homo Sapiens
ASSPAWPAV

SEQ ID NO: 422907 - protein, 9 aa, Homo Sapiens
GLQDDGFQP

SEQ ID NO: 422908 - protein, 9 aa, Homo Sapiens
MTDVSTAFE

SEQ ID NO: 422909 - protein, 9 aa, Homo Sapiens
TIIVNTDLG

SEQ ID NO: 422910 - protein, 9 aa, Homo Sapiens
KKCWIIKEN

SEQ ID NO: 422911 - protein, 9 aa, Homo Sapiens
VLLQELEHF

SEQ ID NO: 422912 - protein, 9 aa, Homo Sapiens
LQAEIREIP

SEQ ID NO: 422913 - protein, 9 aa, Homo Sapiens
GFLPIFMPF

SEQ ID NO: 422914 - protein, 9 aa, Homo Sapiens
RVRRTAQGL

SEQ ID NO: 422915 - protein, 9 aa, Homo Sapiens
EDGVPGVPG

SEQ ID NO: 422916 - protein, 9 aa, Homo Sapiens
WESTDMVSF

SEQ ID NO: 422917 - protein, 9 aa, Homo Sapiens
IGKETFHHF

SEQ ID NO: 422918 - protein, 9 aa, Homo Sapiens
AMEIFATMP

SEQ ID NO: 422919 - protein, 9 aa, Homo Sapiens
GRTLVLVSD

SEQ ID NO: 422920 - protein, 9 aa, Homo Sapiens
GSVVWKKWQ

SEQ ID NO: 422921 - protein, 9 aa, Homo Sapiens
RMLQTQFSL

SEQ ID NO: 422922 - protein, 9 aa, Homo Sapiens
YEGLGNLLE

SEQ ID NO: 422923 - protein, 9 aa, Homo Sapiens
MKGGIRKDQ

SEQ ID NO: 422924 - protein, 9 aa, Homo Sapiens
HCLLTAHLL

SEQ ID NO: 422925 - protein, 9 aa, Homo Sapiens
PQWDSDEGV

SEQ ID NO: 422926 - protein, 9 aa, Homo Sapiens
NLQVWNCPW

SEQ ID NO: 422927 - protein, 9 aa, Homo Sapiens
FFCICTIPK

SEQ ID NO: 422928 - protein, 9 aa, Homo Sapiens
HESFRLFTR

SEQ ID NO: 422929 - protein, 9 aa, Homo Sapiens
CRYQQEVDR

SEQ ID NO: 422930 - protein, 9 aa, Homo Sapiens
PPGASTSSR

SEQ ID NO: 422931 - protein, 9 aa, Homo Sapiens
IQSGLFDII

SEQ ID NO: 422932 - protein, 9 aa, Homo Sapiens
QGPCPPPVT

SEQ ID NO: 422933 - protein, 9 aa, Homo Sapiens
QTTLSSMMT

SEQ ID NO: 422934 - protein, 9 aa, Homo Sapiens
HNLDFAPGV

SEQ ID NO: 422935 - protein, 9 aa, Homo Sapiens
NVQNLFEQL

SEQ ID NO: 422936 - protein, 9 aa, Homo Sapiens
GHLVCVMCL

SEQ ID NO: 422937 - protein, 9 aa, Homo Sapiens
CGKPDVTVY

SEQ ID NO: 422938 - protein, 9 aa, Homo Sapiens
PATFVAHTA

SEQ ID NO: 422939 - protein, 9 aa, Homo Sapiens
RFEVLMTQQ

SEQ ID NO: 422940 - protein, 9 aa, Homo Sapiens
LTSAHDPDT

SEQ ID NO: 422941 - protein, 9 aa, Homo Sapiens
TACARTCWT

SEQ ID NO: 422942 - protein, 9 aa, Homo Sapiens
PSSARPAPP

SEQ ID NO: 422943 - protein, 9 aa, Homo Sapiens
GTGKVTVEY

SEQ ID NO: 422944 - protein, 9 aa, Homo Sapiens
SRACDINTE

SEQ ID NO: 422945 - protein, 9 aa, Homo Sapiens
HSSLVKREQ

SEQ ID NO: 422946 - protein, 9 aa, Homo Sapiens
KGQTQKEKK

SEQ ID NO: 422947 - protein, 9 aa, Homo Sapiens
DYQPPAKKN

SEQ ID NO: 422948 - protein, 9 aa, Homo Sapiens
RHPAPTQER

SEQ ID NO: 422949 - protein, 9 aa, Homo Sapiens
SCISRKCPA

SEQ ID NO: 422950 - protein, 9 aa, Homo Sapiens
ASPAQVTMM

SEQ ID NO: 422951 - protein, 9 aa, Homo Sapiens
ELPCKVLGH

SEQ ID NO: 422952 - protein, 9 aa, Homo Sapiens
KSPFLSSTE

SEQ ID NO: 422953 - protein, 9 aa, Homo Sapiens
GLDVTQRDT

SEQ ID NO: 422954 - protein, 9 aa, Homo Sapiens
DPWTFSPLM

SEQ ID NO: 422955 - protein, 9 aa, Homo Sapiens
LDDAKAPLK

SEQ ID NO: 422956 - protein, 9 aa, Homo Sapiens
MTLWKQKKL

SEQ ID NO: 422957 - protein, 9 aa, Homo Sapiens
KKTENLEYL

SEQ ID NO: 422958 - protein, 9 aa, Homo Sapiens
SPPGASPPR

SEQ ID NO: 422959 - protein, 9 aa, Homo Sapiens
SNTFIVNGC

SEQ ID NO: 422960 - protein, 9 aa, Homo Sapiens
ICGVGHLAV

SEQ ID NO: 422961 - protein, 9 aa, Homo Sapiens
TSSLGIRAQ

SEQ ID NO: 422962 - protein, 9 aa, Homo Sapiens
HKICWLIVA

SEQ ID NO: 422963 - protein, 9 aa, Homo Sapiens
WAIAVLEYM

SEQ ID NO: 422964 - protein, 9 aa, Homo Sapiens
ISHMDVFVS

SEQ ID NO: 422965 - protein, 9 aa, Homo Sapiens
HPLLIRIID

SEQ ID NO: 422966 - protein, 9 aa, Homo Sapiens
HLSPWTFPR

SEQ ID NO: 422967 - protein, 9 aa, Homo Sapiens
QPQPTEARG

SEQ ID NO: 422968 - protein, 9 aa, Homo Sapiens
LLLQNKRSS

SEQ ID NO: 422969 - protein, 9 aa, Homo Sapiens
KVTHYHCTH

SEQ ID NO: 422970 - protein, 9 aa, Homo Sapiens
GRPTFIPAQ

SEQ ID NO: 422971 - protein, 9 aa, Homo Sapiens
PELFLLQAE

SEQ ID NO: 422972 - protein, 9 aa, Homo Sapiens
PALGDPEAA

SEQ ID NO: 422973 - protein, 9 aa, Homo Sapiens
NEICMKEGE

SEQ ID NO: 422974 - protein, 9 aa, Homo Sapiens
KAPLPSPMQ

SEQ ID NO: 422975 - protein, 9 aa, Homo Sapiens
VELQSAVEQ

SEQ ID NO: 422976 - protein, 9 aa, Homo Sapiens
AVGPQQDEM

SEQ ID NO: 422977 - protein, 9 aa, Homo Sapiens
FNKKNLPEG

SEQ ID NO: 422978 - protein, 9 aa, Homo Sapiens
ALLEQYQVL

SEQ ID NO: 422979 - protein, 9 aa, Homo Sapiens
VQQGVQRLL

SEQ ID NO: 422980 - protein, 9 aa, Homo Sapiens
VEVVHDGEA

SEQ ID NO: 422981 - protein, 9 aa, Homo Sapiens
DPDAEVGLA

SEQ ID NO: 422982 - protein, 9 aa, Homo Sapiens
EVEPPPKGC

SEQ ID NO: 422983 - protein, 9 aa, Homo Sapiens
EVMPRTLEG

SEQ ID NO: 422984 - protein, 9 aa, Homo Sapiens
GASTSSRKI

SEQ ID NO: 422985 - protein, 9 aa, Homo Sapiens
TPGPVWPCW

SEQ ID NO: 422986 - protein, 9 aa, Homo Sapiens
PMCNPNKAI

SEQ ID NO: 422987 - protein, 9 aa, Homo Sapiens
VDSPGILTR

SEQ ID NO: 422988 - protein, 9 aa, Homo Sapiens
IVTEISDES

SEQ ID NO: 422989 - protein, 9 aa, Homo Sapiens
RGDFVSSDK

SEQ ID NO: 422990 - protein, 9 aa, Homo Sapiens
LQWNMMASI

SEQ ID NO: 422991 - protein, 9 aa, Homo Sapiens
GSGGHSPCS

SEQ ID NO: 422992 - protein, 9 aa, Homo Sapiens
PAQLVILKH

SEQ ID NO: 422993 - protein, 9 aa, Homo Sapiens
REGIRWLQP

SEQ ID NO: 422994 - protein, 9 aa, Homo Sapiens
PRGKQVIEQ

SEQ ID NO: 422995 - protein, 9 aa, Homo Sapiens
RSPDPSPDL

SEQ ID NO: 422996 - protein, 9 aa, Homo Sapiens
DYHTVLHQN

SEQ ID NO: 422997 - protein, 9 aa, Homo Sapiens
RVMLEGQAA

SEQ ID NO: 422998 - protein, 9 aa, Homo Sapiens
EFPLGGTTP

SEQ ID NO: 422999 - protein, 9 aa, Homo Sapiens
KHASQQFCY

SEQ ID NO: 423000 - protein, 9 aa, Homo Sapiens
AVWYFPFDI

SEQ ID NO: 423001 - protein, 9 aa, Homo Sapiens
LRDSALYLC

SEQ ID NO: 423002 - protein, 9 aa, Homo Sapiens
ALVGPLARV

SEQ ID NO: 423003 - protein, 9 aa, Homo Sapiens
PCEVRMLML

SEQ ID NO: 423004 - protein, 9 aa, Homo Sapiens
VGVFFGDRR

SEQ ID NO: 423005 - protein, 9 aa, Homo Sapiens
LLSKHGRCS

SEQ ID NO: 423006 - protein, 9 aa, Homo Sapiens
CLEGDQISS

SEQ ID NO: 423007 - protein, 9 aa, Homo Sapiens
RAGATRCLW

SEQ ID NO: 423008 - protein, 9 aa, Homo Sapiens
RCLEPERYC

SEQ ID NO: 423009 - protein, 9 aa, Homo Sapiens
AVHPQRRRP

SEQ ID NO: 423010 - protein, 9 aa, Homo Sapiens
WSQVIDFTS

SEQ ID NO: 423011 - protein, 9 aa, Homo Sapiens
DKLLSAGAI

SEQ ID NO: 423012 - protein, 9 aa, Homo Sapiens
SPRATAAGR

SEQ ID NO: 423013 - protein, 9 aa, Homo Sapiens
KYFGPSFMG

SEQ ID NO: 423014 - protein, 9 aa, Homo Sapiens
IISMHFAFG

SEQ ID NO: 423015 - protein, 9 aa, Homo Sapiens
ERYRLDGTE

SEQ ID NO: 423016 - protein, 9 aa, Homo Sapiens
LDNSQDLNM

SEQ ID NO: 423017 - protein, 9 aa, Homo Sapiens
DSRRWAGRG

SEQ ID NO: 423018 - protein, 9 aa, Homo Sapiens
FSCHCVIGK

SEQ ID NO: 423019 - protein, 9 aa, Homo Sapiens
PPSPELVKQ

SEQ ID NO: 423020 - protein, 9 aa, Homo Sapiens
WWQLIQWEN

SEQ ID NO: 423021 - protein, 9 aa, Homo Sapiens
LYMFYALVI

SEQ ID NO: 423022 - protein, 9 aa, Homo Sapiens
TSTGSRQSR

SEQ ID NO: 423023 - protein, 9 aa, Homo Sapiens
KKNMPQVVY

SEQ ID NO: 423024 - protein, 9 aa, Homo Sapiens
PGMWSSPLM

SEQ ID NO: 423025 - protein, 9 aa, Homo Sapiens
ETMRGLQQW

SEQ ID NO: 423026 - protein, 9 aa, Homo Sapiens
TGQGCLLSL

SEQ ID NO: 423027 - protein, 9 aa, Homo Sapiens
GAVAQVYNT

SEQ ID NO: 423028 - protein, 9 aa, Homo Sapiens
EAAGKYSAT

SEQ ID NO: 423029 - protein, 9 aa, Homo Sapiens
PQTPTSQPK

SEQ ID NO: 423030 - protein, 9 aa, Homo Sapiens
EKQVAVHYT

SEQ ID NO: 423031 - protein, 9 aa, Homo Sapiens
VEFFSRPTM

SEQ ID NO: 423032 - protein, 9 aa, Homo Sapiens
KEMMKLMNQ

SEQ ID NO: 423033 - protein, 9 aa, Homo Sapiens
RDARQLQAI

SEQ ID NO: 423034 - protein, 9 aa, Homo Sapiens
CPAVPAAAC

SEQ ID NO: 423035 - protein, 9 aa, Homo Sapiens
QNHRCKMKR

SEQ ID NO: 423036 - protein, 9 aa, Homo Sapiens
NLLEKRASF

SEQ ID NO: 423037 - protein, 9 aa, Homo Sapiens
LESLCEDSN

SEQ ID NO: 423038 - protein, 9 aa, Homo Sapiens
FLRILEQKF

SEQ ID NO: 423039 - protein, 9 aa, Homo Sapiens
TLEHRPPAP

SEQ ID NO: 423040 - protein, 9 aa, Homo Sapiens
GPPPGCGKT

SEQ ID NO: 423041 - protein, 9 aa, Homo Sapiens
QTFILLFLV

SEQ ID NO: 423042 - protein, 9 aa, Homo Sapiens
HSMNPRAMK

SEQ ID NO: 423043 - protein, 9 aa, Homo Sapiens
EVHPFNQVA

SEQ ID NO: 423044 - protein, 9 aa, Homo Sapiens
ECTPPHLLK

SEQ ID NO: 423045 - protein, 9 aa, Homo Sapiens
KNSYSAYIS

SEQ ID NO: 423046 - protein, 9 aa, Homo Sapiens
TSAGTGAVA

SEQ ID NO: 423047 - protein, 9 aa, Homo Sapiens
LQTTSNTFI

SEQ ID NO: 423048 - protein, 9 aa, Homo Sapiens
TTLPEELVQ

SEQ ID NO: 423049 - protein, 9 aa, Homo Sapiens
LWSPPRLRM

SEQ ID NO: 423050 - protein, 9 aa, Homo Sapiens
HKAITAGYF

SEQ ID NO: 423051 - protein, 9 aa, Homo Sapiens
PMSLACSIT

SEQ ID NO: 423052 - protein, 9 aa, Homo Sapiens
QRQRLVEGQ

SEQ ID NO: 423053 - protein, 9 aa, Homo Sapiens
CVGDRFMRL

SEQ ID NO: 423054 - protein, 9 aa, Homo Sapiens
VRMLMLLYS

SEQ ID NO: 423055 - protein, 9 aa, Homo Sapiens
HDERFDLDD

SEQ ID NO: 423056 - protein, 9 aa, Homo Sapiens
FTSKDKKRK

SEQ ID NO: 423057 - protein, 9 aa, Homo Sapiens
CFSASMDGQ

SEQ ID NO: 423058 - protein, 9 aa, Homo Sapiens
GHFTSFNSS

SEQ ID NO: 423059 - protein, 9 aa, Homo Sapiens
EGVYECHVS

SEQ ID NO: 423060 - protein, 9 aa, Homo Sapiens
VLSSLHRAA

SEQ ID NO: 423061 - protein, 9 aa, Homo Sapiens
APATQAPCM

SEQ ID NO: 423062 - protein, 9 aa, Homo Sapiens
LHGPVQGHQ

SEQ ID NO: 423063 - protein, 9 aa, Homo Sapiens
HFFACPSKT

SEQ ID NO: 423064 - protein, 9 aa, Homo Sapiens
PSECVLSDY

SEQ ID NO: 423065 - protein, 9 aa, Homo Sapiens
LILQLLALG

SEQ ID NO: 423066 - protein, 9 aa, Homo Sapiens
KLAFYGILP

SEQ ID NO: 423067 - protein, 9 aa, Homo Sapiens
DWAFVPTPC

SEQ ID NO: 423068 - protein, 9 aa, Homo Sapiens
FQRDNEVNS

SEQ ID NO: 423069 - protein, 9 aa, Homo Sapiens
RPGNPTSHG

SEQ ID NO: 423070 - protein, 9 aa, Homo Sapiens
CPAHPQDPN

SEQ ID NO: 423071 - protein, 9 aa, Homo Sapiens
MILTNFLKK

SEQ ID NO: 423072 - protein, 9 aa, Homo Sapiens
LMASEGLRT

SEQ ID NO: 423073 - protein, 9 aa, Homo Sapiens
LDLPLSSVP

SEQ ID NO: 423074 - protein, 9 aa, Homo Sapiens
CATNIGRVC

SEQ ID NO: 423075 - protein, 9 aa, Homo Sapiens
RAAGPGTGA

SEQ ID NO: 423076 - protein, 9 aa, Homo Sapiens
GNSRSWRPS

SEQ ID NO: 423077 - protein, 9 aa, Homo Sapiens
SPRGLQIQE

SEQ ID NO: 423078 - protein, 9 aa, Homo Sapiens
RKFPLKKLM

SEQ ID NO: 423079 - protein, 9 aa, Homo Sapiens
TTDGIGVDE

SEQ ID NO: 423080 - protein, 9 aa, Homo Sapiens
ATMIYVGCR

SEQ ID NO: 423081 - protein, 9 aa, Homo Sapiens
RKRRKRKGR

SEQ ID NO: 423082 - protein, 9 aa, Homo Sapiens
FIMIPIAGA

SEQ ID NO: 423083 - protein, 9 aa, Homo Sapiens
KIYIGGVSE

SEQ ID NO: 423084 - protein, 9 aa, Homo Sapiens
RLGGEQRKR

SEQ ID NO: 423085 - protein, 9 aa, Homo Sapiens
TGAPRGTDP

SEQ ID NO: 423086 - protein, 9 aa, Homo Sapiens
FAASSHYGT

SEQ ID NO: 423087 - protein, 9 aa, Homo Sapiens
QRCHRAVMA

SEQ ID NO: 423088 - protein, 9 aa, Homo Sapiens
QVHVRLHEL

SEQ ID NO: 423089 - protein, 9 aa, Homo Sapiens
WRQPPRERD

SEQ ID NO: 423090 - protein, 9 aa, Homo Sapiens
PMKRASKEV

SEQ ID NO: 423091 - protein, 9 aa, Homo Sapiens
SCSLLTQPS

SEQ ID NO: 423092 - protein, 9 aa, Homo Sapiens
NVVDSFFVI

SEQ ID NO: 423093 - protein, 9 aa, Homo Sapiens
HKAAHLGIT

SEQ ID NO: 423094 - protein, 9 aa, Homo Sapiens
SNPQLREIL

SEQ ID NO: 423095 - protein, 9 aa, Homo Sapiens
IHSAMECTP

SEQ ID NO: 423096 - protein, 9 aa, Homo Sapiens
LKVTVVDGL

SEQ ID NO: 423097 - protein, 9 aa, Homo Sapiens
PYWMVPEVV

SEQ ID NO: 423098 - protein, 9 aa, Homo Sapiens
VIFVSVQTK

SEQ ID NO: 423099 - protein, 9 aa, Homo Sapiens
KRTQQRPPW

SEQ ID NO: 423100 - protein, 9 aa, Homo Sapiens
APLPSPMQQ

SEQ ID NO: 423101 - protein, 9 aa, Homo Sapiens
SGEQPPCLE

SEQ ID NO: 423102 - protein, 9 aa, Homo Sapiens
AGSQMQGEK

SEQ ID NO: 423103 - protein, 9 aa, Homo Sapiens
QCLPLPPRV

SEQ ID NO: 423104 - protein, 9 aa, Homo Sapiens
CGCLLTAHG

SEQ ID NO: 423105 - protein, 9 aa, Homo Sapiens
QSDVIITQQ

SEQ ID NO: 423106 - protein, 9 aa, Homo Sapiens
GLILKRCLE

SEQ ID NO: 423107 - protein, 9 aa, Homo Sapiens
MIVDEGHCM

SEQ ID NO: 423108 - protein, 9 aa, Homo Sapiens
FLVRRFCCF

SEQ ID NO: 423109 - protein, 9 aa, Homo Sapiens
YCVDNNQGA

SEQ ID NO: 423110 - protein, 9 aa, Homo Sapiens
ACPPTCLAG

SEQ ID NO: 423111 - protein, 9 aa, Homo Sapiens
HGHEAVVHL

SEQ ID NO: 423112 - protein, 9 aa, Homo Sapiens
TSGALCAAL

SEQ ID NO: 423113 - protein, 9 aa, Homo Sapiens
HRLSDEVGF

SEQ ID NO: 423114 - protein, 9 aa, Homo Sapiens
DHTACEKES

SEQ ID NO: 423115 - protein, 9 aa, Homo Sapiens
AVQVRGSMH

SEQ ID NO: 423116 - protein, 9 aa, Homo Sapiens
TTAIPSPKT

SEQ ID NO: 423117 - protein, 9 aa, Homo Sapiens
IYYVFFTTM

SEQ ID NO: 423118 - protein, 9 aa, Homo Sapiens
QEVSSVHSL

SEQ ID NO: 423119 - protein, 9 aa, Homo Sapiens
GLGNLLEKR

SEQ ID NO: 423120 - protein, 9 aa, Homo Sapiens
MRKTAPKAK

SEQ ID NO: 423121 - protein, 9 aa, Homo Sapiens
PGPDDARKK

SEQ ID NO: 423122 - protein, 9 aa, Homo Sapiens
YQASQTHPP

SEQ ID NO: 423123 - protein, 9 aa, Homo Sapiens
HRSPPTSCP

SEQ ID NO: 423124 - protein, 9 aa, Homo Sapiens
FVEANPAAV

SEQ ID NO: 423125 - protein, 9 aa, Homo Sapiens
TFEGTDMWK

SEQ ID NO: 423126 - protein, 9 aa, Homo Sapiens
FFIFFIFGI

SEQ ID NO: 423127 - protein, 9 aa, Homo Sapiens
GSSSCSARW

SEQ ID NO: 423128 - protein, 9 aa, Homo Sapiens
SPEASTFST

SEQ ID NO: 423129 - protein, 9 aa, Homo Sapiens
YACDTCYIL

SEQ ID NO: 423130 - protein, 9 aa, Homo Sapiens
QEASFPIDE

SEQ ID NO: 423131 - protein, 9 aa, Homo Sapiens
FLESPNLPA

SEQ ID NO: 423132 - protein, 9 aa, Homo Sapiens
SKNLIVLEI

SEQ ID NO: 423133 - protein, 9 aa, Homo Sapiens
FDWVYYESC

SEQ ID NO: 423134 - protein, 9 aa, Homo Sapiens
GDRGPAAPP

SEQ ID NO: 423135 - protein, 9 aa, Homo Sapiens
ATNIGRVCD

SEQ ID NO: 423136 - protein, 9 aa, Homo Sapiens
VTTFTITVC

SEQ ID NO: 423137 - protein, 9 aa, Homo Sapiens
PMQVMVEPS

SEQ ID NO: 423138 - protein, 9 aa, Homo Sapiens
LHAAWHDGL

SEQ ID NO: 423139 - protein, 9 aa, Homo Sapiens
GLKGEWGVK

SEQ ID NO: 423140 - protein, 9 aa, Homo Sapiens
LNIPAPRPV

SEQ ID NO: 423141 - protein, 9 aa, Homo Sapiens
IGTLNSHFM

SEQ ID NO: 423142 - protein, 9 aa, Homo Sapiens
SSLSGASKE

SEQ ID NO: 423143 - protein, 9 aa, Homo Sapiens
LGDLLAVPQ

SEQ ID NO: 423144 - protein, 9 aa, Homo Sapiens
VQASAPPAP

SEQ ID NO: 423145 - protein, 9 aa, Homo Sapiens
TRKNGGGLK

SEQ ID NO: 423146 - protein, 9 aa, Homo Sapiens
LITTRTAVD

SEQ ID NO: 423147 - protein, 9 aa, Homo Sapiens
PASACTMPP

SEQ ID NO: 423148 - protein, 9 aa, Homo Sapiens
VCLSIIATN

SEQ ID NO: 423149 - protein, 9 aa, Homo Sapiens
PRQRRRRGL

SEQ ID NO: 423150 - protein, 9 aa, Homo Sapiens
ITAATQDFF

SEQ ID NO: 423151 - protein, 9 aa, Homo Sapiens
NVIQVATYS

SEQ ID NO: 423152 - protein, 9 aa, Homo Sapiens
PLFYVFTLL

SEQ ID NO: 423153 - protein, 9 aa, Homo Sapiens
GTYLIREQP

SEQ ID NO: 423154 - protein, 9 aa, Homo Sapiens
SRLARVLMG

SEQ ID NO: 423155 - protein, 9 aa, Homo Sapiens
WTFPRYPGL

SEQ ID NO: 423156 - protein, 9 aa, Homo Sapiens
AGDLLKLIM

SEQ ID NO: 423157 - protein, 9 aa, Homo Sapiens
GLKMSFLPT

SEQ ID NO: 423158 - protein, 9 aa, Homo Sapiens
DDHGGWGIS

SEQ ID NO: 423159 - protein, 9 aa, Homo Sapiens
VLCSLCLQN

SEQ ID NO: 423160 - protein, 9 aa, Homo Sapiens
TALYRGGQR

SEQ ID NO: 423161 - protein, 9 aa, Homo Sapiens
SRGLGASSL

SEQ ID NO: 423162 - protein, 9 aa, Homo Sapiens
GMVGPHPLV

SEQ ID NO: 423163 - protein, 9 aa, Homo Sapiens
HPPSSGFPC

SEQ ID NO: 423164 - protein, 9 aa, Homo Sapiens
TAAVAGAWS

SEQ ID NO: 423165 - protein, 9 aa, Homo Sapiens
CIEFRPVDC

SEQ ID NO: 423166 - protein, 9 aa, Homo Sapiens
DQEELKNHY

SEQ ID NO: 423167 - protein, 9 aa, Homo Sapiens
SHCQMSCVN

SEQ ID NO: 423168 - protein, 9 aa, Homo Sapiens
PWKAPSGTG

SEQ ID NO: 423169 - protein, 9 aa, Homo Sapiens
LALGLGSDL

SEQ ID NO: 423170 - protein, 9 aa, Homo Sapiens
VPSTPWAIA

SEQ ID NO: 423171 - protein, 9 aa, Homo Sapiens
YCWTELRDV

SEQ ID NO: 423172 - protein, 9 aa, Homo Sapiens
SRASSSCCQ

SEQ ID NO: 423173 - protein, 9 aa, Homo Sapiens
PLSSKKAEM

SEQ ID NO: 423174 - protein, 9 aa, Homo Sapiens
LTLLRFHVL

SEQ ID NO: 423175 - protein, 9 aa, Homo Sapiens
AGMDPAVHS

SEQ ID NO: 423176 - protein, 9 aa, Homo Sapiens
NFQGCNFSE

SEQ ID NO: 423177 - protein, 9 aa, Homo Sapiens
NALTGSQNS

SEQ ID NO: 423178 - protein, 9 aa, Homo Sapiens
EERQPLPIG

SEQ ID NO: 423179 - protein, 9 aa, Homo Sapiens
KSQRHPLGR

SEQ ID NO: 423180 - protein, 9 aa, Homo Sapiens
MPRATWRSR

SEQ ID NO: 423181 - protein, 9 aa, Homo Sapiens
YVDSEIGTS

SEQ ID NO: 423182 - protein, 9 aa, Homo Sapiens
LKNYNKNYH

SEQ ID NO: 423183 - protein, 9 aa, Homo Sapiens
CLLSLLDDS

SEQ ID NO: 423184 - protein, 9 aa, Homo Sapiens
AWTKTMRAP

SEQ ID NO: 423185 - protein, 9 aa, Homo Sapiens
RSASQPRRT

SEQ ID NO: 423186 - protein, 9 aa, Homo Sapiens
PLLHSNVNG

SEQ ID NO: 423187 - protein, 9 aa, Homo Sapiens
RSPGPMWQG

SEQ ID NO: 423188 - protein, 9 aa, Homo Sapiens
SSLQRHEMT

SEQ ID NO: 423189 - protein, 9 aa, Homo Sapiens
RIRMMLCCM

SEQ ID NO: 423190 - protein, 9 aa, Homo Sapiens
KALSTAQKQ

SEQ ID NO: 423191 - protein, 9 aa, Homo Sapiens
FFQSLMSLK

SEQ ID NO: 423192 - protein, 9 aa, Homo Sapiens
VQSSSVSSV

SEQ ID NO: 423193 - protein, 9 aa, Homo Sapiens
VIWTCQNSH

SEQ ID NO: 423194 - protein, 9 aa, Homo Sapiens
CYLKSNDTN

SEQ ID NO: 423195 - protein, 9 aa, Homo Sapiens
WHNEQNLSL

SEQ ID NO: 423196 - protein, 9 aa, Homo Sapiens
TTSSPRRSP

SEQ ID NO: 423197 - protein, 9 aa, Homo Sapiens
STVHHCIVG

SEQ ID NO: 423198 - protein, 9 aa, Homo Sapiens
QKHLTTPSS

SEQ ID NO: 423199 - protein, 9 aa, Homo Sapiens
PQALFCLTL

SEQ ID NO: 423200 - protein, 9 aa, Homo Sapiens
DKLGLGQLL

SEQ ID NO: 423201 - protein, 9 aa, Homo Sapiens
RTFMPPPGH

SEQ ID NO: 423202 - protein, 9 aa, Homo Sapiens
REWVTTIGA

SEQ ID NO: 423203 - protein, 9 aa, Homo Sapiens
SIVILYYRI

SEQ ID NO: 423204 - protein, 9 aa, Homo Sapiens
LQRGLPGNW

SEQ ID NO: 423205 - protein, 9 aa, Homo Sapiens
RKLVGRAVR

SEQ ID NO: 423206 - protein, 9 aa, Homo Sapiens
KYYRVNLHT

SEQ ID NO: 423207 - protein, 9 aa, Homo Sapiens
CCMLAQRLP

SEQ ID NO: 423208 - protein, 9 aa, Homo Sapiens
NDLKKKIAK

SEQ ID NO: 423209 - protein, 9 aa, Homo Sapiens
EDRVQDIFE

SEQ ID NO: 423210 - protein, 9 aa, Homo Sapiens
ICHPLCHAA

SEQ ID NO: 423211 - protein, 9 aa, Homo Sapiens
ATLERQTLG

SEQ ID NO: 423212 - protein, 9 aa, Homo Sapiens
EQLREQRSV

SEQ ID NO: 423213 - protein, 9 aa, Homo Sapiens
HNEAWSMLL

SEQ ID NO: 423214 - protein, 9 aa, Homo Sapiens
HFAVRCVGK

SEQ ID NO: 423215 - protein, 9 aa, Homo Sapiens
SAVMPQMVT

SEQ ID NO: 423216 - protein, 9 aa, Homo Sapiens
LVAFLQGLQ

SEQ ID NO: 423217 - protein, 9 aa, Homo Sapiens
LGSDLVQLL

SEQ ID NO: 423218 - protein, 9 aa, Homo Sapiens
KKRSKKVST

SEQ ID NO: 423219 - protein, 9 aa, Homo Sapiens
KLRNMTDFW

SEQ ID NO: 423220 - protein, 9 aa, Homo Sapiens
PWMLIDFYD

SEQ ID NO: 423221 - protein, 9 aa, Homo Sapiens
ASRRTWSSL

SEQ ID NO: 423222 - protein, 9 aa, Homo Sapiens
YSDCCLAVS

SEQ ID NO: 423223 - protein, 9 aa, Homo Sapiens
LQRLTWVCR

SEQ ID NO: 423224 - protein, 9 aa, Homo Sapiens
SVEVCLSII

SEQ ID NO: 423225 - protein, 9 aa, Homo Sapiens
MYSTAPTPS

SEQ ID NO: 423226 - protein, 9 aa, Homo Sapiens
LLHPQWAPH

SEQ ID NO: 423227 - protein, 9 aa, Homo Sapiens
SAASLLGPP

SEQ ID NO: 423228 - protein, 9 aa, Homo Sapiens
QALISDLIA

SEQ ID NO: 423229 - protein, 9 aa, Homo Sapiens
RPIQGSCTT

SEQ ID NO: 423230 - protein, 9 aa, Homo Sapiens
LLSIVILYY

SEQ ID NO: 423231 - protein, 9 aa, Homo Sapiens
MGSSTFSHQ

SEQ ID NO: 423232 - protein, 9 aa, Homo Sapiens
LSGSKPKSQ

SEQ ID NO: 423233 - protein, 9 aa, Homo Sapiens
SCAPPSSTG

SEQ ID NO: 423234 - protein, 9 aa, Homo Sapiens
IRIIDTPQF

SEQ ID NO: 423235 - protein, 9 aa, Homo Sapiens
ALLDLPGLS

SEQ ID NO: 423236 - protein, 9 aa, Homo Sapiens
ASLRATVPR

SEQ ID NO: 423237 - protein, 9 aa, Homo Sapiens
RKWSWMTLP

SEQ ID NO: 423238 - protein, 9 aa, Homo Sapiens
KRMNNIKPD

SEQ ID NO: 423239 - protein, 9 aa, Homo Sapiens
GGRERRDRR

SEQ ID NO: 423240 - protein, 9 aa, Homo Sapiens
SCGWAPFSV

SEQ ID NO: 423241 - protein, 9 aa, Homo Sapiens
YWEGNEPGR

SEQ ID NO: 423242 - protein, 9 aa, Homo Sapiens
SEDLDHTAC

SEQ ID NO: 423243 - protein, 9 aa, Homo Sapiens
FINTCGCHQ

SEQ ID NO: 423244 - protein, 9 aa, Homo Sapiens
VLTWRFCRR

SEQ ID NO: 423245 - protein, 9 aa, Homo Sapiens
NRANSGQVH

SEQ ID NO: 423246 - protein, 9 aa, Homo Sapiens
PKMCAPVGN

SEQ ID NO: 423247 - protein, 9 aa, Homo Sapiens
RCRPLSTAW

SEQ ID NO: 423248 - protein, 9 aa, Homo Sapiens
SLPSRWCQP

SEQ ID NO: 423249 - protein, 9 aa, Homo Sapiens
WNSTHPGMW

SEQ ID NO: 423250 - protein, 9 aa, Homo Sapiens
RCCAAPGMQ

SEQ ID NO: 423251 - protein, 9 aa, Homo Sapiens
NDPPAQLRL

SEQ ID NO: 423252 - protein, 9 aa, Homo Sapiens
CRQLEARHY

SEQ ID NO: 423253 - protein, 9 aa, Homo Sapiens
TGNTIDVDH

SEQ ID NO: 423254 - protein, 9 aa, Homo Sapiens
PAGCGTPGC

SEQ ID NO: 423255 - protein, 9 aa, Homo Sapiens
ATRDTPRSE

SEQ ID NO: 423256 - protein, 9 aa, Homo Sapiens
EITCDIKQL

SEQ ID NO: 423257 - protein, 9 aa, Homo Sapiens
PPKEFLLVS

SEQ ID NO: 423258 - protein, 9 aa, Homo Sapiens
TVNLSVTTS

SEQ ID NO: 423259 - protein, 9 aa, Homo Sapiens
PPSFSVAPQ

SEQ ID NO: 423260 - protein, 9 aa, Homo Sapiens
PEPLEPPGP

SEQ ID NO: 423261 - protein, 9 aa, Homo Sapiens
NPFTAPSTK

SEQ ID NO: 423262 - protein, 9 aa, Homo Sapiens
KKRYVWFSG

SEQ ID NO: 423263 - protein, 9 aa, Homo Sapiens
PHPRNAGKL

SEQ ID NO: 423264 - protein, 9 aa, Homo Sapiens
LNGTIMAKY

SEQ ID NO: 423265 - protein, 9 aa, Homo Sapiens
PQGQGRVCT

SEQ ID NO: 423266 - protein, 9 aa, Homo Sapiens
CLSWILHRN

SEQ ID NO: 423267 - protein, 9 aa, Homo Sapiens
ATTVTGTPY

SEQ ID NO: 423268 - protein, 9 aa, Homo Sapiens
ALATDQAFC

SEQ ID NO: 423269 - protein, 9 aa, Homo Sapiens
DWECRIRGS

SEQ ID NO: 423270 - protein, 9 aa, Homo Sapiens
VSLRHPRKP

SEQ ID NO: 423271 - protein, 9 aa, Homo Sapiens
APERARVPG

SEQ ID NO: 423272 - protein, 9 aa, Homo Sapiens
VVGAAQGVD

SEQ ID NO: 423273 - protein, 9 aa, Homo Sapiens
WDTEETYIG

SEQ ID NO: 423274 - protein, 9 aa, Homo Sapiens
TRFDKLAAE

SEQ ID NO: 423275 - protein, 9 aa, Homo Sapiens
EQQGEVALS

SEQ ID NO: 423276 - protein, 9 aa, Homo Sapiens
CLPSPITPH

SEQ ID NO: 423277 - protein, 9 aa, Homo Sapiens
WQPELFLLQ

SEQ ID NO: 423278 - protein, 9 aa, Homo Sapiens
WELGHRHQS

SEQ ID NO: 423279 - protein, 9 aa, Homo Sapiens
RMLQEQQKV

SEQ ID NO: 423280 - protein, 9 aa, Homo Sapiens
RASRAPCRP

SEQ ID NO: 423281 - protein, 9 aa, Homo Sapiens
HTHSRDITI

SEQ ID NO: 423282 - protein, 9 aa, Homo Sapiens
SHQLAGHTD

SEQ ID NO: 423283 - protein, 9 aa, Homo Sapiens
YPCCCEEPR

SEQ ID NO: 423284 - protein, 9 aa, Homo Sapiens
TANMPASLR

SEQ ID NO: 423285 - protein, 9 aa, Homo Sapiens
GVMYSFPRV

SEQ ID NO: 423286 - protein, 9 aa, Homo Sapiens
TSILSALRV

SEQ ID NO: 423287 - protein, 9 aa, Homo Sapiens
GVGAQLMAP

SEQ ID NO: 423288 - protein, 9 aa, Homo Sapiens
KEGCEAIVN

SEQ ID NO: 423289 - protein, 9 aa, Homo Sapiens
VEITKVLGT

SEQ ID NO: 423290 - protein, 9 aa, Homo Sapiens
EPEGMPPME

SEQ ID NO: 423291 - protein, 9 aa, Homo Sapiens
GLGASSLSS

SEQ ID NO: 423292 - protein, 9 aa, Homo Sapiens
VGTPYWMVP

SEQ ID NO: 423293 - protein, 9 aa, Homo Sapiens
CLESLCEDS

SEQ ID NO: 423294 - protein, 9 aa, Homo Sapiens
WNPPQGNRK

SEQ ID NO: 423295 - protein, 9 aa, Homo Sapiens
CARAQIKKS

SEQ ID NO: 423296 - protein, 9 aa, Homo Sapiens
HVALVFAQV

SEQ ID NO: 423297 - protein, 9 aa, Homo Sapiens
DEVIEAELR

SEQ ID NO: 423298 - protein, 9 aa, Homo Sapiens
LMMTDTCGL

SEQ ID NO: 423299 - protein, 9 aa, Homo Sapiens
DQVAVGYRA

SEQ ID NO: 423300 - protein, 9 aa, Homo Sapiens
WLALQAGPP

SEQ ID NO: 423301 - protein, 9 aa, Homo Sapiens
SSHSLAWER

SEQ ID NO: 423302 - protein, 9 aa, Homo Sapiens
APCEVRMLM

SEQ ID NO: 423303 - protein, 9 aa, Homo Sapiens
RMRAGTCNI

SEQ ID NO: 423304 - protein, 9 aa, Homo Sapiens
AFLPRVRGR

SEQ ID NO: 423305 - protein, 9 aa, Homo Sapiens
YFKQIRNLH

SEQ ID NO: 423306 - protein, 9 aa, Homo Sapiens
CSVQHLRNI

SEQ ID NO: 423307 - protein, 9 aa, Homo Sapiens
TCGTGAFHP

SEQ ID NO: 423308 - protein, 9 aa, Homo Sapiens
ETTEPPPVG

SEQ ID NO: 423309 - protein, 9 aa, Homo Sapiens
FSLQLLDTA

SEQ ID NO: 423310 - protein, 9 aa, Homo Sapiens
RVNLHTRRV

SEQ ID NO: 423311 - protein, 9 aa, Homo Sapiens
LGLWSQGKK

SEQ ID NO: 423312 - protein, 9 aa, Homo Sapiens
WLLTRWKCT

SEQ ID NO: 423313 - protein, 9 aa, Homo Sapiens
STKDRLLAS

SEQ ID NO: 423314 - protein, 9 aa, Homo Sapiens
REKGRLGKG

SEQ ID NO: 423315 - protein, 9 aa, Homo Sapiens
LIDALCRKG

SEQ ID NO: 423316 - protein, 9 aa, Homo Sapiens
NQPMQVMVE

SEQ ID NO: 423317 - protein, 9 aa, Homo Sapiens
IYHCSQTHS

SEQ ID NO: 423318 - protein, 9 aa, Homo Sapiens
VQLLQPQVP

SEQ ID NO: 423319 - protein, 9 aa, Homo Sapiens
CPPRTPWAL

SEQ ID NO: 423320 - protein, 9 aa, Homo Sapiens
GQENLKMDL

SEQ ID NO: 423321 - protein, 9 aa, Homo Sapiens
TRDKKYHCS

SEQ ID NO: 423322 - protein, 9 aa, Homo Sapiens
PALWMARRG

SEQ ID NO: 423323 - protein, 9 aa, Homo Sapiens
FHFLSSQVI

SEQ ID NO: 423324 - protein, 9 aa, Homo Sapiens
TLEKNIRKN

SEQ ID NO: 423325 - protein, 9 aa, Homo Sapiens
EVAAGPPMR

SEQ ID NO: 423326 - protein, 9 aa, Homo Sapiens
ELQYHCSHL

SEQ ID NO: 423327 - protein, 9 aa, Homo Sapiens
RVTFIITNG

SEQ ID NO: 423328 - protein, 9 aa, Homo Sapiens
TGLLPGEAA

SEQ ID NO: 423329 - protein, 9 aa, Homo Sapiens
PISIQYRLK

SEQ ID NO: 423330 - protein, 9 aa, Homo Sapiens
RPLPHAPMS

SEQ ID NO: 423331 - protein, 9 aa, Homo Sapiens
SVLGTGLCE

SEQ ID NO: 423332 - protein, 9 aa, Homo Sapiens
LELEDDTSY

SEQ ID NO: 423333 - protein, 9 aa, Homo Sapiens
VAQGWQMAT

SEQ ID NO: 423334 - protein, 9 aa, Homo Sapiens
MVMADDNVK

SEQ ID NO: 423335 - protein, 9 aa, Homo Sapiens
EPSRRGPQI

SEQ ID NO: 423336 - protein, 9 aa, Homo Sapiens
RPRLQWPAS

SEQ ID NO: 423337 - protein, 9 aa, Homo Sapiens
YLSGGQGQD

SEQ ID NO: 423338 - protein, 9 aa, Homo Sapiens
FALGSLAVA

SEQ ID NO: 423339 - protein, 9 aa, Homo Sapiens
VLDRDEERV

SEQ ID NO: 423340 - protein, 9 aa, Homo Sapiens
WILHRNAIL

SEQ ID NO: 423341 - protein, 9 aa, Homo Sapiens
LWRNPISPV

SEQ ID NO: 423342 - protein, 9 aa, Homo Sapiens
RKKAFKAFS

SEQ ID NO: 423343 - protein, 9 aa, Homo Sapiens
PPCRCCSLQ

SEQ ID NO: 423344 - protein, 9 aa, Homo Sapiens
KEKRRPLDN

SEQ ID NO: 423345 - protein, 9 aa, Homo Sapiens
DAYPYPLPL

SEQ ID NO: 423346 - protein, 9 aa, Homo Sapiens
PRGGGWAAT

SEQ ID NO: 423347 - protein, 9 aa, Homo Sapiens
QCHLAKLGS

SEQ ID NO: 423348 - protein, 9 aa, Homo Sapiens
LSFGSPTSN

SEQ ID NO: 423349 - protein, 9 aa, Homo Sapiens
SGPATWRCC

SEQ ID NO: 423350 - protein, 9 aa, Homo Sapiens
HRVPGRRLP

SEQ ID NO: 423351 - protein, 9 aa, Homo Sapiens
GCGQTFEGN

SEQ ID NO: 423352 - protein, 9 aa, Homo Sapiens
QYTENSLRG

SEQ ID NO: 423353 - protein, 9 aa, Homo Sapiens
TCYCRTGCC

SEQ ID NO: 423354 - protein, 9 aa, Homo Sapiens
GSRPGWKRT

SEQ ID NO: 423355 - protein, 9 aa, Homo Sapiens
LQMEQLTLA

SEQ ID NO: 423356 - protein, 9 aa, Homo Sapiens
EQQIWKEMD

SEQ ID NO: 423357 - protein, 9 aa, Homo Sapiens
RPLRGRLGS

SEQ ID NO: 423358 - protein, 9 aa, Homo Sapiens
HLEPHHVIL

SEQ ID NO: 423359 - protein, 9 aa, Homo Sapiens
QAKADSTSE

SEQ ID NO: 423360 - protein, 9 aa, Homo Sapiens
DLCSPVYDI

SEQ ID NO: 423361 - protein, 9 aa, Homo Sapiens
GMGMRTSQY

SEQ ID NO: 423362 - protein, 9 aa, Homo Sapiens
TFVMTQGDF

SEQ ID NO: 423363 - protein, 9 aa, Homo Sapiens
HSWFGNLVI

SEQ ID NO: 423364 - protein, 9 aa, Homo Sapiens
ELTAFLMPL

SEQ ID NO: 423365 - protein, 9 aa, Homo Sapiens
GLSPGACRP

SEQ ID NO: 423366 - protein, 9 aa, Homo Sapiens
RPRCCAAPG

SEQ ID NO: 423367 - protein, 9 aa, Homo Sapiens
LSECRDSFK

SEQ ID NO: 423368 - protein, 9 aa, Homo Sapiens
EFGNQWINY

SEQ ID NO: 423369 - protein, 9 aa, Homo Sapiens
KLFITSGIT

SEQ ID NO: 423370 - protein, 9 aa, Homo Sapiens
LVYSLCIAE

SEQ ID NO: 423371 - protein, 9 aa, Homo Sapiens
KDMYVCHQQ

SEQ ID NO: 423372 - protein, 9 aa, Homo Sapiens
AQSEQQGEV

SEQ ID NO: 423373 - protein, 9 aa, Homo Sapiens
HSPHPHGDG

SEQ ID NO: 423374 - protein, 9 aa, Homo Sapiens
GRPGPCSTR

SEQ ID NO: 423375 - protein, 9 aa, Homo Sapiens
SDETWSYNH

SEQ ID NO: 423376 - protein, 9 aa, Homo Sapiens
GMVIASDWL

SEQ ID NO: 423377 - protein, 9 aa, Homo Sapiens
FFVIFLESP

SEQ ID NO: 423378 - protein, 9 aa, Homo Sapiens
PLANLSWCC

SEQ ID NO: 423379 - protein, 9 aa, Homo Sapiens
MIPFPRAWA

SEQ ID NO: 423380 - protein, 9 aa, Homo Sapiens
ATVLCCKQL

SEQ ID NO: 423381 - protein, 9 aa, Homo Sapiens
MGNFKLIST

SEQ ID NO: 423382 - protein, 9 aa, Homo Sapiens
AHALRHRFS

SEQ ID NO: 423383 - protein, 9 aa, Homo Sapiens
AAPLAPPAL

SEQ ID NO: 423384 - protein, 9 aa, Homo Sapiens
GTRRQGLVM

SEQ ID NO: 423385 - protein, 9 aa, Homo Sapiens
VRARGSPCP

SEQ ID NO: 423386 - protein, 9 aa, Homo Sapiens
ELEHFNKLV

SEQ ID NO: 423387 - protein, 9 aa, Homo Sapiens
TVFARVLNE

SEQ ID NO: 423388 - protein, 9 aa, Homo Sapiens
STSSRKIRR

SEQ ID NO: 423389 - protein, 9 aa, Homo Sapiens
YYMLRWLCG

SEQ ID NO: 423390 - protein, 9 aa, Homo Sapiens
ERGQIQLKG

SEQ ID NO: 423391 - protein, 9 aa, Homo Sapiens
LGTQESDFS

SEQ ID NO: 423392 - protein, 9 aa, Homo Sapiens
SSLNSPDKT

SEQ ID NO: 423393 - protein, 9 aa, Homo Sapiens
VTNINVKRC

SEQ ID NO: 423394 - protein, 9 aa, Homo Sapiens
CSRASSSCC

SEQ ID NO: 423395 - protein, 9 aa, Homo Sapiens
TRRPIFEGH

SEQ ID NO: 423396 - protein, 9 aa, Homo Sapiens
KCEICVKRR

SEQ ID NO: 423397 - protein, 9 aa, Homo Sapiens
WEDSPERGV

SEQ ID NO: 423398 - protein, 9 aa, Homo Sapiens
NSSKLCGLK

SEQ ID NO: 423399 - protein, 9 aa, Homo Sapiens
GGVARVEVA

SEQ ID NO: 423400 - protein, 9 aa, Homo Sapiens
PPMPMAMVT

SEQ ID NO: 423401 - protein, 9 aa, Homo Sapiens
AGGGNPCSA

SEQ ID NO: 423402 - protein, 9 aa, Homo Sapiens
IGIIPAGSM

SEQ ID NO: 423403 - protein, 9 aa, Homo Sapiens
SGELRVPEE

SEQ ID NO: 423404 - protein, 9 aa, Homo Sapiens
WLSSPYYHH

SEQ ID NO: 423405 - protein, 9 aa, Homo Sapiens
LKKITIKMN

SEQ ID NO: 423406 - protein, 9 aa, Homo Sapiens
LPIPGQETP

SEQ ID NO: 423407 - protein, 9 aa, Homo Sapiens
KTQSDVIIT

SEQ ID NO: 423408 - protein, 9 aa, Homo Sapiens
LLDCLVFAP

SEQ ID NO: 423409 - protein, 9 aa, Homo Sapiens
QSSAQDIVF

SEQ ID NO: 423410 - protein, 9 aa, Homo Sapiens
DVWMLLGAA

SEQ ID NO: 423411 - protein, 9 aa, Homo Sapiens
VCWEFKHPQ

SEQ ID NO: 423412 - protein, 9 aa, Homo Sapiens
GLGIFKMAV

SEQ ID NO: 423413 - protein, 9 aa, Homo Sapiens
LGMSLQHLS

SEQ ID NO: 423414 - protein, 9 aa, Homo Sapiens
YLVPDNAFY

SEQ ID NO: 423415 - protein, 9 aa, Homo Sapiens
GHRHHALVV

SEQ ID NO: 423416 - protein, 9 aa, Homo Sapiens
GCGTPGCPR

SEQ ID NO: 423417 - protein, 9 aa, Homo Sapiens
FSQHAHLTI

SEQ ID NO: 423418 - protein, 9 aa, Homo Sapiens
GAAEEGHGG

SEQ ID NO: 423419 - protein, 9 aa, Homo Sapiens
KSYPPPPEQ

SEQ ID NO: 423420 - protein, 9 aa, Homo Sapiens
LWVIGFHSV

SEQ ID NO: 423421 - protein, 9 aa, Homo Sapiens
TDSLTIYNS

SEQ ID NO: 423422 - protein, 9 aa, Homo Sapiens
TDCENLLKH

SEQ ID NO: 423423 - protein, 9 aa, Homo Sapiens
PNMVDLLDP

SEQ ID NO: 423424 - protein, 9 aa, Homo Sapiens
SSCGCSAPW

SEQ ID NO: 423425 - protein, 9 aa, Homo Sapiens
EMLGVGGFY

SEQ ID NO: 423426 - protein, 9 aa, Homo Sapiens
CFLFFCQKS

SEQ ID NO: 423427 - protein, 9 aa, Homo Sapiens
NACVGDRFM

SEQ ID NO: 423428 - protein, 9 aa, Homo Sapiens
SILSTCLVA

SEQ ID NO: 423429 - protein, 9 aa, Homo Sapiens
VSPAAAVPT

SEQ ID NO: 423430 - protein, 9 aa, Homo Sapiens
ENLAGPWSS

SEQ ID NO: 423431 - protein, 9 aa, Homo Sapiens
STLSQPPPQ

SEQ ID NO: 423432 - protein, 9 aa, Homo Sapiens
KVSTRKNGG

SEQ ID NO: 423433 - protein, 9 aa, Homo Sapiens
LLSCANLAK

SEQ ID NO: 423434 - protein, 9 aa, Homo Sapiens
IDLLTFKQM

SEQ ID NO: 423435 - protein, 9 aa, Homo Sapiens
HRIRMMLCC

SEQ ID NO: 423436 - protein, 9 aa, Homo Sapiens
AGALLRLLS

SEQ ID NO: 423437 - protein, 9 aa, Homo Sapiens
EWNPCPMDS

SEQ ID NO: 423438 - protein, 9 aa, Homo Sapiens
VKTPGGPPS

SEQ ID NO: 423439 - protein, 9 aa, Homo Sapiens
PVTLRRASI

SEQ ID NO: 423440 - protein, 9 aa, Homo Sapiens
SLRPRPPEP

SEQ ID NO: 423441 - protein, 9 aa, Homo Sapiens
VQAYTPSSP

SEQ ID NO: 423442 - protein, 9 aa, Homo Sapiens
TSSLVASSQ

SEQ ID NO: 423443 - protein, 9 aa, Homo Sapiens
LWLHEHNRV

SEQ ID NO: 423444 - protein, 9 aa, Homo Sapiens
AAPPHPPSS

SEQ ID NO: 423445 - protein, 9 aa, Homo Sapiens
GGSGRRLGG

SEQ ID NO: 423446 - protein, 9 aa, Homo Sapiens
NISNTNHHK

SEQ ID NO: 423447 - protein, 9 aa, Homo Sapiens
AAARATASR

SEQ ID NO: 423448 - protein, 9 aa, Homo Sapiens
GHPIVKLLG

SEQ ID NO: 423449 - protein, 9 aa, Homo Sapiens
GMLNGGQHI

SEQ ID NO: 423450 - protein, 9 aa, Homo Sapiens
QPGGAGFQY

SEQ ID NO: 423451 - protein, 9 aa, Homo Sapiens
PHLRGQGLP

SEQ ID NO: 423452 - protein, 9 aa, Homo Sapiens
TGTPYQDWA

SEQ ID NO: 423453 - protein, 9 aa, Homo Sapiens
DQLLSCANL

SEQ ID NO: 423454 - protein, 9 aa, Homo Sapiens
LREYKALKG

SEQ ID NO: 423455 - protein, 9 aa, Homo Sapiens
FRPDLIIFL

SEQ ID NO: 423456 - protein, 9 aa, Homo Sapiens
NTASLSQRQ

SEQ ID NO: 423457 - protein, 9 aa, Homo Sapiens
QLSSLMMTD

SEQ ID NO: 423458 - protein, 9 aa, Homo Sapiens
GGFYYELGV

SEQ ID NO: 423459 - protein, 9 aa, Homo Sapiens
QMEQLTLAF

SEQ ID NO: 423460 - protein, 9 aa, Homo Sapiens
QKMPKVLPG

SEQ ID NO: 423461 - protein, 9 aa, Homo Sapiens
ILHKTVNSS

SEQ ID NO: 423462 - protein, 9 aa, Homo Sapiens
GPDGLSKPA

SEQ ID NO: 423463 - protein, 9 aa, Homo Sapiens
PVPLHQVIV

SEQ ID NO: 423464 - protein, 9 aa, Homo Sapiens
APISYPCCC

SEQ ID NO: 423465 - protein, 9 aa, Homo Sapiens
PGIVQCGLV

SEQ ID NO: 423466 - protein, 9 aa, Homo Sapiens
TSTSQDSFE

SEQ ID NO: 423467 - protein, 9 aa, Homo Sapiens
EAWDSEGMK

SEQ ID NO: 423468 - protein, 9 aa, Homo Sapiens
IHHLGDQLQ

SEQ ID NO: 423469 - protein, 9 aa, Homo Sapiens
IIPPTGLAA

SEQ ID NO: 423470 - protein, 9 aa, Homo Sapiens
HPGTGTVTA

SEQ ID NO: 423471 - protein, 9 aa, Homo Sapiens
LCSSPGTTQ

SEQ ID NO: 423472 - protein, 9 aa, Homo Sapiens
PGRGASLSG

SEQ ID NO: 423473 - protein, 9 aa, Homo Sapiens
SQPPPQAPS

SEQ ID NO: 423474 - protein, 9 aa, Homo Sapiens
HYSHLLPNQ

SEQ ID NO: 423475 - protein, 9 aa, Homo Sapiens
GLNDLLLPG

SEQ ID NO: 423476 - protein, 9 aa, Homo Sapiens
RWLQPNAAT

SEQ ID NO: 423477 - protein, 9 aa, Homo Sapiens
IALQNDSES

SEQ ID NO: 423478 - protein, 9 aa, Homo Sapiens
QLAGHTDTV

SEQ ID NO: 423479 - protein, 9 aa, Homo Sapiens
DARMNDLHN

SEQ ID NO: 423480 - protein, 9 aa, Homo Sapiens
TSLQLLIPR

SEQ ID NO: 423481 - protein, 9 aa, Homo Sapiens
IIFLKQDIP

SEQ ID NO: 423482 - protein, 9 aa, Homo Sapiens
FVPTPCATS

SEQ ID NO: 423483 - protein, 9 aa, Homo Sapiens
AHPSFFLHP

SEQ ID NO: 423484 - protein, 9 aa, Homo Sapiens
RLGGGRRGA

SEQ ID NO: 423485 - protein, 9 aa, Homo Sapiens
LGVRAAAAP

SEQ ID NO: 423486 - protein, 9 aa, Homo Sapiens
GLVKTTNML

SEQ ID NO: 423487 - protein, 9 aa, Homo Sapiens
TKPVTGNLH

SEQ ID NO: 423488 - protein, 9 aa, Homo Sapiens
LCQGALQGV

SEQ ID NO: 423489 - protein, 9 aa, Homo Sapiens
LYGWEQLSK

SEQ ID NO: 423490 - protein, 9 aa, Homo Sapiens
YYYRETYCA

SEQ ID NO: 423491 - protein, 9 aa, Homo Sapiens
WVLAPPRCT

SEQ ID NO: 423492 - protein, 9 aa, Homo Sapiens
QAASEQRGC

SEQ ID NO: 423493 - protein, 9 aa, Homo Sapiens
NIIQVIELL

SEQ ID NO: 423494 - protein, 9 aa, Homo Sapiens
DFWRLWATE

SEQ ID NO: 423495 - protein, 9 aa, Homo Sapiens
KKWTRSQKG

SEQ ID NO: 423496 - protein, 9 aa, Homo Sapiens
KILTHVHLN

SEQ ID NO: 423497 - protein, 9 aa, Homo Sapiens
VDVLPLVPI

SEQ ID NO: 423498 - protein, 9 aa, Homo Sapiens
HSRTPENYS

SEQ ID NO: 423499 - protein, 9 aa, Homo Sapiens
SFVRGQSRA

SEQ ID NO: 423500 - protein, 9 aa, Homo Sapiens
TRRRAAVTI

SEQ ID NO: 423501 - protein, 9 aa, Homo Sapiens
AFLPSAEVE

SEQ ID NO: 423502 - protein, 9 aa, Homo Sapiens
LEPPGPACP

SEQ ID NO: 423503 - protein, 9 aa, Homo Sapiens
NGFVAAFRF

SEQ ID NO: 423504 - protein, 9 aa, Homo Sapiens
ISKQTFLSE

SEQ ID NO: 423505 - protein, 9 aa, Homo Sapiens
RKEEEDLET

SEQ ID NO: 423506 - protein, 9 aa, Homo Sapiens
MMMKLKKIT

SEQ ID NO: 423507 - protein, 9 aa, Homo Sapiens
YVCHQQLPT

SEQ ID NO: 423508 - protein, 9 aa, Homo Sapiens
SPEATSPHS

SEQ ID NO: 423509 - protein, 9 aa, Homo Sapiens
MCITEIDLI

SEQ ID NO: 423510 - protein, 9 aa, Homo Sapiens
RVIIISMHF

SEQ ID NO: 423511 - protein, 9 aa, Homo Sapiens
SLKNGVSTS

SEQ ID NO: 423512 - protein, 9 aa, Homo Sapiens
LIQKIEAYM

SEQ ID NO: 423513 - protein, 9 aa, Homo Sapiens
GASGRSCPE

SEQ ID NO: 423514 - protein, 9 aa, Homo Sapiens
PEDLPLCLK

SEQ ID NO: 423515 - protein, 9 aa, Homo Sapiens
RCLPHCSSP

SEQ ID NO: 423516 - protein, 9 aa, Homo Sapiens
KLLKSNLSK

SEQ ID NO: 423517 - protein, 9 aa, Homo Sapiens
FRESPWGDY

SEQ ID NO: 423518 - protein, 9 aa, Homo Sapiens
RFDLDDGRW

SEQ ID NO: 423519 - protein, 9 aa, Homo Sapiens
VTVAVGCRR

SEQ ID NO: 423520 - protein, 9 aa, Homo Sapiens
PPACQPALL

SEQ ID NO: 423521 - protein, 9 aa, Homo Sapiens
TPYSATGAP

SEQ ID NO: 423522 - protein, 9 aa, Homo Sapiens
PAEFPHWTT

SEQ ID NO: 423523 - protein, 9 aa, Homo Sapiens
AWTAEGAAG

SEQ ID NO: 423524 - protein, 9 aa, Homo Sapiens
QKNTKYVCL

SEQ ID NO: 423525 - protein, 9 aa, Homo Sapiens
TVLCCKQLS

SEQ ID NO: 423526 - protein, 9 aa, Homo Sapiens
ARVLNENGP

SEQ ID NO: 423527 - protein, 9 aa, Homo Sapiens
FGHFTSFNS

SEQ ID NO: 423528 - protein, 9 aa, Homo Sapiens
HRFLLPASA

SEQ ID NO: 423529 - protein, 9 aa, Homo Sapiens
HNQYTENSL

SEQ ID NO: 423530 - protein, 9 aa, Homo Sapiens
ESTKSYLLQ

SEQ ID NO: 423531 - protein, 9 aa, Homo Sapiens
LEEPVSPAA

SEQ ID NO: 423532 - protein, 9 aa, Homo Sapiens
ETGCCTWAP

SEQ ID NO: 423533 - protein, 9 aa, Homo Sapiens
GRFSHLTRH

SEQ ID NO: 423534 - protein, 9 aa, Homo Sapiens
PLVAPARTG

SEQ ID NO: 423535 - protein, 9 aa, Homo Sapiens
GAWTTTLGH

SEQ ID NO: 423536 - protein, 9 aa, Homo Sapiens
TWCLHRYNS

SEQ ID NO: 423537 - protein, 9 aa, Homo Sapiens
DRRLSAEIW

SEQ ID NO: 423538 - protein, 9 aa, Homo Sapiens
SVTSGAGGS

SEQ ID NO: 423539 - protein, 9 aa, Homo Sapiens
TTSSLVASS

SEQ ID NO: 423540 - protein, 9 aa, Homo Sapiens
SSLGVSGVG

SEQ ID NO: 423541 - protein, 9 aa, Homo Sapiens
RQPVQIQSQ

SEQ ID NO: 423542 - protein, 9 aa, Homo Sapiens
SASCTPLCT

SEQ ID NO: 423543 - protein, 9 aa, Homo Sapiens
LHGNLGETE

SEQ ID NO: 423544 - protein, 9 aa, Homo Sapiens
TSPGVVVDI

SEQ ID NO: 423545 - protein, 9 aa, Homo Sapiens
LQCWGRRRR

SEQ ID NO: 423546 - protein, 9 aa, Homo Sapiens
IDKRMNNIK

SEQ ID NO: 423547 - protein, 9 aa, Homo Sapiens
RKLYSAMPG

SEQ ID NO: 423548 - protein, 9 aa, Homo Sapiens
KRGSKPKPL

SEQ ID NO: 423549 - protein, 9 aa, Homo Sapiens
KTPVSSLCP

SEQ ID NO: 423550 - protein, 9 aa, Homo Sapiens
VDTNDMVDD

SEQ ID NO: 423551 - protein, 9 aa, Homo Sapiens
VHATFRAVD

SEQ ID NO: 423552 - protein, 9 aa, Homo Sapiens
QGQRWTWRS

SEQ ID NO: 423553 - protein, 9 aa, Homo Sapiens
SRPMPMPVR

SEQ ID NO: 423554 - protein, 9 aa, Homo Sapiens
PLQPHRRRP

SEQ ID NO: 423555 - protein, 9 aa, Homo Sapiens
EDLDHTACE

SEQ ID NO: 423556 - protein, 9 aa, Homo Sapiens
SMAVCQIFQ

SEQ ID NO: 423557 - protein, 9 aa, Homo Sapiens
SPAARPPQP

SEQ ID NO: 423558 - protein, 9 aa, Homo Sapiens
SVWWKIAKQ

SEQ ID NO: 423559 - protein, 9 aa, Homo Sapiens
PGNPTSHGS

SEQ ID NO: 423560 - protein, 9 aa, Homo Sapiens
MRSTPSMRT

SEQ ID NO: 423561 - protein, 9 aa, Homo Sapiens
NLVRAHFSP

SEQ ID NO: 423562 - protein, 9 aa, Homo Sapiens
CSPSATSLV

SEQ ID NO: 423563 - protein, 9 aa, Homo Sapiens
SLGVMVDGV

SEQ ID NO: 423564 - protein, 9 aa, Homo Sapiens
LRNLYVPNQ

SEQ ID NO: 423565 - protein, 9 aa, Homo Sapiens
CLRLLWICS

SEQ ID NO: 423566 - protein, 9 aa, Homo Sapiens
MMCKEDLCR

SEQ ID NO: 423567 - protein, 9 aa, Homo Sapiens
NTKAIRTIA

SEQ ID NO: 423568 - protein, 9 aa, Homo Sapiens
SWSATAQRR

SEQ ID NO: 423569 - protein, 9 aa, Homo Sapiens
VQRYLADDR

SEQ ID NO: 423570 - protein, 9 aa, Homo Sapiens
SRKSPSHSS

SEQ ID NO: 423571 - protein, 9 aa, Homo Sapiens
HTGLIKSQR

SEQ ID NO: 423572 - protein, 9 aa, Homo Sapiens
LLSWAGFSP

SEQ ID NO: 423573 - protein, 9 aa, Homo Sapiens
PAWAWHWPL

SEQ ID NO: 423574 - protein, 9 aa, Homo Sapiens
TAWDGGSPS

SEQ ID NO: 423575 - protein, 9 aa, Homo Sapiens
TCNLAENMS

SEQ ID NO: 423576 - protein, 9 aa, Homo Sapiens
GPHLLQPAS

SEQ ID NO: 423577 - protein, 9 aa, Homo Sapiens
GYHKMELPD

SEQ ID NO: 423578 - protein, 9 aa, Homo Sapiens
MTDFWLAGL

SEQ ID NO: 423579 - protein, 9 aa, Homo Sapiens
PYQCPKCEY

SEQ ID NO: 423580 - protein, 9 aa, Homo Sapiens
LSVCPTVSQ

SEQ ID NO: 423581 - protein, 9 aa, Homo Sapiens
TVPRHSSVL

SEQ ID NO: 423582 - protein, 9 aa, Homo Sapiens
VVVKLDNSQ

SEQ ID NO: 423583 - protein, 9 aa, Homo Sapiens
FNMEGYSKT

SEQ ID NO: 423584 - protein, 9 aa, Homo Sapiens
VTTSPAPRT

SEQ ID NO: 423585 - protein, 9 aa, Homo Sapiens
DNNIHSGEM

SEQ ID NO: 423586 - protein, 9 aa, Homo Sapiens
RGAPGHPGV

SEQ ID NO: 423587 - protein, 9 aa, Homo Sapiens
CTRPQSTCA

SEQ ID NO: 423588 - protein, 9 aa, Homo Sapiens
RPMRKTAPK

SEQ ID NO: 423589 - protein, 9 aa, Homo Sapiens
TPELMVPCL

SEQ ID NO: 423590 - protein, 9 aa, Homo Sapiens
IANMVETIP

SEQ ID NO: 423591 - protein, 9 aa, Homo Sapiens
ARRESRFWL

SEQ ID NO: 423592 - protein, 9 aa, Homo Sapiens
LKKFPEENH

SEQ ID NO: 423593 - protein, 9 aa, Homo Sapiens
PLLEAFPLP

SEQ ID NO: 423594 - protein, 9 aa, Homo Sapiens
PPSTCSLPC

SEQ ID NO: 423595 - protein, 9 aa, Homo Sapiens
GTLSGDTLL

SEQ ID NO: 423596 - protein, 9 aa, Homo Sapiens
ILMHRLSDE

SEQ ID NO: 423597 - protein, 9 aa, Homo Sapiens
HVPFSSGQH

SEQ ID NO: 423598 - protein, 9 aa, Homo Sapiens
LLGPSICVF

SEQ ID NO: 423599 - protein, 9 aa, Homo Sapiens
YCVQVLWYD

SEQ ID NO: 423600 - protein, 9 aa, Homo Sapiens
EFDYLTMDG

SEQ ID NO: 423601 - protein, 9 aa, Homo Sapiens
DHVVMGTNG

SEQ ID NO: 423602 - protein, 9 aa, Homo Sapiens
ELLHCAHLA

SEQ ID NO: 423603 - protein, 9 aa, Homo Sapiens
GDSCLCSMA

SEQ ID NO: 423604 - protein, 9 aa, Homo Sapiens
KPNLHTDLD

SEQ ID NO: 423605 - protein, 9 aa, Homo Sapiens
VNVKWEYDH

SEQ ID NO: 423606 - protein, 9 aa, Homo Sapiens
YNSLLPIRS

SEQ ID NO: 423607 - protein, 9 aa, Homo Sapiens
SSQSRSPVP

SEQ ID NO: 423608 - protein, 9 aa, Homo Sapiens
FSASMDGQV

SEQ ID NO: 423609 - protein, 9 aa, Homo Sapiens
NLHVTALKR

SEQ ID NO: 423610 - protein, 9 aa, Homo Sapiens
NPAFDVTPT

SEQ ID NO: 423611 - protein, 9 aa, Homo Sapiens
EQLWVNSDF

SEQ ID NO: 423612 - protein, 9 aa, Homo Sapiens
QRLHSPHPH

SEQ ID NO: 423613 - protein, 9 aa, Homo Sapiens
LGAYLNLRP

SEQ ID NO: 423614 - protein, 9 aa, Homo Sapiens
GPSATCPWT

SEQ ID NO: 423615 - protein, 9 aa, Homo Sapiens
WAEALPAWH

SEQ ID NO: 423616 - protein, 9 aa, Homo Sapiens
LPGCLAWLP

SEQ ID NO: 423617 - protein, 9 aa, Homo Sapiens
RTGDYLRRH

SEQ ID NO: 423618 - protein, 9 aa, Homo Sapiens
DIVFLIAGK

SEQ ID NO: 423619 - protein, 9 aa, Homo Sapiens
LKNQIRSGM

SEQ ID NO: 423620 - protein, 9 aa, Homo Sapiens
RPCSSPQCS

SEQ ID NO: 423621 - protein, 9 aa, Homo Sapiens
QERIQAKTQ

SEQ ID NO: 423622 - protein, 9 aa, Homo Sapiens
SQLEALATE

SEQ ID NO: 423623 - protein, 9 aa, Homo Sapiens
VTVRVKTPG

SEQ ID NO: 423624 - protein, 9 aa, Homo Sapiens
DERFDLDDG

SEQ ID NO: 423625 - protein, 9 aa, Homo Sapiens
QELLILQLL

SEQ ID NO: 423626 - protein, 9 aa, Homo Sapiens
WQAIWQLCA

SEQ ID NO: 423627 - protein, 9 aa, Homo Sapiens
RATSTISAS

SEQ ID NO: 423628 - protein, 9 aa, Homo Sapiens
VQQAPTITM

SEQ ID NO: 423629 - protein, 9 aa, Homo Sapiens
NVPEILYPA

SEQ ID NO: 423630 - protein, 9 aa, Homo Sapiens
ALWKAFHQN

SEQ ID NO: 423631 - protein, 9 aa, Homo Sapiens
VLACQVEHD

SEQ ID NO: 423632 - protein, 9 aa, Homo Sapiens
LCSMAVCQI

SEQ ID NO: 423633 - protein, 9 aa, Homo Sapiens
NALHREKQK

SEQ ID NO: 423634 - protein, 9 aa, Homo Sapiens
TSKKNKRPA

SEQ ID NO: 423635 - protein, 9 aa, Homo Sapiens
GCAPTHMGE

SEQ ID NO: 423636 - protein, 9 aa, Homo Sapiens
TWKRLRLHS

SEQ ID NO: 423637 - protein, 9 aa, Homo Sapiens
VQVGFVSTD

SEQ ID NO: 423638 - protein, 9 aa, Homo Sapiens
LNSHFMRLA

SEQ ID NO: 423639 - protein, 9 aa, Homo Sapiens
WSSSRRWRC

SEQ ID NO: 423640 - protein, 9 aa, Homo Sapiens
AVALFVEAN

SEQ ID NO: 423641 - protein, 9 aa, Homo Sapiens
KNQWCEELP

SEQ ID NO: 423642 - protein, 9 aa, Homo Sapiens
CLGPHGTHS

SEQ ID NO: 423643 - protein, 9 aa, Homo Sapiens
CVGADVLPV

SEQ ID NO: 423644 - protein, 9 aa, Homo Sapiens
GIIPPTGLA

SEQ ID NO: 423645 - protein, 9 aa, Homo Sapiens
NGPVAGTSL

SEQ ID NO: 423646 - protein, 9 aa, Homo Sapiens
GSLAVATAA

SEQ ID NO: 423647 - protein, 9 aa, Homo Sapiens
FVYWAAHQP

SEQ ID NO: 423648 - protein, 9 aa, Homo Sapiens
CISVKDHRT

SEQ ID NO: 423649 - protein, 9 aa, Homo Sapiens
ALVAPRGLL

SEQ ID NO: 423650 - protein, 9 aa, Homo Sapiens
QIIVNLTES

SEQ ID NO: 423651 - protein, 9 aa, Homo Sapiens
VSTDFHSMK

SEQ ID NO: 423652 - protein, 9 aa, Homo Sapiens
IGKLLYGKK

SEQ ID NO: 423653 - protein, 9 aa, Homo Sapiens
VVLDVKPQG

SEQ ID NO: 423654 - protein, 9 aa, Homo Sapiens
EKYVFVSIP

SEQ ID NO: 423655 - protein, 9 aa, Homo Sapiens
ANKNFSFLM

SEQ ID NO: 423656 - protein, 9 aa, Homo Sapiens
EFPHWTTTA

SEQ ID NO: 423657 - protein, 9 aa, Homo Sapiens
WNKINHHGR

SEQ ID NO: 423658 - protein, 9 aa, Homo Sapiens
IKRPPFFTI

SEQ ID NO: 423659 - protein, 9 aa, Homo Sapiens
YLLSVSTAV

SEQ ID NO: 423660 - protein, 9 aa, Homo Sapiens
VDDGYMPMT

SEQ ID NO: 423661 - protein, 9 aa, Homo Sapiens
HWPSRASSG

SEQ ID NO: 423662 - protein, 9 aa, Homo Sapiens
FRNFTSVTQ

SEQ ID NO: 423663 - protein, 9 aa, Homo Sapiens
MSWECCMLV

SEQ ID NO: 423664 - protein, 9 aa, Homo Sapiens
TTQRPFDIH

SEQ ID NO: 423665 - protein, 9 aa, Homo Sapiens
GAGTGGGPA

SEQ ID NO: 423666 - protein, 9 aa, Homo Sapiens
SPGHPRGSQ

SEQ ID NO: 423667 - protein, 9 aa, Homo Sapiens
THARSDKLH

SEQ ID NO: 423668 - protein, 9 aa, Homo Sapiens
HLPLKLQLR

SEQ ID NO: 423669 - protein, 9 aa, Homo Sapiens
ALDEVIEAE

SEQ ID NO: 423670 - protein, 9 aa, Homo Sapiens
QYTQTTLSS

SEQ ID NO: 423671 - protein, 9 aa, Homo Sapiens
VGLNFFFQV

SEQ ID NO: 423672 - protein, 9 aa, Homo Sapiens
LLIPRSPSP

SEQ ID NO: 423673 - protein, 9 aa, Homo Sapiens
RFCRRSGKW

SEQ ID NO: 423674 - protein, 9 aa, Homo Sapiens
VLTVIMRLQ

SEQ ID NO: 423675 - protein, 9 aa, Homo Sapiens
SNETIGSVW

SEQ ID NO: 423676 - protein, 9 aa, Homo Sapiens
PLCHAAVLN

SEQ ID NO: 423677 - protein, 9 aa, Homo Sapiens
RFHRRCWRR

SEQ ID NO: 423678 - protein, 9 aa, Homo Sapiens
TALPSDPRL

SEQ ID NO: 423679 - protein, 9 aa, Homo Sapiens
CVPVAEAST

SEQ ID NO: 423680 - protein, 9 aa, Homo Sapiens
CSAHLIAVT

SEQ ID NO: 423681 - protein, 9 aa, Homo Sapiens
HGMGELMTQ

SEQ ID NO: 423682 - protein, 9 aa, Homo Sapiens
FLAALSAGH

SEQ ID NO: 423683 - protein, 9 aa, Homo Sapiens
FRPTLPPGN

SEQ ID NO: 423684 - protein, 9 aa, Homo Sapiens
RRWAGRGPH

SEQ ID NO: 423685 - protein, 9 aa, Homo Sapiens
HIFQECSPV

SEQ ID NO: 423686 - protein, 9 aa, Homo Sapiens
WCCAETAVS

SEQ ID NO: 423687 - protein, 9 aa, Homo Sapiens
SPAWAWHWP

SEQ ID NO: 423688 - protein, 9 aa, Homo Sapiens
GPVQGHQSP

SEQ ID NO: 423689 - protein, 9 aa, Homo Sapiens
LNGQEMCAL

SEQ ID NO: 423690 - protein, 9 aa, Homo Sapiens
PWLEQMLHS

SEQ ID NO: 423691 - protein, 9 aa, Homo Sapiens
IIAITCVVW

SEQ ID NO: 423692 - protein, 9 aa, Homo Sapiens
GAQVRALVA

SEQ ID NO: 423693 - protein, 9 aa, Homo Sapiens
WSTCCCTAT

SEQ ID NO: 423694 - protein, 9 aa, Homo Sapiens
PNAVHPQRR

SEQ ID NO: 423695 - protein, 9 aa, Homo Sapiens
KSKKSSHCL

SEQ ID NO: 423696 - protein, 9 aa, Homo Sapiens
NDLHNLNLD

SEQ ID NO: 423697 - protein, 9 aa, Homo Sapiens
PKNQERSPD

SEQ ID NO: 423698 - protein, 9 aa, Homo Sapiens
SIFSLLCLL

SEQ ID NO: 423699 - protein, 9 aa, Homo Sapiens
YMDDQLFVF

SEQ ID NO: 423700 - protein, 9 aa, Homo Sapiens
CRSQSRGTF

SEQ ID NO: 423701 - protein, 9 aa, Homo Sapiens
QSNPQLREI

SEQ ID NO: 423702 - protein, 9 aa, Homo Sapiens
QEGGGTSAM

SEQ ID NO: 423703 - protein, 9 aa, Homo Sapiens
QEEPGPSTG

SEQ ID NO: 423704 - protein, 9 aa, Homo Sapiens
DVGTGKVTV

SEQ ID NO: 423705 - protein, 9 aa, Homo Sapiens
KGQTRPSLQ

SEQ ID NO: 423706 - protein, 9 aa, Homo Sapiens
IVQQMMEME

SEQ ID NO: 423707 - protein, 9 aa, Homo Sapiens
DDVVLACQV

SEQ ID NO: 423708 - protein, 9 aa, Homo Sapiens
SASSLVLPV

SEQ ID NO: 423709 - protein, 9 aa, Homo Sapiens
AGLAQVPRE

SEQ ID NO: 423710 - protein, 9 aa, Homo Sapiens
SALGPRGGG

SEQ ID NO: 423711 - protein, 9 aa, Homo Sapiens
SLLLLQLQQ

SEQ ID NO: 423712 - protein, 9 aa, Homo Sapiens
CLSTTSQPG

SEQ ID NO: 423713 - protein, 9 aa, Homo Sapiens
GCLLTAHGQ

SEQ ID NO: 423714 - protein, 9 aa, Homo Sapiens
PRARGHLVC

SEQ ID NO: 423715 - protein, 9 aa, Homo Sapiens
RPPAQIPTS

SEQ ID NO: 423716 - protein, 9 aa, Homo Sapiens
PTQKNLYQD

SEQ ID NO: 423717 - protein, 9 aa, Homo Sapiens
PPISKSEIK

SEQ ID NO: 423718 - protein, 9 aa, Homo Sapiens
RPEGYDLKD

SEQ ID NO: 423719 - protein, 9 aa, Homo Sapiens
RELEELRLE

SEQ ID NO: 423720 - protein, 9 aa, Homo Sapiens
VALLHWLSQ

SEQ ID NO: 423721 - protein, 9 aa, Homo Sapiens
RTLVLVSDC

SEQ ID NO: 423722 - protein, 9 aa, Homo Sapiens
CCFGNFIWL

SEQ ID NO: 423723 - protein, 9 aa, Homo Sapiens
IYRNLPEYK

SEQ ID NO: 423724 - protein, 9 aa, Homo Sapiens
DSGGRQDLP

SEQ ID NO: 423725 - protein, 9 aa, Homo Sapiens
CGMVCSLIH

SEQ ID NO: 423726 - protein, 9 aa, Homo Sapiens
GNVESGGPH

SEQ ID NO: 423727 - protein, 9 aa, Homo Sapiens
QSQSSTSIL

SEQ ID NO: 423728 - protein, 9 aa, Homo Sapiens
LYVPNQKVK

SEQ ID NO: 423729 - protein, 9 aa, Homo Sapiens
RPGQTCQCR

SEQ ID NO: 423730 - protein, 9 aa, Homo Sapiens
QDKNSFFIM

SEQ ID NO: 423731 - protein, 9 aa, Homo Sapiens
RRQWGSFPL

SEQ ID NO: 423732 - protein, 9 aa, Homo Sapiens
SGESTSTGS

SEQ ID NO: 423733 - protein, 9 aa, Homo Sapiens
LKALQMKRW

SEQ ID NO: 423734 - protein, 9 aa, Homo Sapiens
QSAVEQVVK

SEQ ID NO: 423735 - protein, 9 aa, Homo Sapiens
LQVILEVTS

SEQ ID NO: 423736 - protein, 9 aa, Homo Sapiens
TTMDLFHPM

SEQ ID NO: 423737 - protein, 9 aa, Homo Sapiens
LQPAMQALV

SEQ ID NO: 423738 - protein, 9 aa, Homo Sapiens
VPGNIGAPR

SEQ ID NO: 423739 - protein, 9 aa, Homo Sapiens
RPRFRWEVE

SEQ ID NO: 423740 - protein, 9 aa, Homo Sapiens
MATLERQTL

SEQ ID NO: 423741 - protein, 9 aa, Homo Sapiens
RMNNIKPDL

SEQ ID NO: 423742 - protein, 9 aa, Homo Sapiens
EFRKWYSTK

SEQ ID NO: 423743 - protein, 9 aa, Homo Sapiens
EHQSFWKEP

SEQ ID NO: 423744 - protein, 9 aa, Homo Sapiens
RPKGAKGDS

SEQ ID NO: 423745 - protein, 9 aa, Homo Sapiens
RPLRSHTIS

SEQ ID NO: 423746 - protein, 9 aa, Homo Sapiens
DKKNGIWEV

SEQ ID NO: 423747 - protein, 9 aa, Homo Sapiens
VASVVVLYS

SEQ ID NO: 423748 - protein, 9 aa, Homo Sapiens
RDWAFVPTP

SEQ ID NO: 423749 - protein, 9 aa, Homo Sapiens
RRQWGSFPQ

SEQ ID NO: 423750 - protein, 9 aa, Homo Sapiens
VVGKRKTKL

SEQ ID NO: 423751 - protein, 9 aa, Homo Sapiens
HLLGPRPLP

SEQ ID NO: 423752 - protein, 9 aa, Homo Sapiens
DTPRSERKW

SEQ ID NO: 423753 - protein, 9 aa, Homo Sapiens
MPETYQAQL

SEQ ID NO: 423754 - protein, 9 aa, Homo Sapiens
HVSAAGALL

SEQ ID NO: 423755 - protein, 9 aa, Homo Sapiens
PANIFLRPR

SEQ ID NO: 423756 - protein, 9 aa, Homo Sapiens
ESCVALECK

SEQ ID NO: 423757 - protein, 9 aa, Homo Sapiens
SQEPPAILD

SEQ ID NO: 423758 - protein, 9 aa, Homo Sapiens
FVATWAVSH

SEQ ID NO: 423759 - protein, 9 aa, Homo Sapiens
RSGPATWRC

SEQ ID NO: 423760 - protein, 9 aa, Homo Sapiens
RDPLSWSKT

SEQ ID NO: 423761 - protein, 9 aa, Homo Sapiens
RIGKTSCAR

SEQ ID NO: 423762 - protein, 9 aa, Homo Sapiens
GGPACVPVA

SEQ ID NO: 423763 - protein, 9 aa, Homo Sapiens
EFRPVDCAD

SEQ ID NO: 423764 - protein, 9 aa, Homo Sapiens
LHDYQELMN

SEQ ID NO: 423765 - protein, 9 aa, Homo Sapiens
VSWSATAQR

SEQ ID NO: 423766 - protein, 9 aa, Homo Sapiens
SSVKFTSGN

SEQ ID NO: 423767 - protein, 9 aa, Homo Sapiens
YSQQIFWPC

SEQ ID NO: 423768 - protein, 9 aa, Homo Sapiens
FISDESRRD

SEQ ID NO: 423769 - protein, 9 aa, Homo Sapiens
VLPALSSWS

SEQ ID NO: 423770 - protein, 9 aa, Homo Sapiens
LTFIYSVVC

SEQ ID NO: 423771 - protein, 9 aa, Homo Sapiens
TQVQYILPM

SEQ ID NO: 423772 - protein, 9 aa, Homo Sapiens
WENVELRGQ

SEQ ID NO: 423773 - protein, 9 aa, Homo Sapiens
AHAFGPAVV

SEQ ID NO: 423774 - protein, 9 aa, Homo Sapiens
ARSFVRGQS

SEQ ID NO: 423775 - protein, 9 aa, Homo Sapiens
PWSPSPRAV

SEQ ID NO: 423776 - protein, 9 aa, Homo Sapiens
WDSAGATHF

SEQ ID NO: 423777 - protein, 9 aa, Homo Sapiens
SAVAAHQDQ

SEQ ID NO: 423778 - protein, 9 aa, Homo Sapiens
SLQWNMMAS

SEQ ID NO: 423779 - protein, 9 aa, Homo Sapiens
PRFGHFTSF

SEQ ID NO: 423780 - protein, 9 aa, Homo Sapiens
QGHQSPVQL

SEQ ID NO: 423781 - protein, 9 aa, Homo Sapiens
VKKCKTSML

SEQ ID NO: 423782 - protein, 9 aa, Homo Sapiens
AGSMDCVCY

SEQ ID NO: 423783 - protein, 9 aa, Homo Sapiens
GPTEESPPV

SEQ ID NO: 423784 - protein, 9 aa, Homo Sapiens
DGTSYKLTD

SEQ ID NO: 423785 - protein, 9 aa, Homo Sapiens
TSATMGCLL

SEQ ID NO: 423786 - protein, 9 aa, Homo Sapiens
SRQSSLATQ

SEQ ID NO: 423787 - protein, 9 aa, Homo Sapiens
RASSSCCQQ

SEQ ID NO: 423788 - protein, 9 aa, Homo Sapiens
APPHPPSSG

SEQ ID NO: 423789 - protein, 9 aa, Homo Sapiens
QGEVALSDA

SEQ ID NO: 423790 - protein, 9 aa, Homo Sapiens
TESAQDTYM

SEQ ID NO: 423791 - protein, 9 aa, Homo Sapiens
SCRLYQFHY

SEQ ID NO: 423792 - protein, 9 aa, Homo Sapiens
YRVNLHTRR

SEQ ID NO: 423793 - protein, 9 aa, Homo Sapiens
NVVVPSMIN

SEQ ID NO: 423794 - protein, 9 aa, Homo Sapiens
ESFKRYEEL

SEQ ID NO: 423795 - protein, 9 aa, Homo Sapiens
VPHPGLELP

SEQ ID NO: 423796 - protein, 9 aa, Homo Sapiens
GGALSSHGS

SEQ ID NO: 423797 - protein, 9 aa, Homo Sapiens
MSDLSIPSA

SEQ ID NO: 423798 - protein, 9 aa, Homo Sapiens
DAQAIQNPQ

SEQ ID NO: 423799 - protein, 9 aa, Homo Sapiens
GYRKRGSKP

SEQ ID NO: 423800 - protein, 9 aa, Homo Sapiens
ENEPTATRK

SEQ ID NO: 423801 - protein, 9 aa, Homo Sapiens
PTPTPTVVT

SEQ ID NO: 423802 - protein, 9 aa, Homo Sapiens
YVMVVMSDL

SEQ ID NO: 423803 - protein, 9 aa, Homo Sapiens
VPEVQLPEV

SEQ ID NO: 423804 - protein, 9 aa, Homo Sapiens
HVRHVRSRE

SEQ ID NO: 423805 - protein, 9 aa, Homo Sapiens
AEIREIPFL

SEQ ID NO: 423806 - protein, 9 aa, Homo Sapiens
LTSATMGCL

SEQ ID NO: 423807 - protein, 9 aa, Homo Sapiens
MIMIAKNWK

SEQ ID NO: 423808 - protein, 9 aa, Homo Sapiens
EHAQQNGLD

SEQ ID NO: 423809 - protein, 9 aa, Homo Sapiens
AQDDGRGGS

SEQ ID NO: 423810 - protein, 9 aa, Homo Sapiens
AICVPVLRL

SEQ ID NO: 423811 - protein, 9 aa, Homo Sapiens
HKKQAQVEA

SEQ ID NO: 423812 - protein, 9 aa, Homo Sapiens
PDDARKKVP

SEQ ID NO: 423813 - protein, 9 aa, Homo Sapiens
SVKDVCTTK

SEQ ID NO: 423814 - protein, 9 aa, Homo Sapiens
RGDNDDGGG

SEQ ID NO: 423815 - protein, 9 aa, Homo Sapiens
VTVLRVWVR

SEQ ID NO: 423816 - protein, 9 aa, Homo Sapiens
HRDARQLQA

SEQ ID NO: 423817 - protein, 9 aa, Homo Sapiens
SESAWRRRA

SEQ ID NO: 423818 - protein, 9 aa, Homo Sapiens
EARQVEFVR

SEQ ID NO: 423819 - protein, 9 aa, Homo Sapiens
DTHDQELFF

SEQ ID NO: 423820 - protein, 9 aa, Homo Sapiens
VLEIIEHPF

SEQ ID NO: 423821 - protein, 9 aa, Homo Sapiens
RQEVRGSPE

SEQ ID NO: 423822 - protein, 9 aa, Homo Sapiens
SMVVSPFME

SEQ ID NO: 423823 - protein, 9 aa, Homo Sapiens
RFSPLPVGG

SEQ ID NO: 423824 - protein, 9 aa, Homo Sapiens
QEPFKVWLH

SEQ ID NO: 423825 - protein, 9 aa, Homo Sapiens
INLGNNALR

SEQ ID NO: 423826 - protein, 9 aa, Homo Sapiens
SSTKDRLLA

SEQ ID NO: 423827 - protein, 9 aa, Homo Sapiens
MELAVAHRE

SEQ ID NO: 423828 - protein, 9 aa, Homo Sapiens
PERGGVWTG

SEQ ID NO: 423829 - protein, 9 aa, Homo Sapiens
RGSMHFALH

SEQ ID NO: 423830 - protein, 9 aa, Homo Sapiens
GRSSPTDLA

SEQ ID NO: 423831 - protein, 9 aa, Homo Sapiens
ELFFLPLVF

SEQ ID NO: 423832 - protein, 9 aa, Homo Sapiens
LFTELNEIC

SEQ ID NO: 423833 - protein, 9 aa, Homo Sapiens
VKESLAQPV

SEQ ID NO: 423834 - protein, 9 aa, Homo Sapiens
CSQTHSQLA

SEQ ID NO: 423835 - protein, 9 aa, Homo Sapiens
SISRESPWE

SEQ ID NO: 423836 - protein, 9 aa, Homo Sapiens
QVNMTDVST

SEQ ID NO: 423837 - protein, 9 aa, Homo Sapiens
TASSWPMHP

SEQ ID NO: 423838 - protein, 9 aa, Homo Sapiens
IQNPQAPEA

SEQ ID NO: 423839 - protein, 9 aa, Homo Sapiens
QVELDVQEL

SEQ ID NO: 423840 - protein, 9 aa, Homo Sapiens
IKPKDEAAL

SEQ ID NO: 423841 - protein, 9 aa, Homo Sapiens
IPDGFLPIF

SEQ ID NO: 423842 - protein, 9 aa, Homo Sapiens
CSQYAQGYE

SEQ ID NO: 423843 - protein, 9 aa, Homo Sapiens
SLQCHLAKL

SEQ ID NO: 423844 - protein, 9 aa, Homo Sapiens
TCLVAMEPQ

SEQ ID NO: 423845 - protein, 9 aa, Homo Sapiens
LYLWIWQEW

SEQ ID NO: 423846 - protein, 9 aa, Homo Sapiens
YPPSTCSLP

SEQ ID NO: 423847 - protein, 9 aa, Homo Sapiens
AGTGGGPAC

SEQ ID NO: 423848 - protein, 9 aa, Homo Sapiens
QPPCLEAEG

SEQ ID NO: 423849 - protein, 9 aa, Homo Sapiens
GTTSHHMSS

SEQ ID NO: 423850 - protein, 9 aa, Homo Sapiens
DLYLVPDNA

SEQ ID NO: 423851 - protein, 9 aa, Homo Sapiens
RAARDNKVR

SEQ ID NO: 423852 - protein, 9 aa, Homo Sapiens
AAPAAREEP

SEQ ID NO: 423853 - protein, 9 aa, Homo Sapiens
EQHPLGVTK

SEQ ID NO: 423854 - protein, 9 aa, Homo Sapiens
NTYQKMPKV

SEQ ID NO: 423855 - protein, 9 aa, Homo Sapiens
TMGGDFSGM

SEQ ID NO: 423856 - protein, 9 aa, Homo Sapiens
KAFKAFSSE

SEQ ID NO: 423857 - protein, 9 aa, Homo Sapiens
QASYFYAAS

SEQ ID NO: 423858 - protein, 9 aa, Homo Sapiens
CSTMSCLSR

SEQ ID NO: 423859 - protein, 9 aa, Homo Sapiens
ILRSATVRK

SEQ ID NO: 423860 - protein, 9 aa, Homo Sapiens
SVGTSAVPI

SEQ ID NO: 423861 - protein, 9 aa, Homo Sapiens
DEDGVSAEH

SEQ ID NO: 423862 - protein, 9 aa, Homo Sapiens
GHEETAQTI

SEQ ID NO: 423863 - protein, 9 aa, Homo Sapiens
IQEGRYCHP

SEQ ID NO: 423864 - protein, 9 aa, Homo Sapiens
APLPHCSHT

SEQ ID NO: 423865 - protein, 9 aa, Homo Sapiens
GGSAFVAQI

SEQ ID NO: 423866 - protein, 9 aa, Homo Sapiens
NPRKKHKRL

SEQ ID NO: 423867 - protein, 9 aa, Homo Sapiens
IWLPSNIYT

SEQ ID NO: 423868 - protein, 9 aa, Homo Sapiens
HPQLQPLTG

SEQ ID NO: 423869 - protein, 9 aa, Homo Sapiens
AVTIGQVHS

SEQ ID NO: 423870 - protein, 9 aa, Homo Sapiens
WLSLFYLWL

SEQ ID NO: 423871 - protein, 9 aa, Homo Sapiens
SPWSPSPRA

SEQ ID NO: 423872 - protein, 9 aa, Homo Sapiens
RLRVHSQQP

SEQ ID NO: 423873 - protein, 9 aa, Homo Sapiens
LKEIVLVDD

SEQ ID NO: 423874 - protein, 9 aa, Homo Sapiens
WMLQQPCQL

SEQ ID NO: 423875 - protein, 9 aa, Homo Sapiens
APRHPHRSP

SEQ ID NO: 423876 - protein, 9 aa, Homo Sapiens
ITECVRTAL

SEQ ID NO: 423877 - protein, 9 aa, Homo Sapiens
LEHAGARLQ

SEQ ID NO: 423878 - protein, 9 aa, Homo Sapiens
EGESVCNAC

SEQ ID NO: 423879 - protein, 9 aa, Homo Sapiens
LQRMHHQQQ

SEQ ID NO: 423880 - protein, 9 aa, Homo Sapiens
VLMSHKICW

SEQ ID NO: 423881 - protein, 9 aa, Homo Sapiens
CGAGSHLPA

SEQ ID NO: 423882 - protein, 9 aa, Homo Sapiens
FSQLICMKH

SEQ ID NO: 423883 - protein, 9 aa, Homo Sapiens
ELIHNHFSL

SEQ ID NO: 423884 - protein, 9 aa, Homo Sapiens
AGVPRTNPV

SEQ ID NO: 423885 - protein, 9 aa, Homo Sapiens
QGCLLSLLD

SEQ ID NO: 423886 - protein, 9 aa, Homo Sapiens
PGRRRARPG

SEQ ID NO: 423887 - protein, 9 aa, Homo Sapiens
EGTHARSDK

SEQ ID NO: 423888 - protein, 9 aa, Homo Sapiens
AATQDFFTP

SEQ ID NO: 423889 - protein, 9 aa, Homo Sapiens
AYHLASSSP

SEQ ID NO: 423890 - protein, 9 aa, Homo Sapiens
LRVSPVRNS

SEQ ID NO: 423891 - protein, 9 aa, Homo Sapiens
LYLLAFKKS

SEQ ID NO: 423892 - protein, 9 aa, Homo Sapiens
VNYTRTEDF

SEQ ID NO: 423893 - protein, 9 aa, Homo Sapiens
RYDMSLGLL

SEQ ID NO: 423894 - protein, 9 aa, Homo Sapiens
ISSEEFAAD

SEQ ID NO: 423895 - protein, 9 aa, Homo Sapiens
KLCGLKRKW

SEQ ID NO: 423896 - protein, 9 aa, Homo Sapiens
LVDGLNGLM

SEQ ID NO: 423897 - protein, 9 aa, Homo Sapiens
GAGSGTSAG

SEQ ID NO: 423898 - protein, 9 aa, Homo Sapiens
LQGPDLSLD

SEQ ID NO: 423899 - protein, 9 aa, Homo Sapiens
RVIGYHVMV

SEQ ID NO: 423900 - protein, 9 aa, Homo Sapiens
GAMLMVIRL

SEQ ID NO: 423901 - protein, 9 aa, Homo Sapiens
DCEASVTAE

SEQ ID NO: 423902 - protein, 9 aa, Homo Sapiens
TAGGGGSWS

SEQ ID NO: 423903 - protein, 9 aa, Homo Sapiens
ACTRPQSTC

SEQ ID NO: 423904 - protein, 9 aa, Homo Sapiens
SATHPQEGR

SEQ ID NO: 423905 - protein, 9 aa, Homo Sapiens
GGRRGAPGH

SEQ ID NO: 423906 - protein, 9 aa, Homo Sapiens
SSKTNMHAQ

SEQ ID NO: 423907 - protein, 9 aa, Homo Sapiens
RSHCQMSCV

SEQ ID NO: 423908 - protein, 9 aa, Homo Sapiens
FKQIRNLHN

SEQ ID NO: 423909 - protein, 9 aa, Homo Sapiens
RTSVVSEET

SEQ ID NO: 423910 - protein, 9 aa, Homo Sapiens
AVATAATNG

SEQ ID NO: 423911 - protein, 9 aa, Homo Sapiens
FPVSSGVLQ

SEQ ID NO: 423912 - protein, 9 aa, Homo Sapiens
KLGLGQLLS

SEQ ID NO: 423913 - protein, 9 aa, Homo Sapiens
VPVLSSLHR

SEQ ID NO: 423914 - protein, 9 aa, Homo Sapiens
IENGVNMQY

SEQ ID NO: 423915 - protein, 9 aa, Homo Sapiens
HYYPPILRS

SEQ ID NO: 423916 - protein, 9 aa, Homo Sapiens
WCNVVCWEF

SEQ ID NO: 423917 - protein, 9 aa, Homo Sapiens
AQVEVIQSG

SEQ ID NO: 423918 - protein, 9 aa, Homo Sapiens
ATCPWTTHL

SEQ ID NO: 423919 - protein, 9 aa, Homo Sapiens
LLHCAHLAK

SEQ ID NO: 423920 - protein, 9 aa, Homo Sapiens
HLLDDGCVH

SEQ ID NO: 423921 - protein, 9 aa, Homo Sapiens
RHRFSCISR

SEQ ID NO: 423922 - protein, 9 aa, Homo Sapiens
TRMFIPAAA

SEQ ID NO: 423923 - protein, 9 aa, Homo Sapiens
SGSAAPRCW

SEQ ID NO: 423924 - protein, 9 aa, Homo Sapiens
SLHLLLICD

SEQ ID NO: 423925 - protein, 9 aa, Homo Sapiens
AKAPLSRSA

SEQ ID NO: 423926 - protein, 9 aa, Homo Sapiens
KYDREPQRR

SEQ ID NO: 423927 - protein, 9 aa, Homo Sapiens
TKLKLYHLN

SEQ ID NO: 423928 - protein, 9 aa, Homo Sapiens
GPEPGEPGQ

SEQ ID NO: 423929 - protein, 9 aa, Homo Sapiens
AIQNPQAPE

SEQ ID NO: 423930 - protein, 9 aa, Homo Sapiens
EMNNKLAEV

SEQ ID NO: 423931 - protein, 9 aa, Homo Sapiens
SLQLLDTAG

SEQ ID NO: 423932 - protein, 9 aa, Homo Sapiens
VLFRQRSCI

SEQ ID NO: 423933 - protein, 9 aa, Homo Sapiens
SDKGDCHIF

SEQ ID NO: 423934 - protein, 9 aa, Homo Sapiens
PRCLGPHGT

SEQ ID NO: 423935 - protein, 9 aa, Homo Sapiens
PRTNPVLNN

SEQ ID NO: 423936 - protein, 9 aa, Homo Sapiens
NVEGVDSTK

SEQ ID NO: 423937 - protein, 9 aa, Homo Sapiens
SVDALWIEN

SEQ ID NO: 423938 - protein, 9 aa, Homo Sapiens
PSFPAQPPA

SEQ ID NO: 423939 - protein, 9 aa, Homo Sapiens
QEVEVVWTV

SEQ ID NO: 423940 - protein, 9 aa, Homo Sapiens
PLPGAGDQG

SEQ ID NO: 423941 - protein, 9 aa, Homo Sapiens
LLIILFIIM

SEQ ID NO: 423942 - protein, 9 aa, Homo Sapiens
RLLWICSQA

SEQ ID NO: 423943 - protein, 9 aa, Homo Sapiens
VSLGKTNEQ

SEQ ID NO: 423944 - protein, 9 aa, Homo Sapiens
GHMLMPDAM

SEQ ID NO: 423945 - protein, 9 aa, Homo Sapiens
PAPGSSSER

SEQ ID NO: 423946 - protein, 9 aa, Homo Sapiens
TSTISASFM

SEQ ID NO: 423947 - protein, 9 aa, Homo Sapiens
SQNSHASLR

SEQ ID NO: 423948 - protein, 9 aa, Homo Sapiens
EVSVAQGTT

SEQ ID NO: 423949 - protein, 9 aa, Homo Sapiens
AGRGPHWRG

SEQ ID NO: 423950 - protein, 9 aa, Homo Sapiens
KVEIEMDYS

SEQ ID NO: 423951 - protein, 9 aa, Homo Sapiens
ASTRTHGAP

SEQ ID NO: 423952 - protein, 9 aa, Homo Sapiens
VGNLVSYVH

SEQ ID NO: 423953 - protein, 9 aa, Homo Sapiens
GLPDRQIPG

SEQ ID NO: 423954 - protein, 9 aa, Homo Sapiens
ATLSPGEAR

SEQ ID NO: 423955 - protein, 9 aa, Homo Sapiens
PGRTGSSSS

SEQ ID NO: 423956 - protein, 9 aa, Homo Sapiens
SSSVVMMVN

SEQ ID NO: 423957 - protein, 9 aa, Homo Sapiens
GAGLEAEAA

SEQ ID NO: 423958 - protein, 9 aa, Homo Sapiens
TRWSACLST

SEQ ID NO: 423959 - protein, 9 aa, Homo Sapiens
LRLWEGPVQ

SEQ ID NO: 423960 - protein, 9 aa, Homo Sapiens
RGWTACART

SEQ ID NO: 423961 - protein, 9 aa, Homo Sapiens
RMCSGPSTQ

SEQ ID NO: 423962 - protein, 9 aa, Homo Sapiens
APFAPSLWL

SEQ ID NO: 423963 - protein, 9 aa, Homo Sapiens
NTKSYPPPP

SEQ ID NO: 423964 - protein, 9 aa, Homo Sapiens
LEANKNFSF

SEQ ID NO: 423965 - protein, 9 aa, Homo Sapiens
VVVPSMINY

SEQ ID NO: 423966 - protein, 9 aa, Homo Sapiens
RWSETFWGY

SEQ ID NO: 423967 - protein, 9 aa, Homo Sapiens
IVDPQGWRD

SEQ ID NO: 423968 - protein, 9 aa, Homo Sapiens
VAGIFIAIS

SEQ ID NO: 423969 - protein, 9 aa, Homo Sapiens
HLQAAVTFV

SEQ ID NO: 423970 - protein, 9 aa, Homo Sapiens
GGLGGHGQG

SEQ ID NO: 423971 - protein, 9 aa, Homo Sapiens
VMVRVGSCV

SEQ ID NO: 423972 - protein, 9 aa, Homo Sapiens
LSPQLCRPP

SEQ ID NO: 423973 - protein, 9 aa, Homo Sapiens
RTSQNHSKC

SEQ ID NO: 423974 - protein, 9 aa, Homo Sapiens
QESQVCEKH

SEQ ID NO: 423975 - protein, 9 aa, Homo Sapiens
CTTIHLHLC

SEQ ID NO: 423976 - protein, 9 aa, Homo Sapiens
SVHPRAPPR

SEQ ID NO: 423977 - protein, 9 aa, Homo Sapiens
LRILEQKFM

SEQ ID NO: 423978 - protein, 9 aa, Homo Sapiens
QGRNLADLC

SEQ ID NO: 423979 - protein, 9 aa, Homo Sapiens
VTSEEPAGL

SEQ ID NO: 423980 - protein, 9 aa, Homo Sapiens
LIHNHFSLF

SEQ ID NO: 423981 - protein, 9 aa, Homo Sapiens
VLGGEDSGG

SEQ ID NO: 423982 - protein, 9 aa, Homo Sapiens
RAMKNRSRI

SEQ ID NO: 423983 - protein, 9 aa, Homo Sapiens
WSGAWTTTL

SEQ ID NO: 423984 - protein, 9 aa, Homo Sapiens
RLTWVCRRP

SEQ ID NO: 423985 - protein, 9 aa, Homo Sapiens
RRLPQCGAG

SEQ ID NO: 423986 - protein, 9 aa, Homo Sapiens
IEVSHLGNI

SEQ ID NO: 423987 - protein, 9 aa, Homo Sapiens
NFLRKFPLK

SEQ ID NO: 423988 - protein, 9 aa, Homo Sapiens
LFFLSSSPV

SEQ ID NO: 423989 - protein, 9 aa, Homo Sapiens
EKHTIKLTF

SEQ ID NO: 423990 - protein, 9 aa, Homo Sapiens
SHTGSAGSA

SEQ ID NO: 423991 - protein, 9 aa, Homo Sapiens
SGQELVDGI

SEQ ID NO: 423992 - protein, 9 aa, Homo Sapiens
KEVVGKRKT

SEQ ID NO: 423993 - protein, 9 aa, Homo Sapiens
RALSALLPR

SEQ ID NO: 423994 - protein, 9 aa, Homo Sapiens
AIGGGVARV

SEQ ID NO: 423995 - protein, 9 aa, Homo Sapiens
IQVATYSDC

SEQ ID NO: 423996 - protein, 9 aa, Homo Sapiens
LGKGSYWTL

SEQ ID NO: 423997 - protein, 9 aa, Homo Sapiens
KMPKVLPGT

SEQ ID NO: 423998 - protein, 9 aa, Homo Sapiens
KREQLMPHY

SEQ ID NO: 423999 - protein, 9 aa, Homo Sapiens
GLFLFTFLF

SEQ ID NO: 424000 - protein, 9 aa, Homo Sapiens
ERDGAGSPA

SEQ ID NO: 424001 - protein, 9 aa, Homo Sapiens
STPPPPGAP

SEQ ID NO: 424002 - protein, 9 aa, Homo Sapiens
KRYQALKRT

SEQ ID NO: 424003 - protein, 9 aa, Homo Sapiens
WVTDFRVGL

SEQ ID NO: 424004 - protein, 9 aa, Homo Sapiens
HRGLRVMLE

SEQ ID NO: 424005 - protein, 9 aa, Homo Sapiens
GKPDVTVYD

SEQ ID NO: 424006 - protein, 9 aa, Homo Sapiens
FPLPRAGAG

SEQ ID NO: 424007 - protein, 9 aa, Homo Sapiens
TFRVTFDVE

SEQ ID NO: 424008 - protein, 9 aa, Homo Sapiens
TKIYHCSQT

SEQ ID NO: 424009 - protein, 9 aa, Homo Sapiens
AVSLKQDGD

SEQ ID NO: 424010 - protein, 9 aa, Homo Sapiens
ALEKDEGED

SEQ ID NO: 424011 - protein, 9 aa, Homo Sapiens
TLTSDVSSM

SEQ ID NO: 424012 - protein, 9 aa, Homo Sapiens
APASSHPLV

SEQ ID NO: 424013 - protein, 9 aa, Homo Sapiens
DLEARVVPR

SEQ ID NO: 424014 - protein, 9 aa, Homo Sapiens
ASSGCTRCT

SEQ ID NO: 424015 - protein, 9 aa, Homo Sapiens
RDTELRQHR

SEQ ID NO: 424016 - protein, 9 aa, Homo Sapiens
PGGPPPAGC

SEQ ID NO: 424017 - protein, 9 aa, Homo Sapiens
LRGRLGSGW

SEQ ID NO: 424018 - protein, 9 aa, Homo Sapiens
RKWKCTLGV

SEQ ID NO: 424019 - protein, 9 aa, Homo Sapiens
CSGPGGGLV

SEQ ID NO: 424020 - protein, 9 aa, Homo Sapiens
ETRGLNISC

SEQ ID NO: 424021 - protein, 9 aa, Homo Sapiens
VVGQVGCRK

SEQ ID NO: 424022 - protein, 9 aa, Homo Sapiens
LQAANEDIR

SEQ ID NO: 424023 - protein, 9 aa, Homo Sapiens
ISASFMQYT

SEQ ID NO: 424024 - protein, 9 aa, Homo Sapiens
RGIRLGVHP

SEQ ID NO: 424025 - protein, 9 aa, Homo Sapiens
LRGELHFDI

SEQ ID NO: 424026 - protein, 9 aa, Homo Sapiens
PILRSATVR

SEQ ID NO: 424027 - protein, 9 aa, Homo Sapiens
RSFVRGQSR

SEQ ID NO: 424028 - protein, 9 aa, Homo Sapiens
DDTRVHTDI

SEQ ID NO: 424029 - protein, 9 aa, Homo Sapiens
NDFCVIYVH

SEQ ID NO: 424030 - protein, 9 aa, Homo Sapiens
EFDLVCVNV

SEQ ID NO: 424031 - protein, 9 aa, Homo Sapiens
TLAKNKPNL

SEQ ID NO: 424032 - protein, 9 aa, Homo Sapiens
LMRPLRTAP

SEQ ID NO: 424033 - protein, 9 aa, Homo Sapiens
VIHNSMCIT

SEQ ID NO: 424034 - protein, 9 aa, Homo Sapiens
NSPDKTLQF

SEQ ID NO: 424035 - protein, 9 aa, Homo Sapiens
NRAFRRGTE

SEQ ID NO: 424036 - protein, 9 aa, Homo Sapiens
AAGRHPGAQ

SEQ ID NO: 424037 - protein, 9 aa, Homo Sapiens
GCPRARCAR

SEQ ID NO: 424038 - protein, 9 aa, Homo Sapiens
VSGCGRAPA

SEQ ID NO: 424039 - protein, 9 aa, Homo Sapiens
SGRGGRDHF

SEQ ID NO: 424040 - protein, 9 aa, Homo Sapiens
TMRGLQQWV

SEQ ID NO: 424041 - protein, 9 aa, Homo Sapiens
GAPGHPGVG

SEQ ID NO: 424042 - protein, 9 aa, Homo Sapiens
PPDWECRIR

SEQ ID NO: 424043 - protein, 9 aa, Homo Sapiens
HGHEHGYHK

SEQ ID NO: 424044 - protein, 9 aa, Homo Sapiens
VTAETTVSS

SEQ ID NO: 424045 - protein, 9 aa, Homo Sapiens
PLSPGATLT

SEQ ID NO: 424046 - protein, 9 aa, Homo Sapiens
EKVSKKDSQ

SEQ ID NO: 424047 - protein, 9 aa, Homo Sapiens
RATAAGRHP

SEQ ID NO: 424048 - protein, 9 aa, Homo Sapiens
APARMGHRV

SEQ ID NO: 424049 - protein, 9 aa, Homo Sapiens
SKAWTPRKL

SEQ ID NO: 424050 - protein, 9 aa, Homo Sapiens
MCEADTLRP

SEQ ID NO: 424051 - protein, 9 aa, Homo Sapiens
NLEADMEWL

SEQ ID NO: 424052 - protein, 9 aa, Homo Sapiens
ATYSDCCLA

SEQ ID NO: 424053 - protein, 9 aa, Homo Sapiens
VRIQEGRYC

SEQ ID NO: 424054 - protein, 9 aa, Homo Sapiens
KVSLRHPRK

SEQ ID NO: 424055 - protein, 9 aa, Homo Sapiens
LSSCGWAPF

SEQ ID NO: 424056 - protein, 9 aa, Homo Sapiens
SLAWERTPL

SEQ ID NO: 424057 - protein, 9 aa, Homo Sapiens
CHAAVLNNT

SEQ ID NO: 424058 - protein, 9 aa, Homo Sapiens
GQRRMRITV

SEQ ID NO: 424059 - protein, 9 aa, Homo Sapiens
TAQKQRKHG

SEQ ID NO: 424060 - protein, 9 aa, Homo Sapiens
MCIVGRLTW

SEQ ID NO: 424061 - protein, 9 aa, Homo Sapiens
AYNQTHLYT

SEQ ID NO: 424062 - protein, 9 aa, Homo Sapiens
LLHQPLPGQ

SEQ ID NO: 424063 - protein, 9 aa, Homo Sapiens
HIQCEGGSF

SEQ ID NO: 424064 - protein, 9 aa, Homo Sapiens
QVWTAATLR

SEQ ID NO: 424065 - protein, 9 aa, Homo Sapiens
PSCHPLPQL

SEQ ID NO: 424066 - protein, 9 aa, Homo Sapiens
RGLLQDHGS

SEQ ID NO: 424067 - protein, 9 aa, Homo Sapiens
WGQRHHPGK

SEQ ID NO: 424068 - protein, 9 aa, Homo Sapiens
VMPQMVTHY

SEQ ID NO: 424069 - protein, 9 aa, Homo Sapiens
APATPRGRP

SEQ ID NO: 424070 - protein, 9 aa, Homo Sapiens
RVCWEFVTD

SEQ ID NO: 424071 - protein, 9 aa, Homo Sapiens
ALPDEQTAA

SEQ ID NO: 424072 - protein, 9 aa, Homo Sapiens
LAALFMSQC

SEQ ID NO: 424073 - protein, 9 aa, Homo Sapiens
GTCCLPVGG

SEQ ID NO: 424074 - protein, 9 aa, Homo Sapiens
FFRISLFLG

SEQ ID NO: 424075 - protein, 9 aa, Homo Sapiens
LIGAKSKWL

SEQ ID NO: 424076 - protein, 9 aa, Homo Sapiens
MYIVTQTAD

SEQ ID NO: 424077 - protein, 9 aa, Homo Sapiens
DMVDDNGVW

SEQ ID NO: 424078 - protein, 9 aa, Homo Sapiens
ADLPEGEKN

SEQ ID NO: 424079 - protein, 9 aa, Homo Sapiens
LILSVKRWL

SEQ ID NO: 424080 - protein, 9 aa, Homo Sapiens
MPPMEPAGV

SEQ ID NO: 424081 - protein, 9 aa, Homo Sapiens
ISRIIQMYL

SEQ ID NO: 424082 - protein, 9 aa, Homo Sapiens
DVRKNHHKT

SEQ ID NO: 424083 - protein, 9 aa, Homo Sapiens
WKALGPMLS

SEQ ID NO: 424084 - protein, 9 aa, Homo Sapiens
NKPNLHTDL

SEQ ID NO: 424085 - protein, 9 aa, Homo Sapiens
PEELVRQTW

SEQ ID NO: 424086 - protein, 9 aa, Homo Sapiens
HQDQVDILT

SEQ ID NO: 424087 - protein, 9 aa, Homo Sapiens
SPLLCRKDG

SEQ ID NO: 424088 - protein, 9 aa, Homo Sapiens
PPPCRCCSL

SEQ ID NO: 424089 - protein, 9 aa, Homo Sapiens
SAWRRRAAT

SEQ ID NO: 424090 - protein, 9 aa, Homo Sapiens
QENLKMDLV

SEQ ID NO: 424091 - protein, 9 aa, Homo Sapiens
GYLFPHSTH

SEQ ID NO: 424092 - protein, 9 aa, Homo Sapiens
CAIHAERVT

SEQ ID NO: 424093 - protein, 9 aa, Homo Sapiens
SLLGRKEQL

SEQ ID NO: 424094 - protein, 9 aa, Homo Sapiens
NYSGDLATG

SEQ ID NO: 424095 - protein, 9 aa, Homo Sapiens
KWDPQELLH

SEQ ID NO: 424096 - protein, 9 aa, Homo Sapiens
GPHWRGALG

SEQ ID NO: 424097 - protein, 9 aa, Homo Sapiens
GSDPARWWQ

SEQ ID NO: 424098 - protein, 9 aa, Homo Sapiens
VVGCAPTHM

SEQ ID NO: 424099 - protein, 9 aa, Homo Sapiens
TDVPSNCQE

SEQ ID NO: 424100 - protein, 9 aa, Homo Sapiens
GTQEAVIAQ

SEQ ID NO: 424101 - protein, 9 aa, Homo Sapiens
GPRRCPEEA

SEQ ID NO: 424102 - protein, 9 aa, Homo Sapiens
ILEQKFMLY

SEQ ID NO: 424103 - protein, 9 aa, Homo Sapiens
SWCITGFLD

SEQ ID NO: 424104 - protein, 9 aa, Homo Sapiens
WESNRRTDV

SEQ ID NO: 424105 - protein, 9 aa, Homo Sapiens
QRIDLLTFK

SEQ ID NO: 424106 - protein, 9 aa, Homo Sapiens
NVESGGPHL

SEQ ID NO: 424107 - protein, 9 aa, Homo Sapiens
RRRQWGSFP

SEQ ID NO: 424108 - protein, 9 aa, Homo Sapiens
RTARGPRTD

SEQ ID NO: 424109 - protein, 9 aa, Homo Sapiens
HLGMGLVKG

SEQ ID NO: 424110 - protein, 9 aa, Homo Sapiens
QLQRMHHQQ

SEQ ID NO: 424111 - protein, 9 aa, Homo Sapiens
EEKAMRAPH

SEQ ID NO: 424112 - protein, 9 aa, Homo Sapiens
SRSVMMVMA

SEQ ID NO: 424113 - protein, 9 aa, Homo Sapiens
SSASGGESE

SEQ ID NO: 424114 - protein, 9 aa, Homo Sapiens
TIGQVHSTG

SEQ ID NO: 424115 - protein, 9 aa, Homo Sapiens
NHILLKEMK

SEQ ID NO: 424116 - protein, 9 aa, Homo Sapiens
TAPTPSLAP

SEQ ID NO: 424117 - protein, 9 aa, Homo Sapiens
DQLVEITKV

SEQ ID NO: 424118 - protein, 9 aa, Homo Sapiens
SPERGGVWT

SEQ ID NO: 424119 - protein, 9 aa, Homo Sapiens
TVVALGLCQ

SEQ ID NO: 424120 - protein, 9 aa, Homo Sapiens
WRSFCLEYH

SEQ ID NO: 424121 - protein, 9 aa, Homo Sapiens
LCAALNKAA

SEQ ID NO: 424122 - protein, 9 aa, Homo Sapiens
VCMGPGAQG

SEQ ID NO: 424123 - protein, 9 aa, Homo Sapiens
VAPSLNGIS

SEQ ID NO: 424124 - protein, 9 aa, Homo Sapiens
SPCSVLGGE

SEQ ID NO: 424125 - protein, 9 aa, Homo Sapiens
MDGFALGRG

SEQ ID NO: 424126 - protein, 9 aa, Homo Sapiens
SPCSVLGGG

SEQ ID NO: 424127 - protein, 9 aa, Homo Sapiens
EPIKIVIMM

SEQ ID NO: 424128 - protein, 9 aa, Homo Sapiens
YMFYALVIV

SEQ ID NO: 424129 - protein, 9 aa, Homo Sapiens
SQTHSQLAQ

SEQ ID NO: 424130 - protein, 9 aa, Homo Sapiens
YAARQASLS

SEQ ID NO: 424131 - protein, 9 aa, Homo Sapiens
CISTVSKAG

SEQ ID NO: 424132 - protein, 9 aa, Homo Sapiens
TPAHRAQGD

SEQ ID NO: 424133 - protein, 9 aa, Homo Sapiens
NPTSHGSSE

SEQ ID NO: 424134 - protein, 9 aa, Homo Sapiens
KFPEENHEV

SEQ ID NO: 424135 - protein, 9 aa, Homo Sapiens
GQKLAPENR

SEQ ID NO: 424136 - protein, 9 aa, Homo Sapiens
NVLLLFISL

SEQ ID NO: 424137 - protein, 9 aa, Homo Sapiens
EHARMKVTM

SEQ ID NO: 424138 - protein, 9 aa, Homo Sapiens
KALKGLRHP

SEQ ID NO: 424139 - protein, 9 aa, Homo Sapiens
QVTRSWYNY

SEQ ID NO: 424140 - protein, 9 aa, Homo Sapiens
LDHNCDTGA

SEQ ID NO: 424141 - protein, 9 aa, Homo Sapiens
VCGQTFRVT

SEQ ID NO: 424142 - protein, 9 aa, Homo Sapiens
SFPIDEEMI

SEQ ID NO: 424143 - protein, 9 aa, Homo Sapiens
AHVINGGDK

SEQ ID NO: 424144 - protein, 9 aa, Homo Sapiens
LTDMSYTRA

SEQ ID NO: 424145 - protein, 9 aa, Homo Sapiens
SPWTFPRYP

SEQ ID NO: 424146 - protein, 9 aa, Homo Sapiens
TSPFQCEWN

SEQ ID NO: 424147 - protein, 9 aa, Homo Sapiens
QQYCRALLH

SEQ ID NO: 424148 - protein, 9 aa, Homo Sapiens
GQHLWLSHR

SEQ ID NO: 424149 - protein, 9 aa, Homo Sapiens
FFQVELDVQ

SEQ ID NO: 424150 - protein, 9 aa, Homo Sapiens
ALFVEANPA

SEQ ID NO: 424151 - protein, 9 aa, Homo Sapiens
TPRKLVGRA

SEQ ID NO: 424152 - protein, 9 aa, Homo Sapiens
LFYLWLIIN

SEQ ID NO: 424153 - protein, 9 aa, Homo Sapiens
CPWKAPSGT

SEQ ID NO: 424154 - protein, 9 aa, Homo Sapiens
GPAAPLAPP

SEQ ID NO: 424155 - protein, 9 aa, Homo Sapiens
QMQGEKPVW

SEQ ID NO: 424156 - protein, 9 aa, Homo Sapiens
NCLEGDQIS

SEQ ID NO: 424157 - protein, 9 aa, Homo Sapiens
RHHPGKQGC

SEQ ID NO: 424158 - protein, 9 aa, Homo Sapiens
HLGNIAVEE

SEQ ID NO: 424159 - protein, 9 aa, Homo Sapiens
LKSHQGMVI

SEQ ID NO: 424160 - protein, 9 aa, Homo Sapiens
ATINTSCHP

SEQ ID NO: 424161 - protein, 9 aa, Homo Sapiens
RSHHGPELA

SEQ ID NO: 424162 - protein, 9 aa, Homo Sapiens
CPQGARMTV

SEQ ID NO: 424163 - protein, 9 aa, Homo Sapiens
QIPGPAICV

SEQ ID NO: 424164 - protein, 9 aa, Homo Sapiens
FNYSGDLAT

SEQ ID NO: 424165 - protein, 9 aa, Homo Sapiens
TLSYYKSQG

SEQ ID NO: 424166 - protein, 9 aa, Homo Sapiens
QASSPRAIF

SEQ ID NO: 424167 - protein, 9 aa, Homo Sapiens
RCLHFAVRC

SEQ ID NO: 424168 - protein, 9 aa, Homo Sapiens
RHSSVLATG

SEQ ID NO: 424169 - protein, 9 aa, Homo Sapiens
IQWLQRASR

SEQ ID NO: 424170 - protein, 9 aa, Homo Sapiens
GSIISSYKE

SEQ ID NO: 424171 - protein, 9 aa, Homo Sapiens
KETVGLNFF

SEQ ID NO: 424172 - protein, 9 aa, Homo Sapiens
PPPPGAPAT

SEQ ID NO: 424173 - protein, 9 aa, Homo Sapiens
PPPVPSHKP

SEQ ID NO: 424174 - protein, 9 aa, Homo Sapiens
LSQHPLQAS

SEQ ID NO: 424175 - protein, 9 aa, Homo Sapiens
EGNGFVAAF

SEQ ID NO: 424176 - protein, 9 aa, Homo Sapiens
CRQHRFLLP

SEQ ID NO: 424177 - protein, 9 aa, Homo Sapiens
TLYVLVLLS

SEQ ID NO: 424178 - protein, 9 aa, Homo Sapiens
GIGAHQQQV

SEQ ID NO: 424179 - protein, 9 aa, Homo Sapiens
LVGVPPLPA

SEQ ID NO: 424180 - protein, 9 aa, Homo Sapiens
NPHNQNISS

SEQ ID NO: 424181 - protein, 9 aa, Homo Sapiens
WTPRKLVGR

SEQ ID NO: 424182 - protein, 9 aa, Homo Sapiens
KPLYMALAQ

SEQ ID NO: 424183 - protein, 9 aa, Homo Sapiens
VVKLDNSQD

SEQ ID NO: 424184 - protein, 9 aa, Homo Sapiens
MCAPVGNGC

SEQ ID NO: 424185 - protein, 9 aa, Homo Sapiens
GRKKIKEKM

SEQ ID NO: 424186 - protein, 9 aa, Homo Sapiens
RIRREGIRW

SEQ ID NO: 424187 - protein, 9 aa, Homo Sapiens
AKVTENLHV

SEQ ID NO: 424188 - protein, 9 aa, Homo Sapiens
GTWSGLKST

SEQ ID NO: 424189 - protein, 9 aa, Homo Sapiens
ADVLPVVGG

SEQ ID NO: 424190 - protein, 9 aa, Homo Sapiens
LKQLLHWCS

SEQ ID NO: 424191 - protein, 9 aa, Homo Sapiens
LAENMSSKV

SEQ ID NO: 424192 - protein, 9 aa, Homo Sapiens
PYTYVASDS

SEQ ID NO: 424193 - protein, 9 aa, Homo Sapiens
EDRKHALEW

SEQ ID NO: 424194 - protein, 9 aa, Homo Sapiens
WAAVTLQAW

SEQ ID NO: 424195 - protein, 9 aa, Homo Sapiens
SRRAHERPH

SEQ ID NO: 424196 - protein, 9 aa, Homo Sapiens
PCKVLGHPE

SEQ ID NO: 424197 - protein, 9 aa, Homo Sapiens
LVDLKWRHM

SEQ ID NO: 424198 - protein, 9 aa, Homo Sapiens
LQPQPTEAR

SEQ ID NO: 424199 - protein, 9 aa, Homo Sapiens
EADYGAFGT

SEQ ID NO: 424200 - protein, 9 aa, Homo Sapiens
SDPTAFSIL

SEQ ID NO: 424201 - protein, 9 aa, Homo Sapiens
KGRGTRPPV

SEQ ID NO: 424202 - protein, 9 aa, Homo Sapiens
HHHHRLHHH

SEQ ID NO: 424203 - protein, 9 aa, Homo Sapiens
EEPRKGLWE

SEQ ID NO: 424204 - protein, 9 aa, Homo Sapiens
PEVWALYPL

SEQ ID NO: 424205 - protein, 9 aa, Homo Sapiens
LPLVFALKA

SEQ ID NO: 424206 - protein, 9 aa, Homo Sapiens
SKCRTAGHA

SEQ ID NO: 424207 - protein, 9 aa, Homo Sapiens
ENEAPQCPS

SEQ ID NO: 424208 - protein, 9 aa, Homo Sapiens
SPSVHPRAP

SEQ ID NO: 424209 - protein, 9 aa, Homo Sapiens
FKTKFVGGV

SEQ ID NO: 424210 - protein, 9 aa, Homo Sapiens
LGRTDFCPK

SEQ ID NO: 424211 - protein, 9 aa, Homo Sapiens
PDAVDVKAQ

SEQ ID NO: 424212 - protein, 9 aa, Homo Sapiens
RGTSWMSSC

SEQ ID NO: 424213 - protein, 9 aa, Homo Sapiens
KIQKKRSKK

SEQ ID NO: 424214 - protein, 9 aa, Homo Sapiens
CMGPGAQGE

SEQ ID NO: 424215 - protein, 9 aa, Homo Sapiens
MIPIAGATQ

SEQ ID NO: 424216 - protein, 9 aa, Homo Sapiens
LGDTPQPSL

SEQ ID NO: 424217 - protein, 9 aa, Homo Sapiens
KPPRRQALP

SEQ ID NO: 424218 - protein, 9 aa, Homo Sapiens
VPVSILLHS

SEQ ID NO: 424219 - protein, 9 aa, Homo Sapiens
HDEDNTHIS

SEQ ID NO: 424220 - protein, 9 aa, Homo Sapiens
GGKLPGSEE

SEQ ID NO: 424221 - protein, 9 aa, Homo Sapiens
MLQEQQKVA

SEQ ID NO: 424222 - protein, 9 aa, Homo Sapiens
MVIQKDSRT

SEQ ID NO: 424223 - protein, 9 aa, Homo Sapiens
RFLLPASAC

SEQ ID NO: 424224 - protein, 9 aa, Homo Sapiens
QCPKCEYCT

SEQ ID NO: 424225 - protein, 9 aa, Homo Sapiens
MLCCMLAQR

SEQ ID NO: 424226 - protein, 9 aa, Homo Sapiens
STAGTSLPS

SEQ ID NO: 424227 - protein, 9 aa, Homo Sapiens
SDFSNNWNS

SEQ ID NO: 424228 - protein, 9 aa, Homo Sapiens
RLHHHHRLH

SEQ ID NO: 424229 - protein, 9 aa, Homo Sapiens
PATPRGRPA

SEQ ID NO: 424230 - protein, 9 aa, Homo Sapiens
GVRENYSRV

SEQ ID NO: 424231 - protein, 9 aa, Homo Sapiens
PVRVNVKWE

SEQ ID NO: 424232 - protein, 9 aa, Homo Sapiens
QPSYYLPPL

SEQ ID NO: 424233 - protein, 9 aa, Homo Sapiens
HRPYFPVAT

SEQ ID NO: 424234 - protein, 9 aa, Homo Sapiens
RGRPFCADQ

SEQ ID NO: 424235 - protein, 9 aa, Homo Sapiens
SPSSWTSPP

SEQ ID NO: 424236 - protein, 9 aa, Homo Sapiens
TELDAKTMT

SEQ ID NO: 424237 - protein, 9 aa, Homo Sapiens
CLSIIATNS

SEQ ID NO: 424238 - protein, 9 aa, Homo Sapiens
LCPALHLVK

SEQ ID NO: 424239 - protein, 9 aa, Homo Sapiens
TQPSPASAC

SEQ ID NO: 424240 - protein, 9 aa, Homo Sapiens
EGTDMWKKN

SEQ ID NO: 424241 - protein, 9 aa, Homo Sapiens
GQASYFYAA

SEQ ID NO: 424242 - protein, 9 aa, Homo Sapiens
VRVNVKWEY

SEQ ID NO: 424243 - protein, 9 aa, Homo Sapiens
LLPGWGGQG

SEQ ID NO: 424244 - protein, 9 aa, Homo Sapiens
EKCFLLVVL

SEQ ID NO: 424245 - protein, 9 aa, Homo Sapiens
QKSPGNSRS

SEQ ID NO: 424246 - protein, 9 aa, Homo Sapiens
KQTGIMFGS

SEQ ID NO: 424247 - protein, 9 aa, Homo Sapiens
KSAKGQTRP

SEQ ID NO: 424248 - protein, 9 aa, Homo Sapiens
ADSCHLWSP

SEQ ID NO: 424249 - protein, 9 aa, Homo Sapiens
LVGPLARVQ

SEQ ID NO: 424250 - protein, 9 aa, Homo Sapiens
GRPFCADQF

SEQ ID NO: 424251 - protein, 9 aa, Homo Sapiens
DKSSRPISF

SEQ ID NO: 424252 - protein, 9 aa, Homo Sapiens
TPPVNATGH

SEQ ID NO: 424253 - protein, 9 aa, Homo Sapiens
PSCPLATWW

SEQ ID NO: 424254 - protein, 9 aa, Homo Sapiens
PRTPWALGT

SEQ ID NO: 424255 - protein, 9 aa, Homo Sapiens
SPSRNDKHV

SEQ ID NO: 424256 - protein, 9 aa, Homo Sapiens
KLAAFGFVQ

SEQ ID NO: 424257 - protein, 9 aa, Homo Sapiens
IFWFWFWHY

SEQ ID NO: 424258 - protein, 9 aa, Homo Sapiens
WTTTAIPSP

SEQ ID NO: 424259 - protein, 9 aa, Homo Sapiens
VEQDKLLKH

SEQ ID NO: 424260 - protein, 9 aa, Homo Sapiens
SLGVSGVGA

SEQ ID NO: 424261 - protein, 9 aa, Homo Sapiens
RQSSLATQS

SEQ ID NO: 424262 - protein, 9 aa, Homo Sapiens
EHVQEMQEK

SEQ ID NO: 424263 - protein, 9 aa, Homo Sapiens
CWEFKHPQP

SEQ ID NO: 424264 - protein, 9 aa, Homo Sapiens
RLHLFPLTH

SEQ ID NO: 424265 - protein, 9 aa, Homo Sapiens
RKNGETKKA

SEQ ID NO: 424266 - protein, 9 aa, Homo Sapiens
CPKCEYCTN

SEQ ID NO: 424267 - protein, 9 aa, Homo Sapiens
CYGCCGSCC

SEQ ID NO: 424268 - protein, 9 aa, Homo Sapiens
FGHHQHIVS

SEQ ID NO: 424269 - protein, 9 aa, Homo Sapiens
QTQTRTRMG

SEQ ID NO: 424270 - protein, 9 aa, Homo Sapiens
LLQPASLPL

SEQ ID NO: 424271 - protein, 9 aa, Homo Sapiens
ANVPKDTPS

SEQ ID NO: 424272 - protein, 9 aa, Homo Sapiens
SCSWLSLFY

SEQ ID NO: 424273 - protein, 9 aa, Homo Sapiens
GLGGPRRVR

SEQ ID NO: 424274 - protein, 9 aa, Homo Sapiens
VLHHAAGHS

SEQ ID NO: 424275 - protein, 9 aa, Homo Sapiens
KCTLGVMMM

SEQ ID NO: 424276 - protein, 9 aa, Homo Sapiens
ELKNHYQSF

SEQ ID NO: 424277 - protein, 9 aa, Homo Sapiens
TSGTWSGLK

SEQ ID NO: 424278 - protein, 9 aa, Homo Sapiens
DDTVITTAT

SEQ ID NO: 424279 - protein, 9 aa, Homo Sapiens
PTARSTGAG

SEQ ID NO: 424280 - protein, 9 aa, Homo Sapiens
NMSEETVTI

SEQ ID NO: 424281 - protein, 9 aa, Homo Sapiens
GTRRSSNKP

SEQ ID NO: 424282 - protein, 9 aa, Homo Sapiens
RHMLVIFTM

SEQ ID NO: 424283 - protein, 9 aa, Homo Sapiens
HWGAAPMMS

SEQ ID NO: 424284 - protein, 9 aa, Homo Sapiens
LEYQGEPDE

SEQ ID NO: 424285 - protein, 9 aa, Homo Sapiens
QNQKRLQNR

SEQ ID NO: 424286 - protein, 9 aa, Homo Sapiens
FTDVPSNCQ

SEQ ID NO: 424287 - protein, 9 aa, Homo Sapiens
LSTLSQPPP

SEQ ID NO: 424288 - protein, 9 aa, Homo Sapiens
EDYYIVANV

SEQ ID NO: 424289 - protein, 9 aa, Homo Sapiens
TSLVMLMLD

SEQ ID NO: 424290 - protein, 9 aa, Homo Sapiens
CVALPDEQT

SEQ ID NO: 424291 - protein, 9 aa, Homo Sapiens
SCRGSWRYK

SEQ ID NO: 424292 - protein, 9 aa, Homo Sapiens
QCFRLKRGQ

SEQ ID NO: 424293 - protein, 9 aa, Homo Sapiens
TKTMRAPET

SEQ ID NO: 424294 - protein, 9 aa, Homo Sapiens
PRKGLWERS

SEQ ID NO: 424295 - protein, 9 aa, Homo Sapiens
FCADQFCRQ

SEQ ID NO: 424296 - protein, 9 aa, Homo Sapiens
SAAPRCWRC

SEQ ID NO: 424297 - protein, 9 aa, Homo Sapiens
VTFHIIAIT

SEQ ID NO: 424298 - protein, 9 aa, Homo Sapiens
LTGVQNPRK

SEQ ID NO: 424299 - protein, 9 aa, Homo Sapiens
TRWMQKWPT

SEQ ID NO: 424300 - protein, 9 aa, Homo Sapiens
MAKRVCKDY

SEQ ID NO: 424301 - protein, 9 aa, Homo Sapiens
IQVDGSSDT

SEQ ID NO: 424302 - protein, 9 aa, Homo Sapiens
KNCSCFKCK

SEQ ID NO: 424303 - protein, 9 aa, Homo Sapiens
FMYLFIGTS

SEQ ID NO: 424304 - protein, 9 aa, Homo Sapiens
DRVQDIFEK

SEQ ID NO: 424305 - protein, 9 aa, Homo Sapiens
IYSVVCIIG

SEQ ID NO: 424306 - protein, 9 aa, Homo Sapiens
PNVLEFTSA

SEQ ID NO: 424307 - protein, 9 aa, Homo Sapiens
DLRQLRTVV

SEQ ID NO: 424308 - protein, 9 aa, Homo Sapiens
KMRTVVLTP

SEQ ID NO: 424309 - protein, 9 aa, Homo Sapiens
WSWMTLPGS

SEQ ID NO: 424310 - protein, 9 aa, Homo Sapiens
HLETTQAGE

SEQ ID NO: 424311 - protein, 9 aa, Homo Sapiens
LGPDSQFVC

SEQ ID NO: 424312 - protein, 9 aa, Homo Sapiens
NQPIVKKGE

SEQ ID NO: 424313 - protein, 9 aa, Homo Sapiens
KDHRTSQNH

SEQ ID NO: 424314 - protein, 9 aa, Homo Sapiens
LNPLSSHYP

SEQ ID NO: 424315 - protein, 9 aa, Homo Sapiens
YYESCNHVH

SEQ ID NO: 424316 - protein, 9 aa, Homo Sapiens
PDAEVGLAP

SEQ ID NO: 424317 - protein, 9 aa, Homo Sapiens
LVQASAPPA

SEQ ID NO: 424318 - protein, 9 aa, Homo Sapiens
TAGLSLNEE

SEQ ID NO: 424319 - protein, 9 aa, Homo Sapiens
KDFLIQLKV

SEQ ID NO: 424320 - protein, 9 aa, Homo Sapiens
IWNCTKENA

SEQ ID NO: 424321 - protein, 9 aa, Homo Sapiens
VLTDMSYTR

SEQ ID NO: 424322 - protein, 9 aa, Homo Sapiens
STNVALYVG

SEQ ID NO: 424323 - protein, 9 aa, Homo Sapiens
KIVIMMSST

SEQ ID NO: 424324 - protein, 9 aa, Homo Sapiens
GLSDDSPTQ

SEQ ID NO: 424325 - protein, 9 aa, Homo Sapiens
VFIARKLQE

SEQ ID NO: 424326 - protein, 9 aa, Homo Sapiens
PSPSCPHPR

SEQ ID NO: 424327 - protein, 9 aa, Homo Sapiens
LNSAHFNFQ

SEQ ID NO: 424328 - protein, 9 aa, Homo Sapiens
HHFMAIFKG

SEQ ID NO: 424329 - protein, 9 aa, Homo Sapiens
VVVPTPIPI

SEQ ID NO: 424330 - protein, 9 aa, Homo Sapiens
RFQPTAKEL

SEQ ID NO: 424331 - protein, 9 aa, Homo Sapiens
ISVASVTRR

SEQ ID NO: 424332 - protein, 9 aa, Homo Sapiens
LSPWTFPRY

SEQ ID NO: 424333 - protein, 9 aa, Homo Sapiens
KEFLRQRWA

SEQ ID NO: 424334 - protein, 9 aa, Homo Sapiens
RRAHEGLPA

SEQ ID NO: 424335 - protein, 9 aa, Homo Sapiens
DCPEDFKGI

SEQ ID NO: 424336 - protein, 9 aa, Homo Sapiens
LLPAPMCNP

SEQ ID NO: 424337 - protein, 9 aa, Homo Sapiens
NKMPTWLSS

SEQ ID NO: 424338 - protein, 9 aa, Homo Sapiens
TSFTCLQIC

SEQ ID NO: 424339 - protein, 9 aa, Homo Sapiens
DILASSACV

SEQ ID NO: 424340 - protein, 9 aa, Homo Sapiens
PQVPPACQP

SEQ ID NO: 424341 - protein, 9 aa, Homo Sapiens
SGNTLQALN

SEQ ID NO: 424342 - protein, 9 aa, Homo Sapiens
SIIDAHANE

SEQ ID NO: 424343 - protein, 9 aa, Homo Sapiens
HCTHENCGY

SEQ ID NO: 424344 - protein, 9 aa, Homo Sapiens
DIIIANNLW

SEQ ID NO: 424345 - protein, 9 aa, Homo Sapiens
VNYWWLRHH

SEQ ID NO: 424346 - protein, 9 aa, Homo Sapiens
GPDDARKKV

SEQ ID NO: 424347 - protein, 9 aa, Homo Sapiens
HLLGGDRIL

SEQ ID NO: 424348 - protein, 9 aa, Homo Sapiens
KKPSPVPHG

SEQ ID NO: 424349 - protein, 9 aa, Homo Sapiens
VAEAAAVVM

SEQ ID NO: 424350 - protein, 9 aa, Homo Sapiens
SDHLEILPS

SEQ ID NO: 424351 - protein, 9 aa, Homo Sapiens
HHAWAGFEL

SEQ ID NO: 424352 - protein, 9 aa, Homo Sapiens
DLLKKRAVF

SEQ ID NO: 424353 - protein, 9 aa, Homo Sapiens
GGVLGIKIS

SEQ ID NO: 424354 - protein, 9 aa, Homo Sapiens
TCRISVASV

SEQ ID NO: 424355 - protein, 9 aa, Homo Sapiens
SMMCKEDLC

SEQ ID NO: 424356 - protein, 9 aa, Homo Sapiens
KEFIIFLKQ

SEQ ID NO: 424357 - protein, 9 aa, Homo Sapiens
QGRAETHLE

SEQ ID NO: 424358 - protein, 9 aa, Homo Sapiens
YPEGIGAHQ

SEQ ID NO: 424359 - protein, 9 aa, Homo Sapiens
GVPGVPGEM

SEQ ID NO: 424360 - protein, 9 aa, Homo Sapiens
REYKALKGL

SEQ ID NO: 424361 - protein, 9 aa, Homo Sapiens
LPGRGASLS

SEQ ID NO: 424362 - protein, 9 aa, Homo Sapiens
GGPGVGLVA

SEQ ID NO: 424363 - protein, 9 aa, Homo Sapiens
QVEVIQSGQ

SEQ ID NO: 424364 - protein, 9 aa, Homo Sapiens
LLGVLQAKA

SEQ ID NO: 424365 - protein, 9 aa, Homo Sapiens
AGKPVRVIH

SEQ ID NO: 424366 - protein, 9 aa, Homo Sapiens
LREGRTALS

SEQ ID NO: 424367 - protein, 9 aa, Homo Sapiens
PLSRSAPTP

SEQ ID NO: 424368 - protein, 9 aa, Homo Sapiens
LWEPRELQL

SEQ ID NO: 424369 - protein, 9 aa, Homo Sapiens
PFTIVMPNI

SEQ ID NO: 424370 - protein, 9 aa, Homo Sapiens
DMKLMRCYI

SEQ ID NO: 424371 - protein, 9 aa, Homo Sapiens
NKLCLVTLL

SEQ ID NO: 424372 - protein, 9 aa, Homo Sapiens
PMVSSRMLG

SEQ ID NO: 424373 - protein, 9 aa, Homo Sapiens
AATGTAAIL

SEQ ID NO: 424374 - protein, 9 aa, Homo Sapiens
VSTAVDTSV

SEQ ID NO: 424375 - protein, 9 aa, Homo Sapiens
MPTWLSSSG

SEQ ID NO: 424376 - protein, 9 aa, Homo Sapiens
VSIPIYFPP

SEQ ID NO: 424377 - protein, 9 aa, Homo Sapiens
NISAVDIKP

SEQ ID NO: 424378 - protein, 9 aa, Homo Sapiens
RKIPLEDGV

SEQ ID NO: 424379 - protein, 9 aa, Homo Sapiens
QTLGVTLKS

SEQ ID NO: 424380 - protein, 9 aa, Homo Sapiens
LAKKQKFRP

SEQ ID NO: 424381 - protein, 9 aa, Homo Sapiens
AVAAHQDQV

SEQ ID NO: 424382 - protein, 9 aa, Homo Sapiens
PLPRAGAGP

SEQ ID NO: 424383 - protein, 9 aa, Homo Sapiens
PRSPLQPHR

SEQ ID NO: 424384 - protein, 9 aa, Homo Sapiens
GAASSPAWP

SEQ ID NO: 424385 - protein, 9 aa, Homo Sapiens
ASLWNLVVS

SEQ ID NO: 424386 - protein, 9 aa, Homo Sapiens
YDDKLAFYG

SEQ ID NO: 424387 - protein, 9 aa, Homo Sapiens
LVVLDVKPQ

SEQ ID NO: 424388 - protein, 9 aa, Homo Sapiens
ASGRRLLPL

SEQ ID NO: 424389 - protein, 9 aa, Homo Sapiens
DQDNACVGD

SEQ ID NO: 424390 - protein, 9 aa, Homo Sapiens
LPSHSTLLL

SEQ ID NO: 424391 - protein, 9 aa, Homo Sapiens
QQQEVEERQ

SEQ ID NO: 424392 - protein, 9 aa, Homo Sapiens
GISICPGRF

SEQ ID NO: 424393 - protein, 9 aa, Homo Sapiens
LVPILQLVV

SEQ ID NO: 424394 - protein, 9 aa, Homo Sapiens
GLVAEGALV

SEQ ID NO: 424395 - protein, 9 aa, Homo Sapiens
LTLCRAYEA

SEQ ID NO: 424396 - protein, 9 aa, Homo Sapiens
PLRVQSVLL

SEQ ID NO: 424397 - protein, 9 aa, Homo Sapiens
MTLPGSWSM

SEQ ID NO: 424398 - protein, 9 aa, Homo Sapiens
EHGHEHGYH

SEQ ID NO: 424399 - protein, 9 aa, Homo Sapiens
MCMKMGYEE

SEQ ID NO: 424400 - protein, 9 aa, Homo Sapiens
GSSDTSSNE

SEQ ID NO: 424401 - protein, 9 aa, Homo Sapiens
VTPLRVQSV

SEQ ID NO: 424402 - protein, 9 aa, Homo Sapiens
YIDLYLVPD

SEQ ID NO: 424403 - protein, 9 aa, Homo Sapiens
LLRDQDLCR

SEQ ID NO: 424404 - protein, 9 aa, Homo Sapiens
PARRESRFW

SEQ ID NO: 424405 - protein, 9 aa, Homo Sapiens
QTQCRQLEA

SEQ ID NO: 424406 - protein, 9 aa, Homo Sapiens
PTYICGLPD

SEQ ID NO: 424407 - protein, 9 aa, Homo Sapiens
YTVAVSGGG

SEQ ID NO: 424408 - protein, 9 aa, Homo Sapiens
ITVKKLKSV

SEQ ID NO: 424409 - protein, 9 aa, Homo Sapiens
SDKDRRLSA

SEQ ID NO: 424410 - protein, 9 aa, Homo Sapiens
ISAKPLTQY

SEQ ID NO: 424411 - protein, 9 aa, Homo Sapiens
SAMKHSPGL

SEQ ID NO: 424412 - protein, 9 aa, Homo Sapiens
YHLELGFKH

SEQ ID NO: 424413 - protein, 9 aa, Homo Sapiens
AAGHSELPV

SEQ ID NO: 424414 - protein, 9 aa, Homo Sapiens
TWLYHPVVM

SEQ ID NO: 424415 - protein, 9 aa, Homo Sapiens
SSSGSRRRC

SEQ ID NO: 424416 - protein, 9 aa, Homo Sapiens
FQAVSLKQD

SEQ ID NO: 424417 - protein, 9 aa, Homo Sapiens
LCLKVVKYP

SEQ ID NO: 424418 - protein, 9 aa, Homo Sapiens
NMSSKVRQL

SEQ ID NO: 424419 - protein, 9 aa, Homo Sapiens
DEVRVVVRE

SEQ ID NO: 424420 - protein, 9 aa, Homo Sapiens
SQQPCQSGV

SEQ ID NO: 424421 - protein, 9 aa, Homo Sapiens
SATCPWTTH

SEQ ID NO: 424422 - protein, 9 aa, Homo Sapiens
GGKLQRRKN

SEQ ID NO: 424423 - protein, 9 aa, Homo Sapiens
LIGDSGGRQ

SEQ ID NO: 424424 - protein, 9 aa, Homo Sapiens
TISILMSAP

SEQ ID NO: 424425 - protein, 9 aa, Homo Sapiens
PITGPTTQT

SEQ ID NO: 424426 - protein, 9 aa, Homo Sapiens
NNLIFIPSV

SEQ ID NO: 424427 - protein, 9 aa, Homo Sapiens
TTFTITVCP

SEQ ID NO: 424428 - protein, 9 aa, Homo Sapiens
DACVVLCLP

SEQ ID NO: 424429 - protein, 9 aa, Homo Sapiens
PRKKHKRLE

SEQ ID NO: 424430 - protein, 9 aa, Homo Sapiens
LEYHSCWLS

SEQ ID NO: 424431 - protein, 9 aa, Homo Sapiens
TLVLVSDCK

SEQ ID NO: 424432 - protein, 9 aa, Homo Sapiens
VVGHRHHAL

SEQ ID NO: 424433 - protein, 9 aa, Homo Sapiens
LAQLNDRRA

SEQ ID NO: 424434 - protein, 9 aa, Homo Sapiens
TVGCDLKNY

SEQ ID NO: 424435 - protein, 9 aa, Homo Sapiens
GWGWRSPKC

SEQ ID NO: 424436 - protein, 9 aa, Homo Sapiens
GCEEDKNCH

SEQ ID NO: 424437 - protein, 9 aa, Homo Sapiens
SGGSFPLQC

SEQ ID NO: 424438 - protein, 9 aa, Homo Sapiens
GQVLSSLEA

SEQ ID NO: 424439 - protein, 9 aa, Homo Sapiens
RGQAQDTSG

SEQ ID NO: 424440 - protein, 9 aa, Homo Sapiens
PPRTPWALG

SEQ ID NO: 424441 - protein, 9 aa, Homo Sapiens
QLTLSQCKG

SEQ ID NO: 424442 - protein, 9 aa, Homo Sapiens
VASSQNWGS

SEQ ID NO: 424443 - protein, 9 aa, Homo Sapiens
RRPLDNSFY

SEQ ID NO: 424444 - protein, 9 aa, Homo Sapiens
PDGDQVAVG

SEQ ID NO: 424445 - protein, 9 aa, Homo Sapiens
FTGDNGQWA

SEQ ID NO: 424446 - protein, 9 aa, Homo Sapiens
MNETSSHSH

SEQ ID NO: 424447 - protein, 9 aa, Homo Sapiens
NFIWLPSNI

SEQ ID NO: 424448 - protein, 9 aa, Homo Sapiens
EWLIKKREE

SEQ ID NO: 424449 - protein, 9 aa, Homo Sapiens
GTGGGPACV

SEQ ID NO: 424450 - protein, 9 aa, Homo Sapiens
KAVRYERKN

SEQ ID NO: 424451 - protein, 9 aa, Homo Sapiens
STCARRKVS

SEQ ID NO: 424452 - protein, 9 aa, Homo Sapiens
RNMTDFWLA

SEQ ID NO: 424453 - protein, 9 aa, Homo Sapiens
LANTSVFGF

SEQ ID NO: 424454 - protein, 9 aa, Homo Sapiens
SAGVIQNTS

SEQ ID NO: 424455 - protein, 9 aa, Homo Sapiens
HHLLLPGSR

SEQ ID NO: 424456 - protein, 9 aa, Homo Sapiens
AADDPRRSP

SEQ ID NO: 424457 - protein, 9 aa, Homo Sapiens
RLSRGVQSG

SEQ ID NO: 424458 - protein, 9 aa, Homo Sapiens
LNCLEGDQI

SEQ ID NO: 424459 - protein, 9 aa, Homo Sapiens
LGSPDKLGL

SEQ ID NO: 424460 - protein, 9 aa, Homo Sapiens
ESSDRCALH

SEQ ID NO: 424461 - protein, 9 aa, Homo Sapiens
PELLDTPFV

SEQ ID NO: 424462 - protein, 9 aa, Homo Sapiens
RPASSTKDR

SEQ ID NO: 424463 - protein, 9 aa, Homo Sapiens
GTHARSDKL

SEQ ID NO: 424464 - protein, 9 aa, Homo Sapiens
YTCGTGAFH

SEQ ID NO: 424465 - protein, 9 aa, Homo Sapiens
SLVASSQNW

SEQ ID NO: 424466 - protein, 9 aa, Homo Sapiens
GSTTTTCRS

SEQ ID NO: 424467 - protein, 9 aa, Homo Sapiens
GKPGAGLAQ

SEQ ID NO: 424468 - protein, 9 aa, Homo Sapiens
TSEPITGPT

SEQ ID NO: 424469 - protein, 9 aa, Homo Sapiens
GVAGENTSV

SEQ ID NO: 424470 - protein, 9 aa, Homo Sapiens
GPAPGSSSE

SEQ ID NO: 424471 - protein, 9 aa, Homo Sapiens
LYPQCRLEK

SEQ ID NO: 424472 - protein, 9 aa, Homo Sapiens
PAPSLGGGR

SEQ ID NO: 424473 - protein, 9 aa, Homo Sapiens
VVAPLYDTL

SEQ ID NO: 424474 - protein, 9 aa, Homo Sapiens
LADLCRSQS

SEQ ID NO: 424475 - protein, 9 aa, Homo Sapiens
SLWLLTRWK

SEQ ID NO: 424476 - protein, 9 aa, Homo Sapiens
LHSSSQQSL

SEQ ID NO: 424477 - protein, 9 aa, Homo Sapiens
VAQKIDLLE

SEQ ID NO: 424478 - protein, 9 aa, Homo Sapiens
VGILHSVSH

SEQ ID NO: 424479 - protein, 9 aa, Homo Sapiens
PITPHLPHQ

SEQ ID NO: 424480 - protein, 9 aa, Homo Sapiens
TASGADLMC

SEQ ID NO: 424481 - protein, 9 aa, Homo Sapiens
GTEWPSTCL

SEQ ID NO: 424482 - protein, 9 aa, Homo Sapiens
YGSYPPARQ

SEQ ID NO: 424483 - protein, 9 aa, Homo Sapiens
SLQSMAKPK

SEQ ID NO: 424484 - protein, 9 aa, Homo Sapiens
PIQGSCTTI

SEQ ID NO: 424485 - protein, 9 aa, Homo Sapiens
TRCRASRAP

SEQ ID NO: 424486 - protein, 9 aa, Homo Sapiens
HGAGRDEPW

SEQ ID NO: 424487 - protein, 9 aa, Homo Sapiens
KIPDFQGQI

SEQ ID NO: 424488 - protein, 9 aa, Homo Sapiens
QNDSESSGV

SEQ ID NO: 424489 - protein, 9 aa, Homo Sapiens
QLTSLVMLM

SEQ ID NO: 424490 - protein, 9 aa, Homo Sapiens
MLYLCTSHP

SEQ ID NO: 424491 - protein, 9 aa, Homo Sapiens
TGENGLRTY

SEQ ID NO: 424492 - protein, 9 aa, Homo Sapiens
PPARLPGAW

SEQ ID NO: 424493 - protein, 9 aa, Homo Sapiens
FFTIDLVTT

SEQ ID NO: 424494 - protein, 9 aa, Homo Sapiens
NIALQNDSE

SEQ ID NO: 424495 - protein, 9 aa, Homo Sapiens
RHIKLHTRD

SEQ ID NO: 424496 - protein, 9 aa, Homo Sapiens
WWSWLMTAL

SEQ ID NO: 424497 - protein, 9 aa, Homo Sapiens
APEVLTDMS

SEQ ID NO: 424498 - protein, 9 aa, Homo Sapiens
AAGTATCPP

SEQ ID NO: 424499 - protein, 9 aa, Homo Sapiens
LPGFGGPRC

SEQ ID NO: 424500 - protein, 9 aa, Homo Sapiens
SIRCGLDCF

SEQ ID NO: 424501 - protein, 9 aa, Homo Sapiens
AVSHEGRTL

SEQ ID NO: 424502 - protein, 9 aa, Homo Sapiens
VTSESQDEP

SEQ ID NO: 424503 - protein, 9 aa, Homo Sapiens
LLLQKCKEL

SEQ ID NO: 424504 - protein, 9 aa, Homo Sapiens
SSSERCRPL

SEQ ID NO: 424505 - protein, 9 aa, Homo Sapiens
SSHPLVLPN

SEQ ID NO: 424506 - protein, 9 aa, Homo Sapiens
ISWAVGILH

SEQ ID NO: 424507 - protein, 9 aa, Homo Sapiens
VCERAKAGY

SEQ ID NO: 424508 - protein, 9 aa, Homo Sapiens
LFWEKRYQT

SEQ ID NO: 424509 - protein, 9 aa, Homo Sapiens
LRVWVRTTE

SEQ ID NO: 424510 - protein, 9 aa, Homo Sapiens
ESRDHYEEL

SEQ ID NO: 424511 - protein, 9 aa, Homo Sapiens
LRVTKIETS

SEQ ID NO: 424512 - protein, 9 aa, Homo Sapiens
GEKPKAVAK

SEQ ID NO: 424513 - protein, 9 aa, Homo Sapiens
SLATQSQPH

SEQ ID NO: 424514 - protein, 9 aa, Homo Sapiens
TQLQDNKDP

SEQ ID NO: 424515 - protein, 9 aa, Homo Sapiens
EKAMFDVHR

SEQ ID NO: 424516 - protein, 9 aa, Homo Sapiens
LQGINKDQP

SEQ ID NO: 424517 - protein, 9 aa, Homo Sapiens
LPAWHPLTT

SEQ ID NO: 424518 - protein, 9 aa, Homo Sapiens
GMVELVKIW

SEQ ID NO: 424519 - protein, 9 aa, Homo Sapiens
VLQPPKPPG

SEQ ID NO: 424520 - protein, 9 aa, Homo Sapiens
ARAGATRCL

SEQ ID NO: 424521 - protein, 9 aa, Homo Sapiens
TEIDLIPRD

SEQ ID NO: 424522 - protein, 9 aa, Homo Sapiens
PGLGIHMRH

SEQ ID NO: 424523 - protein, 9 aa, Homo Sapiens
MSDEAGVTH

SEQ ID NO: 424524 - protein, 9 aa, Homo Sapiens
MVGPHPLVV

SEQ ID NO: 424525 - protein, 9 aa, Homo Sapiens
ATTSTGGIF

SEQ ID NO: 424526 - protein, 9 aa, Homo Sapiens
QILCLRLLW

SEQ ID NO: 424527 - protein, 9 aa, Homo Sapiens
ALVFAQVRR

SEQ ID NO: 424528 - protein, 9 aa, Homo Sapiens
HLPAARTRY

SEQ ID NO: 424529 - protein, 9 aa, Homo Sapiens
EWVGERCLE

SEQ ID NO: 424530 - protein, 9 aa, Homo Sapiens
SQRLHSPHP

SEQ ID NO: 424531 - protein, 9 aa, Homo Sapiens
DIGASKNSD

SEQ ID NO: 424532 - protein, 9 aa, Homo Sapiens
ALRILLCRP

SEQ ID NO: 424533 - protein, 9 aa, Homo Sapiens
MKMKTFMKA

SEQ ID NO: 424534 - protein, 9 aa, Homo Sapiens
IPGPAICVP

SEQ ID NO: 424535 - protein, 9 aa, Homo Sapiens
VNHFHKIRN

SEQ ID NO: 424536 - protein, 9 aa, Homo Sapiens
GALPTAACP

SEQ ID NO: 424537 - protein, 9 aa, Homo Sapiens
MAVTASSEA

SEQ ID NO: 424538 - protein, 9 aa, Homo Sapiens
WSRVGPRRC

SEQ ID NO: 424539 - protein, 9 aa, Homo Sapiens
GVGLLGHLR

SEQ ID NO: 424540 - protein, 9 aa, Homo Sapiens
QTVFERNCC

SEQ ID NO: 424541 - protein, 9 aa, Homo Sapiens
ILGQLKAEF

SEQ ID NO: 424542 - protein, 9 aa, Homo Sapiens
YHPVVMHWT

SEQ ID NO: 424543 - protein, 9 aa, Homo Sapiens
QALWKAFHQ

SEQ ID NO: 424544 - protein, 9 aa, Homo Sapiens
NSHNSEPWA

SEQ ID NO: 424545 - protein, 9 aa, Homo Sapiens
EPFRPQQAL

SEQ ID NO: 424546 - protein, 9 aa, Homo Sapiens
NAKVILELR

SEQ ID NO: 424547 - protein, 9 aa, Homo Sapiens
PLPSPMQQQ

SEQ ID NO: 424548 - protein, 9 aa, Homo Sapiens
HRETVTTQA

SEQ ID NO: 424549 - protein, 9 aa, Homo Sapiens
AGMGGTCQQ

SEQ ID NO: 424550 - protein, 9 aa, Homo Sapiens
TNMHAQNLA

SEQ ID NO: 424551 - protein, 9 aa, Homo Sapiens
CPFQSPTKR

SEQ ID NO: 424552 - protein, 9 aa, Homo Sapiens
IVMPNIVIS

SEQ ID NO: 424553 - protein, 9 aa, Homo Sapiens
GPATMPALG

SEQ ID NO: 424554 - protein, 9 aa, Homo Sapiens
ESRWWLGAL

SEQ ID NO: 424555 - protein, 9 aa, Homo Sapiens
HCSQTHSQL

SEQ ID NO: 424556 - protein, 9 aa, Homo Sapiens
LCKPKIVRS

SEQ ID NO: 424557 - protein, 9 aa, Homo Sapiens
QGPGILGEV

SEQ ID NO: 424558 - protein, 9 aa, Homo Sapiens
GVHIVSRGR

SEQ ID NO: 424559 - protein, 9 aa, Homo Sapiens
LCVPQNHLL

SEQ ID NO: 424560 - protein, 9 aa, Homo Sapiens
KKRFEVLMT

SEQ ID NO: 424561 - protein, 9 aa, Homo Sapiens
FAFFCICTI

SEQ ID NO: 424562 - protein, 9 aa, Homo Sapiens
VNSPPPSPP

SEQ ID NO: 424563 - protein, 9 aa, Homo Sapiens
SCLLPPAPP

SEQ ID NO: 424564 - protein, 9 aa, Homo Sapiens
ELNEICMKE

SEQ ID NO: 424565 - protein, 9 aa, Homo Sapiens
QAPVLLECA

SEQ ID NO: 424566 - protein, 9 aa, Homo Sapiens
LVRQTWQVV

SEQ ID NO: 424567 - protein, 9 aa, Homo Sapiens
TFLLWYLSW

SEQ ID NO: 424568 - protein, 9 aa, Homo Sapiens
KWYSTKGGE

SEQ ID NO: 424569 - protein, 9 aa, Homo Sapiens
KSLQALDEV

SEQ ID NO: 424570 - protein, 9 aa, Homo Sapiens
SRQQYCRAL

SEQ ID NO: 424571 - protein, 9 aa, Homo Sapiens
TNWLSFNAD

SEQ ID NO: 424572 - protein, 9 aa, Homo Sapiens
LSKLQPQPT

SEQ ID NO: 424573 - protein, 9 aa, Homo Sapiens
HQLQTAPPA

SEQ ID NO: 424574 - protein, 9 aa, Homo Sapiens
SSPRLITTC

SEQ ID NO: 424575 - protein, 9 aa, Homo Sapiens
LYATLWLHE

SEQ ID NO: 424576 - protein, 9 aa, Homo Sapiens
PLELEHLKL

SEQ ID NO: 424577 - protein, 9 aa, Homo Sapiens
VMGIIFMCL

SEQ ID NO: 424578 - protein, 9 aa, Homo Sapiens
LSDGVEWAL

SEQ ID NO: 424579 - protein, 9 aa, Homo Sapiens
DAGCAKDRK

SEQ ID NO: 424580 - protein, 9 aa, Homo Sapiens
ATGVCPARS

SEQ ID NO: 424581 - protein, 9 aa, Homo Sapiens
AQDGARCPS

SEQ ID NO: 424582 - protein, 9 aa, Homo Sapiens
LLSVSTAVD

SEQ ID NO: 424583 - protein, 9 aa, Homo Sapiens
SPAQLVILK

SEQ ID NO: 424584 - protein, 9 aa, Homo Sapiens
ATASRGPSP

SEQ ID NO: 424585 - protein, 9 aa, Homo Sapiens
PTSHGSSES

SEQ ID NO: 424586 - protein, 9 aa, Homo Sapiens
AVQPPEPAS

SEQ ID NO: 424587 - protein, 9 aa, Homo Sapiens
LPSWARSFV

SEQ ID NO: 424588 - protein, 9 aa, Homo Sapiens
KNPTSPRRN

SEQ ID NO: 424589 - protein, 9 aa, Homo Sapiens
LAAFGFVQS

SEQ ID NO: 424590 - protein, 9 aa, Homo Sapiens
AVNTKSYPP

SEQ ID NO: 424591 - protein, 9 aa, Homo Sapiens
TAAGRHPGA

SEQ ID NO: 424592 - protein, 9 aa, Homo Sapiens
SRTDWDDYV

SEQ ID NO: 424593 - protein, 9 aa, Homo Sapiens
DNRQHLAMM

SEQ ID NO: 424594 - protein, 9 aa, Homo Sapiens
GQTFRVTFD

SEQ ID NO: 424595 - protein, 9 aa, Homo Sapiens
RYRLDGTER

SEQ ID NO: 424596 - protein, 9 aa, Homo Sapiens
ESNRRTDVS

SEQ ID NO: 424597 - protein, 9 aa, Homo Sapiens
HLLPNQYPV

SEQ ID NO: 424598 - protein, 9 aa, Homo Sapiens
ALQDDGSQD

SEQ ID NO: 424599 - protein, 9 aa, Homo Sapiens
LPISIQYRL

SEQ ID NO: 424600 - protein, 9 aa, Homo Sapiens
CRKSSLLSA

SEQ ID NO: 424601 - protein, 9 aa, Homo Sapiens
NALLGKDTM

SEQ ID NO: 424602 - protein, 9 aa, Homo Sapiens
WSWLMTALL

SEQ ID NO: 424603 - protein, 9 aa, Homo Sapiens
ASEKSPSTF

SEQ ID NO: 424604 - protein, 9 aa, Homo Sapiens
RQIKWDPQE

SEQ ID NO: 424605 - protein, 9 aa, Homo Sapiens
HLWLSHRLR

SEQ ID NO: 424606 - protein, 9 aa, Homo Sapiens
RNDKHVMSR

SEQ ID NO: 424607 - protein, 9 aa, Homo Sapiens
WRRRAATRR

SEQ ID NO: 424608 - protein, 9 aa, Homo Sapiens
IHEVHQNMD

SEQ ID NO: 424609 - protein, 9 aa, Homo Sapiens
INGVQVQGM

SEQ ID NO: 424610 - protein, 9 aa, Homo Sapiens
ANNLWGCGL

SEQ ID NO: 424611 - protein, 9 aa, Homo Sapiens
YFCGMVCSL

SEQ ID NO: 424612 - protein, 9 aa, Homo Sapiens
SAPNDSLCQ

SEQ ID NO: 424613 - protein, 9 aa, Homo Sapiens
NHTLTLALI

SEQ ID NO: 424614 - protein, 9 aa, Homo Sapiens
CASLLSTLS

SEQ ID NO: 424615 - protein, 9 aa, Homo Sapiens
IIHGPAPAP

SEQ ID NO: 424616 - protein, 9 aa, Homo Sapiens
PTAFSILTQ

SEQ ID NO: 424617 - protein, 9 aa, Homo Sapiens
KAEVNAGIK

SEQ ID NO: 424618 - protein, 9 aa, Homo Sapiens
NLAGPWSSE

SEQ ID NO: 424619 - protein, 9 aa, Homo Sapiens
GNIGAPRPK

SEQ ID NO: 424620 - protein, 9 aa, Homo Sapiens
EFSGSDGGK

SEQ ID NO: 424621 - protein, 9 aa, Homo Sapiens
PTPDGGPYV

SEQ ID NO: 424622 - protein, 9 aa, Homo Sapiens
LDRLQRGLP

SEQ ID NO: 424623 - protein, 9 aa, Homo Sapiens
PEGEKNQLT

SEQ ID NO: 424624 - protein, 9 aa, Homo Sapiens
IFQECSPVV

SEQ ID NO: 424625 - protein, 9 aa, Homo Sapiens
PVVLLHKGC

SEQ ID NO: 424626 - protein, 9 aa, Homo Sapiens
SSEATHRKY

SEQ ID NO: 424627 - protein, 9 aa, Homo Sapiens
EKPAKWTCK

SEQ ID NO: 424628 - protein, 9 aa, Homo Sapiens
WVRPDLSIM

SEQ ID NO: 424629 - protein, 9 aa, Homo Sapiens
LLPRVSAVS

SEQ ID NO: 424630 - protein, 9 aa, Homo Sapiens
SALPQGRAP

SEQ ID NO: 424631 - protein, 9 aa, Homo Sapiens
VVDTYSSSI

SEQ ID NO: 424632 - protein, 9 aa, Homo Sapiens
GPPPPHQAP

SEQ ID NO: 424633 - protein, 9 aa, Homo Sapiens
DMEWLIKKR

SEQ ID NO: 424634 - protein, 9 aa, Homo Sapiens
SLSGASKEG

SEQ ID NO: 424635 - protein, 9 aa, Homo Sapiens
FATLSVRAM

SEQ ID NO: 424636 - protein, 9 aa, Homo Sapiens
LMAPLSPGA

SEQ ID NO: 424637 - protein, 9 aa, Homo Sapiens
NSMRKSMST

SEQ ID NO: 424638 - protein, 9 aa, Homo Sapiens
SRLILSNMS

SEQ ID NO: 424639 - protein, 9 aa, Homo Sapiens
TSEGDHITS

SEQ ID NO: 424640 - protein, 9 aa, Homo Sapiens
NRPEISTDE

SEQ ID NO: 424641 - protein, 9 aa, Homo Sapiens
PQAPSQVWT

SEQ ID NO: 424642 - protein, 9 aa, Homo Sapiens
MARRGHTRW

SEQ ID NO: 424643 - protein, 9 aa, Homo Sapiens
PMSGPGAGS

SEQ ID NO: 424644 - protein, 9 aa, Homo Sapiens
WQLIQWENN

SEQ ID NO: 424645 - protein, 9 aa, Homo Sapiens
GNPTSHGSS

SEQ ID NO: 424646 - protein, 9 aa, Homo Sapiens
AQSYGIPYI

SEQ ID NO: 424647 - protein, 9 aa, Homo Sapiens
MPALGDPEA

SEQ ID NO: 424648 - protein, 9 aa, Homo Sapiens
PFAPSLWLL

SEQ ID NO: 424649 - protein, 9 aa, Homo Sapiens
NPIPSEVPG

SEQ ID NO: 424650 - protein, 9 aa, Homo Sapiens
EGVINHVHV

SEQ ID NO: 424651 - protein, 9 aa, Homo Sapiens
ASLLSTLSQ

SEQ ID NO: 424652 - protein, 9 aa, Homo Sapiens
GRLTWVKLP

SEQ ID NO: 424653 - protein, 9 aa, Homo Sapiens
GRQRSGPAT

SEQ ID NO: 424654 - protein, 9 aa, Homo Sapiens
EQLTLAFYV

SEQ ID NO: 424655 - protein, 9 aa, Homo Sapiens
EEADYGAFG

SEQ ID NO: 424656 - protein, 9 aa, Homo Sapiens
VSTSSSMGS

SEQ ID NO: 424657 - protein, 9 aa, Homo Sapiens
VDHDERFDL

SEQ ID NO: 424658 - protein, 9 aa, Homo Sapiens
EGEKPKAVA

SEQ ID NO: 424659 - protein, 9 aa, Homo Sapiens
QTKFAATIR

SEQ ID NO: 424660 - protein, 9 aa, Homo Sapiens
QPKPPPPEG

SEQ ID NO: 424661 - protein, 9 aa, Homo Sapiens
QDQSALCVA

SEQ ID NO: 424662 - protein, 9 aa, Homo Sapiens
IQSTNNNTK

SEQ ID NO: 424663 - protein, 9 aa, Homo Sapiens
LKALTHLDL

SEQ ID NO: 424664 - protein, 9 aa, Homo Sapiens
TNINVKRCL

SEQ ID NO: 424665 - protein, 9 aa, Homo Sapiens
PRGGTQSFS

SEQ ID NO: 424666 - protein, 9 aa, Homo Sapiens
PQEGRSHHG

SEQ ID NO: 424667 - protein, 9 aa, Homo Sapiens
RSALPQGRA

SEQ ID NO: 424668 - protein, 9 aa, Homo Sapiens
DKLYFFRER

SEQ ID NO: 424669 - protein, 9 aa, Homo Sapiens
TQTMVMGII

SEQ ID NO: 424670 - protein, 9 aa, Homo Sapiens
VTAAAAGAL

SEQ ID NO: 424671 - protein, 9 aa, Homo Sapiens
TLSGDTLLH

SEQ ID NO: 424672 - protein, 9 aa, Homo Sapiens
ASQYSTGKT

SEQ ID NO: 424673 - protein, 9 aa, Homo Sapiens
PMSGEQPPC

SEQ ID NO: 424674 - protein, 9 aa, Homo Sapiens
LDALSQFLR

SEQ ID NO: 424675 - protein, 9 aa, Homo Sapiens
SVLLLGVPQ

SEQ ID NO: 424676 - protein, 9 aa, Homo Sapiens
GFGFHSTQD

SEQ ID NO: 424677 - protein, 9 aa, Homo Sapiens
GCRATVASF

SEQ ID NO: 424678 - protein, 9 aa, Homo Sapiens
PSTAGGCPL

SEQ ID NO: 424679 - protein, 9 aa, Homo Sapiens
KVILELREE

SEQ ID NO: 424680 - protein, 9 aa, Homo Sapiens
VVIDRMLDH

SEQ ID NO: 424681 - protein, 9 aa, Homo Sapiens
DFDKFSCHC

SEQ ID NO: 424682 - protein, 9 aa, Homo Sapiens
TMDGTLHTP

SEQ ID NO: 424683 - protein, 9 aa, Homo Sapiens
RGALGFWGP

SEQ ID NO: 424684 - protein, 9 aa, Homo Sapiens
LDEVIEAEL

SEQ ID NO: 424685 - protein, 9 aa, Homo Sapiens
RVVAALLIL

SEQ ID NO: 424686 - protein, 9 aa, Homo Sapiens
IINLAIVHR

SEQ ID NO: 424687 - protein, 9 aa, Homo Sapiens
KLYSAMPGR

SEQ ID NO: 424688 - protein, 9 aa, Homo Sapiens
QQILMKDNL

SEQ ID NO: 424689 - protein, 9 aa, Homo Sapiens
TGPVTLRRA

SEQ ID NO: 424690 - protein, 9 aa, Homo Sapiens
TIRQALVQQ

SEQ ID NO: 424691 - protein, 9 aa, Homo Sapiens
EATDPVPAV

SEQ ID NO: 424692 - protein, 9 aa, Homo Sapiens
GLQCLPLPP

SEQ ID NO: 424693 - protein, 9 aa, Homo Sapiens
PQLREILDE

SEQ ID NO: 424694 - protein, 9 aa, Homo Sapiens
SKKDSQNCE

SEQ ID NO: 424695 - protein, 9 aa, Homo Sapiens
PRRRRRGRG

SEQ ID NO: 424696 - protein, 9 aa, Homo Sapiens
WCSDDFDGV

SEQ ID NO: 424697 - protein, 9 aa, Homo Sapiens
SLAALFMSQ

SEQ ID NO: 424698 - protein, 9 aa, Homo Sapiens
RRWRCLPHC

SEQ ID NO: 424699 - protein, 9 aa, Homo Sapiens
PTFIPAQMH

SEQ ID NO: 424700 - protein, 9 aa, Homo Sapiens
WKYPTNATG

SEQ ID NO: 424701 - protein, 9 aa, Homo Sapiens
WEGETLTFL

SEQ ID NO: 424702 - protein, 9 aa, Homo Sapiens
LVRPIQGSC

SEQ ID NO: 424703 - protein, 9 aa, Homo Sapiens
LHTLTVQDS

SEQ ID NO: 424704 - protein, 9 aa, Homo Sapiens
PAPPPWRAA

SEQ ID NO: 424705 - protein, 9 aa, Homo Sapiens
KIYYCSQTH

SEQ ID NO: 424706 - protein, 9 aa, Homo Sapiens
AFYTIFTPC

SEQ ID NO: 424707 - protein, 9 aa, Homo Sapiens
RSLFTLRVT

SEQ ID NO: 424708 - protein, 9 aa, Homo Sapiens
NVLTLTFQR

SEQ ID NO: 424709 - protein, 9 aa, Homo Sapiens
GQEMCALIT

SEQ ID NO: 424710 - protein, 9 aa, Homo Sapiens
FSKWCRPWL

SEQ ID NO: 424711 - protein, 9 aa, Homo Sapiens
MVLVASQYS

SEQ ID NO: 424712 - protein, 9 aa, Homo Sapiens
MGSANSTLQ

SEQ ID NO: 424713 - protein, 9 aa, Homo Sapiens
EVYRVTKCV

SEQ ID NO: 424714 - protein, 9 aa, Homo Sapiens
KNKPNLHTD

SEQ ID NO: 424715 - protein, 9 aa, Homo Sapiens
YNTSTVEGR

SEQ ID NO: 424716 - protein, 9 aa, Homo Sapiens
GRTGSSSSA

SEQ ID NO: 424717 - protein, 9 aa, Homo Sapiens
TVHIMKNRN

SEQ ID NO: 424718 - protein, 9 aa, Homo Sapiens
HPSFLQPSP

SEQ ID NO: 424719 - protein, 9 aa, Homo Sapiens
EKNQWCEEL

SEQ ID NO: 424720 - protein, 9 aa, Homo Sapiens
HYGTPEELQ

SEQ ID NO: 424721 - protein, 9 aa, Homo Sapiens
FVAQIHGAN

SEQ ID NO: 424722 - protein, 9 aa, Homo Sapiens
IFLRPRGRC

SEQ ID NO: 424723 - protein, 9 aa, Homo Sapiens
GNNERYCCS

SEQ ID NO: 424724 - protein, 9 aa, Homo Sapiens
AAVDLCGCL

SEQ ID NO: 424725 - protein, 9 aa, Homo Sapiens
ATIRNDFCV

SEQ ID NO: 424726 - protein, 9 aa, Homo Sapiens
TIDVDHVVM

SEQ ID NO: 424727 - protein, 9 aa, Homo Sapiens
AHGYGVCMG

SEQ ID NO: 424728 - protein, 9 aa, Homo Sapiens
SQNWGSLPL

SEQ ID NO: 424729 - protein, 9 aa, Homo Sapiens
RLLSHLRCR

SEQ ID NO: 424730 - protein, 9 aa, Homo Sapiens
VFTEEEPGL

SEQ ID NO: 424731 - protein, 9 aa, Homo Sapiens
VPVLRLSQR

SEQ ID NO: 424732 - protein, 9 aa, Homo Sapiens
SKKVSTRKN

SEQ ID NO: 424733 - protein, 9 aa, Homo Sapiens
ESTDIGICT

SEQ ID NO: 424734 - protein, 9 aa, Homo Sapiens
CVMCLVSQH

SEQ ID NO: 424735 - protein, 9 aa, Homo Sapiens
MIAKNWKIK

SEQ ID NO: 424736 - protein, 9 aa, Homo Sapiens
MSLLVQRTI

SEQ ID NO: 424737 - protein, 9 aa, Homo Sapiens
TLKMIRRGD

SEQ ID NO: 424738 - protein, 9 aa, Homo Sapiens
VELTGGVDG

SEQ ID NO: 424739 - protein, 9 aa, Homo Sapiens
INHGENLKV

SEQ ID NO: 424740 - protein, 9 aa, Homo Sapiens
CQLHGNLGE

SEQ ID NO: 424741 - protein, 9 aa, Homo Sapiens
ASRMRAGTC

SEQ ID NO: 424742 - protein, 9 aa, Homo Sapiens
DQVPRPRPR

SEQ ID NO: 424743 - protein, 9 aa, Homo Sapiens
PSSGKRCPP

SEQ ID NO: 424744 - protein, 9 aa, Homo Sapiens
SRQAQDLAQ

SEQ ID NO: 424745 - protein, 9 aa, Homo Sapiens
FWLAGLDIT

SEQ ID NO: 424746 - protein, 9 aa, Homo Sapiens
SIATRSPAP

SEQ ID NO: 424747 - protein, 9 aa, Homo Sapiens
SLNIPAPRP

SEQ ID NO: 424748 - protein, 9 aa, Homo Sapiens
FFKYYGTQE

SEQ ID NO: 424749 - protein, 9 aa, Homo Sapiens
TEGRPPSPR

SEQ ID NO: 424750 - protein, 9 aa, Homo Sapiens
KPMVLVASQ

SEQ ID NO: 424751 - protein, 9 aa, Homo Sapiens
HPHGDGQQV

SEQ ID NO: 424752 - protein, 9 aa, Homo Sapiens
DLEDIVHNI

SEQ ID NO: 424753 - protein, 9 aa, Homo Sapiens
KTNPQCHQD

SEQ ID NO: 424754 - protein, 9 aa, Homo Sapiens
LHEGVINHV

SEQ ID NO: 424755 - protein, 9 aa, Homo Sapiens
LPAGPSALP

SEQ ID NO: 424756 - protein, 9 aa, Homo Sapiens
FLQGLSLVG

SEQ ID NO: 424757 - protein, 9 aa, Homo Sapiens
SANVTKKKV

SEQ ID NO: 424758 - protein, 9 aa, Homo Sapiens
FRVMRGISC

SEQ ID NO: 424759 - protein, 9 aa, Homo Sapiens
HLWSRVGPR

SEQ ID NO: 424760 - protein, 9 aa, Homo Sapiens
GWAATVPGH

SEQ ID NO: 424761 - protein, 9 aa, Homo Sapiens
LMWGMGMRT

SEQ ID NO: 424762 - protein, 9 aa, Homo Sapiens
SGTPPVNAT

SEQ ID NO: 424763 - protein, 9 aa, Homo Sapiens
EGPLARVHA

SEQ ID NO: 424764 - protein, 9 aa, Homo Sapiens
QMLLFGLFP

SEQ ID NO: 424765 - protein, 9 aa, Homo Sapiens
AVPSSPDDS

SEQ ID NO: 424766 - protein, 9 aa, Homo Sapiens
FFRCSLFTC

SEQ ID NO: 424767 - protein, 9 aa, Homo Sapiens
PIQPEQQAV

SEQ ID NO: 424768 - protein, 9 aa, Homo Sapiens
SSPTKCEIC

SEQ ID NO: 424769 - protein, 9 aa, Homo Sapiens
LLLLLVVLA

SEQ ID NO: 424770 - protein, 9 aa, Homo Sapiens
QQWPGPGFT

SEQ ID NO: 424771 - protein, 9 aa, Homo Sapiens
DLAFMMRVP

SEQ ID NO: 424772 - protein, 9 aa, Homo Sapiens
MVVMSDLSI

SEQ ID NO: 424773 - protein, 9 aa, Homo Sapiens
LPQLLGPPP

SEQ ID NO: 424774 - protein, 9 aa, Homo Sapiens
QLLVYAFLD

SEQ ID NO: 424775 - protein, 9 aa, Homo Sapiens
RFRWEVEKT

SEQ ID NO: 424776 - protein, 9 aa, Homo Sapiens
ERHVKLTDF

SEQ ID NO: 424777 - protein, 9 aa, Homo Sapiens
VKMRTVVLT

SEQ ID NO: 424778 - protein, 9 aa, Homo Sapiens
NEDIRTKLT

SEQ ID NO: 424779 - protein, 9 aa, Homo Sapiens
VDNFSTQYV

SEQ ID NO: 424780 - protein, 9 aa, Homo Sapiens
QTFLSEVVG

SEQ ID NO: 424781 - protein, 9 aa, Homo Sapiens
PLKDKRAGS

SEQ ID NO: 424782 - protein, 9 aa, Homo Sapiens
PQPWRPHAG

SEQ ID NO: 424783 - protein, 9 aa, Homo Sapiens
ARQPSVWCP

SEQ ID NO: 424784 - protein, 9 aa, Homo Sapiens
DINYLLKWH

SEQ ID NO: 424785 - protein, 9 aa, Homo Sapiens
VGLVAEGAL

SEQ ID NO: 424786 - protein, 9 aa, Homo Sapiens
AVGVTAVET

SEQ ID NO: 424787 - protein, 9 aa, Homo Sapiens
ALLYHEPLE

SEQ ID NO: 424788 - protein, 9 aa, Homo Sapiens
PAGWAGSGH

SEQ ID NO: 424789 - protein, 9 aa, Homo Sapiens
RRGAPGHPG

SEQ ID NO: 424790 - protein, 9 aa, Homo Sapiens
SHSRGIRLG

SEQ ID NO: 424791 - protein, 9 aa, Homo Sapiens
LLTQPSPAS

SEQ ID NO: 424792 - protein, 9 aa, Homo Sapiens
PRAVSGNEV

SEQ ID NO: 424793 - protein, 9 aa, Homo Sapiens
RGQIQLKGI

SEQ ID NO: 424794 - protein, 9 aa, Homo Sapiens
HSNVNGSKV

SEQ ID NO: 424795 - protein, 9 aa, Homo Sapiens
KKYIDKIIG

SEQ ID NO: 424796 - protein, 9 aa, Homo Sapiens
ITPHLPHQP

SEQ ID NO: 424797 - protein, 9 aa, Homo Sapiens
IQAKTQEFR

SEQ ID NO: 424798 - protein, 9 aa, Homo Sapiens
QHRFLLPAS

SEQ ID NO: 424799 - protein, 9 aa, Homo Sapiens
RLLHDYQEL

SEQ ID NO: 424800 - protein, 9 aa, Homo Sapiens
DWVYYESCN

SEQ ID NO: 424801 - protein, 9 aa, Homo Sapiens
WCPWTETTT

SEQ ID NO: 424802 - protein, 9 aa, Homo Sapiens
TGPAPLRVH

SEQ ID NO: 424803 - protein, 9 aa, Homo Sapiens
DLLINVQQL

SEQ ID NO: 424804 - protein, 9 aa, Homo Sapiens
GMDPAVHSA

SEQ ID NO: 424805 - protein, 9 aa, Homo Sapiens
AAPRCWRCW

SEQ ID NO: 424806 - protein, 9 aa, Homo Sapiens
KETPIEQEI

SEQ ID NO: 424807 - protein, 9 aa, Homo Sapiens
PDGLSKPAA

SEQ ID NO: 424808 - protein, 9 aa, Homo Sapiens
MLLFGLFPL

SEQ ID NO: 424809 - protein, 9 aa, Homo Sapiens
CTWAPEPRW

SEQ ID NO: 424810 - protein, 9 aa, Homo Sapiens
PATAAAAAT

SEQ ID NO: 424811 - protein, 9 aa, Homo Sapiens
EHAEVREIK

SEQ ID NO: 424812 - protein, 9 aa, Homo Sapiens
GWKRTQQRP

SEQ ID NO: 424813 - protein, 9 aa, Homo Sapiens
MVCSLIHLC

SEQ ID NO: 424814 - protein, 9 aa, Homo Sapiens
ALPSLTNPL

SEQ ID NO: 424815 - protein, 9 aa, Homo Sapiens
QAEDMYSAQ

SEQ ID NO: 424816 - protein, 9 aa, Homo Sapiens
RVRGVKQPN

SEQ ID NO: 424817 - protein, 9 aa, Homo Sapiens
FIIFLKQDI

SEQ ID NO: 424818 - protein, 9 aa, Homo Sapiens
VSHLGNIAV

SEQ ID NO: 424819 - protein, 9 aa, Homo Sapiens
THGAPAPSL

SEQ ID NO: 424820 - protein, 9 aa, Homo Sapiens
LDPEDMMLE

SEQ ID NO: 424821 - protein, 9 aa, Homo Sapiens
ELLRGLNDL

SEQ ID NO: 424822 - protein, 9 aa, Homo Sapiens
LLRGLNDLL

SEQ ID NO: 424823 - protein, 9 aa, Homo Sapiens
ASSPTKCEI

SEQ ID NO: 424824 - protein, 9 aa, Homo Sapiens
GESLEMDLD

SEQ ID NO: 424825 - protein, 9 aa, Homo Sapiens
GWTACARTC

SEQ ID NO: 424826 - protein, 9 aa, Homo Sapiens
LPALSSWSH

SEQ ID NO: 424827 - protein, 9 aa, Homo Sapiens
SPPVRLCVP

SEQ ID NO: 424828 - protein, 9 aa, Homo Sapiens
DALSQFLRK

SEQ ID NO: 424829 - protein, 9 aa, Homo Sapiens
ESKCAFLRT

SEQ ID NO: 424830 - protein, 9 aa, Homo Sapiens
VALGLCQGA

SEQ ID NO: 424831 - protein, 9 aa, Homo Sapiens
VGAGTGGGP

SEQ ID NO: 424832 - protein, 9 aa, Homo Sapiens
LKFPEIVTP

SEQ ID NO: 424833 - protein, 9 aa, Homo Sapiens
SLLGVLQAK

SEQ ID NO: 424834 - protein, 9 aa, Homo Sapiens
ELEHAGARL

SEQ ID NO: 424835 - protein, 9 aa, Homo Sapiens
WKRKDKKRV

SEQ ID NO: 424836 - protein, 9 aa, Homo Sapiens
DQLTLSQCK

SEQ ID NO: 424837 - protein, 9 aa, Homo Sapiens
AQLLPLLHS

SEQ ID NO: 424838 - protein, 9 aa, Homo Sapiens
TRKVPWKRK

SEQ ID NO: 424839 - protein, 9 aa, Homo Sapiens
RESVPSSSP

SEQ ID NO: 424840 - protein, 9 aa, Homo Sapiens
GVSRTDLIE

SEQ ID NO: 424841 - protein, 9 aa, Homo Sapiens
QLEHVQEMQ

SEQ ID NO: 424842 - protein, 9 aa, Homo Sapiens
SIRVDTHDQ

SEQ ID NO: 424843 - protein, 9 aa, Homo Sapiens
SAFGDHPIV

SEQ ID NO: 424844 - protein, 9 aa, Homo Sapiens
QLKGILMHR

SEQ ID NO: 424845 - protein, 9 aa, Homo Sapiens
LGRLMIQHE

SEQ ID NO: 424846 - protein, 9 aa, Homo Sapiens
VSAVSGEVW

SEQ ID NO: 424847 - protein, 9 aa, Homo Sapiens
PLSRLHLFP

SEQ ID NO: 424848 - protein, 9 aa, Homo Sapiens
AGALRLRPH

SEQ ID NO: 424849 - protein, 9 aa, Homo Sapiens
VQPSSSVVM

SEQ ID NO: 424850 - protein, 9 aa, Homo Sapiens
QAHEYQEQK

SEQ ID NO: 424851 - protein, 9 aa, Homo Sapiens
PKRPRLQWP

SEQ ID NO: 424852 - protein, 9 aa, Homo Sapiens
QQEVLQNIS

SEQ ID NO: 424853 - protein, 9 aa, Homo Sapiens
RVCRAAGPG

SEQ ID NO: 424854 - protein, 9 aa, Homo Sapiens
TRWSACPVA

SEQ ID NO: 424855 - protein, 9 aa, Homo Sapiens
WKAFHQNDV

SEQ ID NO: 424856 - protein, 9 aa, Homo Sapiens
RQPVNVFIS

SEQ ID NO: 424857 - protein, 9 aa, Homo Sapiens
RVSPVRNSP

SEQ ID NO: 424858 - protein, 9 aa, Homo Sapiens
ITGPTTQTT

SEQ ID NO: 424859 - protein, 9 aa, Homo Sapiens
TVSMPSMVV

SEQ ID NO: 424860 - protein, 9 aa, Homo Sapiens
NDKPATTIG

SEQ ID NO: 424861 - protein, 9 aa, Homo Sapiens
GLPAVWTRV

SEQ ID NO: 424862 - protein, 9 aa, Homo Sapiens
THLYTCGTG

SEQ ID NO: 424863 - protein, 9 aa, Homo Sapiens
EVKLQLLLH

SEQ ID NO: 424864 - protein, 9 aa, Homo Sapiens
PPPPEQPSS

SEQ ID NO: 424865 - protein, 9 aa, Homo Sapiens
SSGPAVMPP

SEQ ID NO: 424866 - protein, 9 aa, Homo Sapiens
PLEDGVPGV

SEQ ID NO: 424867 - protein, 9 aa, Homo Sapiens
TTYRKLLEG

SEQ ID NO: 424868 - protein, 9 aa, Homo Sapiens
HALEWFEQE

SEQ ID NO: 424869 - protein, 9 aa, Homo Sapiens
SALPDRKTT

SEQ ID NO: 424870 - protein, 9 aa, Homo Sapiens
LHIDVVTGC

SEQ ID NO: 424871 - protein, 9 aa, Homo Sapiens
SIVRTARGP

SEQ ID NO: 424872 - protein, 9 aa, Homo Sapiens
TDMSPGGGA

SEQ ID NO: 424873 - protein, 9 aa, Homo Sapiens
SRETCSSSP

SEQ ID NO: 424874 - protein, 9 aa, Homo Sapiens
ITKYWASLW

SEQ ID NO: 424875 - protein, 9 aa, Homo Sapiens
IPEKKKTRM

SEQ ID NO: 424876 - protein, 9 aa, Homo Sapiens
QLAGIMGKN

SEQ ID NO: 424877 - protein, 9 aa, Homo Sapiens
PTTATSTES

SEQ ID NO: 424878 - protein, 9 aa, Homo Sapiens
SNRRTDVSD

SEQ ID NO: 424879 - protein, 9 aa, Homo Sapiens
PLKFRGGNH

SEQ ID NO: 424880 - protein, 9 aa, Homo Sapiens
QSSLATQSQ

SEQ ID NO: 424881 - protein, 9 aa, Homo Sapiens
VWALYPLYP

SEQ ID NO: 424882 - protein, 9 aa, Homo Sapiens
NHLLGPRPL

SEQ ID NO: 424883 - protein, 9 aa, Homo Sapiens
CLLTAHGQG

SEQ ID NO: 424884 - protein, 9 aa, Homo Sapiens
PQQTPLCKH

SEQ ID NO: 424885 - protein, 9 aa, Homo Sapiens
CMAPEVFQV

SEQ ID NO: 424886 - protein, 9 aa, Homo Sapiens
GGTSAMNVE

SEQ ID NO: 424887 - protein, 9 aa, Homo Sapiens
PTPGNNERY

SEQ ID NO: 424888 - protein, 9 aa, Homo Sapiens
TSTAGTSLP

SEQ ID NO: 424889 - protein, 9 aa, Homo Sapiens
VENGRGHHH

SEQ ID NO: 424890 - protein, 9 aa, Homo Sapiens
LEREQWELG

SEQ ID NO: 424891 - protein, 9 aa, Homo Sapiens
PWTETTTWH

SEQ ID NO: 424892 - protein, 9 aa, Homo Sapiens
MADLLPVQE

SEQ ID NO: 424893 - protein, 9 aa, Homo Sapiens
KSKSKSGFR

SEQ ID NO: 424894 - protein, 9 aa, Homo Sapiens
NEGGKEVMK

SEQ ID NO: 424895 - protein, 9 aa, Homo Sapiens
SALPSPPSP

SEQ ID NO: 424896 - protein, 9 aa, Homo Sapiens
PHPQLQPLT

SEQ ID NO: 424897 - protein, 9 aa, Homo Sapiens
GVQNPRKKH

SEQ ID NO: 424898 - protein, 9 aa, Homo Sapiens
TSTSCSTMS

SEQ ID NO: 424899 - protein, 9 aa, Homo Sapiens
DEGVYECHV

SEQ ID NO: 424900 - protein, 9 aa, Homo Sapiens
WSQGKKPSP

SEQ ID NO: 424901 - protein, 9 aa, Homo Sapiens
AIRKYTSKM

SEQ ID NO: 424902 - protein, 9 aa, Homo Sapiens
RKSKSKSGF

SEQ ID NO: 424903 - protein, 9 aa, Homo Sapiens
MLSSISRPC

SEQ ID NO: 424904 - protein, 9 aa, Homo Sapiens
PPPSWPDGW

SEQ ID NO: 424905 - protein, 9 aa, Homo Sapiens
VPELYAVLP

SEQ ID NO: 424906 - protein, 9 aa, Homo Sapiens
VKLVKQGGR

SEQ ID NO: 424907 - protein, 9 aa, Homo Sapiens
KIVHSIISS

SEQ ID NO: 424908 - protein, 9 aa, Homo Sapiens
SSQPRGSSS

SEQ ID NO: 424909 - protein, 9 aa, Homo Sapiens
IRSLEPGST

SEQ ID NO: 424910 - protein, 9 aa, Homo Sapiens
HDRSVSRDG

SEQ ID NO: 424911 - protein, 9 aa, Homo Sapiens
TSTLSPQLC

SEQ ID NO: 424912 - protein, 9 aa, Homo Sapiens
QQLSSLMMT

SEQ ID NO: 424913 - protein, 9 aa, Homo Sapiens
DPRFQPTAK

SEQ ID NO: 424914 - protein, 9 aa, Homo Sapiens
CAHGHVEVV

SEQ ID NO: 424915 - protein, 9 aa, Homo Sapiens
GEHRRNDSY

SEQ ID NO: 424916 - protein, 9 aa, Homo Sapiens
KIWKEKLAH

SEQ ID NO: 424917 - protein, 9 aa, Homo Sapiens
TTSALLHRV

SEQ ID NO: 424918 - protein, 9 aa, Homo Sapiens
SSSRVRHVA

SEQ ID NO: 424919 - protein, 9 aa, Homo Sapiens
GNFIWLPSN

SEQ ID NO: 424920 - protein, 9 aa, Homo Sapiens
DLTGVQNPR

SEQ ID NO: 424921 - protein, 9 aa, Homo Sapiens
IPGQETPTP

SEQ ID NO: 424922 - protein, 9 aa, Homo Sapiens
PCPLVAPAR

SEQ ID NO: 424923 - protein, 9 aa, Homo Sapiens
TCPQGARMT

SEQ ID NO: 424924 - protein, 9 aa, Homo Sapiens
LTSPQASSP

SEQ ID NO: 424925 - protein, 9 aa, Homo Sapiens
PEPTPTPTV

SEQ ID NO: 424926 - protein, 9 aa, Homo Sapiens
NSRSWRPSA

SEQ ID NO: 424927 - protein, 9 aa, Homo Sapiens
ISHNLDFAP

SEQ ID NO: 424928 - protein, 9 aa, Homo Sapiens
VNIIQVIEL

SEQ ID NO: 424929 - protein, 9 aa, Homo Sapiens
QVATYSDCC

SEQ ID NO: 424930 - protein, 9 aa, Homo Sapiens
AISHMDVFV

SEQ ID NO: 424931 - protein, 9 aa, Homo Sapiens
YQCGRDQRR

SEQ ID NO: 424932 - protein, 9 aa, Homo Sapiens
LDTAGQERF

SEQ ID NO: 424933 - protein, 9 aa, Homo Sapiens
SCVDSAVTV

SEQ ID NO: 424934 - protein, 9 aa, Homo Sapiens
LHCEADINE

SEQ ID NO: 424935 - protein, 9 aa, Homo Sapiens
ITMDELHRE

SEQ ID NO: 424936 - protein, 9 aa, Homo Sapiens
EIIQVDGSS

SEQ ID NO: 424937 - protein, 9 aa, Homo Sapiens
FYALEKDEG

SEQ ID NO: 424938 - protein, 9 aa, Homo Sapiens
QDLNEGNHT

SEQ ID NO: 424939 - protein, 9 aa, Homo Sapiens
STIDDTVIT

SEQ ID NO: 424940 - protein, 9 aa, Homo Sapiens
PASTPSTSR

SEQ ID NO: 424941 - protein, 9 aa, Homo Sapiens
REYKLVVIG

SEQ ID NO: 424942 - protein, 9 aa, Homo Sapiens
ALPTAACPL

SEQ ID NO: 424943 - protein, 9 aa, Homo Sapiens
HIIAITCVV

SEQ ID NO: 424944 - protein, 9 aa, Homo Sapiens
DTAMLALLH

SEQ ID NO: 424945 - protein, 9 aa, Homo Sapiens
MSGWNPPQG

SEQ ID NO: 424946 - protein, 9 aa, Homo Sapiens
EVSRPFYLE

SEQ ID NO: 424947 - protein, 9 aa, Homo Sapiens
FTRFDKLAA

SEQ ID NO: 424948 - protein, 9 aa, Homo Sapiens
SESEPGTQE

SEQ ID NO: 424949 - protein, 9 aa, Homo Sapiens
GPQERDGAG

SEQ ID NO: 424950 - protein, 9 aa, Homo Sapiens
CRISVASVT

SEQ ID NO: 424951 - protein, 9 aa, Homo Sapiens
APWWHPGRR

SEQ ID NO: 424952 - protein, 9 aa, Homo Sapiens
FPIDEEMIM

SEQ ID NO: 424953 - protein, 9 aa, Homo Sapiens
VKTTDGIGV

SEQ ID NO: 424954 - protein, 9 aa, Homo Sapiens
WSEMLGVGG

SEQ ID NO: 424955 - protein, 9 aa, Homo Sapiens
GFINRTVLA

SEQ ID NO: 424956 - protein, 9 aa, Homo Sapiens
HEAVVHLLM

SEQ ID NO: 424957 - protein, 9 aa, Homo Sapiens
LLAFKKSKK

SEQ ID NO: 424958 - protein, 9 aa, Homo Sapiens
NTSCHPATL

SEQ ID NO: 424959 - protein, 9 aa, Homo Sapiens
ATMPALGDP

SEQ ID NO: 424960 - protein, 9 aa, Homo Sapiens
IAKKGFCHS

SEQ ID NO: 424961 - protein, 9 aa, Homo Sapiens
PMPNLQELW

SEQ ID NO: 424962 - protein, 9 aa, Homo Sapiens
PGASRRWRM

SEQ ID NO: 424963 - protein, 9 aa, Homo Sapiens
QPHRRRPSF

SEQ ID NO: 424964 - protein, 9 aa, Homo Sapiens
ISLPLRGFL

SEQ ID NO: 424965 - protein, 9 aa, Homo Sapiens
TSFSINTSP

SEQ ID NO: 424966 - protein, 9 aa, Homo Sapiens
VASQYSTGK

SEQ ID NO: 424967 - protein, 9 aa, Homo Sapiens
HGPHDLCSP

SEQ ID NO: 424968 - protein, 9 aa, Homo Sapiens
GASWFAFFC

SEQ ID NO: 424969 - protein, 9 aa, Homo Sapiens
SLQLLIPRS

SEQ ID NO: 424970 - protein, 9 aa, Homo Sapiens
GNLHPEEAL

SEQ ID NO: 424971 - protein, 9 aa, Homo Sapiens
SAGTGAVAG

SEQ ID NO: 424972 - protein, 9 aa, Homo Sapiens
RWAGRGPHW

SEQ ID NO: 424973 - protein, 9 aa, Homo Sapiens
LGLRPPHLP

SEQ ID NO: 424974 - protein, 9 aa, Homo Sapiens
LVAGSLAAA

SEQ ID NO: 424975 - protein, 9 aa, Homo Sapiens
KFCIPRPIL

SEQ ID NO: 424976 - protein, 9 aa, Homo Sapiens
TQTGSGSVV

SEQ ID NO: 424977 - protein, 9 aa, Homo Sapiens
EPTATRKVP

SEQ ID NO: 424978 - protein, 9 aa, Homo Sapiens
CENLLKHFL

SEQ ID NO: 424979 - protein, 9 aa, Homo Sapiens
RSPFPRQRR

SEQ ID NO: 424980 - protein, 9 aa, Homo Sapiens
RPTSSSHQA

SEQ ID NO: 424981 - protein, 9 aa, Homo Sapiens
GGILSNDVH

SEQ ID NO: 424982 - protein, 9 aa, Homo Sapiens
PTITMVRVV

SEQ ID NO: 424983 - protein, 9 aa, Homo Sapiens
TVFERNCCS

SEQ ID NO: 424984 - protein, 9 aa, Homo Sapiens
LGTGVPQAA

SEQ ID NO: 424985 - protein, 9 aa, Homo Sapiens
AQLQQSFPG

SEQ ID NO: 424986 - protein, 9 aa, Homo Sapiens
RQRGRLEIS

SEQ ID NO: 424987 - protein, 9 aa, Homo Sapiens
AVAHRETVT

SEQ ID NO: 424988 - protein, 9 aa, Homo Sapiens
GWLGTRRQG

SEQ ID NO: 424989 - protein, 9 aa, Homo Sapiens
LLDPYKFCY

SEQ ID NO: 424990 - protein, 9 aa, Homo Sapiens
KTLQDFLYA

SEQ ID NO: 424991 - protein, 9 aa, Homo Sapiens
SSGFPCPAR

SEQ ID NO: 424992 - protein, 9 aa, Homo Sapiens
APGHPGVGP

SEQ ID NO: 424993 - protein, 9 aa, Homo Sapiens
LRMCSGPST

SEQ ID NO: 424994 - protein, 9 aa, Homo Sapiens
AARATASRG

SEQ ID NO: 424995 - protein, 9 aa, Homo Sapiens
KGANVNEKK

SEQ ID NO: 424996 - protein, 9 aa, Homo Sapiens
YYHHPLNPD

SEQ ID NO: 424997 - protein, 9 aa, Homo Sapiens
LVKFWQPEL

SEQ ID NO: 424998 - protein, 9 aa, Homo Sapiens
IYSLFFLSS

SEQ ID NO: 424999 - protein, 9 aa, Homo Sapiens
SGHWDMDVF

SEQ ID NO: 425000 - protein, 9 aa, Homo Sapiens
VFGEHRRND

SEQ ID NO: 425001 - protein, 9 aa, Homo Sapiens
RTDIPSVIA

SEQ ID NO: 425002 - protein, 9 aa, Homo Sapiens
GIRAQGTRR

SEQ ID NO: 425003 - protein, 9 aa, Homo Sapiens
HELSPPRYK

SEQ ID NO: 425004 - protein, 9 aa, Homo Sapiens
CNQQLDLTL

SEQ ID NO: 425005 - protein, 9 aa, Homo Sapiens
EMDLDEDDS

SEQ ID NO: 425006 - protein, 9 aa, Homo Sapiens
QGTRTIIVN

SEQ ID NO: 425007 - protein, 9 aa, Homo Sapiens
DLLLPGWGG

SEQ ID NO: 425008 - protein, 9 aa, Homo Sapiens
TQRPFDIHV

SEQ ID NO: 425009 - protein, 9 aa, Homo Sapiens
QGGKASQLG

SEQ ID NO: 425010 - protein, 9 aa, Homo Sapiens
SLQCCCHVD

SEQ ID NO: 425011 - protein, 9 aa, Homo Sapiens
LCPHILDRL

SEQ ID NO: 425012 - protein, 9 aa, Homo Sapiens
EDNRKCPPL

SEQ ID NO: 425013 - protein, 9 aa, Homo Sapiens
RWEVEKTAC

SEQ ID NO: 425014 - protein, 9 aa, Homo Sapiens
MNGPVAGTS

SEQ ID NO: 425015 - protein, 9 aa, Homo Sapiens
QAPEDLEAR

SEQ ID NO: 425016 - protein, 9 aa, Homo Sapiens
VQVLWYDIY

SEQ ID NO: 425017 - protein, 9 aa, Homo Sapiens
DLHFHRSTF

SEQ ID NO: 425018 - protein, 9 aa, Homo Sapiens
AGLEAEAAS

SEQ ID NO: 425019 - protein, 9 aa, Homo Sapiens
WPHSRASTR

SEQ ID NO: 425020 - protein, 9 aa, Homo Sapiens
AVVCRSCCW

SEQ ID NO: 425021 - protein, 9 aa, Homo Sapiens
HQPARVNVD

SEQ ID NO: 425022 - protein, 9 aa, Homo Sapiens
ATGHQLQTA

SEQ ID NO: 425023 - protein, 9 aa, Homo Sapiens
APAQPPGPA

SEQ ID NO: 425024 - protein, 9 aa, Homo Sapiens
DDAKAPLKK

SEQ ID NO: 425025 - protein, 9 aa, Homo Sapiens
LSDFKGPWP

SEQ ID NO: 425026 - protein, 9 aa, Homo Sapiens
LVEITKVLG

SEQ ID NO: 425027 - protein, 9 aa, Homo Sapiens
LALPCRVLW

SEQ ID NO: 425028 - protein, 9 aa, Homo Sapiens
VPGTDQWQL

SEQ ID NO: 425029 - protein, 9 aa, Homo Sapiens
LAIVHRFAR

SEQ ID NO: 425030 - protein, 9 aa, Homo Sapiens
FSGKKLALC

SEQ ID NO: 425031 - protein, 9 aa, Homo Sapiens
LPVVGGPGV

SEQ ID NO: 425032 - protein, 9 aa, Homo Sapiens
GLYHSRFEV

SEQ ID NO: 425033 - protein, 9 aa, Homo Sapiens
QWSLPMSST

SEQ ID NO: 425034 - protein, 9 aa, Homo Sapiens
HVSDYSDDD

SEQ ID NO: 425035 - protein, 9 aa, Homo Sapiens
RKRKGRGTR

SEQ ID NO: 425036 - protein, 9 aa, Homo Sapiens
IGGWRICCS

SEQ ID NO: 425037 - protein, 9 aa, Homo Sapiens
KEKLVSFLK

SEQ ID NO: 425038 - protein, 9 aa, Homo Sapiens
ARTARSALP

SEQ ID NO: 425039 - protein, 9 aa, Homo Sapiens
REQPAEAER

SEQ ID NO: 425040 - protein, 9 aa, Homo Sapiens
TAFEEGQAL

SEQ ID NO: 425041 - protein, 9 aa, Homo Sapiens
SLNSAHFNF

SEQ ID NO: 425042 - protein, 9 aa, Homo Sapiens
IGLPLLIPM

SEQ ID NO: 425043 - protein, 9 aa, Homo Sapiens
HKSVRVCRA

SEQ ID NO: 425044 - protein, 9 aa, Homo Sapiens
RMLGLHFHP

SEQ ID NO: 425045 - protein, 9 aa, Homo Sapiens
QKAMCMKMG

SEQ ID NO: 425046 - protein, 9 aa, Homo Sapiens
DRLQRGLPG

SEQ ID NO: 425047 - protein, 9 aa, Homo Sapiens
FCKWQKNIN

SEQ ID NO: 425048 - protein, 9 aa, Homo Sapiens
GTLQPEPPR

SEQ ID NO: 425049 - protein, 9 aa, Homo Sapiens
LGQLKAEFG

SEQ ID NO: 425050 - protein, 9 aa, Homo Sapiens
RWLQEEPGP

SEQ ID NO: 425051 - protein, 9 aa, Homo Sapiens
YMEMHYGHQ

SEQ ID NO: 425052 - protein, 9 aa, Homo Sapiens
SGDTLLHLI

SEQ ID NO: 425053 - protein, 9 aa, Homo Sapiens
PAAEGLRPT

SEQ ID NO: 425054 - protein, 9 aa, Homo Sapiens
DFFRKKVEI

SEQ ID NO: 425055 - protein, 9 aa, Homo Sapiens
QSEQQGEVA

SEQ ID NO: 425056 - protein, 9 aa, Homo Sapiens
DCFKVYANG

SEQ ID NO: 425057 - protein, 9 aa, Homo Sapiens
SPCSMCCVI

SEQ ID NO: 425058 - protein, 9 aa, Homo Sapiens
DVAAGMELR

SEQ ID NO: 425059 - protein, 9 aa, Homo Sapiens
HFHKIRNRA

SEQ ID NO: 425060 - protein, 9 aa, Homo Sapiens
QWPASTTVL

SEQ ID NO: 425061 - protein, 9 aa, Homo Sapiens
MLPKLLCRQ

SEQ ID NO: 425062 - protein, 9 aa, Homo Sapiens
ESISLLSEP

SEQ ID NO: 425063 - protein, 9 aa, Homo Sapiens
YHEFTTSAL

SEQ ID NO: 425064 - protein, 9 aa, Homo Sapiens
LRPVSKKDL

SEQ ID NO: 425065 - protein, 9 aa, Homo Sapiens
VKHCKRFFK

SEQ ID NO: 425066 - protein, 9 aa, Homo Sapiens
VVDGLDELL

SEQ ID NO: 425067 - protein, 9 aa, Homo Sapiens
CAKDRKDPR

SEQ ID NO: 425068 - protein, 9 aa, Homo Sapiens
QRSPGPMWQ

SEQ ID NO: 425069 - protein, 9 aa, Homo Sapiens
ICTISILMS

SEQ ID NO: 425070 - protein, 9 aa, Homo Sapiens
TPLSASAHH

SEQ ID NO: 425071 - protein, 9 aa, Homo Sapiens
RDHDLERLH

SEQ ID NO: 425072 - protein, 9 aa, Homo Sapiens
LAVLGQQVL

SEQ ID NO: 425073 - protein, 9 aa, Homo Sapiens
PHWRGALGF

SEQ ID NO: 425074 - protein, 9 aa, Homo Sapiens
ERVTIMPKD

SEQ ID NO: 425075 - protein, 9 aa, Homo Sapiens
CEICVKRRR

SEQ ID NO: 425076 - protein, 9 aa, Homo Sapiens
EDEFPHVLS

SEQ ID NO: 425077 - protein, 9 aa, Homo Sapiens
AACPALQNP

SEQ ID NO: 425078 - protein, 9 aa, Homo Sapiens
GAVAGAWSG

SEQ ID NO: 425079 - protein, 9 aa, Homo Sapiens
AIIVYLLCE

SEQ ID NO: 425080 - protein, 9 aa, Homo Sapiens
IQKKRSKKV

SEQ ID NO: 425081 - protein, 9 aa, Homo Sapiens
LQRRKNPQE

SEQ ID NO: 425082 - protein, 9 aa, Homo Sapiens
HLGITMKAK

SEQ ID NO: 425083 - protein, 9 aa, Homo Sapiens
PAPSQLPAS

SEQ ID NO: 425084 - protein, 9 aa, Homo Sapiens
IPPAVCGEG

SEQ ID NO: 425085 - protein, 9 aa, Homo Sapiens
RKAEEQARR

SEQ ID NO: 425086 - protein, 9 aa, Homo Sapiens
EIVTPLLTS

SEQ ID NO: 425087 - protein, 9 aa, Homo Sapiens
LSILSCLFP

SEQ ID NO: 425088 - protein, 9 aa, Homo Sapiens
AVLLHCFSL

SEQ ID NO: 425089 - protein, 9 aa, Homo Sapiens
TQLVRQRGR

SEQ ID NO: 425090 - protein, 9 aa, Homo Sapiens
LVQCAIRKY

SEQ ID NO: 425091 - protein, 9 aa, Homo Sapiens
SSQGCREGR

SEQ ID NO: 425092 - protein, 9 aa, Homo Sapiens
CSQMRARCH

SEQ ID NO: 425093 - protein, 9 aa, Homo Sapiens
INVQQLLVV

SEQ ID NO: 425094 - protein, 9 aa, Homo Sapiens
LKRQQQEVE

SEQ ID NO: 425095 - protein, 9 aa, Homo Sapiens
IRAQGTRRS

SEQ ID NO: 425096 - protein, 9 aa, Homo Sapiens
KGLTQALWK

SEQ ID NO: 425097 - protein, 9 aa, Homo Sapiens
VHHRSPTTA

SEQ ID NO: 425098 - protein, 9 aa, Homo Sapiens
KNNISNFLR

SEQ ID NO: 425099 - protein, 9 aa, Homo Sapiens
RGNTQKAMC

SEQ ID NO: 425100 - protein, 9 aa, Homo Sapiens
SLNGISQAD

SEQ ID NO: 425101 - protein, 9 aa, Homo Sapiens
WVQDGRVDR

SEQ ID NO: 425102 - protein, 9 aa, Homo Sapiens
WTVHRIRMM

SEQ ID NO: 425103 - protein, 9 aa, Homo Sapiens
QEKHSSQKI

SEQ ID NO: 425104 - protein, 9 aa, Homo Sapiens
MDLASTAGL

SEQ ID NO: 425105 - protein, 9 aa, Homo Sapiens
MDFFRNHNL

SEQ ID NO: 425106 - protein, 9 aa, Homo Sapiens
EIHGSLGQV

SEQ ID NO: 425107 - protein, 9 aa, Homo Sapiens
RVLWRNPIS

SEQ ID NO: 425108 - protein, 9 aa, Homo Sapiens
HAAARSQGY

SEQ ID NO: 425109 - protein, 9 aa, Homo Sapiens
QISTGGIID

SEQ ID NO: 425110 - protein, 9 aa, Homo Sapiens
HKYDREPQR

SEQ ID NO: 425111 - protein, 9 aa, Homo Sapiens
SAATAEKWC

SEQ ID NO: 425112 - protein, 9 aa, Homo Sapiens
ATWCLHRYN

SEQ ID NO: 425113 - protein, 9 aa, Homo Sapiens
FRKWYSTKG

SEQ ID NO: 425114 - protein, 9 aa, Homo Sapiens
RTNWLSFNA

SEQ ID NO: 425115 - protein, 9 aa, Homo Sapiens
SVWEQWQIH

SEQ ID NO: 425116 - protein, 9 aa, Homo Sapiens
ASILQELKL

SEQ ID NO: 425117 - protein, 9 aa, Homo Sapiens
TCSAHLIAV

SEQ ID NO: 425118 - protein, 9 aa, Homo Sapiens
CVSPKHGCN

SEQ ID NO: 425119 - protein, 9 aa, Homo Sapiens
PQCSRPGRP

SEQ ID NO: 425120 - protein, 9 aa, Homo Sapiens
PEVQLPEVE

SEQ ID NO: 425121 - protein, 9 aa, Homo Sapiens
PEVLTDMSY

SEQ ID NO: 425122 - protein, 9 aa, Homo Sapiens
GGAASRLTA

SEQ ID NO: 425123 - protein, 9 aa, Homo Sapiens
SWVCDLDKA

SEQ ID NO: 425124 - protein, 9 aa, Homo Sapiens
IERYRLDGT

SEQ ID NO: 425125 - protein, 9 aa, Homo Sapiens
LGGDRILPS

SEQ ID NO: 425126 - protein, 9 aa, Homo Sapiens
APRAHEHVV

SEQ ID NO: 425127 - protein, 9 aa, Homo Sapiens
GPVKSFSLG

SEQ ID NO: 425128 - protein, 9 aa, Homo Sapiens
KFIILERGQ

SEQ ID NO: 425129 - protein, 9 aa, Homo Sapiens
WGGQGARDS

SEQ ID NO: 425130 - protein, 9 aa, Homo Sapiens
RAAVDLCGC

SEQ ID NO: 425131 - protein, 9 aa, Homo Sapiens
WKVSTIDDT

SEQ ID NO: 425132 - protein, 9 aa, Homo Sapiens
SMHFALHYE

SEQ ID NO: 425133 - protein, 9 aa, Homo Sapiens
AASSLDAAV

SEQ ID NO: 425134 - protein, 9 aa, Homo Sapiens
HLRGQGLPD

SEQ ID NO: 425135 - protein, 9 aa, Homo Sapiens
TGQYLALIE

SEQ ID NO: 425136 - protein, 9 aa, Homo Sapiens
PGTPDQYQA

SEQ ID NO: 425137 - protein, 9 aa, Homo Sapiens
EDSPERGVP

SEQ ID NO: 425138 - protein, 9 aa, Homo Sapiens
PGHLDQLIY

SEQ ID NO: 425139 - protein, 9 aa, Homo Sapiens
NLLPLAGSQ

SEQ ID NO: 425140 - protein, 9 aa, Homo Sapiens
WSLPMSSTL

SEQ ID NO: 425141 - protein, 9 aa, Homo Sapiens
LARIQEDHT

SEQ ID NO: 425142 - protein, 9 aa, Homo Sapiens
AGSGHPEPH

SEQ ID NO: 425143 - protein, 9 aa, Homo Sapiens
GLGQLLSAV

SEQ ID NO: 425144 - protein, 9 aa, Homo Sapiens
IIQVDGSSD

SEQ ID NO: 425145 - protein, 9 aa, Homo Sapiens
WIAMTYERI

SEQ ID NO: 425146 - protein, 9 aa, Homo Sapiens
PARLPGAWS

SEQ ID NO: 425147 - protein, 9 aa, Homo Sapiens
GIQTTGPVT

SEQ ID NO: 425148 - protein, 9 aa, Homo Sapiens
RLESSLRPR

SEQ ID NO: 425149 - protein, 9 aa, Homo Sapiens
GCCCTPGPV

SEQ ID NO: 425150 - protein, 9 aa, Homo Sapiens
EPRVPRCLG

SEQ ID NO: 425151 - protein, 9 aa, Homo Sapiens
PVPAVLIPT

SEQ ID NO: 425152 - protein, 9 aa, Homo Sapiens
VWMLQQPCQ

SEQ ID NO: 425153 - protein, 9 aa, Homo Sapiens
CMDSNEGPS

SEQ ID NO: 425154 - protein, 9 aa, Homo Sapiens
FFALCSRKN

SEQ ID NO: 425155 - protein, 9 aa, Homo Sapiens
VAEASTGAW

SEQ ID NO: 425156 - protein, 9 aa, Homo Sapiens
LLGGDRILP

SEQ ID NO: 425157 - protein, 9 aa, Homo Sapiens
VGRAVRRKG

SEQ ID NO: 425158 - protein, 9 aa, Homo Sapiens
MRTFSATVR

SEQ ID NO: 425159 - protein, 9 aa, Homo Sapiens
PVDFYFIDF

SEQ ID NO: 425160 - protein, 9 aa, Homo Sapiens
EDSGGHSPC

SEQ ID NO: 425161 - protein, 9 aa, Homo Sapiens
YNLEANKNF

SEQ ID NO: 425162 - protein, 9 aa, Homo Sapiens
KLMADLLPV

SEQ ID NO: 425163 - protein, 9 aa, Homo Sapiens
PHLCSICGL

SEQ ID NO: 425164 - protein, 9 aa, Homo Sapiens
VSYVHSSVS

SEQ ID NO: 425165 - protein, 9 aa, Homo Sapiens
MESLCVPGP

SEQ ID NO: 425166 - protein, 9 aa, Homo Sapiens
YNLDQDNAC

SEQ ID NO: 425167 - protein, 9 aa, Homo Sapiens
FLQASYDVP

SEQ ID NO: 425168 - protein, 9 aa, Homo Sapiens
HWSCLEHWL

SEQ ID NO: 425169 - protein, 9 aa, Homo Sapiens
SANSTLQAE

SEQ ID NO: 425170 - protein, 9 aa, Homo Sapiens
LEKTTPSSL

SEQ ID NO: 425171 - protein, 9 aa, Homo Sapiens
ISSFAFGLF

SEQ ID NO: 425172 - protein, 9 aa, Homo Sapiens
TSRPGQTCQ

SEQ ID NO: 425173 - protein, 9 aa, Homo Sapiens
CEPATCPAV

SEQ ID NO: 425174 - protein, 9 aa, Homo Sapiens
FALGRGLEL

SEQ ID NO: 425175 - protein, 9 aa, Homo Sapiens
QKLAPENRC

SEQ ID NO: 425176 - protein, 9 aa, Homo Sapiens
PSLPGPCAS

SEQ ID NO: 425177 - protein, 9 aa, Homo Sapiens
QTPTSQPKS

SEQ ID NO: 425178 - protein, 9 aa, Homo Sapiens
LCSPVYDIR

SEQ ID NO: 425179 - protein, 9 aa, Homo Sapiens
PWLRPRRQA

SEQ ID NO: 425180 - protein, 9 aa, Homo Sapiens
QDCDANVLL

SEQ ID NO: 425181 - protein, 9 aa, Homo Sapiens
HPLPQLLGP

SEQ ID NO: 425182 - protein, 9 aa, Homo Sapiens
QNGAPAPHP

SEQ ID NO: 425183 - protein, 9 aa, Homo Sapiens
AQQARSHFP

SEQ ID NO: 425184 - protein, 9 aa, Homo Sapiens
EKRYQALKR

SEQ ID NO: 425185 - protein, 9 aa, Homo Sapiens
ARRGHTRWP

SEQ ID NO: 425186 - protein, 9 aa, Homo Sapiens
MPMAMVTRR

SEQ ID NO: 425187 - protein, 9 aa, Homo Sapiens
WSACLSTTS

SEQ ID NO: 425188 - protein, 9 aa, Homo Sapiens
LLCRQMLPT

SEQ ID NO: 425189 - protein, 9 aa, Homo Sapiens
RQIFGPDFC

SEQ ID NO: 425190 - protein, 9 aa, Homo Sapiens
GNPCSASQQ

SEQ ID NO: 425191 - protein, 9 aa, Homo Sapiens
PAPRLLPLP

SEQ ID NO: 425192 - protein, 9 aa, Homo Sapiens
KLKKITIKM

SEQ ID NO: 425193 - protein, 9 aa, Homo Sapiens
EKKKTRMFI

SEQ ID NO: 425194 - protein, 9 aa, Homo Sapiens
EWLREGRTA

SEQ ID NO: 425195 - protein, 9 aa, Homo Sapiens
WYSTKGGEV

SEQ ID NO: 425196 - protein, 9 aa, Homo Sapiens
TMMTLIRTK

SEQ ID NO: 425197 - protein, 9 aa, Homo Sapiens
VESGGPHLL

SEQ ID NO: 425198 - protein, 9 aa, Homo Sapiens
YQCPKCEYC

SEQ ID NO: 425199 - protein, 9 aa, Homo Sapiens
QMLPTLSTL

SEQ ID NO: 425200 - protein, 9 aa, Homo Sapiens
RTVVALGLC

SEQ ID NO: 425201 - protein, 9 aa, Homo Sapiens
HPRNAGKLS

SEQ ID NO: 425202 - protein, 9 aa, Homo Sapiens
RQASLSILV

SEQ ID NO: 425203 - protein, 9 aa, Homo Sapiens
ASAHHLLLP

SEQ ID NO: 425204 - protein, 9 aa, Homo Sapiens
PRATAAGRH

SEQ ID NO: 425205 - protein, 9 aa, Homo Sapiens
EDLETLIAH

SEQ ID NO: 425206 - protein, 9 aa, Homo Sapiens
EHLPQPPQH

SEQ ID NO: 425207 - protein, 9 aa, Homo Sapiens
VSAGPCVRT

SEQ ID NO: 425208 - protein, 9 aa, Homo Sapiens
ASKEGSASE

SEQ ID NO: 425209 - protein, 9 aa, Homo Sapiens
GGLGVDSDA

SEQ ID NO: 425210 - protein, 9 aa, Homo Sapiens
PNGENQAMI

SEQ ID NO: 425211 - protein, 9 aa, Homo Sapiens
SRAESQSCQ

SEQ ID NO: 425212 - protein, 9 aa, Homo Sapiens
LDIPYFAVV

SEQ ID NO: 425213 - protein, 9 aa, Homo Sapiens
RGSLRKWRP

SEQ ID NO: 425214 - protein, 9 aa, Homo Sapiens
PHWTTTAIP

SEQ ID NO: 425215 - protein, 9 aa, Homo Sapiens
QTQKEKKAA

SEQ ID NO: 425216 - protein, 9 aa, Homo Sapiens
QLVHIQPFS

SEQ ID NO: 425217 - protein, 9 aa, Homo Sapiens
KKDVKRQCC

SEQ ID NO: 425218 - protein, 9 aa, Homo Sapiens
VEDVSIPIY

SEQ ID NO: 425219 - protein, 9 aa, Homo Sapiens
ARGAIRKDG

SEQ ID NO: 425220 - protein, 9 aa, Homo Sapiens
LNRYRLGDR

SEQ ID NO: 425221 - protein, 9 aa, Homo Sapiens
LRGGAGPAG

SEQ ID NO: 425222 - protein, 9 aa, Homo Sapiens
AQPQSSVAE

SEQ ID NO: 425223 - protein, 9 aa, Homo Sapiens
AVDLCGCLL

SEQ ID NO: 425224 - protein, 9 aa, Homo Sapiens
TVGLNFFFQ

SEQ ID NO: 425225 - protein, 9 aa, Homo Sapiens
SPQTPTSQP

SEQ ID NO: 425226 - protein, 9 aa, Homo Sapiens
RQRLVEGQA

SEQ ID NO: 425227 - protein, 9 aa, Homo Sapiens
KNQLTRDWK

SEQ ID NO: 425228 - protein, 9 aa, Homo Sapiens
VDHQLLWGR

SEQ ID NO: 425229 - protein, 9 aa, Homo Sapiens
IIYRNLPEY

SEQ ID NO: 425230 - protein, 9 aa, Homo Sapiens
MVDLLVSTE

SEQ ID NO: 425231 - protein, 9 aa, Homo Sapiens
DNEVNSQLY

SEQ ID NO: 425232 - protein, 9 aa, Homo Sapiens
DPGLGGPRR

SEQ ID NO: 425233 - protein, 9 aa, Homo Sapiens
VHPRAPPRT

SEQ ID NO: 425234 - protein, 9 aa, Homo Sapiens
VFFFTIGIT

SEQ ID NO: 425235 - protein, 9 aa, Homo Sapiens
VGGVSTVAR

SEQ ID NO: 425236 - protein, 9 aa, Homo Sapiens
VGVIALTNI

SEQ ID NO: 425237 - protein, 9 aa, Homo Sapiens
TYGNPHNQN

SEQ ID NO: 425238 - protein, 9 aa, Homo Sapiens
LPEGLRASV

SEQ ID NO: 425239 - protein, 9 aa, Homo Sapiens
YHLSPWTFP

SEQ ID NO: 425240 - protein, 9 aa, Homo Sapiens
VFARVLNEN

SEQ ID NO: 425241 - protein, 9 aa, Homo Sapiens
PDWECRIRG

SEQ ID NO: 425242 - protein, 9 aa, Homo Sapiens
PLPIGLQKK

SEQ ID NO: 425243 - protein, 9 aa, Homo Sapiens
RPLRVPPPS

SEQ ID NO: 425244 - protein, 9 aa, Homo Sapiens
LKVCGRGWQ

SEQ ID NO: 425245 - protein, 9 aa, Homo Sapiens
LEDYLREPA

SEQ ID NO: 425246 - protein, 9 aa, Homo Sapiens
ILGPVKMSD

SEQ ID NO: 425247 - protein, 9 aa, Homo Sapiens
IVVSSAPFA

SEQ ID NO: 425248 - protein, 9 aa, Homo Sapiens
EDMMLEENE

SEQ ID NO: 425249 - protein, 9 aa, Homo Sapiens
QLLCEGLLY

SEQ ID NO: 425250 - protein, 9 aa, Homo Sapiens
IKNYYGEKN

SEQ ID NO: 425251 - protein, 9 aa, Homo Sapiens
AQVTMMTLI

SEQ ID NO: 425252 - protein, 9 aa, Homo Sapiens
GLDVDVVLK

SEQ ID NO: 425253 - protein, 9 aa, Homo Sapiens
LKFRGGNHT

SEQ ID NO: 425254 - protein, 9 aa, Homo Sapiens
IVGRLTWVK

SEQ ID NO: 425255 - protein, 9 aa, Homo Sapiens
SDPARWWQL

SEQ ID NO: 425256 - protein, 9 aa, Homo Sapiens
ALDVEITTY

SEQ ID NO: 425257 - protein, 9 aa, Homo Sapiens
HPLTTSASL

SEQ ID NO: 425258 - protein, 9 aa, Homo Sapiens
NHYQSFGNN

SEQ ID NO: 425259 - protein, 9 aa, Homo Sapiens
NPRSSLRIA

SEQ ID NO: 425260 - protein, 9 aa, Homo Sapiens
RQASQKERE

SEQ ID NO: 425261 - protein, 9 aa, Homo Sapiens
PAILLKEIV

SEQ ID NO: 425262 - protein, 9 aa, Homo Sapiens
GAPNPDRFY

SEQ ID NO: 425263 - protein, 9 aa, Homo Sapiens
AWSMLLRTV

SEQ ID NO: 425264 - protein, 9 aa, Homo Sapiens
DGRVWGNLR

SEQ ID NO: 425265 - protein, 9 aa, Homo Sapiens
ENMGALTAS

SEQ ID NO: 425266 - protein, 9 aa, Homo Sapiens
PQVVYCIHA

SEQ ID NO: 425267 - protein, 9 aa, Homo Sapiens
EFFSRPTMA

SEQ ID NO: 425268 - protein, 9 aa, Homo Sapiens
GLLKQFLGN

SEQ ID NO: 425269 - protein, 9 aa, Homo Sapiens
QLGLSTGKK

SEQ ID NO: 425270 - protein, 9 aa, Homo Sapiens
LLDILADSC

SEQ ID NO: 425271 - protein, 9 aa, Homo Sapiens
KFTSGNTVD

SEQ ID NO: 425272 - protein, 9 aa, Homo Sapiens
KFLVIGKIS

SEQ ID NO: 425273 - protein, 9 aa, Homo Sapiens
LGPPPPHQA

SEQ ID NO: 425274 - protein, 9 aa, Homo Sapiens
LQSMAKPKS

SEQ ID NO: 425275 - protein, 9 aa, Homo Sapiens
AICGVGHLA

SEQ ID NO: 425276 - protein, 9 aa, Homo Sapiens
LSQRLHSPH

SEQ ID NO: 425277 - protein, 9 aa, Homo Sapiens
TPSPSVNGM

SEQ ID NO: 425278 - protein, 9 aa, Homo Sapiens
HHLHLHHRN

SEQ ID NO: 425279 - protein, 9 aa, Homo Sapiens
GGNPCSASQ

SEQ ID NO: 425280 - protein, 9 aa, Homo Sapiens
PPEPLEPPG

SEQ ID NO: 425281 - protein, 9 aa, Homo Sapiens
PSPRAVMGA

SEQ ID NO: 425282 - protein, 9 aa, Homo Sapiens
LQELEHFNK

SEQ ID NO: 425283 - protein, 9 aa, Homo Sapiens
GKVDIHLLR

SEQ ID NO: 425284 - protein, 9 aa, Homo Sapiens
PAPRPVCIS

SEQ ID NO: 425285 - protein, 9 aa, Homo Sapiens
PPVFQKKIY

SEQ ID NO: 425286 - protein, 9 aa, Homo Sapiens
SQGGYHRSG

SEQ ID NO: 425287 - protein, 9 aa, Homo Sapiens
AVIFVSVQT

SEQ ID NO: 425288 - protein, 9 aa, Homo Sapiens
AFVPTPCAT

SEQ ID NO: 425289 - protein, 9 aa, Homo Sapiens
RKCVDSPML

SEQ ID NO: 425290 - protein, 9 aa, Homo Sapiens
SQSRSPVPK

SEQ ID NO: 425291 - protein, 9 aa, Homo Sapiens
AQWSLPMSS

SEQ ID NO: 425292 - protein, 9 aa, Homo Sapiens
EDKNCHLAM

SEQ ID NO: 425293 - protein, 9 aa, Homo Sapiens
ICVFLVRRF

SEQ ID NO: 425294 - protein, 9 aa, Homo Sapiens
FDIRVPFLF

SEQ ID NO: 425295 - protein, 9 aa, Homo Sapiens
LKMIRRGDV

SEQ ID NO: 425296 - protein, 9 aa, Homo Sapiens
YDACVVLCL

SEQ ID NO: 425297 - protein, 9 aa, Homo Sapiens
ARDSRRWAG

SEQ ID NO: 425298 - protein, 9 aa, Homo Sapiens
TSATVLCCK

SEQ ID NO: 425299 - protein, 9 aa, Homo Sapiens
MQALVLGPG

SEQ ID NO: 425300 - protein, 9 aa, Homo Sapiens
LSTATSTLS

SEQ ID NO: 425301 - protein, 9 aa, Homo Sapiens
ITHVEGEKP

SEQ ID NO: 425302 - protein, 9 aa, Homo Sapiens
SDREGPVKS

SEQ ID NO: 425303 - protein, 9 aa, Homo Sapiens
PITLPWSRS

SEQ ID NO: 425304 - protein, 9 aa, Homo Sapiens
QMYLTTMDL

SEQ ID NO: 425305 - protein, 9 aa, Homo Sapiens
FLPSAEVEL

SEQ ID NO: 425306 - protein, 9 aa, Homo Sapiens
GNTLQALNA

SEQ ID NO: 425307 - protein, 9 aa, Homo Sapiens
STKKSPRGL

SEQ ID NO: 425308 - protein, 9 aa, Homo Sapiens
IQKDSRTAF

SEQ ID NO: 425309 - protein, 9 aa, Homo Sapiens
DAKAPLKKV

SEQ ID NO: 425310 - protein, 9 aa, Homo Sapiens
CRCLHFAVR

SEQ ID NO: 425311 - protein, 9 aa, Homo Sapiens
APARTGCPR

SEQ ID NO: 425312 - protein, 9 aa, Homo Sapiens
HQPDLIYLH

SEQ ID NO: 425313 - protein, 9 aa, Homo Sapiens
TWWTSGAGG

SEQ ID NO: 425314 - protein, 9 aa, Homo Sapiens
KVTVLRVWV

SEQ ID NO: 425315 - protein, 9 aa, Homo Sapiens
EERMTGHGR

SEQ ID NO: 425316 - protein, 9 aa, Homo Sapiens
GGTTPKPRG

SEQ ID NO: 425317 - protein, 9 aa, Homo Sapiens
GTVLLDIIQ

SEQ ID NO: 425318 - protein, 9 aa, Homo Sapiens
NNALRDIQT

SEQ ID NO: 425319 - protein, 9 aa, Homo Sapiens
GQGQDGSPV

SEQ ID NO: 425320 - protein, 9 aa, Homo Sapiens
PSVNGMAAP

SEQ ID NO: 425321 - protein, 9 aa, Homo Sapiens
RNCCSEDCA

SEQ ID NO: 425322 - protein, 9 aa, Homo Sapiens
LFFKYYGTQ

SEQ ID NO: 425323 - protein, 9 aa, Homo Sapiens
RPRGRCKLG

SEQ ID NO: 425324 - protein, 9 aa, Homo Sapiens
TGLFLFTFL

SEQ ID NO: 425325 - protein, 9 aa, Homo Sapiens
HPLRSASST

SEQ ID NO: 425326 - protein, 9 aa, Homo Sapiens
EGLPAVWTR

SEQ ID NO: 425327 - protein, 9 aa, Homo Sapiens
PPWRAALLG

SEQ ID NO: 425328 - protein, 9 aa, Homo Sapiens
NYSNAGLTR

SEQ ID NO: 425329 - protein, 9 aa, Homo Sapiens
PIPGRTGSS

SEQ ID NO: 425330 - protein, 9 aa, Homo Sapiens
KTTPSSLAQ

SEQ ID NO: 425331 - protein, 9 aa, Homo Sapiens
GCDLKNYNK

SEQ ID NO: 425332 - protein, 9 aa, Homo Sapiens
TLMRPLRTA

SEQ ID NO: 425333 - protein, 9 aa, Homo Sapiens
QGMVIASDW

SEQ ID NO: 425334 - protein, 9 aa, Homo Sapiens
GERCLESLC

SEQ ID NO: 425335 - protein, 9 aa, Homo Sapiens
SNTFYLADE

SEQ ID NO: 425336 - protein, 9 aa, Homo Sapiens
DVIITQQLV

SEQ ID NO: 425337 - protein, 9 aa, Homo Sapiens
HARMKVTMP

SEQ ID NO: 425338 - protein, 9 aa, Homo Sapiens
TITSEGDHI

SEQ ID NO: 425339 - protein, 9 aa, Homo Sapiens
CNEGHCTAK

SEQ ID NO: 425340 - protein, 9 aa, Homo Sapiens
KCGFGFVYF

SEQ ID NO: 425341 - protein, 9 aa, Homo Sapiens
VIRRQSWLR

SEQ ID NO: 425342 - protein, 9 aa, Homo Sapiens
MCVNSRTCA

SEQ ID NO: 425343 - protein, 9 aa, Homo Sapiens
GLQQQTMAV

SEQ ID NO: 425344 - protein, 9 aa, Homo Sapiens
LSTKSMMEV

SEQ ID NO: 425345 - protein, 9 aa, Homo Sapiens
SSTLEHRPP

SEQ ID NO: 425346 - protein, 9 aa, Homo Sapiens
CSSPQCSRP

SEQ ID NO: 425347 - protein, 9 aa, Homo Sapiens
QELVDGILA

SEQ ID NO: 425348 - protein, 9 aa, Homo Sapiens
KAFQLIQST

SEQ ID NO: 425349 - protein, 9 aa, Homo Sapiens
RSHTISFWS

SEQ ID NO: 425350 - protein, 9 aa, Homo Sapiens
GVPMSGPGA

SEQ ID NO: 425351 - protein, 9 aa, Homo Sapiens
MKKSRSVMM

SEQ ID NO: 425352 - protein, 9 aa, Homo Sapiens
PLAPASSHP

SEQ ID NO: 425353 - protein, 9 aa, Homo Sapiens
WLRPSDPEA

SEQ ID NO: 425354 - protein, 9 aa, Homo Sapiens
KDYPTSTSQ

SEQ ID NO: 425355 - protein, 9 aa, Homo Sapiens
PDISLVALA

SEQ ID NO: 425356 - protein, 9 aa, Homo Sapiens
TRVPVPRVS

SEQ ID NO: 425357 - protein, 9 aa, Homo Sapiens
SSYSQQIFW

SEQ ID NO: 425358 - protein, 9 aa, Homo Sapiens
AALRPSTSS

SEQ ID NO: 425359 - protein, 9 aa, Homo Sapiens
AARSQGYLF

SEQ ID NO: 425360 - protein, 9 aa, Homo Sapiens
GDMLQIRIG

SEQ ID NO: 425361 - protein, 9 aa, Homo Sapiens
PPPEGAAQA

SEQ ID NO: 425362 - protein, 9 aa, Homo Sapiens
PLPATTSTG

SEQ ID NO: 425363 - protein, 9 aa, Homo Sapiens
NQERSPDPS

SEQ ID NO: 425364 - protein, 9 aa, Homo Sapiens
SSPEVWALY

SEQ ID NO: 425365 - protein, 9 aa, Homo Sapiens
GPTARSTGA

SEQ ID NO: 425366 - protein, 9 aa, Homo Sapiens
FHHVCTLKI

SEQ ID NO: 425367 - protein, 9 aa, Homo Sapiens
HSIISSFAF

SEQ ID NO: 425368 - protein, 9 aa, Homo Sapiens
ASLRARGNA

SEQ ID NO: 425369 - protein, 9 aa, Homo Sapiens
MLLPRALPS

SEQ ID NO: 425370 - protein, 9 aa, Homo Sapiens
LEHRPPAPG

SEQ ID NO: 425371 - protein, 9 aa, Homo Sapiens
PISAFSHDN

SEQ ID NO: 425372 - protein, 9 aa, Homo Sapiens
IKKSQRHPL

SEQ ID NO: 425373 - protein, 9 aa, Homo Sapiens
CSHTGSAGS

SEQ ID NO: 425374 - protein, 9 aa, Homo Sapiens
SWGCLPSPI

SEQ ID NO: 425375 - protein, 9 aa, Homo Sapiens
GVPQAAPPH

SEQ ID NO: 425376 - protein, 9 aa, Homo Sapiens
HNGKKSITH

SEQ ID NO: 425377 - protein, 9 aa, Homo Sapiens
TTCEKVPVG

SEQ ID NO: 425378 - protein, 9 aa, Homo Sapiens
IGIPGRSGP

SEQ ID NO: 425379 - protein, 9 aa, Homo Sapiens
KLVGRAVRR

SEQ ID NO: 425380 - protein, 9 aa, Homo Sapiens
AEFGNQWIN

SEQ ID NO: 425381 - protein, 9 aa, Homo Sapiens
LWERSPGHP

SEQ ID NO: 425382 - protein, 9 aa, Homo Sapiens
IIWNKINHH

SEQ ID NO: 425383 - protein, 9 aa, Homo Sapiens
LKLYHLNLK

SEQ ID NO: 425384 - protein, 9 aa, Homo Sapiens
GQLLSAVLL

SEQ ID NO: 425385 - protein, 9 aa, Homo Sapiens
TDNYPHAIV

SEQ ID NO: 425386 - protein, 9 aa, Homo Sapiens
LCLILADES

SEQ ID NO: 425387 - protein, 9 aa, Homo Sapiens
DVEITTYRK

SEQ ID NO: 425388 - protein, 9 aa, Homo Sapiens
YVADLVHST

SEQ ID NO: 425389 - protein, 9 aa, Homo Sapiens
KSKPTTGHA

SEQ ID NO: 425390 - protein, 9 aa, Homo Sapiens
LAQSYGIPY

SEQ ID NO: 425391 - protein, 9 aa, Homo Sapiens
KSLFKTRLL

SEQ ID NO: 425392 - protein, 9 aa, Homo Sapiens
SATVLCCKQ

SEQ ID NO: 425393 - protein, 9 aa, Homo Sapiens
EDSPAQLVI

SEQ ID NO: 425394 - protein, 9 aa, Homo Sapiens
GGEARQVRL

SEQ ID NO: 425395 - protein, 9 aa, Homo Sapiens
AMLALLHLE

SEQ ID NO: 425396 - protein, 9 aa, Homo Sapiens
FSPLMETEM

SEQ ID NO: 425397 - protein, 9 aa, Homo Sapiens
TFRNFTSVT

SEQ ID NO: 425398 - protein, 9 aa, Homo Sapiens
GLDELLRGL

SEQ ID NO: 425399 - protein, 9 aa, Homo Sapiens
TTGPNRQIL

SEQ ID NO: 425400 - protein, 9 aa, Homo Sapiens
ANNIVLLPD

SEQ ID NO: 425401 - protein, 9 aa, Homo Sapiens
KMPVMYRIS

SEQ ID NO: 425402 - protein, 9 aa, Homo Sapiens
SLSGTPPVN

SEQ ID NO: 425403 - protein, 9 aa, Homo Sapiens
CVDNNQGAP

SEQ ID NO: 425404 - protein, 9 aa, Homo Sapiens
PVMNHICAN

SEQ ID NO: 425405 - protein, 9 aa, Homo Sapiens
QIFPREVHL

SEQ ID NO: 425406 - protein, 9 aa, Homo Sapiens
PSRPAQPTV

SEQ ID NO: 425407 - protein, 9 aa, Homo Sapiens
LLFGLFPLF

SEQ ID NO: 425408 - protein, 9 aa, Homo Sapiens
PIFEGHIEI

SEQ ID NO: 425409 - protein, 9 aa, Homo Sapiens
VMPRTLEGC

SEQ ID NO: 425410 - protein, 9 aa, Homo Sapiens
VAVWYFPFD

SEQ ID NO: 425411 - protein, 9 aa, Homo Sapiens
CQQREQEQR

SEQ ID NO: 425412 - protein, 9 aa, Homo Sapiens
PQGNRKMHG

SEQ ID NO: 425413 - protein, 9 aa, Homo Sapiens
STCCCTATS

SEQ ID NO: 425414 - protein, 9 aa, Homo Sapiens
AHQDQVDIL

SEQ ID NO: 425415 - protein, 9 aa, Homo Sapiens
TGLRAPCTR

SEQ ID NO: 425416 - protein, 9 aa, Homo Sapiens
QGQASYFYA

SEQ ID NO: 425417 - protein, 9 aa, Homo Sapiens
LIVAVHVAL

SEQ ID NO: 425418 - protein, 9 aa, Homo Sapiens
ISPKKPTSW

SEQ ID NO: 425419 - protein, 9 aa, Homo Sapiens
TRKHHQSDG

SEQ ID NO: 425420 - protein, 9 aa, Homo Sapiens
PTGSCTDSQ

SEQ ID NO: 425421 - protein, 9 aa, Homo Sapiens
GRQTVSWAA

SEQ ID NO: 425422 - protein, 9 aa, Homo Sapiens
PLGPARTGL

SEQ ID NO: 425423 - protein, 9 aa, Homo Sapiens
MGALPSTAA

SEQ ID NO: 425424 - protein, 9 aa, Homo Sapiens
GGASGRSCP

SEQ ID NO: 425425 - protein, 9 aa, Homo Sapiens
LAVKWGRNT

SEQ ID NO: 425426 - protein, 9 aa, Homo Sapiens
TVHRIRMML

SEQ ID NO: 425427 - protein, 9 aa, Homo Sapiens
GQIKQKRRP

SEQ ID NO: 425428 - protein, 9 aa, Homo Sapiens
LIRIIDTPQ

SEQ ID NO: 425429 - protein, 9 aa, Homo Sapiens
VMVDGVAPV

SEQ ID NO: 425430 - protein, 9 aa, Homo Sapiens
LRKLRENLA

SEQ ID NO: 425431 - protein, 9 aa, Homo Sapiens
FGDRRRAPQ

SEQ ID NO: 425432 - protein, 9 aa, Homo Sapiens
REVHLPQPR

SEQ ID NO: 425433 - protein, 9 aa, Homo Sapiens
LQKCKELQE

SEQ ID NO: 425434 - protein, 9 aa, Homo Sapiens
YNVAKACNE

SEQ ID NO: 425435 - protein, 9 aa, Homo Sapiens
AVMGALPST

SEQ ID NO: 425436 - protein, 9 aa, Homo Sapiens
PGSSSERCR

SEQ ID NO: 425437 - protein, 9 aa, Homo Sapiens
EMAVPEVQL

SEQ ID NO: 425438 - protein, 9 aa, Homo Sapiens
PPPRRGSSQ

SEQ ID NO: 425439 - protein, 9 aa, Homo Sapiens
LVSYVHSSV

SEQ ID NO: 425440 - protein, 9 aa, Homo Sapiens
FLSEVVGKM

SEQ ID NO: 425441 - protein, 9 aa, Homo Sapiens
QPQSSVAET

SEQ ID NO: 425442 - protein, 9 aa, Homo Sapiens
LPACQTLQS

SEQ ID NO: 425443 - protein, 9 aa, Homo Sapiens
DVKAQHTGV

SEQ ID NO: 425444 - protein, 9 aa, Homo Sapiens
FMDTRKHHQ

SEQ ID NO: 425445 - protein, 9 aa, Homo Sapiens
LVGYPSTTL

SEQ ID NO: 425446 - protein, 9 aa, Homo Sapiens
HAEVREIKR

SEQ ID NO: 425447 - protein, 9 aa, Homo Sapiens
RDEKDYPTS

SEQ ID NO: 425448 - protein, 9 aa, Homo Sapiens
KDRKLGPEE

SEQ ID NO: 425449 - protein, 9 aa, Homo Sapiens
LMADLLPVQ

SEQ ID NO: 425450 - protein, 9 aa, Homo Sapiens
STMRSTPSM

SEQ ID NO: 425451 - protein, 9 aa, Homo Sapiens
RECNQYSWV

SEQ ID NO: 425452 - protein, 9 aa, Homo Sapiens
EAISWLKDR

SEQ ID NO: 425453 - protein, 9 aa, Homo Sapiens
LSNDVHVWV

SEQ ID NO: 425454 - protein, 9 aa, Homo Sapiens
SQRHPLGRP

SEQ ID NO: 425455 - protein, 9 aa, Homo Sapiens
WEIENKAIQ

SEQ ID NO: 425456 - protein, 9 aa, Homo Sapiens
PDADLYKFA

SEQ ID NO: 425457 - protein, 9 aa, Homo Sapiens
AASHVRHVR

SEQ ID NO: 425458 - protein, 9 aa, Homo Sapiens
MRLAAELGG

SEQ ID NO: 425459 - protein, 9 aa, Homo Sapiens
VPTPCATSN

SEQ ID NO: 425460 - protein, 9 aa, Homo Sapiens
MWGMGMRTS

SEQ ID NO: 425461 - protein, 9 aa, Homo Sapiens
RWMQKWPTL

SEQ ID NO: 425462 - protein, 9 aa, Homo Sapiens
AGGAAEGLG

SEQ ID NO: 425463 - protein, 9 aa, Homo Sapiens
HDRNLLRGR

SEQ ID NO: 425464 - protein, 9 aa, Homo Sapiens
WTYGGSGGG

SEQ ID NO: 425465 - protein, 9 aa, Homo Sapiens
RKDKKRVVV

SEQ ID NO: 425466 - protein, 9 aa, Homo Sapiens
CKEILRPRT

SEQ ID NO: 425467 - protein, 9 aa, Homo Sapiens
LPQGRAPLE

SEQ ID NO: 425468 - protein, 9 aa, Homo Sapiens
IDVVTGCLL

SEQ ID NO: 425469 - protein, 9 aa, Homo Sapiens
GAGHAAAAA

SEQ ID NO: 425470 - protein, 9 aa, Homo Sapiens
AHANEEIDT

SEQ ID NO: 425471 - protein, 9 aa, Homo Sapiens
TLPGRLFRL

SEQ ID NO: 425472 - protein, 9 aa, Homo Sapiens
EWFSSRFLN

SEQ ID NO: 425473 - protein, 9 aa, Homo Sapiens
SWCCAETAV

SEQ ID NO: 425474 - protein, 9 aa, Homo Sapiens
WRQNGGSGR

SEQ ID NO: 425475 - protein, 9 aa, Homo Sapiens
VLPTDTWLL

SEQ ID NO: 425476 - protein, 9 aa, Homo Sapiens
GADLMCGWN

SEQ ID NO: 425477 - protein, 9 aa, Homo Sapiens
HQPLPGQHL

SEQ ID NO: 425478 - protein, 9 aa, Homo Sapiens
SPKKPTSWM

SEQ ID NO: 425479 - protein, 9 aa, Homo Sapiens
IMMSSTPNS

SEQ ID NO: 425480 - protein, 9 aa, Homo Sapiens
GGRGPSGSS

SEQ ID NO: 425481 - protein, 9 aa, Homo Sapiens
TSFDHMPKI

SEQ ID NO: 425482 - protein, 9 aa, Homo Sapiens
MNNIKPDLI

SEQ ID NO: 425483 - protein, 9 aa, Homo Sapiens
VAQLFFFHL

SEQ ID NO: 425484 - protein, 9 aa, Homo Sapiens
MLEGQAAFW

SEQ ID NO: 425485 - protein, 9 aa, Homo Sapiens
SGDRRGNLR

SEQ ID NO: 425486 - protein, 9 aa, Homo Sapiens
CFRLSYDIV

SEQ ID NO: 425487 - protein, 9 aa, Homo Sapiens
LFSISPLSI

SEQ ID NO: 425488 - protein, 9 aa, Homo Sapiens
ATGRFALLS

SEQ ID NO: 425489 - protein, 9 aa, Homo Sapiens
QQQLQRMHH

SEQ ID NO: 425490 - protein, 9 aa, Homo Sapiens
RSSPLLCRK

SEQ ID NO: 425491 - protein, 9 aa, Homo Sapiens
GDAFFRCSL

SEQ ID NO: 425492 - protein, 9 aa, Homo Sapiens
LDMKLMRCY

SEQ ID NO: 425493 - protein, 9 aa, Homo Sapiens
WMTLPGSWS

SEQ ID NO: 425494 - protein, 9 aa, Homo Sapiens
RPRPPEPLE

SEQ ID NO: 425495 - protein, 9 aa, Homo Sapiens
RGRRGLVAP

SEQ ID NO: 425496 - protein, 9 aa, Homo Sapiens
VHGHYKQSS

SEQ ID NO: 425497 - protein, 9 aa, Homo Sapiens
EPHHTLGDS

SEQ ID NO: 425498 - protein, 9 aa, Homo Sapiens
LEPEVSLPT

SEQ ID NO: 425499 - protein, 9 aa, Homo Sapiens
FQVLSLLPV

SEQ ID NO: 425500 - protein, 9 aa, Homo Sapiens
SCVSTPGPA

SEQ ID NO: 425501 - protein, 9 aa, Homo Sapiens
PRFQPTAKE

SEQ ID NO: 425502 - protein, 9 aa, Homo Sapiens
ATLTSTSCS

SEQ ID NO: 425503 - protein, 9 aa, Homo Sapiens
GFRLRLRSR

SEQ ID NO: 425504 - protein, 9 aa, Homo Sapiens
NEGHCTAKD

SEQ ID NO: 425505 - protein, 9 aa, Homo Sapiens
KPSIQKEAV

SEQ ID NO: 425506 - protein, 9 aa, Homo Sapiens
HVVMGTNGQ

SEQ ID NO: 425507 - protein, 9 aa, Homo Sapiens
LLPPAPPQK

SEQ ID NO: 425508 - protein, 9 aa, Homo Sapiens
DREGPVKSF

SEQ ID NO: 425509 - protein, 9 aa, Homo Sapiens
VGSLLGNPI

SEQ ID NO: 425510 - protein, 9 aa, Homo Sapiens
KDRRLSAEI

SEQ ID NO: 425511 - protein, 9 aa, Homo Sapiens
RSRSRSPKN

SEQ ID NO: 425512 - protein, 9 aa, Homo Sapiens
PLHSSWVMT

SEQ ID NO: 425513 - protein, 9 aa, Homo Sapiens
FMMRVPSTP

SEQ ID NO: 425514 - protein, 9 aa, Homo Sapiens
SALRVSPVR

SEQ ID NO: 425515 - protein, 9 aa, Homo Sapiens
NFKLISTST

SEQ ID NO: 425516 - protein, 9 aa, Homo Sapiens
TLPWSRSWW

SEQ ID NO: 425517 - protein, 9 aa, Homo Sapiens
LSWCCAETA

SEQ ID NO: 425518 - protein, 9 aa, Homo Sapiens
PKPEWKHQV

SEQ ID NO: 425519 - protein, 9 aa, Homo Sapiens
WKKAPLPSP

SEQ ID NO: 425520 - protein, 9 aa, Homo Sapiens
ELAVRMCGG

SEQ ID NO: 425521 - protein, 9 aa, Homo Sapiens
KMPKQLVHI

SEQ ID NO: 425522 - protein, 9 aa, Homo Sapiens
ALVMGSPFP

SEQ ID NO: 425523 - protein, 9 aa, Homo Sapiens
AMDGFALGR

SEQ ID NO: 425524 - protein, 9 aa, Homo Sapiens
VPGRRLPQC

SEQ ID NO: 425525 - protein, 9 aa, Homo Sapiens
LKQMVGGSL

SEQ ID NO: 425526 - protein, 9 aa, Homo Sapiens
QCEWNPCPM

SEQ ID NO: 425527 - protein, 9 aa, Homo Sapiens
SMMTSGTWS

SEQ ID NO: 425528 - protein, 9 aa, Homo Sapiens
LACSITVSF

SEQ ID NO: 425529 - protein, 9 aa, Homo Sapiens
IGFHSVEVC

SEQ ID NO: 425530 - protein, 9 aa, Homo Sapiens
KSEGGKRRR

SEQ ID NO: 425531 - protein, 9 aa, Homo Sapiens
EKKEKGNSM

SEQ ID NO: 425532 - protein, 9 aa, Homo Sapiens
HALVLHHAA

SEQ ID NO: 425533 - protein, 9 aa, Homo Sapiens
HRLRLRLPR

SEQ ID NO: 425534 - protein, 9 aa, Homo Sapiens
PHLPSCHPL

SEQ ID NO: 425535 - protein, 9 aa, Homo Sapiens
WGQQAHEYQ

SEQ ID NO: 425536 - protein, 9 aa, Homo Sapiens
GGYNHSSGG

SEQ ID NO: 425537 - protein, 9 aa, Homo Sapiens
SAMYSSSYC

SEQ ID NO: 425538 - protein, 9 aa, Homo Sapiens
CQMSCVNKE

SEQ ID NO: 425539 - protein, 9 aa, Homo Sapiens
PVPPDWECR

SEQ ID NO: 425540 - protein, 9 aa, Homo Sapiens
ARMTVLQPP

SEQ ID NO: 425541 - protein, 9 aa, Homo Sapiens
SILQQFASG

SEQ ID NO: 425542 - protein, 9 aa, Homo Sapiens
QPKQAAEAP

SEQ ID NO: 425543 - protein, 9 aa, Homo Sapiens
TEDTPPPAC

SEQ ID NO: 425544 - protein, 9 aa, Homo Sapiens
SSRGTSWMS

SEQ ID NO: 425545 - protein, 9 aa, Homo Sapiens
TDWDDYVNI

SEQ ID NO: 425546 - protein, 9 aa, Homo Sapiens
RESRFWLAL

SEQ ID NO: 425547 - protein, 9 aa, Homo Sapiens
SRSMTTLPS

SEQ ID NO: 425548 - protein, 9 aa, Homo Sapiens
DEETPVDFY

SEQ ID NO: 425549 - protein, 9 aa, Homo Sapiens
DLTNKRAVD

SEQ ID NO: 425550 - protein, 9 aa, Homo Sapiens
AGGDGHAAG

SEQ ID NO: 425551 - protein, 9 aa, Homo Sapiens
TCGCHQTAI

SEQ ID NO: 425552 - protein, 9 aa, Homo Sapiens
RARPGQLRG

SEQ ID NO: 425553 - protein, 9 aa, Homo Sapiens
RSVLRRSRS

SEQ ID NO: 425554 - protein, 9 aa, Homo Sapiens
WCQPRSPLQ

SEQ ID NO: 425555 - protein, 9 aa, Homo Sapiens
KWTCKQKPV

SEQ ID NO: 425556 - protein, 9 aa, Homo Sapiens
PQPPQRPPL

SEQ ID NO: 425557 - protein, 9 aa, Homo Sapiens
LALDVEITT

SEQ ID NO: 425558 - protein, 9 aa, Homo Sapiens
LRSRSVLRR

SEQ ID NO: 425559 - protein, 9 aa, Homo Sapiens
AQGVDVGPI

SEQ ID NO: 425560 - protein, 9 aa, Homo Sapiens
TELNEICMK

SEQ ID NO: 425561 - protein, 9 aa, Homo Sapiens
TAEGAAGTR

SEQ ID NO: 425562 - protein, 9 aa, Homo Sapiens
DADLYKFAE

SEQ ID NO: 425563 - protein, 9 aa, Homo Sapiens
DGGEKCIHI

SEQ ID NO: 425564 - protein, 9 aa, Homo Sapiens
ISLGSMPNL

SEQ ID NO: 425565 - protein, 9 aa, Homo Sapiens
KYVFVSIPL

SEQ ID NO: 425566 - protein, 9 aa, Homo Sapiens
GGQGQDGSP

SEQ ID NO: 425567 - protein, 9 aa, Homo Sapiens
LGPARTGLL

SEQ ID NO: 425568 - protein, 9 aa, Homo Sapiens
LFINTCGCH

SEQ ID NO: 425569 - protein, 9 aa, Homo Sapiens
VLTGMMGGV

SEQ ID NO: 425570 - protein, 9 aa, Homo Sapiens
EDQLEGTHA

SEQ ID NO: 425571 - protein, 9 aa, Homo Sapiens
TGSANVTKK

SEQ ID NO: 425572 - protein, 9 aa, Homo Sapiens
TDMLLTPAT

SEQ ID NO: 425573 - protein, 9 aa, Homo Sapiens
AIRKKAFKA

SEQ ID NO: 425574 - protein, 9 aa, Homo Sapiens
GSGRRLGGE

SEQ ID NO: 425575 - protein, 9 aa, Homo Sapiens
KNAVKFLVI

SEQ ID NO: 425576 - protein, 9 aa, Homo Sapiens
KRSKKVSTR

SEQ ID NO: 425577 - protein, 9 aa, Homo Sapiens
HFAEVVGHR

SEQ ID NO: 425578 - protein, 9 aa, Homo Sapiens
VSTLELRDS

SEQ ID NO: 425579 - protein, 9 aa, Homo Sapiens
KEKEKAIDY

SEQ ID NO: 425580 - protein, 9 aa, Homo Sapiens
TFALGSLAV

SEQ ID NO: 425581 - protein, 9 aa, Homo Sapiens
TPQPSLPGP

SEQ ID NO: 425582 - protein, 9 aa, Homo Sapiens
LLHDYQELM

SEQ ID NO: 425583 - protein, 9 aa, Homo Sapiens
MMLNVQNLF

SEQ ID NO: 425584 - protein, 9 aa, Homo Sapiens
LDRDEERVH

SEQ ID NO: 425585 - protein, 9 aa, Homo Sapiens
RRRRRGRGC

SEQ ID NO: 425586 - protein, 9 aa, Homo Sapiens
VHIMKNRNG

SEQ ID NO: 425587 - protein, 9 aa, Homo Sapiens
RARILCLTP

SEQ ID NO: 425588 - protein, 9 aa, Homo Sapiens
LLVLPGEAA

SEQ ID NO: 425589 - protein, 9 aa, Homo Sapiens
EKNIRKNGE

SEQ ID NO: 425590 - protein, 9 aa, Homo Sapiens
IKISWVCDL

SEQ ID NO: 425591 - protein, 9 aa, Homo Sapiens
QDHPEEHNL

SEQ ID NO: 425592 - protein, 9 aa, Homo Sapiens
LELRDSALY

SEQ ID NO: 425593 - protein, 9 aa, Homo Sapiens
NTYGNPHNQ

SEQ ID NO: 425594 - protein, 9 aa, Homo Sapiens
HTLYQHDAA

SEQ ID NO: 425595 - protein, 9 aa, Homo Sapiens
VGSCVDSAV

SEQ ID NO: 425596 - protein, 9 aa, Homo Sapiens
EGQQKAFGT

SEQ ID NO: 425597 - protein, 9 aa, Homo Sapiens
PVTPLRVQS

SEQ ID NO: 425598 - protein, 9 aa, Homo Sapiens
SFFIMIPIA

SEQ ID NO: 425599 - protein, 9 aa, Homo Sapiens
LQPNAATGG

SEQ ID NO: 425600 - protein, 9 aa, Homo Sapiens
KNLPEGKRK

SEQ ID NO: 425601 - protein, 9 aa, Homo Sapiens
AGRHPGAQP

SEQ ID NO: 425602 - protein, 9 aa, Homo Sapiens
QRRLSVYWQ

SEQ ID NO: 425603 - protein, 9 aa, Homo Sapiens
TSSNVSILQ

SEQ ID NO: 425604 - protein, 9 aa, Homo Sapiens
GHMNLADST

SEQ ID NO: 425605 - protein, 9 aa, Homo Sapiens
AGEGPLARV

SEQ ID NO: 425606 - protein, 9 aa, Homo Sapiens
SPTNVSALA

SEQ ID NO: 425607 - protein, 9 aa, Homo Sapiens
AHEHVVAQG

SEQ ID NO: 425608 - protein, 9 aa, Homo Sapiens
REPPRVLSV

SEQ ID NO: 425609 - protein, 9 aa, Homo Sapiens
RMGHRVSRL

SEQ ID NO: 425610 - protein, 9 aa, Homo Sapiens
CGDHQDLEQ

SEQ ID NO: 425611 - protein, 9 aa, Homo Sapiens
APSLSTATS

SEQ ID NO: 425612 - protein, 9 aa, Homo Sapiens
HASTKLSRV

SEQ ID NO: 425613 - protein, 9 aa, Homo Sapiens
FLPIFMPFV

SEQ ID NO: 425614 - protein, 9 aa, Homo Sapiens
SYGNIIVIT

SEQ ID NO: 425615 - protein, 9 aa, Homo Sapiens
RVMRGISCL

SEQ ID NO: 425616 - protein, 9 aa, Homo Sapiens
PGSSHACVQ

SEQ ID NO: 425617 - protein, 9 aa, Homo Sapiens
PTSPRRNSQ

SEQ ID NO: 425618 - protein, 9 aa, Homo Sapiens
TCEKVPVGT

SEQ ID NO: 425619 - protein, 9 aa, Homo Sapiens
GLTVYSLGR

SEQ ID NO: 425620 - protein, 9 aa, Homo Sapiens
RCPEEAGAG

SEQ ID NO: 425621 - protein, 9 aa, Homo Sapiens
RPCVPGYQC

SEQ ID NO: 425622 - protein, 9 aa, Homo Sapiens
GKLSPSLPS

SEQ ID NO: 425623 - protein, 9 aa, Homo Sapiens
MDFWRLWAT

SEQ ID NO: 425624 - protein, 9 aa, Homo Sapiens
IMKNRNGGG

SEQ ID NO: 425625 - protein, 9 aa, Homo Sapiens
LEEKGQQIL

SEQ ID NO: 425626 - protein, 9 aa, Homo Sapiens
CTHENCGYK

SEQ ID NO: 425627 - protein, 9 aa, Homo Sapiens
YKKTYMEMH

SEQ ID NO: 425628 - protein, 9 aa, Homo Sapiens
QPGIVQCGL

SEQ ID NO: 425629 - protein, 9 aa, Homo Sapiens
LEGQAAFWR

SEQ ID NO: 425630 - protein, 9 aa, Homo Sapiens
ARVKMRTVV

SEQ ID NO: 425631 - protein, 9 aa, Homo Sapiens
SSFVAPNSL

SEQ ID NO: 425632 - protein, 9 aa, Homo Sapiens
QVRLEDYLR

SEQ ID NO: 425633 - protein, 9 aa, Homo Sapiens
CAPEKHTIK

SEQ ID NO: 425634 - protein, 9 aa, Homo Sapiens
RMVIQKDSR

SEQ ID NO: 425635 - protein, 9 aa, Homo Sapiens
SAGAIRVYA

SEQ ID NO: 425636 - protein, 9 aa, Homo Sapiens
GGEDRVQDI

SEQ ID NO: 425637 - protein, 9 aa, Homo Sapiens
WFGNLVINA

SEQ ID NO: 425638 - protein, 9 aa, Homo Sapiens
CWEEYRVLQ

SEQ ID NO: 425639 - protein, 9 aa, Homo Sapiens
IIQVIELLD

SEQ ID NO: 425640 - protein, 9 aa, Homo Sapiens
GPIGAVRPD

SEQ ID NO: 425641 - protein, 9 aa, Homo Sapiens
CTISILMSA

SEQ ID NO: 425642 - protein, 9 aa, Homo Sapiens
ITEHAEVRE

SEQ ID NO: 425643 - protein, 9 aa, Homo Sapiens
IQKEAVWAL

SEQ ID NO: 425644 - protein, 9 aa, Homo Sapiens
DLAQSYGIP

SEQ ID NO: 425645 - protein, 9 aa, Homo Sapiens
SSSSHPSFL

SEQ ID NO: 425646 - protein, 9 aa, Homo Sapiens
SGALCAALN

SEQ ID NO: 425647 - protein, 9 aa, Homo Sapiens
NLLSLAWKI

SEQ ID NO: 425648 - protein, 9 aa, Homo Sapiens
ARSPRTRPR

SEQ ID NO: 425649 - protein, 9 aa, Homo Sapiens
IPLHSSWVM

SEQ ID NO: 425650 - protein, 9 aa, Homo Sapiens
EQERWQVTA

SEQ ID NO: 425651 - protein, 9 aa, Homo Sapiens
CGTPGCPRA

SEQ ID NO: 425652 - protein, 9 aa, Homo Sapiens
PVLRLSQRL

SEQ ID NO: 425653 - protein, 9 aa, Homo Sapiens
NSPCSMCCV

SEQ ID NO: 425654 - protein, 9 aa, Homo Sapiens
PPALDALSQ

SEQ ID NO: 425655 - protein, 9 aa, Homo Sapiens
PVKMSDEAG

SEQ ID NO: 425656 - protein, 9 aa, Homo Sapiens
SGPARDLVN

SEQ ID NO: 425657 - protein, 9 aa, Homo Sapiens
HSSSQQSLP

SEQ ID NO: 425658 - protein, 9 aa, Homo Sapiens
EAVQVRGSM

SEQ ID NO: 425659 - protein, 9 aa, Homo Sapiens
FRAPLNVTS

SEQ ID NO: 425660 - protein, 9 aa, Homo Sapiens
NIMGFIMNL

SEQ ID NO: 425661 - protein, 9 aa, Homo Sapiens
SHVRHVRSR

SEQ ID NO: 425662 - protein, 9 aa, Homo Sapiens
LMKKKKLEK

SEQ ID NO: 425663 - protein, 9 aa, Homo Sapiens
VVGAFMVCW

SEQ ID NO: 425664 - protein, 9 aa, Homo Sapiens
ERIAGMDPA

SEQ ID NO: 425665 - protein, 9 aa, Homo Sapiens
LLHRVIIIS

SEQ ID NO: 425666 - protein, 9 aa, Homo Sapiens
RDTSKKNKR

SEQ ID NO: 425667 - protein, 9 aa, Homo Sapiens
AAEYFEHGV

SEQ ID NO: 425668 - protein, 9 aa, Homo Sapiens
LCHAAVLNN

SEQ ID NO: 425669 - protein, 9 aa, Homo Sapiens
GQAAFWRSF

SEQ ID NO: 425670 - protein, 9 aa, Homo Sapiens
AMPRATWRS

SEQ ID NO: 425671 - protein, 9 aa, Homo Sapiens
DKRPEGYDL

SEQ ID NO: 425672 - protein, 9 aa, Homo Sapiens
LSFWDTEET

SEQ ID NO: 425673 - protein, 9 aa, Homo Sapiens
FSISPLSIL

SEQ ID NO: 425674 - protein, 9 aa, Homo Sapiens
GKECSINHF

SEQ ID NO: 425675 - protein, 9 aa, Homo Sapiens
ALLKVCGRG

SEQ ID NO: 425676 - protein, 9 aa, Homo Sapiens
CPLASTPPP

SEQ ID NO: 425677 - protein, 9 aa, Homo Sapiens
PSSGFPCPA

SEQ ID NO: 425678 - protein, 9 aa, Homo Sapiens
LELEHLKLE

SEQ ID NO: 425679 - protein, 9 aa, Homo Sapiens
CHKAFRCYS

SEQ ID NO: 425680 - protein, 9 aa, Homo Sapiens
PHGDGQQVL

SEQ ID NO: 425681 - protein, 9 aa, Homo Sapiens
VRIWNCTKE

SEQ ID NO: 425682 - protein, 9 aa, Homo Sapiens
RGLLSLTFH

SEQ ID NO: 425683 - protein, 9 aa, Homo Sapiens
ILDRLQRGL

SEQ ID NO: 425684 - protein, 9 aa, Homo Sapiens
NNIVLLPDP

SEQ ID NO: 425685 - protein, 9 aa, Homo Sapiens
VYVVIRIFC

SEQ ID NO: 425686 - protein, 9 aa, Homo Sapiens
MLYATLWLH

SEQ ID NO: 425687 - protein, 9 aa, Homo Sapiens
SVDMLDVHA

SEQ ID NO: 425688 - protein, 9 aa, Homo Sapiens
QRLPYNIAA

SEQ ID NO: 425689 - protein, 9 aa, Homo Sapiens
HRQLFEAGL

SEQ ID NO: 425690 - protein, 9 aa, Homo Sapiens
GLGGKRSLG

SEQ ID NO: 425691 - protein, 9 aa, Homo Sapiens
QSDIGASKN

SEQ ID NO: 425692 - protein, 9 aa, Homo Sapiens
VHNIPHMSE

SEQ ID NO: 425693 - protein, 9 aa, Homo Sapiens
PVMYRISCL

SEQ ID NO: 425694 - protein, 9 aa, Homo Sapiens
RGRRDWGTM

SEQ ID NO: 425695 - protein, 9 aa, Homo Sapiens
GLRVMLEGQ

SEQ ID NO: 425696 - protein, 9 aa, Homo Sapiens
IQGSCTTIH

SEQ ID NO: 425697 - protein, 9 aa, Homo Sapiens
SSPSCLCSS

SEQ ID NO: 425698 - protein, 9 aa, Homo Sapiens
QHLASGDRR

SEQ ID NO: 425699 - protein, 9 aa, Homo Sapiens
IHNSMCITE

SEQ ID NO: 425700 - protein, 9 aa, Homo Sapiens
GGGGGGYNH

SEQ ID NO: 425701 - protein, 9 aa, Homo Sapiens
LSLTFHPNY

SEQ ID NO: 425702 - protein, 9 aa, Homo Sapiens
CVMGFAQKS

SEQ ID NO: 425703 - protein, 9 aa, Homo Sapiens
IAITIFFCM

SEQ ID NO: 425704 - protein, 9 aa, Homo Sapiens
NQNISSKLT

SEQ ID NO: 425705 - protein, 9 aa, Homo Sapiens
QDEPWEEEF

SEQ ID NO: 425706 - protein, 9 aa, Homo Sapiens
WTFSPLMET

SEQ ID NO: 425707 - protein, 9 aa, Homo Sapiens
GSPSSGKRC

SEQ ID NO: 425708 - protein, 9 aa, Homo Sapiens
LLILSKNLI

SEQ ID NO: 425709 - protein, 9 aa, Homo Sapiens
TMSCLSRPG

SEQ ID NO: 425710 - protein, 9 aa, Homo Sapiens
VPYPPFMPQ

SEQ ID NO: 425711 - protein, 9 aa, Homo Sapiens
GVGSVLGSP

SEQ ID NO: 425712 - protein, 9 aa, Homo Sapiens
VCGGQVRAD

SEQ ID NO: 425713 - protein, 9 aa, Homo Sapiens
RMMLCCMLA

SEQ ID NO: 425714 - protein, 9 aa, Homo Sapiens
LRRGQLIVN

SEQ ID NO: 425715 - protein, 9 aa, Homo Sapiens
LTGVSLDLD

SEQ ID NO: 425716 - protein, 9 aa, Homo Sapiens
EKAEQERLS

SEQ ID NO: 425717 - protein, 9 aa, Homo Sapiens
TKYWASLWN

SEQ ID NO: 425718 - protein, 9 aa, Homo Sapiens
DQVKKRKKR

SEQ ID NO: 425719 - protein, 9 aa, Homo Sapiens
LLLAQTFIL

SEQ ID NO: 425720 - protein, 9 aa, Homo Sapiens
LTGQGCLLS

SEQ ID NO: 425721 - protein, 9 aa, Homo Sapiens
CCEPATCPA

SEQ ID NO: 425722 - protein, 9 aa, Homo Sapiens
RLSQGQRWT

SEQ ID NO: 425723 - protein, 9 aa, Homo Sapiens
WATHYIGDL

SEQ ID NO: 425724 - protein, 9 aa, Homo Sapiens
SGTGKTVVG

SEQ ID NO: 425725 - protein, 9 aa, Homo Sapiens
LLKNCVLLN

SEQ ID NO: 425726 - protein, 9 aa, Homo Sapiens
NLADLCRSQ

SEQ ID NO: 425727 - protein, 9 aa, Homo Sapiens
LPIGLQKKR

SEQ ID NO: 425728 - protein, 9 aa, Homo Sapiens
SVSVCQDVR

SEQ ID NO: 425729 - protein, 9 aa, Homo Sapiens
QHRGLRVML

SEQ ID NO: 425730 - protein, 9 aa, Homo Sapiens
LWVIVKEFQ

SEQ ID NO: 425731 - protein, 9 aa, Homo Sapiens
GTSAMNVER

SEQ ID NO: 425732 - protein, 9 aa, Homo Sapiens
TKLCQFVIL

SEQ ID NO: 425733 - protein, 9 aa, Homo Sapiens
CREPLVDSP

SEQ ID NO: 425734 - protein, 9 aa, Homo Sapiens
SPPPSPPSP

SEQ ID NO: 425735 - protein, 9 aa, Homo Sapiens
NVSILQQFA

SEQ ID NO: 425736 - protein, 9 aa, Homo Sapiens
SGMGQRRMR

SEQ ID NO: 425737 - protein, 9 aa, Homo Sapiens
ARIVVSSAP

SEQ ID NO: 425738 - protein, 9 aa, Homo Sapiens
AQLMAPLSP

SEQ ID NO: 425739 - protein, 9 aa, Homo Sapiens
TATSTLSPQ

SEQ ID NO: 425740 - protein, 9 aa, Homo Sapiens
NAIIAHVLF

SEQ ID NO: 425741 - protein, 9 aa, Homo Sapiens
RISVASVTR

SEQ ID NO: 425742 - protein, 9 aa, Homo Sapiens
VSTRKNGGG

SEQ ID NO: 425743 - protein, 9 aa, Homo Sapiens
LIGGRGQKI

SEQ ID NO: 425744 - protein, 9 aa, Homo Sapiens
NINMKGDAH

SEQ ID NO: 425745 - protein, 9 aa, Homo Sapiens
KLVVIGSGG

SEQ ID NO: 425746 - protein, 9 aa, Homo Sapiens
DGHVSETPL

SEQ ID NO: 425747 - protein, 9 aa, Homo Sapiens
EEQEQSKTE

SEQ ID NO: 425748 - protein, 9 aa, Homo Sapiens
VACLAACAP

SEQ ID NO: 425749 - protein, 9 aa, Homo Sapiens
HPDNWFCYP

SEQ ID NO: 425750 - protein, 9 aa, Homo Sapiens
IVYLLCELL

SEQ ID NO: 425751 - protein, 9 aa, Homo Sapiens
KPVTGNLHP

SEQ ID NO: 425752 - protein, 9 aa, Homo Sapiens
MAGTKPCMA

SEQ ID NO: 425753 - protein, 9 aa, Homo Sapiens
RQPPRERDL

SEQ ID NO: 425754 - protein, 9 aa, Homo Sapiens
VSVAQGTTG

SEQ ID NO: 425755 - protein, 9 aa, Homo Sapiens
HSPCSVLGG

SEQ ID NO: 425756 - protein, 9 aa, Homo Sapiens
EAICLLGGG

SEQ ID NO: 425757 - protein, 9 aa, Homo Sapiens
QKNINMKGD

SEQ ID NO: 425758 - protein, 9 aa, Homo Sapiens
YSAVMPQMV

SEQ ID NO: 425759 - protein, 9 aa, Homo Sapiens
RVFSGKKPP

SEQ ID NO: 425760 - protein, 9 aa, Homo Sapiens
TIGVIGNFT

SEQ ID NO: 425761 - protein, 9 aa, Homo Sapiens
GQEVALQAV

SEQ ID NO: 425762 - protein, 9 aa, Homo Sapiens
DLPLSSVPS

SEQ ID NO: 425763 - protein, 9 aa, Homo Sapiens
SREHQSFWK

SEQ ID NO: 425764 - protein, 9 aa, Homo Sapiens
VLGIQWLQR

SEQ ID NO: 425765 - protein, 9 aa, Homo Sapiens
WRGALGFWG

SEQ ID NO: 425766 - protein, 9 aa, Homo Sapiens
YGMPSTHTM

SEQ ID NO: 425767 - protein, 9 aa, Homo Sapiens
NTKYVCLAN

SEQ ID NO: 425768 - protein, 9 aa, Homo Sapiens
ELLLQNKRS

SEQ ID NO: 425769 - protein, 9 aa, Homo Sapiens
GGVWTGADV

SEQ ID NO: 425770 - protein, 9 aa, Homo Sapiens
MVKQMTDML

SEQ ID NO: 425771 - protein, 9 aa, Homo Sapiens
PAGMGGTCQ

SEQ ID NO: 425772 - protein, 9 aa, Homo Sapiens
CLAWLPCVA

SEQ ID NO: 425773 - protein, 9 aa, Homo Sapiens
GRGTAGGDG

SEQ ID NO: 425774 - protein, 9 aa, Homo Sapiens
GEKCIHITG

SEQ ID NO: 425775 - protein, 9 aa, Homo Sapiens
NIAACPALQ

SEQ ID NO: 425776 - protein, 9 aa, Homo Sapiens
ALYMFYALV

SEQ ID NO: 425777 - protein, 9 aa, Homo Sapiens
GYLMIDSKL

SEQ ID NO: 425778 - protein, 9 aa, Homo Sapiens
SWILHRNAI

SEQ ID NO: 425779 - protein, 9 aa, Homo Sapiens
DMSPGGGAA

SEQ ID NO: 425780 - protein, 9 aa, Homo Sapiens
DKTDPRGGT

SEQ ID NO: 425781 - protein, 9 aa, Homo Sapiens
TPSPWSPSP

SEQ ID NO: 425782 - protein, 9 aa, Homo Sapiens
SVLATGLHL

SEQ ID NO: 425783 - protein, 9 aa, Homo Sapiens
FTYTVAVSG

SEQ ID NO: 425784 - protein, 9 aa, Homo Sapiens
AKNKPNLHT

SEQ ID NO: 425785 - protein, 9 aa, Homo Sapiens
KESQEMCPR

SEQ ID NO: 425786 - protein, 9 aa, Homo Sapiens
IVANVELTG

SEQ ID NO: 425787 - protein, 9 aa, Homo Sapiens
DMYTPLTMR

SEQ ID NO: 425788 - protein, 9 aa, Homo Sapiens
RSVSRDGGW

SEQ ID NO: 425789 - protein, 9 aa, Homo Sapiens
ESTDMVSFL

SEQ ID NO: 425790 - protein, 9 aa, Homo Sapiens
HRVSRLNPK

SEQ ID NO: 425791 - protein, 9 aa, Homo Sapiens
LTLAFYVGY

SEQ ID NO: 425792 - protein, 9 aa, Homo Sapiens
CLLGGGHPV

SEQ ID NO: 425793 - protein, 9 aa, Homo Sapiens
EKAIDYMSH

SEQ ID NO: 425794 - protein, 9 aa, Homo Sapiens
FRIGDREDD

SEQ ID NO: 425795 - protein, 9 aa, Homo Sapiens
HLIAVTLYY

SEQ ID NO: 425796 - protein, 9 aa, Homo Sapiens
DPTAFSILT

SEQ ID NO: 425797 - protein, 9 aa, Homo Sapiens
GWMGAHCHL

SEQ ID NO: 425798 - protein, 9 aa, Homo Sapiens
AGLSPGACR

SEQ ID NO: 425799 - protein, 9 aa, Homo Sapiens
CRTGCCATR

SEQ ID NO: 425800 - protein, 9 aa, Homo Sapiens
MREVAEAAA

SEQ ID NO: 425801 - protein, 9 aa, Homo Sapiens
WAICWELLW

SEQ ID NO: 425802 - protein, 9 aa, Homo Sapiens
RPGPSRAHC

SEQ ID NO: 425803 - protein, 9 aa, Homo Sapiens
VASKDLLIN

SEQ ID NO: 425804 - protein, 9 aa, Homo Sapiens
FWFWFWHYG

SEQ ID NO: 425805 - protein, 9 aa, Homo Sapiens
TSPAPRTLP

SEQ ID NO: 425806 - protein, 9 aa, Homo Sapiens
TAHLLRLWM

SEQ ID NO: 425807 - protein, 9 aa, Homo Sapiens
CLVNITLGD

SEQ ID NO: 425808 - protein, 9 aa, Homo Sapiens
VHVALVFAQ

SEQ ID NO: 425809 - protein, 9 aa, Homo Sapiens
LMGNAIALV

SEQ ID NO: 425810 - protein, 9 aa, Homo Sapiens
PQEGGGTSA

SEQ ID NO: 425811 - protein, 9 aa, Homo Sapiens
SLFEMVQCL

SEQ ID NO: 425812 - protein, 9 aa, Homo Sapiens
SSPALLCLT

SEQ ID NO: 425813 - protein, 9 aa, Homo Sapiens
EIPILGPVK

SEQ ID NO: 425814 - protein, 9 aa, Homo Sapiens
NDRRAFILP

SEQ ID NO: 425815 - protein, 9 aa, Homo Sapiens
MLMKQQDWL

SEQ ID NO: 425816 - protein, 9 aa, Homo Sapiens
ESVNKVFVD

SEQ ID NO: 425817 - protein, 9 aa, Homo Sapiens
YTGLHCEAD

SEQ ID NO: 425818 - protein, 9 aa, Homo Sapiens
LHLMYPYKA

SEQ ID NO: 425819 - protein, 9 aa, Homo Sapiens
PANGAGWPC

SEQ ID NO: 425820 - protein, 9 aa, Homo Sapiens
LQNDSESSG

SEQ ID NO: 425821 - protein, 9 aa, Homo Sapiens
CAETAVSVC

SEQ ID NO: 425822 - protein, 9 aa, Homo Sapiens
SDCCLAVSA

SEQ ID NO: 425823 - protein, 9 aa, Homo Sapiens
RSQNKGQKQ

SEQ ID NO: 425824 - protein, 9 aa, Homo Sapiens
TGRFALLSL

SEQ ID NO: 425825 - protein, 9 aa, Homo Sapiens
LERGQIQLK

SEQ ID NO: 425826 - protein, 9 aa, Homo Sapiens
VTMMTLIRT

SEQ ID NO: 425827 - protein, 9 aa, Homo Sapiens
YTDCHGQQY

SEQ ID NO: 425828 - protein, 9 aa, Homo Sapiens
PPQPWRPHA

SEQ ID NO: 425829 - protein, 9 aa, Homo Sapiens
DDSNRPASS

SEQ ID NO: 425830 - protein, 9 aa, Homo Sapiens
NGVNMQYFL

SEQ ID NO: 425831 - protein, 9 aa, Homo Sapiens
SATGAPRGT

SEQ ID NO: 425832 - protein, 9 aa, Homo Sapiens
VHPATFVAH

SEQ ID NO: 425833 - protein, 9 aa, Homo Sapiens
EVVLPGQGG

SEQ ID NO: 425834 - protein, 9 aa, Homo Sapiens
GKYAVRDLV

SEQ ID NO: 425835 - protein, 9 aa, Homo Sapiens
IQVKNDISG

SEQ ID NO: 425836 - protein, 9 aa, Homo Sapiens
DNKRRTLQI

SEQ ID NO: 425837 - protein, 9 aa, Homo Sapiens
ANKGIKEIK

SEQ ID NO: 425838 - protein, 9 aa, Homo Sapiens
GNVEATVVC

SEQ ID NO: 425839 - protein, 9 aa, Homo Sapiens
TERYSDDDS

SEQ ID NO: 425840 - protein, 9 aa, Homo Sapiens
FMSYPGNDM

SEQ ID NO: 425841 - protein, 9 aa, Homo Sapiens
VVSLYFLKL

SEQ ID NO: 425842 - protein, 9 aa, Homo Sapiens
DEFNRPVFR

SEQ ID NO: 425843 - protein, 9 aa, Homo Sapiens
RNFHPRRFL

SEQ ID NO: 425844 - protein, 9 aa, Homo Sapiens
IILYLLRCS

SEQ ID NO: 425845 - protein, 9 aa, Homo Sapiens
CCDKFSVWQ

SEQ ID NO: 425846 - protein, 9 aa, Homo Sapiens
IIKKELQCN

SEQ ID NO: 425847 - protein, 9 aa, Homo Sapiens
GHVQVLRSP

SEQ ID NO: 425848 - protein, 9 aa, Homo Sapiens
KDDNENGPK

SEQ ID NO: 425849 - protein, 9 aa, Homo Sapiens
YDISTANNL

SEQ ID NO: 425850 - protein, 9 aa, Homo Sapiens
INNRNDLQK

SEQ ID NO: 425851 - protein, 9 aa, Homo Sapiens
ENKHQALLL

SEQ ID NO: 425852 - protein, 9 aa, Homo Sapiens
QAGFVFDTS

SEQ ID NO: 425853 - protein, 9 aa, Homo Sapiens
FDTFISESK

SEQ ID NO: 425854 - protein, 9 aa, Homo Sapiens
ASQVPLQES

SEQ ID NO: 425855 - protein, 9 aa, Homo Sapiens
MAPVAMMGG

SEQ ID NO: 425856 - protein, 9 aa, Homo Sapiens
QPQVYSPGY

SEQ ID NO: 425857 - protein, 9 aa, Homo Sapiens
LGVEAFLLR

SEQ ID NO: 425858 - protein, 9 aa, Homo Sapiens
VLQARLCEE

SEQ ID NO: 425859 - protein, 9 aa, Homo Sapiens
PLLFNTLNI

SEQ ID NO: 425860 - protein, 9 aa, Homo Sapiens
REGIISLKK

SEQ ID NO: 425861 - protein, 9 aa, Homo Sapiens
HLSLSQWDP

SEQ ID NO: 425862 - protein, 9 aa, Homo Sapiens
KQCFNNQPA

SEQ ID NO: 425863 - protein, 9 aa, Homo Sapiens
HKGVAASYF

SEQ ID NO: 425864 - protein, 9 aa, Homo Sapiens
LPAEDALLQ

SEQ ID NO: 425865 - protein, 9 aa, Homo Sapiens
SGLGTTSVL

SEQ ID NO: 425866 - protein, 9 aa, Homo Sapiens
HYIIEDIDE

SEQ ID NO: 425867 - protein, 9 aa, Homo Sapiens
GQFDSLEES

SEQ ID NO: 425868 - protein, 9 aa, Homo Sapiens
SPPQPEFRA

SEQ ID NO: 425869 - protein, 9 aa, Homo Sapiens
PPGPMSPPG

SEQ ID NO: 425870 - protein, 9 aa, Homo Sapiens
DSSGDELYV

SEQ ID NO: 425871 - protein, 9 aa, Homo Sapiens
ASGDHSARQ

SEQ ID NO: 425872 - protein, 9 aa, Homo Sapiens
FEKDNIKMK

SEQ ID NO: 425873 - protein, 9 aa, Homo Sapiens
SHHIRDGIC

SEQ ID NO: 425874 - protein, 9 aa, Homo Sapiens
QTVQILGAD

SEQ ID NO: 425875 - protein, 9 aa, Homo Sapiens
KAELDEKIQ

SEQ ID NO: 425876 - protein, 9 aa, Homo Sapiens
EATSEIKDL

SEQ ID NO: 425877 - protein, 9 aa, Homo Sapiens
DAKYLSGIA

SEQ ID NO: 425878 - protein, 9 aa, Homo Sapiens
SCLSDHFQI

SEQ ID NO: 425879 - protein, 9 aa, Homo Sapiens
KALKKDMKE

SEQ ID NO: 425880 - protein, 9 aa, Homo Sapiens
KYCKCNECG

SEQ ID NO: 425881 - protein, 9 aa, Homo Sapiens
RVDGGESVN

SEQ ID NO: 425882 - protein, 9 aa, Homo Sapiens
DLIDCAFLV

SEQ ID NO: 425883 - protein, 9 aa, Homo Sapiens
TVTLPKNMS

SEQ ID NO: 425884 - protein, 9 aa, Homo Sapiens
EFKMFTTKK

SEQ ID NO: 425885 - protein, 9 aa, Homo Sapiens
EDRSRFLRS

SEQ ID NO: 425886 - protein, 9 aa, Homo Sapiens
LIKNQFGLS

SEQ ID NO: 425887 - protein, 9 aa, Homo Sapiens
LEPEDALSG

SEQ ID NO: 425888 - protein, 9 aa, Homo Sapiens
YQPGGLHPL

SEQ ID NO: 425889 - protein, 9 aa, Homo Sapiens
QIENLQKEL

SEQ ID NO: 425890 - protein, 9 aa, Homo Sapiens
KRKTLAERR

SEQ ID NO: 425891 - protein, 9 aa, Homo Sapiens
GRTRIDKRV

SEQ ID NO: 425892 - protein, 9 aa, Homo Sapiens
DLDSVDAFQ

SEQ ID NO: 425893 - protein, 9 aa, Homo Sapiens
KPYKETELP

SEQ ID NO: 425894 - protein, 9 aa, Homo Sapiens
YSWPWWMYE

SEQ ID NO: 425895 - protein, 9 aa, Homo Sapiens
GVELAPHSA

SEQ ID NO: 425896 - protein, 9 aa, Homo Sapiens
CHMWLRPDL

SEQ ID NO: 425897 - protein, 9 aa, Homo Sapiens
NSTGDLMKN

SEQ ID NO: 425898 - protein, 9 aa, Homo Sapiens
TQHDRFDSY

SEQ ID NO: 425899 - protein, 9 aa, Homo Sapiens
KPGGTPQEG

SEQ ID NO: 425900 - protein, 9 aa, Homo Sapiens
QNKPFDANT

SEQ ID NO: 425901 - protein, 9 aa, Homo Sapiens
MESYFDFTL

SEQ ID NO: 425902 - protein, 9 aa, Homo Sapiens
NPFDNCGLI

SEQ ID NO: 425903 - protein, 9 aa, Homo Sapiens
LHNLSTPKV

SEQ ID NO: 425904 - protein, 9 aa, Homo Sapiens
IIHHDQPVK

SEQ ID NO: 425905 - protein, 9 aa, Homo Sapiens
SKAVHSQTV

SEQ ID NO: 425906 - protein, 9 aa, Homo Sapiens
LSFICSSNN

SEQ ID NO: 425907 - protein, 9 aa, Homo Sapiens
HSPDQGKFI

SEQ ID NO: 425908 - protein, 9 aa, Homo Sapiens
KGLDEARAE

SEQ ID NO: 425909 - protein, 9 aa, Homo Sapiens
SVSTFSVLT

SEQ ID NO: 425910 - protein, 9 aa, Homo Sapiens
SRHTKFGYG

SEQ ID NO: 425911 - protein, 9 aa, Homo Sapiens
FCDVPAMWT

SEQ ID NO: 425912 - protein, 9 aa, Homo Sapiens
EIVVCHAKN

SEQ ID NO: 425913 - protein, 9 aa, Homo Sapiens
DNEEFLRYL

SEQ ID NO: 425914 - protein, 9 aa, Homo Sapiens
QLYRVDRFM

SEQ ID NO: 425915 - protein, 9 aa, Homo Sapiens
IDLRHWIQL

SEQ ID NO: 425916 - protein, 9 aa, Homo Sapiens
DRVWLLASN

SEQ ID NO: 425917 - protein, 9 aa, Homo Sapiens
CCDYFLNCS

SEQ ID NO: 425918 - protein, 9 aa, Homo Sapiens
EIKFGFEIS

SEQ ID NO: 425919 - protein, 9 aa, Homo Sapiens
KKLYTISLR

SEQ ID NO: 425920 - protein, 9 aa, Homo Sapiens
FWVGGSLDG

SEQ ID NO: 425921 - protein, 9 aa, Homo Sapiens
LFYIHMLSL

SEQ ID NO: 425922 - protein, 9 aa, Homo Sapiens
LCIHQIVHT

SEQ ID NO: 425923 - protein, 9 aa, Homo Sapiens
DEEEGIQYL

SEQ ID NO: 425924 - protein, 9 aa, Homo Sapiens
IKVRRLEHL

SEQ ID NO: 425925 - protein, 9 aa, Homo Sapiens
TMFCQLAKT

SEQ ID NO: 425926 - protein, 9 aa, Homo Sapiens
IQALGHIAV

SEQ ID NO: 425927 - protein, 9 aa, Homo Sapiens
YTMYNQKPV

SEQ ID NO: 425928 - protein, 9 aa, Homo Sapiens
RDKELAKSM

SEQ ID NO: 425929 - protein, 9 aa, Homo Sapiens
LQINENPFN

SEQ ID NO: 425930 - protein, 9 aa, Homo Sapiens
SPTLQIHER

SEQ ID NO: 425931 - protein, 9 aa, Homo Sapiens
LLLVQNDYE

SEQ ID NO: 425932 - protein, 9 aa, Homo Sapiens
MLITNRSLK

SEQ ID NO: 425933 - protein, 9 aa, Homo Sapiens
SEFQMLLGF

SEQ ID NO: 425934 - protein, 9 aa, Homo Sapiens
RQKEQNKKI

SEQ ID NO: 425935 - protein, 9 aa, Homo Sapiens
EYLLCVKRN

SEQ ID NO: 425936 - protein, 9 aa, Homo Sapiens
LSSLGFYVG

SEQ ID NO: 425937 - protein, 9 aa, Homo Sapiens
GVRVDFWWC

SEQ ID NO: 425938 - protein, 9 aa, Homo Sapiens
TKLDMARGK

SEQ ID NO: 425939 - protein, 9 aa, Homo Sapiens
YGCLLLWLY

SEQ ID NO: 425940 - protein, 9 aa, Homo Sapiens
GKQRYDKMT

SEQ ID NO: 425941 - protein, 9 aa, Homo Sapiens
RTPKPDAFI

SEQ ID NO: 425942 - protein, 9 aa, Homo Sapiens
AVFLNPFDN

SEQ ID NO: 425943 - protein, 9 aa, Homo Sapiens
KEINEKSYQ

SEQ ID NO: 425944 - protein, 9 aa, Homo Sapiens
YLTEEIRSL

SEQ ID NO: 425945 - protein, 9 aa, Homo Sapiens
ANIQFRSDE

SEQ ID NO: 425946 - protein, 9 aa, Homo Sapiens
LINTQNNYK

SEQ ID NO: 425947 - protein, 9 aa, Homo Sapiens
VCKESFTQN

SEQ ID NO: 425948 - protein, 9 aa, Homo Sapiens
CCDFASGVV

SEQ ID NO: 425949 - protein, 9 aa, Homo Sapiens
YKKCRHENV

SEQ ID NO: 425950 - protein, 9 aa, Homo Sapiens
GDTINCRDC

SEQ ID NO: 425951 - protein, 9 aa, Homo Sapiens
DKLHGFTVN

SEQ ID NO: 425952 - protein, 9 aa, Homo Sapiens
NADLVLLPN

SEQ ID NO: 425953 - protein, 9 aa, Homo Sapiens
PTTNIQIWL

SEQ ID NO: 425954 - protein, 9 aa, Homo Sapiens
SPPCQPNYP

SEQ ID NO: 425955 - protein, 9 aa, Homo Sapiens
SSFEVCGAN

SEQ ID NO: 425956 - protein, 9 aa, Homo Sapiens
TLSEMTFRE

SEQ ID NO: 425957 - protein, 9 aa, Homo Sapiens
EDPRVATRV

SEQ ID NO: 425958 - protein, 9 aa, Homo Sapiens
EDRSLKNIK

SEQ ID NO: 425959 - protein, 9 aa, Homo Sapiens
ELLARDFKK

SEQ ID NO: 425960 - protein, 9 aa, Homo Sapiens
LKLWWTIAK

SEQ ID NO: 425961 - protein, 9 aa, Homo Sapiens
FYMQTAPIR

SEQ ID NO: 425962 - protein, 9 aa, Homo Sapiens
GAELNDRAI

SEQ ID NO: 425963 - protein, 9 aa, Homo Sapiens
TSKRFSSLH

SEQ ID NO: 425964 - protein, 9 aa, Homo Sapiens
RIARRCAQH

SEQ ID NO: 425965 - protein, 9 aa, Homo Sapiens
DKPSDSSDL

SEQ ID NO: 425966 - protein, 9 aa, Homo Sapiens
KIFQEYGTA

SEQ ID NO: 425967 - protein, 9 aa, Homo Sapiens
GSHPKGSVG

SEQ ID NO: 425968 - protein, 9 aa, Homo Sapiens
CKECKLICQ

SEQ ID NO: 425969 - protein, 9 aa, Homo Sapiens
PAVGKKSLD

SEQ ID NO: 425970 - protein, 9 aa, Homo Sapiens
PPNKLFGNK

SEQ ID NO: 425971 - protein, 9 aa, Homo Sapiens
VQRKRDKEL

SEQ ID NO: 425972 - protein, 9 aa, Homo Sapiens
NISNNVCFL

SEQ ID NO: 425973 - protein, 9 aa, Homo Sapiens
GHLSLSQWD

SEQ ID NO: 425974 - protein, 9 aa, Homo Sapiens
ALLYLNKPV

SEQ ID NO: 425975 - protein, 9 aa, Homo Sapiens
FVSTKITSY

SEQ ID NO: 425976 - protein, 9 aa, Homo Sapiens
SKTILVRMV

SEQ ID NO: 425977 - protein, 9 aa, Homo Sapiens
FGFHRPNTT

SEQ ID NO: 425978 - protein, 9 aa, Homo Sapiens
VLDLNGCTL

SEQ ID NO: 425979 - protein, 9 aa, Homo Sapiens
LVILIPITC

SEQ ID NO: 425980 - protein, 9 aa, Homo Sapiens
ANHLIGDDE

SEQ ID NO: 425981 - protein, 9 aa, Homo Sapiens
YDIAMQKDS

SEQ ID NO: 425982 - protein, 9 aa, Homo Sapiens
DGPFGLSPL

SEQ ID NO: 425983 - protein, 9 aa, Homo Sapiens
ICYDPRRCY

SEQ ID NO: 425984 - protein, 9 aa, Homo Sapiens
QREETLALS

SEQ ID NO: 425985 - protein, 9 aa, Homo Sapiens
SQRGKSGFN

SEQ ID NO: 425986 - protein, 9 aa, Homo Sapiens
QHDRFDSYS

SEQ ID NO: 425987 - protein, 9 aa, Homo Sapiens
QNHAMKSQL

SEQ ID NO: 425988 - protein, 9 aa, Homo Sapiens
GVQRFQDTL

SEQ ID NO: 425989 - protein, 9 aa, Homo Sapiens
DALVLHQMI

SEQ ID NO: 425990 - protein, 9 aa, Homo Sapiens
VVVSKARAK

SEQ ID NO: 425991 - protein, 9 aa, Homo Sapiens
FTLLYLFLV

SEQ ID NO: 425992 - protein, 9 aa, Homo Sapiens
NGSLQSRDE

SEQ ID NO: 425993 - protein, 9 aa, Homo Sapiens
DSQGRICST

SEQ ID NO: 425994 - protein, 9 aa, Homo Sapiens
EGLNKIFEH

SEQ ID NO: 425995 - protein, 9 aa, Homo Sapiens
GPFGVFLVL

SEQ ID NO: 425996 - protein, 9 aa, Homo Sapiens
HGSGKENKV

SEQ ID NO: 425997 - protein, 9 aa, Homo Sapiens
EWFPDLAAE

SEQ ID NO: 425998 - protein, 9 aa, Homo Sapiens
AQEQKDKAS

SEQ ID NO: 425999 - protein, 9 aa, Homo Sapiens
EKRKRRHPL

SEQ ID NO: 426000 - protein, 9 aa, Homo Sapiens
SRAESKCCK

SEQ ID NO: 426001 - protein, 9 aa, Homo Sapiens
HLLLQNNVP

SEQ ID NO: 426002 - protein, 9 aa, Homo Sapiens
EIGFNGNQI

SEQ ID NO: 426003 - protein, 9 aa, Homo Sapiens
TELVNLLSY

SEQ ID NO: 426004 - protein, 9 aa, Homo Sapiens
FSHSDRHNI

SEQ ID NO: 426005 - protein, 9 aa, Homo Sapiens
SNYEIRICR

SEQ ID NO: 426006 - protein, 9 aa, Homo Sapiens
VFILVCVFG

SEQ ID NO: 426007 - protein, 9 aa, Homo Sapiens
RLFLEYLTN

SEQ ID NO: 426008 - protein, 9 aa, Homo Sapiens
DILQMFVPF

SEQ ID NO: 426009 - protein, 9 aa, Homo Sapiens
RAGMTIDNG

SEQ ID NO: 426010 - protein, 9 aa, Homo Sapiens
LYGLIEEKC

SEQ ID NO: 426011 - protein, 9 aa, Homo Sapiens
PPFDGIHIA

SEQ ID NO: 426012 - protein, 9 aa, Homo Sapiens
LSSQEGRYA

SEQ ID NO: 426013 - protein, 9 aa, Homo Sapiens
MVRKWHLGF

SEQ ID NO: 426014 - protein, 9 aa, Homo Sapiens
VAAVCLERV

SEQ ID NO: 426015 - protein, 9 aa, Homo Sapiens
KLSNEQGLP

SEQ ID NO: 426016 - protein, 9 aa, Homo Sapiens
NIVGSEHYN

SEQ ID NO: 426017 - protein, 9 aa, Homo Sapiens
FYRSCVTYM

SEQ ID NO: 426018 - protein, 9 aa, Homo Sapiens
VGFCVVLLF

SEQ ID NO: 426019 - protein, 9 aa, Homo Sapiens
LTGNGDDYS

SEQ ID NO: 426020 - protein, 9 aa, Homo Sapiens
GQCHISGKY

SEQ ID NO: 426021 - protein, 9 aa, Homo Sapiens
GDKGKPKNT

SEQ ID NO: 426022 - protein, 9 aa, Homo Sapiens
DRLFKIIGV

SEQ ID NO: 426023 - protein, 9 aa, Homo Sapiens
MWTLACTDT

SEQ ID NO: 426024 - protein, 9 aa, Homo Sapiens
NVARGVQKI

SEQ ID NO: 426025 - protein, 9 aa, Homo Sapiens
TFHAEVSAD

SEQ ID NO: 426026 - protein, 9 aa, Homo Sapiens
KEDSYPTPG

SEQ ID NO: 426027 - protein, 9 aa, Homo Sapiens
GCSLHMFRF

SEQ ID NO: 426028 - protein, 9 aa, Homo Sapiens
PTLQFFKKG

SEQ ID NO: 426029 - protein, 9 aa, Homo Sapiens
MVKKEPIKD

SEQ ID NO: 426030 - protein, 9 aa, Homo Sapiens
HQYLLEEIH

SEQ ID NO: 426031 - protein, 9 aa, Homo Sapiens
LGATGTLGQ

SEQ ID NO: 426032 - protein, 9 aa, Homo Sapiens
STCPDKGIV

SEQ ID NO: 426033 - protein, 9 aa, Homo Sapiens
LEETVIYTK

SEQ ID NO: 426034 - protein, 9 aa, Homo Sapiens
CISDAFGEG

SEQ ID NO: 426035 - protein, 9 aa, Homo Sapiens
TPVLSMDEP

SEQ ID NO: 426036 - protein, 9 aa, Homo Sapiens
KISEPGCTK

SEQ ID NO: 426037 - protein, 9 aa, Homo Sapiens
AISSNNKTM

SEQ ID NO: 426038 - protein, 9 aa, Homo Sapiens
LALAIYLIL

SEQ ID NO: 426039 - protein, 9 aa, Homo Sapiens
DPDNPGQIA

SEQ ID NO: 426040 - protein, 9 aa, Homo Sapiens
SNLQRHRII

SEQ ID NO: 426041 - protein, 9 aa, Homo Sapiens
SWKISHKKA

SEQ ID NO: 426042 - protein, 9 aa, Homo Sapiens
KHPAGYFHF

SEQ ID NO: 426043 - protein, 9 aa, Homo Sapiens
SIFGLFGRA

SEQ ID NO: 426044 - protein, 9 aa, Homo Sapiens
DDNVKYYFE

SEQ ID NO: 426045 - protein, 9 aa, Homo Sapiens
NYIHSGTLV

SEQ ID NO: 426046 - protein, 9 aa, Homo Sapiens
FLWESLYPE

SEQ ID NO: 426047 - protein, 9 aa, Homo Sapiens
YKLGDKLHG

SEQ ID NO: 426048 - protein, 9 aa, Homo Sapiens
LISTDALPS

SEQ ID NO: 426049 - protein, 9 aa, Homo Sapiens
ETGEIIKAR

SEQ ID NO: 426050 - protein, 9 aa, Homo Sapiens
NLPFLETWY

SEQ ID NO: 426051 - protein, 9 aa, Homo Sapiens
GPNTLKSLT

SEQ ID NO: 426052 - protein, 9 aa, Homo Sapiens
HSLEIKEGS

SEQ ID NO: 426053 - protein, 9 aa, Homo Sapiens
VHEYSRRHL

SEQ ID NO: 426054 - protein, 9 aa, Homo Sapiens
PFPNQDSDL

SEQ ID NO: 426055 - protein, 9 aa, Homo Sapiens
DSDTIVCDS

SEQ ID NO: 426056 - protein, 9 aa, Homo Sapiens
SASEGNSYV

SEQ ID NO: 426057 - protein, 9 aa, Homo Sapiens
KVSDLCYSN

SEQ ID NO: 426058 - protein, 9 aa, Homo Sapiens
TAPIRNEHE

SEQ ID NO: 426059 - protein, 9 aa, Homo Sapiens
RKLSSFFKS

SEQ ID NO: 426060 - protein, 9 aa, Homo Sapiens
NILSLLRLI

SEQ ID NO: 426061 - protein, 9 aa, Homo Sapiens
GYPLILPPP

SEQ ID NO: 426062 - protein, 9 aa, Homo Sapiens
CPQWAYDNW

SEQ ID NO: 426063 - protein, 9 aa, Homo Sapiens
VGKLHSDQY

SEQ ID NO: 426064 - protein, 9 aa, Homo Sapiens
LWMLLGLLA

SEQ ID NO: 426065 - protein, 9 aa, Homo Sapiens
EATNPEDCS

SEQ ID NO: 426066 - protein, 9 aa, Homo Sapiens
FKHECSRII

SEQ ID NO: 426067 - protein, 9 aa, Homo Sapiens
IFKALPTCG

SEQ ID NO: 426068 - protein, 9 aa, Homo Sapiens
CVCYIQGEG

SEQ ID NO: 426069 - protein, 9 aa, Homo Sapiens
AVFCLSSWE

SEQ ID NO: 426070 - protein, 9 aa, Homo Sapiens
IVDKFQNTN

SEQ ID NO: 426071 - protein, 9 aa, Homo Sapiens
WASLDAETT

SEQ ID NO: 426072 - protein, 9 aa, Homo Sapiens
FQRVKHGWV

SEQ ID NO: 426073 - protein, 9 aa, Homo Sapiens
YLQQGSHPE

SEQ ID NO: 426074 - protein, 9 aa, Homo Sapiens
AAMPHSSST

SEQ ID NO: 426075 - protein, 9 aa, Homo Sapiens
YHLSKAFHS

SEQ ID NO: 426076 - protein, 9 aa, Homo Sapiens
IYGGVKYII

SEQ ID NO: 426077 - protein, 9 aa, Homo Sapiens
TVEIREVHK

SEQ ID NO: 426078 - protein, 9 aa, Homo Sapiens
STRGYSARP

SEQ ID NO: 426079 - protein, 9 aa, Homo Sapiens
LLMTWALIL

SEQ ID NO: 426080 - protein, 9 aa, Homo Sapiens
PSQRSRSVS

SEQ ID NO: 426081 - protein, 9 aa, Homo Sapiens
CRYSTDIVP

SEQ ID NO: 426082 - protein, 9 aa, Homo Sapiens
QNFFFIFLF

SEQ ID NO: 426083 - protein, 9 aa, Homo Sapiens
RDVIGLDYS

SEQ ID NO: 426084 - protein, 9 aa, Homo Sapiens
QHFCGRHKK

SEQ ID NO: 426085 - protein, 9 aa, Homo Sapiens
LPSLQAYSH

SEQ ID NO: 426086 - protein, 9 aa, Homo Sapiens
AVPLGHLES

SEQ ID NO: 426087 - protein, 9 aa, Homo Sapiens
GSTTPLFTD

SEQ ID NO: 426088 - protein, 9 aa, Homo Sapiens
HQHENVHTL

SEQ ID NO: 426089 - protein, 9 aa, Homo Sapiens
DSPNNFNIA

SEQ ID NO: 426090 - protein, 9 aa, Homo Sapiens
SVKREYVAY

SEQ ID NO: 426091 - protein, 9 aa, Homo Sapiens
EVSADISFF

SEQ ID NO: 426092 - protein, 9 aa, Homo Sapiens
CAHVENTER

SEQ ID NO: 426093 - protein, 9 aa, Homo Sapiens
RTYKNLNRA

SEQ ID NO: 426094 - protein, 9 aa, Homo Sapiens
TRCKQSEMY

SEQ ID NO: 426095 - protein, 9 aa, Homo Sapiens
CKLAKENKL

SEQ ID NO: 426096 - protein, 9 aa, Homo Sapiens
EVTRRPLPL

SEQ ID NO: 426097 - protein, 9 aa, Homo Sapiens
LDGPYPKKG

SEQ ID NO: 426098 - protein, 9 aa, Homo Sapiens
KKPNSAGEY

SEQ ID NO: 426099 - protein, 9 aa, Homo Sapiens
CSWQSQSSR

SEQ ID NO: 426100 - protein, 9 aa, Homo Sapiens
VAQQRNCEG

SEQ ID NO: 426101 - protein, 9 aa, Homo Sapiens
RKSLLIDSH

SEQ ID NO: 426102 - protein, 9 aa, Homo Sapiens
STMLPIYPA

SEQ ID NO: 426103 - protein, 9 aa, Homo Sapiens
EQFSGMGFQ

SEQ ID NO: 426104 - protein, 9 aa, Homo Sapiens
VNEAWKEAD

SEQ ID NO: 426105 - protein, 9 aa, Homo Sapiens
WPALVSSIP

SEQ ID NO: 426106 - protein, 9 aa, Homo Sapiens
HYKYGFDLN

SEQ ID NO: 426107 - protein, 9 aa, Homo Sapiens
LYPKVANIR

SEQ ID NO: 426108 - protein, 9 aa, Homo Sapiens
SAGLHKHRI

SEQ ID NO: 426109 - protein, 9 aa, Homo Sapiens
ASFLTSPTE

SEQ ID NO: 426110 - protein, 9 aa, Homo Sapiens
ILAVMSYDR

SEQ ID NO: 426111 - protein, 9 aa, Homo Sapiens
MQTHTGEKP

SEQ ID NO: 426112 - protein, 9 aa, Homo Sapiens
LKESEKVSD

SEQ ID NO: 426113 - protein, 9 aa, Homo Sapiens
LTSQYIKLI

SEQ ID NO: 426114 - protein, 9 aa, Homo Sapiens
LELEDMENK

SEQ ID NO: 426115 - protein, 9 aa, Homo Sapiens
TPNLSTKTH

SEQ ID NO: 426116 - protein, 9 aa, Homo Sapiens
RVIQYFVVI

SEQ ID NO: 426117 - protein, 9 aa, Homo Sapiens
LASLPVPFR

SEQ ID NO: 426118 - protein, 9 aa, Homo Sapiens
QSSVDVIVK

SEQ ID NO: 426119 - protein, 9 aa, Homo Sapiens
YYKLLAERG

SEQ ID NO: 426120 - protein, 9 aa, Homo Sapiens
CMRSFNRSA

SEQ ID NO: 426121 - protein, 9 aa, Homo Sapiens
QEGCCHPIT

SEQ ID NO: 426122 - protein, 9 aa, Homo Sapiens
AEIIIQVIP

SEQ ID NO: 426123 - protein, 9 aa, Homo Sapiens
STSAFSRLD

SEQ ID NO: 426124 - protein, 9 aa, Homo Sapiens
ELRRRGPNF

SEQ ID NO: 426125 - protein, 9 aa, Homo Sapiens
HKINCQLKC

SEQ ID NO: 426126 - protein, 9 aa, Homo Sapiens
LTSILTKDD

SEQ ID NO: 426127 - protein, 9 aa, Homo Sapiens
YVASISTCD

SEQ ID NO: 426128 - protein, 9 aa, Homo Sapiens
KEVHIGLFD

SEQ ID NO: 426129 - protein, 9 aa, Homo Sapiens
NGYFVTPDR

SEQ ID NO: 426130 - protein, 9 aa, Homo Sapiens
IDDSAKQEG

SEQ ID NO: 426131 - protein, 9 aa, Homo Sapiens
EIVCRVFSS

SEQ ID NO: 426132 - protein, 9 aa, Homo Sapiens
VKYYFECSL

SEQ ID NO: 426133 - protein, 9 aa, Homo Sapiens
GMLSNIIAF

SEQ ID NO: 426134 - protein, 9 aa, Homo Sapiens
FKKNYNMYI

SEQ ID NO: 426135 - protein, 9 aa, Homo Sapiens
LKNGSALVL

SEQ ID NO: 426136 - protein, 9 aa, Homo Sapiens
IIQTREIKP

SEQ ID NO: 426137 - protein, 9 aa, Homo Sapiens
FLKHGKART

SEQ ID NO: 426138 - protein, 9 aa, Homo Sapiens
HEISEDVYT

SEQ ID NO: 426139 - protein, 9 aa, Homo Sapiens
LLLINERGG

SEQ ID NO: 426140 - protein, 9 aa, Homo Sapiens
TNLMRPKTC

SEQ ID NO: 426141 - protein, 9 aa, Homo Sapiens
QNAINRINP

SEQ ID NO: 426142 - protein, 9 aa, Homo Sapiens
LTQYARTQF

SEQ ID NO: 426143 - protein, 9 aa, Homo Sapiens
IDEILEPPE

SEQ ID NO: 426144 - protein, 9 aa, Homo Sapiens
WNLHAIHYM

SEQ ID NO: 426145 - protein, 9 aa, Homo Sapiens
GCLSDPGVA

SEQ ID NO: 426146 - protein, 9 aa, Homo Sapiens
HNGTPQNAI

SEQ ID NO: 426147 - protein, 9 aa, Homo Sapiens
FHALSDKNM

SEQ ID NO: 426148 - protein, 9 aa, Homo Sapiens
GLQHIFYLK

SEQ ID NO: 426149 - protein, 9 aa, Homo Sapiens
CGTTYLYDR

SEQ ID NO: 426150 - protein, 9 aa, Homo Sapiens
CQMVVEKGG

SEQ ID NO: 426151 - protein, 9 aa, Homo Sapiens
HFYFLDPPP

SEQ ID NO: 426152 - protein, 9 aa, Homo Sapiens
PNNLGNNTK

SEQ ID NO: 426153 - protein, 9 aa, Homo Sapiens
KKGMIVITD

SEQ ID NO: 426154 - protein, 9 aa, Homo Sapiens
TYRALDSLN

SEQ ID NO: 426155 - protein, 9 aa, Homo Sapiens
IKHTSKENT

SEQ ID NO: 426156 - protein, 9 aa, Homo Sapiens
CEPHKIIKE

SEQ ID NO: 426157 - protein, 9 aa, Homo Sapiens
VDKLHNLNS

SEQ ID NO: 426158 - protein, 9 aa, Homo Sapiens
HMLVELAPP

SEQ ID NO: 426159 - protein, 9 aa, Homo Sapiens
HDPSDLVRV

SEQ ID NO: 426160 - protein, 9 aa, Homo Sapiens
GWALVLPET

SEQ ID NO: 426161 - protein, 9 aa, Homo Sapiens
QSVHIAVKV

SEQ ID NO: 426162 - protein, 9 aa, Homo Sapiens
SEARYKDVY

SEQ ID NO: 426163 - protein, 9 aa, Homo Sapiens
QESLSSSKL

SEQ ID NO: 426164 - protein, 9 aa, Homo Sapiens
QPEDQVNIA

SEQ ID NO: 426165 - protein, 9 aa, Homo Sapiens
RRSQSRSRD

SEQ ID NO: 426166 - protein, 9 aa, Homo Sapiens
DLVENTFLL

SEQ ID NO: 426167 - protein, 9 aa, Homo Sapiens
INLQCNAVL

SEQ ID NO: 426168 - protein, 9 aa, Homo Sapiens
TYLCWMLWR

SEQ ID NO: 426169 - protein, 9 aa, Homo Sapiens
PMISPRYPS

SEQ ID NO: 426170 - protein, 9 aa, Homo Sapiens
KSLETIEQI

SEQ ID NO: 426171 - protein, 9 aa, Homo Sapiens
SKDASSLES

SEQ ID NO: 426172 - protein, 9 aa, Homo Sapiens
ADEGTLKEI

SEQ ID NO: 426173 - protein, 9 aa, Homo Sapiens
LRPAEAGKF

SEQ ID NO: 426174 - protein, 9 aa, Homo Sapiens
LKPYDCKEY

SEQ ID NO: 426175 - protein, 9 aa, Homo Sapiens
LQNSLLPQL

SEQ ID NO: 426176 - protein, 9 aa, Homo Sapiens
APLEVTEDN

SEQ ID NO: 426177 - protein, 9 aa, Homo Sapiens
DQPNLPYAL

SEQ ID NO: 426178 - protein, 9 aa, Homo Sapiens
DMVTFKDVA

SEQ ID NO: 426179 - protein, 9 aa, Homo Sapiens
DIPLWLLVP

SEQ ID NO: 426180 - protein, 9 aa, Homo Sapiens
SEELIVFWF

SEQ ID NO: 426181 - protein, 9 aa, Homo Sapiens
KKKKCEMYR

SEQ ID NO: 426182 - protein, 9 aa, Homo Sapiens
IQMWCVERP

SEQ ID NO: 426183 - protein, 9 aa, Homo Sapiens
LVNCKITSD

SEQ ID NO: 426184 - protein, 9 aa, Homo Sapiens
LEGPGSPPP

SEQ ID NO: 426185 - protein, 9 aa, Homo Sapiens
LINSQQVPN

SEQ ID NO: 426186 - protein, 9 aa, Homo Sapiens
VFSHNSHLV

SEQ ID NO: 426187 - protein, 9 aa, Homo Sapiens
FRSLHNDSV

SEQ ID NO: 426188 - protein, 9 aa, Homo Sapiens
VLGVVATKV

SEQ ID NO: 426189 - protein, 9 aa, Homo Sapiens
SDILQMFVP

SEQ ID NO: 426190 - protein, 9 aa, Homo Sapiens
TKTKHTYYY

SEQ ID NO: 426191 - protein, 9 aa, Homo Sapiens
TIDQILDMV

SEQ ID NO: 426192 - protein, 9 aa, Homo Sapiens
KIKFGEYVD

SEQ ID NO: 426193 - protein, 9 aa, Homo Sapiens
PRHNHFYFH

SEQ ID NO: 426194 - protein, 9 aa, Homo Sapiens
EVIRKKLVD

SEQ ID NO: 426195 - protein, 9 aa, Homo Sapiens
NNLAKHVQE

SEQ ID NO: 426196 - protein, 9 aa, Homo Sapiens
FGQASRHWS

SEQ ID NO: 426197 - protein, 9 aa, Homo Sapiens
RDYFKSLET

SEQ ID NO: 426198 - protein, 9 aa, Homo Sapiens
QGIEDYFQK

SEQ ID NO: 426199 - protein, 9 aa, Homo Sapiens
KKECWLWES

SEQ ID NO: 426200 - protein, 9 aa, Homo Sapiens
EHRQIHTGY

SEQ ID NO: 426201 - protein, 9 aa, Homo Sapiens
WVGYRCNRY

SEQ ID NO: 426202 - protein, 9 aa, Homo Sapiens
QSGIFQYDK

SEQ ID NO: 426203 - protein, 9 aa, Homo Sapiens
FSCFCVLLA

SEQ ID NO: 426204 - protein, 9 aa, Homo Sapiens
LKSSPGLGR

SEQ ID NO: 426205 - protein, 9 aa, Homo Sapiens
ELFNRWKSL

SEQ ID NO: 426206 - protein, 9 aa, Homo Sapiens
IDTVMKLGA

SEQ ID NO: 426207 - protein, 9 aa, Homo Sapiens
VDFFHLVPF

SEQ ID NO: 426208 - protein, 9 aa, Homo Sapiens
RGRYVLCEE

SEQ ID NO: 426209 - protein, 9 aa, Homo Sapiens
SGVESEPSF

SEQ ID NO: 426210 - protein, 9 aa, Homo Sapiens
LTDKIVEKA

SEQ ID NO: 426211 - protein, 9 aa, Homo Sapiens
KVSGLPAPV

SEQ ID NO: 426212 - protein, 9 aa, Homo Sapiens
IHKQTHTGE

SEQ ID NO: 426213 - protein, 9 aa, Homo Sapiens
EFIIRRTST

SEQ ID NO: 426214 - protein, 9 aa, Homo Sapiens
FKQTVQNNK

SEQ ID NO: 426215 - protein, 9 aa, Homo Sapiens
SENNYLYLY

SEQ ID NO: 426216 - protein, 9 aa, Homo Sapiens
LRLHEAENK

SEQ ID NO: 426217 - protein, 9 aa, Homo Sapiens
HFIFKEKVF

SEQ ID NO: 426218 - protein, 9 aa, Homo Sapiens
VHFPKVIQC

SEQ ID NO: 426219 - protein, 9 aa, Homo Sapiens
SGRITMAAR

SEQ ID NO: 426220 - protein, 9 aa, Homo Sapiens
NVERLAEDE

SEQ ID NO: 426221 - protein, 9 aa, Homo Sapiens
ALGIITCFN

SEQ ID NO: 426222 - protein, 9 aa, Homo Sapiens
RHLFGHTFS

SEQ ID NO: 426223 - protein, 9 aa, Homo Sapiens
LIDDHTKKL

SEQ ID NO: 426224 - protein, 9 aa, Homo Sapiens
KKCRMESYF

SEQ ID NO: 426225 - protein, 9 aa, Homo Sapiens
PVLKPHQVG

SEQ ID NO: 426226 - protein, 9 aa, Homo Sapiens
PVKQFQLCK

SEQ ID NO: 426227 - protein, 9 aa, Homo Sapiens
LTENQKNCR

SEQ ID NO: 426228 - protein, 9 aa, Homo Sapiens
IDWLSHKDE

SEQ ID NO: 426229 - protein, 9 aa, Homo Sapiens
DKETREGII

SEQ ID NO: 426230 - protein, 9 aa, Homo Sapiens
DFIDCLKIF

SEQ ID NO: 426231 - protein, 9 aa, Homo Sapiens
SSGPNTLKS

SEQ ID NO: 426232 - protein, 9 aa, Homo Sapiens
MLPTLIIRG

SEQ ID NO: 426233 - protein, 9 aa, Homo Sapiens
ILVIPFPFT

SEQ ID NO: 426234 - protein, 9 aa, Homo Sapiens
KVMDYSLLM

SEQ ID NO: 426235 - protein, 9 aa, Homo Sapiens
SRSDRSPEL

SEQ ID NO: 426236 - protein, 9 aa, Homo Sapiens
LKAEIGQPC

SEQ ID NO: 426237 - protein, 9 aa, Homo Sapiens
TGCDACSES

SEQ ID NO: 426238 - protein, 9 aa, Homo Sapiens
SAPVRLVLK

SEQ ID NO: 426239 - protein, 9 aa, Homo Sapiens
KLIGVGEEV

SEQ ID NO: 426240 - protein, 9 aa, Homo Sapiens
HAMKSQLEA

SEQ ID NO: 426241 - protein, 9 aa, Homo Sapiens
TNETEQKVA

SEQ ID NO: 426242 - protein, 9 aa, Homo Sapiens
KLFENKVVQ

SEQ ID NO: 426243 - protein, 9 aa, Homo Sapiens
ACIKSLPSV

SEQ ID NO: 426244 - protein, 9 aa, Homo Sapiens
HEKTHTINR

SEQ ID NO: 426245 - protein, 9 aa, Homo Sapiens
GNQIPWTNN

SEQ ID NO: 426246 - protein, 9 aa, Homo Sapiens
VPEHPGMPC

SEQ ID NO: 426247 - protein, 9 aa, Homo Sapiens
PGSTTLIQG

SEQ ID NO: 426248 - protein, 9 aa, Homo Sapiens
TALKATPFG

SEQ ID NO: 426249 - protein, 9 aa, Homo Sapiens
LTVGKNYLG

SEQ ID NO: 426250 - protein, 9 aa, Homo Sapiens
YSNQNTAPD

SEQ ID NO: 426251 - protein, 9 aa, Homo Sapiens
KDSGVVSRE

SEQ ID NO: 426252 - protein, 9 aa, Homo Sapiens
QYFVVIAAI

SEQ ID NO: 426253 - protein, 9 aa, Homo Sapiens
LVPTADHCP

SEQ ID NO: 426254 - protein, 9 aa, Homo Sapiens
EKRITVKRA

SEQ ID NO: 426255 - protein, 9 aa, Homo Sapiens
EEEGRYLSC

SEQ ID NO: 426256 - protein, 9 aa, Homo Sapiens
NKLKRCDDM

SEQ ID NO: 426257 - protein, 9 aa, Homo Sapiens
KKVCGKVWK

SEQ ID NO: 426258 - protein, 9 aa, Homo Sapiens
KNYLGALSE

SEQ ID NO: 426259 - protein, 9 aa, Homo Sapiens
IKYKSSAKM

SEQ ID NO: 426260 - protein, 9 aa, Homo Sapiens
MIFLGLYIH

SEQ ID NO: 426261 - protein, 9 aa, Homo Sapiens
LLGHYQEVT

SEQ ID NO: 426262 - protein, 9 aa, Homo Sapiens
NCPGWNEDD

SEQ ID NO: 426263 - protein, 9 aa, Homo Sapiens
NIPVLPDDK

SEQ ID NO: 426264 - protein, 9 aa, Homo Sapiens
KPILGVMLT

SEQ ID NO: 426265 - protein, 9 aa, Homo Sapiens
PVTTWQISA

SEQ ID NO: 426266 - protein, 9 aa, Homo Sapiens
QRINSGEKC

SEQ ID NO: 426267 - protein, 9 aa, Homo Sapiens
KITYLPTVT

SEQ ID NO: 426268 - protein, 9 aa, Homo Sapiens
IMTADDDIF

SEQ ID NO: 426269 - protein, 9 aa, Homo Sapiens
LSECNIQLF

SEQ ID NO: 426270 - protein, 9 aa, Homo Sapiens
SASPSMPEN

SEQ ID NO: 426271 - protein, 9 aa, Homo Sapiens
YVIQGLATL

SEQ ID NO: 426272 - protein, 9 aa, Homo Sapiens
LCNFRSKLY

SEQ ID NO: 426273 - protein, 9 aa, Homo Sapiens
ITVGPVQKV

SEQ ID NO: 426274 - protein, 9 aa, Homo Sapiens
PTQRYINSK

SEQ ID NO: 426275 - protein, 9 aa, Homo Sapiens
HKEEIAELQ

SEQ ID NO: 426276 - protein, 9 aa, Homo Sapiens
SVKKKEDLH

SEQ ID NO: 426277 - protein, 9 aa, Homo Sapiens
LAMRFKPDK

SEQ ID NO: 426278 - protein, 9 aa, Homo Sapiens
GTMGQSAPV

SEQ ID NO: 426279 - protein, 9 aa, Homo Sapiens
LDILSRLMQ

SEQ ID NO: 426280 - protein, 9 aa, Homo Sapiens
QIKNSTFCI

SEQ ID NO: 426281 - protein, 9 aa, Homo Sapiens
AIKAASGHT

SEQ ID NO: 426282 - protein, 9 aa, Homo Sapiens
AWALRYIAI

SEQ ID NO: 426283 - protein, 9 aa, Homo Sapiens
QVQRKRDKE

SEQ ID NO: 426284 - protein, 9 aa, Homo Sapiens
KTILVRMVS

SEQ ID NO: 426285 - protein, 9 aa, Homo Sapiens
KKSYACQQC

SEQ ID NO: 426286 - protein, 9 aa, Homo Sapiens
LVFICFYIN

SEQ ID NO: 426287 - protein, 9 aa, Homo Sapiens
YLMGGAYLC

SEQ ID NO: 426288 - protein, 9 aa, Homo Sapiens
AEKVIQHAL

SEQ ID NO: 426289 - protein, 9 aa, Homo Sapiens
LSVAYCFTH

SEQ ID NO: 426290 - protein, 9 aa, Homo Sapiens
FCLSSWEAR

SEQ ID NO: 426291 - protein, 9 aa, Homo Sapiens
YDNKKMLGH

SEQ ID NO: 426292 - protein, 9 aa, Homo Sapiens
LSLFLVIYV

SEQ ID NO: 426293 - protein, 9 aa, Homo Sapiens
CDFNTNKCK

SEQ ID NO: 426294 - protein, 9 aa, Homo Sapiens
KDKYNCIGL

SEQ ID NO: 426295 - protein, 9 aa, Homo Sapiens
NITSLISQT

SEQ ID NO: 426296 - protein, 9 aa, Homo Sapiens
DPLREVCLA

SEQ ID NO: 426297 - protein, 9 aa, Homo Sapiens
SVYIRSNNW

SEQ ID NO: 426298 - protein, 9 aa, Homo Sapiens
KEINGIYDE

SEQ ID NO: 426299 - protein, 9 aa, Homo Sapiens
DFEKPRQYN

SEQ ID NO: 426300 - protein, 9 aa, Homo Sapiens
STDLIIHHI

SEQ ID NO: 426301 - protein, 9 aa, Homo Sapiens
YNVAISLGY

SEQ ID NO: 426302 - protein, 9 aa, Homo Sapiens
FAMHYIIED

SEQ ID NO: 426303 - protein, 9 aa, Homo Sapiens
YHFSAKHAL

SEQ ID NO: 426304 - protein, 9 aa, Homo Sapiens
LKKVTFEYV

SEQ ID NO: 426305 - protein, 9 aa, Homo Sapiens
RQKHSHQYS

SEQ ID NO: 426306 - protein, 9 aa, Homo Sapiens
KVILSACKA

SEQ ID NO: 426307 - protein, 9 aa, Homo Sapiens
HKPKGTENE

SEQ ID NO: 426308 - protein, 9 aa, Homo Sapiens
GKDKEYADI

SEQ ID NO: 426309 - protein, 9 aa, Homo Sapiens
QTSVEHCKA

SEQ ID NO: 426310 - protein, 9 aa, Homo Sapiens
YDKANIDLE

SEQ ID NO: 426311 - protein, 9 aa, Homo Sapiens
RILQDYHNP

SEQ ID NO: 426312 - protein, 9 aa, Homo Sapiens
MLNDATYKL

SEQ ID NO: 426313 - protein, 9 aa, Homo Sapiens
SKIFADRPC

SEQ ID NO: 426314 - protein, 9 aa, Homo Sapiens
ECINFRKLS

SEQ ID NO: 426315 - protein, 9 aa, Homo Sapiens
SQLVIHHKG

SEQ ID NO: 426316 - protein, 9 aa, Homo Sapiens
PGSVATVSA

SEQ ID NO: 426317 - protein, 9 aa, Homo Sapiens
PNMLGSVAT

SEQ ID NO: 426318 - protein, 9 aa, Homo Sapiens
TSHSAIPDV

SEQ ID NO: 426319 - protein, 9 aa, Homo Sapiens
TNSSKIPVS

SEQ ID NO: 426320 - protein, 9 aa, Homo Sapiens
LIVFWFCVL

SEQ ID NO: 426321 - protein, 9 aa, Homo Sapiens
EIRNPVSVS

SEQ ID NO: 426322 - protein, 9 aa, Homo Sapiens
SDFFYKFRL

SEQ ID NO: 426323 - protein, 9 aa, Homo Sapiens
CQNPNTFQP

SEQ ID NO: 426324 - protein, 9 aa, Homo Sapiens
SLNTPSERL

SEQ ID NO: 426325 - protein, 9 aa, Homo Sapiens
CEGLWHPQC

SEQ ID NO: 426326 - protein, 9 aa, Homo Sapiens
RLNMYNLVE

SEQ ID NO: 426327 - protein, 9 aa, Homo Sapiens
GPQGICGDK

SEQ ID NO: 426328 - protein, 9 aa, Homo Sapiens
LVDFWAQLL

SEQ ID NO: 426329 - protein, 9 aa, Homo Sapiens
DFRNMAYLR

SEQ ID NO: 426330 - protein, 9 aa, Homo Sapiens
QNLEALKKA

SEQ ID NO: 426331 - protein, 9 aa, Homo Sapiens
GLNNPPGPW

SEQ ID NO: 426332 - protein, 9 aa, Homo Sapiens
INRTSDVTI

SEQ ID NO: 426333 - protein, 9 aa, Homo Sapiens
WMAPEPLKD

SEQ ID NO: 426334 - protein, 9 aa, Homo Sapiens
SHSLLLLQP

SEQ ID NO: 426335 - protein, 9 aa, Homo Sapiens
IEFVKHFCS

SEQ ID NO: 426336 - protein, 9 aa, Homo Sapiens
LSHLYNESV

SEQ ID NO: 426337 - protein, 9 aa, Homo Sapiens
VIFCSRDKV

SEQ ID NO: 426338 - protein, 9 aa, Homo Sapiens
PQPCLTGPH

SEQ ID NO: 426339 - protein, 9 aa, Homo Sapiens
KPHLTNHQQ

SEQ ID NO: 426340 - protein, 9 aa, Homo Sapiens
SYLVDNLTN

SEQ ID NO: 426341 - protein, 9 aa, Homo Sapiens
TEDNNFSLN

SEQ ID NO: 426342 - protein, 9 aa, Homo Sapiens
IKVARQSLT

SEQ ID NO: 426343 - protein, 9 aa, Homo Sapiens
QNVRARKYY

SEQ ID NO: 426344 - protein, 9 aa, Homo Sapiens
NKCARRFTD

SEQ ID NO: 426345 - protein, 9 aa, Homo Sapiens
TGVSGSTWA

SEQ ID NO: 426346 - protein, 9 aa, Homo Sapiens
IEKLKIQAE

SEQ ID NO: 426347 - protein, 9 aa, Homo Sapiens
LKEEEASKS

SEQ ID NO: 426348 - protein, 9 aa, Homo Sapiens
MLYLIIMIV

SEQ ID NO: 426349 - protein, 9 aa, Homo Sapiens
EMKNYIFAE

SEQ ID NO: 426350 - protein, 9 aa, Homo Sapiens
VGKNYLGAL

SEQ ID NO: 426351 - protein, 9 aa, Homo Sapiens
ECLQTCQTV

SEQ ID NO: 426352 - protein, 9 aa, Homo Sapiens
RVDEVAAAP

SEQ ID NO: 426353 - protein, 9 aa, Homo Sapiens
SNYRAGMTI

SEQ ID NO: 426354 - protein, 9 aa, Homo Sapiens
LSLSQWDPM

SEQ ID NO: 426355 - protein, 9 aa, Homo Sapiens
FHKRYWKTQ

SEQ ID NO: 426356 - protein, 9 aa, Homo Sapiens
FEYVAIDFT

SEQ ID NO: 426357 - protein, 9 aa, Homo Sapiens
EVRSPTKTP

SEQ ID NO: 426358 - protein, 9 aa, Homo Sapiens
FGLSPLIDR

SEQ ID NO: 426359 - protein, 9 aa, Homo Sapiens
QNCSHDCPC

SEQ ID NO: 426360 - protein, 9 aa, Homo Sapiens
LPEYKIFFV

SEQ ID NO: 426361 - protein, 9 aa, Homo Sapiens
QQVTLRCYP

SEQ ID NO: 426362 - protein, 9 aa, Homo Sapiens
FEKELETNS

SEQ ID NO: 426363 - protein, 9 aa, Homo Sapiens
ECAPHLSLP

SEQ ID NO: 426364 - protein, 9 aa, Homo Sapiens
YSYLMVMYV

SEQ ID NO: 426365 - protein, 9 aa, Homo Sapiens
VPHNSNEGW

SEQ ID NO: 426366 - protein, 9 aa, Homo Sapiens
VAKDLPVYS

SEQ ID NO: 426367 - protein, 9 aa, Homo Sapiens
HIANIGHLV

SEQ ID NO: 426368 - protein, 9 aa, Homo Sapiens
THLPCPGKA

SEQ ID NO: 426369 - protein, 9 aa, Homo Sapiens
RRQQKQLEH

SEQ ID NO: 426370 - protein, 9 aa, Homo Sapiens
VNRSIYVDF

SEQ ID NO: 426371 - protein, 9 aa, Homo Sapiens
CVNFCTEKE

SEQ ID NO: 426372 - protein, 9 aa, Homo Sapiens
VSRSSAMCH

SEQ ID NO: 426373 - protein, 9 aa, Homo Sapiens
EMSNKLEAG

SEQ ID NO: 426374 - protein, 9 aa, Homo Sapiens
QPGDTHPNV

SEQ ID NO: 426375 - protein, 9 aa, Homo Sapiens
FTPMDLFKS

SEQ ID NO: 426376 - protein, 9 aa, Homo Sapiens
KAFQKRQLD

SEQ ID NO: 426377 - protein, 9 aa, Homo Sapiens
NQFGLSLQS

SEQ ID NO: 426378 - protein, 9 aa, Homo Sapiens
HSQLPTLVQ

SEQ ID NO: 426379 - protein, 9 aa, Homo Sapiens
RIQDYGTLL

SEQ ID NO: 426380 - protein, 9 aa, Homo Sapiens
KVCGPPVSC

SEQ ID NO: 426381 - protein, 9 aa, Homo Sapiens
DNTYLCWML

SEQ ID NO: 426382 - protein, 9 aa, Homo Sapiens
WWTLPKNFH

SEQ ID NO: 426383 - protein, 9 aa, Homo Sapiens
KKPPSGSAR

SEQ ID NO: 426384 - protein, 9 aa, Homo Sapiens
QRRGGLHYM

SEQ ID NO: 426385 - protein, 9 aa, Homo Sapiens
AWLAYMNQA

SEQ ID NO: 426386 - protein, 9 aa, Homo Sapiens
NNYSKLRSS

SEQ ID NO: 426387 - protein, 9 aa, Homo Sapiens
QINLIDLAG

SEQ ID NO: 426388 - protein, 9 aa, Homo Sapiens
VKRNIFSNW

SEQ ID NO: 426389 - protein, 9 aa, Homo Sapiens
VKGRGPNVT

SEQ ID NO: 426390 - protein, 9 aa, Homo Sapiens
LMSELEKAR

SEQ ID NO: 426391 - protein, 9 aa, Homo Sapiens
RSVGNTFVL

SEQ ID NO: 426392 - protein, 9 aa, Homo Sapiens
GNPNGNDLY

SEQ ID NO: 426393 - protein, 9 aa, Homo Sapiens
FPDELRPTV

SEQ ID NO: 426394 - protein, 9 aa, Homo Sapiens
LDPLREVCL

SEQ ID NO: 426395 - protein, 9 aa, Homo Sapiens
SYEYHKYGD

SEQ ID NO: 426396 - protein, 9 aa, Homo Sapiens
ARDNELSGG

SEQ ID NO: 426397 - protein, 9 aa, Homo Sapiens
KYKVMRKYD

SEQ ID NO: 426398 - protein, 9 aa, Homo Sapiens
IGLEKLLKQ

SEQ ID NO: 426399 - protein, 9 aa, Homo Sapiens
KEPWWTLPK

SEQ ID NO: 426400 - protein, 9 aa, Homo Sapiens
AASRDKPEP

SEQ ID NO: 426401 - protein, 9 aa, Homo Sapiens
LFMIIWLKG

SEQ ID NO: 426402 - protein, 9 aa, Homo Sapiens
CYRDLHSTL

SEQ ID NO: 426403 - protein, 9 aa, Homo Sapiens
ARIRNVGSE

SEQ ID NO: 426404 - protein, 9 aa, Homo Sapiens
ASFLLLVVA

SEQ ID NO: 426405 - protein, 9 aa, Homo Sapiens
MPRSYVNNQ

SEQ ID NO: 426406 - protein, 9 aa, Homo Sapiens
KVIGRLRAL

SEQ ID NO: 426407 - protein, 9 aa, Homo Sapiens
VLILVVPLS

SEQ ID NO: 426408 - protein, 9 aa, Homo Sapiens
LIKNTYIPQ

SEQ ID NO: 426409 - protein, 9 aa, Homo Sapiens
QREHERLRT

SEQ ID NO: 426410 - protein, 9 aa, Homo Sapiens
SDLTVPNLP

SEQ ID NO: 426411 - protein, 9 aa, Homo Sapiens
NPETNSDDA

SEQ ID NO: 426412 - protein, 9 aa, Homo Sapiens
MVQKMIFYL

SEQ ID NO: 426413 - protein, 9 aa, Homo Sapiens
VAVVVWKIK

SEQ ID NO: 426414 - protein, 9 aa, Homo Sapiens
INAVKKIAE

SEQ ID NO: 426415 - protein, 9 aa, Homo Sapiens
INEQGGVRV

SEQ ID NO: 426416 - protein, 9 aa, Homo Sapiens
EAVIADLST

SEQ ID NO: 426417 - protein, 9 aa, Homo Sapiens
SWNVIAWNR

SEQ ID NO: 426418 - protein, 9 aa, Homo Sapiens
GFINTTFLL

SEQ ID NO: 426419 - protein, 9 aa, Homo Sapiens
SRQEKSNQI

SEQ ID NO: 426420 - protein, 9 aa, Homo Sapiens
TPGSTTLIQ

SEQ ID NO: 426421 - protein, 9 aa, Homo Sapiens
DEKLSGASL

SEQ ID NO: 426422 - protein, 9 aa, Homo Sapiens
TIMLNTSLH

SEQ ID NO: 426423 - protein, 9 aa, Homo Sapiens
NGRYSLKVW

SEQ ID NO: 426424 - protein, 9 aa, Homo Sapiens
EESENQTDF

SEQ ID NO: 426425 - protein, 9 aa, Homo Sapiens
KTVFLVLMF

SEQ ID NO: 426426 - protein, 9 aa, Homo Sapiens
DESHKPKGT

SEQ ID NO: 426427 - protein, 9 aa, Homo Sapiens
EAEKLLCLL

SEQ ID NO: 426428 - protein, 9 aa, Homo Sapiens
SLSMACHQQ

SEQ ID NO: 426429 - protein, 9 aa, Homo Sapiens
GVTTGVIRH

SEQ ID NO: 426430 - protein, 9 aa, Homo Sapiens
DQCLNCPDG

SEQ ID NO: 426431 - protein, 9 aa, Homo Sapiens
AAEEDRDKL

SEQ ID NO: 426432 - protein, 9 aa, Homo Sapiens
NNYHSQFYQ

SEQ ID NO: 426433 - protein, 9 aa, Homo Sapiens
VRGPPTGKR

SEQ ID NO: 426434 - protein, 9 aa, Homo Sapiens
LKVWAHGGA

SEQ ID NO: 426435 - protein, 9 aa, Homo Sapiens
LKVWDVEKS

SEQ ID NO: 426436 - protein, 9 aa, Homo Sapiens
NIKMKPKPR

SEQ ID NO: 426437 - protein, 9 aa, Homo Sapiens
AGVSLHIGI

SEQ ID NO: 426438 - protein, 9 aa, Homo Sapiens
EQEEQGKIS

SEQ ID NO: 426439 - protein, 9 aa, Homo Sapiens
TIIMSFVKG

SEQ ID NO: 426440 - protein, 9 aa, Homo Sapiens
HLRQRRMHQ

SEQ ID NO: 426441 - protein, 9 aa, Homo Sapiens
QHVDSLLSE

SEQ ID NO: 426442 - protein, 9 aa, Homo Sapiens
TGTVYVAEI

SEQ ID NO: 426443 - protein, 9 aa, Homo Sapiens
NNIKLLEKH

SEQ ID NO: 426444 - protein, 9 aa, Homo Sapiens
RHWSASLQC

SEQ ID NO: 426445 - protein, 9 aa, Homo Sapiens
YEPTWQNFT

SEQ ID NO: 426446 - protein, 9 aa, Homo Sapiens
EQPRRKHSH

SEQ ID NO: 426447 - protein, 9 aa, Homo Sapiens
HLGQIMGET

SEQ ID NO: 426448 - protein, 9 aa, Homo Sapiens
RFQVDHVIW

SEQ ID NO: 426449 - protein, 9 aa, Homo Sapiens
ESKPLKMAG

SEQ ID NO: 426450 - protein, 9 aa, Homo Sapiens
ALAPQGRLI

SEQ ID NO: 426451 - protein, 9 aa, Homo Sapiens
FLFFIFLPN

SEQ ID NO: 426452 - protein, 9 aa, Homo Sapiens
IYKKLINSQ

SEQ ID NO: 426453 - protein, 9 aa, Homo Sapiens
STDSQNYFA

SEQ ID NO: 426454 - protein, 9 aa, Homo Sapiens
GSDILDSSV

SEQ ID NO: 426455 - protein, 9 aa, Homo Sapiens
SVGVALSRG

SEQ ID NO: 426456 - protein, 9 aa, Homo Sapiens
FDSANWRAS

SEQ ID NO: 426457 - protein, 9 aa, Homo Sapiens
DRKTGTVYV

SEQ ID NO: 426458 - protein, 9 aa, Homo Sapiens
RLDDVCNRF

SEQ ID NO: 426459 - protein, 9 aa, Homo Sapiens
LHECNNCVK

SEQ ID NO: 426460 - protein, 9 aa, Homo Sapiens
SGGGPPKYF

SEQ ID NO: 426461 - protein, 9 aa, Homo Sapiens
LGRPENIHN

SEQ ID NO: 426462 - protein, 9 aa, Homo Sapiens
NHKNSVLSQ

SEQ ID NO: 426463 - protein, 9 aa, Homo Sapiens
HVQIHTGEK

SEQ ID NO: 426464 - protein, 9 aa, Homo Sapiens
QENYSFTIL

SEQ ID NO: 426465 - protein, 9 aa, Homo Sapiens
DLGRDSKKR

SEQ ID NO: 426466 - protein, 9 aa, Homo Sapiens
PEDESKVTF

SEQ ID NO: 426467 - protein, 9 aa, Homo Sapiens
ANCNLEYLD

SEQ ID NO: 426468 - protein, 9 aa, Homo Sapiens
FIDKLDEVL

SEQ ID NO: 426469 - protein, 9 aa, Homo Sapiens
SYTCEECGK

SEQ ID NO: 426470 - protein, 9 aa, Homo Sapiens
DVLISEFQM

SEQ ID NO: 426471 - protein, 9 aa, Homo Sapiens
LFTEKGEAG

SEQ ID NO: 426472 - protein, 9 aa, Homo Sapiens
AFLIVITLY

SEQ ID NO: 426473 - protein, 9 aa, Homo Sapiens
DQQNTSCLV

SEQ ID NO: 426474 - protein, 9 aa, Homo Sapiens
CDSEIHREQ

SEQ ID NO: 426475 - protein, 9 aa, Homo Sapiens
EAPGDLLQR

SEQ ID NO: 426476 - protein, 9 aa, Homo Sapiens
LLKCPMNLL

SEQ ID NO: 426477 - protein, 9 aa, Homo Sapiens
SQYIKLISE

SEQ ID NO: 426478 - protein, 9 aa, Homo Sapiens
SEFGTLPES

SEQ ID NO: 426479 - protein, 9 aa, Homo Sapiens
LEEITRFLS

SEQ ID NO: 426480 - protein, 9 aa, Homo Sapiens
KLDTDTGVC

SEQ ID NO: 426481 - protein, 9 aa, Homo Sapiens
VSRHTKFGY

SEQ ID NO: 426482 - protein, 9 aa, Homo Sapiens
TGLRNVGNT

SEQ ID NO: 426483 - protein, 9 aa, Homo Sapiens
WLADGGRLV

SEQ ID NO: 426484 - protein, 9 aa, Homo Sapiens
ITWFQNWRA

SEQ ID NO: 426485 - protein, 9 aa, Homo Sapiens
SGSGGFNYL

SEQ ID NO: 426486 - protein, 9 aa, Homo Sapiens
TKADNARMV

SEQ ID NO: 426487 - protein, 9 aa, Homo Sapiens
KVLFLTRHF

SEQ ID NO: 426488 - protein, 9 aa, Homo Sapiens
REECLRTVK

SEQ ID NO: 426489 - protein, 9 aa, Homo Sapiens
PFSNCSGLF

SEQ ID NO: 426490 - protein, 9 aa, Homo Sapiens
DHKLNTYHD

SEQ ID NO: 426491 - protein, 9 aa, Homo Sapiens
AWDDLNKYL

SEQ ID NO: 426492 - protein, 9 aa, Homo Sapiens
WDYRHPPPC

SEQ ID NO: 426493 - protein, 9 aa, Homo Sapiens
ISSTITRDM

SEQ ID NO: 426494 - protein, 9 aa, Homo Sapiens
VRDPFKRLI

SEQ ID NO: 426495 - protein, 9 aa, Homo Sapiens
AKTDSSLHS

SEQ ID NO: 426496 - protein, 9 aa, Homo Sapiens
AEVDKHIEK

SEQ ID NO: 426497 - protein, 9 aa, Homo Sapiens
SLAAAEAVI

SEQ ID NO: 426498 - protein, 9 aa, Homo Sapiens
VAVRVQGIT

SEQ ID NO: 426499 - protein, 9 aa, Homo Sapiens
RDFKKNYNM

SEQ ID NO: 426500 - protein, 9 aa, Homo Sapiens
CHISDLWRK

SEQ ID NO: 426501 - protein, 9 aa, Homo Sapiens
YLLGKQRFE

SEQ ID NO: 426502 - protein, 9 aa, Homo Sapiens
EMEIKINYL

SEQ ID NO: 426503 - protein, 9 aa, Homo Sapiens
GFEKLFEVY

SEQ ID NO: 426504 - protein, 9 aa, Homo Sapiens
RFFCGCGCG

SEQ ID NO: 426505 - protein, 9 aa, Homo Sapiens
MLVPLPVPW

SEQ ID NO: 426506 - protein, 9 aa, Homo Sapiens
GKWAMLGTL

SEQ ID NO: 426507 - protein, 9 aa, Homo Sapiens
EIPMIPGSH

SEQ ID NO: 426508 - protein, 9 aa, Homo Sapiens
HKKYAPKPP

SEQ ID NO: 426509 - protein, 9 aa, Homo Sapiens
ILKRQLYDN

SEQ ID NO: 426510 - protein, 9 aa, Homo Sapiens
VRKPAQSRP

SEQ ID NO: 426511 - protein, 9 aa, Homo Sapiens
EKKEECVQG

SEQ ID NO: 426512 - protein, 9 aa, Homo Sapiens
EAENLNKYF

SEQ ID NO: 426513 - protein, 9 aa, Homo Sapiens
REHEKTHTI

SEQ ID NO: 426514 - protein, 9 aa, Homo Sapiens
ELHSELAGV

SEQ ID NO: 426515 - protein, 9 aa, Homo Sapiens
VWVLDSWSH

SEQ ID NO: 426516 - protein, 9 aa, Homo Sapiens
VTFYILVKA

SEQ ID NO: 426517 - protein, 9 aa, Homo Sapiens
SRIRKFIIS

SEQ ID NO: 426518 - protein, 9 aa, Homo Sapiens
EENIRRLEE

SEQ ID NO: 426519 - protein, 9 aa, Homo Sapiens
KADNARMVV

SEQ ID NO: 426520 - protein, 9 aa, Homo Sapiens
FPKDKETHR

SEQ ID NO: 426521 - protein, 9 aa, Homo Sapiens
ARILALQKN

SEQ ID NO: 426522 - protein, 9 aa, Homo Sapiens
PQPGNTKIS

SEQ ID NO: 426523 - protein, 9 aa, Homo Sapiens
TVKPKEAIK

SEQ ID NO: 426524 - protein, 9 aa, Homo Sapiens
YLDDSDTIV

SEQ ID NO: 426525 - protein, 9 aa, Homo Sapiens
GETVQTLYL

SEQ ID NO: 426526 - protein, 9 aa, Homo Sapiens
DKLDEVLGE

SEQ ID NO: 426527 - protein, 9 aa, Homo Sapiens
HFFSSGLLC

SEQ ID NO: 426528 - protein, 9 aa, Homo Sapiens
VGFIDGSFD

SEQ ID NO: 426529 - protein, 9 aa, Homo Sapiens
YFETSATTG

SEQ ID NO: 426530 - protein, 9 aa, Homo Sapiens
KGEKPYGCL

SEQ ID NO: 426531 - protein, 9 aa, Homo Sapiens
ILNASTTEV

SEQ ID NO: 426532 - protein, 9 aa, Homo Sapiens
EKWSSGFIS

SEQ ID NO: 426533 - protein, 9 aa, Homo Sapiens
DLCYSNDKT

SEQ ID NO: 426534 - protein, 9 aa, Homo Sapiens
WWARLSLCL

SEQ ID NO: 426535 - protein, 9 aa, Homo Sapiens
MNNLLPISV

SEQ ID NO: 426536 - protein, 9 aa, Homo Sapiens
LTLEMLKST

SEQ ID NO: 426537 - protein, 9 aa, Homo Sapiens
DSGRIRTES

SEQ ID NO: 426538 - protein, 9 aa, Homo Sapiens
ATENCFSVN

SEQ ID NO: 426539 - protein, 9 aa, Homo Sapiens
LFGDTPKRI

SEQ ID NO: 426540 - protein, 9 aa, Homo Sapiens
FRFPMDSHS

SEQ ID NO: 426541 - protein, 9 aa, Homo Sapiens
QQILCIQRT

SEQ ID NO: 426542 - protein, 9 aa, Homo Sapiens
VNNIKCDVT

SEQ ID NO: 426543 - protein, 9 aa, Homo Sapiens
RTLFASSAL

SEQ ID NO: 426544 - protein, 9 aa, Homo Sapiens
SICRPLHYP

SEQ ID NO: 426545 - protein, 9 aa, Homo Sapiens
NASNYPNSC

SEQ ID NO: 426546 - protein, 9 aa, Homo Sapiens
EKCNTISVS

SEQ ID NO: 426547 - protein, 9 aa, Homo Sapiens
VANVSVDHS

SEQ ID NO: 426548 - protein, 9 aa, Homo Sapiens
TINHLFCEF

SEQ ID NO: 426549 - protein, 9 aa, Homo Sapiens
TINVLSKSV

SEQ ID NO: 426550 - protein, 9 aa, Homo Sapiens
TVDLAHTIG

SEQ ID NO: 426551 - protein, 9 aa, Homo Sapiens
SSHLRYGMS

SEQ ID NO: 426552 - protein, 9 aa, Homo Sapiens
EHEKTHTIN

SEQ ID NO: 426553 - protein, 9 aa, Homo Sapiens
LHNHVQGLV

SEQ ID NO: 426554 - protein, 9 aa, Homo Sapiens
KYRIREKAR

SEQ ID NO: 426555 - protein, 9 aa, Homo Sapiens
ICCLTTIGH

SEQ ID NO: 426556 - protein, 9 aa, Homo Sapiens
ESQIPPQIP

SEQ ID NO: 426557 - protein, 9 aa, Homo Sapiens
HINTFIKIP

SEQ ID NO: 426558 - protein, 9 aa, Homo Sapiens
WVAVGLSSD

SEQ ID NO: 426559 - protein, 9 aa, Homo Sapiens
YFKLMFDHS

SEQ ID NO: 426560 - protein, 9 aa, Homo Sapiens
NMLERGKAG

SEQ ID NO: 426561 - protein, 9 aa, Homo Sapiens
DNYILAAMA

SEQ ID NO: 426562 - protein, 9 aa, Homo Sapiens
NQHDSNNQF

SEQ ID NO: 426563 - protein, 9 aa, Homo Sapiens
KLIKNTYIP

SEQ ID NO: 426564 - protein, 9 aa, Homo Sapiens
YCEKDDLSC

SEQ ID NO: 426565 - protein, 9 aa, Homo Sapiens
LYYSTMNYD

SEQ ID NO: 426566 - protein, 9 aa, Homo Sapiens
SPLEPLEEL

SEQ ID NO: 426567 - protein, 9 aa, Homo Sapiens
NHLDDLKGT

SEQ ID NO: 426568 - protein, 9 aa, Homo Sapiens
PPTHVAEVA

SEQ ID NO: 426569 - protein, 9 aa, Homo Sapiens
IINKTRTRS

SEQ ID NO: 426570 - protein, 9 aa, Homo Sapiens
DTSHEQWLF

SEQ ID NO: 426571 - protein, 9 aa, Homo Sapiens
IPGLLKSPK

SEQ ID NO: 426572 - protein, 9 aa, Homo Sapiens
DSKKRKMYD

SEQ ID NO: 426573 - protein, 9 aa, Homo Sapiens
DYITLGVEA

SEQ ID NO: 426574 - protein, 9 aa, Homo Sapiens
EQTCSWQSQ

SEQ ID NO: 426575 - protein, 9 aa, Homo Sapiens
SNFRRYKVL

SEQ ID NO: 426576 - protein, 9 aa, Homo Sapiens
ACLDHLAPN

SEQ ID NO: 426577 - protein, 9 aa, Homo Sapiens
EEASQNLST

SEQ ID NO: 426578 - protein, 9 aa, Homo Sapiens
CSPSFFNRF

SEQ ID NO: 426579 - protein, 9 aa, Homo Sapiens
MEVITAAEF

SEQ ID NO: 426580 - protein, 9 aa, Homo Sapiens
GPEPARDIH

SEQ ID NO: 426581 - protein, 9 aa, Homo Sapiens
GNISKDLTD

SEQ ID NO: 426582 - protein, 9 aa, Homo Sapiens
GANKVMNSY

SEQ ID NO: 426583 - protein, 9 aa, Homo Sapiens
VYLAYAFES

SEQ ID NO: 426584 - protein, 9 aa, Homo Sapiens
NQLEGKWAM

SEQ ID NO: 426585 - protein, 9 aa, Homo Sapiens
RSDRSPELS

SEQ ID NO: 426586 - protein, 9 aa, Homo Sapiens
FKFFPFMNL

SEQ ID NO: 426587 - protein, 9 aa, Homo Sapiens
KPNSAGEYG

SEQ ID NO: 426588 - protein, 9 aa, Homo Sapiens
ILLAFLIVI

SEQ ID NO: 426589 - protein, 9 aa, Homo Sapiens
TIILHIKST

SEQ ID NO: 426590 - protein, 9 aa, Homo Sapiens
KESHDCGGV

SEQ ID NO: 426591 - protein, 9 aa, Homo Sapiens
YTLRYHHIM

SEQ ID NO: 426592 - protein, 9 aa, Homo Sapiens
NYLREMRHH

SEQ ID NO: 426593 - protein, 9 aa, Homo Sapiens
FSYAGCFQF

SEQ ID NO: 426594 - protein, 9 aa, Homo Sapiens
MITPSAITV

SEQ ID NO: 426595 - protein, 9 aa, Homo Sapiens
NENPFNCTC

SEQ ID NO: 426596 - protein, 9 aa, Homo Sapiens
DGQNLKELI

SEQ ID NO: 426597 - protein, 9 aa, Homo Sapiens
RTIGMSLAK

SEQ ID NO: 426598 - protein, 9 aa, Homo Sapiens
PTYFRADKK

SEQ ID NO: 426599 - protein, 9 aa, Homo Sapiens
LTVNSEFVG

SEQ ID NO: 426600 - protein, 9 aa, Homo Sapiens
QEKINSRLR

SEQ ID NO: 426601 - protein, 9 aa, Homo Sapiens
ILQMHFFHS

SEQ ID NO: 426602 - protein, 9 aa, Homo Sapiens
ESEQVQWME

SEQ ID NO: 426603 - protein, 9 aa, Homo Sapiens
DYEAGIVSL

SEQ ID NO: 426604 - protein, 9 aa, Homo Sapiens
VPDPGMVNG

SEQ ID NO: 426605 - protein, 9 aa, Homo Sapiens
MYKARIQYF

SEQ ID NO: 426606 - protein, 9 aa, Homo Sapiens
QVNDVNQPF

SEQ ID NO: 426607 - protein, 9 aa, Homo Sapiens
ADHLLHLNT

SEQ ID NO: 426608 - protein, 9 aa, Homo Sapiens
LYLNKPVQV

SEQ ID NO: 426609 - protein, 9 aa, Homo Sapiens
GDTIARATV

SEQ ID NO: 426610 - protein, 9 aa, Homo Sapiens
TDSQNYFAS

SEQ ID NO: 426611 - protein, 9 aa, Homo Sapiens
RTRIAAQGL

SEQ ID NO: 426612 - protein, 9 aa, Homo Sapiens
KNNYLHNFC

SEQ ID NO: 426613 - protein, 9 aa, Homo Sapiens
EEVNNVISP

SEQ ID NO: 426614 - protein, 9 aa, Homo Sapiens
TKNESFLED

SEQ ID NO: 426615 - protein, 9 aa, Homo Sapiens
KNNDLRLRQ

SEQ ID NO: 426616 - protein, 9 aa, Homo Sapiens
MLQEMQSKN

SEQ ID NO: 426617 - protein, 9 aa, Homo Sapiens
YQEPIDSHS

SEQ ID NO: 426618 - protein, 9 aa, Homo Sapiens
KGKSIQQRS

SEQ ID NO: 426619 - protein, 9 aa, Homo Sapiens
IIQHQKIHS

SEQ ID NO: 426620 - protein, 9 aa, Homo Sapiens
YMEKGCHFL

SEQ ID NO: 426621 - protein, 9 aa, Homo Sapiens
QEREREVQK

SEQ ID NO: 426622 - protein, 9 aa, Homo Sapiens
WLSVSLPER

SEQ ID NO: 426623 - protein, 9 aa, Homo Sapiens
VSDRNSGVN

SEQ ID NO: 426624 - protein, 9 aa, Homo Sapiens
TCSPSTNTC

SEQ ID NO: 426625 - protein, 9 aa, Homo Sapiens
ASRHHDQNS

SEQ ID NO: 426626 - protein, 9 aa, Homo Sapiens
KAILSDHQI

SEQ ID NO: 426627 - protein, 9 aa, Homo Sapiens
CYDPRRCYV

SEQ ID NO: 426628 - protein, 9 aa, Homo Sapiens
YDGKFIKKH

SEQ ID NO: 426629 - protein, 9 aa, Homo Sapiens
GDKYFFGGF

SEQ ID NO: 426630 - protein, 9 aa, Homo Sapiens
GHQIVTYFY

SEQ ID NO: 426631 - protein, 9 aa, Homo Sapiens
FVEDGEPWL

SEQ ID NO: 426632 - protein, 9 aa, Homo Sapiens
NTVAYGEFR

SEQ ID NO: 426633 - protein, 9 aa, Homo Sapiens
VTAAIQADL

SEQ ID NO: 426634 - protein, 9 aa, Homo Sapiens
SRKRPGIAL

SEQ ID NO: 426635 - protein, 9 aa, Homo Sapiens
AGPHHAQGK

SEQ ID NO: 426636 - protein, 9 aa, Homo Sapiens
DLSDQLSLG

SEQ ID NO: 426637 - protein, 9 aa, Homo Sapiens
LTEACTDNP

SEQ ID NO: 426638 - protein, 9 aa, Homo Sapiens
CLECDPKCI

SEQ ID NO: 426639 - protein, 9 aa, Homo Sapiens
SLMNSTDQE

SEQ ID NO: 426640 - protein, 9 aa, Homo Sapiens
TWCEQKLKA

SEQ ID NO: 426641 - protein, 9 aa, Homo Sapiens
SATQLRQLK

SEQ ID NO: 426642 - protein, 9 aa, Homo Sapiens
PVLLLITIT

SEQ ID NO: 426643 - protein, 9 aa, Homo Sapiens
SYFAFFILL

SEQ ID NO: 426644 - protein, 9 aa, Homo Sapiens
VYHKFSDNS

SEQ ID NO: 426645 - protein, 9 aa, Homo Sapiens
EEEYQSRYQ

SEQ ID NO: 426646 - protein, 9 aa, Homo Sapiens
LKKLQQTSG

SEQ ID NO: 426647 - protein, 9 aa, Homo Sapiens
TFLFSDTQT

SEQ ID NO: 426648 - protein, 9 aa, Homo Sapiens
VNVTFQIEP

SEQ ID NO: 426649 - protein, 9 aa, Homo Sapiens
STSSENYGR

SEQ ID NO: 426650 - protein, 9 aa, Homo Sapiens
REQKLKFKD

SEQ ID NO: 426651 - protein, 9 aa, Homo Sapiens
TIQQKLVVF

SEQ ID NO: 426652 - protein, 9 aa, Homo Sapiens
NIHTGERPY

SEQ ID NO: 426653 - protein, 9 aa, Homo Sapiens
TSEFLKHGK

SEQ ID NO: 426654 - protein, 9 aa, Homo Sapiens
NYKGLRVLE

SEQ ID NO: 426655 - protein, 9 aa, Homo Sapiens
SNQIMGRGE

SEQ ID NO: 426656 - protein, 9 aa, Homo Sapiens
LQAEIHQLK

SEQ ID NO: 426657 - protein, 9 aa, Homo Sapiens
TDVYYLYIK

SEQ ID NO: 426658 - protein, 9 aa, Homo Sapiens
QFRMRGNNT

SEQ ID NO: 426659 - protein, 9 aa, Homo Sapiens
PHSQHVSLS

SEQ ID NO: 426660 - protein, 9 aa, Homo Sapiens
PKFTQEVFK

SEQ ID NO: 426661 - protein, 9 aa, Homo Sapiens
YSSKSHRFT

SEQ ID NO: 426662 - protein, 9 aa, Homo Sapiens
VAFVGAPIT

SEQ ID NO: 426663 - protein, 9 aa, Homo Sapiens
YGLNKFRWY

SEQ ID NO: 426664 - protein, 9 aa, Homo Sapiens
WQTDIPPHH

SEQ ID NO: 426665 - protein, 9 aa, Homo Sapiens
EGIISLKKP

SEQ ID NO: 426666 - protein, 9 aa, Homo Sapiens
LSLKSHNDW

SEQ ID NO: 426667 - protein, 9 aa, Homo Sapiens
HAWNITLRI

SEQ ID NO: 426668 - protein, 9 aa, Homo Sapiens
VFLVAPQIY

SEQ ID NO: 426669 - protein, 9 aa, Homo Sapiens
GKSFNHSSV

SEQ ID NO: 426670 - protein, 9 aa, Homo Sapiens
LVKLLLLAG

SEQ ID NO: 426671 - protein, 9 aa, Homo Sapiens
CVSPGMQCI

SEQ ID NO: 426672 - protein, 9 aa, Homo Sapiens
LGGSHTLLN

SEQ ID NO: 426673 - protein, 9 aa, Homo Sapiens
ITLWKDSDL

SEQ ID NO: 426674 - protein, 9 aa, Homo Sapiens
AELYDPLKE

SEQ ID NO: 426675 - protein, 9 aa, Homo Sapiens
TSEVESLQP

SEQ ID NO: 426676 - protein, 9 aa, Homo Sapiens
MIYHEQLPE

SEQ ID NO: 426677 - protein, 9 aa, Homo Sapiens
SNFQNEIKL

SEQ ID NO: 426678 - protein, 9 aa, Homo Sapiens
GHTLYTSYY

SEQ ID NO: 426679 - protein, 9 aa, Homo Sapiens
RHVTVYHKG

SEQ ID NO: 426680 - protein, 9 aa, Homo Sapiens
FKYMKEFTL

SEQ ID NO: 426681 - protein, 9 aa, Homo Sapiens
LINVFNKHD

SEQ ID NO: 426682 - protein, 9 aa, Homo Sapiens
QRDFTVVSP

SEQ ID NO: 426683 - protein, 9 aa, Homo Sapiens
KDAERTKLL

SEQ ID NO: 426684 - protein, 9 aa, Homo Sapiens
YILRTDNPI

SEQ ID NO: 426685 - protein, 9 aa, Homo Sapiens
ENTHRRETL

SEQ ID NO: 426686 - protein, 9 aa, Homo Sapiens
LAAAEAVIA

SEQ ID NO: 426687 - protein, 9 aa, Homo Sapiens
GAVYLFNGA

SEQ ID NO: 426688 - protein, 9 aa, Homo Sapiens
KFVKNIDQV

SEQ ID NO: 426689 - protein, 9 aa, Homo Sapiens
GEFVVTIPR

SEQ ID NO: 426690 - protein, 9 aa, Homo Sapiens
NAIREHVCI

SEQ ID NO: 426691 - protein, 9 aa, Homo Sapiens
GINIVTANF

SEQ ID NO: 426692 - protein, 9 aa, Homo Sapiens
ILLCDISTL

SEQ ID NO: 426693 - protein, 9 aa, Homo Sapiens
KEKRAQAHV

SEQ ID NO: 426694 - protein, 9 aa, Homo Sapiens
FSPLQILRK

SEQ ID NO: 426695 - protein, 9 aa, Homo Sapiens
DKMTSGMYL

SEQ ID NO: 426696 - protein, 9 aa, Homo Sapiens
GYAFAAAKG

SEQ ID NO: 426697 - protein, 9 aa, Homo Sapiens
TDRDGIQPS

SEQ ID NO: 426698 - protein, 9 aa, Homo Sapiens
SGTEQTGGR

SEQ ID NO: 426699 - protein, 9 aa, Homo Sapiens
ISNILSLLR

SEQ ID NO: 426700 - protein, 9 aa, Homo Sapiens
YTSYQNKSF

SEQ ID NO: 426701 - protein, 9 aa, Homo Sapiens
EYIYAFVHQ

SEQ ID NO: 426702 - protein, 9 aa, Homo Sapiens
DFKKNYNMY

SEQ ID NO: 426703 - protein, 9 aa, Homo Sapiens
FLNPFDNCG

SEQ ID NO: 426704 - protein, 9 aa, Homo Sapiens
EVCEKLHNF

SEQ ID NO: 426705 - protein, 9 aa, Homo Sapiens
HKRLQYYFT

SEQ ID NO: 426706 - protein, 9 aa, Homo Sapiens
PSSITLFAF

SEQ ID NO: 426707 - protein, 9 aa, Homo Sapiens
RPFPVLEHE

SEQ ID NO: 426708 - protein, 9 aa, Homo Sapiens
EELQRTGWF

SEQ ID NO: 426709 - protein, 9 aa, Homo Sapiens
DYRHPPPCL

SEQ ID NO: 426710 - protein, 9 aa, Homo Sapiens
HPITCCPSS

SEQ ID NO: 426711 - protein, 9 aa, Homo Sapiens
GTCMDLVGG

SEQ ID NO: 426712 - protein, 9 aa, Homo Sapiens
QSELEENIR

SEQ ID NO: 426713 - protein, 9 aa, Homo Sapiens
EIVGIPYSL

SEQ ID NO: 426714 - protein, 9 aa, Homo Sapiens
QDGIGLVSL

SEQ ID NO: 426715 - protein, 9 aa, Homo Sapiens
TNEWIYVVD

SEQ ID NO: 426716 - protein, 9 aa, Homo Sapiens
HAALRWHIL

SEQ ID NO: 426717 - protein, 9 aa, Homo Sapiens
MHITFRNSN

SEQ ID NO: 426718 - protein, 9 aa, Homo Sapiens
IVKIVNYIE

SEQ ID NO: 426719 - protein, 9 aa, Homo Sapiens
LVLKRFFKS

SEQ ID NO: 426720 - protein, 9 aa, Homo Sapiens
ILTKDDWWN

SEQ ID NO: 426721 - protein, 9 aa, Homo Sapiens
SIPFFIFGP

SEQ ID NO: 426722 - protein, 9 aa, Homo Sapiens
TDEFNRPVF

SEQ ID NO: 426723 - protein, 9 aa, Homo Sapiens
FEEAAVIDD

SEQ ID NO: 426724 - protein, 9 aa, Homo Sapiens
YDSKTIRNY

SEQ ID NO: 426725 - protein, 9 aa, Homo Sapiens
KEAENLNKY

SEQ ID NO: 426726 - protein, 9 aa, Homo Sapiens
LKESIKYGP

SEQ ID NO: 426727 - protein, 9 aa, Homo Sapiens
KHDATTCFV

SEQ ID NO: 426728 - protein, 9 aa, Homo Sapiens
QQPNKVIYK

SEQ ID NO: 426729 - protein, 9 aa, Homo Sapiens
LATVPDQEE

SEQ ID NO: 426730 - protein, 9 aa, Homo Sapiens
MDTASHSLC

SEQ ID NO: 426731 - protein, 9 aa, Homo Sapiens
RTLLHLAVP

SEQ ID NO: 426732 - protein, 9 aa, Homo Sapiens
LNFGSYAYT

SEQ ID NO: 426733 - protein, 9 aa, Homo Sapiens
VPKLNHNNW

SEQ ID NO: 426734 - protein, 9 aa, Homo Sapiens
VEKIVVASL

SEQ ID NO: 426735 - protein, 9 aa, Homo Sapiens
MNNFDTSQW

SEQ ID NO: 426736 - protein, 9 aa, Homo Sapiens
SSESKKEYQ

SEQ ID NO: 426737 - protein, 9 aa, Homo Sapiens
QINEPTPNY

SEQ ID NO: 426738 - protein, 9 aa, Homo Sapiens
HEAENKHQA

SEQ ID NO: 426739 - protein, 9 aa, Homo Sapiens
NCVDNLYGY

SEQ ID NO: 426740 - protein, 9 aa, Homo Sapiens
TFCVKTSLT

SEQ ID NO: 426741 - protein, 9 aa, Homo Sapiens
SVDKCVNFC

SEQ ID NO: 426742 - protein, 9 aa, Homo Sapiens
RPDTRYVVQ

SEQ ID NO: 426743 - protein, 9 aa, Homo Sapiens
WRASILLSQ

SEQ ID NO: 426744 - protein, 9 aa, Homo Sapiens
SQMNKIRPN

SEQ ID NO: 426745 - protein, 9 aa, Homo Sapiens
PSYQENRRF

SEQ ID NO: 426746 - protein, 9 aa, Homo Sapiens
PGTGNQIPW

SEQ ID NO: 426747 - protein, 9 aa, Homo Sapiens
VEIREVHKR

SEQ ID NO: 426748 - protein, 9 aa, Homo Sapiens
PSTLAGLGD

SEQ ID NO: 426749 - protein, 9 aa, Homo Sapiens
PNTTEREKL

SEQ ID NO: 426750 - protein, 9 aa, Homo Sapiens
RAASLRCSQ

SEQ ID NO: 426751 - protein, 9 aa, Homo Sapiens
SDIRNPEGT

SEQ ID NO: 426752 - protein, 9 aa, Homo Sapiens
SIKLFTGDV

SEQ ID NO: 426753 - protein, 9 aa, Homo Sapiens
IGKENRPGA

SEQ ID NO: 426754 - protein, 9 aa, Homo Sapiens
LKKDKKTKR

SEQ ID NO: 426755 - protein, 9 aa, Homo Sapiens
CINGENSEV

SEQ ID NO: 426756 - protein, 9 aa, Homo Sapiens
LAIYLILAG

SEQ ID NO: 426757 - protein, 9 aa, Homo Sapiens
VCHTEKFSP

SEQ ID NO: 426758 - protein, 9 aa, Homo Sapiens
QYVLKGGEM

SEQ ID NO: 426759 - protein, 9 aa, Homo Sapiens
ESCKGFFKQ

SEQ ID NO: 426760 - protein, 9 aa, Homo Sapiens
MCTIIMSFV

SEQ ID NO: 426761 - protein, 9 aa, Homo Sapiens
IYAFVHQIP

SEQ ID NO: 426762 - protein, 9 aa, Homo Sapiens
LLVQAENRL

SEQ ID NO: 426763 - protein, 9 aa, Homo Sapiens
RNVIYIHET

SEQ ID NO: 426764 - protein, 9 aa, Homo Sapiens
VVTPDGDFH

SEQ ID NO: 426765 - protein, 9 aa, Homo Sapiens
QRSQTALSK

SEQ ID NO: 426766 - protein, 9 aa, Homo Sapiens
HGSSSPRLP

SEQ ID NO: 426767 - protein, 9 aa, Homo Sapiens
TYMFATKVV

SEQ ID NO: 426768 - protein, 9 aa, Homo Sapiens
FRSKLYEYL

SEQ ID NO: 426769 - protein, 9 aa, Homo Sapiens
TQSGIFQYD

SEQ ID NO: 426770 - protein, 9 aa, Homo Sapiens
IKALTRSRN

SEQ ID NO: 426771 - protein, 9 aa, Homo Sapiens
QLTLHKINH

SEQ ID NO: 426772 - protein, 9 aa, Homo Sapiens
EHYNVARGV

SEQ ID NO: 426773 - protein, 9 aa, Homo Sapiens
STCSPSTNT

SEQ ID NO: 426774 - protein, 9 aa, Homo Sapiens
PSRPPSSEL

SEQ ID NO: 426775 - protein, 9 aa, Homo Sapiens
NKESLESEA

SEQ ID NO: 426776 - protein, 9 aa, Homo Sapiens
HGFNTINHL

SEQ ID NO: 426777 - protein, 9 aa, Homo Sapiens
RDTYQVLAH

SEQ ID NO: 426778 - protein, 9 aa, Homo Sapiens
LFIKLHQLS

SEQ ID NO: 426779 - protein, 9 aa, Homo Sapiens
SEPKTPGEG

SEQ ID NO: 426780 - protein, 9 aa, Homo Sapiens
AMQQGPKKF

SEQ ID NO: 426781 - protein, 9 aa, Homo Sapiens
FLVGYEIKM

SEQ ID NO: 426782 - protein, 9 aa, Homo Sapiens
DLRDNFCWN

SEQ ID NO: 426783 - protein, 9 aa, Homo Sapiens
VLHTIVQGF

SEQ ID NO: 426784 - protein, 9 aa, Homo Sapiens
LPFFIIFTA

SEQ ID NO: 426785 - protein, 9 aa, Homo Sapiens
YIIQTREIK

SEQ ID NO: 426786 - protein, 9 aa, Homo Sapiens
NVRESLEDQ

SEQ ID NO: 426787 - protein, 9 aa, Homo Sapiens
TALKHSKRR

SEQ ID NO: 426788 - protein, 9 aa, Homo Sapiens
HNNWIKQYE

SEQ ID NO: 426789 - protein, 9 aa, Homo Sapiens
CLRSASQGA

SEQ ID NO: 426790 - protein, 9 aa, Homo Sapiens
LLFESMLYS

SEQ ID NO: 426791 - protein, 9 aa, Homo Sapiens
NPDRRCTKL

SEQ ID NO: 426792 - protein, 9 aa, Homo Sapiens
QENRRFVSQ

SEQ ID NO: 426793 - protein, 9 aa, Homo Sapiens
HWILSIGLK

SEQ ID NO: 426794 - protein, 9 aa, Homo Sapiens
PVEGFNHLV

SEQ ID NO: 426795 - protein, 9 aa, Homo Sapiens
AFLFSIETK

SEQ ID NO: 426796 - protein, 9 aa, Homo Sapiens
CMQLAAIIR

SEQ ID NO: 426797 - protein, 9 aa, Homo Sapiens
RFNTVIARI

SEQ ID NO: 426798 - protein, 9 aa, Homo Sapiens
IDKTIDKLK

SEQ ID NO: 426799 - protein, 9 aa, Homo Sapiens
EECVQGEVQ

SEQ ID NO: 426800 - protein, 9 aa, Homo Sapiens
LLSPLHQSG

SEQ ID NO: 426801 - protein, 9 aa, Homo Sapiens
SQSVHIAVK

SEQ ID NO: 426802 - protein, 9 aa, Homo Sapiens
GPFRLHNLF

SEQ ID NO: 426803 - protein, 9 aa, Homo Sapiens
PSLIPLIFL

SEQ ID NO: 426804 - protein, 9 aa, Homo Sapiens
MVVDEDLRS

SEQ ID NO: 426805 - protein, 9 aa, Homo Sapiens
EIIGEQRHL

SEQ ID NO: 426806 - protein, 9 aa, Homo Sapiens
QDMVTFKDV

SEQ ID NO: 426807 - protein, 9 aa, Homo Sapiens
SPGAAQTTS

SEQ ID NO: 426808 - protein, 9 aa, Homo Sapiens
PIVPIDIGP

SEQ ID NO: 426809 - protein, 9 aa, Homo Sapiens
PKIGATIQE

SEQ ID NO: 426810 - protein, 9 aa, Homo Sapiens
FHFKFFPFM

SEQ ID NO: 426811 - protein, 9 aa, Homo Sapiens
YNGPMLTVS

SEQ ID NO: 426812 - protein, 9 aa, Homo Sapiens
KIINVKQFF

SEQ ID NO: 426813 - protein, 9 aa, Homo Sapiens
SNHQHVTKP

SEQ ID NO: 426814 - protein, 9 aa, Homo Sapiens
IQHEIIHTG

SEQ ID NO: 426815 - protein, 9 aa, Homo Sapiens
QGKKPILDS

SEQ ID NO: 426816 - protein, 9 aa, Homo Sapiens
GPWTNHLLR

SEQ ID NO: 426817 - protein, 9 aa, Homo Sapiens
LPINSPTKR

SEQ ID NO: 426818 - protein, 9 aa, Homo Sapiens
LQGSDILDS

SEQ ID NO: 426819 - protein, 9 aa, Homo Sapiens
CHTEKFSPR

SEQ ID NO: 426820 - protein, 9 aa, Homo Sapiens
ISFQWSPSG

SEQ ID NO: 426821 - protein, 9 aa, Homo Sapiens
PSPSPDSKS

SEQ ID NO: 426822 - protein, 9 aa, Homo Sapiens
RIYYKVQNE

SEQ ID NO: 426823 - protein, 9 aa, Homo Sapiens
PFCPHQQIY

SEQ ID NO: 426824 - protein, 9 aa, Homo Sapiens
MLERLTAPW

SEQ ID NO: 426825 - protein, 9 aa, Homo Sapiens
DKVSQKQTV

SEQ ID NO: 426826 - protein, 9 aa, Homo Sapiens
PTTKSNYIN

SEQ ID NO: 426827 - protein, 9 aa, Homo Sapiens
VNCLGIYEQ

SEQ ID NO: 426828 - protein, 9 aa, Homo Sapiens
ILNIHSSEG

SEQ ID NO: 426829 - protein, 9 aa, Homo Sapiens
SGPQGICGD

SEQ ID NO: 426830 - protein, 9 aa, Homo Sapiens
QSRMARYTA

SEQ ID NO: 426831 - protein, 9 aa, Homo Sapiens
LRCCHRFLP

SEQ ID NO: 426832 - protein, 9 aa, Homo Sapiens
EEEASLKPK

SEQ ID NO: 426833 - protein, 9 aa, Homo Sapiens
RPPKGTYGK

SEQ ID NO: 426834 - protein, 9 aa, Homo Sapiens
EVKSQNGEL

SEQ ID NO: 426835 - protein, 9 aa, Homo Sapiens
KKKNPLLWM

SEQ ID NO: 426836 - protein, 9 aa, Homo Sapiens
EAQCQKPCK

SEQ ID NO: 426837 - protein, 9 aa, Homo Sapiens
GVLYMRSCR

SEQ ID NO: 426838 - protein, 9 aa, Homo Sapiens
SAAEDRIWE

SEQ ID NO: 426839 - protein, 9 aa, Homo Sapiens
RQENDKDNL

SEQ ID NO: 426840 - protein, 9 aa, Homo Sapiens
FEHCSIHLM

SEQ ID NO: 426841 - protein, 9 aa, Homo Sapiens
FNATICYHY

SEQ ID NO: 426842 - protein, 9 aa, Homo Sapiens
KCNTISVSK

SEQ ID NO: 426843 - protein, 9 aa, Homo Sapiens
RSLRRIAKY

SEQ ID NO: 426844 - protein, 9 aa, Homo Sapiens
MDFTDIIKL

SEQ ID NO: 426845 - protein, 9 aa, Homo Sapiens
GHKAIEANS

SEQ ID NO: 426846 - protein, 9 aa, Homo Sapiens
NNTFGPRAQ

SEQ ID NO: 426847 - protein, 9 aa, Homo Sapiens
SKFNDAAPA

SEQ ID NO: 426848 - protein, 9 aa, Homo Sapiens
KKLINSQQV

SEQ ID NO: 426849 - protein, 9 aa, Homo Sapiens
PLVKLLLLA

SEQ ID NO: 426850 - protein, 9 aa, Homo Sapiens
VVIPSILLI

SEQ ID NO: 426851 - protein, 9 aa, Homo Sapiens
IEQPSQLQV

SEQ ID NO: 426852 - protein, 9 aa, Homo Sapiens
QSKIFADRP

SEQ ID NO: 426853 - protein, 9 aa, Homo Sapiens
NPIALGSHW

SEQ ID NO: 426854 - protein, 9 aa, Homo Sapiens
MTSLQNSLL

SEQ ID NO: 426855 - protein, 9 aa, Homo Sapiens
SLRQEKWSS

SEQ ID NO: 426856 - protein, 9 aa, Homo Sapiens
SLKLEDDRF

SEQ ID NO: 426857 - protein, 9 aa, Homo Sapiens
EICDIPGTL

SEQ ID NO: 426858 - protein, 9 aa, Homo Sapiens
KVDSPNNFN

SEQ ID NO: 426859 - protein, 9 aa, Homo Sapiens
CLLCQDNNF

SEQ ID NO: 426860 - protein, 9 aa, Homo Sapiens
RVEILANNQ

SEQ ID NO: 426861 - protein, 9 aa, Homo Sapiens
LLLYVLRVI

SEQ ID NO: 426862 - protein, 9 aa, Homo Sapiens
CLFMVVGFW

SEQ ID NO: 426863 - protein, 9 aa, Homo Sapiens
RFMHMFQYS

SEQ ID NO: 426864 - protein, 9 aa, Homo Sapiens
FMTAINPML

SEQ ID NO: 426865 - protein, 9 aa, Homo Sapiens
LSMEQEKLG

SEQ ID NO: 426866 - protein, 9 aa, Homo Sapiens
LTTPTGSFE

SEQ ID NO: 426867 - protein, 9 aa, Homo Sapiens
WQETAITSC

SEQ ID NO: 426868 - protein, 9 aa, Homo Sapiens
SYLVKDLIF

SEQ ID NO: 426869 - protein, 9 aa, Homo Sapiens
ADLSHHPKC

SEQ ID NO: 426870 - protein, 9 aa, Homo Sapiens
CKQACQKAI

SEQ ID NO: 426871 - protein, 9 aa, Homo Sapiens
TLTVCCLYY

SEQ ID NO: 426872 - protein, 9 aa, Homo Sapiens
NKGTQTEGE

SEQ ID NO: 426873 - protein, 9 aa, Homo Sapiens
PRLGMCLGE

SEQ ID NO: 426874 - protein, 9 aa, Homo Sapiens
YDVQHLQTV

SEQ ID NO: 426875 - protein, 9 aa, Homo Sapiens
VKAFKLFQK

SEQ ID NO: 426876 - protein, 9 aa, Homo Sapiens
KAYDQDAHL

SEQ ID NO: 426877 - protein, 9 aa, Homo Sapiens
QEMGFEKLF

SEQ ID NO: 426878 - protein, 9 aa, Homo Sapiens
ICYQLRMSK

SEQ ID NO: 426879 - protein, 9 aa, Homo Sapiens
LHFALLMAL

SEQ ID NO: 426880 - protein, 9 aa, Homo Sapiens
TVCLKEKIS

SEQ ID NO: 426881 - protein, 9 aa, Homo Sapiens
LLSKAKEYL

SEQ ID NO: 426882 - protein, 9 aa, Homo Sapiens
SGENKPGRR

SEQ ID NO: 426883 - protein, 9 aa, Homo Sapiens
GYSARPWGW

SEQ ID NO: 426884 - protein, 9 aa, Homo Sapiens
LNQHLRQRR

SEQ ID NO: 426885 - protein, 9 aa, Homo Sapiens
VGYKITFVD

SEQ ID NO: 426886 - protein, 9 aa, Homo Sapiens
GKIQIWEIK

SEQ ID NO: 426887 - protein, 9 aa, Homo Sapiens
SPRIEEQKL

SEQ ID NO: 426888 - protein, 9 aa, Homo Sapiens
EALINGYGV

SEQ ID NO: 426889 - protein, 9 aa, Homo Sapiens
RQSPKRLLL

SEQ ID NO: 426890 - protein, 9 aa, Homo Sapiens
VQPSAFKPV

SEQ ID NO: 426891 - protein, 9 aa, Homo Sapiens
GEGNKESLE

SEQ ID NO: 426892 - protein, 9 aa, Homo Sapiens
VCTCVVHKW

SEQ ID NO: 426893 - protein, 9 aa, Homo Sapiens
LEYVVSRTS

SEQ ID NO: 426894 - protein, 9 aa, Homo Sapiens
GTNEDSLIE

SEQ ID NO: 426895 - protein, 9 aa, Homo Sapiens
KMIFKRLHL

SEQ ID NO: 426896 - protein, 9 aa, Homo Sapiens
FLVAKSNVE

SEQ ID NO: 426897 - protein, 9 aa, Homo Sapiens
IHDLMHFYF

SEQ ID NO: 426898 - protein, 9 aa, Homo Sapiens
MTCIWIHLD

SEQ ID NO: 426899 - protein, 9 aa, Homo Sapiens
KRLLEFCLV

SEQ ID NO: 426900 - protein, 9 aa, Homo Sapiens
RIAKYEELL

SEQ ID NO: 426901 - protein, 9 aa, Homo Sapiens
FRLITQDFW

SEQ ID NO: 426902 - protein, 9 aa, Homo Sapiens
KIQIFLLSL

SEQ ID NO: 426903 - protein, 9 aa, Homo Sapiens
GMLERNDLF

SEQ ID NO: 426904 - protein, 9 aa, Homo Sapiens
SYSAHEGLA

SEQ ID NO: 426905 - protein, 9 aa, Homo Sapiens
PRVRELSAL

SEQ ID NO: 426906 - protein, 9 aa, Homo Sapiens
STERNICNN

SEQ ID NO: 426907 - protein, 9 aa, Homo Sapiens
NIVTANFVE

SEQ ID NO: 426908 - protein, 9 aa, Homo Sapiens
RSHSDSGLS

SEQ ID NO: 426909 - protein, 9 aa, Homo Sapiens
KQALSKIET

SEQ ID NO: 426910 - protein, 9 aa, Homo Sapiens
DHSARQAEL

SEQ ID NO: 426911 - protein, 9 aa, Homo Sapiens
GNLSIILLI

SEQ ID NO: 426912 - protein, 9 aa, Homo Sapiens
KKIPECGQC

SEQ ID NO: 426913 - protein, 9 aa, Homo Sapiens
QELKQHVDS

SEQ ID NO: 426914 - protein, 9 aa, Homo Sapiens
LSYSPAGSK

SEQ ID NO: 426915 - protein, 9 aa, Homo Sapiens
KEICIEKLK

SEQ ID NO: 426916 - protein, 9 aa, Homo Sapiens
YKGDGSLKY

SEQ ID NO: 426917 - protein, 9 aa, Homo Sapiens
ELLRLESCI

SEQ ID NO: 426918 - protein, 9 aa, Homo Sapiens
RDQRLNLQR

SEQ ID NO: 426919 - protein, 9 aa, Homo Sapiens
RGSPMINRT

SEQ ID NO: 426920 - protein, 9 aa, Homo Sapiens
MAPSEAISL

SEQ ID NO: 426921 - protein, 9 aa, Homo Sapiens
MGIRAPGHM

SEQ ID NO: 426922 - protein, 9 aa, Homo Sapiens
ASRDKPEPE

SEQ ID NO: 426923 - protein, 9 aa, Homo Sapiens
RAINHFVCD

SEQ ID NO: 426924 - protein, 9 aa, Homo Sapiens
NGQNNTLSG

SEQ ID NO: 426925 - protein, 9 aa, Homo Sapiens
EQLHNKCLE

SEQ ID NO: 426926 - protein, 9 aa, Homo Sapiens
CKTCYHIVE

SEQ ID NO: 426927 - protein, 9 aa, Homo Sapiens
GITLLPQLL

SEQ ID NO: 426928 - protein, 9 aa, Homo Sapiens
RKVLYGEPA

SEQ ID NO: 426929 - protein, 9 aa, Homo Sapiens
TFDPEILFN

SEQ ID NO: 426930 - protein, 9 aa, Homo Sapiens
ITEELAVFM

SEQ ID NO: 426931 - protein, 9 aa, Homo Sapiens
EETTLQDWG

SEQ ID NO: 426932 - protein, 9 aa, Homo Sapiens
CGDFPNGSL

SEQ ID NO: 426933 - protein, 9 aa, Homo Sapiens
FNCTCGIVW

SEQ ID NO: 426934 - protein, 9 aa, Homo Sapiens
GYSSKKERD

SEQ ID NO: 426935 - protein, 9 aa, Homo Sapiens
KVEIQRSAI

SEQ ID NO: 426936 - protein, 9 aa, Homo Sapiens
EDYKKTKKP

SEQ ID NO: 426937 - protein, 9 aa, Homo Sapiens
RSKYEVVDA

SEQ ID NO: 426938 - protein, 9 aa, Homo Sapiens
TFFAYQRQQ

SEQ ID NO: 426939 - protein, 9 aa, Homo Sapiens
LALREQKYF

SEQ ID NO: 426940 - protein, 9 aa, Homo Sapiens
HVCFHVNCS

SEQ ID NO: 426941 - protein, 9 aa, Homo Sapiens
KTPHLQLIE

SEQ ID NO: 426942 - protein, 9 aa, Homo Sapiens
LETRRNLEG

SEQ ID NO: 426943 - protein, 9 aa, Homo Sapiens
AQHQIKEMK

SEQ ID NO: 426944 - protein, 9 aa, Homo Sapiens
LRTAMSNRE

SEQ ID NO: 426945 - protein, 9 aa, Homo Sapiens
LKPESALGA

SEQ ID NO: 426946 - protein, 9 aa, Homo Sapiens
GQCDMYSSV

SEQ ID NO: 426947 - protein, 9 aa, Homo Sapiens
KFEYNGLCG

SEQ ID NO: 426948 - protein, 9 aa, Homo Sapiens
SSFDAVFLN

SEQ ID NO: 426949 - protein, 9 aa, Homo Sapiens
APSDTFSTQ

SEQ ID NO: 426950 - protein, 9 aa, Homo Sapiens
KCKNCRVLG

SEQ ID NO: 426951 - protein, 9 aa, Homo Sapiens
VIHHKGHRP

SEQ ID NO: 426952 - protein, 9 aa, Homo Sapiens
MSDIRNPEG

SEQ ID NO: 426953 - protein, 9 aa, Homo Sapiens
FYITGGRAR

SEQ ID NO: 426954 - protein, 9 aa, Homo Sapiens
CIWSLQLNG

SEQ ID NO: 426955 - protein, 9 aa, Homo Sapiens
VDPWESEQV

SEQ ID NO: 426956 - protein, 9 aa, Homo Sapiens
LSRNSEMEK

SEQ ID NO: 426957 - protein, 9 aa, Homo Sapiens
KKDKSFGIQ

SEQ ID NO: 426958 - protein, 9 aa, Homo Sapiens
GGRARMDKD

SEQ ID NO: 426959 - protein, 9 aa, Homo Sapiens
NTLCFLLGN

SEQ ID NO: 426960 - protein, 9 aa, Homo Sapiens
IRINEDSTG

SEQ ID NO: 426961 - protein, 9 aa, Homo Sapiens
RERAKKLDY

SEQ ID NO: 426962 - protein, 9 aa, Homo Sapiens
MSDVGTCVV

SEQ ID NO: 426963 - protein, 9 aa, Homo Sapiens
INYSIEQPS

SEQ ID NO: 426964 - protein, 9 aa, Homo Sapiens
SQNGELMTH

SEQ ID NO: 426965 - protein, 9 aa, Homo Sapiens
PVRAIKEGN

SEQ ID NO: 426966 - protein, 9 aa, Homo Sapiens
ADSWMDEVI

SEQ ID NO: 426967 - protein, 9 aa, Homo Sapiens
EFVGWRKFL

SEQ ID NO: 426968 - protein, 9 aa, Homo Sapiens
KLHQLSTST

SEQ ID NO: 426969 - protein, 9 aa, Homo Sapiens
NKKDSRSSF

SEQ ID NO: 426970 - protein, 9 aa, Homo Sapiens
LTWSVPNCA

SEQ ID NO: 426971 - protein, 9 aa, Homo Sapiens
WGQRIAEGR

SEQ ID NO: 426972 - protein, 9 aa, Homo Sapiens
GMCRPIKPI

SEQ ID NO: 426973 - protein, 9 aa, Homo Sapiens
ANLNIVLAK

SEQ ID NO: 426974 - protein, 9 aa, Homo Sapiens
KWLLLLEEE

SEQ ID NO: 426975 - protein, 9 aa, Homo Sapiens
SCSDYMTLK

SEQ ID NO: 426976 - protein, 9 aa, Homo Sapiens
CNGQITGAS

SEQ ID NO: 426977 - protein, 9 aa, Homo Sapiens
DPKVAFGYL

SEQ ID NO: 426978 - protein, 9 aa, Homo Sapiens
FKSYYVRNT

SEQ ID NO: 426979 - protein, 9 aa, Homo Sapiens
LFRLITQDF

SEQ ID NO: 426980 - protein, 9 aa, Homo Sapiens
RFNTIFKQV

SEQ ID NO: 426981 - protein, 9 aa, Homo Sapiens
AENINKYLD

SEQ ID NO: 426982 - protein, 9 aa, Homo Sapiens
SNVDVFIPV

SEQ ID NO: 426983 - protein, 9 aa, Homo Sapiens
LSFENAIHK

SEQ ID NO: 426984 - protein, 9 aa, Homo Sapiens
NIYPTFQMF

SEQ ID NO: 426985 - protein, 9 aa, Homo Sapiens
IDFFVFWET

SEQ ID NO: 426986 - protein, 9 aa, Homo Sapiens
CLLRESIYY

SEQ ID NO: 426987 - protein, 9 aa, Homo Sapiens
KPQSHFTTP

SEQ ID NO: 426988 - protein, 9 aa, Homo Sapiens
SRCWMTQFS

SEQ ID NO: 426989 - protein, 9 aa, Homo Sapiens
HFCSHLGVI

SEQ ID NO: 426990 - protein, 9 aa, Homo Sapiens
TSVFKDVMG

SEQ ID NO: 426991 - protein, 9 aa, Homo Sapiens
NTRHCPNCQ

SEQ ID NO: 426992 - protein, 9 aa, Homo Sapiens
SNTLNLNSK

SEQ ID NO: 426993 - protein, 9 aa, Homo Sapiens
VYIRLKGQT

SEQ ID NO: 426994 - protein, 9 aa, Homo Sapiens
LYNEDWDSE

SEQ ID NO: 426995 - protein, 9 aa, Homo Sapiens
NESQEDEEG

SEQ ID NO: 426996 - protein, 9 aa, Homo Sapiens
LDLPDLNMQ

SEQ ID NO: 426997 - protein, 9 aa, Homo Sapiens
NLPAGTIKA

SEQ ID NO: 426998 - protein, 9 aa, Homo Sapiens
DLRSTFHNM

SEQ ID NO: 426999 - protein, 9 aa, Homo Sapiens
QDPSFGDTI

SEQ ID NO: 427000 - protein, 9 aa, Homo Sapiens
CVCWVGGFI

SEQ ID NO: 427001 - protein, 9 aa, Homo Sapiens
PEVPDQLYR

SEQ ID NO: 427002 - protein, 9 aa, Homo Sapiens
QEMQSKNEQ

SEQ ID NO: 427003 - protein, 9 aa, Homo Sapiens
LSEEGMVNA

SEQ ID NO: 427004 - protein, 9 aa, Homo Sapiens
PKRLLLRKD

SEQ ID NO: 427005 - protein, 9 aa, Homo Sapiens
ECEEINRFT

SEQ ID NO: 427006 - protein, 9 aa, Homo Sapiens
RCNWIIVLV

SEQ ID NO: 427007 - protein, 9 aa, Homo Sapiens
IILLKGFEL

SEQ ID NO: 427008 - protein, 9 aa, Homo Sapiens
QHDGPTNNL

SEQ ID NO: 427009 - protein, 9 aa, Homo Sapiens
FYGSLMGVH

SEQ ID NO: 427010 - protein, 9 aa, Homo Sapiens
RKNLKRPIT

SEQ ID NO: 427011 - protein, 9 aa, Homo Sapiens
DYGMYYREE

SEQ ID NO: 427012 - protein, 9 aa, Homo Sapiens
CYGPARLWY

SEQ ID NO: 427013 - protein, 9 aa, Homo Sapiens
VVTMQYYVQ

SEQ ID NO: 427014 - protein, 9 aa, Homo Sapiens
VSRTHKLTV

SEQ ID NO: 427015 - protein, 9 aa, Homo Sapiens
CEECGKSVS

SEQ ID NO: 427016 - protein, 9 aa, Homo Sapiens
IVPGACLGL

SEQ ID NO: 427017 - protein, 9 aa, Homo Sapiens
EKLEVIRKK

SEQ ID NO: 427018 - protein, 9 aa, Homo Sapiens
IGPVKEDSY

SEQ ID NO: 427019 - protein, 9 aa, Homo Sapiens
EYVAYDLKT

SEQ ID NO: 427020 - protein, 9 aa, Homo Sapiens
PLNFGSYAY

SEQ ID NO: 427021 - protein, 9 aa, Homo Sapiens
HFQIHTGIK

SEQ ID NO: 427022 - protein, 9 aa, Homo Sapiens
PFVFRISQA

SEQ ID NO: 427023 - protein, 9 aa, Homo Sapiens
VHDFLKRIN

SEQ ID NO: 427024 - protein, 9 aa, Homo Sapiens
KNLDILSQL

SEQ ID NO: 427025 - protein, 9 aa, Homo Sapiens
SIDVGDGAR

SEQ ID NO: 427026 - protein, 9 aa, Homo Sapiens
DPRRCYVCP

SEQ ID NO: 427027 - protein, 9 aa, Homo Sapiens
FLSILTRDR

SEQ ID NO: 427028 - protein, 9 aa, Homo Sapiens
KQENELSDT

SEQ ID NO: 427029 - protein, 9 aa, Homo Sapiens
PVGVLYMRS

SEQ ID NO: 427030 - protein, 9 aa, Homo Sapiens
TKPVVQIHH

SEQ ID NO: 427031 - protein, 9 aa, Homo Sapiens
EEQHAWNIT

SEQ ID NO: 427032 - protein, 9 aa, Homo Sapiens
KVNNLSICL

SEQ ID NO: 427033 - protein, 9 aa, Homo Sapiens
DEGPGAELA

SEQ ID NO: 427034 - protein, 9 aa, Homo Sapiens
LNMYNLVEP

SEQ ID NO: 427035 - protein, 9 aa, Homo Sapiens
TWFQNWRAK

SEQ ID NO: 427036 - protein, 9 aa, Homo Sapiens
PTVVHGVWY

SEQ ID NO: 427037 - protein, 9 aa, Homo Sapiens
RRAKDINQD

SEQ ID NO: 427038 - protein, 9 aa, Homo Sapiens
ANSSNRKKH

SEQ ID NO: 427039 - protein, 9 aa, Homo Sapiens
QPSPGMTRR

SEQ ID NO: 427040 - protein, 9 aa, Homo Sapiens
SDYDKERGN

SEQ ID NO: 427041 - protein, 9 aa, Homo Sapiens
QRFKAHPNQ

SEQ ID NO: 427042 - protein, 9 aa, Homo Sapiens
VTLRTYFSN

SEQ ID NO: 427043 - protein, 9 aa, Homo Sapiens
MDFWGRVNN

SEQ ID NO: 427044 - protein, 9 aa, Homo Sapiens
WALETDSTS

SEQ ID NO: 427045 - protein, 9 aa, Homo Sapiens
RTPISDLNA

SEQ ID NO: 427046 - protein, 9 aa, Homo Sapiens
ANIVFLVDG

SEQ ID NO: 427047 - protein, 9 aa, Homo Sapiens
LTEYANTFG

SEQ ID NO: 427048 - protein, 9 aa, Homo Sapiens
MSKNKTAVK

SEQ ID NO: 427049 - protein, 9 aa, Homo Sapiens
NAISSNNKT

SEQ ID NO: 427050 - protein, 9 aa, Homo Sapiens
GDPERHYKD

SEQ ID NO: 427051 - protein, 9 aa, Homo Sapiens
SSLSFMDIC

SEQ ID NO: 427052 - protein, 9 aa, Homo Sapiens
PQQIFFQSY

SEQ ID NO: 427053 - protein, 9 aa, Homo Sapiens
HLSDSRHVT

SEQ ID NO: 427054 - protein, 9 aa, Homo Sapiens
GEKKECWLW

SEQ ID NO: 427055 - protein, 9 aa, Homo Sapiens
EIPLQKQNY

SEQ ID NO: 427056 - protein, 9 aa, Homo Sapiens
GENKPGRRA

SEQ ID NO: 427057 - protein, 9 aa, Homo Sapiens
MLRLPVFSL

SEQ ID NO: 427058 - protein, 9 aa, Homo Sapiens
CTLGLQHIF

SEQ ID NO: 427059 - protein, 9 aa, Homo Sapiens
LPQLLQYQC

SEQ ID NO: 427060 - protein, 9 aa, Homo Sapiens
VEYFKNTTL

SEQ ID NO: 427061 - protein, 9 aa, Homo Sapiens
EQVQKLKAI

SEQ ID NO: 427062 - protein, 9 aa, Homo Sapiens
VEELVGKPD

SEQ ID NO: 427063 - protein, 9 aa, Homo Sapiens
QSDCLGEHL

SEQ ID NO: 427064 - protein, 9 aa, Homo Sapiens
TQIKVSPEF

SEQ ID NO: 427065 - protein, 9 aa, Homo Sapiens
SVQDQTTVQ

SEQ ID NO: 427066 - protein, 9 aa, Homo Sapiens
ALCLLRLQV

SEQ ID NO: 427067 - protein, 9 aa, Homo Sapiens
IEQMVRTDP

SEQ ID NO: 427068 - protein, 9 aa, Homo Sapiens
SVRSMKRSV

SEQ ID NO: 427069 - protein, 9 aa, Homo Sapiens
VCHAKNYTN

SEQ ID NO: 427070 - protein, 9 aa, Homo Sapiens
LQSPLPGKS

SEQ ID NO: 427071 - protein, 9 aa, Homo Sapiens
ICKDCGDDL

SEQ ID NO: 427072 - protein, 9 aa, Homo Sapiens
QEIYKFMAL

SEQ ID NO: 427073 - protein, 9 aa, Homo Sapiens
HPKCIPEFI

SEQ ID NO: 427074 - protein, 9 aa, Homo Sapiens
CVGEGLAHM

SEQ ID NO: 427075 - protein, 9 aa, Homo Sapiens
NIFGQYLPA

SEQ ID NO: 427076 - protein, 9 aa, Homo Sapiens
DMEEYILEG

SEQ ID NO: 427077 - protein, 9 aa, Homo Sapiens
SVDGGHNSV

SEQ ID NO: 427078 - protein, 9 aa, Homo Sapiens
DRLFAVRPE

SEQ ID NO: 427079 - protein, 9 aa, Homo Sapiens
QPSAEDLDT

SEQ ID NO: 427080 - protein, 9 aa, Homo Sapiens
DGNHKNSVL

SEQ ID NO: 427081 - protein, 9 aa, Homo Sapiens
EIYTKSYWK

SEQ ID NO: 427082 - protein, 9 aa, Homo Sapiens
LESMSPGLP

SEQ ID NO: 427083 - protein, 9 aa, Homo Sapiens
FKLAQYAFK

SEQ ID NO: 427084 - protein, 9 aa, Homo Sapiens
NFHPRRFLL

SEQ ID NO: 427085 - protein, 9 aa, Homo Sapiens
HSQHVSLSS

SEQ ID NO: 427086 - protein, 9 aa, Homo Sapiens
SCKGFFKQT

SEQ ID NO: 427087 - protein, 9 aa, Homo Sapiens
NLHILVHVT

SEQ ID NO: 427088 - protein, 9 aa, Homo Sapiens
GRIAIKQFA

SEQ ID NO: 427089 - protein, 9 aa, Homo Sapiens
TLSYFAFFI

SEQ ID NO: 427090 - protein, 9 aa, Homo Sapiens
RPPENPVLL

SEQ ID NO: 427091 - protein, 9 aa, Homo Sapiens
IMVYQTKSH

SEQ ID NO: 427092 - protein, 9 aa, Homo Sapiens
NDKEHNHME

SEQ ID NO: 427093 - protein, 9 aa, Homo Sapiens
RGAGSITGA

SEQ ID NO: 427094 - protein, 9 aa, Homo Sapiens
IIMIAIIAG

SEQ ID NO: 427095 - protein, 9 aa, Homo Sapiens
TGVAFPLFM

SEQ ID NO: 427096 - protein, 9 aa, Homo Sapiens
VTAQGDGYG

SEQ ID NO: 427097 - protein, 9 aa, Homo Sapiens
SPSFFNRFS

SEQ ID NO: 427098 - protein, 9 aa, Homo Sapiens
KDINQDVYN

SEQ ID NO: 427099 - protein, 9 aa, Homo Sapiens
RKLSSRSDV

SEQ ID NO: 427100 - protein, 9 aa, Homo Sapiens
DDNANLDAS

SEQ ID NO: 427101 - protein, 9 aa, Homo Sapiens
PVGMVFHPQ

SEQ ID NO: 427102 - protein, 9 aa, Homo Sapiens
TPKPDAFIK

SEQ ID NO: 427103 - protein, 9 aa, Homo Sapiens
SSFQKHERI

SEQ ID NO: 427104 - protein, 9 aa, Homo Sapiens
ISDLAVCRA

SEQ ID NO: 427105 - protein, 9 aa, Homo Sapiens
PFDWQNCLL

SEQ ID NO: 427106 - protein, 9 aa, Homo Sapiens
GTPGADGFT

SEQ ID NO: 427107 - protein, 9 aa, Homo Sapiens
ENTTGSNIV

SEQ ID NO: 427108 - protein, 9 aa, Homo Sapiens
GELSSEKGS

SEQ ID NO: 427109 - protein, 9 aa, Homo Sapiens
DINQDVYNF

SEQ ID NO: 427110 - protein, 9 aa, Homo Sapiens
YSVNVALSL

SEQ ID NO: 427111 - protein, 9 aa, Homo Sapiens
RKPQILEEG

SEQ ID NO: 427112 - protein, 9 aa, Homo Sapiens
GREGANDSY

SEQ ID NO: 427113 - protein, 9 aa, Homo Sapiens
PFIIILVFI

SEQ ID NO: 427114 - protein, 9 aa, Homo Sapiens
FIQLFITLF

SEQ ID NO: 427115 - protein, 9 aa, Homo Sapiens
LVTRITQLA

SEQ ID NO: 427116 - protein, 9 aa, Homo Sapiens
DNGTFNLPE

SEQ ID NO: 427117 - protein, 9 aa, Homo Sapiens
QQNCQAGFV

SEQ ID NO: 427118 - protein, 9 aa, Homo Sapiens
QFSSKKKKS

SEQ ID NO: 427119 - protein, 9 aa, Homo Sapiens
LCSSHSPLW

SEQ ID NO: 427120 - protein, 9 aa, Homo Sapiens
PGLLKSPKG

SEQ ID NO: 427121 - protein, 9 aa, Homo Sapiens
GCFQELQEN

SEQ ID NO: 427122 - protein, 9 aa, Homo Sapiens
ELDQYYEQD

SEQ ID NO: 427123 - protein, 9 aa, Homo Sapiens
GGNCFNCGT

SEQ ID NO: 427124 - protein, 9 aa, Homo Sapiens
VEVRDNWTP

SEQ ID NO: 427125 - protein, 9 aa, Homo Sapiens
PMIPGSHPK

SEQ ID NO: 427126 - protein, 9 aa, Homo Sapiens
QHKIEGSKA

SEQ ID NO: 427127 - protein, 9 aa, Homo Sapiens
NQQRVQKPE

SEQ ID NO: 427128 - protein, 9 aa, Homo Sapiens
LREMRHHFQ

SEQ ID NO: 427129 - protein, 9 aa, Homo Sapiens
IFKVKKPED

SEQ ID NO: 427130 - protein, 9 aa, Homo Sapiens
YETRNKMFL

SEQ ID NO: 427131 - protein, 9 aa, Homo Sapiens
GKKCRMESY

SEQ ID NO: 427132 - protein, 9 aa, Homo Sapiens
YYYCSLCGI

SEQ ID NO: 427133 - protein, 9 aa, Homo Sapiens
KSYYVRNTF

SEQ ID NO: 427134 - protein, 9 aa, Homo Sapiens
ALLKRFNEP

SEQ ID NO: 427135 - protein, 9 aa, Homo Sapiens
RALAERLVR

SEQ ID NO: 427136 - protein, 9 aa, Homo Sapiens
DTFHLSFCM

SEQ ID NO: 427137 - protein, 9 aa, Homo Sapiens
LNIPESTPL

SEQ ID NO: 427138 - protein, 9 aa, Homo Sapiens
LITNRSLKE

SEQ ID NO: 427139 - protein, 9 aa, Homo Sapiens
QNGELMTHK

SEQ ID NO: 427140 - protein, 9 aa, Homo Sapiens
FYGRYRISE

SEQ ID NO: 427141 - protein, 9 aa, Homo Sapiens
EGGVRGLYG

SEQ ID NO: 427142 - protein, 9 aa, Homo Sapiens
AMLGYACQV

SEQ ID NO: 427143 - protein, 9 aa, Homo Sapiens
AFYLLGKQR

SEQ ID NO: 427144 - protein, 9 aa, Homo Sapiens
VAKAEEWSC

SEQ ID NO: 427145 - protein, 9 aa, Homo Sapiens
KLDYLLTSS

SEQ ID NO: 427146 - protein, 9 aa, Homo Sapiens
AAGQNKQHY

SEQ ID NO: 427147 - protein, 9 aa, Homo Sapiens
KEQMEDMRN

SEQ ID NO: 427148 - protein, 9 aa, Homo Sapiens
GITGQPFVV

SEQ ID NO: 427149 - protein, 9 aa, Homo Sapiens
AVIADLSTL

SEQ ID NO: 427150 - protein, 9 aa, Homo Sapiens
IDCLKIFLN

SEQ ID NO: 427151 - protein, 9 aa, Homo Sapiens
QCANIQFRS

SEQ ID NO: 427152 - protein, 9 aa, Homo Sapiens
GLTVAAILL

SEQ ID NO: 427153 - protein, 9 aa, Homo Sapiens
VTYMCECPV

SEQ ID NO: 427154 - protein, 9 aa, Homo Sapiens
ITLGVEAFL

SEQ ID NO: 427155 - protein, 9 aa, Homo Sapiens
VFDKDVNER

SEQ ID NO: 427156 - protein, 9 aa, Homo Sapiens
IHIDTLLCN

SEQ ID NO: 427157 - protein, 9 aa, Homo Sapiens
LSHIRHMSS

SEQ ID NO: 427158 - protein, 9 aa, Homo Sapiens
DNEYTERYS

SEQ ID NO: 427159 - protein, 9 aa, Homo Sapiens
HLKRYSVNV

SEQ ID NO: 427160 - protein, 9 aa, Homo Sapiens
LCTLPTVLD

SEQ ID NO: 427161 - protein, 9 aa, Homo Sapiens
VNLPKVTQQ

SEQ ID NO: 427162 - protein, 9 aa, Homo Sapiens
TESSSSDEL

SEQ ID NO: 427163 - protein, 9 aa, Homo Sapiens
SKSLTYTGE

SEQ ID NO: 427164 - protein, 9 aa, Homo Sapiens
EVPESGLWV

SEQ ID NO: 427165 - protein, 9 aa, Homo Sapiens
GTEVSADVF

SEQ ID NO: 427166 - protein, 9 aa, Homo Sapiens
NFSFCSTRC

SEQ ID NO: 427167 - protein, 9 aa, Homo Sapiens
YYLGTTKDA

SEQ ID NO: 427168 - protein, 9 aa, Homo Sapiens
LPDICHANC

SEQ ID NO: 427169 - protein, 9 aa, Homo Sapiens
TKSANKLRS

SEQ ID NO: 427170 - protein, 9 aa, Homo Sapiens
SFLSRYRGL

SEQ ID NO: 427171 - protein, 9 aa, Homo Sapiens
KPQVIEVLP

SEQ ID NO: 427172 - protein, 9 aa, Homo Sapiens
MNWLSVSLP

SEQ ID NO: 427173 - protein, 9 aa, Homo Sapiens
SDNVACMTF

SEQ ID NO: 427174 - protein, 9 aa, Homo Sapiens
LKSTFEDVW

SEQ ID NO: 427175 - protein, 9 aa, Homo Sapiens
IKIYDVQER

SEQ ID NO: 427176 - protein, 9 aa, Homo Sapiens
LLAGLYMFW

SEQ ID NO: 427177 - protein, 9 aa, Homo Sapiens
ENARSCIQA

SEQ ID NO: 427178 - protein, 9 aa, Homo Sapiens
KLEWNREYT

SEQ ID NO: 427179 - protein, 9 aa, Homo Sapiens
HKCWQNGRV

SEQ ID NO: 427180 - protein, 9 aa, Homo Sapiens
LHQVNKAML

SEQ ID NO: 427181 - protein, 9 aa, Homo Sapiens
LKDKIEDEL

SEQ ID NO: 427182 - protein, 9 aa, Homo Sapiens
PIKIYREYE

SEQ ID NO: 427183 - protein, 9 aa, Homo Sapiens
AAAYNNFQK

SEQ ID NO: 427184 - protein, 9 aa, Homo Sapiens
KRKRRHPLS

SEQ ID NO: 427185 - protein, 9 aa, Homo Sapiens
SDLVVLSGT

SEQ ID NO: 427186 - protein, 9 aa, Homo Sapiens
RKWHLGFYR

SEQ ID NO: 427187 - protein, 9 aa, Homo Sapiens
KDLCGGGVG

SEQ ID NO: 427188 - protein, 9 aa, Homo Sapiens
LQLFFYAGW

SEQ ID NO: 427189 - protein, 9 aa, Homo Sapiens
GTTKDAATK

SEQ ID NO: 427190 - protein, 9 aa, Homo Sapiens
LNLSLMNST

SEQ ID NO: 427191 - protein, 9 aa, Homo Sapiens
KTSWSRVYL

SEQ ID NO: 427192 - protein, 9 aa, Homo Sapiens
EKGDYFSGK

SEQ ID NO: 427193 - protein, 9 aa, Homo Sapiens
VQNERKLEL

SEQ ID NO: 427194 - protein, 9 aa, Homo Sapiens
SLQEGCCHP

SEQ ID NO: 427195 - protein, 9 aa, Homo Sapiens
VRTPKPDAF

SEQ ID NO: 427196 - protein, 9 aa, Homo Sapiens
HTALMLNKR

SEQ ID NO: 427197 - protein, 9 aa, Homo Sapiens
VLPETPPTP

SEQ ID NO: 427198 - protein, 9 aa, Homo Sapiens
EKQEKHQDV

SEQ ID NO: 427199 - protein, 9 aa, Homo Sapiens
IYIRIHEII

SEQ ID NO: 427200 - protein, 9 aa, Homo Sapiens
GGVSPFGKQ

SEQ ID NO: 427201 - protein, 9 aa, Homo Sapiens
DKYNCIGLS

SEQ ID NO: 427202 - protein, 9 aa, Homo Sapiens
FLGQLSEKN

SEQ ID NO: 427203 - protein, 9 aa, Homo Sapiens
LKELTEILR

SEQ ID NO: 427204 - protein, 9 aa, Homo Sapiens
PREVCEKLH

SEQ ID NO: 427205 - protein, 9 aa, Homo Sapiens
AAAYVQCLA

SEQ ID NO: 427206 - protein, 9 aa, Homo Sapiens
RRGGLHYMG

SEQ ID NO: 427207 - protein, 9 aa, Homo Sapiens
GKCCKECKL

SEQ ID NO: 427208 - protein, 9 aa, Homo Sapiens
YGTSVVQIR

SEQ ID NO: 427209 - protein, 9 aa, Homo Sapiens
SFNHSSVLR

SEQ ID NO: 427210 - protein, 9 aa, Homo Sapiens
LQEYNLELN

SEQ ID NO: 427211 - protein, 9 aa, Homo Sapiens
FDHEKAQKT

SEQ ID NO: 427212 - protein, 9 aa, Homo Sapiens
AEAGKFTRR

SEQ ID NO: 427213 - protein, 9 aa, Homo Sapiens
TRYGGWNGI

SEQ ID NO: 427214 - protein, 9 aa, Homo Sapiens
DKANIDLEQ

SEQ ID NO: 427215 - protein, 9 aa, Homo Sapiens
LTSRNREAK

SEQ ID NO: 427216 - protein, 9 aa, Homo Sapiens
QHPLFWEIN

SEQ ID NO: 427217 - protein, 9 aa, Homo Sapiens
KSKRGRPPS

SEQ ID NO: 427218 - protein, 9 aa, Homo Sapiens
SHKPKGTEN

SEQ ID NO: 427219 - protein, 9 aa, Homo Sapiens
FHLLKTCLS

SEQ ID NO: 427220 - protein, 9 aa, Homo Sapiens
QCWSIPADG

SEQ ID NO: 427221 - protein, 9 aa, Homo Sapiens
MGRYQCTVE

SEQ ID NO: 427222 - protein, 9 aa, Homo Sapiens
STGDLMKNN

SEQ ID NO: 427223 - protein, 9 aa, Homo Sapiens
FFFILNFWV

SEQ ID NO: 427224 - protein, 9 aa, Homo Sapiens
HLFFFKLIE

SEQ ID NO: 427225 - protein, 9 aa, Homo Sapiens
ALIDEKSTH

SEQ ID NO: 427226 - protein, 9 aa, Homo Sapiens
DRNVPTPRI

SEQ ID NO: 427227 - protein, 9 aa, Homo Sapiens
TQIRQSRLC

SEQ ID NO: 427228 - protein, 9 aa, Homo Sapiens
DHYKWHKFV

SEQ ID NO: 427229 - protein, 9 aa, Homo Sapiens
SPAISPLTF

SEQ ID NO: 427230 - protein, 9 aa, Homo Sapiens
SQDKQIEER

SEQ ID NO: 427231 - protein, 9 aa, Homo Sapiens
LLDRNVPTP

SEQ ID NO: 427232 - protein, 9 aa, Homo Sapiens
LEAAKQVHS

SEQ ID NO: 427233 - protein, 9 aa, Homo Sapiens
LQNNVPAVR

SEQ ID NO: 427234 - protein, 9 aa, Homo Sapiens
SVSDRNSGV

SEQ ID NO: 427235 - protein, 9 aa, Homo Sapiens
ENKKYIMLE

SEQ ID NO: 427236 - protein, 9 aa, Homo Sapiens
KIETRHSEI

SEQ ID NO: 427237 - protein, 9 aa, Homo Sapiens
IKFGFEISF

SEQ ID NO: 427238 - protein, 9 aa, Homo Sapiens
IFVCNYGPE

SEQ ID NO: 427239 - protein, 9 aa, Homo Sapiens
KYLEIIYSM

SEQ ID NO: 427240 - protein, 9 aa, Homo Sapiens
KVWAHGGAN

SEQ ID NO: 427241 - protein, 9 aa, Homo Sapiens
EQLDIHDLL

SEQ ID NO: 427242 - protein, 9 aa, Homo Sapiens
ITALLHNNI

SEQ ID NO: 427243 - protein, 9 aa, Homo Sapiens
NLTVHIRQK

SEQ ID NO: 427244 - protein, 9 aa, Homo Sapiens
HKHIYYSDK

SEQ ID NO: 427245 - protein, 9 aa, Homo Sapiens
SSRWQETAI

SEQ ID NO: 427246 - protein, 9 aa, Homo Sapiens
ACNVCLAPI

SEQ ID NO: 427247 - protein, 9 aa, Homo Sapiens
SRLVSEWNL

SEQ ID NO: 427248 - protein, 9 aa, Homo Sapiens
DVPQEWQKE

SEQ ID NO: 427249 - protein, 9 aa, Homo Sapiens
MHISQVRME

SEQ ID NO: 427250 - protein, 9 aa, Homo Sapiens
SRTPISDLN

SEQ ID NO: 427251 - protein, 9 aa, Homo Sapiens
NLQEGELLL

SEQ ID NO: 427252 - protein, 9 aa, Homo Sapiens
IYEIDFLRT

SEQ ID NO: 427253 - protein, 9 aa, Homo Sapiens
YSNIFGFLG

SEQ ID NO: 427254 - protein, 9 aa, Homo Sapiens
LVDNLTNKN

SEQ ID NO: 427255 - protein, 9 aa, Homo Sapiens
APYDVRTIL

SEQ ID NO: 427256 - protein, 9 aa, Homo Sapiens
VFTCVILEM

SEQ ID NO: 427257 - protein, 9 aa, Homo Sapiens
HKIILTGEK

SEQ ID NO: 427258 - protein, 9 aa, Homo Sapiens
LTYTGEKKE

SEQ ID NO: 427259 - protein, 9 aa, Homo Sapiens
NKFPQAENQ

SEQ ID NO: 427260 - protein, 9 aa, Homo Sapiens
LIIMIAIIA

SEQ ID NO: 427261 - protein, 9 aa, Homo Sapiens
PKDKETHRD

SEQ ID NO: 427262 - protein, 9 aa, Homo Sapiens
WYRYLKARQ

SEQ ID NO: 427263 - protein, 9 aa, Homo Sapiens
FIDGSFDIG

SEQ ID NO: 427264 - protein, 9 aa, Homo Sapiens
FKHKVNIKL

SEQ ID NO: 427265 - protein, 9 aa, Homo Sapiens
IINMNIKLF

SEQ ID NO: 427266 - protein, 9 aa, Homo Sapiens
RFISRHRLQ

SEQ ID NO: 427267 - protein, 9 aa, Homo Sapiens
TKIIINYSI

SEQ ID NO: 427268 - protein, 9 aa, Homo Sapiens
SLLSPLHQS

SEQ ID NO: 427269 - protein, 9 aa, Homo Sapiens
ALISVSDRN

SEQ ID NO: 427270 - protein, 9 aa, Homo Sapiens
KFKMESGEE

SEQ ID NO: 427271 - protein, 9 aa, Homo Sapiens
CEKCLNEIQ

SEQ ID NO: 427272 - protein, 9 aa, Homo Sapiens
KFTPPKSEQ

SEQ ID NO: 427273 - protein, 9 aa, Homo Sapiens
AQRCGRKDH

SEQ ID NO: 427274 - protein, 9 aa, Homo Sapiens
SRSCLRRFW

SEQ ID NO: 427275 - protein, 9 aa, Homo Sapiens
RNCEGMIQM

SEQ ID NO: 427276 - protein, 9 aa, Homo Sapiens
SSVSEDVLS

SEQ ID NO: 427277 - protein, 9 aa, Homo Sapiens
HFWTAKYLT

SEQ ID NO: 427278 - protein, 9 aa, Homo Sapiens
LELGVGLSQ

SEQ ID NO: 427279 - protein, 9 aa, Homo Sapiens
CVQKFIKID

SEQ ID NO: 427280 - protein, 9 aa, Homo Sapiens
VKYLPEGWS

SEQ ID NO: 427281 - protein, 9 aa, Homo Sapiens
VLRNFQHRR

SEQ ID NO: 427282 - protein, 9 aa, Homo Sapiens
PQKEPQEPE

SEQ ID NO: 427283 - protein, 9 aa, Homo Sapiens
MFDQDGIGL

SEQ ID NO: 427284 - protein, 9 aa, Homo Sapiens
FPPNKLFGN

SEQ ID NO: 427285 - protein, 9 aa, Homo Sapiens
LTQHQIFHT

SEQ ID NO: 427286 - protein, 9 aa, Homo Sapiens
SITSETSGS

SEQ ID NO: 427287 - protein, 9 aa, Homo Sapiens
AVSGLLVLT

SEQ ID NO: 427288 - protein, 9 aa, Homo Sapiens
SGHTVGEDT

SEQ ID NO: 427289 - protein, 9 aa, Homo Sapiens
TEQTGGRLG

SEQ ID NO: 427290 - protein, 9 aa, Homo Sapiens
PFGVFLVLL

SEQ ID NO: 427291 - protein, 9 aa, Homo Sapiens
ERKIINVKQ

SEQ ID NO: 427292 - protein, 9 aa, Homo Sapiens
WFPITLPVG

SEQ ID NO: 427293 - protein, 9 aa, Homo Sapiens
NNQAELYVF

SEQ ID NO: 427294 - protein, 9 aa, Homo Sapiens
ISRLSEIWI

SEQ ID NO: 427295 - protein, 9 aa, Homo Sapiens
REETDTMEN

SEQ ID NO: 427296 - protein, 9 aa, Homo Sapiens
FECFFLWES

SEQ ID NO: 427297 - protein, 9 aa, Homo Sapiens
RESSPPYSV

SEQ ID NO: 427298 - protein, 9 aa, Homo Sapiens
PYGYGSGWS

SEQ ID NO: 427299 - protein, 9 aa, Homo Sapiens
DGCKVHKKG

SEQ ID NO: 427300 - protein, 9 aa, Homo Sapiens
GDLMKNNYL

SEQ ID NO: 427301 - protein, 9 aa, Homo Sapiens
HPFTPIHSC

SEQ ID NO: 427302 - protein, 9 aa, Homo Sapiens
FSGLASAAV

SEQ ID NO: 427303 - protein, 9 aa, Homo Sapiens
EQLNLMQKE

SEQ ID NO: 427304 - protein, 9 aa, Homo Sapiens
APQGRLIKD

SEQ ID NO: 427305 - protein, 9 aa, Homo Sapiens
HDLMHFYFL

SEQ ID NO: 427306 - protein, 9 aa, Homo Sapiens
FLRGAGSIT

SEQ ID NO: 427307 - protein, 9 aa, Homo Sapiens
KYGTQICPA

SEQ ID NO: 427308 - protein, 9 aa, Homo Sapiens
KEKPGFLTT

SEQ ID NO: 427309 - protein, 9 aa, Homo Sapiens
PGSTDAFKK

SEQ ID NO: 427310 - protein, 9 aa, Homo Sapiens
DNELSGGVG

SEQ ID NO: 427311 - protein, 9 aa, Homo Sapiens
RDPFKRLIS

SEQ ID NO: 427312 - protein, 9 aa, Homo Sapiens
MSCAVACDK

SEQ ID NO: 427313 - protein, 9 aa, Homo Sapiens
YGRYRISEL

SEQ ID NO: 427314 - protein, 9 aa, Homo Sapiens
GHRWVTDLN

SEQ ID NO: 427315 - protein, 9 aa, Homo Sapiens
TYDTGGKDP

SEQ ID NO: 427316 - protein, 9 aa, Homo Sapiens
SCFCVLLAI

SEQ ID NO: 427317 - protein, 9 aa, Homo Sapiens
NNVVQPVLE

SEQ ID NO: 427318 - protein, 9 aa, Homo Sapiens
ELPKGEKKN

SEQ ID NO: 427319 - protein, 9 aa, Homo Sapiens
NKKYIMLEI

SEQ ID NO: 427320 - protein, 9 aa, Homo Sapiens
DDGLCVFES

SEQ ID NO: 427321 - protein, 9 aa, Homo Sapiens
FDEIFSTTR

SEQ ID NO: 427322 - protein, 9 aa, Homo Sapiens
KARIQYFVR

SEQ ID NO: 427323 - protein, 9 aa, Homo Sapiens
DAPGHRNFI

SEQ ID NO: 427324 - protein, 9 aa, Homo Sapiens
ITRQLRSQV

SEQ ID NO: 427325 - protein, 9 aa, Homo Sapiens
QEWEADREM

SEQ ID NO: 427326 - protein, 9 aa, Homo Sapiens
QVRDSVVFN

SEQ ID NO: 427327 - protein, 9 aa, Homo Sapiens
FISRYQIQV

SEQ ID NO: 427328 - protein, 9 aa, Homo Sapiens
LRQKCKDYV

SEQ ID NO: 427329 - protein, 9 aa, Homo Sapiens
LENYHDHGL

SEQ ID NO: 427330 - protein, 9 aa, Homo Sapiens
YLLNSQYYF

SEQ ID NO: 427331 - protein, 9 aa, Homo Sapiens
LIDSHIYGK

SEQ ID NO: 427332 - protein, 9 aa, Homo Sapiens
RSLLSPLHQ

SEQ ID NO: 427333 - protein, 9 aa, Homo Sapiens
HNNTSHLPN

SEQ ID NO: 427334 - protein, 9 aa, Homo Sapiens
GLFDQFIGT

SEQ ID NO: 427335 - protein, 9 aa, Homo Sapiens
YFLDPPPYE

SEQ ID NO: 427336 - protein, 9 aa, Homo Sapiens
QNELLKRKL

SEQ ID NO: 427337 - protein, 9 aa, Homo Sapiens
VKTLVKIKI

SEQ ID NO: 427338 - protein, 9 aa, Homo Sapiens
SLLIQCQFS

SEQ ID NO: 427339 - protein, 9 aa, Homo Sapiens
EGGGDVSPQ

SEQ ID NO: 427340 - protein, 9 aa, Homo Sapiens
KQGIINKEG

SEQ ID NO: 427341 - protein, 9 aa, Homo Sapiens
NNLGNNTKL

SEQ ID NO: 427342 - protein, 9 aa, Homo Sapiens
LCSKRHRGK

SEQ ID NO: 427343 - protein, 9 aa, Homo Sapiens
SLEIVLFTE

SEQ ID NO: 427344 - protein, 9 aa, Homo Sapiens
SINNRNDLQ

SEQ ID NO: 427345 - protein, 9 aa, Homo Sapiens
QTKRIQKQF

SEQ ID NO: 427346 - protein, 9 aa, Homo Sapiens
GAASKVIGR

SEQ ID NO: 427347 - protein, 9 aa, Homo Sapiens
TFRGEPVEG

SEQ ID NO: 427348 - protein, 9 aa, Homo Sapiens
EHLIKIYDV

SEQ ID NO: 427349 - protein, 9 aa, Homo Sapiens
WFFLFFIFL

SEQ ID NO: 427350 - protein, 9 aa, Homo Sapiens
KCKTFFSDV

SEQ ID NO: 427351 - protein, 9 aa, Homo Sapiens
LKEKWSAPY

SEQ ID NO: 427352 - protein, 9 aa, Homo Sapiens
KNKLSNNVF

SEQ ID NO: 427353 - protein, 9 aa, Homo Sapiens
NLELWVNYY

SEQ ID NO: 427354 - protein, 9 aa, Homo Sapiens
ISLKKPLNY

SEQ ID NO: 427355 - protein, 9 aa, Homo Sapiens
RITSQINLI

SEQ ID NO: 427356 - protein, 9 aa, Homo Sapiens
KGKVIYTYM

SEQ ID NO: 427357 - protein, 9 aa, Homo Sapiens
KRNGLLNEV

SEQ ID NO: 427358 - protein, 9 aa, Homo Sapiens
KPDKKDDNE

SEQ ID NO: 427359 - protein, 9 aa, Homo Sapiens
DKGHIIVDK

SEQ ID NO: 427360 - protein, 9 aa, Homo Sapiens
TRNENNRPR

SEQ ID NO: 427361 - protein, 9 aa, Homo Sapiens
PILDSVTSS

SEQ ID NO: 427362 - protein, 9 aa, Homo Sapiens
HLRGCPCSD

SEQ ID NO: 427363 - protein, 9 aa, Homo Sapiens
ASFATPNMI

SEQ ID NO: 427364 - protein, 9 aa, Homo Sapiens
AQQRNCEGM

SEQ ID NO: 427365 - protein, 9 aa, Homo Sapiens
HLFGHTFSP

SEQ ID NO: 427366 - protein, 9 aa, Homo Sapiens
IIFAVFIVC

SEQ ID NO: 427367 - protein, 9 aa, Homo Sapiens
NFPTIPVAS

SEQ ID NO: 427368 - protein, 9 aa, Homo Sapiens
PSKGGNLPS

SEQ ID NO: 427369 - protein, 9 aa, Homo Sapiens
ITCFNVLKW

SEQ ID NO: 427370 - protein, 9 aa, Homo Sapiens
NRYRYIITY

SEQ ID NO: 427371 - protein, 9 aa, Homo Sapiens
VRQPWNIPV

SEQ ID NO: 427372 - protein, 9 aa, Homo Sapiens
VFQYILRTD

SEQ ID NO: 427373 - protein, 9 aa, Homo Sapiens
YRGCHHEVV

SEQ ID NO: 427374 - protein, 9 aa, Homo Sapiens
RKARNRILS

SEQ ID NO: 427375 - protein, 9 aa, Homo Sapiens
EVKCMPTLQ

SEQ ID NO: 427376 - protein, 9 aa, Homo Sapiens
QAHVEFADI

SEQ ID NO: 427377 - protein, 9 aa, Homo Sapiens
IEVITHQIT

SEQ ID NO: 427378 - protein, 9 aa, Homo Sapiens
ILESKCKSR

SEQ ID NO: 427379 - protein, 9 aa, Homo Sapiens
GKAFNHRSH

SEQ ID NO: 427380 - protein, 9 aa, Homo Sapiens
KGLNNPPGP

SEQ ID NO: 427381 - protein, 9 aa, Homo Sapiens
TFPLALHTQ

SEQ ID NO: 427382 - protein, 9 aa, Homo Sapiens
SVVLSKINF

SEQ ID NO: 427383 - protein, 9 aa, Homo Sapiens
SVLSTLTKH

SEQ ID NO: 427384 - protein, 9 aa, Homo Sapiens
YKAIMCNRR

SEQ ID NO: 427385 - protein, 9 aa, Homo Sapiens
YLVDNLTNK

SEQ ID NO: 427386 - protein, 9 aa, Homo Sapiens
TMSSTVTFN

SEQ ID NO: 427387 - protein, 9 aa, Homo Sapiens
HNHVQGLVL

SEQ ID NO: 427388 - protein, 9 aa, Homo Sapiens
QPLNISNNV

SEQ ID NO: 427389 - protein, 9 aa, Homo Sapiens
SYGTYSPVD

SEQ ID NO: 427390 - protein, 9 aa, Homo Sapiens
VHVVATLLS

SEQ ID NO: 427391 - protein, 9 aa, Homo Sapiens
SPTKTPHLQ

SEQ ID NO: 427392 - protein, 9 aa, Homo Sapiens
TTGEVVPGV

SEQ ID NO: 427393 - protein, 9 aa, Homo Sapiens
FEGFFDLIT

SEQ ID NO: 427394 - protein, 9 aa, Homo Sapiens
PLEVTEDNF

SEQ ID NO: 427395 - protein, 9 aa, Homo Sapiens
RQRAQPNHY

SEQ ID NO: 427396 - protein, 9 aa, Homo Sapiens
FHKGAKKPR

SEQ ID NO: 427397 - protein, 9 aa, Homo Sapiens
FGVFICKLF

SEQ ID NO: 427398 - protein, 9 aa, Homo Sapiens
ITDISLLFC

SEQ ID NO: 427399 - protein, 9 aa, Homo Sapiens
SFINNETKL

SEQ ID NO: 427400 - protein, 9 aa, Homo Sapiens
LCPFTRESL

SEQ ID NO: 427401 - protein, 9 aa, Homo Sapiens
RHHDQNSVA

SEQ ID NO: 427402 - protein, 9 aa, Homo Sapiens
AFSELYLSL

SEQ ID NO: 427403 - protein, 9 aa, Homo Sapiens
CFKFSRLLD

SEQ ID NO: 427404 - protein, 9 aa, Homo Sapiens
LTDDFEREK

SEQ ID NO: 427405 - protein, 9 aa, Homo Sapiens
MFQTLPPSS

SEQ ID NO: 427406 - protein, 9 aa, Homo Sapiens
SAADIKQDN

SEQ ID NO: 427407 - protein, 9 aa, Homo Sapiens
AFACYILVG

SEQ ID NO: 427408 - protein, 9 aa, Homo Sapiens
KTTKMPCKS

SEQ ID NO: 427409 - protein, 9 aa, Homo Sapiens
ESKKMSVAG

SEQ ID NO: 427410 - protein, 9 aa, Homo Sapiens
YFSGKKFCI

SEQ ID NO: 427411 - protein, 9 aa, Homo Sapiens
LQEMQSKNE

SEQ ID NO: 427412 - protein, 9 aa, Homo Sapiens
PCSWKRIQS

SEQ ID NO: 427413 - protein, 9 aa, Homo Sapiens
ESYNVNEYS

SEQ ID NO: 427414 - protein, 9 aa, Homo Sapiens
QTSYFFPHI

SEQ ID NO: 427415 - protein, 9 aa, Homo Sapiens
EVNLPKVTQ

SEQ ID NO: 427416 - protein, 9 aa, Homo Sapiens
LVHGNNKAM

SEQ ID NO: 427417 - protein, 9 aa, Homo Sapiens
EECLEKCFS

SEQ ID NO: 427418 - protein, 9 aa, Homo Sapiens
IFHLLKTCL

SEQ ID NO: 427419 - protein, 9 aa, Homo Sapiens
TSNNGTGAE

SEQ ID NO: 427420 - protein, 9 aa, Homo Sapiens
GPKKFIECV

SEQ ID NO: 427421 - protein, 9 aa, Homo Sapiens
DEFIESCQE

SEQ ID NO: 427422 - protein, 9 aa, Homo Sapiens
NLDLILELI

SEQ ID NO: 427423 - protein, 9 aa, Homo Sapiens
QSDQYVKIK

SEQ ID NO: 427424 - protein, 9 aa, Homo Sapiens
DHLLHLNTK

SEQ ID NO: 427425 - protein, 9 aa, Homo Sapiens
IQKIPEQHQ

SEQ ID NO: 427426 - protein, 9 aa, Homo Sapiens
FLSSLSFMD

SEQ ID NO: 427427 - protein, 9 aa, Homo Sapiens
IHTAEKSYT

SEQ ID NO: 427428 - protein, 9 aa, Homo Sapiens
YLDNWTALI

SEQ ID NO: 427429 - protein, 9 aa, Homo Sapiens
TANEGVMYR

SEQ ID NO: 427430 - protein, 9 aa, Homo Sapiens
YDTLFQALD

SEQ ID NO: 427431 - protein, 9 aa, Homo Sapiens
SFTSGVLDD

SEQ ID NO: 427432 - protein, 9 aa, Homo Sapiens
TEACTDNPN

SEQ ID NO: 427433 - protein, 9 aa, Homo Sapiens
EIELQKKIQ

SEQ ID NO: 427434 - protein, 9 aa, Homo Sapiens
IADFELPII

SEQ ID NO: 427435 - protein, 9 aa, Homo Sapiens
EFILVGYVD

SEQ ID NO: 427436 - protein, 9 aa, Homo Sapiens
SGMLERNDL

SEQ ID NO: 427437 - protein, 9 aa, Homo Sapiens
EIKDLNIHV

SEQ ID NO: 427438 - protein, 9 aa, Homo Sapiens
RMSGTVHSS

SEQ ID NO: 427439 - protein, 9 aa, Homo Sapiens
SRDPSSPLE

SEQ ID NO: 427440 - protein, 9 aa, Homo Sapiens
YPCDPLIVE

SEQ ID NO: 427441 - protein, 9 aa, Homo Sapiens
DGIGLVSLC

SEQ ID NO: 427442 - protein, 9 aa, Homo Sapiens
VDGNFILRD

SEQ ID NO: 427443 - protein, 9 aa, Homo Sapiens
NLCSGSHIT

SEQ ID NO: 427444 - protein, 9 aa, Homo Sapiens
RRMHQQQQV

SEQ ID NO: 427445 - protein, 9 aa, Homo Sapiens
LEENSSEKN

SEQ ID NO: 427446 - protein, 9 aa, Homo Sapiens
EVKQKVSPY

SEQ ID NO: 427447 - protein, 9 aa, Homo Sapiens
LSILVNCYT

SEQ ID NO: 427448 - protein, 9 aa, Homo Sapiens
SKVGVWGDY

SEQ ID NO: 427449 - protein, 9 aa, Homo Sapiens
FQDMVTFKD

SEQ ID NO: 427450 - protein, 9 aa, Homo Sapiens
NIGIIIRKW

SEQ ID NO: 427451 - protein, 9 aa, Homo Sapiens
NPLIQRNEI

SEQ ID NO: 427452 - protein, 9 aa, Homo Sapiens
ITILKLIGV

SEQ ID NO: 427453 - protein, 9 aa, Homo Sapiens
RVIAVHIDN

SEQ ID NO: 427454 - protein, 9 aa, Homo Sapiens
YVHLYAQMY

SEQ ID NO: 427455 - protein, 9 aa, Homo Sapiens
FSRLDKLGL

SEQ ID NO: 427456 - protein, 9 aa, Homo Sapiens
YLPEGWSLP

SEQ ID NO: 427457 - protein, 9 aa, Homo Sapiens
QNEVEKIVV

SEQ ID NO: 427458 - protein, 9 aa, Homo Sapiens
CIIFMDEIY

SEQ ID NO: 427459 - protein, 9 aa, Homo Sapiens
MYSDFALKN

SEQ ID NO: 427460 - protein, 9 aa, Homo Sapiens
AEERHRPDS

SEQ ID NO: 427461 - protein, 9 aa, Homo Sapiens
YTIAQCCPK

SEQ ID NO: 427462 - protein, 9 aa, Homo Sapiens
VFTLGGTRA

SEQ ID NO: 427463 - protein, 9 aa, Homo Sapiens
EVHIGLFDK

SEQ ID NO: 427464 - protein, 9 aa, Homo Sapiens
CSGSHITFH

SEQ ID NO: 427465 - protein, 9 aa, Homo Sapiens
HTCKDLLDR

SEQ ID NO: 427466 - protein, 9 aa, Homo Sapiens
IDAPDLFGD

SEQ ID NO: 427467 - protein, 9 aa, Homo Sapiens
LLLLTNGGR

SEQ ID NO: 427468 - protein, 9 aa, Homo Sapiens
EAFEIVVCH

SEQ ID NO: 427469 - protein, 9 aa, Homo Sapiens
LNEKPFYVE

SEQ ID NO: 427470 - protein, 9 aa, Homo Sapiens
AVCLERVVL

SEQ ID NO: 427471 - protein, 9 aa, Homo Sapiens
IFVLILVVV

SEQ ID NO: 427472 - protein, 9 aa, Homo Sapiens
EADSILSLC

SEQ ID NO: 427473 - protein, 9 aa, Homo Sapiens
LDIFWVGAR

SEQ ID NO: 427474 - protein, 9 aa, Homo Sapiens
VELAPHSAE

SEQ ID NO: 427475 - protein, 9 aa, Homo Sapiens
SKNEQMMEQ

SEQ ID NO: 427476 - protein, 9 aa, Homo Sapiens
TAINPMLNP

SEQ ID NO: 427477 - protein, 9 aa, Homo Sapiens
MVKSDGGTY

SEQ ID NO: 427478 - protein, 9 aa, Homo Sapiens
SGNREITVI

SEQ ID NO: 427479 - protein, 9 aa, Homo Sapiens
AISCQARQT

SEQ ID NO: 427480 - protein, 9 aa, Homo Sapiens
IPITMENFN

SEQ ID NO: 427481 - protein, 9 aa, Homo Sapiens
RDYYELVGV

SEQ ID NO: 427482 - protein, 9 aa, Homo Sapiens
AEHVLLALR

SEQ ID NO: 427483 - protein, 9 aa, Homo Sapiens
GHYQEVTSV

SEQ ID NO: 427484 - protein, 9 aa, Homo Sapiens
MTKIICKWK

SEQ ID NO: 427485 - protein, 9 aa, Homo Sapiens
CSIHLMYLL

SEQ ID NO: 427486 - protein, 9 aa, Homo Sapiens
DTNLFGVLA

SEQ ID NO: 427487 - protein, 9 aa, Homo Sapiens
PPQIPQRDQ

SEQ ID NO: 427488 - protein, 9 aa, Homo Sapiens
EKYQGSQIS

SEQ ID NO: 427489 - protein, 9 aa, Homo Sapiens
KNATKPTFQ

SEQ ID NO: 427490 - protein, 9 aa, Homo Sapiens
IQHQIMHTG

SEQ ID NO: 427491 - protein, 9 aa, Homo Sapiens
IIILNNYEI

SEQ ID NO: 427492 - protein, 9 aa, Homo Sapiens
IRQKHSHQY

SEQ ID NO: 427493 - protein, 9 aa, Homo Sapiens
KGHLIVIGF

SEQ ID NO: 427494 - protein, 9 aa, Homo Sapiens
EYFMKQIND

SEQ ID NO: 427495 - protein, 9 aa, Homo Sapiens
STSEFLKHG

SEQ ID NO: 427496 - protein, 9 aa, Homo Sapiens
TQLFSAHLF

SEQ ID NO: 427497 - protein, 9 aa, Homo Sapiens
VCCSSSKND

SEQ ID NO: 427498 - protein, 9 aa, Homo Sapiens
NVYHKFSDN

SEQ ID NO: 427499 - protein, 9 aa, Homo Sapiens
SGNTSQRGK

SEQ ID NO: 427500 - protein, 9 aa, Homo Sapiens
SETCYTLAI

SEQ ID NO: 427501 - protein, 9 aa, Homo Sapiens
SLNFYTNVK

SEQ ID NO: 427502 - protein, 9 aa, Homo Sapiens
RSSSVKRKI

SEQ ID NO: 427503 - protein, 9 aa, Homo Sapiens
HSWEGHIIP

SEQ ID NO: 427504 - protein, 9 aa, Homo Sapiens
GGYGGYENG

SEQ ID NO: 427505 - protein, 9 aa, Homo Sapiens
HQSGSVEDN

SEQ ID NO: 427506 - protein, 9 aa, Homo Sapiens
NVGVVVFEN

SEQ ID NO: 427507 - protein, 9 aa, Homo Sapiens
LSHHPKCIP

SEQ ID NO: 427508 - protein, 9 aa, Homo Sapiens
QGCHLCFQL

SEQ ID NO: 427509 - protein, 9 aa, Homo Sapiens
GEHVPRFSV

SEQ ID NO: 427510 - protein, 9 aa, Homo Sapiens
ARSRWQCSL

SEQ ID NO: 427511 - protein, 9 aa, Homo Sapiens
TNHKITSIP

SEQ ID NO: 427512 - protein, 9 aa, Homo Sapiens
HFTSLWPTM

SEQ ID NO: 427513 - protein, 9 aa, Homo Sapiens
MNVLIRDIV

SEQ ID NO: 427514 - protein, 9 aa, Homo Sapiens
HYRMECPEV

SEQ ID NO: 427515 - protein, 9 aa, Homo Sapiens
TINLSRMPI

SEQ ID NO: 427516 - protein, 9 aa, Homo Sapiens
VSQMNKIRP

SEQ ID NO: 427517 - protein, 9 aa, Homo Sapiens
PRFSVMYAD

SEQ ID NO: 427518 - protein, 9 aa, Homo Sapiens
KGNWRGQVS

SEQ ID NO: 427519 - protein, 9 aa, Homo Sapiens
IMRTLFSLF

SEQ ID NO: 427520 - protein, 9 aa, Homo Sapiens
STVFQIVPK

SEQ ID NO: 427521 - protein, 9 aa, Homo Sapiens
EPETISEYI

SEQ ID NO: 427522 - protein, 9 aa, Homo Sapiens
DYLLTSSET

SEQ ID NO: 427523 - protein, 9 aa, Homo Sapiens
SLENVLDLN

SEQ ID NO: 427524 - protein, 9 aa, Homo Sapiens
VLAVHGTGN

SEQ ID NO: 427525 - protein, 9 aa, Homo Sapiens
LLCSHCRHR

SEQ ID NO: 427526 - protein, 9 aa, Homo Sapiens
SLQAYSHGG

SEQ ID NO: 427527 - protein, 9 aa, Homo Sapiens
KTYKCKECR

SEQ ID NO: 427528 - protein, 9 aa, Homo Sapiens
QGFFHSACG

SEQ ID NO: 427529 - protein, 9 aa, Homo Sapiens
EEIKTINDI

SEQ ID NO: 427530 - protein, 9 aa, Homo Sapiens
LVLEENSSE

SEQ ID NO: 427531 - protein, 9 aa, Homo Sapiens
KGKPKNTEP

SEQ ID NO: 427532 - protein, 9 aa, Homo Sapiens
SSLCIHQIV

SEQ ID NO: 427533 - protein, 9 aa, Homo Sapiens
SLNHLVDEA

SEQ ID NO: 427534 - protein, 9 aa, Homo Sapiens
EKSDFPPTH

SEQ ID NO: 427535 - protein, 9 aa, Homo Sapiens
KYKRIDGGI

SEQ ID NO: 427536 - protein, 9 aa, Homo Sapiens
VLEENSSEK

SEQ ID NO: 427537 - protein, 9 aa, Homo Sapiens
LCGHQLNHF

SEQ ID NO: 427538 - protein, 9 aa, Homo Sapiens
LLGSQAYSN

SEQ ID NO: 427539 - protein, 9 aa, Homo Sapiens
FLPFIIILV

SEQ ID NO: 427540 - protein, 9 aa, Homo Sapiens
TAAENEVVT

SEQ ID NO: 427541 - protein, 9 aa, Homo Sapiens
YNRYRYIIT

SEQ ID NO: 427542 - protein, 9 aa, Homo Sapiens
LCRQNLTRD

SEQ ID NO: 427543 - protein, 9 aa, Homo Sapiens
EIYRFGYAH

SEQ ID NO: 427544 - protein, 9 aa, Homo Sapiens
TFQIEPTIT

SEQ ID NO: 427545 - protein, 9 aa, Homo Sapiens
IYPTFQMFA

SEQ ID NO: 427546 - protein, 9 aa, Homo Sapiens
TVIESSVPC

SEQ ID NO: 427547 - protein, 9 aa, Homo Sapiens
CHTFNATIC

SEQ ID NO: 427548 - protein, 9 aa, Homo Sapiens
FQVVFTLGG

SEQ ID NO: 427549 - protein, 9 aa, Homo Sapiens
LVGYEIKMF

SEQ ID NO: 427550 - protein, 9 aa, Homo Sapiens
KFSSENSNP

SEQ ID NO: 427551 - protein, 9 aa, Homo Sapiens
GIRAPGHMS

SEQ ID NO: 427552 - protein, 9 aa, Homo Sapiens
IRNPVSVSR

SEQ ID NO: 427553 - protein, 9 aa, Homo Sapiens
THNQTACGF

SEQ ID NO: 427554 - protein, 9 aa, Homo Sapiens
LLDLSSASE

SEQ ID NO: 427555 - protein, 9 aa, Homo Sapiens
RLKESDQIL

SEQ ID NO: 427556 - protein, 9 aa, Homo Sapiens
RCCLSVLIN

SEQ ID NO: 427557 - protein, 9 aa, Homo Sapiens
YKNKMQRAN

SEQ ID NO: 427558 - protein, 9 aa, Homo Sapiens
FLFSIETKT

SEQ ID NO: 427559 - protein, 9 aa, Homo Sapiens
PQVVWLPEP

SEQ ID NO: 427560 - protein, 9 aa, Homo Sapiens
FQAELSLHC

SEQ ID NO: 427561 - protein, 9 aa, Homo Sapiens
LAEFLSSDP

SEQ ID NO: 427562 - protein, 9 aa, Homo Sapiens
YGLSEKELK

SEQ ID NO: 427563 - protein, 9 aa, Homo Sapiens
NDATYKLEE

SEQ ID NO: 427564 - protein, 9 aa, Homo Sapiens
RVLGKDCNK

SEQ ID NO: 427565 - protein, 9 aa, Homo Sapiens
PGQTVYLNM

SEQ ID NO: 427566 - protein, 9 aa, Homo Sapiens
CFNVLKWTM

SEQ ID NO: 427567 - protein, 9 aa, Homo Sapiens
KLDRLFKII

SEQ ID NO: 427568 - protein, 9 aa, Homo Sapiens
TQSCLMSIV

SEQ ID NO: 427569 - protein, 9 aa, Homo Sapiens
NGGRQTQRE

SEQ ID NO: 427570 - protein, 9 aa, Homo Sapiens
CKEYILNDT

SEQ ID NO: 427571 - protein, 9 aa, Homo Sapiens
PPIHHSLEI

SEQ ID NO: 427572 - protein, 9 aa, Homo Sapiens
INVITMQTL

SEQ ID NO: 427573 - protein, 9 aa, Homo Sapiens
STMEKYVRE

SEQ ID NO: 427574 - protein, 9 aa, Homo Sapiens
GDVANAVVV

SEQ ID NO: 427575 - protein, 9 aa, Homo Sapiens
GNHFWTAKY

SEQ ID NO: 427576 - protein, 9 aa, Homo Sapiens
EKMQKYTSA

SEQ ID NO: 427577 - protein, 9 aa, Homo Sapiens
CVRGTFCIH

SEQ ID NO: 427578 - protein, 9 aa, Homo Sapiens
YISKAQEQT

SEQ ID NO: 427579 - protein, 9 aa, Homo Sapiens
GRMASHKIE

SEQ ID NO: 427580 - protein, 9 aa, Homo Sapiens
QGDLYSLLS

SEQ ID NO: 427581 - protein, 9 aa, Homo Sapiens
RSLPDICHA

SEQ ID NO: 427582 - protein, 9 aa, Homo Sapiens
ETQISQTIL

SEQ ID NO: 427583 - protein, 9 aa, Homo Sapiens
AGNMMKEAH

SEQ ID NO: 427584 - protein, 9 aa, Homo Sapiens
GHQTLFIGV

SEQ ID NO: 427585 - protein, 9 aa, Homo Sapiens
SYLMVMYVS

SEQ ID NO: 427586 - protein, 9 aa, Homo Sapiens
KIAFHQRET

SEQ ID NO: 427587 - protein, 9 aa, Homo Sapiens
WKKLWRESW

SEQ ID NO: 427588 - protein, 9 aa, Homo Sapiens
KVGEDSEDE

SEQ ID NO: 427589 - protein, 9 aa, Homo Sapiens
HLDRKAQND

SEQ ID NO: 427590 - protein, 9 aa, Homo Sapiens
PLHKLCDVI

SEQ ID NO: 427591 - protein, 9 aa, Homo Sapiens
EVVNVNDNA

SEQ ID NO: 427592 - protein, 9 aa, Homo Sapiens
LQMEVINLQ

SEQ ID NO: 427593 - protein, 9 aa, Homo Sapiens
AAESPGWPP

SEQ ID NO: 427594 - protein, 9 aa, Homo Sapiens
CAKHGLSYK

SEQ ID NO: 427595 - protein, 9 aa, Homo Sapiens
MCTNKYKEK

SEQ ID NO: 427596 - protein, 9 aa, Homo Sapiens
QNNMAPTKN

SEQ ID NO: 427597 - protein, 9 aa, Homo Sapiens
ILFDDERRN

SEQ ID NO: 427598 - protein, 9 aa, Homo Sapiens
HYITKNTAK

SEQ ID NO: 427599 - protein, 9 aa, Homo Sapiens
RPIIWGLAC

SEQ ID NO: 427600 - protein, 9 aa, Homo Sapiens
PKVTQQDAV

SEQ ID NO: 427601 - protein, 9 aa, Homo Sapiens
TAASRDKPE

SEQ ID NO: 427602 - protein, 9 aa, Homo Sapiens
GELQHTRKR

SEQ ID NO: 427603 - protein, 9 aa, Homo Sapiens
WMKWLLQQM

SEQ ID NO: 427604 - protein, 9 aa, Homo Sapiens
VNYIESNSL

SEQ ID NO: 427605 - protein, 9 aa, Homo Sapiens
IPSIPEIRN

SEQ ID NO: 427606 - protein, 9 aa, Homo Sapiens
TATSLDRKQ

SEQ ID NO: 427607 - protein, 9 aa, Homo Sapiens
VAAMIISIV

SEQ ID NO: 427608 - protein, 9 aa, Homo Sapiens
FFQVTLFTV

SEQ ID NO: 427609 - protein, 9 aa, Homo Sapiens
VKIKIMSFV

SEQ ID NO: 427610 - protein, 9 aa, Homo Sapiens
DKNEKEEYQ

SEQ ID NO: 427611 - protein, 9 aa, Homo Sapiens
FQAGFINTT

SEQ ID NO: 427612 - protein, 9 aa, Homo Sapiens
NATWDGKDL

SEQ ID NO: 427613 - protein, 9 aa, Homo Sapiens
IADETELAL

SEQ ID NO: 427614 - protein, 9 aa, Homo Sapiens
YSLPLVEIW

SEQ ID NO: 427615 - protein, 9 aa, Homo Sapiens
VSHVGAVAL

SEQ ID NO: 427616 - protein, 9 aa, Homo Sapiens
LSLIDFFVF

SEQ ID NO: 427617 - protein, 9 aa, Homo Sapiens
GGIFHFFFF

SEQ ID NO: 427618 - protein, 9 aa, Homo Sapiens
YRIYCEDKH

SEQ ID NO: 427619 - protein, 9 aa, Homo Sapiens
TCWGIDYHS

SEQ ID NO: 427620 - protein, 9 aa, Homo Sapiens
PSKLDSEVA

SEQ ID NO: 427621 - protein, 9 aa, Homo Sapiens
KIKNTHDGL

SEQ ID NO: 427622 - protein, 9 aa, Homo Sapiens
DYLGILFPF

SEQ ID NO: 427623 - protein, 9 aa, Homo Sapiens
GNLYLALYS

SEQ ID NO: 427624 - protein, 9 aa, Homo Sapiens
STADIFNRI

SEQ ID NO: 427625 - protein, 9 aa, Homo Sapiens
SLNPRISVP

SEQ ID NO: 427626 - protein, 9 aa, Homo Sapiens
EEVKNAMKK

SEQ ID NO: 427627 - protein, 9 aa, Homo Sapiens
TLEMLKSTM

SEQ ID NO: 427628 - protein, 9 aa, Homo Sapiens
LDVSTKNPA

SEQ ID NO: 427629 - protein, 9 aa, Homo Sapiens
KFDGSENIP

SEQ ID NO: 427630 - protein, 9 aa, Homo Sapiens
QHYKLASNE

SEQ ID NO: 427631 - protein, 9 aa, Homo Sapiens
MRPKTCGLM

SEQ ID NO: 427632 - protein, 9 aa, Homo Sapiens
CFAALQASG

SEQ ID NO: 427633 - protein, 9 aa, Homo Sapiens
RECLFHQEK

SEQ ID NO: 427634 - protein, 9 aa, Homo Sapiens
NMENKTTWL

SEQ ID NO: 427635 - protein, 9 aa, Homo Sapiens
VVSDLYQSG

SEQ ID NO: 427636 - protein, 9 aa, Homo Sapiens
QRAYRSHEL

SEQ ID NO: 427637 - protein, 9 aa, Homo Sapiens
HIKEDNFFT

SEQ ID NO: 427638 - protein, 9 aa, Homo Sapiens
TPDFIILGL

SEQ ID NO: 427639 - protein, 9 aa, Homo Sapiens
PSYNNALSH

SEQ ID NO: 427640 - protein, 9 aa, Homo Sapiens
CHGISDTFY

SEQ ID NO: 427641 - protein, 9 aa, Homo Sapiens
PQGMIFLSD

SEQ ID NO: 427642 - protein, 9 aa, Homo Sapiens
IASKKIKYL

SEQ ID NO: 427643 - protein, 9 aa, Homo Sapiens
EYVAIDFTQ

SEQ ID NO: 427644 - protein, 9 aa, Homo Sapiens
GITKKEDST

SEQ ID NO: 427645 - protein, 9 aa, Homo Sapiens
EIESITDTF

SEQ ID NO: 427646 - protein, 9 aa, Homo Sapiens
PQYIFKVKK

SEQ ID NO: 427647 - protein, 9 aa, Homo Sapiens
KKCISANQL

SEQ ID NO: 427648 - protein, 9 aa, Homo Sapiens
RPPSSELLD

SEQ ID NO: 427649 - protein, 9 aa, Homo Sapiens
TCELGKFVK

SEQ ID NO: 427650 - protein, 9 aa, Homo Sapiens
GMKLRHLGL

SEQ ID NO: 427651 - protein, 9 aa, Homo Sapiens
NKEPLLNIP

SEQ ID NO: 427652 - protein, 9 aa, Homo Sapiens
ANNINKSLS

SEQ ID NO: 427653 - protein, 9 aa, Homo Sapiens
YRQRSQTAL

SEQ ID NO: 427654 - protein, 9 aa, Homo Sapiens
DISTANNLL

SEQ ID NO: 427655 - protein, 9 aa, Homo Sapiens
NFILRDSES

SEQ ID NO: 427656 - protein, 9 aa, Homo Sapiens
SCQVLSSLH

SEQ ID NO: 427657 - protein, 9 aa, Homo Sapiens
IVPNIQHFW

SEQ ID NO: 427658 - protein, 9 aa, Homo Sapiens
SFALNTRAD

SEQ ID NO: 427659 - protein, 9 aa, Homo Sapiens
YAFVHQIPP

SEQ ID NO: 427660 - protein, 9 aa, Homo Sapiens
HQRINSGEK

SEQ ID NO: 427661 - protein, 9 aa, Homo Sapiens
SLPAVGKKS

SEQ ID NO: 427662 - protein, 9 aa, Homo Sapiens
TGLDRNTLI

SEQ ID NO: 427663 - protein, 9 aa, Homo Sapiens
CTVHLWDVA

SEQ ID NO: 427664 - protein, 9 aa, Homo Sapiens
DGRKMSKNK

SEQ ID NO: 427665 - protein, 9 aa, Homo Sapiens
GDELYVHQL

SEQ ID NO: 427666 - protein, 9 aa, Homo Sapiens
NQNNMAPTK

SEQ ID NO: 427667 - protein, 9 aa, Homo Sapiens
KVCYHLTVD

SEQ ID NO: 427668 - protein, 9 aa, Homo Sapiens
ASLSNHHRV

SEQ ID NO: 427669 - protein, 9 aa, Homo Sapiens
MKQKHKFVD

SEQ ID NO: 427670 - protein, 9 aa, Homo Sapiens
QCSLMSYKS

SEQ ID NO: 427671 - protein, 9 aa, Homo Sapiens
IAAYYCALW

SEQ ID NO: 427672 - protein, 9 aa, Homo Sapiens
CSVLKKPSV

SEQ ID NO: 427673 - protein, 9 aa, Homo Sapiens
THHLQIHNV

SEQ ID NO: 427674 - protein, 9 aa, Homo Sapiens
SLLRKFEFW

SEQ ID NO: 427675 - protein, 9 aa, Homo Sapiens
ASQRGELAR

SEQ ID NO: 427676 - protein, 9 aa, Homo Sapiens
ELQKSDKLD

SEQ ID NO: 427677 - protein, 9 aa, Homo Sapiens
DVSANHSSP

SEQ ID NO: 427678 - protein, 9 aa, Homo Sapiens
HVICKDCGD

SEQ ID NO: 427679 - protein, 9 aa, Homo Sapiens
SKELINLQP

SEQ ID NO: 427680 - protein, 9 aa, Homo Sapiens
GTQTEGETE

SEQ ID NO: 427681 - protein, 9 aa, Homo Sapiens
KIIHSGQKP

SEQ ID NO: 427682 - protein, 9 aa, Homo Sapiens
HNFYWELRQ

SEQ ID NO: 427683 - protein, 9 aa, Homo Sapiens
KFIKKHPDV

SEQ ID NO: 427684 - protein, 9 aa, Homo Sapiens
RLARLWNFT

SEQ ID NO: 427685 - protein, 9 aa, Homo Sapiens
VGQFFGGQL

SEQ ID NO: 427686 - protein, 9 aa, Homo Sapiens
GDLLQRLLP

SEQ ID NO: 427687 - protein, 9 aa, Homo Sapiens
ASKLANTAK

SEQ ID NO: 427688 - protein, 9 aa, Homo Sapiens
TVIYTKKTE

SEQ ID NO: 427689 - protein, 9 aa, Homo Sapiens
QDDRISCLL

SEQ ID NO: 427690 - protein, 9 aa, Homo Sapiens
DGNSLIEEQ

SEQ ID NO: 427691 - protein, 9 aa, Homo Sapiens
VNYTKPGNV

SEQ ID NO: 427692 - protein, 9 aa, Homo Sapiens
IVVIPSILL

SEQ ID NO: 427693 - protein, 9 aa, Homo Sapiens
KYCLRSASQ

SEQ ID NO: 427694 - protein, 9 aa, Homo Sapiens
NSVTAAIQA

SEQ ID NO: 427695 - protein, 9 aa, Homo Sapiens
EFQLFDHHL

SEQ ID NO: 427696 - protein, 9 aa, Homo Sapiens
QTHFESCAD

SEQ ID NO: 427697 - protein, 9 aa, Homo Sapiens
GTTASSDTS

SEQ ID NO: 427698 - protein, 9 aa, Homo Sapiens
PSFNQTPIP

SEQ ID NO: 427699 - protein, 9 aa, Homo Sapiens
VEPERRLLS

SEQ ID NO: 427700 - protein, 9 aa, Homo Sapiens
FLHSNTLTH

SEQ ID NO: 427701 - protein, 9 aa, Homo Sapiens
PERRLLSPE

SEQ ID NO: 427702 - protein, 9 aa, Homo Sapiens
CGPPVSCIK

SEQ ID NO: 427703 - protein, 9 aa, Homo Sapiens
IFKFLGTVA

SEQ ID NO: 427704 - protein, 9 aa, Homo Sapiens
TGNGLSYSP

SEQ ID NO: 427705 - protein, 9 aa, Homo Sapiens
KSPSASPSM

SEQ ID NO: 427706 - protein, 9 aa, Homo Sapiens
LRCCLSVLI

SEQ ID NO: 427707 - protein, 9 aa, Homo Sapiens
GRSCTPTYS

SEQ ID NO: 427708 - protein, 9 aa, Homo Sapiens
KCFSTGPAR

SEQ ID NO: 427709 - protein, 9 aa, Homo Sapiens
YAKKTDSGS

SEQ ID NO: 427710 - protein, 9 aa, Homo Sapiens
EPVNDKREQ

SEQ ID NO: 427711 - protein, 9 aa, Homo Sapiens
AVGFCDMNG

SEQ ID NO: 427712 - protein, 9 aa, Homo Sapiens
LLAMRFKPD

SEQ ID NO: 427713 - protein, 9 aa, Homo Sapiens
RTSDQIRSQ

SEQ ID NO: 427714 - protein, 9 aa, Homo Sapiens
HEGVACVHK

SEQ ID NO: 427715 - protein, 9 aa, Homo Sapiens
QRSAISYIE

SEQ ID NO: 427716 - protein, 9 aa, Homo Sapiens
NTFGPRAQG

SEQ ID NO: 427717 - protein, 9 aa, Homo Sapiens
GGVKYIIKV

SEQ ID NO: 427718 - protein, 9 aa, Homo Sapiens
IWELEEAMA

SEQ ID NO: 427719 - protein, 9 aa, Homo Sapiens
DVSKAAFTA

SEQ ID NO: 427720 - protein, 9 aa, Homo Sapiens
NTHFRSKDH

SEQ ID NO: 427721 - protein, 9 aa, Homo Sapiens
ARDSFRHIT

SEQ ID NO: 427722 - protein, 9 aa, Homo Sapiens
HGETVQTLY

SEQ ID NO: 427723 - protein, 9 aa, Homo Sapiens
FSTTRYIKA

SEQ ID NO: 427724 - protein, 9 aa, Homo Sapiens
SSQVAQGMV

SEQ ID NO: 427725 - protein, 9 aa, Homo Sapiens
FLKKLLMPI

SEQ ID NO: 427726 - protein, 9 aa, Homo Sapiens
WSEQRDYIN

SEQ ID NO: 427727 - protein, 9 aa, Homo Sapiens
VDSVNTART

SEQ ID NO: 427728 - protein, 9 aa, Homo Sapiens
YFVKLRIIA

SEQ ID NO: 427729 - protein, 9 aa, Homo Sapiens
LWPSEEFLA

SEQ ID NO: 427730 - protein, 9 aa, Homo Sapiens
IRRHWNVLQ

SEQ ID NO: 427731 - protein, 9 aa, Homo Sapiens
WAQQKENES

SEQ ID NO: 427732 - protein, 9 aa, Homo Sapiens
NLQCNAVLK

SEQ ID NO: 427733 - protein, 9 aa, Homo Sapiens
IDKVRFLDQ

SEQ ID NO: 427734 - protein, 9 aa, Homo Sapiens
DAFHLDRHL

SEQ ID NO: 427735 - protein, 9 aa, Homo Sapiens
GEQNVPPPK

SEQ ID NO: 427736 - protein, 9 aa, Homo Sapiens
CKDLCGGGV

SEQ ID NO: 427737 - protein, 9 aa, Homo Sapiens
CMHITFRNS

SEQ ID NO: 427738 - protein, 9 aa, Homo Sapiens
EFQNCEFKA

SEQ ID NO: 427739 - protein, 9 aa, Homo Sapiens
LTFVYLYNV

SEQ ID NO: 427740 - protein, 9 aa, Homo Sapiens
HTSAPAACK

SEQ ID NO: 427741 - protein, 9 aa, Homo Sapiens
KKIHYYSIK

SEQ ID NO: 427742 - protein, 9 aa, Homo Sapiens
AKENKLLED

SEQ ID NO: 427743 - protein, 9 aa, Homo Sapiens
TTCYARCQS

SEQ ID NO: 427744 - protein, 9 aa, Homo Sapiens
IQIISKGGL

SEQ ID NO: 427745 - protein, 9 aa, Homo Sapiens
DKCVNFCTE

SEQ ID NO: 427746 - protein, 9 aa, Homo Sapiens
RYSTDIVPA

SEQ ID NO: 427747 - protein, 9 aa, Homo Sapiens
PLEKLNIRG

SEQ ID NO: 427748 - protein, 9 aa, Homo Sapiens
IYTKKTEKS

SEQ ID NO: 427749 - protein, 9 aa, Homo Sapiens
GNGLPSWKL

SEQ ID NO: 427750 - protein, 9 aa, Homo Sapiens
SKIVEFIQS

SEQ ID NO: 427751 - protein, 9 aa, Homo Sapiens
NYGYCSYKT

SEQ ID NO: 427752 - protein, 9 aa, Homo Sapiens
SQEQEKINS

SEQ ID NO: 427753 - protein, 9 aa, Homo Sapiens
NQDWGYFDT

SEQ ID NO: 427754 - protein, 9 aa, Homo Sapiens
MLGHQEPHS

SEQ ID NO: 427755 - protein, 9 aa, Homo Sapiens
DQISQIKYK

SEQ ID NO: 427756 - protein, 9 aa, Homo Sapiens
VKTCLQSQI

SEQ ID NO: 427757 - protein, 9 aa, Homo Sapiens
GKRKQNEDD

SEQ ID NO: 427758 - protein, 9 aa, Homo Sapiens
DLAVCRARH

SEQ ID NO: 427759 - protein, 9 aa, Homo Sapiens
YCDHNFVTP

SEQ ID NO: 427760 - protein, 9 aa, Homo Sapiens
QPQQQCWSI

SEQ ID NO: 427761 - protein, 9 aa, Homo Sapiens
RSTDSQNYF

SEQ ID NO: 427762 - protein, 9 aa, Homo Sapiens
LYEPTWQNF

SEQ ID NO: 427763 - protein, 9 aa, Homo Sapiens
QGITGQPFV

SEQ ID NO: 427764 - protein, 9 aa, Homo Sapiens
NHAPGSTDA

SEQ ID NO: 427765 - protein, 9 aa, Homo Sapiens
INHLFCEFS

SEQ ID NO: 427766 - protein, 9 aa, Homo Sapiens
LYETRNKMF

SEQ ID NO: 427767 - protein, 9 aa, Homo Sapiens
YRKLSLKSH

SEQ ID NO: 427768 - protein, 9 aa, Homo Sapiens
LRKLKDVYG

SEQ ID NO: 427769 - protein, 9 aa, Homo Sapiens
IAVEMLFAV

SEQ ID NO: 427770 - protein, 9 aa, Homo Sapiens
LPWYWSWLW

SEQ ID NO: 427771 - protein, 9 aa, Homo Sapiens
GIVSLFNVT

SEQ ID NO: 427772 - protein, 9 aa, Homo Sapiens
LSNTLNLNS

SEQ ID NO: 427773 - protein, 9 aa, Homo Sapiens
AMTLYGEVP

SEQ ID NO: 427774 - protein, 9 aa, Homo Sapiens
PRSHTLTAV

SEQ ID NO: 427775 - protein, 9 aa, Homo Sapiens
GLRNVGNTC

SEQ ID NO: 427776 - protein, 9 aa, Homo Sapiens
LLITAVVLF

SEQ ID NO: 427777 - protein, 9 aa, Homo Sapiens
FDHCMFTML

SEQ ID NO: 427778 - protein, 9 aa, Homo Sapiens
GRGEKAIEI

SEQ ID NO: 427779 - protein, 9 aa, Homo Sapiens
CQIDRVNLE

SEQ ID NO: 427780 - protein, 9 aa, Homo Sapiens
GKPDFVMEP

SEQ ID NO: 427781 - protein, 9 aa, Homo Sapiens
KRKCEESVE

SEQ ID NO: 427782 - protein, 9 aa, Homo Sapiens
LRCPCKIIK

SEQ ID NO: 427783 - protein, 9 aa, Homo Sapiens
EEDTQKWKC

SEQ ID NO: 427784 - protein, 9 aa, Homo Sapiens
QQNHAMKSQ

SEQ ID NO: 427785 - protein, 9 aa, Homo Sapiens
SQLPTLVQV

SEQ ID NO: 427786 - protein, 9 aa, Homo Sapiens
TKVEWFPDL

SEQ ID NO: 427787 - protein, 9 aa, Homo Sapiens
KTAEETNME

SEQ ID NO: 427788 - protein, 9 aa, Homo Sapiens
MQKKDKSFG

SEQ ID NO: 427789 - protein, 9 aa, Homo Sapiens
PQKANIVLL

SEQ ID NO: 427790 - protein, 9 aa, Homo Sapiens
GSTEFFILA

SEQ ID NO: 427791 - protein, 9 aa, Homo Sapiens
LYLFLVERA

SEQ ID NO: 427792 - protein, 9 aa, Homo Sapiens
NSNERLGLK

SEQ ID NO: 427793 - protein, 9 aa, Homo Sapiens
MAGDLDFET

SEQ ID NO: 427794 - protein, 9 aa, Homo Sapiens
RYVTIFYTL

SEQ ID NO: 427795 - protein, 9 aa, Homo Sapiens
YCYSNKEGG

SEQ ID NO: 427796 - protein, 9 aa, Homo Sapiens
YQPTLSDDW

SEQ ID NO: 427797 - protein, 9 aa, Homo Sapiens
KQALREYFV

SEQ ID NO: 427798 - protein, 9 aa, Homo Sapiens
DARVDTGYC

SEQ ID NO: 427799 - protein, 9 aa, Homo Sapiens
DQNIKEATE

SEQ ID NO: 427800 - protein, 9 aa, Homo Sapiens
QINENPFNC

SEQ ID NO: 427801 - protein, 9 aa, Homo Sapiens
VADVLKKPV

SEQ ID NO: 427802 - protein, 9 aa, Homo Sapiens
ASYFNLSSV

SEQ ID NO: 427803 - protein, 9 aa, Homo Sapiens
KGSVDNQTY

SEQ ID NO: 427804 - protein, 9 aa, Homo Sapiens
EFLQNNRTT

SEQ ID NO: 427805 - protein, 9 aa, Homo Sapiens
VLQKGVELA

SEQ ID NO: 427806 - protein, 9 aa, Homo Sapiens
NIFEEAAVI

SEQ ID NO: 427807 - protein, 9 aa, Homo Sapiens
SEGAELNDR

SEQ ID NO: 427808 - protein, 9 aa, Homo Sapiens
SEQRDYINT

SEQ ID NO: 427809 - protein, 9 aa, Homo Sapiens
MSPPGPPGP

SEQ ID NO: 427810 - protein, 9 aa, Homo Sapiens
LYDNKPRRP

SEQ ID NO: 427811 - protein, 9 aa, Homo Sapiens
PAEIIIQVI

SEQ ID NO: 427812 - protein, 9 aa, Homo Sapiens
YLPVNQQHL

SEQ ID NO: 427813 - protein, 9 aa, Homo Sapiens
QCMCLSPTY

SEQ ID NO: 427814 - protein, 9 aa, Homo Sapiens
PNSFGHIFT

SEQ ID NO: 427815 - protein, 9 aa, Homo Sapiens
FVRALIVVI

SEQ ID NO: 427816 - protein, 9 aa, Homo Sapiens
SHRLLGVCY

SEQ ID NO: 427817 - protein, 9 aa, Homo Sapiens
FHIYRHNYH

SEQ ID NO: 427818 - protein, 9 aa, Homo Sapiens
QSQKVPVDF

SEQ ID NO: 427819 - protein, 9 aa, Homo Sapiens
CIAMEVLDQ

SEQ ID NO: 427820 - protein, 9 aa, Homo Sapiens
LNQTIFVQV

SEQ ID NO: 427821 - protein, 9 aa, Homo Sapiens
SRLESLPAH

SEQ ID NO: 427822 - protein, 9 aa, Homo Sapiens
LCEETTKSQ

SEQ ID NO: 427823 - protein, 9 aa, Homo Sapiens
ISNNVCFLE

SEQ ID NO: 427824 - protein, 9 aa, Homo Sapiens
ILGLFNHTR

SEQ ID NO: 427825 - protein, 9 aa, Homo Sapiens
TYTGEKKEK

SEQ ID NO: 427826 - protein, 9 aa, Homo Sapiens
NDKREQKLK

SEQ ID NO: 427827 - protein, 9 aa, Homo Sapiens
YTTLLCEIT

SEQ ID NO: 427828 - protein, 9 aa, Homo Sapiens
PDICHANCK

SEQ ID NO: 427829 - protein, 9 aa, Homo Sapiens
LPCVAGCSN

SEQ ID NO: 427830 - protein, 9 aa, Homo Sapiens
EDSKGIFDW

SEQ ID NO: 427831 - protein, 9 aa, Homo Sapiens
ITLSEMTFR

SEQ ID NO: 427832 - protein, 9 aa, Homo Sapiens
KVLREILTT

SEQ ID NO: 427833 - protein, 9 aa, Homo Sapiens
LLNNFQDIM

SEQ ID NO: 427834 - protein, 9 aa, Homo Sapiens
ISNSRLESL

SEQ ID NO: 427835 - protein, 9 aa, Homo Sapiens
AELSLHCET

SEQ ID NO: 427836 - protein, 9 aa, Homo Sapiens
STFKSVAFP

SEQ ID NO: 427837 - protein, 9 aa, Homo Sapiens
LIGALLTGA

SEQ ID NO: 427838 - protein, 9 aa, Homo Sapiens
PLKDKIEDE

SEQ ID NO: 427839 - protein, 9 aa, Homo Sapiens
DNLTNKNYR

SEQ ID NO: 427840 - protein, 9 aa, Homo Sapiens
RACIKSLPS

SEQ ID NO: 427841 - protein, 9 aa, Homo Sapiens
KVCYLEYAG

SEQ ID NO: 427842 - protein, 9 aa, Homo Sapiens
MNMNWLSVS

SEQ ID NO: 427843 - protein, 9 aa, Homo Sapiens
VRPFECFFL

SEQ ID NO: 427844 - protein, 9 aa, Homo Sapiens
TKSHVPLTC

SEQ ID NO: 427845 - protein, 9 aa, Homo Sapiens
LSSQREEER

SEQ ID NO: 427846 - protein, 9 aa, Homo Sapiens
AKTANKCSL

SEQ ID NO: 427847 - protein, 9 aa, Homo Sapiens
QRVVKELNH

SEQ ID NO: 427848 - protein, 9 aa, Homo Sapiens
TGGRARMDK

SEQ ID NO: 427849 - protein, 9 aa, Homo Sapiens
KKITRSLTD

SEQ ID NO: 427850 - protein, 9 aa, Homo Sapiens
KVPFKIISS

SEQ ID NO: 427851 - protein, 9 aa, Homo Sapiens
IDDNAPVTE

SEQ ID NO: 427852 - protein, 9 aa, Homo Sapiens
NETFQFIIG

SEQ ID NO: 427853 - protein, 9 aa, Homo Sapiens
IYRHNYHKA

SEQ ID NO: 427854 - protein, 9 aa, Homo Sapiens
WMFSFKAPT

SEQ ID NO: 427855 - protein, 9 aa, Homo Sapiens
SPMGKSTWY

SEQ ID NO: 427856 - protein, 9 aa, Homo Sapiens
NLVWKTSSF

SEQ ID NO: 427857 - protein, 9 aa, Homo Sapiens
YIQPCNSNI

SEQ ID NO: 427858 - protein, 9 aa, Homo Sapiens
AFSYSSVLQ

SEQ ID NO: 427859 - protein, 9 aa, Homo Sapiens
RAKPPLEAE

SEQ ID NO: 427860 - protein, 9 aa, Homo Sapiens
IQRNEIERE

SEQ ID NO: 427861 - protein, 9 aa, Homo Sapiens
VPHITCNPP

SEQ ID NO: 427862 - protein, 9 aa, Homo Sapiens
GESGAGKTK

SEQ ID NO: 427863 - protein, 9 aa, Homo Sapiens
VKVICDFNT

SEQ ID NO: 427864 - protein, 9 aa, Homo Sapiens
DIRQHPLFW

SEQ ID NO: 427865 - protein, 9 aa, Homo Sapiens
RYRISELLG

SEQ ID NO: 427866 - protein, 9 aa, Homo Sapiens
HKIIHSGDK

SEQ ID NO: 427867 - protein, 9 aa, Homo Sapiens
VYCGGVIDK

SEQ ID NO: 427868 - protein, 9 aa, Homo Sapiens
ASFAVQKES

SEQ ID NO: 427869 - protein, 9 aa, Homo Sapiens
LYPEFTPRF

SEQ ID NO: 427870 - protein, 9 aa, Homo Sapiens
ALVKVLLYS

SEQ ID NO: 427871 - protein, 9 aa, Homo Sapiens
LSGSSYSNY

SEQ ID NO: 427872 - protein, 9 aa, Homo Sapiens
DKATAAIQV

SEQ ID NO: 427873 - protein, 9 aa, Homo Sapiens
DQRRGGLHY

SEQ ID NO: 427874 - protein, 9 aa, Homo Sapiens
DHSQVLFER

SEQ ID NO: 427875 - protein, 9 aa, Homo Sapiens
GELLLQALN

SEQ ID NO: 427876 - protein, 9 aa, Homo Sapiens
KMKAPVLPE

SEQ ID NO: 427877 - protein, 9 aa, Homo Sapiens
YTTFDGRHF

SEQ ID NO: 427878 - protein, 9 aa, Homo Sapiens
VGRISKHWP

SEQ ID NO: 427879 - protein, 9 aa, Homo Sapiens
QSQSSVDVI

SEQ ID NO: 427880 - protein, 9 aa, Homo Sapiens
PHDSCFVDM

SEQ ID NO: 427881 - protein, 9 aa, Homo Sapiens
AWDCLQGHW

SEQ ID NO: 427882 - protein, 9 aa, Homo Sapiens
SEGEDSLSP

SEQ ID NO: 427883 - protein, 9 aa, Homo Sapiens
ATPGSTTLI

SEQ ID NO: 427884 - protein, 9 aa, Homo Sapiens
EMENNNLLL

SEQ ID NO: 427885 - protein, 9 aa, Homo Sapiens
NNCVKAFSF

SEQ ID NO: 427886 - protein, 9 aa, Homo Sapiens
GLDLRVLGY

SEQ ID NO: 427887 - protein, 9 aa, Homo Sapiens
YPVASLSNL

SEQ ID NO: 427888 - protein, 9 aa, Homo Sapiens
TASSDTSMD

SEQ ID NO: 427889 - protein, 9 aa, Homo Sapiens
HSKDENYKQ

SEQ ID NO: 427890 - protein, 9 aa, Homo Sapiens
GKPYKETEL

SEQ ID NO: 427891 - protein, 9 aa, Homo Sapiens
KEFFTKKGG

SEQ ID NO: 427892 - protein, 9 aa, Homo Sapiens
SMKGMRKVL

SEQ ID NO: 427893 - protein, 9 aa, Homo Sapiens
LLETRRNLE

SEQ ID NO: 427894 - protein, 9 aa, Homo Sapiens
VLGIGRHAL

SEQ ID NO: 427895 - protein, 9 aa, Homo Sapiens
HHNYVTRYC

SEQ ID NO: 427896 - protein, 9 aa, Homo Sapiens
HGPFLADFV

SEQ ID NO: 427897 - protein, 9 aa, Homo Sapiens
KISLFTEGR

SEQ ID NO: 427898 - protein, 9 aa, Homo Sapiens
YKVDKKPPV

SEQ ID NO: 427899 - protein, 9 aa, Homo Sapiens
NINHSCISS

SEQ ID NO: 427900 - protein, 9 aa, Homo Sapiens
VDMQAQKVM

SEQ ID NO: 427901 - protein, 9 aa, Homo Sapiens
NKDKQAFVK

SEQ ID NO: 427902 - protein, 9 aa, Homo Sapiens
TIIFIIKTE

SEQ ID NO: 427903 - protein, 9 aa, Homo Sapiens
EGHIIPTRK

SEQ ID NO: 427904 - protein, 9 aa, Homo Sapiens
RQEQEVKMW

SEQ ID NO: 427905 - protein, 9 aa, Homo Sapiens
SWGRGCTEP

SEQ ID NO: 427906 - protein, 9 aa, Homo Sapiens
DSYPTPGNP

SEQ ID NO: 427907 - protein, 9 aa, Homo Sapiens
GHDAVQQHP

SEQ ID NO: 427908 - protein, 9 aa, Homo Sapiens
CAPHLSLPL

SEQ ID NO: 427909 - protein, 9 aa, Homo Sapiens
ISKAHLYEI

SEQ ID NO: 427910 - protein, 9 aa, Homo Sapiens
CFLSILTRD

SEQ ID NO: 427911 - protein, 9 aa, Homo Sapiens
SDADPRDPA

SEQ ID NO: 427912 - protein, 9 aa, Homo Sapiens
SRTLVVFVS

SEQ ID NO: 427913 - protein, 9 aa, Homo Sapiens
FTEMENNNL

SEQ ID NO: 427914 - protein, 9 aa, Homo Sapiens
MSGNGRELV

SEQ ID NO: 427915 - protein, 9 aa, Homo Sapiens
TTLLCEITS

SEQ ID NO: 427916 - protein, 9 aa, Homo Sapiens
FNTIFKQVW

SEQ ID NO: 427917 - protein, 9 aa, Homo Sapiens
YSTDIVPAK

SEQ ID NO: 427918 - protein, 9 aa, Homo Sapiens
AVLTSILTK

SEQ ID NO: 427919 - protein, 9 aa, Homo Sapiens
YEVNCLGIY

SEQ ID NO: 427920 - protein, 9 aa, Homo Sapiens
VKNAMKKLF

SEQ ID NO: 427921 - protein, 9 aa, Homo Sapiens
SFLFIGVIL

SEQ ID NO: 427922 - protein, 9 aa, Homo Sapiens
HDKEVITLN

SEQ ID NO: 427923 - protein, 9 aa, Homo Sapiens
NDIEGIHRE

SEQ ID NO: 427924 - protein, 9 aa, Homo Sapiens
GGKTQIAGC

SEQ ID NO: 427925 - protein, 9 aa, Homo Sapiens
GPIPEHILG

SEQ ID NO: 427926 - protein, 9 aa, Homo Sapiens
LKSPKGVEM

SEQ ID NO: 427927 - protein, 9 aa, Homo Sapiens
DINKPKQFM

SEQ ID NO: 427928 - protein, 9 aa, Homo Sapiens
FVQHLRIHT

SEQ ID NO: 427929 - protein, 9 aa, Homo Sapiens
GSYVHNFLP

SEQ ID NO: 427930 - protein, 9 aa, Homo Sapiens
LSGNKYVFT

SEQ ID NO: 427931 - protein, 9 aa, Homo Sapiens
EDTQKWKCI

SEQ ID NO: 427932 - protein, 9 aa, Homo Sapiens
MYVTATHSV

SEQ ID NO: 427933 - protein, 9 aa, Homo Sapiens
EVWDLDDIL

SEQ ID NO: 427934 - protein, 9 aa, Homo Sapiens
QLDYLRALK

SEQ ID NO: 427935 - protein, 9 aa, Homo Sapiens
YFKSLETIE

SEQ ID NO: 427936 - protein, 9 aa, Homo Sapiens
SDKNEKEEY

SEQ ID NO: 427937 - protein, 9 aa, Homo Sapiens
IVSQCPTAG

SEQ ID NO: 427938 - protein, 9 aa, Homo Sapiens
QSSLLNLSL

SEQ ID NO: 427939 - protein, 9 aa, Homo Sapiens
EMTHKLEAL

SEQ ID NO: 427940 - protein, 9 aa, Homo Sapiens
LLLVKAVQN

SEQ ID NO: 427941 - protein, 9 aa, Homo Sapiens
ALRASRVLR

SEQ ID NO: 427942 - protein, 9 aa, Homo Sapiens
SWPWWMYES

SEQ ID NO: 427943 - protein, 9 aa, Homo Sapiens
NINISEVVI

SEQ ID NO: 427944 - protein, 9 aa, Homo Sapiens
VPVGEVLLE

SEQ ID NO: 427945 - protein, 9 aa, Homo Sapiens
AHKNWKIKN

SEQ ID NO: 427946 - protein, 9 aa, Homo Sapiens
AEFAPKADL

SEQ ID NO: 427947 - protein, 9 aa, Homo Sapiens
QELRLVHDT

SEQ ID NO: 427948 - protein, 9 aa, Homo Sapiens
AAIKNTDDR

SEQ ID NO: 427949 - protein, 9 aa, Homo Sapiens
PYITVTSEF

SEQ ID NO: 427950 - protein, 9 aa, Homo Sapiens
FPVLEHEAR

SEQ ID NO: 427951 - protein, 9 aa, Homo Sapiens
ELEWQNRLS

SEQ ID NO: 427952 - protein, 9 aa, Homo Sapiens
KIIKKELQC

SEQ ID NO: 427953 - protein, 9 aa, Homo Sapiens
FLSMEKLLP

SEQ ID NO: 427954 - protein, 9 aa, Homo Sapiens
RCGRKDHLT

SEQ ID NO: 427955 - protein, 9 aa, Homo Sapiens
GPQNCSCVR

SEQ ID NO: 427956 - protein, 9 aa, Homo Sapiens
YVKASAAWA

SEQ ID NO: 427957 - protein, 9 aa, Homo Sapiens
SFGKVCYLE

SEQ ID NO: 427958 - protein, 9 aa, Homo Sapiens
TIQTAEFFR

SEQ ID NO: 427959 - protein, 9 aa, Homo Sapiens
LGIITCFNV

SEQ ID NO: 427960 - protein, 9 aa, Homo Sapiens
GLEKIIYKI

SEQ ID NO: 427961 - protein, 9 aa, Homo Sapiens
AYYHNGKLW

SEQ ID NO: 427962 - protein, 9 aa, Homo Sapiens
DTVMKLGAG

SEQ ID NO: 427963 - protein, 9 aa, Homo Sapiens
QRGKSGFNS

SEQ ID NO: 427964 - protein, 9 aa, Homo Sapiens
LRTDNPIEV

SEQ ID NO: 427965 - protein, 9 aa, Homo Sapiens
AKPVKCILN

SEQ ID NO: 427966 - protein, 9 aa, Homo Sapiens
CAQTFFKIT

SEQ ID NO: 427967 - protein, 9 aa, Homo Sapiens
DFFVSRSSA

SEQ ID NO: 427968 - protein, 9 aa, Homo Sapiens
GQPGTGNQI

SEQ ID NO: 427969 - protein, 9 aa, Homo Sapiens
QKVRAMGKN

SEQ ID NO: 427970 - protein, 9 aa, Homo Sapiens
KKYDFPLNR

SEQ ID NO: 427971 - protein, 9 aa, Homo Sapiens
SQDEQENYS

SEQ ID NO: 427972 - protein, 9 aa, Homo Sapiens
SEFLKHGKA

SEQ ID NO: 427973 - protein, 9 aa, Homo Sapiens
IFTAGLCSF

SEQ ID NO: 427974 - protein, 9 aa, Homo Sapiens
IYRFNTVIA

SEQ ID NO: 427975 - protein, 9 aa, Homo Sapiens
VLTRGNLTY

SEQ ID NO: 427976 - protein, 9 aa, Homo Sapiens
KPFIRLSKE

SEQ ID NO: 427977 - protein, 9 aa, Homo Sapiens
SGNTSMWLA

SEQ ID NO: 427978 - protein, 9 aa, Homo Sapiens
QRHRIIHTG

SEQ ID NO: 427979 - protein, 9 aa, Homo Sapiens
VEQEKVVYM

SEQ ID NO: 427980 - protein, 9 aa, Homo Sapiens
LHEIVPGAC

SEQ ID NO: 427981 - protein, 9 aa, Homo Sapiens
DEGNVFPGS

SEQ ID NO: 427982 - protein, 9 aa, Homo Sapiens
FTFQEDDSF

SEQ ID NO: 427983 - protein, 9 aa, Homo Sapiens
SDKIYVMYI

SEQ ID NO: 427984 - protein, 9 aa, Homo Sapiens
RNSEMEKAP

SEQ ID NO: 427985 - protein, 9 aa, Homo Sapiens
RGEPVEGFN

SEQ ID NO: 427986 - protein, 9 aa, Homo Sapiens
VVILLYGSA

SEQ ID NO: 427987 - protein, 9 aa, Homo Sapiens
PYGGRAASL

SEQ ID NO: 427988 - protein, 9 aa, Homo Sapiens
SIPGPEKNL

SEQ ID NO: 427989 - protein, 9 aa, Homo Sapiens
NRSANLIRH

SEQ ID NO: 427990 - protein, 9 aa, Homo Sapiens
RAQSYTQQL

SEQ ID NO: 427991 - protein, 9 aa, Homo Sapiens
EETLKANKG

SEQ ID NO: 427992 - protein, 9 aa, Homo Sapiens
VIYTYMASE

SEQ ID NO: 427993 - protein, 9 aa, Homo Sapiens
DREFQLFDH

SEQ ID NO: 427994 - protein, 9 aa, Homo Sapiens
LRWNTTYHR

SEQ ID NO: 427995 - protein, 9 aa, Homo Sapiens
VWDLHYQTL

SEQ ID NO: 427996 - protein, 9 aa, Homo Sapiens
RPPHIFLCD

SEQ ID NO: 427997 - protein, 9 aa, Homo Sapiens
VVQELTKAA

SEQ ID NO: 427998 - protein, 9 aa, Homo Sapiens
KVFNSSYVV

SEQ ID NO: 427999 - protein, 9 aa, Homo Sapiens
CFYINKINP

SEQ ID NO: 428000 - protein, 9 aa, Homo Sapiens
ELFAYAAQG

SEQ ID NO: 428001 - protein, 9 aa, Homo Sapiens
KDKASEKKD

SEQ ID NO: 428002 - protein, 9 aa, Homo Sapiens
VNNRLDYHI

SEQ ID NO: 428003 - protein, 9 aa, Homo Sapiens
SLEEDHIIF

SEQ ID NO: 428004 - protein, 9 aa, Homo Sapiens
TSLFDAKER

SEQ ID NO: 428005 - protein, 9 aa, Homo Sapiens
HYMCRMEQD

SEQ ID NO: 428006 - protein, 9 aa, Homo Sapiens
QEYEVLQTL

SEQ ID NO: 428007 - protein, 9 aa, Homo Sapiens
NQLGKGRKK

SEQ ID NO: 428008 - protein, 9 aa, Homo Sapiens
LSELDQYYE

SEQ ID NO: 428009 - protein, 9 aa, Homo Sapiens
GLYFNEFTD

SEQ ID NO: 428010 - protein, 9 aa, Homo Sapiens
FYKVLLSGE

SEQ ID NO: 428011 - protein, 9 aa, Homo Sapiens
TCYVLSFAT

SEQ ID NO: 428012 - protein, 9 aa, Homo Sapiens
SVCQVHASG

SEQ ID NO: 428013 - protein, 9 aa, Homo Sapiens
QSAKSLSLY

SEQ ID NO: 428014 - protein, 9 aa, Homo Sapiens
QLHNKCLEK

SEQ ID NO: 428015 - protein, 9 aa, Homo Sapiens
CRQNLTRDC

SEQ ID NO: 428016 - protein, 9 aa, Homo Sapiens
HKIEIGTIF

SEQ ID NO: 428017 - protein, 9 aa, Homo Sapiens
NCCFSEDGF

SEQ ID NO: 428018 - protein, 9 aa, Homo Sapiens
WWCRLRASL

SEQ ID NO: 428019 - protein, 9 aa, Homo Sapiens
KELIERVLR

SEQ ID NO: 428020 - protein, 9 aa, Homo Sapiens
PSEEIKTIN

SEQ ID NO: 428021 - protein, 9 aa, Homo Sapiens
DNARMVVNI

SEQ ID NO: 428022 - protein, 9 aa, Homo Sapiens
FWDRADIYP

SEQ ID NO: 428023 - protein, 9 aa, Homo Sapiens
DDRFPTHKR

SEQ ID NO: 428024 - protein, 9 aa, Homo Sapiens
KNHAPGSTD

SEQ ID NO: 428025 - protein, 9 aa, Homo Sapiens
QGFLGATGT

SEQ ID NO: 428026 - protein, 9 aa, Homo Sapiens
LEYDWLVPG

SEQ ID NO: 428027 - protein, 9 aa, Homo Sapiens
SGASKPSEE

SEQ ID NO: 428028 - protein, 9 aa, Homo Sapiens
KRLISAFKD

SEQ ID NO: 428029 - protein, 9 aa, Homo Sapiens
SDVDNDGCH

SEQ ID NO: 428030 - protein, 9 aa, Homo Sapiens
QYYEQDDDH

SEQ ID NO: 428031 - protein, 9 aa, Homo Sapiens
IQETLQEEI

SEQ ID NO: 428032 - protein, 9 aa, Homo Sapiens
RTPEMFFFE

SEQ ID NO: 428033 - protein, 9 aa, Homo Sapiens
RPPISKEYS

SEQ ID NO: 428034 - protein, 9 aa, Homo Sapiens
VTNFRFGTI

SEQ ID NO: 428035 - protein, 9 aa, Homo Sapiens
QEKRQEQEV

SEQ ID NO: 428036 - protein, 9 aa, Homo Sapiens
FPFSLILSS

SEQ ID NO: 428037 - protein, 9 aa, Homo Sapiens
YYHNGKLWI

SEQ ID NO: 428038 - protein, 9 aa, Homo Sapiens
WCRPPHIFL

SEQ ID NO: 428039 - protein, 9 aa, Homo Sapiens
LYLSLILLQ

SEQ ID NO: 428040 - protein, 9 aa, Homo Sapiens
QETGYIVIS

SEQ ID NO: 428041 - protein, 9 aa, Homo Sapiens
SMTQTDIVI

SEQ ID NO: 428042 - protein, 9 aa, Homo Sapiens
RQYNEQEET

SEQ ID NO: 428043 - protein, 9 aa, Homo Sapiens
KPRKVQFKI

SEQ ID NO: 428044 - protein, 9 aa, Homo Sapiens
DKVANESQK

SEQ ID NO: 428045 - protein, 9 aa, Homo Sapiens
QGEDDDEEE

SEQ ID NO: 428046 - protein, 9 aa, Homo Sapiens
DLKQAQHQI

SEQ ID NO: 428047 - protein, 9 aa, Homo Sapiens
QQCHQADKY

SEQ ID NO: 428048 - protein, 9 aa, Homo Sapiens
VHGNNKAMA

SEQ ID NO: 428049 - protein, 9 aa, Homo Sapiens
LKNKQQIKR

SEQ ID NO: 428050 - protein, 9 aa, Homo Sapiens
RLSCLSLLI

SEQ ID NO: 428051 - protein, 9 aa, Homo Sapiens
AMSNRETGT

SEQ ID NO: 428052 - protein, 9 aa, Homo Sapiens
KWHKFVYIY

SEQ ID NO: 428053 - protein, 9 aa, Homo Sapiens
PSKDASSLE

SEQ ID NO: 428054 - protein, 9 aa, Homo Sapiens
STPCHSHTP

SEQ ID NO: 428055 - protein, 9 aa, Homo Sapiens
RNDMQLDSE

SEQ ID NO: 428056 - protein, 9 aa, Homo Sapiens
NLFNNYKTY

SEQ ID NO: 428057 - protein, 9 aa, Homo Sapiens
SMVSQMNKI

SEQ ID NO: 428058 - protein, 9 aa, Homo Sapiens
QIRPLLDVL

SEQ ID NO: 428059 - protein, 9 aa, Homo Sapiens
IFVQHLRIH

SEQ ID NO: 428060 - protein, 9 aa, Homo Sapiens
VASLSNLEL

SEQ ID NO: 428061 - protein, 9 aa, Homo Sapiens
KAIEANSSY

SEQ ID NO: 428062 - protein, 9 aa, Homo Sapiens
YLVVAAMII

SEQ ID NO: 428063 - protein, 9 aa, Homo Sapiens
RPCSSCSVI

SEQ ID NO: 428064 - protein, 9 aa, Homo Sapiens
RTWHLNERH

SEQ ID NO: 428065 - protein, 9 aa, Homo Sapiens
NLIHHFFCD

SEQ ID NO: 428066 - protein, 9 aa, Homo Sapiens
LSMEKLLPS

SEQ ID NO: 428067 - protein, 9 aa, Homo Sapiens
NHLVDEAHC

SEQ ID NO: 428068 - protein, 9 aa, Homo Sapiens
SSSDILHHE

SEQ ID NO: 428069 - protein, 9 aa, Homo Sapiens
PAGYFHFTA

SEQ ID NO: 428070 - protein, 9 aa, Homo Sapiens
ERFEIVGIP

SEQ ID NO: 428071 - protein, 9 aa, Homo Sapiens
FLSLLLVAV

SEQ ID NO: 428072 - protein, 9 aa, Homo Sapiens
LTRRRTVSQ

SEQ ID NO: 428073 - protein, 9 aa, Homo Sapiens
PVHHRRPPH

SEQ ID NO: 428074 - protein, 9 aa, Homo Sapiens
CQECMKKCI

SEQ ID NO: 428075 - protein, 9 aa, Homo Sapiens
PDARVDTGY

SEQ ID NO: 428076 - protein, 9 aa, Homo Sapiens
HVSKKHFKA

SEQ ID NO: 428077 - protein, 9 aa, Homo Sapiens
EFTAMTLYG

SEQ ID NO: 428078 - protein, 9 aa, Homo Sapiens
ADIKKSITD

SEQ ID NO: 428079 - protein, 9 aa, Homo Sapiens
CYGLEINKL

SEQ ID NO: 428080 - protein, 9 aa, Homo Sapiens
KYDLHQVNK

SEQ ID NO: 428081 - protein, 9 aa, Homo Sapiens
DIHCEFCGE

SEQ ID NO: 428082 - protein, 9 aa, Homo Sapiens
CTSSLPPLD

SEQ ID NO: 428083 - protein, 9 aa, Homo Sapiens
TMSSDSQVV

SEQ ID NO: 428084 - protein, 9 aa, Homo Sapiens
EDIKFILEK

SEQ ID NO: 428085 - protein, 9 aa, Homo Sapiens
NLAPRTAVA

SEQ ID NO: 428086 - protein, 9 aa, Homo Sapiens
KNFSLPVLD

SEQ ID NO: 428087 - protein, 9 aa, Homo Sapiens
GLLISFLFI

SEQ ID NO: 428088 - protein, 9 aa, Homo Sapiens
HSRMNISDI

SEQ ID NO: 428089 - protein, 9 aa, Homo Sapiens
HLEKQEAQM

SEQ ID NO: 428090 - protein, 9 aa, Homo Sapiens
TSAFSRLDK

SEQ ID NO: 428091 - protein, 9 aa, Homo Sapiens
HKQQHGLGH

SEQ ID NO: 428092 - protein, 9 aa, Homo Sapiens
SSSGTTHKI

SEQ ID NO: 428093 - protein, 9 aa, Homo Sapiens
IPIPLVDTR

SEQ ID NO: 428094 - protein, 9 aa, Homo Sapiens
RQFFVFNDI

SEQ ID NO: 428095 - protein, 9 aa, Homo Sapiens
NNIKCDVTA

SEQ ID NO: 428096 - protein, 9 aa, Homo Sapiens
LHKTEKAIN

SEQ ID NO: 428097 - protein, 9 aa, Homo Sapiens
PSRKAKPVK

SEQ ID NO: 428098 - protein, 9 aa, Homo Sapiens
EEDRDKLLK

SEQ ID NO: 428099 - protein, 9 aa, Homo Sapiens
LFNNYKTYR

SEQ ID NO: 428100 - protein, 9 aa, Homo Sapiens
VRKWHLGFY

SEQ ID NO: 428101 - protein, 9 aa, Homo Sapiens
GIEFVKHFC

SEQ ID NO: 428102 - protein, 9 aa, Homo Sapiens
GVVSRESLL

SEQ ID NO: 428103 - protein, 9 aa, Homo Sapiens
SVLEPPQKH

SEQ ID NO: 428104 - protein, 9 aa, Homo Sapiens
CLVHQSKIF

SEQ ID NO: 428105 - protein, 9 aa, Homo Sapiens
HLANHQKIH

SEQ ID NO: 428106 - protein, 9 aa, Homo Sapiens
PESASEGED

SEQ ID NO: 428107 - protein, 9 aa, Homo Sapiens
SENYGRRRK

SEQ ID NO: 428108 - protein, 9 aa, Homo Sapiens
TIFTLLYLF

SEQ ID NO: 428109 - protein, 9 aa, Homo Sapiens
KIRRKYMIV

SEQ ID NO: 428110 - protein, 9 aa, Homo Sapiens
VPVKQFQLC

SEQ ID NO: 428111 - protein, 9 aa, Homo Sapiens
QIPFSTFQF

SEQ ID NO: 428112 - protein, 9 aa, Homo Sapiens
NCFNCGTWM

SEQ ID NO: 428113 - protein, 9 aa, Homo Sapiens
YDPRRCYVC

SEQ ID NO: 428114 - protein, 9 aa, Homo Sapiens
TDTSHEQWL

SEQ ID NO: 428115 - protein, 9 aa, Homo Sapiens
RIQSPVTNK

SEQ ID NO: 428116 - protein, 9 aa, Homo Sapiens
FCEDIQVPP

SEQ ID NO: 428117 - protein, 9 aa, Homo Sapiens
PGQSGASLM

SEQ ID NO: 428118 - protein, 9 aa, Homo Sapiens
AALKNAFYL

SEQ ID NO: 428119 - protein, 9 aa, Homo Sapiens
TTLAAIMRT

SEQ ID NO: 428120 - protein, 9 aa, Homo Sapiens
NCNLEYLDN

SEQ ID NO: 428121 - protein, 9 aa, Homo Sapiens
SMIRNAMGV

SEQ ID NO: 428122 - protein, 9 aa, Homo Sapiens
DESKVTFYI

SEQ ID NO: 428123 - protein, 9 aa, Homo Sapiens
ELQDTTGVS

SEQ ID NO: 428124 - protein, 9 aa, Homo Sapiens
ERFIFPAPD

SEQ ID NO: 428125 - protein, 9 aa, Homo Sapiens
GNREITVIE

SEQ ID NO: 428126 - protein, 9 aa, Homo Sapiens
VVRTWHLNE

SEQ ID NO: 428127 - protein, 9 aa, Homo Sapiens
PSHSSVCST

SEQ ID NO: 428128 - protein, 9 aa, Homo Sapiens
PFGLSPLID

SEQ ID NO: 428129 - protein, 9 aa, Homo Sapiens
VHLLRSEGA

SEQ ID NO: 428130 - protein, 9 aa, Homo Sapiens
LHLEQQQIE

SEQ ID NO: 428131 - protein, 9 aa, Homo Sapiens
SDKNMCNYQ

SEQ ID NO: 428132 - protein, 9 aa, Homo Sapiens
PHLTNHQQT

SEQ ID NO: 428133 - protein, 9 aa, Homo Sapiens
VCLFMVVGF

SEQ ID NO: 428134 - protein, 9 aa, Homo Sapiens
SKAAAHAVA

SEQ ID NO: 428135 - protein, 9 aa, Homo Sapiens
QLEQELQDL

SEQ ID NO: 428136 - protein, 9 aa, Homo Sapiens
IKELQLMKE

SEQ ID NO: 428137 - protein, 9 aa, Homo Sapiens
SHPTEKTIF

SEQ ID NO: 428138 - protein, 9 aa, Homo Sapiens
VVLVKDNGK

SEQ ID NO: 428139 - protein, 9 aa, Homo Sapiens
DNPGQIALP

SEQ ID NO: 428140 - protein, 9 aa, Homo Sapiens
KMSKNKTAV

SEQ ID NO: 428141 - protein, 9 aa, Homo Sapiens
RYNLPAGTI

SEQ ID NO: 428142 - protein, 9 aa, Homo Sapiens
PPQPEFRAV

SEQ ID NO: 428143 - protein, 9 aa, Homo Sapiens
ASKSVSSTN

SEQ ID NO: 428144 - protein, 9 aa, Homo Sapiens
TDLLTEYAN

SEQ ID NO: 428145 - protein, 9 aa, Homo Sapiens
PVLEEGRKS

SEQ ID NO: 428146 - protein, 9 aa, Homo Sapiens
QHIFYLKLE

SEQ ID NO: 428147 - protein, 9 aa, Homo Sapiens
FKQALREYF

SEQ ID NO: 428148 - protein, 9 aa, Homo Sapiens
LIIMSLAIL

SEQ ID NO: 428149 - protein, 9 aa, Homo Sapiens
VLNVYIRLK

SEQ ID NO: 428150 - protein, 9 aa, Homo Sapiens
YNGYFVTPD

SEQ ID NO: 428151 - protein, 9 aa, Homo Sapiens
GQSLPSLQA

SEQ ID NO: 428152 - protein, 9 aa, Homo Sapiens
NYGPEGNFA

SEQ ID NO: 428153 - protein, 9 aa, Homo Sapiens
QYYKLLAER

SEQ ID NO: 428154 - protein, 9 aa, Homo Sapiens
SSKHKRFYL

SEQ ID NO: 428155 - protein, 9 aa, Homo Sapiens
IVADLDTMR

SEQ ID NO: 428156 - protein, 9 aa, Homo Sapiens
YYSIKLYEK

SEQ ID NO: 428157 - protein, 9 aa, Homo Sapiens
RVVFHFKFF

SEQ ID NO: 428158 - protein, 9 aa, Homo Sapiens
PERKYSVWM

SEQ ID NO: 428159 - protein, 9 aa, Homo Sapiens
CYHIGTTEE

SEQ ID NO: 428160 - protein, 9 aa, Homo Sapiens
AKDSVVQFL

SEQ ID NO: 428161 - protein, 9 aa, Homo Sapiens
LRMSPQHFT

SEQ ID NO: 428162 - protein, 9 aa, Homo Sapiens
YSPGQTVYL

SEQ ID NO: 428163 - protein, 9 aa, Homo Sapiens
GYAFKTVLE

SEQ ID NO: 428164 - protein, 9 aa, Homo Sapiens
RSHELYKFC

SEQ ID NO: 428165 - protein, 9 aa, Homo Sapiens
IHNAELSQA

SEQ ID NO: 428166 - protein, 9 aa, Homo Sapiens
INHTQKKCN

SEQ ID NO: 428167 - protein, 9 aa, Homo Sapiens
DIEAHLNSW

SEQ ID NO: 428168 - protein, 9 aa, Homo Sapiens
QPHQFYVAD

SEQ ID NO: 428169 - protein, 9 aa, Homo Sapiens
TLHIDFCRY

SEQ ID NO: 428170 - protein, 9 aa, Homo Sapiens
RSRLIKLLH

SEQ ID NO: 428171 - protein, 9 aa, Homo Sapiens
QFNRILANT

SEQ ID NO: 428172 - protein, 9 aa, Homo Sapiens
NGKKEEASQ

SEQ ID NO: 428173 - protein, 9 aa, Homo Sapiens
YHKFSDNSM

SEQ ID NO: 428174 - protein, 9 aa, Homo Sapiens
QFLFYQPIS

SEQ ID NO: 428175 - protein, 9 aa, Homo Sapiens
LILHKIIHS

SEQ ID NO: 428176 - protein, 9 aa, Homo Sapiens
GMGFQQDRI

SEQ ID NO: 428177 - protein, 9 aa, Homo Sapiens
ISVGLVLGT

SEQ ID NO: 428178 - protein, 9 aa, Homo Sapiens
LGNLVMEPE

SEQ ID NO: 428179 - protein, 9 aa, Homo Sapiens
KNPLLWMFS

SEQ ID NO: 428180 - protein, 9 aa, Homo Sapiens
TVLSSAPVP

SEQ ID NO: 428181 - protein, 9 aa, Homo Sapiens
TACRYDPHS

SEQ ID NO: 428182 - protein, 9 aa, Homo Sapiens
MAQITKALQ

SEQ ID NO: 428183 - protein, 9 aa, Homo Sapiens
LCSRRFTMK

SEQ ID NO: 428184 - protein, 9 aa, Homo Sapiens
LKAQLDSVD

SEQ ID NO: 428185 - protein, 9 aa, Homo Sapiens
TYDGSLDAC

SEQ ID NO: 428186 - protein, 9 aa, Homo Sapiens
TKFGYGVLV

SEQ ID NO: 428187 - protein, 9 aa, Homo Sapiens
ECKVLPDWK

SEQ ID NO: 428188 - protein, 9 aa, Homo Sapiens
AVKKIAEAG

SEQ ID NO: 428189 - protein, 9 aa, Homo Sapiens
MPYQSVEQT

SEQ ID NO: 428190 - protein, 9 aa, Homo Sapiens
IMGETPQNL

SEQ ID NO: 428191 - protein, 9 aa, Homo Sapiens
CSHLGVIES

SEQ ID NO: 428192 - protein, 9 aa, Homo Sapiens
NLIKFMLRN

SEQ ID NO: 428193 - protein, 9 aa, Homo Sapiens
YPKSKAGNT

SEQ ID NO: 428194 - protein, 9 aa, Homo Sapiens
SSTNLELQA

SEQ ID NO: 428195 - protein, 9 aa, Homo Sapiens
QQGSELIPK

SEQ ID NO: 428196 - protein, 9 aa, Homo Sapiens
LSICRPLHY

SEQ ID NO: 428197 - protein, 9 aa, Homo Sapiens
IKVSPEFSE

SEQ ID NO: 428198 - protein, 9 aa, Homo Sapiens
INMNIKLFM

SEQ ID NO: 428199 - protein, 9 aa, Homo Sapiens
PRRCYVCPA

SEQ ID NO: 428200 - protein, 9 aa, Homo Sapiens
MFVYCTPKK

SEQ ID NO: 428201 - protein, 9 aa, Homo Sapiens
EKSYTCEEC

SEQ ID NO: 428202 - protein, 9 aa, Homo Sapiens
LKSLAIHLL

SEQ ID NO: 428203 - protein, 9 aa, Homo Sapiens
QQNLEALKK

SEQ ID NO: 428204 - protein, 9 aa, Homo Sapiens
MLKQLKKQQ

SEQ ID NO: 428205 - protein, 9 aa, Homo Sapiens
LILLSMLTS

SEQ ID NO: 428206 - protein, 9 aa, Homo Sapiens
LSQCGRSVF

SEQ ID NO: 428207 - protein, 9 aa, Homo Sapiens
SNHGCVLTR

SEQ ID NO: 428208 - protein, 9 aa, Homo Sapiens
REICDIPGT

SEQ ID NO: 428209 - protein, 9 aa, Homo Sapiens
FQSSCYLFS

SEQ ID NO: 428210 - protein, 9 aa, Homo Sapiens
VSNDISDIF

SEQ ID NO: 428211 - protein, 9 aa, Homo Sapiens
LVPGSDKVG

SEQ ID NO: 428212 - protein, 9 aa, Homo Sapiens
SLISTDALP

SEQ ID NO: 428213 - protein, 9 aa, Homo Sapiens
YDNWGECTK

SEQ ID NO: 428214 - protein, 9 aa, Homo Sapiens
PPYCDDTVT

SEQ ID NO: 428215 - protein, 9 aa, Homo Sapiens
NFGSYAYTR

SEQ ID NO: 428216 - protein, 9 aa, Homo Sapiens
GTALNLLKE

SEQ ID NO: 428217 - protein, 9 aa, Homo Sapiens
DICHANCKH

SEQ ID NO: 428218 - protein, 9 aa, Homo Sapiens
VSANHSSPS

SEQ ID NO: 428219 - protein, 9 aa, Homo Sapiens
GKSKVGVWG

SEQ ID NO: 428220 - protein, 9 aa, Homo Sapiens
IFHFFFFVT

SEQ ID NO: 428221 - protein, 9 aa, Homo Sapiens
WCYGPARLW

SEQ ID NO: 428222 - protein, 9 aa, Homo Sapiens
EEQKHGLLK

SEQ ID NO: 428223 - protein, 9 aa, Homo Sapiens
AIVITYSTE

SEQ ID NO: 428224 - protein, 9 aa, Homo Sapiens
AFSVGKFRY

SEQ ID NO: 428225 - protein, 9 aa, Homo Sapiens
KDRIVADLD

SEQ ID NO: 428226 - protein, 9 aa, Homo Sapiens
TLKSLGEET

SEQ ID NO: 428227 - protein, 9 aa, Homo Sapiens
QKSRPDSPC

SEQ ID NO: 428228 - protein, 9 aa, Homo Sapiens
PGTVALRKI

SEQ ID NO: 428229 - protein, 9 aa, Homo Sapiens
KTGRPLKDC

SEQ ID NO: 428230 - protein, 9 aa, Homo Sapiens
ALSDKNMCN

SEQ ID NO: 428231 - protein, 9 aa, Homo Sapiens
NRSTDSQNY

SEQ ID NO: 428232 - protein, 9 aa, Homo Sapiens
EDKTISYQE

SEQ ID NO: 428233 - protein, 9 aa, Homo Sapiens
RRLPAVCKV

SEQ ID NO: 428234 - protein, 9 aa, Homo Sapiens
TGPHTCKDL

SEQ ID NO: 428235 - protein, 9 aa, Homo Sapiens
HNQICEVLD

SEQ ID NO: 428236 - protein, 9 aa, Homo Sapiens
CLDHLAPNS

SEQ ID NO: 428237 - protein, 9 aa, Homo Sapiens
CRICHVKCH

SEQ ID NO: 428238 - protein, 9 aa, Homo Sapiens
ASTQEADPM

SEQ ID NO: 428239 - protein, 9 aa, Homo Sapiens
PQTPSECSY

SEQ ID NO: 428240 - protein, 9 aa, Homo Sapiens
GDKPYKCNV

SEQ ID NO: 428241 - protein, 9 aa, Homo Sapiens
DKGKPKNTE

SEQ ID NO: 428242 - protein, 9 aa, Homo Sapiens
VITNLNGLR

SEQ ID NO: 428243 - protein, 9 aa, Homo Sapiens
IQIWLADGG

SEQ ID NO: 428244 - protein, 9 aa, Homo Sapiens
SPQIPFSTF

SEQ ID NO: 428245 - protein, 9 aa, Homo Sapiens
YYEQDDDHR

SEQ ID NO: 428246 - protein, 9 aa, Homo Sapiens
TEINLVSFC

SEQ ID NO: 428247 - protein, 9 aa, Homo Sapiens
SPSASPSMP

SEQ ID NO: 428248 - protein, 9 aa, Homo Sapiens
QDLATYNSL

SEQ ID NO: 428249 - protein, 9 aa, Homo Sapiens
YQIQVGKNE

SEQ ID NO: 428250 - protein, 9 aa, Homo Sapiens
AVFTDKYAN

SEQ ID NO: 428251 - protein, 9 aa, Homo Sapiens
LDGLRPDTR

SEQ ID NO: 428252 - protein, 9 aa, Homo Sapiens
MSHRVCIIL

SEQ ID NO: 428253 - protein, 9 aa, Homo Sapiens
QKRLKKDKK

SEQ ID NO: 428254 - protein, 9 aa, Homo Sapiens
SESQTVLSS

SEQ ID NO: 428255 - protein, 9 aa, Homo Sapiens
HSLLLLQPC

SEQ ID NO: 428256 - protein, 9 aa, Homo Sapiens
TQTKNESFL

SEQ ID NO: 428257 - protein, 9 aa, Homo Sapiens
AEDALLQMI

SEQ ID NO: 428258 - protein, 9 aa, Homo Sapiens
PQSDGVRGM

SEQ ID NO: 428259 - protein, 9 aa, Homo Sapiens
NISKDLTDK

SEQ ID NO: 428260 - protein, 9 aa, Homo Sapiens
NERGRRRDS

SEQ ID NO: 428261 - protein, 9 aa, Homo Sapiens
NRRESSPPY

SEQ ID NO: 428262 - protein, 9 aa, Homo Sapiens
ENQTDFSGL

SEQ ID NO: 428263 - protein, 9 aa, Homo Sapiens
VCWVGGFIC

SEQ ID NO: 428264 - protein, 9 aa, Homo Sapiens
AGIVSLFNV

SEQ ID NO: 428265 - protein, 9 aa, Homo Sapiens
ALSSQKLEN

SEQ ID NO: 428266 - protein, 9 aa, Homo Sapiens
EDEKLSGAS

SEQ ID NO: 428267 - protein, 9 aa, Homo Sapiens
RPPPPSGTR

SEQ ID NO: 428268 - protein, 9 aa, Homo Sapiens
QTPSECSYY

SEQ ID NO: 428269 - protein, 9 aa, Homo Sapiens
LPFTLEIVI

SEQ ID NO: 428270 - protein, 9 aa, Homo Sapiens
QNLSTPPLR

SEQ ID NO: 428271 - protein, 9 aa, Homo Sapiens
LQQLEVWDL

SEQ ID NO: 428272 - protein, 9 aa, Homo Sapiens
YQEVGGTPG

SEQ ID NO: 428273 - protein, 9 aa, Homo Sapiens
EAECVTFSL

SEQ ID NO: 428274 - protein, 9 aa, Homo Sapiens
LSKAFHSKV

SEQ ID NO: 428275 - protein, 9 aa, Homo Sapiens
KRVKYQYVL

SEQ ID NO: 428276 - protein, 9 aa, Homo Sapiens
SNGSLQSRD

SEQ ID NO: 428277 - protein, 9 aa, Homo Sapiens
CGQRFNPET

SEQ ID NO: 428278 - protein, 9 aa, Homo Sapiens
SLDTCDLHT

SEQ ID NO: 428279 - protein, 9 aa, Homo Sapiens
KAVVVQMAQ

SEQ ID NO: 428280 - protein, 9 aa, Homo Sapiens
DSRHVTVYH

SEQ ID NO: 428281 - protein, 9 aa, Homo Sapiens
SMSSTNLEL

SEQ ID NO: 428282 - protein, 9 aa, Homo Sapiens
IQSGDISAD

SEQ ID NO: 428283 - protein, 9 aa, Homo Sapiens
CGLVGMRSL

SEQ ID NO: 428284 - protein, 9 aa, Homo Sapiens
GQIPKKFAR

SEQ ID NO: 428285 - protein, 9 aa, Homo Sapiens
ELVEYGFHE

SEQ ID NO: 428286 - protein, 9 aa, Homo Sapiens
ICDISNKYI

SEQ ID NO: 428287 - protein, 9 aa, Homo Sapiens
AKDLPCDLK

SEQ ID NO: 428288 - protein, 9 aa, Homo Sapiens
DNATLAADD

SEQ ID NO: 428289 - protein, 9 aa, Homo Sapiens
KVIKIVGLA

SEQ ID NO: 428290 - protein, 9 aa, Homo Sapiens
AFISNLNKM

SEQ ID NO: 428291 - protein, 9 aa, Homo Sapiens
INKYLDQEK

SEQ ID NO: 428292 - protein, 9 aa, Homo Sapiens
TLNIHSSPF

SEQ ID NO: 428293 - protein, 9 aa, Homo Sapiens
ISSRSQFSA

SEQ ID NO: 428294 - protein, 9 aa, Homo Sapiens
YIALPGHTP

SEQ ID NO: 428295 - protein, 9 aa, Homo Sapiens
HGNERCIQY

SEQ ID NO: 428296 - protein, 9 aa, Homo Sapiens
SVIPGKAAK

SEQ ID NO: 428297 - protein, 9 aa, Homo Sapiens
DALATKGHL

SEQ ID NO: 428298 - protein, 9 aa, Homo Sapiens
ELRQKCKDY

SEQ ID NO: 428299 - protein, 9 aa, Homo Sapiens
NDMDEQQNV

SEQ ID NO: 428300 - protein, 9 aa, Homo Sapiens
PLTRRRTVS

SEQ ID NO: 428301 - protein, 9 aa, Homo Sapiens
LFDDERRNI

SEQ ID NO: 428302 - protein, 9 aa, Homo Sapiens
VYMFYTLGI

SEQ ID NO: 428303 - protein, 9 aa, Homo Sapiens
WAPPSVPSH

SEQ ID NO: 428304 - protein, 9 aa, Homo Sapiens
DAAYVIQGL

SEQ ID NO: 428305 - protein, 9 aa, Homo Sapiens
NVAALDTEV

SEQ ID NO: 428306 - protein, 9 aa, Homo Sapiens
IGFTLSENM

SEQ ID NO: 428307 - protein, 9 aa, Homo Sapiens
ELCHMWLRP

SEQ ID NO: 428308 - protein, 9 aa, Homo Sapiens
AFVSTKITS

SEQ ID NO: 428309 - protein, 9 aa, Homo Sapiens
AAPMEDSWL

SEQ ID NO: 428310 - protein, 9 aa, Homo Sapiens
RINPDAWEF

SEQ ID NO: 428311 - protein, 9 aa, Homo Sapiens
ESVKYQNQH

SEQ ID NO: 428312 - protein, 9 aa, Homo Sapiens
LLQPSQHPK

SEQ ID NO: 428313 - protein, 9 aa, Homo Sapiens
TPLFFTRVR

SEQ ID NO: 428314 - protein, 9 aa, Homo Sapiens
RAQKDVASL

SEQ ID NO: 428315 - protein, 9 aa, Homo Sapiens
FRNAIGNFA

SEQ ID NO: 428316 - protein, 9 aa, Homo Sapiens
VLYGEPAGT

SEQ ID NO: 428317 - protein, 9 aa, Homo Sapiens
YCTAVCIEN

SEQ ID NO: 428318 - protein, 9 aa, Homo Sapiens
HALLLIAQK

SEQ ID NO: 428319 - protein, 9 aa, Homo Sapiens
DNNFSLNLG

SEQ ID NO: 428320 - protein, 9 aa, Homo Sapiens
TWALETDST

SEQ ID NO: 428321 - protein, 9 aa, Homo Sapiens
SPLTNQLGK

SEQ ID NO: 428322 - protein, 9 aa, Homo Sapiens
QMCGIHRDT

SEQ ID NO: 428323 - protein, 9 aa, Homo Sapiens
KAPLTDIEN

SEQ ID NO: 428324 - protein, 9 aa, Homo Sapiens
RCQSKVSYL

SEQ ID NO: 428325 - protein, 9 aa, Homo Sapiens
QYFEDPRVA

SEQ ID NO: 428326 - protein, 9 aa, Homo Sapiens
DNKLSTTEP

SEQ ID NO: 428327 - protein, 9 aa, Homo Sapiens
SESSTQSDV

SEQ ID NO: 428328 - protein, 9 aa, Homo Sapiens
SVMSDIRNP

SEQ ID NO: 428329 - protein, 9 aa, Homo Sapiens
RFSVMYADG

SEQ ID NO: 428330 - protein, 9 aa, Homo Sapiens
KPAKTANKC

SEQ ID NO: 428331 - protein, 9 aa, Homo Sapiens
VFTEQAEQE

SEQ ID NO: 428332 - protein, 9 aa, Homo Sapiens
DLLHGEKVH

SEQ ID NO: 428333 - protein, 9 aa, Homo Sapiens
VLDIDLHVQ

SEQ ID NO: 428334 - protein, 9 aa, Homo Sapiens
VVSGVGIWI

SEQ ID NO: 428335 - protein, 9 aa, Homo Sapiens
LFGRAFNMF

SEQ ID NO: 428336 - protein, 9 aa, Homo Sapiens
PNYMEKGCH

SEQ ID NO: 428337 - protein, 9 aa, Homo Sapiens
LIINETPLL

SEQ ID NO: 428338 - protein, 9 aa, Homo Sapiens
EGLAHMELF

SEQ ID NO: 428339 - protein, 9 aa, Homo Sapiens
LKSLGEETQ

SEQ ID NO: 428340 - protein, 9 aa, Homo Sapiens
MRCDKGNEV

SEQ ID NO: 428341 - protein, 9 aa, Homo Sapiens
KLNKTPFHL

SEQ ID NO: 428342 - protein, 9 aa, Homo Sapiens
GGSPAQRRC

SEQ ID NO: 428343 - protein, 9 aa, Homo Sapiens
AIKNTDDRE

SEQ ID NO: 428344 - protein, 9 aa, Homo Sapiens
RQAAGNYIE

SEQ ID NO: 428345 - protein, 9 aa, Homo Sapiens
TTENINNTF

SEQ ID NO: 428346 - protein, 9 aa, Homo Sapiens
QKPQSHFTT

SEQ ID NO: 428347 - protein, 9 aa, Homo Sapiens
RDYITLGVE

SEQ ID NO: 428348 - protein, 9 aa, Homo Sapiens
SPLWKKRSA

SEQ ID NO: 428349 - protein, 9 aa, Homo Sapiens
CGPGAMSAT

SEQ ID NO: 428350 - protein, 9 aa, Homo Sapiens
LQCLEEKLK

SEQ ID NO: 428351 - protein, 9 aa, Homo Sapiens
KRKFDDIQI

SEQ ID NO: 428352 - protein, 9 aa, Homo Sapiens
ASTANTQTP

SEQ ID NO: 428353 - protein, 9 aa, Homo Sapiens
NNRSTVFQI

SEQ ID NO: 428354 - protein, 9 aa, Homo Sapiens
LIRLWRVAR

SEQ ID NO: 428355 - protein, 9 aa, Homo Sapiens
CSGDQTPSD

SEQ ID NO: 428356 - protein, 9 aa, Homo Sapiens
SSKDIWAAC

SEQ ID NO: 428357 - protein, 9 aa, Homo Sapiens
KRTAAENEV

SEQ ID NO: 428358 - protein, 9 aa, Homo Sapiens
TKSDLKHTS

SEQ ID NO: 428359 - protein, 9 aa, Homo Sapiens
NATENCFSV

SEQ ID NO: 428360 - protein, 9 aa, Homo Sapiens
EEINRFTET

SEQ ID NO: 428361 - protein, 9 aa, Homo Sapiens
FIDMERKID

SEQ ID NO: 428362 - protein, 9 aa, Homo Sapiens
TFLDNIVRR

SEQ ID NO: 428363 - protein, 9 aa, Homo Sapiens
FIKIMIIFS

SEQ ID NO: 428364 - protein, 9 aa, Homo Sapiens
QKTGLITPK

SEQ ID NO: 428365 - protein, 9 aa, Homo Sapiens
VNFTQDEWA

SEQ ID NO: 428366 - protein, 9 aa, Homo Sapiens
FQNCEFKAT

SEQ ID NO: 428367 - protein, 9 aa, Homo Sapiens
SECLIHKCC

SEQ ID NO: 428368 - protein, 9 aa, Homo Sapiens
TIKICKNSS

SEQ ID NO: 428369 - protein, 9 aa, Homo Sapiens
NTWSPKWLH

SEQ ID NO: 428370 - protein, 9 aa, Homo Sapiens
FRIAAKYQI

SEQ ID NO: 428371 - protein, 9 aa, Homo Sapiens
LYPKSIQDI

SEQ ID NO: 428372 - protein, 9 aa, Homo Sapiens
NGAESNNYE

SEQ ID NO: 428373 - protein, 9 aa, Homo Sapiens
IIHTGEKPL

SEQ ID NO: 428374 - protein, 9 aa, Homo Sapiens
IKPSATAQG

SEQ ID NO: 428375 - protein, 9 aa, Homo Sapiens
SIPSMMTPP

SEQ ID NO: 428376 - protein, 9 aa, Homo Sapiens
YPSSQATEW

SEQ ID NO: 428377 - protein, 9 aa, Homo Sapiens
HTYLLSAND

SEQ ID NO: 428378 - protein, 9 aa, Homo Sapiens
DFLIDGGNE

SEQ ID NO: 428379 - protein, 9 aa, Homo Sapiens
LQKHMIGIC

SEQ ID NO: 428380 - protein, 9 aa, Homo Sapiens
LSITDISLL

SEQ ID NO: 428381 - protein, 9 aa, Homo Sapiens
KLKDVYGKS

SEQ ID NO: 428382 - protein, 9 aa, Homo Sapiens
LCHMWLRPD

SEQ ID NO: 428383 - protein, 9 aa, Homo Sapiens
CQTAAEGDT

SEQ ID NO: 428384 - protein, 9 aa, Homo Sapiens
ACAGPHHAQ

SEQ ID NO: 428385 - protein, 9 aa, Homo Sapiens
KFAVALYGL

SEQ ID NO: 428386 - protein, 9 aa, Homo Sapiens
AEDERLGCD

SEQ ID NO: 428387 - protein, 9 aa, Homo Sapiens
YTEDLLRVF

SEQ ID NO: 428388 - protein, 9 aa, Homo Sapiens
LFSELEFGK

SEQ ID NO: 428389 - protein, 9 aa, Homo Sapiens
NIFHFGEST

SEQ ID NO: 428390 - protein, 9 aa, Homo Sapiens
LNPLYSSKS

SEQ ID NO: 428391 - protein, 9 aa, Homo Sapiens
CQVNEWSFF

SEQ ID NO: 428392 - protein, 9 aa, Homo Sapiens
RFLLTGPPQ

SEQ ID NO: 428393 - protein, 9 aa, Homo Sapiens
GCYKCLRTV

SEQ ID NO: 428394 - protein, 9 aa, Homo Sapiens
TNDDPECGV

SEQ ID NO: 428395 - protein, 9 aa, Homo Sapiens
STFTYHKIT

SEQ ID NO: 428396 - protein, 9 aa, Homo Sapiens
YSSTKIVEG

SEQ ID NO: 428397 - protein, 9 aa, Homo Sapiens
CGLPDRNTF

SEQ ID NO: 428398 - protein, 9 aa, Homo Sapiens
LDRNVPTPR

SEQ ID NO: 428399 - protein, 9 aa, Homo Sapiens
SRVLRPLRL

SEQ ID NO: 428400 - protein, 9 aa, Homo Sapiens
VVMFVQTEM

SEQ ID NO: 428401 - protein, 9 aa, Homo Sapiens
DCNSTPSTG

SEQ ID NO: 428402 - protein, 9 aa, Homo Sapiens
ATYDTGGKD

SEQ ID NO: 428403 - protein, 9 aa, Homo Sapiens
VRVDFWWCR

SEQ ID NO: 428404 - protein, 9 aa, Homo Sapiens
ALYGLIEEK

SEQ ID NO: 428405 - protein, 9 aa, Homo Sapiens
HKPEQGYLA

SEQ ID NO: 428406 - protein, 9 aa, Homo Sapiens
YQEVTSVCW

SEQ ID NO: 428407 - protein, 9 aa, Homo Sapiens
VSVKREYVA

SEQ ID NO: 428408 - protein, 9 aa, Homo Sapiens
LQPSPGMTR

SEQ ID NO: 428409 - protein, 9 aa, Homo Sapiens
CMKKCISAN

SEQ ID NO: 428410 - protein, 9 aa, Homo Sapiens
GASASTANT

SEQ ID NO: 428411 - protein, 9 aa, Homo Sapiens
DCQECMKKC

SEQ ID NO: 428412 - protein, 9 aa, Homo Sapiens
IAEEEELMM

SEQ ID NO: 428413 - protein, 9 aa, Homo Sapiens
ASQAGVQFG

SEQ ID NO: 428414 - protein, 9 aa, Homo Sapiens
RQAPTKLVG

SEQ ID NO: 428415 - protein, 9 aa, Homo Sapiens
TFKSVAFPG

SEQ ID NO: 428416 - protein, 9 aa, Homo Sapiens
DRACDKILS

SEQ ID NO: 428417 - protein, 9 aa, Homo Sapiens
NQIKAKPVN

SEQ ID NO: 428418 - protein, 9 aa, Homo Sapiens
HRYSAPPMD

SEQ ID NO: 428419 - protein, 9 aa, Homo Sapiens
TVYGLNKFR

SEQ ID NO: 428420 - protein, 9 aa, Homo Sapiens
TELNNNMEM

SEQ ID NO: 428421 - protein, 9 aa, Homo Sapiens
TRYDTLFQA

SEQ ID NO: 428422 - protein, 9 aa, Homo Sapiens
QQCSGTPSS

SEQ ID NO: 428423 - protein, 9 aa, Homo Sapiens
RPGANKVMN

SEQ ID NO: 428424 - protein, 9 aa, Homo Sapiens
KEMKNYIFA

SEQ ID NO: 428425 - protein, 9 aa, Homo Sapiens
IFPHFYFLS

SEQ ID NO: 428426 - protein, 9 aa, Homo Sapiens
FENYHKLWR

SEQ ID NO: 428427 - protein, 9 aa, Homo Sapiens
EGNQRHSSL

SEQ ID NO: 428428 - protein, 9 aa, Homo Sapiens
DRDPSETVS

SEQ ID NO: 428429 - protein, 9 aa, Homo Sapiens
ADLITCKTR

SEQ ID NO: 428430 - protein, 9 aa, Homo Sapiens
VQARYFSDS

SEQ ID NO: 428431 - protein, 9 aa, Homo Sapiens
KVYFKQFCI

SEQ ID NO: 428432 - protein, 9 aa, Homo Sapiens
RSQSRSRDR

SEQ ID NO: 428433 - protein, 9 aa, Homo Sapiens
IVHQQIHTG

SEQ ID NO: 428434 - protein, 9 aa, Homo Sapiens
LANLSIADA

SEQ ID NO: 428435 - protein, 9 aa, Homo Sapiens
QGTRARCCL

SEQ ID NO: 428436 - protein, 9 aa, Homo Sapiens
KGADSTGSP

SEQ ID NO: 428437 - protein, 9 aa, Homo Sapiens
NHFYFHTTQ

SEQ ID NO: 428438 - protein, 9 aa, Homo Sapiens
CVRKLEFIF

SEQ ID NO: 428439 - protein, 9 aa, Homo Sapiens
RNTLPARLD

SEQ ID NO: 428440 - protein, 9 aa, Homo Sapiens
HKKRSSRKN

SEQ ID NO: 428441 - protein, 9 aa, Homo Sapiens
GRGCTEPNH

SEQ ID NO: 428442 - protein, 9 aa, Homo Sapiens
HYQTLVRQF

SEQ ID NO: 428443 - protein, 9 aa, Homo Sapiens
ELSSDAFHL

SEQ ID NO: 428444 - protein, 9 aa, Homo Sapiens
GDAINHLDD

SEQ ID NO: 428445 - protein, 9 aa, Homo Sapiens
YLGQKVAVN

SEQ ID NO: 428446 - protein, 9 aa, Homo Sapiens
GTCHICKMP

SEQ ID NO: 428447 - protein, 9 aa, Homo Sapiens
GTYDGSLDA

SEQ ID NO: 428448 - protein, 9 aa, Homo Sapiens
TEKLEVIRK

SEQ ID NO: 428449 - protein, 9 aa, Homo Sapiens
KANIVFLVD

SEQ ID NO: 428450 - protein, 9 aa, Homo Sapiens
AHGHLWAYS

SEQ ID NO: 428451 - protein, 9 aa, Homo Sapiens
KMTKIICKW

SEQ ID NO: 428452 - protein, 9 aa, Homo Sapiens
LFNLCSRRF

SEQ ID NO: 428453 - protein, 9 aa, Homo Sapiens
LRSASQGAL

SEQ ID NO: 428454 - protein, 9 aa, Homo Sapiens
EEEFIPLVQ

SEQ ID NO: 428455 - protein, 9 aa, Homo Sapiens
EYSPSRIRK

SEQ ID NO: 428456 - protein, 9 aa, Homo Sapiens
PALGVIQLH

SEQ ID NO: 428457 - protein, 9 aa, Homo Sapiens
DAELDKLRN

SEQ ID NO: 428458 - protein, 9 aa, Homo Sapiens
YYVSPIAYE

SEQ ID NO: 428459 - protein, 9 aa, Homo Sapiens
ARYFSDSSP

SEQ ID NO: 428460 - protein, 9 aa, Homo Sapiens
KLCLLCQDN

SEQ ID NO: 428461 - protein, 9 aa, Homo Sapiens
AFRHKQINP

SEQ ID NO: 428462 - protein, 9 aa, Homo Sapiens
ARDTLTLEM

SEQ ID NO: 428463 - protein, 9 aa, Homo Sapiens
NSPRFPQPN

SEQ ID NO: 428464 - protein, 9 aa, Homo Sapiens
INEPTPNYK

SEQ ID NO: 428465 - protein, 9 aa, Homo Sapiens
PWVKRLFLH

SEQ ID NO: 428466 - protein, 9 aa, Homo Sapiens
SGLLVLTLL

SEQ ID NO: 428467 - protein, 9 aa, Homo Sapiens
RICHVKCHR

SEQ ID NO: 428468 - protein, 9 aa, Homo Sapiens
NTYLCWMLW

SEQ ID NO: 428469 - protein, 9 aa, Homo Sapiens
KAFVSTKIT

SEQ ID NO: 428470 - protein, 9 aa, Homo Sapiens
NTPSERLLY

SEQ ID NO: 428471 - protein, 9 aa, Homo Sapiens
EYFVLVAET

SEQ ID NO: 428472 - protein, 9 aa, Homo Sapiens
LLDQEGNQR

SEQ ID NO: 428473 - protein, 9 aa, Homo Sapiens
SQVAQGMVF

SEQ ID NO: 428474 - protein, 9 aa, Homo Sapiens
QLEALKAVF

SEQ ID NO: 428475 - protein, 9 aa, Homo Sapiens
EITSVPCSR

SEQ ID NO: 428476 - protein, 9 aa, Homo Sapiens
TTANEKLEW

SEQ ID NO: 428477 - protein, 9 aa, Homo Sapiens
NPQYIFKVK

SEQ ID NO: 428478 - protein, 9 aa, Homo Sapiens
QIEPTITRI

SEQ ID NO: 428479 - protein, 9 aa, Homo Sapiens
VEDGEPWLI

SEQ ID NO: 428480 - protein, 9 aa, Homo Sapiens
NYKVDSPNN

SEQ ID NO: 428481 - protein, 9 aa, Homo Sapiens
AKKGMIVIT

SEQ ID NO: 428482 - protein, 9 aa, Homo Sapiens
CYICGCEYG

SEQ ID NO: 428483 - protein, 9 aa, Homo Sapiens
NQCGKAFHQ

SEQ ID NO: 428484 - protein, 9 aa, Homo Sapiens
YKDVYVKDV

SEQ ID NO: 428485 - protein, 9 aa, Homo Sapiens
TLVQVRHHW

SEQ ID NO: 428486 - protein, 9 aa, Homo Sapiens
PASTFQKAP

SEQ ID NO: 428487 - protein, 9 aa, Homo Sapiens
RTTSLKEGT

SEQ ID NO: 428488 - protein, 9 aa, Homo Sapiens
KESMLKNDT

SEQ ID NO: 428489 - protein, 9 aa, Homo Sapiens
EHFYLTALS

SEQ ID NO: 428490 - protein, 9 aa, Homo Sapiens
IFLGRPIIW

SEQ ID NO: 428491 - protein, 9 aa, Homo Sapiens
PRYPSPPLP

SEQ ID NO: 428492 - protein, 9 aa, Homo Sapiens
LGLWAWDCL

SEQ ID NO: 428493 - protein, 9 aa, Homo Sapiens
VRDRSDFNI

SEQ ID NO: 428494 - protein, 9 aa, Homo Sapiens
TKNNKQKTP

SEQ ID NO: 428495 - protein, 9 aa, Homo Sapiens
FLAINYNSN

SEQ ID NO: 428496 - protein, 9 aa, Homo Sapiens
SELFNRWKS

SEQ ID NO: 428497 - protein, 9 aa, Homo Sapiens
QGHIAKMPV

SEQ ID NO: 428498 - protein, 9 aa, Homo Sapiens
VASFIKKPF

SEQ ID NO: 428499 - protein, 9 aa, Homo Sapiens
EDHITHKTI

SEQ ID NO: 428500 - protein, 9 aa, Homo Sapiens
ELYSYVKDL

SEQ ID NO: 428501 - protein, 9 aa, Homo Sapiens
WASAPSPED

SEQ ID NO: 428502 - protein, 9 aa, Homo Sapiens
VWGDYGGSG

SEQ ID NO: 428503 - protein, 9 aa, Homo Sapiens
SSFLSQCGR

SEQ ID NO: 428504 - protein, 9 aa, Homo Sapiens
MTFDQKRDA

SEQ ID NO: 428505 - protein, 9 aa, Homo Sapiens
SKSHRFTVL

SEQ ID NO: 428506 - protein, 9 aa, Homo Sapiens
CYQFTFTFA

SEQ ID NO: 428507 - protein, 9 aa, Homo Sapiens
APLARAESY

SEQ ID NO: 428508 - protein, 9 aa, Homo Sapiens
EHLSVVDAT

SEQ ID NO: 428509 - protein, 9 aa, Homo Sapiens
DMINGLFDQ

SEQ ID NO: 428510 - protein, 9 aa, Homo Sapiens
VKEAENLNK

SEQ ID NO: 428511 - protein, 9 aa, Homo Sapiens
AQGYHQITL

SEQ ID NO: 428512 - protein, 9 aa, Homo Sapiens
DEAKQYRKM

SEQ ID NO: 428513 - protein, 9 aa, Homo Sapiens
WGYFDTFIS

SEQ ID NO: 428514 - protein, 9 aa, Homo Sapiens
PYAGIKNAE

SEQ ID NO: 428515 - protein, 9 aa, Homo Sapiens
KPRQYNEQE

SEQ ID NO: 428516 - protein, 9 aa, Homo Sapiens
VIMCVCVED

SEQ ID NO: 428517 - protein, 9 aa, Homo Sapiens
IRGVFVNVD

SEQ ID NO: 428518 - protein, 9 aa, Homo Sapiens
IGVLGGVAS

SEQ ID NO: 428519 - protein, 9 aa, Homo Sapiens
SSGTEQTGG

SEQ ID NO: 428520 - protein, 9 aa, Homo Sapiens
TFDINTGAW

SEQ ID NO: 428521 - protein, 9 aa, Homo Sapiens
EKTMIYFVG

SEQ ID NO: 428522 - protein, 9 aa, Homo Sapiens
QKGVELAHH

SEQ ID NO: 428523 - protein, 9 aa, Homo Sapiens
TARYFTRKR

SEQ ID NO: 428524 - protein, 9 aa, Homo Sapiens
EKCLNEIQG

SEQ ID NO: 428525 - protein, 9 aa, Homo Sapiens
ELQAWHAGQ

SEQ ID NO: 428526 - protein, 9 aa, Homo Sapiens
LCCVQTAHN

SEQ ID NO: 428527 - protein, 9 aa, Homo Sapiens
AKVVADTIS

SEQ ID NO: 428528 - protein, 9 aa, Homo Sapiens
LPPLRQGEV

SEQ ID NO: 428529 - protein, 9 aa, Homo Sapiens
EDRYVNDPM

SEQ ID NO: 428530 - protein, 9 aa, Homo Sapiens
YSGLKYSME

SEQ ID NO: 428531 - protein, 9 aa, Homo Sapiens
IQYFVRGHF

SEQ ID NO: 428532 - protein, 9 aa, Homo Sapiens
CWLWESYLE

SEQ ID NO: 428533 - protein, 9 aa, Homo Sapiens
DTKYLEIIY

SEQ ID NO: 428534 - protein, 9 aa, Homo Sapiens
RRYKVLREI

SEQ ID NO: 428535 - protein, 9 aa, Homo Sapiens
EQQRQKEQN

SEQ ID NO: 428536 - protein, 9 aa, Homo Sapiens
MGRGKHQAT

SEQ ID NO: 428537 - protein, 9 aa, Homo Sapiens
AFENPHAST

SEQ ID NO: 428538 - protein, 9 aa, Homo Sapiens
HKVNIKLSN

SEQ ID NO: 428539 - protein, 9 aa, Homo Sapiens
LFFLTSSSC

SEQ ID NO: 428540 - protein, 9 aa, Homo Sapiens
FILLGFPTH

SEQ ID NO: 428541 - protein, 9 aa, Homo Sapiens
CSAPANLGY

SEQ ID NO: 428542 - protein, 9 aa, Homo Sapiens
GDGLQLEYD

SEQ ID NO: 428543 - protein, 9 aa, Homo Sapiens
LDHEKEIIL

SEQ ID NO: 428544 - protein, 9 aa, Homo Sapiens
TKHTDELTS

SEQ ID NO: 428545 - protein, 9 aa, Homo Sapiens
FTTFTPRQQ

SEQ ID NO: 428546 - protein, 9 aa, Homo Sapiens
KELIGKYAV

SEQ ID NO: 428547 - protein, 9 aa, Homo Sapiens
EAATEPESY

SEQ ID NO: 428548 - protein, 9 aa, Homo Sapiens
LYPVASLSN

SEQ ID NO: 428549 - protein, 9 aa, Homo Sapiens
FRNNKAKDV

SEQ ID NO: 428550 - protein, 9 aa, Homo Sapiens
IRLWRVARI

SEQ ID NO: 428551 - protein, 9 aa, Homo Sapiens
VCYGTCQPT

SEQ ID NO: 428552 - protein, 9 aa, Homo Sapiens
ERHLPQGSL

SEQ ID NO: 428553 - protein, 9 aa, Homo Sapiens
HGLSYKVKP

SEQ ID NO: 428554 - protein, 9 aa, Homo Sapiens
ETERNLQII

SEQ ID NO: 428555 - protein, 9 aa, Homo Sapiens
DIKFILEKL

SEQ ID NO: 428556 - protein, 9 aa, Homo Sapiens
TNQEQVTIF

SEQ ID NO: 428557 - protein, 9 aa, Homo Sapiens
YTIYKILCK

SEQ ID NO: 428558 - protein, 9 aa, Homo Sapiens
STHAHLSLP

SEQ ID NO: 428559 - protein, 9 aa, Homo Sapiens
NLLSTLAQN

SEQ ID NO: 428560 - protein, 9 aa, Homo Sapiens
TFVLHTIVQ

SEQ ID NO: 428561 - protein, 9 aa, Homo Sapiens
QEKDYLITP

SEQ ID NO: 428562 - protein, 9 aa, Homo Sapiens
QYKLGDKLH

SEQ ID NO: 428563 - protein, 9 aa, Homo Sapiens
NRVLKYPKQ

SEQ ID NO: 428564 - protein, 9 aa, Homo Sapiens
FNCLCETVF

SEQ ID NO: 428565 - protein, 9 aa, Homo Sapiens
KRKVLSSSP

SEQ ID NO: 428566 - protein, 9 aa, Homo Sapiens
STDAFKKIG

SEQ ID NO: 428567 - protein, 9 aa, Homo Sapiens
LEKDILSLY

SEQ ID NO: 428568 - protein, 9 aa, Homo Sapiens
SANSFQAGY

SEQ ID NO: 428569 - protein, 9 aa, Homo Sapiens
ILHLKRYSV

SEQ ID NO: 428570 - protein, 9 aa, Homo Sapiens
FQKSMDSIG

SEQ ID NO: 428571 - protein, 9 aa, Homo Sapiens
FFLVQRLIQ

SEQ ID NO: 428572 - protein, 9 aa, Homo Sapiens
YLFKLLDCL

SEQ ID NO: 428573 - protein, 9 aa, Homo Sapiens
SHEDKSPMK

SEQ ID NO: 428574 - protein, 9 aa, Homo Sapiens
GMQCIISGW

SEQ ID NO: 428575 - protein, 9 aa, Homo Sapiens
SRAAGQVAA

SEQ ID NO: 428576 - protein, 9 aa, Homo Sapiens
QHLRQRRMH

SEQ ID NO: 428577 - protein, 9 aa, Homo Sapiens
ASLVLKILG

SEQ ID NO: 428578 - protein, 9 aa, Homo Sapiens
MEAVRGSLN

SEQ ID NO: 428579 - protein, 9 aa, Homo Sapiens
RRWLPAEDA

SEQ ID NO: 428580 - protein, 9 aa, Homo Sapiens
SKPSEEVNK

SEQ ID NO: 428581 - protein, 9 aa, Homo Sapiens
NPDRDPGDC

SEQ ID NO: 428582 - protein, 9 aa, Homo Sapiens
EEQGKISEG

SEQ ID NO: 428583 - protein, 9 aa, Homo Sapiens
AARKLICDI

SEQ ID NO: 428584 - protein, 9 aa, Homo Sapiens
RLCYIQPCN

SEQ ID NO: 428585 - protein, 9 aa, Homo Sapiens
KSKSKTILV

SEQ ID NO: 428586 - protein, 9 aa, Homo Sapiens
IWEIKISQV

SEQ ID NO: 428587 - protein, 9 aa, Homo Sapiens
YHKESDIEN

SEQ ID NO: 428588 - protein, 9 aa, Homo Sapiens
VRALIVVIP

SEQ ID NO: 428589 - protein, 9 aa, Homo Sapiens
WSRVYLHTL

SEQ ID NO: 428590 - protein, 9 aa, Homo Sapiens
GHQLNHFFC

SEQ ID NO: 428591 - protein, 9 aa, Homo Sapiens
AFEGDDGLC

SEQ ID NO: 428592 - protein, 9 aa, Homo Sapiens
VWQLQELRR

SEQ ID NO: 428593 - protein, 9 aa, Homo Sapiens
FILQTYMPY

SEQ ID NO: 428594 - protein, 9 aa, Homo Sapiens
QLRVFVYCT

SEQ ID NO: 428595 - protein, 9 aa, Homo Sapiens
PKDKETNIN

SEQ ID NO: 428596 - protein, 9 aa, Homo Sapiens
KFSHSDRHN

SEQ ID NO: 428597 - protein, 9 aa, Homo Sapiens
SVVQFLFYQ

SEQ ID NO: 428598 - protein, 9 aa, Homo Sapiens
RSRHENASQ

SEQ ID NO: 428599 - protein, 9 aa, Homo Sapiens
VRAGLIAIF

SEQ ID NO: 428600 - protein, 9 aa, Homo Sapiens
YKQENELSD

SEQ ID NO: 428601 - protein, 9 aa, Homo Sapiens
TPHLQLIEG

SEQ ID NO: 428602 - protein, 9 aa, Homo Sapiens
SLRTAMSNR

SEQ ID NO: 428603 - protein, 9 aa, Homo Sapiens
HMVRKWHLG

SEQ ID NO: 428604 - protein, 9 aa, Homo Sapiens
NFWVTILPA

SEQ ID NO: 428605 - protein, 9 aa, Homo Sapiens
EYTGLRCIW

SEQ ID NO: 428606 - protein, 9 aa, Homo Sapiens
NTKIRDIQA

SEQ ID NO: 428607 - protein, 9 aa, Homo Sapiens
TDSLQEVLP

SEQ ID NO: 428608 - protein, 9 aa, Homo Sapiens
WKGDCNFAL

SEQ ID NO: 428609 - protein, 9 aa, Homo Sapiens
RNKEMDSDQ

SEQ ID NO: 428610 - protein, 9 aa, Homo Sapiens
SLNIRKEMR

SEQ ID NO: 428611 - protein, 9 aa, Homo Sapiens
SWQTDIPPH

SEQ ID NO: 428612 - protein, 9 aa, Homo Sapiens
ELARIKIFE

SEQ ID NO: 428613 - protein, 9 aa, Homo Sapiens
EGSAIAIAV

SEQ ID NO: 428614 - protein, 9 aa, Homo Sapiens
HRDTKKMFC

SEQ ID NO: 428615 - protein, 9 aa, Homo Sapiens
NTSKAVHEP

SEQ ID NO: 428616 - protein, 9 aa, Homo Sapiens
QCKESMLKN

SEQ ID NO: 428617 - protein, 9 aa, Homo Sapiens
YYKSKYGID

SEQ ID NO: 428618 - protein, 9 aa, Homo Sapiens
KEMHIINEG

SEQ ID NO: 428619 - protein, 9 aa, Homo Sapiens
SSQNSLDNF

SEQ ID NO: 428620 - protein, 9 aa, Homo Sapiens
THYAPPRKL

SEQ ID NO: 428621 - protein, 9 aa, Homo Sapiens
YITGGRARM

SEQ ID NO: 428622 - protein, 9 aa, Homo Sapiens
LVGVATDGA

SEQ ID NO: 428623 - protein, 9 aa, Homo Sapiens
SDILVAWKH

SEQ ID NO: 428624 - protein, 9 aa, Homo Sapiens
ECKLICQFQ

SEQ ID NO: 428625 - protein, 9 aa, Homo Sapiens
PSLPIPGQF

SEQ ID NO: 428626 - protein, 9 aa, Homo Sapiens
IELTARYFT

SEQ ID NO: 428627 - protein, 9 aa, Homo Sapiens
QILLLGPIG

SEQ ID NO: 428628 - protein, 9 aa, Homo Sapiens
VPEFILVGY

SEQ ID NO: 428629 - protein, 9 aa, Homo Sapiens
LRSVTGRSR

SEQ ID NO: 428630 - protein, 9 aa, Homo Sapiens
RVHTEISPY

SEQ ID NO: 428631 - protein, 9 aa, Homo Sapiens
RDIVNINIS

SEQ ID NO: 428632 - protein, 9 aa, Homo Sapiens
CQKPNYMEK

SEQ ID NO: 428633 - protein, 9 aa, Homo Sapiens
RLQGKLLQN

SEQ ID NO: 428634 - protein, 9 aa, Homo Sapiens
IKIMSFVME

SEQ ID NO: 428635 - protein, 9 aa, Homo Sapiens
NEQSKFVCN

SEQ ID NO: 428636 - protein, 9 aa, Homo Sapiens
RNLPADIKK

SEQ ID NO: 428637 - protein, 9 aa, Homo Sapiens
WERVRFQVD

SEQ ID NO: 428638 - protein, 9 aa, Homo Sapiens
KCIPCSWIG

SEQ ID NO: 428639 - protein, 9 aa, Homo Sapiens
TGEKLHECM

SEQ ID NO: 428640 - protein, 9 aa, Homo Sapiens
SENTHRRET

SEQ ID NO: 428641 - protein, 9 aa, Homo Sapiens
PLLSWGPNF

SEQ ID NO: 428642 - protein, 9 aa, Homo Sapiens
VIWEIKISQ

SEQ ID NO: 428643 - protein, 9 aa, Homo Sapiens
CLVFKPAMP

SEQ ID NO: 428644 - protein, 9 aa, Homo Sapiens
LSPLSDTIF

SEQ ID NO: 428645 - protein, 9 aa, Homo Sapiens
SPCCGGATC

SEQ ID NO: 428646 - protein, 9 aa, Homo Sapiens
TPSDNPSLE

SEQ ID NO: 428647 - protein, 9 aa, Homo Sapiens
HCKRINVIT

SEQ ID NO: 428648 - protein, 9 aa, Homo Sapiens
KVKKRNTYS

SEQ ID NO: 428649 - protein, 9 aa, Homo Sapiens
EENLFKRLM

SEQ ID NO: 428650 - protein, 9 aa, Homo Sapiens
HFLVILIST

SEQ ID NO: 428651 - protein, 9 aa, Homo Sapiens
IANIGHLVE

SEQ ID NO: 428652 - protein, 9 aa, Homo Sapiens
LKKDMKEKT

SEQ ID NO: 428653 - protein, 9 aa, Homo Sapiens
IEDTPIDTF

SEQ ID NO: 428654 - protein, 9 aa, Homo Sapiens
LEGVPECRD

SEQ ID NO: 428655 - protein, 9 aa, Homo Sapiens
NPHPYVKAS

SEQ ID NO: 428656 - protein, 9 aa, Homo Sapiens
CSGLFPSTT

SEQ ID NO: 428657 - protein, 9 aa, Homo Sapiens
ESRKEINER

SEQ ID NO: 428658 - protein, 9 aa, Homo Sapiens
KHKVNIKLS

SEQ ID NO: 428659 - protein, 9 aa, Homo Sapiens
VTYPIKMKI

SEQ ID NO: 428660 - protein, 9 aa, Homo Sapiens
KKFYSKCLR

SEQ ID NO: 428661 - protein, 9 aa, Homo Sapiens
NSGSRYDAK

SEQ ID NO: 428662 - protein, 9 aa, Homo Sapiens
AGEEQDLNV

SEQ ID NO: 428663 - protein, 9 aa, Homo Sapiens
GSRQHYCHE

SEQ ID NO: 428664 - protein, 9 aa, Homo Sapiens
FFLSSLSFM

SEQ ID NO: 428665 - protein, 9 aa, Homo Sapiens
KAMAAVSTQ

SEQ ID NO: 428666 - protein, 9 aa, Homo Sapiens
LDNFSSEII

SEQ ID NO: 428667 - protein, 9 aa, Homo Sapiens
SVKAFKLFQ

SEQ ID NO: 428668 - protein, 9 aa, Homo Sapiens
LKLDLKDSQ

SEQ ID NO: 428669 - protein, 9 aa, Homo Sapiens
NKGDIHGAF

SEQ ID NO: 428670 - protein, 9 aa, Homo Sapiens
VSLPGIRGT

SEQ ID NO: 428671 - protein, 9 aa, Homo Sapiens
LYGEVPENR

SEQ ID NO: 428672 - protein, 9 aa, Homo Sapiens
ALFASQFLN

SEQ ID NO: 428673 - protein, 9 aa, Homo Sapiens
LINLQPLIQ

SEQ ID NO: 428674 - protein, 9 aa, Homo Sapiens
QVAVASVLI

SEQ ID NO: 428675 - protein, 9 aa, Homo Sapiens
TSKFNDAAP

SEQ ID NO: 428676 - protein, 9 aa, Homo Sapiens
IMGRGEKAI

SEQ ID NO: 428677 - protein, 9 aa, Homo Sapiens
KSLCMFKIP

SEQ ID NO: 428678 - protein, 9 aa, Homo Sapiens
WEIKFGFEI

SEQ ID NO: 428679 - protein, 9 aa, Homo Sapiens
KIKIMSFVM

SEQ ID NO: 428680 - protein, 9 aa, Homo Sapiens
RWWQLQYSN

SEQ ID NO: 428681 - protein, 9 aa, Homo Sapiens
QVYSPGYYI

SEQ ID NO: 428682 - protein, 9 aa, Homo Sapiens
PFKGGPPRQ

SEQ ID NO: 428683 - protein, 9 aa, Homo Sapiens
PQSHFTTPA

SEQ ID NO: 428684 - protein, 9 aa, Homo Sapiens
KYNLYGKYM

SEQ ID NO: 428685 - protein, 9 aa, Homo Sapiens
ELDPYKSIL

SEQ ID NO: 428686 - protein, 9 aa, Homo Sapiens
RIHEIIHTG

SEQ ID NO: 428687 - protein, 9 aa, Homo Sapiens
GVAASYFIR

SEQ ID NO: 428688 - protein, 9 aa, Homo Sapiens
LDLLHGEKV

SEQ ID NO: 428689 - protein, 9 aa, Homo Sapiens
VCIRAYLEA

SEQ ID NO: 428690 - protein, 9 aa, Homo Sapiens
AFNIDFNWW

SEQ ID NO: 428691 - protein, 9 aa, Homo Sapiens
GVESEPSFF

SEQ ID NO: 428692 - protein, 9 aa, Homo Sapiens
HEGYKYKRI

SEQ ID NO: 428693 - protein, 9 aa, Homo Sapiens
WGRQRAFST

SEQ ID NO: 428694 - protein, 9 aa, Homo Sapiens
LRSESSSTD

SEQ ID NO: 428695 - protein, 9 aa, Homo Sapiens
AASKVIGRL

SEQ ID NO: 428696 - protein, 9 aa, Homo Sapiens
SDNLDELSS

SEQ ID NO: 428697 - protein, 9 aa, Homo Sapiens
SACNVCLAP

SEQ ID NO: 428698 - protein, 9 aa, Homo Sapiens
SDFYKLPIE

SEQ ID NO: 428699 - protein, 9 aa, Homo Sapiens
PISVKMHIK

SEQ ID NO: 428700 - protein, 9 aa, Homo Sapiens
EQTSLKMVQ

SEQ ID NO: 428701 - protein, 9 aa, Homo Sapiens
TFYTMYNQK

SEQ ID NO: 428702 - protein, 9 aa, Homo Sapiens
SSVWYLGYL

SEQ ID NO: 428703 - protein, 9 aa, Homo Sapiens
VGLSSDKKM

SEQ ID NO: 428704 - protein, 9 aa, Homo Sapiens
GTELVNLLS

SEQ ID NO: 428705 - protein, 9 aa, Homo Sapiens
HIFKLHSHG

SEQ ID NO: 428706 - protein, 9 aa, Homo Sapiens
LVDTRIQGF

SEQ ID NO: 428707 - protein, 9 aa, Homo Sapiens
IHHQIHTGE

SEQ ID NO: 428708 - protein, 9 aa, Homo Sapiens
QFVVSANDV

SEQ ID NO: 428709 - protein, 9 aa, Homo Sapiens
APLGTQGIN

SEQ ID NO: 428710 - protein, 9 aa, Homo Sapiens
LPKNMSYTL

SEQ ID NO: 428711 - protein, 9 aa, Homo Sapiens
QPHMLVELA

SEQ ID NO: 428712 - protein, 9 aa, Homo Sapiens
GMVISHMVV

SEQ ID NO: 428713 - protein, 9 aa, Homo Sapiens
AVIAGSSNV

SEQ ID NO: 428714 - protein, 9 aa, Homo Sapiens
HKKKESHDC

SEQ ID NO: 428715 - protein, 9 aa, Homo Sapiens
AINAALAQA

SEQ ID NO: 428716 - protein, 9 aa, Homo Sapiens
LSVSLPERP

SEQ ID NO: 428717 - protein, 9 aa, Homo Sapiens
QNQGRQKLA

SEQ ID NO: 428718 - protein, 9 aa, Homo Sapiens
LFPSTTTKL

SEQ ID NO: 428719 - protein, 9 aa, Homo Sapiens
FSKFQAELS

SEQ ID NO: 428720 - protein, 9 aa, Homo Sapiens
TEKTMIYFV

SEQ ID NO: 428721 - protein, 9 aa, Homo Sapiens
KQRLPQLNY

SEQ ID NO: 428722 - protein, 9 aa, Homo Sapiens
DRSPELSAA

SEQ ID NO: 428723 - protein, 9 aa, Homo Sapiens
HQNLQGKKS

SEQ ID NO: 428724 - protein, 9 aa, Homo Sapiens
LERGKAGWH

SEQ ID NO: 428725 - protein, 9 aa, Homo Sapiens
EVEPSEVEA

SEQ ID NO: 428726 - protein, 9 aa, Homo Sapiens
EMINNKAAS

SEQ ID NO: 428727 - protein, 9 aa, Homo Sapiens
IVGIPYSLQ

SEQ ID NO: 428728 - protein, 9 aa, Homo Sapiens
DNLKSQPPL

SEQ ID NO: 428729 - protein, 9 aa, Homo Sapiens
NLDYRIRAQ

SEQ ID NO: 428730 - protein, 9 aa, Homo Sapiens
YVSRTLVVF

SEQ ID NO: 428731 - protein, 9 aa, Homo Sapiens
LEAAVADVL

SEQ ID NO: 428732 - protein, 9 aa, Homo Sapiens
GSLNTKIRD

SEQ ID NO: 428733 - protein, 9 aa, Homo Sapiens
KSKTILVRM

SEQ ID NO: 428734 - protein, 9 aa, Homo Sapiens
YQSRYQSDP

SEQ ID NO: 428735 - protein, 9 aa, Homo Sapiens
LSPRIEEQK

SEQ ID NO: 428736 - protein, 9 aa, Homo Sapiens
FNTINHLFC

SEQ ID NO: 428737 - protein, 9 aa, Homo Sapiens
PEQGIEDYF

SEQ ID NO: 428738 - protein, 9 aa, Homo Sapiens
SSSTNTEKK

SEQ ID NO: 428739 - protein, 9 aa, Homo Sapiens
LSVDIDSEL

SEQ ID NO: 428740 - protein, 9 aa, Homo Sapiens
PQKQNTEES

SEQ ID NO: 428741 - protein, 9 aa, Homo Sapiens
WAINQYRVC

SEQ ID NO: 428742 - protein, 9 aa, Homo Sapiens
VGVVVFEND

SEQ ID NO: 428743 - protein, 9 aa, Homo Sapiens
NRSFQTGIK

SEQ ID NO: 428744 - protein, 9 aa, Homo Sapiens
FHADNFLQQ

SEQ ID NO: 428745 - protein, 9 aa, Homo Sapiens
SDNSMSEKA

SEQ ID NO: 428746 - protein, 9 aa, Homo Sapiens
EIFSKYQKT

SEQ ID NO: 428747 - protein, 9 aa, Homo Sapiens
KSFKKGDSN

SEQ ID NO: 428748 - protein, 9 aa, Homo Sapiens
STFCITAYP

SEQ ID NO: 428749 - protein, 9 aa, Homo Sapiens
GQSHNNVFP

SEQ ID NO: 428750 - protein, 9 aa, Homo Sapiens
DEEMINNKA

SEQ ID NO: 428751 - protein, 9 aa, Homo Sapiens
GLLKSQVQI

SEQ ID NO: 428752 - protein, 9 aa, Homo Sapiens
GPIPGLLKS

SEQ ID NO: 428753 - protein, 9 aa, Homo Sapiens
EAMKKRKLS

SEQ ID NO: 428754 - protein, 9 aa, Homo Sapiens
HKRFYLGLE

SEQ ID NO: 428755 - protein, 9 aa, Homo Sapiens
YCLRSASQG

SEQ ID NO: 428756 - protein, 9 aa, Homo Sapiens
VQIPHKRLC

SEQ ID NO: 428757 - protein, 9 aa, Homo Sapiens
SSTLILHKI

SEQ ID NO: 428758 - protein, 9 aa, Homo Sapiens
FASKTKYRI

SEQ ID NO: 428759 - protein, 9 aa, Homo Sapiens
LLTEYANTF

SEQ ID NO: 428760 - protein, 9 aa, Homo Sapiens
RNKKDSRSS

SEQ ID NO: 428761 - protein, 9 aa, Homo Sapiens
KTLVKIKIM

SEQ ID NO: 428762 - protein, 9 aa, Homo Sapiens
SVLILVVPL

SEQ ID NO: 428763 - protein, 9 aa, Homo Sapiens
LVNCYTKLC

SEQ ID NO: 428764 - protein, 9 aa, Homo Sapiens
GQLPGDNNN

SEQ ID NO: 428765 - protein, 9 aa, Homo Sapiens
SFLSQCGRS

SEQ ID NO: 428766 - protein, 9 aa, Homo Sapiens
PLKNYYQAF

SEQ ID NO: 428767 - protein, 9 aa, Homo Sapiens
VYPAMREAP

SEQ ID NO: 428768 - protein, 9 aa, Homo Sapiens
LERIFLVIG

SEQ ID NO: 428769 - protein, 9 aa, Homo Sapiens
DTIARATVY

SEQ ID NO: 428770 - protein, 9 aa, Homo Sapiens
TILVRMVSE

SEQ ID NO: 428771 - protein, 9 aa, Homo Sapiens
ETGTIKLGK

SEQ ID NO: 428772 - protein, 9 aa, Homo Sapiens
SNIMNYFQV

SEQ ID NO: 428773 - protein, 9 aa, Homo Sapiens
RARGRARCR

SEQ ID NO: 428774 - protein, 9 aa, Homo Sapiens
IHIANHLIG

SEQ ID NO: 428775 - protein, 9 aa, Homo Sapiens
KEYDPGQCA

SEQ ID NO: 428776 - protein, 9 aa, Homo Sapiens
VAETFVCHT

SEQ ID NO: 428777 - protein, 9 aa, Homo Sapiens
YFSYAGCFQ

SEQ ID NO: 428778 - protein, 9 aa, Homo Sapiens
IYLTGPDRC

SEQ ID NO: 428779 - protein, 9 aa, Homo Sapiens
LYSTPFSSP

SEQ ID NO: 428780 - protein, 9 aa, Homo Sapiens
KAGWHKLLI

SEQ ID NO: 428781 - protein, 9 aa, Homo Sapiens
ISPGSLPAT

SEQ ID NO: 428782 - protein, 9 aa, Homo Sapiens
SYVFIVTII

SEQ ID NO: 428783 - protein, 9 aa, Homo Sapiens
EQVYIQSTD

SEQ ID NO: 428784 - protein, 9 aa, Homo Sapiens
TWQNFTDPQ

SEQ ID NO: 428785 - protein, 9 aa, Homo Sapiens
SHIFKLAQY

SEQ ID NO: 428786 - protein, 9 aa, Homo Sapiens
LDKDTLYIV

SEQ ID NO: 428787 - protein, 9 aa, Homo Sapiens
ELNQHQKIH

SEQ ID NO: 428788 - protein, 9 aa, Homo Sapiens
LHSGEKLYK

SEQ ID NO: 428789 - protein, 9 aa, Homo Sapiens
VAGCSNSLI

SEQ ID NO: 428790 - protein, 9 aa, Homo Sapiens
YINSKVVKT

SEQ ID NO: 428791 - protein, 9 aa, Homo Sapiens
IQIIFTFQL

SEQ ID NO: 428792 - protein, 9 aa, Homo Sapiens
EKNLRDMHM

SEQ ID NO: 428793 - protein, 9 aa, Homo Sapiens
QHNSLEWAF

SEQ ID NO: 428794 - protein, 9 aa, Homo Sapiens
AGSALSGPR

SEQ ID NO: 428795 - protein, 9 aa, Homo Sapiens
RWTHLVQLL

SEQ ID NO: 428796 - protein, 9 aa, Homo Sapiens
EEAAVIDDI

SEQ ID NO: 428797 - protein, 9 aa, Homo Sapiens
KNEERKLQE

SEQ ID NO: 428798 - protein, 9 aa, Homo Sapiens
MAALLFVNE

SEQ ID NO: 428799 - protein, 9 aa, Homo Sapiens
PPISKEYSV

SEQ ID NO: 428800 - protein, 9 aa, Homo Sapiens
KINQCWTTT

SEQ ID NO: 428801 - protein, 9 aa, Homo Sapiens
LLAPSTRTF

SEQ ID NO: 428802 - protein, 9 aa, Homo Sapiens
HILLLEIES

SEQ ID NO: 428803 - protein, 9 aa, Homo Sapiens
EDDENFFTT

SEQ ID NO: 428804 - protein, 9 aa, Homo Sapiens
NMLNTNNCP

SEQ ID NO: 428805 - protein, 9 aa, Homo Sapiens
RALDSLNTS

SEQ ID NO: 428806 - protein, 9 aa, Homo Sapiens
YIVMPRSYV

SEQ ID NO: 428807 - protein, 9 aa, Homo Sapiens
SNNVPNMLT

SEQ ID NO: 428808 - protein, 9 aa, Homo Sapiens
IKARAGNNR

SEQ ID NO: 428809 - protein, 9 aa, Homo Sapiens
ARIEASLQE

SEQ ID NO: 428810 - protein, 9 aa, Homo Sapiens
CCARCHVPA

SEQ ID NO: 428811 - protein, 9 aa, Homo Sapiens
TQLKELKLK

SEQ ID NO: 428812 - protein, 9 aa, Homo Sapiens
KIVGLANSM

SEQ ID NO: 428813 - protein, 9 aa, Homo Sapiens
NYTFICQNK

SEQ ID NO: 428814 - protein, 9 aa, Homo Sapiens
TGSTDRDGI

SEQ ID NO: 428815 - protein, 9 aa, Homo Sapiens
KDLIWATSG

SEQ ID NO: 428816 - protein, 9 aa, Homo Sapiens
ASTFQKAPE

SEQ ID NO: 428817 - protein, 9 aa, Homo Sapiens
GKCKTFFSD

SEQ ID NO: 428818 - protein, 9 aa, Homo Sapiens
KLHGTLTKL

SEQ ID NO: 428819 - protein, 9 aa, Homo Sapiens
YHSQFYQGL

SEQ ID NO: 428820 - protein, 9 aa, Homo Sapiens
SQTALSKGK

SEQ ID NO: 428821 - protein, 9 aa, Homo Sapiens
VLLSLFIGT

SEQ ID NO: 428822 - protein, 9 aa, Homo Sapiens
VEGGVRGLY

SEQ ID NO: 428823 - protein, 9 aa, Homo Sapiens
SLLEDIASG

SEQ ID NO: 428824 - protein, 9 aa, Homo Sapiens
GEEPTTENP

SEQ ID NO: 428825 - protein, 9 aa, Homo Sapiens
GPKIIFAPP

SEQ ID NO: 428826 - protein, 9 aa, Homo Sapiens
TLLLYVLRV

SEQ ID NO: 428827 - protein, 9 aa, Homo Sapiens
CSIRKLISY

SEQ ID NO: 428828 - protein, 9 aa, Homo Sapiens
NFRDIKKRT

SEQ ID NO: 428829 - protein, 9 aa, Homo Sapiens
PHSSSTKLS

SEQ ID NO: 428830 - protein, 9 aa, Homo Sapiens
NTCRKDCIK

SEQ ID NO: 428831 - protein, 9 aa, Homo Sapiens
DYGGSGTWE

SEQ ID NO: 428832 - protein, 9 aa, Homo Sapiens
QLRDTYMFA

SEQ ID NO: 428833 - protein, 9 aa, Homo Sapiens
ESQTVLSSA

SEQ ID NO: 428834 - protein, 9 aa, Homo Sapiens
SITRQLRSQ

SEQ ID NO: 428835 - protein, 9 aa, Homo Sapiens
FIRHQSDQY

SEQ ID NO: 428836 - protein, 9 aa, Homo Sapiens
YADLVLNVG

SEQ ID NO: 428837 - protein, 9 aa, Homo Sapiens
SDRHNIKHM

SEQ ID NO: 428838 - protein, 9 aa, Homo Sapiens
HTIQTAEFF

SEQ ID NO: 428839 - protein, 9 aa, Homo Sapiens
AYDQDAHLA

SEQ ID NO: 428840 - protein, 9 aa, Homo Sapiens
DVYNFLATA

SEQ ID NO: 428841 - protein, 9 aa, Homo Sapiens
ENKVLTYSD

SEQ ID NO: 428842 - protein, 9 aa, Homo Sapiens
LTNHQQTHT

SEQ ID NO: 428843 - protein, 9 aa, Homo Sapiens
GHLDMINGL

SEQ ID NO: 428844 - protein, 9 aa, Homo Sapiens
ILHAFFIDL

SEQ ID NO: 428845 - protein, 9 aa, Homo Sapiens
PRWTHLVQL

SEQ ID NO: 428846 - protein, 9 aa, Homo Sapiens
LLQQMTGKC

SEQ ID NO: 428847 - protein, 9 aa, Homo Sapiens
NTYSVGIGP

SEQ ID NO: 428848 - protein, 9 aa, Homo Sapiens
DREVPTRKA

SEQ ID NO: 428849 - protein, 9 aa, Homo Sapiens
ACSGQAEVV

SEQ ID NO: 428850 - protein, 9 aa, Homo Sapiens
ILDSVTSSE

SEQ ID NO: 428851 - protein, 9 aa, Homo Sapiens
ENAMRLSII

SEQ ID NO: 428852 - protein, 9 aa, Homo Sapiens
SLRLKNYAL

SEQ ID NO: 428853 - protein, 9 aa, Homo Sapiens
LLFLKYIFD

SEQ ID NO: 428854 - protein, 9 aa, Homo Sapiens
TLFASSALN

SEQ ID NO: 428855 - protein, 9 aa, Homo Sapiens
SVEEIGALQ

SEQ ID NO: 428856 - protein, 9 aa, Homo Sapiens
NPVSVSRSD

SEQ ID NO: 428857 - protein, 9 aa, Homo Sapiens
AHIFKLHSH

SEQ ID NO: 428858 - protein, 9 aa, Homo Sapiens
WINLVIANN

SEQ ID NO: 428859 - protein, 9 aa, Homo Sapiens
VFSTGLLVM

SEQ ID NO: 428860 - protein, 9 aa, Homo Sapiens
FLPRFNWDY

SEQ ID NO: 428861 - protein, 9 aa, Homo Sapiens
DAKWQLEIA

SEQ ID NO: 428862 - protein, 9 aa, Homo Sapiens
VELPVVVKY

SEQ ID NO: 428863 - protein, 9 aa, Homo Sapiens
DKPVEIIRH

SEQ ID NO: 428864 - protein, 9 aa, Homo Sapiens
SSAHVNRGP

SEQ ID NO: 428865 - protein, 9 aa, Homo Sapiens
STEKTMIYF

SEQ ID NO: 428866 - protein, 9 aa, Homo Sapiens
ECTIMCVPT

SEQ ID NO: 428867 - protein, 9 aa, Homo Sapiens
AMKSQLEAS

SEQ ID NO: 428868 - protein, 9 aa, Homo Sapiens
AINHLDDLK

SEQ ID NO: 428869 - protein, 9 aa, Homo Sapiens
VDTMLTVRS

SEQ ID NO: 428870 - protein, 9 aa, Homo Sapiens
FKIAFHQRE

SEQ ID NO: 428871 - protein, 9 aa, Homo Sapiens
DQYEASDKD

SEQ ID NO: 428872 - protein, 9 aa, Homo Sapiens
VKHTHVPKG

SEQ ID NO: 428873 - protein, 9 aa, Homo Sapiens
IHQLKKEEQ

SEQ ID NO: 428874 - protein, 9 aa, Homo Sapiens
GWPPPTAAE

SEQ ID NO: 428875 - protein, 9 aa, Homo Sapiens
LITQDFWEN

SEQ ID NO: 428876 - protein, 9 aa, Homo Sapiens
HIFLCDKIV

SEQ ID NO: 428877 - protein, 9 aa, Homo Sapiens
LRESIYYTL

SEQ ID NO: 428878 - protein, 9 aa, Homo Sapiens
GIFCALLNI

SEQ ID NO: 428879 - protein, 9 aa, Homo Sapiens
KLMKSIRFP

SEQ ID NO: 428880 - protein, 9 aa, Homo Sapiens
PAVCKVNRT

SEQ ID NO: 428881 - protein, 9 aa, Homo Sapiens
KSKAHMFCA

SEQ ID NO: 428882 - protein, 9 aa, Homo Sapiens
IQNGPYRQL

SEQ ID NO: 428883 - protein, 9 aa, Homo Sapiens
GSSQDETKT

SEQ ID NO: 428884 - protein, 9 aa, Homo Sapiens
VICDFNTNK

SEQ ID NO: 428885 - protein, 9 aa, Homo Sapiens
FHFRASYAA

SEQ ID NO: 428886 - protein, 9 aa, Homo Sapiens
LLKESIKYG

SEQ ID NO: 428887 - protein, 9 aa, Homo Sapiens
CHLQSQMPS

SEQ ID NO: 428888 - protein, 9 aa, Homo Sapiens
SVASFIKKP

SEQ ID NO: 428889 - protein, 9 aa, Homo Sapiens
NHNNWIKQY

SEQ ID NO: 428890 - protein, 9 aa, Homo Sapiens
LVHVWLNEY

SEQ ID NO: 428891 - protein, 9 aa, Homo Sapiens
IFCSRDKVS

SEQ ID NO: 428892 - protein, 9 aa, Homo Sapiens
ALQKELDLL

SEQ ID NO: 428893 - protein, 9 aa, Homo Sapiens
LGSVDAGEE

SEQ ID NO: 428894 - protein, 9 aa, Homo Sapiens
CLTRHQIIH

SEQ ID NO: 428895 - protein, 9 aa, Homo Sapiens
KQHNSLEWA

SEQ ID NO: 428896 - protein, 9 aa, Homo Sapiens
EHPGMPCPG

SEQ ID NO: 428897 - protein, 9 aa, Homo Sapiens
LRGLFLGCG

SEQ ID NO: 428898 - protein, 9 aa, Homo Sapiens
RGGKYSVKK

SEQ ID NO: 428899 - protein, 9 aa, Homo Sapiens
VCPFLIYPS

SEQ ID NO: 428900 - protein, 9 aa, Homo Sapiens
QSCLMSIVS

SEQ ID NO: 428901 - protein, 9 aa, Homo Sapiens
KLKEIDTKN

SEQ ID NO: 428902 - protein, 9 aa, Homo Sapiens
PMSQRHVLK

SEQ ID NO: 428903 - protein, 9 aa, Homo Sapiens
RPLQIPLKC

SEQ ID NO: 428904 - protein, 9 aa, Homo Sapiens
WLVPGRQDP

SEQ ID NO: 428905 - protein, 9 aa, Homo Sapiens
HKGHRPEVP

SEQ ID NO: 428906 - protein, 9 aa, Homo Sapiens
PEKPVKKHK

SEQ ID NO: 428907 - protein, 9 aa, Homo Sapiens
VAALDTEVA

SEQ ID NO: 428908 - protein, 9 aa, Homo Sapiens
PAYSKVVMF

SEQ ID NO: 428909 - protein, 9 aa, Homo Sapiens
HINFQQPAD

SEQ ID NO: 428910 - protein, 9 aa, Homo Sapiens
KTLLLYVLR

SEQ ID NO: 428911 - protein, 9 aa, Homo Sapiens
RLLVRAHLL

SEQ ID NO: 428912 - protein, 9 aa, Homo Sapiens
ECHLQSQMP

SEQ ID NO: 428913 - protein, 9 aa, Homo Sapiens
GGVTTGVIR

SEQ ID NO: 428914 - protein, 9 aa, Homo Sapiens
LSTEKTMIY

SEQ ID NO: 428915 - protein, 9 aa, Homo Sapiens
KFQNTNVKG

SEQ ID NO: 428916 - protein, 9 aa, Homo Sapiens
EFTPRFSRG

SEQ ID NO: 428917 - protein, 9 aa, Homo Sapiens
CSCCPVECE

SEQ ID NO: 428918 - protein, 9 aa, Homo Sapiens
RLQVSLMSR

SEQ ID NO: 428919 - protein, 9 aa, Homo Sapiens
DYTCTCPQG

SEQ ID NO: 428920 - protein, 9 aa, Homo Sapiens
RPTCSVEQE

SEQ ID NO: 428921 - protein, 9 aa, Homo Sapiens
SLNWAFGVC

SEQ ID NO: 428922 - protein, 9 aa, Homo Sapiens
ALNASFLTS

SEQ ID NO: 428923 - protein, 9 aa, Homo Sapiens
SARPWGWFL

SEQ ID NO: 428924 - protein, 9 aa, Homo Sapiens
ENKIGTYFR

SEQ ID NO: 428925 - protein, 9 aa, Homo Sapiens
MEDMRNKED

SEQ ID NO: 428926 - protein, 9 aa, Homo Sapiens
GQKVAVNNI

SEQ ID NO: 428927 - protein, 9 aa, Homo Sapiens
EFLVDLIYF

SEQ ID NO: 428928 - protein, 9 aa, Homo Sapiens
VFEQTRVCF

SEQ ID NO: 428929 - protein, 9 aa, Homo Sapiens
VAIKFSLEE

SEQ ID NO: 428930 - protein, 9 aa, Homo Sapiens
EITGPSCDV

SEQ ID NO: 428931 - protein, 9 aa, Homo Sapiens
VHCRTEDNN

SEQ ID NO: 428932 - protein, 9 aa, Homo Sapiens
VFELIKDTR

SEQ ID NO: 428933 - protein, 9 aa, Homo Sapiens
SLLNTLGLN

SEQ ID NO: 428934 - protein, 9 aa, Homo Sapiens
KLLQNWLCF

SEQ ID NO: 428935 - protein, 9 aa, Homo Sapiens
DTLVDFWAQ

SEQ ID NO: 428936 - protein, 9 aa, Homo Sapiens
YLHFCSDIS

SEQ ID NO: 428937 - protein, 9 aa, Homo Sapiens
ILGDHFRDM

SEQ ID NO: 428938 - protein, 9 aa, Homo Sapiens
VFLNPFDNC

SEQ ID NO: 428939 - protein, 9 aa, Homo Sapiens
DTKYNYCII

SEQ ID NO: 428940 - protein, 9 aa, Homo Sapiens
REPASCKDL

SEQ ID NO: 428941 - protein, 9 aa, Homo Sapiens
DLEKVANVS

SEQ ID NO: 428942 - protein, 9 aa, Homo Sapiens
EYVVSRTSP

SEQ ID NO: 428943 - protein, 9 aa, Homo Sapiens
YVYLYIINK

SEQ ID NO: 428944 - protein, 9 aa, Homo Sapiens
AIKTFYQTS

SEQ ID NO: 428945 - protein, 9 aa, Homo Sapiens
LTFPLALHT

SEQ ID NO: 428946 - protein, 9 aa, Homo Sapiens
NKPKFTQEV

SEQ ID NO: 428947 - protein, 9 aa, Homo Sapiens
QIIHTDEKP

SEQ ID NO: 428948 - protein, 9 aa, Homo Sapiens
LNNNMEMMH

SEQ ID NO: 428949 - protein, 9 aa, Homo Sapiens
DTSMDFTMA

SEQ ID NO: 428950 - protein, 9 aa, Homo Sapiens
ICIEKLKER

SEQ ID NO: 428951 - protein, 9 aa, Homo Sapiens
HGNDFKDKL

SEQ ID NO: 428952 - protein, 9 aa, Homo Sapiens
LCYIQPCNS

SEQ ID NO: 428953 - protein, 9 aa, Homo Sapiens
QIREATSEI

SEQ ID NO: 428954 - protein, 9 aa, Homo Sapiens
NNMVKPLDL

SEQ ID NO: 428955 - protein, 9 aa, Homo Sapiens
ANWRASILL

SEQ ID NO: 428956 - protein, 9 aa, Homo Sapiens
QAYHAILQG

SEQ ID NO: 428957 - protein, 9 aa, Homo Sapiens
APSEAISLS

SEQ ID NO: 428958 - protein, 9 aa, Homo Sapiens
PYAILSISN

SEQ ID NO: 428959 - protein, 9 aa, Homo Sapiens
EDEEETTLQ

SEQ ID NO: 428960 - protein, 9 aa, Homo Sapiens
IHEGMCISD

SEQ ID NO: 428961 - protein, 9 aa, Homo Sapiens
DDSDTIVCD

SEQ ID NO: 428962 - protein, 9 aa, Homo Sapiens
DSSLHSQHL

SEQ ID NO: 428963 - protein, 9 aa, Homo Sapiens
SDSKKRKMY

SEQ ID NO: 428964 - protein, 9 aa, Homo Sapiens
CVKRNIFSN

SEQ ID NO: 428965 - protein, 9 aa, Homo Sapiens
AYSTADIFN

SEQ ID NO: 428966 - protein, 9 aa, Homo Sapiens
PLHQDNSEM

SEQ ID NO: 428967 - protein, 9 aa, Homo Sapiens
ESSSSDELF

SEQ ID NO: 428968 - protein, 9 aa, Homo Sapiens
HPRRFLLTG

SEQ ID NO: 428969 - protein, 9 aa, Homo Sapiens
KYGLPGIPG

SEQ ID NO: 428970 - protein, 9 aa, Homo Sapiens
DEDRETEII

SEQ ID NO: 428971 - protein, 9 aa, Homo Sapiens
YRTSPFNFF

SEQ ID NO: 428972 - protein, 9 aa, Homo Sapiens
KGMRKVLRT

SEQ ID NO: 428973 - protein, 9 aa, Homo Sapiens
HEPGSPTRK

SEQ ID NO: 428974 - protein, 9 aa, Homo Sapiens
WSFGKVCYL

SEQ ID NO: 428975 - protein, 9 aa, Homo Sapiens
LFCVGCGCC

SEQ ID NO: 428976 - protein, 9 aa, Homo Sapiens
LNRALNQER

SEQ ID NO: 428977 - protein, 9 aa, Homo Sapiens
LVNEWSLNI

SEQ ID NO: 428978 - protein, 9 aa, Homo Sapiens
IGATIQEEL

SEQ ID NO: 428979 - protein, 9 aa, Homo Sapiens
TIFYTLRYH

SEQ ID NO: 428980 - protein, 9 aa, Homo Sapiens
HQILHTGVK

SEQ ID NO: 428981 - protein, 9 aa, Homo Sapiens
SANERKIIN

SEQ ID NO: 428982 - protein, 9 aa, Homo Sapiens
TVACTFNFL

SEQ ID NO: 428983 - protein, 9 aa, Homo Sapiens
GNGNCVTRI

SEQ ID NO: 428984 - protein, 9 aa, Homo Sapiens
LGHSAKLAF

SEQ ID NO: 428985 - protein, 9 aa, Homo Sapiens
ACDKILSDD

SEQ ID NO: 428986 - protein, 9 aa, Homo Sapiens
QNTEESSSP

SEQ ID NO: 428987 - protein, 9 aa, Homo Sapiens
DNASKRHPF

SEQ ID NO: 428988 - protein, 9 aa, Homo Sapiens
SCKPGVGLL

SEQ ID NO: 428989 - protein, 9 aa, Homo Sapiens
LSRMPIVTR

SEQ ID NO: 428990 - protein, 9 aa, Homo Sapiens
RVLKYPKQR

SEQ ID NO: 428991 - protein, 9 aa, Homo Sapiens
CSLKDIVPH

SEQ ID NO: 428992 - protein, 9 aa, Homo Sapiens
TFTWNTLSA

SEQ ID NO: 428993 - protein, 9 aa, Homo Sapiens
SKLLAVIHK

SEQ ID NO: 428994 - protein, 9 aa, Homo Sapiens
KWLLQQMTG

SEQ ID NO: 428995 - protein, 9 aa, Homo Sapiens
PIDSHSRRE

SEQ ID NO: 428996 - protein, 9 aa, Homo Sapiens
NKRVKYQYV

SEQ ID NO: 428997 - protein, 9 aa, Homo Sapiens
IYPLMQGLR

SEQ ID NO: 428998 - protein, 9 aa, Homo Sapiens
YQNEDYLII

SEQ ID NO: 428999 - protein, 9 aa, Homo Sapiens
ESQLQAGAG

SEQ ID NO: 429000 - protein, 9 aa, Homo Sapiens
AYFKVAHLV

SEQ ID NO: 429001 - protein, 9 aa, Homo Sapiens
QTAKKQDNN

SEQ ID NO: 429002 - protein, 9 aa, Homo Sapiens
ATQLRQLKA

SEQ ID NO: 429003 - protein, 9 aa, Homo Sapiens
SEMQRPPPY

SEQ ID NO: 429004 - protein, 9 aa, Homo Sapiens
RTNSGIRSA

SEQ ID NO: 429005 - protein, 9 aa, Homo Sapiens
EDGLHYVAQ

SEQ ID NO: 429006 - protein, 9 aa, Homo Sapiens
ELPVVVKYL

SEQ ID NO: 429007 - protein, 9 aa, Homo Sapiens
NYFASCKLT

SEQ ID NO: 429008 - protein, 9 aa, Homo Sapiens
EGNKESLES

SEQ ID NO: 429009 - protein, 9 aa, Homo Sapiens
STGLLVMKN

SEQ ID NO: 429010 - protein, 9 aa, Homo Sapiens
YASQDMEDS

SEQ ID NO: 429011 - protein, 9 aa, Homo Sapiens
SHLTHHLQI

SEQ ID NO: 429012 - protein, 9 aa, Homo Sapiens
LQLEILNAS

SEQ ID NO: 429013 - protein, 9 aa, Homo Sapiens
SSHWVDIAL

SEQ ID NO: 429014 - protein, 9 aa, Homo Sapiens
SVTGRSRLP

SEQ ID NO: 429015 - protein, 9 aa, Homo Sapiens
KIQSMDDVD

SEQ ID NO: 429016 - protein, 9 aa, Homo Sapiens
HLVVHQITH

SEQ ID NO: 429017 - protein, 9 aa, Homo Sapiens
KGVGVFMTA

SEQ ID NO: 429018 - protein, 9 aa, Homo Sapiens
DNSEMCKVV

SEQ ID NO: 429019 - protein, 9 aa, Homo Sapiens
AMDFDWRIG

SEQ ID NO: 429020 - protein, 9 aa, Homo Sapiens
EPSSITLFA

SEQ ID NO: 429021 - protein, 9 aa, Homo Sapiens
MMTPPLLGT

SEQ ID NO: 429022 - protein, 9 aa, Homo Sapiens
KTLARYAAR

SEQ ID NO: 429023 - protein, 9 aa, Homo Sapiens
GRKGAKKGM

SEQ ID NO: 429024 - protein, 9 aa, Homo Sapiens
KEDLEGHQT

SEQ ID NO: 429025 - protein, 9 aa, Homo Sapiens
KQALLYLNK

SEQ ID NO: 429026 - protein, 9 aa, Homo Sapiens
KECLQTCQT

SEQ ID NO: 429027 - protein, 9 aa, Homo Sapiens
RDKPEPEQG

SEQ ID NO: 429028 - protein, 9 aa, Homo Sapiens
LNTKGPENI

SEQ ID NO: 429029 - protein, 9 aa, Homo Sapiens
VEFGHIQLL

SEQ ID NO: 429030 - protein, 9 aa, Homo Sapiens
DDSEIVSND

SEQ ID NO: 429031 - protein, 9 aa, Homo Sapiens
WTRCKQSEM

SEQ ID NO: 429032 - protein, 9 aa, Homo Sapiens
PFRKDEKAM

SEQ ID NO: 429033 - protein, 9 aa, Homo Sapiens
LQREETLAL

SEQ ID NO: 429034 - protein, 9 aa, Homo Sapiens
LIEIYRFGY

SEQ ID NO: 429035 - protein, 9 aa, Homo Sapiens
GEGNGNCVT

SEQ ID NO: 429036 - protein, 9 aa, Homo Sapiens
DNVGVVVFE

SEQ ID NO: 429037 - protein, 9 aa, Homo Sapiens
GRRLLNDEL

SEQ ID NO: 429038 - protein, 9 aa, Homo Sapiens
YFDSHLNSP

SEQ ID NO: 429039 - protein, 9 aa, Homo Sapiens
VTLKKLAEF

SEQ ID NO: 429040 - protein, 9 aa, Homo Sapiens
GFAFSIFKS

SEQ ID NO: 429041 - protein, 9 aa, Homo Sapiens
SSVSHCGLV

SEQ ID NO: 429042 - protein, 9 aa, Homo Sapiens
ADNARMVVN

SEQ ID NO: 429043 - protein, 9 aa, Homo Sapiens
EPLEKLNIR

SEQ ID NO: 429044 - protein, 9 aa, Homo Sapiens
GAVVVTSAA

SEQ ID NO: 429045 - protein, 9 aa, Homo Sapiens
TNGNIKHTS

SEQ ID NO: 429046 - protein, 9 aa, Homo Sapiens
GTRARCCLL

SEQ ID NO: 429047 - protein, 9 aa, Homo Sapiens
KDQRRGGLH

SEQ ID NO: 429048 - protein, 9 aa, Homo Sapiens
LPQQCSGTP

SEQ ID NO: 429049 - protein, 9 aa, Homo Sapiens
YYKVQNEAK

SEQ ID NO: 429050 - protein, 9 aa, Homo Sapiens
LQTKQRRPL

SEQ ID NO: 429051 - protein, 9 aa, Homo Sapiens
EKDQQNTSC

SEQ ID NO: 429052 - protein, 9 aa, Homo Sapiens
ENIKLNKKS

SEQ ID NO: 429053 - protein, 9 aa, Homo Sapiens
ADPILTNLS

SEQ ID NO: 429054 - protein, 9 aa, Homo Sapiens
KKWGHKAIE

SEQ ID NO: 429055 - protein, 9 aa, Homo Sapiens
KKDFFLVQR

SEQ ID NO: 429056 - protein, 9 aa, Homo Sapiens
TLIVDGERA

SEQ ID NO: 429057 - protein, 9 aa, Homo Sapiens
VACTFNFLP

SEQ ID NO: 429058 - protein, 9 aa, Homo Sapiens
KQACQKAIE

SEQ ID NO: 429059 - protein, 9 aa, Homo Sapiens
DTPSTSTVW

SEQ ID NO: 429060 - protein, 9 aa, Homo Sapiens
IQVAVASVL

SEQ ID NO: 429061 - protein, 9 aa, Homo Sapiens
GCILQMHFF

SEQ ID NO: 429062 - protein, 9 aa, Homo Sapiens
IHHFFCDVP

SEQ ID NO: 429063 - protein, 9 aa, Homo Sapiens
LMLFVQLPS

SEQ ID NO: 429064 - protein, 9 aa, Homo Sapiens
FLFDILGNF

SEQ ID NO: 429065 - protein, 9 aa, Homo Sapiens
LQSQSSVDV

SEQ ID NO: 429066 - protein, 9 aa, Homo Sapiens
LPFTIASKK

SEQ ID NO: 429067 - protein, 9 aa, Homo Sapiens
RNYFTLQLP

SEQ ID NO: 429068 - protein, 9 aa, Homo Sapiens
SVSTMEILA

SEQ ID NO: 429069 - protein, 9 aa, Homo Sapiens
AAQTTSQSL

SEQ ID NO: 429070 - protein, 9 aa, Homo Sapiens
RKLKNKQQI

SEQ ID NO: 429071 - protein, 9 aa, Homo Sapiens
IKTIKICKN

SEQ ID NO: 429072 - protein, 9 aa, Homo Sapiens
PAQRRCTRG

SEQ ID NO: 429073 - protein, 9 aa, Homo Sapiens
RTLVNGFAN

SEQ ID NO: 429074 - protein, 9 aa, Homo Sapiens
GAHIFKLHS

SEQ ID NO: 429075 - protein, 9 aa, Homo Sapiens
YQCTVENPV

SEQ ID NO: 429076 - protein, 9 aa, Homo Sapiens
YGEFYGRYR

SEQ ID NO: 429077 - protein, 9 aa, Homo Sapiens
DLTKSLGVN

SEQ ID NO: 429078 - protein, 9 aa, Homo Sapiens
DISNKYINS

SEQ ID NO: 429079 - protein, 9 aa, Homo Sapiens
LSLFIGTEI

SEQ ID NO: 429080 - protein, 9 aa, Homo Sapiens
AVALFYIHM

SEQ ID NO: 429081 - protein, 9 aa, Homo Sapiens
ASVSWSPSD

SEQ ID NO: 429082 - protein, 9 aa, Homo Sapiens
CRIYVNNLA

SEQ ID NO: 429083 - protein, 9 aa, Homo Sapiens
QNLTHDGKG

SEQ ID NO: 429084 - protein, 9 aa, Homo Sapiens
EVHMGDSLN

SEQ ID NO: 429085 - protein, 9 aa, Homo Sapiens
YNLELNDVV

SEQ ID NO: 429086 - protein, 9 aa, Homo Sapiens
PQKERKERK

SEQ ID NO: 429087 - protein, 9 aa, Homo Sapiens
SNNLPVVSI

SEQ ID NO: 429088 - protein, 9 aa, Homo Sapiens
ARIIGLEKL

SEQ ID NO: 429089 - protein, 9 aa, Homo Sapiens
AVEMLFAVA

SEQ ID NO: 429090 - protein, 9 aa, Homo Sapiens
SNNKTMSKS

SEQ ID NO: 429091 - protein, 9 aa, Homo Sapiens
LTQGLESNN

SEQ ID NO: 429092 - protein, 9 aa, Homo Sapiens
SSCCVRNNR

SEQ ID NO: 429093 - protein, 9 aa, Homo Sapiens
PLNRNSLCR

SEQ ID NO: 429094 - protein, 9 aa, Homo Sapiens
SHMQTHTGE

SEQ ID NO: 429095 - protein, 9 aa, Homo Sapiens
KEMEECEKR

SEQ ID NO: 429096 - protein, 9 aa, Homo Sapiens
KTKRLTKAD

SEQ ID NO: 429097 - protein, 9 aa, Homo Sapiens
DVGWQVCKT

SEQ ID NO: 429098 - protein, 9 aa, Homo Sapiens
KSGSTRGAG

SEQ ID NO: 429099 - protein, 9 aa, Homo Sapiens
PHVRCIEQT

SEQ ID NO: 429100 - protein, 9 aa, Homo Sapiens
LEYDMVLTN

SEQ ID NO: 429101 - protein, 9 aa, Homo Sapiens
ITGSGRCRH

SEQ ID NO: 429102 - protein, 9 aa, Homo Sapiens
HFLTDANMV

SEQ ID NO: 429103 - protein, 9 aa, Homo Sapiens
KTNSILLYG

SEQ ID NO: 429104 - protein, 9 aa, Homo Sapiens
GLLILIRLW

SEQ ID NO: 429105 - protein, 9 aa, Homo Sapiens
YNHAKFIGV

SEQ ID NO: 429106 - protein, 9 aa, Homo Sapiens
KKEIILAML

SEQ ID NO: 429107 - protein, 9 aa, Homo Sapiens
EFIPLVQRL

SEQ ID NO: 429108 - protein, 9 aa, Homo Sapiens
ITNKDVQKR

SEQ ID NO: 429109 - protein, 9 aa, Homo Sapiens
KSNYINSSS

SEQ ID NO: 429110 - protein, 9 aa, Homo Sapiens
ILDVEIMFN

SEQ ID NO: 429111 - protein, 9 aa, Homo Sapiens
GIDTDHAAP

SEQ ID NO: 429112 - protein, 9 aa, Homo Sapiens
TGKKPNSAG

SEQ ID NO: 429113 - protein, 9 aa, Homo Sapiens
EGMVISHMV

SEQ ID NO: 429114 - protein, 9 aa, Homo Sapiens
GLGTTSVLS

SEQ ID NO: 429115 - protein, 9 aa, Homo Sapiens
KAGNTFIAR

SEQ ID NO: 429116 - protein, 9 aa, Homo Sapiens
VINKSIVKY

SEQ ID NO: 429117 - protein, 9 aa, Homo Sapiens
NVPVKQFQL

SEQ ID NO: 429118 - protein, 9 aa, Homo Sapiens
IICIDEVDS

SEQ ID NO: 429119 - protein, 9 aa, Homo Sapiens
ASLPVPFRK

SEQ ID NO: 429120 - protein, 9 aa, Homo Sapiens
LGGWALVLP

SEQ ID NO: 429121 - protein, 9 aa, Homo Sapiens
KHLQCLEEK

SEQ ID NO: 429122 - protein, 9 aa, Homo Sapiens
RHNHFYFHT

SEQ ID NO: 429123 - protein, 9 aa, Homo Sapiens
GLYDQMSMN

SEQ ID NO: 429124 - protein, 9 aa, Homo Sapiens
DENFFTTGQ

SEQ ID NO: 429125 - protein, 9 aa, Homo Sapiens
WWQLQYSNQ

SEQ ID NO: 429126 - protein, 9 aa, Homo Sapiens
FREKVIKGA

SEQ ID NO: 429127 - protein, 9 aa, Homo Sapiens
GQRDLLRHN

SEQ ID NO: 429128 - protein, 9 aa, Homo Sapiens
DLGSVDAGE

SEQ ID NO: 429129 - protein, 9 aa, Homo Sapiens
LISRQLYWG

SEQ ID NO: 429130 - protein, 9 aa, Homo Sapiens
SKGMEHLYS

SEQ ID NO: 429131 - protein, 9 aa, Homo Sapiens
VEHVEDRFV

SEQ ID NO: 429132 - protein, 9 aa, Homo Sapiens
GKENKVLTY

SEQ ID NO: 429133 - protein, 9 aa, Homo Sapiens
QETAITSCA

SEQ ID NO: 429134 - protein, 9 aa, Homo Sapiens
LGKALKKDM

SEQ ID NO: 429135 - protein, 9 aa, Homo Sapiens
SPYLFFRIF

SEQ ID NO: 429136 - protein, 9 aa, Homo Sapiens
GYLPIYSIS

SEQ ID NO: 429137 - protein, 9 aa, Homo Sapiens
GGDILKYLE

SEQ ID NO: 429138 - protein, 9 aa, Homo Sapiens
HTYQSKGLL

SEQ ID NO: 429139 - protein, 9 aa, Homo Sapiens
KRRTLQIND

SEQ ID NO: 429140 - protein, 9 aa, Homo Sapiens
MLTSVVNAL

SEQ ID NO: 429141 - protein, 9 aa, Homo Sapiens
EVCGANPWI

SEQ ID NO: 429142 - protein, 9 aa, Homo Sapiens
EALTKTQLV

SEQ ID NO: 429143 - protein, 9 aa, Homo Sapiens
NVDALRYFV

SEQ ID NO: 429144 - protein, 9 aa, Homo Sapiens
LMKFMKTRQ

SEQ ID NO: 429145 - protein, 9 aa, Homo Sapiens
ECAFGYKLK

SEQ ID NO: 429146 - protein, 9 aa, Homo Sapiens
EPIKDGHWD

SEQ ID NO: 429147 - protein, 9 aa, Homo Sapiens
KQHYITKNT

SEQ ID NO: 429148 - protein, 9 aa, Homo Sapiens
IVQGFFHSA

SEQ ID NO: 429149 - protein, 9 aa, Homo Sapiens
LNIHSSEGR

SEQ ID NO: 429150 - protein, 9 aa, Homo Sapiens
IQCLNISVL

SEQ ID NO: 429151 - protein, 9 aa, Homo Sapiens
FQNLTHDGK

SEQ ID NO: 429152 - protein, 9 aa, Homo Sapiens
NMYNLVEPV

SEQ ID NO: 429153 - protein, 9 aa, Homo Sapiens
SADVFMSYP

SEQ ID NO: 429154 - protein, 9 aa, Homo Sapiens
KWVSQNRLF

SEQ ID NO: 429155 - protein, 9 aa, Homo Sapiens
LHFRCNWII

SEQ ID NO: 429156 - protein, 9 aa, Homo Sapiens
IKICKNSST

SEQ ID NO: 429157 - protein, 9 aa, Homo Sapiens
PVALGPSTT

SEQ ID NO: 429158 - protein, 9 aa, Homo Sapiens
HFQRVKHGW

SEQ ID NO: 429159 - protein, 9 aa, Homo Sapiens
PRPGSVATV

SEQ ID NO: 429160 - protein, 9 aa, Homo Sapiens
EIIIQVIPQ

SEQ ID NO: 429161 - protein, 9 aa, Homo Sapiens
QEKNLRDMH

SEQ ID NO: 429162 - protein, 9 aa, Homo Sapiens
GIRSASGGS

SEQ ID NO: 429163 - protein, 9 aa, Homo Sapiens
VEKQDIAAY

SEQ ID NO: 429164 - protein, 9 aa, Homo Sapiens
AKYGLPGIP

SEQ ID NO: 429165 - protein, 9 aa, Homo Sapiens
ADDNVKYYF

SEQ ID NO: 429166 - protein, 9 aa, Homo Sapiens
KLTLVFELC

SEQ ID NO: 429167 - protein, 9 aa, Homo Sapiens
TIYKILCKL

SEQ ID NO: 429168 - protein, 9 aa, Homo Sapiens
MGIAFAAFL

SEQ ID NO: 429169 - protein, 9 aa, Homo Sapiens
SLPMVHGPK

SEQ ID NO: 429170 - protein, 9 aa, Homo Sapiens
TEYANTFGY

SEQ ID NO: 429171 - protein, 9 aa, Homo Sapiens
HVNAEIVLH

SEQ ID NO: 429172 - protein, 9 aa, Homo Sapiens
LKDQVNLVA

SEQ ID NO: 429173 - protein, 9 aa, Homo Sapiens
LSTNRNLSN

SEQ ID NO: 429174 - protein, 9 aa, Homo Sapiens
GCEYGTKSI

SEQ ID NO: 429175 - protein, 9 aa, Homo Sapiens
YPQCMCLSP

SEQ ID NO: 429176 - protein, 9 aa, Homo Sapiens
HASLDKFLT

SEQ ID NO: 429177 - protein, 9 aa, Homo Sapiens
KKDMKEKTK

SEQ ID NO: 429178 - protein, 9 aa, Homo Sapiens
HQRINTGEK

SEQ ID NO: 429179 - protein, 9 aa, Homo Sapiens
YIRSNNWAK

SEQ ID NO: 429180 - protein, 9 aa, Homo Sapiens
AGSDSFALN

SEQ ID NO: 429181 - protein, 9 aa, Homo Sapiens
LNKYKKIHT

SEQ ID NO: 429182 - protein, 9 aa, Homo Sapiens
FTKIESNTP

SEQ ID NO: 429183 - protein, 9 aa, Homo Sapiens
RAFTTILII

SEQ ID NO: 429184 - protein, 9 aa, Homo Sapiens
PPCQPNYPP

SEQ ID NO: 429185 - protein, 9 aa, Homo Sapiens
LCLKERHGL

SEQ ID NO: 429186 - protein, 9 aa, Homo Sapiens
DNMDGGDWS

SEQ ID NO: 429187 - protein, 9 aa, Homo Sapiens
QIPITMENF

SEQ ID NO: 429188 - protein, 9 aa, Homo Sapiens
SIRLEKAIQ

SEQ ID NO: 429189 - protein, 9 aa, Homo Sapiens
EDYKNKGQL

SEQ ID NO: 429190 - protein, 9 aa, Homo Sapiens
TGNGDDYSS

SEQ ID NO: 429191 - protein, 9 aa, Homo Sapiens
KWCCDYFLN

SEQ ID NO: 429192 - protein, 9 aa, Homo Sapiens
DTEELRQKC

SEQ ID NO: 429193 - protein, 9 aa, Homo Sapiens
KVKALDIFA

SEQ ID NO: 429194 - protein, 9 aa, Homo Sapiens
HIAQTSLQG

SEQ ID NO: 429195 - protein, 9 aa, Homo Sapiens
ASPTSIQTG

SEQ ID NO: 429196 - protein, 9 aa, Homo Sapiens
LLHLAVPLG

SEQ ID NO: 429197 - protein, 9 aa, Homo Sapiens
ELQDLATYN

SEQ ID NO: 429198 - protein, 9 aa, Homo Sapiens
IKNTYIPQV

SEQ ID NO: 429199 - protein, 9 aa, Homo Sapiens
QEVKMWRQE

SEQ ID NO: 429200 - protein, 9 aa, Homo Sapiens
QLLHSPLFK

SEQ ID NO: 429201 - protein, 9 aa, Homo Sapiens
LLCVKRNIF

SEQ ID NO: 429202 - protein, 9 aa, Homo Sapiens
MPCKSSPPE

SEQ ID NO: 429203 - protein, 9 aa, Homo Sapiens
EPDSSPLAS

SEQ ID NO: 429204 - protein, 9 aa, Homo Sapiens
YLISAVLEK

SEQ ID NO: 429205 - protein, 9 aa, Homo Sapiens
TSILTKDDW

SEQ ID NO: 429206 - protein, 9 aa, Homo Sapiens
FLLDHEKEI

SEQ ID NO: 429207 - protein, 9 aa, Homo Sapiens
VIGLDYSSL

SEQ ID NO: 429208 - protein, 9 aa, Homo Sapiens
QSDLFWLRK

SEQ ID NO: 429209 - protein, 9 aa, Homo Sapiens
YACKECGQA

SEQ ID NO: 429210 - protein, 9 aa, Homo Sapiens
GMVNGGTKC

SEQ ID NO: 429211 - protein, 9 aa, Homo Sapiens
AAKDTKYNY

SEQ ID NO: 429212 - protein, 9 aa, Homo Sapiens
TSLFPDMEA

SEQ ID NO: 429213 - protein, 9 aa, Homo Sapiens
DCSDSSEGW

SEQ ID NO: 429214 - protein, 9 aa, Homo Sapiens
FWTAKYLTE

SEQ ID NO: 429215 - protein, 9 aa, Homo Sapiens
ITSDGGWTV

SEQ ID NO: 429216 - protein, 9 aa, Homo Sapiens
LSSLPLVTG

SEQ ID NO: 429217 - protein, 9 aa, Homo Sapiens
ATAVVENSV

SEQ ID NO: 429218 - protein, 9 aa, Homo Sapiens
DPGDCLIRH

SEQ ID NO: 429219 - protein, 9 aa, Homo Sapiens
EHCRINTGE

SEQ ID NO: 429220 - protein, 9 aa, Homo Sapiens
SDFPPTHVA

SEQ ID NO: 429221 - protein, 9 aa, Homo Sapiens
AALSNTVAL

SEQ ID NO: 429222 - protein, 9 aa, Homo Sapiens
PNDLYLQLE

SEQ ID NO: 429223 - protein, 9 aa, Homo Sapiens
MERFIFPAP

SEQ ID NO: 429224 - protein, 9 aa, Homo Sapiens
HSISKQNVI

SEQ ID NO: 429225 - protein, 9 aa, Homo Sapiens
HWNVLQGVI

SEQ ID NO: 429226 - protein, 9 aa, Homo Sapiens
VAININDIF

SEQ ID NO: 429227 - protein, 9 aa, Homo Sapiens
PELQKLLFV

SEQ ID NO: 429228 - protein, 9 aa, Homo Sapiens
GVAFACYIL

SEQ ID NO: 429229 - protein, 9 aa, Homo Sapiens
KAAKDTKYN

SEQ ID NO: 429230 - protein, 9 aa, Homo Sapiens
SRLQVSLMS

SEQ ID NO: 429231 - protein, 9 aa, Homo Sapiens
TPNHTGCRH

SEQ ID NO: 429232 - protein, 9 aa, Homo Sapiens
LPIYLPVNQ

SEQ ID NO: 429233 - protein, 9 aa, Homo Sapiens
NKTLWERYT

SEQ ID NO: 429234 - protein, 9 aa, Homo Sapiens
LQKNFLLQF

SEQ ID NO: 429235 - protein, 9 aa, Homo Sapiens
GDLRDNFCW

SEQ ID NO: 429236 - protein, 9 aa, Homo Sapiens
ECEKRKIIA

SEQ ID NO: 429237 - protein, 9 aa, Homo Sapiens
QGLEMLRLP

SEQ ID NO: 429238 - protein, 9 aa, Homo Sapiens
LPDKFGTGP

SEQ ID NO: 429239 - protein, 9 aa, Homo Sapiens
KPILHAFFI

SEQ ID NO: 429240 - protein, 9 aa, Homo Sapiens
HLNEHRQIH

SEQ ID NO: 429241 - protein, 9 aa, Homo Sapiens
VSTLNSYQN

SEQ ID NO: 429242 - protein, 9 aa, Homo Sapiens
RSSAMCHSC

SEQ ID NO: 429243 - protein, 9 aa, Homo Sapiens
ALIGNLSII

SEQ ID NO: 429244 - protein, 9 aa, Homo Sapiens
AHMFCANAL

SEQ ID NO: 429245 - protein, 9 aa, Homo Sapiens
FQNPQYIFK

SEQ ID NO: 429246 - protein, 9 aa, Homo Sapiens
NLTLGACQI

SEQ ID NO: 429247 - protein, 9 aa, Homo Sapiens
SSPLEPLEE

SEQ ID NO: 429248 - protein, 9 aa, Homo Sapiens
LAVFSIVGA

SEQ ID NO: 429249 - protein, 9 aa, Homo Sapiens
VDKPTSHSA

SEQ ID NO: 429250 - protein, 9 aa, Homo Sapiens
SLNNWNVNY

SEQ ID NO: 429251 - protein, 9 aa, Homo Sapiens
SSVLQKHQI

SEQ ID NO: 429252 - protein, 9 aa, Homo Sapiens
YGNPQNSPG

SEQ ID NO: 429253 - protein, 9 aa, Homo Sapiens
NTFLDNIVR

SEQ ID NO: 429254 - protein, 9 aa, Homo Sapiens
YEYVEIIGE

SEQ ID NO: 429255 - protein, 9 aa, Homo Sapiens
KITSYMAID

SEQ ID NO: 429256 - protein, 9 aa, Homo Sapiens
KVRFVNSLM

SEQ ID NO: 429257 - protein, 9 aa, Homo Sapiens
YLSSVSRSD

SEQ ID NO: 429258 - protein, 9 aa, Homo Sapiens
QIQVGKNEP

SEQ ID NO: 429259 - protein, 9 aa, Homo Sapiens
GAESNNYEE

SEQ ID NO: 429260 - protein, 9 aa, Homo Sapiens
WGRGCTEPN

SEQ ID NO: 429261 - protein, 9 aa, Homo Sapiens
TLFAFSLIE

SEQ ID NO: 429262 - protein, 9 aa, Homo Sapiens
IKENRQQNV

SEQ ID NO: 429263 - protein, 9 aa, Homo Sapiens
LFLLQCYFV

SEQ ID NO: 429264 - protein, 9 aa, Homo Sapiens
FPNGSLGDD

SEQ ID NO: 429265 - protein, 9 aa, Homo Sapiens
KSVVSWIYI

SEQ ID NO: 429266 - protein, 9 aa, Homo Sapiens
LSRKRPGIA

SEQ ID NO: 429267 - protein, 9 aa, Homo Sapiens
GQYEGHKAE

SEQ ID NO: 429268 - protein, 9 aa, Homo Sapiens
LVFRLLKRT

SEQ ID NO: 429269 - protein, 9 aa, Homo Sapiens
SSSFQKHER

SEQ ID NO: 429270 - protein, 9 aa, Homo Sapiens
EKIDDIFNK

SEQ ID NO: 429271 - protein, 9 aa, Homo Sapiens
SYQESFREV

SEQ ID NO: 429272 - protein, 9 aa, Homo Sapiens
KLMYGLASV

SEQ ID NO: 429273 - protein, 9 aa, Homo Sapiens
PDVLRYDTI

SEQ ID NO: 429274 - protein, 9 aa, Homo Sapiens
YQQLLKHKC

SEQ ID NO: 429275 - protein, 9 aa, Homo Sapiens
LVPQKANIV

SEQ ID NO: 429276 - protein, 9 aa, Homo Sapiens
KDCIWMCKL

SEQ ID NO: 429277 - protein, 9 aa, Homo Sapiens
VIQLVYVEG

SEQ ID NO: 429278 - protein, 9 aa, Homo Sapiens
KQYTESQLQ

SEQ ID NO: 429279 - protein, 9 aa, Homo Sapiens
SKDIWAACC

SEQ ID NO: 429280 - protein, 9 aa, Homo Sapiens
EGDRNGGAN

SEQ ID NO: 429281 - protein, 9 aa, Homo Sapiens
INRVIDRAE

SEQ ID NO: 429282 - protein, 9 aa, Homo Sapiens
SLPIPGQFT

SEQ ID NO: 429283 - protein, 9 aa, Homo Sapiens
ELQENNKSL

SEQ ID NO: 429284 - protein, 9 aa, Homo Sapiens
RIRGSSTDI

SEQ ID NO: 429285 - protein, 9 aa, Homo Sapiens
DSEIVSNDI

SEQ ID NO: 429286 - protein, 9 aa, Homo Sapiens
KVTHTVKFL

SEQ ID NO: 429287 - protein, 9 aa, Homo Sapiens
THWLGAAPS

SEQ ID NO: 429288 - protein, 9 aa, Homo Sapiens
MHLNRDIWK

SEQ ID NO: 429289 - protein, 9 aa, Homo Sapiens
ARAREQVKT

SEQ ID NO: 429290 - protein, 9 aa, Homo Sapiens
LGIHLPLPF

SEQ ID NO: 429291 - protein, 9 aa, Homo Sapiens
RDPSSPLEP

SEQ ID NO: 429292 - protein, 9 aa, Homo Sapiens
KNLHFFAPD

SEQ ID NO: 429293 - protein, 9 aa, Homo Sapiens
SDILDSSVN

SEQ ID NO: 429294 - protein, 9 aa, Homo Sapiens
AYLCNYTRK

SEQ ID NO: 429295 - protein, 9 aa, Homo Sapiens
PKHDMELAF

SEQ ID NO: 429296 - protein, 9 aa, Homo Sapiens
KSDGGTYQC

SEQ ID NO: 429297 - protein, 9 aa, Homo Sapiens
PFGLTQYQY

SEQ ID NO: 429298 - protein, 9 aa, Homo Sapiens
RKLTELCHM

SEQ ID NO: 429299 - protein, 9 aa, Homo Sapiens
QVSTLNSYQ

SEQ ID NO: 429300 - protein, 9 aa, Homo Sapiens
QGRICSTND

SEQ ID NO: 429301 - protein, 9 aa, Homo Sapiens
TRRSLGYAH

SEQ ID NO: 429302 - protein, 9 aa, Homo Sapiens
QRFNPETNS

SEQ ID NO: 429303 - protein, 9 aa, Homo Sapiens
PGSDKVGED

SEQ ID NO: 429304 - protein, 9 aa, Homo Sapiens
QALTERKNR

SEQ ID NO: 429305 - protein, 9 aa, Homo Sapiens
TPSAITVFD

SEQ ID NO: 429306 - protein, 9 aa, Homo Sapiens
AQRYCEGHL

SEQ ID NO: 429307 - protein, 9 aa, Homo Sapiens
KCSQDCATC

SEQ ID NO: 429308 - protein, 9 aa, Homo Sapiens
DQRLKESDQ

SEQ ID NO: 429309 - protein, 9 aa, Homo Sapiens
LQQLEALKA

SEQ ID NO: 429310 - protein, 9 aa, Homo Sapiens
QPSIICIDE

SEQ ID NO: 429311 - protein, 9 aa, Homo Sapiens
ACQKTAHYS

SEQ ID NO: 429312 - protein, 9 aa, Homo Sapiens
LQFAPDNKL

SEQ ID NO: 429313 - protein, 9 aa, Homo Sapiens
KTKRKPQIL

SEQ ID NO: 429314 - protein, 9 aa, Homo Sapiens
ANIGHLVED

SEQ ID NO: 429315 - protein, 9 aa, Homo Sapiens
VQVCNRFNC

SEQ ID NO: 429316 - protein, 9 aa, Homo Sapiens
GSSDKRGSF

SEQ ID NO: 429317 - protein, 9 aa, Homo Sapiens
DGGHNSVIL

SEQ ID NO: 429318 - protein, 9 aa, Homo Sapiens
RRLPANKSR

SEQ ID NO: 429319 - protein, 9 aa, Homo Sapiens
VQSLDKNVM

SEQ ID NO: 429320 - protein, 9 aa, Homo Sapiens
PPQQLLQTS

SEQ ID NO: 429321 - protein, 9 aa, Homo Sapiens
IKKELFTCP

SEQ ID NO: 429322 - protein, 9 aa, Homo Sapiens
ERGVGAGIR

SEQ ID NO: 429323 - protein, 9 aa, Homo Sapiens
PSYKTNESL

SEQ ID NO: 429324 - protein, 9 aa, Homo Sapiens
DTNDDPECG

SEQ ID NO: 429325 - protein, 9 aa, Homo Sapiens
LPQRKTSWS

SEQ ID NO: 429326 - protein, 9 aa, Homo Sapiens
HCKAHTEKQ

SEQ ID NO: 429327 - protein, 9 aa, Homo Sapiens
QDAHLAYGS

SEQ ID NO: 429328 - protein, 9 aa, Homo Sapiens
LTELCHMWL

SEQ ID NO: 429329 - protein, 9 aa, Homo Sapiens
HKAELTEDQ

SEQ ID NO: 429330 - protein, 9 aa, Homo Sapiens
DLNQTIFVQ

SEQ ID NO: 429331 - protein, 9 aa, Homo Sapiens
YFSSGTSSR

SEQ ID NO: 429332 - protein, 9 aa, Homo Sapiens
MEVDEDKST

SEQ ID NO: 429333 - protein, 9 aa, Homo Sapiens
GVDSSADSG

SEQ ID NO: 429334 - protein, 9 aa, Homo Sapiens
LGPTGIPGL

SEQ ID NO: 429335 - protein, 9 aa, Homo Sapiens
SSTFHRMYP

SEQ ID NO: 429336 - protein, 9 aa, Homo Sapiens
YLHVQGVIH

SEQ ID NO: 429337 - protein, 9 aa, Homo Sapiens
RAQAHKALS

SEQ ID NO: 429338 - protein, 9 aa, Homo Sapiens
KEAHMLCQR

SEQ ID NO: 429339 - protein, 9 aa, Homo Sapiens
CGRTFRRRL

SEQ ID NO: 429340 - protein, 9 aa, Homo Sapiens
SRSAGIIEL

SEQ ID NO: 429341 - protein, 9 aa, Homo Sapiens
PLGIDKTID

SEQ ID NO: 429342 - protein, 9 aa, Homo Sapiens
RAKCSQDCA

SEQ ID NO: 429343 - protein, 9 aa, Homo Sapiens
SHLSRHEII

SEQ ID NO: 429344 - protein, 9 aa, Homo Sapiens
WTPQSPDSR

SEQ ID NO: 429345 - protein, 9 aa, Homo Sapiens
RYSSTKIVE

SEQ ID NO: 429346 - protein, 9 aa, Homo Sapiens
YVSLMKRGC

SEQ ID NO: 429347 - protein, 9 aa, Homo Sapiens
MDMEEYILE

SEQ ID NO: 429348 - protein, 9 aa, Homo Sapiens
LTAVILFYG

SEQ ID NO: 429349 - protein, 9 aa, Homo Sapiens
NWGVKLHVF

SEQ ID NO: 429350 - protein, 9 aa, Homo Sapiens
LTVAAILLG

SEQ ID NO: 429351 - protein, 9 aa, Homo Sapiens
GQYLPAVPQ

SEQ ID NO: 429352 - protein, 9 aa, Homo Sapiens
ASVILCFRD

SEQ ID NO: 429353 - protein, 9 aa, Homo Sapiens
IDQILDMVN

SEQ ID NO: 429354 - protein, 9 aa, Homo Sapiens
TEYFQGPCH

SEQ ID NO: 429355 - protein, 9 aa, Homo Sapiens
YYEKSYALA

SEQ ID NO: 429356 - protein, 9 aa, Homo Sapiens
SSSSSESDK

SEQ ID NO: 429357 - protein, 9 aa, Homo Sapiens
KLDSKAVHS

SEQ ID NO: 429358 - protein, 9 aa, Homo Sapiens
RLIDDHTKK

SEQ ID NO: 429359 - protein, 9 aa, Homo Sapiens
ITIVAGLVQ

SEQ ID NO: 429360 - protein, 9 aa, Homo Sapiens
DNANLDASC

SEQ ID NO: 429361 - protein, 9 aa, Homo Sapiens
AMDLVKIHL

SEQ ID NO: 429362 - protein, 9 aa, Homo Sapiens
NWGIDKCNA

SEQ ID NO: 429363 - protein, 9 aa, Homo Sapiens
HHPSGAVEY

SEQ ID NO: 429364 - protein, 9 aa, Homo Sapiens
MSSLGKSSD

SEQ ID NO: 429365 - protein, 9 aa, Homo Sapiens
PPDLGSVDA

SEQ ID NO: 429366 - protein, 9 aa, Homo Sapiens
SPSTMLPIY

SEQ ID NO: 429367 - protein, 9 aa, Homo Sapiens
WVKRLFLHK

SEQ ID NO: 429368 - protein, 9 aa, Homo Sapiens
YLNPLYSSK

SEQ ID NO: 429369 - protein, 9 aa, Homo Sapiens
RLHEAENKH

SEQ ID NO: 429370 - protein, 9 aa, Homo Sapiens
SSAKSGALG

SEQ ID NO: 429371 - protein, 9 aa, Homo Sapiens
KMVEGTAWK

SEQ ID NO: 429372 - protein, 9 aa, Homo Sapiens
LSLFRLITQ

SEQ ID NO: 429373 - protein, 9 aa, Homo Sapiens
CVLTRGNLT

SEQ ID NO: 429374 - protein, 9 aa, Homo Sapiens
ILQKHGKNV

SEQ ID NO: 429375 - protein, 9 aa, Homo Sapiens
NKYINSTLP

SEQ ID NO: 429376 - protein, 9 aa, Homo Sapiens
RYRYIITYH

SEQ ID NO: 429377 - protein, 9 aa, Homo Sapiens
QKESGHSLK

SEQ ID NO: 429378 - protein, 9 aa, Homo Sapiens
RKFEFWASS

SEQ ID NO: 429379 - protein, 9 aa, Homo Sapiens
SGLFPSTTT

SEQ ID NO: 429380 - protein, 9 aa, Homo Sapiens
IHMLTQYAR

SEQ ID NO: 429381 - protein, 9 aa, Homo Sapiens
FKIYGVDSS

SEQ ID NO: 429382 - protein, 9 aa, Homo Sapiens
TCVVQVTAT

SEQ ID NO: 429383 - protein, 9 aa, Homo Sapiens
GVSRTHKLT

SEQ ID NO: 429384 - protein, 9 aa, Homo Sapiens
KGKEVDNVF

SEQ ID NO: 429385 - protein, 9 aa, Homo Sapiens
QNEDDEVPV

SEQ ID NO: 429386 - protein, 9 aa, Homo Sapiens
VNCPGWNED

SEQ ID NO: 429387 - protein, 9 aa, Homo Sapiens
QDNNGSLNT

SEQ ID NO: 429388 - protein, 9 aa, Homo Sapiens
YKKEDQEKK

SEQ ID NO: 429389 - protein, 9 aa, Homo Sapiens
CKRFEEVTR

SEQ ID NO: 429390 - protein, 9 aa, Homo Sapiens
SEISSATQL

SEQ ID NO: 429391 - protein, 9 aa, Homo Sapiens
VDLIRAGKK

SEQ ID NO: 429392 - protein, 9 aa, Homo Sapiens
KLYTISLRL

SEQ ID NO: 429393 - protein, 9 aa, Homo Sapiens
GCSNSLIKE

SEQ ID NO: 429394 - protein, 9 aa, Homo Sapiens
TRSGSAHKY

SEQ ID NO: 429395 - protein, 9 aa, Homo Sapiens
RFANSSNRK

SEQ ID NO: 429396 - protein, 9 aa, Homo Sapiens
DTLPEFRED

SEQ ID NO: 429397 - protein, 9 aa, Homo Sapiens
RNPTFMCLV

SEQ ID NO: 429398 - protein, 9 aa, Homo Sapiens
TKQRRPLKD

SEQ ID NO: 429399 - protein, 9 aa, Homo Sapiens
DQVNIAEGN

SEQ ID NO: 429400 - protein, 9 aa, Homo Sapiens
NSAGEYGKG

SEQ ID NO: 429401 - protein, 9 aa, Homo Sapiens
RKGKRHHTH

SEQ ID NO: 429402 - protein, 9 aa, Homo Sapiens
YESSVSEDV

SEQ ID NO: 429403 - protein, 9 aa, Homo Sapiens
KLWWTIAKY

SEQ ID NO: 429404 - protein, 9 aa, Homo Sapiens
KIPNSGTVD

SEQ ID NO: 429405 - protein, 9 aa, Homo Sapiens
NTSEDGQTI

SEQ ID NO: 429406 - protein, 9 aa, Homo Sapiens
KSITDIIKF

SEQ ID NO: 429407 - protein, 9 aa, Homo Sapiens
KSQLVIHHK

SEQ ID NO: 429408 - protein, 9 aa, Homo Sapiens
WGYQLTQHQ

SEQ ID NO: 429409 - protein, 9 aa, Homo Sapiens
NENGPKPNS

SEQ ID NO: 429410 - protein, 9 aa, Homo Sapiens
QHEAVNVIC

SEQ ID NO: 429411 - protein, 9 aa, Homo Sapiens
NKMIFKRLH

SEQ ID NO: 429412 - protein, 9 aa, Homo Sapiens
GDPGVIKVI

SEQ ID NO: 429413 - protein, 9 aa, Homo Sapiens
GHHSSANSV

SEQ ID NO: 429414 - protein, 9 aa, Homo Sapiens
TIGTQSLHP

SEQ ID NO: 429415 - protein, 9 aa, Homo Sapiens
YIPQVPLPP

SEQ ID NO: 429416 - protein, 9 aa, Homo Sapiens
ETEAIQEEL

SEQ ID NO: 429417 - protein, 9 aa, Homo Sapiens
LKYEDMHWD

SEQ ID NO: 429418 - protein, 9 aa, Homo Sapiens
LNVKQCFNN

SEQ ID NO: 429419 - protein, 9 aa, Homo Sapiens
KLIQHQIMH

SEQ ID NO: 429420 - protein, 9 aa, Homo Sapiens
VDTSEKGRF

SEQ ID NO: 429421 - protein, 9 aa, Homo Sapiens
KDENYKQTC

SEQ ID NO: 429422 - protein, 9 aa, Homo Sapiens
INYNGPMLT

SEQ ID NO: 429423 - protein, 9 aa, Homo Sapiens
CTKKKRKTL

SEQ ID NO: 429424 - protein, 9 aa, Homo Sapiens
VDRKTGTVY

SEQ ID NO: 429425 - protein, 9 aa, Homo Sapiens
CEYGTKSIS

SEQ ID NO: 429426 - protein, 9 aa, Homo Sapiens
KYKKIHTGD

SEQ ID NO: 429427 - protein, 9 aa, Homo Sapiens
AFPLFMDNS

SEQ ID NO: 429428 - protein, 9 aa, Homo Sapiens
NKNYRASQQ

SEQ ID NO: 429429 - protein, 9 aa, Homo Sapiens
TSLTAREDV

SEQ ID NO: 429430 - protein, 9 aa, Homo Sapiens
HTHLNEHRQ

SEQ ID NO: 429431 - protein, 9 aa, Homo Sapiens
SKKSNIRIN

SEQ ID NO: 429432 - protein, 9 aa, Homo Sapiens
TYIPQVPLP

SEQ ID NO: 429433 - protein, 9 aa, Homo Sapiens
RWGMKLRHL

SEQ ID NO: 429434 - protein, 9 aa, Homo Sapiens
SIRFPLMTP

SEQ ID NO: 429435 - protein, 9 aa, Homo Sapiens
SDRYPQCMC

SEQ ID NO: 429436 - protein, 9 aa, Homo Sapiens
TIFAEKTIT

SEQ ID NO: 429437 - protein, 9 aa, Homo Sapiens
EGHQTLFIG

SEQ ID NO: 429438 - protein, 9 aa, Homo Sapiens
NDLGERQSD

SEQ ID NO: 429439 - protein, 9 aa, Homo Sapiens
GWFCGGLIK

SEQ ID NO: 429440 - protein, 9 aa, Homo Sapiens
LAENTTGSN

SEQ ID NO: 429441 - protein, 9 aa, Homo Sapiens
AIQSLLESL

SEQ ID NO: 429442 - protein, 9 aa, Homo Sapiens
DISEDIKFI

SEQ ID NO: 429443 - protein, 9 aa, Homo Sapiens
IYVDFNCLD

SEQ ID NO: 429444 - protein, 9 aa, Homo Sapiens
VLIIVIIYF

SEQ ID NO: 429445 - protein, 9 aa, Homo Sapiens
IFLDILRRT

SEQ ID NO: 429446 - protein, 9 aa, Homo Sapiens
SQGMVKKEP

SEQ ID NO: 429447 - protein, 9 aa, Homo Sapiens
SKHDATTCF

SEQ ID NO: 429448 - protein, 9 aa, Homo Sapiens
FRSKYEVVD

SEQ ID NO: 429449 - protein, 9 aa, Homo Sapiens
EPTTENPKE

SEQ ID NO: 429450 - protein, 9 aa, Homo Sapiens
RRTQPKMVT

SEQ ID NO: 429451 - protein, 9 aa, Homo Sapiens
FHRMYPGQG

SEQ ID NO: 429452 - protein, 9 aa, Homo Sapiens
KHDMELAFD

SEQ ID NO: 429453 - protein, 9 aa, Homo Sapiens
RDTKKMFCE

SEQ ID NO: 429454 - protein, 9 aa, Homo Sapiens
YNLFAVNSI

SEQ ID NO: 429455 - protein, 9 aa, Homo Sapiens
SAIQAVENT

SEQ ID NO: 429456 - protein, 9 aa, Homo Sapiens
WKYSDYNIK

SEQ ID NO: 429457 - protein, 9 aa, Homo Sapiens
KIQQEAISC

SEQ ID NO: 429458 - protein, 9 aa, Homo Sapiens
VRGLYGLQV

SEQ ID NO: 429459 - protein, 9 aa, Homo Sapiens
IVVTKKSPT

SEQ ID NO: 429460 - protein, 9 aa, Homo Sapiens
HTGDKPYQC

SEQ ID NO: 429461 - protein, 9 aa, Homo Sapiens
PLLDVLREL

SEQ ID NO: 429462 - protein, 9 aa, Homo Sapiens
SRTREAALN

SEQ ID NO: 429463 - protein, 9 aa, Homo Sapiens
PALECRICH

SEQ ID NO: 429464 - protein, 9 aa, Homo Sapiens
MGEKDHMVT

SEQ ID NO: 429465 - protein, 9 aa, Homo Sapiens
QALAYLHVQ

SEQ ID NO: 429466 - protein, 9 aa, Homo Sapiens
GIPRAQAHK

SEQ ID NO: 429467 - protein, 9 aa, Homo Sapiens
QKENNICCL

SEQ ID NO: 429468 - protein, 9 aa, Homo Sapiens
ESTIPTNLE

SEQ ID NO: 429469 - protein, 9 aa, Homo Sapiens
KLKRMSTSV

SEQ ID NO: 429470 - protein, 9 aa, Homo Sapiens
GKISLFTEG

SEQ ID NO: 429471 - protein, 9 aa, Homo Sapiens
RNDKVDPVA

SEQ ID NO: 429472 - protein, 9 aa, Homo Sapiens
HNTPKGNWR

SEQ ID NO: 429473 - protein, 9 aa, Homo Sapiens
VRLPFHADN

SEQ ID NO: 429474 - protein, 9 aa, Homo Sapiens
ACYILVGCW

SEQ ID NO: 429475 - protein, 9 aa, Homo Sapiens
HHAQGKSLK

SEQ ID NO: 429476 - protein, 9 aa, Homo Sapiens
TERLEPDSS

SEQ ID NO: 429477 - protein, 9 aa, Homo Sapiens
KLHECMICG

SEQ ID NO: 429478 - protein, 9 aa, Homo Sapiens
FFLLSPLEL

SEQ ID NO: 429479 - protein, 9 aa, Homo Sapiens
EPTPNYKGK

SEQ ID NO: 429480 - protein, 9 aa, Homo Sapiens
LTPLIISNC

SEQ ID NO: 429481 - protein, 9 aa, Homo Sapiens
SVILCFRDE

SEQ ID NO: 429482 - protein, 9 aa, Homo Sapiens
SRNSEMEKA

SEQ ID NO: 429483 - protein, 9 aa, Homo Sapiens
NGIYDESNA

SEQ ID NO: 429484 - protein, 9 aa, Homo Sapiens
SEGDIAQKG

SEQ ID NO: 429485 - protein, 9 aa, Homo Sapiens
ECRDKLIKE

SEQ ID NO: 429486 - protein, 9 aa, Homo Sapiens
FLVNCKITS

SEQ ID NO: 429487 - protein, 9 aa, Homo Sapiens
FAEKTITVL

SEQ ID NO: 429488 - protein, 9 aa, Homo Sapiens
HLKKMDVGG

SEQ ID NO: 429489 - protein, 9 aa, Homo Sapiens
PEPLKDGIF

SEQ ID NO: 429490 - protein, 9 aa, Homo Sapiens
KVMRKYDKS

SEQ ID NO: 429491 - protein, 9 aa, Homo Sapiens
VDEEGDLVK

SEQ ID NO: 429492 - protein, 9 aa, Homo Sapiens
DVEIMFNER

SEQ ID NO: 429493 - protein, 9 aa, Homo Sapiens
GHNSVILDP

SEQ ID NO: 429494 - protein, 9 aa, Homo Sapiens
SAKQEGAIE

SEQ ID NO: 429495 - protein, 9 aa, Homo Sapiens
VQRYQEVGG

SEQ ID NO: 429496 - protein, 9 aa, Homo Sapiens
RAGLIAIFR

SEQ ID NO: 429497 - protein, 9 aa, Homo Sapiens
TLFVKVQLT

SEQ ID NO: 429498 - protein, 9 aa, Homo Sapiens
TQPLDREKK

SEQ ID NO: 429499 - protein, 9 aa, Homo Sapiens
ETHVKMESG

SEQ ID NO: 429500 - protein, 9 aa, Homo Sapiens
LRRIAKYEE

SEQ ID NO: 429501 - protein, 9 aa, Homo Sapiens
AVIHKLRPT

SEQ ID NO: 429502 - protein, 9 aa, Homo Sapiens
NESVSTMEI

SEQ ID NO: 429503 - protein, 9 aa, Homo Sapiens
SLRPRGERH

SEQ ID NO: 429504 - protein, 9 aa, Homo Sapiens
TQESLKTLE

SEQ ID NO: 429505 - protein, 9 aa, Homo Sapiens
GMVGQFFGG

SEQ ID NO: 429506 - protein, 9 aa, Homo Sapiens
TTFAPSDTF

SEQ ID NO: 429507 - protein, 9 aa, Homo Sapiens
MYIVCKNNK

SEQ ID NO: 429508 - protein, 9 aa, Homo Sapiens
HNDFGVFIC

SEQ ID NO: 429509 - protein, 9 aa, Homo Sapiens
QHLLLVQND

SEQ ID NO: 429510 - protein, 9 aa, Homo Sapiens
KHLEKVHVV

SEQ ID NO: 429511 - protein, 9 aa, Homo Sapiens
SKLNRSKHL

SEQ ID NO: 429512 - protein, 9 aa, Homo Sapiens
NRVQHKQFL

SEQ ID NO: 429513 - protein, 9 aa, Homo Sapiens
YINKINPLK

SEQ ID NO: 429514 - protein, 9 aa, Homo Sapiens
NKAIIRHRS

SEQ ID NO: 429515 - protein, 9 aa, Homo Sapiens
QIFLLSLFL

SEQ ID NO: 429516 - protein, 9 aa, Homo Sapiens
QCAGLLHGS

SEQ ID NO: 429517 - protein, 9 aa, Homo Sapiens
AELDKLRNE

SEQ ID NO: 429518 - protein, 9 aa, Homo Sapiens
WPGDIKAIV

SEQ ID NO: 429519 - protein, 9 aa, Homo Sapiens
YDFFVSRSS

SEQ ID NO: 429520 - protein, 9 aa, Homo Sapiens
KIDDIFNKI

SEQ ID NO: 429521 - protein, 9 aa, Homo Sapiens
YAPPRKLMA

SEQ ID NO: 429522 - protein, 9 aa, Homo Sapiens
MISLSECNI

SEQ ID NO: 429523 - protein, 9 aa, Homo Sapiens
FTKKGGLKH

SEQ ID NO: 429524 - protein, 9 aa, Homo Sapiens
GERYLEKCY

SEQ ID NO: 429525 - protein, 9 aa, Homo Sapiens
RREYEEEEG

SEQ ID NO: 429526 - protein, 9 aa, Homo Sapiens
NYYQAFQIT

SEQ ID NO: 429527 - protein, 9 aa, Homo Sapiens
KKDDNENGP

SEQ ID NO: 429528 - protein, 9 aa, Homo Sapiens
ANASNYPNS

SEQ ID NO: 429529 - protein, 9 aa, Homo Sapiens
STSADTNGP

SEQ ID NO: 429530 - protein, 9 aa, Homo Sapiens
PFLETWYIS

SEQ ID NO: 429531 - protein, 9 aa, Homo Sapiens
DFNIEEHRG

SEQ ID NO: 429532 - protein, 9 aa, Homo Sapiens
RVQKPEAEV

SEQ ID NO: 429533 - protein, 9 aa, Homo Sapiens
ISHLPIQMW

SEQ ID NO: 429534 - protein, 9 aa, Homo Sapiens
DKPEPEQGL

SEQ ID NO: 429535 - protein, 9 aa, Homo Sapiens
WTMSRPGAN

SEQ ID NO: 429536 - protein, 9 aa, Homo Sapiens
FNVIHKVAF

SEQ ID NO: 429537 - protein, 9 aa, Homo Sapiens
LSIILLIFL

SEQ ID NO: 429538 - protein, 9 aa, Homo Sapiens
DLNKADNWK

SEQ ID NO: 429539 - protein, 9 aa, Homo Sapiens
STGPAGHFP

SEQ ID NO: 429540 - protein, 9 aa, Homo Sapiens
MKTIFTQKI

SEQ ID NO: 429541 - protein, 9 aa, Homo Sapiens
CDACSESRE

SEQ ID NO: 429542 - protein, 9 aa, Homo Sapiens
GVRALHHLH

SEQ ID NO: 429543 - protein, 9 aa, Homo Sapiens
CCGDLRDNF

SEQ ID NO: 429544 - protein, 9 aa, Homo Sapiens
LEIYNHLLS

SEQ ID NO: 429545 - protein, 9 aa, Homo Sapiens
DEFRNNFDK

SEQ ID NO: 429546 - protein, 9 aa, Homo Sapiens
KINLKVAKN

SEQ ID NO: 429547 - protein, 9 aa, Homo Sapiens
PCSSCSVIP

SEQ ID NO: 429548 - protein, 9 aa, Homo Sapiens
TPKVPASVQ

SEQ ID NO: 429549 - protein, 9 aa, Homo Sapiens
IYREYELVT

SEQ ID NO: 429550 - protein, 9 aa, Homo Sapiens
GSITGASAS

SEQ ID NO: 429551 - protein, 9 aa, Homo Sapiens
PVGEVLLEN

SEQ ID NO: 429552 - protein, 9 aa, Homo Sapiens
TFQKAPEPL

SEQ ID NO: 429553 - protein, 9 aa, Homo Sapiens
TPRFSRGLR

SEQ ID NO: 429554 - protein, 9 aa, Homo Sapiens
KDKEYADII

SEQ ID NO: 429555 - protein, 9 aa, Homo Sapiens
SFATIMLNT

SEQ ID NO: 429556 - protein, 9 aa, Homo Sapiens
RHKKYAPKP

SEQ ID NO: 429557 - protein, 9 aa, Homo Sapiens
KKAKPNKCA

SEQ ID NO: 429558 - protein, 9 aa, Homo Sapiens
VLIGYAFKT

SEQ ID NO: 429559 - protein, 9 aa, Homo Sapiens
THLNEHRQI

SEQ ID NO: 429560 - protein, 9 aa, Homo Sapiens
LIELIKLKA

SEQ ID NO: 429561 - protein, 9 aa, Homo Sapiens
EIVLFTEKG

SEQ ID NO: 429562 - protein, 9 aa, Homo Sapiens
YKVLDFLGR

SEQ ID NO: 429563 - protein, 9 aa, Homo Sapiens
EKQEAQMEL

SEQ ID NO: 429564 - protein, 9 aa, Homo Sapiens
LARAESYSS

SEQ ID NO: 429565 - protein, 9 aa, Homo Sapiens
SDYMTLKIW

SEQ ID NO: 429566 - protein, 9 aa, Homo Sapiens
AQILVELRS

SEQ ID NO: 429567 - protein, 9 aa, Homo Sapiens
KTDTSHEQW

SEQ ID NO: 429568 - protein, 9 aa, Homo Sapiens
YCDDTVTYS

SEQ ID NO: 429569 - protein, 9 aa, Homo Sapiens
VAIELSQEE

SEQ ID NO: 429570 - protein, 9 aa, Homo Sapiens
LQSQENFDA

SEQ ID NO: 429571 - protein, 9 aa, Homo Sapiens
LRPDTRYVV

SEQ ID NO: 429572 - protein, 9 aa, Homo Sapiens
ILANNQGNR

SEQ ID NO: 429573 - protein, 9 aa, Homo Sapiens
KFTFQEDDS

SEQ ID NO: 429574 - protein, 9 aa, Homo Sapiens
AHAEFAPKA

SEQ ID NO: 429575 - protein, 9 aa, Homo Sapiens
NKKKKKTKK

SEQ ID NO: 429576 - protein, 9 aa, Homo Sapiens
RYAARRSLG

SEQ ID NO: 429577 - protein, 9 aa, Homo Sapiens
AADNVCKAS

SEQ ID NO: 429578 - protein, 9 aa, Homo Sapiens
KQQHGLGHG

SEQ ID NO: 429579 - protein, 9 aa, Homo Sapiens
GKSKELKEG

SEQ ID NO: 429580 - protein, 9 aa, Homo Sapiens
SHITQHKII

SEQ ID NO: 429581 - protein, 9 aa, Homo Sapiens
RLKPYKCSI

SEQ ID NO: 429582 - protein, 9 aa, Homo Sapiens
NNLLPISVK

SEQ ID NO: 429583 - protein, 9 aa, Homo Sapiens
NPCSSSPCC

SEQ ID NO: 429584 - protein, 9 aa, Homo Sapiens
NDISDIFRF

SEQ ID NO: 429585 - protein, 9 aa, Homo Sapiens
RTEEQELCD

SEQ ID NO: 429586 - protein, 9 aa, Homo Sapiens
RPVLEYINL

SEQ ID NO: 429587 - protein, 9 aa, Homo Sapiens
IPIIKSPNE

SEQ ID NO: 429588 - protein, 9 aa, Homo Sapiens
MTLSQKICS

SEQ ID NO: 429589 - protein, 9 aa, Homo Sapiens
NQKTQPIPV

SEQ ID NO: 429590 - protein, 9 aa, Homo Sapiens
RNVPTPRIK

SEQ ID NO: 429591 - protein, 9 aa, Homo Sapiens
GLHYVAQAG

SEQ ID NO: 429592 - protein, 9 aa, Homo Sapiens
EKKEDYKKT

SEQ ID NO: 429593 - protein, 9 aa, Homo Sapiens
KYIIKVARQ

SEQ ID NO: 429594 - protein, 9 aa, Homo Sapiens
SYFTRHQII

SEQ ID NO: 429595 - protein, 9 aa, Homo Sapiens
SQRDFTVVS

SEQ ID NO: 429596 - protein, 9 aa, Homo Sapiens
KEGLDKPVE

SEQ ID NO: 429597 - protein, 9 aa, Homo Sapiens
KTCSQDLFN

SEQ ID NO: 429598 - protein, 9 aa, Homo Sapiens
MVPLNQLLD

SEQ ID NO: 429599 - protein, 9 aa, Homo Sapiens
KPAQSRPDD

SEQ ID NO: 429600 - protein, 9 aa, Homo Sapiens
VFICFYINK

SEQ ID NO: 429601 - protein, 9 aa, Homo Sapiens
VTGLRNVGN

SEQ ID NO: 429602 - protein, 9 aa, Homo Sapiens
PSWKLNDQL

SEQ ID NO: 429603 - protein, 9 aa, Homo Sapiens
AIYLTGPDR

SEQ ID NO: 429604 - protein, 9 aa, Homo Sapiens
VQNKSKSLT

SEQ ID NO: 429605 - protein, 9 aa, Homo Sapiens
CAPLAKCKG

SEQ ID NO: 429606 - protein, 9 aa, Homo Sapiens
DLPVYSLEG

SEQ ID NO: 429607 - protein, 9 aa, Homo Sapiens
DSVVQFLFY

SEQ ID NO: 429608 - protein, 9 aa, Homo Sapiens
GLSSDKKMG

SEQ ID NO: 429609 - protein, 9 aa, Homo Sapiens
DKLDRLFKI

SEQ ID NO: 429610 - protein, 9 aa, Homo Sapiens
LRGCPCSDD

SEQ ID NO: 429611 - protein, 9 aa, Homo Sapiens
RQLWGSRSE

SEQ ID NO: 429612 - protein, 9 aa, Homo Sapiens
REYEEEEGT

SEQ ID NO: 429613 - protein, 9 aa, Homo Sapiens
QDNNKMSAY

SEQ ID NO: 429614 - protein, 9 aa, Homo Sapiens
RELGLLISF

SEQ ID NO: 429615 - protein, 9 aa, Homo Sapiens
EETDTMENL

SEQ ID NO: 429616 - protein, 9 aa, Homo Sapiens
VTPTVEEQI

SEQ ID NO: 429617 - protein, 9 aa, Homo Sapiens
FKPLVTVQN

SEQ ID NO: 429618 - protein, 9 aa, Homo Sapiens
AYLKKTCSQ

SEQ ID NO: 429619 - protein, 9 aa, Homo Sapiens
PATLGVLMG

SEQ ID NO: 429620 - protein, 9 aa, Homo Sapiens
STLAQNNQN

SEQ ID NO: 429621 - protein, 9 aa, Homo Sapiens
LYKCVPQEN

SEQ ID NO: 429622 - protein, 9 aa, Homo Sapiens
HQDLKPENI

SEQ ID NO: 429623 - protein, 9 aa, Homo Sapiens
SISNNLFKC

SEQ ID NO: 429624 - protein, 9 aa, Homo Sapiens
RSVTGRSRL

SEQ ID NO: 429625 - protein, 9 aa, Homo Sapiens
VFSMFEQTR

SEQ ID NO: 429626 - protein, 9 aa, Homo Sapiens
LYVHQLLRQ

SEQ ID NO: 429627 - protein, 9 aa, Homo Sapiens
QCYFVLEPK

SEQ ID NO: 429628 - protein, 9 aa, Homo Sapiens
TQKWKCIPC

SEQ ID NO: 429629 - protein, 9 aa, Homo Sapiens
IQYVVQAAD

SEQ ID NO: 429630 - protein, 9 aa, Homo Sapiens
ISFLKKVHK

SEQ ID NO: 429631 - protein, 9 aa, Homo Sapiens
RKYLAQSDL

SEQ ID NO: 429632 - protein, 9 aa, Homo Sapiens
ASSSKMKAP

SEQ ID NO: 429633 - protein, 9 aa, Homo Sapiens
RPVVTHPIY

SEQ ID NO: 429634 - protein, 9 aa, Homo Sapiens
THQIIHTGD

SEQ ID NO: 429635 - protein, 9 aa, Homo Sapiens
LIKLLHLGK

SEQ ID NO: 429636 - protein, 9 aa, Homo Sapiens
ESSTQSDVS

SEQ ID NO: 429637 - protein, 9 aa, Homo Sapiens
GEVDSEVEC

SEQ ID NO: 429638 - protein, 9 aa, Homo Sapiens
ANNPLQARR

SEQ ID NO: 429639 - protein, 9 aa, Homo Sapiens
NTGEKPYKC

SEQ ID NO: 429640 - protein, 9 aa, Homo Sapiens
NYFLSFVKE

SEQ ID NO: 429641 - protein, 9 aa, Homo Sapiens
RYDKMTSGM

SEQ ID NO: 429642 - protein, 9 aa, Homo Sapiens
ANFPTIPVA

SEQ ID NO: 429643 - protein, 9 aa, Homo Sapiens
QNAISSNNK

SEQ ID NO: 429644 - protein, 9 aa, Homo Sapiens
NFNKQNKLK

SEQ ID NO: 429645 - protein, 9 aa, Homo Sapiens
REMGSSSHA

SEQ ID NO: 429646 - protein, 9 aa, Homo Sapiens
FNVLKWTML

SEQ ID NO: 429647 - protein, 9 aa, Homo Sapiens
LSSFETIRL

SEQ ID NO: 429648 - protein, 9 aa, Homo Sapiens
IYHEQLPEL

SEQ ID NO: 429649 - protein, 9 aa, Homo Sapiens
VHPPRLWCP

SEQ ID NO: 429650 - protein, 9 aa, Homo Sapiens
YFSDSSPQT

SEQ ID NO: 429651 - protein, 9 aa, Homo Sapiens
IPLVQRLTC

SEQ ID NO: 429652 - protein, 9 aa, Homo Sapiens
FNFLPWTND

SEQ ID NO: 429653 - protein, 9 aa, Homo Sapiens
QWADLITCK

SEQ ID NO: 429654 - protein, 9 aa, Homo Sapiens
LFLHKLPKL

SEQ ID NO: 429655 - protein, 9 aa, Homo Sapiens
QIMHTGEKP

SEQ ID NO: 429656 - protein, 9 aa, Homo Sapiens
LNKADNWKR

SEQ ID NO: 429657 - protein, 9 aa, Homo Sapiens
SRKAKPVKC

SEQ ID NO: 429658 - protein, 9 aa, Homo Sapiens
GHQENSVCQ

SEQ ID NO: 429659 - protein, 9 aa, Homo Sapiens
HLYACQVAQ

SEQ ID NO: 429660 - protein, 9 aa, Homo Sapiens
DSVDGGHNS

SEQ ID NO: 429661 - protein, 9 aa, Homo Sapiens
SSSSVTYPI

SEQ ID NO: 429662 - protein, 9 aa, Homo Sapiens
TSASEGNSY

SEQ ID NO: 429663 - protein, 9 aa, Homo Sapiens
QQNVRESLE

SEQ ID NO: 429664 - protein, 9 aa, Homo Sapiens
PPTTFAPSD

SEQ ID NO: 429665 - protein, 9 aa, Homo Sapiens
PVPVTVRVH

SEQ ID NO: 429666 - protein, 9 aa, Homo Sapiens
ELINVFNKH

SEQ ID NO: 429667 - protein, 9 aa, Homo Sapiens
VRMEWPTDL

SEQ ID NO: 429668 - protein, 9 aa, Homo Sapiens
AMEVLDQLL

SEQ ID NO: 429669 - protein, 9 aa, Homo Sapiens
DGFSNCDVL

SEQ ID NO: 429670 - protein, 9 aa, Homo Sapiens
LRTYFSNFT

SEQ ID NO: 429671 - protein, 9 aa, Homo Sapiens
ANEQELKSR

SEQ ID NO: 429672 - protein, 9 aa, Homo Sapiens
NVVNLNSLI

SEQ ID NO: 429673 - protein, 9 aa, Homo Sapiens
YFDTFISES

SEQ ID NO: 429674 - protein, 9 aa, Homo Sapiens
TSTNRVLNV

SEQ ID NO: 429675 - protein, 9 aa, Homo Sapiens
PPTSWQTDI

SEQ ID NO: 429676 - protein, 9 aa, Homo Sapiens
IQAVENTSE

SEQ ID NO: 429677 - protein, 9 aa, Homo Sapiens
YKNLDILSQ

SEQ ID NO: 429678 - protein, 9 aa, Homo Sapiens
VVQLEQELQ

SEQ ID NO: 429679 - protein, 9 aa, Homo Sapiens
TYHDWLWEN

SEQ ID NO: 429680 - protein, 9 aa, Homo Sapiens
HHLAAFINK

SEQ ID NO: 429681 - protein, 9 aa, Homo Sapiens
ANVSVDHSL

SEQ ID NO: 429682 - protein, 9 aa, Homo Sapiens
FPHLVESVP

SEQ ID NO: 429683 - protein, 9 aa, Homo Sapiens
LDLNKTKVE

SEQ ID NO: 429684 - protein, 9 aa, Homo Sapiens
HLNKHNKIH

SEQ ID NO: 429685 - protein, 9 aa, Homo Sapiens
TKYPTTPKS

SEQ ID NO: 429686 - protein, 9 aa, Homo Sapiens
NHVQGLVLT

SEQ ID NO: 429687 - protein, 9 aa, Homo Sapiens
PKSEQFSSK

SEQ ID NO: 429688 - protein, 9 aa, Homo Sapiens
ALAVSMAFS

SEQ ID NO: 429689 - protein, 9 aa, Homo Sapiens
LIISSILNI

SEQ ID NO: 429690 - protein, 9 aa, Homo Sapiens
SGSSAKSGA

SEQ ID NO: 429691 - protein, 9 aa, Homo Sapiens
QKSMDSIGK

SEQ ID NO: 429692 - protein, 9 aa, Homo Sapiens
LSEQEAHKK

SEQ ID NO: 429693 - protein, 9 aa, Homo Sapiens
PLDREKKDA

SEQ ID NO: 429694 - protein, 9 aa, Homo Sapiens
HPPQILQKL

SEQ ID NO: 429695 - protein, 9 aa, Homo Sapiens
FGQYLPAVP

SEQ ID NO: 429696 - protein, 9 aa, Homo Sapiens
ITNHHRIHI

SEQ ID NO: 429697 - protein, 9 aa, Homo Sapiens
KTSASEGNS

SEQ ID NO: 429698 - protein, 9 aa, Homo Sapiens
VSSFPHRKT

SEQ ID NO: 429699 - protein, 9 aa, Homo Sapiens
WDDLNKYLE

SEQ ID NO: 429700 - protein, 9 aa, Homo Sapiens
KEEIAELQA

SEQ ID NO: 429701 - protein, 9 aa, Homo Sapiens
EVYSENEAQ

SEQ ID NO: 429702 - protein, 9 aa, Homo Sapiens
HQRNHTVDK

SEQ ID NO: 429703 - protein, 9 aa, Homo Sapiens
NKPVQVEQD

SEQ ID NO: 429704 - protein, 9 aa, Homo Sapiens
NRQQNVRAR

SEQ ID NO: 429705 - protein, 9 aa, Homo Sapiens
EYEEEEGTM

SEQ ID NO: 429706 - protein, 9 aa, Homo Sapiens
CEGHLSLSQ

SEQ ID NO: 429707 - protein, 9 aa, Homo Sapiens
AVAMMFFSN

SEQ ID NO: 429708 - protein, 9 aa, Homo Sapiens
KYVFTKNVH

SEQ ID NO: 429709 - protein, 9 aa, Homo Sapiens
NTFGYTFRL

SEQ ID NO: 429710 - protein, 9 aa, Homo Sapiens
LANLPFLET

SEQ ID NO: 429711 - protein, 9 aa, Homo Sapiens
LAVEVRDNW

SEQ ID NO: 429712 - protein, 9 aa, Homo Sapiens
HTRIELLKG

SEQ ID NO: 429713 - protein, 9 aa, Homo Sapiens
VDEVAAAPE

SEQ ID NO: 429714 - protein, 9 aa, Homo Sapiens
DWKRVETAL

SEQ ID NO: 429715 - protein, 9 aa, Homo Sapiens
QQTSGEVGL

SEQ ID NO: 429716 - protein, 9 aa, Homo Sapiens
RRTERGWMW

SEQ ID NO: 429717 - protein, 9 aa, Homo Sapiens
SSCYPGYGE

SEQ ID NO: 429718 - protein, 9 aa, Homo Sapiens
AININDIFE

SEQ ID NO: 429719 - protein, 9 aa, Homo Sapiens
SEIYKKLIN

SEQ ID NO: 429720 - protein, 9 aa, Homo Sapiens
YFEDPRVAT

SEQ ID NO: 429721 - protein, 9 aa, Homo Sapiens
RHKIIHTGD

SEQ ID NO: 429722 - protein, 9 aa, Homo Sapiens
QIQWPALVS

SEQ ID NO: 429723 - protein, 9 aa, Homo Sapiens
DVLRCVNNY

SEQ ID NO: 429724 - protein, 9 aa, Homo Sapiens
YVNNQPSMK

SEQ ID NO: 429725 - protein, 9 aa, Homo Sapiens
NLQSLISTD

SEQ ID NO: 429726 - protein, 9 aa, Homo Sapiens
VTSEFGTLP

SEQ ID NO: 429727 - protein, 9 aa, Homo Sapiens
EPVEGFNHL

SEQ ID NO: 429728 - protein, 9 aa, Homo Sapiens
APLAKCKGS

SEQ ID NO: 429729 - protein, 9 aa, Homo Sapiens
SNHFIMEYL

SEQ ID NO: 429730 - protein, 9 aa, Homo Sapiens
VDKVANESQ

SEQ ID NO: 429731 - protein, 9 aa, Homo Sapiens
LGPESRKEI

SEQ ID NO: 429732 - protein, 9 aa, Homo Sapiens
SSATQLRQL

SEQ ID NO: 429733 - protein, 9 aa, Homo Sapiens
KNYVASIST

SEQ ID NO: 429734 - protein, 9 aa, Homo Sapiens
FLHKLPKLL

SEQ ID NO: 429735 - protein, 9 aa, Homo Sapiens
QYDVPQEWQ

SEQ ID NO: 429736 - protein, 9 aa, Homo Sapiens
SLIRHWRHY

SEQ ID NO: 429737 - protein, 9 aa, Homo Sapiens
RIFLVIGTP

SEQ ID NO: 429738 - protein, 9 aa, Homo Sapiens
SDNPSLEQL

SEQ ID NO: 429739 - protein, 9 aa, Homo Sapiens
SLDVFMSEM

SEQ ID NO: 429740 - protein, 9 aa, Homo Sapiens
SSDSSFEVC

SEQ ID NO: 429741 - protein, 9 aa, Homo Sapiens
LRCYPISGH

SEQ ID NO: 429742 - protein, 9 aa, Homo Sapiens
SPSKGGNLP

SEQ ID NO: 429743 - protein, 9 aa, Homo Sapiens
NVHTLDTLT

SEQ ID NO: 429744 - protein, 9 aa, Homo Sapiens
TRDERTHKI

SEQ ID NO: 429745 - protein, 9 aa, Homo Sapiens
HQGGKINLK

SEQ ID NO: 429746 - protein, 9 aa, Homo Sapiens
LLVVALYGC

SEQ ID NO: 429747 - protein, 9 aa, Homo Sapiens
SSPAISPLT

SEQ ID NO: 429748 - protein, 9 aa, Homo Sapiens
IIQHVDVIK

SEQ ID NO: 429749 - protein, 9 aa, Homo Sapiens
TNSGIRSAS

SEQ ID NO: 429750 - protein, 9 aa, Homo Sapiens
SERSDFLHF

SEQ ID NO: 429751 - protein, 9 aa, Homo Sapiens
LLCGDMEQI

SEQ ID NO: 429752 - protein, 9 aa, Homo Sapiens
KECLVHQSK

SEQ ID NO: 429753 - protein, 9 aa, Homo Sapiens
EHLYDSKTI

SEQ ID NO: 429754 - protein, 9 aa, Homo Sapiens
VVFTLGGTR

SEQ ID NO: 429755 - protein, 9 aa, Homo Sapiens
DFLNTKERQ

SEQ ID NO: 429756 - protein, 9 aa, Homo Sapiens
EKLIKNTYI

SEQ ID NO: 429757 - protein, 9 aa, Homo Sapiens
CGTVFSRKS

SEQ ID NO: 429758 - protein, 9 aa, Homo Sapiens
VIHNSNTMR

SEQ ID NO: 429759 - protein, 9 aa, Homo Sapiens
MQKYTSAGK

SEQ ID NO: 429760 - protein, 9 aa, Homo Sapiens
GSQHHKQRR

SEQ ID NO: 429761 - protein, 9 aa, Homo Sapiens
FLSLFRLIT

SEQ ID NO: 429762 - protein, 9 aa, Homo Sapiens
VAISLGYAN

SEQ ID NO: 429763 - protein, 9 aa, Homo Sapiens
LVALAEQHV

SEQ ID NO: 429764 - protein, 9 aa, Homo Sapiens
GTTHKIILT

SEQ ID NO: 429765 - protein, 9 aa, Homo Sapiens
ITGPSCDVS

SEQ ID NO: 429766 - protein, 9 aa, Homo Sapiens
VWAINQYRV

SEQ ID NO: 429767 - protein, 9 aa, Homo Sapiens
PMCIKEDIL

SEQ ID NO: 429768 - protein, 9 aa, Homo Sapiens
VILRNKKDS

SEQ ID NO: 429769 - protein, 9 aa, Homo Sapiens
FESCADTSP

SEQ ID NO: 429770 - protein, 9 aa, Homo Sapiens
DRMVALERL

SEQ ID NO: 429771 - protein, 9 aa, Homo Sapiens
VLCEETTKS

SEQ ID NO: 429772 - protein, 9 aa, Homo Sapiens
ENDFVSAKM

SEQ ID NO: 429773 - protein, 9 aa, Homo Sapiens
QGAPMSSYV

SEQ ID NO: 429774 - protein, 9 aa, Homo Sapiens
IKIQKQIQE

SEQ ID NO: 429775 - protein, 9 aa, Homo Sapiens
WICNFIVAL

SEQ ID NO: 429776 - protein, 9 aa, Homo Sapiens
ILQDYHNPL

SEQ ID NO: 429777 - protein, 9 aa, Homo Sapiens
IFTEKLNNQ

SEQ ID NO: 429778 - protein, 9 aa, Homo Sapiens
YPKQRRFFK

SEQ ID NO: 429779 - protein, 9 aa, Homo Sapiens
GLAQHLGLG

SEQ ID NO: 429780 - protein, 9 aa, Homo Sapiens
SKGHRSDGW

SEQ ID NO: 429781 - protein, 9 aa, Homo Sapiens
CILLSDLGY

SEQ ID NO: 429782 - protein, 9 aa, Homo Sapiens
DKEVITLNA

SEQ ID NO: 429783 - protein, 9 aa, Homo Sapiens
LYIHFRHLY

SEQ ID NO: 429784 - protein, 9 aa, Homo Sapiens
ITSYMAIDG

SEQ ID NO: 429785 - protein, 9 aa, Homo Sapiens
LRWHILQKQ

SEQ ID NO: 429786 - protein, 9 aa, Homo Sapiens
SHIIIEELP

SEQ ID NO: 429787 - protein, 9 aa, Homo Sapiens
AHTIGRKPP

SEQ ID NO: 429788 - protein, 9 aa, Homo Sapiens
DVTDVVEAT

SEQ ID NO: 429789 - protein, 9 aa, Homo Sapiens
DQENKKYIM

SEQ ID NO: 429790 - protein, 9 aa, Homo Sapiens
QTYVFQYAA

SEQ ID NO: 429791 - protein, 9 aa, Homo Sapiens
HNIIHRYIK

SEQ ID NO: 429792 - protein, 9 aa, Homo Sapiens
QQTINMQQS

SEQ ID NO: 429793 - protein, 9 aa, Homo Sapiens
KDQVNLVAS

SEQ ID NO: 429794 - protein, 9 aa, Homo Sapiens
DAHACPLNF

SEQ ID NO: 429795 - protein, 9 aa, Homo Sapiens
SRYGTNNII

SEQ ID NO: 429796 - protein, 9 aa, Homo Sapiens
QDWGYFDTF

SEQ ID NO: 429797 - protein, 9 aa, Homo Sapiens
LTKLNFGML

SEQ ID NO: 429798 - protein, 9 aa, Homo Sapiens
INLALEQGD

SEQ ID NO: 429799 - protein, 9 aa, Homo Sapiens
QDSLNPRIS

SEQ ID NO: 429800 - protein, 9 aa, Homo Sapiens
QDTYYPEAD

SEQ ID NO: 429801 - protein, 9 aa, Homo Sapiens
GKLHSDQYK

SEQ ID NO: 429802 - protein, 9 aa, Homo Sapiens
NVGNINNYK

SEQ ID NO: 429803 - protein, 9 aa, Homo Sapiens
SNQIFEVIE

SEQ ID NO: 429804 - protein, 9 aa, Homo Sapiens
GLHKHRITH

SEQ ID NO: 429805 - protein, 9 aa, Homo Sapiens
VTIILHIKS

SEQ ID NO: 429806 - protein, 9 aa, Homo Sapiens
CMHVKLYIL

SEQ ID NO: 429807 - protein, 9 aa, Homo Sapiens
LNKVTQSST

SEQ ID NO: 429808 - protein, 9 aa, Homo Sapiens
PFLADFVRG

SEQ ID NO: 429809 - protein, 9 aa, Homo Sapiens
ERWAFHPCY

SEQ ID NO: 429810 - protein, 9 aa, Homo Sapiens
SIADACFVS

SEQ ID NO: 429811 - protein, 9 aa, Homo Sapiens
KEDNFFTLT

SEQ ID NO: 429812 - protein, 9 aa, Homo Sapiens
AFNRIPSLH

SEQ ID NO: 429813 - protein, 9 aa, Homo Sapiens
VTVRVHLTG

SEQ ID NO: 429814 - protein, 9 aa, Homo Sapiens
GFCVVLLFL

SEQ ID NO: 429815 - protein, 9 aa, Homo Sapiens
DIFAYALQY

SEQ ID NO: 429816 - protein, 9 aa, Homo Sapiens
AKSLSLYIS

SEQ ID NO: 429817 - protein, 9 aa, Homo Sapiens
HQQMKDAAV

SEQ ID NO: 429818 - protein, 9 aa, Homo Sapiens
QVNEWSFFM

SEQ ID NO: 429819 - protein, 9 aa, Homo Sapiens
RLLSPEFIP

SEQ ID NO: 429820 - protein, 9 aa, Homo Sapiens
KFQVRDSVV

SEQ ID NO: 429821 - protein, 9 aa, Homo Sapiens
SKEINGIYD

SEQ ID NO: 429822 - protein, 9 aa, Homo Sapiens
GMIQMFQKK

SEQ ID NO: 429823 - protein, 9 aa, Homo Sapiens
QRKRDKELA

SEQ ID NO: 429824 - protein, 9 aa, Homo Sapiens
VNYYLRNWR

SEQ ID NO: 429825 - protein, 9 aa, Homo Sapiens
HQLHACFQH

SEQ ID NO: 429826 - protein, 9 aa, Homo Sapiens
CQKTAHYSN

SEQ ID NO: 429827 - protein, 9 aa, Homo Sapiens
IDEGETNWK

SEQ ID NO: 429828 - protein, 9 aa, Homo Sapiens
KYKYEECKN

SEQ ID NO: 429829 - protein, 9 aa, Homo Sapiens
PKFLTMMAR

SEQ ID NO: 429830 - protein, 9 aa, Homo Sapiens
CFCEERDVL

SEQ ID NO: 429831 - protein, 9 aa, Homo Sapiens
NNFEMLNKV

SEQ ID NO: 429832 - protein, 9 aa, Homo Sapiens
HLRNKGNTE

SEQ ID NO: 429833 - protein, 9 aa, Homo Sapiens
HLKKMAYLA

SEQ ID NO: 429834 - protein, 9 aa, Homo Sapiens
SKKMSVAGG

SEQ ID NO: 429835 - protein, 9 aa, Homo Sapiens
YLEAASEKY

SEQ ID NO: 429836 - protein, 9 aa, Homo Sapiens
EELEGPGSP

SEQ ID NO: 429837 - protein, 9 aa, Homo Sapiens
ISKQNVISY

SEQ ID NO: 429838 - protein, 9 aa, Homo Sapiens
PVAMMGGQP

SEQ ID NO: 429839 - protein, 9 aa, Homo Sapiens
ENASQVPLQ

SEQ ID NO: 429840 - protein, 9 aa, Homo Sapiens
CYARCQSKV

SEQ ID NO: 429841 - protein, 9 aa, Homo Sapiens
DSGLSDHHE

SEQ ID NO: 429842 - protein, 9 aa, Homo Sapiens
RAHGHLWAY

SEQ ID NO: 429843 - protein, 9 aa, Homo Sapiens
DSKKDATKN

SEQ ID NO: 429844 - protein, 9 aa, Homo Sapiens
WSNDRVIHW

SEQ ID NO: 429845 - protein, 9 aa, Homo Sapiens
QLYKKLYTI

SEQ ID NO: 429846 - protein, 9 aa, Homo Sapiens
LIPDHTIQA

SEQ ID NO: 429847 - protein, 9 aa, Homo Sapiens
QKNFLLQFK

SEQ ID NO: 429848 - protein, 9 aa, Homo Sapiens
GFCEPGGKG

SEQ ID NO: 429849 - protein, 9 aa, Homo Sapiens
LDVIRRAYL

SEQ ID NO: 429850 - protein, 9 aa, Homo Sapiens
KGHIIVDKF

SEQ ID NO: 429851 - protein, 9 aa, Homo Sapiens
VFWFCVLQV

SEQ ID NO: 429852 - protein, 9 aa, Homo Sapiens
YLVKDLIFL

SEQ ID NO: 429853 - protein, 9 aa, Homo Sapiens
SDLFNDLID

SEQ ID NO: 429854 - protein, 9 aa, Homo Sapiens
YNRVNRSIY

SEQ ID NO: 429855 - protein, 9 aa, Homo Sapiens
FIRAFRTIP

SEQ ID NO: 429856 - protein, 9 aa, Homo Sapiens
HRGEGEEDN

SEQ ID NO: 429857 - protein, 9 aa, Homo Sapiens
EEGEVPAST

SEQ ID NO: 429858 - protein, 9 aa, Homo Sapiens
KENNICCLT

SEQ ID NO: 429859 - protein, 9 aa, Homo Sapiens
FILAVMSYD

SEQ ID NO: 429860 - protein, 9 aa, Homo Sapiens
EKLFEVYEK

SEQ ID NO: 429861 - protein, 9 aa, Homo Sapiens
SGLAKEIQR

SEQ ID NO: 429862 - protein, 9 aa, Homo Sapiens
PKLNHNNWI

SEQ ID NO: 429863 - protein, 9 aa, Homo Sapiens
KSDFPPTHV

SEQ ID NO: 429864 - protein, 9 aa, Homo Sapiens
QTALSKGKD

SEQ ID NO: 429865 - protein, 9 aa, Homo Sapiens
FLATFFRGS

SEQ ID NO: 429866 - protein, 9 aa, Homo Sapiens
QLHQEAWEQ

SEQ ID NO: 429867 - protein, 9 aa, Homo Sapiens
PFTIASKKI

SEQ ID NO: 429868 - protein, 9 aa, Homo Sapiens
KKMTKKFKM

SEQ ID NO: 429869 - protein, 9 aa, Homo Sapiens
DISTLTELN

SEQ ID NO: 429870 - protein, 9 aa, Homo Sapiens
QLICTVCLL

SEQ ID NO: 429871 - protein, 9 aa, Homo Sapiens
KLEDDRFPT

SEQ ID NO: 429872 - protein, 9 aa, Homo Sapiens
EQVQWMETV

SEQ ID NO: 429873 - protein, 9 aa, Homo Sapiens
SYVVSGTVC

SEQ ID NO: 429874 - protein, 9 aa, Homo Sapiens
DCSHGAEDE

SEQ ID NO: 429875 - protein, 9 aa, Homo Sapiens
RLESMSPGL

SEQ ID NO: 429876 - protein, 9 aa, Homo Sapiens
ITDWQQGLL

SEQ ID NO: 429877 - protein, 9 aa, Homo Sapiens
QVDGKKSKQ

SEQ ID NO: 429878 - protein, 9 aa, Homo Sapiens
GHKQQHGLG

SEQ ID NO: 429879 - protein, 9 aa, Homo Sapiens
MFDHSEVYG

SEQ ID NO: 429880 - protein, 9 aa, Homo Sapiens
WSVPNCAEG

SEQ ID NO: 429881 - protein, 9 aa, Homo Sapiens
QKRKLSSFF

SEQ ID NO: 429882 - protein, 9 aa, Homo Sapiens
HNSHLVEHW

SEQ ID NO: 429883 - protein, 9 aa, Homo Sapiens
HVQVLRSPP

SEQ ID NO: 429884 - protein, 9 aa, Homo Sapiens
RLVHDTGYF

SEQ ID NO: 429885 - protein, 9 aa, Homo Sapiens
SQSLDLSKL

SEQ ID NO: 429886 - protein, 9 aa, Homo Sapiens
EEVFKIYGV

SEQ ID NO: 429887 - protein, 9 aa, Homo Sapiens
CCLSVLING

SEQ ID NO: 429888 - protein, 9 aa, Homo Sapiens
PVVQIHHPS

SEQ ID NO: 429889 - protein, 9 aa, Homo Sapiens
IIEDYIYGA

SEQ ID NO: 429890 - protein, 9 aa, Homo Sapiens
AEPCRVEQY

SEQ ID NO: 429891 - protein, 9 aa, Homo Sapiens
RQAFDFLNT

SEQ ID NO: 429892 - protein, 9 aa, Homo Sapiens
ALCLGVGRY

SEQ ID NO: 429893 - protein, 9 aa, Homo Sapiens
GAELATVPD

SEQ ID NO: 429894 - protein, 9 aa, Homo Sapiens
FNHHEQSSK

SEQ ID NO: 429895 - protein, 9 aa, Homo Sapiens
ANSEWFEME

SEQ ID NO: 429896 - protein, 9 aa, Homo Sapiens
EERWAFHPC

SEQ ID NO: 429897 - protein, 9 aa, Homo Sapiens
QAMEDNLLR

SEQ ID NO: 429898 - protein, 9 aa, Homo Sapiens
LSLSRNRSL

SEQ ID NO: 429899 - protein, 9 aa, Homo Sapiens
STPLHKLCD

SEQ ID NO: 429900 - protein, 9 aa, Homo Sapiens
LSDSRHVTV

SEQ ID NO: 429901 - protein, 9 aa, Homo Sapiens
EQHAWNITL

SEQ ID NO: 429902 - protein, 9 aa, Homo Sapiens
VLSLQQLEV

SEQ ID NO: 429903 - protein, 9 aa, Homo Sapiens
IDSKKASDK

SEQ ID NO: 429904 - protein, 9 aa, Homo Sapiens
VFSQHPYAD

SEQ ID NO: 429905 - protein, 9 aa, Homo Sapiens
IVLNFTPMD

SEQ ID NO: 429906 - protein, 9 aa, Homo Sapiens
FQMLLGFQL

SEQ ID NO: 429907 - protein, 9 aa, Homo Sapiens
APAACKHLW

SEQ ID NO: 429908 - protein, 9 aa, Homo Sapiens
YTESQLQAG

SEQ ID NO: 429909 - protein, 9 aa, Homo Sapiens
GKAFIHSDQ

SEQ ID NO: 429910 - protein, 9 aa, Homo Sapiens
FVSRSSAMC

SEQ ID NO: 429911 - protein, 9 aa, Homo Sapiens
HFPIKPSLQ

SEQ ID NO: 429912 - protein, 9 aa, Homo Sapiens
LPLHNWLLL

SEQ ID NO: 429913 - protein, 9 aa, Homo Sapiens
WMRLHFPIK

SEQ ID NO: 429914 - protein, 9 aa, Homo Sapiens
EIAQTVQIL

SEQ ID NO: 429915 - protein, 9 aa, Homo Sapiens
CRPPHIFLC

SEQ ID NO: 429916 - protein, 9 aa, Homo Sapiens
GIFQYDKYV

SEQ ID NO: 429917 - protein, 9 aa, Homo Sapiens
INFESFVKD

SEQ ID NO: 429918 - protein, 9 aa, Homo Sapiens
SNLIHHFFC

SEQ ID NO: 429919 - protein, 9 aa, Homo Sapiens
GYKYKRIDG

SEQ ID NO: 429920 - protein, 9 aa, Homo Sapiens
LKDRRHIHL

SEQ ID NO: 429921 - protein, 9 aa, Homo Sapiens
HAEVSADIS

SEQ ID NO: 429922 - protein, 9 aa, Homo Sapiens
GERHLPQGS

SEQ ID NO: 429923 - protein, 9 aa, Homo Sapiens
CHKKKQSIG

SEQ ID NO: 429924 - protein, 9 aa, Homo Sapiens
EDALLQMIT

SEQ ID NO: 429925 - protein, 9 aa, Homo Sapiens
FDHQLVYCK

SEQ ID NO: 429926 - protein, 9 aa, Homo Sapiens
QKQILKILY

SEQ ID NO: 429927 - protein, 9 aa, Homo Sapiens
YLKARQAQV

SEQ ID NO: 429928 - protein, 9 aa, Homo Sapiens
KTIQVSYAR

SEQ ID NO: 429929 - protein, 9 aa, Homo Sapiens
QNGPYRQLF

SEQ ID NO: 429930 - protein, 9 aa, Homo Sapiens
CNRYFISSE

SEQ ID NO: 429931 - protein, 9 aa, Homo Sapiens
LNKTKVEDA

SEQ ID NO: 429932 - protein, 9 aa, Homo Sapiens
DLAHTIGRK

SEQ ID NO: 429933 - protein, 9 aa, Homo Sapiens
TDVCLIGEK

SEQ ID NO: 429934 - protein, 9 aa, Homo Sapiens
DQLYRLWLS

SEQ ID NO: 429935 - protein, 9 aa, Homo Sapiens
VEILPVSDK

SEQ ID NO: 429936 - protein, 9 aa, Homo Sapiens
NTYAIVERL

SEQ ID NO: 429937 - protein, 9 aa, Homo Sapiens
GRDSKKRRL

SEQ ID NO: 429938 - protein, 9 aa, Homo Sapiens
GKACRYMAG

SEQ ID NO: 429939 - protein, 9 aa, Homo Sapiens
ERVNCPGWN

SEQ ID NO: 429940 - protein, 9 aa, Homo Sapiens
QCSEPLVQP

SEQ ID NO: 429941 - protein, 9 aa, Homo Sapiens
AMNQLDFEW

SEQ ID NO: 429942 - protein, 9 aa, Homo Sapiens
LVRNIKVRE

SEQ ID NO: 429943 - protein, 9 aa, Homo Sapiens
VNTIFTLLY

SEQ ID NO: 429944 - protein, 9 aa, Homo Sapiens
LRKRSLNHL

SEQ ID NO: 429945 - protein, 9 aa, Homo Sapiens
YFQKMILRR

SEQ ID NO: 429946 - protein, 9 aa, Homo Sapiens
ADGFTGPDG

SEQ ID NO: 429947 - protein, 9 aa, Homo Sapiens
NRLSDYEKR

SEQ ID NO: 429948 - protein, 9 aa, Homo Sapiens
MYFNLQSSK

SEQ ID NO: 429949 - protein, 9 aa, Homo Sapiens
EGEPPATIG

SEQ ID NO: 429950 - protein, 9 aa, Homo Sapiens
RDTPEYVKF

SEQ ID NO: 429951 - protein, 9 aa, Homo Sapiens
DPKRAKAMN

SEQ ID NO: 429952 - protein, 9 aa, Homo Sapiens
ANPGLIYLT

SEQ ID NO: 429953 - protein, 9 aa, Homo Sapiens
LDLLGKKVY

SEQ ID NO: 429954 - protein, 9 aa, Homo Sapiens
IQLFITLFS

SEQ ID NO: 429955 - protein, 9 aa, Homo Sapiens
KVCGKVWKQ

SEQ ID NO: 429956 - protein, 9 aa, Homo Sapiens
YQPKIKGSF

SEQ ID NO: 429957 - protein, 9 aa, Homo Sapiens
VSHIIIEEL

SEQ ID NO: 429958 - protein, 9 aa, Homo Sapiens
IDEIQNGPY

SEQ ID NO: 429959 - protein, 9 aa, Homo Sapiens
HPYVKASAA

SEQ ID NO: 429960 - protein, 9 aa, Homo Sapiens
PLDLLGKKV

SEQ ID NO: 429961 - protein, 9 aa, Homo Sapiens
QDQSRSLYS

SEQ ID NO: 429962 - protein, 9 aa, Homo Sapiens
GRARCRESY

SEQ ID NO: 429963 - protein, 9 aa, Homo Sapiens
HWPGFLREA

SEQ ID NO: 429964 - protein, 9 aa, Homo Sapiens
KELYEPTWQ

SEQ ID NO: 429965 - protein, 9 aa, Homo Sapiens
REECIGFLP

SEQ ID NO: 429966 - protein, 9 aa, Homo Sapiens
HSHQQMKDA

SEQ ID NO: 429967 - protein, 9 aa, Homo Sapiens
TDRATRYRM

SEQ ID NO: 429968 - protein, 9 aa, Homo Sapiens
EDRAALLKR

SEQ ID NO: 429969 - protein, 9 aa, Homo Sapiens
QNPSHAEHH

SEQ ID NO: 429970 - protein, 9 aa, Homo Sapiens
EENQENMIY

SEQ ID NO: 429971 - protein, 9 aa, Homo Sapiens
LYPVGMYGW

SEQ ID NO: 429972 - protein, 9 aa, Homo Sapiens
IHCEFCGEF

SEQ ID NO: 429973 - protein, 9 aa, Homo Sapiens
GQFPGHNEL

SEQ ID NO: 429974 - protein, 9 aa, Homo Sapiens
SHLPIQMWC

SEQ ID NO: 429975 - protein, 9 aa, Homo Sapiens
KIYVMYIVC

SEQ ID NO: 429976 - protein, 9 aa, Homo Sapiens
RCHTFNATI

SEQ ID NO: 429977 - protein, 9 aa, Homo Sapiens
VIEDIGNKK

SEQ ID NO: 429978 - protein, 9 aa, Homo Sapiens
DLPCDLKPE

SEQ ID NO: 429979 - protein, 9 aa, Homo Sapiens
VPILFHKHW

SEQ ID NO: 429980 - protein, 9 aa, Homo Sapiens
RLGCDSEIH

SEQ ID NO: 429981 - protein, 9 aa, Homo Sapiens
KEPLLNIPE

SEQ ID NO: 429982 - protein, 9 aa, Homo Sapiens
PKPNNLGNN

SEQ ID NO: 429983 - protein, 9 aa, Homo Sapiens
PPEMSNKLE

SEQ ID NO: 429984 - protein, 9 aa, Homo Sapiens
CFVRGPPTG

SEQ ID NO: 429985 - protein, 9 aa, Homo Sapiens
GHLVEDMEN

SEQ ID NO: 429986 - protein, 9 aa, Homo Sapiens
SIFRRVLYA

SEQ ID NO: 429987 - protein, 9 aa, Homo Sapiens
HKLCDVIME

SEQ ID NO: 429988 - protein, 9 aa, Homo Sapiens
ECMANVGGL

SEQ ID NO: 429989 - protein, 9 aa, Homo Sapiens
VPQEWQKEG

SEQ ID NO: 429990 - protein, 9 aa, Homo Sapiens
IYRSASDNL

SEQ ID NO: 429991 - protein, 9 aa, Homo Sapiens
SWEGHIIPT

SEQ ID NO: 429992 - protein, 9 aa, Homo Sapiens
KNSENQTYR

SEQ ID NO: 429993 - protein, 9 aa, Homo Sapiens
EPFYKVLLS

SEQ ID NO: 429994 - protein, 9 aa, Homo Sapiens
TGIKPYACK

SEQ ID NO: 429995 - protein, 9 aa, Homo Sapiens
LRLVHDTGY

SEQ ID NO: 429996 - protein, 9 aa, Homo Sapiens
IICDISNKY

SEQ ID NO: 429997 - protein, 9 aa, Homo Sapiens
FVYCTAVCI

SEQ ID NO: 429998 - protein, 9 aa, Homo Sapiens
SELNQHQKI

SEQ ID NO: 429999 - protein, 9 aa, Homo Sapiens
GLYMFWTMI

SEQ ID NO: 430000 - protein, 9 aa, Homo Sapiens
HTDELTSLN

SEQ ID NO: 430001 - protein, 9 aa, Homo Sapiens
NAIQWMSPY

SEQ ID NO: 430002 - protein, 9 aa, Homo Sapiens
QIYDFLCEV

SEQ ID NO: 430003 - protein, 9 aa, Homo Sapiens
AFEARGSRF

SEQ ID NO: 430004 - protein, 9 aa, Homo Sapiens
VKSEEGQLV

SEQ ID NO: 430005 - protein, 9 aa, Homo Sapiens
FQTILGYHS

SEQ ID NO: 430006 - protein, 9 aa, Homo Sapiens
LDLSMEQEK

SEQ ID NO: 430007 - protein, 9 aa, Homo Sapiens
CTGQECRDT

SEQ ID NO: 430008 - protein, 9 aa, Homo Sapiens
ILKMTYPHQ

SEQ ID NO: 430009 - protein, 9 aa, Homo Sapiens
CGGLEMLPQ

SEQ ID NO: 430010 - protein, 9 aa, Homo Sapiens
EEGQYEGHK

SEQ ID NO: 430011 - protein, 9 aa, Homo Sapiens
GRTFRRRLN

SEQ ID NO: 430012 - protein, 9 aa, Homo Sapiens
QNCKLAKEN

SEQ ID NO: 430013 - protein, 9 aa, Homo Sapiens
IHQRINTGE

SEQ ID NO: 430014 - protein, 9 aa, Homo Sapiens
LAQEKEKLM

SEQ ID NO: 430015 - protein, 9 aa, Homo Sapiens
LGINSHKIN

SEQ ID NO: 430016 - protein, 9 aa, Homo Sapiens
SSYVVGPPE

SEQ ID NO: 430017 - protein, 9 aa, Homo Sapiens
LSPLHQSGS

SEQ ID NO: 430018 - protein, 9 aa, Homo Sapiens
SMFLCMHVK

SEQ ID NO: 430019 - protein, 9 aa, Homo Sapiens
QEWQKEGTP

SEQ ID NO: 430020 - protein, 9 aa, Homo Sapiens
IYTLTTNFF

SEQ ID NO: 430021 - protein, 9 aa, Homo Sapiens
PGKQRYDKM

SEQ ID NO: 430022 - protein, 9 aa, Homo Sapiens
KDLRWYRLS

SEQ ID NO: 430023 - protein, 9 aa, Homo Sapiens
FEHWQEDAL

SEQ ID NO: 430024 - protein, 9 aa, Homo Sapiens
ILYALVQYA

SEQ ID NO: 430025 - protein, 9 aa, Homo Sapiens
IRHFKQALR

SEQ ID NO: 430026 - protein, 9 aa, Homo Sapiens
RLSEEGMVN

SEQ ID NO: 430027 - protein, 9 aa, Homo Sapiens
YFLSQPSLG

SEQ ID NO: 430028 - protein, 9 aa, Homo Sapiens
VQDQTTVQT

SEQ ID NO: 430029 - protein, 9 aa, Homo Sapiens
QVSPFILAL

SEQ ID NO: 430030 - protein, 9 aa, Homo Sapiens
MECGKAFNH

SEQ ID NO: 430031 - protein, 9 aa, Homo Sapiens
PVPFRKDEK

SEQ ID NO: 430032 - protein, 9 aa, Homo Sapiens
ENKCGNCSL

SEQ ID NO: 430033 - protein, 9 aa, Homo Sapiens
IGNFALTVK

SEQ ID NO: 430034 - protein, 9 aa, Homo Sapiens
VEPGSLKSS

SEQ ID NO: 430035 - protein, 9 aa, Homo Sapiens
ALARWLPAD

SEQ ID NO: 430036 - protein, 9 aa, Homo Sapiens
ALINGYGVK

SEQ ID NO: 430037 - protein, 9 aa, Homo Sapiens
CFLPFIIIL

SEQ ID NO: 430038 - protein, 9 aa, Homo Sapiens
LASASVSWS

SEQ ID NO: 430039 - protein, 9 aa, Homo Sapiens
RKNTKLKGY

SEQ ID NO: 430040 - protein, 9 aa, Homo Sapiens
VVFDSLVNV

SEQ ID NO: 430041 - protein, 9 aa, Homo Sapiens
ESKKEYQKN

SEQ ID NO: 430042 - protein, 9 aa, Homo Sapiens
ADFEAKIIE

SEQ ID NO: 430043 - protein, 9 aa, Homo Sapiens
TKDLRWYRL

SEQ ID NO: 430044 - protein, 9 aa, Homo Sapiens
ERRLLSPEF

SEQ ID NO: 430045 - protein, 9 aa, Homo Sapiens
KCEECGTVF

SEQ ID NO: 430046 - protein, 9 aa, Homo Sapiens
GSRAAGQVA

SEQ ID NO: 430047 - protein, 9 aa, Homo Sapiens
FSKVDKMIS

SEQ ID NO: 430048 - protein, 9 aa, Homo Sapiens
LGHGHKQQH

SEQ ID NO: 430049 - protein, 9 aa, Homo Sapiens
AASRNYFTL

SEQ ID NO: 430050 - protein, 9 aa, Homo Sapiens
QSQENFDAF

SEQ ID NO: 430051 - protein, 9 aa, Homo Sapiens
TKPTFQKKN

SEQ ID NO: 430052 - protein, 9 aa, Homo Sapiens
SPSMDKIDQ

SEQ ID NO: 430053 - protein, 9 aa, Homo Sapiens
EDIMKQKHK

SEQ ID NO: 430054 - protein, 9 aa, Homo Sapiens
NIVPRLGMC

SEQ ID NO: 430055 - protein, 9 aa, Homo Sapiens
KFDDIQIYF

SEQ ID NO: 430056 - protein, 9 aa, Homo Sapiens
QLVYCKKDL

SEQ ID NO: 430057 - protein, 9 aa, Homo Sapiens
KLPSTFGQL

SEQ ID NO: 430058 - protein, 9 aa, Homo Sapiens
VANPGLIYL

SEQ ID NO: 430059 - protein, 9 aa, Homo Sapiens
GPQLSNKKR

SEQ ID NO: 430060 - protein, 9 aa, Homo Sapiens
TNVKFSIKK

SEQ ID NO: 430061 - protein, 9 aa, Homo Sapiens
YSNDKTLEV

SEQ ID NO: 430062 - protein, 9 aa, Homo Sapiens
YVTSNALPL

SEQ ID NO: 430063 - protein, 9 aa, Homo Sapiens
RDCGIPLCH

SEQ ID NO: 430064 - protein, 9 aa, Homo Sapiens
HNQFIKIMI

SEQ ID NO: 430065 - protein, 9 aa, Homo Sapiens
AVGASKLAN

SEQ ID NO: 430066 - protein, 9 aa, Homo Sapiens
GLRPDTRYV

SEQ ID NO: 430067 - protein, 9 aa, Homo Sapiens
LAPIIYFFM

SEQ ID NO: 430068 - protein, 9 aa, Homo Sapiens
CHVPAGLKG

SEQ ID NO: 430069 - protein, 9 aa, Homo Sapiens
LDIHHQIHT

SEQ ID NO: 430070 - protein, 9 aa, Homo Sapiens
IKTINDIFK

SEQ ID NO: 430071 - protein, 9 aa, Homo Sapiens
LYYYCSLCG

SEQ ID NO: 430072 - protein, 9 aa, Homo Sapiens
YSTMNYDIC

SEQ ID NO: 430073 - protein, 9 aa, Homo Sapiens
EPLVQPSAF

SEQ ID NO: 430074 - protein, 9 aa, Homo Sapiens
DTQTKNESF

SEQ ID NO: 430075 - protein, 9 aa, Homo Sapiens
FNIFHICQQ

SEQ ID NO: 430076 - protein, 9 aa, Homo Sapiens
NILNEKNYV

SEQ ID NO: 430077 - protein, 9 aa, Homo Sapiens
VIIYFDSHL

SEQ ID NO: 430078 - protein, 9 aa, Homo Sapiens
TGASASPKE

SEQ ID NO: 430079 - protein, 9 aa, Homo Sapiens
KMSSLLRKF

SEQ ID NO: 430080 - protein, 9 aa, Homo Sapiens
WMGKPVSYY

SEQ ID NO: 430081 - protein, 9 aa, Homo Sapiens
QNRLSDYEK

SEQ ID NO: 430082 - protein, 9 aa, Homo Sapiens
KEKGQRMLS

SEQ ID NO: 430083 - protein, 9 aa, Homo Sapiens
LSDSKKRKM

SEQ ID NO: 430084 - protein, 9 aa, Homo Sapiens
IGCDGQCHI

SEQ ID NO: 430085 - protein, 9 aa, Homo Sapiens
VSNQIFEVI

SEQ ID NO: 430086 - protein, 9 aa, Homo Sapiens
FVGVVTHYV

SEQ ID NO: 430087 - protein, 9 aa, Homo Sapiens
ALLNILESA

SEQ ID NO: 430088 - protein, 9 aa, Homo Sapiens
SSEIIEKNK

SEQ ID NO: 430089 - protein, 9 aa, Homo Sapiens
FKLMFDHSE

SEQ ID NO: 430090 - protein, 9 aa, Homo Sapiens
HFFFFVTGC

SEQ ID NO: 430091 - protein, 9 aa, Homo Sapiens
ESTPSTLNN

SEQ ID NO: 430092 - protein, 9 aa, Homo Sapiens
AHLYEIMRK

SEQ ID NO: 430093 - protein, 9 aa, Homo Sapiens
DNAPVTERA

SEQ ID NO: 430094 - protein, 9 aa, Homo Sapiens
GSLGFGFSS

SEQ ID NO: 430095 - protein, 9 aa, Homo Sapiens
LYLNEPNRI

SEQ ID NO: 430096 - protein, 9 aa, Homo Sapiens
TFLDLNLKL

SEQ ID NO: 430097 - protein, 9 aa, Homo Sapiens
KNIKRTKKP

SEQ ID NO: 430098 - protein, 9 aa, Homo Sapiens
LYAVFCLSS

SEQ ID NO: 430099 - protein, 9 aa, Homo Sapiens
TGGDVTQNK

SEQ ID NO: 430100 - protein, 9 aa, Homo Sapiens
CVEDKTISY

SEQ ID NO: 430101 - protein, 9 aa, Homo Sapiens
LQENLGNPS

SEQ ID NO: 430102 - protein, 9 aa, Homo Sapiens
YIRIHEIIH

SEQ ID NO: 430103 - protein, 9 aa, Homo Sapiens
VPGACLGLQ

SEQ ID NO: 430104 - protein, 9 aa, Homo Sapiens
KCGTTYLYD

SEQ ID NO: 430105 - protein, 9 aa, Homo Sapiens
ALCFLLLDV

SEQ ID NO: 430106 - protein, 9 aa, Homo Sapiens
GSAMLFPHT

SEQ ID NO: 430107 - protein, 9 aa, Homo Sapiens
KIPECGQCI

SEQ ID NO: 430108 - protein, 9 aa, Homo Sapiens
VRVERSMKE

SEQ ID NO: 430109 - protein, 9 aa, Homo Sapiens
GDHCAACRT

SEQ ID NO: 430110 - protein, 9 aa, Homo Sapiens
ITQHKIIHN

SEQ ID NO: 430111 - protein, 9 aa, Homo Sapiens
QTHTGEKPF

SEQ ID NO: 430112 - protein, 9 aa, Homo Sapiens
ATQLMNEIK

SEQ ID NO: 430113 - protein, 9 aa, Homo Sapiens
DRNTFCHSS

SEQ ID NO: 430114 - protein, 9 aa, Homo Sapiens
CSIHTKTKH

SEQ ID NO: 430115 - protein, 9 aa, Homo Sapiens
LEILNASTT

SEQ ID NO: 430116 - protein, 9 aa, Homo Sapiens
CCKEGYPCQ

SEQ ID NO: 430117 - protein, 9 aa, Homo Sapiens
DNSCRKYLF

SEQ ID NO: 430118 - protein, 9 aa, Homo Sapiens
RVNLDTMCA

SEQ ID NO: 430119 - protein, 9 aa, Homo Sapiens
NATICYHYF

SEQ ID NO: 430120 - protein, 9 aa, Homo Sapiens
GVENYNETE

SEQ ID NO: 430121 - protein, 9 aa, Homo Sapiens
RPENIHNKL

SEQ ID NO: 430122 - protein, 9 aa, Homo Sapiens
PGHQENSVC

SEQ ID NO: 430123 - protein, 9 aa, Homo Sapiens
AHQITHTGE

SEQ ID NO: 430124 - protein, 9 aa, Homo Sapiens
TDGWVAVGL

SEQ ID NO: 430125 - protein, 9 aa, Homo Sapiens
SVCSTQVSA

SEQ ID NO: 430126 - protein, 9 aa, Homo Sapiens
RARIRNVGS

SEQ ID NO: 430127 - protein, 9 aa, Homo Sapiens
GEAPELRGL

SEQ ID NO: 430128 - protein, 9 aa, Homo Sapiens
ATTGYDIAM

SEQ ID NO: 430129 - protein, 9 aa, Homo Sapiens
NNFDKITLF

SEQ ID NO: 430130 - protein, 9 aa, Homo Sapiens
CEEALINGY

SEQ ID NO: 430131 - protein, 9 aa, Homo Sapiens
ASVSYLIDT

SEQ ID NO: 430132 - protein, 9 aa, Homo Sapiens
PPATIGTQS

SEQ ID NO: 430133 - protein, 9 aa, Homo Sapiens
PCRSCLLSC

SEQ ID NO: 430134 - protein, 9 aa, Homo Sapiens
TFNTLLAGP

SEQ ID NO: 430135 - protein, 9 aa, Homo Sapiens
APGSTDAFK

SEQ ID NO: 430136 - protein, 9 aa, Homo Sapiens
FLLPKDNNG

SEQ ID NO: 430137 - protein, 9 aa, Homo Sapiens
CLCAILCCF

SEQ ID NO: 430138 - protein, 9 aa, Homo Sapiens
MAYLARKVS

SEQ ID NO: 430139 - protein, 9 aa, Homo Sapiens
RGSQNDQSI

SEQ ID NO: 430140 - protein, 9 aa, Homo Sapiens
PLNISNNVC

SEQ ID NO: 430141 - protein, 9 aa, Homo Sapiens
RPYGGRAAS

SEQ ID NO: 430142 - protein, 9 aa, Homo Sapiens
LFASQFLNG

SEQ ID NO: 430143 - protein, 9 aa, Homo Sapiens
EKIQIIATV

SEQ ID NO: 430144 - protein, 9 aa, Homo Sapiens
KLEERDELA

SEQ ID NO: 430145 - protein, 9 aa, Homo Sapiens
HSDESHKQQ

SEQ ID NO: 430146 - protein, 9 aa, Homo Sapiens
VEESLLNNL

SEQ ID NO: 430147 - protein, 9 aa, Homo Sapiens
LSPQQIFFQ

SEQ ID NO: 430148 - protein, 9 aa, Homo Sapiens
QKHGLLKSQ

SEQ ID NO: 430149 - protein, 9 aa, Homo Sapiens
QSKNEQMME

SEQ ID NO: 430150 - protein, 9 aa, Homo Sapiens
NKLRSSNAD

SEQ ID NO: 430151 - protein, 9 aa, Homo Sapiens
LQTVLRNFQ

SEQ ID NO: 430152 - protein, 9 aa, Homo Sapiens
LNSSMLKYF

SEQ ID NO: 430153 - protein, 9 aa, Homo Sapiens
NTNNCPSLK

SEQ ID NO: 430154 - protein, 9 aa, Homo Sapiens
KKLNLLTEC

SEQ ID NO: 430155 - protein, 9 aa, Homo Sapiens
NPRISVPLI

SEQ ID NO: 430156 - protein, 9 aa, Homo Sapiens
NCTTIDKQM

SEQ ID NO: 430157 - protein, 9 aa, Homo Sapiens
IWLQSNGIQ

SEQ ID NO: 430158 - protein, 9 aa, Homo Sapiens
RRKKSGWGQ

SEQ ID NO: 430159 - protein, 9 aa, Homo Sapiens
CVETLCRME

SEQ ID NO: 430160 - protein, 9 aa, Homo Sapiens
HENQSRSAG

SEQ ID NO: 430161 - protein, 9 aa, Homo Sapiens
KGGNLPSFP

SEQ ID NO: 430162 - protein, 9 aa, Homo Sapiens
SFEGLKAHT

SEQ ID NO: 430163 - protein, 9 aa, Homo Sapiens
NDFGVFICK

SEQ ID NO: 430164 - protein, 9 aa, Homo Sapiens
EEAPPSPAK

SEQ ID NO: 430165 - protein, 9 aa, Homo Sapiens
HTDPKESNL

SEQ ID NO: 430166 - protein, 9 aa, Homo Sapiens
DIVILLCAK

SEQ ID NO: 430167 - protein, 9 aa, Homo Sapiens
SLIDFFVFW

SEQ ID NO: 430168 - protein, 9 aa, Homo Sapiens
HLVYSLRNK

SEQ ID NO: 430169 - protein, 9 aa, Homo Sapiens
ESQEDEEGS

SEQ ID NO: 430170 - protein, 9 aa, Homo Sapiens
HDCGGVSPF

SEQ ID NO: 430171 - protein, 9 aa, Homo Sapiens
DKNMCNYQL

SEQ ID NO: 430172 - protein, 9 aa, Homo Sapiens
RIWELEEAM

SEQ ID NO: 430173 - protein, 9 aa, Homo Sapiens
HSTAVKLSW

SEQ ID NO: 430174 - protein, 9 aa, Homo Sapiens
IEHVNAEIV

SEQ ID NO: 430175 - protein, 9 aa, Homo Sapiens
DDLKATLTS

SEQ ID NO: 430176 - protein, 9 aa, Homo Sapiens
EKLGAAEDL

SEQ ID NO: 430177 - protein, 9 aa, Homo Sapiens
HRWVTDLNK

SEQ ID NO: 430178 - protein, 9 aa, Homo Sapiens
GLLKTLKDD

SEQ ID NO: 430179 - protein, 9 aa, Homo Sapiens
FPSLRQEKW

SEQ ID NO: 430180 - protein, 9 aa, Homo Sapiens
ALLHNNIKL

SEQ ID NO: 430181 - protein, 9 aa, Homo Sapiens
HRITSQINL

SEQ ID NO: 430182 - protein, 9 aa, Homo Sapiens
AMPLCGHQL

SEQ ID NO: 430183 - protein, 9 aa, Homo Sapiens
LAYMNQAYH

SEQ ID NO: 430184 - protein, 9 aa, Homo Sapiens
KCGARVRKN

SEQ ID NO: 430185 - protein, 9 aa, Homo Sapiens
KAVFAQTHY

SEQ ID NO: 430186 - protein, 9 aa, Homo Sapiens
IFIIKTEPS

SEQ ID NO: 430187 - protein, 9 aa, Homo Sapiens
SSNQPNLTP

SEQ ID NO: 430188 - protein, 9 aa, Homo Sapiens
LKDDLLLTD

SEQ ID NO: 430189 - protein, 9 aa, Homo Sapiens
LDAIKTFYQ

SEQ ID NO: 430190 - protein, 9 aa, Homo Sapiens
PATETSMDT

SEQ ID NO: 430191 - protein, 9 aa, Homo Sapiens
APAEEAELY

SEQ ID NO: 430192 - protein, 9 aa, Homo Sapiens
ACGFCLRPH

SEQ ID NO: 430193 - protein, 9 aa, Homo Sapiens
EIWLSGITH

SEQ ID NO: 430194 - protein, 9 aa, Homo Sapiens
PTQKDIALL

SEQ ID NO: 430195 - protein, 9 aa, Homo Sapiens
GIAFAAFLI

SEQ ID NO: 430196 - protein, 9 aa, Homo Sapiens
GGVLRGSGH

SEQ ID NO: 430197 - protein, 9 aa, Homo Sapiens
DLAKGRTQL

SEQ ID NO: 430198 - protein, 9 aa, Homo Sapiens
ENQKQCETL

SEQ ID NO: 430199 - protein, 9 aa, Homo Sapiens
KWKCIPCSW

SEQ ID NO: 430200 - protein, 9 aa, Homo Sapiens
TVKRLGIKM

SEQ ID NO: 430201 - protein, 9 aa, Homo Sapiens
GEIIKARAG

SEQ ID NO: 430202 - protein, 9 aa, Homo Sapiens
YVAAVCLER

SEQ ID NO: 430203 - protein, 9 aa, Homo Sapiens
GLRPAEAGK

SEQ ID NO: 430204 - protein, 9 aa, Homo Sapiens
KANEQELKS

SEQ ID NO: 430205 - protein, 9 aa, Homo Sapiens
ATNITPKHT

SEQ ID NO: 430206 - protein, 9 aa, Homo Sapiens
RMKTIFTQK

SEQ ID NO: 430207 - protein, 9 aa, Homo Sapiens
ITLLKESIK

SEQ ID NO: 430208 - protein, 9 aa, Homo Sapiens
TSSSSRSCL

SEQ ID NO: 430209 - protein, 9 aa, Homo Sapiens
ICSCLLSNV

SEQ ID NO: 430210 - protein, 9 aa, Homo Sapiens
GELHSELAG

SEQ ID NO: 430211 - protein, 9 aa, Homo Sapiens
VVELVKSHS

SEQ ID NO: 430212 - protein, 9 aa, Homo Sapiens
KSVKMEVDE

SEQ ID NO: 430213 - protein, 9 aa, Homo Sapiens
VENTSEDGQ

SEQ ID NO: 430214 - protein, 9 aa, Homo Sapiens
FLSQCGRSV

SEQ ID NO: 430215 - protein, 9 aa, Homo Sapiens
KFIECVSHI

SEQ ID NO: 430216 - protein, 9 aa, Homo Sapiens
IATKALHAF

SEQ ID NO: 430217 - protein, 9 aa, Homo Sapiens
AIFAVLTSI

SEQ ID NO: 430218 - protein, 9 aa, Homo Sapiens
LSRMREDRY

SEQ ID NO: 430219 - protein, 9 aa, Homo Sapiens
TWYDGEFLY

SEQ ID NO: 430220 - protein, 9 aa, Homo Sapiens
SPTHHQLHA

SEQ ID NO: 430221 - protein, 9 aa, Homo Sapiens
AEWCYGPAR

SEQ ID NO: 430222 - protein, 9 aa, Homo Sapiens
NNHLRKLPS

SEQ ID NO: 430223 - protein, 9 aa, Homo Sapiens
WFYMQTAPI

SEQ ID NO: 430224 - protein, 9 aa, Homo Sapiens
EKGQRMLSQ

SEQ ID NO: 430225 - protein, 9 aa, Homo Sapiens
ISRYQIQVG

SEQ ID NO: 430226 - protein, 9 aa, Homo Sapiens
VLLLITITA

SEQ ID NO: 430227 - protein, 9 aa, Homo Sapiens
CNHIYQIMW

SEQ ID NO: 430228 - protein, 9 aa, Homo Sapiens
RISKHWPGF

SEQ ID NO: 430229 - protein, 9 aa, Homo Sapiens
TLESFFAWK

SEQ ID NO: 430230 - protein, 9 aa, Homo Sapiens
FPQEFYTED

SEQ ID NO: 430231 - protein, 9 aa, Homo Sapiens
DFAAKLMKS

SEQ ID NO: 430232 - protein, 9 aa, Homo Sapiens
VVMNNLLPI

SEQ ID NO: 430233 - protein, 9 aa, Homo Sapiens
CTDFWDRAD

SEQ ID NO: 430234 - protein, 9 aa, Homo Sapiens
KSNLQRHRI

SEQ ID NO: 430235 - protein, 9 aa, Homo Sapiens
IALGSHWLA

SEQ ID NO: 430236 - protein, 9 aa, Homo Sapiens
KSTLESHKI

SEQ ID NO: 430237 - protein, 9 aa, Homo Sapiens
NHLNTCKPK

SEQ ID NO: 430238 - protein, 9 aa, Homo Sapiens
NHLLSVGCQ

SEQ ID NO: 430239 - protein, 9 aa, Homo Sapiens
SVYMIMDMF

SEQ ID NO: 430240 - protein, 9 aa, Homo Sapiens
KLRRLEVSG

SEQ ID NO: 430241 - protein, 9 aa, Homo Sapiens
AESNNYEEL

SEQ ID NO: 430242 - protein, 9 aa, Homo Sapiens
DTLNSLDTC

SEQ ID NO: 430243 - protein, 9 aa, Homo Sapiens
SAHLFGGTE

SEQ ID NO: 430244 - protein, 9 aa, Homo Sapiens
TYQFMMQGF

SEQ ID NO: 430245 - protein, 9 aa, Homo Sapiens
VEDGGFPQK

SEQ ID NO: 430246 - protein, 9 aa, Homo Sapiens
ILEELKEKA

SEQ ID NO: 430247 - protein, 9 aa, Homo Sapiens
TTYHRYSAP

SEQ ID NO: 430248 - protein, 9 aa, Homo Sapiens
EECKVLPDW

SEQ ID NO: 430249 - protein, 9 aa, Homo Sapiens
CLYRTPEMF

SEQ ID NO: 430250 - protein, 9 aa, Homo Sapiens
TKEIRSRLI

SEQ ID NO: 430251 - protein, 9 aa, Homo Sapiens
LMYGLASVK

SEQ ID NO: 430252 - protein, 9 aa, Homo Sapiens
LGDTEEINT

SEQ ID NO: 430253 - protein, 9 aa, Homo Sapiens
LGYACQVNE

SEQ ID NO: 430254 - protein, 9 aa, Homo Sapiens
EASGQSLLS

SEQ ID NO: 430255 - protein, 9 aa, Homo Sapiens
PNCKLQVLE

SEQ ID NO: 430256 - protein, 9 aa, Homo Sapiens
LRSPPQPEF

SEQ ID NO: 430257 - protein, 9 aa, Homo Sapiens
AGTWRSLDK

SEQ ID NO: 430258 - protein, 9 aa, Homo Sapiens
TALSLCNSP

SEQ ID NO: 430259 - protein, 9 aa, Homo Sapiens
QQMLKQLKK

SEQ ID NO: 430260 - protein, 9 aa, Homo Sapiens
DWKGWSCSS

SEQ ID NO: 430261 - protein, 9 aa, Homo Sapiens
KVRQPWNIP

SEQ ID NO: 430262 - protein, 9 aa, Homo Sapiens
CPLKDRRHI

SEQ ID NO: 430263 - protein, 9 aa, Homo Sapiens
WYLGYLARI

SEQ ID NO: 430264 - protein, 9 aa, Homo Sapiens
TFRNSNERL

SEQ ID NO: 430265 - protein, 9 aa, Homo Sapiens
QHFEHNFCK

SEQ ID NO: 430266 - protein, 9 aa, Homo Sapiens
ECWLWESYL

SEQ ID NO: 430267 - protein, 9 aa, Homo Sapiens
DLMHFYFLD

SEQ ID NO: 430268 - protein, 9 aa, Homo Sapiens
SKEYSVDRP

SEQ ID NO: 430269 - protein, 9 aa, Homo Sapiens
HWIQLPDLE

SEQ ID NO: 430270 - protein, 9 aa, Homo Sapiens
TRWTRCKQS

SEQ ID NO: 430271 - protein, 9 aa, Homo Sapiens
DELFCRCHR

SEQ ID NO: 430272 - protein, 9 aa, Homo Sapiens
RNKGNTEEA

SEQ ID NO: 430273 - protein, 9 aa, Homo Sapiens
KCCKECKLI

SEQ ID NO: 430274 - protein, 9 aa, Homo Sapiens
TTLTNQEQV

SEQ ID NO: 430275 - protein, 9 aa, Homo Sapiens
QNSNLTLGA

SEQ ID NO: 430276 - protein, 9 aa, Homo Sapiens
KKELPFFII

SEQ ID NO: 430277 - protein, 9 aa, Homo Sapiens
TRQLLSEFD

SEQ ID NO: 430278 - protein, 9 aa, Homo Sapiens
ISTANNLLL

SEQ ID NO: 430279 - protein, 9 aa, Homo Sapiens
MVPLGIDKT

SEQ ID NO: 430280 - protein, 9 aa, Homo Sapiens
ECIGFLPYE

SEQ ID NO: 430281 - protein, 9 aa, Homo Sapiens
DSHFLTDAN

SEQ ID NO: 430282 - protein, 9 aa, Homo Sapiens
WVSHRKALT

SEQ ID NO: 430283 - protein, 9 aa, Homo Sapiens
QAEGKICEC

SEQ ID NO: 430284 - protein, 9 aa, Homo Sapiens
TKTVQQNAC

SEQ ID NO: 430285 - protein, 9 aa, Homo Sapiens
IGNKKKYDF

SEQ ID NO: 430286 - protein, 9 aa, Homo Sapiens
KVICDFNTN

SEQ ID NO: 430287 - protein, 9 aa, Homo Sapiens
KAFKLFQKD

SEQ ID NO: 430288 - protein, 9 aa, Homo Sapiens
QRQQIKYFT

SEQ ID NO: 430289 - protein, 9 aa, Homo Sapiens
LDHLAPNSK

SEQ ID NO: 430290 - protein, 9 aa, Homo Sapiens
KSDVVLPFT

SEQ ID NO: 430291 - protein, 9 aa, Homo Sapiens
SHGVWKGAW

SEQ ID NO: 430292 - protein, 9 aa, Homo Sapiens
PVRLVLKDP

SEQ ID NO: 430293 - protein, 9 aa, Homo Sapiens
ANTFGYTFR

SEQ ID NO: 430294 - protein, 9 aa, Homo Sapiens
CSWKRIQSP

SEQ ID NO: 430295 - protein, 9 aa, Homo Sapiens
LEEKLKPLE

SEQ ID NO: 430296 - protein, 9 aa, Homo Sapiens
KEHNKEELY

SEQ ID NO: 430297 - protein, 9 aa, Homo Sapiens
TNINHSNSD

SEQ ID NO: 430298 - protein, 9 aa, Homo Sapiens
EYFQGPCHE

SEQ ID NO: 430299 - protein, 9 aa, Homo Sapiens
LTSSLLPQK

SEQ ID NO: 430300 - protein, 9 aa, Homo Sapiens
TIPRAYHSG

SEQ ID NO: 430301 - protein, 9 aa, Homo Sapiens
AENKHQALL

SEQ ID NO: 430302 - protein, 9 aa, Homo Sapiens
LIKDTRFSH

SEQ ID NO: 430303 - protein, 9 aa, Homo Sapiens
KKTDSGSSA

SEQ ID NO: 430304 - protein, 9 aa, Homo Sapiens
GSAIAIAVH

SEQ ID NO: 430305 - protein, 9 aa, Homo Sapiens
LDDNANLDA

SEQ ID NO: 430306 - protein, 9 aa, Homo Sapiens
SSSSSGFVE

SEQ ID NO: 430307 - protein, 9 aa, Homo Sapiens
KQNFLEERI

SEQ ID NO: 430308 - protein, 9 aa, Homo Sapiens
KIMSFVMEY

SEQ ID NO: 430309 - protein, 9 aa, Homo Sapiens
QFSAKEECM

SEQ ID NO: 430310 - protein, 9 aa, Homo Sapiens
IKAIKELQL

SEQ ID NO: 430311 - protein, 9 aa, Homo Sapiens
LRRLVTRIT

SEQ ID NO: 430312 - protein, 9 aa, Homo Sapiens
QGKISEGLQ

SEQ ID NO: 430313 - protein, 9 aa, Homo Sapiens
FGISSRSQF

SEQ ID NO: 430314 - protein, 9 aa, Homo Sapiens
QGKVPFKII

SEQ ID NO: 430315 - protein, 9 aa, Homo Sapiens
KEFNTLSGK

SEQ ID NO: 430316 - protein, 9 aa, Homo Sapiens
FQGPCHENQ

SEQ ID NO: 430317 - protein, 9 aa, Homo Sapiens
LFTVNEFIL

SEQ ID NO: 430318 - protein, 9 aa, Homo Sapiens
QLTALGCSR

SEQ ID NO: 430319 - protein, 9 aa, Homo Sapiens
YDAVNSFIH

SEQ ID NO: 430320 - protein, 9 aa, Homo Sapiens
GYENGYYCP

SEQ ID NO: 430321 - protein, 9 aa, Homo Sapiens
YFVGCFAQM

SEQ ID NO: 430322 - protein, 9 aa, Homo Sapiens
NLVSFCRTI

SEQ ID NO: 430323 - protein, 9 aa, Homo Sapiens
AWTLYVLIS

SEQ ID NO: 430324 - protein, 9 aa, Homo Sapiens
VQALTERKN

SEQ ID NO: 430325 - protein, 9 aa, Homo Sapiens
GAGQSLPSL

SEQ ID NO: 430326 - protein, 9 aa, Homo Sapiens
LQHNKIHSV

SEQ ID NO: 430327 - protein, 9 aa, Homo Sapiens
NTGRQKYKK

SEQ ID NO: 430328 - protein, 9 aa, Homo Sapiens
SASEGEDSL

SEQ ID NO: 430329 - protein, 9 aa, Homo Sapiens
EPLLNIPES

SEQ ID NO: 430330 - protein, 9 aa, Homo Sapiens
VAQGYHQIT

SEQ ID NO: 430331 - protein, 9 aa, Homo Sapiens
CARCHVPAG

SEQ ID NO: 430332 - protein, 9 aa, Homo Sapiens
SRTLLLLVK

SEQ ID NO: 430333 - protein, 9 aa, Homo Sapiens
TRPVTGLVS

SEQ ID NO: 430334 - protein, 9 aa, Homo Sapiens
PNPLVLIEH

SEQ ID NO: 430335 - protein, 9 aa, Homo Sapiens
DTIQILDAL

SEQ ID NO: 430336 - protein, 9 aa, Homo Sapiens
IRHQRINSG

SEQ ID NO: 430337 - protein, 9 aa, Homo Sapiens
YKATPRRSR

SEQ ID NO: 430338 - protein, 9 aa, Homo Sapiens
FIQSFDEIT

SEQ ID NO: 430339 - protein, 9 aa, Homo Sapiens
YPAMREAPT

SEQ ID NO: 430340 - protein, 9 aa, Homo Sapiens
KNLIKFMLR

SEQ ID NO: 430341 - protein, 9 aa, Homo Sapiens
SPFIVYLAY

SEQ ID NO: 430342 - protein, 9 aa, Homo Sapiens
LGRPIIWGL

SEQ ID NO: 430343 - protein, 9 aa, Homo Sapiens
PDPGMVNGG

SEQ ID NO: 430344 - protein, 9 aa, Homo Sapiens
QPSAFKPVV

SEQ ID NO: 430345 - protein, 9 aa, Homo Sapiens
STLFSSSHL

SEQ ID NO: 430346 - protein, 9 aa, Homo Sapiens
TLESHKIIH

SEQ ID NO: 430347 - protein, 9 aa, Homo Sapiens
ASKTKYRIR

SEQ ID NO: 430348 - protein, 9 aa, Homo Sapiens
PHLEGRNEM

SEQ ID NO: 430349 - protein, 9 aa, Homo Sapiens
ETEETLNGV

SEQ ID NO: 430350 - protein, 9 aa, Homo Sapiens
FFFVDTGSK

SEQ ID NO: 430351 - protein, 9 aa, Homo Sapiens
PLWLLVPTQ

SEQ ID NO: 430352 - protein, 9 aa, Homo Sapiens
LTALNVKQC

SEQ ID NO: 430353 - protein, 9 aa, Homo Sapiens
SSSVKRKIV

SEQ ID NO: 430354 - protein, 9 aa, Homo Sapiens
PHIFLCDKI

SEQ ID NO: 430355 - protein, 9 aa, Homo Sapiens
EKHMWEWQT

SEQ ID NO: 430356 - protein, 9 aa, Homo Sapiens
WHSDLIFHE

SEQ ID NO: 430357 - protein, 9 aa, Homo Sapiens
ERLGCDSEI

SEQ ID NO: 430358 - protein, 9 aa, Homo Sapiens
IFKSDIPFI

SEQ ID NO: 430359 - protein, 9 aa, Homo Sapiens
MRREYEEEE

SEQ ID NO: 430360 - protein, 9 aa, Homo Sapiens
SLLNNLQLR

SEQ ID NO: 430361 - protein, 9 aa, Homo Sapiens
LHLKRYSVN

SEQ ID NO: 430362 - protein, 9 aa, Homo Sapiens
VTATSLDRK

SEQ ID NO: 430363 - protein, 9 aa, Homo Sapiens
SNPNLQSLI

SEQ ID NO: 430364 - protein, 9 aa, Homo Sapiens
KRVQPLLCC

SEQ ID NO: 430365 - protein, 9 aa, Homo Sapiens
GTSFSHTCL

SEQ ID NO: 430366 - protein, 9 aa, Homo Sapiens
FETSATTGQ

SEQ ID NO: 430367 - protein, 9 aa, Homo Sapiens
HTSKENTNK

SEQ ID NO: 430368 - protein, 9 aa, Homo Sapiens
HKRYWKTQA

SEQ ID NO: 430369 - protein, 9 aa, Homo Sapiens
FFLTSSSCF

SEQ ID NO: 430370 - protein, 9 aa, Homo Sapiens
FVNVTFQIE

SEQ ID NO: 430371 - protein, 9 aa, Homo Sapiens
GMRKGSAML

SEQ ID NO: 430372 - protein, 9 aa, Homo Sapiens
ETAKSPKAL

SEQ ID NO: 430373 - protein, 9 aa, Homo Sapiens
VLGGGSGRI

SEQ ID NO: 430374 - protein, 9 aa, Homo Sapiens
EHVLLALRR

SEQ ID NO: 430375 - protein, 9 aa, Homo Sapiens
SAQFEGAER

SEQ ID NO: 430376 - protein, 9 aa, Homo Sapiens
FVNEATRVF

SEQ ID NO: 430377 - protein, 9 aa, Homo Sapiens
DSCFVDMQA

SEQ ID NO: 430378 - protein, 9 aa, Homo Sapiens
GNVEGVPYS

SEQ ID NO: 430379 - protein, 9 aa, Homo Sapiens
HRDFLPSGR

SEQ ID NO: 430380 - protein, 9 aa, Homo Sapiens
ERDQMDKSA

SEQ ID NO: 430381 - protein, 9 aa, Homo Sapiens
KGSSVSHCG

SEQ ID NO: 430382 - protein, 9 aa, Homo Sapiens
RFLIYISTT

SEQ ID NO: 430383 - protein, 9 aa, Homo Sapiens
ICSTNDSLL

SEQ ID NO: 430384 - protein, 9 aa, Homo Sapiens
QNSHLIWHQ

SEQ ID NO: 430385 - protein, 9 aa, Homo Sapiens
SLCKETGIY

SEQ ID NO: 430386 - protein, 9 aa, Homo Sapiens
TYKCKECRK

SEQ ID NO: 430387 - protein, 9 aa, Homo Sapiens
LQKLLFVMF

SEQ ID NO: 430388 - protein, 9 aa, Homo Sapiens
ELETKLQVL

SEQ ID NO: 430389 - protein, 9 aa, Homo Sapiens
GQFFGGQLG

SEQ ID NO: 430390 - protein, 9 aa, Homo Sapiens
YVLTLIFRT

SEQ ID NO: 430391 - protein, 9 aa, Homo Sapiens
VLMGSDCPH

SEQ ID NO: 430392 - protein, 9 aa, Homo Sapiens
PVRKNIFHF

SEQ ID NO: 430393 - protein, 9 aa, Homo Sapiens
ATVVCLFRR

SEQ ID NO: 430394 - protein, 9 aa, Homo Sapiens
PFQTILGYH

SEQ ID NO: 430395 - protein, 9 aa, Homo Sapiens
DFTQEEWGK

SEQ ID NO: 430396 - protein, 9 aa, Homo Sapiens
KAALKNAFY

SEQ ID NO: 430397 - protein, 9 aa, Homo Sapiens
AGPWTNHLL

SEQ ID NO: 430398 - protein, 9 aa, Homo Sapiens
PIEKSQLIH

SEQ ID NO: 430399 - protein, 9 aa, Homo Sapiens
EPQKQNTEE

SEQ ID NO: 430400 - protein, 9 aa, Homo Sapiens
DLPIKIYRE

SEQ ID NO: 430401 - protein, 9 aa, Homo Sapiens
KRLKNISPT

SEQ ID NO: 430402 - protein, 9 aa, Homo Sapiens
CYSYLMVMY

SEQ ID NO: 430403 - protein, 9 aa, Homo Sapiens
DRSDFNIEE

SEQ ID NO: 430404 - protein, 9 aa, Homo Sapiens
YKVEIYTKS

SEQ ID NO: 430405 - protein, 9 aa, Homo Sapiens
SNIGIIIRK

SEQ ID NO: 430406 - protein, 9 aa, Homo Sapiens
SSARHNSIQ

SEQ ID NO: 430407 - protein, 9 aa, Homo Sapiens
ECRICHVKC

SEQ ID NO: 430408 - protein, 9 aa, Homo Sapiens
LRTLDISNS

SEQ ID NO: 430409 - protein, 9 aa, Homo Sapiens
PHQPQIVEM

SEQ ID NO: 430410 - protein, 9 aa, Homo Sapiens
KKHKTGETS

SEQ ID NO: 430411 - protein, 9 aa, Homo Sapiens
DLDYTGISW

SEQ ID NO: 430412 - protein, 9 aa, Homo Sapiens
SNILKMTYP

SEQ ID NO: 430413 - protein, 9 aa, Homo Sapiens
VTRRPLPLT

SEQ ID NO: 430414 - protein, 9 aa, Homo Sapiens
QDQTTVQTV

SEQ ID NO: 430415 - protein, 9 aa, Homo Sapiens
TCFNVLKWT

SEQ ID NO: 430416 - protein, 9 aa, Homo Sapiens
YLQMHSKFP

SEQ ID NO: 430417 - protein, 9 aa, Homo Sapiens
DPSGLLNNF

SEQ ID NO: 430418 - protein, 9 aa, Homo Sapiens
EMGRIIQTP

SEQ ID NO: 430419 - protein, 9 aa, Homo Sapiens
DGPYPKKGA

SEQ ID NO: 430420 - protein, 9 aa, Homo Sapiens
SQDETKTLL

SEQ ID NO: 430421 - protein, 9 aa, Homo Sapiens
LTRMCTIIM

SEQ ID NO: 430422 - protein, 9 aa, Homo Sapiens
DKFATLAEL

SEQ ID NO: 430423 - protein, 9 aa, Homo Sapiens
STFEDVWRM

SEQ ID NO: 430424 - protein, 9 aa, Homo Sapiens
GKAKTKRLT

SEQ ID NO: 430425 - protein, 9 aa, Homo Sapiens
QEKVVYMFY

SEQ ID NO: 430426 - protein, 9 aa, Homo Sapiens
PKSIQDIET

SEQ ID NO: 430427 - protein, 9 aa, Homo Sapiens
DNRVQHKQF

SEQ ID NO: 430428 - protein, 9 aa, Homo Sapiens
SRQNELLKR

SEQ ID NO: 430429 - protein, 9 aa, Homo Sapiens
VGLVLGTFI

SEQ ID NO: 430430 - protein, 9 aa, Homo Sapiens
MLAFHTSAP

SEQ ID NO: 430431 - protein, 9 aa, Homo Sapiens
MGSAEDSKG

SEQ ID NO: 430432 - protein, 9 aa, Homo Sapiens
EMYSDFALK

SEQ ID NO: 430433 - protein, 9 aa, Homo Sapiens
SVVMGLAWT

SEQ ID NO: 430434 - protein, 9 aa, Homo Sapiens
PDKKDDNEN

SEQ ID NO: 430435 - protein, 9 aa, Homo Sapiens
CLELRHREI

SEQ ID NO: 430436 - protein, 9 aa, Homo Sapiens
YNLVEPVNK

SEQ ID NO: 430437 - protein, 9 aa, Homo Sapiens
AYVQCLAWV

SEQ ID NO: 430438 - protein, 9 aa, Homo Sapiens
IIARICING

SEQ ID NO: 430439 - protein, 9 aa, Homo Sapiens
NVCLAPIIY

SEQ ID NO: 430440 - protein, 9 aa, Homo Sapiens
RSMKEASLQ

SEQ ID NO: 430441 - protein, 9 aa, Homo Sapiens
QLSGQSIKA

SEQ ID NO: 430442 - protein, 9 aa, Homo Sapiens
QPGTGNQIP

SEQ ID NO: 430443 - protein, 9 aa, Homo Sapiens
DGKMLRRTE

SEQ ID NO: 430444 - protein, 9 aa, Homo Sapiens
QDETKTLLH

SEQ ID NO: 430445 - protein, 9 aa, Homo Sapiens
DKVGEDSED

SEQ ID NO: 430446 - protein, 9 aa, Homo Sapiens
PPSLPIPGQ

SEQ ID NO: 430447 - protein, 9 aa, Homo Sapiens
HPEINLAID

SEQ ID NO: 430448 - protein, 9 aa, Homo Sapiens
SKCCKEGYP

SEQ ID NO: 430449 - protein, 9 aa, Homo Sapiens
EVDRKTGTV

SEQ ID NO: 430450 - protein, 9 aa, Homo Sapiens
LVNGFANNP

SEQ ID NO: 430451 - protein, 9 aa, Homo Sapiens
LKQQYNDHH

SEQ ID NO: 430452 - protein, 9 aa, Homo Sapiens
SHYRMECPE

SEQ ID NO: 430453 - protein, 9 aa, Homo Sapiens
ICRPTCSVE

SEQ ID NO: 430454 - protein, 9 aa, Homo Sapiens
SNDISDIFR

SEQ ID NO: 430455 - protein, 9 aa, Homo Sapiens
NRNDLQKVL

SEQ ID NO: 430456 - protein, 9 aa, Homo Sapiens
GPLTRRRTV

SEQ ID NO: 430457 - protein, 9 aa, Homo Sapiens
IFTLLQLFF

SEQ ID NO: 430458 - protein, 9 aa, Homo Sapiens
KSLGEETQE

SEQ ID NO: 430459 - protein, 9 aa, Homo Sapiens
NNWAKVGDL

SEQ ID NO: 430460 - protein, 9 aa, Homo Sapiens
QGGSGGPVV

SEQ ID NO: 430461 - protein, 9 aa, Homo Sapiens
LPVLIIMSL

SEQ ID NO: 430462 - protein, 9 aa, Homo Sapiens
PHFYFLSND

SEQ ID NO: 430463 - protein, 9 aa, Homo Sapiens
APIPRINVT

SEQ ID NO: 430464 - protein, 9 aa, Homo Sapiens
NQPNLTPQN

SEQ ID NO: 430465 - protein, 9 aa, Homo Sapiens
YITVTSEFG

SEQ ID NO: 430466 - protein, 9 aa, Homo Sapiens
HIRHMSSKG

SEQ ID NO: 430467 - protein, 9 aa, Homo Sapiens
TQMKLMVIP

SEQ ID NO: 430468 - protein, 9 aa, Homo Sapiens
DQSRSLYST

SEQ ID NO: 430469 - protein, 9 aa, Homo Sapiens
EVNNVISPL

SEQ ID NO: 430470 - protein, 9 aa, Homo Sapiens
VHGPKPETE

SEQ ID NO: 430471 - protein, 9 aa, Homo Sapiens
CLPPSKVIC

SEQ ID NO: 430472 - protein, 9 aa, Homo Sapiens
RINEDSTGG

SEQ ID NO: 430473 - protein, 9 aa, Homo Sapiens
TSIQTGYMP

SEQ ID NO: 430474 - protein, 9 aa, Homo Sapiens
HSAEPGYLV

SEQ ID NO: 430475 - protein, 9 aa, Homo Sapiens
SYLYSHYFG

SEQ ID NO: 430476 - protein, 9 aa, Homo Sapiens
STGWNSVSH

SEQ ID NO: 430477 - protein, 9 aa, Homo Sapiens
EPLPYQPTL

SEQ ID NO: 430478 - protein, 9 aa, Homo Sapiens
VWGECNSTD

SEQ ID NO: 430479 - protein, 9 aa, Homo Sapiens
PKEYDPGQC

SEQ ID NO: 430480 - protein, 9 aa, Homo Sapiens
EKAIAQLNY

SEQ ID NO: 430481 - protein, 9 aa, Homo Sapiens
MHIKEDNFF

SEQ ID NO: 430482 - protein, 9 aa, Homo Sapiens
EQFSSKKKK

SEQ ID NO: 430483 - protein, 9 aa, Homo Sapiens
MIWNLVWKT

SEQ ID NO: 430484 - protein, 9 aa, Homo Sapiens
QRIKLIVMI

SEQ ID NO: 430485 - protein, 9 aa, Homo Sapiens
ILSPNNGNI

SEQ ID NO: 430486 - protein, 9 aa, Homo Sapiens
IKVLENIKL

SEQ ID NO: 430487 - protein, 9 aa, Homo Sapiens
TADHCPAEE

SEQ ID NO: 430488 - protein, 9 aa, Homo Sapiens
ENQLGNTRY

SEQ ID NO: 430489 - protein, 9 aa, Homo Sapiens
VYIALPGHT

SEQ ID NO: 430490 - protein, 9 aa, Homo Sapiens
HLQTSKHHP

SEQ ID NO: 430491 - protein, 9 aa, Homo Sapiens
RDRKKENVE

SEQ ID NO: 430492 - protein, 9 aa, Homo Sapiens
CGCNTCRKD

SEQ ID NO: 430493 - protein, 9 aa, Homo Sapiens
MSGTVHSSW

SEQ ID NO: 430494 - protein, 9 aa, Homo Sapiens
AALEFPPNK

SEQ ID NO: 430495 - protein, 9 aa, Homo Sapiens
EVEKITRRF

SEQ ID NO: 430496 - protein, 9 aa, Homo Sapiens
RLEKTKVEW

SEQ ID NO: 430497 - protein, 9 aa, Homo Sapiens
RMDYLHVED

SEQ ID NO: 430498 - protein, 9 aa, Homo Sapiens
ISEEEDFSN

SEQ ID NO: 430499 - protein, 9 aa, Homo Sapiens
ISKNFGADM

SEQ ID NO: 430500 - protein, 9 aa, Homo Sapiens
NPEYSSTQN

SEQ ID NO: 430501 - protein, 9 aa, Homo Sapiens
HHIRDGICH

SEQ ID NO: 430502 - protein, 9 aa, Homo Sapiens
SARHNSIQR

SEQ ID NO: 430503 - protein, 9 aa, Homo Sapiens
QNLKELIER

SEQ ID NO: 430504 - protein, 9 aa, Homo Sapiens
KMHFQTMLK

SEQ ID NO: 430505 - protein, 9 aa, Homo Sapiens
ISSILNIHS

SEQ ID NO: 430506 - protein, 9 aa, Homo Sapiens
ATICYHYFR

SEQ ID NO: 430507 - protein, 9 aa, Homo Sapiens
TKVEDAILE

SEQ ID NO: 430508 - protein, 9 aa, Homo Sapiens
SLSECNIQL

SEQ ID NO: 430509 - protein, 9 aa, Homo Sapiens
WAMLGTLLQ

SEQ ID NO: 430510 - protein, 9 aa, Homo Sapiens
VKEDSYPTP

SEQ ID NO: 430511 - protein, 9 aa, Homo Sapiens
SGTVDWTVH

SEQ ID NO: 430512 - protein, 9 aa, Homo Sapiens
KRIQSPVTN

SEQ ID NO: 430513 - protein, 9 aa, Homo Sapiens
RVAGEVHIG

SEQ ID NO: 430514 - protein, 9 aa, Homo Sapiens
DSGLAKEIQ

SEQ ID NO: 430515 - protein, 9 aa, Homo Sapiens
FPLSESQTV

SEQ ID NO: 430516 - protein, 9 aa, Homo Sapiens
QIMSVSTIS

SEQ ID NO: 430517 - protein, 9 aa, Homo Sapiens
FCEKCLNEI

SEQ ID NO: 430518 - protein, 9 aa, Homo Sapiens
EDCGQAETE

SEQ ID NO: 430519 - protein, 9 aa, Homo Sapiens
SLGRLLLRT

SEQ ID NO: 430520 - protein, 9 aa, Homo Sapiens
PKEICAQTF

SEQ ID NO: 430521 - protein, 9 aa, Homo Sapiens
AKFRQLWGS

SEQ ID NO: 430522 - protein, 9 aa, Homo Sapiens
SAEQGLEML

SEQ ID NO: 430523 - protein, 9 aa, Homo Sapiens
YSAMLGSKS

SEQ ID NO: 430524 - protein, 9 aa, Homo Sapiens
KIIHNREKP

SEQ ID NO: 430525 - protein, 9 aa, Homo Sapiens
AYLLENKGD

SEQ ID NO: 430526 - protein, 9 aa, Homo Sapiens
SRGSPMINR

SEQ ID NO: 430527 - protein, 9 aa, Homo Sapiens
DNNTDVCLI

SEQ ID NO: 430528 - protein, 9 aa, Homo Sapiens
SSNLTDHKI

SEQ ID NO: 430529 - protein, 9 aa, Homo Sapiens
LSNNVFVFQ

SEQ ID NO: 430530 - protein, 9 aa, Homo Sapiens
NYALVILIP

SEQ ID NO: 430531 - protein, 9 aa, Homo Sapiens
DCKEYGKSF

SEQ ID NO: 430532 - protein, 9 aa, Homo Sapiens
SVASAEYQE

SEQ ID NO: 430533 - protein, 9 aa, Homo Sapiens
WIDQIRTPR

SEQ ID NO: 430534 - protein, 9 aa, Homo Sapiens
CSDISVSAA

SEQ ID NO: 430535 - protein, 9 aa, Homo Sapiens
CVDNLYGYP

SEQ ID NO: 430536 - protein, 9 aa, Homo Sapiens
CNYGPEGNF

SEQ ID NO: 430537 - protein, 9 aa, Homo Sapiens
GAGSITGAS

SEQ ID NO: 430538 - protein, 9 aa, Homo Sapiens
NVISPLLDI

SEQ ID NO: 430539 - protein, 9 aa, Homo Sapiens
LNQLNSLYL

SEQ ID NO: 430540 - protein, 9 aa, Homo Sapiens
RNFPREVCE

SEQ ID NO: 430541 - protein, 9 aa, Homo Sapiens
VKFHRSHRL

SEQ ID NO: 430542 - protein, 9 aa, Homo Sapiens
VMQLINEQG

SEQ ID NO: 430543 - protein, 9 aa, Homo Sapiens
NTSMWLAGH

SEQ ID NO: 430544 - protein, 9 aa, Homo Sapiens
KILVVNVNP

SEQ ID NO: 430545 - protein, 9 aa, Homo Sapiens
NNSKCLLFW

SEQ ID NO: 430546 - protein, 9 aa, Homo Sapiens
NIKVRENSC

SEQ ID NO: 430547 - protein, 9 aa, Homo Sapiens
SYALFQVND

SEQ ID NO: 430548 - protein, 9 aa, Homo Sapiens
NGTIDFPKF

SEQ ID NO: 430549 - protein, 9 aa, Homo Sapiens
DKLIKEMDY

SEQ ID NO: 430550 - protein, 9 aa, Homo Sapiens
LMGSDCPHP

SEQ ID NO: 430551 - protein, 9 aa, Homo Sapiens
LFKVLVALA

SEQ ID NO: 430552 - protein, 9 aa, Homo Sapiens
CRLRASLRL

SEQ ID NO: 430553 - protein, 9 aa, Homo Sapiens
LKRMSTSVP

SEQ ID NO: 430554 - protein, 9 aa, Homo Sapiens
WNIPVLPDD

SEQ ID NO: 430555 - protein, 9 aa, Homo Sapiens
EEAATEPES

SEQ ID NO: 430556 - protein, 9 aa, Homo Sapiens
QPKPSTVQV

SEQ ID NO: 430557 - protein, 9 aa, Homo Sapiens
YVVSGTVCL

SEQ ID NO: 430558 - protein, 9 aa, Homo Sapiens
IFTRGQLPG

SEQ ID NO: 430559 - protein, 9 aa, Homo Sapiens
LRLWKQEPG

SEQ ID NO: 430560 - protein, 9 aa, Homo Sapiens
LIRNPKIML

SEQ ID NO: 430561 - protein, 9 aa, Homo Sapiens
EYLMGGAYL

SEQ ID NO: 430562 - protein, 9 aa, Homo Sapiens
KITRSLTDD

SEQ ID NO: 430563 - protein, 9 aa, Homo Sapiens
YVSPIAYED

SEQ ID NO: 430564 - protein, 9 aa, Homo Sapiens
CFQELQENN

SEQ ID NO: 430565 - protein, 9 aa, Homo Sapiens
VKPKEAIKK

SEQ ID NO: 430566 - protein, 9 aa, Homo Sapiens
KQLHINHNY

SEQ ID NO: 430567 - protein, 9 aa, Homo Sapiens
MAFLVRNIK

SEQ ID NO: 430568 - protein, 9 aa, Homo Sapiens
SNTLTHTDL

SEQ ID NO: 430569 - protein, 9 aa, Homo Sapiens
EWNYFMAKI

SEQ ID NO: 430570 - protein, 9 aa, Homo Sapiens
QKVAQILVE

SEQ ID NO: 430571 - protein, 9 aa, Homo Sapiens
ELKGYTLLL

SEQ ID NO: 430572 - protein, 9 aa, Homo Sapiens
YNEAECVTF

SEQ ID NO: 430573 - protein, 9 aa, Homo Sapiens
VVATKVRRH

SEQ ID NO: 430574 - protein, 9 aa, Homo Sapiens
SVQALTERK

SEQ ID NO: 430575 - protein, 9 aa, Homo Sapiens
TLYSWPWWM

SEQ ID NO: 430576 - protein, 9 aa, Homo Sapiens
QNVVQIQKL

SEQ ID NO: 430577 - protein, 9 aa, Homo Sapiens
SDVINAVKK

SEQ ID NO: 430578 - protein, 9 aa, Homo Sapiens
MPDEDECKE

SEQ ID NO: 430579 - protein, 9 aa, Homo Sapiens
QKFDEIFST

SEQ ID NO: 430580 - protein, 9 aa, Homo Sapiens
LPVVVKYLP

SEQ ID NO: 430581 - protein, 9 aa, Homo Sapiens
FTSGVLDDN

SEQ ID NO: 430582 - protein, 9 aa, Homo Sapiens
NDMQLDSEG

SEQ ID NO: 430583 - protein, 9 aa, Homo Sapiens
MEDSGRIRT

SEQ ID NO: 430584 - protein, 9 aa, Homo Sapiens
LPSWKLNDQ

SEQ ID NO: 430585 - protein, 9 aa, Homo Sapiens
GFEFIFGIQ

SEQ ID NO: 430586 - protein, 9 aa, Homo Sapiens
QDTFTTLVD

SEQ ID NO: 430587 - protein, 9 aa, Homo Sapiens
EGMCISDAF

SEQ ID NO: 430588 - protein, 9 aa, Homo Sapiens
GLLGKISLF

SEQ ID NO: 430589 - protein, 9 aa, Homo Sapiens
EGVPECRDL

SEQ ID NO: 430590 - protein, 9 aa, Homo Sapiens
LISQTAQLS

SEQ ID NO: 430591 - protein, 9 aa, Homo Sapiens
QIYYSLDYG

SEQ ID NO: 430592 - protein, 9 aa, Homo Sapiens
LGNLIFGYL

SEQ ID NO: 430593 - protein, 9 aa, Homo Sapiens
AMEDNLLRI

SEQ ID NO: 430594 - protein, 9 aa, Homo Sapiens
FQVKKHIWV

SEQ ID NO: 430595 - protein, 9 aa, Homo Sapiens
RSIQFFYFH

SEQ ID NO: 430596 - protein, 9 aa, Homo Sapiens
NVEKQDIAA

SEQ ID NO: 430597 - protein, 9 aa, Homo Sapiens
ASECAPHLS

SEQ ID NO: 430598 - protein, 9 aa, Homo Sapiens
DEFSKQVNR

SEQ ID NO: 430599 - protein, 9 aa, Homo Sapiens
GYKITFVDF

SEQ ID NO: 430600 - protein, 9 aa, Homo Sapiens
VKKEKAVKS

SEQ ID NO: 430601 - protein, 9 aa, Homo Sapiens
QKHTHSPEV

SEQ ID NO: 430602 - protein, 9 aa, Homo Sapiens
HPVCYGTCQ

SEQ ID NO: 430603 - protein, 9 aa, Homo Sapiens
EFAPKADLL

SEQ ID NO: 430604 - protein, 9 aa, Homo Sapiens
TAVVENSVK

SEQ ID NO: 430605 - protein, 9 aa, Homo Sapiens
FLELGDSAV

SEQ ID NO: 430606 - protein, 9 aa, Homo Sapiens
VFASRHHDQ

SEQ ID NO: 430607 - protein, 9 aa, Homo Sapiens
VYVGSDSLS

SEQ ID NO: 430608 - protein, 9 aa, Homo Sapiens
QNKLKRCDD

SEQ ID NO: 430609 - protein, 9 aa, Homo Sapiens
LVLHQMIHT

SEQ ID NO: 430610 - protein, 9 aa, Homo Sapiens
RCTSSLPRS

SEQ ID NO: 430611 - protein, 9 aa, Homo Sapiens
CAAQIIGSD

SEQ ID NO: 430612 - protein, 9 aa, Homo Sapiens
KSSPPESAD

SEQ ID NO: 430613 - protein, 9 aa, Homo Sapiens
LNKHNKIHT

SEQ ID NO: 430614 - protein, 9 aa, Homo Sapiens
ASQNLSTPP

SEQ ID NO: 430615 - protein, 9 aa, Homo Sapiens
FTDSLQEVL

SEQ ID NO: 430616 - protein, 9 aa, Homo Sapiens
HSDLTNHVQ

SEQ ID NO: 430617 - protein, 9 aa, Homo Sapiens
FYQEINENI

SEQ ID NO: 430618 - protein, 9 aa, Homo Sapiens
ILYAVFCLS

SEQ ID NO: 430619 - protein, 9 aa, Homo Sapiens
FHSKVTETF

SEQ ID NO: 430620 - protein, 9 aa, Homo Sapiens
PAQIKLYRN

SEQ ID NO: 430621 - protein, 9 aa, Homo Sapiens
AGCSNSLIK

SEQ ID NO: 430622 - protein, 9 aa, Homo Sapiens
MAEVYRAMN

SEQ ID NO: 430623 - protein, 9 aa, Homo Sapiens
VLVKDNGKP

SEQ ID NO: 430624 - protein, 9 aa, Homo Sapiens
LPGKSAAKK

SEQ ID NO: 430625 - protein, 9 aa, Homo Sapiens
FVCDVPAML

SEQ ID NO: 430626 - protein, 9 aa, Homo Sapiens
TIRLFLVES

SEQ ID NO: 430627 - protein, 9 aa, Homo Sapiens
PFDGIHIAN

SEQ ID NO: 430628 - protein, 9 aa, Homo Sapiens
LLHQQLKWL

SEQ ID NO: 430629 - protein, 9 aa, Homo Sapiens
PVFRAICRP

SEQ ID NO: 430630 - protein, 9 aa, Homo Sapiens
KAIFVQHLR

SEQ ID NO: 430631 - protein, 9 aa, Homo Sapiens
EYGTAGVSL

SEQ ID NO: 430632 - protein, 9 aa, Homo Sapiens
NGYGNPQNS

SEQ ID NO: 430633 - protein, 9 aa, Homo Sapiens
WAFHSAPGR

SEQ ID NO: 430634 - protein, 9 aa, Homo Sapiens
VRDGPFGLS

SEQ ID NO: 430635 - protein, 9 aa, Homo Sapiens
LSNKKRKFA

SEQ ID NO: 430636 - protein, 9 aa, Homo Sapiens
FIHSDQLTL

SEQ ID NO: 430637 - protein, 9 aa, Homo Sapiens
LFYHTRIEL

SEQ ID NO: 430638 - protein, 9 aa, Homo Sapiens
DQAVIDERL

SEQ ID NO: 430639 - protein, 9 aa, Homo Sapiens
WTHLVQLLR

SEQ ID NO: 430640 - protein, 9 aa, Homo Sapiens
ELIVDVNKP

SEQ ID NO: 430641 - protein, 9 aa, Homo Sapiens
PGIRGTIPE

SEQ ID NO: 430642 - protein, 9 aa, Homo Sapiens
TETLKVILS

SEQ ID NO: 430643 - protein, 9 aa, Homo Sapiens
EILFNVLLP

SEQ ID NO: 430644 - protein, 9 aa, Homo Sapiens
VFMSEMKSG

SEQ ID NO: 430645 - protein, 9 aa, Homo Sapiens
VERSMKEAS

SEQ ID NO: 430646 - protein, 9 aa, Homo Sapiens
VSCVAGSAL

SEQ ID NO: 430647 - protein, 9 aa, Homo Sapiens
EFFTKKGGL

SEQ ID NO: 430648 - protein, 9 aa, Homo Sapiens
SQENTFYQA

SEQ ID NO: 430649 - protein, 9 aa, Homo Sapiens
IDKQITNRN

SEQ ID NO: 430650 - protein, 9 aa, Homo Sapiens
PISKEYSVD

SEQ ID NO: 430651 - protein, 9 aa, Homo Sapiens
RQEAIATTR

SEQ ID NO: 430652 - protein, 9 aa, Homo Sapiens
RAGKKELIL

SEQ ID NO: 430653 - protein, 9 aa, Homo Sapiens
GEGLDDTLV

SEQ ID NO: 430654 - protein, 9 aa, Homo Sapiens
TIVNRLNMY

SEQ ID NO: 430655 - protein, 9 aa, Homo Sapiens
PEFTPRFSR

SEQ ID NO: 430656 - protein, 9 aa, Homo Sapiens
EECGKSVST

SEQ ID NO: 430657 - protein, 9 aa, Homo Sapiens
VTGCDACSE

SEQ ID NO: 430658 - protein, 9 aa, Homo Sapiens
LHCRELKNG

SEQ ID NO: 430659 - protein, 9 aa, Homo Sapiens
RPDSPCVKQ

SEQ ID NO: 430660 - protein, 9 aa, Homo Sapiens
IWEIKFGFE

SEQ ID NO: 430661 - protein, 9 aa, Homo Sapiens
TRCHTFNAT

SEQ ID NO: 430662 - protein, 9 aa, Homo Sapiens
FNNTIKEHF

SEQ ID NO: 430663 - protein, 9 aa, Homo Sapiens
INGLFDQFI

SEQ ID NO: 430664 - protein, 9 aa, Homo Sapiens
SGNISKDLT

SEQ ID NO: 430665 - protein, 9 aa, Homo Sapiens
MRFLVAKSN

SEQ ID NO: 430666 - protein, 9 aa, Homo Sapiens
FDSLVNVVC

SEQ ID NO: 430667 - protein, 9 aa, Homo Sapiens
TVGKNYLGA

SEQ ID NO: 430668 - protein, 9 aa, Homo Sapiens
DNFLQQFFM

SEQ ID NO: 430669 - protein, 9 aa, Homo Sapiens
RIIADRFIT

SEQ ID NO: 430670 - protein, 9 aa, Homo Sapiens
APDYGEVTN

SEQ ID NO: 430671 - protein, 9 aa, Homo Sapiens
HICQQHTKD

SEQ ID NO: 430672 - protein, 9 aa, Homo Sapiens
QNTSCLVQE

SEQ ID NO: 430673 - protein, 9 aa, Homo Sapiens
HDKIMFGFR

SEQ ID NO: 430674 - protein, 9 aa, Homo Sapiens
PKVAFGYLA

SEQ ID NO: 430675 - protein, 9 aa, Homo Sapiens
KLLMPIKEK

SEQ ID NO: 430676 - protein, 9 aa, Homo Sapiens
LNKPVQVEQ

SEQ ID NO: 430677 - protein, 9 aa, Homo Sapiens
GDCNSTPST

SEQ ID NO: 430678 - protein, 9 aa, Homo Sapiens
NTVIARIEA

SEQ ID NO: 430679 - protein, 9 aa, Homo Sapiens
VLILVVVDI

SEQ ID NO: 430680 - protein, 9 aa, Homo Sapiens
FFHHINTYE

SEQ ID NO: 430681 - protein, 9 aa, Homo Sapiens
EAGKFTRRA

SEQ ID NO: 430682 - protein, 9 aa, Homo Sapiens
AFNNYHSQF

SEQ ID NO: 430683 - protein, 9 aa, Homo Sapiens
SKIETRHSE

SEQ ID NO: 430684 - protein, 9 aa, Homo Sapiens
KPMCIKEDI

SEQ ID NO: 430685 - protein, 9 aa, Homo Sapiens
WARLSLCLL

SEQ ID NO: 430686 - protein, 9 aa, Homo Sapiens
SEPSFFATH

SEQ ID NO: 430687 - protein, 9 aa, Homo Sapiens
LQEGELLLQ

SEQ ID NO: 430688 - protein, 9 aa, Homo Sapiens
YRQGHIAKM

SEQ ID NO: 430689 - protein, 9 aa, Homo Sapiens
PEHCTEENK

SEQ ID NO: 430690 - protein, 9 aa, Homo Sapiens
FIRPPENPV

SEQ ID NO: 430691 - protein, 9 aa, Homo Sapiens
EKGFCGENI

SEQ ID NO: 430692 - protein, 9 aa, Homo Sapiens
GELINVFNK

SEQ ID NO: 430693 - protein, 9 aa, Homo Sapiens
DKIDQINRP

SEQ ID NO: 430694 - protein, 9 aa, Homo Sapiens
IHILQKHGK

SEQ ID NO: 430695 - protein, 9 aa, Homo Sapiens
LHQSGSVED

SEQ ID NO: 430696 - protein, 9 aa, Homo Sapiens
DHNDFGVFI

SEQ ID NO: 430697 - protein, 9 aa, Homo Sapiens
QEPEANNSI

SEQ ID NO: 430698 - protein, 9 aa, Homo Sapiens
MSSDSQVVD

SEQ ID NO: 430699 - protein, 9 aa, Homo Sapiens
SGSSEELLL

SEQ ID NO: 430700 - protein, 9 aa, Homo Sapiens
SPKRLLLRK

SEQ ID NO: 430701 - protein, 9 aa, Homo Sapiens
LLSTLAQNN

SEQ ID NO: 430702 - protein, 9 aa, Homo Sapiens
TYKVLDFLG

SEQ ID NO: 430703 - protein, 9 aa, Homo Sapiens
QVYIEVVNV

SEQ ID NO: 430704 - protein, 9 aa, Homo Sapiens
SDAAYVIQG

SEQ ID NO: 430705 - protein, 9 aa, Homo Sapiens
MNIHLWKAN

SEQ ID NO: 430706 - protein, 9 aa, Homo Sapiens
EYADIIRKQ

SEQ ID NO: 430707 - protein, 9 aa, Homo Sapiens
CINFRKLSS

SEQ ID NO: 430708 - protein, 9 aa, Homo Sapiens
QPSNGSLQS

SEQ ID NO: 430709 - protein, 9 aa, Homo Sapiens
SSQLIQHQI

SEQ ID NO: 430710 - protein, 9 aa, Homo Sapiens
DSCQGGSGG

SEQ ID NO: 430711 - protein, 9 aa, Homo Sapiens
KFIISEAHV

SEQ ID NO: 430712 - protein, 9 aa, Homo Sapiens
EDEVKKVKV

SEQ ID NO: 430713 - protein, 9 aa, Homo Sapiens
NCQLLKGII

SEQ ID NO: 430714 - protein, 9 aa, Homo Sapiens
CCVQTAHNI

SEQ ID NO: 430715 - protein, 9 aa, Homo Sapiens
VSLFNVTSH

SEQ ID NO: 430716 - protein, 9 aa, Homo Sapiens
RPPPYCDDT

SEQ ID NO: 430717 - protein, 9 aa, Homo Sapiens
SSPRLPRQN

SEQ ID NO: 430718 - protein, 9 aa, Homo Sapiens
LEKYHLQLY

SEQ ID NO: 430719 - protein, 9 aa, Homo Sapiens
ESPGWPPPT

SEQ ID NO: 430720 - protein, 9 aa, Homo Sapiens
SENECLEGV

SEQ ID NO: 430721 - protein, 9 aa, Homo Sapiens
EEQSPGEGN

SEQ ID NO: 430722 - protein, 9 aa, Homo Sapiens
KTKTVQQNA

SEQ ID NO: 430723 - protein, 9 aa, Homo Sapiens
MRSCRVLML

SEQ ID NO: 430724 - protein, 9 aa, Homo Sapiens
TKTPHLQLI

SEQ ID NO: 430725 - protein, 9 aa, Homo Sapiens
FTLTVCCLY

SEQ ID NO: 430726 - protein, 9 aa, Homo Sapiens
ALGRPENIH

SEQ ID NO: 430727 - protein, 9 aa, Homo Sapiens
MIVTNKVIK

SEQ ID NO: 430728 - protein, 9 aa, Homo Sapiens
YVALYKCVP

SEQ ID NO: 430729 - protein, 9 aa, Homo Sapiens
KVPVDFERS

SEQ ID NO: 430730 - protein, 9 aa, Homo Sapiens
LMKYCLRSA

SEQ ID NO: 430731 - protein, 9 aa, Homo Sapiens
QVKNDISGG

SEQ ID NO: 430732 - protein, 9 aa, Homo Sapiens
NNWIKQYET

SEQ ID NO: 430733 - protein, 9 aa, Homo Sapiens
QPQIMDEAL

SEQ ID NO: 430734 - protein, 9 aa, Homo Sapiens
GGSHTLLNI

SEQ ID NO: 430735 - protein, 9 aa, Homo Sapiens
VVFENDKLI

SEQ ID NO: 430736 - protein, 9 aa, Homo Sapiens
KSSHWVDIA

SEQ ID NO: 430737 - protein, 9 aa, Homo Sapiens
EKGDPDLIG

SEQ ID NO: 430738 - protein, 9 aa, Homo Sapiens
LEHPARGKL

SEQ ID NO: 430739 - protein, 9 aa, Homo Sapiens
FIIRRTSTN

SEQ ID NO: 430740 - protein, 9 aa, Homo Sapiens
SLAVWGDYG

SEQ ID NO: 430741 - protein, 9 aa, Homo Sapiens
HPPRKKDRN

SEQ ID NO: 430742 - protein, 9 aa, Homo Sapiens
WNYFMAKIN

SEQ ID NO: 430743 - protein, 9 aa, Homo Sapiens
PENYFNVIH

SEQ ID NO: 430744 - protein, 9 aa, Homo Sapiens
KSEQFSSKK

SEQ ID NO: 430745 - protein, 9 aa, Homo Sapiens
CQGTQHDRF

SEQ ID NO: 430746 - protein, 9 aa, Homo Sapiens
AKYLGFKMF

SEQ ID NO: 430747 - protein, 9 aa, Homo Sapiens
KRAQAHVEF

SEQ ID NO: 430748 - protein, 9 aa, Homo Sapiens
RCPCKIIKK

SEQ ID NO: 430749 - protein, 9 aa, Homo Sapiens
NNYKKDEMY

SEQ ID NO: 430750 - protein, 9 aa, Homo Sapiens
NVNYNYTYA

SEQ ID NO: 430751 - protein, 9 aa, Homo Sapiens
QIAETGNNL

SEQ ID NO: 430752 - protein, 9 aa, Homo Sapiens
QALEAWLEK

SEQ ID NO: 430753 - protein, 9 aa, Homo Sapiens
ANLSIADAC

SEQ ID NO: 430754 - protein, 9 aa, Homo Sapiens
SNKKRKFAT

SEQ ID NO: 430755 - protein, 9 aa, Homo Sapiens
ALPSLPMVH

SEQ ID NO: 430756 - protein, 9 aa, Homo Sapiens
YEQGKVPEM

SEQ ID NO: 430757 - protein, 9 aa, Homo Sapiens
KTQIKVSPE

SEQ ID NO: 430758 - protein, 9 aa, Homo Sapiens
EKKVNEAKI

SEQ ID NO: 430759 - protein, 9 aa, Homo Sapiens
LNITEVVKG

SEQ ID NO: 430760 - protein, 9 aa, Homo Sapiens
KEQNKKIEK

SEQ ID NO: 430761 - protein, 9 aa, Homo Sapiens
AAVKSVKME

SEQ ID NO: 430762 - protein, 9 aa, Homo Sapiens
SHSPLWKKR

SEQ ID NO: 430763 - protein, 9 aa, Homo Sapiens
LERPQKERK

SEQ ID NO: 430764 - protein, 9 aa, Homo Sapiens
TGYFRVNYY

SEQ ID NO: 430765 - protein, 9 aa, Homo Sapiens
WFCVLQVLD

SEQ ID NO: 430766 - protein, 9 aa, Homo Sapiens
HTVDKSYLC

SEQ ID NO: 430767 - protein, 9 aa, Homo Sapiens
ARGHHSSAN

SEQ ID NO: 430768 - protein, 9 aa, Homo Sapiens
GSDSFALNT

SEQ ID NO: 430769 - protein, 9 aa, Homo Sapiens
ENDKLIKEG

SEQ ID NO: 430770 - protein, 9 aa, Homo Sapiens
DGGTYQCFV

SEQ ID NO: 430771 - protein, 9 aa, Homo Sapiens
SVEVTGGIF

SEQ ID NO: 430772 - protein, 9 aa, Homo Sapiens
ISLRLKNYA

SEQ ID NO: 430773 - protein, 9 aa, Homo Sapiens
ILEKLGESV

SEQ ID NO: 430774 - protein, 9 aa, Homo Sapiens
MTQFSAENI

SEQ ID NO: 430775 - protein, 9 aa, Homo Sapiens
LQFFKKGQK

SEQ ID NO: 430776 - protein, 9 aa, Homo Sapiens
DYDDTIQIL

SEQ ID NO: 430777 - protein, 9 aa, Homo Sapiens
FCKLYRLIE

SEQ ID NO: 430778 - protein, 9 aa, Homo Sapiens
ETLKVILSA

SEQ ID NO: 430779 - protein, 9 aa, Homo Sapiens
LLVCWFTDR

SEQ ID NO: 430780 - protein, 9 aa, Homo Sapiens
SPTQRYINS

SEQ ID NO: 430781 - protein, 9 aa, Homo Sapiens
FYLLGKQRF

SEQ ID NO: 430782 - protein, 9 aa, Homo Sapiens
LKNYALVIL

SEQ ID NO: 430783 - protein, 9 aa, Homo Sapiens
VWTVSILIV

SEQ ID NO: 430784 - protein, 9 aa, Homo Sapiens
SKLRNTLCF

SEQ ID NO: 430785 - protein, 9 aa, Homo Sapiens
PKHEVLQRC

SEQ ID NO: 430786 - protein, 9 aa, Homo Sapiens
QADREFQLF

SEQ ID NO: 430787 - protein, 9 aa, Homo Sapiens
IAAQGLTVA

SEQ ID NO: 430788 - protein, 9 aa, Homo Sapiens
CGSDEMNIH

SEQ ID NO: 430789 - protein, 9 aa, Homo Sapiens
QHQKNQDLL

SEQ ID NO: 430790 - protein, 9 aa, Homo Sapiens
QFFYFHIGW

SEQ ID NO: 430791 - protein, 9 aa, Homo Sapiens
HKAIEANSS

SEQ ID NO: 430792 - protein, 9 aa, Homo Sapiens
DEEETTLQD

SEQ ID NO: 430793 - protein, 9 aa, Homo Sapiens
ESNTVTQSC

SEQ ID NO: 430794 - protein, 9 aa, Homo Sapiens
YSSSISPIL

SEQ ID NO: 430795 - protein, 9 aa, Homo Sapiens
CCHRFLPCE

SEQ ID NO: 430796 - protein, 9 aa, Homo Sapiens
LEWQNRLSD

SEQ ID NO: 430797 - protein, 9 aa, Homo Sapiens
SLASFATPN

SEQ ID NO: 430798 - protein, 9 aa, Homo Sapiens
HHLIPPVLN

SEQ ID NO: 430799 - protein, 9 aa, Homo Sapiens
AQPNHYPNT

SEQ ID NO: 430800 - protein, 9 aa, Homo Sapiens
FLFGVYVAI

SEQ ID NO: 430801 - protein, 9 aa, Homo Sapiens
ITSNNGTGA

SEQ ID NO: 430802 - protein, 9 aa, Homo Sapiens
KDFFLVQRL

SEQ ID NO: 430803 - protein, 9 aa, Homo Sapiens
KFSNTPKNV

SEQ ID NO: 430804 - protein, 9 aa, Homo Sapiens
KCYHIGTTE

SEQ ID NO: 430805 - protein, 9 aa, Homo Sapiens
VKKHIWVFI

SEQ ID NO: 430806 - protein, 9 aa, Homo Sapiens
LLQGSDILD

SEQ ID NO: 430807 - protein, 9 aa, Homo Sapiens
IVIFFPAEC

SEQ ID NO: 430808 - protein, 9 aa, Homo Sapiens
TTKDAATKI

SEQ ID NO: 430809 - protein, 9 aa, Homo Sapiens
NNICCLTTI

SEQ ID NO: 430810 - protein, 9 aa, Homo Sapiens
DMYSSVDTK

SEQ ID NO: 430811 - protein, 9 aa, Homo Sapiens
QENFDAFMK

SEQ ID NO: 430812 - protein, 9 aa, Homo Sapiens
KYADLYLLD

SEQ ID NO: 430813 - protein, 9 aa, Homo Sapiens
VEEQIDTVT

SEQ ID NO: 430814 - protein, 9 aa, Homo Sapiens
GHGLGHGHK

SEQ ID NO: 430815 - protein, 9 aa, Homo Sapiens
SCCVRNNRP

SEQ ID NO: 430816 - protein, 9 aa, Homo Sapiens
PLTDIENYV

SEQ ID NO: 430817 - protein, 9 aa, Homo Sapiens
QIVPKFKKE

SEQ ID NO: 430818 - protein, 9 aa, Homo Sapiens
MVFLASKNC

SEQ ID NO: 430819 - protein, 9 aa, Homo Sapiens
DIKKELFTC

SEQ ID NO: 430820 - protein, 9 aa, Homo Sapiens
HLNERHYGG

SEQ ID NO: 430821 - protein, 9 aa, Homo Sapiens
CMANVGGLL

SEQ ID NO: 430822 - protein, 9 aa, Homo Sapiens
NARERLRVW

SEQ ID NO: 430823 - protein, 9 aa, Homo Sapiens
PHHKNKDRL

SEQ ID NO: 430824 - protein, 9 aa, Homo Sapiens
VKQFQLCKE

SEQ ID NO: 430825 - protein, 9 aa, Homo Sapiens
PVTNVNKGK

SEQ ID NO: 430826 - protein, 9 aa, Homo Sapiens
CMTFDQKRD

SEQ ID NO: 430827 - protein, 9 aa, Homo Sapiens
GDNDESHHN

SEQ ID NO: 430828 - protein, 9 aa, Homo Sapiens
RQCWWEKPY

SEQ ID NO: 430829 - protein, 9 aa, Homo Sapiens
LMVRFTSLF

SEQ ID NO: 430830 - protein, 9 aa, Homo Sapiens
LWLYVQNQE

SEQ ID NO: 430831 - protein, 9 aa, Homo Sapiens
GISDPGVAY

SEQ ID NO: 430832 - protein, 9 aa, Homo Sapiens
LPPNVASLT

SEQ ID NO: 430833 - protein, 9 aa, Homo Sapiens
QIYRLSEEG

SEQ ID NO: 430834 - protein, 9 aa, Homo Sapiens
AMLAFHTSA

SEQ ID NO: 430835 - protein, 9 aa, Homo Sapiens
KEMTHKLEA

SEQ ID NO: 430836 - protein, 9 aa, Homo Sapiens
FFVDVGNIY

SEQ ID NO: 430837 - protein, 9 aa, Homo Sapiens
MHVKLYILL

SEQ ID NO: 430838 - protein, 9 aa, Homo Sapiens
EDQVNIAEG

SEQ ID NO: 430839 - protein, 9 aa, Homo Sapiens
RVKISISKI

SEQ ID NO: 430840 - protein, 9 aa, Homo Sapiens
LASITRQLR

SEQ ID NO: 430841 - protein, 9 aa, Homo Sapiens
TTTGKKDLD

SEQ ID NO: 430842 - protein, 9 aa, Homo Sapiens
QTLQMEFLQ

SEQ ID NO: 430843 - protein, 9 aa, Homo Sapiens
AVVYNDKEH

SEQ ID NO: 430844 - protein, 9 aa, Homo Sapiens
IRLFLVESS

SEQ ID NO: 430845 - protein, 9 aa, Homo Sapiens
NRINEIQRI

SEQ ID NO: 430846 - protein, 9 aa, Homo Sapiens
YRGRYVLCE

SEQ ID NO: 430847 - protein, 9 aa, Homo Sapiens
MLLDMATSA

SEQ ID NO: 430848 - protein, 9 aa, Homo Sapiens
KCKDYVDKE

SEQ ID NO: 430849 - protein, 9 aa, Homo Sapiens
LLNTLGLNP

SEQ ID NO: 430850 - protein, 9 aa, Homo Sapiens
YFASCKLTQ

SEQ ID NO: 430851 - protein, 9 aa, Homo Sapiens
SITIFCLDT

SEQ ID NO: 430852 - protein, 9 aa, Homo Sapiens
TYPIKMKIP

SEQ ID NO: 430853 - protein, 9 aa, Homo Sapiens
CLLSFICSS

SEQ ID NO: 430854 - protein, 9 aa, Homo Sapiens
CVEKIAFYR

SEQ ID NO: 430855 - protein, 9 aa, Homo Sapiens
NNPPGPWGW

SEQ ID NO: 430856 - protein, 9 aa, Homo Sapiens
GNMMKEAHM

SEQ ID NO: 430857 - protein, 9 aa, Homo Sapiens
WSTNLNKYK

SEQ ID NO: 430858 - protein, 9 aa, Homo Sapiens
SDLYQSGKL

SEQ ID NO: 430859 - protein, 9 aa, Homo Sapiens
QLQSKHDAT

SEQ ID NO: 430860 - protein, 9 aa, Homo Sapiens
LQARRQHTH

SEQ ID NO: 430861 - protein, 9 aa, Homo Sapiens
DNKKMLGHQ

SEQ ID NO: 430862 - protein, 9 aa, Homo Sapiens
QKKFYSKCL

SEQ ID NO: 430863 - protein, 9 aa, Homo Sapiens
LAGKVNKPQ

SEQ ID NO: 430864 - protein, 9 aa, Homo Sapiens
EIHQLKKEE

SEQ ID NO: 430865 - protein, 9 aa, Homo Sapiens
QPWNIPVLP

SEQ ID NO: 430866 - protein, 9 aa, Homo Sapiens
VFPCVPEHP

SEQ ID NO: 430867 - protein, 9 aa, Homo Sapiens
ICINSCGDG

SEQ ID NO: 430868 - protein, 9 aa, Homo Sapiens
RPRITKLYV

SEQ ID NO: 430869 - protein, 9 aa, Homo Sapiens
NKDLTFSIS

SEQ ID NO: 430870 - protein, 9 aa, Homo Sapiens
HNVNMPNQH

SEQ ID NO: 430871 - protein, 9 aa, Homo Sapiens
DKPISKDAR

SEQ ID NO: 430872 - protein, 9 aa, Homo Sapiens
KPCAVGFCD

SEQ ID NO: 430873 - protein, 9 aa, Homo Sapiens
HNGTCMDLV

SEQ ID NO: 430874 - protein, 9 aa, Homo Sapiens
NSLRITAES

SEQ ID NO: 430875 - protein, 9 aa, Homo Sapiens
MDYLHVEDD

SEQ ID NO: 430876 - protein, 9 aa, Homo Sapiens
KMSADFHVD

SEQ ID NO: 430877 - protein, 9 aa, Homo Sapiens
VVKITGHLY

SEQ ID NO: 430878 - protein, 9 aa, Homo Sapiens
VQQNACAEV

SEQ ID NO: 430879 - protein, 9 aa, Homo Sapiens
YDRYLSICR

SEQ ID NO: 430880 - protein, 9 aa, Homo Sapiens
CSKRHRGKS

SEQ ID NO: 430881 - protein, 9 aa, Homo Sapiens
AAAGKNTLV

SEQ ID NO: 430882 - protein, 9 aa, Homo Sapiens
IDEKDPNKD

SEQ ID NO: 430883 - protein, 9 aa, Homo Sapiens
FHTTQILST

SEQ ID NO: 430884 - protein, 9 aa, Homo Sapiens
GSGGFNYLI

SEQ ID NO: 430885 - protein, 9 aa, Homo Sapiens
SASLIQHEI

SEQ ID NO: 430886 - protein, 9 aa, Homo Sapiens
VAWTLYVLI

SEQ ID NO: 430887 - protein, 9 aa, Homo Sapiens
DKRGSFLTG

SEQ ID NO: 430888 - protein, 9 aa, Homo Sapiens
AWGCFDECN

SEQ ID NO: 430889 - protein, 9 aa, Homo Sapiens
GPKPMCIKE

SEQ ID NO: 430890 - protein, 9 aa, Homo Sapiens
WTNHLLRPL

SEQ ID NO: 430891 - protein, 9 aa, Homo Sapiens
PSPPCQPNY

SEQ ID NO: 430892 - protein, 9 aa, Homo Sapiens
EAIKAASGH

SEQ ID NO: 430893 - protein, 9 aa, Homo Sapiens
YMPYTLITI

SEQ ID NO: 430894 - protein, 9 aa, Homo Sapiens
MASYFNLSS

SEQ ID NO: 430895 - protein, 9 aa, Homo Sapiens
LVTLEDINY

SEQ ID NO: 430896 - protein, 9 aa, Homo Sapiens
AQNVVQIQK

SEQ ID NO: 430897 - protein, 9 aa, Homo Sapiens
YKVMRKYDK

SEQ ID NO: 430898 - protein, 9 aa, Homo Sapiens
KRKIVSHGS

SEQ ID NO: 430899 - protein, 9 aa, Homo Sapiens
GFNTINHLF

SEQ ID NO: 430900 - protein, 9 aa, Homo Sapiens
VYIEVVNVN

SEQ ID NO: 430901 - protein, 9 aa, Homo Sapiens
SIQTGYMPR

SEQ ID NO: 430902 - protein, 9 aa, Homo Sapiens
EFRNNKAKD

SEQ ID NO: 430903 - protein, 9 aa, Homo Sapiens
FKELIDTMM

SEQ ID NO: 430904 - protein, 9 aa, Homo Sapiens
IDSQGRICS

SEQ ID NO: 430905 - protein, 9 aa, Homo Sapiens
HNNVFPDGK

SEQ ID NO: 430906 - protein, 9 aa, Homo Sapiens
EPLQARVDE

SEQ ID NO: 430907 - protein, 9 aa, Homo Sapiens
NHTPNLSTK

SEQ ID NO: 430908 - protein, 9 aa, Homo Sapiens
CDKGFYLDD

SEQ ID NO: 430909 - protein, 9 aa, Homo Sapiens
GVGAGIRCK

SEQ ID NO: 430910 - protein, 9 aa, Homo Sapiens
WGSYVHNFL

SEQ ID NO: 430911 - protein, 9 aa, Homo Sapiens
DAVFLNPFD

SEQ ID NO: 430912 - protein, 9 aa, Homo Sapiens
LFDQFIGTA

SEQ ID NO: 430913 - protein, 9 aa, Homo Sapiens
RYKDVYVKD

SEQ ID NO: 430914 - protein, 9 aa, Homo Sapiens
GVLDDNANL

SEQ ID NO: 430915 - protein, 9 aa, Homo Sapiens
TENSHEDKS

SEQ ID NO: 430916 - protein, 9 aa, Homo Sapiens
FFAPDYGEV

SEQ ID NO: 430917 - protein, 9 aa, Homo Sapiens
HKDEELSAQ

SEQ ID NO: 430918 - protein, 9 aa, Homo Sapiens
YYDISTANN

SEQ ID NO: 430919 - protein, 9 aa, Homo Sapiens
NEPWYKLFS

SEQ ID NO: 430920 - protein, 9 aa, Homo Sapiens
EAFEARGSR

SEQ ID NO: 430921 - protein, 9 aa, Homo Sapiens
FFNVTVLIQ

SEQ ID NO: 430922 - protein, 9 aa, Homo Sapiens
SLRMSERRS

SEQ ID NO: 430923 - protein, 9 aa, Homo Sapiens
QEENNFYLC

SEQ ID NO: 430924 - protein, 9 aa, Homo Sapiens
REAALNARF

SEQ ID NO: 430925 - protein, 9 aa, Homo Sapiens
LKQHVDSLL

SEQ ID NO: 430926 - protein, 9 aa, Homo Sapiens
NNWNVNYNY

SEQ ID NO: 430927 - protein, 9 aa, Homo Sapiens
LIRHQRINS

SEQ ID NO: 430928 - protein, 9 aa, Homo Sapiens
IQVIPQYAI

SEQ ID NO: 430929 - protein, 9 aa, Homo Sapiens
SRKESKNED

SEQ ID NO: 430930 - protein, 9 aa, Homo Sapiens
VKELNHLGV

SEQ ID NO: 430931 - protein, 9 aa, Homo Sapiens
STITRDMYV

SEQ ID NO: 430932 - protein, 9 aa, Homo Sapiens
VSPAEFVTR

SEQ ID NO: 430933 - protein, 9 aa, Homo Sapiens
VTPPSVVMG

SEQ ID NO: 430934 - protein, 9 aa, Homo Sapiens
IKTQIKVSP

SEQ ID NO: 430935 - protein, 9 aa, Homo Sapiens
ELPEVVHKD

SEQ ID NO: 430936 - protein, 9 aa, Homo Sapiens
VNEWSFFML

SEQ ID NO: 430937 - protein, 9 aa, Homo Sapiens
IVDKLHNLN

SEQ ID NO: 430938 - protein, 9 aa, Homo Sapiens
AKFIMTADD

SEQ ID NO: 430939 - protein, 9 aa, Homo Sapiens
PLSDTIFAE

SEQ ID NO: 430940 - protein, 9 aa, Homo Sapiens
AVHCRTEDN

SEQ ID NO: 430941 - protein, 9 aa, Homo Sapiens
IQIIATVKC

SEQ ID NO: 430942 - protein, 9 aa, Homo Sapiens
TLAKHKIIH

SEQ ID NO: 430943 - protein, 9 aa, Homo Sapiens
SEQFSSKKK

SEQ ID NO: 430944 - protein, 9 aa, Homo Sapiens
FTDRATRYR

SEQ ID NO: 430945 - protein, 9 aa, Homo Sapiens
RIAAQGLTV

SEQ ID NO: 430946 - protein, 9 aa, Homo Sapiens
NRLNMYNLV

SEQ ID NO: 430947 - protein, 9 aa, Homo Sapiens
GQNNTLSGS

SEQ ID NO: 430948 - protein, 9 aa, Homo Sapiens
KQFCITCQK

SEQ ID NO: 430949 - protein, 9 aa, Homo Sapiens
AQLDSVDIP

SEQ ID NO: 430950 - protein, 9 aa, Homo Sapiens
SYFFPHIPH

SEQ ID NO: 430951 - protein, 9 aa, Homo Sapiens
EKRAQAHVE

SEQ ID NO: 430952 - protein, 9 aa, Homo Sapiens
ANVQLLHSA

SEQ ID NO: 430953 - protein, 9 aa, Homo Sapiens
RWNEVCHIS

SEQ ID NO: 430954 - protein, 9 aa, Homo Sapiens
SRGPFRLHN

SEQ ID NO: 430955 - protein, 9 aa, Homo Sapiens
KHTMKAFLD

SEQ ID NO: 430956 - protein, 9 aa, Homo Sapiens
TGLLVMKND

SEQ ID NO: 430957 - protein, 9 aa, Homo Sapiens
LSLLRLISL

SEQ ID NO: 430958 - protein, 9 aa, Homo Sapiens
KSLGVNTLI

SEQ ID NO: 430959 - protein, 9 aa, Homo Sapiens
NQIFEVIEF

SEQ ID NO: 430960 - protein, 9 aa, Homo Sapiens
SVKRKIVSH

SEQ ID NO: 430961 - protein, 9 aa, Homo Sapiens
TRSKVTFQP

SEQ ID NO: 430962 - protein, 9 aa, Homo Sapiens
RPKGLDEAR

SEQ ID NO: 430963 - protein, 9 aa, Homo Sapiens
TEIIYSLFT

SEQ ID NO: 430964 - protein, 9 aa, Homo Sapiens
DRHNIKHME

SEQ ID NO: 430965 - protein, 9 aa, Homo Sapiens
GISKELINL

SEQ ID NO: 430966 - protein, 9 aa, Homo Sapiens
YGDTINCRD

SEQ ID NO: 430967 - protein, 9 aa, Homo Sapiens
YLYSHYFGG

SEQ ID NO: 430968 - protein, 9 aa, Homo Sapiens
LRNTLCFLL

SEQ ID NO: 430969 - protein, 9 aa, Homo Sapiens
FTRVRSYTA

SEQ ID NO: 430970 - protein, 9 aa, Homo Sapiens
GVIKVITEP

SEQ ID NO: 430971 - protein, 9 aa, Homo Sapiens
KDPHLQIPM

SEQ ID NO: 430972 - protein, 9 aa, Homo Sapiens
RVFQFQPIS

SEQ ID NO: 430973 - protein, 9 aa, Homo Sapiens
RIKAIKELQ

SEQ ID NO: 430974 - protein, 9 aa, Homo Sapiens
EHKKYFGLS

SEQ ID NO: 430975 - protein, 9 aa, Homo Sapiens
FCMAISIPN

SEQ ID NO: 430976 - protein, 9 aa, Homo Sapiens
AKQLETLNN

SEQ ID NO: 430977 - protein, 9 aa, Homo Sapiens
AMGRGKHQA

SEQ ID NO: 430978 - protein, 9 aa, Homo Sapiens
ILQHLLLVQ

SEQ ID NO: 430979 - protein, 9 aa, Homo Sapiens
VWSNDRVIH

SEQ ID NO: 430980 - protein, 9 aa, Homo Sapiens
SWQSQSSRE

SEQ ID NO: 430981 - protein, 9 aa, Homo Sapiens
YSYYCDHNF

SEQ ID NO: 430982 - protein, 9 aa, Homo Sapiens
HKGAKKPRF

SEQ ID NO: 430983 - protein, 9 aa, Homo Sapiens
LLWISYSDG

SEQ ID NO: 430984 - protein, 9 aa, Homo Sapiens
RAENINKYL

SEQ ID NO: 430985 - protein, 9 aa, Homo Sapiens
KVDPVAASA

SEQ ID NO: 430986 - protein, 9 aa, Homo Sapiens
VYGKSLSEL

SEQ ID NO: 430987 - protein, 9 aa, Homo Sapiens
LCMNLYIED

SEQ ID NO: 430988 - protein, 9 aa, Homo Sapiens
FPTKGKRGQ

SEQ ID NO: 430989 - protein, 9 aa, Homo Sapiens
FQKRQLDKV

SEQ ID NO: 430990 - protein, 9 aa, Homo Sapiens
KAIKELQLM

SEQ ID NO: 430991 - protein, 9 aa, Homo Sapiens
ECVQKFIKI

SEQ ID NO: 430992 - protein, 9 aa, Homo Sapiens
VDNVFTIRT

SEQ ID NO: 430993 - protein, 9 aa, Homo Sapiens
CLDDPPGQF

SEQ ID NO: 430994 - protein, 9 aa, Homo Sapiens
SSSGSSSSH

SEQ ID NO: 430995 - protein, 9 aa, Homo Sapiens
KPKFTQEVF

SEQ ID NO: 430996 - protein, 9 aa, Homo Sapiens
LDKLGLRHP

SEQ ID NO: 430997 - protein, 9 aa, Homo Sapiens
VHIAVKVPP

SEQ ID NO: 430998 - protein, 9 aa, Homo Sapiens
SHNIIHRYI

SEQ ID NO: 430999 - protein, 9 aa, Homo Sapiens
NSEMEKAPP

SEQ ID NO: 431000 - protein, 9 aa, Homo Sapiens
TLPVLAASQ

SEQ ID NO: 431001 - protein, 9 aa, Homo Sapiens
ASYFIRSLD

SEQ ID NO: 431002 - protein, 9 aa, Homo Sapiens
CPNIVNINL

SEQ ID NO: 431003 - protein, 9 aa, Homo Sapiens
FVNVDKVAN

SEQ ID NO: 431004 - protein, 9 aa, Homo Sapiens
KICSCLLSN

SEQ ID NO: 431005 - protein, 9 aa, Homo Sapiens
AQRDRCSSL

SEQ ID NO: 431006 - protein, 9 aa, Homo Sapiens
TSEYLLDNL

SEQ ID NO: 431007 - protein, 9 aa, Homo Sapiens
RRPLKDIAW

SEQ ID NO: 431008 - protein, 9 aa, Homo Sapiens
TPVWFYMQT

SEQ ID NO: 431009 - protein, 9 aa, Homo Sapiens
QLAIIILNN

SEQ ID NO: 431010 - protein, 9 aa, Homo Sapiens
LCLGVGRYR

SEQ ID NO: 431011 - protein, 9 aa, Homo Sapiens
FFLGASILA

SEQ ID NO: 431012 - protein, 9 aa, Homo Sapiens
QQVDIPLWL

SEQ ID NO: 431013 - protein, 9 aa, Homo Sapiens
LNTFKAVCN

SEQ ID NO: 431014 - protein, 9 aa, Homo Sapiens
PTNNLFIDY

SEQ ID NO: 431015 - protein, 9 aa, Homo Sapiens
SMMDRMVAL

SEQ ID NO: 431016 - protein, 9 aa, Homo Sapiens
KKKCEMYRR

SEQ ID NO: 431017 - protein, 9 aa, Homo Sapiens
ALDLGKYNG

SEQ ID NO: 431018 - protein, 9 aa, Homo Sapiens
GQLYKCHPD

SEQ ID NO: 431019 - protein, 9 aa, Homo Sapiens
SPKQYKNLY

SEQ ID NO: 431020 - protein, 9 aa, Homo Sapiens
AAVADVLKK

SEQ ID NO: 431021 - protein, 9 aa, Homo Sapiens
NLSPKSYQT

SEQ ID NO: 431022 - protein, 9 aa, Homo Sapiens
TPVHHRRPP

SEQ ID NO: 431023 - protein, 9 aa, Homo Sapiens
QITKALQSN

SEQ ID NO: 431024 - protein, 9 aa, Homo Sapiens
REVKQKVSP

SEQ ID NO: 431025 - protein, 9 aa, Homo Sapiens
SAMLFPHTF

SEQ ID NO: 431026 - protein, 9 aa, Homo Sapiens
AADIKQDNG

SEQ ID NO: 431027 - protein, 9 aa, Homo Sapiens
SDILDSQVQ

SEQ ID NO: 431028 - protein, 9 aa, Homo Sapiens
VPGRQDPRP

SEQ ID NO: 431029 - protein, 9 aa, Homo Sapiens
GPSGPQGIC

SEQ ID NO: 431030 - protein, 9 aa, Homo Sapiens
NRFSVASSG

SEQ ID NO: 431031 - protein, 9 aa, Homo Sapiens
KCNHIYQIM

SEQ ID NO: 431032 - protein, 9 aa, Homo Sapiens
SKPSVNYFI

SEQ ID NO: 431033 - protein, 9 aa, Homo Sapiens
IFKLAQYAF

SEQ ID NO: 431034 - protein, 9 aa, Homo Sapiens
HAEESTIPT

SEQ ID NO: 431035 - protein, 9 aa, Homo Sapiens
SRKEINERE

SEQ ID NO: 431036 - protein, 9 aa, Homo Sapiens
DSTNLNTHF

SEQ ID NO: 431037 - protein, 9 aa, Homo Sapiens
KREQWKKLW

SEQ ID NO: 431038 - protein, 9 aa, Homo Sapiens
PRKVQFKIS

SEQ ID NO: 431039 - protein, 9 aa, Homo Sapiens
KINGRADFR

SEQ ID NO: 431040 - protein, 9 aa, Homo Sapiens
PEEQKHGLL

SEQ ID NO: 431041 - protein, 9 aa, Homo Sapiens
KRKDNFWGK

SEQ ID NO: 431042 - protein, 9 aa, Homo Sapiens
KPLSDRRLV

SEQ ID NO: 431043 - protein, 9 aa, Homo Sapiens
YLRWWQLQY

SEQ ID NO: 431044 - protein, 9 aa, Homo Sapiens
KSSPGLGRG

SEQ ID NO: 431045 - protein, 9 aa, Homo Sapiens
CLQTCQTVA

SEQ ID NO: 431046 - protein, 9 aa, Homo Sapiens
VKSVKMEVD

SEQ ID NO: 431047 - protein, 9 aa, Homo Sapiens
LCHLQVDGG

SEQ ID NO: 431048 - protein, 9 aa, Homo Sapiens
WQRLARLWN

SEQ ID NO: 431049 - protein, 9 aa, Homo Sapiens
KYFEEMRKA

SEQ ID NO: 431050 - protein, 9 aa, Homo Sapiens
VDFWAQLLE

SEQ ID NO: 431051 - protein, 9 aa, Homo Sapiens
IHFLVILIS

SEQ ID NO: 431052 - protein, 9 aa, Homo Sapiens
FGPTLSANI

SEQ ID NO: 431053 - protein, 9 aa, Homo Sapiens
AIMEDSGRI

SEQ ID NO: 431054 - protein, 9 aa, Homo Sapiens
KVIPRDWKT

SEQ ID NO: 431055 - protein, 9 aa, Homo Sapiens
VLKSALCLG

SEQ ID NO: 431056 - protein, 9 aa, Homo Sapiens
YYLYIKFSM

SEQ ID NO: 431057 - protein, 9 aa, Homo Sapiens
RLFKIIGVK

SEQ ID NO: 431058 - protein, 9 aa, Homo Sapiens
LKTLARYAA

SEQ ID NO: 431059 - protein, 9 aa, Homo Sapiens
IIFRNAIGN

SEQ ID NO: 431060 - protein, 9 aa, Homo Sapiens
MYDKILLFH

SEQ ID NO: 431061 - protein, 9 aa, Homo Sapiens
GELSDKSKL

SEQ ID NO: 431062 - protein, 9 aa, Homo Sapiens
ALANINLAL

SEQ ID NO: 431063 - protein, 9 aa, Homo Sapiens
DYHSRMNIS

SEQ ID NO: 431064 - protein, 9 aa, Homo Sapiens
KNPHPYVKA

SEQ ID NO: 431065 - protein, 9 aa, Homo Sapiens
KTIRNYSLG

SEQ ID NO: 431066 - protein, 9 aa, Homo Sapiens
NKVIKIVGL

SEQ ID NO: 431067 - protein, 9 aa, Homo Sapiens
QCNIFGQYL

SEQ ID NO: 431068 - protein, 9 aa, Homo Sapiens
VPLNQLLDG

SEQ ID NO: 431069 - protein, 9 aa, Homo Sapiens
MAYLRSLSL

SEQ ID NO: 431070 - protein, 9 aa, Homo Sapiens
IIEKEIEGD

SEQ ID NO: 431071 - protein, 9 aa, Homo Sapiens
GSHWLAYAE

SEQ ID NO: 431072 - protein, 9 aa, Homo Sapiens
FSGGQIPKK

SEQ ID NO: 431073 - protein, 9 aa, Homo Sapiens
KYWCRPPHI

SEQ ID NO: 431074 - protein, 9 aa, Homo Sapiens
NNISRYLTD

SEQ ID NO: 431075 - protein, 9 aa, Homo Sapiens
SVVDATWLA

SEQ ID NO: 431076 - protein, 9 aa, Homo Sapiens
FGYLLGSEA

SEQ ID NO: 431077 - protein, 9 aa, Homo Sapiens
SSRSQFSAK

SEQ ID NO: 431078 - protein, 9 aa, Homo Sapiens
KGNLIVHQQ

SEQ ID NO: 431079 - protein, 9 aa, Homo Sapiens
DTKKMFCEV

SEQ ID NO: 431080 - protein, 9 aa, Homo Sapiens
REILDGLVE

SEQ ID NO: 431081 - protein, 9 aa, Homo Sapiens
IGSRQHYCH

SEQ ID NO: 431082 - protein, 9 aa, Homo Sapiens
INPVFYFIL

SEQ ID NO: 431083 - protein, 9 aa, Homo Sapiens
IQALQYATS

SEQ ID NO: 431084 - protein, 9 aa, Homo Sapiens
FHRPNTTER

SEQ ID NO: 431085 - protein, 9 aa, Homo Sapiens
PGDIKAIVD

SEQ ID NO: 431086 - protein, 9 aa, Homo Sapiens
SNLTLGACQ

SEQ ID NO: 431087 - protein, 9 aa, Homo Sapiens
ELERPQKER

SEQ ID NO: 431088 - protein, 9 aa, Homo Sapiens
RRTLQINDI

SEQ ID NO: 431089 - protein, 9 aa, Homo Sapiens
MYTPLFFTR

SEQ ID NO: 431090 - protein, 9 aa, Homo Sapiens
KLSSRSDVW

SEQ ID NO: 431091 - protein, 9 aa, Homo Sapiens
NYVSRPHRC

SEQ ID NO: 431092 - protein, 9 aa, Homo Sapiens
SGGQIPKKF

SEQ ID NO: 431093 - protein, 9 aa, Homo Sapiens
IPGSHPKGS

SEQ ID NO: 431094 - protein, 9 aa, Homo Sapiens
SMDKIDQIN

SEQ ID NO: 431095 - protein, 9 aa, Homo Sapiens
CSCVRGTFC

SEQ ID NO: 431096 - protein, 9 aa, Homo Sapiens
PELPRFYEA

SEQ ID NO: 431097 - protein, 9 aa, Homo Sapiens
SGIFQYDKY

SEQ ID NO: 431098 - protein, 9 aa, Homo Sapiens
VPEMPRAGD

SEQ ID NO: 431099 - protein, 9 aa, Homo Sapiens
VLIIHLPFC

SEQ ID NO: 431100 - protein, 9 aa, Homo Sapiens
YGEAWGTAT

SEQ ID NO: 431101 - protein, 9 aa, Homo Sapiens
DFIILGLFN

SEQ ID NO: 431102 - protein, 9 aa, Homo Sapiens
HECNNCVKA

SEQ ID NO: 431103 - protein, 9 aa, Homo Sapiens
HFRHLYKQR

SEQ ID NO: 431104 - protein, 9 aa, Homo Sapiens
LRKIYEMYS

SEQ ID NO: 431105 - protein, 9 aa, Homo Sapiens
PDSGLAKEI

SEQ ID NO: 431106 - protein, 9 aa, Homo Sapiens
ETQESLKTL

SEQ ID NO: 431107 - protein, 9 aa, Homo Sapiens
ENVHTLDTL

SEQ ID NO: 431108 - protein, 9 aa, Homo Sapiens
DLGGDFWYV

SEQ ID NO: 431109 - protein, 9 aa, Homo Sapiens
FHENEIVLR

SEQ ID NO: 431110 - protein, 9 aa, Homo Sapiens
YKEVNNRLD

SEQ ID NO: 431111 - protein, 9 aa, Homo Sapiens
SLARAVYKY

SEQ ID NO: 431112 - protein, 9 aa, Homo Sapiens
ILVFVGAAV

SEQ ID NO: 431113 - protein, 9 aa, Homo Sapiens
DDLNFFNQN

SEQ ID NO: 431114 - protein, 9 aa, Homo Sapiens
ALIQTLGKQ

SEQ ID NO: 431115 - protein, 9 aa, Homo Sapiens
KRNDMQLDS

SEQ ID NO: 431116 - protein, 9 aa, Homo Sapiens
PIPRINVTA

SEQ ID NO: 431117 - protein, 9 aa, Homo Sapiens
LPFLETWYI

SEQ ID NO: 431118 - protein, 9 aa, Homo Sapiens
IDAPGHRNF

SEQ ID NO: 431119 - protein, 9 aa, Homo Sapiens
KQKVSPYFK

SEQ ID NO: 431120 - protein, 9 aa, Homo Sapiens
HKALSPPER

SEQ ID NO: 431121 - protein, 9 aa, Homo Sapiens
VHQITHTGE

SEQ ID NO: 431122 - protein, 9 aa, Homo Sapiens
IIRPRDLEE

SEQ ID NO: 431123 - protein, 9 aa, Homo Sapiens
ERKLHGTLT

SEQ ID NO: 431124 - protein, 9 aa, Homo Sapiens
LGDLIEIYR

SEQ ID NO: 431125 - protein, 9 aa, Homo Sapiens
YLVDCFVSH

SEQ ID NO: 431126 - protein, 9 aa, Homo Sapiens
EELEWQNRL

SEQ ID NO: 431127 - protein, 9 aa, Homo Sapiens
LDYLWAAGQ

SEQ ID NO: 431128 - protein, 9 aa, Homo Sapiens
NKMTPLCIA

SEQ ID NO: 431129 - protein, 9 aa, Homo Sapiens
CYKCLRTVF

SEQ ID NO: 431130 - protein, 9 aa, Homo Sapiens
DTTCTPLAS

SEQ ID NO: 431131 - protein, 9 aa, Homo Sapiens
WNSVSHIII

SEQ ID NO: 431132 - protein, 9 aa, Homo Sapiens
DILKYLENT

SEQ ID NO: 431133 - protein, 9 aa, Homo Sapiens
GAPMSSYVS

SEQ ID NO: 431134 - protein, 9 aa, Homo Sapiens
DTNYADLVL

SEQ ID NO: 431135 - protein, 9 aa, Homo Sapiens
AQKRRKQLL

SEQ ID NO: 431136 - protein, 9 aa, Homo Sapiens
KQMYKNLDI

SEQ ID NO: 431137 - protein, 9 aa, Homo Sapiens
CKSNLIHHF

SEQ ID NO: 431138 - protein, 9 aa, Homo Sapiens
LVRIILLNY

SEQ ID NO: 431139 - protein, 9 aa, Homo Sapiens
RSRNTYREK

SEQ ID NO: 431140 - protein, 9 aa, Homo Sapiens
MSINFRDIK

SEQ ID NO: 431141 - protein, 9 aa, Homo Sapiens
LDKLVNNRA

SEQ ID NO: 431142 - protein, 9 aa, Homo Sapiens
FTYFNIFHI

SEQ ID NO: 431143 - protein, 9 aa, Homo Sapiens
QEAFEIVVC

SEQ ID NO: 431144 - protein, 9 aa, Homo Sapiens
CRTIYLAIQ

SEQ ID NO: 431145 - protein, 9 aa, Homo Sapiens
YLEYAGSVS

SEQ ID NO: 431146 - protein, 9 aa, Homo Sapiens
LSGQSIKAE

SEQ ID NO: 431147 - protein, 9 aa, Homo Sapiens
PSVVMGLAW

SEQ ID NO: 431148 - protein, 9 aa, Homo Sapiens
LPKRLRAVY

SEQ ID NO: 431149 - protein, 9 aa, Homo Sapiens
LTDIENYVG

SEQ ID NO: 431150 - protein, 9 aa, Homo Sapiens
YTEILKVAR

SEQ ID NO: 431151 - protein, 9 aa, Homo Sapiens
HIEKLTTAS

SEQ ID NO: 431152 - protein, 9 aa, Homo Sapiens
DTGPAREGG

SEQ ID NO: 431153 - protein, 9 aa, Homo Sapiens
IRAPGHMSG

SEQ ID NO: 431154 - protein, 9 aa, Homo Sapiens
DNYFMRDSG

SEQ ID NO: 431155 - protein, 9 aa, Homo Sapiens
QTINMQQSQ

SEQ ID NO: 431156 - protein, 9 aa, Homo Sapiens
MYSGKFCEC

SEQ ID NO: 431157 - protein, 9 aa, Homo Sapiens
PAMWTLACT

SEQ ID NO: 431158 - protein, 9 aa, Homo Sapiens
KRAETACFC

SEQ ID NO: 431159 - protein, 9 aa, Homo Sapiens
EGYKYKRID

SEQ ID NO: 431160 - protein, 9 aa, Homo Sapiens
RSIYVDFNC

SEQ ID NO: 431161 - protein, 9 aa, Homo Sapiens
ENNNLLLKW

SEQ ID NO: 431162 - protein, 9 aa, Homo Sapiens
YTCTCGPGS

SEQ ID NO: 431163 - protein, 9 aa, Homo Sapiens
LNESNELHA

SEQ ID NO: 431164 - protein, 9 aa, Homo Sapiens
PKQKFSENL

SEQ ID NO: 431165 - protein, 9 aa, Homo Sapiens
VGGGSSTFH

SEQ ID NO: 431166 - protein, 9 aa, Homo Sapiens
CCLTTIGHF

SEQ ID NO: 431167 - protein, 9 aa, Homo Sapiens
LRENPGDSE

SEQ ID NO: 431168 - protein, 9 aa, Homo Sapiens
HLIPDHTIQ

SEQ ID NO: 431169 - protein, 9 aa, Homo Sapiens
HNLSTPKVP

SEQ ID NO: 431170 - protein, 9 aa, Homo Sapiens
PPHSIVDKV

SEQ ID NO: 431171 - protein, 9 aa, Homo Sapiens
NPKERGEEI

SEQ ID NO: 431172 - protein, 9 aa, Homo Sapiens
RERLLCSKR

SEQ ID NO: 431173 - protein, 9 aa, Homo Sapiens
DRKIIMWDH

SEQ ID NO: 431174 - protein, 9 aa, Homo Sapiens
GNDFKDKLN

SEQ ID NO: 431175 - protein, 9 aa, Homo Sapiens
VTIDQILDM

SEQ ID NO: 431176 - protein, 9 aa, Homo Sapiens
KLLKCPMNL

SEQ ID NO: 431177 - protein, 9 aa, Homo Sapiens
YNLPAGTIK

SEQ ID NO: 431178 - protein, 9 aa, Homo Sapiens
KNNVVQPVL

SEQ ID NO: 431179 - protein, 9 aa, Homo Sapiens
EEAQLAIII

SEQ ID NO: 431180 - protein, 9 aa, Homo Sapiens
KSSITNHHR

SEQ ID NO: 431181 - protein, 9 aa, Homo Sapiens
ALEFPPNKL

SEQ ID NO: 431182 - protein, 9 aa, Homo Sapiens
CLIRHRACA

SEQ ID NO: 431183 - protein, 9 aa, Homo Sapiens
IHHSLEIKE

SEQ ID NO: 431184 - protein, 9 aa, Homo Sapiens
EKVVYMFYT

SEQ ID NO: 431185 - protein, 9 aa, Homo Sapiens
CEVFELIKD

SEQ ID NO: 431186 - protein, 9 aa, Homo Sapiens
THNPELQKL

SEQ ID NO: 431187 - protein, 9 aa, Homo Sapiens
QPDQYEASD

SEQ ID NO: 431188 - protein, 9 aa, Homo Sapiens
SSWCLLRES

SEQ ID NO: 431189 - protein, 9 aa, Homo Sapiens
HNFIQDEVL

SEQ ID NO: 431190 - protein, 9 aa, Homo Sapiens
GHLTDEGQQ

SEQ ID NO: 431191 - protein, 9 aa, Homo Sapiens
EIVPGACLG

SEQ ID NO: 431192 - protein, 9 aa, Homo Sapiens
GVDIKANIV

SEQ ID NO: 431193 - protein, 9 aa, Homo Sapiens
FAPLLCKVY

SEQ ID NO: 431194 - protein, 9 aa, Homo Sapiens
HQPQIVEMK

SEQ ID NO: 431195 - protein, 9 aa, Homo Sapiens
SGSGSGNGS

SEQ ID NO: 431196 - protein, 9 aa, Homo Sapiens
RYDTIFQIF

SEQ ID NO: 431197 - protein, 9 aa, Homo Sapiens
SQKDTSMKG

SEQ ID NO: 431198 - protein, 9 aa, Homo Sapiens
INNTFIKTL

SEQ ID NO: 431199 - protein, 9 aa, Homo Sapiens
VRPKVLFLT

SEQ ID NO: 431200 - protein, 9 aa, Homo Sapiens
KAREERFTM

SEQ ID NO: 431201 - protein, 9 aa, Homo Sapiens
PEGIQKSSP

SEQ ID NO: 431202 - protein, 9 aa, Homo Sapiens
NWRGQVSAV

SEQ ID NO: 431203 - protein, 9 aa, Homo Sapiens
SIILLIFLD

SEQ ID NO: 431204 - protein, 9 aa, Homo Sapiens
AELERPQKE

SEQ ID NO: 431205 - protein, 9 aa, Homo Sapiens
YDMVLTNGK

SEQ ID NO: 431206 - protein, 9 aa, Homo Sapiens
FFDHCMFTM

SEQ ID NO: 431207 - protein, 9 aa, Homo Sapiens
GLLNEVLEL

SEQ ID NO: 431208 - protein, 9 aa, Homo Sapiens
CQIRYERDN

SEQ ID NO: 431209 - protein, 9 aa, Homo Sapiens
LATVRAKCS

SEQ ID NO: 431210 - protein, 9 aa, Homo Sapiens
AALLKRFNE

SEQ ID NO: 431211 - protein, 9 aa, Homo Sapiens
KQRTEKHIE

SEQ ID NO: 431212 - protein, 9 aa, Homo Sapiens
GVVVFENDK

SEQ ID NO: 431213 - protein, 9 aa, Homo Sapiens
VECLKLNKT

SEQ ID NO: 431214 - protein, 9 aa, Homo Sapiens
LNNWNVNYN

SEQ ID NO: 431215 - protein, 9 aa, Homo Sapiens
GFRARQRCK

SEQ ID NO: 431216 - protein, 9 aa, Homo Sapiens
VFSEHLIKI

SEQ ID NO: 431217 - protein, 9 aa, Homo Sapiens
RVMQRRPDS

SEQ ID NO: 431218 - protein, 9 aa, Homo Sapiens
YEYVHLYAQ

SEQ ID NO: 431219 - protein, 9 aa, Homo Sapiens
IIYTLTTNF

SEQ ID NO: 431220 - protein, 9 aa, Homo Sapiens
RGETPPHSQ

SEQ ID NO: 431221 - protein, 9 aa, Homo Sapiens
KSIVKYSVQ

SEQ ID NO: 431222 - protein, 9 aa, Homo Sapiens
HHVRVERSM

SEQ ID NO: 431223 - protein, 9 aa, Homo Sapiens
DKIIQLYDY

SEQ ID NO: 431224 - protein, 9 aa, Homo Sapiens
IRHMSSKGM

SEQ ID NO: 431225 - protein, 9 aa, Homo Sapiens
KNNWGVKLH

SEQ ID NO: 431226 - protein, 9 aa, Homo Sapiens
KESNLSDVN

SEQ ID NO: 431227 - protein, 9 aa, Homo Sapiens
QLQHFEHNF

SEQ ID NO: 431228 - protein, 9 aa, Homo Sapiens
ISLFTEGRE

SEQ ID NO: 431229 - protein, 9 aa, Homo Sapiens
TQLVESRQT

SEQ ID NO: 431230 - protein, 9 aa, Homo Sapiens
KSQNGELMT

SEQ ID NO: 431231 - protein, 9 aa, Homo Sapiens
EGDRVQAEM

SEQ ID NO: 431232 - protein, 9 aa, Homo Sapiens
RGVDIKANI

SEQ ID NO: 431233 - protein, 9 aa, Homo Sapiens
PSVNYFISA

SEQ ID NO: 431234 - protein, 9 aa, Homo Sapiens
DFLHFKFEN

SEQ ID NO: 431235 - protein, 9 aa, Homo Sapiens
FSIFKSDIP

SEQ ID NO: 431236 - protein, 9 aa, Homo Sapiens
PDPEGDRVQ

SEQ ID NO: 431237 - protein, 9 aa, Homo Sapiens
AQGMVFLAS

SEQ ID NO: 431238 - protein, 9 aa, Homo Sapiens
KQYVLKGGE

SEQ ID NO: 431239 - protein, 9 aa, Homo Sapiens
CWGYQLTQH

SEQ ID NO: 431240 - protein, 9 aa, Homo Sapiens
GVQLSPAEY

SEQ ID NO: 431241 - protein, 9 aa, Homo Sapiens
STTEEMEVV

SEQ ID NO: 431242 - protein, 9 aa, Homo Sapiens
AHLVLEENS

SEQ ID NO: 431243 - protein, 9 aa, Homo Sapiens
TLGLCLCAI

SEQ ID NO: 431244 - protein, 9 aa, Homo Sapiens
GFVGVVTHY

SEQ ID NO: 431245 - protein, 9 aa, Homo Sapiens
QRILQRITH

SEQ ID NO: 431246 - protein, 9 aa, Homo Sapiens
IQTGYMPRK

SEQ ID NO: 431247 - protein, 9 aa, Homo Sapiens
ASNLFYWPR

SEQ ID NO: 431248 - protein, 9 aa, Homo Sapiens
EQSITSETS

SEQ ID NO: 431249 - protein, 9 aa, Homo Sapiens
EAWRFLIYI

SEQ ID NO: 431250 - protein, 9 aa, Homo Sapiens
FSEHLIKIY

SEQ ID NO: 431251 - protein, 9 aa, Homo Sapiens
NLLSGFMAP

SEQ ID NO: 431252 - protein, 9 aa, Homo Sapiens
MRDILNMEN

SEQ ID NO: 431253 - protein, 9 aa, Homo Sapiens
HFRCNWIIV

SEQ ID NO: 431254 - protein, 9 aa, Homo Sapiens
YITLSEMTF

SEQ ID NO: 431255 - protein, 9 aa, Homo Sapiens
LMNNFDTSQ

SEQ ID NO: 431256 - protein, 9 aa, Homo Sapiens
DSWSHDPSD

SEQ ID NO: 431257 - protein, 9 aa, Homo Sapiens
FPLHQDNSE

SEQ ID NO: 431258 - protein, 9 aa, Homo Sapiens
RAIKEGNLS

SEQ ID NO: 431259 - protein, 9 aa, Homo Sapiens
QRWLVRFNT

SEQ ID NO: 431260 - protein, 9 aa, Homo Sapiens
VFVRALIVV

SEQ ID NO: 431261 - protein, 9 aa, Homo Sapiens
YLPEYKIFF

SEQ ID NO: 431262 - protein, 9 aa, Homo Sapiens
LGQVKPYSY

SEQ ID NO: 431263 - protein, 9 aa, Homo Sapiens
SPGLPSSLM

SEQ ID NO: 431264 - protein, 9 aa, Homo Sapiens
RLVTRITQL

SEQ ID NO: 431265 - protein, 9 aa, Homo Sapiens
ALKETSENN

SEQ ID NO: 431266 - protein, 9 aa, Homo Sapiens
AKDLPVYSL

SEQ ID NO: 431267 - protein, 9 aa, Homo Sapiens
QGLLGKISL

SEQ ID NO: 431268 - protein, 9 aa, Homo Sapiens
IAARKLICD

SEQ ID NO: 431269 - protein, 9 aa, Homo Sapiens
DLFKSGAAS

SEQ ID NO: 431270 - protein, 9 aa, Homo Sapiens
KPHQVGLIR

SEQ ID NO: 431271 - protein, 9 aa, Homo Sapiens
LFYQPISHQ

SEQ ID NO: 431272 - protein, 9 aa, Homo Sapiens
ECKEYILND

SEQ ID NO: 431273 - protein, 9 aa, Homo Sapiens
SLCSPSVMN

SEQ ID NO: 431274 - protein, 9 aa, Homo Sapiens
CSISSEENA

SEQ ID NO: 431275 - protein, 9 aa, Homo Sapiens
VSTKNPART

SEQ ID NO: 431276 - protein, 9 aa, Homo Sapiens
EFLKHGKAR

SEQ ID NO: 431277 - protein, 9 aa, Homo Sapiens
VQVHDQNIK

SEQ ID NO: 431278 - protein, 9 aa, Homo Sapiens
SVILLACQI

SEQ ID NO: 431279 - protein, 9 aa, Homo Sapiens
SKNWQENQK

SEQ ID NO: 431280 - protein, 9 aa, Homo Sapiens
THKIKKLAS

SEQ ID NO: 431281 - protein, 9 aa, Homo Sapiens
FLTDANMVM

SEQ ID NO: 431282 - protein, 9 aa, Homo Sapiens
GSEAYYSHE

SEQ ID NO: 431283 - protein, 9 aa, Homo Sapiens
TAKKICYQL

SEQ ID NO: 431284 - protein, 9 aa, Homo Sapiens
CFSEDGFLL

SEQ ID NO: 431285 - protein, 9 aa, Homo Sapiens
VQLMLHFRC

SEQ ID NO: 431286 - protein, 9 aa, Homo Sapiens
LPANKSRQQ

SEQ ID NO: 431287 - protein, 9 aa, Homo Sapiens
AVLDEANNI

SEQ ID NO: 431288 - protein, 9 aa, Homo Sapiens
TLYGEVPEN

SEQ ID NO: 431289 - protein, 9 aa, Homo Sapiens
CIVHVVATL

SEQ ID NO: 431290 - protein, 9 aa, Homo Sapiens
EVITHQITV

SEQ ID NO: 431291 - protein, 9 aa, Homo Sapiens
YRSASDNLD

SEQ ID NO: 431292 - protein, 9 aa, Homo Sapiens
RTMLDYLWA

SEQ ID NO: 431293 - protein, 9 aa, Homo Sapiens
TPSSSFRVS

SEQ ID NO: 431294 - protein, 9 aa, Homo Sapiens
QLHINHNYL

SEQ ID NO: 431295 - protein, 9 aa, Homo Sapiens
TVFLVLMFA

SEQ ID NO: 431296 - protein, 9 aa, Homo Sapiens
AAYYCALWE

SEQ ID NO: 431297 - protein, 9 aa, Homo Sapiens
KRFYLGLED

SEQ ID NO: 431298 - protein, 9 aa, Homo Sapiens
KIDQINRPG

SEQ ID NO: 431299 - protein, 9 aa, Homo Sapiens
KGGGDILKY

SEQ ID NO: 431300 - protein, 9 aa, Homo Sapiens
RTCVDFFHL

SEQ ID NO: 431301 - protein, 9 aa, Homo Sapiens
LFSAHLFGG

SEQ ID NO: 431302 - protein, 9 aa, Homo Sapiens
SGVLDDNAN

SEQ ID NO: 431303 - protein, 9 aa, Homo Sapiens
ERMSSNQPN

SEQ ID NO: 431304 - protein, 9 aa, Homo Sapiens
YRLIDDHTK

SEQ ID NO: 431305 - protein, 9 aa, Homo Sapiens
VSGLLVLTL

SEQ ID NO: 431306 - protein, 9 aa, Homo Sapiens
PMLNPQYIA

SEQ ID NO: 431307 - protein, 9 aa, Homo Sapiens
ALRWHILQK

SEQ ID NO: 431308 - protein, 9 aa, Homo Sapiens
KCPMNLLAR

SEQ ID NO: 431309 - protein, 9 aa, Homo Sapiens
VYQTKSHVP

SEQ ID NO: 431310 - protein, 9 aa, Homo Sapiens
YPIKMKIPI

SEQ ID NO: 431311 - protein, 9 aa, Homo Sapiens
RCIQYLASR

SEQ ID NO: 431312 - protein, 9 aa, Homo Sapiens
RQNELLKRK

SEQ ID NO: 431313 - protein, 9 aa, Homo Sapiens
SLIKGPDFL

SEQ ID NO: 431314 - protein, 9 aa, Homo Sapiens
LHEAENKHQ

SEQ ID NO: 431315 - protein, 9 aa, Homo Sapiens
MVNGGTKCG

SEQ ID NO: 431316 - protein, 9 aa, Homo Sapiens
SLSELDNFS

SEQ ID NO: 431317 - protein, 9 aa, Homo Sapiens
KQKRKLSSF

SEQ ID NO: 431318 - protein, 9 aa, Homo Sapiens
RCDKGNEVT

SEQ ID NO: 431319 - protein, 9 aa, Homo Sapiens
TFVLHQTAL

SEQ ID NO: 431320 - protein, 9 aa, Homo Sapiens
IRNAMGVGL

SEQ ID NO: 431321 - protein, 9 aa, Homo Sapiens
MLGMGGLLT

SEQ ID NO: 431322 - protein, 9 aa, Homo Sapiens
SIETKTTIG

SEQ ID NO: 431323 - protein, 9 aa, Homo Sapiens
ICNFIVALC

SEQ ID NO: 431324 - protein, 9 aa, Homo Sapiens
INPDAWEFC

SEQ ID NO: 431325 - protein, 9 aa, Homo Sapiens
GSLKSSPGL

SEQ ID NO: 431326 - protein, 9 aa, Homo Sapiens
SAITVFDML

SEQ ID NO: 431327 - protein, 9 aa, Homo Sapiens
LHQPPAMPS

SEQ ID NO: 431328 - protein, 9 aa, Homo Sapiens
GRAQSYTQQ

SEQ ID NO: 431329 - protein, 9 aa, Homo Sapiens
WTAKALAMT

SEQ ID NO: 431330 - protein, 9 aa, Homo Sapiens
NSLSLNTPS

SEQ ID NO: 431331 - protein, 9 aa, Homo Sapiens
GFSSCRSLG

SEQ ID NO: 431332 - protein, 9 aa, Homo Sapiens
QGSHPEGRF

SEQ ID NO: 431333 - protein, 9 aa, Homo Sapiens
NLVCGDDEN

SEQ ID NO: 431334 - protein, 9 aa, Homo Sapiens
TKGHLIVIG

SEQ ID NO: 431335 - protein, 9 aa, Homo Sapiens
WWHYEHQNR

SEQ ID NO: 431336 - protein, 9 aa, Homo Sapiens
LNYGKSMSL

SEQ ID NO: 431337 - protein, 9 aa, Homo Sapiens
AMGIHENQS

SEQ ID NO: 431338 - protein, 9 aa, Homo Sapiens
FLTNRVLKY

SEQ ID NO: 431339 - protein, 9 aa, Homo Sapiens
EDLNKADNW

SEQ ID NO: 431340 - protein, 9 aa, Homo Sapiens
AQGEQNVPP

SEQ ID NO: 431341 - protein, 9 aa, Homo Sapiens
TNHQQTHTG

SEQ ID NO: 431342 - protein, 9 aa, Homo Sapiens
PPPPGFKRL

SEQ ID NO: 431343 - protein, 9 aa, Homo Sapiens
PIIKSPNEM

SEQ ID NO: 431344 - protein, 9 aa, Homo Sapiens
NTFIARGIL

SEQ ID NO: 431345 - protein, 9 aa, Homo Sapiens
TAIYLTGPD

SEQ ID NO: 431346 - protein, 9 aa, Homo Sapiens
QQQVDIPLW

SEQ ID NO: 431347 - protein, 9 aa, Homo Sapiens
TFAVTAQGD

SEQ ID NO: 431348 - protein, 9 aa, Homo Sapiens
DVVLPFTLE

SEQ ID NO: 431349 - protein, 9 aa, Homo Sapiens
MDTGKPILH

SEQ ID NO: 431350 - protein, 9 aa, Homo Sapiens
IVLEAKHLK

SEQ ID NO: 431351 - protein, 9 aa, Homo Sapiens
HWLAMSLAC

SEQ ID NO: 431352 - protein, 9 aa, Homo Sapiens
RGAVYLFNG

SEQ ID NO: 431353 - protein, 9 aa, Homo Sapiens
RRGDVANAV

SEQ ID NO: 431354 - protein, 9 aa, Homo Sapiens
CKVNRTFQA

SEQ ID NO: 431355 - protein, 9 aa, Homo Sapiens
QKPFIRLSK

SEQ ID NO: 431356 - protein, 9 aa, Homo Sapiens
TEETVYGLN

SEQ ID NO: 431357 - protein, 9 aa, Homo Sapiens
ECNIQLFSF

SEQ ID NO: 431358 - protein, 9 aa, Homo Sapiens
ELYVLRAAQ

SEQ ID NO: 431359 - protein, 9 aa, Homo Sapiens
IEFLSWMEP

SEQ ID NO: 431360 - protein, 9 aa, Homo Sapiens
LDETNKGTQ

SEQ ID NO: 431361 - protein, 9 aa, Homo Sapiens
KLTQSTEKL

SEQ ID NO: 431362 - protein, 9 aa, Homo Sapiens
LRFSTDNAS

SEQ ID NO: 431363 - protein, 9 aa, Homo Sapiens
QPNHYPNTH

SEQ ID NO: 431364 - protein, 9 aa, Homo Sapiens
NGLLNEVLE

SEQ ID NO: 431365 - protein, 9 aa, Homo Sapiens
MAELKGYTL

SEQ ID NO: 431366 - protein, 9 aa, Homo Sapiens
GNFILRDSE

SEQ ID NO: 431367 - protein, 9 aa, Homo Sapiens
TRDRDPSET

SEQ ID NO: 431368 - protein, 9 aa, Homo Sapiens
KKKPDVLRY

SEQ ID NO: 431369 - protein, 9 aa, Homo Sapiens
VCLAKEKEE

SEQ ID NO: 431370 - protein, 9 aa, Homo Sapiens
SSLASDQFN

SEQ ID NO: 431371 - protein, 9 aa, Homo Sapiens
ILAFNVRIE

SEQ ID NO: 431372 - protein, 9 aa, Homo Sapiens
KEYADIIRK

SEQ ID NO: 431373 - protein, 9 aa, Homo Sapiens
ITSVPCSRF

SEQ ID NO: 431374 - protein, 9 aa, Homo Sapiens
TSTGFSGSV

SEQ ID NO: 431375 - protein, 9 aa, Homo Sapiens
CLVLQSFKV

SEQ ID NO: 431376 - protein, 9 aa, Homo Sapiens
IVNYIESNS

SEQ ID NO: 431377 - protein, 9 aa, Homo Sapiens
RHLQLAVSV

SEQ ID NO: 431378 - protein, 9 aa, Homo Sapiens
SGFRKPTNN

SEQ ID NO: 431379 - protein, 9 aa, Homo Sapiens
QRNNYSKLR

SEQ ID NO: 431380 - protein, 9 aa, Homo Sapiens
VTVDEIVVT

SEQ ID NO: 431381 - protein, 9 aa, Homo Sapiens
TDDTLNSLD

SEQ ID NO: 431382 - protein, 9 aa, Homo Sapiens
EPLKNYYQA

SEQ ID NO: 431383 - protein, 9 aa, Homo Sapiens
DFIFVLDIL

SEQ ID NO: 431384 - protein, 9 aa, Homo Sapiens
FMVKNIVPR

SEQ ID NO: 431385 - protein, 9 aa, Homo Sapiens
ESQENTFYQ

SEQ ID NO: 431386 - protein, 9 aa, Homo Sapiens
LPIVPIDIG

SEQ ID NO: 431387 - protein, 9 aa, Homo Sapiens
SYQENRRFV

SEQ ID NO: 431388 - protein, 9 aa, Homo Sapiens
SECESEYGI

SEQ ID NO: 431389 - protein, 9 aa, Homo Sapiens
RSLYSTPFS

SEQ ID NO: 431390 - protein, 9 aa, Homo Sapiens
NSISVMSDI

SEQ ID NO: 431391 - protein, 9 aa, Homo Sapiens
DNEVEKITR

SEQ ID NO: 431392 - protein, 9 aa, Homo Sapiens
FQRTRSFQM

SEQ ID NO: 431393 - protein, 9 aa, Homo Sapiens
EPGYAKYGL

SEQ ID NO: 431394 - protein, 9 aa, Homo Sapiens
QNIHLGVNE

SEQ ID NO: 431395 - protein, 9 aa, Homo Sapiens
NYLISAVLE

SEQ ID NO: 431396 - protein, 9 aa, Homo Sapiens
DFRSKYEVV

SEQ ID NO: 431397 - protein, 9 aa, Homo Sapiens
NKNWVQSGP

SEQ ID NO: 431398 - protein, 9 aa, Homo Sapiens
GMYGWRKRC

SEQ ID NO: 431399 - protein, 9 aa, Homo Sapiens
RGREPASCK

SEQ ID NO: 431400 - protein, 9 aa, Homo Sapiens
KNLVYPAMR

SEQ ID NO: 431401 - protein, 9 aa, Homo Sapiens
YAATKDLRW

SEQ ID NO: 431402 - protein, 9 aa, Homo Sapiens
LQARVDEVA

SEQ ID NO: 431403 - protein, 9 aa, Homo Sapiens
QWLLYAQNV

SEQ ID NO: 431404 - protein, 9 aa, Homo Sapiens
RSLGYAHIN

SEQ ID NO: 431405 - protein, 9 aa, Homo Sapiens
AFAAAKGPR

SEQ ID NO: 431406 - protein, 9 aa, Homo Sapiens
GMYYREEEL

SEQ ID NO: 431407 - protein, 9 aa, Homo Sapiens
EDALFASQF

SEQ ID NO: 431408 - protein, 9 aa, Homo Sapiens
DWQNCLLIF

SEQ ID NO: 431409 - protein, 9 aa, Homo Sapiens
KPFQVKKHI

SEQ ID NO: 431410 - protein, 9 aa, Homo Sapiens
LERRYSDFT

SEQ ID NO: 431411 - protein, 9 aa, Homo Sapiens
PGPLQDRSL

SEQ ID NO: 431412 - protein, 9 aa, Homo Sapiens
LCLLVCWFT

SEQ ID NO: 431413 - protein, 9 aa, Homo Sapiens
ISSNNKTMS

SEQ ID NO: 431414 - protein, 9 aa, Homo Sapiens
VYVAAVCLE

SEQ ID NO: 431415 - protein, 9 aa, Homo Sapiens
LFQGIGRLI

SEQ ID NO: 431416 - protein, 9 aa, Homo Sapiens
KRGIYSRHH

SEQ ID NO: 431417 - protein, 9 aa, Homo Sapiens
DTGVVCHTL

SEQ ID NO: 431418 - protein, 9 aa, Homo Sapiens
NNFPAHIFE

SEQ ID NO: 431419 - protein, 9 aa, Homo Sapiens
NCLCETVFQ

SEQ ID NO: 431420 - protein, 9 aa, Homo Sapiens
CAAVVGFCV

SEQ ID NO: 431421 - protein, 9 aa, Homo Sapiens
SEGLGHSAK

SEQ ID NO: 431422 - protein, 9 aa, Homo Sapiens
LMIIRHLDE

SEQ ID NO: 431423 - protein, 9 aa, Homo Sapiens
WCFVRGPPT

SEQ ID NO: 431424 - protein, 9 aa, Homo Sapiens
WGMKLRHLG

SEQ ID NO: 431425 - protein, 9 aa, Homo Sapiens
KGLKSKSMN

SEQ ID NO: 431426 - protein, 9 aa, Homo Sapiens
LASGDHSAR

SEQ ID NO: 431427 - protein, 9 aa, Homo Sapiens
SLKMVQAVG

SEQ ID NO: 431428 - protein, 9 aa, Homo Sapiens
VQFKISSSY

SEQ ID NO: 431429 - protein, 9 aa, Homo Sapiens
PNDRLFAVR

SEQ ID NO: 431430 - protein, 9 aa, Homo Sapiens
QSYGTYSPV

SEQ ID NO: 431431 - protein, 9 aa, Homo Sapiens
NFLEERIRQ

SEQ ID NO: 431432 - protein, 9 aa, Homo Sapiens
CGKAFIHSD

SEQ ID NO: 431433 - protein, 9 aa, Homo Sapiens
ELATVPDQE

SEQ ID NO: 431434 - protein, 9 aa, Homo Sapiens
MNLANNFPA

SEQ ID NO: 431435 - protein, 9 aa, Homo Sapiens
SPFILALSG

SEQ ID NO: 431436 - protein, 9 aa, Homo Sapiens
CPHQQIYDF

SEQ ID NO: 431437 - protein, 9 aa, Homo Sapiens
LTFNLTKYP

SEQ ID NO: 431438 - protein, 9 aa, Homo Sapiens
EGSNTPLQS

SEQ ID NO: 431439 - protein, 9 aa, Homo Sapiens
NIVFLVDGS

SEQ ID NO: 431440 - protein, 9 aa, Homo Sapiens
IMEYLFCES

SEQ ID NO: 431441 - protein, 9 aa, Homo Sapiens
YYHLSKAFH

SEQ ID NO: 431442 - protein, 9 aa, Homo Sapiens
KRAKAMNTK

SEQ ID NO: 431443 - protein, 9 aa, Homo Sapiens
GHSAKLAFA

SEQ ID NO: 431444 - protein, 9 aa, Homo Sapiens
TNLQKHMIG

SEQ ID NO: 431445 - protein, 9 aa, Homo Sapiens
FLSSDPEVL

SEQ ID NO: 431446 - protein, 9 aa, Homo Sapiens
GGSGGPVVC

SEQ ID NO: 431447 - protein, 9 aa, Homo Sapiens
GTRGPLGAS

SEQ ID NO: 431448 - protein, 9 aa, Homo Sapiens
EKRKEMEEC

SEQ ID NO: 431449 - protein, 9 aa, Homo Sapiens
ELIGKYAVR

SEQ ID NO: 431450 - protein, 9 aa, Homo Sapiens
EHNFCKAKL

SEQ ID NO: 431451 - protein, 9 aa, Homo Sapiens
HVCNIHNKE

SEQ ID NO: 431452 - protein, 9 aa, Homo Sapiens
SSVNYKGLR

SEQ ID NO: 431453 - protein, 9 aa, Homo Sapiens
LYLHFCSDI

SEQ ID NO: 431454 - protein, 9 aa, Homo Sapiens
NKTNSILLY

SEQ ID NO: 431455 - protein, 9 aa, Homo Sapiens
SSLHMAAIL

SEQ ID NO: 431456 - protein, 9 aa, Homo Sapiens
LSNSISVMS

SEQ ID NO: 431457 - protein, 9 aa, Homo Sapiens
QSDFYKLPI

SEQ ID NO: 431458 - protein, 9 aa, Homo Sapiens
KKVVQLEQE

SEQ ID NO: 431459 - protein, 9 aa, Homo Sapiens
TDELYVLRA

SEQ ID NO: 431460 - protein, 9 aa, Homo Sapiens
KLQENLGNP

SEQ ID NO: 431461 - protein, 9 aa, Homo Sapiens
GLFGRAFNM

SEQ ID NO: 431462 - protein, 9 aa, Homo Sapiens
NWQEFVDAY

SEQ ID NO: 431463 - protein, 9 aa, Homo Sapiens
IIHTGEKSF

SEQ ID NO: 431464 - protein, 9 aa, Homo Sapiens
LGYAHINFQ

SEQ ID NO: 431465 - protein, 9 aa, Homo Sapiens
ASRVLRPLR

SEQ ID NO: 431466 - protein, 9 aa, Homo Sapiens
SSHLNKHNK

SEQ ID NO: 431467 - protein, 9 aa, Homo Sapiens
VVVKITGHL

SEQ ID NO: 431468 - protein, 9 aa, Homo Sapiens
NVNKGKIAK

SEQ ID NO: 431469 - protein, 9 aa, Homo Sapiens
SVHIAVKVP

SEQ ID NO: 431470 - protein, 9 aa, Homo Sapiens
YCNVANVFL

SEQ ID NO: 431471 - protein, 9 aa, Homo Sapiens
TISLRLKNY

SEQ ID NO: 431472 - protein, 9 aa, Homo Sapiens
IDRVDGGES

SEQ ID NO: 431473 - protein, 9 aa, Homo Sapiens
EQGTSFSHT

SEQ ID NO: 431474 - protein, 9 aa, Homo Sapiens
QEIELQKKI

SEQ ID NO: 431475 - protein, 9 aa, Homo Sapiens
PSQDEEMIN

SEQ ID NO: 431476 - protein, 9 aa, Homo Sapiens
PTVLDIFWV

SEQ ID NO: 431477 - protein, 9 aa, Homo Sapiens
IKMFCTSCL

SEQ ID NO: 431478 - protein, 9 aa, Homo Sapiens
ETCYTLAIV

SEQ ID NO: 431479 - protein, 9 aa, Homo Sapiens
ISEPGCTKV

SEQ ID NO: 431480 - protein, 9 aa, Homo Sapiens
INDIFEDKQ

SEQ ID NO: 431481 - protein, 9 aa, Homo Sapiens
LVLKSALCL

SEQ ID NO: 431482 - protein, 9 aa, Homo Sapiens
NSYVSSTLS

SEQ ID NO: 431483 - protein, 9 aa, Homo Sapiens
NHAKFIGVT

SEQ ID NO: 431484 - protein, 9 aa, Homo Sapiens
TFHRMYPGQ

SEQ ID NO: 431485 - protein, 9 aa, Homo Sapiens
GEELWASAP

SEQ ID NO: 431486 - protein, 9 aa, Homo Sapiens
SAGIIELSE

SEQ ID NO: 431487 - protein, 9 aa, Homo Sapiens
PNCRIYVNN

SEQ ID NO: 431488 - protein, 9 aa, Homo Sapiens
AQIIGSDTS

SEQ ID NO: 431489 - protein, 9 aa, Homo Sapiens
KVQLTALGC

SEQ ID NO: 431490 - protein, 9 aa, Homo Sapiens
LKRFFKSLE

SEQ ID NO: 431491 - protein, 9 aa, Homo Sapiens
QLERLKQQM

SEQ ID NO: 431492 - protein, 9 aa, Homo Sapiens
YGNGAESNN

SEQ ID NO: 431493 - protein, 9 aa, Homo Sapiens
SQNAINRIN

SEQ ID NO: 431494 - protein, 9 aa, Homo Sapiens
TSPTELPSA

SEQ ID NO: 431495 - protein, 9 aa, Homo Sapiens
LPKHDMELA

SEQ ID NO: 431496 - protein, 9 aa, Homo Sapiens
LPHQPQIVE

SEQ ID NO: 431497 - protein, 9 aa, Homo Sapiens
LEEDHIIFW

SEQ ID NO: 431498 - protein, 9 aa, Homo Sapiens
DNVFTIRTP

SEQ ID NO: 431499 - protein, 9 aa, Homo Sapiens
SELNLQQNQ

SEQ ID NO: 431500 - protein, 9 aa, Homo Sapiens
VLFYHTRIE

SEQ ID NO: 431501 - protein, 9 aa, Homo Sapiens
EEWGKLDSP

SEQ ID NO: 431502 - protein, 9 aa, Homo Sapiens
IDGLEKIIY

SEQ ID NO: 431503 - protein, 9 aa, Homo Sapiens
EKEDKLSKV

SEQ ID NO: 431504 - protein, 9 aa, Homo Sapiens
VTYALCSHV

SEQ ID NO: 431505 - protein, 9 aa, Homo Sapiens
INNETKLGY

SEQ ID NO: 431506 - protein, 9 aa, Homo Sapiens
LMRCDKGNE

SEQ ID NO: 431507 - protein, 9 aa, Homo Sapiens
QAQVKHRCV

SEQ ID NO: 431508 - protein, 9 aa, Homo Sapiens
HMVVDEDLR

SEQ ID NO: 431509 - protein, 9 aa, Homo Sapiens
CRHENVLLR

SEQ ID NO: 431510 - protein, 9 aa, Homo Sapiens
RLVHVWLNE

SEQ ID NO: 431511 - protein, 9 aa, Homo Sapiens
TYYCSGENL

SEQ ID NO: 431512 - protein, 9 aa, Homo Sapiens
RHLYARGWK

SEQ ID NO: 431513 - protein, 9 aa, Homo Sapiens
PGLIYLTGP

SEQ ID NO: 431514 - protein, 9 aa, Homo Sapiens
ISVAWTLYV

SEQ ID NO: 431515 - protein, 9 aa, Homo Sapiens
VVTPLLNHL

SEQ ID NO: 431516 - protein, 9 aa, Homo Sapiens
YQVLAHDSD

SEQ ID NO: 431517 - protein, 9 aa, Homo Sapiens
LIPPVNFTI

SEQ ID NO: 431518 - protein, 9 aa, Homo Sapiens
EWGTSCPHY

SEQ ID NO: 431519 - protein, 9 aa, Homo Sapiens
LCLDDPPGQ

SEQ ID NO: 431520 - protein, 9 aa, Homo Sapiens
VLLRRVWKK

SEQ ID NO: 431521 - protein, 9 aa, Homo Sapiens
RWMAPEPLK

SEQ ID NO: 431522 - protein, 9 aa, Homo Sapiens
AGYETTISV

SEQ ID NO: 431523 - protein, 9 aa, Homo Sapiens
VRDNWTPQR

SEQ ID NO: 431524 - protein, 9 aa, Homo Sapiens
KVANIRLNL

SEQ ID NO: 431525 - protein, 9 aa, Homo Sapiens
KCEECGKSV

SEQ ID NO: 431526 - protein, 9 aa, Homo Sapiens
SNELHAKQK

SEQ ID NO: 431527 - protein, 9 aa, Homo Sapiens
DCFVSHPTE

SEQ ID NO: 431528 - protein, 9 aa, Homo Sapiens
LSESECLIH

SEQ ID NO: 431529 - protein, 9 aa, Homo Sapiens
IDTVTGPNE

SEQ ID NO: 431530 - protein, 9 aa, Homo Sapiens
SGKENKVLT

SEQ ID NO: 431531 - protein, 9 aa, Homo Sapiens
ELRLVHDTG

SEQ ID NO: 431532 - protein, 9 aa, Homo Sapiens
CNRFKLPPQ

SEQ ID NO: 431533 - protein, 9 aa, Homo Sapiens
GAFCYDIVL

SEQ ID NO: 431534 - protein, 9 aa, Homo Sapiens
GLSPLIDRY

SEQ ID NO: 431535 - protein, 9 aa, Homo Sapiens
YVVDMSTRR

SEQ ID NO: 431536 - protein, 9 aa, Homo Sapiens
LSVCVRLPR

SEQ ID NO: 431537 - protein, 9 aa, Homo Sapiens
ISDTFYPYL

SEQ ID NO: 431538 - protein, 9 aa, Homo Sapiens
IFSLPKMTL

SEQ ID NO: 431539 - protein, 9 aa, Homo Sapiens
YHCVVNYTK

SEQ ID NO: 431540 - protein, 9 aa, Homo Sapiens
IQHFWVLFD

SEQ ID NO: 431541 - protein, 9 aa, Homo Sapiens
MRKMSKHAL

SEQ ID NO: 431542 - protein, 9 aa, Homo Sapiens
SKKEYQKND

SEQ ID NO: 431543 - protein, 9 aa, Homo Sapiens
LLYYSTMNY

SEQ ID NO: 431544 - protein, 9 aa, Homo Sapiens
SNCVDNLYG

SEQ ID NO: 431545 - protein, 9 aa, Homo Sapiens
MYGKQSMVD

SEQ ID NO: 431546 - protein, 9 aa, Homo Sapiens
AQDLGGDFW

SEQ ID NO: 431547 - protein, 9 aa, Homo Sapiens
IGYAFKTVL

SEQ ID NO: 431548 - protein, 9 aa, Homo Sapiens
HSELAGVAD

SEQ ID NO: 431549 - protein, 9 aa, Homo Sapiens
RHCPNCQHS

SEQ ID NO: 431550 - protein, 9 aa, Homo Sapiens
HLGTALKAT

SEQ ID NO: 431551 - protein, 9 aa, Homo Sapiens
ERLKQQMNS

SEQ ID NO: 431552 - protein, 9 aa, Homo Sapiens
QQYNDHHSK

SEQ ID NO: 431553 - protein, 9 aa, Homo Sapiens
TLGVLMGSD

SEQ ID NO: 431554 - protein, 9 aa, Homo Sapiens
LQKFVDLAQ

SEQ ID NO: 431555 - protein, 9 aa, Homo Sapiens
QLGNTRYGG

SEQ ID NO: 431556 - protein, 9 aa, Homo Sapiens
LSISKAHLY

SEQ ID NO: 431557 - protein, 9 aa, Homo Sapiens
YIIEDIDED

SEQ ID NO: 431558 - protein, 9 aa, Homo Sapiens
NMHIKEDNF

SEQ ID NO: 431559 - protein, 9 aa, Homo Sapiens
DQINRPGWK

SEQ ID NO: 431560 - protein, 9 aa, Homo Sapiens
SDFRSKYEV

SEQ ID NO: 431561 - protein, 9 aa, Homo Sapiens
VDKMISHAT

SEQ ID NO: 431562 - protein, 9 aa, Homo Sapiens
LKAELDEKI

SEQ ID NO: 431563 - protein, 9 aa, Homo Sapiens
KLNDQLFPC

SEQ ID NO: 431564 - protein, 9 aa, Homo Sapiens
DVGDGARAK

SEQ ID NO: 431565 - protein, 9 aa, Homo Sapiens
NNVPNMLTN

SEQ ID NO: 431566 - protein, 9 aa, Homo Sapiens
VPSYKTNES

SEQ ID NO: 431567 - protein, 9 aa, Homo Sapiens
TWHGNDFKD

SEQ ID NO: 431568 - protein, 9 aa, Homo Sapiens
RRTDKNDDG

SEQ ID NO: 431569 - protein, 9 aa, Homo Sapiens
HAAPMEDSW

SEQ ID NO: 431570 - protein, 9 aa, Homo Sapiens
SIHLMYLLN

SEQ ID NO: 431571 - protein, 9 aa, Homo Sapiens
YVCLRCCLS

SEQ ID NO: 431572 - protein, 9 aa, Homo Sapiens
TADIFNRIK

SEQ ID NO: 431573 - protein, 9 aa, Homo Sapiens
PLGGSHTLL

SEQ ID NO: 431574 - protein, 9 aa, Homo Sapiens
LTKTQLVES

SEQ ID NO: 431575 - protein, 9 aa, Homo Sapiens
DSVTERWFV

SEQ ID NO: 431576 - protein, 9 aa, Homo Sapiens
RMSERRSFE

SEQ ID NO: 431577 - protein, 9 aa, Homo Sapiens
SSITLFAFS

SEQ ID NO: 431578 - protein, 9 aa, Homo Sapiens
LMGLFESGD

SEQ ID NO: 431579 - protein, 9 aa, Homo Sapiens
VCFLEGKHL

SEQ ID NO: 431580 - protein, 9 aa, Homo Sapiens
ITVKRACIK

SEQ ID NO: 431581 - protein, 9 aa, Homo Sapiens
DDEEEEEAE

SEQ ID NO: 431582 - protein, 9 aa, Homo Sapiens
YTKPGNVTW

SEQ ID NO: 431583 - protein, 9 aa, Homo Sapiens
GDSALYLCT

SEQ ID NO: 431584 - protein, 9 aa, Homo Sapiens
VKPLDLLGK

SEQ ID NO: 431585 - protein, 9 aa, Homo Sapiens
LQDTFTTLV

SEQ ID NO: 431586 - protein, 9 aa, Homo Sapiens
TYSMQGRAK

SEQ ID NO: 431587 - protein, 9 aa, Homo Sapiens
TVFITSDLC

SEQ ID NO: 431588 - protein, 9 aa, Homo Sapiens
TGHLYACQV

SEQ ID NO: 431589 - protein, 9 aa, Homo Sapiens
DKMISHATE

SEQ ID NO: 431590 - protein, 9 aa, Homo Sapiens
FPREVCEKL

SEQ ID NO: 431591 - protein, 9 aa, Homo Sapiens
DTIRSISIV

SEQ ID NO: 431592 - protein, 9 aa, Homo Sapiens
HIIIEELPK

SEQ ID NO: 431593 - protein, 9 aa, Homo Sapiens
RELGSGLTL

SEQ ID NO: 431594 - protein, 9 aa, Homo Sapiens
LLPMISPRY

SEQ ID NO: 431595 - protein, 9 aa, Homo Sapiens
KFKDCYQFT

SEQ ID NO: 431596 - protein, 9 aa, Homo Sapiens
SSFRVSSCL

SEQ ID NO: 431597 - protein, 9 aa, Homo Sapiens
KCMFFERHL

SEQ ID NO: 431598 - protein, 9 aa, Homo Sapiens
NKAAVLSVC

SEQ ID NO: 431599 - protein, 9 aa, Homo Sapiens
TTHLDKSCK

SEQ ID NO: 431600 - protein, 9 aa, Homo Sapiens
KTSDVETIF

SEQ ID NO: 431601 - protein, 9 aa, Homo Sapiens
SLTEHKIIH

SEQ ID NO: 431602 - protein, 9 aa, Homo Sapiens
NYRAGMTID

SEQ ID NO: 431603 - protein, 9 aa, Homo Sapiens
PCMSINFRD

SEQ ID NO: 431604 - protein, 9 aa, Homo Sapiens
TQKSSITNH

SEQ ID NO: 431605 - protein, 9 aa, Homo Sapiens
NGPRPYGGR

SEQ ID NO: 431606 - protein, 9 aa, Homo Sapiens
DRFPTHKRK

SEQ ID NO: 431607 - protein, 9 aa, Homo Sapiens
LLKSPKGVE

SEQ ID NO: 431608 - protein, 9 aa, Homo Sapiens
TSMIRNAMG

SEQ ID NO: 431609 - protein, 9 aa, Homo Sapiens
MMSSHLHKT

SEQ ID NO: 431610 - protein, 9 aa, Homo Sapiens
AIVDKLHNL

SEQ ID NO: 431611 - protein, 9 aa, Homo Sapiens
YQIRPLLDV

SEQ ID NO: 431612 - protein, 9 aa, Homo Sapiens
CSHTEAAVR

SEQ ID NO: 431613 - protein, 9 aa, Homo Sapiens
NTLLKTLLE

SEQ ID NO: 431614 - protein, 9 aa, Homo Sapiens
LQIKVRRLE

SEQ ID NO: 431615 - protein, 9 aa, Homo Sapiens
HKYGDKSYE

SEQ ID NO: 431616 - protein, 9 aa, Homo Sapiens
NSHEDKSPM

SEQ ID NO: 431617 - protein, 9 aa, Homo Sapiens
CTEENKIGT

SEQ ID NO: 431618 - protein, 9 aa, Homo Sapiens
RQIHTGYRP

SEQ ID NO: 431619 - protein, 9 aa, Homo Sapiens
IPGKAAKTQ

SEQ ID NO: 431620 - protein, 9 aa, Homo Sapiens
TSKLFSYKD

SEQ ID NO: 431621 - protein, 9 aa, Homo Sapiens
VEILANNQG

SEQ ID NO: 431622 - protein, 9 aa, Homo Sapiens
SRVCPFLIY

SEQ ID NO: 431623 - protein, 9 aa, Homo Sapiens
YDESNAFES

SEQ ID NO: 431624 - protein, 9 aa, Homo Sapiens
VPQVVWLPE

SEQ ID NO: 431625 - protein, 9 aa, Homo Sapiens
AINYNSNQA

SEQ ID NO: 431626 - protein, 9 aa, Homo Sapiens
LEQGKKPIL

SEQ ID NO: 431627 - protein, 9 aa, Homo Sapiens
ETKRHIFPH

SEQ ID NO: 431628 - protein, 9 aa, Homo Sapiens
SGGSTTVDF

SEQ ID NO: 431629 - protein, 9 aa, Homo Sapiens
DVMKYFEEM

SEQ ID NO: 431630 - protein, 9 aa, Homo Sapiens
SNIVPGKAN

SEQ ID NO: 431631 - protein, 9 aa, Homo Sapiens
RHPVCYGTC

SEQ ID NO: 431632 - protein, 9 aa, Homo Sapiens
CIRDVHELF

SEQ ID NO: 431633 - protein, 9 aa, Homo Sapiens
LNLQRRAAE

SEQ ID NO: 431634 - protein, 9 aa, Homo Sapiens
NKYWCRPPH

SEQ ID NO: 431635 - protein, 9 aa, Homo Sapiens
PSPSAPSTL

SEQ ID NO: 431636 - protein, 9 aa, Homo Sapiens
SDLFWLRKA

SEQ ID NO: 431637 - protein, 9 aa, Homo Sapiens
FMAKINICM

SEQ ID NO: 431638 - protein, 9 aa, Homo Sapiens
KKCRHENVL

SEQ ID NO: 431639 - protein, 9 aa, Homo Sapiens
VYCKKDLLR

SEQ ID NO: 431640 - protein, 9 aa, Homo Sapiens
TLIIRGEQV

SEQ ID NO: 431641 - protein, 9 aa, Homo Sapiens
VIKAIADYV

SEQ ID NO: 431642 - protein, 9 aa, Homo Sapiens
CGQCIINSN

SEQ ID NO: 431643 - protein, 9 aa, Homo Sapiens
SGSSDADPR

SEQ ID NO: 431644 - protein, 9 aa, Homo Sapiens
KVLRITVCD

SEQ ID NO: 431645 - protein, 9 aa, Homo Sapiens
SSKSHRFTV

SEQ ID NO: 431646 - protein, 9 aa, Homo Sapiens
GRKQEDKQI

SEQ ID NO: 431647 - protein, 9 aa, Homo Sapiens
LARSRWQCS

SEQ ID NO: 431648 - protein, 9 aa, Homo Sapiens
YSVHSFSDR

SEQ ID NO: 431649 - protein, 9 aa, Homo Sapiens
RPDFREKVI

SEQ ID NO: 431650 - protein, 9 aa, Homo Sapiens
TLNSLDTCD

SEQ ID NO: 431651 - protein, 9 aa, Homo Sapiens
CYPISGHKS

SEQ ID NO: 431652 - protein, 9 aa, Homo Sapiens
QYVKIKRNW

SEQ ID NO: 431653 - protein, 9 aa, Homo Sapiens
VDAAIFHLL

SEQ ID NO: 431654 - protein, 9 aa, Homo Sapiens
RKMSKNKTA

SEQ ID NO: 431655 - protein, 9 aa, Homo Sapiens
VLYDAVNSF

SEQ ID NO: 431656 - protein, 9 aa, Homo Sapiens
WAWDCLQGH

SEQ ID NO: 431657 - protein, 9 aa, Homo Sapiens
KRLGIKMGK

SEQ ID NO: 431658 - protein, 9 aa, Homo Sapiens
LGSRAAGQV

SEQ ID NO: 431659 - protein, 9 aa, Homo Sapiens
NDLIDCAFL

SEQ ID NO: 431660 - protein, 9 aa, Homo Sapiens
FVFRISQAT

SEQ ID NO: 431661 - protein, 9 aa, Homo Sapiens
LPRSGNTSM

SEQ ID NO: 431662 - protein, 9 aa, Homo Sapiens
FIKEFLGRR

SEQ ID NO: 431663 - protein, 9 aa, Homo Sapiens
PYQNEDYLI

SEQ ID NO: 431664 - protein, 9 aa, Homo Sapiens
GDLDFETGD

SEQ ID NO: 431665 - protein, 9 aa, Homo Sapiens
KQISEYNIS

SEQ ID NO: 431666 - protein, 9 aa, Homo Sapiens
KEDIDTVMK

SEQ ID NO: 431667 - protein, 9 aa, Homo Sapiens
GQSLLSTHY

SEQ ID NO: 431668 - protein, 9 aa, Homo Sapiens
VFKIYGVDS

SEQ ID NO: 431669 - protein, 9 aa, Homo Sapiens
LNRYEMIRL

SEQ ID NO: 431670 - protein, 9 aa, Homo Sapiens
DRNGGANKK

SEQ ID NO: 431671 - protein, 9 aa, Homo Sapiens
QHLGYSSKK

SEQ ID NO: 431672 - protein, 9 aa, Homo Sapiens
QPPLPEQSP

SEQ ID NO: 431673 - protein, 9 aa, Homo Sapiens
TYHKITHTG

SEQ ID NO: 431674 - protein, 9 aa, Homo Sapiens
IDSTNLNTH

SEQ ID NO: 431675 - protein, 9 aa, Homo Sapiens
VMQRRPDSR

SEQ ID NO: 431676 - protein, 9 aa, Homo Sapiens
DSKLFENKV

SEQ ID NO: 431677 - protein, 9 aa, Homo Sapiens
TDIENYVGI

SEQ ID NO: 431678 - protein, 9 aa, Homo Sapiens
CLEEKLKPL

SEQ ID NO: 431679 - protein, 9 aa, Homo Sapiens
IFHEQIHSG

SEQ ID NO: 431680 - protein, 9 aa, Homo Sapiens
VGVWGDYDD

SEQ ID NO: 431681 - protein, 9 aa, Homo Sapiens
LIIMIVGER

SEQ ID NO: 431682 - protein, 9 aa, Homo Sapiens
GSALSGPRL

SEQ ID NO: 431683 - protein, 9 aa, Homo Sapiens
DFDWRIGDA

SEQ ID NO: 431684 - protein, 9 aa, Homo Sapiens
ELQPSIICI

SEQ ID NO: 431685 - protein, 9 aa, Homo Sapiens
IQIGDTFHL

SEQ ID NO: 431686 - protein, 9 aa, Homo Sapiens
HLSRHQILH

SEQ ID NO: 431687 - protein, 9 aa, Homo Sapiens
PEPDIYHGI

SEQ ID NO: 431688 - protein, 9 aa, Homo Sapiens
CKLYRLIER

SEQ ID NO: 431689 - protein, 9 aa, Homo Sapiens
GDRNGGANK

SEQ ID NO: 431690 - protein, 9 aa, Homo Sapiens
PLLVTAALQ

SEQ ID NO: 431691 - protein, 9 aa, Homo Sapiens
YNLYGKYMK

SEQ ID NO: 431692 - protein, 9 aa, Homo Sapiens
PGMTRRGLR

SEQ ID NO: 431693 - protein, 9 aa, Homo Sapiens
DQRQLDLVH

SEQ ID NO: 431694 - protein, 9 aa, Homo Sapiens
RHCSLFVYL

SEQ ID NO: 431695 - protein, 9 aa, Homo Sapiens
KQICILNKV

SEQ ID NO: 431696 - protein, 9 aa, Homo Sapiens
LKNLDYRIR

SEQ ID NO: 431697 - protein, 9 aa, Homo Sapiens
RIGLDLPDL

SEQ ID NO: 431698 - protein, 9 aa, Homo Sapiens
RLAQQNLEA

SEQ ID NO: 431699 - protein, 9 aa, Homo Sapiens
YIFNPVLQK

SEQ ID NO: 431700 - protein, 9 aa, Homo Sapiens
RNSLCRQNL

SEQ ID NO: 431701 - protein, 9 aa, Homo Sapiens
TRARCCLLP

SEQ ID NO: 431702 - protein, 9 aa, Homo Sapiens
ISNLNKMND

SEQ ID NO: 431703 - protein, 9 aa, Homo Sapiens
NVNEYSLRD

SEQ ID NO: 431704 - protein, 9 aa, Homo Sapiens
QLRAAYNLV

SEQ ID NO: 431705 - protein, 9 aa, Homo Sapiens
KDYLITPHV

SEQ ID NO: 431706 - protein, 9 aa, Homo Sapiens
QVQWMETVK

SEQ ID NO: 431707 - protein, 9 aa, Homo Sapiens
RKFIISEAH

SEQ ID NO: 431708 - protein, 9 aa, Homo Sapiens
EAICKAFRV

SEQ ID NO: 431709 - protein, 9 aa, Homo Sapiens
HVLLTDSKF

SEQ ID NO: 431710 - protein, 9 aa, Homo Sapiens
STKLSRGDS

SEQ ID NO: 431711 - protein, 9 aa, Homo Sapiens
KIMLLDMAT

SEQ ID NO: 431712 - protein, 9 aa, Homo Sapiens
PALLSKAKE

SEQ ID NO: 431713 - protein, 9 aa, Homo Sapiens
FIGVTELSA

SEQ ID NO: 431714 - protein, 9 aa, Homo Sapiens
TAREDVSIP

SEQ ID NO: 431715 - protein, 9 aa, Homo Sapiens
AVWDLHYQT

SEQ ID NO: 431716 - protein, 9 aa, Homo Sapiens
PHRDMVGEL

SEQ ID NO: 431717 - protein, 9 aa, Homo Sapiens
FEQTLKGHT

SEQ ID NO: 431718 - protein, 9 aa, Homo Sapiens
FLLQCYFVL

SEQ ID NO: 431719 - protein, 9 aa, Homo Sapiens
ELPFFIIFT

SEQ ID NO: 431720 - protein, 9 aa, Homo Sapiens
HFPQHYKSL

SEQ ID NO: 431721 - protein, 9 aa, Homo Sapiens
TNKGTQTEG

SEQ ID NO: 431722 - protein, 9 aa, Homo Sapiens
NVNDNAPEF

SEQ ID NO: 431723 - protein, 9 aa, Homo Sapiens
QVITWFQNW

SEQ ID NO: 431724 - protein, 9 aa, Homo Sapiens
RLLCSKRHR

SEQ ID NO: 431725 - protein, 9 aa, Homo Sapiens
TNLNTHFRS

SEQ ID NO: 431726 - protein, 9 aa, Homo Sapiens
TKKFKMESG

SEQ ID NO: 431727 - protein, 9 aa, Homo Sapiens
PKCIPEFIR

SEQ ID NO: 431728 - protein, 9 aa, Homo Sapiens
KLLPHQPQI

SEQ ID NO: 431729 - protein, 9 aa, Homo Sapiens
AELATVPDQ

SEQ ID NO: 431730 - protein, 9 aa, Homo Sapiens
NTGEKPYEC

SEQ ID NO: 431731 - protein, 9 aa, Homo Sapiens
APIIYFFMC

SEQ ID NO: 431732 - protein, 9 aa, Homo Sapiens
GEKDHMVTM

SEQ ID NO: 431733 - protein, 9 aa, Homo Sapiens
GSVLDCVNL

SEQ ID NO: 431734 - protein, 9 aa, Homo Sapiens
ANKSRQQLQ

SEQ ID NO: 431735 - protein, 9 aa, Homo Sapiens
CQTQMKLMV

SEQ ID NO: 431736 - protein, 9 aa, Homo Sapiens
FCYGNKDLT

SEQ ID NO: 431737 - protein, 9 aa, Homo Sapiens
TKIICKWKK

SEQ ID NO: 431738 - protein, 9 aa, Homo Sapiens
NVPAVRWVG

SEQ ID NO: 431739 - protein, 9 aa, Homo Sapiens
SLETGEIIK

SEQ ID NO: 431740 - protein, 9 aa, Homo Sapiens
ACPLNFGSY

SEQ ID NO: 431741 - protein, 9 aa, Homo Sapiens
YHEHKKYFG

SEQ ID NO: 431742 - protein, 9 aa, Homo Sapiens
RESRQAPTK

SEQ ID NO: 431743 - protein, 9 aa, Homo Sapiens
VVENSVKVQ

SEQ ID NO: 431744 - protein, 9 aa, Homo Sapiens
GVGVFMTAI

SEQ ID NO: 431745 - protein, 9 aa, Homo Sapiens
MTSQYFEDP

SEQ ID NO: 431746 - protein, 9 aa, Homo Sapiens
QLQMASPEE

SEQ ID NO: 431747 - protein, 9 aa, Homo Sapiens
QELCWKYSD

SEQ ID NO: 431748 - protein, 9 aa, Homo Sapiens
EQGYLANMP

SEQ ID NO: 431749 - protein, 9 aa, Homo Sapiens
NYFTLQLPK

SEQ ID NO: 431750 - protein, 9 aa, Homo Sapiens
HPGMPCPGE

SEQ ID NO: 431751 - protein, 9 aa, Homo Sapiens
YICSCVPPC

SEQ ID NO: 431752 - protein, 9 aa, Homo Sapiens
LESFFAWKK

SEQ ID NO: 431753 - protein, 9 aa, Homo Sapiens
QYIKLISET

SEQ ID NO: 431754 - protein, 9 aa, Homo Sapiens
TNRNLSNNC

SEQ ID NO: 431755 - protein, 9 aa, Homo Sapiens
TKLSRGDSL

SEQ ID NO: 431756 - protein, 9 aa, Homo Sapiens
RDLTPLIIS

SEQ ID NO: 431757 - protein, 9 aa, Homo Sapiens
TAKSPKALF

SEQ ID NO: 431758 - protein, 9 aa, Homo Sapiens
LRIKNSKAS

SEQ ID NO: 431759 - protein, 9 aa, Homo Sapiens
ITKNLHYKY

SEQ ID NO: 431760 - protein, 9 aa, Homo Sapiens
NRSIYVDFN

SEQ ID NO: 431761 - protein, 9 aa, Homo Sapiens
YYHPHPKDI

SEQ ID NO: 431762 - protein, 9 aa, Homo Sapiens
AWGRQRAFS

SEQ ID NO: 431763 - protein, 9 aa, Homo Sapiens
YVKEAENLN

SEQ ID NO: 431764 - protein, 9 aa, Homo Sapiens
VRSVDGDQG

SEQ ID NO: 431765 - protein, 9 aa, Homo Sapiens
KIHYYSIKL

SEQ ID NO: 431766 - protein, 9 aa, Homo Sapiens
KQGSCPSLL

SEQ ID NO: 431767 - protein, 9 aa, Homo Sapiens
VEATVVCLF

SEQ ID NO: 431768 - protein, 9 aa, Homo Sapiens
VLSSLHMAA

SEQ ID NO: 431769 - protein, 9 aa, Homo Sapiens
EYLKKVCGK

SEQ ID NO: 431770 - protein, 9 aa, Homo Sapiens
ENLESYKIS

SEQ ID NO: 431771 - protein, 9 aa, Homo Sapiens
HSSANSVVV

SEQ ID NO: 431772 - protein, 9 aa, Homo Sapiens
SQAGVQFGL

SEQ ID NO: 431773 - protein, 9 aa, Homo Sapiens
GSNKTDVEE

SEQ ID NO: 431774 - protein, 9 aa, Homo Sapiens
LLRLESCIR

SEQ ID NO: 431775 - protein, 9 aa, Homo Sapiens
TISVEGCLV

SEQ ID NO: 431776 - protein, 9 aa, Homo Sapiens
TGCYKCLRT

SEQ ID NO: 431777 - protein, 9 aa, Homo Sapiens
TALVKTSDV

SEQ ID NO: 431778 - protein, 9 aa, Homo Sapiens
IFKLHSHGH

SEQ ID NO: 431779 - protein, 9 aa, Homo Sapiens
FVTFRGEPV

SEQ ID NO: 431780 - protein, 9 aa, Homo Sapiens
TAPKKNKNK

SEQ ID NO: 431781 - protein, 9 aa, Homo Sapiens
PRRFLLTGP

SEQ ID NO: 431782 - protein, 9 aa, Homo Sapiens
TPKNVLWRK

SEQ ID NO: 431783 - protein, 9 aa, Homo Sapiens
CLEKCFSTG

SEQ ID NO: 431784 - protein, 9 aa, Homo Sapiens
ASTAASRDK

SEQ ID NO: 431785 - protein, 9 aa, Homo Sapiens
DVTRRKMAY

SEQ ID NO: 431786 - protein, 9 aa, Homo Sapiens
WIQPQSSTP

SEQ ID NO: 431787 - protein, 9 aa, Homo Sapiens
LEIISLDIL

SEQ ID NO: 431788 - protein, 9 aa, Homo Sapiens
TGGVTTGVI

SEQ ID NO: 431789 - protein, 9 aa, Homo Sapiens
ESKEINGIY

SEQ ID NO: 431790 - protein, 9 aa, Homo Sapiens
PKPDKKDDN

SEQ ID NO: 431791 - protein, 9 aa, Homo Sapiens
EGELAIFPI

SEQ ID NO: 431792 - protein, 9 aa, Homo Sapiens
IHSGTLVMI

SEQ ID NO: 431793 - protein, 9 aa, Homo Sapiens
ALAQATRTT

SEQ ID NO: 431794 - protein, 9 aa, Homo Sapiens
IQQEAISCQ

SEQ ID NO: 431795 - protein, 9 aa, Homo Sapiens
PARPRDSLL

SEQ ID NO: 431796 - protein, 9 aa, Homo Sapiens
NHFWTAKYL

SEQ ID NO: 431797 - protein, 9 aa, Homo Sapiens
MVKNIVPRL

SEQ ID NO: 431798 - protein, 9 aa, Homo Sapiens
FDNSPGDLG

SEQ ID NO: 431799 - protein, 9 aa, Homo Sapiens
RPCVDRLWQ

SEQ ID NO: 431800 - protein, 9 aa, Homo Sapiens
KNSIKLFTG

SEQ ID NO: 431801 - protein, 9 aa, Homo Sapiens
IEKRKVELE

SEQ ID NO: 431802 - protein, 9 aa, Homo Sapiens
QHYITKNTA

SEQ ID NO: 431803 - protein, 9 aa, Homo Sapiens
RNNYSKLRS

SEQ ID NO: 431804 - protein, 9 aa, Homo Sapiens
LKKLLMPIK

SEQ ID NO: 431805 - protein, 9 aa, Homo Sapiens
YLWPAYNLT

SEQ ID NO: 431806 - protein, 9 aa, Homo Sapiens
RGNRTTILS

SEQ ID NO: 431807 - protein, 9 aa, Homo Sapiens
ISKLRNTLC

SEQ ID NO: 431808 - protein, 9 aa, Homo Sapiens
FWNWLNTLL

SEQ ID NO: 431809 - protein, 9 aa, Homo Sapiens
HSNSWAEIA

SEQ ID NO: 431810 - protein, 9 aa, Homo Sapiens
SYSIFQELR

SEQ ID NO: 431811 - protein, 9 aa, Homo Sapiens
HKQRRSRTA

SEQ ID NO: 431812 - protein, 9 aa, Homo Sapiens
TQNKMIFKR

SEQ ID NO: 431813 - protein, 9 aa, Homo Sapiens
MYNQKPVGK

SEQ ID NO: 431814 - protein, 9 aa, Homo Sapiens
WPEQGIEDY

SEQ ID NO: 431815 - protein, 9 aa, Homo Sapiens
RKGKPCAVG

SEQ ID NO: 431816 - protein, 9 aa, Homo Sapiens
QKVCNKTLW

SEQ ID NO: 431817 - protein, 9 aa, Homo Sapiens
GINSLRITA

SEQ ID NO: 431818 - protein, 9 aa, Homo Sapiens
VHLERDINK

SEQ ID NO: 431819 - protein, 9 aa, Homo Sapiens
PKCIEDVGS

SEQ ID NO: 431820 - protein, 9 aa, Homo Sapiens
DTSNFCHPN

SEQ ID NO: 431821 - protein, 9 aa, Homo Sapiens
TSLCCLLDP

SEQ ID NO: 431822 - protein, 9 aa, Homo Sapiens
CIGFLPYEA

SEQ ID NO: 431823 - protein, 9 aa, Homo Sapiens
GPITFPAGV

SEQ ID NO: 431824 - protein, 9 aa, Homo Sapiens
MRYNLPAGT

SEQ ID NO: 431825 - protein, 9 aa, Homo Sapiens
HRYDEGNVF

SEQ ID NO: 431826 - protein, 9 aa, Homo Sapiens
KTFVLCSVL

SEQ ID NO: 431827 - protein, 9 aa, Homo Sapiens
INSGEKCYK

SEQ ID NO: 431828 - protein, 9 aa, Homo Sapiens
LVNNKYGTA

SEQ ID NO: 431829 - protein, 9 aa, Homo Sapiens
SSTDILKPF

SEQ ID NO: 431830 - protein, 9 aa, Homo Sapiens
KVSPYFKSN

SEQ ID NO: 431831 - protein, 9 aa, Homo Sapiens
YGEFRNNKA

SEQ ID NO: 431832 - protein, 9 aa, Homo Sapiens
ARALGNLVM

SEQ ID NO: 431833 - protein, 9 aa, Homo Sapiens
RALGWAVGA

SEQ ID NO: 431834 - protein, 9 aa, Homo Sapiens
QPGDLYNED

SEQ ID NO: 431835 - protein, 9 aa, Homo Sapiens
FTKIYRGCH

SEQ ID NO: 431836 - protein, 9 aa, Homo Sapiens
FLKSLEECM

SEQ ID NO: 431837 - protein, 9 aa, Homo Sapiens
GLFPSTTTK

SEQ ID NO: 431838 - protein, 9 aa, Homo Sapiens
FEQTRVCFS

SEQ ID NO: 431839 - protein, 9 aa, Homo Sapiens
RAQSQDKQI

SEQ ID NO: 431840 - protein, 9 aa, Homo Sapiens
LKATPFGGA

SEQ ID NO: 431841 - protein, 9 aa, Homo Sapiens
TRYSSTKIV

SEQ ID NO: 431842 - protein, 9 aa, Homo Sapiens
PVRWMAPEP

SEQ ID NO: 431843 - protein, 9 aa, Homo Sapiens
KGYTLLLGT

SEQ ID NO: 431844 - protein, 9 aa, Homo Sapiens
THLDKSCKY

SEQ ID NO: 431845 - protein, 9 aa, Homo Sapiens
HREYKDHLS

SEQ ID NO: 431846 - protein, 9 aa, Homo Sapiens
IGRHALDEV

SEQ ID NO: 431847 - protein, 9 aa, Homo Sapiens
LFFLLSPLE

SEQ ID NO: 431848 - protein, 9 aa, Homo Sapiens
IFFPAECGN

SEQ ID NO: 431849 - protein, 9 aa, Homo Sapiens
NEWQRLARL

SEQ ID NO: 431850 - protein, 9 aa, Homo Sapiens
HALSDKNMC

SEQ ID NO: 431851 - protein, 9 aa, Homo Sapiens
TDPSHSLLL

SEQ ID NO: 431852 - protein, 9 aa, Homo Sapiens
IGPVSSSRC

SEQ ID NO: 431853 - protein, 9 aa, Homo Sapiens
IEDIGNKKK

SEQ ID NO: 431854 - protein, 9 aa, Homo Sapiens
KGTYGKVET

SEQ ID NO: 431855 - protein, 9 aa, Homo Sapiens
TTGVIRHVG

SEQ ID NO: 431856 - protein, 9 aa, Homo Sapiens
HIRDGICHG

SEQ ID NO: 431857 - protein, 9 aa, Homo Sapiens
LMQKEAIDK

SEQ ID NO: 431858 - protein, 9 aa, Homo Sapiens
FGWSTNLNK

SEQ ID NO: 431859 - protein, 9 aa, Homo Sapiens
ELKQHVDSL

SEQ ID NO: 431860 - protein, 9 aa, Homo Sapiens
LFEVYEKIK

SEQ ID NO: 431861 - protein, 9 aa, Homo Sapiens
MSELEKARE

SEQ ID NO: 431862 - protein, 9 aa, Homo Sapiens
LIYISTTQI

SEQ ID NO: 431863 - protein, 9 aa, Homo Sapiens
PDLFGDTPK

SEQ ID NO: 431864 - protein, 9 aa, Homo Sapiens
STWYDGEFL

SEQ ID NO: 431865 - protein, 9 aa, Homo Sapiens
NKYFNAGHS

SEQ ID NO: 431866 - protein, 9 aa, Homo Sapiens
DNNFLLYNQ

SEQ ID NO: 431867 - protein, 9 aa, Homo Sapiens
MELPEQQVG

SEQ ID NO: 431868 - protein, 9 aa, Homo Sapiens
FEKLFEVYE

SEQ ID NO: 431869 - protein, 9 aa, Homo Sapiens
GLYNVDALR

SEQ ID NO: 431870 - protein, 9 aa, Homo Sapiens
VEDADEGTL

SEQ ID NO: 431871 - protein, 9 aa, Homo Sapiens
EPIDSHSRR

SEQ ID NO: 431872 - protein, 9 aa, Homo Sapiens
LIIHLPFCG

SEQ ID NO: 431873 - protein, 9 aa, Homo Sapiens
EEAILSVFR

SEQ ID NO: 431874 - protein, 9 aa, Homo Sapiens
TQVQRKRDK

SEQ ID NO: 431875 - protein, 9 aa, Homo Sapiens
NSSQNSLDN

SEQ ID NO: 431876 - protein, 9 aa, Homo Sapiens
DAPIPRINV

SEQ ID NO: 431877 - protein, 9 aa, Homo Sapiens
RKKSGWGQR

SEQ ID NO: 431878 - protein, 9 aa, Homo Sapiens
YLHVEDDSR

SEQ ID NO: 431879 - protein, 9 aa, Homo Sapiens
EEAFRHKQI

SEQ ID NO: 431880 - protein, 9 aa, Homo Sapiens
NFISGRPIS

SEQ ID NO: 431881 - protein, 9 aa, Homo Sapiens
QPISCEPLI

SEQ ID NO: 431882 - protein, 9 aa, Homo Sapiens
HKFVDKPGP

SEQ ID NO: 431883 - protein, 9 aa, Homo Sapiens
LGACQISNG

SEQ ID NO: 431884 - protein, 9 aa, Homo Sapiens
NSGTVDWTV

SEQ ID NO: 431885 - protein, 9 aa, Homo Sapiens
QINDAHHGG

SEQ ID NO: 431886 - protein, 9 aa, Homo Sapiens
IKLTVEDFA

SEQ ID NO: 431887 - protein, 9 aa, Homo Sapiens
TRKQICILN

SEQ ID NO: 431888 - protein, 9 aa, Homo Sapiens
PNQFQCKLI

SEQ ID NO: 431889 - protein, 9 aa, Homo Sapiens
VKTVPGASN

SEQ ID NO: 431890 - protein, 9 aa, Homo Sapiens
ITCNPPEER

SEQ ID NO: 431891 - protein, 9 aa, Homo Sapiens
VQGMSLPIW

SEQ ID NO: 431892 - protein, 9 aa, Homo Sapiens
VIFLLCMNL

SEQ ID NO: 431893 - protein, 9 aa, Homo Sapiens
NARSCIQAY

SEQ ID NO: 431894 - protein, 9 aa, Homo Sapiens
KITQQEYYE

SEQ ID NO: 431895 - protein, 9 aa, Homo Sapiens
GNNFIRAFR

SEQ ID NO: 431896 - protein, 9 aa, Homo Sapiens
NLRDMHMQI

SEQ ID NO: 431897 - protein, 9 aa, Homo Sapiens
VTLFTVNEF

SEQ ID NO: 431898 - protein, 9 aa, Homo Sapiens
GSSTFHRMY

SEQ ID NO: 431899 - protein, 9 aa, Homo Sapiens
KTRRKEMTH

SEQ ID NO: 431900 - protein, 9 aa, Homo Sapiens
ENYNEAECV

SEQ ID NO: 431901 - protein, 9 aa, Homo Sapiens
VINFSLNLT

SEQ ID NO: 431902 - protein, 9 aa, Homo Sapiens
DFPKDKETH

SEQ ID NO: 431903 - protein, 9 aa, Homo Sapiens
VQHKQFLRL

SEQ ID NO: 431904 - protein, 9 aa, Homo Sapiens
PRRRCSHTE

SEQ ID NO: 431905 - protein, 9 aa, Homo Sapiens
SLIELIKLK

SEQ ID NO: 431906 - protein, 9 aa, Homo Sapiens
PWFVGYKIT

SEQ ID NO: 431907 - protein, 9 aa, Homo Sapiens
LCNCTFFLC

SEQ ID NO: 431908 - protein, 9 aa, Homo Sapiens
DSGGSTTVD

SEQ ID NO: 431909 - protein, 9 aa, Homo Sapiens
LKTQHMNND

SEQ ID NO: 431910 - protein, 9 aa, Homo Sapiens
LRARIRNVG

SEQ ID NO: 431911 - protein, 9 aa, Homo Sapiens
ESWREMCLR

SEQ ID NO: 431912 - protein, 9 aa, Homo Sapiens
YNEQSKFVC

SEQ ID NO: 431913 - protein, 9 aa, Homo Sapiens
IICKWKKAD

SEQ ID NO: 431914 - protein, 9 aa, Homo Sapiens
LEAKGVNSQ

SEQ ID NO: 431915 - protein, 9 aa, Homo Sapiens
LNYRDGNSL

SEQ ID NO: 431916 - protein, 9 aa, Homo Sapiens
GVMGEKDHM

SEQ ID NO: 431917 - protein, 9 aa, Homo Sapiens
GWHKLLIEE

SEQ ID NO: 431918 - protein, 9 aa, Homo Sapiens
TARTALLTC

SEQ ID NO: 431919 - protein, 9 aa, Homo Sapiens
KRRKQLLLD

SEQ ID NO: 431920 - protein, 9 aa, Homo Sapiens
VCEGSAIAI

SEQ ID NO: 431921 - protein, 9 aa, Homo Sapiens
TINDYTCTC

SEQ ID NO: 431922 - protein, 9 aa, Homo Sapiens
VSQNRLFNL

SEQ ID NO: 431923 - protein, 9 aa, Homo Sapiens
SRSSAMCHS

SEQ ID NO: 431924 - protein, 9 aa, Homo Sapiens
VCIAMEVLD

SEQ ID NO: 431925 - protein, 9 aa, Homo Sapiens
PPTVLLGHY

SEQ ID NO: 431926 - protein, 9 aa, Homo Sapiens
RLIKLLHLG

SEQ ID NO: 431927 - protein, 9 aa, Homo Sapiens
NLKELIERV

SEQ ID NO: 431928 - protein, 9 aa, Homo Sapiens
DARSQNIKG

SEQ ID NO: 431929 - protein, 9 aa, Homo Sapiens
IQVVLIIHL

SEQ ID NO: 431930 - protein, 9 aa, Homo Sapiens
VEYAWEPHH

SEQ ID NO: 431931 - protein, 9 aa, Homo Sapiens
EVAKVQDYD

SEQ ID NO: 431932 - protein, 9 aa, Homo Sapiens
GASNLFYWP

SEQ ID NO: 431933 - protein, 9 aa, Homo Sapiens
VVGFWVGGS

SEQ ID NO: 431934 - protein, 9 aa, Homo Sapiens
DGHHYRCVA

SEQ ID NO: 431935 - protein, 9 aa, Homo Sapiens
LIKDTWYQV

SEQ ID NO: 431936 - protein, 9 aa, Homo Sapiens
AKYLTEEIR

SEQ ID NO: 431937 - protein, 9 aa, Homo Sapiens
NKLGILGSH

SEQ ID NO: 431938 - protein, 9 aa, Homo Sapiens
WLNEYKEQF

SEQ ID NO: 431939 - protein, 9 aa, Homo Sapiens
LSCPYHHGN

SEQ ID NO: 431940 - protein, 9 aa, Homo Sapiens
INSRLRDYR

SEQ ID NO: 431941 - protein, 9 aa, Homo Sapiens
ETVSVLQAR

SEQ ID NO: 431942 - protein, 9 aa, Homo Sapiens
NDLPRAVPL

SEQ ID NO: 431943 - protein, 9 aa, Homo Sapiens
PHAHMHHHH

SEQ ID NO: 431944 - protein, 9 aa, Homo Sapiens
ASVLILVVP

SEQ ID NO: 431945 - protein, 9 aa, Homo Sapiens
KENAMRLSI

SEQ ID NO: 431946 - protein, 9 aa, Homo Sapiens
RNMRKVCGP

SEQ ID NO: 431947 - protein, 9 aa, Homo Sapiens
PEFTAMTLY

SEQ ID NO: 431948 - protein, 9 aa, Homo Sapiens
QETVQVLQI

SEQ ID NO: 431949 - protein, 9 aa, Homo Sapiens
TLAGLGDCN

SEQ ID NO: 431950 - protein, 9 aa, Homo Sapiens
IDKQMCTNK

SEQ ID NO: 431951 - protein, 9 aa, Homo Sapiens
GIINKEGYL

SEQ ID NO: 431952 - protein, 9 aa, Homo Sapiens
NETWGDPGV

SEQ ID NO: 431953 - protein, 9 aa, Homo Sapiens
QEDMSTNPA

SEQ ID NO: 431954 - protein, 9 aa, Homo Sapiens
GQSGASLMT

SEQ ID NO: 431955 - protein, 9 aa, Homo Sapiens
TNLELQALT

SEQ ID NO: 431956 - protein, 9 aa, Homo Sapiens
QKSSITNHH

SEQ ID NO: 431957 - protein, 9 aa, Homo Sapiens
KELFTCPTP

SEQ ID NO: 431958 - protein, 9 aa, Homo Sapiens
AARQTKRIQ

SEQ ID NO: 431959 - protein, 9 aa, Homo Sapiens
KQEKHQDVL

SEQ ID NO: 431960 - protein, 9 aa, Homo Sapiens
EGCCHPITC

SEQ ID NO: 431961 - protein, 9 aa, Homo Sapiens
TLPKNFHSP

SEQ ID NO: 431962 - protein, 9 aa, Homo Sapiens
RLLEFCLVF

SEQ ID NO: 431963 - protein, 9 aa, Homo Sapiens
FQFGAYLIV

SEQ ID NO: 431964 - protein, 9 aa, Homo Sapiens
CLNEIQGES

SEQ ID NO: 431965 - protein, 9 aa, Homo Sapiens
INFLELGDS

SEQ ID NO: 431966 - protein, 9 aa, Homo Sapiens
IYPVTNLQK

SEQ ID NO: 431967 - protein, 9 aa, Homo Sapiens
RHKQINPMD

SEQ ID NO: 431968 - protein, 9 aa, Homo Sapiens
LNNSKCLLF

SEQ ID NO: 431969 - protein, 9 aa, Homo Sapiens
KANIVLLSG

SEQ ID NO: 431970 - protein, 9 aa, Homo Sapiens
RYVEPLKLY

SEQ ID NO: 431971 - protein, 9 aa, Homo Sapiens
LSDQLSLGS

SEQ ID NO: 431972 - protein, 9 aa, Homo Sapiens
EFSKQVNRI

SEQ ID NO: 431973 - protein, 9 aa, Homo Sapiens
AISWLPYTV

SEQ ID NO: 431974 - protein, 9 aa, Homo Sapiens
PYSVHSFSD

SEQ ID NO: 431975 - protein, 9 aa, Homo Sapiens
TMDTGKPIL

SEQ ID NO: 431976 - protein, 9 aa, Homo Sapiens
RKVQFKISS

SEQ ID NO: 431977 - protein, 9 aa, Homo Sapiens
IKNQFGLSL

SEQ ID NO: 431978 - protein, 9 aa, Homo Sapiens
LSHGAVDVR

SEQ ID NO: 431979 - protein, 9 aa, Homo Sapiens
DTASHSLCE

SEQ ID NO: 431980 - protein, 9 aa, Homo Sapiens
LAERLVRVG

SEQ ID NO: 431981 - protein, 9 aa, Homo Sapiens
QHQIFHTGE

SEQ ID NO: 431982 - protein, 9 aa, Homo Sapiens
QADPPQAEH

SEQ ID NO: 431983 - protein, 9 aa, Homo Sapiens
ERHRPDSVS

SEQ ID NO: 431984 - protein, 9 aa, Homo Sapiens
PLEALDGDT

SEQ ID NO: 431985 - protein, 9 aa, Homo Sapiens
QYAVILAFN

SEQ ID NO: 431986 - protein, 9 aa, Homo Sapiens
SCSPTLQIH

SEQ ID NO: 431987 - protein, 9 aa, Homo Sapiens
PGVVSKVFN

SEQ ID NO: 431988 - protein, 9 aa, Homo Sapiens
SPKEHNKEE

SEQ ID NO: 431989 - protein, 9 aa, Homo Sapiens
LREPKSKRG

SEQ ID NO: 431990 - protein, 9 aa, Homo Sapiens
SLDACKGDS

SEQ ID NO: 431991 - protein, 9 aa, Homo Sapiens
ISSATQLRQ

SEQ ID NO: 431992 - protein, 9 aa, Homo Sapiens
EEVMLTLTP

SEQ ID NO: 431993 - protein, 9 aa, Homo Sapiens
EIDNATLAA

SEQ ID NO: 431994 - protein, 9 aa, Homo Sapiens
EVFKIYGVD

SEQ ID NO: 431995 - protein, 9 aa, Homo Sapiens
VLKNCSEGT

SEQ ID NO: 431996 - protein, 9 aa, Homo Sapiens
GLPNMLGMG

SEQ ID NO: 431997 - protein, 9 aa, Homo Sapiens
ASLMTGPMV

SEQ ID NO: 431998 - protein, 9 aa, Homo Sapiens
FLLLVVALY

SEQ ID NO: 431999 - protein, 9 aa, Homo Sapiens
KSAIQYIRI

SEQ ID NO: 432000 - protein, 9 aa, Homo Sapiens
HPPRLWCPH

SEQ ID NO: 432001 - protein, 9 aa, Homo Sapiens
LERDINKFP

SEQ ID NO: 432002 - protein, 9 aa, Homo Sapiens
KEDYLGILF

SEQ ID NO: 432003 - protein, 9 aa, Homo Sapiens
GFGFSSCRS

SEQ ID NO: 432004 - protein, 9 aa, Homo Sapiens
LQKQILKIL

SEQ ID NO: 432005 - protein, 9 aa, Homo Sapiens
RGWKINPTK

SEQ ID NO: 432006 - protein, 9 aa, Homo Sapiens
AIADYVRNI

SEQ ID NO: 432007 - protein, 9 aa, Homo Sapiens
ECNNCVKAF

SEQ ID NO: 432008 - protein, 9 aa, Homo Sapiens
YDIVLDSKL

SEQ ID NO: 432009 - protein, 9 aa, Homo Sapiens
GYLANMPNL

SEQ ID NO: 432010 - protein, 9 aa, Homo Sapiens
AGTELVNLL

SEQ ID NO: 432011 - protein, 9 aa, Homo Sapiens
QLFCVGCGC

SEQ ID NO: 432012 - protein, 9 aa, Homo Sapiens
FKIIGVKSQ

SEQ ID NO: 432013 - protein, 9 aa, Homo Sapiens
NERKLELVA

SEQ ID NO: 432014 - protein, 9 aa, Homo Sapiens
FQAEGKICE

SEQ ID NO: 432015 - protein, 9 aa, Homo Sapiens
KPSDSSDLK

SEQ ID NO: 432016 - protein, 9 aa, Homo Sapiens
ERLRVWDIN

SEQ ID NO: 432017 - protein, 9 aa, Homo Sapiens
LFASSALNL

SEQ ID NO: 432018 - protein, 9 aa, Homo Sapiens
FFKQTVQNN

SEQ ID NO: 432019 - protein, 9 aa, Homo Sapiens
SEENADDNI

SEQ ID NO: 432020 - protein, 9 aa, Homo Sapiens
FGLFGRAFN

SEQ ID NO: 432021 - protein, 9 aa, Homo Sapiens
NESLTLPRR

SEQ ID NO: 432022 - protein, 9 aa, Homo Sapiens
DGEPWLIIN

SEQ ID NO: 432023 - protein, 9 aa, Homo Sapiens
SPKHNNTSH

SEQ ID NO: 432024 - protein, 9 aa, Homo Sapiens
VVTIPRAYH

SEQ ID NO: 432025 - protein, 9 aa, Homo Sapiens
GWALASASV

SEQ ID NO: 432026 - protein, 9 aa, Homo Sapiens
KRHHTHVNV

SEQ ID NO: 432027 - protein, 9 aa, Homo Sapiens
FLTSVSTVL

SEQ ID NO: 432028 - protein, 9 aa, Homo Sapiens
SSSLSRQTR

SEQ ID NO: 432029 - protein, 9 aa, Homo Sapiens
QQNACAEVI

SEQ ID NO: 432030 - protein, 9 aa, Homo Sapiens
EIVLFAHNE

SEQ ID NO: 432031 - protein, 9 aa, Homo Sapiens
YDFLCEVPS

SEQ ID NO: 432032 - protein, 9 aa, Homo Sapiens
ICDIPGTLN

SEQ ID NO: 432033 - protein, 9 aa, Homo Sapiens
SPGIDTPFS

SEQ ID NO: 432034 - protein, 9 aa, Homo Sapiens
WSSTLVQHR

SEQ ID NO: 432035 - protein, 9 aa, Homo Sapiens
QVHSENPEW

SEQ ID NO: 432036 - protein, 9 aa, Homo Sapiens
IQRQLNLSN

SEQ ID NO: 432037 - protein, 9 aa, Homo Sapiens
VQDYDRRAD

SEQ ID NO: 432038 - protein, 9 aa, Homo Sapiens
GIIIRKWNG

SEQ ID NO: 432039 - protein, 9 aa, Homo Sapiens
SHKDSLVQH

SEQ ID NO: 432040 - protein, 9 aa, Homo Sapiens
QDDKNQSIF

SEQ ID NO: 432041 - protein, 9 aa, Homo Sapiens
PFIVYLAYA

SEQ ID NO: 432042 - protein, 9 aa, Homo Sapiens
PASVSYLID

SEQ ID NO: 432043 - protein, 9 aa, Homo Sapiens
ELYKFCSLP

SEQ ID NO: 432044 - protein, 9 aa, Homo Sapiens
GIFKALPTC

SEQ ID NO: 432045 - protein, 9 aa, Homo Sapiens
LDSWSHDPS

SEQ ID NO: 432046 - protein, 9 aa, Homo Sapiens
ANPSHYRME

SEQ ID NO: 432047 - protein, 9 aa, Homo Sapiens
GIYKVEIYT

SEQ ID NO: 432048 - protein, 9 aa, Homo Sapiens
RYPSPPLPT

SEQ ID NO: 432049 - protein, 9 aa, Homo Sapiens
EYSLRDQLL

SEQ ID NO: 432050 - protein, 9 aa, Homo Sapiens
SSRGPFRLH

SEQ ID NO: 432051 - protein, 9 aa, Homo Sapiens
NTFKAVCNS

SEQ ID NO: 432052 - protein, 9 aa, Homo Sapiens
VSQCPTAGN

SEQ ID NO: 432053 - protein, 9 aa, Homo Sapiens
CLCETVFQP

SEQ ID NO: 432054 - protein, 9 aa, Homo Sapiens
EELLLINER

SEQ ID NO: 432055 - protein, 9 aa, Homo Sapiens
QMVRTDPLW

SEQ ID NO: 432056 - protein, 9 aa, Homo Sapiens
KQDNGMESA

SEQ ID NO: 432057 - protein, 9 aa, Homo Sapiens
DFELPIIIV

SEQ ID NO: 432058 - protein, 9 aa, Homo Sapiens
KNNSGALEK

SEQ ID NO: 432059 - protein, 9 aa, Homo Sapiens
ADHCPAEEL

SEQ ID NO: 432060 - protein, 9 aa, Homo Sapiens
VRGSLNVHN

SEQ ID NO: 432061 - protein, 9 aa, Homo Sapiens
VKKKAKPNK

SEQ ID NO: 432062 - protein, 9 aa, Homo Sapiens
VQTLYLSYL

SEQ ID NO: 432063 - protein, 9 aa, Homo Sapiens
DQFRMRGNN

SEQ ID NO: 432064 - protein, 9 aa, Homo Sapiens
VNINLSMNR

SEQ ID NO: 432065 - protein, 9 aa, Homo Sapiens
NVEATVVCL

SEQ ID NO: 432066 - protein, 9 aa, Homo Sapiens
SSQTYVFQY

SEQ ID NO: 432067 - protein, 9 aa, Homo Sapiens
GGKINLKVA

SEQ ID NO: 432068 - protein, 9 aa, Homo Sapiens
TVQVCNRFN

SEQ ID NO: 432069 - protein, 9 aa, Homo Sapiens
LAVFMKEEK

SEQ ID NO: 432070 - protein, 9 aa, Homo Sapiens
RKGSAMLFP

SEQ ID NO: 432071 - protein, 9 aa, Homo Sapiens
SPTMLPQLE

SEQ ID NO: 432072 - protein, 9 aa, Homo Sapiens
HKNIHTGER

SEQ ID NO: 432073 - protein, 9 aa, Homo Sapiens
RAIPELDVY

SEQ ID NO: 432074 - protein, 9 aa, Homo Sapiens
RMASHKIEI

SEQ ID NO: 432075 - protein, 9 aa, Homo Sapiens
TDKNDDGKL

SEQ ID NO: 432076 - protein, 9 aa, Homo Sapiens
HLWDVARAK

SEQ ID NO: 432077 - protein, 9 aa, Homo Sapiens
LDYRLIDDH

SEQ ID NO: 432078 - protein, 9 aa, Homo Sapiens
ISKPQEENN

SEQ ID NO: 432079 - protein, 9 aa, Homo Sapiens
ENTGRQKYK

SEQ ID NO: 432080 - protein, 9 aa, Homo Sapiens
EGRNEMAAR

SEQ ID NO: 432081 - protein, 9 aa, Homo Sapiens
QVLDIDLHV

SEQ ID NO: 432082 - protein, 9 aa, Homo Sapiens
CDLKPESAL

SEQ ID NO: 432083 - protein, 9 aa, Homo Sapiens
SYKEITHSV

SEQ ID NO: 432084 - protein, 9 aa, Homo Sapiens
SYLSIDSED

SEQ ID NO: 432085 - protein, 9 aa, Homo Sapiens
LQKHGKNVP

SEQ ID NO: 432086 - protein, 9 aa, Homo Sapiens
SHSSLQKHV

SEQ ID NO: 432087 - protein, 9 aa, Homo Sapiens
MESGGGAED

SEQ ID NO: 432088 - protein, 9 aa, Homo Sapiens
HIAVKVPPL

SEQ ID NO: 432089 - protein, 9 aa, Homo Sapiens
AEEAELYDP

SEQ ID NO: 432090 - protein, 9 aa, Homo Sapiens
VHNFLPRFN

SEQ ID NO: 432091 - protein, 9 aa, Homo Sapiens
HTHSPEVAE

SEQ ID NO: 432092 - protein, 9 aa, Homo Sapiens
TSMDASSSK

SEQ ID NO: 432093 - protein, 9 aa, Homo Sapiens
DVFMSEMKS

SEQ ID NO: 432094 - protein, 9 aa, Homo Sapiens
ERLLCSKRH

SEQ ID NO: 432095 - protein, 9 aa, Homo Sapiens
CGFCLRPHA

SEQ ID NO: 432096 - protein, 9 aa, Homo Sapiens
DDTKDNLDP

SEQ ID NO: 432097 - protein, 9 aa, Homo Sapiens
CEFKATMCN

SEQ ID NO: 432098 - protein, 9 aa, Homo Sapiens
YASLSNHHR

SEQ ID NO: 432099 - protein, 9 aa, Homo Sapiens
YLHTAIVIT

SEQ ID NO: 432100 - protein, 9 aa, Homo Sapiens
FQNAYLLNS

SEQ ID NO: 432101 - protein, 9 aa, Homo Sapiens
KNFFTDVYY

SEQ ID NO: 432102 - protein, 9 aa, Homo Sapiens
MRLHFPIKP

SEQ ID NO: 432103 - protein, 9 aa, Homo Sapiens
EIYKFMALV

SEQ ID NO: 432104 - protein, 9 aa, Homo Sapiens
DILIQSGDI

SEQ ID NO: 432105 - protein, 9 aa, Homo Sapiens
KIKTIKICK

SEQ ID NO: 432106 - protein, 9 aa, Homo Sapiens
KLLDWHANT

SEQ ID NO: 432107 - protein, 9 aa, Homo Sapiens
FEQLHNKCL

SEQ ID NO: 432108 - protein, 9 aa, Homo Sapiens
LANAREINN

SEQ ID NO: 432109 - protein, 9 aa, Homo Sapiens
LSQEEWKCL

SEQ ID NO: 432110 - protein, 9 aa, Homo Sapiens
TDQNDNKPK

SEQ ID NO: 432111 - protein, 9 aa, Homo Sapiens
LYRVYKEVN

SEQ ID NO: 432112 - protein, 9 aa, Homo Sapiens
ESEKVSDDL

SEQ ID NO: 432113 - protein, 9 aa, Homo Sapiens
YGLPGIPGP

SEQ ID NO: 432114 - protein, 9 aa, Homo Sapiens
PKNTEPTTC

SEQ ID NO: 432115 - protein, 9 aa, Homo Sapiens
LAAFHNFIK

SEQ ID NO: 432116 - protein, 9 aa, Homo Sapiens
QQDCQKPNY

SEQ ID NO: 432117 - protein, 9 aa, Homo Sapiens
PHHAQGKSL

SEQ ID NO: 432118 - protein, 9 aa, Homo Sapiens
HKFVYIYDA

SEQ ID NO: 432119 - protein, 9 aa, Homo Sapiens
LWKLLDWHA

SEQ ID NO: 432120 - protein, 9 aa, Homo Sapiens
YTPLFFTRV

SEQ ID NO: 432121 - protein, 9 aa, Homo Sapiens
VLRCVNNYQ

SEQ ID NO: 432122 - protein, 9 aa, Homo Sapiens
DVYGKSLSE

SEQ ID NO: 432123 - protein, 9 aa, Homo Sapiens
NGGANKKNF

SEQ ID NO: 432124 - protein, 9 aa, Homo Sapiens
VIDRAEKME

SEQ ID NO: 432125 - protein, 9 aa, Homo Sapiens
LMVKKNYVV

SEQ ID NO: 432126 - protein, 9 aa, Homo Sapiens
WTPQRVAQG

SEQ ID NO: 432127 - protein, 9 aa, Homo Sapiens
RTQIRQSRL

SEQ ID NO: 432128 - protein, 9 aa, Homo Sapiens
QTNKNWVQS

SEQ ID NO: 432129 - protein, 9 aa, Homo Sapiens
LSSYLIQHQ

SEQ ID NO: 432130 - protein, 9 aa, Homo Sapiens
EVHKRNDGR

SEQ ID NO: 432131 - protein, 9 aa, Homo Sapiens
LNIVLAKNR

SEQ ID NO: 432132 - protein, 9 aa, Homo Sapiens
CIFLSFKSL

SEQ ID NO: 432133 - protein, 9 aa, Homo Sapiens
IVVAVFLVS

SEQ ID NO: 432134 - protein, 9 aa, Homo Sapiens
PGVNKSPMM

SEQ ID NO: 432135 - protein, 9 aa, Homo Sapiens
ISVKMHIKY

SEQ ID NO: 432136 - protein, 9 aa, Homo Sapiens
FGLSLQSHL

SEQ ID NO: 432137 - protein, 9 aa, Homo Sapiens
QHKQFLRLL

SEQ ID NO: 432138 - protein, 9 aa, Homo Sapiens
RVRELSALV

SEQ ID NO: 432139 - protein, 9 aa, Homo Sapiens
LMQGLREAA

SEQ ID NO: 432140 - protein, 9 aa, Homo Sapiens
TGWFCGGLI

SEQ ID NO: 432141 - protein, 9 aa, Homo Sapiens
ATSANERKI

SEQ ID NO: 432142 - protein, 9 aa, Homo Sapiens
DYFSSGTSS

SEQ ID NO: 432143 - protein, 9 aa, Homo Sapiens
AVNQARRQN

SEQ ID NO: 432144 - protein, 9 aa, Homo Sapiens
MSPGLPSSL

SEQ ID NO: 432145 - protein, 9 aa, Homo Sapiens
VSDLCYSND

SEQ ID NO: 432146 - protein, 9 aa, Homo Sapiens
PLMQGLREA

SEQ ID NO: 432147 - protein, 9 aa, Homo Sapiens
QTSKHHPFF

SEQ ID NO: 432148 - protein, 9 aa, Homo Sapiens
QIVDVNLTS

SEQ ID NO: 432149 - protein, 9 aa, Homo Sapiens
HQKTALTLH

SEQ ID NO: 432150 - protein, 9 aa, Homo Sapiens
GVIRHMRLH

SEQ ID NO: 432151 - protein, 9 aa, Homo Sapiens
EKQDIAAYY

SEQ ID NO: 432152 - protein, 9 aa, Homo Sapiens
STDNASKRH

SEQ ID NO: 432153 - protein, 9 aa, Homo Sapiens
MKEKTKTKK

SEQ ID NO: 432154 - protein, 9 aa, Homo Sapiens
YASNNVPNM

SEQ ID NO: 432155 - protein, 9 aa, Homo Sapiens
MVQAVGGAP

SEQ ID NO: 432156 - protein, 9 aa, Homo Sapiens
KVEVEDLKY

SEQ ID NO: 432157 - protein, 9 aa, Homo Sapiens
NSNILKTIK

SEQ ID NO: 432158 - protein, 9 aa, Homo Sapiens
AIDDSAKQE

SEQ ID NO: 432159 - protein, 9 aa, Homo Sapiens
LQLAPELKF

SEQ ID NO: 432160 - protein, 9 aa, Homo Sapiens
QWISNHYLD

SEQ ID NO: 432161 - protein, 9 aa, Homo Sapiens
TELSLQQLV

SEQ ID NO: 432162 - protein, 9 aa, Homo Sapiens
CTCELGKFV

SEQ ID NO: 432163 - protein, 9 aa, Homo Sapiens
IPPQIPQRD

SEQ ID NO: 432164 - protein, 9 aa, Homo Sapiens
PDYVGDGLS

SEQ ID NO: 432165 - protein, 9 aa, Homo Sapiens
KELINLQPL

SEQ ID NO: 432166 - protein, 9 aa, Homo Sapiens
VSYLKTQKA

SEQ ID NO: 432167 - protein, 9 aa, Homo Sapiens
EIFIQLFIT

SEQ ID NO: 432168 - protein, 9 aa, Homo Sapiens
KLEKSGFSS

SEQ ID NO: 432169 - protein, 9 aa, Homo Sapiens
LVHQSKIFA

SEQ ID NO: 432170 - protein, 9 aa, Homo Sapiens
NERKIINVK

SEQ ID NO: 432171 - protein, 9 aa, Homo Sapiens
HDGKGIYLQ

SEQ ID NO: 432172 - protein, 9 aa, Homo Sapiens
KLYDPPPKK

SEQ ID NO: 432173 - protein, 9 aa, Homo Sapiens
EYSSTQNQG

SEQ ID NO: 432174 - protein, 9 aa, Homo Sapiens
NTNEMYSGK

SEQ ID NO: 432175 - protein, 9 aa, Homo Sapiens
LQIPMYLLL

SEQ ID NO: 432176 - protein, 9 aa, Homo Sapiens
AARGHHSSA

SEQ ID NO: 432177 - protein, 9 aa, Homo Sapiens
LEELKEKAK

SEQ ID NO: 432178 - protein, 9 aa, Homo Sapiens
NIQIWLADG

SEQ ID NO: 432179 - protein, 9 aa, Homo Sapiens
PSTTYVHVQ

SEQ ID NO: 432180 - protein, 9 aa, Homo Sapiens
SEHLIKIYD

SEQ ID NO: 432181 - protein, 9 aa, Homo Sapiens
TSYLGGTDK

SEQ ID NO: 432182 - protein, 9 aa, Homo Sapiens
SKLPDKFGT

SEQ ID NO: 432183 - protein, 9 aa, Homo Sapiens
ERPDFREKV

SEQ ID NO: 432184 - protein, 9 aa, Homo Sapiens
KDDEFRNNF

SEQ ID NO: 432185 - protein, 9 aa, Homo Sapiens
LPASLQPHK

SEQ ID NO: 432186 - protein, 9 aa, Homo Sapiens
KSQLEASHQ

SEQ ID NO: 432187 - protein, 9 aa, Homo Sapiens
NGLSEQEAH

SEQ ID NO: 432188 - protein, 9 aa, Homo Sapiens
KQEGLNKIF

SEQ ID NO: 432189 - protein, 9 aa, Homo Sapiens
SGSRYDAKY

SEQ ID NO: 432190 - protein, 9 aa, Homo Sapiens
IAGCLASLM

SEQ ID NO: 432191 - protein, 9 aa, Homo Sapiens
AKHIPCYEI

SEQ ID NO: 432192 - protein, 9 aa, Homo Sapiens
AVMPFVSVA

SEQ ID NO: 432193 - protein, 9 aa, Homo Sapiens
AVVGFCVVL

SEQ ID NO: 432194 - protein, 9 aa, Homo Sapiens
DAEAATAVV

SEQ ID NO: 432195 - protein, 9 aa, Homo Sapiens
WKFVGGSGQ

SEQ ID NO: 432196 - protein, 9 aa, Homo Sapiens
EQMCGIHRD

SEQ ID NO: 432197 - protein, 9 aa, Homo Sapiens
TQNQGRQKL

SEQ ID NO: 432198 - protein, 9 aa, Homo Sapiens
CSESREGHV

SEQ ID NO: 432199 - protein, 9 aa, Homo Sapiens
EEDNEYTER

SEQ ID NO: 432200 - protein, 9 aa, Homo Sapiens
SHFKDMIDY

SEQ ID NO: 432201 - protein, 9 aa, Homo Sapiens
HPHAHMHHH

SEQ ID NO: 432202 - protein, 9 aa, Homo Sapiens
LKLTDVFKP

SEQ ID NO: 432203 - protein, 9 aa, Homo Sapiens
VLEEGRKSK

SEQ ID NO: 432204 - protein, 9 aa, Homo Sapiens
KLKIQAESF

SEQ ID NO: 432205 - protein, 9 aa, Homo Sapiens
PFDANTSVF

SEQ ID NO: 432206 - protein, 9 aa, Homo Sapiens
AVGKKSLDL

SEQ ID NO: 432207 - protein, 9 aa, Homo Sapiens
VSRSDPFTL

SEQ ID NO: 432208 - protein, 9 aa, Homo Sapiens
HPFMVNATW

SEQ ID NO: 432209 - protein, 9 aa, Homo Sapiens
QHKIIHNRE

SEQ ID NO: 432210 - protein, 9 aa, Homo Sapiens
VNNVKVICD

SEQ ID NO: 432211 - protein, 9 aa, Homo Sapiens
TLGFDRYVE

SEQ ID NO: 432212 - protein, 9 aa, Homo Sapiens
ISYVFIVTI

SEQ ID NO: 432213 - protein, 9 aa, Homo Sapiens
AMIISIVGF

SEQ ID NO: 432214 - protein, 9 aa, Homo Sapiens
QNPDYNLFN

SEQ ID NO: 432215 - protein, 9 aa, Homo Sapiens
NLSTKTHLG

SEQ ID NO: 432216 - protein, 9 aa, Homo Sapiens
VLKPLSDRR

SEQ ID NO: 432217 - protein, 9 aa, Homo Sapiens
VFLWVFILV

SEQ ID NO: 432218 - protein, 9 aa, Homo Sapiens
TLRVAGEVH

SEQ ID NO: 432219 - protein, 9 aa, Homo Sapiens
SVDHSLQDC

SEQ ID NO: 432220 - protein, 9 aa, Homo Sapiens
VDFFVLKNC

SEQ ID NO: 432221 - protein, 9 aa, Homo Sapiens
ILEIVLFAH

SEQ ID NO: 432222 - protein, 9 aa, Homo Sapiens
FKGELINVF

SEQ ID NO: 432223 - protein, 9 aa, Homo Sapiens
MMEKKTVKR

SEQ ID NO: 432224 - protein, 9 aa, Homo Sapiens
RCMRYNLPA

SEQ ID NO: 432225 - protein, 9 aa, Homo Sapiens
IHKKKKCEM

SEQ ID NO: 432226 - protein, 9 aa, Homo Sapiens
RQLDLVHTA

SEQ ID NO: 432227 - protein, 9 aa, Homo Sapiens
GSLDACKGD

SEQ ID NO: 432228 - protein, 9 aa, Homo Sapiens
VEERVNCPG

SEQ ID NO: 432229 - protein, 9 aa, Homo Sapiens
GLKESEKVS

SEQ ID NO: 432230 - protein, 9 aa, Homo Sapiens
QFCITCQKS

SEQ ID NO: 432231 - protein, 9 aa, Homo Sapiens
ATLDTLTKH

SEQ ID NO: 432232 - protein, 9 aa, Homo Sapiens
DGERAVLQL

SEQ ID NO: 432233 - protein, 9 aa, Homo Sapiens
LSEAPNEKF

SEQ ID NO: 432234 - protein, 9 aa, Homo Sapiens
QTQMKLMVI

SEQ ID NO: 432235 - protein, 9 aa, Homo Sapiens
KKHIWVFIN

SEQ ID NO: 432236 - protein, 9 aa, Homo Sapiens
KFQAELSLH

SEQ ID NO: 432237 - protein, 9 aa, Homo Sapiens
DNDGCHPAC

SEQ ID NO: 432238 - protein, 9 aa, Homo Sapiens
EHREVCDRH

SEQ ID NO: 432239 - protein, 9 aa, Homo Sapiens
ARICINGEN

SEQ ID NO: 432240 - protein, 9 aa, Homo Sapiens
LLRSEGAEL

SEQ ID NO: 432241 - protein, 9 aa, Homo Sapiens
GGSWKCMFF

SEQ ID NO: 432242 - protein, 9 aa, Homo Sapiens
DRIYRFNTV

SEQ ID NO: 432243 - protein, 9 aa, Homo Sapiens
VDLIPKYEI

SEQ ID NO: 432244 - protein, 9 aa, Homo Sapiens
LRSIQFFYF

SEQ ID NO: 432245 - protein, 9 aa, Homo Sapiens
FVKVQLTAL

SEQ ID NO: 432246 - protein, 9 aa, Homo Sapiens
GISDTFYPY

SEQ ID NO: 432247 - protein, 9 aa, Homo Sapiens
SQASTVFIT

SEQ ID NO: 432248 - protein, 9 aa, Homo Sapiens
STVQVCNRF

SEQ ID NO: 432249 - protein, 9 aa, Homo Sapiens
WLAAFHNFI

SEQ ID NO: 432250 - protein, 9 aa, Homo Sapiens
NNIIGQPRP

SEQ ID NO: 432251 - protein, 9 aa, Homo Sapiens
LEETMKDKQ

SEQ ID NO: 432252 - protein, 9 aa, Homo Sapiens
EWCYGPARL

SEQ ID NO: 432253 - protein, 9 aa, Homo Sapiens
PVFYFILGD

SEQ ID NO: 432254 - protein, 9 aa, Homo Sapiens
LQEREREVQ

SEQ ID NO: 432255 - protein, 9 aa, Homo Sapiens
IVITYSTER

SEQ ID NO: 432256 - protein, 9 aa, Homo Sapiens
RITVKRACI

SEQ ID NO: 432257 - protein, 9 aa, Homo Sapiens
IFAVFIVCW

SEQ ID NO: 432258 - protein, 9 aa, Homo Sapiens
LQTSKHHPF

SEQ ID NO: 432259 - protein, 9 aa, Homo Sapiens
IAEGNPLTV

SEQ ID NO: 432260 - protein, 9 aa, Homo Sapiens
GTLTKLNFG

SEQ ID NO: 432261 - protein, 9 aa, Homo Sapiens
NVVQPVLEE

SEQ ID NO: 432262 - protein, 9 aa, Homo Sapiens
FLDSVTERW

SEQ ID NO: 432263 - protein, 9 aa, Homo Sapiens
RDNTNEMYS

SEQ ID NO: 432264 - protein, 9 aa, Homo Sapiens
NNVKVICDF

SEQ ID NO: 432265 - protein, 9 aa, Homo Sapiens
DLSCPYHHG

SEQ ID NO: 432266 - protein, 9 aa, Homo Sapiens
LEVTEDNFF

SEQ ID NO: 432267 - protein, 9 aa, Homo Sapiens
SEPGCTKVP

SEQ ID NO: 432268 - protein, 9 aa, Homo Sapiens
GKTQIAGCL

SEQ ID NO: 432269 - protein, 9 aa, Homo Sapiens
VERSREQIQ

SEQ ID NO: 432270 - protein, 9 aa, Homo Sapiens
TSLQGLLVD

SEQ ID NO: 432271 - protein, 9 aa, Homo Sapiens
ILHTGVKPY

SEQ ID NO: 432272 - protein, 9 aa, Homo Sapiens
YGNKDLTFS

SEQ ID NO: 432273 - protein, 9 aa, Homo Sapiens
YYAMDFDWR

SEQ ID NO: 432274 - protein, 9 aa, Homo Sapiens
KSSALIRHQ

SEQ ID NO: 432275 - protein, 9 aa, Homo Sapiens
KQRYDKMTS

SEQ ID NO: 432276 - protein, 9 aa, Homo Sapiens
SEGLIAFSV

SEQ ID NO: 432277 - protein, 9 aa, Homo Sapiens
TFQGAPMSS

SEQ ID NO: 432278 - protein, 9 aa, Homo Sapiens
HPELQIVLF

SEQ ID NO: 432279 - protein, 9 aa, Homo Sapiens
EGETNWKVI

SEQ ID NO: 432280 - protein, 9 aa, Homo Sapiens
PHQQIYDFL

SEQ ID NO: 432281 - protein, 9 aa, Homo Sapiens
EGDIAQKGY

SEQ ID NO: 432282 - protein, 9 aa, Homo Sapiens
SSSNVDVFI

SEQ ID NO: 432283 - protein, 9 aa, Homo Sapiens
FVLHTIVQG

SEQ ID NO: 432284 - protein, 9 aa, Homo Sapiens
SLSAVDFFV

SEQ ID NO: 432285 - protein, 9 aa, Homo Sapiens
KNAIGSRQH

SEQ ID NO: 432286 - protein, 9 aa, Homo Sapiens
GCLLLWLYV

SEQ ID NO: 432287 - protein, 9 aa, Homo Sapiens
LASCSDYMT

SEQ ID NO: 432288 - protein, 9 aa, Homo Sapiens
KVNKPQKNR

SEQ ID NO: 432289 - protein, 9 aa, Homo Sapiens
PMRPSYSAH

SEQ ID NO: 432290 - protein, 9 aa, Homo Sapiens
IRLKPYKCS

SEQ ID NO: 432291 - protein, 9 aa, Homo Sapiens
TASIFGLFG

SEQ ID NO: 432292 - protein, 9 aa, Homo Sapiens
GSEHYNVAR

SEQ ID NO: 432293 - protein, 9 aa, Homo Sapiens
TVSQLYRRY

SEQ ID NO: 432294 - protein, 9 aa, Homo Sapiens
RLPQLNYKD

SEQ ID NO: 432295 - protein, 9 aa, Homo Sapiens
SRQHYCHEC

SEQ ID NO: 432296 - protein, 9 aa, Homo Sapiens
QTVAACNLP

SEQ ID NO: 432297 - protein, 9 aa, Homo Sapiens
SHNSHLVEH

SEQ ID NO: 432298 - protein, 9 aa, Homo Sapiens
RPKVLFLTR

SEQ ID NO: 432299 - protein, 9 aa, Homo Sapiens
YLAQSDLFW

SEQ ID NO: 432300 - protein, 9 aa, Homo Sapiens
SDVSKAAFT

SEQ ID NO: 432301 - protein, 9 aa, Homo Sapiens
TKYRIREKA

SEQ ID NO: 432302 - protein, 9 aa, Homo Sapiens
WWTIAKYAP

SEQ ID NO: 432303 - protein, 9 aa, Homo Sapiens
PYADNFIGK

SEQ ID NO: 432304 - protein, 9 aa, Homo Sapiens
DGLEKIIYK

SEQ ID NO: 432305 - protein, 9 aa, Homo Sapiens
KLLAMRFKP

SEQ ID NO: 432306 - protein, 9 aa, Homo Sapiens
EYIYRHLFG

SEQ ID NO: 432307 - protein, 9 aa, Homo Sapiens
PKARQFFVF

SEQ ID NO: 432308 - protein, 9 aa, Homo Sapiens
YKEITHSVM

SEQ ID NO: 432309 - protein, 9 aa, Homo Sapiens
YSDFTKLQK

SEQ ID NO: 432310 - protein, 9 aa, Homo Sapiens
VSSSRCGHY

SEQ ID NO: 432311 - protein, 9 aa, Homo Sapiens
GHQEPHSLP

SEQ ID NO: 432312 - protein, 9 aa, Homo Sapiens
ILALQKNFL

SEQ ID NO: 432313 - protein, 9 aa, Homo Sapiens
IHGVPEFIL

SEQ ID NO: 432314 - protein, 9 aa, Homo Sapiens
ALGLLILIR

SEQ ID NO: 432315 - protein, 9 aa, Homo Sapiens
EAGMTDFPN

SEQ ID NO: 432316 - protein, 9 aa, Homo Sapiens
VDLAQESAW

SEQ ID NO: 432317 - protein, 9 aa, Homo Sapiens
EVNMHSSVW

SEQ ID NO: 432318 - protein, 9 aa, Homo Sapiens
PVSPALGVI

SEQ ID NO: 432319 - protein, 9 aa, Homo Sapiens
LEFIFLFCL

SEQ ID NO: 432320 - protein, 9 aa, Homo Sapiens
LDAETTARY

SEQ ID NO: 432321 - protein, 9 aa, Homo Sapiens
LEYFMKQIN

SEQ ID NO: 432322 - protein, 9 aa, Homo Sapiens
GLSPANCQI

SEQ ID NO: 432323 - protein, 9 aa, Homo Sapiens
RHRSALVKV

SEQ ID NO: 432324 - protein, 9 aa, Homo Sapiens
KGSVSWMGK

SEQ ID NO: 432325 - protein, 9 aa, Homo Sapiens
LKSLEECMA

SEQ ID NO: 432326 - protein, 9 aa, Homo Sapiens
TCRKDCIKN

SEQ ID NO: 432327 - protein, 9 aa, Homo Sapiens
LVRFNTIFK

SEQ ID NO: 432328 - protein, 9 aa, Homo Sapiens
GIQSVQGMS

SEQ ID NO: 432329 - protein, 9 aa, Homo Sapiens
TRHCPNCQH

SEQ ID NO: 432330 - protein, 9 aa, Homo Sapiens
ESECESEYG

SEQ ID NO: 432331 - protein, 9 aa, Homo Sapiens
GLDRNTLIS

SEQ ID NO: 432332 - protein, 9 aa, Homo Sapiens
RVLTNITVY

SEQ ID NO: 432333 - protein, 9 aa, Homo Sapiens
LKTLKDDLL

SEQ ID NO: 432334 - protein, 9 aa, Homo Sapiens
ASAAEDRIW

SEQ ID NO: 432335 - protein, 9 aa, Homo Sapiens
CSASAWLKP

SEQ ID NO: 432336 - protein, 9 aa, Homo Sapiens
PNKVIYKNK

SEQ ID NO: 432337 - protein, 9 aa, Homo Sapiens
GGDKFATLA

SEQ ID NO: 432338 - protein, 9 aa, Homo Sapiens
YSTADIFNR

SEQ ID NO: 432339 - protein, 9 aa, Homo Sapiens
TPRRGDVAN

SEQ ID NO: 432340 - protein, 9 aa, Homo Sapiens
SCADTSPAP

SEQ ID NO: 432341 - protein, 9 aa, Homo Sapiens
AITIYGVTP

SEQ ID NO: 432342 - protein, 9 aa, Homo Sapiens
LGLLKTLKD

SEQ ID NO: 432343 - protein, 9 aa, Homo Sapiens
VWFCGPGAM

SEQ ID NO: 432344 - protein, 9 aa, Homo Sapiens
CGKSVSTFS

SEQ ID NO: 432345 - protein, 9 aa, Homo Sapiens
CHPITCCPS

SEQ ID NO: 432346 - protein, 9 aa, Homo Sapiens
DVQVHDQNI

SEQ ID NO: 432347 - protein, 9 aa, Homo Sapiens
RGISIPRAD

SEQ ID NO: 432348 - protein, 9 aa, Homo Sapiens
KYQNQHTMN

SEQ ID NO: 432349 - protein, 9 aa, Homo Sapiens
NVAISLGYA

SEQ ID NO: 432350 - protein, 9 aa, Homo Sapiens
AGVAFACYI

SEQ ID NO: 432351 - protein, 9 aa, Homo Sapiens
QKCKDYVDK

SEQ ID NO: 432352 - protein, 9 aa, Homo Sapiens
DTAVNKQNW

SEQ ID NO: 432353 - protein, 9 aa, Homo Sapiens
EDGGFPQKS

SEQ ID NO: 432354 - protein, 9 aa, Homo Sapiens
FKPDKDLLM

SEQ ID NO: 432355 - protein, 9 aa, Homo Sapiens
VILAFNVRI

SEQ ID NO: 432356 - protein, 9 aa, Homo Sapiens
ILNFWVTIL

SEQ ID NO: 432357 - protein, 9 aa, Homo Sapiens
QTELGHKKL

SEQ ID NO: 432358 - protein, 9 aa, Homo Sapiens
YFFNRNRPS

SEQ ID NO: 432359 - protein, 9 aa, Homo Sapiens
DERLGCDSE

SEQ ID NO: 432360 - protein, 9 aa, Homo Sapiens
QIHEIMHRG

SEQ ID NO: 432361 - protein, 9 aa, Homo Sapiens
GYAHINFQQ

SEQ ID NO: 432362 - protein, 9 aa, Homo Sapiens
DRNTLISWT

SEQ ID NO: 432363 - protein, 9 aa, Homo Sapiens
AIEKRKRRH

SEQ ID NO: 432364 - protein, 9 aa, Homo Sapiens
AHACPLNFG

SEQ ID NO: 432365 - protein, 9 aa, Homo Sapiens
TNHSSLWNI

SEQ ID NO: 432366 - protein, 9 aa, Homo Sapiens
LGSVFLVAS

SEQ ID NO: 432367 - protein, 9 aa, Homo Sapiens
LKGLKSKSM

SEQ ID NO: 432368 - protein, 9 aa, Homo Sapiens
SIFQELRLV

SEQ ID NO: 432369 - protein, 9 aa, Homo Sapiens
RETEIIYSL

SEQ ID NO: 432370 - protein, 9 aa, Homo Sapiens
KLSNNVFVF

SEQ ID NO: 432371 - protein, 9 aa, Homo Sapiens
VHIGLFDKN

SEQ ID NO: 432372 - protein, 9 aa, Homo Sapiens
DNKPKFTQE

SEQ ID NO: 432373 - protein, 9 aa, Homo Sapiens
QFSGMGFQQ

SEQ ID NO: 432374 - protein, 9 aa, Homo Sapiens
HSSVNYKGL

SEQ ID NO: 432375 - protein, 9 aa, Homo Sapiens
HLQCLEEKL

SEQ ID NO: 432376 - protein, 9 aa, Homo Sapiens
PMGKSTWYD

SEQ ID NO: 432377 - protein, 9 aa, Homo Sapiens
DYLHVEDDS

SEQ ID NO: 432378 - protein, 9 aa, Homo Sapiens
KELPFFIIF

SEQ ID NO: 432379 - protein, 9 aa, Homo Sapiens
HNKIHTVDK

SEQ ID NO: 432380 - protein, 9 aa, Homo Sapiens
RAEVRTHYA

SEQ ID NO: 432381 - protein, 9 aa, Homo Sapiens
VRFNTIFKQ

SEQ ID NO: 432382 - protein, 9 aa, Homo Sapiens
IQWISNHYL

SEQ ID NO: 432383 - protein, 9 aa, Homo Sapiens
GTFNLPEGY

SEQ ID NO: 432384 - protein, 9 aa, Homo Sapiens
MCVCVEDGK

SEQ ID NO: 432385 - protein, 9 aa, Homo Sapiens
ILSDHQIIH

SEQ ID NO: 432386 - protein, 9 aa, Homo Sapiens
KGEGAHNQG

SEQ ID NO: 432387 - protein, 9 aa, Homo Sapiens
VWFYMQTAP

SEQ ID NO: 432388 - protein, 9 aa, Homo Sapiens
VYEAEGLAL

SEQ ID NO: 432389 - protein, 9 aa, Homo Sapiens
VLPLARAHG

SEQ ID NO: 432390 - protein, 9 aa, Homo Sapiens
MSSKGMEHL

SEQ ID NO: 432391 - protein, 9 aa, Homo Sapiens
SRAINHFVC

SEQ ID NO: 432392 - protein, 9 aa, Homo Sapiens
LKRLCINME

SEQ ID NO: 432393 - protein, 9 aa, Homo Sapiens
ITLLDLNDK

SEQ ID NO: 432394 - protein, 9 aa, Homo Sapiens
SRSLYSTPF

SEQ ID NO: 432395 - protein, 9 aa, Homo Sapiens
HKRGSQNDQ

SEQ ID NO: 432396 - protein, 9 aa, Homo Sapiens
INVTAAAQG

SEQ ID NO: 432397 - protein, 9 aa, Homo Sapiens
NPPEERRLD

SEQ ID NO: 432398 - protein, 9 aa, Homo Sapiens
YNEQEETPE

SEQ ID NO: 432399 - protein, 9 aa, Homo Sapiens
LCVKRNIFS

SEQ ID NO: 432400 - protein, 9 aa, Homo Sapiens
LEALDGDTG

SEQ ID NO: 432401 - protein, 9 aa, Homo Sapiens
FKDMIDYFC

SEQ ID NO: 432402 - protein, 9 aa, Homo Sapiens
LMDIVATDD

SEQ ID NO: 432403 - protein, 9 aa, Homo Sapiens
VREEVMLTL

SEQ ID NO: 432404 - protein, 9 aa, Homo Sapiens
RQESKKMSV

SEQ ID NO: 432405 - protein, 9 aa, Homo Sapiens
SRPVLEYIN

SEQ ID NO: 432406 - protein, 9 aa, Homo Sapiens
IVIIYFDSH

SEQ ID NO: 432407 - protein, 9 aa, Homo Sapiens
GCSTLPVLA

SEQ ID NO: 432408 - protein, 9 aa, Homo Sapiens
APDSAIRQL

SEQ ID NO: 432409 - protein, 9 aa, Homo Sapiens
KIIFAPPAQ

SEQ ID NO: 432410 - protein, 9 aa, Homo Sapiens
GGYGFSGLY

SEQ ID NO: 432411 - protein, 9 aa, Homo Sapiens
AHALLLIAQ

SEQ ID NO: 432412 - protein, 9 aa, Homo Sapiens
MLPSKDGNH

SEQ ID NO: 432413 - protein, 9 aa, Homo Sapiens
SLCRQNLTR

SEQ ID NO: 432414 - protein, 9 aa, Homo Sapiens
EVEAFEARG

SEQ ID NO: 432415 - protein, 9 aa, Homo Sapiens
YVVSRTSPH

SEQ ID NO: 432416 - protein, 9 aa, Homo Sapiens
KNKKLWQIK

SEQ ID NO: 432417 - protein, 9 aa, Homo Sapiens
IQQDFLDTY

SEQ ID NO: 432418 - protein, 9 aa, Homo Sapiens
LAKGRTQLK

SEQ ID NO: 432419 - protein, 9 aa, Homo Sapiens
WSHDPSDLV

SEQ ID NO: 432420 - protein, 9 aa, Homo Sapiens
PDQLYRLWL

SEQ ID NO: 432421 - protein, 9 aa, Homo Sapiens
TLLCEITSN

SEQ ID NO: 432422 - protein, 9 aa, Homo Sapiens
CMNLYIEDS

SEQ ID NO: 432423 - protein, 9 aa, Homo Sapiens
GKFIKKHPD

SEQ ID NO: 432424 - protein, 9 aa, Homo Sapiens
DRAENINKY

SEQ ID NO: 432425 - protein, 9 aa, Homo Sapiens
KGQHLGYSS

SEQ ID NO: 432426 - protein, 9 aa, Homo Sapiens
CDIPGTLNG

SEQ ID NO: 432427 - protein, 9 aa, Homo Sapiens
QIVRALSAQ

SEQ ID NO: 432428 - protein, 9 aa, Homo Sapiens
DYVIHNSNT

SEQ ID NO: 432429 - protein, 9 aa, Homo Sapiens
PPVDYADEE

SEQ ID NO: 432430 - protein, 9 aa, Homo Sapiens
PTHVAEVAP

SEQ ID NO: 432431 - protein, 9 aa, Homo Sapiens
LDRKQISEY

SEQ ID NO: 432432 - protein, 9 aa, Homo Sapiens
YMGRKQEDK

SEQ ID NO: 432433 - protein, 9 aa, Homo Sapiens
CIKEDILAC

SEQ ID NO: 432434 - protein, 9 aa, Homo Sapiens
TFNATICYH

SEQ ID NO: 432435 - protein, 9 aa, Homo Sapiens
VEVAKVQDY

SEQ ID NO: 432436 - protein, 9 aa, Homo Sapiens
KQVNRIDWP

SEQ ID NO: 432437 - protein, 9 aa, Homo Sapiens
AESPGWPPP

SEQ ID NO: 432438 - protein, 9 aa, Homo Sapiens
EEICTANEG

SEQ ID NO: 432439 - protein, 9 aa, Homo Sapiens
VTESFCERT

SEQ ID NO: 432440 - protein, 9 aa, Homo Sapiens
NKPFDANTS

SEQ ID NO: 432441 - protein, 9 aa, Homo Sapiens
PVRTATDYT

SEQ ID NO: 432442 - protein, 9 aa, Homo Sapiens
LRHDKIMFG

SEQ ID NO: 432443 - protein, 9 aa, Homo Sapiens
NTKGPENII

SEQ ID NO: 432444 - protein, 9 aa, Homo Sapiens
MNTKEPVKK

SEQ ID NO: 432445 - protein, 9 aa, Homo Sapiens
CEEVVRECT

SEQ ID NO: 432446 - protein, 9 aa, Homo Sapiens
VLTGNGDDY

SEQ ID NO: 432447 - protein, 9 aa, Homo Sapiens
EPHKIIKEV

SEQ ID NO: 432448 - protein, 9 aa, Homo Sapiens
ISEGLQGAE

SEQ ID NO: 432449 - protein, 9 aa, Homo Sapiens
FSDWPFVEA

SEQ ID NO: 432450 - protein, 9 aa, Homo Sapiens
QGIINKEGY

SEQ ID NO: 432451 - protein, 9 aa, Homo Sapiens
LNNELFAYA

SEQ ID NO: 432452 - protein, 9 aa, Homo Sapiens
PAIYKSACN

SEQ ID NO: 432453 - protein, 9 aa, Homo Sapiens
NAKFDLKLD

SEQ ID NO: 432454 - protein, 9 aa, Homo Sapiens
TLDEFIESC

SEQ ID NO: 432455 - protein, 9 aa, Homo Sapiens
GFFMGGVFV

SEQ ID NO: 432456 - protein, 9 aa, Homo Sapiens
IHRPCGKQG

SEQ ID NO: 432457 - protein, 9 aa, Homo Sapiens
VCDVPAMLT

SEQ ID NO: 432458 - protein, 9 aa, Homo Sapiens
VYSENEAQK

SEQ ID NO: 432459 - protein, 9 aa, Homo Sapiens
LQHRFYGLS

SEQ ID NO: 432460 - protein, 9 aa, Homo Sapiens
CRNYASEVV

SEQ ID NO: 432461 - protein, 9 aa, Homo Sapiens
VFPGSGAPN

SEQ ID NO: 432462 - protein, 9 aa, Homo Sapiens
YFLKLTDVF

SEQ ID NO: 432463 - protein, 9 aa, Homo Sapiens
YTERYSDDD

SEQ ID NO: 432464 - protein, 9 aa, Homo Sapiens
RSCGQRFNP

SEQ ID NO: 432465 - protein, 9 aa, Homo Sapiens
YYSKFFNLI

SEQ ID NO: 432466 - protein, 9 aa, Homo Sapiens
GDYFSGKKF

SEQ ID NO: 432467 - protein, 9 aa, Homo Sapiens
FLGTVAMDL

SEQ ID NO: 432468 - protein, 9 aa, Homo Sapiens
VSDKIYVMY

SEQ ID NO: 432469 - protein, 9 aa, Homo Sapiens
ERINTGEKP

SEQ ID NO: 432470 - protein, 9 aa, Homo Sapiens
TEAIQEELL

SEQ ID NO: 432471 - protein, 9 aa, Homo Sapiens
LVQRLTCKF

SEQ ID NO: 432472 - protein, 9 aa, Homo Sapiens
LWEQFSGMG

SEQ ID NO: 432473 - protein, 9 aa, Homo Sapiens
IKLNKKSMY

SEQ ID NO: 432474 - protein, 9 aa, Homo Sapiens
LYGLQVKYD

SEQ ID NO: 432475 - protein, 9 aa, Homo Sapiens
VAVNNIKCD

SEQ ID NO: 432476 - protein, 9 aa, Homo Sapiens
SFVAELSVP

SEQ ID NO: 432477 - protein, 9 aa, Homo Sapiens
EETQESLKT

SEQ ID NO: 432478 - protein, 9 aa, Homo Sapiens
HCSIHLMYL

SEQ ID NO: 432479 - protein, 9 aa, Homo Sapiens
PNKDKQAFV

SEQ ID NO: 432480 - protein, 9 aa, Homo Sapiens
QNCSCVRGT

SEQ ID NO: 432481 - protein, 9 aa, Homo Sapiens
VTTEEFKLK

SEQ ID NO: 432482 - protein, 9 aa, Homo Sapiens
IILGLFNHT

SEQ ID NO: 432483 - protein, 9 aa, Homo Sapiens
IIHMLTQYA

SEQ ID NO: 432484 - protein, 9 aa, Homo Sapiens
DKANEQELK

SEQ ID NO: 432485 - protein, 9 aa, Homo Sapiens
LQKELNDVL

SEQ ID NO: 432486 - protein, 9 aa, Homo Sapiens
LFPSLCVER

SEQ ID NO: 432487 - protein, 9 aa, Homo Sapiens
QQMTGKCEL

SEQ ID NO: 432488 - protein, 9 aa, Homo Sapiens
KKLSSQREE

SEQ ID NO: 432489 - protein, 9 aa, Homo Sapiens
HRLDLGELK

SEQ ID NO: 432490 - protein, 9 aa, Homo Sapiens
LYSWPWCSA

SEQ ID NO: 432491 - protein, 9 aa, Homo Sapiens
REIYSTDYY

SEQ ID NO: 432492 - protein, 9 aa, Homo Sapiens
MIQIIFTFQ

SEQ ID NO: 432493 - protein, 9 aa, Homo Sapiens
ENMIYYLLL

SEQ ID NO: 432494 - protein, 9 aa, Homo Sapiens
TVEFLVELH

SEQ ID NO: 432495 - protein, 9 aa, Homo Sapiens
LGFKHNKIQ

SEQ ID NO: 432496 - protein, 9 aa, Homo Sapiens
ERERLLCSK

SEQ ID NO: 432497 - protein, 9 aa, Homo Sapiens
HLAPNSKSS

SEQ ID NO: 432498 - protein, 9 aa, Homo Sapiens
EAWEQHHLR

SEQ ID NO: 432499 - protein, 9 aa, Homo Sapiens
LQNEFSSFG

SEQ ID NO: 432500 - protein, 9 aa, Homo Sapiens
NVKVICDFN

SEQ ID NO: 432501 - protein, 9 aa, Homo Sapiens
LGNRLDDVC

SEQ ID NO: 432502 - protein, 9 aa, Homo Sapiens
KEKITYLPT

SEQ ID NO: 432503 - protein, 9 aa, Homo Sapiens
MSVSTISAF

SEQ ID NO: 432504 - protein, 9 aa, Homo Sapiens
TSENNTKEM

SEQ ID NO: 432505 - protein, 9 aa, Homo Sapiens
YTSYYTNEK

SEQ ID NO: 432506 - protein, 9 aa, Homo Sapiens
LGSGLTLIH

SEQ ID NO: 432507 - protein, 9 aa, Homo Sapiens
KSDKLDEQR

SEQ ID NO: 432508 - protein, 9 aa, Homo Sapiens
MFNERGSKG

SEQ ID NO: 432509 - protein, 9 aa, Homo Sapiens
HDSNNQFVS

SEQ ID NO: 432510 - protein, 9 aa, Homo Sapiens
HPHVANPQL

SEQ ID NO: 432511 - protein, 9 aa, Homo Sapiens
FPKHYRPPK

SEQ ID NO: 432512 - protein, 9 aa, Homo Sapiens
QAVSKPQTL

SEQ ID NO: 432513 - protein, 9 aa, Homo Sapiens
TSGVLDDNA

SEQ ID NO: 432514 - protein, 9 aa, Homo Sapiens
PWNIPVLPD

SEQ ID NO: 432515 - protein, 9 aa, Homo Sapiens
SMVQKMIFY

SEQ ID NO: 432516 - protein, 9 aa, Homo Sapiens
KLSGASLAA

SEQ ID NO: 432517 - protein, 9 aa, Homo Sapiens
KNYVVQGMI

SEQ ID NO: 432518 - protein, 9 aa, Homo Sapiens
IMTILEIVL

SEQ ID NO: 432519 - protein, 9 aa, Homo Sapiens
VDYADEEAA

SEQ ID NO: 432520 - protein, 9 aa, Homo Sapiens
TYMPYTLIT

SEQ ID NO: 432521 - protein, 9 aa, Homo Sapiens
LVYPAMREA

SEQ ID NO: 432522 - protein, 9 aa, Homo Sapiens
LDHDKEVIT

SEQ ID NO: 432523 - protein, 9 aa, Homo Sapiens
EAQLAIIIL

SEQ ID NO: 432524 - protein, 9 aa, Homo Sapiens
GNCFNCGTW

SEQ ID NO: 432525 - protein, 9 aa, Homo Sapiens
SQEIYKFMA

SEQ ID NO: 432526 - protein, 9 aa, Homo Sapiens
TRPHLEGRN

SEQ ID NO: 432527 - protein, 9 aa, Homo Sapiens
ECMMKDVFF

SEQ ID NO: 432528 - protein, 9 aa, Homo Sapiens
KWGHKAIEA

SEQ ID NO: 432529 - protein, 9 aa, Homo Sapiens
CKKFANPSH

SEQ ID NO: 432530 - protein, 9 aa, Homo Sapiens
VECPRRQRP

SEQ ID NO: 432531 - protein, 9 aa, Homo Sapiens
ISVLSFIIY

SEQ ID NO: 432532 - protein, 9 aa, Homo Sapiens
NVDKVANES

SEQ ID NO: 432533 - protein, 9 aa, Homo Sapiens
ASNNVPNML

SEQ ID NO: 432534 - protein, 9 aa, Homo Sapiens
NRGAVYLFN

SEQ ID NO: 432535 - protein, 9 aa, Homo Sapiens
KYFVLGRDK

SEQ ID NO: 432536 - protein, 9 aa, Homo Sapiens
QQRQKEQNK

SEQ ID NO: 432537 - protein, 9 aa, Homo Sapiens
PATANMKAS

SEQ ID NO: 432538 - protein, 9 aa, Homo Sapiens
DSTVPNQFQ

SEQ ID NO: 432539 - protein, 9 aa, Homo Sapiens
SPARPRDSL

SEQ ID NO: 432540 - protein, 9 aa, Homo Sapiens
GTPFSVGVA

SEQ ID NO: 432541 - protein, 9 aa, Homo Sapiens
KMLRRTERG

SEQ ID NO: 432542 - protein, 9 aa, Homo Sapiens
GSHITFHMN

SEQ ID NO: 432543 - protein, 9 aa, Homo Sapiens
IYTPRTGHQ

SEQ ID NO: 432544 - protein, 9 aa, Homo Sapiens
NEDSTGGIY

SEQ ID NO: 432545 - protein, 9 aa, Homo Sapiens
NARRRILLD

SEQ ID NO: 432546 - protein, 9 aa, Homo Sapiens
PTGKRRGGR

SEQ ID NO: 432547 - protein, 9 aa, Homo Sapiens
GHFPHLVES

SEQ ID NO: 432548 - protein, 9 aa, Homo Sapiens
EAAVADVLK

SEQ ID NO: 432549 - protein, 9 aa, Homo Sapiens
GETNWKVIA

SEQ ID NO: 432550 - protein, 9 aa, Homo Sapiens
VFELCDQDL

SEQ ID NO: 432551 - protein, 9 aa, Homo Sapiens
CLFHQEKRM

SEQ ID NO: 432552 - protein, 9 aa, Homo Sapiens
WLLVPTQYV

SEQ ID NO: 432553 - protein, 9 aa, Homo Sapiens
IHGAVGASK

SEQ ID NO: 432554 - protein, 9 aa, Homo Sapiens
GAKKPRFDL

SEQ ID NO: 432555 - protein, 9 aa, Homo Sapiens
NTHRRETLC

SEQ ID NO: 432556 - protein, 9 aa, Homo Sapiens
FHFFFFVTG

SEQ ID NO: 432557 - protein, 9 aa, Homo Sapiens
KKDRIVADL

SEQ ID NO: 432558 - protein, 9 aa, Homo Sapiens
HSDLIFHEQ

SEQ ID NO: 432559 - protein, 9 aa, Homo Sapiens
MHFFHSLEN

SEQ ID NO: 432560 - protein, 9 aa, Homo Sapiens
STPSTLNNS

SEQ ID NO: 432561 - protein, 9 aa, Homo Sapiens
TFEYVAIDF

SEQ ID NO: 432562 - protein, 9 aa, Homo Sapiens
QKPEAEVDQ

SEQ ID NO: 432563 - protein, 9 aa, Homo Sapiens
IFTLLYLFL

SEQ ID NO: 432564 - protein, 9 aa, Homo Sapiens
CQAGFVFDT

SEQ ID NO: 432565 - protein, 9 aa, Homo Sapiens
KQTHTGEKP

SEQ ID NO: 432566 - protein, 9 aa, Homo Sapiens
LNRKVLYGE

SEQ ID NO: 432567 - protein, 9 aa, Homo Sapiens
FRARQRCKA

SEQ ID NO: 432568 - protein, 9 aa, Homo Sapiens
VIRRARLPT

SEQ ID NO: 432569 - protein, 9 aa, Homo Sapiens
PSQHPKKKN

SEQ ID NO: 432570 - protein, 9 aa, Homo Sapiens
TVSVLQARL

SEQ ID NO: 432571 - protein, 9 aa, Homo Sapiens
PGQQHLRGC

SEQ ID NO: 432572 - protein, 9 aa, Homo Sapiens
AGCFQFGAY

SEQ ID NO: 432573 - protein, 9 aa, Homo Sapiens
TVNSEFVGW

SEQ ID NO: 432574 - protein, 9 aa, Homo Sapiens
TVLSRTPIS

SEQ ID NO: 432575 - protein, 9 aa, Homo Sapiens
RNVAALDTE

SEQ ID NO: 432576 - protein, 9 aa, Homo Sapiens
NDFVSAKMD

SEQ ID NO: 432577 - protein, 9 aa, Homo Sapiens
YFMDAMNKF

SEQ ID NO: 432578 - protein, 9 aa, Homo Sapiens
IERKQAQIQ

SEQ ID NO: 432579 - protein, 9 aa, Homo Sapiens
DMHWDLVTM

SEQ ID NO: 432580 - protein, 9 aa, Homo Sapiens
VTFNTLLAG

SEQ ID NO: 432581 - protein, 9 aa, Homo Sapiens
HSSVCSTQV

SEQ ID NO: 432582 - protein, 9 aa, Homo Sapiens
KEVNNRLDY

SEQ ID NO: 432583 - protein, 9 aa, Homo Sapiens
LNFWVTILP

SEQ ID NO: 432584 - protein, 9 aa, Homo Sapiens
HHDMNSENI

SEQ ID NO: 432585 - protein, 9 aa, Homo Sapiens
VLRYDTIFQ

SEQ ID NO: 432586 - protein, 9 aa, Homo Sapiens
VPLGIDKTI

SEQ ID NO: 432587 - protein, 9 aa, Homo Sapiens
RLCLEEEAR

SEQ ID NO: 432588 - protein, 9 aa, Homo Sapiens
VQNDYEARP

SEQ ID NO: 432589 - protein, 9 aa, Homo Sapiens
FCVKTSLTR

SEQ ID NO: 432590 - protein, 9 aa, Homo Sapiens
THLVQLLRL

SEQ ID NO: 432591 - protein, 9 aa, Homo Sapiens
DFTDIIKLF

SEQ ID NO: 432592 - protein, 9 aa, Homo Sapiens
DSLNPRISV

SEQ ID NO: 432593 - protein, 9 aa, Homo Sapiens
DAVTYLTGV

SEQ ID NO: 432594 - protein, 9 aa, Homo Sapiens
QVAESVKYQ

SEQ ID NO: 432595 - protein, 9 aa, Homo Sapiens
WAGCLSDPG

SEQ ID NO: 432596 - protein, 9 aa, Homo Sapiens
FALQAEIHQ

SEQ ID NO: 432597 - protein, 9 aa, Homo Sapiens
HRVHTEKKH

SEQ ID NO: 432598 - protein, 9 aa, Homo Sapiens
EMGFEKLFE

SEQ ID NO: 432599 - protein, 9 aa, Homo Sapiens
HILQKHGKN

SEQ ID NO: 432600 - protein, 9 aa, Homo Sapiens
LFYGTLIFM

SEQ ID NO: 432601 - protein, 9 aa, Homo Sapiens
PWMMEKKTV

SEQ ID NO: 432602 - protein, 9 aa, Homo Sapiens
DRRFANSSN

SEQ ID NO: 432603 - protein, 9 aa, Homo Sapiens
VFTDSLQEV

SEQ ID NO: 432604 - protein, 9 aa, Homo Sapiens
ACSSMTQTD

SEQ ID NO: 432605 - protein, 9 aa, Homo Sapiens
SIVSDLEKY

SEQ ID NO: 432606 - protein, 9 aa, Homo Sapiens
FYNTFSSIP

SEQ ID NO: 432607 - protein, 9 aa, Homo Sapiens
TSIFENVIF

SEQ ID NO: 432608 - protein, 9 aa, Homo Sapiens
NTFCMAISI

SEQ ID NO: 432609 - protein, 9 aa, Homo Sapiens
DRELFEDML

SEQ ID NO: 432610 - protein, 9 aa, Homo Sapiens
IEKRKRRHP

SEQ ID NO: 432611 - protein, 9 aa, Homo Sapiens
GTEQTGGRL

SEQ ID NO: 432612 - protein, 9 aa, Homo Sapiens
SGDMKYEIH

SEQ ID NO: 432613 - protein, 9 aa, Homo Sapiens
ILSVFRMFD

SEQ ID NO: 432614 - protein, 9 aa, Homo Sapiens
HSPLFKVLV

SEQ ID NO: 432615 - protein, 9 aa, Homo Sapiens
QAWLAYMNQ

SEQ ID NO: 432616 - protein, 9 aa, Homo Sapiens
KTFFSDVSI

SEQ ID NO: 432617 - protein, 9 aa, Homo Sapiens
KRDNTNEMY

SEQ ID NO: 432618 - protein, 9 aa, Homo Sapiens
VLKGGEMSS

SEQ ID NO: 432619 - protein, 9 aa, Homo Sapiens
TVCLLAVNT

SEQ ID NO: 432620 - protein, 9 aa, Homo Sapiens
LFGHTFSPP

SEQ ID NO: 432621 - protein, 9 aa, Homo Sapiens
AAETQRGFC

SEQ ID NO: 432622 - protein, 9 aa, Homo Sapiens
KYGEFYGRY

SEQ ID NO: 432623 - protein, 9 aa, Homo Sapiens
NKMKKWEGM

SEQ ID NO: 432624 - protein, 9 aa, Homo Sapiens
DKVLWVLVI

SEQ ID NO: 432625 - protein, 9 aa, Homo Sapiens
PSTRTFFCH

SEQ ID NO: 432626 - protein, 9 aa, Homo Sapiens
IIFMDEIYA

SEQ ID NO: 432627 - protein, 9 aa, Homo Sapiens
RQGEVLPLP

SEQ ID NO: 432628 - protein, 9 aa, Homo Sapiens
VRYVCLRCC

SEQ ID NO: 432629 - protein, 9 aa, Homo Sapiens
ASKVIGRLR

SEQ ID NO: 432630 - protein, 9 aa, Homo Sapiens
NNPKMVKFI

SEQ ID NO: 432631 - protein, 9 aa, Homo Sapiens
AIMRTLFSL

SEQ ID NO: 432632 - protein, 9 aa, Homo Sapiens
TMGQSAPVR

SEQ ID NO: 432633 - protein, 9 aa, Homo Sapiens
STSQGLCFN

SEQ ID NO: 432634 - protein, 9 aa, Homo Sapiens
QQCWSIPAD

SEQ ID NO: 432635 - protein, 9 aa, Homo Sapiens
VASLTQPSD

SEQ ID NO: 432636 - protein, 9 aa, Homo Sapiens
ADDNITVQG

SEQ ID NO: 432637 - protein, 9 aa, Homo Sapiens
TIIMSHRVC

SEQ ID NO: 432638 - protein, 9 aa, Homo Sapiens
QHQIKEMKQ

SEQ ID NO: 432639 - protein, 9 aa, Homo Sapiens
VADLDTMRH

SEQ ID NO: 432640 - protein, 9 aa, Homo Sapiens
CKPGVGLLL

SEQ ID NO: 432641 - protein, 9 aa, Homo Sapiens
DRGFAYHKE

SEQ ID NO: 432642 - protein, 9 aa, Homo Sapiens
EERVNCPGW

SEQ ID NO: 432643 - protein, 9 aa, Homo Sapiens
QKENESSSL

SEQ ID NO: 432644 - protein, 9 aa, Homo Sapiens
NMPTNITTK

SEQ ID NO: 432645 - protein, 9 aa, Homo Sapiens
NNYLYLYYK

SEQ ID NO: 432646 - protein, 9 aa, Homo Sapiens
VKSLESRLQ

SEQ ID NO: 432647 - protein, 9 aa, Homo Sapiens
QKCTYQFMM

SEQ ID NO: 432648 - protein, 9 aa, Homo Sapiens
PGPPGPMSP

SEQ ID NO: 432649 - protein, 9 aa, Homo Sapiens
EYDPGQCAG

SEQ ID NO: 432650 - protein, 9 aa, Homo Sapiens
PSSLASDQF

SEQ ID NO: 432651 - protein, 9 aa, Homo Sapiens
SITDISLLF

SEQ ID NO: 432652 - protein, 9 aa, Homo Sapiens
KISHKKATY

SEQ ID NO: 432653 - protein, 9 aa, Homo Sapiens
NSVIFATGY

SEQ ID NO: 432654 - protein, 9 aa, Homo Sapiens
QKQIQETLQ

SEQ ID NO: 432655 - protein, 9 aa, Homo Sapiens
TLQPSTTYV

SEQ ID NO: 432656 - protein, 9 aa, Homo Sapiens
YKKDEMYRS

SEQ ID NO: 432657 - protein, 9 aa, Homo Sapiens
KECKLICQF

SEQ ID NO: 432658 - protein, 9 aa, Homo Sapiens
YLGSSELRK

SEQ ID NO: 432659 - protein, 9 aa, Homo Sapiens
KIIMWDHDL

SEQ ID NO: 432660 - protein, 9 aa, Homo Sapiens
HNGGSPQIP

SEQ ID NO: 432661 - protein, 9 aa, Homo Sapiens
LWVSHRKAL

SEQ ID NO: 432662 - protein, 9 aa, Homo Sapiens
IYDFPQEFY

SEQ ID NO: 432663 - protein, 9 aa, Homo Sapiens
EKPVKKHKT

SEQ ID NO: 432664 - protein, 9 aa, Homo Sapiens
SLLRLISLF

SEQ ID NO: 432665 - protein, 9 aa, Homo Sapiens
EAPNEKFFF

SEQ ID NO: 432666 - protein, 9 aa, Homo Sapiens
DIIEDYIYG

SEQ ID NO: 432667 - protein, 9 aa, Homo Sapiens
IQIWEIKFG

SEQ ID NO: 432668 - protein, 9 aa, Homo Sapiens
KVLTEVYSE

SEQ ID NO: 432669 - protein, 9 aa, Homo Sapiens
ARQAQVKHR

SEQ ID NO: 432670 - protein, 9 aa, Homo Sapiens
TIFVQVSLH

SEQ ID NO: 432671 - protein, 9 aa, Homo Sapiens
IVVASLLTL

SEQ ID NO: 432672 - protein, 9 aa, Homo Sapiens
NAIGSRQHY

SEQ ID NO: 432673 - protein, 9 aa, Homo Sapiens
DATTCFVDA

SEQ ID NO: 432674 - protein, 9 aa, Homo Sapiens
LDKLRNEVT

SEQ ID NO: 432675 - protein, 9 aa, Homo Sapiens
PARTVNENF

SEQ ID NO: 432676 - protein, 9 aa, Homo Sapiens
LVSSIPVSL

SEQ ID NO: 432677 - protein, 9 aa, Homo Sapiens
AHVEFADIG

SEQ ID NO: 432678 - protein, 9 aa, Homo Sapiens
SGVENYNET

SEQ ID NO: 432679 - protein, 9 aa, Homo Sapiens
YKISPEKLV

SEQ ID NO: 432680 - protein, 9 aa, Homo Sapiens
ITPKHTMKA

SEQ ID NO: 432681 - protein, 9 aa, Homo Sapiens
TYFSNFTSN

SEQ ID NO: 432682 - protein, 9 aa, Homo Sapiens
TGQSHNNVF

SEQ ID NO: 432683 - protein, 9 aa, Homo Sapiens
TNAREILDG

SEQ ID NO: 432684 - protein, 9 aa, Homo Sapiens
YKCGARVRK

SEQ ID NO: 432685 - protein, 9 aa, Homo Sapiens
YWIDRVDGG

SEQ ID NO: 432686 - protein, 9 aa, Homo Sapiens
NVGNTCYMN

SEQ ID NO: 432687 - protein, 9 aa, Homo Sapiens
DPMCKIIIG

SEQ ID NO: 432688 - protein, 9 aa, Homo Sapiens
CCSSSKNDS

SEQ ID NO: 432689 - protein, 9 aa, Homo Sapiens
TDYYRVQSK

SEQ ID NO: 432690 - protein, 9 aa, Homo Sapiens
YRAMNQLDF

SEQ ID NO: 432691 - protein, 9 aa, Homo Sapiens
LIVDGERAV

SEQ ID NO: 432692 - protein, 9 aa, Homo Sapiens
GAHNQGKKA

SEQ ID NO: 432693 - protein, 9 aa, Homo Sapiens
IVSEIQPHM

SEQ ID NO: 432694 - protein, 9 aa, Homo Sapiens
CHLQVDGGM

SEQ ID NO: 432695 - protein, 9 aa, Homo Sapiens
NCFSVNFQK

SEQ ID NO: 432696 - protein, 9 aa, Homo Sapiens
PYGCLQCGK

SEQ ID NO: 432697 - protein, 9 aa, Homo Sapiens
VRKNIFHFG

SEQ ID NO: 432698 - protein, 9 aa, Homo Sapiens
YHNGKLWIM

SEQ ID NO: 432699 - protein, 9 aa, Homo Sapiens
KPLMIIRHL

SEQ ID NO: 432700 - protein, 9 aa, Homo Sapiens
PFLVNCKIT

SEQ ID NO: 432701 - protein, 9 aa, Homo Sapiens
KFLKKLLMP

SEQ ID NO: 432702 - protein, 9 aa, Homo Sapiens
ENKIQYHSR

SEQ ID NO: 432703 - protein, 9 aa, Homo Sapiens
LNEVLELTG

SEQ ID NO: 432704 - protein, 9 aa, Homo Sapiens
SVTAAIQAD

SEQ ID NO: 432705 - protein, 9 aa, Homo Sapiens
DRRNDKVDP

SEQ ID NO: 432706 - protein, 9 aa, Homo Sapiens
KLNDLIQKL

SEQ ID NO: 432707 - protein, 9 aa, Homo Sapiens
RINESLLGL

SEQ ID NO: 432708 - protein, 9 aa, Homo Sapiens
QWDMQSTFN

SEQ ID NO: 432709 - protein, 9 aa, Homo Sapiens
RDTIVMDTL

SEQ ID NO: 432710 - protein, 9 aa, Homo Sapiens
EKKTVKRLG

SEQ ID NO: 432711 - protein, 9 aa, Homo Sapiens
ELGVGLSQH

SEQ ID NO: 432712 - protein, 9 aa, Homo Sapiens
ESTDEDLDS

SEQ ID NO: 432713 - protein, 9 aa, Homo Sapiens
KPTNNSEER

SEQ ID NO: 432714 - protein, 9 aa, Homo Sapiens
KNLHYKYGF

SEQ ID NO: 432715 - protein, 9 aa, Homo Sapiens
DLVVLSGTD

SEQ ID NO: 432716 - protein, 9 aa, Homo Sapiens
LILKRNEIQ

SEQ ID NO: 432717 - protein, 9 aa, Homo Sapiens
LLLRTTSLK

SEQ ID NO: 432718 - protein, 9 aa, Homo Sapiens
TNQIVVIKK

SEQ ID NO: 432719 - protein, 9 aa, Homo Sapiens
KDRNNRKLG

SEQ ID NO: 432720 - protein, 9 aa, Homo Sapiens
ILHTALMLN

SEQ ID NO: 432721 - protein, 9 aa, Homo Sapiens
WWRLCKTCY

SEQ ID NO: 432722 - protein, 9 aa, Homo Sapiens
REETLALSV

SEQ ID NO: 432723 - protein, 9 aa, Homo Sapiens
SDSQVVDDE

SEQ ID NO: 432724 - protein, 9 aa, Homo Sapiens
IAICWVLLF

SEQ ID NO: 432725 - protein, 9 aa, Homo Sapiens
MLCAGFHEG

SEQ ID NO: 432726 - protein, 9 aa, Homo Sapiens
VNDLPRAVP

SEQ ID NO: 432727 - protein, 9 aa, Homo Sapiens
EEGDLVKPL

SEQ ID NO: 432728 - protein, 9 aa, Homo Sapiens
PFYCNVANV

SEQ ID NO: 432729 - protein, 9 aa, Homo Sapiens
PYIRPGVKQ

SEQ ID NO: 432730 - protein, 9 aa, Homo Sapiens
DRYVTIFYT

SEQ ID NO: 432731 - protein, 9 aa, Homo Sapiens
EAKHLKKMD

SEQ ID NO: 432732 - protein, 9 aa, Homo Sapiens
KRIQKQFFH

SEQ ID NO: 432733 - protein, 9 aa, Homo Sapiens
IEHFFAVAI

SEQ ID NO: 432734 - protein, 9 aa, Homo Sapiens
KRPWFVGYK

SEQ ID NO: 432735 - protein, 9 aa, Homo Sapiens
TNITVYCQE

SEQ ID NO: 432736 - protein, 9 aa, Homo Sapiens
ADIKQDNGM

SEQ ID NO: 432737 - protein, 9 aa, Homo Sapiens
HRMYPGQGP

SEQ ID NO: 432738 - protein, 9 aa, Homo Sapiens
ATVQARYFS

SEQ ID NO: 432739 - protein, 9 aa, Homo Sapiens
NQNETPSDP

SEQ ID NO: 432740 - protein, 9 aa, Homo Sapiens
PKQFMTFKE

SEQ ID NO: 432741 - protein, 9 aa, Homo Sapiens
KKEPIKDGH

SEQ ID NO: 432742 - protein, 9 aa, Homo Sapiens
IKLIVMINT

SEQ ID NO: 432743 - protein, 9 aa, Homo Sapiens
NPDALGNVE

SEQ ID NO: 432744 - protein, 9 aa, Homo Sapiens
LHAIHYMCR

SEQ ID NO: 432745 - protein, 9 aa, Homo Sapiens
IFPAPDLPA

SEQ ID NO: 432746 - protein, 9 aa, Homo Sapiens
VSDERIHLG

SEQ ID NO: 432747 - protein, 9 aa, Homo Sapiens
RRKQLLLDE

SEQ ID NO: 432748 - protein, 9 aa, Homo Sapiens
PSLCCVQTA

SEQ ID NO: 432749 - protein, 9 aa, Homo Sapiens
MCISDAFGE

SEQ ID NO: 432750 - protein, 9 aa, Homo Sapiens
ATSNHCLDA

SEQ ID NO: 432751 - protein, 9 aa, Homo Sapiens
SSRSCLRRF

SEQ ID NO: 432752 - protein, 9 aa, Homo Sapiens
VLGEIPNPS

SEQ ID NO: 432753 - protein, 9 aa, Homo Sapiens
QAEHVLLAL

SEQ ID NO: 432754 - protein, 9 aa, Homo Sapiens
ETGYIVISN

SEQ ID NO: 432755 - protein, 9 aa, Homo Sapiens
PNSCSPRVG

SEQ ID NO: 432756 - protein, 9 aa, Homo Sapiens
GQVAININD

SEQ ID NO: 432757 - protein, 9 aa, Homo Sapiens
PEYKIFFVM

SEQ ID NO: 432758 - protein, 9 aa, Homo Sapiens
YEKSYALAV

SEQ ID NO: 432759 - protein, 9 aa, Homo Sapiens
VTPLLNHLV

SEQ ID NO: 432760 - protein, 9 aa, Homo Sapiens
RNLQIIATR

SEQ ID NO: 432761 - protein, 9 aa, Homo Sapiens
CEVKCMPTL

SEQ ID NO: 432762 - protein, 9 aa, Homo Sapiens
DYFQKMILR

SEQ ID NO: 432763 - protein, 9 aa, Homo Sapiens
SQKLTRQLL

SEQ ID NO: 432764 - protein, 9 aa, Homo Sapiens
SRDKPEPEQ

SEQ ID NO: 432765 - protein, 9 aa, Homo Sapiens
TVNNDDSDI

SEQ ID NO: 432766 - protein, 9 aa, Homo Sapiens
APGHMSGMG

SEQ ID NO: 432767 - protein, 9 aa, Homo Sapiens
NMLCAGFHE

SEQ ID NO: 432768 - protein, 9 aa, Homo Sapiens
TSMDTASHS

SEQ ID NO: 432769 - protein, 9 aa, Homo Sapiens
ELRHREITL

SEQ ID NO: 432770 - protein, 9 aa, Homo Sapiens
KVFTEQAEQ

SEQ ID NO: 432771 - protein, 9 aa, Homo Sapiens
FGKVCYLEY

SEQ ID NO: 432772 - protein, 9 aa, Homo Sapiens
DGACRTQLQ

SEQ ID NO: 432773 - protein, 9 aa, Homo Sapiens
TAKFKDCYQ

SEQ ID NO: 432774 - protein, 9 aa, Homo Sapiens
RKVINFEQA

SEQ ID NO: 432775 - protein, 9 aa, Homo Sapiens
ERYLEKCYG

SEQ ID NO: 432776 - protein, 9 aa, Homo Sapiens
AHLAYGSRV

SEQ ID NO: 432777 - protein, 9 aa, Homo Sapiens
DVGPHRDMV

SEQ ID NO: 432778 - protein, 9 aa, Homo Sapiens
CTLPTVLDI

SEQ ID NO: 432779 - protein, 9 aa, Homo Sapiens
KPYSYVEKD

SEQ ID NO: 432780 - protein, 9 aa, Homo Sapiens
PTFQMFAKG

SEQ ID NO: 432781 - protein, 9 aa, Homo Sapiens
VGKPDFVME

SEQ ID NO: 432782 - protein, 9 aa, Homo Sapiens
RLPRTIGMS

SEQ ID NO: 432783 - protein, 9 aa, Homo Sapiens
ATDYTKPKT

SEQ ID NO: 432784 - protein, 9 aa, Homo Sapiens
PISDLNADK

SEQ ID NO: 432785 - protein, 9 aa, Homo Sapiens
KSEEGQLVQ

SEQ ID NO: 432786 - protein, 9 aa, Homo Sapiens
SVDAGEEQD

SEQ ID NO: 432787 - protein, 9 aa, Homo Sapiens
VQTVASATT

SEQ ID NO: 432788 - protein, 9 aa, Homo Sapiens
VMDYSLLMS

SEQ ID NO: 432789 - protein, 9 aa, Homo Sapiens
TFYRSCVTY

SEQ ID NO: 432790 - protein, 9 aa, Homo Sapiens
FQIRTTAAQ

SEQ ID NO: 432791 - protein, 9 aa, Homo Sapiens
STQYSAMLG

SEQ ID NO: 432792 - protein, 9 aa, Homo Sapiens
SARYLQTQG

SEQ ID NO: 432793 - protein, 9 aa, Homo Sapiens
EPERRLLSP

SEQ ID NO: 432794 - protein, 9 aa, Homo Sapiens
VCNRFNCPP

SEQ ID NO: 432795 - protein, 9 aa, Homo Sapiens
SLSNLELWV

SEQ ID NO: 432796 - protein, 9 aa, Homo Sapiens
VCLKEKISL

SEQ ID NO: 432797 - protein, 9 aa, Homo Sapiens
DLSKLAKAA

SEQ ID NO: 432798 - protein, 9 aa, Homo Sapiens
FLSFKSLLN

SEQ ID NO: 432799 - protein, 9 aa, Homo Sapiens
DDFEREKEH

SEQ ID NO: 432800 - protein, 9 aa, Homo Sapiens
ARHNSIQRQ

SEQ ID NO: 432801 - protein, 9 aa, Homo Sapiens
CMENILSGN

SEQ ID NO: 432802 - protein, 9 aa, Homo Sapiens
IKGSFVAFA

SEQ ID NO: 432803 - protein, 9 aa, Homo Sapiens
RYFTRKRLH

SEQ ID NO: 432804 - protein, 9 aa, Homo Sapiens
KGFFKQTVQ

SEQ ID NO: 432805 - protein, 9 aa, Homo Sapiens
NISVQVSEA

SEQ ID NO: 432806 - protein, 9 aa, Homo Sapiens
ALLDQEGNQ

SEQ ID NO: 432807 - protein, 9 aa, Homo Sapiens
NKPKQFMTF

SEQ ID NO: 432808 - protein, 9 aa, Homo Sapiens
PPGQFDSLE

SEQ ID NO: 432809 - protein, 9 aa, Homo Sapiens
RPQELCTPQ

SEQ ID NO: 432810 - protein, 9 aa, Homo Sapiens
VNLCSIRKL

SEQ ID NO: 432811 - protein, 9 aa, Homo Sapiens
ARYLQTQGS

SEQ ID NO: 432812 - protein, 9 aa, Homo Sapiens
IQVDSVNTA

SEQ ID NO: 432813 - protein, 9 aa, Homo Sapiens
LGIKMGKQG

SEQ ID NO: 432814 - protein, 9 aa, Homo Sapiens
ASQDMEDSV

SEQ ID NO: 432815 - protein, 9 aa, Homo Sapiens
PKSKRGRPP

SEQ ID NO: 432816 - protein, 9 aa, Homo Sapiens
NRKRTIYHF

SEQ ID NO: 432817 - protein, 9 aa, Homo Sapiens
MASHKIEIG

SEQ ID NO: 432818 - protein, 9 aa, Homo Sapiens
MAKVVADTI

SEQ ID NO: 432819 - protein, 9 aa, Homo Sapiens
FAVLTSILT

SEQ ID NO: 432820 - protein, 9 aa, Homo Sapiens
NALRPPRDT

SEQ ID NO: 432821 - protein, 9 aa, Homo Sapiens
TSALNNELF

SEQ ID NO: 432822 - protein, 9 aa, Homo Sapiens
RSEGAELND

SEQ ID NO: 432823 - protein, 9 aa, Homo Sapiens
ANLIKHQII

SEQ ID NO: 432824 - protein, 9 aa, Homo Sapiens
RRRQNSARN

SEQ ID NO: 432825 - protein, 9 aa, Homo Sapiens
LVISLQHRF

SEQ ID NO: 432826 - protein, 9 aa, Homo Sapiens
TQEEWGKLD

SEQ ID NO: 432827 - protein, 9 aa, Homo Sapiens
ACILLSDLG

SEQ ID NO: 432828 - protein, 9 aa, Homo Sapiens
AFAAFLIGA

SEQ ID NO: 432829 - protein, 9 aa, Homo Sapiens
GHQIRKLDQ

SEQ ID NO: 432830 - protein, 9 aa, Homo Sapiens
IIQLYDYEI

SEQ ID NO: 432831 - protein, 9 aa, Homo Sapiens
PQEPEANNS

SEQ ID NO: 432832 - protein, 9 aa, Homo Sapiens
QSPGEGNGN

SEQ ID NO: 432833 - protein, 9 aa, Homo Sapiens
LQEEEGRYL

SEQ ID NO: 432834 - protein, 9 aa, Homo Sapiens
KTVVIDPSP

SEQ ID NO: 432835 - protein, 9 aa, Homo Sapiens
AEKIIKEDY

SEQ ID NO: 432836 - protein, 9 aa, Homo Sapiens
PPPALECRI

SEQ ID NO: 432837 - protein, 9 aa, Homo Sapiens
QFYTLWTAK

SEQ ID NO: 432838 - protein, 9 aa, Homo Sapiens
SNLGCLPLL

SEQ ID NO: 432839 - protein, 9 aa, Homo Sapiens
VAELSVPLL

SEQ ID NO: 432840 - protein, 9 aa, Homo Sapiens
DTFSTQPTQ

SEQ ID NO: 432841 - protein, 9 aa, Homo Sapiens
TPPSVVMGL

SEQ ID NO: 432842 - protein, 9 aa, Homo Sapiens
LVKAVQNVG

SEQ ID NO: 432843 - protein, 9 aa, Homo Sapiens
ESTVSNNLP

SEQ ID NO: 432844 - protein, 9 aa, Homo Sapiens
GSGHQKVGA

SEQ ID NO: 432845 - protein, 9 aa, Homo Sapiens
ILFYGTLIF

SEQ ID NO: 432846 - protein, 9 aa, Homo Sapiens
KYLAQSDLF

SEQ ID NO: 432847 - protein, 9 aa, Homo Sapiens
ECVTFSLLF

SEQ ID NO: 432848 - protein, 9 aa, Homo Sapiens
EMMAFLVRN

SEQ ID NO: 432849 - protein, 9 aa, Homo Sapiens
IPALVKVLL

SEQ ID NO: 432850 - protein, 9 aa, Homo Sapiens
KMAYLARKV

SEQ ID NO: 432851 - protein, 9 aa, Homo Sapiens
IPPVNFTIK

SEQ ID NO: 432852 - protein, 9 aa, Homo Sapiens
VSTKITSYM

SEQ ID NO: 432853 - protein, 9 aa, Homo Sapiens
QEGELLLQA

SEQ ID NO: 432854 - protein, 9 aa, Homo Sapiens
NLQQNQKTQ

SEQ ID NO: 432855 - protein, 9 aa, Homo Sapiens
KMNDYAGQH

SEQ ID NO: 432856 - protein, 9 aa, Homo Sapiens
ISINGQFVV

SEQ ID NO: 432857 - protein, 9 aa, Homo Sapiens
FDSYSIEKM

SEQ ID NO: 432858 - protein, 9 aa, Homo Sapiens
VIFVLILVV

SEQ ID NO: 432859 - protein, 9 aa, Homo Sapiens
RMYDVTPPS

SEQ ID NO: 432860 - protein, 9 aa, Homo Sapiens
AAGQVAALV

SEQ ID NO: 432861 - protein, 9 aa, Homo Sapiens
HHSLEIKEG

SEQ ID NO: 432862 - protein, 9 aa, Homo Sapiens
YMTLKIWSM

SEQ ID NO: 432863 - protein, 9 aa, Homo Sapiens
AVGELSDKS

SEQ ID NO: 432864 - protein, 9 aa, Homo Sapiens
ENGTGQSHN

SEQ ID NO: 432865 - protein, 9 aa, Homo Sapiens
QLSNKKRKF

SEQ ID NO: 432866 - protein, 9 aa, Homo Sapiens
GRYRISELL

SEQ ID NO: 432867 - protein, 9 aa, Homo Sapiens
WIDRVDGGE

SEQ ID NO: 432868 - protein, 9 aa, Homo Sapiens
IQGLATLFE

SEQ ID NO: 432869 - protein, 9 aa, Homo Sapiens
RNGGANKKN

SEQ ID NO: 432870 - protein, 9 aa, Homo Sapiens
TLLYLFLVE

SEQ ID NO: 432871 - protein, 9 aa, Homo Sapiens
SSELIQHQI

SEQ ID NO: 432872 - protein, 9 aa, Homo Sapiens
KAEEWSCFF

SEQ ID NO: 432873 - protein, 9 aa, Homo Sapiens
TPLLNHLVY

SEQ ID NO: 432874 - protein, 9 aa, Homo Sapiens
TSVSVSDIL

SEQ ID NO: 432875 - protein, 9 aa, Homo Sapiens
WEQMGRYQC

SEQ ID NO: 432876 - protein, 9 aa, Homo Sapiens
ISLQHRFYG

SEQ ID NO: 432877 - protein, 9 aa, Homo Sapiens
SVQSVNDGT

SEQ ID NO: 432878 - protein, 9 aa, Homo Sapiens
LNQERVIAV

SEQ ID NO: 432879 - protein, 9 aa, Homo Sapiens
NYGCTGGEA

SEQ ID NO: 432880 - protein, 9 aa, Homo Sapiens
KISHQDMSS

SEQ ID NO: 432881 - protein, 9 aa, Homo Sapiens
CCSCCPVEC

SEQ ID NO: 432882 - protein, 9 aa, Homo Sapiens
RDRSDFNIE

SEQ ID NO: 432883 - protein, 9 aa, Homo Sapiens
SEDIKFILE

SEQ ID NO: 432884 - protein, 9 aa, Homo Sapiens
INGIYDESN

SEQ ID NO: 432885 - protein, 9 aa, Homo Sapiens
AAIFHLLKT

SEQ ID NO: 432886 - protein, 9 aa, Homo Sapiens
SLDPLREVC

SEQ ID NO: 432887 - protein, 9 aa, Homo Sapiens
KRATATVPD

SEQ ID NO: 432888 - protein, 9 aa, Homo Sapiens
PANKSRQQL

SEQ ID NO: 432889 - protein, 9 aa, Homo Sapiens
YVVQAADLL

SEQ ID NO: 432890 - protein, 9 aa, Homo Sapiens
PDSGSSAEE

SEQ ID NO: 432891 - protein, 9 aa, Homo Sapiens
EYMGRKQED

SEQ ID NO: 432892 - protein, 9 aa, Homo Sapiens
RLTAPWSAA

SEQ ID NO: 432893 - protein, 9 aa, Homo Sapiens
QLMKELADN

SEQ ID NO: 432894 - protein, 9 aa, Homo Sapiens
INLQPLIQF

SEQ ID NO: 432895 - protein, 9 aa, Homo Sapiens
RIRNVGSEV

SEQ ID NO: 432896 - protein, 9 aa, Homo Sapiens
QVPKGLNNP

SEQ ID NO: 432897 - protein, 9 aa, Homo Sapiens
GACFCPAEI

SEQ ID NO: 432898 - protein, 9 aa, Homo Sapiens
FLGLYIHFR

SEQ ID NO: 432899 - protein, 9 aa, Homo Sapiens
YKYGKKVLI

SEQ ID NO: 432900 - protein, 9 aa, Homo Sapiens
EIQRSAISY

SEQ ID NO: 432901 - protein, 9 aa, Homo Sapiens
SSAEEECTT

SEQ ID NO: 432902 - protein, 9 aa, Homo Sapiens
SASTANTQT

SEQ ID NO: 432903 - protein, 9 aa, Homo Sapiens
QVTLFTVNE

SEQ ID NO: 432904 - protein, 9 aa, Homo Sapiens
NRIKRKDFR

SEQ ID NO: 432905 - protein, 9 aa, Homo Sapiens
NPNLQSLIS

SEQ ID NO: 432906 - protein, 9 aa, Homo Sapiens
CAAKFGLKS

SEQ ID NO: 432907 - protein, 9 aa, Homo Sapiens
FSKSSALIR

SEQ ID NO: 432908 - protein, 9 aa, Homo Sapiens
KKNLFKREY

SEQ ID NO: 432909 - protein, 9 aa, Homo Sapiens
TTQRVPVAS

SEQ ID NO: 432910 - protein, 9 aa, Homo Sapiens
RFVSKKVCY

SEQ ID NO: 432911 - protein, 9 aa, Homo Sapiens
DICKSVASF

SEQ ID NO: 432912 - protein, 9 aa, Homo Sapiens
FVKLRIIAG

SEQ ID NO: 432913 - protein, 9 aa, Homo Sapiens
KPSVNYFIS

SEQ ID NO: 432914 - protein, 9 aa, Homo Sapiens
YNKRVKYQY

SEQ ID NO: 432915 - protein, 9 aa, Homo Sapiens
GQRFNPETN

SEQ ID NO: 432916 - protein, 9 aa, Homo Sapiens
NCLGIYEQE

SEQ ID NO: 432917 - protein, 9 aa, Homo Sapiens
GNNNLHILV

SEQ ID NO: 432918 - protein, 9 aa, Homo Sapiens
RVHTGDKPY

SEQ ID NO: 432919 - protein, 9 aa, Homo Sapiens
PVLQKGVEL

SEQ ID NO: 432920 - protein, 9 aa, Homo Sapiens
HMFAVNMFQ

SEQ ID NO: 432921 - protein, 9 aa, Homo Sapiens
ARNRILSRN

SEQ ID NO: 432922 - protein, 9 aa, Homo Sapiens
CMRYNLPAG

SEQ ID NO: 432923 - protein, 9 aa, Homo Sapiens
AFVGAPITR

SEQ ID NO: 432924 - protein, 9 aa, Homo Sapiens
APHSAEPGY

SEQ ID NO: 432925 - protein, 9 aa, Homo Sapiens
LNKYLEPRC

SEQ ID NO: 432926 - protein, 9 aa, Homo Sapiens
VATDDCRYK

SEQ ID NO: 432927 - protein, 9 aa, Homo Sapiens
YNLKVKVVF

SEQ ID NO: 432928 - protein, 9 aa, Homo Sapiens
VVTSAASGA

SEQ ID NO: 432929 - protein, 9 aa, Homo Sapiens
KHGLLKSQV

SEQ ID NO: 432930 - protein, 9 aa, Homo Sapiens
NVRIERDAQ

SEQ ID NO: 432931 - protein, 9 aa, Homo Sapiens
VEGTAIYLT

SEQ ID NO: 432932 - protein, 9 aa, Homo Sapiens
KQYRKMVME

SEQ ID NO: 432933 - protein, 9 aa, Homo Sapiens
ECIEGGTLK

SEQ ID NO: 432934 - protein, 9 aa, Homo Sapiens
SPCVKQGDS

SEQ ID NO: 432935 - protein, 9 aa, Homo Sapiens
SVMYADGSG

SEQ ID NO: 432936 - protein, 9 aa, Homo Sapiens
DIHSTAVKL

SEQ ID NO: 432937 - protein, 9 aa, Homo Sapiens
PPSTLPINS

SEQ ID NO: 432938 - protein, 9 aa, Homo Sapiens
NHKITSIPE

SEQ ID NO: 432939 - protein, 9 aa, Homo Sapiens
YRWLKNGSA

SEQ ID NO: 432940 - protein, 9 aa, Homo Sapiens
PSTFTYHKI

SEQ ID NO: 432941 - protein, 9 aa, Homo Sapiens
RYSLKVWAH

SEQ ID NO: 432942 - protein, 9 aa, Homo Sapiens
ELEDESLSM

SEQ ID NO: 432943 - protein, 9 aa, Homo Sapiens
IRLSKEDVW

SEQ ID NO: 432944 - protein, 9 aa, Homo Sapiens
HLLLVQNDY

SEQ ID NO: 432945 - protein, 9 aa, Homo Sapiens
DEIFSTTRY

SEQ ID NO: 432946 - protein, 9 aa, Homo Sapiens
ACTDNPNWA

SEQ ID NO: 432947 - protein, 9 aa, Homo Sapiens
NRYFISSEQ

SEQ ID NO: 432948 - protein, 9 aa, Homo Sapiens
NSALNPIIY

SEQ ID NO: 432949 - protein, 9 aa, Homo Sapiens
CQHSDLEAL

SEQ ID NO: 432950 - protein, 9 aa, Homo Sapiens
ALQAEIHQL

SEQ ID NO: 432951 - protein, 9 aa, Homo Sapiens
EYEEHLGII

SEQ ID NO: 432952 - protein, 9 aa, Homo Sapiens
KSNFVAASL

SEQ ID NO: 432953 - protein, 9 aa, Homo Sapiens
GRQLTVHGF

SEQ ID NO: 432954 - protein, 9 aa, Homo Sapiens
RRTVSQLYR

SEQ ID NO: 432955 - protein, 9 aa, Homo Sapiens
ESAPQGNLE

SEQ ID NO: 432956 - protein, 9 aa, Homo Sapiens
HCSLFVYLG

SEQ ID NO: 432957 - protein, 9 aa, Homo Sapiens
AKKTDSGSS

SEQ ID NO: 432958 - protein, 9 aa, Homo Sapiens
GKVPFKIIS

SEQ ID NO: 432959 - protein, 9 aa, Homo Sapiens
MDRMVALER

SEQ ID NO: 432960 - protein, 9 aa, Homo Sapiens
FLRKGKPCA

SEQ ID NO: 432961 - protein, 9 aa, Homo Sapiens
VWLNEYKEQ

SEQ ID NO: 432962 - protein, 9 aa, Homo Sapiens
RELVDLIPK

SEQ ID NO: 432963 - protein, 9 aa, Homo Sapiens
KIQHMITRI

SEQ ID NO: 432964 - protein, 9 aa, Homo Sapiens
RFNKWENYF

SEQ ID NO: 432965 - protein, 9 aa, Homo Sapiens
EVKAASPGH

SEQ ID NO: 432966 - protein, 9 aa, Homo Sapiens
ARYFTRKRL

SEQ ID NO: 432967 - protein, 9 aa, Homo Sapiens
EPHHNYVTR

SEQ ID NO: 432968 - protein, 9 aa, Homo Sapiens
SFTYYCSGE

SEQ ID NO: 432969 - protein, 9 aa, Homo Sapiens
LSNHHRVHT

SEQ ID NO: 432970 - protein, 9 aa, Homo Sapiens
NYKQTCIRI

SEQ ID NO: 432971 - protein, 9 aa, Homo Sapiens
STLARDNEL

SEQ ID NO: 432972 - protein, 9 aa, Homo Sapiens
SEVECPRRQ

SEQ ID NO: 432973 - protein, 9 aa, Homo Sapiens
NISPTMLPQ

SEQ ID NO: 432974 - protein, 9 aa, Homo Sapiens
LIWAQQKEN

SEQ ID NO: 432975 - protein, 9 aa, Homo Sapiens
QRFQDTLKI

SEQ ID NO: 432976 - protein, 9 aa, Homo Sapiens
DLHSQLPTL

SEQ ID NO: 432977 - protein, 9 aa, Homo Sapiens
GSSVSHCGL

SEQ ID NO: 432978 - protein, 9 aa, Homo Sapiens
VGWQVCKTC

SEQ ID NO: 432979 - protein, 9 aa, Homo Sapiens
SLFIGTEIV

SEQ ID NO: 432980 - protein, 9 aa, Homo Sapiens
AVDVREGRV

SEQ ID NO: 432981 - protein, 9 aa, Homo Sapiens
ALSNTVALW

SEQ ID NO: 432982 - protein, 9 aa, Homo Sapiens
MACHQQNKI

SEQ ID NO: 432983 - protein, 9 aa, Homo Sapiens
EYSIFDNYY

SEQ ID NO: 432984 - protein, 9 aa, Homo Sapiens
EMNQGVSDE

SEQ ID NO: 432985 - protein, 9 aa, Homo Sapiens
ESLLNTLGL

SEQ ID NO: 432986 - protein, 9 aa, Homo Sapiens
WRVFQFQPI

SEQ ID NO: 432987 - protein, 9 aa, Homo Sapiens
HVPLTCPSS

SEQ ID NO: 432988 - protein, 9 aa, Homo Sapiens
SREIYSTDY

SEQ ID NO: 432989 - protein, 9 aa, Homo Sapiens
NFVELGDFI

SEQ ID NO: 432990 - protein, 9 aa, Homo Sapiens
TCAINKVLM

SEQ ID NO: 432991 - protein, 9 aa, Homo Sapiens
SKCFLGQLS

SEQ ID NO: 432992 - protein, 9 aa, Homo Sapiens
AGKFTRRAF

SEQ ID NO: 432993 - protein, 9 aa, Homo Sapiens
RHNYHKAGT

SEQ ID NO: 432994 - protein, 9 aa, Homo Sapiens
PRINVTAAA

SEQ ID NO: 432995 - protein, 9 aa, Homo Sapiens
ELNEMIYHE

SEQ ID NO: 432996 - protein, 9 aa, Homo Sapiens
QLFSAHLFG

SEQ ID NO: 432997 - protein, 9 aa, Homo Sapiens
LEYINLVCG

SEQ ID NO: 432998 - protein, 9 aa, Homo Sapiens
RSKVTFQPP

SEQ ID NO: 432999 - protein, 9 aa, Homo Sapiens
VNIAEGNPL

SEQ ID NO: 433000 - protein, 9 aa, Homo Sapiens
IQHVDVIKN

SEQ ID NO: 433001 - protein, 9 aa, Homo Sapiens
YAHKNWKIK

SEQ ID NO: 433002 - protein, 9 aa, Homo Sapiens
LRIEDNMDG

SEQ ID NO: 433003 - protein, 9 aa, Homo Sapiens
QDVMLEIYN

SEQ ID NO: 433004 - protein, 9 aa, Homo Sapiens
SREGHVQVL

SEQ ID NO: 433005 - protein, 9 aa, Homo Sapiens
NWWHYEHQN

SEQ ID NO: 433006 - protein, 9 aa, Homo Sapiens
VLEDSIDPV

SEQ ID NO: 433007 - protein, 9 aa, Homo Sapiens
LEQELQDLQ

SEQ ID NO: 433008 - protein, 9 aa, Homo Sapiens
TRRKEMTHK

SEQ ID NO: 433009 - protein, 9 aa, Homo Sapiens
KLAEKTDTS

SEQ ID NO: 433010 - protein, 9 aa, Homo Sapiens
SYPTPGNPC

SEQ ID NO: 433011 - protein, 9 aa, Homo Sapiens
SGLINHQII

SEQ ID NO: 433012 - protein, 9 aa, Homo Sapiens
KDTINVLSK

SEQ ID NO: 433013 - protein, 9 aa, Homo Sapiens
ALGDAKWQL

SEQ ID NO: 433014 - protein, 9 aa, Homo Sapiens
VSVRSMKRS

SEQ ID NO: 433015 - protein, 9 aa, Homo Sapiens
GEKTYKCKE

SEQ ID NO: 433016 - protein, 9 aa, Homo Sapiens
PNFISRYQI

SEQ ID NO: 433017 - protein, 9 aa, Homo Sapiens
ELTARYFTR

SEQ ID NO: 433018 - protein, 9 aa, Homo Sapiens
LTNKNYRAS

SEQ ID NO: 433019 - protein, 9 aa, Homo Sapiens
VAGVAFACY

SEQ ID NO: 433020 - protein, 9 aa, Homo Sapiens
MEWPTDLAI

SEQ ID NO: 433021 - protein, 9 aa, Homo Sapiens
LGRDSKKRR

SEQ ID NO: 433022 - protein, 9 aa, Homo Sapiens
RPHLEGRNE

SEQ ID NO: 433023 - protein, 9 aa, Homo Sapiens
LSNTVALWE

SEQ ID NO: 433024 - protein, 9 aa, Homo Sapiens
GNLAEQACA

SEQ ID NO: 433025 - protein, 9 aa, Homo Sapiens
SHRVCIILA

SEQ ID NO: 433026 - protein, 9 aa, Homo Sapiens
ISSHSHQQM

SEQ ID NO: 433027 - protein, 9 aa, Homo Sapiens
AIPELDVYE

SEQ ID NO: 433028 - protein, 9 aa, Homo Sapiens
TGYCYSNKE

SEQ ID NO: 433029 - protein, 9 aa, Homo Sapiens
SEIPMIPGS

SEQ ID NO: 433030 - protein, 9 aa, Homo Sapiens
IYKNKMQRA

SEQ ID NO: 433031 - protein, 9 aa, Homo Sapiens
QPQIVEMKK

SEQ ID NO: 433032 - protein, 9 aa, Homo Sapiens
LGKIINMNI

SEQ ID NO: 433033 - protein, 9 aa, Homo Sapiens
LTGTSEYLL

SEQ ID NO: 433034 - protein, 9 aa, Homo Sapiens
HVTVYHKGR

SEQ ID NO: 433035 - protein, 9 aa, Homo Sapiens
SHDCPCHHG

SEQ ID NO: 433036 - protein, 9 aa, Homo Sapiens
VNSQNPRRP

SEQ ID NO: 433037 - protein, 9 aa, Homo Sapiens
IISLKKPLN

SEQ ID NO: 433038 - protein, 9 aa, Homo Sapiens
SSELLDLSS

SEQ ID NO: 433039 - protein, 9 aa, Homo Sapiens
GKKPILDSV

SEQ ID NO: 433040 - protein, 9 aa, Homo Sapiens
LVFNAFFSL

SEQ ID NO: 433041 - protein, 9 aa, Homo Sapiens
EDLDTEDDS

SEQ ID NO: 433042 - protein, 9 aa, Homo Sapiens
MEVSWNVIA

SEQ ID NO: 433043 - protein, 9 aa, Homo Sapiens
AALDTEVAS

SEQ ID NO: 433044 - protein, 9 aa, Homo Sapiens
FSTGLLVMK

SEQ ID NO: 433045 - protein, 9 aa, Homo Sapiens
ESLSMACHQ

SEQ ID NO: 433046 - protein, 9 aa, Homo Sapiens
GACAVEGSN

SEQ ID NO: 433047 - protein, 9 aa, Homo Sapiens
ILKVIPRDW

SEQ ID NO: 433048 - protein, 9 aa, Homo Sapiens
EWGGAHIFK

SEQ ID NO: 433049 - protein, 9 aa, Homo Sapiens
CLGLQLVKR

SEQ ID NO: 433050 - protein, 9 aa, Homo Sapiens
VDNLTNKNY

SEQ ID NO: 433051 - protein, 9 aa, Homo Sapiens
LEKVANVSV

SEQ ID NO: 433052 - protein, 9 aa, Homo Sapiens
GCHPACLVN

SEQ ID NO: 433053 - protein, 9 aa, Homo Sapiens
KMRSSNLAS

SEQ ID NO: 433054 - protein, 9 aa, Homo Sapiens
HTTFDWPPK

SEQ ID NO: 433055 - protein, 9 aa, Homo Sapiens
DNTNEMYSG

SEQ ID NO: 433056 - protein, 9 aa, Homo Sapiens
CEKDDLSCP

SEQ ID NO: 433057 - protein, 9 aa, Homo Sapiens
NDSFRDLFI

SEQ ID NO: 433058 - protein, 9 aa, Homo Sapiens
DPEDAVSVR

SEQ ID NO: 433059 - protein, 9 aa, Homo Sapiens
PESGLWVSH

SEQ ID NO: 433060 - protein, 9 aa, Homo Sapiens
IEIYRFGYA

SEQ ID NO: 433061 - protein, 9 aa, Homo Sapiens
SAPAACKHL

SEQ ID NO: 433062 - protein, 9 aa, Homo Sapiens
IKAIVDKLH

SEQ ID NO: 433063 - protein, 9 aa, Homo Sapiens
HNMFSHRLP

SEQ ID NO: 433064 - protein, 9 aa, Homo Sapiens
KRLDPAQIK

SEQ ID NO: 433065 - protein, 9 aa, Homo Sapiens
EKGKWLAAF

SEQ ID NO: 433066 - protein, 9 aa, Homo Sapiens
HCRINTGEK

SEQ ID NO: 433067 - protein, 9 aa, Homo Sapiens
VNMHSSVWY

SEQ ID NO: 433068 - protein, 9 aa, Homo Sapiens
SEIIEKNKD

SEQ ID NO: 433069 - protein, 9 aa, Homo Sapiens
LEQISFQWS

SEQ ID NO: 433070 - protein, 9 aa, Homo Sapiens
AGLPNMLGM

SEQ ID NO: 433071 - protein, 9 aa, Homo Sapiens
SFHFRASYA

SEQ ID NO: 433072 - protein, 9 aa, Homo Sapiens
QYIRISPDN

SEQ ID NO: 433073 - protein, 9 aa, Homo Sapiens
KKEDYKKTK

SEQ ID NO: 433074 - protein, 9 aa, Homo Sapiens
DADEGTLKE

SEQ ID NO: 433075 - protein, 9 aa, Homo Sapiens
EGLDDTLVD

SEQ ID NO: 433076 - protein, 9 aa, Homo Sapiens
VIYKNKMQR

SEQ ID NO: 433077 - protein, 9 aa, Homo Sapiens
KAGITASVS

SEQ ID NO: 433078 - protein, 9 aa, Homo Sapiens
DKREQKLKF

SEQ ID NO: 433079 - protein, 9 aa, Homo Sapiens
ITLDSEKPK

SEQ ID NO: 433080 - protein, 9 aa, Homo Sapiens
ATIQEELGY

SEQ ID NO: 433081 - protein, 9 aa, Homo Sapiens
ENGPHTYQS

SEQ ID NO: 433082 - protein, 9 aa, Homo Sapiens
SLDIIARIC

SEQ ID NO: 433083 - protein, 9 aa, Homo Sapiens
DLIGPKGDI

SEQ ID NO: 433084 - protein, 9 aa, Homo Sapiens
LKVIPRDWK

SEQ ID NO: 433085 - protein, 9 aa, Homo Sapiens
RMGNIINEI

SEQ ID NO: 433086 - protein, 9 aa, Homo Sapiens
GGKYSVKKK

SEQ ID NO: 433087 - protein, 9 aa, Homo Sapiens
MAGLPNMLG

SEQ ID NO: 433088 - protein, 9 aa, Homo Sapiens
HYKWHKFVY

SEQ ID NO: 433089 - protein, 9 aa, Homo Sapiens
FAPDNKLST

SEQ ID NO: 433090 - protein, 9 aa, Homo Sapiens
LLRESIYYT

SEQ ID NO: 433091 - protein, 9 aa, Homo Sapiens
EECKNLIKF

SEQ ID NO: 433092 - protein, 9 aa, Homo Sapiens
QRLARLWNF

SEQ ID NO: 433093 - protein, 9 aa, Homo Sapiens
IQPHMLVEL

SEQ ID NO: 433094 - protein, 9 aa, Homo Sapiens
VDESEKNNS

SEQ ID NO: 433095 - protein, 9 aa, Homo Sapiens
HFSNLGCLP

SEQ ID NO: 433096 - protein, 9 aa, Homo Sapiens
QSGKLRMQI

SEQ ID NO: 433097 - protein, 9 aa, Homo Sapiens
HNSLEWAFH

SEQ ID NO: 433098 - protein, 9 aa, Homo Sapiens
RPLLDVLRE

SEQ ID NO: 433099 - protein, 9 aa, Homo Sapiens
RVLYAPPKE

SEQ ID NO: 433100 - protein, 9 aa, Homo Sapiens
DYSVSNCVD

SEQ ID NO: 433101 - protein, 9 aa, Homo Sapiens
AKAGKVPLS

SEQ ID NO: 433102 - protein, 9 aa, Homo Sapiens
QRGCFLRIR

SEQ ID NO: 433103 - protein, 9 aa, Homo Sapiens
PAYVHCSFC

SEQ ID NO: 433104 - protein, 9 aa, Homo Sapiens
VRCIEQTHT

SEQ ID NO: 433105 - protein, 9 aa, Homo Sapiens
SGTVHSSWH

SEQ ID NO: 433106 - protein, 9 aa, Homo Sapiens
KAEEERICM

SEQ ID NO: 433107 - protein, 9 aa, Homo Sapiens
LSRHQILHT

SEQ ID NO: 433108 - protein, 9 aa, Homo Sapiens
VPAMWTLAC

SEQ ID NO: 433109 - protein, 9 aa, Homo Sapiens
NTAAIKNTD

SEQ ID NO: 433110 - protein, 9 aa, Homo Sapiens
AGMTDFPNI

SEQ ID NO: 433111 - protein, 9 aa, Homo Sapiens
SACFVTSYL

SEQ ID NO: 433112 - protein, 9 aa, Homo Sapiens
ENPHASTMA

SEQ ID NO: 433113 - protein, 9 aa, Homo Sapiens
NKVSDLCYS

SEQ ID NO: 433114 - protein, 9 aa, Homo Sapiens
TKDTALKHS

SEQ ID NO: 433115 - protein, 9 aa, Homo Sapiens
REHQYLLEE

SEQ ID NO: 433116 - protein, 9 aa, Homo Sapiens
MVHGPKPET

SEQ ID NO: 433117 - protein, 9 aa, Homo Sapiens
KITSIPETE

SEQ ID NO: 433118 - protein, 9 aa, Homo Sapiens
VDFRNMAYL

SEQ ID NO: 433119 - protein, 9 aa, Homo Sapiens
RLFVPPNIK

SEQ ID NO: 433120 - protein, 9 aa, Homo Sapiens
FMHMFQYSW

SEQ ID NO: 433121 - protein, 9 aa, Homo Sapiens
ELFTCPTPG

SEQ ID NO: 433122 - protein, 9 aa, Homo Sapiens
PGKVWWRLC

SEQ ID NO: 433123 - protein, 9 aa, Homo Sapiens
HYMGKLVGR

SEQ ID NO: 433124 - protein, 9 aa, Homo Sapiens
ISQATDLEQ

SEQ ID NO: 433125 - protein, 9 aa, Homo Sapiens
ILNAHQPIT

SEQ ID NO: 433126 - protein, 9 aa, Homo Sapiens
ENSSEKNED

SEQ ID NO: 433127 - protein, 9 aa, Homo Sapiens
ARCHVPAGL

SEQ ID NO: 433128 - protein, 9 aa, Homo Sapiens
SQHPYADNF

SEQ ID NO: 433129 - protein, 9 aa, Homo Sapiens
LYVLISFIP

SEQ ID NO: 433130 - protein, 9 aa, Homo Sapiens
PVSSSRCGH

SEQ ID NO: 433131 - protein, 9 aa, Homo Sapiens
LDVYEAEGL

SEQ ID NO: 433132 - protein, 9 aa, Homo Sapiens
KIVEFIQSF

SEQ ID NO: 433133 - protein, 9 aa, Homo Sapiens
IKIDQAWKI

SEQ ID NO: 433134 - protein, 9 aa, Homo Sapiens
NLHAIHYMC

SEQ ID NO: 433135 - protein, 9 aa, Homo Sapiens
YLLDNLGND

SEQ ID NO: 433136 - protein, 9 aa, Homo Sapiens
STNLNKYKK

SEQ ID NO: 433137 - protein, 9 aa, Homo Sapiens
NNTLSGSSY

SEQ ID NO: 433138 - protein, 9 aa, Homo Sapiens
QVNLVASTA

SEQ ID NO: 433139 - protein, 9 aa, Homo Sapiens
NVKFSIKKE

SEQ ID NO: 433140 - protein, 9 aa, Homo Sapiens
LLILIRLWR

SEQ ID NO: 433141 - protein, 9 aa, Homo Sapiens
DRDKLLKQM

SEQ ID NO: 433142 - protein, 9 aa, Homo Sapiens
GQSYGTYSP

SEQ ID NO: 433143 - protein, 9 aa, Homo Sapiens
GIFNRSFQT

SEQ ID NO: 433144 - protein, 9 aa, Homo Sapiens
VIVWQLQEL

SEQ ID NO: 433145 - protein, 9 aa, Homo Sapiens
NCTCGIVWL

SEQ ID NO: 433146 - protein, 9 aa, Homo Sapiens
YRISELLGM

SEQ ID NO: 433147 - protein, 9 aa, Homo Sapiens
WKCMFFERH

SEQ ID NO: 433148 - protein, 9 aa, Homo Sapiens
IFDSPCPKA

SEQ ID NO: 433149 - protein, 9 aa, Homo Sapiens
KCMPTLQFF

SEQ ID NO: 433150 - protein, 9 aa, Homo Sapiens
LSGAEFEGE

SEQ ID NO: 433151 - protein, 9 aa, Homo Sapiens
LKEVVSRNC

SEQ ID NO: 433152 - protein, 9 aa, Homo Sapiens
PDLVNTYAI

SEQ ID NO: 433153 - protein, 9 aa, Homo Sapiens
QEAQFYTLW

SEQ ID NO: 433154 - protein, 9 aa, Homo Sapiens
QIMDEALKI

SEQ ID NO: 433155 - protein, 9 aa, Homo Sapiens
EEALINGYG

SEQ ID NO: 433156 - protein, 9 aa, Homo Sapiens
DLPFPDGMD

SEQ ID NO: 433157 - protein, 9 aa, Homo Sapiens
GNDLYLWPA

SEQ ID NO: 433158 - protein, 9 aa, Homo Sapiens
TFVCHTEKF

SEQ ID NO: 433159 - protein, 9 aa, Homo Sapiens
GVLRGSGHQ

SEQ ID NO: 433160 - protein, 9 aa, Homo Sapiens
SQNLRIEDN

SEQ ID NO: 433161 - protein, 9 aa, Homo Sapiens
SRPAMYYVS

SEQ ID NO: 433162 - protein, 9 aa, Homo Sapiens
KGNTEEAGR

SEQ ID NO: 433163 - protein, 9 aa, Homo Sapiens
GLESNNFEM

SEQ ID NO: 433164 - protein, 9 aa, Homo Sapiens
KRLLLRKDT

SEQ ID NO: 433165 - protein, 9 aa, Homo Sapiens
SLPLVEIWL

SEQ ID NO: 433166 - protein, 9 aa, Homo Sapiens
GGVRGLYGL

SEQ ID NO: 433167 - protein, 9 aa, Homo Sapiens
DEIVVTKKS

SEQ ID NO: 433168 - protein, 9 aa, Homo Sapiens
AGSGSGSGN

SEQ ID NO: 433169 - protein, 9 aa, Homo Sapiens
YMFYTLGIP

SEQ ID NO: 433170 - protein, 9 aa, Homo Sapiens
KESKNEDRK

SEQ ID NO: 433171 - protein, 9 aa, Homo Sapiens
MADKVLWVL

SEQ ID NO: 433172 - protein, 9 aa, Homo Sapiens
LESNNFEML

SEQ ID NO: 433173 - protein, 9 aa, Homo Sapiens
GYEIKMFCT

SEQ ID NO: 433174 - protein, 9 aa, Homo Sapiens
QLDIHHQIH

SEQ ID NO: 433175 - protein, 9 aa, Homo Sapiens
VEGAAAGKN

SEQ ID NO: 433176 - protein, 9 aa, Homo Sapiens
VFLGGVSWD

SEQ ID NO: 433177 - protein, 9 aa, Homo Sapiens
QNERKLELV

SEQ ID NO: 433178 - protein, 9 aa, Homo Sapiens
KLHSHGHLP

SEQ ID NO: 433179 - protein, 9 aa, Homo Sapiens
GSLKKLQQT

SEQ ID NO: 433180 - protein, 9 aa, Homo Sapiens
KAAAHAVAT

SEQ ID NO: 433181 - protein, 9 aa, Homo Sapiens
AHKRGSQND

SEQ ID NO: 433182 - protein, 9 aa, Homo Sapiens
ILESAETEE

SEQ ID NO: 433183 - protein, 9 aa, Homo Sapiens
LLKHKCWQN

SEQ ID NO: 433184 - protein, 9 aa, Homo Sapiens
LLLGSVFLV

SEQ ID NO: 433185 - protein, 9 aa, Homo Sapiens
QMRKMSKHA

SEQ ID NO: 433186 - protein, 9 aa, Homo Sapiens
QLVIHHKGH

SEQ ID NO: 433187 - protein, 9 aa, Homo Sapiens
QSRYQSDPN

SEQ ID NO: 433188 - protein, 9 aa, Homo Sapiens
IIFAPPAQK

SEQ ID NO: 433189 - protein, 9 aa, Homo Sapiens
DDENFFTTG

SEQ ID NO: 433190 - protein, 9 aa, Homo Sapiens
SLLSMSSTN

SEQ ID NO: 433191 - protein, 9 aa, Homo Sapiens
LDISNSRLE

SEQ ID NO: 433192 - protein, 9 aa, Homo Sapiens
IADACFVST

SEQ ID NO: 433193 - protein, 9 aa, Homo Sapiens
TCHICKMPL

SEQ ID NO: 433194 - protein, 9 aa, Homo Sapiens
KVCKLNDLI

SEQ ID NO: 433195 - protein, 9 aa, Homo Sapiens
ETAWLSITV

SEQ ID NO: 433196 - protein, 9 aa, Homo Sapiens
PVTNLQKHM

SEQ ID NO: 433197 - protein, 9 aa, Homo Sapiens
EPCRVEQYS

SEQ ID NO: 433198 - protein, 9 aa, Homo Sapiens
KKFVNTMVL

SEQ ID NO: 433199 - protein, 9 aa, Homo Sapiens
TYQQLLKHK

SEQ ID NO: 433200 - protein, 9 aa, Homo Sapiens
NPGDSEESL

SEQ ID NO: 433201 - protein, 9 aa, Homo Sapiens
PPSKDASSL

SEQ ID NO: 433202 - protein, 9 aa, Homo Sapiens
EAISCQARQ

SEQ ID NO: 433203 - protein, 9 aa, Homo Sapiens
QQVTMVSYT

SEQ ID NO: 433204 - protein, 9 aa, Homo Sapiens
KAHTYSIVI

SEQ ID NO: 433205 - protein, 9 aa, Homo Sapiens
YITERHNCQ

SEQ ID NO: 433206 - protein, 9 aa, Homo Sapiens
ANNFPAHIF

SEQ ID NO: 433207 - protein, 9 aa, Homo Sapiens
LCVEKIAFY

SEQ ID NO: 433208 - protein, 9 aa, Homo Sapiens
PSEHSPDQG

SEQ ID NO: 433209 - protein, 9 aa, Homo Sapiens
ERYSDDDSS

SEQ ID NO: 433210 - protein, 9 aa, Homo Sapiens
VENSVKVQP

SEQ ID NO: 433211 - protein, 9 aa, Homo Sapiens
SSCLSDHFQ

SEQ ID NO: 433212 - protein, 9 aa, Homo Sapiens
THVAEVAPK

SEQ ID NO: 433213 - protein, 9 aa, Homo Sapiens
YEDIVGYLP

SEQ ID NO: 433214 - protein, 9 aa, Homo Sapiens
EQGIEDYFQ

SEQ ID NO: 433215 - protein, 9 aa, Homo Sapiens
CIRFISRHR

SEQ ID NO: 433216 - protein, 9 aa, Homo Sapiens
KAFRWSSTL

SEQ ID NO: 433217 - protein, 9 aa, Homo Sapiens
EDTETLKVI

SEQ ID NO: 433218 - protein, 9 aa, Homo Sapiens
LAPQGRLIK

SEQ ID NO: 433219 - protein, 9 aa, Homo Sapiens
KYFLSQPSL

SEQ ID NO: 433220 - protein, 9 aa, Homo Sapiens
NYNLKVKVV

SEQ ID NO: 433221 - protein, 9 aa, Homo Sapiens
EQIDTVTGP

SEQ ID NO: 433222 - protein, 9 aa, Homo Sapiens
AKTKRLTKA

SEQ ID NO: 433223 - protein, 9 aa, Homo Sapiens
PVVTHPIYK

SEQ ID NO: 433224 - protein, 9 aa, Homo Sapiens
IPLQKQNYL

SEQ ID NO: 433225 - protein, 9 aa, Homo Sapiens
LHTIVQGFF

SEQ ID NO: 433226 - protein, 9 aa, Homo Sapiens
DWLVPGRQD

SEQ ID NO: 433227 - protein, 9 aa, Homo Sapiens
TSSQSSSSS

SEQ ID NO: 433228 - protein, 9 aa, Homo Sapiens
WLLYAQNVV

SEQ ID NO: 433229 - protein, 9 aa, Homo Sapiens
TFICQNKEQ

SEQ ID NO: 433230 - protein, 9 aa, Homo Sapiens
ARLSLCLLL

SEQ ID NO: 433231 - protein, 9 aa, Homo Sapiens
YSWNDFADF

SEQ ID NO: 433232 - protein, 9 aa, Homo Sapiens
SERYELIVD

SEQ ID NO: 433233 - protein, 9 aa, Homo Sapiens
LQHLLLVQN

SEQ ID NO: 433234 - protein, 9 aa, Homo Sapiens
ISCLLLITA

SEQ ID NO: 433235 - protein, 9 aa, Homo Sapiens
LLRHNKSCA

SEQ ID NO: 433236 - protein, 9 aa, Homo Sapiens
SVLQKHQII

SEQ ID NO: 433237 - protein, 9 aa, Homo Sapiens
GCLQCGKAF

SEQ ID NO: 433238 - protein, 9 aa, Homo Sapiens
PTQHSITDN

SEQ ID NO: 433239 - protein, 9 aa, Homo Sapiens
EELNEMIYH

SEQ ID NO: 433240 - protein, 9 aa, Homo Sapiens
LTLVFELCD

SEQ ID NO: 433241 - protein, 9 aa, Homo Sapiens
SDTASEVDC

SEQ ID NO: 433242 - protein, 9 aa, Homo Sapiens
RPWGWFLGS

SEQ ID NO: 433243 - protein, 9 aa, Homo Sapiens
KREVKQKVS

SEQ ID NO: 433244 - protein, 9 aa, Homo Sapiens
GVHLLPPST

SEQ ID NO: 433245 - protein, 9 aa, Homo Sapiens
HSNYRAGMT

SEQ ID NO: 433246 - protein, 9 aa, Homo Sapiens
YMKNSDVSK

SEQ ID NO: 433247 - protein, 9 aa, Homo Sapiens
EQRIKLIVM

SEQ ID NO: 433248 - protein, 9 aa, Homo Sapiens
EGLVNNKYG

SEQ ID NO: 433249 - protein, 9 aa, Homo Sapiens
RRILTRNEN

SEQ ID NO: 433250 - protein, 9 aa, Homo Sapiens
HVLKVCNHE

SEQ ID NO: 433251 - protein, 9 aa, Homo Sapiens
YYCSGENLD

SEQ ID NO: 433252 - protein, 9 aa, Homo Sapiens
PLQDRSLFE

SEQ ID NO: 433253 - protein, 9 aa, Homo Sapiens
SKDIVDNYF

SEQ ID NO: 433254 - protein, 9 aa, Homo Sapiens
TEELAVFMK

SEQ ID NO: 433255 - protein, 9 aa, Homo Sapiens
RRCTKLDMA

SEQ ID NO: 433256 - protein, 9 aa, Homo Sapiens
HVNVTLNIH

SEQ ID NO: 433257 - protein, 9 aa, Homo Sapiens
EGHSEAVIY

SEQ ID NO: 433258 - protein, 9 aa, Homo Sapiens
ATDVLRCVN

SEQ ID NO: 433259 - protein, 9 aa, Homo Sapiens
DRMVRSLES

SEQ ID NO: 433260 - protein, 9 aa, Homo Sapiens
YVRNTFHKA

SEQ ID NO: 433261 - protein, 9 aa, Homo Sapiens
NIQFRSDEE

SEQ ID NO: 433262 - protein, 9 aa, Homo Sapiens
PEAAKFRQL

SEQ ID NO: 433263 - protein, 9 aa, Homo Sapiens
TTGYDIAMQ

SEQ ID NO: 433264 - protein, 9 aa, Homo Sapiens
WKTSSFLDQ

SEQ ID NO: 433265 - protein, 9 aa, Homo Sapiens
STVSNNLPV

SEQ ID NO: 433266 - protein, 9 aa, Homo Sapiens
GGGDVSPQK

SEQ ID NO: 433267 - protein, 9 aa, Homo Sapiens
GGSCTKKKR

SEQ ID NO: 433268 - protein, 9 aa, Homo Sapiens
LLSWGPNFN

SEQ ID NO: 433269 - protein, 9 aa, Homo Sapiens
IPPEMSNKL

SEQ ID NO: 433270 - protein, 9 aa, Homo Sapiens
HVANPQLQM

SEQ ID NO: 433271 - protein, 9 aa, Homo Sapiens
ELIPKALST

SEQ ID NO: 433272 - protein, 9 aa, Homo Sapiens
GMVFHPQSH

SEQ ID NO: 433273 - protein, 9 aa, Homo Sapiens
HRPNTTERE

SEQ ID NO: 433274 - protein, 9 aa, Homo Sapiens
LSFATIMLN

SEQ ID NO: 433275 - protein, 9 aa, Homo Sapiens
NYKYGKKVL

SEQ ID NO: 433276 - protein, 9 aa, Homo Sapiens
LSSFFKSLV

SEQ ID NO: 433277 - protein, 9 aa, Homo Sapiens
SALNNELFA

SEQ ID NO: 433278 - protein, 9 aa, Homo Sapiens
ARRSLGLQY

SEQ ID NO: 433279 - protein, 9 aa, Homo Sapiens
GFLGCIWSL

SEQ ID NO: 433280 - protein, 9 aa, Homo Sapiens
EHALARGLV

SEQ ID NO: 433281 - protein, 9 aa, Homo Sapiens
QIIAALTKA

SEQ ID NO: 433282 - protein, 9 aa, Homo Sapiens
EFGHIQLLL

SEQ ID NO: 433283 - protein, 9 aa, Homo Sapiens
YARGWKINP

SEQ ID NO: 433284 - protein, 9 aa, Homo Sapiens
TSSCYPGYG

SEQ ID NO: 433285 - protein, 9 aa, Homo Sapiens
VEKITRRFT

SEQ ID NO: 433286 - protein, 9 aa, Homo Sapiens
PGYGEAWGT

SEQ ID NO: 433287 - protein, 9 aa, Homo Sapiens
LLARSRWQC

SEQ ID NO: 433288 - protein, 9 aa, Homo Sapiens
AFSCSPTLQ

SEQ ID NO: 433289 - protein, 9 aa, Homo Sapiens
LLLIQNSQE

SEQ ID NO: 433290 - protein, 9 aa, Homo Sapiens
STANNLLLL

SEQ ID NO: 433291 - protein, 9 aa, Homo Sapiens
NNTFIKTLQ

SEQ ID NO: 433292 - protein, 9 aa, Homo Sapiens
GKFVKNIDQ

SEQ ID NO: 433293 - protein, 9 aa, Homo Sapiens
PLKDIAWWY

SEQ ID NO: 433294 - protein, 9 aa, Homo Sapiens
KIIKEVLEE

SEQ ID NO: 433295 - protein, 9 aa, Homo Sapiens
LHVEDDSRG

SEQ ID NO: 433296 - protein, 9 aa, Homo Sapiens
EKNSQASTV

SEQ ID NO: 433297 - protein, 9 aa, Homo Sapiens
YLALYSALF

SEQ ID NO: 433298 - protein, 9 aa, Homo Sapiens
HFAPLLCKV

SEQ ID NO: 433299 - protein, 9 aa, Homo Sapiens
KKAISILSK

SEQ ID NO: 433300 - protein, 9 aa, Homo Sapiens
IDQIRTPRA

SEQ ID NO: 433301 - protein, 9 aa, Homo Sapiens
RILCLKERH

SEQ ID NO: 433302 - protein, 9 aa, Homo Sapiens
SPQKEPQEP

SEQ ID NO: 433303 - protein, 9 aa, Homo Sapiens
FKSVAFPGW

SEQ ID NO: 433304 - protein, 9 aa, Homo Sapiens
PFHYLNFSF

SEQ ID NO: 433305 - protein, 9 aa, Homo Sapiens
KYANVRLAA

SEQ ID NO: 433306 - protein, 9 aa, Homo Sapiens
SDILPLHNW

SEQ ID NO: 433307 - protein, 9 aa, Homo Sapiens
SVAAGTAEE

SEQ ID NO: 433308 - protein, 9 aa, Homo Sapiens
SMDASSSKM

SEQ ID NO: 433309 - protein, 9 aa, Homo Sapiens
GIKPYACKE

SEQ ID NO: 433310 - protein, 9 aa, Homo Sapiens
NQERVIAVH

SEQ ID NO: 433311 - protein, 9 aa, Homo Sapiens
KADIYTHNF

SEQ ID NO: 433312 - protein, 9 aa, Homo Sapiens
YFMAKINIC

SEQ ID NO: 433313 - protein, 9 aa, Homo Sapiens
DTALKHSKR

SEQ ID NO: 433314 - protein, 9 aa, Homo Sapiens
GLGDTEEIN

SEQ ID NO: 433315 - protein, 9 aa, Homo Sapiens
EDPKKEIIL

SEQ ID NO: 433316 - protein, 9 aa, Homo Sapiens
PDDAPIPRI

SEQ ID NO: 433317 - protein, 9 aa, Homo Sapiens
CLGIYEQEP

SEQ ID NO: 433318 - protein, 9 aa, Homo Sapiens
LGPLQLEIL

SEQ ID NO: 433319 - protein, 9 aa, Homo Sapiens
VYSLEGEDF

SEQ ID NO: 433320 - protein, 9 aa, Homo Sapiens
NPVFYFILG

SEQ ID NO: 433321 - protein, 9 aa, Homo Sapiens
MPLIERDRR

SEQ ID NO: 433322 - protein, 9 aa, Homo Sapiens
ESRLQVSLM

SEQ ID NO: 433323 - protein, 9 aa, Homo Sapiens
SDIEVEASD

SEQ ID NO: 433324 - protein, 9 aa, Homo Sapiens
KKVNFKELI

SEQ ID NO: 433325 - protein, 9 aa, Homo Sapiens
YRLPPLRQG

SEQ ID NO: 433326 - protein, 9 aa, Homo Sapiens
EQAVSKPQT

SEQ ID NO: 433327 - protein, 9 aa, Homo Sapiens
QTPSFLSRY

SEQ ID NO: 433328 - protein, 9 aa, Homo Sapiens
VVVWGECNS

SEQ ID NO: 433329 - protein, 9 aa, Homo Sapiens
TANLNIVLA

SEQ ID NO: 433330 - protein, 9 aa, Homo Sapiens
IVVTPDGDF

SEQ ID NO: 433331 - protein, 9 aa, Homo Sapiens
QTIWVTGRK

SEQ ID NO: 433332 - protein, 9 aa, Homo Sapiens
SPNNGNIFN

SEQ ID NO: 433333 - protein, 9 aa, Homo Sapiens
PHVCFHVNC

SEQ ID NO: 433334 - protein, 9 aa, Homo Sapiens
QQRNCEGMI

SEQ ID NO: 433335 - protein, 9 aa, Homo Sapiens
VLTFNLTKY

SEQ ID NO: 433336 - protein, 9 aa, Homo Sapiens
KLLRIQDYG

SEQ ID NO: 433337 - protein, 9 aa, Homo Sapiens
LGDHSQVLF

SEQ ID NO: 433338 - protein, 9 aa, Homo Sapiens
DPHSNSWAE

SEQ ID NO: 433339 - protein, 9 aa, Homo Sapiens
EFGLELDDI

SEQ ID NO: 433340 - protein, 9 aa, Homo Sapiens
LQTCQTVAA

SEQ ID NO: 433341 - protein, 9 aa, Homo Sapiens
STPKVPASV

SEQ ID NO: 433342 - protein, 9 aa, Homo Sapiens
TANNLLLLA

SEQ ID NO: 433343 - protein, 9 aa, Homo Sapiens
RFQDTLKIP

SEQ ID NO: 433344 - protein, 9 aa, Homo Sapiens
YTKSYWKAL

SEQ ID NO: 433345 - protein, 9 aa, Homo Sapiens
PATINARTE

SEQ ID NO: 433346 - protein, 9 aa, Homo Sapiens
RILLDMLQQ

SEQ ID NO: 433347 - protein, 9 aa, Homo Sapiens
RPSNLAVCV

SEQ ID NO: 433348 - protein, 9 aa, Homo Sapiens
EGKICECNH

SEQ ID NO: 433349 - protein, 9 aa, Homo Sapiens
NMILLTFPF

SEQ ID NO: 433350 - protein, 9 aa, Homo Sapiens
SDLCYSNDK

SEQ ID NO: 433351 - protein, 9 aa, Homo Sapiens
NSILLYGRF

SEQ ID NO: 433352 - protein, 9 aa, Homo Sapiens
LAFNVRIER

SEQ ID NO: 433353 - protein, 9 aa, Homo Sapiens
TAVAAAAPR

SEQ ID NO: 433354 - protein, 9 aa, Homo Sapiens
KKQHKIEGS

SEQ ID NO: 433355 - protein, 9 aa, Homo Sapiens
ITGHLYACQ

SEQ ID NO: 433356 - protein, 9 aa, Homo Sapiens
LCGEVNNPY

SEQ ID NO: 433357 - protein, 9 aa, Homo Sapiens
PKQYKNLYF

SEQ ID NO: 433358 - protein, 9 aa, Homo Sapiens
AESCKPGVG

SEQ ID NO: 433359 - protein, 9 aa, Homo Sapiens
YKVKPFLTA

SEQ ID NO: 433360 - protein, 9 aa, Homo Sapiens
IQDYGTLLY

SEQ ID NO: 433361 - protein, 9 aa, Homo Sapiens
DETIQFQTE

SEQ ID NO: 433362 - protein, 9 aa, Homo Sapiens
DAIKTFYQT

SEQ ID NO: 433363 - protein, 9 aa, Homo Sapiens
TGNLAEQAC

SEQ ID NO: 433364 - protein, 9 aa, Homo Sapiens
VCNYGPEGN

SEQ ID NO: 433365 - protein, 9 aa, Homo Sapiens
DPSLSELDN

SEQ ID NO: 433366 - protein, 9 aa, Homo Sapiens
KNISPTMLP

SEQ ID NO: 433367 - protein, 9 aa, Homo Sapiens
EQGKVPEMP

SEQ ID NO: 433368 - protein, 9 aa, Homo Sapiens
HLKHERLRT

SEQ ID NO: 433369 - protein, 9 aa, Homo Sapiens
VSLIKGPDF

SEQ ID NO: 433370 - protein, 9 aa, Homo Sapiens
AVITNKDVQ

SEQ ID NO: 433371 - protein, 9 aa, Homo Sapiens
EGEVPASTF

SEQ ID NO: 433372 - protein, 9 aa, Homo Sapiens
IKDPSRGQA

SEQ ID NO: 433373 - protein, 9 aa, Homo Sapiens
WNEVCHISD

SEQ ID NO: 433374 - protein, 9 aa, Homo Sapiens
EKGQHLGYS

SEQ ID NO: 433375 - protein, 9 aa, Homo Sapiens
VRFVNSLMV

SEQ ID NO: 433376 - protein, 9 aa, Homo Sapiens
YVKKKAKPN

SEQ ID NO: 433377 - protein, 9 aa, Homo Sapiens
RHNTPKGNW

SEQ ID NO: 433378 - protein, 9 aa, Homo Sapiens
LIGYAFKTV

SEQ ID NO: 433379 - protein, 9 aa, Homo Sapiens
NLGYDGRVD

SEQ ID NO: 433380 - protein, 9 aa, Homo Sapiens
GSFLAQHQI

SEQ ID NO: 433381 - protein, 9 aa, Homo Sapiens
KYPKQRRFF

SEQ ID NO: 433382 - protein, 9 aa, Homo Sapiens
PGNTKISEP

SEQ ID NO: 433383 - protein, 9 aa, Homo Sapiens
QSIKAENEP

SEQ ID NO: 433384 - protein, 9 aa, Homo Sapiens
TKPRVAEWC

SEQ ID NO: 433385 - protein, 9 aa, Homo Sapiens
KYMKEFTLE

SEQ ID NO: 433386 - protein, 9 aa, Homo Sapiens
KDGNGCIDH

SEQ ID NO: 433387 - protein, 9 aa, Homo Sapiens
DIKGNTIVP

SEQ ID NO: 433388 - protein, 9 aa, Homo Sapiens
FYTEDLLRV

SEQ ID NO: 433389 - protein, 9 aa, Homo Sapiens
LEMNQGVSD

SEQ ID NO: 433390 - protein, 9 aa, Homo Sapiens
IRGNMYYEK

SEQ ID NO: 433391 - protein, 9 aa, Homo Sapiens
LTLRAKPPL

SEQ ID NO: 433392 - protein, 9 aa, Homo Sapiens
ENSKPSVNY

SEQ ID NO: 433393 - protein, 9 aa, Homo Sapiens
LFAVRPEGS

SEQ ID NO: 433394 - protein, 9 aa, Homo Sapiens
SKVTFYILV

SEQ ID NO: 433395 - protein, 9 aa, Homo Sapiens
IIKLFNEMA

SEQ ID NO: 433396 - protein, 9 aa, Homo Sapiens
CVAGSALSG

SEQ ID NO: 433397 - protein, 9 aa, Homo Sapiens
YVDLNQTIF

SEQ ID NO: 433398 - protein, 9 aa, Homo Sapiens
MMLLCEGLW

SEQ ID NO: 433399 - protein, 9 aa, Homo Sapiens
LRTVKCYNP

SEQ ID NO: 433400 - protein, 9 aa, Homo Sapiens
IRSRLIKLL

SEQ ID NO: 433401 - protein, 9 aa, Homo Sapiens
IEDYIYGAG

SEQ ID NO: 433402 - protein, 9 aa, Homo Sapiens
NSIQRQLNL

SEQ ID NO: 433403 - protein, 9 aa, Homo Sapiens
FQLEEVNNV

SEQ ID NO: 433404 - protein, 9 aa, Homo Sapiens
IVFWFCVLQ

SEQ ID NO: 433405 - protein, 9 aa, Homo Sapiens
LELSEGDIA

SEQ ID NO: 433406 - protein, 9 aa, Homo Sapiens
CQGGSGGPV

SEQ ID NO: 433407 - protein, 9 aa, Homo Sapiens
TGCILQMHF

SEQ ID NO: 433408 - protein, 9 aa, Homo Sapiens
ASLKPKAAV

SEQ ID NO: 433409 - protein, 9 aa, Homo Sapiens
LKCKNCRVL

SEQ ID NO: 433410 - protein, 9 aa, Homo Sapiens
MCYLPEYKI

SEQ ID NO: 433411 - protein, 9 aa, Homo Sapiens
NSKPSVNYF

SEQ ID NO: 433412 - protein, 9 aa, Homo Sapiens
AFSRLDKLG

SEQ ID NO: 433413 - protein, 9 aa, Homo Sapiens
SISIVSQCP

SEQ ID NO: 433414 - protein, 9 aa, Homo Sapiens
QLEEVNNVI

SEQ ID NO: 433415 - protein, 9 aa, Homo Sapiens
MQPYMYQQN

SEQ ID NO: 433416 - protein, 9 aa, Homo Sapiens
AISNRALGW

SEQ ID NO: 433417 - protein, 9 aa, Homo Sapiens
MVALERLAR

SEQ ID NO: 433418 - protein, 9 aa, Homo Sapiens
KNTDDREKS

SEQ ID NO: 433419 - protein, 9 aa, Homo Sapiens
PLCGHQLNH

SEQ ID NO: 433420 - protein, 9 aa, Homo Sapiens
LANKDETIQ

SEQ ID NO: 433421 - protein, 9 aa, Homo Sapiens
HALPDEIQK

SEQ ID NO: 433422 - protein, 9 aa, Homo Sapiens
GRQTQREKI

SEQ ID NO: 433423 - protein, 9 aa, Homo Sapiens
RLRQELTAH

SEQ ID NO: 433424 - protein, 9 aa, Homo Sapiens
LSFCKSNLI

SEQ ID NO: 433425 - protein, 9 aa, Homo Sapiens
TELPKGEKK

SEQ ID NO: 433426 - protein, 9 aa, Homo Sapiens
VHKRNDGRD

SEQ ID NO: 433427 - protein, 9 aa, Homo Sapiens
ALTHNGTPQ

SEQ ID NO: 433428 - protein, 9 aa, Homo Sapiens
AWEQHHLRK

SEQ ID NO: 433429 - protein, 9 aa, Homo Sapiens
DNFCLLTDS

SEQ ID NO: 433430 - protein, 9 aa, Homo Sapiens
YLLSANDFF

SEQ ID NO: 433431 - protein, 9 aa, Homo Sapiens
EDYFFHKRY

SEQ ID NO: 433432 - protein, 9 aa, Homo Sapiens
PETVREEVM

SEQ ID NO: 433433 - protein, 9 aa, Homo Sapiens
QGYLANMPN

SEQ ID NO: 433434 - protein, 9 aa, Homo Sapiens
GKINGRADF

SEQ ID NO: 433435 - protein, 9 aa, Homo Sapiens
CNCTFFLCV

SEQ ID NO: 433436 - protein, 9 aa, Homo Sapiens
KKMSVAGGK

SEQ ID NO: 433437 - protein, 9 aa, Homo Sapiens
KKKGKAKTK

SEQ ID NO: 433438 - protein, 9 aa, Homo Sapiens
PNMPLIERD

SEQ ID NO: 433439 - protein, 9 aa, Homo Sapiens
EASLKPKAA

SEQ ID NO: 433440 - protein, 9 aa, Homo Sapiens
RICMENILS

SEQ ID NO: 433441 - protein, 9 aa, Homo Sapiens
VAKSNVETA

SEQ ID NO: 433442 - protein, 9 aa, Homo Sapiens
YRFGYAHWA

SEQ ID NO: 433443 - protein, 9 aa, Homo Sapiens
IAFSVGKFR

SEQ ID NO: 433444 - protein, 9 aa, Homo Sapiens
TYNGDFSDW

SEQ ID NO: 433445 - protein, 9 aa, Homo Sapiens
EENPAYSKV

SEQ ID NO: 433446 - protein, 9 aa, Homo Sapiens
WLKNGSALV

SEQ ID NO: 433447 - protein, 9 aa, Homo Sapiens
WRNKEMDSD

SEQ ID NO: 433448 - protein, 9 aa, Homo Sapiens
IIGLEKLLK

SEQ ID NO: 433449 - protein, 9 aa, Homo Sapiens
QKIFTEQVV

SEQ ID NO: 433450 - protein, 9 aa, Homo Sapiens
DKSYECKEC

SEQ ID NO: 433451 - protein, 9 aa, Homo Sapiens
HKQFLRLLQ

SEQ ID NO: 433452 - protein, 9 aa, Homo Sapiens
PHITCNPPE

SEQ ID NO: 433453 - protein, 9 aa, Homo Sapiens
TDSKFSMQE

SEQ ID NO: 433454 - protein, 9 aa, Homo Sapiens
VKSQNGELM

SEQ ID NO: 433455 - protein, 9 aa, Homo Sapiens
EDKLSKVDE

SEQ ID NO: 433456 - protein, 9 aa, Homo Sapiens
STNRVLNVL

SEQ ID NO: 433457 - protein, 9 aa, Homo Sapiens
SLHNLSTPK

SEQ ID NO: 433458 - protein, 9 aa, Homo Sapiens
LVQAENRLF

SEQ ID NO: 433459 - protein, 9 aa, Homo Sapiens
YRHGSGKEN

SEQ ID NO: 433460 - protein, 9 aa, Homo Sapiens
QLSHGAVDV

SEQ ID NO: 433461 - protein, 9 aa, Homo Sapiens
EKLHECMIC

SEQ ID NO: 433462 - protein, 9 aa, Homo Sapiens
CFSVNFQKA

SEQ ID NO: 433463 - protein, 9 aa, Homo Sapiens
ELVPTADHC

SEQ ID NO: 433464 - protein, 9 aa, Homo Sapiens
ARIIDKPQV

SEQ ID NO: 433465 - protein, 9 aa, Homo Sapiens
DVAIELSQE

SEQ ID NO: 433466 - protein, 9 aa, Homo Sapiens
HALARGLVR

SEQ ID NO: 433467 - protein, 9 aa, Homo Sapiens
QIRQSRLCA

SEQ ID NO: 433468 - protein, 9 aa, Homo Sapiens
DPGMVNGGT

SEQ ID NO: 433469 - protein, 9 aa, Homo Sapiens
GQAETEETL

SEQ ID NO: 433470 - protein, 9 aa, Homo Sapiens
RPQVPKGLN

SEQ ID NO: 433471 - protein, 9 aa, Homo Sapiens
AVCGLPDRN

SEQ ID NO: 433472 - protein, 9 aa, Homo Sapiens
CGGVIDKQI

SEQ ID NO: 433473 - protein, 9 aa, Homo Sapiens
INRINPDAW

SEQ ID NO: 433474 - protein, 9 aa, Homo Sapiens
ICECNHVEK

SEQ ID NO: 433475 - protein, 9 aa, Homo Sapiens
FNPETNSDD

SEQ ID NO: 433476 - protein, 9 aa, Homo Sapiens
NKTRTRSTQ

SEQ ID NO: 433477 - protein, 9 aa, Homo Sapiens
SPMINRTSD

SEQ ID NO: 433478 - protein, 9 aa, Homo Sapiens
MGKQGIINK

SEQ ID NO: 433479 - protein, 9 aa, Homo Sapiens
FQIHEIMHR

SEQ ID NO: 433480 - protein, 9 aa, Homo Sapiens
TNTEKKKQK

SEQ ID NO: 433481 - protein, 9 aa, Homo Sapiens
MSSAHVNRG

SEQ ID NO: 433482 - protein, 9 aa, Homo Sapiens
RCLGIHLPL

SEQ ID NO: 433483 - protein, 9 aa, Homo Sapiens
VNMHIKEDN

SEQ ID NO: 433484 - protein, 9 aa, Homo Sapiens
SQSSSSSGF

SEQ ID NO: 433485 - protein, 9 aa, Homo Sapiens
ANALAARDP

SEQ ID NO: 433486 - protein, 9 aa, Homo Sapiens
DVIGLDYSS

SEQ ID NO: 433487 - protein, 9 aa, Homo Sapiens
KIQKVCNKT

SEQ ID NO: 433488 - protein, 9 aa, Homo Sapiens
NNLLGELNP

SEQ ID NO: 433489 - protein, 9 aa, Homo Sapiens
RAMGRGKHQ

SEQ ID NO: 433490 - protein, 9 aa, Homo Sapiens
FCSQYIMGP

SEQ ID NO: 433491 - protein, 9 aa, Homo Sapiens
VICDHPDIK

SEQ ID NO: 433492 - protein, 9 aa, Homo Sapiens
MRLSIIHHD

SEQ ID NO: 433493 - protein, 9 aa, Homo Sapiens
KVSDDLILL

SEQ ID NO: 433494 - protein, 9 aa, Homo Sapiens
LVLPETPPT

SEQ ID NO: 433495 - protein, 9 aa, Homo Sapiens
ASITRQLRS

SEQ ID NO: 433496 - protein, 9 aa, Homo Sapiens
GKVFSHNSH

SEQ ID NO: 433497 - protein, 9 aa, Homo Sapiens
GTLKEIASE

SEQ ID NO: 433498 - protein, 9 aa, Homo Sapiens
TRGQLPGDN

SEQ ID NO: 433499 - protein, 9 aa, Homo Sapiens
HGAHCRGGW

SEQ ID NO: 433500 - protein, 9 aa, Homo Sapiens
HPQDTYYPE

SEQ ID NO: 433501 - protein, 9 aa, Homo Sapiens
NWTPQRVAQ

SEQ ID NO: 433502 - protein, 9 aa, Homo Sapiens
LGPSTTAAA

SEQ ID NO: 433503 - protein, 9 aa, Homo Sapiens
INSVIFATG

SEQ ID NO: 433504 - protein, 9 aa, Homo Sapiens
IFAGYETTI

SEQ ID NO: 433505 - protein, 9 aa, Homo Sapiens
PLGASGYPG

SEQ ID NO: 433506 - protein, 9 aa, Homo Sapiens
EAFRHKQIN

SEQ ID NO: 433507 - protein, 9 aa, Homo Sapiens
GCSVKAFKL

SEQ ID NO: 433508 - protein, 9 aa, Homo Sapiens
SSGSSSSHS

SEQ ID NO: 433509 - protein, 9 aa, Homo Sapiens
SSLSYLSID

SEQ ID NO: 433510 - protein, 9 aa, Homo Sapiens
RYIKPENIL

SEQ ID NO: 433511 - protein, 9 aa, Homo Sapiens
SVDWIMEAV

SEQ ID NO: 433512 - protein, 9 aa, Homo Sapiens
PAEHDGINS

SEQ ID NO: 433513 - protein, 9 aa, Homo Sapiens
TLFTVNEFI

SEQ ID NO: 433514 - protein, 9 aa, Homo Sapiens
NLLPISVKM

SEQ ID NO: 433515 - protein, 9 aa, Homo Sapiens
LEDESLSMA

SEQ ID NO: 433516 - protein, 9 aa, Homo Sapiens
GYGGYGGYE

SEQ ID NO: 433517 - protein, 9 aa, Homo Sapiens
YAGIKNAEI

SEQ ID NO: 433518 - protein, 9 aa, Homo Sapiens
QTYRALDSL

SEQ ID NO: 433519 - protein, 9 aa, Homo Sapiens
QPGAMGIHE

SEQ ID NO: 433520 - protein, 9 aa, Homo Sapiens
HAHVLGDHS

SEQ ID NO: 433521 - protein, 9 aa, Homo Sapiens
AYISKAQEQ

SEQ ID NO: 433522 - protein, 9 aa, Homo Sapiens
KDLPVYSLE

SEQ ID NO: 433523 - protein, 9 aa, Homo Sapiens
VAPPFEVND

SEQ ID NO: 433524 - protein, 9 aa, Homo Sapiens
APELPRFYE

SEQ ID NO: 433525 - protein, 9 aa, Homo Sapiens
GFYVGQPEM

SEQ ID NO: 433526 - protein, 9 aa, Homo Sapiens
SMEQEKLGA

SEQ ID NO: 433527 - protein, 9 aa, Homo Sapiens
HACPLNFGS

SEQ ID NO: 433528 - protein, 9 aa, Homo Sapiens
GTALKATPF

SEQ ID NO: 433529 - protein, 9 aa, Homo Sapiens
LTNGGRQTQ

SEQ ID NO: 433530 - protein, 9 aa, Homo Sapiens
EDYFQKMIL

SEQ ID NO: 433531 - protein, 9 aa, Homo Sapiens
AICRPTCSV

SEQ ID NO: 433532 - protein, 9 aa, Homo Sapiens
EYISVDTSW

SEQ ID NO: 433533 - protein, 9 aa, Homo Sapiens
AFHTSAPAA

SEQ ID NO: 433534 - protein, 9 aa, Homo Sapiens
NSKCYHIGT

SEQ ID NO: 433535 - protein, 9 aa, Homo Sapiens
HWQEDALFA

SEQ ID NO: 433536 - protein, 9 aa, Homo Sapiens
RRNLEGDED

SEQ ID NO: 433537 - protein, 9 aa, Homo Sapiens
AEKTDTSHE

SEQ ID NO: 433538 - protein, 9 aa, Homo Sapiens
IKKSITDII

SEQ ID NO: 433539 - protein, 9 aa, Homo Sapiens
NWGSYVHNF

SEQ ID NO: 433540 - protein, 9 aa, Homo Sapiens
FCALLNILE

SEQ ID NO: 433541 - protein, 9 aa, Homo Sapiens
RSNEVAVEY

SEQ ID NO: 433542 - protein, 9 aa, Homo Sapiens
VLKVQNRRI

SEQ ID NO: 433543 - protein, 9 aa, Homo Sapiens
YIAIHNAEL

SEQ ID NO: 433544 - protein, 9 aa, Homo Sapiens
DIHDLLGSQ

SEQ ID NO: 433545 - protein, 9 aa, Homo Sapiens
RSSNLASAS

SEQ ID NO: 433546 - protein, 9 aa, Homo Sapiens
PSNGSLQSR

SEQ ID NO: 433547 - protein, 9 aa, Homo Sapiens
KSSPTHHQL

SEQ ID NO: 433548 - protein, 9 aa, Homo Sapiens
FEFIFGIQD

SEQ ID NO: 433549 - protein, 9 aa, Homo Sapiens
AGDNDESHH

SEQ ID NO: 433550 - protein, 9 aa, Homo Sapiens
SGSTRGAGT

SEQ ID NO: 433551 - protein, 9 aa, Homo Sapiens
VQSELEENI

SEQ ID NO: 433552 - protein, 9 aa, Homo Sapiens
DQMRKMSKH

SEQ ID NO: 433553 - protein, 9 aa, Homo Sapiens
KLAFSELYL

SEQ ID NO: 433554 - protein, 9 aa, Homo Sapiens
PTDPSHSLL

SEQ ID NO: 433555 - protein, 9 aa, Homo Sapiens
LFDHQLVYC

SEQ ID NO: 433556 - protein, 9 aa, Homo Sapiens
LQARLCEEK

SEQ ID NO: 433557 - protein, 9 aa, Homo Sapiens
IPECGQCII

SEQ ID NO: 433558 - protein, 9 aa, Homo Sapiens
IMIIFSIAF

SEQ ID NO: 433559 - protein, 9 aa, Homo Sapiens
EDSGISTEA

SEQ ID NO: 433560 - protein, 9 aa, Homo Sapiens
ASLSNLELW

SEQ ID NO: 433561 - protein, 9 aa, Homo Sapiens
CVILEMQIL

SEQ ID NO: 433562 - protein, 9 aa, Homo Sapiens
KVDALIYEI

SEQ ID NO: 433563 - protein, 9 aa, Homo Sapiens
KRINESLLG

SEQ ID NO: 433564 - protein, 9 aa, Homo Sapiens
EAENKHQAL

SEQ ID NO: 433565 - protein, 9 aa, Homo Sapiens
YYCSLCGIP

SEQ ID NO: 433566 - protein, 9 aa, Homo Sapiens
TINCRDCFK

SEQ ID NO: 433567 - protein, 9 aa, Homo Sapiens
GVCFVGLYN

SEQ ID NO: 433568 - protein, 9 aa, Homo Sapiens
CKTCYRIVE

SEQ ID NO: 433569 - protein, 9 aa, Homo Sapiens
AFYWIDRVD

SEQ ID NO: 433570 - protein, 9 aa, Homo Sapiens
NTTMAVYVS

SEQ ID NO: 433571 - protein, 9 aa, Homo Sapiens
KVIYTYMAS

SEQ ID NO: 433572 - protein, 9 aa, Homo Sapiens
YYICKKGDI

SEQ ID NO: 433573 - protein, 9 aa, Homo Sapiens
LIIVIIYFD

SEQ ID NO: 433574 - protein, 9 aa, Homo Sapiens
IDRVNLEKS

SEQ ID NO: 433575 - protein, 9 aa, Homo Sapiens
RSKKGPRVD

SEQ ID NO: 433576 - protein, 9 aa, Homo Sapiens
KYRTSPFNF

SEQ ID NO: 433577 - protein, 9 aa, Homo Sapiens
IQAESFCQR

SEQ ID NO: 433578 - protein, 9 aa, Homo Sapiens
TDIPPHHPS

SEQ ID NO: 433579 - protein, 9 aa, Homo Sapiens
EVLDQLLMA

SEQ ID NO: 433580 - protein, 9 aa, Homo Sapiens
YDLYGGDKF

SEQ ID NO: 433581 - protein, 9 aa, Homo Sapiens
SEYLLDNLG

SEQ ID NO: 433582 - protein, 9 aa, Homo Sapiens
KGCWCQLLE

SEQ ID NO: 433583 - protein, 9 aa, Homo Sapiens
VNVTLNIHP

SEQ ID NO: 433584 - protein, 9 aa, Homo Sapiens
DEARAERVL

SEQ ID NO: 433585 - protein, 9 aa, Homo Sapiens
AVDSQEIYK

SEQ ID NO: 433586 - protein, 9 aa, Homo Sapiens
QQIKYFTCN

SEQ ID NO: 433587 - protein, 9 aa, Homo Sapiens
NSTFKSVAF

SEQ ID NO: 433588 - protein, 9 aa, Homo Sapiens
YNYAFVSQG

SEQ ID NO: 433589 - protein, 9 aa, Homo Sapiens
VDALATKGH

SEQ ID NO: 433590 - protein, 9 aa, Homo Sapiens
YNPYGPQTP

SEQ ID NO: 433591 - protein, 9 aa, Homo Sapiens
LVFQLERLK

SEQ ID NO: 433592 - protein, 9 aa, Homo Sapiens
NLTHDGKGI

SEQ ID NO: 433593 - protein, 9 aa, Homo Sapiens
DLEIEDDEN

SEQ ID NO: 433594 - protein, 9 aa, Homo Sapiens
LYRVVFHFK

SEQ ID NO: 433595 - protein, 9 aa, Homo Sapiens
YGSLVQQIQ

SEQ ID NO: 433596 - protein, 9 aa, Homo Sapiens
IVPESEISN

SEQ ID NO: 433597 - protein, 9 aa, Homo Sapiens
ILDNLRNKV

SEQ ID NO: 433598 - protein, 9 aa, Homo Sapiens
WRHYHTGEK

SEQ ID NO: 433599 - protein, 9 aa, Homo Sapiens
PSSPLEPLE

SEQ ID NO: 433600 - protein, 9 aa, Homo Sapiens
CSKCFAALQ

SEQ ID NO: 433601 - protein, 9 aa, Homo Sapiens
RTEFQNCEF

SEQ ID NO: 433602 - protein, 9 aa, Homo Sapiens
TSAQNNPTA

SEQ ID NO: 433603 - protein, 9 aa, Homo Sapiens
AVFLVSWLP

SEQ ID NO: 433604 - protein, 9 aa, Homo Sapiens
NHIYQIMWA

SEQ ID NO: 433605 - protein, 9 aa, Homo Sapiens
NSPMGKSTW

SEQ ID NO: 433606 - protein, 9 aa, Homo Sapiens
NYMEKGCHF

SEQ ID NO: 433607 - protein, 9 aa, Homo Sapiens
LQKELDLLH

SEQ ID NO: 433608 - protein, 9 aa, Homo Sapiens
PCAVGFCDM

SEQ ID NO: 433609 - protein, 9 aa, Homo Sapiens
RWGDIIGVQ

SEQ ID NO: 433610 - protein, 9 aa, Homo Sapiens
NQLNSLYLL

SEQ ID NO: 433611 - protein, 9 aa, Homo Sapiens
SQLDIHHQI

SEQ ID NO: 433612 - protein, 9 aa, Homo Sapiens
YPKVANIRL

SEQ ID NO: 433613 - protein, 9 aa, Homo Sapiens
LCYYLGTTK

SEQ ID NO: 433614 - protein, 9 aa, Homo Sapiens
FHLVVHQIT

SEQ ID NO: 433615 - protein, 9 aa, Homo Sapiens
LNFFNQNKK

SEQ ID NO: 433616 - protein, 9 aa, Homo Sapiens
RRDSDYDKE

SEQ ID NO: 433617 - protein, 9 aa, Homo Sapiens
TKALHAFQG

SEQ ID NO: 433618 - protein, 9 aa, Homo Sapiens
IIWGLACKG

SEQ ID NO: 433619 - protein, 9 aa, Homo Sapiens
YGKYMKERA

SEQ ID NO: 433620 - protein, 9 aa, Homo Sapiens
PECLCPFTR

SEQ ID NO: 433621 - protein, 9 aa, Homo Sapiens
LLQFTLTVC

SEQ ID NO: 433622 - protein, 9 aa, Homo Sapiens
STTLIQGAP

SEQ ID NO: 433623 - protein, 9 aa, Homo Sapiens
KPYIRPGVK

SEQ ID NO: 433624 - protein, 9 aa, Homo Sapiens
FHQEKRMGI

SEQ ID NO: 433625 - protein, 9 aa, Homo Sapiens
EIREVHKRN

SEQ ID NO: 433626 - protein, 9 aa, Homo Sapiens
EHVEDRFVF

SEQ ID NO: 433627 - protein, 9 aa, Homo Sapiens
RLLLWLEHN

SEQ ID NO: 433628 - protein, 9 aa, Homo Sapiens
DTETLKVIL

SEQ ID NO: 433629 - protein, 9 aa, Homo Sapiens
PSHYRMECP

SEQ ID NO: 433630 - protein, 9 aa, Homo Sapiens
DIMNRKPHH

SEQ ID NO: 433631 - protein, 9 aa, Homo Sapiens
TPLFTDQPE

SEQ ID NO: 433632 - protein, 9 aa, Homo Sapiens
EPNCRIYVN

SEQ ID NO: 433633 - protein, 9 aa, Homo Sapiens
VEAHKIVIC

SEQ ID NO: 433634 - protein, 9 aa, Homo Sapiens
GAKKGMIVI

SEQ ID NO: 433635 - protein, 9 aa, Homo Sapiens
RHHFQTQQL

SEQ ID NO: 433636 - protein, 9 aa, Homo Sapiens
EREGQLRAA

SEQ ID NO: 433637 - protein, 9 aa, Homo Sapiens
GASILANDH

SEQ ID NO: 433638 - protein, 9 aa, Homo Sapiens
YNEDWDSEL

SEQ ID NO: 433639 - protein, 9 aa, Homo Sapiens
TDISLLFCI

SEQ ID NO: 433640 - protein, 9 aa, Homo Sapiens
DSFALNTRA

SEQ ID NO: 433641 - protein, 9 aa, Homo Sapiens
YCGGVIDKQ

SEQ ID NO: 433642 - protein, 9 aa, Homo Sapiens
IIMIVGERF

SEQ ID NO: 433643 - protein, 9 aa, Homo Sapiens
SENLESYKI

SEQ ID NO: 433644 - protein, 9 aa, Homo Sapiens
LQKKFYSKC

SEQ ID NO: 433645 - protein, 9 aa, Homo Sapiens
PVVRTWHLN

SEQ ID NO: 433646 - protein, 9 aa, Homo Sapiens
KNGQCDMYS

SEQ ID NO: 433647 - protein, 9 aa, Homo Sapiens
GENSLHTYL

SEQ ID NO: 433648 - protein, 9 aa, Homo Sapiens
NTFYQAFTE

SEQ ID NO: 433649 - protein, 9 aa, Homo Sapiens
YWMRLHFPI

SEQ ID NO: 433650 - protein, 9 aa, Homo Sapiens
TVHVAFVGA

SEQ ID NO: 433651 - protein, 9 aa, Homo Sapiens
TLIHHNTHL

SEQ ID NO: 433652 - protein, 9 aa, Homo Sapiens
NQGVSDERI

SEQ ID NO: 433653 - protein, 9 aa, Homo Sapiens
LSEKELKAS

SEQ ID NO: 433654 - protein, 9 aa, Homo Sapiens
DRNPFETDM

SEQ ID NO: 433655 - protein, 9 aa, Homo Sapiens
NDNKPKFTQ

SEQ ID NO: 433656 - protein, 9 aa, Homo Sapiens
CTTIDKQMC

SEQ ID NO: 433657 - protein, 9 aa, Homo Sapiens
LYVIIMADK

SEQ ID NO: 433658 - protein, 9 aa, Homo Sapiens
SVHITMGPS

SEQ ID NO: 433659 - protein, 9 aa, Homo Sapiens
VRSLESVGL

SEQ ID NO: 433660 - protein, 9 aa, Homo Sapiens
NISNVKVET

SEQ ID NO: 433661 - protein, 9 aa, Homo Sapiens
GKPLGRIAI

SEQ ID NO: 433662 - protein, 9 aa, Homo Sapiens
ACTFNFLPW

SEQ ID NO: 433663 - protein, 9 aa, Homo Sapiens
VAHQITHTG

SEQ ID NO: 433664 - protein, 9 aa, Homo Sapiens
LEFSQLSVN

SEQ ID NO: 433665 - protein, 9 aa, Homo Sapiens
PLHNWLLLN

SEQ ID NO: 433666 - protein, 9 aa, Homo Sapiens
IEKKWLLLC

SEQ ID NO: 433667 - protein, 9 aa, Homo Sapiens
LFMLQTYGQ

SEQ ID NO: 433668 - protein, 9 aa, Homo Sapiens
HPPPSLPIP

SEQ ID NO: 433669 - protein, 9 aa, Homo Sapiens
PPQILQKLE

SEQ ID NO: 433670 - protein, 9 aa, Homo Sapiens
ISNCQYQVE

SEQ ID NO: 433671 - protein, 9 aa, Homo Sapiens
YGVDSSADS

SEQ ID NO: 433672 - protein, 9 aa, Homo Sapiens
FETIRLFLV

SEQ ID NO: 433673 - protein, 9 aa, Homo Sapiens
QRDYINTTW

SEQ ID NO: 433674 - protein, 9 aa, Homo Sapiens
PVDVNHLNT

SEQ ID NO: 433675 - protein, 9 aa, Homo Sapiens
RDINKFPQA

SEQ ID NO: 433676 - protein, 9 aa, Homo Sapiens
QKANIVLLS

SEQ ID NO: 433677 - protein, 9 aa, Homo Sapiens
TVRVHLTGW

SEQ ID NO: 433678 - protein, 9 aa, Homo Sapiens
NLPASLQPH

SEQ ID NO: 433679 - protein, 9 aa, Homo Sapiens
DSYMLVMHN

SEQ ID NO: 433680 - protein, 9 aa, Homo Sapiens
ATTCFVDAG

SEQ ID NO: 433681 - protein, 9 aa, Homo Sapiens
VIPSAYFTT

SEQ ID NO: 433682 - protein, 9 aa, Homo Sapiens
PLPVKCNHI

SEQ ID NO: 433683 - protein, 9 aa, Homo Sapiens
CAGLLHGSS

SEQ ID NO: 433684 - protein, 9 aa, Homo Sapiens
VEAELAQII

SEQ ID NO: 433685 - protein, 9 aa, Homo Sapiens
AFGYLAANG

SEQ ID NO: 433686 - protein, 9 aa, Homo Sapiens
TPMDLFKSR

SEQ ID NO: 433687 - protein, 9 aa, Homo Sapiens
SHLPNQNGT

SEQ ID NO: 433688 - protein, 9 aa, Homo Sapiens
LFRSLHNDS

SEQ ID NO: 433689 - protein, 9 aa, Homo Sapiens
THAHLSLPQ

SEQ ID NO: 433690 - protein, 9 aa, Homo Sapiens
NEENKLGIL

SEQ ID NO: 433691 - protein, 9 aa, Homo Sapiens
GSTDAFKKI

SEQ ID NO: 433692 - protein, 9 aa, Homo Sapiens
LIRAGKKEL

SEQ ID NO: 433693 - protein, 9 aa, Homo Sapiens
PTSYRCAGT

SEQ ID NO: 433694 - protein, 9 aa, Homo Sapiens
AQFHYPCDP

SEQ ID NO: 433695 - protein, 9 aa, Homo Sapiens
KEKQDKKIL

SEQ ID NO: 433696 - protein, 9 aa, Homo Sapiens
TFCITAYPN

SEQ ID NO: 433697 - protein, 9 aa, Homo Sapiens
ASLYGLDLD

SEQ ID NO: 433698 - protein, 9 aa, Homo Sapiens
IHSVEGSQL

SEQ ID NO: 433699 - protein, 9 aa, Homo Sapiens
TPQIPITME

SEQ ID NO: 433700 - protein, 9 aa, Homo Sapiens
LLKWQLEQS

SEQ ID NO: 433701 - protein, 9 aa, Homo Sapiens
YQFMMQGFI

SEQ ID NO: 433702 - protein, 9 aa, Homo Sapiens
TIDFPKFLT

SEQ ID NO: 433703 - protein, 9 aa, Homo Sapiens
TLGLQHIFY

SEQ ID NO: 433704 - protein, 9 aa, Homo Sapiens
EGINIDFKE

SEQ ID NO: 433705 - protein, 9 aa, Homo Sapiens
QTYMPYTLI

SEQ ID NO: 433706 - protein, 9 aa, Homo Sapiens
LQLAVSVIL

SEQ ID NO: 433707 - protein, 9 aa, Homo Sapiens
GATIQEELG

SEQ ID NO: 433708 - protein, 9 aa, Homo Sapiens
NIPFSPSPL

SEQ ID NO: 433709 - protein, 9 aa, Homo Sapiens
NNLQLRYEN

SEQ ID NO: 433710 - protein, 9 aa, Homo Sapiens
ERLDKLHFM

SEQ ID NO: 433711 - protein, 9 aa, Homo Sapiens
YPGYGEAWG

SEQ ID NO: 433712 - protein, 9 aa, Homo Sapiens
SVLLRRVWK

SEQ ID NO: 433713 - protein, 9 aa, Homo Sapiens
GHVLLTDSK

SEQ ID NO: 433714 - protein, 9 aa, Homo Sapiens
DQRLEKHEL

SEQ ID NO: 433715 - protein, 9 aa, Homo Sapiens
KRWGMKLRH

SEQ ID NO: 433716 - protein, 9 aa, Homo Sapiens
ISEDIKFIL

SEQ ID NO: 433717 - protein, 9 aa, Homo Sapiens
KLGDKLHGF

SEQ ID NO: 433718 - protein, 9 aa, Homo Sapiens
KYVREWKLE

SEQ ID NO: 433719 - protein, 9 aa, Homo Sapiens
FCVGCGCCG

SEQ ID NO: 433720 - protein, 9 aa, Homo Sapiens
IQNKLFQVA

SEQ ID NO: 433721 - protein, 9 aa, Homo Sapiens
ELDQENKKY

SEQ ID NO: 433722 - protein, 9 aa, Homo Sapiens
RANFSGMLE

SEQ ID NO: 433723 - protein, 9 aa, Homo Sapiens
AQELESFLR

SEQ ID NO: 433724 - protein, 9 aa, Homo Sapiens
CKVFLGGVS

SEQ ID NO: 433725 - protein, 9 aa, Homo Sapiens
YGTNNIIGQ

SEQ ID NO: 433726 - protein, 9 aa, Homo Sapiens
RHREITLNQ

SEQ ID NO: 433727 - protein, 9 aa, Homo Sapiens
LFKVMQLIN

SEQ ID NO: 433728 - protein, 9 aa, Homo Sapiens
NTYSVSAVT

SEQ ID NO: 433729 - protein, 9 aa, Homo Sapiens
NTTGSNIVP

SEQ ID NO: 433730 - protein, 9 aa, Homo Sapiens
LQYQDLVVR

SEQ ID NO: 433731 - protein, 9 aa, Homo Sapiens
HLIASKVTH

SEQ ID NO: 433732 - protein, 9 aa, Homo Sapiens
VAADNVCKA

SEQ ID NO: 433733 - protein, 9 aa, Homo Sapiens
AMSLACYNP

SEQ ID NO: 433734 - protein, 9 aa, Homo Sapiens
SLFRLITQD

SEQ ID NO: 433735 - protein, 9 aa, Homo Sapiens
NILESAETE

SEQ ID NO: 433736 - protein, 9 aa, Homo Sapiens
NGSALVLEE

SEQ ID NO: 433737 - protein, 9 aa, Homo Sapiens
VEAFEARGS

SEQ ID NO: 433738 - protein, 9 aa, Homo Sapiens
NCTFFLCVL

SEQ ID NO: 433739 - protein, 9 aa, Homo Sapiens
NKQNKLKRC

SEQ ID NO: 433740 - protein, 9 aa, Homo Sapiens
ALFQVNDVN

SEQ ID NO: 433741 - protein, 9 aa, Homo Sapiens
VVADTISRT

SEQ ID NO: 433742 - protein, 9 aa, Homo Sapiens
YAFKIATLM

SEQ ID NO: 433743 - protein, 9 aa, Homo Sapiens
RFPTHKRKA

SEQ ID NO: 433744 - protein, 9 aa, Homo Sapiens
KQVHSENPE

SEQ ID NO: 433745 - protein, 9 aa, Homo Sapiens
RRHPLSLPV

SEQ ID NO: 433746 - protein, 9 aa, Homo Sapiens
AAEDRIWEL

SEQ ID NO: 433747 - protein, 9 aa, Homo Sapiens
LIVDVNKPI

SEQ ID NO: 433748 - protein, 9 aa, Homo Sapiens
HLGLGGKTG

SEQ ID NO: 433749 - protein, 9 aa, Homo Sapiens
RMEWPTDLA

SEQ ID NO: 433750 - protein, 9 aa, Homo Sapiens
FTASDNTSR

SEQ ID NO: 433751 - protein, 9 aa, Homo Sapiens
HERRLPAVC

SEQ ID NO: 433752 - protein, 9 aa, Homo Sapiens
EKYLGTGLS

SEQ ID NO: 433753 - protein, 9 aa, Homo Sapiens
TAGVSLHIG

SEQ ID NO: 433754 - protein, 9 aa, Homo Sapiens
IVKYSVQLE

SEQ ID NO: 433755 - protein, 9 aa, Homo Sapiens
NVPNMLTNL

SEQ ID NO: 433756 - protein, 9 aa, Homo Sapiens
VTLNEKPFY

SEQ ID NO: 433757 - protein, 9 aa, Homo Sapiens
PDSPAKPEN

SEQ ID NO: 433758 - protein, 9 aa, Homo Sapiens
QSHNNVFPD

SEQ ID NO: 433759 - protein, 9 aa, Homo Sapiens
GGPEAADLS

SEQ ID NO: 433760 - protein, 9 aa, Homo Sapiens
GHIIPTRKP

SEQ ID NO: 433761 - protein, 9 aa, Homo Sapiens
KREYVAYDL

SEQ ID NO: 433762 - protein, 9 aa, Homo Sapiens
GSSDADPRD

SEQ ID NO: 433763 - protein, 9 aa, Homo Sapiens
KIIEAKQKG

SEQ ID NO: 433764 - protein, 9 aa, Homo Sapiens
ECGTVFSRK

SEQ ID NO: 433765 - protein, 9 aa, Homo Sapiens
LLAVNTFHV

SEQ ID NO: 433766 - protein, 9 aa, Homo Sapiens
LSPKEHNKE

SEQ ID NO: 433767 - protein, 9 aa, Homo Sapiens
RRRGPNFGW

SEQ ID NO: 433768 - protein, 9 aa, Homo Sapiens
LLNLPASLQ

SEQ ID NO: 433769 - protein, 9 aa, Homo Sapiens
FQLFDHHLM

SEQ ID NO: 433770 - protein, 9 aa, Homo Sapiens
EFGTLPESA

SEQ ID NO: 433771 - protein, 9 aa, Homo Sapiens
EPEANNSIS

SEQ ID NO: 433772 - protein, 9 aa, Homo Sapiens
HLLWRDCSH

SEQ ID NO: 433773 - protein, 9 aa, Homo Sapiens
GDHSARQAE

SEQ ID NO: 433774 - protein, 9 aa, Homo Sapiens
SNNVFVFQG

SEQ ID NO: 433775 - protein, 9 aa, Homo Sapiens
LMTWALILK

SEQ ID NO: 433776 - protein, 9 aa, Homo Sapiens
YSKLRSSGP

SEQ ID NO: 433777 - protein, 9 aa, Homo Sapiens
KLAEFLSSD

SEQ ID NO: 433778 - protein, 9 aa, Homo Sapiens
KALDIFAYA

SEQ ID NO: 433779 - protein, 9 aa, Homo Sapiens
KLEEKNTIS

SEQ ID NO: 433780 - protein, 9 aa, Homo Sapiens
LRQELTAHL

SEQ ID NO: 433781 - protein, 9 aa, Homo Sapiens
VLKNNDLRL

SEQ ID NO: 433782 - protein, 9 aa, Homo Sapiens
KDLLSDGTS

SEQ ID NO: 433783 - protein, 9 aa, Homo Sapiens
ILNMENTLK

SEQ ID NO: 433784 - protein, 9 aa, Homo Sapiens
LPSAAAYVQ

SEQ ID NO: 433785 - protein, 9 aa, Homo Sapiens
INEENKLGI

SEQ ID NO: 433786 - protein, 9 aa, Homo Sapiens
HFYFHTTQI

SEQ ID NO: 433787 - protein, 9 aa, Homo Sapiens
ISMAVIYPL

SEQ ID NO: 433788 - protein, 9 aa, Homo Sapiens
LKGYTLLLG

SEQ ID NO: 433789 - protein, 9 aa, Homo Sapiens
SDLIFHEQI

SEQ ID NO: 433790 - protein, 9 aa, Homo Sapiens
GCFLRIRQT

SEQ ID NO: 433791 - protein, 9 aa, Homo Sapiens
QKKDKSFGI

SEQ ID NO: 433792 - protein, 9 aa, Homo Sapiens
LTEKDAELD

SEQ ID NO: 433793 - protein, 9 aa, Homo Sapiens
AVNFTQDEW

SEQ ID NO: 433794 - protein, 9 aa, Homo Sapiens
CRARHRLLS

SEQ ID NO: 433795 - protein, 9 aa, Homo Sapiens
PVIGCDGQC

SEQ ID NO: 433796 - protein, 9 aa, Homo Sapiens
AESVKYQNQ

SEQ ID NO: 433797 - protein, 9 aa, Homo Sapiens
DPSSPLEPL

SEQ ID NO: 433798 - protein, 9 aa, Homo Sapiens
AQPEDQVNI

SEQ ID NO: 433799 - protein, 9 aa, Homo Sapiens
SAFSRLDKL

SEQ ID NO: 433800 - protein, 9 aa, Homo Sapiens
SQINLIDLA

SEQ ID NO: 433801 - protein, 9 aa, Homo Sapiens
MLLFPFSLI

SEQ ID NO: 433802 - protein, 9 aa, Homo Sapiens
TNNYDRLQC

SEQ ID NO: 433803 - protein, 9 aa, Homo Sapiens
PGQCAGLLH

SEQ ID NO: 433804 - protein, 9 aa, Homo Sapiens
IFLTLENVK

SEQ ID NO: 433805 - protein, 9 aa, Homo Sapiens
LANHQKIHT

SEQ ID NO: 433806 - protein, 9 aa, Homo Sapiens
YRFNTVIAR

SEQ ID NO: 433807 - protein, 9 aa, Homo Sapiens
KNKKANECY

SEQ ID NO: 433808 - protein, 9 aa, Homo Sapiens
EGELLLQAL

SEQ ID NO: 433809 - protein, 9 aa, Homo Sapiens
NWICNFIVA

SEQ ID NO: 433810 - protein, 9 aa, Homo Sapiens
HVPAGLKGR

SEQ ID NO: 433811 - protein, 9 aa, Homo Sapiens
WRFSGPKPN

SEQ ID NO: 433812 - protein, 9 aa, Homo Sapiens
QVLLCGEVN

SEQ ID NO: 433813 - protein, 9 aa, Homo Sapiens
KVDKMISHA

SEQ ID NO: 433814 - protein, 9 aa, Homo Sapiens
LCDISTLTE

SEQ ID NO: 433815 - protein, 9 aa, Homo Sapiens
TELCHMWLR

SEQ ID NO: 433816 - protein, 9 aa, Homo Sapiens
ASDKDFMIV

SEQ ID NO: 433817 - protein, 9 aa, Homo Sapiens
GLLILLSML

SEQ ID NO: 433818 - protein, 9 aa, Homo Sapiens
TLKLILIKL

SEQ ID NO: 433819 - protein, 9 aa, Homo Sapiens
RIQEFKEAF

SEQ ID NO: 433820 - protein, 9 aa, Homo Sapiens
LVVFVSISF

SEQ ID NO: 433821 - protein, 9 aa, Homo Sapiens
LSWGPNFNF

SEQ ID NO: 433822 - protein, 9 aa, Homo Sapiens
YKLYDPPPK

SEQ ID NO: 433823 - protein, 9 aa, Homo Sapiens
ITERHNCQY

SEQ ID NO: 433824 - protein, 9 aa, Homo Sapiens
SFDAVFLNP

SEQ ID NO: 433825 - protein, 9 aa, Homo Sapiens
VIHWILSIG

SEQ ID NO: 433826 - protein, 9 aa, Homo Sapiens
YALAFLYEA

SEQ ID NO: 433827 - protein, 9 aa, Homo Sapiens
DSLRQTGVI

SEQ ID NO: 433828 - protein, 9 aa, Homo Sapiens
INKINPLKE

SEQ ID NO: 433829 - protein, 9 aa, Homo Sapiens
DGDTGPARE

SEQ ID NO: 433830 - protein, 9 aa, Homo Sapiens
GCHKKKQSI

SEQ ID NO: 433831 - protein, 9 aa, Homo Sapiens
GKKDITATL

SEQ ID NO: 433832 - protein, 9 aa, Homo Sapiens
KDEQLNLET

SEQ ID NO: 433833 - protein, 9 aa, Homo Sapiens
CNSTPSTGM

SEQ ID NO: 433834 - protein, 9 aa, Homo Sapiens
MEEYILEGM

SEQ ID NO: 433835 - protein, 9 aa, Homo Sapiens
PNLSTKTHL

SEQ ID NO: 433836 - protein, 9 aa, Homo Sapiens
SPLQILRKR

SEQ ID NO: 433837 - protein, 9 aa, Homo Sapiens
KEEASQNLS

SEQ ID NO: 433838 - protein, 9 aa, Homo Sapiens
YLEILKEDT

SEQ ID NO: 433839 - protein, 9 aa, Homo Sapiens
ASIFGLFGR

SEQ ID NO: 433840 - protein, 9 aa, Homo Sapiens
TQICPAFFL

SEQ ID NO: 433841 - protein, 9 aa, Homo Sapiens
ELVNLLSYF

SEQ ID NO: 433842 - protein, 9 aa, Homo Sapiens
CHNCGKRFS

SEQ ID NO: 433843 - protein, 9 aa, Homo Sapiens
REGDGFSNC

SEQ ID NO: 433844 - protein, 9 aa, Homo Sapiens
LKKVRFVNS

SEQ ID NO: 433845 - protein, 9 aa, Homo Sapiens
KNVPKYQCP

SEQ ID NO: 433846 - protein, 9 aa, Homo Sapiens
KLDLKDSQS

SEQ ID NO: 433847 - protein, 9 aa, Homo Sapiens
SIIHHDQPV

SEQ ID NO: 433848 - protein, 9 aa, Homo Sapiens
QARRQHTHK

SEQ ID NO: 433849 - protein, 9 aa, Homo Sapiens
QIFSFVAEL

SEQ ID NO: 433850 - protein, 9 aa, Homo Sapiens
VDKPISKDA

SEQ ID NO: 433851 - protein, 9 aa, Homo Sapiens
KLFSELEFG

SEQ ID NO: 433852 - protein, 9 aa, Homo Sapiens
AWTKRNDMQ

SEQ ID NO: 433853 - protein, 9 aa, Homo Sapiens
ISNHYLDFS

SEQ ID NO: 433854 - protein, 9 aa, Homo Sapiens
ECKNLIKFM

SEQ ID NO: 433855 - protein, 9 aa, Homo Sapiens
GLEMKSARY

SEQ ID NO: 433856 - protein, 9 aa, Homo Sapiens
LENKGDIHG

SEQ ID NO: 433857 - protein, 9 aa, Homo Sapiens
EHNKEELYH

SEQ ID NO: 433858 - protein, 9 aa, Homo Sapiens
LDVAMSFFG

SEQ ID NO: 433859 - protein, 9 aa, Homo Sapiens
ICYPVPIVL

SEQ ID NO: 433860 - protein, 9 aa, Homo Sapiens
HSENPEWLD

SEQ ID NO: 433861 - protein, 9 aa, Homo Sapiens
NNTSHLPNQ

SEQ ID NO: 433862 - protein, 9 aa, Homo Sapiens
EGNLSTKYD

SEQ ID NO: 433863 - protein, 9 aa, Homo Sapiens
VEATSLGIR

SEQ ID NO: 433864 - protein, 9 aa, Homo Sapiens
VLDCVNLQG

SEQ ID NO: 433865 - protein, 9 aa, Homo Sapiens
SLDNFISGR

SEQ ID NO: 433866 - protein, 9 aa, Homo Sapiens
AVKSVKMEV

SEQ ID NO: 433867 - protein, 9 aa, Homo Sapiens
MINNKAASK

SEQ ID NO: 433868 - protein, 9 aa, Homo Sapiens
NIKRTKKPD

SEQ ID NO: 433869 - protein, 9 aa, Homo Sapiens
TDNEVEKIT

SEQ ID NO: 433870 - protein, 9 aa, Homo Sapiens
EEAEEAATE

SEQ ID NO: 433871 - protein, 9 aa, Homo Sapiens
CNLLQYQDL

SEQ ID NO: 433872 - protein, 9 aa, Homo Sapiens
DYIVMPRSY

SEQ ID NO: 433873 - protein, 9 aa, Homo Sapiens
RTREAALNA

SEQ ID NO: 433874 - protein, 9 aa, Homo Sapiens
VKRDRMVRS

SEQ ID NO: 433875 - protein, 9 aa, Homo Sapiens
FFAKSKSKT

SEQ ID NO: 433876 - protein, 9 aa, Homo Sapiens
LTRNENNRP

SEQ ID NO: 433877 - protein, 9 aa, Homo Sapiens
KRLCQPPPC

SEQ ID NO: 433878 - protein, 9 aa, Homo Sapiens
GDRVQAEMP

SEQ ID NO: 433879 - protein, 9 aa, Homo Sapiens
KKMLGHQEP

SEQ ID NO: 433880 - protein, 9 aa, Homo Sapiens
FAYQRQQDF

SEQ ID NO: 433881 - protein, 9 aa, Homo Sapiens
IVRKTFWKL

SEQ ID NO: 433882 - protein, 9 aa, Homo Sapiens
YGMYYREEE

SEQ ID NO: 433883 - protein, 9 aa, Homo Sapiens
DHPDRALLT

SEQ ID NO: 433884 - protein, 9 aa, Homo Sapiens
LFVNEATRV

SEQ ID NO: 433885 - protein, 9 aa, Homo Sapiens
NGVDLYHEH

SEQ ID NO: 433886 - protein, 9 aa, Homo Sapiens
LVPAFQVVF

SEQ ID NO: 433887 - protein, 9 aa, Homo Sapiens
IWIHLDRKA

SEQ ID NO: 433888 - protein, 9 aa, Homo Sapiens
TEPQKQNTE

SEQ ID NO: 433889 - protein, 9 aa, Homo Sapiens
TLSIMADIE

SEQ ID NO: 433890 - protein, 9 aa, Homo Sapiens
CATYELNVD

SEQ ID NO: 433891 - protein, 9 aa, Homo Sapiens
GQDQSRSLY

SEQ ID NO: 433892 - protein, 9 aa, Homo Sapiens
EFSGVENYN

SEQ ID NO: 433893 - protein, 9 aa, Homo Sapiens
LRQEREETD

SEQ ID NO: 433894 - protein, 9 aa, Homo Sapiens
FTEQAEQER

SEQ ID NO: 433895 - protein, 9 aa, Homo Sapiens
ITNKQKMDT

SEQ ID NO: 433896 - protein, 9 aa, Homo Sapiens
FEYNGLCGY

SEQ ID NO: 433897 - protein, 9 aa, Homo Sapiens
STANTQTPV

SEQ ID NO: 433898 - protein, 9 aa, Homo Sapiens
PIPLVDTRI

SEQ ID NO: 433899 - protein, 9 aa, Homo Sapiens
QILRKRNKA

SEQ ID NO: 433900 - protein, 9 aa, Homo Sapiens
TDHSDESHK

SEQ ID NO: 433901 - protein, 9 aa, Homo Sapiens
LLDHDKEVI

SEQ ID NO: 433902 - protein, 9 aa, Homo Sapiens
ENQRGCFLR

SEQ ID NO: 433903 - protein, 9 aa, Homo Sapiens
NKTDVEERP

SEQ ID NO: 433904 - protein, 9 aa, Homo Sapiens
TVCCLYYTS

SEQ ID NO: 433905 - protein, 9 aa, Homo Sapiens
RKMYDQHGS

SEQ ID NO: 433906 - protein, 9 aa, Homo Sapiens
TILGMCRPI

SEQ ID NO: 433907 - protein, 9 aa, Homo Sapiens
PLKGSVSWM

SEQ ID NO: 433908 - protein, 9 aa, Homo Sapiens
VLFTEKGEA

SEQ ID NO: 433909 - protein, 9 aa, Homo Sapiens
SELIPKALS

SEQ ID NO: 433910 - protein, 9 aa, Homo Sapiens
MKKFVNTMV

SEQ ID NO: 433911 - protein, 9 aa, Homo Sapiens
KDIKFHLYL

SEQ ID NO: 433912 - protein, 9 aa, Homo Sapiens
CYPGYGEAW

SEQ ID NO: 433913 - protein, 9 aa, Homo Sapiens
MLVMHNMFS

SEQ ID NO: 433914 - protein, 9 aa, Homo Sapiens
LQFTLTVCC

SEQ ID NO: 433915 - protein, 9 aa, Homo Sapiens
FFLWESLYP

SEQ ID NO: 433916 - protein, 9 aa, Homo Sapiens
SRNTYREKE

SEQ ID NO: 433917 - protein, 9 aa, Homo Sapiens
SGLFRSLHN

SEQ ID NO: 433918 - protein, 9 aa, Homo Sapiens
ILIVIPSAY

SEQ ID NO: 433919 - protein, 9 aa, Homo Sapiens
MFQYSWNDF

SEQ ID NO: 433920 - protein, 9 aa, Homo Sapiens
CIVHQDLKP

SEQ ID NO: 433921 - protein, 9 aa, Homo Sapiens
RQTGVIHEK

SEQ ID NO: 433922 - protein, 9 aa, Homo Sapiens
LQRHRIIHT

SEQ ID NO: 433923 - protein, 9 aa, Homo Sapiens
TNSILLYGR

SEQ ID NO: 433924 - protein, 9 aa, Homo Sapiens
GVSDERIHL

SEQ ID NO: 433925 - protein, 9 aa, Homo Sapiens
GYMICCDKF

SEQ ID NO: 433926 - protein, 9 aa, Homo Sapiens
VNLNSLITS

SEQ ID NO: 433927 - protein, 9 aa, Homo Sapiens
IMSFVMEYV

SEQ ID NO: 433928 - protein, 9 aa, Homo Sapiens
IITQLFPTL

SEQ ID NO: 433929 - protein, 9 aa, Homo Sapiens
SGGGAEDSA

SEQ ID NO: 433930 - protein, 9 aa, Homo Sapiens
TSKENTNKL

SEQ ID NO: 433931 - protein, 9 aa, Homo Sapiens
SLFPDMEAT

SEQ ID NO: 433932 - protein, 9 aa, Homo Sapiens
TDDFEREKE

SEQ ID NO: 433933 - protein, 9 aa, Homo Sapiens
IWIQPQSST

SEQ ID NO: 433934 - protein, 9 aa, Homo Sapiens
TNNLKYLEA

SEQ ID NO: 433935 - protein, 9 aa, Homo Sapiens
LEPPQRNNY

SEQ ID NO: 433936 - protein, 9 aa, Homo Sapiens
MRPSYSAHE

SEQ ID NO: 433937 - protein, 9 aa, Homo Sapiens
ASTSADTNG

SEQ ID NO: 433938 - protein, 9 aa, Homo Sapiens
CKAQLGIHE

SEQ ID NO: 433939 - protein, 9 aa, Homo Sapiens
YAHINFQQP

SEQ ID NO: 433940 - protein, 9 aa, Homo Sapiens
SDVSSKCFL

SEQ ID NO: 433941 - protein, 9 aa, Homo Sapiens
HPKDIKFHL

SEQ ID NO: 433942 - protein, 9 aa, Homo Sapiens
PCDLKPESA

SEQ ID NO: 433943 - protein, 9 aa, Homo Sapiens
LMLLFPFSL

SEQ ID NO: 433944 - protein, 9 aa, Homo Sapiens
SPEPSSITL

SEQ ID NO: 433945 - protein, 9 aa, Homo Sapiens
LVKFHRSHR

SEQ ID NO: 433946 - protein, 9 aa, Homo Sapiens
LPSLPMVHG

SEQ ID NO: 433947 - protein, 9 aa, Homo Sapiens
QTDFSGLAS

SEQ ID NO: 433948 - protein, 9 aa, Homo Sapiens
PNALRPPRD

SEQ ID NO: 433949 - protein, 9 aa, Homo Sapiens
NKSPMMTWG

SEQ ID NO: 433950 - protein, 9 aa, Homo Sapiens
PVIMERLDK

SEQ ID NO: 433951 - protein, 9 aa, Homo Sapiens
IRGTIPESK

SEQ ID NO: 433952 - protein, 9 aa, Homo Sapiens
TEIVPVGEV

SEQ ID NO: 433953 - protein, 9 aa, Homo Sapiens
DQPLKDQVN

SEQ ID NO: 433954 - protein, 9 aa, Homo Sapiens
SLQQLEVWD

SEQ ID NO: 433955 - protein, 9 aa, Homo Sapiens
ESVQTPGTY

SEQ ID NO: 433956 - protein, 9 aa, Homo Sapiens
DCAFLVGAV

SEQ ID NO: 433957 - protein, 9 aa, Homo Sapiens
DTLTKHYGA

SEQ ID NO: 433958 - protein, 9 aa, Homo Sapiens
NSRLESLPA

SEQ ID NO: 433959 - protein, 9 aa, Homo Sapiens
FNLPEGYTP

SEQ ID NO: 433960 - protein, 9 aa, Homo Sapiens
LNKRIVVYH

SEQ ID NO: 433961 - protein, 9 aa, Homo Sapiens
RLLNDELKT

SEQ ID NO: 433962 - protein, 9 aa, Homo Sapiens
FGYKLKEID

SEQ ID NO: 433963 - protein, 9 aa, Homo Sapiens
KYFTCNPLN

SEQ ID NO: 433964 - protein, 9 aa, Homo Sapiens
ACLETCACC

SEQ ID NO: 433965 - protein, 9 aa, Homo Sapiens
DLRLRQELT

SEQ ID NO: 433966 - protein, 9 aa, Homo Sapiens
VKREYVAYD

SEQ ID NO: 433967 - protein, 9 aa, Homo Sapiens
YESWREMCL

SEQ ID NO: 433968 - protein, 9 aa, Homo Sapiens
RSTVFQIVP

SEQ ID NO: 433969 - protein, 9 aa, Homo Sapiens
SYKVKPFLT

SEQ ID NO: 433970 - protein, 9 aa, Homo Sapiens
IISINGQFV

SEQ ID NO: 433971 - protein, 9 aa, Homo Sapiens
EMCLRLQDA

SEQ ID NO: 433972 - protein, 9 aa, Homo Sapiens
QDVLIQRQT

SEQ ID NO: 433973 - protein, 9 aa, Homo Sapiens
TKFQDMVTF

SEQ ID NO: 433974 - protein, 9 aa, Homo Sapiens
EQENYSFTI

SEQ ID NO: 433975 - protein, 9 aa, Homo Sapiens
HEIVPGACL

SEQ ID NO: 433976 - protein, 9 aa, Homo Sapiens
FYRTEFQNC

SEQ ID NO: 433977 - protein, 9 aa, Homo Sapiens
RTLQINDIA

SEQ ID NO: 433978 - protein, 9 aa, Homo Sapiens
STGVELAPH

SEQ ID NO: 433979 - protein, 9 aa, Homo Sapiens
YFLSFVKEN

SEQ ID NO: 433980 - protein, 9 aa, Homo Sapiens
GQLSHGAVD

SEQ ID NO: 433981 - protein, 9 aa, Homo Sapiens
LCLLRLQVP

SEQ ID NO: 433982 - protein, 9 aa, Homo Sapiens
HLSMYIDKY

SEQ ID NO: 433983 - protein, 9 aa, Homo Sapiens
VHITMGPSA

SEQ ID NO: 433984 - protein, 9 aa, Homo Sapiens
QKSVYMIMD

SEQ ID NO: 433985 - protein, 9 aa, Homo Sapiens
MVGQFFGGQ

SEQ ID NO: 433986 - protein, 9 aa, Homo Sapiens
DIYQYYKLL

SEQ ID NO: 433987 - protein, 9 aa, Homo Sapiens
TIPLGSVVE

SEQ ID NO: 433988 - protein, 9 aa, Homo Sapiens
IKGTPFSVG

SEQ ID NO: 433989 - protein, 9 aa, Homo Sapiens
DMRNKEDHL

SEQ ID NO: 433990 - protein, 9 aa, Homo Sapiens
LRDNFCWNL

SEQ ID NO: 433991 - protein, 9 aa, Homo Sapiens
EEDNESPSS

SEQ ID NO: 433992 - protein, 9 aa, Homo Sapiens
VQTDDTLNS

SEQ ID NO: 433993 - protein, 9 aa, Homo Sapiens
AFSNWICNF

SEQ ID NO: 433994 - protein, 9 aa, Homo Sapiens
VFCLCMAEA

SEQ ID NO: 433995 - protein, 9 aa, Homo Sapiens
MTISICINS

SEQ ID NO: 433996 - protein, 9 aa, Homo Sapiens
HSEAVIYVA

SEQ ID NO: 433997 - protein, 9 aa, Homo Sapiens
FSVWQHIDC

SEQ ID NO: 433998 - protein, 9 aa, Homo Sapiens
IKVIPFTTF

SEQ ID NO: 433999 - protein, 9 aa, Homo Sapiens
SINGQFVVS

SEQ ID NO: 434000 - protein, 9 aa, Homo Sapiens
GRAASLRCS

SEQ ID NO: 434001 - protein, 9 aa, Homo Sapiens
QAFDFLNTK

SEQ ID NO: 434002 - protein, 9 aa, Homo Sapiens
VFFVDVGNI

SEQ ID NO: 434003 - protein, 9 aa, Homo Sapiens
GNNLQEAEK

SEQ ID NO: 434004 - protein, 9 aa, Homo Sapiens
RVNCPGWNE

SEQ ID NO: 434005 - protein, 9 aa, Homo Sapiens
MFPTKGKRG

SEQ ID NO: 434006 - protein, 9 aa, Homo Sapiens
GSRCWMTQF

SEQ ID NO: 434007 - protein, 9 aa, Homo Sapiens
REVCLAKEK

SEQ ID NO: 434008 - protein, 9 aa, Homo Sapiens
SLESRLQVS

SEQ ID NO: 434009 - protein, 9 aa, Homo Sapiens
NMENTLKGL

SEQ ID NO: 434010 - protein, 9 aa, Homo Sapiens
CNTSKAVHE

SEQ ID NO: 434011 - protein, 9 aa, Homo Sapiens
FPAYVHCSF

SEQ ID NO: 434012 - protein, 9 aa, Homo Sapiens
LGVLMGSDC

SEQ ID NO: 434013 - protein, 9 aa, Homo Sapiens
SHLTRHQII

SEQ ID NO: 434014 - protein, 9 aa, Homo Sapiens
RWQETAITS

SEQ ID NO: 434015 - protein, 9 aa, Homo Sapiens
NSHGETVQT

SEQ ID NO: 434016 - protein, 9 aa, Homo Sapiens
LKVQNRRIY

SEQ ID NO: 434017 - protein, 9 aa, Homo Sapiens
SNKTDVEER

SEQ ID NO: 434018 - protein, 9 aa, Homo Sapiens
ALNARFLVM

SEQ ID NO: 434019 - protein, 9 aa, Homo Sapiens
WDRTLHSRP

SEQ ID NO: 434020 - protein, 9 aa, Homo Sapiens
HEIMHRGGK

SEQ ID NO: 434021 - protein, 9 aa, Homo Sapiens
IRNTLPARL

SEQ ID NO: 434022 - protein, 9 aa, Homo Sapiens
PPYSVHSFS

SEQ ID NO: 434023 - protein, 9 aa, Homo Sapiens
DHAAPMEDS

SEQ ID NO: 434024 - protein, 9 aa, Homo Sapiens
AWHAGQTIN

SEQ ID NO: 434025 - protein, 9 aa, Homo Sapiens
YYRQGHIAK

SEQ ID NO: 434026 - protein, 9 aa, Homo Sapiens
CRINTGEKP

SEQ ID NO: 434027 - protein, 9 aa, Homo Sapiens
ETLTEYFQG

SEQ ID NO: 434028 - protein, 9 aa, Homo Sapiens
KLLPIVPID

SEQ ID NO: 434029 - protein, 9 aa, Homo Sapiens
DDEFIDMER

SEQ ID NO: 434030 - protein, 9 aa, Homo Sapiens
LKKTSSSEY

SEQ ID NO: 434031 - protein, 9 aa, Homo Sapiens
NPLTSSLLP

SEQ ID NO: 434032 - protein, 9 aa, Homo Sapiens
NNGNIFNSV

SEQ ID NO: 434033 - protein, 9 aa, Homo Sapiens
FSDTQTKNE

SEQ ID NO: 434034 - protein, 9 aa, Homo Sapiens
ELKFQVFNN

SEQ ID NO: 434035 - protein, 9 aa, Homo Sapiens
LHLIESGHL

SEQ ID NO: 434036 - protein, 9 aa, Homo Sapiens
QEAQMELPE

SEQ ID NO: 434037 - protein, 9 aa, Homo Sapiens
IPFSPSPLN

SEQ ID NO: 434038 - protein, 9 aa, Homo Sapiens
GISNIGIII

SEQ ID NO: 434039 - protein, 9 aa, Homo Sapiens
PPSKVICNM

SEQ ID NO: 434040 - protein, 9 aa, Homo Sapiens
LYSLLSKLL

SEQ ID NO: 434041 - protein, 9 aa, Homo Sapiens
LWWTIAKYA

SEQ ID NO: 434042 - protein, 9 aa, Homo Sapiens
GESNSSDTP

SEQ ID NO: 434043 - protein, 9 aa, Homo Sapiens
DESLSMACH

SEQ ID NO: 434044 - protein, 9 aa, Homo Sapiens
SFSVLLRRV

SEQ ID NO: 434045 - protein, 9 aa, Homo Sapiens
RLFLEPTQK

SEQ ID NO: 434046 - protein, 9 aa, Homo Sapiens
YEERWAFHP

SEQ ID NO: 434047 - protein, 9 aa, Homo Sapiens
FYYSKFFNL

SEQ ID NO: 434048 - protein, 9 aa, Homo Sapiens
SSLSRQTRP

SEQ ID NO: 434049 - protein, 9 aa, Homo Sapiens
GHETTTGKK

SEQ ID NO: 434050 - protein, 9 aa, Homo Sapiens
FLAKAHFAL

SEQ ID NO: 434051 - protein, 9 aa, Homo Sapiens
VCIILAMGT

SEQ ID NO: 434052 - protein, 9 aa, Homo Sapiens
LDEKIQIIA

SEQ ID NO: 434053 - protein, 9 aa, Homo Sapiens
PRKKDRNNR

SEQ ID NO: 434054 - protein, 9 aa, Homo Sapiens
TCATYELNV

SEQ ID NO: 434055 - protein, 9 aa, Homo Sapiens
AGNYIESFL

SEQ ID NO: 434056 - protein, 9 aa, Homo Sapiens
ARTVNENFL

SEQ ID NO: 434057 - protein, 9 aa, Homo Sapiens
RLRCCHRFL

SEQ ID NO: 434058 - protein, 9 aa, Homo Sapiens
RDLVTLRTY

SEQ ID NO: 434059 - protein, 9 aa, Homo Sapiens
GNKFDTTCT

SEQ ID NO: 434060 - protein, 9 aa, Homo Sapiens
KIVVASLLT

SEQ ID NO: 434061 - protein, 9 aa, Homo Sapiens
PRVHVICKD

SEQ ID NO: 434062 - protein, 9 aa, Homo Sapiens
SHMVVSGVG

SEQ ID NO: 434063 - protein, 9 aa, Homo Sapiens
LRLKNYALV

SEQ ID NO: 434064 - protein, 9 aa, Homo Sapiens
APLVKLLLL

SEQ ID NO: 434065 - protein, 9 aa, Homo Sapiens
RHNIKHMEN

SEQ ID NO: 434066 - protein, 9 aa, Homo Sapiens
LLNLSLMNS

SEQ ID NO: 434067 - protein, 9 aa, Homo Sapiens
VLDEANNIN

SEQ ID NO: 434068 - protein, 9 aa, Homo Sapiens
EDESKVTFY

SEQ ID NO: 434069 - protein, 9 aa, Homo Sapiens
LSDTKYLEI

SEQ ID NO: 434070 - protein, 9 aa, Homo Sapiens
LQLYKKLYT

SEQ ID NO: 434071 - protein, 9 aa, Homo Sapiens
KEAIKKEEK

SEQ ID NO: 434072 - protein, 9 aa, Homo Sapiens
KFVNTMVLV

SEQ ID NO: 434073 - protein, 9 aa, Homo Sapiens
QNRRRLFSI

SEQ ID NO: 434074 - protein, 9 aa, Homo Sapiens
VPTPRIKII

SEQ ID NO: 434075 - protein, 9 aa, Homo Sapiens
CSSMTQTDI

SEQ ID NO: 434076 - protein, 9 aa, Homo Sapiens
SSVQALTER

SEQ ID NO: 434077 - protein, 9 aa, Homo Sapiens
EEELDQENK

SEQ ID NO: 434078 - protein, 9 aa, Homo Sapiens
KRKLSSFFK

SEQ ID NO: 434079 - protein, 9 aa, Homo Sapiens
FGVERDQMD

SEQ ID NO: 434080 - protein, 9 aa, Homo Sapiens
AFQVVFTLG

SEQ ID NO: 434081 - protein, 9 aa, Homo Sapiens
IKIPVCEPW

SEQ ID NO: 434082 - protein, 9 aa, Homo Sapiens
EGAHNQGKK

SEQ ID NO: 434083 - protein, 9 aa, Homo Sapiens
VYGLNKFRW

SEQ ID NO: 434084 - protein, 9 aa, Homo Sapiens
PAFEGDDGL

SEQ ID NO: 434085 - protein, 9 aa, Homo Sapiens
TLIQGAPCA

SEQ ID NO: 434086 - protein, 9 aa, Homo Sapiens
SFETIRLFL

SEQ ID NO: 434087 - protein, 9 aa, Homo Sapiens
NDAAPAKGN

SEQ ID NO: 434088 - protein, 9 aa, Homo Sapiens
KIYREYELV

SEQ ID NO: 434089 - protein, 9 aa, Homo Sapiens
DLVKPLKPN

SEQ ID NO: 434090 - protein, 9 aa, Homo Sapiens
MPSKLDSEV

SEQ ID NO: 434091 - protein, 9 aa, Homo Sapiens
NIHLWKANA

SEQ ID NO: 434092 - protein, 9 aa, Homo Sapiens
QENQKQCET

SEQ ID NO: 434093 - protein, 9 aa, Homo Sapiens
CLLLICRCN

SEQ ID NO: 434094 - protein, 9 aa, Homo Sapiens
LILIRLWRV

SEQ ID NO: 434095 - protein, 9 aa, Homo Sapiens
TQIAGCLAS

SEQ ID NO: 434096 - protein, 9 aa, Homo Sapiens
EETAWLSIT

SEQ ID NO: 434097 - protein, 9 aa, Homo Sapiens
SYNVNEYSL

SEQ ID NO: 434098 - protein, 9 aa, Homo Sapiens
EKKIPECGQ

SEQ ID NO: 434099 - protein, 9 aa, Homo Sapiens
DAHLRHDKI

SEQ ID NO: 434100 - protein, 9 aa, Homo Sapiens
QALSKIETR

SEQ ID NO: 434101 - protein, 9 aa, Homo Sapiens
KAHPNQLVL

SEQ ID NO: 434102 - protein, 9 aa, Homo Sapiens
SVSHCGLVG

SEQ ID NO: 434103 - protein, 9 aa, Homo Sapiens
INADPILTN

SEQ ID NO: 434104 - protein, 9 aa, Homo Sapiens
SGRNSTFKS

SEQ ID NO: 434105 - protein, 9 aa, Homo Sapiens
WGCFDECNR

SEQ ID NO: 434106 - protein, 9 aa, Homo Sapiens
TKKPTIPTE

SEQ ID NO: 434107 - protein, 9 aa, Homo Sapiens
TGTVPLLVT

SEQ ID NO: 434108 - protein, 9 aa, Homo Sapiens
LDLGKYNGY

SEQ ID NO: 434109 - protein, 9 aa, Homo Sapiens
LCIALMLGG

SEQ ID NO: 434110 - protein, 9 aa, Homo Sapiens
NKYKKIHTG

SEQ ID NO: 434111 - protein, 9 aa, Homo Sapiens
QVAININDI

SEQ ID NO: 434112 - protein, 9 aa, Homo Sapiens
TDNPNWALL

SEQ ID NO: 434113 - protein, 9 aa, Homo Sapiens
VIRRAYLNG

SEQ ID NO: 434114 - protein, 9 aa, Homo Sapiens
RPWFVGYKI

SEQ ID NO: 434115 - protein, 9 aa, Homo Sapiens
NKPLMIIRH

SEQ ID NO: 434116 - protein, 9 aa, Homo Sapiens
KNLRDMHMQ

SEQ ID NO: 434117 - protein, 9 aa, Homo Sapiens
HSHRSLHRS

SEQ ID NO: 434118 - protein, 9 aa, Homo Sapiens
ALQKRSLDI

SEQ ID NO: 434119 - protein, 9 aa, Homo Sapiens
HRPCGKQGS

SEQ ID NO: 434120 - protein, 9 aa, Homo Sapiens
FCEERDVLV

SEQ ID NO: 434121 - protein, 9 aa, Homo Sapiens
DPWESEQVQ

SEQ ID NO: 434122 - protein, 9 aa, Homo Sapiens
NLNKYKKIH

SEQ ID NO: 434123 - protein, 9 aa, Homo Sapiens
EAKGVNSQN

SEQ ID NO: 434124 - protein, 9 aa, Homo Sapiens
NIIHRYIKP

SEQ ID NO: 434125 - protein, 9 aa, Homo Sapiens
RHQRVHTEI

SEQ ID NO: 434126 - protein, 9 aa, Homo Sapiens
CDHNFVTPS

SEQ ID NO: 434127 - protein, 9 aa, Homo Sapiens
KRWFQLYRS

SEQ ID NO: 434128 - protein, 9 aa, Homo Sapiens
DSVVFNALV

SEQ ID NO: 434129 - protein, 9 aa, Homo Sapiens
KKLDYLLTS

SEQ ID NO: 434130 - protein, 9 aa, Homo Sapiens
QEKEKLMYG

SEQ ID NO: 434131 - protein, 9 aa, Homo Sapiens
RSAYEPDRN

SEQ ID NO: 434132 - protein, 9 aa, Homo Sapiens
EVKTKNNKQ

SEQ ID NO: 434133 - protein, 9 aa, Homo Sapiens
GPFLADFVR

SEQ ID NO: 434134 - protein, 9 aa, Homo Sapiens
WSQWSLCGG

SEQ ID NO: 434135 - protein, 9 aa, Homo Sapiens
CDVIMETPL

SEQ ID NO: 434136 - protein, 9 aa, Homo Sapiens
LTQPPQQLL

SEQ ID NO: 434137 - protein, 9 aa, Homo Sapiens
DKELAKSMA

SEQ ID NO: 434138 - protein, 9 aa, Homo Sapiens
QFVILRNKK

SEQ ID NO: 434139 - protein, 9 aa, Homo Sapiens
LNKIFEHKL

SEQ ID NO: 434140 - protein, 9 aa, Homo Sapiens
SSVTYPIKM

SEQ ID NO: 434141 - protein, 9 aa, Homo Sapiens
QVHDQNIKE

SEQ ID NO: 434142 - protein, 9 aa, Homo Sapiens
MAACSGQAE

SEQ ID NO: 434143 - protein, 9 aa, Homo Sapiens
LHKLPKLLC

SEQ ID NO: 434144 - protein, 9 aa, Homo Sapiens
GDTFHLSFC

SEQ ID NO: 434145 - protein, 9 aa, Homo Sapiens
EAELYDPLK

SEQ ID NO: 434146 - protein, 9 aa, Homo Sapiens
DVREGRVQW

SEQ ID NO: 434147 - protein, 9 aa, Homo Sapiens
QCRNGVVLH

SEQ ID NO: 434148 - protein, 9 aa, Homo Sapiens
RVAELSSDA

SEQ ID NO: 434149 - protein, 9 aa, Homo Sapiens
ARKAVAMMF

SEQ ID NO: 434150 - protein, 9 aa, Homo Sapiens
QILHTGVKP

SEQ ID NO: 434151 - protein, 9 aa, Homo Sapiens
VTYFYNPLI

SEQ ID NO: 434152 - protein, 9 aa, Homo Sapiens
KKEECVQGE

SEQ ID NO: 434153 - protein, 9 aa, Homo Sapiens
LEMLRLPVF

SEQ ID NO: 434154 - protein, 9 aa, Homo Sapiens
NRVIDRAEK

SEQ ID NO: 434155 - protein, 9 aa, Homo Sapiens
LYWGTPIPI

SEQ ID NO: 434156 - protein, 9 aa, Homo Sapiens
TNGGRQTQR

SEQ ID NO: 434157 - protein, 9 aa, Homo Sapiens
EATVVCLFR

SEQ ID NO: 434158 - protein, 9 aa, Homo Sapiens
RIYRFNTVI

SEQ ID NO: 434159 - protein, 9 aa, Homo Sapiens
ENKLLEDRI

SEQ ID NO: 434160 - protein, 9 aa, Homo Sapiens
LWISYSDGD

SEQ ID NO: 434161 - protein, 9 aa, Homo Sapiens
AYLRSLSLE

SEQ ID NO: 434162 - protein, 9 aa, Homo Sapiens
RRVWKKHPV

SEQ ID NO: 434163 - protein, 9 aa, Homo Sapiens
LDFLAKAHF

SEQ ID NO: 434164 - protein, 9 aa, Homo Sapiens
EASSPHPTA

SEQ ID NO: 434165 - protein, 9 aa, Homo Sapiens
YHQITLLDL

SEQ ID NO: 434166 - protein, 9 aa, Homo Sapiens
VAVEYFKNT

SEQ ID NO: 434167 - protein, 9 aa, Homo Sapiens
FPILLCDIS

SEQ ID NO: 434168 - protein, 9 aa, Homo Sapiens
SHFPQHYKS

SEQ ID NO: 434169 - protein, 9 aa, Homo Sapiens
NLLLNCFPS

SEQ ID NO: 434170 - protein, 9 aa, Homo Sapiens
LLKDAYLEV

SEQ ID NO: 434171 - protein, 9 aa, Homo Sapiens
VDVNHLNTC

SEQ ID NO: 434172 - protein, 9 aa, Homo Sapiens
KNTKKVIQY

SEQ ID NO: 434173 - protein, 9 aa, Homo Sapiens
YQSVEQTYS

SEQ ID NO: 434174 - protein, 9 aa, Homo Sapiens
DNIDSQGRI

SEQ ID NO: 434175 - protein, 9 aa, Homo Sapiens
TLLPQLLGM

SEQ ID NO: 434176 - protein, 9 aa, Homo Sapiens
RRNQELKQH

SEQ ID NO: 434177 - protein, 9 aa, Homo Sapiens
QVLSSLHMA

SEQ ID NO: 434178 - protein, 9 aa, Homo Sapiens
FDPKKGCWC

SEQ ID NO: 434179 - protein, 9 aa, Homo Sapiens
LLHGEKVHL

SEQ ID NO: 434180 - protein, 9 aa, Homo Sapiens
FQNEIKLLR

SEQ ID NO: 434181 - protein, 9 aa, Homo Sapiens
NGWNPFLYP

SEQ ID NO: 434182 - protein, 9 aa, Homo Sapiens
PKEAIKKEE

SEQ ID NO: 434183 - protein, 9 aa, Homo Sapiens
KQFQLCKEL

SEQ ID NO: 434184 - protein, 9 aa, Homo Sapiens
DDAPIPRIN

SEQ ID NO: 434185 - protein, 9 aa, Homo Sapiens
FSFVAELSV

SEQ ID NO: 434186 - protein, 9 aa, Homo Sapiens
GGNRLHNQI

SEQ ID NO: 434187 - protein, 9 aa, Homo Sapiens
TQLMNEIKY

SEQ ID NO: 434188 - protein, 9 aa, Homo Sapiens
MVVSGVGIW

SEQ ID NO: 434189 - protein, 9 aa, Homo Sapiens
PPQRNNYSK

SEQ ID NO: 434190 - protein, 9 aa, Homo Sapiens
SMDEPLNTL

SEQ ID NO: 434191 - protein, 9 aa, Homo Sapiens
AFDPKKGCW

SEQ ID NO: 434192 - protein, 9 aa, Homo Sapiens
CPCSDDVTP

SEQ ID NO: 434193 - protein, 9 aa, Homo Sapiens
LRPRGERHL

SEQ ID NO: 434194 - protein, 9 aa, Homo Sapiens
RKMSKHALD

SEQ ID NO: 434195 - protein, 9 aa, Homo Sapiens
VDQPLKDQV

SEQ ID NO: 434196 - protein, 9 aa, Homo Sapiens
EQVTIFEEV

SEQ ID NO: 434197 - protein, 9 aa, Homo Sapiens
GRPENIHNK

SEQ ID NO: 434198 - protein, 9 aa, Homo Sapiens
NEDYLIIMI

SEQ ID NO: 434199 - protein, 9 aa, Homo Sapiens
CLIHKCCFS

SEQ ID NO: 434200 - protein, 9 aa, Homo Sapiens
TSNKIRMQL

SEQ ID NO: 434201 - protein, 9 aa, Homo Sapiens
TVDWTVHSG

SEQ ID NO: 434202 - protein, 9 aa, Homo Sapiens
QAEIHQLKK

SEQ ID NO: 434203 - protein, 9 aa, Homo Sapiens
AILGNGTII

SEQ ID NO: 434204 - protein, 9 aa, Homo Sapiens
GYVCIAMEV

SEQ ID NO: 434205 - protein, 9 aa, Homo Sapiens
CRKTFCVKT

SEQ ID NO: 434206 - protein, 9 aa, Homo Sapiens
EKNNSGALE

SEQ ID NO: 434207 - protein, 9 aa, Homo Sapiens
DSSDLKTRP

SEQ ID NO: 434208 - protein, 9 aa, Homo Sapiens
EKSTHAHLS

SEQ ID NO: 434209 - protein, 9 aa, Homo Sapiens
TLNIHPSTG

SEQ ID NO: 434210 - protein, 9 aa, Homo Sapiens
AKQYRKMVM

SEQ ID NO: 434211 - protein, 9 aa, Homo Sapiens
QEQVTIFEE

SEQ ID NO: 434212 - protein, 9 aa, Homo Sapiens
EFSQLSVND

SEQ ID NO: 434213 - protein, 9 aa, Homo Sapiens
YHKITHTGE

SEQ ID NO: 434214 - protein, 9 aa, Homo Sapiens
VVVKYLPEG

SEQ ID NO: 434215 - protein, 9 aa, Homo Sapiens
APANLGYDG

SEQ ID NO: 434216 - protein, 9 aa, Homo Sapiens
NTYHDWLWE

SEQ ID NO: 434217 - protein, 9 aa, Homo Sapiens
GNSNTRFRI

SEQ ID NO: 434218 - protein, 9 aa, Homo Sapiens
PTMLPQLEQ

SEQ ID NO: 434219 - protein, 9 aa, Homo Sapiens
CVDMLKELT

SEQ ID NO: 434220 - protein, 9 aa, Homo Sapiens
GSCTKKKRK

SEQ ID NO: 434221 - protein, 9 aa, Homo Sapiens
DRTMLDYLW

SEQ ID NO: 434222 - protein, 9 aa, Homo Sapiens
QLFFFILNF

SEQ ID NO: 434223 - protein, 9 aa, Homo Sapiens
ITGTLRTQT

SEQ ID NO: 434224 - protein, 9 aa, Homo Sapiens
SPRVRELSA

SEQ ID NO: 434225 - protein, 9 aa, Homo Sapiens
TLILHKIIH

SEQ ID NO: 434226 - protein, 9 aa, Homo Sapiens
EEEREYNCQ

SEQ ID NO: 434227 - protein, 9 aa, Homo Sapiens
HYQEVTSVC

SEQ ID NO: 434228 - protein, 9 aa, Homo Sapiens
KYLTEEIRS

SEQ ID NO: 434229 - protein, 9 aa, Homo Sapiens
SSPHPTAEG

SEQ ID NO: 434230 - protein, 9 aa, Homo Sapiens
AFFSLYFGL

SEQ ID NO: 434231 - protein, 9 aa, Homo Sapiens
MFTMLQELD

SEQ ID NO: 434232 - protein, 9 aa, Homo Sapiens
EPPQRNNYS

SEQ ID NO: 434233 - protein, 9 aa, Homo Sapiens
TLAAERKFF

SEQ ID NO: 434234 - protein, 9 aa, Homo Sapiens
PMNLLARDA

SEQ ID NO: 434235 - protein, 9 aa, Homo Sapiens
VDMSTRRSG

SEQ ID NO: 434236 - protein, 9 aa, Homo Sapiens
TGGNTYSVS

SEQ ID NO: 434237 - protein, 9 aa, Homo Sapiens
ILLYGSALF

SEQ ID NO: 434238 - protein, 9 aa, Homo Sapiens
MEKCNTISV

SEQ ID NO: 434239 - protein, 9 aa, Homo Sapiens
PNLLSRNSE

SEQ ID NO: 434240 - protein, 9 aa, Homo Sapiens
CHPACLVNG

SEQ ID NO: 434241 - protein, 9 aa, Homo Sapiens
SKNEDRKKG

SEQ ID NO: 434242 - protein, 9 aa, Homo Sapiens
PLSRSKLPD

SEQ ID NO: 434243 - protein, 9 aa, Homo Sapiens
QGCCVNGQC

SEQ ID NO: 434244 - protein, 9 aa, Homo Sapiens
QILEEGPFH

SEQ ID NO: 434245 - protein, 9 aa, Homo Sapiens
SANIQFNTD

SEQ ID NO: 434246 - protein, 9 aa, Homo Sapiens
KLAKENKLL

SEQ ID NO: 434247 - protein, 9 aa, Homo Sapiens
DHCAACRTY

SEQ ID NO: 434248 - protein, 9 aa, Homo Sapiens
TKRRQRVKI

SEQ ID NO: 434249 - protein, 9 aa, Homo Sapiens
CEITSNNGT

SEQ ID NO: 434250 - protein, 9 aa, Homo Sapiens
PLSRDPSSP

SEQ ID NO: 434251 - protein, 9 aa, Homo Sapiens
VAQKPQSHF

SEQ ID NO: 434252 - protein, 9 aa, Homo Sapiens
LWASAPSPE

SEQ ID NO: 434253 - protein, 9 aa, Homo Sapiens
RGYSARPWG

SEQ ID NO: 434254 - protein, 9 aa, Homo Sapiens
SQSAKSLSL

SEQ ID NO: 434255 - protein, 9 aa, Homo Sapiens
YPEFTPRFS

SEQ ID NO: 434256 - protein, 9 aa, Homo Sapiens
SAIQVKNDI

SEQ ID NO: 434257 - protein, 9 aa, Homo Sapiens
ETFVCHTEK

SEQ ID NO: 434258 - protein, 9 aa, Homo Sapiens
RRFLLTGPP

SEQ ID NO: 434259 - protein, 9 aa, Homo Sapiens
IDHDACSYV

SEQ ID NO: 434260 - protein, 9 aa, Homo Sapiens
NSLETGEII

SEQ ID NO: 434261 - protein, 9 aa, Homo Sapiens
NKKIEKIKK

SEQ ID NO: 434262 - protein, 9 aa, Homo Sapiens
IVVECMMKD

SEQ ID NO: 434263 - protein, 9 aa, Homo Sapiens
ASTSEFLKH

SEQ ID NO: 434264 - protein, 9 aa, Homo Sapiens
SDTFSTQPT

SEQ ID NO: 434265 - protein, 9 aa, Homo Sapiens
SSSEYSIFD

SEQ ID NO: 434266 - protein, 9 aa, Homo Sapiens
FISFVMGAT

SEQ ID NO: 434267 - protein, 9 aa, Homo Sapiens
YHSRGEYNV

SEQ ID NO: 434268 - protein, 9 aa, Homo Sapiens
SGATVGSSM

SEQ ID NO: 434269 - protein, 9 aa, Homo Sapiens
DGNFILRDS

SEQ ID NO: 434270 - protein, 9 aa, Homo Sapiens
QKDVASLSV

SEQ ID NO: 434271 - protein, 9 aa, Homo Sapiens
DKQIYRLSE

SEQ ID NO: 434272 - protein, 9 aa, Homo Sapiens
RGHHSSANS

SEQ ID NO: 434273 - protein, 9 aa, Homo Sapiens
KVTGVAFPL

SEQ ID NO: 434274 - protein, 9 aa, Homo Sapiens
AYNNFQKSM

SEQ ID NO: 434275 - protein, 9 aa, Homo Sapiens
LKILGFKGV

SEQ ID NO: 434276 - protein, 9 aa, Homo Sapiens
KVELERNRK

SEQ ID NO: 434277 - protein, 9 aa, Homo Sapiens
NRALGWAVG

SEQ ID NO: 434278 - protein, 9 aa, Homo Sapiens
CDVLRFECQ

SEQ ID NO: 434279 - protein, 9 aa, Homo Sapiens
EEEDDDAIH

SEQ ID NO: 434280 - protein, 9 aa, Homo Sapiens
KDATKNAKK

SEQ ID NO: 434281 - protein, 9 aa, Homo Sapiens
SGLLNNFQD

SEQ ID NO: 434282 - protein, 9 aa, Homo Sapiens
TIGGFDHKR

SEQ ID NO: 434283 - protein, 9 aa, Homo Sapiens
LPVYSLEGE

SEQ ID NO: 434284 - protein, 9 aa, Homo Sapiens
QLINKKEIC

SEQ ID NO: 434285 - protein, 9 aa, Homo Sapiens
MYGLASVKN

SEQ ID NO: 434286 - protein, 9 aa, Homo Sapiens
SHLANHQKI

SEQ ID NO: 434287 - protein, 9 aa, Homo Sapiens
DCLKIFLND

SEQ ID NO: 434288 - protein, 9 aa, Homo Sapiens
SVSVSDILV

SEQ ID NO: 434289 - protein, 9 aa, Homo Sapiens
DVVVTNFRF

SEQ ID NO: 434290 - protein, 9 aa, Homo Sapiens
FLNKEPLLN

SEQ ID NO: 434291 - protein, 9 aa, Homo Sapiens
NEPTPNYKG

SEQ ID NO: 434292 - protein, 9 aa, Homo Sapiens
YGVTPLFNA

SEQ ID NO: 434293 - protein, 9 aa, Homo Sapiens
GSLQSRDEE

SEQ ID NO: 434294 - protein, 9 aa, Homo Sapiens
FYMLSLTSV

SEQ ID NO: 434295 - protein, 9 aa, Homo Sapiens
IYGNGAESN

SEQ ID NO: 434296 - protein, 9 aa, Homo Sapiens
ASGSSDKRG

SEQ ID NO: 434297 - protein, 9 aa, Homo Sapiens
PDLIGPKGD

SEQ ID NO: 434298 - protein, 9 aa, Homo Sapiens
CSGTPSSEM

SEQ ID NO: 434299 - protein, 9 aa, Homo Sapiens
PTCGSHLSV

SEQ ID NO: 434300 - protein, 9 aa, Homo Sapiens
LLIAVEMLF

SEQ ID NO: 434301 - protein, 9 aa, Homo Sapiens
KVLSSSPQS

SEQ ID NO: 434302 - protein, 9 aa, Homo Sapiens
CHSHTPTPV

SEQ ID NO: 434303 - protein, 9 aa, Homo Sapiens
NLEHIPKFL

SEQ ID NO: 434304 - protein, 9 aa, Homo Sapiens
ENIEVITHQ

SEQ ID NO: 434305 - protein, 9 aa, Homo Sapiens
SKDARSQNI

SEQ ID NO: 434306 - protein, 9 aa, Homo Sapiens
LHKIIHSGQ

SEQ ID NO: 434307 - protein, 9 aa, Homo Sapiens
SFTKQSIYL

SEQ ID NO: 434308 - protein, 9 aa, Homo Sapiens
FRASYAAEE

SEQ ID NO: 434309 - protein, 9 aa, Homo Sapiens
QRQLNLSNP

SEQ ID NO: 434310 - protein, 9 aa, Homo Sapiens
TVSNNKTPH

SEQ ID NO: 434311 - protein, 9 aa, Homo Sapiens
IGCTNVDGC

SEQ ID NO: 434312 - protein, 9 aa, Homo Sapiens
YAVIAGSSN

SEQ ID NO: 434313 - protein, 9 aa, Homo Sapiens
QQDFLDTYN

SEQ ID NO: 434314 - protein, 9 aa, Homo Sapiens
LTDHKIIHT

SEQ ID NO: 434315 - protein, 9 aa, Homo Sapiens
LLFVNEATR

SEQ ID NO: 434316 - protein, 9 aa, Homo Sapiens
LYKFCSLPE

SEQ ID NO: 434317 - protein, 9 aa, Homo Sapiens
MLDRIYRFN

SEQ ID NO: 434318 - protein, 9 aa, Homo Sapiens
GAPDSAIRQ

SEQ ID NO: 434319 - protein, 9 aa, Homo Sapiens
NRKKHMHVH

SEQ ID NO: 434320 - protein, 9 aa, Homo Sapiens
QACLETCAC

SEQ ID NO: 434321 - protein, 9 aa, Homo Sapiens
PVGMYGWRK

SEQ ID NO: 434322 - protein, 9 aa, Homo Sapiens
KQSIGLIQP

SEQ ID NO: 434323 - protein, 9 aa, Homo Sapiens
QDWPLNEKI

SEQ ID NO: 434324 - protein, 9 aa, Homo Sapiens
DSGSSAEEE

SEQ ID NO: 434325 - protein, 9 aa, Homo Sapiens
IKEDYLGIL

SEQ ID NO: 434326 - protein, 9 aa, Homo Sapiens
ITLESFFAW

SEQ ID NO: 434327 - protein, 9 aa, Homo Sapiens
EVDSEVECP

SEQ ID NO: 434328 - protein, 9 aa, Homo Sapiens
YCEDKHTFL

SEQ ID NO: 434329 - protein, 9 aa, Homo Sapiens
LTDIEIVCR

SEQ ID NO: 434330 - protein, 9 aa, Homo Sapiens
DVFEQTRVC

SEQ ID NO: 434331 - protein, 9 aa, Homo Sapiens
KYGIDNFTS

SEQ ID NO: 434332 - protein, 9 aa, Homo Sapiens
DTSMKGMRK

SEQ ID NO: 434333 - protein, 9 aa, Homo Sapiens
CLHLIESGH

SEQ ID NO: 434334 - protein, 9 aa, Homo Sapiens
PTNNSEERL

SEQ ID NO: 434335 - protein, 9 aa, Homo Sapiens
TNQLGKGRK

SEQ ID NO: 434336 - protein, 9 aa, Homo Sapiens
YLDGLLVFD

SEQ ID NO: 434337 - protein, 9 aa, Homo Sapiens
SDLAVCRAR

SEQ ID NO: 434338 - protein, 9 aa, Homo Sapiens
INSPTKRVD

SEQ ID NO: 434339 - protein, 9 aa, Homo Sapiens
TIMCVPTFQ

SEQ ID NO: 434340 - protein, 9 aa, Homo Sapiens
WKLVHEIGL

SEQ ID NO: 434341 - protein, 9 aa, Homo Sapiens
MSSQYLFKL

SEQ ID NO: 434342 - protein, 9 aa, Homo Sapiens
IGADKLLSG

SEQ ID NO: 434343 - protein, 9 aa, Homo Sapiens
MERRHPVCY

SEQ ID NO: 434344 - protein, 9 aa, Homo Sapiens
KYIFDFEKV

SEQ ID NO: 434345 - protein, 9 aa, Homo Sapiens
NEKSYQLKN

SEQ ID NO: 434346 - protein, 9 aa, Homo Sapiens
FNDLIDCAF

SEQ ID NO: 434347 - protein, 9 aa, Homo Sapiens
PPCTGDGKN

SEQ ID NO: 434348 - protein, 9 aa, Homo Sapiens
LMSNYGCTG

SEQ ID NO: 434349 - protein, 9 aa, Homo Sapiens
LFDHHLMES

SEQ ID NO: 434350 - protein, 9 aa, Homo Sapiens
HKRLCQPPP

SEQ ID NO: 434351 - protein, 9 aa, Homo Sapiens
WGDYGGSGT

SEQ ID NO: 434352 - protein, 9 aa, Homo Sapiens
VLMVRFTSL

SEQ ID NO: 434353 - protein, 9 aa, Homo Sapiens
QEEQGKISE

SEQ ID NO: 434354 - protein, 9 aa, Homo Sapiens
SNKIRMQLQ

SEQ ID NO: 434355 - protein, 9 aa, Homo Sapiens
PVLEYINLV

SEQ ID NO: 434356 - protein, 9 aa, Homo Sapiens
GNYKVDSPN

SEQ ID NO: 434357 - protein, 9 aa, Homo Sapiens
IQFFYFHIG

SEQ ID NO: 434358 - protein, 9 aa, Homo Sapiens
SCFFLWPLE

SEQ ID NO: 434359 - protein, 9 aa, Homo Sapiens
AAQENPSPN

SEQ ID NO: 434360 - protein, 9 aa, Homo Sapiens
SRYQSDPNL

SEQ ID NO: 434361 - protein, 9 aa, Homo Sapiens
RYGTNNIIG

SEQ ID NO: 434362 - protein, 9 aa, Homo Sapiens
LSLCLLLSL

SEQ ID NO: 434363 - protein, 9 aa, Homo Sapiens
GIVVTPDGD

SEQ ID NO: 434364 - protein, 9 aa, Homo Sapiens
DVMLEIYNH

SEQ ID NO: 434365 - protein, 9 aa, Homo Sapiens
VDKVSQKQT

SEQ ID NO: 434366 - protein, 9 aa, Homo Sapiens
AIQVDSVNT

SEQ ID NO: 434367 - protein, 9 aa, Homo Sapiens
LTPFVFRIS

SEQ ID NO: 434368 - protein, 9 aa, Homo Sapiens
TSWQTDIPP

SEQ ID NO: 434369 - protein, 9 aa, Homo Sapiens
HENASQVPL

SEQ ID NO: 434370 - protein, 9 aa, Homo Sapiens
NTFCHSSAA

SEQ ID NO: 434371 - protein, 9 aa, Homo Sapiens
ARRCAQHWA

SEQ ID NO: 434372 - protein, 9 aa, Homo Sapiens
IVNRLNMYN

SEQ ID NO: 434373 - protein, 9 aa, Homo Sapiens
LTDELYVLR

SEQ ID NO: 434374 - protein, 9 aa, Homo Sapiens
MVRASHGVW

SEQ ID NO: 434375 - protein, 9 aa, Homo Sapiens
FLYCEPHKI

SEQ ID NO: 434376 - protein, 9 aa, Homo Sapiens
YTMEVEVKD

SEQ ID NO: 434377 - protein, 9 aa, Homo Sapiens
LHINHNYLE

SEQ ID NO: 434378 - protein, 9 aa, Homo Sapiens
HFALLMALV

SEQ ID NO: 434379 - protein, 9 aa, Homo Sapiens
YLTGPYLDV

SEQ ID NO: 434380 - protein, 9 aa, Homo Sapiens
SVLDCVNLQ

SEQ ID NO: 434381 - protein, 9 aa, Homo Sapiens
HHSSANSVV

SEQ ID NO: 434382 - protein, 9 aa, Homo Sapiens
VRTATDYTK

SEQ ID NO: 434383 - protein, 9 aa, Homo Sapiens
LAEHFYLTA

SEQ ID NO: 434384 - protein, 9 aa, Homo Sapiens
HTSPKVNNL

SEQ ID NO: 434385 - protein, 9 aa, Homo Sapiens
FLLSLFLVI

SEQ ID NO: 434386 - protein, 9 aa, Homo Sapiens
PVWFYMQTA

SEQ ID NO: 434387 - protein, 9 aa, Homo Sapiens
SDQRLRPRI

SEQ ID NO: 434388 - protein, 9 aa, Homo Sapiens
GNVVMLVPL

SEQ ID NO: 434389 - protein, 9 aa, Homo Sapiens
HWDLVTMVE

SEQ ID NO: 434390 - protein, 9 aa, Homo Sapiens
CVEKWCCDY

SEQ ID NO: 434391 - protein, 9 aa, Homo Sapiens
MNQVQSTMD

SEQ ID NO: 434392 - protein, 9 aa, Homo Sapiens
HVEFKMFTT

SEQ ID NO: 434393 - protein, 9 aa, Homo Sapiens
HAFNNYHSQ

SEQ ID NO: 434394 - protein, 9 aa, Homo Sapiens
QECMKKCIS

SEQ ID NO: 434395 - protein, 9 aa, Homo Sapiens
IAQKNAGME

SEQ ID NO: 434396 - protein, 9 aa, Homo Sapiens
LPPTHDPGL

SEQ ID NO: 434397 - protein, 9 aa, Homo Sapiens
QIEKEKETL

SEQ ID NO: 434398 - protein, 9 aa, Homo Sapiens
CMDLVGGFR

SEQ ID NO: 434399 - protein, 9 aa, Homo Sapiens
NFDQPHQFY

SEQ ID NO: 434400 - protein, 9 aa, Homo Sapiens
PDLNMQRSR

SEQ ID NO: 434401 - protein, 9 aa, Homo Sapiens
LVTAALQLT

SEQ ID NO: 434402 - protein, 9 aa, Homo Sapiens
QFFVFNDIL

SEQ ID NO: 434403 - protein, 9 aa, Homo Sapiens
ETLRKGADS

SEQ ID NO: 434404 - protein, 9 aa, Homo Sapiens
KMLPSKDGN

SEQ ID NO: 434405 - protein, 9 aa, Homo Sapiens
ESKAGITAS

SEQ ID NO: 434406 - protein, 9 aa, Homo Sapiens
SSTLFSSSH

SEQ ID NO: 434407 - protein, 9 aa, Homo Sapiens
LLSSFLSQC

SEQ ID NO: 434408 - protein, 9 aa, Homo Sapiens
GEMSSLAGK

SEQ ID NO: 434409 - protein, 9 aa, Homo Sapiens
GVVELVKSH

SEQ ID NO: 434410 - protein, 9 aa, Homo Sapiens
NHFIMEYLF

SEQ ID NO: 434411 - protein, 9 aa, Homo Sapiens
EHVPRFSVM

SEQ ID NO: 434412 - protein, 9 aa, Homo Sapiens
LNTMFCQLA

SEQ ID NO: 434413 - protein, 9 aa, Homo Sapiens
ATLTSRNRE

SEQ ID NO: 434414 - protein, 9 aa, Homo Sapiens
QTGGRLGKV

SEQ ID NO: 434415 - protein, 9 aa, Homo Sapiens
EDIDEDTSM

SEQ ID NO: 434416 - protein, 9 aa, Homo Sapiens
GDLVKPLKP

SEQ ID NO: 434417 - protein, 9 aa, Homo Sapiens
MCAVLYDAV

SEQ ID NO: 434418 - protein, 9 aa, Homo Sapiens
SLLVLVVCY

SEQ ID NO: 434419 - protein, 9 aa, Homo Sapiens
NNKMSAYNL

SEQ ID NO: 434420 - protein, 9 aa, Homo Sapiens
FCANALAAR

SEQ ID NO: 434421 - protein, 9 aa, Homo Sapiens
HPNVDKLEI

SEQ ID NO: 434422 - protein, 9 aa, Homo Sapiens
LNEAGLEDS

SEQ ID NO: 434423 - protein, 9 aa, Homo Sapiens
ADMTKVFYI

SEQ ID NO: 434424 - protein, 9 aa, Homo Sapiens
CFLLGNVAD

SEQ ID NO: 434425 - protein, 9 aa, Homo Sapiens
QSHFLYAYG

SEQ ID NO: 434426 - protein, 9 aa, Homo Sapiens
VTAYLLENK

SEQ ID NO: 434427 - protein, 9 aa, Homo Sapiens
LLDELYIEL

SEQ ID NO: 434428 - protein, 9 aa, Homo Sapiens
LEDDRFPTH

SEQ ID NO: 434429 - protein, 9 aa, Homo Sapiens
LRSTFHNMY

SEQ ID NO: 434430 - protein, 9 aa, Homo Sapiens
DVLKKPVRR

SEQ ID NO: 434431 - protein, 9 aa, Homo Sapiens
NTEEAGRIT

SEQ ID NO: 434432 - protein, 9 aa, Homo Sapiens
HGKNVPKYQ

SEQ ID NO: 434433 - protein, 9 aa, Homo Sapiens
SWDMGNLYL

SEQ ID NO: 434434 - protein, 9 aa, Homo Sapiens
QKVYLTWSV

SEQ ID NO: 434435 - protein, 9 aa, Homo Sapiens
PVQKVVTEM

SEQ ID NO: 434436 - protein, 9 aa, Homo Sapiens
FSNDGSVSC

SEQ ID NO: 434437 - protein, 9 aa, Homo Sapiens
IVVCHAKNY

SEQ ID NO: 434438 - protein, 9 aa, Homo Sapiens
AHNQGKKAE

SEQ ID NO: 434439 - protein, 9 aa, Homo Sapiens
PSPAPGVNK

SEQ ID NO: 434440 - protein, 9 aa, Homo Sapiens
AISPLTFLS

SEQ ID NO: 434441 - protein, 9 aa, Homo Sapiens
VYCTPKKGS

SEQ ID NO: 434442 - protein, 9 aa, Homo Sapiens
TLLHLAVPL

SEQ ID NO: 434443 - protein, 9 aa, Homo Sapiens
NTFIKIPVC

SEQ ID NO: 434444 - protein, 9 aa, Homo Sapiens
KESEKVSDD

SEQ ID NO: 434445 - protein, 9 aa, Homo Sapiens
SRLDKLGLR

SEQ ID NO: 434446 - protein, 9 aa, Homo Sapiens
LETCACCCP

SEQ ID NO: 434447 - protein, 9 aa, Homo Sapiens
SYTCTCGPG

SEQ ID NO: 434448 - protein, 9 aa, Homo Sapiens
SDAFHLDRH

SEQ ID NO: 434449 - protein, 9 aa, Homo Sapiens
AVTAQGDGY

SEQ ID NO: 434450 - protein, 9 aa, Homo Sapiens
KESDQILAI

SEQ ID NO: 434451 - protein, 9 aa, Homo Sapiens
NTISDKEAV

SEQ ID NO: 434452 - protein, 9 aa, Homo Sapiens
GLSYSPAGS

SEQ ID NO: 434453 - protein, 9 aa, Homo Sapiens
WKRILIHHR

SEQ ID NO: 434454 - protein, 9 aa, Homo Sapiens
QNVISYLEQ

SEQ ID NO: 434455 - protein, 9 aa, Homo Sapiens
DRCSSLIEL

SEQ ID NO: 434456 - protein, 9 aa, Homo Sapiens
NKFRWYRFQ

SEQ ID NO: 434457 - protein, 9 aa, Homo Sapiens
AILCCFLVA

SEQ ID NO: 434458 - protein, 9 aa, Homo Sapiens
MRNKEDHLE

SEQ ID NO: 434459 - protein, 9 aa, Homo Sapiens
LVKVLLYSL

SEQ ID NO: 434460 - protein, 9 aa, Homo Sapiens
IRIHEIIHT

SEQ ID NO: 434461 - protein, 9 aa, Homo Sapiens
EPPATIGTQ

SEQ ID NO: 434462 - protein, 9 aa, Homo Sapiens
CQVHASGPH

SEQ ID NO: 434463 - protein, 9 aa, Homo Sapiens
SCLMSIVSA

SEQ ID NO: 434464 - protein, 9 aa, Homo Sapiens
TCKPKKKDA

SEQ ID NO: 434465 - protein, 9 aa, Homo Sapiens
LMGVHLLPP

SEQ ID NO: 434466 - protein, 9 aa, Homo Sapiens
NGDFSDWPF

SEQ ID NO: 434467 - protein, 9 aa, Homo Sapiens
RDRDPSETV

SEQ ID NO: 434468 - protein, 9 aa, Homo Sapiens
MNNVEFKAQ

SEQ ID NO: 434469 - protein, 9 aa, Homo Sapiens
AECVTFSLL

SEQ ID NO: 434470 - protein, 9 aa, Homo Sapiens
NGLFDQFIG

SEQ ID NO: 434471 - protein, 9 aa, Homo Sapiens
YTLSSLPLV

SEQ ID NO: 434472 - protein, 9 aa, Homo Sapiens
NYPNSCSPR

SEQ ID NO: 434473 - protein, 9 aa, Homo Sapiens
DLERTFFAY

SEQ ID NO: 434474 - protein, 9 aa, Homo Sapiens
QCIISGWGA

SEQ ID NO: 434475 - protein, 9 aa, Homo Sapiens
PINVVKTCL

SEQ ID NO: 434476 - protein, 9 aa, Homo Sapiens
VGKYGTQIC

SEQ ID NO: 434477 - protein, 9 aa, Homo Sapiens
ETEQKVAQI

SEQ ID NO: 434478 - protein, 9 aa, Homo Sapiens
GNTYSVSAV

SEQ ID NO: 434479 - protein, 9 aa, Homo Sapiens
ENKGDIHGA

SEQ ID NO: 434480 - protein, 9 aa, Homo Sapiens
LRKDTSVKI

SEQ ID NO: 434481 - protein, 9 aa, Homo Sapiens
NIVLLSGAN

SEQ ID NO: 434482 - protein, 9 aa, Homo Sapiens
YYTNEKWLK

SEQ ID NO: 434483 - protein, 9 aa, Homo Sapiens
FAVNMFQTL

SEQ ID NO: 434484 - protein, 9 aa, Homo Sapiens
PGSLPATAN

SEQ ID NO: 434485 - protein, 9 aa, Homo Sapiens
QARLCEEKK

SEQ ID NO: 434486 - protein, 9 aa, Homo Sapiens
AIELSQEEW

SEQ ID NO: 434487 - protein, 9 aa, Homo Sapiens
YMCRMEQDQ

SEQ ID NO: 434488 - protein, 9 aa, Homo Sapiens
FLTSPTELP

SEQ ID NO: 434489 - protein, 9 aa, Homo Sapiens
DSALYLCTS

SEQ ID NO: 434490 - protein, 9 aa, Homo Sapiens
KLLCLLVCW

SEQ ID NO: 434491 - protein, 9 aa, Homo Sapiens
IGGFDHKRL

SEQ ID NO: 434492 - protein, 9 aa, Homo Sapiens
FVDFMLPTL

SEQ ID NO: 434493 - protein, 9 aa, Homo Sapiens
WSNHGCVLT

SEQ ID NO: 434494 - protein, 9 aa, Homo Sapiens
VVGFCVVLL

SEQ ID NO: 434495 - protein, 9 aa, Homo Sapiens
VLGKIINMN

SEQ ID NO: 434496 - protein, 9 aa, Homo Sapiens
KDILSPNNG

SEQ ID NO: 434497 - protein, 9 aa, Homo Sapiens
LELRHREIT

SEQ ID NO: 434498 - protein, 9 aa, Homo Sapiens
GPPTGKRRG

SEQ ID NO: 434499 - protein, 9 aa, Homo Sapiens
TPGADGFTG

SEQ ID NO: 434500 - protein, 9 aa, Homo Sapiens
SNVETAKKI

SEQ ID NO: 434501 - protein, 9 aa, Homo Sapiens
VITHQITVQ

SEQ ID NO: 434502 - protein, 9 aa, Homo Sapiens
FAPSDTFST

SEQ ID NO: 434503 - protein, 9 aa, Homo Sapiens
MYDQHGSLG

SEQ ID NO: 434504 - protein, 9 aa, Homo Sapiens
QIPHKRLCQ

SEQ ID NO: 434505 - protein, 9 aa, Homo Sapiens
QAEVIVWQL

SEQ ID NO: 434506 - protein, 9 aa, Homo Sapiens
SSGATVGSS

SEQ ID NO: 434507 - protein, 9 aa, Homo Sapiens
SMKNTYKVL

SEQ ID NO: 434508 - protein, 9 aa, Homo Sapiens
WLLLLEEED

SEQ ID NO: 434509 - protein, 9 aa, Homo Sapiens
WENYFLSFV

SEQ ID NO: 434510 - protein, 9 aa, Homo Sapiens
ESSPPYSVH

SEQ ID NO: 434511 - protein, 9 aa, Homo Sapiens
PPKYFVLAP

SEQ ID NO: 434512 - protein, 9 aa, Homo Sapiens
SCVPPCTGD

SEQ ID NO: 434513 - protein, 9 aa, Homo Sapiens
KVYLTWSVP

SEQ ID NO: 434514 - protein, 9 aa, Homo Sapiens
KELTEILRF

SEQ ID NO: 434515 - protein, 9 aa, Homo Sapiens
SKNFGADMT

SEQ ID NO: 434516 - protein, 9 aa, Homo Sapiens
DINKFPQAE

SEQ ID NO: 434517 - protein, 9 aa, Homo Sapiens
IMKQKHKFV

SEQ ID NO: 434518 - protein, 9 aa, Homo Sapiens
VFHFKFFPF

SEQ ID NO: 434519 - protein, 9 aa, Homo Sapiens
ENYGRRRKG

SEQ ID NO: 434520 - protein, 9 aa, Homo Sapiens
QQEAISCQA

SEQ ID NO: 434521 - protein, 9 aa, Homo Sapiens
RKHSHRSLH

SEQ ID NO: 434522 - protein, 9 aa, Homo Sapiens
FPLSVASAE

SEQ ID NO: 434523 - protein, 9 aa, Homo Sapiens
KEYKHVCKQ

SEQ ID NO: 434524 - protein, 9 aa, Homo Sapiens
MVGELGTAL

SEQ ID NO: 434525 - protein, 9 aa, Homo Sapiens
NLKYSSKFI

SEQ ID NO: 434526 - protein, 9 aa, Homo Sapiens
LDKATAAIQ

SEQ ID NO: 434527 - protein, 9 aa, Homo Sapiens
RGIYSRHHS

SEQ ID NO: 434528 - protein, 9 aa, Homo Sapiens
KRMGNIINE

SEQ ID NO: 434529 - protein, 9 aa, Homo Sapiens
MYVLTLIFR

SEQ ID NO: 434530 - protein, 9 aa, Homo Sapiens
EAADLSDQL

SEQ ID NO: 434531 - protein, 9 aa, Homo Sapiens
CKLNDLIQK

SEQ ID NO: 434532 - protein, 9 aa, Homo Sapiens
SQNYFASCK

SEQ ID NO: 434533 - protein, 9 aa, Homo Sapiens
QFRSDEECR

SEQ ID NO: 434534 - protein, 9 aa, Homo Sapiens
EDLNITNKQ

SEQ ID NO: 434535 - protein, 9 aa, Homo Sapiens
FVIKGKVIY

SEQ ID NO: 434536 - protein, 9 aa, Homo Sapiens
QLTRMCTII

SEQ ID NO: 434537 - protein, 9 aa, Homo Sapiens
QVPKIAEFT

SEQ ID NO: 434538 - protein, 9 aa, Homo Sapiens
TEVVKGRGP

SEQ ID NO: 434539 - protein, 9 aa, Homo Sapiens
ARGKLGSSP

SEQ ID NO: 434540 - protein, 9 aa, Homo Sapiens
KIADFELPI

SEQ ID NO: 434541 - protein, 9 aa, Homo Sapiens
GSGGPVVCN

SEQ ID NO: 434542 - protein, 9 aa, Homo Sapiens
HLIAHQKIH

SEQ ID NO: 434543 - protein, 9 aa, Homo Sapiens
SSGGGPPKY

SEQ ID NO: 434544 - protein, 9 aa, Homo Sapiens
SHLIWHQKV

SEQ ID NO: 434545 - protein, 9 aa, Homo Sapiens
CCCGDLRDN

SEQ ID NO: 434546 - protein, 9 aa, Homo Sapiens
IRLEKAIQS

SEQ ID NO: 434547 - protein, 9 aa, Homo Sapiens
IFLGLYIHF

SEQ ID NO: 434548 - protein, 9 aa, Homo Sapiens
LQELCWKYS

SEQ ID NO: 434549 - protein, 9 aa, Homo Sapiens
VQVLQIKVR

SEQ ID NO: 434550 - protein, 9 aa, Homo Sapiens
DREKKDAYV

SEQ ID NO: 434551 - protein, 9 aa, Homo Sapiens
QRLRPRITK

SEQ ID NO: 434552 - protein, 9 aa, Homo Sapiens
EKSYQLKNL

SEQ ID NO: 434553 - protein, 9 aa, Homo Sapiens
YAFAAAKGP

SEQ ID NO: 434554 - protein, 9 aa, Homo Sapiens
ATKQKRKLS

SEQ ID NO: 434555 - protein, 9 aa, Homo Sapiens
RKLEFIFLF

SEQ ID NO: 434556 - protein, 9 aa, Homo Sapiens
GSFHFRASY

SEQ ID NO: 434557 - protein, 9 aa, Homo Sapiens
GKTTKMPCK

SEQ ID NO: 434558 - protein, 9 aa, Homo Sapiens
IRHQSDQYV

SEQ ID NO: 434559 - protein, 9 aa, Homo Sapiens
EICAQTFFK

SEQ ID NO: 434560 - protein, 9 aa, Homo Sapiens
VAMMGGQPS

SEQ ID NO: 434561 - protein, 9 aa, Homo Sapiens
NVTFQIEPT

SEQ ID NO: 434562 - protein, 9 aa, Homo Sapiens
NGDYYRQGH

SEQ ID NO: 434563 - protein, 9 aa, Homo Sapiens
RSGNTSMWL

SEQ ID NO: 434564 - protein, 9 aa, Homo Sapiens
KYFVLAPKT

SEQ ID NO: 434565 - protein, 9 aa, Homo Sapiens
QVSYARPSS

SEQ ID NO: 434566 - protein, 9 aa, Homo Sapiens
GHLIVIGFI

SEQ ID NO: 434567 - protein, 9 aa, Homo Sapiens
EHAAIQNKL

SEQ ID NO: 434568 - protein, 9 aa, Homo Sapiens
YLSCCVASL

SEQ ID NO: 434569 - protein, 9 aa, Homo Sapiens
SLFKSEACY

SEQ ID NO: 434570 - protein, 9 aa, Homo Sapiens
FGQPGTGNQ

SEQ ID NO: 434571 - protein, 9 aa, Homo Sapiens
MILTNRQPK

SEQ ID NO: 434572 - protein, 9 aa, Homo Sapiens
SVPRTSNCH

SEQ ID NO: 434573 - protein, 9 aa, Homo Sapiens
SGINIVTAN

SEQ ID NO: 434574 - protein, 9 aa, Homo Sapiens
NQFQCKLIA

SEQ ID NO: 434575 - protein, 9 aa, Homo Sapiens
RNYDVMKYF

SEQ ID NO: 434576 - protein, 9 aa, Homo Sapiens
KYSVWMGGS

SEQ ID NO: 434577 - protein, 9 aa, Homo Sapiens
GAGKTKNTK

SEQ ID NO: 434578 - protein, 9 aa, Homo Sapiens
LIDEKSTHA

SEQ ID NO: 434579 - protein, 9 aa, Homo Sapiens
TLTNQEQVT

SEQ ID NO: 434580 - protein, 9 aa, Homo Sapiens
LKSHNDWVM

SEQ ID NO: 434581 - protein, 9 aa, Homo Sapiens
ITRDMYVTA

SEQ ID NO: 434582 - protein, 9 aa, Homo Sapiens
SNTWSPKWL

SEQ ID NO: 434583 - protein, 9 aa, Homo Sapiens
HLTNHQQTH

SEQ ID NO: 434584 - protein, 9 aa, Homo Sapiens
LLDDPFSAL

SEQ ID NO: 434585 - protein, 9 aa, Homo Sapiens
VMGKSNVLS

SEQ ID NO: 434586 - protein, 9 aa, Homo Sapiens
RDFMPKTVV

SEQ ID NO: 434587 - protein, 9 aa, Homo Sapiens
ENKNLVYPA

SEQ ID NO: 434588 - protein, 9 aa, Homo Sapiens
HPVALGPST

SEQ ID NO: 434589 - protein, 9 aa, Homo Sapiens
DDKSHFKDM

SEQ ID NO: 434590 - protein, 9 aa, Homo Sapiens
YIITYHEKP

SEQ ID NO: 434591 - protein, 9 aa, Homo Sapiens
VICKDCGDD

SEQ ID NO: 434592 - protein, 9 aa, Homo Sapiens
VDKFQNTNV

SEQ ID NO: 434593 - protein, 9 aa, Homo Sapiens
SAKLAFAVE

SEQ ID NO: 434594 - protein, 9 aa, Homo Sapiens
MALNRKVLY

SEQ ID NO: 434595 - protein, 9 aa, Homo Sapiens
INSATPINT

SEQ ID NO: 434596 - protein, 9 aa, Homo Sapiens
RCTRGTPPG

SEQ ID NO: 434597 - protein, 9 aa, Homo Sapiens
INERECLRM

SEQ ID NO: 434598 - protein, 9 aa, Homo Sapiens
FIVYLAYAF

SEQ ID NO: 434599 - protein, 9 aa, Homo Sapiens
GSKLIQHQI

SEQ ID NO: 434600 - protein, 9 aa, Homo Sapiens
VDALIYEID

SEQ ID NO: 434601 - protein, 9 aa, Homo Sapiens
LSLNNWNVN

SEQ ID NO: 434602 - protein, 9 aa, Homo Sapiens
LEMGVFIRE

SEQ ID NO: 434603 - protein, 9 aa, Homo Sapiens
GQNKQHYIT

SEQ ID NO: 434604 - protein, 9 aa, Homo Sapiens
NYGNNPLTS

SEQ ID NO: 434605 - protein, 9 aa, Homo Sapiens
NGQMHLNRD

SEQ ID NO: 434606 - protein, 9 aa, Homo Sapiens
NGLKAEIGQ

SEQ ID NO: 434607 - protein, 9 aa, Homo Sapiens
GVEAFLLRL

SEQ ID NO: 434608 - protein, 9 aa, Homo Sapiens
EDLDSVDAF

SEQ ID NO: 434609 - protein, 9 aa, Homo Sapiens
MTYPHQVVK

SEQ ID NO: 434610 - protein, 9 aa, Homo Sapiens
PWLIINETP

SEQ ID NO: 434611 - protein, 9 aa, Homo Sapiens
GIDKCNAAV

SEQ ID NO: 434612 - protein, 9 aa, Homo Sapiens
VDGGESVNL

SEQ ID NO: 434613 - protein, 9 aa, Homo Sapiens
NDDSDILDS

SEQ ID NO: 434614 - protein, 9 aa, Homo Sapiens
VQELLQGTR

SEQ ID NO: 434615 - protein, 9 aa, Homo Sapiens
GNGTIIFII

SEQ ID NO: 434616 - protein, 9 aa, Homo Sapiens
RQRVKISIS

SEQ ID NO: 434617 - protein, 9 aa, Homo Sapiens
IKEGLDKPV

SEQ ID NO: 434618 - protein, 9 aa, Homo Sapiens
LLKRFNEPG

SEQ ID NO: 434619 - protein, 9 aa, Homo Sapiens
ILTNRQPKD

SEQ ID NO: 434620 - protein, 9 aa, Homo Sapiens
KNNKQKTPG

SEQ ID NO: 434621 - protein, 9 aa, Homo Sapiens
GYCYSNKEG

SEQ ID NO: 434622 - protein, 9 aa, Homo Sapiens
EIERFEIVG

SEQ ID NO: 434623 - protein, 9 aa, Homo Sapiens
MLRKCIRHE

SEQ ID NO: 434624 - protein, 9 aa, Homo Sapiens
MFPVLKPHQ

SEQ ID NO: 434625 - protein, 9 aa, Homo Sapiens
MVRSLESVG

SEQ ID NO: 434626 - protein, 9 aa, Homo Sapiens
LEVDRKTGT

SEQ ID NO: 434627 - protein, 9 aa, Homo Sapiens
VMEQFDPGL

SEQ ID NO: 434628 - protein, 9 aa, Homo Sapiens
KPSEEVNKA

SEQ ID NO: 434629 - protein, 9 aa, Homo Sapiens
RNMAYLRSL

SEQ ID NO: 434630 - protein, 9 aa, Homo Sapiens
SKLFENKVV

SEQ ID NO: 434631 - protein, 9 aa, Homo Sapiens
VDVIVKEEI

SEQ ID NO: 434632 - protein, 9 aa, Homo Sapiens
LCSVLKKPS

SEQ ID NO: 434633 - protein, 9 aa, Homo Sapiens
IYNHAKFIG

SEQ ID NO: 434634 - protein, 9 aa, Homo Sapiens
DNNMVKPLD

SEQ ID NO: 434635 - protein, 9 aa, Homo Sapiens
KDKQAFVKT

SEQ ID NO: 434636 - protein, 9 aa, Homo Sapiens
LGFYVGQPE

SEQ ID NO: 434637 - protein, 9 aa, Homo Sapiens
SGPHRPSPK

SEQ ID NO: 434638 - protein, 9 aa, Homo Sapiens
NNNLLLKWD

SEQ ID NO: 434639 - protein, 9 aa, Homo Sapiens
QLETLNNAY

SEQ ID NO: 434640 - protein, 9 aa, Homo Sapiens
GENTNRVTL

SEQ ID NO: 434641 - protein, 9 aa, Homo Sapiens
SVGLVLGTF

SEQ ID NO: 434642 - protein, 9 aa, Homo Sapiens
RIKIPNSGT

SEQ ID NO: 434643 - protein, 9 aa, Homo Sapiens
CEELQRTGW

SEQ ID NO: 434644 - protein, 9 aa, Homo Sapiens
AQSRGAKNY

SEQ ID NO: 434645 - protein, 9 aa, Homo Sapiens
QELGSFHFR

SEQ ID NO: 434646 - protein, 9 aa, Homo Sapiens
FLTTPTGSF

SEQ ID NO: 434647 - protein, 9 aa, Homo Sapiens
LQTYMPYTL

SEQ ID NO: 434648 - protein, 9 aa, Homo Sapiens
YKETELPKG

SEQ ID NO: 434649 - protein, 9 aa, Homo Sapiens
QTVASATTA

SEQ ID NO: 434650 - protein, 9 aa, Homo Sapiens
YTFICQNKE

SEQ ID NO: 434651 - protein, 9 aa, Homo Sapiens
KEIRSRLIK

SEQ ID NO: 434652 - protein, 9 aa, Homo Sapiens
GLTPFVFRI

SEQ ID NO: 434653 - protein, 9 aa, Homo Sapiens
NCKLAKENK

SEQ ID NO: 434654 - protein, 9 aa, Homo Sapiens
LRITVCDED

SEQ ID NO: 434655 - protein, 9 aa, Homo Sapiens
PAEYFVLVA

SEQ ID NO: 434656 - protein, 9 aa, Homo Sapiens
RVAADNVCK

SEQ ID NO: 434657 - protein, 9 aa, Homo Sapiens
QHPTEPQAQ

SEQ ID NO: 434658 - protein, 9 aa, Homo Sapiens
WYSSENQDT

SEQ ID NO: 434659 - protein, 9 aa, Homo Sapiens
KYASLSNHH

SEQ ID NO: 434660 - protein, 9 aa, Homo Sapiens
DLFFKEEER

SEQ ID NO: 434661 - protein, 9 aa, Homo Sapiens
SSHITQHKI

SEQ ID NO: 434662 - protein, 9 aa, Homo Sapiens
IYRLFSADW

SEQ ID NO: 434663 - protein, 9 aa, Homo Sapiens
KVIQCLNIS

SEQ ID NO: 434664 - protein, 9 aa, Homo Sapiens
AADLSDQLS

SEQ ID NO: 434665 - protein, 9 aa, Homo Sapiens
YKNLNRAKE

SEQ ID NO: 434666 - protein, 9 aa, Homo Sapiens
FSLASLPVP

SEQ ID NO: 434667 - protein, 9 aa, Homo Sapiens
LYRTPEMFF

SEQ ID NO: 434668 - protein, 9 aa, Homo Sapiens
SSNTWSPKW

SEQ ID NO: 434669 - protein, 9 aa, Homo Sapiens
QHQIIHTDE

SEQ ID NO: 434670 - protein, 9 aa, Homo Sapiens
NKCLEKKVL

SEQ ID NO: 434671 - protein, 9 aa, Homo Sapiens
QDSLDVFMS

SEQ ID NO: 434672 - protein, 9 aa, Homo Sapiens
GKFEYNGLC

SEQ ID NO: 434673 - protein, 9 aa, Homo Sapiens
MYKYMSSQY

SEQ ID NO: 434674 - protein, 9 aa, Homo Sapiens
VKKRNTYSV

SEQ ID NO: 434675 - protein, 9 aa, Homo Sapiens
ATGGDVTQN

SEQ ID NO: 434676 - protein, 9 aa, Homo Sapiens
ESCADTSPA

SEQ ID NO: 434677 - protein, 9 aa, Homo Sapiens
YLSIDSEDD

SEQ ID NO: 434678 - protein, 9 aa, Homo Sapiens
HDKNATKPT

SEQ ID NO: 434679 - protein, 9 aa, Homo Sapiens
FSTKYKVMR

SEQ ID NO: 434680 - protein, 9 aa, Homo Sapiens
QGLCFNILC

SEQ ID NO: 434681 - protein, 9 aa, Homo Sapiens
KLNHNNWIK

SEQ ID NO: 434682 - protein, 9 aa, Homo Sapiens
PQIPITMEN

SEQ ID NO: 434683 - protein, 9 aa, Homo Sapiens
SQLSQTELG

SEQ ID NO: 434684 - protein, 9 aa, Homo Sapiens
SKSKTILVR

SEQ ID NO: 434685 - protein, 9 aa, Homo Sapiens
RINVTAAAQ

SEQ ID NO: 434686 - protein, 9 aa, Homo Sapiens
SGKHEDKQQ

SEQ ID NO: 434687 - protein, 9 aa, Homo Sapiens
EYGTSVVQI

SEQ ID NO: 434688 - protein, 9 aa, Homo Sapiens
YRSHELYKF

SEQ ID NO: 434689 - protein, 9 aa, Homo Sapiens
KKSCGNQNE

SEQ ID NO: 434690 - protein, 9 aa, Homo Sapiens
KCFLGQLSE

SEQ ID NO: 434691 - protein, 9 aa, Homo Sapiens
TRSRNTYRE

SEQ ID NO: 434692 - protein, 9 aa, Homo Sapiens
NICNNYAEM

SEQ ID NO: 434693 - protein, 9 aa, Homo Sapiens
LGFGFSSCR

SEQ ID NO: 434694 - protein, 9 aa, Homo Sapiens
NEGELQHTR

SEQ ID NO: 434695 - protein, 9 aa, Homo Sapiens
WFCGPGAMS

SEQ ID NO: 434696 - protein, 9 aa, Homo Sapiens
QTPPPLSLP

SEQ ID NO: 434697 - protein, 9 aa, Homo Sapiens
GDIIQQDFL

SEQ ID NO: 434698 - protein, 9 aa, Homo Sapiens
KQQVTMVSY

SEQ ID NO: 434699 - protein, 9 aa, Homo Sapiens
LLYAQNVVQ

SEQ ID NO: 434700 - protein, 9 aa, Homo Sapiens
YKSTFCSQY

SEQ ID NO: 434701 - protein, 9 aa, Homo Sapiens
VVIDPSPFT

SEQ ID NO: 434702 - protein, 9 aa, Homo Sapiens
GDGKVTTEE

SEQ ID NO: 434703 - protein, 9 aa, Homo Sapiens
IVYITERHN

SEQ ID NO: 434704 - protein, 9 aa, Homo Sapiens
FSHSGSLQI

SEQ ID NO: 434705 - protein, 9 aa, Homo Sapiens
FLDNIVRRS

SEQ ID NO: 434706 - protein, 9 aa, Homo Sapiens
RQRCKALKE

SEQ ID NO: 434707 - protein, 9 aa, Homo Sapiens
WANNLLGEL

SEQ ID NO: 434708 - protein, 9 aa, Homo Sapiens
ANAKEIAQT

SEQ ID NO: 434709 - protein, 9 aa, Homo Sapiens
YRPPKGTYG

SEQ ID NO: 434710 - protein, 9 aa, Homo Sapiens
YIWRPLQIP

SEQ ID NO: 434711 - protein, 9 aa, Homo Sapiens
LLRMSPQHF

SEQ ID NO: 434712 - protein, 9 aa, Homo Sapiens
VVSATSNHC

SEQ ID NO: 434713 - protein, 9 aa, Homo Sapiens
GISIPRADT

SEQ ID NO: 434714 - protein, 9 aa, Homo Sapiens
VCIAQSHKI

SEQ ID NO: 434715 - protein, 9 aa, Homo Sapiens
PTFHAEVSA

SEQ ID NO: 434716 - protein, 9 aa, Homo Sapiens
NRKVLYGEP

SEQ ID NO: 434717 - protein, 9 aa, Homo Sapiens
PGVAYFKVA

SEQ ID NO: 434718 - protein, 9 aa, Homo Sapiens
DRYKMEDGK

SEQ ID NO: 434719 - protein, 9 aa, Homo Sapiens
VLGGVASFV

SEQ ID NO: 434720 - protein, 9 aa, Homo Sapiens
APPFEVNDL

SEQ ID NO: 434721 - protein, 9 aa, Homo Sapiens
HRRSQSRSR

SEQ ID NO: 434722 - protein, 9 aa, Homo Sapiens
MPKTVVIDP

SEQ ID NO: 434723 - protein, 9 aa, Homo Sapiens
KMYYPSWPN

SEQ ID NO: 434724 - protein, 9 aa, Homo Sapiens
NNHDRRSSS

SEQ ID NO: 434725 - protein, 9 aa, Homo Sapiens
LAEQHVVQE

SEQ ID NO: 434726 - protein, 9 aa, Homo Sapiens
RKTFCVKTS

SEQ ID NO: 434727 - protein, 9 aa, Homo Sapiens
VNDKREQKL

SEQ ID NO: 434728 - protein, 9 aa, Homo Sapiens
KIFLNDSAT

SEQ ID NO: 434729 - protein, 9 aa, Homo Sapiens
HLGVLIDLA

SEQ ID NO: 434730 - protein, 9 aa, Homo Sapiens
GPNFGWRFG

SEQ ID NO: 434731 - protein, 9 aa, Homo Sapiens
TTSSVWRNK

SEQ ID NO: 434732 - protein, 9 aa, Homo Sapiens
HIIFWLITG

SEQ ID NO: 434733 - protein, 9 aa, Homo Sapiens
IRSIILVIP

SEQ ID NO: 434734 - protein, 9 aa, Homo Sapiens
EKFSKVDKM

SEQ ID NO: 434735 - protein, 9 aa, Homo Sapiens
LAIVPKMLE

SEQ ID NO: 434736 - protein, 9 aa, Homo Sapiens
SGVLGVVAT

SEQ ID NO: 434737 - protein, 9 aa, Homo Sapiens
VSATSNHCL

SEQ ID NO: 434738 - protein, 9 aa, Homo Sapiens
KNYVSLMKR

SEQ ID NO: 434739 - protein, 9 aa, Homo Sapiens
ACLLLICRC

SEQ ID NO: 434740 - protein, 9 aa, Homo Sapiens
PSLSELDNF

SEQ ID NO: 434741 - protein, 9 aa, Homo Sapiens
NQMSVTQRV

SEQ ID NO: 434742 - protein, 9 aa, Homo Sapiens
QLKPGGTPQ

SEQ ID NO: 434743 - protein, 9 aa, Homo Sapiens
IKQDNGMES

SEQ ID NO: 434744 - protein, 9 aa, Homo Sapiens
LIYYHPHPK

SEQ ID NO: 434745 - protein, 9 aa, Homo Sapiens
DNKPRRPYI

SEQ ID NO: 434746 - protein, 9 aa, Homo Sapiens
NHGCVLTRG

SEQ ID NO: 434747 - protein, 9 aa, Homo Sapiens
NLSRKRPGI

SEQ ID NO: 434748 - protein, 9 aa, Homo Sapiens
CLVLHCIAN

SEQ ID NO: 434749 - protein, 9 aa, Homo Sapiens
GNMTTVSYL

SEQ ID NO: 434750 - protein, 9 aa, Homo Sapiens
VLLENPKME

SEQ ID NO: 434751 - protein, 9 aa, Homo Sapiens
FTVVSPAEF

SEQ ID NO: 434752 - protein, 9 aa, Homo Sapiens
YINLVCGDD

SEQ ID NO: 434753 - protein, 9 aa, Homo Sapiens
CVNLQGVKM

SEQ ID NO: 434754 - protein, 9 aa, Homo Sapiens
FNGQNNTLS

SEQ ID NO: 434755 - protein, 9 aa, Homo Sapiens
HIFKLAQYA

SEQ ID NO: 434756 - protein, 9 aa, Homo Sapiens
NIKLFMNCR

SEQ ID NO: 434757 - protein, 9 aa, Homo Sapiens
EVCLAKEKE

SEQ ID NO: 434758 - protein, 9 aa, Homo Sapiens
TRFRIAAKY

SEQ ID NO: 434759 - protein, 9 aa, Homo Sapiens
WLWESYLEE

SEQ ID NO: 434760 - protein, 9 aa, Homo Sapiens
HQKVGAIVN

SEQ ID NO: 434761 - protein, 9 aa, Homo Sapiens
FGYLAANGP

SEQ ID NO: 434762 - protein, 9 aa, Homo Sapiens
LLENKGDIH

SEQ ID NO: 434763 - protein, 9 aa, Homo Sapiens
REVRSPTKT

SEQ ID NO: 434764 - protein, 9 aa, Homo Sapiens
YGDIIQQDF

SEQ ID NO: 434765 - protein, 9 aa, Homo Sapiens
NPIEASLYG

SEQ ID NO: 434766 - protein, 9 aa, Homo Sapiens
IDKPCGCNT

SEQ ID NO: 434767 - protein, 9 aa, Homo Sapiens
INENPFNCT

SEQ ID NO: 434768 - protein, 9 aa, Homo Sapiens
FFGGQLGQI

SEQ ID NO: 434769 - protein, 9 aa, Homo Sapiens
DHRITSQIN

SEQ ID NO: 434770 - protein, 9 aa, Homo Sapiens
VGFSPLQIL

SEQ ID NO: 434771 - protein, 9 aa, Homo Sapiens
DKKSLQIKE

SEQ ID NO: 434772 - protein, 9 aa, Homo Sapiens
EARDSTVSN

SEQ ID NO: 434773 - protein, 9 aa, Homo Sapiens
RPRDSLLRQ

SEQ ID NO: 434774 - protein, 9 aa, Homo Sapiens
LDDTLVDFW

SEQ ID NO: 434775 - protein, 9 aa, Homo Sapiens
NPEVPDQLY

SEQ ID NO: 434776 - protein, 9 aa, Homo Sapiens
AFIHSDQLT

SEQ ID NO: 434777 - protein, 9 aa, Homo Sapiens
TEELRQKCK

SEQ ID NO: 434778 - protein, 9 aa, Homo Sapiens
FPKVIQCLN

SEQ ID NO: 434779 - protein, 9 aa, Homo Sapiens
TPYAGIKNA

SEQ ID NO: 434780 - protein, 9 aa, Homo Sapiens
YRIREKARQ

SEQ ID NO: 434781 - protein, 9 aa, Homo Sapiens
INFRKLSSR

SEQ ID NO: 434782 - protein, 9 aa, Homo Sapiens
CFVDMQAQK

SEQ ID NO: 434783 - protein, 9 aa, Homo Sapiens
PLDLKMVEG

SEQ ID NO: 434784 - protein, 9 aa, Homo Sapiens
LLVAVVVWK

SEQ ID NO: 434785 - protein, 9 aa, Homo Sapiens
ATYKLEERD

SEQ ID NO: 434786 - protein, 9 aa, Homo Sapiens
NQARRQNRR

SEQ ID NO: 434787 - protein, 9 aa, Homo Sapiens
VDNKFYEWL

SEQ ID NO: 434788 - protein, 9 aa, Homo Sapiens
DNWGECTKL

SEQ ID NO: 434789 - protein, 9 aa, Homo Sapiens
SRDQSDCLG

SEQ ID NO: 434790 - protein, 9 aa, Homo Sapiens
QSLRIKNSK

SEQ ID NO: 434791 - protein, 9 aa, Homo Sapiens
PSGPQGICG

SEQ ID NO: 434792 - protein, 9 aa, Homo Sapiens
IMHRGGKYH

SEQ ID NO: 434793 - protein, 9 aa, Homo Sapiens
APSTLAGLG

SEQ ID NO: 434794 - protein, 9 aa, Homo Sapiens
QSYSYYCDH

SEQ ID NO: 434795 - protein, 9 aa, Homo Sapiens
CFHVNCSNI

SEQ ID NO: 434796 - protein, 9 aa, Homo Sapiens
KYLFICEFF

SEQ ID NO: 434797 - protein, 9 aa, Homo Sapiens
PMSAPNMPL

SEQ ID NO: 434798 - protein, 9 aa, Homo Sapiens
AKLMKSIRF

SEQ ID NO: 434799 - protein, 9 aa, Homo Sapiens
AEIHQLKKE

SEQ ID NO: 434800 - protein, 9 aa, Homo Sapiens
LYNESVSTM

SEQ ID NO: 434801 - protein, 9 aa, Homo Sapiens
LSDPGVADK

SEQ ID NO: 434802 - protein, 9 aa, Homo Sapiens
SYLNSSGSY

SEQ ID NO: 434803 - protein, 9 aa, Homo Sapiens
ALSGAEFEG

SEQ ID NO: 434804 - protein, 9 aa, Homo Sapiens
VGWNGIKPS

SEQ ID NO: 434805 - protein, 9 aa, Homo Sapiens
DVWRMIWEQ

SEQ ID NO: 434806 - protein, 9 aa, Homo Sapiens
NLICLMEQI

SEQ ID NO: 434807 - protein, 9 aa, Homo Sapiens
KQNWQEFVD

SEQ ID NO: 434808 - protein, 9 aa, Homo Sapiens
IIMWDHDLN

SEQ ID NO: 434809 - protein, 9 aa, Homo Sapiens
KCEMYRRLR

SEQ ID NO: 434810 - protein, 9 aa, Homo Sapiens
AGCSLHMFR

SEQ ID NO: 434811 - protein, 9 aa, Homo Sapiens
EMKYLEVRS

SEQ ID NO: 434812 - protein, 9 aa, Homo Sapiens
IAQLNYKYG

SEQ ID NO: 434813 - protein, 9 aa, Homo Sapiens
QCTCELGKF

SEQ ID NO: 434814 - protein, 9 aa, Homo Sapiens
NHLRKLPST

SEQ ID NO: 434815 - protein, 9 aa, Homo Sapiens
NKGKIAKNS

SEQ ID NO: 434816 - protein, 9 aa, Homo Sapiens
IRNPKIMLL

SEQ ID NO: 434817 - protein, 9 aa, Homo Sapiens
QPQAPKDRE

SEQ ID NO: 434818 - protein, 9 aa, Homo Sapiens
DMKEKTKTK

SEQ ID NO: 434819 - protein, 9 aa, Homo Sapiens
DRTYYESVQ

SEQ ID NO: 434820 - protein, 9 aa, Homo Sapiens
VTVKSLESR

SEQ ID NO: 434821 - protein, 9 aa, Homo Sapiens
IFCALLNIL

SEQ ID NO: 434822 - protein, 9 aa, Homo Sapiens
ANVFLVAPQ

SEQ ID NO: 434823 - protein, 9 aa, Homo Sapiens
KCIDHLLHK

SEQ ID NO: 434824 - protein, 9 aa, Homo Sapiens
QALTYWGCV

SEQ ID NO: 434825 - protein, 9 aa, Homo Sapiens
GLKNISVQV

SEQ ID NO: 434826 - protein, 9 aa, Homo Sapiens
SRRLLKDAY

SEQ ID NO: 434827 - protein, 9 aa, Homo Sapiens
AEGKICECN

SEQ ID NO: 434828 - protein, 9 aa, Homo Sapiens
REREGQLRA

SEQ ID NO: 434829 - protein, 9 aa, Homo Sapiens
GYTLLLGTV

SEQ ID NO: 434830 - protein, 9 aa, Homo Sapiens
NLMRPKTCG

SEQ ID NO: 434831 - protein, 9 aa, Homo Sapiens
VKKVKVEVE

SEQ ID NO: 434832 - protein, 9 aa, Homo Sapiens
ERTFFAYQR

SEQ ID NO: 434833 - protein, 9 aa, Homo Sapiens
YLQPPSEHS

SEQ ID NO: 434834 - protein, 9 aa, Homo Sapiens
DVGTCVVQV

SEQ ID NO: 434835 - protein, 9 aa, Homo Sapiens
TYMCECPVH

SEQ ID NO: 434836 - protein, 9 aa, Homo Sapiens
SPQHFTSLW

SEQ ID NO: 434837 - protein, 9 aa, Homo Sapiens
NKIQHMITR

SEQ ID NO: 434838 - protein, 9 aa, Homo Sapiens
DEKSTHAHL

SEQ ID NO: 434839 - protein, 9 aa, Homo Sapiens
LTPGHPCRL

SEQ ID NO: 434840 - protein, 9 aa, Homo Sapiens
GHPRAYFMQ

SEQ ID NO: 434841 - protein, 9 aa, Homo Sapiens
VRAQSQDKQ

SEQ ID NO: 434842 - protein, 9 aa, Homo Sapiens
QSDNYPNKE

SEQ ID NO: 434843 - protein, 9 aa, Homo Sapiens
VSEDVLSSV

SEQ ID NO: 434844 - protein, 9 aa, Homo Sapiens
TGASILPKH

SEQ ID NO: 434845 - protein, 9 aa, Homo Sapiens
IQAMEDNLL

SEQ ID NO: 434846 - protein, 9 aa, Homo Sapiens
LVERDYFSS

SEQ ID NO: 434847 - protein, 9 aa, Homo Sapiens
EYGIEGDAV

SEQ ID NO: 434848 - protein, 9 aa, Homo Sapiens
VQNLAPRTA

SEQ ID NO: 434849 - protein, 9 aa, Homo Sapiens
CVLMLLFPF

SEQ ID NO: 434850 - protein, 9 aa, Homo Sapiens
LSLCSPSVM

SEQ ID NO: 434851 - protein, 9 aa, Homo Sapiens
MNEIKYKSS

SEQ ID NO: 434852 - protein, 9 aa, Homo Sapiens
VKKHKTGET

SEQ ID NO: 434853 - protein, 9 aa, Homo Sapiens
SSSESDKNE

SEQ ID NO: 434854 - protein, 9 aa, Homo Sapiens
GGRKGAKKG

SEQ ID NO: 434855 - protein, 9 aa, Homo Sapiens
LGFPTHPEL

SEQ ID NO: 434856 - protein, 9 aa, Homo Sapiens
QMDKSAVGH

SEQ ID NO: 434857 - protein, 9 aa, Homo Sapiens
QILDALKVT

SEQ ID NO: 434858 - protein, 9 aa, Homo Sapiens
PPRKKDRNN

SEQ ID NO: 434859 - protein, 9 aa, Homo Sapiens
WVFILVCVF

SEQ ID NO: 434860 - protein, 9 aa, Homo Sapiens
CRRKKKCVC

SEQ ID NO: 434861 - protein, 9 aa, Homo Sapiens
WIHLDRKAQ

SEQ ID NO: 434862 - protein, 9 aa, Homo Sapiens
IQRTIQQKL

SEQ ID NO: 434863 - protein, 9 aa, Homo Sapiens
LIQRNEIER

SEQ ID NO: 434864 - protein, 9 aa, Homo Sapiens
LPSQRSRSV

SEQ ID NO: 434865 - protein, 9 aa, Homo Sapiens
LALSVAYCF

SEQ ID NO: 434866 - protein, 9 aa, Homo Sapiens
YIESNSLNS

SEQ ID NO: 434867 - protein, 9 aa, Homo Sapiens
SPLDDTKDN

SEQ ID NO: 434868 - protein, 9 aa, Homo Sapiens
ILALSGNSR

SEQ ID NO: 434869 - protein, 9 aa, Homo Sapiens
RRQSQKVPV

SEQ ID NO: 434870 - protein, 9 aa, Homo Sapiens
FSSSHLRYG

SEQ ID NO: 434871 - protein, 9 aa, Homo Sapiens
IGTQSLHPP

SEQ ID NO: 434872 - protein, 9 aa, Homo Sapiens
KEAEERHRP

SEQ ID NO: 434873 - protein, 9 aa, Homo Sapiens
SDAQELESF

SEQ ID NO: 434874 - protein, 9 aa, Homo Sapiens
STFKSYYVR

SEQ ID NO: 434875 - protein, 9 aa, Homo Sapiens
ASKVTHTVK

SEQ ID NO: 434876 - protein, 9 aa, Homo Sapiens
DQIRTPRAS

SEQ ID NO: 434877 - protein, 9 aa, Homo Sapiens
IKFSLEEWE

SEQ ID NO: 434878 - protein, 9 aa, Homo Sapiens
DDALSEWND

SEQ ID NO: 434879 - protein, 9 aa, Homo Sapiens
SMHQIILYL

SEQ ID NO: 434880 - protein, 9 aa, Homo Sapiens
GGDFWYVTC

SEQ ID NO: 434881 - protein, 9 aa, Homo Sapiens
LSGQSYGTY

SEQ ID NO: 434882 - protein, 9 aa, Homo Sapiens
QEINENILP

SEQ ID NO: 434883 - protein, 9 aa, Homo Sapiens
ENYSFTILY

SEQ ID NO: 434884 - protein, 9 aa, Homo Sapiens
RSGSAHKYS

SEQ ID NO: 434885 - protein, 9 aa, Homo Sapiens
CFVTSYLGG

SEQ ID NO: 434886 - protein, 9 aa, Homo Sapiens
AFQTKAIFV

SEQ ID NO: 434887 - protein, 9 aa, Homo Sapiens
LRLPKRLRA

SEQ ID NO: 434888 - protein, 9 aa, Homo Sapiens
HSALSVKRA

SEQ ID NO: 434889 - protein, 9 aa, Homo Sapiens
AVQQHPTEP

SEQ ID NO: 434890 - protein, 9 aa, Homo Sapiens
RRGQRDLLR

SEQ ID NO: 434891 - protein, 9 aa, Homo Sapiens
VYNDKEHNH

SEQ ID NO: 434892 - protein, 9 aa, Homo Sapiens
WLEKSAHKD

SEQ ID NO: 434893 - protein, 9 aa, Homo Sapiens
EHPARGKLG

SEQ ID NO: 434894 - protein, 9 aa, Homo Sapiens
FQELRLVHD

SEQ ID NO: 434895 - protein, 9 aa, Homo Sapiens
KIRFNSQSQ

SEQ ID NO: 434896 - protein, 9 aa, Homo Sapiens
SDSSFEVCG

SEQ ID NO: 434897 - protein, 9 aa, Homo Sapiens
EMPRAGDRG

SEQ ID NO: 434898 - protein, 9 aa, Homo Sapiens
EMAIRHFKQ

SEQ ID NO: 434899 - protein, 9 aa, Homo Sapiens
YMCQCRNGV

SEQ ID NO: 434900 - protein, 9 aa, Homo Sapiens
FLTSSSCFQ

SEQ ID NO: 434901 - protein, 9 aa, Homo Sapiens
QLLQTSRLL

SEQ ID NO: 434902 - protein, 9 aa, Homo Sapiens
EVLKVQNRR

SEQ ID NO: 434903 - protein, 9 aa, Homo Sapiens
LKPYKCSIC

SEQ ID NO: 434904 - protein, 9 aa, Homo Sapiens
KEKFSKVDK

SEQ ID NO: 434905 - protein, 9 aa, Homo Sapiens
GCHINTFIK

SEQ ID NO: 434906 - protein, 9 aa, Homo Sapiens
QRLKESDQI

SEQ ID NO: 434907 - protein, 9 aa, Homo Sapiens
DACSESREG

SEQ ID NO: 434908 - protein, 9 aa, Homo Sapiens
ALHTQSSDK

SEQ ID NO: 434909 - protein, 9 aa, Homo Sapiens
LIPALVKVL

SEQ ID NO: 434910 - protein, 9 aa, Homo Sapiens
MSTSVPAFL

SEQ ID NO: 434911 - protein, 9 aa, Homo Sapiens
PLLAGLYMF

SEQ ID NO: 434912 - protein, 9 aa, Homo Sapiens
IRSNNWAKV

SEQ ID NO: 434913 - protein, 9 aa, Homo Sapiens
NMNWLSVSL

SEQ ID NO: 434914 - protein, 9 aa, Homo Sapiens
GSGSGNGSG

SEQ ID NO: 434915 - protein, 9 aa, Homo Sapiens
LLCLEKYHL

SEQ ID NO: 434916 - protein, 9 aa, Homo Sapiens
NSHMQTHTG

SEQ ID NO: 434917 - protein, 9 aa, Homo Sapiens
SWKPPCRSR

SEQ ID NO: 434918 - protein, 9 aa, Homo Sapiens
DTEEINTFH

SEQ ID NO: 434919 - protein, 9 aa, Homo Sapiens
IGKQNFLEE

SEQ ID NO: 434920 - protein, 9 aa, Homo Sapiens
LYEVVHRIL

SEQ ID NO: 434921 - protein, 9 aa, Homo Sapiens
DNPNWALLM

SEQ ID NO: 434922 - protein, 9 aa, Homo Sapiens
SHLSRHQIL

SEQ ID NO: 434923 - protein, 9 aa, Homo Sapiens
GKVWWRLCK

SEQ ID NO: 434924 - protein, 9 aa, Homo Sapiens
KRNDGRDPF

SEQ ID NO: 434925 - protein, 9 aa, Homo Sapiens
EAALNARFL

SEQ ID NO: 434926 - protein, 9 aa, Homo Sapiens
ELFTSLWDI

SEQ ID NO: 434927 - protein, 9 aa, Homo Sapiens
VHQRNHTVD

SEQ ID NO: 434928 - protein, 9 aa, Homo Sapiens
AGDLDFETG

SEQ ID NO: 434929 - protein, 9 aa, Homo Sapiens
TRSPAPTRK

SEQ ID NO: 434930 - protein, 9 aa, Homo Sapiens
HLDMINGLF

SEQ ID NO: 434931 - protein, 9 aa, Homo Sapiens
SSTNTEKKK

SEQ ID NO: 434932 - protein, 9 aa, Homo Sapiens
KITLWKDSD

SEQ ID NO: 434933 - protein, 9 aa, Homo Sapiens
AIAQLNYKY

SEQ ID NO: 434934 - protein, 9 aa, Homo Sapiens
KLTTASEHC

SEQ ID NO: 434935 - protein, 9 aa, Homo Sapiens
VEDKTISYQ

SEQ ID NO: 434936 - protein, 9 aa, Homo Sapiens
HEGMCISDA

SEQ ID NO: 434937 - protein, 9 aa, Homo Sapiens
LPASKMHFQ

SEQ ID NO: 434938 - protein, 9 aa, Homo Sapiens
INQDVYNFL

SEQ ID NO: 434939 - protein, 9 aa, Homo Sapiens
GLKSLAIHL

SEQ ID NO: 434940 - protein, 9 aa, Homo Sapiens
NKLIKNQFG

SEQ ID NO: 434941 - protein, 9 aa, Homo Sapiens
KIQKQIQET

SEQ ID NO: 434942 - protein, 9 aa, Homo Sapiens
ILTTHKIIH

SEQ ID NO: 434943 - protein, 9 aa, Homo Sapiens
EMAALLFVN

SEQ ID NO: 434944 - protein, 9 aa, Homo Sapiens
REDVSIPRS

SEQ ID NO: 434945 - protein, 9 aa, Homo Sapiens
LEKMQKYTS

SEQ ID NO: 434946 - protein, 9 aa, Homo Sapiens
RYLKARQAQ

SEQ ID NO: 434947 - protein, 9 aa, Homo Sapiens
HLFGGTEIF

SEQ ID NO: 434948 - protein, 9 aa, Homo Sapiens
DLEYLKKVC

SEQ ID NO: 434949 - protein, 9 aa, Homo Sapiens
PLLNHLVYS

SEQ ID NO: 434950 - protein, 9 aa, Homo Sapiens
ESSGPNTLK

SEQ ID NO: 434951 - protein, 9 aa, Homo Sapiens
LARLWNFTD

SEQ ID NO: 434952 - protein, 9 aa, Homo Sapiens
GNRLHNQIC

SEQ ID NO: 434953 - protein, 9 aa, Homo Sapiens
KRKEMEECE

SEQ ID NO: 434954 - protein, 9 aa, Homo Sapiens
AIATTRSAK

SEQ ID NO: 434955 - protein, 9 aa, Homo Sapiens
APQGNLELE

SEQ ID NO: 434956 - protein, 9 aa, Homo Sapiens
YLIRHQRIN

SEQ ID NO: 434957 - protein, 9 aa, Homo Sapiens
FEDVWRMIW

SEQ ID NO: 434958 - protein, 9 aa, Homo Sapiens
WVLDSWSHD

SEQ ID NO: 434959 - protein, 9 aa, Homo Sapiens
SENQDTIKS

SEQ ID NO: 434960 - protein, 9 aa, Homo Sapiens
NRSKHLEKV

SEQ ID NO: 434961 - protein, 9 aa, Homo Sapiens
NVKFDLKVI

SEQ ID NO: 434962 - protein, 9 aa, Homo Sapiens
EAELAQIIA

SEQ ID NO: 434963 - protein, 9 aa, Homo Sapiens
QSELFNRWK

SEQ ID NO: 434964 - protein, 9 aa, Homo Sapiens
FSIETKTTI

SEQ ID NO: 434965 - protein, 9 aa, Homo Sapiens
HAAIDAPDL

SEQ ID NO: 434966 - protein, 9 aa, Homo Sapiens
VYYDISTAN

SEQ ID NO: 434967 - protein, 9 aa, Homo Sapiens
WVQSGPRTP

SEQ ID NO: 434968 - protein, 9 aa, Homo Sapiens
IPSMMTPPL

SEQ ID NO: 434969 - protein, 9 aa, Homo Sapiens
IRIRGSSTD

SEQ ID NO: 434970 - protein, 9 aa, Homo Sapiens
QLEGKWAML

SEQ ID NO: 434971 - protein, 9 aa, Homo Sapiens
KQAQIQKVY

SEQ ID NO: 434972 - protein, 9 aa, Homo Sapiens
QSGRNSTFK

SEQ ID NO: 434973 - protein, 9 aa, Homo Sapiens
FILPYDGKF

SEQ ID NO: 434974 - protein, 9 aa, Homo Sapiens
NNYKLPLRR

SEQ ID NO: 434975 - protein, 9 aa, Homo Sapiens
EANNSISVL

SEQ ID NO: 434976 - protein, 9 aa, Homo Sapiens
CYSNDKTLE

SEQ ID NO: 434977 - protein, 9 aa, Homo Sapiens
VQGITGQPF

SEQ ID NO: 434978 - protein, 9 aa, Homo Sapiens
VDAGEEQDL

SEQ ID NO: 434979 - protein, 9 aa, Homo Sapiens
ASPANCPLK

SEQ ID NO: 434980 - protein, 9 aa, Homo Sapiens
EAKIIEAKQ

SEQ ID NO: 434981 - protein, 9 aa, Homo Sapiens
GEVLLENPK

SEQ ID NO: 434982 - protein, 9 aa, Homo Sapiens
TGDFEQTLK

SEQ ID NO: 434983 - protein, 9 aa, Homo Sapiens
DLYQSGKLR

SEQ ID NO: 434984 - protein, 9 aa, Homo Sapiens
SISVMSDIR

SEQ ID NO: 434985 - protein, 9 aa, Homo Sapiens
LWLLVPTQY

SEQ ID NO: 434986 - protein, 9 aa, Homo Sapiens
VVLLDDPFS

SEQ ID NO: 434987 - protein, 9 aa, Homo Sapiens
IHTGDKPYA

SEQ ID NO: 434988 - protein, 9 aa, Homo Sapiens
VDFMLPTLI

SEQ ID NO: 434989 - protein, 9 aa, Homo Sapiens
CNSTDDCIE

SEQ ID NO: 434990 - protein, 9 aa, Homo Sapiens
VIQLHFFKS

SEQ ID NO: 434991 - protein, 9 aa, Homo Sapiens
NGKLWIMIE

SEQ ID NO: 434992 - protein, 9 aa, Homo Sapiens
TLGDDLNSE

SEQ ID NO: 434993 - protein, 9 aa, Homo Sapiens
SSIRRHWNV

SEQ ID NO: 434994 - protein, 9 aa, Homo Sapiens
PCLYRTPEM

SEQ ID NO: 434995 - protein, 9 aa, Homo Sapiens
LLLIIKGLI

SEQ ID NO: 434996 - protein, 9 aa, Homo Sapiens
CFFLWPLEC

SEQ ID NO: 434997 - protein, 9 aa, Homo Sapiens
CTRGTPPGL

SEQ ID NO: 434998 - protein, 9 aa, Homo Sapiens
LPTCGSHLS

SEQ ID NO: 434999 - protein, 9 aa, Homo Sapiens
EYTERYSDD

SEQ ID NO: 435000 - protein, 9 aa, Homo Sapiens
KGSFVAFAG

SEQ ID NO: 435001 - protein, 9 aa, Homo Sapiens
RIYVNNLAK

SEQ ID NO: 435002 - protein, 9 aa, Homo Sapiens
KLSSFFKSL

SEQ ID NO: 435003 - protein, 9 aa, Homo Sapiens
VVTLSNIMN

SEQ ID NO: 435004 - protein, 9 aa, Homo Sapiens
LNKMNDYAG

SEQ ID NO: 435005 - protein, 9 aa, Homo Sapiens
CNQCGKAFH

SEQ ID NO: 435006 - protein, 9 aa, Homo Sapiens
SLGKSSDVS

SEQ ID NO: 435007 - protein, 9 aa, Homo Sapiens
ENVEFGHIQ

SEQ ID NO: 435008 - protein, 9 aa, Homo Sapiens
GSLQIHERT

SEQ ID NO: 435009 - protein, 9 aa, Homo Sapiens
HKKMYGKQS

SEQ ID NO: 435010 - protein, 9 aa, Homo Sapiens
IHFRHLYKQ

SEQ ID NO: 435011 - protein, 9 aa, Homo Sapiens
LNRAKEAEE

SEQ ID NO: 435012 - protein, 9 aa, Homo Sapiens
RGKAGWHKL

SEQ ID NO: 435013 - protein, 9 aa, Homo Sapiens
VLLETRRNL

SEQ ID NO: 435014 - protein, 9 aa, Homo Sapiens
LIQSRMARY

SEQ ID NO: 435015 - protein, 9 aa, Homo Sapiens
CHGELKNNW

SEQ ID NO: 435016 - protein, 9 aa, Homo Sapiens
DIMKQKHKF

SEQ ID NO: 435017 - protein, 9 aa, Homo Sapiens
VVFNALVTF

SEQ ID NO: 435018 - protein, 9 aa, Homo Sapiens
GDTGPAREG

SEQ ID NO: 435019 - protein, 9 aa, Homo Sapiens
GKSSHWVDI

SEQ ID NO: 435020 - protein, 9 aa, Homo Sapiens
EQDFITSLF

SEQ ID NO: 435021 - protein, 9 aa, Homo Sapiens
KRTIYHFSA

SEQ ID NO: 435022 - protein, 9 aa, Homo Sapiens
IGEQRHLTH

SEQ ID NO: 435023 - protein, 9 aa, Homo Sapiens
YVEVAKVQD

SEQ ID NO: 435024 - protein, 9 aa, Homo Sapiens
HELVPTADH

SEQ ID NO: 435025 - protein, 9 aa, Homo Sapiens
LQLLCGDME

SEQ ID NO: 435026 - protein, 9 aa, Homo Sapiens
HLMYLLNCC

SEQ ID NO: 435027 - protein, 9 aa, Homo Sapiens
TELETKLQV

SEQ ID NO: 435028 - protein, 9 aa, Homo Sapiens
IKGNTIVPE

SEQ ID NO: 435029 - protein, 9 aa, Homo Sapiens
IISPLLAGL

SEQ ID NO: 435030 - protein, 9 aa, Homo Sapiens
GEVVPGVVS

SEQ ID NO: 435031 - protein, 9 aa, Homo Sapiens
YTKLCEYIT

SEQ ID NO: 435032 - protein, 9 aa, Homo Sapiens
IILAMLMVD

SEQ ID NO: 435033 - protein, 9 aa, Homo Sapiens
CQLHMEFLR

SEQ ID NO: 435034 - protein, 9 aa, Homo Sapiens
PTAVSSDQV

SEQ ID NO: 435035 - protein, 9 aa, Homo Sapiens
KLDMARGKN

SEQ ID NO: 435036 - protein, 9 aa, Homo Sapiens
LQKVLHLEF

SEQ ID NO: 435037 - protein, 9 aa, Homo Sapiens
AEVSADISF

SEQ ID NO: 435038 - protein, 9 aa, Homo Sapiens
VRDFQLRDT

SEQ ID NO: 435039 - protein, 9 aa, Homo Sapiens
GRVEPGSLK

SEQ ID NO: 435040 - protein, 9 aa, Homo Sapiens
VIPLVFQIM

SEQ ID NO: 435041 - protein, 9 aa, Homo Sapiens
CITCQKSYN

SEQ ID NO: 435042 - protein, 9 aa, Homo Sapiens
IYGVTPLFN

SEQ ID NO: 435043 - protein, 9 aa, Homo Sapiens
INTTFLLMG

SEQ ID NO: 435044 - protein, 9 aa, Homo Sapiens
NWKIKNTHD

SEQ ID NO: 435045 - protein, 9 aa, Homo Sapiens
KTGTLTQNK

SEQ ID NO: 435046 - protein, 9 aa, Homo Sapiens
PKIIVVECM

SEQ ID NO: 435047 - protein, 9 aa, Homo Sapiens
LKSQPPLPE

SEQ ID NO: 435048 - protein, 9 aa, Homo Sapiens
CKNSSTYWE

SEQ ID NO: 435049 - protein, 9 aa, Homo Sapiens
STVSNNKTP

SEQ ID NO: 435050 - protein, 9 aa, Homo Sapiens
LKKMAYLAR

SEQ ID NO: 435051 - protein, 9 aa, Homo Sapiens
QKHVKTHTG

SEQ ID NO: 435052 - protein, 9 aa, Homo Sapiens
EECMANVGG

SEQ ID NO: 435053 - protein, 9 aa, Homo Sapiens
KFSLEEWEC

SEQ ID NO: 435054 - protein, 9 aa, Homo Sapiens
ENVLLRKGC

SEQ ID NO: 435055 - protein, 9 aa, Homo Sapiens
SQPKSFDNS

SEQ ID NO: 435056 - protein, 9 aa, Homo Sapiens
IIIVPEQTI

SEQ ID NO: 435057 - protein, 9 aa, Homo Sapiens
CKSRASNAQ

SEQ ID NO: 435058 - protein, 9 aa, Homo Sapiens
FCLDTLPEF

SEQ ID NO: 435059 - protein, 9 aa, Homo Sapiens
LLTDSKFSM

SEQ ID NO: 435060 - protein, 9 aa, Homo Sapiens
TCCCGDLRD

SEQ ID NO: 435061 - protein, 9 aa, Homo Sapiens
NYKDNKFLT

SEQ ID NO: 435062 - protein, 9 aa, Homo Sapiens
RNDSTVPNQ

SEQ ID NO: 435063 - protein, 9 aa, Homo Sapiens
TNHVQIHTG

SEQ ID NO: 435064 - protein, 9 aa, Homo Sapiens
PDQYEASDK

SEQ ID NO: 435065 - protein, 9 aa, Homo Sapiens
KTHWLGAAP

SEQ ID NO: 435066 - protein, 9 aa, Homo Sapiens
SLHNDSVKV

SEQ ID NO: 435067 - protein, 9 aa, Homo Sapiens
NNLHILVHV

SEQ ID NO: 435068 - protein, 9 aa, Homo Sapiens
YGSQHHKQR

SEQ ID NO: 435069 - protein, 9 aa, Homo Sapiens
KPLGGSHTL

SEQ ID NO: 435070 - protein, 9 aa, Homo Sapiens
TALMLNKRI

SEQ ID NO: 435071 - protein, 9 aa, Homo Sapiens
YSPYGYGSG

SEQ ID NO: 435072 - protein, 9 aa, Homo Sapiens
LQYSNQNTA

SEQ ID NO: 435073 - protein, 9 aa, Homo Sapiens
KWEGMANLP

SEQ ID NO: 435074 - protein, 9 aa, Homo Sapiens
CDVPAMWTL

SEQ ID NO: 435075 - protein, 9 aa, Homo Sapiens
TGNLVNTYY

SEQ ID NO: 435076 - protein, 9 aa, Homo Sapiens
QLLWAKTDS

SEQ ID NO: 435077 - protein, 9 aa, Homo Sapiens
KPKAAVQKE

SEQ ID NO: 435078 - protein, 9 aa, Homo Sapiens
QFMTFKEKR

SEQ ID NO: 435079 - protein, 9 aa, Homo Sapiens
GLLVLTLLL

SEQ ID NO: 435080 - protein, 9 aa, Homo Sapiens
AGNGYGNPQ

SEQ ID NO: 435081 - protein, 9 aa, Homo Sapiens
PRTSDKPYI

SEQ ID NO: 435082 - protein, 9 aa, Homo Sapiens
LYNVAISLG

SEQ ID NO: 435083 - protein, 9 aa, Homo Sapiens
SSEHLSVVD

SEQ ID NO: 435084 - protein, 9 aa, Homo Sapiens
LPKGEKKNV

SEQ ID NO: 435085 - protein, 9 aa, Homo Sapiens
CESEYGIEG

SEQ ID NO: 435086 - protein, 9 aa, Homo Sapiens
EQNVPPPKS

SEQ ID NO: 435087 - protein, 9 aa, Homo Sapiens
QLEVWDLDD

SEQ ID NO: 435088 - protein, 9 aa, Homo Sapiens
GVLTGTSEY

SEQ ID NO: 435089 - protein, 9 aa, Homo Sapiens
DAPDLFGDT

SEQ ID NO: 435090 - protein, 9 aa, Homo Sapiens
GVKYIIKVA

SEQ ID NO: 435091 - protein, 9 aa, Homo Sapiens
IVNINISEV

SEQ ID NO: 435092 - protein, 9 aa, Homo Sapiens
SCNICKIRF

SEQ ID NO: 435093 - protein, 9 aa, Homo Sapiens
VQRFQDTLK

SEQ ID NO: 435094 - protein, 9 aa, Homo Sapiens
LFGPTLSAN

SEQ ID NO: 435095 - protein, 9 aa, Homo Sapiens
DKKITFLKR

SEQ ID NO: 435096 - protein, 9 aa, Homo Sapiens
VQKESGHSL

SEQ ID NO: 435097 - protein, 9 aa, Homo Sapiens
GLLKSPKGV

SEQ ID NO: 435098 - protein, 9 aa, Homo Sapiens
EVEAELAQI

SEQ ID NO: 435099 - protein, 9 aa, Homo Sapiens
AGQSLPSLQ

SEQ ID NO: 435100 - protein, 9 aa, Homo Sapiens
DLIIHHIIH

SEQ ID NO: 435101 - protein, 9 aa, Homo Sapiens
AIRSIILVI

SEQ ID NO: 435102 - protein, 9 aa, Homo Sapiens
DVANAVVVE

SEQ ID NO: 435103 - protein, 9 aa, Homo Sapiens
WICPQGYTC

SEQ ID NO: 435104 - protein, 9 aa, Homo Sapiens
LLIQCQFSG

SEQ ID NO: 435105 - protein, 9 aa, Homo Sapiens
RSKPSEEIK

SEQ ID NO: 435106 - protein, 9 aa, Homo Sapiens
AEQAQGEQN

SEQ ID NO: 435107 - protein, 9 aa, Homo Sapiens
KAKTKRLTK

SEQ ID NO: 435108 - protein, 9 aa, Homo Sapiens
AVCKVNRTF

SEQ ID NO: 435109 - protein, 9 aa, Homo Sapiens
KEIQRSQND

SEQ ID NO: 435110 - protein, 9 aa, Homo Sapiens
ESHNLREEC

SEQ ID NO: 435111 - protein, 9 aa, Homo Sapiens
DSSFEVCGA

SEQ ID NO: 435112 - protein, 9 aa, Homo Sapiens
LRALAERLV

SEQ ID NO: 435113 - protein, 9 aa, Homo Sapiens
CKECGRLLV

SEQ ID NO: 435114 - protein, 9 aa, Homo Sapiens
SVEHCKAHT

SEQ ID NO: 435115 - protein, 9 aa, Homo Sapiens
SLTYTGEKK

SEQ ID NO: 435116 - protein, 9 aa, Homo Sapiens
GQHLGYSSK

SEQ ID NO: 435117 - protein, 9 aa, Homo Sapiens
TYVHVQQGP

SEQ ID NO: 435118 - protein, 9 aa, Homo Sapiens
LLYGRFSSP

SEQ ID NO: 435119 - protein, 9 aa, Homo Sapiens
HLPVLIIMS

SEQ ID NO: 435120 - protein, 9 aa, Homo Sapiens
YIYAFVHQI

SEQ ID NO: 435121 - protein, 9 aa, Homo Sapiens
TRFLSMEKL

SEQ ID NO: 435122 - protein, 9 aa, Homo Sapiens
ELGHKKLKS

SEQ ID NO: 435123 - protein, 9 aa, Homo Sapiens
ADSLTIYLV

SEQ ID NO: 435124 - protein, 9 aa, Homo Sapiens
RDSTVSNNK

SEQ ID NO: 435125 - protein, 9 aa, Homo Sapiens
DVRLPFHAD

SEQ ID NO: 435126 - protein, 9 aa, Homo Sapiens
IRDGICHGL

SEQ ID NO: 435127 - protein, 9 aa, Homo Sapiens
SLHMFRFPM

SEQ ID NO: 435128 - protein, 9 aa, Homo Sapiens
VAKVQDYDR

SEQ ID NO: 435129 - protein, 9 aa, Homo Sapiens
LSSFLSQCG

SEQ ID NO: 435130 - protein, 9 aa, Homo Sapiens
GWGQRIAEG

SEQ ID NO: 435131 - protein, 9 aa, Homo Sapiens
PDNEGELQH

SEQ ID NO: 435132 - protein, 9 aa, Homo Sapiens
MVIVIFFPA

SEQ ID NO: 435133 - protein, 9 aa, Homo Sapiens
EVAVEYFKN

SEQ ID NO: 435134 - protein, 9 aa, Homo Sapiens
AELAQIIAA

SEQ ID NO: 435135 - protein, 9 aa, Homo Sapiens
VRDLVHRLP

SEQ ID NO: 435136 - protein, 9 aa, Homo Sapiens
VSYALFQVN

SEQ ID NO: 435137 - protein, 9 aa, Homo Sapiens
QIRTTAAQE

SEQ ID NO: 435138 - protein, 9 aa, Homo Sapiens
EEINEGRMS

SEQ ID NO: 435139 - protein, 9 aa, Homo Sapiens
GSPQSPVNK

SEQ ID NO: 435140 - protein, 9 aa, Homo Sapiens
IFKEKVFTE

SEQ ID NO: 435141 - protein, 9 aa, Homo Sapiens
GCEFPLHQD

SEQ ID NO: 435142 - protein, 9 aa, Homo Sapiens
QSLDLSKLA

SEQ ID NO: 435143 - protein, 9 aa, Homo Sapiens
RFLVAKSNV

SEQ ID NO: 435144 - protein, 9 aa, Homo Sapiens
MDEPLNTLI

SEQ ID NO: 435145 - protein, 9 aa, Homo Sapiens
DIQIYFDTR

SEQ ID NO: 435146 - protein, 9 aa, Homo Sapiens
QWKKLWRES

SEQ ID NO: 435147 - protein, 9 aa, Homo Sapiens
LEMKSARYL

SEQ ID NO: 435148 - protein, 9 aa, Homo Sapiens
PPPGFKRLS

SEQ ID NO: 435149 - protein, 9 aa, Homo Sapiens
MKNNYLHNF

SEQ ID NO: 435150 - protein, 9 aa, Homo Sapiens
FICKLFPFL

SEQ ID NO: 435151 - protein, 9 aa, Homo Sapiens
ILVNCYTKL

SEQ ID NO: 435152 - protein, 9 aa, Homo Sapiens
AINRINPDA

SEQ ID NO: 435153 - protein, 9 aa, Homo Sapiens
RRKYMIVDE

SEQ ID NO: 435154 - protein, 9 aa, Homo Sapiens
KSNFQNEIK

SEQ ID NO: 435155 - protein, 9 aa, Homo Sapiens
DLHYQTLVR

SEQ ID NO: 435156 - protein, 9 aa, Homo Sapiens
KGHETTTGK

SEQ ID NO: 435157 - protein, 9 aa, Homo Sapiens
PHTANLNIV

SEQ ID NO: 435158 - protein, 9 aa, Homo Sapiens
YGNPIEASL

SEQ ID NO: 435159 - protein, 9 aa, Homo Sapiens
QCHQADKYQ

SEQ ID NO: 435160 - protein, 9 aa, Homo Sapiens
SEKVCKLND

SEQ ID NO: 435161 - protein, 9 aa, Homo Sapiens
ELNLQQNQK

SEQ ID NO: 435162 - protein, 9 aa, Homo Sapiens
KQQMNSASG

SEQ ID NO: 435163 - protein, 9 aa, Homo Sapiens
DHSEVYGPM

SEQ ID NO: 435164 - protein, 9 aa, Homo Sapiens
QIGADKLLS

SEQ ID NO: 435165 - protein, 9 aa, Homo Sapiens
KIKKLASES

SEQ ID NO: 435166 - protein, 9 aa, Homo Sapiens
LERSLPDIC

SEQ ID NO: 435167 - protein, 9 aa, Homo Sapiens
YFAFFILLV

SEQ ID NO: 435168 - protein, 9 aa, Homo Sapiens
CKIRFNSQS

SEQ ID NO: 435169 - protein, 9 aa, Homo Sapiens
NKYLDQEKE

SEQ ID NO: 435170 - protein, 9 aa, Homo Sapiens
YGDKSYECK

SEQ ID NO: 435171 - protein, 9 aa, Homo Sapiens
VDGGHNSVI

SEQ ID NO: 435172 - protein, 9 aa, Homo Sapiens
ASSLESYLQ

SEQ ID NO: 435173 - protein, 9 aa, Homo Sapiens
RHPLSLPVE

SEQ ID NO: 435174 - protein, 9 aa, Homo Sapiens
SGMGFQQDR

SEQ ID NO: 435175 - protein, 9 aa, Homo Sapiens
IPVIFCGDC

SEQ ID NO: 435176 - protein, 9 aa, Homo Sapiens
DKQIKRKWT

SEQ ID NO: 435177 - protein, 9 aa, Homo Sapiens
ADNWKRYKE

SEQ ID NO: 435178 - protein, 9 aa, Homo Sapiens
IPGQFTCPQ

SEQ ID NO: 435179 - protein, 9 aa, Homo Sapiens
TEKYNVYRD

SEQ ID NO: 435180 - protein, 9 aa, Homo Sapiens
KHGWVWNQF

SEQ ID NO: 435181 - protein, 9 aa, Homo Sapiens
SHIRHMSSK

SEQ ID NO: 435182 - protein, 9 aa, Homo Sapiens
VVFDKDVNE

SEQ ID NO: 435183 - protein, 9 aa, Homo Sapiens
QLTQPPQQL

SEQ ID NO: 435184 - protein, 9 aa, Homo Sapiens
VKCYNPHTD

SEQ ID NO: 435185 - protein, 9 aa, Homo Sapiens
TIQILDALK

SEQ ID NO: 435186 - protein, 9 aa, Homo Sapiens
LHAFQGYSN

SEQ ID NO: 435187 - protein, 9 aa, Homo Sapiens
FDGRHFDFM

SEQ ID NO: 435188 - protein, 9 aa, Homo Sapiens
GAWGCFDEC

SEQ ID NO: 435189 - protein, 9 aa, Homo Sapiens
IIRHRSALV

SEQ ID NO: 435190 - protein, 9 aa, Homo Sapiens
ALLLIAQKN

SEQ ID NO: 435191 - protein, 9 aa, Homo Sapiens
SKSMNVLIR

SEQ ID NO: 435192 - protein, 9 aa, Homo Sapiens
DLDRHPEIN

SEQ ID NO: 435193 - protein, 9 aa, Homo Sapiens
SSGYNNHDR

SEQ ID NO: 435194 - protein, 9 aa, Homo Sapiens
LLNHLVYSL

SEQ ID NO: 435195 - protein, 9 aa, Homo Sapiens
MLKFSSENS

SEQ ID NO: 435196 - protein, 9 aa, Homo Sapiens
VADSWMDEV

SEQ ID NO: 435197 - protein, 9 aa, Homo Sapiens
TGVELAPHS

SEQ ID NO: 435198 - protein, 9 aa, Homo Sapiens
EKEIEGDGF

SEQ ID NO: 435199 - protein, 9 aa, Homo Sapiens
LLDGPYPKK

SEQ ID NO: 435200 - protein, 9 aa, Homo Sapiens
CCCPRPPRA

SEQ ID NO: 435201 - protein, 9 aa, Homo Sapiens
TSPKVNNLN

SEQ ID NO: 435202 - protein, 9 aa, Homo Sapiens
MSKHALDFI

SEQ ID NO: 435203 - protein, 9 aa, Homo Sapiens
CAGTYDGSL

SEQ ID NO: 435204 - protein, 9 aa, Homo Sapiens
VLKPHQVGL

SEQ ID NO: 435205 - protein, 9 aa, Homo Sapiens
HGHDAVQQH

SEQ ID NO: 435206 - protein, 9 aa, Homo Sapiens
CHQADKYQP

SEQ ID NO: 435207 - protein, 9 aa, Homo Sapiens
LGKRLDRET

SEQ ID NO: 435208 - protein, 9 aa, Homo Sapiens
PTHPELQIV

SEQ ID NO: 435209 - protein, 9 aa, Homo Sapiens
QKVAVNNIK

SEQ ID NO: 435210 - protein, 9 aa, Homo Sapiens
KELETNSEE

SEQ ID NO: 435211 - protein, 9 aa, Homo Sapiens
LLNKLTQST

SEQ ID NO: 435212 - protein, 9 aa, Homo Sapiens
ATQPIPIIK

SEQ ID NO: 435213 - protein, 9 aa, Homo Sapiens
QADSLTIYL

SEQ ID NO: 435214 - protein, 9 aa, Homo Sapiens
HQERKFNLY

SEQ ID NO: 435215 - protein, 9 aa, Homo Sapiens
DKEKITYLP

SEQ ID NO: 435216 - protein, 9 aa, Homo Sapiens
LGASGYPGN

SEQ ID NO: 435217 - protein, 9 aa, Homo Sapiens
GDCNFALGQ

SEQ ID NO: 435218 - protein, 9 aa, Homo Sapiens
AQRRCTRGT

SEQ ID NO: 435219 - protein, 9 aa, Homo Sapiens
VQIHHPSGA

SEQ ID NO: 435220 - protein, 9 aa, Homo Sapiens
LVKIHLMYA

SEQ ID NO: 435221 - protein, 9 aa, Homo Sapiens
YVTTLSYFA

SEQ ID NO: 435222 - protein, 9 aa, Homo Sapiens
TAPNDLYLQ

SEQ ID NO: 435223 - protein, 9 aa, Homo Sapiens
KCRMESYFD

SEQ ID NO: 435224 - protein, 9 aa, Homo Sapiens
RRRLNLTQH

SEQ ID NO: 435225 - protein, 9 aa, Homo Sapiens
NTMVLVVLT

SEQ ID NO: 435226 - protein, 9 aa, Homo Sapiens
FFATHPNTD

SEQ ID NO: 435227 - protein, 9 aa, Homo Sapiens
NAIGNFALT

SEQ ID NO: 435228 - protein, 9 aa, Homo Sapiens
VHEPGSPTR

SEQ ID NO: 435229 - protein, 9 aa, Homo Sapiens
AIQEELLYF

SEQ ID NO: 435230 - protein, 9 aa, Homo Sapiens
ILCLKERHG

SEQ ID NO: 435231 - protein, 9 aa, Homo Sapiens
VQAENRLFL

SEQ ID NO: 435232 - protein, 9 aa, Homo Sapiens
QLYDNKPRR

SEQ ID NO: 435233 - protein, 9 aa, Homo Sapiens
TSTGCYKCL

SEQ ID NO: 435234 - protein, 9 aa, Homo Sapiens
NVGSEVHLI

SEQ ID NO: 435235 - protein, 9 aa, Homo Sapiens
LSVPLLIFL

SEQ ID NO: 435236 - protein, 9 aa, Homo Sapiens
SATTGQNVE

SEQ ID NO: 435237 - protein, 9 aa, Homo Sapiens
YNETEPVTV

SEQ ID NO: 435238 - protein, 9 aa, Homo Sapiens
VLSRTPISD

SEQ ID NO: 435239 - protein, 9 aa, Homo Sapiens
HKLEALHLE

SEQ ID NO: 435240 - protein, 9 aa, Homo Sapiens
GLILLAFLI

SEQ ID NO: 435241 - protein, 9 aa, Homo Sapiens
TLPTVLDIF

SEQ ID NO: 435242 - protein, 9 aa, Homo Sapiens
RLCYYLGTT

SEQ ID NO: 435243 - protein, 9 aa, Homo Sapiens
RKNIFHFGE

SEQ ID NO: 435244 - protein, 9 aa, Homo Sapiens
NKRRTLQIN

SEQ ID NO: 435245 - protein, 9 aa, Homo Sapiens
SPKDKYNCI

SEQ ID NO: 435246 - protein, 9 aa, Homo Sapiens
MTEKSEPKT

SEQ ID NO: 435247 - protein, 9 aa, Homo Sapiens
KIFTQKSSI

SEQ ID NO: 435248 - protein, 9 aa, Homo Sapiens
NKLFQVAKR

SEQ ID NO: 435249 - protein, 9 aa, Homo Sapiens
SSSSGFVEE

SEQ ID NO: 435250 - protein, 9 aa, Homo Sapiens
ICKSVASFI

SEQ ID NO: 435251 - protein, 9 aa, Homo Sapiens
KQHKIEGSK

SEQ ID NO: 435252 - protein, 9 aa, Homo Sapiens
KSSESKKEY

SEQ ID NO: 435253 - protein, 9 aa, Homo Sapiens
GNTSQRGKS

SEQ ID NO: 435254 - protein, 9 aa, Homo Sapiens
TPEPDIYHG

SEQ ID NO: 435255 - protein, 9 aa, Homo Sapiens
VSRESLLQP

SEQ ID NO: 435256 - protein, 9 aa, Homo Sapiens
LVQRLIQTK

SEQ ID NO: 435257 - protein, 9 aa, Homo Sapiens
SVWRNKEMD

SEQ ID NO: 435258 - protein, 9 aa, Homo Sapiens
GAQNEVEKI

SEQ ID NO: 435259 - protein, 9 aa, Homo Sapiens
IIAALTKAE

SEQ ID NO: 435260 - protein, 9 aa, Homo Sapiens
ELSRLVSEW

SEQ ID NO: 435261 - protein, 9 aa, Homo Sapiens
RHLIEHVNA

SEQ ID NO: 435262 - protein, 9 aa, Homo Sapiens
KVQMGWSID

SEQ ID NO: 435263 - protein, 9 aa, Homo Sapiens
KKKESHDCG

SEQ ID NO: 435264 - protein, 9 aa, Homo Sapiens
EKDPNKDKQ

SEQ ID NO: 435265 - protein, 9 aa, Homo Sapiens
NLKIHKQTH

SEQ ID NO: 435266 - protein, 9 aa, Homo Sapiens
VDTINDYTC

SEQ ID NO: 435267 - protein, 9 aa, Homo Sapiens
THNGTPQNA

SEQ ID NO: 435268 - protein, 9 aa, Homo Sapiens
KTVPGASNL

SEQ ID NO: 435269 - protein, 9 aa, Homo Sapiens
IPPHHPSSA

SEQ ID NO: 435270 - protein, 9 aa, Homo Sapiens
PTSPRPGSV

SEQ ID NO: 435271 - protein, 9 aa, Homo Sapiens
EVVLSNTLN

SEQ ID NO: 435272 - protein, 9 aa, Homo Sapiens
ESHHNFIQD

SEQ ID NO: 435273 - protein, 9 aa, Homo Sapiens
LPTLVQVRH

SEQ ID NO: 435274 - protein, 9 aa, Homo Sapiens
MLNTNNCPS

SEQ ID NO: 435275 - protein, 9 aa, Homo Sapiens
EHGKCKTFF

SEQ ID NO: 435276 - protein, 9 aa, Homo Sapiens
DSWMDEVIK

SEQ ID NO: 435277 - protein, 9 aa, Homo Sapiens
VPVTVRVHL

SEQ ID NO: 435278 - protein, 9 aa, Homo Sapiens
DGLNITEVV

SEQ ID NO: 435279 - protein, 9 aa, Homo Sapiens
FNTLSGKLE

SEQ ID NO: 435280 - protein, 9 aa, Homo Sapiens
PNIVNINLS

SEQ ID NO: 435281 - protein, 9 aa, Homo Sapiens
CSHGAEDEV

SEQ ID NO: 435282 - protein, 9 aa, Homo Sapiens
GPMSPPGPP

SEQ ID NO: 435283 - protein, 9 aa, Homo Sapiens
SVLMKYCLR

SEQ ID NO: 435284 - protein, 9 aa, Homo Sapiens
EGQLRAAYN

SEQ ID NO: 435285 - protein, 9 aa, Homo Sapiens
PDYGEVTNV

SEQ ID NO: 435286 - protein, 9 aa, Homo Sapiens
MVSSFPHRK

SEQ ID NO: 435287 - protein, 9 aa, Homo Sapiens
AAEVLKVQN

SEQ ID NO: 435288 - protein, 9 aa, Homo Sapiens
RSLHNDSVK

SEQ ID NO: 435289 - protein, 9 aa, Homo Sapiens
VVSPAEFVT

SEQ ID NO: 435290 - protein, 9 aa, Homo Sapiens
RAVYFLART

SEQ ID NO: 435291 - protein, 9 aa, Homo Sapiens
TSADTNGPV

SEQ ID NO: 435292 - protein, 9 aa, Homo Sapiens
RQPPPPTQH

SEQ ID NO: 435293 - protein, 9 aa, Homo Sapiens
ESNLSDVNT

SEQ ID NO: 435294 - protein, 9 aa, Homo Sapiens
LGEETQESL

SEQ ID NO: 435295 - protein, 9 aa, Homo Sapiens
SDIEAHLNS

SEQ ID NO: 435296 - protein, 9 aa, Homo Sapiens
SAPNMPLIE

SEQ ID NO: 435297 - protein, 9 aa, Homo Sapiens
SLEECMANV

SEQ ID NO: 435298 - protein, 9 aa, Homo Sapiens
ERSMKEASL

SEQ ID NO: 435299 - protein, 9 aa, Homo Sapiens
HHHHRHHHH

SEQ ID NO: 435300 - protein, 9 aa, Homo Sapiens
YKCEECGTV

SEQ ID NO: 435301 - protein, 9 aa, Homo Sapiens
QLHQGGKIN

SEQ ID NO: 435302 - protein, 9 aa, Homo Sapiens
GSQNDQSIL

SEQ ID NO: 435303 - protein, 9 aa, Homo Sapiens
RDQKEMKNY

SEQ ID NO: 435304 - protein, 9 aa, Homo Sapiens
AAKKAKYLG

SEQ ID NO: 435305 - protein, 9 aa, Homo Sapiens
CRPPISKEY

SEQ ID NO: 435306 - protein, 9 aa, Homo Sapiens
ILVVNVNPT

SEQ ID NO: 435307 - protein, 9 aa, Homo Sapiens
ADTSPAPIP

SEQ ID NO: 435308 - protein, 9 aa, Homo Sapiens
KRVPWSIPG

SEQ ID NO: 435309 - protein, 9 aa, Homo Sapiens
KKILEAEIE

SEQ ID NO: 435310 - protein, 9 aa, Homo Sapiens
PKCGTTYLY

SEQ ID NO: 435311 - protein, 9 aa, Homo Sapiens
ENFFTTGQK

SEQ ID NO: 435312 - protein, 9 aa, Homo Sapiens
VSWSPSDEI

SEQ ID NO: 435313 - protein, 9 aa, Homo Sapiens
IKINYLNQQ

SEQ ID NO: 435314 - protein, 9 aa, Homo Sapiens
ISPRYPSPP

SEQ ID NO: 435315 - protein, 9 aa, Homo Sapiens
WLPVVRTWH

SEQ ID NO: 435316 - protein, 9 aa, Homo Sapiens
WADLITCKT

SEQ ID NO: 435317 - protein, 9 aa, Homo Sapiens
LFSDTQTKN

SEQ ID NO: 435318 - protein, 9 aa, Homo Sapiens
HITILKLIG

SEQ ID NO: 435319 - protein, 9 aa, Homo Sapiens
KNGNSCAAQ

SEQ ID NO: 435320 - protein, 9 aa, Homo Sapiens
LGETWNISI

SEQ ID NO: 435321 - protein, 9 aa, Homo Sapiens
MVVGFWVGG

SEQ ID NO: 435322 - protein, 9 aa, Homo Sapiens
AIDSAENCF

SEQ ID NO: 435323 - protein, 9 aa, Homo Sapiens
VMKLGAGYP

SEQ ID NO: 435324 - protein, 9 aa, Homo Sapiens
PYALAFLYE

SEQ ID NO: 435325 - protein, 9 aa, Homo Sapiens
CTCGPGSRL

SEQ ID NO: 435326 - protein, 9 aa, Homo Sapiens
TIYLVVALA

SEQ ID NO: 435327 - protein, 9 aa, Homo Sapiens
RNTLCFLLG

SEQ ID NO: 435328 - protein, 9 aa, Homo Sapiens
HTEKFSPRQ

SEQ ID NO: 435329 - protein, 9 aa, Homo Sapiens
KRLKKDKKT

SEQ ID NO: 435330 - protein, 9 aa, Homo Sapiens
AVAQKPQSH

SEQ ID NO: 435331 - protein, 9 aa, Homo Sapiens
CVAGCSNSL

SEQ ID NO: 435332 - protein, 9 aa, Homo Sapiens
GKVIYTYMA

SEQ ID NO: 435333 - protein, 9 aa, Homo Sapiens
KMLQEMQSK

SEQ ID NO: 435334 - protein, 9 aa, Homo Sapiens
TKNNNLLHQ

SEQ ID NO: 435335 - protein, 9 aa, Homo Sapiens
NVFPGSGAP

SEQ ID NO: 435336 - protein, 9 aa, Homo Sapiens
VVECMMKDV

SEQ ID NO: 435337 - protein, 9 aa, Homo Sapiens
EQKLKFKDQ

SEQ ID NO: 435338 - protein, 9 aa, Homo Sapiens
MTWALILKR

SEQ ID NO: 435339 - protein, 9 aa, Homo Sapiens
ASKEDIDTV

SEQ ID NO: 435340 - protein, 9 aa, Homo Sapiens
ILLDMLQQR

SEQ ID NO: 435341 - protein, 9 aa, Homo Sapiens
RTHLKDTTQ

SEQ ID NO: 435342 - protein, 9 aa, Homo Sapiens
DTHTDPVPQ

SEQ ID NO: 435343 - protein, 9 aa, Homo Sapiens
HLTLHQIIH

SEQ ID NO: 435344 - protein, 9 aa, Homo Sapiens
KRILIHHRE

SEQ ID NO: 435345 - protein, 9 aa, Homo Sapiens
TRYMLSRPF

SEQ ID NO: 435346 - protein, 9 aa, Homo Sapiens
PLLTLDLDY

SEQ ID NO: 435347 - protein, 9 aa, Homo Sapiens
NYGRRRKGP

SEQ ID NO: 435348 - protein, 9 aa, Homo Sapiens
ITLFSVINN

SEQ ID NO: 435349 - protein, 9 aa, Homo Sapiens
GNYIESFLA

SEQ ID NO: 435350 - protein, 9 aa, Homo Sapiens
ELIQHQIIH

SEQ ID NO: 435351 - protein, 9 aa, Homo Sapiens
LNASFLTSP

SEQ ID NO: 435352 - protein, 9 aa, Homo Sapiens
CFSTGPARP

SEQ ID NO: 435353 - protein, 9 aa, Homo Sapiens
LRIIAGQMN

SEQ ID NO: 435354 - protein, 9 aa, Homo Sapiens
ISPTMLPQL

SEQ ID NO: 435355 - protein, 9 aa, Homo Sapiens
ERGRRRDSD

SEQ ID NO: 435356 - protein, 9 aa, Homo Sapiens
VDDLKDEAK

SEQ ID NO: 435357 - protein, 9 aa, Homo Sapiens
SKKIKYLGI

SEQ ID NO: 435358 - protein, 9 aa, Homo Sapiens
YTPRTGHQI

SEQ ID NO: 435359 - protein, 9 aa, Homo Sapiens
VIQHALAHE

SEQ ID NO: 435360 - protein, 9 aa, Homo Sapiens
KLEIISLDI

SEQ ID NO: 435361 - protein, 9 aa, Homo Sapiens
MVQMFISFV

SEQ ID NO: 435362 - protein, 9 aa, Homo Sapiens
LVPCSWKRI

SEQ ID NO: 435363 - protein, 9 aa, Homo Sapiens
SNYNDWINL

SEQ ID NO: 435364 - protein, 9 aa, Homo Sapiens
KVAQILVEL

SEQ ID NO: 435365 - protein, 9 aa, Homo Sapiens
DNFIGKPHV

SEQ ID NO: 435366 - protein, 9 aa, Homo Sapiens
YVAIDFTQE

SEQ ID NO: 435367 - protein, 9 aa, Homo Sapiens
NYRLEKEDK

SEQ ID NO: 435368 - protein, 9 aa, Homo Sapiens
SNIIAFYDM

SEQ ID NO: 435369 - protein, 9 aa, Homo Sapiens
SKDIKKELF

SEQ ID NO: 435370 - protein, 9 aa, Homo Sapiens
KLLGQLYKC

SEQ ID NO: 435371 - protein, 9 aa, Homo Sapiens
PLQMTSSAD

SEQ ID NO: 435372 - protein, 9 aa, Homo Sapiens
PHTCKDLLD

SEQ ID NO: 435373 - protein, 9 aa, Homo Sapiens
ASLQERERE

SEQ ID NO: 435374 - protein, 9 aa, Homo Sapiens
LKVYSCDKN

SEQ ID NO: 435375 - protein, 9 aa, Homo Sapiens
FLKTKRKPQ

SEQ ID NO: 435376 - protein, 9 aa, Homo Sapiens
PCPQWAYDN

SEQ ID NO: 435377 - protein, 9 aa, Homo Sapiens
QAAEGIHLI

SEQ ID NO: 435378 - protein, 9 aa, Homo Sapiens
IIAICAVSG

SEQ ID NO: 435379 - protein, 9 aa, Homo Sapiens
LVQVFTCVI

SEQ ID NO: 435380 - protein, 9 aa, Homo Sapiens
LQLEYDMVL

SEQ ID NO: 435381 - protein, 9 aa, Homo Sapiens
ECYSGLKYS

SEQ ID NO: 435382 - protein, 9 aa, Homo Sapiens
KSKLNRSKH

SEQ ID NO: 435383 - protein, 9 aa, Homo Sapiens
LDRHPEINL

SEQ ID NO: 435384 - protein, 9 aa, Homo Sapiens
LRTTSLKEG

SEQ ID NO: 435385 - protein, 9 aa, Homo Sapiens
AKCKGSLLD

SEQ ID NO: 435386 - protein, 9 aa, Homo Sapiens
PFSSSTNTE

SEQ ID NO: 435387 - protein, 9 aa, Homo Sapiens
HIGVLNVYI

SEQ ID NO: 435388 - protein, 9 aa, Homo Sapiens
KMESGGGAE

SEQ ID NO: 435389 - protein, 9 aa, Homo Sapiens
ILPQPPKKL

SEQ ID NO: 435390 - protein, 9 aa, Homo Sapiens
PVISCNICK

SEQ ID NO: 435391 - protein, 9 aa, Homo Sapiens
YGEPAGTIS

SEQ ID NO: 435392 - protein, 9 aa, Homo Sapiens
PTSIQTGYM

SEQ ID NO: 435393 - protein, 9 aa, Homo Sapiens
FSNCDVLRF

SEQ ID NO: 435394 - protein, 9 aa, Homo Sapiens
EDGEPWLII

SEQ ID NO: 435395 - protein, 9 aa, Homo Sapiens
NTHNLLTTR

SEQ ID NO: 435396 - protein, 9 aa, Homo Sapiens
RAMNQLDFE

SEQ ID NO: 435397 - protein, 9 aa, Homo Sapiens
QRHSSLIDI

SEQ ID NO: 435398 - protein, 9 aa, Homo Sapiens
RTSDKPYIR

SEQ ID NO: 435399 - protein, 9 aa, Homo Sapiens
QKFTFQEDD

SEQ ID NO: 435400 - protein, 9 aa, Homo Sapiens
SGMAGLPNM

SEQ ID NO: 435401 - protein, 9 aa, Homo Sapiens
KSANKLRSS

SEQ ID NO: 435402 - protein, 9 aa, Homo Sapiens
THSPEVAES

SEQ ID NO: 435403 - protein, 9 aa, Homo Sapiens
IFCGDCNST

SEQ ID NO: 435404 - protein, 9 aa, Homo Sapiens
SNKTATYDT

SEQ ID NO: 435405 - protein, 9 aa, Homo Sapiens
KMISLSECN

SEQ ID NO: 435406 - protein, 9 aa, Homo Sapiens
GFIDGSFDI

SEQ ID NO: 435407 - protein, 9 aa, Homo Sapiens
CGCGCGSGY

SEQ ID NO: 435408 - protein, 9 aa, Homo Sapiens
GISTEAFLA

SEQ ID NO: 435409 - protein, 9 aa, Homo Sapiens
KDIVPHNSN

SEQ ID NO: 435410 - protein, 9 aa, Homo Sapiens
KGFYLDDSD

SEQ ID NO: 435411 - protein, 9 aa, Homo Sapiens
GSLMGVHLL

SEQ ID NO: 435412 - protein, 9 aa, Homo Sapiens
NPGKQRYDK

SEQ ID NO: 435413 - protein, 9 aa, Homo Sapiens
NVVCHTCFK

SEQ ID NO: 435414 - protein, 9 aa, Homo Sapiens
FINIAAHCK

SEQ ID NO: 435415 - protein, 9 aa, Homo Sapiens
NHNYLEILK

SEQ ID NO: 435416 - protein, 9 aa, Homo Sapiens
ERSREQIQK

SEQ ID NO: 435417 - protein, 9 aa, Homo Sapiens
ALRYIAIHN

SEQ ID NO: 435418 - protein, 9 aa, Homo Sapiens
KKDNTFCMA

SEQ ID NO: 435419 - protein, 9 aa, Homo Sapiens
NKLLANLLL

SEQ ID NO: 435420 - protein, 9 aa, Homo Sapiens
TVDAAIFHL

SEQ ID NO: 435421 - protein, 9 aa, Homo Sapiens
HAAIQNKLF

SEQ ID NO: 435422 - protein, 9 aa, Homo Sapiens
VALFYIHML

SEQ ID NO: 435423 - protein, 9 aa, Homo Sapiens
LSLNFYTNV

SEQ ID NO: 435424 - protein, 9 aa, Homo Sapiens
LSYFAFFIL

SEQ ID NO: 435425 - protein, 9 aa, Homo Sapiens
DKDTLYIVE

SEQ ID NO: 435426 - protein, 9 aa, Homo Sapiens
VVTHPIYKA

SEQ ID NO: 435427 - protein, 9 aa, Homo Sapiens
FLTLENVKS

SEQ ID NO: 435428 - protein, 9 aa, Homo Sapiens
GTSVVQIRC

SEQ ID NO: 435429 - protein, 9 aa, Homo Sapiens
KQIQETLQE

SEQ ID NO: 435430 - protein, 9 aa, Homo Sapiens
ATFYTMYNQ

SEQ ID NO: 435431 - protein, 9 aa, Homo Sapiens
AAQGLTVAA

SEQ ID NO: 435432 - protein, 9 aa, Homo Sapiens
ISTDALPSA

SEQ ID NO: 435433 - protein, 9 aa, Homo Sapiens
ELEEQNLLL

SEQ ID NO: 435434 - protein, 9 aa, Homo Sapiens
FHICQQHTK

SEQ ID NO: 435435 - protein, 9 aa, Homo Sapiens
MDEVIKLCG

SEQ ID NO: 435436 - protein, 9 aa, Homo Sapiens
FIFVLDILS

SEQ ID NO: 435437 - protein, 9 aa, Homo Sapiens
GLFRSLHND

SEQ ID NO: 435438 - protein, 9 aa, Homo Sapiens
LSVNDSFRD

SEQ ID NO: 435439 - protein, 9 aa, Homo Sapiens
HFKFFPFMN

SEQ ID NO: 435440 - protein, 9 aa, Homo Sapiens
MCKIIIGLY

SEQ ID NO: 435441 - protein, 9 aa, Homo Sapiens
NSLEWAFHS

SEQ ID NO: 435442 - protein, 9 aa, Homo Sapiens
KSKIVEFIQ

SEQ ID NO: 435443 - protein, 9 aa, Homo Sapiens
RIQGFPQDG

SEQ ID NO: 435444 - protein, 9 aa, Homo Sapiens
EKKDNTFCM

SEQ ID NO: 435445 - protein, 9 aa, Homo Sapiens
KMEDGKVIE

SEQ ID NO: 435446 - protein, 9 aa, Homo Sapiens
SSVAAGTAE

SEQ ID NO: 435447 - protein, 9 aa, Homo Sapiens
TLRLRLRCC

SEQ ID NO: 435448 - protein, 9 aa, Homo Sapiens
DTVVFYDNY

SEQ ID NO: 435449 - protein, 9 aa, Homo Sapiens
KVEWFPDLA

SEQ ID NO: 435450 - protein, 9 aa, Homo Sapiens
LNLNSKLAY

SEQ ID NO: 435451 - protein, 9 aa, Homo Sapiens
PKDQIGVLG

SEQ ID NO: 435452 - protein, 9 aa, Homo Sapiens
KSLTYTGEK

SEQ ID NO: 435453 - protein, 9 aa, Homo Sapiens
CDPLIVEMA

SEQ ID NO: 435454 - protein, 9 aa, Homo Sapiens
HRYIKPENI

SEQ ID NO: 435455 - protein, 9 aa, Homo Sapiens
MAKAGKVPL

SEQ ID NO: 435456 - protein, 9 aa, Homo Sapiens
NINHSNSDN

SEQ ID NO: 435457 - protein, 9 aa, Homo Sapiens
MPHNQFIKI

SEQ ID NO: 435458 - protein, 9 aa, Homo Sapiens
GYDKIVGLR

SEQ ID NO: 435459 - protein, 9 aa, Homo Sapiens
NEYTERYSD

SEQ ID NO: 435460 - protein, 9 aa, Homo Sapiens
ICNMSHTGS

SEQ ID NO: 435461 - protein, 9 aa, Homo Sapiens
GGVIDKQIT

SEQ ID NO: 435462 - protein, 9 aa, Homo Sapiens
GSHTLLNIR

SEQ ID NO: 435463 - protein, 9 aa, Homo Sapiens
ESGDMKYEI

SEQ ID NO: 435464 - protein, 9 aa, Homo Sapiens
KVINFEQAI

SEQ ID NO: 435465 - protein, 9 aa, Homo Sapiens
SLAVQGFLG

SEQ ID NO: 435466 - protein, 9 aa, Homo Sapiens
GSVDNQTYS

SEQ ID NO: 435467 - protein, 9 aa, Homo Sapiens
DQEGNQRHS

SEQ ID NO: 435468 - protein, 9 aa, Homo Sapiens
CKRVPWSIP

SEQ ID NO: 435469 - protein, 9 aa, Homo Sapiens
FDHSEVYGP

SEQ ID NO: 435470 - protein, 9 aa, Homo Sapiens
FGADMTKVF

SEQ ID NO: 435471 - protein, 9 aa, Homo Sapiens
CGANPWIKF

SEQ ID NO: 435472 - protein, 9 aa, Homo Sapiens
LHLAVPLGH

SEQ ID NO: 435473 - protein, 9 aa, Homo Sapiens
FRKLSSRSD

SEQ ID NO: 435474 - protein, 9 aa, Homo Sapiens
ALETDSTSA

SEQ ID NO: 435475 - protein, 9 aa, Homo Sapiens
LPRFYEAFV

SEQ ID NO: 435476 - protein, 9 aa, Homo Sapiens
PQPEFRAVF

SEQ ID NO: 435477 - protein, 9 aa, Homo Sapiens
KSSNFRRYK

SEQ ID NO: 435478 - protein, 9 aa, Homo Sapiens
VMDNLKSQP

SEQ ID NO: 435479 - protein, 9 aa, Homo Sapiens
NMAPTKNFS

SEQ ID NO: 435480 - protein, 9 aa, Homo Sapiens
KTFWKLAKI

SEQ ID NO: 435481 - protein, 9 aa, Homo Sapiens
PHRCELAAA

SEQ ID NO: 435482 - protein, 9 aa, Homo Sapiens
NGLFFSAVD

SEQ ID NO: 435483 - protein, 9 aa, Homo Sapiens
GTEIVAVHF

SEQ ID NO: 435484 - protein, 9 aa, Homo Sapiens
INHQIIHTG

SEQ ID NO: 435485 - protein, 9 aa, Homo Sapiens
SAPSTLAGL

SEQ ID NO: 435486 - protein, 9 aa, Homo Sapiens
ECSNMFPKL

SEQ ID NO: 435487 - protein, 9 aa, Homo Sapiens
PYTLITILS

SEQ ID NO: 435488 - protein, 9 aa, Homo Sapiens
ANERKIINV

SEQ ID NO: 435489 - protein, 9 aa, Homo Sapiens
EESYNVNEY

SEQ ID NO: 435490 - protein, 9 aa, Homo Sapiens
ITFRNSNER

SEQ ID NO: 435491 - protein, 9 aa, Homo Sapiens
NNNLLHQQL

SEQ ID NO: 435492 - protein, 9 aa, Homo Sapiens
QTILGYHSA

SEQ ID NO: 435493 - protein, 9 aa, Homo Sapiens
DRKKGKKED

SEQ ID NO: 435494 - protein, 9 aa, Homo Sapiens
DPEYQWIDQ

SEQ ID NO: 435495 - protein, 9 aa, Homo Sapiens
PVKCNHIYQ

SEQ ID NO: 435496 - protein, 9 aa, Homo Sapiens
DGLRPDTRY

SEQ ID NO: 435497 - protein, 9 aa, Homo Sapiens
SDGVRGMYK

SEQ ID NO: 435498 - protein, 9 aa, Homo Sapiens
LGQVAININ

SEQ ID NO: 435499 - protein, 9 aa, Homo Sapiens
APMSSYVSI

SEQ ID NO: 435500 - protein, 9 aa, Homo Sapiens
LWDIAGARS

SEQ ID NO: 435501 - protein, 9 aa, Homo Sapiens
GILYEDNEK

SEQ ID NO: 435502 - protein, 9 aa, Homo Sapiens
KFANPSHYR

SEQ ID NO: 435503 - protein, 9 aa, Homo Sapiens
QNPRRPPPS

SEQ ID NO: 435504 - protein, 9 aa, Homo Sapiens
IFTQKIFTE

SEQ ID NO: 435505 - protein, 9 aa, Homo Sapiens
SGLSDHHEP

SEQ ID NO: 435506 - protein, 9 aa, Homo Sapiens
SMLKNDTKV

SEQ ID NO: 435507 - protein, 9 aa, Homo Sapiens
YNLFNNYKT

SEQ ID NO: 435508 - protein, 9 aa, Homo Sapiens
ELKQQYNDH

SEQ ID NO: 435509 - protein, 9 aa, Homo Sapiens
RLEKAIQSL

SEQ ID NO: 435510 - protein, 9 aa, Homo Sapiens
TCKTRRNSV

SEQ ID NO: 435511 - protein, 9 aa, Homo Sapiens
KRFEGINID

SEQ ID NO: 435512 - protein, 9 aa, Homo Sapiens
QKYFKITCG

SEQ ID NO: 435513 - protein, 9 aa, Homo Sapiens
LYALVQYAL

SEQ ID NO: 435514 - protein, 9 aa, Homo Sapiens
ESMLKNDTK

SEQ ID NO: 435515 - protein, 9 aa, Homo Sapiens
GIEFNATDV

SEQ ID NO: 435516 - protein, 9 aa, Homo Sapiens
ASRHWSASL

SEQ ID NO: 435517 - protein, 9 aa, Homo Sapiens
KDPNKDKQA

SEQ ID NO: 435518 - protein, 9 aa, Homo Sapiens
HPEDHKLNT

SEQ ID NO: 435519 - protein, 9 aa, Homo Sapiens
FVTGCDACS

SEQ ID NO: 435520 - protein, 9 aa, Homo Sapiens
LNNQAELYV

SEQ ID NO: 435521 - protein, 9 aa, Homo Sapiens
DRGISIPRA

SEQ ID NO: 435522 - protein, 9 aa, Homo Sapiens
HILAKIRRK

SEQ ID NO: 435523 - protein, 9 aa, Homo Sapiens
HYLDFSSKE

SEQ ID NO: 435524 - protein, 9 aa, Homo Sapiens
FFILAVMSY

SEQ ID NO: 435525 - protein, 9 aa, Homo Sapiens
DVTQNKVRK

SEQ ID NO: 435526 - protein, 9 aa, Homo Sapiens
LHMAACSGQ

SEQ ID NO: 435527 - protein, 9 aa, Homo Sapiens
VDCFVSHPT

SEQ ID NO: 435528 - protein, 9 aa, Homo Sapiens
LFKSGAASV

SEQ ID NO: 435529 - protein, 9 aa, Homo Sapiens
CYLFSTDTI

SEQ ID NO: 435530 - protein, 9 aa, Homo Sapiens
RCIWLQSNG

SEQ ID NO: 435531 - protein, 9 aa, Homo Sapiens
NSTDDCIEH

SEQ ID NO: 435532 - protein, 9 aa, Homo Sapiens
CMFTMLQEL

SEQ ID NO: 435533 - protein, 9 aa, Homo Sapiens
IIFIIKTEP

SEQ ID NO: 435534 - protein, 9 aa, Homo Sapiens
QRLFMIIWL

SEQ ID NO: 435535 - protein, 9 aa, Homo Sapiens
GCCGKVLVW

SEQ ID NO: 435536 - protein, 9 aa, Homo Sapiens
QIVTYFYNP

SEQ ID NO: 435537 - protein, 9 aa, Homo Sapiens
QLLKKFINI

SEQ ID NO: 435538 - protein, 9 aa, Homo Sapiens
FCVLQVLDW

SEQ ID NO: 435539 - protein, 9 aa, Homo Sapiens
NKIFEHKLL

SEQ ID NO: 435540 - protein, 9 aa, Homo Sapiens
QNKVRKTFV

SEQ ID NO: 435541 - protein, 9 aa, Homo Sapiens
LRELGSGLT

SEQ ID NO: 435542 - protein, 9 aa, Homo Sapiens
FFNQNKKKK

SEQ ID NO: 435543 - protein, 9 aa, Homo Sapiens
VLSSQEGRY

SEQ ID NO: 435544 - protein, 9 aa, Homo Sapiens
DEKDPNKDK

SEQ ID NO: 435545 - protein, 9 aa, Homo Sapiens
PHSIVDKVS

SEQ ID NO: 435546 - protein, 9 aa, Homo Sapiens
YKKTKKPAE

SEQ ID NO: 435547 - protein, 9 aa, Homo Sapiens
HLVFTDSLQ

SEQ ID NO: 435548 - protein, 9 aa, Homo Sapiens
AIRQLLSQK

SEQ ID NO: 435549 - protein, 9 aa, Homo Sapiens
AISILSKLR

SEQ ID NO: 435550 - protein, 9 aa, Homo Sapiens
EQEKINSRL

SEQ ID NO: 435551 - protein, 9 aa, Homo Sapiens
KKPPSRQNE

SEQ ID NO: 435552 - protein, 9 aa, Homo Sapiens
LCFLLGNVA

SEQ ID NO: 435553 - protein, 9 aa, Homo Sapiens
SVNYFISAQ

SEQ ID NO: 435554 - protein, 9 aa, Homo Sapiens
NFPQGMIFL

SEQ ID NO: 435555 - protein, 9 aa, Homo Sapiens
QAAGNYIES

SEQ ID NO: 435556 - protein, 9 aa, Homo Sapiens
YSIEQPSQL

SEQ ID NO: 435557 - protein, 9 aa, Homo Sapiens
TECGKVFSH

SEQ ID NO: 435558 - protein, 9 aa, Homo Sapiens
LGVIQLHFF

SEQ ID NO: 435559 - protein, 9 aa, Homo Sapiens
LRNKKDSRS

SEQ ID NO: 435560 - protein, 9 aa, Homo Sapiens
LKSALCLGV

SEQ ID NO: 435561 - protein, 9 aa, Homo Sapiens
VNEYSLRDQ

SEQ ID NO: 435562 - protein, 9 aa, Homo Sapiens
LLIQNSQET

SEQ ID NO: 435563 - protein, 9 aa, Homo Sapiens
QFSAENIFK

SEQ ID NO: 435564 - protein, 9 aa, Homo Sapiens
ATSTANFPT

SEQ ID NO: 435565 - protein, 9 aa, Homo Sapiens
AASQAGVQF

SEQ ID NO: 435566 - protein, 9 aa, Homo Sapiens
VVIIHMLTQ

SEQ ID NO: 435567 - protein, 9 aa, Homo Sapiens
YIMGPNILQ

SEQ ID NO: 435568 - protein, 9 aa, Homo Sapiens
LAVWGDYGG

SEQ ID NO: 435569 - protein, 9 aa, Homo Sapiens
KFDLKLDLK

SEQ ID NO: 435570 - protein, 9 aa, Homo Sapiens
QHLQTVLRN

SEQ ID NO: 435571 - protein, 9 aa, Homo Sapiens
MDILINTQN

SEQ ID NO: 435572 - protein, 9 aa, Homo Sapiens
GHHYRCVAR

SEQ ID NO: 435573 - protein, 9 aa, Homo Sapiens
HGDGPRKRA

SEQ ID NO: 435574 - protein, 9 aa, Homo Sapiens
HDGINSLRI

SEQ ID NO: 435575 - protein, 9 aa, Homo Sapiens
TECIEGGTL

SEQ ID NO: 435576 - protein, 9 aa, Homo Sapiens
EKSEPKTPG

SEQ ID NO: 435577 - protein, 9 aa, Homo Sapiens
QQHKPEQGY

SEQ ID NO: 435578 - protein, 9 aa, Homo Sapiens
LATGGDVTQ

SEQ ID NO: 435579 - protein, 9 aa, Homo Sapiens
TQNIHLGVN

SEQ ID NO: 435580 - protein, 9 aa, Homo Sapiens
KPATETSMD

SEQ ID NO: 435581 - protein, 9 aa, Homo Sapiens
HLYAQMYAH

SEQ ID NO: 435582 - protein, 9 aa, Homo Sapiens
YSESSGYNN

SEQ ID NO: 435583 - protein, 9 aa, Homo Sapiens
KMKATGFFM

SEQ ID NO: 435584 - protein, 9 aa, Homo Sapiens
FLHFKFENY

SEQ ID NO: 435585 - protein, 9 aa, Homo Sapiens
GMVFLASKN

SEQ ID NO: 435586 - protein, 9 aa, Homo Sapiens
DEDLDSVDA

SEQ ID NO: 435587 - protein, 9 aa, Homo Sapiens
GQIMGETPQ

SEQ ID NO: 435588 - protein, 9 aa, Homo Sapiens
LRRVWKKHP

SEQ ID NO: 435589 - protein, 9 aa, Homo Sapiens
FQFIIGKEN

SEQ ID NO: 435590 - protein, 9 aa, Homo Sapiens
FNQNKKKKK

SEQ ID NO: 435591 - protein, 9 aa, Homo Sapiens
ILYEDNEKE

SEQ ID NO: 435592 - protein, 9 aa, Homo Sapiens
NAMKKLFTW

SEQ ID NO: 435593 - protein, 9 aa, Homo Sapiens
FILVGYVDS

SEQ ID NO: 435594 - protein, 9 aa, Homo Sapiens
ACLIKCQNA

SEQ ID NO: 435595 - protein, 9 aa, Homo Sapiens
WALILKRNE

SEQ ID NO: 435596 - protein, 9 aa, Homo Sapiens
VSDILVAWK

SEQ ID NO: 435597 - protein, 9 aa, Homo Sapiens
RVQAEMPNQ

SEQ ID NO: 435598 - protein, 9 aa, Homo Sapiens
PPLLGTVST

SEQ ID NO: 435599 - protein, 9 aa, Homo Sapiens
ERLCLEEEA

SEQ ID NO: 435600 - protein, 9 aa, Homo Sapiens
QYSAMLGSK

SEQ ID NO: 435601 - protein, 9 aa, Homo Sapiens
AATEKLEVI

SEQ ID NO: 435602 - protein, 9 aa, Homo Sapiens
LSRDPSSPL

SEQ ID NO: 435603 - protein, 9 aa, Homo Sapiens
QDPIECLLS

SEQ ID NO: 435604 - protein, 9 aa, Homo Sapiens
FFHKGAKKP

SEQ ID NO: 435605 - protein, 9 aa, Homo Sapiens
NSHLIWHQK

SEQ ID NO: 435606 - protein, 9 aa, Homo Sapiens
WKGWSCSSG

SEQ ID NO: 435607 - protein, 9 aa, Homo Sapiens
LDNSCRKYL

SEQ ID NO: 435608 - protein, 9 aa, Homo Sapiens
QQSVPATIN

SEQ ID NO: 435609 - protein, 9 aa, Homo Sapiens
KYNVYRDHS

SEQ ID NO: 435610 - protein, 9 aa, Homo Sapiens
IPNSFGHIF

SEQ ID NO: 435611 - protein, 9 aa, Homo Sapiens
SALGDAKWQ

SEQ ID NO: 435612 - protein, 9 aa, Homo Sapiens
TLSANIQFN

SEQ ID NO: 435613 - protein, 9 aa, Homo Sapiens
LFIGTEIVA

SEQ ID NO: 435614 - protein, 9 aa, Homo Sapiens
SSSPCCGGA

SEQ ID NO: 435615 - protein, 9 aa, Homo Sapiens
AKIEKRKVE

SEQ ID NO: 435616 - protein, 9 aa, Homo Sapiens
SQKLENISP

SEQ ID NO: 435617 - protein, 9 aa, Homo Sapiens
LEIVLFAHN

SEQ ID NO: 435618 - protein, 9 aa, Homo Sapiens
TPPLLGTVS

SEQ ID NO: 435619 - protein, 9 aa, Homo Sapiens
TDFPNIFCE

SEQ ID NO: 435620 - protein, 9 aa, Homo Sapiens
VSSKCFLGQ

SEQ ID NO: 435621 - protein, 9 aa, Homo Sapiens
KFLTMMARK

SEQ ID NO: 435622 - protein, 9 aa, Homo Sapiens
DYVIQLVYV

SEQ ID NO: 435623 - protein, 9 aa, Homo Sapiens
LSYKVKPFL

SEQ ID NO: 435624 - protein, 9 aa, Homo Sapiens
TYFNIFHIC

SEQ ID NO: 435625 - protein, 9 aa, Homo Sapiens
ENECLEGVP

SEQ ID NO: 435626 - protein, 9 aa, Homo Sapiens
EKQMLKFSS

SEQ ID NO: 435627 - protein, 9 aa, Homo Sapiens
NQVNRKVIN

SEQ ID NO: 435628 - protein, 9 aa, Homo Sapiens
AKKLDYLLT

SEQ ID NO: 435629 - protein, 9 aa, Homo Sapiens
LIYPVTNLQ

SEQ ID NO: 435630 - protein, 9 aa, Homo Sapiens
AQQKENESS

SEQ ID NO: 435631 - protein, 9 aa, Homo Sapiens
CQYCAQRCG

SEQ ID NO: 435632 - protein, 9 aa, Homo Sapiens
TAKYLTEEI

SEQ ID NO: 435633 - protein, 9 aa, Homo Sapiens
IAQKGYEKK

SEQ ID NO: 435634 - protein, 9 aa, Homo Sapiens
RSPLPLFFA

SEQ ID NO: 435635 - protein, 9 aa, Homo Sapiens
TQRLPRTIG

SEQ ID NO: 435636 - protein, 9 aa, Homo Sapiens
LELFFDHCM

SEQ ID NO: 435637 - protein, 9 aa, Homo Sapiens
LKIQAESFC

SEQ ID NO: 435638 - protein, 9 aa, Homo Sapiens
GITASVSIL

SEQ ID NO: 435639 - protein, 9 aa, Homo Sapiens
NHYPNTHHC

SEQ ID NO: 435640 - protein, 9 aa, Homo Sapiens
FYTNVKFSI

SEQ ID NO: 435641 - protein, 9 aa, Homo Sapiens
RLQHEGIFR

SEQ ID NO: 435642 - protein, 9 aa, Homo Sapiens
LRVHPPRLW

SEQ ID NO: 435643 - protein, 9 aa, Homo Sapiens
GGLKESEKV

SEQ ID NO: 435644 - protein, 9 aa, Homo Sapiens
IDSAENCFK

SEQ ID NO: 435645 - protein, 9 aa, Homo Sapiens
WCSASAWLK

SEQ ID NO: 435646 - protein, 9 aa, Homo Sapiens
TLQDWGTPR

SEQ ID NO: 435647 - protein, 9 aa, Homo Sapiens
ESQETQISQ

SEQ ID NO: 435648 - protein, 9 aa, Homo Sapiens
GDLYSLLSK

SEQ ID NO: 435649 - protein, 9 aa, Homo Sapiens
SLPSLQAYS

SEQ ID NO: 435650 - protein, 9 aa, Homo Sapiens
VRNNRPQEL

SEQ ID NO: 435651 - protein, 9 aa, Homo Sapiens
SFLAQHQII

SEQ ID NO: 435652 - protein, 9 aa, Homo Sapiens
FQYILRTDN

SEQ ID NO: 435653 - protein, 9 aa, Homo Sapiens
SQVRMEWPT

SEQ ID NO: 435654 - protein, 9 aa, Homo Sapiens
VVNVNDNAP

SEQ ID NO: 435655 - protein, 9 aa, Homo Sapiens
VCRVFSSKR

SEQ ID NO: 435656 - protein, 9 aa, Homo Sapiens
LGRLLLRTT

SEQ ID NO: 435657 - protein, 9 aa, Homo Sapiens
PHLGQIMGE

SEQ ID NO: 435658 - protein, 9 aa, Homo Sapiens
QLGQAERAV

SEQ ID NO: 435659 - protein, 9 aa, Homo Sapiens
VRAHLLLII

SEQ ID NO: 435660 - protein, 9 aa, Homo Sapiens
WESEQVQWM

SEQ ID NO: 435661 - protein, 9 aa, Homo Sapiens
VRDYFKSLE

SEQ ID NO: 435662 - protein, 9 aa, Homo Sapiens
VRFQVDHVI

SEQ ID NO: 435663 - protein, 9 aa, Homo Sapiens
NRDKDLIWA

SEQ ID NO: 435664 - protein, 9 aa, Homo Sapiens
YRSCVTYMC

SEQ ID NO: 435665 - protein, 9 aa, Homo Sapiens
NGELMTHKL

SEQ ID NO: 435666 - protein, 9 aa, Homo Sapiens
NLREECIGF

SEQ ID NO: 435667 - protein, 9 aa, Homo Sapiens
TPDKKITFL

SEQ ID NO: 435668 - protein, 9 aa, Homo Sapiens
ADSTGSPIQ

SEQ ID NO: 435669 - protein, 9 aa, Homo Sapiens
QPRRKHSHR

SEQ ID NO: 435670 - protein, 9 aa, Homo Sapiens
KIEKRKVEL

SEQ ID NO: 435671 - protein, 9 aa, Homo Sapiens
HCPAEELKE

SEQ ID NO: 435672 - protein, 9 aa, Homo Sapiens
IVIPSAYFT

SEQ ID NO: 435673 - protein, 9 aa, Homo Sapiens
STQSDVSAN

SEQ ID NO: 435674 - protein, 9 aa, Homo Sapiens
VEIIGEQRH

SEQ ID NO: 435675 - protein, 9 aa, Homo Sapiens
ALVISLQHR

SEQ ID NO: 435676 - protein, 9 aa, Homo Sapiens
LEALKKAKG

SEQ ID NO: 435677 - protein, 9 aa, Homo Sapiens
DLNFFNQNK

SEQ ID NO: 435678 - protein, 9 aa, Homo Sapiens
KLWRSSSKC

SEQ ID NO: 435679 - protein, 9 aa, Homo Sapiens
REVNLPKVT

SEQ ID NO: 435680 - protein, 9 aa, Homo Sapiens
ALTIHKIIH

SEQ ID NO: 435681 - protein, 9 aa, Homo Sapiens
TYKLEERDE

SEQ ID NO: 435682 - protein, 9 aa, Homo Sapiens
FKLFQKDRK

SEQ ID NO: 435683 - protein, 9 aa, Homo Sapiens
STSINFNII

SEQ ID NO: 435684 - protein, 9 aa, Homo Sapiens
VKTAWGRQR

SEQ ID NO: 435685 - protein, 9 aa, Homo Sapiens
NDNAPELPR

SEQ ID NO: 435686 - protein, 9 aa, Homo Sapiens
SMLYSVLYA

SEQ ID NO: 435687 - protein, 9 aa, Homo Sapiens
VRFTSLFDA

SEQ ID NO: 435688 - protein, 9 aa, Homo Sapiens
LCKVYLVEA

SEQ ID NO: 435689 - protein, 9 aa, Homo Sapiens
TFQFIIGKE

SEQ ID NO: 435690 - protein, 9 aa, Homo Sapiens
VVHKWCHEL

SEQ ID NO: 435691 - protein, 9 aa, Homo Sapiens
RDEAWSTLL

SEQ ID NO: 435692 - protein, 9 aa, Homo Sapiens
LTAPWSAAL

SEQ ID NO: 435693 - protein, 9 aa, Homo Sapiens
KDILSLYEV

SEQ ID NO: 435694 - protein, 9 aa, Homo Sapiens
PAVMAQITK

SEQ ID NO: 435695 - protein, 9 aa, Homo Sapiens
LTGPDRCKM

SEQ ID NO: 435696 - protein, 9 aa, Homo Sapiens
AILSISNNL

SEQ ID NO: 435697 - protein, 9 aa, Homo Sapiens
QWIDQIRTP

SEQ ID NO: 435698 - protein, 9 aa, Homo Sapiens
TVQKCIDHL

SEQ ID NO: 435699 - protein, 9 aa, Homo Sapiens
CPVECEKCA

SEQ ID NO: 435700 - protein, 9 aa, Homo Sapiens
AGFINTTFL

SEQ ID NO: 435701 - protein, 9 aa, Homo Sapiens
TNVDGCKVH

SEQ ID NO: 435702 - protein, 9 aa, Homo Sapiens
SSISPILIS

SEQ ID NO: 435703 - protein, 9 aa, Homo Sapiens
YPSFTYYCS

SEQ ID NO: 435704 - protein, 9 aa, Homo Sapiens
VKKNYVVQG

SEQ ID NO: 435705 - protein, 9 aa, Homo Sapiens
KPGHTPIFC

SEQ ID NO: 435706 - protein, 9 aa, Homo Sapiens
GLSYKVKPF

SEQ ID NO: 435707 - protein, 9 aa, Homo Sapiens
LSCLSLLIT

SEQ ID NO: 435708 - protein, 9 aa, Homo Sapiens
YSPAGSKDH

SEQ ID NO: 435709 - protein, 9 aa, Homo Sapiens
QMCTNKYKE

SEQ ID NO: 435710 - protein, 9 aa, Homo Sapiens
AEEERICME

SEQ ID NO: 435711 - protein, 9 aa, Homo Sapiens
ITKNKLSNN

SEQ ID NO: 435712 - protein, 9 aa, Homo Sapiens
LPDEKISLI

SEQ ID NO: 435713 - protein, 9 aa, Homo Sapiens
CLKIFLNDS

SEQ ID NO: 435714 - protein, 9 aa, Homo Sapiens
MLLGFQLNP

SEQ ID NO: 435715 - protein, 9 aa, Homo Sapiens
IISKGGLIK

SEQ ID NO: 435716 - protein, 9 aa, Homo Sapiens
GIDYHSRMN

SEQ ID NO: 435717 - protein, 9 aa, Homo Sapiens
WKTFLFSAT

SEQ ID NO: 435718 - protein, 9 aa, Homo Sapiens
SSCYLFSTD

SEQ ID NO: 435719 - protein, 9 aa, Homo Sapiens
SCSVIPGKA

SEQ ID NO: 435720 - protein, 9 aa, Homo Sapiens
THRRETLCL

SEQ ID NO: 435721 - protein, 9 aa, Homo Sapiens
GYIIQTREI

SEQ ID NO: 435722 - protein, 9 aa, Homo Sapiens
RRYSDFTKL

SEQ ID NO: 435723 - protein, 9 aa, Homo Sapiens
APNMPLIER

SEQ ID NO: 435724 - protein, 9 aa, Homo Sapiens
NLQRHVCNI

SEQ ID NO: 435725 - protein, 9 aa, Homo Sapiens
PYVDEEGDL

SEQ ID NO: 435726 - protein, 9 aa, Homo Sapiens
FCPAEITGP

SEQ ID NO: 435727 - protein, 9 aa, Homo Sapiens
PRDTPEYVK

SEQ ID NO: 435728 - protein, 9 aa, Homo Sapiens
IDNFTSVSC

SEQ ID NO: 435729 - protein, 9 aa, Homo Sapiens
YQQPQIMDE

SEQ ID NO: 435730 - protein, 9 aa, Homo Sapiens
QTKTIQVSY

SEQ ID NO: 435731 - protein, 9 aa, Homo Sapiens
PAPGVNKSP

SEQ ID NO: 435732 - protein, 9 aa, Homo Sapiens
VQLEQELQD

SEQ ID NO: 435733 - protein, 9 aa, Homo Sapiens
NTTPDFIIL

SEQ ID NO: 435734 - protein, 9 aa, Homo Sapiens
QDSKLFENK

SEQ ID NO: 435735 - protein, 9 aa, Homo Sapiens
LQRHVCNIH

SEQ ID NO: 435736 - protein, 9 aa, Homo Sapiens
PAASALIQT

SEQ ID NO: 435737 - protein, 9 aa, Homo Sapiens
ELLQGTRAR

SEQ ID NO: 435738 - protein, 9 aa, Homo Sapiens
EADREMGSS

SEQ ID NO: 435739 - protein, 9 aa, Homo Sapiens
IVNINLSMN

SEQ ID NO: 435740 - protein, 9 aa, Homo Sapiens
VQMFISFVM

SEQ ID NO: 435741 - protein, 9 aa, Homo Sapiens
QKILCTKAD

SEQ ID NO: 435742 - protein, 9 aa, Homo Sapiens
HIGLFDKNY

SEQ ID NO: 435743 - protein, 9 aa, Homo Sapiens
EELVGKPDF

SEQ ID NO: 435744 - protein, 9 aa, Homo Sapiens
DRSLFEKKR

SEQ ID NO: 435745 - protein, 9 aa, Homo Sapiens
SWMEPFGIA

SEQ ID NO: 435746 - protein, 9 aa, Homo Sapiens
HDFLKRINE

SEQ ID NO: 435747 - protein, 9 aa, Homo Sapiens
KLWRESWER

SEQ ID NO: 435748 - protein, 9 aa, Homo Sapiens
CLRVHPPRL

SEQ ID NO: 435749 - protein, 9 aa, Homo Sapiens
ETILWANNL

SEQ ID NO: 435750 - protein, 9 aa, Homo Sapiens
KKRKCEESV

SEQ ID NO: 435751 - protein, 9 aa, Homo Sapiens
WCFMNNISR

SEQ ID NO: 435752 - protein, 9 aa, Homo Sapiens
HHSYLYSHY

SEQ ID NO: 435753 - protein, 9 aa, Homo Sapiens
EAVRGSLNV

SEQ ID NO: 435754 - protein, 9 aa, Homo Sapiens
KCKECGRLL

SEQ ID NO: 435755 - protein, 9 aa, Homo Sapiens
YQLTQHQIF

SEQ ID NO: 435756 - protein, 9 aa, Homo Sapiens
EVESLQPPR

SEQ ID NO: 435757 - protein, 9 aa, Homo Sapiens
GARAREQVK

SEQ ID NO: 435758 - protein, 9 aa, Homo Sapiens
AVVSLCYSY

SEQ ID NO: 435759 - protein, 9 aa, Homo Sapiens
HSEVYGPMK

SEQ ID NO: 435760 - protein, 9 aa, Homo Sapiens
APNSKSSGK

SEQ ID NO: 435761 - protein, 9 aa, Homo Sapiens
ADLALAIYL

SEQ ID NO: 435762 - protein, 9 aa, Homo Sapiens
YTKPKTTCA

SEQ ID NO: 435763 - protein, 9 aa, Homo Sapiens
TRIAAQGLT

SEQ ID NO: 435764 - protein, 9 aa, Homo Sapiens
GYRKLSLKS

SEQ ID NO: 435765 - protein, 9 aa, Homo Sapiens
DLKLAFSEL

SEQ ID NO: 435766 - protein, 9 aa, Homo Sapiens
ESKCKSRAS

SEQ ID NO: 435767 - protein, 9 aa, Homo Sapiens
IPTKKPTIP

SEQ ID NO: 435768 - protein, 9 aa, Homo Sapiens
ELTSLNNTL

SEQ ID NO: 435769 - protein, 9 aa, Homo Sapiens
TSQPKSFDN

SEQ ID NO: 435770 - protein, 9 aa, Homo Sapiens
FCMQLAAII

SEQ ID NO: 435771 - protein, 9 aa, Homo Sapiens
FEFWASSVE

SEQ ID NO: 435772 - protein, 9 aa, Homo Sapiens
KTKVEDAIL

SEQ ID NO: 435773 - protein, 9 aa, Homo Sapiens
EPAAESPGW

SEQ ID NO: 435774 - protein, 9 aa, Homo Sapiens
EEFLATFFR

SEQ ID NO: 435775 - protein, 9 aa, Homo Sapiens
KHPDYVGDG

SEQ ID NO: 435776 - protein, 9 aa, Homo Sapiens
NDAAKKAKY

SEQ ID NO: 435777 - protein, 9 aa, Homo Sapiens
ENPVIRYKQ

SEQ ID NO: 435778 - protein, 9 aa, Homo Sapiens
CHKNSIKLF

SEQ ID NO: 435779 - protein, 9 aa, Homo Sapiens
LTLAVFSIV

SEQ ID NO: 435780 - protein, 9 aa, Homo Sapiens
QALGRPENI

SEQ ID NO: 435781 - protein, 9 aa, Homo Sapiens
QLEETMKDK

SEQ ID NO: 435782 - protein, 9 aa, Homo Sapiens
RDCQNPNTF

SEQ ID NO: 435783 - protein, 9 aa, Homo Sapiens
PKGTYGKVE

SEQ ID NO: 435784 - protein, 9 aa, Homo Sapiens
MQQGPKKFI

SEQ ID NO: 435785 - protein, 9 aa, Homo Sapiens
INSCGDGFC

SEQ ID NO: 435786 - protein, 9 aa, Homo Sapiens
SLPGIRGTI

SEQ ID NO: 435787 - protein, 9 aa, Homo Sapiens
RCTVCEGSA

SEQ ID NO: 435788 - protein, 9 aa, Homo Sapiens
VYGGNCFNC

SEQ ID NO: 435789 - protein, 9 aa, Homo Sapiens
IIRRTSTNR

SEQ ID NO: 435790 - protein, 9 aa, Homo Sapiens
ISHQDMSSL

SEQ ID NO: 435791 - protein, 9 aa, Homo Sapiens
LRPTVVHGV

SEQ ID NO: 435792 - protein, 9 aa, Homo Sapiens
PVVSDLYQS

SEQ ID NO: 435793 - protein, 9 aa, Homo Sapiens
KPDVLRYDT

SEQ ID NO: 435794 - protein, 9 aa, Homo Sapiens
AMYYVSPIA

SEQ ID NO: 435795 - protein, 9 aa, Homo Sapiens
STRTFFCHP

SEQ ID NO: 435796 - protein, 9 aa, Homo Sapiens
EILEPPEGQ

SEQ ID NO: 435797 - protein, 9 aa, Homo Sapiens
KDLQVELKQ

SEQ ID NO: 435798 - protein, 9 aa, Homo Sapiens
VIVCCSSSK

SEQ ID NO: 435799 - protein, 9 aa, Homo Sapiens
LNTLGLNPR

SEQ ID NO: 435800 - protein, 9 aa, Homo Sapiens
VIDERLDKR

SEQ ID NO: 435801 - protein, 9 aa, Homo Sapiens
YSSKFIKEF

SEQ ID NO: 435802 - protein, 9 aa, Homo Sapiens
ITKALQSNM

SEQ ID NO: 435803 - protein, 9 aa, Homo Sapiens
FLKYIFDFE

SEQ ID NO: 435804 - protein, 9 aa, Homo Sapiens
VFGYLPIYS

SEQ ID NO: 435805 - protein, 9 aa, Homo Sapiens
LYSWPWWMY

SEQ ID NO: 435806 - protein, 9 aa, Homo Sapiens
SGSAHKYSS

SEQ ID NO: 435807 - protein, 9 aa, Homo Sapiens
HPARGKLGS

SEQ ID NO: 435808 - protein, 9 aa, Homo Sapiens
SYRWLKNGS

SEQ ID NO: 435809 - protein, 9 aa, Homo Sapiens
REMRHHFQT

SEQ ID NO: 435810 - protein, 9 aa, Homo Sapiens
RRCAQHWAD

SEQ ID NO: 435811 - protein, 9 aa, Homo Sapiens
EKIVLNFTP

SEQ ID NO: 435812 - protein, 9 aa, Homo Sapiens
YEAACSKCF

SEQ ID NO: 435813 - protein, 9 aa, Homo Sapiens
CAILCCFLV

SEQ ID NO: 435814 - protein, 9 aa, Homo Sapiens
DRYVNDPMP

SEQ ID NO: 435815 - protein, 9 aa, Homo Sapiens
ENTNRVTLN

SEQ ID NO: 435816 - protein, 9 aa, Homo Sapiens
KILLFHHDM

SEQ ID NO: 435817 - protein, 9 aa, Homo Sapiens
VKFSIKKEA

SEQ ID NO: 435818 - protein, 9 aa, Homo Sapiens
KNVEVKTKN

SEQ ID NO: 435819 - protein, 9 aa, Homo Sapiens
SAVEGMPSK

SEQ ID NO: 435820 - protein, 9 aa, Homo Sapiens
PMCKIIIGL

SEQ ID NO: 435821 - protein, 9 aa, Homo Sapiens
PHLSLPLRY

SEQ ID NO: 435822 - protein, 9 aa, Homo Sapiens
EFIESCQED

SEQ ID NO: 435823 - protein, 9 aa, Homo Sapiens
EQEHAAIQN

SEQ ID NO: 435824 - protein, 9 aa, Homo Sapiens
YGSTRNCTL

SEQ ID NO: 435825 - protein, 9 aa, Homo Sapiens
PQLLGMYRL

SEQ ID NO: 435826 - protein, 9 aa, Homo Sapiens
DEETLKANK

SEQ ID NO: 435827 - protein, 9 aa, Homo Sapiens
VTDNTYLCW

SEQ ID NO: 435828 - protein, 9 aa, Homo Sapiens
IDSLRQTGV

SEQ ID NO: 435829 - protein, 9 aa, Homo Sapiens
DIAQKGYEK

SEQ ID NO: 435830 - protein, 9 aa, Homo Sapiens
FKRLISAFK

SEQ ID NO: 435831 - protein, 9 aa, Homo Sapiens
MANAKEIAQ

SEQ ID NO: 435832 - protein, 9 aa, Homo Sapiens
HADNFLQQF

SEQ ID NO: 435833 - protein, 9 aa, Homo Sapiens
YVLRVITRL

SEQ ID NO: 435834 - protein, 9 aa, Homo Sapiens
SEDGFLLAV

SEQ ID NO: 435835 - protein, 9 aa, Homo Sapiens
TNYADLVLN

SEQ ID NO: 435836 - protein, 9 aa, Homo Sapiens
QRRCTSSLP

SEQ ID NO: 435837 - protein, 9 aa, Homo Sapiens
QEEWGKLDS

SEQ ID NO: 435838 - protein, 9 aa, Homo Sapiens
ISCQARQTL

SEQ ID NO: 435839 - protein, 9 aa, Homo Sapiens
SKKGPRVDP

SEQ ID NO: 435840 - protein, 9 aa, Homo Sapiens
DTGTCHICK

SEQ ID NO: 435841 - protein, 9 aa, Homo Sapiens
HHKNKDRLV

SEQ ID NO: 435842 - protein, 9 aa, Homo Sapiens
REQVKTVRF

SEQ ID NO: 435843 - protein, 9 aa, Homo Sapiens
IVLAKNRRQ

SEQ ID NO: 435844 - protein, 9 aa, Homo Sapiens
MPLRLGIKR

SEQ ID NO: 435845 - protein, 9 aa, Homo Sapiens
IPPVLNPIV

SEQ ID NO: 435846 - protein, 9 aa, Homo Sapiens
TRQLRSQVL

SEQ ID NO: 435847 - protein, 9 aa, Homo Sapiens
LGLYFNEFT

SEQ ID NO: 435848 - protein, 9 aa, Homo Sapiens
QDVYNFLAT

SEQ ID NO: 435849 - protein, 9 aa, Homo Sapiens
QAVENTSED

SEQ ID NO: 435850 - protein, 9 aa, Homo Sapiens
DKREKSNFQ

SEQ ID NO: 435851 - protein, 9 aa, Homo Sapiens
ENVERLAED

SEQ ID NO: 435852 - protein, 9 aa, Homo Sapiens
VTFECEQKK

SEQ ID NO: 435853 - protein, 9 aa, Homo Sapiens
AKITQQEYY

SEQ ID NO: 435854 - protein, 9 aa, Homo Sapiens
KSQKIHLTV

SEQ ID NO: 435855 - protein, 9 aa, Homo Sapiens
CRELKNGNL

SEQ ID NO: 435856 - protein, 9 aa, Homo Sapiens
DVASLSVKL

SEQ ID NO: 435857 - protein, 9 aa, Homo Sapiens
DVNHLNTCK

SEQ ID NO: 435858 - protein, 9 aa, Homo Sapiens
QMNKIRPNR

SEQ ID NO: 435859 - protein, 9 aa, Homo Sapiens
ALNQERVIA

SEQ ID NO: 435860 - protein, 9 aa, Homo Sapiens
LQNFFFIFL

SEQ ID NO: 435861 - protein, 9 aa, Homo Sapiens
HLEQQQIEK

SEQ ID NO: 435862 - protein, 9 aa, Homo Sapiens
GNTFIARGI

SEQ ID NO: 435863 - protein, 9 aa, Homo Sapiens
LNIRGCEVV

SEQ ID NO: 435864 - protein, 9 aa, Homo Sapiens
DGNAKFDLK

SEQ ID NO: 435865 - protein, 9 aa, Homo Sapiens
SDEMNIHLW

SEQ ID NO: 435866 - protein, 9 aa, Homo Sapiens
LQMHSKFPP

SEQ ID NO: 435867 - protein, 9 aa, Homo Sapiens
DKLEIISLD

SEQ ID NO: 435868 - protein, 9 aa, Homo Sapiens
NMYHSQMRQ

SEQ ID NO: 435869 - protein, 9 aa, Homo Sapiens
PNIFCETSQ

SEQ ID NO: 435870 - protein, 9 aa, Homo Sapiens
DREETAWLS

SEQ ID NO: 435871 - protein, 9 aa, Homo Sapiens
RSTFHNMYH

SEQ ID NO: 435872 - protein, 9 aa, Homo Sapiens
HQIRKLDQI

SEQ ID NO: 435873 - protein, 9 aa, Homo Sapiens
YKELQKSDK

SEQ ID NO: 435874 - protein, 9 aa, Homo Sapiens
VQGFLGATG

SEQ ID NO: 435875 - protein, 9 aa, Homo Sapiens
QFIKIMIIF

SEQ ID NO: 435876 - protein, 9 aa, Homo Sapiens
QLEYDWLVP

SEQ ID NO: 435877 - protein, 9 aa, Homo Sapiens
QYIMGPNIL

SEQ ID NO: 435878 - protein, 9 aa, Homo Sapiens
SYYARHQKI

SEQ ID NO: 435879 - protein, 9 aa, Homo Sapiens
NPYGPQTPS

SEQ ID NO: 435880 - protein, 9 aa, Homo Sapiens
YHVIVPCRS

SEQ ID NO: 435881 - protein, 9 aa, Homo Sapiens
QLMLHFRCN

SEQ ID NO: 435882 - protein, 9 aa, Homo Sapiens
SASRCRSAY

SEQ ID NO: 435883 - protein, 9 aa, Homo Sapiens
GQHEAVNVI

SEQ ID NO: 435884 - protein, 9 aa, Homo Sapiens
PHSAEPGYL

SEQ ID NO: 435885 - protein, 9 aa, Homo Sapiens
NHLVYSLRN

SEQ ID NO: 435886 - protein, 9 aa, Homo Sapiens
MHHHHRHHH

SEQ ID NO: 435887 - protein, 9 aa, Homo Sapiens
VIDKQITNR

SEQ ID NO: 435888 - protein, 9 aa, Homo Sapiens
ASTPFQTIL

SEQ ID NO: 435889 - protein, 9 aa, Homo Sapiens
IYSSSISPI

SEQ ID NO: 435890 - protein, 9 aa, Homo Sapiens
DELYVLRAA

SEQ ID NO: 435891 - protein, 9 aa, Homo Sapiens
PHVANPQLQ

SEQ ID NO: 435892 - protein, 9 aa, Homo Sapiens
KEFIIRRTS

SEQ ID NO: 435893 - protein, 9 aa, Homo Sapiens
VNAEIVLHT

SEQ ID NO: 435894 - protein, 9 aa, Homo Sapiens
LQPSIICID

SEQ ID NO: 435895 - protein, 9 aa, Homo Sapiens
TTILIIFAV

SEQ ID NO: 435896 - protein, 9 aa, Homo Sapiens
IKLYRNVML

SEQ ID NO: 435897 - protein, 9 aa, Homo Sapiens
VSTMEILAV

SEQ ID NO: 435898 - protein, 9 aa, Homo Sapiens
EYFSTKYKV

SEQ ID NO: 435899 - protein, 9 aa, Homo Sapiens
CQLQGKVPF

SEQ ID NO: 435900 - protein, 9 aa, Homo Sapiens
NLYFMDAMN

SEQ ID NO: 435901 - protein, 9 aa, Homo Sapiens
TRIDKRVDC

SEQ ID NO: 435902 - protein, 9 aa, Homo Sapiens
QDEQENYSF

SEQ ID NO: 435903 - protein, 9 aa, Homo Sapiens
MSSNQPNLT

SEQ ID NO: 435904 - protein, 9 aa, Homo Sapiens
ESEPSFFAT

SEQ ID NO: 435905 - protein, 9 aa, Homo Sapiens
GGILTSTGC

SEQ ID NO: 435906 - protein, 9 aa, Homo Sapiens
WELEEAMAG

SEQ ID NO: 435907 - protein, 9 aa, Homo Sapiens
GFKHNKIQH

SEQ ID NO: 435908 - protein, 9 aa, Homo Sapiens
VRNTFHKAL

SEQ ID NO: 435909 - protein, 9 aa, Homo Sapiens
VASVLILVV

SEQ ID NO: 435910 - protein, 9 aa, Homo Sapiens
VEENKNLVY

SEQ ID NO: 435911 - protein, 9 aa, Homo Sapiens
FRRRLNLTQ

SEQ ID NO: 435912 - protein, 9 aa, Homo Sapiens
PSTLPINSP

SEQ ID NO: 435913 - protein, 9 aa, Homo Sapiens
TLDSEKPKK

SEQ ID NO: 435914 - protein, 9 aa, Homo Sapiens
PESTDEDLD

SEQ ID NO: 435915 - protein, 9 aa, Homo Sapiens
QFQVLVDNK

SEQ ID NO: 435916 - protein, 9 aa, Homo Sapiens
AEVYRAMNQ

SEQ ID NO: 435917 - protein, 9 aa, Homo Sapiens
RLFLVESSS

SEQ ID NO: 435918 - protein, 9 aa, Homo Sapiens
PALHLQTSK

SEQ ID NO: 435919 - protein, 9 aa, Homo Sapiens
PARKAVAMM

SEQ ID NO: 435920 - protein, 9 aa, Homo Sapiens
HLNRDIWKP

SEQ ID NO: 435921 - protein, 9 aa, Homo Sapiens
AVVVTSAAS

SEQ ID NO: 435922 - protein, 9 aa, Homo Sapiens
RTQLKELKL

SEQ ID NO: 435923 - protein, 9 aa, Homo Sapiens
ANTQTPVEY

SEQ ID NO: 435924 - protein, 9 aa, Homo Sapiens
KLEGCTRSK

SEQ ID NO: 435925 - protein, 9 aa, Homo Sapiens
ETVCMAAIK

SEQ ID NO: 435926 - protein, 9 aa, Homo Sapiens
LGSTEFFIL

SEQ ID NO: 435927 - protein, 9 aa, Homo Sapiens
KPISKDARS

SEQ ID NO: 435928 - protein, 9 aa, Homo Sapiens
TEPESYLDL

SEQ ID NO: 435929 - protein, 9 aa, Homo Sapiens
NNTDVCLIG

SEQ ID NO: 435930 - protein, 9 aa, Homo Sapiens
IGVTELSAY

SEQ ID NO: 435931 - protein, 9 aa, Homo Sapiens
LFQKDRKMA

SEQ ID NO: 435932 - protein, 9 aa, Homo Sapiens
DAAKKAKYL

SEQ ID NO: 435933 - protein, 9 aa, Homo Sapiens
YIRPGVKQA

SEQ ID NO: 435934 - protein, 9 aa, Homo Sapiens
EELQMEVIN

SEQ ID NO: 435935 - protein, 9 aa, Homo Sapiens
ILLGFPTHP

SEQ ID NO: 435936 - protein, 9 aa, Homo Sapiens
EGSGCLVRR

SEQ ID NO: 435937 - protein, 9 aa, Homo Sapiens
YIFDFEKVR

SEQ ID NO: 435938 - protein, 9 aa, Homo Sapiens
GNQRHSSLI

SEQ ID NO: 435939 - protein, 9 aa, Homo Sapiens
DLKATLTSR

SEQ ID NO: 435940 - protein, 9 aa, Homo Sapiens
KVRAMGKNP

SEQ ID NO: 435941 - protein, 9 aa, Homo Sapiens
VCHTLATRI

SEQ ID NO: 435942 - protein, 9 aa, Homo Sapiens
PTSWQTDIP

SEQ ID NO: 435943 - protein, 9 aa, Homo Sapiens
FNKMKKWEG

SEQ ID NO: 435944 - protein, 9 aa, Homo Sapiens
MRFKPDKDL

SEQ ID NO: 435945 - protein, 9 aa, Homo Sapiens
LLLRKDTSV

SEQ ID NO: 435946 - protein, 9 aa, Homo Sapiens
DQTPSDNPS

SEQ ID NO: 435947 - protein, 9 aa, Homo Sapiens
CTYSPALNT

SEQ ID NO: 435948 - protein, 9 aa, Homo Sapiens
CALLNILES

SEQ ID NO: 435949 - protein, 9 aa, Homo Sapiens
AGSYTCTCG

SEQ ID NO: 435950 - protein, 9 aa, Homo Sapiens
DLCLWCFMN

SEQ ID NO: 435951 - protein, 9 aa, Homo Sapiens
FMPKTVVID

SEQ ID NO: 435952 - protein, 9 aa, Homo Sapiens
LKHGKARTD

SEQ ID NO: 435953 - protein, 9 aa, Homo Sapiens
VCRRWNEVC

SEQ ID NO: 435954 - protein, 9 aa, Homo Sapiens
IIQLFMLQT

SEQ ID NO: 435955 - protein, 9 aa, Homo Sapiens
LIVIPSAYF

SEQ ID NO: 435956 - protein, 9 aa, Homo Sapiens
PYDVRTILL

SEQ ID NO: 435957 - protein, 9 aa, Homo Sapiens
LQGKVPFKI

SEQ ID NO: 435958 - protein, 9 aa, Homo Sapiens
HAPGSTDAF

SEQ ID NO: 435959 - protein, 9 aa, Homo Sapiens
GFQLCCYGY

SEQ ID NO: 435960 - protein, 9 aa, Homo Sapiens
RVHVICKDC

SEQ ID NO: 435961 - protein, 9 aa, Homo Sapiens
ISTFKSYYV

SEQ ID NO: 435962 - protein, 9 aa, Homo Sapiens
KELWKLVHE

SEQ ID NO: 435963 - protein, 9 aa, Homo Sapiens
DTYYPEADH

SEQ ID NO: 435964 - protein, 9 aa, Homo Sapiens
ITMENFNNF

SEQ ID NO: 435965 - protein, 9 aa, Homo Sapiens
KNYTDNEVE

SEQ ID NO: 435966 - protein, 9 aa, Homo Sapiens
YDAKYLSGI

SEQ ID NO: 435967 - protein, 9 aa, Homo Sapiens
LLNRIYYKV

SEQ ID NO: 435968 - protein, 9 aa, Homo Sapiens
NKADNWKRY

SEQ ID NO: 435969 - protein, 9 aa, Homo Sapiens
CFLLLDVAM

SEQ ID NO: 435970 - protein, 9 aa, Homo Sapiens
GQEWKFVGG

SEQ ID NO: 435971 - protein, 9 aa, Homo Sapiens
APTKNFSLP

SEQ ID NO: 435972 - protein, 9 aa, Homo Sapiens
NIKLSNEQG

SEQ ID NO: 435973 - protein, 9 aa, Homo Sapiens
IMDWEECSN

SEQ ID NO: 435974 - protein, 9 aa, Homo Sapiens
PAAHAEFAP

SEQ ID NO: 435975 - protein, 9 aa, Homo Sapiens
MKATGFFMG

SEQ ID NO: 435976 - protein, 9 aa, Homo Sapiens
KCLRLECPI

SEQ ID NO: 435977 - protein, 9 aa, Homo Sapiens
TPCAPLAKC

SEQ ID NO: 435978 - protein, 9 aa, Homo Sapiens
KLIEQMVRT

SEQ ID NO: 435979 - protein, 9 aa, Homo Sapiens
CEERDVLVN

SEQ ID NO: 435980 - protein, 9 aa, Homo Sapiens
ARQFFVFND

SEQ ID NO: 435981 - protein, 9 aa, Homo Sapiens
VDTGYCYSN

SEQ ID NO: 435982 - protein, 9 aa, Homo Sapiens
ELFCRCHRP

SEQ ID NO: 435983 - protein, 9 aa, Homo Sapiens
DDPEDAVSV

SEQ ID NO: 435984 - protein, 9 aa, Homo Sapiens
VPCRSCLLS

SEQ ID NO: 435985 - protein, 9 aa, Homo Sapiens
PRRGDVANA

SEQ ID NO: 435986 - protein, 9 aa, Homo Sapiens
IIPTRKPNT

SEQ ID NO: 435987 - protein, 9 aa, Homo Sapiens
TIQYVVQAA

SEQ ID NO: 435988 - protein, 9 aa, Homo Sapiens
TIYNNMLCA

SEQ ID NO: 435989 - protein, 9 aa, Homo Sapiens
TNPEDCSDS

SEQ ID NO: 435990 - protein, 9 aa, Homo Sapiens
LETKLQVLK

SEQ ID NO: 435991 - protein, 9 aa, Homo Sapiens
HFIMEYLFC

SEQ ID NO: 435992 - protein, 9 aa, Homo Sapiens
AAIQADLEL

SEQ ID NO: 435993 - protein, 9 aa, Homo Sapiens
ISNIGIIIR

SEQ ID NO: 435994 - protein, 9 aa, Homo Sapiens
AVCRARHRL

SEQ ID NO: 435995 - protein, 9 aa, Homo Sapiens
AYHKESDIE

SEQ ID NO: 435996 - protein, 9 aa, Homo Sapiens
QGVSDERIH

SEQ ID NO: 435997 - protein, 9 aa, Homo Sapiens
KLSWIEKKW

SEQ ID NO: 435998 - protein, 9 aa, Homo Sapiens
HNYLEILKE

SEQ ID NO: 435999 - protein, 9 aa, Homo Sapiens
DFCRYSTDI

SEQ ID NO: 436000 - protein, 9 aa, Homo Sapiens
GTVEFLVEL

SEQ ID NO: 436001 - protein, 9 aa, Homo Sapiens
RFTSVGTGN

SEQ ID NO: 436002 - protein, 9 aa, Homo Sapiens
PLGRIAIKQ

SEQ ID NO: 436003 - protein, 9 aa, Homo Sapiens
FITLFSVIN

SEQ ID NO: 436004 - protein, 9 aa, Homo Sapiens
CFQFGAYLI

SEQ ID NO: 436005 - protein, 9 aa, Homo Sapiens
LHNKCLEKK

SEQ ID NO: 436006 - protein, 9 aa, Homo Sapiens
PSMMTPPLL

SEQ ID NO: 436007 - protein, 9 aa, Homo Sapiens
PVFRTDRNC

SEQ ID NO: 436008 - protein, 9 aa, Homo Sapiens
GVVLHDNKH

SEQ ID NO: 436009 - protein, 9 aa, Homo Sapiens
TCVVHKWCH

SEQ ID NO: 436010 - protein, 9 aa, Homo Sapiens
CGEELWASA

SEQ ID NO: 436011 - protein, 9 aa, Homo Sapiens
SELLDLSSA

SEQ ID NO: 436012 - protein, 9 aa, Homo Sapiens
SGHQKVGAI

SEQ ID NO: 436013 - protein, 9 aa, Homo Sapiens
PVKGSGPHR

SEQ ID NO: 436014 - protein, 9 aa, Homo Sapiens
TYALCSHVD

SEQ ID NO: 436015 - protein, 9 aa, Homo Sapiens
NNQALTYWG

SEQ ID NO: 436016 - protein, 9 aa, Homo Sapiens
ALGLLKTLK

SEQ ID NO: 436017 - protein, 9 aa, Homo Sapiens
VTRHPFTPI

SEQ ID NO: 436018 - protein, 9 aa, Homo Sapiens
IPQRDQRVR

SEQ ID NO: 436019 - protein, 9 aa, Homo Sapiens
MFLTQVMAH

SEQ ID NO: 436020 - protein, 9 aa, Homo Sapiens
DRIWELEEA

SEQ ID NO: 436021 - protein, 9 aa, Homo Sapiens
AKQHNSLEW

SEQ ID NO: 436022 - protein, 9 aa, Homo Sapiens
INLHRLCIV

SEQ ID NO: 436023 - protein, 9 aa, Homo Sapiens
AAVAQKPQS

SEQ ID NO: 436024 - protein, 9 aa, Homo Sapiens
GNIKHTSKE

SEQ ID NO: 436025 - protein, 9 aa, Homo Sapiens
HANELTLMI

SEQ ID NO: 436026 - protein, 9 aa, Homo Sapiens
SGTTHKIIL

SEQ ID NO: 436027 - protein, 9 aa, Homo Sapiens
AQTFFKITA

SEQ ID NO: 436028 - protein, 9 aa, Homo Sapiens
PMINRTSDV

SEQ ID NO: 436029 - protein, 9 aa, Homo Sapiens
KKKMTKKFK

SEQ ID NO: 436030 - protein, 9 aa, Homo Sapiens
AMQLTSKIP

SEQ ID NO: 436031 - protein, 9 aa, Homo Sapiens
LNKEPLLNI

SEQ ID NO: 436032 - protein, 9 aa, Homo Sapiens
DSLTIYLVV

SEQ ID NO: 436033 - protein, 9 aa, Homo Sapiens
VCGPPVSCI

SEQ ID NO: 436034 - protein, 9 aa, Homo Sapiens
ALKHSKRRW

SEQ ID NO: 436035 - protein, 9 aa, Homo Sapiens
FNRPVFRTD

SEQ ID NO: 436036 - protein, 9 aa, Homo Sapiens
CSLQEGCCH

SEQ ID NO: 436037 - protein, 9 aa, Homo Sapiens
NMYGSTRNC

SEQ ID NO: 436038 - protein, 9 aa, Homo Sapiens
QYPKEAVRR

SEQ ID NO: 436039 - protein, 9 aa, Homo Sapiens
DCTVHLWDV

SEQ ID NO: 436040 - protein, 9 aa, Homo Sapiens
QLLKHKCWQ

SEQ ID NO: 436041 - protein, 9 aa, Homo Sapiens
TKNKLSNNV

SEQ ID NO: 436042 - protein, 9 aa, Homo Sapiens
ARVDTGYCY

SEQ ID NO: 436043 - protein, 9 aa, Homo Sapiens
QVVFTLGGT

SEQ ID NO: 436044 - protein, 9 aa, Homo Sapiens
LSLQQLVEA

SEQ ID NO: 436045 - protein, 9 aa, Homo Sapiens
LCQPPPCYL

SEQ ID NO: 436046 - protein, 9 aa, Homo Sapiens
AKEYLIARG

SEQ ID NO: 436047 - protein, 9 aa, Homo Sapiens
VNCQLQGKV

SEQ ID NO: 436048 - protein, 9 aa, Homo Sapiens
SLDKATAAI

SEQ ID NO: 436049 - protein, 9 aa, Homo Sapiens
IWRPLQIPL

SEQ ID NO: 436050 - protein, 9 aa, Homo Sapiens
FSGKLLQTH

SEQ ID NO: 436051 - protein, 9 aa, Homo Sapiens
NECYSGLKY

SEQ ID NO: 436052 - protein, 9 aa, Homo Sapiens
IKIYREYEL

SEQ ID NO: 436053 - protein, 9 aa, Homo Sapiens
DHEKAQKTG

SEQ ID NO: 436054 - protein, 9 aa, Homo Sapiens
DKETNINHS

SEQ ID NO: 436055 - protein, 9 aa, Homo Sapiens
TERKNRQAL

SEQ ID NO: 436056 - protein, 9 aa, Homo Sapiens
ERSDFLHFK

SEQ ID NO: 436057 - protein, 9 aa, Homo Sapiens
HGAVDVREG

SEQ ID NO: 436058 - protein, 9 aa, Homo Sapiens
LVNLLSYFV

SEQ ID NO: 436059 - protein, 9 aa, Homo Sapiens
VIESSVPCQ

SEQ ID NO: 436060 - protein, 9 aa, Homo Sapiens
ILSISNNLF

SEQ ID NO: 436061 - protein, 9 aa, Homo Sapiens
SYSPYGYGS

SEQ ID NO: 436062 - protein, 9 aa, Homo Sapiens
GVDLYHEHK

SEQ ID NO: 436063 - protein, 9 aa, Homo Sapiens
VYDNKKMLG

SEQ ID NO: 436064 - protein, 9 aa, Homo Sapiens
GHMSGMGMN

SEQ ID NO: 436065 - protein, 9 aa, Homo Sapiens
QEEEGRYLS

SEQ ID NO: 436066 - protein, 9 aa, Homo Sapiens
RSRFLRSVT

SEQ ID NO: 436067 - protein, 9 aa, Homo Sapiens
PEELEGPGS

SEQ ID NO: 436068 - protein, 9 aa, Homo Sapiens
HTAEKSYTC

SEQ ID NO: 436069 - protein, 9 aa, Homo Sapiens
TCQTVAACN

SEQ ID NO: 436070 - protein, 9 aa, Homo Sapiens
DTIVMDTLP

SEQ ID NO: 436071 - protein, 9 aa, Homo Sapiens
VTLNIHPST

SEQ ID NO: 436072 - protein, 9 aa, Homo Sapiens
KMFLTQVMA

SEQ ID NO: 436073 - protein, 9 aa, Homo Sapiens
VGGFICYPV

SEQ ID NO: 436074 - protein, 9 aa, Homo Sapiens
VLHQMIHTG

SEQ ID NO: 436075 - protein, 9 aa, Homo Sapiens
KKNYVVQGM

SEQ ID NO: 436076 - protein, 9 aa, Homo Sapiens
FFNRNRPSF

SEQ ID NO: 436077 - protein, 9 aa, Homo Sapiens
STNRNLSNN

SEQ ID NO: 436078 - protein, 9 aa, Homo Sapiens
QTACGFCLR

SEQ ID NO: 436079 - protein, 9 aa, Homo Sapiens
VGKKSLDLF

SEQ ID NO: 436080 - protein, 9 aa, Homo Sapiens
CQLLWAKTD

SEQ ID NO: 436081 - protein, 9 aa, Homo Sapiens
MLEKDILSL

SEQ ID NO: 436082 - protein, 9 aa, Homo Sapiens
FMPDEDECK

SEQ ID NO: 436083 - protein, 9 aa, Homo Sapiens
LMDMFDQDG

SEQ ID NO: 436084 - protein, 9 aa, Homo Sapiens
TCIWIHLDR

SEQ ID NO: 436085 - protein, 9 aa, Homo Sapiens
SWREMCLRL

SEQ ID NO: 436086 - protein, 9 aa, Homo Sapiens
EIKIQKQIQ

SEQ ID NO: 436087 - protein, 9 aa, Homo Sapiens
LQAWHAGQT

SEQ ID NO: 436088 - protein, 9 aa, Homo Sapiens
SPFNFFHHI

SEQ ID NO: 436089 - protein, 9 aa, Homo Sapiens
ISQTAQLST

SEQ ID NO: 436090 - protein, 9 aa, Homo Sapiens
GRMSGTVHS

SEQ ID NO: 436091 - protein, 9 aa, Homo Sapiens
LDILRRTDK

SEQ ID NO: 436092 - protein, 9 aa, Homo Sapiens
EQGKISEGL

SEQ ID NO: 436093 - protein, 9 aa, Homo Sapiens
WSPKDKYNC

SEQ ID NO: 436094 - protein, 9 aa, Homo Sapiens
LGRIAIKQF

SEQ ID NO: 436095 - protein, 9 aa, Homo Sapiens
SEEIKTIND

SEQ ID NO: 436096 - protein, 9 aa, Homo Sapiens
EHFFAVAIY

SEQ ID NO: 436097 - protein, 9 aa, Homo Sapiens
PKKVFFVDV

SEQ ID NO: 436098 - protein, 9 aa, Homo Sapiens
QTAQLSTQA

SEQ ID NO: 436099 - protein, 9 aa, Homo Sapiens
FPSLCVERM

SEQ ID NO: 436100 - protein, 9 aa, Homo Sapiens
IAYCENKCG

SEQ ID NO: 436101 - protein, 9 aa, Homo Sapiens
WTVSILIVI

SEQ ID NO: 436102 - protein, 9 aa, Homo Sapiens
LEDSIDPVD

SEQ ID NO: 436103 - protein, 9 aa, Homo Sapiens
RIRKFIISE

SEQ ID NO: 436104 - protein, 9 aa, Homo Sapiens
TLWERYTHR

SEQ ID NO: 436105 - protein, 9 aa, Homo Sapiens
KATSVSVSD

SEQ ID NO: 436106 - protein, 9 aa, Homo Sapiens
RSSASPGID

SEQ ID NO: 436107 - protein, 9 aa, Homo Sapiens
SPAKDEHNQ

SEQ ID NO: 436108 - protein, 9 aa, Homo Sapiens
RPLKDIAWW

SEQ ID NO: 436109 - protein, 9 aa, Homo Sapiens
VITNKDVQK

SEQ ID NO: 436110 - protein, 9 aa, Homo Sapiens
RVYKEVNNR

SEQ ID NO: 436111 - protein, 9 aa, Homo Sapiens
QHHLRKELR

SEQ ID NO: 436112 - protein, 9 aa, Homo Sapiens
LDPYKSILD

SEQ ID NO: 436113 - protein, 9 aa, Homo Sapiens
RFKASKSGS

SEQ ID NO: 436114 - protein, 9 aa, Homo Sapiens
ALWSLEYVV

SEQ ID NO: 436115 - protein, 9 aa, Homo Sapiens
WMTLSQKIC

SEQ ID NO: 436116 - protein, 9 aa, Homo Sapiens
PVRDECEEI

SEQ ID NO: 436117 - protein, 9 aa, Homo Sapiens
LKNYYQAFQ

SEQ ID NO: 436118 - protein, 9 aa, Homo Sapiens
EEFEKDNIK

SEQ ID NO: 436119 - protein, 9 aa, Homo Sapiens
GNNKAMAAV

SEQ ID NO: 436120 - protein, 9 aa, Homo Sapiens
CVLKPLSDR

SEQ ID NO: 436121 - protein, 9 aa, Homo Sapiens
GSYTCTCGP

SEQ ID NO: 436122 - protein, 9 aa, Homo Sapiens
NIDSQGRIC

SEQ ID NO: 436123 - protein, 9 aa, Homo Sapiens
SRRHLQLAV

SEQ ID NO: 436124 - protein, 9 aa, Homo Sapiens
KAHTEKQKE

SEQ ID NO: 436125 - protein, 9 aa, Homo Sapiens
SNRLESMSP

SEQ ID NO: 436126 - protein, 9 aa, Homo Sapiens
LSGPRLASA

SEQ ID NO: 436127 - protein, 9 aa, Homo Sapiens
SILPKHDME

SEQ ID NO: 436128 - protein, 9 aa, Homo Sapiens
SSFETIRLF

SEQ ID NO: 436129 - protein, 9 aa, Homo Sapiens
DDTLNSLDT

SEQ ID NO: 436130 - protein, 9 aa, Homo Sapiens
PNQDSDLVV

SEQ ID NO: 436131 - protein, 9 aa, Homo Sapiens
TPPPLSLPP

SEQ ID NO: 436132 - protein, 9 aa, Homo Sapiens
PKKKNKLVI

SEQ ID NO: 436133 - protein, 9 aa, Homo Sapiens
EMSDVGTCV

SEQ ID NO: 436134 - protein, 9 aa, Homo Sapiens
PGDLYNEDW

SEQ ID NO: 436135 - protein, 9 aa, Homo Sapiens
ETMDTGKPI

SEQ ID NO: 436136 - protein, 9 aa, Homo Sapiens
CVKAFSFKS

SEQ ID NO: 436137 - protein, 9 aa, Homo Sapiens
DNAPELPRF

SEQ ID NO: 436138 - protein, 9 aa, Homo Sapiens
CGRLLVRAH

SEQ ID NO: 436139 - protein, 9 aa, Homo Sapiens
RDGPFGLSP

SEQ ID NO: 436140 - protein, 9 aa, Homo Sapiens
PPSVVMGLA

SEQ ID NO: 436141 - protein, 9 aa, Homo Sapiens
PLELGVGLS

SEQ ID NO: 436142 - protein, 9 aa, Homo Sapiens
GEPVEGFNH

SEQ ID NO: 436143 - protein, 9 aa, Homo Sapiens
GDLYNEDWD

SEQ ID NO: 436144 - protein, 9 aa, Homo Sapiens
EALLLLEGI

SEQ ID NO: 436145 - protein, 9 aa, Homo Sapiens
QLLDGPYPK

SEQ ID NO: 436146 - protein, 9 aa, Homo Sapiens
EIKINYLNQ

SEQ ID NO: 436147 - protein, 9 aa, Homo Sapiens
NPHCFKITT

SEQ ID NO: 436148 - protein, 9 aa, Homo Sapiens
VELERNRKR

SEQ ID NO: 436149 - protein, 9 aa, Homo Sapiens
NEAEKLLCL

SEQ ID NO: 436150 - protein, 9 aa, Homo Sapiens
CTVCEGSAI

SEQ ID NO: 436151 - protein, 9 aa, Homo Sapiens
QLDKVRRKK

SEQ ID NO: 436152 - protein, 9 aa, Homo Sapiens
IIRHLDECP

SEQ ID NO: 436153 - protein, 9 aa, Homo Sapiens
PEDCGQAET

SEQ ID NO: 436154 - protein, 9 aa, Homo Sapiens
ALRKIRRYQ

SEQ ID NO: 436155 - protein, 9 aa, Homo Sapiens
NKQNWQEFV

SEQ ID NO: 436156 - protein, 9 aa, Homo Sapiens
MIVDCKNKT

SEQ ID NO: 436157 - protein, 9 aa, Homo Sapiens
LEAFDYFFP

SEQ ID NO: 436158 - protein, 9 aa, Homo Sapiens
KQFQVLVDN

SEQ ID NO: 436159 - protein, 9 aa, Homo Sapiens
QAASQAGVQ

SEQ ID NO: 436160 - protein, 9 aa, Homo Sapiens
HSQTVSRNF

SEQ ID NO: 436161 - protein, 9 aa, Homo Sapiens
NYVASISTC

SEQ ID NO: 436162 - protein, 9 aa, Homo Sapiens
TTTPWTRPS

SEQ ID NO: 436163 - protein, 9 aa, Homo Sapiens
KIIIGLYFV

SEQ ID NO: 436164 - protein, 9 aa, Homo Sapiens
QSFKVMDYS

SEQ ID NO: 436165 - protein, 9 aa, Homo Sapiens
GNTDNYILA

SEQ ID NO: 436166 - protein, 9 aa, Homo Sapiens
VQYTLSSLP

SEQ ID NO: 436167 - protein, 9 aa, Homo Sapiens
IHDLLGSQA

SEQ ID NO: 436168 - protein, 9 aa, Homo Sapiens
LFGGTEIFL

SEQ ID NO: 436169 - protein, 9 aa, Homo Sapiens
CFCVLLAIF

SEQ ID NO: 436170 - protein, 9 aa, Homo Sapiens
LYDPPPKKK

SEQ ID NO: 436171 - protein, 9 aa, Homo Sapiens
SIYIRIHEI

SEQ ID NO: 436172 - protein, 9 aa, Homo Sapiens
GRPIIWGLA

SEQ ID NO: 436173 - protein, 9 aa, Homo Sapiens
TKGKILCLF

SEQ ID NO: 436174 - protein, 9 aa, Homo Sapiens
KFHLVVHQI

SEQ ID NO: 436175 - protein, 9 aa, Homo Sapiens
WRDVTRRKM

SEQ ID NO: 436176 - protein, 9 aa, Homo Sapiens
ITLFVKVQL

SEQ ID NO: 436177 - protein, 9 aa, Homo Sapiens
LGCLRIYYE

SEQ ID NO: 436178 - protein, 9 aa, Homo Sapiens
RNTFCHSSA

SEQ ID NO: 436179 - protein, 9 aa, Homo Sapiens
KQLLHSPLF

SEQ ID NO: 436180 - protein, 9 aa, Homo Sapiens
LARDNELSG

SEQ ID NO: 436181 - protein, 9 aa, Homo Sapiens
IQLVNTHNL

SEQ ID NO: 436182 - protein, 9 aa, Homo Sapiens
DYFKSLETI

SEQ ID NO: 436183 - protein, 9 aa, Homo Sapiens
PICINSCGD

SEQ ID NO: 436184 - protein, 9 aa, Homo Sapiens
QSLPSLQAY

SEQ ID NO: 436185 - protein, 9 aa, Homo Sapiens
EMLKSTMKK

SEQ ID NO: 436186 - protein, 9 aa, Homo Sapiens
KHWPGFLRE

SEQ ID NO: 436187 - protein, 9 aa, Homo Sapiens
SYQTAKFHS

SEQ ID NO: 436188 - protein, 9 aa, Homo Sapiens
VYLGSSELR

SEQ ID NO: 436189 - protein, 9 aa, Homo Sapiens
HQIVTYFYN

SEQ ID NO: 436190 - protein, 9 aa, Homo Sapiens
VYSCDKNTG

SEQ ID NO: 436191 - protein, 9 aa, Homo Sapiens
DQILDMVNG

SEQ ID NO: 436192 - protein, 9 aa, Homo Sapiens
VCLIGEKLF

SEQ ID NO: 436193 - protein, 9 aa, Homo Sapiens
RDKLIKEMD

SEQ ID NO: 436194 - protein, 9 aa, Homo Sapiens
GTGQSHNNV

SEQ ID NO: 436195 - protein, 9 aa, Homo Sapiens
ICQNKEQEP

SEQ ID NO: 436196 - protein, 9 aa, Homo Sapiens
YDPGQCAGL

SEQ ID NO: 436197 - protein, 9 aa, Homo Sapiens
QKFIIFKIA

SEQ ID NO: 436198 - protein, 9 aa, Homo Sapiens
LSNILKMTY

SEQ ID NO: 436199 - protein, 9 aa, Homo Sapiens
RAPGHMSGM

SEQ ID NO: 436200 - protein, 9 aa, Homo Sapiens
LAHTIGRKP

SEQ ID NO: 436201 - protein, 9 aa, Homo Sapiens
GRHFDFMGT

SEQ ID NO: 436202 - protein, 9 aa, Homo Sapiens
NNYGNNPLT

SEQ ID NO: 436203 - protein, 9 aa, Homo Sapiens
QAMKDALDL

SEQ ID NO: 436204 - protein, 9 aa, Homo Sapiens
CAACRTYAT

SEQ ID NO: 436205 - protein, 9 aa, Homo Sapiens
FQCKESMLK

SEQ ID NO: 436206 - protein, 9 aa, Homo Sapiens
HLAVPLGHL

SEQ ID NO: 436207 - protein, 9 aa, Homo Sapiens
FFVRLTDEL

SEQ ID NO: 436208 - protein, 9 aa, Homo Sapiens
IYVVDMSTR

SEQ ID NO: 436209 - protein, 9 aa, Homo Sapiens
KDFANHFPA

SEQ ID NO: 436210 - protein, 9 aa, Homo Sapiens
TLARYAARR

SEQ ID NO: 436211 - protein, 9 aa, Homo Sapiens
DFQLRDTYM

SEQ ID NO: 436212 - protein, 9 aa, Homo Sapiens
HTPNLSTKT

SEQ ID NO: 436213 - protein, 9 aa, Homo Sapiens
LLGSTEFFI

SEQ ID NO: 436214 - protein, 9 aa, Homo Sapiens
EPDTSTGFS

SEQ ID NO: 436215 - protein, 9 aa, Homo Sapiens
AGHSISKQN

SEQ ID NO: 436216 - protein, 9 aa, Homo Sapiens
DIFNRIKRK

SEQ ID NO: 436217 - protein, 9 aa, Homo Sapiens
LDDVCNRFK

SEQ ID NO: 436218 - protein, 9 aa, Homo Sapiens
SISSISCCN

SEQ ID NO: 436219 - protein, 9 aa, Homo Sapiens
VKRKIVSHG

SEQ ID NO: 436220 - protein, 9 aa, Homo Sapiens
KNTYIPQVP

SEQ ID NO: 436221 - protein, 9 aa, Homo Sapiens
TDSTGSTDR

SEQ ID NO: 436222 - protein, 9 aa, Homo Sapiens
PIQLVNTHN

SEQ ID NO: 436223 - protein, 9 aa, Homo Sapiens
NARFLVMAS

SEQ ID NO: 436224 - protein, 9 aa, Homo Sapiens
LLPQSSTLE

SEQ ID NO: 436225 - protein, 9 aa, Homo Sapiens
DWAARGHHS

SEQ ID NO: 436226 - protein, 9 aa, Homo Sapiens
NKMNDYAGQ

SEQ ID NO: 436227 - protein, 9 aa, Homo Sapiens
QYQDLVVRI

SEQ ID NO: 436228 - protein, 9 aa, Homo Sapiens
AITEELAVF

SEQ ID NO: 436229 - protein, 9 aa, Homo Sapiens
GSGCLVRRR

SEQ ID NO: 436230 - protein, 9 aa, Homo Sapiens
LPMVHGPKP

SEQ ID NO: 436231 - protein, 9 aa, Homo Sapiens
VLRSNEVAV

SEQ ID NO: 436232 - protein, 9 aa, Homo Sapiens
QIIATRGVV

SEQ ID NO: 436233 - protein, 9 aa, Homo Sapiens
DFPPTHVAE

SEQ ID NO: 436234 - protein, 9 aa, Homo Sapiens
QAHKALSPP

SEQ ID NO: 436235 - protein, 9 aa, Homo Sapiens
ADLVLLPNI

SEQ ID NO: 436236 - protein, 9 aa, Homo Sapiens
YFDFTLCKK

SEQ ID NO: 436237 - protein, 9 aa, Homo Sapiens
YLFSTDTIS

SEQ ID NO: 436238 - protein, 9 aa, Homo Sapiens
NWRKAPLTD

SEQ ID NO: 436239 - protein, 9 aa, Homo Sapiens
SGGFNYLIS

SEQ ID NO: 436240 - protein, 9 aa, Homo Sapiens
NVGLEALSK

SEQ ID NO: 436241 - protein, 9 aa, Homo Sapiens
NGSTERNIC

SEQ ID NO: 436242 - protein, 9 aa, Homo Sapiens
GALPQQCSG

SEQ ID NO: 436243 - protein, 9 aa, Homo Sapiens
SFQIHEIMH

SEQ ID NO: 436244 - protein, 9 aa, Homo Sapiens
VFNAFFSLY

SEQ ID NO: 436245 - protein, 9 aa, Homo Sapiens
SRHRRSQSR

SEQ ID NO: 436246 - protein, 9 aa, Homo Sapiens
CCVLMLLFP

SEQ ID NO: 436247 - protein, 9 aa, Homo Sapiens
ETRNKMFLT

SEQ ID NO: 436248 - protein, 9 aa, Homo Sapiens
AVNSFIHQH

SEQ ID NO: 436249 - protein, 9 aa, Homo Sapiens
KIIGVKSQE

SEQ ID NO: 436250 - protein, 9 aa, Homo Sapiens
MDEQQNVRE

SEQ ID NO: 436251 - protein, 9 aa, Homo Sapiens
TNEMYSGKF

SEQ ID NO: 436252 - protein, 9 aa, Homo Sapiens
WSIPGPEKN

SEQ ID NO: 436253 - protein, 9 aa, Homo Sapiens
DELYIELDQ

SEQ ID NO: 436254 - protein, 9 aa, Homo Sapiens
NTSCLVQEH

SEQ ID NO: 436255 - protein, 9 aa, Homo Sapiens
CGQAETEET

SEQ ID NO: 436256 - protein, 9 aa, Homo Sapiens
LKAHTYSIV

SEQ ID NO: 436257 - protein, 9 aa, Homo Sapiens
EGDGFLFPK

SEQ ID NO: 436258 - protein, 9 aa, Homo Sapiens
AQQKLVGLD

SEQ ID NO: 436259 - protein, 9 aa, Homo Sapiens
KNFLLQFKM

SEQ ID NO: 436260 - protein, 9 aa, Homo Sapiens
NAVKKIAEA

SEQ ID NO: 436261 - protein, 9 aa, Homo Sapiens
WPPPTAAER

SEQ ID NO: 436262 - protein, 9 aa, Homo Sapiens
EGRYLSCCV

SEQ ID NO: 436263 - protein, 9 aa, Homo Sapiens
SITNHHRIH

SEQ ID NO: 436264 - protein, 9 aa, Homo Sapiens
YKDNKFLTC

SEQ ID NO: 436265 - protein, 9 aa, Homo Sapiens
FGVRALHHL

SEQ ID NO: 436266 - protein, 9 aa, Homo Sapiens
EELWASAPS

SEQ ID NO: 436267 - protein, 9 aa, Homo Sapiens
LVKTSDVET

SEQ ID NO: 436268 - protein, 9 aa, Homo Sapiens
NEDTIQYVV

SEQ ID NO: 436269 - protein, 9 aa, Homo Sapiens
ILTRDRDPS

SEQ ID NO: 436270 - protein, 9 aa, Homo Sapiens
FQLKKVRFV

SEQ ID NO: 436271 - protein, 9 aa, Homo Sapiens
NSSYVVGPP

SEQ ID NO: 436272 - protein, 9 aa, Homo Sapiens
RVNRSIYVD

SEQ ID NO: 436273 - protein, 9 aa, Homo Sapiens
QMKLMVIPL

SEQ ID NO: 436274 - protein, 9 aa, Homo Sapiens
IYFFLQHLA

SEQ ID NO: 436275 - protein, 9 aa, Homo Sapiens
LGERQSDNY

SEQ ID NO: 436276 - protein, 9 aa, Homo Sapiens
GCTNVDGCK

SEQ ID NO: 436277 - protein, 9 aa, Homo Sapiens
VVCYLWEPI

SEQ ID NO: 436278 - protein, 9 aa, Homo Sapiens
ALYPKSIQD

SEQ ID NO: 436279 - protein, 9 aa, Homo Sapiens
RYDEGNVFP

SEQ ID NO: 436280 - protein, 9 aa, Homo Sapiens
AGKGKSSHW

SEQ ID NO: 436281 - protein, 9 aa, Homo Sapiens
FWFCVLQVL

SEQ ID NO: 436282 - protein, 9 aa, Homo Sapiens
GFNGNQIVD

SEQ ID NO: 436283 - protein, 9 aa, Homo Sapiens
LLPQLLQYQ

SEQ ID NO: 436284 - protein, 9 aa, Homo Sapiens
VPGVVSKVF

SEQ ID NO: 436285 - protein, 9 aa, Homo Sapiens
QYIFKVKKP

SEQ ID NO: 436286 - protein, 9 aa, Homo Sapiens
KSTEQAVSK

SEQ ID NO: 436287 - protein, 9 aa, Homo Sapiens
LVSFCRTIY

SEQ ID NO: 436288 - protein, 9 aa, Homo Sapiens
DHLAPNSKS

SEQ ID NO: 436289 - protein, 9 aa, Homo Sapiens
FLIQASSRD

SEQ ID NO: 436290 - protein, 9 aa, Homo Sapiens
QELLQGTRA

SEQ ID NO: 436291 - protein, 9 aa, Homo Sapiens
EGSRRLLKD

SEQ ID NO: 436292 - protein, 9 aa, Homo Sapiens
FQVLVDNKF

SEQ ID NO: 436293 - protein, 9 aa, Homo Sapiens
RLCADRVST

SEQ ID NO: 436294 - protein, 9 aa, Homo Sapiens
NNFSLNLGL

SEQ ID NO: 436295 - protein, 9 aa, Homo Sapiens
KSLDLFRLY

SEQ ID NO: 436296 - protein, 9 aa, Homo Sapiens
PDEDECKEY

SEQ ID NO: 436297 - protein, 9 aa, Homo Sapiens
VILLYGSAL

SEQ ID NO: 436298 - protein, 9 aa, Homo Sapiens
EGESNSSDT

SEQ ID NO: 436299 - protein, 9 aa, Homo Sapiens
PLPGPITFP

SEQ ID NO: 436300 - protein, 9 aa, Homo Sapiens
TAIVITYST

SEQ ID NO: 436301 - protein, 9 aa, Homo Sapiens
KGVELAHHC

SEQ ID NO: 436302 - protein, 9 aa, Homo Sapiens
VDEIVVTKK

SEQ ID NO: 436303 - protein, 9 aa, Homo Sapiens
VMKYFEEMR

SEQ ID NO: 436304 - protein, 9 aa, Homo Sapiens
YLLENKGDI

SEQ ID NO: 436305 - protein, 9 aa, Homo Sapiens
SADWKRVET

SEQ ID NO: 436306 - protein, 9 aa, Homo Sapiens
EGIQYLDGL

SEQ ID NO: 436307 - protein, 9 aa, Homo Sapiens
HVRVERSMK

SEQ ID NO: 436308 - protein, 9 aa, Homo Sapiens
QIPPSYVKM

SEQ ID NO: 436309 - protein, 9 aa, Homo Sapiens
MGNLYLALY

SEQ ID NO: 436310 - protein, 9 aa, Homo Sapiens
NMQTIWVTG

SEQ ID NO: 436311 - protein, 9 aa, Homo Sapiens
QNCLLIFRS

SEQ ID NO: 436312 - protein, 9 aa, Homo Sapiens
GENINHSCI

SEQ ID NO: 436313 - protein, 9 aa, Homo Sapiens
ASTMALVFY

SEQ ID NO: 436314 - protein, 9 aa, Homo Sapiens
FRSPLPLFF

SEQ ID NO: 436315 - protein, 9 aa, Homo Sapiens
TAKQLETLN

SEQ ID NO: 436316 - protein, 9 aa, Homo Sapiens
TLNETDHSD

SEQ ID NO: 436317 - protein, 9 aa, Homo Sapiens
HVNCSNITS

SEQ ID NO: 436318 - protein, 9 aa, Homo Sapiens
KLAFAVEPS

SEQ ID NO: 436319 - protein, 9 aa, Homo Sapiens
KGPKIIFAP

SEQ ID NO: 436320 - protein, 9 aa, Homo Sapiens
TTGHYNHND

SEQ ID NO: 436321 - protein, 9 aa, Homo Sapiens
TASPANCPL

SEQ ID NO: 436322 - protein, 9 aa, Homo Sapiens
FIVVAVFLV

SEQ ID NO: 436323 - protein, 9 aa, Homo Sapiens
LTAKKICYQ

SEQ ID NO: 436324 - protein, 9 aa, Homo Sapiens
WNVNYNYTY

SEQ ID NO: 436325 - protein, 9 aa, Homo Sapiens
SNTVALWES

SEQ ID NO: 436326 - protein, 9 aa, Homo Sapiens
KLNEARKIL

SEQ ID NO: 436327 - protein, 9 aa, Homo Sapiens
FFCDVPAMW

SEQ ID NO: 436328 - protein, 9 aa, Homo Sapiens
NLRNVAALD

SEQ ID NO: 436329 - protein, 9 aa, Homo Sapiens
IVDVNKPII

SEQ ID NO: 436330 - protein, 9 aa, Homo Sapiens
LAQIIAALT

SEQ ID NO: 436331 - protein, 9 aa, Homo Sapiens
KPKARQFFV

SEQ ID NO: 436332 - protein, 9 aa, Homo Sapiens
PNISNVKVE

SEQ ID NO: 436333 - protein, 9 aa, Homo Sapiens
NLNTHFRSK

SEQ ID NO: 436334 - protein, 9 aa, Homo Sapiens
ALGPSTTAA

SEQ ID NO: 436335 - protein, 9 aa, Homo Sapiens
VAALVHIYL

SEQ ID NO: 436336 - protein, 9 aa, Homo Sapiens
DVSSKCFLG

SEQ ID NO: 436337 - protein, 9 aa, Homo Sapiens
AINPMLNPL

SEQ ID NO: 436338 - protein, 9 aa, Homo Sapiens
IQFRSDEEC

SEQ ID NO: 436339 - protein, 9 aa, Homo Sapiens
PVSVSRSDP

SEQ ID NO: 436340 - protein, 9 aa, Homo Sapiens
DYFHDKNAT

SEQ ID NO: 436341 - protein, 9 aa, Homo Sapiens
FWGRVNNFL

SEQ ID NO: 436342 - protein, 9 aa, Homo Sapiens
RNVMEQFDP

SEQ ID NO: 436343 - protein, 9 aa, Homo Sapiens
NNKYGTALN

SEQ ID NO: 436344 - protein, 9 aa, Homo Sapiens
SRTKRRQRV

SEQ ID NO: 436345 - protein, 9 aa, Homo Sapiens
KRIVRKTFW

SEQ ID NO: 436346 - protein, 9 aa, Homo Sapiens
KAWDDLNKY

SEQ ID NO: 436347 - protein, 9 aa, Homo Sapiens
ICGDKGEPG

SEQ ID NO: 436348 - protein, 9 aa, Homo Sapiens
TEFQNCEFK

SEQ ID NO: 436349 - protein, 9 aa, Homo Sapiens
LLWMFSFKA

SEQ ID NO: 436350 - protein, 9 aa, Homo Sapiens
PHTYQSKGL

SEQ ID NO: 436351 - protein, 9 aa, Homo Sapiens
PLEMGVFIR

SEQ ID NO: 436352 - protein, 9 aa, Homo Sapiens
SQLHNHVQG

SEQ ID NO: 436353 - protein, 9 aa, Homo Sapiens
DSGCRNTYY

SEQ ID NO: 436354 - protein, 9 aa, Homo Sapiens
VTLRCYPIS

SEQ ID NO: 436355 - protein, 9 aa, Homo Sapiens
IIILVFIRE

SEQ ID NO: 436356 - protein, 9 aa, Homo Sapiens
WLPAEDALL

SEQ ID NO: 436357 - protein, 9 aa, Homo Sapiens
ALECRICHV

SEQ ID NO: 436358 - protein, 9 aa, Homo Sapiens
CCFSEDGFL

SEQ ID NO: 436359 - protein, 9 aa, Homo Sapiens
SQLSVNDSF

SEQ ID NO: 436360 - protein, 9 aa, Homo Sapiens
AELSSDAFH

SEQ ID NO: 436361 - protein, 9 aa, Homo Sapiens
VNQARRQNR

SEQ ID NO: 436362 - protein, 9 aa, Homo Sapiens
VVTEMGTYA

SEQ ID NO: 436363 - protein, 9 aa, Homo Sapiens
IILVFIREL

SEQ ID NO: 436364 - protein, 9 aa, Homo Sapiens
TSSLLPQKQ

SEQ ID NO: 436365 - protein, 9 aa, Homo Sapiens
LIRHWRHYH

SEQ ID NO: 436366 - protein, 9 aa, Homo Sapiens
PKRLRAVYF

SEQ ID NO: 436367 - protein, 9 aa, Homo Sapiens
SKHKRFYLG

SEQ ID NO: 436368 - protein, 9 aa, Homo Sapiens
NSSNRKKHM

SEQ ID NO: 436369 - protein, 9 aa, Homo Sapiens
VGMVFHPQS

SEQ ID NO: 436370 - protein, 9 aa, Homo Sapiens
YHSRMNISD

SEQ ID NO: 436371 - protein, 9 aa, Homo Sapiens
QLNHFFCEM

SEQ ID NO: 436372 - protein, 9 aa, Homo Sapiens
GFYLDDSDT

SEQ ID NO: 436373 - protein, 9 aa, Homo Sapiens
EKYHLQLYK

SEQ ID NO: 436374 - protein, 9 aa, Homo Sapiens
SDYVEVAKV

SEQ ID NO: 436375 - protein, 9 aa, Homo Sapiens
QGSQISPPF

SEQ ID NO: 436376 - protein, 9 aa, Homo Sapiens
LAHMELFLF

SEQ ID NO: 436377 - protein, 9 aa, Homo Sapiens
KGLGTNEDS

SEQ ID NO: 436378 - protein, 9 aa, Homo Sapiens
VVKTCLQSQ

SEQ ID NO: 436379 - protein, 9 aa, Homo Sapiens
GIGYHLSMY

SEQ ID NO: 436380 - protein, 9 aa, Homo Sapiens
RQAINAALA

SEQ ID NO: 436381 - protein, 9 aa, Homo Sapiens
TEEQVQKLK

SEQ ID NO: 436382 - protein, 9 aa, Homo Sapiens
LQVQRYQEV

SEQ ID NO: 436383 - protein, 9 aa, Homo Sapiens
ITVKMYYPS

SEQ ID NO: 436384 - protein, 9 aa, Homo Sapiens
QTKNESFLE

SEQ ID NO: 436385 - protein, 9 aa, Homo Sapiens
TDFSGLASA

SEQ ID NO: 436386 - protein, 9 aa, Homo Sapiens
TRPCVDRLW

SEQ ID NO: 436387 - protein, 9 aa, Homo Sapiens
KMFCTSCLF

SEQ ID NO: 436388 - protein, 9 aa, Homo Sapiens
VSQDEQENY

SEQ ID NO: 436389 - protein, 9 aa, Homo Sapiens
TGSNIVPGK

SEQ ID NO: 436390 - protein, 9 aa, Homo Sapiens
DGKPLGRIA

SEQ ID NO: 436391 - protein, 9 aa, Homo Sapiens
NSFQAGYGA

SEQ ID NO: 436392 - protein, 9 aa, Homo Sapiens
HMAACSGQA

SEQ ID NO: 436393 - protein, 9 aa, Homo Sapiens
SQKVPVDFE

SEQ ID NO: 436394 - protein, 9 aa, Homo Sapiens
AFLKSLEEC

SEQ ID NO: 436395 - protein, 9 aa, Homo Sapiens
KEKWSAPYD

SEQ ID NO: 436396 - protein, 9 aa, Homo Sapiens
EHISTSINF

SEQ ID NO: 436397 - protein, 9 aa, Homo Sapiens
IPLWLLVPT

SEQ ID NO: 436398 - protein, 9 aa, Homo Sapiens
VDVGNIYVV

SEQ ID NO: 436399 - protein, 9 aa, Homo Sapiens
IHIVIWEIK

SEQ ID NO: 436400 - protein, 9 aa, Homo Sapiens
AILLTRWTR

SEQ ID NO: 436401 - protein, 9 aa, Homo Sapiens
FLVRNIKVR

SEQ ID NO: 436402 - protein, 9 aa, Homo Sapiens
VTAVFTDKY

SEQ ID NO: 436403 - protein, 9 aa, Homo Sapiens
AQSYTQQLG

SEQ ID NO: 436404 - protein, 9 aa, Homo Sapiens
SHKDEELSA

SEQ ID NO: 436405 - protein, 9 aa, Homo Sapiens
MAPEPLKDG

SEQ ID NO: 436406 - protein, 9 aa, Homo Sapiens
KYGDKSYEC

SEQ ID NO: 436407 - protein, 9 aa, Homo Sapiens
QDRSLFEKK

SEQ ID NO: 436408 - protein, 9 aa, Homo Sapiens
KDLCAACLI

SEQ ID NO: 436409 - protein, 9 aa, Homo Sapiens
YKNKGQLSR

SEQ ID NO: 436410 - protein, 9 aa, Homo Sapiens
AKTDEFNRP

SEQ ID NO: 436411 - protein, 9 aa, Homo Sapiens
GFKGELINV

SEQ ID NO: 436412 - protein, 9 aa, Homo Sapiens
DGLCVFESN

SEQ ID NO: 436413 - protein, 9 aa, Homo Sapiens
RITKLYVMA

SEQ ID NO: 436414 - protein, 9 aa, Homo Sapiens
QELQENNKS

SEQ ID NO: 436415 - protein, 9 aa, Homo Sapiens
MCGIHRDTK

SEQ ID NO: 436416 - protein, 9 aa, Homo Sapiens
VLQSFKVMD

SEQ ID NO: 436417 - protein, 9 aa, Homo Sapiens
ISKDLTDKI

SEQ ID NO: 436418 - protein, 9 aa, Homo Sapiens
NKHQALLLD

SEQ ID NO: 436419 - protein, 9 aa, Homo Sapiens
RYQSDPNLA

SEQ ID NO: 436420 - protein, 9 aa, Homo Sapiens
QKRPRSHTL

SEQ ID NO: 436421 - protein, 9 aa, Homo Sapiens
EKKKLLGQL

SEQ ID NO: 436422 - protein, 9 aa, Homo Sapiens
YRYIITYHE

SEQ ID NO: 436423 - protein, 9 aa, Homo Sapiens
PADFEAKII

SEQ ID NO: 436424 - protein, 9 aa, Homo Sapiens
HLTKVLKEK

SEQ ID NO: 436425 - protein, 9 aa, Homo Sapiens
EKAQKTGLI

SEQ ID NO: 436426 - protein, 9 aa, Homo Sapiens
LGTTSVLSL

SEQ ID NO: 436427 - protein, 9 aa, Homo Sapiens
AASYFIRSL

SEQ ID NO: 436428 - protein, 9 aa, Homo Sapiens
TILGYHSAA

SEQ ID NO: 436429 - protein, 9 aa, Homo Sapiens
FSELYLSLI

SEQ ID NO: 436430 - protein, 9 aa, Homo Sapiens
HKFSDNSMS

SEQ ID NO: 436431 - protein, 9 aa, Homo Sapiens
SERRSFETQ

SEQ ID NO: 436432 - protein, 9 aa, Homo Sapiens
LIAFSVGKF

SEQ ID NO: 436433 - protein, 9 aa, Homo Sapiens
HTIGRKPPA

SEQ ID NO: 436434 - protein, 9 aa, Homo Sapiens
DFLRKLKDV

SEQ ID NO: 436435 - protein, 9 aa, Homo Sapiens
VLSKSVNRM

SEQ ID NO: 436436 - protein, 9 aa, Homo Sapiens
RWLVRFNTI

SEQ ID NO: 436437 - protein, 9 aa, Homo Sapiens
HLIVIGFIS

SEQ ID NO: 436438 - protein, 9 aa, Homo Sapiens
SAGEYGKGF

SEQ ID NO: 436439 - protein, 9 aa, Homo Sapiens
ALQYATSQD

SEQ ID NO: 436440 - protein, 9 aa, Homo Sapiens
PARGKLGSS

SEQ ID NO: 436441 - protein, 9 aa, Homo Sapiens
SGIRSASGG

SEQ ID NO: 436442 - protein, 9 aa, Homo Sapiens
EKRQEQEVK

SEQ ID NO: 436443 - protein, 9 aa, Homo Sapiens
PVVSATSNH

SEQ ID NO: 436444 - protein, 9 aa, Homo Sapiens
RNPFETDML

SEQ ID NO: 436445 - protein, 9 aa, Homo Sapiens
STLAGLGDC

SEQ ID NO: 436446 - protein, 9 aa, Homo Sapiens
QKIPEQHQK

SEQ ID NO: 436447 - protein, 9 aa, Homo Sapiens
ISLDQRLEK

SEQ ID NO: 436448 - protein, 9 aa, Homo Sapiens
QIPPQIPQR

SEQ ID NO: 436449 - protein, 9 aa, Homo Sapiens
GERQSDNYP

SEQ ID NO: 436450 - protein, 9 aa, Homo Sapiens
ENRRFVSQE

SEQ ID NO: 436451 - protein, 9 aa, Homo Sapiens
LPYDGKFIK

SEQ ID NO: 436452 - protein, 9 aa, Homo Sapiens
ICCDKFSVW

SEQ ID NO: 436453 - protein, 9 aa, Homo Sapiens
PENPVLLLI

SEQ ID NO: 436454 - protein, 9 aa, Homo Sapiens
EEFIPLVQR

SEQ ID NO: 436455 - protein, 9 aa, Homo Sapiens
QESAWILQQ

SEQ ID NO: 436456 - protein, 9 aa, Homo Sapiens
RKVCGPPVS

SEQ ID NO: 436457 - protein, 9 aa, Homo Sapiens
LTSLGDAIN

SEQ ID NO: 436458 - protein, 9 aa, Homo Sapiens
ENYHKLWRS

SEQ ID NO: 436459 - protein, 9 aa, Homo Sapiens
RNIFSNWGH

SEQ ID NO: 436460 - protein, 9 aa, Homo Sapiens
FFAYQRQQD

SEQ ID NO: 436461 - protein, 9 aa, Homo Sapiens
LHQHENVHT

SEQ ID NO: 436462 - protein, 9 aa, Homo Sapiens
PIISPSTML

SEQ ID NO: 436463 - protein, 9 aa, Homo Sapiens
IIFWLITGI

SEQ ID NO: 436464 - protein, 9 aa, Homo Sapiens
SQGSGLEQI

SEQ ID NO: 436465 - protein, 9 aa, Homo Sapiens
EWEADREMG

SEQ ID NO: 436466 - protein, 9 aa, Homo Sapiens
RFPLSVASA

SEQ ID NO: 436467 - protein, 9 aa, Homo Sapiens
PWYWSWLWA

SEQ ID NO: 436468 - protein, 9 aa, Homo Sapiens
LNPRISVPL

SEQ ID NO: 436469 - protein, 9 aa, Homo Sapiens
APSTRTFFC

SEQ ID NO: 436470 - protein, 9 aa, Homo Sapiens
KENVERLAE

SEQ ID NO: 436471 - protein, 9 aa, Homo Sapiens
YDCKEYGKS

SEQ ID NO: 436472 - protein, 9 aa, Homo Sapiens
PLLCKVYLV

SEQ ID NO: 436473 - protein, 9 aa, Homo Sapiens
WNGIKPSAT

SEQ ID NO: 436474 - protein, 9 aa, Homo Sapiens
WKINPTKIK

SEQ ID NO: 436475 - protein, 9 aa, Homo Sapiens
MVTYNGDFS

SEQ ID NO: 436476 - protein, 9 aa, Homo Sapiens
KQKFTFQED

SEQ ID NO: 436477 - protein, 9 aa, Homo Sapiens
PKLRRLEVS

SEQ ID NO: 436478 - protein, 9 aa, Homo Sapiens
GVNSQNPRR

SEQ ID NO: 436479 - protein, 9 aa, Homo Sapiens
SDLKNLDYR

SEQ ID NO: 436480 - protein, 9 aa, Homo Sapiens
PKPDAFIKL

SEQ ID NO: 436481 - protein, 9 aa, Homo Sapiens
TWSPKWLHK

SEQ ID NO: 436482 - protein, 9 aa, Homo Sapiens
LVLGGGSGR

SEQ ID NO: 436483 - protein, 9 aa, Homo Sapiens
LCDKPGECK

SEQ ID NO: 436484 - protein, 9 aa, Homo Sapiens
TCSWQSQSS

SEQ ID NO: 436485 - protein, 9 aa, Homo Sapiens
GLVGMRSLW

SEQ ID NO: 436486 - protein, 9 aa, Homo Sapiens
IFTFQLPFC

SEQ ID NO: 436487 - protein, 9 aa, Homo Sapiens
SSRDPENFP

SEQ ID NO: 436488 - protein, 9 aa, Homo Sapiens
AYVHCSFCR

SEQ ID NO: 436489 - protein, 9 aa, Homo Sapiens
GNSSEGLIA

SEQ ID NO: 436490 - protein, 9 aa, Homo Sapiens
AYEDIVGYL

SEQ ID NO: 436491 - protein, 9 aa, Homo Sapiens
MQNSNLTLG

SEQ ID NO: 436492 - protein, 9 aa, Homo Sapiens
NQRHSSLID

SEQ ID NO: 436493 - protein, 9 aa, Homo Sapiens
LEIESITDT

SEQ ID NO: 436494 - protein, 9 aa, Homo Sapiens
CTYQFMMQG

SEQ ID NO: 436495 - protein, 9 aa, Homo Sapiens
FGAGKGKSS

SEQ ID NO: 436496 - protein, 9 aa, Homo Sapiens
ECGKVFSHN

SEQ ID NO: 436497 - protein, 9 aa, Homo Sapiens
DTIDDEKLQ

SEQ ID NO: 436498 - protein, 9 aa, Homo Sapiens
QEDPKKEII

SEQ ID NO: 436499 - protein, 9 aa, Homo Sapiens
QSQDKQIEE

SEQ ID NO: 436500 - protein, 9 aa, Homo Sapiens
VLDDNANLD

SEQ ID NO: 436501 - protein, 9 aa, Homo Sapiens
YLEVRSPEY

SEQ ID NO: 436502 - protein, 9 aa, Homo Sapiens
PSKVICNMS

SEQ ID NO: 436503 - protein, 9 aa, Homo Sapiens
VIKIVGLAN

SEQ ID NO: 436504 - protein, 9 aa, Homo Sapiens
ISEFQMLLG

SEQ ID NO: 436505 - protein, 9 aa, Homo Sapiens
SKLIQHQIM

SEQ ID NO: 436506 - protein, 9 aa, Homo Sapiens
SGTRSPAPT

SEQ ID NO: 436507 - protein, 9 aa, Homo Sapiens
VQLKPGGTP

SEQ ID NO: 436508 - protein, 9 aa, Homo Sapiens
KLSENTSLP

SEQ ID NO: 436509 - protein, 9 aa, Homo Sapiens
IHPSTGTGV

SEQ ID NO: 436510 - protein, 9 aa, Homo Sapiens
LLYLNKPVQ

SEQ ID NO: 436511 - protein, 9 aa, Homo Sapiens
LLDNSCRKY

SEQ ID NO: 436512 - protein, 9 aa, Homo Sapiens
IYIHETHTR

SEQ ID NO: 436513 - protein, 9 aa, Homo Sapiens
EVEKIVVAS

SEQ ID NO: 436514 - protein, 9 aa, Homo Sapiens
KVKYLATLD

SEQ ID NO: 436515 - protein, 9 aa, Homo Sapiens
NRIDWPVGS

SEQ ID NO: 436516 - protein, 9 aa, Homo Sapiens
GRPLKDCIW

SEQ ID NO: 436517 - protein, 9 aa, Homo Sapiens
LGLYIHFRH

SEQ ID NO: 436518 - protein, 9 aa, Homo Sapiens
SNIIQHQKI

SEQ ID NO: 436519 - protein, 9 aa, Homo Sapiens
HGPTPIQAL

SEQ ID NO: 436520 - protein, 9 aa, Homo Sapiens
KKEKAVKSE

SEQ ID NO: 436521 - protein, 9 aa, Homo Sapiens
SFLTSPTEL

SEQ ID NO: 436522 - protein, 9 aa, Homo Sapiens
VKDIHSTAV

SEQ ID NO: 436523 - protein, 9 aa, Homo Sapiens
CPKLRRLEV

SEQ ID NO: 436524 - protein, 9 aa, Homo Sapiens
TTVQTVASA

SEQ ID NO: 436525 - protein, 9 aa, Homo Sapiens
MTECHLQSQ

SEQ ID NO: 436526 - protein, 9 aa, Homo Sapiens
IGIIVVIWI

SEQ ID NO: 436527 - protein, 9 aa, Homo Sapiens
RRQRVKISI

SEQ ID NO: 436528 - protein, 9 aa, Homo Sapiens
WKRYKEENN

SEQ ID NO: 436529 - protein, 9 aa, Homo Sapiens
GVWKGAWYF

SEQ ID NO: 436530 - protein, 9 aa, Homo Sapiens
KETHRDFLP

SEQ ID NO: 436531 - protein, 9 aa, Homo Sapiens
LRPRITKLY

SEQ ID NO: 436532 - protein, 9 aa, Homo Sapiens
ISKELINLQ

SEQ ID NO: 436533 - protein, 9 aa, Homo Sapiens
QRLPKVEIQ

SEQ ID NO: 436534 - protein, 9 aa, Homo Sapiens
VLVVCYLWE

SEQ ID NO: 436535 - protein, 9 aa, Homo Sapiens
ENLFKRLMI

SEQ ID NO: 436536 - protein, 9 aa, Homo Sapiens
LTTTQSGIF

SEQ ID NO: 436537 - protein, 9 aa, Homo Sapiens
QSDPNLARY

SEQ ID NO: 436538 - protein, 9 aa, Homo Sapiens
DILINTQNN

SEQ ID NO: 436539 - protein, 9 aa, Homo Sapiens
EPRHNHFYF

SEQ ID NO: 436540 - protein, 9 aa, Homo Sapiens
FIKLHQLST

SEQ ID NO: 436541 - protein, 9 aa, Homo Sapiens
YGTQICPAF

SEQ ID NO: 436542 - protein, 9 aa, Homo Sapiens
TLLLLVKAV

SEQ ID NO: 436543 - protein, 9 aa, Homo Sapiens
PVPQVVWLP

SEQ ID NO: 436544 - protein, 9 aa, Homo Sapiens
RLESCIRDV

SEQ ID NO: 436545 - protein, 9 aa, Homo Sapiens
DKPCGCNTC

SEQ ID NO: 436546 - protein, 9 aa, Homo Sapiens
CSGFRKPTN

SEQ ID NO: 436547 - protein, 9 aa, Homo Sapiens
KGKRHHTHV

SEQ ID NO: 436548 - protein, 9 aa, Homo Sapiens
KSVASFIKK

SEQ ID NO: 436549 - protein, 9 aa, Homo Sapiens
ATDGKEEAN

SEQ ID NO: 436550 - protein, 9 aa, Homo Sapiens
QNRLFNLGT

SEQ ID NO: 436551 - protein, 9 aa, Homo Sapiens
QRGFCEPGG

SEQ ID NO: 436552 - protein, 9 aa, Homo Sapiens
EELMEVITA

SEQ ID NO: 436553 - protein, 9 aa, Homo Sapiens
VLRPSYNGY

SEQ ID NO: 436554 - protein, 9 aa, Homo Sapiens
SCTPTYSMQ

SEQ ID NO: 436555 - protein, 9 aa, Homo Sapiens
CSPSTNTCP

SEQ ID NO: 436556 - protein, 9 aa, Homo Sapiens
KLHSDQYKG

SEQ ID NO: 436557 - protein, 9 aa, Homo Sapiens
SLPATANMK

SEQ ID NO: 436558 - protein, 9 aa, Homo Sapiens
TSSVQALTE

SEQ ID NO: 436559 - protein, 9 aa, Homo Sapiens
SLHRLDLGE

SEQ ID NO: 436560 - protein, 9 aa, Homo Sapiens
EHVNAEIVL

SEQ ID NO: 436561 - protein, 9 aa, Homo Sapiens
TCLQSQIGG

SEQ ID NO: 436562 - protein, 9 aa, Homo Sapiens
TAESCPKCG

SEQ ID NO: 436563 - protein, 9 aa, Homo Sapiens
RQEIIQHVD

SEQ ID NO: 436564 - protein, 9 aa, Homo Sapiens
HLNTCKPKK

SEQ ID NO: 436565 - protein, 9 aa, Homo Sapiens
QIAGCLASL

SEQ ID NO: 436566 - protein, 9 aa, Homo Sapiens
GDGPRKRAT

SEQ ID NO: 436567 - protein, 9 aa, Homo Sapiens
LLYVIIMAD

SEQ ID NO: 436568 - protein, 9 aa, Homo Sapiens
EYAWEPHHN

SEQ ID NO: 436569 - protein, 9 aa, Homo Sapiens
NNYEELLRA

SEQ ID NO: 436570 - protein, 9 aa, Homo Sapiens
VEGMPSKLD

SEQ ID NO: 436571 - protein, 9 aa, Homo Sapiens
TDYTKPKTT

SEQ ID NO: 436572 - protein, 9 aa, Homo Sapiens
FRLCLSHFP

SEQ ID NO: 436573 - protein, 9 aa, Homo Sapiens
MKNYIFAEY

SEQ ID NO: 436574 - protein, 9 aa, Homo Sapiens
VGVISEKHM

SEQ ID NO: 436575 - protein, 9 aa, Homo Sapiens
PALNTMFCQ

SEQ ID NO: 436576 - protein, 9 aa, Homo Sapiens
EAYYSHERC

SEQ ID NO: 436577 - protein, 9 aa, Homo Sapiens
PADKEKITY

SEQ ID NO: 436578 - protein, 9 aa, Homo Sapiens
KPSATAQGG

SEQ ID NO: 436579 - protein, 9 aa, Homo Sapiens
VGNTCYMNS

SEQ ID NO: 436580 - protein, 9 aa, Homo Sapiens
MCRPIKPIY

SEQ ID NO: 436581 - protein, 9 aa, Homo Sapiens
FMKEEKKEA

SEQ ID NO: 436582 - protein, 9 aa, Homo Sapiens
VQLLHSAAD

SEQ ID NO: 436583 - protein, 9 aa, Homo Sapiens
WGKLDSPQR

SEQ ID NO: 436584 - protein, 9 aa, Homo Sapiens
HTHVNVSWC

SEQ ID NO: 436585 - protein, 9 aa, Homo Sapiens
FFVFNDILV

SEQ ID NO: 436586 - protein, 9 aa, Homo Sapiens
HKDYGKKYF

SEQ ID NO: 436587 - protein, 9 aa, Homo Sapiens
SIQRQLNLS

SEQ ID NO: 436588 - protein, 9 aa, Homo Sapiens
AQSHKIPRE

SEQ ID NO: 436589 - protein, 9 aa, Homo Sapiens
RALGNLVME

SEQ ID NO: 436590 - protein, 9 aa, Homo Sapiens
PNKCEKNIH

SEQ ID NO: 436591 - protein, 9 aa, Homo Sapiens
YNESVSTME

SEQ ID NO: 436592 - protein, 9 aa, Homo Sapiens
TSINFNIIK

SEQ ID NO: 436593 - protein, 9 aa, Homo Sapiens
VTVLAFAIS

SEQ ID NO: 436594 - protein, 9 aa, Homo Sapiens
IESCQEDDN

SEQ ID NO: 436595 - protein, 9 aa, Homo Sapiens
TELGHKKLK

SEQ ID NO: 436596 - protein, 9 aa, Homo Sapiens
SHLWKLLDW

SEQ ID NO: 436597 - protein, 9 aa, Homo Sapiens
SELYLSLIL

SEQ ID NO: 436598 - protein, 9 aa, Homo Sapiens
AITSCAFNS

SEQ ID NO: 436599 - protein, 9 aa, Homo Sapiens
VYIRSNNWA

SEQ ID NO: 436600 - protein, 9 aa, Homo Sapiens
ECFQSLRIK

SEQ ID NO: 436601 - protein, 9 aa, Homo Sapiens
QTVLRNFQH

SEQ ID NO: 436602 - protein, 9 aa, Homo Sapiens
EDHKLNTYH

SEQ ID NO: 436603 - protein, 9 aa, Homo Sapiens
GECNSTDDC

SEQ ID NO: 436604 - protein, 9 aa, Homo Sapiens
KIQEEETFL

SEQ ID NO: 436605 - protein, 9 aa, Homo Sapiens
IVGKYGTQI

SEQ ID NO: 436606 - protein, 9 aa, Homo Sapiens
EANSEWFEM

SEQ ID NO: 436607 - protein, 9 aa, Homo Sapiens
PIHFQNAYL

SEQ ID NO: 436608 - protein, 9 aa, Homo Sapiens
NSILFNHES

SEQ ID NO: 436609 - protein, 9 aa, Homo Sapiens
KKVKVEVED

SEQ ID NO: 436610 - protein, 9 aa, Homo Sapiens
RHTPVVRLS

SEQ ID NO: 436611 - protein, 9 aa, Homo Sapiens
QESKKMSVA

SEQ ID NO: 436612 - protein, 9 aa, Homo Sapiens
LKTKRKPQI

SEQ ID NO: 436613 - protein, 9 aa, Homo Sapiens
SNLTTHKNI

SEQ ID NO: 436614 - protein, 9 aa, Homo Sapiens
RKRWFQLYR

SEQ ID NO: 436615 - protein, 9 aa, Homo Sapiens
QRRPLKDIA

SEQ ID NO: 436616 - protein, 9 aa, Homo Sapiens
TACFCEERD

SEQ ID NO: 436617 - protein, 9 aa, Homo Sapiens
HITFHMNPR

SEQ ID NO: 436618 - protein, 9 aa, Homo Sapiens
ENSVCQVHA

SEQ ID NO: 436619 - protein, 9 aa, Homo Sapiens
KAKPVKCIL

SEQ ID NO: 436620 - protein, 9 aa, Homo Sapiens
QNPQYIFKV

SEQ ID NO: 436621 - protein, 9 aa, Homo Sapiens
TTRSAKSWG

SEQ ID NO: 436622 - protein, 9 aa, Homo Sapiens
AVRDLVHRL

SEQ ID NO: 436623 - protein, 9 aa, Homo Sapiens
LTEYFQGPC

SEQ ID NO: 436624 - protein, 9 aa, Homo Sapiens
EAATAVVEN

SEQ ID NO: 436625 - protein, 9 aa, Homo Sapiens
AVRLNRYEM

SEQ ID NO: 436626 - protein, 9 aa, Homo Sapiens
EFPPNKLFG

SEQ ID NO: 436627 - protein, 9 aa, Homo Sapiens
RGGLHYMGK

SEQ ID NO: 436628 - protein, 9 aa, Homo Sapiens
VARECLFHQ

SEQ ID NO: 436629 - protein, 9 aa, Homo Sapiens
ITNRSLKEE

SEQ ID NO: 436630 - protein, 9 aa, Homo Sapiens
MGVHLLPPS

SEQ ID NO: 436631 - protein, 9 aa, Homo Sapiens
TKRHIFPHF

SEQ ID NO: 436632 - protein, 9 aa, Homo Sapiens
AEISGEHLW

SEQ ID NO: 436633 - protein, 9 aa, Homo Sapiens
WQISAGSGG

SEQ ID NO: 436634 - protein, 9 aa, Homo Sapiens
NHFPAYVHC

SEQ ID NO: 436635 - protein, 9 aa, Homo Sapiens
EIRNTLPAR

SEQ ID NO: 436636 - protein, 9 aa, Homo Sapiens
TILIIFAVF

SEQ ID NO: 436637 - protein, 9 aa, Homo Sapiens
WKCIPCSWI

SEQ ID NO: 436638 - protein, 9 aa, Homo Sapiens
DNEGELQHT

SEQ ID NO: 436639 - protein, 9 aa, Homo Sapiens
HPCFLTTQN

SEQ ID NO: 436640 - protein, 9 aa, Homo Sapiens
YECHLCGKS

SEQ ID NO: 436641 - protein, 9 aa, Homo Sapiens
ASLDKFLTS

SEQ ID NO: 436642 - protein, 9 aa, Homo Sapiens
KEGVDGNFI

SEQ ID NO: 436643 - protein, 9 aa, Homo Sapiens
TYLYDRLRL

SEQ ID NO: 436644 - protein, 9 aa, Homo Sapiens
TILWANNLL

SEQ ID NO: 436645 - protein, 9 aa, Homo Sapiens
KDPYSYDQE

SEQ ID NO: 436646 - protein, 9 aa, Homo Sapiens
NEKNKVKNK

SEQ ID NO: 436647 - protein, 9 aa, Homo Sapiens
KTVGMLSNI

SEQ ID NO: 436648 - protein, 9 aa, Homo Sapiens
DNLKVWDVE

SEQ ID NO: 436649 - protein, 9 aa, Homo Sapiens
LIKHYEEQH

SEQ ID NO: 436650 - protein, 9 aa, Homo Sapiens
LIHHREDIP

SEQ ID NO: 436651 - protein, 9 aa, Homo Sapiens
MRSSNLASA

SEQ ID NO: 436652 - protein, 9 aa, Homo Sapiens
CEMYRRLRE

SEQ ID NO: 436653 - protein, 9 aa, Homo Sapiens
YIFKVKKPE

SEQ ID NO: 436654 - protein, 9 aa, Homo Sapiens
FNDAAPAKG

SEQ ID NO: 436655 - protein, 9 aa, Homo Sapiens
KKESHDCGG

SEQ ID NO: 436656 - protein, 9 aa, Homo Sapiens
FICQNKEQE

SEQ ID NO: 436657 - protein, 9 aa, Homo Sapiens
TTSKFNDAA

SEQ ID NO: 436658 - protein, 9 aa, Homo Sapiens
HTLATRIVE

SEQ ID NO: 436659 - protein, 9 aa, Homo Sapiens
HLVPFMVFL

SEQ ID NO: 436660 - protein, 9 aa, Homo Sapiens
RPRRRCSHT

SEQ ID NO: 436661 - protein, 9 aa, Homo Sapiens
FVCHTEKFS

SEQ ID NO: 436662 - protein, 9 aa, Homo Sapiens
ATPVLSMDE

SEQ ID NO: 436663 - protein, 9 aa, Homo Sapiens
SDFNIEEHR

SEQ ID NO: 436664 - protein, 9 aa, Homo Sapiens
LKDIAWWYY

SEQ ID NO: 436665 - protein, 9 aa, Homo Sapiens
TKLCEYITQ

SEQ ID NO: 436666 - protein, 9 aa, Homo Sapiens
QQIFFQSYA

SEQ ID NO: 436667 - protein, 9 aa, Homo Sapiens
WRSSSKCIH

SEQ ID NO: 436668 - protein, 9 aa, Homo Sapiens
QKEAIDKLI

SEQ ID NO: 436669 - protein, 9 aa, Homo Sapiens
TGWNSVSHI

SEQ ID NO: 436670 - protein, 9 aa, Homo Sapiens
NPELQKLLF

SEQ ID NO: 436671 - protein, 9 aa, Homo Sapiens
GEYKCGARV

SEQ ID NO: 436672 - protein, 9 aa, Homo Sapiens
PSDTFSTQP

SEQ ID NO: 436673 - protein, 9 aa, Homo Sapiens
SKDENYKQT

SEQ ID NO: 436674 - protein, 9 aa, Homo Sapiens
FTGPDGSPG

SEQ ID NO: 436675 - protein, 9 aa, Homo Sapiens
SGFYQEINE

SEQ ID NO: 436676 - protein, 9 aa, Homo Sapiens
PWGPALLVK

SEQ ID NO: 436677 - protein, 9 aa, Homo Sapiens
ELIDTMMSN

SEQ ID NO: 436678 - protein, 9 aa, Homo Sapiens
NKEQEPEPV

SEQ ID NO: 436679 - protein, 9 aa, Homo Sapiens
NIIGPQLSN

SEQ ID NO: 436680 - protein, 9 aa, Homo Sapiens
NIKHTSKEN

SEQ ID NO: 436681 - protein, 9 aa, Homo Sapiens
GHSISKQNV

SEQ ID NO: 436682 - protein, 9 aa, Homo Sapiens
TWERVRFQV

SEQ ID NO: 436683 - protein, 9 aa, Homo Sapiens
TSSSCFQHQ

SEQ ID NO: 436684 - protein, 9 aa, Homo Sapiens
PYAHKNWKI

SEQ ID NO: 436685 - protein, 9 aa, Homo Sapiens
LFLVESSSS

SEQ ID NO: 436686 - protein, 9 aa, Homo Sapiens
RKYLFICEF

SEQ ID NO: 436687 - protein, 9 aa, Homo Sapiens
MLTDPENVQ

SEQ ID NO: 436688 - protein, 9 aa, Homo Sapiens
AEDEDFEKE

SEQ ID NO: 436689 - protein, 9 aa, Homo Sapiens
ARVDEVAAA

SEQ ID NO: 436690 - protein, 9 aa, Homo Sapiens
VFICKLFPF

SEQ ID NO: 436691 - protein, 9 aa, Homo Sapiens
QVVDDELAT

SEQ ID NO: 436692 - protein, 9 aa, Homo Sapiens
YNNALSHNV

SEQ ID NO: 436693 - protein, 9 aa, Homo Sapiens
NRLHNQICE

SEQ ID NO: 436694 - protein, 9 aa, Homo Sapiens
YLNGSNMET

SEQ ID NO: 436695 - protein, 9 aa, Homo Sapiens
HKIKKLASE

SEQ ID NO: 436696 - protein, 9 aa, Homo Sapiens
FASGVVELV

SEQ ID NO: 436697 - protein, 9 aa, Homo Sapiens
RVQGITGQP

SEQ ID NO: 436698 - protein, 9 aa, Homo Sapiens
YKDPDNPGQ

SEQ ID NO: 436699 - protein, 9 aa, Homo Sapiens
GDEREMAKV

SEQ ID NO: 436700 - protein, 9 aa, Homo Sapiens
CVPQENEDL

SEQ ID NO: 436701 - protein, 9 aa, Homo Sapiens
RFPSVEREH

SEQ ID NO: 436702 - protein, 9 aa, Homo Sapiens
WMMEKKTVK

SEQ ID NO: 436703 - protein, 9 aa, Homo Sapiens
VVQFLFYQP

SEQ ID NO: 436704 - protein, 9 aa, Homo Sapiens
NKRIVVYHP

SEQ ID NO: 436705 - protein, 9 aa, Homo Sapiens
GKVNNLSIC

SEQ ID NO: 436706 - protein, 9 aa, Homo Sapiens
GGFQDSLNP

SEQ ID NO: 436707 - protein, 9 aa, Homo Sapiens
FSNTPKNVL

SEQ ID NO: 436708 - protein, 9 aa, Homo Sapiens
KIILTGEKP

SEQ ID NO: 436709 - protein, 9 aa, Homo Sapiens
IFHICQQHT

SEQ ID NO: 436710 - protein, 9 aa, Homo Sapiens
DFEAKIIEA

SEQ ID NO: 436711 - protein, 9 aa, Homo Sapiens
DYLITPHVS

SEQ ID NO: 436712 - protein, 9 aa, Homo Sapiens
LPLRFLYIT

SEQ ID NO: 436713 - protein, 9 aa, Homo Sapiens
DFMPKTVVI

SEQ ID NO: 436714 - protein, 9 aa, Homo Sapiens
QNKKKKKTK

SEQ ID NO: 436715 - protein, 9 aa, Homo Sapiens
SVFRMFDPS

SEQ ID NO: 436716 - protein, 9 aa, Homo Sapiens
EECLRTVKC

SEQ ID NO: 436717 - protein, 9 aa, Homo Sapiens
EEGSGCLVR

SEQ ID NO: 436718 - protein, 9 aa, Homo Sapiens
LLVHGNNKA

SEQ ID NO: 436719 - protein, 9 aa, Homo Sapiens
YSIFQELRL

SEQ ID NO: 436720 - protein, 9 aa, Homo Sapiens
KELQDLATY

SEQ ID NO: 436721 - protein, 9 aa, Homo Sapiens
QRGASPNIS

SEQ ID NO: 436722 - protein, 9 aa, Homo Sapiens
EFLSWMEPF

SEQ ID NO: 436723 - protein, 9 aa, Homo Sapiens
CSNIDEILE

SEQ ID NO: 436724 - protein, 9 aa, Homo Sapiens
PAWTFDINT

SEQ ID NO: 436725 - protein, 9 aa, Homo Sapiens
LNYKDNKFL

SEQ ID NO: 436726 - protein, 9 aa, Homo Sapiens
ANLVNRSIA

SEQ ID NO: 436727 - protein, 9 aa, Homo Sapiens
ETACFCEER

SEQ ID NO: 436728 - protein, 9 aa, Homo Sapiens
ISFLFIGVI

SEQ ID NO: 436729 - protein, 9 aa, Homo Sapiens
GLPSWKLND

SEQ ID NO: 436730 - protein, 9 aa, Homo Sapiens
PKIMLLDMA

SEQ ID NO: 436731 - protein, 9 aa, Homo Sapiens
LRNVAALDT

SEQ ID NO: 436732 - protein, 9 aa, Homo Sapiens
SYVHNFLPR

SEQ ID NO: 436733 - protein, 9 aa, Homo Sapiens
YFISAQKET

SEQ ID NO: 436734 - protein, 9 aa, Homo Sapiens
VLKRMGNII

SEQ ID NO: 436735 - protein, 9 aa, Homo Sapiens
LSSSPQSGC

SEQ ID NO: 436736 - protein, 9 aa, Homo Sapiens
NFLHSNTLT

SEQ ID NO: 436737 - protein, 9 aa, Homo Sapiens
WHHVRVERS

SEQ ID NO: 436738 - protein, 9 aa, Homo Sapiens
ALKATPFGG

SEQ ID NO: 436739 - protein, 9 aa, Homo Sapiens
LKTQSKSFP

SEQ ID NO: 436740 - protein, 9 aa, Homo Sapiens
KINICMYSY

SEQ ID NO: 436741 - protein, 9 aa, Homo Sapiens
GKDCNKTSF

SEQ ID NO: 436742 - protein, 9 aa, Homo Sapiens
SRSTMEKYV

SEQ ID NO: 436743 - protein, 9 aa, Homo Sapiens
QNKSKSLTY

SEQ ID NO: 436744 - protein, 9 aa, Homo Sapiens
LVIPVTFKY

SEQ ID NO: 436745 - protein, 9 aa, Homo Sapiens
QCVDTINDY

SEQ ID NO: 436746 - protein, 9 aa, Homo Sapiens
SSIPVSLSI

SEQ ID NO: 436747 - protein, 9 aa, Homo Sapiens
LNPFDNCGL

SEQ ID NO: 436748 - protein, 9 aa, Homo Sapiens
KAQLDSVDI

SEQ ID NO: 436749 - protein, 9 aa, Homo Sapiens
IENPLIQRN

SEQ ID NO: 436750 - protein, 9 aa, Homo Sapiens
NLKLSKFRM

SEQ ID NO: 436751 - protein, 9 aa, Homo Sapiens
EGLLHPNCK

SEQ ID NO: 436752 - protein, 9 aa, Homo Sapiens
EDIVGYLPK

SEQ ID NO: 436753 - protein, 9 aa, Homo Sapiens
VLELTGTPE

SEQ ID NO: 436754 - protein, 9 aa, Homo Sapiens
YKAMAVSDS

SEQ ID NO: 436755 - protein, 9 aa, Homo Sapiens
GSWKCMFFE

SEQ ID NO: 436756 - protein, 9 aa, Homo Sapiens
ANVNAITIY

SEQ ID NO: 436757 - protein, 9 aa, Homo Sapiens
AFDFLNTKE

SEQ ID NO: 436758 - protein, 9 aa, Homo Sapiens
EQACAHVEN

SEQ ID NO: 436759 - protein, 9 aa, Homo Sapiens
QKVYPGLSC

SEQ ID NO: 436760 - protein, 9 aa, Homo Sapiens
QENTFYQAF

SEQ ID NO: 436761 - protein, 9 aa, Homo Sapiens
ERSENECLE

SEQ ID NO: 436762 - protein, 9 aa, Homo Sapiens
LASFATPNM

SEQ ID NO: 436763 - protein, 9 aa, Homo Sapiens
GAEFEGEGD

SEQ ID NO: 436764 - protein, 9 aa, Homo Sapiens
NDLYLWPAY

SEQ ID NO: 436765 - protein, 9 aa, Homo Sapiens
KKWLLLCLE

SEQ ID NO: 436766 - protein, 9 aa, Homo Sapiens
VLIEHFFAV

SEQ ID NO: 436767 - protein, 9 aa, Homo Sapiens
PKTCGLMTA

SEQ ID NO: 436768 - protein, 9 aa, Homo Sapiens
AQGDGYGTF

SEQ ID NO: 436769 - protein, 9 aa, Homo Sapiens
LGCDPQTRL

SEQ ID NO: 436770 - protein, 9 aa, Homo Sapiens
RLHFPIKPS

SEQ ID NO: 436771 - protein, 9 aa, Homo Sapiens
DRRCTKLDM

SEQ ID NO: 436772 - protein, 9 aa, Homo Sapiens
NDNSPRFPQ

SEQ ID NO: 436773 - protein, 9 aa, Homo Sapiens
QMYAATKDL

SEQ ID NO: 436774 - protein, 9 aa, Homo Sapiens
FDWQNCLLI

SEQ ID NO: 436775 - protein, 9 aa, Homo Sapiens
SSQEGRYAL

SEQ ID NO: 436776 - protein, 9 aa, Homo Sapiens
TEKPTIPTK

SEQ ID NO: 436777 - protein, 9 aa, Homo Sapiens
NYRDGNSLI

SEQ ID NO: 436778 - protein, 9 aa, Homo Sapiens
DSSDSSDNS

SEQ ID NO: 436779 - protein, 9 aa, Homo Sapiens
QLYLHFCSD

SEQ ID NO: 436780 - protein, 9 aa, Homo Sapiens
CEKRKIIAE

SEQ ID NO: 436781 - protein, 9 aa, Homo Sapiens
KPPLEAEYT

SEQ ID NO: 436782 - protein, 9 aa, Homo Sapiens
LKDVYGKSL

SEQ ID NO: 436783 - protein, 9 aa, Homo Sapiens
NQTYRALDS

SEQ ID NO: 436784 - protein, 9 aa, Homo Sapiens
SYQNVFIGE

SEQ ID NO: 436785 - protein, 9 aa, Homo Sapiens
RLLLRTTSL

SEQ ID NO: 436786 - protein, 9 aa, Homo Sapiens
LEDHITHKT

SEQ ID NO: 436787 - protein, 9 aa, Homo Sapiens
YSSKKERDR

SEQ ID NO: 436788 - protein, 9 aa, Homo Sapiens
VTVQNERKL

SEQ ID NO: 436789 - protein, 9 aa, Homo Sapiens
KPKQFMTFK

SEQ ID NO: 436790 - protein, 9 aa, Homo Sapiens
FPDMEATLW

SEQ ID NO: 436791 - protein, 9 aa, Homo Sapiens
FNMPTNITT

SEQ ID NO: 436792 - protein, 9 aa, Homo Sapiens
WYKLFSELE

SEQ ID NO: 436793 - protein, 9 aa, Homo Sapiens
SCKDDEFRN

SEQ ID NO: 436794 - protein, 9 aa, Homo Sapiens
LTQNKMIFK

SEQ ID NO: 436795 - protein, 9 aa, Homo Sapiens
NKSRQQLQR

SEQ ID NO: 436796 - protein, 9 aa, Homo Sapiens
PKKMGSAED

SEQ ID NO: 436797 - protein, 9 aa, Homo Sapiens
NVDVFIPVS

SEQ ID NO: 436798 - protein, 9 aa, Homo Sapiens
HLNTKGPEN

SEQ ID NO: 436799 - protein, 9 aa, Homo Sapiens
RIPAWTFDI

SEQ ID NO: 436800 - protein, 9 aa, Homo Sapiens
INSKVVKTR

SEQ ID NO: 436801 - protein, 9 aa, Homo Sapiens
NWKRILIHH

SEQ ID NO: 436802 - protein, 9 aa, Homo Sapiens
INLSMNRIQ

SEQ ID NO: 436803 - protein, 9 aa, Homo Sapiens
RLHNQICEV

SEQ ID NO: 436804 - protein, 9 aa, Homo Sapiens
SILIVIPSA

SEQ ID NO: 436805 - protein, 9 aa, Homo Sapiens
SQSIGKQNF

SEQ ID NO: 436806 - protein, 9 aa, Homo Sapiens
FDYFFPVEP

SEQ ID NO: 436807 - protein, 9 aa, Homo Sapiens
MKSQLEASH

SEQ ID NO: 436808 - protein, 9 aa, Homo Sapiens
HQATAHCPN

SEQ ID NO: 436809 - protein, 9 aa, Homo Sapiens
HALSRDQSD

SEQ ID NO: 436810 - protein, 9 aa, Homo Sapiens
HQFYVADVY

SEQ ID NO: 436811 - protein, 9 aa, Homo Sapiens
TQFSAENIF

SEQ ID NO: 436812 - protein, 9 aa, Homo Sapiens
SSIATWHGN

SEQ ID NO: 436813 - protein, 9 aa, Homo Sapiens
PTVWAINQY

SEQ ID NO: 436814 - protein, 9 aa, Homo Sapiens
SSKDSGVVS

SEQ ID NO: 436815 - protein, 9 aa, Homo Sapiens
MFTTKKVIP

SEQ ID NO: 436816 - protein, 9 aa, Homo Sapiens
AWLEKSAHK

SEQ ID NO: 436817 - protein, 9 aa, Homo Sapiens
TIARATVYF

SEQ ID NO: 436818 - protein, 9 aa, Homo Sapiens
VLDLLYYST

SEQ ID NO: 436819 - protein, 9 aa, Homo Sapiens
EGDDGLCVF

SEQ ID NO: 436820 - protein, 9 aa, Homo Sapiens
KLNTYHDWL

SEQ ID NO: 436821 - protein, 9 aa, Homo Sapiens
ENTFYQAFT

SEQ ID NO: 436822 - protein, 9 aa, Homo Sapiens
SLSPMSQRH

SEQ ID NO: 436823 - protein, 9 aa, Homo Sapiens
QLCCYGYQN

SEQ ID NO: 436824 - protein, 9 aa, Homo Sapiens
HIPKFLKKL

SEQ ID NO: 436825 - protein, 9 aa, Homo Sapiens
PIIYTLTTN

SEQ ID NO: 436826 - protein, 9 aa, Homo Sapiens
VLMKYCLRS

SEQ ID NO: 436827 - protein, 9 aa, Homo Sapiens
PDGMDNDIG

SEQ ID NO: 436828 - protein, 9 aa, Homo Sapiens
PAQLPIYQR

SEQ ID NO: 436829 - protein, 9 aa, Homo Sapiens
RQLEREKRW

SEQ ID NO: 436830 - protein, 9 aa, Homo Sapiens
FKITTANVV

SEQ ID NO: 436831 - protein, 9 aa, Homo Sapiens
INISEVVIK

SEQ ID NO: 436832 - protein, 9 aa, Homo Sapiens
RQLYDNKPR

SEQ ID NO: 436833 - protein, 9 aa, Homo Sapiens
HGLGHGHKQ

SEQ ID NO: 436834 - protein, 9 aa, Homo Sapiens
RFTSLFDAK

SEQ ID NO: 436835 - protein, 9 aa, Homo Sapiens
FRQLWGSRS

SEQ ID NO: 436836 - protein, 9 aa, Homo Sapiens
GRFGVERDQ

SEQ ID NO: 436837 - protein, 9 aa, Homo Sapiens
SPNMLGSVA

SEQ ID NO: 436838 - protein, 9 aa, Homo Sapiens
DPEGDRVQA

SEQ ID NO: 436839 - protein, 9 aa, Homo Sapiens
VSPALGVIQ

SEQ ID NO: 436840 - protein, 9 aa, Homo Sapiens
AENLNKYFN

SEQ ID NO: 436841 - protein, 9 aa, Homo Sapiens
EYANTFGYT

SEQ ID NO: 436842 - protein, 9 aa, Homo Sapiens
GLINHQIIH

SEQ ID NO: 436843 - protein, 9 aa, Homo Sapiens
IKNTDDREK

SEQ ID NO: 436844 - protein, 9 aa, Homo Sapiens
PPSPAKDEH

SEQ ID NO: 436845 - protein, 9 aa, Homo Sapiens
FNLSSVNEF

SEQ ID NO: 436846 - protein, 9 aa, Homo Sapiens
NLALEQGDA

SEQ ID NO: 436847 - protein, 9 aa, Homo Sapiens
QSLISTDAL

SEQ ID NO: 436848 - protein, 9 aa, Homo Sapiens
LCFNILCVG

SEQ ID NO: 436849 - protein, 9 aa, Homo Sapiens
ATKALHAFQ

SEQ ID NO: 436850 - protein, 9 aa, Homo Sapiens
PESRKEINE

SEQ ID NO: 436851 - protein, 9 aa, Homo Sapiens
HSHFRSHSK

SEQ ID NO: 436852 - protein, 9 aa, Homo Sapiens
TLTKLNFGM

SEQ ID NO: 436853 - protein, 9 aa, Homo Sapiens
LGGGSGRIT

SEQ ID NO: 436854 - protein, 9 aa, Homo Sapiens
NEQELKSRT

SEQ ID NO: 436855 - protein, 9 aa, Homo Sapiens
HIFPHFYFL

SEQ ID NO: 436856 - protein, 9 aa, Homo Sapiens
SSASLVLKI

SEQ ID NO: 436857 - protein, 9 aa, Homo Sapiens
FCGCGCGCG

SEQ ID NO: 436858 - protein, 9 aa, Homo Sapiens
PVPEELEGP

SEQ ID NO: 436859 - protein, 9 aa, Homo Sapiens
RHRPDSVSL

SEQ ID NO: 436860 - protein, 9 aa, Homo Sapiens
PVASLSNLE

SEQ ID NO: 436861 - protein, 9 aa, Homo Sapiens
YGVKFKEFI

SEQ ID NO: 436862 - protein, 9 aa, Homo Sapiens
VNNLNPKKF

SEQ ID NO: 436863 - protein, 9 aa, Homo Sapiens
GYSMFLCMH

SEQ ID NO: 436864 - protein, 9 aa, Homo Sapiens
LIAVEMLFA

SEQ ID NO: 436865 - protein, 9 aa, Homo Sapiens
AQNNQNRDH

SEQ ID NO: 436866 - protein, 9 aa, Homo Sapiens
SKMKAPVLP

SEQ ID NO: 436867 - protein, 9 aa, Homo Sapiens
WSAASRNYF

SEQ ID NO: 436868 - protein, 9 aa, Homo Sapiens
LAFHTSAPA

SEQ ID NO: 436869 - protein, 9 aa, Homo Sapiens
PEMPRAGDR

SEQ ID NO: 436870 - protein, 9 aa, Homo Sapiens
KTATYDTGG

SEQ ID NO: 436871 - protein, 9 aa, Homo Sapiens
LRKCIRHEP

SEQ ID NO: 436872 - protein, 9 aa, Homo Sapiens
NQCIVPICI

SEQ ID NO: 436873 - protein, 9 aa, Homo Sapiens
NDDPECGVE

SEQ ID NO: 436874 - protein, 9 aa, Homo Sapiens
CLSDPGVAD

SEQ ID NO: 436875 - protein, 9 aa, Homo Sapiens
CTPLASTTQ

SEQ ID NO: 436876 - protein, 9 aa, Homo Sapiens
EGRMSGTVH

SEQ ID NO: 436877 - protein, 9 aa, Homo Sapiens
VDIPKARRK

SEQ ID NO: 436878 - protein, 9 aa, Homo Sapiens
ATIGTQSLH

SEQ ID NO: 436879 - protein, 9 aa, Homo Sapiens
KIIINYSIE

SEQ ID NO: 436880 - protein, 9 aa, Homo Sapiens
ADREMGSSS

SEQ ID NO: 436881 - protein, 9 aa, Homo Sapiens
DWIMEAVRG

SEQ ID NO: 436882 - protein, 9 aa, Homo Sapiens
GLEALSKSS

SEQ ID NO: 436883 - protein, 9 aa, Homo Sapiens
NTIVPESEI

SEQ ID NO: 436884 - protein, 9 aa, Homo Sapiens
NQKNCRFEV

SEQ ID NO: 436885 - protein, 9 aa, Homo Sapiens
RPNTTEREK

SEQ ID NO: 436886 - protein, 9 aa, Homo Sapiens
YILMKFMKT

SEQ ID NO: 436887 - protein, 9 aa, Homo Sapiens
RKILVVNVN

SEQ ID NO: 436888 - protein, 9 aa, Homo Sapiens
LIIHHIIHT

SEQ ID NO: 436889 - protein, 9 aa, Homo Sapiens
EEDYKNKGQ

SEQ ID NO: 436890 - protein, 9 aa, Homo Sapiens
TFTTLVDLK

SEQ ID NO: 436891 - protein, 9 aa, Homo Sapiens
INTFIKIPV

SEQ ID NO: 436892 - protein, 9 aa, Homo Sapiens
KKKKNPLLW

SEQ ID NO: 436893 - protein, 9 aa, Homo Sapiens
DKVSHLQKG

SEQ ID NO: 436894 - protein, 9 aa, Homo Sapiens
SKVLTFNLT

SEQ ID NO: 436895 - protein, 9 aa, Homo Sapiens
SQISPPFSL

SEQ ID NO: 436896 - protein, 9 aa, Homo Sapiens
TDTMENLTR

SEQ ID NO: 436897 - protein, 9 aa, Homo Sapiens
SNCDVLRFE

SEQ ID NO: 436898 - protein, 9 aa, Homo Sapiens
GCMHITFRN

SEQ ID NO: 436899 - protein, 9 aa, Homo Sapiens
NFGADMTKV

SEQ ID NO: 436900 - protein, 9 aa, Homo Sapiens
KTLCKLVYV

SEQ ID NO: 436901 - protein, 9 aa, Homo Sapiens
KIDRQGAVV

SEQ ID NO: 436902 - protein, 9 aa, Homo Sapiens
IIGPQLSNK

SEQ ID NO: 436903 - protein, 9 aa, Homo Sapiens
QERGETPPH

SEQ ID NO: 436904 - protein, 9 aa, Homo Sapiens
AAGLILLAF

SEQ ID NO: 436905 - protein, 9 aa, Homo Sapiens
INSQQVPNH

SEQ ID NO: 436906 - protein, 9 aa, Homo Sapiens
CKVLPDWKG

SEQ ID NO: 436907 - protein, 9 aa, Homo Sapiens
IAFYRLISG

SEQ ID NO: 436908 - protein, 9 aa, Homo Sapiens
SHGETVQTL

SEQ ID NO: 436909 - protein, 9 aa, Homo Sapiens
YYETVCMAA

SEQ ID NO: 436910 - protein, 9 aa, Homo Sapiens
CKNLIKFML

SEQ ID NO: 436911 - protein, 9 aa, Homo Sapiens
HKTEKAINE

SEQ ID NO: 436912 - protein, 9 aa, Homo Sapiens
RFLDQQNQV

SEQ ID NO: 436913 - protein, 9 aa, Homo Sapiens
FSHTCLTQF

SEQ ID NO: 436914 - protein, 9 aa, Homo Sapiens
YHNERGVGA

SEQ ID NO: 436915 - protein, 9 aa, Homo Sapiens
YSVWMGGSI

SEQ ID NO: 436916 - protein, 9 aa, Homo Sapiens
VDGPAMNNV

SEQ ID NO: 436917 - protein, 9 aa, Homo Sapiens
DYYELVGVA

SEQ ID NO: 436918 - protein, 9 aa, Homo Sapiens
GESKAGITA

SEQ ID NO: 436919 - protein, 9 aa, Homo Sapiens
YHKYGDKSY

SEQ ID NO: 436920 - protein, 9 aa, Homo Sapiens
DEDLRSESS

SEQ ID NO: 436921 - protein, 9 aa, Homo Sapiens
IEKEIEGDG

SEQ ID NO: 436922 - protein, 9 aa, Homo Sapiens
NLHFFAPDY

SEQ ID NO: 436923 - protein, 9 aa, Homo Sapiens
IGYLCTEKY

SEQ ID NO: 436924 - protein, 9 aa, Homo Sapiens
GQTPYAGIK

SEQ ID NO: 436925 - protein, 9 aa, Homo Sapiens
SILSKLRNE

SEQ ID NO: 436926 - protein, 9 aa, Homo Sapiens
SDTSMDFTM

SEQ ID NO: 436927 - protein, 9 aa, Homo Sapiens
EFLFFLLSP

SEQ ID NO: 436928 - protein, 9 aa, Homo Sapiens
CLIGEKLFH

SEQ ID NO: 436929 - protein, 9 aa, Homo Sapiens
KYLENTVTT

SEQ ID NO: 436930 - protein, 9 aa, Homo Sapiens
GLCGYLLKP

SEQ ID NO: 436931 - protein, 9 aa, Homo Sapiens
SCYLFSTDT

SEQ ID NO: 436932 - protein, 9 aa, Homo Sapiens
ERCIQYLAS

SEQ ID NO: 436933 - protein, 9 aa, Homo Sapiens
SWLWAPPSV

SEQ ID NO: 436934 - protein, 9 aa, Homo Sapiens
NYVVQGMIL

SEQ ID NO: 436935 - protein, 9 aa, Homo Sapiens
AMNNVEFKA

SEQ ID NO: 436936 - protein, 9 aa, Homo Sapiens
KVLLETRRN

SEQ ID NO: 436937 - protein, 9 aa, Homo Sapiens
GRICSTNDS

SEQ ID NO: 436938 - protein, 9 aa, Homo Sapiens
PGRQLTVHG

SEQ ID NO: 436939 - protein, 9 aa, Homo Sapiens
LNRIYYKVQ

SEQ ID NO: 436940 - protein, 9 aa, Homo Sapiens
AKPLGGSHT

SEQ ID NO: 436941 - protein, 9 aa, Homo Sapiens
SVSWMGKPV

SEQ ID NO: 436942 - protein, 9 aa, Homo Sapiens
CPMNLLARD

SEQ ID NO: 436943 - protein, 9 aa, Homo Sapiens
RMVRSLESV

SEQ ID NO: 436944 - protein, 9 aa, Homo Sapiens
ELMEVITAA

SEQ ID NO: 436945 - protein, 9 aa, Homo Sapiens
EGTLKEIAS

SEQ ID NO: 436946 - protein, 9 aa, Homo Sapiens
RSHTLTAVH

SEQ ID NO: 436947 - protein, 9 aa, Homo Sapiens
KQKHKFVDK

SEQ ID NO: 436948 - protein, 9 aa, Homo Sapiens
VDVFIPVSQ

SEQ ID NO: 436949 - protein, 9 aa, Homo Sapiens
SCCPVECEK

SEQ ID NO: 436950 - protein, 9 aa, Homo Sapiens
PQCMCLSPT

SEQ ID NO: 436951 - protein, 9 aa, Homo Sapiens
HITMGPSAV

SEQ ID NO: 436952 - protein, 9 aa, Homo Sapiens
CANALAARD

SEQ ID NO: 436953 - protein, 9 aa, Homo Sapiens
GKKSLDLFR

SEQ ID NO: 436954 - protein, 9 aa, Homo Sapiens
DTWCEQKLK

SEQ ID NO: 436955 - protein, 9 aa, Homo Sapiens
PHLQIPMYL

SEQ ID NO: 436956 - protein, 9 aa, Homo Sapiens
PELRGLFLG

SEQ ID NO: 436957 - protein, 9 aa, Homo Sapiens
IGIFNRSFQ

SEQ ID NO: 436958 - protein, 9 aa, Homo Sapiens
LSEKVCKLN

SEQ ID NO: 436959 - protein, 9 aa, Homo Sapiens
NTKISEPGC

SEQ ID NO: 436960 - protein, 9 aa, Homo Sapiens
PASCKDLCG

SEQ ID NO: 436961 - protein, 9 aa, Homo Sapiens
PDFREKVIK

SEQ ID NO: 436962 - protein, 9 aa, Homo Sapiens
AGLYPKVAN

SEQ ID NO: 436963 - protein, 9 aa, Homo Sapiens
LITTNPYNY

SEQ ID NO: 436964 - protein, 9 aa, Homo Sapiens
YYPSWPNFD

SEQ ID NO: 436965 - protein, 9 aa, Homo Sapiens
IFCLDTLPE

SEQ ID NO: 436966 - protein, 9 aa, Homo Sapiens
PYKETELPK

SEQ ID NO: 436967 - protein, 9 aa, Homo Sapiens
TVSYLKTQK

SEQ ID NO: 436968 - protein, 9 aa, Homo Sapiens
ERGKAGWHK

SEQ ID NO: 436969 - protein, 9 aa, Homo Sapiens
WGIADETEL

SEQ ID NO: 436970 - protein, 9 aa, Homo Sapiens
VFLASKNCI

SEQ ID NO: 436971 - protein, 9 aa, Homo Sapiens
FILRDSESI

SEQ ID NO: 436972 - protein, 9 aa, Homo Sapiens
LFLEYLTNK

SEQ ID NO: 436973 - protein, 9 aa, Homo Sapiens
CPDGITKKE

SEQ ID NO: 436974 - protein, 9 aa, Homo Sapiens
SVPNCAEGC

SEQ ID NO: 436975 - protein, 9 aa, Homo Sapiens
EDECKEYIL

SEQ ID NO: 436976 - protein, 9 aa, Homo Sapiens
ETKLGYSMT

SEQ ID NO: 436977 - protein, 9 aa, Homo Sapiens
YCEPHKIIK

SEQ ID NO: 436978 - protein, 9 aa, Homo Sapiens
KTALVERDY

SEQ ID NO: 436979 - protein, 9 aa, Homo Sapiens
YELDPYKSI

SEQ ID NO: 436980 - protein, 9 aa, Homo Sapiens
PNHTGCRHT

SEQ ID NO: 436981 - protein, 9 aa, Homo Sapiens
TLHQIIHTG

SEQ ID NO: 436982 - protein, 9 aa, Homo Sapiens
VPGPVIRRA

SEQ ID NO: 436983 - protein, 9 aa, Homo Sapiens
FILALSGNS

SEQ ID NO: 436984 - protein, 9 aa, Homo Sapiens
SRHRLQHEG

SEQ ID NO: 436985 - protein, 9 aa, Homo Sapiens
KQSIYLASL

SEQ ID NO: 436986 - protein, 9 aa, Homo Sapiens
ETPDSGLAK

SEQ ID NO: 436987 - protein, 9 aa, Homo Sapiens
PSVEREHAL

SEQ ID NO: 436988 - protein, 9 aa, Homo Sapiens
INQCWTTTQ

SEQ ID NO: 436989 - protein, 9 aa, Homo Sapiens
SPQQIFFQS

SEQ ID NO: 436990 - protein, 9 aa, Homo Sapiens
YPAPDSCQP

SEQ ID NO: 436991 - protein, 9 aa, Homo Sapiens
SDELFCRCH

SEQ ID NO: 436992 - protein, 9 aa, Homo Sapiens
YKSACNIEV

SEQ ID NO: 436993 - protein, 9 aa, Homo Sapiens
IPKFLKKLL

SEQ ID NO: 436994 - protein, 9 aa, Homo Sapiens
HQIIHTDEK

SEQ ID NO: 436995 - protein, 9 aa, Homo Sapiens
FLLCMNLYI

SEQ ID NO: 436996 - protein, 9 aa, Homo Sapiens
SLSRQTRPI

SEQ ID NO: 436997 - protein, 9 aa, Homo Sapiens
IFLPGYDKI

SEQ ID NO: 436998 - protein, 9 aa, Homo Sapiens
KYLPEGWSL

SEQ ID NO: 436999 - protein, 9 aa, Homo Sapiens
PKNGQCDMY

SEQ ID NO: 437000 - protein, 9 aa, Homo Sapiens
ITGGRARMD

SEQ ID NO: 437001 - protein, 9 aa, Homo Sapiens
RGSNIIQHQ

SEQ ID NO: 437002 - protein, 9 aa, Homo Sapiens
GTSEYLLDN

SEQ ID NO: 437003 - protein, 9 aa, Homo Sapiens
ASPGIDTPF

SEQ ID NO: 437004 - protein, 9 aa, Homo Sapiens
VFRMFDPSG

SEQ ID NO: 437005 - protein, 9 aa, Homo Sapiens
LNIHSSPFT

SEQ ID NO: 437006 - protein, 9 aa, Homo Sapiens
IAYLDKSPQ

SEQ ID NO: 437007 - protein, 9 aa, Homo Sapiens
AAYNNFQKS

SEQ ID NO: 437008 - protein, 9 aa, Homo Sapiens
LAYFSLSTC

SEQ ID NO: 437009 - protein, 9 aa, Homo Sapiens
KVMQLINEQ

SEQ ID NO: 437010 - protein, 9 aa, Homo Sapiens
NLNKYFNAG

SEQ ID NO: 437011 - protein, 9 aa, Homo Sapiens
SEWNLLEVS

SEQ ID NO: 437012 - protein, 9 aa, Homo Sapiens
TVDEIVVTK

SEQ ID NO: 437013 - protein, 9 aa, Homo Sapiens
CVDTINDYT

SEQ ID NO: 437014 - protein, 9 aa, Homo Sapiens
INESLLGLI

SEQ ID NO: 437015 - protein, 9 aa, Homo Sapiens
QEQKNKKLW

SEQ ID NO: 437016 - protein, 9 aa, Homo Sapiens
QETGTIKLG

SEQ ID NO: 437017 - protein, 9 aa, Homo Sapiens
EMRHHFQTQ

SEQ ID NO: 437018 - protein, 9 aa, Homo Sapiens
DMFDQDGIG

SEQ ID NO: 437019 - protein, 9 aa, Homo Sapiens
RNTYSVGIG

SEQ ID NO: 437020 - protein, 9 aa, Homo Sapiens
PESQIPPQI

SEQ ID NO: 437021 - protein, 9 aa, Homo Sapiens
LVQTAPKKN

SEQ ID NO: 437022 - protein, 9 aa, Homo Sapiens
ARGRARCRE

SEQ ID NO: 437023 - protein, 9 aa, Homo Sapiens
QIHHPSGAV

SEQ ID NO: 437024 - protein, 9 aa, Homo Sapiens
KHIEALHAK

SEQ ID NO: 437025 - protein, 9 aa, Homo Sapiens
VIQGLATLF

SEQ ID NO: 437026 - protein, 9 aa, Homo Sapiens
LYGGDKFAT

SEQ ID NO: 437027 - protein, 9 aa, Homo Sapiens
WTKRNDMQL

SEQ ID NO: 437028 - protein, 9 aa, Homo Sapiens
RIQKQFFHS

SEQ ID NO: 437029 - protein, 9 aa, Homo Sapiens
KAKQRTEKH

SEQ ID NO: 437030 - protein, 9 aa, Homo Sapiens
AREERFTMG

SEQ ID NO: 437031 - protein, 9 aa, Homo Sapiens
KYMKERALI

SEQ ID NO: 437032 - protein, 9 aa, Homo Sapiens
DVLRYDTIF

SEQ ID NO: 437033 - protein, 9 aa, Homo Sapiens
ALKAQLDSV

SEQ ID NO: 437034 - protein, 9 aa, Homo Sapiens
AMYKARIQY

SEQ ID NO: 437035 - protein, 9 aa, Homo Sapiens
LYPEVTPHR

SEQ ID NO: 437036 - protein, 9 aa, Homo Sapiens
SEARDSTVS

SEQ ID NO: 437037 - protein, 9 aa, Homo Sapiens
IKDLNIHVR

SEQ ID NO: 437038 - protein, 9 aa, Homo Sapiens
IFYTLRYHH

SEQ ID NO: 437039 - protein, 9 aa, Homo Sapiens
HPSGAVEYV

SEQ ID NO: 437040 - protein, 9 aa, Homo Sapiens
NNVFVFQGA

SEQ ID NO: 437041 - protein, 9 aa, Homo Sapiens
MLERGKAGW

SEQ ID NO: 437042 - protein, 9 aa, Homo Sapiens
FVLHQTALV

SEQ ID NO: 437043 - protein, 9 aa, Homo Sapiens
INTQNNYKL

SEQ ID NO: 437044 - protein, 9 aa, Homo Sapiens
PVECEKCAK

SEQ ID NO: 437045 - protein, 9 aa, Homo Sapiens
FNKQNKLKR

SEQ ID NO: 437046 - protein, 9 aa, Homo Sapiens
LAVHGTGNL

SEQ ID NO: 437047 - protein, 9 aa, Homo Sapiens
GRRRDSDYD

SEQ ID NO: 437048 - protein, 9 aa, Homo Sapiens
NVVMLVPLP

SEQ ID NO: 437049 - protein, 9 aa, Homo Sapiens
LFSIETKTT

SEQ ID NO: 437050 - protein, 9 aa, Homo Sapiens
RKQAQIQKV

SEQ ID NO: 437051 - protein, 9 aa, Homo Sapiens
GWWWARLSL

SEQ ID NO: 437052 - protein, 9 aa, Homo Sapiens
QNWLCFPDQ

SEQ ID NO: 437053 - protein, 9 aa, Homo Sapiens
YTNLMRPKT

SEQ ID NO: 437054 - protein, 9 aa, Homo Sapiens
GDHSQVLFE

SEQ ID NO: 437055 - protein, 9 aa, Homo Sapiens
EGPGAELAT

SEQ ID NO: 437056 - protein, 9 aa, Homo Sapiens
QLSQKLTRQ

SEQ ID NO: 437057 - protein, 9 aa, Homo Sapiens
MCIKEDILA

SEQ ID NO: 437058 - protein, 9 aa, Homo Sapiens
SLTAREDVS

SEQ ID NO: 437059 - protein, 9 aa, Homo Sapiens
LNLTQHIRT

SEQ ID NO: 437060 - protein, 9 aa, Homo Sapiens
AVEGMPSKL

SEQ ID NO: 437061 - protein, 9 aa, Homo Sapiens
SKSVSSTNF

SEQ ID NO: 437062 - protein, 9 aa, Homo Sapiens
RNKMTPLCI

SEQ ID NO: 437063 - protein, 9 aa, Homo Sapiens
RNYASEVVL

SEQ ID NO: 437064 - protein, 9 aa, Homo Sapiens
ILCIQRTIQ

SEQ ID NO: 437065 - protein, 9 aa, Homo Sapiens
SMIQIIFTF

SEQ ID NO: 437066 - protein, 9 aa, Homo Sapiens
VFLVSWLPF

SEQ ID NO: 437067 - protein, 9 aa, Homo Sapiens
AFGYKLKEI

SEQ ID NO: 437068 - protein, 9 aa, Homo Sapiens
KARQAQVKH

SEQ ID NO: 437069 - protein, 9 aa, Homo Sapiens
PCDVVIKAI

SEQ ID NO: 437070 - protein, 9 aa, Homo Sapiens
FFTDVYYLY

SEQ ID NO: 437071 - protein, 9 aa, Homo Sapiens
LEFGNNNLH

SEQ ID NO: 437072 - protein, 9 aa, Homo Sapiens
FIKQQRETR

SEQ ID NO: 437073 - protein, 9 aa, Homo Sapiens
RFNPETNSD

SEQ ID NO: 437074 - protein, 9 aa, Homo Sapiens
GHPGRGMDV

SEQ ID NO: 437075 - protein, 9 aa, Homo Sapiens
MISPRYPSP

SEQ ID NO: 437076 - protein, 9 aa, Homo Sapiens
EVEVKDGGG

SEQ ID NO: 437077 - protein, 9 aa, Homo Sapiens
GSGRCRHFQ

SEQ ID NO: 437078 - protein, 9 aa, Homo Sapiens
DSLVNVVCH

SEQ ID NO: 437079 - protein, 9 aa, Homo Sapiens
IVSNDISDI

SEQ ID NO: 437080 - protein, 9 aa, Homo Sapiens
AAVLSVCVR

SEQ ID NO: 437081 - protein, 9 aa, Homo Sapiens
HEVLQRCLC

SEQ ID NO: 437082 - protein, 9 aa, Homo Sapiens
QLYDYEITD

SEQ ID NO: 437083 - protein, 9 aa, Homo Sapiens
SSWEARLKA

SEQ ID NO: 437084 - protein, 9 aa, Homo Sapiens
QNVRESLED

SEQ ID NO: 437085 - protein, 9 aa, Homo Sapiens
FDECNRISV

SEQ ID NO: 437086 - protein, 9 aa, Homo Sapiens
SVVEAIKAN

SEQ ID NO: 437087 - protein, 9 aa, Homo Sapiens
LPEGYTPQT

SEQ ID NO: 437088 - protein, 9 aa, Homo Sapiens
TLSFTEMEN

SEQ ID NO: 437089 - protein, 9 aa, Homo Sapiens
DTHPNVVVT

SEQ ID NO: 437090 - protein, 9 aa, Homo Sapiens
LDWHANTIR

SEQ ID NO: 437091 - protein, 9 aa, Homo Sapiens
ATSLDRKQI

SEQ ID NO: 437092 - protein, 9 aa, Homo Sapiens
DGKEEANKC

SEQ ID NO: 437093 - protein, 9 aa, Homo Sapiens
LSISNNLFK

SEQ ID NO: 437094 - protein, 9 aa, Homo Sapiens
PRIEEQKLS

SEQ ID NO: 437095 - protein, 9 aa, Homo Sapiens
LPQSSTLEK

SEQ ID NO: 437096 - protein, 9 aa, Homo Sapiens
FLQNNRTTE

SEQ ID NO: 437097 - protein, 9 aa, Homo Sapiens
HFESCADTS

SEQ ID NO: 437098 - protein, 9 aa, Homo Sapiens
RRHPVCYGT

SEQ ID NO: 437099 - protein, 9 aa, Homo Sapiens
IVYRKARNR

SEQ ID NO: 437100 - protein, 9 aa, Homo Sapiens
VYTTSMIRN

SEQ ID NO: 437101 - protein, 9 aa, Homo Sapiens
ITLFAFSLI

SEQ ID NO: 437102 - protein, 9 aa, Homo Sapiens
YLFFRIFTP

SEQ ID NO: 437103 - protein, 9 aa, Homo Sapiens
RLNEDTIQY

SEQ ID NO: 437104 - protein, 9 aa, Homo Sapiens
ATYELNVDR

SEQ ID NO: 437105 - protein, 9 aa, Homo Sapiens
NKVIYKNKM

SEQ ID NO: 437106 - protein, 9 aa, Homo Sapiens
IFTGGVTTG

SEQ ID NO: 437107 - protein, 9 aa, Homo Sapiens
GLLHPNCKL

SEQ ID NO: 437108 - protein, 9 aa, Homo Sapiens
HTSDNLSEE

SEQ ID NO: 437109 - protein, 9 aa, Homo Sapiens
DVAIKFSLE

SEQ ID NO: 437110 - protein, 9 aa, Homo Sapiens
KASDKLLAS

SEQ ID NO: 437111 - protein, 9 aa, Homo Sapiens
VSLYFLKLT

SEQ ID NO: 437112 - protein, 9 aa, Homo Sapiens
ILDGLVEIS

SEQ ID NO: 437113 - protein, 9 aa, Homo Sapiens
ENINKYLDQ

SEQ ID NO: 437114 - protein, 9 aa, Homo Sapiens
SAIQYIRIS

SEQ ID NO: 437115 - protein, 9 aa, Homo Sapiens
KQDNNKMSA

SEQ ID NO: 437116 - protein, 9 aa, Homo Sapiens
SIIDHYKWH

SEQ ID NO: 437117 - protein, 9 aa, Homo Sapiens
WPSEEFLAT

SEQ ID NO: 437118 - protein, 9 aa, Homo Sapiens
GTIDFPKFL

SEQ ID NO: 437119 - protein, 9 aa, Homo Sapiens
NIRKEMRVV

SEQ ID NO: 437120 - protein, 9 aa, Homo Sapiens
FYLSFENAI

SEQ ID NO: 437121 - protein, 9 aa, Homo Sapiens
DKLDEQRTA

SEQ ID NO: 437122 - protein, 9 aa, Homo Sapiens
DDAHLRHDK

SEQ ID NO: 437123 - protein, 9 aa, Homo Sapiens
VAASYFIRS

SEQ ID NO: 437124 - protein, 9 aa, Homo Sapiens
HSHLTHHLQ

SEQ ID NO: 437125 - protein, 9 aa, Homo Sapiens
SFTPRYSFC

SEQ ID NO: 437126 - protein, 9 aa, Homo Sapiens
SYWVSLPGK

SEQ ID NO: 437127 - protein, 9 aa, Homo Sapiens
DFASKTKYR

SEQ ID NO: 437128 - protein, 9 aa, Homo Sapiens
NNFDTSQWE

SEQ ID NO: 437129 - protein, 9 aa, Homo Sapiens
RRWNEVCHI

SEQ ID NO: 437130 - protein, 9 aa, Homo Sapiens
ATKPTFQKK

SEQ ID NO: 437131 - protein, 9 aa, Homo Sapiens
LSKSDVVLP

SEQ ID NO: 437132 - protein, 9 aa, Homo Sapiens
YTLITILSW

SEQ ID NO: 437133 - protein, 9 aa, Homo Sapiens
NRPVFRTDR

SEQ ID NO: 437134 - protein, 9 aa, Homo Sapiens
ISILSKLRN

SEQ ID NO: 437135 - protein, 9 aa, Homo Sapiens
KGKAKTKRL

SEQ ID NO: 437136 - protein, 9 aa, Homo Sapiens
EETLALSVA

SEQ ID NO: 437137 - protein, 9 aa, Homo Sapiens
EQKNKGKFQ

SEQ ID NO: 437138 - protein, 9 aa, Homo Sapiens
AVILFYGTL

SEQ ID NO: 437139 - protein, 9 aa, Homo Sapiens
STLNSYQNV

SEQ ID NO: 437140 - protein, 9 aa, Homo Sapiens
SITLFAFSL

SEQ ID NO: 437141 - protein, 9 aa, Homo Sapiens
NIKEATEKA

SEQ ID NO: 437142 - protein, 9 aa, Homo Sapiens
LQVSRHTKF

SEQ ID NO: 437143 - protein, 9 aa, Homo Sapiens
KANKGIKEI

SEQ ID NO: 437144 - protein, 9 aa, Homo Sapiens
KEDLNITNK

SEQ ID NO: 437145 - protein, 9 aa, Homo Sapiens
VIPQYAIPC

SEQ ID NO: 437146 - protein, 9 aa, Homo Sapiens
MENSGFCED

SEQ ID NO: 437147 - protein, 9 aa, Homo Sapiens
TDNYILAAM

SEQ ID NO: 437148 - protein, 9 aa, Homo Sapiens
YNDKEHNHM

SEQ ID NO: 437149 - protein, 9 aa, Homo Sapiens
TVPNLPPTH

SEQ ID NO: 437150 - protein, 9 aa, Homo Sapiens
ERAKKLDYL

SEQ ID NO: 437151 - protein, 9 aa, Homo Sapiens
FNLYVIEDP

SEQ ID NO: 437152 - protein, 9 aa, Homo Sapiens
WNVLQGVIH

SEQ ID NO: 437153 - protein, 9 aa, Homo Sapiens
IHLMYAVRE

SEQ ID NO: 437154 - protein, 9 aa, Homo Sapiens
EYSVDRPTF

SEQ ID NO: 437155 - protein, 9 aa, Homo Sapiens
EIVVTKKSP

SEQ ID NO: 437156 - protein, 9 aa, Homo Sapiens
GKPILHAFF

SEQ ID NO: 437157 - protein, 9 aa, Homo Sapiens
EVCHISDLW

SEQ ID NO: 437158 - protein, 9 aa, Homo Sapiens
AAKLMKSIR

SEQ ID NO: 437159 - protein, 9 aa, Homo Sapiens
FSRNSSLSY

SEQ ID NO: 437160 - protein, 9 aa, Homo Sapiens
NSSLSYLSI

SEQ ID NO: 437161 - protein, 9 aa, Homo Sapiens
QINPMDVWH

SEQ ID NO: 437162 - protein, 9 aa, Homo Sapiens
SYLGGTDKE

SEQ ID NO: 437163 - protein, 9 aa, Homo Sapiens
GRANFSGML

SEQ ID NO: 437164 - protein, 9 aa, Homo Sapiens
LLSMLTSVV

SEQ ID NO: 437165 - protein, 9 aa, Homo Sapiens
KLLLLAGPS

SEQ ID NO: 437166 - protein, 9 aa, Homo Sapiens
MVIPLVFQI

SEQ ID NO: 437167 - protein, 9 aa, Homo Sapiens
LQILRKRNK

SEQ ID NO: 437168 - protein, 9 aa, Homo Sapiens
FNRIKRKDF

SEQ ID NO: 437169 - protein, 9 aa, Homo Sapiens
TKIESNTPA

SEQ ID NO: 437170 - protein, 9 aa, Homo Sapiens
HFRASYAAE

SEQ ID NO: 437171 - protein, 9 aa, Homo Sapiens
RSLKNIKRT

SEQ ID NO: 437172 - protein, 9 aa, Homo Sapiens
ISGGVLNDW

SEQ ID NO: 437173 - protein, 9 aa, Homo Sapiens
LTLENVKSQ

SEQ ID NO: 437174 - protein, 9 aa, Homo Sapiens
TMFEHCSIH

SEQ ID NO: 437175 - protein, 9 aa, Homo Sapiens
QEKHQDVLI

SEQ ID NO: 437176 - protein, 9 aa, Homo Sapiens
VEGSNKTDV

SEQ ID NO: 437177 - protein, 9 aa, Homo Sapiens
PKKEIILAM

SEQ ID NO: 437178 - protein, 9 aa, Homo Sapiens
GCGGNGLFF

SEQ ID NO: 437179 - protein, 9 aa, Homo Sapiens
TGRPLKDCI

SEQ ID NO: 437180 - protein, 9 aa, Homo Sapiens
LFWEINWEE

SEQ ID NO: 437181 - protein, 9 aa, Homo Sapiens
AIGSRQHYC

SEQ ID NO: 437182 - protein, 9 aa, Homo Sapiens
TPGGNRLHN

SEQ ID NO: 437183 - protein, 9 aa, Homo Sapiens
FIFGIQDFL

SEQ ID NO: 437184 - protein, 9 aa, Homo Sapiens
PEIRNTLPA

SEQ ID NO: 437185 - protein, 9 aa, Homo Sapiens
VSKPQTLTS

SEQ ID NO: 437186 - protein, 9 aa, Homo Sapiens
TYVFQYAAK

SEQ ID NO: 437187 - protein, 9 aa, Homo Sapiens
DVKVKKRNT

SEQ ID NO: 437188 - protein, 9 aa, Homo Sapiens
KDIVDNYFM

SEQ ID NO: 437189 - protein, 9 aa, Homo Sapiens
SFENAIHKD

SEQ ID NO: 437190 - protein, 9 aa, Homo Sapiens
SQECGEELW

SEQ ID NO: 437191 - protein, 9 aa, Homo Sapiens
FYLGLEDVL

SEQ ID NO: 437192 - protein, 9 aa, Homo Sapiens
CLTTTQSGI

SEQ ID NO: 437193 - protein, 9 aa, Homo Sapiens
YALVILIPI

SEQ ID NO: 437194 - protein, 9 aa, Homo Sapiens
LDKLHFMQK

SEQ ID NO: 437195 - protein, 9 aa, Homo Sapiens
SVTQRVEDQ

SEQ ID NO: 437196 - protein, 9 aa, Homo Sapiens
HQIMHTGEK

SEQ ID NO: 437197 - protein, 9 aa, Homo Sapiens
RTAALPTFC

SEQ ID NO: 437198 - protein, 9 aa, Homo Sapiens
QPTGTVPLL

SEQ ID NO: 437199 - protein, 9 aa, Homo Sapiens
NEWIYVVDM

SEQ ID NO: 437200 - protein, 9 aa, Homo Sapiens
HWRHYHTGE

SEQ ID NO: 437201 - protein, 9 aa, Homo Sapiens
PKVPASVQT

SEQ ID NO: 437202 - protein, 9 aa, Homo Sapiens
IAAFSNWIC

SEQ ID NO: 437203 - protein, 9 aa, Homo Sapiens
SHLRYGMSD

SEQ ID NO: 437204 - protein, 9 aa, Homo Sapiens
KDMIDYFCD

SEQ ID NO: 437205 - protein, 9 aa, Homo Sapiens
EGELQHTRK

SEQ ID NO: 437206 - protein, 9 aa, Homo Sapiens
HICKMPLQS

SEQ ID NO: 437207 - protein, 9 aa, Homo Sapiens
QHSDKIIQL

SEQ ID NO: 437208 - protein, 9 aa, Homo Sapiens
MPSALGTTI

SEQ ID NO: 437209 - protein, 9 aa, Homo Sapiens
LSVFRMFDP

SEQ ID NO: 437210 - protein, 9 aa, Homo Sapiens
QEAWEQHHL

SEQ ID NO: 437211 - protein, 9 aa, Homo Sapiens
WGIDYHSRM

SEQ ID NO: 437212 - protein, 9 aa, Homo Sapiens
IQTPPPLSL

SEQ ID NO: 437213 - protein, 9 aa, Homo Sapiens
GGASGASKP

SEQ ID NO: 437214 - protein, 9 aa, Homo Sapiens
TMLTVRSVD

SEQ ID NO: 437215 - protein, 9 aa, Homo Sapiens
SVDIPKARR

SEQ ID NO: 437216 - protein, 9 aa, Homo Sapiens
LSSLPIYLP

SEQ ID NO: 437217 - protein, 9 aa, Homo Sapiens
KIIVVECMM

SEQ ID NO: 437218 - protein, 9 aa, Homo Sapiens
QHQIMHTGE

SEQ ID NO: 437219 - protein, 9 aa, Homo Sapiens
NMQLTLHKI

SEQ ID NO: 437220 - protein, 9 aa, Homo Sapiens
DRAALLKRF

SEQ ID NO: 437221 - protein, 9 aa, Homo Sapiens
GLRCIWLQS

SEQ ID NO: 437222 - protein, 9 aa, Homo Sapiens
LQQNQKTQP

SEQ ID NO: 437223 - protein, 9 aa, Homo Sapiens
WALPSLPMV

SEQ ID NO: 437224 - protein, 9 aa, Homo Sapiens
RSCTPTYSM

SEQ ID NO: 437225 - protein, 9 aa, Homo Sapiens
EYPSYQENR

SEQ ID NO: 437226 - protein, 9 aa, Homo Sapiens
SWRVFQFQP

SEQ ID NO: 437227 - protein, 9 aa, Homo Sapiens
NSPLTNQLG

SEQ ID NO: 437228 - protein, 9 aa, Homo Sapiens
NTSQRGKSG

SEQ ID NO: 437229 - protein, 9 aa, Homo Sapiens
QQLEVWDLD

SEQ ID NO: 437230 - protein, 9 aa, Homo Sapiens
KQSELFNRW

SEQ ID NO: 437231 - protein, 9 aa, Homo Sapiens
NHLLLQNNV

SEQ ID NO: 437232 - protein, 9 aa, Homo Sapiens
SEIPLQKQN

SEQ ID NO: 437233 - protein, 9 aa, Homo Sapiens
PLRLGIKRK

SEQ ID NO: 437234 - protein, 9 aa, Homo Sapiens
KSLEECMAN

SEQ ID NO: 437235 - protein, 9 aa, Homo Sapiens
DFMRQQQTI

SEQ ID NO: 437236 - protein, 9 aa, Homo Sapiens
QPKIKGSFV

SEQ ID NO: 437237 - protein, 9 aa, Homo Sapiens
KLHGFTVNQ

SEQ ID NO: 437238 - protein, 9 aa, Homo Sapiens
AQCVDTIND

SEQ ID NO: 437239 - protein, 9 aa, Homo Sapiens
VGNTFVLHQ

SEQ ID NO: 437240 - protein, 9 aa, Homo Sapiens
LCYSNDKTL

SEQ ID NO: 437241 - protein, 9 aa, Homo Sapiens
METAECNGQ

SEQ ID NO: 437242 - protein, 9 aa, Homo Sapiens
HFQNAYLLN

SEQ ID NO: 437243 - protein, 9 aa, Homo Sapiens
CLGIHLPLP

SEQ ID NO: 437244 - protein, 9 aa, Homo Sapiens
FSKYQKTAE

SEQ ID NO: 437245 - protein, 9 aa, Homo Sapiens
IILKMKYFQ

SEQ ID NO: 437246 - protein, 9 aa, Homo Sapiens
LVTLRTYFS

SEQ ID NO: 437247 - protein, 9 aa, Homo Sapiens
ALHFALLMA

SEQ ID NO: 437248 - protein, 9 aa, Homo Sapiens
VDSSADSGT

SEQ ID NO: 437249 - protein, 9 aa, Homo Sapiens
LNETDHSDE

SEQ ID NO: 437250 - protein, 9 aa, Homo Sapiens
GTLYSWPWW

SEQ ID NO: 437251 - protein, 9 aa, Homo Sapiens
QGKLLQNWL

SEQ ID NO: 437252 - protein, 9 aa, Homo Sapiens
QKHRICVCV

SEQ ID NO: 437253 - protein, 9 aa, Homo Sapiens
LHQLYLQMH

SEQ ID NO: 437254 - protein, 9 aa, Homo Sapiens
RKRSLNHLV

SEQ ID NO: 437255 - protein, 9 aa, Homo Sapiens
YFQSSCYLF

SEQ ID NO: 437256 - protein, 9 aa, Homo Sapiens
RVSYLVKDL

SEQ ID NO: 437257 - protein, 9 aa, Homo Sapiens
SDQYVKIKR

SEQ ID NO: 437258 - protein, 9 aa, Homo Sapiens
HSDKIIQLY

SEQ ID NO: 437259 - protein, 9 aa, Homo Sapiens
SVVSWIYIL

SEQ ID NO: 437260 - protein, 9 aa, Homo Sapiens
GSAEDSKGI

SEQ ID NO: 437261 - protein, 9 aa, Homo Sapiens
IFTQKSSIT

SEQ ID NO: 437262 - protein, 9 aa, Homo Sapiens
CVARVDLRK

SEQ ID NO: 437263 - protein, 9 aa, Homo Sapiens
ESGAGKTKN

SEQ ID NO: 437264 - protein, 9 aa, Homo Sapiens
RYHFCEKCL

SEQ ID NO: 437265 - protein, 9 aa, Homo Sapiens
IPRAQAHKA

SEQ ID NO: 437266 - protein, 9 aa, Homo Sapiens
MLSRPFRKH

SEQ ID NO: 437267 - protein, 9 aa, Homo Sapiens
VKDEQLNLE

SEQ ID NO: 437268 - protein, 9 aa, Homo Sapiens
NNRPQELCT

SEQ ID NO: 437269 - protein, 9 aa, Homo Sapiens
EKEIILGVL

SEQ ID NO: 437270 - protein, 9 aa, Homo Sapiens
LKYLEAASE

SEQ ID NO: 437271 - protein, 9 aa, Homo Sapiens
CSLHMFRFP

SEQ ID NO: 437272 - protein, 9 aa, Homo Sapiens
LISRINFCR

SEQ ID NO: 437273 - protein, 9 aa, Homo Sapiens
AARRSLGLQ

SEQ ID NO: 437274 - protein, 9 aa, Homo Sapiens
LVMKNDTDT

SEQ ID NO: 437275 - protein, 9 aa, Homo Sapiens
LFVQLPSNT

SEQ ID NO: 437276 - protein, 9 aa, Homo Sapiens
IQAYFYDLH

SEQ ID NO: 437277 - protein, 9 aa, Homo Sapiens
SALWMLLGL

SEQ ID NO: 437278 - protein, 9 aa, Homo Sapiens
DEQHGLCDK

SEQ ID NO: 437279 - protein, 9 aa, Homo Sapiens
VVLEDSIDP

SEQ ID NO: 437280 - protein, 9 aa, Homo Sapiens
HMFRFPMDS

SEQ ID NO: 437281 - protein, 9 aa, Homo Sapiens
LAMSLACYN

SEQ ID NO: 437282 - protein, 9 aa, Homo Sapiens
SPLFPSLCV

SEQ ID NO: 437283 - protein, 9 aa, Homo Sapiens
NGCIDHLEL

SEQ ID NO: 437284 - protein, 9 aa, Homo Sapiens
KDRGISIPR

SEQ ID NO: 437285 - protein, 9 aa, Homo Sapiens
PTYSMQGRA

SEQ ID NO: 437286 - protein, 9 aa, Homo Sapiens
ILKEKWSAP

SEQ ID NO: 437287 - protein, 9 aa, Homo Sapiens
QQKLVGLDK

SEQ ID NO: 437288 - protein, 9 aa, Homo Sapiens
VVHKDYGKK

SEQ ID NO: 437289 - protein, 9 aa, Homo Sapiens
KKFKMESGE

SEQ ID NO: 437290 - protein, 9 aa, Homo Sapiens
DKYFFGGFL

SEQ ID NO: 437291 - protein, 9 aa, Homo Sapiens
NNMLCAGFH

SEQ ID NO: 437292 - protein, 9 aa, Homo Sapiens
GKILCLFQG

SEQ ID NO: 437293 - protein, 9 aa, Homo Sapiens
DLILELIAY

SEQ ID NO: 437294 - protein, 9 aa, Homo Sapiens
VLQRDEISE

SEQ ID NO: 437295 - protein, 9 aa, Homo Sapiens
LNCPDGITK

SEQ ID NO: 437296 - protein, 9 aa, Homo Sapiens
SYNGYFVTP

SEQ ID NO: 437297 - protein, 9 aa, Homo Sapiens
FNATDVLRC

SEQ ID NO: 437298 - protein, 9 aa, Homo Sapiens
YFFHKRYWK

SEQ ID NO: 437299 - protein, 9 aa, Homo Sapiens
SDQYKGDGS

SEQ ID NO: 437300 - protein, 9 aa, Homo Sapiens
STGSTDRDG

SEQ ID NO: 437301 - protein, 9 aa, Homo Sapiens
GIFHFFFFV

SEQ ID NO: 437302 - protein, 9 aa, Homo Sapiens
QATVQARYF

SEQ ID NO: 437303 - protein, 9 aa, Homo Sapiens
NKAMLRPAL

SEQ ID NO: 437304 - protein, 9 aa, Homo Sapiens
NNRNDLQKV

SEQ ID NO: 437305 - protein, 9 aa, Homo Sapiens
LGCIWSLQL

SEQ ID NO: 437306 - protein, 9 aa, Homo Sapiens
TLDKINADL

SEQ ID NO: 437307 - protein, 9 aa, Homo Sapiens
LVDCFVSHP

SEQ ID NO: 437308 - protein, 9 aa, Homo Sapiens
EKSNQIKAK

SEQ ID NO: 437309 - protein, 9 aa, Homo Sapiens
ITSLFPDME

SEQ ID NO: 437310 - protein, 9 aa, Homo Sapiens
QKDIEQSIT

SEQ ID NO: 437311 - protein, 9 aa, Homo Sapiens
QCIVPICIN

SEQ ID NO: 437312 - protein, 9 aa, Homo Sapiens
ANAVVVESS

SEQ ID NO: 437313 - protein, 9 aa, Homo Sapiens
QPSTRDRVW

SEQ ID NO: 437314 - protein, 9 aa, Homo Sapiens
GFGLEMASA

SEQ ID NO: 437315 - protein, 9 aa, Homo Sapiens
NQRGCFLRI

SEQ ID NO: 437316 - protein, 9 aa, Homo Sapiens
DSGVVSRES

SEQ ID NO: 437317 - protein, 9 aa, Homo Sapiens
KYLNFTASD

SEQ ID NO: 437318 - protein, 9 aa, Homo Sapiens
AVWGDYGGS

SEQ ID NO: 437319 - protein, 9 aa, Homo Sapiens
LCDVIMETP

SEQ ID NO: 437320 - protein, 9 aa, Homo Sapiens
LETLTEYFQ

SEQ ID NO: 437321 - protein, 9 aa, Homo Sapiens
GGVSWDITE

SEQ ID NO: 437322 - protein, 9 aa, Homo Sapiens
ALYRQRSQT

SEQ ID NO: 437323 - protein, 9 aa, Homo Sapiens
PCYEITSVP

SEQ ID NO: 437324 - protein, 9 aa, Homo Sapiens
NKEMDSDQQ

SEQ ID NO: 437325 - protein, 9 aa, Homo Sapiens
INEKSYQLK

SEQ ID NO: 437326 - protein, 9 aa, Homo Sapiens
SLPDICHAN

SEQ ID NO: 437327 - protein, 9 aa, Homo Sapiens
KIILLKGFE

SEQ ID NO: 437328 - protein, 9 aa, Homo Sapiens
TIDDEKLQN

SEQ ID NO: 437329 - protein, 9 aa, Homo Sapiens
VLLSGEVSG

SEQ ID NO: 437330 - protein, 9 aa, Homo Sapiens
PYLFFRIFT

SEQ ID NO: 437331 - protein, 9 aa, Homo Sapiens
IIHTEERYH

SEQ ID NO: 437332 - protein, 9 aa, Homo Sapiens
NLKSQPPLP

SEQ ID NO: 437333 - protein, 9 aa, Homo Sapiens
KDNIYPTFQ

SEQ ID NO: 437334 - protein, 9 aa, Homo Sapiens
LDHRLSATL

SEQ ID NO: 437335 - protein, 9 aa, Homo Sapiens
DPSFGDTIA

SEQ ID NO: 437336 - protein, 9 aa, Homo Sapiens
LHQRQEIIQ

SEQ ID NO: 437337 - protein, 9 aa, Homo Sapiens
NYHKAGTVM

SEQ ID NO: 437338 - protein, 9 aa, Homo Sapiens
KNLNRAKEA

SEQ ID NO: 437339 - protein, 9 aa, Homo Sapiens
ANNSISVLL

SEQ ID NO: 437340 - protein, 9 aa, Homo Sapiens
IREVHKRND

SEQ ID NO: 437341 - protein, 9 aa, Homo Sapiens
FYYLQQGSH

SEQ ID NO: 437342 - protein, 9 aa, Homo Sapiens
TDDCRYKFH

SEQ ID NO: 437343 - protein, 9 aa, Homo Sapiens
QSRSRDRRR

SEQ ID NO: 437344 - protein, 9 aa, Homo Sapiens
IHHIIHTGE

SEQ ID NO: 437345 - protein, 9 aa, Homo Sapiens
HKLPKLLCM

SEQ ID NO: 437346 - protein, 9 aa, Homo Sapiens
KTLWERYTH

SEQ ID NO: 437347 - protein, 9 aa, Homo Sapiens
PNLNHTPNL

SEQ ID NO: 437348 - protein, 9 aa, Homo Sapiens
SLGDAINHL

SEQ ID NO: 437349 - protein, 9 aa, Homo Sapiens
VFATPVLSM

SEQ ID NO: 437350 - protein, 9 aa, Homo Sapiens
EHDHRITSQ

SEQ ID NO: 437351 - protein, 9 aa, Homo Sapiens
DELRPTVVH

SEQ ID NO: 437352 - protein, 9 aa, Homo Sapiens
CWKYSDYNI

SEQ ID NO: 437353 - protein, 9 aa, Homo Sapiens
REGANDSYD

SEQ ID NO: 437354 - protein, 9 aa, Homo Sapiens
SSLEEDHII

SEQ ID NO: 437355 - protein, 9 aa, Homo Sapiens
SVHTLVFRL

SEQ ID NO: 437356 - protein, 9 aa, Homo Sapiens
LNEYKEQFF

SEQ ID NO: 437357 - protein, 9 aa, Homo Sapiens
CTPLCLRVH

SEQ ID NO: 437358 - protein, 9 aa, Homo Sapiens
DPKKGCWCQ

SEQ ID NO: 437359 - protein, 9 aa, Homo Sapiens
VTSNALPLK

SEQ ID NO: 437360 - protein, 9 aa, Homo Sapiens
GSNIVPGKA

SEQ ID NO: 437361 - protein, 9 aa, Homo Sapiens
ILSLCSPSV

SEQ ID NO: 437362 - protein, 9 aa, Homo Sapiens
FLVGILNQL

SEQ ID NO: 437363 - protein, 9 aa, Homo Sapiens
FADRCSSLI

SEQ ID NO: 437364 - protein, 9 aa, Homo Sapiens
CTHASQLHN

SEQ ID NO: 437365 - protein, 9 aa, Homo Sapiens
LQAYSHGGL

SEQ ID NO: 437366 - protein, 9 aa, Homo Sapiens
QEYGTAGVS

SEQ ID NO: 437367 - protein, 9 aa, Homo Sapiens
VEIMFNERG

SEQ ID NO: 437368 - protein, 9 aa, Homo Sapiens
DPHLQIPMY

SEQ ID NO: 437369 - protein, 9 aa, Homo Sapiens
VLDQLLMAC

SEQ ID NO: 437370 - protein, 9 aa, Homo Sapiens
EGSEHGTSL

SEQ ID NO: 437371 - protein, 9 aa, Homo Sapiens
GLIYLTGPY

SEQ ID NO: 437372 - protein, 9 aa, Homo Sapiens
SFDNSPGDL

SEQ ID NO: 437373 - protein, 9 aa, Homo Sapiens
SQPPLPEQS

SEQ ID NO: 437374 - protein, 9 aa, Homo Sapiens
HLIKVFAKT

SEQ ID NO: 437375 - protein, 9 aa, Homo Sapiens
GSQVLARII

SEQ ID NO: 437376 - protein, 9 aa, Homo Sapiens
LDYRIRAQK

SEQ ID NO: 437377 - protein, 9 aa, Homo Sapiens
AEQPTRYDT

SEQ ID NO: 437378 - protein, 9 aa, Homo Sapiens
SFFLQFAPD

SEQ ID NO: 437379 - protein, 9 aa, Homo Sapiens
KAVHEPGSP

SEQ ID NO: 437380 - protein, 9 aa, Homo Sapiens
FQDTLKIPY

SEQ ID NO: 437381 - protein, 9 aa, Homo Sapiens
KEEANKCAY

SEQ ID NO: 437382 - protein, 9 aa, Homo Sapiens
SYFIRSLDH

SEQ ID NO: 437383 - protein, 9 aa, Homo Sapiens
APGARAREQ

SEQ ID NO: 437384 - protein, 9 aa, Homo Sapiens
NWQENQKQC

SEQ ID NO: 437385 - protein, 9 aa, Homo Sapiens
ECMRSFNRS

SEQ ID NO: 437386 - protein, 9 aa, Homo Sapiens
FTEKLNNQA

SEQ ID NO: 437387 - protein, 9 aa, Homo Sapiens
ERLVRVGPP

SEQ ID NO: 437388 - protein, 9 aa, Homo Sapiens
FKHNKIQHM

SEQ ID NO: 437389 - protein, 9 aa, Homo Sapiens
SLLRQTIAA

SEQ ID NO: 437390 - protein, 9 aa, Homo Sapiens
PKKGCWCQL

SEQ ID NO: 437391 - protein, 9 aa, Homo Sapiens
LFVYLGSSE

SEQ ID NO: 437392 - protein, 9 aa, Homo Sapiens
SFVMGATEC

SEQ ID NO: 437393 - protein, 9 aa, Homo Sapiens
REHVCIRAY

SEQ ID NO: 437394 - protein, 9 aa, Homo Sapiens
GLWHPQCRL

SEQ ID NO: 437395 - protein, 9 aa, Homo Sapiens
GQSAPVRLV

SEQ ID NO: 437396 - protein, 9 aa, Homo Sapiens
AIIRHRSAL

SEQ ID NO: 437397 - protein, 9 aa, Homo Sapiens
PKPSTVQVC

SEQ ID NO: 437398 - protein, 9 aa, Homo Sapiens
TENIEVITH

SEQ ID NO: 437399 - protein, 9 aa, Homo Sapiens
LHNQICEVL

SEQ ID NO: 437400 - protein, 9 aa, Homo Sapiens
RTSENTHRR

SEQ ID NO: 437401 - protein, 9 aa, Homo Sapiens
EDEGPGAEL

SEQ ID NO: 437402 - protein, 9 aa, Homo Sapiens
LHHLHQFQQ

SEQ ID NO: 437403 - protein, 9 aa, Homo Sapiens
TPNMITDYL

SEQ ID NO: 437404 - protein, 9 aa, Homo Sapiens
DCKNKTTKP

SEQ ID NO: 437405 - protein, 9 aa, Homo Sapiens
ACRYMAGVI

SEQ ID NO: 437406 - protein, 9 aa, Homo Sapiens
TPTIPLGSV

SEQ ID NO: 437407 - protein, 9 aa, Homo Sapiens
LLWLYVQNQ

SEQ ID NO: 437408 - protein, 9 aa, Homo Sapiens
GSVVEAIKA

SEQ ID NO: 437409 - protein, 9 aa, Homo Sapiens
AKYEELLVW

SEQ ID NO: 437410 - protein, 9 aa, Homo Sapiens
NNARDTIVM

SEQ ID NO: 437411 - protein, 9 aa, Homo Sapiens
MYYVSPIAY

SEQ ID NO: 437412 - protein, 9 aa, Homo Sapiens
HLTDEGQQY

SEQ ID NO: 437413 - protein, 9 aa, Homo Sapiens
SQHPKKKNK

SEQ ID NO: 437414 - protein, 9 aa, Homo Sapiens
LLICRCNIE

SEQ ID NO: 437415 - protein, 9 aa, Homo Sapiens
FLHTYSHEV

SEQ ID NO: 437416 - protein, 9 aa, Homo Sapiens
GLSLIDFFV

SEQ ID NO: 437417 - protein, 9 aa, Homo Sapiens
APDLFGDTP

SEQ ID NO: 437418 - protein, 9 aa, Homo Sapiens
HKAGTVMFE

SEQ ID NO: 437419 - protein, 9 aa, Homo Sapiens
LFFFILNFW

SEQ ID NO: 437420 - protein, 9 aa, Homo Sapiens
NFRSKLYEY

SEQ ID NO: 437421 - protein, 9 aa, Homo Sapiens
CGDMEQIRR

SEQ ID NO: 437422 - protein, 9 aa, Homo Sapiens
AIKEGNLST

SEQ ID NO: 437423 - protein, 9 aa, Homo Sapiens
VPIDIGPSP

SEQ ID NO: 437424 - protein, 9 aa, Homo Sapiens
INIDFKELA

SEQ ID NO: 437425 - protein, 9 aa, Homo Sapiens
VDTRIQGFP

SEQ ID NO: 437426 - protein, 9 aa, Homo Sapiens
FFYFHIGWV

SEQ ID NO: 437427 - protein, 9 aa, Homo Sapiens
PLWKKRSAL

SEQ ID NO: 437428 - protein, 9 aa, Homo Sapiens
KLSSQREEE

SEQ ID NO: 437429 - protein, 9 aa, Homo Sapiens
LVGILNQLN

SEQ ID NO: 437430 - protein, 9 aa, Homo Sapiens
KKRKTLAER

SEQ ID NO: 437431 - protein, 9 aa, Homo Sapiens
SGLTLIHHN

SEQ ID NO: 437432 - protein, 9 aa, Homo Sapiens
FFSLYFGLR

SEQ ID NO: 437433 - protein, 9 aa, Homo Sapiens
RLPKRLRAV

SEQ ID NO: 437434 - protein, 9 aa, Homo Sapiens
TCGLMTAFS

SEQ ID NO: 437435 - protein, 9 aa, Homo Sapiens
EVSADVFMS

SEQ ID NO: 437436 - protein, 9 aa, Homo Sapiens
NGIKPSATA

SEQ ID NO: 437437 - protein, 9 aa, Homo Sapiens
KLNHSLDKD

SEQ ID NO: 437438 - protein, 9 aa, Homo Sapiens
FIMLREICD

SEQ ID NO: 437439 - protein, 9 aa, Homo Sapiens
TYAIVERLN

SEQ ID NO: 437440 - protein, 9 aa, Homo Sapiens
NSMLTDPEN

SEQ ID NO: 437441 - protein, 9 aa, Homo Sapiens
VQEDMSTNP

SEQ ID NO: 437442 - protein, 9 aa, Homo Sapiens
GSTDRDGIQ

SEQ ID NO: 437443 - protein, 9 aa, Homo Sapiens
VDSEVECPR

SEQ ID NO: 437444 - protein, 9 aa, Homo Sapiens
DNFFEICDE

SEQ ID NO: 437445 - protein, 9 aa, Homo Sapiens
KVAFGYLAA

SEQ ID NO: 437446 - protein, 9 aa, Homo Sapiens
KALFVMTLN

SEQ ID NO: 437447 - protein, 9 aa, Homo Sapiens
PSASPTSIQ

SEQ ID NO: 437448 - protein, 9 aa, Homo Sapiens
KVQFKISSS

SEQ ID NO: 437449 - protein, 9 aa, Homo Sapiens
FKSLEEIDS

SEQ ID NO: 437450 - protein, 9 aa, Homo Sapiens
IYISTTQIA

SEQ ID NO: 437451 - protein, 9 aa, Homo Sapiens
TKLLWISYS

SEQ ID NO: 437452 - protein, 9 aa, Homo Sapiens
VWKTSSFLD

SEQ ID NO: 437453 - protein, 9 aa, Homo Sapiens
YMDRAENIN

SEQ ID NO: 437454 - protein, 9 aa, Homo Sapiens
KNGNLEVGV

SEQ ID NO: 437455 - protein, 9 aa, Homo Sapiens
IPHKRLCQP

SEQ ID NO: 437456 - protein, 9 aa, Homo Sapiens
GNGLSYSPA

SEQ ID NO: 437457 - protein, 9 aa, Homo Sapiens
PNLQSLIST

SEQ ID NO: 437458 - protein, 9 aa, Homo Sapiens
RRCTRGTPP

SEQ ID NO: 437459 - protein, 9 aa, Homo Sapiens
PKDREVPTR

SEQ ID NO: 437460 - protein, 9 aa, Homo Sapiens
HHRVHTEKK

SEQ ID NO: 437461 - protein, 9 aa, Homo Sapiens
APQNTFLDN

SEQ ID NO: 437462 - protein, 9 aa, Homo Sapiens
VLPDWKGWS

SEQ ID NO: 437463 - protein, 9 aa, Homo Sapiens
FQGLLGKIS

SEQ ID NO: 437464 - protein, 9 aa, Homo Sapiens
ANSFQAGYG

SEQ ID NO: 437465 - protein, 9 aa, Homo Sapiens
TQNKVRKTF

SEQ ID NO: 437466 - protein, 9 aa, Homo Sapiens
SEYSIFDNY

SEQ ID NO: 437467 - protein, 9 aa, Homo Sapiens
TTSVLSLAD

SEQ ID NO: 437468 - protein, 9 aa, Homo Sapiens
NATKPTFQK

SEQ ID NO: 437469 - protein, 9 aa, Homo Sapiens
NPQLQMASP

SEQ ID NO: 437470 - protein, 9 aa, Homo Sapiens
NEFLVDLIY

SEQ ID NO: 437471 - protein, 9 aa, Homo Sapiens
CDPKCIEDV

SEQ ID NO: 437472 - protein, 9 aa, Homo Sapiens
YIEVVNVND

SEQ ID NO: 437473 - protein, 9 aa, Homo Sapiens
TVIVLEAKH

SEQ ID NO: 437474 - protein, 9 aa, Homo Sapiens
PATQPIPII

SEQ ID NO: 437475 - protein, 9 aa, Homo Sapiens
VNVVCHTCF

SEQ ID NO: 437476 - protein, 9 aa, Homo Sapiens
LSGSVLDCV

SEQ ID NO: 437477 - protein, 9 aa, Homo Sapiens
WQLEQSIRE

SEQ ID NO: 437478 - protein, 9 aa, Homo Sapiens
LSLYISPSG

SEQ ID NO: 437479 - protein, 9 aa, Homo Sapiens
KVWDVEKSF

SEQ ID NO: 437480 - protein, 9 aa, Homo Sapiens
EVLDQGDLY

SEQ ID NO: 437481 - protein, 9 aa, Homo Sapiens
SLVHFSPNM

SEQ ID NO: 437482 - protein, 9 aa, Homo Sapiens
EKLTTASEH

SEQ ID NO: 437483 - protein, 9 aa, Homo Sapiens
MTTVSYLKT

SEQ ID NO: 437484 - protein, 9 aa, Homo Sapiens
RSASDNLDE

SEQ ID NO: 437485 - protein, 9 aa, Homo Sapiens
AVQKESGHS

SEQ ID NO: 437486 - protein, 9 aa, Homo Sapiens
NLSRMPIVT

SEQ ID NO: 437487 - protein, 9 aa, Homo Sapiens
AETTARYNF

SEQ ID NO: 437488 - protein, 9 aa, Homo Sapiens
SSDILHHEY

SEQ ID NO: 437489 - protein, 9 aa, Homo Sapiens
HYKLASNEF

SEQ ID NO: 437490 - protein, 9 aa, Homo Sapiens
YYETCATYE

SEQ ID NO: 437491 - protein, 9 aa, Homo Sapiens
LVGNNCDLP

SEQ ID NO: 437492 - protein, 9 aa, Homo Sapiens
ALVLHQMIH

SEQ ID NO: 437493 - protein, 9 aa, Homo Sapiens
VQNRRIYDI

SEQ ID NO: 437494 - protein, 9 aa, Homo Sapiens
PEDAVSVRS

SEQ ID NO: 437495 - protein, 9 aa, Homo Sapiens
MRIGLDLPD

SEQ ID NO: 437496 - protein, 9 aa, Homo Sapiens
ENASISSIS

SEQ ID NO: 437497 - protein, 9 aa, Homo Sapiens
LKPGGTPQE

SEQ ID NO: 437498 - protein, 9 aa, Homo Sapiens
THPNVVVTE

SEQ ID NO: 437499 - protein, 9 aa, Homo Sapiens
NNDDSDILD

SEQ ID NO: 437500 - protein, 9 aa, Homo Sapiens
QDKQIEERM

SEQ ID NO: 437501 - protein, 9 aa, Homo Sapiens
ERKFNLYVI

SEQ ID NO: 437502 - protein, 9 aa, Homo Sapiens
VHSENPEWL

SEQ ID NO: 437503 - protein, 9 aa, Homo Sapiens
ANDSYDFFT

SEQ ID NO: 437504 - protein, 9 aa, Homo Sapiens
AKSNVETAK

SEQ ID NO: 437505 - protein, 9 aa, Homo Sapiens
ERDESSGPN

SEQ ID NO: 437506 - protein, 9 aa, Homo Sapiens
EDEILEELK

SEQ ID NO: 437507 - protein, 9 aa, Homo Sapiens
RTTAAQENP

SEQ ID NO: 437508 - protein, 9 aa, Homo Sapiens
LNPTDYDNE

SEQ ID NO: 437509 - protein, 9 aa, Homo Sapiens
DLVNTYAIV

SEQ ID NO: 437510 - protein, 9 aa, Homo Sapiens
VEKIAFYRL

SEQ ID NO: 437511 - protein, 9 aa, Homo Sapiens
DAVCQLHME

SEQ ID NO: 437512 - protein, 9 aa, Homo Sapiens
KVLLSGEVS

SEQ ID NO: 437513 - protein, 9 aa, Homo Sapiens
ARQRCKALK

SEQ ID NO: 437514 - protein, 9 aa, Homo Sapiens
LSESQTVLS

SEQ ID NO: 437515 - protein, 9 aa, Homo Sapiens
FRNSNERLG

SEQ ID NO: 437516 - protein, 9 aa, Homo Sapiens
ENYNETEPV

SEQ ID NO: 437517 - protein, 9 aa, Homo Sapiens
QIIHTGDKP

SEQ ID NO: 437518 - protein, 9 aa, Homo Sapiens
AIKFSLEEW

SEQ ID NO: 437519 - protein, 9 aa, Homo Sapiens
HTDPVPQVV

SEQ ID NO: 437520 - protein, 9 aa, Homo Sapiens
NFRFGTIPV

SEQ ID NO: 437521 - protein, 9 aa, Homo Sapiens
NYKKDEMYR

SEQ ID NO: 437522 - protein, 9 aa, Homo Sapiens
FDGSENIPF

SEQ ID NO: 437523 - protein, 9 aa, Homo Sapiens
VLQRCLCAG

SEQ ID NO: 437524 - protein, 9 aa, Homo Sapiens
INTTWNCGY

SEQ ID NO: 437525 - protein, 9 aa, Homo Sapiens
MLMKMHGLG

SEQ ID NO: 437526 - protein, 9 aa, Homo Sapiens
SRSMMDRMV

SEQ ID NO: 437527 - protein, 9 aa, Homo Sapiens
KLIIHQRIN

SEQ ID NO: 437528 - protein, 9 aa, Homo Sapiens
LHTALMLNK

SEQ ID NO: 437529 - protein, 9 aa, Homo Sapiens
QKPCKDTVQ

SEQ ID NO: 437530 - protein, 9 aa, Homo Sapiens
TGYDIAMQK

SEQ ID NO: 437531 - protein, 9 aa, Homo Sapiens
DSQNYFASC

SEQ ID NO: 437532 - protein, 9 aa, Homo Sapiens
DNWKRYKEE

SEQ ID NO: 437533 - protein, 9 aa, Homo Sapiens
NTLGLNPRT

SEQ ID NO: 437534 - protein, 9 aa, Homo Sapiens
NQIVVIKKI

SEQ ID NO: 437535 - protein, 9 aa, Homo Sapiens
CEGMIQMFQ

SEQ ID NO: 437536 - protein, 9 aa, Homo Sapiens
EHGSSSPRL

SEQ ID NO: 437537 - protein, 9 aa, Homo Sapiens
PSRYGTNNI

SEQ ID NO: 437538 - protein, 9 aa, Homo Sapiens
ATKGHLIVI

SEQ ID NO: 437539 - protein, 9 aa, Homo Sapiens
LVDKQIYRL

SEQ ID NO: 437540 - protein, 9 aa, Homo Sapiens
IHLDRKAQN

SEQ ID NO: 437541 - protein, 9 aa, Homo Sapiens
HGLCDKPGE

SEQ ID NO: 437542 - protein, 9 aa, Homo Sapiens
IFLLSLFLV

SEQ ID NO: 437543 - protein, 9 aa, Homo Sapiens
SFRLCLSHF

SEQ ID NO: 437544 - protein, 9 aa, Homo Sapiens
VAMMFFSNF

SEQ ID NO: 437545 - protein, 9 aa, Homo Sapiens
FEDPRVATR

SEQ ID NO: 437546 - protein, 9 aa, Homo Sapiens
AEEECTTSY

SEQ ID NO: 437547 - protein, 9 aa, Homo Sapiens
AIKELQLMK

SEQ ID NO: 437548 - protein, 9 aa, Homo Sapiens
QTDIVILLC

SEQ ID NO: 437549 - protein, 9 aa, Homo Sapiens
MKGEFSRGF

SEQ ID NO: 437550 - protein, 9 aa, Homo Sapiens
IQSRMARYT

SEQ ID NO: 437551 - protein, 9 aa, Homo Sapiens
NGLPSWKLN

SEQ ID NO: 437552 - protein, 9 aa, Homo Sapiens
GVDGNFILR

SEQ ID NO: 437553 - protein, 9 aa, Homo Sapiens
DRNNRKLGP

SEQ ID NO: 437554 - protein, 9 aa, Homo Sapiens
YYTSYQNKS

SEQ ID NO: 437555 - protein, 9 aa, Homo Sapiens
LENVKSQKI

SEQ ID NO: 437556 - protein, 9 aa, Homo Sapiens
GNMYYEKSY

SEQ ID NO: 437557 - protein, 9 aa, Homo Sapiens
LTSVQSVND

SEQ ID NO: 437558 - protein, 9 aa, Homo Sapiens
TTPQIPITM

SEQ ID NO: 437559 - protein, 9 aa, Homo Sapiens
FPEHCTEEN

SEQ ID NO: 437560 - protein, 9 aa, Homo Sapiens
DYLIIMIAI

SEQ ID NO: 437561 - protein, 9 aa, Homo Sapiens
ATKNAKKDA

SEQ ID NO: 437562 - protein, 9 aa, Homo Sapiens
NMEMMHKRT

SEQ ID NO: 437563 - protein, 9 aa, Homo Sapiens
LKHKCWQNG

SEQ ID NO: 437564 - protein, 9 aa, Homo Sapiens
IEEQKLSEN

SEQ ID NO: 437565 - protein, 9 aa, Homo Sapiens
VTNKVIKIV

SEQ ID NO: 437566 - protein, 9 aa, Homo Sapiens
LASASAGPP

SEQ ID NO: 437567 - protein, 9 aa, Homo Sapiens
FLYPYKKLD

SEQ ID NO: 437568 - protein, 9 aa, Homo Sapiens
TKYKVMRKY

SEQ ID NO: 437569 - protein, 9 aa, Homo Sapiens
SQRSRSVSS

SEQ ID NO: 437570 - protein, 9 aa, Homo Sapiens
KMVPLGIDK

SEQ ID NO: 437571 - protein, 9 aa, Homo Sapiens
TGDKPYQCD

SEQ ID NO: 437572 - protein, 9 aa, Homo Sapiens
NNFNIAGTV

SEQ ID NO: 437573 - protein, 9 aa, Homo Sapiens
CLRTVKCYN

SEQ ID NO: 437574 - protein, 9 aa, Homo Sapiens
LELDDITSE

SEQ ID NO: 437575 - protein, 9 aa, Homo Sapiens
RLSDYEKRK

SEQ ID NO: 437576 - protein, 9 aa, Homo Sapiens
NKYLEPRCP

SEQ ID NO: 437577 - protein, 9 aa, Homo Sapiens
LKNPHPYVK

SEQ ID NO: 437578 - protein, 9 aa, Homo Sapiens
HTYSIVIGF

SEQ ID NO: 437579 - protein, 9 aa, Homo Sapiens
QKKLSSQRE

SEQ ID NO: 437580 - protein, 9 aa, Homo Sapiens
ELDDITSEK

SEQ ID NO: 437581 - protein, 9 aa, Homo Sapiens
IKGPDFLID

SEQ ID NO: 437582 - protein, 9 aa, Homo Sapiens
SALVSQSYI

SEQ ID NO: 437583 - protein, 9 aa, Homo Sapiens
NIDEILEPP

SEQ ID NO: 437584 - protein, 9 aa, Homo Sapiens
APVRLVLKD

SEQ ID NO: 437585 - protein, 9 aa, Homo Sapiens
HREVNLPKV

SEQ ID NO: 437586 - protein, 9 aa, Homo Sapiens
WPPKSEIQN

SEQ ID NO: 437587 - protein, 9 aa, Homo Sapiens
KNSTFCITA

SEQ ID NO: 437588 - protein, 9 aa, Homo Sapiens
HSAIPDVLQ

SEQ ID NO: 437589 - protein, 9 aa, Homo Sapiens
ANDQLEETM

SEQ ID NO: 437590 - protein, 9 aa, Homo Sapiens
STTVDFHWC

SEQ ID NO: 437591 - protein, 9 aa, Homo Sapiens
RKGAKKGMI

SEQ ID NO: 437592 - protein, 9 aa, Homo Sapiens
QTAPKKNKN

SEQ ID NO: 437593 - protein, 9 aa, Homo Sapiens
KSLDTGTCH

SEQ ID NO: 437594 - protein, 9 aa, Homo Sapiens
MTGCILQMH

SEQ ID NO: 437595 - protein, 9 aa, Homo Sapiens
TSQSLLERF

SEQ ID NO: 437596 - protein, 9 aa, Homo Sapiens
SPAKPENNG

SEQ ID NO: 437597 - protein, 9 aa, Homo Sapiens
HMFQYSWND

SEQ ID NO: 437598 - protein, 9 aa, Homo Sapiens
WLSDFFYKF

SEQ ID NO: 437599 - protein, 9 aa, Homo Sapiens
RNTLISWTK

SEQ ID NO: 437600 - protein, 9 aa, Homo Sapiens
RGPPTGKRR

SEQ ID NO: 437601 - protein, 9 aa, Homo Sapiens
EERICMENI

SEQ ID NO: 437602 - protein, 9 aa, Homo Sapiens
LVIHHKGHR

SEQ ID NO: 437603 - protein, 9 aa, Homo Sapiens
DQLEETMKD

SEQ ID NO: 437604 - protein, 9 aa, Homo Sapiens
SHVGAVALF

SEQ ID NO: 437605 - protein, 9 aa, Homo Sapiens
GYFDTFISE

SEQ ID NO: 437606 - protein, 9 aa, Homo Sapiens
DRISSSDIL

SEQ ID NO: 437607 - protein, 9 aa, Homo Sapiens
LLPIVPIDI

SEQ ID NO: 437608 - protein, 9 aa, Homo Sapiens
TMKAFLDEL

SEQ ID NO: 437609 - protein, 9 aa, Homo Sapiens
EPEDALSGA

SEQ ID NO: 437610 - protein, 9 aa, Homo Sapiens
LSDKNMCNY

SEQ ID NO: 437611 - protein, 9 aa, Homo Sapiens
VAVLAVHGT

SEQ ID NO: 437612 - protein, 9 aa, Homo Sapiens
HEKAQKTGL

SEQ ID NO: 437613 - protein, 9 aa, Homo Sapiens
VPPETLGKG

SEQ ID NO: 437614 - protein, 9 aa, Homo Sapiens
DRKQISEYN

SEQ ID NO: 437615 - protein, 9 aa, Homo Sapiens
PLLFSCFCV

SEQ ID NO: 437616 - protein, 9 aa, Homo Sapiens
NMYYEKSYA

SEQ ID NO: 437617 - protein, 9 aa, Homo Sapiens
QEAIATTRS

SEQ ID NO: 437618 - protein, 9 aa, Homo Sapiens
QYFVRGHFY

SEQ ID NO: 437619 - protein, 9 aa, Homo Sapiens
LSKAKEYLI

SEQ ID NO: 437620 - protein, 9 aa, Homo Sapiens
CEKNIHFLV

SEQ ID NO: 437621 - protein, 9 aa, Homo Sapiens
LHKINHTQK

SEQ ID NO: 437622 - protein, 9 aa, Homo Sapiens
MYAATKDLR

SEQ ID NO: 437623 - protein, 9 aa, Homo Sapiens
RWFQLYRST

SEQ ID NO: 437624 - protein, 9 aa, Homo Sapiens
SQTYVFQYA

SEQ ID NO: 437625 - protein, 9 aa, Homo Sapiens
WNWLNTLLK

SEQ ID NO: 437626 - protein, 9 aa, Homo Sapiens
RDRRQQKQL

SEQ ID NO: 437627 - protein, 9 aa, Homo Sapiens
EKRWEHSRE

SEQ ID NO: 437628 - protein, 9 aa, Homo Sapiens
SGLEQISFQ

SEQ ID NO: 437629 - protein, 9 aa, Homo Sapiens
SCGQRFNPE

SEQ ID NO: 437630 - protein, 9 aa, Homo Sapiens
FRGEPVEGF

SEQ ID NO: 437631 - protein, 9 aa, Homo Sapiens
MLFAVALLN

SEQ ID NO: 437632 - protein, 9 aa, Homo Sapiens
ANTSVFVVD

SEQ ID NO: 437633 - protein, 9 aa, Homo Sapiens
IGNQINVSE

SEQ ID NO: 437634 - protein, 9 aa, Homo Sapiens
TLHPFMVNA

SEQ ID NO: 437635 - protein, 9 aa, Homo Sapiens
KKEDLHPDP

SEQ ID NO: 437636 - protein, 9 aa, Homo Sapiens
DTMLTVRSV

SEQ ID NO: 437637 - protein, 9 aa, Homo Sapiens
LISFLFIGV

SEQ ID NO: 437638 - protein, 9 aa, Homo Sapiens
GKSFKKGDS

SEQ ID NO: 437639 - protein, 9 aa, Homo Sapiens
AEEWSCFFL

SEQ ID NO: 437640 - protein, 9 aa, Homo Sapiens
GVDYMKKIF

SEQ ID NO: 437641 - protein, 9 aa, Homo Sapiens
VLGDHSQVL

SEQ ID NO: 437642 - protein, 9 aa, Homo Sapiens
FEKGDYFSG

SEQ ID NO: 437643 - protein, 9 aa, Homo Sapiens
QDLRLWKQE

SEQ ID NO: 437644 - protein, 9 aa, Homo Sapiens
CDLIHLNTE

SEQ ID NO: 437645 - protein, 9 aa, Homo Sapiens
CIEGGTLKD

SEQ ID NO: 437646 - protein, 9 aa, Homo Sapiens
LFDKNYGSS

SEQ ID NO: 437647 - protein, 9 aa, Homo Sapiens
DGLHYVAQA

SEQ ID NO: 437648 - protein, 9 aa, Homo Sapiens
VTEDNFFEI

SEQ ID NO: 437649 - protein, 9 aa, Homo Sapiens
NTLKGLNSE

SEQ ID NO: 437650 - protein, 9 aa, Homo Sapiens
ESSYKEITH

SEQ ID NO: 437651 - protein, 9 aa, Homo Sapiens
FLEPTQKDI

SEQ ID NO: 437652 - protein, 9 aa, Homo Sapiens
ANIDLEQME

SEQ ID NO: 437653 - protein, 9 aa, Homo Sapiens
EKSAHKDSD

SEQ ID NO: 437654 - protein, 9 aa, Homo Sapiens
TDEDLDSVD

SEQ ID NO: 437655 - protein, 9 aa, Homo Sapiens
REGHVQVLR

SEQ ID NO: 437656 - protein, 9 aa, Homo Sapiens
EPTVIDEIQ

SEQ ID NO: 437657 - protein, 9 aa, Homo Sapiens
PKFLKKLLM

SEQ ID NO: 437658 - protein, 9 aa, Homo Sapiens
NQRKANLVN

SEQ ID NO: 437659 - protein, 9 aa, Homo Sapiens
RNMQTIWVT

SEQ ID NO: 437660 - protein, 9 aa, Homo Sapiens
CLGVGRYRS

SEQ ID NO: 437661 - protein, 9 aa, Homo Sapiens
KITSDGGWT

SEQ ID NO: 437662 - protein, 9 aa, Homo Sapiens
EVVRECTIM

SEQ ID NO: 437663 - protein, 9 aa, Homo Sapiens
MGSDCPHPA

SEQ ID NO: 437664 - protein, 9 aa, Homo Sapiens
EACTDFWDR

SEQ ID NO: 437665 - protein, 9 aa, Homo Sapiens
PPPHSIVDK

SEQ ID NO: 437666 - protein, 9 aa, Homo Sapiens
SLGFGFSSC

SEQ ID NO: 437667 - protein, 9 aa, Homo Sapiens
HNWLLLNQP

SEQ ID NO: 437668 - protein, 9 aa, Homo Sapiens
VCYLEYAGS

SEQ ID NO: 437669 - protein, 9 aa, Homo Sapiens
KSHFKDMID

SEQ ID NO: 437670 - protein, 9 aa, Homo Sapiens
IDKLDEVLG

SEQ ID NO: 437671 - protein, 9 aa, Homo Sapiens
VGLKNISVQ

SEQ ID NO: 437672 - protein, 9 aa, Homo Sapiens
ININDIFED

SEQ ID NO: 437673 - protein, 9 aa, Homo Sapiens
RLPPLRQGE

SEQ ID NO: 437674 - protein, 9 aa, Homo Sapiens
HSLDKDTLY

SEQ ID NO: 437675 - protein, 9 aa, Homo Sapiens
VQKGNVVNL

SEQ ID NO: 437676 - protein, 9 aa, Homo Sapiens
TNLERLWSF

SEQ ID NO: 437677 - protein, 9 aa, Homo Sapiens
AIIILNNYE

SEQ ID NO: 437678 - protein, 9 aa, Homo Sapiens
HQIHTGEKP

SEQ ID NO: 437679 - protein, 9 aa, Homo Sapiens
LLCNCTFFL

SEQ ID NO: 437680 - protein, 9 aa, Homo Sapiens
MRQCWWEKP

SEQ ID NO: 437681 - protein, 9 aa, Homo Sapiens
FCHPNFPFS

SEQ ID NO: 437682 - protein, 9 aa, Homo Sapiens
PYNYAFVSQ

SEQ ID NO: 437683 - protein, 9 aa, Homo Sapiens
LCMMSSHLH

SEQ ID NO: 437684 - protein, 9 aa, Homo Sapiens
ELQMEVINL

SEQ ID NO: 437685 - protein, 9 aa, Homo Sapiens
NGSLGDDFD

SEQ ID NO: 437686 - protein, 9 aa, Homo Sapiens
DYINTTWNC

SEQ ID NO: 437687 - protein, 9 aa, Homo Sapiens
KTIDKLKMM

SEQ ID NO: 437688 - protein, 9 aa, Homo Sapiens
PEDALSGAE

SEQ ID NO: 437689 - protein, 9 aa, Homo Sapiens
IVATDDCRY

SEQ ID NO: 437690 - protein, 9 aa, Homo Sapiens
TMQKRLKKD

SEQ ID NO: 437691 - protein, 9 aa, Homo Sapiens
SQTVLSSAP

SEQ ID NO: 437692 - protein, 9 aa, Homo Sapiens
KNKGQLSRQ

SEQ ID NO: 437693 - protein, 9 aa, Homo Sapiens
RGDVANAVV

SEQ ID NO: 437694 - protein, 9 aa, Homo Sapiens
GAVALFYIH

SEQ ID NO: 437695 - protein, 9 aa, Homo Sapiens
TQLQFTAYL

SEQ ID NO: 437696 - protein, 9 aa, Homo Sapiens
SHGAEDEVS

SEQ ID NO: 437697 - protein, 9 aa, Homo Sapiens
PETISEYIS

SEQ ID NO: 437698 - protein, 9 aa, Homo Sapiens
LLDLLVTDN

SEQ ID NO: 437699 - protein, 9 aa, Homo Sapiens
INGQFVVSA

SEQ ID NO: 437700 - protein, 9 aa, Homo Sapiens
EQKKLSSQR

SEQ ID NO: 437701 - protein, 9 aa, Homo Sapiens
EKDILSPNN

SEQ ID NO: 437702 - protein, 9 aa, Homo Sapiens
RSQFSAKEE

SEQ ID NO: 437703 - protein, 9 aa, Homo Sapiens
VLENIKLNK

SEQ ID NO: 437704 - protein, 9 aa, Homo Sapiens
IGNLSIILL

SEQ ID NO: 437705 - protein, 9 aa, Homo Sapiens
ETNINHSNS

SEQ ID NO: 437706 - protein, 9 aa, Homo Sapiens
SSGKSKELK

SEQ ID NO: 437707 - protein, 9 aa, Homo Sapiens
VCYICGCEY

SEQ ID NO: 437708 - protein, 9 aa, Homo Sapiens
HLPIQMWCV

SEQ ID NO: 437709 - protein, 9 aa, Homo Sapiens
LSSFQIHEI

SEQ ID NO: 437710 - protein, 9 aa, Homo Sapiens
TGEVVPGVV

SEQ ID NO: 437711 - protein, 9 aa, Homo Sapiens
MKYFVLGRD

SEQ ID NO: 437712 - protein, 9 aa, Homo Sapiens
EDADEGTLK

SEQ ID NO: 437713 - protein, 9 aa, Homo Sapiens
NMLGMGGLL

SEQ ID NO: 437714 - protein, 9 aa, Homo Sapiens
NKKKYDFPL

SEQ ID NO: 437715 - protein, 9 aa, Homo Sapiens
LHQMIHTGE

SEQ ID NO: 437716 - protein, 9 aa, Homo Sapiens
NKQHYITKN

SEQ ID NO: 437717 - protein, 9 aa, Homo Sapiens
DHDACSYVT

SEQ ID NO: 437718 - protein, 9 aa, Homo Sapiens
VKGSGPHRP

SEQ ID NO: 437719 - protein, 9 aa, Homo Sapiens
RLSGNKYVF

SEQ ID NO: 437720 - protein, 9 aa, Homo Sapiens
LIKCQNARD

SEQ ID NO: 437721 - protein, 9 aa, Homo Sapiens
DISNSRLES

SEQ ID NO: 437722 - protein, 9 aa, Homo Sapiens
SHFQRVKHG

SEQ ID NO: 437723 - protein, 9 aa, Homo Sapiens
RVTYALCSH

SEQ ID NO: 437724 - protein, 9 aa, Homo Sapiens
ELAYFSLST

SEQ ID NO: 437725 - protein, 9 aa, Homo Sapiens
LLCMNLYIE

SEQ ID NO: 437726 - protein, 9 aa, Homo Sapiens
IPQSPLDDT

SEQ ID NO: 437727 - protein, 9 aa, Homo Sapiens
LTVHGFLQT

SEQ ID NO: 437728 - protein, 9 aa, Homo Sapiens
QQPHAELSP

SEQ ID NO: 437729 - protein, 9 aa, Homo Sapiens
TRRKMAYEY

SEQ ID NO: 437730 - protein, 9 aa, Homo Sapiens
GGSLLEDIA

SEQ ID NO: 437731 - protein, 9 aa, Homo Sapiens
YGTAGVSLH

SEQ ID NO: 437732 - protein, 9 aa, Homo Sapiens
YITHLSITD

SEQ ID NO: 437733 - protein, 9 aa, Homo Sapiens
PLELEHPAR

SEQ ID NO: 437734 - protein, 9 aa, Homo Sapiens
ALTRSRNTY

SEQ ID NO: 437735 - protein, 9 aa, Homo Sapiens
MAGHSISKQ

SEQ ID NO: 437736 - protein, 9 aa, Homo Sapiens
IEFNATDVL

SEQ ID NO: 437737 - protein, 9 aa, Homo Sapiens
RLNRYEMIR

SEQ ID NO: 437738 - protein, 9 aa, Homo Sapiens
WRFLIYIST

SEQ ID NO: 437739 - protein, 9 aa, Homo Sapiens
GFQDSLNPR

SEQ ID NO: 437740 - protein, 9 aa, Homo Sapiens
KAVKSEEGQ

SEQ ID NO: 437741 - protein, 9 aa, Homo Sapiens
RCMTISICI

SEQ ID NO: 437742 - protein, 9 aa, Homo Sapiens
PEYSSTQNQ

SEQ ID NO: 437743 - protein, 9 aa, Homo Sapiens
VHLWDVARA

SEQ ID NO: 437744 - protein, 9 aa, Homo Sapiens
VIVLEAKHL

SEQ ID NO: 437745 - protein, 9 aa, Homo Sapiens
DMHMQISNA

SEQ ID NO: 437746 - protein, 9 aa, Homo Sapiens
NKTTWLSVD

SEQ ID NO: 437747 - protein, 9 aa, Homo Sapiens
SHPKGSVGS

SEQ ID NO: 437748 - protein, 9 aa, Homo Sapiens
VNRPFPVLE

SEQ ID NO: 437749 - protein, 9 aa, Homo Sapiens
KIKGSFVAF

SEQ ID NO: 437750 - protein, 9 aa, Homo Sapiens
ALGVIQLHF

SEQ ID NO: 437751 - protein, 9 aa, Homo Sapiens
RMLSQPAGN

SEQ ID NO: 437752 - protein, 9 aa, Homo Sapiens
RSLEIVLFT

SEQ ID NO: 437753 - protein, 9 aa, Homo Sapiens
NYNSNQAAG

SEQ ID NO: 437754 - protein, 9 aa, Homo Sapiens
AFVHQIPPS

SEQ ID NO: 437755 - protein, 9 aa, Homo Sapiens
GGAHIFKLH

SEQ ID NO: 437756 - protein, 9 aa, Homo Sapiens
QLKKVRFVN

SEQ ID NO: 437757 - protein, 9 aa, Homo Sapiens
RNVGSEVHL

SEQ ID NO: 437758 - protein, 9 aa, Homo Sapiens
KVLPDWKGW

SEQ ID NO: 437759 - protein, 9 aa, Homo Sapiens
MSATRAVST

SEQ ID NO: 437760 - protein, 9 aa, Homo Sapiens
CIQYLASRN

SEQ ID NO: 437761 - protein, 9 aa, Homo Sapiens
TYSVGIGPA

SEQ ID NO: 437762 - protein, 9 aa, Homo Sapiens
VSTFSVLTK

SEQ ID NO: 437763 - protein, 9 aa, Homo Sapiens
GETPPHSQH

SEQ ID NO: 437764 - protein, 9 aa, Homo Sapiens
WAYDNWGEC

SEQ ID NO: 437765 - protein, 9 aa, Homo Sapiens
NTYVALYKC

SEQ ID NO: 437766 - protein, 9 aa, Homo Sapiens
SEEENQENM

SEQ ID NO: 437767 - protein, 9 aa, Homo Sapiens
IFHFGESTT

SEQ ID NO: 437768 - protein, 9 aa, Homo Sapiens
IQYLDGLLV

SEQ ID NO: 437769 - protein, 9 aa, Homo Sapiens
GKISEGLQG

SEQ ID NO: 437770 - protein, 9 aa, Homo Sapiens
RGFLGCIWS

SEQ ID NO: 437771 - protein, 9 aa, Homo Sapiens
VRKTFWKLA

SEQ ID NO: 437772 - protein, 9 aa, Homo Sapiens
IVVILLYGS

SEQ ID NO: 437773 - protein, 9 aa, Homo Sapiens
NKINQCWTT

SEQ ID NO: 437774 - protein, 9 aa, Homo Sapiens
TRYVVQVRA

SEQ ID NO: 437775 - protein, 9 aa, Homo Sapiens
MQSTFNNTI

SEQ ID NO: 437776 - protein, 9 aa, Homo Sapiens
SLEYVVSRT

SEQ ID NO: 437777 - protein, 9 aa, Homo Sapiens
DHFQIHTGI

SEQ ID NO: 437778 - protein, 9 aa, Homo Sapiens
NNPLQARRE

SEQ ID NO: 437779 - protein, 9 aa, Homo Sapiens
MSVAGGKAN

SEQ ID NO: 437780 - protein, 9 aa, Homo Sapiens
EQAQGEQNV

SEQ ID NO: 437781 - protein, 9 aa, Homo Sapiens
NICCLTTIG

SEQ ID NO: 437782 - protein, 9 aa, Homo Sapiens
EETVYGLNK

SEQ ID NO: 437783 - protein, 9 aa, Homo Sapiens
LNMENTLKG

SEQ ID NO: 437784 - protein, 9 aa, Homo Sapiens
SVTYPIKMK

SEQ ID NO: 437785 - protein, 9 aa, Homo Sapiens
DEGETNWKV

SEQ ID NO: 437786 - protein, 9 aa, Homo Sapiens
TFAPSDTFS

SEQ ID NO: 437787 - protein, 9 aa, Homo Sapiens
PGKSAAKKS

SEQ ID NO: 437788 - protein, 9 aa, Homo Sapiens
LISVAWTLY

SEQ ID NO: 437789 - protein, 9 aa, Homo Sapiens
SRCGHYYDA

SEQ ID NO: 437790 - protein, 9 aa, Homo Sapiens
GEFSRGFGL

SEQ ID NO: 437791 - protein, 9 aa, Homo Sapiens
YFFPVEPVS

SEQ ID NO: 437792 - protein, 9 aa, Homo Sapiens
VFQLERLKQ

SEQ ID NO: 437793 - protein, 9 aa, Homo Sapiens
LYMRSCRVL

SEQ ID NO: 437794 - protein, 9 aa, Homo Sapiens
GNQIVDVNL

SEQ ID NO: 437795 - protein, 9 aa, Homo Sapiens
LCLRVHPPR

SEQ ID NO: 437796 - protein, 9 aa, Homo Sapiens
EGEEDNESP

SEQ ID NO: 437797 - protein, 9 aa, Homo Sapiens
YAWEPHHNY

SEQ ID NO: 437798 - protein, 9 aa, Homo Sapiens
KREYPITHR

SEQ ID NO: 437799 - protein, 9 aa, Homo Sapiens
LPQLLGMYR

SEQ ID NO: 437800 - protein, 9 aa, Homo Sapiens
EANKCAYTF

SEQ ID NO: 437801 - protein, 9 aa, Homo Sapiens
HIPCYEITS

SEQ ID NO: 437802 - protein, 9 aa, Homo Sapiens
CEVRPKVLF

SEQ ID NO: 437803 - protein, 9 aa, Homo Sapiens
GKNTLVSKF

SEQ ID NO: 437804 - protein, 9 aa, Homo Sapiens
LSHNVNMPN

SEQ ID NO: 437805 - protein, 9 aa, Homo Sapiens
STFNNTIKE

SEQ ID NO: 437806 - protein, 9 aa, Homo Sapiens
HALIWAQQK

SEQ ID NO: 437807 - protein, 9 aa, Homo Sapiens
KPSEEIKTI

SEQ ID NO: 437808 - protein, 9 aa, Homo Sapiens
FAWKKRKRQ

SEQ ID NO: 437809 - protein, 9 aa, Homo Sapiens
LNKTPFHLV

SEQ ID NO: 437810 - protein, 9 aa, Homo Sapiens
EDEEEYKAT

SEQ ID NO: 437811 - protein, 9 aa, Homo Sapiens
LIERDRRRR

SEQ ID NO: 437812 - protein, 9 aa, Homo Sapiens
PENVQKAVC

SEQ ID NO: 437813 - protein, 9 aa, Homo Sapiens
KIVSHGSHS

SEQ ID NO: 437814 - protein, 9 aa, Homo Sapiens
DLVLVKEAN

SEQ ID NO: 437815 - protein, 9 aa, Homo Sapiens
TVYNHTLSI

SEQ ID NO: 437816 - protein, 9 aa, Homo Sapiens
LNTNNCPSL

SEQ ID NO: 437817 - protein, 9 aa, Homo Sapiens
TFFSDVSIL

SEQ ID NO: 437818 - protein, 9 aa, Homo Sapiens
EIRICRPCE

SEQ ID NO: 437819 - protein, 9 aa, Homo Sapiens
LSDHFQIHT

SEQ ID NO: 437820 - protein, 9 aa, Homo Sapiens
NGNDLYLWP

SEQ ID NO: 437821 - protein, 9 aa, Homo Sapiens
DNTSRVMQH

SEQ ID NO: 437822 - protein, 9 aa, Homo Sapiens
EKCFSTGPA

SEQ ID NO: 437823 - protein, 9 aa, Homo Sapiens
CCKECKLIC

SEQ ID NO: 437824 - protein, 9 aa, Homo Sapiens
LKTEENLFK

SEQ ID NO: 437825 - protein, 9 aa, Homo Sapiens
PYPCHNCGK

SEQ ID NO: 437826 - protein, 9 aa, Homo Sapiens
RHQKIIHSR

SEQ ID NO: 437827 - protein, 9 aa, Homo Sapiens
ATEKLEVIR

SEQ ID NO: 437828 - protein, 9 aa, Homo Sapiens
GWNSVSHII

SEQ ID NO: 437829 - protein, 9 aa, Homo Sapiens
TEPNHPGVY

SEQ ID NO: 437830 - protein, 9 aa, Homo Sapiens
NKDVQKRRQ

SEQ ID NO: 437831 - protein, 9 aa, Homo Sapiens
ESGLWVSHR

SEQ ID NO: 437832 - protein, 9 aa, Homo Sapiens
EIMFNERGS

SEQ ID NO: 437833 - protein, 9 aa, Homo Sapiens
QLYWGTPIP

SEQ ID NO: 437834 - protein, 9 aa, Homo Sapiens
RSFTKQSIY

SEQ ID NO: 437835 - protein, 9 aa, Homo Sapiens
HDATTCFVD

SEQ ID NO: 437836 - protein, 9 aa, Homo Sapiens
ASLQPHKMK

SEQ ID NO: 437837 - protein, 9 aa, Homo Sapiens
NEHRQIHTG

SEQ ID NO: 437838 - protein, 9 aa, Homo Sapiens
HQIMSVSTI

SEQ ID NO: 437839 - protein, 9 aa, Homo Sapiens
EGDLVKPLK

SEQ ID NO: 437840 - protein, 9 aa, Homo Sapiens
ASPGHCLPK

SEQ ID NO: 437841 - protein, 9 aa, Homo Sapiens
LLGKISLFT

SEQ ID NO: 437842 - protein, 9 aa, Homo Sapiens
DKQAFVKTV

SEQ ID NO: 437843 - protein, 9 aa, Homo Sapiens
QRDLLRHNK

SEQ ID NO: 437844 - protein, 9 aa, Homo Sapiens
SRSFEKGDY

SEQ ID NO: 437845 - protein, 9 aa, Homo Sapiens
VGVLYMRSC

SEQ ID NO: 437846 - protein, 9 aa, Homo Sapiens
FDKNYGSSS

SEQ ID NO: 437847 - protein, 9 aa, Homo Sapiens
HRVCIILAM

SEQ ID NO: 437848 - protein, 9 aa, Homo Sapiens
RNGDGKVTT

SEQ ID NO: 437849 - protein, 9 aa, Homo Sapiens
IDFPKFLTM

SEQ ID NO: 437850 - protein, 9 aa, Homo Sapiens
NLLARDAPD

SEQ ID NO: 437851 - protein, 9 aa, Homo Sapiens
SLSLTVVQH

SEQ ID NO: 437852 - protein, 9 aa, Homo Sapiens
SGPNTLKSL

SEQ ID NO: 437853 - protein, 9 aa, Homo Sapiens
AHLRHDKIM

SEQ ID NO: 437854 - protein, 9 aa, Homo Sapiens
QAEMPNQLR

SEQ ID NO: 437855 - protein, 9 aa, Homo Sapiens
AMAELKGYT

SEQ ID NO: 437856 - protein, 9 aa, Homo Sapiens
LNFTPMDLF

SEQ ID NO: 437857 - protein, 9 aa, Homo Sapiens
QTRLFVPPN

SEQ ID NO: 437858 - protein, 9 aa, Homo Sapiens
CVRLPRGLG

SEQ ID NO: 437859 - protein, 9 aa, Homo Sapiens
ENLNKYFNA

SEQ ID NO: 437860 - protein, 9 aa, Homo Sapiens
YENVEFGHI

SEQ ID NO: 437861 - protein, 9 aa, Homo Sapiens
SPALGVIQL

SEQ ID NO: 437862 - protein, 9 aa, Homo Sapiens
PTKTPHLQL

SEQ ID NO: 437863 - protein, 9 aa, Homo Sapiens
NKTPFHLVG

SEQ ID NO: 437864 - protein, 9 aa, Homo Sapiens
HYFLGAYKL

SEQ ID NO: 437865 - protein, 9 aa, Homo Sapiens
GTLYSWPWC

SEQ ID NO: 437866 - protein, 9 aa, Homo Sapiens
GMAGLPNML

SEQ ID NO: 437867 - protein, 9 aa, Homo Sapiens
YTDGACRTQ

SEQ ID NO: 437868 - protein, 9 aa, Homo Sapiens
VGVFMTAIN

SEQ ID NO: 437869 - protein, 9 aa, Homo Sapiens
GKNYLGALS

SEQ ID NO: 437870 - protein, 9 aa, Homo Sapiens
HAGQTINDQ

SEQ ID NO: 437871 - protein, 9 aa, Homo Sapiens
KHTHSPEVA

SEQ ID NO: 437872 - protein, 9 aa, Homo Sapiens
GLCVFESNA

SEQ ID NO: 437873 - protein, 9 aa, Homo Sapiens
QNRRIYDIT

SEQ ID NO: 437874 - protein, 9 aa, Homo Sapiens
PASKMHFQT

SEQ ID NO: 437875 - protein, 9 aa, Homo Sapiens
DCVNLQGVK

SEQ ID NO: 437876 - protein, 9 aa, Homo Sapiens
HILGKMTVA

SEQ ID NO: 437877 - protein, 9 aa, Homo Sapiens
DRDQRLKES

SEQ ID NO: 437878 - protein, 9 aa, Homo Sapiens
NNKSLELVS

SEQ ID NO: 437879 - protein, 9 aa, Homo Sapiens
LGNTDNYIL

SEQ ID NO: 437880 - protein, 9 aa, Homo Sapiens
NRPFPVLEH

SEQ ID NO: 437881 - protein, 9 aa, Homo Sapiens
ANEGVMYRI

SEQ ID NO: 437882 - protein, 9 aa, Homo Sapiens
FSAHLFGGT

SEQ ID NO: 437883 - protein, 9 aa, Homo Sapiens
FICFYINKI

SEQ ID NO: 437884 - protein, 9 aa, Homo Sapiens
GRRRKKSGW

SEQ ID NO: 437885 - protein, 9 aa, Homo Sapiens
VQVNEWSLN

SEQ ID NO: 437886 - protein, 9 aa, Homo Sapiens
KHVCKQACQ

SEQ ID NO: 437887 - protein, 9 aa, Homo Sapiens
SQGFEFIFG

SEQ ID NO: 437888 - protein, 9 aa, Homo Sapiens
KSNVETAKK

SEQ ID NO: 437889 - protein, 9 aa, Homo Sapiens
ILVCVFGTA

SEQ ID NO: 437890 - protein, 9 aa, Homo Sapiens
RKLPSTFGQ

SEQ ID NO: 437891 - protein, 9 aa, Homo Sapiens
YLLCVKRNI

SEQ ID NO: 437892 - protein, 9 aa, Homo Sapiens
YMIWNLVWK

SEQ ID NO: 437893 - protein, 9 aa, Homo Sapiens
MHSKFPPSL

SEQ ID NO: 437894 - protein, 9 aa, Homo Sapiens
LPTFCKLYR

SEQ ID NO: 437895 - protein, 9 aa, Homo Sapiens
HNLFSATFP

SEQ ID NO: 437896 - protein, 9 aa, Homo Sapiens
SVTERWFVG

SEQ ID NO: 437897 - protein, 9 aa, Homo Sapiens
GEKGDPDLI

SEQ ID NO: 437898 - protein, 9 aa, Homo Sapiens
PVYSLEGED

SEQ ID NO: 437899 - protein, 9 aa, Homo Sapiens
QLSELDQYY

SEQ ID NO: 437900 - protein, 9 aa, Homo Sapiens
FGFSSCRSL

SEQ ID NO: 437901 - protein, 9 aa, Homo Sapiens
VEMLFAVAL

SEQ ID NO: 437902 - protein, 9 aa, Homo Sapiens
HQADKYQPE

SEQ ID NO: 437903 - protein, 9 aa, Homo Sapiens
FLRKLKDVY

SEQ ID NO: 437904 - protein, 9 aa, Homo Sapiens
SQIKYKSSA

SEQ ID NO: 437905 - protein, 9 aa, Homo Sapiens
ELEDTNDDP

SEQ ID NO: 437906 - protein, 9 aa, Homo Sapiens
RQEKSNQIK

SEQ ID NO: 437907 - protein, 9 aa, Homo Sapiens
ALLDNSCRK

SEQ ID NO: 437908 - protein, 9 aa, Homo Sapiens
KAEYEERWA

SEQ ID NO: 437909 - protein, 9 aa, Homo Sapiens
DLPCDLIHL

SEQ ID NO: 437910 - protein, 9 aa, Homo Sapiens
TFQMFAKGY

SEQ ID NO: 437911 - protein, 9 aa, Homo Sapiens
KMYGKQSMV

SEQ ID NO: 437912 - protein, 9 aa, Homo Sapiens
NEVVTLKKD

SEQ ID NO: 437913 - protein, 9 aa, Homo Sapiens
LLWLEHNLE

SEQ ID NO: 437914 - protein, 9 aa, Homo Sapiens
QSHLSRHQI

SEQ ID NO: 437915 - protein, 9 aa, Homo Sapiens
LRRTDKNDD

SEQ ID NO: 437916 - protein, 9 aa, Homo Sapiens
GSSAEEECT

SEQ ID NO: 437917 - protein, 9 aa, Homo Sapiens
KSDIPFIFT

SEQ ID NO: 437918 - protein, 9 aa, Homo Sapiens
PGHMSGMGM

SEQ ID NO: 437919 - protein, 9 aa, Homo Sapiens
VNRLNMYNL

SEQ ID NO: 437920 - protein, 9 aa, Homo Sapiens
LCIVHVVAT

SEQ ID NO: 437921 - protein, 9 aa, Homo Sapiens
WCCDYFLNC

SEQ ID NO: 437922 - protein, 9 aa, Homo Sapiens
CIFKFLGTV

SEQ ID NO: 437923 - protein, 9 aa, Homo Sapiens
DTLTKHTDE

SEQ ID NO: 437924 - protein, 9 aa, Homo Sapiens
GNFALTVKE

SEQ ID NO: 437925 - protein, 9 aa, Homo Sapiens
SYACQQCGK

SEQ ID NO: 437926 - protein, 9 aa, Homo Sapiens
YLDDRYKME

SEQ ID NO: 437927 - protein, 9 aa, Homo Sapiens
WGALVISLQ

SEQ ID NO: 437928 - protein, 9 aa, Homo Sapiens
EDTNDDPEC

SEQ ID NO: 437929 - protein, 9 aa, Homo Sapiens
RFGPKPMCI

SEQ ID NO: 437930 - protein, 9 aa, Homo Sapiens
QVHFPKVIQ

SEQ ID NO: 437931 - protein, 9 aa, Homo Sapiens
RELQPSIIC

SEQ ID NO: 437932 - protein, 9 aa, Homo Sapiens
QARVDEVAA

SEQ ID NO: 437933 - protein, 9 aa, Homo Sapiens
CKLICQFQG

SEQ ID NO: 437934 - protein, 9 aa, Homo Sapiens
ECRNYASEV

SEQ ID NO: 437935 - protein, 9 aa, Homo Sapiens
AMHYIIEDI

SEQ ID NO: 437936 - protein, 9 aa, Homo Sapiens
VNTYAIVER

SEQ ID NO: 437937 - protein, 9 aa, Homo Sapiens
FSHSSLQKH

SEQ ID NO: 437938 - protein, 9 aa, Homo Sapiens
LCDQDLKKY

SEQ ID NO: 437939 - protein, 9 aa, Homo Sapiens
ISVSDRNSG

SEQ ID NO: 437940 - protein, 9 aa, Homo Sapiens
GELKNNWGV

SEQ ID NO: 437941 - protein, 9 aa, Homo Sapiens
HLHQFQQLL

SEQ ID NO: 437942 - protein, 9 aa, Homo Sapiens
QVGRIILEN

SEQ ID NO: 437943 - protein, 9 aa, Homo Sapiens
QPNYPPKSK

SEQ ID NO: 437944 - protein, 9 aa, Homo Sapiens
NLNTALVKT

SEQ ID NO: 437945 - protein, 9 aa, Homo Sapiens
CLEKMQKYT

SEQ ID NO: 437946 - protein, 9 aa, Homo Sapiens
NILESKCKS

SEQ ID NO: 437947 - protein, 9 aa, Homo Sapiens
ADVLKKPVR

SEQ ID NO: 437948 - protein, 9 aa, Homo Sapiens
VNRSRHENA

SEQ ID NO: 437949 - protein, 9 aa, Homo Sapiens
SYNNALSHN

SEQ ID NO: 437950 - protein, 9 aa, Homo Sapiens
IIHTGEKTY

SEQ ID NO: 437951 - protein, 9 aa, Homo Sapiens
LRRLSGNKY

SEQ ID NO: 437952 - protein, 9 aa, Homo Sapiens
MFLCMHVKL

SEQ ID NO: 437953 - protein, 9 aa, Homo Sapiens
YVEGGAELD

SEQ ID NO: 437954 - protein, 9 aa, Homo Sapiens
YKCSICGKA

SEQ ID NO: 437955 - protein, 9 aa, Homo Sapiens
WAKTDSSLH

SEQ ID NO: 437956 - protein, 9 aa, Homo Sapiens
VEIWLSGIT

SEQ ID NO: 437957 - protein, 9 aa, Homo Sapiens
NEDSLIEII

SEQ ID NO: 437958 - protein, 9 aa, Homo Sapiens
KSPKALFVM

SEQ ID NO: 437959 - protein, 9 aa, Homo Sapiens
FDFLNTKER

SEQ ID NO: 437960 - protein, 9 aa, Homo Sapiens
QYVLQSIIK

SEQ ID NO: 437961 - protein, 9 aa, Homo Sapiens
TIVMDTLPL

SEQ ID NO: 437962 - protein, 9 aa, Homo Sapiens
YNSNQAAGG

SEQ ID NO: 437963 - protein, 9 aa, Homo Sapiens
SYYVRNTFH

SEQ ID NO: 437964 - protein, 9 aa, Homo Sapiens
QIKEMKQMH

SEQ ID NO: 437965 - protein, 9 aa, Homo Sapiens
EAEFQQMLK

SEQ ID NO: 437966 - protein, 9 aa, Homo Sapiens
RDQSDCLGE

SEQ ID NO: 437967 - protein, 9 aa, Homo Sapiens
GIVFGYLPI

SEQ ID NO: 437968 - protein, 9 aa, Homo Sapiens
REMCLRLQD

SEQ ID NO: 437969 - protein, 9 aa, Homo Sapiens
MALNSKAAA

SEQ ID NO: 437970 - protein, 9 aa, Homo Sapiens
RISSSDILH

SEQ ID NO: 437971 - protein, 9 aa, Homo Sapiens
ICINSRELL

SEQ ID NO: 437972 - protein, 9 aa, Homo Sapiens
PTVLLGHYQ

SEQ ID NO: 437973 - protein, 9 aa, Homo Sapiens
YSTHMVRKW

SEQ ID NO: 437974 - protein, 9 aa, Homo Sapiens
LKKLEKSGF

SEQ ID NO: 437975 - protein, 9 aa, Homo Sapiens
ADLVLVKEA

SEQ ID NO: 437976 - protein, 9 aa, Homo Sapiens
EEGRYLSCC

SEQ ID NO: 437977 - protein, 9 aa, Homo Sapiens
PVLSMDEPL

SEQ ID NO: 437978 - protein, 9 aa, Homo Sapiens
YVTIFYTLR

SEQ ID NO: 437979 - protein, 9 aa, Homo Sapiens
IPSLHRLDL

SEQ ID NO: 437980 - protein, 9 aa, Homo Sapiens
GTIKLGKRL

SEQ ID NO: 437981 - protein, 9 aa, Homo Sapiens
SSGLLCSHC

SEQ ID NO: 437982 - protein, 9 aa, Homo Sapiens
EFTDSDILQ

SEQ ID NO: 437983 - protein, 9 aa, Homo Sapiens
RHWRHYHTG

SEQ ID NO: 437984 - protein, 9 aa, Homo Sapiens
EILDGLVEI

SEQ ID NO: 437985 - protein, 9 aa, Homo Sapiens
ILVVVDITC

SEQ ID NO: 437986 - protein, 9 aa, Homo Sapiens
KSLSLYISP

SEQ ID NO: 437987 - protein, 9 aa, Homo Sapiens
QGEVLPLPE

SEQ ID NO: 437988 - protein, 9 aa, Homo Sapiens
QVFTCVILE

SEQ ID NO: 437989 - protein, 9 aa, Homo Sapiens
VFCMQLAAI

SEQ ID NO: 437990 - protein, 9 aa, Homo Sapiens
ITYLPTVTV

SEQ ID NO: 437991 - protein, 9 aa, Homo Sapiens
TVIDEIQNG

SEQ ID NO: 437992 - protein, 9 aa, Homo Sapiens
PVIRRARLP

SEQ ID NO: 437993 - protein, 9 aa, Homo Sapiens
SISPILISG

SEQ ID NO: 437994 - protein, 9 aa, Homo Sapiens
SSSKNDSGV

SEQ ID NO: 437995 - protein, 9 aa, Homo Sapiens
DQTTVQTVA

SEQ ID NO: 437996 - protein, 9 aa, Homo Sapiens
ILAMLMVDK

SEQ ID NO: 437997 - protein, 9 aa, Homo Sapiens
MKMHGLGLR

SEQ ID NO: 437998 - protein, 9 aa, Homo Sapiens
QISAGSGGQ

SEQ ID NO: 437999 - protein, 9 aa, Homo Sapiens
LIIHQRINT

SEQ ID NO: 438000 - protein, 9 aa, Homo Sapiens
DAIHITARI

SEQ ID NO: 438001 - protein, 9 aa, Homo Sapiens
WFCGGLIKD

SEQ ID NO: 438002 - protein, 9 aa, Homo Sapiens
QIALPKPRN

SEQ ID NO: 438003 - protein, 9 aa, Homo Sapiens
WALRYIAIH

SEQ ID NO: 438004 - protein, 9 aa, Homo Sapiens
VYRAMNQLD

SEQ ID NO: 438005 - protein, 9 aa, Homo Sapiens
QRGFLGCIW

SEQ ID NO: 438006 - protein, 9 aa, Homo Sapiens
GNLPSFPHD

SEQ ID NO: 438007 - protein, 9 aa, Homo Sapiens
DDNAIREHV

SEQ ID NO: 438008 - protein, 9 aa, Homo Sapiens
ENIRRLEED

SEQ ID NO: 438009 - protein, 9 aa, Homo Sapiens
HLAYGSRVK

SEQ ID NO: 438010 - protein, 9 aa, Homo Sapiens
DKSFGIQML

SEQ ID NO: 438011 - protein, 9 aa, Homo Sapiens
SELIQHQII

SEQ ID NO: 438012 - protein, 9 aa, Homo Sapiens
ENTSEDGQT

SEQ ID NO: 438013 - protein, 9 aa, Homo Sapiens
STMDESHIL

SEQ ID NO: 438014 - protein, 9 aa, Homo Sapiens
NKNKGKKGL

SEQ ID NO: 438015 - protein, 9 aa, Homo Sapiens
PCKSSPPES

SEQ ID NO: 438016 - protein, 9 aa, Homo Sapiens
YAILSISNN

SEQ ID NO: 438017 - protein, 9 aa, Homo Sapiens
FENVIFICS

SEQ ID NO: 438018 - protein, 9 aa, Homo Sapiens
YIINKTRTR

SEQ ID NO: 438019 - protein, 9 aa, Homo Sapiens
HADQAVIDE

SEQ ID NO: 438020 - protein, 9 aa, Homo Sapiens
IALMAYISK

SEQ ID NO: 438021 - protein, 9 aa, Homo Sapiens
QQIENLQKE

SEQ ID NO: 438022 - protein, 9 aa, Homo Sapiens
PGSLKSSPG

SEQ ID NO: 438023 - protein, 9 aa, Homo Sapiens
DSVHITMGP

SEQ ID NO: 438024 - protein, 9 aa, Homo Sapiens
QRTIQQKLV

SEQ ID NO: 438025 - protein, 9 aa, Homo Sapiens
EYVEIIGEQ

SEQ ID NO: 438026 - protein, 9 aa, Homo Sapiens
LTLIFRTSS

SEQ ID NO: 438027 - protein, 9 aa, Homo Sapiens
GSLVLFYHT

SEQ ID NO: 438028 - protein, 9 aa, Homo Sapiens
ATANMKASE

SEQ ID NO: 438029 - protein, 9 aa, Homo Sapiens
FLRSVTGRS

SEQ ID NO: 438030 - protein, 9 aa, Homo Sapiens
GCCVNGQCV

SEQ ID NO: 438031 - protein, 9 aa, Homo Sapiens
NMLCNFRSK

SEQ ID NO: 438032 - protein, 9 aa, Homo Sapiens
HFKADERDF

SEQ ID NO: 438033 - protein, 9 aa, Homo Sapiens
LPWTNDPKE

SEQ ID NO: 438034 - protein, 9 aa, Homo Sapiens
VEDDSRGWW

SEQ ID NO: 438035 - protein, 9 aa, Homo Sapiens
VYCTAVCIE

SEQ ID NO: 438036 - protein, 9 aa, Homo Sapiens
TKTTIGYGF

SEQ ID NO: 438037 - protein, 9 aa, Homo Sapiens
KFNDAAPAK

SEQ ID NO: 438038 - protein, 9 aa, Homo Sapiens
YLFLVERAG

SEQ ID NO: 438039 - protein, 9 aa, Homo Sapiens
FLLFESMLY

SEQ ID NO: 438040 - protein, 9 aa, Homo Sapiens
FCDKVMQLL

SEQ ID NO: 438041 - protein, 9 aa, Homo Sapiens
RVPWSIPGP

SEQ ID NO: 438042 - protein, 9 aa, Homo Sapiens
HMVVSGVGI

SEQ ID NO: 438043 - protein, 9 aa, Homo Sapiens
LHILVHVTK

SEQ ID NO: 438044 - protein, 9 aa, Homo Sapiens
VALYRQRSQ

SEQ ID NO: 438045 - protein, 9 aa, Homo Sapiens
LEEELDQEN

SEQ ID NO: 438046 - protein, 9 aa, Homo Sapiens
VLRRLVTRI

SEQ ID NO: 438047 - protein, 9 aa, Homo Sapiens
EKDILSLYE

SEQ ID NO: 438048 - protein, 9 aa, Homo Sapiens
GNVFPGSGA

SEQ ID NO: 438049 - protein, 9 aa, Homo Sapiens
YEDMHWDLV

SEQ ID NO: 438050 - protein, 9 aa, Homo Sapiens
NPNGNDLYL

SEQ ID NO: 438051 - protein, 9 aa, Homo Sapiens
SSSRCGHYY

SEQ ID NO: 438052 - protein, 9 aa, Homo Sapiens
MSRPGANKV

SEQ ID NO: 438053 - protein, 9 aa, Homo Sapiens
NEAECVTFS

SEQ ID NO: 438054 - protein, 9 aa, Homo Sapiens
NCPDGITKK

SEQ ID NO: 438055 - protein, 9 aa, Homo Sapiens
RAVAGYPDP

SEQ ID NO: 438056 - protein, 9 aa, Homo Sapiens
QNAVFQYIL

SEQ ID NO: 438057 - protein, 9 aa, Homo Sapiens
PFQVKKHIW

SEQ ID NO: 438058 - protein, 9 aa, Homo Sapiens
VEQYSSDTM

SEQ ID NO: 438059 - protein, 9 aa, Homo Sapiens
IKHYEEQHA

SEQ ID NO: 438060 - protein, 9 aa, Homo Sapiens
HPNVVVTEA

SEQ ID NO: 438061 - protein, 9 aa, Homo Sapiens
AWSFGKVCY

SEQ ID NO: 438062 - protein, 9 aa, Homo Sapiens
TSLDRKQIS

SEQ ID NO: 438063 - protein, 9 aa, Homo Sapiens
AKGVNSQNP

SEQ ID NO: 438064 - protein, 9 aa, Homo Sapiens
HGGSWKCMF

SEQ ID NO: 438065 - protein, 9 aa, Homo Sapiens
EQLIQSRMA

SEQ ID NO: 438066 - protein, 9 aa, Homo Sapiens
LQQPGITGT

SEQ ID NO: 438067 - protein, 9 aa, Homo Sapiens
MLRQMSDLR

SEQ ID NO: 438068 - protein, 9 aa, Homo Sapiens
AQLGIHEIS

SEQ ID NO: 438069 - protein, 9 aa, Homo Sapiens
YVQNQEFEI

SEQ ID NO: 438070 - protein, 9 aa, Homo Sapiens
KVVYMFYTL

SEQ ID NO: 438071 - protein, 9 aa, Homo Sapiens
PKEQPGDLY

SEQ ID NO: 438072 - protein, 9 aa, Homo Sapiens
LPGYDKIVG

SEQ ID NO: 438073 - protein, 9 aa, Homo Sapiens
RVEPGSLKS

SEQ ID NO: 438074 - protein, 9 aa, Homo Sapiens
TGIPGLPGD

SEQ ID NO: 438075 - protein, 9 aa, Homo Sapiens
EMHIINEGK

SEQ ID NO: 438076 - protein, 9 aa, Homo Sapiens
AWTFDINTG

SEQ ID NO: 438077 - protein, 9 aa, Homo Sapiens
NELSDTASE

SEQ ID NO: 438078 - protein, 9 aa, Homo Sapiens
WMLLGLLAL

SEQ ID NO: 438079 - protein, 9 aa, Homo Sapiens
RKCEESVEQ

SEQ ID NO: 438080 - protein, 9 aa, Homo Sapiens
TTHKNIHTG

SEQ ID NO: 438081 - protein, 9 aa, Homo Sapiens
TSAPAACKH

SEQ ID NO: 438082 - protein, 9 aa, Homo Sapiens
KEEAQLAII

SEQ ID NO: 438083 - protein, 9 aa, Homo Sapiens
LCQDNNFLL

SEQ ID NO: 438084 - protein, 9 aa, Homo Sapiens
LFLGCGFNS

SEQ ID NO: 438085 - protein, 9 aa, Homo Sapiens
IAKYEELLV

SEQ ID NO: 438086 - protein, 9 aa, Homo Sapiens
RCCHRFLPC

SEQ ID NO: 438087 - protein, 9 aa, Homo Sapiens
MKWLLQQMT

SEQ ID NO: 438088 - protein, 9 aa, Homo Sapiens
APQKGQLYR

SEQ ID NO: 438089 - protein, 9 aa, Homo Sapiens
LDEARAERV

SEQ ID NO: 438090 - protein, 9 aa, Homo Sapiens
REKNSQAST

SEQ ID NO: 438091 - protein, 9 aa, Homo Sapiens
DVVIKAIAD

SEQ ID NO: 438092 - protein, 9 aa, Homo Sapiens
KDTWYQVYR

SEQ ID NO: 438093 - protein, 9 aa, Homo Sapiens
ELLGEERRS

SEQ ID NO: 438094 - protein, 9 aa, Homo Sapiens
DAETTARYN

SEQ ID NO: 438095 - protein, 9 aa, Homo Sapiens
ASASVSWSP

SEQ ID NO: 438096 - protein, 9 aa, Homo Sapiens
FCERTSLRE

SEQ ID NO: 438097 - protein, 9 aa, Homo Sapiens
KPNFISRYQ

SEQ ID NO: 438098 - protein, 9 aa, Homo Sapiens
MWCVERPLD

SEQ ID NO: 438099 - protein, 9 aa, Homo Sapiens
WESLYPEVT

SEQ ID NO: 438100 - protein, 9 aa, Homo Sapiens
SHFRSHSKS

SEQ ID NO: 438101 - protein, 9 aa, Homo Sapiens
LLKGIIYLN

SEQ ID NO: 438102 - protein, 9 aa, Homo Sapiens
FEQTRIQEF

SEQ ID NO: 438103 - protein, 9 aa, Homo Sapiens
RLQTKTIQV

SEQ ID NO: 438104 - protein, 9 aa, Homo Sapiens
YALFQVNDV

SEQ ID NO: 438105 - protein, 9 aa, Homo Sapiens
EWIYVVDMS

SEQ ID NO: 438106 - protein, 9 aa, Homo Sapiens
PCHSHTPTP

SEQ ID NO: 438107 - protein, 9 aa, Homo Sapiens
EKLVKLTNQ

SEQ ID NO: 438108 - protein, 9 aa, Homo Sapiens
FLADFVRGC

SEQ ID NO: 438109 - protein, 9 aa, Homo Sapiens
PPSRQNELL

SEQ ID NO: 438110 - protein, 9 aa, Homo Sapiens
NGNIKHTSK

SEQ ID NO: 438111 - protein, 9 aa, Homo Sapiens
EPSEARDST

SEQ ID NO: 438112 - protein, 9 aa, Homo Sapiens
LVFELCDQD

SEQ ID NO: 438113 - protein, 9 aa, Homo Sapiens
HLQIHNVKI

SEQ ID NO: 438114 - protein, 9 aa, Homo Sapiens
VPRFSVMYA

SEQ ID NO: 438115 - protein, 9 aa, Homo Sapiens
LSANIQFNT

SEQ ID NO: 438116 - protein, 9 aa, Homo Sapiens
DHCMFTMLQ

SEQ ID NO: 438117 - protein, 9 aa, Homo Sapiens
KIFFVMGIT

SEQ ID NO: 438118 - protein, 9 aa, Homo Sapiens
RVRSGVMGE

SEQ ID NO: 438119 - protein, 9 aa, Homo Sapiens
FGNNNLHIL

SEQ ID NO: 438120 - protein, 9 aa, Homo Sapiens
NRKPHHKNK

SEQ ID NO: 438121 - protein, 9 aa, Homo Sapiens
HQDMSSLGK

SEQ ID NO: 438122 - protein, 9 aa, Homo Sapiens
FNRNRPSFD

SEQ ID NO: 438123 - protein, 9 aa, Homo Sapiens
TCMDLVGGF

SEQ ID NO: 438124 - protein, 9 aa, Homo Sapiens
DLNKYLEPR

SEQ ID NO: 438125 - protein, 9 aa, Homo Sapiens
KWENYFLSF

SEQ ID NO: 438126 - protein, 9 aa, Homo Sapiens
DFNWWHYEH

SEQ ID NO: 438127 - protein, 9 aa, Homo Sapiens
AGMTIDNGV

SEQ ID NO: 438128 - protein, 9 aa, Homo Sapiens
LYARGWKIN

SEQ ID NO: 438129 - protein, 9 aa, Homo Sapiens
NKMFLTQVM

SEQ ID NO: 438130 - protein, 9 aa, Homo Sapiens
EITVIESSV

SEQ ID NO: 438131 - protein, 9 aa, Homo Sapiens
NATLAADDF

SEQ ID NO: 438132 - protein, 9 aa, Homo Sapiens
QRYQEVGGT

SEQ ID NO: 438133 - protein, 9 aa, Homo Sapiens
MFALHSNRH

SEQ ID NO: 438134 - protein, 9 aa, Homo Sapiens
RKTFWKLAK

SEQ ID NO: 438135 - protein, 9 aa, Homo Sapiens
SSYIYQPGG

SEQ ID NO: 438136 - protein, 9 aa, Homo Sapiens
CAFGYKLKE

SEQ ID NO: 438137 - protein, 9 aa, Homo Sapiens
NLELQALTG

SEQ ID NO: 438138 - protein, 9 aa, Homo Sapiens
SYPAPDSCQ

SEQ ID NO: 438139 - protein, 9 aa, Homo Sapiens
VIFFPAECG

SEQ ID NO: 438140 - protein, 9 aa, Homo Sapiens
NYMIWNLVW

SEQ ID NO: 438141 - protein, 9 aa, Homo Sapiens
ISQVRMEWP

SEQ ID NO: 438142 - protein, 9 aa, Homo Sapiens
VDEDLRSES

SEQ ID NO: 438143 - protein, 9 aa, Homo Sapiens
QTVLSSAPV

SEQ ID NO: 438144 - protein, 9 aa, Homo Sapiens
WYGHQIVTY

SEQ ID NO: 438145 - protein, 9 aa, Homo Sapiens
LEKCYGLEI

SEQ ID NO: 438146 - protein, 9 aa, Homo Sapiens
AKHLKKMDV

SEQ ID NO: 438147 - protein, 9 aa, Homo Sapiens
HKSTEQAVS

SEQ ID NO: 438148 - protein, 9 aa, Homo Sapiens
FNRWKSLQM

SEQ ID NO: 438149 - protein, 9 aa, Homo Sapiens
KRRQRVKIS

SEQ ID NO: 438150 - protein, 9 aa, Homo Sapiens
KIIHAEEKP

SEQ ID NO: 438151 - protein, 9 aa, Homo Sapiens
HLSITDISL

SEQ ID NO: 438152 - protein, 9 aa, Homo Sapiens
PKEHNKEEL

SEQ ID NO: 438153 - protein, 9 aa, Homo Sapiens
DHNGGSPQI

SEQ ID NO: 438154 - protein, 9 aa, Homo Sapiens
VRDECEEIN

SEQ ID NO: 438155 - protein, 9 aa, Homo Sapiens
PRDSLLRQT

SEQ ID NO: 438156 - protein, 9 aa, Homo Sapiens
MIISIVGFL

SEQ ID NO: 438157 - protein, 9 aa, Homo Sapiens
SIKVIPFTT

SEQ ID NO: 438158 - protein, 9 aa, Homo Sapiens
SRFVSKKVC

SEQ ID NO: 438159 - protein, 9 aa, Homo Sapiens
DLVLLPNIT

SEQ ID NO: 438160 - protein, 9 aa, Homo Sapiens
DRALLTFDG

SEQ ID NO: 438161 - protein, 9 aa, Homo Sapiens
LTSKNWQEN

SEQ ID NO: 438162 - protein, 9 aa, Homo Sapiens
LTHHLQIHN

SEQ ID NO: 438163 - protein, 9 aa, Homo Sapiens
FQVDHVIWP

SEQ ID NO: 438164 - protein, 9 aa, Homo Sapiens
YDKIVGLRD

SEQ ID NO: 438165 - protein, 9 aa, Homo Sapiens
MTAINPMLN

SEQ ID NO: 438166 - protein, 9 aa, Homo Sapiens
HPACLVNGQ

SEQ ID NO: 438167 - protein, 9 aa, Homo Sapiens
NHFVCDVPA

SEQ ID NO: 438168 - protein, 9 aa, Homo Sapiens
MELYSYVKD

SEQ ID NO: 438169 - protein, 9 aa, Homo Sapiens
LAQATRTTV

SEQ ID NO: 438170 - protein, 9 aa, Homo Sapiens
TQASKRTSD

SEQ ID NO: 438171 - protein, 9 aa, Homo Sapiens
HLVLEENSS

SEQ ID NO: 438172 - protein, 9 aa, Homo Sapiens
QEELLYFKA

SEQ ID NO: 438173 - protein, 9 aa, Homo Sapiens
NYFISAQKE

SEQ ID NO: 438174 - protein, 9 aa, Homo Sapiens
SGSSAEEEC

SEQ ID NO: 438175 - protein, 9 aa, Homo Sapiens
EILEETVIY

SEQ ID NO: 438176 - protein, 9 aa, Homo Sapiens
VEFIQSFDE

SEQ ID NO: 438177 - protein, 9 aa, Homo Sapiens
LGQAERAVA

SEQ ID NO: 438178 - protein, 9 aa, Homo Sapiens
SCKGKEVDN

SEQ ID NO: 438179 - protein, 9 aa, Homo Sapiens
SQYLFKLLD

SEQ ID NO: 438180 - protein, 9 aa, Homo Sapiens
VKTSDVETI

SEQ ID NO: 438181 - protein, 9 aa, Homo Sapiens
EDEEGSEHG

SEQ ID NO: 438182 - protein, 9 aa, Homo Sapiens
TVCNEFLVD

SEQ ID NO: 438183 - protein, 9 aa, Homo Sapiens
HYRCVARVD

SEQ ID NO: 438184 - protein, 9 aa, Homo Sapiens
TVRAKCSQD

SEQ ID NO: 438185 - protein, 9 aa, Homo Sapiens
KRSLDIGKK

SEQ ID NO: 438186 - protein, 9 aa, Homo Sapiens
KEEEASKSV

SEQ ID NO: 438187 - protein, 9 aa, Homo Sapiens
PITMENFNN

SEQ ID NO: 438188 - protein, 9 aa, Homo Sapiens
LHTAIVITY

SEQ ID NO: 438189 - protein, 9 aa, Homo Sapiens
LICDIFRKQ

SEQ ID NO: 438190 - protein, 9 aa, Homo Sapiens
SSMLKYFLS

SEQ ID NO: 438191 - protein, 9 aa, Homo Sapiens
LANNFPAHI

SEQ ID NO: 438192 - protein, 9 aa, Homo Sapiens
IYDVQERHP

SEQ ID NO: 438193 - protein, 9 aa, Homo Sapiens
EQMVRTDPL

SEQ ID NO: 438194 - protein, 9 aa, Homo Sapiens
KHGKARTDL

SEQ ID NO: 438195 - protein, 9 aa, Homo Sapiens
ILQKLEPID

SEQ ID NO: 438196 - protein, 9 aa, Homo Sapiens
ETSLWLRWV

SEQ ID NO: 438197 - protein, 9 aa, Homo Sapiens
LPWGPALLV

SEQ ID NO: 438198 - protein, 9 aa, Homo Sapiens
MSQSLDLSK

SEQ ID NO: 438199 - protein, 9 aa, Homo Sapiens
IFENVIFIC

SEQ ID NO: 438200 - protein, 9 aa, Homo Sapiens
GVVATKVRR

SEQ ID NO: 438201 - protein, 9 aa, Homo Sapiens
IHETHTRHR

SEQ ID NO: 438202 - protein, 9 aa, Homo Sapiens
KKPRFDLEK

SEQ ID NO: 438203 - protein, 9 aa, Homo Sapiens
SVWYLGYLA

SEQ ID NO: 438204 - protein, 9 aa, Homo Sapiens
YSSVLQKHQ

SEQ ID NO: 438205 - protein, 9 aa, Homo Sapiens
LLQRLLPAG

SEQ ID NO: 438206 - protein, 9 aa, Homo Sapiens
DKLLASIDI

SEQ ID NO: 438207 - protein, 9 aa, Homo Sapiens
WGPALLVKR

SEQ ID NO: 438208 - protein, 9 aa, Homo Sapiens
LKIHKQTHT

SEQ ID NO: 438209 - protein, 9 aa, Homo Sapiens
RDYFSSGTS

SEQ ID NO: 438210 - protein, 9 aa, Homo Sapiens
PLIQRNEIE

SEQ ID NO: 438211 - protein, 9 aa, Homo Sapiens
ETDHSDESH

SEQ ID NO: 438212 - protein, 9 aa, Homo Sapiens
QLPIYQRKP

SEQ ID NO: 438213 - protein, 9 aa, Homo Sapiens
NKLFGNKDE

SEQ ID NO: 438214 - protein, 9 aa, Homo Sapiens
LKLEEKNTI

SEQ ID NO: 438215 - protein, 9 aa, Homo Sapiens
LRLGIKRKL

SEQ ID NO: 438216 - protein, 9 aa, Homo Sapiens
RLDFLAKAH

SEQ ID NO: 438217 - protein, 9 aa, Homo Sapiens
DLDTEDDSE

SEQ ID NO: 438218 - protein, 9 aa, Homo Sapiens
IWSLQLNGV

SEQ ID NO: 438219 - protein, 9 aa, Homo Sapiens
AQKGYEKKR

SEQ ID NO: 438220 - protein, 9 aa, Homo Sapiens
LTIYLVVAL

SEQ ID NO: 438221 - protein, 9 aa, Homo Sapiens
TVCEGSAIA

SEQ ID NO: 438222 - protein, 9 aa, Homo Sapiens
LGGIFHFFF

SEQ ID NO: 438223 - protein, 9 aa, Homo Sapiens
HKQINPMDV

SEQ ID NO: 438224 - protein, 9 aa, Homo Sapiens
LGQKVAVNN

SEQ ID NO: 438225 - protein, 9 aa, Homo Sapiens
MTKFQDMVT

SEQ ID NO: 438226 - protein, 9 aa, Homo Sapiens
NPIITQLFP

SEQ ID NO: 438227 - protein, 9 aa, Homo Sapiens
RNQELKQHV

SEQ ID NO: 438228 - protein, 9 aa, Homo Sapiens
KVWWRLCKT

SEQ ID NO: 438229 - protein, 9 aa, Homo Sapiens
FCWGYQLTQ

SEQ ID NO: 438230 - protein, 9 aa, Homo Sapiens
IKNAEIYNY

SEQ ID NO: 438231 - protein, 9 aa, Homo Sapiens
ELDNFSSEI

SEQ ID NO: 438232 - protein, 9 aa, Homo Sapiens
LTNRQPKDK

SEQ ID NO: 438233 - protein, 9 aa, Homo Sapiens
VTANFVELG

SEQ ID NO: 438234 - protein, 9 aa, Homo Sapiens
KDAELDKLR

SEQ ID NO: 438235 - protein, 9 aa, Homo Sapiens
GRFLASTPC

SEQ ID NO: 438236 - protein, 9 aa, Homo Sapiens
NGNSCAAQI

SEQ ID NO: 438237 - protein, 9 aa, Homo Sapiens
NLDTMCADD

SEQ ID NO: 438238 - protein, 9 aa, Homo Sapiens
ETSEVESLQ

SEQ ID NO: 438239 - protein, 9 aa, Homo Sapiens
GKQNFLEER

SEQ ID NO: 438240 - protein, 9 aa, Homo Sapiens
QNQKTQPIP

SEQ ID NO: 438241 - protein, 9 aa, Homo Sapiens
SADKPSVSQ

SEQ ID NO: 438242 - protein, 9 aa, Homo Sapiens
FIDCLKIFL

SEQ ID NO: 438243 - protein, 9 aa, Homo Sapiens
IIIGLYFVG

SEQ ID NO: 438244 - protein, 9 aa, Homo Sapiens
IINTTHLDK

SEQ ID NO: 438245 - protein, 9 aa, Homo Sapiens
LILPPPHLF

SEQ ID NO: 438246 - protein, 9 aa, Homo Sapiens
ESEYGIEGD

SEQ ID NO: 438247 - protein, 9 aa, Homo Sapiens
SGAFCYDIV

SEQ ID NO: 438248 - protein, 9 aa, Homo Sapiens
IIATRGVVQ

SEQ ID NO: 438249 - protein, 9 aa, Homo Sapiens
AEDSKGIFD

SEQ ID NO: 438250 - protein, 9 aa, Homo Sapiens
YLEKCYGLE

SEQ ID NO: 438251 - protein, 9 aa, Homo Sapiens
HCLPKSIKT

SEQ ID NO: 438252 - protein, 9 aa, Homo Sapiens
TANTQTPVE

SEQ ID NO: 438253 - protein, 9 aa, Homo Sapiens
VIYPLMQGL

SEQ ID NO: 438254 - protein, 9 aa, Homo Sapiens
FQNWRAKLK

SEQ ID NO: 438255 - protein, 9 aa, Homo Sapiens
EQEMGFEKL

SEQ ID NO: 438256 - protein, 9 aa, Homo Sapiens
CTQNGQMHL

SEQ ID NO: 438257 - protein, 9 aa, Homo Sapiens
YRALDSLNT

SEQ ID NO: 438258 - protein, 9 aa, Homo Sapiens
HLNLHINFL

SEQ ID NO: 438259 - protein, 9 aa, Homo Sapiens
VLKKPVRRR

SEQ ID NO: 438260 - protein, 9 aa, Homo Sapiens
PFQRTRSFQ

SEQ ID NO: 438261 - protein, 9 aa, Homo Sapiens
YDTGGKDPR

SEQ ID NO: 438262 - protein, 9 aa, Homo Sapiens
QHSDLEALF

SEQ ID NO: 438263 - protein, 9 aa, Homo Sapiens
AWLSITVFA

SEQ ID NO: 438264 - protein, 9 aa, Homo Sapiens
LRNEYFFNR

SEQ ID NO: 438265 - protein, 9 aa, Homo Sapiens
VCGKVWKQR

SEQ ID NO: 438266 - protein, 9 aa, Homo Sapiens
KGIFKALPT

SEQ ID NO: 438267 - protein, 9 aa, Homo Sapiens
KKTSSSEYS

SEQ ID NO: 438268 - protein, 9 aa, Homo Sapiens
GKILDVEIM

SEQ ID NO: 438269 - protein, 9 aa, Homo Sapiens
VQWMETVKV

SEQ ID NO: 438270 - protein, 9 aa, Homo Sapiens
VMLVPLPVP

SEQ ID NO: 438271 - protein, 9 aa, Homo Sapiens
SKAQEQTPF

SEQ ID NO: 438272 - protein, 9 aa, Homo Sapiens
EAGIVFGYL

SEQ ID NO: 438273 - protein, 9 aa, Homo Sapiens
AEYEERWAF

SEQ ID NO: 438274 - protein, 9 aa, Homo Sapiens
LAQESAWIL

SEQ ID NO: 438275 - protein, 9 aa, Homo Sapiens
PGANKVMNS

SEQ ID NO: 438276 - protein, 9 aa, Homo Sapiens
LSMSSTNLE

SEQ ID NO: 438277 - protein, 9 aa, Homo Sapiens
NHAMKSQLE

SEQ ID NO: 438278 - protein, 9 aa, Homo Sapiens
VCLLAVNTF

SEQ ID NO: 438279 - protein, 9 aa, Homo Sapiens
MSPYLFFRI

SEQ ID NO: 438280 - protein, 9 aa, Homo Sapiens
RFWMKWLLQ

SEQ ID NO: 438281 - protein, 9 aa, Homo Sapiens
NNALSHNVN

SEQ ID NO: 438282 - protein, 9 aa, Homo Sapiens
TALHMAACS

SEQ ID NO: 438283 - protein, 9 aa, Homo Sapiens
KLEVIRKKL

SEQ ID NO: 438284 - protein, 9 aa, Homo Sapiens
HTKFGYGVL

SEQ ID NO: 438285 - protein, 9 aa, Homo Sapiens
RQQQTINMQ

SEQ ID NO: 438286 - protein, 9 aa, Homo Sapiens
LSDLGYLLL

SEQ ID NO: 438287 - protein, 9 aa, Homo Sapiens
ASRCRSAYE

SEQ ID NO: 438288 - protein, 9 aa, Homo Sapiens
DIEGIHREY

SEQ ID NO: 438289 - protein, 9 aa, Homo Sapiens
EGNGNCVTR

SEQ ID NO: 438290 - protein, 9 aa, Homo Sapiens
IMNQVQSTM

SEQ ID NO: 438291 - protein, 9 aa, Homo Sapiens
VDVREGRVQ

SEQ ID NO: 438292 - protein, 9 aa, Homo Sapiens
RLRAVYFLA

SEQ ID NO: 438293 - protein, 9 aa, Homo Sapiens
ESFLARAKF

SEQ ID NO: 438294 - protein, 9 aa, Homo Sapiens
DYFPIQLVN

SEQ ID NO: 438295 - protein, 9 aa, Homo Sapiens
EIIHTGEEP

SEQ ID NO: 438296 - protein, 9 aa, Homo Sapiens
CTNVDGCKV

SEQ ID NO: 438297 - protein, 9 aa, Homo Sapiens
PSEVEAFEA

SEQ ID NO: 438298 - protein, 9 aa, Homo Sapiens
NCLLIFRSQ

SEQ ID NO: 438299 - protein, 9 aa, Homo Sapiens
QSRLCADRV

SEQ ID NO: 438300 - protein, 9 aa, Homo Sapiens
QFQPISCEP

SEQ ID NO: 438301 - protein, 9 aa, Homo Sapiens
LSGGVGAFA

SEQ ID NO: 438302 - protein, 9 aa, Homo Sapiens
TSVQSVNDG

SEQ ID NO: 438303 - protein, 9 aa, Homo Sapiens
KETILWANN

SEQ ID NO: 438304 - protein, 9 aa, Homo Sapiens
RRKKKCVCY

SEQ ID NO: 438305 - protein, 9 aa, Homo Sapiens
THKIILTGE

SEQ ID NO: 438306 - protein, 9 aa, Homo Sapiens
RYQCTVENP

SEQ ID NO: 438307 - protein, 9 aa, Homo Sapiens
TSKHHPFFQ

SEQ ID NO: 438308 - protein, 9 aa, Homo Sapiens
STTRYIKAL

SEQ ID NO: 438309 - protein, 9 aa, Homo Sapiens
SILNIHSSE

SEQ ID NO: 438310 - protein, 9 aa, Homo Sapiens
YEASDKDFM

SEQ ID NO: 438311 - protein, 9 aa, Homo Sapiens
KDRKIIMWD

SEQ ID NO: 438312 - protein, 9 aa, Homo Sapiens
VRECTIMCV

SEQ ID NO: 438313 - protein, 9 aa, Homo Sapiens
INHFVCDVP

SEQ ID NO: 438314 - protein, 9 aa, Homo Sapiens
LLEGIKKVI

SEQ ID NO: 438315 - protein, 9 aa, Homo Sapiens
ITIYGVTPL

SEQ ID NO: 438316 - protein, 9 aa, Homo Sapiens
SFEELQSTL

SEQ ID NO: 438317 - protein, 9 aa, Homo Sapiens
LMSFINNET

SEQ ID NO: 438318 - protein, 9 aa, Homo Sapiens
CGDKGEPGE

SEQ ID NO: 438319 - protein, 9 aa, Homo Sapiens
IFIVVAVFL

SEQ ID NO: 438320 - protein, 9 aa, Homo Sapiens
REQKYFKIT

SEQ ID NO: 438321 - protein, 9 aa, Homo Sapiens
PWESEQVQW

SEQ ID NO: 438322 - protein, 9 aa, Homo Sapiens
DHCPAEELK

SEQ ID NO: 438323 - protein, 9 aa, Homo Sapiens
PIFCTSSLP

SEQ ID NO: 438324 - protein, 9 aa, Homo Sapiens
EGHVQVLRS

SEQ ID NO: 438325 - protein, 9 aa, Homo Sapiens
RHPFTPIHS

SEQ ID NO: 438326 - protein, 9 aa, Homo Sapiens
TFDQKRDAL

SEQ ID NO: 438327 - protein, 9 aa, Homo Sapiens
LTLDLDYTG

SEQ ID NO: 438328 - protein, 9 aa, Homo Sapiens
KRFFKSLEE

SEQ ID NO: 438329 - protein, 9 aa, Homo Sapiens
AKQRTEKHI

SEQ ID NO: 438330 - protein, 9 aa, Homo Sapiens
PPPPPVDYA

SEQ ID NO: 438331 - protein, 9 aa, Homo Sapiens
IDDEKLQNE

SEQ ID NO: 438332 - protein, 9 aa, Homo Sapiens
FCSIAARKL

SEQ ID NO: 438333 - protein, 9 aa, Homo Sapiens
NHSLDKDTL

SEQ ID NO: 438334 - protein, 9 aa, Homo Sapiens
PDELRPTVV

SEQ ID NO: 438335 - protein, 9 aa, Homo Sapiens
LNKLRTNWI

SEQ ID NO: 438336 - protein, 9 aa, Homo Sapiens
VAGEVHIGG

SEQ ID NO: 438337 - protein, 9 aa, Homo Sapiens
TPPGQYSGK

SEQ ID NO: 438338 - protein, 9 aa, Homo Sapiens
FSGPKPNNL

SEQ ID NO: 438339 - protein, 9 aa, Homo Sapiens
AKPPLEAEY

SEQ ID NO: 438340 - protein, 9 aa, Homo Sapiens
NFTPMDLFK

SEQ ID NO: 438341 - protein, 9 aa, Homo Sapiens
AYFSLSTCP

SEQ ID NO: 438342 - protein, 9 aa, Homo Sapiens
TMVSYTEIL

SEQ ID NO: 438343 - protein, 9 aa, Homo Sapiens
TPKGNWRGQ

SEQ ID NO: 438344 - protein, 9 aa, Homo Sapiens
RTKRRQRVK

SEQ ID NO: 438345 - protein, 9 aa, Homo Sapiens
GQYSGKSFK

SEQ ID NO: 438346 - protein, 9 aa, Homo Sapiens
TRTFFCHPL

SEQ ID NO: 438347 - protein, 9 aa, Homo Sapiens
ATEPESYLD

SEQ ID NO: 438348 - protein, 9 aa, Homo Sapiens
QYLFKLLDC

SEQ ID NO: 438349 - protein, 9 aa, Homo Sapiens
SKMHFQTML

SEQ ID NO: 438350 - protein, 9 aa, Homo Sapiens
RSLDIGKKH

SEQ ID NO: 438351 - protein, 9 aa, Homo Sapiens
AVLSVCVRL

SEQ ID NO: 438352 - protein, 9 aa, Homo Sapiens
HVEDDSRGW

SEQ ID NO: 438353 - protein, 9 aa, Homo Sapiens
TEVSADVFM

SEQ ID NO: 438354 - protein, 9 aa, Homo Sapiens
ADIIRKQVS

SEQ ID NO: 438355 - protein, 9 aa, Homo Sapiens
SKAKEYLIA

SEQ ID NO: 438356 - protein, 9 aa, Homo Sapiens
VFNDILVYG

SEQ ID NO: 438357 - protein, 9 aa, Homo Sapiens
FLANLSIAD

SEQ ID NO: 438358 - protein, 9 aa, Homo Sapiens
RESIYYTLS

SEQ ID NO: 438359 - protein, 9 aa, Homo Sapiens
QLGIHEISE

SEQ ID NO: 438360 - protein, 9 aa, Homo Sapiens
QGPIPEHIL

SEQ ID NO: 438361 - protein, 9 aa, Homo Sapiens
LGLLISFLF

SEQ ID NO: 438362 - protein, 9 aa, Homo Sapiens
FNGASESGI

SEQ ID NO: 438363 - protein, 9 aa, Homo Sapiens
HTGKKSYAC

SEQ ID NO: 438364 - protein, 9 aa, Homo Sapiens
DNLLRITET

SEQ ID NO: 438365 - protein, 9 aa, Homo Sapiens
TSCPHYFLG

SEQ ID NO: 438366 - protein, 9 aa, Homo Sapiens
GCGCCGKVL

SEQ ID NO: 438367 - protein, 9 aa, Homo Sapiens
HRRPPHNAS

SEQ ID NO: 438368 - protein, 9 aa, Homo Sapiens
SDDESHKPK

SEQ ID NO: 438369 - protein, 9 aa, Homo Sapiens
GGDPSGLLN

SEQ ID NO: 438370 - protein, 9 aa, Homo Sapiens
FPKFLTMMA

SEQ ID NO: 438371 - protein, 9 aa, Homo Sapiens
KHYRPPKGT

SEQ ID NO: 438372 - protein, 9 aa, Homo Sapiens
EVPDQLYRL

SEQ ID NO: 438373 - protein, 9 aa, Homo Sapiens
TLKANKGIK

SEQ ID NO: 438374 - protein, 9 aa, Homo Sapiens
LQVDGKKSK

SEQ ID NO: 438375 - protein, 9 aa, Homo Sapiens
YKKIILLKG

SEQ ID NO: 438376 - protein, 9 aa, Homo Sapiens
KEKQMLKFS

SEQ ID NO: 438377 - protein, 9 aa, Homo Sapiens
ERRLPAVCK

SEQ ID NO: 438378 - protein, 9 aa, Homo Sapiens
SLIKDTWYQ

SEQ ID NO: 438379 - protein, 9 aa, Homo Sapiens
ECPRRQRPH

SEQ ID NO: 438380 - protein, 9 aa, Homo Sapiens
KFIKIDQAW

SEQ ID NO: 438381 - protein, 9 aa, Homo Sapiens
LKEKGKWLA

SEQ ID NO: 438382 - protein, 9 aa, Homo Sapiens
TKRIQKQFF

SEQ ID NO: 438383 - protein, 9 aa, Homo Sapiens
ALNSSMLKY

SEQ ID NO: 438384 - protein, 9 aa, Homo Sapiens
LRLWEQFSG

SEQ ID NO: 438385 - protein, 9 aa, Homo Sapiens
CTPTYSMQG

SEQ ID NO: 438386 - protein, 9 aa, Homo Sapiens
FLGRPIIWG

SEQ ID NO: 438387 - protein, 9 aa, Homo Sapiens
ELCDQDLKK

SEQ ID NO: 438388 - protein, 9 aa, Homo Sapiens
ISEYISVDT

SEQ ID NO: 438389 - protein, 9 aa, Homo Sapiens
FKDVMGKSN

SEQ ID NO: 438390 - protein, 9 aa, Homo Sapiens
FVLILVVVD

SEQ ID NO: 438391 - protein, 9 aa, Homo Sapiens
IDFCRYSTD

SEQ ID NO: 438392 - protein, 9 aa, Homo Sapiens
NPTFMCLVL

SEQ ID NO: 438393 - protein, 9 aa, Homo Sapiens
QNSLDNFIS

SEQ ID NO: 438394 - protein, 9 aa, Homo Sapiens
KEIINRVID

SEQ ID NO: 438395 - protein, 9 aa, Homo Sapiens
SYYCDHNFV

SEQ ID NO: 438396 - protein, 9 aa, Homo Sapiens
MNPIALGSH

SEQ ID NO: 438397 - protein, 9 aa, Homo Sapiens
VIDDIQDLI

SEQ ID NO: 438398 - protein, 9 aa, Homo Sapiens
QVAALVHIY

SEQ ID NO: 438399 - protein, 9 aa, Homo Sapiens
SSKCFLGQL

SEQ ID NO: 438400 - protein, 9 aa, Homo Sapiens
IHLPFCGPN

SEQ ID NO: 438401 - protein, 9 aa, Homo Sapiens
LHLNTKGPE

SEQ ID NO: 438402 - protein, 9 aa, Homo Sapiens
VKLLLLAGP

SEQ ID NO: 438403 - protein, 9 aa, Homo Sapiens
PEMSNKLEA

SEQ ID NO: 438404 - protein, 9 aa, Homo Sapiens
GLNEAGLED

SEQ ID NO: 438405 - protein, 9 aa, Homo Sapiens
PVTGLVSCK

SEQ ID NO: 438406 - protein, 9 aa, Homo Sapiens
LSHKDEELS

SEQ ID NO: 438407 - protein, 9 aa, Homo Sapiens
RASHGVWKG

SEQ ID NO: 438408 - protein, 9 aa, Homo Sapiens
ANECYSGLK

SEQ ID NO: 438409 - protein, 9 aa, Homo Sapiens
YGNNPLTSS

SEQ ID NO: 438410 - protein, 9 aa, Homo Sapiens
LNQETEAIQ

SEQ ID NO: 438411 - protein, 9 aa, Homo Sapiens
NADHLLHLN

SEQ ID NO: 438412 - protein, 9 aa, Homo Sapiens
INSHKINCQ

SEQ ID NO: 438413 - protein, 9 aa, Homo Sapiens
NKKLWQIKS

SEQ ID NO: 438414 - protein, 9 aa, Homo Sapiens
QFGLSLQSH

SEQ ID NO: 438415 - protein, 9 aa, Homo Sapiens
SVMRQGCHL

SEQ ID NO: 438416 - protein, 9 aa, Homo Sapiens
TVSILIVIP

SEQ ID NO: 438417 - protein, 9 aa, Homo Sapiens
KPNNLGNNT

SEQ ID NO: 438418 - protein, 9 aa, Homo Sapiens
FLDMFVYCT

SEQ ID NO: 438419 - protein, 9 aa, Homo Sapiens
TMSRPGANK

SEQ ID NO: 438420 - protein, 9 aa, Homo Sapiens
MALHFALLM

SEQ ID NO: 438421 - protein, 9 aa, Homo Sapiens
RIEASLQER

SEQ ID NO: 438422 - protein, 9 aa, Homo Sapiens
GNRTTILSS

SEQ ID NO: 438423 - protein, 9 aa, Homo Sapiens
AGITASVSI

SEQ ID NO: 438424 - protein, 9 aa, Homo Sapiens
EPKDQIGVL

SEQ ID NO: 438425 - protein, 9 aa, Homo Sapiens
FILNFWVTI

SEQ ID NO: 438426 - protein, 9 aa, Homo Sapiens
MYYPSWPNF

SEQ ID NO: 438427 - protein, 9 aa, Homo Sapiens
KKSLDLFRL

SEQ ID NO: 438428 - protein, 9 aa, Homo Sapiens
GRGKHQATA

SEQ ID NO: 438429 - protein, 9 aa, Homo Sapiens
GDYYRQGHI

SEQ ID NO: 438430 - protein, 9 aa, Homo Sapiens
GNTKISEPG

SEQ ID NO: 438431 - protein, 9 aa, Homo Sapiens
VAEDERLGC

SEQ ID NO: 438432 - protein, 9 aa, Homo Sapiens
GCFQFGAYL

SEQ ID NO: 438433 - protein, 9 aa, Homo Sapiens
SLWPSEEFL

SEQ ID NO: 438434 - protein, 9 aa, Homo Sapiens
VVMLVPLPV

SEQ ID NO: 438435 - protein, 9 aa, Homo Sapiens
TNNIIGQPR

SEQ ID NO: 438436 - protein, 9 aa, Homo Sapiens
CHTLATRIV

SEQ ID NO: 438437 - protein, 9 aa, Homo Sapiens
KAGKVPLSL

SEQ ID NO: 438438 - protein, 9 aa, Homo Sapiens
VLIQRQTKT

SEQ ID NO: 438439 - protein, 9 aa, Homo Sapiens
HRSALVKVI

SEQ ID NO: 438440 - protein, 9 aa, Homo Sapiens
HWLAYAENK

SEQ ID NO: 438441 - protein, 9 aa, Homo Sapiens
NIYSNIFGF

SEQ ID NO: 438442 - protein, 9 aa, Homo Sapiens
YQTAKFHSR

SEQ ID NO: 438443 - protein, 9 aa, Homo Sapiens
PLTSSLLPQ

SEQ ID NO: 438444 - protein, 9 aa, Homo Sapiens
TLTLEMLKS

SEQ ID NO: 438445 - protein, 9 aa, Homo Sapiens
SKPLKMAGD

SEQ ID NO: 438446 - protein, 9 aa, Homo Sapiens
ELDHRLSAT

SEQ ID NO: 438447 - protein, 9 aa, Homo Sapiens
EECFQSLRI

SEQ ID NO: 438448 - protein, 9 aa, Homo Sapiens
GNGTIDFPK

SEQ ID NO: 438449 - protein, 9 aa, Homo Sapiens
SPLTFLSAP

SEQ ID NO: 438450 - protein, 9 aa, Homo Sapiens
ITSSQSSSS

SEQ ID NO: 438451 - protein, 9 aa, Homo Sapiens
FVSKKVCYH

SEQ ID NO: 438452 - protein, 9 aa, Homo Sapiens
IFNRSFQTG

SEQ ID NO: 438453 - protein, 9 aa, Homo Sapiens
MGKNPRSWG

SEQ ID NO: 438454 - protein, 9 aa, Homo Sapiens
KDMKEKTKT

SEQ ID NO: 438455 - protein, 9 aa, Homo Sapiens
NWRASILLS

SEQ ID NO: 438456 - protein, 9 aa, Homo Sapiens
DELTSLNNT

SEQ ID NO: 438457 - protein, 9 aa, Homo Sapiens
YSKFFNLIC

SEQ ID NO: 438458 - protein, 9 aa, Homo Sapiens
WLALPFSII

SEQ ID NO: 438459 - protein, 9 aa, Homo Sapiens
ENNITGKWL

SEQ ID NO: 438460 - protein, 9 aa, Homo Sapiens
QWIRVKHTH

SEQ ID NO: 438461 - protein, 9 aa, Homo Sapiens
TMGPSAVCK

SEQ ID NO: 438462 - protein, 9 aa, Homo Sapiens
NLELEDMEN

SEQ ID NO: 438463 - protein, 9 aa, Homo Sapiens
NGKKVKALD

SEQ ID NO: 438464 - protein, 9 aa, Homo Sapiens
KVQKGNVVN

SEQ ID NO: 438465 - protein, 9 aa, Homo Sapiens
DPAEHDGIN

SEQ ID NO: 438466 - protein, 9 aa, Homo Sapiens
ADCSNIDEI

SEQ ID NO: 438467 - protein, 9 aa, Homo Sapiens
YSVKKKEDL

SEQ ID NO: 438468 - protein, 9 aa, Homo Sapiens
SFADRCSSL

SEQ ID NO: 438469 - protein, 9 aa, Homo Sapiens
YFKITCGKV

SEQ ID NO: 438470 - protein, 9 aa, Homo Sapiens
VKMWRQEEK

SEQ ID NO: 438471 - protein, 9 aa, Homo Sapiens
SLPVPFRKD

SEQ ID NO: 438472 - protein, 9 aa, Homo Sapiens
MDKIDQINR

SEQ ID NO: 438473 - protein, 9 aa, Homo Sapiens
AGLHKHRIT

SEQ ID NO: 438474 - protein, 9 aa, Homo Sapiens
KETSENNTK

SEQ ID NO: 438475 - protein, 9 aa, Homo Sapiens
TDTGVVCHT

SEQ ID NO: 438476 - protein, 9 aa, Homo Sapiens
AQADSLTIY

SEQ ID NO: 438477 - protein, 9 aa, Homo Sapiens
YLRNWRLLI

SEQ ID NO: 438478 - protein, 9 aa, Homo Sapiens
FANNPLQAR

SEQ ID NO: 438479 - protein, 9 aa, Homo Sapiens
LPLLSGLGG

SEQ ID NO: 438480 - protein, 9 aa, Homo Sapiens
LKDEAKQYR

SEQ ID NO: 438481 - protein, 9 aa, Homo Sapiens
TKNFSLPVL

SEQ ID NO: 438482 - protein, 9 aa, Homo Sapiens
LITLDSEKP

SEQ ID NO: 438483 - protein, 9 aa, Homo Sapiens
TQTEGETEV

SEQ ID NO: 438484 - protein, 9 aa, Homo Sapiens
MDWLEFLFF

SEQ ID NO: 438485 - protein, 9 aa, Homo Sapiens
AIGNFALTV

SEQ ID NO: 438486 - protein, 9 aa, Homo Sapiens
KEIILAMLM

SEQ ID NO: 438487 - protein, 9 aa, Homo Sapiens
STQEADPMK

SEQ ID NO: 438488 - protein, 9 aa, Homo Sapiens
TQHSITDNS

SEQ ID NO: 438489 - protein, 9 aa, Homo Sapiens
AVVVWKIKQ

SEQ ID NO: 438490 - protein, 9 aa, Homo Sapiens
VAEWCYGPA

SEQ ID NO: 438491 - protein, 9 aa, Homo Sapiens
SNDRVIHWI

SEQ ID NO: 438492 - protein, 9 aa, Homo Sapiens
PSTVQVCNR

SEQ ID NO: 438493 - protein, 9 aa, Homo Sapiens
QPYMYQQNT

SEQ ID NO: 438494 - protein, 9 aa, Homo Sapiens
IKLLHLGKT

SEQ ID NO: 438495 - protein, 9 aa, Homo Sapiens
IYFDSHLNS

SEQ ID NO: 438496 - protein, 9 aa, Homo Sapiens
QPPLQPSPG

SEQ ID NO: 438497 - protein, 9 aa, Homo Sapiens
CTPKKGSNC

SEQ ID NO: 438498 - protein, 9 aa, Homo Sapiens
ELAIFPISP

SEQ ID NO: 438499 - protein, 9 aa, Homo Sapiens
KIQYHSRGE

SEQ ID NO: 438500 - protein, 9 aa, Homo Sapiens
RDVAIKFSL

SEQ ID NO: 438501 - protein, 9 aa, Homo Sapiens
LLRTTSLKE

SEQ ID NO: 438502 - protein, 9 aa, Homo Sapiens
NVMEQFDPG

SEQ ID NO: 438503 - protein, 9 aa, Homo Sapiens
EIHIVIWEI

SEQ ID NO: 438504 - protein, 9 aa, Homo Sapiens
PGWPPPTAA

SEQ ID NO: 438505 - protein, 9 aa, Homo Sapiens
LNLMQKEAI

SEQ ID NO: 438506 - protein, 9 aa, Homo Sapiens
SVEAVVYND

SEQ ID NO: 438507 - protein, 9 aa, Homo Sapiens
EIKLLAMRF

SEQ ID NO: 438508 - protein, 9 aa, Homo Sapiens
ISKVLTFNL

SEQ ID NO: 438509 - protein, 9 aa, Homo Sapiens
TAPGARARE

SEQ ID NO: 438510 - protein, 9 aa, Homo Sapiens
RLCINMEAK

SEQ ID NO: 438511 - protein, 9 aa, Homo Sapiens
NFGQASRHW

SEQ ID NO: 438512 - protein, 9 aa, Homo Sapiens
PSEARDSTV

SEQ ID NO: 438513 - protein, 9 aa, Homo Sapiens
FTVNEFILL

SEQ ID NO: 438514 - protein, 9 aa, Homo Sapiens
CHSALSVKR

SEQ ID NO: 438515 - protein, 9 aa, Homo Sapiens
VQKPEAEVD

SEQ ID NO: 438516 - protein, 9 aa, Homo Sapiens
SSIICDISN

SEQ ID NO: 438517 - protein, 9 aa, Homo Sapiens
KVIFCSRDK

SEQ ID NO: 438518 - protein, 9 aa, Homo Sapiens
HVWLNEYKE

SEQ ID NO: 438519 - protein, 9 aa, Homo Sapiens
FVVTLSNIM

SEQ ID NO: 438520 - protein, 9 aa, Homo Sapiens
CHISGKYTS

SEQ ID NO: 438521 - protein, 9 aa, Homo Sapiens
YALGCLRIY

SEQ ID NO: 438522 - protein, 9 aa, Homo Sapiens
AEFLSSDPE

SEQ ID NO: 438523 - protein, 9 aa, Homo Sapiens
EGIYKVEIY

SEQ ID NO: 438524 - protein, 9 aa, Homo Sapiens
FQAGYGAGV

SEQ ID NO: 438525 - protein, 9 aa, Homo Sapiens
AVHEPGSPT

SEQ ID NO: 438526 - protein, 9 aa, Homo Sapiens
FCEPGGKGR

SEQ ID NO: 438527 - protein, 9 aa, Homo Sapiens
VVEATSLGI

SEQ ID NO: 438528 - protein, 9 aa, Homo Sapiens
SPGMQCIIS

SEQ ID NO: 438529 - protein, 9 aa, Homo Sapiens
CKSSPPESA

SEQ ID NO: 438530 - protein, 9 aa, Homo Sapiens
FQWIRVKHT

SEQ ID NO: 438531 - protein, 9 aa, Homo Sapiens
SELDNFSSE

SEQ ID NO: 438532 - protein, 9 aa, Homo Sapiens
LGIHEISED

SEQ ID NO: 438533 - protein, 9 aa, Homo Sapiens
ICGCEYGTK

SEQ ID NO: 438534 - protein, 9 aa, Homo Sapiens
SKEDIDTVM

SEQ ID NO: 438535 - protein, 9 aa, Homo Sapiens
NTLSGSSYS

SEQ ID NO: 438536 - protein, 9 aa, Homo Sapiens
KMPYQSVEQ

SEQ ID NO: 438537 - protein, 9 aa, Homo Sapiens
VYRLPPLRQ

SEQ ID NO: 438538 - protein, 9 aa, Homo Sapiens
NLLLIQNSQ

SEQ ID NO: 438539 - protein, 9 aa, Homo Sapiens
RLKKDKKTK

SEQ ID NO: 438540 - protein, 9 aa, Homo Sapiens
INICMYSYT

SEQ ID NO: 438541 - protein, 9 aa, Homo Sapiens
SVLQARLCE

SEQ ID NO: 438542 - protein, 9 aa, Homo Sapiens
SNRALGWAV

SEQ ID NO: 438543 - protein, 9 aa, Homo Sapiens
WFPDLAAEK

SEQ ID NO: 438544 - protein, 9 aa, Homo Sapiens
NTLSGKLEE

SEQ ID NO: 438545 - protein, 9 aa, Homo Sapiens
NGQFVVSAN

SEQ ID NO: 438546 - protein, 9 aa, Homo Sapiens
TFYQTSVES

SEQ ID NO: 438547 - protein, 9 aa, Homo Sapiens
NNYDRLQCE

SEQ ID NO: 438548 - protein, 9 aa, Homo Sapiens
LQSTFSGGQ

SEQ ID NO: 438549 - protein, 9 aa, Homo Sapiens
FSSCRSLGY

SEQ ID NO: 438550 - protein, 9 aa, Homo Sapiens
LIFHEQIHS

SEQ ID NO: 438551 - protein, 9 aa, Homo Sapiens
GEFRMRVSY

SEQ ID NO: 438552 - protein, 9 aa, Homo Sapiens
FAISNILSL

SEQ ID NO: 438553 - protein, 9 aa, Homo Sapiens
YYIYWTDWS

SEQ ID NO: 438554 - protein, 9 aa, Homo Sapiens
EYKHVCKQA

SEQ ID NO: 438555 - protein, 9 aa, Homo Sapiens
KLSLKSHND

SEQ ID NO: 438556 - protein, 9 aa, Homo Sapiens
LPAPVVSWY

SEQ ID NO: 438557 - protein, 9 aa, Homo Sapiens
GLKRLCINM

SEQ ID NO: 438558 - protein, 9 aa, Homo Sapiens
VTLNYTTRD

SEQ ID NO: 438559 - protein, 9 aa, Homo Sapiens
RRHHSYLYS

SEQ ID NO: 438560 - protein, 9 aa, Homo Sapiens
AIQYIRISP

SEQ ID NO: 438561 - protein, 9 aa, Homo Sapiens
HSRSRSSRG

SEQ ID NO: 438562 - protein, 9 aa, Homo Sapiens
EKAREERFT

SEQ ID NO: 438563 - protein, 9 aa, Homo Sapiens
TYEAICKAF

SEQ ID NO: 438564 - protein, 9 aa, Homo Sapiens
IYVMYIVCK

SEQ ID NO: 438565 - protein, 9 aa, Homo Sapiens
ETFQFIIGK

SEQ ID NO: 438566 - protein, 9 aa, Homo Sapiens
YYSTMNYDI

SEQ ID NO: 438567 - protein, 9 aa, Homo Sapiens
QTGVIHEKQ

SEQ ID NO: 438568 - protein, 9 aa, Homo Sapiens
KFEFWASSV

SEQ ID NO: 438569 - protein, 9 aa, Homo Sapiens
FPHIPHPSM

SEQ ID NO: 438570 - protein, 9 aa, Homo Sapiens
DFANHFPAY

SEQ ID NO: 438571 - protein, 9 aa, Homo Sapiens
RGCTEPNHP

SEQ ID NO: 438572 - protein, 9 aa, Homo Sapiens
NTLTHTDLK

SEQ ID NO: 438573 - protein, 9 aa, Homo Sapiens
WRQVTESFC

SEQ ID NO: 438574 - protein, 9 aa, Homo Sapiens
PDKLKRMST

SEQ ID NO: 438575 - protein, 9 aa, Homo Sapiens
GGGSGRITM

SEQ ID NO: 438576 - protein, 9 aa, Homo Sapiens
DSLLRQTIA

SEQ ID NO: 438577 - protein, 9 aa, Homo Sapiens
SILDNLRNK

SEQ ID NO: 438578 - protein, 9 aa, Homo Sapiens
SDTFYPYLD

SEQ ID NO: 438579 - protein, 9 aa, Homo Sapiens
GFFDLITIV

SEQ ID NO: 438580 - protein, 9 aa, Homo Sapiens
SEDVLSSVD

SEQ ID NO: 438581 - protein, 9 aa, Homo Sapiens
SKLDSEVAW

SEQ ID NO: 438582 - protein, 9 aa, Homo Sapiens
ACNIEVKHF

SEQ ID NO: 438583 - protein, 9 aa, Homo Sapiens
CCPVECEKC

SEQ ID NO: 438584 - protein, 9 aa, Homo Sapiens
ESVSTMEIL

SEQ ID NO: 438585 - protein, 9 aa, Homo Sapiens
VNHLNTCKP

SEQ ID NO: 438586 - protein, 9 aa, Homo Sapiens
DNENGPKPN

SEQ ID NO: 438587 - protein, 9 aa, Homo Sapiens
VLEPPQKHR

SEQ ID NO: 438588 - protein, 9 aa, Homo Sapiens
GDFSDWPFV

SEQ ID NO: 438589 - protein, 9 aa, Homo Sapiens
FPKVRILCL

SEQ ID NO: 438590 - protein, 9 aa, Homo Sapiens
KIKENRQQN

SEQ ID NO: 438591 - protein, 9 aa, Homo Sapiens
ALKDRGISI

SEQ ID NO: 438592 - protein, 9 aa, Homo Sapiens
LLASCSDYM

SEQ ID NO: 438593 - protein, 9 aa, Homo Sapiens
INICTGQEC

SEQ ID NO: 438594 - protein, 9 aa, Homo Sapiens
SPLSDTIFA

SEQ ID NO: 438595 - protein, 9 aa, Homo Sapiens
MHFYFLDPP

SEQ ID NO: 438596 - protein, 9 aa, Homo Sapiens
SSVWRNKEM

SEQ ID NO: 438597 - protein, 9 aa, Homo Sapiens
EALCLLRLQ

SEQ ID NO: 438598 - protein, 9 aa, Homo Sapiens
CSMKNTYKV

SEQ ID NO: 438599 - protein, 9 aa, Homo Sapiens
KSRAINHFV

SEQ ID NO: 438600 - protein, 9 aa, Homo Sapiens
ELNVDRVFQ

SEQ ID NO: 438601 - protein, 9 aa, Homo Sapiens
SVKMEVDED

SEQ ID NO: 438602 - protein, 9 aa, Homo Sapiens
MELEDHITH

SEQ ID NO: 438603 - protein, 9 aa, Homo Sapiens
NQALGRPEN

SEQ ID NO: 438604 - protein, 9 aa, Homo Sapiens
KSALCLGVG

SEQ ID NO: 438605 - protein, 9 aa, Homo Sapiens
VKIEQAKRS

SEQ ID NO: 438606 - protein, 9 aa, Homo Sapiens
VNDVNQPFE

SEQ ID NO: 438607 - protein, 9 aa, Homo Sapiens
LDACKGDSG

SEQ ID NO: 438608 - protein, 9 aa, Homo Sapiens
GNNPLTSSL

SEQ ID NO: 438609 - protein, 9 aa, Homo Sapiens
IKDTRFSHP

SEQ ID NO: 438610 - protein, 9 aa, Homo Sapiens
DYEDGLSLP

SEQ ID NO: 438611 - protein, 9 aa, Homo Sapiens
TYQVLAHDS

SEQ ID NO: 438612 - protein, 9 aa, Homo Sapiens
LVEIWLSGI

SEQ ID NO: 438613 - protein, 9 aa, Homo Sapiens
SSMTQTDIV

SEQ ID NO: 438614 - protein, 9 aa, Homo Sapiens
RLNLQRRAA

SEQ ID NO: 438615 - protein, 9 aa, Homo Sapiens
SLLNLSLMN

SEQ ID NO: 438616 - protein, 9 aa, Homo Sapiens
STSATVLGQ

SEQ ID NO: 438617 - protein, 9 aa, Homo Sapiens
PVDYADEEA

SEQ ID NO: 438618 - protein, 9 aa, Homo Sapiens
FTWNTLSAA

SEQ ID NO: 438619 - protein, 9 aa, Homo Sapiens
EEDEEETTL

SEQ ID NO: 438620 - protein, 9 aa, Homo Sapiens
LSSLPEFEK

SEQ ID NO: 438621 - protein, 9 aa, Homo Sapiens
IYGVDSSAD

SEQ ID NO: 438622 - protein, 9 aa, Homo Sapiens
EYLTRPHLE

SEQ ID NO: 438623 - protein, 9 aa, Homo Sapiens
KAIMCNRRQ

SEQ ID NO: 438624 - protein, 9 aa, Homo Sapiens
KFMKTRQRQ

SEQ ID NO: 438625 - protein, 9 aa, Homo Sapiens
KNQFGLSLQ

SEQ ID NO: 438626 - protein, 9 aa, Homo Sapiens
NIEVKHFPF

SEQ ID NO: 438627 - protein, 9 aa, Homo Sapiens
QDEEEGIQY

SEQ ID NO: 438628 - protein, 9 aa, Homo Sapiens
INHSNSDNT

SEQ ID NO: 438629 - protein, 9 aa, Homo Sapiens
SAKMDDNGN

SEQ ID NO: 438630 - protein, 9 aa, Homo Sapiens
LGARVTRHP

SEQ ID NO: 438631 - protein, 9 aa, Homo Sapiens
LFLEPTQKD

SEQ ID NO: 438632 - protein, 9 aa, Homo Sapiens
LGMCRPIKP

SEQ ID NO: 438633 - protein, 9 aa, Homo Sapiens
VLKRFFKSL

SEQ ID NO: 438634 - protein, 9 aa, Homo Sapiens
SCPKCGHPR

SEQ ID NO: 438635 - protein, 9 aa, Homo Sapiens
AETQRGFCE

SEQ ID NO: 438636 - protein, 9 aa, Homo Sapiens
RIDIIEDYI

SEQ ID NO: 438637 - protein, 9 aa, Homo Sapiens
LTLGACQIS

SEQ ID NO: 438638 - protein, 9 aa, Homo Sapiens
SLALTSVYY

SEQ ID NO: 438639 - protein, 9 aa, Homo Sapiens
NQFIKIMII

SEQ ID NO: 438640 - protein, 9 aa, Homo Sapiens
SNLASASAG

SEQ ID NO: 438641 - protein, 9 aa, Homo Sapiens
RVNYYLRNW

SEQ ID NO: 438642 - protein, 9 aa, Homo Sapiens
HDCGECHSA

SEQ ID NO: 438643 - protein, 9 aa, Homo Sapiens
LHGDGPRKR

SEQ ID NO: 438644 - protein, 9 aa, Homo Sapiens
HCRELKNGN

SEQ ID NO: 438645 - protein, 9 aa, Homo Sapiens
LQPPSEHSP

SEQ ID NO: 438646 - protein, 9 aa, Homo Sapiens
SILSLCSPS

SEQ ID NO: 438647 - protein, 9 aa, Homo Sapiens
DAKDLPCDL

SEQ ID NO: 438648 - protein, 9 aa, Homo Sapiens
WHPQCRLQM

SEQ ID NO: 438649 - protein, 9 aa, Homo Sapiens
ASFRLCLSH

SEQ ID NO: 438650 - protein, 9 aa, Homo Sapiens
KMTEKSEPK

SEQ ID NO: 438651 - protein, 9 aa, Homo Sapiens
MCQCRNGVV

SEQ ID NO: 438652 - protein, 9 aa, Homo Sapiens
LLFSCFCVL

SEQ ID NO: 438653 - protein, 9 aa, Homo Sapiens
EAQFYTLWT

SEQ ID NO: 438654 - protein, 9 aa, Homo Sapiens
HGTGNLVNT

SEQ ID NO: 438655 - protein, 9 aa, Homo Sapiens
DTGKPILHA

SEQ ID NO: 438656 - protein, 9 aa, Homo Sapiens
LQCYFVLEP

SEQ ID NO: 438657 - protein, 9 aa, Homo Sapiens
TFLSAPVTP

SEQ ID NO: 438658 - protein, 9 aa, Homo Sapiens
VGPHRDMVG

SEQ ID NO: 438659 - protein, 9 aa, Homo Sapiens
PHAELSPIH

SEQ ID NO: 438660 - protein, 9 aa, Homo Sapiens
AAIIRPRDL

SEQ ID NO: 438661 - protein, 9 aa, Homo Sapiens
SQYKSNFVA

SEQ ID NO: 438662 - protein, 9 aa, Homo Sapiens
SYFDFTLCK

SEQ ID NO: 438663 - protein, 9 aa, Homo Sapiens
VGRIILENY

SEQ ID NO: 438664 - protein, 9 aa, Homo Sapiens
SDHQIIHTG

SEQ ID NO: 438665 - protein, 9 aa, Homo Sapiens
VPRTSNCHQ

SEQ ID NO: 438666 - protein, 9 aa, Homo Sapiens
ILRDSESIP

SEQ ID NO: 438667 - protein, 9 aa, Homo Sapiens
NGSLNTKIR

SEQ ID NO: 438668 - protein, 9 aa, Homo Sapiens
LIGNLSIIL

SEQ ID NO: 438669 - protein, 9 aa, Homo Sapiens
TVVSPAEFV

SEQ ID NO: 438670 - protein, 9 aa, Homo Sapiens
FVGLYNVDA

SEQ ID NO: 438671 - protein, 9 aa, Homo Sapiens
KLHECNNCV

SEQ ID NO: 438672 - protein, 9 aa, Homo Sapiens
PDKNHAPGS

SEQ ID NO: 438673 - protein, 9 aa, Homo Sapiens
LDTLPEFRE

SEQ ID NO: 438674 - protein, 9 aa, Homo Sapiens
SRYQIQVGK

SEQ ID NO: 438675 - protein, 9 aa, Homo Sapiens
MEVEVKDGG

SEQ ID NO: 438676 - protein, 9 aa, Homo Sapiens
EIEFLSWME

SEQ ID NO: 438677 - protein, 9 aa, Homo Sapiens
DLTNHVQIH

SEQ ID NO: 438678 - protein, 9 aa, Homo Sapiens
AENARSCIQ

SEQ ID NO: 438679 - protein, 9 aa, Homo Sapiens
YETELSLQQ

SEQ ID NO: 438680 - protein, 9 aa, Homo Sapiens
IMHTGEKPY

SEQ ID NO: 438681 - protein, 9 aa, Homo Sapiens
QEAISCQAR

SEQ ID NO: 438682 - protein, 9 aa, Homo Sapiens
WEPHHNYVT

SEQ ID NO: 438683 - protein, 9 aa, Homo Sapiens
TTASSDTSM

SEQ ID NO: 438684 - protein, 9 aa, Homo Sapiens
EFIDMERKI

SEQ ID NO: 438685 - protein, 9 aa, Homo Sapiens
ICILNKVTQ

SEQ ID NO: 438686 - protein, 9 aa, Homo Sapiens
YLATLDTLT

SEQ ID NO: 438687 - protein, 9 aa, Homo Sapiens
IDIIEDYIY

SEQ ID NO: 438688 - protein, 9 aa, Homo Sapiens
QPNYQLQVS

SEQ ID NO: 438689 - protein, 9 aa, Homo Sapiens
LSEIWITHR

SEQ ID NO: 438690 - protein, 9 aa, Homo Sapiens
EIMHRGGKY

SEQ ID NO: 438691 - protein, 9 aa, Homo Sapiens
NEKITLWKD

SEQ ID NO: 438692 - protein, 9 aa, Homo Sapiens
KFHRSHRLL

SEQ ID NO: 438693 - protein, 9 aa, Homo Sapiens
NTCKPKKKD

SEQ ID NO: 438694 - protein, 9 aa, Homo Sapiens
SPNNFNIAG

SEQ ID NO: 438695 - protein, 9 aa, Homo Sapiens
STHVEFKMF

SEQ ID NO: 438696 - protein, 9 aa, Homo Sapiens
QVTIFEEVQ

SEQ ID NO: 438697 - protein, 9 aa, Homo Sapiens
CRHFQWVDG

SEQ ID NO: 438698 - protein, 9 aa, Homo Sapiens
LIDFFVFWE

SEQ ID NO: 438699 - protein, 9 aa, Homo Sapiens
KRNTYSVGI

SEQ ID NO: 438700 - protein, 9 aa, Homo Sapiens
LIAQKNAGM

SEQ ID NO: 438701 - protein, 9 aa, Homo Sapiens
EKISLIPPV

SEQ ID NO: 438702 - protein, 9 aa, Homo Sapiens
TLAIVPKML

SEQ ID NO: 438703 - protein, 9 aa, Homo Sapiens
VVALYGCCH

SEQ ID NO: 438704 - protein, 9 aa, Homo Sapiens
EHEANSEWF

SEQ ID NO: 438705 - protein, 9 aa, Homo Sapiens
NTFVLHQTA

SEQ ID NO: 438706 - protein, 9 aa, Homo Sapiens
NLSIADACF

SEQ ID NO: 438707 - protein, 9 aa, Homo Sapiens
EDKSPMKNV

SEQ ID NO: 438708 - protein, 9 aa, Homo Sapiens
HEGLAGYQR

SEQ ID NO: 438709 - protein, 9 aa, Homo Sapiens
HSDSGLSDH

SEQ ID NO: 438710 - protein, 9 aa, Homo Sapiens
IIFKIAFHQ

SEQ ID NO: 438711 - protein, 9 aa, Homo Sapiens
LPRTIGMSL

SEQ ID NO: 438712 - protein, 9 aa, Homo Sapiens
KPAQLPIYQ

SEQ ID NO: 438713 - protein, 9 aa, Homo Sapiens
SIKDAVMSC

SEQ ID NO: 438714 - protein, 9 aa, Homo Sapiens
QIQILLLGP

SEQ ID NO: 438715 - protein, 9 aa, Homo Sapiens
LLLDVAMSF

SEQ ID NO: 438716 - protein, 9 aa, Homo Sapiens
KSSALVSQS

SEQ ID NO: 438717 - protein, 9 aa, Homo Sapiens
YPVGMYGWR

SEQ ID NO: 438718 - protein, 9 aa, Homo Sapiens
NNRPRRRFL

SEQ ID NO: 438719 - protein, 9 aa, Homo Sapiens
CQNKEQEPE

SEQ ID NO: 438720 - protein, 9 aa, Homo Sapiens
QKLLFVMFL

SEQ ID NO: 438721 - protein, 9 aa, Homo Sapiens
REHALARGL

SEQ ID NO: 438722 - protein, 9 aa, Homo Sapiens
AGIVFGYLP

SEQ ID NO: 438723 - protein, 9 aa, Homo Sapiens
HYHTGEKPF

SEQ ID NO: 438724 - protein, 9 aa, Homo Sapiens
GANCNLEYL

SEQ ID NO: 438725 - protein, 9 aa, Homo Sapiens
FYHNERGVG

SEQ ID NO: 438726 - protein, 9 aa, Homo Sapiens
HKSKIVEFI

SEQ ID NO: 438727 - protein, 9 aa, Homo Sapiens
RALYPKSIQ

SEQ ID NO: 438728 - protein, 9 aa, Homo Sapiens
YHGPTPIQA

SEQ ID NO: 438729 - protein, 9 aa, Homo Sapiens
SGTSREKTT

SEQ ID NO: 438730 - protein, 9 aa, Homo Sapiens
VVTKSANKL

SEQ ID NO: 438731 - protein, 9 aa, Homo Sapiens
NICTGQECR

SEQ ID NO: 438732 - protein, 9 aa, Homo Sapiens
RNASTPFQT

SEQ ID NO: 438733 - protein, 9 aa, Homo Sapiens
GSENIPFSP

SEQ ID NO: 438734 - protein, 9 aa, Homo Sapiens
VILCFRDEA

SEQ ID NO: 438735 - protein, 9 aa, Homo Sapiens
TVHIRQKHS

SEQ ID NO: 438736 - protein, 9 aa, Homo Sapiens
CFLGQLSEK

SEQ ID NO: 438737 - protein, 9 aa, Homo Sapiens
QRINTGEKP

SEQ ID NO: 438738 - protein, 9 aa, Homo Sapiens
HTLTAVHDA

SEQ ID NO: 438739 - protein, 9 aa, Homo Sapiens
RGNMYYEKS

SEQ ID NO: 438740 - protein, 9 aa, Homo Sapiens
NMVMSFVNL

SEQ ID NO: 438741 - protein, 9 aa, Homo Sapiens
DALHCRELK

SEQ ID NO: 438742 - protein, 9 aa, Homo Sapiens
LDPAQIKLY

SEQ ID NO: 438743 - protein, 9 aa, Homo Sapiens
DYTKPKTTC

SEQ ID NO: 438744 - protein, 9 aa, Homo Sapiens
SNSRLESLP

SEQ ID NO: 438745 - protein, 9 aa, Homo Sapiens
EPKSKRGRP

SEQ ID NO: 438746 - protein, 9 aa, Homo Sapiens
TGKPILHAF

SEQ ID NO: 438747 - protein, 9 aa, Homo Sapiens
EAAKQVHSE

SEQ ID NO: 438748 - protein, 9 aa, Homo Sapiens
QQHGIQSVQ

SEQ ID NO: 438749 - protein, 9 aa, Homo Sapiens
MNLLARDAP

SEQ ID NO: 438750 - protein, 9 aa, Homo Sapiens
GADSTGSPI

SEQ ID NO: 438751 - protein, 9 aa, Homo Sapiens
PMSSYVSIN

SEQ ID NO: 438752 - protein, 9 aa, Homo Sapiens
ANKLRSSNA

SEQ ID NO: 438753 - protein, 9 aa, Homo Sapiens
KAEEERLCL

SEQ ID NO: 438754 - protein, 9 aa, Homo Sapiens
QQGPKKFIE

SEQ ID NO: 438755 - protein, 9 aa, Homo Sapiens
TLKEIASEP

SEQ ID NO: 438756 - protein, 9 aa, Homo Sapiens
VFSIVGALR

SEQ ID NO: 438757 - protein, 9 aa, Homo Sapiens
VHMGDSLNW

SEQ ID NO: 438758 - protein, 9 aa, Homo Sapiens
SYSSVLQKH

SEQ ID NO: 438759 - protein, 9 aa, Homo Sapiens
NLSICLTLK

SEQ ID NO: 438760 - protein, 9 aa, Homo Sapiens
TVCDEDKLS

SEQ ID NO: 438761 - protein, 9 aa, Homo Sapiens
PHTVHVAFV

SEQ ID NO: 438762 - protein, 9 aa, Homo Sapiens
ANKKNFFKL

SEQ ID NO: 438763 - protein, 9 aa, Homo Sapiens
NVLQGVIHC

SEQ ID NO: 438764 - protein, 9 aa, Homo Sapiens
QVVLEDSID

SEQ ID NO: 438765 - protein, 9 aa, Homo Sapiens
KVKRWGMKL

SEQ ID NO: 438766 - protein, 9 aa, Homo Sapiens
RYVLCEETT

SEQ ID NO: 438767 - protein, 9 aa, Homo Sapiens
YCKCNECGK

SEQ ID NO: 438768 - protein, 9 aa, Homo Sapiens
KETREGIIS

SEQ ID NO: 438769 - protein, 9 aa, Homo Sapiens
TVQVLQIKV

SEQ ID NO: 438770 - protein, 9 aa, Homo Sapiens
YQSWKISHK

SEQ ID NO: 438771 - protein, 9 aa, Homo Sapiens
CRPCEIKKT

SEQ ID NO: 438772 - protein, 9 aa, Homo Sapiens
YRKSSHHLA

SEQ ID NO: 438773 - protein, 9 aa, Homo Sapiens
DVMGKSNVL

SEQ ID NO: 438774 - protein, 9 aa, Homo Sapiens
FFFIFLFGV

SEQ ID NO: 438775 - protein, 9 aa, Homo Sapiens
NSCSPRVGG

SEQ ID NO: 438776 - protein, 9 aa, Homo Sapiens
SFQKHERIH

SEQ ID NO: 438777 - protein, 9 aa, Homo Sapiens
WEELPEVVH

SEQ ID NO: 438778 - protein, 9 aa, Homo Sapiens
VVEAIKANC

SEQ ID NO: 438779 - protein, 9 aa, Homo Sapiens
LGIDKTIDK

SEQ ID NO: 438780 - protein, 9 aa, Homo Sapiens
SVFLVASAP

SEQ ID NO: 438781 - protein, 9 aa, Homo Sapiens
DKLLSGTRD

SEQ ID NO: 438782 - protein, 9 aa, Homo Sapiens
HKKKKCEMY

SEQ ID NO: 438783 - protein, 9 aa, Homo Sapiens
HTHVPKGWI

SEQ ID NO: 438784 - protein, 9 aa, Homo Sapiens
VYSLPLVEI

SEQ ID NO: 438785 - protein, 9 aa, Homo Sapiens
KVERSREQI

SEQ ID NO: 438786 - protein, 9 aa, Homo Sapiens
CFQSLRIKN

SEQ ID NO: 438787 - protein, 9 aa, Homo Sapiens
SLQLLCGDM

SEQ ID NO: 438788 - protein, 9 aa, Homo Sapiens
LAILLTRWT

SEQ ID NO: 438789 - protein, 9 aa, Homo Sapiens
NDTSIFENV

SEQ ID NO: 438790 - protein, 9 aa, Homo Sapiens
NETKLGYSM

SEQ ID NO: 438791 - protein, 9 aa, Homo Sapiens
VFENDKLIK

SEQ ID NO: 438792 - protein, 9 aa, Homo Sapiens
RCSSLIELI

SEQ ID NO: 438793 - protein, 9 aa, Homo Sapiens
REAGIVFGY

SEQ ID NO: 438794 - protein, 9 aa, Homo Sapiens
EKAWKAVVV

SEQ ID NO: 438795 - protein, 9 aa, Homo Sapiens
ATIQVRTPK

SEQ ID NO: 438796 - protein, 9 aa, Homo Sapiens
PPLMVKKNY

SEQ ID NO: 438797 - protein, 9 aa, Homo Sapiens
KGYIIQTRE

SEQ ID NO: 438798 - protein, 9 aa, Homo Sapiens
FMLITNRSL

SEQ ID NO: 438799 - protein, 9 aa, Homo Sapiens
EPLKDGIFT

SEQ ID NO: 438800 - protein, 9 aa, Homo Sapiens
VDKQIYRLS

SEQ ID NO: 438801 - protein, 9 aa, Homo Sapiens
ACKLLDHDK

SEQ ID NO: 438802 - protein, 9 aa, Homo Sapiens
GYHLSMYID

SEQ ID NO: 438803 - protein, 9 aa, Homo Sapiens
KDCNKTSFF

SEQ ID NO: 438804 - protein, 9 aa, Homo Sapiens
VQKFIKIDQ

SEQ ID NO: 438805 - protein, 9 aa, Homo Sapiens
LNDELKTQS

SEQ ID NO: 438806 - protein, 9 aa, Homo Sapiens
VLEYINLVC

SEQ ID NO: 438807 - protein, 9 aa, Homo Sapiens
DVPAMWTLA

SEQ ID NO: 438808 - protein, 9 aa, Homo Sapiens
SQLIHNNLK

SEQ ID NO: 438809 - protein, 9 aa, Homo Sapiens
SLWNIWKET

SEQ ID NO: 438810 - protein, 9 aa, Homo Sapiens
VRLTDELYV

SEQ ID NO: 438811 - protein, 9 aa, Homo Sapiens
VTFEPLKNY

SEQ ID NO: 438812 - protein, 9 aa, Homo Sapiens
QGSYPAPDS

SEQ ID NO: 438813 - protein, 9 aa, Homo Sapiens
IYVAFSPTG

SEQ ID NO: 438814 - protein, 9 aa, Homo Sapiens
FALELANKD

SEQ ID NO: 438815 - protein, 9 aa, Homo Sapiens
NWKVIAINV

SEQ ID NO: 438816 - protein, 9 aa, Homo Sapiens
LVLRRLVTR

SEQ ID NO: 438817 - protein, 9 aa, Homo Sapiens
VKRWGMKLR

SEQ ID NO: 438818 - protein, 9 aa, Homo Sapiens
IACGSENNY

SEQ ID NO: 438819 - protein, 9 aa, Homo Sapiens
AWKAVVVQM

SEQ ID NO: 438820 - protein, 9 aa, Homo Sapiens
VPVDFERSF

SEQ ID NO: 438821 - protein, 9 aa, Homo Sapiens
LNTYHDWLW

SEQ ID NO: 438822 - protein, 9 aa, Homo Sapiens
LARDFKKNY

SEQ ID NO: 438823 - protein, 9 aa, Homo Sapiens
GSVQYTLSS

SEQ ID NO: 438824 - protein, 9 aa, Homo Sapiens
SDWAARGHH

SEQ ID NO: 438825 - protein, 9 aa, Homo Sapiens
IDSHSRREH

SEQ ID NO: 438826 - protein, 9 aa, Homo Sapiens
VRSVGNTFV

SEQ ID NO: 438827 - protein, 9 aa, Homo Sapiens
RSCLRRFWA

SEQ ID NO: 438828 - protein, 9 aa, Homo Sapiens
DDSDILDSQ

SEQ ID NO: 438829 - protein, 9 aa, Homo Sapiens
RGSSTDILK

SEQ ID NO: 438830 - protein, 9 aa, Homo Sapiens
LWRDCSHGA

SEQ ID NO: 438831 - protein, 9 aa, Homo Sapiens
TLVFELCDQ

SEQ ID NO: 438832 - protein, 9 aa, Homo Sapiens
ILHKIIHSG

SEQ ID NO: 438833 - protein, 9 aa, Homo Sapiens
TKYNYCIIS

SEQ ID NO: 438834 - protein, 9 aa, Homo Sapiens
DFVMEPRQE

SEQ ID NO: 438835 - protein, 9 aa, Homo Sapiens
SCVTYMCEC

SEQ ID NO: 438836 - protein, 9 aa, Homo Sapiens
SVPATINAR

SEQ ID NO: 438837 - protein, 9 aa, Homo Sapiens
DLKPESALG

SEQ ID NO: 438838 - protein, 9 aa, Homo Sapiens
DTPGYGDTI

SEQ ID NO: 438839 - protein, 9 aa, Homo Sapiens
PRRTQPKMV

SEQ ID NO: 438840 - protein, 9 aa, Homo Sapiens
ENPKERGEE

SEQ ID NO: 438841 - protein, 9 aa, Homo Sapiens
QIMGRGEKA

SEQ ID NO: 438842 - protein, 9 aa, Homo Sapiens
CAGEFVVTI

SEQ ID NO: 438843 - protein, 9 aa, Homo Sapiens
LIKDPSRGQ

SEQ ID NO: 438844 - protein, 9 aa, Homo Sapiens
MGVFIREHL

SEQ ID NO: 438845 - protein, 9 aa, Homo Sapiens
AVFMKEEKK

SEQ ID NO: 438846 - protein, 9 aa, Homo Sapiens
NLYGKYMKE

SEQ ID NO: 438847 - protein, 9 aa, Homo Sapiens
PTWQNFTDP

SEQ ID NO: 438848 - protein, 9 aa, Homo Sapiens
TKVLKEKNK

SEQ ID NO: 438849 - protein, 9 aa, Homo Sapiens
LEALKAVFA

SEQ ID NO: 438850 - protein, 9 aa, Homo Sapiens
IRQLLSQKP

SEQ ID NO: 438851 - protein, 9 aa, Homo Sapiens
AFLHTYSHE

SEQ ID NO: 438852 - protein, 9 aa, Homo Sapiens
VFMKEEKKE

SEQ ID NO: 438853 - protein, 9 aa, Homo Sapiens
PRSEIPLQK

SEQ ID NO: 438854 - protein, 9 aa, Homo Sapiens
ATLHLVFTD

SEQ ID NO: 438855 - protein, 9 aa, Homo Sapiens
YSVSAVTMD

SEQ ID NO: 438856 - protein, 9 aa, Homo Sapiens
PAKPENNGH

SEQ ID NO: 438857 - protein, 9 aa, Homo Sapiens
QYKNLYFMD

SEQ ID NO: 438858 - protein, 9 aa, Homo Sapiens
YLYNVAISL

SEQ ID NO: 438859 - protein, 9 aa, Homo Sapiens
FDVKALRAS

SEQ ID NO: 438860 - protein, 9 aa, Homo Sapiens
PITHLPCPG

SEQ ID NO: 438861 - protein, 9 aa, Homo Sapiens
PASLQPHKM

SEQ ID NO: 438862 - protein, 9 aa, Homo Sapiens
SSSKLDTDT

SEQ ID NO: 438863 - protein, 9 aa, Homo Sapiens
LFFKEEERE

SEQ ID NO: 438864 - protein, 9 aa, Homo Sapiens
EDRACDKIL

SEQ ID NO: 438865 - protein, 9 aa, Homo Sapiens
NQKQCETLS

SEQ ID NO: 438866 - protein, 9 aa, Homo Sapiens
CFNNQPAVS

SEQ ID NO: 438867 - protein, 9 aa, Homo Sapiens
THDGKGIYL

SEQ ID NO: 438868 - protein, 9 aa, Homo Sapiens
LLDVLRELE

SEQ ID NO: 438869 - protein, 9 aa, Homo Sapiens
NEGRMSGTV

SEQ ID NO: 438870 - protein, 9 aa, Homo Sapiens
GAGVSSYIY

SEQ ID NO: 438871 - protein, 9 aa, Homo Sapiens
RTEDNNFSL

SEQ ID NO: 438872 - protein, 9 aa, Homo Sapiens
EPPQKHRIC

SEQ ID NO: 438873 - protein, 9 aa, Homo Sapiens
DKNTNQIVV

SEQ ID NO: 438874 - protein, 9 aa, Homo Sapiens
AMKDALDLG

SEQ ID NO: 438875 - protein, 9 aa, Homo Sapiens
VGNIYVVTS

SEQ ID NO: 438876 - protein, 9 aa, Homo Sapiens
TETSMDTAS

SEQ ID NO: 438877 - protein, 9 aa, Homo Sapiens
QTGIKRRIL

SEQ ID NO: 438878 - protein, 9 aa, Homo Sapiens
KGDPDLIGP

SEQ ID NO: 438879 - protein, 9 aa, Homo Sapiens
LCGDMEQIR

SEQ ID NO: 438880 - protein, 9 aa, Homo Sapiens
DYLRALKHE

SEQ ID NO: 438881 - protein, 9 aa, Homo Sapiens
PKKFIECVS

SEQ ID NO: 438882 - protein, 9 aa, Homo Sapiens
GAHCRGGWT

SEQ ID NO: 438883 - protein, 9 aa, Homo Sapiens
NDFKDKLNL

SEQ ID NO: 438884 - protein, 9 aa, Homo Sapiens
HMQTHTGEK

SEQ ID NO: 438885 - protein, 9 aa, Homo Sapiens
PSGLLNNFQ

SEQ ID NO: 438886 - protein, 9 aa, Homo Sapiens
DLEGHQTLF

SEQ ID NO: 438887 - protein, 9 aa, Homo Sapiens
MNKIRPNRQ

SEQ ID NO: 438888 - protein, 9 aa, Homo Sapiens
YGYGSGWSS

SEQ ID NO: 438889 - protein, 9 aa, Homo Sapiens
KRTELETKL

SEQ ID NO: 438890 - protein, 9 aa, Homo Sapiens
LSFKSLLNA

SEQ ID NO: 438891 - protein, 9 aa, Homo Sapiens
KHECSRIIA

SEQ ID NO: 438892 - protein, 9 aa, Homo Sapiens
RQLLEHRDV

SEQ ID NO: 438893 - protein, 9 aa, Homo Sapiens
ELSGGVGAF

SEQ ID NO: 438894 - protein, 9 aa, Homo Sapiens
SKKGILYED

SEQ ID NO: 438895 - protein, 9 aa, Homo Sapiens
HECSRIIAD

SEQ ID NO: 438896 - protein, 9 aa, Homo Sapiens
GIHDLMHFY

SEQ ID NO: 438897 - protein, 9 aa, Homo Sapiens
VVKYLPEGW

SEQ ID NO: 438898 - protein, 9 aa, Homo Sapiens
SSSFRVSSC

SEQ ID NO: 438899 - protein, 9 aa, Homo Sapiens
FHYLNFSFC

SEQ ID NO: 438900 - protein, 9 aa, Homo Sapiens
IGNLLTSKL

SEQ ID NO: 438901 - protein, 9 aa, Homo Sapiens
HMNNDLEKL

SEQ ID NO: 438902 - protein, 9 aa, Homo Sapiens
FCGENINHS

SEQ ID NO: 438903 - protein, 9 aa, Homo Sapiens
RHPPQILQK

SEQ ID NO: 438904 - protein, 9 aa, Homo Sapiens
LTPGGNRLH

SEQ ID NO: 438905 - protein, 9 aa, Homo Sapiens
DEKKEDYKK

SEQ ID NO: 438906 - protein, 9 aa, Homo Sapiens
KQLETLNNA

SEQ ID NO: 438907 - protein, 9 aa, Homo Sapiens
ENNGHAKDH

SEQ ID NO: 438908 - protein, 9 aa, Homo Sapiens
IEVVNVNDN

SEQ ID NO: 438909 - protein, 9 aa, Homo Sapiens
YCAQRCGRK

SEQ ID NO: 438910 - protein, 9 aa, Homo Sapiens
ALQQIENLQ

SEQ ID NO: 438911 - protein, 9 aa, Homo Sapiens
LTKLKMPYQ

SEQ ID NO: 438912 - protein, 9 aa, Homo Sapiens
KPFYVEDTY

SEQ ID NO: 438913 - protein, 9 aa, Homo Sapiens
TSATTGQNV

SEQ ID NO: 438914 - protein, 9 aa, Homo Sapiens
HENEIVLRA

SEQ ID NO: 438915 - protein, 9 aa, Homo Sapiens
QRYDKMTSG

SEQ ID NO: 438916 - protein, 9 aa, Homo Sapiens
FQIHTGIKP

SEQ ID NO: 438917 - protein, 9 aa, Homo Sapiens
TFILFAIVG

SEQ ID NO: 438918 - protein, 9 aa, Homo Sapiens
SAHEGLAGY

SEQ ID NO: 438919 - protein, 9 aa, Homo Sapiens
LTRWTRCKQ

SEQ ID NO: 438920 - protein, 9 aa, Homo Sapiens
NYKGKYVME

SEQ ID NO: 438921 - protein, 9 aa, Homo Sapiens
ALKAVFAQT

SEQ ID NO: 438922 - protein, 9 aa, Homo Sapiens
SLEWAFHSA

SEQ ID NO: 438923 - protein, 9 aa, Homo Sapiens
YDLMRQCWW

SEQ ID NO: 438924 - protein, 9 aa, Homo Sapiens
HQELGSFHF

SEQ ID NO: 438925 - protein, 9 aa, Homo Sapiens
NFPREVCEK

SEQ ID NO: 438926 - protein, 9 aa, Homo Sapiens
SALCLGVGR

SEQ ID NO: 438927 - protein, 9 aa, Homo Sapiens
PSPDSKSKK

SEQ ID NO: 438928 - protein, 9 aa, Homo Sapiens
FCITCQKSY

SEQ ID NO: 438929 - protein, 9 aa, Homo Sapiens
NCDVLRFEC

SEQ ID NO: 438930 - protein, 9 aa, Homo Sapiens
LKLSKFRMP

SEQ ID NO: 438931 - protein, 9 aa, Homo Sapiens
SFQTGIKRR

SEQ ID NO: 438932 - protein, 9 aa, Homo Sapiens
CLHNGTCMD

SEQ ID NO: 438933 - protein, 9 aa, Homo Sapiens
ATLAADDFR

SEQ ID NO: 438934 - protein, 9 aa, Homo Sapiens
RSLENVLDL

SEQ ID NO: 438935 - protein, 9 aa, Homo Sapiens
VHVAFVGAP

SEQ ID NO: 438936 - protein, 9 aa, Homo Sapiens
QIHTGYRPH

SEQ ID NO: 438937 - protein, 9 aa, Homo Sapiens
SKRGIYSRH

SEQ ID NO: 438938 - protein, 9 aa, Homo Sapiens
KLLAVIHKL

SEQ ID NO: 438939 - protein, 9 aa, Homo Sapiens
KCFAALQAS

SEQ ID NO: 438940 - protein, 9 aa, Homo Sapiens
GNILNEKNY

SEQ ID NO: 438941 - protein, 9 aa, Homo Sapiens
PERHYKDPY

SEQ ID NO: 438942 - protein, 9 aa, Homo Sapiens
ERPQKERKE

SEQ ID NO: 438943 - protein, 9 aa, Homo Sapiens
QPPAMPSAL

SEQ ID NO: 438944 - protein, 9 aa, Homo Sapiens
KDIKKELFT

SEQ ID NO: 438945 - protein, 9 aa, Homo Sapiens
ILIQSGDIS

SEQ ID NO: 438946 - protein, 9 aa, Homo Sapiens
KVTPDKKIT

SEQ ID NO: 438947 - protein, 9 aa, Homo Sapiens
FLSISKAHL

SEQ ID NO: 438948 - protein, 9 aa, Homo Sapiens
YSFTILYEE

SEQ ID NO: 438949 - protein, 9 aa, Homo Sapiens
TVTSAQNNP

SEQ ID NO: 438950 - protein, 9 aa, Homo Sapiens
IDEDRETEI

SEQ ID NO: 438951 - protein, 9 aa, Homo Sapiens
LAEALCLLR

SEQ ID NO: 438952 - protein, 9 aa, Homo Sapiens
TQNGQMHLN

SEQ ID NO: 438953 - protein, 9 aa, Homo Sapiens
TLALSVAYC

SEQ ID NO: 438954 - protein, 9 aa, Homo Sapiens
SGAGKTKNT

SEQ ID NO: 438955 - protein, 9 aa, Homo Sapiens
NQTYSGMVL

SEQ ID NO: 438956 - protein, 9 aa, Homo Sapiens
IHLMYLLNC

SEQ ID NO: 438957 - protein, 9 aa, Homo Sapiens
ALATKGHLI

SEQ ID NO: 438958 - protein, 9 aa, Homo Sapiens
LIHHFFCDV

SEQ ID NO: 438959 - protein, 9 aa, Homo Sapiens
QFFGGQLGQ

SEQ ID NO: 438960 - protein, 9 aa, Homo Sapiens
MVTDNTYLC

SEQ ID NO: 438961 - protein, 9 aa, Homo Sapiens
TRNKMFLTQ

SEQ ID NO: 438962 - protein, 9 aa, Homo Sapiens
PQKGQLYRV

SEQ ID NO: 438963 - protein, 9 aa, Homo Sapiens
ATTRSAKSW

SEQ ID NO: 438964 - protein, 9 aa, Homo Sapiens
KNCRVLGHT

SEQ ID NO: 438965 - protein, 9 aa, Homo Sapiens
TIPTKKPTI

SEQ ID NO: 438966 - protein, 9 aa, Homo Sapiens
SSHSHQQMK

SEQ ID NO: 438967 - protein, 9 aa, Homo Sapiens
PKHNNTSHL

SEQ ID NO: 438968 - protein, 9 aa, Homo Sapiens
EHIPKFLKK

SEQ ID NO: 438969 - protein, 9 aa, Homo Sapiens
LCQYCAQRC

SEQ ID NO: 438970 - protein, 9 aa, Homo Sapiens
FAAFLIGAL

SEQ ID NO: 438971 - protein, 9 aa, Homo Sapiens
PSQDSLDVF

SEQ ID NO: 438972 - protein, 9 aa, Homo Sapiens
ASSDTSMDF

SEQ ID NO: 438973 - protein, 9 aa, Homo Sapiens
VFVNVDKVA

SEQ ID NO: 438974 - protein, 9 aa, Homo Sapiens
QRKTSWSRV

SEQ ID NO: 438975 - protein, 9 aa, Homo Sapiens
KTLLHDHEL

SEQ ID NO: 438976 - protein, 9 aa, Homo Sapiens
HLRYGMSDV

SEQ ID NO: 438977 - protein, 9 aa, Homo Sapiens
PGMVNGGTK

SEQ ID NO: 438978 - protein, 9 aa, Homo Sapiens
SFAVQKESG

SEQ ID NO: 438979 - protein, 9 aa, Homo Sapiens
GNERCIQYL

SEQ ID NO: 438980 - protein, 9 aa, Homo Sapiens
IRLKGQTTI

SEQ ID NO: 438981 - protein, 9 aa, Homo Sapiens
SIDPVDTGN

SEQ ID NO: 438982 - protein, 9 aa, Homo Sapiens
FHHDMNSEN

SEQ ID NO: 438983 - protein, 9 aa, Homo Sapiens
STTAAAATV

SEQ ID NO: 438984 - protein, 9 aa, Homo Sapiens
EGIHREYKD

SEQ ID NO: 438985 - protein, 9 aa, Homo Sapiens
RLKCKNCRV

SEQ ID NO: 438986 - protein, 9 aa, Homo Sapiens
GYHQITLLD

SEQ ID NO: 438987 - protein, 9 aa, Homo Sapiens
LRDYITLGV

SEQ ID NO: 438988 - protein, 9 aa, Homo Sapiens
DEEGSEHGT

SEQ ID NO: 438989 - protein, 9 aa, Homo Sapiens
LCEITSNNG

SEQ ID NO: 438990 - protein, 9 aa, Homo Sapiens
IVQEDMSTN

SEQ ID NO: 438991 - protein, 9 aa, Homo Sapiens
PDKFGTGPQ

SEQ ID NO: 438992 - protein, 9 aa, Homo Sapiens
NDSYDFFTE

SEQ ID NO: 438993 - protein, 9 aa, Homo Sapiens
DIVGYLPKE

SEQ ID NO: 438994 - protein, 9 aa, Homo Sapiens
LGNVEGVPY

SEQ ID NO: 438995 - protein, 9 aa, Homo Sapiens
KSEIQNRLM

SEQ ID NO: 438996 - protein, 9 aa, Homo Sapiens
ELLDLSSAS

SEQ ID NO: 438997 - protein, 9 aa, Homo Sapiens
LKMPYQSVE

SEQ ID NO: 438998 - protein, 9 aa, Homo Sapiens
HNIKHMENK

SEQ ID NO: 438999 - protein, 9 aa, Homo Sapiens
DILSRLMQV

SEQ ID NO: 439000 - protein, 9 aa, Homo Sapiens
SVSNCVDNL

SEQ ID NO: 439001 - protein, 9 aa, Homo Sapiens
TQHQIFHTG

SEQ ID NO: 439002 - protein, 9 aa, Homo Sapiens
YLSFENAIH

SEQ ID NO: 439003 - protein, 9 aa, Homo Sapiens
FISNLNKMN

SEQ ID NO: 439004 - protein, 9 aa, Homo Sapiens
YSLVHFSPN

SEQ ID NO: 439005 - protein, 9 aa, Homo Sapiens
LKAILKPMM

SEQ ID NO: 439006 - protein, 9 aa, Homo Sapiens
KANIDLEQM

SEQ ID NO: 439007 - protein, 9 aa, Homo Sapiens
RFEIVGIPY

SEQ ID NO: 439008 - protein, 9 aa, Homo Sapiens
KAFHSKVTE

SEQ ID NO: 439009 - protein, 9 aa, Homo Sapiens
YPISGHKSV

SEQ ID NO: 439010 - protein, 9 aa, Homo Sapiens
YSNVLHVAR

SEQ ID NO: 439011 - protein, 9 aa, Homo Sapiens
GNNTFGPRA

SEQ ID NO: 439012 - protein, 9 aa, Homo Sapiens
QKLSENTSL

SEQ ID NO: 439013 - protein, 9 aa, Homo Sapiens
KVFLGGVSW

SEQ ID NO: 439014 - protein, 9 aa, Homo Sapiens
ERFPLSVAS

SEQ ID NO: 439015 - protein, 9 aa, Homo Sapiens
EKPFYVEDT

SEQ ID NO: 439016 - protein, 9 aa, Homo Sapiens
INSGSRYDA

SEQ ID NO: 439017 - protein, 9 aa, Homo Sapiens
NNINKSLSA

SEQ ID NO: 439018 - protein, 9 aa, Homo Sapiens
KKQDNNKMS

SEQ ID NO: 439019 - protein, 9 aa, Homo Sapiens
NTEKKKQKN

SEQ ID NO: 439020 - protein, 9 aa, Homo Sapiens
LNNPIITQL

SEQ ID NO: 439021 - protein, 9 aa, Homo Sapiens
HSQQRQNPS

SEQ ID NO: 439022 - protein, 9 aa, Homo Sapiens
HLVAHQITH

SEQ ID NO: 439023 - protein, 9 aa, Homo Sapiens
HLYNESVST

SEQ ID NO: 439024 - protein, 9 aa, Homo Sapiens
TVPHITCNP

SEQ ID NO: 439025 - protein, 9 aa, Homo Sapiens
IQLHFFKSE

SEQ ID NO: 439026 - protein, 9 aa, Homo Sapiens
DKYMKNSDV

SEQ ID NO: 439027 - protein, 9 aa, Homo Sapiens
SIVKYSVQL

SEQ ID NO: 439028 - protein, 9 aa, Homo Sapiens
THVEFKMFT

SEQ ID NO: 439029 - protein, 9 aa, Homo Sapiens
LHILMSNYG

SEQ ID NO: 439030 - protein, 9 aa, Homo Sapiens
VKALDIFAY

SEQ ID NO: 439031 - protein, 9 aa, Homo Sapiens
QNCQAGFVF

SEQ ID NO: 439032 - protein, 9 aa, Homo Sapiens
SCNHQIMSV

SEQ ID NO: 439033 - protein, 9 aa, Homo Sapiens
SQSSVDVIV

SEQ ID NO: 439034 - protein, 9 aa, Homo Sapiens
FDPGLRNLI

SEQ ID NO: 439035 - protein, 9 aa, Homo Sapiens
IEPSGVLGV

SEQ ID NO: 439036 - protein, 9 aa, Homo Sapiens
HRMDYLHVE

SEQ ID NO: 439037 - protein, 9 aa, Homo Sapiens
TGCRHTPVV

SEQ ID NO: 439038 - protein, 9 aa, Homo Sapiens
ESKCCKEGY

SEQ ID NO: 439039 - protein, 9 aa, Homo Sapiens
AKKRKDNFW

SEQ ID NO: 439040 - protein, 9 aa, Homo Sapiens
KHKKRSSRK

SEQ ID NO: 439041 - protein, 9 aa, Homo Sapiens
EHKIIHSGD

SEQ ID NO: 439042 - protein, 9 aa, Homo Sapiens
ALGNTDNYI

SEQ ID NO: 439043 - protein, 9 aa, Homo Sapiens
MMAFLVRNI

SEQ ID NO: 439044 - protein, 9 aa, Homo Sapiens
GEGEEDNES

SEQ ID NO: 439045 - protein, 9 aa, Homo Sapiens
TPCLYRTPE

SEQ ID NO: 439046 - protein, 9 aa, Homo Sapiens
YATYEAICK

SEQ ID NO: 439047 - protein, 9 aa, Homo Sapiens
RDLLRHNKS

SEQ ID NO: 439048 - protein, 9 aa, Homo Sapiens
EDYLGILFP

SEQ ID NO: 439049 - protein, 9 aa, Homo Sapiens
SELDQYYEQ

SEQ ID NO: 439050 - protein, 9 aa, Homo Sapiens
LGGVASFVC

SEQ ID NO: 439051 - protein, 9 aa, Homo Sapiens
RNFIKNMIT

SEQ ID NO: 439052 - protein, 9 aa, Homo Sapiens
NENDNRVQH

SEQ ID NO: 439053 - protein, 9 aa, Homo Sapiens
KKIFDSPCP

SEQ ID NO: 439054 - protein, 9 aa, Homo Sapiens
IMSFVKGWG

SEQ ID NO: 439055 - protein, 9 aa, Homo Sapiens
KAQEQTPFY

SEQ ID NO: 439056 - protein, 9 aa, Homo Sapiens
AFQSQYKSN

SEQ ID NO: 439057 - protein, 9 aa, Homo Sapiens
LEGRMASHK

SEQ ID NO: 439058 - protein, 9 aa, Homo Sapiens
LIFLPGYDK

SEQ ID NO: 439059 - protein, 9 aa, Homo Sapiens
SLLKNPHPY

SEQ ID NO: 439060 - protein, 9 aa, Homo Sapiens
LNNARDTIV

SEQ ID NO: 439061 - protein, 9 aa, Homo Sapiens
WKRKVLSSS

SEQ ID NO: 439062 - protein, 9 aa, Homo Sapiens
SGPKPNNLG

SEQ ID NO: 439063 - protein, 9 aa, Homo Sapiens
MLYSVLYAK

SEQ ID NO: 439064 - protein, 9 aa, Homo Sapiens
INDAHHGGW

SEQ ID NO: 439065 - protein, 9 aa, Homo Sapiens
KFSDNSMSE

SEQ ID NO: 439066 - protein, 9 aa, Homo Sapiens
KVKPFLTAL

SEQ ID NO: 439067 - protein, 9 aa, Homo Sapiens
EDEDFEKEL

SEQ ID NO: 439068 - protein, 9 aa, Homo Sapiens
HPEKKYCKC

SEQ ID NO: 439069 - protein, 9 aa, Homo Sapiens
ALGCLRIYY

SEQ ID NO: 439070 - protein, 9 aa, Homo Sapiens
VTPDKKITF

SEQ ID NO: 439071 - protein, 9 aa, Homo Sapiens
CRKYLFICE

SEQ ID NO: 439072 - protein, 9 aa, Homo Sapiens
DCVLKPLSD

SEQ ID NO: 439073 - protein, 9 aa, Homo Sapiens
SHPEGRFSA

SEQ ID NO: 439074 - protein, 9 aa, Homo Sapiens
RQHGPFLAD

SEQ ID NO: 439075 - protein, 9 aa, Homo Sapiens
SLASDQFNR

SEQ ID NO: 439076 - protein, 9 aa, Homo Sapiens
CLCPFTRES

SEQ ID NO: 439077 - protein, 9 aa, Homo Sapiens
SLNNNHLRK

SEQ ID NO: 439078 - protein, 9 aa, Homo Sapiens
TSSADKPSV

SEQ ID NO: 439079 - protein, 9 aa, Homo Sapiens
ELIVFWFCV

SEQ ID NO: 439080 - protein, 9 aa, Homo Sapiens
DMFVYCTPK

SEQ ID NO: 439081 - protein, 9 aa, Homo Sapiens
VNTARTALL

SEQ ID NO: 439082 - protein, 9 aa, Homo Sapiens
SQRFKAHPN

SEQ ID NO: 439083 - protein, 9 aa, Homo Sapiens
KLENISPEE

SEQ ID NO: 439084 - protein, 9 aa, Homo Sapiens
QGSGLEQIS

SEQ ID NO: 439085 - protein, 9 aa, Homo Sapiens
SRPDSPCVK

SEQ ID NO: 439086 - protein, 9 aa, Homo Sapiens
DDSIKVIPF

SEQ ID NO: 439087 - protein, 9 aa, Homo Sapiens
DKHTFLQDC

SEQ ID NO: 439088 - protein, 9 aa, Homo Sapiens
RVWDINEAF

SEQ ID NO: 439089 - protein, 9 aa, Homo Sapiens
MGKSTWYDG

SEQ ID NO: 439090 - protein, 9 aa, Homo Sapiens
LEKQEAQME

SEQ ID NO: 439091 - protein, 9 aa, Homo Sapiens
INVLSKSVN

SEQ ID NO: 439092 - protein, 9 aa, Homo Sapiens
SMAFSTYGG

SEQ ID NO: 439093 - protein, 9 aa, Homo Sapiens
KIVICAVSH

SEQ ID NO: 439094 - protein, 9 aa, Homo Sapiens
DSVNTARTA

SEQ ID NO: 439095 - protein, 9 aa, Homo Sapiens
LDKINADLV

SEQ ID NO: 439096 - protein, 9 aa, Homo Sapiens
ATDDCRYKF

SEQ ID NO: 439097 - protein, 9 aa, Homo Sapiens
NLYLALYSA

SEQ ID NO: 439098 - protein, 9 aa, Homo Sapiens
KVMQLLLEN

SEQ ID NO: 439099 - protein, 9 aa, Homo Sapiens
ETVIYTKKT

SEQ ID NO: 439100 - protein, 9 aa, Homo Sapiens
VLARIIGLE

SEQ ID NO: 439101 - protein, 9 aa, Homo Sapiens
YSGSLGFGF

SEQ ID NO: 439102 - protein, 9 aa, Homo Sapiens
VLSSAPVPK

SEQ ID NO: 439103 - protein, 9 aa, Homo Sapiens
KKLEKSGFS

SEQ ID NO: 439104 - protein, 9 aa, Homo Sapiens
WLHADQAVI

SEQ ID NO: 439105 - protein, 9 aa, Homo Sapiens
KEGNLSTKY

SEQ ID NO: 439106 - protein, 9 aa, Homo Sapiens
HRDMVGELG

SEQ ID NO: 439107 - protein, 9 aa, Homo Sapiens
YSPPSTLPI

SEQ ID NO: 439108 - protein, 9 aa, Homo Sapiens
APVVSWYLN

SEQ ID NO: 439109 - protein, 9 aa, Homo Sapiens
YETCATYEL

SEQ ID NO: 439110 - protein, 9 aa, Homo Sapiens
EGLWHPQCR

SEQ ID NO: 439111 - protein, 9 aa, Homo Sapiens
LDEFIESCQ

SEQ ID NO: 439112 - protein, 9 aa, Homo Sapiens
KIICKWKKA

SEQ ID NO: 439113 - protein, 9 aa, Homo Sapiens
NTFIKTLQG

SEQ ID NO: 439114 - protein, 9 aa, Homo Sapiens
KCIEDVGSL

SEQ ID NO: 439115 - protein, 9 aa, Homo Sapiens
MQQGSELIP

SEQ ID NO: 439116 - protein, 9 aa, Homo Sapiens
LIFGYLVSI

SEQ ID NO: 439117 - protein, 9 aa, Homo Sapiens
VTDNFCLLT

SEQ ID NO: 439118 - protein, 9 aa, Homo Sapiens
KSRPAMYYV

SEQ ID NO: 439119 - protein, 9 aa, Homo Sapiens
IIAGFCFLL

SEQ ID NO: 439120 - protein, 9 aa, Homo Sapiens
HLIRHKIIH

SEQ ID NO: 439121 - protein, 9 aa, Homo Sapiens
STLPVLAAS

SEQ ID NO: 439122 - protein, 9 aa, Homo Sapiens
KGILYEDNE

SEQ ID NO: 439123 - protein, 9 aa, Homo Sapiens
SKCLRLECP

SEQ ID NO: 439124 - protein, 9 aa, Homo Sapiens
WQLQELRRL

SEQ ID NO: 439125 - protein, 9 aa, Homo Sapiens
VFQNLTHDG

SEQ ID NO: 439126 - protein, 9 aa, Homo Sapiens
IIHQRINTG

SEQ ID NO: 439127 - protein, 9 aa, Homo Sapiens
SNNWAKVGD

SEQ ID NO: 439128 - protein, 9 aa, Homo Sapiens
QHPKKKNKL

SEQ ID NO: 439129 - protein, 9 aa, Homo Sapiens
PIQWNKVSS

SEQ ID NO: 439130 - protein, 9 aa, Homo Sapiens
QPLDREKKD

SEQ ID NO: 439131 - protein, 9 aa, Homo Sapiens
HPQSHFLYA

SEQ ID NO: 439132 - protein, 9 aa, Homo Sapiens
SLAAREAHN

SEQ ID NO: 439133 - protein, 9 aa, Homo Sapiens
QLHACFQHC

SEQ ID NO: 439134 - protein, 9 aa, Homo Sapiens
GEPWLIINE

SEQ ID NO: 439135 - protein, 9 aa, Homo Sapiens
ISQHDGPTN

SEQ ID NO: 439136 - protein, 9 aa, Homo Sapiens
FKVKKPEDE

SEQ ID NO: 439137 - protein, 9 aa, Homo Sapiens
INVGNINNY

SEQ ID NO: 439138 - protein, 9 aa, Homo Sapiens
DEQLNLETT

SEQ ID NO: 439139 - protein, 9 aa, Homo Sapiens
STEAFLASC

SEQ ID NO: 439140 - protein, 9 aa, Homo Sapiens
SLRIKNSKA

SEQ ID NO: 439141 - protein, 9 aa, Homo Sapiens
KPPSRQNEL

SEQ ID NO: 439142 - protein, 9 aa, Homo Sapiens
DCGGVSPFG

SEQ ID NO: 439143 - protein, 9 aa, Homo Sapiens
KGVEHVEDR

SEQ ID NO: 439144 - protein, 9 aa, Homo Sapiens
HNLREECIG

SEQ ID NO: 439145 - protein, 9 aa, Homo Sapiens
TGSGRCRHF

SEQ ID NO: 439146 - protein, 9 aa, Homo Sapiens
SHDCGGVSP

SEQ ID NO: 439147 - protein, 9 aa, Homo Sapiens
NMFPKLTKN

SEQ ID NO: 439148 - protein, 9 aa, Homo Sapiens
VDGCKVHKK

SEQ ID NO: 439149 - protein, 9 aa, Homo Sapiens
QNIKEATEK

SEQ ID NO: 439150 - protein, 9 aa, Homo Sapiens
ITSCAFNSS

SEQ ID NO: 439151 - protein, 9 aa, Homo Sapiens
NSGIRSASG

SEQ ID NO: 439152 - protein, 9 aa, Homo Sapiens
NRSTVFQIV

SEQ ID NO: 439153 - protein, 9 aa, Homo Sapiens
IRHLDECPH

SEQ ID NO: 439154 - protein, 9 aa, Homo Sapiens
KSTHAHLSL

SEQ ID NO: 439155 - protein, 9 aa, Homo Sapiens
KQDIAAYYC

SEQ ID NO: 439156 - protein, 9 aa, Homo Sapiens
DNFTSVSCK

SEQ ID NO: 439157 - protein, 9 aa, Homo Sapiens
AKVDALIYE

SEQ ID NO: 439158 - protein, 9 aa, Homo Sapiens
RGTRYMLSR

SEQ ID NO: 439159 - protein, 9 aa, Homo Sapiens
RQHPLFWEI

SEQ ID NO: 439160 - protein, 9 aa, Homo Sapiens
FFIVRDPFK

SEQ ID NO: 439161 - protein, 9 aa, Homo Sapiens
GCKSWKPPC

SEQ ID NO: 439162 - protein, 9 aa, Homo Sapiens
RAQAHVEFA

SEQ ID NO: 439163 - protein, 9 aa, Homo Sapiens
EVLQTLHHE

SEQ ID NO: 439164 - protein, 9 aa, Homo Sapiens
QPIPIIKSP

SEQ ID NO: 439165 - protein, 9 aa, Homo Sapiens
ACFCEERDV

SEQ ID NO: 439166 - protein, 9 aa, Homo Sapiens
SSHLHKTEK

SEQ ID NO: 439167 - protein, 9 aa, Homo Sapiens
QDMEDSVEE

SEQ ID NO: 439168 - protein, 9 aa, Homo Sapiens
AEHDGINSL

SEQ ID NO: 439169 - protein, 9 aa, Homo Sapiens
RYVEMKYLE

SEQ ID NO: 439170 - protein, 9 aa, Homo Sapiens
RLRVWDINE

SEQ ID NO: 439171 - protein, 9 aa, Homo Sapiens
DKPVPEELE

SEQ ID NO: 439172 - protein, 9 aa, Homo Sapiens
LGNTRYGGW

SEQ ID NO: 439173 - protein, 9 aa, Homo Sapiens
LDFCYGNKD

SEQ ID NO: 439174 - protein, 9 aa, Homo Sapiens
DKSYLCSEC

SEQ ID NO: 439175 - protein, 9 aa, Homo Sapiens
VKLRCPCKI

SEQ ID NO: 439176 - protein, 9 aa, Homo Sapiens
DSKKASDKL

SEQ ID NO: 439177 - protein, 9 aa, Homo Sapiens
SLPQRKTSW

SEQ ID NO: 439178 - protein, 9 aa, Homo Sapiens
EVNNRLDYH

SEQ ID NO: 439179 - protein, 9 aa, Homo Sapiens
NSSEKNEDF

SEQ ID NO: 439180 - protein, 9 aa, Homo Sapiens
ECLIHKCCF

SEQ ID NO: 439181 - protein, 9 aa, Homo Sapiens
EAIQEELLY

SEQ ID NO: 439182 - protein, 9 aa, Homo Sapiens
SLKKLQQTS

SEQ ID NO: 439183 - protein, 9 aa, Homo Sapiens
RVQDRALRW

SEQ ID NO: 439184 - protein, 9 aa, Homo Sapiens
PLPYQPTLS

SEQ ID NO: 439185 - protein, 9 aa, Homo Sapiens
QILDMVNGQ

SEQ ID NO: 439186 - protein, 9 aa, Homo Sapiens
KDKETNINH

SEQ ID NO: 439187 - protein, 9 aa, Homo Sapiens
PKIIFAPPA

SEQ ID NO: 439188 - protein, 9 aa, Homo Sapiens
ALPFSIIAG

SEQ ID NO: 439189 - protein, 9 aa, Homo Sapiens
TALNVKQCF

SEQ ID NO: 439190 - protein, 9 aa, Homo Sapiens
LPIQMWCVE

SEQ ID NO: 439191 - protein, 9 aa, Homo Sapiens
MLSLTSVQS

SEQ ID NO: 439192 - protein, 9 aa, Homo Sapiens
SWPWCSASA

SEQ ID NO: 439193 - protein, 9 aa, Homo Sapiens
AESKCCKEG

SEQ ID NO: 439194 - protein, 9 aa, Homo Sapiens
RNCTLLDEH

SEQ ID NO: 439195 - protein, 9 aa, Homo Sapiens
EDCSDSSEG

SEQ ID NO: 439196 - protein, 9 aa, Homo Sapiens
RTTINLSRM

SEQ ID NO: 439197 - protein, 9 aa, Homo Sapiens
DVLRELEAS

SEQ ID NO: 439198 - protein, 9 aa, Homo Sapiens
TNKQKMDTL

SEQ ID NO: 439199 - protein, 9 aa, Homo Sapiens
VSPGMQCII

SEQ ID NO: 439200 - protein, 9 aa, Homo Sapiens
CLYETRNKM

SEQ ID NO: 439201 - protein, 9 aa, Homo Sapiens
CQPPPCYLT

SEQ ID NO: 439202 - protein, 9 aa, Homo Sapiens
FRMRVSYLV

SEQ ID NO: 439203 - protein, 9 aa, Homo Sapiens
SALNPIIYT

SEQ ID NO: 439204 - protein, 9 aa, Homo Sapiens
SRVGSPQSP

SEQ ID NO: 439205 - protein, 9 aa, Homo Sapiens
NGPHTYQSK

SEQ ID NO: 439206 - protein, 9 aa, Homo Sapiens
NITEVVKGR

SEQ ID NO: 439207 - protein, 9 aa, Homo Sapiens
QVTLRCYPI

SEQ ID NO: 439208 - protein, 9 aa, Homo Sapiens
SWMDEVIKL

SEQ ID NO: 439209 - protein, 9 aa, Homo Sapiens
AKFIGVTEL

SEQ ID NO: 439210 - protein, 9 aa, Homo Sapiens
ADPMKRPAV

SEQ ID NO: 439211 - protein, 9 aa, Homo Sapiens
GRGMDVRRR

SEQ ID NO: 439212 - protein, 9 aa, Homo Sapiens
VMLEIYNHL

SEQ ID NO: 439213 - protein, 9 aa, Homo Sapiens
AEKPLNFFN

SEQ ID NO: 439214 - protein, 9 aa, Homo Sapiens
SDRNSGVNG

SEQ ID NO: 439215 - protein, 9 aa, Homo Sapiens
ARDSTVSNN

SEQ ID NO: 439216 - protein, 9 aa, Homo Sapiens
LGHSKDENY

SEQ ID NO: 439217 - protein, 9 aa, Homo Sapiens
CDKILSDDN

SEQ ID NO: 439218 - protein, 9 aa, Homo Sapiens
QPHDSCFVD

SEQ ID NO: 439219 - protein, 9 aa, Homo Sapiens
LNTPSERLL

SEQ ID NO: 439220 - protein, 9 aa, Homo Sapiens
DKLRNEVTV

SEQ ID NO: 439221 - protein, 9 aa, Homo Sapiens
YADQFNMPT

SEQ ID NO: 439222 - protein, 9 aa, Homo Sapiens
LGAFTRPCV

SEQ ID NO: 439223 - protein, 9 aa, Homo Sapiens
LREHQYLLE

SEQ ID NO: 439224 - protein, 9 aa, Homo Sapiens
RVDFWWCRL

SEQ ID NO: 439225 - protein, 9 aa, Homo Sapiens
ILDSSVNCT

SEQ ID NO: 439226 - protein, 9 aa, Homo Sapiens
TGLQPSTRD

SEQ ID NO: 439227 - protein, 9 aa, Homo Sapiens
HEKEIILGV

SEQ ID NO: 439228 - protein, 9 aa, Homo Sapiens
GASPNISNV

SEQ ID NO: 439229 - protein, 9 aa, Homo Sapiens
TPIQALQYA

SEQ ID NO: 439230 - protein, 9 aa, Homo Sapiens
FKALPTCGS

SEQ ID NO: 439231 - protein, 9 aa, Homo Sapiens
KGDYFSGKK

SEQ ID NO: 439232 - protein, 9 aa, Homo Sapiens
EEANKCAYT

SEQ ID NO: 439233 - protein, 9 aa, Homo Sapiens
YNTFSSIPF

SEQ ID NO: 439234 - protein, 9 aa, Homo Sapiens
KPDFVMEPR

SEQ ID NO: 439235 - protein, 9 aa, Homo Sapiens
EEEYKATPR

SEQ ID NO: 439236 - protein, 9 aa, Homo Sapiens
WLRENPGDS

SEQ ID NO: 439237 - protein, 9 aa, Homo Sapiens
QEHAAIQNK

SEQ ID NO: 439238 - protein, 9 aa, Homo Sapiens
TEQKVAQIL

SEQ ID NO: 439239 - protein, 9 aa, Homo Sapiens
GSNDIEGIH

SEQ ID NO: 439240 - protein, 9 aa, Homo Sapiens
KVIQHALAH

SEQ ID NO: 439241 - protein, 9 aa, Homo Sapiens
MGKPVSYYL

SEQ ID NO: 439242 - protein, 9 aa, Homo Sapiens
FKSEACYLV

SEQ ID NO: 439243 - protein, 9 aa, Homo Sapiens
PLRQGEVLP

SEQ ID NO: 439244 - protein, 9 aa, Homo Sapiens
HEAVNVICD

SEQ ID NO: 439245 - protein, 9 aa, Homo Sapiens
PFLIYPSSQ

SEQ ID NO: 439246 - protein, 9 aa, Homo Sapiens
NEIEREEKF

SEQ ID NO: 439247 - protein, 9 aa, Homo Sapiens
HIDTLLCNC

SEQ ID NO: 439248 - protein, 9 aa, Homo Sapiens
DFENYHKLW

SEQ ID NO: 439249 - protein, 9 aa, Homo Sapiens
TLAAIMRTL

SEQ ID NO: 439250 - protein, 9 aa, Homo Sapiens
PFCDKVMQL

SEQ ID NO: 439251 - protein, 9 aa, Homo Sapiens
HTGCRHTPV

SEQ ID NO: 439252 - protein, 9 aa, Homo Sapiens
VAGYPDPYS

SEQ ID NO: 439253 - protein, 9 aa, Homo Sapiens
VIEHPDAVC

SEQ ID NO: 439254 - protein, 9 aa, Homo Sapiens
SENQTDFSG

SEQ ID NO: 439255 - protein, 9 aa, Homo Sapiens
KLKNKQQIK

SEQ ID NO: 439256 - protein, 9 aa, Homo Sapiens
PAFQVVFTL

SEQ ID NO: 439257 - protein, 9 aa, Homo Sapiens
ARDFKKNYN

SEQ ID NO: 439258 - protein, 9 aa, Homo Sapiens
HDSCFVDMQ

SEQ ID NO: 439259 - protein, 9 aa, Homo Sapiens
YGHQIVTYF

SEQ ID NO: 439260 - protein, 9 aa, Homo Sapiens
AQMELPEQQ

SEQ ID NO: 439261 - protein, 9 aa, Homo Sapiens
EPTTNIQIW

SEQ ID NO: 439262 - protein, 9 aa, Homo Sapiens
LLIAQKNAG

SEQ ID NO: 439263 - protein, 9 aa, Homo Sapiens
RNKMFLTQV

SEQ ID NO: 439264 - protein, 9 aa, Homo Sapiens
SHHNFIQDE

SEQ ID NO: 439265 - protein, 9 aa, Homo Sapiens
HSSSTKLSR

SEQ ID NO: 439266 - protein, 9 aa, Homo Sapiens
ELDEKIQII

SEQ ID NO: 439267 - protein, 9 aa, Homo Sapiens
RVIDRAEKM

SEQ ID NO: 439268 - protein, 9 aa, Homo Sapiens
NLVCDRTHL

SEQ ID NO: 439269 - protein, 9 aa, Homo Sapiens
TMALNSKAA

SEQ ID NO: 439270 - protein, 9 aa, Homo Sapiens
GMQPQQQCW

SEQ ID NO: 439271 - protein, 9 aa, Homo Sapiens
IATWHGNDF

SEQ ID NO: 439272 - protein, 9 aa, Homo Sapiens
LVLLPNITL

SEQ ID NO: 439273 - protein, 9 aa, Homo Sapiens
MINGLFDQF

SEQ ID NO: 439274 - protein, 9 aa, Homo Sapiens
SRLCADRVS

SEQ ID NO: 439275 - protein, 9 aa, Homo Sapiens
NEERKLQEN

SEQ ID NO: 439276 - protein, 9 aa, Homo Sapiens
TPRTGHQIR

SEQ ID NO: 439277 - protein, 9 aa, Homo Sapiens
YTLVGFVGV

SEQ ID NO: 439278 - protein, 9 aa, Homo Sapiens
LRKSLLIDS

SEQ ID NO: 439279 - protein, 9 aa, Homo Sapiens
AINHFVCDV

SEQ ID NO: 439280 - protein, 9 aa, Homo Sapiens
KRWEHSRER

SEQ ID NO: 439281 - protein, 9 aa, Homo Sapiens
ADTNGPVFV

SEQ ID NO: 439282 - protein, 9 aa, Homo Sapiens
FHTSAPAAC

SEQ ID NO: 439283 - protein, 9 aa, Homo Sapiens
YQLKNLSEL

SEQ ID NO: 439284 - protein, 9 aa, Homo Sapiens
EEDEEEYKA

SEQ ID NO: 439285 - protein, 9 aa, Homo Sapiens
SPPGPPGPT

SEQ ID NO: 439286 - protein, 9 aa, Homo Sapiens
ILTSSVAAG

SEQ ID NO: 439287 - protein, 9 aa, Homo Sapiens
NMAYLRSLS

SEQ ID NO: 439288 - protein, 9 aa, Homo Sapiens
ETNWKVIAI

SEQ ID NO: 439289 - protein, 9 aa, Homo Sapiens
MSNKLEAGN

SEQ ID NO: 439290 - protein, 9 aa, Homo Sapiens
TFIARGILY

SEQ ID NO: 439291 - protein, 9 aa, Homo Sapiens
KHEDKQQEG

SEQ ID NO: 439292 - protein, 9 aa, Homo Sapiens
QENNKSLEL

SEQ ID NO: 439293 - protein, 9 aa, Homo Sapiens
FFKEEEREY

SEQ ID NO: 439294 - protein, 9 aa, Homo Sapiens
HQVAESVKY

SEQ ID NO: 439295 - protein, 9 aa, Homo Sapiens
GSVFLVASA

SEQ ID NO: 439296 - protein, 9 aa, Homo Sapiens
AGFVFDTSC

SEQ ID NO: 439297 - protein, 9 aa, Homo Sapiens
TLLLGTVNA

SEQ ID NO: 439298 - protein, 9 aa, Homo Sapiens
LEHNLERVL

SEQ ID NO: 439299 - protein, 9 aa, Homo Sapiens
SGKGYIIQT

SEQ ID NO: 439300 - protein, 9 aa, Homo Sapiens
QVKTGDKYF

SEQ ID NO: 439301 - protein, 9 aa, Homo Sapiens
HVLGDHSQV

SEQ ID NO: 439302 - protein, 9 aa, Homo Sapiens
ASNEFQNKI

SEQ ID NO: 439303 - protein, 9 aa, Homo Sapiens
TLGVEAFLL

SEQ ID NO: 439304 - protein, 9 aa, Homo Sapiens
YIQSTDVDR

SEQ ID NO: 439305 - protein, 9 aa, Homo Sapiens
VGPVQKVVT

SEQ ID NO: 439306 - protein, 9 aa, Homo Sapiens
YVSRPHRCE

SEQ ID NO: 439307 - protein, 9 aa, Homo Sapiens
NEYSLRDQL

SEQ ID NO: 439308 - protein, 9 aa, Homo Sapiens
KVCNKTLWE

SEQ ID NO: 439309 - protein, 9 aa, Homo Sapiens
EEYILEGMR

SEQ ID NO: 439310 - protein, 9 aa, Homo Sapiens
KSKWGIGYH

SEQ ID NO: 439311 - protein, 9 aa, Homo Sapiens
LSRDQSDCL

SEQ ID NO: 439312 - protein, 9 aa, Homo Sapiens
GPQTPSECS

SEQ ID NO: 439313 - protein, 9 aa, Homo Sapiens
KNWVQSGPR

SEQ ID NO: 439314 - protein, 9 aa, Homo Sapiens
RIDSLRQTG

SEQ ID NO: 439315 - protein, 9 aa, Homo Sapiens
EKLQNEFSS

SEQ ID NO: 439316 - protein, 9 aa, Homo Sapiens
RIPPEMSNK

SEQ ID NO: 439317 - protein, 9 aa, Homo Sapiens
VDATWLALN

SEQ ID NO: 439318 - protein, 9 aa, Homo Sapiens
LLLLVKAVQ

SEQ ID NO: 439319 - protein, 9 aa, Homo Sapiens
MLKYFLSQP

SEQ ID NO: 439320 - protein, 9 aa, Homo Sapiens
QIQKVYPGL

SEQ ID NO: 439321 - protein, 9 aa, Homo Sapiens
IYKAMAVSD

SEQ ID NO: 439322 - protein, 9 aa, Homo Sapiens
THNFYWELR

SEQ ID NO: 439323 - protein, 9 aa, Homo Sapiens
SLIQHEIIH

SEQ ID NO: 439324 - protein, 9 aa, Homo Sapiens
GANKKNFFK

SEQ ID NO: 439325 - protein, 9 aa, Homo Sapiens
RPQKERKER

SEQ ID NO: 439326 - protein, 9 aa, Homo Sapiens
LGHQEPHSL

SEQ ID NO: 439327 - protein, 9 aa, Homo Sapiens
AQITKALQS

SEQ ID NO: 439328 - protein, 9 aa, Homo Sapiens
NKLLEDRIA

SEQ ID NO: 439329 - protein, 9 aa, Homo Sapiens
FSHNSHLVE

SEQ ID NO: 439330 - protein, 9 aa, Homo Sapiens
YKLKEIDTK

SEQ ID NO: 439331 - protein, 9 aa, Homo Sapiens
HHGIDTDHA

SEQ ID NO: 439332 - protein, 9 aa, Homo Sapiens
ELAPHSAEP

SEQ ID NO: 439333 - protein, 9 aa, Homo Sapiens
EQHHLRKEL

SEQ ID NO: 439334 - protein, 9 aa, Homo Sapiens
QKHERIHTG

SEQ ID NO: 439335 - protein, 9 aa, Homo Sapiens
INGYGVKFK

SEQ ID NO: 439336 - protein, 9 aa, Homo Sapiens
HPLFWEINW

SEQ ID NO: 439337 - protein, 9 aa, Homo Sapiens
NCEFKATMC

SEQ ID NO: 439338 - protein, 9 aa, Homo Sapiens
GKKELILTV

SEQ ID NO: 439339 - protein, 9 aa, Homo Sapiens
DTLFQALDR

SEQ ID NO: 439340 - protein, 9 aa, Homo Sapiens
NMDFTKIES

SEQ ID NO: 439341 - protein, 9 aa, Homo Sapiens
SNEVAVEYF

SEQ ID NO: 439342 - protein, 9 aa, Homo Sapiens
LEGKWAMLG

SEQ ID NO: 439343 - protein, 9 aa, Homo Sapiens
ECPNIVNIN

SEQ ID NO: 439344 - protein, 9 aa, Homo Sapiens
RFLLPKDNN

SEQ ID NO: 439345 - protein, 9 aa, Homo Sapiens
AVIYPLMQG

SEQ ID NO: 439346 - protein, 9 aa, Homo Sapiens
RLQTPIYFF

SEQ ID NO: 439347 - protein, 9 aa, Homo Sapiens
NNFLMFFSF

SEQ ID NO: 439348 - protein, 9 aa, Homo Sapiens
GAGKGKSSH

SEQ ID NO: 439349 - protein, 9 aa, Homo Sapiens
FLDLNLKLS

SEQ ID NO: 439350 - protein, 9 aa, Homo Sapiens
CHLCFQLVS

SEQ ID NO: 439351 - protein, 9 aa, Homo Sapiens
THKLEALHL

SEQ ID NO: 439352 - protein, 9 aa, Homo Sapiens
LAQQNLEAL

SEQ ID NO: 439353 - protein, 9 aa, Homo Sapiens
PNMLTNLGL

SEQ ID NO: 439354 - protein, 9 aa, Homo Sapiens
VNTLIENVV

SEQ ID NO: 439355 - protein, 9 aa, Homo Sapiens
LPKMTLLSC

SEQ ID NO: 439356 - protein, 9 aa, Homo Sapiens
TKRVIQYFV

SEQ ID NO: 439357 - protein, 9 aa, Homo Sapiens
TFVLCSVLK

SEQ ID NO: 439358 - protein, 9 aa, Homo Sapiens
QQHLRGCPC

SEQ ID NO: 439359 - protein, 9 aa, Homo Sapiens
RWETAKSPK

SEQ ID NO: 439360 - protein, 9 aa, Homo Sapiens
LACQIRYER

SEQ ID NO: 439361 - protein, 9 aa, Homo Sapiens
SKLDTDTGV

SEQ ID NO: 439362 - protein, 9 aa, Homo Sapiens
IMDQYKLYD

SEQ ID NO: 439363 - protein, 9 aa, Homo Sapiens
ADPRDPAAP

SEQ ID NO: 439364 - protein, 9 aa, Homo Sapiens
WVLLFAIGL

SEQ ID NO: 439365 - protein, 9 aa, Homo Sapiens
SEEGQLVQL

SEQ ID NO: 439366 - protein, 9 aa, Homo Sapiens
HSSLQKHVK

SEQ ID NO: 439367 - protein, 9 aa, Homo Sapiens
PDRDPGDCL

SEQ ID NO: 439368 - protein, 9 aa, Homo Sapiens
KKRSSRKNT

SEQ ID NO: 439369 - protein, 9 aa, Homo Sapiens
KMPCKSSPP

SEQ ID NO: 439370 - protein, 9 aa, Homo Sapiens
VKSQKIHLT

SEQ ID NO: 439371 - protein, 9 aa, Homo Sapiens
GINIDFKEL

SEQ ID NO: 439372 - protein, 9 aa, Homo Sapiens
FIVRDPFKR

SEQ ID NO: 439373 - protein, 9 aa, Homo Sapiens
HSIVDKVSQ

SEQ ID NO: 439374 - protein, 9 aa, Homo Sapiens
HNDSVKVRS

SEQ ID NO: 439375 - protein, 9 aa, Homo Sapiens
MAIRHFKQA

SEQ ID NO: 439376 - protein, 9 aa, Homo Sapiens
RGRARCRES

SEQ ID NO: 439377 - protein, 9 aa, Homo Sapiens
FELPIIIVP

SEQ ID NO: 439378 - protein, 9 aa, Homo Sapiens
VVVLNNSKC

SEQ ID NO: 439379 - protein, 9 aa, Homo Sapiens
RYINSKVVK

SEQ ID NO: 439380 - protein, 9 aa, Homo Sapiens
VLHHLIPPV

SEQ ID NO: 439381 - protein, 9 aa, Homo Sapiens
NMLGSVATT

SEQ ID NO: 439382 - protein, 9 aa, Homo Sapiens
SFCRTIYLA

SEQ ID NO: 439383 - protein, 9 aa, Homo Sapiens
YLPAVPQRK

SEQ ID NO: 439384 - protein, 9 aa, Homo Sapiens
AFLSLFRLI

SEQ ID NO: 439385 - protein, 9 aa, Homo Sapiens
SPAQRRCTS

SEQ ID NO: 439386 - protein, 9 aa, Homo Sapiens
SPAQRRCTR

SEQ ID NO: 439387 - protein, 9 aa, Homo Sapiens
IQTREIKPS

SEQ ID NO: 439388 - protein, 9 aa, Homo Sapiens
KEVDNVFTI

SEQ ID NO: 439389 - protein, 9 aa, Homo Sapiens
CYTLAIVPK

SEQ ID NO: 439390 - protein, 9 aa, Homo Sapiens
PMHALPDEI

SEQ ID NO: 439391 - protein, 9 aa, Homo Sapiens
PADLALAIY

SEQ ID NO: 439392 - protein, 9 aa, Homo Sapiens
DRETEIIYS

SEQ ID NO: 439393 - protein, 9 aa, Homo Sapiens
VNFLHSNTL

SEQ ID NO: 439394 - protein, 9 aa, Homo Sapiens
ARRQNRRRL

SEQ ID NO: 439395 - protein, 9 aa, Homo Sapiens
ENVQKAVCH

SEQ ID NO: 439396 - protein, 9 aa, Homo Sapiens
HQIKEMKQM

SEQ ID NO: 439397 - protein, 9 aa, Homo Sapiens
ALLLLEGIK

SEQ ID NO: 439398 - protein, 9 aa, Homo Sapiens
AIFRGPVAT

SEQ ID NO: 439399 - protein, 9 aa, Homo Sapiens
NLSDVNTNR

SEQ ID NO: 439400 - protein, 9 aa, Homo Sapiens
PPAQGYAFA

SEQ ID NO: 439401 - protein, 9 aa, Homo Sapiens
YGGSGTWET

SEQ ID NO: 439402 - protein, 9 aa, Homo Sapiens
MLRRTERGW

SEQ ID NO: 439403 - protein, 9 aa, Homo Sapiens
GIITCFNVL

SEQ ID NO: 439404 - protein, 9 aa, Homo Sapiens
SICINSREL

SEQ ID NO: 439405 - protein, 9 aa, Homo Sapiens
LDYGMYYRE

SEQ ID NO: 439406 - protein, 9 aa, Homo Sapiens
YEEEEGTMM

SEQ ID NO: 439407 - protein, 9 aa, Homo Sapiens
PSPTAVSSD

SEQ ID NO: 439408 - protein, 9 aa, Homo Sapiens
SDRSPELSA

SEQ ID NO: 439409 - protein, 9 aa, Homo Sapiens
PSFGDTIAR

SEQ ID NO: 439410 - protein, 9 aa, Homo Sapiens
ISFVMGATE

SEQ ID NO: 439411 - protein, 9 aa, Homo Sapiens
RLLLRKDTS

SEQ ID NO: 439412 - protein, 9 aa, Homo Sapiens
CIFTEKLNN

SEQ ID NO: 439413 - protein, 9 aa, Homo Sapiens
FPSVEREHA

SEQ ID NO: 439414 - protein, 9 aa, Homo Sapiens
TLQINDIAM

SEQ ID NO: 439415 - protein, 9 aa, Homo Sapiens
KTFSHKDSL

SEQ ID NO: 439416 - protein, 9 aa, Homo Sapiens
HPHPKDIKF

SEQ ID NO: 439417 - protein, 9 aa, Homo Sapiens
FTSVGTGNF

SEQ ID NO: 439418 - protein, 9 aa, Homo Sapiens
IIGKENRPG

SEQ ID NO: 439419 - protein, 9 aa, Homo Sapiens
GKKWGHKAI

SEQ ID NO: 439420 - protein, 9 aa, Homo Sapiens
QKMIFYLNK

SEQ ID NO: 439421 - protein, 9 aa, Homo Sapiens
VVCHTCFKR

SEQ ID NO: 439422 - protein, 9 aa, Homo Sapiens
ISPLTFLSA

SEQ ID NO: 439423 - protein, 9 aa, Homo Sapiens
YGGRAASLR

SEQ ID NO: 439424 - protein, 9 aa, Homo Sapiens
KVKKPEDEV

SEQ ID NO: 439425 - protein, 9 aa, Homo Sapiens
CPFTRESLA

SEQ ID NO: 439426 - protein, 9 aa, Homo Sapiens
YKVQNEAKT

SEQ ID NO: 439427 - protein, 9 aa, Homo Sapiens
VTLRVAGEV

SEQ ID NO: 439428 - protein, 9 aa, Homo Sapiens
SEKNNSGAL

SEQ ID NO: 439429 - protein, 9 aa, Homo Sapiens
VDTEPQKQN

SEQ ID NO: 439430 - protein, 9 aa, Homo Sapiens
TLKIIILKM

SEQ ID NO: 439431 - protein, 9 aa, Homo Sapiens
QSKHDATTC

SEQ ID NO: 439432 - protein, 9 aa, Homo Sapiens
DLTDKIVEK

SEQ ID NO: 439433 - protein, 9 aa, Homo Sapiens
ISPSTMLPI

SEQ ID NO: 439434 - protein, 9 aa, Homo Sapiens
NKLLRIQDY

SEQ ID NO: 439435 - protein, 9 aa, Homo Sapiens
IVMDTLPLN

SEQ ID NO: 439436 - protein, 9 aa, Homo Sapiens
ALNLTELAA

SEQ ID NO: 439437 - protein, 9 aa, Homo Sapiens
NEEDYKNKG

SEQ ID NO: 439438 - protein, 9 aa, Homo Sapiens
PKDKNVKKC

SEQ ID NO: 439439 - protein, 9 aa, Homo Sapiens
IFGQYLPAV

SEQ ID NO: 439440 - protein, 9 aa, Homo Sapiens
LALHTQSSD

SEQ ID NO: 439441 - protein, 9 aa, Homo Sapiens
SNLQRHVCN

SEQ ID NO: 439442 - protein, 9 aa, Homo Sapiens
WKHLLPQSS

SEQ ID NO: 439443 - protein, 9 aa, Homo Sapiens
IISGWGAVS

SEQ ID NO: 439444 - protein, 9 aa, Homo Sapiens
TQVSAVHIS

SEQ ID NO: 439445 - protein, 9 aa, Homo Sapiens
TTPWTRPSN

SEQ ID NO: 439446 - protein, 9 aa, Homo Sapiens
FSYSSVLQK

SEQ ID NO: 439447 - protein, 9 aa, Homo Sapiens
KHEQVYIQS

SEQ ID NO: 439448 - protein, 9 aa, Homo Sapiens
ALVLPETPP

SEQ ID NO: 439449 - protein, 9 aa, Homo Sapiens
GPFGLSPLI

SEQ ID NO: 439450 - protein, 9 aa, Homo Sapiens
FCSRDKVSH

SEQ ID NO: 439451 - protein, 9 aa, Homo Sapiens
EVDKHIEKL

SEQ ID NO: 439452 - protein, 9 aa, Homo Sapiens
VCFVGLYNV

SEQ ID NO: 439453 - protein, 9 aa, Homo Sapiens
KKIKYLGIQ

SEQ ID NO: 439454 - protein, 9 aa, Homo Sapiens
MTDFPNIFC

SEQ ID NO: 439455 - protein, 9 aa, Homo Sapiens
AHRMDYLHV

SEQ ID NO: 439456 - protein, 9 aa, Homo Sapiens
SYVNNQPSM

SEQ ID NO: 439457 - protein, 9 aa, Homo Sapiens
SEGHPGRGM

SEQ ID NO: 439458 - protein, 9 aa, Homo Sapiens
SNWICNFIV

SEQ ID NO: 439459 - protein, 9 aa, Homo Sapiens
KRLFLHKLP

SEQ ID NO: 439460 - protein, 9 aa, Homo Sapiens
RSCVTYMCE

SEQ ID NO: 439461 - protein, 9 aa, Homo Sapiens
LPATQPIPI

SEQ ID NO: 439462 - protein, 9 aa, Homo Sapiens
NCQLQGKVP

SEQ ID NO: 439463 - protein, 9 aa, Homo Sapiens
YNNFQKSMD

SEQ ID NO: 439464 - protein, 9 aa, Homo Sapiens
NISEVVIKQ

SEQ ID NO: 439465 - protein, 9 aa, Homo Sapiens
ALITLDSEK

SEQ ID NO: 439466 - protein, 9 aa, Homo Sapiens
MDASSSKMK

SEQ ID NO: 439467 - protein, 9 aa, Homo Sapiens
YFTLQLPKL

SEQ ID NO: 439468 - protein, 9 aa, Homo Sapiens
KSFDNSPGD

SEQ ID NO: 439469 - protein, 9 aa, Homo Sapiens
RFHCKRINV

SEQ ID NO: 439470 - protein, 9 aa, Homo Sapiens
PTLIIRGEQ

SEQ ID NO: 439471 - protein, 9 aa, Homo Sapiens
QLMNEIKYK

SEQ ID NO: 439472 - protein, 9 aa, Homo Sapiens
LVMHNMFSH

SEQ ID NO: 439473 - protein, 9 aa, Homo Sapiens
KFFPFMNLT

SEQ ID NO: 439474 - protein, 9 aa, Homo Sapiens
RWAFHPCYL

SEQ ID NO: 439475 - protein, 9 aa, Homo Sapiens
DPQTRLFVP

SEQ ID NO: 439476 - protein, 9 aa, Homo Sapiens
TPSTLNNSK

SEQ ID NO: 439477 - protein, 9 aa, Homo Sapiens
VQGFFHSAC

SEQ ID NO: 439478 - protein, 9 aa, Homo Sapiens
DKDNLNLEN

SEQ ID NO: 439479 - protein, 9 aa, Homo Sapiens
EINERECLR

SEQ ID NO: 439480 - protein, 9 aa, Homo Sapiens
STNTCPDGH

SEQ ID NO: 439481 - protein, 9 aa, Homo Sapiens
KTRSIMAEK

SEQ ID NO: 439482 - protein, 9 aa, Homo Sapiens
RWKRKVLSS

SEQ ID NO: 439483 - protein, 9 aa, Homo Sapiens
MLFVQLPSN

SEQ ID NO: 439484 - protein, 9 aa, Homo Sapiens
DYSSGNDLT

SEQ ID NO: 439485 - protein, 9 aa, Homo Sapiens
IVHVVATLL

SEQ ID NO: 439486 - protein, 9 aa, Homo Sapiens
VKDNGKPPR

SEQ ID NO: 439487 - protein, 9 aa, Homo Sapiens
IRHRSALVK

SEQ ID NO: 439488 - protein, 9 aa, Homo Sapiens
FNLICLMEQ

SEQ ID NO: 439489 - protein, 9 aa, Homo Sapiens
YHKKKESHD

SEQ ID NO: 439490 - protein, 9 aa, Homo Sapiens
FPVLKPHQV

SEQ ID NO: 439491 - protein, 9 aa, Homo Sapiens
QLQGKVPFK

SEQ ID NO: 439492 - protein, 9 aa, Homo Sapiens
HHLHQFQQL

SEQ ID NO: 439493 - protein, 9 aa, Homo Sapiens
IAGFCFLLA

SEQ ID NO: 439494 - protein, 9 aa, Homo Sapiens
HKAISDKRV

SEQ ID NO: 439495 - protein, 9 aa, Homo Sapiens
RWNTTYHRY

SEQ ID NO: 439496 - protein, 9 aa, Homo Sapiens
SVNTARTAL

SEQ ID NO: 439497 - protein, 9 aa, Homo Sapiens
FRDVAIKFS

SEQ ID NO: 439498 - protein, 9 aa, Homo Sapiens
NVETAKKIH

SEQ ID NO: 439499 - protein, 9 aa, Homo Sapiens
EEQVQKLKA

SEQ ID NO: 439500 - protein, 9 aa, Homo Sapiens
RAAGQVAAL

SEQ ID NO: 439501 - protein, 9 aa, Homo Sapiens
NCGIMLRKC

SEQ ID NO: 439502 - protein, 9 aa, Homo Sapiens
DCRKTFCVK

SEQ ID NO: 439503 - protein, 9 aa, Homo Sapiens
PTLQIHERT

SEQ ID NO: 439504 - protein, 9 aa, Homo Sapiens
EGTNHKITS

SEQ ID NO: 439505 - protein, 9 aa, Homo Sapiens
MPRAGDRGS

SEQ ID NO: 439506 - protein, 9 aa, Homo Sapiens
PSGVLGVVA

SEQ ID NO: 439507 - protein, 9 aa, Homo Sapiens
HTLDTLTSR

SEQ ID NO: 439508 - protein, 9 aa, Homo Sapiens
DESSGPNTL

SEQ ID NO: 439509 - protein, 9 aa, Homo Sapiens
SHKAISDKR

SEQ ID NO: 439510 - protein, 9 aa, Homo Sapiens
HKHRITHTG

SEQ ID NO: 439511 - protein, 9 aa, Homo Sapiens
ASCLGETWN

SEQ ID NO: 439512 - protein, 9 aa, Homo Sapiens
FFSAVDNDC

SEQ ID NO: 439513 - protein, 9 aa, Homo Sapiens
EPGSLKSSP

SEQ ID NO: 439514 - protein, 9 aa, Homo Sapiens
DQGDLYSLL

SEQ ID NO: 439515 - protein, 9 aa, Homo Sapiens
IYEMYSDFA

SEQ ID NO: 439516 - protein, 9 aa, Homo Sapiens
CKVYLVEAV

SEQ ID NO: 439517 - protein, 9 aa, Homo Sapiens
MSLAILSFC

SEQ ID NO: 439518 - protein, 9 aa, Homo Sapiens
IRKFIISEA

SEQ ID NO: 439519 - protein, 9 aa, Homo Sapiens
CSSCSVIPG

SEQ ID NO: 439520 - protein, 9 aa, Homo Sapiens
EVITNLNGL

SEQ ID NO: 439521 - protein, 9 aa, Homo Sapiens
YCSGENLDL

SEQ ID NO: 439522 - protein, 9 aa, Homo Sapiens
RRCSHTEAA

SEQ ID NO: 439523 - protein, 9 aa, Homo Sapiens
YFPIQLVNT

SEQ ID NO: 439524 - protein, 9 aa, Homo Sapiens
RLKNISPTM

SEQ ID NO: 439525 - protein, 9 aa, Homo Sapiens
NADDNITVQ

SEQ ID NO: 439526 - protein, 9 aa, Homo Sapiens
LFESMLYSV

SEQ ID NO: 439527 - protein, 9 aa, Homo Sapiens
LEREKRWEH

SEQ ID NO: 439528 - protein, 9 aa, Homo Sapiens
PKVIQCLNI

SEQ ID NO: 439529 - protein, 9 aa, Homo Sapiens
TNKVIKIVG

SEQ ID NO: 439530 - protein, 9 aa, Homo Sapiens
SASLVLKIL

SEQ ID NO: 439531 - protein, 9 aa, Homo Sapiens
QPLPSQRSR

SEQ ID NO: 439532 - protein, 9 aa, Homo Sapiens
RMREDRYVN

SEQ ID NO: 439533 - protein, 9 aa, Homo Sapiens
TMQYYVQYR

SEQ ID NO: 439534 - protein, 9 aa, Homo Sapiens
ASLIQHEII

SEQ ID NO: 439535 - protein, 9 aa, Homo Sapiens
KVRAQSQDK

SEQ ID NO: 439536 - protein, 9 aa, Homo Sapiens
QYSNQNTAP

SEQ ID NO: 439537 - protein, 9 aa, Homo Sapiens
KDTDSTGST

SEQ ID NO: 439538 - protein, 9 aa, Homo Sapiens
SLPKMTLLS

SEQ ID NO: 439539 - protein, 9 aa, Homo Sapiens
DLDTNYADL

SEQ ID NO: 439540 - protein, 9 aa, Homo Sapiens
QHPYADNFI

SEQ ID NO: 439541 - protein, 9 aa, Homo Sapiens
ETPPHSQHV

SEQ ID NO: 439542 - protein, 9 aa, Homo Sapiens
QSRPDDDPP

SEQ ID NO: 439543 - protein, 9 aa, Homo Sapiens
SLGVNTLIE

SEQ ID NO: 439544 - protein, 9 aa, Homo Sapiens
PLGINSHKI

SEQ ID NO: 439545 - protein, 9 aa, Homo Sapiens
LEDSGISTE

SEQ ID NO: 439546 - protein, 9 aa, Homo Sapiens
KSEACYLVC

SEQ ID NO: 439547 - protein, 9 aa, Homo Sapiens
LVQLLRLII

SEQ ID NO: 439548 - protein, 9 aa, Homo Sapiens
LQDLATYNS

SEQ ID NO: 439549 - protein, 9 aa, Homo Sapiens
TTSLKEGTI

SEQ ID NO: 439550 - protein, 9 aa, Homo Sapiens
KSKAGNTFI

SEQ ID NO: 439551 - protein, 9 aa, Homo Sapiens
VSPQKEPQE

SEQ ID NO: 439552 - protein, 9 aa, Homo Sapiens
ISKDARSQN

SEQ ID NO: 439553 - protein, 9 aa, Homo Sapiens
GLGHSAKLA

SEQ ID NO: 439554 - protein, 9 aa, Homo Sapiens
LERLKQQMN

SEQ ID NO: 439555 - protein, 9 aa, Homo Sapiens
RSHSKSRSY

SEQ ID NO: 439556 - protein, 9 aa, Homo Sapiens
YTIIMSHRV

SEQ ID NO: 439557 - protein, 9 aa, Homo Sapiens
AGVLQVQRY

SEQ ID NO: 439558 - protein, 9 aa, Homo Sapiens
IMSVSTISA

SEQ ID NO: 439559 - protein, 9 aa, Homo Sapiens
HVEFADIGC

SEQ ID NO: 439560 - protein, 9 aa, Homo Sapiens
CGIMLRKCI

SEQ ID NO: 439561 - protein, 9 aa, Homo Sapiens
GLSEQEAHK

SEQ ID NO: 439562 - protein, 9 aa, Homo Sapiens
ISNRALGWA

SEQ ID NO: 439563 - protein, 9 aa, Homo Sapiens
FRVNYYLRN

SEQ ID NO: 439564 - protein, 9 aa, Homo Sapiens
KWAMLGTLL

SEQ ID NO: 439565 - protein, 9 aa, Homo Sapiens
FLGQVAINI

SEQ ID NO: 439566 - protein, 9 aa, Homo Sapiens
LVYCKKDLL

SEQ ID NO: 439567 - protein, 9 aa, Homo Sapiens
GSDEMNIHL

SEQ ID NO: 439568 - protein, 9 aa, Homo Sapiens
IKPYACKEC

SEQ ID NO: 439569 - protein, 9 aa, Homo Sapiens
ECLVHQSKI

SEQ ID NO: 439570 - protein, 9 aa, Homo Sapiens
HKDSLVQHQ

SEQ ID NO: 439571 - protein, 9 aa, Homo Sapiens
QLEYDMVLT

SEQ ID NO: 439572 - protein, 9 aa, Homo Sapiens
DLRVLGYLN

SEQ ID NO: 439573 - protein, 9 aa, Homo Sapiens
YKSILDNLR

SEQ ID NO: 439574 - protein, 9 aa, Homo Sapiens
IMADIENIS

SEQ ID NO: 439575 - protein, 9 aa, Homo Sapiens
NRDVTLRVA

SEQ ID NO: 439576 - protein, 9 aa, Homo Sapiens
VGLDKLVNN

SEQ ID NO: 439577 - protein, 9 aa, Homo Sapiens
VTHTVKFLT

SEQ ID NO: 439578 - protein, 9 aa, Homo Sapiens
SSNVKFDLK

SEQ ID NO: 439579 - protein, 9 aa, Homo Sapiens
YELNVDRVF

SEQ ID NO: 439580 - protein, 9 aa, Homo Sapiens
FLNTKERQS

SEQ ID NO: 439581 - protein, 9 aa, Homo Sapiens
YVDFNCLDV

SEQ ID NO: 439582 - protein, 9 aa, Homo Sapiens
SSLWNIWKE

SEQ ID NO: 439583 - protein, 9 aa, Homo Sapiens
KELQLMKEL

SEQ ID NO: 439584 - protein, 9 aa, Homo Sapiens
FSQRLFMII

SEQ ID NO: 439585 - protein, 9 aa, Homo Sapiens
ILIIFAVFI

SEQ ID NO: 439586 - protein, 9 aa, Homo Sapiens
PSSEHLSVV

SEQ ID NO: 439587 - protein, 9 aa, Homo Sapiens
DIKGTPFSV

SEQ ID NO: 439588 - protein, 9 aa, Homo Sapiens
NISINLVGS

SEQ ID NO: 439589 - protein, 9 aa, Homo Sapiens
NWKRYKEEN

SEQ ID NO: 439590 - protein, 9 aa, Homo Sapiens
GSNIIQHQK

SEQ ID NO: 439591 - protein, 9 aa, Homo Sapiens
KNVMVPVGG

SEQ ID NO: 439592 - protein, 9 aa, Homo Sapiens
QMVVEKGGC

SEQ ID NO: 439593 - protein, 9 aa, Homo Sapiens
YFVLTVGKN

SEQ ID NO: 439594 - protein, 9 aa, Homo Sapiens
TLIFRTSSN

SEQ ID NO: 439595 - protein, 9 aa, Homo Sapiens
GNQNETPSD

SEQ ID NO: 439596 - protein, 9 aa, Homo Sapiens
QMEDMRNKE

SEQ ID NO: 439597 - protein, 9 aa, Homo Sapiens
QKLKFKDQL

SEQ ID NO: 439598 - protein, 9 aa, Homo Sapiens
GFCGENINH

SEQ ID NO: 439599 - protein, 9 aa, Homo Sapiens
ILIHHREDI

SEQ ID NO: 439600 - protein, 9 aa, Homo Sapiens
TVESQENTF

SEQ ID NO: 439601 - protein, 9 aa, Homo Sapiens
FVLCSVLKK

SEQ ID NO: 439602 - protein, 9 aa, Homo Sapiens
KRKPQILEE

SEQ ID NO: 439603 - protein, 9 aa, Homo Sapiens
PKVEIQRSA

SEQ ID NO: 439604 - protein, 9 aa, Homo Sapiens
YVHNFLPRF

SEQ ID NO: 439605 - protein, 9 aa, Homo Sapiens
SEKELKASE

SEQ ID NO: 439606 - protein, 9 aa, Homo Sapiens
PPSGTRSPA

SEQ ID NO: 439607 - protein, 9 aa, Homo Sapiens
PWDVGWQVC

SEQ ID NO: 439608 - protein, 9 aa, Homo Sapiens
TKALQSNMR

SEQ ID NO: 439609 - protein, 9 aa, Homo Sapiens
NGIYRSASD

SEQ ID NO: 439610 - protein, 9 aa, Homo Sapiens
LVAHQITHT

SEQ ID NO: 439611 - protein, 9 aa, Homo Sapiens
KRTEEQELC

SEQ ID NO: 439612 - protein, 9 aa, Homo Sapiens
YAMDFDWRI

SEQ ID NO: 439613 - protein, 9 aa, Homo Sapiens
RRLNLTQHI

SEQ ID NO: 439614 - protein, 9 aa, Homo Sapiens
LKGSVSWMG

SEQ ID NO: 439615 - protein, 9 aa, Homo Sapiens
NNLEQILNG

SEQ ID NO: 439616 - protein, 9 aa, Homo Sapiens
IIMADKVLW

SEQ ID NO: 439617 - protein, 9 aa, Homo Sapiens
VFKDVMGKS

SEQ ID NO: 439618 - protein, 9 aa, Homo Sapiens
FEEVTRRPL

SEQ ID NO: 439619 - protein, 9 aa, Homo Sapiens
WNTLSAAQL

SEQ ID NO: 439620 - protein, 9 aa, Homo Sapiens
PDEIQKMLP

SEQ ID NO: 439621 - protein, 9 aa, Homo Sapiens
TIYGVTPLF

SEQ ID NO: 439622 - protein, 9 aa, Homo Sapiens
CLAEIPYDV

SEQ ID NO: 439623 - protein, 9 aa, Homo Sapiens
RGPLGASGY

SEQ ID NO: 439624 - protein, 9 aa, Homo Sapiens
LTRSRNTYR

SEQ ID NO: 439625 - protein, 9 aa, Homo Sapiens
VTQVNVGLE

SEQ ID NO: 439626 - protein, 9 aa, Homo Sapiens
GVQFGLKNT

SEQ ID NO: 439627 - protein, 9 aa, Homo Sapiens
HNFVTPSGS

SEQ ID NO: 439628 - protein, 9 aa, Homo Sapiens
VGSEHYNVA

SEQ ID NO: 439629 - protein, 9 aa, Homo Sapiens
GKRPWFVGY

SEQ ID NO: 439630 - protein, 9 aa, Homo Sapiens
PRTAVAAAA

SEQ ID NO: 439631 - protein, 9 aa, Homo Sapiens
FTQKIFTEQ

SEQ ID NO: 439632 - protein, 9 aa, Homo Sapiens
GYKQEGLNK

SEQ ID NO: 439633 - protein, 9 aa, Homo Sapiens
TDSDILQMF

SEQ ID NO: 439634 - protein, 9 aa, Homo Sapiens
LTTCYARCQ

SEQ ID NO: 439635 - protein, 9 aa, Homo Sapiens
LWCFMNNIS

SEQ ID NO: 439636 - protein, 9 aa, Homo Sapiens
QVQSTMDES

SEQ ID NO: 439637 - protein, 9 aa, Homo Sapiens
LDGDTGPAR

SEQ ID NO: 439638 - protein, 9 aa, Homo Sapiens
CKAFRVWES

SEQ ID NO: 439639 - protein, 9 aa, Homo Sapiens
FFPSRKAKP

SEQ ID NO: 439640 - protein, 9 aa, Homo Sapiens
PNMITDYLT

SEQ ID NO: 439641 - protein, 9 aa, Homo Sapiens
TLNEKPFYV

SEQ ID NO: 439642 - protein, 9 aa, Homo Sapiens
PCDPLIVEM

SEQ ID NO: 439643 - protein, 9 aa, Homo Sapiens
RSFQTGIKR

SEQ ID NO: 439644 - protein, 9 aa, Homo Sapiens
QPITQRAEI

SEQ ID NO: 439645 - protein, 9 aa, Homo Sapiens
AASQPEGFK

SEQ ID NO: 439646 - protein, 9 aa, Homo Sapiens
RPADLALAI

SEQ ID NO: 439647 - protein, 9 aa, Homo Sapiens
PILFHKHWN

SEQ ID NO: 439648 - protein, 9 aa, Homo Sapiens
CNIHNKEKP

SEQ ID NO: 439649 - protein, 9 aa, Homo Sapiens
NNRDKDLIW

SEQ ID NO: 439650 - protein, 9 aa, Homo Sapiens
VDCKNKTTK

SEQ ID NO: 439651 - protein, 9 aa, Homo Sapiens
EVLELTGTP

SEQ ID NO: 439652 - protein, 9 aa, Homo Sapiens
TFHNMYHSQ

SEQ ID NO: 439653 - protein, 9 aa, Homo Sapiens
AQFYTLWTA

SEQ ID NO: 439654 - protein, 9 aa, Homo Sapiens
VVWGECNST

SEQ ID NO: 439655 - protein, 9 aa, Homo Sapiens
CGRSVFDIG

SEQ ID NO: 439656 - protein, 9 aa, Homo Sapiens
NGANCNLEY

SEQ ID NO: 439657 - protein, 9 aa, Homo Sapiens
LMEVITAAE

SEQ ID NO: 439658 - protein, 9 aa, Homo Sapiens
TPSQDEEMI

SEQ ID NO: 439659 - protein, 9 aa, Homo Sapiens
AQHLGLGGK

SEQ ID NO: 439660 - protein, 9 aa, Homo Sapiens
TYFRADKKS

SEQ ID NO: 439661 - protein, 9 aa, Homo Sapiens
PIPGLLKSP

SEQ ID NO: 439662 - protein, 9 aa, Homo Sapiens
DFTTLAAIM

SEQ ID NO: 439663 - protein, 9 aa, Homo Sapiens
EQPGDLYNE

SEQ ID NO: 439664 - protein, 9 aa, Homo Sapiens
IEIVCRVFS

SEQ ID NO: 439665 - protein, 9 aa, Homo Sapiens
ANNLLLLAN

SEQ ID NO: 439666 - protein, 9 aa, Homo Sapiens
FTDVYYLYI

SEQ ID NO: 439667 - protein, 9 aa, Homo Sapiens
ALHLQTSKH

SEQ ID NO: 439668 - protein, 9 aa, Homo Sapiens
YVAYDLKTQ

SEQ ID NO: 439669 - protein, 9 aa, Homo Sapiens
EENNFYLCP

SEQ ID NO: 439670 - protein, 9 aa, Homo Sapiens
EVRYEVNCL

SEQ ID NO: 439671 - protein, 9 aa, Homo Sapiens
RSLWPSEEF

SEQ ID NO: 439672 - protein, 9 aa, Homo Sapiens
DEQENYSFT

SEQ ID NO: 439673 - protein, 9 aa, Homo Sapiens
KNWKIKNTH

SEQ ID NO: 439674 - protein, 9 aa, Homo Sapiens
INENILPSD

SEQ ID NO: 439675 - protein, 9 aa, Homo Sapiens
EEQNLLLIQ

SEQ ID NO: 439676 - protein, 9 aa, Homo Sapiens
QSRSLYSTP

SEQ ID NO: 439677 - protein, 9 aa, Homo Sapiens
EFNATDVLR

SEQ ID NO: 439678 - protein, 9 aa, Homo Sapiens
KAASPGHCL

SEQ ID NO: 439679 - protein, 9 aa, Homo Sapiens
NDQLEETMK

SEQ ID NO: 439680 - protein, 9 aa, Homo Sapiens
PLQVKTGDK

SEQ ID NO: 439681 - protein, 9 aa, Homo Sapiens
AVQGFLGAT

SEQ ID NO: 439682 - protein, 9 aa, Homo Sapiens
KIIFIVVAV

SEQ ID NO: 439683 - protein, 9 aa, Homo Sapiens
PFSQMILFD

SEQ ID NO: 439684 - protein, 9 aa, Homo Sapiens
SGVMGEKDH

SEQ ID NO: 439685 - protein, 9 aa, Homo Sapiens
LGQLYKCHP

SEQ ID NO: 439686 - protein, 9 aa, Homo Sapiens
QEPIDSHSR

SEQ ID NO: 439687 - protein, 9 aa, Homo Sapiens
LWKQEPGLR

SEQ ID NO: 439688 - protein, 9 aa, Homo Sapiens
SIVSQCPTA

SEQ ID NO: 439689 - protein, 9 aa, Homo Sapiens
VSEIQPHML

SEQ ID NO: 439690 - protein, 9 aa, Homo Sapiens
KLKEKQDKK

SEQ ID NO: 439691 - protein, 9 aa, Homo Sapiens
TLTKHTDEL

SEQ ID NO: 439692 - protein, 9 aa, Homo Sapiens
NAMRLSIIH

SEQ ID NO: 439693 - protein, 9 aa, Homo Sapiens
TCIVQEDMS

SEQ ID NO: 439694 - protein, 9 aa, Homo Sapiens
CSNMFPKLT

SEQ ID NO: 439695 - protein, 9 aa, Homo Sapiens
NSSMLKYFL

SEQ ID NO: 439696 - protein, 9 aa, Homo Sapiens
DIDLHVQIH

SEQ ID NO: 439697 - protein, 9 aa, Homo Sapiens
KVPASVQTV

SEQ ID NO: 439698 - protein, 9 aa, Homo Sapiens
ALELANKDE

SEQ ID NO: 439699 - protein, 9 aa, Homo Sapiens
SLLIDSHIY

SEQ ID NO: 439700 - protein, 9 aa, Homo Sapiens
DKTIDKLKM

SEQ ID NO: 439701 - protein, 9 aa, Homo Sapiens
YSLRMSERR

SEQ ID NO: 439702 - protein, 9 aa, Homo Sapiens
FKRLSCLSL

SEQ ID NO: 439703 - protein, 9 aa, Homo Sapiens
VILEMQILL

SEQ ID NO: 439704 - protein, 9 aa, Homo Sapiens
MLLGLLALM

SEQ ID NO: 439705 - protein, 9 aa, Homo Sapiens
LKYLENTVT

SEQ ID NO: 439706 - protein, 9 aa, Homo Sapiens
ELCDLNDSK

SEQ ID NO: 439707 - protein, 9 aa, Homo Sapiens
TSSSEYSIF

SEQ ID NO: 439708 - protein, 9 aa, Homo Sapiens
DIENYVGII

SEQ ID NO: 439709 - protein, 9 aa, Homo Sapiens
SKGLSPKEH

SEQ ID NO: 439710 - protein, 9 aa, Homo Sapiens
AEFQQMLKQ

SEQ ID NO: 439711 - protein, 9 aa, Homo Sapiens
ESDQILAIN

SEQ ID NO: 439712 - protein, 9 aa, Homo Sapiens
CGCEYGTKS

SEQ ID NO: 439713 - protein, 9 aa, Homo Sapiens
VSPFILALS

SEQ ID NO: 439714 - protein, 9 aa, Homo Sapiens
DFFHLVPFM

SEQ ID NO: 439715 - protein, 9 aa, Homo Sapiens
VCDRHHSLG

SEQ ID NO: 439716 - protein, 9 aa, Homo Sapiens
RPTVVHGVW

SEQ ID NO: 439717 - protein, 9 aa, Homo Sapiens
LEWNREYTY

SEQ ID NO: 439718 - protein, 9 aa, Homo Sapiens
RPHRCELAA

SEQ ID NO: 439719 - protein, 9 aa, Homo Sapiens
TESQLQAGA

SEQ ID NO: 439720 - protein, 9 aa, Homo Sapiens
TDFWDRADI

SEQ ID NO: 439721 - protein, 9 aa, Homo Sapiens
LVVNVNPTN

SEQ ID NO: 439722 - protein, 9 aa, Homo Sapiens
PWSIPGPEK

SEQ ID NO: 439723 - protein, 9 aa, Homo Sapiens
RQGCHLCFQ

SEQ ID NO: 439724 - protein, 9 aa, Homo Sapiens
PQAEHVLLA

SEQ ID NO: 439725 - protein, 9 aa, Homo Sapiens
SKRFLLPKD

SEQ ID NO: 439726 - protein, 9 aa, Homo Sapiens
ITHKVLRIT

SEQ ID NO: 439727 - protein, 9 aa, Homo Sapiens
DVYYLYIKF

SEQ ID NO: 439728 - protein, 9 aa, Homo Sapiens
RNEIEREEK

SEQ ID NO: 439729 - protein, 9 aa, Homo Sapiens
QNEFSSFGS

SEQ ID NO: 439730 - protein, 9 aa, Homo Sapiens
EGFFDLITI

SEQ ID NO: 439731 - protein, 9 aa, Homo Sapiens
NNLLLLANS

SEQ ID NO: 439732 - protein, 9 aa, Homo Sapiens
HANVVLLDD

SEQ ID NO: 439733 - protein, 9 aa, Homo Sapiens
WNIWKETVP

SEQ ID NO: 439734 - protein, 9 aa, Homo Sapiens
TSFSHTCLT

SEQ ID NO: 439735 - protein, 9 aa, Homo Sapiens
NPIIYTLTT

SEQ ID NO: 439736 - protein, 9 aa, Homo Sapiens
NSVSHIIIE

SEQ ID NO: 439737 - protein, 9 aa, Homo Sapiens
QEQKDKASE

SEQ ID NO: 439738 - protein, 9 aa, Homo Sapiens
TNSHGETVQ

SEQ ID NO: 439739 - protein, 9 aa, Homo Sapiens
EKEAEERHR

SEQ ID NO: 439740 - protein, 9 aa, Homo Sapiens
NTPRSKRFL

SEQ ID NO: 439741 - protein, 9 aa, Homo Sapiens
HLIPPVLNP

SEQ ID NO: 439742 - protein, 9 aa, Homo Sapiens
MENNNLLLK

SEQ ID NO: 439743 - protein, 9 aa, Homo Sapiens
KIKYLGIQL

SEQ ID NO: 439744 - protein, 9 aa, Homo Sapiens
TPISDLNAD

SEQ ID NO: 439745 - protein, 9 aa, Homo Sapiens
HVTKPSPSH

SEQ ID NO: 439746 - protein, 9 aa, Homo Sapiens
IREHVCIRA

SEQ ID NO: 439747 - protein, 9 aa, Homo Sapiens
DFFLVQRLI

SEQ ID NO: 439748 - protein, 9 aa, Homo Sapiens
LYFLKLTDV

SEQ ID NO: 439749 - protein, 9 aa, Homo Sapiens
LKNISVQVS

SEQ ID NO: 439750 - protein, 9 aa, Homo Sapiens
REYVAYDLK

SEQ ID NO: 439751 - protein, 9 aa, Homo Sapiens
TLYSWPWCS

SEQ ID NO: 439752 - protein, 9 aa, Homo Sapiens
LAGSYTCTC

SEQ ID NO: 439753 - protein, 9 aa, Homo Sapiens
SLQKHVKTH

SEQ ID NO: 439754 - protein, 9 aa, Homo Sapiens
KINADLVLL

SEQ ID NO: 439755 - protein, 9 aa, Homo Sapiens
ANPHCFKIT

SEQ ID NO: 439756 - protein, 9 aa, Homo Sapiens
VAVGLSSDK

SEQ ID NO: 439757 - protein, 9 aa, Homo Sapiens
NNLQEAEKT

SEQ ID NO: 439758 - protein, 9 aa, Homo Sapiens
IVGALRTGA

SEQ ID NO: 439759 - protein, 9 aa, Homo Sapiens
DTPFSYAVP

SEQ ID NO: 439760 - protein, 9 aa, Homo Sapiens
TIKLGKRLD

SEQ ID NO: 439761 - protein, 9 aa, Homo Sapiens
NMFQTLPPS

SEQ ID NO: 439762 - protein, 9 aa, Homo Sapiens
YIKEGLDKP

SEQ ID NO: 439763 - protein, 9 aa, Homo Sapiens
WHANTIRLF

SEQ ID NO: 439764 - protein, 9 aa, Homo Sapiens
RCKALKEQR

SEQ ID NO: 439765 - protein, 9 aa, Homo Sapiens
YPLMQGLRE

SEQ ID NO: 439766 - protein, 9 aa, Homo Sapiens
NLTNKNYRA

SEQ ID NO: 439767 - protein, 9 aa, Homo Sapiens
WNISINLVG

SEQ ID NO: 439768 - protein, 9 aa, Homo Sapiens
LEIGFNGNQ

SEQ ID NO: 439769 - protein, 9 aa, Homo Sapiens
HEEICTANE

SEQ ID NO: 439770 - protein, 9 aa, Homo Sapiens
LAPNSKSSG

SEQ ID NO: 439771 - protein, 9 aa, Homo Sapiens
VVIKAIADY

SEQ ID NO: 439772 - protein, 9 aa, Homo Sapiens
LHLQTSKHH

SEQ ID NO: 439773 - protein, 9 aa, Homo Sapiens
LDSVTERWF

SEQ ID NO: 439774 - protein, 9 aa, Homo Sapiens
DSGLPNDRL

SEQ ID NO: 439775 - protein, 9 aa, Homo Sapiens
HMDFWGRVN

SEQ ID NO: 439776 - protein, 9 aa, Homo Sapiens
SELEKAREE

SEQ ID NO: 439777 - protein, 9 aa, Homo Sapiens
EYLFCESSG

SEQ ID NO: 439778 - protein, 9 aa, Homo Sapiens
PRDWKTFLF

SEQ ID NO: 439779 - protein, 9 aa, Homo Sapiens
LPTLIIRGE

SEQ ID NO: 439780 - protein, 9 aa, Homo Sapiens
EEKNTISDK

SEQ ID NO: 439781 - protein, 9 aa, Homo Sapiens
KRHPPQILQ

SEQ ID NO: 439782 - protein, 9 aa, Homo Sapiens
GIDNFTSVS

SEQ ID NO: 439783 - protein, 9 aa, Homo Sapiens
VILLACQIR

SEQ ID NO: 439784 - protein, 9 aa, Homo Sapiens
KWPDSGSSA

SEQ ID NO: 439785 - protein, 9 aa, Homo Sapiens
NFRRYKVLR

SEQ ID NO: 439786 - protein, 9 aa, Homo Sapiens
VQLSPAEYF

SEQ ID NO: 439787 - protein, 9 aa, Homo Sapiens
LAQHLGLGG

SEQ ID NO: 439788 - protein, 9 aa, Homo Sapiens
PKEAVRRRQ

SEQ ID NO: 439789 - protein, 9 aa, Homo Sapiens
YLRSLSLEG

SEQ ID NO: 439790 - protein, 9 aa, Homo Sapiens
SKVICNMSH

SEQ ID NO: 439791 - protein, 9 aa, Homo Sapiens
ASISSISCC

SEQ ID NO: 439792 - protein, 9 aa, Homo Sapiens
YPTFAVTAQ

SEQ ID NO: 439793 - protein, 9 aa, Homo Sapiens
DEWALLDSS

SEQ ID NO: 439794 - protein, 9 aa, Homo Sapiens
QMLKFSSEN

SEQ ID NO: 439795 - protein, 9 aa, Homo Sapiens
PEYQWIDQI

SEQ ID NO: 439796 - protein, 9 aa, Homo Sapiens
DCGIPLCHL

SEQ ID NO: 439797 - protein, 9 aa, Homo Sapiens
CREHEKTHT

SEQ ID NO: 439798 - protein, 9 aa, Homo Sapiens
DIIRKQVSA

SEQ ID NO: 439799 - protein, 9 aa, Homo Sapiens
AHLFGGTEI

SEQ ID NO: 439800 - protein, 9 aa, Homo Sapiens
NDVKIEQAK

SEQ ID NO: 439801 - protein, 9 aa, Homo Sapiens
WTTILGMCR

SEQ ID NO: 439802 - protein, 9 aa, Homo Sapiens
LAFDPKKGC

SEQ ID NO: 439803 - protein, 9 aa, Homo Sapiens
QERIDSLRQ

SEQ ID NO: 439804 - protein, 9 aa, Homo Sapiens
CIQAYFYDL

SEQ ID NO: 439805 - protein, 9 aa, Homo Sapiens
KYAVRDLVH

SEQ ID NO: 439806 - protein, 9 aa, Homo Sapiens
MTSSADKPS

SEQ ID NO: 439807 - protein, 9 aa, Homo Sapiens
IFAEKTITV

SEQ ID NO: 439808 - protein, 9 aa, Homo Sapiens
LAVQGFLGA

SEQ ID NO: 439809 - protein, 9 aa, Homo Sapiens
ETGDFEQTL

SEQ ID NO: 439810 - protein, 9 aa, Homo Sapiens
VVFNNVTNN

SEQ ID NO: 439811 - protein, 9 aa, Homo Sapiens
HSDRHNIKH

SEQ ID NO: 439812 - protein, 9 aa, Homo Sapiens
FCGPGAMSA

SEQ ID NO: 439813 - protein, 9 aa, Homo Sapiens
LSNLELWVN

SEQ ID NO: 439814 - protein, 9 aa, Homo Sapiens
GRLLLRTTS

SEQ ID NO: 439815 - protein, 9 aa, Homo Sapiens
LLLVAVVVW

SEQ ID NO: 439816 - protein, 9 aa, Homo Sapiens
DGCHPACLV

SEQ ID NO: 439817 - protein, 9 aa, Homo Sapiens
DGRNHHKTT

SEQ ID NO: 439818 - protein, 9 aa, Homo Sapiens
MQCIISGWG

SEQ ID NO: 439819 - protein, 9 aa, Homo Sapiens
SHQVPILFH

SEQ ID NO: 439820 - protein, 9 aa, Homo Sapiens
KYFKITCGK

SEQ ID NO: 439821 - protein, 9 aa, Homo Sapiens
EVPTRKAER

SEQ ID NO: 439822 - protein, 9 aa, Homo Sapiens
GPQKVRAMG

SEQ ID NO: 439823 - protein, 9 aa, Homo Sapiens
HTMKAFLDE

SEQ ID NO: 439824 - protein, 9 aa, Homo Sapiens
HYYETVCMA

SEQ ID NO: 439825 - protein, 9 aa, Homo Sapiens
LTSPTELPS

SEQ ID NO: 439826 - protein, 9 aa, Homo Sapiens
MYKNLDILS

SEQ ID NO: 439827 - protein, 9 aa, Homo Sapiens
ITVCDEDKL

SEQ ID NO: 439828 - protein, 9 aa, Homo Sapiens
MAFSTYGGL

SEQ ID NO: 439829 - protein, 9 aa, Homo Sapiens
LQSTLGDDL

SEQ ID NO: 439830 - protein, 9 aa, Homo Sapiens
RTERGWMWN

SEQ ID NO: 439831 - protein, 9 aa, Homo Sapiens
RNSNERLGL

SEQ ID NO: 439832 - protein, 9 aa, Homo Sapiens
IDTLLCNCT

SEQ ID NO: 439833 - protein, 9 aa, Homo Sapiens
AAEAVIADL

SEQ ID NO: 439834 - protein, 9 aa, Homo Sapiens
FTCPTPGCD

SEQ ID NO: 439835 - protein, 9 aa, Homo Sapiens
QRCLCAGYF

SEQ ID NO: 439836 - protein, 9 aa, Homo Sapiens
PLILPPPHL

SEQ ID NO: 439837 - protein, 9 aa, Homo Sapiens
RHITDWQQG

SEQ ID NO: 439838 - protein, 9 aa, Homo Sapiens
RHDCGECHS

SEQ ID NO: 439839 - protein, 9 aa, Homo Sapiens
ERWSQWSLC

SEQ ID NO: 439840 - protein, 9 aa, Homo Sapiens
TLVVFVSIS

SEQ ID NO: 439841 - protein, 9 aa, Homo Sapiens
HFVCDVPAM

SEQ ID NO: 439842 - protein, 9 aa, Homo Sapiens
PKGNWRGQV

SEQ ID NO: 439843 - protein, 9 aa, Homo Sapiens
NSLLVLVVC

SEQ ID NO: 439844 - protein, 9 aa, Homo Sapiens
HRPSPKKFY

SEQ ID NO: 439845 - protein, 9 aa, Homo Sapiens
TPKQKFSEN

SEQ ID NO: 439846 - protein, 9 aa, Homo Sapiens
RKTSWSRVY

SEQ ID NO: 439847 - protein, 9 aa, Homo Sapiens
EHVCIRAYL

SEQ ID NO: 439848 - protein, 9 aa, Homo Sapiens
IIELTARYF

SEQ ID NO: 439849 - protein, 9 aa, Homo Sapiens
SDNYPNKED

SEQ ID NO: 439850 - protein, 9 aa, Homo Sapiens
GHTPIFCTS

SEQ ID NO: 439851 - protein, 9 aa, Homo Sapiens
RTYFSNFTS

SEQ ID NO: 439852 - protein, 9 aa, Homo Sapiens
LLFNTLNIH

SEQ ID NO: 439853 - protein, 9 aa, Homo Sapiens
YQENRRFVS

SEQ ID NO: 439854 - protein, 9 aa, Homo Sapiens
MEKYVREWK

SEQ ID NO: 439855 - protein, 9 aa, Homo Sapiens
HFPARKAVA

SEQ ID NO: 439856 - protein, 9 aa, Homo Sapiens
QRRLPANKS

SEQ ID NO: 439857 - protein, 9 aa, Homo Sapiens
SPNPLVLIE

SEQ ID NO: 439858 - protein, 9 aa, Homo Sapiens
SLNTKIRDI

SEQ ID NO: 439859 - protein, 9 aa, Homo Sapiens
HIINEGKLA

SEQ ID NO: 439860 - protein, 9 aa, Homo Sapiens
KKVIFCSRD

SEQ ID NO: 439861 - protein, 9 aa, Homo Sapiens
DSPCVKQGD

SEQ ID NO: 439862 - protein, 9 aa, Homo Sapiens
LEFPPNKLF

SEQ ID NO: 439863 - protein, 9 aa, Homo Sapiens
YTESQETQI

SEQ ID NO: 439864 - protein, 9 aa, Homo Sapiens
GQNLKELIE

SEQ ID NO: 439865 - protein, 9 aa, Homo Sapiens
YLNEPNRIK

SEQ ID NO: 439866 - protein, 9 aa, Homo Sapiens
VALGLLKTL

SEQ ID NO: 439867 - protein, 9 aa, Homo Sapiens
LNEKITLWK

SEQ ID NO: 439868 - protein, 9 aa, Homo Sapiens
NKLSNNVFV

SEQ ID NO: 439869 - protein, 9 aa, Homo Sapiens
HITCNPPEE

SEQ ID NO: 439870 - protein, 9 aa, Homo Sapiens
QAEPLQARV

SEQ ID NO: 439871 - protein, 9 aa, Homo Sapiens
CFLRIRQTM

SEQ ID NO: 439872 - protein, 9 aa, Homo Sapiens
YKILCKLSL

SEQ ID NO: 439873 - protein, 9 aa, Homo Sapiens
VFVGAAVAV

SEQ ID NO: 439874 - protein, 9 aa, Homo Sapiens
IDQINRPGW

SEQ ID NO: 439875 - protein, 9 aa, Homo Sapiens
TEDIMKQKH

SEQ ID NO: 439876 - protein, 9 aa, Homo Sapiens
VLKILGFKG

SEQ ID NO: 439877 - protein, 9 aa, Homo Sapiens
KYSSKFIKE

SEQ ID NO: 439878 - protein, 9 aa, Homo Sapiens
ITHLSITDI

SEQ ID NO: 439879 - protein, 9 aa, Homo Sapiens
FRVSSCLGG

SEQ ID NO: 439880 - protein, 9 aa, Homo Sapiens
GANPHCFKI

SEQ ID NO: 439881 - protein, 9 aa, Homo Sapiens
HIRQKHSHQ

SEQ ID NO: 439882 - protein, 9 aa, Homo Sapiens
GKPPRSATA

SEQ ID NO: 439883 - protein, 9 aa, Homo Sapiens
INVVKTCLQ

SEQ ID NO: 439884 - protein, 9 aa, Homo Sapiens
RQFVILRNK

SEQ ID NO: 439885 - protein, 9 aa, Homo Sapiens
EKECLQTCQ

SEQ ID NO: 439886 - protein, 9 aa, Homo Sapiens
MINTDKNQL

SEQ ID NO: 439887 - protein, 9 aa, Homo Sapiens
KVYVAAVCL

SEQ ID NO: 439888 - protein, 9 aa, Homo Sapiens
ELIKDTRFS

SEQ ID NO: 439889 - protein, 9 aa, Homo Sapiens
HGIQSVQGM

SEQ ID NO: 439890 - protein, 9 aa, Homo Sapiens
GRGPGPLQD

SEQ ID NO: 439891 - protein, 9 aa, Homo Sapiens
QSGDISADF

SEQ ID NO: 439892 - protein, 9 aa, Homo Sapiens
YLEIIYSMC

SEQ ID NO: 439893 - protein, 9 aa, Homo Sapiens
DYKKTKKPA

SEQ ID NO: 439894 - protein, 9 aa, Homo Sapiens
MIILPQPPK

SEQ ID NO: 439895 - protein, 9 aa, Homo Sapiens
RTEKHIEAL

SEQ ID NO: 439896 - protein, 9 aa, Homo Sapiens
YHTRIELLK

SEQ ID NO: 439897 - protein, 9 aa, Homo Sapiens
EKIVVASLL

SEQ ID NO: 439898 - protein, 9 aa, Homo Sapiens
ILDSQVQYS

SEQ ID NO: 439899 - protein, 9 aa, Homo Sapiens
GRYSLKVWA

SEQ ID NO: 439900 - protein, 9 aa, Homo Sapiens
PNGSLGDDF

SEQ ID NO: 439901 - protein, 9 aa, Homo Sapiens
TVTQSCLMS

SEQ ID NO: 439902 - protein, 9 aa, Homo Sapiens
PYFLFDILG

SEQ ID NO: 439903 - protein, 9 aa, Homo Sapiens
NVDGCKVHK

SEQ ID NO: 439904 - protein, 9 aa, Homo Sapiens
CPAEITGPS

SEQ ID NO: 439905 - protein, 9 aa, Homo Sapiens
PYACKECGQ

SEQ ID NO: 439906 - protein, 9 aa, Homo Sapiens
DERIHLGSS

SEQ ID NO: 439907 - protein, 9 aa, Homo Sapiens
HHHRHHHHH

SEQ ID NO: 439908 - protein, 9 aa, Homo Sapiens
EINRFTETR

SEQ ID NO: 439909 - protein, 9 aa, Homo Sapiens
KHPHVANPQ

SEQ ID NO: 439910 - protein, 9 aa, Homo Sapiens
SRNYFTLQL

SEQ ID NO: 439911 - protein, 9 aa, Homo Sapiens
PWTNHLLRP

SEQ ID NO: 439912 - protein, 9 aa, Homo Sapiens
PCLPPSKVI

SEQ ID NO: 439913 - protein, 9 aa, Homo Sapiens
SISQSVHIA

SEQ ID NO: 439914 - protein, 9 aa, Homo Sapiens
FHQKTALTL

SEQ ID NO: 439915 - protein, 9 aa, Homo Sapiens
CQFSGKLLQ

SEQ ID NO: 439916 - protein, 9 aa, Homo Sapiens
NIVYCGGVI

SEQ ID NO: 439917 - protein, 9 aa, Homo Sapiens
GVAFPLFMD

SEQ ID NO: 439918 - protein, 9 aa, Homo Sapiens
KQKFSENLE

SEQ ID NO: 439919 - protein, 9 aa, Homo Sapiens
DTRYVVQVR

SEQ ID NO: 439920 - protein, 9 aa, Homo Sapiens
STLNNSKCL

SEQ ID NO: 439921 - protein, 9 aa, Homo Sapiens
PDRNTFCHS

SEQ ID NO: 439922 - protein, 9 aa, Homo Sapiens
EEMINNKAA

SEQ ID NO: 439923 - protein, 9 aa, Homo Sapiens
MTQTDIVIL

SEQ ID NO: 439924 - protein, 9 aa, Homo Sapiens
EQLNLETTL

SEQ ID NO: 439925 - protein, 9 aa, Homo Sapiens
NASISSISC

SEQ ID NO: 439926 - protein, 9 aa, Homo Sapiens
LHFCSDISV

SEQ ID NO: 439927 - protein, 9 aa, Homo Sapiens
INKTRTRST

SEQ ID NO: 439928 - protein, 9 aa, Homo Sapiens
PHRIDIIED

SEQ ID NO: 439929 - protein, 9 aa, Homo Sapiens
PSAITVFDM

SEQ ID NO: 439930 - protein, 9 aa, Homo Sapiens
QALQYATSQ

SEQ ID NO: 439931 - protein, 9 aa, Homo Sapiens
LNQQRVQKP

SEQ ID NO: 439932 - protein, 9 aa, Homo Sapiens
KEIEGDGFL

SEQ ID NO: 439933 - protein, 9 aa, Homo Sapiens
QHDSNNQFV

SEQ ID NO: 439934 - protein, 9 aa, Homo Sapiens
YSPLFFLTS

SEQ ID NO: 439935 - protein, 9 aa, Homo Sapiens
ANFVELGDF

SEQ ID NO: 439936 - protein, 9 aa, Homo Sapiens
GSGKSKVGV

SEQ ID NO: 439937 - protein, 9 aa, Homo Sapiens
TRFRAALSN

SEQ ID NO: 439938 - protein, 9 aa, Homo Sapiens
CNTISVSKC

SEQ ID NO: 439939 - protein, 9 aa, Homo Sapiens
DALIYEIDF

SEQ ID NO: 439940 - protein, 9 aa, Homo Sapiens
GIGLVSLCE

SEQ ID NO: 439941 - protein, 9 aa, Homo Sapiens
DNFCWNLDG

SEQ ID NO: 439942 - protein, 9 aa, Homo Sapiens
AQIQKVYPG

SEQ ID NO: 439943 - protein, 9 aa, Homo Sapiens
DEEGDLVKP

SEQ ID NO: 439944 - protein, 9 aa, Homo Sapiens
VKMYYPSWP

SEQ ID NO: 439945 - protein, 9 aa, Homo Sapiens
QRVGVQQPH

SEQ ID NO: 439946 - protein, 9 aa, Homo Sapiens
IDLPIKIYR

SEQ ID NO: 439947 - protein, 9 aa, Homo Sapiens
EYCVEKWCC

SEQ ID NO: 439948 - protein, 9 aa, Homo Sapiens
SVNVALSLN

SEQ ID NO: 439949 - protein, 9 aa, Homo Sapiens
ILQTYMPYT

SEQ ID NO: 439950 - protein, 9 aa, Homo Sapiens
HMSGMGMNM

SEQ ID NO: 439951 - protein, 9 aa, Homo Sapiens
ILGSVQYTL

SEQ ID NO: 439952 - protein, 9 aa, Homo Sapiens
MKKCISANQ

SEQ ID NO: 439953 - protein, 9 aa, Homo Sapiens
KSTWYDGEF

SEQ ID NO: 439954 - protein, 9 aa, Homo Sapiens
LMFDHSEVY

SEQ ID NO: 439955 - protein, 9 aa, Homo Sapiens
TKLVGAAEA

SEQ ID NO: 439956 - protein, 9 aa, Homo Sapiens
RLGELHSEL

SEQ ID NO: 439957 - protein, 9 aa, Homo Sapiens
SFNRSANLI

SEQ ID NO: 439958 - protein, 9 aa, Homo Sapiens
PYKSILDNL

SEQ ID NO: 439959 - protein, 9 aa, Homo Sapiens
VFYDNYLNP

SEQ ID NO: 439960 - protein, 9 aa, Homo Sapiens
SVTKVTPDK

SEQ ID NO: 439961 - protein, 9 aa, Homo Sapiens
GVIDKQITN

SEQ ID NO: 439962 - protein, 9 aa, Homo Sapiens
QRLLREHQY

SEQ ID NO: 439963 - protein, 9 aa, Homo Sapiens
PGADGFTGP

SEQ ID NO: 439964 - protein, 9 aa, Homo Sapiens
DTINDYTCT

SEQ ID NO: 439965 - protein, 9 aa, Homo Sapiens
SYSSISSSA

SEQ ID NO: 439966 - protein, 9 aa, Homo Sapiens
ETLALSVAY

SEQ ID NO: 439967 - protein, 9 aa, Homo Sapiens
LSWIEKKWL

SEQ ID NO: 439968 - protein, 9 aa, Homo Sapiens
TAECNGQIT

SEQ ID NO: 439969 - protein, 9 aa, Homo Sapiens
AMRFKPDKD

SEQ ID NO: 439970 - protein, 9 aa, Homo Sapiens
KDDLSCPYH

SEQ ID NO: 439971 - protein, 9 aa, Homo Sapiens
FPFDWQNCL

SEQ ID NO: 439972 - protein, 9 aa, Homo Sapiens
ENTLKGLNS

SEQ ID NO: 439973 - protein, 9 aa, Homo Sapiens
SHQDMSSLG

SEQ ID NO: 439974 - protein, 9 aa, Homo Sapiens
KDEEFEKDN

SEQ ID NO: 439975 - protein, 9 aa, Homo Sapiens
NCTLLDEHQ

SEQ ID NO: 439976 - protein, 9 aa, Homo Sapiens
FKSDIPFIF

SEQ ID NO: 439977 - protein, 9 aa, Homo Sapiens
KKEICIEKL

SEQ ID NO: 439978 - protein, 9 aa, Homo Sapiens
LSSDAFHLD

SEQ ID NO: 439979 - protein, 9 aa, Homo Sapiens
AQKPQSHFT

SEQ ID NO: 439980 - protein, 9 aa, Homo Sapiens
FIDSTNLNT

SEQ ID NO: 439981 - protein, 9 aa, Homo Sapiens
YVREWKLEA

SEQ ID NO: 439982 - protein, 9 aa, Homo Sapiens
QTSLQGLLV

SEQ ID NO: 439983 - protein, 9 aa, Homo Sapiens
MILFDDERR

SEQ ID NO: 439984 - protein, 9 aa, Homo Sapiens
NRQPKDKNV

SEQ ID NO: 439985 - protein, 9 aa, Homo Sapiens
CLSHFPQHY

SEQ ID NO: 439986 - protein, 9 aa, Homo Sapiens
AFCYDIVLD

SEQ ID NO: 439987 - protein, 9 aa, Homo Sapiens
QIVVIKKIK

SEQ ID NO: 439988 - protein, 9 aa, Homo Sapiens
EAHLNSWNL

SEQ ID NO: 439989 - protein, 9 aa, Homo Sapiens
VDWIMEAVR

SEQ ID NO: 439990 - protein, 9 aa, Homo Sapiens
RGSFLTGKR

SEQ ID NO: 439991 - protein, 9 aa, Homo Sapiens
LEHEARHSF

SEQ ID NO: 439992 - protein, 9 aa, Homo Sapiens
HDQNSVACI

SEQ ID NO: 439993 - protein, 9 aa, Homo Sapiens
GGDVSPQKE

SEQ ID NO: 439994 - protein, 9 aa, Homo Sapiens
MRSFNRSAN

SEQ ID NO: 439995 - protein, 9 aa, Homo Sapiens
DCNKTSFFF

SEQ ID NO: 439996 - protein, 9 aa, Homo Sapiens
ERGETPPHS

SEQ ID NO: 439997 - protein, 9 aa, Homo Sapiens
PDAVCQLHM

SEQ ID NO: 439998 - protein, 9 aa, Homo Sapiens
NLSMNRIQQ

SEQ ID NO: 439999 - protein, 9 aa, Homo Sapiens
SKFIKEFLG

SEQ ID NO: 440000 - protein, 9 aa, Homo Sapiens
ELNNNMEMM

SEQ ID NO: 440001 - protein, 9 aa, Homo Sapiens
YQSDPNLAR

SEQ ID NO: 440002 - protein, 9 aa, Homo Sapiens
LLSDLGYLL

SEQ ID NO: 440003 - protein, 9 aa, Homo Sapiens
HVAEVAPKA

SEQ ID NO: 440004 - protein, 9 aa, Homo Sapiens
KPQILEEGP

SEQ ID NO: 440005 - protein, 9 aa, Homo Sapiens
YIIKVARQS

SEQ ID NO: 440006 - protein, 9 aa, Homo Sapiens
NQIMGRGEK

SEQ ID NO: 440007 - protein, 9 aa, Homo Sapiens
LDQLPSPTA

SEQ ID NO: 440008 - protein, 9 aa, Homo Sapiens
VNTHNLLTT

SEQ ID NO: 440009 - protein, 9 aa, Homo Sapiens
RVNELCVET

SEQ ID NO: 440010 - protein, 9 aa, Homo Sapiens
CFLTTQNIH

SEQ ID NO: 440011 - protein, 9 aa, Homo Sapiens
KTMIYFVGC

SEQ ID NO: 440012 - protein, 9 aa, Homo Sapiens
LKKLAEFLS

SEQ ID NO: 440013 - protein, 9 aa, Homo Sapiens
CIPEFIRKQ

SEQ ID NO: 440014 - protein, 9 aa, Homo Sapiens
VTTGVIRHV

SEQ ID NO: 440015 - protein, 9 aa, Homo Sapiens
ADLIGGKWI

SEQ ID NO: 440016 - protein, 9 aa, Homo Sapiens
LHGTLTKLN

SEQ ID NO: 440017 - protein, 9 aa, Homo Sapiens
CIQRTIQQK

SEQ ID NO: 440018 - protein, 9 aa, Homo Sapiens
WSLGFQLCC

SEQ ID NO: 440019 - protein, 9 aa, Homo Sapiens
NWIKQYETL

SEQ ID NO: 440020 - protein, 9 aa, Homo Sapiens
PIYFFLQHL

SEQ ID NO: 440021 - protein, 9 aa, Homo Sapiens
DNAIREHVC

SEQ ID NO: 440022 - protein, 9 aa, Homo Sapiens
YPEVTPHRT

SEQ ID NO: 440023 - protein, 9 aa, Homo Sapiens
AVADSWMDE

SEQ ID NO: 440024 - protein, 9 aa, Homo Sapiens
VSLQVDGKK

SEQ ID NO: 440025 - protein, 9 aa, Homo Sapiens
IIATKALHA

SEQ ID NO: 440026 - protein, 9 aa, Homo Sapiens
FSCSPTLQI

SEQ ID NO: 440027 - protein, 9 aa, Homo Sapiens
PLPSQRSRS

SEQ ID NO: 440028 - protein, 9 aa, Homo Sapiens
DYHNPLMEM

SEQ ID NO: 440029 - protein, 9 aa, Homo Sapiens
SPPRNTTMA

SEQ ID NO: 440030 - protein, 9 aa, Homo Sapiens
LHSMIQIIF

SEQ ID NO: 440031 - protein, 9 aa, Homo Sapiens
TLQMEFLQN

SEQ ID NO: 440032 - protein, 9 aa, Homo Sapiens
CGDLRDNFC

SEQ ID NO: 440033 - protein, 9 aa, Homo Sapiens
AKGRTQLKE

SEQ ID NO: 440034 - protein, 9 aa, Homo Sapiens
ECNSTDDCI

SEQ ID NO: 440035 - protein, 9 aa, Homo Sapiens
ICLTLKPEE

SEQ ID NO: 440036 - protein, 9 aa, Homo Sapiens
CGENINHSC

SEQ ID NO: 440037 - protein, 9 aa, Homo Sapiens
KFINIAAHC

SEQ ID NO: 440038 - protein, 9 aa, Homo Sapiens
LAKENKLLE

SEQ ID NO: 440039 - protein, 9 aa, Homo Sapiens
NLIKHKTIH

SEQ ID NO: 440040 - protein, 9 aa, Homo Sapiens
ERQSDNYPN

SEQ ID NO: 440041 - protein, 9 aa, Homo Sapiens
IKLFTGDVF

SEQ ID NO: 440042 - protein, 9 aa, Homo Sapiens
SVYYACILA

SEQ ID NO: 440043 - protein, 9 aa, Homo Sapiens
RNEYFFNRN

SEQ ID NO: 440044 - protein, 9 aa, Homo Sapiens
PVSDKNLSL

SEQ ID NO: 440045 - protein, 9 aa, Homo Sapiens
LYAPPKESR

SEQ ID NO: 440046 - protein, 9 aa, Homo Sapiens
KFRQLWGSR

SEQ ID NO: 440047 - protein, 9 aa, Homo Sapiens
PGMQCIISG

SEQ ID NO: 440048 - protein, 9 aa, Homo Sapiens
NPDYNLFNN

SEQ ID NO: 440049 - protein, 9 aa, Homo Sapiens
TSHLIRHKI

SEQ ID NO: 440050 - protein, 9 aa, Homo Sapiens
DRVDGGESV

SEQ ID NO: 440051 - protein, 9 aa, Homo Sapiens
DALDLGKYN

SEQ ID NO: 440052 - protein, 9 aa, Homo Sapiens
QNPNTFQPW

SEQ ID NO: 440053 - protein, 9 aa, Homo Sapiens
NLQIIATRG

SEQ ID NO: 440054 - protein, 9 aa, Homo Sapiens
CKLLDHDKE

SEQ ID NO: 440055 - protein, 9 aa, Homo Sapiens
VVPGVVSKV

SEQ ID NO: 440056 - protein, 9 aa, Homo Sapiens
GIHLIKVFA

SEQ ID NO: 440057 - protein, 9 aa, Homo Sapiens
PSYSAHEGL

SEQ ID NO: 440058 - protein, 9 aa, Homo Sapiens
PSLEDLFNL

SEQ ID NO: 440059 - protein, 9 aa, Homo Sapiens
QLFITLFSV

SEQ ID NO: 440060 - protein, 9 aa, Homo Sapiens
ENNYLYLYY

SEQ ID NO: 440061 - protein, 9 aa, Homo Sapiens
QPLKDQVNL

SEQ ID NO: 440062 - protein, 9 aa, Homo Sapiens
DVDNDGCHP

SEQ ID NO: 440063 - protein, 9 aa, Homo Sapiens
SSEELLLIN

SEQ ID NO: 440064 - protein, 9 aa, Homo Sapiens
PNQLVLIFA

SEQ ID NO: 440065 - protein, 9 aa, Homo Sapiens
SLWDIAGAR

SEQ ID NO: 440066 - protein, 9 aa, Homo Sapiens
PFTTFTPRQ

SEQ ID NO: 440067 - protein, 9 aa, Homo Sapiens
RECTIMCVP

SEQ ID NO: 440068 - protein, 9 aa, Homo Sapiens
LWAKTDSSL

SEQ ID NO: 440069 - protein, 9 aa, Homo Sapiens
PNSAGEYGK

SEQ ID NO: 440070 - protein, 9 aa, Homo Sapiens
YLASLPKID

SEQ ID NO: 440071 - protein, 9 aa, Homo Sapiens
GFANNPLQA

SEQ ID NO: 440072 - protein, 9 aa, Homo Sapiens
WKRVETALE

SEQ ID NO: 440073 - protein, 9 aa, Homo Sapiens
PGIDTPFSY

SEQ ID NO: 440074 - protein, 9 aa, Homo Sapiens
LGSVVEAIK

SEQ ID NO: 440075 - protein, 9 aa, Homo Sapiens
DGDFHRGYH

SEQ ID NO: 440076 - protein, 9 aa, Homo Sapiens
ALKEEEASK

SEQ ID NO: 440077 - protein, 9 aa, Homo Sapiens
SPAASALIQ

SEQ ID NO: 440078 - protein, 9 aa, Homo Sapiens
LYLIIMIVG

SEQ ID NO: 440079 - protein, 9 aa, Homo Sapiens
DSDLVVLSG

SEQ ID NO: 440080 - protein, 9 aa, Homo Sapiens
LPVLAASQP

SEQ ID NO: 440081 - protein, 9 aa, Homo Sapiens
RGERHLPQG

SEQ ID NO: 440082 - protein, 9 aa, Homo Sapiens
TVLDIFWVG

SEQ ID NO: 440083 - protein, 9 aa, Homo Sapiens
PKDIKFHLY

SEQ ID NO: 440084 - protein, 9 aa, Homo Sapiens
GSPTSYRCA

SEQ ID NO: 440085 - protein, 9 aa, Homo Sapiens
SDQILAINH

SEQ ID NO: 440086 - protein, 9 aa, Homo Sapiens
DPGVIKVIT

SEQ ID NO: 440087 - protein, 9 aa, Homo Sapiens
VGLEALSKS

SEQ ID NO: 440088 - protein, 9 aa, Homo Sapiens
PFMVNATWD

SEQ ID NO: 440089 - protein, 9 aa, Homo Sapiens
PTKNFSLPV

SEQ ID NO: 440090 - protein, 9 aa, Homo Sapiens
VSILIVIPS

SEQ ID NO: 440091 - protein, 9 aa, Homo Sapiens
EQKVAQILV

SEQ ID NO: 440092 - protein, 9 aa, Homo Sapiens
KQQCHQADK

SEQ ID NO: 440093 - protein, 9 aa, Homo Sapiens
RFYLGLEDV

SEQ ID NO: 440094 - protein, 9 aa, Homo Sapiens
ENPGDSEES

SEQ ID NO: 440095 - protein, 9 aa, Homo Sapiens
SPPQKIPSV

SEQ ID NO: 440096 - protein, 9 aa, Homo Sapiens
EDSTDLFKS

SEQ ID NO: 440097 - protein, 9 aa, Homo Sapiens
PCPHLGQIM

SEQ ID NO: 440098 - protein, 9 aa, Homo Sapiens
RLSLCLLLS

SEQ ID NO: 440099 - protein, 9 aa, Homo Sapiens
KSARYLQTQ

SEQ ID NO: 440100 - protein, 9 aa, Homo Sapiens
LRWGDIIGV

SEQ ID NO: 440101 - protein, 9 aa, Homo Sapiens
LYQHANVVL

SEQ ID NO: 440102 - protein, 9 aa, Homo Sapiens
CWWEKPYER

SEQ ID NO: 440103 - protein, 9 aa, Homo Sapiens
PVEQTCSWQ

SEQ ID NO: 440104 - protein, 9 aa, Homo Sapiens
VGDGLSGVC

SEQ ID NO: 440105 - protein, 9 aa, Homo Sapiens
EQNLLLIQN

SEQ ID NO: 440106 - protein, 9 aa, Homo Sapiens
VFHPQSHFL

SEQ ID NO: 440107 - protein, 9 aa, Homo Sapiens
QKFSENLES

SEQ ID NO: 440108 - protein, 9 aa, Homo Sapiens
EDLEGHQTL

SEQ ID NO: 440109 - protein, 9 aa, Homo Sapiens
TTEMLMKMH

SEQ ID NO: 440110 - protein, 9 aa, Homo Sapiens
WSSGFISEL

SEQ ID NO: 440111 - protein, 9 aa, Homo Sapiens
KMSKHALDF

SEQ ID NO: 440112 - protein, 9 aa, Homo Sapiens
MSSSNVDVF

SEQ ID NO: 440113 - protein, 9 aa, Homo Sapiens
LQDRSLFEK

SEQ ID NO: 440114 - protein, 9 aa, Homo Sapiens
DTFYPYLDI

SEQ ID NO: 440115 - protein, 9 aa, Homo Sapiens
LCKETGIYL

SEQ ID NO: 440116 - protein, 9 aa, Homo Sapiens
LECDPKCIE

SEQ ID NO: 440117 - protein, 9 aa, Homo Sapiens
ITEVVKGRG

SEQ ID NO: 440118 - protein, 9 aa, Homo Sapiens
SYFKLMFDH

SEQ ID NO: 440119 - protein, 9 aa, Homo Sapiens
LRNVIYIHE

SEQ ID NO: 440120 - protein, 9 aa, Homo Sapiens
ALIWAQQKE

SEQ ID NO: 440121 - protein, 9 aa, Homo Sapiens
CTSTSSGGI

SEQ ID NO: 440122 - protein, 9 aa, Homo Sapiens
DDESHKPKG

SEQ ID NO: 440123 - protein, 9 aa, Homo Sapiens
FSEDGFLLA

SEQ ID NO: 440124 - protein, 9 aa, Homo Sapiens
SYFNLSSVN

SEQ ID NO: 440125 - protein, 9 aa, Homo Sapiens
PSFFNRFSV

SEQ ID NO: 440126 - protein, 9 aa, Homo Sapiens
DKEYADIIR

SEQ ID NO: 440127 - protein, 9 aa, Homo Sapiens
SYIYQPGGL

SEQ ID NO: 440128 - protein, 9 aa, Homo Sapiens
FTKQSIYLA

SEQ ID NO: 440129 - protein, 9 aa, Homo Sapiens
CVVLLFLWR

SEQ ID NO: 440130 - protein, 9 aa, Homo Sapiens
LVLVVCYLW

SEQ ID NO: 440131 - protein, 9 aa, Homo Sapiens
QVNEWSLNI

SEQ ID NO: 440132 - protein, 9 aa, Homo Sapiens
HEDKSPMKN

SEQ ID NO: 440133 - protein, 9 aa, Homo Sapiens
NPARTVNEN

SEQ ID NO: 440134 - protein, 9 aa, Homo Sapiens
VEDGKTLPN

SEQ ID NO: 440135 - protein, 9 aa, Homo Sapiens
KIIHSGDKP

SEQ ID NO: 440136 - protein, 9 aa, Homo Sapiens
LATGNGLSY

SEQ ID NO: 440137 - protein, 9 aa, Homo Sapiens
GVSWDITEA

SEQ ID NO: 440138 - protein, 9 aa, Homo Sapiens
NKCGNCSLT

SEQ ID NO: 440139 - protein, 9 aa, Homo Sapiens
CDKVMQLLL

SEQ ID NO: 440140 - protein, 9 aa, Homo Sapiens
LQSFKVMDY

SEQ ID NO: 440141 - protein, 9 aa, Homo Sapiens
TRGYSARPW

SEQ ID NO: 440142 - protein, 9 aa, Homo Sapiens
NIIQHQKIH

SEQ ID NO: 440143 - protein, 9 aa, Homo Sapiens
RNDLQKVLH

SEQ ID NO: 440144 - protein, 9 aa, Homo Sapiens
RVNNFLMFF

SEQ ID NO: 440145 - protein, 9 aa, Homo Sapiens
HLLYGDIIQ

SEQ ID NO: 440146 - protein, 9 aa, Homo Sapiens
GNSLIEEQS

SEQ ID NO: 440147 - protein, 9 aa, Homo Sapiens
PVVVKYLPE

SEQ ID NO: 440148 - protein, 9 aa, Homo Sapiens
NELLKRKLE

SEQ ID NO: 440149 - protein, 9 aa, Homo Sapiens
SFSHTCLTQ

SEQ ID NO: 440150 - protein, 9 aa, Homo Sapiens
IYILCKNYY

SEQ ID NO: 440151 - protein, 9 aa, Homo Sapiens
KMDDNGNSE

SEQ ID NO: 440152 - protein, 9 aa, Homo Sapiens
HKIVICAVS

SEQ ID NO: 440153 - protein, 9 aa, Homo Sapiens
EINTFHVIS

SEQ ID NO: 440154 - protein, 9 aa, Homo Sapiens
IIYSMCKKV

SEQ ID NO: 440155 - protein, 9 aa, Homo Sapiens
SGSARPSTS

SEQ ID NO: 440156 - protein, 9 aa, Homo Sapiens
ENPVLLLIT

SEQ ID NO: 440157 - protein, 9 aa, Homo Sapiens
GGMQQGSYP

SEQ ID NO: 440158 - protein, 9 aa, Homo Sapiens
AEAATAVVE

SEQ ID NO: 440159 - protein, 9 aa, Homo Sapiens
NKTKVEDAI

SEQ ID NO: 440160 - protein, 9 aa, Homo Sapiens
DRISCLLLI

SEQ ID NO: 440161 - protein, 9 aa, Homo Sapiens
IGLFDKNYG

SEQ ID NO: 440162 - protein, 9 aa, Homo Sapiens
ISVLEPPQK

SEQ ID NO: 440163 - protein, 9 aa, Homo Sapiens
SSPPYSVHS

SEQ ID NO: 440164 - protein, 9 aa, Homo Sapiens
LHMFRFPMD

SEQ ID NO: 440165 - protein, 9 aa, Homo Sapiens
GTNHKITSI

SEQ ID NO: 440166 - protein, 9 aa, Homo Sapiens
HPAGYFHFT

SEQ ID NO: 440167 - protein, 9 aa, Homo Sapiens
FDSPCPKAR

SEQ ID NO: 440168 - protein, 9 aa, Homo Sapiens
CMPTLQFFK

SEQ ID NO: 440169 - protein, 9 aa, Homo Sapiens
KAISILSKL

SEQ ID NO: 440170 - protein, 9 aa, Homo Sapiens
YFSLSTCPD

SEQ ID NO: 440171 - protein, 9 aa, Homo Sapiens
TPDSGLAKE

SEQ ID NO: 440172 - protein, 9 aa, Homo Sapiens
SQVLARIIG

SEQ ID NO: 440173 - protein, 9 aa, Homo Sapiens
IPQVPLPPV

SEQ ID NO: 440174 - protein, 9 aa, Homo Sapiens
DQNDNKPKF

SEQ ID NO: 440175 - protein, 9 aa, Homo Sapiens
DQFNRILAN

SEQ ID NO: 440176 - protein, 9 aa, Homo Sapiens
DMVGELGTA

SEQ ID NO: 440177 - protein, 9 aa, Homo Sapiens
YSGKSFKKG

SEQ ID NO: 440178 - protein, 9 aa, Homo Sapiens
DIFWVGARE

SEQ ID NO: 440179 - protein, 9 aa, Homo Sapiens
CTIIMSFVK

SEQ ID NO: 440180 - protein, 9 aa, Homo Sapiens
PPALECRIC

SEQ ID NO: 440181 - protein, 9 aa, Homo Sapiens
PSSELLDLS

SEQ ID NO: 440182 - protein, 9 aa, Homo Sapiens
DWPPKSEIQ

SEQ ID NO: 440183 - protein, 9 aa, Homo Sapiens
IIVDKFQNT

SEQ ID NO: 440184 - protein, 9 aa, Homo Sapiens
EAELERPQK

SEQ ID NO: 440185 - protein, 9 aa, Homo Sapiens
VKNDISGGV

SEQ ID NO: 440186 - protein, 9 aa, Homo Sapiens
THTVKFLTA

SEQ ID NO: 440187 - protein, 9 aa, Homo Sapiens
LRQGEVLPL

SEQ ID NO: 440188 - protein, 9 aa, Homo Sapiens
RWSSTLVQH

SEQ ID NO: 440189 - protein, 9 aa, Homo Sapiens
LPSFPHDEV

SEQ ID NO: 440190 - protein, 9 aa, Homo Sapiens
EKLKIQAES

SEQ ID NO: 440191 - protein, 9 aa, Homo Sapiens
QDESSYKEI

SEQ ID NO: 440192 - protein, 9 aa, Homo Sapiens
KHRICVCVR

SEQ ID NO: 440193 - protein, 9 aa, Homo Sapiens
IFNKIKFGE

SEQ ID NO: 440194 - protein, 9 aa, Homo Sapiens
PDTSTGFSG

SEQ ID NO: 440195 - protein, 9 aa, Homo Sapiens
ETLCRMEQA

SEQ ID NO: 440196 - protein, 9 aa, Homo Sapiens
LVVLSGTDS

SEQ ID NO: 440197 - protein, 9 aa, Homo Sapiens
KLECAFGYK

SEQ ID NO: 440198 - protein, 9 aa, Homo Sapiens
WSLQLNGVA

SEQ ID NO: 440199 - protein, 9 aa, Homo Sapiens
VGDPKIGAT

SEQ ID NO: 440200 - protein, 9 aa, Homo Sapiens
ANMEELMEV

SEQ ID NO: 440201 - protein, 9 aa, Homo Sapiens
PAPVVSWYL

SEQ ID NO: 440202 - protein, 9 aa, Homo Sapiens
NYYLRNWRL

SEQ ID NO: 440203 - protein, 9 aa, Homo Sapiens
APPRKLMAM

SEQ ID NO: 440204 - protein, 9 aa, Homo Sapiens
LSPAEYFVL

SEQ ID NO: 440205 - protein, 9 aa, Homo Sapiens
MPKPAKTAN

SEQ ID NO: 440206 - protein, 9 aa, Homo Sapiens
HVPPETLGK

SEQ ID NO: 440207 - protein, 9 aa, Homo Sapiens
PFILALSGN

SEQ ID NO: 440208 - protein, 9 aa, Homo Sapiens
NEIVLRAVG

SEQ ID NO: 440209 - protein, 9 aa, Homo Sapiens
MYYEKSYAL

SEQ ID NO: 440210 - protein, 9 aa, Homo Sapiens
NSLLPQLLQ

SEQ ID NO: 440211 - protein, 9 aa, Homo Sapiens
PLVEESLLN

SEQ ID NO: 440212 - protein, 9 aa, Homo Sapiens
CSGENLDLS

SEQ ID NO: 440213 - protein, 9 aa, Homo Sapiens
QQHPTEPQA

SEQ ID NO: 440214 - protein, 9 aa, Homo Sapiens
GMRDQRLNL

SEQ ID NO: 440215 - protein, 9 aa, Homo Sapiens
AEGDTWCEQ

SEQ ID NO: 440216 - protein, 9 aa, Homo Sapiens
AILSVFRMF

SEQ ID NO: 440217 - protein, 9 aa, Homo Sapiens
VLSNTLNLN

SEQ ID NO: 440218 - protein, 9 aa, Homo Sapiens
CHQTGLDRN

SEQ ID NO: 440219 - protein, 9 aa, Homo Sapiens
GFVFDTSCD

SEQ ID NO: 440220 - protein, 9 aa, Homo Sapiens
PEDCSDSSE

SEQ ID NO: 440221 - protein, 9 aa, Homo Sapiens
TLLHDHELL

SEQ ID NO: 440222 - protein, 9 aa, Homo Sapiens
LCKRFEEVT

SEQ ID NO: 440223 - protein, 9 aa, Homo Sapiens
SADSKKDAT

SEQ ID NO: 440224 - protein, 9 aa, Homo Sapiens
QMYKNLDIL

SEQ ID NO: 440225 - protein, 9 aa, Homo Sapiens
VCVRLPRGL

SEQ ID NO: 440226 - protein, 9 aa, Homo Sapiens
IASGLEHSC

SEQ ID NO: 440227 - protein, 9 aa, Homo Sapiens
SSVCSTQVS

SEQ ID NO: 440228 - protein, 9 aa, Homo Sapiens
IKEKEQIYY

SEQ ID NO: 440229 - protein, 9 aa, Homo Sapiens
FIIILVFIR

SEQ ID NO: 440230 - protein, 9 aa, Homo Sapiens
YRVYKEVNN

SEQ ID NO: 440231 - protein, 9 aa, Homo Sapiens
EVDNVFTIR

SEQ ID NO: 440232 - protein, 9 aa, Homo Sapiens
RRLSGNKYV

SEQ ID NO: 440233 - protein, 9 aa, Homo Sapiens
LYFGLRFMA

SEQ ID NO: 440234 - protein, 9 aa, Homo Sapiens
IDSGENKPG

SEQ ID NO: 440235 - protein, 9 aa, Homo Sapiens
FSVGVALSR

SEQ ID NO: 440236 - protein, 9 aa, Homo Sapiens
RSPPQPEFR

SEQ ID NO: 440237 - protein, 9 aa, Homo Sapiens
PIALGSHWL

SEQ ID NO: 440238 - protein, 9 aa, Homo Sapiens
EAVRRRQNS

SEQ ID NO: 440239 - protein, 9 aa, Homo Sapiens
CYGNKDLTF

SEQ ID NO: 440240 - protein, 9 aa, Homo Sapiens
YLPTVTVTQ

SEQ ID NO: 440241 - protein, 9 aa, Homo Sapiens
LIAIFRGPV

SEQ ID NO: 440242 - protein, 9 aa, Homo Sapiens
QACAHVENT

SEQ ID NO: 440243 - protein, 9 aa, Homo Sapiens
VDYMKKIFD

SEQ ID NO: 440244 - protein, 9 aa, Homo Sapiens
WDRADIYPL

SEQ ID NO: 440245 - protein, 9 aa, Homo Sapiens
DDIFNKIKF

SEQ ID NO: 440246 - protein, 9 aa, Homo Sapiens
ESECLIHKC

SEQ ID NO: 440247 - protein, 9 aa, Homo Sapiens
KNTISDKEA

SEQ ID NO: 440248 - protein, 9 aa, Homo Sapiens
LLYGSALFM

SEQ ID NO: 440249 - protein, 9 aa, Homo Sapiens
LSIADACFV

SEQ ID NO: 440250 - protein, 9 aa, Homo Sapiens
MGSKRGIYS

SEQ ID NO: 440251 - protein, 9 aa, Homo Sapiens
SHTEAAVRF

SEQ ID NO: 440252 - protein, 9 aa, Homo Sapiens
NKKRKFATK

SEQ ID NO: 440253 - protein, 9 aa, Homo Sapiens
LDILSQLNE

SEQ ID NO: 440254 - protein, 9 aa, Homo Sapiens
LDKSCKYLE

SEQ ID NO: 440255 - protein, 9 aa, Homo Sapiens
VSKKVCYHL

SEQ ID NO: 440256 - protein, 9 aa, Homo Sapiens
RFRIAAKYQ

SEQ ID NO: 440257 - protein, 9 aa, Homo Sapiens
AKEIQRSQN

SEQ ID NO: 440258 - protein, 9 aa, Homo Sapiens
KDWLISRQL

SEQ ID NO: 440259 - protein, 9 aa, Homo Sapiens
HANCIVHQD

SEQ ID NO: 440260 - protein, 9 aa, Homo Sapiens
GGDPMCKII

SEQ ID NO: 440261 - protein, 9 aa, Homo Sapiens
EYEVLQTLH

SEQ ID NO: 440262 - protein, 9 aa, Homo Sapiens
TTYLYDRLR

SEQ ID NO: 440263 - protein, 9 aa, Homo Sapiens
HDRFDSYSI

SEQ ID NO: 440264 - protein, 9 aa, Homo Sapiens
LVYVEGGAE

SEQ ID NO: 440265 - protein, 9 aa, Homo Sapiens
SRHQILHTG

SEQ ID NO: 440266 - protein, 9 aa, Homo Sapiens
GPTNNLFID

SEQ ID NO: 440267 - protein, 9 aa, Homo Sapiens
LAAAYNNFQ

SEQ ID NO: 440268 - protein, 9 aa, Homo Sapiens
AVSMAFSTY

SEQ ID NO: 440269 - protein, 9 aa, Homo Sapiens
LVVFNNVTN

SEQ ID NO: 440270 - protein, 9 aa, Homo Sapiens
RSNNWAKVG

SEQ ID NO: 440271 - protein, 9 aa, Homo Sapiens
ICCVLMLLF

SEQ ID NO: 440272 - protein, 9 aa, Homo Sapiens
AKQVHSENP

SEQ ID NO: 440273 - protein, 9 aa, Homo Sapiens
ITIFCLDTL

SEQ ID NO: 440274 - protein, 9 aa, Homo Sapiens
LEDTNDDPE

SEQ ID NO: 440275 - protein, 9 aa, Homo Sapiens
KYLGTGLSS

SEQ ID NO: 440276 - protein, 9 aa, Homo Sapiens
NLAEQACAH

SEQ ID NO: 440277 - protein, 9 aa, Homo Sapiens
DAAIFHLLK

SEQ ID NO: 440278 - protein, 9 aa, Homo Sapiens
TLSNIMNYF

SEQ ID NO: 440279 - protein, 9 aa, Homo Sapiens
GSSNVKFDL

SEQ ID NO: 440280 - protein, 9 aa, Homo Sapiens
WLRWVPLPD

SEQ ID NO: 440281 - protein, 9 aa, Homo Sapiens
AGCLSDPGV

SEQ ID NO: 440282 - protein, 9 aa, Homo Sapiens
RTHPEKKYC

SEQ ID NO: 440283 - protein, 9 aa, Homo Sapiens
RLGIKRKLT

SEQ ID NO: 440284 - protein, 9 aa, Homo Sapiens
QARYFSDSS

SEQ ID NO: 440285 - protein, 9 aa, Homo Sapiens
VRRRQNSAR

SEQ ID NO: 440286 - protein, 9 aa, Homo Sapiens
KHLLPQSST

SEQ ID NO: 440287 - protein, 9 aa, Homo Sapiens
SRPHRCELA

SEQ ID NO: 440288 - protein, 9 aa, Homo Sapiens
VVDEDLRSE

SEQ ID NO: 440289 - protein, 9 aa, Homo Sapiens
PLQKQNYLA

SEQ ID NO: 440290 - protein, 9 aa, Homo Sapiens
NLQSQSSVD

SEQ ID NO: 440291 - protein, 9 aa, Homo Sapiens
VREWKLEAG

SEQ ID NO: 440292 - protein, 9 aa, Homo Sapiens
IADYVRNIQ

SEQ ID NO: 440293 - protein, 9 aa, Homo Sapiens
LLIFRSQTY

SEQ ID NO: 440294 - protein, 9 aa, Homo Sapiens
AAKKRKCEE

SEQ ID NO: 440295 - protein, 9 aa, Homo Sapiens
APSPVTNVN

SEQ ID NO: 440296 - protein, 9 aa, Homo Sapiens
FYFVLTVGK

SEQ ID NO: 440297 - protein, 9 aa, Homo Sapiens
LCHWLAMSL

SEQ ID NO: 440298 - protein, 9 aa, Homo Sapiens
EEYQSRYQS

SEQ ID NO: 440299 - protein, 9 aa, Homo Sapiens
KGMRDQRLN

SEQ ID NO: 440300 - protein, 9 aa, Homo Sapiens
EAVNVICDH

SEQ ID NO: 440301 - protein, 9 aa, Homo Sapiens
QDRALRWFP

SEQ ID NO: 440302 - protein, 9 aa, Homo Sapiens
PAEQAQGEQ

SEQ ID NO: 440303 - protein, 9 aa, Homo Sapiens
TTGQNVEKA

SEQ ID NO: 440304 - protein, 9 aa, Homo Sapiens
VKAVQNVGN

SEQ ID NO: 440305 - protein, 9 aa, Homo Sapiens
PECGQCIIN

SEQ ID NO: 440306 - protein, 9 aa, Homo Sapiens
KYGTALNLL

SEQ ID NO: 440307 - protein, 9 aa, Homo Sapiens
LIQHEIIHT

SEQ ID NO: 440308 - protein, 9 aa, Homo Sapiens
QDAVGLKNI

SEQ ID NO: 440309 - protein, 9 aa, Homo Sapiens
TWNTLSAAQ

SEQ ID NO: 440310 - protein, 9 aa, Homo Sapiens
LHQEAWEQH

SEQ ID NO: 440311 - protein, 9 aa, Homo Sapiens
RAKEAEESY

SEQ ID NO: 440312 - protein, 9 aa, Homo Sapiens
VDGERAVLQ

SEQ ID NO: 440313 - protein, 9 aa, Homo Sapiens
YKSKYGIDN

SEQ ID NO: 440314 - protein, 9 aa, Homo Sapiens
VATVSASTS

SEQ ID NO: 440315 - protein, 9 aa, Homo Sapiens
LEKGQHLGY

SEQ ID NO: 440316 - protein, 9 aa, Homo Sapiens
LKESDQILA

SEQ ID NO: 440317 - protein, 9 aa, Homo Sapiens
YGGSANSFQ

SEQ ID NO: 440318 - protein, 9 aa, Homo Sapiens
TTPEPDIYH

SEQ ID NO: 440319 - protein, 9 aa, Homo Sapiens
TKGIFKALP

SEQ ID NO: 440320 - protein, 9 aa, Homo Sapiens
RRHTIQTAE

SEQ ID NO: 440321 - protein, 9 aa, Homo Sapiens
ELAQIIAAL

SEQ ID NO: 440322 - protein, 9 aa, Homo Sapiens
DPVEQTCSW

SEQ ID NO: 440323 - protein, 9 aa, Homo Sapiens
YFHIGWVTL

SEQ ID NO: 440324 - protein, 9 aa, Homo Sapiens
PDFLIDGGN

SEQ ID NO: 440325 - protein, 9 aa, Homo Sapiens
EDFEKELET

SEQ ID NO: 440326 - protein, 9 aa, Homo Sapiens
KRFNEPGSQ

SEQ ID NO: 440327 - protein, 9 aa, Homo Sapiens
GLFRIVYIT

SEQ ID NO: 440328 - protein, 9 aa, Homo Sapiens
EDSYMLVMH

SEQ ID NO: 440329 - protein, 9 aa, Homo Sapiens
PMKRPAVWE

SEQ ID NO: 440330 - protein, 9 aa, Homo Sapiens
TISYQESFR

SEQ ID NO: 440331 - protein, 9 aa, Homo Sapiens
LDREKKDAY

SEQ ID NO: 440332 - protein, 9 aa, Homo Sapiens
EWAFHSAPG

SEQ ID NO: 440333 - protein, 9 aa, Homo Sapiens
RHYHTGEKP

SEQ ID NO: 440334 - protein, 9 aa, Homo Sapiens
HIPLIIQLF

SEQ ID NO: 440335 - protein, 9 aa, Homo Sapiens
KIAFYRLIS

SEQ ID NO: 440336 - protein, 9 aa, Homo Sapiens
EVCDRHHSL

SEQ ID NO: 440337 - protein, 9 aa, Homo Sapiens
LFQVNDVNQ

SEQ ID NO: 440338 - protein, 9 aa, Homo Sapiens
KKKQSIGLI

SEQ ID NO: 440339 - protein, 9 aa, Homo Sapiens
MCLSPTYEL

SEQ ID NO: 440340 - protein, 9 aa, Homo Sapiens
YRTLFASSA

SEQ ID NO: 440341 - protein, 9 aa, Homo Sapiens
KQTVQNNKR

SEQ ID NO: 440342 - protein, 9 aa, Homo Sapiens
KIHKQTHTG

SEQ ID NO: 440343 - protein, 9 aa, Homo Sapiens
LPFIIILVF

SEQ ID NO: 440344 - protein, 9 aa, Homo Sapiens
LYLWPAYNL

SEQ ID NO: 440345 - protein, 9 aa, Homo Sapiens
SVATVSAST

SEQ ID NO: 440346 - protein, 9 aa, Homo Sapiens
ALGSHWLAY

SEQ ID NO: 440347 - protein, 9 aa, Homo Sapiens
QNLRIEDNM

SEQ ID NO: 440348 - protein, 9 aa, Homo Sapiens
KGKSSHWVD

SEQ ID NO: 440349 - protein, 9 aa, Homo Sapiens
PCSSSPCCG

SEQ ID NO: 440350 - protein, 9 aa, Homo Sapiens
VELKQQYND

SEQ ID NO: 440351 - protein, 9 aa, Homo Sapiens
AKFKDCYQF

SEQ ID NO: 440352 - protein, 9 aa, Homo Sapiens
DQAAEGIHL

SEQ ID NO: 440353 - protein, 9 aa, Homo Sapiens
LWMFSFKAP

SEQ ID NO: 440354 - protein, 9 aa, Homo Sapiens
NIHSSPFTA

SEQ ID NO: 440355 - protein, 9 aa, Homo Sapiens
GEEDNESPS

SEQ ID NO: 440356 - protein, 9 aa, Homo Sapiens
PAQSRPDDD

SEQ ID NO: 440357 - protein, 9 aa, Homo Sapiens
EVRPKVLFL

SEQ ID NO: 440358 - protein, 9 aa, Homo Sapiens
ENIPFSPSP

SEQ ID NO: 440359 - protein, 9 aa, Homo Sapiens
SAKSLSLYI

SEQ ID NO: 440360 - protein, 9 aa, Homo Sapiens
IKANIVFLV

SEQ ID NO: 440361 - protein, 9 aa, Homo Sapiens
LLEFCLVFK

SEQ ID NO: 440362 - protein, 9 aa, Homo Sapiens
HLHKTEKAI

SEQ ID NO: 440363 - protein, 9 aa, Homo Sapiens
PAKTANKCS

SEQ ID NO: 440364 - protein, 9 aa, Homo Sapiens
QNEDYLIIM

SEQ ID NO: 440365 - protein, 9 aa, Homo Sapiens
QLDQLPSPT

SEQ ID NO: 440366 - protein, 9 aa, Homo Sapiens
IIGEQRHLT

SEQ ID NO: 440367 - protein, 9 aa, Homo Sapiens
SNTRFRIAA

SEQ ID NO: 440368 - protein, 9 aa, Homo Sapiens
MEYLFCESS

SEQ ID NO: 440369 - protein, 9 aa, Homo Sapiens
HQEAWEQHH

SEQ ID NO: 440370 - protein, 9 aa, Homo Sapiens
VLSVCVRLP

SEQ ID NO: 440371 - protein, 9 aa, Homo Sapiens
YVEMKYLEV

SEQ ID NO: 440372 - protein, 9 aa, Homo Sapiens
LVGENTNRV

SEQ ID NO: 440373 - protein, 9 aa, Homo Sapiens
EILPVSDKN

SEQ ID NO: 440374 - protein, 9 aa, Homo Sapiens
KNAEIYNYL

SEQ ID NO: 440375 - protein, 9 aa, Homo Sapiens
DSAENCFKF

SEQ ID NO: 440376 - protein, 9 aa, Homo Sapiens
PQVIEVLPR

SEQ ID NO: 440377 - protein, 9 aa, Homo Sapiens
ITVESQENT

SEQ ID NO: 440378 - protein, 9 aa, Homo Sapiens
KLNKKSMYS

SEQ ID NO: 440379 - protein, 9 aa, Homo Sapiens
GTTYLYDRL

SEQ ID NO: 440380 - protein, 9 aa, Homo Sapiens
LPGHTPRPA

SEQ ID NO: 440381 - protein, 9 aa, Homo Sapiens
VNINISEVV

SEQ ID NO: 440382 - protein, 9 aa, Homo Sapiens
QRLIQTKTV

SEQ ID NO: 440383 - protein, 9 aa, Homo Sapiens
KSLLNAFFR

SEQ ID NO: 440384 - protein, 9 aa, Homo Sapiens
INTGAWVNH

SEQ ID NO: 440385 - protein, 9 aa, Homo Sapiens
PHNQFIKIM

SEQ ID NO: 440386 - protein, 9 aa, Homo Sapiens
NEMIYHEQL

SEQ ID NO: 440387 - protein, 9 aa, Homo Sapiens
EPSGSPTSY

SEQ ID NO: 440388 - protein, 9 aa, Homo Sapiens
PTKLVGAAE

SEQ ID NO: 440389 - protein, 9 aa, Homo Sapiens
SQRILQRIT

SEQ ID NO: 440390 - protein, 9 aa, Homo Sapiens
DPDVVVTNF

SEQ ID NO: 440391 - protein, 9 aa, Homo Sapiens
NEARKILVV

SEQ ID NO: 440392 - protein, 9 aa, Homo Sapiens
KEAVRRRQN

SEQ ID NO: 440393 - protein, 9 aa, Homo Sapiens
NCKITSDGG

SEQ ID NO: 440394 - protein, 9 aa, Homo Sapiens
LFAVNSILF

SEQ ID NO: 440395 - protein, 9 aa, Homo Sapiens
GERAVLQLW

SEQ ID NO: 440396 - protein, 9 aa, Homo Sapiens
KRPRSHTLT

SEQ ID NO: 440397 - protein, 9 aa, Homo Sapiens
ASPNISNVK

SEQ ID NO: 440398 - protein, 9 aa, Homo Sapiens
NLRKSLLID

SEQ ID NO: 440399 - protein, 9 aa, Homo Sapiens
YWIEGTNHK

SEQ ID NO: 440400 - protein, 9 aa, Homo Sapiens
ELEKAREER

SEQ ID NO: 440401 - protein, 9 aa, Homo Sapiens
ENWDRTLHS

SEQ ID NO: 440402 - protein, 9 aa, Homo Sapiens
PTTFAPSDT

SEQ ID NO: 440403 - protein, 9 aa, Homo Sapiens
FLIYPSSQA

SEQ ID NO: 440404 - protein, 9 aa, Homo Sapiens
LNPGKQRYD

SEQ ID NO: 440405 - protein, 9 aa, Homo Sapiens
LQENNKSLE

SEQ ID NO: 440406 - protein, 9 aa, Homo Sapiens
LKNNWGVKL

SEQ ID NO: 440407 - protein, 9 aa, Homo Sapiens
FDLKLDLKD

SEQ ID NO: 440408 - protein, 9 aa, Homo Sapiens
HHREDIPFD

SEQ ID NO: 440409 - protein, 9 aa, Homo Sapiens
DLYNEDWDS

SEQ ID NO: 440410 - protein, 9 aa, Homo Sapiens
QVKKHIWVF

SEQ ID NO: 440411 - protein, 9 aa, Homo Sapiens
CINSCGDGF

SEQ ID NO: 440412 - protein, 9 aa, Homo Sapiens
SRTNSGIRS

SEQ ID NO: 440413 - protein, 9 aa, Homo Sapiens
GQTINDQDF

SEQ ID NO: 440414 - protein, 9 aa, Homo Sapiens
IQILLLGPI

SEQ ID NO: 440415 - protein, 9 aa, Homo Sapiens
EIQPHMLVE

SEQ ID NO: 440416 - protein, 9 aa, Homo Sapiens
YMLVMHNMF

SEQ ID NO: 440417 - protein, 9 aa, Homo Sapiens
DDDLQKSVY

SEQ ID NO: 440418 - protein, 9 aa, Homo Sapiens
YGRRRKGPF

SEQ ID NO: 440419 - protein, 9 aa, Homo Sapiens
WKDPHLQIP

SEQ ID NO: 440420 - protein, 9 aa, Homo Sapiens
AALLFVNEA

SEQ ID NO: 440421 - protein, 9 aa, Homo Sapiens
TAVNQARRQ

SEQ ID NO: 440422 - protein, 9 aa, Homo Sapiens
SLTDDFERE

SEQ ID NO: 440423 - protein, 9 aa, Homo Sapiens
ESMLYSVLY

SEQ ID NO: 440424 - protein, 9 aa, Homo Sapiens
HYRPPKGTY

SEQ ID NO: 440425 - protein, 9 aa, Homo Sapiens
QHTRKREAP

SEQ ID NO: 440426 - protein, 9 aa, Homo Sapiens
MPEEGSGCL

SEQ ID NO: 440427 - protein, 9 aa, Homo Sapiens
RKESKNEDR

SEQ ID NO: 440428 - protein, 9 aa, Homo Sapiens
DFEQTLKGH

SEQ ID NO: 440429 - protein, 9 aa, Homo Sapiens
RDERTHKIK

SEQ ID NO: 440430 - protein, 9 aa, Homo Sapiens
QECGEELWA

SEQ ID NO: 440431 - protein, 9 aa, Homo Sapiens
NVLSKSVNR

SEQ ID NO: 440432 - protein, 9 aa, Homo Sapiens
VGFWVGGSL

SEQ ID NO: 440433 - protein, 9 aa, Homo Sapiens
LDQMRKMSK

SEQ ID NO: 440434 - protein, 9 aa, Homo Sapiens
HMEGDKSQQ

SEQ ID NO: 440435 - protein, 9 aa, Homo Sapiens
LHSPLFKVL

SEQ ID NO: 440436 - protein, 9 aa, Homo Sapiens
VCKVNRTFQ

SEQ ID NO: 440437 - protein, 9 aa, Homo Sapiens
LFPILLCDI

SEQ ID NO: 440438 - protein, 9 aa, Homo Sapiens
CNNCVKAFS

SEQ ID NO: 440439 - protein, 9 aa, Homo Sapiens
LLVQNDYEA

SEQ ID NO: 440440 - protein, 9 aa, Homo Sapiens
LSLQQLEVW

SEQ ID NO: 440441 - protein, 9 aa, Homo Sapiens
EYHKYGDKS

SEQ ID NO: 440442 - protein, 9 aa, Homo Sapiens
PQSPVNKTT

SEQ ID NO: 440443 - protein, 9 aa, Homo Sapiens
FFHLVPFMV

SEQ ID NO: 440444 - protein, 9 aa, Homo Sapiens
TKAIFVQHL

SEQ ID NO: 440445 - protein, 9 aa, Homo Sapiens
VSADISFFF

SEQ ID NO: 440446 - protein, 9 aa, Homo Sapiens
LGQLSEKNS

SEQ ID NO: 440447 - protein, 9 aa, Homo Sapiens
RVHLTGWLM

SEQ ID NO: 440448 - protein, 9 aa, Homo Sapiens
WGTSCPHYF

SEQ ID NO: 440449 - protein, 9 aa, Homo Sapiens
DILSLYEVV

SEQ ID NO: 440450 - protein, 9 aa, Homo Sapiens
PTIGGFDHK

SEQ ID NO: 440451 - protein, 9 aa, Homo Sapiens
VCNEFLVDL

SEQ ID NO: 440452 - protein, 9 aa, Homo Sapiens
EGLGHSAKL

SEQ ID NO: 440453 - protein, 9 aa, Homo Sapiens
FCYDIVLDS

SEQ ID NO: 440454 - protein, 9 aa, Homo Sapiens
LFCRCHRPY

SEQ ID NO: 440455 - protein, 9 aa, Homo Sapiens
TTGSNIVPG

SEQ ID NO: 440456 - protein, 9 aa, Homo Sapiens
VEVKTKNNK

SEQ ID NO: 440457 - protein, 9 aa, Homo Sapiens
LEYLKKVCG

SEQ ID NO: 440458 - protein, 9 aa, Homo Sapiens
IEASLQERE

SEQ ID NO: 440459 - protein, 9 aa, Homo Sapiens
SRNSSLSYL

SEQ ID NO: 440460 - protein, 9 aa, Homo Sapiens
MLLCEGLWH

SEQ ID NO: 440461 - protein, 9 aa, Homo Sapiens
SWDITEAGL

SEQ ID NO: 440462 - protein, 9 aa, Homo Sapiens
SEGNSYVSS

SEQ ID NO: 440463 - protein, 9 aa, Homo Sapiens
CVQGEVQDS

SEQ ID NO: 440464 - protein, 9 aa, Homo Sapiens
NLSIILLIF

SEQ ID NO: 440465 - protein, 9 aa, Homo Sapiens
QSPSMAPVA

SEQ ID NO: 440466 - protein, 9 aa, Homo Sapiens
TNIQIWLAD

SEQ ID NO: 440467 - protein, 9 aa, Homo Sapiens
RMESYFDFT

SEQ ID NO: 440468 - protein, 9 aa, Homo Sapiens
PLFFTRVRS

SEQ ID NO: 440469 - protein, 9 aa, Homo Sapiens
RNHHKTTGH

SEQ ID NO: 440470 - protein, 9 aa, Homo Sapiens
PEDGEYKCG

SEQ ID NO: 440471 - protein, 9 aa, Homo Sapiens
EYKCGARVR

SEQ ID NO: 440472 - protein, 9 aa, Homo Sapiens
QLLKGIIYL

SEQ ID NO: 440473 - protein, 9 aa, Homo Sapiens
EQQQIEKEK

SEQ ID NO: 440474 - protein, 9 aa, Homo Sapiens
DTRIQGFPQ

SEQ ID NO: 440475 - protein, 9 aa, Homo Sapiens
EANNINKSL

SEQ ID NO: 440476 - protein, 9 aa, Homo Sapiens
EALGLLILI

SEQ ID NO: 440477 - protein, 9 aa, Homo Sapiens
CALGNSRVT

SEQ ID NO: 440478 - protein, 9 aa, Homo Sapiens
VKRLFLHKL

SEQ ID NO: 440479 - protein, 9 aa, Homo Sapiens
YSFEELQST

SEQ ID NO: 440480 - protein, 9 aa, Homo Sapiens
TAQLSTQAQ

SEQ ID NO: 440481 - protein, 9 aa, Homo Sapiens
NCPLKDRRH

SEQ ID NO: 440482 - protein, 9 aa, Homo Sapiens
FCGDCNSTP

SEQ ID NO: 440483 - protein, 9 aa, Homo Sapiens
TTSVSGLGT

SEQ ID NO: 440484 - protein, 9 aa, Homo Sapiens
AQIIAALTK

SEQ ID NO: 440485 - protein, 9 aa, Homo Sapiens
LRVAGEVHI

SEQ ID NO: 440486 - protein, 9 aa, Homo Sapiens
RKRKFDDIQ

SEQ ID NO: 440487 - protein, 9 aa, Homo Sapiens
LDLSKLAKA

SEQ ID NO: 440488 - protein, 9 aa, Homo Sapiens
SIESTVSNN

SEQ ID NO: 440489 - protein, 9 aa, Homo Sapiens
GNIINEIGV

SEQ ID NO: 440490 - protein, 9 aa, Homo Sapiens
VGENTNRVT

SEQ ID NO: 440491 - protein, 9 aa, Homo Sapiens
NIDFNWWHY

SEQ ID NO: 440492 - protein, 9 aa, Homo Sapiens
KEGHKKMYG

SEQ ID NO: 440493 - protein, 9 aa, Homo Sapiens
EMNKINEEN

SEQ ID NO: 440494 - protein, 9 aa, Homo Sapiens
FKEKVFTEQ

SEQ ID NO: 440495 - protein, 9 aa, Homo Sapiens
LYVLRAAQL

SEQ ID NO: 440496 - protein, 9 aa, Homo Sapiens
ADKKSLQIK

SEQ ID NO: 440497 - protein, 9 aa, Homo Sapiens
RTDKNDDGK

SEQ ID NO: 440498 - protein, 9 aa, Homo Sapiens
QHVTKPSPS

SEQ ID NO: 440499 - protein, 9 aa, Homo Sapiens
IIMSFVKGW

SEQ ID NO: 440500 - protein, 9 aa, Homo Sapiens
VVQPVLEEG

SEQ ID NO: 440501 - protein, 9 aa, Homo Sapiens
GDKPYACKE

SEQ ID NO: 440502 - protein, 9 aa, Homo Sapiens
KYVLRDVWF

SEQ ID NO: 440503 - protein, 9 aa, Homo Sapiens
TEASSPHPT

SEQ ID NO: 440504 - protein, 9 aa, Homo Sapiens
LNSYQNVFI

SEQ ID NO: 440505 - protein, 9 aa, Homo Sapiens
MGNQMSVTQ

SEQ ID NO: 440506 - protein, 9 aa, Homo Sapiens
KKRKDNFWG

SEQ ID NO: 440507 - protein, 9 aa, Homo Sapiens
LDTNYADLV

SEQ ID NO: 440508 - protein, 9 aa, Homo Sapiens
GTVAMDLGI

SEQ ID NO: 440509 - protein, 9 aa, Homo Sapiens
INEIGVFYM

SEQ ID NO: 440510 - protein, 9 aa, Homo Sapiens
EALSSLGFY

SEQ ID NO: 440511 - protein, 9 aa, Homo Sapiens
EFNLVCDRT

SEQ ID NO: 440512 - protein, 9 aa, Homo Sapiens
AAPSLIPLI

SEQ ID NO: 440513 - protein, 9 aa, Homo Sapiens
AGKKELILT

SEQ ID NO: 440514 - protein, 9 aa, Homo Sapiens
PDNPGQIAL

SEQ ID NO: 440515 - protein, 9 aa, Homo Sapiens
ILINTQNNY

SEQ ID NO: 440516 - protein, 9 aa, Homo Sapiens
QGLESNNFE

SEQ ID NO: 440517 - protein, 9 aa, Homo Sapiens
ANHQKIHTG

SEQ ID NO: 440518 - protein, 9 aa, Homo Sapiens
IPMIPGSHP

SEQ ID NO: 440519 - protein, 9 aa, Homo Sapiens
ANLGYDGRV

SEQ ID NO: 440520 - protein, 9 aa, Homo Sapiens
LVRAHLLLI

SEQ ID NO: 440521 - protein, 9 aa, Homo Sapiens
SFRHITDWQ

SEQ ID NO: 440522 - protein, 9 aa, Homo Sapiens
SHQQMKDAA

SEQ ID NO: 440523 - protein, 9 aa, Homo Sapiens
VTENIEVIT

SEQ ID NO: 440524 - protein, 9 aa, Homo Sapiens
ISRHRLQHE

SEQ ID NO: 440525 - protein, 9 aa, Homo Sapiens
HQLKKEEQQ

SEQ ID NO: 440526 - protein, 9 aa, Homo Sapiens
QHQCSAPAN

SEQ ID NO: 440527 - protein, 9 aa, Homo Sapiens
PITQRAEIH

SEQ ID NO: 440528 - protein, 9 aa, Homo Sapiens
LEPDSSPLA

SEQ ID NO: 440529 - protein, 9 aa, Homo Sapiens
ETRSGSAHK

SEQ ID NO: 440530 - protein, 9 aa, Homo Sapiens
EFEECLEKC

SEQ ID NO: 440531 - protein, 9 aa, Homo Sapiens
EYEERWAFH

SEQ ID NO: 440532 - protein, 9 aa, Homo Sapiens
QNKTNSILL

SEQ ID NO: 440533 - protein, 9 aa, Homo Sapiens
TSSVWRNKE

SEQ ID NO: 440534 - protein, 9 aa, Homo Sapiens
LHLISSHSH

SEQ ID NO: 440535 - protein, 9 aa, Homo Sapiens
KETERNLQI

SEQ ID NO: 440536 - protein, 9 aa, Homo Sapiens
QIWLADGGR

SEQ ID NO: 440537 - protein, 9 aa, Homo Sapiens
HRSDGWNGK

SEQ ID NO: 440538 - protein, 9 aa, Homo Sapiens
PNCQHSDLE

SEQ ID NO: 440539 - protein, 9 aa, Homo Sapiens
GFWVGGSLD

SEQ ID NO: 440540 - protein, 9 aa, Homo Sapiens
VDEMEIKIN

SEQ ID NO: 440541 - protein, 9 aa, Homo Sapiens
MDWEECSNM

SEQ ID NO: 440542 - protein, 9 aa, Homo Sapiens
ANFSGMLER

SEQ ID NO: 440543 - protein, 9 aa, Homo Sapiens
GVACVHKEK

SEQ ID NO: 440544 - protein, 9 aa, Homo Sapiens
RIEDNMDGG

SEQ ID NO: 440545 - protein, 9 aa, Homo Sapiens
WKPPCRSRS

SEQ ID NO: 440546 - protein, 9 aa, Homo Sapiens
TSPRPGSVA

SEQ ID NO: 440547 - protein, 9 aa, Homo Sapiens
LPRPCMSIN

SEQ ID NO: 440548 - protein, 9 aa, Homo Sapiens
LEKAIQSLL

SEQ ID NO: 440549 - protein, 9 aa, Homo Sapiens
NNKLRWGDI

SEQ ID NO: 440550 - protein, 9 aa, Homo Sapiens
VLGTFILFA

SEQ ID NO: 440551 - protein, 9 aa, Homo Sapiens
GEPGYAKYG

SEQ ID NO: 440552 - protein, 9 aa, Homo Sapiens
NIVPGKANP

SEQ ID NO: 440553 - protein, 9 aa, Homo Sapiens
AALRWHILQ

SEQ ID NO: 440554 - protein, 9 aa, Homo Sapiens
YWGCVYLLM

SEQ ID NO: 440555 - protein, 9 aa, Homo Sapiens
KSYQTAKFH

SEQ ID NO: 440556 - protein, 9 aa, Homo Sapiens
IFGIQDFLY

SEQ ID NO: 440557 - protein, 9 aa, Homo Sapiens
GLRNVIYIH

SEQ ID NO: 440558 - protein, 9 aa, Homo Sapiens
HEIIHTGEE

SEQ ID NO: 440559 - protein, 9 aa, Homo Sapiens
PFRLHNLFS

SEQ ID NO: 440560 - protein, 9 aa, Homo Sapiens
AVLAVHGTG

SEQ ID NO: 440561 - protein, 9 aa, Homo Sapiens
SSNSWGIAD

SEQ ID NO: 440562 - protein, 9 aa, Homo Sapiens
LAEHCRINT

SEQ ID NO: 440563 - protein, 9 aa, Homo Sapiens
RFGRSCTPT

SEQ ID NO: 440564 - protein, 9 aa, Homo Sapiens
ILDMVNGQR

SEQ ID NO: 440565 - protein, 9 aa, Homo Sapiens
MSHKHIYYS

SEQ ID NO: 440566 - protein, 9 aa, Homo Sapiens
SIYLASLPK

SEQ ID NO: 440567 - protein, 9 aa, Homo Sapiens
CPHAKFIMT

SEQ ID NO: 440568 - protein, 9 aa, Homo Sapiens
SLYSTPFSS

SEQ ID NO: 440569 - protein, 9 aa, Homo Sapiens
STNPAILAV

SEQ ID NO: 440570 - protein, 9 aa, Homo Sapiens
MGSSSHAGT

SEQ ID NO: 440571 - protein, 9 aa, Homo Sapiens
ESNELHAKQ

SEQ ID NO: 440572 - protein, 9 aa, Homo Sapiens
ICNNYAEMH

SEQ ID NO: 440573 - protein, 9 aa, Homo Sapiens
YAARRSLGL

SEQ ID NO: 440574 - protein, 9 aa, Homo Sapiens
PQQLLQTSR

SEQ ID NO: 440575 - protein, 9 aa, Homo Sapiens
RSEIPLQKQ

SEQ ID NO: 440576 - protein, 9 aa, Homo Sapiens
FLPGYDKIV

SEQ ID NO: 440577 - protein, 9 aa, Homo Sapiens
SLQQLVEAD

SEQ ID NO: 440578 - protein, 9 aa, Homo Sapiens
LVKDNGKPP

SEQ ID NO: 440579 - protein, 9 aa, Homo Sapiens
VCIFTEKLN

SEQ ID NO: 440580 - protein, 9 aa, Homo Sapiens
NDVNQPFEI

SEQ ID NO: 440581 - protein, 9 aa, Homo Sapiens
YVEDTYLLC

SEQ ID NO: 440582 - protein, 9 aa, Homo Sapiens
ERAQKDVAS

SEQ ID NO: 440583 - protein, 9 aa, Homo Sapiens
EDRETEIIY

SEQ ID NO: 440584 - protein, 9 aa, Homo Sapiens
INGRADFRE

SEQ ID NO: 440585 - protein, 9 aa, Homo Sapiens
GPVQKVVTE

SEQ ID NO: 440586 - protein, 9 aa, Homo Sapiens
HPDRALLTF

SEQ ID NO: 440587 - protein, 9 aa, Homo Sapiens
VSGLGTTSV

SEQ ID NO: 440588 - protein, 9 aa, Homo Sapiens
AAGKKWGHK

SEQ ID NO: 440589 - protein, 9 aa, Homo Sapiens
RPRTSDKPY

SEQ ID NO: 440590 - protein, 9 aa, Homo Sapiens
YTKKTEKSN

SEQ ID NO: 440591 - protein, 9 aa, Homo Sapiens
GDKPYQCDI

SEQ ID NO: 440592 - protein, 9 aa, Homo Sapiens
ILLKGFELM

SEQ ID NO: 440593 - protein, 9 aa, Homo Sapiens
QHMNNDLEK

SEQ ID NO: 440594 - protein, 9 aa, Homo Sapiens
VILTSSVAA

SEQ ID NO: 440595 - protein, 9 aa, Homo Sapiens
LQPSTRDRV

SEQ ID NO: 440596 - protein, 9 aa, Homo Sapiens
HTYYYGKRK

SEQ ID NO: 440597 - protein, 9 aa, Homo Sapiens
YMICCDKFS

SEQ ID NO: 440598 - protein, 9 aa, Homo Sapiens
KDTALKHSK

SEQ ID NO: 440599 - protein, 9 aa, Homo Sapiens
GELAIFPIS

SEQ ID NO: 440600 - protein, 9 aa, Homo Sapiens
EEWSCFFLW

SEQ ID NO: 440601 - protein, 9 aa, Homo Sapiens
STLSLSRNR

SEQ ID NO: 440602 - protein, 9 aa, Homo Sapiens
AQQNLEALK

SEQ ID NO: 440603 - protein, 9 aa, Homo Sapiens
MKEAHMLCQ

SEQ ID NO: 440604 - protein, 9 aa, Homo Sapiens
RLFAVRPEG

SEQ ID NO: 440605 - protein, 9 aa, Homo Sapiens
VVIKKIKLG

SEQ ID NO: 440606 - protein, 9 aa, Homo Sapiens
EITSNNGTG

SEQ ID NO: 440607 - protein, 9 aa, Homo Sapiens
CEEINRFTE

SEQ ID NO: 440608 - protein, 9 aa, Homo Sapiens
QVRTPKPDA

SEQ ID NO: 440609 - protein, 9 aa, Homo Sapiens
QPGNTKISE

SEQ ID NO: 440610 - protein, 9 aa, Homo Sapiens
CCCSMVSQM

SEQ ID NO: 440611 - protein, 9 aa, Homo Sapiens
SESKKEYQK

SEQ ID NO: 440612 - protein, 9 aa, Homo Sapiens
ARLPVTTWQ

SEQ ID NO: 440613 - protein, 9 aa, Homo Sapiens
SQHDGPTNN

SEQ ID NO: 440614 - protein, 9 aa, Homo Sapiens
AITLLKESI

SEQ ID NO: 440615 - protein, 9 aa, Homo Sapiens
VEYGFHEYT

SEQ ID NO: 440616 - protein, 9 aa, Homo Sapiens
FRGSELNQH

SEQ ID NO: 440617 - protein, 9 aa, Homo Sapiens
LTNRVLKYP

SEQ ID NO: 440618 - protein, 9 aa, Homo Sapiens
NSDVSKAAF

SEQ ID NO: 440619 - protein, 9 aa, Homo Sapiens
ALAQHQIIH

SEQ ID NO: 440620 - protein, 9 aa, Homo Sapiens
LMTGPMVQG

SEQ ID NO: 440621 - protein, 9 aa, Homo Sapiens
LNDLIQKLQ

SEQ ID NO: 440622 - protein, 9 aa, Homo Sapiens
LEAEYTDVL

SEQ ID NO: 440623 - protein, 9 aa, Homo Sapiens
ILIRLWRVA

SEQ ID NO: 440624 - protein, 9 aa, Homo Sapiens
DILNMENTL

SEQ ID NO: 440625 - protein, 9 aa, Homo Sapiens
AKKAFQKRQ

SEQ ID NO: 440626 - protein, 9 aa, Homo Sapiens
VLMLLFPFS

SEQ ID NO: 440627 - protein, 9 aa, Homo Sapiens
GCVYLLMVT

SEQ ID NO: 440628 - protein, 9 aa, Homo Sapiens
TSREKTTCA

SEQ ID NO: 440629 - protein, 9 aa, Homo Sapiens
LYKELQKSD

SEQ ID NO: 440630 - protein, 9 aa, Homo Sapiens
QFGLNEAGL

SEQ ID NO: 440631 - protein, 9 aa, Homo Sapiens
RRGPNFGWR

SEQ ID NO: 440632 - protein, 9 aa, Homo Sapiens
QAQGEQNVP

SEQ ID NO: 440633 - protein, 9 aa, Homo Sapiens
HLELLNIVE

SEQ ID NO: 440634 - protein, 9 aa, Homo Sapiens
TQPIPIIKS

SEQ ID NO: 440635 - protein, 9 aa, Homo Sapiens
KETNINHSN

SEQ ID NO: 440636 - protein, 9 aa, Homo Sapiens
IHKLRPTEK

SEQ ID NO: 440637 - protein, 9 aa, Homo Sapiens
FKAHPNQLV

SEQ ID NO: 440638 - protein, 9 aa, Homo Sapiens
EESTIPTNL

SEQ ID NO: 440639 - protein, 9 aa, Homo Sapiens
ILCFRDEAW

SEQ ID NO: 440640 - protein, 9 aa, Homo Sapiens
VTFTWNTLS

SEQ ID NO: 440641 - protein, 9 aa, Homo Sapiens
ALPQRRCCA

SEQ ID NO: 440642 - protein, 9 aa, Homo Sapiens
THTDPVPQV

SEQ ID NO: 440643 - protein, 9 aa, Homo Sapiens
ELVDLIPKY

SEQ ID NO: 440644 - protein, 9 aa, Homo Sapiens
TVTSEFGTL

SEQ ID NO: 440645 - protein, 9 aa, Homo Sapiens
GIHENQSRS

SEQ ID NO: 440646 - protein, 9 aa, Homo Sapiens
GGRQTQREK

SEQ ID NO: 440647 - protein, 9 aa, Homo Sapiens
QIRTPRASN

SEQ ID NO: 440648 - protein, 9 aa, Homo Sapiens
LRVWDINEA

SEQ ID NO: 440649 - protein, 9 aa, Homo Sapiens
LIQHQIMHT

SEQ ID NO: 440650 - protein, 9 aa, Homo Sapiens
NKLYLNEPN

SEQ ID NO: 440651 - protein, 9 aa, Homo Sapiens
WVLFDITQE

SEQ ID NO: 440652 - protein, 9 aa, Homo Sapiens
TATYDTGGK

SEQ ID NO: 440653 - protein, 9 aa, Homo Sapiens
HLGIIGPII

SEQ ID NO: 440654 - protein, 9 aa, Homo Sapiens
SSEVDCVLK

SEQ ID NO: 440655 - protein, 9 aa, Homo Sapiens
FPQPNYQLQ

SEQ ID NO: 440656 - protein, 9 aa, Homo Sapiens
REQWKKLWR

SEQ ID NO: 440657 - protein, 9 aa, Homo Sapiens
QGPKKFIEC

SEQ ID NO: 440658 - protein, 9 aa, Homo Sapiens
FDFVIDDNA

SEQ ID NO: 440659 - protein, 9 aa, Homo Sapiens
ELRHIAQTS

SEQ ID NO: 440660 - protein, 9 aa, Homo Sapiens
RPGTVALRK

SEQ ID NO: 440661 - protein, 9 aa, Homo Sapiens
TKTQLVESR

SEQ ID NO: 440662 - protein, 9 aa, Homo Sapiens
VCVEDGKTL

SEQ ID NO: 440663 - protein, 9 aa, Homo Sapiens
AIAAFSNWI

SEQ ID NO: 440664 - protein, 9 aa, Homo Sapiens
PTLVQVRHH

SEQ ID NO: 440665 - protein, 9 aa, Homo Sapiens
TVLLGHYQE

SEQ ID NO: 440666 - protein, 9 aa, Homo Sapiens
SDCRKTFCV

SEQ ID NO: 440667 - protein, 9 aa, Homo Sapiens
SFEVCGANP

SEQ ID NO: 440668 - protein, 9 aa, Homo Sapiens
CAQHWADLG

SEQ ID NO: 440669 - protein, 9 aa, Homo Sapiens
LQTPIYFFL

SEQ ID NO: 440670 - protein, 9 aa, Homo Sapiens
NLMQKEAID

SEQ ID NO: 440671 - protein, 9 aa, Homo Sapiens
ACFVTSYLG

SEQ ID NO: 440672 - protein, 9 aa, Homo Sapiens
QTAEFFRDL

SEQ ID NO: 440673 - protein, 9 aa, Homo Sapiens
LHSELAGVA

SEQ ID NO: 440674 - protein, 9 aa, Homo Sapiens
YIHETHTRH

SEQ ID NO: 440675 - protein, 9 aa, Homo Sapiens
LTVVQHMEG

SEQ ID NO: 440676 - protein, 9 aa, Homo Sapiens
AVQNLAPRT

SEQ ID NO: 440677 - protein, 9 aa, Homo Sapiens
QASSRDPEN

SEQ ID NO: 440678 - protein, 9 aa, Homo Sapiens
APRTAVAAA

SEQ ID NO: 440679 - protein, 9 aa, Homo Sapiens
WLSHKDEEL

SEQ ID NO: 440680 - protein, 9 aa, Homo Sapiens
GPPGPMSPP

SEQ ID NO: 440681 - protein, 9 aa, Homo Sapiens
KYGFDLNKG

SEQ ID NO: 440682 - protein, 9 aa, Homo Sapiens
TPKHTMKAF

SEQ ID NO: 440683 - protein, 9 aa, Homo Sapiens
LLNCFPSYN

SEQ ID NO: 440684 - protein, 9 aa, Homo Sapiens
THQKEFNTL

SEQ ID NO: 440685 - protein, 9 aa, Homo Sapiens
INRFTETRE

SEQ ID NO: 440686 - protein, 9 aa, Homo Sapiens
SPRYPSPPL

SEQ ID NO: 440687 - protein, 9 aa, Homo Sapiens
ELNHLGVLI

SEQ ID NO: 440688 - protein, 9 aa, Homo Sapiens
CRNTYYASI

SEQ ID NO: 440689 - protein, 9 aa, Homo Sapiens
DKTISYQES

SEQ ID NO: 440690 - protein, 9 aa, Homo Sapiens
NLSSVNEFA

SEQ ID NO: 440691 - protein, 9 aa, Homo Sapiens
TLLKESIKY

SEQ ID NO: 440692 - protein, 9 aa, Homo Sapiens
SSNLASASA

SEQ ID NO: 440693 - protein, 9 aa, Homo Sapiens
ITRSLTDDF

SEQ ID NO: 440694 - protein, 9 aa, Homo Sapiens
PQWAYDNWG

SEQ ID NO: 440695 - protein, 9 aa, Homo Sapiens
IEHPDAVCQ

SEQ ID NO: 440696 - protein, 9 aa, Homo Sapiens
RKPAQSRPD

SEQ ID NO: 440697 - protein, 9 aa, Homo Sapiens
QAQADSLTI

SEQ ID NO: 440698 - protein, 9 aa, Homo Sapiens
IRRAYLNGS

SEQ ID NO: 440699 - protein, 9 aa, Homo Sapiens
RILIHHRED

SEQ ID NO: 440700 - protein, 9 aa, Homo Sapiens
TQRVPVASP

SEQ ID NO: 440701 - protein, 9 aa, Homo Sapiens
SNSWGIADE

SEQ ID NO: 440702 - protein, 9 aa, Homo Sapiens
DSTGSPIQL

SEQ ID NO: 440703 - protein, 9 aa, Homo Sapiens
ITGQPFVVL

SEQ ID NO: 440704 - protein, 9 aa, Homo Sapiens
EAVVYNDKE

SEQ ID NO: 440705 - protein, 9 aa, Homo Sapiens
LFFIFLPNT

SEQ ID NO: 440706 - protein, 9 aa, Homo Sapiens
DMQAQKVMH

SEQ ID NO: 440707 - protein, 9 aa, Homo Sapiens
KHSHRSLHR

SEQ ID NO: 440708 - protein, 9 aa, Homo Sapiens
LIQSGDISA

SEQ ID NO: 440709 - protein, 9 aa, Homo Sapiens
CYVCPAVLG

SEQ ID NO: 440710 - protein, 9 aa, Homo Sapiens
KPQKNRILE

SEQ ID NO: 440711 - protein, 9 aa, Homo Sapiens
KSKYGIDNF

SEQ ID NO: 440712 - protein, 9 aa, Homo Sapiens
RMVALERLA

SEQ ID NO: 440713 - protein, 9 aa, Homo Sapiens
LSGASLAAR

SEQ ID NO: 440714 - protein, 9 aa, Homo Sapiens
HFFAPDYGE

SEQ ID NO: 440715 - protein, 9 aa, Homo Sapiens
QNKKIEKIK

SEQ ID NO: 440716 - protein, 9 aa, Homo Sapiens
VSRSDRSPE

SEQ ID NO: 440717 - protein, 9 aa, Homo Sapiens
IYHFSAKHA

SEQ ID NO: 440718 - protein, 9 aa, Homo Sapiens
SQNLSTPPL

SEQ ID NO: 440719 - protein, 9 aa, Homo Sapiens
RRLDFLAKA

SEQ ID NO: 440720 - protein, 9 aa, Homo Sapiens
TFKSYYVRN

SEQ ID NO: 440721 - protein, 9 aa, Homo Sapiens
QVCNRFNCP

SEQ ID NO: 440722 - protein, 9 aa, Homo Sapiens
PSQRVNLDT

SEQ ID NO: 440723 - protein, 9 aa, Homo Sapiens
HLLHLNTKG

SEQ ID NO: 440724 - protein, 9 aa, Homo Sapiens
STNLELQAL

SEQ ID NO: 440725 - protein, 9 aa, Homo Sapiens
NLFKRLMIV

SEQ ID NO: 440726 - protein, 9 aa, Homo Sapiens
RNFDQPHQF

SEQ ID NO: 440727 - protein, 9 aa, Homo Sapiens
YVKQQCHQA

SEQ ID NO: 440728 - protein, 9 aa, Homo Sapiens
GVNKSPMMT

SEQ ID NO: 440729 - protein, 9 aa, Homo Sapiens
DKFGQGVHH

SEQ ID NO: 440730 - protein, 9 aa, Homo Sapiens
RQSQKVPVD

SEQ ID NO: 440731 - protein, 9 aa, Homo Sapiens
GDILKYLEN

SEQ ID NO: 440732 - protein, 9 aa, Homo Sapiens
RICSTNDSL

SEQ ID NO: 440733 - protein, 9 aa, Homo Sapiens
KSACNIEVK

SEQ ID NO: 440734 - protein, 9 aa, Homo Sapiens
KFGLKSLAI

SEQ ID NO: 440735 - protein, 9 aa, Homo Sapiens
FLFSDTQTK

SEQ ID NO: 440736 - protein, 9 aa, Homo Sapiens
RKVLSSSPQ

SEQ ID NO: 440737 - protein, 9 aa, Homo Sapiens
NVPSYKTNE

SEQ ID NO: 440738 - protein, 9 aa, Homo Sapiens
SNSVTAAIQ

SEQ ID NO: 440739 - protein, 9 aa, Homo Sapiens
MGGAYLCNY

SEQ ID NO: 440740 - protein, 9 aa, Homo Sapiens
CGKTFSHKD

SEQ ID NO: 440741 - protein, 9 aa, Homo Sapiens
IYKILCKLS

SEQ ID NO: 440742 - protein, 9 aa, Homo Sapiens
AAVIDDIQD

SEQ ID NO: 440743 - protein, 9 aa, Homo Sapiens
KLILIKLCY

SEQ ID NO: 440744 - protein, 9 aa, Homo Sapiens
SILTRDRDP

SEQ ID NO: 440745 - protein, 9 aa, Homo Sapiens
KRLSCLSLL

SEQ ID NO: 440746 - protein, 9 aa, Homo Sapiens
QSLDKNVMV

SEQ ID NO: 440747 - protein, 9 aa, Homo Sapiens
PRNTTMAVY

SEQ ID NO: 440748 - protein, 9 aa, Homo Sapiens
ICSNQIMGR

SEQ ID NO: 440749 - protein, 9 aa, Homo Sapiens
TTCCARCHV

SEQ ID NO: 440750 - protein, 9 aa, Homo Sapiens
DHRLSATLE

SEQ ID NO: 440751 - protein, 9 aa, Homo Sapiens
QLWGSRSEL

SEQ ID NO: 440752 - protein, 9 aa, Homo Sapiens
GNETWGDPG

SEQ ID NO: 440753 - protein, 9 aa, Homo Sapiens
DAVSVRSMK

SEQ ID NO: 440754 - protein, 9 aa, Homo Sapiens
SKQNVISYL

SEQ ID NO: 440755 - protein, 9 aa, Homo Sapiens
GLHGDGPRK

SEQ ID NO: 440756 - protein, 9 aa, Homo Sapiens
VERDYFSSG

SEQ ID NO: 440757 - protein, 9 aa, Homo Sapiens
NQIVDVNLT

SEQ ID NO: 440758 - protein, 9 aa, Homo Sapiens
DACSYVTSN

SEQ ID NO: 440759 - protein, 9 aa, Homo Sapiens
VRTHYAPPR

SEQ ID NO: 440760 - protein, 9 aa, Homo Sapiens
SLYGLDLDC

SEQ ID NO: 440761 - protein, 9 aa, Homo Sapiens
HYENVEFGH

SEQ ID NO: 440762 - protein, 9 aa, Homo Sapiens
ACYLVCRKD

SEQ ID NO: 440763 - protein, 9 aa, Homo Sapiens
KKFINIAAH

SEQ ID NO: 440764 - protein, 9 aa, Homo Sapiens
LASNEFQNK

SEQ ID NO: 440765 - protein, 9 aa, Homo Sapiens
VCYHLTVDR

SEQ ID NO: 440766 - protein, 9 aa, Homo Sapiens
IPNLLSRNS

SEQ ID NO: 440767 - protein, 9 aa, Homo Sapiens
RNSTFKSVA

SEQ ID NO: 440768 - protein, 9 aa, Homo Sapiens
WEIKISQVT

SEQ ID NO: 440769 - protein, 9 aa, Homo Sapiens
TKGKRGQKE

SEQ ID NO: 440770 - protein, 9 aa, Homo Sapiens
DKPYQCDIC

SEQ ID NO: 440771 - protein, 9 aa, Homo Sapiens
LVFCLCMAE

SEQ ID NO: 440772 - protein, 9 aa, Homo Sapiens
QGFEFIFGI

SEQ ID NO: 440773 - protein, 9 aa, Homo Sapiens
SGEKLYKCN

SEQ ID NO: 440774 - protein, 9 aa, Homo Sapiens
FDANTSVFV

SEQ ID NO: 440775 - protein, 9 aa, Homo Sapiens
QLIQSRMAR

SEQ ID NO: 440776 - protein, 9 aa, Homo Sapiens
ATPVHHRRP

SEQ ID NO: 440777 - protein, 9 aa, Homo Sapiens
NNKAMAAVS

SEQ ID NO: 440778 - protein, 9 aa, Homo Sapiens
GEKLHECMI

SEQ ID NO: 440779 - protein, 9 aa, Homo Sapiens
PSYNGYFVT

SEQ ID NO: 440780 - protein, 9 aa, Homo Sapiens
ASPKKQHKI

SEQ ID NO: 440781 - protein, 9 aa, Homo Sapiens
AVHGTGNLV

SEQ ID NO: 440782 - protein, 9 aa, Homo Sapiens
KVSPEFSEP

SEQ ID NO: 440783 - protein, 9 aa, Homo Sapiens
AIQVKNDIS

SEQ ID NO: 440784 - protein, 9 aa, Homo Sapiens
VQQASLMLF

SEQ ID NO: 440785 - protein, 9 aa, Homo Sapiens
TWALILKRN

SEQ ID NO: 440786 - protein, 9 aa, Homo Sapiens
LPASPLMNN

SEQ ID NO: 440787 - protein, 9 aa, Homo Sapiens
HFRSHSKSR

SEQ ID NO: 440788 - protein, 9 aa, Homo Sapiens
SLCYSYLMV

SEQ ID NO: 440789 - protein, 9 aa, Homo Sapiens
QTRVCFSDN

SEQ ID NO: 440790 - protein, 9 aa, Homo Sapiens
YRNFDQPHQ

SEQ ID NO: 440791 - protein, 9 aa, Homo Sapiens
RKIINVKQF

SEQ ID NO: 440792 - protein, 9 aa, Homo Sapiens
HNLERVLPQ

SEQ ID NO: 440793 - protein, 9 aa, Homo Sapiens
EEASLKPKA

SEQ ID NO: 440794 - protein, 9 aa, Homo Sapiens
KPVQVEQDT

SEQ ID NO: 440795 - protein, 9 aa, Homo Sapiens
YDQDAHLAY

SEQ ID NO: 440796 - protein, 9 aa, Homo Sapiens
GKVNKPQKN

SEQ ID NO: 440797 - protein, 9 aa, Homo Sapiens
DYMKKIFDS

SEQ ID NO: 440798 - protein, 9 aa, Homo Sapiens
KIHLMYAVR

SEQ ID NO: 440799 - protein, 9 aa, Homo Sapiens
PILNAHQPI

SEQ ID NO: 440800 - protein, 9 aa, Homo Sapiens
NYINSSSVD

SEQ ID NO: 440801 - protein, 9 aa, Homo Sapiens
KHQATAHCP

SEQ ID NO: 440802 - protein, 9 aa, Homo Sapiens
CKSVASFIK

SEQ ID NO: 440803 - protein, 9 aa, Homo Sapiens
ILEMQILLY

SEQ ID NO: 440804 - protein, 9 aa, Homo Sapiens
YEMIRLLIM

SEQ ID NO: 440805 - protein, 9 aa, Homo Sapiens
LQRLGELHS

SEQ ID NO: 440806 - protein, 9 aa, Homo Sapiens
DFWYVTCAI

SEQ ID NO: 440807 - protein, 9 aa, Homo Sapiens
TFEQLHNKC

SEQ ID NO: 440808 - protein, 9 aa, Homo Sapiens
ISFRCLGIH

SEQ ID NO: 440809 - protein, 9 aa, Homo Sapiens
FRCLGIHLP

SEQ ID NO: 440810 - protein, 9 aa, Homo Sapiens
VKRLGIKMG

SEQ ID NO: 440811 - protein, 9 aa, Homo Sapiens
EQMEDMRNK

SEQ ID NO: 440812 - protein, 9 aa, Homo Sapiens
LARWLPADY

SEQ ID NO: 440813 - protein, 9 aa, Homo Sapiens
NGQCDMYSS

SEQ ID NO: 440814 - protein, 9 aa, Homo Sapiens
IAGSSNVKF

SEQ ID NO: 440815 - protein, 9 aa, Homo Sapiens
SHKIEIGTI

SEQ ID NO: 440816 - protein, 9 aa, Homo Sapiens
EKELKASES

SEQ ID NO: 440817 - protein, 9 aa, Homo Sapiens
VMADDNVKY

SEQ ID NO: 440818 - protein, 9 aa, Homo Sapiens
SYQLKNLSE

SEQ ID NO: 440819 - protein, 9 aa, Homo Sapiens
ALDGDTGPA

SEQ ID NO: 440820 - protein, 9 aa, Homo Sapiens
GPESRKEIN

SEQ ID NO: 440821 - protein, 9 aa, Homo Sapiens
QCLTTTQSG

SEQ ID NO: 440822 - protein, 9 aa, Homo Sapiens
PDALGNVEG

SEQ ID NO: 440823 - protein, 9 aa, Homo Sapiens
GLCLCAILC

SEQ ID NO: 440824 - protein, 9 aa, Homo Sapiens
SLVQQIQIL

SEQ ID NO: 440825 - protein, 9 aa, Homo Sapiens
NGTCMDLVG

SEQ ID NO: 440826 - protein, 9 aa, Homo Sapiens
NDLIQKLQN

SEQ ID NO: 440827 - protein, 9 aa, Homo Sapiens
APNDLYLQL

SEQ ID NO: 440828 - protein, 9 aa, Homo Sapiens
NMTTVSYLK

SEQ ID NO: 440829 - protein, 9 aa, Homo Sapiens
LQLEDVTHK

SEQ ID NO: 440830 - protein, 9 aa, Homo Sapiens
KWVGYRCNR

SEQ ID NO: 440831 - protein, 9 aa, Homo Sapiens
NKNLVYPAM

SEQ ID NO: 440832 - protein, 9 aa, Homo Sapiens
ENKLGILGS

SEQ ID NO: 440833 - protein, 9 aa, Homo Sapiens
QKYVSRTLV

SEQ ID NO: 440834 - protein, 9 aa, Homo Sapiens
KYQYVLQSI

SEQ ID NO: 440835 - protein, 9 aa, Homo Sapiens
EGMPSKLDS

SEQ ID NO: 440836 - protein, 9 aa, Homo Sapiens
LLHSMIQII

SEQ ID NO: 440837 - protein, 9 aa, Homo Sapiens
SETNQHDSN

SEQ ID NO: 440838 - protein, 9 aa, Homo Sapiens
ALLKWQLEQ

SEQ ID NO: 440839 - protein, 9 aa, Homo Sapiens
AVSVRSMKR

SEQ ID NO: 440840 - protein, 9 aa, Homo Sapiens
DVTPPSVVM

SEQ ID NO: 440841 - protein, 9 aa, Homo Sapiens
PKESNLSDV

SEQ ID NO: 440842 - protein, 9 aa, Homo Sapiens
GQSIKAENE

SEQ ID NO: 440843 - protein, 9 aa, Homo Sapiens
CLTGPHTCK

SEQ ID NO: 440844 - protein, 9 aa, Homo Sapiens
GADMTKVFY

SEQ ID NO: 440845 - protein, 9 aa, Homo Sapiens
IQKQIQETL

SEQ ID NO: 440846 - protein, 9 aa, Homo Sapiens
TFIKIPVCE

SEQ ID NO: 440847 - protein, 9 aa, Homo Sapiens
IEKLTTASE

SEQ ID NO: 440848 - protein, 9 aa, Homo Sapiens
TTEEMEVVV

SEQ ID NO: 440849 - protein, 9 aa, Homo Sapiens
SPANCQIDR

SEQ ID NO: 440850 - protein, 9 aa, Homo Sapiens
ILSLLRLIS

SEQ ID NO: 440851 - protein, 9 aa, Homo Sapiens
TDLIIHHII

SEQ ID NO: 440852 - protein, 9 aa, Homo Sapiens
FPINVVKTC

SEQ ID NO: 440853 - protein, 9 aa, Homo Sapiens
PLYSSKSHR

SEQ ID NO: 440854 - protein, 9 aa, Homo Sapiens
FCGRHKKYA

SEQ ID NO: 440855 - protein, 9 aa, Homo Sapiens
AVASVLILV

SEQ ID NO: 440856 - protein, 9 aa, Homo Sapiens
LDLKMVEGT

SEQ ID NO: 440857 - protein, 9 aa, Homo Sapiens
RVQHKQFLR

SEQ ID NO: 440858 - protein, 9 aa, Homo Sapiens
SNLFYWPRR

SEQ ID NO: 440859 - protein, 9 aa, Homo Sapiens
NVLKWTMLP

SEQ ID NO: 440860 - protein, 9 aa, Homo Sapiens
IQKQFFHSV

SEQ ID NO: 440861 - protein, 9 aa, Homo Sapiens
NFFTTGQKE

SEQ ID NO: 440862 - protein, 9 aa, Homo Sapiens
CNPPEERRL

SEQ ID NO: 440863 - protein, 9 aa, Homo Sapiens
NKLTQSTEK

SEQ ID NO: 440864 - protein, 9 aa, Homo Sapiens
NFISRYQIQ

SEQ ID NO: 440865 - protein, 9 aa, Homo Sapiens
YTPSSSFRV

SEQ ID NO: 440866 - protein, 9 aa, Homo Sapiens
KSYQLKNLS

SEQ ID NO: 440867 - protein, 9 aa, Homo Sapiens
LFFTRVRSY

SEQ ID NO: 440868 - protein, 9 aa, Homo Sapiens
SIFENVIFI

SEQ ID NO: 440869 - protein, 9 aa, Homo Sapiens
VYIQSTDVD

SEQ ID NO: 440870 - protein, 9 aa, Homo Sapiens
CSYVTSNAL

SEQ ID NO: 440871 - protein, 9 aa, Homo Sapiens
GTTQRVPVA

SEQ ID NO: 440872 - protein, 9 aa, Homo Sapiens
IMLLDMATS

SEQ ID NO: 440873 - protein, 9 aa, Homo Sapiens
NVANVFLVA

SEQ ID NO: 440874 - protein, 9 aa, Homo Sapiens
HNERGVGAG

SEQ ID NO: 440875 - protein, 9 aa, Homo Sapiens
FPPSKDASS

SEQ ID NO: 440876 - protein, 9 aa, Homo Sapiens
MHALPDEIQ

SEQ ID NO: 440877 - protein, 9 aa, Homo Sapiens
SVTWYTNSS

SEQ ID NO: 440878 - protein, 9 aa, Homo Sapiens
NRSLKEEDG

SEQ ID NO: 440879 - protein, 9 aa, Homo Sapiens
VVSRNCLAE

SEQ ID NO: 440880 - protein, 9 aa, Homo Sapiens
PVTVRVHLT

SEQ ID NO: 440881 - protein, 9 aa, Homo Sapiens
PCGCNTCRK

SEQ ID NO: 440882 - protein, 9 aa, Homo Sapiens
ATGNGLSYS

SEQ ID NO: 440883 - protein, 9 aa, Homo Sapiens
DSGEGNKES

SEQ ID NO: 440884 - protein, 9 aa, Homo Sapiens
PSPVTNVNK

SEQ ID NO: 440885 - protein, 9 aa, Homo Sapiens
DMYVTATHS

SEQ ID NO: 440886 - protein, 9 aa, Homo Sapiens
SFCCIFLFL

SEQ ID NO: 440887 - protein, 9 aa, Homo Sapiens
NIPESTPLG

SEQ ID NO: 440888 - protein, 9 aa, Homo Sapiens
EDMRNKEDH

SEQ ID NO: 440889 - protein, 9 aa, Homo Sapiens
HDCPCHHGG

SEQ ID NO: 440890 - protein, 9 aa, Homo Sapiens
GCLVQVFFV

SEQ ID NO: 440891 - protein, 9 aa, Homo Sapiens
KETELPKGE

SEQ ID NO: 440892 - protein, 9 aa, Homo Sapiens
AGVQFGLKN

SEQ ID NO: 440893 - protein, 9 aa, Homo Sapiens
ICLQLAPEL

SEQ ID NO: 440894 - protein, 9 aa, Homo Sapiens
VGGMVGQFF

SEQ ID NO: 440895 - protein, 9 aa, Homo Sapiens
AQATRTTVY

SEQ ID NO: 440896 - protein, 9 aa, Homo Sapiens
TRRRTVSQL

SEQ ID NO: 440897 - protein, 9 aa, Homo Sapiens
HNSIQRQLN

SEQ ID NO: 440898 - protein, 9 aa, Homo Sapiens
VLDQGDLYS

SEQ ID NO: 440899 - protein, 9 aa, Homo Sapiens
SPRLPRQNS

SEQ ID NO: 440900 - protein, 9 aa, Homo Sapiens
ISIVSQCPT

SEQ ID NO: 440901 - protein, 9 aa, Homo Sapiens
MSYTLLPPS

SEQ ID NO: 440902 - protein, 9 aa, Homo Sapiens
QIIHTGEKS

SEQ ID NO: 440903 - protein, 9 aa, Homo Sapiens
DTMENLTRL

SEQ ID NO: 440904 - protein, 9 aa, Homo Sapiens
KHIPCYEIT

SEQ ID NO: 440905 - protein, 9 aa, Homo Sapiens
LLCDISTLT

SEQ ID NO: 440906 - protein, 9 aa, Homo Sapiens
QIIHTGEKL

SEQ ID NO: 440907 - protein, 9 aa, Homo Sapiens
TGTLTQNKM

SEQ ID NO: 440908 - protein, 9 aa, Homo Sapiens
ENPAYSKVV

SEQ ID NO: 440909 - protein, 9 aa, Homo Sapiens
KKRNTYSVG

SEQ ID NO: 440910 - protein, 9 aa, Homo Sapiens
GRCRHFQWV

SEQ ID NO: 440911 - protein, 9 aa, Homo Sapiens
TTFDGRHFD

SEQ ID NO: 440912 - protein, 9 aa, Homo Sapiens
RNIKVRENS

SEQ ID NO: 440913 - protein, 9 aa, Homo Sapiens
IALPGHTPR

SEQ ID NO: 440914 - protein, 9 aa, Homo Sapiens
IEGIHREYK

SEQ ID NO: 440915 - protein, 9 aa, Homo Sapiens
FQLCCYGYQ

SEQ ID NO: 440916 - protein, 9 aa, Homo Sapiens
NQETEAIQE

SEQ ID NO: 440917 - protein, 9 aa, Homo Sapiens
TGKKSYACQ

SEQ ID NO: 440918 - protein, 9 aa, Homo Sapiens
KDIEQSITS

SEQ ID NO: 440919 - protein, 9 aa, Homo Sapiens
SPRVAADNV

SEQ ID NO: 440920 - protein, 9 aa, Homo Sapiens
FVVSANDVS

SEQ ID NO: 440921 - protein, 9 aa, Homo Sapiens
LIPNLRNVA

SEQ ID NO: 440922 - protein, 9 aa, Homo Sapiens
QINVSEEMK

SEQ ID NO: 440923 - protein, 9 aa, Homo Sapiens
CGGVSPFGK

SEQ ID NO: 440924 - protein, 9 aa, Homo Sapiens
LEHIPKFLK

SEQ ID NO: 440925 - protein, 9 aa, Homo Sapiens
VISLQHRFY

SEQ ID NO: 440926 - protein, 9 aa, Homo Sapiens
GDPSGLLNN

SEQ ID NO: 440927 - protein, 9 aa, Homo Sapiens
VTNVNKGKI

SEQ ID NO: 440928 - protein, 9 aa, Homo Sapiens
ARCRESYQQ

SEQ ID NO: 440929 - protein, 9 aa, Homo Sapiens
QNDYEARPQ

SEQ ID NO: 440930 - protein, 9 aa, Homo Sapiens
DAVGFSPLQ

SEQ ID NO: 440931 - protein, 9 aa, Homo Sapiens
QYCAQRCGR

SEQ ID NO: 440932 - protein, 9 aa, Homo Sapiens
HYSNVLHVA

SEQ ID NO: 440933 - protein, 9 aa, Homo Sapiens
LVSDFRSKY

SEQ ID NO: 440934 - protein, 9 aa, Homo Sapiens
NERCIQYLA

SEQ ID NO: 440935 - protein, 9 aa, Homo Sapiens
LLGFPTHPE

SEQ ID NO: 440936 - protein, 9 aa, Homo Sapiens
NKVTQSSTI

SEQ ID NO: 440937 - protein, 9 aa, Homo Sapiens
SSEEGSRRL

SEQ ID NO: 440938 - protein, 9 aa, Homo Sapiens
SDKVGEDSE

SEQ ID NO: 440939 - protein, 9 aa, Homo Sapiens
SLTSVQSVN

SEQ ID NO: 440940 - protein, 9 aa, Homo Sapiens
QRLPRTIGM

SEQ ID NO: 440941 - protein, 9 aa, Homo Sapiens
SRKNTKLKG

SEQ ID NO: 440942 - protein, 9 aa, Homo Sapiens
GPAGHFPHL

SEQ ID NO: 440943 - protein, 9 aa, Homo Sapiens
FVGAPITRS

SEQ ID NO: 440944 - protein, 9 aa, Homo Sapiens
YLYLYYKGL

SEQ ID NO: 440945 - protein, 9 aa, Homo Sapiens
SIMAEKLVK

SEQ ID NO: 440946 - protein, 9 aa, Homo Sapiens
VSRTLVVFV

SEQ ID NO: 440947 - protein, 9 aa, Homo Sapiens
TAITSCAFN

SEQ ID NO: 440948 - protein, 9 aa, Homo Sapiens
IGVLNVYIR

SEQ ID NO: 440949 - protein, 9 aa, Homo Sapiens
KKNPLLWMF

SEQ ID NO: 440950 - protein, 9 aa, Homo Sapiens
LLSGFMAPS

SEQ ID NO: 440951 - protein, 9 aa, Homo Sapiens
SRPRRRCSH

SEQ ID NO: 440952 - protein, 9 aa, Homo Sapiens
RGQKEMLEV

SEQ ID NO: 440953 - protein, 9 aa, Homo Sapiens
QEREETDTM

SEQ ID NO: 440954 - protein, 9 aa, Homo Sapiens
KKAFQKRQL

SEQ ID NO: 440955 - protein, 9 aa, Homo Sapiens
WRSLDKATA

SEQ ID NO: 440956 - protein, 9 aa, Homo Sapiens
FDPLLFSCF

SEQ ID NO: 440957 - protein, 9 aa, Homo Sapiens
THLMGLFES

SEQ ID NO: 440958 - protein, 9 aa, Homo Sapiens
SKAVHEPGS

SEQ ID NO: 440959 - protein, 9 aa, Homo Sapiens
GYLPKENPY

SEQ ID NO: 440960 - protein, 9 aa, Homo Sapiens
FSQHPYADN

SEQ ID NO: 440961 - protein, 9 aa, Homo Sapiens
QSSCYLFST

SEQ ID NO: 440962 - protein, 9 aa, Homo Sapiens
LDLLVTDNF

SEQ ID NO: 440963 - protein, 9 aa, Homo Sapiens
RCRSAYEPD

SEQ ID NO: 440964 - protein, 9 aa, Homo Sapiens
AVNNIKCDV

SEQ ID NO: 440965 - protein, 9 aa, Homo Sapiens
LVLVKEANM

SEQ ID NO: 440966 - protein, 9 aa, Homo Sapiens
ELEENIRRL

SEQ ID NO: 440967 - protein, 9 aa, Homo Sapiens
VQAEMPNQL

SEQ ID NO: 440968 - protein, 9 aa, Homo Sapiens
LLHSAADWS

SEQ ID NO: 440969 - protein, 9 aa, Homo Sapiens
EQEKLGAAE

SEQ ID NO: 440970 - protein, 9 aa, Homo Sapiens
FSYYARHQK

SEQ ID NO: 440971 - protein, 9 aa, Homo Sapiens
AEQHVVQEL

SEQ ID NO: 440972 - protein, 9 aa, Homo Sapiens
VAFGYLAAN

SEQ ID NO: 440973 - protein, 9 aa, Homo Sapiens
ELIAYLDKS

SEQ ID NO: 440974 - protein, 9 aa, Homo Sapiens
GLGHGHKQQ

SEQ ID NO: 440975 - protein, 9 aa, Homo Sapiens
WRAFENPHA

SEQ ID NO: 440976 - protein, 9 aa, Homo Sapiens
LKSVLSTNR

SEQ ID NO: 440977 - protein, 9 aa, Homo Sapiens
ARAVYKYAD

SEQ ID NO: 440978 - protein, 9 aa, Homo Sapiens
SKFFNLICL

SEQ ID NO: 440979 - protein, 9 aa, Homo Sapiens
RSASGGSTE

SEQ ID NO: 440980 - protein, 9 aa, Homo Sapiens
ICAQTFFKI

SEQ ID NO: 440981 - protein, 9 aa, Homo Sapiens
MRGNNTFGP

SEQ ID NO: 440982 - protein, 9 aa, Homo Sapiens
EQFGLNEAG

SEQ ID NO: 440983 - protein, 9 aa, Homo Sapiens
ECGKSVSTF

SEQ ID NO: 440984 - protein, 9 aa, Homo Sapiens
LDMVNGQRG

SEQ ID NO: 440985 - protein, 9 aa, Homo Sapiens
LWNIWKETV

SEQ ID NO: 440986 - protein, 9 aa, Homo Sapiens
CLVQVFFVF

SEQ ID NO: 440987 - protein, 9 aa, Homo Sapiens
TNEDSLIEI

SEQ ID NO: 440988 - protein, 9 aa, Homo Sapiens
WQENQKQCE

SEQ ID NO: 440989 - protein, 9 aa, Homo Sapiens
KCLNEIQGE

SEQ ID NO: 440990 - protein, 9 aa, Homo Sapiens
QEDALFASQ

SEQ ID NO: 440991 - protein, 9 aa, Homo Sapiens
DTTGVSRTH

SEQ ID NO: 440992 - protein, 9 aa, Homo Sapiens
STDEDLDSV

SEQ ID NO: 440993 - protein, 9 aa, Homo Sapiens
RAALSNTVA

SEQ ID NO: 440994 - protein, 9 aa, Homo Sapiens
DRIVADLDT

SEQ ID NO: 440995 - protein, 9 aa, Homo Sapiens
LLGMYRLNV

SEQ ID NO: 440996 - protein, 9 aa, Homo Sapiens
DHLELLNIV

SEQ ID NO: 440997 - protein, 9 aa, Homo Sapiens
EDTSNFCHP

SEQ ID NO: 440998 - protein, 9 aa, Homo Sapiens
NADPILTNL

SEQ ID NO: 440999 - protein, 9 aa, Homo Sapiens
CLKEKISLS

SEQ ID NO: 441000 - protein, 9 aa, Homo Sapiens
FTDKYANVR

SEQ ID NO: 441001 - protein, 9 aa, Homo Sapiens
FMVVGFWVG

SEQ ID NO: 441002 - protein, 9 aa, Homo Sapiens
QNYFASCKL

SEQ ID NO: 441003 - protein, 9 aa, Homo Sapiens
SHALKQKFT

SEQ ID NO: 441004 - protein, 9 aa, Homo Sapiens
CNLEYLDNW

SEQ ID NO: 441005 - protein, 9 aa, Homo Sapiens
KRGQKEMLE

SEQ ID NO: 441006 - protein, 9 aa, Homo Sapiens
AYYAMDFDW

SEQ ID NO: 441007 - protein, 9 aa, Homo Sapiens
VIAGSSNVK

SEQ ID NO: 441008 - protein, 9 aa, Homo Sapiens
TSQYIKLIS

SEQ ID NO: 441009 - protein, 9 aa, Homo Sapiens
SAHKYSSSP

SEQ ID NO: 441010 - protein, 9 aa, Homo Sapiens
LPVVRTWHL

SEQ ID NO: 441011 - protein, 9 aa, Homo Sapiens
HEDLNTFKA

SEQ ID NO: 441012 - protein, 9 aa, Homo Sapiens
SSNLIKHKT

SEQ ID NO: 441013 - protein, 9 aa, Homo Sapiens
SFCKSNLIH

SEQ ID NO: 441014 - protein, 9 aa, Homo Sapiens
FCKSNLIHH

SEQ ID NO: 441015 - protein, 9 aa, Homo Sapiens
YEIKMFCTS

SEQ ID NO: 441016 - protein, 9 aa, Homo Sapiens
TFQGLLGKI

SEQ ID NO: 441017 - protein, 9 aa, Homo Sapiens
KRKLKNKQQ

SEQ ID NO: 441018 - protein, 9 aa, Homo Sapiens
GDFEQTLKG

SEQ ID NO: 441019 - protein, 9 aa, Homo Sapiens
SFQAGYGAG

SEQ ID NO: 441020 - protein, 9 aa, Homo Sapiens
EFFILAVMS

SEQ ID NO: 441021 - protein, 9 aa, Homo Sapiens
RALLTFDGF

SEQ ID NO: 441022 - protein, 9 aa, Homo Sapiens
DQYKLYDPP

SEQ ID NO: 441023 - protein, 9 aa, Homo Sapiens
RNAIGNFAL

SEQ ID NO: 441024 - protein, 9 aa, Homo Sapiens
SDPEDESKV

SEQ ID NO: 441025 - protein, 9 aa, Homo Sapiens
NGLCGYLLK

SEQ ID NO: 441026 - protein, 9 aa, Homo Sapiens
ERRYSDFTK

SEQ ID NO: 441027 - protein, 9 aa, Homo Sapiens
PIGTTASSD

SEQ ID NO: 441028 - protein, 9 aa, Homo Sapiens
TSPTKYPTT

SEQ ID NO: 441029 - protein, 9 aa, Homo Sapiens
LSYLSIDSE

SEQ ID NO: 441030 - protein, 9 aa, Homo Sapiens
TMDESHILE

SEQ ID NO: 441031 - protein, 9 aa, Homo Sapiens
GMTALLKVY

SEQ ID NO: 441032 - protein, 9 aa, Homo Sapiens
ATVGSSMYT

SEQ ID NO: 441033 - protein, 9 aa, Homo Sapiens
SNYADQFNM

SEQ ID NO: 441034 - protein, 9 aa, Homo Sapiens
GRYQCTVEN

SEQ ID NO: 441035 - protein, 9 aa, Homo Sapiens
FTKLQKALL

SEQ ID NO: 441036 - protein, 9 aa, Homo Sapiens
LSTCPDKGI

SEQ ID NO: 441037 - protein, 9 aa, Homo Sapiens
KIESNTPAP

SEQ ID NO: 441038 - protein, 9 aa, Homo Sapiens
EKKECWLWE

SEQ ID NO: 441039 - protein, 9 aa, Homo Sapiens
SHKHIYYSD

SEQ ID NO: 441040 - protein, 9 aa, Homo Sapiens
AVGFSPLQI

SEQ ID NO: 441041 - protein, 9 aa, Homo Sapiens
LQGMRKGSA

SEQ ID NO: 441042 - protein, 9 aa, Homo Sapiens
RQPKDKNVK

SEQ ID NO: 441043 - protein, 9 aa, Homo Sapiens
YVLQSIIKI

SEQ ID NO: 441044 - protein, 9 aa, Homo Sapiens
TLTHTDLKP

SEQ ID NO: 441045 - protein, 9 aa, Homo Sapiens
EWNREYTYQ

SEQ ID NO: 441046 - protein, 9 aa, Homo Sapiens
LEEVNNVIS

SEQ ID NO: 441047 - protein, 9 aa, Homo Sapiens
DKFSVWQHI

SEQ ID NO: 441048 - protein, 9 aa, Homo Sapiens
WMSPYLFFR

SEQ ID NO: 441049 - protein, 9 aa, Homo Sapiens
ASGVVELVK

SEQ ID NO: 441050 - protein, 9 aa, Homo Sapiens
DSKSKKRPL

SEQ ID NO: 441051 - protein, 9 aa, Homo Sapiens
TKSSALVSQ

SEQ ID NO: 441052 - protein, 9 aa, Homo Sapiens
VHLTGWLMT

SEQ ID NO: 441053 - protein, 9 aa, Homo Sapiens
KADNWKRYK

SEQ ID NO: 441054 - protein, 9 aa, Homo Sapiens
DHTIQALGH

SEQ ID NO: 441055 - protein, 9 aa, Homo Sapiens
LKQQMNSAS

SEQ ID NO: 441056 - protein, 9 aa, Homo Sapiens
VINMLCNFR

SEQ ID NO: 441057 - protein, 9 aa, Homo Sapiens
PPGPPGPMS

SEQ ID NO: 441058 - protein, 9 aa, Homo Sapiens
AYYSHERCT

SEQ ID NO: 441059 - protein, 9 aa, Homo Sapiens
MEDNLLRIT

SEQ ID NO: 441060 - protein, 9 aa, Homo Sapiens
IQSFDEITA

SEQ ID NO: 441061 - protein, 9 aa, Homo Sapiens
PCVDRLWQK

SEQ ID NO: 441062 - protein, 9 aa, Homo Sapiens
SSQSSSSSG

SEQ ID NO: 441063 - protein, 9 aa, Homo Sapiens
QDLKPENIL

SEQ ID NO: 441064 - protein, 9 aa, Homo Sapiens
MVFHPQSHF

SEQ ID NO: 441065 - protein, 9 aa, Homo Sapiens
VQLICTVCL

SEQ ID NO: 441066 - protein, 9 aa, Homo Sapiens
TFFCHPLNL

SEQ ID NO: 441067 - protein, 9 aa, Homo Sapiens
HYTTFDGRH

SEQ ID NO: 441068 - protein, 9 aa, Homo Sapiens
VFQFQPISC

SEQ ID NO: 441069 - protein, 9 aa, Homo Sapiens
TARALGNLV

SEQ ID NO: 441070 - protein, 9 aa, Homo Sapiens
FVLKNCSEG

SEQ ID NO: 441071 - protein, 9 aa, Homo Sapiens
ACTQNGQMH

SEQ ID NO: 441072 - protein, 9 aa, Homo Sapiens
ECLKLNKTP

SEQ ID NO: 441073 - protein, 9 aa, Homo Sapiens
ALPTFCKLY

SEQ ID NO: 441074 - protein, 9 aa, Homo Sapiens
NCDLPSRTV

SEQ ID NO: 441075 - protein, 9 aa, Homo Sapiens
FSKADIYTH

SEQ ID NO: 441076 - protein, 9 aa, Homo Sapiens
VHGFLQTLL

SEQ ID NO: 441077 - protein, 9 aa, Homo Sapiens
KGMIVITDG

SEQ ID NO: 441078 - protein, 9 aa, Homo Sapiens
YLTWSVPNC

SEQ ID NO: 441079 - protein, 9 aa, Homo Sapiens
LKHERLRTY

SEQ ID NO: 441080 - protein, 9 aa, Homo Sapiens
FNVTVLIQD

SEQ ID NO: 441081 - protein, 9 aa, Homo Sapiens
GANASNYPN

SEQ ID NO: 441082 - protein, 9 aa, Homo Sapiens
EPWYKLFSE

SEQ ID NO: 441083 - protein, 9 aa, Homo Sapiens
CVHKEKSVV

SEQ ID NO: 441084 - protein, 9 aa, Homo Sapiens
CIDHLLHKN

SEQ ID NO: 441085 - protein, 9 aa, Homo Sapiens
DLNTFKAVC

SEQ ID NO: 441086 - protein, 9 aa, Homo Sapiens
EECSNMFPK

SEQ ID NO: 441087 - protein, 9 aa, Homo Sapiens
FTIYNNMLC

SEQ ID NO: 441088 - protein, 9 aa, Homo Sapiens
WMFALHSNR

SEQ ID NO: 441089 - protein, 9 aa, Homo Sapiens
LTKSDLKHT

SEQ ID NO: 441090 - protein, 9 aa, Homo Sapiens
NHLFCEFSS

SEQ ID NO: 441091 - protein, 9 aa, Homo Sapiens
LQQLVEADI

SEQ ID NO: 441092 - protein, 9 aa, Homo Sapiens
PSLQAYSHG

SEQ ID NO: 441093 - protein, 9 aa, Homo Sapiens
QIDTVTGPN

SEQ ID NO: 441094 - protein, 9 aa, Homo Sapiens
MIPGSHPKG

SEQ ID NO: 441095 - protein, 9 aa, Homo Sapiens
IPRWTHLVQ

SEQ ID NO: 441096 - protein, 9 aa, Homo Sapiens
HMWLRPDLH

SEQ ID NO: 441097 - protein, 9 aa, Homo Sapiens
AQLYPVGMY

SEQ ID NO: 441098 - protein, 9 aa, Homo Sapiens
SQYIMGPNI

SEQ ID NO: 441099 - protein, 9 aa, Homo Sapiens
SDSVDGGHN

SEQ ID NO: 441100 - protein, 9 aa, Homo Sapiens
SPTSYRCAG

SEQ ID NO: 441101 - protein, 9 aa, Homo Sapiens
RKLKDVYGK

SEQ ID NO: 441102 - protein, 9 aa, Homo Sapiens
AYNLFAVNS

SEQ ID NO: 441103 - protein, 9 aa, Homo Sapiens
RRSRVGSPQ

SEQ ID NO: 441104 - protein, 9 aa, Homo Sapiens
YFNEFTDIP

SEQ ID NO: 441105 - protein, 9 aa, Homo Sapiens
IQVSPFILA

SEQ ID NO: 441106 - protein, 9 aa, Homo Sapiens
IESTVSNNL

SEQ ID NO: 441107 - protein, 9 aa, Homo Sapiens
KCYNPHTDH

SEQ ID NO: 441108 - protein, 9 aa, Homo Sapiens
TANEKLEWN

SEQ ID NO: 441109 - protein, 9 aa, Homo Sapiens
KTLRLRLRC

SEQ ID NO: 441110 - protein, 9 aa, Homo Sapiens
DNMNLANNF

SEQ ID NO: 441111 - protein, 9 aa, Homo Sapiens
YWKTQAANI

SEQ ID NO: 441112 - protein, 9 aa, Homo Sapiens
SQKICSCLL

SEQ ID NO: 441113 - protein, 9 aa, Homo Sapiens
GKGYIIQTR

SEQ ID NO: 441114 - protein, 9 aa, Homo Sapiens
EENKIGTYF

SEQ ID NO: 441115 - protein, 9 aa, Homo Sapiens
SVSGLGTTS

SEQ ID NO: 441116 - protein, 9 aa, Homo Sapiens
LWLEHNLER

SEQ ID NO: 441117 - protein, 9 aa, Homo Sapiens
EVEHLTKVL

SEQ ID NO: 441118 - protein, 9 aa, Homo Sapiens
KEPFYKVLL

SEQ ID NO: 441119 - protein, 9 aa, Homo Sapiens
YEKKDNTFC

SEQ ID NO: 441120 - protein, 9 aa, Homo Sapiens
VFIVTIILH

SEQ ID NO: 441121 - protein, 9 aa, Homo Sapiens
CLECMRSFN

SEQ ID NO: 441122 - protein, 9 aa, Homo Sapiens
CTDNPNWAL

SEQ ID NO: 441123 - protein, 9 aa, Homo Sapiens
GCNTCRKDC

SEQ ID NO: 441124 - protein, 9 aa, Homo Sapiens
KWSSGFISE

SEQ ID NO: 441125 - protein, 9 aa, Homo Sapiens
PEGYTPQTD

SEQ ID NO: 441126 - protein, 9 aa, Homo Sapiens
KDNTFCMAI

SEQ ID NO: 441127 - protein, 9 aa, Homo Sapiens
NIFCETSQK

SEQ ID NO: 441128 - protein, 9 aa, Homo Sapiens
DEIQKMLPE

SEQ ID NO: 441129 - protein, 9 aa, Homo Sapiens
LRLESCIRD

SEQ ID NO: 441130 - protein, 9 aa, Homo Sapiens
VSDFRSKYE

SEQ ID NO: 441131 - protein, 9 aa, Homo Sapiens
GGYENGYYC

SEQ ID NO: 441132 - protein, 9 aa, Homo Sapiens
TLNLNSKLA

SEQ ID NO: 441133 - protein, 9 aa, Homo Sapiens
NEAGLEDSV

SEQ ID NO: 441134 - protein, 9 aa, Homo Sapiens
VPESGLWVS

SEQ ID NO: 441135 - protein, 9 aa, Homo Sapiens
VEIDLRHWI

SEQ ID NO: 441136 - protein, 9 aa, Homo Sapiens
WRLCKTCYH

SEQ ID NO: 441137 - protein, 9 aa, Homo Sapiens
AVYLFNGAS

SEQ ID NO: 441138 - protein, 9 aa, Homo Sapiens
DLFGDTPKR

SEQ ID NO: 441139 - protein, 9 aa, Homo Sapiens
EERKLQENL

SEQ ID NO: 441140 - protein, 9 aa, Homo Sapiens
RDVTRRKMA

SEQ ID NO: 441141 - protein, 9 aa, Homo Sapiens
VIVPCRSCL

SEQ ID NO: 441142 - protein, 9 aa, Homo Sapiens
PSAPSTLAG

SEQ ID NO: 441143 - protein, 9 aa, Homo Sapiens
TQPPQQLLQ

SEQ ID NO: 441144 - protein, 9 aa, Homo Sapiens
LTSKLFSYK

SEQ ID NO: 441145 - protein, 9 aa, Homo Sapiens
QNFNKQNKL

SEQ ID NO: 441146 - protein, 9 aa, Homo Sapiens
SISKQNVIS

SEQ ID NO: 441147 - protein, 9 aa, Homo Sapiens
LDLNLKLSK

SEQ ID NO: 441148 - protein, 9 aa, Homo Sapiens
TLVFRLLKR

SEQ ID NO: 441149 - protein, 9 aa, Homo Sapiens
EEREYNCQM

SEQ ID NO: 441150 - protein, 9 aa, Homo Sapiens
QTIFVQVSL

SEQ ID NO: 441151 - protein, 9 aa, Homo Sapiens
KAFISNLNK

SEQ ID NO: 441152 - protein, 9 aa, Homo Sapiens
FVSVADLIG

SEQ ID NO: 441153 - protein, 9 aa, Homo Sapiens
MNRKPHHKN

SEQ ID NO: 441154 - protein, 9 aa, Homo Sapiens
AEHFYLTAL

SEQ ID NO: 441155 - protein, 9 aa, Homo Sapiens
SRMNISDIG

SEQ ID NO: 441156 - protein, 9 aa, Homo Sapiens
EGIKKVITP

SEQ ID NO: 441157 - protein, 9 aa, Homo Sapiens
NLKVKVVFD

SEQ ID NO: 441158 - protein, 9 aa, Homo Sapiens
DRSRFLRSV

SEQ ID NO: 441159 - protein, 9 aa, Homo Sapiens
NVVQIQKLQ

SEQ ID NO: 441160 - protein, 9 aa, Homo Sapiens
QVRMEWPTD

SEQ ID NO: 441161 - protein, 9 aa, Homo Sapiens
RYFSDSSPQ

SEQ ID NO: 441162 - protein, 9 aa, Homo Sapiens
QGMVFLASK

SEQ ID NO: 441163 - protein, 9 aa, Homo Sapiens
SPLFKVLVA

SEQ ID NO: 441164 - protein, 9 aa, Homo Sapiens
EDIASGLEH

SEQ ID NO: 441165 - protein, 9 aa, Homo Sapiens
IWNLVWKTS

SEQ ID NO: 441166 - protein, 9 aa, Homo Sapiens
LLGQLYKCH

SEQ ID NO: 441167 - protein, 9 aa, Homo Sapiens
PKNFHSPMV

SEQ ID NO: 441168 - protein, 9 aa, Homo Sapiens
RKCIRHEPL

SEQ ID NO: 441169 - protein, 9 aa, Homo Sapiens
NHLGVLIDL

SEQ ID NO: 441170 - protein, 9 aa, Homo Sapiens
VIHKVAFLR

SEQ ID NO: 441171 - protein, 9 aa, Homo Sapiens
SLSTCPDKG

SEQ ID NO: 441172 - protein, 9 aa, Homo Sapiens
EVLQRCLCA

SEQ ID NO: 441173 - protein, 9 aa, Homo Sapiens
TKRNDMQLD

SEQ ID NO: 441174 - protein, 9 aa, Homo Sapiens
KPILDSVTS

SEQ ID NO: 441175 - protein, 9 aa, Homo Sapiens
AYDLKTQVP

SEQ ID NO: 441176 - protein, 9 aa, Homo Sapiens
FIFLFGVYV

SEQ ID NO: 441177 - protein, 9 aa, Homo Sapiens
EAVIYVAFS

SEQ ID NO: 441178 - protein, 9 aa, Homo Sapiens
KWLLLCLEK

SEQ ID NO: 441179 - protein, 9 aa, Homo Sapiens
KDREVPTRK

SEQ ID NO: 441180 - protein, 9 aa, Homo Sapiens
PDYNLFNNY

SEQ ID NO: 441181 - protein, 9 aa, Homo Sapiens
KCKGSLLDD

SEQ ID NO: 441182 - protein, 9 aa, Homo Sapiens
SNCSGLFPS

SEQ ID NO: 441183 - protein, 9 aa, Homo Sapiens
GFSKFQAEL

SEQ ID NO: 441184 - protein, 9 aa, Homo Sapiens
SSSSDELFC

SEQ ID NO: 441185 - protein, 9 aa, Homo Sapiens
TMNYDICKV

SEQ ID NO: 441186 - protein, 9 aa, Homo Sapiens
QVQKLKAIL

SEQ ID NO: 441187 - protein, 9 aa, Homo Sapiens
LLHSPLFKV

SEQ ID NO: 441188 - protein, 9 aa, Homo Sapiens
ANELTLMIT

SEQ ID NO: 441189 - protein, 9 aa, Homo Sapiens
TYKNLNRAK

SEQ ID NO: 441190 - protein, 9 aa, Homo Sapiens
QDEWALLDS

SEQ ID NO: 441191 - protein, 9 aa, Homo Sapiens
SEVDCVLKP

SEQ ID NO: 441192 - protein, 9 aa, Homo Sapiens
ENNTKEMKK

SEQ ID NO: 441193 - protein, 9 aa, Homo Sapiens
RGAKNYVSL

SEQ ID NO: 441194 - protein, 9 aa, Homo Sapiens
PHHNYVTRY

SEQ ID NO: 441195 - protein, 9 aa, Homo Sapiens
HFQTQQLLE

SEQ ID NO: 441196 - protein, 9 aa, Homo Sapiens
VMGATECMI

SEQ ID NO: 441197 - protein, 9 aa, Homo Sapiens
IQVRTPKPD

SEQ ID NO: 441198 - protein, 9 aa, Homo Sapiens
RFKPDKDLL

SEQ ID NO: 441199 - protein, 9 aa, Homo Sapiens
EIISLDILK

SEQ ID NO: 441200 - protein, 9 aa, Homo Sapiens
RIIAGQMNI

SEQ ID NO: 441201 - protein, 9 aa, Homo Sapiens
KKLLGQLYK

SEQ ID NO: 441202 - protein, 9 aa, Homo Sapiens
RDSLLRQTI

SEQ ID NO: 441203 - protein, 9 aa, Homo Sapiens
PLFPSLCVE

SEQ ID NO: 441204 - protein, 9 aa, Homo Sapiens
PHIANIGHL

SEQ ID NO: 441205 - protein, 9 aa, Homo Sapiens
CFCPAEITG

SEQ ID NO: 441206 - protein, 9 aa, Homo Sapiens
SCKDLCGGG

SEQ ID NO: 441207 - protein, 9 aa, Homo Sapiens
SHLTAVILF

SEQ ID NO: 441208 - protein, 9 aa, Homo Sapiens
VLVGNNCDL

SEQ ID NO: 441209 - protein, 9 aa, Homo Sapiens
NQVLLFLKY

SEQ ID NO: 441210 - protein, 9 aa, Homo Sapiens
LQKSVYMIM

SEQ ID NO: 441211 - protein, 9 aa, Homo Sapiens
YMIMDMFCP

SEQ ID NO: 441212 - protein, 9 aa, Homo Sapiens
DFGISSRSQ

SEQ ID NO: 441213 - protein, 9 aa, Homo Sapiens
CPCKIIKKE

SEQ ID NO: 441214 - protein, 9 aa, Homo Sapiens
KQRRPLKDK

SEQ ID NO: 441215 - protein, 9 aa, Homo Sapiens
KQRRPLKDI

SEQ ID NO: 441216 - protein, 9 aa, Homo Sapiens
VVEIDNATL

SEQ ID NO: 441217 - protein, 9 aa, Homo Sapiens
YKHEQVYIQ

SEQ ID NO: 441218 - protein, 9 aa, Homo Sapiens
ELTENQKNC

SEQ ID NO: 441219 - protein, 9 aa, Homo Sapiens
DETNKGTQT

SEQ ID NO: 441220 - protein, 9 aa, Homo Sapiens
VIGTPNEDT

SEQ ID NO: 441221 - protein, 9 aa, Homo Sapiens
LRMSERRSF

SEQ ID NO: 441222 - protein, 9 aa, Homo Sapiens
LRLRCCHRF

SEQ ID NO: 441223 - protein, 9 aa, Homo Sapiens
EDVFQNLTH

SEQ ID NO: 441224 - protein, 9 aa, Homo Sapiens
DILRRTDKN

SEQ ID NO: 441225 - protein, 9 aa, Homo Sapiens
RSQRILQRI

SEQ ID NO: 441226 - protein, 9 aa, Homo Sapiens
NTSVFVVDP

SEQ ID NO: 441227 - protein, 9 aa, Homo Sapiens
GLCDKPGEC

SEQ ID NO: 441228 - protein, 9 aa, Homo Sapiens
AWEQMGRYQ

SEQ ID NO: 441229 - protein, 9 aa, Homo Sapiens
TTYVHVQQG

SEQ ID NO: 441230 - protein, 9 aa, Homo Sapiens
RLCKTCYHI

SEQ ID NO: 441231 - protein, 9 aa, Homo Sapiens
EGCLVQVFF

SEQ ID NO: 441232 - protein, 9 aa, Homo Sapiens
LLCQDNNFL

SEQ ID NO: 441233 - protein, 9 aa, Homo Sapiens
MSAPNMPLI

SEQ ID NO: 441234 - protein, 9 aa, Homo Sapiens
AAGTAEEFT

SEQ ID NO: 441235 - protein, 9 aa, Homo Sapiens
EFVVTIPRA

SEQ ID NO: 441236 - protein, 9 aa, Homo Sapiens
HVRCIEQTH

SEQ ID NO: 441237 - protein, 9 aa, Homo Sapiens
LNRNSLCRQ

SEQ ID NO: 441238 - protein, 9 aa, Homo Sapiens
DLTVPNLPP

SEQ ID NO: 441239 - protein, 9 aa, Homo Sapiens
HPSTGTGVM

SEQ ID NO: 441240 - protein, 9 aa, Homo Sapiens
TENINNTFI

SEQ ID NO: 441241 - protein, 9 aa, Homo Sapiens
ALVSSIPVS

SEQ ID NO: 441242 - protein, 9 aa, Homo Sapiens
CNNYAEMHA

SEQ ID NO: 441243 - protein, 9 aa, Homo Sapiens
LNLQEGELL

SEQ ID NO: 441244 - protein, 9 aa, Homo Sapiens
RENYVSRPH

SEQ ID NO: 441245 - protein, 9 aa, Homo Sapiens
SGSPTSYRC

SEQ ID NO: 441246 - protein, 9 aa, Homo Sapiens
HRSLHRSGS

SEQ ID NO: 441247 - protein, 9 aa, Homo Sapiens
EIGFTLSEN

SEQ ID NO: 441248 - protein, 9 aa, Homo Sapiens
YIRISPDNR

SEQ ID NO: 441249 - protein, 9 aa, Homo Sapiens
ENMILLTFP

SEQ ID NO: 441250 - protein, 9 aa, Homo Sapiens
STFCSQYIM

SEQ ID NO: 441251 - protein, 9 aa, Homo Sapiens
YQNPDYNLF

SEQ ID NO: 441252 - protein, 9 aa, Homo Sapiens
DLTPLIISN

SEQ ID NO: 441253 - protein, 9 aa, Homo Sapiens
VASAEYQEA

SEQ ID NO: 441254 - protein, 9 aa, Homo Sapiens
ILLFHHDMN

SEQ ID NO: 441255 - protein, 9 aa, Homo Sapiens
CYEITSVPC

SEQ ID NO: 441256 - protein, 9 aa, Homo Sapiens
YCVEKWCCD

SEQ ID NO: 441257 - protein, 9 aa, Homo Sapiens
YQESFREVI

SEQ ID NO: 441258 - protein, 9 aa, Homo Sapiens
WMYESTSFF

SEQ ID NO: 441259 - protein, 9 aa, Homo Sapiens
VWDVEKSFM

SEQ ID NO: 441260 - protein, 9 aa, Homo Sapiens
LDQQNQVLE

SEQ ID NO: 441261 - protein, 9 aa, Homo Sapiens
ILEAAKQVH

SEQ ID NO: 441262 - protein, 9 aa, Homo Sapiens
KLTELCHMW

SEQ ID NO: 441263 - protein, 9 aa, Homo Sapiens
EGHKAELTE

SEQ ID NO: 441264 - protein, 9 aa, Homo Sapiens
FSEARYKDV

SEQ ID NO: 441265 - protein, 9 aa, Homo Sapiens
KSRSYRHKN

SEQ ID NO: 441266 - protein, 9 aa, Homo Sapiens
RFRAALSNT

SEQ ID NO: 441267 - protein, 9 aa, Homo Sapiens
SVKYQNQHT

SEQ ID NO: 441268 - protein, 9 aa, Homo Sapiens
NLCSRRFTM

SEQ ID NO: 441269 - protein, 9 aa, Homo Sapiens
EGIHLIKVF

SEQ ID NO: 441270 - protein, 9 aa, Homo Sapiens
KVKDIHSTA

SEQ ID NO: 441271 - protein, 9 aa, Homo Sapiens
PPENPVLLL

SEQ ID NO: 441272 - protein, 9 aa, Homo Sapiens
NENNRPRRR

SEQ ID NO: 441273 - protein, 9 aa, Homo Sapiens
EHLTEACTD

SEQ ID NO: 441274 - protein, 9 aa, Homo Sapiens
WMTQFSAEN

SEQ ID NO: 441275 - protein, 9 aa, Homo Sapiens
YVIEDPSMK

SEQ ID NO: 441276 - protein, 9 aa, Homo Sapiens
LLQCYFVLE

SEQ ID NO: 441277 - protein, 9 aa, Homo Sapiens
YVHQLLRQT

SEQ ID NO: 441278 - protein, 9 aa, Homo Sapiens
ILSLYEVVH

SEQ ID NO: 441279 - protein, 9 aa, Homo Sapiens
INVFNKHDG

SEQ ID NO: 441280 - protein, 9 aa, Homo Sapiens
NYIFAEYAK

SEQ ID NO: 441281 - protein, 9 aa, Homo Sapiens
DKLLKQMRI

SEQ ID NO: 441282 - protein, 9 aa, Homo Sapiens
VTNGGQEWK

SEQ ID NO: 441283 - protein, 9 aa, Homo Sapiens
DMSSLGKSS

SEQ ID NO: 441284 - protein, 9 aa, Homo Sapiens
WNLLEVSEV

SEQ ID NO: 441285 - protein, 9 aa, Homo Sapiens
ILKMKYFQQ

SEQ ID NO: 441286 - protein, 9 aa, Homo Sapiens
ITGKWLLLL

SEQ ID NO: 441287 - protein, 9 aa, Homo Sapiens
RWHILQKQE

SEQ ID NO: 441288 - protein, 9 aa, Homo Sapiens
SLGFYVGQP

SEQ ID NO: 441289 - protein, 9 aa, Homo Sapiens
KSVSSTNFS

SEQ ID NO: 441290 - protein, 9 aa, Homo Sapiens
LGCGGNGLF

SEQ ID NO: 441291 - protein, 9 aa, Homo Sapiens
EYEAGSTTP

SEQ ID NO: 441292 - protein, 9 aa, Homo Sapiens
VEVPESGLW

SEQ ID NO: 441293 - protein, 9 aa, Homo Sapiens
GHLYACQVA

SEQ ID NO: 441294 - protein, 9 aa, Homo Sapiens
SAVDSQEIY

SEQ ID NO: 441295 - protein, 9 aa, Homo Sapiens
EIINRVIDR

SEQ ID NO: 441296 - protein, 9 aa, Homo Sapiens
QSHFTTPAP

SEQ ID NO: 441297 - protein, 9 aa, Homo Sapiens
LDIDLHVQI

SEQ ID NO: 441298 - protein, 9 aa, Homo Sapiens
KNEDRKKGK

SEQ ID NO: 441299 - protein, 9 aa, Homo Sapiens
ELQLMKELA

SEQ ID NO: 441300 - protein, 9 aa, Homo Sapiens
NKFQVRDSV

SEQ ID NO: 441301 - protein, 9 aa, Homo Sapiens
KQYKNLYFM

SEQ ID NO: 441302 - protein, 9 aa, Homo Sapiens
CLLLITAVV

SEQ ID NO: 441303 - protein, 9 aa, Homo Sapiens
VKPYSYVEK

SEQ ID NO: 441304 - protein, 9 aa, Homo Sapiens
EDLERTFFA

SEQ ID NO: 441305 - protein, 9 aa, Homo Sapiens
ATETSMDTA

SEQ ID NO: 441306 - protein, 9 aa, Homo Sapiens
NIEEHRGSS

SEQ ID NO: 441307 - protein, 9 aa, Homo Sapiens
CNKTSFFFE

SEQ ID NO: 441308 - protein, 9 aa, Homo Sapiens
NDELKTQSK

SEQ ID NO: 441309 - protein, 9 aa, Homo Sapiens
TKTLLHDHE

SEQ ID NO: 441310 - protein, 9 aa, Homo Sapiens
HYPCDPLIV

SEQ ID NO: 441311 - protein, 9 aa, Homo Sapiens
AVLPLARAH

SEQ ID NO: 441312 - protein, 9 aa, Homo Sapiens
MNSPMGKST

SEQ ID NO: 441313 - protein, 9 aa, Homo Sapiens
THPIYKAMA

SEQ ID NO: 441314 - protein, 9 aa, Homo Sapiens
RACDKILSD

SEQ ID NO: 441315 - protein, 9 aa, Homo Sapiens
AVYFLARTR

SEQ ID NO: 441316 - protein, 9 aa, Homo Sapiens
LKKVHKEEI

SEQ ID NO: 441317 - protein, 9 aa, Homo Sapiens
CYVLSFATI

SEQ ID NO: 441318 - protein, 9 aa, Homo Sapiens
CVTYMCECP

SEQ ID NO: 441319 - protein, 9 aa, Homo Sapiens
KTKVEWFPD

SEQ ID NO: 441320 - protein, 9 aa, Homo Sapiens
GPKHEVLQR

SEQ ID NO: 441321 - protein, 9 aa, Homo Sapiens
EELPEVVHK

SEQ ID NO: 441322 - protein, 9 aa, Homo Sapiens
GQMHLNRDI

SEQ ID NO: 441323 - protein, 9 aa, Homo Sapiens
LHSNTLTHT

SEQ ID NO: 441324 - protein, 9 aa, Homo Sapiens
ELLEDSGIS

SEQ ID NO: 441325 - protein, 9 aa, Homo Sapiens
WFVGYKITF

SEQ ID NO: 441326 - protein, 9 aa, Homo Sapiens
RTIYHFSAK

SEQ ID NO: 441327 - protein, 9 aa, Homo Sapiens
QGKFEYNGL

SEQ ID NO: 441328 - protein, 9 aa, Homo Sapiens
LEKYLGTGL

SEQ ID NO: 441329 - protein, 9 aa, Homo Sapiens
PSRQNELLK

SEQ ID NO: 441330 - protein, 9 aa, Homo Sapiens
RLCIVHVVA

SEQ ID NO: 441331 - protein, 9 aa, Homo Sapiens
WKWVSQNRL

SEQ ID NO: 441332 - protein, 9 aa, Homo Sapiens
GIEDYFQKM

SEQ ID NO: 441333 - protein, 9 aa, Homo Sapiens
NKKEICIEK

SEQ ID NO: 441334 - protein, 9 aa, Homo Sapiens
IVTANFVEL

SEQ ID NO: 441335 - protein, 9 aa, Homo Sapiens
VVPAMQLTS

SEQ ID NO: 441336 - protein, 9 aa, Homo Sapiens
KLGRPQIKK

SEQ ID NO: 441337 - protein, 9 aa, Homo Sapiens
AVALLFLLQ

SEQ ID NO: 441338 - protein, 9 aa, Homo Sapiens
SGVVELVKS

SEQ ID NO: 441339 - protein, 9 aa, Homo Sapiens
LGVVATKVR

SEQ ID NO: 441340 - protein, 9 aa, Homo Sapiens
YFHDKNATK

SEQ ID NO: 441341 - protein, 9 aa, Homo Sapiens
VNFCTEKEY

SEQ ID NO: 441342 - protein, 9 aa, Homo Sapiens
LPSPTAVSS

SEQ ID NO: 441343 - protein, 9 aa, Homo Sapiens
AQKTGLITP

SEQ ID NO: 441344 - protein, 9 aa, Homo Sapiens
DEEAWRFLI

SEQ ID NO: 441345 - protein, 9 aa, Homo Sapiens
VDLNQTIFV

SEQ ID NO: 441346 - protein, 9 aa, Homo Sapiens
VWYLGYLAR

SEQ ID NO: 441347 - protein, 9 aa, Homo Sapiens
PCDLIHLNT

SEQ ID NO: 441348 - protein, 9 aa, Homo Sapiens
KKVRFVNSL

SEQ ID NO: 441349 - protein, 9 aa, Homo Sapiens
ALEHLYDSK

SEQ ID NO: 441350 - protein, 9 aa, Homo Sapiens
QNVFIGEKN

SEQ ID NO: 441351 - protein, 9 aa, Homo Sapiens
AKKPRFDLE

SEQ ID NO: 441352 - protein, 9 aa, Homo Sapiens
HFEHNFCKA

SEQ ID NO: 441353 - protein, 9 aa, Homo Sapiens
DKNATKPTF

SEQ ID NO: 441354 - protein, 9 aa, Homo Sapiens
RERLRVWDI

SEQ ID NO: 441355 - protein, 9 aa, Homo Sapiens
FVMGATECM

SEQ ID NO: 441356 - protein, 9 aa, Homo Sapiens
DNWTPQRVA

SEQ ID NO: 441357 - protein, 9 aa, Homo Sapiens
EVSGKHEDK

SEQ ID NO: 441358 - protein, 9 aa, Homo Sapiens
NMSYTLLPP

SEQ ID NO: 441359 - protein, 9 aa, Homo Sapiens
AQGLTVAAI

SEQ ID NO: 441360 - protein, 9 aa, Homo Sapiens
SENNTKEMK

SEQ ID NO: 441361 - protein, 9 aa, Homo Sapiens
FPLALHTQS

SEQ ID NO: 441362 - protein, 9 aa, Homo Sapiens
GHGHKQQHG

SEQ ID NO: 441363 - protein, 9 aa, Homo Sapiens
EGNSYVSST

SEQ ID NO: 441364 - protein, 9 aa, Homo Sapiens
QALLYLNKP

SEQ ID NO: 441365 - protein, 9 aa, Homo Sapiens
LSKIETRHS

SEQ ID NO: 441366 - protein, 9 aa, Homo Sapiens
DEDYEASGQ

SEQ ID NO: 441367 - protein, 9 aa, Homo Sapiens
AKLAFAVEP

SEQ ID NO: 441368 - protein, 9 aa, Homo Sapiens
RLCLSHFPQ

SEQ ID NO: 441369 - protein, 9 aa, Homo Sapiens
GSFDIGNLL

SEQ ID NO: 441370 - protein, 9 aa, Homo Sapiens
CSVIPGKAA

SEQ ID NO: 441371 - protein, 9 aa, Homo Sapiens
TALLKVYSC

SEQ ID NO: 441372 - protein, 9 aa, Homo Sapiens
KPNYMEKGC

SEQ ID NO: 441373 - protein, 9 aa, Homo Sapiens
PQGICGDKG

SEQ ID NO: 441374 - protein, 9 aa, Homo Sapiens
YRALYPKSI

SEQ ID NO: 441375 - protein, 9 aa, Homo Sapiens
PQGRLIKDP

SEQ ID NO: 441376 - protein, 9 aa, Homo Sapiens
VLTLIFRTS

SEQ ID NO: 441377 - protein, 9 aa, Homo Sapiens
NVTVLIQDI

SEQ ID NO: 441378 - protein, 9 aa, Homo Sapiens
SLLDLLVTD

SEQ ID NO: 441379 - protein, 9 aa, Homo Sapiens
VSSIPVSLS

SEQ ID NO: 441380 - protein, 9 aa, Homo Sapiens
TFQEDDSFE

SEQ ID NO: 441381 - protein, 9 aa, Homo Sapiens
IQKVYPGLS

SEQ ID NO: 441382 - protein, 9 aa, Homo Sapiens
ANVVLLDDP

SEQ ID NO: 441383 - protein, 9 aa, Homo Sapiens
FLRNWGIDK

SEQ ID NO: 441384 - protein, 9 aa, Homo Sapiens
RLKVLTEVY

SEQ ID NO: 441385 - protein, 9 aa, Homo Sapiens
YKYEECKNL

SEQ ID NO: 441386 - protein, 9 aa, Homo Sapiens
DSIDPVDTG

SEQ ID NO: 441387 - protein, 9 aa, Homo Sapiens
SEMEVSWNV

SEQ ID NO: 441388 - protein, 9 aa, Homo Sapiens
ETSMDTASH

SEQ ID NO: 441389 - protein, 9 aa, Homo Sapiens
EEQELCDLN

SEQ ID NO: 441390 - protein, 9 aa, Homo Sapiens
FWMKWLLQQ

SEQ ID NO: 441391 - protein, 9 aa, Homo Sapiens
YRVVFHFKF

SEQ ID NO: 441392 - protein, 9 aa, Homo Sapiens
FLQHNKIHS

SEQ ID NO: 441393 - protein, 9 aa, Homo Sapiens
GKVYVAAVC

SEQ ID NO: 441394 - protein, 9 aa, Homo Sapiens
KTPFHLVGT

SEQ ID NO: 441395 - protein, 9 aa, Homo Sapiens
RGCHHEVVD

SEQ ID NO: 441396 - protein, 9 aa, Homo Sapiens
FEAINSVIF

SEQ ID NO: 441397 - protein, 9 aa, Homo Sapiens
HNIYSNIFG

SEQ ID NO: 441398 - protein, 9 aa, Homo Sapiens
QEFSGVENY

SEQ ID NO: 441399 - protein, 9 aa, Homo Sapiens
TGTIKLGKR

SEQ ID NO: 441400 - protein, 9 aa, Homo Sapiens
TLVGFVGVV

SEQ ID NO: 441401 - protein, 9 aa, Homo Sapiens
YILEGMRSQ

SEQ ID NO: 441402 - protein, 9 aa, Homo Sapiens
QLDSVDIPK

SEQ ID NO: 441403 - protein, 9 aa, Homo Sapiens
AQSQDKQIE

SEQ ID NO: 441404 - protein, 9 aa, Homo Sapiens
GYLAANGPT

SEQ ID NO: 441405 - protein, 9 aa, Homo Sapiens
TITRDMYVT

SEQ ID NO: 441406 - protein, 9 aa, Homo Sapiens
KNEKEEYQN

SEQ ID NO: 441407 - protein, 9 aa, Homo Sapiens
WKIKNTHDG

SEQ ID NO: 441408 - protein, 9 aa, Homo Sapiens
YSPGYYICK

SEQ ID NO: 441409 - protein, 9 aa, Homo Sapiens
RTHKIKKLA

SEQ ID NO: 441410 - protein, 9 aa, Homo Sapiens
VTMALNSKA

SEQ ID NO: 441411 - protein, 9 aa, Homo Sapiens
QGLTVAAIL

SEQ ID NO: 441412 - protein, 9 aa, Homo Sapiens
CCHPITCCP

SEQ ID NO: 441413 - protein, 9 aa, Homo Sapiens
FTQKSSITN

SEQ ID NO: 441414 - protein, 9 aa, Homo Sapiens
KGTPFSVGV

SEQ ID NO: 441415 - protein, 9 aa, Homo Sapiens
EKLLCLLVC

SEQ ID NO: 441416 - protein, 9 aa, Homo Sapiens
AIQAVENTS

SEQ ID NO: 441417 - protein, 9 aa, Homo Sapiens
LLLVVALYG

SEQ ID NO: 441418 - protein, 9 aa, Homo Sapiens
PDDDPPPST

SEQ ID NO: 441419 - protein, 9 aa, Homo Sapiens
TKKVNFKEL

SEQ ID NO: 441420 - protein, 9 aa, Homo Sapiens
CEESVEQKR

SEQ ID NO: 441421 - protein, 9 aa, Homo Sapiens
TEETLNGVL

SEQ ID NO: 441422 - protein, 9 aa, Homo Sapiens
ISQSVHIAV

SEQ ID NO: 441423 - protein, 9 aa, Homo Sapiens
DQVNLVAST

SEQ ID NO: 441424 - protein, 9 aa, Homo Sapiens
EINADPILT

SEQ ID NO: 441425 - protein, 9 aa, Homo Sapiens
WAAEECRDK

SEQ ID NO: 441426 - protein, 9 aa, Homo Sapiens
ECHSALSVK

SEQ ID NO: 441427 - protein, 9 aa, Homo Sapiens
DLFNDLIDC

SEQ ID NO: 441428 - protein, 9 aa, Homo Sapiens
LELANKDET

SEQ ID NO: 441429 - protein, 9 aa, Homo Sapiens
LMRQCWWEK

SEQ ID NO: 441430 - protein, 9 aa, Homo Sapiens
AHEEICTAN

SEQ ID NO: 441431 - protein, 9 aa, Homo Sapiens
FAFSIFKSD

SEQ ID NO: 441432 - protein, 9 aa, Homo Sapiens
VHWTTILGM

SEQ ID NO: 441433 - protein, 9 aa, Homo Sapiens
AVMAQITKA

SEQ ID NO: 441434 - protein, 9 aa, Homo Sapiens
IARDSFRHI

SEQ ID NO: 441435 - protein, 9 aa, Homo Sapiens
QENLREPKS

SEQ ID NO: 441436 - protein, 9 aa, Homo Sapiens
SNIRINEDS

SEQ ID NO: 441437 - protein, 9 aa, Homo Sapiens
ECLFHQEKR

SEQ ID NO: 441438 - protein, 9 aa, Homo Sapiens
IWATSGAAT

SEQ ID NO: 441439 - protein, 9 aa, Homo Sapiens
NLCSIRKLI

SEQ ID NO: 441440 - protein, 9 aa, Homo Sapiens
HITQHKIIH

SEQ ID NO: 441441 - protein, 9 aa, Homo Sapiens
EILNASTTE

SEQ ID NO: 441442 - protein, 9 aa, Homo Sapiens
NPTDYDNEE

SEQ ID NO: 441443 - protein, 9 aa, Homo Sapiens
GGFPQKSST

SEQ ID NO: 441444 - protein, 9 aa, Homo Sapiens
HSSVWYLGY

SEQ ID NO: 441445 - protein, 9 aa, Homo Sapiens
RRRKMTKII

SEQ ID NO: 441446 - protein, 9 aa, Homo Sapiens
LHRYDEGNV

SEQ ID NO: 441447 - protein, 9 aa, Homo Sapiens
EAEKKAISI

SEQ ID NO: 441448 - protein, 9 aa, Homo Sapiens
CEFPLHQDN

SEQ ID NO: 441449 - protein, 9 aa, Homo Sapiens
LKDRGISIP

SEQ ID NO: 441450 - protein, 9 aa, Homo Sapiens
VLEYWMRLH

SEQ ID NO: 441451 - protein, 9 aa, Homo Sapiens
FFIFLFGVY

SEQ ID NO: 441452 - protein, 9 aa, Homo Sapiens
GLDLPDLNM

SEQ ID NO: 441453 - protein, 9 aa, Homo Sapiens
HRDVIGLDY

SEQ ID NO: 441454 - protein, 9 aa, Homo Sapiens
LLIIKGLII

SEQ ID NO: 441455 - protein, 9 aa, Homo Sapiens
RWFPITLPV

SEQ ID NO: 441456 - protein, 9 aa, Homo Sapiens
KQMCTNKYK

SEQ ID NO: 441457 - protein, 9 aa, Homo Sapiens
LQRGASPNI

SEQ ID NO: 441458 - protein, 9 aa, Homo Sapiens
RTFISYYTS

SEQ ID NO: 441459 - protein, 9 aa, Homo Sapiens
RTKLLWISY

SEQ ID NO: 441460 - protein, 9 aa, Homo Sapiens
FILVCVFGT

SEQ ID NO: 441461 - protein, 9 aa, Homo Sapiens
AKPNKCARR

SEQ ID NO: 441462 - protein, 9 aa, Homo Sapiens
ETHNQTACG

SEQ ID NO: 441463 - protein, 9 aa, Homo Sapiens
VKLHLEQQQ

SEQ ID NO: 441464 - protein, 9 aa, Homo Sapiens
TFSHKDSLV

SEQ ID NO: 441465 - protein, 9 aa, Homo Sapiens
LTVRSVDGD

SEQ ID NO: 441466 - protein, 9 aa, Homo Sapiens
CPHYFLGAY

SEQ ID NO: 441467 - protein, 9 aa, Homo Sapiens
LEKTKVEWF

SEQ ID NO: 441468 - protein, 9 aa, Homo Sapiens
VDNDGCHPA

SEQ ID NO: 441469 - protein, 9 aa, Homo Sapiens
LALQKNFLL

SEQ ID NO: 441470 - protein, 9 aa, Homo Sapiens
SRQAFDFLN

SEQ ID NO: 441471 - protein, 9 aa, Homo Sapiens
LKFQVFNNA

SEQ ID NO: 441472 - protein, 9 aa, Homo Sapiens
LSCKGKEVD

SEQ ID NO: 441473 - protein, 9 aa, Homo Sapiens
YPTPGNPCY

SEQ ID NO: 441474 - protein, 9 aa, Homo Sapiens
QSSKDIWAA

SEQ ID NO: 441475 - protein, 9 aa, Homo Sapiens
YAVFCLSSW

SEQ ID NO: 441476 - protein, 9 aa, Homo Sapiens
KNWQENQKQ

SEQ ID NO: 441477 - protein, 9 aa, Homo Sapiens
SLRQTGVIH

SEQ ID NO: 441478 - protein, 9 aa, Homo Sapiens
EQIYYSLDY

SEQ ID NO: 441479 - protein, 9 aa, Homo Sapiens
ITKLYVMAS

SEQ ID NO: 441480 - protein, 9 aa, Homo Sapiens
ACVHKEKSV

SEQ ID NO: 441481 - protein, 9 aa, Homo Sapiens
VSWMGKPVS

SEQ ID NO: 441482 - protein, 9 aa, Homo Sapiens
KHTYYYGKR

SEQ ID NO: 441483 - protein, 9 aa, Homo Sapiens
DHQLVYCKK

SEQ ID NO: 441484 - protein, 9 aa, Homo Sapiens
KGFCGENIN

SEQ ID NO: 441485 - protein, 9 aa, Homo Sapiens
IEDYFQKMI

SEQ ID NO: 441486 - protein, 9 aa, Homo Sapiens
RHQSDQYVK

SEQ ID NO: 441487 - protein, 9 aa, Homo Sapiens
GVRGLYGLQ

SEQ ID NO: 441488 - protein, 9 aa, Homo Sapiens
PARDIHCEF

SEQ ID NO: 441489 - protein, 9 aa, Homo Sapiens
LPAVGKKSL

SEQ ID NO: 441490 - protein, 9 aa, Homo Sapiens
DQYYEQDDD

SEQ ID NO: 441491 - protein, 9 aa, Homo Sapiens
LATYNSLLQ

SEQ ID NO: 441492 - protein, 9 aa, Homo Sapiens
LESGSSEEL

SEQ ID NO: 441493 - protein, 9 aa, Homo Sapiens
LLITTNPYN

SEQ ID NO: 441494 - protein, 9 aa, Homo Sapiens
FLKKVHKEE

SEQ ID NO: 441495 - protein, 9 aa, Homo Sapiens
PFEVNDLPR

SEQ ID NO: 441496 - protein, 9 aa, Homo Sapiens
QYYVQYRSF

SEQ ID NO: 441497 - protein, 9 aa, Homo Sapiens
ENEIVLRAV

SEQ ID NO: 441498 - protein, 9 aa, Homo Sapiens
KVVQLEQEL

SEQ ID NO: 441499 - protein, 9 aa, Homo Sapiens
VFLAINYNS

SEQ ID NO: 441500 - protein, 9 aa, Homo Sapiens
EIRSRLIKL

SEQ ID NO: 441501 - protein, 9 aa, Homo Sapiens
QLRQLKAFK

SEQ ID NO: 441502 - protein, 9 aa, Homo Sapiens
ATSEIKDLN

SEQ ID NO: 441503 - protein, 9 aa, Homo Sapiens
VMPFVSVAD

SEQ ID NO: 441504 - protein, 9 aa, Homo Sapiens
FGDTIARAT

SEQ ID NO: 441505 - protein, 9 aa, Homo Sapiens
NSTFCITAY

SEQ ID NO: 441506 - protein, 9 aa, Homo Sapiens
ECDPKCIED

SEQ ID NO: 441507 - protein, 9 aa, Homo Sapiens
ALAERLVRV

SEQ ID NO: 441508 - protein, 9 aa, Homo Sapiens
ILTNLSSNS

SEQ ID NO: 441509 - protein, 9 aa, Homo Sapiens
PVKKHKTGE

SEQ ID NO: 441510 - protein, 9 aa, Homo Sapiens
MSRGSPMIN

SEQ ID NO: 441511 - protein, 9 aa, Homo Sapiens
GCPCSDDVT

SEQ ID NO: 441512 - protein, 9 aa, Homo Sapiens
IKLGKRLDR

SEQ ID NO: 441513 - protein, 9 aa, Homo Sapiens
GYHVIVPCR

SEQ ID NO: 441514 - protein, 9 aa, Homo Sapiens
ELPIIIVPE

SEQ ID NO: 441515 - protein, 9 aa, Homo Sapiens
DDSTSLTAR

SEQ ID NO: 441516 - protein, 9 aa, Homo Sapiens
NQAYHAILQ

SEQ ID NO: 441517 - protein, 9 aa, Homo Sapiens
ALWMLLGLL

SEQ ID NO: 441518 - protein, 9 aa, Homo Sapiens
RKIVSHGSH

SEQ ID NO: 441519 - protein, 9 aa, Homo Sapiens
PGARAREQV

SEQ ID NO: 441520 - protein, 9 aa, Homo Sapiens
ALVKTSDVE

SEQ ID NO: 441521 - protein, 9 aa, Homo Sapiens
LKHTSDNLS

SEQ ID NO: 441522 - protein, 9 aa, Homo Sapiens
LSSWEARLK

SEQ ID NO: 441523 - protein, 9 aa, Homo Sapiens
INTFHVISF

SEQ ID NO: 441524 - protein, 9 aa, Homo Sapiens
YLCNYTRKN

SEQ ID NO: 441525 - protein, 9 aa, Homo Sapiens
GPKPNNLGN

SEQ ID NO: 441526 - protein, 9 aa, Homo Sapiens
TVQARYFSD

SEQ ID NO: 441527 - protein, 9 aa, Homo Sapiens
VSSYIYQPG

SEQ ID NO: 441528 - protein, 9 aa, Homo Sapiens
SLQVDGKKS

SEQ ID NO: 441529 - protein, 9 aa, Homo Sapiens
LRLVHVWLN

SEQ ID NO: 441530 - protein, 9 aa, Homo Sapiens
SFLLLVVAL

SEQ ID NO: 441531 - protein, 9 aa, Homo Sapiens
SLAEIRDTY

SEQ ID NO: 441532 - protein, 9 aa, Homo Sapiens
RDLHSTLLL

SEQ ID NO: 441533 - protein, 9 aa, Homo Sapiens
MVNEYKKII

SEQ ID NO: 441534 - protein, 9 aa, Homo Sapiens
DTEPQKQNT

SEQ ID NO: 441535 - protein, 9 aa, Homo Sapiens
AETGNNLQE

SEQ ID NO: 441536 - protein, 9 aa, Homo Sapiens
SENQTYRAL

SEQ ID NO: 441537 - protein, 9 aa, Homo Sapiens
FEGLKAHTY

SEQ ID NO: 441538 - protein, 9 aa, Homo Sapiens
SSPCCGGAT

SEQ ID NO: 441539 - protein, 9 aa, Homo Sapiens
LKTLCKLVY

SEQ ID NO: 441540 - protein, 9 aa, Homo Sapiens
ESSVSEDVL

SEQ ID NO: 441541 - protein, 9 aa, Homo Sapiens
VAVFLVSWL

SEQ ID NO: 441542 - protein, 9 aa, Homo Sapiens
RGCPCSDDV

SEQ ID NO: 441543 - protein, 9 aa, Homo Sapiens
TEVYSENEA

SEQ ID NO: 441544 - protein, 9 aa, Homo Sapiens
LLWRDCSHG

SEQ ID NO: 441545 - protein, 9 aa, Homo Sapiens
CSPSLCCVQ

SEQ ID NO: 441546 - protein, 9 aa, Homo Sapiens
KGSGPHRPS

SEQ ID NO: 441547 - protein, 9 aa, Homo Sapiens
LPKVTQQDA

SEQ ID NO: 441548 - protein, 9 aa, Homo Sapiens
VYLLNITTL

SEQ ID NO: 441549 - protein, 9 aa, Homo Sapiens
CSSSKNDSG

SEQ ID NO: 441550 - protein, 9 aa, Homo Sapiens
VERLAEDEE

SEQ ID NO: 441551 - protein, 9 aa, Homo Sapiens
QFGLKNTSS

SEQ ID NO: 441552 - protein, 9 aa, Homo Sapiens
SRCTVCEGS

SEQ ID NO: 441553 - protein, 9 aa, Homo Sapiens
WEGHIIPTR

SEQ ID NO: 441554 - protein, 9 aa, Homo Sapiens
GIADETELA

SEQ ID NO: 441555 - protein, 9 aa, Homo Sapiens
SSSSLSRQT

SEQ ID NO: 441556 - protein, 9 aa, Homo Sapiens
LHMAAILDD

SEQ ID NO: 441557 - protein, 9 aa, Homo Sapiens
FSADWKRVE

SEQ ID NO: 441558 - protein, 9 aa, Homo Sapiens
ALLSDYVIH

SEQ ID NO: 441559 - protein, 9 aa, Homo Sapiens
IHLPLPFLL

SEQ ID NO: 441560 - protein, 9 aa, Homo Sapiens
VENTFLLPS

SEQ ID NO: 441561 - protein, 9 aa, Homo Sapiens
KSAAKKSES

SEQ ID NO: 441562 - protein, 9 aa, Homo Sapiens
FYVGQPEMA

SEQ ID NO: 441563 - protein, 9 aa, Homo Sapiens
LQCANIQFR

SEQ ID NO: 441564 - protein, 9 aa, Homo Sapiens
ENYKQTCIR

SEQ ID NO: 441565 - protein, 9 aa, Homo Sapiens
EMSSLAGKK

SEQ ID NO: 441566 - protein, 9 aa, Homo Sapiens
TENCFSVNF

SEQ ID NO: 441567 - protein, 9 aa, Homo Sapiens
RAESKCCKE

SEQ ID NO: 441568 - protein, 9 aa, Homo Sapiens
FIPLVQRLT

SEQ ID NO: 441569 - protein, 9 aa, Homo Sapiens
LLSPEFIPR

SEQ ID NO: 441570 - protein, 9 aa, Homo Sapiens
SLQPHKMKS

SEQ ID NO: 441571 - protein, 9 aa, Homo Sapiens
RHMSSKGME

SEQ ID NO: 441572 - protein, 9 aa, Homo Sapiens
ALNTRADKE

SEQ ID NO: 441573 - protein, 9 aa, Homo Sapiens
DGINSLRIT

SEQ ID NO: 441574 - protein, 9 aa, Homo Sapiens
SPANCPLKD

SEQ ID NO: 441575 - protein, 9 aa, Homo Sapiens
PLSVASAEY

SEQ ID NO: 441576 - protein, 9 aa, Homo Sapiens
LICTVCLLA

SEQ ID NO: 441577 - protein, 9 aa, Homo Sapiens
EDRDKLLKQ

SEQ ID NO: 441578 - protein, 9 aa, Homo Sapiens
FLQDTFTTL

SEQ ID NO: 441579 - protein, 9 aa, Homo Sapiens
SFGHIFTHI

SEQ ID NO: 441580 - protein, 9 aa, Homo Sapiens
FGYLVSITK

SEQ ID NO: 441581 - protein, 9 aa, Homo Sapiens
YKFRLSKMD

SEQ ID NO: 441582 - protein, 9 aa, Homo Sapiens
PAGTIKAVT

SEQ ID NO: 441583 - protein, 9 aa, Homo Sapiens
NLVNRSIAQ

SEQ ID NO: 441584 - protein, 9 aa, Homo Sapiens
ALILKRNEI

SEQ ID NO: 441585 - protein, 9 aa, Homo Sapiens
ASHGVWKGA

SEQ ID NO: 441586 - protein, 9 aa, Homo Sapiens
QTLGKQLNV

SEQ ID NO: 441587 - protein, 9 aa, Homo Sapiens
KMTKKFKME

SEQ ID NO: 441588 - protein, 9 aa, Homo Sapiens
KGKILCLFQ

SEQ ID NO: 441589 - protein, 9 aa, Homo Sapiens
KIYDVQERH

SEQ ID NO: 441590 - protein, 9 aa, Homo Sapiens
EAFDYFFPV

SEQ ID NO: 441591 - protein, 9 aa, Homo Sapiens
KGKRGQKEM

SEQ ID NO: 441592 - protein, 9 aa, Homo Sapiens
HKKYFGLSE

SEQ ID NO: 441593 - protein, 9 aa, Homo Sapiens
TSWSRVYLH

SEQ ID NO: 441594 - protein, 9 aa, Homo Sapiens
CYILVGCWK

SEQ ID NO: 441595 - protein, 9 aa, Homo Sapiens
IKGKVIYTY

SEQ ID NO: 441596 - protein, 9 aa, Homo Sapiens
VKQKVSPYF

SEQ ID NO: 441597 - protein, 9 aa, Homo Sapiens
AAENEVVTL

SEQ ID NO: 441598 - protein, 9 aa, Homo Sapiens
LANNQGNRT

SEQ ID NO: 441599 - protein, 9 aa, Homo Sapiens
LEQQQIEKE

SEQ ID NO: 441600 - protein, 9 aa, Homo Sapiens
YINTTWNCG

SEQ ID NO: 441601 - protein, 9 aa, Homo Sapiens
KSNLIHHFF

SEQ ID NO: 441602 - protein, 9 aa, Homo Sapiens
SNLIKHKTI

SEQ ID NO: 441603 - protein, 9 aa, Homo Sapiens
DFDYSVSNC

SEQ ID NO: 441604 - protein, 9 aa, Homo Sapiens
DPPQAEHVL

SEQ ID NO: 441605 - protein, 9 aa, Homo Sapiens
DRAEKMEEM

SEQ ID NO: 441606 - protein, 9 aa, Homo Sapiens
ENPHVRCIE

SEQ ID NO: 441607 - protein, 9 aa, Homo Sapiens
RYRMIDIEG

SEQ ID NO: 441608 - protein, 9 aa, Homo Sapiens
LMNSTDQES

SEQ ID NO: 441609 - protein, 9 aa, Homo Sapiens
LGWAVGASV

SEQ ID NO: 441610 - protein, 9 aa, Homo Sapiens
KPLGRIAIK

SEQ ID NO: 441611 - protein, 9 aa, Homo Sapiens
TYFYNPLIP

SEQ ID NO: 441612 - protein, 9 aa, Homo Sapiens
RGCFLRIRQ

SEQ ID NO: 441613 - protein, 9 aa, Homo Sapiens
PDSAIRQLL

SEQ ID NO: 441614 - protein, 9 aa, Homo Sapiens
KIGATIQEE

SEQ ID NO: 441615 - protein, 9 aa, Homo Sapiens
SKPSEEIKT

SEQ ID NO: 441616 - protein, 9 aa, Homo Sapiens
QSITSETSG

SEQ ID NO: 441617 - protein, 9 aa, Homo Sapiens
LINSGSRYD

SEQ ID NO: 441618 - protein, 9 aa, Homo Sapiens
QQRVQKPEA

SEQ ID NO: 441619 - protein, 9 aa, Homo Sapiens
TPLASTTQY

SEQ ID NO: 441620 - protein, 9 aa, Homo Sapiens
LLCGEVNNP

SEQ ID NO: 441621 - protein, 9 aa, Homo Sapiens
GVLNVYIRL

SEQ ID NO: 441622 - protein, 9 aa, Homo Sapiens
QNWRAKLKR

SEQ ID NO: 441623 - protein, 9 aa, Homo Sapiens
QFYVADVYT

SEQ ID NO: 441624 - protein, 9 aa, Homo Sapiens
QKQHFCGRH

SEQ ID NO: 441625 - protein, 9 aa, Homo Sapiens
RDSFRHITD

SEQ ID NO: 441626 - protein, 9 aa, Homo Sapiens
EISERAFKL

SEQ ID NO: 441627 - protein, 9 aa, Homo Sapiens
NKEDHLERE

SEQ ID NO: 441628 - protein, 9 aa, Homo Sapiens
VCLERVVLT

SEQ ID NO: 441629 - protein, 9 aa, Homo Sapiens
EDNFFEICD

SEQ ID NO: 441630 - protein, 9 aa, Homo Sapiens
QNWQEFVDA

SEQ ID NO: 441631 - protein, 9 aa, Homo Sapiens
QDTIKSLTA

SEQ ID NO: 441632 - protein, 9 aa, Homo Sapiens
DGPAMNNVE

SEQ ID NO: 441633 - protein, 9 aa, Homo Sapiens
IILPQPPKK

SEQ ID NO: 441634 - protein, 9 aa, Homo Sapiens
HFDFMGTCV

SEQ ID NO: 441635 - protein, 9 aa, Homo Sapiens
SALSVKRAA

SEQ ID NO: 441636 - protein, 9 aa, Homo Sapiens
DTFQGAPMS

SEQ ID NO: 441637 - protein, 9 aa, Homo Sapiens
FLPNTILSN

SEQ ID NO: 441638 - protein, 9 aa, Homo Sapiens
AGLIAIFRG

SEQ ID NO: 441639 - protein, 9 aa, Homo Sapiens
VEFKMFTTK

SEQ ID NO: 441640 - protein, 9 aa, Homo Sapiens
EGMIQMFQK

SEQ ID NO: 441641 - protein, 9 aa, Homo Sapiens
LQTKTIQVS

SEQ ID NO: 441642 - protein, 9 aa, Homo Sapiens
ADNFLQQFF

SEQ ID NO: 441643 - protein, 9 aa, Homo Sapiens
RKRATATVP

SEQ ID NO: 441644 - protein, 9 aa, Homo Sapiens
NGDGKVTTE

SEQ ID NO: 441645 - protein, 9 aa, Homo Sapiens
QRHVLKVCN

SEQ ID NO: 441646 - protein, 9 aa, Homo Sapiens
DFPQEFYTE

SEQ ID NO: 441647 - protein, 9 aa, Homo Sapiens
ASDNTSRVM

SEQ ID NO: 441648 - protein, 9 aa, Homo Sapiens
GQFVVSAND

SEQ ID NO: 441649 - protein, 9 aa, Homo Sapiens
CEKVVKLLA

SEQ ID NO: 441650 - protein, 9 aa, Homo Sapiens
WKDDKSHFK

SEQ ID NO: 441651 - protein, 9 aa, Homo Sapiens
NGGQEWKFV

SEQ ID NO: 441652 - protein, 9 aa, Homo Sapiens
YLTGVSGST

SEQ ID NO: 441653 - protein, 9 aa, Homo Sapiens
GKLDSPQRA

SEQ ID NO: 441654 - protein, 9 aa, Homo Sapiens
VTSQPKSFD

SEQ ID NO: 441655 - protein, 9 aa, Homo Sapiens
PKYEIACEH

SEQ ID NO: 441656 - protein, 9 aa, Homo Sapiens
NTTYHRYSA

SEQ ID NO: 441657 - protein, 9 aa, Homo Sapiens
KPLVTVQNE

SEQ ID NO: 441658 - protein, 9 aa, Homo Sapiens
LSACNVCLA

SEQ ID NO: 441659 - protein, 9 aa, Homo Sapiens
HIIVDKFQN

SEQ ID NO: 441660 - protein, 9 aa, Homo Sapiens
LDNIVRRSN

SEQ ID NO: 441661 - protein, 9 aa, Homo Sapiens
ISSSDILHH

SEQ ID NO: 441662 - protein, 9 aa, Homo Sapiens
YRCAGTSWK

SEQ ID NO: 441663 - protein, 9 aa, Homo Sapiens
INDYTCTCP

SEQ ID NO: 441664 - protein, 9 aa, Homo Sapiens
YEASGQSLL

SEQ ID NO: 441665 - protein, 9 aa, Homo Sapiens
PASPLMNNF

SEQ ID NO: 441666 - protein, 9 aa, Homo Sapiens
FDIGNLLVI

SEQ ID NO: 441667 - protein, 9 aa, Homo Sapiens
HYAPPRKLM

SEQ ID NO: 441668 - protein, 9 aa, Homo Sapiens
IYAIGGRRF

SEQ ID NO: 441669 - protein, 9 aa, Homo Sapiens
PTNLERLWS

SEQ ID NO: 441670 - protein, 9 aa, Homo Sapiens
PAKDEHNQN

SEQ ID NO: 441671 - protein, 9 aa, Homo Sapiens
HPNCKLQVL

SEQ ID NO: 441672 - protein, 9 aa, Homo Sapiens
DTNGPVFVG

SEQ ID NO: 441673 - protein, 9 aa, Homo Sapiens
WEVDSGCRN

SEQ ID NO: 441674 - protein, 9 aa, Homo Sapiens
TNNCPSLKD

SEQ ID NO: 441675 - protein, 9 aa, Homo Sapiens
SAEDLDTED

SEQ ID NO: 441676 - protein, 9 aa, Homo Sapiens
LCYFQEPES

SEQ ID NO: 441677 - protein, 9 aa, Homo Sapiens
FTRGQLPGD

SEQ ID NO: 441678 - protein, 9 aa, Homo Sapiens
TFEDTSNFC

SEQ ID NO: 441679 - protein, 9 aa, Homo Sapiens
PLREVCLAK

SEQ ID NO: 441680 - protein, 9 aa, Homo Sapiens
NRNLSNNCD

SEQ ID NO: 441681 - protein, 9 aa, Homo Sapiens
DAQELESFL

SEQ ID NO: 441682 - protein, 9 aa, Homo Sapiens
IFNRIKRKD

SEQ ID NO: 441683 - protein, 9 aa, Homo Sapiens
ARECLFHQE

SEQ ID NO: 441684 - protein, 9 aa, Homo Sapiens
SSYQYILVI

SEQ ID NO: 441685 - protein, 9 aa, Homo Sapiens
GALVFLDSV

SEQ ID NO: 441686 - protein, 9 aa, Homo Sapiens
SLSLNTPSE

SEQ ID NO: 441687 - protein, 9 aa, Homo Sapiens
KLDSPQRAL

SEQ ID NO: 441688 - protein, 9 aa, Homo Sapiens
RYGSQHHKQ

SEQ ID NO: 441689 - protein, 9 aa, Homo Sapiens
QEQEKINSR

SEQ ID NO: 441690 - protein, 9 aa, Homo Sapiens
TCIFKFLGT

SEQ ID NO: 441691 - protein, 9 aa, Homo Sapiens
AFSIFKSDI

SEQ ID NO: 441692 - protein, 9 aa, Homo Sapiens
QQNVRARKY

SEQ ID NO: 441693 - protein, 9 aa, Homo Sapiens
LALLSDYVI

SEQ ID NO: 441694 - protein, 9 aa, Homo Sapiens
NRFFPSRKA

SEQ ID NO: 441695 - protein, 9 aa, Homo Sapiens
LLCKVYLVE

SEQ ID NO: 441696 - protein, 9 aa, Homo Sapiens
HLFKVMQLI

SEQ ID NO: 441697 - protein, 9 aa, Homo Sapiens
VTWYTNSSK

SEQ ID NO: 441698 - protein, 9 aa, Homo Sapiens
TAGPWTNHL

SEQ ID NO: 441699 - protein, 9 aa, Homo Sapiens
LGPQKVRAM

SEQ ID NO: 441700 - protein, 9 aa, Homo Sapiens
GIDKTIDKL

SEQ ID NO: 441701 - protein, 9 aa, Homo Sapiens
SYKTSKRFS

SEQ ID NO: 441702 - protein, 9 aa, Homo Sapiens
IKYFTCNPL

SEQ ID NO: 441703 - protein, 9 aa, Homo Sapiens
EVYLLNITT

SEQ ID NO: 441704 - protein, 9 aa, Homo Sapiens
QCFNNQPAV

SEQ ID NO: 441705 - protein, 9 aa, Homo Sapiens
TTNIQIWLA

SEQ ID NO: 441706 - protein, 9 aa, Homo Sapiens
QAQYILMKF

SEQ ID NO: 441707 - protein, 9 aa, Homo Sapiens
FIMTADDDI

SEQ ID NO: 441708 - protein, 9 aa, Homo Sapiens
RTACRYDPH

SEQ ID NO: 441709 - protein, 9 aa, Homo Sapiens
DVCNRFKLP

SEQ ID NO: 441710 - protein, 9 aa, Homo Sapiens
NIRGCEVVP

SEQ ID NO: 441711 - protein, 9 aa, Homo Sapiens
CDEQHGLCD

SEQ ID NO: 441712 - protein, 9 aa, Homo Sapiens
RHWNVLQGV

SEQ ID NO: 441713 - protein, 9 aa, Homo Sapiens
PNEKFFFVD

SEQ ID NO: 441714 - protein, 9 aa, Homo Sapiens
MAPTKNFSL

SEQ ID NO: 441715 - protein, 9 aa, Homo Sapiens
NCRIYVNNL

SEQ ID NO: 441716 - protein, 9 aa, Homo Sapiens
INVGWNGIK

SEQ ID NO: 441717 - protein, 9 aa, Homo Sapiens
CHGLWICPF

SEQ ID NO: 441718 - protein, 9 aa, Homo Sapiens
DSDDESHKP

SEQ ID NO: 441719 - protein, 9 aa, Homo Sapiens
TLWTAKALA

SEQ ID NO: 441720 - protein, 9 aa, Homo Sapiens
RLPRQNSGS

SEQ ID NO: 441721 - protein, 9 aa, Homo Sapiens
LVDNKFYEW

SEQ ID NO: 441722 - protein, 9 aa, Homo Sapiens
YFNIFHICQ

SEQ ID NO: 441723 - protein, 9 aa, Homo Sapiens
VTKPSPSHS

SEQ ID NO: 441724 - protein, 9 aa, Homo Sapiens
PAEAGKFTR

SEQ ID NO: 441725 - protein, 9 aa, Homo Sapiens
NIIPFCDKV

SEQ ID NO: 441726 - protein, 9 aa, Homo Sapiens
RFFKSLEEI

SEQ ID NO: 441727 - protein, 9 aa, Homo Sapiens
EQNKKIEKI

SEQ ID NO: 441728 - protein, 9 aa, Homo Sapiens
LSSQKLENI

SEQ ID NO: 441729 - protein, 9 aa, Homo Sapiens
IGTEIVAVH

SEQ ID NO: 441730 - protein, 9 aa, Homo Sapiens
VSLRQQLDY

SEQ ID NO: 441731 - protein, 9 aa, Homo Sapiens
GSPPRNTTM

SEQ ID NO: 441732 - protein, 9 aa, Homo Sapiens
RARCRESYQ

SEQ ID NO: 441733 - protein, 9 aa, Homo Sapiens
FKFLGTVAM

SEQ ID NO: 441734 - protein, 9 aa, Homo Sapiens
IPIFTLLQL

SEQ ID NO: 441735 - protein, 9 aa, Homo Sapiens
MHWDLVTMV

SEQ ID NO: 441736 - protein, 9 aa, Homo Sapiens
SSTQSDVSA

SEQ ID NO: 441737 - protein, 9 aa, Homo Sapiens
PSGTRSPAP

SEQ ID NO: 441738 - protein, 9 aa, Homo Sapiens
KPCGCNTCR

SEQ ID NO: 441739 - protein, 9 aa, Homo Sapiens
RWLKNGSAL

SEQ ID NO: 441740 - protein, 9 aa, Homo Sapiens
GERFPLSVA

SEQ ID NO: 441741 - protein, 9 aa, Homo Sapiens
VMVPVGGAI

SEQ ID NO: 441742 - protein, 9 aa, Homo Sapiens
IRGCEVVPD

SEQ ID NO: 441743 - protein, 9 aa, Homo Sapiens
ECLLSFICS

SEQ ID NO: 441744 - protein, 9 aa, Homo Sapiens
GLMRCDKGN

SEQ ID NO: 441745 - protein, 9 aa, Homo Sapiens
LLIDSHIYG

SEQ ID NO: 441746 - protein, 9 aa, Homo Sapiens
VQHMEGDKS

SEQ ID NO: 441747 - protein, 9 aa, Homo Sapiens
VVHQITHTG

SEQ ID NO: 441748 - protein, 9 aa, Homo Sapiens
TFLLPSANS

SEQ ID NO: 441749 - protein, 9 aa, Homo Sapiens
SSKNDSGVP

SEQ ID NO: 441750 - protein, 9 aa, Homo Sapiens
YADEEAAVV

SEQ ID NO: 441751 - protein, 9 aa, Homo Sapiens
ALGNLVMEP

SEQ ID NO: 441752 - protein, 9 aa, Homo Sapiens
TIQEELGYN

SEQ ID NO: 441753 - protein, 9 aa, Homo Sapiens
NINRINEIQ

SEQ ID NO: 441754 - protein, 9 aa, Homo Sapiens
FINTTFLLM

SEQ ID NO: 441755 - protein, 9 aa, Homo Sapiens
GKPRKVQFK

SEQ ID NO: 441756 - protein, 9 aa, Homo Sapiens
SFFATHPNT

SEQ ID NO: 441757 - protein, 9 aa, Homo Sapiens
KVAFPRRTQ

SEQ ID NO: 441758 - protein, 9 aa, Homo Sapiens
GAFTRPCVD

SEQ ID NO: 441759 - protein, 9 aa, Homo Sapiens
EYKIFFVMG

SEQ ID NO: 441760 - protein, 9 aa, Homo Sapiens
LMKSIRFPL

SEQ ID NO: 441761 - protein, 9 aa, Homo Sapiens
SPLPGKSAA

SEQ ID NO: 441762 - protein, 9 aa, Homo Sapiens
KQHFCGRHK

SEQ ID NO: 441763 - protein, 9 aa, Homo Sapiens
ATSLGIRPN

SEQ ID NO: 441764 - protein, 9 aa, Homo Sapiens
NKSKSLTYT

SEQ ID NO: 441765 - protein, 9 aa, Homo Sapiens
PGACLGLQL

SEQ ID NO: 441766 - protein, 9 aa, Homo Sapiens
VLHCIANVG

SEQ ID NO: 441767 - protein, 9 aa, Homo Sapiens
PQIMDEALK

SEQ ID NO: 441768 - protein, 9 aa, Homo Sapiens
LKLEDDRFP

SEQ ID NO: 441769 - protein, 9 aa, Homo Sapiens
DKRVDCSSF

SEQ ID NO: 441770 - protein, 9 aa, Homo Sapiens
NMSVDKCVN

SEQ ID NO: 441771 - protein, 9 aa, Homo Sapiens
NLTKPILGV

SEQ ID NO: 441772 - protein, 9 aa, Homo Sapiens
CCSMVSQMN

SEQ ID NO: 441773 - protein, 9 aa, Homo Sapiens
ISYLEKNNY

SEQ ID NO: 441774 - protein, 9 aa, Homo Sapiens
PTTLKKLEK

SEQ ID NO: 441775 - protein, 9 aa, Homo Sapiens
IFVQVSLHT

SEQ ID NO: 441776 - protein, 9 aa, Homo Sapiens
NFDNISLDQ

SEQ ID NO: 441777 - protein, 9 aa, Homo Sapiens
EKGEKGDPD

SEQ ID NO: 441778 - protein, 9 aa, Homo Sapiens
KCEKNIHFL

SEQ ID NO: 441779 - protein, 9 aa, Homo Sapiens
GWAAEECRD

SEQ ID NO: 441780 - protein, 9 aa, Homo Sapiens
SSQKLENIS

SEQ ID NO: 441781 - protein, 9 aa, Homo Sapiens
DKLKRMSTS

SEQ ID NO: 441782 - protein, 9 aa, Homo Sapiens
LIKLCYFQE

SEQ ID NO: 441783 - protein, 9 aa, Homo Sapiens
HLQLAVSVI

SEQ ID NO: 441784 - protein, 9 aa, Homo Sapiens
QISQIKYKS

SEQ ID NO: 441785 - protein, 9 aa, Homo Sapiens
QGRFLQDTF

SEQ ID NO: 441786 - protein, 9 aa, Homo Sapiens
HGLLKSQVQ

SEQ ID NO: 441787 - protein, 9 aa, Homo Sapiens
TCVDFFHLV

SEQ ID NO: 441788 - protein, 9 aa, Homo Sapiens
KRELDHRLS

SEQ ID NO: 441789 - protein, 9 aa, Homo Sapiens
TTSMIRNAM

SEQ ID NO: 441790 - protein, 9 aa, Homo Sapiens
TCTPLASTT

SEQ ID NO: 441791 - protein, 9 aa, Homo Sapiens
TVPLLVTAA

SEQ ID NO: 441792 - protein, 9 aa, Homo Sapiens
PAEEAELYD

SEQ ID NO: 441793 - protein, 9 aa, Homo Sapiens
EERDRRQQK

SEQ ID NO: 441794 - protein, 9 aa, Homo Sapiens
KTFEQLHNK

SEQ ID NO: 441795 - protein, 9 aa, Homo Sapiens
DLLGSQAYS

SEQ ID NO: 441796 - protein, 9 aa, Homo Sapiens
MYTIYKILC

SEQ ID NO: 441797 - protein, 9 aa, Homo Sapiens
KDCYQFTFT

SEQ ID NO: 441798 - protein, 9 aa, Homo Sapiens
AHKALSPPE

SEQ ID NO: 441799 - protein, 9 aa, Homo Sapiens
QQRQNPSHA

SEQ ID NO: 441800 - protein, 9 aa, Homo Sapiens
PLVEIWLSG

SEQ ID NO: 441801 - protein, 9 aa, Homo Sapiens
AIYKSACNI

SEQ ID NO: 441802 - protein, 9 aa, Homo Sapiens
LLRKIYEMY

SEQ ID NO: 441803 - protein, 9 aa, Homo Sapiens
IRTTAAQEN

SEQ ID NO: 441804 - protein, 9 aa, Homo Sapiens
LKKVCGKVW

SEQ ID NO: 441805 - protein, 9 aa, Homo Sapiens
TQQLGRLFR

SEQ ID NO: 441806 - protein, 9 aa, Homo Sapiens
DTLYIVEQI

SEQ ID NO: 441807 - protein, 9 aa, Homo Sapiens
INVSEEMKV

SEQ ID NO: 441808 - protein, 9 aa, Homo Sapiens
ILWANNLLG

SEQ ID NO: 441809 - protein, 9 aa, Homo Sapiens
NHYLDFSSK

SEQ ID NO: 441810 - protein, 9 aa, Homo Sapiens
EIFSTTRYI

SEQ ID NO: 441811 - protein, 9 aa, Homo Sapiens
DSDYDKERG

SEQ ID NO: 441812 - protein, 9 aa, Homo Sapiens
INCQLKCQW

SEQ ID NO: 441813 - protein, 9 aa, Homo Sapiens
TIFCLDTLP

SEQ ID NO: 441814 - protein, 9 aa, Homo Sapiens
NEVEKIVVA

SEQ ID NO: 441815 - protein, 9 aa, Homo Sapiens
VPLGPECLC

SEQ ID NO: 441816 - protein, 9 aa, Homo Sapiens
LTPFHYLNF

SEQ ID NO: 441817 - protein, 9 aa, Homo Sapiens
TVGSSMYTA

SEQ ID NO: 441818 - protein, 9 aa, Homo Sapiens
VSGLPAPVV

SEQ ID NO: 441819 - protein, 9 aa, Homo Sapiens
AHQPITQRA

SEQ ID NO: 441820 - protein, 9 aa, Homo Sapiens
HQSKIFADR

SEQ ID NO: 441821 - protein, 9 aa, Homo Sapiens
MVSQMNKIR

SEQ ID NO: 441822 - protein, 9 aa, Homo Sapiens
ILIVIFVLI

SEQ ID NO: 441823 - protein, 9 aa, Homo Sapiens
APVRTATDY

SEQ ID NO: 441824 - protein, 9 aa, Homo Sapiens
CIEQTHTKL

SEQ ID NO: 441825 - protein, 9 aa, Homo Sapiens
TIQALGHIA

SEQ ID NO: 441826 - protein, 9 aa, Homo Sapiens
YSKCLRLEC

SEQ ID NO: 441827 - protein, 9 aa, Homo Sapiens
CESAPQGNL

SEQ ID NO: 441828 - protein, 9 aa, Homo Sapiens
DRKSAIQYI

SEQ ID NO: 441829 - protein, 9 aa, Homo Sapiens
TCYTLAIVP

SEQ ID NO: 441830 - protein, 9 aa, Homo Sapiens
NEKFFFVDT

SEQ ID NO: 441831 - protein, 9 aa, Homo Sapiens
RFPQPNYQL

SEQ ID NO: 441832 - protein, 9 aa, Homo Sapiens
VRTWHLNER

SEQ ID NO: 441833 - protein, 9 aa, Homo Sapiens
TGHYNHNDS

SEQ ID NO: 441834 - protein, 9 aa, Homo Sapiens
WALASASVS

SEQ ID NO: 441835 - protein, 9 aa, Homo Sapiens
LKFQAGFIN

SEQ ID NO: 441836 - protein, 9 aa, Homo Sapiens
RTELETKLQ

SEQ ID NO: 441837 - protein, 9 aa, Homo Sapiens
NRVNRSIYV

SEQ ID NO: 441838 - protein, 9 aa, Homo Sapiens
IHLIKVFAK

SEQ ID NO: 441839 - protein, 9 aa, Homo Sapiens
VYFKQFCIT

SEQ ID NO: 441840 - protein, 9 aa, Homo Sapiens
IMFNERGSK

SEQ ID NO: 441841 - protein, 9 aa, Homo Sapiens
TDNASKRHP

SEQ ID NO: 441842 - protein, 9 aa, Homo Sapiens
AQEKEKLMY

SEQ ID NO: 441843 - protein, 9 aa, Homo Sapiens
HPKKKNKLV

SEQ ID NO: 441844 - protein, 9 aa, Homo Sapiens
AGSITGASA

SEQ ID NO: 441845 - protein, 9 aa, Homo Sapiens
LKKTCSQDL

SEQ ID NO: 441846 - protein, 9 aa, Homo Sapiens
YRDRKKENV

SEQ ID NO: 441847 - protein, 9 aa, Homo Sapiens
KYLATLDTL

SEQ ID NO: 441848 - protein, 9 aa, Homo Sapiens
KEICAQTFF

SEQ ID NO: 441849 - protein, 9 aa, Homo Sapiens
SRMARYTAI

SEQ ID NO: 441850 - protein, 9 aa, Homo Sapiens
FWVLFDITQ

SEQ ID NO: 441851 - protein, 9 aa, Homo Sapiens
TQKENNICC

SEQ ID NO: 441852 - protein, 9 aa, Homo Sapiens
SANKLRSSN

SEQ ID NO: 441853 - protein, 9 aa, Homo Sapiens
SCIQAYFYD

SEQ ID NO: 441854 - protein, 9 aa, Homo Sapiens
GAVGASKLA

SEQ ID NO: 441855 - protein, 9 aa, Homo Sapiens
GGKDSCQGG

SEQ ID NO: 441856 - protein, 9 aa, Homo Sapiens
GYFVTPDRR

SEQ ID NO: 441857 - protein, 9 aa, Homo Sapiens
SSNLTTHKN

SEQ ID NO: 441858 - protein, 9 aa, Homo Sapiens
KILCLFQGI

SEQ ID NO: 441859 - protein, 9 aa, Homo Sapiens
YMQNSNLTL

SEQ ID NO: 441860 - protein, 9 aa, Homo Sapiens
PIYLPVNQQ

SEQ ID NO: 441861 - protein, 9 aa, Homo Sapiens
NDKDNLNLE

SEQ ID NO: 441862 - protein, 9 aa, Homo Sapiens
GIMLRKCIR

SEQ ID NO: 441863 - protein, 9 aa, Homo Sapiens
SLSLYISPS

SEQ ID NO: 441864 - protein, 9 aa, Homo Sapiens
PKNMSYTLL

SEQ ID NO: 441865 - protein, 9 aa, Homo Sapiens
FNYLISAVL

SEQ ID NO: 441866 - protein, 9 aa, Homo Sapiens
CQGNNFIRA

SEQ ID NO: 441867 - protein, 9 aa, Homo Sapiens
RNKEDHLER

SEQ ID NO: 441868 - protein, 9 aa, Homo Sapiens
FRRYKVLRE

SEQ ID NO: 441869 - protein, 9 aa, Homo Sapiens
SLIPPVNFT

SEQ ID NO: 441870 - protein, 9 aa, Homo Sapiens
ARSCIQAYF

SEQ ID NO: 441871 - protein, 9 aa, Homo Sapiens
KASGSSDKR

SEQ ID NO: 441872 - protein, 9 aa, Homo Sapiens
IQSTDVDRT

SEQ ID NO: 441873 - protein, 9 aa, Homo Sapiens
QSGSVEDNY

SEQ ID NO: 441874 - protein, 9 aa, Homo Sapiens
GKGPKIIFA

SEQ ID NO: 441875 - protein, 9 aa, Homo Sapiens
LSFTEMENN

SEQ ID NO: 441876 - protein, 9 aa, Homo Sapiens
QHENVHTLD

SEQ ID NO: 441877 - protein, 9 aa, Homo Sapiens
DPILTNLSS

SEQ ID NO: 441878 - protein, 9 aa, Homo Sapiens
IHRYIKPEN

SEQ ID NO: 441879 - protein, 9 aa, Homo Sapiens
GKRLDRETS

SEQ ID NO: 441880 - protein, 9 aa, Homo Sapiens
QRLGELHSE

SEQ ID NO: 441881 - protein, 9 aa, Homo Sapiens
RRHWNVLQG

SEQ ID NO: 441882 - protein, 9 aa, Homo Sapiens
GTVCLKEKI

SEQ ID NO: 441883 - protein, 9 aa, Homo Sapiens
LRHREITLN

SEQ ID NO: 441884 - protein, 9 aa, Homo Sapiens
ARDTIVMDT

SEQ ID NO: 441885 - protein, 9 aa, Homo Sapiens
DIGNQINVS

SEQ ID NO: 441886 - protein, 9 aa, Homo Sapiens
TTFDWPPKS

SEQ ID NO: 441887 - protein, 9 aa, Homo Sapiens
GFNYLISAV

SEQ ID NO: 441888 - protein, 9 aa, Homo Sapiens
SHLVAHQIT

SEQ ID NO: 441889 - protein, 9 aa, Homo Sapiens
THRDFLPSG

SEQ ID NO: 441890 - protein, 9 aa, Homo Sapiens
SIRRHWNVL

SEQ ID NO: 441891 - protein, 9 aa, Homo Sapiens
SKHLEKVHV

SEQ ID NO: 441892 - protein, 9 aa, Homo Sapiens
ALLFVNEAT

SEQ ID NO: 441893 - protein, 9 aa, Homo Sapiens
ELYEPTWQN

SEQ ID NO: 441894 - protein, 9 aa, Homo Sapiens
LTSTGCYKC

SEQ ID NO: 441895 - protein, 9 aa, Homo Sapiens
DLLQRLLPA

SEQ ID NO: 441896 - protein, 9 aa, Homo Sapiens
EYILEGMRS

SEQ ID NO: 441897 - protein, 9 aa, Homo Sapiens
CNEFLVDLI

SEQ ID NO: 441898 - protein, 9 aa, Homo Sapiens
LSYVTTLSY

SEQ ID NO: 441899 - protein, 9 aa, Homo Sapiens
KVDKKPPVR

SEQ ID NO: 441900 - protein, 9 aa, Homo Sapiens
WPLNEKITL

SEQ ID NO: 441901 - protein, 9 aa, Homo Sapiens
RLLKDAYLE

SEQ ID NO: 441902 - protein, 9 aa, Homo Sapiens
RYVKQQCHQ

SEQ ID NO: 441903 - protein, 9 aa, Homo Sapiens
GLLNNFQDI

SEQ ID NO: 441904 - protein, 9 aa, Homo Sapiens
THKTIEIES

SEQ ID NO: 441905 - protein, 9 aa, Homo Sapiens
ECGEELWAS

SEQ ID NO: 441906 - protein, 9 aa, Homo Sapiens
GDIGKEMHI

SEQ ID NO: 441907 - protein, 9 aa, Homo Sapiens
PGVGLLLVE

SEQ ID NO: 441908 - protein, 9 aa, Homo Sapiens
ADWKRVETA

SEQ ID NO: 441909 - protein, 9 aa, Homo Sapiens
HKLWRSSSK

SEQ ID NO: 441910 - protein, 9 aa, Homo Sapiens
SCPHYFLGA

SEQ ID NO: 441911 - protein, 9 aa, Homo Sapiens
LYGEPAGTI

SEQ ID NO: 441912 - protein, 9 aa, Homo Sapiens
QKNKKLWQI

SEQ ID NO: 441913 - protein, 9 aa, Homo Sapiens
KEIEFLSWM

SEQ ID NO: 441914 - protein, 9 aa, Homo Sapiens
SSLLNLSLM

SEQ ID NO: 441915 - protein, 9 aa, Homo Sapiens
PLTNQLGKG

SEQ ID NO: 441916 - protein, 9 aa, Homo Sapiens
PKTFVLCSV

SEQ ID NO: 441917 - protein, 9 aa, Homo Sapiens
PGSHPKGSV

SEQ ID NO: 441918 - protein, 9 aa, Homo Sapiens
MQLDSEGIF

SEQ ID NO: 441919 - protein, 9 aa, Homo Sapiens
NVTNNYDRL

SEQ ID NO: 441920 - protein, 9 aa, Homo Sapiens
VGVATDGAV

SEQ ID NO: 441921 - protein, 9 aa, Homo Sapiens
GAMSATRAV

SEQ ID NO: 441922 - protein, 9 aa, Homo Sapiens
SSSGFVEEK

SEQ ID NO: 441923 - protein, 9 aa, Homo Sapiens
PTKGKRGQK

SEQ ID NO: 441924 - protein, 9 aa, Homo Sapiens
SVSLPERPE

SEQ ID NO: 441925 - protein, 9 aa, Homo Sapiens
ICRPCEIKK

SEQ ID NO: 441926 - protein, 9 aa, Homo Sapiens
KHKFVDKPG

SEQ ID NO: 441927 - protein, 9 aa, Homo Sapiens
DSDILQMFV

SEQ ID NO: 441928 - protein, 9 aa, Homo Sapiens
DKKSCGNQN

SEQ ID NO: 441929 - protein, 9 aa, Homo Sapiens
LKYFLSQPS

SEQ ID NO: 441930 - protein, 9 aa, Homo Sapiens
HTIVQGFFH

SEQ ID NO: 441931 - protein, 9 aa, Homo Sapiens
NNYLHNFCS

SEQ ID NO: 441932 - protein, 9 aa, Homo Sapiens
TEDNFFEIC

SEQ ID NO: 441933 - protein, 9 aa, Homo Sapiens
GMCISDAFG

SEQ ID NO: 441934 - protein, 9 aa, Homo Sapiens
ICSCVPPCT

SEQ ID NO: 441935 - protein, 9 aa, Homo Sapiens
DHKIIHTGE

SEQ ID NO: 441936 - protein, 9 aa, Homo Sapiens
QSTFNNTIK

SEQ ID NO: 441937 - protein, 9 aa, Homo Sapiens
SKHALDFIH

SEQ ID NO: 441938 - protein, 9 aa, Homo Sapiens
NNSKCYHIG

SEQ ID NO: 441939 - protein, 9 aa, Homo Sapiens
LNARFLVMA

SEQ ID NO: 441940 - protein, 9 aa, Homo Sapiens
NINLALEQG

SEQ ID NO: 441941 - protein, 9 aa, Homo Sapiens
WMDEVIKLC

SEQ ID NO: 441942 - protein, 9 aa, Homo Sapiens
VTRRKMAYE

SEQ ID NO: 441943 - protein, 9 aa, Homo Sapiens
LLQNNVPAV

SEQ ID NO: 441944 - protein, 9 aa, Homo Sapiens
LRKFEFWAS

SEQ ID NO: 441945 - protein, 9 aa, Homo Sapiens
LKRINESLL

SEQ ID NO: 441946 - protein, 9 aa, Homo Sapiens
FATPNMITD

SEQ ID NO: 441947 - protein, 9 aa, Homo Sapiens
VIKGKVIYT

SEQ ID NO: 441948 - protein, 9 aa, Homo Sapiens
ELANAREIN

SEQ ID NO: 441949 - protein, 9 aa, Homo Sapiens
CSEPLVQPS

SEQ ID NO: 441950 - protein, 9 aa, Homo Sapiens
IILLNYGKS

SEQ ID NO: 441951 - protein, 9 aa, Homo Sapiens
LFNVTSHGS

SEQ ID NO: 441952 - protein, 9 aa, Homo Sapiens
QKDKASEKK

SEQ ID NO: 441953 - protein, 9 aa, Homo Sapiens
MYNLVEPVN

SEQ ID NO: 441954 - protein, 9 aa, Homo Sapiens
SLLQGSDIL

SEQ ID NO: 441955 - protein, 9 aa, Homo Sapiens
GRYVLCEET

SEQ ID NO: 441956 - protein, 9 aa, Homo Sapiens
NTQTPVEYP

SEQ ID NO: 441957 - protein, 9 aa, Homo Sapiens
LSSSYQEPI

SEQ ID NO: 441958 - protein, 9 aa, Homo Sapiens
GIKMGKQGI

SEQ ID NO: 441959 - protein, 9 aa, Homo Sapiens
ANKDETIQF

SEQ ID NO: 441960 - protein, 9 aa, Homo Sapiens
WEADREMGS

SEQ ID NO: 441961 - protein, 9 aa, Homo Sapiens
QLEDVTHKF

SEQ ID NO: 441962 - protein, 9 aa, Homo Sapiens
KKGGLKHIT

SEQ ID NO: 441963 - protein, 9 aa, Homo Sapiens
YGLQVKYDE

SEQ ID NO: 441964 - protein, 9 aa, Homo Sapiens
DKVMQLLLE

SEQ ID NO: 441965 - protein, 9 aa, Homo Sapiens
SDGGTYQCF

SEQ ID NO: 441966 - protein, 9 aa, Homo Sapiens
AELSVPLLI

SEQ ID NO: 441967 - protein, 9 aa, Homo Sapiens
FTSLFDAKE

SEQ ID NO: 441968 - protein, 9 aa, Homo Sapiens
PRVAADNVC

SEQ ID NO: 441969 - protein, 9 aa, Homo Sapiens
GANDSYDFF

SEQ ID NO: 441970 - protein, 9 aa, Homo Sapiens
PVASPSAHS

SEQ ID NO: 441971 - protein, 9 aa, Homo Sapiens
SYVTTLSYF

SEQ ID NO: 441972 - protein, 9 aa, Homo Sapiens
GLCVEKIAF

SEQ ID NO: 441973 - protein, 9 aa, Homo Sapiens
RNRILSRNV

SEQ ID NO: 441974 - protein, 9 aa, Homo Sapiens
HIDFCRYST

SEQ ID NO: 441975 - protein, 9 aa, Homo Sapiens
GVVTHYVLP

SEQ ID NO: 441976 - protein, 9 aa, Homo Sapiens
EWQNRLSDY

SEQ ID NO: 441977 - protein, 9 aa, Homo Sapiens
ILLLEIESI

SEQ ID NO: 441978 - protein, 9 aa, Homo Sapiens
SMFEQTRIQ

SEQ ID NO: 441979 - protein, 9 aa, Homo Sapiens
LNHLVDEAH

SEQ ID NO: 441980 - protein, 9 aa, Homo Sapiens
ICAVSHVFM

SEQ ID NO: 441981 - protein, 9 aa, Homo Sapiens
QNKLFQVAK

SEQ ID NO: 441982 - protein, 9 aa, Homo Sapiens
WKAVVVQMA

SEQ ID NO: 441983 - protein, 9 aa, Homo Sapiens
PLFFLTSSS

SEQ ID NO: 441984 - protein, 9 aa, Homo Sapiens
ETVREEVML

SEQ ID NO: 441985 - protein, 9 aa, Homo Sapiens
SKLFSYKDF

SEQ ID NO: 441986 - protein, 9 aa, Homo Sapiens
LSRYRGLTG

SEQ ID NO: 441987 - protein, 9 aa, Homo Sapiens
CEETTKSQD

SEQ ID NO: 441988 - protein, 9 aa, Homo Sapiens
SHTCLTQFL

SEQ ID NO: 441989 - protein, 9 aa, Homo Sapiens
VEMKYLEVR

SEQ ID NO: 441990 - protein, 9 aa, Homo Sapiens
FSPNMLGSV

SEQ ID NO: 441991 - protein, 9 aa, Homo Sapiens
DQDGIGLVS

SEQ ID NO: 441992 - protein, 9 aa, Homo Sapiens
KRKQNEDDE

SEQ ID NO: 441993 - protein, 9 aa, Homo Sapiens
NASTPFQTI

SEQ ID NO: 441994 - protein, 9 aa, Homo Sapiens
DITATLAAE

SEQ ID NO: 441995 - protein, 9 aa, Homo Sapiens
QGTQHDRFD

SEQ ID NO: 441996 - protein, 9 aa, Homo Sapiens
NLPADIKKS

SEQ ID NO: 441997 - protein, 9 aa, Homo Sapiens
ACKECGQAF

SEQ ID NO: 441998 - protein, 9 aa, Homo Sapiens
RSLTDDFER

SEQ ID NO: 441999 - protein, 9 aa, Homo Sapiens
GNSYVSSTL

SEQ ID NO: 442000 - protein, 9 aa, Homo Sapiens
DNSPGDLGN

SEQ ID NO: 442001 - protein, 9 aa, Homo Sapiens
YKRIDGGIT

SEQ ID NO: 442002 - protein, 9 aa, Homo Sapiens
QKLENISPE

SEQ ID NO: 442003 - protein, 9 aa, Homo Sapiens
TYLLSANDF

SEQ ID NO: 442004 - protein, 9 aa, Homo Sapiens
QYFVKLRII

SEQ ID NO: 442005 - protein, 9 aa, Homo Sapiens
PLGTQGINS

SEQ ID NO: 442006 - protein, 9 aa, Homo Sapiens
QSTEKLEKE

SEQ ID NO: 442007 - protein, 9 aa, Homo Sapiens
NVAKDLPVY

SEQ ID NO: 442008 - protein, 9 aa, Homo Sapiens
SSKLDTDTG

SEQ ID NO: 442009 - protein, 9 aa, Homo Sapiens
VYCSPSLCC

SEQ ID NO: 442010 - protein, 9 aa, Homo Sapiens
NLKVWDVEK

SEQ ID NO: 442011 - protein, 9 aa, Homo Sapiens
QKGNVVNLN

SEQ ID NO: 442012 - protein, 9 aa, Homo Sapiens
SKRTSDQIR

SEQ ID NO: 442013 - protein, 9 aa, Homo Sapiens
VQWADLITC

SEQ ID NO: 442014 - protein, 9 aa, Homo Sapiens
SPKKQHKIE

SEQ ID NO: 442015 - protein, 9 aa, Homo Sapiens
PSTNTCPDG

SEQ ID NO: 442016 - protein, 9 aa, Homo Sapiens
GNTEEAGRI

SEQ ID NO: 442017 - protein, 9 aa, Homo Sapiens
GTRSPAPTR

SEQ ID NO: 442018 - protein, 9 aa, Homo Sapiens
MEFLQNNRT

SEQ ID NO: 442019 - protein, 9 aa, Homo Sapiens
LCGKSFNHS

SEQ ID NO: 442020 - protein, 9 aa, Homo Sapiens
YPYLDIALD

SEQ ID NO: 442021 - protein, 9 aa, Homo Sapiens
RIKNSKASK

SEQ ID NO: 442022 - protein, 9 aa, Homo Sapiens
QIPQRDQRV

SEQ ID NO: 442023 - protein, 9 aa, Homo Sapiens
FEPLKNYYQ

SEQ ID NO: 442024 - protein, 9 aa, Homo Sapiens
SITGASASP

SEQ ID NO: 442025 - protein, 9 aa, Homo Sapiens
FSWHSDLIF

SEQ ID NO: 442026 - protein, 9 aa, Homo Sapiens
WDQNSPLTN

SEQ ID NO: 442027 - protein, 9 aa, Homo Sapiens
QTTVQTVAS

SEQ ID NO: 442028 - protein, 9 aa, Homo Sapiens
VRDYYELVG

SEQ ID NO: 442029 - protein, 9 aa, Homo Sapiens
VQKPFIRLS

SEQ ID NO: 442030 - protein, 9 aa, Homo Sapiens
VPMVLVGNN

SEQ ID NO: 442031 - protein, 9 aa, Homo Sapiens
YFGVRALHH

SEQ ID NO: 442032 - protein, 9 aa, Homo Sapiens
KKVSNQIFE

SEQ ID NO: 442033 - protein, 9 aa, Homo Sapiens
ELMTHKLKH

SEQ ID NO: 442034 - protein, 9 aa, Homo Sapiens
RELEEQNLL

SEQ ID NO: 442035 - protein, 9 aa, Homo Sapiens
QPPRFFNED

SEQ ID NO: 442036 - protein, 9 aa, Homo Sapiens
AHSIVVILL

SEQ ID NO: 442037 - protein, 9 aa, Homo Sapiens
FENPHASTM

SEQ ID NO: 442038 - protein, 9 aa, Homo Sapiens
NSNTRFRIA

SEQ ID NO: 442039 - protein, 9 aa, Homo Sapiens
SYSESSGYN

SEQ ID NO: 442040 - protein, 9 aa, Homo Sapiens
QLQSQENFD

SEQ ID NO: 442041 - protein, 9 aa, Homo Sapiens
DNFSSEIIS

SEQ ID NO: 442042 - protein, 9 aa, Homo Sapiens
PSPIISPST

SEQ ID NO: 442043 - protein, 9 aa, Homo Sapiens
NINKYLDQE

SEQ ID NO: 442044 - protein, 9 aa, Homo Sapiens
LAVPLGHLE

SEQ ID NO: 442045 - protein, 9 aa, Homo Sapiens
LKRTELETK

SEQ ID NO: 442046 - protein, 9 aa, Homo Sapiens
AWKHPDYVG

SEQ ID NO: 442047 - protein, 9 aa, Homo Sapiens
TDHKIIHTG

SEQ ID NO: 442048 - protein, 9 aa, Homo Sapiens
LINHQIIHT

SEQ ID NO: 442049 - protein, 9 aa, Homo Sapiens
GCVLTRGNL

SEQ ID NO: 442050 - protein, 9 aa, Homo Sapiens
HMFCANALA

SEQ ID NO: 442051 - protein, 9 aa, Homo Sapiens
SWCLLRESI

SEQ ID NO: 442052 - protein, 9 aa, Homo Sapiens
LQLEYDWLV

SEQ ID NO: 442053 - protein, 9 aa, Homo Sapiens
HKITSIPET

SEQ ID NO: 442054 - protein, 9 aa, Homo Sapiens
EKNKDATRT

SEQ ID NO: 442055 - protein, 9 aa, Homo Sapiens
LLRQTIAAT

SEQ ID NO: 442056 - protein, 9 aa, Homo Sapiens
FPTYFRADK

SEQ ID NO: 442057 - protein, 9 aa, Homo Sapiens
DSTSLTARE

SEQ ID NO: 442058 - protein, 9 aa, Homo Sapiens
QLYLQMHSK

SEQ ID NO: 442059 - protein, 9 aa, Homo Sapiens
NPLLWMFSF

SEQ ID NO: 442060 - protein, 9 aa, Homo Sapiens
DHQIIHTGE

SEQ ID NO: 442061 - protein, 9 aa, Homo Sapiens
DDLSCPYHH

SEQ ID NO: 442062 - protein, 9 aa, Homo Sapiens
VALRKIRRY

SEQ ID NO: 442063 - protein, 9 aa, Homo Sapiens
NNMEMMHKR

SEQ ID NO: 442064 - protein, 9 aa, Homo Sapiens
FCSHLGVIE

SEQ ID NO: 442065 - protein, 9 aa, Homo Sapiens
KIHSVEGSQ

SEQ ID NO: 442066 - protein, 9 aa, Homo Sapiens
GTRYMLSRP

SEQ ID NO: 442067 - protein, 9 aa, Homo Sapiens
DSPAKPENN

SEQ ID NO: 442068 - protein, 9 aa, Homo Sapiens
CENKCGNCS

SEQ ID NO: 442069 - protein, 9 aa, Homo Sapiens
SPLLAGLYM

SEQ ID NO: 442070 - protein, 9 aa, Homo Sapiens
CQLLKGIIY

SEQ ID NO: 442071 - protein, 9 aa, Homo Sapiens
EEDFSNDGS

SEQ ID NO: 442072 - protein, 9 aa, Homo Sapiens
STKNPARTV

SEQ ID NO: 442073 - protein, 9 aa, Homo Sapiens
AVNMFQTLP

SEQ ID NO: 442074 - protein, 9 aa, Homo Sapiens
FFHKRYWKT

SEQ ID NO: 442075 - protein, 9 aa, Homo Sapiens
VQAVGGAPA

SEQ ID NO: 442076 - protein, 9 aa, Homo Sapiens
HSHNIIHRY

SEQ ID NO: 442077 - protein, 9 aa, Homo Sapiens
LEKSAHKDS

SEQ ID NO: 442078 - protein, 9 aa, Homo Sapiens
DDNENGPKP

SEQ ID NO: 442079 - protein, 9 aa, Homo Sapiens
GAAAGKNTL

SEQ ID NO: 442080 - protein, 9 aa, Homo Sapiens
MQRPPPYCD

SEQ ID NO: 442081 - protein, 9 aa, Homo Sapiens
SIATWHGND

SEQ ID NO: 442082 - protein, 9 aa, Homo Sapiens
YITKNTAKL

SEQ ID NO: 442083 - protein, 9 aa, Homo Sapiens
EFYGRYRIS

SEQ ID NO: 442084 - protein, 9 aa, Homo Sapiens
QLAAIIRPR

SEQ ID NO: 442085 - protein, 9 aa, Homo Sapiens
QYEAACSKC

SEQ ID NO: 442086 - protein, 9 aa, Homo Sapiens
AESYSSISS

SEQ ID NO: 442087 - protein, 9 aa, Homo Sapiens
LVKRSYNKL

SEQ ID NO: 442088 - protein, 9 aa, Homo Sapiens
GAPAEEAEL

SEQ ID NO: 442089 - protein, 9 aa, Homo Sapiens
LAKCKGSLL

SEQ ID NO: 442090 - protein, 9 aa, Homo Sapiens
ILGVMLTSY

SEQ ID NO: 442091 - protein, 9 aa, Homo Sapiens
NLDILSQLN

SEQ ID NO: 442092 - protein, 9 aa, Homo Sapiens
KHKGVAASY

SEQ ID NO: 442093 - protein, 9 aa, Homo Sapiens
SSNLQRHVC

SEQ ID NO: 442094 - protein, 9 aa, Homo Sapiens
VVDLIRAGK

SEQ ID NO: 442095 - protein, 9 aa, Homo Sapiens
TPGHPCRLS

SEQ ID NO: 442096 - protein, 9 aa, Homo Sapiens
KRLQYYFTL

SEQ ID NO: 442097 - protein, 9 aa, Homo Sapiens
AVEERRNMQ

SEQ ID NO: 442098 - protein, 9 aa, Homo Sapiens
ESNNFEMLN

SEQ ID NO: 442099 - protein, 9 aa, Homo Sapiens
EDINYNGPM

SEQ ID NO: 442100 - protein, 9 aa, Homo Sapiens
NEVCHISDL

SEQ ID NO: 442101 - protein, 9 aa, Homo Sapiens
KRKVELERN

SEQ ID NO: 442102 - protein, 9 aa, Homo Sapiens
GDFYITGGR

SEQ ID NO: 442103 - protein, 9 aa, Homo Sapiens
MYGWRKRCL

SEQ ID NO: 442104 - protein, 9 aa, Homo Sapiens
NVQLLHSAA

SEQ ID NO: 442105 - protein, 9 aa, Homo Sapiens
YENGYYCPS

SEQ ID NO: 442106 - protein, 9 aa, Homo Sapiens
CFTYFNIFH

SEQ ID NO: 442107 - protein, 9 aa, Homo Sapiens
PKGLDEARA

SEQ ID NO: 442108 - protein, 9 aa, Homo Sapiens
GTNAREILD

SEQ ID NO: 442109 - protein, 9 aa, Homo Sapiens
LFHKHWNID

SEQ ID NO: 442110 - protein, 9 aa, Homo Sapiens
DINYNGPML

SEQ ID NO: 442111 - protein, 9 aa, Homo Sapiens
STLGDDLNS

SEQ ID NO: 442112 - protein, 9 aa, Homo Sapiens
NTALVKTSD

SEQ ID NO: 442113 - protein, 9 aa, Homo Sapiens
CNWIIVLVS

SEQ ID NO: 442114 - protein, 9 aa, Homo Sapiens
NMNLANNFP

SEQ ID NO: 442115 - protein, 9 aa, Homo Sapiens
VNEATRVFH

SEQ ID NO: 442116 - protein, 9 aa, Homo Sapiens
TAQGDGYGT

SEQ ID NO: 442117 - protein, 9 aa, Homo Sapiens
CCVRNNRPQ

SEQ ID NO: 442118 - protein, 9 aa, Homo Sapiens
IKLCYFQEP

SEQ ID NO: 442119 - protein, 9 aa, Homo Sapiens
RHRLQHEGI

SEQ ID NO: 442120 - protein, 9 aa, Homo Sapiens
GVWSNHGCV

SEQ ID NO: 442121 - protein, 9 aa, Homo Sapiens
GARVTRHPF

SEQ ID NO: 442122 - protein, 9 aa, Homo Sapiens
VEPSEVEAF

SEQ ID NO: 442123 - protein, 9 aa, Homo Sapiens
VKVEVEDLK

SEQ ID NO: 442124 - protein, 9 aa, Homo Sapiens
CLFQGIGRL

SEQ ID NO: 442125 - protein, 9 aa, Homo Sapiens
ESKVTFYIL

SEQ ID NO: 442126 - protein, 9 aa, Homo Sapiens
PQVYSPGYY

SEQ ID NO: 442127 - protein, 9 aa, Homo Sapiens
KKNKNKGKK

SEQ ID NO: 442128 - protein, 9 aa, Homo Sapiens
TFCSQYIMG

SEQ ID NO: 442129 - protein, 9 aa, Homo Sapiens
QDCQKPNYM

SEQ ID NO: 442130 - protein, 9 aa, Homo Sapiens
LYLQLEDVT

SEQ ID NO: 442131 - protein, 9 aa, Homo Sapiens
RRCTSSLPR

SEQ ID NO: 442132 - protein, 9 aa, Homo Sapiens
EMGSSSHAG

SEQ ID NO: 442133 - protein, 9 aa, Homo Sapiens
IMAEKLVKL

SEQ ID NO: 442134 - protein, 9 aa, Homo Sapiens
QSSSSSGFV

SEQ ID NO: 442135 - protein, 9 aa, Homo Sapiens
KIGCTNVDG

SEQ ID NO: 442136 - protein, 9 aa, Homo Sapiens
CGHYYDASK

SEQ ID NO: 442137 - protein, 9 aa, Homo Sapiens
SQQSVPATI

SEQ ID NO: 442138 - protein, 9 aa, Homo Sapiens
YFVVIAAIG

SEQ ID NO: 442139 - protein, 9 aa, Homo Sapiens
NSKAAAHAV

SEQ ID NO: 442140 - protein, 9 aa, Homo Sapiens
FKVKDIHST

SEQ ID NO: 442141 - protein, 9 aa, Homo Sapiens
EAAVIDDIQ

SEQ ID NO: 442142 - protein, 9 aa, Homo Sapiens
EYDWLVPGR

SEQ ID NO: 442143 - protein, 9 aa, Homo Sapiens
RLRPRITKL

SEQ ID NO: 442144 - protein, 9 aa, Homo Sapiens
PPPSLPIPG

SEQ ID NO: 442145 - protein, 9 aa, Homo Sapiens
FTLSENMIL

SEQ ID NO: 442146 - protein, 9 aa, Homo Sapiens
ALERPDFRE

SEQ ID NO: 442147 - protein, 9 aa, Homo Sapiens
NKVVQDDTE

SEQ ID NO: 442148 - protein, 9 aa, Homo Sapiens
GGLEAFDYF

SEQ ID NO: 442149 - protein, 9 aa, Homo Sapiens
DVFIPVSQG

SEQ ID NO: 442150 - protein, 9 aa, Homo Sapiens
KSTPLHKLC

SEQ ID NO: 442151 - protein, 9 aa, Homo Sapiens
VTTPEPDIY

SEQ ID NO: 442152 - protein, 9 aa, Homo Sapiens
GGTKCGAGK

SEQ ID NO: 442153 - protein, 9 aa, Homo Sapiens
EYESWREMC

SEQ ID NO: 442154 - protein, 9 aa, Homo Sapiens
SSKMKAPVL

SEQ ID NO: 442155 - protein, 9 aa, Homo Sapiens
QHLGLGGKT

SEQ ID NO: 442156 - protein, 9 aa, Homo Sapiens
HIANHLIGD

SEQ ID NO: 442157 - protein, 9 aa, Homo Sapiens
DSGENKPGR

SEQ ID NO: 442158 - protein, 9 aa, Homo Sapiens
YSGMVLASE

SEQ ID NO: 442159 - protein, 9 aa, Homo Sapiens
AQLAIIILN

SEQ ID NO: 442160 - protein, 9 aa, Homo Sapiens
LEVWDLDDI

SEQ ID NO: 442161 - protein, 9 aa, Homo Sapiens
NEVFASRHH

SEQ ID NO: 442162 - protein, 9 aa, Homo Sapiens
FFFFVTGCD

SEQ ID NO: 442163 - protein, 9 aa, Homo Sapiens
RYKVLREIL

SEQ ID NO: 442164 - protein, 9 aa, Homo Sapiens
RNICNNYAE

SEQ ID NO: 442165 - protein, 9 aa, Homo Sapiens
GGGSSTFHR

SEQ ID NO: 442166 - protein, 9 aa, Homo Sapiens
DLSMEQEKL

SEQ ID NO: 442167 - protein, 9 aa, Homo Sapiens
DGKVTTEEF

SEQ ID NO: 442168 - protein, 9 aa, Homo Sapiens
EDKQIKRKW

SEQ ID NO: 442169 - protein, 9 aa, Homo Sapiens
DLGKYNGYA

SEQ ID NO: 442170 - protein, 9 aa, Homo Sapiens
TLSGSSYSN

SEQ ID NO: 442171 - protein, 9 aa, Homo Sapiens
TSDVINAVK

SEQ ID NO: 442172 - protein, 9 aa, Homo Sapiens
YNCIGLSQG

SEQ ID NO: 442173 - protein, 9 aa, Homo Sapiens
LLHNNIKLL

SEQ ID NO: 442174 - protein, 9 aa, Homo Sapiens
QGKVPEMPR

SEQ ID NO: 442175 - protein, 9 aa, Homo Sapiens
RHHSYLYSH

SEQ ID NO: 442176 - protein, 9 aa, Homo Sapiens
KFQVPKIAE

SEQ ID NO: 442177 - protein, 9 aa, Homo Sapiens
TLDLDYTGI

SEQ ID NO: 442178 - protein, 9 aa, Homo Sapiens
FIILGLFNH

SEQ ID NO: 442179 - protein, 9 aa, Homo Sapiens
DQQNQVLET

SEQ ID NO: 442180 - protein, 9 aa, Homo Sapiens
RKYSVWMGG

SEQ ID NO: 442181 - protein, 9 aa, Homo Sapiens
GLFDKNYGS

SEQ ID NO: 442182 - protein, 9 aa, Homo Sapiens
KYQGSQISP

SEQ ID NO: 442183 - protein, 9 aa, Homo Sapiens
YESVQTPGT

SEQ ID NO: 442184 - protein, 9 aa, Homo Sapiens
MEELMEVIT

SEQ ID NO: 442185 - protein, 9 aa, Homo Sapiens
LSWMEPFGI

SEQ ID NO: 442186 - protein, 9 aa, Homo Sapiens
FRDEAWSTL

SEQ ID NO: 442187 - protein, 9 aa, Homo Sapiens
ASEGNSYVS

SEQ ID NO: 442188 - protein, 9 aa, Homo Sapiens
GSWTYDKAN

SEQ ID NO: 442189 - protein, 9 aa, Homo Sapiens
LCSGSHITF

SEQ ID NO: 442190 - protein, 9 aa, Homo Sapiens
YFIRSLDHC

SEQ ID NO: 442191 - protein, 9 aa, Homo Sapiens
KALASECAP

SEQ ID NO: 442192 - protein, 9 aa, Homo Sapiens
QQLDYLRAL

SEQ ID NO: 442193 - protein, 9 aa, Homo Sapiens
QIPMYLLLG

SEQ ID NO: 442194 - protein, 9 aa, Homo Sapiens
KCSICGKAF

SEQ ID NO: 442195 - protein, 9 aa, Homo Sapiens
TLQFFKKGQ

SEQ ID NO: 442196 - protein, 9 aa, Homo Sapiens
DDSAKQEGA

SEQ ID NO: 442197 - protein, 9 aa, Homo Sapiens
EDGFLLAVS

SEQ ID NO: 442198 - protein, 9 aa, Homo Sapiens
DDLQKSVYM

SEQ ID NO: 442199 - protein, 9 aa, Homo Sapiens
ADKVLWVLV

SEQ ID NO: 442200 - protein, 9 aa, Homo Sapiens
LSITVFAAE

SEQ ID NO: 442201 - protein, 9 aa, Homo Sapiens
LQLQHFEHN

SEQ ID NO: 442202 - protein, 9 aa, Homo Sapiens
VGLLLVETL

SEQ ID NO: 442203 - protein, 9 aa, Homo Sapiens
LQSPESASE

SEQ ID NO: 442204 - protein, 9 aa, Homo Sapiens
DYVEVAKVQ

SEQ ID NO: 442205 - protein, 9 aa, Homo Sapiens
LFPKDTINV

SEQ ID NO: 442206 - protein, 9 aa, Homo Sapiens
SSALNLTEL

SEQ ID NO: 442207 - protein, 9 aa, Homo Sapiens
EHLTKVLKE

SEQ ID NO: 442208 - protein, 9 aa, Homo Sapiens
TVLTGNGDD

SEQ ID NO: 442209 - protein, 9 aa, Homo Sapiens
RALHHLHQF

SEQ ID NO: 442210 - protein, 8 aa, Homo Sapiens
IVYFPGIL

SEQ ID NO: 442211 - protein, 9 aa, Homo Sapiens
KWLAAFHNF

SEQ ID NO: 442212 - protein, 9 aa, Homo Sapiens
MSSHLHKTE

SEQ ID NO: 442213 - protein, 9 aa, Homo Sapiens
QQLVEADIN

SEQ ID NO: 442214 - protein, 9 aa, Homo Sapiens
YFIDSTNLN

SEQ ID NO: 442215 - protein, 9 aa, Homo Sapiens
VHIRQKHSH

SEQ ID NO: 442216 - protein, 9 aa, Homo Sapiens
GLEQISFQW

SEQ ID NO: 442217 - protein, 9 aa, Homo Sapiens
DIQAMEDNL

SEQ ID NO: 442218 - protein, 9 aa, Homo Sapiens
VKMESGGGA

SEQ ID NO: 442219 - protein, 9 aa, Homo Sapiens
IVCRVFSSK

SEQ ID NO: 442220 - protein, 9 aa, Homo Sapiens
AYYCALWEV

SEQ ID NO: 442221 - protein, 9 aa, Homo Sapiens
FLLLDVAMS

SEQ ID NO: 442222 - protein, 9 aa, Homo Sapiens
NKKANECYS

SEQ ID NO: 442223 - protein, 9 aa, Homo Sapiens
AYYCALWEL

SEQ ID NO: 442224 - protein, 9 aa, Homo Sapiens
GDLIEIYRF

SEQ ID NO: 442225 - protein, 9 aa, Homo Sapiens
LIDTNLFGV

SEQ ID NO: 442226 - protein, 9 aa, Homo Sapiens
RASILLSQD

SEQ ID NO: 442227 - protein, 9 aa, Homo Sapiens
RRRDSDYDK

SEQ ID NO: 442228 - protein, 9 aa, Homo Sapiens
NGNVEATVV

SEQ ID NO: 442229 - protein, 9 aa, Homo Sapiens
IPEIRNTLP

SEQ ID NO: 442230 - protein, 9 aa, Homo Sapiens
RTSPFNFFH

SEQ ID NO: 442231 - protein, 9 aa, Homo Sapiens
NKTLLLYVL

SEQ ID NO: 442232 - protein, 9 aa, Homo Sapiens
HHRRPPHNA

SEQ ID NO: 442233 - protein, 9 aa, Homo Sapiens
TLENVKSQK

SEQ ID NO: 442234 - protein, 9 aa, Homo Sapiens
LDKFLTSVS

SEQ ID NO: 442235 - protein, 9 aa, Homo Sapiens
QYARTQFVS

SEQ ID NO: 442236 - protein, 9 aa, Homo Sapiens
YANVRLAAV

SEQ ID NO: 442237 - protein, 9 aa, Homo Sapiens
MKKIFDSPC

SEQ ID NO: 442238 - protein, 9 aa, Homo Sapiens
KYLGFKMFA

SEQ ID NO: 442239 - protein, 9 aa, Homo Sapiens
VLISEFQML

SEQ ID NO: 442240 - protein, 9 aa, Homo Sapiens
GKYGTQICP

SEQ ID NO: 442241 - protein, 9 aa, Homo Sapiens
VKDGGGLST

SEQ ID NO: 442242 - protein, 9 aa, Homo Sapiens
NWLNTLLKT

SEQ ID NO: 442243 - protein, 9 aa, Homo Sapiens
GYGDTINCR

SEQ ID NO: 442244 - protein, 9 aa, Homo Sapiens
HIAKMPVKW

SEQ ID NO: 442245 - protein, 9 aa, Homo Sapiens
SRFLRSVTG

SEQ ID NO: 442246 - protein, 9 aa, Homo Sapiens
YLDAIKTFY

SEQ ID NO: 442247 - protein, 9 aa, Homo Sapiens
IDNATLAAD

SEQ ID NO: 442248 - protein, 9 aa, Homo Sapiens
PSTMLPIYP

SEQ ID NO: 442249 - protein, 9 aa, Homo Sapiens
KFSKVDKMI

SEQ ID NO: 442250 - protein, 9 aa, Homo Sapiens
FSQLSVNDS

SEQ ID NO: 442251 - protein, 9 aa, Homo Sapiens
QDFITSLFP

SEQ ID NO: 442252 - protein, 9 aa, Homo Sapiens
SGASLAARE

SEQ ID NO: 442253 - protein, 9 aa, Homo Sapiens
SRNREAKQL

SEQ ID NO: 442254 - protein, 9 aa, Homo Sapiens
LRYDTIFQI

SEQ ID NO: 442255 - protein, 9 aa, Homo Sapiens
LAKEIQRSQ

SEQ ID NO: 442256 - protein, 9 aa, Homo Sapiens
VYSPGYYIC

SEQ ID NO: 442257 - protein, 9 aa, Homo Sapiens
AGKKWGHKA

SEQ ID NO: 442258 - protein, 9 aa, Homo Sapiens
YYNEQSKFV

SEQ ID NO: 442259 - protein, 9 aa, Homo Sapiens
HGVPEFILV

SEQ ID NO: 442260 - protein, 9 aa, Homo Sapiens
GDPKIGATI

SEQ ID NO: 442261 - protein, 9 aa, Homo Sapiens
YTNSSKIPV

SEQ ID NO: 442262 - protein, 9 aa, Homo Sapiens
CSNSLIKEL

SEQ ID NO: 442263 - protein, 9 aa, Homo Sapiens
HQIIHTEER

SEQ ID NO: 442264 - protein, 9 aa, Homo Sapiens
DFWWCRLRA

SEQ ID NO: 442265 - protein, 9 aa, Homo Sapiens
EECEKRKII

SEQ ID NO: 442266 - protein, 9 aa, Homo Sapiens
TYYESVQTP

SEQ ID NO: 442267 - protein, 9 aa, Homo Sapiens
VSWGRGCTE

SEQ ID NO: 442268 - protein, 9 aa, Homo Sapiens
MMKEAHMLC

SEQ ID NO: 442269 - protein, 9 aa, Homo Sapiens
QLNLETTLQ

SEQ ID NO: 442270 - protein, 9 aa, Homo Sapiens
GQAERAVAG

SEQ ID NO: 442271 - protein, 9 aa, Homo Sapiens
FALNTRADK

SEQ ID NO: 442272 - protein, 9 aa, Homo Sapiens
SASDNLDEL

SEQ ID NO: 442273 - protein, 9 aa, Homo Sapiens
GQQHLRGCP

SEQ ID NO: 442274 - protein, 9 aa, Homo Sapiens
SSASRCRSA

SEQ ID NO: 442275 - protein, 9 aa, Homo Sapiens
GRNSTFKSV

SEQ ID NO: 442276 - protein, 9 aa, Homo Sapiens
TASVILCFR

SEQ ID NO: 442277 - protein, 9 aa, Homo Sapiens
TSKAVHEPG

SEQ ID NO: 442278 - protein, 9 aa, Homo Sapiens
RKLICDIFR

SEQ ID NO: 442279 - protein, 9 aa, Homo Sapiens
AEVRTHYAP

SEQ ID NO: 442280 - protein, 9 aa, Homo Sapiens
SSEENADDN

SEQ ID NO: 442281 - protein, 9 aa, Homo Sapiens
ATHQKEFNT

SEQ ID NO: 442282 - protein, 9 aa, Homo Sapiens
SRLTSHKII

SEQ ID NO: 442283 - protein, 9 aa, Homo Sapiens
LLDWHANTI

SEQ ID NO: 442284 - protein, 9 aa, Homo Sapiens
NQLYLHFCS

SEQ ID NO: 442285 - protein, 9 aa, Homo Sapiens
TVYCQEKDL

SEQ ID NO: 442286 - protein, 9 aa, Homo Sapiens
EDSIDPVDT

SEQ ID NO: 442287 - protein, 9 aa, Homo Sapiens
GVGPIPGLL

SEQ ID NO: 442288 - protein, 9 aa, Homo Sapiens
MSNRETGTL

SEQ ID NO: 442289 - protein, 9 aa, Homo Sapiens
SKVTHTVKF

SEQ ID NO: 442290 - protein, 9 aa, Homo Sapiens
CTVCLLAVN

SEQ ID NO: 442291 - protein, 9 aa, Homo Sapiens
TFVYLYNVA

SEQ ID NO: 442292 - protein, 9 aa, Homo Sapiens
NVTLNIHPS

SEQ ID NO: 442293 - protein, 9 aa, Homo Sapiens
VTLDEFIES

SEQ ID NO: 442294 - protein, 9 aa, Homo Sapiens
GLQNFNKQN

SEQ ID NO: 442295 - protein, 9 aa, Homo Sapiens
CLVQEHKKL

SEQ ID NO: 442296 - protein, 9 aa, Homo Sapiens
YVTELNNNM

SEQ ID NO: 442297 - protein, 9 aa, Homo Sapiens
HKTIEIESL

SEQ ID NO: 442298 - protein, 9 aa, Homo Sapiens
SCAAQIIGS

SEQ ID NO: 442299 - protein, 9 aa, Homo Sapiens
QNLAPRTAV

SEQ ID NO: 442300 - protein, 9 aa, Homo Sapiens
VCLRCCLSV

SEQ ID NO: 442301 - protein, 9 aa, Homo Sapiens
SRWQCSLMS

SEQ ID NO: 442302 - protein, 9 aa, Homo Sapiens
FQIEPTITR

SEQ ID NO: 442303 - protein, 9 aa, Homo Sapiens
SRHENASQV

SEQ ID NO: 442304 - protein, 9 aa, Homo Sapiens
DSSKHKRFY

SEQ ID NO: 442305 - protein, 9 aa, Homo Sapiens
QSDVSANHS

SEQ ID NO: 442306 - protein, 9 aa, Homo Sapiens
KADMVNKDL

SEQ ID NO: 442307 - protein, 9 aa, Homo Sapiens
KGAKKGMIV

SEQ ID NO: 442308 - protein, 9 aa, Homo Sapiens
VTDVVEATS

SEQ ID NO: 442309 - protein, 9 aa, Homo Sapiens
PNLPPTHDP

SEQ ID NO: 442310 - protein, 9 aa, Homo Sapiens
KDFREREGQ

SEQ ID NO: 442311 - protein, 9 aa, Homo Sapiens
KAISDKRVQ

SEQ ID NO: 442312 - protein, 9 aa, Homo Sapiens
IMDVVTMQY

SEQ ID NO: 442313 - protein, 9 aa, Homo Sapiens
NTLPARLDP

SEQ ID NO: 442314 - protein, 9 aa, Homo Sapiens
FFLFFIFLP

SEQ ID NO: 442315 - protein, 9 aa, Homo Sapiens
KTVKRLGIK

SEQ ID NO: 442316 - protein, 9 aa, Homo Sapiens
SHSRSRSSR

SEQ ID NO: 442317 - protein, 9 aa, Homo Sapiens
LFFYAGWLK

SEQ ID NO: 442318 - protein, 9 aa, Homo Sapiens
HLTDIEIVC

SEQ ID NO: 442319 - protein, 9 aa, Homo Sapiens
NLKYLEAAS

SEQ ID NO: 442320 - protein, 9 aa, Homo Sapiens
LCFLLLDVA

SEQ ID NO: 442321 - protein, 9 aa, Homo Sapiens
IMEAVRGSL

SEQ ID NO: 442322 - protein, 9 aa, Homo Sapiens
TIQVSYARP

SEQ ID NO: 442323 - protein, 9 aa, Homo Sapiens
RRRSQRILQ

SEQ ID NO: 442324 - protein, 9 aa, Homo Sapiens
EMLMKMHGL

SEQ ID NO: 442325 - protein, 9 aa, Homo Sapiens
WQEDALFAS

SEQ ID NO: 442326 - protein, 9 aa, Homo Sapiens
LISETLRRM

SEQ ID NO: 442327 - protein, 9 aa, Homo Sapiens
YRHPPPCLV

SEQ ID NO: 442328 - protein, 9 aa, Homo Sapiens
LCLCAILCC

SEQ ID NO: 442329 - protein, 9 aa, Homo Sapiens
NLNKMNDYA

SEQ ID NO: 442330 - protein, 9 aa, Homo Sapiens
ATGFFMGGV

SEQ ID NO: 442331 - protein, 9 aa, Homo Sapiens
VTPHRTSEN

SEQ ID NO: 442332 - protein, 9 aa, Homo Sapiens
DRKAQNDNS

SEQ ID NO: 442333 - protein, 9 aa, Homo Sapiens
IEGTNHKIT

SEQ ID NO: 442334 - protein, 9 aa, Homo Sapiens
DELRHIAQT

SEQ ID NO: 442335 - protein, 9 aa, Homo Sapiens
DAEVEHLTK

SEQ ID NO: 442336 - protein, 9 aa, Homo Sapiens
IHHPSGAVE

SEQ ID NO: 442337 - protein, 9 aa, Homo Sapiens
PTADHCPAE

SEQ ID NO: 442338 - protein, 9 aa, Homo Sapiens
ARCQSKVSY

SEQ ID NO: 442339 - protein, 9 aa, Homo Sapiens
ALGNVEGVP

SEQ ID NO: 442340 - protein, 9 aa, Homo Sapiens
IPRAYHSGF

SEQ ID NO: 442341 - protein, 9 aa, Homo Sapiens
PSPGAAQTT

SEQ ID NO: 442342 - protein, 9 aa, Homo Sapiens
SLRSIQFFY

SEQ ID NO: 442343 - protein, 9 aa, Homo Sapiens
GDKSPSASP

SEQ ID NO: 442344 - protein, 9 aa, Homo Sapiens
RGVYAIFGL

SEQ ID NO: 442345 - protein, 9 aa, Homo Sapiens
ILCLFQGIG

SEQ ID NO: 442346 - protein, 9 aa, Homo Sapiens
FVKHFCSHL

SEQ ID NO: 442347 - protein, 9 aa, Homo Sapiens
QNNTLSGSS

SEQ ID NO: 442348 - protein, 9 aa, Homo Sapiens
DVKALRASR

SEQ ID NO: 442349 - protein, 9 aa, Homo Sapiens
SHVPLTCPS

SEQ ID NO: 442350 - protein, 9 aa, Homo Sapiens
SNHYLDFSS

SEQ ID NO: 442351 - protein, 9 aa, Homo Sapiens
NDISGGVLN

SEQ ID NO: 442352 - protein, 9 aa, Homo Sapiens
LRASRVLRP

SEQ ID NO: 442353 - protein, 9 aa, Homo Sapiens
LSYLGLYFN

SEQ ID NO: 442354 - protein, 9 aa, Homo Sapiens
RTYATSSPG

SEQ ID NO: 442355 - protein, 9 aa, Homo Sapiens
KAVHSQTVS

SEQ ID NO: 442356 - protein, 9 aa, Homo Sapiens
GNPQNSPGL

SEQ ID NO: 442357 - protein, 9 aa, Homo Sapiens
NPDAWEFCQ

SEQ ID NO: 442358 - protein, 9 aa, Homo Sapiens
LTVEDFAVK

SEQ ID NO: 442359 - protein, 9 aa, Homo Sapiens
KRRGTRYML

SEQ ID NO: 442360 - protein, 9 aa, Homo Sapiens
MVNKDLLSD

SEQ ID NO: 442361 - protein, 9 aa, Homo Sapiens
KITLESFFA

SEQ ID NO: 442362 - protein, 9 aa, Homo Sapiens
RLFLHKLPK

SEQ ID NO: 442363 - protein, 9 aa, Homo Sapiens
LRKIRRYQK

SEQ ID NO: 442364 - protein, 9 aa, Homo Sapiens
HLLPPSTYS

SEQ ID NO: 442365 - protein, 9 aa, Homo Sapiens
DILGNFNLL

SEQ ID NO: 442366 - protein, 9 aa, Homo Sapiens
GLVLKRFFK

SEQ ID NO: 442367 - protein, 9 aa, Homo Sapiens
GKEEANKCA

SEQ ID NO: 442368 - protein, 9 aa, Homo Sapiens
NFLPWTNDP

SEQ ID NO: 442369 - protein, 9 aa, Homo Sapiens
RKQISEYNI

SEQ ID NO: 442370 - protein, 9 aa, Homo Sapiens
HTGKKPNSA

SEQ ID NO: 442371 - protein, 9 aa, Homo Sapiens
AKREVKQKV

SEQ ID NO: 442372 - protein, 9 aa, Homo Sapiens
ERAVAGYPD

SEQ ID NO: 442373 - protein, 9 aa, Homo Sapiens
RVLGYLNLA

SEQ ID NO: 442374 - protein, 9 aa, Homo Sapiens
CKESFTQNN

SEQ ID NO: 442375 - protein, 9 aa, Homo Sapiens
LKVLTEVYS

SEQ ID NO: 442376 - protein, 9 aa, Homo Sapiens
ELVGKPDFV

SEQ ID NO: 442377 - protein, 9 aa, Homo Sapiens
RSALVKVIL

SEQ ID NO: 442378 - protein, 9 aa, Homo Sapiens
PELDVYEAE

SEQ ID NO: 442379 - protein, 9 aa, Homo Sapiens
KPEQGYLAN

SEQ ID NO: 442380 - protein, 9 aa, Homo Sapiens
HSGSLQIHE

SEQ ID NO: 442381 - protein, 9 aa, Homo Sapiens
RPLKDCIWM

SEQ ID NO: 442382 - protein, 9 aa, Homo Sapiens
KLMVIPLVF

SEQ ID NO: 442383 - protein, 9 aa, Homo Sapiens
SGFCEDIQV

SEQ ID NO: 442384 - protein, 9 aa, Homo Sapiens
FTIASKKIK

SEQ ID NO: 442385 - protein, 9 aa, Homo Sapiens
LQQGSHPEG

SEQ ID NO: 442386 - protein, 9 aa, Homo Sapiens
SVNDSFRDL

SEQ ID NO: 442387 - protein, 9 aa, Homo Sapiens
SHSGSLQIH

SEQ ID NO: 442388 - protein, 9 aa, Homo Sapiens
PQQQCWSIP

SEQ ID NO: 442389 - protein, 9 aa, Homo Sapiens
RMSSNQPNL

SEQ ID NO: 442390 - protein, 9 aa, Homo Sapiens
GTTSVLSLA

SEQ ID NO: 442391 - protein, 9 aa, Homo Sapiens
STSALNNEL

SEQ ID NO: 442392 - protein, 9 aa, Homo Sapiens
EKSQLIHNN

SEQ ID NO: 442393 - protein, 9 aa, Homo Sapiens
IALGNTDNY

SEQ ID NO: 442394 - protein, 9 aa, Homo Sapiens
YFILGDHFR

SEQ ID NO: 442395 - protein, 9 aa, Homo Sapiens
IDTPFSYAV

SEQ ID NO: 442396 - protein, 9 aa, Homo Sapiens
GADKLLSGT

SEQ ID NO: 442397 - protein, 9 aa, Homo Sapiens
FGFLGGVSW

SEQ ID NO: 442398 - protein, 9 aa, Homo Sapiens
PNHYPNTHH

SEQ ID NO: 442399 - protein, 9 aa, Homo Sapiens
VYALGCLRI

SEQ ID NO: 442400 - protein, 9 aa, Homo Sapiens
PENNGHAKD

SEQ ID NO: 442401 - protein, 9 aa, Homo Sapiens
EGVDGNFIL

SEQ ID NO: 442402 - protein, 9 aa, Homo Sapiens
QQLEALKAV

SEQ ID NO: 442403 - protein, 9 aa, Homo Sapiens
AVCQLHMEF

SEQ ID NO: 442404 - protein, 9 aa, Homo Sapiens
DILHHEYFT

SEQ ID NO: 442405 - protein, 9 aa, Homo Sapiens
KSHRFTVLE

SEQ ID NO: 442406 - protein, 9 aa, Homo Sapiens
QSHKIPREP

SEQ ID NO: 442407 - protein, 9 aa, Homo Sapiens
SPAEIIIQV

SEQ ID NO: 442408 - protein, 9 aa, Homo Sapiens
AAVLGIGRH

SEQ ID NO: 442409 - protein, 9 aa, Homo Sapiens
IYLVVALAS

SEQ ID NO: 442410 - protein, 9 aa, Homo Sapiens
WQNCLLIFR

SEQ ID NO: 442411 - protein, 9 aa, Homo Sapiens
LVQPSAFKP

SEQ ID NO: 442412 - protein, 9 aa, Homo Sapiens
IYNHLLSVG

SEQ ID NO: 442413 - protein, 9 aa, Homo Sapiens
SSGTTHKII

SEQ ID NO: 442414 - protein, 9 aa, Homo Sapiens
PQVHFPKVI

SEQ ID NO: 442415 - protein, 9 aa, Homo Sapiens
GLKAHTYSI

SEQ ID NO: 442416 - protein, 9 aa, Homo Sapiens
EVVVSKARA

SEQ ID NO: 442417 - protein, 9 aa, Homo Sapiens
DVINAVKKI

SEQ ID NO: 442418 - protein, 9 aa, Homo Sapiens
VLFAHNEYL

SEQ ID NO: 442419 - protein, 9 aa, Homo Sapiens
NKFDTTCTP

SEQ ID NO: 442420 - protein, 9 aa, Homo Sapiens
LEEGRKSKS

SEQ ID NO: 442421 - protein, 9 aa, Homo Sapiens
VKITGHLYA

SEQ ID NO: 442422 - protein, 9 aa, Homo Sapiens
KTKYRIREK

SEQ ID NO: 442423 - protein, 9 aa, Homo Sapiens
LGNSRVTYA

SEQ ID NO: 442424 - protein, 9 aa, Homo Sapiens
KIQIIATVK

SEQ ID NO: 442425 - protein, 9 aa, Homo Sapiens
KLPIEIVNK

SEQ ID NO: 442426 - protein, 9 aa, Homo Sapiens
PLVDTRIQG

SEQ ID NO: 442427 - protein, 9 aa, Homo Sapiens
RFQCKESML

SEQ ID NO: 442428 - protein, 9 aa, Homo Sapiens
GGTYQCFVR

SEQ ID NO: 442429 - protein, 9 aa, Homo Sapiens
KVRILCLKE

SEQ ID NO: 442430 - protein, 9 aa, Homo Sapiens
CNYKVDKKP

SEQ ID NO: 442431 - protein, 9 aa, Homo Sapiens
VNIKLSNEQ

SEQ ID NO: 442432 - protein, 9 aa, Homo Sapiens
LLLDHPDRA

SEQ ID NO: 442433 - protein, 9 aa, Homo Sapiens
GVIPNSFGH

SEQ ID NO: 442434 - protein, 9 aa, Homo Sapiens
NKDATRTPS

SEQ ID NO: 442435 - protein, 9 aa, Homo Sapiens
LFFSAVDND

SEQ ID NO: 442436 - protein, 9 aa, Homo Sapiens
RAALLKRFN

SEQ ID NO: 442437 - protein, 9 aa, Homo Sapiens
IANHLIGDD

SEQ ID NO: 442438 - protein, 9 aa, Homo Sapiens
KAAVGELSD

SEQ ID NO: 442439 - protein, 9 aa, Homo Sapiens
LGGDFWYVT

SEQ ID NO: 442440 - protein, 9 aa, Homo Sapiens
KHIYYSDKY

SEQ ID NO: 442441 - protein, 9 aa, Homo Sapiens
SGNGRELVE

SEQ ID NO: 442442 - protein, 9 aa, Homo Sapiens
RIEEQKLSE

SEQ ID NO: 442443 - protein, 9 aa, Homo Sapiens
GKVTTEEFK

SEQ ID NO: 442444 - protein, 9 aa, Homo Sapiens
YNNMLCAGF

SEQ ID NO: 442445 - protein, 9 aa, Homo Sapiens
RSLNHLVDE

SEQ ID NO: 442446 - protein, 9 aa, Homo Sapiens
LPVKCNHIY

SEQ ID NO: 442447 - protein, 9 aa, Homo Sapiens
GKQGIINKE

SEQ ID NO: 442448 - protein, 9 aa, Homo Sapiens
FEVNDLPRA

SEQ ID NO: 442449 - protein, 9 aa, Homo Sapiens
DAVMSCAVA

SEQ ID NO: 442450 - protein, 9 aa, Homo Sapiens
DMQSTFNNT

SEQ ID NO: 442451 - protein, 9 aa, Homo Sapiens
NEATNPEDC

SEQ ID NO: 442452 - protein, 9 aa, Homo Sapiens
LEKCFSTGP

SEQ ID NO: 442453 - protein, 9 aa, Homo Sapiens
FSTCSPSTN

SEQ ID NO: 442454 - protein, 9 aa, Homo Sapiens
EELRQKCKD

SEQ ID NO: 442455 - protein, 9 aa, Homo Sapiens
PGHNELFRA

SEQ ID NO: 442456 - protein, 9 aa, Homo Sapiens
SPHIANIGH

SEQ ID NO: 442457 - protein, 9 aa, Homo Sapiens
VYYLYIKFS

SEQ ID NO: 442458 - protein, 9 aa, Homo Sapiens
FNLPSAAAY

SEQ ID NO: 442459 - protein, 9 aa, Homo Sapiens
NTRFRIAAK

SEQ ID NO: 442460 - protein, 9 aa, Homo Sapiens
DGKPRKVQF

SEQ ID NO: 442461 - protein, 9 aa, Homo Sapiens
QAAKKRKCE

SEQ ID NO: 442462 - protein, 9 aa, Homo Sapiens
TQEADPMKR

SEQ ID NO: 442463 - protein, 9 aa, Homo Sapiens
DIVNINISE

SEQ ID NO: 442464 - protein, 9 aa, Homo Sapiens
SGEHLWICP

SEQ ID NO: 442465 - protein, 9 aa, Homo Sapiens
AAEGIHLIK

SEQ ID NO: 442466 - protein, 9 aa, Homo Sapiens
LRRHHSYLY

SEQ ID NO: 442467 - protein, 9 aa, Homo Sapiens
KLNNQAELY

SEQ ID NO: 442468 - protein, 9 aa, Homo Sapiens
DLKMVEGTA

SEQ ID NO: 442469 - protein, 9 aa, Homo Sapiens
PQHFTSLWP

SEQ ID NO: 442470 - protein, 9 aa, Homo Sapiens
ISPILISGL

SEQ ID NO: 442471 - protein, 9 aa, Homo Sapiens
SIFCWEIPV

SEQ ID NO: 442472 - protein, 9 aa, Homo Sapiens
RDMVGELGT

SEQ ID NO: 442473 - protein, 9 aa, Homo Sapiens
GLTPFHYLN

SEQ ID NO: 442474 - protein, 9 aa, Homo Sapiens
LQKKIQEEE

SEQ ID NO: 442475 - protein, 9 aa, Homo Sapiens
AQEKDYLIT

SEQ ID NO: 442476 - protein, 9 aa, Homo Sapiens
ENLREPKSK

SEQ ID NO: 442477 - protein, 9 aa, Homo Sapiens
LACYNPFIY

SEQ ID NO: 442478 - protein, 9 aa, Homo Sapiens
SSKGMEHLY

SEQ ID NO: 442479 - protein, 9 aa, Homo Sapiens
LKPAQLPIY

SEQ ID NO: 442480 - protein, 9 aa, Homo Sapiens
PKKQHKIEG

SEQ ID NO: 442481 - protein, 9 aa, Homo Sapiens
DKLVNNRAI

SEQ ID NO: 442482 - protein, 9 aa, Homo Sapiens
RISQATDLE

SEQ ID NO: 442483 - protein, 9 aa, Homo Sapiens
TYSVSAVTM

SEQ ID NO: 442484 - protein, 9 aa, Homo Sapiens
PDLGSVDAG

SEQ ID NO: 442485 - protein, 9 aa, Homo Sapiens
RQQIKYFTC

SEQ ID NO: 442486 - protein, 9 aa, Homo Sapiens
KQGLSLIDF

SEQ ID NO: 442487 - protein, 9 aa, Homo Sapiens
GVYAIFGLY

SEQ ID NO: 442488 - protein, 9 aa, Homo Sapiens
IREHLNYWY

SEQ ID NO: 442489 - protein, 9 aa, Homo Sapiens
NYIESNSLN

SEQ ID NO: 442490 - protein, 9 aa, Homo Sapiens
ELHAKQKFY

SEQ ID NO: 442491 - protein, 9 aa, Homo Sapiens
NTLLAGPPY

SEQ ID NO: 442492 - protein, 9 aa, Homo Sapiens
KDSSSGTEQ

SEQ ID NO: 442493 - protein, 9 aa, Homo Sapiens
SEQVQWMET

SEQ ID NO: 442494 - protein, 9 aa, Homo Sapiens
SISKQALSK

SEQ ID NO: 442495 - protein, 9 aa, Homo Sapiens
ELDKLRNEV

SEQ ID NO: 442496 - protein, 9 aa, Homo Sapiens
YNVNEYSLR

SEQ ID NO: 442497 - protein, 9 aa, Homo Sapiens
KDTSMKGMR

SEQ ID NO: 442498 - protein, 9 aa, Homo Sapiens
ETRRNLEGD

SEQ ID NO: 442499 - protein, 9 aa, Homo Sapiens
IQWNKVSSG

SEQ ID NO: 442500 - protein, 9 aa, Homo Sapiens
ELPTTKSNY

SEQ ID NO: 442501 - protein, 9 aa, Homo Sapiens
FNTLNIHSS

SEQ ID NO: 442502 - protein, 9 aa, Homo Sapiens
FLIYISTTQ

SEQ ID NO: 442503 - protein, 9 aa, Homo Sapiens
SLDRKQISE

SEQ ID NO: 442504 - protein, 9 aa, Homo Sapiens
QVNRKVINF

SEQ ID NO: 442505 - protein, 9 aa, Homo Sapiens
PNTLKSLTS

SEQ ID NO: 442506 - protein, 9 aa, Homo Sapiens
EHLWICPQG

SEQ ID NO: 442507 - protein, 9 aa, Homo Sapiens
KGQLSRQTK

SEQ ID NO: 442508 - protein, 9 aa, Homo Sapiens
HISQVRMEW

SEQ ID NO: 442509 - protein, 9 aa, Homo Sapiens
NKCEKNIHF

SEQ ID NO: 442510 - protein, 9 aa, Homo Sapiens
EDSYPTPGN

SEQ ID NO: 442511 - protein, 9 aa, Homo Sapiens
KKWEGMANL

SEQ ID NO: 442512 - protein, 9 aa, Homo Sapiens
ALNRKVLYG

SEQ ID NO: 442513 - protein, 9 aa, Homo Sapiens
KKLIEQMVR

SEQ ID NO: 442514 - protein, 9 aa, Homo Sapiens
LSMLTSVVN

SEQ ID NO: 442515 - protein, 9 aa, Homo Sapiens
AAKFGLKSL

SEQ ID NO: 442516 - protein, 9 aa, Homo Sapiens
LKMTYPHQV

SEQ ID NO: 442517 - protein, 9 aa, Homo Sapiens
NGFANNPLQ

SEQ ID NO: 442518 - protein, 9 aa, Homo Sapiens
SSYFTRHQI

SEQ ID NO: 442519 - protein, 9 aa, Homo Sapiens
KKDITATLA

SEQ ID NO: 442520 - protein, 9 aa, Homo Sapiens
YEELLVWYG

SEQ ID NO: 442521 - protein, 9 aa, Homo Sapiens
AEESTIPTN

SEQ ID NO: 442522 - protein, 9 aa, Homo Sapiens
LVFLDSVTE

SEQ ID NO: 442523 - protein, 9 aa, Homo Sapiens
TEMLMKMHG

SEQ ID NO: 442524 - protein, 9 aa, Homo Sapiens
GEETQESLK

SEQ ID NO: 442525 - protein, 9 aa, Homo Sapiens
SYKTNESLT

SEQ ID NO: 442526 - protein, 9 aa, Homo Sapiens
TSVSTVLTS

SEQ ID NO: 442527 - protein, 9 aa, Homo Sapiens
ILFHKHWNI

SEQ ID NO: 442528 - protein, 9 aa, Homo Sapiens
VECEKCAKD

SEQ ID NO: 442529 - protein, 9 aa, Homo Sapiens
GYGNPQNSP

SEQ ID NO: 442530 - protein, 9 aa, Homo Sapiens
VPLGHLESA

SEQ ID NO: 442531 - protein, 9 aa, Homo Sapiens
GQNCSHDCP

SEQ ID NO: 442532 - protein, 9 aa, Homo Sapiens
NTIFTLLYL

SEQ ID NO: 442533 - protein, 9 aa, Homo Sapiens
ILSQLNERQ

SEQ ID NO: 442534 - protein, 9 aa, Homo Sapiens
HFYFLSNDD

SEQ ID NO: 442535 - protein, 9 aa, Homo Sapiens
GSPAQRRCT

SEQ ID NO: 442536 - protein, 9 aa, Homo Sapiens
FTYHCVVNY

SEQ ID NO: 442537 - protein, 9 aa, Homo Sapiens
CLQSQIGGE

SEQ ID NO: 442538 - protein, 9 aa, Homo Sapiens
RPAEAGKFT

SEQ ID NO: 442539 - protein, 9 aa, Homo Sapiens
PAMYYVSPI

SEQ ID NO: 442540 - protein, 9 aa, Homo Sapiens
NQPGDTHPN

SEQ ID NO: 442541 - protein, 9 aa, Homo Sapiens
SLYPEVTPH

SEQ ID NO: 442542 - protein, 9 aa, Homo Sapiens
PLLDQRQLD

SEQ ID NO: 442543 - protein, 9 aa, Homo Sapiens
YFVTPDRRF

SEQ ID NO: 442544 - protein, 9 aa, Homo Sapiens
FYFHTTQIL

SEQ ID NO: 442545 - protein, 9 aa, Homo Sapiens
RKGADSTGS

SEQ ID NO: 442546 - protein, 9 aa, Homo Sapiens
KSIQQRSPP

SEQ ID NO: 442547 - protein, 9 aa, Homo Sapiens
ERSLPDICH

SEQ ID NO: 442548 - protein, 9 aa, Homo Sapiens
YARCQSKVS

SEQ ID NO: 442549 - protein, 9 aa, Homo Sapiens
FRLLKRTHD

SEQ ID NO: 442550 - protein, 9 aa, Homo Sapiens
GKSMSCQEV

SEQ ID NO: 442551 - protein, 9 aa, Homo Sapiens
YVAFSPTGK

SEQ ID NO: 442552 - protein, 9 aa, Homo Sapiens
QDNNFLLYN

SEQ ID NO: 442553 - protein, 9 aa, Homo Sapiens
CCVNGQCVC

SEQ ID NO: 442554 - protein, 9 aa, Homo Sapiens
SPGQTVYLN

SEQ ID NO: 442555 - protein, 9 aa, Homo Sapiens
IKLSNEQGL

SEQ ID NO: 442556 - protein, 9 aa, Homo Sapiens
GQVAALVHI

SEQ ID NO: 442557 - protein, 9 aa, Homo Sapiens
QKQNYLAVD

SEQ ID NO: 442558 - protein, 9 aa, Homo Sapiens
KNLDYRIRA

SEQ ID NO: 442559 - protein, 9 aa, Homo Sapiens
QNLLLIQNS

SEQ ID NO: 442560 - protein, 9 aa, Homo Sapiens
HDAVQQHPT

SEQ ID NO: 442561 - protein, 9 aa, Homo Sapiens
PWLPRSGNT

SEQ ID NO: 442562 - protein, 9 aa, Homo Sapiens
PAQGYAFAA

SEQ ID NO: 442563 - protein, 9 aa, Homo Sapiens
FICYPVPIV

SEQ ID NO: 442564 - protein, 9 aa, Homo Sapiens
WGVKLHVFL

SEQ ID NO: 442565 - protein, 9 aa, Homo Sapiens
IEKNKDATR

SEQ ID NO: 442566 - protein, 9 aa, Homo Sapiens
ILTKSDLKH

SEQ ID NO: 442567 - protein, 9 aa, Homo Sapiens
VIPVTFKYM

SEQ ID NO: 442568 - protein, 9 aa, Homo Sapiens
NYGDKPSDS

SEQ ID NO: 442569 - protein, 9 aa, Homo Sapiens
DMQPYMYQQ

SEQ ID NO: 442570 - protein, 9 aa, Homo Sapiens
FTSSSSSLS

SEQ ID NO: 442571 - protein, 9 aa, Homo Sapiens
DNYPNKEDV

SEQ ID NO: 442572 - protein, 9 aa, Homo Sapiens
WIFTGGVTT

SEQ ID NO: 442573 - protein, 9 aa, Homo Sapiens
LSMHQIILY

SEQ ID NO: 442574 - protein, 9 aa, Homo Sapiens
DIIARICIN

SEQ ID NO: 442575 - protein, 9 aa, Homo Sapiens
RQRSQTALS

SEQ ID NO: 442576 - protein, 9 aa, Homo Sapiens
SMNVLIRDI

SEQ ID NO: 442577 - protein, 9 aa, Homo Sapiens
GKKPNSAGE

SEQ ID NO: 442578 - protein, 9 aa, Homo Sapiens
KHSKRRWAP

SEQ ID NO: 442579 - protein, 9 aa, Homo Sapiens
ALIYEIDFL

SEQ ID NO: 442580 - protein, 9 aa, Homo Sapiens
EGQYEGHKA

SEQ ID NO: 442581 - protein, 9 aa, Homo Sapiens
SSTQNQGRQ

SEQ ID NO: 442582 - protein, 9 aa, Homo Sapiens
YLSICRPLH

SEQ ID NO: 442583 - protein, 9 aa, Homo Sapiens
INADLVLLP

SEQ ID NO: 442584 - protein, 9 aa, Homo Sapiens
KDEDRACDK

SEQ ID NO: 442585 - protein, 9 aa, Homo Sapiens
DYDNEEFLR

SEQ ID NO: 442586 - protein, 9 aa, Homo Sapiens
HNCGKRFSN

SEQ ID NO: 442587 - protein, 9 aa, Homo Sapiens
KKVERSREQ

SEQ ID NO: 442588 - protein, 9 aa, Homo Sapiens
PPLRQGEVL

SEQ ID NO: 442589 - protein, 9 aa, Homo Sapiens
DAKKPPSGS

SEQ ID NO: 442590 - protein, 9 aa, Homo Sapiens
ERRSKKGPR

SEQ ID NO: 442591 - protein, 9 aa, Homo Sapiens
KHFKADERD

SEQ ID NO: 442592 - protein, 9 aa, Homo Sapiens
NQDVYNFLA

SEQ ID NO: 442593 - protein, 9 aa, Homo Sapiens
YVLRDVWFG

SEQ ID NO: 442594 - protein, 9 aa, Homo Sapiens
QICILNKVT

SEQ ID NO: 442595 - protein, 9 aa, Homo Sapiens
FVYLYNVAI

SEQ ID NO: 442596 - protein, 9 aa, Homo Sapiens
IDKCNAAVE

SEQ ID NO: 442597 - protein, 9 aa, Homo Sapiens
NETDHSDES

SEQ ID NO: 442598 - protein, 9 aa, Homo Sapiens
AVEVRDNWT

SEQ ID NO: 442599 - protein, 9 aa, Homo Sapiens
LTQYQYYIY

SEQ ID NO: 442600 - protein, 9 aa, Homo Sapiens
ARPWGWFLG

SEQ ID NO: 442601 - protein, 9 aa, Homo Sapiens
QAELSLHCE

SEQ ID NO: 442602 - protein, 9 aa, Homo Sapiens
VVQHMEGDK

SEQ ID NO: 442603 - protein, 9 aa, Homo Sapiens
YFNVIHKVA

SEQ ID NO: 442604 - protein, 9 aa, Homo Sapiens
GLEQGKKPI

SEQ ID NO: 442605 - protein, 9 aa, Homo Sapiens
NSCAAQIIG

SEQ ID NO: 442606 - protein, 9 aa, Homo Sapiens
WSPKWLHKF

SEQ ID NO: 442607 - protein, 9 aa, Homo Sapiens
NELFAYAAQ

SEQ ID NO: 442608 - protein, 9 aa, Homo Sapiens
VNKSPMMTW

SEQ ID NO: 442609 - protein, 9 aa, Homo Sapiens
TPLCLRVHP

SEQ ID NO: 442610 - protein, 9 aa, Homo Sapiens
NNNHLRKLP

SEQ ID NO: 442611 - protein, 9 aa, Homo Sapiens
TKIVEGTRD

SEQ ID NO: 442612 - protein, 9 aa, Homo Sapiens
NPVLQKGVE

SEQ ID NO: 442613 - protein, 9 aa, Homo Sapiens
CDFASGVVE

SEQ ID NO: 442614 - protein, 9 aa, Homo Sapiens
HQLNHFFCE

SEQ ID NO: 442615 - protein, 9 aa, Homo Sapiens
WHQKVHTRE

SEQ ID NO: 442616 - protein, 9 aa, Homo Sapiens
DTIFAEKTI

SEQ ID NO: 442617 - protein, 9 aa, Homo Sapiens
EARYKDVYV

SEQ ID NO: 442618 - protein, 9 aa, Homo Sapiens
ITCKTRRNS

SEQ ID NO: 442619 - protein, 9 aa, Homo Sapiens
EKTFEQLHN

SEQ ID NO: 442620 - protein, 9 aa, Homo Sapiens
PKTPGEGKK

SEQ ID NO: 442621 - protein, 9 aa, Homo Sapiens
WGECNSTDD

SEQ ID NO: 442622 - protein, 9 aa, Homo Sapiens
DGPTNNLFI

SEQ ID NO: 442623 - protein, 9 aa, Homo Sapiens
GKRHHTHVN

SEQ ID NO: 442624 - protein, 9 aa, Homo Sapiens
LKNGNLEVG

SEQ ID NO: 442625 - protein, 9 aa, Homo Sapiens
MLDYLWAAG

SEQ ID NO: 442626 - protein, 9 aa, Homo Sapiens
KKVHKEEIA

SEQ ID NO: 442627 - protein, 9 aa, Homo Sapiens
LYVQNQEFE

SEQ ID NO: 442628 - protein, 9 aa, Homo Sapiens
LTVPNLPPT

SEQ ID NO: 442629 - protein, 9 aa, Homo Sapiens
QTRIQEFKE

SEQ ID NO: 442630 - protein, 9 aa, Homo Sapiens
LLKVYSCDK

SEQ ID NO: 442631 - protein, 9 aa, Homo Sapiens
VVAVFLVSW

SEQ ID NO: 442632 - protein, 9 aa, Homo Sapiens
FCVVLLFLW

SEQ ID NO: 442633 - protein, 9 aa, Homo Sapiens
KKVKALDIF

SEQ ID NO: 442634 - protein, 9 aa, Homo Sapiens
DREMGSSSH

SEQ ID NO: 442635 - protein, 9 aa, Homo Sapiens
ARPRDSLLR

SEQ ID NO: 442636 - protein, 9 aa, Homo Sapiens
LSLTVVQHM

SEQ ID NO: 442637 - protein, 9 aa, Homo Sapiens
LHANCIVHQ

SEQ ID NO: 442638 - protein, 9 aa, Homo Sapiens
EVINKSIVK

SEQ ID NO: 442639 - protein, 9 aa, Homo Sapiens
EQPTRYDTL

SEQ ID NO: 442640 - protein, 9 aa, Homo Sapiens
GEGAHNQGK

SEQ ID NO: 442641 - protein, 9 aa, Homo Sapiens
HCRGGWTPQ

SEQ ID NO: 442642 - protein, 9 aa, Homo Sapiens
LAAIIRPRD

SEQ ID NO: 442643 - protein, 9 aa, Homo Sapiens
CNFRSKLYE

SEQ ID NO: 442644 - protein, 9 aa, Homo Sapiens
ICHVKCHRD

SEQ ID NO: 442645 - protein, 9 aa, Homo Sapiens
QMYVLTLIF

SEQ ID NO: 442646 - protein, 9 aa, Homo Sapiens
GSGLEQISF

SEQ ID NO: 442647 - protein, 9 aa, Homo Sapiens
LEHEGYKYK

SEQ ID NO: 442648 - protein, 9 aa, Homo Sapiens
QRCGRKDHL

SEQ ID NO: 442649 - protein, 9 aa, Homo Sapiens
LNASTTEVA

SEQ ID NO: 442650 - protein, 9 aa, Homo Sapiens
ELVNEWSLN

SEQ ID NO: 442651 - protein, 9 aa, Homo Sapiens
QDYGTLLYT

SEQ ID NO: 442652 - protein, 9 aa, Homo Sapiens
VKQSELFNR

SEQ ID NO: 442653 - protein, 9 aa, Homo Sapiens
DKIVGLRDR

SEQ ID NO: 442654 - protein, 9 aa, Homo Sapiens
IILVIPFPF

SEQ ID NO: 442655 - protein, 9 aa, Homo Sapiens
YAIGGRRFS

SEQ ID NO: 442656 - protein, 9 aa, Homo Sapiens
DNQTYSGMV

SEQ ID NO: 442657 - protein, 9 aa, Homo Sapiens
QIVEMKKGS

SEQ ID NO: 442658 - protein, 9 aa, Homo Sapiens
MPPAQGYAF

SEQ ID NO: 442659 - protein, 9 aa, Homo Sapiens
ITYHEKPWL

SEQ ID NO: 442660 - protein, 9 aa, Homo Sapiens
YETTISVLS

SEQ ID NO: 442661 - protein, 9 aa, Homo Sapiens
PAVPGPVIR

SEQ ID NO: 442662 - protein, 9 aa, Homo Sapiens
SSHHLAAFI

SEQ ID NO: 442663 - protein, 9 aa, Homo Sapiens
VLRELEASQ

SEQ ID NO: 442664 - protein, 9 aa, Homo Sapiens
SSPDLVNTY

SEQ ID NO: 442665 - protein, 9 aa, Homo Sapiens
KVKVEVEDL

SEQ ID NO: 442666 - protein, 9 aa, Homo Sapiens
RFLSMEKLL

SEQ ID NO: 442667 - protein, 9 aa, Homo Sapiens
ILGFKGVWK

SEQ ID NO: 442668 - protein, 9 aa, Homo Sapiens
TFPAGVSPK

SEQ ID NO: 442669 - protein, 9 aa, Homo Sapiens
RALSAQFEG

SEQ ID NO: 442670 - protein, 9 aa, Homo Sapiens
GGFDHKRLQ

SEQ ID NO: 442671 - protein, 9 aa, Homo Sapiens
CLKPAQLPI

SEQ ID NO: 442672 - protein, 9 aa, Homo Sapiens
ATVRAKCSQ

SEQ ID NO: 442673 - protein, 9 aa, Homo Sapiens
RSHSRSRSS

SEQ ID NO: 442674 - protein, 9 aa, Homo Sapiens
FMKQINDAH

SEQ ID NO: 442675 - protein, 9 aa, Homo Sapiens
ELDLLHGEK

SEQ ID NO: 442676 - protein, 9 aa, Homo Sapiens
QQNQKTQPI

SEQ ID NO: 442677 - protein, 9 aa, Homo Sapiens
NITVYCQEK

SEQ ID NO: 442678 - protein, 9 aa, Homo Sapiens
YKKLINSQQ

SEQ ID NO: 442679 - protein, 9 aa, Homo Sapiens
PPQKHRICV

SEQ ID NO: 442680 - protein, 9 aa, Homo Sapiens
ENQDTIKSL

SEQ ID NO: 442681 - protein, 9 aa, Homo Sapiens
PWCSASAWL

SEQ ID NO: 442682 - protein, 9 aa, Homo Sapiens
DRVIHWILS

SEQ ID NO: 442683 - protein, 9 aa, Homo Sapiens
ISERAFKLT

SEQ ID NO: 442684 - protein, 9 aa, Homo Sapiens
ASSPHPTAE

SEQ ID NO: 442685 - protein, 9 aa, Homo Sapiens
LGVMLTSYT

SEQ ID NO: 442686 - protein, 9 aa, Homo Sapiens
SIPEIRNTL

SEQ ID NO: 442687 - protein, 9 aa, Homo Sapiens
PLQARVDEV

SEQ ID NO: 442688 - protein, 9 aa, Homo Sapiens
AFHQKTALT

SEQ ID NO: 442689 - protein, 9 aa, Homo Sapiens
LGIKRKLTA

SEQ ID NO: 442690 - protein, 9 aa, Homo Sapiens
YGLIEEKCK

SEQ ID NO: 442691 - protein, 9 aa, Homo Sapiens
HSKSRSYRH

SEQ ID NO: 442692 - protein, 9 aa, Homo Sapiens
GHQKVGAIV

SEQ ID NO: 442693 - protein, 9 aa, Homo Sapiens
PGTPGADGF

SEQ ID NO: 442694 - protein, 9 aa, Homo Sapiens
TDLPIQWNK

SEQ ID NO: 442695 - protein, 9 aa, Homo Sapiens
IPELDVYEA

SEQ ID NO: 442696 - protein, 9 aa, Homo Sapiens
NILKMTYPH

SEQ ID NO: 442697 - protein, 9 aa, Homo Sapiens
DCQNPNTFQ

SEQ ID NO: 442698 - protein, 9 aa, Homo Sapiens
VEAFLLRLY

SEQ ID NO: 442699 - protein, 9 aa, Homo Sapiens
YDWLVPGRQ

SEQ ID NO: 442700 - protein, 9 aa, Homo Sapiens
NIKLLEKHI

SEQ ID NO: 442701 - protein, 9 aa, Homo Sapiens
MNDLAKGRT

SEQ ID NO: 442702 - protein, 9 aa, Homo Sapiens
DCIWMCKLD

SEQ ID NO: 442703 - protein, 9 aa, Homo Sapiens
RKANLVNRS

SEQ ID NO: 442704 - protein, 9 aa, Homo Sapiens
EQGLEMLRL

SEQ ID NO: 442705 - protein, 9 aa, Homo Sapiens
WLAYMNQAY

SEQ ID NO: 442706 - protein, 9 aa, Homo Sapiens
IIFIVVAVF

SEQ ID NO: 442707 - protein, 9 aa, Homo Sapiens
IRVKHTHVP

SEQ ID NO: 442708 - protein, 9 aa, Homo Sapiens
EKFDGSENI

SEQ ID NO: 442709 - protein, 9 aa, Homo Sapiens
KALQSNMRF

SEQ ID NO: 442710 - protein, 9 aa, Homo Sapiens
YLAYAFESK

SEQ ID NO: 442711 - protein, 9 aa, Homo Sapiens
CKAHTEKQK

SEQ ID NO: 442712 - protein, 9 aa, Homo Sapiens
EISGEHLWI

SEQ ID NO: 442713 - protein, 9 aa, Homo Sapiens
FQVPKIAEF

SEQ ID NO: 442714 - protein, 9 aa, Homo Sapiens
RTLDISNSR

SEQ ID NO: 442715 - protein, 9 aa, Homo Sapiens
TTPDFIILG

SEQ ID NO: 442716 - protein, 9 aa, Homo Sapiens
ILEETVIYT

SEQ ID NO: 442717 - protein, 9 aa, Homo Sapiens
GNQINVSEE

SEQ ID NO: 442718 - protein, 9 aa, Homo Sapiens
GTGNQIPWT

SEQ ID NO: 442719 - protein, 9 aa, Homo Sapiens
SALIQTLGK

SEQ ID NO: 442720 - protein, 9 aa, Homo Sapiens
TLAVFSIVG

SEQ ID NO: 442721 - protein, 9 aa, Homo Sapiens
IDNSLSLNT

SEQ ID NO: 442722 - protein, 9 aa, Homo Sapiens
EMNIHLWKA

SEQ ID NO: 442723 - protein, 9 aa, Homo Sapiens
LIASKVTHT

SEQ ID NO: 442724 - protein, 9 aa, Homo Sapiens
AEDRIWELE

SEQ ID NO: 442725 - protein, 9 aa, Homo Sapiens
FQVRDSVVF

SEQ ID NO: 442726 - protein, 9 aa, Homo Sapiens
YMRSCRVLM

SEQ ID NO: 442727 - protein, 9 aa, Homo Sapiens
EEENQENMI

SEQ ID NO: 442728 - protein, 9 aa, Homo Sapiens
SCLGETWNI

SEQ ID NO: 442729 - protein, 9 aa, Homo Sapiens
RYELIVDVN

SEQ ID NO: 442730 - protein, 9 aa, Homo Sapiens
EKDYLITPH

SEQ ID NO: 442731 - protein, 9 aa, Homo Sapiens
GYGGYENGY

SEQ ID NO: 442732 - protein, 9 aa, Homo Sapiens
DSAIRQLLS

SEQ ID NO: 442733 - protein, 9 aa, Homo Sapiens
DDTLVDFWA

SEQ ID NO: 442734 - protein, 9 aa, Homo Sapiens
LDSKAVHSQ

SEQ ID NO: 442735 - protein, 9 aa, Homo Sapiens
LSTPKVPAS

SEQ ID NO: 442736 - protein, 9 aa, Homo Sapiens
GFSPLQILR

SEQ ID NO: 442737 - protein, 9 aa, Homo Sapiens
CHAKNYTNA

SEQ ID NO: 442738 - protein, 9 aa, Homo Sapiens
GLTQYQYYI

SEQ ID NO: 442739 - protein, 9 aa, Homo Sapiens
ERHYKDPYS

SEQ ID NO: 442740 - protein, 9 aa, Homo Sapiens
RRRILLDML

SEQ ID NO: 442741 - protein, 9 aa, Homo Sapiens
SLVNVVCHT

SEQ ID NO: 442742 - protein, 9 aa, Homo Sapiens
GSLALTSVY

SEQ ID NO: 442743 - protein, 9 aa, Homo Sapiens
ILSACKAKG

SEQ ID NO: 442744 - protein, 9 aa, Homo Sapiens
QQAEVIVWQ

SEQ ID NO: 442745 - protein, 9 aa, Homo Sapiens
KDQAAEGIH

SEQ ID NO: 442746 - protein, 9 aa, Homo Sapiens
ENEVVTLKK

SEQ ID NO: 442747 - protein, 9 aa, Homo Sapiens
PDEEDEILE

SEQ ID NO: 442748 - protein, 9 aa, Homo Sapiens
PQLNYKDNK

SEQ ID NO: 442749 - protein, 9 aa, Homo Sapiens
DKFQNTNVK

SEQ ID NO: 442750 - protein, 9 aa, Homo Sapiens
VESQENTFY

SEQ ID NO: 442751 - protein, 9 aa, Homo Sapiens
CSPTLQIHE

SEQ ID NO: 442752 - protein, 9 aa, Homo Sapiens
WCRLRASLR

SEQ ID NO: 442753 - protein, 9 aa, Homo Sapiens
SNDIEGIHR

SEQ ID NO: 442754 - protein, 9 aa, Homo Sapiens
YSYVEKDQH

SEQ ID NO: 442755 - protein, 9 aa, Homo Sapiens
NICYDPRRC

SEQ ID NO: 442756 - protein, 9 aa, Homo Sapiens
TQSTEKLEK

SEQ ID NO: 442757 - protein, 9 aa, Homo Sapiens
SNKPLMIIR

SEQ ID NO: 442758 - protein, 9 aa, Homo Sapiens
NSLFKSEAC

SEQ ID NO: 442759 - protein, 9 aa, Homo Sapiens
KRYSVNVAL

SEQ ID NO: 442760 - protein, 9 aa, Homo Sapiens
APAKGNLFI

SEQ ID NO: 442761 - protein, 9 aa, Homo Sapiens
GWNPFLYPY

SEQ ID NO: 442762 - protein, 9 aa, Homo Sapiens
TIPVASTSQ

SEQ ID NO: 442763 - protein, 9 aa, Homo Sapiens
LKIQQEAIS

SEQ ID NO: 442764 - protein, 9 aa, Homo Sapiens
EHYQQPQIM

SEQ ID NO: 442765 - protein, 9 aa, Homo Sapiens
QEQENKIQY

SEQ ID NO: 442766 - protein, 9 aa, Homo Sapiens
HEDKQQEGG

SEQ ID NO: 442767 - protein, 9 aa, Homo Sapiens
EENKNLVYP

SEQ ID NO: 442768 - protein, 9 aa, Homo Sapiens
CITAYPNVT

SEQ ID NO: 442769 - protein, 9 aa, Homo Sapiens
SYYTSYQNK

SEQ ID NO: 442770 - protein, 9 aa, Homo Sapiens
NIQFNTDLS

SEQ ID NO: 442771 - protein, 9 aa, Homo Sapiens
GSARPSTSG

SEQ ID NO: 442772 - protein, 9 aa, Homo Sapiens
HRQIHTGYR

SEQ ID NO: 442773 - protein, 9 aa, Homo Sapiens
SKSGSTRGA

SEQ ID NO: 442774 - protein, 9 aa, Homo Sapiens
FCRTIYLAI

SEQ ID NO: 442775 - protein, 9 aa, Homo Sapiens
MWEWQTVEA

SEQ ID NO: 442776 - protein, 9 aa, Homo Sapiens
YSLDYGKDL

SEQ ID NO: 442777 - protein, 9 aa, Homo Sapiens
ITLNQSETA

SEQ ID NO: 442778 - protein, 9 aa, Homo Sapiens
YQKTAEETN

SEQ ID NO: 442779 - protein, 9 aa, Homo Sapiens
FNAFFSLYF

SEQ ID NO: 442780 - protein, 9 aa, Homo Sapiens
KGRFTSVGT

SEQ ID NO: 442781 - protein, 9 aa, Homo Sapiens
KALLKWQLE

SEQ ID NO: 442782 - protein, 9 aa, Homo Sapiens
KKHKKRSSR

SEQ ID NO: 442783 - protein, 9 aa, Homo Sapiens
ARKGKRHHT

SEQ ID NO: 442784 - protein, 9 aa, Homo Sapiens
TCPDKGIVL

SEQ ID NO: 442785 - protein, 9 aa, Homo Sapiens
GHIFTHISR

SEQ ID NO: 442786 - protein, 9 aa, Homo Sapiens
ASPSMPENQ

SEQ ID NO: 442787 - protein, 9 aa, Homo Sapiens
KEYQKNDKD

SEQ ID NO: 442788 - protein, 9 aa, Homo Sapiens
GKSVSTFSV

SEQ ID NO: 442789 - protein, 9 aa, Homo Sapiens
SRPGANKVM

SEQ ID NO: 442790 - protein, 9 aa, Homo Sapiens
KPRFDLEKY

SEQ ID NO: 442791 - protein, 9 aa, Homo Sapiens
QKMTEKSEP

SEQ ID NO: 442792 - protein, 9 aa, Homo Sapiens
ECESEYGIE

SEQ ID NO: 442793 - protein, 9 aa, Homo Sapiens
IHSSPFTAV

SEQ ID NO: 442794 - protein, 9 aa, Homo Sapiens
ALNSKAAAH

SEQ ID NO: 442795 - protein, 9 aa, Homo Sapiens
MLCNFRSKL

SEQ ID NO: 442796 - protein, 9 aa, Homo Sapiens
MRELGLLIS

SEQ ID NO: 442797 - protein, 9 aa, Homo Sapiens
DFYKLPIEI

SEQ ID NO: 442798 - protein, 9 aa, Homo Sapiens
KIVGLRDRI

SEQ ID NO: 442799 - protein, 9 aa, Homo Sapiens
GGANKKNFF

SEQ ID NO: 442800 - protein, 9 aa, Homo Sapiens
KIPEQHQKN

SEQ ID NO: 442801 - protein, 9 aa, Homo Sapiens
CSDYMTLKI

SEQ ID NO: 442802 - protein, 9 aa, Homo Sapiens
NKIQSMDDV

SEQ ID NO: 442803 - protein, 9 aa, Homo Sapiens
GLGTNEDSL

SEQ ID NO: 442804 - protein, 9 aa, Homo Sapiens
SDFTKLQKA

SEQ ID NO: 442805 - protein, 9 aa, Homo Sapiens
LLSANDFFN

SEQ ID NO: 442806 - protein, 9 aa, Homo Sapiens
GKSAAKKSE

SEQ ID NO: 442807 - protein, 9 aa, Homo Sapiens
ILSKLRNEL

SEQ ID NO: 442808 - protein, 9 aa, Homo Sapiens
RPRGERHLP

SEQ ID NO: 442809 - protein, 9 aa, Homo Sapiens
KLQSPLPGK

SEQ ID NO: 442810 - protein, 9 aa, Homo Sapiens
SKSRSYRHK

SEQ ID NO: 442811 - protein, 9 aa, Homo Sapiens
IYYNEQSKF

SEQ ID NO: 442812 - protein, 9 aa, Homo Sapiens
LARILALQK

SEQ ID NO: 442813 - protein, 9 aa, Homo Sapiens
NITVQKPFI

SEQ ID NO: 442814 - protein, 9 aa, Homo Sapiens
IRVMQRRPD

SEQ ID NO: 442815 - protein, 9 aa, Homo Sapiens
KNDISGGVL

SEQ ID NO: 442816 - protein, 9 aa, Homo Sapiens
IYLPVNQQH

SEQ ID NO: 442817 - protein, 9 aa, Homo Sapiens
RVHPPRLWC

SEQ ID NO: 442818 - protein, 9 aa, Homo Sapiens
WHILQKQEQ

SEQ ID NO: 442819 - protein, 9 aa, Homo Sapiens
FSETCYTLA

SEQ ID NO: 442820 - protein, 9 aa, Homo Sapiens
FMCLVLHCI

SEQ ID NO: 442821 - protein, 9 aa, Homo Sapiens
GKSIQQRSP

SEQ ID NO: 442822 - protein, 9 aa, Homo Sapiens
ENQKNCRFE

SEQ ID NO: 442823 - protein, 9 aa, Homo Sapiens
NQTPIPWLS

SEQ ID NO: 442824 - protein, 9 aa, Homo Sapiens
LWLRWVPLP

SEQ ID NO: 442825 - protein, 9 aa, Homo Sapiens
EYDMVLTNG

SEQ ID NO: 442826 - protein, 9 aa, Homo Sapiens
SCNTSKAVH

SEQ ID NO: 442827 - protein, 9 aa, Homo Sapiens
SKQVNRIDW

SEQ ID NO: 442828 - protein, 9 aa, Homo Sapiens
HVPTVWAIN

SEQ ID NO: 442829 - protein, 9 aa, Homo Sapiens
DWHANTIRL

SEQ ID NO: 442830 - protein, 9 aa, Homo Sapiens
HLGYSSKKE

SEQ ID NO: 442831 - protein, 9 aa, Homo Sapiens
VAADKANEQ

SEQ ID NO: 442832 - protein, 9 aa, Homo Sapiens
NLFAVNSIL

SEQ ID NO: 442833 - protein, 9 aa, Homo Sapiens
SAEDSKGIF

SEQ ID NO: 442834 - protein, 9 aa, Homo Sapiens
VNVGLEALS

SEQ ID NO: 442835 - protein, 9 aa, Homo Sapiens
NPAYSKVVM

SEQ ID NO: 442836 - protein, 9 aa, Homo Sapiens
TWSVPNCAE

SEQ ID NO: 442837 - protein, 9 aa, Homo Sapiens
KGQLYRVDR

SEQ ID NO: 442838 - protein, 9 aa, Homo Sapiens
PQGNLELED

SEQ ID NO: 442839 - protein, 9 aa, Homo Sapiens
HQIIHTGDK

SEQ ID NO: 442840 - protein, 9 aa, Homo Sapiens
TATDYTKPK

SEQ ID NO: 442841 - protein, 9 aa, Homo Sapiens
KVNNLNPKK

SEQ ID NO: 442842 - protein, 9 aa, Homo Sapiens
TGFSGSVEN

SEQ ID NO: 442843 - protein, 9 aa, Homo Sapiens
KYETELSLQ

SEQ ID NO: 442844 - protein, 9 aa, Homo Sapiens
HHKQRRSRT

SEQ ID NO: 442845 - protein, 9 aa, Homo Sapiens
KPANMEELM

SEQ ID NO: 442846 - protein, 9 aa, Homo Sapiens
DWGYFDTFI

SEQ ID NO: 442847 - protein, 9 aa, Homo Sapiens
RLKNYALVI

SEQ ID NO: 442848 - protein, 9 aa, Homo Sapiens
PQLSNKKRK

SEQ ID NO: 442849 - protein, 9 aa, Homo Sapiens
VRLVLKDPP

SEQ ID NO: 442850 - protein, 9 aa, Homo Sapiens
YLNMATGMD

SEQ ID NO: 442851 - protein, 9 aa, Homo Sapiens
CKDNIYPTF

SEQ ID NO: 442852 - protein, 9 aa, Homo Sapiens
SSNRKKHMH

SEQ ID NO: 442853 - protein, 9 aa, Homo Sapiens
KEQPGDLYN

SEQ ID NO: 442854 - protein, 9 aa, Homo Sapiens
SFRVSSCLG

SEQ ID NO: 442855 - protein, 9 aa, Homo Sapiens
ENCFSVNFQ

SEQ ID NO: 442856 - protein, 9 aa, Homo Sapiens
VWEMITPSA

SEQ ID NO: 442857 - protein, 9 aa, Homo Sapiens
DKILSDDNF

SEQ ID NO: 442858 - protein, 9 aa, Homo Sapiens
SASVSWSPS

SEQ ID NO: 442859 - protein, 9 aa, Homo Sapiens
ASVYIRSNN

SEQ ID NO: 442860 - protein, 9 aa, Homo Sapiens
LQTLHHERI

SEQ ID NO: 442861 - protein, 9 aa, Homo Sapiens
NWLSVSLPE

SEQ ID NO: 442862 - protein, 9 aa, Homo Sapiens
LIKIYDVQE

SEQ ID NO: 442863 - protein, 9 aa, Homo Sapiens
EQKYFKITC

SEQ ID NO: 442864 - protein, 9 aa, Homo Sapiens
MNPFLILVF

SEQ ID NO: 442865 - protein, 9 aa, Homo Sapiens
KNKQQIKRK

SEQ ID NO: 442866 - protein, 9 aa, Homo Sapiens
NSSEGLIAF

SEQ ID NO: 442867 - protein, 9 aa, Homo Sapiens
VDSRLQTPI

SEQ ID NO: 442868 - protein, 9 aa, Homo Sapiens
PQNTFLDNI

SEQ ID NO: 442869 - protein, 9 aa, Homo Sapiens
SQLQELCWK

SEQ ID NO: 442870 - protein, 9 aa, Homo Sapiens
NWMTLSQKI

SEQ ID NO: 442871 - protein, 9 aa, Homo Sapiens
LGCDSEIHR

SEQ ID NO: 442872 - protein, 9 aa, Homo Sapiens
DNITVKMYY

SEQ ID NO: 442873 - protein, 9 aa, Homo Sapiens
LGLCLCAIL

SEQ ID NO: 442874 - protein, 9 aa, Homo Sapiens
LSPKSYQTA

SEQ ID NO: 442875 - protein, 9 aa, Homo Sapiens
DITLFVKVQ

SEQ ID NO: 442876 - protein, 9 aa, Homo Sapiens
TVALRKIRR

SEQ ID NO: 442877 - protein, 9 aa, Homo Sapiens
KKVNEAKIT

SEQ ID NO: 442878 - protein, 9 aa, Homo Sapiens
ALLFLLQCY

SEQ ID NO: 442879 - protein, 9 aa, Homo Sapiens
FIKTQIKVS

SEQ ID NO: 442880 - protein, 9 aa, Homo Sapiens
IKHKTIHTG

SEQ ID NO: 442881 - protein, 9 aa, Homo Sapiens
YGGGSGKSY

SEQ ID NO: 442882 - protein, 9 aa, Homo Sapiens
SLDKDTLYI

SEQ ID NO: 442883 - protein, 9 aa, Homo Sapiens
FRMRGNNTF

SEQ ID NO: 442884 - protein, 9 aa, Homo Sapiens
KGDCNFALG

SEQ ID NO: 442885 - protein, 9 aa, Homo Sapiens
VVCYICGCE

SEQ ID NO: 442886 - protein, 9 aa, Homo Sapiens
TREGIISLK

SEQ ID NO: 442887 - protein, 9 aa, Homo Sapiens
PSFTYYCSG

SEQ ID NO: 442888 - protein, 9 aa, Homo Sapiens
SDQFNRILA

SEQ ID NO: 442889 - protein, 9 aa, Homo Sapiens
RERMSSNQP

SEQ ID NO: 442890 - protein, 9 aa, Homo Sapiens
MERLDKLHF

SEQ ID NO: 442891 - protein, 9 aa, Homo Sapiens
ISKHWPGFL

SEQ ID NO: 442892 - protein, 9 aa, Homo Sapiens
ALGWAVGAS

SEQ ID NO: 442893 - protein, 9 aa, Homo Sapiens
VTKVTPDKK

SEQ ID NO: 442894 - protein, 9 aa, Homo Sapiens
KFSMQEPMV

SEQ ID NO: 442895 - protein, 9 aa, Homo Sapiens
LLHLNTKGP

SEQ ID NO: 442896 - protein, 9 aa, Homo Sapiens
SYLKTQKAT

SEQ ID NO: 442897 - protein, 9 aa, Homo Sapiens
EDTFQGAPM

SEQ ID NO: 442898 - protein, 9 aa, Homo Sapiens
VSEKLKTQH

SEQ ID NO: 442899 - protein, 9 aa, Homo Sapiens
YPNSCSPRV

SEQ ID NO: 442900 - protein, 9 aa, Homo Sapiens
AKTAQEKDY

SEQ ID NO: 442901 - protein, 9 aa, Homo Sapiens
YYVQYRSFF

SEQ ID NO: 442902 - protein, 9 aa, Homo Sapiens
DMVLTNGKS

SEQ ID NO: 442903 - protein, 9 aa, Homo Sapiens
HNKIQHMIT

SEQ ID NO: 442904 - protein, 9 aa, Homo Sapiens
APELRGLFL

SEQ ID NO: 442905 - protein, 9 aa, Homo Sapiens
EKCYGLEIN

SEQ ID NO: 442906 - protein, 9 aa, Homo Sapiens
PGVTGLRNV

SEQ ID NO: 442907 - protein, 9 aa, Homo Sapiens
SQDSLDVFM

SEQ ID NO: 442908 - protein, 9 aa, Homo Sapiens
QLPTLVQVR

SEQ ID NO: 442909 - protein, 9 aa, Homo Sapiens
VNCKITSDG

SEQ ID NO: 442910 - protein, 9 aa, Homo Sapiens
YLVSITKSI

SEQ ID NO: 442911 - protein, 9 aa, Homo Sapiens
YCPECRNYA

SEQ ID NO: 442912 - protein, 9 aa, Homo Sapiens
LDLLYYSTM

SEQ ID NO: 442913 - protein, 9 aa, Homo Sapiens
QIKVRRLEH

SEQ ID NO: 442914 - protein, 9 aa, Homo Sapiens
IVDNYFMRD

SEQ ID NO: 442915 - protein, 9 aa, Homo Sapiens
IYPSFTYYC

SEQ ID NO: 442916 - protein, 9 aa, Homo Sapiens
PVEPERRLL

SEQ ID NO: 442917 - protein, 9 aa, Homo Sapiens
TCVILEMQI

SEQ ID NO: 442918 - protein, 9 aa, Homo Sapiens
LCAGFHEGG

SEQ ID NO: 442919 - protein, 9 aa, Homo Sapiens
TTCTPLAST

SEQ ID NO: 442920 - protein, 9 aa, Homo Sapiens
IGALQKRSL

SEQ ID NO: 442921 - protein, 9 aa, Homo Sapiens
NVLDLNGCT

SEQ ID NO: 442922 - protein, 9 aa, Homo Sapiens
CSHCRHRSI

SEQ ID NO: 442923 - protein, 9 aa, Homo Sapiens
NARDTIVMD

SEQ ID NO: 442924 - protein, 9 aa, Homo Sapiens
QEGAASKVI

SEQ ID NO: 442925 - protein, 9 aa, Homo Sapiens
KAHMFCANA

SEQ ID NO: 442926 - protein, 9 aa, Homo Sapiens
FFVSRSSAM

SEQ ID NO: 442927 - protein, 9 aa, Homo Sapiens
MYEAELERP

SEQ ID NO: 442928 - protein, 9 aa, Homo Sapiens
TDVLRCVNN

SEQ ID NO: 442929 - protein, 9 aa, Homo Sapiens
ACMTFDQKR

SEQ ID NO: 442930 - protein, 9 aa, Homo Sapiens
DWLEFLFFL

SEQ ID NO: 442931 - protein, 9 aa, Homo Sapiens
VRSPTKTPH

SEQ ID NO: 442932 - protein, 9 aa, Homo Sapiens
LPAGTIKAV

SEQ ID NO: 442933 - protein, 9 aa, Homo Sapiens
PDSSPLASR

SEQ ID NO: 442934 - protein, 9 aa, Homo Sapiens
VDVNKPIIA

SEQ ID NO: 442935 - protein, 9 aa, Homo Sapiens
AFQKRQLDK

SEQ ID NO: 442936 - protein, 9 aa, Homo Sapiens
RYQEVGGTP

SEQ ID NO: 442937 - protein, 9 aa, Homo Sapiens
TTILSSLPE

SEQ ID NO: 442938 - protein, 9 aa, Homo Sapiens
VFNNVTNNY

SEQ ID NO: 442939 - protein, 9 aa, Homo Sapiens
DPLDLKMVE

SEQ ID NO: 442940 - protein, 9 aa, Homo Sapiens
EAGIVSLFN

SEQ ID NO: 442941 - protein, 9 aa, Homo Sapiens
NPGLIYLTG

SEQ ID NO: 442942 - protein, 9 aa, Homo Sapiens
DLKLDLKDS

SEQ ID NO: 442943 - protein, 9 aa, Homo Sapiens
MDEIYAIGG

SEQ ID NO: 442944 - protein, 9 aa, Homo Sapiens
RCRESYQQE

SEQ ID NO: 442945 - protein, 9 aa, Homo Sapiens
AKIIEAKQK

SEQ ID NO: 442946 - protein, 9 aa, Homo Sapiens
IMSHRVCII

SEQ ID NO: 442947 - protein, 9 aa, Homo Sapiens
DATKNAKKD

SEQ ID NO: 442948 - protein, 9 aa, Homo Sapiens
DEANNINKS

SEQ ID NO: 442949 - protein, 9 aa, Homo Sapiens
KMTFDPEIL

SEQ ID NO: 442950 - protein, 9 aa, Homo Sapiens
DIYHGICLQ

SEQ ID NO: 442951 - protein, 9 aa, Homo Sapiens
HLPQGSLSL

SEQ ID NO: 442952 - protein, 9 aa, Homo Sapiens
AELKGYTLL

SEQ ID NO: 442953 - protein, 9 aa, Homo Sapiens
APLKLWWTI

SEQ ID NO: 442954 - protein, 9 aa, Homo Sapiens
ETALHMAAC

SEQ ID NO: 442955 - protein, 9 aa, Homo Sapiens
VCQVHASGP

SEQ ID NO: 442956 - protein, 9 aa, Homo Sapiens
YGGYENGYY

SEQ ID NO: 442957 - protein, 9 aa, Homo Sapiens
LQQTSGEVG

SEQ ID NO: 442958 - protein, 9 aa, Homo Sapiens
DPGLRNLIN

SEQ ID NO: 442959 - protein, 9 aa, Homo Sapiens
RYDPHSNSW

SEQ ID NO: 442960 - protein, 9 aa, Homo Sapiens
TEENKIGTY

SEQ ID NO: 442961 - protein, 9 aa, Homo Sapiens
LIQTLGKQL

SEQ ID NO: 442962 - protein, 9 aa, Homo Sapiens
APLEALDGD

SEQ ID NO: 442963 - protein, 9 aa, Homo Sapiens
NYTKPGNVT

SEQ ID NO: 442964 - protein, 9 aa, Homo Sapiens
QYKGDGSLK

SEQ ID NO: 442965 - protein, 9 aa, Homo Sapiens
LFPTLLLWC

SEQ ID NO: 442966 - protein, 9 aa, Homo Sapiens
KVYSLPLVE

SEQ ID NO: 442967 - protein, 9 aa, Homo Sapiens
NVVKTCLQS

SEQ ID NO: 442968 - protein, 9 aa, Homo Sapiens
KPYDCKEYG

SEQ ID NO: 442969 - protein, 9 aa, Homo Sapiens
DMQLDSEGI

SEQ ID NO: 442970 - protein, 9 aa, Homo Sapiens
DQLPSPTAV

SEQ ID NO: 442971 - protein, 9 aa, Homo Sapiens
LNYRKSSHH

SEQ ID NO: 442972 - protein, 9 aa, Homo Sapiens
VYVEGGAEL

SEQ ID NO: 442973 - protein, 9 aa, Homo Sapiens
LSHFPQHYK

SEQ ID NO: 442974 - protein, 9 aa, Homo Sapiens
IQASSRDPE

SEQ ID NO: 442975 - protein, 9 aa, Homo Sapiens
SDNTSRVMQ

SEQ ID NO: 442976 - protein, 9 aa, Homo Sapiens
VWRMIWEQN

SEQ ID NO: 442977 - protein, 9 aa, Homo Sapiens
GKSCEKVVK

SEQ ID NO: 442978 - protein, 9 aa, Homo Sapiens
QLKKEEQQP

SEQ ID NO: 442979 - protein, 9 aa, Homo Sapiens
DEDRACDKI

SEQ ID NO: 442980 - protein, 9 aa, Homo Sapiens
RIILENYHD

SEQ ID NO: 442981 - protein, 9 aa, Homo Sapiens
FIIFKIAFH

SEQ ID NO: 442982 - protein, 9 aa, Homo Sapiens
KNYALVILI

SEQ ID NO: 442983 - protein, 9 aa, Homo Sapiens
HAKFIGVTE

SEQ ID NO: 442984 - protein, 9 aa, Homo Sapiens
FVYCTPKKG

SEQ ID NO: 442985 - protein, 9 aa, Homo Sapiens
SCYPGYGEA

SEQ ID NO: 442986 - protein, 9 aa, Homo Sapiens
YPSPPLPTH

SEQ ID NO: 442987 - protein, 9 aa, Homo Sapiens
SPHPTAEGT

SEQ ID NO: 442988 - protein, 9 aa, Homo Sapiens
CYDIVLDSK

SEQ ID NO: 442989 - protein, 9 aa, Homo Sapiens
DTKDNLDPE

SEQ ID NO: 442990 - protein, 9 aa, Homo Sapiens
VLQTLHHER

SEQ ID NO: 442991 - protein, 9 aa, Homo Sapiens
GLNKFRWYR

SEQ ID NO: 442992 - protein, 9 aa, Homo Sapiens
MENKTTWLS

SEQ ID NO: 442993 - protein, 9 aa, Homo Sapiens
IERFEIVGI

SEQ ID NO: 442994 - protein, 9 aa, Homo Sapiens
QFPKVRILC

SEQ ID NO: 442995 - protein, 9 aa, Homo Sapiens
VYMIMDMFC

SEQ ID NO: 442996 - protein, 9 aa, Homo Sapiens
DFSNDGSVS

SEQ ID NO: 442997 - protein, 9 aa, Homo Sapiens
GIKRKLTAR

SEQ ID NO: 442998 - protein, 9 aa, Homo Sapiens
IMIVGERFS

SEQ ID NO: 442999 - protein, 9 aa, Homo Sapiens
TEILRFNYK

SEQ ID NO: 443000 - protein, 9 aa, Homo Sapiens
HGCVLTRGN

SEQ ID NO: 443001 - protein, 9 aa, Homo Sapiens
RIIEKEIEG

SEQ ID NO: 443002 - protein, 9 aa, Homo Sapiens
RIIQTPPPL

SEQ ID NO: 443003 - protein, 9 aa, Homo Sapiens
DFPNIFCET

SEQ ID NO: 443004 - protein, 9 aa, Homo Sapiens
VKIHLMYAV

SEQ ID NO: 443005 - protein, 9 aa, Homo Sapiens
QCLNCPDGI

SEQ ID NO: 443006 - protein, 9 aa, Homo Sapiens
FILEKLGES

SEQ ID NO: 443007 - protein, 9 aa, Homo Sapiens
SKVRQPWNI

SEQ ID NO: 443008 - protein, 9 aa, Homo Sapiens
PKEVHIGLF

SEQ ID NO: 443009 - protein, 9 aa, Homo Sapiens
HNGKLWIMI

SEQ ID NO: 443010 - protein, 9 aa, Homo Sapiens
ASEKKDQAL

SEQ ID NO: 443011 - protein, 9 aa, Homo Sapiens
LLSMSSTNL

SEQ ID NO: 443012 - protein, 9 aa, Homo Sapiens
HSAKLAFAV

SEQ ID NO: 443013 - protein, 9 aa, Homo Sapiens
VQRLIQTKT

SEQ ID NO: 443014 - protein, 9 aa, Homo Sapiens
QEQEVKMWR

SEQ ID NO: 443015 - protein, 9 aa, Homo Sapiens
DIIKLFNEM

SEQ ID NO: 443016 - protein, 9 aa, Homo Sapiens
DDFASKTKY

SEQ ID NO: 443017 - protein, 9 aa, Homo Sapiens
VLSMDEPLN

SEQ ID NO: 443018 - protein, 9 aa, Homo Sapiens
FLIDGGNET

SEQ ID NO: 443019 - protein, 9 aa, Homo Sapiens
LTTQNIHLG

SEQ ID NO: 443020 - protein, 9 aa, Homo Sapiens
VFMTAINPM

SEQ ID NO: 443021 - protein, 9 aa, Homo Sapiens
LTFRDVAIK

SEQ ID NO: 443022 - protein, 9 aa, Homo Sapiens
ILPLHNWLL

SEQ ID NO: 443023 - protein, 9 aa, Homo Sapiens
GCLRIYYEK

SEQ ID NO: 443024 - protein, 9 aa, Homo Sapiens
PRRKHSHRS

SEQ ID NO: 443025 - protein, 9 aa, Homo Sapiens
SALSGPRLA

SEQ ID NO: 443026 - protein, 9 aa, Homo Sapiens
FEGDDGLCV

SEQ ID NO: 443027 - protein, 9 aa, Homo Sapiens
AFLVRNIKV

SEQ ID NO: 443028 - protein, 9 aa, Homo Sapiens
MGLLLGSVF

SEQ ID NO: 443029 - protein, 9 aa, Homo Sapiens
NIDFKELAY

SEQ ID NO: 443030 - protein, 9 aa, Homo Sapiens
LNLHINFLE

SEQ ID NO: 443031 - protein, 9 aa, Homo Sapiens
MTDDKYVLR

SEQ ID NO: 443032 - protein, 9 aa, Homo Sapiens
KRLRAVYFL

SEQ ID NO: 443033 - protein, 9 aa, Homo Sapiens
PEINLAIDG

SEQ ID NO: 443034 - protein, 9 aa, Homo Sapiens
DGNGCIDHL

SEQ ID NO: 443035 - protein, 9 aa, Homo Sapiens
EDSGEGNKE

SEQ ID NO: 443036 - protein, 9 aa, Homo Sapiens
HIYRHNYHK

SEQ ID NO: 443037 - protein, 9 aa, Homo Sapiens
FATPVLSMD

SEQ ID NO: 443038 - protein, 9 aa, Homo Sapiens
IIADRFITP

SEQ ID NO: 443039 - protein, 9 aa, Homo Sapiens
LDMELYSYV

SEQ ID NO: 443040 - protein, 9 aa, Homo Sapiens
YELIVDVNK

SEQ ID NO: 443041 - protein, 9 aa, Homo Sapiens
HTANLNIVL

SEQ ID NO: 443042 - protein, 9 aa, Homo Sapiens
LRRFWASVF

SEQ ID NO: 443043 - protein, 9 aa, Homo Sapiens
QEVITNLNG

SEQ ID NO: 443044 - protein, 9 aa, Homo Sapiens
ARSQNIKGD

SEQ ID NO: 443045 - protein, 9 aa, Homo Sapiens
HDHRITSQI

SEQ ID NO: 443046 - protein, 9 aa, Homo Sapiens
LRNKGNTEE

SEQ ID NO: 443047 - protein, 9 aa, Homo Sapiens
LVLMFAVSG

SEQ ID NO: 443048 - protein, 9 aa, Homo Sapiens
YEEQHAWNI

SEQ ID NO: 443049 - protein, 9 aa, Homo Sapiens
RPVFRTDRN

SEQ ID NO: 443050 - protein, 9 aa, Homo Sapiens
ALAEQHVVQ

SEQ ID NO: 443051 - protein, 9 aa, Homo Sapiens
SVLSTNRNL

SEQ ID NO: 443052 - protein, 9 aa, Homo Sapiens
YSPALNTMF

SEQ ID NO: 443053 - protein, 9 aa, Homo Sapiens
HTLSIMADI

SEQ ID NO: 443054 - protein, 9 aa, Homo Sapiens
MSVTQRVED

SEQ ID NO: 443055 - protein, 9 aa, Homo Sapiens
NACAEVIKQ

SEQ ID NO: 443056 - protein, 9 aa, Homo Sapiens
SMACHQQNK

SEQ ID NO: 443057 - protein, 9 aa, Homo Sapiens
MGGVFVVLI

SEQ ID NO: 443058 - protein, 9 aa, Homo Sapiens
VPYVDEEGD

SEQ ID NO: 443059 - protein, 9 aa, Homo Sapiens
ECGKINGRA

SEQ ID NO: 443060 - protein, 9 aa, Homo Sapiens
PMENSGFCE

SEQ ID NO: 443061 - protein, 9 aa, Homo Sapiens
QKVPVDFER

SEQ ID NO: 443062 - protein, 9 aa, Homo Sapiens
YSARPWGWF

SEQ ID NO: 443063 - protein, 9 aa, Homo Sapiens
VSQGFEFIF

SEQ ID NO: 443064 - protein, 9 aa, Homo Sapiens
KHKRFYLGL

SEQ ID NO: 443065 - protein, 9 aa, Homo Sapiens
RPAAHAEFA

SEQ ID NO: 443066 - protein, 9 aa, Homo Sapiens
KNLYFMDAM

SEQ ID NO: 443067 - protein, 9 aa, Homo Sapiens
TAWGRQRAF

SEQ ID NO: 443068 - protein, 9 aa, Homo Sapiens
GNPIEASLY

SEQ ID NO: 443069 - protein, 9 aa, Homo Sapiens
STSLTARED

SEQ ID NO: 443070 - protein, 9 aa, Homo Sapiens
SQQAEVIVW

SEQ ID NO: 443071 - protein, 9 aa, Homo Sapiens
CFSDNALPY

SEQ ID NO: 443072 - protein, 9 aa, Homo Sapiens
LWRSSSKCI

SEQ ID NO: 443073 - protein, 9 aa, Homo Sapiens
TQYQYYIYW

SEQ ID NO: 443074 - protein, 9 aa, Homo Sapiens
IAFHQRETT

SEQ ID NO: 443075 - protein, 9 aa, Homo Sapiens
CNICKIRFN

SEQ ID NO: 443076 - protein, 9 aa, Homo Sapiens
RRIAKYEEL

SEQ ID NO: 443077 - protein, 9 aa, Homo Sapiens
AIFPISPVA

SEQ ID NO: 443078 - protein, 9 aa, Homo Sapiens
ILRNKKDSR

SEQ ID NO: 443079 - protein, 9 aa, Homo Sapiens
CFSKDIVDN

SEQ ID NO: 443080 - protein, 9 aa, Homo Sapiens
LEKAREERF

SEQ ID NO: 443081 - protein, 9 aa, Homo Sapiens
AEKSYTCEE

SEQ ID NO: 443082 - protein, 9 aa, Homo Sapiens
ACRYDPHSN

SEQ ID NO: 443083 - protein, 9 aa, Homo Sapiens
LCIQRTIQQ

SEQ ID NO: 443084 - protein, 9 aa, Homo Sapiens
RSIILVIPF

SEQ ID NO: 443085 - protein, 9 aa, Homo Sapiens
KDTKYNYCI

SEQ ID NO: 443086 - protein, 9 aa, Homo Sapiens
ISSISCCNC

SEQ ID NO: 443087 - protein, 9 aa, Homo Sapiens
HVYCSPSLC

SEQ ID NO: 443088 - protein, 9 aa, Homo Sapiens
GGSGRITMA

SEQ ID NO: 443089 - protein, 9 aa, Homo Sapiens
FLVELHKFY

SEQ ID NO: 443090 - protein, 9 aa, Homo Sapiens
KTAQEKDYL

SEQ ID NO: 443091 - protein, 9 aa, Homo Sapiens
FTDSDILQM

SEQ ID NO: 443092 - protein, 9 aa, Homo Sapiens
DEEEYKATP

SEQ ID NO: 443093 - protein, 9 aa, Homo Sapiens
FSQMILFDD

SEQ ID NO: 443094 - protein, 9 aa, Homo Sapiens
NHRSHLKQH

SEQ ID NO: 443095 - protein, 9 aa, Homo Sapiens
KYNYCIISS

SEQ ID NO: 443096 - protein, 9 aa, Homo Sapiens
IMDEALKIC

SEQ ID NO: 443097 - protein, 9 aa, Homo Sapiens
LSKINFESF

SEQ ID NO: 443098 - protein, 9 aa, Homo Sapiens
LLVTFTWNT

SEQ ID NO: 443099 - protein, 9 aa, Homo Sapiens
PLSESQTVL

SEQ ID NO: 443100 - protein, 9 aa, Homo Sapiens
ICTANEGVM

SEQ ID NO: 443101 - protein, 9 aa, Homo Sapiens
ALAEALCLL

SEQ ID NO: 443102 - protein, 9 aa, Homo Sapiens
VITWFQNWR

SEQ ID NO: 443103 - protein, 9 aa, Homo Sapiens
LVYALGCLR

SEQ ID NO: 443104 - protein, 9 aa, Homo Sapiens
RQTKRIQKQ

SEQ ID NO: 443105 - protein, 9 aa, Homo Sapiens
DQSDCLGEH

SEQ ID NO: 443106 - protein, 9 aa, Homo Sapiens
IVPHNSNEG

SEQ ID NO: 443107 - protein, 9 aa, Homo Sapiens
GMVKKEPIK

SEQ ID NO: 443108 - protein, 9 aa, Homo Sapiens
TEEQELCDL

SEQ ID NO: 443109 - protein, 9 aa, Homo Sapiens
MVISHMVVS

SEQ ID NO: 443110 - protein, 9 aa, Homo Sapiens
LQQIENLQK

SEQ ID NO: 443111 - protein, 9 aa, Homo Sapiens
NLQKHMIGI

SEQ ID NO: 443112 - protein, 9 aa, Homo Sapiens
LNNFQDIMQ

SEQ ID NO: 443113 - protein, 9 aa, Homo Sapiens
VRHQKIIHS

SEQ ID NO: 443114 - protein, 9 aa, Homo Sapiens
KEINERECL

SEQ ID NO: 443115 - protein, 9 aa, Homo Sapiens
VEHLTKVLK

SEQ ID NO: 443116 - protein, 9 aa, Homo Sapiens
QERKFNLYV

SEQ ID NO: 443117 - protein, 9 aa, Homo Sapiens
NRSCGQRFN

SEQ ID NO: 443118 - protein, 9 aa, Homo Sapiens
GMIVITDGE

SEQ ID NO: 443119 - protein, 9 aa, Homo Sapiens
QRMLSQPAG

SEQ ID NO: 443120 - protein, 9 aa, Homo Sapiens
YELQEYNLE

SEQ ID NO: 443121 - protein, 9 aa, Homo Sapiens
EYQWIDQIR

SEQ ID NO: 443122 - protein, 9 aa, Homo Sapiens
PRAQAHKAL

SEQ ID NO: 443123 - protein, 9 aa, Homo Sapiens
AGNSNTRFR

SEQ ID NO: 443124 - protein, 9 aa, Homo Sapiens
YEDNEKEKR

SEQ ID NO: 443125 - protein, 9 aa, Homo Sapiens
GRLIKDPSR

SEQ ID NO: 443126 - protein, 9 aa, Homo Sapiens
IYTHNFYWE

SEQ ID NO: 443127 - protein, 9 aa, Homo Sapiens
SLAILSFCY

SEQ ID NO: 443128 - protein, 9 aa, Homo Sapiens
FNRGSNIIQ

SEQ ID NO: 443129 - protein, 9 aa, Homo Sapiens
KKSGWGQRI

SEQ ID NO: 443130 - protein, 9 aa, Homo Sapiens
ASLTQPSDQ

SEQ ID NO: 443131 - protein, 9 aa, Homo Sapiens
GNTIVPESE

SEQ ID NO: 443132 - protein, 9 aa, Homo Sapiens
VLLFAIGLT

SEQ ID NO: 443133 - protein, 9 aa, Homo Sapiens
SEIWITHRS

SEQ ID NO: 443134 - protein, 9 aa, Homo Sapiens
MTILEIVLF

SEQ ID NO: 443135 - protein, 9 aa, Homo Sapiens
CLSSWEARL

SEQ ID NO: 443136 - protein, 9 aa, Homo Sapiens
FLCMHVKLY

SEQ ID NO: 443137 - protein, 9 aa, Homo Sapiens
GCGCGCGSG

SEQ ID NO: 443138 - protein, 9 aa, Homo Sapiens
VQQHPTEPQ

SEQ ID NO: 443139 - protein, 9 aa, Homo Sapiens
DTAKFKDCY

SEQ ID NO: 443140 - protein, 9 aa, Homo Sapiens
ADRCSSLIE

SEQ ID NO: 443141 - protein, 9 aa, Homo Sapiens
PLQSPESAS

SEQ ID NO: 443142 - protein, 9 aa, Homo Sapiens
HERINTGEK

SEQ ID NO: 443143 - protein, 9 aa, Homo Sapiens
VIHKLRPTE

SEQ ID NO: 443144 - protein, 9 aa, Homo Sapiens
TKPSPSHSA

SEQ ID NO: 443145 - protein, 9 aa, Homo Sapiens
LLTSKLFSY

SEQ ID NO: 443146 - protein, 9 aa, Homo Sapiens
RMSTSVPAF

SEQ ID NO: 443147 - protein, 9 aa, Homo Sapiens
ESGHLTDEG

SEQ ID NO: 443148 - protein, 9 aa, Homo Sapiens
TIPTNLERL

SEQ ID NO: 443149 - protein, 9 aa, Homo Sapiens
SKKDATKNA

SEQ ID NO: 443150 - protein, 9 aa, Homo Sapiens
LGEERRSKK

SEQ ID NO: 443151 - protein, 9 aa, Homo Sapiens
TLHLVFTDS

SEQ ID NO: 443152 - protein, 9 aa, Homo Sapiens
YKLLAERGD

SEQ ID NO: 443153 - protein, 9 aa, Homo Sapiens
HISTSINFN

SEQ ID NO: 443154 - protein, 9 aa, Homo Sapiens
LGSHWLAYA

SEQ ID NO: 443155 - protein, 9 aa, Homo Sapiens
NIFGFLGGV

SEQ ID NO: 443156 - protein, 9 aa, Homo Sapiens
HVVQELTKA

SEQ ID NO: 443157 - protein, 9 aa, Homo Sapiens
IILHIKSTQ

SEQ ID NO: 443158 - protein, 9 aa, Homo Sapiens
KFFFVDTGS

SEQ ID NO: 443159 - protein, 9 aa, Homo Sapiens
LHALSRDQS

SEQ ID NO: 443160 - protein, 9 aa, Homo Sapiens
ECGKGPKII

SEQ ID NO: 443161 - protein, 9 aa, Homo Sapiens
DYETGDFEQ

SEQ ID NO: 443162 - protein, 9 aa, Homo Sapiens
VCMAAIKES

SEQ ID NO: 443163 - protein, 9 aa, Homo Sapiens
NERGVGAGI

SEQ ID NO: 443164 - protein, 9 aa, Homo Sapiens
PNNVPVKQF

SEQ ID NO: 443165 - protein, 9 aa, Homo Sapiens
GVQQPHAEL

SEQ ID NO: 443166 - protein, 9 aa, Homo Sapiens
LLFVMFLIT

SEQ ID NO: 443167 - protein, 9 aa, Homo Sapiens
DVAMSFFGS

SEQ ID NO: 443168 - protein, 9 aa, Homo Sapiens
IFIQLFITL

SEQ ID NO: 443169 - protein, 9 aa, Homo Sapiens
DIGNKKKYD

SEQ ID NO: 443170 - protein, 9 aa, Homo Sapiens
FDINTGAWV

SEQ ID NO: 443171 - protein, 9 aa, Homo Sapiens
KLISYRGCV

SEQ ID NO: 443172 - protein, 9 aa, Homo Sapiens
EKLMYGLAS

SEQ ID NO: 443173 - protein, 9 aa, Homo Sapiens
SNNFEMLNK

SEQ ID NO: 443174 - protein, 9 aa, Homo Sapiens
NNAYKNSPK

SEQ ID NO: 443175 - protein, 9 aa, Homo Sapiens
FANHFPAYV

SEQ ID NO: 443176 - protein, 9 aa, Homo Sapiens
QKGQLYRVD

SEQ ID NO: 443177 - protein, 9 aa, Homo Sapiens
HPIYKAMAV

SEQ ID NO: 443178 - protein, 9 aa, Homo Sapiens
AVIDDIQDL

SEQ ID NO: 443179 - protein, 9 aa, Homo Sapiens
DRQGAVVVT

SEQ ID NO: 443180 - protein, 9 aa, Homo Sapiens
REQIQKHVW

SEQ ID NO: 443181 - protein, 9 aa, Homo Sapiens
RVFVYCTAV

SEQ ID NO: 443182 - protein, 9 aa, Homo Sapiens
KSLLQGSDI

SEQ ID NO: 443183 - protein, 9 aa, Homo Sapiens
QLTVHGFLQ

SEQ ID NO: 443184 - protein, 9 aa, Homo Sapiens
VPCSWKRIQ

SEQ ID NO: 443185 - protein, 9 aa, Homo Sapiens
QSGASLMTG

SEQ ID NO: 443186 - protein, 9 aa, Homo Sapiens
NFIKQQRET

SEQ ID NO: 443187 - protein, 9 aa, Homo Sapiens
HSDQYKGDG

SEQ ID NO: 443188 - protein, 9 aa, Homo Sapiens
YCSPSLCCV

SEQ ID NO: 443189 - protein, 9 aa, Homo Sapiens
DHSDESHKQ

SEQ ID NO: 443190 - protein, 9 aa, Homo Sapiens
SEAVIYVAF

SEQ ID NO: 443191 - protein, 9 aa, Homo Sapiens
SAEEECTTS

SEQ ID NO: 443192 - protein, 9 aa, Homo Sapiens
DDTIQILDA

SEQ ID NO: 443193 - protein, 9 aa, Homo Sapiens
DQNSPLTNQ

SEQ ID NO: 443194 - protein, 9 aa, Homo Sapiens
FDSLRFSTD

SEQ ID NO: 443195 - protein, 9 aa, Homo Sapiens
IMNYFQVAK

SEQ ID NO: 443196 - protein, 9 aa, Homo Sapiens
TGSCCDMSV

SEQ ID NO: 443197 - protein, 9 aa, Homo Sapiens
QASKRTSDQ

SEQ ID NO: 443198 - protein, 9 aa, Homo Sapiens
KTEENLFKR

SEQ ID NO: 443199 - protein, 9 aa, Homo Sapiens
SSHLVAHQI

SEQ ID NO: 443200 - protein, 9 aa, Homo Sapiens
TPKTFVLCS

SEQ ID NO: 443201 - protein, 9 aa, Homo Sapiens
ELGSFHFRA

SEQ ID NO: 443202 - protein, 9 aa, Homo Sapiens
GEVSVTWYT

SEQ ID NO: 443203 - protein, 9 aa, Homo Sapiens
QRCMRYNLP

SEQ ID NO: 443204 - protein, 9 aa, Homo Sapiens
VEGFNHLVV

SEQ ID NO: 443205 - protein, 9 aa, Homo Sapiens
STAASRDKP

SEQ ID NO: 443206 - protein, 9 aa, Homo Sapiens
RSGVMGEKD

SEQ ID NO: 443207 - protein, 9 aa, Homo Sapiens
LNFSFCSTR

SEQ ID NO: 443208 - protein, 9 aa, Homo Sapiens
IFNPVLQKG

SEQ ID NO: 443209 - protein, 9 aa, Homo Sapiens
NCSCVRGTF

SEQ ID NO: 443210 - protein, 9 aa, Homo Sapiens
QSPLPGKSA

SEQ ID NO: 443211 - protein, 9 aa, Homo Sapiens
HCGLVGMRS

SEQ ID NO: 443212 - protein, 9 aa, Homo Sapiens
QSKVSYLQL

SEQ ID NO: 443213 - protein, 9 aa, Homo Sapiens
TDEYQSWKI

SEQ ID NO: 443214 - protein, 9 aa, Homo Sapiens
QVIPQYAIP

SEQ ID NO: 443215 - protein, 9 aa, Homo Sapiens
HRLQHEGIF

SEQ ID NO: 443216 - protein, 9 aa, Homo Sapiens
SRYDAKYLS

SEQ ID NO: 443217 - protein, 9 aa, Homo Sapiens
LQALAYLHV

SEQ ID NO: 443218 - protein, 9 aa, Homo Sapiens
TQYHKKKES

SEQ ID NO: 443219 - protein, 9 aa, Homo Sapiens
DQRLRPRIT

SEQ ID NO: 443220 - protein, 9 aa, Homo Sapiens
TPFGGASHA

SEQ ID NO: 443221 - protein, 9 aa, Homo Sapiens
DFSDWPFVE

SEQ ID NO: 443222 - protein, 9 aa, Homo Sapiens
QTAKFHSRV

SEQ ID NO: 443223 - protein, 9 aa, Homo Sapiens
SEELLLINE

SEQ ID NO: 443224 - protein, 9 aa, Homo Sapiens
FEDMLRQMS

SEQ ID NO: 443225 - protein, 9 aa, Homo Sapiens
TSDKPYIRP

SEQ ID NO: 443226 - protein, 9 aa, Homo Sapiens
TKMRSSNLA

SEQ ID NO: 443227 - protein, 9 aa, Homo Sapiens
MSFSVLLRR

SEQ ID NO: 443228 - protein, 9 aa, Homo Sapiens
VWAHGGANT

SEQ ID NO: 443229 - protein, 9 aa, Homo Sapiens
ENVKSQKIH

SEQ ID NO: 443230 - protein, 9 aa, Homo Sapiens
NYNETEPVT

SEQ ID NO: 443231 - protein, 9 aa, Homo Sapiens
DRGCSCQMV

SEQ ID NO: 443232 - protein, 9 aa, Homo Sapiens
LRDMHMQIS

SEQ ID NO: 443233 - protein, 9 aa, Homo Sapiens
ELAEHFYLT

SEQ ID NO: 443234 - protein, 9 aa, Homo Sapiens
YLPKENPYE

SEQ ID NO: 443235 - protein, 9 aa, Homo Sapiens
SHNDWVMDV

SEQ ID NO: 443236 - protein, 9 aa, Homo Sapiens
ECLRTVKCY

SEQ ID NO: 443237 - protein, 9 aa, Homo Sapiens
LVYVGSDSL

SEQ ID NO: 443238 - protein, 9 aa, Homo Sapiens
RCWMTQFSA

SEQ ID NO: 443239 - protein, 9 aa, Homo Sapiens
HLLPQSSTL

SEQ ID NO: 443240 - protein, 9 aa, Homo Sapiens
ACFCPAEIT

SEQ ID NO: 443241 - protein, 9 aa, Homo Sapiens
EEEDFSNDG

SEQ ID NO: 443242 - protein, 9 aa, Homo Sapiens
YYLRNWRLL

SEQ ID NO: 443243 - protein, 9 aa, Homo Sapiens
EMEVVVSKA

SEQ ID NO: 443244 - protein, 9 aa, Homo Sapiens
SSLAVQGFL

SEQ ID NO: 443245 - protein, 9 aa, Homo Sapiens
KKSRPAMYY

SEQ ID NO: 443246 - protein, 9 aa, Homo Sapiens
QHLRGCPCS

SEQ ID NO: 443247 - protein, 9 aa, Homo Sapiens
LLFHHDMNS

SEQ ID NO: 443248 - protein, 9 aa, Homo Sapiens
RRKHSHRSL

SEQ ID NO: 443249 - protein, 9 aa, Homo Sapiens
NNPDALGNV

SEQ ID NO: 443250 - protein, 9 aa, Homo Sapiens
VHKDYGKKY

SEQ ID NO: 443251 - protein, 9 aa, Homo Sapiens
LGTVAMDLG

SEQ ID NO: 443252 - protein, 9 aa, Homo Sapiens
HAIHYMCRM

SEQ ID NO: 443253 - protein, 9 aa, Homo Sapiens
NLAGSYTCT

SEQ ID NO: 443254 - protein, 9 aa, Homo Sapiens
YDVPQEWQK

SEQ ID NO: 443255 - protein, 9 aa, Homo Sapiens
DPKIGATIQ

SEQ ID NO: 443256 - protein, 9 aa, Homo Sapiens
VPNQFQCKL

SEQ ID NO: 443257 - protein, 9 aa, Homo Sapiens
QEKLGAAED

SEQ ID NO: 443258 - protein, 9 aa, Homo Sapiens
QKFVDLAQE

SEQ ID NO: 443259 - protein, 9 aa, Homo Sapiens
INLKKIHYY

SEQ ID NO: 443260 - protein, 9 aa, Homo Sapiens
LLNNARDTI

SEQ ID NO: 443261 - protein, 9 aa, Homo Sapiens
VGEVLLENP

SEQ ID NO: 443262 - protein, 9 aa, Homo Sapiens
VAYFKVAHL

SEQ ID NO: 443263 - protein, 9 aa, Homo Sapiens
MYLDYRLID

SEQ ID NO: 443264 - protein, 9 aa, Homo Sapiens
EAKQYRKMV

SEQ ID NO: 443265 - protein, 9 aa, Homo Sapiens
KTKNNKQKT

SEQ ID NO: 443266 - protein, 9 aa, Homo Sapiens
ENKTTWLSV

SEQ ID NO: 443267 - protein, 9 aa, Homo Sapiens
MLREICDIP

SEQ ID NO: 443268 - protein, 9 aa, Homo Sapiens
NGSLKKLQQ

SEQ ID NO: 443269 - protein, 9 aa, Homo Sapiens
APVAMMGGQ

SEQ ID NO: 443270 - protein, 9 aa, Homo Sapiens
VVEKGGCIM

SEQ ID NO: 443271 - protein, 9 aa, Homo Sapiens
SRMREDRYV

SEQ ID NO: 443272 - protein, 9 aa, Homo Sapiens
NLQKELNDV

SEQ ID NO: 443273 - protein, 9 aa, Homo Sapiens
GSSTDILKP

SEQ ID NO: 443274 - protein, 9 aa, Homo Sapiens
SASPKKQHK

SEQ ID NO: 443275 - protein, 9 aa, Homo Sapiens
NVEVKTKNN

SEQ ID NO: 443276 - protein, 9 aa, Homo Sapiens
QFDSLEESR

SEQ ID NO: 443277 - protein, 9 aa, Homo Sapiens
SNEFQNKIL

SEQ ID NO: 443278 - protein, 9 aa, Homo Sapiens
TLRKGADST

SEQ ID NO: 443279 - protein, 9 aa, Homo Sapiens
QNNYKLPLR

SEQ ID NO: 443280 - protein, 9 aa, Homo Sapiens
FLFDHQLVY

SEQ ID NO: 443281 - protein, 9 aa, Homo Sapiens
CIAQSHKIP

SEQ ID NO: 443282 - protein, 9 aa, Homo Sapiens
GINSHKINC

SEQ ID NO: 443283 - protein, 9 aa, Homo Sapiens
GIKKVITPS

SEQ ID NO: 443284 - protein, 9 aa, Homo Sapiens
WGRVNNFLM

SEQ ID NO: 443285 - protein, 9 aa, Homo Sapiens
EKWSAPYDV

SEQ ID NO: 443286 - protein, 9 aa, Homo Sapiens
KVQELLQGT

SEQ ID NO: 443287 - protein, 9 aa, Homo Sapiens
YISVDTSWK

SEQ ID NO: 443288 - protein, 9 aa, Homo Sapiens
PIIWGLACK

SEQ ID NO: 443289 - protein, 9 aa, Homo Sapiens
IQHYKLASN

SEQ ID NO: 443290 - protein, 9 aa, Homo Sapiens
EKTYKCKEC

SEQ ID NO: 443291 - protein, 9 aa, Homo Sapiens
NNKQKTPGN

SEQ ID NO: 443292 - protein, 9 aa, Homo Sapiens
EDKHTFLQD

SEQ ID NO: 443293 - protein, 9 aa, Homo Sapiens
YIYRHLFGH

SEQ ID NO: 443294 - protein, 9 aa, Homo Sapiens
HVLLALRRY

SEQ ID NO: 443295 - protein, 9 aa, Homo Sapiens
AGVSSYIYQ

SEQ ID NO: 443296 - protein, 9 aa, Homo Sapiens
HSVEGSQLK

SEQ ID NO: 443297 - protein, 9 aa, Homo Sapiens
RKEINEREC

SEQ ID NO: 443298 - protein, 9 aa, Homo Sapiens
HQDVLIQRQ

SEQ ID NO: 443299 - protein, 9 aa, Homo Sapiens
VMINTDKNQ

SEQ ID NO: 443300 - protein, 9 aa, Homo Sapiens
LAVSMAFST

SEQ ID NO: 443301 - protein, 9 aa, Homo Sapiens
LNNAYKNSP

SEQ ID NO: 443302 - protein, 9 aa, Homo Sapiens
STDLFKSGA

SEQ ID NO: 443303 - protein, 9 aa, Homo Sapiens
TMYNQKPVG

SEQ ID NO: 443304 - protein, 9 aa, Homo Sapiens
EDNNFSLNL

SEQ ID NO: 443305 - protein, 9 aa, Homo Sapiens
DEDFEKELE

SEQ ID NO: 443306 - protein, 9 aa, Homo Sapiens
LIYLTGPYL

SEQ ID NO: 443307 - protein, 9 aa, Homo Sapiens
TMLPIYPAI

SEQ ID NO: 443308 - protein, 9 aa, Homo Sapiens
LGKDCNKTS

SEQ ID NO: 443309 - protein, 9 aa, Homo Sapiens
EASLYGLDL

SEQ ID NO: 443310 - protein, 9 aa, Homo Sapiens
LNIHPSTGT

SEQ ID NO: 443311 - protein, 9 aa, Homo Sapiens
EEQIDTVTG

SEQ ID NO: 443312 - protein, 9 aa, Homo Sapiens
KKCVCYIQG

SEQ ID NO: 443313 - protein, 9 aa, Homo Sapiens
AKMDDNGNS

SEQ ID NO: 443314 - protein, 9 aa, Homo Sapiens
LVIFLLCMN

SEQ ID NO: 443315 - protein, 9 aa, Homo Sapiens
RALRWFPIT

SEQ ID NO: 443316 - protein, 9 aa, Homo Sapiens
SLRQQLDYL

SEQ ID NO: 443317 - protein, 9 aa, Homo Sapiens
NLHINFLEL

SEQ ID NO: 443318 - protein, 9 aa, Homo Sapiens
PTVEEQIDT

SEQ ID NO: 443319 - protein, 9 aa, Homo Sapiens
DVYEAEGLA

SEQ ID NO: 443320 - protein, 9 aa, Homo Sapiens
LNNSKCYHI

SEQ ID NO: 443321 - protein, 9 aa, Homo Sapiens
VGELSDKSK

SEQ ID NO: 443322 - protein, 9 aa, Homo Sapiens
CVGCGCCGK

SEQ ID NO: 443323 - protein, 9 aa, Homo Sapiens
YTSAGKESI

SEQ ID NO: 443324 - protein, 9 aa, Homo Sapiens
DEGTLKEIA

SEQ ID NO: 443325 - protein, 9 aa, Homo Sapiens
TLSQKICSC

SEQ ID NO: 443326 - protein, 9 aa, Homo Sapiens
DNLNLENHR

SEQ ID NO: 443327 - protein, 9 aa, Homo Sapiens
AIFGLYDQM

SEQ ID NO: 443328 - protein, 9 aa, Homo Sapiens
PSRIRKFII

SEQ ID NO: 443329 - protein, 9 aa, Homo Sapiens
VPAGLKGRY

SEQ ID NO: 443330 - protein, 9 aa, Homo Sapiens
GYYICKKGD

SEQ ID NO: 443331 - protein, 9 aa, Homo Sapiens
CYHLTVDRP

SEQ ID NO: 443332 - protein, 9 aa, Homo Sapiens
VKYIIKVAR

SEQ ID NO: 443333 - protein, 9 aa, Homo Sapiens
LPIEIVNKT

SEQ ID NO: 443334 - protein, 9 aa, Homo Sapiens
LGIIGPIIR

SEQ ID NO: 443335 - protein, 9 aa, Homo Sapiens
IPAWTFDIN

SEQ ID NO: 443336 - protein, 9 aa, Homo Sapiens
QNSPGLLVS

SEQ ID NO: 443337 - protein, 9 aa, Homo Sapiens
ELSALVAIK

SEQ ID NO: 443338 - protein, 9 aa, Homo Sapiens
QPNLPYALA

SEQ ID NO: 443339 - protein, 9 aa, Homo Sapiens
SDFLHFKFE

SEQ ID NO: 443340 - protein, 9 aa, Homo Sapiens
GRKMSKNKT

SEQ ID NO: 443341 - protein, 9 aa, Homo Sapiens
VWKGAWYFE

SEQ ID NO: 443342 - protein, 9 aa, Homo Sapiens
HLIWHQKVH

SEQ ID NO: 443343 - protein, 9 aa, Homo Sapiens
FSIVGALRT

SEQ ID NO: 443344 - protein, 9 aa, Homo Sapiens
KRQLDKVRR

SEQ ID NO: 443345 - protein, 9 aa, Homo Sapiens
NSKSSGKGK

SEQ ID NO: 443346 - protein, 9 aa, Homo Sapiens
NLNHTPNLS

SEQ ID NO: 443347 - protein, 9 aa, Homo Sapiens
EVEDSTDLF

SEQ ID NO: 443348 - protein, 9 aa, Homo Sapiens
NTKEMKKKL

SEQ ID NO: 443349 - protein, 9 aa, Homo Sapiens
SENMILLTF

SEQ ID NO: 443350 - protein, 9 aa, Homo Sapiens
LTFHALSDK

SEQ ID NO: 443351 - protein, 9 aa, Homo Sapiens
RGEKAIEIR

SEQ ID NO: 443352 - protein, 9 aa, Homo Sapiens
VWSNHGCVL

SEQ ID NO: 443353 - protein, 9 aa, Homo Sapiens
YFRADKKSL

SEQ ID NO: 443354 - protein, 9 aa, Homo Sapiens
RELLRLESC

SEQ ID NO: 443355 - protein, 9 aa, Homo Sapiens
KTTWLSVDI

SEQ ID NO: 443356 - protein, 9 aa, Homo Sapiens
HQENSVCQV

SEQ ID NO: 443357 - protein, 9 aa, Homo Sapiens
TNQPGDTHP

SEQ ID NO: 443358 - protein, 9 aa, Homo Sapiens
GWQVCKTCY

SEQ ID NO: 443359 - protein, 9 aa, Homo Sapiens
SPGMTRRGL

SEQ ID NO: 443360 - protein, 9 aa, Homo Sapiens
PKNYTDNEV

SEQ ID NO: 443361 - protein, 9 aa, Homo Sapiens
LNNPPGPWG

SEQ ID NO: 443362 - protein, 9 aa, Homo Sapiens
ICINGENSE

SEQ ID NO: 443363 - protein, 9 aa, Homo Sapiens
CRYDPHSNS

SEQ ID NO: 443364 - protein, 9 aa, Homo Sapiens
YKVLLSGEV

SEQ ID NO: 443365 - protein, 9 aa, Homo Sapiens
CILNKVTQS

SEQ ID NO: 443366 - protein, 9 aa, Homo Sapiens
NTPLQSSPS

SEQ ID NO: 443367 - protein, 9 aa, Homo Sapiens
FDWPPKSEI

SEQ ID NO: 443368 - protein, 9 aa, Homo Sapiens
EEKLKPLEE

SEQ ID NO: 443369 - protein, 9 aa, Homo Sapiens
ASDNLDELS

SEQ ID NO: 443370 - protein, 9 aa, Homo Sapiens
KSTERLEPD

SEQ ID NO: 443371 - protein, 9 aa, Homo Sapiens
AEEAATEPE

SEQ ID NO: 443372 - protein, 9 aa, Homo Sapiens
ALYKCVPQE

SEQ ID NO: 443373 - protein, 9 aa, Homo Sapiens
GIYSRHHSL

SEQ ID NO: 443374 - protein, 9 aa, Homo Sapiens
TEDINKPKQ

SEQ ID NO: 443375 - protein, 9 aa, Homo Sapiens
DSTGSTDRD

SEQ ID NO: 443376 - protein, 9 aa, Homo Sapiens
FEELQSTLG

SEQ ID NO: 443377 - protein, 9 aa, Homo Sapiens
KPLKMAGDL

SEQ ID NO: 443378 - protein, 9 aa, Homo Sapiens
KPEAEVDQW

SEQ ID NO: 443379 - protein, 9 aa, Homo Sapiens
YLRALKHEL

SEQ ID NO: 443380 - protein, 9 aa, Homo Sapiens
LKKQTNKNW

SEQ ID NO: 443381 - protein, 9 aa, Homo Sapiens
KEPIKDGHW

SEQ ID NO: 443382 - protein, 9 aa, Homo Sapiens
VPWSIPGPE

SEQ ID NO: 443383 - protein, 9 aa, Homo Sapiens
RFSTDNASK

SEQ ID NO: 443384 - protein, 9 aa, Homo Sapiens
LIRVMQRRP

SEQ ID NO: 443385 - protein, 9 aa, Homo Sapiens
GSTRNCTLL

SEQ ID NO: 443386 - protein, 9 aa, Homo Sapiens
SVVTKSANK

SEQ ID NO: 443387 - protein, 9 aa, Homo Sapiens
ILGNFNLLP

SEQ ID NO: 443388 - protein, 9 aa, Homo Sapiens
THVNVSWCF

SEQ ID NO: 443389 - protein, 9 aa, Homo Sapiens
SVCVRLPRG

SEQ ID NO: 443390 - protein, 9 aa, Homo Sapiens
MGLFESGDM

SEQ ID NO: 443391 - protein, 9 aa, Homo Sapiens
RHFKQALRE

SEQ ID NO: 443392 - protein, 9 aa, Homo Sapiens
VRYEVNCLG

SEQ ID NO: 443393 - protein, 9 aa, Homo Sapiens
IYYSLDYGK

SEQ ID NO: 443394 - protein, 9 aa, Homo Sapiens
ARAESYSSI

SEQ ID NO: 443395 - protein, 9 aa, Homo Sapiens
IMLRKCIRH

SEQ ID NO: 443396 - protein, 9 aa, Homo Sapiens
LELGFKHNK

SEQ ID NO: 443397 - protein, 9 aa, Homo Sapiens
TYATSSPGQ

SEQ ID NO: 443398 - protein, 9 aa, Homo Sapiens
KTKNTKKVI

SEQ ID NO: 443399 - protein, 9 aa, Homo Sapiens
LSDYVIHNS

SEQ ID NO: 443400 - protein, 9 aa, Homo Sapiens
MQLTSKIPD

SEQ ID NO: 443401 - protein, 9 aa, Homo Sapiens
LEKSGFSSP

SEQ ID NO: 443402 - protein, 9 aa, Homo Sapiens
IAIKQFADK

SEQ ID NO: 443403 - protein, 9 aa, Homo Sapiens
AETFVCHTE

SEQ ID NO: 443404 - protein, 9 aa, Homo Sapiens
RVRFQVDHV

SEQ ID NO: 443405 - protein, 9 aa, Homo Sapiens
CKGKEVDNV

SEQ ID NO: 443406 - protein, 9 aa, Homo Sapiens
GFSNCDVLR

SEQ ID NO: 443407 - protein, 9 aa, Homo Sapiens
GQDESSYKE

SEQ ID NO: 443408 - protein, 9 aa, Homo Sapiens
PSSSFRVSS

SEQ ID NO: 443409 - protein, 9 aa, Homo Sapiens
RKRTEEQEL

SEQ ID NO: 443410 - protein, 9 aa, Homo Sapiens
FCPHQQIYD

SEQ ID NO: 443411 - protein, 9 aa, Homo Sapiens
QEHISTSIN

SEQ ID NO: 443412 - protein, 9 aa, Homo Sapiens
FFSHSSLQK

SEQ ID NO: 443413 - protein, 9 aa, Homo Sapiens
ADYEDGLSL

SEQ ID NO: 443414 - protein, 9 aa, Homo Sapiens
FFLSSYLIQ

SEQ ID NO: 443415 - protein, 9 aa, Homo Sapiens
NYHDHGLLR

SEQ ID NO: 443416 - protein, 9 aa, Homo Sapiens
SIVDKVSQK

SEQ ID NO: 443417 - protein, 9 aa, Homo Sapiens
LAEKTDTSH

SEQ ID NO: 443418 - protein, 9 aa, Homo Sapiens
DGKFIKKHP

SEQ ID NO: 443419 - protein, 9 aa, Homo Sapiens
KCEESVEQK

SEQ ID NO: 443420 - protein, 9 aa, Homo Sapiens
VSVLQARLC

SEQ ID NO: 443421 - protein, 9 aa, Homo Sapiens
DNISLDQRL

SEQ ID NO: 443422 - protein, 9 aa, Homo Sapiens
LTSLCCLLD

SEQ ID NO: 443423 - protein, 9 aa, Homo Sapiens
RADIYPLSG

SEQ ID NO: 443424 - protein, 9 aa, Homo Sapiens
IIGPIIRAE

SEQ ID NO: 443425 - protein, 9 aa, Homo Sapiens
EPDLPCDLI

SEQ ID NO: 443426 - protein, 9 aa, Homo Sapiens
REVHKRNDG

SEQ ID NO: 443427 - protein, 9 aa, Homo Sapiens
EGAELNDRA

SEQ ID NO: 443428 - protein, 9 aa, Homo Sapiens
NPGQIALPK

SEQ ID NO: 443429 - protein, 9 aa, Homo Sapiens
VLCSVLKKP

SEQ ID NO: 443430 - protein, 9 aa, Homo Sapiens
DFPQEPEAN

SEQ ID NO: 443431 - protein, 9 aa, Homo Sapiens
WLWAPPSVP

SEQ ID NO: 443432 - protein, 9 aa, Homo Sapiens
FQFQPISCE

SEQ ID NO: 443433 - protein, 9 aa, Homo Sapiens
SLGEETQES

SEQ ID NO: 443434 - protein, 9 aa, Homo Sapiens
TVINMLCNF

SEQ ID NO: 443435 - protein, 9 aa, Homo Sapiens
QAQEQKDKA

SEQ ID NO: 443436 - protein, 9 aa, Homo Sapiens
KMSVAGGKA

SEQ ID NO: 443437 - protein, 9 aa, Homo Sapiens
FNVRIERDA

SEQ ID NO: 443438 - protein, 9 aa, Homo Sapiens
VVTKKSPTH

SEQ ID NO: 443439 - protein, 9 aa, Homo Sapiens
KQAAKKRKC

SEQ ID NO: 443440 - protein, 9 aa, Homo Sapiens
VNRGPAYGL

SEQ ID NO: 443441 - protein, 9 aa, Homo Sapiens
EWFEMETRG

SEQ ID NO: 443442 - protein, 9 aa, Homo Sapiens
KAAVKSVKM

SEQ ID NO: 443443 - protein, 9 aa, Homo Sapiens
YKVDSPNNF

SEQ ID NO: 443444 - protein, 9 aa, Homo Sapiens
FVHTSPKVN

SEQ ID NO: 443445 - protein, 9 aa, Homo Sapiens
DRYVEPLKL

SEQ ID NO: 443446 - protein, 9 aa, Homo Sapiens
KILDVEIMF

SEQ ID NO: 443447 - protein, 9 aa, Homo Sapiens
ASILLSQDY

SEQ ID NO: 443448 - protein, 9 aa, Homo Sapiens
HQITLLDLN

SEQ ID NO: 443449 - protein, 9 aa, Homo Sapiens
LLTRWTRCK

SEQ ID NO: 443450 - protein, 9 aa, Homo Sapiens
ALLVKRSYN

SEQ ID NO: 443451 - protein, 9 aa, Homo Sapiens
KSVSTFSVL

SEQ ID NO: 443452 - protein, 9 aa, Homo Sapiens
ESMSPGLPS

SEQ ID NO: 443453 - protein, 9 aa, Homo Sapiens
NYFNVIHKV

SEQ ID NO: 443454 - protein, 9 aa, Homo Sapiens
DESHKQQSE

SEQ ID NO: 443455 - protein, 9 aa, Homo Sapiens
IQTLGKQLN

SEQ ID NO: 443456 - protein, 9 aa, Homo Sapiens
RINEIQRIA

SEQ ID NO: 443457 - protein, 9 aa, Homo Sapiens
SIMADIENI

SEQ ID NO: 443458 - protein, 9 aa, Homo Sapiens
DNLDELSSS

SEQ ID NO: 443459 - protein, 9 aa, Homo Sapiens
HCRTEDNNF

SEQ ID NO: 443460 - protein, 9 aa, Homo Sapiens
DFREREGQL

SEQ ID NO: 443461 - protein, 9 aa, Homo Sapiens
SNKYINSTL

SEQ ID NO: 443462 - protein, 9 aa, Homo Sapiens
NQIPWTNNT

SEQ ID NO: 443463 - protein, 9 aa, Homo Sapiens
GGRAASLRC

SEQ ID NO: 443464 - protein, 9 aa, Homo Sapiens
NFYIWRPLQ

SEQ ID NO: 443465 - protein, 9 aa, Homo Sapiens
SVDNQTYSG

SEQ ID NO: 443466 - protein, 9 aa, Homo Sapiens
VHQQTHTGE

SEQ ID NO: 443467 - protein, 9 aa, Homo Sapiens
VQALKDRGI

SEQ ID NO: 443468 - protein, 9 aa, Homo Sapiens
IVEFIQSFD

SEQ ID NO: 443469 - protein, 9 aa, Homo Sapiens
MSTNPAILA

SEQ ID NO: 443470 - protein, 9 aa, Homo Sapiens
YKYGFDLNK

SEQ ID NO: 443471 - protein, 9 aa, Homo Sapiens
DILDSQVQY

SEQ ID NO: 443472 - protein, 9 aa, Homo Sapiens
IFQEYGTAG

SEQ ID NO: 443473 - protein, 9 aa, Homo Sapiens
NEKLEWNRE

SEQ ID NO: 443474 - protein, 9 aa, Homo Sapiens
LHGFTVNQV

SEQ ID NO: 443475 - protein, 9 aa, Homo Sapiens
CINMEAKHP

SEQ ID NO: 443476 - protein, 9 aa, Homo Sapiens
YVGDGLSGV

SEQ ID NO: 443477 - protein, 9 aa, Homo Sapiens
LEYLDNWTA

SEQ ID NO: 443478 - protein, 9 aa, Homo Sapiens
CLETCACCC

SEQ ID NO: 443479 - protein, 9 aa, Homo Sapiens
NVYIRLKGQ

SEQ ID NO: 443480 - protein, 9 aa, Homo Sapiens
YGEHVPRFS

SEQ ID NO: 443481 - protein, 9 aa, Homo Sapiens
MWRDVTRRK

SEQ ID NO: 443482 - protein, 9 aa, Homo Sapiens
EMAKVVADT

SEQ ID NO: 443483 - protein, 9 aa, Homo Sapiens
LLEDSGIST

SEQ ID NO: 443484 - protein, 9 aa, Homo Sapiens
YQTLVRQFQ

SEQ ID NO: 443485 - protein, 9 aa, Homo Sapiens
PQEFTDSDI

SEQ ID NO: 443486 - protein, 9 aa, Homo Sapiens
QKRRQVLKD

SEQ ID NO: 443487 - protein, 9 aa, Homo Sapiens
VHSQTVSRN

SEQ ID NO: 443488 - protein, 9 aa, Homo Sapiens
EGTGGKTQI

SEQ ID NO: 443489 - protein, 9 aa, Homo Sapiens
MSPPQKIPS

SEQ ID NO: 443490 - protein, 9 aa, Homo Sapiens
DKPYKCNVC

SEQ ID NO: 443491 - protein, 9 aa, Homo Sapiens
HYEEQHAWN

SEQ ID NO: 443492 - protein, 9 aa, Homo Sapiens
WYQNPDYNL

SEQ ID NO: 443493 - protein, 9 aa, Homo Sapiens
ITLLPQLLG

SEQ ID NO: 443494 - protein, 9 aa, Homo Sapiens
LIDCAFLVG

SEQ ID NO: 443495 - protein, 9 aa, Homo Sapiens
SSTLSLSRN

SEQ ID NO: 443496 - protein, 9 aa, Homo Sapiens
EIEGDGFLF

SEQ ID NO: 443497 - protein, 9 aa, Homo Sapiens
ALSKIETRH

SEQ ID NO: 443498 - protein, 9 aa, Homo Sapiens
TRSIMAEKL

SEQ ID NO: 443499 - protein, 9 aa, Homo Sapiens
KLISETLRR

SEQ ID NO: 443500 - protein, 9 aa, Homo Sapiens
PLLSGLGGE

SEQ ID NO: 443501 - protein, 9 aa, Homo Sapiens
AKKPPSRQN

SEQ ID NO: 443502 - protein, 9 aa, Homo Sapiens
RRKMTKIIC

SEQ ID NO: 443503 - protein, 9 aa, Homo Sapiens
SVADLIGGK

SEQ ID NO: 443504 - protein, 9 aa, Homo Sapiens
WPIFTRGQL

SEQ ID NO: 443505 - protein, 9 aa, Homo Sapiens
NLEGDEDSH

SEQ ID NO: 443506 - protein, 9 aa, Homo Sapiens
LMQQGSELI

SEQ ID NO: 443507 - protein, 9 aa, Homo Sapiens
GTVALRKIR

SEQ ID NO: 443508 - protein, 9 aa, Homo Sapiens
TYLTGVSGS

SEQ ID NO: 443509 - protein, 9 aa, Homo Sapiens
SSESDKNEK

SEQ ID NO: 443510 - protein, 9 aa, Homo Sapiens
EKEQIYYSL

SEQ ID NO: 443511 - protein, 9 aa, Homo Sapiens
PKRAKAMNT

SEQ ID NO: 443512 - protein, 9 aa, Homo Sapiens
WLGAAPSLI

SEQ ID NO: 443513 - protein, 9 aa, Homo Sapiens
VHQDLKPEN

SEQ ID NO: 443514 - protein, 9 aa, Homo Sapiens
CLDLNKTKV

SEQ ID NO: 443515 - protein, 9 aa, Homo Sapiens
ALIVVIPSI

SEQ ID NO: 443516 - protein, 9 aa, Homo Sapiens
FLSSYLIQH

SEQ ID NO: 443517 - protein, 9 aa, Homo Sapiens
RSHFQRVKH

SEQ ID NO: 443518 - protein, 9 aa, Homo Sapiens
IFAVLTSIL

SEQ ID NO: 443519 - protein, 9 aa, Homo Sapiens
PKWLHKFND

SEQ ID NO: 443520 - protein, 9 aa, Homo Sapiens
FGLTQYQYY

SEQ ID NO: 443521 - protein, 9 aa, Homo Sapiens
TKKSPTHQE

SEQ ID NO: 443522 - protein, 9 aa, Homo Sapiens
RLHNLFSAT

SEQ ID NO: 443523 - protein, 9 aa, Homo Sapiens
GLFLGCGFN

SEQ ID NO: 443524 - protein, 9 aa, Homo Sapiens
YREEELLRE

SEQ ID NO: 443525 - protein, 9 aa, Homo Sapiens
LVVHQITHT

SEQ ID NO: 443526 - protein, 9 aa, Homo Sapiens
LLNIPESTP

SEQ ID NO: 443527 - protein, 9 aa, Homo Sapiens
DKAIMEDSG

SEQ ID NO: 443528 - protein, 9 aa, Homo Sapiens
RLWKQEPGL

SEQ ID NO: 443529 - protein, 9 aa, Homo Sapiens
LGKISLFTE

SEQ ID NO: 443530 - protein, 9 aa, Homo Sapiens
TGDLMKNNY

SEQ ID NO: 443531 - protein, 9 aa, Homo Sapiens
PNIQHFWVL

SEQ ID NO: 443532 - protein, 9 aa, Homo Sapiens
SVTGVQRFQ

SEQ ID NO: 443533 - protein, 9 aa, Homo Sapiens
INNKLRWGD

SEQ ID NO: 443534 - protein, 9 aa, Homo Sapiens
NSENQTYRA

SEQ ID NO: 443535 - protein, 9 aa, Homo Sapiens
VLLTDSKFS

SEQ ID NO: 443536 - protein, 9 aa, Homo Sapiens
KLFQKDRKM

SEQ ID NO: 443537 - protein, 9 aa, Homo Sapiens
MSTLGFDRY

SEQ ID NO: 443538 - protein, 9 aa, Homo Sapiens
GEPPATIGT

SEQ ID NO: 443539 - protein, 9 aa, Homo Sapiens
LCKTCYHIV

SEQ ID NO: 443540 - protein, 9 aa, Homo Sapiens
LNYKYGKKV

SEQ ID NO: 443541 - protein, 9 aa, Homo Sapiens
PGEGNGNCV

SEQ ID NO: 443542 - protein, 9 aa, Homo Sapiens
TTPTGSFER

SEQ ID NO: 443543 - protein, 9 aa, Homo Sapiens
GTKLDDEFI

SEQ ID NO: 443544 - protein, 9 aa, Homo Sapiens
KYPTTPKSV

SEQ ID NO: 443545 - protein, 9 aa, Homo Sapiens
GFPQKSSTA

SEQ ID NO: 443546 - protein, 9 aa, Homo Sapiens
PACLLLICR

SEQ ID NO: 443547 - protein, 9 aa, Homo Sapiens
NLTDHKIIH

SEQ ID NO: 443548 - protein, 9 aa, Homo Sapiens
VVSWIYILC

SEQ ID NO: 443549 - protein, 9 aa, Homo Sapiens
TRNFHPRRF

SEQ ID NO: 443550 - protein, 9 aa, Homo Sapiens
SAIRQLLSQ

SEQ ID NO: 443551 - protein, 9 aa, Homo Sapiens
ENSMLTDPE

SEQ ID NO: 443552 - protein, 9 aa, Homo Sapiens
FAVQKESGH

SEQ ID NO: 443553 - protein, 9 aa, Homo Sapiens
VERDQMDKS

SEQ ID NO: 443554 - protein, 9 aa, Homo Sapiens
MALIGNLSI

SEQ ID NO: 443555 - protein, 9 aa, Homo Sapiens
DEILEPPEG

SEQ ID NO: 443556 - protein, 9 aa, Homo Sapiens
DILSQLNER

SEQ ID NO: 443557 - protein, 9 aa, Homo Sapiens
NTINHLFCE

SEQ ID NO: 443558 - protein, 9 aa, Homo Sapiens
GADPVVSAT

SEQ ID NO: 443559 - protein, 9 aa, Homo Sapiens
DFPDELRPT

SEQ ID NO: 443560 - protein, 9 aa, Homo Sapiens
GKAGWHKLL

SEQ ID NO: 443561 - protein, 9 aa, Homo Sapiens
SVEGCLVQV

SEQ ID NO: 443562 - protein, 9 aa, Homo Sapiens
LNTHFRSKD

SEQ ID NO: 443563 - protein, 9 aa, Homo Sapiens
EDLFNLCSR

SEQ ID NO: 443564 - protein, 9 aa, Homo Sapiens
TNLNKYKKI

SEQ ID NO: 443565 - protein, 9 aa, Homo Sapiens
IVMINTDKN

SEQ ID NO: 443566 - protein, 9 aa, Homo Sapiens
PINSPTKRV

SEQ ID NO: 443567 - protein, 9 aa, Homo Sapiens
NSGEKCYKC

SEQ ID NO: 443568 - protein, 9 aa, Homo Sapiens
PPPTQHSIT

SEQ ID NO: 443569 - protein, 9 aa, Homo Sapiens
IVVIKKIKL

SEQ ID NO: 443570 - protein, 9 aa, Homo Sapiens
QAERAVAGY

SEQ ID NO: 443571 - protein, 9 aa, Homo Sapiens
GGWTPQSPD

SEQ ID NO: 443572 - protein, 9 aa, Homo Sapiens
NNSGALEKE

SEQ ID NO: 443573 - protein, 9 aa, Homo Sapiens
EGPKHEVLQ

SEQ ID NO: 443574 - protein, 9 aa, Homo Sapiens
ETKTLLHDH

SEQ ID NO: 443575 - protein, 9 aa, Homo Sapiens
YILKRQLYD

SEQ ID NO: 443576 - protein, 9 aa, Homo Sapiens
LISRLSEIW

SEQ ID NO: 443577 - protein, 9 aa, Homo Sapiens
LPQEFTDSD

SEQ ID NO: 443578 - protein, 9 aa, Homo Sapiens
AHMLCQRHR

SEQ ID NO: 443579 - protein, 9 aa, Homo Sapiens
KMAGDLDFE

SEQ ID NO: 443580 - protein, 9 aa, Homo Sapiens
DQCSEPLVQ

SEQ ID NO: 443581 - protein, 9 aa, Homo Sapiens
QSVPATINA

SEQ ID NO: 443582 - protein, 9 aa, Homo Sapiens
RVAEWCYGP

SEQ ID NO: 443583 - protein, 9 aa, Homo Sapiens
GYIVISNAY

SEQ ID NO: 443584 - protein, 9 aa, Homo Sapiens
LASDQFNRI

SEQ ID NO: 443585 - protein, 9 aa, Homo Sapiens
PNKTLLLYV

SEQ ID NO: 443586 - protein, 9 aa, Homo Sapiens
IGPQNCSCV

SEQ ID NO: 443587 - protein, 9 aa, Homo Sapiens
EWNLLEVSE

SEQ ID NO: 443588 - protein, 9 aa, Homo Sapiens
FQDSLNPRI

SEQ ID NO: 443589 - protein, 9 aa, Homo Sapiens
VQDRALRWF

SEQ ID NO: 443590 - protein, 9 aa, Homo Sapiens
SPILISGLF

SEQ ID NO: 443591 - protein, 9 aa, Homo Sapiens
KVHKEEIAE

SEQ ID NO: 443592 - protein, 9 aa, Homo Sapiens
QQGSYPAPD

SEQ ID NO: 443593 - protein, 9 aa, Homo Sapiens
NLIVHQQIH

SEQ ID NO: 443594 - protein, 9 aa, Homo Sapiens
KLFSYKDFD

SEQ ID NO: 443595 - protein, 9 aa, Homo Sapiens
WKKLIEQMV

SEQ ID NO: 443596 - protein, 9 aa, Homo Sapiens
KENNITGKW

SEQ ID NO: 443597 - protein, 9 aa, Homo Sapiens
RSRWQCSLM

SEQ ID NO: 443598 - protein, 9 aa, Homo Sapiens
QLNYKDNKF

SEQ ID NO: 443599 - protein, 9 aa, Homo Sapiens
KKHFKADER

SEQ ID NO: 443600 - protein, 9 aa, Homo Sapiens
QQMYAATKD

SEQ ID NO: 443601 - protein, 9 aa, Homo Sapiens
HGKARTDLE

SEQ ID NO: 443602 - protein, 9 aa, Homo Sapiens
LFPDMEATL

SEQ ID NO: 443603 - protein, 9 aa, Homo Sapiens
GPHHAQGKS

SEQ ID NO: 443604 - protein, 9 aa, Homo Sapiens
NPEGIQKSS

SEQ ID NO: 443605 - protein, 9 aa, Homo Sapiens
KGEFSRGFG

SEQ ID NO: 443606 - protein, 9 aa, Homo Sapiens
DAGCSLHMF

SEQ ID NO: 443607 - protein, 9 aa, Homo Sapiens
PKTVVIDPS

SEQ ID NO: 443608 - protein, 9 aa, Homo Sapiens
SSSISPILI

SEQ ID NO: 443609 - protein, 9 aa, Homo Sapiens
KQTNKNWVQ

SEQ ID NO: 443610 - protein, 9 aa, Homo Sapiens
MKNTYKVLD

SEQ ID NO: 443611 - protein, 9 aa, Homo Sapiens
YQYYKLLAE

SEQ ID NO: 443612 - protein, 9 aa, Homo Sapiens
SEEFLATFF

SEQ ID NO: 443613 - protein, 9 aa, Homo Sapiens
IMERLDKLH

SEQ ID NO: 443614 - protein, 9 aa, Homo Sapiens
KDGNHKNSV

SEQ ID NO: 443615 - protein, 9 aa, Homo Sapiens
SSGSSDADP

SEQ ID NO: 443616 - protein, 9 aa, Homo Sapiens
GNGRELVEY

SEQ ID NO: 443617 - protein, 9 aa, Homo Sapiens
KGLSPKEHN

SEQ ID NO: 443618 - protein, 9 aa, Homo Sapiens
LDLDYTGIS

SEQ ID NO: 443619 - protein, 9 aa, Homo Sapiens
NMHSSVWYL

SEQ ID NO: 443620 - protein, 9 aa, Homo Sapiens
GFVYGGNCF

SEQ ID NO: 443621 - protein, 9 aa, Homo Sapiens
GLWAWDCLQ

SEQ ID NO: 443622 - protein, 9 aa, Homo Sapiens
VGVQQPHAE

SEQ ID NO: 443623 - protein, 9 aa, Homo Sapiens
TTVQKCIDH

SEQ ID NO: 443624 - protein, 9 aa, Homo Sapiens
LYGDIIQQD

SEQ ID NO: 443625 - protein, 9 aa, Homo Sapiens
AQAHKALSP

SEQ ID NO: 443626 - protein, 9 aa, Homo Sapiens
TVSNNLPVV

SEQ ID NO: 443627 - protein, 9 aa, Homo Sapiens
LQHTRKREA

SEQ ID NO: 443628 - protein, 9 aa, Homo Sapiens
GDTEEINTF

SEQ ID NO: 443629 - protein, 9 aa, Homo Sapiens
QYVVQAADL

SEQ ID NO: 443630 - protein, 9 aa, Homo Sapiens
RTAMSNRET

SEQ ID NO: 443631 - protein, 9 aa, Homo Sapiens
GSFVAFAGF

SEQ ID NO: 443632 - protein, 9 aa, Homo Sapiens
RYVNDPMPN

SEQ ID NO: 443633 - protein, 9 aa, Homo Sapiens
SRILTTHKI

SEQ ID NO: 443634 - protein, 9 aa, Homo Sapiens
PCNSNILKT

SEQ ID NO: 443635 - protein, 9 aa, Homo Sapiens
EQELCDLND

SEQ ID NO: 443636 - protein, 9 aa, Homo Sapiens
NNPIITQLF

SEQ ID NO: 443637 - protein, 9 aa, Homo Sapiens
QKEQNKKIE

SEQ ID NO: 443638 - protein, 9 aa, Homo Sapiens
HGELKNNWG

SEQ ID NO: 443639 - protein, 9 aa, Homo Sapiens
YQEINENIL

SEQ ID NO: 443640 - protein, 9 aa, Homo Sapiens
LCGGLEMLP

SEQ ID NO: 443641 - protein, 9 aa, Homo Sapiens
LGFQLCCYG

SEQ ID NO: 443642 - protein, 9 aa, Homo Sapiens
AFDHEKAQK

SEQ ID NO: 443643 - protein, 9 aa, Homo Sapiens
VISEKHMWE

SEQ ID NO: 443644 - protein, 9 aa, Homo Sapiens
HALKQKFTF

SEQ ID NO: 443645 - protein, 9 aa, Homo Sapiens
QYHSRGEYN

SEQ ID NO: 443646 - protein, 9 aa, Homo Sapiens
WKSQLVIHH

SEQ ID NO: 443647 - protein, 9 aa, Homo Sapiens
AIKVLENIK

SEQ ID NO: 443648 - protein, 9 aa, Homo Sapiens
TRDRVWLLA

SEQ ID NO: 443649 - protein, 9 aa, Homo Sapiens
TVVAAVLGI

SEQ ID NO: 443650 - protein, 9 aa, Homo Sapiens
PYDGKFIKK

SEQ ID NO: 443651 - protein, 9 aa, Homo Sapiens
GIKNAEIYN

SEQ ID NO: 443652 - protein, 9 aa, Homo Sapiens
PHPKDIKFH

SEQ ID NO: 443653 - protein, 9 aa, Homo Sapiens
IMEDSGRIR

SEQ ID NO: 443654 - protein, 9 aa, Homo Sapiens
STSSVQALT

SEQ ID NO: 443655 - protein, 9 aa, Homo Sapiens
YVDEEGDLV

SEQ ID NO: 443656 - protein, 9 aa, Homo Sapiens
ALVRHQIIH

SEQ ID NO: 443657 - protein, 9 aa, Homo Sapiens
EMLRLPVFS

SEQ ID NO: 443658 - protein, 9 aa, Homo Sapiens
FCITAYPNV

SEQ ID NO: 443659 - protein, 9 aa, Homo Sapiens
LNFFNVTVL

SEQ ID NO: 443660 - protein, 9 aa, Homo Sapiens
GLNITEVVK

SEQ ID NO: 443661 - protein, 9 aa, Homo Sapiens
IYSNIFGFL

SEQ ID NO: 443662 - protein, 9 aa, Homo Sapiens
DYVGDGLSG

SEQ ID NO: 443663 - protein, 9 aa, Homo Sapiens
NRLCYYLGT

SEQ ID NO: 443664 - protein, 9 aa, Homo Sapiens
KHLKKMDVG

SEQ ID NO: 443665 - protein, 9 aa, Homo Sapiens
ICRIVDWKG

SEQ ID NO: 443666 - protein, 9 aa, Homo Sapiens
LDRKAQNDN

SEQ ID NO: 443667 - protein, 9 aa, Homo Sapiens
AIQWMSPYL

SEQ ID NO: 443668 - protein, 9 aa, Homo Sapiens
NEYKEQFFL

SEQ ID NO: 443669 - protein, 9 aa, Homo Sapiens
GEDDDEEEE

SEQ ID NO: 443670 - protein, 9 aa, Homo Sapiens
QKSSPTHHQ

SEQ ID NO: 443671 - protein, 9 aa, Homo Sapiens
IIKSPNEMV

SEQ ID NO: 443672 - protein, 9 aa, Homo Sapiens
PPGQYSGKS

SEQ ID NO: 443673 - protein, 9 aa, Homo Sapiens
NTSHLPNQN

SEQ ID NO: 443674 - protein, 9 aa, Homo Sapiens
EEHLGIIGP

SEQ ID NO: 443675 - protein, 9 aa, Homo Sapiens
QHYCHECGK

SEQ ID NO: 443676 - protein, 9 aa, Homo Sapiens
SSALVSQSY

SEQ ID NO: 443677 - protein, 9 aa, Homo Sapiens
RRKEMTHKL

SEQ ID NO: 443678 - protein, 9 aa, Homo Sapiens
TTRYIKALE

SEQ ID NO: 443679 - protein, 9 aa, Homo Sapiens
AAHAEFAPK

SEQ ID NO: 443680 - protein, 9 aa, Homo Sapiens
FKVMQLINE

SEQ ID NO: 443681 - protein, 9 aa, Homo Sapiens
PDGDFHRGY

SEQ ID NO: 443682 - protein, 9 aa, Homo Sapiens
HETTTGKKD

SEQ ID NO: 443683 - protein, 9 aa, Homo Sapiens
DDVCNRFKL

SEQ ID NO: 443684 - protein, 9 aa, Homo Sapiens
PCCGGATCV

SEQ ID NO: 443685 - protein, 9 aa, Homo Sapiens
QNKQHYITK

SEQ ID NO: 443686 - protein, 9 aa, Homo Sapiens
LFSADWKRV

SEQ ID NO: 443687 - protein, 9 aa, Homo Sapiens
NNRKLGPGA

SEQ ID NO: 443688 - protein, 9 aa, Homo Sapiens
RDSDYDKER

SEQ ID NO: 443689 - protein, 9 aa, Homo Sapiens
PQIPFSTFQ

SEQ ID NO: 443690 - protein, 9 aa, Homo Sapiens
AASVYIRSN

SEQ ID NO: 443691 - protein, 9 aa, Homo Sapiens
IFLPNTILS

SEQ ID NO: 443692 - protein, 9 aa, Homo Sapiens
KINYLNQQI

SEQ ID NO: 443693 - protein, 9 aa, Homo Sapiens
LVDLIPKYE

SEQ ID NO: 443694 - protein, 9 aa, Homo Sapiens
DLLGKKVYA

SEQ ID NO: 443695 - protein, 9 aa, Homo Sapiens
KVLKEKNKE

SEQ ID NO: 443696 - protein, 9 aa, Homo Sapiens
SLWLRWVPL

SEQ ID NO: 443697 - protein, 9 aa, Homo Sapiens
LHADQAVID

SEQ ID NO: 443698 - protein, 9 aa, Homo Sapiens
ESNNYEELL

SEQ ID NO: 443699 - protein, 9 aa, Homo Sapiens
RRRRSQRIL

SEQ ID NO: 443700 - protein, 9 aa, Homo Sapiens
KNNNLLHQQ

SEQ ID NO: 443701 - protein, 9 aa, Homo Sapiens
PNMLGMGGL

SEQ ID NO: 443702 - protein, 9 aa, Homo Sapiens
SQNSLDNFI

SEQ ID NO: 443703 - protein, 9 aa, Homo Sapiens
LRAVYFLAR

SEQ ID NO: 443704 - protein, 9 aa, Homo Sapiens
KQNAISSNN

SEQ ID NO: 443705 - protein, 9 aa, Homo Sapiens
LAVIHKLRP

SEQ ID NO: 443706 - protein, 9 aa, Homo Sapiens
HCAACRTYA

SEQ ID NO: 443707 - protein, 9 aa, Homo Sapiens
IQEEETFLR

SEQ ID NO: 443708 - protein, 9 aa, Homo Sapiens
AWKEADKFG

SEQ ID NO: 443709 - protein, 9 aa, Homo Sapiens
WGPNFNFSI

SEQ ID NO: 443710 - protein, 9 aa, Homo Sapiens
WATSGAATP

SEQ ID NO: 443711 - protein, 9 aa, Homo Sapiens
QRGLASGDH

SEQ ID NO: 443712 - protein, 9 aa, Homo Sapiens
EGLIAFSVG

SEQ ID NO: 443713 - protein, 9 aa, Homo Sapiens
MQSLGLWAW

SEQ ID NO: 443714 - protein, 9 aa, Homo Sapiens
EKEDLNITN

SEQ ID NO: 443715 - protein, 9 aa, Homo Sapiens
LIISLQLLC

SEQ ID NO: 443716 - protein, 9 aa, Homo Sapiens
KARNRILSR

SEQ ID NO: 443717 - protein, 9 aa, Homo Sapiens
AGLILLAFL

SEQ ID NO: 443718 - protein, 9 aa, Homo Sapiens
RSRHRRSQS

SEQ ID NO: 443719 - protein, 9 aa, Homo Sapiens
RINSGEKCY

SEQ ID NO: 443720 - protein, 9 aa, Homo Sapiens
GMRKVLRTL

SEQ ID NO: 443721 - protein, 9 aa, Homo Sapiens
SWIEKKWLL

SEQ ID NO: 443722 - protein, 9 aa, Homo Sapiens
CHLCGKSFN

SEQ ID NO: 443723 - protein, 9 aa, Homo Sapiens
AGEVHIGGV

SEQ ID NO: 443724 - protein, 9 aa, Homo Sapiens
LKMVEGTAW

SEQ ID NO: 443725 - protein, 9 aa, Homo Sapiens
RGEGEEDNE

SEQ ID NO: 443726 - protein, 9 aa, Homo Sapiens
CQDNNFLLY

SEQ ID NO: 443727 - protein, 9 aa, Homo Sapiens
ETNKGTQTE

SEQ ID NO: 443728 - protein, 9 aa, Homo Sapiens
NVLLRKGCK

SEQ ID NO: 443729 - protein, 9 aa, Homo Sapiens
SDTKYLEII

SEQ ID NO: 443730 - protein, 9 aa, Homo Sapiens
SHNNVFPDG

SEQ ID NO: 443731 - protein, 9 aa, Homo Sapiens
EELIVFWFC

SEQ ID NO: 443732 - protein, 9 aa, Homo Sapiens
KGSAMLFPH

SEQ ID NO: 443733 - protein, 9 aa, Homo Sapiens
GEFYGRYRI

SEQ ID NO: 443734 - protein, 9 aa, Homo Sapiens
ADNVCKASA

SEQ ID NO: 443735 - protein, 9 aa, Homo Sapiens
VVALSSQKL

SEQ ID NO: 443736 - protein, 9 aa, Homo Sapiens
LREQKYFKI

SEQ ID NO: 443737 - protein, 9 aa, Homo Sapiens
QRAFSTCSS

SEQ ID NO: 443738 - protein, 9 aa, Homo Sapiens
TVQQNACAE

SEQ ID NO: 443739 - protein, 9 aa, Homo Sapiens
FPNIFCETS

SEQ ID NO: 443740 - protein, 9 aa, Homo Sapiens
INHNYLEIL

SEQ ID NO: 443741 - protein, 9 aa, Homo Sapiens
QPKSFDNSP

SEQ ID NO: 443742 - protein, 9 aa, Homo Sapiens
NFRKLSSRS

SEQ ID NO: 443743 - protein, 9 aa, Homo Sapiens
GDPLDLKMV

SEQ ID NO: 443744 - protein, 9 aa, Homo Sapiens
EEVVRECTI

SEQ ID NO: 443745 - protein, 9 aa, Homo Sapiens
EDPSLSELD

SEQ ID NO: 443746 - protein, 9 aa, Homo Sapiens
SSRNQGGES

SEQ ID NO: 443747 - protein, 9 aa, Homo Sapiens
KMYTPLFFT

SEQ ID NO: 443748 - protein, 9 aa, Homo Sapiens
PAEITGPSC

SEQ ID NO: 443749 - protein, 9 aa, Homo Sapiens
SRDKVSHLQ

SEQ ID NO: 443750 - protein, 9 aa, Homo Sapiens
LHKLCDVIM

SEQ ID NO: 443751 - protein, 9 aa, Homo Sapiens
EIVSNDISD

SEQ ID NO: 443752 - protein, 9 aa, Homo Sapiens
VQFGLKNTS

SEQ ID NO: 443753 - protein, 9 aa, Homo Sapiens
KGNVVNLNS

SEQ ID NO: 443754 - protein, 9 aa, Homo Sapiens
TLLCNCTFF

SEQ ID NO: 443755 - protein, 9 aa, Homo Sapiens
PKVANIRLN

SEQ ID NO: 443756 - protein, 9 aa, Homo Sapiens
KPTVDLAHT

SEQ ID NO: 443757 - protein, 9 aa, Homo Sapiens
WTLYVLISF

SEQ ID NO: 443758 - protein, 9 aa, Homo Sapiens
ALPTCGSHL

SEQ ID NO: 443759 - protein, 9 aa, Homo Sapiens
KVQETGYIV

SEQ ID NO: 443760 - protein, 9 aa, Homo Sapiens
RYWKTQAAN

SEQ ID NO: 443761 - protein, 9 aa, Homo Sapiens
ITQRAEIHF

SEQ ID NO: 443762 - protein, 9 aa, Homo Sapiens
IMCNRRQEM

SEQ ID NO: 443763 - protein, 9 aa, Homo Sapiens
SSSKMKAPV

SEQ ID NO: 443764 - protein, 9 aa, Homo Sapiens
TRARGRARC

SEQ ID NO: 443765 - protein, 9 aa, Homo Sapiens
AKKQDNNKM

SEQ ID NO: 443766 - protein, 9 aa, Homo Sapiens
RCLHNGTCM

SEQ ID NO: 443767 - protein, 9 aa, Homo Sapiens
GDVSPQKEP

SEQ ID NO: 443768 - protein, 9 aa, Homo Sapiens
QPCLTGPHT

SEQ ID NO: 443769 - protein, 9 aa, Homo Sapiens
GVFVNVDKV

SEQ ID NO: 443770 - protein, 9 aa, Homo Sapiens
KGAKKPRFD

SEQ ID NO: 443771 - protein, 9 aa, Homo Sapiens
FCSDISVSA

SEQ ID NO: 443772 - protein, 9 aa, Homo Sapiens
ISRQLYWGT

SEQ ID NO: 443773 - protein, 9 aa, Homo Sapiens
FPLFMDNSN

SEQ ID NO: 443774 - protein, 9 aa, Homo Sapiens
LKSKSMNVL

SEQ ID NO: 443775 - protein, 9 aa, Homo Sapiens
LGFDRYVEP

SEQ ID NO: 443776 - protein, 9 aa, Homo Sapiens
PTGIPGLPG

SEQ ID NO: 443777 - protein, 9 aa, Homo Sapiens
LSPANCQID

SEQ ID NO: 443778 - protein, 9 aa, Homo Sapiens
QTREIKPSL

SEQ ID NO: 443779 - protein, 9 aa, Homo Sapiens
DEILEELKE

SEQ ID NO: 443780 - protein, 9 aa, Homo Sapiens
DERTHKIKK

SEQ ID NO: 443781 - protein, 9 aa, Homo Sapiens
TKQSIYLAS

SEQ ID NO: 443782 - protein, 9 aa, Homo Sapiens
KDIHSTAVK

SEQ ID NO: 443783 - protein, 9 aa, Homo Sapiens
RRTSTNRVL

SEQ ID NO: 443784 - protein, 9 aa, Homo Sapiens
LRNVGNTCY

SEQ ID NO: 443785 - protein, 9 aa, Homo Sapiens
WLEHNLERV

SEQ ID NO: 443786 - protein, 9 aa, Homo Sapiens
NYLEILKED

SEQ ID NO: 443787 - protein, 9 aa, Homo Sapiens
TYLPTVTVT

SEQ ID NO: 443788 - protein, 9 aa, Homo Sapiens
APKKNKNKG

SEQ ID NO: 443789 - protein, 9 aa, Homo Sapiens
LVWKTSSFL

SEQ ID NO: 443790 - protein, 9 aa, Homo Sapiens
EVNCQLQGK

SEQ ID NO: 443791 - protein, 9 aa, Homo Sapiens
TQSSDKTAN

SEQ ID NO: 443792 - protein, 9 aa, Homo Sapiens
WIQLPDLEN

SEQ ID NO: 443793 - protein, 9 aa, Homo Sapiens
CDMYSSVDT

SEQ ID NO: 443794 - protein, 9 aa, Homo Sapiens
ETCATYELN

SEQ ID NO: 443795 - protein, 9 aa, Homo Sapiens
KQILKILYA

SEQ ID NO: 443796 - protein, 9 aa, Homo Sapiens
SLDLSKLAK

SEQ ID NO: 443797 - protein, 9 aa, Homo Sapiens
SSEYSIFDN

SEQ ID NO: 443798 - protein, 9 aa, Homo Sapiens
DTYMFATKV

SEQ ID NO: 443799 - protein, 9 aa, Homo Sapiens
LCEGLLHPN

SEQ ID NO: 443800 - protein, 9 aa, Homo Sapiens
VIDDNAPVT

SEQ ID NO: 443801 - protein, 9 aa, Homo Sapiens
LRFGPKPMC

SEQ ID NO: 443802 - protein, 9 aa, Homo Sapiens
PMSPPGPPG

SEQ ID NO: 443803 - protein, 9 aa, Homo Sapiens
TYYPEADHE

SEQ ID NO: 443804 - protein, 9 aa, Homo Sapiens
KPGVGLLLV

SEQ ID NO: 443805 - protein, 9 aa, Homo Sapiens
FPSRKAKPV

SEQ ID NO: 443806 - protein, 9 aa, Homo Sapiens
PPPYCDDTV

SEQ ID NO: 443807 - protein, 9 aa, Homo Sapiens
TTQNIHLGV

SEQ ID NO: 443808 - protein, 9 aa, Homo Sapiens
FANSSNRKK

SEQ ID NO: 443809 - protein, 9 aa, Homo Sapiens
FVYGGNCFN

SEQ ID NO: 443810 - protein, 9 aa, Homo Sapiens
FPTIPVAST

SEQ ID NO: 443811 - protein, 9 aa, Homo Sapiens
GGFICYPVP

SEQ ID NO: 443812 - protein, 9 aa, Homo Sapiens
IIYKISPEK

SEQ ID NO: 443813 - protein, 9 aa, Homo Sapiens
MGQSAPVRL

SEQ ID NO: 443814 - protein, 9 aa, Homo Sapiens
AKQEGAIEA

SEQ ID NO: 443815 - protein, 9 aa, Homo Sapiens
YFMKQINDA

SEQ ID NO: 443816 - protein, 9 aa, Homo Sapiens
DTSIFENVI

SEQ ID NO: 443817 - protein, 9 aa, Homo Sapiens
KETGIYLPL

SEQ ID NO: 443818 - protein, 9 aa, Homo Sapiens
ELQKKIQEE

SEQ ID NO: 443819 - protein, 9 aa, Homo Sapiens
GKSTWYDGE

SEQ ID NO: 443820 - protein, 9 aa, Homo Sapiens
DDIQIYFDT

SEQ ID NO: 443821 - protein, 9 aa, Homo Sapiens
SEEGSRRLL

SEQ ID NO: 443822 - protein, 9 aa, Homo Sapiens
GCCHPITCC

SEQ ID NO: 443823 - protein, 9 aa, Homo Sapiens
RVTLNYTTR

SEQ ID NO: 443824 - protein, 9 aa, Homo Sapiens
LFITLFSVI

SEQ ID NO: 443825 - protein, 9 aa, Homo Sapiens
ERICMENIL

SEQ ID NO: 443826 - protein, 9 aa, Homo Sapiens
SEHEANSEW

SEQ ID NO: 443827 - protein, 9 aa, Homo Sapiens
HAKQKFYLR

SEQ ID NO: 443828 - protein, 9 aa, Homo Sapiens
VNNDDSDIL

SEQ ID NO: 443829 - protein, 9 aa, Homo Sapiens
YSTDYYRVQ

SEQ ID NO: 443830 - protein, 9 aa, Homo Sapiens
VDIKANIVF

SEQ ID NO: 443831 - protein, 9 aa, Homo Sapiens
EGTAIYLTG

SEQ ID NO: 443832 - protein, 9 aa, Homo Sapiens
LDKPVEIIR

SEQ ID NO: 443833 - protein, 9 aa, Homo Sapiens
SKADIYTHN

SEQ ID NO: 443834 - protein, 9 aa, Homo Sapiens
TSLWDIAGA

SEQ ID NO: 443835 - protein, 9 aa, Homo Sapiens
KRLCINMEA

SEQ ID NO: 443836 - protein, 9 aa, Homo Sapiens
PEDHKLNTY

SEQ ID NO: 443837 - protein, 9 aa, Homo Sapiens
AYVYLYIIN

SEQ ID NO: 443838 - protein, 9 aa, Homo Sapiens
SKKHFKADE

SEQ ID NO: 443839 - protein, 9 aa, Homo Sapiens
EKLKPLEEV

SEQ ID NO: 443840 - protein, 9 aa, Homo Sapiens
LHPNCKLQV

SEQ ID NO: 443841 - protein, 9 aa, Homo Sapiens
LQDYHNPLM

SEQ ID NO: 443842 - protein, 9 aa, Homo Sapiens
FVILRNKKD

SEQ ID NO: 443843 - protein, 9 aa, Homo Sapiens
GSLLEDIAS

SEQ ID NO: 443844 - protein, 9 aa, Homo Sapiens
LPIQWNKVS

SEQ ID NO: 443845 - protein, 9 aa, Homo Sapiens
HYPNTHHCL

SEQ ID NO: 443846 - protein, 9 aa, Homo Sapiens
NTKEPVKKI

SEQ ID NO: 443847 - protein, 9 aa, Homo Sapiens
LPYALAFLY

SEQ ID NO: 443848 - protein, 9 aa, Homo Sapiens
AVSKPQTLT

SEQ ID NO: 443849 - protein, 9 aa, Homo Sapiens
LLLCLEKYH

SEQ ID NO: 443850 - protein, 9 aa, Homo Sapiens
KEYLIARGK

SEQ ID NO: 443851 - protein, 9 aa, Homo Sapiens
MVHGNERCI

SEQ ID NO: 443852 - protein, 9 aa, Homo Sapiens
CSSSPCCGG

SEQ ID NO: 443853 - protein, 9 aa, Homo Sapiens
MMQGFICKQ

SEQ ID NO: 443854 - protein, 9 aa, Homo Sapiens
PCQGNNFIR

SEQ ID NO: 443855 - protein, 9 aa, Homo Sapiens
KSKSLTYTG

SEQ ID NO: 443856 - protein, 9 aa, Homo Sapiens
LAASQPEGF

SEQ ID NO: 443857 - protein, 9 aa, Homo Sapiens
PSFFATHPN

SEQ ID NO: 443858 - protein, 9 aa, Homo Sapiens
EVPASTFQK

SEQ ID NO: 443859 - protein, 9 aa, Homo Sapiens
YLCTEKYNV

SEQ ID NO: 443860 - protein, 9 aa, Homo Sapiens
MQKHTHSPE

SEQ ID NO: 443861 - protein, 9 aa, Homo Sapiens
QPNKVIYKN

SEQ ID NO: 443862 - protein, 9 aa, Homo Sapiens
IGHLVEDME

SEQ ID NO: 443863 - protein, 9 aa, Homo Sapiens
NSHKINCQL

SEQ ID NO: 443864 - protein, 9 aa, Homo Sapiens
LDEFSKQVN

SEQ ID NO: 443865 - protein, 9 aa, Homo Sapiens
PCLTGPHTC

SEQ ID NO: 443866 - protein, 9 aa, Homo Sapiens
MDVVTMQYY

SEQ ID NO: 443867 - protein, 9 aa, Homo Sapiens
TKRLTKADI

SEQ ID NO: 443868 - protein, 9 aa, Homo Sapiens
SKTIRNYSL

SEQ ID NO: 443869 - protein, 9 aa, Homo Sapiens
VTIFEEVQK

SEQ ID NO: 443870 - protein, 9 aa, Homo Sapiens
LPEVVHKDY

SEQ ID NO: 443871 - protein, 9 aa, Homo Sapiens
WLLLCLEKY

SEQ ID NO: 443872 - protein, 9 aa, Homo Sapiens
EKSYALAVL

SEQ ID NO: 443873 - protein, 9 aa, Homo Sapiens
NCYTKLCEY

SEQ ID NO: 443874 - protein, 9 aa, Homo Sapiens
LCTEKYNVY

SEQ ID NO: 443875 - protein, 9 aa, Homo Sapiens
VGCGCCGKV

SEQ ID NO: 443876 - protein, 9 aa, Homo Sapiens
LNHSLDKDT

SEQ ID NO: 443877 - protein, 9 aa, Homo Sapiens
EISSATQLR

SEQ ID NO: 443878 - protein, 9 aa, Homo Sapiens
CANIQFRSD

SEQ ID NO: 443879 - protein, 9 aa, Homo Sapiens
AHLLLIIKG

SEQ ID NO: 443880 - protein, 9 aa, Homo Sapiens
CSMVSQMNK

SEQ ID NO: 443881 - protein, 9 aa, Homo Sapiens
EQIQKHVWL

SEQ ID NO: 443882 - protein, 9 aa, Homo Sapiens
LNEIQGESV

SEQ ID NO: 443883 - protein, 9 aa, Homo Sapiens
QTPIPWLSS

SEQ ID NO: 443884 - protein, 9 aa, Homo Sapiens
EILEELKEK

SEQ ID NO: 443885 - protein, 9 aa, Homo Sapiens
GTQRLPRTI

SEQ ID NO: 443886 - protein, 9 aa, Homo Sapiens
VFRLLKRTH

SEQ ID NO: 443887 - protein, 9 aa, Homo Sapiens
SLFVYLGSS

SEQ ID NO: 443888 - protein, 9 aa, Homo Sapiens
VVIWIQPQS

SEQ ID NO: 443889 - protein, 9 aa, Homo Sapiens
RRSLGYAHI

SEQ ID NO: 443890 - protein, 9 aa, Homo Sapiens
CGGATCVLG

SEQ ID NO: 443891 - protein, 9 aa, Homo Sapiens
VRFLDQQNQ

SEQ ID NO: 443892 - protein, 9 aa, Homo Sapiens
ISDKRVQPL

SEQ ID NO: 443893 - protein, 9 aa, Homo Sapiens
RGPFRLHNL

SEQ ID NO: 443894 - protein, 9 aa, Homo Sapiens
QLDLVHTAA

SEQ ID NO: 443895 - protein, 9 aa, Homo Sapiens
PDFIILGLF

SEQ ID NO: 443896 - protein, 9 aa, Homo Sapiens
ENQENMIYY

SEQ ID NO: 443897 - protein, 9 aa, Homo Sapiens
VVKGRGPNV

SEQ ID NO: 443898 - protein, 9 aa, Homo Sapiens
QRRPLKDKI

SEQ ID NO: 443899 - protein, 9 aa, Homo Sapiens
KQINPMDVW

SEQ ID NO: 443900 - protein, 9 aa, Homo Sapiens
ECMKKCISA

SEQ ID NO: 443901 - protein, 9 aa, Homo Sapiens
FFRGSELNQ

SEQ ID NO: 443902 - protein, 9 aa, Homo Sapiens
VEAVVYNDK

SEQ ID NO: 443903 - protein, 9 aa, Homo Sapiens
YVNNLAKHV

SEQ ID NO: 443904 - protein, 9 aa, Homo Sapiens
EDINKPKQF

SEQ ID NO: 443905 - protein, 9 aa, Homo Sapiens
SGTPSSEME

SEQ ID NO: 443906 - protein, 9 aa, Homo Sapiens
LKNEERKLQ

SEQ ID NO: 443907 - protein, 9 aa, Homo Sapiens
LDVEIMFNE

SEQ ID NO: 443908 - protein, 9 aa, Homo Sapiens
NAFFSLYFG

SEQ ID NO: 443909 - protein, 9 aa, Homo Sapiens
PLDNLKVWD

SEQ ID NO: 443910 - protein, 9 aa, Homo Sapiens
PLEAEYTDV

SEQ ID NO: 443911 - protein, 9 aa, Homo Sapiens
KYNRKMSAD

SEQ ID NO: 443912 - protein, 9 aa, Homo Sapiens
PQVPKGLNN

SEQ ID NO: 443913 - protein, 9 aa, Homo Sapiens
FFVDFMLPT

SEQ ID NO: 443914 - protein, 9 aa, Homo Sapiens
EKNYVASIS

SEQ ID NO: 443915 - protein, 9 aa, Homo Sapiens
ISCLKPAQL

SEQ ID NO: 443916 - protein, 9 aa, Homo Sapiens
MKSIRFPLM

SEQ ID NO: 443917 - protein, 9 aa, Homo Sapiens
ASLMLFVQL

SEQ ID NO: 443918 - protein, 9 aa, Homo Sapiens
TQGLESNNF

SEQ ID NO: 443919 - protein, 9 aa, Homo Sapiens
KQLKKQQEE

SEQ ID NO: 443920 - protein, 9 aa, Homo Sapiens
QAETEETLN

SEQ ID NO: 443921 - protein, 9 aa, Homo Sapiens
SRLIVHQQT

SEQ ID NO: 443922 - protein, 9 aa, Homo Sapiens
FYPGYPLIL

SEQ ID NO: 443923 - protein, 9 aa, Homo Sapiens
TGPAGHFPH

SEQ ID NO: 443924 - protein, 9 aa, Homo Sapiens
TRSLTDDFE

SEQ ID NO: 443925 - protein, 9 aa, Homo Sapiens
VIPRDWKTF

SEQ ID NO: 443926 - protein, 9 aa, Homo Sapiens
LQIIATRGV

SEQ ID NO: 443927 - protein, 9 aa, Homo Sapiens
PKPMCIKED

SEQ ID NO: 443928 - protein, 9 aa, Homo Sapiens
YQRWLVRFN

SEQ ID NO: 443929 - protein, 9 aa, Homo Sapiens
CVDFRNMAY

SEQ ID NO: 443930 - protein, 9 aa, Homo Sapiens
YMSSQYLFK

SEQ ID NO: 443931 - protein, 9 aa, Homo Sapiens
FVDLAQESA

SEQ ID NO: 443932 - protein, 9 aa, Homo Sapiens
MVSYTEILK

SEQ ID NO: 443933 - protein, 9 aa, Homo Sapiens
SYLVRHQKI

SEQ ID NO: 443934 - protein, 9 aa, Homo Sapiens
LNHTPNLST

SEQ ID NO: 443935 - protein, 9 aa, Homo Sapiens
TGVVCHTLA

SEQ ID NO: 443936 - protein, 9 aa, Homo Sapiens
TYELNVDRV

SEQ ID NO: 443937 - protein, 9 aa, Homo Sapiens
YRLEKEDKL

SEQ ID NO: 443938 - protein, 9 aa, Homo Sapiens
FHAEVSADI

SEQ ID NO: 443939 - protein, 9 aa, Homo Sapiens
LGQIMGETP

SEQ ID NO: 443940 - protein, 9 aa, Homo Sapiens
YKGKYVMEL

SEQ ID NO: 443941 - protein, 9 aa, Homo Sapiens
TSRNREAKQ

SEQ ID NO: 443942 - protein, 9 aa, Homo Sapiens
DKNQSIFCW

SEQ ID NO: 443943 - protein, 9 aa, Homo Sapiens
ALNTMFCQL

SEQ ID NO: 443944 - protein, 9 aa, Homo Sapiens
PGHCLPKSI

SEQ ID NO: 443945 - protein, 9 aa, Homo Sapiens
DYGEVTNVT

SEQ ID NO: 443946 - protein, 9 aa, Homo Sapiens
SIVSEIQPH

SEQ ID NO: 443947 - protein, 9 aa, Homo Sapiens
WEMITPSAI

SEQ ID NO: 443948 - protein, 9 aa, Homo Sapiens
NFFTDVYYL

SEQ ID NO: 443949 - protein, 9 aa, Homo Sapiens
ALSSLGFYV

SEQ ID NO: 443950 - protein, 9 aa, Homo Sapiens
FTRPCVDRL

SEQ ID NO: 443951 - protein, 9 aa, Homo Sapiens
AATEPESYL

SEQ ID NO: 443952 - protein, 9 aa, Homo Sapiens
EIYNHLLSV

SEQ ID NO: 443953 - protein, 9 aa, Homo Sapiens
EECVQKFIK

SEQ ID NO: 443954 - protein, 9 aa, Homo Sapiens
EWSCFFLWP

SEQ ID NO: 443955 - protein, 9 aa, Homo Sapiens
LARIIGLEK

SEQ ID NO: 443956 - protein, 9 aa, Homo Sapiens
RQLDKVRRK

SEQ ID NO: 443957 - protein, 9 aa, Homo Sapiens
RTVSQLYRR

SEQ ID NO: 443958 - protein, 9 aa, Homo Sapiens
IVGSEHYNV

SEQ ID NO: 443959 - protein, 9 aa, Homo Sapiens
AYNQRKANL

SEQ ID NO: 443960 - protein, 9 aa, Homo Sapiens
CYQLRMSKA

SEQ ID NO: 443961 - protein, 9 aa, Homo Sapiens
LLGSEAYYS

SEQ ID NO: 443962 - protein, 9 aa, Homo Sapiens
HEYSRRHLQ

SEQ ID NO: 443963 - protein, 9 aa, Homo Sapiens
ANIQFNTDL

SEQ ID NO: 443964 - protein, 9 aa, Homo Sapiens
ILFNVLLPP

SEQ ID NO: 443965 - protein, 9 aa, Homo Sapiens
ETWGDPGVI

SEQ ID NO: 443966 - protein, 9 aa, Homo Sapiens
PHKRLCQPP

SEQ ID NO: 443967 - protein, 9 aa, Homo Sapiens
LHRLCIVHV

SEQ ID NO: 443968 - protein, 9 aa, Homo Sapiens
GNLIVHQQI

SEQ ID NO: 443969 - protein, 9 aa, Homo Sapiens
IIDAPGHRN

SEQ ID NO: 443970 - protein, 9 aa, Homo Sapiens
SEIQPHMLV

SEQ ID NO: 443971 - protein, 9 aa, Homo Sapiens
GFIQIISKG

SEQ ID NO: 443972 - protein, 9 aa, Homo Sapiens
VMSDIRNPE

SEQ ID NO: 443973 - protein, 9 aa, Homo Sapiens
RNNRKLGPG

SEQ ID NO: 443974 - protein, 9 aa, Homo Sapiens
LPVSDKNLS

SEQ ID NO: 443975 - protein, 9 aa, Homo Sapiens
LDDTKDNLD

SEQ ID NO: 443976 - protein, 9 aa, Homo Sapiens
PQATVQARY

SEQ ID NO: 443977 - protein, 9 aa, Homo Sapiens
DLIWATSGA

SEQ ID NO: 443978 - protein, 9 aa, Homo Sapiens
QKDIALLKL

SEQ ID NO: 443979 - protein, 9 aa, Homo Sapiens
GFVVTLSNI

SEQ ID NO: 443980 - protein, 9 aa, Homo Sapiens
LPTVLDIFW

SEQ ID NO: 443981 - protein, 9 aa, Homo Sapiens
HIVIWEIKI

SEQ ID NO: 443982 - protein, 9 aa, Homo Sapiens
TFWKLAKIK

SEQ ID NO: 443983 - protein, 9 aa, Homo Sapiens
QMGWSIDVG

SEQ ID NO: 443984 - protein, 9 aa, Homo Sapiens
LAIFPISPV

SEQ ID NO: 443985 - protein, 9 aa, Homo Sapiens
HLTRHQIIH

SEQ ID NO: 443986 - protein, 9 aa, Homo Sapiens
FPTHPELQI

SEQ ID NO: 443987 - protein, 9 aa, Homo Sapiens
FTRHQIIHT

SEQ ID NO: 443988 - protein, 9 aa, Homo Sapiens
KDSVVQFLF

SEQ ID NO: 443989 - protein, 9 aa, Homo Sapiens
NNRLDYHIS

SEQ ID NO: 443990 - protein, 9 aa, Homo Sapiens
AALAEALCL

SEQ ID NO: 443991 - protein, 9 aa, Homo Sapiens
VHFSPNMLG

SEQ ID NO: 443992 - protein, 9 aa, Homo Sapiens
PEQHQKNQD

SEQ ID NO: 443993 - protein, 9 aa, Homo Sapiens
PLWAGCLSD

SEQ ID NO: 443994 - protein, 9 aa, Homo Sapiens
SAMQQGPKK

SEQ ID NO: 443995 - protein, 9 aa, Homo Sapiens
LLAQFHYPC

SEQ ID NO: 443996 - protein, 9 aa, Homo Sapiens
YFVLVAETT

SEQ ID NO: 443997 - protein, 9 aa, Homo Sapiens
DGSFDIGNL

SEQ ID NO: 443998 - protein, 9 aa, Homo Sapiens
KLPNGLKAE

SEQ ID NO: 443999 - protein, 9 aa, Homo Sapiens
RTLLLLVKA

SEQ ID NO: 444000 - protein, 9 aa, Homo Sapiens
NPHTANLNI

SEQ ID NO: 444001 - protein, 9 aa, Homo Sapiens
ARVTRHPFT

SEQ ID NO: 444002 - protein, 9 aa, Homo Sapiens
KNLKRPITH

SEQ ID NO: 444003 - protein, 9 aa, Homo Sapiens
GIGREGAND

SEQ ID NO: 444004 - protein, 9 aa, Homo Sapiens
YKYKRIDGG

SEQ ID NO: 444005 - protein, 9 aa, Homo Sapiens
SSPRVRELS

SEQ ID NO: 444006 - protein, 9 aa, Homo Sapiens
NNVPVKQFQ

SEQ ID NO: 444007 - protein, 9 aa, Homo Sapiens
STTYVHVQQ

SEQ ID NO: 444008 - protein, 9 aa, Homo Sapiens
KPSTVQVCN

SEQ ID NO: 444009 - protein, 9 aa, Homo Sapiens
QILQKLEPI

SEQ ID NO: 444010 - protein, 9 aa, Homo Sapiens
KVLDFLGRG

SEQ ID NO: 444011 - protein, 9 aa, Homo Sapiens
GLAHMELFL

SEQ ID NO: 444012 - protein, 9 aa, Homo Sapiens
LARYAARRS

SEQ ID NO: 444013 - protein, 9 aa, Homo Sapiens
EASLQERER

SEQ ID NO: 444014 - protein, 9 aa, Homo Sapiens
DKPYACKEC

SEQ ID NO: 444015 - protein, 9 aa, Homo Sapiens
PAAESPGWP

SEQ ID NO: 444016 - protein, 9 aa, Homo Sapiens
QTAAEGDTW

SEQ ID NO: 444017 - protein, 9 aa, Homo Sapiens
AHPNQLVLI

SEQ ID NO: 444018 - protein, 9 aa, Homo Sapiens
PKALFVMTL

SEQ ID NO: 444019 - protein, 9 aa, Homo Sapiens
PPLPEQSPC

SEQ ID NO: 444020 - protein, 9 aa, Homo Sapiens
FALWSLEYV

SEQ ID NO: 444021 - protein, 9 aa, Homo Sapiens
QHGIQSVQG

SEQ ID NO: 444022 - protein, 9 aa, Homo Sapiens
SMLKYFLSQ

SEQ ID NO: 444023 - protein, 9 aa, Homo Sapiens
KNTNQIVVI

SEQ ID NO: 444024 - protein, 9 aa, Homo Sapiens
IQHQIIHTE

SEQ ID NO: 444025 - protein, 9 aa, Homo Sapiens
NESNELHAK

SEQ ID NO: 444026 - protein, 9 aa, Homo Sapiens
RLALREQKY

SEQ ID NO: 444027 - protein, 9 aa, Homo Sapiens
YYFECSLSK

SEQ ID NO: 444028 - protein, 9 aa, Homo Sapiens
DLLGPTGIP

SEQ ID NO: 444029 - protein, 9 aa, Homo Sapiens
GPLQDRSLF

SEQ ID NO: 444030 - protein, 9 aa, Homo Sapiens
QTLFIGVHV

SEQ ID NO: 444031 - protein, 9 aa, Homo Sapiens
DLIEIYRFG

SEQ ID NO: 444032 - protein, 9 aa, Homo Sapiens
LTARYFTRK

SEQ ID NO: 444033 - protein, 9 aa, Homo Sapiens
ETAITSCAF

SEQ ID NO: 444034 - protein, 9 aa, Homo Sapiens
LPFHADNFL

SEQ ID NO: 444035 - protein, 9 aa, Homo Sapiens
QKQFFHSVL

SEQ ID NO: 444036 - protein, 9 aa, Homo Sapiens
LFKSEACYL

SEQ ID NO: 444037 - protein, 9 aa, Homo Sapiens
VDWKGDCNF

SEQ ID NO: 444038 - protein, 9 aa, Homo Sapiens
QLVPQKANI

SEQ ID NO: 444039 - protein, 9 aa, Homo Sapiens
HNYHKAGTV

SEQ ID NO: 444040 - protein, 9 aa, Homo Sapiens
WLGAIDDSA

SEQ ID NO: 444041 - protein, 9 aa, Homo Sapiens
FLFGFHRPN

SEQ ID NO: 444042 - protein, 9 aa, Homo Sapiens
GTVYVAEIG

SEQ ID NO: 444043 - protein, 9 aa, Homo Sapiens
LFAFSLIEG

SEQ ID NO: 444044 - protein, 9 aa, Homo Sapiens
GDISADFKE

SEQ ID NO: 444045 - protein, 9 aa, Homo Sapiens
KIMIIFSIA

SEQ ID NO: 444046 - protein, 9 aa, Homo Sapiens
VFDSLVNVV

SEQ ID NO: 444047 - protein, 9 aa, Homo Sapiens
ANLPFLETW

SEQ ID NO: 444048 - protein, 9 aa, Homo Sapiens
SSVKRKIVS

SEQ ID NO: 444049 - protein, 9 aa, Homo Sapiens
VIYVAFSPT

SEQ ID NO: 444050 - protein, 9 aa, Homo Sapiens
FDDIQIYFD

SEQ ID NO: 444051 - protein, 9 aa, Homo Sapiens
TWGDPGVIK

SEQ ID NO: 444052 - protein, 9 aa, Homo Sapiens
LRLRLRCCH

SEQ ID NO: 444053 - protein, 9 aa, Homo Sapiens
IPDHTIQAL

SEQ ID NO: 444054 - protein, 9 aa, Homo Sapiens
YNHTLSIMA

SEQ ID NO: 444055 - protein, 9 aa, Homo Sapiens
VTFKYMKEF

SEQ ID NO: 444056 - protein, 9 aa, Homo Sapiens
PHIPHPSMT

SEQ ID NO: 444057 - protein, 9 aa, Homo Sapiens
DIVDNYFMR

SEQ ID NO: 444058 - protein, 9 aa, Homo Sapiens
YEECKNLIK

SEQ ID NO: 444059 - protein, 9 aa, Homo Sapiens
AFSCSSSFQ

SEQ ID NO: 444060 - protein, 9 aa, Homo Sapiens
KEKEQIYYS

SEQ ID NO: 444061 - protein, 9 aa, Homo Sapiens
FYKLPIEIV

SEQ ID NO: 444062 - protein, 9 aa, Homo Sapiens
EFLVELHKF

SEQ ID NO: 444063 - protein, 9 aa, Homo Sapiens
PKVAFPRRT

SEQ ID NO: 444064 - protein, 9 aa, Homo Sapiens
HVEDRFVFR

SEQ ID NO: 444065 - protein, 9 aa, Homo Sapiens
VWDLDDILQ

SEQ ID NO: 444066 - protein, 9 aa, Homo Sapiens
AEHCRINTG

SEQ ID NO: 444067 - protein, 9 aa, Homo Sapiens
MTGPMVQGR

SEQ ID NO: 444068 - protein, 9 aa, Homo Sapiens
ESRQEKSNQ

SEQ ID NO: 444069 - protein, 9 aa, Homo Sapiens
SSGDELYVH

SEQ ID NO: 444070 - protein, 9 aa, Homo Sapiens
LTAREDVSI

SEQ ID NO: 444071 - protein, 9 aa, Homo Sapiens
DQIGVLGGV

SEQ ID NO: 444072 - protein, 9 aa, Homo Sapiens
PSKDGNHKN

SEQ ID NO: 444073 - protein, 9 aa, Homo Sapiens
SDEETLKAN

SEQ ID NO: 444074 - protein, 9 aa, Homo Sapiens
PGFKRLSCL

SEQ ID NO: 444075 - protein, 9 aa, Homo Sapiens
LCSHCRHRS

SEQ ID NO: 444076 - protein, 9 aa, Homo Sapiens
MHEEAYNKI

SEQ ID NO: 444077 - protein, 9 aa, Homo Sapiens
PSLIKDTWY

SEQ ID NO: 444078 - protein, 9 aa, Homo Sapiens
LILVVPLSL

SEQ ID NO: 444079 - protein, 9 aa, Homo Sapiens
NYADLVLNV

SEQ ID NO: 444080 - protein, 9 aa, Homo Sapiens
MGDSLNWAF

SEQ ID NO: 444081 - protein, 9 aa, Homo Sapiens
GGNTYSVSA

SEQ ID NO: 444082 - protein, 9 aa, Homo Sapiens
IACQKTAHY

SEQ ID NO: 444083 - protein, 9 aa, Homo Sapiens
KKEYQKNDK

SEQ ID NO: 444084 - protein, 9 aa, Homo Sapiens
MDFDWRIGD

SEQ ID NO: 444085 - protein, 9 aa, Homo Sapiens
SDWPFVEAR

SEQ ID NO: 444086 - protein, 9 aa, Homo Sapiens
RLPKVEIQR

SEQ ID NO: 444087 - protein, 9 aa, Homo Sapiens
RLEKEDKLS

SEQ ID NO: 444088 - protein, 9 aa, Homo Sapiens
VLQEEEGRY

SEQ ID NO: 444089 - protein, 9 aa, Homo Sapiens
SLDTGTCHI

SEQ ID NO: 444090 - protein, 9 aa, Homo Sapiens
CFNCGTWMD

SEQ ID NO: 444091 - protein, 9 aa, Homo Sapiens
ARAKKRKDN

SEQ ID NO: 444092 - protein, 9 aa, Homo Sapiens
FYFHIGWVT

SEQ ID NO: 444093 - protein, 9 aa, Homo Sapiens
IDVGDGARA

SEQ ID NO: 444094 - protein, 9 aa, Homo Sapiens
ASGASKPSE

SEQ ID NO: 444095 - protein, 9 aa, Homo Sapiens
CWMTQFSAE

SEQ ID NO: 444096 - protein, 9 aa, Homo Sapiens
ITGASASPK

SEQ ID NO: 444097 - protein, 9 aa, Homo Sapiens
MAVIYPLMQ

SEQ ID NO: 444098 - protein, 9 aa, Homo Sapiens
RELSALVAI

SEQ ID NO: 444099 - protein, 9 aa, Homo Sapiens
VSWNVIAWN

SEQ ID NO: 444100 - protein, 9 aa, Homo Sapiens
RIILLNYGK

SEQ ID NO: 444101 - protein, 9 aa, Homo Sapiens
LNTKIRDIQ

SEQ ID NO: 444102 - protein, 9 aa, Homo Sapiens
QARIEASLQ

SEQ ID NO: 444103 - protein, 9 aa, Homo Sapiens
FGRSCTPTY

SEQ ID NO: 444104 - protein, 9 aa, Homo Sapiens
WDLHYQTLV

SEQ ID NO: 444105 - protein, 9 aa, Homo Sapiens
LGYSSKKER

SEQ ID NO: 444106 - protein, 9 aa, Homo Sapiens
TEQIAETGN

SEQ ID NO: 444107 - protein, 9 aa, Homo Sapiens
DTNTGSCCD

SEQ ID NO: 444108 - protein, 9 aa, Homo Sapiens
FFQSYAQVM

SEQ ID NO: 444109 - protein, 9 aa, Homo Sapiens
GIHIANHLI

SEQ ID NO: 444110 - protein, 9 aa, Homo Sapiens
LDTMCADDL

SEQ ID NO: 444111 - protein, 9 aa, Homo Sapiens
PPQAEHVLL

SEQ ID NO: 444112 - protein, 9 aa, Homo Sapiens
QLVNTHNLL

SEQ ID NO: 444113 - protein, 9 aa, Homo Sapiens
IRRFKASKS

SEQ ID NO: 444114 - protein, 9 aa, Homo Sapiens
LQPHKMKSL

SEQ ID NO: 444115 - protein, 9 aa, Homo Sapiens
PCFLTTQNI

SEQ ID NO: 444116 - protein, 9 aa, Homo Sapiens
EHLEDGLHY

SEQ ID NO: 444117 - protein, 9 aa, Homo Sapiens
LVQVFFVFV

SEQ ID NO: 444118 - protein, 9 aa, Homo Sapiens
TLEDINYNG

SEQ ID NO: 444119 - protein, 9 aa, Homo Sapiens
LHQDNSEMC

SEQ ID NO: 444120 - protein, 9 aa, Homo Sapiens
QQKENESSS

SEQ ID NO: 444121 - protein, 9 aa, Homo Sapiens
IEAKQKGYV

SEQ ID NO: 444122 - protein, 9 aa, Homo Sapiens
KFTQEVFKG

SEQ ID NO: 444123 - protein, 9 aa, Homo Sapiens
MTSNKIRMQ

SEQ ID NO: 444124 - protein, 9 aa, Homo Sapiens
EERRNMQTI

SEQ ID NO: 444125 - protein, 9 aa, Homo Sapiens
KHNNTSHLP

SEQ ID NO: 444126 - protein, 9 aa, Homo Sapiens
VGSSMYTAT

SEQ ID NO: 444127 - protein, 9 aa, Homo Sapiens
FSNLGCLPL

SEQ ID NO: 444128 - protein, 9 aa, Homo Sapiens
AECNGQITG

SEQ ID NO: 444129 - protein, 9 aa, Homo Sapiens
LLNILESAE

SEQ ID NO: 444130 - protein, 9 aa, Homo Sapiens
EKLEWNREY

SEQ ID NO: 444131 - protein, 9 aa, Homo Sapiens
ILLMDIVAT

SEQ ID NO: 444132 - protein, 9 aa, Homo Sapiens
TQKIFTEQV

SEQ ID NO: 444133 - protein, 9 aa, Homo Sapiens
LNEDTIQYV

SEQ ID NO: 444134 - protein, 9 aa, Homo Sapiens
KTDSGSSAK

SEQ ID NO: 444135 - protein, 9 aa, Homo Sapiens
TRSLEIVLF

SEQ ID NO: 444136 - protein, 9 aa, Homo Sapiens
AQYILMKFM

SEQ ID NO: 444137 - protein, 9 aa, Homo Sapiens
LEPETISEY

SEQ ID NO: 444138 - protein, 9 aa, Homo Sapiens
GDPMCKIII

SEQ ID NO: 444139 - protein, 9 aa, Homo Sapiens
EYQSWKISH

SEQ ID NO: 444140 - protein, 9 aa, Homo Sapiens
TAFDHEKAQ

SEQ ID NO: 444141 - protein, 9 aa, Homo Sapiens
LQRDEISER

SEQ ID NO: 444142 - protein, 9 aa, Homo Sapiens
FVDVGNIYV

SEQ ID NO: 444143 - protein, 9 aa, Homo Sapiens
VMEPESCGD

SEQ ID NO: 444144 - protein, 9 aa, Homo Sapiens
KGVNSQNPR

SEQ ID NO: 444145 - protein, 9 aa, Homo Sapiens
TLHSRPRKL

SEQ ID NO: 444146 - protein, 9 aa, Homo Sapiens
DWKGDCNFA

SEQ ID NO: 444147 - protein, 9 aa, Homo Sapiens
GPHTCKDLL

SEQ ID NO: 444148 - protein, 9 aa, Homo Sapiens
PPRNTTMAV

SEQ ID NO: 444149 - protein, 9 aa, Homo Sapiens
YINSSSVDS

SEQ ID NO: 444150 - protein, 9 aa, Homo Sapiens
NTIFKQVWD

SEQ ID NO: 444151 - protein, 9 aa, Homo Sapiens
RYDTLFQAL

SEQ ID NO: 444152 - protein, 9 aa, Homo Sapiens
LALPFSIIA

SEQ ID NO: 444153 - protein, 9 aa, Homo Sapiens
AVDTMLTVR

SEQ ID NO: 444154 - protein, 9 aa, Homo Sapiens
KTEAQKRRK

SEQ ID NO: 444155 - protein, 9 aa, Homo Sapiens
HILMSNYGC

SEQ ID NO: 444156 - protein, 9 aa, Homo Sapiens
GFFLGASIL

SEQ ID NO: 444157 - protein, 9 aa, Homo Sapiens
SHSDSGLSD

SEQ ID NO: 444158 - protein, 9 aa, Homo Sapiens
LLSFICSSN

SEQ ID NO: 444159 - protein, 9 aa, Homo Sapiens
LFHQEKRMG

SEQ ID NO: 444160 - protein, 9 aa, Homo Sapiens
SQQRQNPSH

SEQ ID NO: 444161 - protein, 9 aa, Homo Sapiens
YYACILATV

SEQ ID NO: 444162 - protein, 9 aa, Homo Sapiens
YQSGKLRMQ

SEQ ID NO: 444163 - protein, 9 aa, Homo Sapiens
KRYWKTQAA

SEQ ID NO: 444164 - protein, 9 aa, Homo Sapiens
NESTSSENY

SEQ ID NO: 444165 - protein, 9 aa, Homo Sapiens
QTLPPSSNP

SEQ ID NO: 444166 - protein, 9 aa, Homo Sapiens
CGIPLCHLQ

SEQ ID NO: 444167 - protein, 9 aa, Homo Sapiens
IVEERVNCP

SEQ ID NO: 444168 - protein, 9 aa, Homo Sapiens
SEKLKTQHM

SEQ ID NO: 444169 - protein, 9 aa, Homo Sapiens
RHQRINSGE

SEQ ID NO: 444170 - protein, 9 aa, Homo Sapiens
ADNNTDVCL

SEQ ID NO: 444171 - protein, 9 aa, Homo Sapiens
EGVDESEKN

SEQ ID NO: 444172 - protein, 9 aa, Homo Sapiens
MQKEAIDKL

SEQ ID NO: 444173 - protein, 9 aa, Homo Sapiens
VGIPYSLQI

SEQ ID NO: 444174 - protein, 9 aa, Homo Sapiens
NRNSLCRQN

SEQ ID NO: 444175 - protein, 9 aa, Homo Sapiens
TFGQNCSHD

SEQ ID NO: 444176 - protein, 9 aa, Homo Sapiens
SWGIADETE

SEQ ID NO: 444177 - protein, 9 aa, Homo Sapiens
TMLDYLWAA

SEQ ID NO: 444178 - protein, 9 aa, Homo Sapiens
KNKGKFQVP

SEQ ID NO: 444179 - protein, 9 aa, Homo Sapiens
WHGNDFKDK

SEQ ID NO: 444180 - protein, 9 aa, Homo Sapiens
PKNVLWRKT

SEQ ID NO: 444181 - protein, 9 aa, Homo Sapiens
LNQLLDGPY

SEQ ID NO: 444182 - protein, 9 aa, Homo Sapiens
GPRPYGGRA

SEQ ID NO: 444183 - protein, 9 aa, Homo Sapiens
IISPSTMLP

SEQ ID NO: 444184 - protein, 9 aa, Homo Sapiens
PSVTKVTPD

SEQ ID NO: 444185 - protein, 9 aa, Homo Sapiens
SKNDSGVPC

SEQ ID NO: 444186 - protein, 9 aa, Homo Sapiens
NLVYPAMRE

SEQ ID NO: 444187 - protein, 9 aa, Homo Sapiens
GWKINPTKI

SEQ ID NO: 444188 - protein, 9 aa, Homo Sapiens
DYNLFNNYK

SEQ ID NO: 444189 - protein, 9 aa, Homo Sapiens
TREAALNAR

SEQ ID NO: 444190 - protein, 9 aa, Homo Sapiens
TCYARCQSK

SEQ ID NO: 444191 - protein, 9 aa, Homo Sapiens
IPTNLERLW

SEQ ID NO: 444192 - protein, 9 aa, Homo Sapiens
TGRAQSYTQ

SEQ ID NO: 444193 - protein, 9 aa, Homo Sapiens
RIAYYAMDF

SEQ ID NO: 444194 - protein, 9 aa, Homo Sapiens
LLRKDTSVK

SEQ ID NO: 444195 - protein, 9 aa, Homo Sapiens
EKTVFLVLM

SEQ ID NO: 444196 - protein, 9 aa, Homo Sapiens
LVKEANMKC

SEQ ID NO: 444197 - protein, 9 aa, Homo Sapiens
IILNNYEIR

SEQ ID NO: 444198 - protein, 9 aa, Homo Sapiens
GVFICKLFP

SEQ ID NO: 444199 - protein, 9 aa, Homo Sapiens
RHITILKLI

SEQ ID NO: 444200 - protein, 9 aa, Homo Sapiens
AGQVAALVH

SEQ ID NO: 444201 - protein, 9 aa, Homo Sapiens
HWADLGCSS

SEQ ID NO: 444202 - protein, 9 aa, Homo Sapiens
CLAKEKEEE

SEQ ID NO: 444203 - protein, 9 aa, Homo Sapiens
GFAYHKESD

SEQ ID NO: 444204 - protein, 9 aa, Homo Sapiens
AKEIAQTVQ

SEQ ID NO: 444205 - protein, 9 aa, Homo Sapiens
VRVQGITGQ

SEQ ID NO: 444206 - protein, 9 aa, Homo Sapiens
AFEIVVCHA

SEQ ID NO: 444207 - protein, 9 aa, Homo Sapiens
GACLGLQLV

SEQ ID NO: 444208 - protein, 9 aa, Homo Sapiens
LVNTYAIVE

SEQ ID NO: 444209 - protein, 9 aa, Homo Sapiens
AHTYSIVIG

SEQ ID NO: 444210 - protein, 9 aa, Homo Sapiens
KIFDSPCPK

SEQ ID NO: 444211 - protein, 9 aa, Homo Sapiens
GPHRDMVGE

SEQ ID NO: 444212 - protein, 9 aa, Homo Sapiens
HHILLLEIE

SEQ ID NO: 444213 - protein, 9 aa, Homo Sapiens
CIPCSWIGR

SEQ ID NO: 444214 - protein, 9 aa, Homo Sapiens
LLHPNCKLQ

SEQ ID NO: 444215 - protein, 9 aa, Homo Sapiens
LSKLAKAAK

SEQ ID NO: 444216 - protein, 9 aa, Homo Sapiens
KKMYGKQSM

SEQ ID NO: 444217 - protein, 9 aa, Homo Sapiens
QRTFISYYT

SEQ ID NO: 444218 - protein, 9 aa, Homo Sapiens
NIEVITHQI

SEQ ID NO: 444219 - protein, 9 aa, Homo Sapiens
QGTSFSHTC

SEQ ID NO: 444220 - protein, 9 aa, Homo Sapiens
SGTVCLKEK

SEQ ID NO: 444221 - protein, 9 aa, Homo Sapiens
RALNQERVI

SEQ ID NO: 444222 - protein, 9 aa, Homo Sapiens
GYDIAMQKD

SEQ ID NO: 444223 - protein, 9 aa, Homo Sapiens
MGRKQEDKQ

SEQ ID NO: 444224 - protein, 9 aa, Homo Sapiens
DEKIQIIAT

SEQ ID NO: 444225 - protein, 9 aa, Homo Sapiens
KVTFEYVAI

SEQ ID NO: 444226 - protein, 9 aa, Homo Sapiens
IQIFLLSLF

SEQ ID NO: 444227 - protein, 9 aa, Homo Sapiens
KRFEEVTRR

SEQ ID NO: 444228 - protein, 9 aa, Homo Sapiens
TTLKKLEKS

SEQ ID NO: 444229 - protein, 9 aa, Homo Sapiens
MFAVNMFQT

SEQ ID NO: 444230 - protein, 9 aa, Homo Sapiens
YVVQGMILM

SEQ ID NO: 444231 - protein, 9 aa, Homo Sapiens
TRVRSYTAF

SEQ ID NO: 444232 - protein, 9 aa, Homo Sapiens
FKDVAIELS

SEQ ID NO: 444233 - protein, 9 aa, Homo Sapiens
EIDLRHWIQ

SEQ ID NO: 444234 - protein, 9 aa, Homo Sapiens
FLDILRRTD

SEQ ID NO: 444235 - protein, 9 aa, Homo Sapiens
TVYLNMATG

SEQ ID NO: 444236 - protein, 9 aa, Homo Sapiens
SEKVSDDLI

SEQ ID NO: 444237 - protein, 9 aa, Homo Sapiens
LNHNNWIKQ

SEQ ID NO: 444238 - protein, 9 aa, Homo Sapiens
EFQQMLKQL

SEQ ID NO: 444239 - protein, 9 aa, Homo Sapiens
FPVPVTVRV

SEQ ID NO: 444240 - protein, 9 aa, Homo Sapiens
DFLKRINES

SEQ ID NO: 444241 - protein, 9 aa, Homo Sapiens
FNGWNPFLY

SEQ ID NO: 444242 - protein, 9 aa, Homo Sapiens
RKYMIVDEG

SEQ ID NO: 444243 - protein, 9 aa, Homo Sapiens
AREQVKTVR

SEQ ID NO: 444244 - protein, 9 aa, Homo Sapiens
IIHTDEKPY

SEQ ID NO: 444245 - protein, 9 aa, Homo Sapiens
GLSPKEHNK

SEQ ID NO: 444246 - protein, 9 aa, Homo Sapiens
IAQCCPKLR

SEQ ID NO: 444247 - protein, 9 aa, Homo Sapiens
APNEKFFFV

SEQ ID NO: 444248 - protein, 9 aa, Homo Sapiens
ATINARTEL

SEQ ID NO: 444249 - protein, 9 aa, Homo Sapiens
VDSGCRNTY

SEQ ID NO: 444250 - protein, 9 aa, Homo Sapiens
ASQLHNHVQ

SEQ ID NO: 444251 - protein, 9 aa, Homo Sapiens
RCIEQTHTK

SEQ ID NO: 444252 - protein, 9 aa, Homo Sapiens
GIIGPIIRA

SEQ ID NO: 444253 - protein, 9 aa, Homo Sapiens
NRSRHENAS

SEQ ID NO: 444254 - protein, 9 aa, Homo Sapiens
ESPSKGGNL

SEQ ID NO: 444255 - protein, 9 aa, Homo Sapiens
LHIDFCRYS

SEQ ID NO: 444256 - protein, 9 aa, Homo Sapiens
RILALQKNF

SEQ ID NO: 444257 - protein, 9 aa, Homo Sapiens
NKDETIQFQ

SEQ ID NO: 444258 - protein, 9 aa, Homo Sapiens
VPICINSCG

SEQ ID NO: 444259 - protein, 9 aa, Homo Sapiens
LFGVYVAIM

SEQ ID NO: 444260 - protein, 9 aa, Homo Sapiens
QGDFYITGG

SEQ ID NO: 444261 - protein, 9 aa, Homo Sapiens
PGRGMDVRR

SEQ ID NO: 444262 - protein, 9 aa, Homo Sapiens
RIQYFVRGH

SEQ ID NO: 444263 - protein, 9 aa, Homo Sapiens
SGKSFKKGD

SEQ ID NO: 444264 - protein, 9 aa, Homo Sapiens
TAAEGDTWC

SEQ ID NO: 444265 - protein, 9 aa, Homo Sapiens
GFYQEINEN

SEQ ID NO: 444266 - protein, 9 aa, Homo Sapiens
LQNNRTTEV

SEQ ID NO: 444267 - protein, 9 aa, Homo Sapiens
VSLKLEDDR

SEQ ID NO: 444268 - protein, 9 aa, Homo Sapiens
WLFIKLHQL

SEQ ID NO: 444269 - protein, 9 aa, Homo Sapiens
AVRVQGITG

SEQ ID NO: 444270 - protein, 9 aa, Homo Sapiens
KREQKLKFK

SEQ ID NO: 444271 - protein, 9 aa, Homo Sapiens
VTYLTGVSG

SEQ ID NO: 444272 - protein, 9 aa, Homo Sapiens
FDYSVSNCV

SEQ ID NO: 444273 - protein, 9 aa, Homo Sapiens
FIIFTAGLC

SEQ ID NO: 444274 - protein, 9 aa, Homo Sapiens
NNFLLYNQR

SEQ ID NO: 444275 - protein, 9 aa, Homo Sapiens
FWWCRLRAS

SEQ ID NO: 444276 - protein, 9 aa, Homo Sapiens
DLKDEAKQY

SEQ ID NO: 444277 - protein, 9 aa, Homo Sapiens
VTPDGDFHR

SEQ ID NO: 444278 - protein, 9 aa, Homo Sapiens
VVDMSTRRS

SEQ ID NO: 444279 - protein, 9 aa, Homo Sapiens
VNEAKITQQ

SEQ ID NO: 444280 - protein, 9 aa, Homo Sapiens
RIAIKQFAD

SEQ ID NO: 444281 - protein, 9 aa, Homo Sapiens
LFEDMLRQM

SEQ ID NO: 444282 - protein, 9 aa, Homo Sapiens
ETREGIISL

SEQ ID NO: 444283 - protein, 9 aa, Homo Sapiens
RYSFCCIFL

SEQ ID NO: 444284 - protein, 9 aa, Homo Sapiens
GSAHKYSSS

SEQ ID NO: 444285 - protein, 9 aa, Homo Sapiens
EDAVSVRSM

SEQ ID NO: 444286 - protein, 9 aa, Homo Sapiens
SQHHKQRRS

SEQ ID NO: 444287 - protein, 9 aa, Homo Sapiens
DDEKLQNEF

SEQ ID NO: 444288 - protein, 9 aa, Homo Sapiens
NKVSSGSAD

SEQ ID NO: 444289 - protein, 9 aa, Homo Sapiens
LAPHSAEPG

SEQ ID NO: 444290 - protein, 9 aa, Homo Sapiens
PGERFPLSV

SEQ ID NO: 444291 - protein, 9 aa, Homo Sapiens
EFVTQVNVG

SEQ ID NO: 444292 - protein, 9 aa, Homo Sapiens
NNTIKEHFP

SEQ ID NO: 444293 - protein, 9 aa, Homo Sapiens
HVAFVGAPI

SEQ ID NO: 444294 - protein, 9 aa, Homo Sapiens
EKLSGASLA

SEQ ID NO: 444295 - protein, 9 aa, Homo Sapiens
DFSGLASAA

SEQ ID NO: 444296 - protein, 9 aa, Homo Sapiens
LIEDTPIDT

SEQ ID NO: 444297 - protein, 9 aa, Homo Sapiens
INARRRILL

SEQ ID NO: 444298 - protein, 9 aa, Homo Sapiens
ITATLAAER

SEQ ID NO: 444299 - protein, 9 aa, Homo Sapiens
VKEANMKCP

SEQ ID NO: 444300 - protein, 9 aa, Homo Sapiens
FLVIGTPNE

SEQ ID NO: 444301 - protein, 9 aa, Homo Sapiens
QASTVFITS

SEQ ID NO: 444302 - protein, 9 aa, Homo Sapiens
REFQLFDHH

SEQ ID NO: 444303 - protein, 9 aa, Homo Sapiens
YLKKVCGKV

SEQ ID NO: 444304 - protein, 9 aa, Homo Sapiens
TDELTSLNN

SEQ ID NO: 444305 - protein, 9 aa, Homo Sapiens
RQEKWSSGF

SEQ ID NO: 444306 - protein, 9 aa, Homo Sapiens
SALAQHQII

SEQ ID NO: 444307 - protein, 9 aa, Homo Sapiens
GPVSSSRCG

SEQ ID NO: 444308 - protein, 9 aa, Homo Sapiens
QIPLKCPNC

SEQ ID NO: 444309 - protein, 9 aa, Homo Sapiens
KVSSPFIVY

SEQ ID NO: 444310 - protein, 9 aa, Homo Sapiens
DKVDPVAAS

SEQ ID NO: 444311 - protein, 9 aa, Homo Sapiens
IDSHIYGKL

SEQ ID NO: 444312 - protein, 9 aa, Homo Sapiens
LDRLFKIIG

SEQ ID NO: 444313 - protein, 9 aa, Homo Sapiens
LNRKRTIYH

SEQ ID NO: 444314 - protein, 9 aa, Homo Sapiens
ELDVYEAEG

SEQ ID NO: 444315 - protein, 9 aa, Homo Sapiens
FRAALSNTV

SEQ ID NO: 444316 - protein, 9 aa, Homo Sapiens
IWLKGVIFN

SEQ ID NO: 444317 - protein, 9 aa, Homo Sapiens
LAQNNQNRD

SEQ ID NO: 444318 - protein, 9 aa, Homo Sapiens
AMSTLGFDR

SEQ ID NO: 444319 - protein, 9 aa, Homo Sapiens
SASPGIDTP

SEQ ID NO: 444320 - protein, 9 aa, Homo Sapiens
WITHRSHHF

SEQ ID NO: 444321 - protein, 9 aa, Homo Sapiens
FTLLQLFFY

SEQ ID NO: 444322 - protein, 9 aa, Homo Sapiens
LLDHPDRAL

SEQ ID NO: 444323 - protein, 9 aa, Homo Sapiens
IQLVYVEGG

SEQ ID NO: 444324 - protein, 9 aa, Homo Sapiens
LYVIEDPSM

SEQ ID NO: 444325 - protein, 9 aa, Homo Sapiens
GCIWSLQLN

SEQ ID NO: 444326 - protein, 9 aa, Homo Sapiens
MRQGCHLCF

SEQ ID NO: 444327 - protein, 9 aa, Homo Sapiens
LFTCPTPGC

SEQ ID NO: 444328 - protein, 9 aa, Homo Sapiens
YFVRGHFYG

SEQ ID NO: 444329 - protein, 9 aa, Homo Sapiens
NVVLLDDPF

SEQ ID NO: 444330 - protein, 9 aa, Homo Sapiens
YRCNRYFIS

SEQ ID NO: 444331 - protein, 9 aa, Homo Sapiens
CIDEVDSLL

SEQ ID NO: 444332 - protein, 9 aa, Homo Sapiens
RDEISERAF

SEQ ID NO: 444333 - protein, 9 aa, Homo Sapiens
INKFPQAEN

SEQ ID NO: 444334 - protein, 9 aa, Homo Sapiens
TWYQVYRRH

SEQ ID NO: 444335 - protein, 9 aa, Homo Sapiens
SCKVSACPP

SEQ ID NO: 444336 - protein, 9 aa, Homo Sapiens
RKKDRNNRK

SEQ ID NO: 444337 - protein, 9 aa, Homo Sapiens
MTDRNPFET

SEQ ID NO: 444338 - protein, 9 aa, Homo Sapiens
VLMFAVSGI

SEQ ID NO: 444339 - protein, 9 aa, Homo Sapiens
QTGLDRNTL

SEQ ID NO: 444340 - protein, 9 aa, Homo Sapiens
SLYFGLRFM

SEQ ID NO: 444341 - protein, 9 aa, Homo Sapiens
NNLFIDYVG

SEQ ID NO: 444342 - protein, 9 aa, Homo Sapiens
SCLDLNKTK

SEQ ID NO: 444343 - protein, 9 aa, Homo Sapiens
AYFYHNERG

SEQ ID NO: 444344 - protein, 9 aa, Homo Sapiens
CIVQEDMST

SEQ ID NO: 444345 - protein, 9 aa, Homo Sapiens
KALPTCGSH

SEQ ID NO: 444346 - protein, 9 aa, Homo Sapiens
KNFHSPMVF

SEQ ID NO: 444347 - protein, 9 aa, Homo Sapiens
IASKVTHTV

SEQ ID NO: 444348 - protein, 9 aa, Homo Sapiens
LTQSTEKLE

SEQ ID NO: 444349 - protein, 9 aa, Homo Sapiens
DPGQCAGLL

SEQ ID NO: 444350 - protein, 9 aa, Homo Sapiens
SRNFPREVC

SEQ ID NO: 444351 - protein, 9 aa, Homo Sapiens
IIINYSIEQ

SEQ ID NO: 444352 - protein, 9 aa, Homo Sapiens
IILENYHDH

SEQ ID NO: 444353 - protein, 9 aa, Homo Sapiens
IIYFDSHLN

SEQ ID NO: 444354 - protein, 9 aa, Homo Sapiens
SPSPDSKSK

SEQ ID NO: 444355 - protein, 9 aa, Homo Sapiens
HKVAFLRLN

SEQ ID NO: 444356 - protein, 9 aa, Homo Sapiens
YLLGSEAYY

SEQ ID NO: 444357 - protein, 9 aa, Homo Sapiens
PATIQVRTP

SEQ ID NO: 444358 - protein, 9 aa, Homo Sapiens
NIINEIGVF

SEQ ID NO: 444359 - protein, 9 aa, Homo Sapiens
EYKKIILLK

SEQ ID NO: 444360 - protein, 9 aa, Homo Sapiens
KLGAAEDLP

SEQ ID NO: 444361 - protein, 9 aa, Homo Sapiens
TPLCIALML

SEQ ID NO: 444362 - protein, 9 aa, Homo Sapiens
CSDCRKTFC

SEQ ID NO: 444363 - protein, 9 aa, Homo Sapiens
LRIQDYGTL

SEQ ID NO: 444364 - protein, 9 aa, Homo Sapiens
DLKNLDYRI

SEQ ID NO: 444365 - protein, 9 aa, Homo Sapiens
VKMEVDEDK

SEQ ID NO: 444366 - protein, 9 aa, Homo Sapiens
NMKLGRPQI

SEQ ID NO: 444367 - protein, 9 aa, Homo Sapiens
RELFEDMLR

SEQ ID NO: 444368 - protein, 9 aa, Homo Sapiens
QAINAALAQ

SEQ ID NO: 444369 - protein, 9 aa, Homo Sapiens
SMKGLGTNE

SEQ ID NO: 444370 - protein, 9 aa, Homo Sapiens
IDERLDKRV

SEQ ID NO: 444371 - protein, 9 aa, Homo Sapiens
NMITDYLTG

SEQ ID NO: 444372 - protein, 9 aa, Homo Sapiens
SMAVIYPLM

SEQ ID NO: 444373 - protein, 9 aa, Homo Sapiens
AELDEKIQI

SEQ ID NO: 444374 - protein, 9 aa, Homo Sapiens
VTQNKVRKT

SEQ ID NO: 444375 - protein, 9 aa, Homo Sapiens
EDVWRMIWE

SEQ ID NO: 444376 - protein, 9 aa, Homo Sapiens
QIYFDTRII

SEQ ID NO: 444377 - protein, 9 aa, Homo Sapiens
LESRLQVSL

SEQ ID NO: 444378 - protein, 9 aa, Homo Sapiens
EEAAEEDRD

SEQ ID NO: 444379 - protein, 9 aa, Homo Sapiens
ARGWKINPT

SEQ ID NO: 444380 - protein, 9 aa, Homo Sapiens
KKGILYEDN

SEQ ID NO: 444381 - protein, 9 aa, Homo Sapiens
MYHSQMRQK

SEQ ID NO: 444382 - protein, 9 aa, Homo Sapiens
MSERSDFLH

SEQ ID NO: 444383 - protein, 9 aa, Homo Sapiens
TSDVETIFS

SEQ ID NO: 444384 - protein, 9 aa, Homo Sapiens
FNTVIARIE

SEQ ID NO: 444385 - protein, 9 aa, Homo Sapiens
DFLRNWGID

SEQ ID NO: 444386 - protein, 9 aa, Homo Sapiens
YRNKMTPLC

SEQ ID NO: 444387 - protein, 9 aa, Homo Sapiens
TIKELQDLA

SEQ ID NO: 444388 - protein, 9 aa, Homo Sapiens
VVCHAKNYT

SEQ ID NO: 444389 - protein, 9 aa, Homo Sapiens
IEQTSLKMV

SEQ ID NO: 444390 - protein, 9 aa, Homo Sapiens
DNGKPPRSA

SEQ ID NO: 444391 - protein, 9 aa, Homo Sapiens
TEEMEVVVS

SEQ ID NO: 444392 - protein, 9 aa, Homo Sapiens
NSLDNFISG

SEQ ID NO: 444393 - protein, 9 aa, Homo Sapiens
VALYKCVPQ

SEQ ID NO: 444394 - protein, 9 aa, Homo Sapiens
LEGESNSSD

SEQ ID NO: 444395 - protein, 9 aa, Homo Sapiens
EINGIYDES

SEQ ID NO: 444396 - protein, 9 aa, Homo Sapiens
SISKAHLYE

SEQ ID NO: 444397 - protein, 9 aa, Homo Sapiens
YEAGIVSLF

SEQ ID NO: 444398 - protein, 9 aa, Homo Sapiens
QVFSTGLLV

SEQ ID NO: 444399 - protein, 9 aa, Homo Sapiens
LQKSDKLDE

SEQ ID NO: 444400 - protein, 9 aa, Homo Sapiens
KVSQKQTVL

SEQ ID NO: 444401 - protein, 9 aa, Homo Sapiens
INFNIIKIL

SEQ ID NO: 444402 - protein, 9 aa, Homo Sapiens
LHVQIHFGR

SEQ ID NO: 444403 - protein, 9 aa, Homo Sapiens
NKLRWGDII

SEQ ID NO: 444404 - protein, 9 aa, Homo Sapiens
LHSDQYKGD

SEQ ID NO: 444405 - protein, 9 aa, Homo Sapiens
SGGPEAADL

SEQ ID NO: 444406 - protein, 9 aa, Homo Sapiens
PATIGTQSL

SEQ ID NO: 444407 - protein, 9 aa, Homo Sapiens
PTPRIKIID

SEQ ID NO: 444408 - protein, 9 aa, Homo Sapiens
NVPTPRIKI

SEQ ID NO: 444409 - protein, 9 aa, Homo Sapiens
RLDPAQIKL

SEQ ID NO: 444410 - protein, 9 aa, Homo Sapiens
GQPKCGTTY

SEQ ID NO: 444411 - protein, 9 aa, Homo Sapiens
MADDNVKYY

SEQ ID NO: 444412 - protein, 9 aa, Homo Sapiens
VNELCVETL

SEQ ID NO: 444413 - protein, 9 aa, Homo Sapiens
LLNNLQLRY

SEQ ID NO: 444414 - protein, 9 aa, Homo Sapiens
ANMVMSFVN

SEQ ID NO: 444415 - protein, 9 aa, Homo Sapiens
RLPANKSRQ

SEQ ID NO: 444416 - protein, 9 aa, Homo Sapiens
SSCREHEKT

SEQ ID NO: 444417 - protein, 9 aa, Homo Sapiens
CNRRQEMRQ

SEQ ID NO: 444418 - protein, 9 aa, Homo Sapiens
VSDKNLSLT

SEQ ID NO: 444419 - protein, 9 aa, Homo Sapiens
VMRRWLPAE

SEQ ID NO: 444420 - protein, 9 aa, Homo Sapiens
SPKWLHKFN

SEQ ID NO: 444421 - protein, 9 aa, Homo Sapiens
MREDRYVND

SEQ ID NO: 444422 - protein, 9 aa, Homo Sapiens
EVNCLGIYE

SEQ ID NO: 444423 - protein, 9 aa, Homo Sapiens
EYQSRYQSD

SEQ ID NO: 444424 - protein, 9 aa, Homo Sapiens
TEHKIIHSG

SEQ ID NO: 444425 - protein, 9 aa, Homo Sapiens
RDNWTPQRV

SEQ ID NO: 444426 - protein, 9 aa, Homo Sapiens
VLSTNRNLS

SEQ ID NO: 444427 - protein, 9 aa, Homo Sapiens
PFLYPYKKL

SEQ ID NO: 444428 - protein, 9 aa, Homo Sapiens
YGTALNLLK

SEQ ID NO: 444429 - protein, 9 aa, Homo Sapiens
DECNRISVE

SEQ ID NO: 444430 - protein, 9 aa, Homo Sapiens
DAERTKLLW

SEQ ID NO: 444431 - protein, 9 aa, Homo Sapiens
TQLIPALVK

SEQ ID NO: 444432 - protein, 9 aa, Homo Sapiens
HNKCLEKKV

SEQ ID NO: 444433 - protein, 9 aa, Homo Sapiens
DFNGWNPFL

SEQ ID NO: 444434 - protein, 9 aa, Homo Sapiens
DFEKELETN

SEQ ID NO: 444435 - protein, 9 aa, Homo Sapiens
SLCIHQIVH

SEQ ID NO: 444436 - protein, 9 aa, Homo Sapiens
QHMEGDKSQ

SEQ ID NO: 444437 - protein, 9 aa, Homo Sapiens
VTSAQNNPT

SEQ ID NO: 444438 - protein, 9 aa, Homo Sapiens
MIALGNTDN

SEQ ID NO: 444439 - protein, 9 aa, Homo Sapiens
EDRIWELEE

SEQ ID NO: 444440 - protein, 9 aa, Homo Sapiens
KIMFGFRVW

SEQ ID NO: 444441 - protein, 9 aa, Homo Sapiens
ASHKIEIGT

SEQ ID NO: 444442 - protein, 9 aa, Homo Sapiens
QLIYPVTNL

SEQ ID NO: 444443 - protein, 9 aa, Homo Sapiens
MMDRMVALE

SEQ ID NO: 444444 - protein, 9 aa, Homo Sapiens
LIQGAPCAP

SEQ ID NO: 444445 - protein, 9 aa, Homo Sapiens
LPDEIQKML

SEQ ID NO: 444446 - protein, 9 aa, Homo Sapiens
INTTHLDKS

SEQ ID NO: 444447 - protein, 9 aa, Homo Sapiens
QEFYTEDLL

SEQ ID NO: 444448 - protein, 9 aa, Homo Sapiens
IKEFLGRRS

SEQ ID NO: 444449 - protein, 9 aa, Homo Sapiens
EKPRQYNEQ

SEQ ID NO: 444450 - protein, 9 aa, Homo Sapiens
DGFLLAVSF

SEQ ID NO: 444451 - protein, 9 aa, Homo Sapiens
LINEQGGVR

SEQ ID NO: 444452 - protein, 9 aa, Homo Sapiens
YRNYDVMKY

SEQ ID NO: 444453 - protein, 9 aa, Homo Sapiens
SKAHLYEIM

SEQ ID NO: 444454 - protein, 9 aa, Homo Sapiens
ASSRDPENF

SEQ ID NO: 444455 - protein, 9 aa, Homo Sapiens
KWSAPYDVR

SEQ ID NO: 444456 - protein, 9 aa, Homo Sapiens
RLDKLGLRH

SEQ ID NO: 444457 - protein, 9 aa, Homo Sapiens
ANKCAYTFL

SEQ ID NO: 444458 - protein, 9 aa, Homo Sapiens
RKMSADFHV

SEQ ID NO: 444459 - protein, 9 aa, Homo Sapiens
IYRFGYAHW

SEQ ID NO: 444460 - protein, 9 aa, Homo Sapiens
CKGFFKQTV

SEQ ID NO: 444461 - protein, 9 aa, Homo Sapiens
KHGLSYKVK

SEQ ID NO: 444462 - protein, 9 aa, Homo Sapiens
GQKEMLEVS

SEQ ID NO: 444463 - protein, 9 aa, Homo Sapiens
LGDAKWQLE

SEQ ID NO: 444464 - protein, 9 aa, Homo Sapiens
LETDSTSAT

SEQ ID NO: 444465 - protein, 9 aa, Homo Sapiens
DSGSSAKSG

SEQ ID NO: 444466 - protein, 9 aa, Homo Sapiens
RKQNEDDEV

SEQ ID NO: 444467 - protein, 9 aa, Homo Sapiens
DLITIVAGL

SEQ ID NO: 444468 - protein, 9 aa, Homo Sapiens
IVRDPFKRL

SEQ ID NO: 444469 - protein, 9 aa, Homo Sapiens
EVTAYLLEN

SEQ ID NO: 444470 - protein, 9 aa, Homo Sapiens
CQEVITNLN

SEQ ID NO: 444471 - protein, 9 aa, Homo Sapiens
QTVLSRTPI

SEQ ID NO: 444472 - protein, 9 aa, Homo Sapiens
KFDEIFSTT

SEQ ID NO: 444473 - protein, 9 aa, Homo Sapiens
GKKEEASQN

SEQ ID NO: 444474 - protein, 9 aa, Homo Sapiens
NITVKMYYP

SEQ ID NO: 444475 - protein, 9 aa, Homo Sapiens
RCYPISGHK

SEQ ID NO: 444476 - protein, 9 aa, Homo Sapiens
EDDDAIHIT

SEQ ID NO: 444477 - protein, 9 aa, Homo Sapiens
KPVKKHKTG

SEQ ID NO: 444478 - protein, 9 aa, Homo Sapiens
QGSCPSLLL

SEQ ID NO: 444479 - protein, 9 aa, Homo Sapiens
VNNLSICLT

SEQ ID NO: 444480 - protein, 9 aa, Homo Sapiens
LHLVFTDSL

SEQ ID NO: 444481 - protein, 9 aa, Homo Sapiens
FEIVGIPYS

SEQ ID NO: 444482 - protein, 9 aa, Homo Sapiens
NYDVMKYFE

SEQ ID NO: 444483 - protein, 9 aa, Homo Sapiens
VGKRKQNED

SEQ ID NO: 444484 - protein, 9 aa, Homo Sapiens
HSKRRWAPI

SEQ ID NO: 444485 - protein, 9 aa, Homo Sapiens
SDTIFAEKT

SEQ ID NO: 444486 - protein, 9 aa, Homo Sapiens
INIVTANFV

SEQ ID NO: 444487 - protein, 9 aa, Homo Sapiens
PPTQHSITD

SEQ ID NO: 444488 - protein, 9 aa, Homo Sapiens
CLPLLSGLG

SEQ ID NO: 444489 - protein, 9 aa, Homo Sapiens
LYSLRMSER

SEQ ID NO: 444490 - protein, 9 aa, Homo Sapiens
ELAVFMKEE

SEQ ID NO: 444491 - protein, 9 aa, Homo Sapiens
DKKTKRKLQ

SEQ ID NO: 444492 - protein, 9 aa, Homo Sapiens
TKITLESFF

SEQ ID NO: 444493 - protein, 9 aa, Homo Sapiens
VKVLLYSLG

SEQ ID NO: 444494 - protein, 9 aa, Homo Sapiens
NEEFLRYLW

SEQ ID NO: 444495 - protein, 9 aa, Homo Sapiens
LRWWQLQYS

SEQ ID NO: 444496 - protein, 9 aa, Homo Sapiens
VKTKNNKQK

SEQ ID NO: 444497 - protein, 9 aa, Homo Sapiens
RAESYSSIS

SEQ ID NO: 444498 - protein, 9 aa, Homo Sapiens
PHKIIKEVL

SEQ ID NO: 444499 - protein, 9 aa, Homo Sapiens
YDKMTSGMY

SEQ ID NO: 444500 - protein, 9 aa, Homo Sapiens
FIESCQEDD

SEQ ID NO: 444501 - protein, 9 aa, Homo Sapiens
PPEFTAMTL

SEQ ID NO: 444502 - protein, 9 aa, Homo Sapiens
VTNLQKHMI

SEQ ID NO: 444503 - protein, 9 aa, Homo Sapiens
TDKYANVRL

SEQ ID NO: 444504 - protein, 9 aa, Homo Sapiens
SSSEIIEKN

SEQ ID NO: 444505 - protein, 9 aa, Homo Sapiens
KHTSDNLSE

SEQ ID NO: 444506 - protein, 9 aa, Homo Sapiens
EPAVPGPVI

SEQ ID NO: 444507 - protein, 9 aa, Homo Sapiens
TSLKMVQAV

SEQ ID NO: 444508 - protein, 9 aa, Homo Sapiens
TERNICNNY

SEQ ID NO: 444509 - protein, 9 aa, Homo Sapiens
IDCAFLVGA

SEQ ID NO: 444510 - protein, 9 aa, Homo Sapiens
LTNQLGKGR

SEQ ID NO: 444511 - protein, 9 aa, Homo Sapiens
PALLVKRSY

SEQ ID NO: 444512 - protein, 9 aa, Homo Sapiens
WLISRQLYW

SEQ ID NO: 444513 - protein, 9 aa, Homo Sapiens
SDYVIHNSN

SEQ ID NO: 444514 - protein, 9 aa, Homo Sapiens
QDLGGDFWY

SEQ ID NO: 444515 - protein, 9 aa, Homo Sapiens
LGPECLCPF

SEQ ID NO: 444516 - protein, 9 aa, Homo Sapiens
GDGFSNCDV

SEQ ID NO: 444517 - protein, 9 aa, Homo Sapiens
VAYGEFRNN

SEQ ID NO: 444518 - protein, 9 aa, Homo Sapiens
RDPGDCLIR

SEQ ID NO: 444519 - protein, 9 aa, Homo Sapiens
GKKVSNQIF

SEQ ID NO: 444520 - protein, 9 aa, Homo Sapiens
CNSNILKTI

SEQ ID NO: 444521 - protein, 9 aa, Homo Sapiens
TSATVLGQD

SEQ ID NO: 444522 - protein, 9 aa, Homo Sapiens
HFQWVDGSR

SEQ ID NO: 444523 - protein, 9 aa, Homo Sapiens
MQLINEQGG

SEQ ID NO: 444524 - protein, 9 aa, Homo Sapiens
QRRCTRGTP

SEQ ID NO: 444525 - protein, 9 aa, Homo Sapiens
GDPLLDQRQ

SEQ ID NO: 444526 - protein, 9 aa, Homo Sapiens
TLDISNSRL

SEQ ID NO: 444527 - protein, 9 aa, Homo Sapiens
TYVTELNNN

SEQ ID NO: 444528 - protein, 9 aa, Homo Sapiens
SCQEVITNL

SEQ ID NO: 444529 - protein, 9 aa, Homo Sapiens
TTWLSVDID

SEQ ID NO: 444530 - protein, 9 aa, Homo Sapiens
SARPSTSGS

SEQ ID NO: 444531 - protein, 9 aa, Homo Sapiens
AVDFFVLKN

SEQ ID NO: 444532 - protein, 9 aa, Homo Sapiens
KMYDQHGSL

SEQ ID NO: 444533 - protein, 9 aa, Homo Sapiens
VCFSDNALP

SEQ ID NO: 444534 - protein, 9 aa, Homo Sapiens
DGTMFEAIN

SEQ ID NO: 444535 - protein, 9 aa, Homo Sapiens
CAACLIKCQ

SEQ ID NO: 444536 - protein, 9 aa, Homo Sapiens
IISLQLLCG

SEQ ID NO: 444537 - protein, 9 aa, Homo Sapiens
PSEEFLATF

SEQ ID NO: 444538 - protein, 9 aa, Homo Sapiens
FDILIQSGD

SEQ ID NO: 444539 - protein, 9 aa, Homo Sapiens
LKENQRGCF

SEQ ID NO: 444540 - protein, 9 aa, Homo Sapiens
KFFNLICLM

SEQ ID NO: 444541 - protein, 9 aa, Homo Sapiens
VFQPSPESG

SEQ ID NO: 444542 - protein, 9 aa, Homo Sapiens
VQQIQILLL

SEQ ID NO: 444543 - protein, 9 aa, Homo Sapiens
EYFQSSCYL

SEQ ID NO: 444544 - protein, 9 aa, Homo Sapiens
VILSACKAK

SEQ ID NO: 444545 - protein, 9 aa, Homo Sapiens
GAVLDEANN

SEQ ID NO: 444546 - protein, 9 aa, Homo Sapiens
SSSLCIHQI

SEQ ID NO: 444547 - protein, 9 aa, Homo Sapiens
KNSQASTVF

SEQ ID NO: 444548 - protein, 9 aa, Homo Sapiens
YSVSNCVDN

SEQ ID NO: 444549 - protein, 9 aa, Homo Sapiens
CSSSFQKHE

SEQ ID NO: 444550 - protein, 9 aa, Homo Sapiens
PWGWFLGSG

SEQ ID NO: 444551 - protein, 9 aa, Homo Sapiens
FFNRFSVAS

SEQ ID NO: 444552 - protein, 9 aa, Homo Sapiens
PLAKCKGSL

SEQ ID NO: 444553 - protein, 9 aa, Homo Sapiens
ALVSQSYIR

SEQ ID NO: 444554 - protein, 9 aa, Homo Sapiens
TSTGLAQHL

SEQ ID NO: 444555 - protein, 9 aa, Homo Sapiens
FSNCSGLFP

SEQ ID NO: 444556 - protein, 9 aa, Homo Sapiens
LQPSQHPKK

SEQ ID NO: 444557 - protein, 9 aa, Homo Sapiens
YLGGTDKEL

SEQ ID NO: 444558 - protein, 9 aa, Homo Sapiens
MEVLDQLLM

SEQ ID NO: 444559 - protein, 9 aa, Homo Sapiens
ISLQLLCGD

SEQ ID NO: 444560 - protein, 9 aa, Homo Sapiens
AHEGLAGYQ

SEQ ID NO: 444561 - protein, 9 aa, Homo Sapiens
SSSRSCLRR

SEQ ID NO: 444562 - protein, 9 aa, Homo Sapiens
SALITLDSE

SEQ ID NO: 444563 - protein, 9 aa, Homo Sapiens
LGRLASITR

SEQ ID NO: 444564 - protein, 9 aa, Homo Sapiens
GSYPAPDSC

SEQ ID NO: 444565 - protein, 9 aa, Homo Sapiens
SYTQQLGRL

SEQ ID NO: 444566 - protein, 9 aa, Homo Sapiens
KFYSKCLRL

SEQ ID NO: 444567 - protein, 9 aa, Homo Sapiens
QAPKDREVP

SEQ ID NO: 444568 - protein, 9 aa, Homo Sapiens
SLAIHLLQC

SEQ ID NO: 444569 - protein, 9 aa, Homo Sapiens
DPLLFSCFC

SEQ ID NO: 444570 - protein, 9 aa, Homo Sapiens
WVSQNRLFN

SEQ ID NO: 444571 - protein, 9 aa, Homo Sapiens
RFLYITLSE

SEQ ID NO: 444572 - protein, 9 aa, Homo Sapiens
VCHISDLWR

SEQ ID NO: 444573 - protein, 9 aa, Homo Sapiens
IYRGCHHEV

SEQ ID NO: 444574 - protein, 9 aa, Homo Sapiens
RGMYKLLCQ

SEQ ID NO: 444575 - protein, 9 aa, Homo Sapiens
SLGAFTRPC

SEQ ID NO: 444576 - protein, 9 aa, Homo Sapiens
CIWMCKLDD

SEQ ID NO: 444577 - protein, 9 aa, Homo Sapiens
LGELHSELA

SEQ ID NO: 444578 - protein, 9 aa, Homo Sapiens
LSAVDFFVL

SEQ ID NO: 444579 - protein, 9 aa, Homo Sapiens
CEHLEDGLH

SEQ ID NO: 444580 - protein, 9 aa, Homo Sapiens
LGELSSEKG

SEQ ID NO: 444581 - protein, 9 aa, Homo Sapiens
NQEQVTIFE

SEQ ID NO: 444582 - protein, 9 aa, Homo Sapiens
PTGTVPLLV

SEQ ID NO: 444583 - protein, 9 aa, Homo Sapiens
FATTGYDIA

SEQ ID NO: 444584 - protein, 9 aa, Homo Sapiens
RNWGIDKCN

SEQ ID NO: 444585 - protein, 9 aa, Homo Sapiens
ASLDAETTA

SEQ ID NO: 444586 - protein, 9 aa, Homo Sapiens
IDTDHAAPM

SEQ ID NO: 444587 - protein, 9 aa, Homo Sapiens
GIHRDTKKM

SEQ ID NO: 444588 - protein, 9 aa, Homo Sapiens
ACRTQLQFT

SEQ ID NO: 444589 - protein, 9 aa, Homo Sapiens
SLLRKIYEM

SEQ ID NO: 444590 - protein, 9 aa, Homo Sapiens
NLPKVTQQD

SEQ ID NO: 444591 - protein, 9 aa, Homo Sapiens
YGIEGDAVL

SEQ ID NO: 444592 - protein, 9 aa, Homo Sapiens
VPASTFQKA

SEQ ID NO: 444593 - protein, 9 aa, Homo Sapiens
ADPPQAEHV

SEQ ID NO: 444594 - protein, 9 aa, Homo Sapiens
AEDLDTEDD

SEQ ID NO: 444595 - protein, 9 aa, Homo Sapiens
LQRCLCAGY

SEQ ID NO: 444596 - protein, 9 aa, Homo Sapiens
SHLNKHNKI

SEQ ID NO: 444597 - protein, 9 aa, Homo Sapiens
DDDSEIVSN

SEQ ID NO: 444598 - protein, 9 aa, Homo Sapiens
TRIAYYAMD

SEQ ID NO: 444599 - protein, 9 aa, Homo Sapiens
QRRCCAYIT

SEQ ID NO: 444600 - protein, 9 aa, Homo Sapiens
SWSHDPSDL

SEQ ID NO: 444601 - protein, 9 aa, Homo Sapiens
WQEFVDAYV

SEQ ID NO: 444602 - protein, 9 aa, Homo Sapiens
RHPPPCLVG

SEQ ID NO: 444603 - protein, 9 aa, Homo Sapiens
EETVDAAIF

SEQ ID NO: 444604 - protein, 9 aa, Homo Sapiens
DSKAVHSQT

SEQ ID NO: 444605 - protein, 9 aa, Homo Sapiens
MIFLSDGLV

SEQ ID NO: 444606 - protein, 9 aa, Homo Sapiens
IISLDILKD

SEQ ID NO: 444607 - protein, 9 aa, Homo Sapiens
IFSFVAELS

SEQ ID NO: 444608 - protein, 9 aa, Homo Sapiens
RVCIILAMG

SEQ ID NO: 444609 - protein, 9 aa, Homo Sapiens
DYADEEAAV

SEQ ID NO: 444610 - protein, 9 aa, Homo Sapiens
VVFHFKFFP

SEQ ID NO: 444611 - protein, 9 aa, Homo Sapiens
SVSRSDRSP

SEQ ID NO: 444612 - protein, 9 aa, Homo Sapiens
RLLREHQYL

SEQ ID NO: 444613 - protein, 9 aa, Homo Sapiens
DEDECKEYI

SEQ ID NO: 444614 - protein, 9 aa, Homo Sapiens
RSISIVSQC

SEQ ID NO: 444615 - protein, 9 aa, Homo Sapiens
EETMKDKQE

SEQ ID NO: 444616 - protein, 9 aa, Homo Sapiens
RSMMDRMVA

SEQ ID NO: 444617 - protein, 9 aa, Homo Sapiens
NNQGNRTTP

SEQ ID NO: 444618 - protein, 9 aa, Homo Sapiens
QASLMLFVQ

SEQ ID NO: 444619 - protein, 9 aa, Homo Sapiens
YQNVFIGEK

SEQ ID NO: 444620 - protein, 9 aa, Homo Sapiens
DDYSSGNDL

SEQ ID NO: 444621 - protein, 9 aa, Homo Sapiens
IFCTSSLPP

SEQ ID NO: 444622 - protein, 9 aa, Homo Sapiens
AFSTYGGLL

SEQ ID NO: 444623 - protein, 9 aa, Homo Sapiens
IIETVKDEQ

SEQ ID NO: 444624 - protein, 9 aa, Homo Sapiens
QQQCWSIPA

SEQ ID NO: 444625 - protein, 9 aa, Homo Sapiens
QITLLDLND

SEQ ID NO: 444626 - protein, 9 aa, Homo Sapiens
ALYLCTSTS

SEQ ID NO: 444627 - protein, 9 aa, Homo Sapiens
MPLCGHQLN

SEQ ID NO: 444628 - protein, 9 aa, Homo Sapiens
DTDSTGSTD

SEQ ID NO: 444629 - protein, 9 aa, Homo Sapiens
GSGKENKVL

SEQ ID NO: 444630 - protein, 9 aa, Homo Sapiens
GKDRKIIMW

SEQ ID NO: 444631 - protein, 9 aa, Homo Sapiens
RDECEEINR

SEQ ID NO: 444632 - protein, 9 aa, Homo Sapiens
SFSVLSTLT

SEQ ID NO: 444633 - protein, 9 aa, Homo Sapiens
PENWDRTLH

SEQ ID NO: 444634 - protein, 9 aa, Homo Sapiens
NKWENYFLS

SEQ ID NO: 444635 - protein, 9 aa, Homo Sapiens
WLEFLFFLL

SEQ ID NO: 444636 - protein, 9 aa, Homo Sapiens
ISPLLAGLY

SEQ ID NO: 444637 - protein, 9 aa, Homo Sapiens
VNMDFTKIE

SEQ ID NO: 444638 - protein, 9 aa, Homo Sapiens
KTGTVYVAE

SEQ ID NO: 444639 - protein, 9 aa, Homo Sapiens
NQALTYWGC

SEQ ID NO: 444640 - protein, 9 aa, Homo Sapiens
HRNFIKNMI

SEQ ID NO: 444641 - protein, 9 aa, Homo Sapiens
FGQNCSHDC

SEQ ID NO: 444642 - protein, 9 aa, Homo Sapiens
KDETIQFQT

SEQ ID NO: 444643 - protein, 9 aa, Homo Sapiens
KHNKIQHMI

SEQ ID NO: 444644 - protein, 9 aa, Homo Sapiens
QENMIYYLL

SEQ ID NO: 444645 - protein, 9 aa, Homo Sapiens
ATGASILPK

SEQ ID NO: 444646 - protein, 9 aa, Homo Sapiens
SVSEDVLSS

SEQ ID NO: 444647 - protein, 9 aa, Homo Sapiens
VSVSRSDPF

SEQ ID NO: 444648 - protein, 9 aa, Homo Sapiens
WDLVTMVEQ

SEQ ID NO: 444649 - protein, 9 aa, Homo Sapiens
PEGNFANMP

SEQ ID NO: 444650 - protein, 9 aa, Homo Sapiens
QRLPQLNYK

SEQ ID NO: 444651 - protein, 9 aa, Homo Sapiens
VQSTMDESH

SEQ ID NO: 444652 - protein, 9 aa, Homo Sapiens
VGTCVVQVT

SEQ ID NO: 444653 - protein, 9 aa, Homo Sapiens
YFHFTAEIL

SEQ ID NO: 444654 - protein, 9 aa, Homo Sapiens
LATKGHLIV

SEQ ID NO: 444655 - protein, 9 aa, Homo Sapiens
EYWMRLHFP

SEQ ID NO: 444656 - protein, 9 aa, Homo Sapiens
FSRGFGLEM

SEQ ID NO: 444657 - protein, 9 aa, Homo Sapiens
VIPNSFGHI

SEQ ID NO: 444658 - protein, 9 aa, Homo Sapiens
KCCKEGYPC

SEQ ID NO: 444659 - protein, 9 aa, Homo Sapiens
CSSHSPLWK

SEQ ID NO: 444660 - protein, 9 aa, Homo Sapiens
FIDSKKASD

SEQ ID NO: 444661 - protein, 9 aa, Homo Sapiens
HNQGKKAEG

SEQ ID NO: 444662 - protein, 9 aa, Homo Sapiens
CKETGIYLP

SEQ ID NO: 444663 - protein, 9 aa, Homo Sapiens
RHENVLLRK

SEQ ID NO: 444664 - protein, 9 aa, Homo Sapiens
KVNFKELID

SEQ ID NO: 444665 - protein, 9 aa, Homo Sapiens
PTTENPKER

SEQ ID NO: 444666 - protein, 9 aa, Homo Sapiens
SNNQFVSLG

SEQ ID NO: 444667 - protein, 9 aa, Homo Sapiens
RQDPIECLL

SEQ ID NO: 444668 - protein, 9 aa, Homo Sapiens
SKCKSRASN

SEQ ID NO: 444669 - protein, 9 aa, Homo Sapiens
GLELDDITS

SEQ ID NO: 444670 - protein, 9 aa, Homo Sapiens
NLTTHKNIH

SEQ ID NO: 444671 - protein, 9 aa, Homo Sapiens
QRQESKKMS

SEQ ID NO: 444672 - protein, 9 aa, Homo Sapiens
CYTKLCEYI

SEQ ID NO: 444673 - protein, 9 aa, Homo Sapiens
GNKDLTFSI

SEQ ID NO: 444674 - protein, 9 aa, Homo Sapiens
RFGVERDQM

SEQ ID NO: 444675 - protein, 9 aa, Homo Sapiens
PSAEDLDTE

SEQ ID NO: 444676 - protein, 9 aa, Homo Sapiens
SPVTNVNKG

SEQ ID NO: 444677 - protein, 9 aa, Homo Sapiens
SLWKHLLPQ

SEQ ID NO: 444678 - protein, 9 aa, Homo Sapiens
SGCRNTYYA

SEQ ID NO: 444679 - protein, 9 aa, Homo Sapiens
DVDTEPQKQ

SEQ ID NO: 444680 - protein, 9 aa, Homo Sapiens
NDLQKVLHL

SEQ ID NO: 444681 - protein, 9 aa, Homo Sapiens
EIILNYRDG

SEQ ID NO: 444682 - protein, 9 aa, Homo Sapiens
QVLLFLKYI

SEQ ID NO: 444683 - protein, 9 aa, Homo Sapiens
EHDGINSLR

SEQ ID NO: 444684 - protein, 9 aa, Homo Sapiens
KEGKAAYLK

SEQ ID NO: 444685 - protein, 9 aa, Homo Sapiens
RRLVTRITQ

SEQ ID NO: 444686 - protein, 9 aa, Homo Sapiens
EVFELIKDT

SEQ ID NO: 444687 - protein, 9 aa, Homo Sapiens
LLPHQPQIV

SEQ ID NO: 444688 - protein, 9 aa, Homo Sapiens
TLSAAQLYY

SEQ ID NO: 444689 - protein, 9 aa, Homo Sapiens
MYLQPPSEH

SEQ ID NO: 444690 - protein, 9 aa, Homo Sapiens
KAIIRHRSA

SEQ ID NO: 444691 - protein, 9 aa, Homo Sapiens
LAVCRARHR

SEQ ID NO: 444692 - protein, 9 aa, Homo Sapiens
SRGFGLEMA

SEQ ID NO: 444693 - protein, 9 aa, Homo Sapiens
TPIYFFLQH

SEQ ID NO: 444694 - protein, 9 aa, Homo Sapiens
DLAQESAWI

SEQ ID NO: 444695 - protein, 9 aa, Homo Sapiens
RQNRRRLFS

SEQ ID NO: 444696 - protein, 9 aa, Homo Sapiens
REVCDRHHS

SEQ ID NO: 444697 - protein, 9 aa, Homo Sapiens
QKELDLLHG

SEQ ID NO: 444698 - protein, 9 aa, Homo Sapiens
IRRHTIQTA

SEQ ID NO: 444699 - protein, 9 aa, Homo Sapiens
IIILKMKYF

SEQ ID NO: 444700 - protein, 9 aa, Homo Sapiens
VNNVISPLL

SEQ ID NO: 444701 - protein, 9 aa, Homo Sapiens
EREKRWEHS

SEQ ID NO: 444702 - protein, 9 aa, Homo Sapiens
PKMTLLSCV

SEQ ID NO: 444703 - protein, 9 aa, Homo Sapiens
REVPTRKAE

SEQ ID NO: 444704 - protein, 9 aa, Homo Sapiens
FNRSANLIR

SEQ ID NO: 444705 - protein, 9 aa, Homo Sapiens
VVRAGLIAI

SEQ ID NO: 444706 - protein, 9 aa, Homo Sapiens
AFRWSSTLV

SEQ ID NO: 444707 - protein, 9 aa, Homo Sapiens
TITVESQEN

SEQ ID NO: 444708 - protein, 9 aa, Homo Sapiens
GGPPKYFVL

SEQ ID NO: 444709 - protein, 9 aa, Homo Sapiens
IFGLYDQMS

SEQ ID NO: 444710 - protein, 9 aa, Homo Sapiens
SFCERTSLR

SEQ ID NO: 444711 - protein, 9 aa, Homo Sapiens
RQPWNIPVL

SEQ ID NO: 444712 - protein, 9 aa, Homo Sapiens
ENVIFICSI

SEQ ID NO: 444713 - protein, 9 aa, Homo Sapiens
ETELSLQQL

SEQ ID NO: 444714 - protein, 9 aa, Homo Sapiens
CNDTSIFEN

SEQ ID NO: 444715 - protein, 9 aa, Homo Sapiens
KKPDVLRYD

SEQ ID NO: 444716 - protein, 9 aa, Homo Sapiens
TVLRNFQHR

SEQ ID NO: 444717 - protein, 9 aa, Homo Sapiens
ILKMETAEC

SEQ ID NO: 444718 - protein, 9 aa, Homo Sapiens
FNMLNTNNC

SEQ ID NO: 444719 - protein, 9 aa, Homo Sapiens
ICKAFRVWE

SEQ ID NO: 444720 - protein, 9 aa, Homo Sapiens
AIREHVCIR

SEQ ID NO: 444721 - protein, 9 aa, Homo Sapiens
VSHPTEKTI

SEQ ID NO: 444722 - protein, 9 aa, Homo Sapiens
ISGAFCYDI

SEQ ID NO: 444723 - protein, 9 aa, Homo Sapiens
GVLMGSDCP

SEQ ID NO: 444724 - protein, 9 aa, Homo Sapiens
AITVFDMLT

SEQ ID NO: 444725 - protein, 9 aa, Homo Sapiens
SSADKPSVS

SEQ ID NO: 444726 - protein, 9 aa, Homo Sapiens
MKNSDVSKA

SEQ ID NO: 444727 - protein, 9 aa, Homo Sapiens
AAIMRTLFS

SEQ ID NO: 444728 - protein, 9 aa, Homo Sapiens
RKQEDKQIK

SEQ ID NO: 444729 - protein, 9 aa, Homo Sapiens
RSEEENQEN

SEQ ID NO: 444730 - protein, 9 aa, Homo Sapiens
FSIRLEKAI

SEQ ID NO: 444731 - protein, 9 aa, Homo Sapiens
PTCSVEQEP

SEQ ID NO: 444732 - protein, 9 aa, Homo Sapiens
NVCFLEGKH

SEQ ID NO: 444733 - protein, 9 aa, Homo Sapiens
IDRAEKMEE

SEQ ID NO: 444734 - protein, 9 aa, Homo Sapiens
LCGIPRQCI

SEQ ID NO: 444735 - protein, 9 aa, Homo Sapiens
SYVVGPPET

SEQ ID NO: 444736 - protein, 9 aa, Homo Sapiens
SLCGGLEML

SEQ ID NO: 444737 - protein, 9 aa, Homo Sapiens
VLSKINFES

SEQ ID NO: 444738 - protein, 9 aa, Homo Sapiens
EPWWTLPKN

SEQ ID NO: 444739 - protein, 9 aa, Homo Sapiens
DLGERQSDN

SEQ ID NO: 444740 - protein, 9 aa, Homo Sapiens
PAEDALLQM

SEQ ID NO: 444741 - protein, 9 aa, Homo Sapiens
ETLLDELYI

SEQ ID NO: 444742 - protein, 9 aa, Homo Sapiens
LERPDFREK

SEQ ID NO: 444743 - protein, 9 aa, Homo Sapiens
NRIYYKVQN

SEQ ID NO: 444744 - protein, 9 aa, Homo Sapiens
KNFGADMTK

SEQ ID NO: 444745 - protein, 9 aa, Homo Sapiens
PQKVRAMGK

SEQ ID NO: 444746 - protein, 9 aa, Homo Sapiens
EVNPKGHET

SEQ ID NO: 444747 - protein, 9 aa, Homo Sapiens
QNGSLKKLQ

SEQ ID NO: 444748 - protein, 9 aa, Homo Sapiens
AHKIVICAV

SEQ ID NO: 444749 - protein, 9 aa, Homo Sapiens
VVTLKKDVD

SEQ ID NO: 444750 - protein, 9 aa, Homo Sapiens
VQKCIDHLL

SEQ ID NO: 444751 - protein, 9 aa, Homo Sapiens
GIHEISEDV

SEQ ID NO: 444752 - protein, 9 aa, Homo Sapiens
QKRQLDKVR

SEQ ID NO: 444753 - protein, 9 aa, Homo Sapiens
VVSLCYSYL

SEQ ID NO: 444754 - protein, 9 aa, Homo Sapiens
HGQGCCVNG

SEQ ID NO: 444755 - protein, 9 aa, Homo Sapiens
ADIYTHNFY

SEQ ID NO: 444756 - protein, 9 aa, Homo Sapiens
EGKVNNLSI

SEQ ID NO: 444757 - protein, 9 aa, Homo Sapiens
GKFTRRAFA

SEQ ID NO: 444758 - protein, 9 aa, Homo Sapiens
IIKEDYLGI

SEQ ID NO: 444759 - protein, 9 aa, Homo Sapiens
AREILDGLV

SEQ ID NO: 444760 - protein, 9 aa, Homo Sapiens
IQLFFFILN

SEQ ID NO: 444761 - protein, 9 aa, Homo Sapiens
KGELINVFN

SEQ ID NO: 444762 - protein, 9 aa, Homo Sapiens
EIIQHVDVI

SEQ ID NO: 444763 - protein, 9 aa, Homo Sapiens
QKVSPYFKS

SEQ ID NO: 444764 - protein, 9 aa, Homo Sapiens
RPVEPERRL

SEQ ID NO: 444765 - protein, 9 aa, Homo Sapiens
CERTSLRER

SEQ ID NO: 444766 - protein, 9 aa, Homo Sapiens
KTQLVESRQ

SEQ ID NO: 444767 - protein, 9 aa, Homo Sapiens
PQSPLDDTK

SEQ ID NO: 444768 - protein, 9 aa, Homo Sapiens
IPEQHQKNQ

SEQ ID NO: 444769 - protein, 9 aa, Homo Sapiens
LVVEIDNAT

SEQ ID NO: 444770 - protein, 9 aa, Homo Sapiens
PECINFRKL

SEQ ID NO: 444771 - protein, 9 aa, Homo Sapiens
DLMYLDYRL

SEQ ID NO: 444772 - protein, 9 aa, Homo Sapiens
EMIRLLIMY

SEQ ID NO: 444773 - protein, 9 aa, Homo Sapiens
ADQAVIDER

SEQ ID NO: 444774 - protein, 9 aa, Homo Sapiens
SWKRIQSPV

SEQ ID NO: 444775 - protein, 9 aa, Homo Sapiens
VPIHFQNAY

SEQ ID NO: 444776 - protein, 9 aa, Homo Sapiens
FIKIDQAWK

SEQ ID NO: 444777 - protein, 9 aa, Homo Sapiens
KMVQAVGGA

SEQ ID NO: 444778 - protein, 9 aa, Homo Sapiens
IYKISPEKL

SEQ ID NO: 444779 - protein, 9 aa, Homo Sapiens
VAFPRRTQP

SEQ ID NO: 444780 - protein, 9 aa, Homo Sapiens
PIPIIKSPN

SEQ ID NO: 444781 - protein, 9 aa, Homo Sapiens
YRAIPELDV

SEQ ID NO: 444782 - protein, 9 aa, Homo Sapiens
DMELYSYVK

SEQ ID NO: 444783 - protein, 9 aa, Homo Sapiens
QGINSATPI

SEQ ID NO: 444784 - protein, 9 aa, Homo Sapiens
VVLSKINFE

SEQ ID NO: 444785 - protein, 9 aa, Homo Sapiens
CCEKKIPEC

SEQ ID NO: 444786 - protein, 9 aa, Homo Sapiens
KRSSRKNTK

SEQ ID NO: 444787 - protein, 9 aa, Homo Sapiens
SGLPNDRLF

SEQ ID NO: 444788 - protein, 9 aa, Homo Sapiens
EEDRGFAYH

SEQ ID NO: 444789 - protein, 9 aa, Homo Sapiens
LFRIVYITE

SEQ ID NO: 444790 - protein, 9 aa, Homo Sapiens
HVIVPCRSC

SEQ ID NO: 444791 - protein, 9 aa, Homo Sapiens
DLYSLLSKL

SEQ ID NO: 444792 - protein, 9 aa, Homo Sapiens
FSLPKMTLL

SEQ ID NO: 444793 - protein, 9 aa, Homo Sapiens
VEIMEKCNT

SEQ ID NO: 444794 - protein, 9 aa, Homo Sapiens
AAYNQRKAN

SEQ ID NO: 444795 - protein, 9 aa, Homo Sapiens
NVKSQKIHL

SEQ ID NO: 444796 - protein, 9 aa, Homo Sapiens
DLVLNVGRV

SEQ ID NO: 444797 - protein, 9 aa, Homo Sapiens
PESTPSTLN

SEQ ID NO: 444798 - protein, 9 aa, Homo Sapiens
SGCLVRRRP

SEQ ID NO: 444799 - protein, 9 aa, Homo Sapiens
EIIDWLSHK

SEQ ID NO: 444800 - protein, 9 aa, Homo Sapiens
GLSEKELKA

SEQ ID NO: 444801 - protein, 9 aa, Homo Sapiens
LSLTSVQSV

SEQ ID NO: 444802 - protein, 9 aa, Homo Sapiens
LGSFHFRAS

SEQ ID NO: 444803 - protein, 9 aa, Homo Sapiens
KNTEPTTCE

SEQ ID NO: 444804 - protein, 9 aa, Homo Sapiens
KNTYKVLDF

SEQ ID NO: 444805 - protein, 9 aa, Homo Sapiens
RDRMVRSLE

SEQ ID NO: 444806 - protein, 9 aa, Homo Sapiens
NIMNYFQVA

SEQ ID NO: 444807 - protein, 9 aa, Homo Sapiens
LLCKRFEEV

SEQ ID NO: 444808 - protein, 9 aa, Homo Sapiens
TRPSNLAVC

SEQ ID NO: 444809 - protein, 9 aa, Homo Sapiens
KINSRLRDY

SEQ ID NO: 444810 - protein, 9 aa, Homo Sapiens
EFEKDNIKM

SEQ ID NO: 444811 - protein, 9 aa, Homo Sapiens
EINEKSYQL

SEQ ID NO: 444812 - protein, 9 aa, Homo Sapiens
KEQLDIHDL

SEQ ID NO: 444813 - protein, 9 aa, Homo Sapiens
KSVAFPGWF

SEQ ID NO: 444814 - protein, 9 aa, Homo Sapiens
KLLANLLLN

SEQ ID NO: 444815 - protein, 9 aa, Homo Sapiens
YVKDLFLQR

SEQ ID NO: 444816 - protein, 9 aa, Homo Sapiens
IYCEDKHTF

SEQ ID NO: 444817 - protein, 9 aa, Homo Sapiens
SYASNNVPN

SEQ ID NO: 444818 - protein, 9 aa, Homo Sapiens
KDVGPHRDM

SEQ ID NO: 444819 - protein, 9 aa, Homo Sapiens
DKKILEAEI

SEQ ID NO: 444820 - protein, 9 aa, Homo Sapiens
NFIRAFRTI

SEQ ID NO: 444821 - protein, 9 aa, Homo Sapiens
DEISERAFK

SEQ ID NO: 444822 - protein, 9 aa, Homo Sapiens
GKTTGEVVP

SEQ ID NO: 444823 - protein, 9 aa, Homo Sapiens
TFRRRLNLT

SEQ ID NO: 444824 - protein, 9 aa, Homo Sapiens
VHKWCHELI

SEQ ID NO: 444825 - protein, 9 aa, Homo Sapiens
NPHVRCIEQ

SEQ ID NO: 444826 - protein, 9 aa, Homo Sapiens
GTMFEAINS

SEQ ID NO: 444827 - protein, 9 aa, Homo Sapiens
AICWVLLFA

SEQ ID NO: 444828 - protein, 9 aa, Homo Sapiens
TQKDIALLK

SEQ ID NO: 444829 - protein, 9 aa, Homo Sapiens
FMVNATWDG

SEQ ID NO: 444830 - protein, 9 aa, Homo Sapiens
VCKTCYRIV

SEQ ID NO: 444831 - protein, 9 aa, Homo Sapiens
FYRALYPKS

SEQ ID NO: 444832 - protein, 9 aa, Homo Sapiens
DVYVKDVLG

SEQ ID NO: 444833 - protein, 9 aa, Homo Sapiens
SYSYYCDHN

SEQ ID NO: 444834 - protein, 9 aa, Homo Sapiens
GEERRSKKG

SEQ ID NO: 444835 - protein, 9 aa, Homo Sapiens
LAQFHYPCD

SEQ ID NO: 444836 - protein, 9 aa, Homo Sapiens
DEEEEDDDA

SEQ ID NO: 444837 - protein, 9 aa, Homo Sapiens
DKEHNHMEK

SEQ ID NO: 444838 - protein, 9 aa, Homo Sapiens
FTTLAAIMR

SEQ ID NO: 444839 - protein, 9 aa, Homo Sapiens
NTNQIVVIK

SEQ ID NO: 444840 - protein, 9 aa, Homo Sapiens
EAICNLLQY

SEQ ID NO: 444841 - protein, 9 aa, Homo Sapiens
DLIRAGKKE

SEQ ID NO: 444842 - protein, 9 aa, Homo Sapiens
DTQKENNIC

SEQ ID NO: 444843 - protein, 9 aa, Homo Sapiens
LDKVVGLQQ

SEQ ID NO: 444844 - protein, 9 aa, Homo Sapiens
ESYFDFTLC

SEQ ID NO: 444845 - protein, 9 aa, Homo Sapiens
KEVDEMEIK

SEQ ID NO: 444846 - protein, 9 aa, Homo Sapiens
PLKDGIFTT

SEQ ID NO: 444847 - protein, 9 aa, Homo Sapiens
AVNSILFNH

SEQ ID NO: 444848 - protein, 9 aa, Homo Sapiens
EEASKSVSS

SEQ ID NO: 444849 - protein, 9 aa, Homo Sapiens
HPLSLPVEK

SEQ ID NO: 444850 - protein, 9 aa, Homo Sapiens
LRPSYNGYF

SEQ ID NO: 444851 - protein, 9 aa, Homo Sapiens
AYLARKVSL

SEQ ID NO: 444852 - protein, 9 aa, Homo Sapiens
NGTIIFIIK

SEQ ID NO: 444853 - protein, 9 aa, Homo Sapiens
LWRESWERE

SEQ ID NO: 444854 - protein, 9 aa, Homo Sapiens
DAVGLKNIS

SEQ ID NO: 444855 - protein, 9 aa, Homo Sapiens
SCDCTVHLW

SEQ ID NO: 444856 - protein, 9 aa, Homo Sapiens
GKKSYACQQ

SEQ ID NO: 444857 - protein, 9 aa, Homo Sapiens
GPALLVKRS

SEQ ID NO: 444858 - protein, 9 aa, Homo Sapiens
DANMVMSFV

SEQ ID NO: 444859 - protein, 9 aa, Homo Sapiens
HENVLLRKG

SEQ ID NO: 444860 - protein, 9 aa, Homo Sapiens
GKHQATAHC

SEQ ID NO: 444861 - protein, 9 aa, Homo Sapiens
GYLLGSEAY

SEQ ID NO: 444862 - protein, 9 aa, Homo Sapiens
WRAKLKRDL

SEQ ID NO: 444863 - protein, 9 aa, Homo Sapiens
LSRPFRKHG

SEQ ID NO: 444864 - protein, 9 aa, Homo Sapiens
NIDLEQMEQ

SEQ ID NO: 444865 - protein, 9 aa, Homo Sapiens
VGVEIMEKC

SEQ ID NO: 444866 - protein, 9 aa, Homo Sapiens
SALANINLA

SEQ ID NO: 444867 - protein, 9 aa, Homo Sapiens
LFMDNSNIV

SEQ ID NO: 444868 - protein, 9 aa, Homo Sapiens
TRGPLGASG

SEQ ID NO: 444869 - protein, 9 aa, Homo Sapiens
DYFFPVEPV

SEQ ID NO: 444870 - protein, 9 aa, Homo Sapiens
ITASVSILE

SEQ ID NO: 444871 - protein, 9 aa, Homo Sapiens
LFCEFSSLL

SEQ ID NO: 444872 - protein, 9 aa, Homo Sapiens
EDNMDGGDW

SEQ ID NO: 444873 - protein, 9 aa, Homo Sapiens
LAAIMRTLF

SEQ ID NO: 444874 - protein, 9 aa, Homo Sapiens
MTLYGEVPE

SEQ ID NO: 444875 - protein, 9 aa, Homo Sapiens
GCEHLEDGL

SEQ ID NO: 444876 - protein, 9 aa, Homo Sapiens
NVRARKYYD

SEQ ID NO: 444877 - protein, 9 aa, Homo Sapiens
QKEMKNYIF

SEQ ID NO: 444878 - protein, 9 aa, Homo Sapiens
INLVCGDDE

SEQ ID NO: 444879 - protein, 9 aa, Homo Sapiens
EDYEASGQS

SEQ ID NO: 444880 - protein, 9 aa, Homo Sapiens
SIQFFYFHI

SEQ ID NO: 444881 - protein, 9 aa, Homo Sapiens
HIPMHALPD

SEQ ID NO: 444882 - protein, 9 aa, Homo Sapiens
LYEDNEKEK

SEQ ID NO: 444883 - protein, 9 aa, Homo Sapiens
LWQIKSEQL

SEQ ID NO: 444884 - protein, 9 aa, Homo Sapiens
AIFVQHLRI

SEQ ID NO: 444885 - protein, 9 aa, Homo Sapiens
ADLVLNVGR

SEQ ID NO: 444886 - protein, 9 aa, Homo Sapiens
LAEIRDTYQ

SEQ ID NO: 444887 - protein, 9 aa, Homo Sapiens
RGPGPLQDR

SEQ ID NO: 444888 - protein, 9 aa, Homo Sapiens
CKKGFIQII

SEQ ID NO: 444889 - protein, 9 aa, Homo Sapiens
LGAAPSLIP

SEQ ID NO: 444890 - protein, 9 aa, Homo Sapiens
EKKKGKAKT

SEQ ID NO: 444891 - protein, 9 aa, Homo Sapiens
GEVPASTFQ

SEQ ID NO: 444892 - protein, 9 aa, Homo Sapiens
RLLNRIYYK

SEQ ID NO: 444893 - protein, 9 aa, Homo Sapiens
QISFQWSPS

SEQ ID NO: 444894 - protein, 9 aa, Homo Sapiens
PTPIQALQY

SEQ ID NO: 444895 - protein, 9 aa, Homo Sapiens
WLSVDIDSE

SEQ ID NO: 444896 - protein, 9 aa, Homo Sapiens
HNFLPRFNW

SEQ ID NO: 444897 - protein, 9 aa, Homo Sapiens
RYFISSEQK

SEQ ID NO: 444898 - protein, 9 aa, Homo Sapiens
GIPLCHLQV

SEQ ID NO: 444899 - protein, 9 aa, Homo Sapiens
EKEDLEGHQ

SEQ ID NO: 444900 - protein, 9 aa, Homo Sapiens
LLSNHQHVT

SEQ ID NO: 444901 - protein, 9 aa, Homo Sapiens
FMLPTLIIR

SEQ ID NO: 444902 - protein, 9 aa, Homo Sapiens
RDRVWLLAS

SEQ ID NO: 444903 - protein, 9 aa, Homo Sapiens
VDLYHEHKK

SEQ ID NO: 444904 - protein, 9 aa, Homo Sapiens
KQDKKILEA

SEQ ID NO: 444905 - protein, 9 aa, Homo Sapiens
HKRNDGRDP

SEQ ID NO: 444906 - protein, 9 aa, Homo Sapiens
WETAKSPKA

SEQ ID NO: 444907 - protein, 9 aa, Homo Sapiens
PKCGHPRAY

SEQ ID NO: 444908 - protein, 9 aa, Homo Sapiens
KSRPDSPCV

SEQ ID NO: 444909 - protein, 9 aa, Homo Sapiens
YEEHLGIIG

SEQ ID NO: 444910 - protein, 9 aa, Homo Sapiens
IKIAYCENK

SEQ ID NO: 444911 - protein, 9 aa, Homo Sapiens
IVTNKVIKI

SEQ ID NO: 444912 - protein, 9 aa, Homo Sapiens
HTKDTALKH

SEQ ID NO: 444913 - protein, 9 aa, Homo Sapiens
TFISYYTSY

SEQ ID NO: 444914 - protein, 9 aa, Homo Sapiens
THPELQIVL

SEQ ID NO: 444915 - protein, 9 aa, Homo Sapiens
MSSRNQGGE

SEQ ID NO: 444916 - protein, 9 aa, Homo Sapiens
MDIFSLPKM

SEQ ID NO: 444917 - protein, 9 aa, Homo Sapiens
TSMWLAGHP

SEQ ID NO: 444918 - protein, 9 aa, Homo Sapiens
GKSFSVLST

SEQ ID NO: 444919 - protein, 9 aa, Homo Sapiens
LCEGLWHPQ

SEQ ID NO: 444920 - protein, 9 aa, Homo Sapiens
TILEIVLFA

SEQ ID NO: 444921 - protein, 9 aa, Homo Sapiens
KYSVKKKED

SEQ ID NO: 444922 - protein, 9 aa, Homo Sapiens
EMASYFNLS

SEQ ID NO: 444923 - protein, 9 aa, Homo Sapiens
FYIWRPLQI

SEQ ID NO: 444924 - protein, 9 aa, Homo Sapiens
EYNGLCGYL

SEQ ID NO: 444925 - protein, 9 aa, Homo Sapiens
KHKIIHAEE

SEQ ID NO: 444926 - protein, 9 aa, Homo Sapiens
AVKSEEGQL

SEQ ID NO: 444927 - protein, 9 aa, Homo Sapiens
RPLKDKIED

SEQ ID NO: 444928 - protein, 9 aa, Homo Sapiens
NYSFTILYE

SEQ ID NO: 444929 - protein, 9 aa, Homo Sapiens
WKLAKIKQD

SEQ ID NO: 444930 - protein, 9 aa, Homo Sapiens
FFFVTGCDA

SEQ ID NO: 444931 - protein, 9 aa, Homo Sapiens
NQTACGFCL

SEQ ID NO: 444932 - protein, 9 aa, Homo Sapiens
VINAVKKIA

SEQ ID NO: 444933 - protein, 9 aa, Homo Sapiens
LYRQRSQTA

SEQ ID NO: 444934 - protein, 9 aa, Homo Sapiens
LECAFGYKL

SEQ ID NO: 444935 - protein, 9 aa, Homo Sapiens
TPLELGVGL

SEQ ID NO: 444936 - protein, 9 aa, Homo Sapiens
VIGRLRALS

SEQ ID NO: 444937 - protein, 9 aa, Homo Sapiens
EKNIHFLVI

SEQ ID NO: 444938 - protein, 9 aa, Homo Sapiens
EMIYHEQLP

SEQ ID NO: 444939 - protein, 9 aa, Homo Sapiens
TSYQNKSFD

SEQ ID NO: 444940 - protein, 9 aa, Homo Sapiens
PRSYVNNQP

SEQ ID NO: 444941 - protein, 9 aa, Homo Sapiens
AAYVQCLAW

SEQ ID NO: 444942 - protein, 9 aa, Homo Sapiens
IHFQNAYLL

SEQ ID NO: 444943 - protein, 9 aa, Homo Sapiens
GAAQTTSQS

SEQ ID NO: 444944 - protein, 9 aa, Homo Sapiens
CHICKMPLQ

SEQ ID NO: 444945 - protein, 9 aa, Homo Sapiens
LIVIFVLIL

SEQ ID NO: 444946 - protein, 9 aa, Homo Sapiens
AELNDRAIP

SEQ ID NO: 444947 - protein, 9 aa, Homo Sapiens
ALSRDQSDC

SEQ ID NO: 444948 - protein, 9 aa, Homo Sapiens
VACVHKEKS

SEQ ID NO: 444949 - protein, 9 aa, Homo Sapiens
STKITSYMA

SEQ ID NO: 444950 - protein, 9 aa, Homo Sapiens
TAATPVHHR

SEQ ID NO: 444951 - protein, 9 aa, Homo Sapiens
LKNEPWYKL

SEQ ID NO: 444952 - protein, 9 aa, Homo Sapiens
VQKMIFYLN

SEQ ID NO: 444953 - protein, 9 aa, Homo Sapiens
NNILESKCK

SEQ ID NO: 444954 - protein, 9 aa, Homo Sapiens
EIEDDENFF

SEQ ID NO: 444955 - protein, 9 aa, Homo Sapiens
LENVLDLNG

SEQ ID NO: 444956 - protein, 9 aa, Homo Sapiens
FVRGPPTGK

SEQ ID NO: 444957 - protein, 9 aa, Homo Sapiens
HRLCIVHVV

SEQ ID NO: 444958 - protein, 9 aa, Homo Sapiens
VWMFALHSN

SEQ ID NO: 444959 - protein, 9 aa, Homo Sapiens
QAVIDERLD

SEQ ID NO: 444960 - protein, 9 aa, Homo Sapiens
LTEVYSENE

SEQ ID NO: 444961 - protein, 9 aa, Homo Sapiens
NDYDDTIQI

SEQ ID NO: 444962 - protein, 9 aa, Homo Sapiens
LQYKLGDKL

SEQ ID NO: 444963 - protein, 9 aa, Homo Sapiens
LNNLQLRYE

SEQ ID NO: 444964 - protein, 9 aa, Homo Sapiens
LLGPTGIPG

SEQ ID NO: 444965 - protein, 9 aa, Homo Sapiens
QMTSSADKP

SEQ ID NO: 444966 - protein, 9 aa, Homo Sapiens
YCCDFASGV

SEQ ID NO: 444967 - protein, 9 aa, Homo Sapiens
SSQDETKTL

SEQ ID NO: 444968 - protein, 9 aa, Homo Sapiens
NLLSRNSEM

SEQ ID NO: 444969 - protein, 9 aa, Homo Sapiens
PPTGKRRGG

SEQ ID NO: 444970 - protein, 9 aa, Homo Sapiens
LQAILTFHL

SEQ ID NO: 444971 - protein, 9 aa, Homo Sapiens
NHQIMSVST

SEQ ID NO: 444972 - protein, 9 aa, Homo Sapiens
RIDKRVDCS

SEQ ID NO: 444973 - protein, 9 aa, Homo Sapiens
ILANDHMRV

SEQ ID NO: 444974 - protein, 9 aa, Homo Sapiens
NQVQSTMDE

SEQ ID NO: 444975 - protein, 9 aa, Homo Sapiens
EKELETNSE

SEQ ID NO: 444976 - protein, 9 aa, Homo Sapiens
NSEWFEMET

SEQ ID NO: 444977 - protein, 9 aa, Homo Sapiens
FLKLTDVFK

SEQ ID NO: 444978 - protein, 9 aa, Homo Sapiens
KSWKPPCRS

SEQ ID NO: 444979 - protein, 9 aa, Homo Sapiens
DTSPAPIPN

SEQ ID NO: 444980 - protein, 9 aa, Homo Sapiens
NPYNYAFVS

SEQ ID NO: 444981 - protein, 9 aa, Homo Sapiens
ETDSTSATV

SEQ ID NO: 444982 - protein, 9 aa, Homo Sapiens
GAAPSLIPL

SEQ ID NO: 444983 - protein, 9 aa, Homo Sapiens
SLDQRLEKH

SEQ ID NO: 444984 - protein, 9 aa, Homo Sapiens
DVFMSYPGN

SEQ ID NO: 444985 - protein, 9 aa, Homo Sapiens
SNILSLLRL

SEQ ID NO: 444986 - protein, 9 aa, Homo Sapiens
YCQEKDLLA

SEQ ID NO: 444987 - protein, 9 aa, Homo Sapiens
TSENTHRRE

SEQ ID NO: 444988 - protein, 9 aa, Homo Sapiens
WQVCKTCYR

SEQ ID NO: 444989 - protein, 9 aa, Homo Sapiens
LVGKPDFVM

SEQ ID NO: 444990 - protein, 9 aa, Homo Sapiens
EAEEAATEP

SEQ ID NO: 444991 - protein, 9 aa, Homo Sapiens
FNFFHHINT

SEQ ID NO: 444992 - protein, 9 aa, Homo Sapiens
WDIAGARSL

SEQ ID NO: 444993 - protein, 9 aa, Homo Sapiens
TAEETNMEK

SEQ ID NO: 444994 - protein, 9 aa, Homo Sapiens
EIQWISNHY

SEQ ID NO: 444995 - protein, 9 aa, Homo Sapiens
SSLPIYLPV

SEQ ID NO: 444996 - protein, 9 aa, Homo Sapiens
CVKQGDSNK

SEQ ID NO: 444997 - protein, 9 aa, Homo Sapiens
KAQKTGLIT

SEQ ID NO: 444998 - protein, 9 aa, Homo Sapiens
LLVTAALQL

SEQ ID NO: 444999 - protein, 9 aa, Homo Sapiens
WRMWRDVTR

SEQ ID NO: 445000 - protein, 9 aa, Homo Sapiens
LEKEDKLSK

SEQ ID NO: 445001 - protein, 9 aa, Homo Sapiens
ISTSINFNI

SEQ ID NO: 445002 - protein, 9 aa, Homo Sapiens
SQRHVLKVC

SEQ ID NO: 445003 - protein, 9 aa, Homo Sapiens
KPVVQIHHP

SEQ ID NO: 445004 - protein, 9 aa, Homo Sapiens
NKKRKLKNK

SEQ ID NO: 445005 - protein, 9 aa, Homo Sapiens
GCDPQTRLF

SEQ ID NO: 445006 - protein, 9 aa, Homo Sapiens
VNSILFNHE

SEQ ID NO: 445007 - protein, 9 aa, Homo Sapiens
NTFLLPSAN

SEQ ID NO: 445008 - protein, 9 aa, Homo Sapiens
GYFHFTAEI

SEQ ID NO: 445009 - protein, 9 aa, Homo Sapiens
LKRILQDYH

SEQ ID NO: 445010 - protein, 9 aa, Homo Sapiens
TNITPKHTM

SEQ ID NO: 445011 - protein, 9 aa, Homo Sapiens
RPKTCGLMT

SEQ ID NO: 445012 - protein, 9 aa, Homo Sapiens
CSLFVYLGS

SEQ ID NO: 445013 - protein, 9 aa, Homo Sapiens
NGVVLHDNK

SEQ ID NO: 445014 - protein, 9 aa, Homo Sapiens
YFTCNPLNS

SEQ ID NO: 445015 - protein, 9 aa, Homo Sapiens
VKQCFNNQP

SEQ ID NO: 445016 - protein, 9 aa, Homo Sapiens
AQVYIEVVN

SEQ ID NO: 445017 - protein, 9 aa, Homo Sapiens
SSDTPSTST

SEQ ID NO: 445018 - protein, 9 aa, Homo Sapiens
LCGYLLKPD

SEQ ID NO: 445019 - protein, 9 aa, Homo Sapiens
KINPTKIKE

SEQ ID NO: 445020 - protein, 9 aa, Homo Sapiens
NFCKAKLAL

SEQ ID NO: 445021 - protein, 9 aa, Homo Sapiens
RRSQRILQR

SEQ ID NO: 445022 - protein, 9 aa, Homo Sapiens
YQYILVINF

SEQ ID NO: 445023 - protein, 9 aa, Homo Sapiens
KSQLIHNNL

SEQ ID NO: 445024 - protein, 9 aa, Homo Sapiens
LVGLDKLVN

SEQ ID NO: 445025 - protein, 9 aa, Homo Sapiens
ECLEKCFST

SEQ ID NO: 445026 - protein, 9 aa, Homo Sapiens
KYEVVDALV

SEQ ID NO: 445027 - protein, 9 aa, Homo Sapiens
SRHVTVYHK

SEQ ID NO: 445028 - protein, 9 aa, Homo Sapiens
PQEGIAKES

SEQ ID NO: 445029 - protein, 9 aa, Homo Sapiens
TIRSISIVS

SEQ ID NO: 445030 - protein, 9 aa, Homo Sapiens
PDLLGPTGI

SEQ ID NO: 445031 - protein, 9 aa, Homo Sapiens
TAALPTFCK

SEQ ID NO: 445032 - protein, 9 aa, Homo Sapiens
FYTLRYHHI

SEQ ID NO: 445033 - protein, 9 aa, Homo Sapiens
IKAIADYVR

SEQ ID NO: 445034 - protein, 9 aa, Homo Sapiens
YNDWINLVI

SEQ ID NO: 445035 - protein, 9 aa, Homo Sapiens
DKKDDNENG

SEQ ID NO: 445036 - protein, 9 aa, Homo Sapiens
YSVRDYFKS

SEQ ID NO: 445037 - protein, 9 aa, Homo Sapiens
RYEINADPI

SEQ ID NO: 445038 - protein, 9 aa, Homo Sapiens
QSPVNKTTL

SEQ ID NO: 445039 - protein, 9 aa, Homo Sapiens
YHLSMYIDK

SEQ ID NO: 445040 - protein, 9 aa, Homo Sapiens
KQNKLKRCD

SEQ ID NO: 445041 - protein, 9 aa, Homo Sapiens
GSSAKSGAL

SEQ ID NO: 445042 - protein, 9 aa, Homo Sapiens
ETHRDFLPS

SEQ ID NO: 445043 - protein, 9 aa, Homo Sapiens
AVFQYILRT

SEQ ID NO: 445044 - protein, 9 aa, Homo Sapiens
WRGQVSAVL

SEQ ID NO: 445045 - protein, 9 aa, Homo Sapiens
GRRQSQKVP

SEQ ID NO: 445046 - protein, 9 aa, Homo Sapiens
LEHLYDSKT

SEQ ID NO: 445047 - protein, 9 aa, Homo Sapiens
TSSVAAGTA

SEQ ID NO: 445048 - protein, 9 aa, Homo Sapiens
WGGAHIFKL

SEQ ID NO: 445049 - protein, 9 aa, Homo Sapiens
NETEQKVAQ

SEQ ID NO: 445050 - protein, 9 aa, Homo Sapiens
SADTNGPVF

SEQ ID NO: 445051 - protein, 9 aa, Homo Sapiens
NTLIENVVS

SEQ ID NO: 445052 - protein, 9 aa, Homo Sapiens
VSYLVKDLI

SEQ ID NO: 445053 - protein, 9 aa, Homo Sapiens
LDQEGNQRH

SEQ ID NO: 445054 - protein, 9 aa, Homo Sapiens
IFHTIRELY

SEQ ID NO: 445055 - protein, 9 aa, Homo Sapiens
QFFSDAQEL

SEQ ID NO: 445056 - protein, 9 aa, Homo Sapiens
LMYLDYRLI

SEQ ID NO: 445057 - protein, 9 aa, Homo Sapiens
YADNFIGKP

SEQ ID NO: 445058 - protein, 9 aa, Homo Sapiens
MDFTTLAAI

SEQ ID NO: 445059 - protein, 9 aa, Homo Sapiens
MKSARYLQT

SEQ ID NO: 445060 - protein, 9 aa, Homo Sapiens
IEDNMDGGD

SEQ ID NO: 445061 - protein, 9 aa, Homo Sapiens
LIIFAVFIV

SEQ ID NO: 445062 - protein, 9 aa, Homo Sapiens
GISSRSQFS

SEQ ID NO: 445063 - protein, 9 aa, Homo Sapiens
WFNKLYLNE

SEQ ID NO: 445064 - protein, 9 aa, Homo Sapiens
HNHFYFHTT

SEQ ID NO: 445065 - protein, 9 aa, Homo Sapiens
CYIQPCNSN

SEQ ID NO: 445066 - protein, 9 aa, Homo Sapiens
SRGAKNYVS

SEQ ID NO: 445067 - protein, 9 aa, Homo Sapiens
EEYKATPRR

SEQ ID NO: 445068 - protein, 9 aa, Homo Sapiens
HPYADNFIG

SEQ ID NO: 445069 - protein, 9 aa, Homo Sapiens
DGITKKEDS

SEQ ID NO: 445070 - protein, 9 aa, Homo Sapiens
VLSMHQIIL

SEQ ID NO: 445071 - protein, 9 aa, Homo Sapiens
SALVKVILI

SEQ ID NO: 445072 - protein, 9 aa, Homo Sapiens
KHIIKLTVE

SEQ ID NO: 445073 - protein, 9 aa, Homo Sapiens
YDKILLFHH

SEQ ID NO: 445074 - protein, 9 aa, Homo Sapiens
LDDPEDAVS

SEQ ID NO: 445075 - protein, 9 aa, Homo Sapiens
ALPQQCSGT

SEQ ID NO: 445076 - protein, 9 aa, Homo Sapiens
RQRRMHQQQ

SEQ ID NO: 445077 - protein, 9 aa, Homo Sapiens
EEYTGLRCI

SEQ ID NO: 445078 - protein, 9 aa, Homo Sapiens
KKRKLKNKQ

SEQ ID NO: 445079 - protein, 9 aa, Homo Sapiens
EAYNKINQC

SEQ ID NO: 445080 - protein, 9 aa, Homo Sapiens
FKGGPPRQF

SEQ ID NO: 445081 - protein, 9 aa, Homo Sapiens
EPTWQNFTD

SEQ ID NO: 445082 - protein, 9 aa, Homo Sapiens
NLESYKISV

SEQ ID NO: 445083 - protein, 9 aa, Homo Sapiens
HGHKQQHGL

SEQ ID NO: 445084 - protein, 9 aa, Homo Sapiens
RDILNMENT

SEQ ID NO: 445085 - protein, 9 aa, Homo Sapiens
DVGNIYVVT

SEQ ID NO: 445086 - protein, 9 aa, Homo Sapiens
ELINLQPLI

SEQ ID NO: 445087 - protein, 9 aa, Homo Sapiens
LNLQQNQKT

SEQ ID NO: 445088 - protein, 9 aa, Homo Sapiens
HTYSHEVSL

SEQ ID NO: 445089 - protein, 9 aa, Homo Sapiens
DPDNEGELQ

SEQ ID NO: 445090 - protein, 9 aa, Homo Sapiens
RLCQPPPCY

SEQ ID NO: 445091 - protein, 9 aa, Homo Sapiens
GASGASKPS

SEQ ID NO: 445092 - protein, 9 aa, Homo Sapiens
YFVLAPKTN

SEQ ID NO: 445093 - protein, 9 aa, Homo Sapiens
YMKERALID

SEQ ID NO: 445094 - protein, 9 aa, Homo Sapiens
FMNNISRYL

SEQ ID NO: 445095 - protein, 9 aa, Homo Sapiens
TWPIFTRGQ

SEQ ID NO: 445096 - protein, 9 aa, Homo Sapiens
CACCCPRPP

SEQ ID NO: 445097 - protein, 9 aa, Homo Sapiens
NYLYLYYKG

SEQ ID NO: 445098 - protein, 9 aa, Homo Sapiens
LCFRDEAWS

SEQ ID NO: 445099 - protein, 9 aa, Homo Sapiens
NLEYLDNWT

SEQ ID NO: 445100 - protein, 9 aa, Homo Sapiens
TALLHNNIK

SEQ ID NO: 445101 - protein, 9 aa, Homo Sapiens
DMEDSVEEI

SEQ ID NO: 445102 - protein, 9 aa, Homo Sapiens
ILGNGTIIF

SEQ ID NO: 445103 - protein, 9 aa, Homo Sapiens
NKCSLDQLD

SEQ ID NO: 445104 - protein, 9 aa, Homo Sapiens
EKIIYKISP

SEQ ID NO: 445105 - protein, 9 aa, Homo Sapiens
LITIVAGLV

SEQ ID NO: 445106 - protein, 9 aa, Homo Sapiens
RHNSIQRQL

SEQ ID NO: 445107 - protein, 9 aa, Homo Sapiens
DAEQPTRYD

SEQ ID NO: 445108 - protein, 9 aa, Homo Sapiens
ISDPGVAYF

SEQ ID NO: 445109 - protein, 9 aa, Homo Sapiens
DILKPFFFP

SEQ ID NO: 445110 - protein, 9 aa, Homo Sapiens
IADICKSVA

SEQ ID NO: 445111 - protein, 9 aa, Homo Sapiens
PILISGLFF

SEQ ID NO: 445112 - protein, 9 aa, Homo Sapiens
IWHQKVHTR

SEQ ID NO: 445113 - protein, 9 aa, Homo Sapiens
AVGLSSDKK

SEQ ID NO: 445114 - protein, 9 aa, Homo Sapiens
HQTGLDRNT

SEQ ID NO: 445115 - protein, 9 aa, Homo Sapiens
KSRWKRKVL

SEQ ID NO: 445116 - protein, 9 aa, Homo Sapiens
RMQGPIPEH

SEQ ID NO: 445117 - protein, 9 aa, Homo Sapiens
KHKTGETSR

SEQ ID NO: 445118 - protein, 9 aa, Homo Sapiens
YVIQLVYVE

SEQ ID NO: 445119 - protein, 9 aa, Homo Sapiens
KHRITHTGE

SEQ ID NO: 445120 - protein, 9 aa, Homo Sapiens
LDLKQAQHQ

SEQ ID NO: 445121 - protein, 9 aa, Homo Sapiens
SLQNSLLPQ

SEQ ID NO: 445122 - protein, 9 aa, Homo Sapiens
DIFNKIKFG

SEQ ID NO: 445123 - protein, 9 aa, Homo Sapiens
GHRSDGWNG

SEQ ID NO: 445124 - protein, 9 aa, Homo Sapiens
SIAARKLIC

SEQ ID NO: 445125 - protein, 9 aa, Homo Sapiens
YTNVKFSIK

SEQ ID NO: 445126 - protein, 9 aa, Homo Sapiens
NGANPHCFK

SEQ ID NO: 445127 - protein, 9 aa, Homo Sapiens
VAPLKLWWT

SEQ ID NO: 445128 - protein, 9 aa, Homo Sapiens
LISVSDRNS

SEQ ID NO: 445129 - protein, 9 aa, Homo Sapiens
FFKLIEDTP

SEQ ID NO: 445130 - protein, 9 aa, Homo Sapiens
DILSPNNGN

SEQ ID NO: 445131 - protein, 9 aa, Homo Sapiens
NIIAFYDMA

SEQ ID NO: 445132 - protein, 9 aa, Homo Sapiens
SPAEYFVLV

SEQ ID NO: 445133 - protein, 9 aa, Homo Sapiens
YRAGMTIDN

SEQ ID NO: 445134 - protein, 9 aa, Homo Sapiens
HRTSENTHR

SEQ ID NO: 445135 - protein, 9 aa, Homo Sapiens
KFTRRAFAN

SEQ ID NO: 445136 - protein, 9 aa, Homo Sapiens
STVPNQFQC

SEQ ID NO: 445137 - protein, 9 aa, Homo Sapiens
VCYLWEPIL

SEQ ID NO: 445138 - protein, 9 aa, Homo Sapiens
MIRNAMGVG

SEQ ID NO: 445139 - protein, 9 aa, Homo Sapiens
LLFAIGLTP

SEQ ID NO: 445140 - protein, 9 aa, Homo Sapiens
DECEEINRF

SEQ ID NO: 445141 - protein, 9 aa, Homo Sapiens
FIIGKENRP

SEQ ID NO: 445142 - protein, 9 aa, Homo Sapiens
ELKTQSKSF

SEQ ID NO: 445143 - protein, 9 aa, Homo Sapiens
QIMGETPQN

SEQ ID NO: 445144 - protein, 9 aa, Homo Sapiens
NLSTKYDAP

SEQ ID NO: 445145 - protein, 9 aa, Homo Sapiens
ALNPIIYTL

SEQ ID NO: 445146 - protein, 9 aa, Homo Sapiens
ELEDHITHK

SEQ ID NO: 445147 - protein, 9 aa, Homo Sapiens
AILSDHQII

SEQ ID NO: 445148 - protein, 9 aa, Homo Sapiens
QPLPVKCNH

SEQ ID NO: 445149 - protein, 9 aa, Homo Sapiens
SCLVQEHKK

SEQ ID NO: 445150 - protein, 9 aa, Homo Sapiens
KHMWEWQTV

SEQ ID NO: 445151 - protein, 9 aa, Homo Sapiens
IKAASGHTV

SEQ ID NO: 445152 - protein, 9 aa, Homo Sapiens
GFPTHPELQ

SEQ ID NO: 445153 - protein, 9 aa, Homo Sapiens
MVKKNYVVQ

SEQ ID NO: 445154 - protein, 9 aa, Homo Sapiens
QFQLCKELS

SEQ ID NO: 445155 - protein, 9 aa, Homo Sapiens
SAVDFFVLK

SEQ ID NO: 445156 - protein, 9 aa, Homo Sapiens
CRCNIEYSS

SEQ ID NO: 445157 - protein, 9 aa, Homo Sapiens
ITVTSEFGT

SEQ ID NO: 445158 - protein, 9 aa, Homo Sapiens
GQASRHWSA

SEQ ID NO: 445159 - protein, 9 aa, Homo Sapiens
CVCVEDGKT

SEQ ID NO: 445160 - protein, 9 aa, Homo Sapiens
QLYPVGMYG

SEQ ID NO: 445161 - protein, 9 aa, Homo Sapiens
WMEPFGIAL

SEQ ID NO: 445162 - protein, 9 aa, Homo Sapiens
SSDADPRDP

SEQ ID NO: 445163 - protein, 9 aa, Homo Sapiens
EVTPHRTSE

SEQ ID NO: 445164 - protein, 9 aa, Homo Sapiens
KGQRMLSQP

SEQ ID NO: 445165 - protein, 9 aa, Homo Sapiens
NKAMAAVST

SEQ ID NO: 445166 - protein, 9 aa, Homo Sapiens
EGHPGRGMD

SEQ ID NO: 445167 - protein, 9 aa, Homo Sapiens
QKHKFVDKP

SEQ ID NO: 445168 - protein, 9 aa, Homo Sapiens
EIQNGPYRQ

SEQ ID NO: 445169 - protein, 9 aa, Homo Sapiens
FKASKSGST

SEQ ID NO: 445170 - protein, 9 aa, Homo Sapiens
IHINNKLRW

SEQ ID NO: 445171 - protein, 9 aa, Homo Sapiens
HKTTGHYNH

SEQ ID NO: 445172 - protein, 9 aa, Homo Sapiens
SYQEPIDSH

SEQ ID NO: 445173 - protein, 9 aa, Homo Sapiens
SPKSYQTAK

SEQ ID NO: 445174 - protein, 9 aa, Homo Sapiens
ERDINKFPQ

SEQ ID NO: 445175 - protein, 9 aa, Homo Sapiens
NVEGVPYSA

SEQ ID NO: 445176 - protein, 9 aa, Homo Sapiens
NSCLTRHQI

SEQ ID NO: 445177 - protein, 9 aa, Homo Sapiens
GKIKTIKIC

SEQ ID NO: 445178 - protein, 9 aa, Homo Sapiens
QDKKILEAE

SEQ ID NO: 445179 - protein, 9 aa, Homo Sapiens
CQPHVCFHV

SEQ ID NO: 445180 - protein, 9 aa, Homo Sapiens
PGYDKIVGL

SEQ ID NO: 445181 - protein, 9 aa, Homo Sapiens
SFNQTPIPW

SEQ ID NO: 445182 - protein, 9 aa, Homo Sapiens
MTKVFYIGL

SEQ ID NO: 445183 - protein, 9 aa, Homo Sapiens
VILFYGTLI

SEQ ID NO: 445184 - protein, 9 aa, Homo Sapiens
TDNGTFNLP

SEQ ID NO: 445185 - protein, 9 aa, Homo Sapiens
RDKVSHLQK

SEQ ID NO: 445186 - protein, 9 aa, Homo Sapiens
ISHMVVSGV

SEQ ID NO: 445187 - protein, 9 aa, Homo Sapiens
IKCQNARDN

SEQ ID NO: 445188 - protein, 9 aa, Homo Sapiens
ATIMLNTSL

SEQ ID NO: 445189 - protein, 9 aa, Homo Sapiens
VLTSILTKD

SEQ ID NO: 445190 - protein, 9 aa, Homo Sapiens
LPQLNYKDN

SEQ ID NO: 445191 - protein, 9 aa, Homo Sapiens
AACSKCFAA

SEQ ID NO: 445192 - protein, 9 aa, Homo Sapiens
DQDTNTGSC

SEQ ID NO: 445193 - protein, 9 aa, Homo Sapiens
SRSQFSAKE

SEQ ID NO: 445194 - protein, 9 aa, Homo Sapiens
SKHHPFFQL

SEQ ID NO: 445195 - protein, 9 aa, Homo Sapiens
KSMSCQEVI

SEQ ID NO: 445196 - protein, 9 aa, Homo Sapiens
IRGSSTDIL

SEQ ID NO: 445197 - protein, 9 aa, Homo Sapiens
HSGTLVMIV

SEQ ID NO: 445198 - protein, 9 aa, Homo Sapiens
RHFDFMGTC

SEQ ID NO: 445199 - protein, 9 aa, Homo Sapiens
TLPKNMSYT

SEQ ID NO: 445200 - protein, 9 aa, Homo Sapiens
NHTLSIMAD

SEQ ID NO: 445201 - protein, 9 aa, Homo Sapiens
YFTRHQIIH

SEQ ID NO: 445202 - protein, 9 aa, Homo Sapiens
KCYGLEINK

SEQ ID NO: 445203 - protein, 9 aa, Homo Sapiens
KFSENLESY

SEQ ID NO: 445204 - protein, 9 aa, Homo Sapiens
KYLDDRYKM

SEQ ID NO: 445205 - protein, 9 aa, Homo Sapiens
VVFYDNYLN

SEQ ID NO: 445206 - protein, 9 aa, Homo Sapiens
GYFRVNYYL

SEQ ID NO: 445207 - protein, 9 aa, Homo Sapiens
SQWSLCGGL

SEQ ID NO: 445208 - protein, 9 aa, Homo Sapiens
VCDRTHLKD

SEQ ID NO: 445209 - protein, 9 aa, Homo Sapiens
SLGYAHINF

SEQ ID NO: 445210 - protein, 9 aa, Homo Sapiens
KFIRHQSDQ

SEQ ID NO: 445211 - protein, 9 aa, Homo Sapiens
HKTGETSRA

SEQ ID NO: 445212 - protein, 9 aa, Homo Sapiens
QEDRSLKNI

SEQ ID NO: 445213 - protein, 9 aa, Homo Sapiens
DESSYKEIT

SEQ ID NO: 445214 - protein, 9 aa, Homo Sapiens
PPNVASLTQ

SEQ ID NO: 445215 - protein, 9 aa, Homo Sapiens
KALRASRVL

SEQ ID NO: 445216 - protein, 9 aa, Homo Sapiens
GVDESEKNN

SEQ ID NO: 445217 - protein, 9 aa, Homo Sapiens
KNKTAVKRD

SEQ ID NO: 445218 - protein, 9 aa, Homo Sapiens
LTNHVQIHT

SEQ ID NO: 445219 - protein, 9 aa, Homo Sapiens
IVSHGSHSP

SEQ ID NO: 445220 - protein, 9 aa, Homo Sapiens
NNILLVHYN

SEQ ID NO: 445221 - protein, 9 aa, Homo Sapiens
ELKLEEKNT

SEQ ID NO: 445222 - protein, 9 aa, Homo Sapiens
VNATWDGKD

SEQ ID NO: 445223 - protein, 9 aa, Homo Sapiens
LALTSVYYA

SEQ ID NO: 445224 - protein, 9 aa, Homo Sapiens
GTCVVQVTA

SEQ ID NO: 445225 - protein, 9 aa, Homo Sapiens
GIHLPLPFL

SEQ ID NO: 445226 - protein, 9 aa, Homo Sapiens
WKIQIFLLS

SEQ ID NO: 445227 - protein, 9 aa, Homo Sapiens
SSSTKLSRG

SEQ ID NO: 445228 - protein, 9 aa, Homo Sapiens
GDQTPSDNP

SEQ ID NO: 445229 - protein, 9 aa, Homo Sapiens
CHANCKHKM

SEQ ID NO: 445230 - protein, 9 aa, Homo Sapiens
DLRPKGLDE

SEQ ID NO: 445231 - protein, 9 aa, Homo Sapiens
NQLDFEWKV

SEQ ID NO: 445232 - protein, 9 aa, Homo Sapiens
PKHTMKAFL

SEQ ID NO: 445233 - protein, 9 aa, Homo Sapiens
LTHDGKGIY

SEQ ID NO: 445234 - protein, 9 aa, Homo Sapiens
GHIIVDKFQ

SEQ ID NO: 445235 - protein, 9 aa, Homo Sapiens
IINRVIDRA

SEQ ID NO: 445236 - protein, 9 aa, Homo Sapiens
VETLCRMEQ

SEQ ID NO: 445237 - protein, 9 aa, Homo Sapiens
SAASRNYFT

SEQ ID NO: 445238 - protein, 9 aa, Homo Sapiens
LQGKLLQNW

SEQ ID NO: 445239 - protein, 9 aa, Homo Sapiens
DWRMWRDVT

SEQ ID NO: 445240 - protein, 9 aa, Homo Sapiens
RMARYTAIL

SEQ ID NO: 445241 - protein, 9 aa, Homo Sapiens
LLSYFVELG

SEQ ID NO: 445242 - protein, 9 aa, Homo Sapiens
EKGSVGSDR

SEQ ID NO: 445243 - protein, 9 aa, Homo Sapiens
NVLIIVIIY

SEQ ID NO: 445244 - protein, 9 aa, Homo Sapiens
AFHQRETTF

SEQ ID NO: 445245 - protein, 9 aa, Homo Sapiens
VKYQYVLQS

SEQ ID NO: 445246 - protein, 9 aa, Homo Sapiens
HYSPLFFLT

SEQ ID NO: 445247 - protein, 9 aa, Homo Sapiens
ITSSCYPGY

SEQ ID NO: 445248 - protein, 9 aa, Homo Sapiens
KLWQIKSEQ

SEQ ID NO: 445249 - protein, 9 aa, Homo Sapiens
NKIRMQLQA

SEQ ID NO: 445250 - protein, 9 aa, Homo Sapiens
QRVKISISK

SEQ ID NO: 445251 - protein, 9 aa, Homo Sapiens
EIRDTYQVL

SEQ ID NO: 445252 - protein, 9 aa, Homo Sapiens
CKIIIGLYF

SEQ ID NO: 445253 - protein, 9 aa, Homo Sapiens
LASTPCHSH

SEQ ID NO: 445254 - protein, 9 aa, Homo Sapiens
DAGEEQDLN

SEQ ID NO: 445255 - protein, 9 aa, Homo Sapiens
NRVTLNYTT

SEQ ID NO: 445256 - protein, 9 aa, Homo Sapiens
YYREEELLR

SEQ ID NO: 445257 - protein, 9 aa, Homo Sapiens
HSKVRQPWN

SEQ ID NO: 445258 - protein, 9 aa, Homo Sapiens
LVMEPESCG

SEQ ID NO: 445259 - protein, 9 aa, Homo Sapiens
KYSDYNIKL

SEQ ID NO: 445260 - protein, 9 aa, Homo Sapiens
EFGAGKGKS

SEQ ID NO: 445261 - protein, 9 aa, Homo Sapiens
RRSKKGPRV

SEQ ID NO: 445262 - protein, 9 aa, Homo Sapiens
SRFFCGCGC

SEQ ID NO: 445263 - protein, 9 aa, Homo Sapiens
GPATLGVLM

SEQ ID NO: 445264 - protein, 9 aa, Homo Sapiens
CRSRSETNP

SEQ ID NO: 445265 - protein, 9 aa, Homo Sapiens
ILISGLFFG

SEQ ID NO: 445266 - protein, 9 aa, Homo Sapiens
QDMSSLGKS

SEQ ID NO: 445267 - protein, 9 aa, Homo Sapiens
YGGNVVMLV

SEQ ID NO: 445268 - protein, 9 aa, Homo Sapiens
IIHSGDKPY

SEQ ID NO: 445269 - protein, 9 aa, Homo Sapiens
ELSVPLLIF

SEQ ID NO: 445270 - protein, 9 aa, Homo Sapiens
MFCANALAA

SEQ ID NO: 445271 - protein, 9 aa, Homo Sapiens
PLQPSPGMT

SEQ ID NO: 445272 - protein, 9 aa, Homo Sapiens
GSEHGTSLN

SEQ ID NO: 445273 - protein, 9 aa, Homo Sapiens
VPGSDKVGE

SEQ ID NO: 445274 - protein, 9 aa, Homo Sapiens
FDQDGIGLV

SEQ ID NO: 445275 - protein, 9 aa, Homo Sapiens
CDKGNEVTV

SEQ ID NO: 445276 - protein, 9 aa, Homo Sapiens
NDESHHNFI

SEQ ID NO: 445277 - protein, 9 aa, Homo Sapiens
ILAKIRRKY

SEQ ID NO: 445278 - protein, 9 aa, Homo Sapiens
KVYSCDKNT

SEQ ID NO: 445279 - protein, 9 aa, Homo Sapiens
MAGVIRHMR

SEQ ID NO: 445280 - protein, 9 aa, Homo Sapiens
TPSFLSRYR

SEQ ID NO: 445281 - protein, 9 aa, Homo Sapiens
KTAHYSNVL

SEQ ID NO: 445282 - protein, 9 aa, Homo Sapiens
NSSDTPSTS

SEQ ID NO: 445283 - protein, 9 aa, Homo Sapiens
SISCLKPAQ

SEQ ID NO: 445284 - protein, 9 aa, Homo Sapiens
FQTGIKRRI

SEQ ID NO: 445285 - protein, 9 aa, Homo Sapiens
FVQSLDKNV

SEQ ID NO: 445286 - protein, 9 aa, Homo Sapiens
LESRSKGHR

SEQ ID NO: 445287 - protein, 9 aa, Homo Sapiens
IIQVVLIIH

SEQ ID NO: 445288 - protein, 9 aa, Homo Sapiens
DEREMAKVV

SEQ ID NO: 445289 - protein, 9 aa, Homo Sapiens
DKSPSASPS

SEQ ID NO: 445290 - protein, 9 aa, Homo Sapiens
RIYYEKEPL

SEQ ID NO: 445291 - protein, 9 aa, Homo Sapiens
VIYTKKTEK

SEQ ID NO: 445292 - protein, 9 aa, Homo Sapiens
PYSYVEKDQ

SEQ ID NO: 445293 - protein, 9 aa, Homo Sapiens
YLGFKMFAV

SEQ ID NO: 445294 - protein, 9 aa, Homo Sapiens
TTNPYNYAF

SEQ ID NO: 445295 - protein, 9 aa, Homo Sapiens
NDLAKGRTQ

SEQ ID NO: 445296 - protein, 9 aa, Homo Sapiens
VLSSSPQSG

SEQ ID NO: 445297 - protein, 9 aa, Homo Sapiens
QRPPPYCDD

SEQ ID NO: 445298 - protein, 9 aa, Homo Sapiens
LKELIERVL

SEQ ID NO: 445299 - protein, 9 aa, Homo Sapiens
TKSLGVNTL

SEQ ID NO: 445300 - protein, 9 aa, Homo Sapiens
EKNKVKNKI

SEQ ID NO: 445301 - protein, 9 aa, Homo Sapiens
FVSAKMDDN

SEQ ID NO: 445302 - protein, 9 aa, Homo Sapiens
DIEQSITSE

SEQ ID NO: 445303 - protein, 9 aa, Homo Sapiens
LLAFLIVIT

SEQ ID NO: 445304 - protein, 9 aa, Homo Sapiens
FFKSLEEID

SEQ ID NO: 445305 - protein, 9 aa, Homo Sapiens
EQQNVRESL

SEQ ID NO: 445306 - protein, 9 aa, Homo Sapiens
DCLIRHRAC

SEQ ID NO: 445307 - protein, 9 aa, Homo Sapiens
LDIGNQINV

SEQ ID NO: 445308 - protein, 9 aa, Homo Sapiens
RMSPQHFTS

SEQ ID NO: 445309 - protein, 9 aa, Homo Sapiens
SINFRDIKK

SEQ ID NO: 445310 - protein, 9 aa, Homo Sapiens
CGRKDHLTR

SEQ ID NO: 445311 - protein, 9 aa, Homo Sapiens
LPRQNSGST

SEQ ID NO: 445312 - protein, 9 aa, Homo Sapiens
VPAMQLTSK

SEQ ID NO: 445313 - protein, 9 aa, Homo Sapiens
YEGLEMKSA

SEQ ID NO: 445314 - protein, 9 aa, Homo Sapiens
NAIHKDYIT

SEQ ID NO: 445315 - protein, 9 aa, Homo Sapiens
KMFTTKKVI

SEQ ID NO: 445316 - protein, 9 aa, Homo Sapiens
PLKLWWTIA

SEQ ID NO: 445317 - protein, 9 aa, Homo Sapiens
QAKVDALIY

SEQ ID NO: 445318 - protein, 9 aa, Homo Sapiens
SALTIHKII

SEQ ID NO: 445319 - protein, 9 aa, Homo Sapiens
IGTPNEDTW

SEQ ID NO: 445320 - protein, 9 aa, Homo Sapiens
RFLASTPCH

SEQ ID NO: 445321 - protein, 9 aa, Homo Sapiens
VPMLNPQYI

SEQ ID NO: 445322 - protein, 9 aa, Homo Sapiens
AHINFQQPA

SEQ ID NO: 445323 - protein, 9 aa, Homo Sapiens
KNIVPRLGM

SEQ ID NO: 445324 - protein, 9 aa, Homo Sapiens
TATLAAERK

SEQ ID NO: 445325 - protein, 9 aa, Homo Sapiens
NKVMNSYFI

SEQ ID NO: 445326 - protein, 9 aa, Homo Sapiens
AQGKSLKEF

SEQ ID NO: 445327 - protein, 9 aa, Homo Sapiens
NVIHKVAFL

SEQ ID NO: 445328 - protein, 9 aa, Homo Sapiens
PGASNLFYW

SEQ ID NO: 445329 - protein, 9 aa, Homo Sapiens
EQSSKDIWA

SEQ ID NO: 445330 - protein, 9 aa, Homo Sapiens
PRFDLEKYN

SEQ ID NO: 445331 - protein, 9 aa, Homo Sapiens
NVIAWNRNT

SEQ ID NO: 445332 - protein, 9 aa, Homo Sapiens
CDGQCHISG

SEQ ID NO: 445333 - protein, 9 aa, Homo Sapiens
FAVTAQGDG

SEQ ID NO: 445334 - protein, 9 aa, Homo Sapiens
GDDGLCVFE

SEQ ID NO: 445335 - protein, 9 aa, Homo Sapiens
SDKRVQPLL

SEQ ID NO: 445336 - protein, 9 aa, Homo Sapiens
QSPLDDTKD

SEQ ID NO: 445337 - protein, 9 aa, Homo Sapiens
KILCKLSLE

SEQ ID NO: 445338 - protein, 9 aa, Homo Sapiens
GLIAFSVGK

SEQ ID NO: 445339 - protein, 9 aa, Homo Sapiens
LSDYEKRKE

SEQ ID NO: 445340 - protein, 9 aa, Homo Sapiens
AWTTTPWTR

SEQ ID NO: 445341 - protein, 9 aa, Homo Sapiens
EGLKAHTYS

SEQ ID NO: 445342 - protein, 9 aa, Homo Sapiens
FDPEILFNV

SEQ ID NO: 445343 - protein, 9 aa, Homo Sapiens
LSPMSQRHV

SEQ ID NO: 445344 - protein, 9 aa, Homo Sapiens
RNPVSVSRS

SEQ ID NO: 445345 - protein, 9 aa, Homo Sapiens
EADLVLVKE

SEQ ID NO: 445346 - protein, 9 aa, Homo Sapiens
RIYCEDKHT

SEQ ID NO: 445347 - protein, 9 aa, Homo Sapiens
SSPTHHQLH

SEQ ID NO: 445348 - protein, 9 aa, Homo Sapiens
SSYKEITHS

SEQ ID NO: 445349 - protein, 9 aa, Homo Sapiens
DVKIEQAKR

SEQ ID NO: 445350 - protein, 9 aa, Homo Sapiens
TSVVQIRCF

SEQ ID NO: 445351 - protein, 9 aa, Homo Sapiens
LSSIKDAVM

SEQ ID NO: 445352 - protein, 9 aa, Homo Sapiens
DSVDIPKAR

SEQ ID NO: 445353 - protein, 9 aa, Homo Sapiens
LLVMKNDTD

SEQ ID NO: 445354 - protein, 9 aa, Homo Sapiens
LLVTDNFCL

SEQ ID NO: 445355 - protein, 9 aa, Homo Sapiens
DSGISTEAF

SEQ ID NO: 445356 - protein, 9 aa, Homo Sapiens
AKDLVENTF

SEQ ID NO: 445357 - protein, 9 aa, Homo Sapiens
CECNHVEKS

SEQ ID NO: 445358 - protein, 9 aa, Homo Sapiens
KDLTFSISE

SEQ ID NO: 445359 - protein, 9 aa, Homo Sapiens
PSHSLLLLQ

SEQ ID NO: 445360 - protein, 9 aa, Homo Sapiens
YATQLMNEI

SEQ ID NO: 445361 - protein, 9 aa, Homo Sapiens
KTFYQTSVE

SEQ ID NO: 445362 - protein, 9 aa, Homo Sapiens
SEHYNVARG

SEQ ID NO: 445363 - protein, 9 aa, Homo Sapiens
EEAWRFLIY

SEQ ID NO: 445364 - protein, 9 aa, Homo Sapiens
AGQNKQHYI

SEQ ID NO: 445365 - protein, 9 aa, Homo Sapiens
KSAHKDSDA

SEQ ID NO: 445366 - protein, 9 aa, Homo Sapiens
GNTRYGGWN

SEQ ID NO: 445367 - protein, 9 aa, Homo Sapiens
FGLNEAGLE

SEQ ID NO: 445368 - protein, 9 aa, Homo Sapiens
SAYEPDRNA

SEQ ID NO: 445369 - protein, 9 aa, Homo Sapiens
ETIRLFLVE

SEQ ID NO: 445370 - protein, 9 aa, Homo Sapiens
DLEEEASLK

SEQ ID NO: 445371 - protein, 9 aa, Homo Sapiens
CDSDILPLH

SEQ ID NO: 445372 - protein, 9 aa, Homo Sapiens
LVTVQNERK

SEQ ID NO: 445373 - protein, 9 aa, Homo Sapiens
DDNAPVTER

SEQ ID NO: 445374 - protein, 9 aa, Homo Sapiens
FFIFLPNTI

SEQ ID NO: 445375 - protein, 9 aa, Homo Sapiens
LKATLTSRN

SEQ ID NO: 445376 - protein, 9 aa, Homo Sapiens
QFGQPGTGN

SEQ ID NO: 445377 - protein, 9 aa, Homo Sapiens
VLWGWSLPY

SEQ ID NO: 445378 - protein, 9 aa, Homo Sapiens
SLCLLLSLY

SEQ ID NO: 445379 - protein, 9 aa, Homo Sapiens
VSGQDESSY

SEQ ID NO: 445380 - protein, 9 aa, Homo Sapiens
GSDKVGEDS

SEQ ID NO: 445381 - protein, 9 aa, Homo Sapiens
TMEVEVKDG

SEQ ID NO: 445382 - protein, 9 aa, Homo Sapiens
NVGWNGIKP

SEQ ID NO: 445383 - protein, 9 aa, Homo Sapiens
GWSIDVGDG

SEQ ID NO: 445384 - protein, 9 aa, Homo Sapiens
MQLTLHKIN

SEQ ID NO: 445385 - protein, 9 aa, Homo Sapiens
KRIDGGITG

SEQ ID NO: 445386 - protein, 9 aa, Homo Sapiens
WKRLDPAQI

SEQ ID NO: 445387 - protein, 9 aa, Homo Sapiens
VFNSSYVVG

SEQ ID NO: 445388 - protein, 9 aa, Homo Sapiens
KLTVEDFAV

SEQ ID NO: 445389 - protein, 9 aa, Homo Sapiens
NNPTAFYLC

SEQ ID NO: 445390 - protein, 9 aa, Homo Sapiens
RLSIIHHDQ

SEQ ID NO: 445391 - protein, 9 aa, Homo Sapiens
SEACYLVCR

SEQ ID NO: 445392 - protein, 9 aa, Homo Sapiens
LWAGCLSDP

SEQ ID NO: 445393 - protein, 9 aa, Homo Sapiens
YIQKIPEQH

SEQ ID NO: 445394 - protein, 9 aa, Homo Sapiens
KFYLSFENA

SEQ ID NO: 445395 - protein, 9 aa, Homo Sapiens
LEKLNIRGC

SEQ ID NO: 445396 - protein, 9 aa, Homo Sapiens
CQQKLPNGL

SEQ ID NO: 445397 - protein, 9 aa, Homo Sapiens
LFNRWKSLQ

SEQ ID NO: 445398 - protein, 9 aa, Homo Sapiens
KILSDDNFN

SEQ ID NO: 445399 - protein, 9 aa, Homo Sapiens
DNFFTLTTY

SEQ ID NO: 445400 - protein, 9 aa, Homo Sapiens
SDPENWDRT

SEQ ID NO: 445401 - protein, 9 aa, Homo Sapiens
RHVLKVCNH

SEQ ID NO: 445402 - protein, 9 aa, Homo Sapiens
NGYGVKFKE

SEQ ID NO: 445403 - protein, 9 aa, Homo Sapiens
ASSTQYSAM

SEQ ID NO: 445404 - protein, 9 aa, Homo Sapiens
GRQKYKKED

SEQ ID NO: 445405 - protein, 9 aa, Homo Sapiens
RTLVVFVSI

SEQ ID NO: 445406 - protein, 9 aa, Homo Sapiens
REALLLLEG

SEQ ID NO: 445407 - protein, 9 aa, Homo Sapiens
LPFPDGMDN

SEQ ID NO: 445408 - protein, 9 aa, Homo Sapiens
VNAITIYGV

SEQ ID NO: 445409 - protein, 9 aa, Homo Sapiens
LQIPLKCPN

SEQ ID NO: 445410 - protein, 9 aa, Homo Sapiens
QRQKEQNKK

SEQ ID NO: 445411 - protein, 9 aa, Homo Sapiens
DWPLNEKIT

SEQ ID NO: 445412 - protein, 9 aa, Homo Sapiens
GVLVIFLLC

SEQ ID NO: 445413 - protein, 9 aa, Homo Sapiens
TIASKKIKY

SEQ ID NO: 445414 - protein, 9 aa, Homo Sapiens
KRKMYDQHG

SEQ ID NO: 445415 - protein, 9 aa, Homo Sapiens
MVEGTAWKM

SEQ ID NO: 445416 - protein, 9 aa, Homo Sapiens
EQEAHKKIW

SEQ ID NO: 445417 - protein, 9 aa, Homo Sapiens
DKSPMKNVS

SEQ ID NO: 445418 - protein, 9 aa, Homo Sapiens
CLCLTSLCC

SEQ ID NO: 445419 - protein, 9 aa, Homo Sapiens
SNVKFDLKV

SEQ ID NO: 445420 - protein, 9 aa, Homo Sapiens
VKYQNQHTM

SEQ ID NO: 445421 - protein, 9 aa, Homo Sapiens
SRNRSLGQR

SEQ ID NO: 445422 - protein, 9 aa, Homo Sapiens
EDYLIIMIA

SEQ ID NO: 445423 - protein, 9 aa, Homo Sapiens
AERTKLLWI

SEQ ID NO: 445424 - protein, 9 aa, Homo Sapiens
FYWIDRVDG

SEQ ID NO: 445425 - protein, 9 aa, Homo Sapiens
HRIDIIEDY

SEQ ID NO: 445426 - protein, 9 aa, Homo Sapiens
NPKMVKFIL

SEQ ID NO: 445427 - protein, 9 aa, Homo Sapiens
FGLEMASAQ

SEQ ID NO: 445428 - protein, 9 aa, Homo Sapiens
RKQFQVLVD

SEQ ID NO: 445429 - protein, 9 aa, Homo Sapiens
FCVLLAIFT

SEQ ID NO: 445430 - protein, 9 aa, Homo Sapiens
KELKASESF

SEQ ID NO: 445431 - protein, 9 aa, Homo Sapiens
ETSENNTKE

SEQ ID NO: 445432 - protein, 9 aa, Homo Sapiens
EAIDSAENC

SEQ ID NO: 445433 - protein, 9 aa, Homo Sapiens
KMVKFILEK

SEQ ID NO: 445434 - protein, 9 aa, Homo Sapiens
NEWSLNIRK

SEQ ID NO: 445435 - protein, 9 aa, Homo Sapiens
STRNCTLLD

SEQ ID NO: 445436 - protein, 9 aa, Homo Sapiens
RGKHQATAH

SEQ ID NO: 445437 - protein, 9 aa, Homo Sapiens
GIIVVIWIQ

SEQ ID NO: 445438 - protein, 9 aa, Homo Sapiens
IGIIIRKWN

SEQ ID NO: 445439 - protein, 9 aa, Homo Sapiens
TGVSRTHKL

SEQ ID NO: 445440 - protein, 9 aa, Homo Sapiens
GLNLQEGEL

SEQ ID NO: 445441 - protein, 9 aa, Homo Sapiens
KDEKKEDYK

SEQ ID NO: 445442 - protein, 9 aa, Homo Sapiens
PQLQMASPE

SEQ ID NO: 445443 - protein, 9 aa, Homo Sapiens
VYAIFGLYD

SEQ ID NO: 445444 - protein, 9 aa, Homo Sapiens
KCKSRASNA

SEQ ID NO: 445445 - protein, 9 aa, Homo Sapiens
YVCIAMEVL

SEQ ID NO: 445446 - protein, 9 aa, Homo Sapiens
SNQLYLHFC

SEQ ID NO: 445447 - protein, 9 aa, Homo Sapiens
GDSEESLRK

SEQ ID NO: 445448 - protein, 9 aa, Homo Sapiens
PHMLVELAP

SEQ ID NO: 445449 - protein, 9 aa, Homo Sapiens
RCVARVDLR

SEQ ID NO: 445450 - protein, 9 aa, Homo Sapiens
PLGPECLCP

SEQ ID NO: 445451 - protein, 9 aa, Homo Sapiens
ENSHEDKSP

SEQ ID NO: 445452 - protein, 9 aa, Homo Sapiens
KRRHPLSLP

SEQ ID NO: 445453 - protein, 9 aa, Homo Sapiens
NKQKMDTLP

SEQ ID NO: 445454 - protein, 9 aa, Homo Sapiens
PPSEHSPDQ

SEQ ID NO: 445455 - protein, 9 aa, Homo Sapiens
CADTSPAPI

SEQ ID NO: 445456 - protein, 9 aa, Homo Sapiens
QVNRIDWPV

SEQ ID NO: 445457 - protein, 9 aa, Homo Sapiens
NVNAITIYG

SEQ ID NO: 445458 - protein, 9 aa, Homo Sapiens
NNLNPKKFS

SEQ ID NO: 445459 - protein, 9 aa, Homo Sapiens
MGETPQNLS

SEQ ID NO: 445460 - protein, 9 aa, Homo Sapiens
GCIDHLELL

SEQ ID NO: 445461 - protein, 9 aa, Homo Sapiens
RASRVLRPL

SEQ ID NO: 445462 - protein, 9 aa, Homo Sapiens
TDSTSATVL

SEQ ID NO: 445463 - protein, 9 aa, Homo Sapiens
FFSSGLLCS

SEQ ID NO: 445464 - protein, 9 aa, Homo Sapiens
VKLRIIAGQ

SEQ ID NO: 445465 - protein, 9 aa, Homo Sapiens
AHGHDAVQQ

SEQ ID NO: 445466 - protein, 9 aa, Homo Sapiens
KWQLEIAQG

SEQ ID NO: 445467 - protein, 9 aa, Homo Sapiens
PKDTINVLS

SEQ ID NO: 445468 - protein, 9 aa, Homo Sapiens
KAFHQKTAL

SEQ ID NO: 445469 - protein, 9 aa, Homo Sapiens
ECGQCIINS

SEQ ID NO: 445470 - protein, 9 aa, Homo Sapiens
KLFEVYEKI

SEQ ID NO: 445471 - protein, 9 aa, Homo Sapiens
CLQLAPELK

SEQ ID NO: 445472 - protein, 9 aa, Homo Sapiens
KIVNYIESN

SEQ ID NO: 445473 - protein, 9 aa, Homo Sapiens
KVTQQDAVC

SEQ ID NO: 445474 - protein, 9 aa, Homo Sapiens
CKPLLTLDL

SEQ ID NO: 445475 - protein, 9 aa, Homo Sapiens
KLRIIAGQM

SEQ ID NO: 445476 - protein, 9 aa, Homo Sapiens
RQQNVRARK

SEQ ID NO: 445477 - protein, 9 aa, Homo Sapiens
LGHYQEVTS

SEQ ID NO: 445478 - protein, 9 aa, Homo Sapiens
PGFLREAFT

SEQ ID NO: 445479 - protein, 9 aa, Homo Sapiens
QICPAFFLS

SEQ ID NO: 445480 - protein, 9 aa, Homo Sapiens
TKSNYINSS

SEQ ID NO: 445481 - protein, 9 aa, Homo Sapiens
KVIYKNKMQ

SEQ ID NO: 445482 - protein, 9 aa, Homo Sapiens
AGWHKLLIE

SEQ ID NO: 445483 - protein, 9 aa, Homo Sapiens
QALKDRGIS

SEQ ID NO: 445484 - protein, 9 aa, Homo Sapiens
INLAIDGAD

SEQ ID NO: 445485 - protein, 9 aa, Homo Sapiens
KVQDYDRRA

SEQ ID NO: 445486 - protein, 9 aa, Homo Sapiens
DCINICTGQ

SEQ ID NO: 445487 - protein, 9 aa, Homo Sapiens
GRFTSVGTG

SEQ ID NO: 445488 - protein, 9 aa, Homo Sapiens
PDIYHGICL

SEQ ID NO: 445489 - protein, 9 aa, Homo Sapiens
MEECEKRKI

SEQ ID NO: 445490 - protein, 9 aa, Homo Sapiens
RVVFLAINY

SEQ ID NO: 445491 - protein, 9 aa, Homo Sapiens
FEALTKTQL

SEQ ID NO: 445492 - protein, 9 aa, Homo Sapiens
IVHQDLKPE

SEQ ID NO: 445493 - protein, 9 aa, Homo Sapiens
LEGCTRSKV

SEQ ID NO: 445494 - protein, 9 aa, Homo Sapiens
AKWQLEIAQ

SEQ ID NO: 445495 - protein, 9 aa, Homo Sapiens
RINVITMQT

SEQ ID NO: 445496 - protein, 9 aa, Homo Sapiens
NKYGTALNL

SEQ ID NO: 445497 - protein, 9 aa, Homo Sapiens
ADKPSVSQT

SEQ ID NO: 445498 - protein, 9 aa, Homo Sapiens
VSTISAFCA

SEQ ID NO: 445499 - protein, 9 aa, Homo Sapiens
EQGRFLQDT

SEQ ID NO: 445500 - protein, 9 aa, Homo Sapiens
TMEKYVREW

SEQ ID NO: 445501 - protein, 9 aa, Homo Sapiens
FPARKAVAM

SEQ ID NO: 445502 - protein, 9 aa, Homo Sapiens
CPLNFGSYA

SEQ ID NO: 445503 - protein, 9 aa, Homo Sapiens
FMVTDNTYL

SEQ ID NO: 445504 - protein, 9 aa, Homo Sapiens
GNSRVTYAL

SEQ ID NO: 445505 - protein, 9 aa, Homo Sapiens
RRHLQLAVS

SEQ ID NO: 445506 - protein, 9 aa, Homo Sapiens
QHVVQELTK

SEQ ID NO: 445507 - protein, 9 aa, Homo Sapiens
GNINNYKKD

SEQ ID NO: 445508 - protein, 9 aa, Homo Sapiens
TESQETQIS

SEQ ID NO: 445509 - protein, 9 aa, Homo Sapiens
DTINCRDCF

SEQ ID NO: 445510 - protein, 9 aa, Homo Sapiens
LVLFYHTRI

SEQ ID NO: 445511 - protein, 9 aa, Homo Sapiens
FISRHRLQH

SEQ ID NO: 445512 - protein, 9 aa, Homo Sapiens
DIEIVCRVF

SEQ ID NO: 445513 - protein, 9 aa, Homo Sapiens
LYPYKKLDY

SEQ ID NO: 445514 - protein, 9 aa, Homo Sapiens
FMDIFSLPK

SEQ ID NO: 445515 - protein, 9 aa, Homo Sapiens
FVTQVNVGL

SEQ ID NO: 445516 - protein, 9 aa, Homo Sapiens
NKTSFFFEA

SEQ ID NO: 445517 - protein, 9 aa, Homo Sapiens
LYCEPHKII

SEQ ID NO: 445518 - protein, 9 aa, Homo Sapiens
TQTPVEYPM

SEQ ID NO: 445519 - protein, 9 aa, Homo Sapiens
FALHSNRHS

SEQ ID NO: 445520 - protein, 9 aa, Homo Sapiens
PSMDKIDQI

SEQ ID NO: 445521 - protein, 9 aa, Homo Sapiens
FRCNWIIVL

SEQ ID NO: 445522 - protein, 9 aa, Homo Sapiens
IDFNWWHYE

SEQ ID NO: 445523 - protein, 9 aa, Homo Sapiens
KANECYSGL

SEQ ID NO: 445524 - protein, 9 aa, Homo Sapiens
NNVFPDGKP

SEQ ID NO: 445525 - protein, 9 aa, Homo Sapiens
GELQQPGIT

SEQ ID NO: 445526 - protein, 9 aa, Homo Sapiens
SGNKYVFTK

SEQ ID NO: 445527 - protein, 9 aa, Homo Sapiens
SRHWSASLQ

SEQ ID NO: 445528 - protein, 9 aa, Homo Sapiens
VWRNKEMDS

SEQ ID NO: 445529 - protein, 9 aa, Homo Sapiens
NDKVDPVAA

SEQ ID NO: 445530 - protein, 9 aa, Homo Sapiens
LDSVDIPKA

SEQ ID NO: 445531 - protein, 9 aa, Homo Sapiens
LYAQNVVQI

SEQ ID NO: 445532 - protein, 9 aa, Homo Sapiens
ELSSEKGSV

SEQ ID NO: 445533 - protein, 9 aa, Homo Sapiens
NKIGTYFRV

SEQ ID NO: 445534 - protein, 9 aa, Homo Sapiens
FSGVENYNE

SEQ ID NO: 445535 - protein, 9 aa, Homo Sapiens
GYGVKFKEF

SEQ ID NO: 445536 - protein, 9 aa, Homo Sapiens
SDVGTCVVQ

SEQ ID NO: 445537 - protein, 9 aa, Homo Sapiens
KVIPFTTFT

SEQ ID NO: 445538 - protein, 9 aa, Homo Sapiens
LNITNKQKM

SEQ ID NO: 445539 - protein, 9 aa, Homo Sapiens
RIIGLEKLL

SEQ ID NO: 445540 - protein, 9 aa, Homo Sapiens
QLIPALVKV

SEQ ID NO: 445541 - protein, 9 aa, Homo Sapiens
GFFKQTVQN

SEQ ID NO: 445542 - protein, 9 aa, Homo Sapiens
DNESPSSGR

SEQ ID NO: 445543 - protein, 9 aa, Homo Sapiens
KNAFYLLGK

SEQ ID NO: 445544 - protein, 9 aa, Homo Sapiens
FLLAVSFEE

SEQ ID NO: 445545 - protein, 9 aa, Homo Sapiens
VLSFATIML

SEQ ID NO: 445546 - protein, 9 aa, Homo Sapiens
LANINLALE

SEQ ID NO: 445547 - protein, 9 aa, Homo Sapiens
TLTSQYIKL

SEQ ID NO: 445548 - protein, 9 aa, Homo Sapiens
RNENNRPRR

SEQ ID NO: 445549 - protein, 9 aa, Homo Sapiens
MIIRHLDEC

SEQ ID NO: 445550 - protein, 9 aa, Homo Sapiens
DQRLNLQRR

SEQ ID NO: 445551 - protein, 9 aa, Homo Sapiens
IELQKKIQE

SEQ ID NO: 445552 - protein, 9 aa, Homo Sapiens
TVFQIVPKF

SEQ ID NO: 445553 - protein, 9 aa, Homo Sapiens
QLEAQCQKP

SEQ ID NO: 445554 - protein, 9 aa, Homo Sapiens
ISNKYINST

SEQ ID NO: 445555 - protein, 9 aa, Homo Sapiens
PVCYGTCQP

SEQ ID NO: 445556 - protein, 9 aa, Homo Sapiens
KTCGLMTAF

SEQ ID NO: 445557 - protein, 9 aa, Homo Sapiens
SIYYNEQSK

SEQ ID NO: 445558 - protein, 9 aa, Homo Sapiens
SNQDWGYFD

SEQ ID NO: 445559 - protein, 9 aa, Homo Sapiens
KHIEKLTTA

SEQ ID NO: 445560 - protein, 9 aa, Homo Sapiens
LTLHKINHT

SEQ ID NO: 445561 - protein, 9 aa, Homo Sapiens
RLEPDSSPL

SEQ ID NO: 445562 - protein, 9 aa, Homo Sapiens
KKKNKLVIK

SEQ ID NO: 445563 - protein, 9 aa, Homo Sapiens
ILGMCRPIK

SEQ ID NO: 445564 - protein, 9 aa, Homo Sapiens
EACYLVCRK

SEQ ID NO: 445565 - protein, 9 aa, Homo Sapiens
LDMINGLFD

SEQ ID NO: 445566 - protein, 9 aa, Homo Sapiens
MGRGEKAIE

SEQ ID NO: 445567 - protein, 9 aa, Homo Sapiens
KMTPLCIAL

SEQ ID NO: 445568 - protein, 9 aa, Homo Sapiens
DKVRFLDQQ

SEQ ID NO: 445569 - protein, 9 aa, Homo Sapiens
SISCCNCEP

SEQ ID NO: 445570 - protein, 9 aa, Homo Sapiens
RLMSELEKA

SEQ ID NO: 445571 - protein, 9 aa, Homo Sapiens
CLKLNKTPF

SEQ ID NO: 445572 - protein, 9 aa, Homo Sapiens
TGQPFVVLN

SEQ ID NO: 445573 - protein, 9 aa, Homo Sapiens
QYSWNDFAD

SEQ ID NO: 445574 - protein, 9 aa, Homo Sapiens
QIIFTFQLP

SEQ ID NO: 445575 - protein, 9 aa, Homo Sapiens
CGECHSALS

SEQ ID NO: 445576 - protein, 9 aa, Homo Sapiens
YICGCEYGT

SEQ ID NO: 445577 - protein, 9 aa, Homo Sapiens
LLGAYYHNG

SEQ ID NO: 445578 - protein, 9 aa, Homo Sapiens
TGKWLLLLE

SEQ ID NO: 445579 - protein, 9 aa, Homo Sapiens
RLGIKMGKQ

SEQ ID NO: 445580 - protein, 9 aa, Homo Sapiens
HNYVTRYCQ

SEQ ID NO: 445581 - protein, 9 aa, Homo Sapiens
QPPQQLLQT

SEQ ID NO: 445582 - protein, 9 aa, Homo Sapiens
AVAGYPDPY

SEQ ID NO: 445583 - protein, 9 aa, Homo Sapiens
PPKSEQFSS

SEQ ID NO: 445584 - protein, 9 aa, Homo Sapiens
GYETTISVL

SEQ ID NO: 445585 - protein, 9 aa, Homo Sapiens
IKAENEPEN

SEQ ID NO: 445586 - protein, 9 aa, Homo Sapiens
AISNILSLL

SEQ ID NO: 445587 - protein, 9 aa, Homo Sapiens
FPIQLVNTH

SEQ ID NO: 445588 - protein, 9 aa, Homo Sapiens
VTFRGEPVE

SEQ ID NO: 445589 - protein, 9 aa, Homo Sapiens
LEDIASGLE

SEQ ID NO: 445590 - protein, 9 aa, Homo Sapiens
NHHKTTGHY

SEQ ID NO: 445591 - protein, 9 aa, Homo Sapiens
GKKGEGAHN

SEQ ID NO: 445592 - protein, 9 aa, Homo Sapiens
TCGPGSRLD

SEQ ID NO: 445593 - protein, 9 aa, Homo Sapiens
GLPNDRLFA

SEQ ID NO: 445594 - protein, 9 aa, Homo Sapiens
INHSCISSG

SEQ ID NO: 445595 - protein, 9 aa, Homo Sapiens
KDALDLGKY

SEQ ID NO: 445596 - protein, 9 aa, Homo Sapiens
CSTQVSAVH

SEQ ID NO: 445597 - protein, 9 aa, Homo Sapiens
NPEDCSDSS

SEQ ID NO: 445598 - protein, 9 aa, Homo Sapiens
QWNKVSSGS

SEQ ID NO: 445599 - protein, 9 aa, Homo Sapiens
YNVARGVQK

SEQ ID NO: 445600 - protein, 9 aa, Homo Sapiens
IIDNSLSLN

SEQ ID NO: 445601 - protein, 9 aa, Homo Sapiens
RDGICHGLW

SEQ ID NO: 445602 - protein, 9 aa, Homo Sapiens
GVPEFILVG

SEQ ID NO: 445603 - protein, 9 aa, Homo Sapiens
WLAMSLACY

SEQ ID NO: 445604 - protein, 9 aa, Homo Sapiens
VIAWNRNTG

SEQ ID NO: 445605 - protein, 9 aa, Homo Sapiens
NKIHTVDKP

SEQ ID NO: 445606 - protein, 9 aa, Homo Sapiens
RKFNLYVIE

SEQ ID NO: 445607 - protein, 9 aa, Homo Sapiens
VDFWWCRLR

SEQ ID NO: 445608 - protein, 9 aa, Homo Sapiens
NAINRINPD

SEQ ID NO: 445609 - protein, 9 aa, Homo Sapiens
WNPFLYPYK

SEQ ID NO: 445610 - protein, 9 aa, Homo Sapiens
VIDPSPFTV

SEQ ID NO: 445611 - protein, 9 aa, Homo Sapiens
LWAWDCLQG

SEQ ID NO: 445612 - protein, 9 aa, Homo Sapiens
AMSATRAVS

SEQ ID NO: 445613 - protein, 9 aa, Homo Sapiens
PTPNYKGKY

SEQ ID NO: 445614 - protein, 9 aa, Homo Sapiens
QEFTDSDIL

SEQ ID NO: 445615 - protein, 9 aa, Homo Sapiens
YKARIQYFV

SEQ ID NO: 445616 - protein, 9 aa, Homo Sapiens
GNGLFFSAV

SEQ ID NO: 445617 - protein, 9 aa, Homo Sapiens
PGAAQTTSQ

SEQ ID NO: 445618 - protein, 9 aa, Homo Sapiens
EQISFQWSP

SEQ ID NO: 445619 - protein, 9 aa, Homo Sapiens
RNVGNTCYM

SEQ ID NO: 445620 - protein, 9 aa, Homo Sapiens
EYNLELNDV

SEQ ID NO: 445621 - protein, 9 aa, Homo Sapiens
EWKFVGGSG

SEQ ID NO: 445622 - protein, 9 aa, Homo Sapiens
YFRVNYYLR

SEQ ID NO: 445623 - protein, 9 aa, Homo Sapiens
TLYVLISFI

SEQ ID NO: 445624 - protein, 9 aa, Homo Sapiens
VDTPGYGDT

SEQ ID NO: 445625 - protein, 9 aa, Homo Sapiens
LNKYFNAGH

SEQ ID NO: 445626 - protein, 9 aa, Homo Sapiens
PNDCHGQGC

SEQ ID NO: 445627 - protein, 9 aa, Homo Sapiens
LSDGLVHDP

SEQ ID NO: 445628 - protein, 9 aa, Homo Sapiens
LDIFAYALQ

SEQ ID NO: 445629 - protein, 9 aa, Homo Sapiens
DILPLHNWL

SEQ ID NO: 445630 - protein, 9 aa, Homo Sapiens
STFHNMYHS

SEQ ID NO: 445631 - protein, 9 aa, Homo Sapiens
ERPYPCHNC

SEQ ID NO: 445632 - protein, 9 aa, Homo Sapiens
TSFKVKDIH

SEQ ID NO: 445633 - protein, 9 aa, Homo Sapiens
QSVHKGVEH

SEQ ID NO: 445634 - protein, 9 aa, Homo Sapiens
HLSKAFHSK

SEQ ID NO: 445635 - protein, 9 aa, Homo Sapiens
CNIEVKHFP

SEQ ID NO: 445636 - protein, 9 aa, Homo Sapiens
ECFFLWESL

SEQ ID NO: 445637 - protein, 9 aa, Homo Sapiens
HLWKLLDWH

SEQ ID NO: 445638 - protein, 9 aa, Homo Sapiens
EDGEYKCGA

SEQ ID NO: 445639 - protein, 9 aa, Homo Sapiens
TSEIKDLNI

SEQ ID NO: 445640 - protein, 9 aa, Homo Sapiens
PFSIIAGFC

SEQ ID NO: 445641 - protein, 9 aa, Homo Sapiens
MLKSTMKKE

SEQ ID NO: 445642 - protein, 9 aa, Homo Sapiens
ENYFNVIHK

SEQ ID NO: 445643 - protein, 9 aa, Homo Sapiens
LCVRKLEFI

SEQ ID NO: 445644 - protein, 9 aa, Homo Sapiens
NYVSLMKRG

SEQ ID NO: 445645 - protein, 9 aa, Homo Sapiens
ITFPAGVSP

SEQ ID NO: 445646 - protein, 9 aa, Homo Sapiens
EWQKEGTPG

SEQ ID NO: 445647 - protein, 9 aa, Homo Sapiens
ERGWMWNQF

SEQ ID NO: 445648 - protein, 9 aa, Homo Sapiens
HEKAPLVKL

SEQ ID NO: 445649 - protein, 9 aa, Homo Sapiens
PYKCSICGK

SEQ ID NO: 445650 - protein, 9 aa, Homo Sapiens
DPSSLASDQ

SEQ ID NO: 445651 - protein, 9 aa, Homo Sapiens
RKRTIYHFS

SEQ ID NO: 445652 - protein, 9 aa, Homo Sapiens
AKINICMYS

SEQ ID NO: 445653 - protein, 9 aa, Homo Sapiens
PLMNNFDTS

SEQ ID NO: 445654 - protein, 9 aa, Homo Sapiens
LAIIILNNY

SEQ ID NO: 445655 - protein, 9 aa, Homo Sapiens
LCMFKIPKE

SEQ ID NO: 445656 - protein, 9 aa, Homo Sapiens
EVLMVRFTS

SEQ ID NO: 445657 - protein, 9 aa, Homo Sapiens
TSLISQTAQ

SEQ ID NO: 445658 - protein, 9 aa, Homo Sapiens
RYKMEDGKV

SEQ ID NO: 445659 - protein, 9 aa, Homo Sapiens
SNDGSVSCS

SEQ ID NO: 445660 - protein, 9 aa, Homo Sapiens
NKGIKEIKV

SEQ ID NO: 445661 - protein, 9 aa, Homo Sapiens
LGAIDDSAK

SEQ ID NO: 445662 - protein, 9 aa, Homo Sapiens
RQNPSHAEH

SEQ ID NO: 445663 - protein, 9 aa, Homo Sapiens
DHNFVTPSG

SEQ ID NO: 445664 - protein, 9 aa, Homo Sapiens
FTQDEWALL

SEQ ID NO: 445665 - protein, 9 aa, Homo Sapiens
SSYLNSHMQ

SEQ ID NO: 445666 - protein, 9 aa, Homo Sapiens
LSDTASEVD

SEQ ID NO: 445667 - protein, 9 aa, Homo Sapiens
YHKLWRSSS

SEQ ID NO: 445668 - protein, 9 aa, Homo Sapiens
GPLGASGYP

SEQ ID NO: 445669 - protein, 9 aa, Homo Sapiens
SHLIRHKII

SEQ ID NO: 445670 - protein, 9 aa, Homo Sapiens
LMVIPLVFQ

SEQ ID NO: 445671 - protein, 9 aa, Homo Sapiens
AATKDLRWY

SEQ ID NO: 445672 - protein, 9 aa, Homo Sapiens
RTGHQIRKL

SEQ ID NO: 445673 - protein, 9 aa, Homo Sapiens
YKLPIEIVN

SEQ ID NO: 445674 - protein, 9 aa, Homo Sapiens
ELFRANSTS

SEQ ID NO: 445675 - protein, 9 aa, Homo Sapiens
GCKVHKKGY

SEQ ID NO: 445676 - protein, 9 aa, Homo Sapiens
PCKPLLTLD

SEQ ID NO: 445677 - protein, 9 aa, Homo Sapiens
LNSHMQTHT

SEQ ID NO: 445678 - protein, 9 aa, Homo Sapiens
DIVATDDCR

SEQ ID NO: 445679 - protein, 9 aa, Homo Sapiens
HQIPPSYVK

SEQ ID NO: 445680 - protein, 9 aa, Homo Sapiens
VAQGMVFLA

SEQ ID NO: 445681 - protein, 9 aa, Homo Sapiens
QIWEIKFGF

SEQ ID NO: 445682 - protein, 9 aa, Homo Sapiens
SPDLVNTYA

SEQ ID NO: 445683 - protein, 9 aa, Homo Sapiens
LWRSHSDSG

SEQ ID NO: 445684 - protein, 9 aa, Homo Sapiens
SHSSVCSTQ

SEQ ID NO: 445685 - protein, 9 aa, Homo Sapiens
CYYLGTTKD

SEQ ID NO: 445686 - protein, 9 aa, Homo Sapiens
INDIAMAIT

SEQ ID NO: 445687 - protein, 9 aa, Homo Sapiens
LPKVEIQRS

SEQ ID NO: 445688 - protein, 9 aa, Homo Sapiens
TPPHSQHVS

SEQ ID NO: 445689 - protein, 9 aa, Homo Sapiens
GCSCQMVVE

SEQ ID NO: 445690 - protein, 9 aa, Homo Sapiens
SLSSSKLDT

SEQ ID NO: 445691 - protein, 9 aa, Homo Sapiens
AIYLILAGF

SEQ ID NO: 445692 - protein, 9 aa, Homo Sapiens
ARRQHTHKK

SEQ ID NO: 445693 - protein, 9 aa, Homo Sapiens
GNAKFDLKL

SEQ ID NO: 445694 - protein, 9 aa, Homo Sapiens
FIKIPVCEP

SEQ ID NO: 445695 - protein, 9 aa, Homo Sapiens
SSLVLIGYA

SEQ ID NO: 445696 - protein, 9 aa, Homo Sapiens
RYMAGVIRH

SEQ ID NO: 445697 - protein, 9 aa, Homo Sapiens
STERLEPDS

SEQ ID NO: 445698 - protein, 9 aa, Homo Sapiens
DLPIQWNKV

SEQ ID NO: 445699 - protein, 9 aa, Homo Sapiens
AAVVGFCVV

SEQ ID NO: 445700 - protein, 9 aa, Homo Sapiens
RRPLKDKIE

SEQ ID NO: 445701 - protein, 9 aa, Homo Sapiens
TSVEVTGGI

SEQ ID NO: 445702 - protein, 9 aa, Homo Sapiens
KEEEREYNC

SEQ ID NO: 445703 - protein, 9 aa, Homo Sapiens
RGVFVNVDK

SEQ ID NO: 445704 - protein, 9 aa, Homo Sapiens
MPMDCINIC

SEQ ID NO: 445705 - protein, 9 aa, Homo Sapiens
IGKYAVRDL

SEQ ID NO: 445706 - protein, 9 aa, Homo Sapiens
QLSQTELGH

SEQ ID NO: 445707 - protein, 9 aa, Homo Sapiens
CVVNYTKPG

SEQ ID NO: 445708 - protein, 9 aa, Homo Sapiens
SLKSHNDWV

SEQ ID NO: 445709 - protein, 9 aa, Homo Sapiens
WLYVQNQEF

SEQ ID NO: 445710 - protein, 9 aa, Homo Sapiens
SCTKKKRKT

SEQ ID NO: 445711 - protein, 9 aa, Homo Sapiens
HVQGVIHRD

SEQ ID NO: 445712 - protein, 9 aa, Homo Sapiens
SASPTSIQT

SEQ ID NO: 445713 - protein, 9 aa, Homo Sapiens
RAFENPHAS

SEQ ID NO: 445714 - protein, 9 aa, Homo Sapiens
SHKINCQLK

SEQ ID NO: 445715 - protein, 9 aa, Homo Sapiens
LNKLTQSTE

SEQ ID NO: 445716 - protein, 9 aa, Homo Sapiens
HGKCKTFFS

SEQ ID NO: 445717 - protein, 9 aa, Homo Sapiens
GNVYHKFSD

SEQ ID NO: 445718 - protein, 9 aa, Homo Sapiens
EPTQKDIAL

SEQ ID NO: 445719 - protein, 9 aa, Homo Sapiens
LQHFEHNFC

SEQ ID NO: 445720 - protein, 9 aa, Homo Sapiens
SPGSLPATA

SEQ ID NO: 445721 - protein, 9 aa, Homo Sapiens
ILHHEYFTR

SEQ ID NO: 445722 - protein, 9 aa, Homo Sapiens
KYEIACEHE

SEQ ID NO: 445723 - protein, 9 aa, Homo Sapiens
QNLQGKKSS

SEQ ID NO: 445724 - protein, 9 aa, Homo Sapiens
TFEDVWRMI

SEQ ID NO: 445725 - protein, 9 aa, Homo Sapiens
SQNDQSILS

SEQ ID NO: 445726 - protein, 9 aa, Homo Sapiens
EPKTPGEGK

SEQ ID NO: 445727 - protein, 9 aa, Homo Sapiens
QKTAHYSNV

SEQ ID NO: 445728 - protein, 9 aa, Homo Sapiens
CLVRRRPYG

SEQ ID NO: 445729 - protein, 9 aa, Homo Sapiens
KENKLLEDR

SEQ ID NO: 445730 - protein, 9 aa, Homo Sapiens
EGGASGASK

SEQ ID NO: 445731 - protein, 9 aa, Homo Sapiens
CRVEQYSSD

SEQ ID NO: 445732 - protein, 9 aa, Homo Sapiens
ARQEAIATT

SEQ ID NO: 445733 - protein, 9 aa, Homo Sapiens
QFNGQNNTL

SEQ ID NO: 445734 - protein, 9 aa, Homo Sapiens
TQVNVGLEA

SEQ ID NO: 445735 - protein, 9 aa, Homo Sapiens
GVMLTSYTL

SEQ ID NO: 445736 - protein, 9 aa, Homo Sapiens
HKLNTYHDW

SEQ ID NO: 445737 - protein, 9 aa, Homo Sapiens
EELRRRGPN

SEQ ID NO: 445738 - protein, 9 aa, Homo Sapiens
VESEPSFFA

SEQ ID NO: 445739 - protein, 9 aa, Homo Sapiens
WKHPDYVGD

SEQ ID NO: 445740 - protein, 9 aa, Homo Sapiens
LMVHGNERC

SEQ ID NO: 445741 - protein, 9 aa, Homo Sapiens
AEVIVWQLQ

SEQ ID NO: 445742 - protein, 9 aa, Homo Sapiens
FNPVLQKGV

SEQ ID NO: 445743 - protein, 9 aa, Homo Sapiens
TKLQKALLK

SEQ ID NO: 445744 - protein, 9 aa, Homo Sapiens
YPITHRLYG

SEQ ID NO: 445745 - protein, 9 aa, Homo Sapiens
QQHSDKIIQ

SEQ ID NO: 445746 - protein, 9 aa, Homo Sapiens
WFVIKGKVI

SEQ ID NO: 445747 - protein, 9 aa, Homo Sapiens
IQGAPCAPG

SEQ ID NO: 445748 - protein, 9 aa, Homo Sapiens
DDAIHITAR

SEQ ID NO: 445749 - protein, 9 aa, Homo Sapiens
ESHKIIHTG

SEQ ID NO: 445750 - protein, 9 aa, Homo Sapiens
GRLASITRQ

SEQ ID NO: 445751 - protein, 9 aa, Homo Sapiens
FAKSKSKTI

SEQ ID NO: 445752 - protein, 9 aa, Homo Sapiens
SNKLEAGNG

SEQ ID NO: 445753 - protein, 9 aa, Homo Sapiens
RLVSEWNLL

SEQ ID NO: 445754 - protein, 9 aa, Homo Sapiens
LTSVSTVLT

SEQ ID NO: 445755 - protein, 9 aa, Homo Sapiens
HRLHSGEKL

SEQ ID NO: 445756 - protein, 9 aa, Homo Sapiens
QNAYLLNSQ

SEQ ID NO: 445757 - protein, 9 aa, Homo Sapiens
ELCWKYSDY

SEQ ID NO: 445758 - protein, 9 aa, Homo Sapiens
EEERICMEN

SEQ ID NO: 445759 - protein, 9 aa, Homo Sapiens
LSNHQHVTK

SEQ ID NO: 445760 - protein, 9 aa, Homo Sapiens
NYADQFNMP

SEQ ID NO: 445761 - protein, 9 aa, Homo Sapiens
RRLLKDAYL

SEQ ID NO: 445762 - protein, 9 aa, Homo Sapiens
GVLQVQRYQ

SEQ ID NO: 445763 - protein, 9 aa, Homo Sapiens
LKGGEMSSL

SEQ ID NO: 445764 - protein, 9 aa, Homo Sapiens
LKETSENNT

SEQ ID NO: 445765 - protein, 9 aa, Homo Sapiens
PSGSPTSYR

SEQ ID NO: 445766 - protein, 9 aa, Homo Sapiens
RADCSNIDE

SEQ ID NO: 445767 - protein, 9 aa, Homo Sapiens
WIEGTNHKI

SEQ ID NO: 445768 - protein, 9 aa, Homo Sapiens
QIKYFTCNP

SEQ ID NO: 445769 - protein, 9 aa, Homo Sapiens
NVEFGHIQL

SEQ ID NO: 445770 - protein, 9 aa, Homo Sapiens
SSSPRVREL

SEQ ID NO: 445771 - protein, 9 aa, Homo Sapiens
QPTLSDDWQ

SEQ ID NO: 445772 - protein, 9 aa, Homo Sapiens
RPSFNQTPI

SEQ ID NO: 445773 - protein, 9 aa, Homo Sapiens
NEYKKIILL

SEQ ID NO: 445774 - protein, 9 aa, Homo Sapiens
YRLSEEGMV

SEQ ID NO: 445775 - protein, 9 aa, Homo Sapiens
GICHGLWIC

SEQ ID NO: 445776 - protein, 9 aa, Homo Sapiens
KQKRPRSHT

SEQ ID NO: 445777 - protein, 9 aa, Homo Sapiens
APPLPGPIT

SEQ ID NO: 445778 - protein, 9 aa, Homo Sapiens
FDIKYNRKM

SEQ ID NO: 445779 - protein, 9 aa, Homo Sapiens
MLGTLLQEY

SEQ ID NO: 445780 - protein, 9 aa, Homo Sapiens
SESDKNEKE

SEQ ID NO: 445781 - protein, 9 aa, Homo Sapiens
KLAQYAFKI

SEQ ID NO: 445782 - protein, 9 aa, Homo Sapiens
DFPKFLTMM

SEQ ID NO: 445783 - protein, 9 aa, Homo Sapiens
MKLGRPQIK

SEQ ID NO: 445784 - protein, 9 aa, Homo Sapiens
NLPPTHDPG

SEQ ID NO: 445785 - protein, 9 aa, Homo Sapiens
RADKKSLQI

SEQ ID NO: 445786 - protein, 9 aa, Homo Sapiens
ISYYTSYQN

SEQ ID NO: 445787 - protein, 9 aa, Homo Sapiens
WIYVVDMST

SEQ ID NO: 445788 - protein, 9 aa, Homo Sapiens
KGSVGSDRG

SEQ ID NO: 445789 - protein, 9 aa, Homo Sapiens
TECHLQSQM

SEQ ID NO: 445790 - protein, 9 aa, Homo Sapiens
PACAGPHHA

SEQ ID NO: 445791 - protein, 9 aa, Homo Sapiens
LSDDWQLPE

SEQ ID NO: 445792 - protein, 9 aa, Homo Sapiens
LDLILELIA

SEQ ID NO: 445793 - protein, 9 aa, Homo Sapiens
RHWIQLPDL

SEQ ID NO: 445794 - protein, 9 aa, Homo Sapiens
ENDKDNLNL

SEQ ID NO: 445795 - protein, 9 aa, Homo Sapiens
KCIRHEPLA

SEQ ID NO: 445796 - protein, 9 aa, Homo Sapiens
ELSDTASEV

SEQ ID NO: 445797 - protein, 9 aa, Homo Sapiens
LTNITVYCQ

SEQ ID NO: 445798 - protein, 9 aa, Homo Sapiens
DCGDFPNGS

SEQ ID NO: 445799 - protein, 9 aa, Homo Sapiens
NDRLFAVRP

SEQ ID NO: 445800 - protein, 9 aa, Homo Sapiens
LQINDIAMA

SEQ ID NO: 445801 - protein, 9 aa, Homo Sapiens
LLVKAVQNV

SEQ ID NO: 445802 - protein, 9 aa, Homo Sapiens
KKDRNNRKL

SEQ ID NO: 445803 - protein, 9 aa, Homo Sapiens
QIKAKPVNS

SEQ ID NO: 445804 - protein, 9 aa, Homo Sapiens
VGFVGVVTH

SEQ ID NO: 445805 - protein, 9 aa, Homo Sapiens
YNVDALRYF

SEQ ID NO: 445806 - protein, 9 aa, Homo Sapiens
LGAYYHNGK

SEQ ID NO: 445807 - protein, 9 aa, Homo Sapiens
INARTELDS

SEQ ID NO: 445808 - protein, 9 aa, Homo Sapiens
DMTKVFYIG

SEQ ID NO: 445809 - protein, 9 aa, Homo Sapiens
TTILGMCRP

SEQ ID NO: 445810 - protein, 9 aa, Homo Sapiens
LCNYTRKNF

SEQ ID NO: 445811 - protein, 9 aa, Homo Sapiens
ITTNPYNYA

SEQ ID NO: 445812 - protein, 9 aa, Homo Sapiens
TVVQHMEGD

SEQ ID NO: 445813 - protein, 9 aa, Homo Sapiens
FVEQEKVVY

SEQ ID NO: 445814 - protein, 9 aa, Homo Sapiens
LYAQMYAHT

SEQ ID NO: 445815 - protein, 9 aa, Homo Sapiens
GYRCNRYFI

SEQ ID NO: 445816 - protein, 9 aa, Homo Sapiens
SQDMEDSVE

SEQ ID NO: 445817 - protein, 9 aa, Homo Sapiens
MLTVRSVDG

SEQ ID NO: 445818 - protein, 9 aa, Homo Sapiens
LKKDRIVAD

SEQ ID NO: 445819 - protein, 9 aa, Homo Sapiens
DIGNLLVIV

SEQ ID NO: 445820 - protein, 9 aa, Homo Sapiens
NFDAFMKAI

SEQ ID NO: 445821 - protein, 9 aa, Homo Sapiens
SLPIYLPVN

SEQ ID NO: 445822 - protein, 9 aa, Homo Sapiens
INNILESKC

SEQ ID NO: 445823 - protein, 9 aa, Homo Sapiens
TFEPLKNYY

SEQ ID NO: 445824 - protein, 9 aa, Homo Sapiens
DFVIDDNAP

SEQ ID NO: 445825 - protein, 9 aa, Homo Sapiens
ELSLHCETN

SEQ ID NO: 445826 - protein, 9 aa, Homo Sapiens
QRGELARIK

SEQ ID NO: 445827 - protein, 9 aa, Homo Sapiens
GLTFHALSD

SEQ ID NO: 445828 - protein, 9 aa, Homo Sapiens
RSQTALSKG

SEQ ID NO: 445829 - protein, 9 aa, Homo Sapiens
WGDIIGVQG

SEQ ID NO: 445830 - protein, 9 aa, Homo Sapiens
SIEQPSQLQ

SEQ ID NO: 445831 - protein, 9 aa, Homo Sapiens
WWEKPYERP

SEQ ID NO: 445832 - protein, 9 aa, Homo Sapiens
VEGCLVQVF

SEQ ID NO: 445833 - protein, 9 aa, Homo Sapiens
LCWKYSDYN

SEQ ID NO: 445834 - protein, 9 aa, Homo Sapiens
VHGTGNLVN

SEQ ID NO: 445835 - protein, 9 aa, Homo Sapiens
HHPKCIPEF

SEQ ID NO: 445836 - protein, 9 aa, Homo Sapiens
GSCPSLLLD

SEQ ID NO: 445837 - protein, 9 aa, Homo Sapiens
SEVEAFEAR

SEQ ID NO: 445838 - protein, 9 aa, Homo Sapiens
KLLDHDKEV

SEQ ID NO: 445839 - protein, 9 aa, Homo Sapiens
DYYDLYGGD

SEQ ID NO: 445840 - protein, 9 aa, Homo Sapiens
QPGITGTLR

SEQ ID NO: 445841 - protein, 9 aa, Homo Sapiens
PADIKKSIT

SEQ ID NO: 445842 - protein, 9 aa, Homo Sapiens
DEVLGEIPN

SEQ ID NO: 445843 - protein, 9 aa, Homo Sapiens
NINNTFIKT

SEQ ID NO: 445844 - protein, 9 aa, Homo Sapiens
KGGKSCEKV

SEQ ID NO: 445845 - protein, 9 aa, Homo Sapiens
VDMLKELTE

SEQ ID NO: 445846 - protein, 9 aa, Homo Sapiens
LTLHQIIHT

SEQ ID NO: 445847 - protein, 9 aa, Homo Sapiens
HSYLYSHYF

SEQ ID NO: 445848 - protein, 9 aa, Homo Sapiens
ASILANDHM

SEQ ID NO: 445849 - protein, 9 aa, Homo Sapiens
VKRSYNKLN

SEQ ID NO: 445850 - protein, 9 aa, Homo Sapiens
LADNNTDVC

SEQ ID NO: 445851 - protein, 9 aa, Homo Sapiens
SYLNSHMQT

SEQ ID NO: 445852 - protein, 9 aa, Homo Sapiens
EADKFGQGV

SEQ ID NO: 445853 - protein, 9 aa, Homo Sapiens
ESFWNWLNT

SEQ ID NO: 445854 - protein, 9 aa, Homo Sapiens
DASSSKMKA

SEQ ID NO: 445855 - protein, 9 aa, Homo Sapiens
SPESASEGE

SEQ ID NO: 445856 - protein, 9 aa, Homo Sapiens
VEVTGGIFM

SEQ ID NO: 445857 - protein, 9 aa, Homo Sapiens
NNLSICLTL

SEQ ID NO: 445858 - protein, 9 aa, Homo Sapiens
DIKKSITDI

SEQ ID NO: 445859 - protein, 9 aa, Homo Sapiens
YLKKTCSQD

SEQ ID NO: 445860 - protein, 9 aa, Homo Sapiens
EAKIEKRKV

SEQ ID NO: 445861 - protein, 9 aa, Homo Sapiens
WDINEAFKE

SEQ ID NO: 445862 - protein, 9 aa, Homo Sapiens
LLLAPSTRT

SEQ ID NO: 445863 - protein, 9 aa, Homo Sapiens
EFQLEEVNN

SEQ ID NO: 445864 - protein, 9 aa, Homo Sapiens
MLERNDLFL

SEQ ID NO: 445865 - protein, 9 aa, Homo Sapiens
AASALIQTL

SEQ ID NO: 445866 - protein, 9 aa, Homo Sapiens
AVRGSLNVH

SEQ ID NO: 445867 - protein, 9 aa, Homo Sapiens
FRWSSTLVQ

SEQ ID NO: 445868 - protein, 9 aa, Homo Sapiens
DFHRGYHLQ

SEQ ID NO: 445869 - protein, 9 aa, Homo Sapiens
TVVHGVWYF

SEQ ID NO: 445870 - protein, 9 aa, Homo Sapiens
HHFQTQQLL

SEQ ID NO: 445871 - protein, 9 aa, Homo Sapiens
FLKRINESL

SEQ ID NO: 445872 - protein, 9 aa, Homo Sapiens
SGVVSRESL

SEQ ID NO: 445873 - protein, 9 aa, Homo Sapiens
NKIHSVEGS

SEQ ID NO: 445874 - protein, 9 aa, Homo Sapiens
TRRNLEGDE

SEQ ID NO: 445875 - protein, 9 aa, Homo Sapiens
FRSHSKSRS

SEQ ID NO: 445876 - protein, 9 aa, Homo Sapiens
VNKAMLRPA

SEQ ID NO: 445877 - protein, 9 aa, Homo Sapiens
AKELYEPTW

SEQ ID NO: 445878 - protein, 9 aa, Homo Sapiens
SAPEEQKHG

SEQ ID NO: 445879 - protein, 9 aa, Homo Sapiens
VMAQITKAL

SEQ ID NO: 445880 - protein, 9 aa, Homo Sapiens
PNSGTVDWT

SEQ ID NO: 445881 - protein, 9 aa, Homo Sapiens
LLGEERRSK

SEQ ID NO: 445882 - protein, 9 aa, Homo Sapiens
TVEDFAVKF

SEQ ID NO: 445883 - protein, 9 aa, Homo Sapiens
DFREKVIKG

SEQ ID NO: 445884 - protein, 9 aa, Homo Sapiens
RENPGDSEE

SEQ ID NO: 445885 - protein, 9 aa, Homo Sapiens
LCVETLCRM

SEQ ID NO: 445886 - protein, 9 aa, Homo Sapiens
FVFDTSCDC

SEQ ID NO: 445887 - protein, 9 aa, Homo Sapiens
ECLCPFTRE

SEQ ID NO: 445888 - protein, 9 aa, Homo Sapiens
PQRNNYSKL

SEQ ID NO: 445889 - protein, 9 aa, Homo Sapiens
QHKPEQGYL

SEQ ID NO: 445890 - protein, 9 aa, Homo Sapiens
MLTQYARTQ

SEQ ID NO: 445891 - protein, 9 aa, Homo Sapiens
ARKLICDIF

SEQ ID NO: 445892 - protein, 9 aa, Homo Sapiens
YFHTTQILS

SEQ ID NO: 445893 - protein, 9 aa, Homo Sapiens
LFSCFCVLL

SEQ ID NO: 445894 - protein, 9 aa, Homo Sapiens
WTYDKANID

SEQ ID NO: 445895 - protein, 9 aa, Homo Sapiens
ITVIESSVP

SEQ ID NO: 445896 - protein, 9 aa, Homo Sapiens
GAVDVREGR

SEQ ID NO: 445897 - protein, 9 aa, Homo Sapiens
QLPSPTAVS

SEQ ID NO: 445898 - protein, 9 aa, Homo Sapiens
VQPVLEEGR

SEQ ID NO: 445899 - protein, 9 aa, Homo Sapiens
GDPDLIGPK

SEQ ID NO: 445900 - protein, 9 aa, Homo Sapiens
VVFLAINYN

SEQ ID NO: 445901 - protein, 9 aa, Homo Sapiens
AMRLSIIHH

SEQ ID NO: 445902 - protein, 9 aa, Homo Sapiens
SEHSPDQGK

SEQ ID NO: 445903 - protein, 9 aa, Homo Sapiens
IYRHLFGHT

SEQ ID NO: 445904 - protein, 9 aa, Homo Sapiens
QVQRYQEVG

SEQ ID NO: 445905 - protein, 9 aa, Homo Sapiens
KNPARTVNE

SEQ ID NO: 445906 - protein, 9 aa, Homo Sapiens
VIYIHETHT

SEQ ID NO: 445907 - protein, 9 aa, Homo Sapiens
NFCHPNFPF

SEQ ID NO: 445908 - protein, 9 aa, Homo Sapiens
VQHLQTVLR

SEQ ID NO: 445909 - protein, 9 aa, Homo Sapiens
SIVGALRTG

SEQ ID NO: 445910 - protein, 9 aa, Homo Sapiens
NQELKQHVD

SEQ ID NO: 445911 - protein, 9 aa, Homo Sapiens
ESCPKCGHP

SEQ ID NO: 445912 - protein, 9 aa, Homo Sapiens
GALQKRSLD

SEQ ID NO: 445913 - protein, 9 aa, Homo Sapiens
VGVVTHYVL

SEQ ID NO: 445914 - protein, 9 aa, Homo Sapiens
NTARTALLT

SEQ ID NO: 445915 - protein, 9 aa, Homo Sapiens
LISSHSHQQ

SEQ ID NO: 445916 - protein, 9 aa, Homo Sapiens
SSENYGRRR

SEQ ID NO: 445917 - protein, 9 aa, Homo Sapiens
AEGIHLIKV

SEQ ID NO: 445918 - protein, 9 aa, Homo Sapiens
FDAVFLNPF

SEQ ID NO: 445919 - protein, 9 aa, Homo Sapiens
PLTFLSAPV

SEQ ID NO: 445920 - protein, 9 aa, Homo Sapiens
YDKAEKVIQ

SEQ ID NO: 445921 - protein, 9 aa, Homo Sapiens
SWSAASRNY

SEQ ID NO: 445922 - protein, 9 aa, Homo Sapiens
RQHYCHECG

SEQ ID NO: 445923 - protein, 9 aa, Homo Sapiens
SIICIDEVD

SEQ ID NO: 445924 - protein, 9 aa, Homo Sapiens
GTAGVSLHI

SEQ ID NO: 445925 - protein, 9 aa, Homo Sapiens
LSDVNTNRS

SEQ ID NO: 445926 - protein, 9 aa, Homo Sapiens
DSTVSNNKT

SEQ ID NO: 445927 - protein, 9 aa, Homo Sapiens
SIHTKTKHT

SEQ ID NO: 445928 - protein, 9 aa, Homo Sapiens
KMKKWEGMA

SEQ ID NO: 445929 - protein, 9 aa, Homo Sapiens
SLVLIGYAF

SEQ ID NO: 445930 - protein, 9 aa, Homo Sapiens
GLDDTLVDF

SEQ ID NO: 445931 - protein, 9 aa, Homo Sapiens
DITSEKEII

SEQ ID NO: 445932 - protein, 9 aa, Homo Sapiens
KKFAVALYG

SEQ ID NO: 445933 - protein, 9 aa, Homo Sapiens
KLHLEQQQI

SEQ ID NO: 445934 - protein, 9 aa, Homo Sapiens
FGSRCWMTQ

SEQ ID NO: 445935 - protein, 9 aa, Homo Sapiens
NDGCHPACL

SEQ ID NO: 445936 - protein, 9 aa, Homo Sapiens
PLCLRVHPP

SEQ ID NO: 445937 - protein, 9 aa, Homo Sapiens
SDSSDSSDN

SEQ ID NO: 445938 - protein, 9 aa, Homo Sapiens
QRHVCNIHN

SEQ ID NO: 445939 - protein, 9 aa, Homo Sapiens
QAYFYDLHE

SEQ ID NO: 445940 - protein, 9 aa, Homo Sapiens
WFQNWRAKL

SEQ ID NO: 445941 - protein, 9 aa, Homo Sapiens
HLIKIYDVQ

SEQ ID NO: 445942 - protein, 9 aa, Homo Sapiens
LKRPITHLP

SEQ ID NO: 445943 - protein, 9 aa, Homo Sapiens
IHEIMHRGG

SEQ ID NO: 445944 - protein, 9 aa, Homo Sapiens
RTSTNRVLN

SEQ ID NO: 445945 - protein, 9 aa, Homo Sapiens
SYVKDLFLQ

SEQ ID NO: 445946 - protein, 9 aa, Homo Sapiens
KLRWGDIIG

SEQ ID NO: 445947 - protein, 9 aa, Homo Sapiens
NFEMLNKVL

SEQ ID NO: 445948 - protein, 9 aa, Homo Sapiens
FRSKPSEEI

SEQ ID NO: 445949 - protein, 9 aa, Homo Sapiens
LIVVIPSIL

SEQ ID NO: 445950 - protein, 9 aa, Homo Sapiens
RTYYESVQT

SEQ ID NO: 445951 - protein, 9 aa, Homo Sapiens
SLKPKAAVQ

SEQ ID NO: 445952 - protein, 9 aa, Homo Sapiens
TSLGDAINH

SEQ ID NO: 445953 - protein, 9 aa, Homo Sapiens
PSSWDYRHP

SEQ ID NO: 445954 - protein, 9 aa, Homo Sapiens
SKAFHSKVT

SEQ ID NO: 445955 - protein, 9 aa, Homo Sapiens
WQRNMRKVC

SEQ ID NO: 445956 - protein, 9 aa, Homo Sapiens
FYFILGDHF

SEQ ID NO: 445957 - protein, 9 aa, Homo Sapiens
IDDIFNKIK

SEQ ID NO: 445958 - protein, 9 aa, Homo Sapiens
VGEGLAHME

SEQ ID NO: 445959 - protein, 9 aa, Homo Sapiens
IVLFAHNEY

SEQ ID NO: 445960 - protein, 9 aa, Homo Sapiens
DADPRDPAA

SEQ ID NO: 445961 - protein, 9 aa, Homo Sapiens
YDNKPRRPY

SEQ ID NO: 445962 - protein, 9 aa, Homo Sapiens
PIEASLYGL

SEQ ID NO: 445963 - protein, 9 aa, Homo Sapiens
LIAYLDKSP

SEQ ID NO: 445964 - protein, 9 aa, Homo Sapiens
SDVVLPFTL

SEQ ID NO: 445965 - protein, 9 aa, Homo Sapiens
PNVDKLEII

SEQ ID NO: 445966 - protein, 9 aa, Homo Sapiens
TMEVINKSI

SEQ ID NO: 445967 - protein, 9 aa, Homo Sapiens
NYNEAECVT

SEQ ID NO: 445968 - protein, 9 aa, Homo Sapiens
VGYSTHMVR

SEQ ID NO: 445969 - protein, 9 aa, Homo Sapiens
PVHDFLKRI

SEQ ID NO: 445970 - protein, 9 aa, Homo Sapiens
KAKEYLIAR

SEQ ID NO: 445971 - protein, 9 aa, Homo Sapiens
HSSLWNIWK

SEQ ID NO: 445972 - protein, 9 aa, Homo Sapiens
EQKHGLLKS

SEQ ID NO: 445973 - protein, 9 aa, Homo Sapiens
QNTFLDNIV

SEQ ID NO: 445974 - protein, 9 aa, Homo Sapiens
MALVFCLCM

SEQ ID NO: 445975 - protein, 9 aa, Homo Sapiens
MSLACYNPF

SEQ ID NO: 445976 - protein, 9 aa, Homo Sapiens
SGSHITFHM

SEQ ID NO: 445977 - protein, 9 aa, Homo Sapiens
QDNGMESAS

SEQ ID NO: 445978 - protein, 9 aa, Homo Sapiens
SDLEKYLGT

SEQ ID NO: 445979 - protein, 9 aa, Homo Sapiens
PSLPMVHGP

SEQ ID NO: 445980 - protein, 9 aa, Homo Sapiens
IEGDGFLFP

SEQ ID NO: 445981 - protein, 9 aa, Homo Sapiens
RHFQWVDGS

SEQ ID NO: 445982 - protein, 9 aa, Homo Sapiens
DPYKSILDN

SEQ ID NO: 445983 - protein, 9 aa, Homo Sapiens
NPLYSSKSH

SEQ ID NO: 445984 - protein, 9 aa, Homo Sapiens
KDPDNPGQI

SEQ ID NO: 445985 - protein, 9 aa, Homo Sapiens
GVFIREHLN

SEQ ID NO: 445986 - protein, 9 aa, Homo Sapiens
IAHQKIHTG

SEQ ID NO: 445987 - protein, 9 aa, Homo Sapiens
TGFFMGGVF

SEQ ID NO: 445988 - protein, 9 aa, Homo Sapiens
NIQLFSFAI

SEQ ID NO: 445989 - protein, 9 aa, Homo Sapiens
HGNNKAMAA

SEQ ID NO: 445990 - protein, 9 aa, Homo Sapiens
HSVILLACQ

SEQ ID NO: 445991 - protein, 9 aa, Homo Sapiens
SKALLKWQL

SEQ ID NO: 445992 - protein, 9 aa, Homo Sapiens
LNLPASLQP

SEQ ID NO: 445993 - protein, 9 aa, Homo Sapiens
PPPVDYADE

SEQ ID NO: 445994 - protein, 9 aa, Homo Sapiens
KTDSSLHSQ

SEQ ID NO: 445995 - protein, 9 aa, Homo Sapiens
PIFTLLQLF

SEQ ID NO: 445996 - protein, 9 aa, Homo Sapiens
TFFQVTLFT

SEQ ID NO: 445997 - protein, 9 aa, Homo Sapiens
RVAQGYHQI

SEQ ID NO: 445998 - protein, 9 aa, Homo Sapiens
DGAPDSAIR

SEQ ID NO: 445999 - protein, 9 aa, Homo Sapiens
KRNIFSNWG

SEQ ID NO: 446000 - protein, 9 aa, Homo Sapiens
GASILPKHD

SEQ ID NO: 446001 - protein, 9 aa, Homo Sapiens
QRTEKHIEA

SEQ ID NO: 446002 - protein, 9 aa, Homo Sapiens
TGYIVISNA

SEQ ID NO: 446003 - protein, 9 aa, Homo Sapiens
DELYVHQLL

SEQ ID NO: 446004 - protein, 9 aa, Homo Sapiens
IAAGLILLA

SEQ ID NO: 446005 - protein, 9 aa, Homo Sapiens
GCGCGSGYY

SEQ ID NO: 446006 - protein, 9 aa, Homo Sapiens
QHHKQRRSR

SEQ ID NO: 446007 - protein, 9 aa, Homo Sapiens
IMLREICDI

SEQ ID NO: 446008 - protein, 9 aa, Homo Sapiens
FIFKEKVFT

SEQ ID NO: 446009 - protein, 9 aa, Homo Sapiens
TTVDFHWCL

SEQ ID NO: 446010 - protein, 9 aa, Homo Sapiens
IIIQVIPQY

SEQ ID NO: 446011 - protein, 9 aa, Homo Sapiens
YGGYGFSGL

SEQ ID NO: 446012 - protein, 9 aa, Homo Sapiens
YSSISSSAS

SEQ ID NO: 446013 - protein, 9 aa, Homo Sapiens
YIYQPGGLH

SEQ ID NO: 446014 - protein, 9 aa, Homo Sapiens
HCTEENKIG

SEQ ID NO: 446015 - protein, 9 aa, Homo Sapiens
CSVKAFKLF

SEQ ID NO: 446016 - protein, 9 aa, Homo Sapiens
LARAVYKYA

SEQ ID NO: 446017 - protein, 9 aa, Homo Sapiens
PQIPQRDQR

SEQ ID NO: 446018 - protein, 9 aa, Homo Sapiens
KWKVFNSSY

SEQ ID NO: 446019 - protein, 9 aa, Homo Sapiens
GDRQENDKD

SEQ ID NO: 446020 - protein, 9 aa, Homo Sapiens
HEQVYIQST

SEQ ID NO: 446021 - protein, 9 aa, Homo Sapiens
RRTVSLQVD

SEQ ID NO: 446022 - protein, 9 aa, Homo Sapiens
KLLEQFGLN

SEQ ID NO: 446023 - protein, 9 aa, Homo Sapiens
VQTPGTYPE

SEQ ID NO: 446024 - protein, 9 aa, Homo Sapiens
GVFVRALIV

SEQ ID NO: 446025 - protein, 9 aa, Homo Sapiens
FNKIKFGEY

SEQ ID NO: 446026 - protein, 9 aa, Homo Sapiens
HQRVHTEIS

SEQ ID NO: 446027 - protein, 9 aa, Homo Sapiens
PIPEHILGK

SEQ ID NO: 446028 - protein, 9 aa, Homo Sapiens
WKRIQSPVT

SEQ ID NO: 446029 - protein, 9 aa, Homo Sapiens
VEIQRSAIS

SEQ ID NO: 446030 - protein, 9 aa, Homo Sapiens
NYAFVSQGE

SEQ ID NO: 446031 - protein, 9 aa, Homo Sapiens
SIYVDFNCL

SEQ ID NO: 446032 - protein, 9 aa, Homo Sapiens
IYEYVEIIG

SEQ ID NO: 446033 - protein, 9 aa, Homo Sapiens
YEAGSTTPL

SEQ ID NO: 446034 - protein, 9 aa, Homo Sapiens
TLQCANIQF

SEQ ID NO: 446035 - protein, 9 aa, Homo Sapiens
NRLDDVCNR

SEQ ID NO: 446036 - protein, 9 aa, Homo Sapiens
EHCSIHLMY

SEQ ID NO: 446037 - protein, 9 aa, Homo Sapiens
WIEKKWLLL

SEQ ID NO: 446038 - protein, 9 aa, Homo Sapiens
NEIFIQLFI

SEQ ID NO: 446039 - protein, 9 aa, Homo Sapiens
PNNFNIAGT

SEQ ID NO: 446040 - protein, 9 aa, Homo Sapiens
APELKFQVF

SEQ ID NO: 446041 - protein, 9 aa, Homo Sapiens
TPRIKIIDF

SEQ ID NO: 446042 - protein, 9 aa, Homo Sapiens
NESPSSGRV

SEQ ID NO: 446043 - protein, 9 aa, Homo Sapiens
LPADIKKSI

SEQ ID NO: 446044 - protein, 9 aa, Homo Sapiens
IVIWEIKIS

SEQ ID NO: 446045 - protein, 9 aa, Homo Sapiens
VIVIFFPAE

SEQ ID NO: 446046 - protein, 9 aa, Homo Sapiens
KGEEPTTEN

SEQ ID NO: 446047 - protein, 9 aa, Homo Sapiens
SDGKPRKVQ

SEQ ID NO: 446048 - protein, 9 aa, Homo Sapiens
CMCLSPTYE

SEQ ID NO: 446049 - protein, 9 aa, Homo Sapiens
GSLVQQIQI

SEQ ID NO: 446050 - protein, 9 aa, Homo Sapiens
QLLHSAADW

SEQ ID NO: 446051 - protein, 9 aa, Homo Sapiens
QKAEEERIC

SEQ ID NO: 446052 - protein, 9 aa, Homo Sapiens
DQYVKIKRN

SEQ ID NO: 446053 - protein, 9 aa, Homo Sapiens
SSLSSGATV

SEQ ID NO: 446054 - protein, 9 aa, Homo Sapiens
CRMESYFDF

SEQ ID NO: 446055 - protein, 9 aa, Homo Sapiens
PDNKLSTTE

SEQ ID NO: 446056 - protein, 9 aa, Homo Sapiens
PLVTVQNER

SEQ ID NO: 446057 - protein, 9 aa, Homo Sapiens
KLEFIFLFC

SEQ ID NO: 446058 - protein, 9 aa, Homo Sapiens
LDLRVLGYL

SEQ ID NO: 446059 - protein, 9 aa, Homo Sapiens
KTTSSVWRN

SEQ ID NO: 446060 - protein, 9 aa, Homo Sapiens
CMFFERHLE

SEQ ID NO: 446061 - protein, 9 aa, Homo Sapiens
VGMYGWRKR

SEQ ID NO: 446062 - protein, 9 aa, Homo Sapiens
NLLQYQDLV

SEQ ID NO: 446063 - protein, 9 aa, Homo Sapiens
FLFFLLSPL

SEQ ID NO: 446064 - protein, 9 aa, Homo Sapiens
QDTLKIPYK

SEQ ID NO: 446065 - protein, 9 aa, Homo Sapiens
QYSGKSFKK

SEQ ID NO: 446066 - protein, 9 aa, Homo Sapiens
TLDYGMYYR

SEQ ID NO: 446067 - protein, 9 aa, Homo Sapiens
GHIAKMPVK

SEQ ID NO: 446068 - protein, 9 aa, Homo Sapiens
GERPYPCHN

SEQ ID NO: 446069 - protein, 9 aa, Homo Sapiens
KHEVLQRCL

SEQ ID NO: 446070 - protein, 9 aa, Homo Sapiens
ARKILVVNV

SEQ ID NO: 446071 - protein, 9 aa, Homo Sapiens
TVVTPLLNH

SEQ ID NO: 446072 - protein, 9 aa, Homo Sapiens
IWAQQKENE

SEQ ID NO: 446073 - protein, 9 aa, Homo Sapiens
PGPMSPPGP

SEQ ID NO: 446074 - protein, 9 aa, Homo Sapiens
HLRHDKIMF

SEQ ID NO: 446075 - protein, 9 aa, Homo Sapiens
GKEINEKSY

SEQ ID NO: 446076 - protein, 9 aa, Homo Sapiens
DKNHAPGST

SEQ ID NO: 446077 - protein, 9 aa, Homo Sapiens
EPARDIHCE

SEQ ID NO: 446078 - protein, 9 aa, Homo Sapiens
AMMFFSNFP

SEQ ID NO: 446079 - protein, 9 aa, Homo Sapiens
RLGRLASIT

SEQ ID NO: 446080 - protein, 9 aa, Homo Sapiens
ISKQALSKI

SEQ ID NO: 446081 - protein, 9 aa, Homo Sapiens
DPKESNLSD

SEQ ID NO: 446082 - protein, 9 aa, Homo Sapiens
QAMDLVKIH

SEQ ID NO: 446083 - protein, 9 aa, Homo Sapiens
QYSSDTMQT

SEQ ID NO: 446084 - protein, 9 aa, Homo Sapiens
TIVEERVNC

SEQ ID NO: 446085 - protein, 9 aa, Homo Sapiens
RAVYKYADL

SEQ ID NO: 446086 - protein, 9 aa, Homo Sapiens
KDARSQNIK

SEQ ID NO: 446087 - protein, 9 aa, Homo Sapiens
IDYHSRMNI

SEQ ID NO: 446088 - protein, 9 aa, Homo Sapiens
QIISKGGLI

SEQ ID NO: 446089 - protein, 9 aa, Homo Sapiens
CLAGKVNKP

SEQ ID NO: 446090 - protein, 9 aa, Homo Sapiens
PNVASLTQP

SEQ ID NO: 446091 - protein, 9 aa, Homo Sapiens
SKAGITASV

SEQ ID NO: 446092 - protein, 9 aa, Homo Sapiens
LMNEIKYKS

SEQ ID NO: 446093 - protein, 9 aa, Homo Sapiens
ELSLQQLVE

SEQ ID NO: 446094 - protein, 9 aa, Homo Sapiens
AAEGDTWCE

SEQ ID NO: 446095 - protein, 9 aa, Homo Sapiens
FHLSFCMSN

SEQ ID NO: 446096 - protein, 9 aa, Homo Sapiens
AQPSAEDLD

SEQ ID NO: 446097 - protein, 9 aa, Homo Sapiens
LVSEWNLLE

SEQ ID NO: 446098 - protein, 9 aa, Homo Sapiens
KIMDQYKLY

SEQ ID NO: 446099 - protein, 9 aa, Homo Sapiens
GLVNNKYGT

SEQ ID NO: 446100 - protein, 9 aa, Homo Sapiens
MGEAPGDLL

SEQ ID NO: 446101 - protein, 9 aa, Homo Sapiens
PCTGDGKNC

SEQ ID NO: 446102 - protein, 9 aa, Homo Sapiens
NFIMLREIC

SEQ ID NO: 446103 - protein, 9 aa, Homo Sapiens
NLYVIEDPS

SEQ ID NO: 446104 - protein, 9 aa, Homo Sapiens
DETQASKRT

SEQ ID NO: 446105 - protein, 9 aa, Homo Sapiens
PLGHLESAR

SEQ ID NO: 446106 - protein, 9 aa, Homo Sapiens
FYTMYNQKP

SEQ ID NO: 446107 - protein, 9 aa, Homo Sapiens
KADERDFPI

SEQ ID NO: 446108 - protein, 9 aa, Homo Sapiens
RSFEKGDYF

SEQ ID NO: 446109 - protein, 9 aa, Homo Sapiens
NTLSAAQLY

SEQ ID NO: 446110 - protein, 9 aa, Homo Sapiens
SFFAWKKRK

SEQ ID NO: 446111 - protein, 9 aa, Homo Sapiens
EGNVFPGSG

SEQ ID NO: 446112 - protein, 9 aa, Homo Sapiens
VMNNLLPIS

SEQ ID NO: 446113 - protein, 9 aa, Homo Sapiens
KCRHENVLL

SEQ ID NO: 446114 - protein, 9 aa, Homo Sapiens
FENKVVQDD

SEQ ID NO: 446115 - protein, 9 aa, Homo Sapiens
GILNQLNSL

SEQ ID NO: 446116 - protein, 9 aa, Homo Sapiens
YTFLDLNLK

SEQ ID NO: 446117 - protein, 9 aa, Homo Sapiens
EVNNPYLLT

SEQ ID NO: 446118 - protein, 9 aa, Homo Sapiens
PWTRPSNLA

SEQ ID NO: 446119 - protein, 9 aa, Homo Sapiens
AERLVRVGP

SEQ ID NO: 446120 - protein, 9 aa, Homo Sapiens
IKNSTFCIT

SEQ ID NO: 446121 - protein, 9 aa, Homo Sapiens
EHPDAVCQL

SEQ ID NO: 446122 - protein, 9 aa, Homo Sapiens
ISNVKVETP

SEQ ID NO: 446123 - protein, 9 aa, Homo Sapiens
GDFPNGSLG

SEQ ID NO: 446124 - protein, 9 aa, Homo Sapiens
RGTIPESKP

SEQ ID NO: 446125 - protein, 9 aa, Homo Sapiens
TVRSVDGDQ

SEQ ID NO: 446126 - protein, 9 aa, Homo Sapiens
EFRMRVSYL

SEQ ID NO: 446127 - protein, 9 aa, Homo Sapiens
EKLNNQAEL

SEQ ID NO: 446128 - protein, 9 aa, Homo Sapiens
HHKGHRPEV

SEQ ID NO: 446129 - protein, 9 aa, Homo Sapiens
RQKYKKEDQ

SEQ ID NO: 446130 - protein, 9 aa, Homo Sapiens
LVEESLLNN

SEQ ID NO: 446131 - protein, 9 aa, Homo Sapiens
AQNEVEKIV

SEQ ID NO: 446132 - protein, 9 aa, Homo Sapiens
DLIFHEQIH

SEQ ID NO: 446133 - protein, 9 aa, Homo Sapiens
VTMQYYVQY

SEQ ID NO: 446134 - protein, 9 aa, Homo Sapiens
RQSDNYPNK

SEQ ID NO: 446135 - protein, 9 aa, Homo Sapiens
LRGSGHQKV

SEQ ID NO: 446136 - protein, 9 aa, Homo Sapiens
RDQRLKESD

SEQ ID NO: 446137 - protein, 9 aa, Homo Sapiens
FQLSGQSIK

SEQ ID NO: 446138 - protein, 9 aa, Homo Sapiens
KNYYQAFQI

SEQ ID NO: 446139 - protein, 9 aa, Homo Sapiens
SCVRGTFCI

SEQ ID NO: 446140 - protein, 9 aa, Homo Sapiens
DGMDNDIGI

SEQ ID NO: 446141 - protein, 9 aa, Homo Sapiens
LDDEFIDME

SEQ ID NO: 446142 - protein, 9 aa, Homo Sapiens
SISQEQEKI

SEQ ID NO: 446143 - protein, 9 aa, Homo Sapiens
LEENIRRLE

SEQ ID NO: 446144 - protein, 9 aa, Homo Sapiens
NTLVSKFFD

SEQ ID NO: 446145 - protein, 9 aa, Homo Sapiens
ILQKQEQQQ

SEQ ID NO: 446146 - protein, 9 aa, Homo Sapiens
LNEARKILV

SEQ ID NO: 446147 - protein, 9 aa, Homo Sapiens
PQSHFLYAY

SEQ ID NO: 446148 - protein, 9 aa, Homo Sapiens
FHEQIHSGE

SEQ ID NO: 446149 - protein, 9 aa, Homo Sapiens
QKELWKLVH

SEQ ID NO: 446150 - protein, 9 aa, Homo Sapiens
SKCYHIGTT

SEQ ID NO: 446151 - protein, 9 aa, Homo Sapiens
KVGVWGDYD

SEQ ID NO: 446152 - protein, 9 aa, Homo Sapiens
MDQYKLYDP

SEQ ID NO: 446153 - protein, 9 aa, Homo Sapiens
TTLQDWGTP

SEQ ID NO: 446154 - protein, 9 aa, Homo Sapiens
GMANLPPHF

SEQ ID NO: 446155 - protein, 9 aa, Homo Sapiens
LFENKVVQD

SEQ ID NO: 446156 - protein, 9 aa, Homo Sapiens
EQTGGRLGK

SEQ ID NO: 446157 - protein, 9 aa, Homo Sapiens
FQLERLKQQ

SEQ ID NO: 446158 - protein, 9 aa, Homo Sapiens
GCLVRRRPY

SEQ ID NO: 446159 - protein, 9 aa, Homo Sapiens
SVDVIVKEE

SEQ ID NO: 446160 - protein, 9 aa, Homo Sapiens
TEEFKLKDQ

SEQ ID NO: 446161 - protein, 9 aa, Homo Sapiens
FVLDILSRL

SEQ ID NO: 446162 - protein, 9 aa, Homo Sapiens
LSSRSDVWS

SEQ ID NO: 446163 - protein, 9 aa, Homo Sapiens
VKVQLTALG

SEQ ID NO: 446164 - protein, 9 aa, Homo Sapiens
SLDIGKKHD

SEQ ID NO: 446165 - protein, 9 aa, Homo Sapiens
RKRDNTNEM

SEQ ID NO: 446166 - protein, 9 aa, Homo Sapiens
DNVCKASAG

SEQ ID NO: 446167 - protein, 9 aa, Homo Sapiens
CELGKFVKN

SEQ ID NO: 446168 - protein, 9 aa, Homo Sapiens
NTRYGGWNG

SEQ ID NO: 446169 - protein, 9 aa, Homo Sapiens
QYILMKFMK

SEQ ID NO: 446170 - protein, 9 aa, Homo Sapiens
NNLLHQQLK

SEQ ID NO: 446171 - protein, 9 aa, Homo Sapiens
ECVQGEVQD

SEQ ID NO: 446172 - protein, 9 aa, Homo Sapiens
DCSNIDEIL

SEQ ID NO: 446173 - protein, 9 aa, Homo Sapiens
WAARGHHSS

SEQ ID NO: 446174 - protein, 9 aa, Homo Sapiens
LLFPFSLIL

SEQ ID NO: 446175 - protein, 9 aa, Homo Sapiens
QLQELCWKY

SEQ ID NO: 446176 - protein, 9 aa, Homo Sapiens
LFPFSLILS

SEQ ID NO: 446177 - protein, 9 aa, Homo Sapiens
CGGNGLFFS

SEQ ID NO: 446178 - protein, 9 aa, Homo Sapiens
RMCTIIMSF

SEQ ID NO: 446179 - protein, 9 aa, Homo Sapiens
LPLSRDPSS

SEQ ID NO: 446180 - protein, 9 aa, Homo Sapiens
VICAVSHVF

SEQ ID NO: 446181 - protein, 9 aa, Homo Sapiens
KFIKEFLGR

SEQ ID NO: 446182 - protein, 9 aa, Homo Sapiens
TAVFTDKYA

SEQ ID NO: 446183 - protein, 9 aa, Homo Sapiens
LALYPEFTP

SEQ ID NO: 446184 - protein, 9 aa, Homo Sapiens
DDDEEEEEA

SEQ ID NO: 446185 - protein, 9 aa, Homo Sapiens
CNVANVFLV

SEQ ID NO: 446186 - protein, 9 aa, Homo Sapiens
RPYPCHNCG

SEQ ID NO: 446187 - protein, 9 aa, Homo Sapiens
LNLLTECIE

SEQ ID NO: 446188 - protein, 9 aa, Homo Sapiens
IITCFNVLK

SEQ ID NO: 446189 - protein, 9 aa, Homo Sapiens
AHKYSSSPD

SEQ ID NO: 446190 - protein, 9 aa, Homo Sapiens
MEVVVSKAR

SEQ ID NO: 446191 - protein, 9 aa, Homo Sapiens
AETEETLNG

SEQ ID NO: 446192 - protein, 9 aa, Homo Sapiens
KPKGTENED

SEQ ID NO: 446193 - protein, 9 aa, Homo Sapiens
ITSETSGSF

SEQ ID NO: 446194 - protein, 9 aa, Homo Sapiens
MRVSYLVKD

SEQ ID NO: 446195 - protein, 9 aa, Homo Sapiens
TFECEQKKE

SEQ ID NO: 446196 - protein, 9 aa, Homo Sapiens
MENTLKGLN

SEQ ID NO: 446197 - protein, 9 aa, Homo Sapiens
KPFDANTSV

SEQ ID NO: 446198 - protein, 9 aa, Homo Sapiens
DAFMKAIGL

SEQ ID NO: 446199 - protein, 9 aa, Homo Sapiens
GGQIPKKFA

SEQ ID NO: 446200 - protein, 9 aa, Homo Sapiens
SFEKGDYFS

SEQ ID NO: 446201 - protein, 9 aa, Homo Sapiens
NQLVLIFAG

SEQ ID NO: 446202 - protein, 9 aa, Homo Sapiens
PPFLVNCKI

SEQ ID NO: 446203 - protein, 9 aa, Homo Sapiens
GTPQEGIAK

SEQ ID NO: 446204 - protein, 9 aa, Homo Sapiens
GFTGPDGSP

SEQ ID NO: 446205 - protein, 9 aa, Homo Sapiens
MKFMKTRQR

SEQ ID NO: 446206 - protein, 9 aa, Homo Sapiens
VKPFQVKKH

SEQ ID NO: 446207 - protein, 9 aa, Homo Sapiens
VHKEEIAEL

SEQ ID NO: 446208 - protein, 9 aa, Homo Sapiens
SVNFLHSNT

SEQ ID NO: 446209 - protein, 9 aa, Homo Sapiens
RAVLQLWDT

SEQ ID NO: 446210 - protein, 9 aa, Homo Sapiens
CSNQIMGRG

SEQ ID NO: 446211 - protein, 9 aa, Homo Sapiens
LWKHLLPQS

SEQ ID NO: 446212 - protein, 9 aa, Homo Sapiens
CLSDHFQIH

SEQ ID NO: 446213 - protein, 9 aa, Homo Sapiens
PTLSANIQF

SEQ ID NO: 446214 - protein, 9 aa, Homo Sapiens
ANHFPAYVH

SEQ ID NO: 446215 - protein, 9 aa, Homo Sapiens
KINEENKLG

SEQ ID NO: 446216 - protein, 9 aa, Homo Sapiens
HKIEGSKAP

SEQ ID NO: 446217 - protein, 9 aa, Homo Sapiens
WQSQSSRES

SEQ ID NO: 446218 - protein, 9 aa, Homo Sapiens
NLFYWPRRA

SEQ ID NO: 446219 - protein, 9 aa, Homo Sapiens
LFAVALLNQ

SEQ ID NO: 446220 - protein, 9 aa, Homo Sapiens
SEGLQGAED

SEQ ID NO: 446221 - protein, 9 aa, Homo Sapiens
VQKLKAILK

SEQ ID NO: 446222 - protein, 9 aa, Homo Sapiens
YTLHSSVNY

SEQ ID NO: 446223 - protein, 9 aa, Homo Sapiens
NCGKRFSNR

SEQ ID NO: 446224 - protein, 9 aa, Homo Sapiens
ISKEYSVDR

SEQ ID NO: 446225 - protein, 9 aa, Homo Sapiens
TLNNSKCLL

SEQ ID NO: 446226 - protein, 9 aa, Homo Sapiens
LDHPDRALL

SEQ ID NO: 446227 - protein, 9 aa, Homo Sapiens
EAITLLKES

SEQ ID NO: 446228 - protein, 9 aa, Homo Sapiens
YLVLKSALC

SEQ ID NO: 446229 - protein, 9 aa, Homo Sapiens
SGKSKVGVW

SEQ ID NO: 446230 - protein, 9 aa, Homo Sapiens
IFPISPVAA

SEQ ID NO: 446231 - protein, 9 aa, Homo Sapiens
KTTGHYNHN

SEQ ID NO: 446232 - protein, 9 aa, Homo Sapiens
KSKVGVWGD

SEQ ID NO: 446233 - protein, 9 aa, Homo Sapiens
FLFYQPISH

SEQ ID NO: 446234 - protein, 9 aa, Homo Sapiens
ELQRTGWFC

SEQ ID NO: 446235 - protein, 9 aa, Homo Sapiens
VSQSYIRGW

SEQ ID NO: 446236 - protein, 9 aa, Homo Sapiens
NIQHFWVLF

SEQ ID NO: 446237 - protein, 9 aa, Homo Sapiens
SLQHRFYGL

SEQ ID NO: 446238 - protein, 9 aa, Homo Sapiens
KINFESFVK

SEQ ID NO: 446239 - protein, 9 aa, Homo Sapiens
AYGEFRNNK

SEQ ID NO: 446240 - protein, 9 aa, Homo Sapiens
KQNTEESSS

SEQ ID NO: 446241 - protein, 9 aa, Homo Sapiens
LEEEASLKP

SEQ ID NO: 446242 - protein, 9 aa, Homo Sapiens
HLVQLLRLI

SEQ ID NO: 446243 - protein, 9 aa, Homo Sapiens
VTDLNKLRT

SEQ ID NO: 446244 - protein, 9 aa, Homo Sapiens
KFPPSKDAS

SEQ ID NO: 446245 - protein, 9 aa, Homo Sapiens
NIVGKYGTQ

SEQ ID NO: 446246 - protein, 9 aa, Homo Sapiens
ERNICNNYA

SEQ ID NO: 446247 - protein, 9 aa, Homo Sapiens
QWFNKLYLN

SEQ ID NO: 446248 - protein, 9 aa, Homo Sapiens
KKGKAKTKR

SEQ ID NO: 446249 - protein, 9 aa, Homo Sapiens
VLYAPPKES

SEQ ID NO: 446250 - protein, 9 aa, Homo Sapiens
TSHKIIHTG

SEQ ID NO: 446251 - protein, 9 aa, Homo Sapiens
IYDESNAFE

SEQ ID NO: 446252 - protein, 9 aa, Homo Sapiens
RTQLQFTAY

SEQ ID NO: 446253 - protein, 9 aa, Homo Sapiens
ISNNLFKCW

SEQ ID NO: 446254 - protein, 9 aa, Homo Sapiens
CKIIKKELQ

SEQ ID NO: 446255 - protein, 9 aa, Homo Sapiens
KDTLYIVEQ

SEQ ID NO: 446256 - protein, 9 aa, Homo Sapiens
DLSHHPKCI

SEQ ID NO: 446257 - protein, 9 aa, Homo Sapiens
ITYSTERLR

SEQ ID NO: 446258 - protein, 9 aa, Homo Sapiens
NSLDTCDLH

SEQ ID NO: 446259 - protein, 9 aa, Homo Sapiens
QAQIQKVYP

SEQ ID NO: 446260 - protein, 9 aa, Homo Sapiens
LVSCKVSAC

SEQ ID NO: 446261 - protein, 9 aa, Homo Sapiens
NMLTNLGLN

SEQ ID NO: 446262 - protein, 9 aa, Homo Sapiens
AVRRRQNSA

SEQ ID NO: 446263 - protein, 9 aa, Homo Sapiens
NVMVPVGGA

SEQ ID NO: 446264 - protein, 9 aa, Homo Sapiens
KSEIYKKLI

SEQ ID NO: 446265 - protein, 9 aa, Homo Sapiens
EICTANEGV

SEQ ID NO: 446266 - protein, 9 aa, Homo Sapiens
CSRIIADRF

SEQ ID NO: 446267 - protein, 9 aa, Homo Sapiens
AHVLGDHSQ

SEQ ID NO: 446268 - protein, 9 aa, Homo Sapiens
CIWIHLDRK

SEQ ID NO: 446269 - protein, 9 aa, Homo Sapiens
RAREQVKTV

SEQ ID NO: 446270 - protein, 9 aa, Homo Sapiens
YLCWMLWRQ

SEQ ID NO: 446271 - protein, 9 aa, Homo Sapiens
TVTMSSDSQ

SEQ ID NO: 446272 - protein, 9 aa, Homo Sapiens
LQDSKLFEN

SEQ ID NO: 446273 - protein, 9 aa, Homo Sapiens
TFTYHKITH

SEQ ID NO: 446274 - protein, 9 aa, Homo Sapiens
QENELSDTA

SEQ ID NO: 446275 - protein, 9 aa, Homo Sapiens
FQLRDTYMF

SEQ ID NO: 446276 - protein, 9 aa, Homo Sapiens
ARYKDVYVK

SEQ ID NO: 446277 - protein, 9 aa, Homo Sapiens
CPKCGHPRA

SEQ ID NO: 446278 - protein, 9 aa, Homo Sapiens
AIKKEEKVL

SEQ ID NO: 446279 - protein, 9 aa, Homo Sapiens
STEFFILAV

SEQ ID NO: 446280 - protein, 9 aa, Homo Sapiens
TTEGRTRID

SEQ ID NO: 446281 - protein, 9 aa, Homo Sapiens
GPLQLEILN

SEQ ID NO: 446282 - protein, 9 aa, Homo Sapiens
TAVNKQNWQ

SEQ ID NO: 446283 - protein, 9 aa, Homo Sapiens
KASEKKDQA

SEQ ID NO: 446284 - protein, 9 aa, Homo Sapiens
LLTNGGRQT

SEQ ID NO: 446285 - protein, 9 aa, Homo Sapiens
SPSQRVNLD

SEQ ID NO: 446286 - protein, 9 aa, Homo Sapiens
LSDRKRELD

SEQ ID NO: 446287 - protein, 9 aa, Homo Sapiens
TSKIPDMSV

SEQ ID NO: 446288 - protein, 9 aa, Homo Sapiens
EAHKIVICA

SEQ ID NO: 446289 - protein, 9 aa, Homo Sapiens
ALAYLHVQG

SEQ ID NO: 446290 - protein, 9 aa, Homo Sapiens
EGAAAGKNT

SEQ ID NO: 446291 - protein, 9 aa, Homo Sapiens
PALVKVLLY

SEQ ID NO: 446292 - protein, 9 aa, Homo Sapiens
GQTVYLNMA

SEQ ID NO: 446293 - protein, 9 aa, Homo Sapiens
KPKEAIKKE

SEQ ID NO: 446294 - protein, 9 aa, Homo Sapiens
QPSQHPKKK

SEQ ID NO: 446295 - protein, 9 aa, Homo Sapiens
QTLYLSYLT

SEQ ID NO: 446296 - protein, 9 aa, Homo Sapiens
TNESLTLPR

SEQ ID NO: 446297 - protein, 9 aa, Homo Sapiens
SPLHQSGSV

SEQ ID NO: 446298 - protein, 9 aa, Homo Sapiens
YFQFFSDAQ

SEQ ID NO: 446299 - protein, 9 aa, Homo Sapiens
ICKIRFNSQ

SEQ ID NO: 446300 - protein, 9 aa, Homo Sapiens
IRFISRHRL

SEQ ID NO: 446301 - protein, 9 aa, Homo Sapiens
RLWNFTDDQ

SEQ ID NO: 446302 - protein, 9 aa, Homo Sapiens
PVTFKYMKE

SEQ ID NO: 446303 - protein, 9 aa, Homo Sapiens
IENLQKELN

SEQ ID NO: 446304 - protein, 9 aa, Homo Sapiens
HANVQLLHS

SEQ ID NO: 446305 - protein, 9 aa, Homo Sapiens
NYILAAMAY

SEQ ID NO: 446306 - protein, 9 aa, Homo Sapiens
GVLGVVATK

SEQ ID NO: 446307 - protein, 9 aa, Homo Sapiens
DKFLTSVST

SEQ ID NO: 446308 - protein, 9 aa, Homo Sapiens
IWITHRSHH

SEQ ID NO: 446309 - protein, 9 aa, Homo Sapiens
LEDGLHYVA

SEQ ID NO: 446310 - protein, 9 aa, Homo Sapiens
LDYLRALKH

SEQ ID NO: 446311 - protein, 9 aa, Homo Sapiens
TFYPYLDIA

SEQ ID NO: 446312 - protein, 9 aa, Homo Sapiens
GCRHTPVVR

SEQ ID NO: 446313 - protein, 9 aa, Homo Sapiens
ALYPEFTPR

SEQ ID NO: 446314 - protein, 9 aa, Homo Sapiens
STTPLFTDQ

SEQ ID NO: 446315 - protein, 9 aa, Homo Sapiens
LDKGGKSCE

SEQ ID NO: 446316 - protein, 9 aa, Homo Sapiens
KICTLGLQH

SEQ ID NO: 446317 - protein, 9 aa, Homo Sapiens
KAIMEDSGR

SEQ ID NO: 446318 - protein, 9 aa, Homo Sapiens
HTCLTQFLE

SEQ ID NO: 446319 - protein, 9 aa, Homo Sapiens
NPVLLLITI

SEQ ID NO: 446320 - protein, 9 aa, Homo Sapiens
EDMSTNPAI

SEQ ID NO: 446321 - protein, 9 aa, Homo Sapiens
WSIDVGDGA

SEQ ID NO: 446322 - protein, 9 aa, Homo Sapiens
KIVLNFTPM

SEQ ID NO: 446323 - protein, 9 aa, Homo Sapiens
EQEKVVYMF

SEQ ID NO: 446324 - protein, 9 aa, Homo Sapiens
QHRFYGLSI

SEQ ID NO: 446325 - protein, 9 aa, Homo Sapiens
TKKGGLKHI

SEQ ID NO: 446326 - protein, 9 aa, Homo Sapiens
LSRTPISDL

SEQ ID NO: 446327 - protein, 9 aa, Homo Sapiens
AFHLDRHLY

SEQ ID NO: 446328 - protein, 9 aa, Homo Sapiens
LLYVLRVIT

SEQ ID NO: 446329 - protein, 9 aa, Homo Sapiens
NYNGPMLTV

SEQ ID NO: 446330 - protein, 9 aa, Homo Sapiens
LLSDYVIHN

SEQ ID NO: 446331 - protein, 9 aa, Homo Sapiens
ADPVVSATS

SEQ ID NO: 446332 - protein, 9 aa, Homo Sapiens
GEPLEKLNI

SEQ ID NO: 446333 - protein, 9 aa, Homo Sapiens
CGLKRLCIN

SEQ ID NO: 446334 - protein, 9 aa, Homo Sapiens
IIAFYDMAR

SEQ ID NO: 446335 - protein, 9 aa, Homo Sapiens
VVYMFYTLG

SEQ ID NO: 446336 - protein, 9 aa, Homo Sapiens
GATVGSSMY

SEQ ID NO: 446337 - protein, 9 aa, Homo Sapiens
QPPSEHSPD

SEQ ID NO: 446338 - protein, 9 aa, Homo Sapiens
RYRGLTGCL

SEQ ID NO: 446339 - protein, 9 aa, Homo Sapiens
LVQNDYEAR

SEQ ID NO: 446340 - protein, 9 aa, Homo Sapiens
DNTFCMAIS

SEQ ID NO: 446341 - protein, 9 aa, Homo Sapiens
SVQYTLSSL

SEQ ID NO: 446342 - protein, 9 aa, Homo Sapiens
SLRFSTDNA

SEQ ID NO: 446343 - protein, 9 aa, Homo Sapiens
AMGKNPRSW

SEQ ID NO: 446344 - protein, 9 aa, Homo Sapiens
FYLDDSDTI

SEQ ID NO: 446345 - protein, 9 aa, Homo Sapiens
VIRKKLVDL

SEQ ID NO: 446346 - protein, 9 aa, Homo Sapiens
ELSEGDIAQ

SEQ ID NO: 446347 - protein, 9 aa, Homo Sapiens
FSSPDLVNT

SEQ ID NO: 446348 - protein, 9 aa, Homo Sapiens
SPTKYPTTP

SEQ ID NO: 446349 - protein, 9 aa, Homo Sapiens
HIQWFNKLY

SEQ ID NO: 446350 - protein, 9 aa, Homo Sapiens
QWAYDNWGE

SEQ ID NO: 446351 - protein, 9 aa, Homo Sapiens
VSGKHEDKQ

SEQ ID NO: 446352 - protein, 9 aa, Homo Sapiens
QEKRMGIDL

SEQ ID NO: 446353 - protein, 9 aa, Homo Sapiens
ENPFNCTCG

SEQ ID NO: 446354 - protein, 9 aa, Homo Sapiens
LARAKKRKD

SEQ ID NO: 446355 - protein, 9 aa, Homo Sapiens
LRHIAQTSL

SEQ ID NO: 446356 - protein, 9 aa, Homo Sapiens
WKEADKFGQ

SEQ ID NO: 446357 - protein, 9 aa, Homo Sapiens
TNRQPKDKN

SEQ ID NO: 446358 - protein, 9 aa, Homo Sapiens
PEILFNVLL

SEQ ID NO: 446359 - protein, 9 aa, Homo Sapiens
WEVHMGDSL

SEQ ID NO: 446360 - protein, 9 aa, Homo Sapiens
QPALAVSMA

SEQ ID NO: 446361 - protein, 9 aa, Homo Sapiens
CKESMLKND

SEQ ID NO: 446362 - protein, 9 aa, Homo Sapiens
VEGTAWKME

SEQ ID NO: 446363 - protein, 9 aa, Homo Sapiens
QTSLKMVQA

SEQ ID NO: 446364 - protein, 9 aa, Homo Sapiens
PCHNCGKRF

SEQ ID NO: 446365 - protein, 9 aa, Homo Sapiens
KVTFYILVK

SEQ ID NO: 446366 - protein, 9 aa, Homo Sapiens
REYPITHRL

SEQ ID NO: 446367 - protein, 9 aa, Homo Sapiens
EKKYCKCNE

SEQ ID NO: 446368 - protein, 9 aa, Homo Sapiens
CLLIFRSQT

SEQ ID NO: 446369 - protein, 9 aa, Homo Sapiens
EWSLNIRKE

SEQ ID NO: 446370 - protein, 9 aa, Homo Sapiens
SNTPKNVLW

SEQ ID NO: 446371 - protein, 9 aa, Homo Sapiens
DLGYLLLGA

SEQ ID NO: 446372 - protein, 9 aa, Homo Sapiens
TILKLIGVG

SEQ ID NO: 446373 - protein, 9 aa, Homo Sapiens
PQCNIFGQY

SEQ ID NO: 446374 - protein, 9 aa, Homo Sapiens
QSDGVRGMY

SEQ ID NO: 446375 - protein, 9 aa, Homo Sapiens
NKTTKPLDR

SEQ ID NO: 446376 - protein, 9 aa, Homo Sapiens
ALTKTQLVE

SEQ ID NO: 446377 - protein, 9 aa, Homo Sapiens
IGPIIRAEV

SEQ ID NO: 446378 - protein, 9 aa, Homo Sapiens
CFVGLYNVD

SEQ ID NO: 446379 - protein, 9 aa, Homo Sapiens
CLNCPDGIT

SEQ ID NO: 446380 - protein, 9 aa, Homo Sapiens
EAIATTRSA

SEQ ID NO: 446381 - protein, 9 aa, Homo Sapiens
TDIVILLCA

SEQ ID NO: 446382 - protein, 9 aa, Homo Sapiens
GCDEQHGLC

SEQ ID NO: 446383 - protein, 9 aa, Homo Sapiens
FQYSWNDFA

SEQ ID NO: 446384 - protein, 9 aa, Homo Sapiens
GTDFIDCLK

SEQ ID NO: 446385 - protein, 9 aa, Homo Sapiens
SVKPFQVKK

SEQ ID NO: 446386 - protein, 9 aa, Homo Sapiens
TNHLLRPLG

SEQ ID NO: 446387 - protein, 9 aa, Homo Sapiens
ADVFMSYPG

SEQ ID NO: 446388 - protein, 9 aa, Homo Sapiens
TLRYHHIMT

SEQ ID NO: 446389 - protein, 9 aa, Homo Sapiens
KQLRVFVYC

SEQ ID NO: 446390 - protein, 9 aa, Homo Sapiens
HPTAEGTSM

SEQ ID NO: 446391 - protein, 9 aa, Homo Sapiens
NSKKVVQLE

SEQ ID NO: 446392 - protein, 9 aa, Homo Sapiens
ILAIRSIIL

SEQ ID NO: 446393 - protein, 9 aa, Homo Sapiens
KIEKLKIQA

SEQ ID NO: 446394 - protein, 9 aa, Homo Sapiens
EKYNVYRDH

SEQ ID NO: 446395 - protein, 9 aa, Homo Sapiens
LQSLISTDA

SEQ ID NO: 446396 - protein, 9 aa, Homo Sapiens
PGDLLQRLL

SEQ ID NO: 446397 - protein, 9 aa, Homo Sapiens
LASSTQYSA

SEQ ID NO: 446398 - protein, 9 aa, Homo Sapiens
MLEIYNHLL

SEQ ID NO: 446399 - protein, 9 aa, Homo Sapiens
SALVRHQII

SEQ ID NO: 446400 - protein, 9 aa, Homo Sapiens
KKKCVCYIQ

SEQ ID NO: 446401 - protein, 9 aa, Homo Sapiens
DIEVEASDL

SEQ ID NO: 446402 - protein, 9 aa, Homo Sapiens
YKTNESLTL

SEQ ID NO: 446403 - protein, 9 aa, Homo Sapiens
SQNRLFNLG

SEQ ID NO: 446404 - protein, 9 aa, Homo Sapiens
VQVLRSPPQ

SEQ ID NO: 446405 - protein, 9 aa, Homo Sapiens
KGNTIVPES

SEQ ID NO: 446406 - protein, 9 aa, Homo Sapiens
TLATRIVEC

SEQ ID NO: 446407 - protein, 9 aa, Homo Sapiens
LGKKVKRWG

SEQ ID NO: 446408 - protein, 9 aa, Homo Sapiens
NHHEQSSKD

SEQ ID NO: 446409 - protein, 9 aa, Homo Sapiens
KHIWVFINC

SEQ ID NO: 446410 - protein, 9 aa, Homo Sapiens
FTEKGEAGH

SEQ ID NO: 446411 - protein, 9 aa, Homo Sapiens
LAPELKFQV

SEQ ID NO: 446412 - protein, 9 aa, Homo Sapiens
YRHNYHKAG

SEQ ID NO: 446413 - protein, 9 aa, Homo Sapiens
DNIKMKPKP

SEQ ID NO: 446414 - protein, 9 aa, Homo Sapiens
EYINLVCGD

SEQ ID NO: 446415 - protein, 9 aa, Homo Sapiens
SLMTGPMVQ

SEQ ID NO: 446416 - protein, 9 aa, Homo Sapiens
YSWPWCSAS

SEQ ID NO: 446417 - protein, 9 aa, Homo Sapiens
YKKLYTISL

SEQ ID NO: 446418 - protein, 9 aa, Homo Sapiens
FWKLAKIKQ

SEQ ID NO: 446419 - protein, 9 aa, Homo Sapiens
NCRVLGHTV

SEQ ID NO: 446420 - protein, 9 aa, Homo Sapiens
ADICKSVAS

SEQ ID NO: 446421 - protein, 9 aa, Homo Sapiens
YSCDKNTGD

SEQ ID NO: 446422 - protein, 9 aa, Homo Sapiens
RKSSHHLAA

SEQ ID NO: 446423 - protein, 9 aa, Homo Sapiens
YLREMRHHF

SEQ ID NO: 446424 - protein, 9 aa, Homo Sapiens
AVIYVAFSP

SEQ ID NO: 446425 - protein, 9 aa, Homo Sapiens
KLAKAAKKK

SEQ ID NO: 446426 - protein, 9 aa, Homo Sapiens
LRHWIQLPD

SEQ ID NO: 446427 - protein, 9 aa, Homo Sapiens
PLLWMFSFK

SEQ ID NO: 446428 - protein, 9 aa, Homo Sapiens
KRINVITMQ

SEQ ID NO: 446429 - protein, 9 aa, Homo Sapiens
SPTAVSSDQ

SEQ ID NO: 446430 - protein, 9 aa, Homo Sapiens
IYPSSQATE

SEQ ID NO: 446431 - protein, 9 aa, Homo Sapiens
DPIECLLSF

SEQ ID NO: 446432 - protein, 9 aa, Homo Sapiens
DAVRLNRYE

SEQ ID NO: 446433 - protein, 9 aa, Homo Sapiens
RYQIQVGKN

SEQ ID NO: 446434 - protein, 9 aa, Homo Sapiens
TLNNAYKNS

SEQ ID NO: 446435 - protein, 9 aa, Homo Sapiens
AIHITARIE

SEQ ID NO: 446436 - protein, 9 aa, Homo Sapiens
LSIMADIEN

SEQ ID NO: 446437 - protein, 9 aa, Homo Sapiens
LSQKICSCL

SEQ ID NO: 446438 - protein, 9 aa, Homo Sapiens
LDETLLDEL

SEQ ID NO: 446439 - protein, 9 aa, Homo Sapiens
PYGPQTPSE

SEQ ID NO: 446440 - protein, 9 aa, Homo Sapiens
FLSRYRGLT

SEQ ID NO: 446441 - protein, 9 aa, Homo Sapiens
PSGSARPST

SEQ ID NO: 446442 - protein, 9 aa, Homo Sapiens
CRVFSSKRS

SEQ ID NO: 446443 - protein, 9 aa, Homo Sapiens
VEDFAVKFS

SEQ ID NO: 446444 - protein, 9 aa, Homo Sapiens
QKNAIGSRQ

SEQ ID NO: 446445 - protein, 9 aa, Homo Sapiens
KSTSQGLCF

SEQ ID NO: 446446 - protein, 9 aa, Homo Sapiens
PIQMWCVER

SEQ ID NO: 446447 - protein, 9 aa, Homo Sapiens
NKTAVKRDD

SEQ ID NO: 446448 - protein, 9 aa, Homo Sapiens
GLYPKVANI

SEQ ID NO: 446449 - protein, 9 aa, Homo Sapiens
QKEGTPGIF

SEQ ID NO: 446450 - protein, 9 aa, Homo Sapiens
CVPPCTGDG

SEQ ID NO: 446451 - protein, 9 aa, Homo Sapiens
GLKAEIGQP

SEQ ID NO: 446452 - protein, 9 aa, Homo Sapiens
RKLISYRGC

SEQ ID NO: 446453 - protein, 9 aa, Homo Sapiens
FSSSTNTEK

SEQ ID NO: 446454 - protein, 9 aa, Homo Sapiens
KDEHNQNGN

SEQ ID NO: 446455 - protein, 9 aa, Homo Sapiens
LQVELKQQY

SEQ ID NO: 446456 - protein, 9 aa, Homo Sapiens
IVPCRSCLL

SEQ ID NO: 446457 - protein, 9 aa, Homo Sapiens
FNLCSRRFT

SEQ ID NO: 446458 - protein, 9 aa, Homo Sapiens
IIMSHRVCI

SEQ ID NO: 446459 - protein, 9 aa, Homo Sapiens
EFLSSDPEV

SEQ ID NO: 446460 - protein, 9 aa, Homo Sapiens
FFTKKGGLK

SEQ ID NO: 446461 - protein, 9 aa, Homo Sapiens
TAEFFRDLL

SEQ ID NO: 446462 - protein, 9 aa, Homo Sapiens
QGSELIPKA

SEQ ID NO: 446463 - protein, 9 aa, Homo Sapiens
ICNLLQYQD

SEQ ID NO: 446464 - protein, 9 aa, Homo Sapiens
HNPELQKLL

SEQ ID NO: 446465 - protein, 9 aa, Homo Sapiens
NNCPSLKDK

SEQ ID NO: 446466 - protein, 9 aa, Homo Sapiens
SSLLRKFEF

SEQ ID NO: 446467 - protein, 9 aa, Homo Sapiens
LFVKVQLTA

SEQ ID NO: 446468 - protein, 9 aa, Homo Sapiens
LDDRYKMED

SEQ ID NO: 446469 - protein, 9 aa, Homo Sapiens
QPMENSGFC

SEQ ID NO: 446470 - protein, 9 aa, Homo Sapiens
TSEFGTLPE

SEQ ID NO: 446471 - protein, 9 aa, Homo Sapiens
VFIREHLNY

SEQ ID NO: 446472 - protein, 9 aa, Homo Sapiens
RITMAARMK

SEQ ID NO: 446473 - protein, 9 aa, Homo Sapiens
CIEKLKERS

SEQ ID NO: 446474 - protein, 9 aa, Homo Sapiens
KILYALVQY

SEQ ID NO: 446475 - protein, 9 aa, Homo Sapiens
GDYGGSGTW

SEQ ID NO: 446476 - protein, 9 aa, Homo Sapiens
RGPNFGWRF

SEQ ID NO: 446477 - protein, 9 aa, Homo Sapiens
QIGVLGGVA

SEQ ID NO: 446478 - protein, 9 aa, Homo Sapiens
LINKKEICI

SEQ ID NO: 446479 - protein, 9 aa, Homo Sapiens
VNPEYSSTQ

SEQ ID NO: 446480 - protein, 9 aa, Homo Sapiens
GCRNTYYAS

SEQ ID NO: 446481 - protein, 9 aa, Homo Sapiens
LEEKNTISD

SEQ ID NO: 446482 - protein, 9 aa, Homo Sapiens
IFLSFKSLL

SEQ ID NO: 446483 - protein, 9 aa, Homo Sapiens
HQKEFNTLS

SEQ ID NO: 446484 - protein, 9 aa, Homo Sapiens
KICKNSSTY

SEQ ID NO: 446485 - protein, 9 aa, Homo Sapiens
IIYSLFTLS

SEQ ID NO: 446486 - protein, 9 aa, Homo Sapiens
RSASPKKQH

SEQ ID NO: 446487 - protein, 9 aa, Homo Sapiens
QTLKGHTDS

SEQ ID NO: 446488 - protein, 9 aa, Homo Sapiens
GFLTTPTGS

SEQ ID NO: 446489 - protein, 9 aa, Homo Sapiens
ESTSSENYG

SEQ ID NO: 446490 - protein, 9 aa, Homo Sapiens
HVCIRAYLE

SEQ ID NO: 446491 - protein, 9 aa, Homo Sapiens
MTPLCIALM

SEQ ID NO: 446492 - protein, 9 aa, Homo Sapiens
RPAMYYVSP

SEQ ID NO: 446493 - protein, 9 aa, Homo Sapiens
VDNQTYSGM

SEQ ID NO: 446494 - protein, 9 aa, Homo Sapiens
RCGHYYDAS

SEQ ID NO: 446495 - protein, 9 aa, Homo Sapiens
MCLRLQDAR

SEQ ID NO: 446496 - protein, 9 aa, Homo Sapiens
PSLHRLDLG

SEQ ID NO: 446497 - protein, 9 aa, Homo Sapiens
VLLDDPFSA

SEQ ID NO: 446498 - protein, 9 aa, Homo Sapiens
KMEVDEDKS

SEQ ID NO: 446499 - protein, 9 aa, Homo Sapiens
HEQSSKDIW

SEQ ID NO: 446500 - protein, 9 aa, Homo Sapiens
PGYYICKKG

SEQ ID NO: 446501 - protein, 9 aa, Homo Sapiens
WHKFVYIYD

SEQ ID NO: 446502 - protein, 9 aa, Homo Sapiens
EESLLNNLQ

SEQ ID NO: 446503 - protein, 9 aa, Homo Sapiens
HQRQEIIQH

SEQ ID NO: 446504 - protein, 9 aa, Homo Sapiens
KPYGCLQCG

SEQ ID NO: 446505 - protein, 9 aa, Homo Sapiens
CRYVKQQCH

SEQ ID NO: 446506 - protein, 9 aa, Homo Sapiens
HGWVWNQFF

SEQ ID NO: 446507 - protein, 9 aa, Homo Sapiens
RITQLAKEL

SEQ ID NO: 446508 - protein, 9 aa, Homo Sapiens
RAMGKNPRS

SEQ ID NO: 446509 - protein, 9 aa, Homo Sapiens
CNHQIMSVS

SEQ ID NO: 446510 - protein, 9 aa, Homo Sapiens
VPATINART

SEQ ID NO: 446511 - protein, 9 aa, Homo Sapiens
FRRVLYAPP

SEQ ID NO: 446512 - protein, 9 aa, Homo Sapiens
SKNTAAIKN

SEQ ID NO: 446513 - protein, 9 aa, Homo Sapiens
GHKAELTED

SEQ ID NO: 446514 - protein, 9 aa, Homo Sapiens
RDTLTLEML

SEQ ID NO: 446515 - protein, 9 aa, Homo Sapiens
AFTTILIIF

SEQ ID NO: 446516 - protein, 9 aa, Homo Sapiens
VTERWFVGG

SEQ ID NO: 446517 - protein, 9 aa, Homo Sapiens
TCLEKMQKY

SEQ ID NO: 446518 - protein, 9 aa, Homo Sapiens
IYLASLPKI

SEQ ID NO: 446519 - protein, 9 aa, Homo Sapiens
IKIMIIFSI

SEQ ID NO: 446520 - protein, 9 aa, Homo Sapiens
YTGLRCIWL

SEQ ID NO: 446521 - protein, 9 aa, Homo Sapiens
LFQLKKVRF

SEQ ID NO: 446522 - protein, 9 aa, Homo Sapiens
WKGAWYFEI

SEQ ID NO: 446523 - protein, 9 aa, Homo Sapiens
QYAFKIATL

SEQ ID NO: 446524 - protein, 9 aa, Homo Sapiens
AEVEHLTKV

SEQ ID NO: 446525 - protein, 9 aa, Homo Sapiens
SDKPYIRPG

SEQ ID NO: 446526 - protein, 9 aa, Homo Sapiens
KDDKSHFKD

SEQ ID NO: 446527 - protein, 9 aa, Homo Sapiens
QKPNYMEKG

SEQ ID NO: 446528 - protein, 9 aa, Homo Sapiens
PDLPCDLIH

SEQ ID NO: 446529 - protein, 9 aa, Homo Sapiens
HRLLGVCYI

SEQ ID NO: 446530 - protein, 9 aa, Homo Sapiens
GFKRLSCLS

SEQ ID NO: 446531 - protein, 9 aa, Homo Sapiens
IVHLERDIN

SEQ ID NO: 446532 - protein, 9 aa, Homo Sapiens
GDIKAIVDK

SEQ ID NO: 446533 - protein, 9 aa, Homo Sapiens
IEQSITSET

SEQ ID NO: 446534 - protein, 9 aa, Homo Sapiens
EYATYEAIC

SEQ ID NO: 446535 - protein, 9 aa, Homo Sapiens
IPRDWKTFL

SEQ ID NO: 446536 - protein, 9 aa, Homo Sapiens
LSNIMNYFQ

SEQ ID NO: 446537 - protein, 9 aa, Homo Sapiens
ICFHENEIV

SEQ ID NO: 446538 - protein, 9 aa, Homo Sapiens
PEAADLSDQ

SEQ ID NO: 446539 - protein, 9 aa, Homo Sapiens
EKIMDQYKL

SEQ ID NO: 446540 - protein, 9 aa, Homo Sapiens
VDSQEIYKF

SEQ ID NO: 446541 - protein, 9 aa, Homo Sapiens
THFESCADT

SEQ ID NO: 446542 - protein, 9 aa, Homo Sapiens
LLLQNNVPA

SEQ ID NO: 446543 - protein, 9 aa, Homo Sapiens
AFYPGYPLI

SEQ ID NO: 446544 - protein, 9 aa, Homo Sapiens
GLQPSTRDR

SEQ ID NO: 446545 - protein, 9 aa, Homo Sapiens
FAYHKESDI

SEQ ID NO: 446546 - protein, 9 aa, Homo Sapiens
YSSENQDTI

SEQ ID NO: 446547 - protein, 9 aa, Homo Sapiens
NRFMHMFQY

SEQ ID NO: 446548 - protein, 9 aa, Homo Sapiens
ESKKGILYE

SEQ ID NO: 446549 - protein, 9 aa, Homo Sapiens
KQNYLAVDS

SEQ ID NO: 446550 - protein, 9 aa, Homo Sapiens
WRESWEREV

SEQ ID NO: 446551 - protein, 9 aa, Homo Sapiens
EVLGEIPNP

SEQ ID NO: 446552 - protein, 9 aa, Homo Sapiens
GNSKKVVQL

SEQ ID NO: 446553 - protein, 9 aa, Homo Sapiens
NLPSAAAYV

SEQ ID NO: 446554 - protein, 9 aa, Homo Sapiens
RQDLRLWKQ

SEQ ID NO: 446555 - protein, 9 aa, Homo Sapiens
TYSGMVLAS

SEQ ID NO: 446556 - protein, 9 aa, Homo Sapiens
RWLPADYED

SEQ ID NO: 446557 - protein, 9 aa, Homo Sapiens
LIWHQKVHT

SEQ ID NO: 446558 - protein, 9 aa, Homo Sapiens
QPPPPTQHS

SEQ ID NO: 446559 - protein, 9 aa, Homo Sapiens
NNSEERLTS

SEQ ID NO: 446560 - protein, 9 aa, Homo Sapiens
ESGSSEELL

SEQ ID NO: 446561 - protein, 9 aa, Homo Sapiens
LRLLLWLEH

SEQ ID NO: 446562 - protein, 9 aa, Homo Sapiens
ERFNKWENY

SEQ ID NO: 446563 - protein, 9 aa, Homo Sapiens
VCAAVVGFC

SEQ ID NO: 446564 - protein, 9 aa, Homo Sapiens
NDWINLVIA

SEQ ID NO: 446565 - protein, 9 aa, Homo Sapiens
VVNLNSLIT

SEQ ID NO: 446566 - protein, 9 aa, Homo Sapiens
DNSMSEKAQ

SEQ ID NO: 446567 - protein, 9 aa, Homo Sapiens
VAYDLKTQV

SEQ ID NO: 446568 - protein, 9 aa, Homo Sapiens
EDRGFAYHK

SEQ ID NO: 446569 - protein, 9 aa, Homo Sapiens
GLSPSPSPD

SEQ ID NO: 446570 - protein, 9 aa, Homo Sapiens
EPNGSVETN

SEQ ID NO: 446571 - protein, 9 aa, Homo Sapiens
WEQHHLRKE

SEQ ID NO: 446572 - protein, 9 aa, Homo Sapiens
SIQDIETIE

SEQ ID NO: 446573 - protein, 9 aa, Homo Sapiens
SGASLMTGP

SEQ ID NO: 446574 - protein, 9 aa, Homo Sapiens
AKIRRKYMI

SEQ ID NO: 446575 - protein, 9 aa, Homo Sapiens
GQIALPKPR

SEQ ID NO: 446576 - protein, 9 aa, Homo Sapiens
LEQIGADKL

SEQ ID NO: 446577 - protein, 9 aa, Homo Sapiens
LHNNIKLLE

SEQ ID NO: 446578 - protein, 9 aa, Homo Sapiens
SFKVKDIHS

SEQ ID NO: 446579 - protein, 9 aa, Homo Sapiens
KKVKRWGMK

SEQ ID NO: 446580 - protein, 9 aa, Homo Sapiens
NKQQIKRKK

SEQ ID NO: 446581 - protein, 9 aa, Homo Sapiens
SSDSQVVDD

SEQ ID NO: 446582 - protein, 9 aa, Homo Sapiens
ASAADIKQD

SEQ ID NO: 446583 - protein, 9 aa, Homo Sapiens
WCHELIITK

SEQ ID NO: 446584 - protein, 9 aa, Homo Sapiens
NYSIEQPSQ

SEQ ID NO: 446585 - protein, 9 aa, Homo Sapiens
VLGHTVRST

SEQ ID NO: 446586 - protein, 9 aa, Homo Sapiens
PHAKFIMTA

SEQ ID NO: 446587 - protein, 9 aa, Homo Sapiens
EARYGSQHH

SEQ ID NO: 446588 - protein, 9 aa, Homo Sapiens
QDEEMINNK

SEQ ID NO: 446589 - protein, 9 aa, Homo Sapiens
GAEDEDFEK

SEQ ID NO: 446590 - protein, 9 aa, Homo Sapiens
SACNIEVKH

SEQ ID NO: 446591 - protein, 9 aa, Homo Sapiens
LPENYNEAE

SEQ ID NO: 446592 - protein, 9 aa, Homo Sapiens
HSRTNSGIR

SEQ ID NO: 446593 - protein, 9 aa, Homo Sapiens
PSASPSMPE

SEQ ID NO: 446594 - protein, 9 aa, Homo Sapiens
KKVCYHLTV

SEQ ID NO: 446595 - protein, 9 aa, Homo Sapiens
VEIYTKSYW

SEQ ID NO: 446596 - protein, 9 aa, Homo Sapiens
QPKCGTTYL

SEQ ID NO: 446597 - protein, 9 aa, Homo Sapiens
KRPGIALEL

SEQ ID NO: 446598 - protein, 9 aa, Homo Sapiens
MINRTSDVT

SEQ ID NO: 446599 - protein, 9 aa, Homo Sapiens
EITRFLSME

SEQ ID NO: 446600 - protein, 9 aa, Homo Sapiens
VVDATWLAL

SEQ ID NO: 446601 - protein, 9 aa, Homo Sapiens
SDKSKLQEI

SEQ ID NO: 446602 - protein, 9 aa, Homo Sapiens
MQSKNEQMM

SEQ ID NO: 446603 - protein, 9 aa, Homo Sapiens
SLIISSILN

SEQ ID NO: 446604 - protein, 9 aa, Homo Sapiens
LKEKQDKKI

SEQ ID NO: 446605 - protein, 9 aa, Homo Sapiens
GDVTQNKVR

SEQ ID NO: 446606 - protein, 9 aa, Homo Sapiens
TGHQIRKLD

SEQ ID NO: 446607 - protein, 9 aa, Homo Sapiens
VCNIHNKEK

SEQ ID NO: 446608 - protein, 9 aa, Homo Sapiens
QKLVGLDKL

SEQ ID NO: 446609 - protein, 9 aa, Homo Sapiens
WEINWEELE

SEQ ID NO: 446610 - protein, 9 aa, Homo Sapiens
VASPSAHSI

SEQ ID NO: 446611 - protein, 9 aa, Homo Sapiens
ALREQKYFK

SEQ ID NO: 446612 - protein, 9 aa, Homo Sapiens
FENAIHKDY

SEQ ID NO: 446613 - protein, 9 aa, Homo Sapiens
CPRRQRPHR

SEQ ID NO: 446614 - protein, 9 aa, Homo Sapiens
LSHQVPILF

SEQ ID NO: 446615 - protein, 9 aa, Homo Sapiens
RKIIMWDHD

SEQ ID NO: 446616 - protein, 9 aa, Homo Sapiens
FAVALYGLI

SEQ ID NO: 446617 - protein, 9 aa, Homo Sapiens
ETNHSSLWN

SEQ ID NO: 446618 - protein, 9 aa, Homo Sapiens
QSRGAKNYV

SEQ ID NO: 446619 - protein, 9 aa, Homo Sapiens
GWAVGASVE

SEQ ID NO: 446620 - protein, 9 aa, Homo Sapiens
KTISYQESF

SEQ ID NO: 446621 - protein, 9 aa, Homo Sapiens
GGDVTQNKV

SEQ ID NO: 446622 - protein, 9 aa, Homo Sapiens
LELIAYLDK

SEQ ID NO: 446623 - protein, 9 aa, Homo Sapiens
QQAQYILMK

SEQ ID NO: 446624 - protein, 9 aa, Homo Sapiens
RNDYDDTIQ

SEQ ID NO: 446625 - protein, 9 aa, Homo Sapiens
NFTQDEWAL

SEQ ID NO: 446626 - protein, 9 aa, Homo Sapiens
VQSVNDGTW

SEQ ID NO: 446627 - protein, 9 aa, Homo Sapiens
QTPYAGIKN

SEQ ID NO: 446628 - protein, 9 aa, Homo Sapiens
LLMPIKEKP

SEQ ID NO: 446629 - protein, 9 aa, Homo Sapiens
ELWASAPSP

SEQ ID NO: 446630 - protein, 9 aa, Homo Sapiens
IQYFVVIAA

SEQ ID NO: 446631 - protein, 9 aa, Homo Sapiens
LIEHVNAEI

SEQ ID NO: 446632 - protein, 9 aa, Homo Sapiens
HGHLWAYSC

SEQ ID NO: 446633 - protein, 9 aa, Homo Sapiens
LDAVTYLTG

SEQ ID NO: 446634 - protein, 9 aa, Homo Sapiens
FNRIPSLHR

SEQ ID NO: 446635 - protein, 9 aa, Homo Sapiens
TVAGVAFAC

SEQ ID NO: 446636 - protein, 9 aa, Homo Sapiens
YFTRKRLHK

SEQ ID NO: 446637 - protein, 9 aa, Homo Sapiens
VDNYFMRDS

SEQ ID NO: 446638 - protein, 9 aa, Homo Sapiens
HCFKITTAN

SEQ ID NO: 446639 - protein, 9 aa, Homo Sapiens
FDLITIVAG

SEQ ID NO: 446640 - protein, 9 aa, Homo Sapiens
TILSSLPEF

SEQ ID NO: 446641 - protein, 9 aa, Homo Sapiens
KEELNEMIY

SEQ ID NO: 446642 - protein, 9 aa, Homo Sapiens
LSILTRDRD

SEQ ID NO: 446643 - protein, 9 aa, Homo Sapiens
SHLYNESVS

SEQ ID NO: 446644 - protein, 9 aa, Homo Sapiens
GLGELSSEK

SEQ ID NO: 446645 - protein, 9 aa, Homo Sapiens
FLSWMEPFG

SEQ ID NO: 446646 - protein, 9 aa, Homo Sapiens
SQFYQGLPW

SEQ ID NO: 446647 - protein, 9 aa, Homo Sapiens
VMYIVCKNN

SEQ ID NO: 446648 - protein, 9 aa, Homo Sapiens
CQKPCKDTV

SEQ ID NO: 446649 - protein, 9 aa, Homo Sapiens
LFAIGLTPM

SEQ ID NO: 446650 - protein, 9 aa, Homo Sapiens
DDRYKMEDG

SEQ ID NO: 446651 - protein, 9 aa, Homo Sapiens
VGYEIKMFC

SEQ ID NO: 446652 - protein, 9 aa, Homo Sapiens
PGHTPRPAL

SEQ ID NO: 446653 - protein, 9 aa, Homo Sapiens
EFSRGFGLE

SEQ ID NO: 446654 - protein, 9 aa, Homo Sapiens
LQSVVLSKI

SEQ ID NO: 446655 - protein, 9 aa, Homo Sapiens
YTLAIVPKM

SEQ ID NO: 446656 - protein, 9 aa, Homo Sapiens
RSREQIQKH

SEQ ID NO: 446657 - protein, 9 aa, Homo Sapiens
IWFFLFFIF

SEQ ID NO: 446658 - protein, 9 aa, Homo Sapiens
FPKDTINVL

SEQ ID NO: 446659 - protein, 9 aa, Homo Sapiens
YLGLYFNEF

SEQ ID NO: 446660 - protein, 9 aa, Homo Sapiens
TGTSEYLLD

SEQ ID NO: 446661 - protein, 9 aa, Homo Sapiens
TIVAGLVQT

SEQ ID NO: 446662 - protein, 9 aa, Homo Sapiens
KAIAQLNYK

SEQ ID NO: 446663 - protein, 9 aa, Homo Sapiens
VVQWADLIT

SEQ ID NO: 446664 - protein, 9 aa, Homo Sapiens
AIFNMLNTN

SEQ ID NO: 446665 - protein, 9 aa, Homo Sapiens
FFVFWETSK

SEQ ID NO: 446666 - protein, 9 aa, Homo Sapiens
KTVQQNACA

SEQ ID NO: 446667 - protein, 9 aa, Homo Sapiens
YEIDFLRTL

SEQ ID NO: 446668 - protein, 9 aa, Homo Sapiens
EQAMDLVKI

SEQ ID NO: 446669 - protein, 9 aa, Homo Sapiens
LIHEGMCIS

SEQ ID NO: 446670 - protein, 9 aa, Homo Sapiens
ITQLFPTLL

SEQ ID NO: 446671 - protein, 9 aa, Homo Sapiens
CTCVVHKWC

SEQ ID NO: 446672 - protein, 9 aa, Homo Sapiens
ATPNMITDY

SEQ ID NO: 446673 - protein, 9 aa, Homo Sapiens
CETVFQPSP

SEQ ID NO: 446674 - protein, 9 aa, Homo Sapiens
YLGTTKDAA

SEQ ID NO: 446675 - protein, 9 aa, Homo Sapiens
RPQIKKDEK

SEQ ID NO: 446676 - protein, 9 aa, Homo Sapiens
NIFHICQQH

SEQ ID NO: 446677 - protein, 9 aa, Homo Sapiens
RWTRCKQSE

SEQ ID NO: 446678 - protein, 9 aa, Homo Sapiens
GWNGIKPSA

SEQ ID NO: 446679 - protein, 9 aa, Homo Sapiens
LNHLGVLID

SEQ ID NO: 446680 - protein, 9 aa, Homo Sapiens
NLNSLITSG

SEQ ID NO: 446681 - protein, 9 aa, Homo Sapiens
KEDYKKTKK

SEQ ID NO: 446682 - protein, 9 aa, Homo Sapiens
AADKANEQE

SEQ ID NO: 446683 - protein, 9 aa, Homo Sapiens
DLYHEHKKY

SEQ ID NO: 446684 - protein, 9 aa, Homo Sapiens
LPCDLIHLN

SEQ ID NO: 446685 - protein, 9 aa, Homo Sapiens
DTQKWKCIP

SEQ ID NO: 446686 - protein, 9 aa, Homo Sapiens
LFHHDMNSE

SEQ ID NO: 446687 - protein, 9 aa, Homo Sapiens
DRNSGVNGQ

SEQ ID NO: 446688 - protein, 9 aa, Homo Sapiens
ASDKLLASI

SEQ ID NO: 446689 - protein, 9 aa, Homo Sapiens
PEHILGKMT

SEQ ID NO: 446690 - protein, 9 aa, Homo Sapiens
QIIHTEERY

SEQ ID NO: 446691 - protein, 9 aa, Homo Sapiens
RSYVNNQPS

SEQ ID NO: 446692 - protein, 9 aa, Homo Sapiens
KKDKKTKRK

SEQ ID NO: 446693 - protein, 9 aa, Homo Sapiens
TFNLTKYPD

SEQ ID NO: 446694 - protein, 9 aa, Homo Sapiens
TIYHFSAKH

SEQ ID NO: 446695 - protein, 9 aa, Homo Sapiens
RYLEKCYGL

SEQ ID NO: 446696 - protein, 9 aa, Homo Sapiens
IDLDTNYAD

SEQ ID NO: 446697 - protein, 9 aa, Homo Sapiens
VVAAMIISI

SEQ ID NO: 446698 - protein, 9 aa, Homo Sapiens
VYLYNVAIS

SEQ ID NO: 446699 - protein, 9 aa, Homo Sapiens
DPEEAILSV

SEQ ID NO: 446700 - protein, 9 aa, Homo Sapiens
AYLNGSNME

SEQ ID NO: 446701 - protein, 9 aa, Homo Sapiens
PVNDKREQK

SEQ ID NO: 446702 - protein, 9 aa, Homo Sapiens
FYCNVANVF

SEQ ID NO: 446703 - protein, 9 aa, Homo Sapiens
AAKQVHSEN

SEQ ID NO: 446704 - protein, 9 aa, Homo Sapiens
PISKDARSQ

SEQ ID NO: 446705 - protein, 9 aa, Homo Sapiens
HKQTHTGEK

SEQ ID NO: 446706 - protein, 9 aa, Homo Sapiens
TVEEQIDTV

SEQ ID NO: 446707 - protein, 9 aa, Homo Sapiens
LPNDRLFAV

SEQ ID NO: 446708 - protein, 9 aa, Homo Sapiens
YGCLQCGKA

SEQ ID NO: 446709 - protein, 9 aa, Homo Sapiens
KFILEKGAD

SEQ ID NO: 446710 - protein, 9 aa, Homo Sapiens
SDLGYLLLG

SEQ ID NO: 446711 - protein, 9 aa, Homo Sapiens
VSVDHSLQD

SEQ ID NO: 446712 - protein, 9 aa, Homo Sapiens
EEEASKSVS

SEQ ID NO: 446713 - protein, 9 aa, Homo Sapiens
PLCHLQVDG

SEQ ID NO: 446714 - protein, 9 aa, Homo Sapiens
QVIEVLPRG

SEQ ID NO: 446715 - protein, 9 aa, Homo Sapiens
YFLDMFVYC

SEQ ID NO: 446716 - protein, 9 aa, Homo Sapiens
VSFCRTIYL

SEQ ID NO: 446717 - protein, 9 aa, Homo Sapiens
PLIISNCQY

SEQ ID NO: 446718 - protein, 9 aa, Homo Sapiens
SKVVMFVQT

SEQ ID NO: 446719 - protein, 9 aa, Homo Sapiens
LVIGTPNED

SEQ ID NO: 446720 - protein, 9 aa, Homo Sapiens
LGCLPLLSG

SEQ ID NO: 446721 - protein, 9 aa, Homo Sapiens
AKVQDYDRR

SEQ ID NO: 446722 - protein, 9 aa, Homo Sapiens
MKRPAVWEA

SEQ ID NO: 446723 - protein, 9 aa, Homo Sapiens
QPHKMKSLL

SEQ ID NO: 446724 - protein, 9 aa, Homo Sapiens
PALAVSMAF

SEQ ID NO: 446725 - protein, 9 aa, Homo Sapiens
NLANNFPAH

SEQ ID NO: 446726 - protein, 9 aa, Homo Sapiens
PNVVVTEAG

SEQ ID NO: 446727 - protein, 9 aa, Homo Sapiens
VCLAPIIYF

SEQ ID NO: 446728 - protein, 9 aa, Homo Sapiens
FFCGCGCGC

SEQ ID NO: 446729 - protein, 9 aa, Homo Sapiens
RCAQHWADL

SEQ ID NO: 446730 - protein, 9 aa, Homo Sapiens
GVISEKHMW

SEQ ID NO: 446731 - protein, 9 aa, Homo Sapiens
TVHLWDVAR

SEQ ID NO: 446732 - protein, 9 aa, Homo Sapiens
TYCPHAKFI

SEQ ID NO: 446733 - protein, 9 aa, Homo Sapiens
NIEYELQEY

SEQ ID NO: 446734 - protein, 9 aa, Homo Sapiens
PNNGNIFNS

SEQ ID NO: 446735 - protein, 9 aa, Homo Sapiens
EVTENIEVI

SEQ ID NO: 446736 - protein, 9 aa, Homo Sapiens
LPLVEIWLS

SEQ ID NO: 446737 - protein, 9 aa, Homo Sapiens
LHNGTCMDL

SEQ ID NO: 446738 - protein, 9 aa, Homo Sapiens
LDYLLTSSE

SEQ ID NO: 446739 - protein, 9 aa, Homo Sapiens
IYKSACNIE

SEQ ID NO: 446740 - protein, 9 aa, Homo Sapiens
TKGTRGPLG

SEQ ID NO: 446741 - protein, 9 aa, Homo Sapiens
SGIGREGAN

SEQ ID NO: 446742 - protein, 9 aa, Homo Sapiens
YQQNCQAGF

SEQ ID NO: 446743 - protein, 9 aa, Homo Sapiens
TARIIDKPQ

SEQ ID NO: 446744 - protein, 9 aa, Homo Sapiens
LCLWCFMNN

SEQ ID NO: 446745 - protein, 9 aa, Homo Sapiens
SQYFEDPRV

SEQ ID NO: 446746 - protein, 9 aa, Homo Sapiens
IVVIWIQPQ

SEQ ID NO: 446747 - protein, 9 aa, Homo Sapiens
VCKLNDLIQ

SEQ ID NO: 446748 - protein, 9 aa, Homo Sapiens
LQDWGTPRE

SEQ ID NO: 446749 - protein, 9 aa, Homo Sapiens
LIQASSRDP

SEQ ID NO: 446750 - protein, 9 aa, Homo Sapiens
NLLTSKLFS

SEQ ID NO: 446751 - protein, 9 aa, Homo Sapiens
WRSHSDSGL

SEQ ID NO: 446752 - protein, 9 aa, Homo Sapiens
VNVICDHPD

SEQ ID NO: 446753 - protein, 9 aa, Homo Sapiens
IIHLPFCGP

SEQ ID NO: 446754 - protein, 9 aa, Homo Sapiens
SIQIGDTFH

SEQ ID NO: 446755 - protein, 9 aa, Homo Sapiens
LRKRWFQLY

SEQ ID NO: 446756 - protein, 9 aa, Homo Sapiens
THASQLHNH

SEQ ID NO: 446757 - protein, 9 aa, Homo Sapiens
SIFKSDIPF

SEQ ID NO: 446758 - protein, 9 aa, Homo Sapiens
FFYKFRLSK

SEQ ID NO: 446759 - protein, 9 aa, Homo Sapiens
KARTTINLS

SEQ ID NO: 446760 - protein, 9 aa, Homo Sapiens
WKLDSKAVH

SEQ ID NO: 446761 - protein, 9 aa, Homo Sapiens
YMKKIFDSP

SEQ ID NO: 446762 - protein, 9 aa, Homo Sapiens
ESITDTFSS

SEQ ID NO: 446763 - protein, 9 aa, Homo Sapiens
CSCQMVVEK

SEQ ID NO: 446764 - protein, 9 aa, Homo Sapiens
LENQLGNTR

SEQ ID NO: 446765 - protein, 9 aa, Homo Sapiens
TSYRCAGTS

SEQ ID NO: 446766 - protein, 9 aa, Homo Sapiens
ETCACCCPR

SEQ ID NO: 446767 - protein, 9 aa, Homo Sapiens
TAAQENPSP

SEQ ID NO: 446768 - protein, 9 aa, Homo Sapiens
LCAACLIKC

SEQ ID NO: 446769 - protein, 9 aa, Homo Sapiens
DVAVNFTQD

SEQ ID NO: 446770 - protein, 9 aa, Homo Sapiens
LYFMDAMNK

SEQ ID NO: 446771 - protein, 9 aa, Homo Sapiens
VSKAAFTAS

SEQ ID NO: 446772 - protein, 9 aa, Homo Sapiens
GYGSGWSSS

SEQ ID NO: 446773 - protein, 9 aa, Homo Sapiens
GWTPQSPDS

SEQ ID NO: 446774 - protein, 9 aa, Homo Sapiens
IPLCHLQVD

SEQ ID NO: 446775 - protein, 9 aa, Homo Sapiens
LIISNCQYQ

SEQ ID NO: 446776 - protein, 9 aa, Homo Sapiens
HMAAILDDQ

SEQ ID NO: 446777 - protein, 9 aa, Homo Sapiens
LSPLIDRYC

SEQ ID NO: 446778 - protein, 9 aa, Homo Sapiens
ALNNELFAY

SEQ ID NO: 446779 - protein, 9 aa, Homo Sapiens
SSILNIHSS

SEQ ID NO: 446780 - protein, 9 aa, Homo Sapiens
TVLAFAISW

SEQ ID NO: 446781 - protein, 9 aa, Homo Sapiens
QLRLHEAEN

SEQ ID NO: 446782 - protein, 9 aa, Homo Sapiens
LEQFGLNEA

SEQ ID NO: 446783 - protein, 9 aa, Homo Sapiens
RIIDKPQVI

SEQ ID NO: 446784 - protein, 9 aa, Homo Sapiens
SDTQTKNES

SEQ ID NO: 446785 - protein, 9 aa, Homo Sapiens
NSGVNGQVT

SEQ ID NO: 446786 - protein, 9 aa, Homo Sapiens
EMYRRLREF

SEQ ID NO: 446787 - protein, 9 aa, Homo Sapiens
NIAAHCKEY

SEQ ID NO: 446788 - protein, 9 aa, Homo Sapiens
QRAQPNHYP

SEQ ID NO: 446789 - protein, 9 aa, Homo Sapiens
PLKDQVNLV

SEQ ID NO: 446790 - protein, 9 aa, Homo Sapiens
QIKLYRNVM

SEQ ID NO: 446791 - protein, 9 aa, Homo Sapiens
DSQEIYKFM

SEQ ID NO: 446792 - protein, 9 aa, Homo Sapiens
NAVFQYILR

SEQ ID NO: 446793 - protein, 9 aa, Homo Sapiens
QHFTSLWPT

SEQ ID NO: 446794 - protein, 9 aa, Homo Sapiens
GIISLKKPL

SEQ ID NO: 446795 - protein, 9 aa, Homo Sapiens
RRLLSPEFI

SEQ ID NO: 446796 - protein, 9 aa, Homo Sapiens
SDKRGSFLT

SEQ ID NO: 446797 - protein, 9 aa, Homo Sapiens
ETKLQVLKQ

SEQ ID NO: 446798 - protein, 9 aa, Homo Sapiens
EFVKHFCSH

SEQ ID NO: 446799 - protein, 9 aa, Homo Sapiens
QQGSHPEGR

SEQ ID NO: 446800 - protein, 9 aa, Homo Sapiens
QQNTSCLVQ

SEQ ID NO: 446801 - protein, 9 aa, Homo Sapiens
GKPKNTEPT

SEQ ID NO: 446802 - protein, 9 aa, Homo Sapiens
GNRLDDVCN

SEQ ID NO: 446803 - protein, 9 aa, Homo Sapiens
FQTLPPSSN

SEQ ID NO: 446804 - protein, 9 aa, Homo Sapiens
HSIVVILLY

SEQ ID NO: 446805 - protein, 9 aa, Homo Sapiens
EAWLEKSAH

SEQ ID NO: 446806 - protein, 9 aa, Homo Sapiens
IAIHNAELS

SEQ ID NO: 446807 - protein, 9 aa, Homo Sapiens
EAILSVFRM

SEQ ID NO: 446808 - protein, 9 aa, Homo Sapiens
IEKSQLIHN

SEQ ID NO: 446809 - protein, 9 aa, Homo Sapiens
TAVSSDQVH

SEQ ID NO: 446810 - protein, 9 aa, Homo Sapiens
NCQIDRVNL

SEQ ID NO: 446811 - protein, 9 aa, Homo Sapiens
DFASGVVEL

SEQ ID NO: 446812 - protein, 9 aa, Homo Sapiens
YKCVPQENE

SEQ ID NO: 446813 - protein, 9 aa, Homo Sapiens
TGNQIPWTN

SEQ ID NO: 446814 - protein, 9 aa, Homo Sapiens
IMEKCNTIS

SEQ ID NO: 446815 - protein, 9 aa, Homo Sapiens
VAESVKYQN

SEQ ID NO: 446816 - protein, 9 aa, Homo Sapiens
EGCTRSKVT

SEQ ID NO: 446817 - protein, 9 aa, Homo Sapiens
DHDKEVITL

SEQ ID NO: 446818 - protein, 9 aa, Homo Sapiens
RFEEVTRRP

SEQ ID NO: 446819 - protein, 9 aa, Homo Sapiens
LHQGGKINL

SEQ ID NO: 446820 - protein, 9 aa, Homo Sapiens
SNQPNLTPQ

SEQ ID NO: 446821 - protein, 9 aa, Homo Sapiens
SQLEASHQR

SEQ ID NO: 446822 - protein, 9 aa, Homo Sapiens
CHIDSVHIT

SEQ ID NO: 446823 - protein, 9 aa, Homo Sapiens
RYGGWNGIY

SEQ ID NO: 446824 - protein, 9 aa, Homo Sapiens
SPRPGSVAT

SEQ ID NO: 446825 - protein, 9 aa, Homo Sapiens
NAPQKGQLY

SEQ ID NO: 446826 - protein, 9 aa, Homo Sapiens
VNKQNWQEF

SEQ ID NO: 446827 - protein, 9 aa, Homo Sapiens
RRVLYAPPK

SEQ ID NO: 446828 - protein, 9 aa, Homo Sapiens
ESIYYNEQS

SEQ ID NO: 446829 - protein, 9 aa, Homo Sapiens
NEDRKKGKK

SEQ ID NO: 446830 - protein, 9 aa, Homo Sapiens
KLRPTEKVV

SEQ ID NO: 446831 - protein, 9 aa, Homo Sapiens
KTSSSEYSI

SEQ ID NO: 446832 - protein, 9 aa, Homo Sapiens
DLALAIYLI

SEQ ID NO: 446833 - protein, 9 aa, Homo Sapiens
VQETGYIVI

SEQ ID NO: 446834 - protein, 9 aa, Homo Sapiens
VNKDLLSDG

SEQ ID NO: 446835 - protein, 9 aa, Homo Sapiens
TIQVRTPKP

SEQ ID NO: 446836 - protein, 9 aa, Homo Sapiens
MAKINICMY

SEQ ID NO: 446837 - protein, 9 aa, Homo Sapiens
VHQIPPSYV

SEQ ID NO: 446838 - protein, 9 aa, Homo Sapiens
QELANAREI

SEQ ID NO: 446839 - protein, 9 aa, Homo Sapiens
IPFCDKVMQ

SEQ ID NO: 446840 - protein, 9 aa, Homo Sapiens
FSGMGFQQD

SEQ ID NO: 446841 - protein, 9 aa, Homo Sapiens
FDSSGDELY

SEQ ID NO: 446842 - protein, 9 aa, Homo Sapiens
FAAKLMKSI

SEQ ID NO: 446843 - protein, 9 aa, Homo Sapiens
QVNKAMLRP

SEQ ID NO: 446844 - protein, 9 aa, Homo Sapiens
TLVKIKIMS

SEQ ID NO: 446845 - protein, 9 aa, Homo Sapiens
NRALNQERV

SEQ ID NO: 446846 - protein, 9 aa, Homo Sapiens
NPKGHETTT

SEQ ID NO: 446847 - protein, 9 aa, Homo Sapiens
AEFYNTFSS

SEQ ID NO: 446848 - protein, 9 aa, Homo Sapiens
DNVACMTFD

SEQ ID NO: 446849 - protein, 9 aa, Homo Sapiens
QMILFDDER

SEQ ID NO: 446850 - protein, 9 aa, Homo Sapiens
SETNHSSLW

SEQ ID NO: 446851 - protein, 9 aa, Homo Sapiens
RWEHSRERD

SEQ ID NO: 446852 - protein, 9 aa, Homo Sapiens
FIGTEIVAV

SEQ ID NO: 446853 - protein, 9 aa, Homo Sapiens
TVGMLSNII

SEQ ID NO: 446854 - protein, 9 aa, Homo Sapiens
EGNFANMPP

SEQ ID NO: 446855 - protein, 9 aa, Homo Sapiens
QISPPFSLA

SEQ ID NO: 446856 - protein, 9 aa, Homo Sapiens
TSCLVQEHK

SEQ ID NO: 446857 - protein, 9 aa, Homo Sapiens
WYQVYRRHF

SEQ ID NO: 446858 - protein, 9 aa, Homo Sapiens
FVLTVGKNY

SEQ ID NO: 446859 - protein, 9 aa, Homo Sapiens
RRILLDMLQ

SEQ ID NO: 446860 - protein, 9 aa, Homo Sapiens
TISHLPIQM

SEQ ID NO: 446861 - protein, 9 aa, Homo Sapiens
FSMFEQTRI

SEQ ID NO: 446862 - protein, 9 aa, Homo Sapiens
ENCFKFSRL

SEQ ID NO: 446863 - protein, 9 aa, Homo Sapiens
VMSCAVACD

SEQ ID NO: 446864 - protein, 9 aa, Homo Sapiens
DWKTFLFSA

SEQ ID NO: 446865 - protein, 9 aa, Homo Sapiens
FWYVTCAIH

SEQ ID NO: 446866 - protein, 9 aa, Homo Sapiens
VQGVIHRDI

SEQ ID NO: 446867 - protein, 9 aa, Homo Sapiens
QLNLMQKEA

SEQ ID NO: 446868 - protein, 9 aa, Homo Sapiens
GASKPSEEV

SEQ ID NO: 446869 - protein, 9 aa, Homo Sapiens
LLWAKTDSS

SEQ ID NO: 446870 - protein, 9 aa, Homo Sapiens
ILIKLCYFQ

SEQ ID NO: 446871 - protein, 9 aa, Homo Sapiens
EKTTCAINK

SEQ ID NO: 446872 - protein, 9 aa, Homo Sapiens
NMPLIERDR

SEQ ID NO: 446873 - protein, 9 aa, Homo Sapiens
SKAGNTFIA

SEQ ID NO: 446874 - protein, 9 aa, Homo Sapiens
GGGSGKSYH

SEQ ID NO: 446875 - protein, 9 aa, Homo Sapiens
FLGGVSWDI

SEQ ID NO: 446876 - protein, 9 aa, Homo Sapiens
QSWKISHKK

SEQ ID NO: 446877 - protein, 9 aa, Homo Sapiens
SLACYNPFI

SEQ ID NO: 446878 - protein, 9 aa, Homo Sapiens
QLDSEGIFL

SEQ ID NO: 446879 - protein, 9 aa, Homo Sapiens
VGMLSNIIA

SEQ ID NO: 446880 - protein, 9 aa, Homo Sapiens
EKVANVSVD

SEQ ID NO: 446881 - protein, 9 aa, Homo Sapiens
KSNIRINED

SEQ ID NO: 446882 - protein, 9 aa, Homo Sapiens
CGIHRDTKK

SEQ ID NO: 446883 - protein, 9 aa, Homo Sapiens
SVSTISAFC

SEQ ID NO: 446884 - protein, 9 aa, Homo Sapiens
HINFLELGD

SEQ ID NO: 446885 - protein, 9 aa, Homo Sapiens
RGASPNISN

SEQ ID NO: 446886 - protein, 9 aa, Homo Sapiens
LFSTDTISW

SEQ ID NO: 446887 - protein, 9 aa, Homo Sapiens
FTTILIIFA

SEQ ID NO: 446888 - protein, 9 aa, Homo Sapiens
EDTPIDTFL

SEQ ID NO: 446889 - protein, 9 aa, Homo Sapiens
QCQFSGKLL

SEQ ID NO: 446890 - protein, 9 aa, Homo Sapiens
FCCIFLFLL

SEQ ID NO: 446891 - protein, 9 aa, Homo Sapiens
APKDREVPT

SEQ ID NO: 446892 - protein, 9 aa, Homo Sapiens
ETTTGKKDL

SEQ ID NO: 446893 - protein, 9 aa, Homo Sapiens
SGDQTPSDN

SEQ ID NO: 446894 - protein, 9 aa, Homo Sapiens
HILQKQEQQ

SEQ ID NO: 446895 - protein, 9 aa, Homo Sapiens
VLGYLNLAA

SEQ ID NO: 446896 - protein, 9 aa, Homo Sapiens
HFCEKCLNE

SEQ ID NO: 446897 - protein, 9 aa, Homo Sapiens
EIKTINDIF

SEQ ID NO: 446898 - protein, 9 aa, Homo Sapiens
YKYADLYLL

SEQ ID NO: 446899 - protein, 9 aa, Homo Sapiens
TASFAVQKE

SEQ ID NO: 446900 - protein, 9 aa, Homo Sapiens
NDQSILSIC

SEQ ID NO: 446901 - protein, 9 aa, Homo Sapiens
LHECMICGK

SEQ ID NO: 446902 - protein, 9 aa, Homo Sapiens
LIFRTSSND

SEQ ID NO: 446903 - protein, 9 aa, Homo Sapiens
KPNKCARRF

SEQ ID NO: 446904 - protein, 9 aa, Homo Sapiens
NGGSPQIPF

SEQ ID NO: 446905 - protein, 9 aa, Homo Sapiens
SECNIQLFS

SEQ ID NO: 446906 - protein, 9 aa, Homo Sapiens
SQIPPQIPQ

SEQ ID NO: 446907 - protein, 9 aa, Homo Sapiens
APGHRNFIK

SEQ ID NO: 446908 - protein, 9 aa, Homo Sapiens
RKPTNNSEE

SEQ ID NO: 446909 - protein, 9 aa, Homo Sapiens
GKEMHIINE

SEQ ID NO: 446910 - protein, 9 aa, Homo Sapiens
SQGLCFNIL

SEQ ID NO: 446911 - protein, 9 aa, Homo Sapiens
PEHPGMPCP

SEQ ID NO: 446912 - protein, 9 aa, Homo Sapiens
QNDNKPKFT

SEQ ID NO: 446913 - protein, 9 aa, Homo Sapiens
QKKADMVNK

SEQ ID NO: 446914 - protein, 9 aa, Homo Sapiens
KLTDVFKPV

SEQ ID NO: 446915 - protein, 9 aa, Homo Sapiens
AEVLKVQNR

SEQ ID NO: 446916 - protein, 9 aa, Homo Sapiens
EECIGFLPY

SEQ ID NO: 446917 - protein, 9 aa, Homo Sapiens
LARAHGHLW

SEQ ID NO: 446918 - protein, 9 aa, Homo Sapiens
KKKEDLHPD

SEQ ID NO: 446919 - protein, 9 aa, Homo Sapiens
LPIIIVPEQ

SEQ ID NO: 446920 - protein, 9 aa, Homo Sapiens
YVIIMADKV

SEQ ID NO: 446921 - protein, 9 aa, Homo Sapiens
SWMGKPVSY

SEQ ID NO: 446922 - protein, 9 aa, Homo Sapiens
YSVLYAKNK

SEQ ID NO: 446923 - protein, 9 aa, Homo Sapiens
RAETACFCE

SEQ ID NO: 446924 - protein, 9 aa, Homo Sapiens
RYIAIHNAE

SEQ ID NO: 446925 - protein, 9 aa, Homo Sapiens
RQLYWGTPI

SEQ ID NO: 446926 - protein, 9 aa, Homo Sapiens
ILMSNYGCT

SEQ ID NO: 446927 - protein, 9 aa, Homo Sapiens
EEVLDQGDL

SEQ ID NO: 446928 - protein, 9 aa, Homo Sapiens
WEQFSGMGF

SEQ ID NO: 446929 - protein, 9 aa, Homo Sapiens
FIMEYLFCE

SEQ ID NO: 446930 - protein, 9 aa, Homo Sapiens
QSYAQVMCR

SEQ ID NO: 446931 - protein, 9 aa, Homo Sapiens
RTFRRRLNL

SEQ ID NO: 446932 - protein, 9 aa, Homo Sapiens
TPTGSFERT

SEQ ID NO: 446933 - protein, 9 aa, Homo Sapiens
NKLRTNWIK

SEQ ID NO: 446934 - protein, 9 aa, Homo Sapiens
DTLTLEMLK

SEQ ID NO: 446935 - protein, 9 aa, Homo Sapiens
LDEANNINK

SEQ ID NO: 446936 - protein, 9 aa, Homo Sapiens
KENRQQNVR

SEQ ID NO: 446937 - protein, 9 aa, Homo Sapiens
GLFPILLCD

SEQ ID NO: 446938 - protein, 9 aa, Homo Sapiens
TVQSELEEN

SEQ ID NO: 446939 - protein, 9 aa, Homo Sapiens
PHPTAEGTS

SEQ ID NO: 446940 - protein, 9 aa, Homo Sapiens
HLQTVLRNF

SEQ ID NO: 446941 - protein, 9 aa, Homo Sapiens
LLILLSMLT

SEQ ID NO: 446942 - protein, 9 aa, Homo Sapiens
HELYKFCSL

SEQ ID NO: 446943 - protein, 9 aa, Homo Sapiens
ECKVRAQSQ

SEQ ID NO: 446944 - protein, 9 aa, Homo Sapiens
SHEGVACVH

SEQ ID NO: 446945 - protein, 9 aa, Homo Sapiens
RKLEGCTRS

SEQ ID NO: 446946 - protein, 9 aa, Homo Sapiens
EVDCVLKPL

SEQ ID NO: 446947 - protein, 9 aa, Homo Sapiens
VNCYTKLCE

SEQ ID NO: 446948 - protein, 9 aa, Homo Sapiens
LDNLKVWDV

SEQ ID NO: 446949 - protein, 9 aa, Homo Sapiens
NLIFGYLVS

SEQ ID NO: 446950 - protein, 9 aa, Homo Sapiens
RLLKRTHDM

SEQ ID NO: 446951 - protein, 9 aa, Homo Sapiens
LLKTLKDDL

SEQ ID NO: 446952 - protein, 9 aa, Homo Sapiens
MRDQRLNLQ

SEQ ID NO: 446953 - protein, 9 aa, Homo Sapiens
MRHHFQTQQ

SEQ ID NO: 446954 - protein, 9 aa, Homo Sapiens
GDKPSDSSD

SEQ ID NO: 446955 - protein, 9 aa, Homo Sapiens
SMDWLEFLF

SEQ ID NO: 446956 - protein, 9 aa, Homo Sapiens
RKSAIQYIR

SEQ ID NO: 446957 - protein, 9 aa, Homo Sapiens
NICFHENEI

SEQ ID NO: 446958 - protein, 9 aa, Homo Sapiens
EGRETSSDI

SEQ ID NO: 446959 - protein, 9 aa, Homo Sapiens
LFFFKLIED

SEQ ID NO: 446960 - protein, 9 aa, Homo Sapiens
DLNMQRSRD

SEQ ID NO: 446961 - protein, 9 aa, Homo Sapiens
TLPINSPTK

SEQ ID NO: 446962 - protein, 9 aa, Homo Sapiens
PEVVHKDYG

SEQ ID NO: 446963 - protein, 9 aa, Homo Sapiens
CGKINGRAD

SEQ ID NO: 446964 - protein, 9 aa, Homo Sapiens
ESLLNNLQL

SEQ ID NO: 446965 - protein, 9 aa, Homo Sapiens
LPVIMERLD

SEQ ID NO: 446966 - protein, 9 aa, Homo Sapiens
ELQQPGITG

SEQ ID NO: 446967 - protein, 9 aa, Homo Sapiens
RLLLLTNGG

SEQ ID NO: 446968 - protein, 9 aa, Homo Sapiens
KLLWISYSD

SEQ ID NO: 446969 - protein, 9 aa, Homo Sapiens
EVDGPAMNN

SEQ ID NO: 446970 - protein, 9 aa, Homo Sapiens
LYIINKTRT

SEQ ID NO: 446971 - protein, 9 aa, Homo Sapiens
EYLDAIKTF

SEQ ID NO: 446972 - protein, 9 aa, Homo Sapiens
NDGSVSCSL

SEQ ID NO: 446973 - protein, 9 aa, Homo Sapiens
RKENPHVRC

SEQ ID NO: 446974 - protein, 9 aa, Homo Sapiens
GPVFVGGFP

SEQ ID NO: 446975 - protein, 9 aa, Homo Sapiens
AVYKYADLY

SEQ ID NO: 446976 - protein, 9 aa, Homo Sapiens
PEGDRVQAE

SEQ ID NO: 446977 - protein, 9 aa, Homo Sapiens
NGASESGIS

SEQ ID NO: 446978 - protein, 9 aa, Homo Sapiens
LIEHFFAVA

SEQ ID NO: 446979 - protein, 9 aa, Homo Sapiens
GPNFNFSIW

SEQ ID NO: 446980 - protein, 9 aa, Homo Sapiens
RPPRDTPEY

SEQ ID NO: 446981 - protein, 9 aa, Homo Sapiens
VSPYFKSND

SEQ ID NO: 446982 - protein, 9 aa, Homo Sapiens
QQQIEKEKE

SEQ ID NO: 446983 - protein, 9 aa, Homo Sapiens
APEEQKHGL

SEQ ID NO: 446984 - protein, 9 aa, Homo Sapiens
AISDLAVCR

SEQ ID NO: 446985 - protein, 9 aa, Homo Sapiens
WVTDLNKLR

SEQ ID NO: 446986 - protein, 9 aa, Homo Sapiens
KNDSGVPCN

SEQ ID NO: 446987 - protein, 9 aa, Homo Sapiens
CKDYVDKEK

SEQ ID NO: 446988 - protein, 9 aa, Homo Sapiens
ITHKTIEIE

SEQ ID NO: 446989 - protein, 9 aa, Homo Sapiens
YNGLCGYLL

SEQ ID NO: 446990 - protein, 9 aa, Homo Sapiens
GVEHVEDRF

SEQ ID NO: 446991 - protein, 9 aa, Homo Sapiens
VVNYTKPGN

SEQ ID NO: 446992 - protein, 9 aa, Homo Sapiens
THKVLRITV

SEQ ID NO: 446993 - protein, 9 aa, Homo Sapiens
GSPQIPFST

SEQ ID NO: 446994 - protein, 9 aa, Homo Sapiens
AKSKSKTIL

SEQ ID NO: 446995 - protein, 9 aa, Homo Sapiens
RSCIQAYFY

SEQ ID NO: 446996 - protein, 9 aa, Homo Sapiens
QHAWNITLR

SEQ ID NO: 446997 - protein, 9 aa, Homo Sapiens
PQILEEGPF

SEQ ID NO: 446998 - protein, 9 aa, Homo Sapiens
WREMCLRLQ

SEQ ID NO: 446999 - protein, 9 aa, Homo Sapiens
LTWERVRFQ

SEQ ID NO: 447000 - protein, 9 aa, Homo Sapiens
ESHDCGGVS

SEQ ID NO: 447001 - protein, 9 aa, Homo Sapiens
KPIEKSQLI

SEQ ID NO: 447002 - protein, 9 aa, Homo Sapiens
AVFSIVGAL

SEQ ID NO: 447003 - protein, 9 aa, Homo Sapiens
EPSEVEAFE

SEQ ID NO: 447004 - protein, 9 aa, Homo Sapiens
CINICTGQE

SEQ ID NO: 447005 - protein, 9 aa, Homo Sapiens
GVIQLHFFK

SEQ ID NO: 447006 - protein, 9 aa, Homo Sapiens
FMMQGFICK

SEQ ID NO: 447007 - protein, 9 aa, Homo Sapiens
KIIQLYDYE

SEQ ID NO: 447008 - protein, 9 aa, Homo Sapiens
CEGSAIAIA

SEQ ID NO: 447009 - protein, 9 aa, Homo Sapiens
HLWICPQGY

SEQ ID NO: 447010 - protein, 9 aa, Homo Sapiens
KKKLLGQLY

SEQ ID NO: 447011 - protein, 9 aa, Homo Sapiens
MDGAPDSAI

SEQ ID NO: 447012 - protein, 9 aa, Homo Sapiens
KLLAERGDV

SEQ ID NO: 447013 - protein, 9 aa, Homo Sapiens
AFTRPCVDR

SEQ ID NO: 447014 - protein, 9 aa, Homo Sapiens
KLKMPYQSV

SEQ ID NO: 447015 - protein, 9 aa, Homo Sapiens
LHPHRIDII

SEQ ID NO: 447016 - protein, 9 aa, Homo Sapiens
LDTDTGVCS

SEQ ID NO: 447017 - protein, 9 aa, Homo Sapiens
IFGFLGGVS

SEQ ID NO: 447018 - protein, 9 aa, Homo Sapiens
SVTNGGQEW

SEQ ID NO: 447019 - protein, 9 aa, Homo Sapiens
RFLQDTFTT

SEQ ID NO: 447020 - protein, 9 aa, Homo Sapiens
KKFANPSHY

SEQ ID NO: 447021 - protein, 9 aa, Homo Sapiens
MCLVLHCIA

SEQ ID NO: 447022 - protein, 9 aa, Homo Sapiens
SHSHQQMKD

SEQ ID NO: 447023 - protein, 9 aa, Homo Sapiens
VLVDNKFYE

SEQ ID NO: 447024 - protein, 9 aa, Homo Sapiens
NAPLEVTED

SEQ ID NO: 447025 - protein, 9 aa, Homo Sapiens
GPSTTAAAA

SEQ ID NO: 447026 - protein, 9 aa, Homo Sapiens
LTSKIPDMS

SEQ ID NO: 447027 - protein, 9 aa, Homo Sapiens
DRVQAEMPN

SEQ ID NO: 447028 - protein, 9 aa, Homo Sapiens
IKDAVMSCA

SEQ ID NO: 447029 - protein, 9 aa, Homo Sapiens
CGKQGSCPS

SEQ ID NO: 447030 - protein, 9 aa, Homo Sapiens
KMLGHQEPH

SEQ ID NO: 447031 - protein, 9 aa, Homo Sapiens
KGKWLAAFH

SEQ ID NO: 447032 - protein, 9 aa, Homo Sapiens
DRFDSYSIE

SEQ ID NO: 447033 - protein, 9 aa, Homo Sapiens
IFLVIGTPN

SEQ ID NO: 447034 - protein, 9 aa, Homo Sapiens
GLSDHHEPI

SEQ ID NO: 447035 - protein, 9 aa, Homo Sapiens
PTVTLPKNM

SEQ ID NO: 447036 - protein, 9 aa, Homo Sapiens
KLYLNEPNR

SEQ ID NO: 447037 - protein, 9 aa, Homo Sapiens
IQYHSRGEY

SEQ ID NO: 447038 - protein, 9 aa, Homo Sapiens
TEKLNNQAE

SEQ ID NO: 447039 - protein, 9 aa, Homo Sapiens
IHLNTEPME

SEQ ID NO: 447040 - protein, 9 aa, Homo Sapiens
QRNMRKVCG

SEQ ID NO: 447041 - protein, 9 aa, Homo Sapiens
AGLYMFWTM

SEQ ID NO: 447042 - protein, 9 aa, Homo Sapiens
GKQLLHSPL

SEQ ID NO: 447043 - protein, 9 aa, Homo Sapiens
GTGGKTQIA

SEQ ID NO: 447044 - protein, 9 aa, Homo Sapiens
DLNITNKQK

SEQ ID NO: 447045 - protein, 9 aa, Homo Sapiens
KKELFTCPT

SEQ ID NO: 447046 - protein, 9 aa, Homo Sapiens
NAFYLLGKQ

SEQ ID NO: 447047 - protein, 9 aa, Homo Sapiens
VPEELEGPG

SEQ ID NO: 447048 - protein, 9 aa, Homo Sapiens
AYEPDRNAL

SEQ ID NO: 447049 - protein, 9 aa, Homo Sapiens
KLVYVGSDS

SEQ ID NO: 447050 - protein, 9 aa, Homo Sapiens
SKLANTAKA

SEQ ID NO: 447051 - protein, 9 aa, Homo Sapiens
IAQSHKIPR

SEQ ID NO: 447052 - protein, 9 aa, Homo Sapiens
KVFATTGYD

SEQ ID NO: 447053 - protein, 9 aa, Homo Sapiens
EELQSTLGD

SEQ ID NO: 447054 - protein, 9 aa, Homo Sapiens
FKNGNSCAA

SEQ ID NO: 447055 - protein, 9 aa, Homo Sapiens
WKLLDWHAN

SEQ ID NO: 447056 - protein, 9 aa, Homo Sapiens
QNNILLVHY

SEQ ID NO: 447057 - protein, 9 aa, Homo Sapiens
HIIPTRKPN

SEQ ID NO: 447058 - protein, 9 aa, Homo Sapiens
KILGFKGVW

SEQ ID NO: 447059 - protein, 9 aa, Homo Sapiens
NEIKYKSSA

SEQ ID NO: 447060 - protein, 9 aa, Homo Sapiens
IHKVAFLRL

SEQ ID NO: 447061 - protein, 9 aa, Homo Sapiens
PLFKVLVAL

SEQ ID NO: 447062 - protein, 9 aa, Homo Sapiens
IILNYRDGN

SEQ ID NO: 447063 - protein, 9 aa, Homo Sapiens
GKTKTVQQN

SEQ ID NO: 447064 - protein, 9 aa, Homo Sapiens
NNDLRLRQE

SEQ ID NO: 447065 - protein, 9 aa, Homo Sapiens
SKELKEGKA

SEQ ID NO: 447066 - protein, 9 aa, Homo Sapiens
IQLFMLQTY

SEQ ID NO: 447067 - protein, 9 aa, Homo Sapiens
FYHTRIELL

SEQ ID NO: 447068 - protein, 9 aa, Homo Sapiens
VLDILSRLM

SEQ ID NO: 447069 - protein, 9 aa, Homo Sapiens
LHYYETVCM

SEQ ID NO: 447070 - protein, 9 aa, Homo Sapiens
AVEGSNKTD

SEQ ID NO: 447071 - protein, 9 aa, Homo Sapiens
SKYQKTAEE

SEQ ID NO: 447072 - protein, 9 aa, Homo Sapiens
VGAVALFYI

SEQ ID NO: 447073 - protein, 9 aa, Homo Sapiens
VMGEKDHMV

SEQ ID NO: 447074 - protein, 9 aa, Homo Sapiens
CNRISVEVL

SEQ ID NO: 447075 - protein, 9 aa, Homo Sapiens
PRTSNCHQF

SEQ ID NO: 447076 - protein, 9 aa, Homo Sapiens
KFLTSVSTV

SEQ ID NO: 447077 - protein, 9 aa, Homo Sapiens
GCTEPNHPG

SEQ ID NO: 447078 - protein, 9 aa, Homo Sapiens
CWVLLFAIG

SEQ ID NO: 447079 - protein, 9 aa, Homo Sapiens
LLLWLEHNL

SEQ ID NO: 447080 - protein, 9 aa, Homo Sapiens
FKLHSHGHL

SEQ ID NO: 447081 - protein, 9 aa, Homo Sapiens
KKEKRAQAH

SEQ ID NO: 447082 - protein, 9 aa, Homo Sapiens
KSCGNQNET

SEQ ID NO: 447083 - protein, 9 aa, Homo Sapiens
DCQKPNYME

SEQ ID NO: 447084 - protein, 9 aa, Homo Sapiens
CRNGVVLHD

SEQ ID NO: 447085 - protein, 9 aa, Homo Sapiens
NPFLYPYKK

SEQ ID NO: 447086 - protein, 9 aa, Homo Sapiens
TFHMNPRFD

SEQ ID NO: 447087 - protein, 9 aa, Homo Sapiens
LVPGRQDPR

SEQ ID NO: 447088 - protein, 9 aa, Homo Sapiens
QPHAELSPI

SEQ ID NO: 447089 - protein, 9 aa, Homo Sapiens
PNINRINEI

SEQ ID NO: 447090 - protein, 9 aa, Homo Sapiens
LPISVKMHI

SEQ ID NO: 447091 - protein, 9 aa, Homo Sapiens
LKLNKTPFH

SEQ ID NO: 447092 - protein, 9 aa, Homo Sapiens
QENKKYIML

SEQ ID NO: 447093 - protein, 9 aa, Homo Sapiens
FNKLYLNEP

SEQ ID NO: 447094 - protein, 9 aa, Homo Sapiens
PSPTTLKKL

SEQ ID NO: 447095 - protein, 9 aa, Homo Sapiens
RFLRSVTGR

SEQ ID NO: 447096 - protein, 9 aa, Homo Sapiens
DKILLFHHD

SEQ ID NO: 447097 - protein, 9 aa, Homo Sapiens
ECSRIIADR

SEQ ID NO: 447098 - protein, 9 aa, Homo Sapiens
VPAFQVVFT

SEQ ID NO: 447099 - protein, 9 aa, Homo Sapiens
VQIHTGEKP

SEQ ID NO: 447100 - protein, 9 aa, Homo Sapiens
LQRTGWFCG

SEQ ID NO: 447101 - protein, 9 aa, Homo Sapiens
EVLLENPKM

SEQ ID NO: 447102 - protein, 9 aa, Homo Sapiens
GKIINMNIK

SEQ ID NO: 447103 - protein, 9 aa, Homo Sapiens
LMGGAYLCN

SEQ ID NO: 447104 - protein, 9 aa, Homo Sapiens
PSFLSRYRG

SEQ ID NO: 447105 - protein, 9 aa, Homo Sapiens
RDFQLRDTY

SEQ ID NO: 447106 - protein, 9 aa, Homo Sapiens
NWNVNYNYT

SEQ ID NO: 447107 - protein, 9 aa, Homo Sapiens
PLPGKSAAK

SEQ ID NO: 447108 - protein, 9 aa, Homo Sapiens
AHLNSWNLG

SEQ ID NO: 447109 - protein, 9 aa, Homo Sapiens
VYGGNVVML

SEQ ID NO: 447110 - protein, 9 aa, Homo Sapiens
AMAAVSTQL

SEQ ID NO: 447111 - protein, 9 aa, Homo Sapiens
ADKLLSGTR

SEQ ID NO: 447112 - protein, 9 aa, Homo Sapiens
VQIDLPIKI

SEQ ID NO: 447113 - protein, 9 aa, Homo Sapiens
HHFAPLLCK

SEQ ID NO: 447114 - protein, 9 aa, Homo Sapiens
LWKLVHEIG

SEQ ID NO: 447115 - protein, 9 aa, Homo Sapiens
EEVTRRPLP

SEQ ID NO: 447116 - protein, 9 aa, Homo Sapiens
GIQYLDGLL

SEQ ID NO: 447117 - protein, 9 aa, Homo Sapiens
GLYGLQVKY

SEQ ID NO: 447118 - protein, 9 aa, Homo Sapiens
VTKSANKLR

SEQ ID NO: 447119 - protein, 9 aa, Homo Sapiens
YVEIIGEQR

SEQ ID NO: 447120 - protein, 9 aa, Homo Sapiens
YNNHDRRSS

SEQ ID NO: 447121 - protein, 9 aa, Homo Sapiens
RWVTDLNKL

SEQ ID NO: 447122 - protein, 9 aa, Homo Sapiens
TSVEHCKAH

SEQ ID NO: 447123 - protein, 9 aa, Homo Sapiens
IHYYSIKLY

SEQ ID NO: 447124 - protein, 9 aa, Homo Sapiens
MWDHDLNPE

SEQ ID NO: 447125 - protein, 9 aa, Homo Sapiens
ARYGSQHHK

SEQ ID NO: 447126 - protein, 9 aa, Homo Sapiens
QLFPTLLLW

SEQ ID NO: 447127 - protein, 9 aa, Homo Sapiens
LISEFQMLL

SEQ ID NO: 447128 - protein, 9 aa, Homo Sapiens
GAHLVLEEN

SEQ ID NO: 447129 - protein, 9 aa, Homo Sapiens
SSDAFHLDR

SEQ ID NO: 447130 - protein, 9 aa, Homo Sapiens
ILPYDGKFI

SEQ ID NO: 447131 - protein, 9 aa, Homo Sapiens
KENQGKNES

SEQ ID NO: 447132 - protein, 9 aa, Homo Sapiens
LEDINYNGP

SEQ ID NO: 447133 - protein, 9 aa, Homo Sapiens
DNNGSLNTK

SEQ ID NO: 447134 - protein, 9 aa, Homo Sapiens
YNRKMSADF

SEQ ID NO: 447135 - protein, 9 aa, Homo Sapiens
AQNKPFDAN

SEQ ID NO: 447136 - protein, 9 aa, Homo Sapiens
QSKGLLPRA

SEQ ID NO: 447137 - protein, 9 aa, Homo Sapiens
SSYSPYGYG

SEQ ID NO: 447138 - protein, 9 aa, Homo Sapiens
VHKEKSVVK

SEQ ID NO: 447139 - protein, 9 aa, Homo Sapiens
QNKEQEPEP

SEQ ID NO: 447140 - protein, 9 aa, Homo Sapiens
LKRMGNIIN

SEQ ID NO: 447141 - protein, 9 aa, Homo Sapiens
ILNYRDGNS

SEQ ID NO: 447142 - protein, 9 aa, Homo Sapiens
DDRELFEDM

SEQ ID NO: 447143 - protein, 9 aa, Homo Sapiens
AAVCLERVV

SEQ ID NO: 447144 - protein, 9 aa, Homo Sapiens
AHKKIWMFD

SEQ ID NO: 447145 - protein, 9 aa, Homo Sapiens
YMAGVIRHM

SEQ ID NO: 447146 - protein, 9 aa, Homo Sapiens
TLRTYFSNF

SEQ ID NO: 447147 - protein, 9 aa, Homo Sapiens
HAHLSLPQK

SEQ ID NO: 447148 - protein, 9 aa, Homo Sapiens
MYSSVDTKQ

SEQ ID NO: 447149 - protein, 9 aa, Homo Sapiens
NLTKYPDAN

SEQ ID NO: 447150 - protein, 9 aa, Homo Sapiens
EGLDKPVEI

SEQ ID NO: 447151 - protein, 9 aa, Homo Sapiens
GPCPQWAYD

SEQ ID NO: 447152 - protein, 9 aa, Homo Sapiens
FAVALLNQA

SEQ ID NO: 447153 - protein, 9 aa, Homo Sapiens
IAQTSLQGL

SEQ ID NO: 447154 - protein, 9 aa, Homo Sapiens
TEEINTFHV

SEQ ID NO: 447155 - protein, 9 aa, Homo Sapiens
TALVERDYF

SEQ ID NO: 447156 - protein, 9 aa, Homo Sapiens
LCFLPFIII

SEQ ID NO: 447157 - protein, 9 aa, Homo Sapiens
KLDEVLGEI

SEQ ID NO: 447158 - protein, 9 aa, Homo Sapiens
TFKDVAIEL

SEQ ID NO: 447159 - protein, 9 aa, Homo Sapiens
RVIQVSPFI

SEQ ID NO: 447160 - protein, 9 aa, Homo Sapiens
YFSNFTSNT

SEQ ID NO: 447161 - protein, 9 aa, Homo Sapiens
TPQEGIAKE

SEQ ID NO: 447162 - protein, 9 aa, Homo Sapiens
HLLRPLGIE

SEQ ID NO: 447163 - protein, 9 aa, Homo Sapiens
SKFQAELSL

SEQ ID NO: 447164 - protein, 9 aa, Homo Sapiens
FFDLITIVA

SEQ ID NO: 447165 - protein, 9 aa, Homo Sapiens
HKEKSVVKT

SEQ ID NO: 447166 - protein, 9 aa, Homo Sapiens
TFDWPPKSE

SEQ ID NO: 447167 - protein, 9 aa, Homo Sapiens
LENTGRQKY

SEQ ID NO: 447168 - protein, 9 aa, Homo Sapiens
PMGEAPGDL

SEQ ID NO: 447169 - protein, 9 aa, Homo Sapiens
EERHRPDSV

SEQ ID NO: 447170 - protein, 9 aa, Homo Sapiens
MVRFTSLFD

SEQ ID NO: 447171 - protein, 9 aa, Homo Sapiens
NPFETDMLT

SEQ ID NO: 447172 - protein, 9 aa, Homo Sapiens
PANCPLKDR

SEQ ID NO: 447173 - protein, 9 aa, Homo Sapiens
KHILAKIRR

SEQ ID NO: 447174 - protein, 9 aa, Homo Sapiens
ICDFNTNKC

SEQ ID NO: 447175 - protein, 9 aa, Homo Sapiens
EEEVYLLNI

SEQ ID NO: 447176 - protein, 9 aa, Homo Sapiens
KGFIQIISK

SEQ ID NO: 447177 - protein, 9 aa, Homo Sapiens
DSEVECPRR

SEQ ID NO: 447178 - protein, 9 aa, Homo Sapiens
IRRKYMIVD

SEQ ID NO: 447179 - protein, 9 aa, Homo Sapiens
STEQAVSKP

SEQ ID NO: 447180 - protein, 9 aa, Homo Sapiens
RPCMSINFR

SEQ ID NO: 447181 - protein, 9 aa, Homo Sapiens
AWEPHHNYV

SEQ ID NO: 447182 - protein, 9 aa, Homo Sapiens
AFNRGSNII

SEQ ID NO: 447183 - protein, 9 aa, Homo Sapiens
TSPFNFFHH

SEQ ID NO: 447184 - protein, 9 aa, Homo Sapiens
GVRAFLHTY

SEQ ID NO: 447185 - protein, 9 aa, Homo Sapiens
PLVQRLTCK

SEQ ID NO: 447186 - protein, 9 aa, Homo Sapiens
FSLSTCPDK

SEQ ID NO: 447187 - protein, 9 aa, Homo Sapiens
CAVLYDAVN

SEQ ID NO: 447188 - protein, 9 aa, Homo Sapiens
TYEYVHLYA

SEQ ID NO: 447189 - protein, 9 aa, Homo Sapiens
FYKFRLSKM

SEQ ID NO: 447190 - protein, 9 aa, Homo Sapiens
SEYISVDTS

SEQ ID NO: 447191 - protein, 9 aa, Homo Sapiens
AQKDVASLS

SEQ ID NO: 447192 - protein, 9 aa, Homo Sapiens
IRRTSTNRV

SEQ ID NO: 447193 - protein, 9 aa, Homo Sapiens
LDMFVYCTP

SEQ ID NO: 447194 - protein, 9 aa, Homo Sapiens
TEKHIEALH

SEQ ID NO: 447195 - protein, 9 aa, Homo Sapiens
SVSAVTMDL

SEQ ID NO: 447196 - protein, 9 aa, Homo Sapiens
IIDWLSHKD

SEQ ID NO: 447197 - protein, 9 aa, Homo Sapiens
NPEDSGEGN

SEQ ID NO: 447198 - protein, 9 aa, Homo Sapiens
EMQRPPPYC

SEQ ID NO: 447199 - protein, 9 aa, Homo Sapiens
EKYVREWKL

SEQ ID NO: 447200 - protein, 9 aa, Homo Sapiens
MVVEKGGCI

SEQ ID NO: 447201 - protein, 9 aa, Homo Sapiens
HFCGRHKKY

SEQ ID NO: 447202 - protein, 9 aa, Homo Sapiens
FEVLMVRFT

SEQ ID NO: 447203 - protein, 9 aa, Homo Sapiens
QVLVDNKFY

SEQ ID NO: 447204 - protein, 9 aa, Homo Sapiens
ICKLFPFLQ

SEQ ID NO: 447205 - protein, 9 aa, Homo Sapiens
PKDKYNCIG

SEQ ID NO: 447206 - protein, 9 aa, Homo Sapiens
VQKRRQVLK

SEQ ID NO: 447207 - protein, 9 aa, Homo Sapiens
TVTMALNSK

SEQ ID NO: 447208 - protein, 9 aa, Homo Sapiens
GTYQCFVRK

SEQ ID NO: 447209 - protein, 9 aa, Homo Sapiens
GIKPSATAQ

SEQ ID NO: 447210 - protein, 9 aa, Homo Sapiens
TACGFCLRP

SEQ ID NO: 447211 - protein, 9 aa, Homo Sapiens
DVVEATSLG

SEQ ID NO: 447212 - protein, 9 aa, Homo Sapiens
QCSAPANLG

SEQ ID NO: 447213 - protein, 9 aa, Homo Sapiens
FEKPRQYNE

SEQ ID NO: 447214 - protein, 9 aa, Homo Sapiens
LHFGLPASK

SEQ ID NO: 447215 - protein, 9 aa, Homo Sapiens
KIIKEDYLG

SEQ ID NO: 447216 - protein, 9 aa, Homo Sapiens
AENCFKFSR

SEQ ID NO: 447217 - protein, 9 aa, Homo Sapiens
SGISTEAFL

SEQ ID NO: 447218 - protein, 9 aa, Homo Sapiens
DKCNAAVER

SEQ ID NO: 447219 - protein, 9 aa, Homo Sapiens
LTQPSDQGV

SEQ ID NO: 447220 - protein, 9 aa, Homo Sapiens
ELGFKHNKI

SEQ ID NO: 447221 - protein, 9 aa, Homo Sapiens
ALLKVYSCD

SEQ ID NO: 447222 - protein, 9 aa, Homo Sapiens
KLCYFQEPE

SEQ ID NO: 447223 - protein, 9 aa, Homo Sapiens
AIQADLELE

SEQ ID NO: 447224 - protein, 9 aa, Homo Sapiens
GCHHEVVDG

SEQ ID NO: 447225 - protein, 9 aa, Homo Sapiens
LCLTSLCCL

SEQ ID NO: 447226 - protein, 9 aa, Homo Sapiens
QREEERSRH

SEQ ID NO: 447227 - protein, 9 aa, Homo Sapiens
YYSLDYGKD

SEQ ID NO: 447228 - protein, 9 aa, Homo Sapiens
DRGSPPRNT

SEQ ID NO: 447229 - protein, 9 aa, Homo Sapiens
PVIFCGDCN

SEQ ID NO: 447230 - protein, 9 aa, Homo Sapiens
CSCVPPCTG

SEQ ID NO: 447231 - protein, 9 aa, Homo Sapiens
FVAELSVPL

SEQ ID NO: 447232 - protein, 9 aa, Homo Sapiens
LDGLVEISW

SEQ ID NO: 447233 - protein, 9 aa, Homo Sapiens
RNTTPDFII

SEQ ID NO: 447234 - protein, 9 aa, Homo Sapiens
WDMQSTFNN

SEQ ID NO: 447235 - protein, 9 aa, Homo Sapiens
TLLQLFFYA

SEQ ID NO: 447236 - protein, 9 aa, Homo Sapiens
VHTLVFRLL

SEQ ID NO: 447237 - protein, 9 aa, Homo Sapiens
WNVIAWNRN

SEQ ID NO: 447238 - protein, 9 aa, Homo Sapiens
DGGFPQKSS

SEQ ID NO: 447239 - protein, 9 aa, Homo Sapiens
YSSTQNQGR

SEQ ID NO: 447240 - protein, 9 aa, Homo Sapiens
LFAYAAQGW

SEQ ID NO: 447241 - protein, 9 aa, Homo Sapiens
DILVAWKHI

SEQ ID NO: 447242 - protein, 9 aa, Homo Sapiens
IYFVGCFAQ

SEQ ID NO: 447243 - protein, 9 aa, Homo Sapiens
LVLKILGFK

SEQ ID NO: 447244 - protein, 9 aa, Homo Sapiens
RGVGAGIRC

SEQ ID NO: 447245 - protein, 9 aa, Homo Sapiens
QWMSPYLFF

SEQ ID NO: 447246 - protein, 9 aa, Homo Sapiens
DAVNSFIHQ

SEQ ID NO: 447247 - protein, 9 aa, Homo Sapiens
SLCGIPRQC

SEQ ID NO: 447248 - protein, 9 aa, Homo Sapiens
QCQKPCKDT

SEQ ID NO: 447249 - protein, 9 aa, Homo Sapiens
SNMFPKLTK

SEQ ID NO: 447250 - protein, 9 aa, Homo Sapiens
DENYKQTCI

SEQ ID NO: 447251 - protein, 9 aa, Homo Sapiens
ALASASVSW

SEQ ID NO: 447252 - protein, 9 aa, Homo Sapiens
TTINLSRMP

SEQ ID NO: 447253 - protein, 9 aa, Homo Sapiens
RTLHSRPRK

SEQ ID NO: 447254 - protein, 9 aa, Homo Sapiens
MHIINEGKL

SEQ ID NO: 447255 - protein, 9 aa, Homo Sapiens
TFRDVAIKF

SEQ ID NO: 447256 - protein, 9 aa, Homo Sapiens
GLAKEIQRS

SEQ ID NO: 447257 - protein, 9 aa, Homo Sapiens
SGRCRHFQW

SEQ ID NO: 447258 - protein, 9 aa, Homo Sapiens
EHSPDQGKF

SEQ ID NO: 447259 - protein, 9 aa, Homo Sapiens
TFHLSFCMS

SEQ ID NO: 447260 - protein, 9 aa, Homo Sapiens
VLLRKGCKN

SEQ ID NO: 447261 - protein, 9 aa, Homo Sapiens
SGWGQRIAE

SEQ ID NO: 447262 - protein, 9 aa, Homo Sapiens
VYKEVNNRL

SEQ ID NO: 447263 - protein, 9 aa, Homo Sapiens
VPNMLTNLG

SEQ ID NO: 447264 - protein, 9 aa, Homo Sapiens
HLEKVHVVI

SEQ ID NO: 447265 - protein, 9 aa, Homo Sapiens
KIQIWEIKF

SEQ ID NO: 447266 - protein, 9 aa, Homo Sapiens
DIVPHNSNE

SEQ ID NO: 447267 - protein, 9 aa, Homo Sapiens
EHWQEDALF

SEQ ID NO: 447268 - protein, 9 aa, Homo Sapiens
KATLTSRNR

SEQ ID NO: 447269 - protein, 9 aa, Homo Sapiens
KDLVENTFL

SEQ ID NO: 447270 - protein, 9 aa, Homo Sapiens
MDIVATDDC

SEQ ID NO: 447271 - protein, 9 aa, Homo Sapiens
RNNRSTVFQ

SEQ ID NO: 447272 - protein, 9 aa, Homo Sapiens
SALYLCTST

SEQ ID NO: 447273 - protein, 9 aa, Homo Sapiens
DVIRRAYLN

SEQ ID NO: 447274 - protein, 9 aa, Homo Sapiens
ADKANEQEL

SEQ ID NO: 447275 - protein, 9 aa, Homo Sapiens
RFLVGILNQ

SEQ ID NO: 447276 - protein, 9 aa, Homo Sapiens
LNSLDTCDL

SEQ ID NO: 447277 - protein, 9 aa, Homo Sapiens
YLSLNNWNV

SEQ ID NO: 447278 - protein, 9 aa, Homo Sapiens
INLKVAKNG

SEQ ID NO: 447279 - protein, 9 aa, Homo Sapiens
RTQPKMVTR

SEQ ID NO: 447280 - protein, 9 aa, Homo Sapiens
KSNYEIRIC

SEQ ID NO: 447281 - protein, 9 aa, Homo Sapiens
AQGYAFAAA

SEQ ID NO: 447282 - protein, 9 aa, Homo Sapiens
WLKKDRIVA

SEQ ID NO: 447283 - protein, 9 aa, Homo Sapiens
VKKIAEAGS

SEQ ID NO: 447284 - protein, 9 aa, Homo Sapiens
CSLMSYKSI

SEQ ID NO: 447285 - protein, 9 aa, Homo Sapiens
QTKSSALVS

SEQ ID NO: 447286 - protein, 9 aa, Homo Sapiens
TPVYTTSMI

SEQ ID NO: 447287 - protein, 9 aa, Homo Sapiens
LSEGDIAQK

SEQ ID NO: 447288 - protein, 9 aa, Homo Sapiens
IMNRKPHHK

SEQ ID NO: 447289 - protein, 9 aa, Homo Sapiens
GTYQQLLKH

SEQ ID NO: 447290 - protein, 9 aa, Homo Sapiens
QIRKLDQIQ

SEQ ID NO: 447291 - protein, 9 aa, Homo Sapiens
AGGMQQGSY

SEQ ID NO: 447292 - protein, 9 aa, Homo Sapiens
YQNQHTMNK

SEQ ID NO: 447293 - protein, 9 aa, Homo Sapiens
ERIDSLRQT

SEQ ID NO: 447294 - protein, 9 aa, Homo Sapiens
YGGDKFATL

SEQ ID NO: 447295 - protein, 9 aa, Homo Sapiens
TSNFCHPNF

SEQ ID NO: 447296 - protein, 9 aa, Homo Sapiens
EQTRVCFSD

SEQ ID NO: 447297 - protein, 9 aa, Homo Sapiens
SYVTSNALP

SEQ ID NO: 447298 - protein, 9 aa, Homo Sapiens
AKPENNGHA

SEQ ID NO: 447299 - protein, 9 aa, Homo Sapiens
TGEIIKARA

SEQ ID NO: 447300 - protein, 9 aa, Homo Sapiens
YPKSIQDIE

SEQ ID NO: 447301 - protein, 9 aa, Homo Sapiens
LENISPEEE

SEQ ID NO: 447302 - protein, 9 aa, Homo Sapiens
HNNIKLLEK

SEQ ID NO: 447303 - protein, 9 aa, Homo Sapiens
VFATTGYDI

SEQ ID NO: 447304 - protein, 9 aa, Homo Sapiens
SAKDLVENT

SEQ ID NO: 447305 - protein, 9 aa, Homo Sapiens
IQEELLYFK

SEQ ID NO: 447306 - protein, 9 aa, Homo Sapiens
NSNLTLGAC

SEQ ID NO: 447307 - protein, 9 aa, Homo Sapiens
MCNRRQEMR

SEQ ID NO: 447308 - protein, 9 aa, Homo Sapiens
INMLCNFRS

SEQ ID NO: 447309 - protein, 9 aa, Homo Sapiens
NYHKLWRSS

SEQ ID NO: 447310 - protein, 9 aa, Homo Sapiens
LQMEFLQNN

SEQ ID NO: 447311 - protein, 9 aa, Homo Sapiens
KLQVSRHTK

SEQ ID NO: 447312 - protein, 9 aa, Homo Sapiens
VFVYCTAVC

SEQ ID NO: 447313 - protein, 9 aa, Homo Sapiens
NFGWRFGTI

SEQ ID NO: 447314 - protein, 9 aa, Homo Sapiens
FEHNFCKAK

SEQ ID NO: 447315 - protein, 9 aa, Homo Sapiens
RLTDELYVL

SEQ ID NO: 447316 - protein, 9 aa, Homo Sapiens
ASKSGSTRG

SEQ ID NO: 447317 - protein, 9 aa, Homo Sapiens
AIHNAELSQ

SEQ ID NO: 447318 - protein, 9 aa, Homo Sapiens
VLQIKVRRL

SEQ ID NO: 447319 - protein, 9 aa, Homo Sapiens
STQNQGRQK

SEQ ID NO: 447320 - protein, 9 aa, Homo Sapiens
LHYVAQAGL

SEQ ID NO: 447321 - protein, 9 aa, Homo Sapiens
VDSPNNFNI

SEQ ID NO: 447322 - protein, 9 aa, Homo Sapiens
VPGASNLFY

SEQ ID NO: 447323 - protein, 9 aa, Homo Sapiens
TVVIDPSPF

SEQ ID NO: 447324 - protein, 9 aa, Homo Sapiens
AFFSHSSLQ

SEQ ID NO: 447325 - protein, 9 aa, Homo Sapiens
FQTKAIFVQ

SEQ ID NO: 447326 - protein, 9 aa, Homo Sapiens
LYSYVKDLF

SEQ ID NO: 447327 - protein, 9 aa, Homo Sapiens
KMLEHREVC

SEQ ID NO: 447328 - protein, 9 aa, Homo Sapiens
VYRKARNRI

SEQ ID NO: 447329 - protein, 9 aa, Homo Sapiens
HTQSSDKTA

SEQ ID NO: 447330 - protein, 9 aa, Homo Sapiens
ISVEGCLVQ

SEQ ID NO: 447331 - protein, 9 aa, Homo Sapiens
SSGSYWVSL

SEQ ID NO: 447332 - protein, 9 aa, Homo Sapiens
DKLGLRHPK

SEQ ID NO: 447333 - protein, 9 aa, Homo Sapiens
NSQASTVFI

SEQ ID NO: 447334 - protein, 9 aa, Homo Sapiens
GNFNLLPDT

SEQ ID NO: 447335 - protein, 9 aa, Homo Sapiens
HLTHHLQIH

SEQ ID NO: 447336 - protein, 9 aa, Homo Sapiens
SSALTIHKI

SEQ ID NO: 447337 - protein, 9 aa, Homo Sapiens
NSATPINTQ

SEQ ID NO: 447338 - protein, 9 aa, Homo Sapiens
YIESFLARA

SEQ ID NO: 447339 - protein, 9 aa, Homo Sapiens
VYYACILAT

SEQ ID NO: 447340 - protein, 9 aa, Homo Sapiens
VMKNDTDTG

SEQ ID NO: 447341 - protein, 9 aa, Homo Sapiens
RHDKIMFGF

SEQ ID NO: 447342 - protein, 9 aa, Homo Sapiens
PLVQPSAFK

SEQ ID NO: 447343 - protein, 9 aa, Homo Sapiens
KCISANQLK

SEQ ID NO: 447344 - protein, 9 aa, Homo Sapiens
KLTRQLLSE

SEQ ID NO: 447345 - protein, 9 aa, Homo Sapiens
HTPRPALAF

SEQ ID NO: 447346 - protein, 9 aa, Homo Sapiens
AKHPAGYFH

SEQ ID NO: 447347 - protein, 9 aa, Homo Sapiens
CDVVIKAIA

SEQ ID NO: 447348 - protein, 9 aa, Homo Sapiens
INNYKKDEM

SEQ ID NO: 447349 - protein, 9 aa, Homo Sapiens
NCFKFSRLL

SEQ ID NO: 447350 - protein, 9 aa, Homo Sapiens
FKSLETIEQ

SEQ ID NO: 447351 - protein, 9 aa, Homo Sapiens
PLGSVVEAI

SEQ ID NO: 447352 - protein, 9 aa, Homo Sapiens
CGKGPKIIF

SEQ ID NO: 447353 - protein, 9 aa, Homo Sapiens
PGPITFPAG

SEQ ID NO: 447354 - protein, 9 aa, Homo Sapiens
FNNYHSQFY

SEQ ID NO: 447355 - protein, 9 aa, Homo Sapiens
PCQPNYPPK

SEQ ID NO: 447356 - protein, 9 aa, Homo Sapiens
IHREYKDHL

SEQ ID NO: 447357 - protein, 9 aa, Homo Sapiens
TNGGQEWKF

SEQ ID NO: 447358 - protein, 9 aa, Homo Sapiens
IHKCCFSSS

SEQ ID NO: 447359 - protein, 9 aa, Homo Sapiens
ETTISVLSF

SEQ ID NO: 447360 - protein, 9 aa, Homo Sapiens
VWWRLCKTC

SEQ ID NO: 447361 - protein, 9 aa, Homo Sapiens
YTLQPSTTY

SEQ ID NO: 447362 - protein, 9 aa, Homo Sapiens
HPPPCLVGQ

SEQ ID NO: 447363 - protein, 9 aa, Homo Sapiens
RQKCKDYVD

SEQ ID NO: 447364 - protein, 9 aa, Homo Sapiens
LLSLFLVIY

SEQ ID NO: 447365 - protein, 9 aa, Homo Sapiens
LREICDIPG

SEQ ID NO: 447366 - protein, 9 aa, Homo Sapiens
PNYKGKYVM

SEQ ID NO: 447367 - protein, 9 aa, Homo Sapiens
AKCSQDCAT

SEQ ID NO: 447368 - protein, 9 aa, Homo Sapiens
LIYPSSQAT

SEQ ID NO: 447369 - protein, 9 aa, Homo Sapiens
KKKAKPNKC

SEQ ID NO: 447370 - protein, 9 aa, Homo Sapiens
VKCMPTLQF

SEQ ID NO: 447371 - protein, 9 aa, Homo Sapiens
IYKVEIYTK

SEQ ID NO: 447372 - protein, 9 aa, Homo Sapiens
KIFADRPCL

SEQ ID NO: 447373 - protein, 9 aa, Homo Sapiens
HDACSYVTS

SEQ ID NO: 447374 - protein, 9 aa, Homo Sapiens
KRGSQNDQS

SEQ ID NO: 447375 - protein, 9 aa, Homo Sapiens
LNWAFGVCN

SEQ ID NO: 447376 - protein, 9 aa, Homo Sapiens
KNISVQVSE

SEQ ID NO: 447377 - protein, 9 aa, Homo Sapiens
VSHCGLVGM

SEQ ID NO: 447378 - protein, 9 aa, Homo Sapiens
EAGTWRSLD

SEQ ID NO: 447379 - protein, 9 aa, Homo Sapiens
TTSQSLLER

SEQ ID NO: 447380 - protein, 9 aa, Homo Sapiens
CKLYSLRMS

SEQ ID NO: 447381 - protein, 9 aa, Homo Sapiens
NNWGVKLHV

SEQ ID NO: 447382 - protein, 9 aa, Homo Sapiens
KRDKELAKS

SEQ ID NO: 447383 - protein, 9 aa, Homo Sapiens
DSIKVIPFT

SEQ ID NO: 447384 - protein, 9 aa, Homo Sapiens
TSDQIRSQA

SEQ ID NO: 447385 - protein, 9 aa, Homo Sapiens
VLEHEARHS

SEQ ID NO: 447386 - protein, 9 aa, Homo Sapiens
VRIILLNYG

SEQ ID NO: 447387 - protein, 9 aa, Homo Sapiens
SCSSSFQKH

SEQ ID NO: 447388 - protein, 9 aa, Homo Sapiens
LILVFVGAA

SEQ ID NO: 447389 - protein, 9 aa, Homo Sapiens
NDRVIHWIL

SEQ ID NO: 447390 - protein, 9 aa, Homo Sapiens
SRPPSSELL

SEQ ID NO: 447391 - protein, 9 aa, Homo Sapiens
PLKDRRHIH

SEQ ID NO: 447392 - protein, 9 aa, Homo Sapiens
SNFVAASLS

SEQ ID NO: 447393 - protein, 9 aa, Homo Sapiens
FNTLLAGPP

SEQ ID NO: 447394 - protein, 9 aa, Homo Sapiens
MTHKLEALH

SEQ ID NO: 447395 - protein, 9 aa, Homo Sapiens
RYSVNVALS

SEQ ID NO: 447396 - protein, 9 aa, Homo Sapiens
NSYQNVFIG

SEQ ID NO: 447397 - protein, 9 aa, Homo Sapiens
DDKYVLRDV

SEQ ID NO: 447398 - protein, 9 aa, Homo Sapiens
TANKCSLDQ

SEQ ID NO: 447399 - protein, 9 aa, Homo Sapiens
KAMNTKEPV

SEQ ID NO: 447400 - protein, 9 aa, Homo Sapiens
EGLEMKSAR

SEQ ID NO: 447401 - protein, 9 aa, Homo Sapiens
FQVTLFTVN

SEQ ID NO: 447402 - protein, 9 aa, Homo Sapiens
YNVYRDHSE

SEQ ID NO: 447403 - protein, 9 aa, Homo Sapiens
NFVAASLSN

SEQ ID NO: 447404 - protein, 9 aa, Homo Sapiens
IRRARLPTV

SEQ ID NO: 447405 - protein, 9 aa, Homo Sapiens
YFFLANLSI

SEQ ID NO: 447406 - protein, 9 aa, Homo Sapiens
KNEPWYKLF

SEQ ID NO: 447407 - protein, 9 aa, Homo Sapiens
VYITHLSIT

SEQ ID NO: 447408 - protein, 9 aa, Homo Sapiens
GSSEELLLI

SEQ ID NO: 447409 - protein, 9 aa, Homo Sapiens
SQCGRSVFD

SEQ ID NO: 447410 - protein, 9 aa, Homo Sapiens
EEINTFHVI

SEQ ID NO: 447411 - protein, 9 aa, Homo Sapiens
VKHGWVWNQ

SEQ ID NO: 447412 - protein, 9 aa, Homo Sapiens
VYKYADLYL

SEQ ID NO: 447413 - protein, 9 aa, Homo Sapiens
TRIQGFPQD

SEQ ID NO: 447414 - protein, 9 aa, Homo Sapiens
VVVTSAASG

SEQ ID NO: 447415 - protein, 9 aa, Homo Sapiens
YDLHQVNKA

SEQ ID NO: 447416 - protein, 9 aa, Homo Sapiens
EPASCKDLC

SEQ ID NO: 447417 - protein, 9 aa, Homo Sapiens
KAENEPENA

SEQ ID NO: 447418 - protein, 9 aa, Homo Sapiens
EFLIQASSR

SEQ ID NO: 447419 - protein, 9 aa, Homo Sapiens
HKLRPTEKV

SEQ ID NO: 447420 - protein, 9 aa, Homo Sapiens
HQKNQDLLL

SEQ ID NO: 447421 - protein, 9 aa, Homo Sapiens
PSLRQEKWS

SEQ ID NO: 447422 - protein, 9 aa, Homo Sapiens
QYEASDKDF

SEQ ID NO: 447423 - protein, 9 aa, Homo Sapiens
YAVILAFNV

SEQ ID NO: 447424 - protein, 9 aa, Homo Sapiens
LETLNNAYK

SEQ ID NO: 447425 - protein, 9 aa, Homo Sapiens
LQMHFFHSL

SEQ ID NO: 447426 - protein, 9 aa, Homo Sapiens
PGYGDTINC

SEQ ID NO: 447427 - protein, 9 aa, Homo Sapiens
KAASGHTVG

SEQ ID NO: 447428 - protein, 9 aa, Homo Sapiens
KAEKVIQHA

SEQ ID NO: 447429 - protein, 9 aa, Homo Sapiens
DSLDVFMSE

SEQ ID NO: 447430 - protein, 9 aa, Homo Sapiens
ENADDNITV

SEQ ID NO: 447431 - protein, 9 aa, Homo Sapiens
GNLVMEPES

SEQ ID NO: 447432 - protein, 9 aa, Homo Sapiens
KYNRYRYII

SEQ ID NO: 447433 - protein, 9 aa, Homo Sapiens
YPVTNLQKH

SEQ ID NO: 447434 - protein, 9 aa, Homo Sapiens
GIQKSSPRK

SEQ ID NO: 447435 - protein, 9 aa, Homo Sapiens
FERTLGLAK

SEQ ID NO: 447436 - protein, 9 aa, Homo Sapiens
RHRRSQSRS

SEQ ID NO: 447437 - protein, 9 aa, Homo Sapiens
YCTPKKGSN

SEQ ID NO: 447438 - protein, 9 aa, Homo Sapiens
RKFDDIQIY

SEQ ID NO: 447439 - protein, 9 aa, Homo Sapiens
REEVMLTLT

SEQ ID NO: 447440 - protein, 9 aa, Homo Sapiens
LRQQLDYLR

SEQ ID NO: 447441 - protein, 9 aa, Homo Sapiens
KAISDLAVC

SEQ ID NO: 447442 - protein, 9 aa, Homo Sapiens
LFRANSTSD

SEQ ID NO: 447443 - protein, 9 aa, Homo Sapiens
IIFTAGLCS

SEQ ID NO: 447444 - protein, 9 aa, Homo Sapiens
MYRRLREFA

SEQ ID NO: 447445 - protein, 9 aa, Homo Sapiens
GTLTQNKMI

SEQ ID NO: 447446 - protein, 9 aa, Homo Sapiens
EDNEYTERY

SEQ ID NO: 447447 - protein, 9 aa, Homo Sapiens
MKYFEEMRK

SEQ ID NO: 447448 - protein, 9 aa, Homo Sapiens
GDTHPNVVV

SEQ ID NO: 447449 - protein, 9 aa, Homo Sapiens
ALTSVYYAC

SEQ ID NO: 447450 - protein, 9 aa, Homo Sapiens
FLDVIRRAY

SEQ ID NO: 447451 - protein, 9 aa, Homo Sapiens
VGGESIYYN

SEQ ID NO: 447452 - protein, 9 aa, Homo Sapiens
VRILCLKER

SEQ ID NO: 447453 - protein, 9 aa, Homo Sapiens
RPVTGLVSC

SEQ ID NO: 447454 - protein, 9 aa, Homo Sapiens
IRNVGSEVH

SEQ ID NO: 447455 - protein, 9 aa, Homo Sapiens
VHKGVEHVE

SEQ ID NO: 447456 - protein, 9 aa, Homo Sapiens
LIHLNTEPM

SEQ ID NO: 447457 - protein, 9 aa, Homo Sapiens
MEQEKLGAA

SEQ ID NO: 447458 - protein, 9 aa, Homo Sapiens
GFRKPTNNS

SEQ ID NO: 447459 - protein, 9 aa, Homo Sapiens
DTIKSLTAL

SEQ ID NO: 447460 - protein, 9 aa, Homo Sapiens
ESTHVEFKM

SEQ ID NO: 447461 - protein, 9 aa, Homo Sapiens
ILPKHDMEL

SEQ ID NO: 447462 - protein, 9 aa, Homo Sapiens
KVVFDKDVN

SEQ ID NO: 447463 - protein, 9 aa, Homo Sapiens
QPLNRNSLC

SEQ ID NO: 447464 - protein, 9 aa, Homo Sapiens
AAEECRDKL

SEQ ID NO: 447465 - protein, 9 aa, Homo Sapiens
QVDSVNTAR

SEQ ID NO: 447466 - protein, 9 aa, Homo Sapiens
GEDSEDEEE

SEQ ID NO: 447467 - protein, 9 aa, Homo Sapiens
KASKSGSTR

SEQ ID NO: 447468 - protein, 9 aa, Homo Sapiens
DPENVQKAV

SEQ ID NO: 447469 - protein, 9 aa, Homo Sapiens
VRSGVMGEK

SEQ ID NO: 447470 - protein, 9 aa, Homo Sapiens
KLLNKLTQS

SEQ ID NO: 447471 - protein, 9 aa, Homo Sapiens
VDLPFPDGM

SEQ ID NO: 447472 - protein, 9 aa, Homo Sapiens
VVPKLNHNN

SEQ ID NO: 447473 - protein, 9 aa, Homo Sapiens
SFKVMDYSL

SEQ ID NO: 447474 - protein, 9 aa, Homo Sapiens
SSDTSMDFT

SEQ ID NO: 447475 - protein, 9 aa, Homo Sapiens
LPATANMKA

SEQ ID NO: 447476 - protein, 9 aa, Homo Sapiens
KPEDGEYKC

SEQ ID NO: 447477 - protein, 9 aa, Homo Sapiens
SRWKRKVLS

SEQ ID NO: 447478 - protein, 9 aa, Homo Sapiens
VELLARDFK

SEQ ID NO: 447479 - protein, 9 aa, Homo Sapiens
CRSAYEPDR

SEQ ID NO: 447480 - protein, 9 aa, Homo Sapiens
YIKLISETL

SEQ ID NO: 447481 - protein, 9 aa, Homo Sapiens
LSLLLVAVV

SEQ ID NO: 447482 - protein, 9 aa, Homo Sapiens
TNWKVIAIN

SEQ ID NO: 447483 - protein, 9 aa, Homo Sapiens
ADRISSSDI

SEQ ID NO: 447484 - protein, 9 aa, Homo Sapiens
QTDDTLNSL

SEQ ID NO: 447485 - protein, 9 aa, Homo Sapiens
SAISNRALG

SEQ ID NO: 447486 - protein, 9 aa, Homo Sapiens
DVRSVGNTF

SEQ ID NO: 447487 - protein, 9 aa, Homo Sapiens
PFNFFHHIN

SEQ ID NO: 447488 - protein, 9 aa, Homo Sapiens
AHVNRGPAY

SEQ ID NO: 447489 - protein, 9 aa, Homo Sapiens
LGSEAYYSH

SEQ ID NO: 447490 - protein, 9 aa, Homo Sapiens
QTCQTVAAC

SEQ ID NO: 447491 - protein, 9 aa, Homo Sapiens
GKDSCQGGS

SEQ ID NO: 447492 - protein, 9 aa, Homo Sapiens
ACQVNEWSF

SEQ ID NO: 447493 - protein, 9 aa, Homo Sapiens
TKNTKKVIQ

SEQ ID NO: 447494 - protein, 9 aa, Homo Sapiens
ILELIAYLD

SEQ ID NO: 447495 - protein, 9 aa, Homo Sapiens
GGSGKSYHS

SEQ ID NO: 447496 - protein, 9 aa, Homo Sapiens
DALSGAEFE

SEQ ID NO: 447497 - protein, 9 aa, Homo Sapiens
HQLYLQMHS

SEQ ID NO: 447498 - protein, 9 aa, Homo Sapiens
TVHGFLQTL

SEQ ID NO: 447499 - protein, 9 aa, Homo Sapiens
PDKKITFLK

SEQ ID NO: 447500 - protein, 9 aa, Homo Sapiens
RKLHGTLTK

SEQ ID NO: 447501 - protein, 9 aa, Homo Sapiens
PFYVEDTYL

SEQ ID NO: 447502 - protein, 9 aa, Homo Sapiens
LLACILLSD

SEQ ID NO: 447503 - protein, 9 aa, Homo Sapiens
TPFQTILGY

SEQ ID NO: 447504 - protein, 9 aa, Homo Sapiens
IKMGKQGII

SEQ ID NO: 447505 - protein, 9 aa, Homo Sapiens
LNCFPSYNR

SEQ ID NO: 447506 - protein, 9 aa, Homo Sapiens
RKRPGIALE

SEQ ID NO: 447507 - protein, 9 aa, Homo Sapiens
KENQRGCFL

SEQ ID NO: 447508 - protein, 9 aa, Homo Sapiens
LPLARAHGH

SEQ ID NO: 447509 - protein, 9 aa, Homo Sapiens
QMLLGFQLN

SEQ ID NO: 447510 - protein, 9 aa, Homo Sapiens
TPFVFRISQ

SEQ ID NO: 447511 - protein, 9 aa, Homo Sapiens
VFMPDEDEC

SEQ ID NO: 447512 - protein, 9 aa, Homo Sapiens
PGAMGIHEN

SEQ ID NO: 447513 - protein, 9 aa, Homo Sapiens
VNSEFVGWR

SEQ ID NO: 447514 - protein, 9 aa, Homo Sapiens
PENIHNKLE

SEQ ID NO: 447515 - protein, 9 aa, Homo Sapiens
PPAMPSALG

SEQ ID NO: 447516 - protein, 9 aa, Homo Sapiens
HGQHEAVNV

SEQ ID NO: 447517 - protein, 9 aa, Homo Sapiens
IYRLSEEGM

SEQ ID NO: 447518 - protein, 9 aa, Homo Sapiens
EGAASKVIG

SEQ ID NO: 447519 - protein, 9 aa, Homo Sapiens
KDKETHRDF

SEQ ID NO: 447520 - protein, 9 aa, Homo Sapiens
TIVPESEIS

SEQ ID NO: 447521 - protein, 9 aa, Homo Sapiens
HITHKTIEI

SEQ ID NO: 447522 - protein, 9 aa, Homo Sapiens
LCKLVYVGS

SEQ ID NO: 447523 - protein, 9 aa, Homo Sapiens
QKWKCIPCS

SEQ ID NO: 447524 - protein, 9 aa, Homo Sapiens
SSIKDAVMS

SEQ ID NO: 447525 - protein, 9 aa, Homo Sapiens
AKDTKYNYC

SEQ ID NO: 447526 - protein, 9 aa, Homo Sapiens
LDVLRELEA

SEQ ID NO: 447527 - protein, 9 aa, Homo Sapiens
ELGKFVKNI

SEQ ID NO: 447528 - protein, 9 aa, Homo Sapiens
DVSTKNPAR

SEQ ID NO: 447529 - protein, 9 aa, Homo Sapiens
VIGCDGQCH

SEQ ID NO: 447530 - protein, 9 aa, Homo Sapiens
SVGSALPQR

SEQ ID NO: 447531 - protein, 9 aa, Homo Sapiens
WYTNSSKIP

SEQ ID NO: 447532 - protein, 9 aa, Homo Sapiens
SILLYGRFS

SEQ ID NO: 447533 - protein, 9 aa, Homo Sapiens
KPGFLTTPT

SEQ ID NO: 447534 - protein, 9 aa, Homo Sapiens
AACLIKCQN

SEQ ID NO: 447535 - protein, 9 aa, Homo Sapiens
QNSLLPQLL

SEQ ID NO: 447536 - protein, 9 aa, Homo Sapiens
YNQRKANLV

SEQ ID NO: 447537 - protein, 9 aa, Homo Sapiens
TAVILFYGT

SEQ ID NO: 447538 - protein, 9 aa, Homo Sapiens
HIYYSDKYD

SEQ ID NO: 447539 - protein, 9 aa, Homo Sapiens
LSLMNSTDQ

SEQ ID NO: 447540 - protein, 9 aa, Homo Sapiens
WLIINETPL

SEQ ID NO: 447541 - protein, 9 aa, Homo Sapiens
DSSSGTEQT

SEQ ID NO: 447542 - protein, 9 aa, Homo Sapiens
SISSEENAD

SEQ ID NO: 447543 - protein, 9 aa, Homo Sapiens
CPHLGQIMG

SEQ ID NO: 447544 - protein, 9 aa, Homo Sapiens
EENSSEKNE

SEQ ID NO: 447545 - protein, 9 aa, Homo Sapiens
VCTVCNEFL

SEQ ID NO: 447546 - protein, 9 aa, Homo Sapiens
DTASEVDCG

SEQ ID NO: 447547 - protein, 9 aa, Homo Sapiens
HKIPREPRP

SEQ ID NO: 447548 - protein, 9 aa, Homo Sapiens
AKDEHNQNG

SEQ ID NO: 447549 - protein, 9 aa, Homo Sapiens
HGISDTFYP

SEQ ID NO: 447550 - protein, 9 aa, Homo Sapiens
PLMIIRHLD

SEQ ID NO: 447551 - protein, 9 aa, Homo Sapiens
MSADFHVDL

SEQ ID NO: 447552 - protein, 9 aa, Homo Sapiens
NTTHLDKSC

SEQ ID NO: 447553 - protein, 9 aa, Homo Sapiens
STMNYDICK

SEQ ID NO: 447554 - protein, 9 aa, Homo Sapiens
HVFPCVPEH

SEQ ID NO: 447555 - protein, 9 aa, Homo Sapiens
ARLCEEKKE

SEQ ID NO: 447556 - protein, 9 aa, Homo Sapiens
LQNFNKQNK

SEQ ID NO: 447557 - protein, 9 aa, Homo Sapiens
IKTFYQTSV

SEQ ID NO: 447558 - protein, 9 aa, Homo Sapiens
REDRYVNDP

SEQ ID NO: 447559 - protein, 9 aa, Homo Sapiens
QVYIQSTDV

SEQ ID NO: 447560 - protein, 9 aa, Homo Sapiens
SSLTEHKII

SEQ ID NO: 447561 - protein, 9 aa, Homo Sapiens
YQVYRRHFL

SEQ ID NO: 447562 - protein, 9 aa, Homo Sapiens
AKFDLKLDL

SEQ ID NO: 447563 - protein, 9 aa, Homo Sapiens
FANPSHYRM

SEQ ID NO: 447564 - protein, 9 aa, Homo Sapiens
VYQPKIKGS

SEQ ID NO: 447565 - protein, 9 aa, Homo Sapiens
IVYLAYAFE

SEQ ID NO: 447566 - protein, 9 aa, Homo Sapiens
FHYPCDPLI

SEQ ID NO: 447567 - protein, 9 aa, Homo Sapiens
INTGEKPYK

SEQ ID NO: 447568 - protein, 9 aa, Homo Sapiens
INTGEKPYE

SEQ ID NO: 447569 - protein, 9 aa, Homo Sapiens
LAIRSIILV

SEQ ID NO: 447570 - protein, 9 aa, Homo Sapiens
AAIDAPDLF

SEQ ID NO: 447571 - protein, 9 aa, Homo Sapiens
DWLSHKDEE

SEQ ID NO: 447572 - protein, 9 aa, Homo Sapiens
LRHNKSCAR

SEQ ID NO: 447573 - protein, 9 aa, Homo Sapiens
LNRSKHLEK

SEQ ID NO: 447574 - protein, 9 aa, Homo Sapiens
AINQYRVCQ

SEQ ID NO: 447575 - protein, 9 aa, Homo Sapiens
SESREGHVQ

SEQ ID NO: 447576 - protein, 9 aa, Homo Sapiens
NQSIFCWEI

SEQ ID NO: 447577 - protein, 9 aa, Homo Sapiens
YFFPHIPHP

SEQ ID NO: 447578 - protein, 9 aa, Homo Sapiens
DFMLPTLII

SEQ ID NO: 447579 - protein, 9 aa, Homo Sapiens
QLTAKKICY

SEQ ID NO: 447580 - protein, 9 aa, Homo Sapiens
QHWADLGCS

SEQ ID NO: 447581 - protein, 9 aa, Homo Sapiens
LEIEDDENF

SEQ ID NO: 447582 - protein, 9 aa, Homo Sapiens
MWLRPDLHT

SEQ ID NO: 447583 - protein, 9 aa, Homo Sapiens
SGSGNGSGP

SEQ ID NO: 447584 - protein, 9 aa, Homo Sapiens
TDANMVMSF

SEQ ID NO: 447585 - protein, 9 aa, Homo Sapiens
WSCFFLWPL

SEQ ID NO: 447586 - protein, 9 aa, Homo Sapiens
IQKVCNKTL

SEQ ID NO: 447587 - protein, 9 aa, Homo Sapiens
YTHNFYWEL

SEQ ID NO: 447588 - protein, 9 aa, Homo Sapiens
RGSPPRNTT

SEQ ID NO: 447589 - protein, 9 aa, Homo Sapiens
FLGATGTLG

SEQ ID NO: 447590 - protein, 9 aa, Homo Sapiens
LPDLNMQRS

SEQ ID NO: 447591 - protein, 9 aa, Homo Sapiens
GITGTLRTQ

SEQ ID NO: 447592 - protein, 9 aa, Homo Sapiens
CTSSLPRSE

SEQ ID NO: 447593 - protein, 9 aa, Homo Sapiens
TISICINSR

SEQ ID NO: 447594 - protein, 9 aa, Homo Sapiens
EAEERHRPD

SEQ ID NO: 447595 - protein, 9 aa, Homo Sapiens
PYCDDTVTY

SEQ ID NO: 447596 - protein, 9 aa, Homo Sapiens
CCGKVLVWP

SEQ ID NO: 447597 - protein, 9 aa, Homo Sapiens
DKAEKVIQH

SEQ ID NO: 447598 - protein, 9 aa, Homo Sapiens
PQVTTPEPD

SEQ ID NO: 447599 - protein, 9 aa, Homo Sapiens
ETVFQPSPE

SEQ ID NO: 447600 - protein, 9 aa, Homo Sapiens
PRGERHLPQ

SEQ ID NO: 447601 - protein, 9 aa, Homo Sapiens
AGFAFSIFK

SEQ ID NO: 447602 - protein, 9 aa, Homo Sapiens
QVNVGLEAL

SEQ ID NO: 447603 - protein, 9 aa, Homo Sapiens
IYYKVQNEA

SEQ ID NO: 447604 - protein, 9 aa, Homo Sapiens
KKKRKTLAE

SEQ ID NO: 447605 - protein, 9 aa, Homo Sapiens
STQVSAVHI

SEQ ID NO: 447606 - protein, 9 aa, Homo Sapiens
KKVFFVDVG

SEQ ID NO: 447607 - protein, 9 aa, Homo Sapiens
TANGNVEAT

SEQ ID NO: 447608 - protein, 9 aa, Homo Sapiens
QGNLELEDM

SEQ ID NO: 447609 - protein, 9 aa, Homo Sapiens
YQYYIYWTD

SEQ ID NO: 447610 - protein, 9 aa, Homo Sapiens
DSDILPLHN

SEQ ID NO: 447611 - protein, 9 aa, Homo Sapiens
LKFSSENSN

SEQ ID NO: 447612 - protein, 9 aa, Homo Sapiens
ETVYGLNKF

SEQ ID NO: 447613 - protein, 9 aa, Homo Sapiens
SPAPGVNKS

SEQ ID NO: 447614 - protein, 9 aa, Homo Sapiens
GESIYYNEQ

SEQ ID NO: 447615 - protein, 9 aa, Homo Sapiens
MEQFDPGLR

SEQ ID NO: 447616 - protein, 9 aa, Homo Sapiens
DLIHLNTEP

SEQ ID NO: 447617 - protein, 9 aa, Homo Sapiens
NVFLVAPQI

SEQ ID NO: 447618 - protein, 9 aa, Homo Sapiens
EHCTEENKI

SEQ ID NO: 447619 - protein, 9 aa, Homo Sapiens
ILMKFMKTR

SEQ ID NO: 447620 - protein, 9 aa, Homo Sapiens
TVQKPFIRL

SEQ ID NO: 447621 - protein, 9 aa, Homo Sapiens
NTLKSLTSH

SEQ ID NO: 447622 - protein, 9 aa, Homo Sapiens
GLFTDRATR

SEQ ID NO: 447623 - protein, 9 aa, Homo Sapiens
KAPLVKLLL

SEQ ID NO: 447624 - protein, 9 aa, Homo Sapiens
VVKELNHLG

SEQ ID NO: 447625 - protein, 9 aa, Homo Sapiens
GLRRLSGNK

SEQ ID NO: 447626 - protein, 9 aa, Homo Sapiens
RYDFFVSRS

SEQ ID NO: 447627 - protein, 9 aa, Homo Sapiens
NHHRVHTEK

SEQ ID NO: 447628 - protein, 9 aa, Homo Sapiens
NVTNNLKYL

SEQ ID NO: 447629 - protein, 9 aa, Homo Sapiens
FYTLWTAKA

SEQ ID NO: 447630 - protein, 9 aa, Homo Sapiens
GKYCEKDDL

SEQ ID NO: 447631 - protein, 9 aa, Homo Sapiens
SGQDESSYK

SEQ ID NO: 447632 - protein, 9 aa, Homo Sapiens
YMCECPVHK

SEQ ID NO: 447633 - protein, 9 aa, Homo Sapiens
PSTTAAAAT

SEQ ID NO: 447634 - protein, 9 aa, Homo Sapiens
PVVSWYLNG

SEQ ID NO: 447635 - protein, 9 aa, Homo Sapiens
RSAGIIELS

SEQ ID NO: 447636 - protein, 9 aa, Homo Sapiens
MLNKRIVVY

SEQ ID NO: 447637 - protein, 9 aa, Homo Sapiens
IQSLLESLT

SEQ ID NO: 447638 - protein, 9 aa, Homo Sapiens
GRHKKYAPK

SEQ ID NO: 447639 - protein, 9 aa, Homo Sapiens
RQLLSEFDR

SEQ ID NO: 447640 - protein, 9 aa, Homo Sapiens
INYNSNQAA

SEQ ID NO: 447641 - protein, 9 aa, Homo Sapiens
LRNDSTVPN

SEQ ID NO: 447642 - protein, 9 aa, Homo Sapiens
ETLNNAYKN

SEQ ID NO: 447643 - protein, 9 aa, Homo Sapiens
LNSKAAAHA

SEQ ID NO: 447644 - protein, 9 aa, Homo Sapiens
QARRQNRRR

SEQ ID NO: 447645 - protein, 9 aa, Homo Sapiens
NRGSNIIQH

SEQ ID NO: 447646 - protein, 9 aa, Homo Sapiens
KSFSVLSTL

SEQ ID NO: 447647 - protein, 9 aa, Homo Sapiens
PQTRLFVPP

SEQ ID NO: 447648 - protein, 9 aa, Homo Sapiens
IPVTFKYMK

SEQ ID NO: 447649 - protein, 9 aa, Homo Sapiens
ADKEKITYL

SEQ ID NO: 447650 - protein, 9 aa, Homo Sapiens
STLGFDRYV

SEQ ID NO: 447651 - protein, 9 aa, Homo Sapiens
YRDGNSLIE

SEQ ID NO: 447652 - protein, 9 aa, Homo Sapiens
ERIFLVIGT

SEQ ID NO: 447653 - protein, 9 aa, Homo Sapiens
LGTALKATP

SEQ ID NO: 447654 - protein, 9 aa, Homo Sapiens
WIYILCKNY

SEQ ID NO: 447655 - protein, 9 aa, Homo Sapiens
DALGNVEGV

SEQ ID NO: 447656 - protein, 9 aa, Homo Sapiens
STVTFNTLL

SEQ ID NO: 447657 - protein, 9 aa, Homo Sapiens
TPHRTSENT

SEQ ID NO: 447658 - protein, 9 aa, Homo Sapiens
IDLHVQIHF

SEQ ID NO: 447659 - protein, 9 aa, Homo Sapiens
TSRTKRRQR

SEQ ID NO: 447660 - protein, 9 aa, Homo Sapiens
LRQRRMHQQ

SEQ ID NO: 447661 - protein, 9 aa, Homo Sapiens
MKQINDAHH

SEQ ID NO: 447662 - protein, 9 aa, Homo Sapiens
SSISCCNCE

SEQ ID NO: 447663 - protein, 9 aa, Homo Sapiens
DIKQDNGME

SEQ ID NO: 447664 - protein, 9 aa, Homo Sapiens
GQQVTLRCY

SEQ ID NO: 447665 - protein, 9 aa, Homo Sapiens
GSRYDAKYL

SEQ ID NO: 447666 - protein, 9 aa, Homo Sapiens
NSWGIADET

SEQ ID NO: 447667 - protein, 9 aa, Homo Sapiens
NPFLILVFV

SEQ ID NO: 447668 - protein, 9 aa, Homo Sapiens
YNYCIISSS

SEQ ID NO: 447669 - protein, 9 aa, Homo Sapiens
HLVEDMENK

SEQ ID NO: 447670 - protein, 9 aa, Homo Sapiens
ESRQAPTKL

SEQ ID NO: 447671 - protein, 9 aa, Homo Sapiens
ASKRTSDQI

SEQ ID NO: 447672 - protein, 9 aa, Homo Sapiens
WEGMANLPP

SEQ ID NO: 447673 - protein, 9 aa, Homo Sapiens
KKCEMYRRL

SEQ ID NO: 447674 - protein, 9 aa, Homo Sapiens
LFSSSHLRY

SEQ ID NO: 447675 - protein, 9 aa, Homo Sapiens
VEVSGKHED

SEQ ID NO: 447676 - protein, 9 aa, Homo Sapiens
TKLGYSMTR

SEQ ID NO: 447677 - protein, 9 aa, Homo Sapiens
ICKWKKADL

SEQ ID NO: 447678 - protein, 9 aa, Homo Sapiens
YEGHKAELT

SEQ ID NO: 447679 - protein, 9 aa, Homo Sapiens
YEAICKAFR

SEQ ID NO: 447680 - protein, 9 aa, Homo Sapiens
TKTIQVSYA

SEQ ID NO: 447681 - protein, 9 aa, Homo Sapiens
CTLLDEHQD

SEQ ID NO: 447682 - protein, 9 aa, Homo Sapiens
MEVINLQCN

SEQ ID NO: 447683 - protein, 9 aa, Homo Sapiens
EQHGLCDKP

SEQ ID NO: 447684 - protein, 9 aa, Homo Sapiens
CRDKLIKEM

SEQ ID NO: 447685 - protein, 9 aa, Homo Sapiens
LMLNKRIVV

SEQ ID NO: 447686 - protein, 9 aa, Homo Sapiens
VNRKVINFE

SEQ ID NO: 447687 - protein, 9 aa, Homo Sapiens
TTEEFKLKD

SEQ ID NO: 447688 - protein, 9 aa, Homo Sapiens
DKDLIWATS

SEQ ID NO: 447689 - protein, 9 aa, Homo Sapiens
ESGGGAEDS

SEQ ID NO: 447690 - protein, 9 aa, Homo Sapiens
SKTKYRIRE

SEQ ID NO: 447691 - protein, 9 aa, Homo Sapiens
GKGKSSHWV

SEQ ID NO: 447692 - protein, 9 aa, Homo Sapiens
TLDTLTSRI

SEQ ID NO: 447693 - protein, 9 aa, Homo Sapiens
VDGVRAFLH

SEQ ID NO: 447694 - protein, 9 aa, Homo Sapiens
LRRRGPNFG

SEQ ID NO: 447695 - protein, 9 aa, Homo Sapiens
SSSSESDKN

SEQ ID NO: 447696 - protein, 9 aa, Homo Sapiens
LHSAADWSA

SEQ ID NO: 447697 - protein, 9 aa, Homo Sapiens
RGVIPNSFG

SEQ ID NO: 447698 - protein, 9 aa, Homo Sapiens
GGVCIAQSH

SEQ ID NO: 447699 - protein, 9 aa, Homo Sapiens
PLARAHGHL

SEQ ID NO: 447700 - protein, 9 aa, Homo Sapiens
IISSILNIH

SEQ ID NO: 447701 - protein, 9 aa, Homo Sapiens
VKCNHIYQI

SEQ ID NO: 447702 - protein, 9 aa, Homo Sapiens
HQSDQYVKI

SEQ ID NO: 447703 - protein, 9 aa, Homo Sapiens
QLQYSNQNT

SEQ ID NO: 447704 - protein, 9 aa, Homo Sapiens
LVLIEHFFA

SEQ ID NO: 447705 - protein, 9 aa, Homo Sapiens
LLDAVTYLT

SEQ ID NO: 447706 - protein, 9 aa, Homo Sapiens
APDNKLSTT

SEQ ID NO: 447707 - protein, 9 aa, Homo Sapiens
TVFQPSPES

SEQ ID NO: 447708 - protein, 9 aa, Homo Sapiens
NQYRVCQEV

SEQ ID NO: 447709 - protein, 9 aa, Homo Sapiens
HLERDINKF

SEQ ID NO: 447710 - protein, 9 aa, Homo Sapiens
LYGSALFMY

SEQ ID NO: 447711 - protein, 9 aa, Homo Sapiens
NNVCFLEGK

SEQ ID NO: 447712 - protein, 9 aa, Homo Sapiens
RKQLLLDEL

SEQ ID NO: 447713 - protein, 9 aa, Homo Sapiens
GDIAQKGYE

SEQ ID NO: 447714 - protein, 9 aa, Homo Sapiens
FTQYHKKKE

SEQ ID NO: 447715 - protein, 9 aa, Homo Sapiens
CDPQTRLFV

SEQ ID NO: 447716 - protein, 9 aa, Homo Sapiens
THLSITDIS

SEQ ID NO: 447717 - protein, 9 aa, Homo Sapiens
SLKSSPGLG

SEQ ID NO: 447718 - protein, 9 aa, Homo Sapiens
EGRRQSQKV

SEQ ID NO: 447719 - protein, 9 aa, Homo Sapiens
VLVRIILLN

SEQ ID NO: 447720 - protein, 9 aa, Homo Sapiens
APEKPVKKH

SEQ ID NO: 447721 - protein, 9 aa, Homo Sapiens
DDSDIEAHL

SEQ ID NO: 447722 - protein, 9 aa, Homo Sapiens
SLSRNRSLG

SEQ ID NO: 447723 - protein, 9 aa, Homo Sapiens
QACQKAIEK

SEQ ID NO: 447724 - protein, 9 aa, Homo Sapiens
LAPRTAVAA

SEQ ID NO: 447725 - protein, 9 aa, Homo Sapiens
TNKNWVQSG

SEQ ID NO: 447726 - protein, 9 aa, Homo Sapiens
HTFNATICY

SEQ ID NO: 447727 - protein, 9 aa, Homo Sapiens
NEMYSGKFC

SEQ ID NO: 447728 - protein, 9 aa, Homo Sapiens
LLTECIEGG

SEQ ID NO: 447729 - protein, 9 aa, Homo Sapiens
SYYTNEKWL

SEQ ID NO: 447730 - protein, 9 aa, Homo Sapiens
FAHKRGSQN

SEQ ID NO: 447731 - protein, 9 aa, Homo Sapiens
CFDECNRIS

SEQ ID NO: 447732 - protein, 9 aa, Homo Sapiens
DYGTLLYTM

SEQ ID NO: 447733 - protein, 9 aa, Homo Sapiens
LHRLDLGEL

SEQ ID NO: 447734 - protein, 9 aa, Homo Sapiens
IYTYMASED

SEQ ID NO: 447735 - protein, 9 aa, Homo Sapiens
KDVYVKDVL

SEQ ID NO: 447736 - protein, 9 aa, Homo Sapiens
NLSLMNSTD

SEQ ID NO: 447737 - protein, 9 aa, Homo Sapiens
RLGDLIEIY

SEQ ID NO: 447738 - protein, 9 aa, Homo Sapiens
LNLKLSKFR

SEQ ID NO: 447739 - protein, 9 aa, Homo Sapiens
TFSGGQIPK

SEQ ID NO: 447740 - protein, 9 aa, Homo Sapiens
GPECLCPFT

SEQ ID NO: 447741 - protein, 9 aa, Homo Sapiens
GNLSTKYDA

SEQ ID NO: 447742 - protein, 9 aa, Homo Sapiens
EVDEMEIKI

SEQ ID NO: 447743 - protein, 9 aa, Homo Sapiens
RCNRYFISS

SEQ ID NO: 447744 - protein, 9 aa, Homo Sapiens
NTEPTTCEL

SEQ ID NO: 447745 - protein, 9 aa, Homo Sapiens
KAIVDKLHN

SEQ ID NO: 447746 - protein, 9 aa, Homo Sapiens
TQYARTQFV

SEQ ID NO: 447747 - protein, 9 aa, Homo Sapiens
ALKKDMKEK

SEQ ID NO: 447748 - protein, 9 aa, Homo Sapiens
LSGFMAPSE

SEQ ID NO: 447749 - protein, 9 aa, Homo Sapiens
QLLCGDMEQ

SEQ ID NO: 447750 - protein, 9 aa, Homo Sapiens
EDYDRRNDK

SEQ ID NO: 447751 - protein, 9 aa, Homo Sapiens
FSCSSSFQK

SEQ ID NO: 447752 - protein, 9 aa, Homo Sapiens
LERLTAPWS

SEQ ID NO: 447753 - protein, 9 aa, Homo Sapiens
KTQHMNNDL

SEQ ID NO: 447754 - protein, 9 aa, Homo Sapiens
DEKLQNEFS

SEQ ID NO: 447755 - protein, 9 aa, Homo Sapiens
TLSLSRNRS

SEQ ID NO: 447756 - protein, 9 aa, Homo Sapiens
PALCFLLLD

SEQ ID NO: 447757 - protein, 9 aa, Homo Sapiens
VTMSSDSQV

SEQ ID NO: 447758 - protein, 9 aa, Homo Sapiens
QGYHQITLL

SEQ ID NO: 447759 - protein, 9 aa, Homo Sapiens
KNQSIFCWE

SEQ ID NO: 447760 - protein, 9 aa, Homo Sapiens
ACAHVENTE

SEQ ID NO: 447761 - protein, 9 aa, Homo Sapiens
PGDTHPNVV

SEQ ID NO: 447762 - protein, 9 aa, Homo Sapiens
GGHNSVILD

SEQ ID NO: 447763 - protein, 9 aa, Homo Sapiens
VKAFSFKSQ

SEQ ID NO: 447764 - protein, 9 aa, Homo Sapiens
DLEKYLGTG

SEQ ID NO: 447765 - protein, 9 aa, Homo Sapiens
AGKNTLVSK

SEQ ID NO: 447766 - protein, 9 aa, Homo Sapiens
PHRPSPKKF

SEQ ID NO: 447767 - protein, 9 aa, Homo Sapiens
IDDIQDLIY

SEQ ID NO: 447768 - protein, 9 aa, Homo Sapiens
AHLIAHQKI

SEQ ID NO: 447769 - protein, 9 aa, Homo Sapiens
YGSLMGVHL

SEQ ID NO: 447770 - protein, 9 aa, Homo Sapiens
GQLYRVDRF

SEQ ID NO: 447771 - protein, 9 aa, Homo Sapiens
ICVGEGLAH

SEQ ID NO: 447772 - protein, 9 aa, Homo Sapiens
SSFAFGPFG

SEQ ID NO: 447773 - protein, 9 aa, Homo Sapiens
YIRLKGQTT

SEQ ID NO: 447774 - protein, 9 aa, Homo Sapiens
DNKFYEWLI

SEQ ID NO: 447775 - protein, 9 aa, Homo Sapiens
NGLSYSPAG

SEQ ID NO: 447776 - protein, 9 aa, Homo Sapiens
ACSPSFFNR

SEQ ID NO: 447777 - protein, 9 aa, Homo Sapiens
EEMEVVVSK

SEQ ID NO: 447778 - protein, 9 aa, Homo Sapiens
RRQNSARNS

SEQ ID NO: 447779 - protein, 9 aa, Homo Sapiens
VGLYNVDAL

SEQ ID NO: 447780 - protein, 9 aa, Homo Sapiens
FLPWTNDPK

SEQ ID NO: 447781 - protein, 9 aa, Homo Sapiens
PFNCTCGIV

SEQ ID NO: 447782 - protein, 9 aa, Homo Sapiens
CGEELEDTN

SEQ ID NO: 447783 - protein, 9 aa, Homo Sapiens
QEGLNKIFE

SEQ ID NO: 447784 - protein, 9 aa, Homo Sapiens
KYVSRTLVV

SEQ ID NO: 447785 - protein, 9 aa, Homo Sapiens
NLVMEPESC

SEQ ID NO: 447786 - protein, 9 aa, Homo Sapiens
NYIESFLAR

SEQ ID NO: 447787 - protein, 9 aa, Homo Sapiens
FVYLGSSEL

SEQ ID NO: 447788 - protein, 9 aa, Homo Sapiens
QKFIKIDQA

SEQ ID NO: 447789 - protein, 9 aa, Homo Sapiens
IFCWEIPVQ

SEQ ID NO: 447790 - protein, 9 aa, Homo Sapiens
VSLCYSYLM

SEQ ID NO: 447791 - protein, 9 aa, Homo Sapiens
AGEFVVTIP

SEQ ID NO: 447792 - protein, 9 aa, Homo Sapiens
GLWVSHRKA

SEQ ID NO: 447793 - protein, 9 aa, Homo Sapiens
LQSKHDATT

SEQ ID NO: 447794 - protein, 9 aa, Homo Sapiens
YNETFQFII

SEQ ID NO: 447795 - protein, 9 aa, Homo Sapiens
LYISPSGEW

SEQ ID NO: 447796 - protein, 9 aa, Homo Sapiens
VNSFIHQHF

SEQ ID NO: 447797 - protein, 9 aa, Homo Sapiens
ALDIFAYAL

SEQ ID NO: 447798 - protein, 9 aa, Homo Sapiens
NQSPSMAPV

SEQ ID NO: 447799 - protein, 9 aa, Homo Sapiens
CIGLSQGNL

SEQ ID NO: 447800 - protein, 9 aa, Homo Sapiens
RSKLPDKFG

SEQ ID NO: 447801 - protein, 9 aa, Homo Sapiens
VSRPHRCEL

SEQ ID NO: 447802 - protein, 9 aa, Homo Sapiens
MLLDRNVPT

SEQ ID NO: 447803 - protein, 9 aa, Homo Sapiens
LSSVSRSDR

SEQ ID NO: 447804 - protein, 9 aa, Homo Sapiens
RSIFRRVLY

SEQ ID NO: 447805 - protein, 9 aa, Homo Sapiens
KVLENIKLN

SEQ ID NO: 447806 - protein, 9 aa, Homo Sapiens
TGIYLPLLS

SEQ ID NO: 447807 - protein, 9 aa, Homo Sapiens
KQHVDSLLS

SEQ ID NO: 447808 - protein, 9 aa, Homo Sapiens
QPKDKNVKK

SEQ ID NO: 447809 - protein, 9 aa, Homo Sapiens
MSSQTYVFQ

SEQ ID NO: 447810 - protein, 9 aa, Homo Sapiens
KIFTEQVVT

SEQ ID NO: 447811 - protein, 9 aa, Homo Sapiens
FMRQQQTIN

SEQ ID NO: 447812 - protein, 9 aa, Homo Sapiens
APEPLKDGI

SEQ ID NO: 447813 - protein, 9 aa, Homo Sapiens
NNFQDIMQK

SEQ ID NO: 447814 - protein, 9 aa, Homo Sapiens
KKNYNMYIF

SEQ ID NO: 447815 - protein, 9 aa, Homo Sapiens
TGESKAGIT

SEQ ID NO: 447816 - protein, 9 aa, Homo Sapiens
KSHNDWVMD

SEQ ID NO: 447817 - protein, 9 aa, Homo Sapiens
SDCGDFPNG

SEQ ID NO: 447818 - protein, 9 aa, Homo Sapiens
PLRRHHSYL

SEQ ID NO: 447819 - protein, 9 aa, Homo Sapiens
TKHKIIHAE

SEQ ID NO: 447820 - protein, 9 aa, Homo Sapiens
VPTADHCPA

SEQ ID NO: 447821 - protein, 9 aa, Homo Sapiens
LQKGVELAH

SEQ ID NO: 447822 - protein, 9 aa, Homo Sapiens
ALVILIPIT

SEQ ID NO: 447823 - protein, 9 aa, Homo Sapiens
LQKQNYLAV

SEQ ID NO: 447824 - protein, 9 aa, Homo Sapiens
VSGTVCLKE

SEQ ID NO: 447825 - protein, 9 aa, Homo Sapiens
FNRSFQTGI

SEQ ID NO: 447826 - protein, 9 aa, Homo Sapiens
DVVTMQYYV

SEQ ID NO: 447827 - protein, 9 aa, Homo Sapiens
MHMFQYSWN

SEQ ID NO: 447828 - protein, 9 aa, Homo Sapiens
DSKTIRNYS

SEQ ID NO: 447829 - protein, 9 aa, Homo Sapiens
RIAAKYQID

SEQ ID NO: 447830 - protein, 9 aa, Homo Sapiens
FFILNFWVT

SEQ ID NO: 447831 - protein, 9 aa, Homo Sapiens
SVGNTFVLH

SEQ ID NO: 447832 - protein, 9 aa, Homo Sapiens
TNNSEERLT

SEQ ID NO: 447833 - protein, 9 aa, Homo Sapiens
PLRNEYFFN

SEQ ID NO: 447834 - protein, 9 aa, Homo Sapiens
ETGRAQSYT

SEQ ID NO: 447835 - protein, 9 aa, Homo Sapiens
SEKGSVGSD

SEQ ID NO: 447836 - protein, 9 aa, Homo Sapiens
VNDNAPELP

SEQ ID NO: 447837 - protein, 9 aa, Homo Sapiens
PGPEKNLPI

SEQ ID NO: 447838 - protein, 9 aa, Homo Sapiens
NSQNPRRPP

SEQ ID NO: 447839 - protein, 9 aa, Homo Sapiens
QAGYGAGVG

SEQ ID NO: 447840 - protein, 9 aa, Homo Sapiens
EINLAIDGA

SEQ ID NO: 447841 - protein, 9 aa, Homo Sapiens
VWDINEAFK

SEQ ID NO: 447842 - protein, 9 aa, Homo Sapiens
NSFGHIFTH

SEQ ID NO: 447843 - protein, 9 aa, Homo Sapiens
IDMERKIDV

SEQ ID NO: 447844 - protein, 9 aa, Homo Sapiens
GRVEILANN

SEQ ID NO: 447845 - protein, 9 aa, Homo Sapiens
DRYLSICRP

SEQ ID NO: 447846 - protein, 9 aa, Homo Sapiens
VMHNMFSHR

SEQ ID NO: 447847 - protein, 9 aa, Homo Sapiens
VGASKLANT

SEQ ID NO: 447848 - protein, 9 aa, Homo Sapiens
HWTTILGMC

SEQ ID NO: 447849 - protein, 9 aa, Homo Sapiens
ESFFAWKKR

SEQ ID NO: 447850 - protein, 9 aa, Homo Sapiens
VGNINNYKK

SEQ ID NO: 447851 - protein, 9 aa, Homo Sapiens
GRLLVRAHL

SEQ ID NO: 447852 - protein, 9 aa, Homo Sapiens
KPHHKNKDR

SEQ ID NO: 447853 - protein, 9 aa, Homo Sapiens
SANLTTHKI

SEQ ID NO: 447854 - protein, 9 aa, Homo Sapiens
DTINVLSKS

SEQ ID NO: 447855 - protein, 9 aa, Homo Sapiens
DMVNKDLLS

SEQ ID NO: 447856 - protein, 9 aa, Homo Sapiens
GLKSKSMNV

SEQ ID NO: 447857 - protein, 9 aa, Homo Sapiens
MEKKTVKRL

SEQ ID NO: 447858 - protein, 9 aa, Homo Sapiens
LEPTQKDIA

SEQ ID NO: 447859 - protein, 9 aa, Homo Sapiens
YETGDFEQT

SEQ ID NO: 447860 - protein, 9 aa, Homo Sapiens
GVEDADEGT

SEQ ID NO: 447861 - protein, 9 aa, Homo Sapiens
HLMGLFESG

SEQ ID NO: 447862 - protein, 9 aa, Homo Sapiens
CKNCRVLGH

SEQ ID NO: 447863 - protein, 9 aa, Homo Sapiens
FMGGVFVVL

SEQ ID NO: 447864 - protein, 9 aa, Homo Sapiens
LTVKPKEAI

SEQ ID NO: 447865 - protein, 9 aa, Homo Sapiens
NKLEAGNGG

SEQ ID NO: 447866 - protein, 9 aa, Homo Sapiens
RSNSVTAAI

SEQ ID NO: 447867 - protein, 9 aa, Homo Sapiens
DRALRWFPI

SEQ ID NO: 447868 - protein, 9 aa, Homo Sapiens
AGVDSGGST

SEQ ID NO: 447869 - protein, 9 aa, Homo Sapiens
EIKMFCTSC

SEQ ID NO: 447870 - protein, 9 aa, Homo Sapiens
NRILSRNVA

SEQ ID NO: 447871 - protein, 9 aa, Homo Sapiens
DLMRQCWWE

SEQ ID NO: 447872 - protein, 9 aa, Homo Sapiens
YRLFSADWK

SEQ ID NO: 447873 - protein, 9 aa, Homo Sapiens
SSSPRLPRQ

SEQ ID NO: 447874 - protein, 9 aa, Homo Sapiens
EKVFTEQAE

SEQ ID NO: 447875 - protein, 9 aa, Homo Sapiens
GDQPNLPYA

SEQ ID NO: 447876 - protein, 9 aa, Homo Sapiens
SKVIGRLRA

SEQ ID NO: 447877 - protein, 9 aa, Homo Sapiens
WQCSLMSYK

SEQ ID NO: 447878 - protein, 9 aa, Homo Sapiens
IQPCNSNIL

SEQ ID NO: 447879 - protein, 9 aa, Homo Sapiens
ANKCSLDQL

SEQ ID NO: 447880 - protein, 9 aa, Homo Sapiens
KYLEVRSPE

SEQ ID NO: 447881 - protein, 9 aa, Homo Sapiens
AEYFVLVAE

SEQ ID NO: 447882 - protein, 9 aa, Homo Sapiens
RHYKDPYSY

SEQ ID NO: 447883 - protein, 9 aa, Homo Sapiens
GKTKNTKKV

SEQ ID NO: 447884 - protein, 9 aa, Homo Sapiens
LEVIRKKLV

SEQ ID NO: 447885 - protein, 9 aa, Homo Sapiens
PNFGWRFGT

SEQ ID NO: 447886 - protein, 9 aa, Homo Sapiens
QEGELAIFP

SEQ ID NO: 447887 - protein, 9 aa, Homo Sapiens
EASDKDFMI

SEQ ID NO: 447888 - protein, 9 aa, Homo Sapiens
IYVNNLAKH

SEQ ID NO: 447889 - protein, 9 aa, Homo Sapiens
SLLPQLLQY

SEQ ID NO: 447890 - protein, 9 aa, Homo Sapiens
KRMSTSVPA

SEQ ID NO: 447891 - protein, 9 aa, Homo Sapiens
QQASLMLFV

SEQ ID NO: 447892 - protein, 9 aa, Homo Sapiens
VNCSNITSN

SEQ ID NO: 447893 - protein, 9 aa, Homo Sapiens
VDLAHTIGR

SEQ ID NO: 447894 - protein, 9 aa, Homo Sapiens
VEREHALAR

SEQ ID NO: 447895 - protein, 9 aa, Homo Sapiens
GHTVGEDTE

SEQ ID NO: 447896 - protein, 9 aa, Homo Sapiens
KKAKYLGFK

SEQ ID NO: 447897 - protein, 9 aa, Homo Sapiens
ADEEAAVVQ

SEQ ID NO: 447898 - protein, 9 aa, Homo Sapiens
KFQAGFINT

SEQ ID NO: 447899 - protein, 9 aa, Homo Sapiens
NINLSMNRI

SEQ ID NO: 447900 - protein, 9 aa, Homo Sapiens
MAEKLVKLT

SEQ ID NO: 447901 - protein, 9 aa, Homo Sapiens
LPAVCKVNR

SEQ ID NO: 447902 - protein, 9 aa, Homo Sapiens
CGDCNSTPS

SEQ ID NO: 447903 - protein, 9 aa, Homo Sapiens
RGFRARQRC

SEQ ID NO: 447904 - protein, 9 aa, Homo Sapiens
DESHHNFIQ

SEQ ID NO: 447905 - protein, 9 aa, Homo Sapiens
NYRKSSHHL

SEQ ID NO: 447906 - protein, 9 aa, Homo Sapiens
PDTRYVVQV

SEQ ID NO: 447907 - protein, 9 aa, Homo Sapiens
SCLKPAQLP

SEQ ID NO: 447908 - protein, 9 aa, Homo Sapiens
DTPEYVKFA

SEQ ID NO: 447909 - protein, 9 aa, Homo Sapiens
GIDTPFSYA

SEQ ID NO: 447910 - protein, 9 aa, Homo Sapiens
VSLPERPEA

SEQ ID NO: 447911 - protein, 9 aa, Homo Sapiens
LLCLLVCWF

SEQ ID NO: 447912 - protein, 9 aa, Homo Sapiens
MDAHACPLN

SEQ ID NO: 447913 - protein, 9 aa, Homo Sapiens
MSNYGCTGG

SEQ ID NO: 447914 - protein, 9 aa, Homo Sapiens
EINLVSFCR

SEQ ID NO: 447915 - protein, 9 aa, Homo Sapiens
ENRLFLEYL

SEQ ID NO: 447916 - protein, 9 aa, Homo Sapiens
PFLILVFVG

SEQ ID NO: 447917 - protein, 9 aa, Homo Sapiens
KKMAYLARK

SEQ ID NO: 447918 - protein, 9 aa, Homo Sapiens
DTKNNNLLH

SEQ ID NO: 447919 - protein, 9 aa, Homo Sapiens
EFPLHQDNS

SEQ ID NO: 447920 - protein, 9 aa, Homo Sapiens
SDESHKQQS

SEQ ID NO: 447921 - protein, 9 aa, Homo Sapiens
FESGDMKYE

SEQ ID NO: 447922 - protein, 9 aa, Homo Sapiens
GNTSMWLAG

SEQ ID NO: 447923 - protein, 9 aa, Homo Sapiens
IIDKPQVIE

SEQ ID NO: 447924 - protein, 9 aa, Homo Sapiens
LTASIFGLF

SEQ ID NO: 447925 - protein, 9 aa, Homo Sapiens
SILANDHMR

SEQ ID NO: 447926 - protein, 9 aa, Homo Sapiens
LIAHQKIHT

SEQ ID NO: 447927 - protein, 9 aa, Homo Sapiens
VKHFCSHLG

SEQ ID NO: 447928 - protein, 9 aa, Homo Sapiens
YRGLTGCLL

SEQ ID NO: 447929 - protein, 9 aa, Homo Sapiens
GRPQIKKDE

SEQ ID NO: 447930 - protein, 9 aa, Homo Sapiens
NISLDQRLE

SEQ ID NO: 447931 - protein, 9 aa, Homo Sapiens
ARWLPADYE

SEQ ID NO: 447932 - protein, 9 aa, Homo Sapiens
PEMSDVGTC

SEQ ID NO: 447933 - protein, 9 aa, Homo Sapiens
QNETPSDPV

SEQ ID NO: 447934 - protein, 9 aa, Homo Sapiens
GRYLSCCVA

SEQ ID NO: 447935 - protein, 9 aa, Homo Sapiens
NFNIIKILN

SEQ ID NO: 447936 - protein, 9 aa, Homo Sapiens
VDCVLKPLS

SEQ ID NO: 447937 - protein, 9 aa, Homo Sapiens
WEKPYERPS

SEQ ID NO: 447938 - protein, 9 aa, Homo Sapiens
YTTSMIRNA

SEQ ID NO: 447939 - protein, 9 aa, Homo Sapiens
KNTLVSKFF

SEQ ID NO: 447940 - protein, 9 aa, Homo Sapiens
ALASECAPH

SEQ ID NO: 447941 - protein, 9 aa, Homo Sapiens
FKVMDYSLL

SEQ ID NO: 447942 - protein, 9 aa, Homo Sapiens
QTPSDNPSL

SEQ ID NO: 447943 - protein, 9 aa, Homo Sapiens
SSSYQEPID

SEQ ID NO: 447944 - protein, 9 aa, Homo Sapiens
KWCHELIIT

SEQ ID NO: 447945 - protein, 9 aa, Homo Sapiens
WTLACTDTW

SEQ ID NO: 447946 - protein, 9 aa, Homo Sapiens
LVHFSPNML

SEQ ID NO: 447947 - protein, 9 aa, Homo Sapiens
TQHMNNDLE

SEQ ID NO: 447948 - protein, 9 aa, Homo Sapiens
LPIPGQFTC

SEQ ID NO: 447949 - protein, 9 aa, Homo Sapiens
KKVTFEYVA

SEQ ID NO: 447950 - protein, 9 aa, Homo Sapiens
RAKKLDYLL

SEQ ID NO: 447951 - protein, 9 aa, Homo Sapiens
YDEGNVFPG

SEQ ID NO: 447952 - protein, 9 aa, Homo Sapiens
VICNMSHTG

SEQ ID NO: 447953 - protein, 9 aa, Homo Sapiens
QENSVCQVH

SEQ ID NO: 447954 - protein, 9 aa, Homo Sapiens
CKVRAQSQD

SEQ ID NO: 447955 - protein, 9 aa, Homo Sapiens
KLKKTSSSE

SEQ ID NO: 447956 - protein, 9 aa, Homo Sapiens
YMLSRPFRK

SEQ ID NO: 447957 - protein, 9 aa, Homo Sapiens
HAKFIMTAD

SEQ ID NO: 447958 - protein, 9 aa, Homo Sapiens
QIHERINTG

SEQ ID NO: 447959 - protein, 9 aa, Homo Sapiens
SHSAIPDVL

SEQ ID NO: 447960 - protein, 9 aa, Homo Sapiens
DTSEKGRFT

SEQ ID NO: 447961 - protein, 9 aa, Homo Sapiens
LSDHQIIHT

SEQ ID NO: 447962 - protein, 9 aa, Homo Sapiens
TDDKYVLRD

SEQ ID NO: 447963 - protein, 9 aa, Homo Sapiens
SILLSQDYT

SEQ ID NO: 447964 - protein, 9 aa, Homo Sapiens
SHTLTAVHD

SEQ ID NO: 447965 - protein, 9 aa, Homo Sapiens
ALRWNTTYH

SEQ ID NO: 447966 - protein, 9 aa, Homo Sapiens
DEEDEILEE

SEQ ID NO: 447967 - protein, 9 aa, Homo Sapiens
IVYIALPGH

SEQ ID NO: 447968 - protein, 9 aa, Homo Sapiens
QLAPELKFQ

SEQ ID NO: 447969 - protein, 9 aa, Homo Sapiens
ILEKGADVN

SEQ ID NO: 447970 - protein, 9 aa, Homo Sapiens
VNNKYGTAL

SEQ ID NO: 447971 - protein, 9 aa, Homo Sapiens
ANIVLLSGA

SEQ ID NO: 447972 - protein, 9 aa, Homo Sapiens
PSIPEIRNT

SEQ ID NO: 447973 - protein, 9 aa, Homo Sapiens
QYTLSSLPL

SEQ ID NO: 447974 - protein, 9 aa, Homo Sapiens
YGGYGGYEN

SEQ ID NO: 447975 - protein, 9 aa, Homo Sapiens
AIHYMCRME

SEQ ID NO: 447976 - protein, 9 aa, Homo Sapiens
ALSAQFEGA

SEQ ID NO: 447977 - protein, 9 aa, Homo Sapiens
YLNKPVQVE

SEQ ID NO: 447978 - protein, 9 aa, Homo Sapiens
PNGNDLYLW

SEQ ID NO: 447979 - protein, 9 aa, Homo Sapiens
SHSDRHNIK

SEQ ID NO: 447980 - protein, 9 aa, Homo Sapiens
TLVDFWAQL

SEQ ID NO: 447981 - protein, 9 aa, Homo Sapiens
GMYKLLCQQ

SEQ ID NO: 447982 - protein, 9 aa, Homo Sapiens
DVLSSVDEE

SEQ ID NO: 447983 - protein, 9 aa, Homo Sapiens
DLYLQLEDV

SEQ ID NO: 447984 - protein, 9 aa, Homo Sapiens
ETSSDIEVE

SEQ ID NO: 447985 - protein, 9 aa, Homo Sapiens
TSRTLLLLV

SEQ ID NO: 447986 - protein, 9 aa, Homo Sapiens
ESENQTDFS

SEQ ID NO: 447987 - protein, 9 aa, Homo Sapiens
LSSTLSLSR

SEQ ID NO: 447988 - protein, 9 aa, Homo Sapiens
REVCEKLHN

SEQ ID NO: 447989 - protein, 9 aa, Homo Sapiens
RSLDKATAA

SEQ ID NO: 447990 - protein, 9 aa, Homo Sapiens
QQPGITGTL

SEQ ID NO: 447991 - protein, 9 aa, Homo Sapiens
QLVESRQTS

SEQ ID NO: 447992 - protein, 9 aa, Homo Sapiens
QLFMLQTYG

SEQ ID NO: 447993 - protein, 9 aa, Homo Sapiens
HHEVVDGEA

SEQ ID NO: 447994 - protein, 9 aa, Homo Sapiens
KNSDVSKAA

SEQ ID NO: 447995 - protein, 9 aa, Homo Sapiens
SDSRHVTVY

SEQ ID NO: 447996 - protein, 9 aa, Homo Sapiens
LPTTKSNYI

SEQ ID NO: 447997 - protein, 9 aa, Homo Sapiens
RVIHWILSI

SEQ ID NO: 447998 - protein, 9 aa, Homo Sapiens
LDEVLGEIP

SEQ ID NO: 447999 - protein, 9 aa, Homo Sapiens
TVDKPTSHS

SEQ ID NO: 448000 - protein, 9 aa, Homo Sapiens
KTDEFNRPV

SEQ ID NO: 448001 - protein, 9 aa, Homo Sapiens
VIISINGQF

SEQ ID NO: 448002 - protein, 9 aa, Homo Sapiens
YHFCEKCLN

SEQ ID NO: 448003 - protein, 9 aa, Homo Sapiens
KFSVWQHID

SEQ ID NO: 448004 - protein, 9 aa, Homo Sapiens
SMHISQVRM

SEQ ID NO: 448005 - protein, 9 aa, Homo Sapiens
STKIVEGTR

SEQ ID NO: 448006 - protein, 9 aa, Homo Sapiens
TLGACQISN

SEQ ID NO: 448007 - protein, 9 aa, Homo Sapiens
RQQKQLEHQ

SEQ ID NO: 448008 - protein, 9 aa, Homo Sapiens
WDIYQYYKL

SEQ ID NO: 448009 - protein, 9 aa, Homo Sapiens
LLACQIRYE

SEQ ID NO: 448010 - protein, 9 aa, Homo Sapiens
EKKAISILS

SEQ ID NO: 448011 - protein, 9 aa, Homo Sapiens
YGFDLNKGI

SEQ ID NO: 448012 - protein, 9 aa, Homo Sapiens
TRYRMIDIE

SEQ ID NO: 448013 - protein, 9 aa, Homo Sapiens
SNRETGTLS

SEQ ID NO: 448014 - protein, 9 aa, Homo Sapiens
TFCMAISIP

SEQ ID NO: 448015 - protein, 9 aa, Homo Sapiens
GTWRSLDKA

SEQ ID NO: 448016 - protein, 9 aa, Homo Sapiens
EVVTLKKDV

SEQ ID NO: 448017 - protein, 9 aa, Homo Sapiens
HTIQALGHI

SEQ ID NO: 448018 - protein, 9 aa, Homo Sapiens
CRTQLQFTA

SEQ ID NO: 448019 - protein, 9 aa, Homo Sapiens
QQQTINMQQ

SEQ ID NO: 448020 - protein, 9 aa, Homo Sapiens
EDSGRIRTE

SEQ ID NO: 448021 - protein, 9 aa, Homo Sapiens
TRITQLAKE

SEQ ID NO: 448022 - protein, 9 aa, Homo Sapiens
ISLIPPVNF

SEQ ID NO: 448023 - protein, 9 aa, Homo Sapiens
TYVALYKCV

SEQ ID NO: 448024 - protein, 9 aa, Homo Sapiens
LKANKGIKE

SEQ ID NO: 448025 - protein, 9 aa, Homo Sapiens
LAFAISWLP

SEQ ID NO: 448026 - protein, 9 aa, Homo Sapiens
QTDIPPHHP

SEQ ID NO: 448027 - protein, 9 aa, Homo Sapiens
GPHTYQSKG

SEQ ID NO: 448028 - protein, 9 aa, Homo Sapiens
DLVTLRTYF

SEQ ID NO: 448029 - protein, 9 aa, Homo Sapiens
VQIHFGRVF

SEQ ID NO: 448030 - protein, 9 aa, Homo Sapiens
LWESLYPEV

SEQ ID NO: 448031 - protein, 9 aa, Homo Sapiens
YQWIDQIRT

SEQ ID NO: 448032 - protein, 9 aa, Homo Sapiens
NDLYLQLED

SEQ ID NO: 448033 - protein, 9 aa, Homo Sapiens
PPLQPSPGM

SEQ ID NO: 448034 - protein, 9 aa, Homo Sapiens
RKTLAERRR

SEQ ID NO: 448035 - protein, 9 aa, Homo Sapiens
KSQPPLPEQ

SEQ ID NO: 448036 - protein, 9 aa, Homo Sapiens
DLCAACLIK

SEQ ID NO: 448037 - protein, 9 aa, Homo Sapiens
EKSNFQNEI

SEQ ID NO: 448038 - protein, 9 aa, Homo Sapiens
HDLLGSQAY

SEQ ID NO: 448039 - protein, 9 aa, Homo Sapiens
SREQIQKHV

SEQ ID NO: 448040 - protein, 9 aa, Homo Sapiens
QNNVPAVRW

SEQ ID NO: 448041 - protein, 9 aa, Homo Sapiens
VNYFISAQK

SEQ ID NO: 448042 - protein, 9 aa, Homo Sapiens
FLVQRLIQT

SEQ ID NO: 448043 - protein, 9 aa, Homo Sapiens
QGKKGEGAH

SEQ ID NO: 448044 - protein, 9 aa, Homo Sapiens
LEDLFNLCS

SEQ ID NO: 448045 - protein, 9 aa, Homo Sapiens
TEGRTRIDK

SEQ ID NO: 448046 - protein, 9 aa, Homo Sapiens
IQILDALKV

SEQ ID NO: 448047 - protein, 9 aa, Homo Sapiens
TERHNCQYP

SEQ ID NO: 448048 - protein, 9 aa, Homo Sapiens
PTIPVASTS

SEQ ID NO: 448049 - protein, 9 aa, Homo Sapiens
GTVPLLVTA

SEQ ID NO: 448050 - protein, 9 aa, Homo Sapiens
IWGLACKGE

SEQ ID NO: 448051 - protein, 9 aa, Homo Sapiens
DQKEMKNYI

SEQ ID NO: 448052 - protein, 9 aa, Homo Sapiens
KLYSLRMSE

SEQ ID NO: 448053 - protein, 9 aa, Homo Sapiens
PLLNIPEST

SEQ ID NO: 448054 - protein, 9 aa, Homo Sapiens
CDCTVHLWD

SEQ ID NO: 448055 - protein, 9 aa, Homo Sapiens
IIHNREKPF

SEQ ID NO: 448056 - protein, 9 aa, Homo Sapiens
VINPVFYFI

SEQ ID NO: 448057 - protein, 9 aa, Homo Sapiens
ENRQQNVRA

SEQ ID NO: 448058 - protein, 9 aa, Homo Sapiens
FWEINWEEL

SEQ ID NO: 448059 - protein, 9 aa, Homo Sapiens
LKEKGQRML

SEQ ID NO: 448060 - protein, 9 aa, Homo Sapiens
EDVLSSVDE

SEQ ID NO: 448061 - protein, 9 aa, Homo Sapiens
QERVIAVHI

SEQ ID NO: 448062 - protein, 9 aa, Homo Sapiens
NEKNYVASI

SEQ ID NO: 448063 - protein, 9 aa, Homo Sapiens
NSVILDPER

SEQ ID NO: 448064 - protein, 9 aa, Homo Sapiens
FNLTKYPDA

SEQ ID NO: 448065 - protein, 9 aa, Homo Sapiens
VTEKEAEER

SEQ ID NO: 448066 - protein, 9 aa, Homo Sapiens
IIHAEEKPF

SEQ ID NO: 448067 - protein, 9 aa, Homo Sapiens
HLISSHSHQ

SEQ ID NO: 448068 - protein, 9 aa, Homo Sapiens
DYMTLKIWS

SEQ ID NO: 448069 - protein, 9 aa, Homo Sapiens
EMEECEKRK

SEQ ID NO: 448070 - protein, 9 aa, Homo Sapiens
GGTPQEGIA

SEQ ID NO: 448071 - protein, 9 aa, Homo Sapiens
GYAKYGLPG

SEQ ID NO: 448072 - protein, 9 aa, Homo Sapiens
LFTGDVFGY

SEQ ID NO: 448073 - protein, 9 aa, Homo Sapiens
SLALYPEFT

SEQ ID NO: 448074 - protein, 9 aa, Homo Sapiens
VLRGSGHQK

SEQ ID NO: 448075 - protein, 9 aa, Homo Sapiens
QSDLTVPNL

SEQ ID NO: 448076 - protein, 9 aa, Homo Sapiens
KNKDATRTP

SEQ ID NO: 448077 - protein, 9 aa, Homo Sapiens
ENSGFCEDI

SEQ ID NO: 448078 - protein, 9 aa, Homo Sapiens
PSTRDRVWL

SEQ ID NO: 448079 - protein, 9 aa, Homo Sapiens
GSIESTVSN

SEQ ID NO: 448080 - protein, 9 aa, Homo Sapiens
AQRRCTSSL

SEQ ID NO: 448081 - protein, 9 aa, Homo Sapiens
MTIDNGVKT

SEQ ID NO: 448082 - protein, 9 aa, Homo Sapiens
FSSGLLCSH

SEQ ID NO: 448083 - protein, 9 aa, Homo Sapiens
DYFSGKKFC

SEQ ID NO: 448084 - protein, 9 aa, Homo Sapiens
LESALITLD

SEQ ID NO: 448085 - protein, 9 aa, Homo Sapiens
HLDKSCKYL

SEQ ID NO: 448086 - protein, 9 aa, Homo Sapiens
VVEAHKIVI

SEQ ID NO: 448087 - protein, 9 aa, Homo Sapiens
PFPVLEHEA

SEQ ID NO: 448088 - protein, 9 aa, Homo Sapiens
HQLVYCKKD

SEQ ID NO: 448089 - protein, 9 aa, Homo Sapiens
TEKDAELDK

SEQ ID NO: 448090 - protein, 9 aa, Homo Sapiens
RYLSICRPL

SEQ ID NO: 448091 - protein, 9 aa, Homo Sapiens
KIDQAWKIL

SEQ ID NO: 448092 - protein, 9 aa, Homo Sapiens
YLGTGLSSI

SEQ ID NO: 448093 - protein, 9 aa, Homo Sapiens
RAQPNHYPN

SEQ ID NO: 448094 - protein, 9 aa, Homo Sapiens
RGFGLEMAS

SEQ ID NO: 448095 - protein, 9 aa, Homo Sapiens
QPRVHVICK

SEQ ID NO: 448096 - protein, 9 aa, Homo Sapiens
KENPHVRCI

SEQ ID NO: 448097 - protein, 9 aa, Homo Sapiens
VHVICKDCG

SEQ ID NO: 448098 - protein, 9 aa, Homo Sapiens
QNKMIFKRL

SEQ ID NO: 448099 - protein, 9 aa, Homo Sapiens
YFEEMRKAG

SEQ ID NO: 448100 - protein, 9 aa, Homo Sapiens
CPACLLLIC

SEQ ID NO: 448101 - protein, 9 aa, Homo Sapiens
NNLKYLEAA

SEQ ID NO: 448102 - protein, 9 aa, Homo Sapiens
FASSALNLT

SEQ ID NO: 448103 - protein, 9 aa, Homo Sapiens
AEKLLCLLV

SEQ ID NO: 448104 - protein, 9 aa, Homo Sapiens
VCEQLIQSR

SEQ ID NO: 448105 - protein, 9 aa, Homo Sapiens
LDMLQQRRN

SEQ ID NO: 448106 - protein, 9 aa, Homo Sapiens
WDVGWQVCK

SEQ ID NO: 448107 - protein, 9 aa, Homo Sapiens
GNGYGNPQN

SEQ ID NO: 448108 - protein, 9 aa, Homo Sapiens
HLTAVILFY

SEQ ID NO: 448109 - protein, 9 aa, Homo Sapiens
LQKYVSRTL

SEQ ID NO: 448110 - protein, 9 aa, Homo Sapiens
MKYFQQCWN

SEQ ID NO: 448111 - protein, 9 aa, Homo Sapiens
KCGHPRAYF

SEQ ID NO: 448112 - protein, 9 aa, Homo Sapiens
SRLSEIWIT

SEQ ID NO: 448113 - protein, 9 aa, Homo Sapiens
VTGVAFPLF

SEQ ID NO: 448114 - protein, 9 aa, Homo Sapiens
FGTLPESAE

SEQ ID NO: 448115 - protein, 9 aa, Homo Sapiens
LLSSLPIYL

SEQ ID NO: 448116 - protein, 9 aa, Homo Sapiens
LSNKTATYD

SEQ ID NO: 448117 - protein, 9 aa, Homo Sapiens
ILVINFSLN

SEQ ID NO: 448118 - protein, 9 aa, Homo Sapiens
EIWITHRSH

SEQ ID NO: 448119 - protein, 9 aa, Homo Sapiens
DHIIFWLIT

SEQ ID NO: 448120 - protein, 9 aa, Homo Sapiens
ESVMRQGCH

SEQ ID NO: 448121 - protein, 9 aa, Homo Sapiens
FENDKLIKE

SEQ ID NO: 448122 - protein, 9 aa, Homo Sapiens
NVIFICSIV

SEQ ID NO: 448123 - protein, 9 aa, Homo Sapiens
GHKKMYGKQ

SEQ ID NO: 448124 - protein, 9 aa, Homo Sapiens
TNFRFGTIP

SEQ ID NO: 448125 - protein, 9 aa, Homo Sapiens
IVLFTEKGE

SEQ ID NO: 448126 - protein, 9 aa, Homo Sapiens
IIRRHTIQT

SEQ ID NO: 448127 - protein, 9 aa, Homo Sapiens
FPCVPEHPG

SEQ ID NO: 448128 - protein, 9 aa, Homo Sapiens
PDFVMEPRQ

SEQ ID NO: 448129 - protein, 9 aa, Homo Sapiens
KAALAEALC

SEQ ID NO: 448130 - protein, 9 aa, Homo Sapiens
GEYKAIMCN

SEQ ID NO: 448131 - protein, 9 aa, Homo Sapiens
LNWKRILIH

SEQ ID NO: 448132 - protein, 9 aa, Homo Sapiens
RCNYKVDKK

SEQ ID NO: 448133 - protein, 9 aa, Homo Sapiens
TLCRMEQAN

SEQ ID NO: 448134 - protein, 9 aa, Homo Sapiens
DSNHFIMEY

SEQ ID NO: 448135 - protein, 9 aa, Homo Sapiens
LTKVLKEKN

SEQ ID NO: 448136 - protein, 9 aa, Homo Sapiens
RKAVAMMFF

SEQ ID NO: 448137 - protein, 9 aa, Homo Sapiens
RISCLLLIT

SEQ ID NO: 448138 - protein, 9 aa, Homo Sapiens
SMAPVAMMG

SEQ ID NO: 448139 - protein, 9 aa, Homo Sapiens
LQAGAGYIL

SEQ ID NO: 448140 - protein, 9 aa, Homo Sapiens
EIYAIGGRR

SEQ ID NO: 448141 - protein, 9 aa, Homo Sapiens
LCADRVSTY

SEQ ID NO: 448142 - protein, 9 aa, Homo Sapiens
ENPLIQRNE

SEQ ID NO: 448143 - protein, 9 aa, Homo Sapiens
NTYREKESV

SEQ ID NO: 448144 - protein, 9 aa, Homo Sapiens
NRPQELCTP

SEQ ID NO: 448145 - protein, 9 aa, Homo Sapiens
LLSLFIGTE

SEQ ID NO: 448146 - protein, 9 aa, Homo Sapiens
AEAVIADLS

SEQ ID NO: 448147 - protein, 9 aa, Homo Sapiens
LPLRRHHSY

SEQ ID NO: 448148 - protein, 9 aa, Homo Sapiens
EKKWLLLCL

SEQ ID NO: 448149 - protein, 9 aa, Homo Sapiens
GPEGNFANM

SEQ ID NO: 448150 - protein, 9 aa, Homo Sapiens
VLDKGGKSC

SEQ ID NO: 448151 - protein, 9 aa, Homo Sapiens
PNLRNVAAL

SEQ ID NO: 448152 - protein, 9 aa, Homo Sapiens
TGTCHICKM

SEQ ID NO: 448153 - protein, 9 aa, Homo Sapiens
TSYFFPHIP

SEQ ID NO: 448154 - protein, 9 aa, Homo Sapiens
VVYNDKEHN

SEQ ID NO: 448155 - protein, 9 aa, Homo Sapiens
CRTEDNNFS

SEQ ID NO: 448156 - protein, 9 aa, Homo Sapiens
YIVISNAYV

SEQ ID NO: 448157 - protein, 9 aa, Homo Sapiens
SQSYIRGWK

SEQ ID NO: 448158 - protein, 9 aa, Homo Sapiens
RFKAHPNQL

SEQ ID NO: 448159 - protein, 9 aa, Homo Sapiens
THKNIHTGE

SEQ ID NO: 448160 - protein, 9 aa, Homo Sapiens
KLKEKYEKL

SEQ ID NO: 448161 - protein, 9 aa, Homo Sapiens
LIEQMVRTD

SEQ ID NO: 448162 - protein, 9 aa, Homo Sapiens
SYLIDTNLF

SEQ ID NO: 448163 - protein, 9 aa, Homo Sapiens
CINSRELLV

SEQ ID NO: 448164 - protein, 9 aa, Homo Sapiens
FSTDNASKR

SEQ ID NO: 448165 - protein, 9 aa, Homo Sapiens
SRHHDQNSV

SEQ ID NO: 448166 - protein, 9 aa, Homo Sapiens
GKICECNHV

SEQ ID NO: 448167 - protein, 9 aa, Homo Sapiens
LAQSDLFWL

SEQ ID NO: 448168 - protein, 9 aa, Homo Sapiens
GSHPEGRFS

SEQ ID NO: 448169 - protein, 9 aa, Homo Sapiens
PQILQKLEP

SEQ ID NO: 448170 - protein, 9 aa, Homo Sapiens
IFLFCLECF

SEQ ID NO: 448171 - protein, 9 aa, Homo Sapiens
AQFEGAERP

SEQ ID NO: 448172 - protein, 9 aa, Homo Sapiens
PMDLFKSRL

SEQ ID NO: 448173 - protein, 9 aa, Homo Sapiens
RQLSQKLTR

SEQ ID NO: 448174 - protein, 9 aa, Homo Sapiens
IAYYAMDFD

SEQ ID NO: 448175 - protein, 9 aa, Homo Sapiens
FASRHHDQN

SEQ ID NO: 448176 - protein, 9 aa, Homo Sapiens
NSSGSYWVS

SEQ ID NO: 448177 - protein, 9 aa, Homo Sapiens
VIRYKQRSK

SEQ ID NO: 448178 - protein, 9 aa, Homo Sapiens
VVLHDNKHD

SEQ ID NO: 448179 - protein, 9 aa, Homo Sapiens
RWSQWSLCG

SEQ ID NO: 448180 - protein, 9 aa, Homo Sapiens
LHKHRITHT

SEQ ID NO: 448181 - protein, 9 aa, Homo Sapiens
AYCENKCGN

SEQ ID NO: 448182 - protein, 9 aa, Homo Sapiens
SKDLTDKIV

SEQ ID NO: 448183 - protein, 9 aa, Homo Sapiens
SPLQVKTGD

SEQ ID NO: 448184 - protein, 9 aa, Homo Sapiens
TIDKQMCTN

SEQ ID NO: 448185 - protein, 9 aa, Homo Sapiens
LVFKPAMPR

SEQ ID NO: 448186 - protein, 9 aa, Homo Sapiens
VNTMVLVVL

SEQ ID NO: 448187 - protein, 9 aa, Homo Sapiens
QGTVEFLVE

SEQ ID NO: 448188 - protein, 9 aa, Homo Sapiens
LILAIRSII

SEQ ID NO: 448189 - protein, 9 aa, Homo Sapiens
QIYEYVEII

SEQ ID NO: 448190 - protein, 9 aa, Homo Sapiens
TSLQNSLLP

SEQ ID NO: 448191 - protein, 9 aa, Homo Sapiens
VIIMADKVL

SEQ ID NO: 448192 - protein, 9 aa, Homo Sapiens
VCKQACQKA

SEQ ID NO: 448193 - protein, 9 aa, Homo Sapiens
PGHRNFIKN

SEQ ID NO: 448194 - protein, 9 aa, Homo Sapiens
IPCYEITSV

SEQ ID NO: 448195 - protein, 9 aa, Homo Sapiens
NEAKITQQE

SEQ ID NO: 448196 - protein, 9 aa, Homo Sapiens
IHRDTKKMF

SEQ ID NO: 448197 - protein, 9 aa, Homo Sapiens
SMMTPPLLG

SEQ ID NO: 448198 - protein, 9 aa, Homo Sapiens
PPSGSARPS

SEQ ID NO: 448199 - protein, 9 aa, Homo Sapiens
QSTFSGGQI

SEQ ID NO: 448200 - protein, 9 aa, Homo Sapiens
DKIYVMYIV

SEQ ID NO: 448201 - protein, 9 aa, Homo Sapiens
NLQPLIQFP

SEQ ID NO: 448202 - protein, 9 aa, Homo Sapiens
RGNNTFGPR

SEQ ID NO: 448203 - protein, 9 aa, Homo Sapiens
PRSGNTSMW

SEQ ID NO: 448204 - protein, 9 aa, Homo Sapiens
VAFACYILV

SEQ ID NO: 448205 - protein, 9 aa, Homo Sapiens
KYEDMHWDL

SEQ ID NO: 448206 - protein, 9 aa, Homo Sapiens
NPSHYRMEC

SEQ ID NO: 448207 - protein, 9 aa, Homo Sapiens
HSKVTETFA

SEQ ID NO: 448208 - protein, 9 aa, Homo Sapiens
SLYFLKLTD

SEQ ID NO: 448209 - protein, 9 aa, Homo Sapiens
FDGIHIANH

SEQ ID NO: 448210 - protein, 9 aa, Homo Sapiens
PFECFFLWE

SEQ ID NO: 448211 - protein, 9 aa, Homo Sapiens
ATLAAERKF

SEQ ID NO: 448212 - protein, 9 aa, Homo Sapiens
LLQTSRLLH

SEQ ID NO: 448213 - protein, 9 aa, Homo Sapiens
YTQQLGRLF

SEQ ID NO: 448214 - protein, 9 aa, Homo Sapiens
HGAVGASKL

SEQ ID NO: 448215 - protein, 9 aa, Homo Sapiens
RFSGPKPNN

SEQ ID NO: 448216 - protein, 9 aa, Homo Sapiens
SLSGQSYGT

SEQ ID NO: 448217 - protein, 9 aa, Homo Sapiens
ALHAFQGYS

SEQ ID NO: 448218 - protein, 9 aa, Homo Sapiens
MLEHREVCD

SEQ ID NO: 448219 - protein, 9 aa, Homo Sapiens
FRLSKMDFK

SEQ ID NO: 448220 - protein, 9 aa, Homo Sapiens
KVVMFVQTE

SEQ ID NO: 448221 - protein, 9 aa, Homo Sapiens
EHRDVIGLD

SEQ ID NO: 448222 - protein, 9 aa, Homo Sapiens
PGFLTTPTG

SEQ ID NO: 448223 - protein, 9 aa, Homo Sapiens
LDCVNLQGV

SEQ ID NO: 448224 - protein, 9 aa, Homo Sapiens
PSDNPSLEQ

SEQ ID NO: 448225 - protein, 9 aa, Homo Sapiens
RDCSHGAED

SEQ ID NO: 448226 - protein, 9 aa, Homo Sapiens
CYGTCQPTQ

SEQ ID NO: 448227 - protein, 9 aa, Homo Sapiens
VVTNFRFGT

SEQ ID NO: 448228 - protein, 9 aa, Homo Sapiens
MIIWLKGVI

SEQ ID NO: 448229 - protein, 9 aa, Homo Sapiens
NTYIPQVPL

SEQ ID NO: 448230 - protein, 9 aa, Homo Sapiens
SRDPENFPF

SEQ ID NO: 448231 - protein, 9 aa, Homo Sapiens
CWCQLLEGG

SEQ ID NO: 448232 - protein, 9 aa, Homo Sapiens
SRCRSAYEP

SEQ ID NO: 448233 - protein, 9 aa, Homo Sapiens
ELANKDETI

SEQ ID NO: 448234 - protein, 9 aa, Homo Sapiens
VPNIQHFWV

SEQ ID NO: 448235 - protein, 9 aa, Homo Sapiens
RPDDDPPPS

SEQ ID NO: 448236 - protein, 9 aa, Homo Sapiens
TPRYSFCCI

SEQ ID NO: 448237 - protein, 9 aa, Homo Sapiens
YLITPHVSR

SEQ ID NO: 448238 - protein, 9 aa, Homo Sapiens
EAKITQQEY

SEQ ID NO: 448239 - protein, 9 aa, Homo Sapiens
EGNMTTVSY

SEQ ID NO: 448240 - protein, 9 aa, Homo Sapiens
SEYEAGSTT

SEQ ID NO: 448241 - protein, 9 aa, Homo Sapiens
PSEHGKCKT

SEQ ID NO: 448242 - protein, 9 aa, Homo Sapiens
TVQNERKLE

SEQ ID NO: 448243 - protein, 9 aa, Homo Sapiens
FGERYLEKC

SEQ ID NO: 448244 - protein, 9 aa, Homo Sapiens
LWTAKALAM

SEQ ID NO: 448245 - protein, 9 aa, Homo Sapiens
HEHKKYFGL

SEQ ID NO: 448246 - protein, 9 aa, Homo Sapiens
TSVPAFLQD

SEQ ID NO: 448247 - protein, 9 aa, Homo Sapiens
NSEISSATQ

SEQ ID NO: 448248 - protein, 9 aa, Homo Sapiens
YGPQTPSEC

SEQ ID NO: 448249 - protein, 9 aa, Homo Sapiens
IKNTHDGLA

SEQ ID NO: 448250 - protein, 9 aa, Homo Sapiens
YLDYRLIDD

SEQ ID NO: 448251 - protein, 9 aa, Homo Sapiens
IIHTGEEPY

SEQ ID NO: 448252 - protein, 9 aa, Homo Sapiens
LLYLFLVER

SEQ ID NO: 448253 - protein, 9 aa, Homo Sapiens
NLEALKKAK

SEQ ID NO: 448254 - protein, 9 aa, Homo Sapiens
KGTQTEGET

SEQ ID NO: 448255 - protein, 9 aa, Homo Sapiens
ILCTKADNA

SEQ ID NO: 448256 - protein, 9 aa, Homo Sapiens
DYKNKGQLS

SEQ ID NO: 448257 - protein, 9 aa, Homo Sapiens
FCTSSLPPL

SEQ ID NO: 448258 - protein, 9 aa, Homo Sapiens
DSQVVDDEL

SEQ ID NO: 448259 - protein, 9 aa, Homo Sapiens
KSLLIQCQF

SEQ ID NO: 448260 - protein, 9 aa, Homo Sapiens
KTHLIAHQR

SEQ ID NO: 448261 - protein, 9 aa, Homo Sapiens
YSVDRPTFL

SEQ ID NO: 448262 - protein, 9 aa, Homo Sapiens
TREIKPSLE

SEQ ID NO: 448263 - protein, 9 aa, Homo Sapiens
ELKEGKAAY

SEQ ID NO: 448264 - protein, 9 aa, Homo Sapiens
RTATDYTKP

SEQ ID NO: 448265 - protein, 9 aa, Homo Sapiens
DKSHFKDMI

SEQ ID NO: 448266 - protein, 9 aa, Homo Sapiens
NMIYYLLLD

SEQ ID NO: 448267 - protein, 9 aa, Homo Sapiens
VPDQLYRLW

SEQ ID NO: 448268 - protein, 9 aa, Homo Sapiens
AQCQKPCKD

SEQ ID NO: 448269 - protein, 9 aa, Homo Sapiens
LLEQFGLNE

SEQ ID NO: 448270 - protein, 9 aa, Homo Sapiens
DKPYIRPGV

SEQ ID NO: 448271 - protein, 9 aa, Homo Sapiens
SLGFQLCCY

SEQ ID NO: 448272 - protein, 9 aa, Homo Sapiens
SDVSANHSS

SEQ ID NO: 448273 - protein, 9 aa, Homo Sapiens
FYPYLDIAL

SEQ ID NO: 448274 - protein, 9 aa, Homo Sapiens
KRQEQEVKM

SEQ ID NO: 448275 - protein, 9 aa, Homo Sapiens
FDQPHQFYV

SEQ ID NO: 448276 - protein, 9 aa, Homo Sapiens
EVSVTWYTN

SEQ ID NO: 448277 - protein, 9 aa, Homo Sapiens
RRFKASKSG

SEQ ID NO: 448278 - protein, 9 aa, Homo Sapiens
TLSSLPLVT

SEQ ID NO: 448279 - protein, 9 aa, Homo Sapiens
EVRDGPFGL

SEQ ID NO: 448280 - protein, 9 aa, Homo Sapiens
PRLLNRIYY

SEQ ID NO: 448281 - protein, 9 aa, Homo Sapiens
QLLGMYRLN

SEQ ID NO: 448282 - protein, 9 aa, Homo Sapiens
GGKDRKIIM

SEQ ID NO: 448283 - protein, 9 aa, Homo Sapiens
DGVRAFLHT

SEQ ID NO: 448284 - protein, 9 aa, Homo Sapiens
SLCCVQTAH

SEQ ID NO: 448285 - protein, 9 aa, Homo Sapiens
EIVLRAVGG

SEQ ID NO: 448286 - protein, 9 aa, Homo Sapiens
CVEDGKTLP

SEQ ID NO: 448287 - protein, 9 aa, Homo Sapiens
GEFRNNKAK

SEQ ID NO: 448288 - protein, 9 aa, Homo Sapiens
AAATEKLEV

SEQ ID NO: 448289 - protein, 9 aa, Homo Sapiens
VLIIMSLAI

SEQ ID NO: 448290 - protein, 9 aa, Homo Sapiens
SCIRDVHEL

SEQ ID NO: 448291 - protein, 9 aa, Homo Sapiens
EDNESPSSG

SEQ ID NO: 448292 - protein, 9 aa, Homo Sapiens
LEIIYSMCK

SEQ ID NO: 448293 - protein, 9 aa, Homo Sapiens
QLHNHVQGL

SEQ ID NO: 448294 - protein, 9 aa, Homo Sapiens
FSKDIVDNY

SEQ ID NO: 448295 - protein, 9 aa, Homo Sapiens
AGISKELIN

SEQ ID NO: 448296 - protein, 9 aa, Homo Sapiens
TKITSYMAI

SEQ ID NO: 448297 - protein, 9 aa, Homo Sapiens
LTPLWAGCL

SEQ ID NO: 448298 - protein, 9 aa, Homo Sapiens
LSENMILLT

SEQ ID NO: 448299 - protein, 9 aa, Homo Sapiens
TTKSNYINS

SEQ ID NO: 448300 - protein, 9 aa, Homo Sapiens
IQVSYARPS

SEQ ID NO: 448301 - protein, 9 aa, Homo Sapiens
ITHQITVQQ

SEQ ID NO: 448302 - protein, 9 aa, Homo Sapiens
PGGNRLHNQ

SEQ ID NO: 448303 - protein, 9 aa, Homo Sapiens
PQRRLPANK

SEQ ID NO: 448304 - protein, 9 aa, Homo Sapiens
QAGFINTTF

SEQ ID NO: 448305 - protein, 9 aa, Homo Sapiens
KRQLYDNKP

SEQ ID NO: 448306 - protein, 9 aa, Homo Sapiens
FIFLFCLEC

SEQ ID NO: 448307 - protein, 9 aa, Homo Sapiens
KTANKCSLD

SEQ ID NO: 448308 - protein, 9 aa, Homo Sapiens
KTLKDDLLL

SEQ ID NO: 448309 - protein, 9 aa, Homo Sapiens
QLLEHRDVI

SEQ ID NO: 448310 - protein, 9 aa, Homo Sapiens
EPSFFATHP

SEQ ID NO: 448311 - protein, 9 aa, Homo Sapiens
MSSTVTFNT

SEQ ID NO: 448312 - protein, 9 aa, Homo Sapiens
RKLQENLGN

SEQ ID NO: 448313 - protein, 9 aa, Homo Sapiens
ASKKIKYLG

SEQ ID NO: 448314 - protein, 9 aa, Homo Sapiens
QFPGHNELF

SEQ ID NO: 448315 - protein, 9 aa, Homo Sapiens
TANFPTIPV

SEQ ID NO: 448316 - protein, 9 aa, Homo Sapiens
LEECMANVG

SEQ ID NO: 448317 - protein, 9 aa, Homo Sapiens
PNGLKAEIG

SEQ ID NO: 448318 - protein, 9 aa, Homo Sapiens
QINRPGWKR

SEQ ID NO: 448319 - protein, 9 aa, Homo Sapiens
LMLHFRCNW

SEQ ID NO: 448320 - protein, 9 aa, Homo Sapiens
TEENLFKRL

SEQ ID NO: 448321 - protein, 9 aa, Homo Sapiens
IISIVGFLS

SEQ ID NO: 448322 - protein, 9 aa, Homo Sapiens
HCEFCGEFF

SEQ ID NO: 448323 - protein, 9 aa, Homo Sapiens
CKDCGDDLS

SEQ ID NO: 448324 - protein, 9 aa, Homo Sapiens
AAHEEICTA

SEQ ID NO: 448325 - protein, 9 aa, Homo Sapiens
KKPTIPTEK

SEQ ID NO: 448326 - protein, 9 aa, Homo Sapiens
QHGPFLADF

SEQ ID NO: 448327 - protein, 9 aa, Homo Sapiens
LSGEVSGRI

SEQ ID NO: 448328 - protein, 9 aa, Homo Sapiens
HAQGKSLKE

SEQ ID NO: 448329 - protein, 9 aa, Homo Sapiens
KLIKNQFGL

SEQ ID NO: 448330 - protein, 9 aa, Homo Sapiens
NTVALWESL

SEQ ID NO: 448331 - protein, 9 aa, Homo Sapiens
NNLSRKRPG

SEQ ID NO: 448332 - protein, 9 aa, Homo Sapiens
ISQEQEKIN

SEQ ID NO: 448333 - protein, 9 aa, Homo Sapiens
LKASESFLL

SEQ ID NO: 448334 - protein, 9 aa, Homo Sapiens
HVQIHFGRV

SEQ ID NO: 448335 - protein, 9 aa, Homo Sapiens
KRILQDYHN

SEQ ID NO: 448336 - protein, 9 aa, Homo Sapiens
GLYIHFRHL

SEQ ID NO: 448337 - protein, 9 aa, Homo Sapiens
NTDVCLIGE

SEQ ID NO: 448338 - protein, 9 aa, Homo Sapiens
RGQLPGDNN

SEQ ID NO: 448339 - protein, 9 aa, Homo Sapiens
ISKAQEQTP

SEQ ID NO: 448340 - protein, 9 aa, Homo Sapiens
RKLSLKSHN

SEQ ID NO: 448341 - protein, 9 aa, Homo Sapiens
SGHLTDEGQ

SEQ ID NO: 448342 - protein, 9 aa, Homo Sapiens
SLPCVAGCS

SEQ ID NO: 448343 - protein, 9 aa, Homo Sapiens
CQPNYPPKS

SEQ ID NO: 448344 - protein, 9 aa, Homo Sapiens
MVNATWDGK

SEQ ID NO: 448345 - protein, 9 aa, Homo Sapiens
NALSHNVNM

SEQ ID NO: 448346 - protein, 9 aa, Homo Sapiens
FLLTGPPQV

SEQ ID NO: 448347 - protein, 9 aa, Homo Sapiens
RIVYITERH

SEQ ID NO: 448348 - protein, 9 aa, Homo Sapiens
LIIQLFMLQ

SEQ ID NO: 448349 - protein, 9 aa, Homo Sapiens
AYLHVQGVI

SEQ ID NO: 448350 - protein, 9 aa, Homo Sapiens
VQVFFVFVT

SEQ ID NO: 448351 - protein, 9 aa, Homo Sapiens
ARTTINLSR

SEQ ID NO: 448352 - protein, 9 aa, Homo Sapiens
IVICAVSHV

SEQ ID NO: 448353 - protein, 9 aa, Homo Sapiens
KLICDIFRK

SEQ ID NO: 448354 - protein, 9 aa, Homo Sapiens
NPNTFQPWE

SEQ ID NO: 448355 - protein, 9 aa, Homo Sapiens
FTQNNILLV

SEQ ID NO: 448356 - protein, 9 aa, Homo Sapiens
CDYFLNCSA

SEQ ID NO: 448357 - protein, 9 aa, Homo Sapiens
QTEGETEVK

SEQ ID NO: 448358 - protein, 9 aa, Homo Sapiens
ECGKSFSVL

SEQ ID NO: 448359 - protein, 9 aa, Homo Sapiens
MLKELTEIL

SEQ ID NO: 448360 - protein, 8 aa, Homo Sapiens
NYVGQLAE

SEQ ID NO: 448361 - protein, 9 aa, Homo Sapiens
AYSPGQTVY

SEQ ID NO: 448362 - protein, 9 aa, Homo Sapiens
ALSVAYCFT

SEQ ID NO: 448363 - protein, 9 aa, Homo Sapiens
WSLNIRKEM

SEQ ID NO: 448364 - protein, 9 aa, Homo Sapiens
SLTIYLVVA

SEQ ID NO: 448365 - protein, 9 aa, Homo Sapiens
LHTYSHEVS

SEQ ID NO: 448366 - protein, 9 aa, Homo Sapiens
LVEYGFHEY

SEQ ID NO: 448367 - protein, 9 aa, Homo Sapiens
ALQAILTFH

SEQ ID NO: 448368 - protein, 9 aa, Homo Sapiens
AKQKFYLRQ

SEQ ID NO: 448369 - protein, 9 aa, Homo Sapiens
HSQVLFERP

SEQ ID NO: 448370 - protein, 9 aa, Homo Sapiens
KYKLAEKTD

SEQ ID NO: 448371 - protein, 9 aa, Homo Sapiens
LLCSKRHRG

SEQ ID NO: 448372 - protein, 9 aa, Homo Sapiens
LFKIIGVKS

SEQ ID NO: 448373 - protein, 9 aa, Homo Sapiens
GRQRAFSTC

SEQ ID NO: 448374 - protein, 9 aa, Homo Sapiens
FQIVPKFKK

SEQ ID NO: 448375 - protein, 9 aa, Homo Sapiens
DSDILDSQV

SEQ ID NO: 448376 - protein, 9 aa, Homo Sapiens
ENYRLEKED

SEQ ID NO: 448377 - protein, 9 aa, Homo Sapiens
FIHEDLNTF

SEQ ID NO: 448378 - protein, 9 aa, Homo Sapiens
GCDACSESR

SEQ ID NO: 448379 - protein, 9 aa, Homo Sapiens
IRDTYQVLA

SEQ ID NO: 448380 - protein, 9 aa, Homo Sapiens
TMIVDCKNK

SEQ ID NO: 448381 - protein, 9 aa, Homo Sapiens
AATPVHHRR

SEQ ID NO: 448382 - protein, 9 aa, Homo Sapiens
RTTILSSLP

SEQ ID NO: 448383 - protein, 9 aa, Homo Sapiens
CMAAIKESW

SEQ ID NO: 448384 - protein, 9 aa, Homo Sapiens
VAFPLFMDN

SEQ ID NO: 448385 - protein, 9 aa, Homo Sapiens
DLLYYSTMN

SEQ ID NO: 448386 - protein, 9 aa, Homo Sapiens
IFSTTRYIK

SEQ ID NO: 448387 - protein, 9 aa, Homo Sapiens
EDLNTFKAV

SEQ ID NO: 448388 - protein, 9 aa, Homo Sapiens
HPDYVGDGL

SEQ ID NO: 448389 - protein, 9 aa, Homo Sapiens
EVVPGVVSK

SEQ ID NO: 448390 - protein, 9 aa, Homo Sapiens
IRSASGGST

SEQ ID NO: 448391 - protein, 9 aa, Homo Sapiens
SPMSQRHVL

SEQ ID NO: 448392 - protein, 9 aa, Homo Sapiens
RMHQQQQVQ

SEQ ID NO: 448393 - protein, 9 aa, Homo Sapiens
EKPYGCLQC

SEQ ID NO: 448394 - protein, 9 aa, Homo Sapiens
FTAMTLYGE

SEQ ID NO: 448395 - protein, 9 aa, Homo Sapiens
TLSDDWQLP

SEQ ID NO: 448396 - protein, 9 aa, Homo Sapiens
LDELYIELD

SEQ ID NO: 448397 - protein, 9 aa, Homo Sapiens
DIAMQKDSH

SEQ ID NO: 448398 - protein, 9 aa, Homo Sapiens
VCRARHRLL

SEQ ID NO: 448399 - protein, 9 aa, Homo Sapiens
KCIPEFIRK

SEQ ID NO: 448400 - protein, 9 aa, Homo Sapiens
ESLRTAMSN

SEQ ID NO: 448401 - protein, 9 aa, Homo Sapiens
KRFQCKESM

SEQ ID NO: 448402 - protein, 9 aa, Homo Sapiens
TDIIKLFNE

SEQ ID NO: 448403 - protein, 9 aa, Homo Sapiens
KYKKEDQEK

SEQ ID NO: 448404 - protein, 9 aa, Homo Sapiens
FKAVCNSPV

SEQ ID NO: 448405 - protein, 9 aa, Homo Sapiens
VVLSNTLNL

SEQ ID NO: 448406 - protein, 9 aa, Homo Sapiens
EKDNIKMKP

SEQ ID NO: 448407 - protein, 9 aa, Homo Sapiens
VALLFLLQC

SEQ ID NO: 448408 - protein, 9 aa, Homo Sapiens
CAVSGLLVL

SEQ ID NO: 448409 - protein, 9 aa, Homo Sapiens
CIEDVGSLL

SEQ ID NO: 448410 - protein, 9 aa, Homo Sapiens
DELFTSLWD

SEQ ID NO: 448411 - protein, 9 aa, Homo Sapiens
RYMLSRPFR

SEQ ID NO: 448412 - protein, 9 aa, Homo Sapiens
GMTIDNGVK

SEQ ID NO: 448413 - protein, 9 aa, Homo Sapiens
CLERVVLTC

SEQ ID NO: 448414 - protein, 9 aa, Homo Sapiens
EVVSRNCLA

SEQ ID NO: 448415 - protein, 9 aa, Homo Sapiens
IEKYQGSQI

SEQ ID NO: 448416 - protein, 9 aa, Homo Sapiens
WAHSQQRQN

SEQ ID NO: 448417 - protein, 9 aa, Homo Sapiens
RSCLLSCNN

SEQ ID NO: 448418 - protein, 9 aa, Homo Sapiens
FEFGLELDD

SEQ ID NO: 448419 - protein, 9 aa, Homo Sapiens
NCIVHQDLK

SEQ ID NO: 448420 - protein, 9 aa, Homo Sapiens
SNSSDTPST

SEQ ID NO: 448421 - protein, 9 aa, Homo Sapiens
QPNNVPVKQ

SEQ ID NO: 448422 - protein, 9 aa, Homo Sapiens
QAGVQFGLK

SEQ ID NO: 448423 - protein, 9 aa, Homo Sapiens
HVNRGPAYG

SEQ ID NO: 448424 - protein, 9 aa, Homo Sapiens
ENINHSCIS

SEQ ID NO: 448425 - protein, 9 aa, Homo Sapiens
LHAKQKFYL

SEQ ID NO: 448426 - protein, 9 aa, Homo Sapiens
LLLICRCNI

SEQ ID NO: 448427 - protein, 9 aa, Homo Sapiens
CTIMCVPTF

SEQ ID NO: 448428 - protein, 9 aa, Homo Sapiens
NLFKREYPI

SEQ ID NO: 448429 - protein, 9 aa, Homo Sapiens
ELLLINERG

SEQ ID NO: 448430 - protein, 9 aa, Homo Sapiens
DGALPQQCS

SEQ ID NO: 448431 - protein, 9 aa, Homo Sapiens
RRFANSSNR

SEQ ID NO: 448432 - protein, 9 aa, Homo Sapiens
QETEAIQEE

SEQ ID NO: 448433 - protein, 9 aa, Homo Sapiens
IPGLPGDKG

SEQ ID NO: 448434 - protein, 9 aa, Homo Sapiens
PRPYGGRAA

SEQ ID NO: 448435 - protein, 9 aa, Homo Sapiens
TLHSSVNYK

SEQ ID NO: 448436 - protein, 9 aa, Homo Sapiens
RHLPQGSLS

SEQ ID NO: 448437 - protein, 9 aa, Homo Sapiens
GLFESGDMK

SEQ ID NO: 448438 - protein, 9 aa, Homo Sapiens
WTLPKNFHS

SEQ ID NO: 448439 - protein, 9 aa, Homo Sapiens
YFSTKYKVM

SEQ ID NO: 448440 - protein, 9 aa, Homo Sapiens
RLFMIIWLK

SEQ ID NO: 448441 - protein, 9 aa, Homo Sapiens
SSSLTEHKI

SEQ ID NO: 448442 - protein, 9 aa, Homo Sapiens
RPSYNGYFV

SEQ ID NO: 448443 - protein, 9 aa, Homo Sapiens
AAGNYIESF

SEQ ID NO: 448444 - protein, 9 aa, Homo Sapiens
GREPASCKD

SEQ ID NO: 448445 - protein, 9 aa, Homo Sapiens
DEEFEKDNI

SEQ ID NO: 448446 - protein, 9 aa, Homo Sapiens
KYKSLCMFK

SEQ ID NO: 448447 - protein, 9 aa, Homo Sapiens
NHTGCRHTP

SEQ ID NO: 448448 - protein, 9 aa, Homo Sapiens
FKADERDFP

SEQ ID NO: 448449 - protein, 9 aa, Homo Sapiens
LSRQTRPIL

SEQ ID NO: 448450 - protein, 9 aa, Homo Sapiens
HFSPNMLGS

SEQ ID NO: 448451 - protein, 9 aa, Homo Sapiens
IFQELRLVH

SEQ ID NO: 448452 - protein, 9 aa, Homo Sapiens
HILVHVTKE

SEQ ID NO: 448453 - protein, 9 aa, Homo Sapiens
FSSIRRHWN

SEQ ID NO: 448454 - protein, 9 aa, Homo Sapiens
GSSSPRLPR

SEQ ID NO: 448455 - protein, 9 aa, Homo Sapiens
IIKRHPPQI

SEQ ID NO: 448456 - protein, 9 aa, Homo Sapiens
ESCKPGVGL

SEQ ID NO: 448457 - protein, 9 aa, Homo Sapiens
KKRKMYDQH

SEQ ID NO: 448458 - protein, 9 aa, Homo Sapiens
QRLNLQRRA

SEQ ID NO: 448459 - protein, 9 aa, Homo Sapiens
LNMKLGRPQ

SEQ ID NO: 448460 - protein, 9 aa, Homo Sapiens
PRLPRQNSG

SEQ ID NO: 448461 - protein, 9 aa, Homo Sapiens
RLPVTTWQI

SEQ ID NO: 448462 - protein, 9 aa, Homo Sapiens
MLSNIIAFY

SEQ ID NO: 448463 - protein, 9 aa, Homo Sapiens
RDMYVTATH

SEQ ID NO: 448464 - protein, 9 aa, Homo Sapiens
LTKHTDELT

SEQ ID NO: 448465 - protein, 9 aa, Homo Sapiens
GMPSKLDSE

SEQ ID NO: 448466 - protein, 9 aa, Homo Sapiens
GTSCPHYFL

SEQ ID NO: 448467 - protein, 9 aa, Homo Sapiens
QMEVINLQC

SEQ ID NO: 448468 - protein, 9 aa, Homo Sapiens
TSLIRHWRH

SEQ ID NO: 448469 - protein, 9 aa, Homo Sapiens
SDSGLSDHH

SEQ ID NO: 448470 - protein, 9 aa, Homo Sapiens
LVNTHNLLT

SEQ ID NO: 448471 - protein, 9 aa, Homo Sapiens
ALHCRELKN

SEQ ID NO: 448472 - protein, 9 aa, Homo Sapiens
HTVHVAFVG

SEQ ID NO: 448473 - protein, 9 aa, Homo Sapiens
TFNFLPWTN

SEQ ID NO: 448474 - protein, 9 aa, Homo Sapiens
IESGHLTDE

SEQ ID NO: 448475 - protein, 9 aa, Homo Sapiens
FRKLLPIVP

SEQ ID NO: 448476 - protein, 9 aa, Homo Sapiens
KFVDLAQES

SEQ ID NO: 448477 - protein, 9 aa, Homo Sapiens
PEANNSISV

SEQ ID NO: 448478 - protein, 9 aa, Homo Sapiens
YGDKPSDSS

SEQ ID NO: 448479 - protein, 9 aa, Homo Sapiens
NRWKSLQMC

SEQ ID NO: 448480 - protein, 9 aa, Homo Sapiens
KQEAQMELP

SEQ ID NO: 448481 - protein, 9 aa, Homo Sapiens
NVAPLKLWW

SEQ ID NO: 448482 - protein, 9 aa, Homo Sapiens
CHHEVVDGE

SEQ ID NO: 448483 - protein, 9 aa, Homo Sapiens
ELQSTLGDD

SEQ ID NO: 448484 - protein, 9 aa, Homo Sapiens
LHTYLLSAN

SEQ ID NO: 448485 - protein, 9 aa, Homo Sapiens
KVGDKSPSA

SEQ ID NO: 448486 - protein, 9 aa, Homo Sapiens
CGGFQDSLN

SEQ ID NO: 448487 - protein, 9 aa, Homo Sapiens
IVTYFYNPL

SEQ ID NO: 448488 - protein, 9 aa, Homo Sapiens
VLRARIRNV

SEQ ID NO: 448489 - protein, 9 aa, Homo Sapiens
HVCKQACQK

SEQ ID NO: 448490 - protein, 9 aa, Homo Sapiens
TALNASFLT

SEQ ID NO: 448491 - protein, 9 aa, Homo Sapiens
WWWARLSLC

SEQ ID NO: 448492 - protein, 9 aa, Homo Sapiens
MFCTSCLFS

SEQ ID NO: 448493 - protein, 9 aa, Homo Sapiens
TRDMYVTAT

SEQ ID NO: 448494 - protein, 9 aa, Homo Sapiens
LLVKRSYNK

SEQ ID NO: 448495 - protein, 9 aa, Homo Sapiens
MLHFRCNWI

SEQ ID NO: 448496 - protein, 9 aa, Homo Sapiens
DLYLWPAYN

SEQ ID NO: 448497 - protein, 9 aa, Homo Sapiens
NGDDYSSGN

SEQ ID NO: 448498 - protein, 9 aa, Homo Sapiens
KDKNVKKCS

SEQ ID NO: 448499 - protein, 9 aa, Homo Sapiens
ELQHTRKRE

SEQ ID NO: 448500 - protein, 9 aa, Homo Sapiens
KRRTVSLQV

SEQ ID NO: 448501 - protein, 9 aa, Homo Sapiens
KKAWDDLNK

SEQ ID NO: 448502 - protein, 9 aa, Homo Sapiens
YETVCMAAI

SEQ ID NO: 448503 - protein, 9 aa, Homo Sapiens
RPITHLPCP

SEQ ID NO: 448504 - protein, 9 aa, Homo Sapiens
PVKEDSYPT

SEQ ID NO: 448505 - protein, 9 aa, Homo Sapiens
CLEKYHLQL

SEQ ID NO: 448506 - protein, 9 aa, Homo Sapiens
FQGAPMSSY

SEQ ID NO: 448507 - protein, 9 aa, Homo Sapiens
GGGAEDSAE

SEQ ID NO: 448508 - protein, 9 aa, Homo Sapiens
QNKVSDLCY

SEQ ID NO: 448509 - protein, 9 aa, Homo Sapiens
KTFCVKTSL

SEQ ID NO: 448510 - protein, 9 aa, Homo Sapiens
KVFFVDVGN

SEQ ID NO: 448511 - protein, 9 aa, Homo Sapiens
RKEMEECEK

SEQ ID NO: 448512 - protein, 9 aa, Homo Sapiens
KFRLSKMDF

SEQ ID NO: 448513 - protein, 9 aa, Homo Sapiens
KKGEGAHNQ

SEQ ID NO: 448514 - protein, 9 aa, Homo Sapiens
TVYHKGRFF

SEQ ID NO: 448515 - protein, 9 aa, Homo Sapiens
TAQEKDYLI

SEQ ID NO: 448516 - protein, 9 aa, Homo Sapiens
DLIPKYEIA

SEQ ID NO: 448517 - protein, 9 aa, Homo Sapiens
FLQFAPDNK

SEQ ID NO: 448518 - protein, 9 aa, Homo Sapiens
ARRRILLDM

SEQ ID NO: 448519 - protein, 9 aa, Homo Sapiens
IIEKNKDAT

SEQ ID NO: 448520 - protein, 9 aa, Homo Sapiens
ENYHDHGLL

SEQ ID NO: 448521 - protein, 9 aa, Homo Sapiens
GKWLAAFHN

SEQ ID NO: 448522 - protein, 9 aa, Homo Sapiens
LDDSDTIVC

SEQ ID NO: 448523 - protein, 9 aa, Homo Sapiens
KPPRSATAT

SEQ ID NO: 448524 - protein, 9 aa, Homo Sapiens
KITGHLYAC

SEQ ID NO: 448525 - protein, 9 aa, Homo Sapiens
VRESLEDQN

SEQ ID NO: 448526 - protein, 9 aa, Homo Sapiens
AVANPGLIY

SEQ ID NO: 448527 - protein, 9 aa, Homo Sapiens
EASKSVSST

SEQ ID NO: 448528 - protein, 9 aa, Homo Sapiens
QALGHIAVA

SEQ ID NO: 448529 - protein, 9 aa, Homo Sapiens
DMVNGQRGL

SEQ ID NO: 448530 - protein, 9 aa, Homo Sapiens
KMGSAEDSK

SEQ ID NO: 448531 - protein, 9 aa, Homo Sapiens
LKAYDQDAH

SEQ ID NO: 448532 - protein, 9 aa, Homo Sapiens
TLHQLYLQM

SEQ ID NO: 448533 - protein, 9 aa, Homo Sapiens
ALRWFPITL

SEQ ID NO: 448534 - protein, 9 aa, Homo Sapiens
WCANYIHSG

SEQ ID NO: 448535 - protein, 9 aa, Homo Sapiens
VEQLNLMQK

SEQ ID NO: 448536 - protein, 9 aa, Homo Sapiens
TTCAINKVL

SEQ ID NO: 448537 - protein, 9 aa, Homo Sapiens
NELSGGVGA

SEQ ID NO: 448538 - protein, 9 aa, Homo Sapiens
KKKYDFPLN

SEQ ID NO: 448539 - protein, 9 aa, Homo Sapiens
FDTTCTPLA

SEQ ID NO: 448540 - protein, 9 aa, Homo Sapiens
PWYKLFSEL

SEQ ID NO: 448541 - protein, 9 aa, Homo Sapiens
GSYWVSLPG

SEQ ID NO: 448542 - protein, 9 aa, Homo Sapiens
TKVQETGYI

SEQ ID NO: 448543 - protein, 9 aa, Homo Sapiens
VQRLTCKFL

SEQ ID NO: 448544 - protein, 9 aa, Homo Sapiens
NITPKHTMK

SEQ ID NO: 448545 - protein, 9 aa, Homo Sapiens
RHVCNIHNK

SEQ ID NO: 448546 - protein, 9 aa, Homo Sapiens
REEERSRHK

SEQ ID NO: 448547 - protein, 9 aa, Homo Sapiens
LATLDTLTK

SEQ ID NO: 448548 - protein, 9 aa, Homo Sapiens
KINHTQKKC

SEQ ID NO: 448549 - protein, 9 aa, Homo Sapiens
DMLRQMSDL

SEQ ID NO: 448550 - protein, 9 aa, Homo Sapiens
NFQNEIKLL

SEQ ID NO: 448551 - protein, 9 aa, Homo Sapiens
DYRLIDDHT

SEQ ID NO: 448552 - protein, 9 aa, Homo Sapiens
SLYEVVHRI

SEQ ID NO: 448553 - protein, 9 aa, Homo Sapiens
SQENFDAFM

SEQ ID NO: 448554 - protein, 9 aa, Homo Sapiens
NASQVPLQE

SEQ ID NO: 448555 - protein, 9 aa, Homo Sapiens
PQDTYYPEA

SEQ ID NO: 448556 - protein, 9 aa, Homo Sapiens
FVNTMVLVV

SEQ ID NO: 448557 - protein, 9 aa, Homo Sapiens
NHLLRPLGI

SEQ ID NO: 448558 - protein, 9 aa, Homo Sapiens
GLPAPVVSW

SEQ ID NO: 448559 - protein, 9 aa, Homo Sapiens
AAAEAVIAD

SEQ ID NO: 448560 - protein, 9 aa, Homo Sapiens
RVDTGYCYS

SEQ ID NO: 448561 - protein, 9 aa, Homo Sapiens
MYYREEELL

SEQ ID NO: 448562 - protein, 9 aa, Homo Sapiens
MDLVKIHLM

SEQ ID NO: 448563 - protein, 9 aa, Homo Sapiens
IELSQEEWK

SEQ ID NO: 448564 - protein, 9 aa, Homo Sapiens
CIISGWGAV

SEQ ID NO: 448565 - protein, 9 aa, Homo Sapiens
TIFTQKIFT

SEQ ID NO: 448566 - protein, 9 aa, Homo Sapiens
VCNRFKLPP

SEQ ID NO: 448567 - protein, 9 aa, Homo Sapiens
VFRAICRPT

SEQ ID NO: 448568 - protein, 9 aa, Homo Sapiens
FFTRVRSYT

SEQ ID NO: 448569 - protein, 9 aa, Homo Sapiens
LDMQPYMYQ

SEQ ID NO: 448570 - protein, 9 aa, Homo Sapiens
GKEVDNVFT

SEQ ID NO: 448571 - protein, 9 aa, Homo Sapiens
QKHSHQYSY

SEQ ID NO: 448572 - protein, 9 aa, Homo Sapiens
LNNNHLRKL

SEQ ID NO: 448573 - protein, 9 aa, Homo Sapiens
AVVCYICGC

SEQ ID NO: 448574 - protein, 9 aa, Homo Sapiens
SPGWPPPTA

SEQ ID NO: 448575 - protein, 9 aa, Homo Sapiens
GLLCSHCRH

SEQ ID NO: 448576 - protein, 9 aa, Homo Sapiens
CDKFSVWQH

SEQ ID NO: 448577 - protein, 9 aa, Homo Sapiens
KGGLKHITK

SEQ ID NO: 448578 - protein, 9 aa, Homo Sapiens
FSVLLRRVW

SEQ ID NO: 448579 - protein, 9 aa, Homo Sapiens
LPFSIIAGF

SEQ ID NO: 448580 - protein, 9 aa, Homo Sapiens
YLIHEGMCI

SEQ ID NO: 448581 - protein, 9 aa, Homo Sapiens
AMIDEGETN

SEQ ID NO: 448582 - protein, 9 aa, Homo Sapiens
IRAGKKELI

SEQ ID NO: 448583 - protein, 9 aa, Homo Sapiens
QILCIQRTI

SEQ ID NO: 448584 - protein, 9 aa, Homo Sapiens
LEAKHLKKM

SEQ ID NO: 448585 - protein, 9 aa, Homo Sapiens
DKNLSLTPS

SEQ ID NO: 448586 - protein, 9 aa, Homo Sapiens
CFKITTANV

SEQ ID NO: 448587 - protein, 9 aa, Homo Sapiens
MKDALDLGK

SEQ ID NO: 448588 - protein, 9 aa, Homo Sapiens
YTPRRGDVA

SEQ ID NO: 448589 - protein, 9 aa, Homo Sapiens
RSSRKNTKL

SEQ ID NO: 448590 - protein, 9 aa, Homo Sapiens
KTGDKYFFG

SEQ ID NO: 448591 - protein, 9 aa, Homo Sapiens
VDKKPPVRQ

SEQ ID NO: 448592 - protein, 9 aa, Homo Sapiens
YKMEDGKVI

SEQ ID NO: 448593 - protein, 9 aa, Homo Sapiens
SNQIKAKPV

SEQ ID NO: 448594 - protein, 9 aa, Homo Sapiens
IILLIFLDT

SEQ ID NO: 448595 - protein, 9 aa, Homo Sapiens
SSLGKSSDV

SEQ ID NO: 448596 - protein, 9 aa, Homo Sapiens
KAIQSLLES

SEQ ID NO: 448597 - protein, 9 aa, Homo Sapiens
AKHGLSYKV

SEQ ID NO: 448598 - protein, 9 aa, Homo Sapiens
VSYTEILKV

SEQ ID NO: 448599 - protein, 9 aa, Homo Sapiens
RGKIQIWEI

SEQ ID NO: 448600 - protein, 9 aa, Homo Sapiens
SPDSKSKKR

SEQ ID NO: 448601 - protein, 9 aa, Homo Sapiens
LEFLFFLLS

SEQ ID NO: 448602 - protein, 9 aa, Homo Sapiens
QTKQRRPLK

SEQ ID NO: 448603 - protein, 9 aa, Homo Sapiens
TKIRDIQAN

SEQ ID NO: 448604 - protein, 9 aa, Homo Sapiens
SSLLMTWAL

SEQ ID NO: 448605 - protein, 9 aa, Homo Sapiens
EHCKAHTEK

SEQ ID NO: 448606 - protein, 9 aa, Homo Sapiens
THPEKKYCK

SEQ ID NO: 448607 - protein, 9 aa, Homo Sapiens
APGDLLQRL

SEQ ID NO: 448608 - protein, 9 aa, Homo Sapiens
GGNGLFFSA

SEQ ID NO: 448609 - protein, 9 aa, Homo Sapiens
YKVLREILT

SEQ ID NO: 448610 - protein, 9 aa, Homo Sapiens
YQSKGLLPR

SEQ ID NO: 448611 - protein, 9 aa, Homo Sapiens
YDFPQEFYT

SEQ ID NO: 448612 - protein, 9 aa, Homo Sapiens
YDPDVVVTN

SEQ ID NO: 448613 - protein, 9 aa, Homo Sapiens
LNEHRQIHT

SEQ ID NO: 448614 - protein, 9 aa, Homo Sapiens
ISICINSRE

SEQ ID NO: 448615 - protein, 9 aa, Homo Sapiens
VVCHTLATR

SEQ ID NO: 448616 - protein, 9 aa, Homo Sapiens
LFESGDMKY

SEQ ID NO: 448617 - protein, 9 aa, Homo Sapiens
ADPKVAFGY

SEQ ID NO: 448618 - protein, 9 aa, Homo Sapiens
TEKTVFLVL

SEQ ID NO: 448619 - protein, 9 aa, Homo Sapiens
VAVASVLIL

SEQ ID NO: 448620 - protein, 9 aa, Homo Sapiens
YVMYIVCKN

SEQ ID NO: 448621 - protein, 9 aa, Homo Sapiens
SSRKNTKLK

SEQ ID NO: 448622 - protein, 9 aa, Homo Sapiens
VVVTNFRFG

SEQ ID NO: 448623 - protein, 9 aa, Homo Sapiens
QEKSNQIKA

SEQ ID NO: 448624 - protein, 9 aa, Homo Sapiens
KHTFLQDCE

SEQ ID NO: 448625 - protein, 9 aa, Homo Sapiens
PSPGMTRRG

SEQ ID NO: 448626 - protein, 9 aa, Homo Sapiens
KQAQHQIKE

SEQ ID NO: 448627 - protein, 9 aa, Homo Sapiens
WLVRFNTIF

SEQ ID NO: 448628 - protein, 9 aa, Homo Sapiens
PLKDCIWMC

SEQ ID NO: 448629 - protein, 9 aa, Homo Sapiens
YFYHNERGV

SEQ ID NO: 448630 - protein, 9 aa, Homo Sapiens
AVNVICDHP

SEQ ID NO: 448631 - protein, 9 aa, Homo Sapiens
LLVPAFQVV

SEQ ID NO: 448632 - protein, 9 aa, Homo Sapiens
QQIEKEKET

SEQ ID NO: 448633 - protein, 9 aa, Homo Sapiens
IGDTFHLSF

SEQ ID NO: 448634 - protein, 9 aa, Homo Sapiens
KCTYQFMMQ

SEQ ID NO: 448635 - protein, 9 aa, Homo Sapiens
NLNIVLAKN

SEQ ID NO: 448636 - protein, 9 aa, Homo Sapiens
LSISQSVHI

SEQ ID NO: 448637 - protein, 9 aa, Homo Sapiens
YHNPLMEME

SEQ ID NO: 448638 - protein, 9 aa, Homo Sapiens
LHSQLPTLV

SEQ ID NO: 448639 - protein, 9 aa, Homo Sapiens
LRIYYEKEP

SEQ ID NO: 448640 - protein, 9 aa, Homo Sapiens
FLHQRQEII

SEQ ID NO: 448641 - protein, 9 aa, Homo Sapiens
CFHENEIVL

SEQ ID NO: 448642 - protein, 9 aa, Homo Sapiens
SNHHRVHTE

SEQ ID NO: 448643 - protein, 9 aa, Homo Sapiens
HTVKFLTAI

SEQ ID NO: 448644 - protein, 9 aa, Homo Sapiens
GNNCDLPSR

SEQ ID NO: 448645 - protein, 9 aa, Homo Sapiens
MDGHHYRCV

SEQ ID NO: 448646 - protein, 9 aa, Homo Sapiens
EQKDKASEK

SEQ ID NO: 448647 - protein, 9 aa, Homo Sapiens
SPKVNNLNP

SEQ ID NO: 448648 - protein, 9 aa, Homo Sapiens
LLMDIVATD

SEQ ID NO: 448649 - protein, 9 aa, Homo Sapiens
AIIRPRDLE

SEQ ID NO: 448650 - protein, 9 aa, Homo Sapiens
PTDYDNEEF

SEQ ID NO: 448651 - protein, 9 aa, Homo Sapiens
AEQGLEMLR

SEQ ID NO: 448652 - protein, 9 aa, Homo Sapiens
QSLLSTHYT

SEQ ID NO: 448653 - protein, 9 aa, Homo Sapiens
ALLSKAKEY

SEQ ID NO: 448654 - protein, 9 aa, Homo Sapiens
ECHLCGKSF

SEQ ID NO: 448655 - protein, 9 aa, Homo Sapiens
SSHKAISDK

SEQ ID NO: 448656 - protein, 9 aa, Homo Sapiens
KQFMTFKEK

SEQ ID NO: 448657 - protein, 9 aa, Homo Sapiens
SCVAGSALS

SEQ ID NO: 448658 - protein, 9 aa, Homo Sapiens
LTSVYYACI

SEQ ID NO: 448659 - protein, 9 aa, Homo Sapiens
GEKPYGCLQ

SEQ ID NO: 448660 - protein, 9 aa, Homo Sapiens
KKLQVSRHT

SEQ ID NO: 448661 - protein, 9 aa, Homo Sapiens
LSNIIAFYD

SEQ ID NO: 448662 - protein, 9 aa, Homo Sapiens
IQYIRISPD

SEQ ID NO: 448663 - protein, 9 aa, Homo Sapiens
GASKLANTA

SEQ ID NO: 448664 - protein, 9 aa, Homo Sapiens
IIHSGQKPY

SEQ ID NO: 448665 - protein, 9 aa, Homo Sapiens
WLHKFNDVV

SEQ ID NO: 448666 - protein, 9 aa, Homo Sapiens
GVVCHTLAT

SEQ ID NO: 448667 - protein, 9 aa, Homo Sapiens
DFYITGGRA

SEQ ID NO: 448668 - protein, 9 aa, Homo Sapiens
LEAQCQKPC

SEQ ID NO: 448669 - protein, 9 aa, Homo Sapiens
GALVISLQH

SEQ ID NO: 448670 - protein, 9 aa, Homo Sapiens
GPDFLIDGG

SEQ ID NO: 448671 - protein, 9 aa, Homo Sapiens
CPTDPSHSL

SEQ ID NO: 448672 - protein, 9 aa, Homo Sapiens
QSPESASEG

SEQ ID NO: 448673 - protein, 9 aa, Homo Sapiens
HFWVLFDIT

SEQ ID NO: 448674 - protein, 9 aa, Homo Sapiens
MSSTNLELQ

SEQ ID NO: 448675 - protein, 9 aa, Homo Sapiens
KEQIYYSLD

SEQ ID NO: 448676 - protein, 9 aa, Homo Sapiens
EIVPVGEVL

SEQ ID NO: 448677 - protein, 9 aa, Homo Sapiens
LSRSKLPDK

SEQ ID NO: 448678 - protein, 9 aa, Homo Sapiens
APSLIPLIF

SEQ ID NO: 448679 - protein, 9 aa, Homo Sapiens
SLKVWAHGG

SEQ ID NO: 448680 - protein, 9 aa, Homo Sapiens
GDSLNWAFG

SEQ ID NO: 448681 - protein, 9 aa, Homo Sapiens
EATSLGIRP

SEQ ID NO: 448682 - protein, 9 aa, Homo Sapiens
NLGCLPLLS

SEQ ID NO: 448683 - protein, 9 aa, Homo Sapiens
ARAHGHLWA

SEQ ID NO: 448684 - protein, 9 aa, Homo Sapiens
VQLLKKFIN

SEQ ID NO: 448685 - protein, 9 aa, Homo Sapiens
CLDTLPEFR

SEQ ID NO: 448686 - protein, 9 aa, Homo Sapiens
QRVQKPEAE

SEQ ID NO: 448687 - protein, 9 aa, Homo Sapiens
SCQMVVEKG

SEQ ID NO: 448688 - protein, 9 aa, Homo Sapiens
KDAVMSCAV

SEQ ID NO: 448689 - protein, 9 aa, Homo Sapiens
CNVCLAPII

SEQ ID NO: 448690 - protein, 9 aa, Homo Sapiens
SIICDISNK

SEQ ID NO: 448691 - protein, 9 aa, Homo Sapiens
RRESSPPYS

SEQ ID NO: 448692 - protein, 9 aa, Homo Sapiens
EVKMWRQEE

SEQ ID NO: 448693 - protein, 9 aa, Homo Sapiens
NSGFCEDIQ

SEQ ID NO: 448694 - protein, 9 aa, Homo Sapiens
RDQMDKSAV

SEQ ID NO: 448695 - protein, 9 aa, Homo Sapiens
IHEIIHTGE

SEQ ID NO: 448696 - protein, 9 aa, Homo Sapiens
IHENQSRSA

SEQ ID NO: 448697 - protein, 9 aa, Homo Sapiens
NLPASPLMN

SEQ ID NO: 448698 - protein, 9 aa, Homo Sapiens
DSANWRASI

SEQ ID NO: 448699 - protein, 9 aa, Homo Sapiens
LIVMINTDK

SEQ ID NO: 448700 - protein, 9 aa, Homo Sapiens
EKITYLPTV

SEQ ID NO: 448701 - protein, 9 aa, Homo Sapiens
LKHSKRRWA

SEQ ID NO: 448702 - protein, 9 aa, Homo Sapiens
AENRLFLEY

SEQ ID NO: 448703 - protein, 9 aa, Homo Sapiens
AYLIHEGMC

SEQ ID NO: 448704 - protein, 9 aa, Homo Sapiens
NTCPDGHCD

SEQ ID NO: 448705 - protein, 9 aa, Homo Sapiens
RLASITRQL

SEQ ID NO: 448706 - protein, 9 aa, Homo Sapiens
VNKPQKNRI

SEQ ID NO: 448707 - protein, 9 aa, Homo Sapiens
SNYGCTGGE

SEQ ID NO: 448708 - protein, 9 aa, Homo Sapiens
FCLVFKPAM

SEQ ID NO: 448709 - protein, 9 aa, Homo Sapiens
PQRKTSWSR

SEQ ID NO: 448710 - protein, 9 aa, Homo Sapiens
EFIQSFDEI

SEQ ID NO: 448711 - protein, 9 aa, Homo Sapiens
YFVLGRDKV

SEQ ID NO: 448712 - protein, 9 aa, Homo Sapiens
GAMGIHENQ

SEQ ID NO: 448713 - protein, 9 aa, Homo Sapiens
GQLRAAYNL

SEQ ID NO: 448714 - protein, 9 aa, Homo Sapiens
DGSLDACKG

SEQ ID NO: 448715 - protein, 9 aa, Homo Sapiens
SNRKKHMHV

SEQ ID NO: 448716 - protein, 9 aa, Homo Sapiens
SRIIADRFI

SEQ ID NO: 448717 - protein, 9 aa, Homo Sapiens
EMLFAVALL

SEQ ID NO: 448718 - protein, 9 aa, Homo Sapiens
MDFTKIESN

SEQ ID NO: 448719 - protein, 9 aa, Homo Sapiens
VSGLFRSLH

SEQ ID NO: 448720 - protein, 9 aa, Homo Sapiens
YLTRPHLEG

SEQ ID NO: 448721 - protein, 9 aa, Homo Sapiens
QTTSQSLLE

SEQ ID NO: 448722 - protein, 9 aa, Homo Sapiens
SHCGLVGMR

SEQ ID NO: 448723 - protein, 9 aa, Homo Sapiens
QRNHTVDKS

SEQ ID NO: 448724 - protein, 9 aa, Homo Sapiens
IKEGNLSTK

SEQ ID NO: 448725 - protein, 9 aa, Homo Sapiens
FNWWHYEHQ

SEQ ID NO: 448726 - protein, 9 aa, Homo Sapiens
AISDKRVQP

SEQ ID NO: 448727 - protein, 9 aa, Homo Sapiens
ETNNLEQIL

SEQ ID NO: 448728 - protein, 9 aa, Homo Sapiens
SGLLCSHCR

SEQ ID NO: 448729 - protein, 9 aa, Homo Sapiens
CYLVCRKDP

SEQ ID NO: 448730 - protein, 9 aa, Homo Sapiens
CVDFFHLVP

SEQ ID NO: 448731 - protein, 9 aa, Homo Sapiens
LYACQVAQR

SEQ ID NO: 448732 - protein, 9 aa, Homo Sapiens
PALVSSIPV

SEQ ID NO: 448733 - protein, 9 aa, Homo Sapiens
EDERLGCDS

SEQ ID NO: 448734 - protein, 9 aa, Homo Sapiens
PSPAKDEHN

SEQ ID NO: 448735 - protein, 9 aa, Homo Sapiens
INEGRMSGT

SEQ ID NO: 448736 - protein, 9 aa, Homo Sapiens
DGGLEAFDY

SEQ ID NO: 448737 - protein, 9 aa, Homo Sapiens
RAKDINQDV

SEQ ID NO: 448738 - protein, 9 aa, Homo Sapiens
VNLDTMCAD

SEQ ID NO: 448739 - protein, 9 aa, Homo Sapiens
AVGLKNISV

SEQ ID NO: 448740 - protein, 9 aa, Homo Sapiens
QLDIHDLLG

SEQ ID NO: 448741 - protein, 9 aa, Homo Sapiens
YRTEFQNCE

SEQ ID NO: 448742 - protein, 9 aa, Homo Sapiens
FKEEEREYN

SEQ ID NO: 448743 - protein, 9 aa, Homo Sapiens
FVFNDILVY

SEQ ID NO: 448744 - protein, 9 aa, Homo Sapiens
ADETELALV

SEQ ID NO: 448745 - protein, 9 aa, Homo Sapiens
SGYNNHDRR

SEQ ID NO: 448746 - protein, 9 aa, Homo Sapiens
HKWCHELII

SEQ ID NO: 448747 - protein, 9 aa, Homo Sapiens
DLKHTSDNL

SEQ ID NO: 448748 - protein, 9 aa, Homo Sapiens
VLTNITVYC

SEQ ID NO: 448749 - protein, 9 aa, Homo Sapiens
YQPGAMGIH

SEQ ID NO: 448750 - protein, 9 aa, Homo Sapiens
TVWAINQYR

SEQ ID NO: 448751 - protein, 9 aa, Homo Sapiens
CLRLECPIR

SEQ ID NO: 448752 - protein, 9 aa, Homo Sapiens
SVSYLIDTN

SEQ ID NO: 448753 - protein, 9 aa, Homo Sapiens
NKQKRPRSH

SEQ ID NO: 448754 - protein, 9 aa, Homo Sapiens
VAESCKPGV

SEQ ID NO: 448755 - protein, 9 aa, Homo Sapiens
LTECIEGGT

SEQ ID NO: 448756 - protein, 9 aa, Homo Sapiens
TPDGDFHRG

SEQ ID NO: 448757 - protein, 9 aa, Homo Sapiens
VGVALSRGH

SEQ ID NO: 448758 - protein, 9 aa, Homo Sapiens
MSSYVSINS

SEQ ID NO: 448759 - protein, 9 aa, Homo Sapiens
FPDGMDNDI

SEQ ID NO: 448760 - protein, 9 aa, Homo Sapiens
GNLIFGYLV

SEQ ID NO: 448761 - protein, 9 aa, Homo Sapiens
NICKIRFNS

SEQ ID NO: 448762 - protein, 9 aa, Homo Sapiens
SQRCEVRPK

SEQ ID NO: 448763 - protein, 9 aa, Homo Sapiens
RILTTHKII

SEQ ID NO: 448764 - protein, 9 aa, Homo Sapiens
QHNKIHSVE

SEQ ID NO: 448765 - protein, 9 aa, Homo Sapiens
ENFDAFMKA

SEQ ID NO: 448766 - protein, 9 aa, Homo Sapiens
LESCIRDVH

SEQ ID NO: 448767 - protein, 9 aa, Homo Sapiens
VSVTWYTNS

SEQ ID NO: 448768 - protein, 9 aa, Homo Sapiens
TPWTRPSNL

SEQ ID NO: 448769 - protein, 9 aa, Homo Sapiens
YGCTGGEAS

SEQ ID NO: 448770 - protein, 9 aa, Homo Sapiens
TTLSYFAFF

SEQ ID NO: 448771 - protein, 9 aa, Homo Sapiens
WKLNDQLFP

SEQ ID NO: 448772 - protein, 9 aa, Homo Sapiens
HVKMESGGG

SEQ ID NO: 448773 - protein, 9 aa, Homo Sapiens
YDNYLNPVM

SEQ ID NO: 448774 - protein, 9 aa, Homo Sapiens
IKELQDLAT

SEQ ID NO: 448775 - protein, 9 aa, Homo Sapiens
HGTLTKLNF

SEQ ID NO: 448776 - protein, 9 aa, Homo Sapiens
GNHKNSVLS

SEQ ID NO: 448777 - protein, 9 aa, Homo Sapiens
HQQLKWLIC

SEQ ID NO: 448778 - protein, 9 aa, Homo Sapiens
FGLYDQMSM

SEQ ID NO: 448779 - protein, 9 aa, Homo Sapiens
ECGRLLVRA

SEQ ID NO: 448780 - protein, 9 aa, Homo Sapiens
EKDAELDKL

SEQ ID NO: 448781 - protein, 9 aa, Homo Sapiens
CRHTPVVRL

SEQ ID NO: 448782 - protein, 9 aa, Homo Sapiens
GLSREIYST

SEQ ID NO: 448783 - protein, 9 aa, Homo Sapiens
RMRVSYLVK

SEQ ID NO: 448784 - protein, 9 aa, Homo Sapiens
DLQKSVYMI

SEQ ID NO: 448785 - protein, 9 aa, Homo Sapiens
LQVKTGDKY

SEQ ID NO: 448786 - protein, 9 aa, Homo Sapiens
QQLLKHKCW

SEQ ID NO: 448787 - protein, 9 aa, Homo Sapiens
KYHLQLYKK

SEQ ID NO: 448788 - protein, 9 aa, Homo Sapiens
KKPILDSVT

SEQ ID NO: 448789 - protein, 9 aa, Homo Sapiens
ISDLNADKK

SEQ ID NO: 448790 - protein, 9 aa, Homo Sapiens
GFTLSENMI

SEQ ID NO: 448791 - protein, 9 aa, Homo Sapiens
LSNRPSFNQ

SEQ ID NO: 448792 - protein, 9 aa, Homo Sapiens
KYYFECSLS

SEQ ID NO: 448793 - protein, 9 aa, Homo Sapiens
NYASEVVLA

SEQ ID NO: 448794 - protein, 9 aa, Homo Sapiens
DIKANIVFL

SEQ ID NO: 448795 - protein, 9 aa, Homo Sapiens
AGKTKNTKK

SEQ ID NO: 448796 - protein, 9 aa, Homo Sapiens
DLQKVLHLE

SEQ ID NO: 448797 - protein, 9 aa, Homo Sapiens
ITQDFWENL

SEQ ID NO: 448798 - protein, 9 aa, Homo Sapiens
GPNKTLLLY

SEQ ID NO: 448799 - protein, 9 aa, Homo Sapiens
GASTAASRD

SEQ ID NO: 448800 - protein, 9 aa, Homo Sapiens
QYILRTDNP

SEQ ID NO: 448801 - protein, 9 aa, Homo Sapiens
QLINEQGGV

SEQ ID NO: 448802 - protein, 9 aa, Homo Sapiens
DGLQLEYDM

SEQ ID NO: 448803 - protein, 9 aa, Homo Sapiens
TEAQKRRKQ

SEQ ID NO: 448804 - protein, 9 aa, Homo Sapiens
QGMIFLSDG

SEQ ID NO: 448805 - protein, 9 aa, Homo Sapiens
EELAVFMKE

SEQ ID NO: 448806 - protein, 9 aa, Homo Sapiens
EDRKKGKKE

SEQ ID NO: 448807 - protein, 9 aa, Homo Sapiens
GCLECDPKC

SEQ ID NO: 448808 - protein, 9 aa, Homo Sapiens
KLIVMINTD

SEQ ID NO: 448809 - protein, 9 aa, Homo Sapiens
TSANERKII

SEQ ID NO: 448810 - protein, 9 aa, Homo Sapiens
PNGSVETNN

SEQ ID NO: 448811 - protein, 9 aa, Homo Sapiens
MQLAAIIRP

SEQ ID NO: 448812 - protein, 9 aa, Homo Sapiens
LARIKIFEG

SEQ ID NO: 448813 - protein, 9 aa, Homo Sapiens
VEFLVELHK

SEQ ID NO: 448814 - protein, 9 aa, Homo Sapiens
HTPIFCTSS

SEQ ID NO: 448815 - protein, 9 aa, Homo Sapiens
YQYVLQSII

SEQ ID NO: 448816 - protein, 9 aa, Homo Sapiens
YEQDDDHRE

SEQ ID NO: 448817 - protein, 9 aa, Homo Sapiens
SEWFEMETR

SEQ ID NO: 448818 - protein, 9 aa, Homo Sapiens
SQTELGHKK

SEQ ID NO: 448819 - protein, 9 aa, Homo Sapiens
MNNISRYLT

SEQ ID NO: 448820 - protein, 9 aa, Homo Sapiens
EREMAKVVA

SEQ ID NO: 448821 - protein, 9 aa, Homo Sapiens
GSLPATANM

SEQ ID NO: 448822 - protein, 9 aa, Homo Sapiens
EIIEKNKDA

SEQ ID NO: 448823 - protein, 9 aa, Homo Sapiens
NVFVFQGAG

SEQ ID NO: 448824 - protein, 9 aa, Homo Sapiens
RYSDDDSSM

SEQ ID NO: 448825 - protein, 9 aa, Homo Sapiens
ESEKNNSGA

SEQ ID NO: 448826 - protein, 9 aa, Homo Sapiens
ATLGVLMGS

SEQ ID NO: 448827 - protein, 9 aa, Homo Sapiens
QEDEEGSEH

SEQ ID NO: 448828 - protein, 9 aa, Homo Sapiens
SDIKGNTIV

SEQ ID NO: 448829 - protein, 9 aa, Homo Sapiens
TAAIKNTDD

SEQ ID NO: 448830 - protein, 9 aa, Homo Sapiens
HLEDGLHYV

SEQ ID NO: 448831 - protein, 9 aa, Homo Sapiens
YQPRVHVIC

SEQ ID NO: 448832 - protein, 9 aa, Homo Sapiens
HNPLMEMEP

SEQ ID NO: 448833 - protein, 9 aa, Homo Sapiens
LEAWLEKSA

SEQ ID NO: 448834 - protein, 9 aa, Homo Sapiens
HGAEDEVSS

SEQ ID NO: 448835 - protein, 9 aa, Homo Sapiens
REITLNQSE

SEQ ID NO: 448836 - protein, 9 aa, Homo Sapiens
PLFWEINWE

SEQ ID NO: 448837 - protein, 9 aa, Homo Sapiens
SPLMNNFDT

SEQ ID NO: 448838 - protein, 9 aa, Homo Sapiens
NVACMTFDQ

SEQ ID NO: 448839 - protein, 9 aa, Homo Sapiens
NCSGLFPST

SEQ ID NO: 448840 - protein, 9 aa, Homo Sapiens
QKKIQEEET

SEQ ID NO: 448841 - protein, 9 aa, Homo Sapiens
IIKARAGNN

SEQ ID NO: 448842 - protein, 9 aa, Homo Sapiens
GLNKIFEHK

SEQ ID NO: 448843 - protein, 9 aa, Homo Sapiens
GACRTQLQF

SEQ ID NO: 448844 - protein, 9 aa, Homo Sapiens
ILLYGRFSS

SEQ ID NO: 448845 - protein, 9 aa, Homo Sapiens
GPTPIQALQ

SEQ ID NO: 448846 - protein, 9 aa, Homo Sapiens
VLYMRSCRV

SEQ ID NO: 448847 - protein, 9 aa, Homo Sapiens
YLANMPNLD

SEQ ID NO: 448848 - protein, 9 aa, Homo Sapiens
HAFQGYSNN

SEQ ID NO: 448849 - protein, 9 aa, Homo Sapiens
LFKREYPIT

SEQ ID NO: 448850 - protein, 9 aa, Homo Sapiens
RNGVVLHDN

SEQ ID NO: 448851 - protein, 9 aa, Homo Sapiens
YNHLLSVGC

SEQ ID NO: 448852 - protein, 9 aa, Homo Sapiens
SWHSDLIFH

SEQ ID NO: 448853 - protein, 9 aa, Homo Sapiens
ACSKCFAAL

SEQ ID NO: 448854 - protein, 9 aa, Homo Sapiens
FLVLMFAVS

SEQ ID NO: 448855 - protein, 9 aa, Homo Sapiens
GNLELEDME

SEQ ID NO: 448856 - protein, 9 aa, Homo Sapiens
FACYILVGC

SEQ ID NO: 448857 - protein, 9 aa, Homo Sapiens
FIQIISKGG

SEQ ID NO: 448858 - protein, 9 aa, Homo Sapiens
PAISPLTFL

SEQ ID NO: 448859 - protein, 9 aa, Homo Sapiens
TYSIVIGFW

SEQ ID NO: 448860 - protein, 9 aa, Homo Sapiens
EEETTLQDW

SEQ ID NO: 448861 - protein, 9 aa, Homo Sapiens
HIYQIMWAN

SEQ ID NO: 448862 - protein, 9 aa, Homo Sapiens
NEVLELTGT

SEQ ID NO: 448863 - protein, 9 aa, Homo Sapiens
VPTVWAINQ

SEQ ID NO: 448864 - protein, 9 aa, Homo Sapiens
PSTLNNSKC

SEQ ID NO: 448865 - protein, 9 aa, Homo Sapiens
WISNHYLDF

SEQ ID NO: 448866 - protein, 9 aa, Homo Sapiens
MTKKFKMES

SEQ ID NO: 448867 - protein, 9 aa, Homo Sapiens
KMQKYTSAG

SEQ ID NO: 448868 - protein, 9 aa, Homo Sapiens
KNTAAIKNT

SEQ ID NO: 448869 - protein, 9 aa, Homo Sapiens
VIPNLLSRN

SEQ ID NO: 448870 - protein, 9 aa, Homo Sapiens
NAITIYGVT

SEQ ID NO: 448871 - protein, 9 aa, Homo Sapiens
VKAASPGHC

SEQ ID NO: 448872 - protein, 9 aa, Homo Sapiens
IPFSQMILF

SEQ ID NO: 448873 - protein, 9 aa, Homo Sapiens
GVTGLRNVG

SEQ ID NO: 448874 - protein, 9 aa, Homo Sapiens
TTVSYLKTQ

SEQ ID NO: 448875 - protein, 9 aa, Homo Sapiens
SLVLFYHTR

SEQ ID NO: 448876 - protein, 9 aa, Homo Sapiens
LVLGTFILF

SEQ ID NO: 448877 - protein, 9 aa, Homo Sapiens
VANAVVVES

SEQ ID NO: 448878 - protein, 9 aa, Homo Sapiens
VGWRKFLLV

SEQ ID NO: 448879 - protein, 9 aa, Homo Sapiens
NTRADKEGD

SEQ ID NO: 448880 - protein, 9 aa, Homo Sapiens
LRKLPSTFG

SEQ ID NO: 448881 - protein, 9 aa, Homo Sapiens
TQNNILLVH

SEQ ID NO: 448882 - protein, 9 aa, Homo Sapiens
RLDKLHFMQ

SEQ ID NO: 448883 - protein, 9 aa, Homo Sapiens
SGPLTRRRT

SEQ ID NO: 448884 - protein, 9 aa, Homo Sapiens
RFDSYSIEK

SEQ ID NO: 448885 - protein, 9 aa, Homo Sapiens
EKWCCDYFL

SEQ ID NO: 448886 - protein, 9 aa, Homo Sapiens
VQKVVTEMG

SEQ ID NO: 448887 - protein, 9 aa, Homo Sapiens
IIAICWVLL

SEQ ID NO: 448888 - protein, 9 aa, Homo Sapiens
GPGAELATV

SEQ ID NO: 448889 - protein, 9 aa, Homo Sapiens
FIGALQKRS

SEQ ID NO: 448890 - protein, 9 aa, Homo Sapiens
KIRMQLQAD

SEQ ID NO: 448891 - protein, 9 aa, Homo Sapiens
LGLGDTEEI

SEQ ID NO: 448892 - protein, 9 aa, Homo Sapiens
PLALHTQSS

SEQ ID NO: 448893 - protein, 9 aa, Homo Sapiens
NDLRLRQEL

SEQ ID NO: 448894 - protein, 9 aa, Homo Sapiens
AFNVRIERD

SEQ ID NO: 448895 - protein, 9 aa, Homo Sapiens
EKGRFTSVG

SEQ ID NO: 448896 - protein, 9 aa, Homo Sapiens
RMWRDVTRR

SEQ ID NO: 448897 - protein, 9 aa, Homo Sapiens
IVDCKNKTT

SEQ ID NO: 448898 - protein, 9 aa, Homo Sapiens
GDGFLFPKN

SEQ ID NO: 448899 - protein, 9 aa, Homo Sapiens
GDGLSGVCN

SEQ ID NO: 448900 - protein, 9 aa, Homo Sapiens
KVICNMSHT

SEQ ID NO: 448901 - protein, 9 aa, Homo Sapiens
KSILDNLRN

SEQ ID NO: 448902 - protein, 9 aa, Homo Sapiens
SPQSPVNKT

SEQ ID NO: 448903 - protein, 9 aa, Homo Sapiens
SGFMAPSEA

SEQ ID NO: 448904 - protein, 9 aa, Homo Sapiens
ADQFNMPTN

SEQ ID NO: 448905 - protein, 9 aa, Homo Sapiens
YSLEGEDFE

SEQ ID NO: 448906 - protein, 9 aa, Homo Sapiens
LGYLNLAAD

SEQ ID NO: 448907 - protein, 9 aa, Homo Sapiens
DSLRFSTDN

SEQ ID NO: 448908 - protein, 9 aa, Homo Sapiens
MVYQTKSHV

SEQ ID NO: 448909 - protein, 9 aa, Homo Sapiens
KKMGSAEDS

SEQ ID NO: 448910 - protein, 9 aa, Homo Sapiens
IQCQFSGKL

SEQ ID NO: 448911 - protein, 9 aa, Homo Sapiens
EEERLCLEE

SEQ ID NO: 448912 - protein, 9 aa, Homo Sapiens
WKISHKKAT

SEQ ID NO: 448913 - protein, 9 aa, Homo Sapiens
KAHLYEIMR

SEQ ID NO: 448914 - protein, 9 aa, Homo Sapiens
CCGGATCVL

SEQ ID NO: 448915 - protein, 9 aa, Homo Sapiens
DVCLIGEKL

SEQ ID NO: 448916 - protein, 9 aa, Homo Sapiens
IECLLSFIC

SEQ ID NO: 448917 - protein, 9 aa, Homo Sapiens
NNVPAVRWV

SEQ ID NO: 448918 - protein, 9 aa, Homo Sapiens
RHENASQVP

SEQ ID NO: 448919 - protein, 9 aa, Homo Sapiens
LNISNNVCF

SEQ ID NO: 448920 - protein, 9 aa, Homo Sapiens
DGKKDITAT

SEQ ID NO: 448921 - protein, 9 aa, Homo Sapiens
TVAYGEFRN

SEQ ID NO: 448922 - protein, 9 aa, Homo Sapiens
KRFLLPKDN

SEQ ID NO: 448923 - protein, 9 aa, Homo Sapiens
LLQNWLCFP

SEQ ID NO: 448924 - protein, 9 aa, Homo Sapiens
RTFFCHPLN

SEQ ID NO: 448925 - protein, 9 aa, Homo Sapiens
FATIMLNTS

SEQ ID NO: 448926 - protein, 9 aa, Homo Sapiens
FTDIIKLFN

SEQ ID NO: 448927 - protein, 9 aa, Homo Sapiens
AKAMNTKEP

SEQ ID NO: 448928 - protein, 9 aa, Homo Sapiens
TVKSLESRL

SEQ ID NO: 448929 - protein, 9 aa, Homo Sapiens
ESFCERTSL

SEQ ID NO: 448930 - protein, 9 aa, Homo Sapiens
EYERAQKDV

SEQ ID NO: 448931 - protein, 9 aa, Homo Sapiens
PTKKPTIPT

SEQ ID NO: 448932 - protein, 9 aa, Homo Sapiens
GKKVKRWGM

SEQ ID NO: 448933 - protein, 9 aa, Homo Sapiens
LCYSYLMVM

SEQ ID NO: 448934 - protein, 9 aa, Homo Sapiens
QVLQIKVRR

SEQ ID NO: 448935 - protein, 9 aa, Homo Sapiens
FRHITDWQQ

SEQ ID NO: 448936 - protein, 9 aa, Homo Sapiens
DAVQQHPTE

SEQ ID NO: 448937 - protein, 9 aa, Homo Sapiens
EGRMASHKI

SEQ ID NO: 448938 - protein, 9 aa, Homo Sapiens
ATWHGNDFK

SEQ ID NO: 448939 - protein, 9 aa, Homo Sapiens
DKGNEVTVE

SEQ ID NO: 448940 - protein, 9 aa, Homo Sapiens
VQVFTCVIL

SEQ ID NO: 448941 - protein, 9 aa, Homo Sapiens
IIELSEKIT

SEQ ID NO: 448942 - protein, 9 aa, Homo Sapiens
DNFDNISLD

SEQ ID NO: 448943 - protein, 9 aa, Homo Sapiens
KAKELYEPT

SEQ ID NO: 448944 - protein, 9 aa, Homo Sapiens
TMENFNNFY

SEQ ID NO: 448945 - protein, 9 aa, Homo Sapiens
CYGYQNDSE

SEQ ID NO: 448946 - protein, 9 aa, Homo Sapiens
HIIKLTVED

SEQ ID NO: 448947 - protein, 9 aa, Homo Sapiens
FRNMAYLRS

SEQ ID NO: 448948 - protein, 9 aa, Homo Sapiens
YLVRHQKII

SEQ ID NO: 448949 - protein, 9 aa, Homo Sapiens
QSPKRLLLR

SEQ ID NO: 448950 - protein, 9 aa, Homo Sapiens
GELMTHKLK

SEQ ID NO: 448951 - protein, 9 aa, Homo Sapiens
MVKPLDLLG

SEQ ID NO: 448952 - protein, 9 aa, Homo Sapiens
EKRLLEFCL

SEQ ID NO: 448953 - protein, 9 aa, Homo Sapiens
DEYQSWKIS

SEQ ID NO: 448954 - protein, 9 aa, Homo Sapiens
RTRIDKRVD

SEQ ID NO: 448955 - protein, 9 aa, Homo Sapiens
RTGWFCGGL

SEQ ID NO: 448956 - protein, 9 aa, Homo Sapiens
AALAQATRT

SEQ ID NO: 448957 - protein, 9 aa, Homo Sapiens
SRSKLPDKF

SEQ ID NO: 448958 - protein, 9 aa, Homo Sapiens
EGDTWCEQK

SEQ ID NO: 448959 - protein, 9 aa, Homo Sapiens
EHNLERVLP

SEQ ID NO: 448960 - protein, 9 aa, Homo Sapiens
LPSKDGNHK

SEQ ID NO: 448961 - protein, 9 aa, Homo Sapiens
PCKIIKKEL

SEQ ID NO: 448962 - protein, 9 aa, Homo Sapiens
EMGVFIREH

SEQ ID NO: 448963 - protein, 9 aa, Homo Sapiens
ADSILSLCS

SEQ ID NO: 448964 - protein, 9 aa, Homo Sapiens
TGKRRGGRR

SEQ ID NO: 448965 - protein, 9 aa, Homo Sapiens
LYKKLYTIS

SEQ ID NO: 448966 - protein, 9 aa, Homo Sapiens
SGQSLLSTH

SEQ ID NO: 448967 - protein, 9 aa, Homo Sapiens
NKYVFTKNV

SEQ ID NO: 448968 - protein, 9 aa, Homo Sapiens
EMITPSAIT

SEQ ID NO: 448969 - protein, 9 aa, Homo Sapiens
EELEDTNDD

SEQ ID NO: 448970 - protein, 9 aa, Homo Sapiens
YQDLVVRIE

SEQ ID NO: 448971 - protein, 9 aa, Homo Sapiens
RNPKIMLLD

SEQ ID NO: 448972 - protein, 9 aa, Homo Sapiens
RGGWTPQSP

SEQ ID NO: 448973 - protein, 9 aa, Homo Sapiens
ERHCSLFVY

SEQ ID NO: 448974 - protein, 9 aa, Homo Sapiens
DDTHTDPVP

SEQ ID NO: 448975 - protein, 9 aa, Homo Sapiens
GTGNLVNTY

SEQ ID NO: 448976 - protein, 9 aa, Homo Sapiens
GIYRSASDN

SEQ ID NO: 448977 - protein, 9 aa, Homo Sapiens
DVTLRVAGE

SEQ ID NO: 448978 - protein, 9 aa, Homo Sapiens
MKETILWAN

SEQ ID NO: 448979 - protein, 9 aa, Homo Sapiens
NQDSDLVVL

SEQ ID NO: 448980 - protein, 9 aa, Homo Sapiens
HAELSPIHF

SEQ ID NO: 448981 - protein, 9 aa, Homo Sapiens
QKHGKNVPK

SEQ ID NO: 448982 - protein, 9 aa, Homo Sapiens
NYKVDKKPP

SEQ ID NO: 448983 - protein, 9 aa, Homo Sapiens
QMHFFHSLE

SEQ ID NO: 448984 - protein, 9 aa, Homo Sapiens
LMDGHHYRC

SEQ ID NO: 448985 - protein, 9 aa, Homo Sapiens
GGWALVLPE

SEQ ID NO: 448986 - protein, 9 aa, Homo Sapiens
GAYLCNYTR

SEQ ID NO: 448987 - protein, 9 aa, Homo Sapiens
NYEIRICRP

SEQ ID NO: 448988 - protein, 9 aa, Homo Sapiens
TVTFNTLLA

SEQ ID NO: 448989 - protein, 9 aa, Homo Sapiens
TSIPSMMTP

SEQ ID NO: 448990 - protein, 9 aa, Homo Sapiens
YANTFGYTF

SEQ ID NO: 448991 - protein, 9 aa, Homo Sapiens
FFIIFTAGL

SEQ ID NO: 448992 - protein, 9 aa, Homo Sapiens
AVLQLWDTA

SEQ ID NO: 448993 - protein, 9 aa, Homo Sapiens
MHNMFSHRL

SEQ ID NO: 448994 - protein, 9 aa, Homo Sapiens
SYMLVMHNM

SEQ ID NO: 448995 - protein, 9 aa, Homo Sapiens
GWEKKEECV

SEQ ID NO: 448996 - protein, 9 aa, Homo Sapiens
PPCRSRSET

SEQ ID NO: 448997 - protein, 9 aa, Homo Sapiens
FKMFTTKKV

SEQ ID NO: 448998 - protein, 9 aa, Homo Sapiens
KFIMTADDD

SEQ ID NO: 448999 - protein, 9 aa, Homo Sapiens
ILNQLNSLY

SEQ ID NO: 449000 - protein, 9 aa, Homo Sapiens
NLSTPKVPA

SEQ ID NO: 449001 - protein, 9 aa, Homo Sapiens
TDSSLHSQH

SEQ ID NO: 449002 - protein, 9 aa, Homo Sapiens
TGLRCIWLQ

SEQ ID NO: 449003 - protein, 9 aa, Homo Sapiens
NIHNKLEFP

SEQ ID NO: 449004 - protein, 9 aa, Homo Sapiens
KLKTEENLF

SEQ ID NO: 449005 - protein, 9 aa, Homo Sapiens
RRSRHRRSQ

SEQ ID NO: 449006 - protein, 9 aa, Homo Sapiens
KSLLIDSHI

SEQ ID NO: 449007 - protein, 9 aa, Homo Sapiens
RSIMAEKLV

SEQ ID NO: 449008 - protein, 9 aa, Homo Sapiens
DKEKAWKAV

SEQ ID NO: 449009 - protein, 9 aa, Homo Sapiens
LYDSKTIRN

SEQ ID NO: 449010 - protein, 9 aa, Homo Sapiens
NNKTMSKSP

SEQ ID NO: 449011 - protein, 9 aa, Homo Sapiens
HIDSVHITM

SEQ ID NO: 449012 - protein, 9 aa, Homo Sapiens
IEERDRRQQ

SEQ ID NO: 449013 - protein, 9 aa, Homo Sapiens
PEGEPPATI

SEQ ID NO: 449014 - protein, 9 aa, Homo Sapiens
DLPRAVPLS

SEQ ID NO: 449015 - protein, 9 aa, Homo Sapiens
ELIERVLRG

SEQ ID NO: 449016 - protein, 9 aa, Homo Sapiens
LGWWWARLS

SEQ ID NO: 449017 - protein, 9 aa, Homo Sapiens
VLEAKHLKK

SEQ ID NO: 449018 - protein, 9 aa, Homo Sapiens
VLTVGKNYL

SEQ ID NO: 449019 - protein, 9 aa, Homo Sapiens
MDCINICTG

SEQ ID NO: 449020 - protein, 9 aa, Homo Sapiens
LAGLYMFWT

SEQ ID NO: 449021 - protein, 9 aa, Homo Sapiens
AHYSNVLHV

SEQ ID NO: 449022 - protein, 9 aa, Homo Sapiens
GFDRYVEPL

SEQ ID NO: 449023 - protein, 9 aa, Homo Sapiens
LLISFLFIG

SEQ ID NO: 449024 - protein, 9 aa, Homo Sapiens
HAEFAPKAD

SEQ ID NO: 449025 - protein, 9 aa, Homo Sapiens
EYLLDNLGN

SEQ ID NO: 449026 - protein, 9 aa, Homo Sapiens
HYIKEGLDK

SEQ ID NO: 449027 - protein, 9 aa, Homo Sapiens
LPNGLKAEI

SEQ ID NO: 449028 - protein, 9 aa, Homo Sapiens
PTSHSAIPD

SEQ ID NO: 449029 - protein, 9 aa, Homo Sapiens
VLSSVDEEN

SEQ ID NO: 449030 - protein, 9 aa, Homo Sapiens
GGSSTFHRM

SEQ ID NO: 449031 - protein, 9 aa, Homo Sapiens
YTLLLGTVN

SEQ ID NO: 449032 - protein, 9 aa, Homo Sapiens
CKSWKPPCR

SEQ ID NO: 449033 - protein, 9 aa, Homo Sapiens
VTQPLDREK

SEQ ID NO: 449034 - protein, 9 aa, Homo Sapiens
TLCKLVYVG

SEQ ID NO: 449035 - protein, 9 aa, Homo Sapiens
LILLAFLIV

SEQ ID NO: 449036 - protein, 9 aa, Homo Sapiens
ILLTRWTRC

SEQ ID NO: 449037 - protein, 9 aa, Homo Sapiens
SLRRIAKYE

SEQ ID NO: 449038 - protein, 9 aa, Homo Sapiens
PPRDTPEYV

SEQ ID NO: 449039 - protein, 9 aa, Homo Sapiens
VTYNGDFSD

SEQ ID NO: 449040 - protein, 9 aa, Homo Sapiens
QFAPDNKLS

SEQ ID NO: 449041 - protein, 9 aa, Homo Sapiens
DVLIQRQTK

SEQ ID NO: 449042 - protein, 9 aa, Homo Sapiens
DTKGKILCL

SEQ ID NO: 449043 - protein, 9 aa, Homo Sapiens
LTGPHTCKD

SEQ ID NO: 449044 - protein, 9 aa, Homo Sapiens
IKEKPGFLT

SEQ ID NO: 449045 - protein, 9 aa, Homo Sapiens
AQESAWILQ

SEQ ID NO: 449046 - protein, 9 aa, Homo Sapiens
GPRKRATAT

SEQ ID NO: 449047 - protein, 9 aa, Homo Sapiens
VPQKANIVL

SEQ ID NO: 449048 - protein, 9 aa, Homo Sapiens
YSKVVMFVQ

SEQ ID NO: 449049 - protein, 9 aa, Homo Sapiens
HSMIQIIFT

SEQ ID NO: 449050 - protein, 9 aa, Homo Sapiens
NSRVTYALC

SEQ ID NO: 449051 - protein, 9 aa, Homo Sapiens
AENTTGSNI

SEQ ID NO: 449052 - protein, 9 aa, Homo Sapiens
ASILPKHDM

SEQ ID NO: 449053 - protein, 9 aa, Homo Sapiens
KKLAEFLSS

SEQ ID NO: 449054 - protein, 9 aa, Homo Sapiens
QEIIQHVDV

SEQ ID NO: 449055 - protein, 9 aa, Homo Sapiens
ANCPLKDRR

SEQ ID NO: 449056 - protein, 9 aa, Homo Sapiens
NKINPLKEK

SEQ ID NO: 449057 - protein, 9 aa, Homo Sapiens
DEMNIHLWK

SEQ ID NO: 449058 - protein, 9 aa, Homo Sapiens
RKPHHKNKD

SEQ ID NO: 449059 - protein, 9 aa, Homo Sapiens
DPFKRLISA

SEQ ID NO: 449060 - protein, 9 aa, Homo Sapiens
SLDKNVMVP

SEQ ID NO: 449061 - protein, 9 aa, Homo Sapiens
LTVCCLYYT

SEQ ID NO: 449062 - protein, 9 aa, Homo Sapiens
GGSPQIPFS

SEQ ID NO: 449063 - protein, 9 aa, Homo Sapiens
HQVPILFHK

SEQ ID NO: 449064 - protein, 9 aa, Homo Sapiens
NVSVDHSLQ

SEQ ID NO: 449065 - protein, 9 aa, Homo Sapiens
TWQISAGSG

SEQ ID NO: 449066 - protein, 9 aa, Homo Sapiens
TTLIQGAPC

SEQ ID NO: 449067 - protein, 9 aa, Homo Sapiens
QFIIGKENR

SEQ ID NO: 449068 - protein, 9 aa, Homo Sapiens
VNLLSYFVE

SEQ ID NO: 449069 - protein, 9 aa, Homo Sapiens
TVEIDLRHW

SEQ ID NO: 449070 - protein, 9 aa, Homo Sapiens
FMDEIYAIG

SEQ ID NO: 449071 - protein, 9 aa, Homo Sapiens
AGQTINDQD

SEQ ID NO: 449072 - protein, 9 aa, Homo Sapiens
SRINFCRKG

SEQ ID NO: 449073 - protein, 9 aa, Homo Sapiens
LWANNLLGE

SEQ ID NO: 449074 - protein, 9 aa, Homo Sapiens
DEADLVLVK

SEQ ID NO: 449075 - protein, 9 aa, Homo Sapiens
FCRYSTDIV

SEQ ID NO: 449076 - protein, 9 aa, Homo Sapiens
IDRQGAVVV

SEQ ID NO: 449077 - protein, 9 aa, Homo Sapiens
MPTLQFFKK

SEQ ID NO: 449078 - protein, 9 aa, Homo Sapiens
LSVASAEYQ

SEQ ID NO: 449079 - protein, 9 aa, Homo Sapiens
NAREILDGL

SEQ ID NO: 449080 - protein, 9 aa, Homo Sapiens
DLRLWKQEP

SEQ ID NO: 449081 - protein, 9 aa, Homo Sapiens
LSMDEPLNT

SEQ ID NO: 449082 - protein, 9 aa, Homo Sapiens
ESTGPAGHF

SEQ ID NO: 449083 - protein, 9 aa, Homo Sapiens
PGAELATVP

SEQ ID NO: 449084 - protein, 9 aa, Homo Sapiens
IAVWDLHYQ

SEQ ID NO: 449085 - protein, 9 aa, Homo Sapiens
VTMVSYTEI

SEQ ID NO: 449086 - protein, 9 aa, Homo Sapiens
PFKRLISAF

SEQ ID NO: 449087 - protein, 9 aa, Homo Sapiens
DSAKQEGAI

SEQ ID NO: 449088 - protein, 9 aa, Homo Sapiens
KIYRGCHHE

SEQ ID NO: 449089 - protein, 9 aa, Homo Sapiens
MHQIILYLL

SEQ ID NO: 449090 - protein, 9 aa, Homo Sapiens
VDKHIEKLT

SEQ ID NO: 449091 - protein, 9 aa, Homo Sapiens
IEASLYGLD

SEQ ID NO: 449092 - protein, 9 aa, Homo Sapiens
YVEKDQHRI

SEQ ID NO: 449093 - protein, 9 aa, Homo Sapiens
KKIILLKGF

SEQ ID NO: 449094 - protein, 9 aa, Homo Sapiens
FQCTCELGK

SEQ ID NO: 449095 - protein, 9 aa, Homo Sapiens
SAQNNPTAF

SEQ ID NO: 449096 - protein, 9 aa, Homo Sapiens
AKYLDDRYK

SEQ ID NO: 449097 - protein, 9 aa, Homo Sapiens
RQRAFSTCS

SEQ ID NO: 449098 - protein, 9 aa, Homo Sapiens
MNIKLFMNC

SEQ ID NO: 449099 - protein, 9 aa, Homo Sapiens
VINLQCNAV

SEQ ID NO: 449100 - protein, 9 aa, Homo Sapiens
LTDSKFSMQ

SEQ ID NO: 449101 - protein, 9 aa, Homo Sapiens
NKKMLGHQE

SEQ ID NO: 449102 - protein, 9 aa, Homo Sapiens
QCWWEKPYE

SEQ ID NO: 449103 - protein, 9 aa, Homo Sapiens
YRCVARVDL

SEQ ID NO: 449104 - protein, 9 aa, Homo Sapiens
CGCCGKVLV

SEQ ID NO: 449105 - protein, 9 aa, Homo Sapiens
TDLNKLRTN

SEQ ID NO: 449106 - protein, 9 aa, Homo Sapiens
LPPSKVICN

SEQ ID NO: 449107 - protein, 9 aa, Homo Sapiens
DTDHAAPME

SEQ ID NO: 449108 - protein, 9 aa, Homo Sapiens
DSLNWAFGV

SEQ ID NO: 449109 - protein, 9 aa, Homo Sapiens
QPSTTYVHV

SEQ ID NO: 449110 - protein, 9 aa, Homo Sapiens
ASMKGLGTN

SEQ ID NO: 449111 - protein, 9 aa, Homo Sapiens
SPKALFVMT

SEQ ID NO: 449112 - protein, 9 aa, Homo Sapiens
APTKLVGAA

SEQ ID NO: 449113 - protein, 9 aa, Homo Sapiens
SKSDVVLPF

SEQ ID NO: 449114 - protein, 9 aa, Homo Sapiens
PELKFQVFN

SEQ ID NO: 449115 - protein, 9 aa, Homo Sapiens
IRMQLQADI

SEQ ID NO: 449116 - protein, 9 aa, Homo Sapiens
AKEAEESYM

SEQ ID NO: 449117 - protein, 9 aa, Homo Sapiens
VLAFAISWL

SEQ ID NO: 449118 - protein, 9 aa, Homo Sapiens
SPSRIRKFI

SEQ ID NO: 449119 - protein, 9 aa, Homo Sapiens
LTYWGCVYL

SEQ ID NO: 449120 - protein, 9 aa, Homo Sapiens
PIHHSLEIK

SEQ ID NO: 449121 - protein, 9 aa, Homo Sapiens
KSPMMTWGE

SEQ ID NO: 449122 - protein, 9 aa, Homo Sapiens
PDNMNLANN

SEQ ID NO: 449123 - protein, 9 aa, Homo Sapiens
QQPSNGSLQ

SEQ ID NO: 449124 - protein, 9 aa, Homo Sapiens
RPGSVATVS

SEQ ID NO: 449125 - protein, 9 aa, Homo Sapiens
GAKNYVSLM

SEQ ID NO: 449126 - protein, 9 aa, Homo Sapiens
YKLASNEFQ

SEQ ID NO: 449127 - protein, 9 aa, Homo Sapiens
VAFNIDFNW

SEQ ID NO: 449128 - protein, 9 aa, Homo Sapiens
IHEISEDVY

SEQ ID NO: 449129 - protein, 9 aa, Homo Sapiens
HSNTLTHTD

SEQ ID NO: 449130 - protein, 9 aa, Homo Sapiens
EQHVVQELT

SEQ ID NO: 449131 - protein, 9 aa, Homo Sapiens
PIFTRGQLP

SEQ ID NO: 449132 - protein, 9 aa, Homo Sapiens
KVKVVFDKD

SEQ ID NO: 449133 - protein, 9 aa, Homo Sapiens
LPDWKGWSC

SEQ ID NO: 449134 - protein, 9 aa, Homo Sapiens
ACSYVTSNA

SEQ ID NO: 449135 - protein, 9 aa, Homo Sapiens
QRDRCSSLI

SEQ ID NO: 449136 - protein, 9 aa, Homo Sapiens
VYITERHNC

SEQ ID NO: 449137 - protein, 9 aa, Homo Sapiens
DGQCHISGK

SEQ ID NO: 449138 - protein, 9 aa, Homo Sapiens
FNIEEHRGS

SEQ ID NO: 449139 - protein, 9 aa, Homo Sapiens
NMEELMEVI

SEQ ID NO: 449140 - protein, 9 aa, Homo Sapiens
ARDCQNPNT

SEQ ID NO: 449141 - protein, 9 aa, Homo Sapiens
AMPHSSSTK

SEQ ID NO: 449142 - protein, 9 aa, Homo Sapiens
EKVIQHALA

SEQ ID NO: 449143 - protein, 9 aa, Homo Sapiens
VHANVQLLH

SEQ ID NO: 449144 - protein, 9 aa, Homo Sapiens
EESECESEY

SEQ ID NO: 449145 - protein, 9 aa, Homo Sapiens
KIVEGTRDP

SEQ ID NO: 449146 - protein, 9 aa, Homo Sapiens
TNGPVFVGG

SEQ ID NO: 449147 - protein, 9 aa, Homo Sapiens
CKDDEFRNN

SEQ ID NO: 449148 - protein, 9 aa, Homo Sapiens
GKMLRRTER

SEQ ID NO: 449149 - protein, 9 aa, Homo Sapiens
SKWGIGYHL

SEQ ID NO: 449150 - protein, 9 aa, Homo Sapiens
KSMNVLIRD

SEQ ID NO: 449151 - protein, 9 aa, Homo Sapiens
YQHANVVLL

SEQ ID NO: 449152 - protein, 9 aa, Homo Sapiens
LHNLFSATF

SEQ ID NO: 449153 - protein, 9 aa, Homo Sapiens
FNQTPIPWL

SEQ ID NO: 449154 - protein, 9 aa, Homo Sapiens
WFEMETRGV

SEQ ID NO: 449155 - protein, 9 aa, Homo Sapiens
DGGESVNLQ

SEQ ID NO: 449156 - protein, 9 aa, Homo Sapiens
GKVPEMPRA

SEQ ID NO: 449157 - protein, 9 aa, Homo Sapiens
IQRSAISYI

SEQ ID NO: 449158 - protein, 9 aa, Homo Sapiens
DQFNMPTNI

SEQ ID NO: 449159 - protein, 9 aa, Homo Sapiens
LICQFQGRT

SEQ ID NO: 449160 - protein, 9 aa, Homo Sapiens
LERNDLFLS

SEQ ID NO: 449161 - protein, 9 aa, Homo Sapiens
ENELSDTAS

SEQ ID NO: 449162 - protein, 9 aa, Homo Sapiens
AEEDRDKLL

SEQ ID NO: 449163 - protein, 9 aa, Homo Sapiens
NIHLKKMAY

SEQ ID NO: 449164 - protein, 9 aa, Homo Sapiens
SVVFNALVT

SEQ ID NO: 449165 - protein, 9 aa, Homo Sapiens
EEGRETSSD

SEQ ID NO: 449166 - protein, 9 aa, Homo Sapiens
NELHAKQKF

SEQ ID NO: 449167 - protein, 9 aa, Homo Sapiens
LIPKALSTR

SEQ ID NO: 449168 - protein, 9 aa, Homo Sapiens
QLNYKYGKK

SEQ ID NO: 449169 - protein, 9 aa, Homo Sapiens
AFDYFFPVE

SEQ ID NO: 449170 - protein, 9 aa, Homo Sapiens
KVVADTISR

SEQ ID NO: 449171 - protein, 9 aa, Homo Sapiens
PCAPLAKCK

SEQ ID NO: 449172 - protein, 9 aa, Homo Sapiens
FDILGNFNL

SEQ ID NO: 449173 - protein, 9 aa, Homo Sapiens
EGLCVEKIA

SEQ ID NO: 449174 - protein, 9 aa, Homo Sapiens
ANINLALEQ

SEQ ID NO: 449175 - protein, 9 aa, Homo Sapiens
LRAKPPLEA

SEQ ID NO: 449176 - protein, 9 aa, Homo Sapiens
CEDKHTFLQ

SEQ ID NO: 449177 - protein, 9 aa, Homo Sapiens
IGKEMHIIN

SEQ ID NO: 449178 - protein, 9 aa, Homo Sapiens
KAAVAQKPQ

SEQ ID NO: 449179 - protein, 9 aa, Homo Sapiens
VLVIFLLCM

SEQ ID NO: 449180 - protein, 9 aa, Homo Sapiens
SGLWVSHRK

SEQ ID NO: 449181 - protein, 9 aa, Homo Sapiens
ELEGPGSPP

SEQ ID NO: 449182 - protein, 9 aa, Homo Sapiens
ERDLTPLII

SEQ ID NO: 449183 - protein, 9 aa, Homo Sapiens
SHHLAAFIN

SEQ ID NO: 449184 - protein, 9 aa, Homo Sapiens
FSIIAGFCF

SEQ ID NO: 449185 - protein, 9 aa, Homo Sapiens
LAGLGDCNH

SEQ ID NO: 449186 - protein, 9 aa, Homo Sapiens
EQKCTYQFM

SEQ ID NO: 449187 - protein, 9 aa, Homo Sapiens
WKQEPGLRI

SEQ ID NO: 449188 - protein, 9 aa, Homo Sapiens
TVDKSYLCS

SEQ ID NO: 449189 - protein, 9 aa, Homo Sapiens
SSEGLIAFS

SEQ ID NO: 449190 - protein, 9 aa, Homo Sapiens
EDSVEEIGA

SEQ ID NO: 449191 - protein, 9 aa, Homo Sapiens
EIIKARAGN

SEQ ID NO: 449192 - protein, 9 aa, Homo Sapiens
DCGQAETEE

SEQ ID NO: 449193 - protein, 9 aa, Homo Sapiens
LNAHQPITQ

SEQ ID NO: 449194 - protein, 9 aa, Homo Sapiens
NIGHLVEDM

SEQ ID NO: 449195 - protein, 9 aa, Homo Sapiens
EKPTIPTKK

SEQ ID NO: 449196 - protein, 9 aa, Homo Sapiens
LYIELDQQL

SEQ ID NO: 449197 - protein, 9 aa, Homo Sapiens
IPGPEKNLP

SEQ ID NO: 449198 - protein, 9 aa, Homo Sapiens
EQYSSDTMQ

SEQ ID NO: 449199 - protein, 9 aa, Homo Sapiens
KSYALAVLS

SEQ ID NO: 449200 - protein, 9 aa, Homo Sapiens
LILIKLCYF

SEQ ID NO: 449201 - protein, 9 aa, Homo Sapiens
YFYNPLIPT

SEQ ID NO: 449202 - protein, 9 aa, Homo Sapiens
IFRRVLYAP

SEQ ID NO: 449203 - protein, 9 aa, Homo Sapiens
MIYFVGCFA

SEQ ID NO: 449204 - protein, 9 aa, Homo Sapiens
INIAAHCKE

SEQ ID NO: 449205 - protein, 9 aa, Homo Sapiens
YNQKPVGKY

SEQ ID NO: 449206 - protein, 9 aa, Homo Sapiens
PCVAGCSNS

SEQ ID NO: 449207 - protein, 9 aa, Homo Sapiens
NNGHAKDHP

SEQ ID NO: 449208 - protein, 9 aa, Homo Sapiens
KISLIPPVN

SEQ ID NO: 449209 - protein, 9 aa, Homo Sapiens
YCENKCGNC

SEQ ID NO: 449210 - protein, 9 aa, Homo Sapiens
RTHYAPPRK

SEQ ID NO: 449211 - protein, 9 aa, Homo Sapiens
SDKLDEQRT

SEQ ID NO: 449212 - protein, 9 aa, Homo Sapiens
MKGMRKVLR

SEQ ID NO: 449213 - protein, 9 aa, Homo Sapiens
QVSRHTKFG

SEQ ID NO: 449214 - protein, 9 aa, Homo Sapiens
RAFLHTYSH

SEQ ID NO: 449215 - protein, 9 aa, Homo Sapiens
LRVLGYLNL

SEQ ID NO: 449216 - protein, 9 aa, Homo Sapiens
YLGILFPFR

SEQ ID NO: 449217 - protein, 9 aa, Homo Sapiens
ITHLPCPGK

SEQ ID NO: 449218 - protein, 9 aa, Homo Sapiens
INTPRSKRF

SEQ ID NO: 449219 - protein, 9 aa, Homo Sapiens
KNYIFAEYA

SEQ ID NO: 449220 - protein, 9 aa, Homo Sapiens
SQREEERSR

SEQ ID NO: 449221 - protein, 9 aa, Homo Sapiens
ILKRTELET

SEQ ID NO: 449222 - protein, 9 aa, Homo Sapiens
LAALEFPPN

SEQ ID NO: 449223 - protein, 9 aa, Homo Sapiens
PQPNYQLQV

SEQ ID NO: 449224 - protein, 9 aa, Homo Sapiens
GNKESLESE

SEQ ID NO: 449225 - protein, 9 aa, Homo Sapiens
ELSQEEWKC

SEQ ID NO: 449226 - protein, 9 aa, Homo Sapiens
TNNLEQILN

SEQ ID NO: 449227 - protein, 9 aa, Homo Sapiens
SSSYSPYGY

SEQ ID NO: 449228 - protein, 9 aa, Homo Sapiens
NHSSLWNIW

SEQ ID NO: 449229 - protein, 9 aa, Homo Sapiens
PFCLCLTSL

SEQ ID NO: 449230 - protein, 9 aa, Homo Sapiens
RSDFNIEEH

SEQ ID NO: 449231 - protein, 9 aa, Homo Sapiens
YKEKQMLKF

SEQ ID NO: 449232 - protein, 9 aa, Homo Sapiens
PGPVIRRAR

SEQ ID NO: 449233 - protein, 9 aa, Homo Sapiens
VQFLFYQPI

SEQ ID NO: 449234 - protein, 9 aa, Homo Sapiens
AIFHLLKTC

SEQ ID NO: 449235 - protein, 9 aa, Homo Sapiens
TDPKESNLS

SEQ ID NO: 449236 - protein, 9 aa, Homo Sapiens
HSPLWKKRS

SEQ ID NO: 449237 - protein, 9 aa, Homo Sapiens
IYTKSYWKA

SEQ ID NO: 449238 - protein, 9 aa, Homo Sapiens
DTFISESKI

SEQ ID NO: 449239 - protein, 9 aa, Homo Sapiens
LRKGKPCAV

SEQ ID NO: 449240 - protein, 9 aa, Homo Sapiens
NRINPDAWE

SEQ ID NO: 449241 - protein, 9 aa, Homo Sapiens
VGALRTGAY

SEQ ID NO: 449242 - protein, 9 aa, Homo Sapiens
DKSCKYLEE

SEQ ID NO: 449243 - protein, 9 aa, Homo Sapiens
TYPHQVVKD

SEQ ID NO: 449244 - protein, 9 aa, Homo Sapiens
PFIRLSKED

SEQ ID NO: 449245 - protein, 9 aa, Homo Sapiens
LNILESAET

SEQ ID NO: 449246 - protein, 9 aa, Homo Sapiens
SGWEKKEEC

SEQ ID NO: 449247 - protein, 9 aa, Homo Sapiens
VIPFTTFTP

SEQ ID NO: 449248 - protein, 9 aa, Homo Sapiens
CANYIHSGT

SEQ ID NO: 449249 - protein, 9 aa, Homo Sapiens
KHAALRWHI

SEQ ID NO: 449250 - protein, 9 aa, Homo Sapiens
ETGIYLPLL

SEQ ID NO: 449251 - protein, 9 aa, Homo Sapiens
CVDRLWQKK

SEQ ID NO: 449252 - protein, 9 aa, Homo Sapiens
YKDPYSYDQ

SEQ ID NO: 449253 - protein, 9 aa, Homo Sapiens
AGIKNAEIY

SEQ ID NO: 449254 - protein, 9 aa, Homo Sapiens
ISVMSDIRN

SEQ ID NO: 449255 - protein, 9 aa, Homo Sapiens
PGCDEQHGL

SEQ ID NO: 449256 - protein, 9 aa, Homo Sapiens
YILVINFSL

SEQ ID NO: 449257 - protein, 9 aa, Homo Sapiens
VENYNETEP

SEQ ID NO: 449258 - protein, 9 aa, Homo Sapiens
SHKIPREPR

SEQ ID NO: 449259 - protein, 9 aa, Homo Sapiens
RAKKRKDNF

SEQ ID NO: 449260 - protein, 9 aa, Homo Sapiens
SLKNIKRTK

SEQ ID NO: 449261 - protein, 9 aa, Homo Sapiens
YYDLYGGDK

SEQ ID NO: 449262 - protein, 9 aa, Homo Sapiens
VHVWLNEYK

SEQ ID NO: 449263 - protein, 9 aa, Homo Sapiens
ATPFGGASH

SEQ ID NO: 449264 - protein, 9 aa, Homo Sapiens
LIERVLRGK

SEQ ID NO: 449265 - protein, 9 aa, Homo Sapiens
FKREYPITH

SEQ ID NO: 449266 - protein, 9 aa, Homo Sapiens
AYVIQGLAT

SEQ ID NO: 449267 - protein, 9 aa, Homo Sapiens
LEGIKKVIT

SEQ ID NO: 449268 - protein, 9 aa, Homo Sapiens
KKLKTEENL

SEQ ID NO: 449269 - protein, 9 aa, Homo Sapiens
FTQEEWGKL

SEQ ID NO: 449270 - protein, 9 aa, Homo Sapiens
FQPISCEPL

SEQ ID NO: 449271 - protein, 9 aa, Homo Sapiens
SLLMTWALI

SEQ ID NO: 449272 - protein, 9 aa, Homo Sapiens
DPLLDQRQL

SEQ ID NO: 449273 - protein, 9 aa, Homo Sapiens
LYLQMHSKF

SEQ ID NO: 449274 - protein, 9 aa, Homo Sapiens
HMWEWQTVE

SEQ ID NO: 449275 - protein, 9 aa, Homo Sapiens
CVRNNRPQE

SEQ ID NO: 449276 - protein, 9 aa, Homo Sapiens
LKRFNEPGS

SEQ ID NO: 449277 - protein, 9 aa, Homo Sapiens
QSSHLNKHN

SEQ ID NO: 449278 - protein, 9 aa, Homo Sapiens
PRKRATATV

SEQ ID NO: 449279 - protein, 9 aa, Homo Sapiens
KSFNHSSVL

SEQ ID NO: 449280 - protein, 9 aa, Homo Sapiens
MDMFDQDGI

SEQ ID NO: 449281 - protein, 9 aa, Homo Sapiens
NFFHHINTY

SEQ ID NO: 449282 - protein, 9 aa, Homo Sapiens
SQSRSRDRR

SEQ ID NO: 449283 - protein, 9 aa, Homo Sapiens
APLLCKVYL

SEQ ID NO: 449284 - protein, 9 aa, Homo Sapiens
EVRDNWTPQ

SEQ ID NO: 449285 - protein, 9 aa, Homo Sapiens
LEIKEGSYS

SEQ ID NO: 449286 - protein, 9 aa, Homo Sapiens
ASCSDYMTL

SEQ ID NO: 449287 - protein, 9 aa, Homo Sapiens
CGSENNYLY

SEQ ID NO: 449288 - protein, 9 aa, Homo Sapiens
MGWSIDVGD

SEQ ID NO: 449289 - protein, 9 aa, Homo Sapiens
ERYTMEVEV

SEQ ID NO: 449290 - protein, 9 aa, Homo Sapiens
GLDKLVNNR

SEQ ID NO: 449291 - protein, 9 aa, Homo Sapiens
KNAMKKLFT

SEQ ID NO: 449292 - protein, 9 aa, Homo Sapiens
DGSENIPFS

SEQ ID NO: 449293 - protein, 9 aa, Homo Sapiens
CTKLDMARG

SEQ ID NO: 449294 - protein, 9 aa, Homo Sapiens
IATTRSAKS

SEQ ID NO: 449295 - protein, 9 aa, Homo Sapiens
ALEYFMKQI

SEQ ID NO: 449296 - protein, 9 aa, Homo Sapiens
KQLSYLGLY

SEQ ID NO: 449297 - protein, 9 aa, Homo Sapiens
HQEKRMGID

SEQ ID NO: 449298 - protein, 9 aa, Homo Sapiens
PTIPLGSVV

SEQ ID NO: 449299 - protein, 9 aa, Homo Sapiens
STDRDGIQP

SEQ ID NO: 449300 - protein, 9 aa, Homo Sapiens
KKFIECVSH

SEQ ID NO: 449301 - protein, 9 aa, Homo Sapiens
SSSHLRYGM

SEQ ID NO: 449302 - protein, 9 aa, Homo Sapiens
KMETAECNG

SEQ ID NO: 449303 - protein, 9 aa, Homo Sapiens
CQVLSSLHM

SEQ ID NO: 449304 - protein, 9 aa, Homo Sapiens
VMPRSYVNN

SEQ ID NO: 449305 - protein, 9 aa, Homo Sapiens
DISADFKEP

SEQ ID NO: 449306 - protein, 9 aa, Homo Sapiens
LSPNNGNIF

SEQ ID NO: 449307 - protein, 9 aa, Homo Sapiens
SPGEGNGNC

SEQ ID NO: 449308 - protein, 9 aa, Homo Sapiens
LPKEICAQT

SEQ ID NO: 449309 - protein, 9 aa, Homo Sapiens
WNREYTYQW

SEQ ID NO: 449310 - protein, 9 aa, Homo Sapiens
LFSYKDFDT

SEQ ID NO: 449311 - protein, 9 aa, Homo Sapiens
VSADVFMSY

SEQ ID NO: 449312 - protein, 9 aa, Homo Sapiens
EQHQKNQDL

SEQ ID NO: 449313 - protein, 9 aa, Homo Sapiens
AMAYDRYLS

SEQ ID NO: 449314 - protein, 9 aa, Homo Sapiens
IIQTPPPLS

SEQ ID NO: 449315 - protein, 9 aa, Homo Sapiens
VAQGEDDDE

SEQ ID NO: 449316 - protein, 9 aa, Homo Sapiens
RQGHIAKMP

SEQ ID NO: 449317 - protein, 9 aa, Homo Sapiens
RQAQVKHRC

SEQ ID NO: 449318 - protein, 9 aa, Homo Sapiens
EEGSEHGTS

SEQ ID NO: 449319 - protein, 9 aa, Homo Sapiens
TENQKNCRF

SEQ ID NO: 449320 - protein, 9 aa, Homo Sapiens
RFFPSRKAK

SEQ ID NO: 449321 - protein, 9 aa, Homo Sapiens
DQDAHLAYG

SEQ ID NO: 449322 - protein, 9 aa, Homo Sapiens
SKCFAALQA

SEQ ID NO: 449323 - protein, 9 aa, Homo Sapiens
EVAHALLLI

SEQ ID NO: 449324 - protein, 9 aa, Homo Sapiens
AYNKINQCW

SEQ ID NO: 449325 - protein, 9 aa, Homo Sapiens
LDEYIYRHL

SEQ ID NO: 449326 - protein, 9 aa, Homo Sapiens
ATKDLRWYR

SEQ ID NO: 449327 - protein, 9 aa, Homo Sapiens
AMWTLACTD

SEQ ID NO: 449328 - protein, 9 aa, Homo Sapiens
SYRCAGTSW

SEQ ID NO: 449329 - protein, 9 aa, Homo Sapiens
KNKNKGKKG

SEQ ID NO: 449330 - protein, 9 aa, Homo Sapiens
GCDGQCHIS

SEQ ID NO: 449331 - protein, 9 aa, Homo Sapiens
QRQEIIQHV

SEQ ID NO: 449332 - protein, 9 aa, Homo Sapiens
SLMLFVQLP

SEQ ID NO: 449333 - protein, 9 aa, Homo Sapiens
WEHSRERDR

SEQ ID NO: 449334 - protein, 9 aa, Homo Sapiens
SQEDEEGSE

SEQ ID NO: 449335 - protein, 9 aa, Homo Sapiens
YAPPKESRT

SEQ ID NO: 449336 - protein, 9 aa, Homo Sapiens
LCLFQGIGR

SEQ ID NO: 449337 - protein, 9 aa, Homo Sapiens
TFSSIPFFI

SEQ ID NO: 449338 - protein, 9 aa, Homo Sapiens
KLCDVIMET

SEQ ID NO: 449339 - protein, 9 aa, Homo Sapiens
SSSSRSCLR

SEQ ID NO: 449340 - protein, 9 aa, Homo Sapiens
SMLTSVVNA

SEQ ID NO: 449341 - protein, 9 aa, Homo Sapiens
LRCIWLQSN

SEQ ID NO: 449342 - protein, 9 aa, Homo Sapiens
EFCLVFKPA

SEQ ID NO: 449343 - protein, 9 aa, Homo Sapiens
KLSKFRMPQ

SEQ ID NO: 449344 - protein, 9 aa, Homo Sapiens
IHERINTGE

SEQ ID NO: 449345 - protein, 9 aa, Homo Sapiens
SALNLTELA

SEQ ID NO: 449346 - protein, 9 aa, Homo Sapiens
FNSSYVVGP

SEQ ID NO: 449347 - protein, 9 aa, Homo Sapiens
KDITATLAA

SEQ ID NO: 449348 - protein, 9 aa, Homo Sapiens
PLVIPVTFK

SEQ ID NO: 449349 - protein, 9 aa, Homo Sapiens
QVLRSPPQP

SEQ ID NO: 449350 - protein, 9 aa, Homo Sapiens
MQQGSYPAP

SEQ ID NO: 449351 - protein, 9 aa, Homo Sapiens
NYLNPVMDA

SEQ ID NO: 449352 - protein, 9 aa, Homo Sapiens
RVSSCLGGP

SEQ ID NO: 449353 - protein, 9 aa, Homo Sapiens
PPHIFLCDK

SEQ ID NO: 449354 - protein, 9 aa, Homo Sapiens
NQTDFSGLA

SEQ ID NO: 449355 - protein, 9 aa, Homo Sapiens
GLTLIHHNT

SEQ ID NO: 449356 - protein, 9 aa, Homo Sapiens
AVIDERLDK

SEQ ID NO: 449357 - protein, 9 aa, Homo Sapiens
LENIKLNKK

SEQ ID NO: 449358 - protein, 9 aa, Homo Sapiens
SRQLYWGTP

SEQ ID NO: 449359 - protein, 9 aa, Homo Sapiens
LQHIFYLKL

SEQ ID NO: 449360 - protein, 9 aa, Homo Sapiens
KKLQQTSGE

SEQ ID NO: 449361 - protein, 9 aa, Homo Sapiens
EYSVRDYFK

SEQ ID NO: 449362 - protein, 9 aa, Homo Sapiens
TVNEFILLN

SEQ ID NO: 449363 - protein, 9 aa, Homo Sapiens
NIKLNKKSM

SEQ ID NO: 449364 - protein, 9 aa, Homo Sapiens
RKMTKIICK

SEQ ID NO: 449365 - protein, 9 aa, Homo Sapiens
LSSVNEFAK

SEQ ID NO: 449366 - protein, 9 aa, Homo Sapiens
ALNVKQCFN

SEQ ID NO: 449367 - protein, 9 aa, Homo Sapiens
SWCANYIHS

SEQ ID NO: 449368 - protein, 9 aa, Homo Sapiens
VTGVQRFQD

SEQ ID NO: 449369 - protein, 9 aa, Homo Sapiens
AFAISWLPY

SEQ ID NO: 449370 - protein, 9 aa, Homo Sapiens
ILKYLENTV

SEQ ID NO: 449371 - protein, 9 aa, Homo Sapiens
CTKADNARM

SEQ ID NO: 449372 - protein, 9 aa, Homo Sapiens
SPSAPSTLA

SEQ ID NO: 449373 - protein, 9 aa, Homo Sapiens
VAELSSDAF

SEQ ID NO: 449374 - protein, 9 aa, Homo Sapiens
QTCSWQSQS

SEQ ID NO: 449375 - protein, 9 aa, Homo Sapiens
HMSSKGMEH

SEQ ID NO: 449376 - protein, 9 aa, Homo Sapiens
ANVSLPGIR

SEQ ID NO: 449377 - protein, 9 aa, Homo Sapiens
IINVKQFFL

SEQ ID NO: 449378 - protein, 9 aa, Homo Sapiens
LSQTELGHK

SEQ ID NO: 449379 - protein, 9 aa, Homo Sapiens
PHQFYVADV

SEQ ID NO: 449380 - protein, 9 aa, Homo Sapiens
GRIILENYH

SEQ ID NO: 449381 - protein, 9 aa, Homo Sapiens
VLGNLIFGY

SEQ ID NO: 449382 - protein, 9 aa, Homo Sapiens
GKRGQKEML

SEQ ID NO: 449383 - protein, 9 aa, Homo Sapiens
WEECSNMFP

SEQ ID NO: 449384 - protein, 9 aa, Homo Sapiens
FISYYTSYQ

SEQ ID NO: 449385 - protein, 9 aa, Homo Sapiens
EQVKTVRFQ

SEQ ID NO: 449386 - protein, 9 aa, Homo Sapiens
KLNIRGCEV

SEQ ID NO: 449387 - protein, 9 aa, Homo Sapiens
DSTSATVLG

SEQ ID NO: 449388 - protein, 9 aa, Homo Sapiens
TFQPWELLG

SEQ ID NO: 449389 - protein, 9 aa, Homo Sapiens
PEFILVGYV

SEQ ID NO: 449390 - protein, 9 aa, Homo Sapiens
QFNMPTNIT

SEQ ID NO: 449391 - protein, 9 aa, Homo Sapiens
KRDRMVRSL

SEQ ID NO: 449392 - protein, 9 aa, Homo Sapiens
GVATDGAVH

SEQ ID NO: 449393 - protein, 9 aa, Homo Sapiens
ESCIRDVHE

SEQ ID NO: 449394 - protein, 9 aa, Homo Sapiens
TEMENNNLL

SEQ ID NO: 449395 - protein, 9 aa, Homo Sapiens
RNLEGDEDS

SEQ ID NO: 449396 - protein, 9 aa, Homo Sapiens
SSNNKTMSK

SEQ ID NO: 449397 - protein, 9 aa, Homo Sapiens
FILEKGADV

SEQ ID NO: 449398 - protein, 9 aa, Homo Sapiens
RTFFAYQRQ

SEQ ID NO: 449399 - protein, 9 aa, Homo Sapiens
RSHRLLGVC

SEQ ID NO: 449400 - protein, 9 aa, Homo Sapiens
GTNNIIGQP

SEQ ID NO: 449401 - protein, 9 aa, Homo Sapiens
RTAAENEVV

SEQ ID NO: 449402 - protein, 9 aa, Homo Sapiens
NKGNTEEAG

SEQ ID NO: 449403 - protein, 9 aa, Homo Sapiens
KQNEDDEVP

SEQ ID NO: 449404 - protein, 9 aa, Homo Sapiens
CILQMHFFH

SEQ ID NO: 449405 - protein, 9 aa, Homo Sapiens
FRISQATDL

SEQ ID NO: 449406 - protein, 9 aa, Homo Sapiens
KHNKIHTVD

SEQ ID NO: 449407 - protein, 9 aa, Homo Sapiens
MQPQQQCWS

SEQ ID NO: 449408 - protein, 9 aa, Homo Sapiens
NQTIFVQVS

SEQ ID NO: 449409 - protein, 9 aa, Homo Sapiens
YGTLLYTMR

SEQ ID NO: 449410 - protein, 9 aa, Homo Sapiens
HCVVNYTKP

SEQ ID NO: 449411 - protein, 9 aa, Homo Sapiens
HQCSAPANL

SEQ ID NO: 449412 - protein, 9 aa, Homo Sapiens
AEKKAISIL

SEQ ID NO: 449413 - protein, 9 aa, Homo Sapiens
KLFNEMAER

SEQ ID NO: 449414 - protein, 9 aa, Homo Sapiens
RLFSADWKR

SEQ ID NO: 449415 - protein, 9 aa, Homo Sapiens
PLLTFRAIT

SEQ ID NO: 449416 - protein, 9 aa, Homo Sapiens
SFDIGNLLV

SEQ ID NO: 449417 - protein, 9 aa, Homo Sapiens
TKNPARTVN

SEQ ID NO: 449418 - protein, 9 aa, Homo Sapiens
YKQTCIRIG

SEQ ID NO: 449419 - protein, 9 aa, Homo Sapiens
TSKNWQENQ

SEQ ID NO: 449420 - protein, 9 aa, Homo Sapiens
EEGIQYLDG

SEQ ID NO: 449421 - protein, 9 aa, Homo Sapiens
TQPSDQGVI

SEQ ID NO: 449422 - protein, 9 aa, Homo Sapiens
EKITLWKDS

SEQ ID NO: 449423 - protein, 9 aa, Homo Sapiens
LEGHQTLFI

SEQ ID NO: 449424 - protein, 9 aa, Homo Sapiens
LQEGCCHPI

SEQ ID NO: 449425 - protein, 9 aa, Homo Sapiens
VLDIFWVGA

SEQ ID NO: 449426 - protein, 9 aa, Homo Sapiens
STEASSPHP

SEQ ID NO: 449427 - protein, 9 aa, Homo Sapiens
CGKAFHQKT

SEQ ID NO: 449428 - protein, 9 aa, Homo Sapiens
PRTIGMSLA

SEQ ID NO: 449429 - protein, 9 aa, Homo Sapiens
ICIDEVDSL

SEQ ID NO: 449430 - protein, 9 aa, Homo Sapiens
ALAFLYEAM

SEQ ID NO: 449431 - protein, 9 aa, Homo Sapiens
DIGKEMHII

SEQ ID NO: 449432 - protein, 9 aa, Homo Sapiens
VCGANPWIK

SEQ ID NO: 449433 - protein, 9 aa, Homo Sapiens
DIVLDSKLD

SEQ ID NO: 449434 - protein, 9 aa, Homo Sapiens
HLQLYKKLY

SEQ ID NO: 449435 - protein, 9 aa, Homo Sapiens
VSCKVSACP

SEQ ID NO: 449436 - protein, 9 aa, Homo Sapiens
IHHKGHRPE

SEQ ID NO: 449437 - protein, 9 aa, Homo Sapiens
KALHAFQGY

SEQ ID NO: 449438 - protein, 9 aa, Homo Sapiens
QIKYKSSAK

SEQ ID NO: 449439 - protein, 9 aa, Homo Sapiens
KVANVSVDH

SEQ ID NO: 449440 - protein, 9 aa, Homo Sapiens
TSEKGRFTS

SEQ ID NO: 449441 - protein, 9 aa, Homo Sapiens
GDTWCEQKL

SEQ ID NO: 449442 - protein, 9 aa, Homo Sapiens
IDSVHITMG

SEQ ID NO: 449443 - protein, 9 aa, Homo Sapiens
KGNEVTVEQ

SEQ ID NO: 449444 - protein, 9 aa, Homo Sapiens
SEFVGWRKF

SEQ ID NO: 449445 - protein, 9 aa, Homo Sapiens
RKLLKCPMN

SEQ ID NO: 449446 - protein, 9 aa, Homo Sapiens
RAKAMNTKE

SEQ ID NO: 449447 - protein, 9 aa, Homo Sapiens
TNRVLKYPK

SEQ ID NO: 449448 - protein, 9 aa, Homo Sapiens
RLPAVCKVN

SEQ ID NO: 449449 - protein, 9 aa, Homo Sapiens
TRIELLKGN

SEQ ID NO: 449450 - protein, 9 aa, Homo Sapiens
LLEHRDVIG

SEQ ID NO: 449451 - protein, 9 aa, Homo Sapiens
KEVITLNAT

SEQ ID NO: 449452 - protein, 9 aa, Homo Sapiens
NTKMRSSNL

SEQ ID NO: 449453 - protein, 9 aa, Homo Sapiens
KLTKLKMPY

SEQ ID NO: 449454 - protein, 9 aa, Homo Sapiens
SIQIHERIN

SEQ ID NO: 449455 - protein, 9 aa, Homo Sapiens
NVASLTQPS

SEQ ID NO: 449456 - protein, 9 aa, Homo Sapiens
AHCRGGWTP

SEQ ID NO: 449457 - protein, 9 aa, Homo Sapiens
THTGIKPYA

SEQ ID NO: 449458 - protein, 9 aa, Homo Sapiens
LFEALTKTQ

SEQ ID NO: 449459 - protein, 9 aa, Homo Sapiens
LHVQGVIHR

SEQ ID NO: 449460 - protein, 9 aa, Homo Sapiens
ISLSECNIQ

SEQ ID NO: 449461 - protein, 9 aa, Homo Sapiens
LLTLDLDYT

SEQ ID NO: 449462 - protein, 9 aa, Homo Sapiens
GLATLFEEL

SEQ ID NO: 449463 - protein, 9 aa, Homo Sapiens
TKYLEIIYS

SEQ ID NO: 449464 - protein, 9 aa, Homo Sapiens
REATSEIKD

SEQ ID NO: 449465 - protein, 9 aa, Homo Sapiens
TSSENYGRR

SEQ ID NO: 449466 - protein, 9 aa, Homo Sapiens
RLSEIWITH

SEQ ID NO: 449467 - protein, 9 aa, Homo Sapiens
TQQNHAMKS

SEQ ID NO: 449468 - protein, 9 aa, Homo Sapiens
KHFCSHLGV

SEQ ID NO: 449469 - protein, 9 aa, Homo Sapiens
QKLPNGLKA

SEQ ID NO: 449470 - protein, 9 aa, Homo Sapiens
PVLAASQPE

SEQ ID NO: 449471 - protein, 9 aa, Homo Sapiens
TAMSNRETG

SEQ ID NO: 449472 - protein, 9 aa, Homo Sapiens
VSSFAFGPF

SEQ ID NO: 449473 - protein, 9 aa, Homo Sapiens
PWASLDAET

SEQ ID NO: 449474 - protein, 9 aa, Homo Sapiens
HLLLIIKGL

SEQ ID NO: 449475 - protein, 9 aa, Homo Sapiens
VIWIQPQSS

SEQ ID NO: 449476 - protein, 9 aa, Homo Sapiens
GVDSGGSTT

SEQ ID NO: 449477 - protein, 9 aa, Homo Sapiens
GGEMSSLAG

SEQ ID NO: 449478 - protein, 9 aa, Homo Sapiens
QGICGDKGE

SEQ ID NO: 449479 - protein, 9 aa, Homo Sapiens
WGDPGVIKV

SEQ ID NO: 449480 - protein, 9 aa, Homo Sapiens
YKQEGLNKI

SEQ ID NO: 449481 - protein, 9 aa, Homo Sapiens
PLIERDRRR

SEQ ID NO: 449482 - protein, 9 aa, Homo Sapiens
GSKRGIYSR

SEQ ID NO: 449483 - protein, 9 aa, Homo Sapiens
QSRDEERIS

SEQ ID NO: 449484 - protein, 9 aa, Homo Sapiens
SNIDEILEP

SEQ ID NO: 449485 - protein, 9 aa, Homo Sapiens
GIGRHALDE

SEQ ID NO: 449486 - protein, 9 aa, Homo Sapiens
NESKKGILY

SEQ ID NO: 449487 - protein, 9 aa, Homo Sapiens
PQNSPGLLV

SEQ ID NO: 449488 - protein, 9 aa, Homo Sapiens
VHHRRPPHN

SEQ ID NO: 449489 - protein, 9 aa, Homo Sapiens
EQFDPGLRN

SEQ ID NO: 449490 - protein, 9 aa, Homo Sapiens
YCPHAKFIM

SEQ ID NO: 449491 - protein, 9 aa, Homo Sapiens
MLGYACQVN

SEQ ID NO: 449492 - protein, 9 aa, Homo Sapiens
KTTCAINKV

SEQ ID NO: 449493 - protein, 9 aa, Homo Sapiens
TDYDNEEFL

SEQ ID NO: 449494 - protein, 9 aa, Homo Sapiens
EERRSKKGP

SEQ ID NO: 449495 - protein, 9 aa, Homo Sapiens
VTQSCLMSI

SEQ ID NO: 449496 - protein, 9 aa, Homo Sapiens
SLSNHHRVH

SEQ ID NO: 449497 - protein, 9 aa, Homo Sapiens
PIDIGPSPG

SEQ ID NO: 449498 - protein, 9 aa, Homo Sapiens
TVYVAEIGA

SEQ ID NO: 449499 - protein, 9 aa, Homo Sapiens
ETVQTLYLS

SEQ ID NO: 449500 - protein, 9 aa, Homo Sapiens
AGELQQPGI

SEQ ID NO: 449501 - protein, 9 aa, Homo Sapiens
FHVNCSNIT

SEQ ID NO: 449502 - protein, 9 aa, Homo Sapiens
LLLQALNGF

SEQ ID NO: 449503 - protein, 9 aa, Homo Sapiens
IAMEVLDQL

SEQ ID NO: 449504 - protein, 9 aa, Homo Sapiens
YIVCKNNKK

SEQ ID NO: 449505 - protein, 9 aa, Homo Sapiens
VKKEPIKDG

SEQ ID NO: 449506 - protein, 9 aa, Homo Sapiens
DYFFHKRYW

SEQ ID NO: 449507 - protein, 9 aa, Homo Sapiens
SWIYILCKN

SEQ ID NO: 449508 - protein, 9 aa, Homo Sapiens
PKSEIQNRL

SEQ ID NO: 449509 - protein, 9 aa, Homo Sapiens
PIPGQFTCP

SEQ ID NO: 449510 - protein, 9 aa, Homo Sapiens
TNRSLKEED

SEQ ID NO: 449511 - protein, 9 aa, Homo Sapiens
IKYNRKMSA

SEQ ID NO: 449512 - protein, 9 aa, Homo Sapiens
VGILNQLNS

SEQ ID NO: 449513 - protein, 9 aa, Homo Sapiens
LMAYISKAQ

SEQ ID NO: 449514 - protein, 9 aa, Homo Sapiens
LIGVGEEVG

SEQ ID NO: 449515 - protein, 9 aa, Homo Sapiens
EENASISSI

SEQ ID NO: 449516 - protein, 9 aa, Homo Sapiens
HEANSEWFE

SEQ ID NO: 449517 - protein, 9 aa, Homo Sapiens
NEAWKEADK

SEQ ID NO: 449518 - protein, 9 aa, Homo Sapiens
RSPTKTPHL

SEQ ID NO: 449519 - protein, 9 aa, Homo Sapiens
DFTKIESNT

SEQ ID NO: 449520 - protein, 9 aa, Homo Sapiens
EEITRFLSM

SEQ ID NO: 449521 - protein, 9 aa, Homo Sapiens
LRSEGAELN

SEQ ID NO: 449522 - protein, 9 aa, Homo Sapiens
IFLLCMNLY

SEQ ID NO: 449523 - protein, 9 aa, Homo Sapiens
KWQLEQSIR

SEQ ID NO: 449524 - protein, 9 aa, Homo Sapiens
GPPKYFVLA

SEQ ID NO: 449525 - protein, 9 aa, Homo Sapiens
ILDQMRKMS

SEQ ID NO: 449526 - protein, 9 aa, Homo Sapiens
LLLNCFPSY

SEQ ID NO: 449527 - protein, 9 aa, Homo Sapiens
GWRKFLLVT

SEQ ID NO: 449528 - protein, 9 aa, Homo Sapiens
MEVINKSIV

SEQ ID NO: 449529 - protein, 9 aa, Homo Sapiens
TDGKEEANK

SEQ ID NO: 449530 - protein, 9 aa, Homo Sapiens
WENDFVSAK

SEQ ID NO: 449531 - protein, 9 aa, Homo Sapiens
AVTYLTGVS

SEQ ID NO: 449532 - protein, 9 aa, Homo Sapiens
IDKPQVIEV

SEQ ID NO: 449533 - protein, 9 aa, Homo Sapiens
AYDNWGECT

SEQ ID NO: 449534 - protein, 9 aa, Homo Sapiens
RDIHCEFCG

SEQ ID NO: 449535 - protein, 9 aa, Homo Sapiens
TSTEASSPH

SEQ ID NO: 449536 - protein, 9 aa, Homo Sapiens
GDRTMLDYL

SEQ ID NO: 449537 - protein, 9 aa, Homo Sapiens
PGDRTMLDY

SEQ ID NO: 449538 - protein, 9 aa, Homo Sapiens
PGQIALPKP

SEQ ID NO: 449539 - protein, 9 aa, Homo Sapiens
NRLFLEYLT

SEQ ID NO: 449540 - protein, 9 aa, Homo Sapiens
FLANLPFLE

SEQ ID NO: 449541 - protein, 9 aa, Homo Sapiens
NQLGNTRYG

SEQ ID NO: 449542 - protein, 9 aa, Homo Sapiens
EGDPERHYK

SEQ ID NO: 449543 - protein, 9 aa, Homo Sapiens
TDLFKSGAA

SEQ ID NO: 449544 - protein, 9 aa, Homo Sapiens
NDNRVQHKQ

SEQ ID NO: 449545 - protein, 9 aa, Homo Sapiens
EVNDLPRAV

SEQ ID NO: 449546 - protein, 9 aa, Homo Sapiens
SQADREFQL

SEQ ID NO: 449547 - protein, 9 aa, Homo Sapiens
RRQNRRRLF

SEQ ID NO: 449548 - protein, 9 aa, Homo Sapiens
DKQQEGGIV

SEQ ID NO: 449549 - protein, 9 aa, Homo Sapiens
HLYEIMRKQ

SEQ ID NO: 449550 - protein, 9 aa, Homo Sapiens
YLYDRLRLH

SEQ ID NO: 449551 - protein, 9 aa, Homo Sapiens
YYLQQGSHP

SEQ ID NO: 449552 - protein, 9 aa, Homo Sapiens
KKEEASQNL

SEQ ID NO: 449553 - protein, 8 aa, Homo Sapiens
TLAASSQR

SEQ ID NO: 449554 - protein, 9 aa, Homo Sapiens
EELDQENKK

SEQ ID NO: 449555 - protein, 9 aa, Homo Sapiens
GHPQDTYYP

SEQ ID NO: 449556 - protein, 9 aa, Homo Sapiens
FELCDQDLK

SEQ ID NO: 449557 - protein, 9 aa, Homo Sapiens
DGEYKCGAR

SEQ ID NO: 449558 - protein, 9 aa, Homo Sapiens
IIWLKGVIF

SEQ ID NO: 449559 - protein, 9 aa, Homo Sapiens
KEECVQGEV

SEQ ID NO: 449560 - protein, 9 aa, Homo Sapiens
KYNCIGLSQ

SEQ ID NO: 449561 - protein, 9 aa, Homo Sapiens
IMSLAILSF

SEQ ID NO: 449562 - protein, 9 aa, Homo Sapiens
EREYNCQMC

SEQ ID NO: 449563 - protein, 9 aa, Homo Sapiens
CYSGLKYSM

SEQ ID NO: 449564 - protein, 9 aa, Homo Sapiens
DWEECSNMF

SEQ ID NO: 449565 - protein, 9 aa, Homo Sapiens
FTCVILEMQ

SEQ ID NO: 449566 - protein, 9 aa, Homo Sapiens
YARHQKIHT

SEQ ID NO: 449567 - protein, 9 aa, Homo Sapiens
LHNWLLLNQ

SEQ ID NO: 449568 - protein, 9 aa, Homo Sapiens
DLRWYRLSD

SEQ ID NO: 449569 - protein, 9 aa, Homo Sapiens
LGNGTIIFI

SEQ ID NO: 449570 - protein, 9 aa, Homo Sapiens
EVVKGRGPN

SEQ ID NO: 449571 - protein, 9 aa, Homo Sapiens
GFICYPVPI

SEQ ID NO: 449572 - protein, 9 aa, Homo Sapiens
DLEAAVADV

SEQ ID NO: 449573 - protein, 9 aa, Homo Sapiens
ENYVSRPHR

SEQ ID NO: 449574 - protein, 9 aa, Homo Sapiens
SEYLLCVKR

SEQ ID NO: 449575 - protein, 9 aa, Homo Sapiens
PHSNSWAEI

SEQ ID NO: 449576 - protein, 9 aa, Homo Sapiens
LLRRVWKKH

SEQ ID NO: 449577 - protein, 9 aa, Homo Sapiens
ITSQINLID

SEQ ID NO: 449578 - protein, 9 aa, Homo Sapiens
RGCSCQMVV

SEQ ID NO: 449579 - protein, 9 aa, Homo Sapiens
KYSSSPDDA

SEQ ID NO: 449580 - protein, 9 aa, Homo Sapiens
MYKLLCQQH

SEQ ID NO: 449581 - protein, 9 aa, Homo Sapiens
PQDPSFGDT

SEQ ID NO: 449582 - protein, 9 aa, Homo Sapiens
SSQYLFKLL

SEQ ID NO: 449583 - protein, 9 aa, Homo Sapiens
AHLNLHINF

SEQ ID NO: 449584 - protein, 9 aa, Homo Sapiens
QVTTPEPDI

SEQ ID NO: 449585 - protein, 9 aa, Homo Sapiens
RATRYRMID

SEQ ID NO: 449586 - protein, 9 aa, Homo Sapiens
EGNNLSRKR

SEQ ID NO: 449587 - protein, 9 aa, Homo Sapiens
LMHFYFLDP

SEQ ID NO: 449588 - protein, 9 aa, Homo Sapiens
PGDKGKPKN

SEQ ID NO: 449589 - protein, 9 aa, Homo Sapiens
DPEILFNVL

SEQ ID NO: 449590 - protein, 9 aa, Homo Sapiens
EAACSKCFA

SEQ ID NO: 449591 - protein, 9 aa, Homo Sapiens
RTIQQKLVV

SEQ ID NO: 449592 - protein, 9 aa, Homo Sapiens
GGSTTVDFH

SEQ ID NO: 449593 - protein, 9 aa, Homo Sapiens
IQWMSPYLF

SEQ ID NO: 449594 - protein, 9 aa, Homo Sapiens
IRSISIVSQ

SEQ ID NO: 449595 - protein, 9 aa, Homo Sapiens
DIKYNRKMS

SEQ ID NO: 449596 - protein, 9 aa, Homo Sapiens
CSTLPVLAA

SEQ ID NO: 449597 - protein, 9 aa, Homo Sapiens
SENIPFSPS

SEQ ID NO: 449598 - protein, 9 aa, Homo Sapiens
CNTCRKDCI

SEQ ID NO: 449599 - protein, 9 aa, Homo Sapiens
SITVFAAEI

SEQ ID NO: 449600 - protein, 9 aa, Homo Sapiens
EYKAIMCNR

SEQ ID NO: 449601 - protein, 9 aa, Homo Sapiens
SEQGTSFSH

SEQ ID NO: 449602 - protein, 9 aa, Homo Sapiens
IFEVIEFDD

SEQ ID NO: 449603 - protein, 9 aa, Homo Sapiens
AAQIIGSDT

SEQ ID NO: 449604 - protein, 9 aa, Homo Sapiens
KESFTQNNI

SEQ ID NO: 449605 - protein, 9 aa, Homo Sapiens
TPNYKGKYV

SEQ ID NO: 449606 - protein, 9 aa, Homo Sapiens
NPSHAEHHD

SEQ ID NO: 449607 - protein, 9 aa, Homo Sapiens
KTIKICKNS

SEQ ID NO: 449608 - protein, 9 aa, Homo Sapiens
LGLMRCDKG

SEQ ID NO: 449609 - protein, 9 aa, Homo Sapiens
PSALGTTIR

SEQ ID NO: 449610 - protein, 9 aa, Homo Sapiens
FFVTGCDAC

SEQ ID NO: 449611 - protein, 9 aa, Homo Sapiens
RNSGVNGQV

SEQ ID NO: 449612 - protein, 9 aa, Homo Sapiens
TEFFILAVM

SEQ ID NO: 449613 - protein, 9 aa, Homo Sapiens
GVRGMYKLL

SEQ ID NO: 449614 - protein, 9 aa, Homo Sapiens
LERTFFAYQ

SEQ ID NO: 449615 - protein, 9 aa, Homo Sapiens
REKKDAYVF

SEQ ID NO: 449616 - protein, 9 aa, Homo Sapiens
FLNPTDYDN

SEQ ID NO: 449617 - protein, 9 aa, Homo Sapiens
HHDQNSVAC

SEQ ID NO: 449618 - protein, 9 aa, Homo Sapiens
NVITMQTLV

SEQ ID NO: 449619 - protein, 9 aa, Homo Sapiens
LEDLERTFF

SEQ ID NO: 449620 - protein, 9 aa, Homo Sapiens
ESLYPEVTP

SEQ ID NO: 449621 - protein, 9 aa, Homo Sapiens
QTFFKITAP

SEQ ID NO: 449622 - protein, 9 aa, Homo Sapiens
GIPGLPGDK

SEQ ID NO: 449623 - protein, 9 aa, Homo Sapiens
SQLQAGAGY

SEQ ID NO: 449624 - protein, 9 aa, Homo Sapiens
WHAGQTIND

SEQ ID NO: 449625 - protein, 9 aa, Homo Sapiens
CSYKTSKRF

SEQ ID NO: 449626 - protein, 9 aa, Homo Sapiens
DKRFQCKES

SEQ ID NO: 449627 - protein, 9 aa, Homo Sapiens
AASSSSVTY

SEQ ID NO: 449628 - protein, 9 aa, Homo Sapiens
DNSLSLNTP

SEQ ID NO: 449629 - protein, 9 aa, Homo Sapiens
AQYFVKLRI

SEQ ID NO: 449630 - protein, 9 aa, Homo Sapiens
PYVKASAAW

SEQ ID NO: 449631 - protein, 9 aa, Homo Sapiens
LLYGDIIQQ

SEQ ID NO: 449632 - protein, 9 aa, Homo Sapiens
CDISTLTEL

SEQ ID NO: 449633 - protein, 9 aa, Homo Sapiens
IIHHIIHTG

SEQ ID NO: 449634 - protein, 9 aa, Homo Sapiens
NVKYYFECS

SEQ ID NO: 449635 - protein, 9 aa, Homo Sapiens
VIMERLDKL

SEQ ID NO: 449636 - protein, 9 aa, Homo Sapiens
LEGLCVEKI

SEQ ID NO: 449637 - protein, 9 aa, Homo Sapiens
MSVDKCVNF

SEQ ID NO: 449638 - protein, 9 aa, Homo Sapiens
FYFLDPPPY

SEQ ID NO: 449639 - protein, 9 aa, Homo Sapiens
KENKVLTYS

SEQ ID NO: 449640 - protein, 9 aa, Homo Sapiens
LFQIRTTAA

SEQ ID NO: 449641 - protein, 9 aa, Homo Sapiens
NFIKNMITG

SEQ ID NO: 449642 - protein, 9 aa, Homo Sapiens
VHTEISPYK

SEQ ID NO: 449643 - protein, 9 aa, Homo Sapiens
QSIGKQNFL

SEQ ID NO: 449644 - protein, 9 aa, Homo Sapiens
IFLFGVYVA

SEQ ID NO: 449645 - protein, 9 aa, Homo Sapiens
QRNCEGMIQ

SEQ ID NO: 449646 - protein, 9 aa, Homo Sapiens
SFVAFAGFY

SEQ ID NO: 449647 - protein, 9 aa, Homo Sapiens
GEGLAHMEL

SEQ ID NO: 449648 - protein, 9 aa, Homo Sapiens
HRSHRLLGV

SEQ ID NO: 449649 - protein, 9 aa, Homo Sapiens
IEAHLNSWN

SEQ ID NO: 449650 - protein, 9 aa, Homo Sapiens
SIIAGFCFL

SEQ ID NO: 449651 - protein, 9 aa, Homo Sapiens
YFLGAYKLQ

SEQ ID NO: 449652 - protein, 9 aa, Homo Sapiens
PLARAESYS

SEQ ID NO: 449653 - protein, 9 aa, Homo Sapiens
IDKRVDCSS

SEQ ID NO: 449654 - protein, 9 aa, Homo Sapiens
EIYSTDYYR

SEQ ID NO: 449655 - protein, 9 aa, Homo Sapiens
RIVADLDTM

SEQ ID NO: 449656 - protein, 9 aa, Homo Sapiens
MLWKKLIEQ

SEQ ID NO: 449657 - protein, 9 aa, Homo Sapiens
VIQVSPFIL

SEQ ID NO: 449658 - protein, 9 aa, Homo Sapiens
SSRCGHYYD

SEQ ID NO: 449659 - protein, 9 aa, Homo Sapiens
IVTLDEFIE

SEQ ID NO: 449660 - protein, 9 aa, Homo Sapiens
RTAVAAAAP

SEQ ID NO: 449661 - protein, 9 aa, Homo Sapiens
KDVQKRRQV

SEQ ID NO: 449662 - protein, 9 aa, Homo Sapiens
DKASEKKDQ

SEQ ID NO: 449663 - protein, 9 aa, Homo Sapiens
CEIRNPVSV

SEQ ID NO: 449664 - protein, 9 aa, Homo Sapiens
CVKTSLTRH

SEQ ID NO: 449665 - protein, 9 aa, Homo Sapiens
NINDIFEDK

SEQ ID NO: 449666 - protein, 9 aa, Homo Sapiens
FNHRSHLKQ

SEQ ID NO: 449667 - protein, 9 aa, Homo Sapiens
CMAISIPNR

SEQ ID NO: 449668 - protein, 9 aa, Homo Sapiens
KVNEAKITQ

SEQ ID NO: 449669 - protein, 9 aa, Homo Sapiens
KPVPEELEG

SEQ ID NO: 449670 - protein, 9 aa, Homo Sapiens
SEESYNVNE

SEQ ID NO: 449671 - protein, 9 aa, Homo Sapiens
QQKLPNGLK

SEQ ID NO: 449672 - protein, 9 aa, Homo Sapiens
PQEENNFYL

SEQ ID NO: 449673 - protein, 9 aa, Homo Sapiens
NFNFSIWYV

SEQ ID NO: 449674 - protein, 9 aa, Homo Sapiens
IFMDEIYAI

SEQ ID NO: 449675 - protein, 9 aa, Homo Sapiens
DYRIRAQKK

SEQ ID NO: 449676 - protein, 9 aa, Homo Sapiens
EASQNLSTP

SEQ ID NO: 449677 - protein, 9 aa, Homo Sapiens
PTFMCLVLH

SEQ ID NO: 449678 - protein, 9 aa, Homo Sapiens
KDASSLESY

SEQ ID NO: 449679 - protein, 9 aa, Homo Sapiens
SCLLLITAV

SEQ ID NO: 449680 - protein, 9 aa, Homo Sapiens
QVCKTCYRI

SEQ ID NO: 449681 - protein, 9 aa, Homo Sapiens
VLRSPPQPE

SEQ ID NO: 449682 - protein, 9 aa, Homo Sapiens
ELYDPLKEK

SEQ ID NO: 449683 - protein, 9 aa, Homo Sapiens
DMLKELTEI

SEQ ID NO: 449684 - protein, 9 aa, Homo Sapiens
TYQSKGLLP

SEQ ID NO: 449685 - protein, 9 aa, Homo Sapiens
VAVNFTQDE

SEQ ID NO: 449686 - protein, 9 aa, Homo Sapiens
TPPKSEQFS

SEQ ID NO: 449687 - protein, 9 aa, Homo Sapiens
ETMKDKQEL

SEQ ID NO: 449688 - protein, 9 aa, Homo Sapiens
ASCKDLCGG

SEQ ID NO: 449689 - protein, 9 aa, Homo Sapiens
HQHVTKPSP

SEQ ID NO: 449690 - protein, 9 aa, Homo Sapiens
WSWLWAPPS

SEQ ID NO: 449691 - protein, 9 aa, Homo Sapiens
LVLQSFKVM

SEQ ID NO: 449692 - protein, 9 aa, Homo Sapiens
CKRINVITM

SEQ ID NO: 449693 - protein, 9 aa, Homo Sapiens
VTLSNIMNY

SEQ ID NO: 449694 - protein, 9 aa, Homo Sapiens
FGPFGVFLV

SEQ ID NO: 449695 - protein, 9 aa, Homo Sapiens
LYDPLKEKW

SEQ ID NO: 449696 - protein, 9 aa, Homo Sapiens
LLQGTRARC

SEQ ID NO: 449697 - protein, 9 aa, Homo Sapiens
SLYISPSGE

SEQ ID NO: 449698 - protein, 9 aa, Homo Sapiens
FTRKRLHKW

SEQ ID NO: 449699 - protein, 9 aa, Homo Sapiens
SVSDILVAW

SEQ ID NO: 449700 - protein, 9 aa, Homo Sapiens
LKQAQHQIK

SEQ ID NO: 449701 - protein, 9 aa, Homo Sapiens
VLNNSKCYH

SEQ ID NO: 449702 - protein, 9 aa, Homo Sapiens
ALGNSRVTY

SEQ ID NO: 449703 - protein, 9 aa, Homo Sapiens
PSDRYPQCM

SEQ ID NO: 449704 - protein, 9 aa, Homo Sapiens
QNSPLTNQL

SEQ ID NO: 449705 - protein, 9 aa, Homo Sapiens
PRTGHQIRK

SEQ ID NO: 449706 - protein, 9 aa, Homo Sapiens
YYCDHNFVT

SEQ ID NO: 449707 - protein, 9 aa, Homo Sapiens
IIVVECMMK

SEQ ID NO: 449708 - protein, 9 aa, Homo Sapiens
VRWMAPEPL

SEQ ID NO: 449709 - protein, 9 aa, Homo Sapiens
ENNRPRRRF

SEQ ID NO: 449710 - protein, 9 aa, Homo Sapiens
LVTFTWNTL

SEQ ID NO: 449711 - protein, 9 aa, Homo Sapiens
EDIDTVMKL

SEQ ID NO: 449712 - protein, 9 aa, Homo Sapiens
RSRVGSPQS

SEQ ID NO: 449713 - protein, 9 aa, Homo Sapiens
DTFTTLVDL

SEQ ID NO: 449714 - protein, 9 aa, Homo Sapiens
IMADKVLWV

SEQ ID NO: 449715 - protein, 9 aa, Homo Sapiens
ALMLNKRIV

SEQ ID NO: 449716 - protein, 9 aa, Homo Sapiens
EILANNQGN

SEQ ID NO: 449717 - protein, 9 aa, Homo Sapiens
GNTTENINN

SEQ ID NO: 449718 - protein, 9 aa, Homo Sapiens
AQNNPTAFY

SEQ ID NO: 449719 - protein, 9 aa, Homo Sapiens
QRVNLDTMC

SEQ ID NO: 449720 - protein, 9 aa, Homo Sapiens
NMDGGDWSF

SEQ ID NO: 449721 - protein, 9 aa, Homo Sapiens
GKKVKALDI

SEQ ID NO: 449722 - protein, 9 aa, Homo Sapiens
KSCEKVVKL

SEQ ID NO: 449723 - protein, 9 aa, Homo Sapiens
EEDHIIFWL

SEQ ID NO: 449724 - protein, 9 aa, Homo Sapiens
NAALAQATR

SEQ ID NO: 449725 - protein, 9 aa, Homo Sapiens
NRIPSLHRL

SEQ ID NO: 449726 - protein, 9 aa, Homo Sapiens
WWYSSENQD

SEQ ID NO: 449727 - protein, 9 aa, Homo Sapiens
KLKAILKPM

SEQ ID NO: 449728 - protein, 9 aa, Homo Sapiens
SEHLSVVDA

SEQ ID NO: 449729 - protein, 9 aa, Homo Sapiens
TFDGRHFDF

SEQ ID NO: 449730 - protein, 9 aa, Homo Sapiens
RQGAVVVTS

SEQ ID NO: 449731 - protein, 9 aa, Homo Sapiens
HYKDPYSYD

SEQ ID NO: 449732 - protein, 9 aa, Homo Sapiens
SGLPAPVVS

SEQ ID NO: 449733 - protein, 9 aa, Homo Sapiens
VRLNRYEMI

SEQ ID NO: 449734 - protein, 9 aa, Homo Sapiens
PEEAILSVF

SEQ ID NO: 449735 - protein, 9 aa, Homo Sapiens
FLKYEDMHW

SEQ ID NO: 449736 - protein, 9 aa, Homo Sapiens
KATHQKEFN

SEQ ID NO: 449737 - protein, 9 aa, Homo Sapiens
QRTHPEKKY

SEQ ID NO: 449738 - protein, 9 aa, Homo Sapiens
TQGINSATP

SEQ ID NO: 449739 - protein, 9 aa, Homo Sapiens
IIDHYKWHK

SEQ ID NO: 449740 - protein, 9 aa, Homo Sapiens
LRPKGLDEA

SEQ ID NO: 449741 - protein, 9 aa, Homo Sapiens
PFFIIFTAG

SEQ ID NO: 449742 - protein, 9 aa, Homo Sapiens
FYINKINPL

SEQ ID NO: 449743 - protein, 9 aa, Homo Sapiens
KEIAQTVQI

SEQ ID NO: 449744 - protein, 9 aa, Homo Sapiens
RNTYREKES

SEQ ID NO: 449745 - protein, 9 aa, Homo Sapiens
CQTVAACNL

SEQ ID NO: 449746 - protein, 9 aa, Homo Sapiens
VNNPYLLTS

SEQ ID NO: 449747 - protein, 9 aa, Homo Sapiens
FSRAESKCC

SEQ ID NO: 449748 - protein, 9 aa, Homo Sapiens
YCSYKTSKR

SEQ ID NO: 449749 - protein, 9 aa, Homo Sapiens
GSTERNICN

SEQ ID NO: 449750 - protein, 9 aa, Homo Sapiens
LNVYIRLKG

SEQ ID NO: 449751 - protein, 9 aa, Homo Sapiens
PAMPSALGT

SEQ ID NO: 449752 - protein, 9 aa, Homo Sapiens
EDALSGAEF

SEQ ID NO: 449753 - protein, 9 aa, Homo Sapiens
KVTTEEFKL

SEQ ID NO: 449754 - protein, 9 aa, Homo Sapiens
IRHKIIHTE

SEQ ID NO: 449755 - protein, 9 aa, Homo Sapiens
TERGWMWNQ

SEQ ID NO: 449756 - protein, 9 aa, Homo Sapiens
AYMNQAYHA

SEQ ID NO: 449757 - protein, 9 aa, Homo Sapiens
YFKVAHLVL

SEQ ID NO: 449758 - protein, 9 aa, Homo Sapiens
YLIIMIVGE

SEQ ID NO: 449759 - protein, 9 aa, Homo Sapiens
RIVRKTFWK

SEQ ID NO: 449760 - protein, 9 aa, Homo Sapiens
VEQTCSWQS

SEQ ID NO: 449761 - protein, 9 aa, Homo Sapiens
PECRNYASE

SEQ ID NO: 449762 - protein, 9 aa, Homo Sapiens
CGKSFSVLS

SEQ ID NO: 449763 - protein, 9 aa, Homo Sapiens
CIWLQSNGI

SEQ ID NO: 449764 - protein, 9 aa, Homo Sapiens
CIVPICINS

SEQ ID NO: 449765 - protein, 9 aa, Homo Sapiens
SQMILFDDE

SEQ ID NO: 449766 - protein, 9 aa, Homo Sapiens
KSGWGQRIA

SEQ ID NO: 449767 - protein, 9 aa, Homo Sapiens
LHTQSSDKT

SEQ ID NO: 449768 - protein, 9 aa, Homo Sapiens
PKHYRPPKG

SEQ ID NO: 449769 - protein, 9 aa, Homo Sapiens
HENVHTLDT

SEQ ID NO: 449770 - protein, 9 aa, Homo Sapiens
NIKHMENKP

SEQ ID NO: 449771 - protein, 9 aa, Homo Sapiens
PMVLVGNNC

SEQ ID NO: 449772 - protein, 9 aa, Homo Sapiens
INLVSFCRT

SEQ ID NO: 449773 - protein, 9 aa, Homo Sapiens
INEIQRIAE

SEQ ID NO: 449774 - protein, 9 aa, Homo Sapiens
RKEMTHKLE

SEQ ID NO: 449775 - protein, 9 aa, Homo Sapiens
SESSGYNNH

SEQ ID NO: 449776 - protein, 9 aa, Homo Sapiens
DLLVTDNFC

SEQ ID NO: 449777 - protein, 9 aa, Homo Sapiens
SHSKSRSYR

SEQ ID NO: 449778 - protein, 9 aa, Homo Sapiens
YERAQKDVA

SEQ ID NO: 449779 - protein, 9 aa, Homo Sapiens
FLIGALLTG

SEQ ID NO: 449780 - protein, 9 aa, Homo Sapiens
MSQRHVLKV

SEQ ID NO: 449781 - protein, 9 aa, Homo Sapiens
NFTASDNTS

SEQ ID NO: 449782 - protein, 9 aa, Homo Sapiens
YFQGPCHEN

SEQ ID NO: 449783 - protein, 9 aa, Homo Sapiens
TRIQEFKEA

SEQ ID NO: 449784 - protein, 9 aa, Homo Sapiens
QGYAFAAAK

SEQ ID NO: 449785 - protein, 9 aa, Homo Sapiens
PLDDTKDNL

SEQ ID NO: 449786 - protein, 9 aa, Homo Sapiens
ISRINFCRK

SEQ ID NO: 449787 - protein, 9 aa, Homo Sapiens
LYRVDRFMN

SEQ ID NO: 449788 - protein, 9 aa, Homo Sapiens
WPDSGSSAE

SEQ ID NO: 449789 - protein, 9 aa, Homo Sapiens
EKVCKLNDL

SEQ ID NO: 449790 - protein, 9 aa, Homo Sapiens
SVQGMSLPI

SEQ ID NO: 449791 - protein, 9 aa, Homo Sapiens
TAWLSITVF

SEQ ID NO: 449792 - protein, 9 aa, Homo Sapiens
EEAELYDPL

SEQ ID NO: 449793 - protein, 9 aa, Homo Sapiens
IHNSNTMRL

SEQ ID NO: 449794 - protein, 9 aa, Homo Sapiens
LIGKYAVRD

SEQ ID NO: 449795 - protein, 9 aa, Homo Sapiens
ELEHPARGK

SEQ ID NO: 449796 - protein, 9 aa, Homo Sapiens
HRCELAAAL

SEQ ID NO: 449797 - protein, 9 aa, Homo Sapiens
IVSDLEKYL

SEQ ID NO: 449798 - protein, 9 aa, Homo Sapiens
RESVMRQGC

SEQ ID NO: 449799 - protein, 9 aa, Homo Sapiens
AFPRRTQPK

SEQ ID NO: 449800 - protein, 9 aa, Homo Sapiens
NLASASAGP

SEQ ID NO: 449801 - protein, 9 aa, Homo Sapiens
TVSLQVDGK

SEQ ID NO: 449802 - protein, 9 aa, Homo Sapiens
TCCARCHVP

SEQ ID NO: 449803 - protein, 9 aa, Homo Sapiens
GLLVMKNDT

SEQ ID NO: 449804 - protein, 9 aa, Homo Sapiens
RGDKAIMED

SEQ ID NO: 449805 - protein, 9 aa, Homo Sapiens
IFNMLNTNN

SEQ ID NO: 449806 - protein, 9 aa, Homo Sapiens
PVLIIMSLA

SEQ ID NO: 449807 - protein, 9 aa, Homo Sapiens
KSKELKEGK

SEQ ID NO: 449808 - protein, 9 aa, Homo Sapiens
VLELMQKHT

SEQ ID NO: 449809 - protein, 9 aa, Homo Sapiens
TKPILGVML

SEQ ID NO: 449810 - protein, 9 aa, Homo Sapiens
GMTRRGLRD

SEQ ID NO: 449811 - protein, 9 aa, Homo Sapiens
RVFLWVFIL

SEQ ID NO: 449812 - protein, 9 aa, Homo Sapiens
CVVHKWCHE

SEQ ID NO: 449813 - protein, 9 aa, Homo Sapiens
LFKRLMIVK

SEQ ID NO: 449814 - protein, 9 aa, Homo Sapiens
HKIIHSGQK

SEQ ID NO: 449815 - protein, 9 aa, Homo Sapiens
SSVGSALPQ

SEQ ID NO: 449816 - protein, 9 aa, Homo Sapiens
GLKHITKLK

SEQ ID NO: 449817 - protein, 9 aa, Homo Sapiens
NATDVLRCV

SEQ ID NO: 449818 - protein, 9 aa, Homo Sapiens
HKKIWMFDK

SEQ ID NO: 449819 - protein, 9 aa, Homo Sapiens
GEVNNPYLL

SEQ ID NO: 449820 - protein, 9 aa, Homo Sapiens
IPFTTFTPR

SEQ ID NO: 449821 - protein, 9 aa, Homo Sapiens
RRGTRYMLS

SEQ ID NO: 449822 - protein, 9 aa, Homo Sapiens
KQIYRLSEE

SEQ ID NO: 449823 - protein, 9 aa, Homo Sapiens
STLESHKII

SEQ ID NO: 449824 - protein, 9 aa, Homo Sapiens
ALMAYISKA

SEQ ID NO: 449825 - protein, 9 aa, Homo Sapiens
EKIEKLKIQ

SEQ ID NO: 449826 - protein, 9 aa, Homo Sapiens
ALVERDYFS

SEQ ID NO: 449827 - protein, 9 aa, Homo Sapiens
YKYMSSQYL

SEQ ID NO: 449828 - protein, 9 aa, Homo Sapiens
TNPDRRCTK

SEQ ID NO: 449829 - protein, 9 aa, Homo Sapiens
GASLAAREA

SEQ ID NO: 449830 - protein, 9 aa, Homo Sapiens
HRRETLCLQ

SEQ ID NO: 449831 - protein, 9 aa, Homo Sapiens
RLKEKGKWL

SEQ ID NO: 449832 - protein, 9 aa, Homo Sapiens
NFLPRFNWD

SEQ ID NO: 449833 - protein, 9 aa, Homo Sapiens
EEEEDDDAI

SEQ ID NO: 449834 - protein, 9 aa, Homo Sapiens
GQCAGLLHG

SEQ ID NO: 449835 - protein, 9 aa, Homo Sapiens
HKNWKIKNT

SEQ ID NO: 449836 - protein, 9 aa, Homo Sapiens
YITLGVEAF

SEQ ID NO: 449837 - protein, 9 aa, Homo Sapiens
AVNKQNWQE

SEQ ID NO: 449838 - protein, 9 aa, Homo Sapiens
SSVSRSDRS

SEQ ID NO: 449839 - protein, 9 aa, Homo Sapiens
SCQGGSGGP

SEQ ID NO: 449840 - protein, 9 aa, Homo Sapiens
GLPASKMHF

SEQ ID NO: 449841 - protein, 9 aa, Homo Sapiens
SANWRASIL

SEQ ID NO: 449842 - protein, 9 aa, Homo Sapiens
TCTCGPGSR

SEQ ID NO: 449843 - protein, 9 aa, Homo Sapiens
YEVLQTLHH

SEQ ID NO: 449844 - protein, 9 aa, Homo Sapiens
ETEIIYSLF

SEQ ID NO: 449845 - protein, 9 aa, Homo Sapiens
TNTGSCCDM

SEQ ID NO: 449846 - protein, 9 aa, Homo Sapiens
FSKQVNRID

SEQ ID NO: 449847 - protein, 9 aa, Homo Sapiens
SILTKDDWW

SEQ ID NO: 449848 - protein, 9 aa, Homo Sapiens
HFSAKHALF

SEQ ID NO: 449849 - protein, 9 aa, Homo Sapiens
PSAAAYVQC

SEQ ID NO: 449850 - protein, 9 aa, Homo Sapiens
HIFYLKLED

SEQ ID NO: 449851 - protein, 9 aa, Homo Sapiens
RQANDQLEE

SEQ ID NO: 449852 - protein, 9 aa, Homo Sapiens
CNIFGQYLP

SEQ ID NO: 449853 - protein, 9 aa, Homo Sapiens
LIKGPDFLI

SEQ ID NO: 449854 - protein, 9 aa, Homo Sapiens
LQGKKSSVI

SEQ ID NO: 449855 - protein, 9 aa, Homo Sapiens
WNTTYHRYS

SEQ ID NO: 449856 - protein, 9 aa, Homo Sapiens
PIITQLFPT

SEQ ID NO: 449857 - protein, 9 aa, Homo Sapiens
ILCCFLVAV

SEQ ID NO: 449858 - protein, 9 aa, Homo Sapiens
SWTYDKANI

SEQ ID NO: 449859 - protein, 9 aa, Homo Sapiens
VQMGWSIDV

SEQ ID NO: 449860 - protein, 9 aa, Homo Sapiens
SFRCLGIHL

SEQ ID NO: 449861 - protein, 9 aa, Homo Sapiens
AAFSNWICN

SEQ ID NO: 449862 - protein, 9 aa, Homo Sapiens
QQLLQTSRL

SEQ ID NO: 449863 - protein, 9 aa, Homo Sapiens
LLSRNSEME

SEQ ID NO: 449864 - protein, 9 aa, Homo Sapiens
ATRYRMIDI

SEQ ID NO: 449865 - protein, 9 aa, Homo Sapiens
HHNFIQDEV

SEQ ID NO: 449866 - protein, 9 aa, Homo Sapiens
KKTCSQDLF

SEQ ID NO: 449867 - protein, 9 aa, Homo Sapiens
IQWPALVSS

SEQ ID NO: 449868 - protein, 9 aa, Homo Sapiens
KAIADYVRN

SEQ ID NO: 449869 - protein, 9 aa, Homo Sapiens
LGDKLHGFT

SEQ ID NO: 449870 - protein, 9 aa, Homo Sapiens
GNKKKYDFP

SEQ ID NO: 449871 - protein, 9 aa, Homo Sapiens
LKLILIKLC

SEQ ID NO: 449872 - protein, 9 aa, Homo Sapiens
LSSDKKMGG

SEQ ID NO: 449873 - protein, 9 aa, Homo Sapiens
EISPGSLPA

SEQ ID NO: 449874 - protein, 9 aa, Homo Sapiens
LLATVRAKC

SEQ ID NO: 449875 - protein, 9 aa, Homo Sapiens
SSALVRHQI

SEQ ID NO: 449876 - protein, 9 aa, Homo Sapiens
EKAVKSEEG

SEQ ID NO: 449877 - protein, 9 aa, Homo Sapiens
QHFWVLFDI

SEQ ID NO: 449878 - protein, 9 aa, Homo Sapiens
LEWAFHSAP

SEQ ID NO: 449879 - protein, 9 aa, Homo Sapiens
KHTDELTSL

SEQ ID NO: 449880 - protein, 9 aa, Homo Sapiens
PNSKSSGKG

SEQ ID NO: 449881 - protein, 9 aa, Homo Sapiens
KNKIQSMDD

SEQ ID NO: 449882 - protein, 9 aa, Homo Sapiens
TFNLPEGYT

SEQ ID NO: 449883 - protein, 9 aa, Homo Sapiens
SGKSKELKE

SEQ ID NO: 449884 - protein, 9 aa, Homo Sapiens
TDIEIVCRV

SEQ ID NO: 449885 - protein, 9 aa, Homo Sapiens
LSACFVTSY

SEQ ID NO: 449886 - protein, 9 aa, Homo Sapiens
ESSGYNNHD

SEQ ID NO: 449887 - protein, 9 aa, Homo Sapiens
NLPSFPHDE

SEQ ID NO: 449888 - protein, 9 aa, Homo Sapiens
LTRYSSTKI

SEQ ID NO: 449889 - protein, 9 aa, Homo Sapiens
ANPQLQMAS

SEQ ID NO: 449890 - protein, 9 aa, Homo Sapiens
LSAQFEGAE

SEQ ID NO: 449891 - protein, 9 aa, Homo Sapiens
GSVETNNLE

SEQ ID NO: 449892 - protein, 9 aa, Homo Sapiens
KEYSVDRPT

SEQ ID NO: 449893 - protein, 9 aa, Homo Sapiens
NIHSSEGRS

SEQ ID NO: 449894 - protein, 9 aa, Homo Sapiens
PGGTPQEGI

SEQ ID NO: 449895 - protein, 9 aa, Homo Sapiens
SLQEREREV

SEQ ID NO: 449896 - protein, 9 aa, Homo Sapiens
LSLYEVVHR

SEQ ID NO: 449897 - protein, 9 aa, Homo Sapiens
ELYVHQLLR

SEQ ID NO: 449898 - protein, 9 aa, Homo Sapiens
TDGACRTQL

SEQ ID NO: 449899 - protein, 9 aa, Homo Sapiens
LLPISVKMH

SEQ ID NO: 449900 - protein, 9 aa, Homo Sapiens
NNNMEMMHK

SEQ ID NO: 449901 - protein, 9 aa, Homo Sapiens
NMNIKLFMN

SEQ ID NO: 449902 - protein, 9 aa, Homo Sapiens
FSHKDSLVQ

SEQ ID NO: 449903 - protein, 9 aa, Homo Sapiens
QRRMHQQQQ

SEQ ID NO: 449904 - protein, 9 aa, Homo Sapiens
ALVFCLCMA

SEQ ID NO: 449905 - protein, 9 aa, Homo Sapiens
LRPPRDTPE

SEQ ID NO: 449906 - protein, 9 aa, Homo Sapiens
ASKMHFQTM

SEQ ID NO: 449907 - protein, 9 aa, Homo Sapiens
LRTCVDFFH

SEQ ID NO: 449908 - protein, 9 aa, Homo Sapiens
AEECRDKLI

SEQ ID NO: 449909 - protein, 9 aa, Homo Sapiens
FGLKSLAIH

SEQ ID NO: 449910 - protein, 9 aa, Homo Sapiens
VNLLSGFMA

SEQ ID NO: 449911 - protein, 9 aa, Homo Sapiens
AESCPKCGH

SEQ ID NO: 449912 - protein, 9 aa, Homo Sapiens
LSRLVSEWN

SEQ ID NO: 449913 - protein, 9 aa, Homo Sapiens
TDNTYLCWM

SEQ ID NO: 449914 - protein, 9 aa, Homo Sapiens
DCYQFTFTF

SEQ ID NO: 449915 - protein, 9 aa, Homo Sapiens
EEQKLSENT

SEQ ID NO: 449916 - protein, 9 aa, Homo Sapiens
PGYAKYGLP

SEQ ID NO: 449917 - protein, 9 aa, Homo Sapiens
PGHPQDTYY

SEQ ID NO: 449918 - protein, 9 aa, Homo Sapiens
LTVGKRKQN

SEQ ID NO: 449919 - protein, 9 aa, Homo Sapiens
TPRSKRFLL

SEQ ID NO: 449920 - protein, 9 aa, Homo Sapiens
CMMKDVFFF

SEQ ID NO: 449921 - protein, 9 aa, Homo Sapiens
QAWHAGQTI

SEQ ID NO: 449922 - protein, 9 aa, Homo Sapiens
PAQPSAEDL

SEQ ID NO: 449923 - protein, 9 aa, Homo Sapiens
ESTTVQKCI

SEQ ID NO: 449924 - protein, 9 aa, Homo Sapiens
TSYYTNEKW

SEQ ID NO: 449925 - protein, 9 aa, Homo Sapiens
EVSWNVIAW

SEQ ID NO: 449926 - protein, 9 aa, Homo Sapiens
CEKLHNFAV

SEQ ID NO: 449927 - protein, 9 aa, Homo Sapiens
RNNPDALGN

SEQ ID NO: 449928 - protein, 9 aa, Homo Sapiens
KECGRLLVR

SEQ ID NO: 449929 - protein, 9 aa, Homo Sapiens
LASECAPHL

SEQ ID NO: 449930 - protein, 9 aa, Homo Sapiens
HKINHTQKK

SEQ ID NO: 449931 - protein, 9 aa, Homo Sapiens
IGYHLSMYI

SEQ ID NO: 449932 - protein, 9 aa, Homo Sapiens
SFTEMENNN

SEQ ID NO: 449933 - protein, 9 aa, Homo Sapiens
DEIYAIGGR

SEQ ID NO: 449934 - protein, 9 aa, Homo Sapiens
NLQRRAAET

SEQ ID NO: 449935 - protein, 9 aa, Homo Sapiens
GGNLPSFPH

SEQ ID NO: 449936 - protein, 9 aa, Homo Sapiens
RELVEYGFH

SEQ ID NO: 449937 - protein, 9 aa, Homo Sapiens
QLLRLIILI

SEQ ID NO: 449938 - protein, 9 aa, Homo Sapiens
NCEGMIQMF

SEQ ID NO: 449939 - protein, 9 aa, Homo Sapiens
GSDIKGNTI

SEQ ID NO: 449940 - protein, 9 aa, Homo Sapiens
CKITSDGGW

SEQ ID NO: 449941 - protein, 9 aa, Homo Sapiens
AEQACAHVE

SEQ ID NO: 449942 - protein, 9 aa, Homo Sapiens
NMVKPLDLL

SEQ ID NO: 449943 - protein, 9 aa, Homo Sapiens
TLTSRNREA

SEQ ID NO: 449944 - protein, 9 aa, Homo Sapiens
FVVIAAIGD

SEQ ID NO: 449945 - protein, 9 aa, Homo Sapiens
SGSLGFGFS

SEQ ID NO: 449946 - protein, 9 aa, Homo Sapiens
INQYRVCQE

SEQ ID NO: 449947 - protein, 9 aa, Homo Sapiens
KTWPIFTRG

SEQ ID NO: 449948 - protein, 9 aa, Homo Sapiens
SALMDMEEY

SEQ ID NO: 449949 - protein, 9 aa, Homo Sapiens
KDVAIELSQ

SEQ ID NO: 449950 - protein, 9 aa, Homo Sapiens
IIHRYIKPE

SEQ ID NO: 449951 - protein, 9 aa, Homo Sapiens
FRKPTNNSE

SEQ ID NO: 449952 - protein, 9 aa, Homo Sapiens
GEHLWICPQ

SEQ ID NO: 449953 - protein, 9 aa, Homo Sapiens
EVMLTLTPC

SEQ ID NO: 449954 - protein, 9 aa, Homo Sapiens
LIAPNINRI

SEQ ID NO: 449955 - protein, 9 aa, Homo Sapiens
IQWFNKLYL

SEQ ID NO: 449956 - protein, 9 aa, Homo Sapiens
YTLWTAKAL

SEQ ID NO: 449957 - protein, 9 aa, Homo Sapiens
QTPGTYPED

SEQ ID NO: 449958 - protein, 9 aa, Homo Sapiens
YLTALSLCN

SEQ ID NO: 449959 - protein, 9 aa, Homo Sapiens
TGRQKYKKE

SEQ ID NO: 449960 - protein, 9 aa, Homo Sapiens
VSDDLILLL

SEQ ID NO: 449961 - protein, 9 aa, Homo Sapiens
QPCNSNILK

SEQ ID NO: 449962 - protein, 9 aa, Homo Sapiens
LWAPPSVPS

SEQ ID NO: 449963 - protein, 9 aa, Homo Sapiens
DPFSNCSGL

SEQ ID NO: 449964 - protein, 9 aa, Homo Sapiens
EREETDTME

SEQ ID NO: 449965 - protein, 9 aa, Homo Sapiens
TPFHLVGTS

SEQ ID NO: 449966 - protein, 9 aa, Homo Sapiens
TNVNKGKIA

SEQ ID NO: 449967 - protein, 9 aa, Homo Sapiens
NKGKFQVPK

SEQ ID NO: 449968 - protein, 9 aa, Homo Sapiens
MNQAYHAIL

SEQ ID NO: 449969 - protein, 9 aa, Homo Sapiens
GYLCTEKYN

SEQ ID NO: 449970 - protein, 9 aa, Homo Sapiens
TTKMPCKSS

SEQ ID NO: 449971 - protein, 9 aa, Homo Sapiens
DPNKDKQAF

SEQ ID NO: 449972 - protein, 9 aa, Homo Sapiens
NRTTILSSL

SEQ ID NO: 449973 - protein, 9 aa, Homo Sapiens
KKLTLVFEL

SEQ ID NO: 449974 - protein, 9 aa, Homo Sapiens
RLITQDFWE

SEQ ID NO: 449975 - protein, 9 aa, Homo Sapiens
DNYLNPVMD

SEQ ID NO: 449976 - protein, 9 aa, Homo Sapiens
YFLFDILGN

SEQ ID NO: 449977 - protein, 9 aa, Homo Sapiens
TTHKIILTG

SEQ ID NO: 449978 - protein, 9 aa, Homo Sapiens
SRAMGRGKH

SEQ ID NO: 449979 - protein, 9 aa, Homo Sapiens
ASLAAREAH

SEQ ID NO: 449980 - protein, 9 aa, Homo Sapiens
QRCEVRPKV

SEQ ID NO: 449981 - protein, 9 aa, Homo Sapiens
EVLSMHQII

SEQ ID NO: 449982 - protein, 9 aa, Homo Sapiens
SKDGNHKNS

SEQ ID NO: 449983 - protein, 9 aa, Homo Sapiens
LLNEVLELT

SEQ ID NO: 449984 - protein, 9 aa, Homo Sapiens
LIYEIDFLR

SEQ ID NO: 449985 - protein, 9 aa, Homo Sapiens
YVGSDSLSL

SEQ ID NO: 449986 - protein, 9 aa, Homo Sapiens
ADNFIGKPH

SEQ ID NO: 449987 - protein, 9 aa, Homo Sapiens
VNRIDWPVG

SEQ ID NO: 449988 - protein, 9 aa, Homo Sapiens
VEMGRIIQT

SEQ ID NO: 449989 - protein, 9 aa, Homo Sapiens
DGISNIGII

SEQ ID NO: 449990 - protein, 9 aa, Homo Sapiens
EEMASYFNL

SEQ ID NO: 449991 - protein, 9 aa, Homo Sapiens
SHLHKTEKA

SEQ ID NO: 449992 - protein, 9 aa, Homo Sapiens
LGLQHIFYL

SEQ ID NO: 449993 - protein, 9 aa, Homo Sapiens
GSENNYLYL

SEQ ID NO: 449994 - protein, 9 aa, Homo Sapiens
ADREFQLFD

SEQ ID NO: 449995 - protein, 9 aa, Homo Sapiens
YLNSHMQTH

SEQ ID NO: 449996 - protein, 9 aa, Homo Sapiens
VPNLPPTHD

SEQ ID NO: 449997 - protein, 9 aa, Homo Sapiens
RDGNSLIEE

SEQ ID NO: 449998 - protein, 9 aa, Homo Sapiens
CKLVYVGSD

SEQ ID NO: 449999 - protein, 9 aa, Homo Sapiens
ASCDCTVHL

SEQ ID NO: 450000 - protein, 9 aa, Homo Sapiens
CHNIYSNIF

SEQ ID NO: 450001 - protein, 9 aa, Homo Sapiens
RPFECFFLW

SEQ ID NO: 450002 - protein, 9 aa, Homo Sapiens
LHQQLKWLI

SEQ ID NO: 450003 - protein, 9 aa, Homo Sapiens
FGLPASKMH

SEQ ID NO: 450004 - protein, 9 aa, Homo Sapiens
QMEFLQNNR

SEQ ID NO: 450005 - protein, 9 aa, Homo Sapiens
PLIIQLFML

SEQ ID NO: 450006 - protein, 9 aa, Homo Sapiens
VTSYLGGTD

SEQ ID NO: 450007 - protein, 9 aa, Homo Sapiens
ILTRNENNR

SEQ ID NO: 450008 - protein, 9 aa, Homo Sapiens
SLRKRSLNH

SEQ ID NO: 450009 - protein, 9 aa, Homo Sapiens
QRYCEGHLS

SEQ ID NO: 450010 - protein, 9 aa, Homo Sapiens
GVEIMEKCN

SEQ ID NO: 450011 - protein, 9 aa, Homo Sapiens
AKKICYQLR

SEQ ID NO: 450012 - protein, 9 aa, Homo Sapiens
VVVWKIKQT

SEQ ID NO: 450013 - protein, 9 aa, Homo Sapiens
PAGHFPHLV

SEQ ID NO: 450014 - protein, 9 aa, Homo Sapiens
DDKNQSIFC

SEQ ID NO: 450015 - protein, 9 aa, Homo Sapiens
RARQRCKAL

SEQ ID NO: 450016 - protein, 9 aa, Homo Sapiens
CIFLGRPII

SEQ ID NO: 450017 - protein, 9 aa, Homo Sapiens
KDTAKFKDC

SEQ ID NO: 450018 - protein, 9 aa, Homo Sapiens
GCTRSKVTF

SEQ ID NO: 450019 - protein, 9 aa, Homo Sapiens
QYLPAVPQR

SEQ ID NO: 450020 - protein, 9 aa, Homo Sapiens
IVLRAVGGT

SEQ ID NO: 450021 - protein, 9 aa, Homo Sapiens
NNVISPLLD

SEQ ID NO: 450022 - protein, 9 aa, Homo Sapiens
RLCEEKKEK

SEQ ID NO: 450023 - protein, 9 aa, Homo Sapiens
SNRPSFNQT

SEQ ID NO: 450024 - protein, 9 aa, Homo Sapiens
GSTTVDFHW

SEQ ID NO: 450025 - protein, 9 aa, Homo Sapiens
ILVGYVDSH

SEQ ID NO: 450026 - protein, 9 aa, Homo Sapiens
LVGFVGVVT

SEQ ID NO: 450027 - protein, 9 aa, Homo Sapiens
CISANQLKR

SEQ ID NO: 450028 - protein, 9 aa, Homo Sapiens
RKRDKELAK

SEQ ID NO: 450029 - protein, 9 aa, Homo Sapiens
HLYYYCSLC

SEQ ID NO: 450030 - protein, 9 aa, Homo Sapiens
KHTHVPKGW

SEQ ID NO: 450031 - protein, 9 aa, Homo Sapiens
SKLAKAAKK

SEQ ID NO: 450032 - protein, 9 aa, Homo Sapiens
DLATYNSLL

SEQ ID NO: 450033 - protein, 9 aa, Homo Sapiens
EDNFFTLTT

SEQ ID NO: 450034 - protein, 9 aa, Homo Sapiens
RLTSHKIIH

SEQ ID NO: 450035 - protein, 9 aa, Homo Sapiens
AIKQFADKI

SEQ ID NO: 450036 - protein, 9 aa, Homo Sapiens
QGLSLIDFF

SEQ ID NO: 450037 - protein, 9 aa, Homo Sapiens
PDRALLTFD

SEQ ID NO: 450038 - protein, 9 aa, Homo Sapiens
NSKVVKTRA

SEQ ID NO: 450039 - protein, 9 aa, Homo Sapiens
KVVVWGECN

SEQ ID NO: 450040 - protein, 9 aa, Homo Sapiens
EHEGYKYKR

SEQ ID NO: 450041 - protein, 9 aa, Homo Sapiens
HHKTTGHYN

SEQ ID NO: 450042 - protein, 9 aa, Homo Sapiens
QIRYERDNN

SEQ ID NO: 450043 - protein, 9 aa, Homo Sapiens
QVELKQQYN

SEQ ID NO: 450044 - protein, 9 aa, Homo Sapiens
SIGKQNFLE

SEQ ID NO: 450045 - protein, 9 aa, Homo Sapiens
NAQLYPVGM

SEQ ID NO: 450046 - protein, 9 aa, Homo Sapiens
EYKATPRRS

SEQ ID NO: 450047 - protein, 9 aa, Homo Sapiens
QVTMVSYTE

SEQ ID NO: 450048 - protein, 9 aa, Homo Sapiens
LFNTLNIHS

SEQ ID NO: 450049 - protein, 9 aa, Homo Sapiens
SNLTKPILG

SEQ ID NO: 450050 - protein, 9 aa, Homo Sapiens
LVGYVDSHP

SEQ ID NO: 450051 - protein, 9 aa, Homo Sapiens
MYGSTRNCT

SEQ ID NO: 450052 - protein, 9 aa, Homo Sapiens
QAENRLFLE

SEQ ID NO: 450053 - protein, 9 aa, Homo Sapiens
YVLCEETTK

SEQ ID NO: 450054 - protein, 9 aa, Homo Sapiens
VNSALNPII

SEQ ID NO: 450055 - protein, 9 aa, Homo Sapiens
TGLAQHLGL

SEQ ID NO: 450056 - protein, 9 aa, Homo Sapiens
SSTKLSRGD

SEQ ID NO: 450057 - protein, 9 aa, Homo Sapiens
SEVESLQPP

SEQ ID NO: 450058 - protein, 9 aa, Homo Sapiens
TVKDEQLNL

SEQ ID NO: 450059 - protein, 9 aa, Homo Sapiens
LCTSTSSGG

SEQ ID NO: 450060 - protein, 9 aa, Homo Sapiens
FVGYKITFV

SEQ ID NO: 450061 - protein, 9 aa, Homo Sapiens
KARQFFVFN

SEQ ID NO: 450062 - protein, 9 aa, Homo Sapiens
TPTVEEQID

SEQ ID NO: 450063 - protein, 9 aa, Homo Sapiens
TVKRACIKS

SEQ ID NO: 450064 - protein, 9 aa, Homo Sapiens
LLARDFKKN

SEQ ID NO: 450065 - protein, 9 aa, Homo Sapiens
NLNSKLAYC

SEQ ID NO: 450066 - protein, 9 aa, Homo Sapiens
KALTRSRNT

SEQ ID NO: 450067 - protein, 9 aa, Homo Sapiens
AEPLQARVD

SEQ ID NO: 450068 - protein, 9 aa, Homo Sapiens
GSFERTLGL

SEQ ID NO: 450069 - protein, 9 aa, Homo Sapiens
AWIFTGGVT

SEQ ID NO: 450070 - protein, 9 aa, Homo Sapiens
FFSDAQELE

SEQ ID NO: 450071 - protein, 9 aa, Homo Sapiens
CLEGVPECR

SEQ ID NO: 450072 - protein, 9 aa, Homo Sapiens
LRCNYKVDK

SEQ ID NO: 450073 - protein, 9 aa, Homo Sapiens
QIEERDRRQ

SEQ ID NO: 450074 - protein, 9 aa, Homo Sapiens
KSIQDIETI

SEQ ID NO: 450075 - protein, 9 aa, Homo Sapiens
MHSSVWYLG

SEQ ID NO: 450076 - protein, 9 aa, Homo Sapiens
TQDEWALLD

SEQ ID NO: 450077 - protein, 9 aa, Homo Sapiens
TQRGFCEPG

SEQ ID NO: 450078 - protein, 9 aa, Homo Sapiens
SMEKLLPSY

SEQ ID NO: 450079 - protein, 9 aa, Homo Sapiens
WCLLRESIY

SEQ ID NO: 450080 - protein, 9 aa, Homo Sapiens
QEKWSSGFI

SEQ ID NO: 450081 - protein, 9 aa, Homo Sapiens
PEKKYCKCN

SEQ ID NO: 450082 - protein, 9 aa, Homo Sapiens
HIPHPSMTS

SEQ ID NO: 450083 - protein, 9 aa, Homo Sapiens
TLAQNNQNR

SEQ ID NO: 450084 - protein, 9 aa, Homo Sapiens
FAFGPFGVF

SEQ ID NO: 450085 - protein, 9 aa, Homo Sapiens
YLNPVMDAK

SEQ ID NO: 450086 - protein, 9 aa, Homo Sapiens
TLNSYQNVF

SEQ ID NO: 450087 - protein, 9 aa, Homo Sapiens
HMGDSLNWA

SEQ ID NO: 450088 - protein, 9 aa, Homo Sapiens
YADLYLLDS

SEQ ID NO: 450089 - protein, 9 aa, Homo Sapiens
SNFCHPNFP

SEQ ID NO: 450090 - protein, 9 aa, Homo Sapiens
VLSTLTKHK

SEQ ID NO: 450091 - protein, 9 aa, Homo Sapiens
TKMPCKSSP

SEQ ID NO: 450092 - protein, 9 aa, Homo Sapiens
FTPRFSRGL

SEQ ID NO: 450093 - protein, 9 aa, Homo Sapiens
PKVNNLNPK

SEQ ID NO: 450094 - protein, 9 aa, Homo Sapiens
LGDAINHLD

SEQ ID NO: 450095 - protein, 9 aa, Homo Sapiens
KATGFFMGG

SEQ ID NO: 450096 - protein, 9 aa, Homo Sapiens
EKNTISDKE

SEQ ID NO: 450097 - protein, 9 aa, Homo Sapiens
ACLGLQLVK

SEQ ID NO: 450098 - protein, 9 aa, Homo Sapiens
VVIAAIGDR

SEQ ID NO: 450099 - protein, 9 aa, Homo Sapiens
DDRISCLLL

SEQ ID NO: 450100 - protein, 9 aa, Homo Sapiens
NIAEGNPLT

SEQ ID NO: 450101 - protein, 9 aa, Homo Sapiens
LKDCIWMCK

SEQ ID NO: 450102 - protein, 9 aa, Homo Sapiens
HQIILYLLR

SEQ ID NO: 450103 - protein, 9 aa, Homo Sapiens
GSHLTRHQI

SEQ ID NO: 450104 - protein, 9 aa, Homo Sapiens
YPHQVVKDP

SEQ ID NO: 450105 - protein, 9 aa, Homo Sapiens
IKLLAMRFK

SEQ ID NO: 450106 - protein, 9 aa, Homo Sapiens
SEKGRFTSV

SEQ ID NO: 450107 - protein, 9 aa, Homo Sapiens
KCVPQENED

SEQ ID NO: 450108 - protein, 9 aa, Homo Sapiens
VVRECTIMC

SEQ ID NO: 450109 - protein, 9 aa, Homo Sapiens
MIDSGENKP

SEQ ID NO: 450110 - protein, 9 aa, Homo Sapiens
VEIDNATLA

SEQ ID NO: 450111 - protein, 9 aa, Homo Sapiens
FTYHKITHT

SEQ ID NO: 450112 - protein, 9 aa, Homo Sapiens
TFHALSDKN

SEQ ID NO: 450113 - protein, 9 aa, Homo Sapiens
AICKAFRVW

SEQ ID NO: 450114 - protein, 9 aa, Homo Sapiens
LSVVDATWL

SEQ ID NO: 450115 - protein, 9 aa, Homo Sapiens
RSKHLEKVH

SEQ ID NO: 450116 - protein, 9 aa, Homo Sapiens
KKKKPDVLR

SEQ ID NO: 450117 - protein, 9 aa, Homo Sapiens
SDQDTNTGS

SEQ ID NO: 450118 - protein, 9 aa, Homo Sapiens
VNNLAKHVQ

SEQ ID NO: 450119 - protein, 9 aa, Homo Sapiens
YCEGHLSLS

SEQ ID NO: 450120 - protein, 9 aa, Homo Sapiens
KVAVNNIKC

SEQ ID NO: 450121 - protein, 9 aa, Homo Sapiens
SSYQEPIDS

SEQ ID NO: 450122 - protein, 9 aa, Homo Sapiens
REITVIESS

SEQ ID NO: 450123 - protein, 9 aa, Homo Sapiens
NEVAVEYFK

SEQ ID NO: 450124 - protein, 9 aa, Homo Sapiens
VYCQEKDLL

SEQ ID NO: 450125 - protein, 9 aa, Homo Sapiens
DRRQQKQLE

SEQ ID NO: 450126 - protein, 9 aa, Homo Sapiens
LLKIQQEAI

SEQ ID NO: 450127 - protein, 9 aa, Homo Sapiens
SFKSLLNAF

SEQ ID NO: 450128 - protein, 9 aa, Homo Sapiens
CTANEGVMY

SEQ ID NO: 450129 - protein, 9 aa, Homo Sapiens
IPLIIQLFM

SEQ ID NO: 450130 - protein, 9 aa, Homo Sapiens
RICRPCEIK

SEQ ID NO: 450131 - protein, 9 aa, Homo Sapiens
RQVVLEDSI

SEQ ID NO: 450132 - protein, 9 aa, Homo Sapiens
CIHQIVHTG

SEQ ID NO: 450133 - protein, 9 aa, Homo Sapiens
NFLELGDSA

SEQ ID NO: 450134 - protein, 9 aa, Homo Sapiens
RSFNRSANL

SEQ ID NO: 450135 - protein, 9 aa, Homo Sapiens
QMFISFVMG

SEQ ID NO: 450136 - protein, 9 aa, Homo Sapiens
QKQNTEESS

SEQ ID NO: 450137 - protein, 9 aa, Homo Sapiens
DPCQGNNFI

SEQ ID NO: 450138 - protein, 9 aa, Homo Sapiens
MKYCLRSAS

SEQ ID NO: 450139 - protein, 9 aa, Homo Sapiens
DLRSESSST

SEQ ID NO: 450140 - protein, 9 aa, Homo Sapiens
SLKDIVPHN

SEQ ID NO: 450141 - protein, 9 aa, Homo Sapiens
PLFMDNSNI

SEQ ID NO: 450142 - protein, 9 aa, Homo Sapiens
ATNPEDCSD

SEQ ID NO: 450143 - protein, 9 aa, Homo Sapiens
NKDLLSDGT

SEQ ID NO: 450144 - protein, 9 aa, Homo Sapiens
VTNNYDRLQ

SEQ ID NO: 450145 - protein, 9 aa, Homo Sapiens
RTNGNIKHT

SEQ ID NO: 450146 - protein, 9 aa, Homo Sapiens
LTERKNRQA

SEQ ID NO: 450147 - protein, 9 aa, Homo Sapiens
KTSKRFSSL

SEQ ID NO: 450148 - protein, 9 aa, Homo Sapiens
TTARYNFYV

SEQ ID NO: 450149 - protein, 9 aa, Homo Sapiens
LSIIHHDQP

SEQ ID NO: 450150 - protein, 9 aa, Homo Sapiens
QSQYKSNFV

SEQ ID NO: 450151 - protein, 9 aa, Homo Sapiens
CAVEGSNKT

SEQ ID NO: 450152 - protein, 9 aa, Homo Sapiens
CCLYYTSFS

SEQ ID NO: 450153 - protein, 9 aa, Homo Sapiens
ISPPFSLAT

SEQ ID NO: 450154 - protein, 9 aa, Homo Sapiens
SIQQRSPPY

SEQ ID NO: 450155 - protein, 9 aa, Homo Sapiens
FQVNDVNQP

SEQ ID NO: 450156 - protein, 9 aa, Homo Sapiens
ARYAARRSL

SEQ ID NO: 450157 - protein, 9 aa, Homo Sapiens
EGRTRIDKR

SEQ ID NO: 450158 - protein, 9 aa, Homo Sapiens
VDIPLWLLV

SEQ ID NO: 450159 - protein, 9 aa, Homo Sapiens
VTTWQISAG

SEQ ID NO: 450160 - protein, 9 aa, Homo Sapiens
HINNKLRWG

SEQ ID NO: 450161 - protein, 9 aa, Homo Sapiens
EYLDNWTAL

SEQ ID NO: 450162 - protein, 9 aa, Homo Sapiens
QFMMQGFIC

SEQ ID NO: 450163 - protein, 9 aa, Homo Sapiens
AREDVSIPR

SEQ ID NO: 450164 - protein, 9 aa, Homo Sapiens
IPTRKPNTK

SEQ ID NO: 450165 - protein, 9 aa, Homo Sapiens
DLVKIHLMY

SEQ ID NO: 450166 - protein, 9 aa, Homo Sapiens
IHLKKMAYL

SEQ ID NO: 450167 - protein, 9 aa, Homo Sapiens
DSNNQFVSL

SEQ ID NO: 450168 - protein, 9 aa, Homo Sapiens
QCHISGKYT

SEQ ID NO: 450169 - protein, 9 aa, Homo Sapiens
QIQKHVWLW

SEQ ID NO: 450170 - protein, 9 aa, Homo Sapiens
RKLLPIVPI

SEQ ID NO: 450171 - protein, 9 aa, Homo Sapiens
EAQKRRKQL

SEQ ID NO: 450172 - protein, 9 aa, Homo Sapiens
LTALSLCNS

SEQ ID NO: 450173 - protein, 9 aa, Homo Sapiens
GTFILFAIV

SEQ ID NO: 450174 - protein, 9 aa, Homo Sapiens
FLGASILAN

SEQ ID NO: 450175 - protein, 9 aa, Homo Sapiens
EPWLIINET

SEQ ID NO: 450176 - protein, 9 aa, Homo Sapiens
ALSHNVNMP

SEQ ID NO: 450177 - protein, 9 aa, Homo Sapiens
LQGTRARCC

SEQ ID NO: 450178 - protein, 9 aa, Homo Sapiens
PDSPCVKQG

SEQ ID NO: 450179 - protein, 9 aa, Homo Sapiens
SCLTRHQII

SEQ ID NO: 450180 - protein, 9 aa, Homo Sapiens
MPIKEKPGF

SEQ ID NO: 450181 - protein, 9 aa, Homo Sapiens
LIDTMMSNT

SEQ ID NO: 450182 - protein, 9 aa, Homo Sapiens
TQNNYKLPL

SEQ ID NO: 450183 - protein, 9 aa, Homo Sapiens
STSVPAFLQ

SEQ ID NO: 450184 - protein, 9 aa, Homo Sapiens
DLHVQIHFG

SEQ ID NO: 450185 - protein, 9 aa, Homo Sapiens
RLNLTQHIR

SEQ ID NO: 450186 - protein, 9 aa, Homo Sapiens
AQCCPKLRR

SEQ ID NO: 450187 - protein, 9 aa, Homo Sapiens
GHSEAVIYV

SEQ ID NO: 450188 - protein, 9 aa, Homo Sapiens
LNTLLKTLL

SEQ ID NO: 450189 - protein, 9 aa, Homo Sapiens
FLGCIWSLQ

SEQ ID NO: 450190 - protein, 9 aa, Homo Sapiens
RCYVCPAVL

SEQ ID NO: 450191 - protein, 9 aa, Homo Sapiens
TYHCVVNYT

SEQ ID NO: 450192 - protein, 9 aa, Homo Sapiens
LCMHVKLYI

SEQ ID NO: 450193 - protein, 9 aa, Homo Sapiens
SQDEEMINN

SEQ ID NO: 450194 - protein, 9 aa, Homo Sapiens
AFHSKVTET

SEQ ID NO: 450195 - protein, 9 aa, Homo Sapiens
TWRSLDKAT

SEQ ID NO: 450196 - protein, 9 aa, Homo Sapiens
QILKILYAL

SEQ ID NO: 450197 - protein, 9 aa, Homo Sapiens
IVWQLQELR

SEQ ID NO: 450198 - protein, 9 aa, Homo Sapiens
QEGNQRHSS

SEQ ID NO: 450199 - protein, 9 aa, Homo Sapiens
VRAIKEGNL

SEQ ID NO: 450200 - protein, 9 aa, Homo Sapiens
KANLVNRSI

SEQ ID NO: 450201 - protein, 9 aa, Homo Sapiens
KQLLLDELV

SEQ ID NO: 450202 - protein, 9 aa, Homo Sapiens
DGIHIANHL

SEQ ID NO: 450203 - protein, 9 aa, Homo Sapiens
MSERRSFET

SEQ ID NO: 450204 - protein, 9 aa, Homo Sapiens
EDMLRQMSD

SEQ ID NO: 450205 - protein, 9 aa, Homo Sapiens
QQKQLEHQK

SEQ ID NO: 450206 - protein, 9 aa, Homo Sapiens
MVVPAMQLT

SEQ ID NO: 450207 - protein, 9 aa, Homo Sapiens
FHPRRFLLT

SEQ ID NO: 450208 - protein, 9 aa, Homo Sapiens
KYCEKDDLS

SEQ ID NO: 450209 - protein, 9 aa, Homo Sapiens
KRGLDLRVL

SEQ ID NO: 450210 - protein, 9 aa, Homo Sapiens
MSALWMLLG

SEQ ID NO: 450211 - protein, 9 aa, Homo Sapiens
TTPLFTDQP

SEQ ID NO: 450212 - protein, 9 aa, Homo Sapiens
STDILKPFF

SEQ ID NO: 450213 - protein, 9 aa, Homo Sapiens
SHIPLIIQL

SEQ ID NO: 450214 - protein, 9 aa, Homo Sapiens
GGAYLCNYT

SEQ ID NO: 450215 - protein, 9 aa, Homo Sapiens
DSEESLRKL

SEQ ID NO: 450216 - protein, 9 aa, Homo Sapiens
YYVDLNQTI

SEQ ID NO: 450217 - protein, 9 aa, Homo Sapiens
KNGSALVLE

SEQ ID NO: 450218 - protein, 9 aa, Homo Sapiens
SRYRGLTGC

SEQ ID NO: 450219 - protein, 9 aa, Homo Sapiens
HQPPAMPSA

SEQ ID NO: 450220 - protein, 9 aa, Homo Sapiens
LAINYNSNQ

SEQ ID NO: 450221 - protein, 9 aa, Homo Sapiens
YNGDFSDWP

SEQ ID NO: 450222 - protein, 9 aa, Homo Sapiens
SKYGIDNFT

SEQ ID NO: 450223 - protein, 9 aa, Homo Sapiens
TVMKLGAGY

SEQ ID NO: 450224 - protein, 9 aa, Homo Sapiens
EEDEILEEL

SEQ ID NO: 450225 - protein, 9 aa, Homo Sapiens
NEATRVFHD

SEQ ID NO: 450226 - protein, 9 aa, Homo Sapiens
VSNCVDNLY

SEQ ID NO: 450227 - protein, 9 aa, Homo Sapiens
GGESIYYNE

SEQ ID NO: 450228 - protein, 9 aa, Homo Sapiens
WAHGGANTA

SEQ ID NO: 450229 - protein, 9 aa, Homo Sapiens
QPLELEHPA

SEQ ID NO: 450230 - protein, 9 aa, Homo Sapiens
DTMCADDLL

SEQ ID NO: 450231 - protein, 9 aa, Homo Sapiens
NSHLANHQK

SEQ ID NO: 450232 - protein, 9 aa, Homo Sapiens
MSFINNETK

SEQ ID NO: 450233 - protein, 9 aa, Homo Sapiens
CCYGYQNDS

SEQ ID NO: 450234 - protein, 9 aa, Homo Sapiens
NFYYSKFFN

SEQ ID NO: 450235 - protein, 9 aa, Homo Sapiens
TEKSEPKTP

SEQ ID NO: 450236 - protein, 9 aa, Homo Sapiens
WGCVYLLMV

SEQ ID NO: 450237 - protein, 9 aa, Homo Sapiens
CDRHHSLGL

SEQ ID NO: 450238 - protein, 9 aa, Homo Sapiens
ITRFLSMEK

SEQ ID NO: 450239 - protein, 9 aa, Homo Sapiens
NHQHVTKPS

SEQ ID NO: 450240 - protein, 9 aa, Homo Sapiens
SILFNHESP

SEQ ID NO: 450241 - protein, 9 aa, Homo Sapiens
KELAKSMAI

SEQ ID NO: 450242 - protein, 9 aa, Homo Sapiens
SLESVGLKP

SEQ ID NO: 450243 - protein, 9 aa, Homo Sapiens
SKINFESFV

SEQ ID NO: 450244 - protein, 9 aa, Homo Sapiens
TFSALANIN

SEQ ID NO: 450245 - protein, 9 aa, Homo Sapiens
QMLKQLKKQ

SEQ ID NO: 450246 - protein, 9 aa, Homo Sapiens
IVIFVLILV

SEQ ID NO: 450247 - protein, 9 aa, Homo Sapiens
SRQAPTKLV

SEQ ID NO: 450248 - protein, 9 aa, Homo Sapiens
TLLKTLLEK

SEQ ID NO: 450249 - protein, 9 aa, Homo Sapiens
SCFVDMQAQ

SEQ ID NO: 450250 - protein, 9 aa, Homo Sapiens
SLDIGNQIN

SEQ ID NO: 450251 - protein, 9 aa, Homo Sapiens
TVQTLYLSY

SEQ ID NO: 450252 - protein, 9 aa, Homo Sapiens
AGKVNKPQK

SEQ ID NO: 450253 - protein, 9 aa, Homo Sapiens
DLFWLRKAV

SEQ ID NO: 450254 - protein, 9 aa, Homo Sapiens
HLSRHEIIH

SEQ ID NO: 450255 - protein, 9 aa, Homo Sapiens
WDMGNLYLA

SEQ ID NO: 450256 - protein, 9 aa, Homo Sapiens
GCLPLLSGL

SEQ ID NO: 450257 - protein, 9 aa, Homo Sapiens
GHRNFIKNM

SEQ ID NO: 450258 - protein, 9 aa, Homo Sapiens
GHSKDENYK

SEQ ID NO: 450259 - protein, 9 aa, Homo Sapiens
LTRQLLSEF

SEQ ID NO: 450260 - protein, 9 aa, Homo Sapiens
VMRQGCHLC

SEQ ID NO: 450261 - protein, 9 aa, Homo Sapiens
MLSQPAGNQ

SEQ ID NO: 450262 - protein, 9 aa, Homo Sapiens
QFKISSSYS

SEQ ID NO: 450263 - protein, 9 aa, Homo Sapiens
LQAMKKFVN

SEQ ID NO: 450264 - protein, 9 aa, Homo Sapiens
PRDPAAPEP

SEQ ID NO: 450265 - protein, 9 aa, Homo Sapiens
PVYTTSMIR

SEQ ID NO: 450266 - protein, 9 aa, Homo Sapiens
FNEYPSYQE

SEQ ID NO: 450267 - protein, 9 aa, Homo Sapiens
LHSSVNYKG

SEQ ID NO: 450268 - protein, 9 aa, Homo Sapiens
REETAWLSI

SEQ ID NO: 450269 - protein, 9 aa, Homo Sapiens
LLDHEKEII

SEQ ID NO: 450270 - protein, 9 aa, Homo Sapiens
FAPKADLLT

SEQ ID NO: 450271 - protein, 9 aa, Homo Sapiens
QCLEEKLKP

SEQ ID NO: 450272 - protein, 9 aa, Homo Sapiens
NDSTVPNQF

SEQ ID NO: 450273 - protein, 9 aa, Homo Sapiens
SKQALSKIE

SEQ ID NO: 450274 - protein, 9 aa, Homo Sapiens
LGHKKLKST

SEQ ID NO: 450275 - protein, 9 aa, Homo Sapiens
KEGCHKKKQ

SEQ ID NO: 450276 - protein, 9 aa, Homo Sapiens
GTKGTRGPL

SEQ ID NO: 450277 - protein, 9 aa, Homo Sapiens
IILTGEKPY

SEQ ID NO: 450278 - protein, 9 aa, Homo Sapiens
TFCKLYRLI

SEQ ID NO: 450279 - protein, 9 aa, Homo Sapiens
VDSGGSTTV

SEQ ID NO: 450280 - protein, 9 aa, Homo Sapiens
QKNKGKFQV

SEQ ID NO: 450281 - protein, 9 aa, Homo Sapiens
PHNSNEGWE

SEQ ID NO: 450282 - protein, 9 aa, Homo Sapiens
CYLEYAGSV

SEQ ID NO: 450283 - protein, 9 aa, Homo Sapiens
DIDTVMKLG

SEQ ID NO: 450284 - protein, 9 aa, Homo Sapiens
ALPGHTPRP

SEQ ID NO: 450285 - protein, 9 aa, Homo Sapiens
CAVGFCDMN

SEQ ID NO: 450286 - protein, 9 aa, Homo Sapiens
QTVYLNMAT

SEQ ID NO: 450287 - protein, 9 aa, Homo Sapiens
YLKTQKATN

SEQ ID NO: 450288 - protein, 9 aa, Homo Sapiens
ERRHPVCYG

SEQ ID NO: 450289 - protein, 9 aa, Homo Sapiens
LYKCHPDIF

SEQ ID NO: 450290 - protein, 9 aa, Homo Sapiens
SKPQEENNF

SEQ ID NO: 450291 - protein, 9 aa, Homo Sapiens
KIIILKMKY

SEQ ID NO: 450292 - protein, 9 aa, Homo Sapiens
SDRKRELDH

SEQ ID NO: 450293 - protein, 9 aa, Homo Sapiens
RVGVQQPHA

SEQ ID NO: 450294 - protein, 9 aa, Homo Sapiens
SLCMFKIPK

SEQ ID NO: 450295 - protein, 9 aa, Homo Sapiens
EPDIYHGIC

SEQ ID NO: 450296 - protein, 9 aa, Homo Sapiens
ETQASKRTS

SEQ ID NO: 450297 - protein, 9 aa, Homo Sapiens
GNGDDYSSG

SEQ ID NO: 450298 - protein, 9 aa, Homo Sapiens
HNSVILDPE

SEQ ID NO: 450299 - protein, 9 aa, Homo Sapiens
QMSVTQRVE

SEQ ID NO: 450300 - protein, 9 aa, Homo Sapiens
VLQKHQIIH

SEQ ID NO: 450301 - protein, 9 aa, Homo Sapiens
PEPARDIHC

SEQ ID NO: 450302 - protein, 9 aa, Homo Sapiens
TLDTLTKHY

SEQ ID NO: 450303 - protein, 9 aa, Homo Sapiens
ATLDYGMYY

SEQ ID NO: 450304 - protein, 9 aa, Homo Sapiens
EIMEKCNTI

SEQ ID NO: 450305 - protein, 9 aa, Homo Sapiens
AQTSLQGLL

SEQ ID NO: 450306 - protein, 9 aa, Homo Sapiens
TSVYYACIL

SEQ ID NO: 450307 - protein, 9 aa, Homo Sapiens
LHLRNKGNT

SEQ ID NO: 450308 - protein, 9 aa, Homo Sapiens
VFRISQATD

SEQ ID NO: 450309 - protein, 9 aa, Homo Sapiens
YKSNFVAAS

SEQ ID NO: 450310 - protein, 9 aa, Homo Sapiens
RQEREETDT

SEQ ID NO: 450311 - protein, 9 aa, Homo Sapiens
KQNVISYLE

SEQ ID NO: 450312 - protein, 9 aa, Homo Sapiens
ELFEDMLRQ

SEQ ID NO: 450313 - protein, 9 aa, Homo Sapiens
SCLRRFWAS

SEQ ID NO: 450314 - protein, 9 aa, Homo Sapiens
LKLAFSELY

SEQ ID NO: 450315 - protein, 9 aa, Homo Sapiens
NKGQLSRQT

SEQ ID NO: 450316 - protein, 9 aa, Homo Sapiens
GEAPGDLLQ

SEQ ID NO: 450317 - protein, 9 aa, Homo Sapiens
ACSESREGH

SEQ ID NO: 450318 - protein, 9 aa, Homo Sapiens
CDKKSCGNQ

SEQ ID NO: 450319 - protein, 9 aa, Homo Sapiens
NHQQTHTGE

SEQ ID NO: 450320 - protein, 9 aa, Homo Sapiens
HETHTRHRG

SEQ ID NO: 450321 - protein, 9 aa, Homo Sapiens
KLICQFQGR

SEQ ID NO: 450322 - protein, 9 aa, Homo Sapiens
TPLIISNCQ

SEQ ID NO: 450323 - protein, 9 aa, Homo Sapiens
PPDNMNLAN

SEQ ID NO: 450324 - protein, 9 aa, Homo Sapiens
NRNRPSFDG

SEQ ID NO: 450325 - protein, 9 aa, Homo Sapiens
VIPGKAAKT

SEQ ID NO: 450326 - protein, 9 aa, Homo Sapiens
DYDRRNDKV

SEQ ID NO: 450327 - protein, 9 aa, Homo Sapiens
LDTEDDSEA

SEQ ID NO: 450328 - protein, 9 aa, Homo Sapiens
KKLWRESWE

SEQ ID NO: 450329 - protein, 9 aa, Homo Sapiens
PQAPKDREV

SEQ ID NO: 450330 - protein, 9 aa, Homo Sapiens
MEPFGIALT

SEQ ID NO: 450331 - protein, 9 aa, Homo Sapiens
FPNQDSDLV

SEQ ID NO: 450332 - protein, 9 aa, Homo Sapiens
MIALERPDF

SEQ ID NO: 450333 - protein, 9 aa, Homo Sapiens
VALYGLIEE

SEQ ID NO: 450334 - protein, 9 aa, Homo Sapiens
KKDAYVFYA

SEQ ID NO: 450335 - protein, 9 aa, Homo Sapiens
VKTGDKYFF

SEQ ID NO: 450336 - protein, 9 aa, Homo Sapiens
SAPANLGYD

SEQ ID NO: 450337 - protein, 9 aa, Homo Sapiens
NYFMAKINI

SEQ ID NO: 450338 - protein, 9 aa, Homo Sapiens
LKARTTINL

SEQ ID NO: 450339 - protein, 9 aa, Homo Sapiens
GKYSVKKKE

SEQ ID NO: 450340 - protein, 9 aa, Homo Sapiens
LDNFISGRP

SEQ ID NO: 450341 - protein, 9 aa, Homo Sapiens
NCKLQVLEL

SEQ ID NO: 450342 - protein, 9 aa, Homo Sapiens
IVGYLPKEN

SEQ ID NO: 450343 - protein, 9 aa, Homo Sapiens
YPNTHHCLC

SEQ ID NO: 450344 - protein, 9 aa, Homo Sapiens
YKSLCMFKI

SEQ ID NO: 450345 - protein, 9 aa, Homo Sapiens
YTDNEVEKI

SEQ ID NO: 450346 - protein, 9 aa, Homo Sapiens
DKGGKSCEK

SEQ ID NO: 450347 - protein, 9 aa, Homo Sapiens
TAMTLYGEV

SEQ ID NO: 450348 - protein, 9 aa, Homo Sapiens
DMSTNPAIL

SEQ ID NO: 450349 - protein, 9 aa, Homo Sapiens
KYTSAGKES

SEQ ID NO: 450350 - protein, 9 aa, Homo Sapiens
NRKVINFEQ

SEQ ID NO: 450351 - protein, 9 aa, Homo Sapiens
ITQRQQIKY

SEQ ID NO: 450352 - protein, 9 aa, Homo Sapiens
YLWAAGQEL

SEQ ID NO: 450353 - protein, 9 aa, Homo Sapiens
PPPPVDYAD

SEQ ID NO: 450354 - protein, 9 aa, Homo Sapiens
KDNLNLENH

SEQ ID NO: 450355 - protein, 9 aa, Homo Sapiens
LFWLRKAVP

SEQ ID NO: 450356 - protein, 9 aa, Homo Sapiens
HEEAYNKIN

SEQ ID NO: 450357 - protein, 9 aa, Homo Sapiens
STKYKVMRK

SEQ ID NO: 450358 - protein, 9 aa, Homo Sapiens
KLDSEVAWG

SEQ ID NO: 450359 - protein, 9 aa, Homo Sapiens
LFAHNEYLV

SEQ ID NO: 450360 - protein, 9 aa, Homo Sapiens
TLRCYPISG

SEQ ID NO: 450361 - protein, 9 aa, Homo Sapiens
FEMAIRHFK

SEQ ID NO: 450362 - protein, 9 aa, Homo Sapiens
RLKQQMNSA

SEQ ID NO: 450363 - protein, 9 aa, Homo Sapiens
SDSDDESHK

SEQ ID NO: 450364 - protein, 9 aa, Homo Sapiens
VSEWNLLEV

SEQ ID NO: 450365 - protein, 9 aa, Homo Sapiens
KELDLLHGE

SEQ ID NO: 450366 - protein, 9 aa, Homo Sapiens
TSSSSSLSR

SEQ ID NO: 450367 - protein, 9 aa, Homo Sapiens
PRVAEWCYG

SEQ ID NO: 450368 - protein, 9 aa, Homo Sapiens
ELSDKSKLQ

SEQ ID NO: 450369 - protein, 9 aa, Homo Sapiens
DLNKTKVED

SEQ ID NO: 450370 - protein, 9 aa, Homo Sapiens
CAGPHHAQG

SEQ ID NO: 450371 - protein, 9 aa, Homo Sapiens
PGHTPIFCT

SEQ ID NO: 450372 - protein, 9 aa, Homo Sapiens
SLMGVHLLP

SEQ ID NO: 450373 - protein, 9 aa, Homo Sapiens
KEKLMYGLA

SEQ ID NO: 450374 - protein, 9 aa, Homo Sapiens
VFLVLMFAV

SEQ ID NO: 450375 - protein, 9 aa, Homo Sapiens
MTQLFSAHL

SEQ ID NO: 450376 - protein, 9 aa, Homo Sapiens
NNVTNNYDR

SEQ ID NO: 450377 - protein, 9 aa, Homo Sapiens
MRKVCGPPV

SEQ ID NO: 450378 - protein, 9 aa, Homo Sapiens
DRYPQCMCL

SEQ ID NO: 450379 - protein, 9 aa, Homo Sapiens
FNRFSVASS

SEQ ID NO: 450380 - protein, 9 aa, Homo Sapiens
EKEKLMYGL

SEQ ID NO: 450381 - protein, 9 aa, Homo Sapiens
LDDSDIEAH

SEQ ID NO: 450382 - protein, 9 aa, Homo Sapiens
ICRCNIEYS

SEQ ID NO: 450383 - protein, 9 aa, Homo Sapiens
FRLHNLFSA

SEQ ID NO: 450384 - protein, 9 aa, Homo Sapiens
YHRYSAPPM

SEQ ID NO: 450385 - protein, 9 aa, Homo Sapiens
IKISQVTDK

SEQ ID NO: 450386 - protein, 9 aa, Homo Sapiens
ALPDEIQKM

SEQ ID NO: 450387 - protein, 9 aa, Homo Sapiens
AEIRDTYQV

SEQ ID NO: 450388 - protein, 9 aa, Homo Sapiens
IRHWRHYHT

SEQ ID NO: 450389 - protein, 9 aa, Homo Sapiens
DLITCKTRR

SEQ ID NO: 450390 - protein, 9 aa, Homo Sapiens
GGMTSNKIR

SEQ ID NO: 450391 - protein, 9 aa, Homo Sapiens
AGNTFIARG

SEQ ID NO: 450392 - protein, 9 aa, Homo Sapiens
TQLFPTLLL

SEQ ID NO: 450393 - protein, 9 aa, Homo Sapiens
KSLEEIDSF

SEQ ID NO: 450394 - protein, 9 aa, Homo Sapiens
ETVKDEQLN

SEQ ID NO: 450395 - protein, 9 aa, Homo Sapiens
LPETPPTPG

SEQ ID NO: 450396 - protein, 9 aa, Homo Sapiens
AICGLKRLC

SEQ ID NO: 450397 - protein, 9 aa, Homo Sapiens
RYVCLRCCL

SEQ ID NO: 450398 - protein, 9 aa, Homo Sapiens
KVQNRRIYD

SEQ ID NO: 450399 - protein, 9 aa, Homo Sapiens
GRTQLKELK

SEQ ID NO: 450400 - protein, 9 aa, Homo Sapiens
EYVHLYAQM

SEQ ID NO: 450401 - protein, 9 aa, Homo Sapiens
SKHWPGFLR

SEQ ID NO: 450402 - protein, 9 aa, Homo Sapiens
GKWLLLLEE

SEQ ID NO: 450403 - protein, 9 aa, Homo Sapiens
QFQAEGKIC

SEQ ID NO: 450404 - protein, 9 aa, Homo Sapiens
LKQLKKQQE

SEQ ID NO: 450405 - protein, 9 aa, Homo Sapiens
MEDSVEEIG

SEQ ID NO: 450406 - protein, 9 aa, Homo Sapiens
EPSGVLGVV

SEQ ID NO: 450407 - protein, 9 aa, Homo Sapiens
RAYLNGSNM

SEQ ID NO: 450408 - protein, 9 aa, Homo Sapiens
RKDNFWGKT

SEQ ID NO: 450409 - protein, 9 aa, Homo Sapiens
SQGRICSTN

SEQ ID NO: 450410 - protein, 9 aa, Homo Sapiens
GMTSNKIRM

SEQ ID NO: 450411 - protein, 9 aa, Homo Sapiens
PQRRCCAYI

SEQ ID NO: 450412 - protein, 9 aa, Homo Sapiens
KQQYNDHHS

SEQ ID NO: 450413 - protein, 9 aa, Homo Sapiens
GSGRITMAA

SEQ ID NO: 450414 - protein, 9 aa, Homo Sapiens
YEIRICRPC

SEQ ID NO: 450415 - protein, 9 aa, Homo Sapiens
LVSQSYIRG

SEQ ID NO: 450416 - protein, 9 aa, Homo Sapiens
DPVGVLYMR

SEQ ID NO: 450417 - protein, 9 aa, Homo Sapiens
NLRIEDNMD

SEQ ID NO: 450418 - protein, 9 aa, Homo Sapiens
DKPQVIEVL

SEQ ID NO: 450419 - protein, 9 aa, Homo Sapiens
ATWDGKDLS

SEQ ID NO: 450420 - protein, 9 aa, Homo Sapiens
RIPSLHRLD

SEQ ID NO: 450421 - protein, 9 aa, Homo Sapiens
DYEASGQSL

SEQ ID NO: 450422 - protein, 9 aa, Homo Sapiens
QSVVLSKIN

SEQ ID NO: 450423 - protein, 9 aa, Homo Sapiens
SYAGCFQFG

SEQ ID NO: 450424 - protein, 9 aa, Homo Sapiens
FIREHLNYW

SEQ ID NO: 450425 - protein, 9 aa, Homo Sapiens
SCREHEKTH

SEQ ID NO: 450426 - protein, 9 aa, Homo Sapiens
LKMETAECN

SEQ ID NO: 450427 - protein, 9 aa, Homo Sapiens
KTTIGYGFR

SEQ ID NO: 450428 - protein, 9 aa, Homo Sapiens
SYVSSTLSV

SEQ ID NO: 450429 - protein, 9 aa, Homo Sapiens
NWDRTLHSR

SEQ ID NO: 450430 - protein, 9 aa, Homo Sapiens
GLYNPYGPQ

SEQ ID NO: 450431 - protein, 9 aa, Homo Sapiens
KYLEAASEK

SEQ ID NO: 450432 - protein, 9 aa, Homo Sapiens
LPYQPTLSD

SEQ ID NO: 450433 - protein, 9 aa, Homo Sapiens
CYIQGEGSC

SEQ ID NO: 450434 - protein, 9 aa, Homo Sapiens
IAQTVQILG

SEQ ID NO: 450435 - protein, 9 aa, Homo Sapiens
ELQKLLFVM

SEQ ID NO: 450436 - protein, 9 aa, Homo Sapiens
DFPNGSLGD

SEQ ID NO: 450437 - protein, 9 aa, Homo Sapiens
PLKMAGDLD

SEQ ID NO: 450438 - protein, 9 aa, Homo Sapiens
ENINNTFIK

SEQ ID NO: 450439 - protein, 9 aa, Homo Sapiens
VRALHHLHQ

SEQ ID NO: 450440 - protein, 9 aa, Homo Sapiens
NIHLGVNES

SEQ ID NO: 450441 - protein, 9 aa, Homo Sapiens
EGMANLPPH

SEQ ID NO: 450442 - protein, 9 aa, Homo Sapiens
VVLNNSKCY

SEQ ID NO: 450443 - protein, 9 aa, Homo Sapiens
TMLPQLEQS

SEQ ID NO: 450444 - protein, 9 aa, Homo Sapiens
DDDAIHITA

SEQ ID NO: 450445 - protein, 9 aa, Homo Sapiens
SLDKFLTSV

SEQ ID NO: 450446 - protein, 9 aa, Homo Sapiens
VRASHGVWK

SEQ ID NO: 450447 - protein, 9 aa, Homo Sapiens
LEIVLFTEK

SEQ ID NO: 450448 - protein, 9 aa, Homo Sapiens
FSQNSHLIW

SEQ ID NO: 450449 - protein, 9 aa, Homo Sapiens
ILKILYALV

SEQ ID NO: 450450 - protein, 9 aa, Homo Sapiens
DSDIEAHLN

SEQ ID NO: 450451 - protein, 9 aa, Homo Sapiens
EGHLSLSQW

SEQ ID NO: 450452 - protein, 9 aa, Homo Sapiens
VSPEFSEPE

SEQ ID NO: 450453 - protein, 9 aa, Homo Sapiens
EAHKKIWMF

SEQ ID NO: 450454 - protein, 9 aa, Homo Sapiens
IITYHEKPW

SEQ ID NO: 450455 - protein, 9 aa, Homo Sapiens
EQMGRYQCT

SEQ ID NO: 450456 - protein, 9 aa, Homo Sapiens
RYEMIRLLI

SEQ ID NO: 450457 - protein, 9 aa, Homo Sapiens
EFLATFFRG

SEQ ID NO: 450458 - protein, 9 aa, Homo Sapiens
ESLQPPRFF

SEQ ID NO: 450459 - protein, 9 aa, Homo Sapiens
LDRIYRFNT

SEQ ID NO: 450460 - protein, 9 aa, Homo Sapiens
AAKFRQLWG

SEQ ID NO: 450461 - protein, 9 aa, Homo Sapiens
GTYSPVDSL

SEQ ID NO: 450462 - protein, 9 aa, Homo Sapiens
LFKHECSRI

SEQ ID NO: 450463 - protein, 9 aa, Homo Sapiens
PKKNKNKGK

SEQ ID NO: 450464 - protein, 9 aa, Homo Sapiens
ETDTMENLT

SEQ ID NO: 450465 - protein, 9 aa, Homo Sapiens
NGKPPRSAT

SEQ ID NO: 450466 - protein, 9 aa, Homo Sapiens
KGKDKEYAD

SEQ ID NO: 450467 - protein, 9 aa, Homo Sapiens
LKMVQAVGG

SEQ ID NO: 450468 - protein, 9 aa, Homo Sapiens
GDDYSSGND

SEQ ID NO: 450469 - protein, 9 aa, Homo Sapiens
REHERLRTY

SEQ ID NO: 450470 - protein, 9 aa, Homo Sapiens
HDGPTNNLF

SEQ ID NO: 450471 - protein, 9 aa, Homo Sapiens
LYTSYYTNE

SEQ ID NO: 450472 - protein, 9 aa, Homo Sapiens
DNGMESASE

SEQ ID NO: 450473 - protein, 9 aa, Homo Sapiens
WYWSWLWAP

SEQ ID NO: 450474 - protein, 9 aa, Homo Sapiens
AVAKHPAGY

SEQ ID NO: 450475 - protein, 9 aa, Homo Sapiens
WYVTCAIHN

SEQ ID NO: 450476 - protein, 9 aa, Homo Sapiens
TWYTNSSKI

SEQ ID NO: 450477 - protein, 9 aa, Homo Sapiens
SNPEGIQKS

SEQ ID NO: 450478 - protein, 9 aa, Homo Sapiens
ILRTDNPIE

SEQ ID NO: 450479 - protein, 9 aa, Homo Sapiens
SNLNKMNDY

SEQ ID NO: 450480 - protein, 9 aa, Homo Sapiens
SSIPFFIFG

SEQ ID NO: 450481 - protein, 9 aa, Homo Sapiens
NWRAKLKRD

SEQ ID NO: 450482 - protein, 9 aa, Homo Sapiens
LGNFNLLPD

SEQ ID NO: 450483 - protein, 9 aa, Homo Sapiens
QIILYLLRC

SEQ ID NO: 450484 - protein, 9 aa, Homo Sapiens
EDESLSMAC

SEQ ID NO: 450485 - protein, 9 aa, Homo Sapiens
KDEAKQYRK

SEQ ID NO: 450486 - protein, 9 aa, Homo Sapiens
FSALANINL

SEQ ID NO: 450487 - protein, 9 aa, Homo Sapiens
DNIYPTFQM

SEQ ID NO: 450488 - protein, 9 aa, Homo Sapiens
LLGSVFLVA

SEQ ID NO: 450489 - protein, 9 aa, Homo Sapiens
EEEGIQYLD

SEQ ID NO: 450490 - protein, 9 aa, Homo Sapiens
DISGGVLND

SEQ ID NO: 450491 - protein, 9 aa, Homo Sapiens
QEDKQIKRK

SEQ ID NO: 450492 - protein, 9 aa, Homo Sapiens
IPYFETSAT

SEQ ID NO: 450493 - protein, 9 aa, Homo Sapiens
PEDSGEGNK

SEQ ID NO: 450494 - protein, 9 aa, Homo Sapiens
RDSVVFNAL

SEQ ID NO: 450495 - protein, 9 aa, Homo Sapiens
SHRSLHRSG

SEQ ID NO: 450496 - protein, 9 aa, Homo Sapiens
NKIQYHSRG

SEQ ID NO: 450497 - protein, 9 aa, Homo Sapiens
LKAAKDTKY

SEQ ID NO: 450498 - protein, 9 aa, Homo Sapiens
ICGLKRLCI

SEQ ID NO: 450499 - protein, 9 aa, Homo Sapiens
DHEKEIILG

SEQ ID NO: 450500 - protein, 9 aa, Homo Sapiens
FQSLRIKNS

SEQ ID NO: 450501 - protein, 9 aa, Homo Sapiens
KEIILGVLK

SEQ ID NO: 450502 - protein, 9 aa, Homo Sapiens
LRSNEVAVE

SEQ ID NO: 450503 - protein, 9 aa, Homo Sapiens
ELQEYNLEL

SEQ ID NO: 450504 - protein, 9 aa, Homo Sapiens
RVLGHTVRS

SEQ ID NO: 450505 - protein, 9 aa, Homo Sapiens
CDHNGGSPQ

SEQ ID NO: 450506 - protein, 9 aa, Homo Sapiens
RNTTMAVYV

SEQ ID NO: 450507 - protein, 9 aa, Homo Sapiens
WGIGYHLSM

SEQ ID NO: 450508 - protein, 9 aa, Homo Sapiens
VEHCKAHTE

SEQ ID NO: 450509 - protein, 9 aa, Homo Sapiens
FLTTQNIHL

SEQ ID NO: 450510 - protein, 9 aa, Homo Sapiens
QGLATLFEE

SEQ ID NO: 450511 - protein, 9 aa, Homo Sapiens
EKIIKEDYL

SEQ ID NO: 450512 - protein, 9 aa, Homo Sapiens
IIKEVLEEE

SEQ ID NO: 450513 - protein, 9 aa, Homo Sapiens
ASELNLQQN

SEQ ID NO: 450514 - protein, 9 aa, Homo Sapiens
RYEVNCLGI

SEQ ID NO: 450515 - protein, 9 aa, Homo Sapiens
SLASLPVPF

SEQ ID NO: 450516 - protein, 9 aa, Homo Sapiens
LPVPFRKDE

SEQ ID NO: 450517 - protein, 9 aa, Homo Sapiens
ISITIFCLD

SEQ ID NO: 450518 - protein, 9 aa, Homo Sapiens
QYQYYIYWT

SEQ ID NO: 450519 - protein, 9 aa, Homo Sapiens
YVLKGGEMS

SEQ ID NO: 450520 - protein, 9 aa, Homo Sapiens
IERVLRGKY

SEQ ID NO: 450521 - protein, 9 aa, Homo Sapiens
EAHMLCQRH

SEQ ID NO: 450522 - protein, 9 aa, Homo Sapiens
LRYIAIHNA

SEQ ID NO: 450523 - protein, 9 aa, Homo Sapiens
NKTMSKSPS

SEQ ID NO: 450524 - protein, 9 aa, Homo Sapiens
VKQQCHQAD

SEQ ID NO: 450525 - protein, 9 aa, Homo Sapiens
WYCPECRNY

SEQ ID NO: 450526 - protein, 9 aa, Homo Sapiens
GFCEDIQVP

SEQ ID NO: 450527 - protein, 9 aa, Homo Sapiens
RKKENVERL

SEQ ID NO: 450528 - protein, 9 aa, Homo Sapiens
CGHQLNHFF

SEQ ID NO: 450529 - protein, 9 aa, Homo Sapiens
FLASTPCHS

SEQ ID NO: 450530 - protein, 9 aa, Homo Sapiens
SSVDVIVKE

SEQ ID NO: 450531 - protein, 9 aa, Homo Sapiens
TLHKINHTQ

SEQ ID NO: 450532 - protein, 9 aa, Homo Sapiens
FHPFCLCLT

SEQ ID NO: 450533 - protein, 9 aa, Homo Sapiens
RAVADSWMD

SEQ ID NO: 450534 - protein, 9 aa, Homo Sapiens
DLFNLCSRR

SEQ ID NO: 450535 - protein, 9 aa, Homo Sapiens
DPKKMGSAE

SEQ ID NO: 450536 - protein, 9 aa, Homo Sapiens
ASKPSEEVN

SEQ ID NO: 450537 - protein, 9 aa, Homo Sapiens
DKETHRDFL

SEQ ID NO: 450538 - protein, 9 aa, Homo Sapiens
EREHALARG

SEQ ID NO: 450539 - protein, 9 aa, Homo Sapiens
KNIFHFGES

SEQ ID NO: 450540 - protein, 9 aa, Homo Sapiens
NKVKNKIQS

SEQ ID NO: 450541 - protein, 9 aa, Homo Sapiens
NGRELVEYG

SEQ ID NO: 450542 - protein, 9 aa, Homo Sapiens
HLPNQNGTV

SEQ ID NO: 450543 - protein, 9 aa, Homo Sapiens
QKEFNTLSG

SEQ ID NO: 450544 - protein, 9 aa, Homo Sapiens
QGGKINLKV

SEQ ID NO: 450545 - protein, 9 aa, Homo Sapiens
FEVCGANPW

SEQ ID NO: 450546 - protein, 9 aa, Homo Sapiens
GELARIKIF

SEQ ID NO: 450547 - protein, 9 aa, Homo Sapiens
EAIKKEEKV

SEQ ID NO: 450548 - protein, 9 aa, Homo Sapiens
THVKMESGG

SEQ ID NO: 450549 - protein, 9 aa, Homo Sapiens
STNLNTHFR

SEQ ID NO: 450550 - protein, 9 aa, Homo Sapiens
KFILEKLGE

SEQ ID NO: 450551 - protein, 9 aa, Homo Sapiens
RSTMEKYVR

SEQ ID NO: 450552 - protein, 9 aa, Homo Sapiens
TSQINLIDL

SEQ ID NO: 450553 - protein, 9 aa, Homo Sapiens
QSALAQHQI

SEQ ID NO: 450554 - protein, 9 aa, Homo Sapiens
DRKKENVER

SEQ ID NO: 450555 - protein, 9 aa, Homo Sapiens
SVEREHALA

SEQ ID NO: 450556 - protein, 9 aa, Homo Sapiens
TQHKIIHNR

SEQ ID NO: 450557 - protein, 9 aa, Homo Sapiens
LSLNTPSER

SEQ ID NO: 450558 - protein, 9 aa, Homo Sapiens
LERERLLCS

SEQ ID NO: 450559 - protein, 9 aa, Homo Sapiens
NHTVDKSYL

SEQ ID NO: 450560 - protein, 9 aa, Homo Sapiens
SEQEAHKKI

SEQ ID NO: 450561 - protein, 9 aa, Homo Sapiens
PYQPTLSDD

SEQ ID NO: 450562 - protein, 9 aa, Homo Sapiens
EEPTTENPK

SEQ ID NO: 450563 - protein, 9 aa, Homo Sapiens
VIQYFVVIA

SEQ ID NO: 450564 - protein, 9 aa, Homo Sapiens
AEEERLCLE

SEQ ID NO: 450565 - protein, 9 aa, Homo Sapiens
WQLQYSNQN

SEQ ID NO: 450566 - protein, 9 aa, Homo Sapiens
NEKPFYVED

SEQ ID NO: 450567 - protein, 9 aa, Homo Sapiens
YSMFLCMHV

SEQ ID NO: 450568 - protein, 9 aa, Homo Sapiens
KMTLLSCVN

SEQ ID NO: 450569 - protein, 9 aa, Homo Sapiens
CDRTHLKDT

SEQ ID NO: 450570 - protein, 9 aa, Homo Sapiens
KLNRSKHLE

SEQ ID NO: 450571 - protein, 9 aa, Homo Sapiens
ITQQEYYER

SEQ ID NO: 450572 - protein, 9 aa, Homo Sapiens
RHTIQTAEF

SEQ ID NO: 450573 - protein, 9 aa, Homo Sapiens
WDVQVHDQN

SEQ ID NO: 450574 - protein, 9 aa, Homo Sapiens
LLNYRKSSH

SEQ ID NO: 450575 - protein, 9 aa, Homo Sapiens
GTIIFIIKT

SEQ ID NO: 450576 - protein, 9 aa, Homo Sapiens
QRVHTEISP

SEQ ID NO: 450577 - protein, 9 aa, Homo Sapiens
GTVDWTVHS

SEQ ID NO: 450578 - protein, 9 aa, Homo Sapiens
LLDVAMSFF

SEQ ID NO: 450579 - protein, 9 aa, Homo Sapiens
SRNCLAEIP

SEQ ID NO: 450580 - protein, 9 aa, Homo Sapiens
LLRLISLFT

SEQ ID NO: 450581 - protein, 9 aa, Homo Sapiens
NQINVSEEM

SEQ ID NO: 450582 - protein, 9 aa, Homo Sapiens
GRELVEYGF

SEQ ID NO: 450583 - protein, 9 aa, Homo Sapiens
FHCKRINVI

SEQ ID NO: 450584 - protein, 9 aa, Homo Sapiens
NGGTKCGAG

SEQ ID NO: 450585 - protein, 9 aa, Homo Sapiens
PHRTSENTH

SEQ ID NO: 450586 - protein, 9 aa, Homo Sapiens
RQVTESFCE

SEQ ID NO: 450587 - protein, 9 aa, Homo Sapiens
EDDRFPTHK

SEQ ID NO: 450588 - protein, 9 aa, Homo Sapiens
VKSDGGTYQ

SEQ ID NO: 450589 - protein, 9 aa, Homo Sapiens
GVWGDYDDS

SEQ ID NO: 450590 - protein, 9 aa, Homo Sapiens
VPFRKDEKA

SEQ ID NO: 450591 - protein, 9 aa, Homo Sapiens
EYFFNRNRP

SEQ ID NO: 450592 - protein, 9 aa, Homo Sapiens
RTSNCHQFG

SEQ ID NO: 450593 - protein, 9 aa, Homo Sapiens
KKLLMPIKE

SEQ ID NO: 450594 - protein, 9 aa, Homo Sapiens
KIINMNIKL

SEQ ID NO: 450595 - protein, 9 aa, Homo Sapiens
CQCRNGVVL

SEQ ID NO: 450596 - protein, 9 aa, Homo Sapiens
RALIVVIPS

SEQ ID NO: 450597 - protein, 9 aa, Homo Sapiens
VVSGTVCLK

SEQ ID NO: 450598 - protein, 9 aa, Homo Sapiens
DATKQKRKL

SEQ ID NO: 450599 - protein, 9 aa, Homo Sapiens
QYILVINFS

SEQ ID NO: 450600 - protein, 9 aa, Homo Sapiens
YFNLQSSKK

SEQ ID NO: 450601 - protein, 9 aa, Homo Sapiens
ANLLLNCFP

SEQ ID NO: 450602 - protein, 9 aa, Homo Sapiens
YPTFQMFAK

SEQ ID NO: 450603 - protein, 9 aa, Homo Sapiens
VISHMVVSG

SEQ ID NO: 450604 - protein, 9 aa, Homo Sapiens
GFLGATGTL

SEQ ID NO: 450605 - protein, 9 aa, Homo Sapiens
DPERHYKDP

SEQ ID NO: 450606 - protein, 9 aa, Homo Sapiens
VFTSSSSSL

SEQ ID NO: 450607 - protein, 9 aa, Homo Sapiens
DLPDLNMQR

SEQ ID NO: 450608 - protein, 9 aa, Homo Sapiens
HNKIHSVEG

SEQ ID NO: 450609 - protein, 9 aa, Homo Sapiens
AIVPKMLED

SEQ ID NO: 450610 - protein, 9 aa, Homo Sapiens
KKENQGKNE

SEQ ID NO: 450611 - protein, 9 aa, Homo Sapiens
VKDLFLQRY

SEQ ID NO: 450612 - protein, 9 aa, Homo Sapiens
ELRGLFLGC

SEQ ID NO: 450613 - protein, 9 aa, Homo Sapiens
RMLNDATYK

SEQ ID NO: 450614 - protein, 9 aa, Homo Sapiens
LDQENKKYI

SEQ ID NO: 450615 - protein, 9 aa, Homo Sapiens
KEVVSRNCL

SEQ ID NO: 450616 - protein, 9 aa, Homo Sapiens
NQLLDGPYP

SEQ ID NO: 450617 - protein, 9 aa, Homo Sapiens
DASSLESYL

SEQ ID NO: 450618 - protein, 9 aa, Homo Sapiens
DSRLQTPIY

SEQ ID NO: 450619 - protein, 9 aa, Homo Sapiens
RNNFDKITL

SEQ ID NO: 450620 - protein, 9 aa, Homo Sapiens
HITDWQQGL

SEQ ID NO: 450621 - protein, 9 aa, Homo Sapiens
EEAITLLKE

SEQ ID NO: 450622 - protein, 9 aa, Homo Sapiens
SYVEKDQHR

SEQ ID NO: 450623 - protein, 9 aa, Homo Sapiens
LLNYGKSMS

SEQ ID NO: 450624 - protein, 9 aa, Homo Sapiens
PPETLGKGD

SEQ ID NO: 450625 - protein, 9 aa, Homo Sapiens
YYVRNTFHK

SEQ ID NO: 450626 - protein, 9 aa, Homo Sapiens
CPNCQHSDL

SEQ ID NO: 450627 - protein, 9 aa, Homo Sapiens
NYLVVAAMI

SEQ ID NO: 450628 - protein, 9 aa, Homo Sapiens
QKYKKEDQE

SEQ ID NO: 450629 - protein, 9 aa, Homo Sapiens
HKVLRITVC

SEQ ID NO: 450630 - protein, 9 aa, Homo Sapiens
GRETSSDIE

SEQ ID NO: 450631 - protein, 9 aa, Homo Sapiens
HNFCKAKLA

SEQ ID NO: 450632 - protein, 9 aa, Homo Sapiens
RYCEGHLSL

SEQ ID NO: 450633 - protein, 9 aa, Homo Sapiens
PGAMSATRA

SEQ ID NO: 450634 - protein, 9 aa, Homo Sapiens
QETQISQTI

SEQ ID NO: 450635 - protein, 9 aa, Homo Sapiens
DDLNKYLEP

SEQ ID NO: 450636 - protein, 9 aa, Homo Sapiens
QFTLTVCCL

SEQ ID NO: 450637 - protein, 9 aa, Homo Sapiens
EKPLNFFNV

SEQ ID NO: 450638 - protein, 9 aa, Homo Sapiens
LGKYNGYAP

SEQ ID NO: 450639 - protein, 9 aa, Homo Sapiens
IVFGYLPIY

SEQ ID NO: 450640 - protein, 9 aa, Homo Sapiens
ILYLLRCSK

SEQ ID NO: 450641 - protein, 9 aa, Homo Sapiens
SALPQRRCC

SEQ ID NO: 450642 - protein, 9 aa, Homo Sapiens
DNDESHHNF

SEQ ID NO: 450643 - protein, 9 aa, Homo Sapiens
RAYRSHELY

SEQ ID NO: 450644 - protein, 9 aa, Homo Sapiens
LKLIGVGEE

SEQ ID NO: 450645 - protein, 9 aa, Homo Sapiens
YWVSLPGKM

SEQ ID NO: 450646 - protein, 9 aa, Homo Sapiens
DSKRFEGIN

SEQ ID NO: 450647 - protein, 9 aa, Homo Sapiens
ILPVSDKNL

SEQ ID NO: 450648 - protein, 9 aa, Homo Sapiens
SWGPNFNFS

SEQ ID NO: 450649 - protein, 9 aa, Homo Sapiens
LKQKFTFQE

SEQ ID NO: 450650 - protein, 9 aa, Homo Sapiens
GYGEAWGTA

SEQ ID NO: 450651 - protein, 9 aa, Homo Sapiens
TYWGCVYLL

SEQ ID NO: 450652 - protein, 9 aa, Homo Sapiens
APASQRGEL

SEQ ID NO: 450653 - protein, 9 aa, Homo Sapiens
LEYWMRLHF

SEQ ID NO: 450654 - protein, 9 aa, Homo Sapiens
PIYKAMAVS

SEQ ID NO: 450655 - protein, 9 aa, Homo Sapiens
FEDTSNFCH

SEQ ID NO: 450656 - protein, 9 aa, Homo Sapiens
NNETKLGYS

SEQ ID NO: 450657 - protein, 9 aa, Homo Sapiens
LSICLTLKP

SEQ ID NO: 450658 - protein, 9 aa, Homo Sapiens
DSQRDFTVV

SEQ ID NO: 450659 - protein, 9 aa, Homo Sapiens
TMSRGSPMI

SEQ ID NO: 450660 - protein, 9 aa, Homo Sapiens
STENSHEDK

SEQ ID NO: 450661 - protein, 9 aa, Homo Sapiens
LCSIRKLIS

SEQ ID NO: 450662 - protein, 9 aa, Homo Sapiens
TWHLNERHY

SEQ ID NO: 450663 - protein, 9 aa, Homo Sapiens
MFEAINSVI

SEQ ID NO: 450664 - protein, 9 aa, Homo Sapiens
KTKHTYYYG

SEQ ID NO: 450665 - protein, 9 aa, Homo Sapiens
HMQISNAEK

SEQ ID NO: 450666 - protein, 9 aa, Homo Sapiens
DGPRKRATA

SEQ ID NO: 450667 - protein, 9 aa, Homo Sapiens
VFMSYPGND

SEQ ID NO: 450668 - protein, 9 aa, Homo Sapiens
ARLWNFTDD

SEQ ID NO: 450669 - protein, 9 aa, Homo Sapiens
PCPTDPSHS

SEQ ID NO: 450670 - protein, 9 aa, Homo Sapiens
QLTQHQIFH

SEQ ID NO: 450671 - protein, 9 aa, Homo Sapiens
NNSISVLLR

SEQ ID NO: 450672 - protein, 9 aa, Homo Sapiens
EYGKSFSRR

SEQ ID NO: 450673 - protein, 9 aa, Homo Sapiens
VALYGCCHQ

SEQ ID NO: 450674 - protein, 9 aa, Homo Sapiens
SKVDKMISH

SEQ ID NO: 450675 - protein, 9 aa, Homo Sapiens
CEDIQVPPG

SEQ ID NO: 450676 - protein, 9 aa, Homo Sapiens
TTIDKQMCT

SEQ ID NO: 450677 - protein, 9 aa, Homo Sapiens
SFATPNMIT

SEQ ID NO: 450678 - protein, 9 aa, Homo Sapiens
KFNLYVIED

SEQ ID NO: 450679 - protein, 9 aa, Homo Sapiens
SLSYLSIDS

SEQ ID NO: 450680 - protein, 9 aa, Homo Sapiens
RRLLNDELK

SEQ ID NO: 450681 - protein, 9 aa, Homo Sapiens
LPDRNTFCH

SEQ ID NO: 450682 - protein, 9 aa, Homo Sapiens
TLGARVTRH

SEQ ID NO: 450683 - protein, 9 aa, Homo Sapiens
KKENVERLA

SEQ ID NO: 450684 - protein, 9 aa, Homo Sapiens
VQLLRLIIL

SEQ ID NO: 450685 - protein, 9 aa, Homo Sapiens
KNKVKNKIQ

SEQ ID NO: 450686 - protein, 9 aa, Homo Sapiens
HRHLIEHVN

SEQ ID NO: 450687 - protein, 9 aa, Homo Sapiens
FYSKCLRLE

SEQ ID NO: 450688 - protein, 9 aa, Homo Sapiens
VRALSAQFE

SEQ ID NO: 450689 - protein, 9 aa, Homo Sapiens
ERVIAVHID

SEQ ID NO: 450690 - protein, 9 aa, Homo Sapiens
TPSPPCQPN

SEQ ID NO: 450691 - protein, 9 aa, Homo Sapiens
IINYSIEQP

SEQ ID NO: 450692 - protein, 9 aa, Homo Sapiens
AMNTKEPVK

SEQ ID NO: 450693 - protein, 9 aa, Homo Sapiens
FHHFAPLLC

SEQ ID NO: 450694 - protein, 9 aa, Homo Sapiens
SPEFSEPEE

SEQ ID NO: 450695 - protein, 9 aa, Homo Sapiens
LKKFINIAA

SEQ ID NO: 450696 - protein, 9 aa, Homo Sapiens
LIPKYEIAC

SEQ ID NO: 450697 - protein, 9 aa, Homo Sapiens
VGYLPKENP

SEQ ID NO: 450698 - protein, 9 aa, Homo Sapiens
ERYELIVDV

SEQ ID NO: 450699 - protein, 9 aa, Homo Sapiens
IQPQSSTPL

SEQ ID NO: 450700 - protein, 9 aa, Homo Sapiens
DPVPQVVWL

SEQ ID NO: 450701 - protein, 9 aa, Homo Sapiens
FVCNYGPEG

SEQ ID NO: 450702 - protein, 9 aa, Homo Sapiens
HPTEKTIFI

SEQ ID NO: 450703 - protein, 9 aa, Homo Sapiens
VALGPSTTA

SEQ ID NO: 450704 - protein, 9 aa, Homo Sapiens
GDKAIMEDS

SEQ ID NO: 450705 - protein, 9 aa, Homo Sapiens
YVNMDFTKI

SEQ ID NO: 450706 - protein, 9 aa, Homo Sapiens
LPNMLGMGG

SEQ ID NO: 450707 - protein, 9 aa, Homo Sapiens
QGNNFIRAF

SEQ ID NO: 450708 - protein, 9 aa, Homo Sapiens
DTSTGFSGS

SEQ ID NO: 450709 - protein, 9 aa, Homo Sapiens
KYMKNSDVS

SEQ ID NO: 450710 - protein, 9 aa, Homo Sapiens
HDQNIKEAT

SEQ ID NO: 450711 - protein, 9 aa, Homo Sapiens
RKVELERNR

SEQ ID NO: 450712 - protein, 9 aa, Homo Sapiens
SRSKALLKW

SEQ ID NO: 450713 - protein, 9 aa, Homo Sapiens
GKTFSHKDS

SEQ ID NO: 450714 - protein, 9 aa, Homo Sapiens
DGFTGPDGS

SEQ ID NO: 450715 - protein, 9 aa, Homo Sapiens
NLLTECIEG

SEQ ID NO: 450716 - protein, 9 aa, Homo Sapiens
GPKIIVVEC

SEQ ID NO: 450717 - protein, 9 aa, Homo Sapiens
KKQTNKNWV

SEQ ID NO: 450718 - protein, 9 aa, Homo Sapiens
PRKLEGCTR

SEQ ID NO: 450719 - protein, 9 aa, Homo Sapiens
LSTKTHLGT

SEQ ID NO: 450720 - protein, 9 aa, Homo Sapiens
LSSGATVGS

SEQ ID NO: 450721 - protein, 9 aa, Homo Sapiens
LLLIAQKNA

SEQ ID NO: 450722 - protein, 9 aa, Homo Sapiens
QIDRVNLEK

SEQ ID NO: 450723 - protein, 9 aa, Homo Sapiens
LTRDRDPSE

SEQ ID NO: 450724 - protein, 9 aa, Homo Sapiens
IHLWKANAS

SEQ ID NO: 450725 - protein, 9 aa, Homo Sapiens
KKIQEEETF

SEQ ID NO: 450726 - protein, 9 aa, Homo Sapiens
LITCKTRRN

SEQ ID NO: 450727 - protein, 9 aa, Homo Sapiens
SEAYYSHER

SEQ ID NO: 450728 - protein, 9 aa, Homo Sapiens
CLLAVNTFH

SEQ ID NO: 450729 - protein, 9 aa, Homo Sapiens
TATLHLVFT

SEQ ID NO: 450730 - protein, 9 aa, Homo Sapiens
QRDEISERA

SEQ ID NO: 450731 - protein, 9 aa, Homo Sapiens
YWCRPPHIF

SEQ ID NO: 450732 - protein, 9 aa, Homo Sapiens
TSPTQRYIN

SEQ ID NO: 450733 - protein, 9 aa, Homo Sapiens
FVNSLMVAS

SEQ ID NO: 450734 - protein, 9 aa, Homo Sapiens
FINNETKLG

SEQ ID NO: 450735 - protein, 9 aa, Homo Sapiens
VGSEVHLIE

SEQ ID NO: 450736 - protein, 9 aa, Homo Sapiens
TLVKFHRSH

SEQ ID NO: 450737 - protein, 9 aa, Homo Sapiens
IKFILEKLG

SEQ ID NO: 450738 - protein, 9 aa, Homo Sapiens
AINSVIFAT

SEQ ID NO: 450739 - protein, 9 aa, Homo Sapiens
CGIPRQCIP

SEQ ID NO: 450740 - protein, 9 aa, Homo Sapiens
KTTGEVVPG

SEQ ID NO: 450741 - protein, 9 aa, Homo Sapiens
PDRRCTKLD

SEQ ID NO: 450742 - protein, 9 aa, Homo Sapiens
QIQETLQEE

SEQ ID NO: 450743 - protein, 9 aa, Homo Sapiens
LNIRKEMRV

SEQ ID NO: 450744 - protein, 9 aa, Homo Sapiens
NYGKSMSLI

SEQ ID NO: 450745 - protein, 9 aa, Homo Sapiens
SFWNWLNTL

SEQ ID NO: 450746 - protein, 9 aa, Homo Sapiens
KAHLIAHQK

SEQ ID NO: 450747 - protein, 9 aa, Homo Sapiens
FYVEDTYLL

SEQ ID NO: 450748 - protein, 9 aa, Homo Sapiens
HHQLHACFQ

SEQ ID NO: 450749 - protein, 9 aa, Homo Sapiens
LRNWGIDKC

SEQ ID NO: 450750 - protein, 9 aa, Homo Sapiens
LQKRSLDIG

SEQ ID NO: 450751 - protein, 9 aa, Homo Sapiens
FSNWICNFI

SEQ ID NO: 450752 - protein, 9 aa, Homo Sapiens
EVKDGGGLS

SEQ ID NO: 450753 - protein, 9 aa, Homo Sapiens
VEVKDGGGL

SEQ ID NO: 450754 - protein, 9 aa, Homo Sapiens
FDRYVEPLK

SEQ ID NO: 450755 - protein, 9 aa, Homo Sapiens
SQRLFMIIW

SEQ ID NO: 450756 - protein, 9 aa, Homo Sapiens
SNIIPFCDK

SEQ ID NO: 450757 - protein, 9 aa, Homo Sapiens
RRPPHNAST

SEQ ID NO: 450758 - protein, 9 aa, Homo Sapiens
PILLCDIST

SEQ ID NO: 450759 - protein, 9 aa, Homo Sapiens
EERLCLEEE

SEQ ID NO: 450760 - protein, 9 aa, Homo Sapiens
MKGLGTNED

SEQ ID NO: 450761 - protein, 9 aa, Homo Sapiens
DFLAKAHFA

SEQ ID NO: 450762 - protein, 9 aa, Homo Sapiens
VISCNICKI

SEQ ID NO: 450763 - protein, 9 aa, Homo Sapiens
GIHREYKDH

SEQ ID NO: 450764 - protein, 9 aa, Homo Sapiens
LCLLCQDNN

SEQ ID NO: 450765 - protein, 9 aa, Homo Sapiens
WLPADYEDG

SEQ ID NO: 450766 - protein, 9 aa, Homo Sapiens
IHTGDKPYQ

SEQ ID NO: 450767 - protein, 9 aa, Homo Sapiens
PFMVTDNTY

SEQ ID NO: 450768 - protein, 9 aa, Homo Sapiens
GHCLPKSIK

SEQ ID NO: 450769 - protein, 9 aa, Homo Sapiens
IFSKYQKTA

SEQ ID NO: 450770 - protein, 9 aa, Homo Sapiens
GLCFNILCV

SEQ ID NO: 450771 - protein, 9 aa, Homo Sapiens
QRRGQRDLL

SEQ ID NO: 450772 - protein, 9 aa, Homo Sapiens
ENQTYRALD

SEQ ID NO: 450773 - protein, 9 aa, Homo Sapiens
NNLPVVSIH

SEQ ID NO: 450774 - protein, 9 aa, Homo Sapiens
HKESDIENF

SEQ ID NO: 450775 - protein, 9 aa, Homo Sapiens
YWSWLWAPP

SEQ ID NO: 450776 - protein, 9 aa, Homo Sapiens
EKLKTQHMN

SEQ ID NO: 450777 - protein, 9 aa, Homo Sapiens
SSASPGIDT

SEQ ID NO: 450778 - protein, 9 aa, Homo Sapiens
IKLISETLR

SEQ ID NO: 450779 - protein, 9 aa, Homo Sapiens
IFGYLVSIT

SEQ ID NO: 450780 - protein, 9 aa, Homo Sapiens
PQKHRICVC

SEQ ID NO: 450781 - protein, 9 aa, Homo Sapiens
AAYVIQGLA

SEQ ID NO: 450782 - protein, 9 aa, Homo Sapiens
ENVPSYKTN

SEQ ID NO: 450783 - protein, 9 aa, Homo Sapiens
IESITDTFS

SEQ ID NO: 450784 - protein, 9 aa, Homo Sapiens
EAPPSPAKD

SEQ ID NO: 450785 - protein, 9 aa, Homo Sapiens
WRPLQIPLK

SEQ ID NO: 450786 - protein, 9 aa, Homo Sapiens
PFPDGMDND

SEQ ID NO: 450787 - protein, 9 aa, Homo Sapiens
YNLSPKSYQ

SEQ ID NO: 450788 - protein, 9 aa, Homo Sapiens
DEFIDMERK

SEQ ID NO: 450789 - protein, 9 aa, Homo Sapiens
AAQYFVKLR

SEQ ID NO: 450790 - protein, 9 aa, Homo Sapiens
FGYLPIYSI

SEQ ID NO: 450791 - protein, 9 aa, Homo Sapiens
DMDEQQNVR

SEQ ID NO: 450792 - protein, 9 aa, Homo Sapiens
SRTASFAVQ

SEQ ID NO: 450793 - protein, 9 aa, Homo Sapiens
HGVWKGAWY

SEQ ID NO: 450794 - protein, 9 aa, Homo Sapiens
FVRLTDELY

SEQ ID NO: 450795 - protein, 9 aa, Homo Sapiens
WGHKAIEAN

SEQ ID NO: 450796 - protein, 9 aa, Homo Sapiens
VSAKMDDNG

SEQ ID NO: 450797 - protein, 9 aa, Homo Sapiens
SPSMAPVAM

SEQ ID NO: 450798 - protein, 9 aa, Homo Sapiens
AAFLIGALL

SEQ ID NO: 450799 - protein, 9 aa, Homo Sapiens
PKYFVLAPK

SEQ ID NO: 450800 - protein, 9 aa, Homo Sapiens
QLIHNNLKD

SEQ ID NO: 450801 - protein, 9 aa, Homo Sapiens
TQRYINSKV

SEQ ID NO: 450802 - protein, 9 aa, Homo Sapiens
NPQNSPGLL

SEQ ID NO: 450803 - protein, 9 aa, Homo Sapiens
GSVDAGEEQ

SEQ ID NO: 450804 - protein, 9 aa, Homo Sapiens
CLRRFWASV

SEQ ID NO: 450805 - protein, 9 aa, Homo Sapiens
AEAMKKRKL

SEQ ID NO: 450806 - protein, 9 aa, Homo Sapiens
KNMSYTLLP

SEQ ID NO: 450807 - protein, 9 aa, Homo Sapiens
PPFEVNDLP

SEQ ID NO: 450808 - protein, 9 aa, Homo Sapiens
KYEELLVWY

SEQ ID NO: 450809 - protein, 9 aa, Homo Sapiens
EYELQEYNL

SEQ ID NO: 450810 - protein, 9 aa, Homo Sapiens
CKEYGKSFS

SEQ ID NO: 450811 - protein, 9 aa, Homo Sapiens
QRKANLVNR

SEQ ID NO: 450812 - protein, 9 aa, Homo Sapiens
ILLSMLTSV

SEQ ID NO: 450813 - protein, 9 aa, Homo Sapiens
GGLKHITKL

SEQ ID NO: 450814 - protein, 9 aa, Homo Sapiens
IAETGNNLQ

SEQ ID NO: 450815 - protein, 9 aa, Homo Sapiens
KPQEENNFY

SEQ ID NO: 450816 - protein, 9 aa, Homo Sapiens
YDPHSNSWA

SEQ ID NO: 450817 - protein, 9 aa, Homo Sapiens
GMDNDIGIL

SEQ ID NO: 450818 - protein, 9 aa, Homo Sapiens
IVRALSAQF

SEQ ID NO: 450819 - protein, 9 aa, Homo Sapiens
NQQSDFYKL

SEQ ID NO: 450820 - protein, 9 aa, Homo Sapiens
APKADLLTL

SEQ ID NO: 450821 - protein, 9 aa, Homo Sapiens
AVAETFVCH

SEQ ID NO: 450822 - protein, 9 aa, Homo Sapiens
FNGNQIVDV

SEQ ID NO: 450823 - protein, 9 aa, Homo Sapiens
VWGDYDDSA

SEQ ID NO: 450824 - protein, 9 aa, Homo Sapiens
PTFCKLYRL

SEQ ID NO: 450825 - protein, 9 aa, Homo Sapiens
DKSKLQEIY

SEQ ID NO: 450826 - protein, 9 aa, Homo Sapiens
ISGNTSQRG

SEQ ID NO: 450827 - protein, 9 aa, Homo Sapiens
GLKSVLSTN

SEQ ID NO: 450828 - protein, 9 aa, Homo Sapiens
EHYIKEGLD

SEQ ID NO: 450829 - protein, 9 aa, Homo Sapiens
AFSHSGSLQ

SEQ ID NO: 450830 - protein, 9 aa, Homo Sapiens
NENILPSDF

SEQ ID NO: 450831 - protein, 9 aa, Homo Sapiens
ICMENILSG

SEQ ID NO: 450832 - protein, 9 aa, Homo Sapiens
SAPYDVRTI

SEQ ID NO: 450833 - protein, 9 aa, Homo Sapiens
LCLEKYHLQ

SEQ ID NO: 450834 - protein, 9 aa, Homo Sapiens
ETISEYISV

SEQ ID NO: 450835 - protein, 9 aa, Homo Sapiens
PVTIDQILD

SEQ ID NO: 450836 - protein, 9 aa, Homo Sapiens
VNEYKKIIL

SEQ ID NO: 450837 - protein, 9 aa, Homo Sapiens
ENKVVQDDT

SEQ ID NO: 450838 - protein, 9 aa, Homo Sapiens
PTVIDEIQN

SEQ ID NO: 450839 - protein, 9 aa, Homo Sapiens
RMQLQADIL

SEQ ID NO: 450840 - protein, 9 aa, Homo Sapiens
VESLQPPRF

SEQ ID NO: 450841 - protein, 9 aa, Homo Sapiens
ASSALNLTE

SEQ ID NO: 450842 - protein, 9 aa, Homo Sapiens
MFEQTRIQE

SEQ ID NO: 450843 - protein, 9 aa, Homo Sapiens
LQEYEVLQT

SEQ ID NO: 450844 - protein, 9 aa, Homo Sapiens
EVDSGCRNT

SEQ ID NO: 450845 - protein, 9 aa, Homo Sapiens
STFHRMYPG

SEQ ID NO: 450846 - protein, 9 aa, Homo Sapiens
NPLVLIEHF

SEQ ID NO: 450847 - protein, 9 aa, Homo Sapiens
KDNIKMKPK

SEQ ID NO: 450848 - protein, 9 aa, Homo Sapiens
YRDLHSTLL

SEQ ID NO: 450849 - protein, 9 aa, Homo Sapiens
VAGSALSGP

SEQ ID NO: 450850 - protein, 9 aa, Homo Sapiens
NLNRAKEAE

SEQ ID NO: 450851 - protein, 9 aa, Homo Sapiens
TSTANFPTI

SEQ ID NO: 450852 - protein, 9 aa, Homo Sapiens
SAVTMDLLS

SEQ ID NO: 450853 - protein, 9 aa, Homo Sapiens
SSHSPLWKK

SEQ ID NO: 450854 - protein, 9 aa, Homo Sapiens
ELGLLISFL

SEQ ID NO: 450855 - protein, 9 aa, Homo Sapiens
GSQISPPFS

SEQ ID NO: 450856 - protein, 9 aa, Homo Sapiens
YLQLEDVTH

SEQ ID NO: 450857 - protein, 9 aa, Homo Sapiens
GNTFVLHQT

SEQ ID NO: 450858 - protein, 9 aa, Homo Sapiens
LNFTASDNT

SEQ ID NO: 450859 - protein, 9 aa, Homo Sapiens
MAMPLCGHQ

SEQ ID NO: 450860 - protein, 9 aa, Homo Sapiens
TGLVSCKVS

SEQ ID NO: 450861 - protein, 9 aa, Homo Sapiens
HFPHLVESV

SEQ ID NO: 450862 - protein, 9 aa, Homo Sapiens
GLDKPVEII

SEQ ID NO: 450863 - protein, 9 aa, Homo Sapiens
TLVNGFANN

SEQ ID NO: 450864 - protein, 9 aa, Homo Sapiens
ANLTTHKII

SEQ ID NO: 450865 - protein, 9 aa, Homo Sapiens
SDKIIQLYD

SEQ ID NO: 450866 - protein, 9 aa, Homo Sapiens
YLYIINKTR

SEQ ID NO: 450867 - protein, 9 aa, Homo Sapiens
SREKTTCAI

SEQ ID NO: 450868 - protein, 9 aa, Homo Sapiens
NNVEFKAQK

SEQ ID NO: 450869 - protein, 9 aa, Homo Sapiens
EALQKELDL

SEQ ID NO: 450870 - protein, 9 aa, Homo Sapiens
SLEIKEGSY

SEQ ID NO: 450871 - protein, 9 aa, Homo Sapiens
GNEVTVEQL

SEQ ID NO: 450872 - protein, 9 aa, Homo Sapiens
KPLLTLDLD

SEQ ID NO: 450873 - protein, 9 aa, Homo Sapiens
NSCRKYLFI

SEQ ID NO: 450874 - protein, 9 aa, Homo Sapiens
NFFNVTVLI

SEQ ID NO: 450875 - protein, 9 aa, Homo Sapiens
GKFQVPKIA

SEQ ID NO: 450876 - protein, 9 aa, Homo Sapiens
REKTTCAIN

SEQ ID NO: 450877 - protein, 9 aa, Homo Sapiens
RCEVRPKVL

SEQ ID NO: 450878 - protein, 9 aa, Homo Sapiens
TNAPQKGQL

SEQ ID NO: 450879 - protein, 9 aa, Homo Sapiens
HTPVVRLSW

SEQ ID NO: 450880 - protein, 9 aa, Homo Sapiens
GTFGQNCSH

SEQ ID NO: 450881 - protein, 9 aa, Homo Sapiens
VHTSPKVNN

SEQ ID NO: 450882 - protein, 9 aa, Homo Sapiens
SIVVILLYG

SEQ ID NO: 450883 - protein, 9 aa, Homo Sapiens
EEGSRRLLK

SEQ ID NO: 450884 - protein, 9 aa, Homo Sapiens
SLSSGATVG

SEQ ID NO: 450885 - protein, 9 aa, Homo Sapiens
PIIIVPEQT

SEQ ID NO: 450886 - protein, 9 aa, Homo Sapiens
TLHILMSNY

SEQ ID NO: 450887 - protein, 9 aa, Homo Sapiens
LPEADSILS

SEQ ID NO: 450888 - protein, 9 aa, Homo Sapiens
PHASTMALV

SEQ ID NO: 450889 - protein, 9 aa, Homo Sapiens
YHEQLPELD

SEQ ID NO: 450890 - protein, 9 aa, Homo Sapiens
TLKVILSAC

SEQ ID NO: 450891 - protein, 9 aa, Homo Sapiens
IYLTGPYLD

SEQ ID NO: 450892 - protein, 9 aa, Homo Sapiens
CWSIPADGR

SEQ ID NO: 450893 - protein, 9 aa, Homo Sapiens
FSSIPFFIF

SEQ ID NO: 450894 - protein, 9 aa, Homo Sapiens
TSQRGKSGF

SEQ ID NO: 450895 - protein, 9 aa, Homo Sapiens
QDNSEMCKV

SEQ ID NO: 450896 - protein, 9 aa, Homo Sapiens
DYLWAAGQE

SEQ ID NO: 450897 - protein, 9 aa, Homo Sapiens
HLAEHCRIN

SEQ ID NO: 450898 - protein, 9 aa, Homo Sapiens
KQQNATENC

SEQ ID NO: 450899 - protein, 9 aa, Homo Sapiens
LMKMHGLGL

SEQ ID NO: 450900 - protein, 9 aa, Homo Sapiens
KFIGVTELS

SEQ ID NO: 450901 - protein, 9 aa, Homo Sapiens
SDPVGVLYM

SEQ ID NO: 450902 - protein, 9 aa, Homo Sapiens
RILTRNENN

SEQ ID NO: 450903 - protein, 9 aa, Homo Sapiens
EEAYNKINQ

SEQ ID NO: 450904 - protein, 9 aa, Homo Sapiens
VSAVTMDLL

SEQ ID NO: 450905 - protein, 9 aa, Homo Sapiens
AFNHRSHLK

SEQ ID NO: 450906 - protein, 9 aa, Homo Sapiens
EALKAVFAQ

SEQ ID NO: 450907 - protein, 9 aa, Homo Sapiens
LVFTDSLQE

SEQ ID NO: 450908 - protein, 9 aa, Homo Sapiens
GYRDIVNIN

SEQ ID NO: 450909 - protein, 9 aa, Homo Sapiens
NSRYVEMKY

SEQ ID NO: 450910 - protein, 9 aa, Homo Sapiens
QIFFQSYAQ

SEQ ID NO: 450911 - protein, 9 aa, Homo Sapiens
PFHADNFLQ

SEQ ID NO: 450912 - protein, 9 aa, Homo Sapiens
RDMHMQISN

SEQ ID NO: 450913 - protein, 9 aa, Homo Sapiens
LNTRADKEG

SEQ ID NO: 450914 - protein, 9 aa, Homo Sapiens
DKPSVSQTS

SEQ ID NO: 450915 - protein, 9 aa, Homo Sapiens
ILPPPHLFT

SEQ ID NO: 450916 - protein, 9 aa, Homo Sapiens
LDTLTKHYG

SEQ ID NO: 450917 - protein, 9 aa, Homo Sapiens
IYDFLCEVP

SEQ ID NO: 450918 - protein, 9 aa, Homo Sapiens
AVLYDAVNS

SEQ ID NO: 450919 - protein, 9 aa, Homo Sapiens
FFVLKNCSE

SEQ ID NO: 450920 - protein, 9 aa, Homo Sapiens
DLLTEYANT

SEQ ID NO: 450921 - protein, 9 aa, Homo Sapiens
WLNTLLKTL

SEQ ID NO: 450922 - protein, 9 aa, Homo Sapiens
STNTEKKKQ

SEQ ID NO: 450923 - protein, 9 aa, Homo Sapiens
ACQIRYERD

SEQ ID NO: 450924 - protein, 9 aa, Homo Sapiens
TSHLPNQNG

SEQ ID NO: 450925 - protein, 9 aa, Homo Sapiens
IRAFRTIPE

SEQ ID NO: 450926 - protein, 9 aa, Homo Sapiens
TERNLQIIA

SEQ ID NO: 450927 - protein, 9 aa, Homo Sapiens
LHYQTLVRQ

SEQ ID NO: 450928 - protein, 9 aa, Homo Sapiens
VTVYHKGRF

SEQ ID NO: 450929 - protein, 9 aa, Homo Sapiens
ELMQKHTHS

SEQ ID NO: 450930 - protein, 9 aa, Homo Sapiens
KGEKGDPDL

SEQ ID NO: 450931 - protein, 9 aa, Homo Sapiens
LACILLSDL

SEQ ID NO: 450932 - protein, 9 aa, Homo Sapiens
DEEEFIPLV

SEQ ID NO: 450933 - protein, 9 aa, Homo Sapiens
MHSWEGHII

SEQ ID NO: 450934 - protein, 9 aa, Homo Sapiens
FYLTALSLC

SEQ ID NO: 450935 - protein, 9 aa, Homo Sapiens
LEPPQKHRI

SEQ ID NO: 450936 - protein, 9 aa, Homo Sapiens
LDQGDLYSL

SEQ ID NO: 450937 - protein, 9 aa, Homo Sapiens
DSGSGGFNY

SEQ ID NO: 450938 - protein, 9 aa, Homo Sapiens
DRTLHSRPR

SEQ ID NO: 450939 - protein, 9 aa, Homo Sapiens
YPTTPKSVK

SEQ ID NO: 450940 - protein, 9 aa, Homo Sapiens
YEVVDALVC

SEQ ID NO: 450941 - protein, 9 aa, Homo Sapiens
SPTTLKKLE

SEQ ID NO: 450942 - protein, 9 aa, Homo Sapiens
IVPRLGMCL

SEQ ID NO: 450943 - protein, 9 aa, Homo Sapiens
STLAKHKII

SEQ ID NO: 450944 - protein, 9 aa, Homo Sapiens
FSWCANYIH

SEQ ID NO: 450945 - protein, 9 aa, Homo Sapiens
GNQVNRKVI

SEQ ID NO: 450946 - protein, 9 aa, Homo Sapiens
FELIKDTRF

SEQ ID NO: 450947 - protein, 9 aa, Homo Sapiens
LTRDERTHK

SEQ ID NO: 450948 - protein, 9 aa, Homo Sapiens
WSLEYVVSR

SEQ ID NO: 450949 - protein, 9 aa, Homo Sapiens
IWKDPHLQI

SEQ ID NO: 450950 - protein, 9 aa, Homo Sapiens
SVAWTLYVL

SEQ ID NO: 450951 - protein, 9 aa, Homo Sapiens
CFVSHPTEK

SEQ ID NO: 450952 - protein, 9 aa, Homo Sapiens
CSRDKVSHL

SEQ ID NO: 450953 - protein, 9 aa, Homo Sapiens
MECGKINGR

SEQ ID NO: 450954 - protein, 9 aa, Homo Sapiens
TLKKLEKSG

SEQ ID NO: 450955 - protein, 9 aa, Homo Sapiens
PKPIEKSQL

SEQ ID NO: 450956 - protein, 9 aa, Homo Sapiens
FFFKLIEDT

SEQ ID NO: 450957 - protein, 9 aa, Homo Sapiens
FMIIWLKGV

SEQ ID NO: 450958 - protein, 9 aa, Homo Sapiens
DEQQNVRES

SEQ ID NO: 450959 - protein, 9 aa, Homo Sapiens
GADGFTGPD

SEQ ID NO: 450960 - protein, 9 aa, Homo Sapiens
YVNDPMPNR

SEQ ID NO: 450961 - protein, 9 aa, Homo Sapiens
KSVLSTNRN

SEQ ID NO: 450962 - protein, 9 aa, Homo Sapiens
RCTKLDMAR

SEQ ID NO: 450963 - protein, 9 aa, Homo Sapiens
CGCGCGCGS

SEQ ID NO: 450964 - protein, 9 aa, Homo Sapiens
QFVNVTFQI

SEQ ID NO: 450965 - protein, 9 aa, Homo Sapiens
EGCHKKKQS

SEQ ID NO: 450966 - protein, 9 aa, Homo Sapiens
SPALNTMFC

SEQ ID NO: 450967 - protein, 9 aa, Homo Sapiens
TMFEAINSV

SEQ ID NO: 450968 - protein, 9 aa, Homo Sapiens
YTISLRLKN

SEQ ID NO: 450969 - protein, 9 aa, Homo Sapiens
IPHPSMTSQ

SEQ ID NO: 450970 - protein, 9 aa, Homo Sapiens
CAQRCGRKD

SEQ ID NO: 450971 - protein, 9 aa, Homo Sapiens
GASLMTGPM

SEQ ID NO: 450972 - protein, 9 aa, Homo Sapiens
LSTLAQNNQ

SEQ ID NO: 450973 - protein, 9 aa, Homo Sapiens
FKDCYQFTF

SEQ ID NO: 450974 - protein, 9 aa, Homo Sapiens
CLRCCLSVL

SEQ ID NO: 450975 - protein, 9 aa, Homo Sapiens
LHMVVDEDL

SEQ ID NO: 450976 - protein, 9 aa, Homo Sapiens
EADPMKRPA

SEQ ID NO: 450977 - protein, 9 aa, Homo Sapiens
FLEERIRQQ

SEQ ID NO: 450978 - protein, 9 aa, Homo Sapiens
DWINLVIAN

SEQ ID NO: 450979 - protein, 9 aa, Homo Sapiens
RGQRDLLRH

SEQ ID NO: 450980 - protein, 9 aa, Homo Sapiens
REIAEEEEL

SEQ ID NO: 450981 - protein, 9 aa, Homo Sapiens
NNCDLPSRT

SEQ ID NO: 450982 - protein, 9 aa, Homo Sapiens
ALSPRVAAD

SEQ ID NO: 450983 - protein, 9 aa, Homo Sapiens
TIAQCCPKL

SEQ ID NO: 450984 - protein, 9 aa, Homo Sapiens
GDKLHGFTV

SEQ ID NO: 450985 - protein, 9 aa, Homo Sapiens
WIRVKHTHV

SEQ ID NO: 450986 - protein, 9 aa, Homo Sapiens
CRRWNEVCH

SEQ ID NO: 450987 - protein, 9 aa, Homo Sapiens
GGMVGQFFG

SEQ ID NO: 450988 - protein, 9 aa, Homo Sapiens
MQEGELAIF

SEQ ID NO: 450989 - protein, 9 aa, Homo Sapiens
VGSPQSPVN

SEQ ID NO: 450990 - protein, 9 aa, Homo Sapiens
GPGPLQDRS

SEQ ID NO: 450991 - protein, 9 aa, Homo Sapiens
RCRHFQWVD

SEQ ID NO: 450992 - protein, 9 aa, Homo Sapiens
DKFGTGPQS

SEQ ID NO: 450993 - protein, 9 aa, Homo Sapiens
IHSDQLTLH

SEQ ID NO: 450994 - protein, 9 aa, Homo Sapiens
QHANVVLLD

SEQ ID NO: 450995 - protein, 9 aa, Homo Sapiens
ATNEWIYVV

SEQ ID NO: 450996 - protein, 9 aa, Homo Sapiens
PFYKVLLSG

SEQ ID NO: 450997 - protein, 9 aa, Homo Sapiens
LSDFFYKFR

SEQ ID NO: 450998 - protein, 9 aa, Homo Sapiens
LVKIKIMSF

SEQ ID NO: 450999 - protein, 9 aa, Homo Sapiens
CLLLWLYVQ

SEQ ID NO: 451000 - protein, 9 aa, Homo Sapiens
KEKGKWLAA

SEQ ID NO: 451001 - protein, 9 aa, Homo Sapiens
GNSCAAQII

SEQ ID NO: 451002 - protein, 9 aa, Homo Sapiens
QKTHLIAHQ

SEQ ID NO: 451003 - protein, 9 aa, Homo Sapiens
DESEKNNSG

SEQ ID NO: 451004 - protein, 9 aa, Homo Sapiens
NDCHGQGCC

SEQ ID NO: 451005 - protein, 9 aa, Homo Sapiens
YVFIVTIIL

SEQ ID NO: 451006 - protein, 9 aa, Homo Sapiens
PVLEHEARH

SEQ ID NO: 451007 - protein, 9 aa, Homo Sapiens
PTKYPTTPK

SEQ ID NO: 451008 - protein, 9 aa, Homo Sapiens
LCDLNDSKC

SEQ ID NO: 451009 - protein, 9 aa, Homo Sapiens
FVCTVCNEF

SEQ ID NO: 451010 - protein, 9 aa, Homo Sapiens
KISEGLQGA

SEQ ID NO: 451011 - protein, 9 aa, Homo Sapiens
GLHYMGKLV

SEQ ID NO: 451012 - protein, 9 aa, Homo Sapiens
PIKDGHWDI

SEQ ID NO: 451013 - protein, 9 aa, Homo Sapiens
INPMDVWHN

SEQ ID NO: 451014 - protein, 9 aa, Homo Sapiens
LHHLIPPVL

SEQ ID NO: 451015 - protein, 9 aa, Homo Sapiens
ILSRLMQVG

SEQ ID NO: 451016 - protein, 9 aa, Homo Sapiens
KPRVAEWCY

SEQ ID NO: 451017 - protein, 9 aa, Homo Sapiens
AQSDLFWLR

SEQ ID NO: 451018 - protein, 9 aa, Homo Sapiens
GIYDESNAF

SEQ ID NO: 451019 - protein, 9 aa, Homo Sapiens
ANNQGNRTT

SEQ ID NO: 451020 - protein, 9 aa, Homo Sapiens
GLVSCKVSA

SEQ ID NO: 451021 - protein, 9 aa, Homo Sapiens
ANKVMNSYF

SEQ ID NO: 451022 - protein, 9 aa, Homo Sapiens
YDRRNDKVD

SEQ ID NO: 451023 - protein, 9 aa, Homo Sapiens
RKRELDHRL

SEQ ID NO: 451024 - protein, 9 aa, Homo Sapiens
ELRPTVVHG

SEQ ID NO: 451025 - protein, 9 aa, Homo Sapiens
VIADLSTLK

SEQ ID NO: 451026 - protein, 9 aa, Homo Sapiens
AVALYGLIE

SEQ ID NO: 451027 - protein, 9 aa, Homo Sapiens
LRWFPITLP

SEQ ID NO: 451028 - protein, 9 aa, Homo Sapiens
YSRRHLQLA

SEQ ID NO: 451029 - protein, 9 aa, Homo Sapiens
SKSSALIRH

SEQ ID NO: 451030 - protein, 9 aa, Homo Sapiens
IDPVDTGNW

SEQ ID NO: 451031 - protein, 9 aa, Homo Sapiens
KKYCKCNEC

SEQ ID NO: 451032 - protein, 9 aa, Homo Sapiens
KSYTCEECG

SEQ ID NO: 451033 - protein, 9 aa, Homo Sapiens
EMKSARYLQ

SEQ ID NO: 451034 - protein, 9 aa, Homo Sapiens
NCVKAFSFK

SEQ ID NO: 451035 - protein, 9 aa, Homo Sapiens
KEKVFTEQA

SEQ ID NO: 451036 - protein, 9 aa, Homo Sapiens
FIRLSKEDV

SEQ ID NO: 451037 - protein, 9 aa, Homo Sapiens
GHNELFRAN

SEQ ID NO: 451038 - protein, 9 aa, Homo Sapiens
KELNHLGVL

SEQ ID NO: 451039 - protein, 9 aa, Homo Sapiens
DSVLMKYCL

SEQ ID NO: 451040 - protein, 9 aa, Homo Sapiens
WYDKAEKVI

SEQ ID NO: 451041 - protein, 9 aa, Homo Sapiens
KDIWAACCV

SEQ ID NO: 451042 - protein, 9 aa, Homo Sapiens
INKPKQFMT

SEQ ID NO: 451043 - protein, 9 aa, Homo Sapiens
RTVSLQVDG

SEQ ID NO: 451044 - protein, 9 aa, Homo Sapiens
QYLLEEIHL

SEQ ID NO: 451045 - protein, 9 aa, Homo Sapiens
FEECLEKCF

SEQ ID NO: 451046 - protein, 9 aa, Homo Sapiens
QCGRSVFDI

SEQ ID NO: 451047 - protein, 9 aa, Homo Sapiens
NFFNQNKKK

SEQ ID NO: 451048 - protein, 9 aa, Homo Sapiens
ETQRGFCEP

SEQ ID NO: 451049 - protein, 9 aa, Homo Sapiens
DCGECHSAL

SEQ ID NO: 451050 - protein, 9 aa, Homo Sapiens
LLQYQDLVV

SEQ ID NO: 451051 - protein, 9 aa, Homo Sapiens
FRHKQINPM

SEQ ID NO: 451052 - protein, 9 aa, Homo Sapiens
EHILGKMTV

SEQ ID NO: 451053 - protein, 9 aa, Homo Sapiens
KHHPFFQLP

SEQ ID NO: 451054 - protein, 9 aa, Homo Sapiens
LDDPPGQFD

SEQ ID NO: 451055 - protein, 9 aa, Homo Sapiens
ITCQKSYNP

SEQ ID NO: 451056 - protein, 9 aa, Homo Sapiens
TKQKRKLSS

SEQ ID NO: 451057 - protein, 9 aa, Homo Sapiens
EKAIQSLLE

SEQ ID NO: 451058 - protein, 9 aa, Homo Sapiens
FSDNSMSEK

SEQ ID NO: 451059 - protein, 9 aa, Homo Sapiens
INFRDIKKR

SEQ ID NO: 451060 - protein, 9 aa, Homo Sapiens
GSGPHRPSP

SEQ ID NO: 451061 - protein, 9 aa, Homo Sapiens
HSQFYQGLP

SEQ ID NO: 451062 - protein, 9 aa, Homo Sapiens
HLIEHVNAE

SEQ ID NO: 451063 - protein, 9 aa, Homo Sapiens
HYLNFSFCS

SEQ ID NO: 451064 - protein, 9 aa, Homo Sapiens
YKGLRVLED

SEQ ID NO: 451065 - protein, 9 aa, Homo Sapiens
CFFLWESLY

SEQ ID NO: 451066 - protein, 9 aa, Homo Sapiens
DNFISGRPI

SEQ ID NO: 451067 - protein, 9 aa, Homo Sapiens
LMQKHTHSP

SEQ ID NO: 451068 - protein, 9 aa, Homo Sapiens
EEDFMRQQQ

SEQ ID NO: 451069 - protein, 9 aa, Homo Sapiens
DKYANVRLA

SEQ ID NO: 451070 - protein, 9 aa, Homo Sapiens
FSVMYADGS

SEQ ID NO: 451071 - protein, 9 aa, Homo Sapiens
LQDTTGVSR

SEQ ID NO: 451072 - protein, 9 aa, Homo Sapiens
PIECLLSFI

SEQ ID NO: 451073 - protein, 9 aa, Homo Sapiens
HETQKELWK

SEQ ID NO: 451074 - protein, 9 aa, Homo Sapiens
NEEVKNAMK

SEQ ID NO: 451075 - protein, 9 aa, Homo Sapiens
NTFSSIPFF

SEQ ID NO: 451076 - protein, 9 aa, Homo Sapiens
MGRIIQTPP

SEQ ID NO: 451077 - protein, 9 aa, Homo Sapiens
TPFHYLNFS

SEQ ID NO: 451078 - protein, 9 aa, Homo Sapiens
IYNNMLCAG

SEQ ID NO: 451079 - protein, 9 aa, Homo Sapiens
SMDIQAMED

SEQ ID NO: 451080 - protein, 9 aa, Homo Sapiens
PNKCARRFT

SEQ ID NO: 451081 - protein, 9 aa, Homo Sapiens
VCYIQGEGS

SEQ ID NO: 451082 - protein, 9 aa, Homo Sapiens
EFIFGIQDF

SEQ ID NO: 451083 - protein, 9 aa, Homo Sapiens
QNEIKLLRK

SEQ ID NO: 451084 - protein, 9 aa, Homo Sapiens
ENAIHKDYI

SEQ ID NO: 451085 - protein, 9 aa, Homo Sapiens
AIDAPDLFG

SEQ ID NO: 451086 - protein, 9 aa, Homo Sapiens
PRITKLYVM

SEQ ID NO: 451087 - protein, 9 aa, Homo Sapiens
RHIAQTSLQ

SEQ ID NO: 451088 - protein, 9 aa, Homo Sapiens
GSANSFQAG

SEQ ID NO: 451089 - protein, 9 aa, Homo Sapiens
KSYACQQCG

SEQ ID NO: 451090 - protein, 9 aa, Homo Sapiens
INHLDDLKG

SEQ ID NO: 451091 - protein, 9 aa, Homo Sapiens
DEIQNGPYR

SEQ ID NO: 451092 - protein, 9 aa, Homo Sapiens
QAGAGYILE

SEQ ID NO: 451093 - protein, 9 aa, Homo Sapiens
VSVSDILVA

SEQ ID NO: 451094 - protein, 9 aa, Homo Sapiens
TQYSAMLGS

SEQ ID NO: 451095 - protein, 9 aa, Homo Sapiens
WDVEKSFMS

SEQ ID NO: 451096 - protein, 9 aa, Homo Sapiens
GECHSALSV

SEQ ID NO: 451097 - protein, 9 aa, Homo Sapiens
IILGVLKRD

SEQ ID NO: 451098 - protein, 9 aa, Homo Sapiens
DLQVELKQQ

SEQ ID NO: 451099 - protein, 9 aa, Homo Sapiens
VRDSVVFNA

SEQ ID NO: 451100 - protein, 9 aa, Homo Sapiens
HREITLNQS

SEQ ID NO: 451101 - protein, 9 aa, Homo Sapiens
EDNLLRITE

SEQ ID NO: 451102 - protein, 9 aa, Homo Sapiens
QKKENQGKN

SEQ ID NO: 451103 - protein, 9 aa, Homo Sapiens
LGTNAREIL

SEQ ID NO: 451104 - protein, 9 aa, Homo Sapiens
SINFNIIKI

SEQ ID NO: 451105 - protein, 9 aa, Homo Sapiens
HTAIVITYS

SEQ ID NO: 451106 - protein, 9 aa, Homo Sapiens
FYDNYLNPV

SEQ ID NO: 451107 - protein, 9 aa, Homo Sapiens
IRKLISYRG

SEQ ID NO: 451108 - protein, 9 aa, Homo Sapiens
TQPKMVTRT

SEQ ID NO: 451109 - protein, 9 aa, Homo Sapiens
AQRWKWVSQ

SEQ ID NO: 451110 - protein, 9 aa, Homo Sapiens
GFMAPSEAI

SEQ ID NO: 451111 - protein, 9 aa, Homo Sapiens
LLLEGIKKV

SEQ ID NO: 451112 - protein, 9 aa, Homo Sapiens
FQQMLKQLK

SEQ ID NO: 451113 - protein, 9 aa, Homo Sapiens
VYLYIINKT

SEQ ID NO: 451114 - protein, 9 aa, Homo Sapiens
WALVLPETP

SEQ ID NO: 451115 - protein, 9 aa, Homo Sapiens
VYLFNGASE

SEQ ID NO: 451116 - protein, 9 aa, Homo Sapiens
SPVRKNIFH

SEQ ID NO: 451117 - protein, 9 aa, Homo Sapiens
GKINLKVAK

SEQ ID NO: 451118 - protein, 9 aa, Homo Sapiens
IVCCSSSKN

SEQ ID NO: 451119 - protein, 9 aa, Homo Sapiens
SSTVTFNTL

SEQ ID NO: 451120 - protein, 9 aa, Homo Sapiens
LLLEIESIT

SEQ ID NO: 451121 - protein, 9 aa, Homo Sapiens
NNQFVSLGS

SEQ ID NO: 451122 - protein, 9 aa, Homo Sapiens
SGSYWVSLP

SEQ ID NO: 451123 - protein, 9 aa, Homo Sapiens
KDVMGKSNV

SEQ ID NO: 451124 - protein, 9 aa, Homo Sapiens
SHNLREECI

SEQ ID NO: 451125 - protein, 9 aa, Homo Sapiens
QVDIPLWLL

SEQ ID NO: 451126 - protein, 9 aa, Homo Sapiens
IGREGANDS

SEQ ID NO: 451127 - protein, 9 aa, Homo Sapiens
ETELPKGEK

SEQ ID NO: 451128 - protein, 9 aa, Homo Sapiens
SPGYYICKK

SEQ ID NO: 451129 - protein, 9 aa, Homo Sapiens
TTTPQIPIT

SEQ ID NO: 451130 - protein, 9 aa, Homo Sapiens
RSKRFLLPK

SEQ ID NO: 451131 - protein, 9 aa, Homo Sapiens
SLSFMDICF

SEQ ID NO: 451132 - protein, 9 aa, Homo Sapiens
DIFSLPKMT

SEQ ID NO: 451133 - protein, 9 aa, Homo Sapiens
ASGQSLLST

SEQ ID NO: 451134 - protein, 9 aa, Homo Sapiens
KAILKPMML

SEQ ID NO: 451135 - protein, 9 aa, Homo Sapiens
AFGPFGVFL

SEQ ID NO: 451136 - protein, 9 aa, Homo Sapiens
QANDQLEET

SEQ ID NO: 451137 - protein, 9 aa, Homo Sapiens
TSAIQAVEN

SEQ ID NO: 451138 - protein, 9 aa, Homo Sapiens
GKALKKDMK

SEQ ID NO: 451139 - protein, 9 aa, Homo Sapiens
KNLFKREYP

SEQ ID NO: 451140 - protein, 9 aa, Homo Sapiens
SSWDMGNLY

SEQ ID NO: 451141 - protein, 9 aa, Homo Sapiens
YGIDNFTSV

SEQ ID NO: 451142 - protein, 9 aa, Homo Sapiens
KHALIWAQQ

SEQ ID NO: 451143 - protein, 9 aa, Homo Sapiens
RRRKKSGWG

SEQ ID NO: 451144 - protein, 9 aa, Homo Sapiens
IVTIILHIK

SEQ ID NO: 451145 - protein, 9 aa, Homo Sapiens
FQELQENNK

SEQ ID NO: 451146 - protein, 9 aa, Homo Sapiens
SLGGWALVL

SEQ ID NO: 451147 - protein, 9 aa, Homo Sapiens
GSRRLLKDA

SEQ ID NO: 451148 - protein, 9 aa, Homo Sapiens
IGTTASSDT

SEQ ID NO: 451149 - protein, 9 aa, Homo Sapiens
SKDSGVVSR

SEQ ID NO: 451150 - protein, 9 aa, Homo Sapiens
CEGLLHPNC

SEQ ID NO: 451151 - protein, 9 aa, Homo Sapiens
SKKVCYHLT

SEQ ID NO: 451152 - protein, 9 aa, Homo Sapiens
QVPILFHKH

SEQ ID NO: 451153 - protein, 9 aa, Homo Sapiens
YIHSGTLVM

SEQ ID NO: 451154 - protein, 9 aa, Homo Sapiens
NRDCGIPLC

SEQ ID NO: 451155 - protein, 9 aa, Homo Sapiens
EVVHKDYGK

SEQ ID NO: 451156 - protein, 9 aa, Homo Sapiens
VPLLVTAAL

SEQ ID NO: 451157 - protein, 9 aa, Homo Sapiens
GNLLTSKLF

SEQ ID NO: 451158 - protein, 9 aa, Homo Sapiens
PRSKRFLLP

SEQ ID NO: 451159 - protein, 9 aa, Homo Sapiens
SYLGLYFNE

SEQ ID NO: 451160 - protein, 9 aa, Homo Sapiens
RLWEQFSGM

SEQ ID NO: 451161 - protein, 9 aa, Homo Sapiens
PEAEVDQWQ

SEQ ID NO: 451162 - protein, 9 aa, Homo Sapiens
LTDPENVQK

SEQ ID NO: 451163 - protein, 9 aa, Homo Sapiens
AQENPSPNC

SEQ ID NO: 451164 - protein, 9 aa, Homo Sapiens
HRSHLKQHQ

SEQ ID NO: 451165 - protein, 9 aa, Homo Sapiens
SHELYKFCS

SEQ ID NO: 451166 - protein, 9 aa, Homo Sapiens
LYSSKSHRF

SEQ ID NO: 451167 - protein, 9 aa, Homo Sapiens
SYTEILKVA

SEQ ID NO: 451168 - protein, 9 aa, Homo Sapiens
LPQRRCCAY

SEQ ID NO: 451169 - protein, 9 aa, Homo Sapiens
IHWILSIGL

SEQ ID NO: 451170 - protein, 9 aa, Homo Sapiens
LFMVVGFWV

SEQ ID NO: 451171 - protein, 9 aa, Homo Sapiens
ISGEHLWIC

SEQ ID NO: 451172 - protein, 9 aa, Homo Sapiens
ALLTFDGFD

SEQ ID NO: 451173 - protein, 9 aa, Homo Sapiens
YNKINQCWT

SEQ ID NO: 451174 - protein, 9 aa, Homo Sapiens
KRPITHLPC

SEQ ID NO: 451175 - protein, 9 aa, Homo Sapiens
VTGLVSCKV

SEQ ID NO: 451176 - protein, 9 aa, Homo Sapiens
LYFNEFTDI

SEQ ID NO: 451177 - protein, 9 aa, Homo Sapiens
SALVLEERT

SEQ ID NO: 451178 - protein, 9 aa, Homo Sapiens
SGQSYGTYS

SEQ ID NO: 451179 - protein, 9 aa, Homo Sapiens
TLQQLEALK

SEQ ID NO: 451180 - protein, 9 aa, Homo Sapiens
EITLNQSET

SEQ ID NO: 451181 - protein, 9 aa, Homo Sapiens
TTENPKERG

SEQ ID NO: 451182 - protein, 9 aa, Homo Sapiens
ISIPRADTL

SEQ ID NO: 451183 - protein, 9 aa, Homo Sapiens
KHKCWQNGR

SEQ ID NO: 451184 - protein, 9 aa, Homo Sapiens
FLILVFVGA

SEQ ID NO: 451185 - protein, 9 aa, Homo Sapiens
IIVVIWIQP

SEQ ID NO: 451186 - protein, 9 aa, Homo Sapiens
QNGQMHLNR

SEQ ID NO: 451187 - protein, 9 aa, Homo Sapiens
SAAAYVQCL

SEQ ID NO: 451188 - protein, 9 aa, Homo Sapiens
GGGDILKYL

SEQ ID NO: 451189 - protein, 9 aa, Homo Sapiens
SEIVSNDIS

SEQ ID NO: 451190 - protein, 9 aa, Homo Sapiens
IKLFNEMAE

SEQ ID NO: 451191 - protein, 9 aa, Homo Sapiens
RVCPFLIYP

SEQ ID NO: 451192 - protein, 9 aa, Homo Sapiens
KEDKLSKVD

SEQ ID NO: 451193 - protein, 9 aa, Homo Sapiens
TVQTVASAT

SEQ ID NO: 451194 - protein, 9 aa, Homo Sapiens
NTTWNCGYL

SEQ ID NO: 451195 - protein, 9 aa, Homo Sapiens
AQAHVEFAD

SEQ ID NO: 451196 - protein, 9 aa, Homo Sapiens
IETVKDEQL

SEQ ID NO: 451197 - protein, 9 aa, Homo Sapiens
KIRRYQKST

SEQ ID NO: 451198 - protein, 9 aa, Homo Sapiens
WQKEGTPGI

SEQ ID NO: 451199 - protein, 9 aa, Homo Sapiens
RHLDECPHS

SEQ ID NO: 451200 - protein, 9 aa, Homo Sapiens
SRVTYALCS

SEQ ID NO: 451201 - protein, 9 aa, Homo Sapiens
GETWNISIN

SEQ ID NO: 451202 - protein, 9 aa, Homo Sapiens
IIQQDFLDT

SEQ ID NO: 451203 - protein, 9 aa, Homo Sapiens
KKICYQLRM

SEQ ID NO: 451204 - protein, 9 aa, Homo Sapiens
QINDIAMAI

SEQ ID NO: 451205 - protein, 9 aa, Homo Sapiens
ACRTYATSS

SEQ ID NO: 451206 - protein, 9 aa, Homo Sapiens
ERDRRQQKQ

SEQ ID NO: 451207 - protein, 9 aa, Homo Sapiens
IHTKTKHTY

SEQ ID NO: 451208 - protein, 9 aa, Homo Sapiens
LPADYEDGL

SEQ ID NO: 451209 - protein, 9 aa, Homo Sapiens
EWGKLDSPQ

SEQ ID NO: 451210 - protein, 9 aa, Homo Sapiens
LELMQKHTH

SEQ ID NO: 451211 - protein, 9 aa, Homo Sapiens
PTIPTKKPT

SEQ ID NO: 451212 - protein, 9 aa, Homo Sapiens
FTSLWDIAG

SEQ ID NO: 451213 - protein, 9 aa, Homo Sapiens
CPECRNYAS

SEQ ID NO: 451214 - protein, 9 aa, Homo Sapiens
SKGLLPRAS

SEQ ID NO: 451215 - protein, 9 aa, Homo Sapiens
SVQTPGTYP

SEQ ID NO: 451216 - protein, 9 aa, Homo Sapiens
CCPKLRRLE

SEQ ID NO: 451217 - protein, 9 aa, Homo Sapiens
NIHFLVILI

SEQ ID NO: 451218 - protein, 9 aa, Homo Sapiens
KSNQIKAKP

SEQ ID NO: 451219 - protein, 9 aa, Homo Sapiens
EDLRSESSS

SEQ ID NO: 451220 - protein, 9 aa, Homo Sapiens
SLTRYSSTK

SEQ ID NO: 451221 - protein, 9 aa, Homo Sapiens
IAFAAFLIG

SEQ ID NO: 451222 - protein, 9 aa, Homo Sapiens
KVVTEMGTY

SEQ ID NO: 451223 - protein, 9 aa, Homo Sapiens
NTLISWTKG

SEQ ID NO: 451224 - protein, 9 aa, Homo Sapiens
GKAFHQKTA

SEQ ID NO: 451225 - protein, 9 aa, Homo Sapiens
TFKYMKEFT

SEQ ID NO: 451226 - protein, 9 aa, Homo Sapiens
LTKSLGVNT

SEQ ID NO: 451227 - protein, 9 aa, Homo Sapiens
VNLQGVKML

SEQ ID NO: 451228 - protein, 9 aa, Homo Sapiens
LYVLRVITR

SEQ ID NO: 451229 - protein, 9 aa, Homo Sapiens
KIQAESFCQ

SEQ ID NO: 451230 - protein, 9 aa, Homo Sapiens
LESHKIIHT

SEQ ID NO: 451231 - protein, 9 aa, Homo Sapiens
ILLACQIRY

SEQ ID NO: 451232 - protein, 9 aa, Homo Sapiens
DATYKLEER

SEQ ID NO: 451233 - protein, 9 aa, Homo Sapiens
LKYPKQRRF

SEQ ID NO: 451234 - protein, 9 aa, Homo Sapiens
HPHRIDIIE

SEQ ID NO: 451235 - protein, 9 aa, Homo Sapiens
VLNFTPMDL

SEQ ID NO: 451236 - protein, 9 aa, Homo Sapiens
KDSCQGGSG

SEQ ID NO: 451237 - protein, 9 aa, Homo Sapiens
SHWLAYAEN

SEQ ID NO: 451238 - protein, 9 aa, Homo Sapiens
VIIHMLTQY

SEQ ID NO: 451239 - protein, 9 aa, Homo Sapiens
VNVNDNAPE

SEQ ID NO: 451240 - protein, 9 aa, Homo Sapiens
TAYLLENKG

SEQ ID NO: 451241 - protein, 9 aa, Homo Sapiens
TCNPPEERR

SEQ ID NO: 451242 - protein, 9 aa, Homo Sapiens
YKIFFVMGI

SEQ ID NO: 451243 - protein, 9 aa, Homo Sapiens
GVFMTAINP

SEQ ID NO: 451244 - protein, 9 aa, Homo Sapiens
RPGIALELS

SEQ ID NO: 451245 - protein, 9 aa, Homo Sapiens
QFGAYLIVN

SEQ ID NO: 451246 - protein, 9 aa, Homo Sapiens
VTKKSPTHQ

SEQ ID NO: 451247 - protein, 9 aa, Homo Sapiens
CIDHLELLN

SEQ ID NO: 451248 - protein, 9 aa, Homo Sapiens
HHTHVNVSW

SEQ ID NO: 451249 - protein, 9 aa, Homo Sapiens
GVSSYIYQP

SEQ ID NO: 451250 - protein, 9 aa, Homo Sapiens
IFFQSYAQV

SEQ ID NO: 451251 - protein, 9 aa, Homo Sapiens
LFLQHNKIH

SEQ ID NO: 451252 - protein, 9 aa, Homo Sapiens
KSVYMIMDM

SEQ ID NO: 451253 - protein, 9 aa, Homo Sapiens
CRPTCSVEQ

SEQ ID NO: 451254 - protein, 9 aa, Homo Sapiens
IVLDSKLDE

SEQ ID NO: 451255 - protein, 9 aa, Homo Sapiens
VRGTFCIHL

SEQ ID NO: 451256 - protein, 9 aa, Homo Sapiens
ELPRFYEAF

SEQ ID NO: 451257 - protein, 9 aa, Homo Sapiens
SLTQPSDQG

SEQ ID NO: 451258 - protein, 9 aa, Homo Sapiens
DVIVKEEIN

SEQ ID NO: 451259 - protein, 9 aa, Homo Sapiens
AKDINQDVY

SEQ ID NO: 451260 - protein, 9 aa, Homo Sapiens
VFQIVPKFK

SEQ ID NO: 451261 - protein, 9 aa, Homo Sapiens
VFYFILGDH

SEQ ID NO: 451262 - protein, 9 aa, Homo Sapiens
PLCIALMLG

SEQ ID NO: 451263 - protein, 9 aa, Homo Sapiens
IIGLYFVGL

SEQ ID NO: 451264 - protein, 9 aa, Homo Sapiens
NGFDFVIDD

SEQ ID NO: 451265 - protein, 9 aa, Homo Sapiens
FKQFCITCQ

SEQ ID NO: 451266 - protein, 9 aa, Homo Sapiens
QCFSKDIVD

SEQ ID NO: 451267 - protein, 9 aa, Homo Sapiens
MRKGSAMLF

SEQ ID NO: 451268 - protein, 9 aa, Homo Sapiens
TVVCLFRRR

SEQ ID NO: 451269 - protein, 9 aa, Homo Sapiens
NCQAGFVFD

SEQ ID NO: 451270 - protein, 9 aa, Homo Sapiens
KNVLWRKTL

SEQ ID NO: 451271 - protein, 9 aa, Homo Sapiens
LDRNTLISW

SEQ ID NO: 451272 - protein, 9 aa, Homo Sapiens
ILPKEICAQ

SEQ ID NO: 451273 - protein, 9 aa, Homo Sapiens
TGDKPYACK

SEQ ID NO: 451274 - protein, 9 aa, Homo Sapiens
EKFFFVDTG

SEQ ID NO: 451275 - protein, 9 aa, Homo Sapiens
WQNRLSDYE

SEQ ID NO: 451276 - protein, 9 aa, Homo Sapiens
DANTSVFVV

SEQ ID NO: 451277 - protein, 9 aa, Homo Sapiens
STFSGGQIP

SEQ ID NO: 451278 - protein, 9 aa, Homo Sapiens
SRWQETAIT

SEQ ID NO: 451279 - protein, 9 aa, Homo Sapiens
KVSNQIFEV

SEQ ID NO: 451280 - protein, 9 aa, Homo Sapiens
KRITVKRAC

SEQ ID NO: 451281 - protein, 9 aa, Homo Sapiens
IHQRVHTGD

SEQ ID NO: 451282 - protein, 9 aa, Homo Sapiens
SPIISPSTM

SEQ ID NO: 451283 - protein, 9 aa, Homo Sapiens
TGGSLLEDI

SEQ ID NO: 451284 - protein, 9 aa, Homo Sapiens
EIKYKSSAK

SEQ ID NO: 451285 - protein, 9 aa, Homo Sapiens
EECGTVFSR

SEQ ID NO: 451286 - protein, 9 aa, Homo Sapiens
VQQHGIQSV

SEQ ID NO: 451287 - protein, 9 aa, Homo Sapiens
NRRIYDITN

SEQ ID NO: 451288 - protein, 9 aa, Homo Sapiens
NNPLTSSLL

SEQ ID NO: 451289 - protein, 9 aa, Homo Sapiens
NAKEIAQTV

SEQ ID NO: 451290 - protein, 9 aa, Homo Sapiens
FIFLPNTIL

SEQ ID NO: 451291 - protein, 9 aa, Homo Sapiens
ACTDFWDRA

SEQ ID NO: 451292 - protein, 9 aa, Homo Sapiens
TINARTELD

SEQ ID NO: 451293 - protein, 9 aa, Homo Sapiens
QVAQGMVFL

SEQ ID NO: 451294 - protein, 9 aa, Homo Sapiens
TDILKPFFF

SEQ ID NO: 451295 - protein, 9 aa, Homo Sapiens
FLWVFILVC

SEQ ID NO: 451296 - protein, 9 aa, Homo Sapiens
EQIAETGNN

SEQ ID NO: 451297 - protein, 9 aa, Homo Sapiens
RYTMEVEVK

SEQ ID NO: 451298 - protein, 9 aa, Homo Sapiens
EFRNNFDKI

SEQ ID NO: 451299 - protein, 9 aa, Homo Sapiens
MPYTLITIL

SEQ ID NO: 451300 - protein, 9 aa, Homo Sapiens
PSDSSDLKT

SEQ ID NO: 451301 - protein, 9 aa, Homo Sapiens
PGQFDSLEE

SEQ ID NO: 451302 - protein, 9 aa, Homo Sapiens
FREREGQLR

SEQ ID NO: 451303 - protein, 9 aa, Homo Sapiens
KLANTAKAD

SEQ ID NO: 451304 - protein, 9 aa, Homo Sapiens
LYNVDALRY

SEQ ID NO: 451305 - protein, 9 aa, Homo Sapiens
PEVTPHRTS

SEQ ID NO: 451306 - protein, 9 aa, Homo Sapiens
AQSRPDDDP

SEQ ID NO: 451307 - protein, 9 aa, Homo Sapiens
YGKSFSRRG

SEQ ID NO: 451308 - protein, 9 aa, Homo Sapiens
EICIEKLKE

SEQ ID NO: 451309 - protein, 9 aa, Homo Sapiens
AAMIISIVG

SEQ ID NO: 451310 - protein, 9 aa, Homo Sapiens
EINEGRMSG

SEQ ID NO: 451311 - protein, 9 aa, Homo Sapiens
RGLDLRVLG

SEQ ID NO: 451312 - protein, 9 aa, Homo Sapiens
HVPRFSVMY

SEQ ID NO: 451313 - protein, 9 aa, Homo Sapiens
FHLVPFMVF

SEQ ID NO: 451314 - protein, 9 aa, Homo Sapiens
INFEQAIKD

SEQ ID NO: 451315 - protein, 9 aa, Homo Sapiens
LVCDRTHLK

SEQ ID NO: 451316 - protein, 9 aa, Homo Sapiens
NHVQIHTGE

SEQ ID NO: 451317 - protein, 9 aa, Homo Sapiens
GLLATVRAK

SEQ ID NO: 451318 - protein, 9 aa, Homo Sapiens
PKIKGSFVA

SEQ ID NO: 451319 - protein, 9 aa, Homo Sapiens
ITVYCQEKD

SEQ ID NO: 451320 - protein, 9 aa, Homo Sapiens
ENNFYLCPV

SEQ ID NO: 451321 - protein, 9 aa, Homo Sapiens
HWSASLQCI

SEQ ID NO: 451322 - protein, 9 aa, Homo Sapiens
EKVSDDLIL

SEQ ID NO: 451323 - protein, 9 aa, Homo Sapiens
ASSCREHEK

SEQ ID NO: 451324 - protein, 9 aa, Homo Sapiens
YEITSVPCS

SEQ ID NO: 451325 - protein, 9 aa, Homo Sapiens
AQIKLYRNV

SEQ ID NO: 451326 - protein, 9 aa, Homo Sapiens
STTVQKCID

SEQ ID NO: 451327 - protein, 9 aa, Homo Sapiens
IGRLRALSD

SEQ ID NO: 451328 - protein, 9 aa, Homo Sapiens
FRIVYITER

SEQ ID NO: 451329 - protein, 9 aa, Homo Sapiens
LHRHLIEHV

SEQ ID NO: 451330 - protein, 9 aa, Homo Sapiens
RLIVHQQTH

SEQ ID NO: 451331 - protein, 9 aa, Homo Sapiens
VLRITVCDE

SEQ ID NO: 451332 - protein, 9 aa, Homo Sapiens
MRQQQTINM

SEQ ID NO: 451333 - protein, 9 aa, Homo Sapiens
QLFFYAGWL

SEQ ID NO: 451334 - protein, 9 aa, Homo Sapiens
PSIICIDEV

SEQ ID NO: 451335 - protein, 9 aa, Homo Sapiens
NKSTSQGLC

SEQ ID NO: 451336 - protein, 9 aa, Homo Sapiens
CLLVCWFTD

SEQ ID NO: 451337 - protein, 9 aa, Homo Sapiens
QCSGTPSSE

SEQ ID NO: 451338 - protein, 9 aa, Homo Sapiens
TDKIVEKAK

SEQ ID NO: 451339 - protein, 9 aa, Homo Sapiens
SKGGNLPSF

SEQ ID NO: 451340 - protein, 9 aa, Homo Sapiens
RPRSHTLTA

SEQ ID NO: 451341 - protein, 9 aa, Homo Sapiens
NLIKHQIIH

SEQ ID NO: 451342 - protein, 9 aa, Homo Sapiens
VISKVLTFN

SEQ ID NO: 451343 - protein, 9 aa, Homo Sapiens
IVPVGEVLL

SEQ ID NO: 451344 - protein, 9 aa, Homo Sapiens
SRLQTPIYF

SEQ ID NO: 451345 - protein, 9 aa, Homo Sapiens
RGFCEPGGK

SEQ ID NO: 451346 - protein, 9 aa, Homo Sapiens
LGIYEQEPL

SEQ ID NO: 451347 - protein, 9 aa, Homo Sapiens
IARRCAQHW

SEQ ID NO: 451348 - protein, 9 aa, Homo Sapiens
FGPKPMCIK

SEQ ID NO: 451349 - protein, 9 aa, Homo Sapiens
NIVNINLSM

SEQ ID NO: 451350 - protein, 9 aa, Homo Sapiens
FKSLLNAFF

SEQ ID NO: 451351 - protein, 9 aa, Homo Sapiens
LYHEHKKYF

SEQ ID NO: 451352 - protein, 9 aa, Homo Sapiens
QKYTSAGKE

SEQ ID NO: 451353 - protein, 9 aa, Homo Sapiens
RKLLNKLTQ

SEQ ID NO: 451354 - protein, 9 aa, Homo Sapiens
LTGVSGSTW

SEQ ID NO: 451355 - protein, 9 aa, Homo Sapiens
RKIYEMYSD

SEQ ID NO: 451356 - protein, 9 aa, Homo Sapiens
PAQRRCTSS

SEQ ID NO: 451357 - protein, 9 aa, Homo Sapiens
LCTKADNAR

SEQ ID NO: 451358 - protein, 9 aa, Homo Sapiens
FTYYCSGEN

SEQ ID NO: 451359 - protein, 9 aa, Homo Sapiens
LKNAFYLLG

SEQ ID NO: 451360 - protein, 9 aa, Homo Sapiens
IDTNLFGVL

SEQ ID NO: 451361 - protein, 9 aa, Homo Sapiens
GYACQVNEW

SEQ ID NO: 451362 - protein, 9 aa, Homo Sapiens
QNNQNRDHK

SEQ ID NO: 451363 - protein, 9 aa, Homo Sapiens
AISFRCLGI

SEQ ID NO: 451364 - protein, 9 aa, Homo Sapiens
GGLHYMGKL

SEQ ID NO: 451365 - protein, 9 aa, Homo Sapiens
GGTQRLPRT

SEQ ID NO: 451366 - protein, 9 aa, Homo Sapiens
WPGFLREAF

SEQ ID NO: 451367 - protein, 9 aa, Homo Sapiens
STLPINSPT

SEQ ID NO: 451368 - protein, 9 aa, Homo Sapiens
IESNSLNSR

SEQ ID NO: 451369 - protein, 9 aa, Homo Sapiens
SPEKPKVIK

SEQ ID NO: 451370 - protein, 9 aa, Homo Sapiens
EVECPRRQR

SEQ ID NO: 451371 - protein, 9 aa, Homo Sapiens
PGVIKVITE

SEQ ID NO: 451372 - protein, 9 aa, Homo Sapiens
VSNNLPVVS

SEQ ID NO: 451373 - protein, 9 aa, Homo Sapiens
YFALWSLEY

SEQ ID NO: 451374 - protein, 9 aa, Homo Sapiens
HYQQPQIMD

SEQ ID NO: 451375 - protein, 9 aa, Homo Sapiens
SAENCFKFS

SEQ ID NO: 451376 - protein, 9 aa, Homo Sapiens
SCRKYLFIC

SEQ ID NO: 451377 - protein, 9 aa, Homo Sapiens
QFHYPCDPL

SEQ ID NO: 451378 - protein, 9 aa, Homo Sapiens
FRSDEECRQ

SEQ ID NO: 451379 - protein, 9 aa, Homo Sapiens
ILSSLPEFE

SEQ ID NO: 451380 - protein, 9 aa, Homo Sapiens
QKCIDHLLH

SEQ ID NO: 451381 - protein, 9 aa, Homo Sapiens
STDYYRVQS

SEQ ID NO: 451382 - protein, 9 aa, Homo Sapiens
QNFLEERIR

SEQ ID NO: 451383 - protein, 9 aa, Homo Sapiens
ESHKPKGTE

SEQ ID NO: 451384 - protein, 9 aa, Homo Sapiens
VEDSTDLFK

SEQ ID NO: 451385 - protein, 9 aa, Homo Sapiens
HITFRNSNE

SEQ ID NO: 451386 - protein, 9 aa, Homo Sapiens
LCVFESNAI

SEQ ID NO: 451387 - protein, 9 aa, Homo Sapiens
GSELNQHQK

SEQ ID NO: 451388 - protein, 9 aa, Homo Sapiens
NCLAEIPYD

SEQ ID NO: 451389 - protein, 9 aa, Homo Sapiens
ERKLQENLG

SEQ ID NO: 451390 - protein, 9 aa, Homo Sapiens
AKAEEWSCF

SEQ ID NO: 451391 - protein, 9 aa, Homo Sapiens
YPGYPLILP

SEQ ID NO: 451392 - protein, 9 aa, Homo Sapiens
AVENTSEDG

SEQ ID NO: 451393 - protein, 9 aa, Homo Sapiens
NKPQKNRIL

SEQ ID NO: 451394 - protein, 9 aa, Homo Sapiens
ENDNRVQHK

SEQ ID NO: 451395 - protein, 9 aa, Homo Sapiens
IKIVGLANS

SEQ ID NO: 451396 - protein, 9 aa, Homo Sapiens
YSDLKNLDY

SEQ ID NO: 451397 - protein, 9 aa, Homo Sapiens
PEQGYLANM

SEQ ID NO: 451398 - protein, 9 aa, Homo Sapiens
VNPKGHETT

SEQ ID NO: 451399 - protein, 9 aa, Homo Sapiens
RVKYQYVLQ

SEQ ID NO: 451400 - protein, 9 aa, Homo Sapiens
TLCFLLGNV

SEQ ID NO: 451401 - protein, 9 aa, Homo Sapiens
THLIAHQRI

SEQ ID NO: 451402 - protein, 9 aa, Homo Sapiens
QASRHWSAS

SEQ ID NO: 451403 - protein, 9 aa, Homo Sapiens
DDITSEKEI

SEQ ID NO: 451404 - protein, 9 aa, Homo Sapiens
LLDMLQQRR

SEQ ID NO: 451405 - protein, 9 aa, Homo Sapiens
QMLASSTQY

SEQ ID NO: 451406 - protein, 9 aa, Homo Sapiens
IKRHPPQIL

SEQ ID NO: 451407 - protein, 9 aa, Homo Sapiens
LAFLIVITL

SEQ ID NO: 451408 - protein, 9 aa, Homo Sapiens
GYHLTLHQI

SEQ ID NO: 451409 - protein, 9 aa, Homo Sapiens
LWHPQCRLQ

SEQ ID NO: 451410 - protein, 9 aa, Homo Sapiens
YKITFVDFL

SEQ ID NO: 451411 - protein, 9 aa, Homo Sapiens
SAVDTMLTV

SEQ ID NO: 451412 - protein, 9 aa, Homo Sapiens
DRQENDKDN

SEQ ID NO: 451413 - protein, 9 aa, Homo Sapiens
PHPYVKASA

SEQ ID NO: 451414 - protein, 9 aa, Homo Sapiens
YDGSLDACK

SEQ ID NO: 451415 - protein, 9 aa, Homo Sapiens
LLKKFINIA

SEQ ID NO: 451416 - protein, 9 aa, Homo Sapiens
FLVDLIYFY

SEQ ID NO: 451417 - protein, 9 aa, Homo Sapiens
CMSINFRDI

SEQ ID NO: 451418 - protein, 9 aa, Homo Sapiens
TGDKYFFGG

SEQ ID NO: 451419 - protein, 9 aa, Homo Sapiens
SSDLKTRPT

SEQ ID NO: 451420 - protein, 9 aa, Homo Sapiens
RFVNSLMVA

SEQ ID NO: 451421 - protein, 9 aa, Homo Sapiens
QTPIYFFLQ

SEQ ID NO: 451422 - protein, 9 aa, Homo Sapiens
GKQGSCPSL

SEQ ID NO: 451423 - protein, 9 aa, Homo Sapiens
ILTSTGCYK

SEQ ID NO: 451424 - protein, 9 aa, Homo Sapiens
AETACFCEE

SEQ ID NO: 451425 - protein, 9 aa, Homo Sapiens
AGVIRHMRL

SEQ ID NO: 451426 - protein, 9 aa, Homo Sapiens
PRQYNEQEE

SEQ ID NO: 451427 - protein, 9 aa, Homo Sapiens
RDSKKRRLV

SEQ ID NO: 451428 - protein, 9 aa, Homo Sapiens
AMKKFVNTM

SEQ ID NO: 451429 - protein, 9 aa, Homo Sapiens
YAGCFQFGA

SEQ ID NO: 451430 - protein, 9 aa, Homo Sapiens
SLFNVTSHG

SEQ ID NO: 451431 - protein, 9 aa, Homo Sapiens
DCHGQGCCV

SEQ ID NO: 451432 - protein, 9 aa, Homo Sapiens
EGSNKTDVE

SEQ ID NO: 451433 - protein, 9 aa, Homo Sapiens
NTFQPWELL

SEQ ID NO: 451434 - protein, 9 aa, Homo Sapiens
VYVKDVLGH

SEQ ID NO: 451435 - protein, 9 aa, Homo Sapiens
VGSALPQRR

SEQ ID NO: 451436 - protein, 9 aa, Homo Sapiens
GPTGIPGLP

SEQ ID NO: 451437 - protein, 9 aa, Homo Sapiens
QVVLIIHLP

SEQ ID NO: 451438 - protein, 9 aa, Homo Sapiens
QVTESFCER

SEQ ID NO: 451439 - protein, 9 aa, Homo Sapiens
QLVYVEGGA

SEQ ID NO: 451440 - protein, 9 aa, Homo Sapiens
TDHAAPMED

SEQ ID NO: 451441 - protein, 9 aa, Homo Sapiens
VVQIHHPSG

SEQ ID NO: 451442 - protein, 9 aa, Homo Sapiens
YVLSFATIM

SEQ ID NO: 451443 - protein, 9 aa, Homo Sapiens
VKIVNYIES

SEQ ID NO: 451444 - protein, 9 aa, Homo Sapiens
SSDKRGSFL

SEQ ID NO: 451445 - protein, 9 aa, Homo Sapiens
IFGLFGRAF

SEQ ID NO: 451446 - protein, 9 aa, Homo Sapiens
MEIKINYLN

SEQ ID NO: 451447 - protein, 9 aa, Homo Sapiens
IKLHQLSTS

SEQ ID NO: 451448 - protein, 9 aa, Homo Sapiens
YSSDTMQTT

SEQ ID NO: 451449 - protein, 9 aa, Homo Sapiens
IIQVIPQYA

SEQ ID NO: 451450 - protein, 9 aa, Homo Sapiens
PNTFQPWEL

SEQ ID NO: 451451 - protein, 9 aa, Homo Sapiens
NTSDVINAV

SEQ ID NO: 451452 - protein, 9 aa, Homo Sapiens
TIVQGFFHS

SEQ ID NO: 451453 - protein, 9 aa, Homo Sapiens
QEPGLRIFK

SEQ ID NO: 451454 - protein, 9 aa, Homo Sapiens
IFRTSSNDR

SEQ ID NO: 451455 - protein, 9 aa, Homo Sapiens
HYYSIKLYE

SEQ ID NO: 451456 - protein, 9 aa, Homo Sapiens
AVNNVKVIC

SEQ ID NO: 451457 - protein, 9 aa, Homo Sapiens
NNELFAYAA

SEQ ID NO: 451458 - protein, 9 aa, Homo Sapiens
EDKLDRLFK

SEQ ID NO: 451459 - protein, 9 aa, Homo Sapiens
HKIIHNREK

SEQ ID NO: 451460 - protein, 9 aa, Homo Sapiens
NGNCVTRIY

SEQ ID NO: 451461 - protein, 9 aa, Homo Sapiens
PKGLNNPPG

SEQ ID NO: 451462 - protein, 9 aa, Homo Sapiens
LPIKIYREY

SEQ ID NO: 451463 - protein, 9 aa, Homo Sapiens
DAAPAKGNL

SEQ ID NO: 451464 - protein, 9 aa, Homo Sapiens
EVTEDNFFE

SEQ ID NO: 451465 - protein, 9 aa, Homo Sapiens
LGRPQIKKD

SEQ ID NO: 451466 - protein, 9 aa, Homo Sapiens
NQENMIYYL

SEQ ID NO: 451467 - protein, 9 aa, Homo Sapiens
YCSLCGIPR

SEQ ID NO: 451468 - protein, 9 aa, Homo Sapiens
GDKFATLAE

SEQ ID NO: 451469 - protein, 9 aa, Homo Sapiens
SGDELYVHQ

SEQ ID NO: 451470 - protein, 9 aa, Homo Sapiens
ASRNYFTLQ

SEQ ID NO: 451471 - protein, 9 aa, Homo Sapiens
KHYEEQHAW

SEQ ID NO: 451472 - protein, 9 aa, Homo Sapiens
AIQNKLFQV

SEQ ID NO: 451473 - protein, 9 aa, Homo Sapiens
CRTYATSSP

SEQ ID NO: 451474 - protein, 9 aa, Homo Sapiens
VTRITQLAK

SEQ ID NO: 451475 - protein, 9 aa, Homo Sapiens
AQHWADLGC

SEQ ID NO: 451476 - protein, 9 aa, Homo Sapiens
PQEWQKEGT

SEQ ID NO: 451477 - protein, 9 aa, Homo Sapiens
DHITHKTIE

SEQ ID NO: 451478 - protein, 9 aa, Homo Sapiens
DPKKEIILA

SEQ ID NO: 451479 - protein, 9 aa, Homo Sapiens
PLSNKTATY

SEQ ID NO: 451480 - protein, 9 aa, Homo Sapiens
NFKELIDTM

SEQ ID NO: 451481 - protein, 9 aa, Homo Sapiens
LLCEITSNN

SEQ ID NO: 451482 - protein, 9 aa, Homo Sapiens
RDFMLITNR

SEQ ID NO: 451483 - protein, 9 aa, Homo Sapiens
PKMVKFILE

SEQ ID NO: 451484 - protein, 9 aa, Homo Sapiens
LPGPITFPA

SEQ ID NO: 451485 - protein, 9 aa, Homo Sapiens
MDRAENINK

SEQ ID NO: 451486 - protein, 9 aa, Homo Sapiens
IFKIAFHQR

SEQ ID NO: 451487 - protein, 9 aa, Homo Sapiens
PRYSFCCIF

SEQ ID NO: 451488 - protein, 9 aa, Homo Sapiens
KGVAASYFI

SEQ ID NO: 451489 - protein, 9 aa, Homo Sapiens
FVVTIPRAY

SEQ ID NO: 451490 - protein, 9 aa, Homo Sapiens
PTVDLAHTI

SEQ ID NO: 451491 - protein, 9 aa, Homo Sapiens
SHHPKCIPE

SEQ ID NO: 451492 - protein, 9 aa, Homo Sapiens
EDHIIFWLI

SEQ ID NO: 451493 - protein, 9 aa, Homo Sapiens
FDNISLDQR

SEQ ID NO: 451494 - protein, 9 aa, Homo Sapiens
KYEECKNLI

SEQ ID NO: 451495 - protein, 9 aa, Homo Sapiens
HPFCLCLTS

SEQ ID NO: 451496 - protein, 9 aa, Homo Sapiens
EARKILVVN

SEQ ID NO: 451497 - protein, 9 aa, Homo Sapiens
KLINSQQVP

SEQ ID NO: 451498 - protein, 9 aa, Homo Sapiens
SGDHSARQA

SEQ ID NO: 451499 - protein, 9 aa, Homo Sapiens
LKNIKRTKK

SEQ ID NO: 451500 - protein, 9 aa, Homo Sapiens
AASGHTVGE

SEQ ID NO: 451501 - protein, 9 aa, Homo Sapiens
ENNKSLELV

SEQ ID NO: 451502 - protein, 9 aa, Homo Sapiens
DIAAYYCAL

SEQ ID NO: 451503 - protein, 9 aa, Homo Sapiens
IKLLEKHIT

SEQ ID NO: 451504 - protein, 9 aa, Homo Sapiens
SGSLQIHER

SEQ ID NO: 451505 - protein, 9 aa, Homo Sapiens
CSDSSEGWS

SEQ ID NO: 451506 - protein, 9 aa, Homo Sapiens
EKTDTSHEQ

SEQ ID NO: 451507 - protein, 9 aa, Homo Sapiens
ALTERKNRQ

SEQ ID NO: 451508 - protein, 9 aa, Homo Sapiens
VNYNYTYAN

SEQ ID NO: 451509 - protein, 9 aa, Homo Sapiens
KSHVPLTCP

SEQ ID NO: 451510 - protein, 9 aa, Homo Sapiens
VFCLSSWEA

SEQ ID NO: 451511 - protein, 9 aa, Homo Sapiens
NVICDHPDI

SEQ ID NO: 451512 - protein, 9 aa, Homo Sapiens
VPAVRWVGG

SEQ ID NO: 451513 - protein, 9 aa, Homo Sapiens
DMGNLYLAL

SEQ ID NO: 451514 - protein, 9 aa, Homo Sapiens
WGIDKCNAA

SEQ ID NO: 451515 - protein, 9 aa, Homo Sapiens
AEITGPSCD

SEQ ID NO: 451516 - protein, 9 aa, Homo Sapiens
YLENTVTTA

SEQ ID NO: 451517 - protein, 9 aa, Homo Sapiens
YLFCESSGD

SEQ ID NO: 451518 - protein, 9 aa, Homo Sapiens
LLQLFFYAG

SEQ ID NO: 451519 - protein, 9 aa, Homo Sapiens
EHERLRTYH

SEQ ID NO: 451520 - protein, 9 aa, Homo Sapiens
GNGAESNNY

SEQ ID NO: 451521 - protein, 9 aa, Homo Sapiens
KKTVKRLGI

SEQ ID NO: 451522 - protein, 9 aa, Homo Sapiens
FSSENSNPE

SEQ ID NO: 451523 - protein, 9 aa, Homo Sapiens
AHMHHHHRH

SEQ ID NO: 451524 - protein, 9 aa, Homo Sapiens
MDNLKSQPP

SEQ ID NO: 451525 - protein, 9 aa, Homo Sapiens
TDPVPQVVW

SEQ ID NO: 451526 - protein, 9 aa, Homo Sapiens
TSMKGMRKV

SEQ ID NO: 451527 - protein, 9 aa, Homo Sapiens
WQIKSEQLC

SEQ ID NO: 451528 - protein, 9 aa, Homo Sapiens
SIKAENEPE

SEQ ID NO: 451529 - protein, 9 aa, Homo Sapiens
QRWKWVSQN

SEQ ID NO: 451530 - protein, 9 aa, Homo Sapiens
ADIFNRIKR

SEQ ID NO: 451531 - protein, 9 aa, Homo Sapiens
GLEAFDYFF

SEQ ID NO: 451532 - protein, 9 aa, Homo Sapiens
ISEKHMWEW

SEQ ID NO: 451533 - protein, 9 aa, Homo Sapiens
TLSENMILL

SEQ ID NO: 451534 - protein, 9 aa, Homo Sapiens
TDPENVQKA

SEQ ID NO: 451535 - protein, 9 aa, Homo Sapiens
FTPRYSFCC

SEQ ID NO: 451536 - protein, 9 aa, Homo Sapiens
HTGIKPYAC

SEQ ID NO: 451537 - protein, 9 aa, Homo Sapiens
LTEILRFNY

SEQ ID NO: 451538 - protein, 9 aa, Homo Sapiens
NTLNIHSSP

SEQ ID NO: 451539 - protein, 9 aa, Homo Sapiens
KKDATKNAK

SEQ ID NO: 451540 - protein, 9 aa, Homo Sapiens
LISYRGCVA

SEQ ID NO: 451541 - protein, 9 aa, Homo Sapiens
LQKHVKTHT

SEQ ID NO: 451542 - protein, 9 aa, Homo Sapiens
VIKKIKLGH

SEQ ID NO: 451543 - protein, 9 aa, Homo Sapiens
VGPGRQLTV

SEQ ID NO: 451544 - protein, 9 aa, Homo Sapiens
KKADMVNKD

SEQ ID NO: 451545 - protein, 9 aa, Homo Sapiens
NECLEGVPE

SEQ ID NO: 451546 - protein, 9 aa, Homo Sapiens
PCVPEHPGM

SEQ ID NO: 451547 - protein, 9 aa, Homo Sapiens
KDNGKPPRS

SEQ ID NO: 451548 - protein, 9 aa, Homo Sapiens
GFHRPNTTE

SEQ ID NO: 451549 - protein, 9 aa, Homo Sapiens
KSIRFPLMT

SEQ ID NO: 451550 - protein, 9 aa, Homo Sapiens
NAPELPRFY

SEQ ID NO: 451551 - protein, 9 aa, Homo Sapiens
QIFEVIEFD

SEQ ID NO: 451552 - protein, 9 aa, Homo Sapiens
MHETQKELW

SEQ ID NO: 451553 - protein, 9 aa, Homo Sapiens
DIYTHNFYW

SEQ ID NO: 451554 - protein, 9 aa, Homo Sapiens
MHMQISNAE

SEQ ID NO: 451555 - protein, 9 aa, Homo Sapiens
QPTRYDTLF

SEQ ID NO: 451556 - protein, 9 aa, Homo Sapiens
KPENNGHAK

SEQ ID NO: 451557 - protein, 9 aa, Homo Sapiens
KILEAEIES

SEQ ID NO: 451558 - protein, 9 aa, Homo Sapiens
FVSHPTEKT

SEQ ID NO: 451559 - protein, 9 aa, Homo Sapiens
TRSAKSWGL

SEQ ID NO: 451560 - protein, 9 aa, Homo Sapiens
LAQYAFKIA

SEQ ID NO: 451561 - protein, 9 aa, Homo Sapiens
EKINSRLRD

SEQ ID NO: 451562 - protein, 9 aa, Homo Sapiens
ITPSAITVF

SEQ ID NO: 451563 - protein, 9 aa, Homo Sapiens
CCIFLFLLF

SEQ ID NO: 451564 - protein, 9 aa, Homo Sapiens
TTGVSRTHK

SEQ ID NO: 451565 - protein, 9 aa, Homo Sapiens
LQPSTTYVH

SEQ ID NO: 451566 - protein, 9 aa, Homo Sapiens
GSVATVSAS

SEQ ID NO: 451567 - protein, 9 aa, Homo Sapiens
KDVYGKSLS

SEQ ID NO: 451568 - protein, 9 aa, Homo Sapiens
PTHHQLHAC

SEQ ID NO: 451569 - protein, 9 aa, Homo Sapiens
QSIFCWEIP

SEQ ID NO: 451570 - protein, 9 aa, Homo Sapiens
LYTPSSSFR

SEQ ID NO: 451571 - protein, 9 aa, Homo Sapiens
SPSLCCVQT

SEQ ID NO: 451572 - protein, 9 aa, Homo Sapiens
AKKRKCEES

SEQ ID NO: 451573 - protein, 9 aa, Homo Sapiens
FVDMQAQKV

SEQ ID NO: 451574 - protein, 9 aa, Homo Sapiens
GGKSCEKVV

SEQ ID NO: 451575 - protein, 9 aa, Homo Sapiens
HMLTQYART

SEQ ID NO: 451576 - protein, 9 aa, Homo Sapiens
IIKLTVEDF

SEQ ID NO: 451577 - protein, 9 aa, Homo Sapiens
LQQMTGKCE

SEQ ID NO: 451578 - protein, 9 aa, Homo Sapiens
LFTSLWDIA

SEQ ID NO: 451579 - protein, 9 aa, Homo Sapiens
NRAKEAEES

SEQ ID NO: 451580 - protein, 9 aa, Homo Sapiens
AESLRTAMS

SEQ ID NO: 451581 - protein, 9 aa, Homo Sapiens
MTFDPEILF

SEQ ID NO: 451582 - protein, 9 aa, Homo Sapiens
EEEDEEEYK

SEQ ID NO: 451583 - protein, 9 aa, Homo Sapiens
TDSGSSAKS

SEQ ID NO: 451584 - protein, 9 aa, Homo Sapiens
IIIRKWNGL

SEQ ID NO: 451585 - protein, 9 aa, Homo Sapiens
GNGCIDHLE

SEQ ID NO: 451586 - protein, 9 aa, Homo Sapiens
AQYAFKIAT

SEQ ID NO: 451587 - protein, 9 aa, Homo Sapiens
NEFQNKILF

SEQ ID NO: 451588 - protein, 9 aa, Homo Sapiens
LAYLHVQGV

SEQ ID NO: 451589 - protein, 9 aa, Homo Sapiens
PTPCAPLAK

SEQ ID NO: 451590 - protein, 9 aa, Homo Sapiens
EKAPLVKLL

SEQ ID NO: 451591 - protein, 9 aa, Homo Sapiens
SSTQYSAML

SEQ ID NO: 451592 - protein, 9 aa, Homo Sapiens
EIYKKLINS

SEQ ID NO: 451593 - protein, 9 aa, Homo Sapiens
ESDKNEKEE

SEQ ID NO: 451594 - protein, 9 aa, Homo Sapiens
TFKAVCNSP

SEQ ID NO: 451595 - protein, 9 aa, Homo Sapiens
INAALAQAT

SEQ ID NO: 451596 - protein, 9 aa, Homo Sapiens
KSSHHLAAF

SEQ ID NO: 451597 - protein, 9 aa, Homo Sapiens
KPTIPTKKP

SEQ ID NO: 451598 - protein, 9 aa, Homo Sapiens
FAVNSILFN

SEQ ID NO: 451599 - protein, 9 aa, Homo Sapiens
RETSSDIEV

SEQ ID NO: 451600 - protein, 9 aa, Homo Sapiens
QELESFLRN

SEQ ID NO: 451601 - protein, 9 aa, Homo Sapiens
HKIIHAEEK

SEQ ID NO: 451602 - protein, 9 aa, Homo Sapiens
EQSPGEGNG

SEQ ID NO: 451603 - protein, 9 aa, Homo Sapiens
MEGSNTPLQ

SEQ ID NO: 451604 - protein, 9 aa, Homo Sapiens
SYQYILVIN

SEQ ID NO: 451605 - protein, 9 aa, Homo Sapiens
ETQKELWKL

SEQ ID NO: 451606 - protein, 9 aa, Homo Sapiens
FAPDYGEVT

SEQ ID NO: 451607 - protein, 9 aa, Homo Sapiens
VRESRQAPT

SEQ ID NO: 451608 - protein, 9 aa, Homo Sapiens
GVGLLLVET

SEQ ID NO: 451609 - protein, 9 aa, Homo Sapiens
QNNRTTEVP

SEQ ID NO: 451610 - protein, 9 aa, Homo Sapiens
DLSESECLI

SEQ ID NO: 451611 - protein, 9 aa, Homo Sapiens
FLYITLSEM

SEQ ID NO: 451612 - protein, 9 aa, Homo Sapiens
LHYMGKLVG

SEQ ID NO: 451613 - protein, 9 aa, Homo Sapiens
LAPSTRTFF

SEQ ID NO: 451614 - protein, 9 aa, Homo Sapiens
SNTVTQSCL

SEQ ID NO: 451615 - protein, 9 aa, Homo Sapiens
LRQFVILRN

SEQ ID NO: 451616 - protein, 9 aa, Homo Sapiens
ALEAWLEKS

SEQ ID NO: 451617 - protein, 9 aa, Homo Sapiens
LKEGHKKMY

SEQ ID NO: 451618 - protein, 9 aa, Homo Sapiens
VSRNCLAEI

SEQ ID NO: 451619 - protein, 9 aa, Homo Sapiens
CPGWNEDDD

SEQ ID NO: 451620 - protein, 9 aa, Homo Sapiens
KWLHKFNDV

SEQ ID NO: 451621 - protein, 9 aa, Homo Sapiens
SLGLWAWDC

SEQ ID NO: 451622 - protein, 9 aa, Homo Sapiens
KEKAWKAVV

SEQ ID NO: 451623 - protein, 9 aa, Homo Sapiens
DSFRHITDW

SEQ ID NO: 451624 - protein, 9 aa, Homo Sapiens
KVRFLDQQN

SEQ ID NO: 451625 - protein, 9 aa, Homo Sapiens
YPLILPPPH

SEQ ID NO: 451626 - protein, 9 aa, Homo Sapiens
MPFVSVADL

SEQ ID NO: 451627 - protein, 9 aa, Homo Sapiens
GYSTHMVRK

SEQ ID NO: 451628 - protein, 9 aa, Homo Sapiens
SKFSMQEPM

SEQ ID NO: 451629 - protein, 9 aa, Homo Sapiens
RVKHGWVWN

SEQ ID NO: 451630 - protein, 9 aa, Homo Sapiens
VLLFLKYIF

SEQ ID NO: 451631 - protein, 9 aa, Homo Sapiens
YPKEAVRRR

SEQ ID NO: 451632 - protein, 9 aa, Homo Sapiens
QCTVENPVT

SEQ ID NO: 451633 - protein, 9 aa, Homo Sapiens
QDSDLVVLS

SEQ ID NO: 451634 - protein, 9 aa, Homo Sapiens
GSTTLIQGA

SEQ ID NO: 451635 - protein, 9 aa, Homo Sapiens
EPWMMEKKT

SEQ ID NO: 451636 - protein, 9 aa, Homo Sapiens
NKCAYTFLV

SEQ ID NO: 451637 - protein, 9 aa, Homo Sapiens
NTDNYILAA

SEQ ID NO: 451638 - protein, 9 aa, Homo Sapiens
NTVTQSCLM

SEQ ID NO: 451639 - protein, 9 aa, Homo Sapiens
RHIFPHFYF

SEQ ID NO: 451640 - protein, 9 aa, Homo Sapiens
NTLNLNSKL

SEQ ID NO: 451641 - protein, 9 aa, Homo Sapiens
IDEKSTHAH

SEQ ID NO: 451642 - protein, 9 aa, Homo Sapiens
HSARQAELG

SEQ ID NO: 451643 - protein, 9 aa, Homo Sapiens
PLNFFNVTV

SEQ ID NO: 451644 - protein, 9 aa, Homo Sapiens
LRVFVYCTA

SEQ ID NO: 451645 - protein, 9 aa, Homo Sapiens
SDILHHEYF

SEQ ID NO: 451646 - protein, 9 aa, Homo Sapiens
DGVRGMYKL

SEQ ID NO: 451647 - protein, 9 aa, Homo Sapiens
CRGGWTPQS

SEQ ID NO: 451648 - protein, 9 aa, Homo Sapiens
VANPQLQMA

SEQ ID NO: 451649 - protein, 9 aa, Homo Sapiens
VGYRCNRYF

SEQ ID NO: 451650 - protein, 9 aa, Homo Sapiens
SSSVTYPIK

SEQ ID NO: 451651 - protein, 9 aa, Homo Sapiens
NITGKWLLL

SEQ ID NO: 451652 - protein, 9 aa, Homo Sapiens
SWKLNDQLF

SEQ ID NO: 451653 - protein, 9 aa, Homo Sapiens
LSMACHQQN

SEQ ID NO: 451654 - protein, 9 aa, Homo Sapiens
GQRMLSQPA

SEQ ID NO: 451655 - protein, 9 aa, Homo Sapiens
FLAQHQIIH

SEQ ID NO: 451656 - protein, 9 aa, Homo Sapiens
WLLQQMTGK

SEQ ID NO: 451657 - protein, 9 aa, Homo Sapiens
IFVLDILSR

SEQ ID NO: 451658 - protein, 9 aa, Homo Sapiens
LRRTERGWM

SEQ ID NO: 451659 - protein, 9 aa, Homo Sapiens
QYKSNFVAA

SEQ ID NO: 451660 - protein, 9 aa, Homo Sapiens
CVPEHPGMP

SEQ ID NO: 451661 - protein, 9 aa, Homo Sapiens
RAVLQRDEI

SEQ ID NO: 451662 - protein, 9 aa, Homo Sapiens
LIQCQFSGK

SEQ ID NO: 451663 - protein, 9 aa, Homo Sapiens
AVILAFNVR

SEQ ID NO: 451664 - protein, 9 aa, Homo Sapiens
IGVGEEVGG

SEQ ID NO: 451665 - protein, 9 aa, Homo Sapiens
DILDSSVNC

SEQ ID NO: 451666 - protein, 9 aa, Homo Sapiens
QKVLHLEFL

SEQ ID NO: 451667 - protein, 9 aa, Homo Sapiens
QGSDILDSS

SEQ ID NO: 451668 - protein, 9 aa, Homo Sapiens
KAFNRGSNI

SEQ ID NO: 451669 - protein, 9 aa, Homo Sapiens
NAYEDIVGY

SEQ ID NO: 451670 - protein, 9 aa, Homo Sapiens
LGTTKDAAT

SEQ ID NO: 451671 - protein, 9 aa, Homo Sapiens
QCCPKLRRL

SEQ ID NO: 451672 - protein, 9 aa, Homo Sapiens
RGFAYHKES

SEQ ID NO: 451673 - protein, 9 aa, Homo Sapiens
HSAADWSAG

SEQ ID NO: 451674 - protein, 9 aa, Homo Sapiens
STGCYKCLR

SEQ ID NO: 451675 - protein, 9 aa, Homo Sapiens
SPSTNTCPD

SEQ ID NO: 451676 - protein, 9 aa, Homo Sapiens
LVVCYLWEP

SEQ ID NO: 451677 - protein, 9 aa, Homo Sapiens
NQDTIKSLT

SEQ ID NO: 451678 - protein, 9 aa, Homo Sapiens
GPVKEDSYP

SEQ ID NO: 451679 - protein, 9 aa, Homo Sapiens
LRKGADSTG

SEQ ID NO: 451680 - protein, 9 aa, Homo Sapiens
CSGQAEVVR

SEQ ID NO: 451681 - protein, 9 aa, Homo Sapiens
ATTGQNVEK

SEQ ID NO: 451682 - protein, 9 aa, Homo Sapiens
LFDILGNFN

SEQ ID NO: 451683 - protein, 9 aa, Homo Sapiens
RRNMQTIWV

SEQ ID NO: 451684 - protein, 9 aa, Homo Sapiens
IWLADGGRL

SEQ ID NO: 451685 - protein, 9 aa, Homo Sapiens
QGRLIKDPS

SEQ ID NO: 451686 - protein, 9 aa, Homo Sapiens
LNEMIYHEQ

SEQ ID NO: 451687 - protein, 9 aa, Homo Sapiens
CKNKTTKPL

SEQ ID NO: 451688 - protein, 9 aa, Homo Sapiens
PIKEKPGFL

SEQ ID NO: 451689 - protein, 9 aa, Homo Sapiens
HHGGSWKCM

SEQ ID NO: 451690 - protein, 9 aa, Homo Sapiens
LSREIYSTD

SEQ ID NO: 451691 - protein, 9 aa, Homo Sapiens
CSLCGIPRQ

SEQ ID NO: 451692 - protein, 9 aa, Homo Sapiens
HMHHHHRHH

SEQ ID NO: 451693 - protein, 9 aa, Homo Sapiens
DKPTSHSAI

SEQ ID NO: 451694 - protein, 9 aa, Homo Sapiens
QDYHNPLME

SEQ ID NO: 451695 - protein, 9 aa, Homo Sapiens
DQMDKSAVG

SEQ ID NO: 451696 - protein, 9 aa, Homo Sapiens
GYNNHDRRS

SEQ ID NO: 451697 - protein, 9 aa, Homo Sapiens
KFQDMVTFK

SEQ ID NO: 451698 - protein, 9 aa, Homo Sapiens
TASDNTSRV

SEQ ID NO: 451699 - protein, 9 aa, Homo Sapiens
HQPITQRAE

SEQ ID NO: 451700 - protein, 9 aa, Homo Sapiens
LSSEKGSVG

SEQ ID NO: 451701 - protein, 9 aa, Homo Sapiens
GRITMAARM

SEQ ID NO: 451702 - protein, 9 aa, Homo Sapiens
TWLRENPGD

SEQ ID NO: 451703 - protein, 9 aa, Homo Sapiens
GKPCAVGFC

SEQ ID NO: 451704 - protein, 9 aa, Homo Sapiens
LINGYGVKF

SEQ ID NO: 451705 - protein, 9 aa, Homo Sapiens
IAIFRGPVA

SEQ ID NO: 451706 - protein, 9 aa, Homo Sapiens
QDTTGVSRT

SEQ ID NO: 451707 - protein, 9 aa, Homo Sapiens
FVIDDNAPV

SEQ ID NO: 451708 - protein, 9 aa, Homo Sapiens
DSVDAFQHL

SEQ ID NO: 451709 - protein, 9 aa, Homo Sapiens
SKAHMFCAN

SEQ ID NO: 451710 - protein, 9 aa, Homo Sapiens
KSTFEDVWR

SEQ ID NO: 451711 - protein, 9 aa, Homo Sapiens
LVELHKFYN

SEQ ID NO: 451712 - protein, 9 aa, Homo Sapiens
CLRLQDARE

SEQ ID NO: 451713 - protein, 9 aa, Homo Sapiens
EVQQASLML

SEQ ID NO: 451714 - protein, 9 aa, Homo Sapiens
EENKLGILG

SEQ ID NO: 451715 - protein, 9 aa, Homo Sapiens
FVGWRKFLL

SEQ ID NO: 451716 - protein, 9 aa, Homo Sapiens
DLMKNNYLH

SEQ ID NO: 451717 - protein, 9 aa, Homo Sapiens
LKMAGDLDF

SEQ ID NO: 451718 - protein, 9 aa, Homo Sapiens
VHLLPPSTY

SEQ ID NO: 451719 - protein, 9 aa, Homo Sapiens
NQGNRTTPS

SEQ ID NO: 451720 - protein, 9 aa, Homo Sapiens
MDVRRRKIW

SEQ ID NO: 451721 - protein, 9 aa, Homo Sapiens
ACCCPRPPR

SEQ ID NO: 451722 - protein, 9 aa, Homo Sapiens
RDYINTTWN

SEQ ID NO: 451723 - protein, 9 aa, Homo Sapiens
DKIMFGFRV

SEQ ID NO: 451724 - protein, 9 aa, Homo Sapiens
SLEDLFNLC

SEQ ID NO: 451725 - protein, 9 aa, Homo Sapiens
QIGDTFHLS

SEQ ID NO: 451726 - protein, 9 aa, Homo Sapiens
HKNSIKLFT

SEQ ID NO: 451727 - protein, 9 aa, Homo Sapiens
RRRTVSQLY

SEQ ID NO: 451728 - protein, 9 aa, Homo Sapiens
VGAPITRSP

SEQ ID NO: 451729 - protein, 9 aa, Homo Sapiens
LTSHKIIHT

SEQ ID NO: 451730 - protein, 9 aa, Homo Sapiens
QEADPMKRP

SEQ ID NO: 451731 - protein, 9 aa, Homo Sapiens
KFLGTVAMD

SEQ ID NO: 451732 - protein, 9 aa, Homo Sapiens
IISNCQYQV

SEQ ID NO: 451733 - protein, 9 aa, Homo Sapiens
PILTNLSSN

SEQ ID NO: 451734 - protein, 9 aa, Homo Sapiens
YAVRDLVHR

SEQ ID NO: 451735 - protein, 9 aa, Homo Sapiens
APPSPAKDE

SEQ ID NO: 451736 - protein, 9 aa, Homo Sapiens
AWEVDSGCR

SEQ ID NO: 451737 - protein, 9 aa, Homo Sapiens
MRRWLPAED

SEQ ID NO: 451738 - protein, 9 aa, Homo Sapiens
TKLDDEFID

SEQ ID NO: 451739 - protein, 9 aa, Homo Sapiens
QLEREKRWE

SEQ ID NO: 451740 - protein, 9 aa, Homo Sapiens
SSTKIVEGT

SEQ ID NO: 451741 - protein, 9 aa, Homo Sapiens
FQSQYKSNF

SEQ ID NO: 451742 - protein, 9 aa, Homo Sapiens
FPLEMGVFI

SEQ ID NO: 451743 - protein, 9 aa, Homo Sapiens
CYLPEYKIF

SEQ ID NO: 451744 - protein, 9 aa, Homo Sapiens
KRTSDQIRS

SEQ ID NO: 451745 - protein, 9 aa, Homo Sapiens
CSNRLESMS

SEQ ID NO: 451746 - protein, 9 aa, Homo Sapiens
ESREGHVQV

SEQ ID NO: 451747 - protein, 9 aa, Homo Sapiens
GSGSGSGNG

SEQ ID NO: 451748 - protein, 9 aa, Homo Sapiens
VLKYPKQRR

SEQ ID NO: 451749 - protein, 9 aa, Homo Sapiens
AGHFPHLVE

SEQ ID NO: 451750 - protein, 9 aa, Homo Sapiens
LTDANMVMS

SEQ ID NO: 451751 - protein, 9 aa, Homo Sapiens
ADLSDQLSL

SEQ ID NO: 451752 - protein, 9 aa, Homo Sapiens
VLPFTLEIV

SEQ ID NO: 451753 - protein, 9 aa, Homo Sapiens
VNGGTKCGA

SEQ ID NO: 451754 - protein, 9 aa, Homo Sapiens
SLHALSRDQ

SEQ ID NO: 451755 - protein, 9 aa, Homo Sapiens
EAWKEADKF

SEQ ID NO: 451756 - protein, 9 aa, Homo Sapiens
LGLLILIRL

SEQ ID NO: 451757 - protein, 9 aa, Homo Sapiens
LYDQMSMNT

SEQ ID NO: 451758 - protein, 9 aa, Homo Sapiens
LGTQGINSA

SEQ ID NO: 451759 - protein, 9 aa, Homo Sapiens
RQSRLCADR

SEQ ID NO: 451760 - protein, 9 aa, Homo Sapiens
YSAHEGLAG

SEQ ID NO: 451761 - protein, 9 aa, Homo Sapiens
FPGHNELFR

SEQ ID NO: 451762 - protein, 9 aa, Homo Sapiens
IMCVCVEDG

SEQ ID NO: 451763 - protein, 9 aa, Homo Sapiens
GVCIAQSHK

SEQ ID NO: 451764 - protein, 9 aa, Homo Sapiens
SGEGNKESL

SEQ ID NO: 451765 - protein, 9 aa, Homo Sapiens
PLTVKPKEA

SEQ ID NO: 451766 - protein, 9 aa, Homo Sapiens
VPLLSWGPN

SEQ ID NO: 451767 - protein, 9 aa, Homo Sapiens
SLKKVTFEY

SEQ ID NO: 451768 - protein, 9 aa, Homo Sapiens
NYHSQFYQG

SEQ ID NO: 451769 - protein, 9 aa, Homo Sapiens
RRAYLNGSN

SEQ ID NO: 451770 - protein, 9 aa, Homo Sapiens
DEYIYRHLF

SEQ ID NO: 451771 - protein, 9 aa, Homo Sapiens
LCSMKNTYK

SEQ ID NO: 451772 - protein, 9 aa, Homo Sapiens
CEKKIPECG

SEQ ID NO: 451773 - protein, 9 aa, Homo Sapiens
HMELFLFLT

SEQ ID NO: 451774 - protein, 9 aa, Homo Sapiens
IQTAEFFRD

SEQ ID NO: 451775 - protein, 9 aa, Homo Sapiens
SMNMNWLSV

SEQ ID NO: 451776 - protein, 9 aa, Homo Sapiens
NQNKKKKKT

SEQ ID NO: 451777 - protein, 9 aa, Homo Sapiens
KSPMKNVSS

SEQ ID NO: 451778 - protein, 9 aa, Homo Sapiens
LKKIHYYSI

SEQ ID NO: 451779 - protein, 9 aa, Homo Sapiens
VCEKLHNFA

SEQ ID NO: 451780 - protein, 9 aa, Homo Sapiens
ILKLIGVGE

SEQ ID NO: 451781 - protein, 9 aa, Homo Sapiens
CFPTYFRAD

SEQ ID NO: 451782 - protein, 9 aa, Homo Sapiens
KVSSGSADL

SEQ ID NO: 451783 - protein, 9 aa, Homo Sapiens
LNHLVYSLR

SEQ ID NO: 451784 - protein, 9 aa, Homo Sapiens
KKDEKKEDY

SEQ ID NO: 451785 - protein, 9 aa, Homo Sapiens
SVSWSPSDE

SEQ ID NO: 451786 - protein, 9 aa, Homo Sapiens
LKDIVPHNS

SEQ ID NO: 451787 - protein, 9 aa, Homo Sapiens
IDHYKWHKF

SEQ ID NO: 451788 - protein, 9 aa, Homo Sapiens
PYQSVEQTY

SEQ ID NO: 451789 - protein, 9 aa, Homo Sapiens
HLFCEFSSL

SEQ ID NO: 451790 - protein, 9 aa, Homo Sapiens
SPRFPQPNY

SEQ ID NO: 451791 - protein, 9 aa, Homo Sapiens
YDNEEFLRY

SEQ ID NO: 451792 - protein, 9 aa, Homo Sapiens
WKFPPSKDA

SEQ ID NO: 451793 - protein, 9 aa, Homo Sapiens
QIPKKFARR

SEQ ID NO: 451794 - protein, 9 aa, Homo Sapiens
AERAVAGYP

SEQ ID NO: 451795 - protein, 9 aa, Homo Sapiens
NTQNNYKLP

SEQ ID NO: 451796 - protein, 9 aa, Homo Sapiens
ETTARYNFY

SEQ ID NO: 451797 - protein, 9 aa, Homo Sapiens
NELCVETLC

SEQ ID NO: 451798 - protein, 9 aa, Homo Sapiens
KMHGLGLRQ

SEQ ID NO: 451799 - protein, 9 aa, Homo Sapiens
VFLVASAPA

SEQ ID NO: 451800 - protein, 9 aa, Homo Sapiens
YLLTSSETP

SEQ ID NO: 451801 - protein, 9 aa, Homo Sapiens
LLAVIHKLR

SEQ ID NO: 451802 - protein, 9 aa, Homo Sapiens
MPTNITTKT

SEQ ID NO: 451803 - protein, 9 aa, Homo Sapiens
YFNLSSVNE

SEQ ID NO: 451804 - protein, 9 aa, Homo Sapiens
STLLLNPKH

SEQ ID NO: 451805 - protein, 9 aa, Homo Sapiens
STFQKAPEP

SEQ ID NO: 451806 - protein, 9 aa, Homo Sapiens
WTTTPWTRP

SEQ ID NO: 451807 - protein, 9 aa, Homo Sapiens
LECRICHVK

SEQ ID NO: 451808 - protein, 9 aa, Homo Sapiens
VKALRASRV

SEQ ID NO: 451809 - protein, 9 aa, Homo Sapiens
DKLSKVDEK

SEQ ID NO: 451810 - protein, 9 aa, Homo Sapiens
DELKTQSKS

SEQ ID NO: 451811 - protein, 9 aa, Homo Sapiens
EHLGIIGPI

SEQ ID NO: 451812 - protein, 9 aa, Homo Sapiens
FIDKVRFLD

SEQ ID NO: 451813 - protein, 9 aa, Homo Sapiens
SFRSPLPLF

SEQ ID NO: 451814 - protein, 9 aa, Homo Sapiens
YRTPEMFFF

SEQ ID NO: 451815 - protein, 9 aa, Homo Sapiens
QLSVNDSFR

SEQ ID NO: 451816 - protein, 9 aa, Homo Sapiens
YKLEERDEL

SEQ ID NO: 451817 - protein, 9 aa, Homo Sapiens
EVFASRHHD

SEQ ID NO: 451818 - protein, 9 aa, Homo Sapiens
NSRLTSHKI

SEQ ID NO: 451819 - protein, 9 aa, Homo Sapiens
LNTALVKTS

SEQ ID NO: 451820 - protein, 9 aa, Homo Sapiens
GRIIQTPPP

SEQ ID NO: 451821 - protein, 9 aa, Homo Sapiens
KSKSMNVLI

SEQ ID NO: 451822 - protein, 9 aa, Homo Sapiens
EYQKNDKDL

SEQ ID NO: 451823 - protein, 9 aa, Homo Sapiens
QSTLGDDLN

SEQ ID NO: 451824 - protein, 9 aa, Homo Sapiens
TVREEVMLT

SEQ ID NO: 451825 - protein, 9 aa, Homo Sapiens
DIKAIVDKL

SEQ ID NO: 451826 - protein, 9 aa, Homo Sapiens
SEKHMWEWQ

SEQ ID NO: 451827 - protein, 9 aa, Homo Sapiens
TNYTFICQN

SEQ ID NO: 451828 - protein, 9 aa, Homo Sapiens
SMKCGKAVI

SEQ ID NO: 451829 - protein, 9 aa, Homo Sapiens
PGYPLILPP

SEQ ID NO: 451830 - protein, 9 aa, Homo Sapiens
VVVFENDKL

SEQ ID NO: 451831 - protein, 9 aa, Homo Sapiens
DSVEEIGAL

SEQ ID NO: 451832 - protein, 9 aa, Homo Sapiens
SHNVNMPNQ

SEQ ID NO: 451833 - protein, 9 aa, Homo Sapiens
KEKIEKLKI

SEQ ID NO: 451834 - protein, 9 aa, Homo Sapiens
FCLCLTSLC

SEQ ID NO: 451835 - protein, 9 aa, Homo Sapiens
AIMCNRRQE

SEQ ID NO: 451836 - protein, 9 aa, Homo Sapiens
EGDGFSNCD

SEQ ID NO: 451837 - protein, 9 aa, Homo Sapiens
KHQDVLIQR

SEQ ID NO: 451838 - protein, 9 aa, Homo Sapiens
DKKPPVRQI

SEQ ID NO: 451839 - protein, 9 aa, Homo Sapiens
YIFAEYAKE

SEQ ID NO: 451840 - protein, 9 aa, Homo Sapiens
ERGNRTTIL

SEQ ID NO: 451841 - protein, 9 aa, Homo Sapiens
SLISQTAQL

SEQ ID NO: 451842 - protein, 9 aa, Homo Sapiens
IGPQLSNKK

SEQ ID NO: 451843 - protein, 9 aa, Homo Sapiens
KLVGLDKLV

SEQ ID NO: 451844 - protein, 9 aa, Homo Sapiens
IETKTTIGY

SEQ ID NO: 451845 - protein, 9 aa, Homo Sapiens
GNVVNLNSL

SEQ ID NO: 451846 - protein, 9 aa, Homo Sapiens
FFAWKKRKR

SEQ ID NO: 451847 - protein, 9 aa, Homo Sapiens
YSIKLYEKL

SEQ ID NO: 451848 - protein, 9 aa, Homo Sapiens
HFKDMIDYF

SEQ ID NO: 451849 - protein, 9 aa, Homo Sapiens
DTYQVLAHD

SEQ ID NO: 451850 - protein, 9 aa, Homo Sapiens
YKNLYFMDA

SEQ ID NO: 451851 - protein, 9 aa, Homo Sapiens
KKSITDIIK

SEQ ID NO: 451852 - protein, 9 aa, Homo Sapiens
HHQIHTGEK

SEQ ID NO: 451853 - protein, 9 aa, Homo Sapiens
TAHYSNVLH

SEQ ID NO: 451854 - protein, 9 aa, Homo Sapiens
HNQTACGFC

SEQ ID NO: 451855 - protein, 9 aa, Homo Sapiens
REPKSKRGR

SEQ ID NO: 451856 - protein, 9 aa, Homo Sapiens
MQKRLKKDK

SEQ ID NO: 451857 - protein, 9 aa, Homo Sapiens
CHGQGCCVN

SEQ ID NO: 451858 - protein, 9 aa, Homo Sapiens
QVNIAEGNP

SEQ ID NO: 451859 - protein, 9 aa, Homo Sapiens
QLDGLRPDT

SEQ ID NO: 451860 - protein, 9 aa, Homo Sapiens
IHYMCRMEQ

SEQ ID NO: 451861 - protein, 9 aa, Homo Sapiens
QEIKIQKQI

SEQ ID NO: 451862 - protein, 9 aa, Homo Sapiens
ELYIELDQQ

SEQ ID NO: 451863 - protein, 9 aa, Homo Sapiens
TMIYFVGCF

SEQ ID NO: 451864 - protein, 9 aa, Homo Sapiens
LCLEEEARK

SEQ ID NO: 451865 - protein, 9 aa, Homo Sapiens
GLDEARAER

SEQ ID NO: 451866 - protein, 9 aa, Homo Sapiens
SLQPPRFFN

SEQ ID NO: 451867 - protein, 9 aa, Homo Sapiens
MIVGERFSP

SEQ ID NO: 451868 - protein, 9 aa, Homo Sapiens
EFIFLFCLE

SEQ ID NO: 451869 - protein, 9 aa, Homo Sapiens
NAYLLNSQY

SEQ ID NO: 451870 - protein, 9 aa, Homo Sapiens
GTQGINSAT

SEQ ID NO: 451871 - protein, 9 aa, Homo Sapiens
LYITLSEMT

SEQ ID NO: 451872 - protein, 9 aa, Homo Sapiens
NIRRLEEDR

SEQ ID NO: 451873 - protein, 9 aa, Homo Sapiens
VLEQIGADK

SEQ ID NO: 451874 - protein, 9 aa, Homo Sapiens
ILLNYGKSM

SEQ ID NO: 451875 - protein, 9 aa, Homo Sapiens
HLQIPMYLL

SEQ ID NO: 451876 - protein, 9 aa, Homo Sapiens
SCGNQNETP

SEQ ID NO: 451877 - protein, 9 aa, Homo Sapiens
QYEGHKAEL

SEQ ID NO: 451878 - protein, 9 aa, Homo Sapiens
RSLKEEDGE

SEQ ID NO: 451879 - protein, 9 aa, Homo Sapiens
RGSELNQHQ

SEQ ID NO: 451880 - protein, 9 aa, Homo Sapiens
PADYEDGLS

SEQ ID NO: 451881 - protein, 9 aa, Homo Sapiens
DECKEYILN

SEQ ID NO: 451882 - protein, 9 aa, Homo Sapiens
QTKVQETGY

SEQ ID NO: 451883 - protein, 9 aa, Homo Sapiens
DPRDPAAPE

SEQ ID NO: 451884 - protein, 9 aa, Homo Sapiens
SLTVVQHME

SEQ ID NO: 451885 - protein, 9 aa, Homo Sapiens
VDKCVNFCT

SEQ ID NO: 451886 - protein, 9 aa, Homo Sapiens
WHLNERHYG

SEQ ID NO: 451887 - protein, 9 aa, Homo Sapiens
RSKALLKWQ

SEQ ID NO: 451888 - protein, 9 aa, Homo Sapiens
ITAGPWTNH

SEQ ID NO: 451889 - protein, 9 aa, Homo Sapiens
SEEEDFSND

SEQ ID NO: 451890 - protein, 9 aa, Homo Sapiens
IIPFCDKVM

SEQ ID NO: 451891 - protein, 9 aa, Homo Sapiens
PKSYQTAKF

SEQ ID NO: 451892 - protein, 9 aa, Homo Sapiens
PQNCSCVRG

SEQ ID NO: 451893 - protein, 9 aa, Homo Sapiens
HLNSWNLGI

SEQ ID NO: 451894 - protein, 9 aa, Homo Sapiens
HFPTFHAEV

SEQ ID NO: 451895 - protein, 9 aa, Homo Sapiens
CGLLILLSM

SEQ ID NO: 451896 - protein, 9 aa, Homo Sapiens
FPISPVAAM

SEQ ID NO: 451897 - protein, 9 aa, Homo Sapiens
ISCNICKIR

SEQ ID NO: 451898 - protein, 9 aa, Homo Sapiens
CTEKYNVYR

SEQ ID NO: 451899 - protein, 9 aa, Homo Sapiens
VCNKTLWER

SEQ ID NO: 451900 - protein, 9 aa, Homo Sapiens
VEWFPDLAA

SEQ ID NO: 451901 - protein, 9 aa, Homo Sapiens
TSETSGSFE

SEQ ID NO: 451902 - protein, 9 aa, Homo Sapiens
PQLTAKKIC

SEQ ID NO: 451903 - protein, 9 aa, Homo Sapiens
KETLRKGAD

SEQ ID NO: 451904 - protein, 9 aa, Homo Sapiens
GQKVYLTWS

SEQ ID NO: 451905 - protein, 9 aa, Homo Sapiens
YACQVNEWS

SEQ ID NO: 451906 - protein, 9 aa, Homo Sapiens
SVRDYFKSL

SEQ ID NO: 451907 - protein, 9 aa, Homo Sapiens
INLSRMPIV

SEQ ID NO: 451908 - protein, 9 aa, Homo Sapiens
NYNDWINLV

SEQ ID NO: 451909 - protein, 9 aa, Homo Sapiens
TYSPALNTM

SEQ ID NO: 451910 - protein, 9 aa, Homo Sapiens
LFNVLLPPI

SEQ ID NO: 451911 - protein, 9 aa, Homo Sapiens
IIVYRKARN

SEQ ID NO: 451912 - protein, 9 aa, Homo Sapiens
YKCKECGRL

SEQ ID NO: 451913 - protein, 9 aa, Homo Sapiens
EECGKGPKI

SEQ ID NO: 451914 - protein, 9 aa, Homo Sapiens
YFKQFCITC

SEQ ID NO: 451915 - protein, 9 aa, Homo Sapiens
VAAGTAEEF

SEQ ID NO: 451916 - protein, 9 aa, Homo Sapiens
FSVLSTLTK

SEQ ID NO: 451917 - protein, 9 aa, Homo Sapiens
EQKLSENTS

SEQ ID NO: 451918 - protein, 9 aa, Homo Sapiens
ACKKGFIQI

SEQ ID NO: 451919 - protein, 9 aa, Homo Sapiens
QHGLCDKPG

SEQ ID NO: 451920 - protein, 9 aa, Homo Sapiens
TNLTVHIRQ

SEQ ID NO: 451921 - protein, 9 aa, Homo Sapiens
ALKQKFTFQ

SEQ ID NO: 451922 - protein, 9 aa, Homo Sapiens
TCACCCPRP

SEQ ID NO: 451923 - protein, 9 aa, Homo Sapiens
ECNRISVEV

SEQ ID NO: 451924 - protein, 9 aa, Homo Sapiens
PNLPYALAF

SEQ ID NO: 451925 - protein, 9 aa, Homo Sapiens
ASGHTVGED

SEQ ID NO: 451926 - protein, 9 aa, Homo Sapiens
DSHIYGKLL

SEQ ID NO: 451927 - protein, 9 aa, Homo Sapiens
HQQIYDFLC

SEQ ID NO: 451928 - protein, 9 aa, Homo Sapiens
DFFVLKNCS

SEQ ID NO: 451929 - protein, 9 aa, Homo Sapiens
NIVLAKNRR

SEQ ID NO: 451930 - protein, 9 aa, Homo Sapiens
FSALGDAKW

SEQ ID NO: 451931 - protein, 9 aa, Homo Sapiens
LEFCLVFKP

SEQ ID NO: 451932 - protein, 9 aa, Homo Sapiens
HFFHSLENS

SEQ ID NO: 451933 - protein, 9 aa, Homo Sapiens
QKICSCLLS

SEQ ID NO: 451934 - protein, 9 aa, Homo Sapiens
IVSLFNVTS

SEQ ID NO: 451935 - protein, 9 aa, Homo Sapiens
LKEGKAAYL

SEQ ID NO: 451936 - protein, 9 aa, Homo Sapiens
NLQRHRIIH

SEQ ID NO: 451937 - protein, 9 aa, Homo Sapiens
GAIDDSAKQ

SEQ ID NO: 451938 - protein, 9 aa, Homo Sapiens
QRTGWFCGG

SEQ ID NO: 451939 - protein, 9 aa, Homo Sapiens
ERDYFSSGT

SEQ ID NO: 451940 - protein, 9 aa, Homo Sapiens
VAKHPAGYF

SEQ ID NO: 451941 - protein, 9 aa, Homo Sapiens
DFITSLFPD

SEQ ID NO: 451942 - protein, 9 aa, Homo Sapiens
MNKINEENK

SEQ ID NO: 451943 - protein, 9 aa, Homo Sapiens
YPSYQENRR

SEQ ID NO: 451944 - protein, 9 aa, Homo Sapiens
KPYKCSICG

SEQ ID NO: 451945 - protein, 9 aa, Homo Sapiens
DLKENQRGC

SEQ ID NO: 451946 - protein, 9 aa, Homo Sapiens
DRATRYRMI

SEQ ID NO: 451947 - protein, 9 aa, Homo Sapiens
SMKEASLQV

SEQ ID NO: 451948 - protein, 9 aa, Homo Sapiens
PFTLEIVIM

SEQ ID NO: 451949 - protein, 9 aa, Homo Sapiens
EQENKIQYH

SEQ ID NO: 451950 - protein, 9 aa, Homo Sapiens
FILGDHFRD

SEQ ID NO: 451951 - protein, 9 aa, Homo Sapiens
DNPSLEQLF

SEQ ID NO: 451952 - protein, 9 aa, Homo Sapiens
TQRQQIKYF

SEQ ID NO: 451953 - protein, 9 aa, Homo Sapiens
GRNHHKTTG

SEQ ID NO: 451954 - protein, 9 aa, Homo Sapiens
EAPELRGLF

SEQ ID NO: 451955 - protein, 9 aa, Homo Sapiens
SPPSTLPIN

SEQ ID NO: 451956 - protein, 9 aa, Homo Sapiens
FAISWLPYT

SEQ ID NO: 451957 - protein, 9 aa, Homo Sapiens
HASQLHNHV

SEQ ID NO: 451958 - protein, 9 aa, Homo Sapiens
KQMLKFSSE

SEQ ID NO: 451959 - protein, 9 aa, Homo Sapiens
SSENQDTIK

SEQ ID NO: 451960 - protein, 9 aa, Homo Sapiens
LLKRTHDMF

SEQ ID NO: 451961 - protein, 9 aa, Homo Sapiens
HELQDTTGV

SEQ ID NO: 451962 - protein, 9 aa, Homo Sapiens
ERKQAQIQK

SEQ ID NO: 451963 - protein, 9 aa, Homo Sapiens
LSDTIFAEK

SEQ ID NO: 451964 - protein, 9 aa, Homo Sapiens
AICAVSGLL

SEQ ID NO: 451965 - protein, 9 aa, Homo Sapiens
RSDFLHFKF

SEQ ID NO: 451966 - protein, 9 aa, Homo Sapiens
TVVFYDNYL

SEQ ID NO: 451967 - protein, 9 aa, Homo Sapiens
DIASGLEHS

SEQ ID NO: 451968 - protein, 9 aa, Homo Sapiens
CFRDEAWST

SEQ ID NO: 451969 - protein, 9 aa, Homo Sapiens
LWNLHAIHY

SEQ ID NO: 451970 - protein, 9 aa, Homo Sapiens
NNNLHILVH

SEQ ID NO: 451971 - protein, 9 aa, Homo Sapiens
GNNLSRKRP

SEQ ID NO: 451972 - protein, 9 aa, Homo Sapiens
IIKVARQSL

SEQ ID NO: 451973 - protein, 9 aa, Homo Sapiens
ALTYWGCVY

SEQ ID NO: 451974 - protein, 9 aa, Homo Sapiens
TNKNYRASQ

SEQ ID NO: 451975 - protein, 9 aa, Homo Sapiens
HTFLQDCED

SEQ ID NO: 451976 - protein, 9 aa, Homo Sapiens
WSAPYDVRT

SEQ ID NO: 451977 - protein, 9 aa, Homo Sapiens
TSQLSQTEL

SEQ ID NO: 451978 - protein, 9 aa, Homo Sapiens
RELDHRLSA

SEQ ID NO: 451979 - protein, 9 aa, Homo Sapiens
RPSYSAHEG

SEQ ID NO: 451980 - protein, 9 aa, Homo Sapiens
SHGAVDVRE

SEQ ID NO: 451981 - protein, 9 aa, Homo Sapiens
IMWDHDLNP

SEQ ID NO: 451982 - protein, 9 aa, Homo Sapiens
RHQILHTGV

SEQ ID NO: 451983 - protein, 9 aa, Homo Sapiens
KTCLQSQIG

SEQ ID NO: 451984 - protein, 9 aa, Homo Sapiens
CHINTFIKI

SEQ ID NO: 451985 - protein, 9 aa, Homo Sapiens
PSSKDSGVV

SEQ ID NO: 451986 - protein, 9 aa, Homo Sapiens
HTVDKPTSH

SEQ ID NO: 451987 - protein, 9 aa, Homo Sapiens
SDSFALNTR

SEQ ID NO: 451988 - protein, 9 aa, Homo Sapiens
DVQHLQTVL

SEQ ID NO: 451989 - protein, 9 aa, Homo Sapiens
TQKELWKLV

SEQ ID NO: 451990 - protein, 9 aa, Homo Sapiens
RLRLRCCHR

SEQ ID NO: 451991 - protein, 9 aa, Homo Sapiens
NFYTNVKFS

SEQ ID NO: 451992 - protein, 9 aa, Homo Sapiens
LTVPHITCN

SEQ ID NO: 451993 - protein, 9 aa, Homo Sapiens
FRADKKSLQ

SEQ ID NO: 451994 - protein, 9 aa, Homo Sapiens
SENLKIHKQ

SEQ ID NO: 451995 - protein, 9 aa, Homo Sapiens
NSIKLFTGD

SEQ ID NO: 451996 - protein, 9 aa, Homo Sapiens
LKPHQVGLI

SEQ ID NO: 451997 - protein, 9 aa, Homo Sapiens
KLQQTSGEV

SEQ ID NO: 451998 - protein, 9 aa, Homo Sapiens
HVGAVALFY

SEQ ID NO: 451999 - protein, 9 aa, Homo Sapiens
NTGSCCDMS

SEQ ID NO: 452000 - protein, 9 aa, Homo Sapiens
VADLIGGKW

SEQ ID NO: 452001 - protein, 9 aa, Homo Sapiens
NNFQKSMDS

SEQ ID NO: 452002 - protein, 9 aa, Homo Sapiens
ASEGEDSLS

SEQ ID NO: 452003 - protein, 9 aa, Homo Sapiens
KTQIAGCLA

SEQ ID NO: 452004 - protein, 9 aa, Homo Sapiens
QTGYMPRKA

SEQ ID NO: 452005 - protein, 9 aa, Homo Sapiens
ASPLMNNFD

SEQ ID NO: 452006 - protein, 9 aa, Homo Sapiens
QMHSKFPPS

SEQ ID NO: 452007 - protein, 9 aa, Homo Sapiens
SKNKTAVKR

SEQ ID NO: 452008 - protein, 9 aa, Homo Sapiens
GMDVRRRKI

SEQ ID NO: 452009 - protein, 9 aa, Homo Sapiens
LDIHDLLGS

SEQ ID NO: 452010 - protein, 9 aa, Homo Sapiens
PNKLFGNKD

SEQ ID NO: 452011 - protein, 9 aa, Homo Sapiens
MQGPIPEHI

SEQ ID NO: 452012 - protein, 9 aa, Homo Sapiens
GPAMNNVEF

SEQ ID NO: 452013 - protein, 9 aa, Homo Sapiens
LSQPAGNQT

SEQ ID NO: 452014 - protein, 9 aa, Homo Sapiens
LCCYGYQND

SEQ ID NO: 452015 - protein, 9 aa, Homo Sapiens
QYHKKKESH

SEQ ID NO: 452016 - protein, 9 aa, Homo Sapiens
NMMKEAHML

SEQ ID NO: 452017 - protein, 9 aa, Homo Sapiens
EMSFSVLLR

SEQ ID NO: 452018 - protein, 9 aa, Homo Sapiens
LPKDKETNI

SEQ ID NO: 452019 - protein, 9 aa, Homo Sapiens
AEKLVKLTN

SEQ ID NO: 452020 - protein, 9 aa, Homo Sapiens
STPFQTILG

SEQ ID NO: 452021 - protein, 9 aa, Homo Sapiens
EPQRRLPAN

SEQ ID NO: 452022 - protein, 9 aa, Homo Sapiens
GMQQGSYPA

SEQ ID NO: 452023 - protein, 9 aa, Homo Sapiens
LEKIIYKIS

SEQ ID NO: 452024 - protein, 9 aa, Homo Sapiens
DIYNHAKFI

SEQ ID NO: 452025 - protein, 9 aa, Homo Sapiens
FNIDFNWWH

SEQ ID NO: 452026 - protein, 9 aa, Homo Sapiens
RRRCSHTEA

SEQ ID NO: 452027 - protein, 9 aa, Homo Sapiens
TPIFCTSSL

SEQ ID NO: 452028 - protein, 9 aa, Homo Sapiens
SRLIKLLHL

SEQ ID NO: 452029 - protein, 9 aa, Homo Sapiens
VSKKHFKAD

SEQ ID NO: 452030 - protein, 9 aa, Homo Sapiens
LVAKSNVET

SEQ ID NO: 452031 - protein, 9 aa, Homo Sapiens
PDGITKKED

SEQ ID NO: 452032 - protein, 9 aa, Homo Sapiens
CTEPNHPGV

SEQ ID NO: 452033 - protein, 9 aa, Homo Sapiens
QLFDHHLME

SEQ ID NO: 452034 - protein, 9 aa, Homo Sapiens
WTAKYLTEE

SEQ ID NO: 452035 - protein, 9 aa, Homo Sapiens
SGAEFEGEG

SEQ ID NO: 452036 - protein, 9 aa, Homo Sapiens
TYSPVDSLE

SEQ ID NO: 452037 - protein, 9 aa, Homo Sapiens
KTNESLTLP

SEQ ID NO: 452038 - protein, 9 aa, Homo Sapiens
ILRRTDKND

SEQ ID NO: 452039 - protein, 9 aa, Homo Sapiens
YHLTLHQII

SEQ ID NO: 452040 - protein, 9 aa, Homo Sapiens
LILVVVDIT

SEQ ID NO: 452041 - protein, 9 aa, Homo Sapiens
EGIQKSSPR

SEQ ID NO: 452042 - protein, 9 aa, Homo Sapiens
PLRFLYITL

SEQ ID NO: 452043 - protein, 9 aa, Homo Sapiens
IHEDLNTFK

SEQ ID NO: 452044 - protein, 9 aa, Homo Sapiens
TEENASISS

SEQ ID NO: 452045 - protein, 9 aa, Homo Sapiens
NSLCRQNLT

SEQ ID NO: 452046 - protein, 9 aa, Homo Sapiens
EKYDLHQVN

SEQ ID NO: 452047 - protein, 9 aa, Homo Sapiens
QTYSGMVLA

SEQ ID NO: 452048 - protein, 9 aa, Homo Sapiens
QYKLYDPPP

SEQ ID NO: 452049 - protein, 9 aa, Homo Sapiens
KLQNEFSSF

SEQ ID NO: 452050 - protein, 9 aa, Homo Sapiens
DTGYCYSNK

SEQ ID NO: 452051 - protein, 9 aa, Homo Sapiens
FQKHERIHT

SEQ ID NO: 452052 - protein, 9 aa, Homo Sapiens
TRHPFTPIH

SEQ ID NO: 452053 - protein, 9 aa, Homo Sapiens
GRFLQDTFT

SEQ ID NO: 452054 - protein, 9 aa, Homo Sapiens
TSQYFEDPR

SEQ ID NO: 452055 - protein, 9 aa, Homo Sapiens
RICINGENS

SEQ ID NO: 452056 - protein, 9 aa, Homo Sapiens
SLDLFRLYV

SEQ ID NO: 452057 - protein, 9 aa, Homo Sapiens
GWVAVGLSS

SEQ ID NO: 452058 - protein, 9 aa, Homo Sapiens
RLVRVGPPE

SEQ ID NO: 452059 - protein, 9 aa, Homo Sapiens
NFIDKLDEV

SEQ ID NO: 452060 - protein, 9 aa, Homo Sapiens
RYDAKYLSG

SEQ ID NO: 452061 - protein, 9 aa, Homo Sapiens
ITMGPSAVC

SEQ ID NO: 452062 - protein, 9 aa, Homo Sapiens
QLSYLGLYF

SEQ ID NO: 452063 - protein, 9 aa, Homo Sapiens
NVSLPGIRG

SEQ ID NO: 452064 - protein, 9 aa, Homo Sapiens
LLVRAHLLL

SEQ ID NO: 452065 - protein, 9 aa, Homo Sapiens
NEQEETPEM

SEQ ID NO: 452066 - protein, 9 aa, Homo Sapiens
RIVDWKGDC

SEQ ID NO: 452067 - protein, 9 aa, Homo Sapiens
EIKISQVTD

SEQ ID NO: 452068 - protein, 9 aa, Homo Sapiens
IYYHPHPKD

SEQ ID NO: 452069 - protein, 9 aa, Homo Sapiens
CEECGTVFS

SEQ ID NO: 452070 - protein, 9 aa, Homo Sapiens
DRDPGDCLI

SEQ ID NO: 452071 - protein, 9 aa, Homo Sapiens
KECWLWESY

SEQ ID NO: 452072 - protein, 9 aa, Homo Sapiens
KLASNEFQN

SEQ ID NO: 452073 - protein, 9 aa, Homo Sapiens
QQNATENCF

SEQ ID NO: 452074 - protein, 9 aa, Homo Sapiens
IFFVMGITS

SEQ ID NO: 452075 - protein, 9 aa, Homo Sapiens
DPPGQFDSL

SEQ ID NO: 452076 - protein, 9 aa, Homo Sapiens
LWVFILVCV

SEQ ID NO: 452077 - protein, 9 aa, Homo Sapiens
ESFTQNNIL

SEQ ID NO: 452078 - protein, 9 aa, Homo Sapiens
QFDPGLRNL

SEQ ID NO: 452079 - protein, 9 aa, Homo Sapiens
RYPQCMCLS

SEQ ID NO: 452080 - protein, 9 aa, Homo Sapiens
AGTYDGSLD

SEQ ID NO: 452081 - protein, 9 aa, Homo Sapiens
NELFRANST

SEQ ID NO: 452082 - protein, 9 aa, Homo Sapiens
CGKVWKQRI

SEQ ID NO: 452083 - protein, 9 aa, Homo Sapiens
GLASGDHSA

SEQ ID NO: 452084 - protein, 9 aa, Homo Sapiens
VLHQPPAMP

SEQ ID NO: 452085 - protein, 9 aa, Homo Sapiens
SSLIELIKL

SEQ ID NO: 452086 - protein, 9 aa, Homo Sapiens
CFSRAESKC

SEQ ID NO: 452087 - protein, 9 aa, Homo Sapiens
REYNCQMCK

SEQ ID NO: 452088 - protein, 9 aa, Homo Sapiens
THAHVLGDH

SEQ ID NO: 452089 - protein, 9 aa, Homo Sapiens
KRHIFPHFY

SEQ ID NO: 452090 - protein, 9 aa, Homo Sapiens
PPPSGTRSP

SEQ ID NO: 452091 - protein, 9 aa, Homo Sapiens
QMWCVERPL

SEQ ID NO: 452092 - protein, 9 aa, Homo Sapiens
LHSTLLLNP

SEQ ID NO: 452093 - protein, 9 aa, Homo Sapiens
DFGVFICKL

SEQ ID NO: 452094 - protein, 9 aa, Homo Sapiens
HMVKSDGGT

SEQ ID NO: 452095 - protein, 9 aa, Homo Sapiens
LFNDLIDCA

SEQ ID NO: 452096 - protein, 9 aa, Homo Sapiens
SFGDTIARA

SEQ ID NO: 452097 - protein, 9 aa, Homo Sapiens
RGLYGLQVK

SEQ ID NO: 452098 - protein, 9 aa, Homo Sapiens
VRAKCSQDC

SEQ ID NO: 452099 - protein, 9 aa, Homo Sapiens
CFMNNISRY

SEQ ID NO: 452100 - protein, 9 aa, Homo Sapiens
KLPDKFGTG

SEQ ID NO: 452101 - protein, 9 aa, Homo Sapiens
KFIIFKIAF

SEQ ID NO: 452102 - protein, 9 aa, Homo Sapiens
EYSRRHLQL

SEQ ID NO: 452103 - protein, 9 aa, Homo Sapiens
LSPSPSPDS

SEQ ID NO: 452104 - protein, 9 aa, Homo Sapiens
GPHRPSPKK

SEQ ID NO: 452105 - protein, 9 aa, Homo Sapiens
FDQKRDALG

SEQ ID NO: 452106 - protein, 9 aa, Homo Sapiens
YASEVVLAG

SEQ ID NO: 452107 - protein, 9 aa, Homo Sapiens
RSLESVGLK

SEQ ID NO: 452108 - protein, 9 aa, Homo Sapiens
NLLSYFVEL

SEQ ID NO: 452109 - protein, 9 aa, Homo Sapiens
CEQLIQSRM

SEQ ID NO: 452110 - protein, 9 aa, Homo Sapiens
RIKLIVMIN

SEQ ID NO: 452111 - protein, 9 aa, Homo Sapiens
YPCHNCGKR

SEQ ID NO: 452112 - protein, 9 aa, Homo Sapiens
VRKKECQKY

SEQ ID NO: 452113 - protein, 9 aa, Homo Sapiens
TEIVAVHFS

SEQ ID NO: 452114 - protein, 9 aa, Homo Sapiens
VHQSKIFAD

SEQ ID NO: 452115 - protein, 9 aa, Homo Sapiens
LPCDLKPES

SEQ ID NO: 452116 - protein, 9 aa, Homo Sapiens
QTKAIFVQH

SEQ ID NO: 452117 - protein, 9 aa, Homo Sapiens
RGELARIKI

SEQ ID NO: 452118 - protein, 9 aa, Homo Sapiens
QKDTSMKGM

SEQ ID NO: 452119 - protein, 9 aa, Homo Sapiens
EQKNKKLWQ

SEQ ID NO: 452120 - protein, 9 aa, Homo Sapiens
GNKYVFTKN

SEQ ID NO: 452121 - protein, 9 aa, Homo Sapiens
DFCYGNKDL

SEQ ID NO: 452122 - protein, 9 aa, Homo Sapiens
ELWKLVHEI

SEQ ID NO: 452123 - protein, 9 aa, Homo Sapiens
MKYLEVRSP

SEQ ID NO: 452124 - protein, 9 aa, Homo Sapiens
KQEDKQIKR

SEQ ID NO: 452125 - protein, 9 aa, Homo Sapiens
CLIKCQNAR

SEQ ID NO: 452126 - protein, 9 aa, Homo Sapiens
HINHNYLEI

SEQ ID NO: 452127 - protein, 9 aa, Homo Sapiens
ENLQKELND

SEQ ID NO: 452128 - protein, 9 aa, Homo Sapiens
EKLNIRGCE

SEQ ID NO: 452129 - protein, 9 aa, Homo Sapiens
SNNVCFLEG

SEQ ID NO: 452130 - protein, 9 aa, Homo Sapiens
EYGLSEKEL

SEQ ID NO: 452131 - protein, 9 aa, Homo Sapiens
SEHGKCKTF

SEQ ID NO: 452132 - protein, 9 aa, Homo Sapiens
CYLHTAIVI

SEQ ID NO: 452133 - protein, 9 aa, Homo Sapiens
SSNVDVFIP

SEQ ID NO: 452134 - protein, 9 aa, Homo Sapiens
LTRPHLEGR

SEQ ID NO: 452135 - protein, 9 aa, Homo Sapiens
VHGNERCIQ

SEQ ID NO: 452136 - protein, 9 aa, Homo Sapiens
NCSHDCPCH

SEQ ID NO: 452137 - protein, 9 aa, Homo Sapiens
KPPSGSARP

SEQ ID NO: 452138 - protein, 9 aa, Homo Sapiens
NIHPSTGTG

SEQ ID NO: 452139 - protein, 9 aa, Homo Sapiens
IIFTFQLPF

SEQ ID NO: 452140 - protein, 9 aa, Homo Sapiens
ILNKVTQSS

SEQ ID NO: 452141 - protein, 9 aa, Homo Sapiens
LKNISPTML

SEQ ID NO: 452142 - protein, 9 aa, Homo Sapiens
ERTKLLWIS

SEQ ID NO: 452143 - protein, 9 aa, Homo Sapiens
HNKEELYHL

SEQ ID NO: 452144 - protein, 9 aa, Homo Sapiens
HSGEKLYKC

SEQ ID NO: 452145 - protein, 9 aa, Homo Sapiens
KELKEGKAA

SEQ ID NO: 452146 - protein, 9 aa, Homo Sapiens
LTSSSCFQH

SEQ ID NO: 452147 - protein, 9 aa, Homo Sapiens
AKMLQEMQS

SEQ ID NO: 452148 - protein, 9 aa, Homo Sapiens
VAAVLGIGR

SEQ ID NO: 452149 - protein, 9 aa, Homo Sapiens
ANNLLGELN

SEQ ID NO: 452150 - protein, 9 aa, Homo Sapiens
AQTVQILGA

SEQ ID NO: 452151 - protein, 9 aa, Homo Sapiens
FTPPKSEQF

SEQ ID NO: 452152 - protein, 9 aa, Homo Sapiens
SDKNLSLTP

SEQ ID NO: 452153 - protein, 9 aa, Homo Sapiens
YQGSQISPP

SEQ ID NO: 452154 - protein, 9 aa, Homo Sapiens
NLKKIHYYS

SEQ ID NO: 452155 - protein, 9 aa, Homo Sapiens
GKAFRWSST

SEQ ID NO: 452156 - protein, 9 aa, Homo Sapiens
IAPNINRIN

SEQ ID NO: 452157 - protein, 9 aa, Homo Sapiens
VRNIKVREN

SEQ ID NO: 452158 - protein, 9 aa, Homo Sapiens
EFYTEDLLR

SEQ ID NO: 452159 - protein, 9 aa, Homo Sapiens
YRHLFGHTF

SEQ ID NO: 452160 - protein, 9 aa, Homo Sapiens
RFIFPAPDL

SEQ ID NO: 452161 - protein, 9 aa, Homo Sapiens
TPTYSMQGR

SEQ ID NO: 452162 - protein, 9 aa, Homo Sapiens
VANIRLNLG

SEQ ID NO: 452163 - protein, 9 aa, Homo Sapiens
QSTDVDRTL

SEQ ID NO: 452164 - protein, 9 aa, Homo Sapiens
LCLSHFPQH

SEQ ID NO: 452165 - protein, 9 aa, Homo Sapiens
FGLELDDIT

SEQ ID NO: 452166 - protein, 9 aa, Homo Sapiens
VQTAPKKNK

SEQ ID NO: 452167 - protein, 9 aa, Homo Sapiens
WSLCGGLEM

SEQ ID NO: 452168 - protein, 9 aa, Homo Sapiens
IPNLRNVAA

SEQ ID NO: 452169 - protein, 9 aa, Homo Sapiens
RVTRHPFTP

SEQ ID NO: 452170 - protein, 9 aa, Homo Sapiens
RNGLLNEVL

SEQ ID NO: 452171 - protein, 9 aa, Homo Sapiens
MGFEKLFEV

SEQ ID NO: 452172 - protein, 9 aa, Homo Sapiens
YYARHQKIH

SEQ ID NO: 452173 - protein, 9 aa, Homo Sapiens
SKYNLYGKY

SEQ ID NO: 452174 - protein, 9 aa, Homo Sapiens
TNQHDSNNQ

SEQ ID NO: 452175 - protein, 9 aa, Homo Sapiens
ECLEGVPEC

SEQ ID NO: 452176 - protein, 9 aa, Homo Sapiens
GDLGRDSKK

SEQ ID NO: 452177 - protein, 9 aa, Homo Sapiens
PTPKTFVLC

SEQ ID NO: 452178 - protein, 9 aa, Homo Sapiens
SNYPNSCSP

SEQ ID NO: 452179 - protein, 9 aa, Homo Sapiens
CCLAGKVNK

SEQ ID NO: 452180 - protein, 9 aa, Homo Sapiens
EKQDKKILE

SEQ ID NO: 452181 - protein, 9 aa, Homo Sapiens
ESYSSISSS

SEQ ID NO: 452182 - protein, 9 aa, Homo Sapiens
IVDKVSQKQ

SEQ ID NO: 452183 - protein, 9 aa, Homo Sapiens
ERAVLQLWD

SEQ ID NO: 452184 - protein, 9 aa, Homo Sapiens
ISTEAFLAS

SEQ ID NO: 452185 - protein, 9 aa, Homo Sapiens
ITVQKPFIR

SEQ ID NO: 452186 - protein, 9 aa, Homo Sapiens
VVLPFTLEI

SEQ ID NO: 452187 - protein, 9 aa, Homo Sapiens
STVFITSDL

SEQ ID NO: 452188 - protein, 9 aa, Homo Sapiens
SPYGYGSGW

SEQ ID NO: 452189 - protein, 9 aa, Homo Sapiens
LVENTFLLP

SEQ ID NO: 452190 - protein, 9 aa, Homo Sapiens
RDFTVVSPA

SEQ ID NO: 452191 - protein, 9 aa, Homo Sapiens
PVIRYKQRS

SEQ ID NO: 452192 - protein, 9 aa, Homo Sapiens
DEFLIQASS

SEQ ID NO: 452193 - protein, 9 aa, Homo Sapiens
PLTVTSAQN

SEQ ID NO: 452194 - protein, 9 aa, Homo Sapiens
DTRFSHPSL

SEQ ID NO: 452195 - protein, 9 aa, Homo Sapiens
LLLITAVVL

SEQ ID NO: 452196 - protein, 9 aa, Homo Sapiens
YYQAFQITL

SEQ ID NO: 452197 - protein, 9 aa, Homo Sapiens
SQRVNLDTM

SEQ ID NO: 452198 - protein, 9 aa, Homo Sapiens
WSASLQCIR

SEQ ID NO: 452199 - protein, 9 aa, Homo Sapiens
INRINEIQR

SEQ ID NO: 452200 - protein, 9 aa, Homo Sapiens
AGEYGKGFI

SEQ ID NO: 452201 - protein, 9 aa, Homo Sapiens
TKRKPQILE

SEQ ID NO: 452202 - protein, 9 aa, Homo Sapiens
SSHLSRHEI

SEQ ID NO: 452203 - protein, 9 aa, Homo Sapiens
FESMLYSVL

SEQ ID NO: 452204 - protein, 9 aa, Homo Sapiens
SVVSLYFLK

SEQ ID NO: 452205 - protein, 9 aa, Homo Sapiens
PEADSILSL

SEQ ID NO: 452206 - protein, 9 aa, Homo Sapiens
KAKPNKCAR

SEQ ID NO: 452207 - protein, 9 aa, Homo Sapiens
SACSPSFFN

SEQ ID NO: 452208 - protein, 9 aa, Homo Sapiens
TTAAAATVT

SEQ ID NO: 452209 - protein, 9 aa, Homo Sapiens
MFEHCSIHL

SEQ ID NO: 452210 - protein, 9 aa, Homo Sapiens
AMPSALGTT

SEQ ID NO: 452211 - protein, 9 aa, Homo Sapiens
SSITNHHRI

SEQ ID NO: 452212 - protein, 9 aa, Homo Sapiens
LDQRQLDLV

SEQ ID NO: 452213 - protein, 9 aa, Homo Sapiens
SKRFEGINI

SEQ ID NO: 452214 - protein, 9 aa, Homo Sapiens
GDFWYVTCA

SEQ ID NO: 452215 - protein, 9 aa, Homo Sapiens
VVSWGRGCT

SEQ ID NO: 452216 - protein, 9 aa, Homo Sapiens
QEYNLELND

SEQ ID NO: 452217 - protein, 9 aa, Homo Sapiens
NNTVAYGEF

SEQ ID NO: 452218 - protein, 9 aa, Homo Sapiens
LRDTYMFAT

SEQ ID NO: 452219 - protein, 9 aa, Homo Sapiens
VAQILVELR

SEQ ID NO: 452220 - protein, 9 aa, Homo Sapiens
PASQRGELA

SEQ ID NO: 452221 - protein, 9 aa, Homo Sapiens
PGITGTLRT

SEQ ID NO: 452222 - protein, 9 aa, Homo Sapiens
RHHTHVNVS

SEQ ID NO: 452223 - protein, 9 aa, Homo Sapiens
RLHLRNKGN

SEQ ID NO: 452224 - protein, 9 aa, Homo Sapiens
YQKNDKDLK

SEQ ID NO: 452225 - protein, 9 aa, Homo Sapiens
TKLKMPYQS

SEQ ID NO: 452226 - protein, 9 aa, Homo Sapiens
EVRTHYAPP

SEQ ID NO: 452227 - protein, 9 aa, Homo Sapiens
IRPPENPVL

SEQ ID NO: 452228 - protein, 9 aa, Homo Sapiens
TNRVTLNYT

SEQ ID NO: 452229 - protein, 9 aa, Homo Sapiens
SLHTYLLSA

SEQ ID NO: 452230 - protein, 9 aa, Homo Sapiens
IVDGERAVL

SEQ ID NO: 452231 - protein, 9 aa, Homo Sapiens
QYYIYWTDW

SEQ ID NO: 452232 - protein, 9 aa, Homo Sapiens
ISHKKATYV

SEQ ID NO: 452233 - protein, 9 aa, Homo Sapiens
ITAYPNVTM

SEQ ID NO: 452234 - protein, 9 aa, Homo Sapiens
KLVKLTNQN

SEQ ID NO: 452235 - protein, 9 aa, Homo Sapiens
IPLGSVVEA

SEQ ID NO: 452236 - protein, 9 aa, Homo Sapiens
KAELTEDQI

SEQ ID NO: 452237 - protein, 9 aa, Homo Sapiens
TSLWLRWVP

SEQ ID NO: 452238 - protein, 9 aa, Homo Sapiens
TESFCERTS

SEQ ID NO: 452239 - protein, 9 aa, Homo Sapiens
QKTAEETNM

SEQ ID NO: 452240 - protein, 9 aa, Homo Sapiens
VQLTALGCS

SEQ ID NO: 452241 - protein, 9 aa, Homo Sapiens
ELKASESFL

SEQ ID NO: 452242 - protein, 9 aa, Homo Sapiens
VVVAADKAN

SEQ ID NO: 452243 - protein, 9 aa, Homo Sapiens
NKHNKIHTV

SEQ ID NO: 452244 - protein, 9 aa, Homo Sapiens
DRKRELDHR

SEQ ID NO: 452245 - protein, 9 aa, Homo Sapiens
DRADIYPLS

SEQ ID NO: 452246 - protein, 9 aa, Homo Sapiens
PSLAVWGDY

SEQ ID NO: 452247 - protein, 9 aa, Homo Sapiens
LPMISPRYP

SEQ ID NO: 452248 - protein, 9 aa, Homo Sapiens
NPFNCTCGI

SEQ ID NO: 452249 - protein, 9 aa, Homo Sapiens
STANFPTIP

SEQ ID NO: 452250 - protein, 9 aa, Homo Sapiens
HVDSLLSES

SEQ ID NO: 452251 - protein, 9 aa, Homo Sapiens
FIVTIILHI

SEQ ID NO: 452252 - protein, 9 aa, Homo Sapiens
LVVALYGCC

SEQ ID NO: 452253 - protein, 9 aa, Homo Sapiens
QFSGKLLQT

SEQ ID NO: 452254 - protein, 9 aa, Homo Sapiens
ARQTKRIQK

SEQ ID NO: 452255 - protein, 9 aa, Homo Sapiens
SNNYEELLR

SEQ ID NO: 452256 - protein, 9 aa, Homo Sapiens
LKARQAQVK

SEQ ID NO: 452257 - protein, 9 aa, Homo Sapiens
YEMYSDFAL

SEQ ID NO: 452258 - protein, 9 aa, Homo Sapiens
PKVRILCLK

SEQ ID NO: 452259 - protein, 9 aa, Homo Sapiens
SHITFHMNP

SEQ ID NO: 452260 - protein, 9 aa, Homo Sapiens
LQDDKNQSI

SEQ ID NO: 452261 - protein, 9 aa, Homo Sapiens
DNVKYYFEC

SEQ ID NO: 452262 - protein, 9 aa, Homo Sapiens
IVHTGEKPF

SEQ ID NO: 452263 - protein, 9 aa, Homo Sapiens
NWLCFPDQG

SEQ ID NO: 452264 - protein, 9 aa, Homo Sapiens
TKNLHYKYG

SEQ ID NO: 452265 - protein, 9 aa, Homo Sapiens
VSMAFSTYG

SEQ ID NO: 452266 - protein, 9 aa, Homo Sapiens
IRQSRLCAD

SEQ ID NO: 452267 - protein, 9 aa, Homo Sapiens
NNFIRAFRT

SEQ ID NO: 452268 - protein, 9 aa, Homo Sapiens
LTFLSAPVT

SEQ ID NO: 452269 - protein, 9 aa, Homo Sapiens
STRDRVWLL

SEQ ID NO: 452270 - protein, 9 aa, Homo Sapiens
PIQALQYAT

SEQ ID NO: 452271 - protein, 9 aa, Homo Sapiens
QSSLVLIGY

SEQ ID NO: 452272 - protein, 9 aa, Homo Sapiens
LAKIRRKYM

SEQ ID NO: 452273 - protein, 9 aa, Homo Sapiens
LMTHKLKHT

SEQ ID NO: 452274 - protein, 9 aa, Homo Sapiens
TVCMAAIKE

SEQ ID NO: 452275 - protein, 9 aa, Homo Sapiens
TWLSVDIDS

SEQ ID NO: 452276 - protein, 9 aa, Homo Sapiens
GEELEDTND

SEQ ID NO: 452277 - protein, 9 aa, Homo Sapiens
NPKIMLLDM

SEQ ID NO: 452278 - protein, 9 aa, Homo Sapiens
IPKYEIACE

SEQ ID NO: 452279 - protein, 9 aa, Homo Sapiens
RDVTLRVAG

SEQ ID NO: 452280 - protein, 9 aa, Homo Sapiens
CIALMLGGC

SEQ ID NO: 452281 - protein, 9 aa, Homo Sapiens
KAVAMMFFS

SEQ ID NO: 452282 - protein, 9 aa, Homo Sapiens
ETNQHDSNN

SEQ ID NO: 452283 - protein, 9 aa, Homo Sapiens
NASFLTSPT

SEQ ID NO: 452284 - protein, 9 aa, Homo Sapiens
AHTEKQKEC

SEQ ID NO: 452285 - protein, 9 aa, Homo Sapiens
SSLQKHVKT

SEQ ID NO: 452286 - protein, 9 aa, Homo Sapiens
QRYINSKVV

SEQ ID NO: 452287 - protein, 9 aa, Homo Sapiens
LKYSSKFIK

SEQ ID NO: 452288 - protein, 9 aa, Homo Sapiens
QRIPPEMSN

SEQ ID NO: 452289 - protein, 9 aa, Homo Sapiens
CLDMQPYMY

SEQ ID NO: 452290 - protein, 9 aa, Homo Sapiens
THLKDTTQS

SEQ ID NO: 452291 - protein, 9 aa, Homo Sapiens
LFLKYIFDF

SEQ ID NO: 452292 - protein, 9 aa, Homo Sapiens
VGFFLGASI

SEQ ID NO: 452293 - protein, 9 aa, Homo Sapiens
VCQLHMEFL

SEQ ID NO: 452294 - protein, 9 aa, Homo Sapiens
YLGLEDVLI

SEQ ID NO: 452295 - protein, 9 aa, Homo Sapiens
DLQRLGELH

SEQ ID NO: 452296 - protein, 9 aa, Homo Sapiens
TLESALITL

SEQ ID NO: 452297 - protein, 9 aa, Homo Sapiens
SPTSIQTGY

SEQ ID NO: 452298 - protein, 9 aa, Homo Sapiens
AHMELFLFL

SEQ ID NO: 452299 - protein, 9 aa, Homo Sapiens
GDAKWQLEI

SEQ ID NO: 452300 - protein, 9 aa, Homo Sapiens
HCMFTMLQE

SEQ ID NO: 452301 - protein, 9 aa, Homo Sapiens
KIEIGTIFT

SEQ ID NO: 452302 - protein, 9 aa, Homo Sapiens
FRTSSNDRR

SEQ ID NO: 452303 - protein, 9 aa, Homo Sapiens
YRKARNRIL

SEQ ID NO: 452304 - protein, 9 aa, Homo Sapiens
NQHLRQRRM

SEQ ID NO: 452305 - protein, 9 aa, Homo Sapiens
TRLFVPPNI

SEQ ID NO: 452306 - protein, 9 aa, Homo Sapiens
KDVASLSVK

SEQ ID NO: 452307 - protein, 9 aa, Homo Sapiens
VANVFLVAP

SEQ ID NO: 452308 - protein, 9 aa, Homo Sapiens
ATSVSVSDI

SEQ ID NO: 452309 - protein, 9 aa, Homo Sapiens
YSYVKDLFL

SEQ ID NO: 452310 - protein, 9 aa, Homo Sapiens
WIIFRNAIG

SEQ ID NO: 452311 - protein, 9 aa, Homo Sapiens
VETNNLEQI

SEQ ID NO: 452312 - protein, 9 aa, Homo Sapiens
GSALVLEER

SEQ ID NO: 452313 - protein, 9 aa, Homo Sapiens
TSSDIEVEA

SEQ ID NO: 452314 - protein, 9 aa, Homo Sapiens
YRERMSSNQ

SEQ ID NO: 452315 - protein, 9 aa, Homo Sapiens
TDVVEATSL

SEQ ID NO: 452316 - protein, 9 aa, Homo Sapiens
KPPCRSRSE

SEQ ID NO: 452317 - protein, 9 aa, Homo Sapiens
PPKGTYGKV

SEQ ID NO: 452318 - protein, 9 aa, Homo Sapiens
QRPADLALA

SEQ ID NO: 452319 - protein, 9 aa, Homo Sapiens
SQRGELARI

SEQ ID NO: 452320 - protein, 9 aa, Homo Sapiens
HLEGRNEMA

SEQ ID NO: 452321 - protein, 9 aa, Homo Sapiens
DTETSPTKY

SEQ ID NO: 452322 - protein, 9 aa, Homo Sapiens
YHPHPKDIK

SEQ ID NO: 452323 - protein, 9 aa, Homo Sapiens
YTSVFKDVM

SEQ ID NO: 452324 - protein, 9 aa, Homo Sapiens
KLLGAYYHN

SEQ ID NO: 452325 - protein, 9 aa, Homo Sapiens
LLEIESITD

SEQ ID NO: 452326 - protein, 9 aa, Homo Sapiens
GKLLQNWLC

SEQ ID NO: 452327 - protein, 9 aa, Homo Sapiens
VNKGKIAKN

SEQ ID NO: 452328 - protein, 9 aa, Homo Sapiens
TKDNLDPEK

SEQ ID NO: 452329 - protein, 9 aa, Homo Sapiens
IREATSEIK

SEQ ID NO: 452330 - protein, 9 aa, Homo Sapiens
YRNVMEQFD

SEQ ID NO: 452331 - protein, 9 aa, Homo Sapiens
KKQPLPSQR

SEQ ID NO: 452332 - protein, 9 aa, Homo Sapiens
HWLGAAPSL

SEQ ID NO: 452333 - protein, 9 aa, Homo Sapiens
KREKSNFQN

SEQ ID NO: 452334 - protein, 9 aa, Homo Sapiens
QHQIIHTEE

SEQ ID NO: 452335 - protein, 9 aa, Homo Sapiens
KDQQNTSCL

SEQ ID NO: 452336 - protein, 9 aa, Homo Sapiens
FFLANLSIA

SEQ ID NO: 452337 - protein, 9 aa, Homo Sapiens
IDHLELLNI

SEQ ID NO: 452338 - protein, 9 aa, Homo Sapiens
YVHVQQGPQ

SEQ ID NO: 452339 - protein, 9 aa, Homo Sapiens
TKNAKKDAK

SEQ ID NO: 452340 - protein, 9 aa, Homo Sapiens
VDELFTSLW

SEQ ID NO: 452341 - protein, 9 aa, Homo Sapiens
AAIQNKLFQ

SEQ ID NO: 452342 - protein, 9 aa, Homo Sapiens
KICYQLRMS

SEQ ID NO: 452343 - protein, 9 aa, Homo Sapiens
MAYDRYLSI

SEQ ID NO: 452344 - protein, 9 aa, Homo Sapiens
IVSSFAFGP

SEQ ID NO: 452345 - protein, 9 aa, Homo Sapiens
EKHIIKLTV

SEQ ID NO: 452346 - protein, 9 aa, Homo Sapiens
LYTDGACRT

SEQ ID NO: 452347 - protein, 9 aa, Homo Sapiens
RVCFSDNAL

SEQ ID NO: 452348 - protein, 9 aa, Homo Sapiens
KDQIGVLGG

SEQ ID NO: 452349 - protein, 9 aa, Homo Sapiens
VLVKEANMK

SEQ ID NO: 452350 - protein, 9 aa, Homo Sapiens
PDWKGWSCS

SEQ ID NO: 452351 - protein, 9 aa, Homo Sapiens
TEKEAEERH

SEQ ID NO: 452352 - protein, 9 aa, Homo Sapiens
VRVGPPESE

SEQ ID NO: 452353 - protein, 9 aa, Homo Sapiens
ETTLQDWGT

SEQ ID NO: 452354 - protein, 9 aa, Homo Sapiens
DTIKELQDL

SEQ ID NO: 452355 - protein, 9 aa, Homo Sapiens
GRARMDKDG

SEQ ID NO: 452356 - protein, 9 aa, Homo Sapiens
LVTDNFCLL

SEQ ID NO: 452357 - protein, 9 aa, Homo Sapiens
SESECLIHK

SEQ ID NO: 452358 - protein, 9 aa, Homo Sapiens
ALQKNFLLQ

SEQ ID NO: 452359 - protein, 9 aa, Homo Sapiens
THMVRKWHL

SEQ ID NO: 452360 - protein, 9 aa, Homo Sapiens
QVKPYSYVE

SEQ ID NO: 452361 - protein, 9 aa, Homo Sapiens
NMRKVCGPP

SEQ ID NO: 452362 - protein, 9 aa, Homo Sapiens
NTDDREKSR

SEQ ID NO: 452363 - protein, 9 aa, Homo Sapiens
LNTCKPKKK

SEQ ID NO: 452364 - protein, 9 aa, Homo Sapiens
RKAKPVKCI

SEQ ID NO: 452365 - protein, 9 aa, Homo Sapiens
TIGRKPPAF

SEQ ID NO: 452366 - protein, 9 aa, Homo Sapiens
IPNSGTVDW

SEQ ID NO: 452367 - protein, 9 aa, Homo Sapiens
NFCTEKEYP

SEQ ID NO: 452368 - protein, 9 aa, Homo Sapiens
QSYTQQLGR

SEQ ID NO: 452369 - protein, 9 aa, Homo Sapiens
VHTLDTLTS

SEQ ID NO: 452370 - protein, 9 aa, Homo Sapiens
IHKGEKPYG

SEQ ID NO: 452371 - protein, 9 aa, Homo Sapiens
IINEIGVFY

SEQ ID NO: 452372 - protein, 9 aa, Homo Sapiens
LVINFSLNL

SEQ ID NO: 452373 - protein, 9 aa, Homo Sapiens
QGAVVVTSA

SEQ ID NO: 452374 - protein, 9 aa, Homo Sapiens
KTIFTQKIF

SEQ ID NO: 452375 - protein, 9 aa, Homo Sapiens
HQTLFIGVH

SEQ ID NO: 452376 - protein, 9 aa, Homo Sapiens
KKANECYSG

SEQ ID NO: 452377 - protein, 9 aa, Homo Sapiens
KPKNTEPTT

SEQ ID NO: 452378 - protein, 9 aa, Homo Sapiens
GLVLGTFIL

SEQ ID NO: 452379 - protein, 9 aa, Homo Sapiens
GNWRGQVSA

SEQ ID NO: 452380 - protein, 9 aa, Homo Sapiens
NGNIFNSVL

SEQ ID NO: 452381 - protein, 9 aa, Homo Sapiens
EKKFAVALY

SEQ ID NO: 452382 - protein, 9 aa, Homo Sapiens
SDHFQIHTG

SEQ ID NO: 452383 - protein, 9 aa, Homo Sapiens
VNDSFRDLF

SEQ ID NO: 452384 - protein, 9 aa, Homo Sapiens
YLPIYSISS

SEQ ID NO: 452385 - protein, 9 aa, Homo Sapiens
PANLGYDGR

SEQ ID NO: 452386 - protein, 9 aa, Homo Sapiens
SYSPAGSKD

SEQ ID NO: 452387 - protein, 9 aa, Homo Sapiens
SYTSVFKDV

SEQ ID NO: 452388 - protein, 9 aa, Homo Sapiens
GNQMSVTQR

SEQ ID NO: 452389 - protein, 9 aa, Homo Sapiens
HLCGKSFNH

SEQ ID NO: 452390 - protein, 9 aa, Homo Sapiens
EQKKENQGK

SEQ ID NO: 452391 - protein, 9 aa, Homo Sapiens
DPSHSLLLL

SEQ ID NO: 452392 - protein, 9 aa, Homo Sapiens
MMRREYEEE

SEQ ID NO: 452393 - protein, 9 aa, Homo Sapiens
ALFYIHMLS

SEQ ID NO: 452394 - protein, 9 aa, Homo Sapiens
GIPFSQMIL

SEQ ID NO: 452395 - protein, 9 aa, Homo Sapiens
ICKNSSTYW

SEQ ID NO: 452396 - protein, 9 aa, Homo Sapiens
KSGNREITV

SEQ ID NO: 452397 - protein, 9 aa, Homo Sapiens
PCRSRSETN

SEQ ID NO: 452398 - protein, 9 aa, Homo Sapiens
CMTISICIN

SEQ ID NO: 452399 - protein, 9 aa, Homo Sapiens
LLTASIFGL

SEQ ID NO: 452400 - protein, 9 aa, Homo Sapiens
VYLNMATGM

SEQ ID NO: 452401 - protein, 9 aa, Homo Sapiens
EQWKKLWRE

SEQ ID NO: 452402 - protein, 9 aa, Homo Sapiens
TPLWAGCLS

SEQ ID NO: 452403 - protein, 9 aa, Homo Sapiens
LESKCKSRA

SEQ ID NO: 452404 - protein, 9 aa, Homo Sapiens
TKEGCHKKK

SEQ ID NO: 452405 - protein, 9 aa, Homo Sapiens
SLDFCYGNK

SEQ ID NO: 452406 - protein, 9 aa, Homo Sapiens
SMSCQEVIT

SEQ ID NO: 452407 - protein, 9 aa, Homo Sapiens
SQFSAKEEC

SEQ ID NO: 452408 - protein, 9 aa, Homo Sapiens
QTLHHERIM

SEQ ID NO: 452409 - protein, 9 aa, Homo Sapiens
HIEALHAKL

SEQ ID NO: 452410 - protein, 9 aa, Homo Sapiens
VNGFANNPL

SEQ ID NO: 452411 - protein, 9 aa, Homo Sapiens
TAEKSYTCE

SEQ ID NO: 452412 - protein, 9 aa, Homo Sapiens
LCINMEAKH

SEQ ID NO: 452413 - protein, 9 aa, Homo Sapiens
PQQCSGTPS

SEQ ID NO: 452414 - protein, 9 aa, Homo Sapiens
WAFHPCYLD

SEQ ID NO: 452415 - protein, 9 aa, Homo Sapiens
NGTGQSHNN

SEQ ID NO: 452416 - protein, 9 aa, Homo Sapiens
KSDLKHTSD

SEQ ID NO: 452417 - protein, 9 aa, Homo Sapiens
QGMRKGSAM

SEQ ID NO: 452418 - protein, 9 aa, Homo Sapiens
DKHIEKLTT

SEQ ID NO: 452419 - protein, 9 aa, Homo Sapiens
DETKTLLHD

SEQ ID NO: 452420 - protein, 9 aa, Homo Sapiens
KRSLNHLVD

SEQ ID NO: 452421 - protein, 9 aa, Homo Sapiens
FIFPAPDLP

SEQ ID NO: 452422 - protein, 9 aa, Homo Sapiens
PWWMYESTS

SEQ ID NO: 452423 - protein, 9 aa, Homo Sapiens
KSERYELIV

SEQ ID NO: 452424 - protein, 9 aa, Homo Sapiens
LWGSRSELR

SEQ ID NO: 452425 - protein, 9 aa, Homo Sapiens
TLRAKPPLE

SEQ ID NO: 452426 - protein, 9 aa, Homo Sapiens
KPLDLLGKK

SEQ ID NO: 452427 - protein, 9 aa, Homo Sapiens
HNMYHSQMR

SEQ ID NO: 452428 - protein, 9 aa, Homo Sapiens
YRDIVNINI

SEQ ID NO: 452429 - protein, 9 aa, Homo Sapiens
WISKPQEEN

SEQ ID NO: 452430 - protein, 9 aa, Homo Sapiens
CGEVNNPYL

SEQ ID NO: 452431 - protein, 9 aa, Homo Sapiens
CPFLIYPSS

SEQ ID NO: 452432 - protein, 9 aa, Homo Sapiens
RAHLLLIIK

SEQ ID NO: 452433 - protein, 9 aa, Homo Sapiens
LRQEKWSSG

SEQ ID NO: 452434 - protein, 9 aa, Homo Sapiens
QKLKAILKP

SEQ ID NO: 452435 - protein, 9 aa, Homo Sapiens
LANLLLNCF

SEQ ID NO: 452436 - protein, 9 aa, Homo Sapiens
EALKKAKGC

SEQ ID NO: 452437 - protein, 9 aa, Homo Sapiens
LNTKERQSK

SEQ ID NO: 452438 - protein, 9 aa, Homo Sapiens
LKVILSACK

SEQ ID NO: 452439 - protein, 9 aa, Homo Sapiens
VQQPHAELS

SEQ ID NO: 452440 - protein, 9 aa, Homo Sapiens
GKNVPKYQC

SEQ ID NO: 452441 - protein, 9 aa, Homo Sapiens
DDEFRNNFD

SEQ ID NO: 452442 - protein, 9 aa, Homo Sapiens
QYNEQEETP

SEQ ID NO: 452443 - protein, 9 aa, Homo Sapiens
FHDKNATKP

SEQ ID NO: 452444 - protein, 9 aa, Homo Sapiens
IYKFMALVY

SEQ ID NO: 452445 - protein, 9 aa, Homo Sapiens
IRICRPCEI

SEQ ID NO: 452446 - protein, 9 aa, Homo Sapiens
AYRSHELYK

SEQ ID NO: 452447 - protein, 9 aa, Homo Sapiens
IIMSLAILS

SEQ ID NO: 452448 - protein, 9 aa, Homo Sapiens
LGGVSWDIT

SEQ ID NO: 452449 - protein, 9 aa, Homo Sapiens
KLNLLTECI

SEQ ID NO: 452450 - protein, 9 aa, Homo Sapiens
CGARVRKNY

SEQ ID NO: 452451 - protein, 9 aa, Homo Sapiens
DYYRQGHIA

SEQ ID NO: 452452 - protein, 9 aa, Homo Sapiens
GSELIPKAL

SEQ ID NO: 452453 - protein, 9 aa, Homo Sapiens
RFEGINIDF

SEQ ID NO: 452454 - protein, 9 aa, Homo Sapiens
ADMVNKDLL

SEQ ID NO: 452455 - protein, 9 aa, Homo Sapiens
YHLQLYKKL

SEQ ID NO: 452456 - protein, 9 aa, Homo Sapiens
MDEALKICN

SEQ ID NO: 452457 - protein, 9 aa, Homo Sapiens
GMIFLSDGL

SEQ ID NO: 452458 - protein, 9 aa, Homo Sapiens
EACTDNPNW

SEQ ID NO: 452459 - protein, 9 aa, Homo Sapiens
KLKTQHMNN

SEQ ID NO: 452460 - protein, 9 aa, Homo Sapiens
MFRFPMDSH

SEQ ID NO: 452461 - protein, 9 aa, Homo Sapiens
ESIYYTLSV

SEQ ID NO: 452462 - protein, 9 aa, Homo Sapiens
TLKKLAEFL

SEQ ID NO: 452463 - protein, 9 aa, Homo Sapiens
KALSPPERE

SEQ ID NO: 452464 - protein, 9 aa, Homo Sapiens
NEYFFNRNR

SEQ ID NO: 452465 - protein, 9 aa, Homo Sapiens
RSENECLEG

SEQ ID NO: 452466 - protein, 9 aa, Homo Sapiens
FDHKRLQYY

SEQ ID NO: 452467 - protein, 9 aa, Homo Sapiens
AYSKVVMFV

SEQ ID NO: 452468 - protein, 9 aa, Homo Sapiens
LLKNPHPYV

SEQ ID NO: 452469 - protein, 9 aa, Homo Sapiens
EIAEEEELM

SEQ ID NO: 452470 - protein, 9 aa, Homo Sapiens
NTPKGNWRG

SEQ ID NO: 452471 - protein, 9 aa, Homo Sapiens
SKRGRPPSI

SEQ ID NO: 452472 - protein, 9 aa, Homo Sapiens
PRPCMSINF

SEQ ID NO: 452473 - protein, 9 aa, Homo Sapiens
LKRYSVNVA

SEQ ID NO: 452474 - protein, 9 aa, Homo Sapiens
LVQQIQILL

SEQ ID NO: 452475 - protein, 9 aa, Homo Sapiens
QWPALVSSI

SEQ ID NO: 452476 - protein, 9 aa, Homo Sapiens
LWICPQGYT

SEQ ID NO: 452477 - protein, 9 aa, Homo Sapiens
HLYDSKTIR

SEQ ID NO: 452478 - protein, 9 aa, Homo Sapiens
YVIHNSNTM

SEQ ID NO: 452479 - protein, 9 aa, Homo Sapiens
PGTTQRVPV

SEQ ID NO: 452480 - protein, 9 aa, Homo Sapiens
FSLYFGLRF

SEQ ID NO: 452481 - protein, 9 aa, Homo Sapiens
TDRNPFETD

SEQ ID NO: 452482 - protein, 9 aa, Homo Sapiens
ERVRFQVDH

SEQ ID NO: 452483 - protein, 9 aa, Homo Sapiens
PTLSDDWQL

SEQ ID NO: 452484 - protein, 9 aa, Homo Sapiens
TVGKRKQNE

SEQ ID NO: 452485 - protein, 9 aa, Homo Sapiens
VTIFYTLRY

SEQ ID NO: 452486 - protein, 9 aa, Homo Sapiens
CGRHKKYAP

SEQ ID NO: 452487 - protein, 9 aa, Homo Sapiens
LGASILAND

SEQ ID NO: 452488 - protein, 9 aa, Homo Sapiens
ALMDMEEYI

SEQ ID NO: 452489 - protein, 9 aa, Homo Sapiens
IIVIIYFDS

SEQ ID NO: 452490 - protein, 9 aa, Homo Sapiens
KMISHATEE

SEQ ID NO: 452491 - protein, 9 aa, Homo Sapiens
KDLTDKIVE

SEQ ID NO: 452492 - protein, 9 aa, Homo Sapiens
EFDKEKAWK

SEQ ID NO: 452493 - protein, 9 aa, Homo Sapiens
LICRCNIEY

SEQ ID NO: 452494 - protein, 9 aa, Homo Sapiens
CLKERHGLI

SEQ ID NO: 452495 - protein, 9 aa, Homo Sapiens
VNSLLVLVV

SEQ ID NO: 452496 - protein, 9 aa, Homo Sapiens
DPDLIGPKG

SEQ ID NO: 452497 - protein, 9 aa, Homo Sapiens
LPKNFHSPM

SEQ ID NO: 452498 - protein, 9 aa, Homo Sapiens
NLHYKYGFD

SEQ ID NO: 452499 - protein, 9 aa, Homo Sapiens
PPHSQHVSL

SEQ ID NO: 452500 - protein, 9 aa, Homo Sapiens
LLCEGLWHP

SEQ ID NO: 452501 - protein, 9 aa, Homo Sapiens
AKNYVSLMK

SEQ ID NO: 452502 - protein, 9 aa, Homo Sapiens
SVHKGVEHV

SEQ ID NO: 452503 - protein, 9 aa, Homo Sapiens
TSVSGLGTT

SEQ ID NO: 452504 - protein, 9 aa, Homo Sapiens
SAHVNRGPA

SEQ ID NO: 452505 - protein, 9 aa, Homo Sapiens
STIPTNLER

SEQ ID NO: 452506 - protein, 9 aa, Homo Sapiens
SFTQNNILL

SEQ ID NO: 452507 - protein, 9 aa, Homo Sapiens
PKGHETTTG

SEQ ID NO: 452508 - protein, 9 aa, Homo Sapiens
TGFVYGGNC

SEQ ID NO: 452509 - protein, 9 aa, Homo Sapiens
CQSKVSYLQ

SEQ ID NO: 452510 - protein, 9 aa, Homo Sapiens
CRYMAGVIR

SEQ ID NO: 452511 - protein, 9 aa, Homo Sapiens
PKVLFLTRH

SEQ ID NO: 452512 - protein, 9 aa, Homo Sapiens
FGYSMFLCM

SEQ ID NO: 452513 - protein, 9 aa, Homo Sapiens
GGGPPKYFV

SEQ ID NO: 452514 - protein, 9 aa, Homo Sapiens
VLAASQPEG

SEQ ID NO: 452515 - protein, 9 aa, Homo Sapiens
QLYRLWLSL

SEQ ID NO: 452516 - protein, 9 aa, Homo Sapiens
VECMMKDVF

SEQ ID NO: 452517 - protein, 9 aa, Homo Sapiens
RKAPLTDIE

SEQ ID NO: 452518 - protein, 9 aa, Homo Sapiens
SKKASDKLL

SEQ ID NO: 452519 - protein, 9 aa, Homo Sapiens
LFFDHCMFT

SEQ ID NO: 452520 - protein, 9 aa, Homo Sapiens
TQLRQLKAF

SEQ ID NO: 452521 - protein, 9 aa, Homo Sapiens
HNELFRANS

SEQ ID NO: 452522 - protein, 9 aa, Homo Sapiens
NNITGKWLL

SEQ ID NO: 452523 - protein, 9 aa, Homo Sapiens
VYNHTLSIM

SEQ ID NO: 452524 - protein, 9 aa, Homo Sapiens
PQIKKDEKQ

SEQ ID NO: 452525 - protein, 9 aa, Homo Sapiens
HLWKANASE

SEQ ID NO: 452526 - protein, 9 aa, Homo Sapiens
WWMYESTSF

SEQ ID NO: 452527 - protein, 9 aa, Homo Sapiens
FHRSHRLLG

SEQ ID NO: 452528 - protein, 9 aa, Homo Sapiens
DTIQYVVQA

SEQ ID NO: 452529 - protein, 9 aa, Homo Sapiens
TVKCYNPHT

SEQ ID NO: 452530 - protein, 9 aa, Homo Sapiens
QKLTRQLLS

SEQ ID NO: 452531 - protein, 9 aa, Homo Sapiens
DFFVFWETS

SEQ ID NO: 452532 - protein, 9 aa, Homo Sapiens
VKNKIQSMD

SEQ ID NO: 452533 - protein, 9 aa, Homo Sapiens
NTYKVLDFL

SEQ ID NO: 452534 - protein, 9 aa, Homo Sapiens
ENSLHTYLL

SEQ ID NO: 452535 - protein, 9 aa, Homo Sapiens
YAKYGLPGI

SEQ ID NO: 452536 - protein, 9 aa, Homo Sapiens
LEVDGPAMN

SEQ ID NO: 452537 - protein, 9 aa, Homo Sapiens
FGHIFTHIS

SEQ ID NO: 452538 - protein, 9 aa, Homo Sapiens
CGNQNETPS

SEQ ID NO: 452539 - protein, 9 aa, Homo Sapiens
HGITLLPQL

SEQ ID NO: 452540 - protein, 9 aa, Homo Sapiens
SSTLAKHKI

SEQ ID NO: 452541 - protein, 9 aa, Homo Sapiens
ILENYHDHG

SEQ ID NO: 452542 - protein, 9 aa, Homo Sapiens
SDIMNRKPH

SEQ ID NO: 452543 - protein, 9 aa, Homo Sapiens
EHVSKKHFK

SEQ ID NO: 452544 - protein, 9 aa, Homo Sapiens
KKLWQIKSE

SEQ ID NO: 452545 - protein, 9 aa, Homo Sapiens
GQGCCVNGQ

SEQ ID NO: 452546 - protein, 9 aa, Homo Sapiens
PLQLEILNA

SEQ ID NO: 452547 - protein, 9 aa, Homo Sapiens
EVYRAMNQL

SEQ ID NO: 452548 - protein, 9 aa, Homo Sapiens
VRVHLTGWL

SEQ ID NO: 452549 - protein, 9 aa, Homo Sapiens
GYLVSITKS

SEQ ID NO: 452550 - protein, 9 aa, Homo Sapiens
KITTANVVY

SEQ ID NO: 452551 - protein, 9 aa, Homo Sapiens
INFSLNLTF

SEQ ID NO: 452552 - protein, 9 aa, Homo Sapiens
KKGCWCQLL

SEQ ID NO: 452553 - protein, 9 aa, Homo Sapiens
LPGIRGTIP

SEQ ID NO: 452554 - protein, 9 aa, Homo Sapiens
PDSKSKKRP

SEQ ID NO: 452555 - protein, 9 aa, Homo Sapiens
TKLNFGMLR

SEQ ID NO: 452556 - protein, 9 aa, Homo Sapiens
LFTDRATRY

SEQ ID NO: 452557 - protein, 9 aa, Homo Sapiens
KYQKTAEET

SEQ ID NO: 452558 - protein, 9 aa, Homo Sapiens
YKLFSELEF

SEQ ID NO: 452559 - protein, 9 aa, Homo Sapiens
EDMHWDLVT

SEQ ID NO: 452560 - protein, 9 aa, Homo Sapiens
TTQSGIFQY

SEQ ID NO: 452561 - protein, 9 aa, Homo Sapiens
NWLKKDRIV

SEQ ID NO: 452562 - protein, 9 aa, Homo Sapiens
NLAIDGADE

SEQ ID NO: 452563 - protein, 9 aa, Homo Sapiens
RWQCSLMSY

SEQ ID NO: 452564 - protein, 9 aa, Homo Sapiens
KFTIYNNML

SEQ ID NO: 452565 - protein, 9 aa, Homo Sapiens
LEHREVCDR

SEQ ID NO: 452566 - protein, 9 aa, Homo Sapiens
DKINADLVL

SEQ ID NO: 452567 - protein, 9 aa, Homo Sapiens
EQTLKGHTD

SEQ ID NO: 452568 - protein, 9 aa, Homo Sapiens
KDALVLHQM

SEQ ID NO: 452569 - protein, 9 aa, Homo Sapiens
EKDDLSCPY

SEQ ID NO: 452570 - protein, 9 aa, Homo Sapiens
NRYEMIRLL

SEQ ID NO: 452571 - protein, 9 aa, Homo Sapiens
NAHQPITQR

SEQ ID NO: 452572 - protein, 9 aa, Homo Sapiens
NSVCQVHAS

SEQ ID NO: 452573 - protein, 9 aa, Homo Sapiens
RLIQTKTVA

SEQ ID NO: 452574 - protein, 9 aa, Homo Sapiens
EEDDDAIHI

SEQ ID NO: 452575 - protein, 9 aa, Homo Sapiens
QIKKDEKQS

SEQ ID NO: 452576 - protein, 9 aa, Homo Sapiens
KAFIHSDQL

SEQ ID NO: 452577 - protein, 9 aa, Homo Sapiens
NFSGMLERN

SEQ ID NO: 452578 - protein, 9 aa, Homo Sapiens
LLLTNGGRQ

SEQ ID NO: 452579 - protein, 9 aa, Homo Sapiens
KNKKRKLKN

SEQ ID NO: 452580 - protein, 9 aa, Homo Sapiens
FSDAQELES

SEQ ID NO: 452581 - protein, 9 aa, Homo Sapiens
SLHMAAILD

SEQ ID NO: 452582 - protein, 9 aa, Homo Sapiens
TPLHKLCDV

SEQ ID NO: 452583 - protein, 9 aa, Homo Sapiens
LVRVGPPES

SEQ ID NO: 452584 - protein, 9 aa, Homo Sapiens
RCHVPAGLK

SEQ ID NO: 452585 - protein, 9 aa, Homo Sapiens
VPPCTGDGK

SEQ ID NO: 452586 - protein, 9 aa, Homo Sapiens
MDLVGGFRC

SEQ ID NO: 452587 - protein, 9 aa, Homo Sapiens
PLKSTFEDV

SEQ ID NO: 452588 - protein, 9 aa, Homo Sapiens
GFLLAVSFE

SEQ ID NO: 452589 - protein, 9 aa, Homo Sapiens
FPTFHAEVS

SEQ ID NO: 452590 - protein, 9 aa, Homo Sapiens
YSLKVWAHG

SEQ ID NO: 452591 - protein, 9 aa, Homo Sapiens
VALSSQKLE

SEQ ID NO: 452592 - protein, 9 aa, Homo Sapiens
SFFNRFSVA

SEQ ID NO: 452593 - protein, 9 aa, Homo Sapiens
DPAQIKLYR

SEQ ID NO: 452594 - protein, 9 aa, Homo Sapiens
CTFNFLPWT

SEQ ID NO: 452595 - protein, 9 aa, Homo Sapiens
NPVIRYKQR

SEQ ID NO: 452596 - protein, 9 aa, Homo Sapiens
IIEDIDEDT

SEQ ID NO: 452597 - protein, 9 aa, Homo Sapiens
ADSKKDATK

SEQ ID NO: 452598 - protein, 9 aa, Homo Sapiens
EDFSNDGSV

SEQ ID NO: 452599 - protein, 9 aa, Homo Sapiens
ECNGQITGA

SEQ ID NO: 452600 - protein, 9 aa, Homo Sapiens
DSKFSMQEP

SEQ ID NO: 452601 - protein, 9 aa, Homo Sapiens
QNDQSILSI

SEQ ID NO: 452602 - protein, 9 aa, Homo Sapiens
EKKDAYVFY

SEQ ID NO: 452603 - protein, 9 aa, Homo Sapiens
TNEEDYKNK

SEQ ID NO: 452604 - protein, 9 aa, Homo Sapiens
TLAADDFRT

SEQ ID NO: 452605 - protein, 9 aa, Homo Sapiens
IEEHRGSSK

SEQ ID NO: 452606 - protein, 9 aa, Homo Sapiens
KLKEGHKKM

SEQ ID NO: 452607 - protein, 9 aa, Homo Sapiens
EQTRIQEFK

SEQ ID NO: 452608 - protein, 9 aa, Homo Sapiens
AFHPCYLDW

SEQ ID NO: 452609 - protein, 9 aa, Homo Sapiens
ETSATTGQN

SEQ ID NO: 452610 - protein, 9 aa, Homo Sapiens
ELTWERVRF

SEQ ID NO: 452611 - protein, 9 aa, Homo Sapiens
IKDTWYQVY

SEQ ID NO: 452612 - protein, 9 aa, Homo Sapiens
NINNYKKDE

SEQ ID NO: 452613 - protein, 9 aa, Homo Sapiens
DIADICKSV

SEQ ID NO: 452614 - protein, 9 aa, Homo Sapiens
CWVGGFICY

SEQ ID NO: 452615 - protein, 9 aa, Homo Sapiens
LQNWLCFPD

SEQ ID NO: 452616 - protein, 9 aa, Homo Sapiens
LPVTTWQIS

SEQ ID NO: 452617 - protein, 9 aa, Homo Sapiens
VNNFLMFFS

SEQ ID NO: 452618 - protein, 9 aa, Homo Sapiens
LMKNNYLHN

SEQ ID NO: 452619 - protein, 9 aa, Homo Sapiens
YSFCCIFLF

SEQ ID NO: 452620 - protein, 9 aa, Homo Sapiens
LNDQLFPCD

SEQ ID NO: 452621 - protein, 9 aa, Homo Sapiens
YGYCSYKTS

SEQ ID NO: 452622 - protein, 9 aa, Homo Sapiens
VGYKQEGLN

SEQ ID NO: 452623 - protein, 9 aa, Homo Sapiens
QWSLCGGLE

SEQ ID NO: 452624 - protein, 9 aa, Homo Sapiens
VFTDKYANV

SEQ ID NO: 452625 - protein, 9 aa, Homo Sapiens
LGTNEDSLI

SEQ ID NO: 452626 - protein, 9 aa, Homo Sapiens
TTWQISAGS

SEQ ID NO: 452627 - protein, 9 aa, Homo Sapiens
NREITVIES

SEQ ID NO: 452628 - protein, 9 aa, Homo Sapiens
LVQVRHHWW

SEQ ID NO: 452629 - protein, 9 aa, Homo Sapiens
VHLYAQMYA

SEQ ID NO: 452630 - protein, 9 aa, Homo Sapiens
EKIAFYRLI

SEQ ID NO: 452631 - protein, 9 aa, Homo Sapiens
REKRWEHSR

SEQ ID NO: 452632 - protein, 9 aa, Homo Sapiens
KELQKSDKL

SEQ ID NO: 452633 - protein, 9 aa, Homo Sapiens
TTMAVYVSV

SEQ ID NO: 452634 - protein, 9 aa, Homo Sapiens
DLNLKLSKF

SEQ ID NO: 452635 - protein, 9 aa, Homo Sapiens
HTKTKHTYY

SEQ ID NO: 452636 - protein, 9 aa, Homo Sapiens
DEEEEEAEE

SEQ ID NO: 452637 - protein, 9 aa, Homo Sapiens
IADLSTLKV

SEQ ID NO: 452638 - protein, 9 aa, Homo Sapiens
IHSTAVKLS

SEQ ID NO: 452639 - protein, 9 aa, Homo Sapiens
VNYKGLRVL

SEQ ID NO: 452640 - protein, 9 aa, Homo Sapiens
KNVAPLKLW

SEQ ID NO: 452641 - protein, 9 aa, Homo Sapiens
SQQPNKVIY

SEQ ID NO: 452642 - protein, 9 aa, Homo Sapiens
NLREPKSKR

SEQ ID NO: 452643 - protein, 9 aa, Homo Sapiens
VTFQIEPTI

SEQ ID NO: 452644 - protein, 9 aa, Homo Sapiens
LLNAFFRGN

SEQ ID NO: 452645 - protein, 9 aa, Homo Sapiens
ETAECNGQI

SEQ ID NO: 452646 - protein, 9 aa, Homo Sapiens
LREVCLAKE

SEQ ID NO: 452647 - protein, 9 aa, Homo Sapiens
LLSGEVSGR

SEQ ID NO: 452648 - protein, 9 aa, Homo Sapiens
NNTKEMKKK

SEQ ID NO: 452649 - protein, 9 aa, Homo Sapiens
AVMSCAVAC

SEQ ID NO: 452650 - protein, 9 aa, Homo Sapiens
APGVNKSPM

SEQ ID NO: 452651 - protein, 9 aa, Homo Sapiens
SAIAIAVHS

SEQ ID NO: 452652 - protein, 9 aa, Homo Sapiens
SDLKHTSDN

SEQ ID NO: 452653 - protein, 9 aa, Homo Sapiens
SFLKKVHKE

SEQ ID NO: 452654 - protein, 9 aa, Homo Sapiens
MKKWEGMAN

SEQ ID NO: 452655 - protein, 9 aa, Homo Sapiens
AICNLLQYQ

SEQ ID NO: 452656 - protein, 9 aa, Homo Sapiens
EQIVRALSA

SEQ ID NO: 452657 - protein, 9 aa, Homo Sapiens
DPENWDRTL

SEQ ID NO: 452658 - protein, 9 aa, Homo Sapiens
SVFKDVMGK

SEQ ID NO: 452659 - protein, 9 aa, Homo Sapiens
SPSPSPDSK

SEQ ID NO: 452660 - protein, 9 aa, Homo Sapiens
LAEQACAHV

SEQ ID NO: 452661 - protein, 9 aa, Homo Sapiens
VTIPRAYHS

SEQ ID NO: 452662 - protein, 9 aa, Homo Sapiens
CGKVFSHNS

SEQ ID NO: 452663 - protein, 9 aa, Homo Sapiens
DLYGGDKFA

SEQ ID NO: 452664 - protein, 9 aa, Homo Sapiens
AVVENSVKV

SEQ ID NO: 452665 - protein, 9 aa, Homo Sapiens
RGRRRDSDY

SEQ ID NO: 452666 - protein, 9 aa, Homo Sapiens
CSHDCPCHH

SEQ ID NO: 452667 - protein, 9 aa, Homo Sapiens
VTHPIYKAM

SEQ ID NO: 452668 - protein, 9 aa, Homo Sapiens
FPPTHVAEV

SEQ ID NO: 452669 - protein, 9 aa, Homo Sapiens
IVLLSGANE

SEQ ID NO: 452670 - protein, 9 aa, Homo Sapiens
QLQAGAGYI

SEQ ID NO: 452671 - protein, 9 aa, Homo Sapiens
ETGNNLQEA

SEQ ID NO: 452672 - protein, 9 aa, Homo Sapiens
ESKNEDRKK

SEQ ID NO: 452673 - protein, 9 aa, Homo Sapiens
HIRLKPYKC

SEQ ID NO: 452674 - protein, 9 aa, Homo Sapiens
QKVVTEMGT

SEQ ID NO: 452675 - protein, 9 aa, Homo Sapiens
RRFLVGILN

SEQ ID NO: 452676 - protein, 9 aa, Homo Sapiens
APLTDIENY

SEQ ID NO: 452677 - protein, 9 aa, Homo Sapiens
VGDKSPSAS

SEQ ID NO: 452678 - protein, 9 aa, Homo Sapiens
GPGRQLTVH

SEQ ID NO: 452679 - protein, 9 aa, Homo Sapiens
ALRPPRDTP

SEQ ID NO: 452680 - protein, 9 aa, Homo Sapiens
TRMCTIIMS

SEQ ID NO: 452681 - protein, 9 aa, Homo Sapiens
LRLQTKTIQ

SEQ ID NO: 452682 - protein, 9 aa, Homo Sapiens
ETVQVLQIK

SEQ ID NO: 452683 - protein, 9 aa, Homo Sapiens
LGIGRHALD

SEQ ID NO: 452684 - protein, 9 aa, Homo Sapiens
QLSPAEYFV

SEQ ID NO: 452685 - protein, 9 aa, Homo Sapiens
RDTYMFATK

SEQ ID NO: 452686 - protein, 9 aa, Homo Sapiens
WNLVWKTSS

SEQ ID NO: 452687 - protein, 9 aa, Homo Sapiens
LVLHCIANV

SEQ ID NO: 452688 - protein, 9 aa, Homo Sapiens
AMLGTLLQE

SEQ ID NO: 452689 - protein, 9 aa, Homo Sapiens
YGGNCFNCG

SEQ ID NO: 452690 - protein, 9 aa, Homo Sapiens
AVLQRDEIS

SEQ ID NO: 452691 - protein, 9 aa, Homo Sapiens
DEVKKVKVE

SEQ ID NO: 452692 - protein, 9 aa, Homo Sapiens
IVMPRSYVN

SEQ ID NO: 452693 - protein, 9 aa, Homo Sapiens
YGTCQPTQF

SEQ ID NO: 452694 - protein, 9 aa, Homo Sapiens
VIQCLNISV

SEQ ID NO: 452695 - protein, 9 aa, Homo Sapiens
VRKLEFIFL

SEQ ID NO: 452696 - protein, 9 aa, Homo Sapiens
SPGHCLPKS

SEQ ID NO: 452697 - protein, 9 aa, Homo Sapiens
PDHTIQALG

SEQ ID NO: 452698 - protein, 9 aa, Homo Sapiens
KIIHTGEKT

SEQ ID NO: 452699 - protein, 9 aa, Homo Sapiens
LKIFLNDSA

SEQ ID NO: 452700 - protein, 9 aa, Homo Sapiens
AACRTYATS

SEQ ID NO: 452701 - protein, 9 aa, Homo Sapiens
REKSNFQNE

SEQ ID NO: 452702 - protein, 9 aa, Homo Sapiens
SDSSDLKTR

SEQ ID NO: 452703 - protein, 9 aa, Homo Sapiens
KKQSIGLIQ

SEQ ID NO: 452704 - protein, 9 aa, Homo Sapiens
EETVIYTKK

SEQ ID NO: 452705 - protein, 9 aa, Homo Sapiens
AWRFLIYIS

SEQ ID NO: 452706 - protein, 9 aa, Homo Sapiens
KIYEMYSDF

SEQ ID NO: 452707 - protein, 9 aa, Homo Sapiens
ASASTANTQ

SEQ ID NO: 452708 - protein, 9 aa, Homo Sapiens
ESASEGEDS

SEQ ID NO: 452709 - protein, 9 aa, Homo Sapiens
HMLCQRHRR

SEQ ID NO: 452710 - protein, 9 aa, Homo Sapiens
GKYMKERAL

SEQ ID NO: 452711 - protein, 9 aa, Homo Sapiens
HPDAVCQLH

SEQ ID NO: 452712 - protein, 9 aa, Homo Sapiens
GVERDQMDK

SEQ ID NO: 452713 - protein, 9 aa, Homo Sapiens
DFWDRADIY

SEQ ID NO: 452714 - protein, 9 aa, Homo Sapiens
PANMEELME

SEQ ID NO: 452715 - protein, 9 aa, Homo Sapiens
HKKKQSIGL

SEQ ID NO: 452716 - protein, 9 aa, Homo Sapiens
STHMVRKWH

SEQ ID NO: 452717 - protein, 9 aa, Homo Sapiens
RMSVPRTSN

SEQ ID NO: 452718 - protein, 9 aa, Homo Sapiens
IVPICINSC

SEQ ID NO: 452719 - protein, 9 aa, Homo Sapiens
EDFMRQQQT

SEQ ID NO: 452720 - protein, 9 aa, Homo Sapiens
NGNQIVDVN

SEQ ID NO: 452721 - protein, 9 aa, Homo Sapiens
YLNFTASDN

SEQ ID NO: 452722 - protein, 9 aa, Homo Sapiens
QSLGLWAWD

SEQ ID NO: 452723 - protein, 9 aa, Homo Sapiens
EIKEGSYSS

SEQ ID NO: 452724 - protein, 9 aa, Homo Sapiens
SIRKLISYR

SEQ ID NO: 452725 - protein, 9 aa, Homo Sapiens
GDFHRGYHL

SEQ ID NO: 452726 - protein, 9 aa, Homo Sapiens
IPEHILGKM

SEQ ID NO: 452727 - protein, 9 aa, Homo Sapiens
DFFYKFRLS

SEQ ID NO: 452728 - protein, 9 aa, Homo Sapiens
APNINRINE

SEQ ID NO: 452729 - protein, 9 aa, Homo Sapiens
SGSSDKRGS

SEQ ID NO: 452730 - protein, 9 aa, Homo Sapiens
LTHNGTPQN

SEQ ID NO: 452731 - protein, 9 aa, Homo Sapiens
CRVLGHTVR

SEQ ID NO: 452732 - protein, 9 aa, Homo Sapiens
QNATENCFS

SEQ ID NO: 452733 - protein, 9 aa, Homo Sapiens
HKYSSSPDD

SEQ ID NO: 452734 - protein, 9 aa, Homo Sapiens
LDQYYEQDD

SEQ ID NO: 452735 - protein, 9 aa, Homo Sapiens
QVVRAGLIA

SEQ ID NO: 452736 - protein, 9 aa, Homo Sapiens
DLHSTLLLN

SEQ ID NO: 452737 - protein, 9 aa, Homo Sapiens
DKQMCTNKY

SEQ ID NO: 452738 - protein, 9 aa, Homo Sapiens
DAHLAYGSR

SEQ ID NO: 452739 - protein, 9 aa, Homo Sapiens
CLLRLQVPP

SEQ ID NO: 452740 - protein, 9 aa, Homo Sapiens
EDKQQEGGI

SEQ ID NO: 452741 - protein, 9 aa, Homo Sapiens
LEVEDSTDL

SEQ ID NO: 452742 - protein, 9 aa, Homo Sapiens
EENADDNIT

SEQ ID NO: 452743 - protein, 9 aa, Homo Sapiens
HLTEACTDN

SEQ ID NO: 452744 - protein, 9 aa, Homo Sapiens
MQTAPIRNE

SEQ ID NO: 452745 - protein, 9 aa, Homo Sapiens
QFYQGLPWG

SEQ ID NO: 452746 - protein, 9 aa, Homo Sapiens
EMLYLIIMI

SEQ ID NO: 452747 - protein, 9 aa, Homo Sapiens
LNSSGSYWV

SEQ ID NO: 452748 - protein, 9 aa, Homo Sapiens
IALERPDFR

SEQ ID NO: 452749 - protein, 9 aa, Homo Sapiens
GYQLTQHQI

SEQ ID NO: 452750 - protein, 9 aa, Homo Sapiens
QKSDKLDEQ

SEQ ID NO: 452751 - protein, 9 aa, Homo Sapiens
FPQGMIFLS

SEQ ID NO: 452752 - protein, 9 aa, Homo Sapiens
ICFYINKIN

SEQ ID NO: 452753 - protein, 9 aa, Homo Sapiens
RPCGKQGSC

SEQ ID NO: 452754 - protein, 9 aa, Homo Sapiens
DTLLCNCTF

SEQ ID NO: 452755 - protein, 9 aa, Homo Sapiens
VINFEQAIK

SEQ ID NO: 452756 - protein, 9 aa, Homo Sapiens
QEWKFVGGS

SEQ ID NO: 452757 - protein, 9 aa, Homo Sapiens
HYNVARGVQ

SEQ ID NO: 452758 - protein, 9 aa, Homo Sapiens
TISEYISVD

SEQ ID NO: 452759 - protein, 9 aa, Homo Sapiens
MAYISKAQE

SEQ ID NO: 452760 - protein, 9 aa, Homo Sapiens
LRLPVFSLQ

SEQ ID NO: 452761 - protein, 9 aa, Homo Sapiens
DALFASQFL

SEQ ID NO: 452762 - protein, 9 aa, Homo Sapiens
IVGERFSPG

SEQ ID NO: 452763 - protein, 9 aa, Homo Sapiens
DVFQNLTHD

SEQ ID NO: 452764 - protein, 9 aa, Homo Sapiens
NPFSSSTNT

SEQ ID NO: 452765 - protein, 9 aa, Homo Sapiens
LGKFVKNID

SEQ ID NO: 452766 - protein, 9 aa, Homo Sapiens
LSELDNFSS

SEQ ID NO: 452767 - protein, 9 aa, Homo Sapiens
PQIVEMKKG

SEQ ID NO: 452768 - protein, 9 aa, Homo Sapiens
FEIERFEIV

SEQ ID NO: 452769 - protein, 9 aa, Homo Sapiens
VLLCGEVNN

SEQ ID NO: 452770 - protein, 9 aa, Homo Sapiens
LLRKFEFWA

SEQ ID NO: 452771 - protein, 9 aa, Homo Sapiens
EEYERAQKD

SEQ ID NO: 452772 - protein, 9 aa, Homo Sapiens
SNYINSSSV

SEQ ID NO: 452773 - protein, 9 aa, Homo Sapiens
LLPQLLGMY

SEQ ID NO: 452774 - protein, 9 aa, Homo Sapiens
PFSVGVALS

SEQ ID NO: 452775 - protein, 9 aa, Homo Sapiens
GDKSYECKE

SEQ ID NO: 452776 - protein, 9 aa, Homo Sapiens
LHFPIKPSL

SEQ ID NO: 452777 - protein, 9 aa, Homo Sapiens
HTLVFRLLK

SEQ ID NO: 452778 - protein, 9 aa, Homo Sapiens
YSENEAQKQ

SEQ ID NO: 452779 - protein, 9 aa, Homo Sapiens
ITFHMNPRF

SEQ ID NO: 452780 - protein, 9 aa, Homo Sapiens
ASSSSVTYP

SEQ ID NO: 452781 - protein, 9 aa, Homo Sapiens
HLIESGHLT

SEQ ID NO: 452782 - protein, 9 aa, Homo Sapiens
KGKPCAVGF

SEQ ID NO: 452783 - protein, 9 aa, Homo Sapiens
HHYRCVARV

SEQ ID NO: 452784 - protein, 9 aa, Homo Sapiens
KANLIKHQI

SEQ ID NO: 452785 - protein, 9 aa, Homo Sapiens
NSEFVGWRK

SEQ ID NO: 452786 - protein, 9 aa, Homo Sapiens
TEKKKQKNF

SEQ ID NO: 452787 - protein, 9 aa, Homo Sapiens
QLEILNAST

SEQ ID NO: 452788 - protein, 9 aa, Homo Sapiens
DSTDLFKSG

SEQ ID NO: 452789 - protein, 9 aa, Homo Sapiens
GGQEWKFVG

SEQ ID NO: 452790 - protein, 9 aa, Homo Sapiens
EINENILPS

SEQ ID NO: 452791 - protein, 9 aa, Homo Sapiens
DNNKMSAYN

SEQ ID NO: 452792 - protein, 9 aa, Homo Sapiens
LIKHKTIHT

SEQ ID NO: 452793 - protein, 9 aa, Homo Sapiens
GLLLGSVFL

SEQ ID NO: 452794 - protein, 9 aa, Homo Sapiens
QYLDGLLVF

SEQ ID NO: 452795 - protein, 9 aa, Homo Sapiens
MHYIIEDID

SEQ ID NO: 452796 - protein, 9 aa, Homo Sapiens
SDKDFMIVA

SEQ ID NO: 452797 - protein, 9 aa, Homo Sapiens
LSRNRSLGQ

SEQ ID NO: 452798 - protein, 9 aa, Homo Sapiens
DIPPHHPSS

SEQ ID NO: 452799 - protein, 9 aa, Homo Sapiens
NLKRPITHL

SEQ ID NO: 452800 - protein, 9 aa, Homo Sapiens
GTQICPAFF

SEQ ID NO: 452801 - protein, 9 aa, Homo Sapiens
GICGDKGEP

SEQ ID NO: 452802 - protein, 9 aa, Homo Sapiens
SDERIHLGS

SEQ ID NO: 452803 - protein, 9 aa, Homo Sapiens
QRNEIEREE

SEQ ID NO: 452804 - protein, 9 aa, Homo Sapiens
KMKYFQQCW

SEQ ID NO: 452805 - protein, 9 aa, Homo Sapiens
NVDKLEIIS

SEQ ID NO: 452806 - protein, 9 aa, Homo Sapiens
VRELSALVA

SEQ ID NO: 452807 - protein, 9 aa, Homo Sapiens
SLERERLLC

SEQ ID NO: 452808 - protein, 9 aa, Homo Sapiens
KQQRETRVQ

SEQ ID NO: 452809 - protein, 9 aa, Homo Sapiens
LSALVAIKE

SEQ ID NO: 452810 - protein, 9 aa, Homo Sapiens
LLNDELKTQ

SEQ ID NO: 452811 - protein, 9 aa, Homo Sapiens
LSSWCLLRE

SEQ ID NO: 452812 - protein, 9 aa, Homo Sapiens
HASTMALVF

SEQ ID NO: 452813 - protein, 9 aa, Homo Sapiens
YLIDTNLFG

SEQ ID NO: 452814 - protein, 9 aa, Homo Sapiens
DHKRLQYYF

SEQ ID NO: 452815 - protein, 9 aa, Homo Sapiens
VCSTQVSAV

SEQ ID NO: 452816 - protein, 9 aa, Homo Sapiens
RLIKDPSRG

SEQ ID NO: 452817 - protein, 9 aa, Homo Sapiens
SQNPRRPPP

SEQ ID NO: 452818 - protein, 9 aa, Homo Sapiens
RKQICILNK

SEQ ID NO: 452819 - protein, 9 aa, Homo Sapiens
SSLGFYVGQ

SEQ ID NO: 452820 - protein, 9 aa, Homo Sapiens
LCETVFQPS

SEQ ID NO: 452821 - protein, 9 aa, Homo Sapiens
QRCKALKEQ

SEQ ID NO: 452822 - protein, 9 aa, Homo Sapiens
QMHLNRDIW

SEQ ID NO: 452823 - protein, 9 aa, Homo Sapiens
YELVGVATD

SEQ ID NO: 452824 - protein, 9 aa, Homo Sapiens
NYTDNEVEK

SEQ ID NO: 452825 - protein, 9 aa, Homo Sapiens
DKGFYLDDS

SEQ ID NO: 452826 - protein, 9 aa, Homo Sapiens
KVKNKIQSM

SEQ ID NO: 452827 - protein, 9 aa, Homo Sapiens
EARAERVLE

SEQ ID NO: 452828 - protein, 9 aa, Homo Sapiens
PPCPTDPSH

SEQ ID NO: 452829 - protein, 9 aa, Homo Sapiens
IEYELQEYN

SEQ ID NO: 452830 - protein, 9 aa, Homo Sapiens
EEVYLLNIT

SEQ ID NO: 452831 - protein, 9 aa, Homo Sapiens
YVQCLAWVP

SEQ ID NO: 452832 - protein, 9 aa, Homo Sapiens
EGKWAMLGT

SEQ ID NO: 452833 - protein, 9 aa, Homo Sapiens
TTISVLSFI

SEQ ID NO: 452834 - protein, 9 aa, Homo Sapiens
VVSRESLLQ

SEQ ID NO: 452835 - protein, 9 aa, Homo Sapiens
DKRVQPLLC

SEQ ID NO: 452836 - protein, 9 aa, Homo Sapiens
TQRVEDQEN

SEQ ID NO: 452837 - protein, 9 aa, Homo Sapiens
ASTPCHSHT

SEQ ID NO: 452838 - protein, 9 aa, Homo Sapiens
LLEDIASGL

SEQ ID NO: 452839 - protein, 9 aa, Homo Sapiens
TNNLFIDYV

SEQ ID NO: 452840 - protein, 9 aa, Homo Sapiens
QRQNPSHAE

SEQ ID NO: 452841 - protein, 9 aa, Homo Sapiens
LRFLYITLS

SEQ ID NO: 452842 - protein, 9 aa, Homo Sapiens
NIRLNLGKK

SEQ ID NO: 452843 - protein, 9 aa, Homo Sapiens
EDTIQYVVQ

SEQ ID NO: 452844 - protein, 9 aa, Homo Sapiens
LYNPYGPQT

SEQ ID NO: 452845 - protein, 9 aa, Homo Sapiens
EKRKVELER

SEQ ID NO: 452846 - protein, 9 aa, Homo Sapiens
SKKRKMYDQ

SEQ ID NO: 452847 - protein, 9 aa, Homo Sapiens
TDNFCLLTD

SEQ ID NO: 452848 - protein, 9 aa, Homo Sapiens
YLCTSTSSG

SEQ ID NO: 452849 - protein, 9 aa, Homo Sapiens
ELLLQALNG

SEQ ID NO: 452850 - protein, 9 aa, Homo Sapiens
RDWKTFLFS

SEQ ID NO: 452851 - protein, 9 aa, Homo Sapiens
QSTMDESHI

SEQ ID NO: 452852 - protein, 9 aa, Homo Sapiens
KLDDEFIDM

SEQ ID NO: 452853 - protein, 9 aa, Homo Sapiens
AVEILPVSD

SEQ ID NO: 452854 - protein, 9 aa, Homo Sapiens
AQLEAQCQK

SEQ ID NO: 452855 - protein, 9 aa, Homo Sapiens
ICAVSGLLV

SEQ ID NO: 452856 - protein, 9 aa, Homo Sapiens
VTLPKNMSY

SEQ ID NO: 452857 - protein, 9 aa, Homo Sapiens
SQVVDDELA

SEQ ID NO: 452858 - protein, 9 aa, Homo Sapiens
NKINEENKL

SEQ ID NO: 452859 - protein, 9 aa, Homo Sapiens
LYGKYMKER

SEQ ID NO: 452860 - protein, 9 aa, Homo Sapiens
LCAILCCFL

SEQ ID NO: 452861 - protein, 9 aa, Homo Sapiens
GCWCQLLEG

SEQ ID NO: 452862 - protein, 9 aa, Homo Sapiens
VNVDKVANE

SEQ ID NO: 452863 - protein, 9 aa, Homo Sapiens
ELCVETLCR

SEQ ID NO: 452864 - protein, 9 aa, Homo Sapiens
QPHVCFHVN

SEQ ID NO: 452865 - protein, 9 aa, Homo Sapiens
LGSVQYTLS

SEQ ID NO: 452866 - protein, 9 aa, Homo Sapiens
GMTDFPNIF

SEQ ID NO: 452867 - protein, 9 aa, Homo Sapiens
NRLESMSPG

SEQ ID NO: 452868 - protein, 9 aa, Homo Sapiens
HKIIKEVLE

SEQ ID NO: 452869 - protein, 9 aa, Homo Sapiens
RELKNGNLE

SEQ ID NO: 452870 - protein, 9 aa, Homo Sapiens
QAPTKLVGA

SEQ ID NO: 452871 - protein, 9 aa, Homo Sapiens
VVLIIHLPF

SEQ ID NO: 452872 - protein, 9 aa, Homo Sapiens
IQHALAHEP

SEQ ID NO: 452873 - protein, 9 aa, Homo Sapiens
ESALITLDS

SEQ ID NO: 452874 - protein, 9 aa, Homo Sapiens
IYQPGGLHP

SEQ ID NO: 452875 - protein, 9 aa, Homo Sapiens
RITVCDEDK

SEQ ID NO: 452876 - protein, 9 aa, Homo Sapiens
PDEKISLIP

SEQ ID NO: 452877 - protein, 9 aa, Homo Sapiens
WLPRSGNTS

SEQ ID NO: 452878 - protein, 9 aa, Homo Sapiens
PEPSSITLF

SEQ ID NO: 452879 - protein, 9 aa, Homo Sapiens
HTLYTSYYT

SEQ ID NO: 452880 - protein, 9 aa, Homo Sapiens
LYDAVNSFI

SEQ ID NO: 452881 - protein, 9 aa, Homo Sapiens
ELFFDHCMF

SEQ ID NO: 452882 - protein, 9 aa, Homo Sapiens
PLQILRKRN

SEQ ID NO: 452883 - protein, 9 aa, Homo Sapiens
ASDQFNRIL

SEQ ID NO: 452884 - protein, 9 aa, Homo Sapiens
SQTAQLSTQ

SEQ ID NO: 452885 - protein, 9 aa, Homo Sapiens
IVYCGGVID

SEQ ID NO: 452886 - protein, 9 aa, Homo Sapiens
IESFLARAK

SEQ ID NO: 452887 - protein, 9 aa, Homo Sapiens
DVSPQKEPQ

SEQ ID NO: 452888 - protein, 9 aa, Homo Sapiens
GHTPRPALA

SEQ ID NO: 452889 - protein, 9 aa, Homo Sapiens
VLLGHYQEV

SEQ ID NO: 452890 - protein, 9 aa, Homo Sapiens
SGQSIKAEN

SEQ ID NO: 452891 - protein, 9 aa, Homo Sapiens
MQYYVQYRS

SEQ ID NO: 452892 - protein, 9 aa, Homo Sapiens
VIDEIQNGP

SEQ ID NO: 452893 - protein, 9 aa, Homo Sapiens
VMRKYDKSG

SEQ ID NO: 452894 - protein, 9 aa, Homo Sapiens
NIAVWDLHY

SEQ ID NO: 452895 - protein, 9 aa, Homo Sapiens
IQADLELEG

SEQ ID NO: 452896 - protein, 9 aa, Homo Sapiens
LILELIAYL

SEQ ID NO: 452897 - protein, 9 aa, Homo Sapiens
SVSHIIIEE

SEQ ID NO: 452898 - protein, 9 aa, Homo Sapiens
YLYIKFSMN

SEQ ID NO: 452899 - protein, 9 aa, Homo Sapiens
DIMNQVQST

SEQ ID NO: 452900 - protein, 9 aa, Homo Sapiens
LCYRDLHST

SEQ ID NO: 452901 - protein, 9 aa, Homo Sapiens
KAAVLSVCV

SEQ ID NO: 452902 - protein, 9 aa, Homo Sapiens
VKRACIKSL

SEQ ID NO: 452903 - protein, 9 aa, Homo Sapiens
SEYGIEGDA

SEQ ID NO: 452904 - protein, 9 aa, Homo Sapiens
VTMIVDCKN

SEQ ID NO: 452905 - protein, 9 aa, Homo Sapiens
RWKWVSQNR

SEQ ID NO: 452906 - protein, 9 aa, Homo Sapiens
GILTSTGCY

SEQ ID NO: 452907 - protein, 9 aa, Homo Sapiens
VRAMGKNPR

SEQ ID NO: 452908 - protein, 9 aa, Homo Sapiens
CRIVDWKGD

SEQ ID NO: 452909 - protein, 9 aa, Homo Sapiens
SFERTLGLA

SEQ ID NO: 452910 - protein, 9 aa, Homo Sapiens
LIVHQQTHT

SEQ ID NO: 452911 - protein, 9 aa, Homo Sapiens
YIHFRHLYK

SEQ ID NO: 452912 - protein, 9 aa, Homo Sapiens
PFVSVADLI

SEQ ID NO: 452913 - protein, 9 aa, Homo Sapiens
ICHKNSIKL

SEQ ID NO: 452914 - protein, 9 aa, Homo Sapiens
VVPMLNPQY

SEQ ID NO: 452915 - protein, 9 aa, Homo Sapiens
EYPITHRLY

SEQ ID NO: 452916 - protein, 9 aa, Homo Sapiens
FITSLFPDM

SEQ ID NO: 452917 - protein, 9 aa, Homo Sapiens
YGGVKYIIK

SEQ ID NO: 452918 - protein, 9 aa, Homo Sapiens
KLGKRLDRE

SEQ ID NO: 452919 - protein, 9 aa, Homo Sapiens
RRVRSGVMG

SEQ ID NO: 452920 - protein, 9 aa, Homo Sapiens
GAYYHNGKL

SEQ ID NO: 452921 - protein, 9 aa, Homo Sapiens
YYELVGVAT

SEQ ID NO: 452922 - protein, 9 aa, Homo Sapiens
DRSLKNIKR

SEQ ID NO: 452923 - protein, 9 aa, Homo Sapiens
AHSQQRQNP

SEQ ID NO: 452924 - protein, 9 aa, Homo Sapiens
VILIPITCT

SEQ ID NO: 452925 - protein, 9 aa, Homo Sapiens
GVNTLIENV

SEQ ID NO: 452926 - protein, 9 aa, Homo Sapiens
AGIIELSEK

SEQ ID NO: 452927 - protein, 9 aa, Homo Sapiens
SSDELFCRC

SEQ ID NO: 452928 - protein, 9 aa, Homo Sapiens
LLAERGDVQ

SEQ ID NO: 452929 - protein, 9 aa, Homo Sapiens
TKLQVLKQT

SEQ ID NO: 452930 - protein, 9 aa, Homo Sapiens
QTKSHVPLT

SEQ ID NO: 452931 - protein, 9 aa, Homo Sapiens
HFYLTALSL

SEQ ID NO: 452932 - protein, 9 aa, Homo Sapiens
ATYEAICKA

SEQ ID NO: 452933 - protein, 9 aa, Homo Sapiens
SSNFRRYKV

SEQ ID NO: 452934 - protein, 9 aa, Homo Sapiens
EIIYSLFTL

SEQ ID NO: 452935 - protein, 9 aa, Homo Sapiens
GLFFSAVDN

SEQ ID NO: 452936 - protein, 9 aa, Homo Sapiens
LMPIKEKPG

SEQ ID NO: 452937 - protein, 9 aa, Homo Sapiens
CVVQVTATD

SEQ ID NO: 452938 - protein, 9 aa, Homo Sapiens
LLLLAGPSG

SEQ ID NO: 452939 - protein, 9 aa, Homo Sapiens
KNVTNNLKY

SEQ ID NO: 452940 - protein, 9 aa, Homo Sapiens
AENEVVTLK

SEQ ID NO: 452941 - protein, 9 aa, Homo Sapiens
LYRLWLSLF

SEQ ID NO: 452942 - protein, 9 aa, Homo Sapiens
LTLIHHNTH

SEQ ID NO: 452943 - protein, 9 aa, Homo Sapiens
NGTFNLPEG

SEQ ID NO: 452944 - protein, 9 aa, Homo Sapiens
DFWGRVNNF

SEQ ID NO: 452945 - protein, 9 aa, Homo Sapiens
TKVTPDKKI

SEQ ID NO: 452946 - protein, 9 aa, Homo Sapiens
KQEPGLRIF

SEQ ID NO: 452947 - protein, 9 aa, Homo Sapiens
LTVTSAQNN

SEQ ID NO: 452948 - protein, 9 aa, Homo Sapiens
LYMFWTMII

SEQ ID NO: 452949 - protein, 9 aa, Homo Sapiens
CWGIDYHSR

SEQ ID NO: 452950 - protein, 9 aa, Homo Sapiens
ERTHKIKKL

SEQ ID NO: 452951 - protein, 9 aa, Homo Sapiens
PLHYYETVC

SEQ ID NO: 452952 - protein, 9 aa, Homo Sapiens
SMLTDPENV

SEQ ID NO: 452953 - protein, 9 aa, Homo Sapiens
AQLPIYQRK

SEQ ID NO: 452954 - protein, 9 aa, Homo Sapiens
INKSIVKYS

SEQ ID NO: 452955 - protein, 9 aa, Homo Sapiens
VSYLIDTNL

SEQ ID NO: 452956 - protein, 9 aa, Homo Sapiens
NLLASCSDY

SEQ ID NO: 452957 - protein, 9 aa, Homo Sapiens
NYSKLRSSG

SEQ ID NO: 452958 - protein, 9 aa, Homo Sapiens
FHTIRELYL

SEQ ID NO: 452959 - protein, 9 aa, Homo Sapiens
WNKVSSGSA

SEQ ID NO: 452960 - protein, 9 aa, Homo Sapiens
LRGAGSITG

SEQ ID NO: 452961 - protein, 9 aa, Homo Sapiens
IARICINGE

SEQ ID NO: 452962 - protein, 9 aa, Homo Sapiens
LQMTSSADK

SEQ ID NO: 452963 - protein, 9 aa, Homo Sapiens
GGNVVMLVP

SEQ ID NO: 452964 - protein, 9 aa, Homo Sapiens
ITRCHTFNA

SEQ ID NO: 452965 - protein, 9 aa, Homo Sapiens
YEYHKYGDK

SEQ ID NO: 452966 - protein, 9 aa, Homo Sapiens
PSMAPVAMM

SEQ ID NO: 452967 - protein, 9 aa, Homo Sapiens
EVKKVKVEV

SEQ ID NO: 452968 - protein, 9 aa, Homo Sapiens
IIINTTHLD

SEQ ID NO: 452969 - protein, 9 aa, Homo Sapiens
QDGRKMSKN

SEQ ID NO: 452970 - protein, 9 aa, Homo Sapiens
CSQYIMGPN

SEQ ID NO: 452971 - protein, 9 aa, Homo Sapiens
NWVQSGPRT

SEQ ID NO: 452972 - protein, 9 aa, Homo Sapiens
QEYLDAIKT

SEQ ID NO: 452973 - protein, 9 aa, Homo Sapiens
LTSSVAAGT

SEQ ID NO: 452974 - protein, 9 aa, Homo Sapiens
EGHKKMYGK

SEQ ID NO: 452975 - protein, 9 aa, Homo Sapiens
LEMLKSTMK

SEQ ID NO: 452976 - protein, 9 aa, Homo Sapiens
GTSREKTTC

SEQ ID NO: 452977 - protein, 9 aa, Homo Sapiens
RRCMTISIC

SEQ ID NO: 452978 - protein, 9 aa, Homo Sapiens
MTALLKVYS

SEQ ID NO: 452979 - protein, 9 aa, Homo Sapiens
NNQNRDHKQ

SEQ ID NO: 452980 - protein, 9 aa, Homo Sapiens
AVLGIGRHA

SEQ ID NO: 452981 - protein, 9 aa, Homo Sapiens
QENKIQYHS

SEQ ID NO: 452982 - protein, 9 aa, Homo Sapiens
SSSGTEQTG

SEQ ID NO: 452983 - protein, 9 aa, Homo Sapiens
GYCSYKTSK

SEQ ID NO: 452984 - protein, 9 aa, Homo Sapiens
TLFSSSHLR

SEQ ID NO: 452985 - protein, 9 aa, Homo Sapiens
LLRIQDYGT

SEQ ID NO: 452986 - protein, 9 aa, Homo Sapiens
LNPEVPDQL

SEQ ID NO: 452987 - protein, 9 aa, Homo Sapiens
AIRHFKQAL

SEQ ID NO: 452988 - protein, 9 aa, Homo Sapiens
NKIKFGEYV

SEQ ID NO: 452989 - protein, 9 aa, Homo Sapiens
VSDLEKYLG

SEQ ID NO: 452990 - protein, 9 aa, Homo Sapiens
MSVPRTSNC

SEQ ID NO: 452991 - protein, 9 aa, Homo Sapiens
IRQHPLFWE

SEQ ID NO: 452992 - protein, 9 aa, Homo Sapiens
NRKMSADFH

SEQ ID NO: 452993 - protein, 9 aa, Homo Sapiens
NNGSLNTKI

SEQ ID NO: 452994 - protein, 9 aa, Homo Sapiens
EVNMHIKED

SEQ ID NO: 452995 - protein, 9 aa, Homo Sapiens
YKHVCKQAC

SEQ ID NO: 452996 - protein, 9 aa, Homo Sapiens
LWESYLEEQ

SEQ ID NO: 452997 - protein, 9 aa, Homo Sapiens
LRQTGVIHE

SEQ ID NO: 452998 - protein, 9 aa, Homo Sapiens
CSSLIELIK

SEQ ID NO: 452999 - protein, 9 aa, Homo Sapiens
IHHREDIPF

SEQ ID NO: 453000 - protein, 9 aa, Homo Sapiens
YGSGWSSSR

SEQ ID NO: 453001 - protein, 9 aa, Homo Sapiens
MQTIWVTGR

SEQ ID NO: 453002 - protein, 9 aa, Homo Sapiens
YLNFSFCST

SEQ ID NO: 453003 - protein, 9 aa, Homo Sapiens
MIDEGETNW

SEQ ID NO: 453004 - protein, 9 aa, Homo Sapiens
ADKFGQGVH

SEQ ID NO: 453005 - protein, 9 aa, Homo Sapiens
SLDAETTAR

SEQ ID NO: 453006 - protein, 9 aa, Homo Sapiens
LGTFILFAI

SEQ ID NO: 453007 - protein, 9 aa, Homo Sapiens
ARDIHCEFC

SEQ ID NO: 453008 - protein, 9 aa, Homo Sapiens
EFNTLSGKL

SEQ ID NO: 453009 - protein, 9 aa, Homo Sapiens
IKQQRETRV

SEQ ID NO: 453010 - protein, 9 aa, Homo Sapiens
DKLHFMQKV

SEQ ID NO: 453011 - protein, 9 aa, Homo Sapiens
RNSSLSYLS

SEQ ID NO: 453012 - protein, 9 aa, Homo Sapiens
HMGIRAPGH

SEQ ID NO: 453013 - protein, 9 aa, Homo Sapiens
LFVPPNIKQ

SEQ ID NO: 453014 - protein, 9 aa, Homo Sapiens
PPLPGPITF

SEQ ID NO: 453015 - protein, 9 aa, Homo Sapiens
IIEAKQKGY

SEQ ID NO: 453016 - protein, 9 aa, Homo Sapiens
HCPNCQHSD

SEQ ID NO: 453017 - protein, 9 aa, Homo Sapiens
LIHKCCFSS

SEQ ID NO: 453018 - protein, 9 aa, Homo Sapiens
TNTCPDGHC

SEQ ID NO: 453019 - protein, 9 aa, Homo Sapiens
ETLKANKGI

SEQ ID NO: 453020 - protein, 9 aa, Homo Sapiens
SYLIQHQKI

SEQ ID NO: 453021 - protein, 9 aa, Homo Sapiens
RGLFLGCGF

SEQ ID NO: 453022 - protein, 9 aa, Homo Sapiens
TVKMYYPSW

SEQ ID NO: 453023 - protein, 9 aa, Homo Sapiens
YLIIMIAII

SEQ ID NO: 453024 - protein, 9 aa, Homo Sapiens
HQDNSEMCK

SEQ ID NO: 453025 - protein, 9 aa, Homo Sapiens
LDDITSEKE

SEQ ID NO: 453026 - protein, 9 aa, Homo Sapiens
DLRHWIQLP

SEQ ID NO: 453027 - protein, 9 aa, Homo Sapiens
LWNFTDDQI

SEQ ID NO: 453028 - protein, 9 aa, Homo Sapiens
RQLTVHGFL

SEQ ID NO: 453029 - protein, 9 aa, Homo Sapiens
QYTESQLQA

SEQ ID NO: 453030 - protein, 9 aa, Homo Sapiens
LRLRQELTA

SEQ ID NO: 453031 - protein, 9 aa, Homo Sapiens
NRPSFNQTP

SEQ ID NO: 453032 - protein, 9 aa, Homo Sapiens
TRNCTLLDE

SEQ ID NO: 453033 - protein, 9 aa, Homo Sapiens
GCFDECNRI

SEQ ID NO: 453034 - protein, 9 aa, Homo Sapiens
KNIHTGERP

SEQ ID NO: 453035 - protein, 9 aa, Homo Sapiens
GSALPQRRC

SEQ ID NO: 453036 - protein, 9 aa, Homo Sapiens
TTQLIPALV

SEQ ID NO: 453037 - protein, 9 aa, Homo Sapiens
LVPLPVPWT

SEQ ID NO: 453038 - protein, 9 aa, Homo Sapiens
AKKAKYLGF

SEQ ID NO: 453039 - protein, 9 aa, Homo Sapiens
VPRLGMCLG

SEQ ID NO: 453040 - protein, 9 aa, Homo Sapiens
CNIQLFSFA

SEQ ID NO: 453041 - protein, 9 aa, Homo Sapiens
WRKAPLTDI

SEQ ID NO: 453042 - protein, 9 aa, Homo Sapiens
TDFIDCLKI

SEQ ID NO: 453043 - protein, 9 aa, Homo Sapiens
SCEKVVKLL

SEQ ID NO: 453044 - protein, 9 aa, Homo Sapiens
IPKALSTRI

SEQ ID NO: 453045 - protein, 9 aa, Homo Sapiens
AVADVLKKP

SEQ ID NO: 453046 - protein, 9 aa, Homo Sapiens
YIKPENILV

SEQ ID NO: 453047 - protein, 9 aa, Homo Sapiens
RKRRHPLSL

SEQ ID NO: 453048 - protein, 9 aa, Homo Sapiens
RLGMCLGEL

SEQ ID NO: 453049 - protein, 9 aa, Homo Sapiens
NKVLTYSDL

SEQ ID NO: 453050 - protein, 9 aa, Homo Sapiens
ETSPTKYPT

SEQ ID NO: 453051 - protein, 9 aa, Homo Sapiens
GTQHDRFDS

SEQ ID NO: 453052 - protein, 9 aa, Homo Sapiens
SASCDCTVH

SEQ ID NO: 453053 - protein, 9 aa, Homo Sapiens
NGPVFVGGF

SEQ ID NO: 453054 - protein, 9 aa, Homo Sapiens
EAINSVIFA

SEQ ID NO: 453055 - protein, 9 aa, Homo Sapiens
FFNLICLME

SEQ ID NO: 453056 - protein, 9 aa, Homo Sapiens
RISGNTSQR

SEQ ID NO: 453057 - protein, 9 aa, Homo Sapiens
QPNLTPQNQ

SEQ ID NO: 453058 - protein, 9 aa, Homo Sapiens
TTSTGLAQH

SEQ ID NO: 453059 - protein, 9 aa, Homo Sapiens
SSAMCHSCH

SEQ ID NO: 453060 - protein, 9 aa, Homo Sapiens
DTWYQVYRR

SEQ ID NO: 453061 - protein, 9 aa, Homo Sapiens
DKNVMVPVG

SEQ ID NO: 453062 - protein, 9 aa, Homo Sapiens
VNLVASTAK

SEQ ID NO: 453063 - protein, 9 aa, Homo Sapiens
IPRINVTAA

SEQ ID NO: 453064 - protein, 9 aa, Homo Sapiens
LVFVGAAVA

SEQ ID NO: 453065 - protein, 9 aa, Homo Sapiens
RYSDFTKLQ

SEQ ID NO: 453066 - protein, 9 aa, Homo Sapiens
VLDSWSHDP

SEQ ID NO: 453067 - protein, 9 aa, Homo Sapiens
TVGPVQKVV

SEQ ID NO: 453068 - protein, 9 aa, Homo Sapiens
HAHMHHHHR

SEQ ID NO: 453069 - protein, 9 aa, Homo Sapiens
QLQGMRKGS

SEQ ID NO: 453070 - protein, 9 aa, Homo Sapiens
QSIYLASLP

SEQ ID NO: 453071 - protein, 9 aa, Homo Sapiens
KLRCPCKII

SEQ ID NO: 453072 - protein, 9 aa, Homo Sapiens
QAMKKFVNT

SEQ ID NO: 453073 - protein, 9 aa, Homo Sapiens
TVPGASNLF

SEQ ID NO: 453074 - protein, 9 aa, Homo Sapiens
KKSNIRINE

SEQ ID NO: 453075 - protein, 9 aa, Homo Sapiens
LSRLMQVGE

SEQ ID NO: 453076 - protein, 9 aa, Homo Sapiens
GPEAADLSD

SEQ ID NO: 453077 - protein, 9 aa, Homo Sapiens
EMQSKNEQM

SEQ ID NO: 453078 - protein, 9 aa, Homo Sapiens
PAMQLTSKI

SEQ ID NO: 453079 - protein, 9 aa, Homo Sapiens
GQEDRSLKN

SEQ ID NO: 453080 - protein, 9 aa, Homo Sapiens
YMQTAPIRN

SEQ ID NO: 453081 - protein, 9 aa, Homo Sapiens
LFGFHRPNT

SEQ ID NO: 453082 - protein, 9 aa, Homo Sapiens
ENTFLLPSA

SEQ ID NO: 453083 - protein, 9 aa, Homo Sapiens
EHQYLLEEI

SEQ ID NO: 453084 - protein, 9 aa, Homo Sapiens
KIIYKISPE

SEQ ID NO: 453085 - protein, 9 aa, Homo Sapiens
KGHRSDGWN

SEQ ID NO: 453086 - protein, 9 aa, Homo Sapiens
ALIRNPKIM

SEQ ID NO: 453087 - protein, 9 aa, Homo Sapiens
RVGSPQSPV

SEQ ID NO: 453088 - protein, 9 aa, Homo Sapiens
GSNPEGIQK

SEQ ID NO: 453089 - protein, 9 aa, Homo Sapiens
RWLPAEDAL

SEQ ID NO: 453090 - protein, 9 aa, Homo Sapiens
DSDQDTNTG

SEQ ID NO: 453091 - protein, 9 aa, Homo Sapiens
QDTNTGSCC

SEQ ID NO: 453092 - protein, 9 aa, Homo Sapiens
SLVLKILGF

SEQ ID NO: 453093 - protein, 9 aa, Homo Sapiens
QQIYDFLCE

SEQ ID NO: 453094 - protein, 9 aa, Homo Sapiens
IEDIDEDTS

SEQ ID NO: 453095 - protein, 9 aa, Homo Sapiens
ILNEKNYVA

SEQ ID NO: 453096 - protein, 9 aa, Homo Sapiens
ENGYYCPSC

SEQ ID NO: 453097 - protein, 9 aa, Homo Sapiens
CLGETWNIS

SEQ ID NO: 453098 - protein, 9 aa, Homo Sapiens
VGPIPGLLK

SEQ ID NO: 453099 - protein, 9 aa, Homo Sapiens
KPCKDTVQI

SEQ ID NO: 453100 - protein, 9 aa, Homo Sapiens
TYHRYSAPP

SEQ ID NO: 453101 - protein, 9 aa, Homo Sapiens
RLPFHADNF

SEQ ID NO: 453102 - protein, 9 aa, Homo Sapiens
LNFYTNVKF

SEQ ID NO: 453103 - protein, 9 aa, Homo Sapiens
HREVCDRHH

SEQ ID NO: 453104 - protein, 9 aa, Homo Sapiens
LELEHPARG

SEQ ID NO: 453105 - protein, 9 aa, Homo Sapiens
RMRGNNTFG

SEQ ID NO: 453106 - protein, 9 aa, Homo Sapiens
YDVTPPSVV

SEQ ID NO: 453107 - protein, 9 aa, Homo Sapiens
VSDLYQSGK

SEQ ID NO: 453108 - protein, 9 aa, Homo Sapiens
AIHKDYITE

SEQ ID NO: 453109 - protein, 9 aa, Homo Sapiens
CLRIYYEKE

SEQ ID NO: 453110 - protein, 9 aa, Homo Sapiens
LKVKVVFDK

SEQ ID NO: 453111 - protein, 9 aa, Homo Sapiens
IYQYYKLLA

SEQ ID NO: 453112 - protein, 9 aa, Homo Sapiens
TKIYRGCHH

SEQ ID NO: 453113 - protein, 9 aa, Homo Sapiens
GIRGTIPES

SEQ ID NO: 453114 - protein, 9 aa, Homo Sapiens
LTVHIRQKH

SEQ ID NO: 453115 - protein, 9 aa, Homo Sapiens
GPTLSANIQ

SEQ ID NO: 453116 - protein, 9 aa, Homo Sapiens
EEEAEEAAT

SEQ ID NO: 453117 - protein, 9 aa, Homo Sapiens
VTQRVEDQE

SEQ ID NO: 453118 - protein, 9 aa, Homo Sapiens
KSLAIHLLQ

SEQ ID NO: 453119 - protein, 9 aa, Homo Sapiens
ERNLQIIAT

SEQ ID NO: 453120 - protein, 9 aa, Homo Sapiens
KHERLRTYH

SEQ ID NO: 453121 - protein, 9 aa, Homo Sapiens
QGEQNVPPP

SEQ ID NO: 453122 - protein, 9 aa, Homo Sapiens
INEDSTGGI

SEQ ID NO: 453123 - protein, 9 aa, Homo Sapiens
NKTATYDTG

SEQ ID NO: 453124 - protein, 9 aa, Homo Sapiens
ADFELPIII

SEQ ID NO: 453125 - protein, 9 aa, Homo Sapiens
CLMSIVSAL

SEQ ID NO: 453126 - protein, 9 aa, Homo Sapiens
LYLCTSTSS

SEQ ID NO: 453127 - protein, 9 aa, Homo Sapiens
VTELNNNME

SEQ ID NO: 453128 - protein, 9 aa, Homo Sapiens
QMGRYQCTV

SEQ ID NO: 453129 - protein, 9 aa, Homo Sapiens
KTAWGRQRA

SEQ ID NO: 453130 - protein, 9 aa, Homo Sapiens
DLNKLRTNW

SEQ ID NO: 453131 - protein, 9 aa, Homo Sapiens
YPEADHECC

SEQ ID NO: 453132 - protein, 9 aa, Homo Sapiens
MNQGVSDER

SEQ ID NO: 453133 - protein, 9 aa, Homo Sapiens
RGHTLYTSY

SEQ ID NO: 453134 - protein, 9 aa, Homo Sapiens
KDLPCDLKP

SEQ ID NO: 453135 - protein, 9 aa, Homo Sapiens
QNNPTAFYL

SEQ ID NO: 453136 - protein, 9 aa, Homo Sapiens
DEVIKLCGR

SEQ ID NO: 453137 - protein, 9 aa, Homo Sapiens
VEERRNMQT

SEQ ID NO: 453138 - protein, 9 aa, Homo Sapiens
LDQRLEKHE

SEQ ID NO: 453139 - protein, 9 aa, Homo Sapiens
ANCIVHQDL

SEQ ID NO: 453140 - protein, 9 aa, Homo Sapiens
DPVVSATSN

SEQ ID NO: 453141 - protein, 9 aa, Homo Sapiens
QKEPQEPEV

SEQ ID NO: 453142 - protein, 9 aa, Homo Sapiens
NTPKNVLWR

SEQ ID NO: 453143 - protein, 9 aa, Homo Sapiens
AKKPPSGSA

SEQ ID NO: 453144 - protein, 9 aa, Homo Sapiens
KLIEDTPID

SEQ ID NO: 453145 - protein, 9 aa, Homo Sapiens
KAFQTKAIF

SEQ ID NO: 453146 - protein, 9 aa, Homo Sapiens
KVEIYTKSY

SEQ ID NO: 453147 - protein, 9 aa, Homo Sapiens
DEKISLIPP

SEQ ID NO: 453148 - protein, 9 aa, Homo Sapiens
QRQLDLVHT

SEQ ID NO: 453149 - protein, 9 aa, Homo Sapiens
MSEPDTSTG

SEQ ID NO: 453150 - protein, 9 aa, Homo Sapiens
PGDSEESLR

SEQ ID NO: 453151 - protein, 9 aa, Homo Sapiens
QKPVGKYHI

SEQ ID NO: 453152 - protein, 9 aa, Homo Sapiens
SDLTNHVQI

SEQ ID NO: 453153 - protein, 9 aa, Homo Sapiens
SSYLIQHQK

SEQ ID NO: 453154 - protein, 9 aa, Homo Sapiens
THHQLHACF

SEQ ID NO: 453155 - protein, 9 aa, Homo Sapiens
NFFFIFLFG

SEQ ID NO: 453156 - protein, 9 aa, Homo Sapiens
KSRLIVHQQ

SEQ ID NO: 453157 - protein, 9 aa, Homo Sapiens
ANCQIDRVN

SEQ ID NO: 453158 - protein, 9 aa, Homo Sapiens
INKKEICIE

SEQ ID NO: 453159 - protein, 9 aa, Homo Sapiens
RHREVNLPK

SEQ ID NO: 453160 - protein, 9 aa, Homo Sapiens
RDRKSAIQY

SEQ ID NO: 453161 - protein, 9 aa, Homo Sapiens
VEVEDLKYL

SEQ ID NO: 453162 - protein, 9 aa, Homo Sapiens
YSRHHSLSS

SEQ ID NO: 453163 - protein, 9 aa, Homo Sapiens
KLMFDHSEV

SEQ ID NO: 453164 - protein, 9 aa, Homo Sapiens
LSSLHMAAI

SEQ ID NO: 453165 - protein, 9 aa, Homo Sapiens
SNSISVMSD

SEQ ID NO: 453166 - protein, 9 aa, Homo Sapiens
DINTGAWVN

SEQ ID NO: 453167 - protein, 9 aa, Homo Sapiens
LGVTVLAFA

SEQ ID NO: 453168 - protein, 9 aa, Homo Sapiens
PLKNEERKL

SEQ ID NO: 453169 - protein, 9 aa, Homo Sapiens
SSQREEERS

SEQ ID NO: 453170 - protein, 9 aa, Homo Sapiens
FTGGVTTGV

SEQ ID NO: 453171 - protein, 9 aa, Homo Sapiens
SATSNHCLD

SEQ ID NO: 453172 - protein, 9 aa, Homo Sapiens
PTRYDTLFQ

SEQ ID NO: 453173 - protein, 9 aa, Homo Sapiens
SQETQISQT

SEQ ID NO: 453174 - protein, 9 aa, Homo Sapiens
ICHGLWICP

SEQ ID NO: 453175 - protein, 9 aa, Homo Sapiens
HHLQIHNVK

SEQ ID NO: 453176 - protein, 9 aa, Homo Sapiens
SHFLTDANM

SEQ ID NO: 453177 - protein, 9 aa, Homo Sapiens
ICTGQECRD

SEQ ID NO: 453178 - protein, 9 aa, Homo Sapiens
NLHRLCIVH

SEQ ID NO: 453179 - protein, 9 aa, Homo Sapiens
PCVKQGDSN

SEQ ID NO: 453180 - protein, 9 aa, Homo Sapiens
TKHTYYYGK

SEQ ID NO: 453181 - protein, 9 aa, Homo Sapiens
YVVGPPETS

SEQ ID NO: 453182 - protein, 9 aa, Homo Sapiens
VDKPVPEEL

SEQ ID NO: 453183 - protein, 9 aa, Homo Sapiens
SHKIIHTGE

SEQ ID NO: 453184 - protein, 9 aa, Homo Sapiens
QCGKAFHQK

SEQ ID NO: 453185 - protein, 9 aa, Homo Sapiens
SDKLLASID

SEQ ID NO: 453186 - protein, 9 aa, Homo Sapiens
NVIYIHETH

SEQ ID NO: 453187 - protein, 9 aa, Homo Sapiens
EIILAMLMV

SEQ ID NO: 453188 - protein, 9 aa, Homo Sapiens
LETGEIIKA

SEQ ID NO: 453189 - protein, 9 aa, Homo Sapiens
LNCGIMLRK

SEQ ID NO: 453190 - protein, 9 aa, Homo Sapiens
QKELNDVLT

SEQ ID NO: 453191 - protein, 9 aa, Homo Sapiens
RSKGHRSDG

SEQ ID NO: 453192 - protein, 9 aa, Homo Sapiens
SLLLVAVVV

SEQ ID NO: 453193 - protein, 9 aa, Homo Sapiens
PLNEKITLW

SEQ ID NO: 453194 - protein, 9 aa, Homo Sapiens
LKLLPHQPQ

SEQ ID NO: 453195 - protein, 9 aa, Homo Sapiens
LSSLSFMDI

SEQ ID NO: 453196 - protein, 9 aa, Homo Sapiens
DNSPRFPQP

SEQ ID NO: 453197 - protein, 9 aa, Homo Sapiens
GSGLTLIHH

SEQ ID NO: 453198 - protein, 9 aa, Homo Sapiens
KVLYGEPAG

SEQ ID NO: 453199 - protein, 9 aa, Homo Sapiens
EIQGTVEFL

SEQ ID NO: 453200 - protein, 9 aa, Homo Sapiens
RGLASGDHS

SEQ ID NO: 453201 - protein, 9 aa, Homo Sapiens
FPRRTQPKM

SEQ ID NO: 453202 - protein, 9 aa, Homo Sapiens
NHIRLKPYK

SEQ ID NO: 453203 - protein, 9 aa, Homo Sapiens
GVLGGVASF

SEQ ID NO: 453204 - protein, 9 aa, Homo Sapiens
SLLSSLPIY

SEQ ID NO: 453205 - protein, 9 aa, Homo Sapiens
LQLMKELAD

SEQ ID NO: 453206 - protein, 9 aa, Homo Sapiens
MLASSTQYS

SEQ ID NO: 453207 - protein, 9 aa, Homo Sapiens
RDKDLIWAT

SEQ ID NO: 453208 - protein, 9 aa, Homo Sapiens
QLTSKIPDM

SEQ ID NO: 453209 - protein, 9 aa, Homo Sapiens
KMGKQGIIN

SEQ ID NO: 453210 - protein, 9 aa, Homo Sapiens
KGKFQVPKI

SEQ ID NO: 453211 - protein, 9 aa, Homo Sapiens
AGSSNVKFD

SEQ ID NO: 453212 - protein, 9 aa, Homo Sapiens
YSPSRIRKF

SEQ ID NO: 453213 - protein, 9 aa, Homo Sapiens
KLTVGKRKQ

SEQ ID NO: 453214 - protein, 9 aa, Homo Sapiens
PGQYSGKSF

SEQ ID NO: 453215 - protein, 9 aa, Homo Sapiens
QDIAAYYCA

SEQ ID NO: 453216 - protein, 9 aa, Homo Sapiens
ISYQESFRE

SEQ ID NO: 453217 - protein, 9 aa, Homo Sapiens
RVEQYSSDT

SEQ ID NO: 453218 - protein, 9 aa, Homo Sapiens
ELISRINFC

SEQ ID NO: 453219 - protein, 9 aa, Homo Sapiens
HHEQSSKDI

SEQ ID NO: 453220 - protein, 9 aa, Homo Sapiens
IVHQQTHTG

SEQ ID NO: 453221 - protein, 9 aa, Homo Sapiens
NEYPSYQEN

SEQ ID NO: 453222 - protein, 9 aa, Homo Sapiens
VVQIQKLQH

SEQ ID NO: 453223 - protein, 9 aa, Homo Sapiens
SRYVEMKYL

SEQ ID NO: 453224 - protein, 9 aa, Homo Sapiens
LVCVFGTAG

SEQ ID NO: 453225 - protein, 9 aa, Homo Sapiens
GWSTNLNKY

SEQ ID NO: 453226 - protein, 9 aa, Homo Sapiens
TSLRKRSLN

SEQ ID NO: 453227 - protein, 9 aa, Homo Sapiens
FSENLESYK

SEQ ID NO: 453228 - protein, 9 aa, Homo Sapiens
YADIIRKQV

SEQ ID NO: 453229 - protein, 9 aa, Homo Sapiens
FYRGRYVLC

SEQ ID NO: 453230 - protein, 9 aa, Homo Sapiens
DIDEDTSME

SEQ ID NO: 453231 - protein, 9 aa, Homo Sapiens
DGRHFDFMG

SEQ ID NO: 453232 - protein, 9 aa, Homo Sapiens
FLDQQNQVL

SEQ ID NO: 453233 - protein, 9 aa, Homo Sapiens
VIWKDPHLQ

SEQ ID NO: 453234 - protein, 9 aa, Homo Sapiens
TVAMDLGID

SEQ ID NO: 453235 - protein, 9 aa, Homo Sapiens
MTPPLLGTV

SEQ ID NO: 453236 - protein, 9 aa, Homo Sapiens
VAHALLLIA

SEQ ID NO: 453237 - protein, 9 aa, Homo Sapiens
VVTHYVLPQ

SEQ ID NO: 453238 - protein, 9 aa, Homo Sapiens
SFAFGPFGV

SEQ ID NO: 453239 - protein, 9 aa, Homo Sapiens
RTVKCYNPH

SEQ ID NO: 453240 - protein, 9 aa, Homo Sapiens
SEPLVQPSA

SEQ ID NO: 453241 - protein, 9 aa, Homo Sapiens
ASALIQTLG

SEQ ID NO: 453242 - protein, 9 aa, Homo Sapiens
KGKKVSNQI

SEQ ID NO: 453243 - protein, 9 aa, Homo Sapiens
HSTLLLNPK

SEQ ID NO: 453244 - protein, 9 aa, Homo Sapiens
PEDQVNIAE

SEQ ID NO: 453245 - protein, 9 aa, Homo Sapiens
WVGGFICYP

SEQ ID NO: 453246 - protein, 9 aa, Homo Sapiens
ALHMAACSG

SEQ ID NO: 453247 - protein, 9 aa, Homo Sapiens
LTNQEQVTI

SEQ ID NO: 453248 - protein, 9 aa, Homo Sapiens
DWLISRQLY

SEQ ID NO: 453249 - protein, 9 aa, Homo Sapiens
TWNISINLV

SEQ ID NO: 453250 - protein, 9 aa, Homo Sapiens
LHINFLELG

SEQ ID NO: 453251 - protein, 9 aa, Homo Sapiens
LLVLVVCYL

SEQ ID NO: 453252 - protein, 9 aa, Homo Sapiens
KIPVCEPWR

SEQ ID NO: 453253 - protein, 9 aa, Homo Sapiens
AQGEDDDEE

SEQ ID NO: 453254 - protein, 9 aa, Homo Sapiens
LKMKYFQQC

SEQ ID NO: 453255 - protein, 9 aa, Homo Sapiens
DFMLITNRS

SEQ ID NO: 453256 - protein, 9 aa, Homo Sapiens
DIHHQIHTG

SEQ ID NO: 453257 - protein, 9 aa, Homo Sapiens
KGFKGELIN

SEQ ID NO: 453258 - protein, 9 aa, Homo Sapiens
KKELILTVL

SEQ ID NO: 453259 - protein, 9 aa, Homo Sapiens
PGDCLIRHR

SEQ ID NO: 453260 - protein, 9 aa, Homo Sapiens
REGQLRAAY

SEQ ID NO: 453261 - protein, 9 aa, Homo Sapiens
DQPHQFYVA

SEQ ID NO: 453262 - protein, 9 aa, Homo Sapiens
ISQIKYKSS

SEQ ID NO: 453263 - protein, 9 aa, Homo Sapiens
EESTTVQKC

SEQ ID NO: 453264 - protein, 9 aa, Homo Sapiens
VSWIYILCK

SEQ ID NO: 453265 - protein, 9 aa, Homo Sapiens
FFMGGVFVV

SEQ ID NO: 453266 - protein, 9 aa, Homo Sapiens
VCFHVNCSN

SEQ ID NO: 453267 - protein, 9 aa, Homo Sapiens
YQTAKKQDN

SEQ ID NO: 453268 - protein, 9 aa, Homo Sapiens
AHHGGSWKC

SEQ ID NO: 453269 - protein, 9 aa, Homo Sapiens
VFLDSVTER

SEQ ID NO: 453270 - protein, 9 aa, Homo Sapiens
AQTTSQSLL

SEQ ID NO: 453271 - protein, 9 aa, Homo Sapiens
NLQGKKSSV

SEQ ID NO: 453272 - protein, 9 aa, Homo Sapiens
YLSHQVPIL

SEQ ID NO: 453273 - protein, 9 aa, Homo Sapiens
WIMEAVRGS

SEQ ID NO: 453274 - protein, 9 aa, Homo Sapiens
EFILPYDGK

SEQ ID NO: 453275 - protein, 9 aa, Homo Sapiens
RCSHTEAAV

SEQ ID NO: 453276 - protein, 9 aa, Homo Sapiens
MVKFILEKG

SEQ ID NO: 453277 - protein, 9 aa, Homo Sapiens
FLVASAPAT

SEQ ID NO: 453278 - protein, 9 aa, Homo Sapiens
KSLDIGNQI

SEQ ID NO: 453279 - protein, 9 aa, Homo Sapiens
EAGSTTPLF

SEQ ID NO: 453280 - protein, 9 aa, Homo Sapiens
TSNCHQFGF

SEQ ID NO: 453281 - protein, 9 aa, Homo Sapiens
PWWTLPKNF

SEQ ID NO: 453282 - protein, 9 aa, Homo Sapiens
EQGKKPILD

SEQ ID NO: 453283 - protein, 9 aa, Homo Sapiens
SRGVDIKAN

SEQ ID NO: 453284 - protein, 9 aa, Homo Sapiens
KAWKAVVVQ

SEQ ID NO: 453285 - protein, 9 aa, Homo Sapiens
PYDCKEYGK

SEQ ID NO: 453286 - protein, 9 aa, Homo Sapiens
IAICAVSGL

SEQ ID NO: 453287 - protein, 9 aa, Homo Sapiens
RRCYVCPAV

SEQ ID NO: 453288 - protein, 9 aa, Homo Sapiens
HNSNEGWEE

SEQ ID NO: 453289 - protein, 9 aa, Homo Sapiens
FNLVCDRTH

SEQ ID NO: 453290 - protein, 9 aa, Homo Sapiens
AEALCLLRL

SEQ ID NO: 453291 - protein, 9 aa, Homo Sapiens
ACAVEGSNK

SEQ ID NO: 453292 - protein, 9 aa, Homo Sapiens
EFYNTFSSI

SEQ ID NO: 453293 - protein, 9 aa, Homo Sapiens
SSKFIKEFL

SEQ ID NO: 453294 - protein, 9 aa, Homo Sapiens
RNCLIDRTS

SEQ ID NO: 453295 - protein, 9 aa, Homo Sapiens
HLYARGWKI

SEQ ID NO: 453296 - protein, 9 aa, Homo Sapiens
LIWATSGAA

SEQ ID NO: 453297 - protein, 9 aa, Homo Sapiens
GQVKPYSYV

SEQ ID NO: 453298 - protein, 9 aa, Homo Sapiens
LKPKAAVQK

SEQ ID NO: 453299 - protein, 9 aa, Homo Sapiens
QGMVKKEPI

SEQ ID NO: 453300 - protein, 9 aa, Homo Sapiens
TPGYGDTIN

SEQ ID NO: 453301 - protein, 9 aa, Homo Sapiens
PITFPAGVS

SEQ ID NO: 453302 - protein, 9 aa, Homo Sapiens
GSVSWMGKP

SEQ ID NO: 453303 - protein, 9 aa, Homo Sapiens
LTKPILGVM

SEQ ID NO: 453304 - protein, 9 aa, Homo Sapiens
LKPLSDRRL

SEQ ID NO: 453305 - protein, 9 aa, Homo Sapiens
LNKFRWYRF

SEQ ID NO: 453306 - protein, 9 aa, Homo Sapiens
VCCLYYTSF

SEQ ID NO: 453307 - protein, 9 aa, Homo Sapiens
PDVVVTNFR

SEQ ID NO: 453308 - protein, 9 aa, Homo Sapiens
DVQKRRQVL

SEQ ID NO: 453309 - protein, 9 aa, Homo Sapiens
RYIITYHEK

SEQ ID NO: 453310 - protein, 9 aa, Homo Sapiens
VRAFLHTYS

SEQ ID NO: 453311 - protein, 9 aa, Homo Sapiens
RPSPKKFYP

SEQ ID NO: 453312 - protein, 9 aa, Homo Sapiens
IVDWKGDCN

SEQ ID NO: 453313 - protein, 9 aa, Homo Sapiens
QEAHKKIWM

SEQ ID NO: 453314 - protein, 9 aa, Homo Sapiens
PENYNEAEC

SEQ ID NO: 453315 - protein, 9 aa, Homo Sapiens
YSTPFSSPT

SEQ ID NO: 453316 - protein, 9 aa, Homo Sapiens
LSGFYQEIN

SEQ ID NO: 453317 - protein, 9 aa, Homo Sapiens
LDKNVMVPV

SEQ ID NO: 453318 - protein, 9 aa, Homo Sapiens
GTVFSRKSH

SEQ ID NO: 453319 - protein, 9 aa, Homo Sapiens
ETKTTIGYG

SEQ ID NO: 453320 - protein, 9 aa, Homo Sapiens
VLTGTSEYL

SEQ ID NO: 453321 - protein, 9 aa, Homo Sapiens
GFDFVIDDN

SEQ ID NO: 453322 - protein, 9 aa, Homo Sapiens
AKSPKALFV

SEQ ID NO: 453323 - protein, 9 aa, Homo Sapiens
VALAEQHVV

SEQ ID NO: 453324 - protein, 9 aa, Homo Sapiens
QHKSTEQAV

SEQ ID NO: 453325 - protein, 9 aa, Homo Sapiens
IRPLLDVLR

SEQ ID NO: 453326 - protein, 9 aa, Homo Sapiens
PHCFKITTA

SEQ ID NO: 453327 - protein, 9 aa, Homo Sapiens
YAQNVVQIQ

SEQ ID NO: 453328 - protein, 9 aa, Homo Sapiens
FAGYETTIS

SEQ ID NO: 453329 - protein, 9 aa, Homo Sapiens
YVLISFIPV

SEQ ID NO: 453330 - protein, 9 aa, Homo Sapiens
GCDSEIHRE

SEQ ID NO: 453331 - protein, 9 aa, Homo Sapiens
MDIQAMEDN

SEQ ID NO: 453332 - protein, 9 aa, Homo Sapiens
EFNRPVFRT

SEQ ID NO: 453333 - protein, 9 aa, Homo Sapiens
CTRSKVTFQ

SEQ ID NO: 453334 - protein, 9 aa, Homo Sapiens
TKKKRKTLA

SEQ ID NO: 453335 - protein, 9 aa, Homo Sapiens
TQTDIVILL

SEQ ID NO: 453336 - protein, 9 aa, Homo Sapiens
VLGKDCNKT

SEQ ID NO: 453337 - protein, 9 aa, Homo Sapiens
SVETNNLEQ

SEQ ID NO: 453338 - protein, 9 aa, Homo Sapiens
SCCSCCPVE

SEQ ID NO: 453339 - protein, 9 aa, Homo Sapiens
SDTPSTSTV

SEQ ID NO: 453340 - protein, 9 aa, Homo Sapiens
KILCTKADN

SEQ ID NO: 453341 - protein, 9 aa, Homo Sapiens
SITSSQSSS

SEQ ID NO: 453342 - protein, 9 aa, Homo Sapiens
SMSPGLPSS

SEQ ID NO: 453343 - protein, 9 aa, Homo Sapiens
KACRYMAGV

SEQ ID NO: 453344 - protein, 9 aa, Homo Sapiens
AALPTFCKL

SEQ ID NO: 453345 - protein, 9 aa, Homo Sapiens
VNVALSLNN

SEQ ID NO: 453346 - protein, 9 aa, Homo Sapiens
LYLALYSAL

SEQ ID NO: 453347 - protein, 9 aa, Homo Sapiens
CTAVCIENS

SEQ ID NO: 453348 - protein, 9 aa, Homo Sapiens
GRISKHWPG

SEQ ID NO: 453349 - protein, 9 aa, Homo Sapiens
HGLGLRQYF

SEQ ID NO: 453350 - protein, 9 aa, Homo Sapiens
LKWQLEQSI

SEQ ID NO: 453351 - protein, 9 aa, Homo Sapiens
PLMVKKNYV

SEQ ID NO: 453352 - protein, 9 aa, Homo Sapiens
ANEKLEWNR

SEQ ID NO: 453353 - protein, 9 aa, Homo Sapiens
KSQLDIHHQ

SEQ ID NO: 453354 - protein, 9 aa, Homo Sapiens
RNRSLGQRQ

SEQ ID NO: 453355 - protein, 9 aa, Homo Sapiens
ENVLDLNGC

SEQ ID NO: 453356 - protein, 9 aa, Homo Sapiens
AALNARFLV

SEQ ID NO: 453357 - protein, 9 aa, Homo Sapiens
TTTQSGIFQ

SEQ ID NO: 453358 - protein, 9 aa, Homo Sapiens
ETLESALIT

SEQ ID NO: 453359 - protein, 9 aa, Homo Sapiens
QCDMYSSVD

SEQ ID NO: 453360 - protein, 9 aa, Homo Sapiens
LDVFMSEMK

SEQ ID NO: 453361 - protein, 9 aa, Homo Sapiens
HLSVVDATW

SEQ ID NO: 453362 - protein, 9 aa, Homo Sapiens
SAPQGNLEL

SEQ ID NO: 453363 - protein, 9 aa, Homo Sapiens
YLMVMYVSP

SEQ ID NO: 453364 - protein, 9 aa, Homo Sapiens
HFPAYVHCS

SEQ ID NO: 453365 - protein, 9 aa, Homo Sapiens
FMAPSEAIS

SEQ ID NO: 453366 - protein, 9 aa, Homo Sapiens
ELTEILRFN

SEQ ID NO: 453367 - protein, 9 aa, Homo Sapiens
TGEKKECWL

SEQ ID NO: 453368 - protein, 9 aa, Homo Sapiens
VITYSTERL

SEQ ID NO: 453369 - protein, 9 aa, Homo Sapiens
DNIVRRSND

SEQ ID NO: 453370 - protein, 9 aa, Homo Sapiens
KAQLGIHEI

SEQ ID NO: 453371 - protein, 9 aa, Homo Sapiens
NSGLINHQI

SEQ ID NO: 453372 - protein, 9 aa, Homo Sapiens
IKIPNSGTV

SEQ ID NO: 453373 - protein, 9 aa, Homo Sapiens
YVGQPEMAP

SEQ ID NO: 453374 - protein, 9 aa, Homo Sapiens
IKNSKASKS

SEQ ID NO: 453375 - protein, 9 aa, Homo Sapiens
NLPEGYTPQ

SEQ ID NO: 453376 - protein, 9 aa, Homo Sapiens
FPQEPEANN

SEQ ID NO: 453377 - protein, 9 aa, Homo Sapiens
LSDKSKLQE

SEQ ID NO: 453378 - protein, 9 aa, Homo Sapiens
VPKGLNNPP

SEQ ID NO: 453379 - protein, 9 aa, Homo Sapiens
CLEEEARKQ

SEQ ID NO: 453380 - protein, 9 aa, Homo Sapiens
KHTSKENTN

SEQ ID NO: 453381 - protein, 9 aa, Homo Sapiens
ALKKAKGCT

SEQ ID NO: 453382 - protein, 9 aa, Homo Sapiens
SNTPLQSSP

SEQ ID NO: 453383 - protein, 9 aa, Homo Sapiens
KMESGEEDK

SEQ ID NO: 453384 - protein, 9 aa, Homo Sapiens
FNNVTNNYD

SEQ ID NO: 453385 - protein, 9 aa, Homo Sapiens
NPHASTMAL

SEQ ID NO: 453386 - protein, 9 aa, Homo Sapiens
IHTGKKSYA

SEQ ID NO: 453387 - protein, 9 aa, Homo Sapiens
EQRDYINTT

SEQ ID NO: 453388 - protein, 9 aa, Homo Sapiens
IVPIDIGPS

SEQ ID NO: 453389 - protein, 9 aa, Homo Sapiens
GLIAIFRGP

SEQ ID NO: 453390 - protein, 9 aa, Homo Sapiens
ARERLRVWD

SEQ ID NO: 453391 - protein, 9 aa, Homo Sapiens
IEDDENFFT

SEQ ID NO: 453392 - protein, 9 aa, Homo Sapiens
TASVSILEN

SEQ ID NO: 453393 - protein, 9 aa, Homo Sapiens
VNEWSLNIR

SEQ ID NO: 453394 - protein, 9 aa, Homo Sapiens
VKVKKRNTY

SEQ ID NO: 453395 - protein, 9 aa, Homo Sapiens
EVIVWQLQE

SEQ ID NO: 453396 - protein, 9 aa, Homo Sapiens
VVSKARAKV

SEQ ID NO: 453397 - protein, 9 aa, Homo Sapiens
IKEDNFFTL

SEQ ID NO: 453398 - protein, 9 aa, Homo Sapiens
HPEGRFSAL

SEQ ID NO: 453399 - protein, 9 aa, Homo Sapiens
YMNQAYHAI

SEQ ID NO: 453400 - protein, 9 aa, Homo Sapiens
DPGVAYFKV

SEQ ID NO: 453401 - protein, 9 aa, Homo Sapiens
QTINDQDFF

SEQ ID NO: 453402 - protein, 9 aa, Homo Sapiens
YLAANGPTT

SEQ ID NO: 453403 - protein, 9 aa, Homo Sapiens
TVRYVCLRC

SEQ ID NO: 453404 - protein, 9 aa, Homo Sapiens
SCKAQLGIH

SEQ ID NO: 453405 - protein, 9 aa, Homo Sapiens
TSNHCLDAA

SEQ ID NO: 453406 - protein, 9 aa, Homo Sapiens
ECEQKKENQ

SEQ ID NO: 453407 - protein, 9 aa, Homo Sapiens
VSSPFIVYL

SEQ ID NO: 453408 - protein, 9 aa, Homo Sapiens
WPWWMYEST

SEQ ID NO: 453409 - protein, 9 aa, Homo Sapiens
LNDATYKLE

SEQ ID NO: 453410 - protein, 9 aa, Homo Sapiens
LECMRSFNR

SEQ ID NO: 453411 - protein, 9 aa, Homo Sapiens
ANIRLNLGK

SEQ ID NO: 453412 - protein, 9 aa, Homo Sapiens
NDYTCTCPQ

SEQ ID NO: 453413 - protein, 9 aa, Homo Sapiens
DRTHLKDTT

SEQ ID NO: 453414 - protein, 9 aa, Homo Sapiens
SNLTDHKII

SEQ ID NO: 453415 - protein, 9 aa, Homo Sapiens
GTAIYLTGP

SEQ ID NO: 453416 - protein, 9 aa, Homo Sapiens
AVEYFKNTT

SEQ ID NO: 453417 - protein, 9 aa, Homo Sapiens
KDKKTKRKL

SEQ ID NO: 453418 - protein, 9 aa, Homo Sapiens
ALSGPRLAS

SEQ ID NO: 453419 - protein, 9 aa, Homo Sapiens
SQNSHLIWH

SEQ ID NO: 453420 - protein, 9 aa, Homo Sapiens
QQSDFYKLP

SEQ ID NO: 453421 - protein, 9 aa, Homo Sapiens
HKGVEHVED

SEQ ID NO: 453422 - protein, 9 aa, Homo Sapiens
SSCSVIPGK

SEQ ID NO: 453423 - protein, 9 aa, Homo Sapiens
PNFNFSIWY

SEQ ID NO: 453424 - protein, 9 aa, Homo Sapiens
NLPYALAFL

SEQ ID NO: 453425 - protein, 9 aa, Homo Sapiens
RNHTVDKSY

SEQ ID NO: 453426 - protein, 9 aa, Homo Sapiens
QIDLPIKIY

SEQ ID NO: 453427 - protein, 9 aa, Homo Sapiens
LVVAAMIIS

SEQ ID NO: 453428 - protein, 9 aa, Homo Sapiens
YDDTIQILD

SEQ ID NO: 453429 - protein, 9 aa, Homo Sapiens
NTTENINNT

SEQ ID NO: 453430 - protein, 9 aa, Homo Sapiens
CSIAARKLI

SEQ ID NO: 453431 - protein, 9 aa, Homo Sapiens
ANYIHSGTL

SEQ ID NO: 453432 - protein, 9 aa, Homo Sapiens
RKIRRYQKS

SEQ ID NO: 453433 - protein, 9 aa, Homo Sapiens
IFLSDGLVH

SEQ ID NO: 453434 - protein, 9 aa, Homo Sapiens
TFNNTIKEH

SEQ ID NO: 453435 - protein, 9 aa, Homo Sapiens
TYDKANIDL

SEQ ID NO: 453436 - protein, 9 aa, Homo Sapiens
CRSCLLSCN

SEQ ID NO: 453437 - protein, 9 aa, Homo Sapiens
TGNNLQEAE

SEQ ID NO: 453438 - protein, 9 aa, Homo Sapiens
KLFTGDVFG

SEQ ID NO: 453439 - protein, 9 aa, Homo Sapiens
MVLVGNNCD

SEQ ID NO: 453440 - protein, 9 aa, Homo Sapiens
YEAELERPQ

SEQ ID NO: 453441 - protein, 9 aa, Homo Sapiens
DQYKGDGSL

SEQ ID NO: 453442 - protein, 9 aa, Homo Sapiens
SICLTLKPE

SEQ ID NO: 453443 - protein, 9 aa, Homo Sapiens
DSSPLASRS

SEQ ID NO: 453444 - protein, 9 aa, Homo Sapiens
VVAADKANE

SEQ ID NO: 453445 - protein, 9 aa, Homo Sapiens
FSGMLERND

SEQ ID NO: 453446 - protein, 9 aa, Homo Sapiens
IFRNAIGNF

SEQ ID NO: 453447 - protein, 9 aa, Homo Sapiens
SMDTASHSL

SEQ ID NO: 453448 - protein, 9 aa, Homo Sapiens
RKTGTVYVA

SEQ ID NO: 453449 - protein, 9 aa, Homo Sapiens
EFQMLLGFQ

SEQ ID NO: 453450 - protein, 9 aa, Homo Sapiens
PPPPTQHSI

SEQ ID NO: 453451 - protein, 9 aa, Homo Sapiens
CEQKKENQG

SEQ ID NO: 453452 - protein, 9 aa, Homo Sapiens
FEIVVCHAK

SEQ ID NO: 453453 - protein, 9 aa, Homo Sapiens
PGEPGYAKY

SEQ ID NO: 453454 - protein, 9 aa, Homo Sapiens
ENNICCLTT

SEQ ID NO: 453455 - protein, 9 aa, Homo Sapiens
PAMNNVEFK

SEQ ID NO: 453456 - protein, 9 aa, Homo Sapiens
SDPGVAYFK

SEQ ID NO: 453457 - protein, 9 aa, Homo Sapiens
AVPGPVIRR

SEQ ID NO: 453458 - protein, 9 aa, Homo Sapiens
TYQCFVRKD

SEQ ID NO: 453459 - protein, 9 aa, Homo Sapiens
VALERLART

SEQ ID NO: 453460 - protein, 9 aa, Homo Sapiens
TLLDELYIE

SEQ ID NO: 453461 - protein, 9 aa, Homo Sapiens
LKILYALVQ

SEQ ID NO: 453462 - protein, 9 aa, Homo Sapiens
YYESVQTPG

SEQ ID NO: 453463 - protein, 9 aa, Homo Sapiens
DAINHLDDL

SEQ ID NO: 453464 - protein, 9 aa, Homo Sapiens
GYKLKEIDT

SEQ ID NO: 453465 - protein, 9 aa, Homo Sapiens
SNSLIKELH

SEQ ID NO: 453466 - protein, 9 aa, Homo Sapiens
INNKAASKR

SEQ ID NO: 453467 - protein, 9 aa, Homo Sapiens
KGRTQLKEL

SEQ ID NO: 453468 - protein, 9 aa, Homo Sapiens
PANCQIDRV

SEQ ID NO: 453469 - protein, 9 aa, Homo Sapiens
HFGLPASKM

SEQ ID NO: 453470 - protein, 9 aa, Homo Sapiens
EKPGFLTTP

SEQ ID NO: 453471 - protein, 9 aa, Homo Sapiens
KCVNFCTEK

SEQ ID NO: 453472 - protein, 9 aa, Homo Sapiens
KHGKNVPKY

SEQ ID NO: 453473 - protein, 9 aa, Homo Sapiens
RDESSGPNT

SEQ ID NO: 453474 - protein, 9 aa, Homo Sapiens
KPDEEDEIL

SEQ ID NO: 453475 - protein, 9 aa, Homo Sapiens
MGNIINEIG

SEQ ID NO: 453476 - protein, 9 aa, Homo Sapiens
RDRCSSLIE

SEQ ID NO: 453477 - protein, 9 aa, Homo Sapiens
CLAPIIYFF

SEQ ID NO: 453478 - protein, 9 aa, Homo Sapiens
GRVNNFLMF

SEQ ID NO: 453479 - protein, 9 aa, Homo Sapiens
TAPWSAALQ

SEQ ID NO: 453480 - protein, 9 aa, Homo Sapiens
NCQHSDLEA

SEQ ID NO: 453481 - protein, 9 aa, Homo Sapiens
KLLFVMFLI

SEQ ID NO: 453482 - protein, 9 aa, Homo Sapiens
ISSEENADD

SEQ ID NO: 453483 - protein, 9 aa, Homo Sapiens
KGGEMSSLA

SEQ ID NO: 453484 - protein, 9 aa, Homo Sapiens
TETSPTKYP

SEQ ID NO: 453485 - protein, 9 aa, Homo Sapiens
HVEQLNLMQ

SEQ ID NO: 453486 - protein, 9 aa, Homo Sapiens
MNQLDFEWK

SEQ ID NO: 453487 - protein, 9 aa, Homo Sapiens
ESLSSSKLD

SEQ ID NO: 453488 - protein, 9 aa, Homo Sapiens
VGNNCDLPS

SEQ ID NO: 453489 - protein, 9 aa, Homo Sapiens
WTRPSNLAV

SEQ ID NO: 453490 - protein, 9 aa, Homo Sapiens
SFNCLCETV

SEQ ID NO: 453491 - protein, 9 aa, Homo Sapiens
GLESRSKGH

SEQ ID NO: 453492 - protein, 9 aa, Homo Sapiens
KSTFCSQYI

SEQ ID NO: 453493 - protein, 9 aa, Homo Sapiens
KLKPLEEVL

SEQ ID NO: 453494 - protein, 9 aa, Homo Sapiens
IDGSFDIGN

SEQ ID NO: 453495 - protein, 9 aa, Homo Sapiens
TPCHSHTPT

SEQ ID NO: 453496 - protein, 9 aa, Homo Sapiens
SPLFFLTSS

SEQ ID NO: 453497 - protein, 9 aa, Homo Sapiens
DPKCIEDVG

SEQ ID NO: 453498 - protein, 9 aa, Homo Sapiens
RHGSGKENK

SEQ ID NO: 453499 - protein, 9 aa, Homo Sapiens
VLQVQRYQE

SEQ ID NO: 453500 - protein, 9 aa, Homo Sapiens
LWSLEYVVS

SEQ ID NO: 453501 - protein, 9 aa, Homo Sapiens
TSQGLCFNI

SEQ ID NO: 453502 - protein, 9 aa, Homo Sapiens
LSSSKLDTD

SEQ ID NO: 453503 - protein, 9 aa, Homo Sapiens
PRFPQPNYQ

SEQ ID NO: 453504 - protein, 9 aa, Homo Sapiens
IQSVQGMSL

SEQ ID NO: 453505 - protein, 9 aa, Homo Sapiens
GLEMLRLPV

SEQ ID NO: 453506 - protein, 9 aa, Homo Sapiens
AIKIAYCEN

SEQ ID NO: 453507 - protein, 9 aa, Homo Sapiens
YAFKTVLEE

SEQ ID NO: 453508 - protein, 9 aa, Homo Sapiens
GFDHKRLQY

SEQ ID NO: 453509 - protein, 9 aa, Homo Sapiens
NSLHTYLLS

SEQ ID NO: 453510 - protein, 9 aa, Homo Sapiens
EIIYSMCKK

SEQ ID NO: 453511 - protein, 9 aa, Homo Sapiens
HFCSDISVS

SEQ ID NO: 453512 - protein, 9 aa, Homo Sapiens
SDEADLVLV

SEQ ID NO: 453513 - protein, 9 aa, Homo Sapiens
SVSRSDPFT

SEQ ID NO: 453514 - protein, 9 aa, Homo Sapiens
EIIATKALH

SEQ ID NO: 453515 - protein, 9 aa, Homo Sapiens
SWSRVYLHT

SEQ ID NO: 453516 - protein, 9 aa, Homo Sapiens
KSEPKTPGE

SEQ ID NO: 453517 - protein, 9 aa, Homo Sapiens
YMLSLTSVQ

SEQ ID NO: 453518 - protein, 9 aa, Homo Sapiens
TIGMSLAKE

SEQ ID NO: 453519 - protein, 9 aa, Homo Sapiens
MSSLLRKFE

SEQ ID NO: 453520 - protein, 9 aa, Homo Sapiens
YEINADPIL

SEQ ID NO: 453521 - protein, 9 aa, Homo Sapiens
DLLRHNKSC

SEQ ID NO: 453522 - protein, 9 aa, Homo Sapiens
FDKEKAWKA

SEQ ID NO: 453523 - protein, 9 aa, Homo Sapiens
LLLWLYVQN

SEQ ID NO: 453524 - protein, 9 aa, Homo Sapiens
SGDISADFK

SEQ ID NO: 453525 - protein, 9 aa, Homo Sapiens
KVNIKLSNE

SEQ ID NO: 453526 - protein, 9 aa, Homo Sapiens
VVSWYLNGR

SEQ ID NO: 453527 - protein, 9 aa, Homo Sapiens
HVAQGEDDD

SEQ ID NO: 453528 - protein, 9 aa, Homo Sapiens
HFPKVIQCL

SEQ ID NO: 453529 - protein, 9 aa, Homo Sapiens
CETHNQTAC

SEQ ID NO: 453530 - protein, 9 aa, Homo Sapiens
EKHIEALHA

SEQ ID NO: 453531 - protein, 9 aa, Homo Sapiens
NQKPVGKYH

SEQ ID NO: 453532 - protein, 9 aa, Homo Sapiens
PPLEAEYTD

SEQ ID NO: 453533 - protein, 9 aa, Homo Sapiens
GKVCYLEYA

SEQ ID NO: 453534 - protein, 9 aa, Homo Sapiens
QLYKCHPDI

SEQ ID NO: 453535 - protein, 9 aa, Homo Sapiens
PQEFYTEDL

SEQ ID NO: 453536 - protein, 9 aa, Homo Sapiens
EGANDSYDF

SEQ ID NO: 453537 - protein, 9 aa, Homo Sapiens
ENKPGRRAE

SEQ ID NO: 453538 - protein, 9 aa, Homo Sapiens
LDSVDAFQH

SEQ ID NO: 453539 - protein, 9 aa, Homo Sapiens
FDAFMKAIG

SEQ ID NO: 453540 - protein, 9 aa, Homo Sapiens
MSPQHFTSL

SEQ ID NO: 453541 - protein, 9 aa, Homo Sapiens
ELKNGNLEV

SEQ ID NO: 453542 - protein, 9 aa, Homo Sapiens
KELIDTMMS

SEQ ID NO: 453543 - protein, 9 aa, Homo Sapiens
RKKKCVCYI

SEQ ID NO: 453544 - protein, 9 aa, Homo Sapiens
KVEDAILEG

SEQ ID NO: 453545 - protein, 9 aa, Homo Sapiens
PTGSFERTL

SEQ ID NO: 453546 - protein, 9 aa, Homo Sapiens
SSEKGSVGS

SEQ ID NO: 453547 - protein, 9 aa, Homo Sapiens
YVNRPFPVL

SEQ ID NO: 453548 - protein, 9 aa, Homo Sapiens
LLFLLQCYF

SEQ ID NO: 453549 - protein, 9 aa, Homo Sapiens
AYDRYLSIC

SEQ ID NO: 453550 - protein, 9 aa, Homo Sapiens
LVAVVVWKI

SEQ ID NO: 453551 - protein, 9 aa, Homo Sapiens
EVINLQCNA

SEQ ID NO: 453552 - protein, 9 aa, Homo Sapiens
MYDVTPPSV

SEQ ID NO: 453553 - protein, 9 aa, Homo Sapiens
HGIDTDHAA

SEQ ID NO: 453554 - protein, 9 aa, Homo Sapiens
DETELALVK

SEQ ID NO: 453555 - protein, 9 aa, Homo Sapiens
FHPQSHFLY

SEQ ID NO: 453556 - protein, 9 aa, Homo Sapiens
DGWVAVGLS

SEQ ID NO: 453557 - protein, 9 aa, Homo Sapiens
FKMESGEED

SEQ ID NO: 453558 - protein, 9 aa, Homo Sapiens
QTVQNNKRY

SEQ ID NO: 453559 - protein, 9 aa, Homo Sapiens
QQIQILLLG

SEQ ID NO: 453560 - protein, 9 aa, Homo Sapiens
QAQHQIKEM

SEQ ID NO: 453561 - protein, 9 aa, Homo Sapiens
ENYFLSFVK

SEQ ID NO: 453562 - protein, 9 aa, Homo Sapiens
SSFQIHEIM

SEQ ID NO: 453563 - protein, 9 aa, Homo Sapiens
CHWLAMSLA

SEQ ID NO: 453564 - protein, 9 aa, Homo Sapiens
AQPDQYEAS

SEQ ID NO: 453565 - protein, 9 aa, Homo Sapiens
RHPEINLAI

SEQ ID NO: 453566 - protein, 9 aa, Homo Sapiens
IEPTITRIA

SEQ ID NO: 453567 - protein, 9 aa, Homo Sapiens
HLSFCMSNV

SEQ ID NO: 453568 - protein, 9 aa, Homo Sapiens
FVTSYLGGT

SEQ ID NO: 453569 - protein, 9 aa, Homo Sapiens
LHFFAPDYG

SEQ ID NO: 453570 - protein, 9 aa, Homo Sapiens
AQLNYKYGK

SEQ ID NO: 453571 - protein, 9 aa, Homo Sapiens
SLQSRDEER

SEQ ID NO: 453572 - protein, 9 aa, Homo Sapiens
IGEYKAIMC

SEQ ID NO: 453573 - protein, 9 aa, Homo Sapiens
NVKQCFNNQ

SEQ ID NO: 453574 - protein, 9 aa, Homo Sapiens
FNKWENYFL

SEQ ID NO: 453575 - protein, 9 aa, Homo Sapiens
KFQWIRVKH

SEQ ID NO: 453576 - protein, 9 aa, Homo Sapiens
ELVGVATDG

SEQ ID NO: 453577 - protein, 9 aa, Homo Sapiens
SGSVLDCVN

SEQ ID NO: 453578 - protein, 9 aa, Homo Sapiens
LPLDNLKVW

SEQ ID NO: 453579 - protein, 9 aa, Homo Sapiens
LNEKNYVAS

SEQ ID NO: 453580 - protein, 9 aa, Homo Sapiens
DETLLDELY

SEQ ID NO: 453581 - protein, 9 aa, Homo Sapiens
WEKKEECVQ

SEQ ID NO: 453582 - protein, 9 aa, Homo Sapiens
VEVIMCVCV

SEQ ID NO: 453583 - protein, 9 aa, Homo Sapiens
IQLYDYEIT

SEQ ID NO: 453584 - protein, 9 aa, Homo Sapiens
VYLTWSVPN

SEQ ID NO: 453585 - protein, 9 aa, Homo Sapiens
CDISNKYIN

SEQ ID NO: 453586 - protein, 9 aa, Homo Sapiens
HPNQLVLIF

SEQ ID NO: 453587 - protein, 9 aa, Homo Sapiens
QLERIFLVI

SEQ ID NO: 453588 - protein, 9 aa, Homo Sapiens
IQIYFDTRI

SEQ ID NO: 453589 - protein, 9 aa, Homo Sapiens
LKCPMNLLA

SEQ ID NO: 453590 - protein, 9 aa, Homo Sapiens
REMAKVVAD

SEQ ID NO: 453591 - protein, 9 aa, Homo Sapiens
KEADKFGQG

SEQ ID NO: 453592 - protein, 9 aa, Homo Sapiens
CKTFFSDVS

SEQ ID NO: 453593 - protein, 9 aa, Homo Sapiens
EWQRLARLW

SEQ ID NO: 453594 - protein, 9 aa, Homo Sapiens
QENDKDNLN

SEQ ID NO: 453595 - protein, 9 aa, Homo Sapiens
PLQIPLKCP

SEQ ID NO: 453596 - protein, 9 aa, Homo Sapiens
GPGAMSATR

SEQ ID NO: 453597 - protein, 9 aa, Homo Sapiens
CTVCNEFLV

SEQ ID NO: 453598 - protein, 9 aa, Homo Sapiens
HFKQALREY

SEQ ID NO: 453599 - protein, 9 aa, Homo Sapiens
ENIHNKLEF

SEQ ID NO: 453600 - protein, 9 aa, Homo Sapiens
FQSYAQVMC

SEQ ID NO: 453601 - protein, 9 aa, Homo Sapiens
YLRCNYKVD

SEQ ID NO: 453602 - protein, 9 aa, Homo Sapiens
DDLKDEAKQ

SEQ ID NO: 453603 - protein, 9 aa, Homo Sapiens
FRNNFDKIT

SEQ ID NO: 453604 - protein, 9 aa, Homo Sapiens
EQEVKMWRQ

SEQ ID NO: 453605 - protein, 9 aa, Homo Sapiens
VCGLPDRNT

SEQ ID NO: 453606 - protein, 9 aa, Homo Sapiens
LCKDNIYPT

SEQ ID NO: 453607 - protein, 9 aa, Homo Sapiens
AYLLNSQYY

SEQ ID NO: 453608 - protein, 9 aa, Homo Sapiens
KICECNHVE

SEQ ID NO: 453609 - protein, 9 aa, Homo Sapiens
EKHQDVLIQ

SEQ ID NO: 453610 - protein, 9 aa, Homo Sapiens
ESDCGDFPN

SEQ ID NO: 453611 - protein, 9 aa, Homo Sapiens
TNPYNYAFV

SEQ ID NO: 453612 - protein, 9 aa, Homo Sapiens
SSDIEVEAS

SEQ ID NO: 453613 - protein, 9 aa, Homo Sapiens
SSTITRDMY

SEQ ID NO: 453614 - protein, 9 aa, Homo Sapiens
QIKVSPEFS

SEQ ID NO: 453615 - protein, 9 aa, Homo Sapiens
LLLLEGIKK

SEQ ID NO: 453616 - protein, 9 aa, Homo Sapiens
DFTVVSPAE

SEQ ID NO: 453617 - protein, 9 aa, Homo Sapiens
CKALKEQRL

SEQ ID NO: 453618 - protein, 9 aa, Homo Sapiens
LVLIGYAFK

SEQ ID NO: 453619 - protein, 9 aa, Homo Sapiens
FECEQKKEN

SEQ ID NO: 453620 - protein, 9 aa, Homo Sapiens
TLETLTEYF

SEQ ID NO: 453621 - protein, 9 aa, Homo Sapiens
AASPGHCLP

SEQ ID NO: 453622 - protein, 9 aa, Homo Sapiens
VGEDSEDEE

SEQ ID NO: 453623 - protein, 9 aa, Homo Sapiens
AGSTTPLFT

SEQ ID NO: 453624 - protein, 9 aa, Homo Sapiens
NNPYLLTSN

SEQ ID NO: 453625 - protein, 9 aa, Homo Sapiens
WFQLYRSTN

SEQ ID NO: 453626 - protein, 9 aa, Homo Sapiens
YDVMKYFEE

SEQ ID NO: 453627 - protein, 9 aa, Homo Sapiens
LLANLLLNC

SEQ ID NO: 453628 - protein, 9 aa, Homo Sapiens
LTEHKIIHS

SEQ ID NO: 453629 - protein, 9 aa, Homo Sapiens
RGMDVRRRK

SEQ ID NO: 453630 - protein, 9 aa, Homo Sapiens
ESNSSDTPS

SEQ ID NO: 453631 - protein, 9 aa, Homo Sapiens
IFEEAAVID

SEQ ID NO: 453632 - protein, 9 aa, Homo Sapiens
QSAPVRLVL

SEQ ID NO: 453633 - protein, 9 aa, Homo Sapiens
ERKYSVWMG

SEQ ID NO: 453634 - protein, 9 aa, Homo Sapiens
SHDPSDLVR

SEQ ID NO: 453635 - protein, 9 aa, Homo Sapiens
YHKAGTVMF

SEQ ID NO: 453636 - protein, 9 aa, Homo Sapiens
MVKQSELFN

SEQ ID NO: 453637 - protein, 9 aa, Homo Sapiens
HLLRSEGAE

SEQ ID NO: 453638 - protein, 9 aa, Homo Sapiens
LVNVVCHTC

SEQ ID NO: 453639 - protein, 9 aa, Homo Sapiens
LIHNNLKDV

SEQ ID NO: 453640 - protein, 9 aa, Homo Sapiens
KGDIGKEMH

SEQ ID NO: 453641 - protein, 9 aa, Homo Sapiens
LMRPKTCGL

SEQ ID NO: 453642 - protein, 9 aa, Homo Sapiens
KAKYLGFKM

SEQ ID NO: 453643 - protein, 9 aa, Homo Sapiens
LSQKLTRQL

SEQ ID NO: 453644 - protein, 9 aa, Homo Sapiens
KVLTFNLTK

SEQ ID NO: 453645 - protein, 9 aa, Homo Sapiens
WTFDINTGA

SEQ ID NO: 453646 - protein, 9 aa, Homo Sapiens
LKYIFDFEK

SEQ ID NO: 453647 - protein, 9 aa, Homo Sapiens
HPGRGMDVR

SEQ ID NO: 453648 - protein, 9 aa, Homo Sapiens
ICTLGLQHI

SEQ ID NO: 453649 - protein, 9 aa, Homo Sapiens
GPVIRRARL

SEQ ID NO: 453650 - protein, 9 aa, Homo Sapiens
SLLNAFFRG

SEQ ID NO: 453651 - protein, 9 aa, Homo Sapiens
RKAEEERLC

SEQ ID NO: 453652 - protein, 9 aa, Homo Sapiens
DPEDESKVT

SEQ ID NO: 453653 - protein, 9 aa, Homo Sapiens
MFISFVMGA

SEQ ID NO: 453654 - protein, 9 aa, Homo Sapiens
PMDCINICT

SEQ ID NO: 453655 - protein, 9 aa, Homo Sapiens
STGLAQHLG

SEQ ID NO: 453656 - protein, 9 aa, Homo Sapiens
GGSANSFQA

SEQ ID NO: 453657 - protein, 9 aa, Homo Sapiens
KRVIQYFVV

SEQ ID NO: 453658 - protein, 9 aa, Homo Sapiens
VTLEDINYN

SEQ ID NO: 453659 - protein, 9 aa, Homo Sapiens
TELKLEEKN

SEQ ID NO: 453660 - protein, 9 aa, Homo Sapiens
KRGSFLTGK

SEQ ID NO: 453661 - protein, 9 aa, Homo Sapiens
FFPAECGNS

SEQ ID NO: 453662 - protein, 9 aa, Homo Sapiens
QAAETQRGF

SEQ ID NO: 453663 - protein, 9 aa, Homo Sapiens
ADSDQDTNT

SEQ ID NO: 453664 - protein, 9 aa, Homo Sapiens
VHDQNIKEA

SEQ ID NO: 453665 - protein, 9 aa, Homo Sapiens
VNFKELIDT

SEQ ID NO: 453666 - protein, 9 aa, Homo Sapiens
IKKAWDDLN

SEQ ID NO: 453667 - protein, 9 aa, Homo Sapiens
NEVEKITRR

SEQ ID NO: 453668 - protein, 9 aa, Homo Sapiens
APHLSLPLR

SEQ ID NO: 453669 - protein, 9 aa, Homo Sapiens
NGSVETNNL

SEQ ID NO: 453670 - protein, 9 aa, Homo Sapiens
TLTEYFQGP

SEQ ID NO: 453671 - protein, 9 aa, Homo Sapiens
LFNGASESG

SEQ ID NO: 453672 - protein, 9 aa, Homo Sapiens
FKLIEDTPI

SEQ ID NO: 453673 - protein, 9 aa, Homo Sapiens
SEAPNEKFF

SEQ ID NO: 453674 - protein, 9 aa, Homo Sapiens
LQSRDEERI

SEQ ID NO: 453675 - protein, 9 aa, Homo Sapiens
QQPQIMDEA

SEQ ID NO: 453676 - protein, 9 aa, Homo Sapiens
YLLEEIHLW

SEQ ID NO: 453677 - protein, 9 aa, Homo Sapiens
LHYKYGFDL

SEQ ID NO: 453678 - protein, 9 aa, Homo Sapiens
AAGKNTLVS

SEQ ID NO: 453679 - protein, 9 aa, Homo Sapiens
NFQKSMDSI

SEQ ID NO: 453680 - protein, 9 aa, Homo Sapiens
VDKSYLCSE

SEQ ID NO: 453681 - protein, 9 aa, Homo Sapiens
LKIIILKMK

SEQ ID NO: 453682 - protein, 9 aa, Homo Sapiens
WRDCSHGAE

SEQ ID NO: 453683 - protein, 9 aa, Homo Sapiens
KINCQLKCQ

SEQ ID NO: 453684 - protein, 9 aa, Homo Sapiens
PLNQLLDGP

SEQ ID NO: 453685 - protein, 9 aa, Homo Sapiens
SSSSSLSRQ

SEQ ID NO: 453686 - protein, 9 aa, Homo Sapiens
EQIGADKLL

SEQ ID NO: 453687 - protein, 9 aa, Homo Sapiens
CTGDGKNCA

SEQ ID NO: 453688 - protein, 9 aa, Homo Sapiens
VEKWCCDYF

SEQ ID NO: 453689 - protein, 9 aa, Homo Sapiens
FEIQWISNH

SEQ ID NO: 453690 - protein, 9 aa, Homo Sapiens
SVNYKGLRV

SEQ ID NO: 453691 - protein, 9 aa, Homo Sapiens
SKKVVQLEQ

SEQ ID NO: 453692 - protein, 9 aa, Homo Sapiens
RVVKELNHL

SEQ ID NO: 453693 - protein, 9 aa, Homo Sapiens
TANFVELGD

SEQ ID NO: 453694 - protein, 9 aa, Homo Sapiens
LEEQNLLLI

SEQ ID NO: 453695 - protein, 9 aa, Homo Sapiens
DFTKLQKAL

SEQ ID NO: 453696 - protein, 9 aa, Homo Sapiens
KDKSFGIQM

SEQ ID NO: 453697 - protein, 9 aa, Homo Sapiens
SSPFIVYLA

SEQ ID NO: 453698 - protein, 9 aa, Homo Sapiens
KESIKYGPE

SEQ ID NO: 453699 - protein, 9 aa, Homo Sapiens
VAKPLGGSH

SEQ ID NO: 453700 - protein, 9 aa, Homo Sapiens
NLLHQQLKW

SEQ ID NO: 453701 - protein, 9 aa, Homo Sapiens
TLKFQAGFI

SEQ ID NO: 453702 - protein, 9 aa, Homo Sapiens
TTCFVDAGN

SEQ ID NO: 453703 - protein, 9 aa, Homo Sapiens
IKEGSYSSL

SEQ ID NO: 453704 - protein, 9 aa, Homo Sapiens
TLLLNPKHP

SEQ ID NO: 453705 - protein, 9 aa, Homo Sapiens
QEIIDWLSH

SEQ ID NO: 453706 - protein, 9 aa, Homo Sapiens
PHYFLGAYK

SEQ ID NO: 453707 - protein, 9 aa, Homo Sapiens
EECRDKLIK

SEQ ID NO: 453708 - protein, 9 aa, Homo Sapiens
EGVACVHKE

SEQ ID NO: 453709 - protein, 9 aa, Homo Sapiens
ALKNAFYLL

SEQ ID NO: 453710 - protein, 9 aa, Homo Sapiens
LMFAVSGIC

SEQ ID NO: 453711 - protein, 9 aa, Homo Sapiens
ICHANCKHK

SEQ ID NO: 453712 - protein, 9 aa, Homo Sapiens
AVLEQIGAD

SEQ ID NO: 453713 - protein, 9 aa, Homo Sapiens
YLFNGASES

SEQ ID NO: 453714 - protein, 9 aa, Homo Sapiens
SNLSDVNTN

SEQ ID NO: 453715 - protein, 9 aa, Homo Sapiens
AAYLKKTCS

SEQ ID NO: 453716 - protein, 9 aa, Homo Sapiens
NIRINEDST

SEQ ID NO: 453717 - protein, 9 aa, Homo Sapiens
GVTVLAFAI

SEQ ID NO: 453718 - protein, 9 aa, Homo Sapiens
AKFGLKSLA

SEQ ID NO: 453719 - protein, 9 aa, Homo Sapiens
INSLRITAE

SEQ ID NO: 453720 - protein, 9 aa, Homo Sapiens
AFKLFQKDR

SEQ ID NO: 453721 - protein, 9 aa, Homo Sapiens
VKVVFDKDV

SEQ ID NO: 453722 - protein, 9 aa, Homo Sapiens
SRPDDDPPP

SEQ ID NO: 453723 - protein, 9 aa, Homo Sapiens
TISVLSFII

SEQ ID NO: 453724 - protein, 9 aa, Homo Sapiens
NMQSLGLWA

SEQ ID NO: 453725 - protein, 9 aa, Homo Sapiens
DIIQQDFLD

SEQ ID NO: 453726 - protein, 9 aa, Homo Sapiens
LYGLDLDCG

SEQ ID NO: 453727 - protein, 9 aa, Homo Sapiens
ELYLSLILL

SEQ ID NO: 453728 - protein, 9 aa, Homo Sapiens
FFPHIPHPS

SEQ ID NO: 453729 - protein, 9 aa, Homo Sapiens
LAFSELYLS

SEQ ID NO: 453730 - protein, 9 aa, Homo Sapiens
TIDNGVKTT

SEQ ID NO: 453731 - protein, 9 aa, Homo Sapiens
PYFETSATT

SEQ ID NO: 453732 - protein, 9 aa, Homo Sapiens
KVPEMPRAG

SEQ ID NO: 453733 - protein, 9 aa, Homo Sapiens
WPKNGQCDM

SEQ ID NO: 453734 - protein, 9 aa, Homo Sapiens
RKAFVSTKI

SEQ ID NO: 453735 - protein, 9 aa, Homo Sapiens
SPNISNVKV

SEQ ID NO: 453736 - protein, 9 aa, Homo Sapiens
PMVHGPKPE

SEQ ID NO: 453737 - protein, 9 aa, Homo Sapiens
RNCLAEIPY

SEQ ID NO: 453738 - protein, 9 aa, Homo Sapiens
QPVLEEGRK

SEQ ID NO: 453739 - protein, 9 aa, Homo Sapiens
VLTEVYSEN

SEQ ID NO: 453740 - protein, 9 aa, Homo Sapiens
FSWRVFQFQ

SEQ ID NO: 453741 - protein, 9 aa, Homo Sapiens
VIFCGDCNS

SEQ ID NO: 453742 - protein, 9 aa, Homo Sapiens
LWKKLIEQM

SEQ ID NO: 453743 - protein, 9 aa, Homo Sapiens
CWKIQIFLL

SEQ ID NO: 453744 - protein, 9 aa, Homo Sapiens
FVDLPFPDG

SEQ ID NO: 453745 - protein, 9 aa, Homo Sapiens
ESRSKGHRS

SEQ ID NO: 453746 - protein, 9 aa, Homo Sapiens
QNVPPPKSP

SEQ ID NO: 453747 - protein, 9 aa, Homo Sapiens
MPHSSSTKL

SEQ ID NO: 453748 - protein, 9 aa, Homo Sapiens
ERRNMQTIW

SEQ ID NO: 453749 - protein, 9 aa, Homo Sapiens
TVPNQFQCK

SEQ ID NO: 453750 - protein, 9 aa, Homo Sapiens
TAKKQDNNK

SEQ ID NO: 453751 - protein, 9 aa, Homo Sapiens
IGLDLPDLN

SEQ ID NO: 453752 - protein, 9 aa, Homo Sapiens
PLVLIEHFF

SEQ ID NO: 453753 - protein, 9 aa, Homo Sapiens
EMEVSWNVI

SEQ ID NO: 453754 - protein, 9 aa, Homo Sapiens
ALVPCSWKR

SEQ ID NO: 453755 - protein, 9 aa, Homo Sapiens
HQVNKAMLR

SEQ ID NO: 453756 - protein, 9 aa, Homo Sapiens
PPSSELLDL

SEQ ID NO: 453757 - protein, 9 aa, Homo Sapiens
EAQMELPEQ

SEQ ID NO: 453758 - protein, 9 aa, Homo Sapiens
KFDTTCTPL

SEQ ID NO: 453759 - protein, 9 aa, Homo Sapiens
LKAVFAQTH

SEQ ID NO: 453760 - protein, 9 aa, Homo Sapiens
IGFNGNQIV

SEQ ID NO: 453761 - protein, 9 aa, Homo Sapiens
FHNMYHSQM

SEQ ID NO: 453762 - protein, 9 aa, Homo Sapiens
LFNEMAERH

SEQ ID NO: 453763 - protein, 9 aa, Homo Sapiens
IYSRHHSLS

SEQ ID NO: 453764 - protein, 9 aa, Homo Sapiens
LSLHCETNL

SEQ ID NO: 453765 - protein, 9 aa, Homo Sapiens
FVHQIPPSY

SEQ ID NO: 453766 - protein, 9 aa, Homo Sapiens
DDPPGQFDS

SEQ ID NO: 453767 - protein, 9 aa, Homo Sapiens
WKVFNSSYV

SEQ ID NO: 453768 - protein, 9 aa, Homo Sapiens
KMTYPHQVV

SEQ ID NO: 453769 - protein, 9 aa, Homo Sapiens
RHTKFGYGV

SEQ ID NO: 453770 - protein, 9 aa, Homo Sapiens
LHPFMVNAT

SEQ ID NO: 453771 - protein, 9 aa, Homo Sapiens
SKYEVVDAL

SEQ ID NO: 453772 - protein, 9 aa, Homo Sapiens
KQINDAHHG

SEQ ID NO: 453773 - protein, 9 aa, Homo Sapiens
FLSDGLVHD

SEQ ID NO: 453774 - protein, 9 aa, Homo Sapiens
ERLEPDSSP

SEQ ID NO: 453775 - protein, 9 aa, Homo Sapiens
EAAKFRQLW

SEQ ID NO: 453776 - protein, 9 aa, Homo Sapiens
LEHRDVIGL

SEQ ID NO: 453777 - protein, 9 aa, Homo Sapiens
LKRQLYDNK

SEQ ID NO: 453778 - protein, 9 aa, Homo Sapiens
VKYLATLDT

SEQ ID NO: 453779 - protein, 9 aa, Homo Sapiens
KTSFFFEAR

SEQ ID NO: 453780 - protein, 9 aa, Homo Sapiens
KKGFIQIIS

SEQ ID NO: 453781 - protein, 9 aa, Homo Sapiens
DKYVLRDVW

SEQ ID NO: 453782 - protein, 9 aa, Homo Sapiens
KNIHFLVIL

SEQ ID NO: 453783 - protein, 9 aa, Homo Sapiens
MSCQEVITN

SEQ ID NO: 453784 - protein, 9 aa, Homo Sapiens
DEMEIKINY

SEQ ID NO: 453785 - protein, 9 aa, Homo Sapiens
HTEAAVRFV

SEQ ID NO: 453786 - protein, 9 aa, Homo Sapiens
IESNTPAPS

SEQ ID NO: 453787 - protein, 9 aa, Homo Sapiens
QKRSLDIGK

SEQ ID NO: 453788 - protein, 9 aa, Homo Sapiens
AAPAKGNLF

SEQ ID NO: 453789 - protein, 9 aa, Homo Sapiens
RNNRPQELC

SEQ ID NO: 453790 - protein, 9 aa, Homo Sapiens
RDNELSGGV

SEQ ID NO: 453791 - protein, 9 aa, Homo Sapiens
TEAIKAASG

SEQ ID NO: 453792 - protein, 9 aa, Homo Sapiens
LYEIMRKQP

SEQ ID NO: 453793 - protein, 9 aa, Homo Sapiens
VKFILEKGA

SEQ ID NO: 453794 - protein, 9 aa, Homo Sapiens
EYLIARGKL

SEQ ID NO: 453795 - protein, 9 aa, Homo Sapiens
EDYVIQLVY

SEQ ID NO: 453796 - protein, 9 aa, Homo Sapiens
LEGRNEMAA

SEQ ID NO: 453797 - protein, 9 aa, Homo Sapiens
PPGFKRLSC

SEQ ID NO: 453798 - protein, 9 aa, Homo Sapiens
GINSATPIN

SEQ ID NO: 453799 - protein, 9 aa, Homo Sapiens
FEGINIDFK

SEQ ID NO: 453800 - protein, 9 aa, Homo Sapiens
ARFHCKRIN

SEQ ID NO: 453801 - protein, 9 aa, Homo Sapiens
VTFEYVAID

SEQ ID NO: 453802 - protein, 9 aa, Homo Sapiens
NKPGRRAEE

SEQ ID NO: 453803 - protein, 9 aa, Homo Sapiens
IQIHERINT

SEQ ID NO: 453804 - protein, 9 aa, Homo Sapiens
FTSLWPTMI

SEQ ID NO: 453805 - protein, 9 aa, Homo Sapiens
GSPMINRTS

SEQ ID NO: 453806 - protein, 9 aa, Homo Sapiens
NSVVTKSAN

SEQ ID NO: 453807 - protein, 9 aa, Homo Sapiens
TGVQRFQDT

SEQ ID NO: 453808 - protein, 9 aa, Homo Sapiens
LSNEQGLPG

SEQ ID NO: 453809 - protein, 9 aa, Homo Sapiens
QRISGNTSQ

SEQ ID NO: 453810 - protein, 9 aa, Homo Sapiens
GIVTLDEFI

SEQ ID NO: 453811 - protein, 9 aa, Homo Sapiens
ISVQVSEAN

SEQ ID NO: 453812 - protein, 9 aa, Homo Sapiens
LDTGTCHIC

SEQ ID NO: 453813 - protein, 9 aa, Homo Sapiens
KIYGVDSSA

SEQ ID NO: 453814 - protein, 9 aa, Homo Sapiens
QMELPEQQV

SEQ ID NO: 453815 - protein, 9 aa, Homo Sapiens
EGAVLDEAN

SEQ ID NO: 453816 - protein, 9 aa, Homo Sapiens
LIESGHLTD

SEQ ID NO: 453817 - protein, 9 aa, Homo Sapiens
RVERSMKEA

SEQ ID NO: 453818 - protein, 9 aa, Homo Sapiens
KGTRGPLGA

SEQ ID NO: 453819 - protein, 9 aa, Homo Sapiens
SPPYSVHSF

SEQ ID NO: 453820 - protein, 9 aa, Homo Sapiens
NTMFCQLAK

SEQ ID NO: 453821 - protein, 9 aa, Homo Sapiens
KYMSSQYLF

SEQ ID NO: 453822 - protein, 9 aa, Homo Sapiens
ETWNISINL

SEQ ID NO: 453823 - protein, 9 aa, Homo Sapiens
KEKAVKSEE

SEQ ID NO: 453824 - protein, 9 aa, Homo Sapiens
QNCEFKATM

SEQ ID NO: 453825 - protein, 9 aa, Homo Sapiens
GDCLIRHRA

SEQ ID NO: 453826 - protein, 9 aa, Homo Sapiens
PILGVMLTS

SEQ ID NO: 453827 - protein, 9 aa, Homo Sapiens
ETVDAAIFH

SEQ ID NO: 453828 - protein, 9 aa, Homo Sapiens
FQLHQGGKI

SEQ ID NO: 453829 - protein, 9 aa, Homo Sapiens
AGYFHFTAE

SEQ ID NO: 453830 - protein, 9 aa, Homo Sapiens
GSNTPLQSS

SEQ ID NO: 453831 - protein, 9 aa, Homo Sapiens
NVFNKHDGA

SEQ ID NO: 453832 - protein, 9 aa, Homo Sapiens
ITSLISQTA

SEQ ID NO: 453833 - protein, 9 aa, Homo Sapiens
NCIGLSQGN

SEQ ID NO: 453834 - protein, 9 aa, Homo Sapiens
NTNRVTLNY

SEQ ID NO: 453835 - protein, 9 aa, Homo Sapiens
SEIKDLNIH

SEQ ID NO: 453836 - protein, 9 aa, Homo Sapiens
SNIFGFLGG

SEQ ID NO: 453837 - protein, 9 aa, Homo Sapiens
DGICHGLWI

SEQ ID NO: 453838 - protein, 9 aa, Homo Sapiens
EFGNNNLHI

SEQ ID NO: 453839 - protein, 9 aa, Homo Sapiens
SPSQDSLDV

SEQ ID NO: 453840 - protein, 9 aa, Homo Sapiens
ARIQYFVRG

SEQ ID NO: 453841 - protein, 9 aa, Homo Sapiens
QSVQGMSLP

SEQ ID NO: 453842 - protein, 9 aa, Homo Sapiens
AATAVVENS

SEQ ID NO: 453843 - protein, 9 aa, Homo Sapiens
YYPEADHEC

SEQ ID NO: 453844 - protein, 9 aa, Homo Sapiens
RQQLDYLRA

SEQ ID NO: 453845 - protein, 9 aa, Homo Sapiens
CGCGSGYYY

SEQ ID NO: 453846 - protein, 9 aa, Homo Sapiens
PTFAVTAQG

SEQ ID NO: 453847 - protein, 9 aa, Homo Sapiens
KNKTTKPLD

SEQ ID NO: 453848 - protein, 9 aa, Homo Sapiens
KLRNTLCFL

SEQ ID NO: 453849 - protein, 9 aa, Homo Sapiens
YGTYSPVDS

SEQ ID NO: 453850 - protein, 9 aa, Homo Sapiens
GVAYFKVAH

SEQ ID NO: 453851 - protein, 9 aa, Homo Sapiens
DFVSAKMDD

SEQ ID NO: 453852 - protein, 9 aa, Homo Sapiens
SECAPHLSL

SEQ ID NO: 453853 - protein, 9 aa, Homo Sapiens
ACGSENNYL

SEQ ID NO: 453854 - protein, 9 aa, Homo Sapiens
FQEYGTAGV

SEQ ID NO: 453855 - protein, 9 aa, Homo Sapiens
QVLARIIGL

SEQ ID NO: 453856 - protein, 9 aa, Homo Sapiens
KPLNFFNVT

SEQ ID NO: 453857 - protein, 9 aa, Homo Sapiens
CRESYQQEA

SEQ ID NO: 453858 - protein, 9 aa, Homo Sapiens
HSDQLTLHQ

SEQ ID NO: 453859 - protein, 9 aa, Homo Sapiens
FEAKIIEAK

SEQ ID NO: 453860 - protein, 9 aa, Homo Sapiens
PILHAFFID

SEQ ID NO: 453861 - protein, 9 aa, Homo Sapiens
ALAIYLILA

SEQ ID NO: 453862 - protein, 9 aa, Homo Sapiens
YKFMALVYA

SEQ ID NO: 453863 - protein, 9 aa, Homo Sapiens
NITNKQKMD

SEQ ID NO: 453864 - protein, 9 aa, Homo Sapiens
NKSIVKYSV

SEQ ID NO: 453865 - protein, 9 aa, Homo Sapiens
RFNEPGSQY

SEQ ID NO: 453866 - protein, 9 aa, Homo Sapiens
CMMSSHLHK

SEQ ID NO: 453867 - protein, 9 aa, Homo Sapiens
RDKLLKQMR

SEQ ID NO: 453868 - protein, 9 aa, Homo Sapiens
YRIRAQKKK

SEQ ID NO: 453869 - protein, 9 aa, Homo Sapiens
SWKCMFFER

SEQ ID NO: 453870 - protein, 9 aa, Homo Sapiens
YLNSSGSYW

SEQ ID NO: 453871 - protein, 9 aa, Homo Sapiens
KCVCYIQGE

SEQ ID NO: 453872 - protein, 9 aa, Homo Sapiens
VNMFQTLPP

SEQ ID NO: 453873 - protein, 9 aa, Homo Sapiens
YLTGPDRCK

SEQ ID NO: 453874 - protein, 9 aa, Homo Sapiens
KQPLPSQRS

SEQ ID NO: 453875 - protein, 9 aa, Homo Sapiens
ICTVCLLAV

SEQ ID NO: 453876 - protein, 9 aa, Homo Sapiens
QKRRKQLLL

SEQ ID NO: 453877 - protein, 9 aa, Homo Sapiens
VNKSTSQGL

SEQ ID NO: 453878 - protein, 9 aa, Homo Sapiens
YRYLKARQA

SEQ ID NO: 453879 - protein, 9 aa, Homo Sapiens
MKLMVIPLV

SEQ ID NO: 453880 - protein, 9 aa, Homo Sapiens
EAAEEDRDK

SEQ ID NO: 453881 - protein, 9 aa, Homo Sapiens
EIILGVLKR

SEQ ID NO: 453882 - protein, 9 aa, Homo Sapiens
ALHHLHQFQ

SEQ ID NO: 453883 - protein, 9 aa, Homo Sapiens
VTTLSYFAF

SEQ ID NO: 453884 - protein, 9 aa, Homo Sapiens
ASTVFITSD

SEQ ID NO: 453885 - protein, 9 aa, Homo Sapiens
KDTRFSHPS

SEQ ID NO: 453886 - protein, 9 aa, Homo Sapiens
TTAAQENPS

SEQ ID NO: 453887 - protein, 9 aa, Homo Sapiens
SNLELWVNY

SEQ ID NO: 453888 - protein, 9 aa, Homo Sapiens
PKPAKTANK

SEQ ID NO: 453889 - protein, 9 aa, Homo Sapiens
CLWCFMNNI

SEQ ID NO: 453890 - protein, 9 aa, Homo Sapiens
TRVCFSDNA

SEQ ID NO: 453891 - protein, 9 aa, Homo Sapiens
TSLGIRPNY

SEQ ID NO: 453892 - protein, 9 aa, Homo Sapiens
AAWEVDSGC

SEQ ID NO: 453893 - protein, 9 aa, Homo Sapiens
TLYTSYYTN

SEQ ID NO: 453894 - protein, 9 aa, Homo Sapiens
FPHFYFLSN

SEQ ID NO: 453895 - protein, 9 aa, Homo Sapiens
VKKKEDLHP

SEQ ID NO: 453896 - protein, 9 aa, Homo Sapiens
TAAIQADLE

SEQ ID NO: 453897 - protein, 9 aa, Homo Sapiens
RGSGHQKVG

SEQ ID NO: 453898 - protein, 9 aa, Homo Sapiens
PKSKAGNTF

SEQ ID NO: 453899 - protein, 9 aa, Homo Sapiens
LVRHQKIIH

SEQ ID NO: 453900 - protein, 9 aa, Homo Sapiens
TQSDVSANH

SEQ ID NO: 453901 - protein, 9 aa, Homo Sapiens
LYTISLRLK

SEQ ID NO: 453902 - protein, 9 aa, Homo Sapiens
SILVNCYTK

SEQ ID NO: 453903 - protein, 9 aa, Homo Sapiens
PLHQSGSVE

SEQ ID NO: 453904 - protein, 9 aa, Homo Sapiens
ESIKYGPEF

SEQ ID NO: 453905 - protein, 9 aa, Homo Sapiens
DRHPEINLA

SEQ ID NO: 453906 - protein, 9 aa, Homo Sapiens
FRAICRPTC

SEQ ID NO: 453907 - protein, 9 aa, Homo Sapiens
YLARKVSLW

SEQ ID NO: 453908 - protein, 9 aa, Homo Sapiens
VVAAVLGIG

SEQ ID NO: 453909 - protein, 9 aa, Homo Sapiens
GGFNYLISA

SEQ ID NO: 453910 - protein, 9 aa, Homo Sapiens
LDGISNIGI

SEQ ID NO: 453911 - protein, 9 aa, Homo Sapiens
LKNNDLRLR

SEQ ID NO: 453912 - protein, 9 aa, Homo Sapiens
KAGTELVNL

SEQ ID NO: 453913 - protein, 9 aa, Homo Sapiens
PPVVSDLYQ

SEQ ID NO: 453914 - protein, 9 aa, Homo Sapiens
LYQSGKLRM

SEQ ID NO: 453915 - protein, 9 aa, Homo Sapiens
LDIIARICI

SEQ ID NO: 453916 - protein, 9 aa, Homo Sapiens
LYSVLYAKN

SEQ ID NO: 453917 - protein, 9 aa, Homo Sapiens
NKKNFFKLN

SEQ ID NO: 453918 - protein, 9 aa, Homo Sapiens
YQTKSHVPL

SEQ ID NO: 453919 - protein, 9 aa, Homo Sapiens
VACMTFDQK

SEQ ID NO: 453920 - protein, 9 aa, Homo Sapiens
LGVNTLIEN

SEQ ID NO: 453921 - protein, 9 aa, Homo Sapiens
ELKNNWGVK

SEQ ID NO: 453922 - protein, 9 aa, Homo Sapiens
AVHSQTVSR

SEQ ID NO: 453923 - protein, 9 aa, Homo Sapiens
CGHPRAYFM

SEQ ID NO: 453924 - protein, 9 aa, Homo Sapiens
TNKDVQKRR

SEQ ID NO: 453925 - protein, 9 aa, Homo Sapiens
IAVKVPPLI

SEQ ID NO: 453926 - protein, 9 aa, Homo Sapiens
LMDMEEYIL

SEQ ID NO: 453927 - protein, 9 aa, Homo Sapiens
MICCDKFSV

SEQ ID NO: 453928 - protein, 9 aa, Homo Sapiens
ELGSGLTLI

SEQ ID NO: 453929 - protein, 9 aa, Homo Sapiens
LSPRVAADN

SEQ ID NO: 453930 - protein, 9 aa, Homo Sapiens
WLSITVFAA

SEQ ID NO: 453931 - protein, 9 aa, Homo Sapiens
MGIHENQSR

SEQ ID NO: 453932 - protein, 9 aa, Homo Sapiens
YKLAEKTDT

SEQ ID NO: 453933 - protein, 9 aa, Homo Sapiens
GVSQGFEFI

SEQ ID NO: 453934 - protein, 9 aa, Homo Sapiens
SELEENIRR

SEQ ID NO: 453935 - protein, 9 aa, Homo Sapiens
RDNFCWNLD

SEQ ID NO: 453936 - protein, 9 aa, Homo Sapiens
IHPPPSLPI

SEQ ID NO: 453937 - protein, 9 aa, Homo Sapiens
NTKERQSKY

SEQ ID NO: 453938 - protein, 9 aa, Homo Sapiens
HVGGMVGQF

SEQ ID NO: 453939 - protein, 9 aa, Homo Sapiens
GLPDRNTFC

SEQ ID NO: 453940 - protein, 9 aa, Homo Sapiens
YAIFGLYDQ

SEQ ID NO: 453941 - protein, 9 aa, Homo Sapiens
EDIGNKKKY

SEQ ID NO: 453942 - protein, 9 aa, Homo Sapiens
YKWHKFVYI

SEQ ID NO: 453943 - protein, 9 aa, Homo Sapiens
KSLESRLQV

SEQ ID NO: 453944 - protein, 9 aa, Homo Sapiens
MVILTSSVA

SEQ ID NO: 453945 - protein, 9 aa, Homo Sapiens
KRACIKSLP

SEQ ID NO: 453946 - protein, 9 aa, Homo Sapiens
CHPNFPFSG

SEQ ID NO: 453947 - protein, 9 aa, Homo Sapiens
DPMKRPAVW

SEQ ID NO: 453948 - protein, 9 aa, Homo Sapiens
GSHLTAVIL

SEQ ID NO: 453949 - protein, 9 aa, Homo Sapiens
KPTSHSAIP

SEQ ID NO: 453950 - protein, 9 aa, Homo Sapiens
ESSLEEDHI

SEQ ID NO: 453951 - protein, 9 aa, Homo Sapiens
ASNYPNSCS

SEQ ID NO: 453952 - protein, 9 aa, Homo Sapiens
PCRVEQYSS

SEQ ID NO: 453953 - protein, 9 aa, Homo Sapiens
VTNNLKYLE

SEQ ID NO: 453954 - protein, 9 aa, Homo Sapiens
EVIMCVCVE

SEQ ID NO: 453955 - protein, 9 aa, Homo Sapiens
VKNIVPRLG

SEQ ID NO: 453956 - protein, 9 aa, Homo Sapiens
TLTQNKMIF

SEQ ID NO: 453957 - protein, 9 aa, Homo Sapiens
VSVADLIGG

SEQ ID NO: 453958 - protein, 9 aa, Homo Sapiens
PPPPSGTRS

SEQ ID NO: 453959 - protein, 9 aa, Homo Sapiens
SRSKGHRSD

SEQ ID NO: 453960 - protein, 9 aa, Homo Sapiens
ICWVLLFAI

SEQ ID NO: 453961 - protein, 9 aa, Homo Sapiens
PCGKQGSCP

SEQ ID NO: 453962 - protein, 9 aa, Homo Sapiens
EMYSGKFCE

SEQ ID NO: 453963 - protein, 9 aa, Homo Sapiens
LHNDSVKVR

SEQ ID NO: 453964 - protein, 9 aa, Homo Sapiens
RTASFAVQK

SEQ ID NO: 453965 - protein, 9 aa, Homo Sapiens
DLHQVNKAM

SEQ ID NO: 453966 - protein, 9 aa, Homo Sapiens
FFLQFAPDN

SEQ ID NO: 453967 - protein, 9 aa, Homo Sapiens
DSILSLCSP

SEQ ID NO: 453968 - protein, 9 aa, Homo Sapiens
AAVGELSDK

SEQ ID NO: 453969 - protein, 9 aa, Homo Sapiens
VDGKKSKQQ

SEQ ID NO: 453970 - protein, 9 aa, Homo Sapiens
YPSWPNFDY

SEQ ID NO: 453971 - protein, 9 aa, Homo Sapiens
IQGTVEFLV

SEQ ID NO: 453972 - protein, 9 aa, Homo Sapiens
ENLKIHKQT

SEQ ID NO: 453973 - protein, 9 aa, Homo Sapiens
SEPDTSTGF

SEQ ID NO: 453974 - protein, 9 aa, Homo Sapiens
PEEGSGCLV

SEQ ID NO: 453975 - protein, 9 aa, Homo Sapiens
AACSGQAEV

SEQ ID NO: 453976 - protein, 9 aa, Homo Sapiens
GCHLCFQLV

SEQ ID NO: 453977 - protein, 9 aa, Homo Sapiens
TENPKERGE

SEQ ID NO: 453978 - protein, 9 aa, Homo Sapiens
MASFLLLVV

SEQ ID NO: 453979 - protein, 9 aa, Homo Sapiens
QNACAEVIK

SEQ ID NO: 453980 - protein, 9 aa, Homo Sapiens
KGPDFLIDG

SEQ ID NO: 453981 - protein, 9 aa, Homo Sapiens
STGFSGSVE

SEQ ID NO: 453982 - protein, 9 aa, Homo Sapiens
EALDGDTGP

SEQ ID NO: 453983 - protein, 9 aa, Homo Sapiens
RRNDKVDPV

SEQ ID NO: 453984 - protein, 9 aa, Homo Sapiens
ILVFIRELK

SEQ ID NO: 453985 - protein, 9 aa, Homo Sapiens
IPMHALPDE

SEQ ID NO: 453986 - protein, 9 aa, Homo Sapiens
QELCDLNDS

SEQ ID NO: 453987 - protein, 9 aa, Homo Sapiens
STLILHKII

SEQ ID NO: 453988 - protein, 9 aa, Homo Sapiens
IPLVDTRIQ

SEQ ID NO: 453989 - protein, 9 aa, Homo Sapiens
TFMCLVLHC

SEQ ID NO: 453990 - protein, 9 aa, Homo Sapiens
NNMAPTKNF

SEQ ID NO: 453991 - protein, 9 aa, Homo Sapiens
YKTSKRFSS

SEQ ID NO: 453992 - protein, 9 aa, Homo Sapiens
ANGNVEATV

SEQ ID NO: 453993 - protein, 9 aa, Homo Sapiens
SVAGGKANK

SEQ ID NO: 453994 - protein, 9 aa, Homo Sapiens
KATPFGGAS

SEQ ID NO: 453995 - protein, 9 aa, Homo Sapiens
ERLTAPWSA

SEQ ID NO: 453996 - protein, 9 aa, Homo Sapiens
ESNSLNSRL

SEQ ID NO: 453997 - protein, 9 aa, Homo Sapiens
LTTHKNIHT

SEQ ID NO: 453998 - protein, 9 aa, Homo Sapiens
WPWCSASAW

SEQ ID NO: 453999 - protein, 9 aa, Homo Sapiens
QRPPPPSGT

SEQ ID NO: 454000 - protein, 9 aa, Homo Sapiens
KIAYCENKC

SEQ ID NO: 454001 - protein, 9 aa, Homo Sapiens
EKTKVEWFP

SEQ ID NO: 454002 - protein, 9 aa, Homo Sapiens
QRVKHGWVW

SEQ ID NO: 454003 - protein, 9 aa, Homo Sapiens
WQLEIAQGQ

SEQ ID NO: 454004 - protein, 9 aa, Homo Sapiens
FPQKSSTAI

SEQ ID NO: 454005 - protein, 9 aa, Homo Sapiens
MHGLGLRQY

SEQ ID NO: 454006 - protein, 9 aa, Homo Sapiens
TLARDNELS

SEQ ID NO: 454007 - protein, 9 aa, Homo Sapiens
TPFSVGVAL

SEQ ID NO: 454008 - protein, 9 aa, Homo Sapiens
TGSFERTLG

SEQ ID NO: 454009 - protein, 9 aa, Homo Sapiens
TEQAVSKPQ

SEQ ID NO: 454010 - protein, 9 aa, Homo Sapiens
QTAPIRNEH

SEQ ID NO: 454011 - protein, 9 aa, Homo Sapiens
RAICRPTCS

SEQ ID NO: 454012 - protein, 9 aa, Homo Sapiens
VGMQPQQQC

SEQ ID NO: 454013 - protein, 9 aa, Homo Sapiens
KKASDKLLA

SEQ ID NO: 454014 - protein, 9 aa, Homo Sapiens
CNKTLWERY

SEQ ID NO: 454015 - protein, 9 aa, Homo Sapiens
GIIELSEKI

SEQ ID NO: 454016 - protein, 9 aa, Homo Sapiens
ILLSDLGYL

SEQ ID NO: 454017 - protein, 9 aa, Homo Sapiens
VDKLEIISL

SEQ ID NO: 454018 - protein, 9 aa, Homo Sapiens
VSWDITEAG

SEQ ID NO: 454019 - protein, 9 aa, Homo Sapiens
PKSFDNSPG

SEQ ID NO: 454020 - protein, 9 aa, Homo Sapiens
VLQEYEVLQ

SEQ ID NO: 454021 - protein, 9 aa, Homo Sapiens
LVRRRPYGC

SEQ ID NO: 454022 - protein, 9 aa, Homo Sapiens
TLKDDLLLT

SEQ ID NO: 454023 - protein, 9 aa, Homo Sapiens
TKISEPGCT

SEQ ID NO: 454024 - protein, 9 aa, Homo Sapiens
FQFFSDAQE

SEQ ID NO: 454025 - protein, 9 aa, Homo Sapiens
ALVFLDSVT

SEQ ID NO: 454026 - protein, 9 aa, Homo Sapiens
SIILVIPFP

SEQ ID NO: 454027 - protein, 9 aa, Homo Sapiens
YGPEGNFAN

SEQ ID NO: 454028 - protein, 9 aa, Homo Sapiens
LLREHQYLL

SEQ ID NO: 454029 - protein, 9 aa, Homo Sapiens
LLDQRQLDL

SEQ ID NO: 454030 - protein, 9 aa, Homo Sapiens
RYLSCCVAS

SEQ ID NO: 454031 - protein, 9 aa, Homo Sapiens
LREECIGFL

SEQ ID NO: 454032 - protein, 9 aa, Homo Sapiens
CLTSLCCLL

SEQ ID NO: 454033 - protein, 9 aa, Homo Sapiens
GKHEDKQQE

SEQ ID NO: 454034 - protein, 9 aa, Homo Sapiens
PPKSEIQNR

SEQ ID NO: 454035 - protein, 9 aa, Homo Sapiens
VRGMYKLLC

SEQ ID NO: 454036 - protein, 9 aa, Homo Sapiens
HLRKLPSTF

SEQ ID NO: 454037 - protein, 9 aa, Homo Sapiens
LQPPRFFNE

SEQ ID NO: 454038 - protein, 9 aa, Homo Sapiens
GLQLEYDMV

SEQ ID NO: 454039 - protein, 9 aa, Homo Sapiens
SSSDELFCR

SEQ ID NO: 454040 - protein, 9 aa, Homo Sapiens
RVKHTHVPK

SEQ ID NO: 454041 - protein, 9 aa, Homo Sapiens
RNKLIKNQF

SEQ ID NO: 454042 - protein, 9 aa, Homo Sapiens
SENTSSLSP

SEQ ID NO: 454043 - protein, 9 aa, Homo Sapiens
SRAIPIKQG

SEQ ID NO: 454044 - protein, 9 aa, Homo Sapiens
ASVFQWLQN

SEQ ID NO: 454045 - protein, 9 aa, Homo Sapiens
RDLCGVNSE

SEQ ID NO: 454046 - protein, 9 aa, Homo Sapiens
CHVLEEDIG

SEQ ID NO: 454047 - protein, 9 aa, Homo Sapiens
TFNGEISRL

SEQ ID NO: 454048 - protein, 9 aa, Homo Sapiens
ADPHWPGSQ

SEQ ID NO: 454049 - protein, 9 aa, Homo Sapiens
AAALAGVVG

SEQ ID NO: 454050 - protein, 9 aa, Homo Sapiens
AKRESETRI

SEQ ID NO: 454051 - protein, 9 aa, Homo Sapiens
RVKRKLNFC

SEQ ID NO: 454052 - protein, 9 aa, Homo Sapiens
VIPIRAAKA

SEQ ID NO: 454053 - protein, 9 aa, Homo Sapiens
NCEVYCSVD

SEQ ID NO: 454054 - protein, 9 aa, Homo Sapiens
MYRDGVGDG

SEQ ID NO: 454055 - protein, 9 aa, Homo Sapiens
CEESYLSVT

SEQ ID NO: 454056 - protein, 9 aa, Homo Sapiens
QLAKESEQL

SEQ ID NO: 454057 - protein, 9 aa, Homo Sapiens
SSQRLLVAR

SEQ ID NO: 454058 - protein, 9 aa, Homo Sapiens
HPYPEHPKT

SEQ ID NO: 454059 - protein, 9 aa, Homo Sapiens
NRIPSLAEF

SEQ ID NO: 454060 - protein, 9 aa, Homo Sapiens
GLGKGSAKR

SEQ ID NO: 454061 - protein, 9 aa, Homo Sapiens
KRKLNFCAN

SEQ ID NO: 454062 - protein, 9 aa, Homo Sapiens
MTKACIKGG

SEQ ID NO: 454063 - protein, 9 aa, Homo Sapiens
RRPRLQRQG

SEQ ID NO: 454064 - protein, 9 aa, Homo Sapiens
PVSVGSSTH

SEQ ID NO: 454065 - protein, 9 aa, Homo Sapiens
KRESETRIR

SEQ ID NO: 454066 - protein, 9 aa, Homo Sapiens
VRSRRVIDI

SEQ ID NO: 454067 - protein, 9 aa, Homo Sapiens
DVIPSEALN

SEQ ID NO: 454068 - protein, 9 aa, Homo Sapiens
SLGCAQVLL

SEQ ID NO: 454069 - protein, 9 aa, Homo Sapiens
KGDADAPGE

SEQ ID NO: 454070 - protein, 9 aa, Homo Sapiens
DLRTDVIPI

SEQ ID NO: 454071 - protein, 9 aa, Homo Sapiens
GLDVTNLRF

SEQ ID NO: 454072 - protein, 9 aa, Homo Sapiens
EAQRADIEI

SEQ ID NO: 454073 - protein, 9 aa, Homo Sapiens
DCRLHTHMY

SEQ ID NO: 454074 - protein, 9 aa, Homo Sapiens
MVMPPAEQE

SEQ ID NO: 454075 - protein, 9 aa, Homo Sapiens
PDKNYICPE

SEQ ID NO: 454076 - protein, 9 aa, Homo Sapiens
PAPLQRTAC

SEQ ID NO: 454077 - protein, 9 aa, Homo Sapiens
QLKDWKKPE

SEQ ID NO: 454078 - protein, 9 aa, Homo Sapiens
IQLAKESEQ

SEQ ID NO: 454079 - protein, 9 aa, Homo Sapiens
SRLSNGEMM

SEQ ID NO: 454080 - protein, 9 aa, Homo Sapiens
MMSSSDIKS

SEQ ID NO: 454081 - protein, 9 aa, Homo Sapiens
HGSLDRATS

SEQ ID NO: 454082 - protein, 9 aa, Homo Sapiens
QPDAHGSLD

SEQ ID NO: 454083 - protein, 9 aa, Homo Sapiens
DTIGSSRAI

SEQ ID NO: 454084 - protein, 9 aa, Homo Sapiens
TKEGCHKKK

SEQ ID NO: 454085 - protein, 9 aa, Homo Sapiens
FDCRLHTHM

SEQ ID NO: 454086 - protein, 9 aa, Homo Sapiens
AEFFYLKGL

SEQ ID NO: 454087 - protein, 9 aa, Homo Sapiens
RRTTLATSP

SEQ ID NO: 454088 - protein, 9 aa, Homo Sapiens
NFCANTRHS

SEQ ID NO: 454089 - protein, 9 aa, Homo Sapiens
DCVHIHLDL

SEQ ID NO: 454090 - protein, 9 aa, Homo Sapiens
VDWLCYASL

SEQ ID NO: 454091 - protein, 9 aa, Homo Sapiens
PVKKGLDVT

SEQ ID NO: 454092 - protein, 9 aa, Homo Sapiens
ALNELTVLV

SEQ ID NO: 454093 - protein, 9 aa, Homo Sapiens
VCEESYLSV

SEQ ID NO: 454094 - protein, 9 aa, Homo Sapiens
PRWCTWPLP

SEQ ID NO: 454095 - protein, 9 aa, Homo Sapiens
AVIKYTSSK

SEQ ID NO: 454096 - protein, 9 aa, Homo Sapiens
SPPQVSHHK

SEQ ID NO: 454097 - protein, 9 aa, Homo Sapiens
HYEFYKMVM

SEQ ID NO: 454098 - protein, 9 aa, Homo Sapiens
LQPPTADEG

SEQ ID NO: 454099 - protein, 9 aa, Homo Sapiens
TPLMVVRSR

SEQ ID NO: 454100 - protein, 9 aa, Homo Sapiens
SSILIPSVV

SEQ ID NO: 454101 - protein, 9 aa, Homo Sapiens
LGPAPGVFW

SEQ ID NO: 454102 - protein, 9 aa, Homo Sapiens
AEVQLLHSA

SEQ ID NO: 454103 - protein, 9 aa, Homo Sapiens
VGSSTHLSQ

SEQ ID NO: 454104 - protein, 9 aa, Homo Sapiens
PRPRWCTWP

SEQ ID NO: 454105 - protein, 9 aa, Homo Sapiens
SAKRHRKVL

SEQ ID NO: 454106 - protein, 9 aa, Homo Sapiens
LMSFRQGGL

SEQ ID NO: 454107 - protein, 9 aa, Homo Sapiens
QSPEYKNLL

SEQ ID NO: 454108 - protein, 9 aa, Homo Sapiens
LRDLCGVNS

SEQ ID NO: 454109 - protein, 9 aa, Homo Sapiens
PPGPRGPKG

SEQ ID NO: 454110 - protein, 9 aa, Homo Sapiens
LLGPAPGVF

SEQ ID NO: 454111 - protein, 9 aa, Homo Sapiens
QLLHSAAEV

SEQ ID NO: 454112 - protein, 9 aa, Homo Sapiens
VANIQASVF

SEQ ID NO: 454113 - protein, 9 aa, Homo Sapiens
VQLLHSAAE

SEQ ID NO: 454114 - protein, 9 aa, Homo Sapiens
QGLSPAAPL

SEQ ID NO: 454115 - protein, 9 aa, Homo Sapiens
VKHYEFYKM

SEQ ID NO: 454116 - protein, 9 aa, Homo Sapiens
GKGSAKRHR

SEQ ID NO: 454117 - protein, 9 aa, Homo Sapiens
EPLPRPRWC

SEQ ID NO: 454118 - protein, 9 aa, Homo Sapiens
SILIPSVVI

SEQ ID NO: 454119 - protein, 9 aa, Homo Sapiens
LDVTNLRFP

SEQ ID NO: 454120 - protein, 9 aa, Homo Sapiens
EQSPEYKNL

SEQ ID NO: 454121 - protein, 9 aa, Homo Sapiens
TPERCWSHS

SEQ ID NO: 454122 - protein, 9 aa, Homo Sapiens
QVSHHKSHY

SEQ ID NO: 454123 - protein, 9 aa, Homo Sapiens
TDVIPIRAA

SEQ ID NO: 454124 - protein, 9 aa, Homo Sapiens
NPTTAWTRA

SEQ ID NO: 454125 - protein, 9 aa, Homo Sapiens
KDWKKPEPC

SEQ ID NO: 454126 - protein, 9 aa, Homo Sapiens
MDCPSTLHQ

SEQ ID NO: 454127 - protein, 9 aa, Homo Sapiens
VNWTNSAIC

SEQ ID NO: 454128 - protein, 9 aa, Homo Sapiens
VVLVAASNY

SEQ ID NO: 454129 - protein, 9 aa, Homo Sapiens
KPVNWTNSA

SEQ ID NO: 454130 - protein, 9 aa, Homo Sapiens
QRQGRIFSK

SEQ ID NO: 454131 - protein, 9 aa, Homo Sapiens
SMFRVDAEL

SEQ ID NO: 454132 - protein, 9 aa, Homo Sapiens
DIEIFVVVV

SEQ ID NO: 454133 - protein, 9 aa, Homo Sapiens
FSNEEHFTG

SEQ ID NO: 454134 - protein, 9 aa, Homo Sapiens
VLVAASNYF

SEQ ID NO: 454135 - protein, 9 aa, Homo Sapiens
VKSPDTGPD

SEQ ID NO: 454136 - protein, 9 aa, Homo Sapiens
RLHTHMYFL

SEQ ID NO: 454137 - protein, 9 aa, Homo Sapiens
AVASMFRVD

SEQ ID NO: 454138 - protein, 9 aa, Homo Sapiens
GLAAALAGV

SEQ ID NO: 454139 - protein, 9 aa, Homo Sapiens
LVSVNVYYK

SEQ ID NO: 454140 - protein, 9 aa, Homo Sapiens
KEKGLEVKS

SEQ ID NO: 454141 - protein, 9 aa, Homo Sapiens
DGMTKACIK

SEQ ID NO: 454142 - protein, 9 aa, Homo Sapiens
LIEVGVDSS

SEQ ID NO: 454143 - protein, 9 aa, Homo Sapiens
RLQRQGRIF

SEQ ID NO: 454144 - protein, 9 aa, Homo Sapiens
NVYYKKCWS

SEQ ID NO: 454145 - protein, 9 aa, Homo Sapiens
AKASQAEGT

SEQ ID NO: 454146 - protein, 9 aa, Homo Sapiens
KASQAEGTP

SEQ ID NO: 454147 - protein, 9 aa, Homo Sapiens
ICPEIFFAL

SEQ ID NO: 454148 - protein, 9 aa, Homo Sapiens
GTKAVIKYT

SEQ ID NO: 454149 - protein, 9 aa, Homo Sapiens
TKACIKGGI

SEQ ID NO: 454150 - protein, 9 aa, Homo Sapiens
VFAEVQLLH

SEQ ID NO: 454151 - protein, 9 aa, Homo Sapiens
LGVVALYAC

SEQ ID NO: 454152 - protein, 9 aa, Homo Sapiens
ALSMGSGSD

SEQ ID NO: 454153 - protein, 9 aa, Homo Sapiens
NPPGVKQYE

SEQ ID NO: 454154 - protein, 9 aa, Homo Sapiens
ENAKRESET

SEQ ID NO: 454155 - protein, 9 aa, Homo Sapiens
DKEYYFDQN

SEQ ID NO: 454156 - protein, 9 aa, Homo Sapiens
AASLGCAQV

SEQ ID NO: 454157 - protein, 9 aa, Homo Sapiens
GITIIEMAI

SEQ ID NO: 454158 - protein, 9 aa, Homo Sapiens
VIPSEALNE

SEQ ID NO: 454159 - protein, 9 aa, Homo Sapiens
LNFCANTRH

SEQ ID NO: 454160 - protein, 9 aa, Homo Sapiens
ENTSSLSPG

SEQ ID NO: 454161 - protein, 9 aa, Homo Sapiens
EFFYLKGLP

SEQ ID NO: 454162 - protein, 9 aa, Homo Sapiens
KESEQLQAM

SEQ ID NO: 454163 - protein, 9 aa, Homo Sapiens
RTDVIPIRA

SEQ ID NO: 454164 - protein, 9 aa, Homo Sapiens
AGIQTLEPQ

SEQ ID NO: 454165 - protein, 9 aa, Homo Sapiens
GHAVPPLVR

SEQ ID NO: 454166 - protein, 9 aa, Homo Sapiens
EGCQDPKYH

SEQ ID NO: 454167 - protein, 9 aa, Homo Sapiens
CMIFAATFC

SEQ ID NO: 454168 - protein, 9 aa, Homo Sapiens
QVLLEHGAS

SEQ ID NO: 454169 - protein, 9 aa, Homo Sapiens
VSMGTDQAS

SEQ ID NO: 454170 - protein, 9 aa, Homo Sapiens
RPRLQRQGR

SEQ ID NO: 454171 - protein, 9 aa, Homo Sapiens
SSDIKSTDK

SEQ ID NO: 454172 - protein, 9 aa, Homo Sapiens
STHLSQGLR

SEQ ID NO: 454173 - protein, 9 aa, Homo Sapiens
HWPGSQEVD

SEQ ID NO: 454174 - protein, 9 aa, Homo Sapiens
LMVVRSRRV

SEQ ID NO: 454175 - protein, 9 aa, Homo Sapiens
LHTHMYFLL

SEQ ID NO: 454176 - protein, 9 aa, Homo Sapiens
LSPFLERPM

SEQ ID NO: 454177 - protein, 9 aa, Homo Sapiens
AWTRASRCC

SEQ ID NO: 454178 - protein, 9 aa, Homo Sapiens
YTCRIVECR

SEQ ID NO: 454179 - protein, 9 aa, Homo Sapiens
PAKASQAEG

SEQ ID NO: 454180 - protein, 9 aa, Homo Sapiens
NYICPEIFF

SEQ ID NO: 454181 - protein, 9 aa, Homo Sapiens
VISVTSALI

SEQ ID NO: 454182 - protein, 9 aa, Homo Sapiens
HRKAGIQTL

SEQ ID NO: 454183 - protein, 9 aa, Homo Sapiens
LAAQNQFLL

SEQ ID NO: 454184 - protein, 9 aa, Homo Sapiens
GCHKKKPVN

SEQ ID NO: 454185 - protein, 9 aa, Homo Sapiens
FPETFNGEI

SEQ ID NO: 454186 - protein, 9 aa, Homo Sapiens
SVFQWLQNA

SEQ ID NO: 454187 - protein, 9 aa, Homo Sapiens
VFWTAGSPA

SEQ ID NO: 454188 - protein, 9 aa, Homo Sapiens
WLHRKAGIQ

SEQ ID NO: 454189 - protein, 9 aa, Homo Sapiens
KKGLDVTNL

SEQ ID NO: 454190 - protein, 9 aa, Homo Sapiens
PEYKNLLLT

SEQ ID NO: 454191 - protein, 9 aa, Homo Sapiens
NTSSLSPGL

SEQ ID NO: 454192 - protein, 9 aa, Homo Sapiens
PEKVTSANK

SEQ ID NO: 454193 - protein, 9 aa, Homo Sapiens
ESPLQGQRN

SEQ ID NO: 454194 - protein, 9 aa, Homo Sapiens
DVWSLGITI

SEQ ID NO: 454195 - protein, 9 aa, Homo Sapiens
QNPSLFRYV

SEQ ID NO: 454196 - protein, 9 aa, Homo Sapiens
LVARPRRSR

SEQ ID NO: 454197 - protein, 9 aa, Homo Sapiens
EALNELTVL

SEQ ID NO: 454198 - protein, 9 aa, Homo Sapiens
ESETRIRRN

SEQ ID NO: 454199 - protein, 9 aa, Homo Sapiens
PSKDCMIFA

SEQ ID NO: 454200 - protein, 9 aa, Homo Sapiens
KQLRDLCGV

SEQ ID NO: 454201 - protein, 9 aa, Homo Sapiens
PTLESPLQG

SEQ ID NO: 454202 - protein, 9 aa, Homo Sapiens
PLQGQRNPT

SEQ ID NO: 454203 - protein, 9 aa, Homo Sapiens
KRDGKKECG

SEQ ID NO: 454204 - protein, 9 aa, Homo Sapiens
KCPEGCQDP

SEQ ID NO: 454205 - protein, 9 aa, Homo Sapiens
ILIPSVVIK

SEQ ID NO: 454206 - protein, 9 aa, Homo Sapiens
EHFTGFAAY

SEQ ID NO: 454207 - protein, 9 aa, Homo Sapiens
IQTLEPQLE

SEQ ID NO: 454208 - protein, 9 aa, Homo Sapiens
RVVLVAASN

SEQ ID NO: 454209 - protein, 9 aa, Homo Sapiens
PSAATTVPL

SEQ ID NO: 454210 - protein, 9 aa, Homo Sapiens
SKRLVDWLC

SEQ ID NO: 454211 - protein, 9 aa, Homo Sapiens
GYDLRTDVI

SEQ ID NO: 454212 - protein, 9 aa, Homo Sapiens
LSPAAPLKL

SEQ ID NO: 454213 - protein, 9 aa, Homo Sapiens
GEMMRGIFI

SEQ ID NO: 454214 - protein, 9 aa, Homo Sapiens
KAGIQTLEP

SEQ ID NO: 454215 - protein, 9 aa, Homo Sapiens
PGPLHTSQQ

SEQ ID NO: 454216 - protein, 9 aa, Homo Sapiens
HADTIGSSR

SEQ ID NO: 454217 - protein, 9 aa, Homo Sapiens
EESYLSVTL

SEQ ID NO: 454218 - protein, 9 aa, Homo Sapiens
TQVSHPYPE

SEQ ID NO: 454219 - protein, 9 aa, Homo Sapiens
GQRNPTTAW

SEQ ID NO: 454220 - protein, 9 aa, Homo Sapiens
STLHQLMLD

SEQ ID NO: 454221 - protein, 9 aa, Homo Sapiens
TNSAICNKW

SEQ ID NO: 454222 - protein, 9 aa, Homo Sapiens
EMMRGIFIK

SEQ ID NO: 454223 - protein, 9 aa, Homo Sapiens
LEALQMCTA

SEQ ID NO: 454224 - protein, 9 aa, Homo Sapiens
KNLLLTLQR

SEQ ID NO: 454225 - protein, 9 aa, Homo Sapiens
PPPMDCPST

SEQ ID NO: 454226 - protein, 9 aa, Homo Sapiens
RTTLATSPI

SEQ ID NO: 454227 - protein, 9 aa, Homo Sapiens
MVVRSRRVI

SEQ ID NO: 454228 - protein, 9 aa, Homo Sapiens
LLSPFLERP

SEQ ID NO: 454229 - protein, 9 aa, Homo Sapiens
HSAAEVKRP

SEQ ID NO: 454230 - protein, 9 aa, Homo Sapiens
RRDSSQRLL

SEQ ID NO: 454231 - protein, 9 aa, Homo Sapiens
KRLVDWLCY

SEQ ID NO: 454232 - protein, 9 aa, Homo Sapiens
RQAQESHVF

SEQ ID NO: 454233 - protein, 9 aa, Homo Sapiens
VKKGLDVTN

SEQ ID NO: 454234 - protein, 9 aa, Homo Sapiens
SCHRVVLVA

SEQ ID NO: 454235 - protein, 9 aa, Homo Sapiens
ESEQLQAMM

SEQ ID NO: 454236 - protein, 9 aa, Homo Sapiens
QRNPTTAWT

SEQ ID NO: 454237 - protein, 9 aa, Homo Sapiens
VQEAQRADI

SEQ ID NO: 454238 - protein, 9 aa, Homo Sapiens
KMMSSSDIK

SEQ ID NO: 454239 - protein, 9 aa, Homo Sapiens
TCRIVECRP

SEQ ID NO: 454240 - protein, 9 aa, Homo Sapiens
PFCAPPPPG

SEQ ID NO: 454241 - protein, 9 aa, Homo Sapiens
PSRIIMYRD

SEQ ID NO: 454242 - protein, 9 aa, Homo Sapiens
QAQESHVFL

SEQ ID NO: 454243 - protein, 9 aa, Homo Sapiens
VSVGSSTHL

SEQ ID NO: 454244 - protein, 9 aa, Homo Sapiens
TPAPLQRTA

SEQ ID NO: 454245 - protein, 9 aa, Homo Sapiens
GLEVKSPDT

SEQ ID NO: 454246 - protein, 9 aa, Homo Sapiens
PGVFWTAGS

SEQ ID NO: 454247 - protein, 9 aa, Homo Sapiens
QMCTAYVAG

SEQ ID NO: 454248 - protein, 9 aa, Homo Sapiens
DAHGSLDRA

SEQ ID NO: 454249 - protein, 9 aa, Homo Sapiens
DWKKPEPCK

SEQ ID NO: 454250 - protein, 9 aa, Homo Sapiens
TTLATSPIT

SEQ ID NO: 454251 - protein, 9 aa, Homo Sapiens
QNCEVYCSV

SEQ ID NO: 454252 - protein, 9 aa, Homo Sapiens
SANKTNKQT

SEQ ID NO: 454253 - protein, 9 aa, Homo Sapiens
FWTAGSPAP

SEQ ID NO: 454254 - protein, 9 aa, Homo Sapiens
TPTLESPLQ

SEQ ID NO: 454255 - protein, 9 aa, Homo Sapiens
SHHKSHYRN

SEQ ID NO: 454256 - protein, 9 aa, Homo Sapiens
GKKECGIVS

SEQ ID NO: 454257 - protein, 9 aa, Homo Sapiens
CVHIHLDLT

SEQ ID NO: 454258 - protein, 9 aa, Homo Sapiens
KNYICPEIF

SEQ ID NO: 454259 - protein, 9 aa, Homo Sapiens
IALVSVNVY

SEQ ID NO: 454260 - protein, 9 aa, Homo Sapiens
CRIVECRPP

SEQ ID NO: 454261 - protein, 9 aa, Homo Sapiens
CYASLQQGL

SEQ ID NO: 454262 - protein, 9 aa, Homo Sapiens
DVIPIRAAK

SEQ ID NO: 454263 - protein, 9 aa, Homo Sapiens
QGGLRGDGQ

SEQ ID NO: 454264 - protein, 9 aa, Homo Sapiens
LNELTVLVL

SEQ ID NO: 454265 - protein, 9 aa, Homo Sapiens
RADIEIFVV

SEQ ID NO: 454266 - protein, 9 aa, Homo Sapiens
FFYLKGLPR

SEQ ID NO: 454267 - protein, 9 aa, Homo Sapiens
YKKNPPGVK

SEQ ID NO: 454268 - protein, 9 aa, Homo Sapiens
GDILAMDRE

SEQ ID NO: 454269 - protein, 9 aa, Homo Sapiens
GIVSRDGGA

SEQ ID NO: 454270 - protein, 9 aa, Homo Sapiens
FCANTRHSN

SEQ ID NO: 454271 - protein, 9 aa, Homo Sapiens
MCTAYVAGF

SEQ ID NO: 454272 - protein, 9 aa, Homo Sapiens
TLESPLQGQ

SEQ ID NO: 454273 - protein, 9 aa, Homo Sapiens
FRQGGLRGD

SEQ ID NO: 454274 - protein, 9 aa, Homo Sapiens
LSVTLRTAE

SEQ ID NO: 454275 - protein, 9 aa, Homo Sapiens
LPRPRWCTW

SEQ ID NO: 454276 - protein, 9 aa, Homo Sapiens
TAWTRASRC

SEQ ID NO: 454277 - protein, 9 aa, Homo Sapiens
GVNSEQILL

SEQ ID NO: 454278 - protein, 9 aa, Homo Sapiens
SVNVYYKKC

SEQ ID NO: 454279 - protein, 9 aa, Homo Sapiens
YKNLLLTLQ

SEQ ID NO: 454280 - protein, 9 aa, Homo Sapiens
PPLVRKVLV

SEQ ID NO: 454281 - protein, 9 aa, Homo Sapiens
SHCRCATTL

SEQ ID NO: 454282 - protein, 9 aa, Homo Sapiens
DCMIFAATF

SEQ ID NO: 454283 - protein, 9 aa, Homo Sapiens
QTPERCWSH

SEQ ID NO: 454284 - protein, 9 aa, Homo Sapiens
HGKQLKDWK

SEQ ID NO: 454285 - protein, 9 aa, Homo Sapiens
GSQGLSPAA

SEQ ID NO: 454286 - protein, 9 aa, Homo Sapiens
ADTIGSSRA

SEQ ID NO: 454287 - protein, 9 aa, Homo Sapiens
DTPLMVVRS

SEQ ID NO: 454288 - protein, 9 aa, Homo Sapiens
HIHLDLTWC

SEQ ID NO: 454289 - protein, 9 aa, Homo Sapiens
LQPQTPERC

SEQ ID NO: 454290 - protein, 9 aa, Homo Sapiens
DKNYICPEI

SEQ ID NO: 454291 - protein, 9 aa, Homo Sapiens
SAKDCVHIH

SEQ ID NO: 454292 - protein, 9 aa, Homo Sapiens
EGTKAVIKY

SEQ ID NO: 454293 - protein, 9 aa, Homo Sapiens
ICHVLEEDI

SEQ ID NO: 454294 - protein, 9 aa, Homo Sapiens
QNRGPVVPP

SEQ ID NO: 454295 - protein, 9 aa, Homo Sapiens
VNSEQILLA

SEQ ID NO: 454296 - protein, 9 aa, Homo Sapiens
KLIMDGMTK

SEQ ID NO: 454297 - protein, 9 aa, Homo Sapiens
RIVECRPPV

SEQ ID NO: 454298 - protein, 9 aa, Homo Sapiens
TGQENIYYV

SEQ ID NO: 454299 - protein, 9 aa, Homo Sapiens
PPPPGPLHT

SEQ ID NO: 454300 - protein, 9 aa, Homo Sapiens
IIEMAILRF

SEQ ID NO: 454301 - protein, 9 aa, Homo Sapiens
KNPPGVKQY

SEQ ID NO: 454302 - protein, 9 aa, Homo Sapiens
PLYLQPDAH

SEQ ID NO: 454303 - protein, 9 aa, Homo Sapiens
MPALSMGSG

SEQ ID NO: 454304 - protein, 9 aa, Homo Sapiens
IPSEALNEL

SEQ ID NO: 454305 - protein, 9 aa, Homo Sapiens
EVKSPDTGP

SEQ ID NO: 454306 - protein, 9 aa, Homo Sapiens
LQRQGRIFS

SEQ ID NO: 454307 - protein, 9 aa, Homo Sapiens
LYLQPDAHG

SEQ ID NO: 454308 - protein, 9 aa, Homo Sapiens
GTRLGVVAL

SEQ ID NO: 454309 - protein, 9 aa, Homo Sapiens
CPEGCQDPK

SEQ ID NO: 454310 - protein, 9 aa, Homo Sapiens
RRVKRKLNF

SEQ ID NO: 454311 - protein, 9 aa, Homo Sapiens
CRLHTHMYF

SEQ ID NO: 454312 - protein, 9 aa, Homo Sapiens
QPSWTPAPL

SEQ ID NO: 454313 - protein, 9 aa, Homo Sapiens
KDCMIFAAT

SEQ ID NO: 454314 - protein, 9 aa, Homo Sapiens
SEQLQAMMA

SEQ ID NO: 454315 - protein, 9 aa, Homo Sapiens
PSLAEFFYL

SEQ ID NO: 454316 - protein, 9 aa, Homo Sapiens
LEVKSPDTG

SEQ ID NO: 454317 - protein, 9 aa, Homo Sapiens
RIIMYRDGV

SEQ ID NO: 454318 - protein, 9 aa, Homo Sapiens
RAPSKDCMI

SEQ ID NO: 454319 - protein, 9 aa, Homo Sapiens
LESPLQGQR

SEQ ID NO: 454320 - protein, 9 aa, Homo Sapiens
FDQNPSLFR

SEQ ID NO: 454321 - protein, 9 aa, Homo Sapiens
KWEIVSMGT

SEQ ID NO: 454322 - protein, 9 aa, Homo Sapiens
YEFYKMVMP

SEQ ID NO: 454323 - protein, 9 aa, Homo Sapiens
PSSASENTS

SEQ ID NO: 454324 - protein, 9 aa, Homo Sapiens
GPAPGVFWT

SEQ ID NO: 454325 - protein, 9 aa, Homo Sapiens
CAPPPPGPL

SEQ ID NO: 454326 - protein, 9 aa, Homo Sapiens
VSHHKSHYR

SEQ ID NO: 454327 - protein, 9 aa, Homo Sapiens
ALVSVNVYY

SEQ ID NO: 454328 - protein, 9 aa, Homo Sapiens
ANIQASVFQ

SEQ ID NO: 454329 - protein, 9 aa, Homo Sapiens
SAICNKWEI

SEQ ID NO: 454330 - protein, 9 aa, Homo Sapiens
GIQTLEPQL

SEQ ID NO: 454331 - protein, 9 aa, Homo Sapiens
FSCHRVVLV

SEQ ID NO: 454332 - protein, 9 aa, Homo Sapiens
KKNPPGVKQ

SEQ ID NO: 454333 - protein, 9 aa, Homo Sapiens
RLVDWLCYA

SEQ ID NO: 454334 - protein, 9 aa, Homo Sapiens
LLICHVLEE

SEQ ID NO: 454335 - protein, 9 aa, Homo Sapiens
GDADAPGER

SEQ ID NO: 454336 - protein, 9 aa, Homo Sapiens
DKKCHREAA

SEQ ID NO: 454337 - protein, 9 aa, Homo Sapiens
KKCHREAAV

SEQ ID NO: 454338 - protein, 9 aa, Homo Sapiens
GMTKACIKG

SEQ ID NO: 454339 - protein, 9 aa, Homo Sapiens
NLYKKNPPG

SEQ ID NO: 454340 - protein, 9 aa, Homo Sapiens
PHGKQLKDW

SEQ ID NO: 454341 - protein, 9 aa, Homo Sapiens
TDVIPSEAL

SEQ ID NO: 454342 - protein, 9 aa, Homo Sapiens
VYTCRIVEC

SEQ ID NO: 454343 - protein, 9 aa, Homo Sapiens
SLGITIIEM

SEQ ID NO: 454344 - protein, 9 aa, Homo Sapiens
KRCVYTCRI

SEQ ID NO: 454345 - protein, 9 aa, Homo Sapiens
GGKGDADAP

SEQ ID NO: 454346 - protein, 9 aa, Homo Sapiens
PAAPLKLDP

SEQ ID NO: 454347 - protein, 9 aa, Homo Sapiens
VFQWLQNAL

SEQ ID NO: 454348 - protein, 9 aa, Homo Sapiens
KPLHPDATS

SEQ ID NO: 454349 - protein, 9 aa, Homo Sapiens
TSALIEVGV

SEQ ID NO: 454350 - protein, 9 aa, Homo Sapiens
FAEVQLLHS

SEQ ID NO: 454351 - protein, 9 aa, Homo Sapiens
RRAPSKDCM

SEQ ID NO: 454352 - protein, 9 aa, Homo Sapiens
QGQRNPTTA

SEQ ID NO: 454353 - protein, 9 aa, Homo Sapiens
IMYRDGVGD

SEQ ID NO: 454354 - protein, 9 aa, Homo Sapiens
KKPVNWTNS

SEQ ID NO: 454355 - protein, 9 aa, Homo Sapiens
AAPLKLDPL

SEQ ID NO: 454356 - protein, 9 aa, Homo Sapiens
GPPGPRGPK

SEQ ID NO: 454357 - protein, 9 aa, Homo Sapiens
KHYEFYKMV

SEQ ID NO: 454358 - protein, 9 aa, Homo Sapiens
PHWPGSQEV

SEQ ID NO: 454359 - protein, 9 aa, Homo Sapiens
ADKEYYFDQ

SEQ ID NO: 454360 - protein, 9 aa, Homo Sapiens
YDLRTDVIP

SEQ ID NO: 454361 - protein, 9 aa, Homo Sapiens
ALAGVVGLA

SEQ ID NO: 454362 - protein, 9 aa, Homo Sapiens
VLLEHGASV

SEQ ID NO: 454363 - protein, 9 aa, Homo Sapiens
DVTNLRFPL

SEQ ID NO: 454364 - protein, 9 aa, Homo Sapiens
EYYFDQNPS

SEQ ID NO: 454365 - protein, 9 aa, Homo Sapiens
IEVGVDSSL

SEQ ID NO: 454366 - protein, 9 aa, Homo Sapiens
HLNLYKKNP

SEQ ID NO: 454367 - protein, 9 aa, Homo Sapiens
WSLGITIIE

SEQ ID NO: 454368 - protein, 9 aa, Homo Sapiens
CVYTCRIVE

SEQ ID NO: 454369 - protein, 9 aa, Homo Sapiens
SEGTKAVIK

SEQ ID NO: 454370 - protein, 9 aa, Homo Sapiens
YKMVMPPAE

SEQ ID NO: 454371 - protein, 9 aa, Homo Sapiens
VSEGTKAVI

SEQ ID NO: 454372 - protein, 9 aa, Homo Sapiens
LIMDGMTKA

SEQ ID NO: 454373 - protein, 9 aa, Homo Sapiens
SMGSGSDTG

SEQ ID NO: 454374 - protein, 9 aa, Homo Sapiens
HKKKPVNWT

SEQ ID NO: 454375 - protein, 9 aa, Homo Sapiens
LAKESEQLQ

SEQ ID NO: 454376 - protein, 9 aa, Homo Sapiens
DGKKECGIV

SEQ ID NO: 454377 - protein, 9 aa, Homo Sapiens
WDKKCHREA

SEQ ID NO: 454378 - protein, 9 aa, Homo Sapiens
LHRKAGIQT

SEQ ID NO: 454379 - protein, 9 aa, Homo Sapiens
CGIEIVCRD

SEQ ID NO: 454380 - protein, 9 aa, Homo Sapiens
APLQRTACN

SEQ ID NO: 454381 - protein, 9 aa, Homo Sapiens
KGYDLRTDV

SEQ ID NO: 454382 - protein, 9 aa, Homo Sapiens
RDGKKECGI

SEQ ID NO: 454383 - protein, 9 aa, Homo Sapiens
VVGLATAAF

SEQ ID NO: 454384 - protein, 9 aa, Homo Sapiens
RPRWCTWPL

SEQ ID NO: 454385 - protein, 9 aa, Homo Sapiens
QPSSASENT

SEQ ID NO: 454386 - protein, 9 aa, Homo Sapiens
VTSALIEVG

SEQ ID NO: 454387 - protein, 9 aa, Homo Sapiens
GSRLSNGEM

SEQ ID NO: 454388 - protein, 9 aa, Homo Sapiens
VALADPHWP

SEQ ID NO: 454389 - protein, 9 aa, Homo Sapiens
YNTGDILAM

SEQ ID NO: 454390 - protein, 9 aa, Homo Sapiens
VTSANKTNK

SEQ ID NO: 454391 - protein, 9 aa, Homo Sapiens
FCAPPPPGP

SEQ ID NO: 454392 - protein, 9 aa, Homo Sapiens
SSSDIKSTD

SEQ ID NO: 454393 - protein, 9 aa, Homo Sapiens
LAQSRRTTL

SEQ ID NO: 454394 - protein, 9 aa, Homo Sapiens
ENIYYVGYS

SEQ ID NO: 454395 - protein, 9 aa, Homo Sapiens
MGSGSDTGL

SEQ ID NO: 454396 - protein, 9 aa, Homo Sapiens
YYFDQNPSL

SEQ ID NO: 454397 - protein, 9 aa, Homo Sapiens
GKEKGLEVK

SEQ ID NO: 454398 - protein, 9 aa, Homo Sapiens
NAKRESETR

SEQ ID NO: 454399 - protein, 9 aa, Homo Sapiens
PPPGPLHTS

SEQ ID NO: 454400 - protein, 9 aa, Homo Sapiens
SSLLICHVL

SEQ ID NO: 454401 - protein, 9 aa, Homo Sapiens
SMGTDQASH

SEQ ID NO: 454402 - protein, 9 aa, Homo Sapiens
PVVPPAWPK

SEQ ID NO: 454403 - protein, 9 aa, Homo Sapiens
PQVSHHKSH

SEQ ID NO: 454404 - protein, 9 aa, Homo Sapiens
PVNWTNSAI

SEQ ID NO: 454405 - protein, 9 aa, Homo Sapiens
THLSQGLRS

SEQ ID NO: 454406 - protein, 9 aa, Homo Sapiens
VPVKKGLDV

SEQ ID NO: 454407 - protein, 9 aa, Homo Sapiens
NDTPLMVVR

SEQ ID NO: 454408 - protein, 9 aa, Homo Sapiens
GPVVPPAWP

SEQ ID NO: 454409 - protein, 9 aa, Homo Sapiens
SQGLSPAAP

SEQ ID NO: 454410 - protein, 9 aa, Homo Sapiens
APSKDCMIF

SEQ ID NO: 454411 - protein, 9 aa, Homo Sapiens
HHKSHYRNR

SEQ ID NO: 454412 - protein, 9 aa, Homo Sapiens
PPFCAPPPP

SEQ ID NO: 454413 - protein, 9 aa, Homo Sapiens
QLRDLCGVN

SEQ ID NO: 454414 - protein, 9 aa, Homo Sapiens
RQGGLRGDG

SEQ ID NO: 454415 - protein, 9 aa, Homo Sapiens
CNKWEIVSM

SEQ ID NO: 454416 - protein, 9 aa, Homo Sapiens
LQGQRNPTT

SEQ ID NO: 454417 - protein, 9 aa, Homo Sapiens
LRHSSILIP

SEQ ID NO: 454418 - protein, 9 aa, Homo Sapiens
NKWEIVSMG

SEQ ID NO: 454419 - protein, 9 aa, Homo Sapiens
GTQNCEVYC

SEQ ID NO: 454420 - protein, 9 aa, Homo Sapiens
LQRTACNIT

SEQ ID NO: 454421 - protein, 9 aa, Homo Sapiens
GKGDADAPG

SEQ ID NO: 454422 - protein, 9 aa, Homo Sapiens
PGTPTLESP

SEQ ID NO: 454423 - protein, 9 aa, Homo Sapiens
DADAPGERG

SEQ ID NO: 454424 - protein, 9 aa, Homo Sapiens
SASENTSSL

SEQ ID NO: 454425 - protein, 9 aa, Homo Sapiens
KGLEVKSPD

SEQ ID NO: 454426 - protein, 9 aa, Homo Sapiens
IGSSRAIPI

SEQ ID NO: 454427 - protein, 9 aa, Homo Sapiens
SPEKVTSAN

SEQ ID NO: 454428 - protein, 9 aa, Homo Sapiens
LGKGSAKRH

SEQ ID NO: 454429 - protein, 9 aa, Homo Sapiens
DCPSTLHQL

SEQ ID NO: 454430 - protein, 9 aa, Homo Sapiens
HFTGFAAYY

SEQ ID NO: 454431 - protein, 9 aa, Homo Sapiens
ACIALVSVN

SEQ ID NO: 454432 - protein, 9 aa, Homo Sapiens
SDFSNEEHF

SEQ ID NO: 454433 - protein, 9 aa, Homo Sapiens
PLQRTACNI

SEQ ID NO: 454434 - protein, 9 aa, Homo Sapiens
NSSLLICHV

SEQ ID NO: 454435 - protein, 9 aa, Homo Sapiens
HLQPPTADE

SEQ ID NO: 454436 - protein, 9 aa, Homo Sapiens
CSVDLAFFI

SEQ ID NO: 454437 - protein, 9 aa, Homo Sapiens
DQNPSLFRY

SEQ ID NO: 454438 - protein, 9 aa, Homo Sapiens
MGTDQASHC

SEQ ID NO: 454439 - protein, 9 aa, Homo Sapiens
HRVVLVAAS

SEQ ID NO: 454440 - protein, 9 aa, Homo Sapiens
FLLSPFLER

SEQ ID NO: 454441 - protein, 9 aa, Homo Sapiens
PLMVVRSRR

SEQ ID NO: 454442 - protein, 9 aa, Homo Sapiens
VAASNYFRA

SEQ ID NO: 454443 - protein, 9 aa, Homo Sapiens
WEIVSMGTD

SEQ ID NO: 454444 - protein, 9 aa, Homo Sapiens
HVFLLDEGR

SEQ ID NO: 454445 - protein, 9 aa, Homo Sapiens
SSTHLSQGL

SEQ ID NO: 454446 - protein, 9 aa, Homo Sapiens
MPSRIIMYR

SEQ ID NO: 454447 - protein, 9 aa, Homo Sapiens
EFIVKCPEG

SEQ ID NO: 454448 - protein, 9 aa, Homo Sapiens
PQSPPQVSH

SEQ ID NO: 454449 - protein, 9 aa, Homo Sapiens
PYPEHPKTR

SEQ ID NO: 454450 - protein, 9 aa, Homo Sapiens
GGKGLGKGS

SEQ ID NO: 454451 - protein, 9 aa, Homo Sapiens
KAVIKYTSS

SEQ ID NO: 454452 - protein, 9 aa, Homo Sapiens
FQWLQNALD

SEQ ID NO: 454453 - protein, 9 aa, Homo Sapiens
EEHFTGFAA

SEQ ID NO: 454454 - protein, 9 aa, Homo Sapiens
LAEFFYLKG

SEQ ID NO: 454455 - protein, 9 aa, Homo Sapiens
SPEYKNLLL

SEQ ID NO: 454456 - protein, 9 aa, Homo Sapiens
IVSMGTDQA

SEQ ID NO: 454457 - protein, 9 aa, Homo Sapiens
NTGDILAMD

SEQ ID NO: 454458 - protein, 9 aa, Homo Sapiens
AATTVPLSP

SEQ ID NO: 454459 - protein, 9 aa, Homo Sapiens
PPTAGPSAA

SEQ ID NO: 454460 - protein, 9 aa, Homo Sapiens
AEPQNRGPV

SEQ ID NO: 454461 - protein, 9 aa, Homo Sapiens
CAQVLLEHG

SEQ ID NO: 454462 - protein, 9 aa, Homo Sapiens
QSRRTTLAT

SEQ ID NO: 454463 - protein, 9 aa, Homo Sapiens
RKVLVGNKC

SEQ ID NO: 454464 - protein, 9 aa, Homo Sapiens
CPEIFFALA

SEQ ID NO: 454465 - protein, 9 aa, Homo Sapiens
MMRGIFIKH

SEQ ID NO: 454466 - protein, 9 aa, Homo Sapiens
CGVNSEQIL

SEQ ID NO: 454467 - protein, 9 aa, Homo Sapiens
TLATSPITV

SEQ ID NO: 454468 - protein, 9 aa, Homo Sapiens
QASHCRCAT

SEQ ID NO: 454469 - protein, 9 aa, Homo Sapiens
PQNRGPVVP

SEQ ID NO: 454470 - protein, 9 aa, Homo Sapiens
GAVASMFRV

SEQ ID NO: 454471 - protein, 9 aa, Homo Sapiens
KGLGKGSAK

SEQ ID NO: 454472 - protein, 9 aa, Homo Sapiens
VSAKDCVHI

SEQ ID NO: 454473 - protein, 9 aa, Homo Sapiens
PGGKGDADA

SEQ ID NO: 454474 - protein, 9 aa, Homo Sapiens
PMDCPSTLH

SEQ ID NO: 454475 - protein, 9 aa, Homo Sapiens
VNVYYKKCW

SEQ ID NO: 454476 - protein, 9 aa, Homo Sapiens
EVYCSVDLA

SEQ ID NO: 454477 - protein, 9 aa, Homo Sapiens
SWTPAPLQR

SEQ ID NO: 454478 - protein, 9 aa, Homo Sapiens
PQTPERCWS

SEQ ID NO: 454479 - protein, 9 aa, Homo Sapiens
APGVFWTAG

SEQ ID NO: 454480 - protein, 9 aa, Homo Sapiens
PRLQRQGRI

SEQ ID NO: 454481 - protein, 9 aa, Homo Sapiens
FKWDKKCHR

SEQ ID NO: 454482 - protein, 9 aa, Homo Sapiens
NGTRLGVVA

SEQ ID NO: 454483 - protein, 9 aa, Homo Sapiens
SVTSALIEV

SEQ ID NO: 454484 - protein, 9 aa, Homo Sapiens
CHRVVLVAA

SEQ ID NO: 454485 - protein, 9 aa, Homo Sapiens
KEGCHKKKP

SEQ ID NO: 454486 - protein, 9 aa, Homo Sapiens
RLQPQTPER

SEQ ID NO: 454487 - protein, 9 aa, Homo Sapiens
PSTLHQLML

SEQ ID NO: 454488 - protein, 9 aa, Homo Sapiens
SLLICHVLE

SEQ ID NO: 454489 - protein, 9 aa, Homo Sapiens
FYKMVMPPA

SEQ ID NO: 454490 - protein, 9 aa, Homo Sapiens
VKPLHPDAT

SEQ ID NO: 454491 - protein, 9 aa, Homo Sapiens
YICPEIFFA

SEQ ID NO: 454492 - protein, 9 aa, Homo Sapiens
GTPTLESPL

SEQ ID NO: 454493 - protein, 9 aa, Homo Sapiens
RDSSQRLLV

SEQ ID NO: 454494 - protein, 9 aa, Homo Sapiens
VSHPYPEHP

SEQ ID NO: 454495 - protein, 9 aa, Homo Sapiens
AKDCVHIHL

SEQ ID NO: 454496 - protein, 9 aa, Homo Sapiens
ECGIVSRDG

SEQ ID NO: 454497 - protein, 9 aa, Homo Sapiens
DVYYNTGDI

SEQ ID NO: 454498 - protein, 9 aa, Homo Sapiens
EKMMSSSDI

SEQ ID NO: 454499 - protein, 9 aa, Homo Sapiens
VPPLVRKVL

SEQ ID NO: 454500 - protein, 9 aa, Homo Sapiens
KGSAKRHRK

SEQ ID NO: 454501 - protein, 9 aa, Homo Sapiens
LICHVLEED

SEQ ID NO: 454502 - protein, 9 aa, Homo Sapiens
LGCAQVLLE

SEQ ID NO: 454503 - protein, 9 aa, Homo Sapiens
VVRSRRVID

SEQ ID NO: 454504 - protein, 9 aa, Homo Sapiens
PLPRPRWCT

SEQ ID NO: 454505 - protein, 9 aa, Homo Sapiens
EQLQAMMAH

SEQ ID NO: 454506 - protein, 9 aa, Homo Sapiens
CTAYVAGFV

SEQ ID NO: 454507 - protein, 9 aa, Homo Sapiens
GVFWTAGSP

SEQ ID NO: 454508 - protein, 9 aa, Homo Sapiens
NIQASVFQW

SEQ ID NO: 454509 - protein, 9 aa, Homo Sapiens
AICNKWEIV

SEQ ID NO: 454510 - protein, 9 aa, Homo Sapiens
CIALVSVNV

SEQ ID NO: 454511 - protein, 9 aa, Homo Sapiens
ALADPHWPG

SEQ ID NO: 454512 - protein, 9 aa, Homo Sapiens
DLCGVNSEQ

SEQ ID NO: 454513 - protein, 9 aa, Homo Sapiens
WLCYASLQQ

SEQ ID NO: 454514 - protein, 9 aa, Homo Sapiens
YLQPDAHGS

SEQ ID NO: 454515 - protein, 9 aa, Homo Sapiens
TTAWTRASR

SEQ ID NO: 454516 - protein, 9 aa, Homo Sapiens
GKGLGKGSA

SEQ ID NO: 454517 - protein, 9 aa, Homo Sapiens
KSDFSNEEH

SEQ ID NO: 454518 - protein, 9 aa, Homo Sapiens
HTHMYFLLR

SEQ ID NO: 454519 - protein, 9 aa, Homo Sapiens
NHADTIGSS

SEQ ID NO: 454520 - protein, 9 aa, Homo Sapiens
LQKTGQENI

SEQ ID NO: 454521 - protein, 9 aa, Homo Sapiens
GSAKRHRKV

SEQ ID NO: 454522 - protein, 9 aa, Homo Sapiens
RFNGTRLGV

SEQ ID NO: 454523 - protein, 9 aa, Homo Sapiens
KDCVHIHLD

SEQ ID NO: 454524 - protein, 9 aa, Homo Sapiens
AGPSAATTV

SEQ ID NO: 454525 - protein, 9 aa, Homo Sapiens
QPPTADEGR

SEQ ID NO: 454526 - protein, 9 aa, Homo Sapiens
QGRIFSKRR

SEQ ID NO: 454527 - protein, 9 aa, Homo Sapiens
KGLDVTNLR

SEQ ID NO: 454528 - protein, 9 aa, Homo Sapiens
RLLVARPRR

SEQ ID NO: 454529 - protein, 9 aa, Homo Sapiens
FNGTRLGVV

SEQ ID NO: 454530 - protein, 9 aa, Homo Sapiens
IEIVCRDMR

SEQ ID NO: 454531 - protein, 9 aa, Homo Sapiens
SPVCEESYL

SEQ ID NO: 454532 - protein, 9 aa, Homo Sapiens
QKTGQENIY

SEQ ID NO: 454533 - protein, 9 aa, Homo Sapiens
LRTDVIPIR

SEQ ID NO: 454534 - protein, 9 aa, Homo Sapiens
TRLGVVALY

SEQ ID NO: 454535 - protein, 9 aa, Homo Sapiens
DWLCYASLQ

SEQ ID NO: 454536 - protein, 9 aa, Homo Sapiens
KLAQSRRTT

SEQ ID NO: 454537 - protein, 9 aa, Homo Sapiens
TAGPSAATT

SEQ ID NO: 454538 - protein, 9 aa, Homo Sapiens
EAENAKRES

SEQ ID NO: 454539 - protein, 9 aa, Homo Sapiens
ASENTSSLS

SEQ ID NO: 454540 - protein, 9 aa, Homo Sapiens
MDGMTKACI

SEQ ID NO: 454541 - protein, 9 aa, Homo Sapiens
SFRQGGLRG

SEQ ID NO: 454542 - protein, 9 aa, Homo Sapiens
TIGSSRAIP

SEQ ID NO: 454543 - protein, 9 aa, Homo Sapiens
LAAALAGVV

SEQ ID NO: 454544 - protein, 9 aa, Homo Sapiens
ITIIEMAIL

SEQ ID NO: 454545 - protein, 9 aa, Homo Sapiens
GTDQASHCR

SEQ ID NO: 454546 - protein, 9 aa, Homo Sapiens
KCHREAAVM

SEQ ID NO: 454547 - protein, 9 aa, Homo Sapiens
ARVKPLHPD

SEQ ID NO: 454548 - protein, 9 aa, Homo Sapiens
HMYFLLRNL

SEQ ID NO: 454549 - protein, 9 aa, Homo Sapiens
RHSSILIPS

SEQ ID NO: 454550 - protein, 9 aa, Homo Sapiens
LADPHWPGS

SEQ ID NO: 454551 - protein, 9 aa, Homo Sapiens
QEAQRADIE

SEQ ID NO: 454552 - protein, 9 aa, Homo Sapiens
YYNTGDILA

SEQ ID NO: 454553 - protein, 9 aa, Homo Sapiens
SQRLLVARP

SEQ ID NO: 454554 - protein, 9 aa, Homo Sapiens
DDSPEPAKA

SEQ ID NO: 454555 - protein, 9 aa, Homo Sapiens
SALIEVGVD

SEQ ID NO: 454556 - protein, 9 aa, Homo Sapiens
ADKFKWDKK

SEQ ID NO: 454557 - protein, 9 aa, Homo Sapiens
ASHCRCATT

SEQ ID NO: 454558 - protein, 9 aa, Homo Sapiens
VKRKLNFCA

SEQ ID NO: 454559 - protein, 9 aa, Homo Sapiens
ANKTNKQTT

SEQ ID NO: 454560 - protein, 9 aa, Homo Sapiens
HSSILIPSV

SEQ ID NO: 454561 - protein, 9 aa, Homo Sapiens
VCRDMRNLR

SEQ ID NO: 454562 - protein, 9 aa, Homo Sapiens
SSASENTSS

SEQ ID NO: 454563 - protein, 9 aa, Homo Sapiens
PSWTPAPLQ

SEQ ID NO: 454564 - protein, 9 aa, Homo Sapiens
PVALADPHW

SEQ ID NO: 454565 - protein, 9 aa, Homo Sapiens
IMDGMTKAC

SEQ ID NO: 454566 - protein, 9 aa, Homo Sapiens
PERCWSHSA

SEQ ID NO: 454567 - protein, 9 aa, Homo Sapiens
IHLDLTWCG

SEQ ID NO: 454568 - protein, 9 aa, Homo Sapiens
ILQKTGQEN

SEQ ID NO: 454569 - protein, 9 aa, Homo Sapiens
IIMYRDGVG

SEQ ID NO: 454570 - protein, 9 aa, Homo Sapiens
QFLLSPFLE

SEQ ID NO: 454571 - protein, 9 aa, Homo Sapiens
PAPGVFWTA

SEQ ID NO: 454572 - protein, 9 aa, Homo Sapiens
GVVGLATAA

SEQ ID NO: 454573 - protein, 9 aa, Homo Sapiens
SAATTVPLS

SEQ ID NO: 454574 - protein, 9 aa, Homo Sapiens
HNDTPLMVV

SEQ ID NO: 454575 - protein, 9 aa, Homo Sapiens
DFSNEEHFT

SEQ ID NO: 454576 - protein, 9 aa, Homo Sapiens
VRKVLVGNK

SEQ ID NO: 454577 - protein, 9 aa, Homo Sapiens
ERRAPSKDC

SEQ ID NO: 454578 - protein, 9 aa, Homo Sapiens
AQRADIEIF

SEQ ID NO: 454579 - protein, 9 aa, Homo Sapiens
AVQEAQRAD

SEQ ID NO: 454580 - protein, 9 aa, Homo Sapiens
SCGIEIVCR

SEQ ID NO: 454581 - protein, 9 aa, Homo Sapiens
DQPSSASEN

SEQ ID NO: 454582 - protein, 9 aa, Homo Sapiens
NEEHFTGFA

SEQ ID NO: 454583 - protein, 9 aa, Homo Sapiens
GRIFSKRRG

SEQ ID NO: 454584 - protein, 9 aa, Homo Sapiens
EPQNRGPVV

SEQ ID NO: 454585 - protein, 9 aa, Homo Sapiens
VSVNVYYKK

SEQ ID NO: 454586 - protein, 9 aa, Homo Sapiens
EKGLEVKSP

SEQ ID NO: 454587 - protein, 9 aa, Homo Sapiens
VSRQAQESH

SEQ ID NO: 454588 - protein, 9 aa, Homo Sapiens
SYLSVTLRT

SEQ ID NO: 454589 - protein, 9 aa, Homo Sapiens
ILFEKMMSS

SEQ ID NO: 454590 - protein, 9 aa, Homo Sapiens
AQSRRTTLA

SEQ ID NO: 454591 - protein, 9 aa, Homo Sapiens
VYCSVDLAF

SEQ ID NO: 454592 - protein, 9 aa, Homo Sapiens
EALQMCTAY

SEQ ID NO: 454593 - protein, 9 aa, Homo Sapiens
LKDWKKPEP

SEQ ID NO: 454594 - protein, 9 aa, Homo Sapiens
PLVRKVLVG

SEQ ID NO: 454595 - protein, 9 aa, Homo Sapiens
DKFKWDKKC

SEQ ID NO: 454596 - protein, 9 aa, Homo Sapiens
LNLYKKNPP

SEQ ID NO: 454597 - protein, 9 aa, Homo Sapiens
NGEMMRGIF

SEQ ID NO: 454598 - protein, 9 aa, Homo Sapiens
GPPTAGPSA

SEQ ID NO: 454599 - protein, 9 aa, Homo Sapiens
VKCPEGCQD

SEQ ID NO: 454600 - protein, 9 aa, Homo Sapiens
KLNFCANTR

SEQ ID NO: 454601 - protein, 9 aa, Homo Sapiens
YCSVDLAFF

SEQ ID NO: 454602 - protein, 9 aa, Homo Sapiens
PLMSFRQGG

SEQ ID NO: 454603 - protein, 9 aa, Homo Sapiens
GVVALYACD

SEQ ID NO: 454604 - protein, 9 aa, Homo Sapiens
AKESEQLQA

SEQ ID NO: 454605 - protein, 9 aa, Homo Sapiens
NSAICNKWE

SEQ ID NO: 454606 - protein, 9 aa, Homo Sapiens
RVKPLHPDA

SEQ ID NO: 454607 - protein, 9 aa, Homo Sapiens
KEYYFDQNP

SEQ ID NO: 454608 - protein, 9 aa, Homo Sapiens
LVAASNYFR

SEQ ID NO: 454609 - protein, 9 aa, Homo Sapiens
ESHVFLLDE

SEQ ID NO: 454610 - protein, 9 aa, Homo Sapiens
PHLNLYKKN

SEQ ID NO: 454611 - protein, 9 aa, Homo Sapiens
QLQAMMAHL

SEQ ID NO: 454612 - protein, 9 aa, Homo Sapiens
RWCTWPLPR

SEQ ID NO: 454613 - protein, 9 aa, Homo Sapiens
VYYNTGDIL

SEQ ID NO: 454614 - protein, 9 aa, Homo Sapiens
RNPTTAWTR

SEQ ID NO: 454615 - protein, 9 aa, Homo Sapiens
GQENIYYVG

SEQ ID NO: 454616 - protein, 9 aa, Homo Sapiens
AQVLLEHGA

SEQ ID NO: 454617 - protein, 9 aa, Homo Sapiens
ALIEVGVDS

SEQ ID NO: 454618 - protein, 9 aa, Homo Sapiens
SLAEFFYLK

SEQ ID NO: 454619 - protein, 9 aa, Homo Sapiens
GCAQVLLEH

SEQ ID NO: 454620 - protein, 9 aa, Homo Sapiens
SETRIRRNA

SEQ ID NO: 454621 - protein, 9 aa, Homo Sapiens
FEKMMSSSD

SEQ ID NO: 454622 - protein, 9 aa, Homo Sapiens
AHLQPPTAD

SEQ ID NO: 454623 - protein, 9 aa, Homo Sapiens
HAVPPLVRK

SEQ ID NO: 454624 - protein, 9 aa, Homo Sapiens
LEQSPEYKN

SEQ ID NO: 454625 - protein, 9 aa, Homo Sapiens
WTNSAICNK

SEQ ID NO: 454626 - protein, 9 aa, Homo Sapiens
NGEISRLPE

SEQ ID NO: 454627 - protein, 9 aa, Homo Sapiens
AYVAGFVDL

SEQ ID NO: 454628 - protein, 9 aa, Homo Sapiens
TKAVIKYTS

SEQ ID NO: 454629 - protein, 9 aa, Homo Sapiens
MSSSDIKST

SEQ ID NO: 454630 - protein, 9 aa, Homo Sapiens
EFYKMVMPP

SEQ ID NO: 454631 - protein, 9 aa, Homo Sapiens
QSPPQVSHH

SEQ ID NO: 454632 - protein, 9 aa, Homo Sapiens
KECGIVSRD

SEQ ID NO: 454633 - protein, 9 aa, Homo Sapiens
QVSHPYPEH

SEQ ID NO: 454634 - protein, 9 aa, Homo Sapiens
GEISRLPEF

SEQ ID NO: 454635 - protein, 9 aa, Homo Sapiens
VTNLRFPLP

SEQ ID NO: 454636 - protein, 9 aa, Homo Sapiens
YFDQNPSLF

SEQ ID NO: 454637 - protein, 9 aa, Homo Sapiens
SHVFLLDEG

SEQ ID NO: 454638 - protein, 9 aa, Homo Sapiens
LPVSVGSST

SEQ ID NO: 454639 - protein, 9 aa, Homo Sapiens
GKQLKDWKK

SEQ ID NO: 454640 - protein, 9 aa, Homo Sapiens
LHSAAEVKR

SEQ ID NO: 454641 - protein, 9 aa, Homo Sapiens
TQNCEVYCS

SEQ ID NO: 454642 - protein, 9 aa, Homo Sapiens
EVQLLHSAA

SEQ ID NO: 454643 - protein, 9 aa, Homo Sapiens
FIVKCPEGC

SEQ ID NO: 454644 - protein, 9 aa, Homo Sapiens
EIVCRDMRN

SEQ ID NO: 454645 - protein, 9 aa, Homo Sapiens
PGAVASMFR

SEQ ID NO: 454646 - protein, 9 aa, Homo Sapiens
SNEEHFTGF

SEQ ID NO: 454647 - protein, 9 aa, Homo Sapiens
NIYYVGYSQ

SEQ ID NO: 454648 - protein, 9 aa, Homo Sapiens
ICNKWEIVS

SEQ ID NO: 454649 - protein, 9 aa, Homo Sapiens
PTAGPSAAT

SEQ ID NO: 454650 - protein, 9 aa, Homo Sapiens
FNGEISRLP

SEQ ID NO: 454651 - protein, 9 aa, Homo Sapiens
ISRLPEFIV

SEQ ID NO: 454652 - protein, 9 aa, Homo Sapiens
GPRGPKGDK

SEQ ID NO: 454653 - protein, 9 aa, Homo Sapiens
ISVTSALIE

SEQ ID NO: 454654 - protein, 9 aa, Homo Sapiens
TDQASHCRC

SEQ ID NO: 454655 - protein, 9 aa, Homo Sapiens
APLKLDPLG

SEQ ID NO: 454656 - protein, 9 aa, Homo Sapiens
VVPPAWPKM

SEQ ID NO: 454657 - protein, 9 aa, Homo Sapiens
QWLHRKAGI

SEQ ID NO: 454658 - protein, 9 aa, Homo Sapiens
SRQAQESHV

SEQ ID NO: 454659 - protein, 9 aa, Homo Sapiens
SHPYPEHPK

SEQ ID NO: 454660 - protein, 9 aa, Homo Sapiens
EKVTSANKT

SEQ ID NO: 454661 - protein, 9 aa, Homo Sapiens
CHKKKPVNW

SEQ ID NO: 454662 - protein, 9 aa, Homo Sapiens
LSMGSGSDT

SEQ ID NO: 454663 - protein, 9 aa, Homo Sapiens
AVPDKNYIC

SEQ ID NO: 454664 - protein, 9 aa, Homo Sapiens
ALQMCTAYV

SEQ ID NO: 454665 - protein, 9 aa, Homo Sapiens
AGVVGLATA

SEQ ID NO: 454666 - protein, 9 aa, Homo Sapiens
NKTNKQTTT

SEQ ID NO: 454667 - protein, 9 aa, Homo Sapiens
YLSVTLRTA

SEQ ID NO: 454668 - protein, 9 aa, Homo Sapiens
TFDCRLHTH

SEQ ID NO: 454669 - protein, 9 aa, Homo Sapiens
AQNQFLLSP

SEQ ID NO: 454670 - protein, 9 aa, Homo Sapiens
MFRVDAELG

SEQ ID NO: 454671 - protein, 9 aa, Homo Sapiens
MSFRQGGLR

SEQ ID NO: 454672 - protein, 9 aa, Homo Sapiens
PSEALNELT

SEQ ID NO: 454673 - protein, 9 aa, Homo Sapiens
ILAMDREGF

SEQ ID NO: 454674 - protein, 9 aa, Homo Sapiens
FEPLPRPRW

SEQ ID NO: 454675 - protein, 9 aa, Homo Sapiens
KTGQENIYY

SEQ ID NO: 454676 - protein, 9 aa, Homo Sapiens
ILEQSPEYK

SEQ ID NO: 454677 - protein, 9 aa, Homo Sapiens
APPPPGPLH

SEQ ID NO: 454678 - protein, 9 aa, Homo Sapiens
TGDILAMDR

SEQ ID NO: 454679 - protein, 9 aa, Homo Sapiens
CEVYCSVDL

SEQ ID NO: 454680 - protein, 9 aa, Homo Sapiens
GPSAATTVP

SEQ ID NO: 454681 - protein, 9 aa, Homo Sapiens
QENIYYVGY

SEQ ID NO: 454682 - protein, 9 aa, Homo Sapiens
RKLNFCANT

SEQ ID NO: 454683 - protein, 9 aa, Homo Sapiens
IVKCPEGCQ

SEQ ID NO: 454684 - protein, 9 aa, Homo Sapiens
PALSMGSGS

SEQ ID NO: 454685 - protein, 9 aa, Homo Sapiens
VASMFRVDA

SEQ ID NO: 454686 - protein, 9 aa, Homo Sapiens
GSSRAIPIK

SEQ ID NO: 454687 - protein, 9 aa, Homo Sapiens
ADIEIFVVV

SEQ ID NO: 454688 - protein, 9 aa, Homo Sapiens
PLHPDATST

SEQ ID NO: 454689 - protein, 9 aa, Homo Sapiens
LVRKVLVGN

SEQ ID NO: 454690 - protein, 8 aa, Homo Sapiens
SAIQAAWP

SEQ ID NO: 454691 - protein, 9 aa, Homo Sapiens
LIPSVVIKL

SEQ ID NO: 454692 - protein, 9 aa, Homo Sapiens
ASMFRVDAE

SEQ ID NO: 454693 - protein, 9 aa, Homo Sapiens
LPNSSLLIC

SEQ ID NO: 454694 - protein, 9 aa, Homo Sapiens
LQPDAHGSL

SEQ ID NO: 454695 - protein, 9 aa, Homo Sapiens
RIPSLAEFF

SEQ ID NO: 454696 - protein, 9 aa, Homo Sapiens
PDAHGSLDR

SEQ ID NO: 454697 - protein, 9 aa, Homo Sapiens
AAQNQFLLS

SEQ ID NO: 454698 - protein, 9 aa, Homo Sapiens
DSSQRLLVA

SEQ ID NO: 454699 - protein, 9 aa, Homo Sapiens
QPQTPERCW

SEQ ID NO: 454700 - protein, 9 aa, Homo Sapiens
ETQVSHPYP

SEQ ID NO: 454701 - protein, 9 aa, Homo Sapiens
SSRAIPIKQ

SEQ ID NO: 454702 - protein, 9 aa, Homo Sapiens
LQMCTAYVA

SEQ ID NO: 454703 - protein, 9 aa, Homo Sapiens
EISRLPEFI

SEQ ID NO: 454704 - protein, 9 aa, Homo Sapiens
PETQVSHPY

SEQ ID NO: 454705 - protein, 9 aa, Homo Sapiens
RGPVVPPAW

SEQ ID NO: 454706 - protein, 9 aa, Homo Sapiens
LAGVVGLAT

SEQ ID NO: 454707 - protein, 9 aa, Homo Sapiens
TSANKTNKQ

SEQ ID NO: 454708 - protein, 9 aa, Homo Sapiens
GGKEKGLEV

SEQ ID NO: 454709 - protein, 9 aa, Homo Sapiens
APGGKGDAD

SEQ ID NO: 454710 - protein, 9 aa, Homo Sapiens
ASQAEGTPG

SEQ ID NO: 454711 - protein, 9 aa, Homo Sapiens
LCGVNSEQI

SEQ ID NO: 454712 - protein, 9 aa, Homo Sapiens
LVDWLCYAS

SEQ ID NO: 454713 - protein, 9 aa, Homo Sapiens
AHGSLDRAT

SEQ ID NO: 454714 - protein, 9 aa, Homo Sapiens
WPGSQEVDS

SEQ ID NO: 454715 - protein, 9 aa, Homo Sapiens
TLHQLMLDC

SEQ ID NO: 454716 - protein, 9 aa, Homo Sapiens
EIVSMGTDQ

SEQ ID NO: 454717 - protein, 9 aa, Homo Sapiens
KWDKKCHRE

SEQ ID NO: 454718 - protein, 9 aa, Homo Sapiens
QASVFQWLQ

SEQ ID NO: 454719 - protein, 9 aa, Homo Sapiens
ASLGCAQVL

SEQ ID NO: 454720 - protein, 9 aa, Homo Sapiens
PRGPKGDKG

SEQ ID NO: 454721 - protein, 9 aa, Homo Sapiens
CGIVSRDGG

SEQ ID NO: 454722 - protein, 9 aa, Homo Sapiens
WCTWPLPRP

SEQ ID NO: 454723 - protein, 9 aa, Homo Sapiens
KKECGIVSR

SEQ ID NO: 454724 - protein, 9 aa, Homo Sapiens
EPAKASQAE

SEQ ID NO: 454725 - protein, 9 aa, Homo Sapiens
PETFNGEIS

SEQ ID NO: 454726 - protein, 9 aa, Homo Sapiens
SEALNELTV

SEQ ID NO: 454727 - protein, 9 aa, Homo Sapiens
NWTNSAICN

SEQ ID NO: 454728 - protein, 9 aa, Homo Sapiens
ADAPGERGP

SEQ ID NO: 454729 - protein, 9 aa, Homo Sapiens
KVTSANKTN

SEQ ID NO: 454730 - protein, 9 aa, Homo Sapiens
PNSSLLICH

SEQ ID NO: 454731 - protein, 9 aa, Homo Sapiens
TIIEMAILR

SEQ ID NO: 454732 - protein, 9 aa, Homo Sapiens
SPAAPLKLD

SEQ ID NO: 454733 - protein, 9 aa, Homo Sapiens
IVCRDMRNL

SEQ ID NO: 454734 - protein, 9 aa, Homo Sapiens
AVPPLVRKV

SEQ ID NO: 454735 - protein, 9 aa, Homo Sapiens
PPQVSHHKS

SEQ ID NO: 454736 - protein, 9 aa, Homo Sapiens
SRIIMYRDG

SEQ ID NO: 454737 - protein, 9 aa, Homo Sapiens
LSNGEMMRG

SEQ ID NO: 454738 - protein, 9 aa, Homo Sapiens
DILAMDREG

SEQ ID NO: 454739 - protein, 9 aa, Homo Sapiens
AALAGVVGL

SEQ ID NO: 454740 - protein, 9 aa, Homo Sapiens
SKDCMIFAA

SEQ ID NO: 454741 - protein, 9 aa, Homo Sapiens
TAYVAGFVD

SEQ ID NO: 454742 - protein, 9 aa, Homo Sapiens
SRRTTLATS

SEQ ID NO: 454743 - protein, 9 aa, Homo Sapiens
PVCEESYLS

SEQ ID NO: 454744 - protein, 9 aa, Homo Sapiens
ETFNGEISR

SEQ ID NO: 454745 - protein, 9 aa, Homo Sapiens
NRGPVVPPA

SEQ ID NO: 454746 - protein, 9 aa, Homo Sapiens
YPEHPKTRR

SEQ ID NO: 454747 - protein, 9 aa, Homo Sapiens
EYKNLLLTL

SEQ ID NO: 454748 - protein, 9 aa, Homo Sapiens
VPDKNYICP

SEQ ID NO: 454749 - protein, 9 aa, Homo Sapiens
RESETRIRR

SEQ ID NO: 454750 - protein, 9 aa, Homo Sapiens
IQASVFQWL

SEQ ID NO: 454751 - protein, 9 aa, Homo Sapiens
GIEIVCRDM

SEQ ID NO: 454752 - protein, 9 aa, Homo Sapiens
LLHSAAEVK

SEQ ID NO: 454753 - protein, 9 aa, Homo Sapiens
RLSNGEMMR

SEQ ID NO: 454754 - protein, 9 aa, Homo Sapiens
LFEKMMSSS

SEQ ID NO: 454755 - protein, 9 aa, Homo Sapiens
CPSTLHQLM

SEQ ID NO: 454756 - protein, 9 aa, Homo Sapiens
GSSTHLSQG

SEQ ID NO: 454757 - protein, 9 aa, Homo Sapiens
EGCHKKKPV

SEQ ID NO: 454758 - protein, 9 aa, Homo Sapiens
GLSPAAPLK

SEQ ID NO: 454759 - protein, 9 aa, Homo Sapiens
QRADIEIFV

SEQ ID NO: 454760 - protein, 9 aa, Homo Sapiens
WTPAPLQRT

SEQ ID NO: 454761 - protein, 9 aa, Homo Sapiens
AENAKRESE

SEQ ID NO: 454762 - protein, 9 aa, Homo Sapiens
LLVARPRRS

SEQ ID NO: 454763 - protein, 9 aa, Homo Sapiens
FRVDAELGS

SEQ ID NO: 454764 - protein, 9 aa, Homo Sapiens
RLGVVALYA

SEQ ID NO: 454765 - protein, 9 aa, Homo Sapiens
PEPAKASQA

SEQ ID NO: 454766 - protein, 9 aa, Homo Sapiens
VHIHLDLTW

SEQ ID NO: 454767 - protein, 9 aa, Homo Sapiens
IPSVVIKLG

SEQ ID NO: 454768 - protein, 9 aa, Homo Sapiens
VVALYACDR

SEQ ID NO: 454769 - protein, 9 aa, Homo Sapiens
RDMRNLRLA

SEQ ID NO: 454770 - protein, 9 aa, Homo Sapiens
IPSLAEFFY

SEQ ID NO: 454771 - protein, 9 aa, Homo Sapiens
PLRHSSILI

SEQ ID NO: 454772 - protein, 9 aa, Homo Sapiens
ESYLSVTLR

SEQ ID NO: 454773 - protein, 9 aa, Homo Sapiens
KFKWDKKCH

SEQ ID NO: 454774 - protein, 9 aa, Homo Sapiens
KACIKGGIE

SEQ ID NO: 454775 - protein, 9 aa, Homo Sapiens
DSPEPAKAS

SEQ ID NO: 454776 - protein, 9 aa, Homo Sapiens
NQFLLSPFL

SEQ ID NO: 454777 - protein, 9 aa, Homo Sapiens
SPEPAKASQ

SEQ ID NO: 454778 - protein, 9 aa, Homo Sapiens
PPMDCPSTL

SEQ ID NO: 454779 - protein, 9 aa, Homo Sapiens
EYMPSRIIM

SEQ ID NO: 454780 - protein, 9 aa, Homo Sapiens
YMPSRIIMY

SEQ ID NO: 454781 - protein, 9 aa, Homo Sapiens
KMVMPPAEQ

SEQ ID NO: 454782 - protein, 9 aa, Homo Sapiens
LCYASLQQG

SEQ ID NO: 454783 - protein, 9 aa, Homo Sapiens
QNQFLLSPF

SEQ ID NO: 454784 - protein, 9 aa, Homo Sapiens
RKRCVYTCR

SEQ ID NO: 454785 - protein, 9 aa, Homo Sapiens
AQESHVFLL

SEQ ID NO: 454786 - protein, 9 aa, Homo Sapiens
RVDAELGSD

SEQ ID NO: 454787 - protein, 9 aa, Homo Sapiens
QRLQPQTPE

SEQ ID NO: 454788 - protein, 9 aa, Homo Sapiens
RQGRIFSKR

SEQ ID NO: 454789 - protein, 9 aa, Homo Sapiens
DAPGERGPP

SEQ ID NO: 454790 - protein, 9 aa, Homo Sapiens
DPHWPGSQE

SEQ ID NO: 454791 - protein, 9 aa, Homo Sapiens
THMYFLLRN

SEQ ID NO: 454792 - protein, 9 aa, Homo Sapiens
VWSLGITII

SEQ ID NO: 454793 - protein, 9 aa, Homo Sapiens
RCVYTCRIV

SEQ ID NO: 454794 - protein, 9 aa, Homo Sapiens
KQLKDWKKP

SEQ ID NO: 454795 - protein, 9 aa, Homo Sapiens
PPGPLHTSQ

SEQ ID NO: 454796 - protein, 9 aa, Homo Sapiens
PEFIVKCPE

SEQ ID NO: 454797 - protein, 9 aa, Homo Sapiens
LGITIIEMA

SEQ ID NO: 454798 - protein, 9 aa, Homo Sapiens
CRDMRNLRL

SEQ ID NO: 454799 - protein, 9 aa, Homo Sapiens
ERCWSHSAE

SEQ ID NO: 454800 - protein, 9 aa, Homo Sapiens
SVGSSTHLS

SEQ ID NO: 454801 - protein, 9 aa, Homo Sapiens
DQASHCRCA

SEQ ID NO: 454802 - protein, 9 aa, Homo Sapiens
WKKPEPCKP

SEQ ID NO: 454803 - protein, 9 aa, Homo Sapiens
LYKKNPPGV

SEQ ID NO: 454804 - protein, 9 aa, Homo Sapiens
PTTAWTRAS

SEQ ID NO: 454805 - protein, 9 aa, Homo Sapiens
SPLQGQRNP

SEQ ID NO: 454806 - protein, 9 aa, Homo Sapiens
QESHVFLLD

SEQ ID NO: 454807 - protein, 9 aa, Homo Sapiens
QRLLVARPR

SEQ ID NO: 454808 - protein, 9 aa, Homo Sapiens
KKKPVNWTN

SEQ ID NO: 454809 - protein, 9 aa, Homo Sapiens
SNGEMMRGI

SEQ ID NO: 454810 - protein, 9 aa, Homo Sapiens
PEGCQDPKY

SEQ ID NO: 454811 - protein, 9 aa, Homo Sapiens
RKAGIQTLE

SEQ ID NO: 454812 - protein, 9 aa, Homo Sapiens
QSILTTPEA

SEQ ID NO: 454813 - protein, 9 aa, Homo Sapiens
EAARPLFFL

SEQ ID NO: 454814 - protein, 9 aa, Homo Sapiens
LWVDDLSVE

SEQ ID NO: 454815 - protein, 9 aa, Homo Sapiens
LATYTDGNW

SEQ ID NO: 454816 - protein, 9 aa, Homo Sapiens
DPRKLLNIH

SEQ ID NO: 454817 - protein, 9 aa, Homo Sapiens
TIAAKTHHQ

SEQ ID NO: 454818 - protein, 9 aa, Homo Sapiens
PGRWKLHLA

SEQ ID NO: 454819 - protein, 9 aa, Homo Sapiens
KFFHHLLQI

SEQ ID NO: 454820 - protein, 9 aa, Homo Sapiens
RLLRKGGLG

SEQ ID NO: 454821 - protein, 9 aa, Homo Sapiens
KKDIRHCHR

SEQ ID NO: 454822 - protein, 9 aa, Homo Sapiens
HKGLTVKIG

SEQ ID NO: 454823 - protein, 9 aa, Homo Sapiens
VVYKSENVH

SEQ ID NO: 454824 - protein, 9 aa, Homo Sapiens
FVTGTLRVP

SEQ ID NO: 454825 - protein, 9 aa, Homo Sapiens
ILEGRRGPG

SEQ ID NO: 454826 - protein, 9 aa, Homo Sapiens
KGRKGMGGW

SEQ ID NO: 454827 - protein, 9 aa, Homo Sapiens
TGHRNQTIF

SEQ ID NO: 454828 - protein, 9 aa, Homo Sapiens
SVDLMLSIT

SEQ ID NO: 454829 - protein, 9 aa, Homo Sapiens
NTGPGKRKR

SEQ ID NO: 454830 - protein, 9 aa, Homo Sapiens
WESESPCET

SEQ ID NO: 454831 - protein, 9 aa, Homo Sapiens
LIQSILTTP

SEQ ID NO: 454832 - protein, 9 aa, Homo Sapiens
KEREDIKKK

SEQ ID NO: 454833 - protein, 9 aa, Homo Sapiens
YSQREVDAV

SEQ ID NO: 454834 - protein, 9 aa, Homo Sapiens
ADVKALSCG

SEQ ID NO: 454835 - protein, 9 aa, Homo Sapiens
SNNIFLHKG

SEQ ID NO: 454836 - protein, 9 aa, Homo Sapiens
EELTFSWVK

SEQ ID NO: 454837 - protein, 9 aa, Homo Sapiens
LIQAQPRGS

SEQ ID NO: 454838 - protein, 9 aa, Homo Sapiens
YLISAHHPE

SEQ ID NO: 454839 - protein, 9 aa, Homo Sapiens
GDPRKLLNI

SEQ ID NO: 454840 - protein, 9 aa, Homo Sapiens
AEELADMVV

SEQ ID NO: 454841 - protein, 9 aa, Homo Sapiens
VQFSKSIEV

SEQ ID NO: 454842 - protein, 9 aa, Homo Sapiens
AEELPGLKL

SEQ ID NO: 454843 - protein, 9 aa, Homo Sapiens
ESSEPYFFR

SEQ ID NO: 454844 - protein, 9 aa, Homo Sapiens
DEENSWESE

SEQ ID NO: 454845 - protein, 9 aa, Homo Sapiens
DNKNEVHVA

SEQ ID NO: 454846 - protein, 9 aa, Homo Sapiens
AKDLCSTSS

SEQ ID NO: 454847 - protein, 9 aa, Homo Sapiens
MSLPKPQPC

SEQ ID NO: 454848 - protein, 9 aa, Homo Sapiens
ENVHVIKLN

SEQ ID NO: 454849 - protein, 9 aa, Homo Sapiens
LVPPGLQPP

SEQ ID NO: 454850 - protein, 9 aa, Homo Sapiens
PELKKNTPW

SEQ ID NO: 454851 - protein, 9 aa, Homo Sapiens
RRGPGCAVL

SEQ ID NO: 454852 - protein, 9 aa, Homo Sapiens
HHLLQITVL

SEQ ID NO: 454853 - protein, 9 aa, Homo Sapiens
FFDFHGHSQ

SEQ ID NO: 454854 - protein, 9 aa, Homo Sapiens
SGADLPQMD

SEQ ID NO: 454855 - protein, 9 aa, Homo Sapiens
GGLGQARRC

SEQ ID NO: 454856 - protein, 9 aa, Homo Sapiens
VGTLYPFSR

SEQ ID NO: 454857 - protein, 8 aa, Homo Sapiens
DETGNLTV

SEQ ID NO: 454858 - protein, 9 aa, Homo Sapiens
IAAKTHHQA

SEQ ID NO: 454859 - protein, 9 aa, Homo Sapiens
QHVQKLSKC

SEQ ID NO: 454860 - protein, 9 aa, Homo Sapiens
TVSIGGHSL

SEQ ID NO: 454861 - protein, 9 aa, Homo Sapiens
FPLAMENIK

SEQ ID NO: 454862 - protein, 9 aa, Homo Sapiens
TKGTGASGC

SEQ ID NO: 454863 - protein, 9 aa, Homo Sapiens
RRRQREQRL

SEQ ID NO: 454864 - protein, 9 aa, Homo Sapiens
TFSWVKNGR

SEQ ID NO: 454865 - protein, 9 aa, Homo Sapiens
RPEEIMQIL

SEQ ID NO: 454866 - protein, 9 aa, Homo Sapiens
SDTMVEPYN

SEQ ID NO: 454867 - protein, 9 aa, Homo Sapiens
MVTAIYIAC

SEQ ID NO: 454868 - protein, 9 aa, Homo Sapiens
QISMEMDVT

SEQ ID NO: 454869 - protein, 9 aa, Homo Sapiens
SMRGEKVMS

SEQ ID NO: 454870 - protein, 9 aa, Homo Sapiens
TGGSSSVLL

SEQ ID NO: 454871 - protein, 9 aa, Homo Sapiens
SGQDGSSQW

SEQ ID NO: 454872 - protein, 9 aa, Homo Sapiens
GPEGARVSS

SEQ ID NO: 454873 - protein, 9 aa, Homo Sapiens
IGVFLDLSS

SEQ ID NO: 454874 - protein, 9 aa, Homo Sapiens
KCLEWKNKE

SEQ ID NO: 454875 - protein, 9 aa, Homo Sapiens
FLMGKTLLV

SEQ ID NO: 454876 - protein, 9 aa, Homo Sapiens
PCPELKKNT

SEQ ID NO: 454877 - protein, 9 aa, Homo Sapiens
VSHIAVVIL

SEQ ID NO: 454878 - protein, 9 aa, Homo Sapiens
LVFLIPFVI

SEQ ID NO: 454879 - protein, 9 aa, Homo Sapiens
HRPFSPGKQ

SEQ ID NO: 454880 - protein, 9 aa, Homo Sapiens
HHPEVLPTA

SEQ ID NO: 454881 - protein, 9 aa, Homo Sapiens
SSQTTTKGP

SEQ ID NO: 454882 - protein, 9 aa, Homo Sapiens
PGVPGLPGY

SEQ ID NO: 454883 - protein, 9 aa, Homo Sapiens
VARCDVSKR

SEQ ID NO: 454884 - protein, 9 aa, Homo Sapiens
QTEEKKCKR

SEQ ID NO: 454885 - protein, 9 aa, Homo Sapiens
TKKKEREDI

SEQ ID NO: 454886 - protein, 9 aa, Homo Sapiens
WPTPTRIPM

SEQ ID NO: 454887 - protein, 9 aa, Homo Sapiens
KNEVHVARC

SEQ ID NO: 454888 - protein, 9 aa, Homo Sapiens
MREMRAGGC

SEQ ID NO: 454889 - protein, 9 aa, Homo Sapiens
SAVPQASFS

SEQ ID NO: 454890 - protein, 9 aa, Homo Sapiens
KSNNIFLHK

SEQ ID NO: 454891 - protein, 9 aa, Homo Sapiens
GVCREGSRC

SEQ ID NO: 454892 - protein, 9 aa, Homo Sapiens
KMQIQVLLH

SEQ ID NO: 454893 - protein, 9 aa, Homo Sapiens
EAIHEACRN

SEQ ID NO: 454894 - protein, 9 aa, Homo Sapiens
IRASRNKPG

SEQ ID NO: 454895 - protein, 9 aa, Homo Sapiens
VDAVEVFFS

SEQ ID NO: 454896 - protein, 9 aa, Homo Sapiens
EGASFGAPQ

SEQ ID NO: 454897 - protein, 9 aa, Homo Sapiens
DGKDCQSCF

SEQ ID NO: 454898 - protein, 9 aa, Homo Sapiens
GELAEEAAE

SEQ ID NO: 454899 - protein, 9 aa, Homo Sapiens
KSIKVEAVE

SEQ ID NO: 454900 - protein, 9 aa, Homo Sapiens
ATYTDGNWY

SEQ ID NO: 454901 - protein, 9 aa, Homo Sapiens
AVVQFSKSI

SEQ ID NO: 454902 - protein, 9 aa, Homo Sapiens
SWVKNGRPL

SEQ ID NO: 454903 - protein, 9 aa, Homo Sapiens
CGLFMRNPN

SEQ ID NO: 454904 - protein, 9 aa, Homo Sapiens
LEDSYICNE

SEQ ID NO: 454905 - protein, 9 aa, Homo Sapiens
APSQIYGGV

SEQ ID NO: 454906 - protein, 9 aa, Homo Sapiens
KVSDTMVEP

SEQ ID NO: 454907 - protein, 9 aa, Homo Sapiens
IPDKPVSVK

SEQ ID NO: 454908 - protein, 9 aa, Homo Sapiens
VSEVVEQFE

SEQ ID NO: 454909 - protein, 9 aa, Homo Sapiens
VECNRHMLT

SEQ ID NO: 454910 - protein, 9 aa, Homo Sapiens
SNIRTQPQR

SEQ ID NO: 454911 - protein, 9 aa, Homo Sapiens
IRCEVCKKA

SEQ ID NO: 454912 - protein, 9 aa, Homo Sapiens
IRHCHRMSR

SEQ ID NO: 454913 - protein, 9 aa, Homo Sapiens
HQDTMPRPQ

SEQ ID NO: 454914 - protein, 9 aa, Homo Sapiens
QAQPRGSRW

SEQ ID NO: 454915 - protein, 9 aa, Homo Sapiens
PFKPEGKAE

SEQ ID NO: 454916 - protein, 9 aa, Homo Sapiens
PGWTWPLLT

SEQ ID NO: 454917 - protein, 9 aa, Homo Sapiens
AEGGAAHRV

SEQ ID NO: 454918 - protein, 9 aa, Homo Sapiens
SSEGSNVSS

SEQ ID NO: 454919 - protein, 9 aa, Homo Sapiens
QDGLSPNHL

SEQ ID NO: 454920 - protein, 9 aa, Homo Sapiens
DVQIVEREM

SEQ ID NO: 454921 - protein, 9 aa, Homo Sapiens
TSHQNLWVD

SEQ ID NO: 454922 - protein, 9 aa, Homo Sapiens
PPALASRPS

SEQ ID NO: 454923 - protein, 9 aa, Homo Sapiens
QSHTGEKPY

SEQ ID NO: 454924 - protein, 9 aa, Homo Sapiens
VFFLRCTIC

SEQ ID NO: 454925 - protein, 9 aa, Homo Sapiens
LVTEVSAYS

SEQ ID NO: 454926 - protein, 9 aa, Homo Sapiens
SEGSNVSSE

SEQ ID NO: 454927 - protein, 9 aa, Homo Sapiens
HSHDMTERE

SEQ ID NO: 454928 - protein, 9 aa, Homo Sapiens
ALSGSLLSS

SEQ ID NO: 454929 - protein, 9 aa, Homo Sapiens
PVSDYFFLL

SEQ ID NO: 454930 - protein, 9 aa, Homo Sapiens
LCVHIAGLC

SEQ ID NO: 454931 - protein, 9 aa, Homo Sapiens
QLHRISFYA

SEQ ID NO: 454932 - protein, 9 aa, Homo Sapiens
PLLTRHTIN

SEQ ID NO: 454933 - protein, 9 aa, Homo Sapiens
QLIDIIHTT

SEQ ID NO: 454934 - protein, 9 aa, Homo Sapiens
TSASACASP

SEQ ID NO: 454935 - protein, 9 aa, Homo Sapiens
LPEAYKLRA

SEQ ID NO: 454936 - protein, 9 aa, Homo Sapiens
CSTIIPSSN

SEQ ID NO: 454937 - protein, 9 aa, Homo Sapiens
GASFGAPQM

SEQ ID NO: 454938 - protein, 9 aa, Homo Sapiens
NLLGFMPEE

SEQ ID NO: 454939 - protein, 9 aa, Homo Sapiens
ERGICRYGA

SEQ ID NO: 454940 - protein, 9 aa, Homo Sapiens
PAVIPDVQI

SEQ ID NO: 454941 - protein, 9 aa, Homo Sapiens
LHILNSNWF

SEQ ID NO: 454942 - protein, 9 aa, Homo Sapiens
MPAHLHLRS

SEQ ID NO: 454943 - protein, 9 aa, Homo Sapiens
NPDLRVLTL

SEQ ID NO: 454944 - protein, 9 aa, Homo Sapiens
KRFKSQDAD

SEQ ID NO: 454945 - protein, 9 aa, Homo Sapiens
VFLIPFVIT

SEQ ID NO: 454946 - protein, 9 aa, Homo Sapiens
NKQRMSNVA

SEQ ID NO: 454947 - protein, 9 aa, Homo Sapiens
KNKQRMSNV

SEQ ID NO: 454948 - protein, 9 aa, Homo Sapiens
PGRWCLGED

SEQ ID NO: 454949 - protein, 9 aa, Homo Sapiens
TTAARANKE

SEQ ID NO: 454950 - protein, 9 aa, Homo Sapiens
RGLQEKHLK

SEQ ID NO: 454951 - protein, 9 aa, Homo Sapiens
GMKMKLDPQ

SEQ ID NO: 454952 - protein, 9 aa, Homo Sapiens
LKLGTCPSR

SEQ ID NO: 454953 - protein, 9 aa, Homo Sapiens
VVEQFEDIW

SEQ ID NO: 454954 - protein, 9 aa, Homo Sapiens
KRAEMVALM

SEQ ID NO: 454955 - protein, 9 aa, Homo Sapiens
KLMLIDFKY

SEQ ID NO: 454956 - protein, 9 aa, Homo Sapiens
YQSTSASAC

SEQ ID NO: 454957 - protein, 9 aa, Homo Sapiens
QNTFGQLQR

SEQ ID NO: 454958 - protein, 9 aa, Homo Sapiens
FCKIYYSVD

SEQ ID NO: 454959 - protein, 9 aa, Homo Sapiens
NQFQVPIGV

SEQ ID NO: 454960 - protein, 9 aa, Homo Sapiens
DVKALSCGE

SEQ ID NO: 454961 - protein, 9 aa, Homo Sapiens
DPQNSEVMP

SEQ ID NO: 454962 - protein, 9 aa, Homo Sapiens
EGKPHLIPA

SEQ ID NO: 454963 - protein, 9 aa, Homo Sapiens
CGELGLVLA

SEQ ID NO: 454964 - protein, 9 aa, Homo Sapiens
HRNQTIFSP

SEQ ID NO: 454965 - protein, 9 aa, Homo Sapiens
EGFLFRLSF

SEQ ID NO: 454966 - protein, 9 aa, Homo Sapiens
SESSEGSNV

SEQ ID NO: 454967 - protein, 9 aa, Homo Sapiens
RKISNIRTQ

SEQ ID NO: 454968 - protein, 9 aa, Homo Sapiens
SPKVSDTMV

SEQ ID NO: 454969 - protein, 9 aa, Homo Sapiens
CFCCYEECK

SEQ ID NO: 454970 - protein, 9 aa, Homo Sapiens
MVLELPSFL

SEQ ID NO: 454971 - protein, 9 aa, Homo Sapiens
RHAFQNLEI

SEQ ID NO: 454972 - protein, 9 aa, Homo Sapiens
KPQPCVMPP

SEQ ID NO: 454973 - protein, 9 aa, Homo Sapiens
TLSQCEFLM

SEQ ID NO: 454974 - protein, 9 aa, Homo Sapiens
EKRFKSQDA

SEQ ID NO: 454975 - protein, 9 aa, Homo Sapiens
YVKHMFIHT

SEQ ID NO: 454976 - protein, 9 aa, Homo Sapiens
AHHPEVLPT

SEQ ID NO: 454977 - protein, 9 aa, Homo Sapiens
ANYSDVLDP

SEQ ID NO: 454978 - protein, 9 aa, Homo Sapiens
GNVSLCETA

SEQ ID NO: 454979 - protein, 9 aa, Homo Sapiens
IRKISNIRT

SEQ ID NO: 454980 - protein, 9 aa, Homo Sapiens
LPSAVQTFS

SEQ ID NO: 454981 - protein, 9 aa, Homo Sapiens
LCKRFLERG

SEQ ID NO: 454982 - protein, 9 aa, Homo Sapiens
SMEMDVTKP

SEQ ID NO: 454983 - protein, 9 aa, Homo Sapiens
QREVDAVEV

SEQ ID NO: 454984 - protein, 9 aa, Homo Sapiens
ETKKKERED

SEQ ID NO: 454985 - protein, 9 aa, Homo Sapiens
DMANYSDVL

SEQ ID NO: 454986 - protein, 9 aa, Homo Sapiens
GSISFGFRT

SEQ ID NO: 454987 - protein, 9 aa, Homo Sapiens
ANMVTAIYI

SEQ ID NO: 454988 - protein, 9 aa, Homo Sapiens
DENQDVSME

SEQ ID NO: 454989 - protein, 9 aa, Homo Sapiens
RQGIQHLLR

SEQ ID NO: 454990 - protein, 9 aa, Homo Sapiens
SVKELDLVL

SEQ ID NO: 454991 - protein, 9 aa, Homo Sapiens
EVWEVLNLM

SEQ ID NO: 454992 - protein, 9 aa, Homo Sapiens
LIDIIHTTA

SEQ ID NO: 454993 - protein, 9 aa, Homo Sapiens
KGTRTIAAK

SEQ ID NO: 454994 - protein, 9 aa, Homo Sapiens
TSGNCSAST

SEQ ID NO: 454995 - protein, 9 aa, Homo Sapiens
HPELITFNY

SEQ ID NO: 454996 - protein, 9 aa, Homo Sapiens
VMSHSSLNC

SEQ ID NO: 454997 - protein, 9 aa, Homo Sapiens
GEKGKPGVP

SEQ ID NO: 454998 - protein, 9 aa, Homo Sapiens
HEGRTNLTV

SEQ ID NO: 454999 - protein, 9 aa, Homo Sapiens
PGPKGSSDD

SEQ ID NO: 455000 - protein, 9 aa, Homo Sapiens
MVEPYNATL

SEQ ID NO: 455001 - protein, 9 aa, Homo Sapiens
TVTCGLFMR

SEQ ID NO: 455002 - protein, 9 aa, Homo Sapiens
NNIFLHKGL

SEQ ID NO: 455003 - protein, 9 aa, Homo Sapiens
SSSVLLGAP

SEQ ID NO: 455004 - protein, 9 aa, Homo Sapiens
FAVDAAATV

SEQ ID NO: 455005 - protein, 9 aa, Homo Sapiens
HTLNAVNME

SEQ ID NO: 455006 - protein, 9 aa, Homo Sapiens
RFYRGDSST

SEQ ID NO: 455007 - protein, 9 aa, Homo Sapiens
RQREQRLKR

SEQ ID NO: 455008 - protein, 9 aa, Homo Sapiens
PSQIYGGVT

SEQ ID NO: 455009 - protein, 9 aa, Homo Sapiens
VIRGLQEKH

SEQ ID NO: 455010 - protein, 9 aa, Homo Sapiens
VQEENDSHV

SEQ ID NO: 455011 - protein, 9 aa, Homo Sapiens
HLKNYREHL

SEQ ID NO: 455012 - protein, 9 aa, Homo Sapiens
NAVNMELYT

SEQ ID NO: 455013 - protein, 9 aa, Homo Sapiens
DAKEKRFKS

SEQ ID NO: 455014 - protein, 9 aa, Homo Sapiens
KSDRLSPAP

SEQ ID NO: 455015 - protein, 9 aa, Homo Sapiens
KTEGLEEQG

SEQ ID NO: 455016 - protein, 9 aa, Homo Sapiens
EVCKKAGNL

SEQ ID NO: 455017 - protein, 9 aa, Homo Sapiens
VLAQKSGFD

SEQ ID NO: 455018 - protein, 9 aa, Homo Sapiens
GKDCQSCFC

SEQ ID NO: 455019 - protein, 9 aa, Homo Sapiens
WSELDVGTL

SEQ ID NO: 455020 - protein, 9 aa, Homo Sapiens
KSSINHIET

SEQ ID NO: 455021 - protein, 9 aa, Homo Sapiens
RPTKYKDAN

SEQ ID NO: 455022 - protein, 9 aa, Homo Sapiens
RKVCEDSVR

SEQ ID NO: 455023 - protein, 9 aa, Homo Sapiens
PIEDIQENL

SEQ ID NO: 455024 - protein, 9 aa, Homo Sapiens
ATICRTLNG

SEQ ID NO: 455025 - protein, 9 aa, Homo Sapiens
SLGACLGPR

SEQ ID NO: 455026 - protein, 9 aa, Homo Sapiens
EVTGAFMKI

SEQ ID NO: 455027 - protein, 9 aa, Homo Sapiens
LLCGMREMR

SEQ ID NO: 455028 - protein, 9 aa, Homo Sapiens
ELGLVLASA

SEQ ID NO: 455029 - protein, 9 aa, Homo Sapiens
KHMFIHTGE

SEQ ID NO: 455030 - protein, 9 aa, Homo Sapiens
TSSSREESS

SEQ ID NO: 455031 - protein, 9 aa, Homo Sapiens
TNLTVLVED

SEQ ID NO: 455032 - protein, 9 aa, Homo Sapiens
EENSWESES

SEQ ID NO: 455033 - protein, 9 aa, Homo Sapiens
DCQSCFCCY

SEQ ID NO: 455034 - protein, 9 aa, Homo Sapiens
EFLTQAVIR

SEQ ID NO: 455035 - protein, 9 aa, Homo Sapiens
QFNELGANA

SEQ ID NO: 455036 - protein, 9 aa, Homo Sapiens
LEVLTSVSD

SEQ ID NO: 455037 - protein, 9 aa, Homo Sapiens
YLFEALACT

SEQ ID NO: 455038 - protein, 9 aa, Homo Sapiens
ALLCGMREM

SEQ ID NO: 455039 - protein, 9 aa, Homo Sapiens
TNHGQLFQN

SEQ ID NO: 455040 - protein, 9 aa, Homo Sapiens
VSYLFEALA

SEQ ID NO: 455041 - protein, 9 aa, Homo Sapiens
TGILITMET

SEQ ID NO: 455042 - protein, 9 aa, Homo Sapiens
MLIDFKYSS

SEQ ID NO: 455043 - protein, 9 aa, Homo Sapiens
ELDLVLAYY

SEQ ID NO: 455044 - protein, 9 aa, Homo Sapiens
PKGSSDDPG

SEQ ID NO: 455045 - protein, 9 aa, Homo Sapiens
LNAVNMELY

SEQ ID NO: 455046 - protein, 9 aa, Homo Sapiens
RGDSSTDSQ

SEQ ID NO: 455047 - protein, 9 aa, Homo Sapiens
GKDVMVAPS

SEQ ID NO: 455048 - protein, 9 aa, Homo Sapiens
AAQKTGCLY

SEQ ID NO: 455049 - protein, 9 aa, Homo Sapiens
LSSWCASPP

SEQ ID NO: 455050 - protein, 9 aa, Homo Sapiens
QDLDIVPSD

SEQ ID NO: 455051 - protein, 9 aa, Homo Sapiens
IQAQPRGSR

SEQ ID NO: 455052 - protein, 9 aa, Homo Sapiens
QPCVMPPPP

SEQ ID NO: 455053 - protein, 9 aa, Homo Sapiens
LDLVLAYYV

SEQ ID NO: 455054 - protein, 9 aa, Homo Sapiens
KLSHLHNVL

SEQ ID NO: 455055 - protein, 9 aa, Homo Sapiens
KPDMADIEK

SEQ ID NO: 455056 - protein, 9 aa, Homo Sapiens
YSDVLDPTY

SEQ ID NO: 455057 - protein, 9 aa, Homo Sapiens
SNKTPHKSS

SEQ ID NO: 455058 - protein, 9 aa, Homo Sapiens
CTPLTLCTA

SEQ ID NO: 455059 - protein, 9 aa, Homo Sapiens
WVDDLSVEW

SEQ ID NO: 455060 - protein, 9 aa, Homo Sapiens
LQITVLNSY

SEQ ID NO: 455061 - protein, 9 aa, Homo Sapiens
KLLNIHWVQ

SEQ ID NO: 455062 - protein, 9 aa, Homo Sapiens
TDLRHAFQN

SEQ ID NO: 455063 - protein, 9 aa, Homo Sapiens
LDPQNSEVM

SEQ ID NO: 455064 - protein, 9 aa, Homo Sapiens
LLGAPSLQT

SEQ ID NO: 455065 - protein, 9 aa, Homo Sapiens
AMQDGLSPN

SEQ ID NO: 455066 - protein, 9 aa, Homo Sapiens
SNNPHRCTP

SEQ ID NO: 455067 - protein, 9 aa, Homo Sapiens
KTHTGDRHY

SEQ ID NO: 455068 - protein, 9 aa, Homo Sapiens
TGASGCFKL

SEQ ID NO: 455069 - protein, 9 aa, Homo Sapiens
LAEEAAEKA

SEQ ID NO: 455070 - protein, 9 aa, Homo Sapiens
VIQVKCLEW

SEQ ID NO: 455071 - protein, 9 aa, Homo Sapiens
ERQGIQHLL

SEQ ID NO: 455072 - protein, 9 aa, Homo Sapiens
STLSQCEFL

SEQ ID NO: 455073 - protein, 9 aa, Homo Sapiens
GFLFRLSFC

SEQ ID NO: 455074 - protein, 9 aa, Homo Sapiens
QDINENEPK

SEQ ID NO: 455075 - protein, 9 aa, Homo Sapiens
MVVSMATEI

SEQ ID NO: 455076 - protein, 9 aa, Homo Sapiens
WLAATICRT

SEQ ID NO: 455077 - protein, 9 aa, Homo Sapiens
QQSHTGEKP

SEQ ID NO: 455078 - protein, 9 aa, Homo Sapiens
YAQISMEMD

SEQ ID NO: 455079 - protein, 9 aa, Homo Sapiens
RDSIAPVSP

SEQ ID NO: 455080 - protein, 9 aa, Homo Sapiens
PDLRVLTLV

SEQ ID NO: 455081 - protein, 9 aa, Homo Sapiens
GADLPQMDH

SEQ ID NO: 455082 - protein, 9 aa, Homo Sapiens
QACIRCEVC

SEQ ID NO: 455083 - protein, 9 aa, Homo Sapiens
DGPHEGRTN

SEQ ID NO: 455084 - protein, 9 aa, Homo Sapiens
TLNAVNMEL

SEQ ID NO: 455085 - protein, 9 aa, Homo Sapiens
CLYLFPTFL

SEQ ID NO: 455086 - protein, 9 aa, Homo Sapiens
NNPHRCTPV

SEQ ID NO: 455087 - protein, 9 aa, Homo Sapiens
VMVLELPSF

SEQ ID NO: 455088 - protein, 9 aa, Homo Sapiens
GPFLVSAPV

SEQ ID NO: 455089 - protein, 9 aa, Homo Sapiens
DAETSSGGQ

SEQ ID NO: 455090 - protein, 9 aa, Homo Sapiens
EFQGGDHSN

SEQ ID NO: 455091 - protein, 9 aa, Homo Sapiens
RLKKDIRHC

SEQ ID NO: 455092 - protein, 9 aa, Homo Sapiens
EDIQENLLQ

SEQ ID NO: 455093 - protein, 9 aa, Homo Sapiens
DWQYSQREV

SEQ ID NO: 455094 - protein, 9 aa, Homo Sapiens
LLTRHTINP

SEQ ID NO: 455095 - protein, 9 aa, Homo Sapiens
QCNCTPLTL

SEQ ID NO: 455096 - protein, 9 aa, Homo Sapiens
TEEKKCKRY

SEQ ID NO: 455097 - protein, 9 aa, Homo Sapiens
SCAIEQGNV

SEQ ID NO: 455098 - protein, 9 aa, Homo Sapiens
EIQKTEGLE

SEQ ID NO: 455099 - protein, 9 aa, Homo Sapiens
KEVCGEKQH

SEQ ID NO: 455100 - protein, 9 aa, Homo Sapiens
DMTERELRT

SEQ ID NO: 455101 - protein, 9 aa, Homo Sapiens
RFLESEFSP

SEQ ID NO: 455102 - protein, 9 aa, Homo Sapiens
GMLKQQYLS

SEQ ID NO: 455103 - protein, 9 aa, Homo Sapiens
CEFLMGKTL

SEQ ID NO: 455104 - protein, 9 aa, Homo Sapiens
EHDIIKEKT

SEQ ID NO: 455105 - protein, 9 aa, Homo Sapiens
DGATMRASV

SEQ ID NO: 455106 - protein, 9 aa, Homo Sapiens
HPLDCPICH

SEQ ID NO: 455107 - protein, 9 aa, Homo Sapiens
VLTGRGTYS

SEQ ID NO: 455108 - protein, 9 aa, Homo Sapiens
ISNIRTQPQ

SEQ ID NO: 455109 - protein, 9 aa, Homo Sapiens
DPLVSAVPQ

SEQ ID NO: 455110 - protein, 9 aa, Homo Sapiens
SAPVRAKKP

SEQ ID NO: 455111 - protein, 9 aa, Homo Sapiens
NVMRHFAVD

SEQ ID NO: 455112 - protein, 9 aa, Homo Sapiens
SLHTLNAVN

SEQ ID NO: 455113 - protein, 9 aa, Homo Sapiens
VNKMVLVFA

SEQ ID NO: 455114 - protein, 9 aa, Homo Sapiens
PVVFFDFHG

SEQ ID NO: 455115 - protein, 9 aa, Homo Sapiens
AAAQKTGCL

SEQ ID NO: 455116 - protein, 9 aa, Homo Sapiens
ANNLTMNCF

SEQ ID NO: 455117 - protein, 9 aa, Homo Sapiens
VYDNGTRDI

SEQ ID NO: 455118 - protein, 9 aa, Homo Sapiens
IQVGHSPEP

SEQ ID NO: 455119 - protein, 9 aa, Homo Sapiens
NAHAANMVT

SEQ ID NO: 455120 - protein, 9 aa, Homo Sapiens
DDEENSWES

SEQ ID NO: 455121 - protein, 9 aa, Homo Sapiens
CKIYYSVDL

SEQ ID NO: 455122 - protein, 9 aa, Homo Sapiens
RNKPGAAFG

SEQ ID NO: 455123 - protein, 9 aa, Homo Sapiens
QIQYAQISM

SEQ ID NO: 455124 - protein, 9 aa, Homo Sapiens
SHSSLNCYI

SEQ ID NO: 455125 - protein, 9 aa, Homo Sapiens
SEPYFFRRT

SEQ ID NO: 455126 - protein, 9 aa, Homo Sapiens
RCALSGSLL

SEQ ID NO: 455127 - protein, 9 aa, Homo Sapiens
LVSATEVPS

SEQ ID NO: 455128 - protein, 9 aa, Homo Sapiens
PLVSAVPQA

SEQ ID NO: 455129 - protein, 9 aa, Homo Sapiens
HRVGTLQVG

SEQ ID NO: 455130 - protein, 9 aa, Homo Sapiens
INAGVFFLR

SEQ ID NO: 455131 - protein, 9 aa, Homo Sapiens
VHVIKLNIE

SEQ ID NO: 455132 - protein, 9 aa, Homo Sapiens
KRPRPPPAR

SEQ ID NO: 455133 - protein, 9 aa, Homo Sapiens
GAPQMAKGD

SEQ ID NO: 455134 - protein, 9 aa, Homo Sapiens
LLVHQQSHT

SEQ ID NO: 455135 - protein, 9 aa, Homo Sapiens
FFQDLDIVP

SEQ ID NO: 455136 - protein, 9 aa, Homo Sapiens
QEENDSHVQ

SEQ ID NO: 455137 - protein, 9 aa, Homo Sapiens
SELDVGTLY

SEQ ID NO: 455138 - protein, 9 aa, Homo Sapiens
RCGELGLVL

SEQ ID NO: 455139 - protein, 9 aa, Homo Sapiens
WLSVYSRLS

SEQ ID NO: 455140 - protein, 9 aa, Homo Sapiens
SSRESAPVR

SEQ ID NO: 455141 - protein, 9 aa, Homo Sapiens
IAPVSPTAN

SEQ ID NO: 455142 - protein, 9 aa, Homo Sapiens
SWESESPCE

SEQ ID NO: 455143 - protein, 9 aa, Homo Sapiens
MSDKPDMAD

SEQ ID NO: 455144 - protein, 9 aa, Homo Sapiens
IVRPQGPPG

SEQ ID NO: 455145 - protein, 9 aa, Homo Sapiens
RRQREQRLK

SEQ ID NO: 455146 - protein, 9 aa, Homo Sapiens
ECMICGKVF

SEQ ID NO: 455147 - protein, 9 aa, Homo Sapiens
VSATEVPST

SEQ ID NO: 455148 - protein, 9 aa, Homo Sapiens
VLNLMGVYS

SEQ ID NO: 455149 - protein, 9 aa, Homo Sapiens
RQACIRCEV

SEQ ID NO: 455150 - protein, 9 aa, Homo Sapiens
QGISAAVYD

SEQ ID NO: 455151 - protein, 9 aa, Homo Sapiens
SPGRWCLGE

SEQ ID NO: 455152 - protein, 9 aa, Homo Sapiens
LADMVVSMA

SEQ ID NO: 455153 - protein, 9 aa, Homo Sapiens
AANMVTAIY

SEQ ID NO: 455154 - protein, 9 aa, Homo Sapiens
MNCFENCGG

SEQ ID NO: 455155 - protein, 9 aa, Homo Sapiens
LDSGPEGAR

SEQ ID NO: 455156 - protein, 9 aa, Homo Sapiens
PELITFNYG

SEQ ID NO: 455157 - protein, 9 aa, Homo Sapiens
HYYSIPSYH

SEQ ID NO: 455158 - protein, 9 aa, Homo Sapiens
QNVLSTALR

SEQ ID NO: 455159 - protein, 9 aa, Homo Sapiens
NVSLCETAL

SEQ ID NO: 455160 - protein, 9 aa, Homo Sapiens
WISSDCPER

SEQ ID NO: 455161 - protein, 9 aa, Homo Sapiens
TIFILVFLI

SEQ ID NO: 455162 - protein, 9 aa, Homo Sapiens
MKLDPQNSE

SEQ ID NO: 455163 - protein, 9 aa, Homo Sapiens
MLKQQYLSI

SEQ ID NO: 455164 - protein, 9 aa, Homo Sapiens
VMVAPSHLR

SEQ ID NO: 455165 - protein, 9 aa, Homo Sapiens
DLLVHQQSH

SEQ ID NO: 455166 - protein, 9 aa, Homo Sapiens
EIMQILAQS

SEQ ID NO: 455167 - protein, 9 aa, Homo Sapiens
IIKIQDINE

SEQ ID NO: 455168 - protein, 9 aa, Homo Sapiens
GQVGPKKCH

SEQ ID NO: 455169 - protein, 9 aa, Homo Sapiens
REDIKKKSE

SEQ ID NO: 455170 - protein, 9 aa, Homo Sapiens
GTGASGCFK

SEQ ID NO: 455171 - protein, 9 aa, Homo Sapiens
PQCNCTPLT

SEQ ID NO: 455172 - protein, 9 aa, Homo Sapiens
TFSGTASSI

SEQ ID NO: 455173 - protein, 9 aa, Homo Sapiens
LCGMREMRA

SEQ ID NO: 455174 - protein, 9 aa, Homo Sapiens
KDDEENSWE

SEQ ID NO: 455175 - protein, 9 aa, Homo Sapiens
PLDCPICHQ

SEQ ID NO: 455176 - protein, 9 aa, Homo Sapiens
IVIHLKNYR

SEQ ID NO: 455177 - protein, 9 aa, Homo Sapiens
LPQEPPQMM

SEQ ID NO: 455178 - protein, 9 aa, Homo Sapiens
IRGMKMKLD

SEQ ID NO: 455179 - protein, 9 aa, Homo Sapiens
QCEFLMGKT

SEQ ID NO: 455180 - protein, 9 aa, Homo Sapiens
GIQHLLRAV

SEQ ID NO: 455181 - protein, 9 aa, Homo Sapiens
YYSVDLMLS

SEQ ID NO: 455182 - protein, 9 aa, Homo Sapiens
LTEIQKTEG

SEQ ID NO: 455183 - protein, 9 aa, Homo Sapiens
LVAPLVSAT

SEQ ID NO: 455184 - protein, 9 aa, Homo Sapiens
SSDDPGKPG

SEQ ID NO: 455185 - protein, 9 aa, Homo Sapiens
AIDRFDEGE

SEQ ID NO: 455186 - protein, 9 aa, Homo Sapiens
AETLSQSYH

SEQ ID NO: 455187 - protein, 9 aa, Homo Sapiens
DIHFDVNLT

SEQ ID NO: 455188 - protein, 9 aa, Homo Sapiens
NLPSKVVRI

SEQ ID NO: 455189 - protein, 9 aa, Homo Sapiens
RRCALSGSL

SEQ ID NO: 455190 - protein, 9 aa, Homo Sapiens
FNELGANAV

SEQ ID NO: 455191 - protein, 9 aa, Homo Sapiens
KGSSDDPGK

SEQ ID NO: 455192 - protein, 9 aa, Homo Sapiens
DPKGTRTIA

SEQ ID NO: 455193 - protein, 9 aa, Homo Sapiens
YSRLSSSRY

SEQ ID NO: 455194 - protein, 9 aa, Homo Sapiens
LSHLHNVLV

SEQ ID NO: 455195 - protein, 9 aa, Homo Sapiens
IYAVSYLFE

SEQ ID NO: 455196 - protein, 9 aa, Homo Sapiens
SILTTPEAS

SEQ ID NO: 455197 - protein, 9 aa, Homo Sapiens
EGRRGPGCA

SEQ ID NO: 455198 - protein, 9 aa, Homo Sapiens
VHRLLRKGG

SEQ ID NO: 455199 - protein, 9 aa, Homo Sapiens
SSEPPAAPK

SEQ ID NO: 455200 - protein, 9 aa, Homo Sapiens
QRKGRNTGP

SEQ ID NO: 455201 - protein, 9 aa, Homo Sapiens
RCVFLFEQI

SEQ ID NO: 455202 - protein, 9 aa, Homo Sapiens
EGGIVRPQG

SEQ ID NO: 455203 - protein, 9 aa, Homo Sapiens
QTIFSPSQA

SEQ ID NO: 455204 - protein, 9 aa, Homo Sapiens
FLHKGLTVK

SEQ ID NO: 455205 - protein, 9 aa, Homo Sapiens
LKEAKQFVS

SEQ ID NO: 455206 - protein, 9 aa, Homo Sapiens
GTLCLATYT

SEQ ID NO: 455207 - protein, 9 aa, Homo Sapiens
LRVPMNGFA

SEQ ID NO: 455208 - protein, 9 aa, Homo Sapiens
FSPENLRFW

SEQ ID NO: 455209 - protein, 9 aa, Homo Sapiens
MLVTEVSAY

SEQ ID NO: 455210 - protein, 9 aa, Homo Sapiens
EFFQDLDIV

SEQ ID NO: 455211 - protein, 9 aa, Homo Sapiens
PSSNNPHRC

SEQ ID NO: 455212 - protein, 9 aa, Homo Sapiens
QPDSIVPTL

SEQ ID NO: 455213 - protein, 9 aa, Homo Sapiens
ALSCGEVRQ

SEQ ID NO: 455214 - protein, 9 aa, Homo Sapiens
TSNPRYRLI

SEQ ID NO: 455215 - protein, 9 aa, Homo Sapiens
PKSIKVEAV

SEQ ID NO: 455216 - protein, 9 aa, Homo Sapiens
HYEVCLTGG

SEQ ID NO: 455217 - protein, 9 aa, Homo Sapiens
EKKCKRYIP

SEQ ID NO: 455218 - protein, 9 aa, Homo Sapiens
AVQTFSGTA

SEQ ID NO: 455219 - protein, 9 aa, Homo Sapiens
SRKDTSGNC

SEQ ID NO: 455220 - protein, 9 aa, Homo Sapiens
TICRTLNGI

SEQ ID NO: 455221 - protein, 9 aa, Homo Sapiens
DLRHAFQNL

SEQ ID NO: 455222 - protein, 9 aa, Homo Sapiens
ELADMVVSM

SEQ ID NO: 455223 - protein, 9 aa, Homo Sapiens
PSPKVSDTM

SEQ ID NO: 455224 - protein, 9 aa, Homo Sapiens
NGRPQGNSW

SEQ ID NO: 455225 - protein, 9 aa, Homo Sapiens
SYLFEALAC

SEQ ID NO: 455226 - protein, 9 aa, Homo Sapiens
SSNNPHRCT

SEQ ID NO: 455227 - protein, 9 aa, Homo Sapiens
VRRRQREQR

SEQ ID NO: 455228 - protein, 9 aa, Homo Sapiens
DDPGKPGEA

SEQ ID NO: 455229 - protein, 9 aa, Homo Sapiens
IMQILAQSQ

SEQ ID NO: 455230 - protein, 9 aa, Homo Sapiens
HLHLRSYSP

SEQ ID NO: 455231 - protein, 9 aa, Homo Sapiens
TSSVVSPSF

SEQ ID NO: 455232 - protein, 9 aa, Homo Sapiens
EITSSRESA

SEQ ID NO: 455233 - protein, 9 aa, Homo Sapiens
RDVLCVHIA

SEQ ID NO: 455234 - protein, 9 aa, Homo Sapiens
HLLQITVLN

SEQ ID NO: 455235 - protein, 9 aa, Homo Sapiens
GWTWPLLTR

SEQ ID NO: 455236 - protein, 9 aa, Homo Sapiens
TNRSALLSQ

SEQ ID NO: 455237 - protein, 9 aa, Homo Sapiens
SNLNLPSKV

SEQ ID NO: 455238 - protein, 9 aa, Homo Sapiens
TPLTLCTAI

SEQ ID NO: 455239 - protein, 9 aa, Homo Sapiens
VKCLEWKNK

SEQ ID NO: 455240 - protein, 9 aa, Homo Sapiens
QRMSNVAQF

SEQ ID NO: 455241 - protein, 9 aa, Homo Sapiens
PWSELDVGT

SEQ ID NO: 455242 - protein, 9 aa, Homo Sapiens
HTTAARANK

SEQ ID NO: 455243 - protein, 9 aa, Homo Sapiens
PAGADVKAL

SEQ ID NO: 455244 - protein, 9 aa, Homo Sapiens
NAMLYHQAE

SEQ ID NO: 455245 - protein, 9 aa, Homo Sapiens
QIVEREMAP

SEQ ID NO: 455246 - protein, 9 aa, Homo Sapiens
GMREMRAGG

SEQ ID NO: 455247 - protein, 9 aa, Homo Sapiens
MVLTGRGTY

SEQ ID NO: 455248 - protein, 9 aa, Homo Sapiens
GHSPEPSNE

SEQ ID NO: 455249 - protein, 9 aa, Homo Sapiens
VSAYSHCCM

SEQ ID NO: 455250 - protein, 9 aa, Homo Sapiens
ISSNKTPHK

SEQ ID NO: 455251 - protein, 9 aa, Homo Sapiens
EVPQEAPGA

SEQ ID NO: 455252 - protein, 9 aa, Homo Sapiens
INSPESLPE

SEQ ID NO: 455253 - protein, 9 aa, Homo Sapiens
FNYGNSSAS

SEQ ID NO: 455254 - protein, 9 aa, Homo Sapiens
ENQDVSMEF

SEQ ID NO: 455255 - protein, 9 aa, Homo Sapiens
GLGQARRCT

SEQ ID NO: 455256 - protein, 9 aa, Homo Sapiens
LSFCNSNIV

SEQ ID NO: 455257 - protein, 9 aa, Homo Sapiens
EVDAVEVFF

SEQ ID NO: 455258 - protein, 9 aa, Homo Sapiens
SWFESSVTH

SEQ ID NO: 455259 - protein, 9 aa, Homo Sapiens
GCFKLNKKA

SEQ ID NO: 455260 - protein, 9 aa, Homo Sapiens
FLESEFSPE

SEQ ID NO: 455261 - protein, 9 aa, Homo Sapiens
LWEYDLVKL

SEQ ID NO: 455262 - protein, 9 aa, Homo Sapiens
LLKFLSVFL

SEQ ID NO: 455263 - protein, 9 aa, Homo Sapiens
GTIEFQGGD

SEQ ID NO: 455264 - protein, 9 aa, Homo Sapiens
DINSPESLP

SEQ ID NO: 455265 - protein, 9 aa, Homo Sapiens
LNIHWVQRK

SEQ ID NO: 455266 - protein, 9 aa, Homo Sapiens
QAQPDSIVP

SEQ ID NO: 455267 - protein, 9 aa, Homo Sapiens
QLQRRVVKE

SEQ ID NO: 455268 - protein, 9 aa, Homo Sapiens
ASACASPFQ

SEQ ID NO: 455269 - protein, 9 aa, Homo Sapiens
LFAEFFQDL

SEQ ID NO: 455270 - protein, 9 aa, Homo Sapiens
GPKKCHESL

SEQ ID NO: 455271 - protein, 9 aa, Homo Sapiens
LHLRSYSPD

SEQ ID NO: 455272 - protein, 9 aa, Homo Sapiens
TFLLKFLSV

SEQ ID NO: 455273 - protein, 9 aa, Homo Sapiens
IKEGKPHLI

SEQ ID NO: 455274 - protein, 9 aa, Homo Sapiens
PVSIKSDRL

SEQ ID NO: 455275 - protein, 9 aa, Homo Sapiens
WRGDERQGI

SEQ ID NO: 455276 - protein, 9 aa, Homo Sapiens
CKRYIPSYL

SEQ ID NO: 455277 - protein, 9 aa, Homo Sapiens
VHVARCDVS

SEQ ID NO: 455278 - protein, 9 aa, Homo Sapiens
GEKQHFEKL

SEQ ID NO: 455279 - protein, 9 aa, Homo Sapiens
NQLWEYDLV

SEQ ID NO: 455280 - protein, 9 aa, Homo Sapiens
ACASPFQSA

SEQ ID NO: 455281 - protein, 9 aa, Homo Sapiens
AVIPDVQIV

SEQ ID NO: 455282 - protein, 9 aa, Homo Sapiens
VTCGLFMRN

SEQ ID NO: 455283 - protein, 9 aa, Homo Sapiens
CHGVPPKDT

SEQ ID NO: 455284 - protein, 9 aa, Homo Sapiens
PSLQTPSFW

SEQ ID NO: 455285 - protein, 9 aa, Homo Sapiens
PIGVFLDLS

SEQ ID NO: 455286 - protein, 9 aa, Homo Sapiens
KIYYSVDLM

SEQ ID NO: 455287 - protein, 9 aa, Homo Sapiens
FLRCTICNN

SEQ ID NO: 455288 - protein, 9 aa, Homo Sapiens
GGIVRPQGP

SEQ ID NO: 455289 - protein, 9 aa, Homo Sapiens
PKGEGGIVR

SEQ ID NO: 455290 - protein, 9 aa, Homo Sapiens
KTDDRVVTM

SEQ ID NO: 455291 - protein, 9 aa, Homo Sapiens
FCAFVVVNS

SEQ ID NO: 455292 - protein, 9 aa, Homo Sapiens
NSRLLEDSY

SEQ ID NO: 455293 - protein, 9 aa, Homo Sapiens
RGLRETITE

SEQ ID NO: 455294 - protein, 9 aa, Homo Sapiens
GFRTTEPNG

SEQ ID NO: 455295 - protein, 9 aa, Homo Sapiens
LRSYSPDWP

SEQ ID NO: 455296 - protein, 9 aa, Homo Sapiens
KISNIRTQP

SEQ ID NO: 455297 - protein, 9 aa, Homo Sapiens
IKIQDINEN

SEQ ID NO: 455298 - protein, 9 aa, Homo Sapiens
HESLRPETV

SEQ ID NO: 455299 - protein, 9 aa, Homo Sapiens
TFNYGNSSA

SEQ ID NO: 455300 - protein, 9 aa, Homo Sapiens
RCLFSHDLA

SEQ ID NO: 455301 - protein, 9 aa, Homo Sapiens
GYNAHAANM

SEQ ID NO: 455302 - protein, 9 aa, Homo Sapiens
AATICRTLN

SEQ ID NO: 455303 - protein, 9 aa, Homo Sapiens
QGGDHSNKA

SEQ ID NO: 455304 - protein, 9 aa, Homo Sapiens
IHLKNYREH

SEQ ID NO: 455305 - protein, 9 aa, Homo Sapiens
QEHDIIKEK

SEQ ID NO: 455306 - protein, 9 aa, Homo Sapiens
RRVVKEGDE

SEQ ID NO: 455307 - protein, 9 aa, Homo Sapiens
VTGAFMKIL

SEQ ID NO: 455308 - protein, 9 aa, Homo Sapiens
LDEAIHEAC

SEQ ID NO: 455309 - protein, 9 aa, Homo Sapiens
KEKRFKSQD

SEQ ID NO: 455310 - protein, 9 aa, Homo Sapiens
DIRHCHRMS

SEQ ID NO: 455311 - protein, 9 aa, Homo Sapiens
DKLHILNSN

SEQ ID NO: 455312 - protein, 9 aa, Homo Sapiens
SVYSRLSSS

SEQ ID NO: 455313 - protein, 9 aa, Homo Sapiens
SLPKPQPCV

SEQ ID NO: 455314 - protein, 9 aa, Homo Sapiens
IYYSVDLML

SEQ ID NO: 455315 - protein, 9 aa, Homo Sapiens
FVVVNSGIV

SEQ ID NO: 455316 - protein, 9 aa, Homo Sapiens
DVLDPTYTT

SEQ ID NO: 455317 - protein, 9 aa, Homo Sapiens
TTTKGPDSA

SEQ ID NO: 455318 - protein, 9 aa, Homo Sapiens
GQPPEAARP

SEQ ID NO: 455319 - protein, 9 aa, Homo Sapiens
HSPEPSNES

SEQ ID NO: 455320 - protein, 9 aa, Homo Sapiens
LDKLHILNS

SEQ ID NO: 455321 - protein, 9 aa, Homo Sapiens
ELTFSWVKN

SEQ ID NO: 455322 - protein, 9 aa, Homo Sapiens
QTTTKGPDS

SEQ ID NO: 455323 - protein, 9 aa, Homo Sapiens
PKKCHESLR

SEQ ID NO: 455324 - protein, 9 aa, Homo Sapiens
EYDLVKLTL

SEQ ID NO: 455325 - protein, 9 aa, Homo Sapiens
LTQAVIRGL

SEQ ID NO: 455326 - protein, 9 aa, Homo Sapiens
HAFQNLEIE

SEQ ID NO: 455327 - protein, 9 aa, Homo Sapiens
SSREESSEP

SEQ ID NO: 455328 - protein, 9 aa, Homo Sapiens
KPGAAFGVA

SEQ ID NO: 455329 - protein, 9 aa, Homo Sapiens
MEDGFHGVF

SEQ ID NO: 455330 - protein, 9 aa, Homo Sapiens
RCEVCKKAG

SEQ ID NO: 455331 - protein, 9 aa, Homo Sapiens
NMELYTGLQ

SEQ ID NO: 455332 - protein, 9 aa, Homo Sapiens
PVWISLPLC

SEQ ID NO: 455333 - protein, 9 aa, Homo Sapiens
VNLTYEKEA

SEQ ID NO: 455334 - protein, 9 aa, Homo Sapiens
EAQPTDMWA

SEQ ID NO: 455335 - protein, 9 aa, Homo Sapiens
GGSSSVLLG

SEQ ID NO: 455336 - protein, 9 aa, Homo Sapiens
NIFLHKGLT

SEQ ID NO: 455337 - protein, 9 aa, Homo Sapiens
VVKGVARGL

SEQ ID NO: 455338 - protein, 9 aa, Homo Sapiens
ELPGLKLGT

SEQ ID NO: 455339 - protein, 9 aa, Homo Sapiens
PEAARPLFF

SEQ ID NO: 455340 - protein, 9 aa, Homo Sapiens
HQNLWVDDL

SEQ ID NO: 455341 - protein, 9 aa, Homo Sapiens
PQPCVMPPP

SEQ ID NO: 455342 - protein, 9 aa, Homo Sapiens
VNSGIVIGD

SEQ ID NO: 455343 - protein, 9 aa, Homo Sapiens
PSYSHYYSI

SEQ ID NO: 455344 - protein, 9 aa, Homo Sapiens
NWNQSPHCP

SEQ ID NO: 455345 - protein, 9 aa, Homo Sapiens
LRCTICNNS

SEQ ID NO: 455346 - protein, 9 aa, Homo Sapiens
TQLPQEPPQ

SEQ ID NO: 455347 - protein, 9 aa, Homo Sapiens
GTPDAETSS

SEQ ID NO: 455348 - protein, 9 aa, Homo Sapiens
TRTIAAKTH

SEQ ID NO: 455349 - protein, 9 aa, Homo Sapiens
SDVLDPTYT

SEQ ID NO: 455350 - protein, 9 aa, Homo Sapiens
GRNTGPGKR

SEQ ID NO: 455351 - protein, 9 aa, Homo Sapiens
RTIAAKTHH

SEQ ID NO: 455352 - protein, 9 aa, Homo Sapiens
IKSDRLSPA

SEQ ID NO: 455353 - protein, 9 aa, Homo Sapiens
PDVQIVERE

SEQ ID NO: 455354 - protein, 9 aa, Homo Sapiens
DNGTRDILI

SEQ ID NO: 455355 - protein, 9 aa, Homo Sapiens
RPPPARPKK

SEQ ID NO: 455356 - protein, 9 aa, Homo Sapiens
ASTSHQNLW

SEQ ID NO: 455357 - protein, 9 aa, Homo Sapiens
LLGFMPEEL

SEQ ID NO: 455358 - protein, 9 aa, Homo Sapiens
CVSHIAVVI

SEQ ID NO: 455359 - protein, 9 aa, Homo Sapiens
RVVTMDLGL

SEQ ID NO: 455360 - protein, 9 aa, Homo Sapiens
RVSSAGLFM

SEQ ID NO: 455361 - protein, 9 aa, Homo Sapiens
RHMLTRYIN

SEQ ID NO: 455362 - protein, 9 aa, Homo Sapiens
YKGRKGMGG

SEQ ID NO: 455363 - protein, 9 aa, Homo Sapiens
IVIQVKCLE

SEQ ID NO: 455364 - protein, 9 aa, Homo Sapiens
LVKLTLQHV

SEQ ID NO: 455365 - protein, 9 aa, Homo Sapiens
PRKLLNIHW

SEQ ID NO: 455366 - protein, 9 aa, Homo Sapiens
KESPGRWCL

SEQ ID NO: 455367 - protein, 9 aa, Homo Sapiens
PICHQGGEC

SEQ ID NO: 455368 - protein, 9 aa, Homo Sapiens
VTDLRHAFQ

SEQ ID NO: 455369 - protein, 9 aa, Homo Sapiens
TPHKSSINH

SEQ ID NO: 455370 - protein, 9 aa, Homo Sapiens
SPASSWISS

SEQ ID NO: 455371 - protein, 9 aa, Homo Sapiens
GIVRPQGPP

SEQ ID NO: 455372 - protein, 9 aa, Homo Sapiens
VKGVARGLR

SEQ ID NO: 455373 - protein, 9 aa, Homo Sapiens
SKCASCLKE

SEQ ID NO: 455374 - protein, 9 aa, Homo Sapiens
ISFGFRTTE

SEQ ID NO: 455375 - protein, 9 aa, Homo Sapiens
HVLVPPGLQ

SEQ ID NO: 455376 - protein, 9 aa, Homo Sapiens
MVAPSHLRV

SEQ ID NO: 455377 - protein, 9 aa, Homo Sapiens
KTPHKSSIN

SEQ ID NO: 455378 - protein, 9 aa, Homo Sapiens
RNQTIFSPS

SEQ ID NO: 455379 - protein, 9 aa, Homo Sapiens
DSSTDSQKD

SEQ ID NO: 455380 - protein, 9 aa, Homo Sapiens
VLLGAPSLQ

SEQ ID NO: 455381 - protein, 9 aa, Homo Sapiens
CHESLRPET

SEQ ID NO: 455382 - protein, 9 aa, Homo Sapiens
LDCPICHQG

SEQ ID NO: 455383 - protein, 9 aa, Homo Sapiens
LSGSLLSSW

SEQ ID NO: 455384 - protein, 9 aa, Homo Sapiens
KDCQSCFCC

SEQ ID NO: 455385 - protein, 9 aa, Homo Sapiens
EGELAEEAA

SEQ ID NO: 455386 - protein, 9 aa, Homo Sapiens
TQAVIRGLQ

SEQ ID NO: 455387 - protein, 9 aa, Homo Sapiens
RKRDSIAPV

SEQ ID NO: 455388 - protein, 9 aa, Homo Sapiens
RSPVVFFDF

SEQ ID NO: 455389 - protein, 9 aa, Homo Sapiens
FQGGDHSNK

SEQ ID NO: 455390 - protein, 9 aa, Homo Sapiens
GDNLKMQIQ

SEQ ID NO: 455391 - protein, 9 aa, Homo Sapiens
QPRGSRWWL

SEQ ID NO: 455392 - protein, 9 aa, Homo Sapiens
IIPSSNNPH

SEQ ID NO: 455393 - protein, 9 aa, Homo Sapiens
GQAGEKGKP

SEQ ID NO: 455394 - protein, 9 aa, Homo Sapiens
LEKMKTNRS

SEQ ID NO: 455395 - protein, 9 aa, Homo Sapiens
ILVFLIPFV

SEQ ID NO: 455396 - protein, 9 aa, Homo Sapiens
MGSISFGFR

SEQ ID NO: 455397 - protein, 9 aa, Homo Sapiens
APVSTIINW

SEQ ID NO: 455398 - protein, 9 aa, Homo Sapiens
GLIQVGHSP

SEQ ID NO: 455399 - protein, 9 aa, Homo Sapiens
MRAGGCCHA

SEQ ID NO: 455400 - protein, 9 aa, Homo Sapiens
SENVHVIKL

SEQ ID NO: 455401 - protein, 9 aa, Homo Sapiens
PTKYKDANI

SEQ ID NO: 455402 - protein, 9 aa, Homo Sapiens
NTFLLKFLS

SEQ ID NO: 455403 - protein, 9 aa, Homo Sapiens
QIYGGVTYY

SEQ ID NO: 455404 - protein, 9 aa, Homo Sapiens
MKMKLDPQN

SEQ ID NO: 455405 - protein, 9 aa, Homo Sapiens
EVHVARCDV

SEQ ID NO: 455406 - protein, 9 aa, Homo Sapiens
KEWAEVPQE

SEQ ID NO: 455407 - protein, 9 aa, Homo Sapiens
KVLQFNELG

SEQ ID NO: 455408 - protein, 9 aa, Homo Sapiens
AGIGRTGIL

SEQ ID NO: 455409 - protein, 9 aa, Homo Sapiens
LHSQNVLST

SEQ ID NO: 455410 - protein, 9 aa, Homo Sapiens
VQKLSKCAS

SEQ ID NO: 455411 - protein, 9 aa, Homo Sapiens
KALKYIPDK

SEQ ID NO: 455412 - protein, 9 aa, Homo Sapiens
DIIKEKTQI

SEQ ID NO: 455413 - protein, 9 aa, Homo Sapiens
YMCHGVPPK

SEQ ID NO: 455414 - protein, 9 aa, Homo Sapiens
GIYKGRKGM

SEQ ID NO: 455415 - protein, 9 aa, Homo Sapiens
NDSHVQNFA

SEQ ID NO: 455416 - protein, 9 aa, Homo Sapiens
RKGRNTGPG

SEQ ID NO: 455417 - protein, 9 aa, Homo Sapiens
FAEFFQDLD

SEQ ID NO: 455418 - protein, 9 aa, Homo Sapiens
RHCHRMSRR

SEQ ID NO: 455419 - protein, 9 aa, Homo Sapiens
ITSSRESAP

SEQ ID NO: 455420 - protein, 9 aa, Homo Sapiens
LQFVTGTLR

SEQ ID NO: 455421 - protein, 9 aa, Homo Sapiens
HGVFRTIDM

SEQ ID NO: 455422 - protein, 9 aa, Homo Sapiens
TPDAETSSG

SEQ ID NO: 455423 - protein, 9 aa, Homo Sapiens
HLAERADFQ

SEQ ID NO: 455424 - protein, 9 aa, Homo Sapiens
PMPLIQSIL

SEQ ID NO: 455425 - protein, 9 aa, Homo Sapiens
TAARAIDRF

SEQ ID NO: 455426 - protein, 9 aa, Homo Sapiens
AHLHLRSYS

SEQ ID NO: 455427 - protein, 9 aa, Homo Sapiens
YRGDSSTDS

SEQ ID NO: 455428 - protein, 9 aa, Homo Sapiens
MDMANYSDV

SEQ ID NO: 455429 - protein, 9 aa, Homo Sapiens
TEKLKSLVL

SEQ ID NO: 455430 - protein, 9 aa, Homo Sapiens
LRKGGLGQA

SEQ ID NO: 455431 - protein, 9 aa, Homo Sapiens
VLAYYVQEQ

SEQ ID NO: 455432 - protein, 9 aa, Homo Sapiens
LTFSWVKNG

SEQ ID NO: 455433 - protein, 9 aa, Homo Sapiens
KDIRHCHRM

SEQ ID NO: 455434 - protein, 9 aa, Homo Sapiens
HSLGACLGP

SEQ ID NO: 455435 - protein, 9 aa, Homo Sapiens
FQLDSAENQ

SEQ ID NO: 455436 - protein, 9 aa, Homo Sapiens
QVGHSPEPS

SEQ ID NO: 455437 - protein, 9 aa, Homo Sapiens
VPQASFSSS

SEQ ID NO: 455438 - protein, 9 aa, Homo Sapiens
FQVPIGVFL

SEQ ID NO: 455439 - protein, 9 aa, Homo Sapiens
LDGKDCQSC

SEQ ID NO: 455440 - protein, 9 aa, Homo Sapiens
LDVGTLYPF

SEQ ID NO: 455441 - protein, 9 aa, Homo Sapiens
GILDEAIHE

SEQ ID NO: 455442 - protein, 9 aa, Homo Sapiens
TKGPDSAVT

SEQ ID NO: 455443 - protein, 9 aa, Homo Sapiens
IHEACRNSN

SEQ ID NO: 455444 - protein, 9 aa, Homo Sapiens
KKRPRPPPA

SEQ ID NO: 455445 - protein, 9 aa, Homo Sapiens
NSWQVVEQD

SEQ ID NO: 455446 - protein, 9 aa, Homo Sapiens
CQSCFCCYE

SEQ ID NO: 455447 - protein, 9 aa, Homo Sapiens
ARPLFFLTL

SEQ ID NO: 455448 - protein, 9 aa, Homo Sapiens
WCASPPALA

SEQ ID NO: 455449 - protein, 9 aa, Homo Sapiens
KNYREHLPL

SEQ ID NO: 455450 - protein, 9 aa, Homo Sapiens
PRPPPARPK

SEQ ID NO: 455451 - protein, 9 aa, Homo Sapiens
DINENEPKF

SEQ ID NO: 455452 - protein, 9 aa, Homo Sapiens
KAILDKLHI

SEQ ID NO: 455453 - protein, 9 aa, Homo Sapiens
SSWISSDCP

SEQ ID NO: 455454 - protein, 9 aa, Homo Sapiens
GRPQGNSWQ

SEQ ID NO: 455455 - protein, 9 aa, Homo Sapiens
WLDENQDVS

SEQ ID NO: 455456 - protein, 9 aa, Homo Sapiens
IYGGVTYYN

SEQ ID NO: 455457 - protein, 9 aa, Homo Sapiens
GDRHYKCYE

SEQ ID NO: 455458 - protein, 9 aa, Homo Sapiens
KQFVSENEG

SEQ ID NO: 455459 - protein, 9 aa, Homo Sapiens
CGEKQHFEK

SEQ ID NO: 455460 - protein, 9 aa, Homo Sapiens
DSSQTTTKG

SEQ ID NO: 455461 - protein, 9 aa, Homo Sapiens
NTFGQLQRR

SEQ ID NO: 455462 - protein, 9 aa, Homo Sapiens
MQWLDENQD

SEQ ID NO: 455463 - protein, 9 aa, Homo Sapiens
QYAQISMEM

SEQ ID NO: 455464 - protein, 9 aa, Homo Sapiens
DAMTYVYNR

SEQ ID NO: 455465 - protein, 9 aa, Homo Sapiens
VYKSENVHV

SEQ ID NO: 455466 - protein, 9 aa, Homo Sapiens
PPAAPKSIK

SEQ ID NO: 455467 - protein, 9 aa, Homo Sapiens
GGDHSNKAM

SEQ ID NO: 455468 - protein, 9 aa, Homo Sapiens
NYREHLPLI

SEQ ID NO: 455469 - protein, 9 aa, Homo Sapiens
NPCPELKKN

SEQ ID NO: 455470 - protein, 9 aa, Homo Sapiens
TALQAQPDS

SEQ ID NO: 455471 - protein, 9 aa, Homo Sapiens
HDGPHEGRT

SEQ ID NO: 455472 - protein, 9 aa, Homo Sapiens
SHYYSIPSY

SEQ ID NO: 455473 - protein, 9 aa, Homo Sapiens
WEKEWAEVP

SEQ ID NO: 455474 - protein, 9 aa, Homo Sapiens
TPTVIRCGE

SEQ ID NO: 455475 - protein, 9 aa, Homo Sapiens
PHRHRPFSP

SEQ ID NO: 455476 - protein, 9 aa, Homo Sapiens
RNTGPGKRK

SEQ ID NO: 455477 - protein, 9 aa, Homo Sapiens
GTYSDPMEI

SEQ ID NO: 455478 - protein, 9 aa, Homo Sapiens
NHGQLFQNM

SEQ ID NO: 455479 - protein, 9 aa, Homo Sapiens
AAKTHHQAV

SEQ ID NO: 455480 - protein, 9 aa, Homo Sapiens
SAMQDGLSP

SEQ ID NO: 455481 - protein, 9 aa, Homo Sapiens
ALQAQPDSI

SEQ ID NO: 455482 - protein, 9 aa, Homo Sapiens
SGSLLSSWC

SEQ ID NO: 455483 - protein, 9 aa, Homo Sapiens
VAQFDSDFY

SEQ ID NO: 455484 - protein, 9 aa, Homo Sapiens
KSEVTDLRH

SEQ ID NO: 455485 - protein, 9 aa, Homo Sapiens
GEGGIVRPQ

SEQ ID NO: 455486 - protein, 9 aa, Homo Sapiens
CKRFLERGI

SEQ ID NO: 455487 - protein, 9 aa, Homo Sapiens
MMVLTGRGT

SEQ ID NO: 455488 - protein, 9 aa, Homo Sapiens
RYRLIGQWT

SEQ ID NO: 455489 - protein, 9 aa, Homo Sapiens
NKTPHKSSI

SEQ ID NO: 455490 - protein, 9 aa, Homo Sapiens
TQPQRHFRV

SEQ ID NO: 455491 - protein, 9 aa, Homo Sapiens
KRYIPSYLD

SEQ ID NO: 455492 - protein, 9 aa, Homo Sapiens
RTLNGIRFT

SEQ ID NO: 455493 - protein, 9 aa, Homo Sapiens
GHSEESTTV

SEQ ID NO: 455494 - protein, 9 aa, Homo Sapiens
CPICHQGGE

SEQ ID NO: 455495 - protein, 9 aa, Homo Sapiens
PAHLHLRSY

SEQ ID NO: 455496 - protein, 9 aa, Homo Sapiens
KMKTNRSAL

SEQ ID NO: 455497 - protein, 9 aa, Homo Sapiens
RLEKMKTNR

SEQ ID NO: 455498 - protein, 9 aa, Homo Sapiens
VLKEAKQFV

SEQ ID NO: 455499 - protein, 9 aa, Homo Sapiens
LSTCVSHIA

SEQ ID NO: 455500 - protein, 9 aa, Homo Sapiens
CDDPLVSAV

SEQ ID NO: 455501 - protein, 9 aa, Homo Sapiens
LSCGEVRQA

SEQ ID NO: 455502 - protein, 9 aa, Homo Sapiens
LTGRGTYSD

SEQ ID NO: 455503 - protein, 9 aa, Homo Sapiens
WNGIYKGRK

SEQ ID NO: 455504 - protein, 9 aa, Homo Sapiens
SIGGHSLGA

SEQ ID NO: 455505 - protein, 9 aa, Homo Sapiens
TGDRHYKCY

SEQ ID NO: 455506 - protein, 9 aa, Homo Sapiens
HNVLVFAPS

SEQ ID NO: 455507 - protein, 9 aa, Homo Sapiens
SNPRYRLIG

SEQ ID NO: 455508 - protein, 9 aa, Homo Sapiens
TIEFQGGDH

SEQ ID NO: 455509 - protein, 9 aa, Homo Sapiens
DVNLTYEKE

SEQ ID NO: 455510 - protein, 9 aa, Homo Sapiens
RKESPGRWC

SEQ ID NO: 455511 - protein, 9 aa, Homo Sapiens
SFGAPQMAK

SEQ ID NO: 455512 - protein, 9 aa, Homo Sapiens
AVSYLFEAL

SEQ ID NO: 455513 - protein, 9 aa, Homo Sapiens
VSTIINWER

SEQ ID NO: 455514 - protein, 9 aa, Homo Sapiens
ISFYADDKT

SEQ ID NO: 455515 - protein, 9 aa, Homo Sapiens
AMLYHQAEP

SEQ ID NO: 455516 - protein, 9 aa, Homo Sapiens
IDIIHTTAA

SEQ ID NO: 455517 - protein, 9 aa, Homo Sapiens
ENEPKFLDG

SEQ ID NO: 455518 - protein, 9 aa, Homo Sapiens
RPRPPPARP

SEQ ID NO: 455519 - protein, 9 aa, Homo Sapiens
RLSFCNSNI

SEQ ID NO: 455520 - protein, 9 aa, Homo Sapiens
ASPASSWIS

SEQ ID NO: 455521 - protein, 9 aa, Homo Sapiens
CAFVVVNSG

SEQ ID NO: 455522 - protein, 9 aa, Homo Sapiens
SDDPGKPGE

SEQ ID NO: 455523 - protein, 9 aa, Homo Sapiens
QYDEAVVQF

SEQ ID NO: 455524 - protein, 9 aa, Homo Sapiens
THTGDRHYK

SEQ ID NO: 455525 - protein, 9 aa, Homo Sapiens
ENAMLYHQA

SEQ ID NO: 455526 - protein, 9 aa, Homo Sapiens
QSRTKERCV

SEQ ID NO: 455527 - protein, 9 aa, Homo Sapiens
QTPSFWWRR

SEQ ID NO: 455528 - protein, 9 aa, Homo Sapiens
AQPDSIVPT

SEQ ID NO: 455529 - protein, 9 aa, Homo Sapiens
EGGAAHRVG

SEQ ID NO: 455530 - protein, 9 aa, Homo Sapiens
NRHMLTRYI

SEQ ID NO: 455531 - protein, 9 aa, Homo Sapiens
LPGLKLGTC

SEQ ID NO: 455532 - protein, 9 aa, Homo Sapiens
IDKRCQHKR

SEQ ID NO: 455533 - protein, 9 aa, Homo Sapiens
GTRTIAAKT

SEQ ID NO: 455534 - protein, 9 aa, Homo Sapiens
IPVKALKYI

SEQ ID NO: 455535 - protein, 9 aa, Homo Sapiens
SIAPVSPTA

SEQ ID NO: 455536 - protein, 9 aa, Homo Sapiens
PQMAKGDAA

SEQ ID NO: 455537 - protein, 9 aa, Homo Sapiens
LMGKTLLVY

SEQ ID NO: 455538 - protein, 9 aa, Homo Sapiens
QDVSMEFLH

SEQ ID NO: 455539 - protein, 9 aa, Homo Sapiens
NLTMNCFEN

SEQ ID NO: 455540 - protein, 9 aa, Homo Sapiens
DERRYRKVC

SEQ ID NO: 455541 - protein, 9 aa, Homo Sapiens
VMRHFAVDA

SEQ ID NO: 455542 - protein, 9 aa, Homo Sapiens
GNSWQVVEQ

SEQ ID NO: 455543 - protein, 9 aa, Homo Sapiens
GFMPEELHA

SEQ ID NO: 455544 - protein, 9 aa, Homo Sapiens
VVRRRQREQ

SEQ ID NO: 455545 - protein, 9 aa, Homo Sapiens
CQHKRAEMV

SEQ ID NO: 455546 - protein, 9 aa, Homo Sapiens
EENDSHVQN

SEQ ID NO: 455547 - protein, 9 aa, Homo Sapiens
KVVRIAPVP

SEQ ID NO: 455548 - protein, 9 aa, Homo Sapiens
KNTPWTPWT

SEQ ID NO: 455549 - protein, 9 aa, Homo Sapiens
QTPILEGRR

SEQ ID NO: 455550 - protein, 9 aa, Homo Sapiens
GRTNLTVLV

SEQ ID NO: 455551 - protein, 9 aa, Homo Sapiens
TFGQLQRRV

SEQ ID NO: 455552 - protein, 9 aa, Homo Sapiens
EKPNWNQSP

SEQ ID NO: 455553 - protein, 9 aa, Homo Sapiens
EKLKSLVLH

SEQ ID NO: 455554 - protein, 9 aa, Homo Sapiens
GAFMKILGK

SEQ ID NO: 455555 - protein, 9 aa, Homo Sapiens
EVTDLRHAF

SEQ ID NO: 455556 - protein, 9 aa, Homo Sapiens
DMADIEKFD

SEQ ID NO: 455557 - protein, 9 aa, Homo Sapiens
AQKTGCLYL

SEQ ID NO: 455558 - protein, 9 aa, Homo Sapiens
RGMKMKLDP

SEQ ID NO: 455559 - protein, 9 aa, Homo Sapiens
LKNYREHLP

SEQ ID NO: 455560 - protein, 9 aa, Homo Sapiens
KPHLIPAGP

SEQ ID NO: 455561 - protein, 9 aa, Homo Sapiens
VTLTEIQKT

SEQ ID NO: 455562 - protein, 9 aa, Homo Sapiens
PHLIPAGPI

SEQ ID NO: 455563 - protein, 9 aa, Homo Sapiens
FFLLSGSCP

SEQ ID NO: 455564 - protein, 9 aa, Homo Sapiens
HEGFLFRLS

SEQ ID NO: 455565 - protein, 9 aa, Homo Sapiens
FAEELADMV

SEQ ID NO: 455566 - protein, 9 aa, Homo Sapiens
DLRVLTLVE

SEQ ID NO: 455567 - protein, 9 aa, Homo Sapiens
KGKPGVPGL

SEQ ID NO: 455568 - protein, 9 aa, Homo Sapiens
SGPEGARVS

SEQ ID NO: 455569 - protein, 9 aa, Homo Sapiens
SILGLPHRH

SEQ ID NO: 455570 - protein, 9 aa, Homo Sapiens
QARRCTWRR

SEQ ID NO: 455571 - protein, 9 aa, Homo Sapiens
GRWKLHLAE

SEQ ID NO: 455572 - protein, 9 aa, Homo Sapiens
TLLVGKDVM

SEQ ID NO: 455573 - protein, 9 aa, Homo Sapiens
EHVLVPPGL

SEQ ID NO: 455574 - protein, 9 aa, Homo Sapiens
VIHLKNYRE

SEQ ID NO: 455575 - protein, 9 aa, Homo Sapiens
EEHVLVPPG

SEQ ID NO: 455576 - protein, 9 aa, Homo Sapiens
TMVEPYNAT

SEQ ID NO: 455577 - protein, 9 aa, Homo Sapiens
AVIRGLQEK

SEQ ID NO: 455578 - protein, 9 aa, Homo Sapiens
HKSSINHIE

SEQ ID NO: 455579 - protein, 9 aa, Homo Sapiens
FTIFILVFL

SEQ ID NO: 455580 - protein, 9 aa, Homo Sapiens
ARAIDRFDE

SEQ ID NO: 455581 - protein, 9 aa, Homo Sapiens
PGTLCLATY

SEQ ID NO: 455582 - protein, 9 aa, Homo Sapiens
APVRAKKPR

SEQ ID NO: 455583 - protein, 9 aa, Homo Sapiens
SSWCASPPA

SEQ ID NO: 455584 - protein, 9 aa, Homo Sapiens
VDAAATVAA

SEQ ID NO: 455585 - protein, 9 aa, Homo Sapiens
TIIPSSNNP

SEQ ID NO: 455586 - protein, 9 aa, Homo Sapiens
TPQCNCTPL

SEQ ID NO: 455587 - protein, 9 aa, Homo Sapiens
VKHMFIHTG

SEQ ID NO: 455588 - protein, 9 aa, Homo Sapiens
NMVTAIYIA

SEQ ID NO: 455589 - protein, 9 aa, Homo Sapiens
SHLHNVLVF

SEQ ID NO: 455590 - protein, 9 aa, Homo Sapiens
LTALQAQPD

SEQ ID NO: 455591 - protein, 9 aa, Homo Sapiens
PGLKLGTCP

SEQ ID NO: 455592 - protein, 9 aa, Homo Sapiens
YLFAEFFQD

SEQ ID NO: 455593 - protein, 9 aa, Homo Sapiens
MRGEKVMSH

SEQ ID NO: 455594 - protein, 9 aa, Homo Sapiens
SQCEFLMGK

SEQ ID NO: 455595 - protein, 9 aa, Homo Sapiens
QNLWVDDLS

SEQ ID NO: 455596 - protein, 9 aa, Homo Sapiens
MADIEKFDK

SEQ ID NO: 455597 - protein, 9 aa, Homo Sapiens
WFESSVTHE

SEQ ID NO: 455598 - protein, 9 aa, Homo Sapiens
WWRRCALSG

SEQ ID NO: 455599 - protein, 9 aa, Homo Sapiens
QSGTPDAET

SEQ ID NO: 455600 - protein, 9 aa, Homo Sapiens
SASACASPF

SEQ ID NO: 455601 - protein, 9 aa, Homo Sapiens
YTVTCGLFM

SEQ ID NO: 455602 - protein, 9 aa, Homo Sapiens
TLYPFSRSG

SEQ ID NO: 455603 - protein, 9 aa, Homo Sapiens
WALQDFEEP

SEQ ID NO: 455604 - protein, 9 aa, Homo Sapiens
HLIPAGPIT

SEQ ID NO: 455605 - protein, 9 aa, Homo Sapiens
KLHLAERAD

SEQ ID NO: 455606 - protein, 9 aa, Homo Sapiens
HECMICGKV

SEQ ID NO: 455607 - protein, 9 aa, Homo Sapiens
QDTMPRPQM

SEQ ID NO: 455608 - protein, 9 aa, Homo Sapiens
SEVVEQFED

SEQ ID NO: 455609 - protein, 9 aa, Homo Sapiens
KGRNTGPGK

SEQ ID NO: 455610 - protein, 9 aa, Homo Sapiens
VPQEAPGAW

SEQ ID NO: 455611 - protein, 9 aa, Homo Sapiens
HPGTGHRNQ

SEQ ID NO: 455612 - protein, 9 aa, Homo Sapiens
NYVKHMFIH

SEQ ID NO: 455613 - protein, 9 aa, Homo Sapiens
YSGSAMQDG

SEQ ID NO: 455614 - protein, 9 aa, Homo Sapiens
IIRKRDSIA

SEQ ID NO: 455615 - protein, 9 aa, Homo Sapiens
KDLCSTSSV

SEQ ID NO: 455616 - protein, 9 aa, Homo Sapiens
GCLYLFPTF

SEQ ID NO: 455617 - protein, 9 aa, Homo Sapiens
GWEKEWAEV

SEQ ID NO: 455618 - protein, 9 aa, Homo Sapiens
ERRYRKVCE

SEQ ID NO: 455619 - protein, 9 aa, Homo Sapiens
LAQKSGFDL

SEQ ID NO: 455620 - protein, 9 aa, Homo Sapiens
SMPAHLHLR

SEQ ID NO: 455621 - protein, 9 aa, Homo Sapiens
RYIPSYLDK

SEQ ID NO: 455622 - protein, 9 aa, Homo Sapiens
SAHHPEVLP

SEQ ID NO: 455623 - protein, 9 aa, Homo Sapiens
VMLVTEVSA

SEQ ID NO: 455624 - protein, 9 aa, Homo Sapiens
TYVYNRGMN

SEQ ID NO: 455625 - protein, 9 aa, Homo Sapiens
LSVYSRLSS

SEQ ID NO: 455626 - protein, 9 aa, Homo Sapiens
LDGATMRAS

SEQ ID NO: 455627 - protein, 9 aa, Homo Sapiens
SSTDSQKDM

SEQ ID NO: 455628 - protein, 9 aa, Homo Sapiens
RWCLGEDPT

SEQ ID NO: 455629 - protein, 9 aa, Homo Sapiens
SEELTFSWV

SEQ ID NO: 455630 - protein, 9 aa, Homo Sapiens
VGHSPEPSN

SEQ ID NO: 455631 - protein, 9 aa, Homo Sapiens
EEIMQILAQ

SEQ ID NO: 455632 - protein, 9 aa, Homo Sapiens
KSGFDLQET

SEQ ID NO: 455633 - protein, 9 aa, Homo Sapiens
LMANRPTKY

SEQ ID NO: 455634 - protein, 9 aa, Homo Sapiens
QVTNHGQLF

SEQ ID NO: 455635 - protein, 9 aa, Homo Sapiens
EIIRKRDSI

SEQ ID NO: 455636 - protein, 9 aa, Homo Sapiens
SAYSHCCMN

SEQ ID NO: 455637 - protein, 9 aa, Homo Sapiens
HGMLKQQYL

SEQ ID NO: 455638 - protein, 9 aa, Homo Sapiens
AKEKRFKSQ

SEQ ID NO: 455639 - protein, 9 aa, Homo Sapiens
YSHYYSIPS

SEQ ID NO: 455640 - protein, 9 aa, Homo Sapiens
TKERCVFLF

SEQ ID NO: 455641 - protein, 9 aa, Homo Sapiens
NENEPKFLD

SEQ ID NO: 455642 - protein, 9 aa, Homo Sapiens
NSWESESPC

SEQ ID NO: 455643 - protein, 9 aa, Homo Sapiens
NYGNSSASG

SEQ ID NO: 455644 - protein, 9 aa, Homo Sapiens
QAGEKGKPG

SEQ ID NO: 455645 - protein, 9 aa, Homo Sapiens
LEGRRGPGC

SEQ ID NO: 455646 - protein, 9 aa, Homo Sapiens
PQEPPQMMA

SEQ ID NO: 455647 - protein, 9 aa, Homo Sapiens
YFPLAMENI

SEQ ID NO: 455648 - protein, 9 aa, Homo Sapiens
LKKDIRHCH

SEQ ID NO: 455649 - protein, 9 aa, Homo Sapiens
PAAPKSIKV

SEQ ID NO: 455650 - protein, 9 aa, Homo Sapiens
GKVFRLHSH

SEQ ID NO: 455651 - protein, 9 aa, Homo Sapiens
IPSYHTLSQ

SEQ ID NO: 455652 - protein, 9 aa, Homo Sapiens
AAPKSIKVE

SEQ ID NO: 455653 - protein, 9 aa, Homo Sapiens
ALGVYMCHG

SEQ ID NO: 455654 - protein, 9 aa, Homo Sapiens
DVMVAPSHL

SEQ ID NO: 455655 - protein, 9 aa, Homo Sapiens
ALVEGELAE

SEQ ID NO: 455656 - protein, 9 aa, Homo Sapiens
ASALVEGEL

SEQ ID NO: 455657 - protein, 9 aa, Homo Sapiens
GRWCLGEDP

SEQ ID NO: 455658 - protein, 9 aa, Homo Sapiens
NAGVFFLRC

SEQ ID NO: 455659 - protein, 9 aa, Homo Sapiens
TFCKIYYSV

SEQ ID NO: 455660 - protein, 9 aa, Homo Sapiens
NEVHVARCD

SEQ ID NO: 455661 - protein, 9 aa, Homo Sapiens
HQDVMTLAC

SEQ ID NO: 455662 - protein, 9 aa, Homo Sapiens
GATMRASVR

SEQ ID NO: 455663 - protein, 9 aa, Homo Sapiens
RYRKVCEDS

SEQ ID NO: 455664 - protein, 9 aa, Homo Sapiens
LQNLLGFMP

SEQ ID NO: 455665 - protein, 9 aa, Homo Sapiens
PEVLPTAQR

SEQ ID NO: 455666 - protein, 9 aa, Homo Sapiens
VSLCETALD

SEQ ID NO: 455667 - protein, 9 aa, Homo Sapiens
SYPDIHFDV

SEQ ID NO: 455668 - protein, 9 aa, Homo Sapiens
PPQMMAAAA

SEQ ID NO: 455669 - protein, 9 aa, Homo Sapiens
DSYICNETY

SEQ ID NO: 455670 - protein, 9 aa, Homo Sapiens
HILNSNWFP

SEQ ID NO: 455671 - protein, 9 aa, Homo Sapiens
PTDMWALQD

SEQ ID NO: 455672 - protein, 9 aa, Homo Sapiens
KGPDSAVTP

SEQ ID NO: 455673 - protein, 9 aa, Homo Sapiens
RVGTLQVGD

SEQ ID NO: 455674 - protein, 9 aa, Homo Sapiens
DNLKMQIQV

SEQ ID NO: 455675 - protein, 9 aa, Homo Sapiens
CRDAKEKRF

SEQ ID NO: 455676 - protein, 9 aa, Homo Sapiens
MLTRYINPA

SEQ ID NO: 455677 - protein, 9 aa, Homo Sapiens
VPVWISLPL

SEQ ID NO: 455678 - protein, 9 aa, Homo Sapiens
VWLLKEQGI

SEQ ID NO: 455679 - protein, 9 aa, Homo Sapiens
TPPVSIKSD

SEQ ID NO: 455680 - protein, 9 aa, Homo Sapiens
QSWFESSVT

SEQ ID NO: 455681 - protein, 9 aa, Homo Sapiens
PKGTRTIAA

SEQ ID NO: 455682 - protein, 9 aa, Homo Sapiens
HEACRNSNL

SEQ ID NO: 455683 - protein, 9 aa, Homo Sapiens
LIQVGHSPE

SEQ ID NO: 455684 - protein, 9 aa, Homo Sapiens
KQQYLSIAM

SEQ ID NO: 455685 - protein, 9 aa, Homo Sapiens
YPDIHFDVN

SEQ ID NO: 455686 - protein, 9 aa, Homo Sapiens
GEEHVLVPP

SEQ ID NO: 455687 - protein, 9 aa, Homo Sapiens
NPRYRLIGQ

SEQ ID NO: 455688 - protein, 9 aa, Homo Sapiens
VWEVLNLMG

SEQ ID NO: 455689 - protein, 9 aa, Homo Sapiens
YSVDLMLSI

SEQ ID NO: 455690 - protein, 9 aa, Homo Sapiens
GTEKLKSLV

SEQ ID NO: 455691 - protein, 9 aa, Homo Sapiens
EELADMVVS

SEQ ID NO: 455692 - protein, 9 aa, Homo Sapiens
STALRGDVC

SEQ ID NO: 455693 - protein, 9 aa, Homo Sapiens
DIIHTTAAR

SEQ ID NO: 455694 - protein, 9 aa, Homo Sapiens
SLQTPSFWW

SEQ ID NO: 455695 - protein, 9 aa, Homo Sapiens
SSSREESSE

SEQ ID NO: 455696 - protein, 9 aa, Homo Sapiens
RHGMLKQQY

SEQ ID NO: 455697 - protein, 9 aa, Homo Sapiens
NLMANRPTK

SEQ ID NO: 455698 - protein, 9 aa, Homo Sapiens
SWCASPPAL

SEQ ID NO: 455699 - protein, 9 aa, Homo Sapiens
TEVSAYSHC

SEQ ID NO: 455700 - protein, 9 aa, Homo Sapiens
QREQRLKRL

SEQ ID NO: 455701 - protein, 9 aa, Homo Sapiens
KGTGASGCF

SEQ ID NO: 455702 - protein, 9 aa, Homo Sapiens
HPEVLPTAQ

SEQ ID NO: 455703 - protein, 9 aa, Homo Sapiens
CRTLNGIRF

SEQ ID NO: 455704 - protein, 9 aa, Homo Sapiens
KDVMVAPSH

SEQ ID NO: 455705 - protein, 9 aa, Homo Sapiens
MGTGGSSSV

SEQ ID NO: 455706 - protein, 9 aa, Homo Sapiens
VYSRLSSSR

SEQ ID NO: 455707 - protein, 9 aa, Homo Sapiens
GSNVSSEEQ

SEQ ID NO: 455708 - protein, 9 aa, Homo Sapiens
GPHEGRTNL

SEQ ID NO: 455709 - protein, 9 aa, Homo Sapiens
YHQAEPLAA

SEQ ID NO: 455710 - protein, 9 aa, Homo Sapiens
LCSTSSVVS

SEQ ID NO: 455711 - protein, 9 aa, Homo Sapiens
QPPEAARPL

SEQ ID NO: 455712 - protein, 9 aa, Homo Sapiens
KPNWNQSPH

SEQ ID NO: 455713 - protein, 9 aa, Homo Sapiens
PEGARVSSA

SEQ ID NO: 455714 - protein, 9 aa, Homo Sapiens
EVLKEAKQF

SEQ ID NO: 455715 - protein, 9 aa, Homo Sapiens
ATMRASVRM

SEQ ID NO: 455716 - protein, 9 aa, Homo Sapiens
AAEVMVLEL

SEQ ID NO: 455717 - protein, 9 aa, Homo Sapiens
TSSRESAPV

SEQ ID NO: 455718 - protein, 9 aa, Homo Sapiens
QPTDMWALQ

SEQ ID NO: 455719 - protein, 9 aa, Homo Sapiens
LESEFSPEN

SEQ ID NO: 455720 - protein, 9 aa, Homo Sapiens
VVFFDFHGH

SEQ ID NO: 455721 - protein, 9 aa, Homo Sapiens
AHAANMVTA

SEQ ID NO: 455722 - protein, 9 aa, Homo Sapiens
LITFNYGNS

SEQ ID NO: 455723 - protein, 9 aa, Homo Sapiens
VKPIEDIQE

SEQ ID NO: 455724 - protein, 9 aa, Homo Sapiens
IKEKTQIPL

SEQ ID NO: 455725 - protein, 9 aa, Homo Sapiens
IIKEKTQIP

SEQ ID NO: 455726 - protein, 9 aa, Homo Sapiens
NLWVDDLSV

SEQ ID NO: 455727 - protein, 9 aa, Homo Sapiens
SRTKERCVF

SEQ ID NO: 455728 - protein, 9 aa, Homo Sapiens
NETSGLEVL

SEQ ID NO: 455729 - protein, 9 aa, Homo Sapiens
PDIHFDVNL

SEQ ID NO: 455730 - protein, 9 aa, Homo Sapiens
WRRCALSGS

SEQ ID NO: 455731 - protein, 9 aa, Homo Sapiens
STSHQNLWV

SEQ ID NO: 455732 - protein, 9 aa, Homo Sapiens
IQENLLQAL

SEQ ID NO: 455733 - protein, 9 aa, Homo Sapiens
YALGVYMCH

SEQ ID NO: 455734 - protein, 9 aa, Homo Sapiens
EVCGEKQHF

SEQ ID NO: 455735 - protein, 9 aa, Homo Sapiens
DLCSTSSVV

SEQ ID NO: 455736 - protein, 9 aa, Homo Sapiens
LVMLVTEVS

SEQ ID NO: 455737 - protein, 9 aa, Homo Sapiens
SSDLLVHQQ

SEQ ID NO: 455738 - protein, 9 aa, Homo Sapiens
QDVMTLACS

SEQ ID NO: 455739 - protein, 9 aa, Homo Sapiens
AQPTDMWAL

SEQ ID NO: 455740 - protein, 9 aa, Homo Sapiens
LLVVRRRQR

SEQ ID NO: 455741 - protein, 9 aa, Homo Sapiens
YPKPFKPEG

SEQ ID NO: 455742 - protein, 9 aa, Homo Sapiens
HLRSYSPDW

SEQ ID NO: 455743 - protein, 9 aa, Homo Sapiens
AVDAAATVA

SEQ ID NO: 455744 - protein, 9 aa, Homo Sapiens
YICNETYKK

SEQ ID NO: 455745 - protein, 9 aa, Homo Sapiens
KRLEKMKTN

SEQ ID NO: 455746 - protein, 9 aa, Homo Sapiens
DDPLVSAVP

SEQ ID NO: 455747 - protein, 9 aa, Homo Sapiens
GILITMETA

SEQ ID NO: 455748 - protein, 9 aa, Homo Sapiens
TRYINPAKL

SEQ ID NO: 455749 - protein, 9 aa, Homo Sapiens
CSTSSVVSP

SEQ ID NO: 455750 - protein, 9 aa, Homo Sapiens
EDKRPEEIM

SEQ ID NO: 455751 - protein, 9 aa, Homo Sapiens
STVVKGVAR

SEQ ID NO: 455752 - protein, 9 aa, Homo Sapiens
GSSDDPGKP

SEQ ID NO: 455753 - protein, 9 aa, Homo Sapiens
ELGDNLKMQ

SEQ ID NO: 455754 - protein, 9 aa, Homo Sapiens
QFQLDSAEN

SEQ ID NO: 455755 - protein, 9 aa, Homo Sapiens
RISFYADDK

SEQ ID NO: 455756 - protein, 9 aa, Homo Sapiens
IEDIQENLL

SEQ ID NO: 455757 - protein, 9 aa, Homo Sapiens
KGEGGIVRP

SEQ ID NO: 455758 - protein, 9 aa, Homo Sapiens
FYRGDSSTD

SEQ ID NO: 455759 - protein, 9 aa, Homo Sapiens
ESPGRWCLG

SEQ ID NO: 455760 - protein, 9 aa, Homo Sapiens
NQTIFSPSQ

SEQ ID NO: 455761 - protein, 9 aa, Homo Sapiens
KEAKQFVSE

SEQ ID NO: 455762 - protein, 9 aa, Homo Sapiens
FESSVTHEA

SEQ ID NO: 455763 - protein, 9 aa, Homo Sapiens
DLVKLTLQH

SEQ ID NO: 455764 - protein, 9 aa, Homo Sapiens
MFIHTGEKP

SEQ ID NO: 455765 - protein, 9 aa, Homo Sapiens
DGSSQWPTP

SEQ ID NO: 455766 - protein, 9 aa, Homo Sapiens
HTLDGATMR

SEQ ID NO: 455767 - protein, 9 aa, Homo Sapiens
QFVTGTLRV

SEQ ID NO: 455768 - protein, 9 aa, Homo Sapiens
AARPLFFLT

SEQ ID NO: 455769 - protein, 9 aa, Homo Sapiens
MGVYSGKKH

SEQ ID NO: 455770 - protein, 9 aa, Homo Sapiens
DLPQMDHQH

SEQ ID NO: 455771 - protein, 9 aa, Homo Sapiens
FWWRRCALS

SEQ ID NO: 455772 - protein, 9 aa, Homo Sapiens
TMDLGLLFL

SEQ ID NO: 455773 - protein, 9 aa, Homo Sapiens
IPGLERVPV

SEQ ID NO: 455774 - protein, 9 aa, Homo Sapiens
MSHSSLNCY

SEQ ID NO: 455775 - protein, 9 aa, Homo Sapiens
SGLEVLTSV

SEQ ID NO: 455776 - protein, 9 aa, Homo Sapiens
PFLVSAPVS

SEQ ID NO: 455777 - protein, 9 aa, Homo Sapiens
LTMNCFENC

SEQ ID NO: 455778 - protein, 9 aa, Homo Sapiens
DTMPRPQMM

SEQ ID NO: 455779 - protein, 9 aa, Homo Sapiens
FGTEKLKSL

SEQ ID NO: 455780 - protein, 9 aa, Homo Sapiens
ISAEELPGL

SEQ ID NO: 455781 - protein, 9 aa, Homo Sapiens
KRPEEIMQI

SEQ ID NO: 455782 - protein, 9 aa, Homo Sapiens
HFEKLMEHF

SEQ ID NO: 455783 - protein, 9 aa, Homo Sapiens
LSTALRGDV

SEQ ID NO: 455784 - protein, 9 aa, Homo Sapiens
ALASRPSSG

SEQ ID NO: 455785 - protein, 9 aa, Homo Sapiens
QENAMLYHQ

SEQ ID NO: 455786 - protein, 9 aa, Homo Sapiens
HFDVNLTYE

SEQ ID NO: 455787 - protein, 9 aa, Homo Sapiens
IFILVFLIP

SEQ ID NO: 455788 - protein, 9 aa, Homo Sapiens
SQIYGGVTY

SEQ ID NO: 455789 - protein, 9 aa, Homo Sapiens
IQHLLRAVN

SEQ ID NO: 455790 - protein, 9 aa, Homo Sapiens
PILEGRRGP

SEQ ID NO: 455791 - protein, 9 aa, Homo Sapiens
TLNGIRFTC

SEQ ID NO: 455792 - protein, 9 aa, Homo Sapiens
TSLQEVNKM

SEQ ID NO: 455793 - protein, 9 aa, Homo Sapiens
SSGEEHVLV

SEQ ID NO: 455794 - protein, 9 aa, Homo Sapiens
IYGVQEEND

SEQ ID NO: 455795 - protein, 9 aa, Homo Sapiens
VVTMDLGLL

SEQ ID NO: 455796 - protein, 9 aa, Homo Sapiens
PQGNSWQVV

SEQ ID NO: 455797 - protein, 9 aa, Homo Sapiens
NIQVTNHGQ

SEQ ID NO: 455798 - protein, 9 aa, Homo Sapiens
VRQRKGRNT

SEQ ID NO: 455799 - protein, 9 aa, Homo Sapiens
RMGSISFGF

SEQ ID NO: 455800 - protein, 9 aa, Homo Sapiens
PNTQAPSQI

SEQ ID NO: 455801 - protein, 9 aa, Homo Sapiens
VSIGGHSLG

SEQ ID NO: 455802 - protein, 9 aa, Homo Sapiens
SAGIGRTGI

SEQ ID NO: 455803 - protein, 9 aa, Homo Sapiens
DYFFLLSGS

SEQ ID NO: 455804 - protein, 9 aa, Homo Sapiens
LKEQGISAA

SEQ ID NO: 455805 - protein, 9 aa, Homo Sapiens
DRLSPAPGG

SEQ ID NO: 455806 - protein, 9 aa, Homo Sapiens
LKKNTPWTP

SEQ ID NO: 455807 - protein, 9 aa, Homo Sapiens
EKQHFEKLM

SEQ ID NO: 455808 - protein, 9 aa, Homo Sapiens
GARVSSAGL

SEQ ID NO: 455809 - protein, 9 aa, Homo Sapiens
KHPELITFN

SEQ ID NO: 455810 - protein, 9 aa, Homo Sapiens
LGFMPEELH

SEQ ID NO: 455811 - protein, 9 aa, Homo Sapiens
EVTLTEIQK

SEQ ID NO: 455812 - protein, 9 aa, Homo Sapiens
QVPIGVFLD

SEQ ID NO: 455813 - protein, 9 aa, Homo Sapiens
QENLLQALE

SEQ ID NO: 455814 - protein, 9 aa, Homo Sapiens
PLAMENIKS

SEQ ID NO: 455815 - protein, 9 aa, Homo Sapiens
SSRQSGTPD

SEQ ID NO: 455816 - protein, 9 aa, Homo Sapiens
PKVSDTMVE

SEQ ID NO: 455817 - protein, 9 aa, Homo Sapiens
TGTLRVPMN

SEQ ID NO: 455818 - protein, 9 aa, Homo Sapiens
ISAHHPEVL

SEQ ID NO: 455819 - protein, 9 aa, Homo Sapiens
RTQPQRHFR

SEQ ID NO: 455820 - protein, 9 aa, Homo Sapiens
RDILITTVK

SEQ ID NO: 455821 - protein, 9 aa, Homo Sapiens
MQILAQSQG

SEQ ID NO: 455822 - protein, 9 aa, Homo Sapiens
DSIVPTLVL

SEQ ID NO: 455823 - protein, 9 aa, Homo Sapiens
MTYVYNRGM

SEQ ID NO: 455824 - protein, 9 aa, Homo Sapiens
ASLLGLVSL

SEQ ID NO: 455825 - protein, 9 aa, Homo Sapiens
EGQPPEAAR

SEQ ID NO: 455826 - protein, 9 aa, Homo Sapiens
GAAHRVGTL

SEQ ID NO: 455827 - protein, 9 aa, Homo Sapiens
LQRRVVKEG

SEQ ID NO: 455828 - protein, 9 aa, Homo Sapiens
VSAVPQASF

SEQ ID NO: 455829 - protein, 9 aa, Homo Sapiens
AFVVVNSGI

SEQ ID NO: 455830 - protein, 9 aa, Homo Sapiens
VTGTLRVPM

SEQ ID NO: 455831 - protein, 9 aa, Homo Sapiens
GLVAPLVSA

SEQ ID NO: 455832 - protein, 9 aa, Homo Sapiens
SAENQNLGH

SEQ ID NO: 455833 - protein, 9 aa, Homo Sapiens
ICGKVFRLH

SEQ ID NO: 455834 - protein, 9 aa, Homo Sapiens
LVYDNGTRD

SEQ ID NO: 455835 - protein, 9 aa, Homo Sapiens
HQAEPLAAV

SEQ ID NO: 455836 - protein, 9 aa, Homo Sapiens
AKVLQFNEL

SEQ ID NO: 455837 - protein, 9 aa, Homo Sapiens
PRHTLDGAT

SEQ ID NO: 455838 - protein, 9 aa, Homo Sapiens
GRGTYSDPM

SEQ ID NO: 455839 - protein, 9 aa, Homo Sapiens
EFLMGKTLL

SEQ ID NO: 455840 - protein, 9 aa, Homo Sapiens
DVMTLACSD

SEQ ID NO: 455841 - protein, 9 aa, Homo Sapiens
ISMEMDVTK

SEQ ID NO: 455842 - protein, 9 aa, Homo Sapiens
LGAPSLQTP

SEQ ID NO: 455843 - protein, 9 aa, Homo Sapiens
CREGSRCLF

SEQ ID NO: 455844 - protein, 9 aa, Homo Sapiens
FGQLQRRVV

SEQ ID NO: 455845 - protein, 9 aa, Homo Sapiens
EQGNVSLCE

SEQ ID NO: 455846 - protein, 9 aa, Homo Sapiens
NSGIVIGDR

SEQ ID NO: 455847 - protein, 9 aa, Homo Sapiens
IGRSPVVFF

SEQ ID NO: 455848 - protein, 9 aa, Homo Sapiens
PNWNQSPHC

SEQ ID NO: 455849 - protein, 9 aa, Homo Sapiens
ELPSFLRRP

SEQ ID NO: 455850 - protein, 9 aa, Homo Sapiens
VCGEKQHFE

SEQ ID NO: 455851 - protein, 9 aa, Homo Sapiens
RFKSQDADS

SEQ ID NO: 455852 - protein, 9 aa, Homo Sapiens
EQGISAAVY

SEQ ID NO: 455853 - protein, 9 aa, Homo Sapiens
DVGTLYPFS

SEQ ID NO: 455854 - protein, 9 aa, Homo Sapiens
QGNSWQVVE

SEQ ID NO: 455855 - protein, 9 aa, Homo Sapiens
IEQGNVSLC

SEQ ID NO: 455856 - protein, 9 aa, Homo Sapiens
EKVMSHSSL

SEQ ID NO: 455857 - protein, 9 aa, Homo Sapiens
ADMVVSMAT

SEQ ID NO: 455858 - protein, 9 aa, Homo Sapiens
KYSSYNYRG

SEQ ID NO: 455859 - protein, 9 aa, Homo Sapiens
ADLPQMDHQ

SEQ ID NO: 455860 - protein, 9 aa, Homo Sapiens
GADVKALSC

SEQ ID NO: 455861 - protein, 9 aa, Homo Sapiens
VKTDDRVVT

SEQ ID NO: 455862 - protein, 9 aa, Homo Sapiens
YIPDKPVSV

SEQ ID NO: 455863 - protein, 9 aa, Homo Sapiens
PSFWWRRCA

SEQ ID NO: 455864 - protein, 9 aa, Homo Sapiens
VVVASLLGL

SEQ ID NO: 455865 - protein, 9 aa, Homo Sapiens
FHHLLQITV

SEQ ID NO: 455866 - protein, 9 aa, Homo Sapiens
GRTGILITM

SEQ ID NO: 455867 - protein, 9 aa, Homo Sapiens
VSPVVVASL

SEQ ID NO: 455868 - protein, 9 aa, Homo Sapiens
EGSNVSSEE

SEQ ID NO: 455869 - protein, 9 aa, Homo Sapiens
SQNVLSTAL

SEQ ID NO: 455870 - protein, 9 aa, Homo Sapiens
SLLGLVSLG

SEQ ID NO: 455871 - protein, 9 aa, Homo Sapiens
EQLIQAQPR

SEQ ID NO: 455872 - protein, 9 aa, Homo Sapiens
KKCKRYIPS

SEQ ID NO: 455873 - protein, 9 aa, Homo Sapiens
TMNCFENCG

SEQ ID NO: 455874 - protein, 9 aa, Homo Sapiens
VLCVHIAGL

SEQ ID NO: 455875 - protein, 9 aa, Homo Sapiens
TLTEIQKTE

SEQ ID NO: 455876 - protein, 9 aa, Homo Sapiens
PVSTIINWE

SEQ ID NO: 455877 - protein, 9 aa, Homo Sapiens
SLPEAYKLR

SEQ ID NO: 455878 - protein, 9 aa, Homo Sapiens
CGKVFRLHS

SEQ ID NO: 455879 - protein, 9 aa, Homo Sapiens
EESSEPYFF

SEQ ID NO: 455880 - protein, 9 aa, Homo Sapiens
APLVSATEV

SEQ ID NO: 455881 - protein, 9 aa, Homo Sapiens
KYIVIQVKC

SEQ ID NO: 455882 - protein, 9 aa, Homo Sapiens
ASRPSSGTS

SEQ ID NO: 455883 - protein, 9 aa, Homo Sapiens
LKFLSVFLG

SEQ ID NO: 455884 - protein, 9 aa, Homo Sapiens
PVVVASLLG

SEQ ID NO: 455885 - protein, 9 aa, Homo Sapiens
GVFRTIDMS

SEQ ID NO: 455886 - protein, 9 aa, Homo Sapiens
SQWPTPTRI

SEQ ID NO: 455887 - protein, 9 aa, Homo Sapiens
GNCSASTSQ

SEQ ID NO: 455888 - protein, 9 aa, Homo Sapiens
SDTRGIYFP

SEQ ID NO: 455889 - protein, 9 aa, Homo Sapiens
ETLSQSYHY

SEQ ID NO: 455890 - protein, 9 aa, Homo Sapiens
CQLHRISFY

SEQ ID NO: 455891 - protein, 9 aa, Homo Sapiens
LLQITVLNS

SEQ ID NO: 455892 - protein, 9 aa, Homo Sapiens
LEALYPKPF

SEQ ID NO: 455893 - protein, 9 aa, Homo Sapiens
LVWLLKEQG

SEQ ID NO: 455894 - protein, 9 aa, Homo Sapiens
LGHSHDMTE

SEQ ID NO: 455895 - protein, 9 aa, Homo Sapiens
TDMWALQDF

SEQ ID NO: 455896 - protein, 9 aa, Homo Sapiens
GLERVPVWI

SEQ ID NO: 455897 - protein, 9 aa, Homo Sapiens
KLHILNSNW

SEQ ID NO: 455898 - protein, 9 aa, Homo Sapiens
IGRTGILIT

SEQ ID NO: 455899 - protein, 9 aa, Homo Sapiens
LTRHTINPP

SEQ ID NO: 455900 - protein, 9 aa, Homo Sapiens
RGTYSDPME

SEQ ID NO: 455901 - protein, 9 aa, Homo Sapiens
PGAAFGVAP

SEQ ID NO: 455902 - protein, 9 aa, Homo Sapiens
TGAFMKILG

SEQ ID NO: 455903 - protein, 9 aa, Homo Sapiens
LYDAMTYVY

SEQ ID NO: 455904 - protein, 9 aa, Homo Sapiens
KKVSEVVEQ

SEQ ID NO: 455905 - protein, 9 aa, Homo Sapiens
LAERADFQY

SEQ ID NO: 455906 - protein, 9 aa, Homo Sapiens
ENVMRHFAV

SEQ ID NO: 455907 - protein, 9 aa, Homo Sapiens
MWALQDFEE

SEQ ID NO: 455908 - protein, 9 aa, Homo Sapiens
IQKTEGLEE

SEQ ID NO: 455909 - protein, 9 aa, Homo Sapiens
LDSAENQNL

SEQ ID NO: 455910 - protein, 9 aa, Homo Sapiens
YFGTEKLKS

SEQ ID NO: 455911 - protein, 9 aa, Homo Sapiens
IRNETSGLE

SEQ ID NO: 455912 - protein, 9 aa, Homo Sapiens
LVSAPVSTI

SEQ ID NO: 455913 - protein, 9 aa, Homo Sapiens
IQVTNHGQL

SEQ ID NO: 455914 - protein, 9 aa, Homo Sapiens
SACASPFQS

SEQ ID NO: 455915 - protein, 9 aa, Homo Sapiens
CNCTPLTLC

SEQ ID NO: 455916 - protein, 9 aa, Homo Sapiens
EVVEQFEDI

SEQ ID NO: 455917 - protein, 9 aa, Homo Sapiens
LHKGLTVKI

SEQ ID NO: 455918 - protein, 9 aa, Homo Sapiens
CLKKVSEVV

SEQ ID NO: 455919 - protein, 9 aa, Homo Sapiens
SPHQDTMPR

SEQ ID NO: 455920 - protein, 9 aa, Homo Sapiens
LVEGELAEE

SEQ ID NO: 455921 - protein, 9 aa, Homo Sapiens
LKIHYTVTC

SEQ ID NO: 455922 - protein, 9 aa, Homo Sapiens
SRNKPGAAF

SEQ ID NO: 455923 - protein, 9 aa, Homo Sapiens
NGTRDILIT

SEQ ID NO: 455924 - protein, 9 aa, Homo Sapiens
EGRTNLTVL

SEQ ID NO: 455925 - protein, 9 aa, Homo Sapiens
IHTTAARAN

SEQ ID NO: 455926 - protein, 9 aa, Homo Sapiens
DMWALQDFE

SEQ ID NO: 455927 - protein, 9 aa, Homo Sapiens
NLNLPSKVV

SEQ ID NO: 455928 - protein, 9 aa, Homo Sapiens
KGSYFGTEK

SEQ ID NO: 455929 - protein, 9 aa, Homo Sapiens
EDSYICNET

SEQ ID NO: 455930 - protein, 9 aa, Homo Sapiens
SCFCCYEEC

SEQ ID NO: 455931 - protein, 9 aa, Homo Sapiens
RRYRKVCED

SEQ ID NO: 455932 - protein, 9 aa, Homo Sapiens
VPIGVFLDL

SEQ ID NO: 455933 - protein, 9 aa, Homo Sapiens
LHTLNAVNM

SEQ ID NO: 455934 - protein, 9 aa, Homo Sapiens
IYFPLAMEN

SEQ ID NO: 455935 - protein, 9 aa, Homo Sapiens
RGDERQGIQ

SEQ ID NO: 455936 - protein, 9 aa, Homo Sapiens
GRRGPGCAV

SEQ ID NO: 455937 - protein, 9 aa, Homo Sapiens
DERQGIQHL

SEQ ID NO: 455938 - protein, 9 aa, Homo Sapiens
REGQPPEAA

SEQ ID NO: 455939 - protein, 9 aa, Homo Sapiens
EPPAAPKSI

SEQ ID NO: 455940 - protein, 9 aa, Homo Sapiens
KALSCGEVR

SEQ ID NO: 455941 - protein, 9 aa, Homo Sapiens
LASRPSSGT

SEQ ID NO: 455942 - protein, 9 aa, Homo Sapiens
QLWEYDLVK

SEQ ID NO: 455943 - protein, 9 aa, Homo Sapiens
VPPGLQPPH

SEQ ID NO: 455944 - protein, 9 aa, Homo Sapiens
DRHYKCYEC

SEQ ID NO: 455945 - protein, 9 aa, Homo Sapiens
AHRVGTLQV

SEQ ID NO: 455946 - protein, 9 aa, Homo Sapiens
YGPKLSHLH

SEQ ID NO: 455947 - protein, 9 aa, Homo Sapiens
MSNVAQFDS

SEQ ID NO: 455948 - protein, 9 aa, Homo Sapiens
CFKLNKKAA

SEQ ID NO: 455949 - protein, 9 aa, Homo Sapiens
ETSGLEVLT

SEQ ID NO: 455950 - protein, 9 aa, Homo Sapiens
YDAMTYVYN

SEQ ID NO: 455951 - protein, 9 aa, Homo Sapiens
VLPSAVQTF

SEQ ID NO: 455952 - protein, 9 aa, Homo Sapiens
HRHRPFSPG

SEQ ID NO: 455953 - protein, 9 aa, Homo Sapiens
GNQLWEYDL

SEQ ID NO: 455954 - protein, 9 aa, Homo Sapiens
GFHGVFRTI

SEQ ID NO: 455955 - protein, 9 aa, Homo Sapiens
FLVSAPVST

SEQ ID NO: 455956 - protein, 9 aa, Homo Sapiens
CPELKKNTP

SEQ ID NO: 455957 - protein, 9 aa, Homo Sapiens
REGSRCLFS

SEQ ID NO: 455958 - protein, 9 aa, Homo Sapiens
KSRKDTSGN

SEQ ID NO: 455959 - protein, 9 aa, Homo Sapiens
SYICNETYK

SEQ ID NO: 455960 - protein, 9 aa, Homo Sapiens
CLATYTDGN

SEQ ID NO: 455961 - protein, 9 aa, Homo Sapiens
ERDVLCVHI

SEQ ID NO: 455962 - protein, 9 aa, Homo Sapiens
RGPGCAVLD

SEQ ID NO: 455963 - protein, 9 aa, Homo Sapiens
LGVYMCHGV

SEQ ID NO: 455964 - protein, 9 aa, Homo Sapiens
FFLRCTICN

SEQ ID NO: 455965 - protein, 9 aa, Homo Sapiens
LYPKPFKPE

SEQ ID NO: 455966 - protein, 9 aa, Homo Sapiens
SYSHYYSIP

SEQ ID NO: 455967 - protein, 9 aa, Homo Sapiens
VSDYFFLLS

SEQ ID NO: 455968 - protein, 9 aa, Homo Sapiens
EEATAARAI

SEQ ID NO: 455969 - protein, 9 aa, Homo Sapiens
TLDGATMRA

SEQ ID NO: 455970 - protein, 9 aa, Homo Sapiens
LSASGAGSS

SEQ ID NO: 455971 - protein, 9 aa, Homo Sapiens
CFENCGGYC

SEQ ID NO: 455972 - protein, 9 aa, Homo Sapiens
SSNKTPHKS

SEQ ID NO: 455973 - protein, 9 aa, Homo Sapiens
KIQDINENE

SEQ ID NO: 455974 - protein, 9 aa, Homo Sapiens
WKLHLAERA

SEQ ID NO: 455975 - protein, 9 aa, Homo Sapiens
SPVVVASLL

SEQ ID NO: 455976 - protein, 9 aa, Homo Sapiens
HDIIKEKTQ

SEQ ID NO: 455977 - protein, 9 aa, Homo Sapiens
NLMGVYSGK

SEQ ID NO: 455978 - protein, 9 aa, Homo Sapiens
QFVSENEGA

SEQ ID NO: 455979 - protein, 9 aa, Homo Sapiens
MCHGVPPKD

SEQ ID NO: 455980 - protein, 9 aa, Homo Sapiens
CGMREMRAG

SEQ ID NO: 455981 - protein, 9 aa, Homo Sapiens
ANRPTKYKD

SEQ ID NO: 455982 - protein, 9 aa, Homo Sapiens
ASPPALASR

SEQ ID NO: 455983 - protein, 9 aa, Homo Sapiens
LSQCEFLMG

SEQ ID NO: 455984 - protein, 9 aa, Homo Sapiens
HVQKLSKCA

SEQ ID NO: 455985 - protein, 9 aa, Homo Sapiens
QAEPLAAVL

SEQ ID NO: 455986 - protein, 9 aa, Homo Sapiens
RHFAVDAAA

SEQ ID NO: 455987 - protein, 9 aa, Homo Sapiens
GVFFLRCTI

SEQ ID NO: 455988 - protein, 9 aa, Homo Sapiens
GSYFGTEKL

SEQ ID NO: 455989 - protein, 9 aa, Homo Sapiens
DFAEELADM

SEQ ID NO: 455990 - protein, 9 aa, Homo Sapiens
PGIKEGKPH

SEQ ID NO: 455991 - protein, 9 aa, Homo Sapiens
QQYLSIAMV

SEQ ID NO: 455992 - protein, 9 aa, Homo Sapiens
GHSHDMTER

SEQ ID NO: 455993 - protein, 9 aa, Homo Sapiens
ENLLQALEL

SEQ ID NO: 455994 - protein, 9 aa, Homo Sapiens
VEGELAEEA

SEQ ID NO: 455995 - protein, 9 aa, Homo Sapiens
KKFFHHLLQ

SEQ ID NO: 455996 - protein, 9 aa, Homo Sapiens
SDRLSPAPG

SEQ ID NO: 455997 - protein, 9 aa, Homo Sapiens
QKTEGLEEQ

SEQ ID NO: 455998 - protein, 9 aa, Homo Sapiens
AARAIDRFD

SEQ ID NO: 455999 - protein, 9 aa, Homo Sapiens
LVSAVPQAS

SEQ ID NO: 456000 - protein, 9 aa, Homo Sapiens
TLACSDNRI

SEQ ID NO: 456001 - protein, 9 aa, Homo Sapiens
IEVLKEAKQ

SEQ ID NO: 456002 - protein, 9 aa, Homo Sapiens
LVHQQSHTG

SEQ ID NO: 456003 - protein, 9 aa, Homo Sapiens
AIHEACRNS

SEQ ID NO: 456004 - protein, 9 aa, Homo Sapiens
KEVTGAFMK

SEQ ID NO: 456005 - protein, 9 aa, Homo Sapiens
PHQDTMPRP

SEQ ID NO: 456006 - protein, 9 aa, Homo Sapiens
PDAETSSGG

SEQ ID NO: 456007 - protein, 9 aa, Homo Sapiens
PGTGHRNQT

SEQ ID NO: 456008 - protein, 9 aa, Homo Sapiens
ESSEGSNVS

SEQ ID NO: 456009 - protein, 9 aa, Homo Sapiens
KVLAQKSGF

SEQ ID NO: 456010 - protein, 9 aa, Homo Sapiens
SWISSDCPE

SEQ ID NO: 456011 - protein, 9 aa, Homo Sapiens
PCVMPPPPQ

SEQ ID NO: 456012 - protein, 9 aa, Homo Sapiens
LVGKDVMVA

SEQ ID NO: 456013 - protein, 9 aa, Homo Sapiens
DIEKFDKSK

SEQ ID NO: 456014 - protein, 9 aa, Homo Sapiens
HVARCDVSK

SEQ ID NO: 456015 - protein, 9 aa, Homo Sapiens
QVKCLEWKN

SEQ ID NO: 456016 - protein, 9 aa, Homo Sapiens
GLPHRHRPF

SEQ ID NO: 456017 - protein, 9 aa, Homo Sapiens
QAPSQIYGG

SEQ ID NO: 456018 - protein, 9 aa, Homo Sapiens
VCREGSRCL

SEQ ID NO: 456019 - protein, 9 aa, Homo Sapiens
SGAGSSWGS

SEQ ID NO: 456020 - protein, 9 aa, Homo Sapiens
VLQFNELGA

SEQ ID NO: 456021 - protein, 9 aa, Homo Sapiens
SSESSEGSN

SEQ ID NO: 456022 - protein, 9 aa, Homo Sapiens
QWPTPTRIP

SEQ ID NO: 456023 - protein, 9 aa, Homo Sapiens
MKTNRSALL

SEQ ID NO: 456024 - protein, 9 aa, Homo Sapiens
CEVCKKAGN

SEQ ID NO: 456025 - protein, 9 aa, Homo Sapiens
DEAIHEACR

SEQ ID NO: 456026 - protein, 9 aa, Homo Sapiens
SNLSFVDLG

SEQ ID NO: 456027 - protein, 9 aa, Homo Sapiens
LMLIDFKYS

SEQ ID NO: 456028 - protein, 9 aa, Homo Sapiens
SSVLLGAPS

SEQ ID NO: 456029 - protein, 9 aa, Homo Sapiens
TPILEGRRG

SEQ ID NO: 456030 - protein, 9 aa, Homo Sapiens
APSLQTPSF

SEQ ID NO: 456031 - protein, 9 aa, Homo Sapiens
HSEESTTVH

SEQ ID NO: 456032 - protein, 9 aa, Homo Sapiens
AERADFQYS

SEQ ID NO: 456033 - protein, 9 aa, Homo Sapiens
SFWWRRCAL

SEQ ID NO: 456034 - protein, 9 aa, Homo Sapiens
TMRASVRMT

SEQ ID NO: 456035 - protein, 9 aa, Homo Sapiens
RQSGTPDAE

SEQ ID NO: 456036 - protein, 9 aa, Homo Sapiens
SEFSPENLR

SEQ ID NO: 456037 - protein, 9 aa, Homo Sapiens
RAEMVALME

SEQ ID NO: 456038 - protein, 9 aa, Homo Sapiens
DSMPAHLHL

SEQ ID NO: 456039 - protein, 9 aa, Homo Sapiens
IQSILTTPE

SEQ ID NO: 456040 - protein, 9 aa, Homo Sapiens
YCLHQDVMT

SEQ ID NO: 456041 - protein, 9 aa, Homo Sapiens
PPARPKKSE

SEQ ID NO: 456042 - protein, 9 aa, Homo Sapiens
RHYKCYECG

SEQ ID NO: 456043 - protein, 9 aa, Homo Sapiens
DTRGIYFPL

SEQ ID NO: 456044 - protein, 9 aa, Homo Sapiens
YADDKTDKR

SEQ ID NO: 456045 - protein, 9 aa, Homo Sapiens
EGARVSSAG

SEQ ID NO: 456046 - protein, 9 aa, Homo Sapiens
SWQVVEQDE

SEQ ID NO: 456047 - protein, 9 aa, Homo Sapiens
GDHSNKAMY

SEQ ID NO: 456048 - protein, 9 aa, Homo Sapiens
GAGSSWGSA

SEQ ID NO: 456049 - protein, 9 aa, Homo Sapiens
IPSAVSTGH

SEQ ID NO: 456050 - protein, 9 aa, Homo Sapiens
DLVLAYYVQ

SEQ ID NO: 456051 - protein, 9 aa, Homo Sapiens
EKTQIPLQA

SEQ ID NO: 456052 - protein, 9 aa, Homo Sapiens
LNLMGVYSG

SEQ ID NO: 456053 - protein, 9 aa, Homo Sapiens
YLSIAMVVT

SEQ ID NO: 456054 - protein, 9 aa, Homo Sapiens
KVFRLHSHL

SEQ ID NO: 456055 - protein, 9 aa, Homo Sapiens
VKNGRPLRS

SEQ ID NO: 456056 - protein, 9 aa, Homo Sapiens
NCFENCGGY

SEQ ID NO: 456057 - protein, 9 aa, Homo Sapiens
IPDVQIVER

SEQ ID NO: 456058 - protein, 9 aa, Homo Sapiens
DMVVSMATE

SEQ ID NO: 456059 - protein, 9 aa, Homo Sapiens
INENEPKFL

SEQ ID NO: 456060 - protein, 9 aa, Homo Sapiens
TPSFWWRRC

SEQ ID NO: 456061 - protein, 9 aa, Homo Sapiens
AVNMELYTG

SEQ ID NO: 456062 - protein, 9 aa, Homo Sapiens
EMRAGGCCH

SEQ ID NO: 456063 - protein, 9 aa, Homo Sapiens
VTVSIGGHS

SEQ ID NO: 456064 - protein, 9 aa, Homo Sapiens
TVVKGVARG

SEQ ID NO: 456065 - protein, 9 aa, Homo Sapiens
REESSEPYF

SEQ ID NO: 456066 - protein, 9 aa, Homo Sapiens
ENDSHVQNF

SEQ ID NO: 456067 - protein, 9 aa, Homo Sapiens
WLLKEQGIS

SEQ ID NO: 456068 - protein, 9 aa, Homo Sapiens
VLVPPGLQP

SEQ ID NO: 456069 - protein, 9 aa, Homo Sapiens
VKALKYIPD

SEQ ID NO: 456070 - protein, 9 aa, Homo Sapiens
RPQGPPGPK

SEQ ID NO: 456071 - protein, 9 aa, Homo Sapiens
AVSTGHTTP

SEQ ID NO: 456072 - protein, 9 aa, Homo Sapiens
YKSENVHVI

SEQ ID NO: 456073 - protein, 9 aa, Homo Sapiens
AVPQASFSS

SEQ ID NO: 456074 - protein, 9 aa, Homo Sapiens
DVVYKSENV

SEQ ID NO: 456075 - protein, 9 aa, Homo Sapiens
SQREVDAVE

SEQ ID NO: 456076 - protein, 9 aa, Homo Sapiens
QHFEKLMEH

SEQ ID NO: 456077 - protein, 9 aa, Homo Sapiens
KKCHESLRP

SEQ ID NO: 456078 - protein, 9 aa, Homo Sapiens
HTGDRHYKC

SEQ ID NO: 456079 - protein, 9 aa, Homo Sapiens
STSASACAS

SEQ ID NO: 456080 - protein, 9 aa, Homo Sapiens
GLKLGTCPS

SEQ ID NO: 456081 - protein, 9 aa, Homo Sapiens
SDYFFLLSG

SEQ ID NO: 456082 - protein, 9 aa, Homo Sapiens
CLEWKNKEN

SEQ ID NO: 456083 - protein, 9 aa, Homo Sapiens
LMGVYSGKK

SEQ ID NO: 456084 - protein, 9 aa, Homo Sapiens
QYLSIAMVV

SEQ ID NO: 456085 - protein, 9 aa, Homo Sapiens
KKNTPWTPW

SEQ ID NO: 456086 - protein, 9 aa, Homo Sapiens
HQGGECDLQ

SEQ ID NO: 456087 - protein, 9 aa, Homo Sapiens
PSKVVRIAP

SEQ ID NO: 456088 - protein, 9 aa, Homo Sapiens
DDRVVTMDL

SEQ ID NO: 456089 - protein, 9 aa, Homo Sapiens
TLCLATYTD

SEQ ID NO: 456090 - protein, 9 aa, Homo Sapiens
YSIPSYHTL

SEQ ID NO: 456091 - protein, 9 aa, Homo Sapiens
KERCVFLFE

SEQ ID NO: 456092 - protein, 9 aa, Homo Sapiens
IQVKCLEWK

SEQ ID NO: 456093 - protein, 9 aa, Homo Sapiens
NRLYDAMTY

SEQ ID NO: 456094 - protein, 9 aa, Homo Sapiens
QKTHTGDRH

SEQ ID NO: 456095 - protein, 9 aa, Homo Sapiens
SRQSGTPDA

SEQ ID NO: 456096 - protein, 9 aa, Homo Sapiens
WEYDLVKLT

SEQ ID NO: 456097 - protein, 9 aa, Homo Sapiens
RTGILITME

SEQ ID NO: 456098 - protein, 9 aa, Homo Sapiens
IPKVLAQKS

SEQ ID NO: 456099 - protein, 9 aa, Homo Sapiens
QITVLNSYI

SEQ ID NO: 456100 - protein, 8 aa, Homo Sapiens
CHHRHCDF

SEQ ID NO: 456101 - protein, 9 aa, Homo Sapiens
LERVPVWIS

SEQ ID NO: 456102 - protein, 9 aa, Homo Sapiens
SAVSTGHTT

SEQ ID NO: 456103 - protein, 9 aa, Homo Sapiens
CVMPPPPQL

SEQ ID NO: 456104 - protein, 9 aa, Homo Sapiens
MANRPTKYK

SEQ ID NO: 456105 - protein, 9 aa, Homo Sapiens
PEAYKLRAA

SEQ ID NO: 456106 - protein, 9 aa, Homo Sapiens
EWAEVPQEA

SEQ ID NO: 456107 - protein, 9 aa, Homo Sapiens
ACIRCEVCK

SEQ ID NO: 456108 - protein, 9 aa, Homo Sapiens
DKPDMADIE

SEQ ID NO: 456109 - protein, 9 aa, Homo Sapiens
DGGNPDLRV

SEQ ID NO: 456110 - protein, 9 aa, Homo Sapiens
REVDAVEVF

SEQ ID NO: 456111 - protein, 9 aa, Homo Sapiens
PENLRFWLA

SEQ ID NO: 456112 - protein, 9 aa, Homo Sapiens
TCVSHIAVV

SEQ ID NO: 456113 - protein, 9 aa, Homo Sapiens
QAVIRGLQE

SEQ ID NO: 456114 - protein, 9 aa, Homo Sapiens
SAPVSTIIN

SEQ ID NO: 456115 - protein, 9 aa, Homo Sapiens
ARVSSAGLF

SEQ ID NO: 456116 - protein, 9 aa, Homo Sapiens
LSKCASCLK

SEQ ID NO: 456117 - protein, 9 aa, Homo Sapiens
VIPDVQIVE

SEQ ID NO: 456118 - protein, 9 aa, Homo Sapiens
GDERQGIQH

SEQ ID NO: 456119 - protein, 9 aa, Homo Sapiens
LKYIPDKPV

SEQ ID NO: 456120 - protein, 9 aa, Homo Sapiens
IRCGELGLV

SEQ ID NO: 456121 - protein, 9 aa, Homo Sapiens
RKDTSGNCS

SEQ ID NO: 456122 - protein, 9 aa, Homo Sapiens
NITQLPQEP

SEQ ID NO: 456123 - protein, 9 aa, Homo Sapiens
NLKMQIQVL

SEQ ID NO: 456124 - protein, 9 aa, Homo Sapiens
PDSIVPTLV

SEQ ID NO: 456125 - protein, 9 aa, Homo Sapiens
LLQFVTGTL

SEQ ID NO: 456126 - protein, 9 aa, Homo Sapiens
HCHRMSRRP

SEQ ID NO: 456127 - protein, 9 aa, Homo Sapiens
QLIQAQPRG

SEQ ID NO: 456128 - protein, 9 aa, Homo Sapiens
EVNKMVLVF

SEQ ID NO: 456129 - protein, 9 aa, Homo Sapiens
LCLATYTDG

SEQ ID NO: 456130 - protein, 9 aa, Homo Sapiens
MICGKVFRL

SEQ ID NO: 456131 - protein, 9 aa, Homo Sapiens
KGVARGLRE

SEQ ID NO: 456132 - protein, 9 aa, Homo Sapiens
CLGLVAPLV

SEQ ID NO: 456133 - protein, 9 aa, Homo Sapiens
EELPGLKLG

SEQ ID NO: 456134 - protein, 9 aa, Homo Sapiens
SSPHQDTMP

SEQ ID NO: 456135 - protein, 9 aa, Homo Sapiens
NVLSTALRG

SEQ ID NO: 456136 - protein, 9 aa, Homo Sapiens
MLGHSHDMT

SEQ ID NO: 456137 - protein, 9 aa, Homo Sapiens
SASGAGSSW

SEQ ID NO: 456138 - protein, 9 aa, Homo Sapiens
WCLGEDPTG

SEQ ID NO: 456139 - protein, 9 aa, Homo Sapiens
EKEWAEVPQ

SEQ ID NO: 456140 - protein, 9 aa, Homo Sapiens
LHNVLVFAP

SEQ ID NO: 456141 - protein, 9 aa, Homo Sapiens
ESLPEAYKL

SEQ ID NO: 456142 - protein, 9 aa, Homo Sapiens
DGLSPNHLK

SEQ ID NO: 456143 - protein, 9 aa, Homo Sapiens
SPPALASRP

SEQ ID NO: 456144 - protein, 9 aa, Homo Sapiens
WNQSPHCPR

SEQ ID NO: 456145 - protein, 9 aa, Homo Sapiens
GLEVLTSVS

SEQ ID NO: 456146 - protein, 9 aa, Homo Sapiens
GTGHRNQTI

SEQ ID NO: 456147 - protein, 9 aa, Homo Sapiens
SGNCSASTS

SEQ ID NO: 456148 - protein, 9 aa, Homo Sapiens
NGIYKGRKG

SEQ ID NO: 456149 - protein, 9 aa, Homo Sapiens
DGFHGVFRT

SEQ ID NO: 456150 - protein, 9 aa, Homo Sapiens
YGILDEAIH

SEQ ID NO: 456151 - protein, 9 aa, Homo Sapiens
VCKKAGNLY

SEQ ID NO: 456152 - protein, 9 aa, Homo Sapiens
RTNLTVLVE

SEQ ID NO: 456153 - protein, 9 aa, Homo Sapiens
NKEVTGAFM

SEQ ID NO: 456154 - protein, 9 aa, Homo Sapiens
GQARRCTWR

SEQ ID NO: 456155 - protein, 9 aa, Homo Sapiens
GGHSLGACL

SEQ ID NO: 456156 - protein, 9 aa, Homo Sapiens
LERGICRYG

SEQ ID NO: 456157 - protein, 9 aa, Homo Sapiens
SFGFRTTEP

SEQ ID NO: 456158 - protein, 9 aa, Homo Sapiens
LLVGKDVMV

SEQ ID NO: 456159 - protein, 9 aa, Homo Sapiens
PVTIPSAVS

SEQ ID NO: 456160 - protein, 9 aa, Homo Sapiens
FLFRLSFCN

SEQ ID NO: 456161 - protein, 9 aa, Homo Sapiens
ESESPCETV

SEQ ID NO: 456162 - protein, 9 aa, Homo Sapiens
KPIEDIQEN

SEQ ID NO: 456163 - protein, 9 aa, Homo Sapiens
GRKGMGGWE

SEQ ID NO: 456164 - protein, 9 aa, Homo Sapiens
TEIQKTEGL

SEQ ID NO: 456165 - protein, 9 aa, Homo Sapiens
VMQWLDENQ

SEQ ID NO: 456166 - protein, 9 aa, Homo Sapiens
CLHQDVMTL

SEQ ID NO: 456167 - protein, 9 aa, Homo Sapiens
SRLLEDSYI

SEQ ID NO: 456168 - protein, 9 aa, Homo Sapiens
FPVSDYFFL

SEQ ID NO: 456169 - protein, 9 aa, Homo Sapiens
EAVVQFSKS

SEQ ID NO: 456170 - protein, 9 aa, Homo Sapiens
LFRLSFCNS

SEQ ID NO: 456171 - protein, 9 aa, Homo Sapiens
HMLTRYINP

SEQ ID NO: 456172 - protein, 9 aa, Homo Sapiens
DVLCVHIAG

SEQ ID NO: 456173 - protein, 9 aa, Homo Sapiens
SGTPDAETS

SEQ ID NO: 456174 - protein, 9 aa, Homo Sapiens
PGLERVPVW

SEQ ID NO: 456175 - protein, 9 aa, Homo Sapiens
FDFHGHSQK

SEQ ID NO: 456176 - protein, 9 aa, Homo Sapiens
VTIPSAVST

SEQ ID NO: 456177 - protein, 9 aa, Homo Sapiens
SLVYDNGTR

SEQ ID NO: 456178 - protein, 9 aa, Homo Sapiens
WEVLNLMGV

SEQ ID NO: 456179 - protein, 9 aa, Homo Sapiens
ISSDCPERC

SEQ ID NO: 456180 - protein, 9 aa, Homo Sapiens
IHFDVNLTY

SEQ ID NO: 456181 - protein, 9 aa, Homo Sapiens
ATAARAIDR

SEQ ID NO: 456182 - protein, 9 aa, Homo Sapiens
DQFQLDSAE

SEQ ID NO: 456183 - protein, 9 aa, Homo Sapiens
ICHQGGECD

SEQ ID NO: 456184 - protein, 9 aa, Homo Sapiens
CIRCEVCKK

SEQ ID NO: 456185 - protein, 9 aa, Homo Sapiens
PKLSHLHNV

SEQ ID NO: 456186 - protein, 9 aa, Homo Sapiens
LTLCTAISH

SEQ ID NO: 456187 - protein, 9 aa, Homo Sapiens
WAEVPQEAP

SEQ ID NO: 456188 - protein, 9 aa, Homo Sapiens
GNPDLRVLT

SEQ ID NO: 456189 - protein, 9 aa, Homo Sapiens
FRLSFCNSN

SEQ ID NO: 456190 - protein, 9 aa, Homo Sapiens
ELITFNYGN

SEQ ID NO: 456191 - protein, 9 aa, Homo Sapiens
WPLLTRHTI

SEQ ID NO: 456192 - protein, 9 aa, Homo Sapiens
KRMGSISFG

SEQ ID NO: 456193 - protein, 9 aa, Homo Sapiens
GQLFQNMTC

SEQ ID NO: 456194 - protein, 9 aa, Homo Sapiens
SEPPAAPKS

SEQ ID NO: 456195 - protein, 9 aa, Homo Sapiens
TRGIYFPLA

SEQ ID NO: 456196 - protein, 9 aa, Homo Sapiens
LGDNLKMQI

SEQ ID NO: 456197 - protein, 9 aa, Homo Sapiens
IIHTTAARA

SEQ ID NO: 456198 - protein, 9 aa, Homo Sapiens
KLKSLVLHF

SEQ ID NO: 456199 - protein, 9 aa, Homo Sapiens
LVVRRRQRE

SEQ ID NO: 456200 - protein, 9 aa, Homo Sapiens
RGQHVQKLS

SEQ ID NO: 456201 - protein, 9 aa, Homo Sapiens
PHKSSINHI

SEQ ID NO: 456202 - protein, 9 aa, Homo Sapiens
MLYHQAEPL

SEQ ID NO: 456203 - protein, 9 aa, Homo Sapiens
ELGANAVTP

SEQ ID NO: 456204 - protein, 9 aa, Homo Sapiens
SIPSYHTLS

SEQ ID NO: 456205 - protein, 9 aa, Homo Sapiens
VFRLHSHLI

SEQ ID NO: 456206 - protein, 9 aa, Homo Sapiens
VSIKSDRLS

SEQ ID NO: 456207 - protein, 9 aa, Homo Sapiens
ECNRHMLTR

SEQ ID NO: 456208 - protein, 9 aa, Homo Sapiens
LPKPQPCVM

SEQ ID NO: 456209 - protein, 9 aa, Homo Sapiens
SPENLRFWL

SEQ ID NO: 456210 - protein, 9 aa, Homo Sapiens
QSTSASACA

SEQ ID NO: 456211 - protein, 9 aa, Homo Sapiens
YFFLLSGSC

SEQ ID NO: 456212 - protein, 9 aa, Homo Sapiens
GASGCFKLN

SEQ ID NO: 456213 - protein, 9 aa, Homo Sapiens
GVYMCHGVP

SEQ ID NO: 456214 - protein, 9 aa, Homo Sapiens
NKPGAAFGV

SEQ ID NO: 456215 - protein, 9 aa, Homo Sapiens
LELPSFLRR

SEQ ID NO: 456216 - protein, 9 aa, Homo Sapiens
VVNSGIVIG

SEQ ID NO: 456217 - protein, 9 aa, Homo Sapiens
APQMAKGDA

SEQ ID NO: 456218 - protein, 9 aa, Homo Sapiens
VHQQSHTGE

SEQ ID NO: 456219 - protein, 9 aa, Homo Sapiens
AINAGVFFL

SEQ ID NO: 456220 - protein, 9 aa, Homo Sapiens
VRPQGPPGP

SEQ ID NO: 456221 - protein, 9 aa, Homo Sapiens
AIEQGNVSL

SEQ ID NO: 456222 - protein, 9 aa, Homo Sapiens
RLYDAMTYV

SEQ ID NO: 456223 - protein, 9 aa, Homo Sapiens
VKRLEKMKT

SEQ ID NO: 456224 - protein, 9 aa, Homo Sapiens
RKLLNIHWV

SEQ ID NO: 456225 - protein, 9 aa, Homo Sapiens
KRDSIAPVS

SEQ ID NO: 456226 - protein, 9 aa, Homo Sapiens
QEVNKMVLV

SEQ ID NO: 456227 - protein, 9 aa, Homo Sapiens
LTRYINPAK

SEQ ID NO: 456228 - protein, 9 aa, Homo Sapiens
VNMELYTGL

SEQ ID NO: 456229 - protein, 9 aa, Homo Sapiens
FILVFLIPF

SEQ ID NO: 456230 - protein, 9 aa, Homo Sapiens
PEEIMQILA

SEQ ID NO: 456231 - protein, 9 aa, Homo Sapiens
FKYSSYNYR

SEQ ID NO: 456232 - protein, 9 aa, Homo Sapiens
YREHLPLIG

SEQ ID NO: 456233 - protein, 9 aa, Homo Sapiens
RAIDRFDEG

SEQ ID NO: 456234 - protein, 9 aa, Homo Sapiens
DSAENQNLG

SEQ ID NO: 456235 - protein, 9 aa, Homo Sapiens
ARGLRETIT

SEQ ID NO: 456236 - protein, 9 aa, Homo Sapiens
VARGLRETI

SEQ ID NO: 456237 - protein, 9 aa, Homo Sapiens
DFKYSSYNY

SEQ ID NO: 456238 - protein, 9 aa, Homo Sapiens
QNYVKHMFI

SEQ ID NO: 456239 - protein, 9 aa, Homo Sapiens
TSETKKKER

SEQ ID NO: 456240 - protein, 9 aa, Homo Sapiens
SQYDEAVVQ

SEQ ID NO: 456241 - protein, 9 aa, Homo Sapiens
LGHSEESTT

SEQ ID NO: 456242 - protein, 9 aa, Homo Sapiens
EPAVIPDVQ

SEQ ID NO: 456243 - protein, 9 aa, Homo Sapiens
VLELPSFLR

SEQ ID NO: 456244 - protein, 9 aa, Homo Sapiens
WQVVEQDEE

SEQ ID NO: 456245 - protein, 9 aa, Homo Sapiens
ASAKDLCST

SEQ ID NO: 456246 - protein, 9 aa, Homo Sapiens
FENCGGYCY

SEQ ID NO: 456247 - protein, 9 aa, Homo Sapiens
HRLKKDIRH

SEQ ID NO: 456248 - protein, 9 aa, Homo Sapiens
RMSNVAQFD

SEQ ID NO: 456249 - protein, 9 aa, Homo Sapiens
RTKERCVFL

SEQ ID NO: 456250 - protein, 9 aa, Homo Sapiens
SLLSSWCAS

SEQ ID NO: 456251 - protein, 9 aa, Homo Sapiens
TYSDPMEIP

SEQ ID NO: 456252 - protein, 9 aa, Homo Sapiens
QHKRAEMVA

SEQ ID NO: 456253 - protein, 9 aa, Homo Sapiens
GWNGIYKGR

SEQ ID NO: 456254 - protein, 9 aa, Homo Sapiens
GTRDILITT

SEQ ID NO: 456255 - protein, 9 aa, Homo Sapiens
HAANMVTAI

SEQ ID NO: 456256 - protein, 9 aa, Homo Sapiens
NIHWVQRKY

SEQ ID NO: 456257 - protein, 9 aa, Homo Sapiens
GPKGSSDDP

SEQ ID NO: 456258 - protein, 9 aa, Homo Sapiens
HSQNVLSTA

SEQ ID NO: 456259 - protein, 9 aa, Homo Sapiens
RCQHKRAEM

SEQ ID NO: 456260 - protein, 9 aa, Homo Sapiens
VCEDSVRIM

SEQ ID NO: 456261 - protein, 9 aa, Homo Sapiens
LVLAYYVQE

SEQ ID NO: 456262 - protein, 9 aa, Homo Sapiens
MTLACSDNR

SEQ ID NO: 456263 - protein, 9 aa, Homo Sapiens
TGCLYLFPT

SEQ ID NO: 456264 - protein, 9 aa, Homo Sapiens
DSHVQNFAL

SEQ ID NO: 456265 - protein, 9 aa, Homo Sapiens
TAARANKEL

SEQ ID NO: 456266 - protein, 9 aa, Homo Sapiens
RNLMANRPT

SEQ ID NO: 456267 - protein, 9 aa, Homo Sapiens
VTMDLGLLF

SEQ ID NO: 456268 - protein, 9 aa, Homo Sapiens
PASSWISSD

SEQ ID NO: 456269 - protein, 9 aa, Homo Sapiens
LPSFLRRPV

SEQ ID NO: 456270 - protein, 9 aa, Homo Sapiens
LKQQYLSIA

SEQ ID NO: 456271 - protein, 9 aa, Homo Sapiens
VDLMLSITS

SEQ ID NO: 456272 - protein, 9 aa, Homo Sapiens
RPQGNSWQV

SEQ ID NO: 456273 - protein, 9 aa, Homo Sapiens
PLTLCTAIS

SEQ ID NO: 456274 - protein, 9 aa, Homo Sapiens
KGLTVKIGD

SEQ ID NO: 456275 - protein, 9 aa, Homo Sapiens
HGQLFQNMT

SEQ ID NO: 456276 - protein, 9 aa, Homo Sapiens
NCTPLTLCT

SEQ ID NO: 456277 - protein, 9 aa, Homo Sapiens
IRGLQEKHL

SEQ ID NO: 456278 - protein, 9 aa, Homo Sapiens
MPEELHAIL

SEQ ID NO: 456279 - protein, 9 aa, Homo Sapiens
LQEVNKMVL

SEQ ID NO: 456280 - protein, 9 aa, Homo Sapiens
PVLPSAVQT

SEQ ID NO: 456281 - protein, 9 aa, Homo Sapiens
ITQLPQEPP

SEQ ID NO: 456282 - protein, 9 aa, Homo Sapiens
EKMKTNRSA

SEQ ID NO: 456283 - protein, 9 aa, Homo Sapiens
KGGLGQARR

SEQ ID NO: 456284 - protein, 9 aa, Homo Sapiens
RDAKEKRFK

SEQ ID NO: 456285 - protein, 9 aa, Homo Sapiens
LQTPSFWWR

SEQ ID NO: 456286 - protein, 9 aa, Homo Sapiens
NIRTQPQRH

SEQ ID NO: 456287 - protein, 9 aa, Homo Sapiens
GIPGLERVP

SEQ ID NO: 456288 - protein, 9 aa, Homo Sapiens
KLDPQNSEV

SEQ ID NO: 456289 - protein, 9 aa, Homo Sapiens
KRFLERGIC

SEQ ID NO: 456290 - protein, 9 aa, Homo Sapiens
CHQGGECDL

SEQ ID NO: 456291 - protein, 9 aa, Homo Sapiens
SLQEVNKMV

SEQ ID NO: 456292 - protein, 9 aa, Homo Sapiens
HIAGLCHDL

SEQ ID NO: 456293 - protein, 9 aa, Homo Sapiens
SSQWPTPTR

SEQ ID NO: 456294 - protein, 9 aa, Homo Sapiens
IDFKYSSYN

SEQ ID NO: 456295 - protein, 9 aa, Homo Sapiens
STIIPSSNN

SEQ ID NO: 456296 - protein, 9 aa, Homo Sapiens
KCKRYIPSY

SEQ ID NO: 456297 - protein, 9 aa, Homo Sapiens
VLTLVEIGI

SEQ ID NO: 456298 - protein, 9 aa, Homo Sapiens
TVIRCGELG

SEQ ID NO: 456299 - protein, 9 aa, Homo Sapiens
ILNSNWFPA

SEQ ID NO: 456300 - protein, 9 aa, Homo Sapiens
GIKEGKPHL

SEQ ID NO: 456301 - protein, 9 aa, Homo Sapiens
AEFFQDLDI

SEQ ID NO: 456302 - protein, 9 aa, Homo Sapiens
KDTSGNCSA

SEQ ID NO: 456303 - protein, 9 aa, Homo Sapiens
LISAHHPEV

SEQ ID NO: 456304 - protein, 9 aa, Homo Sapiens
STCVSHIAV

SEQ ID NO: 456305 - protein, 9 aa, Homo Sapiens
GQHVQKLSK

SEQ ID NO: 456306 - protein, 9 aa, Homo Sapiens
NKNEVHVAR

SEQ ID NO: 456307 - protein, 9 aa, Homo Sapiens
RKGGLGQAR

SEQ ID NO: 456308 - protein, 9 aa, Homo Sapiens
KKEREDIKK

SEQ ID NO: 456309 - protein, 9 aa, Homo Sapiens
MVLVFALTQ

SEQ ID NO: 456310 - protein, 9 aa, Homo Sapiens
HRLLRKGGL

SEQ ID NO: 456311 - protein, 9 aa, Homo Sapiens
LSSSRYLHT

SEQ ID NO: 456312 - protein, 9 aa, Homo Sapiens
YAVSYLFEA

SEQ ID NO: 456313 - protein, 9 aa, Homo Sapiens
DDNKNEVHV

SEQ ID NO: 456314 - protein, 9 aa, Homo Sapiens
KFLSVFLGL

SEQ ID NO: 456315 - protein, 9 aa, Homo Sapiens
WQYSQREVD

SEQ ID NO: 456316 - protein, 9 aa, Homo Sapiens
QGNVSLCET

SEQ ID NO: 456317 - protein, 9 aa, Homo Sapiens
DKRPEEIMQ

SEQ ID NO: 456318 - protein, 9 aa, Homo Sapiens
EFPVSDYFF

SEQ ID NO: 456319 - protein, 9 aa, Homo Sapiens
ENRLYDAMT

SEQ ID NO: 456320 - protein, 9 aa, Homo Sapiens
TTNTSNPRY

SEQ ID NO: 456321 - protein, 9 aa, Homo Sapiens
FKSQDADSP

SEQ ID NO: 456322 - protein, 9 aa, Homo Sapiens
ASSWISSDC

SEQ ID NO: 456323 - protein, 9 aa, Homo Sapiens
WTWPLLTRH

SEQ ID NO: 456324 - protein, 9 aa, Homo Sapiens
EAKQFVSEN

SEQ ID NO: 456325 - protein, 9 aa, Homo Sapiens
HELSASGAG

SEQ ID NO: 456326 - protein, 9 aa, Homo Sapiens
NKMVLVFAL

SEQ ID NO: 456327 - protein, 9 aa, Homo Sapiens
CALSGSLLS

SEQ ID NO: 456328 - protein, 9 aa, Homo Sapiens
TQAPSQIYG

SEQ ID NO: 456329 - protein, 9 aa, Homo Sapiens
GQLQRRVVK

SEQ ID NO: 456330 - protein, 9 aa, Homo Sapiens
AEVMVLELP

SEQ ID NO: 456331 - protein, 9 aa, Homo Sapiens
GTLRVPMNG

SEQ ID NO: 456332 - protein, 9 aa, Homo Sapiens
SHQNLWVDD

SEQ ID NO: 456333 - protein, 9 aa, Homo Sapiens
MQSRTKERC

SEQ ID NO: 456334 - protein, 9 aa, Homo Sapiens
RLHSQNVLS

SEQ ID NO: 456335 - protein, 9 aa, Homo Sapiens
KEKTQIPLQ

SEQ ID NO: 456336 - protein, 9 aa, Homo Sapiens
FMPEELHAI

SEQ ID NO: 456337 - protein, 9 aa, Homo Sapiens
GHSLGACLG

SEQ ID NO: 456338 - protein, 9 aa, Homo Sapiens
QLDSAENQN

SEQ ID NO: 456339 - protein, 9 aa, Homo Sapiens
AQPRGSRWW

SEQ ID NO: 456340 - protein, 9 aa, Homo Sapiens
VFRTIDMSF

SEQ ID NO: 456341 - protein, 9 aa, Homo Sapiens
DEAVVQFSK

SEQ ID NO: 456342 - protein, 9 aa, Homo Sapiens
ALYPKPFKP

SEQ ID NO: 456343 - protein, 9 aa, Homo Sapiens
GEKVMSHSS

SEQ ID NO: 456344 - protein, 9 aa, Homo Sapiens
AAHRVGTLQ

SEQ ID NO: 456345 - protein, 9 aa, Homo Sapiens
KPFKPEGKA

SEQ ID NO: 456346 - protein, 9 aa, Homo Sapiens
NYSDVLDPT

SEQ ID NO: 456347 - protein, 9 aa, Homo Sapiens
EVMVLELPS

SEQ ID NO: 456348 - protein, 9 aa, Homo Sapiens
VSVKELDLV

SEQ ID NO: 456349 - protein, 9 aa, Homo Sapiens
TYTDGNWYR

SEQ ID NO: 456350 - protein, 9 aa, Homo Sapiens
SDKPDMADI

SEQ ID NO: 456351 - protein, 9 aa, Homo Sapiens
QDGSSQWPT

SEQ ID NO: 456352 - protein, 9 aa, Homo Sapiens
GSSSVLLGA

SEQ ID NO: 456353 - protein, 9 aa, Homo Sapiens
MANYSDVLD

SEQ ID NO: 456354 - protein, 9 aa, Homo Sapiens
SHDMTEREL

SEQ ID NO: 456355 - protein, 9 aa, Homo Sapiens
MPLIQSILT

SEQ ID NO: 456356 - protein, 9 aa, Homo Sapiens
HDMTERELR

SEQ ID NO: 456357 - protein, 9 aa, Homo Sapiens
KVCEDSVRI

SEQ ID NO: 456358 - protein, 9 aa, Homo Sapiens
DTMVEPYNA

SEQ ID NO: 456359 - protein, 9 aa, Homo Sapiens
QTTNTSNPR

SEQ ID NO: 456360 - protein, 9 aa, Homo Sapiens
QSCFCCYEE

SEQ ID NO: 456361 - protein, 9 aa, Homo Sapiens
PDMADIEKF

SEQ ID NO: 456362 - protein, 9 aa, Homo Sapiens
MTERELRTL

SEQ ID NO: 456363 - protein, 9 aa, Homo Sapiens
ARRCTWRRC

SEQ ID NO: 456364 - protein, 9 aa, Homo Sapiens
SERDVLCVH

SEQ ID NO: 456365 - protein, 9 aa, Homo Sapiens
SPESLPEAY

SEQ ID NO: 456366 - protein, 9 aa, Homo Sapiens
KSENVHVIK

SEQ ID NO: 456367 - protein, 9 aa, Homo Sapiens
ILITMETAM

SEQ ID NO: 456368 - protein, 9 aa, Homo Sapiens
HYKCYECGK

SEQ ID NO: 456369 - protein, 9 aa, Homo Sapiens
YGVQEENDS

SEQ ID NO: 456370 - protein, 9 aa, Homo Sapiens
LLEDSYICN

SEQ ID NO: 456371 - protein, 9 aa, Homo Sapiens
GGLIQVGHS

SEQ ID NO: 456372 - protein, 9 aa, Homo Sapiens
ALKYIPDKP

SEQ ID NO: 456373 - protein, 9 aa, Homo Sapiens
VQTFSGTAS

SEQ ID NO: 456374 - protein, 9 aa, Homo Sapiens
GFDQFQLDS

SEQ ID NO: 456375 - protein, 9 aa, Homo Sapiens
VWLSVYSRL

SEQ ID NO: 456376 - protein, 9 aa, Homo Sapiens
ERCVFLFEQ

SEQ ID NO: 456377 - protein, 9 aa, Homo Sapiens
LQFNELGAN

SEQ ID NO: 456378 - protein, 9 aa, Homo Sapiens
SQTTTKGPD

SEQ ID NO: 456379 - protein, 9 aa, Homo Sapiens
AGADVKALS

SEQ ID NO: 456380 - protein, 9 aa, Homo Sapiens
AYLFAEFFQ

SEQ ID NO: 456381 - protein, 9 aa, Homo Sapiens
FGFRTTEPN

SEQ ID NO: 456382 - protein, 9 aa, Homo Sapiens
LLLVVRRRQ

SEQ ID NO: 456383 - protein, 9 aa, Homo Sapiens
MEMDVTKPD

SEQ ID NO: 456384 - protein, 9 aa, Homo Sapiens
ESSVTHEAR

SEQ ID NO: 456385 - protein, 9 aa, Homo Sapiens
SPEPSNESV

SEQ ID NO: 456386 - protein, 9 aa, Homo Sapiens
QFQVPIGVF

SEQ ID NO: 456387 - protein, 9 aa, Homo Sapiens
PLVSATEVP

SEQ ID NO: 456388 - protein, 9 aa, Homo Sapiens
KTNRSALLS

SEQ ID NO: 456389 - protein, 9 aa, Homo Sapiens
SGCFKLNKK

SEQ ID NO: 456390 - protein, 9 aa, Homo Sapiens
SGSAMQDGL

SEQ ID NO: 456391 - protein, 9 aa, Homo Sapiens
VYMCHGVPP

SEQ ID NO: 456392 - protein, 9 aa, Homo Sapiens
SSEPYFFRR

SEQ ID NO: 456393 - protein, 9 aa, Homo Sapiens
IYKGRKGMG

SEQ ID NO: 456394 - protein, 9 aa, Homo Sapiens
QGIQHLLRA

SEQ ID NO: 456395 - protein, 9 aa, Homo Sapiens
TLRVPMNGF

SEQ ID NO: 456396 - protein, 9 aa, Homo Sapiens
DRVVTMDLG

SEQ ID NO: 456397 - protein, 9 aa, Homo Sapiens
GVARGLRET

SEQ ID NO: 456398 - protein, 9 aa, Homo Sapiens
DIQENLLQA

SEQ ID NO: 456399 - protein, 9 aa, Homo Sapiens
SAKDLCSTS

SEQ ID NO: 456400 - protein, 9 aa, Homo Sapiens
GTLYPFSRS

SEQ ID NO: 456401 - protein, 9 aa, Homo Sapiens
VMLGHSHDM

SEQ ID NO: 456402 - protein, 9 aa, Homo Sapiens
AQISMEMDV

SEQ ID NO: 456403 - protein, 9 aa, Homo Sapiens
VHIAGLCHD

SEQ ID NO: 456404 - protein, 9 aa, Homo Sapiens
NRPTKYKDA

SEQ ID NO: 456405 - protein, 9 aa, Homo Sapiens
KIHYTVTCG

SEQ ID NO: 456406 - protein, 9 aa, Homo Sapiens
CVFLFEQIV

SEQ ID NO: 456407 - protein, 9 aa, Homo Sapiens
KAAAQKTGC

SEQ ID NO: 456408 - protein, 9 aa, Homo Sapiens
HQQSHTGEK

SEQ ID NO: 456409 - protein, 9 aa, Homo Sapiens
VKKRPRPPP

SEQ ID NO: 456410 - protein, 9 aa, Homo Sapiens
ILDEAIHEA

SEQ ID NO: 456411 - protein, 9 aa, Homo Sapiens
CVHIAGLCH

SEQ ID NO: 456412 - protein, 9 aa, Homo Sapiens
RKGMGGWEG

SEQ ID NO: 456413 - protein, 9 aa, Homo Sapiens
EEKKCKRYI

SEQ ID NO: 456414 - protein, 9 aa, Homo Sapiens
TIPSAVSTG

SEQ ID NO: 456415 - protein, 9 aa, Homo Sapiens
IQDINENEP

SEQ ID NO: 456416 - protein, 9 aa, Homo Sapiens
KQRMSNVAQ

SEQ ID NO: 456417 - protein, 9 aa, Homo Sapiens
FGAPQMAKG

SEQ ID NO: 456418 - protein, 9 aa, Homo Sapiens
FHGVFRTID

SEQ ID NO: 456419 - protein, 9 aa, Homo Sapiens
KVSEVVEQF

SEQ ID NO: 456420 - protein, 9 aa, Homo Sapiens
ICRTLNGIR

SEQ ID NO: 456421 - protein, 9 aa, Homo Sapiens
RNKEVTGAF

SEQ ID NO: 456422 - protein, 9 aa, Homo Sapiens
FLERGICRY

SEQ ID NO: 456423 - protein, 9 aa, Homo Sapiens
KELDLVLAY

SEQ ID NO: 456424 - protein, 9 aa, Homo Sapiens
INQFQVPIG

SEQ ID NO: 456425 - protein, 9 aa, Homo Sapiens
RGIYFPLAM

SEQ ID NO: 456426 - protein, 9 aa, Homo Sapiens
FLLKFLSVF

SEQ ID NO: 456427 - protein, 9 aa, Homo Sapiens
NNLTMNCFE

SEQ ID NO: 456428 - protein, 9 aa, Homo Sapiens
KKKEREDIK

SEQ ID NO: 456429 - protein, 9 aa, Homo Sapiens
LLSSWCASP

SEQ ID NO: 456430 - protein, 9 aa, Homo Sapiens
MQDGLSPNH

SEQ ID NO: 456431 - protein, 9 aa, Homo Sapiens
FQDLDIVPS

SEQ ID NO: 456432 - protein, 9 aa, Homo Sapiens
IRKRDSIAP

SEQ ID NO: 456433 - protein, 9 aa, Homo Sapiens
SRESAPVRA

SEQ ID NO: 456434 - protein, 9 aa, Homo Sapiens
STDSQKDMI

SEQ ID NO: 456435 - protein, 9 aa, Homo Sapiens
AASPASSWI

SEQ ID NO: 456436 - protein, 9 aa, Homo Sapiens
SNVAQFDSD

SEQ ID NO: 456437 - protein, 9 aa, Homo Sapiens
LAATICRTL

SEQ ID NO: 456438 - protein, 9 aa, Homo Sapiens
SDSSQTTTK

SEQ ID NO: 456439 - protein, 9 aa, Homo Sapiens
VPIYAVSYL

SEQ ID NO: 456440 - protein, 9 aa, Homo Sapiens
FSWVKNGRP

SEQ ID NO: 456441 - protein, 9 aa, Homo Sapiens
VLSTALRGD

SEQ ID NO: 456442 - protein, 9 aa, Homo Sapiens
ASRNKPGAA

SEQ ID NO: 456443 - protein, 9 aa, Homo Sapiens
GSSQWPTPT

SEQ ID NO: 456444 - protein, 9 aa, Homo Sapiens
PKPQPCVMP

SEQ ID NO: 456445 - protein, 9 aa, Homo Sapiens
FFHHLLQIT

SEQ ID NO: 456446 - protein, 9 aa, Homo Sapiens
EVSAYSHCC

SEQ ID NO: 456447 - protein, 9 aa, Homo Sapiens
VGPKKCHES

SEQ ID NO: 456448 - protein, 9 aa, Homo Sapiens
ELDVGTLYP

SEQ ID NO: 456449 - protein, 9 aa, Homo Sapiens
CMICGKVFR

SEQ ID NO: 456450 - protein, 9 aa, Homo Sapiens
QLPQEPPQM

SEQ ID NO: 456451 - protein, 9 aa, Homo Sapiens
VVPIYAVSY

SEQ ID NO: 456452 - protein, 9 aa, Homo Sapiens
EIRNETSGL

SEQ ID NO: 456453 - protein, 9 aa, Homo Sapiens
LNLPSKVVR

SEQ ID NO: 456454 - protein, 9 aa, Homo Sapiens
GAPSLQTPS

SEQ ID NO: 456455 - protein, 9 aa, Homo Sapiens
HMFIHTGEK

SEQ ID NO: 456456 - protein, 9 aa, Homo Sapiens
SYFGTEKLK

SEQ ID NO: 456457 - protein, 9 aa, Homo Sapiens
RWKLHLAER

SEQ ID NO: 456458 - protein, 9 aa, Homo Sapiens
LYHQAEPLA

SEQ ID NO: 456459 - protein, 9 aa, Homo Sapiens
YIVIQVKCL

SEQ ID NO: 456460 - protein, 9 aa, Homo Sapiens
ENSWESESP

SEQ ID NO: 456461 - protein, 9 aa, Homo Sapiens
EREDIKKKS

SEQ ID NO: 456462 - protein, 9 aa, Homo Sapiens
LQAQPDSIV

SEQ ID NO: 456463 - protein, 9 aa, Homo Sapiens
GDSSTDSQK

SEQ ID NO: 456464 - protein, 9 aa, Homo Sapiens
EDGFHGVFR

SEQ ID NO: 456465 - protein, 9 aa, Homo Sapiens
GTGGSSSVL

SEQ ID NO: 456466 - protein, 9 aa, Homo Sapiens
ENTFLLKFL

SEQ ID NO: 456467 - protein, 9 aa, Homo Sapiens
VTEVSAYSH

SEQ ID NO: 456468 - protein, 9 aa, Homo Sapiens
RHRPFSPGK

SEQ ID NO: 456469 - protein, 9 aa, Homo Sapiens
IEFQGGDHS

SEQ ID NO: 456470 - protein, 9 aa, Homo Sapiens
FLLSGSCPS

SEQ ID NO: 456471 - protein, 9 aa, Homo Sapiens
AGSSWGSAD

SEQ ID NO: 456472 - protein, 9 aa, Homo Sapiens
AGVFFLRCT

SEQ ID NO: 456473 - protein, 9 aa, Homo Sapiens
VQIVEREMA

SEQ ID NO: 456474 - protein, 9 aa, Homo Sapiens
PEEATAARA

SEQ ID NO: 456475 - protein, 9 aa, Homo Sapiens
QYLISAHHP

SEQ ID NO: 456476 - protein, 9 aa, Homo Sapiens
DSGPEGARV

SEQ ID NO: 456477 - protein, 9 aa, Homo Sapiens
VSAPVSTII

SEQ ID NO: 456478 - protein, 9 aa, Homo Sapiens
RLLEDSYIC

SEQ ID NO: 456479 - protein, 9 aa, Homo Sapiens
SVLLGAPSL

SEQ ID NO: 456480 - protein, 9 aa, Homo Sapiens
QNLLGFMPE

SEQ ID NO: 456481 - protein, 9 aa, Homo Sapiens
CASPFQSAW

SEQ ID NO: 456482 - protein, 9 aa, Homo Sapiens
CLGEDPTGV

SEQ ID NO: 456483 - protein, 9 aa, Homo Sapiens
IFLHKGLTV

SEQ ID NO: 456484 - protein, 9 aa, Homo Sapiens
DTSGNCSAS

SEQ ID NO: 456485 - protein, 9 aa, Homo Sapiens
KMKLDPQNS

SEQ ID NO: 456486 - protein, 9 aa, Homo Sapiens
TGRGTYSDP

SEQ ID NO: 456487 - protein, 9 aa, Homo Sapiens
TCGLFMRNP

SEQ ID NO: 456488 - protein, 9 aa, Homo Sapiens
PALASRPSS

SEQ ID NO: 456489 - protein, 9 aa, Homo Sapiens
QTFSGTASS

SEQ ID NO: 456490 - protein, 9 aa, Homo Sapiens
SIKSDRLSP

SEQ ID NO: 456491 - protein, 9 aa, Homo Sapiens
AMTYVYNRG

SEQ ID NO: 456492 - protein, 9 aa, Homo Sapiens
QKLMLIDFK

SEQ ID NO: 456493 - protein, 9 aa, Homo Sapiens
LSVFLGLIF

SEQ ID NO: 456494 - protein, 9 aa, Homo Sapiens
YDEAVVQFS

SEQ ID NO: 456495 - protein, 9 aa, Homo Sapiens
APKSIKVEA

SEQ ID NO: 456496 - protein, 9 aa, Homo Sapiens
ASFGAPQMA

SEQ ID NO: 456497 - protein, 9 aa, Homo Sapiens
WVKNGRPLR

SEQ ID NO: 456498 - protein, 9 aa, Homo Sapiens
TSGLEVLTS

SEQ ID NO: 456499 - protein, 9 aa, Homo Sapiens
DHSNKAMYV

SEQ ID NO: 456500 - protein, 9 aa, Homo Sapiens
DKRCQHKRA

SEQ ID NO: 456501 - protein, 9 aa, Homo Sapiens
QEPPQMMAA

SEQ ID NO: 456502 - protein, 9 aa, Homo Sapiens
SAVQTFSGT

SEQ ID NO: 456503 - protein, 9 aa, Homo Sapiens
QKLSKCASC

SEQ ID NO: 456504 - protein, 9 aa, Homo Sapiens
HLHNVLVFA

SEQ ID NO: 456505 - protein, 9 aa, Homo Sapiens
KKSRKDTSG

SEQ ID NO: 456506 - protein, 9 aa, Homo Sapiens
NSPESLPEA

SEQ ID NO: 456507 - protein, 9 aa, Homo Sapiens
FLFTIFILV

SEQ ID NO: 456508 - protein, 9 aa, Homo Sapiens
NSQYDEAVV

SEQ ID NO: 456509 - protein, 9 aa, Homo Sapiens
IHYTVTCGL

SEQ ID NO: 456510 - protein, 9 aa, Homo Sapiens
RGEKVMSHS

SEQ ID NO: 456511 - protein, 9 aa, Homo Sapiens
IRTQPQRHF

SEQ ID NO: 456512 - protein, 9 aa, Homo Sapiens
ASGCFKLNK

SEQ ID NO: 456513 - protein, 9 aa, Homo Sapiens
PKPFKPEGK

SEQ ID NO: 456514 - protein, 9 aa, Homo Sapiens
AKQFVSENE

SEQ ID NO: 456515 - protein, 9 aa, Homo Sapiens
IIPKVLAQK

SEQ ID NO: 456516 - protein, 9 aa, Homo Sapiens
PRYRLIGQW

SEQ ID NO: 456517 - protein, 9 aa, Homo Sapiens
VIRCGELGL

SEQ ID NO: 456518 - protein, 9 aa, Homo Sapiens
SGIVIGDRS

SEQ ID NO: 456519 - protein, 9 aa, Homo Sapiens
LLNIHWVQR

SEQ ID NO: 456520 - protein, 9 aa, Homo Sapiens
SKVVRIAPV

SEQ ID NO: 456521 - protein, 9 aa, Homo Sapiens
LEAQPTDMW

SEQ ID NO: 456522 - protein, 9 aa, Homo Sapiens
LHQDVMTLA

SEQ ID NO: 456523 - protein, 9 aa, Homo Sapiens
LPVTIPSAV

SEQ ID NO: 456524 - protein, 9 aa, Homo Sapiens
SAEELPGLK

SEQ ID NO: 456525 - protein, 9 aa, Homo Sapiens
ILGLPHRHR

SEQ ID NO: 456526 - protein, 9 aa, Homo Sapiens
FRTIDMSFL

SEQ ID NO: 456527 - protein, 9 aa, Homo Sapiens
SISFGFRTT

SEQ ID NO: 456528 - protein, 9 aa, Homo Sapiens
PTVIRCGEL

SEQ ID NO: 456529 - protein, 9 aa, Homo Sapiens
QKTGCLYLF

SEQ ID NO: 456530 - protein, 9 aa, Homo Sapiens
VVVNSGIVI

SEQ ID NO: 456531 - protein, 9 aa, Homo Sapiens
RHTLDGATM

SEQ ID NO: 456532 - protein, 9 aa, Homo Sapiens
AILDKLHIL

SEQ ID NO: 456533 - protein, 9 aa, Homo Sapiens
HYTVTCGLF

SEQ ID NO: 456534 - protein, 9 aa, Homo Sapiens
KLSKCASCL

SEQ ID NO: 456535 - protein, 9 aa, Homo Sapiens
VASLLGLVS

SEQ ID NO: 456536 - protein, 9 aa, Homo Sapiens
KTGCLYLFP

SEQ ID NO: 456537 - protein, 9 aa, Homo Sapiens
KMVLVFALT

SEQ ID NO: 456538 - protein, 9 aa, Homo Sapiens
LDENQDVSM

SEQ ID NO: 456539 - protein, 9 aa, Homo Sapiens
REMRAGGCC

SEQ ID NO: 456540 - protein, 9 aa, Homo Sapiens
CAIEQGNVS

SEQ ID NO: 456541 - protein, 9 aa, Homo Sapiens
TRDILITTV

SEQ ID NO: 456542 - protein, 9 aa, Homo Sapiens
GKPHLIPAG

SEQ ID NO: 456543 - protein, 9 aa, Homo Sapiens
GQDGSSQWP

SEQ ID NO: 456544 - protein, 9 aa, Homo Sapiens
PESLPEAYK

SEQ ID NO: 456545 - protein, 9 aa, Homo Sapiens
GELGLVLAS

SEQ ID NO: 456546 - protein, 9 aa, Homo Sapiens
EKGKPGVPG

SEQ ID NO: 456547 - protein, 9 aa, Homo Sapiens
KQHFEKLME

SEQ ID NO: 456548 - protein, 9 aa, Homo Sapiens
VQSWFESSV

SEQ ID NO: 456549 - protein, 9 aa, Homo Sapiens
SALVEGELA

SEQ ID NO: 456550 - protein, 9 aa, Homo Sapiens
QMAKGDAAK

SEQ ID NO: 456551 - protein, 9 aa, Homo Sapiens
PIYAVSYLF

SEQ ID NO: 456552 - protein, 9 aa, Homo Sapiens
ELSASGAGS

SEQ ID NO: 456553 - protein, 9 aa, Homo Sapiens
LPGPKGSSD

SEQ ID NO: 456554 - protein, 9 aa, Homo Sapiens
SRCLFSHDL

SEQ ID NO: 456555 - protein, 9 aa, Homo Sapiens
LGQARRCTW

SEQ ID NO: 456556 - protein, 9 aa, Homo Sapiens
LKKVSEVVE

SEQ ID NO: 456557 - protein, 9 aa, Homo Sapiens
NPGTLCLAT

SEQ ID NO: 456558 - protein, 9 aa, Homo Sapiens
QYSQREVDA

SEQ ID NO: 456559 - protein, 9 aa, Homo Sapiens
LIDFKYSSY

SEQ ID NO: 456560 - protein, 9 aa, Homo Sapiens
NTSNPRYRL

SEQ ID NO: 456561 - protein, 9 aa, Homo Sapiens
KVMSHSSLN

SEQ ID NO: 456562 - protein, 9 aa, Homo Sapiens
KQEHDIIKE

SEQ ID NO: 456563 - protein, 9 aa, Homo Sapiens
KRCQHKRAE

SEQ ID NO: 456564 - protein, 9 aa, Homo Sapiens
GRSPVVFFD

SEQ ID NO: 456565 - protein, 9 aa, Homo Sapiens
RGICRYGAQ

SEQ ID NO: 456566 - protein, 9 aa, Homo Sapiens
SRLSSSRYL

SEQ ID NO: 456567 - protein, 9 aa, Homo Sapiens
VAPLVSATE

SEQ ID NO: 456568 - protein, 9 aa, Homo Sapiens
FDQFQLDSA

SEQ ID NO: 456569 - protein, 9 aa, Homo Sapiens
NTQAPSQIY

SEQ ID NO: 456570 - protein, 9 aa, Homo Sapiens
GVFLDLSSL

SEQ ID NO: 456571 - protein, 9 aa, Homo Sapiens
EVLNLMGVY

SEQ ID NO: 456572 - protein, 9 aa, Homo Sapiens
GSLLSSWCA

SEQ ID NO: 456573 - protein, 9 aa, Homo Sapiens
IQYAQISME

SEQ ID NO: 456574 - protein, 9 aa, Homo Sapiens
VTNHGQLFQ

SEQ ID NO: 456575 - protein, 9 aa, Homo Sapiens
VKALSCGEV

SEQ ID NO: 456576 - protein, 9 aa, Homo Sapiens
SGEEHVLVP

SEQ ID NO: 456577 - protein, 9 aa, Homo Sapiens
RNETSGLEV

SEQ ID NO: 456578 - protein, 9 aa, Homo Sapiens
VVASLLGLV

SEQ ID NO: 456579 - protein, 9 aa, Homo Sapiens
HKRAEMVAL

SEQ ID NO: 456580 - protein, 9 aa, Homo Sapiens
ELKKNTPWT

SEQ ID NO: 456581 - protein, 9 aa, Homo Sapiens
MRHFAVDAA

SEQ ID NO: 456582 - protein, 9 aa, Homo Sapiens
DSIAPVSPT

SEQ ID NO: 456583 - protein, 9 aa, Homo Sapiens
HGVCREGSR

SEQ ID NO: 456584 - protein, 9 aa, Homo Sapiens
ITFNYGNSS

SEQ ID NO: 456585 - protein, 9 aa, Homo Sapiens
HRISFYADD

SEQ ID NO: 456586 - protein, 9 aa, Homo Sapiens
SETKKKERE

SEQ ID NO: 456587 - protein, 9 aa, Homo Sapiens
ADIEKFDKS

SEQ ID NO: 456588 - protein, 9 aa, Homo Sapiens
PHEGRTNLT

SEQ ID NO: 456589 - protein, 9 aa, Homo Sapiens
LTTPEASGV

SEQ ID NO: 456590 - protein, 9 aa, Homo Sapiens
QVGPKKCHE

SEQ ID NO: 456591 - protein, 9 aa, Homo Sapiens
KCHESLRPE

SEQ ID NO: 456592 - protein, 9 aa, Homo Sapiens
VMTLACSDN

SEQ ID NO: 456593 - protein, 9 aa, Homo Sapiens
YDNGTRDIL

SEQ ID NO: 456594 - protein, 9 aa, Homo Sapiens
TNTSNPRYR

SEQ ID NO: 456595 - protein, 9 aa, Homo Sapiens
LLKEQGISA

SEQ ID NO: 456596 - protein, 9 aa, Homo Sapiens
IPSSNNPHR

SEQ ID NO: 456597 - protein, 9 aa, Homo Sapiens
RFLERGICR

SEQ ID NO: 456598 - protein, 9 aa, Homo Sapiens
LKMQIQVLL

SEQ ID NO: 456599 - protein, 9 aa, Homo Sapiens
STSSVVSPS

SEQ ID NO: 456600 - protein, 9 aa, Homo Sapiens
PPVSIKSDR

SEQ ID NO: 456601 - protein, 9 aa, Homo Sapiens
LHLAERADF

SEQ ID NO: 456602 - protein, 9 aa, Homo Sapiens
PVKALKYIP

SEQ ID NO: 456603 - protein, 9 aa, Homo Sapiens
VGTLQVGDR

SEQ ID NO: 456604 - protein, 9 aa, Homo Sapiens
LRHAFQNLE

SEQ ID NO: 456605 - protein, 9 aa, Homo Sapiens
NVAQFDSDF

SEQ ID NO: 456606 - protein, 9 aa, Homo Sapiens
IPGWTWPLL

SEQ ID NO: 456607 - protein, 9 aa, Homo Sapiens
VVQFSKSIE

SEQ ID NO: 456608 - protein, 9 aa, Homo Sapiens
FYALGVYMC

SEQ ID NO: 456609 - protein, 9 aa, Homo Sapiens
GLVWLLKEQ

SEQ ID NO: 456610 - protein, 9 aa, Homo Sapiens
GIGRTGILI

SEQ ID NO: 456611 - protein, 9 aa, Homo Sapiens
CASPPALAS

SEQ ID NO: 456612 - protein, 9 aa, Homo Sapiens
PKVLAQKSG

SEQ ID NO: 456613 - protein, 9 aa, Homo Sapiens
VFFDFHGHS

SEQ ID NO: 456614 - protein, 9 aa, Homo Sapiens
SFCNSNIVH

SEQ ID NO: 456615 - protein, 9 aa, Homo Sapiens
ASGAGSSWG

SEQ ID NO: 456616 - protein, 9 aa, Homo Sapiens
GIYFPLAME

SEQ ID NO: 456617 - protein, 9 aa, Homo Sapiens
YRKVCEDSV

SEQ ID NO: 456618 - protein, 9 aa, Homo Sapiens
PPPARPKKS

SEQ ID NO: 456619 - protein, 9 aa, Homo Sapiens
VVRIAPVPI

SEQ ID NO: 456620 - protein, 9 aa, Homo Sapiens
GVQEENDSH

SEQ ID NO: 456621 - protein, 9 aa, Homo Sapiens
RNIQVTNHG

SEQ ID NO: 456622 - protein, 9 aa, Homo Sapiens
PRGSRWWLR

SEQ ID NO: 456623 - protein, 9 aa, Homo Sapiens
FLTQAVIRG

SEQ ID NO: 456624 - protein, 9 aa, Homo Sapiens
GSAMQDGLS

SEQ ID NO: 456625 - protein, 9 aa, Homo Sapiens
HFAVDAAAT

SEQ ID NO: 456626 - protein, 9 aa, Homo Sapiens
PSAVQTFSG

SEQ ID NO: 456627 - protein, 9 aa, Homo Sapiens
PLIQSILTT

SEQ ID NO: 456628 - protein, 9 aa, Homo Sapiens
GGNPDLRVL

SEQ ID NO: 456629 - protein, 9 aa, Homo Sapiens
SNVSSEEQA

SEQ ID NO: 456630 - protein, 9 aa, Homo Sapiens
EPPQMMAAA

SEQ ID NO: 456631 - protein, 9 aa, Homo Sapiens
LLGLVSLGG

SEQ ID NO: 456632 - protein, 9 aa, Homo Sapiens
PVRQRKGRN

SEQ ID NO: 456633 - protein, 9 aa, Homo Sapiens
QKSGFDLQE

SEQ ID NO: 456634 - protein, 9 aa, Homo Sapiens
YNAHAANMV

SEQ ID NO: 456635 - protein, 9 aa, Homo Sapiens
EGSRCLFSH

SEQ ID NO: 456636 - protein, 9 aa, Homo Sapiens
RCLKKVSEV

SEQ ID NO: 456637 - protein, 9 aa, Homo Sapiens
TLCKRFLER

SEQ ID NO: 456638 - protein, 9 aa, Homo Sapiens
EALYPKPFK

SEQ ID NO: 456639 - protein, 9 aa, Homo Sapiens
VSDTMVEPY

SEQ ID NO: 456640 - protein, 9 aa, Homo Sapiens
TWPLLTRHT

SEQ ID NO: 456641 - protein, 9 aa, Homo Sapiens
KEQGISAAV

SEQ ID NO: 456642 - protein, 9 aa, Homo Sapiens
LGLVAPLVS

SEQ ID NO: 456643 - protein, 9 aa, Homo Sapiens
ERVPVWISL

SEQ ID NO: 456644 - protein, 9 aa, Homo Sapiens
EATAARAID

SEQ ID NO: 456645 - protein, 9 aa, Homo Sapiens
EFSPENLRF

SEQ ID NO: 456646 - protein, 9 aa, Homo Sapiens
NTPWTPWTP

SEQ ID NO: 456647 - protein, 9 aa, Homo Sapiens
AEVPQEAPG

SEQ ID NO: 456648 - protein, 9 aa, Homo Sapiens
GSRCLFSHD

SEQ ID NO: 456649 - protein, 9 aa, Homo Sapiens
PYSGSAMQD

SEQ ID NO: 456650 - protein, 9 aa, Homo Sapiens
LLRKGGLGQ

SEQ ID NO: 456651 - protein, 9 aa, Homo Sapiens
ELAEEAAEK

SEQ ID NO: 456652 - protein, 9 aa, Homo Sapiens
GHRNQTIFS

SEQ ID NO: 456653 - protein, 9 aa, Homo Sapiens
LPSKVVRIA

SEQ ID NO: 456654 - protein, 9 aa, Homo Sapiens
RASRNKPGA

SEQ ID NO: 456655 - protein, 9 aa, Homo Sapiens
AGEKGKPGV

SEQ ID NO: 456656 - protein, 9 aa, Homo Sapiens
LGANAVTPM

SEQ ID NO: 456657 - protein, 9 aa, Homo Sapiens
DLQNLLGFM

SEQ ID NO: 456658 - protein, 9 aa, Homo Sapiens
ESEFSPENL

SEQ ID NO: 456659 - protein, 9 aa, Homo Sapiens
TEQLIQAQP

SEQ ID NO: 456660 - protein, 9 aa, Homo Sapiens
QWLDENQDV

SEQ ID NO: 456661 - protein, 9 aa, Homo Sapiens
SREESSEPY

SEQ ID NO: 456662 - protein, 9 aa, Homo Sapiens
SDLLVHQQS

SEQ ID NO: 456663 - protein, 9 aa, Homo Sapiens
LIVIHLKNY

SEQ ID NO: 456664 - protein, 9 aa, Homo Sapiens
CNRHMLTRY

SEQ ID NO: 456665 - protein, 9 aa, Homo Sapiens
NQDVSMEFL

SEQ ID NO: 456666 - protein, 9 aa, Homo Sapiens
NELGANAVT

SEQ ID NO: 456667 - protein, 9 aa, Homo Sapiens
SPVVFFDFH

SEQ ID NO: 456668 - protein, 9 aa, Homo Sapiens
DCPICHQGG

SEQ ID NO: 456669 - protein, 9 aa, Homo Sapiens
RESAPVRAK

SEQ ID NO: 456670 - protein, 9 aa, Homo Sapiens
PSAVSTGHT

SEQ ID NO: 456671 - protein, 9 aa, Homo Sapiens
GPKLSHLHN

SEQ ID NO: 456672 - protein, 9 aa, Homo Sapiens
KYIPDKPVS

SEQ ID NO: 456673 - protein, 9 aa, Homo Sapiens
LPHRHRPFS

SEQ ID NO: 456674 - protein, 9 aa, Homo Sapiens
ILDKLHILN

SEQ ID NO: 456675 - protein, 9 aa, Homo Sapiens
YGDPRKLLN

SEQ ID NO: 456676 - protein, 9 aa, Homo Sapiens
MIRASRNKP

SEQ ID NO: 456677 - protein, 9 aa, Homo Sapiens
VKELDLVLA

SEQ ID NO: 456678 - protein, 9 aa, Homo Sapiens
LRVLTLVEI

SEQ ID NO: 456679 - protein, 9 aa, Homo Sapiens
ESAPVRAKK

SEQ ID NO: 456680 - protein, 9 aa, Homo Sapiens
SEVTDLRHA

SEQ ID NO: 456681 - protein, 9 aa, Homo Sapiens
SFYADDKTD

SEQ ID NO: 456682 - protein, 9 aa, Homo Sapiens
LFTIFILVF

SEQ ID NO: 456683 - protein, 9 aa, Homo Sapiens
FDVNLTYEK

SEQ ID NO: 456684 - protein, 9 aa, Homo Sapiens
FYADDKTDK

SEQ ID NO: 456685 - protein, 9 aa, Homo Sapiens
LLEALYPKP

SEQ ID NO: 456686 - protein, 9 aa, Homo Sapiens
GGAAHRVGT

SEQ ID NO: 456687 - protein, 9 aa, Homo Sapiens
LGLPHRHRP

SEQ ID NO: 456688 - protein, 9 aa, Homo Sapiens
TTKGPDSAV

SEQ ID NO: 456689 - protein, 9 aa, Homo Sapiens
VGKDVMVAP

SEQ ID NO: 456690 - protein, 9 aa, Homo Sapiens
AQKSGFDLQ

SEQ ID NO: 456691 - protein, 9 aa, Homo Sapiens
NVSSEEQAN

SEQ ID NO: 456692 - protein, 9 aa, Homo Sapiens
RVLTLVEIG

SEQ ID NO: 456693 - protein, 9 aa, Homo Sapiens
IGGHSLGAC

SEQ ID NO: 456694 - protein, 9 aa, Homo Sapiens
NVHVIKLNI

SEQ ID NO: 456695 - protein, 9 aa, Homo Sapiens
PPEAARPLF

SEQ ID NO: 456696 - protein, 9 aa, Homo Sapiens
RRFYRGDSS

SEQ ID NO: 456697 - protein, 9 aa, Homo Sapiens
ILTTPEASG

SEQ ID NO: 456698 - protein, 9 aa, Homo Sapiens
TKYKDANIM

SEQ ID NO: 456699 - protein, 9 aa, Homo Sapiens
RLSSSRYLH

SEQ ID NO: 456700 - protein, 9 aa, Homo Sapiens
YYSIPSYHT

SEQ ID NO: 456701 - protein, 9 aa, Homo Sapiens
TDDRVVTMD

SEQ ID NO: 456702 - protein, 9 aa, Homo Sapiens
YDLVKLTLQ

SEQ ID NO: 456703 - protein, 9 aa, Homo Sapiens
LHRISFYAD

SEQ ID NO: 456704 - protein, 9 aa, Homo Sapiens
RQRKGRNTG

SEQ ID NO: 456705 - protein, 9 aa, Homo Sapiens
RVPVWISLP

SEQ ID NO: 456706 - protein, 9 aa, Homo Sapiens
CEDSVRIMD

SEQ ID NO: 456707 - protein, 9 aa, Homo Sapiens
FLSVFLGLI

SEQ ID NO: 456708 - protein, 9 aa, Homo Sapiens
EVKKRPRPP

SEQ ID NO: 456709 - protein, 9 aa, Homo Sapiens
KEGKPHLIP

SEQ ID NO: 456710 - protein, 9 aa, Homo Sapiens
QRRVVKEGD

SEQ ID NO: 456711 - protein, 9 aa, Homo Sapiens
TPLQVGPVS

SEQ ID NO: 456712 - protein, 9 aa, Homo Sapiens
FRRMPVPQQ

SEQ ID NO: 456713 - protein, 9 aa, Homo Sapiens
TTDASGFKQ

SEQ ID NO: 456714 - protein, 9 aa, Homo Sapiens
VPKDRDCEG

SEQ ID NO: 456715 - protein, 9 aa, Homo Sapiens
REDSSFFAK

SEQ ID NO: 456716 - protein, 9 aa, Homo Sapiens
PPFTGVLCT

SEQ ID NO: 456717 - protein, 9 aa, Homo Sapiens
FYEEDIDQI

SEQ ID NO: 456718 - protein, 9 aa, Homo Sapiens
PLQQVGLQD

SEQ ID NO: 456719 - protein, 9 aa, Homo Sapiens
KNTGMFPGF

SEQ ID NO: 456720 - protein, 9 aa, Homo Sapiens
GPMATPSST

SEQ ID NO: 456721 - protein, 9 aa, Homo Sapiens
SHQRASCGI

SEQ ID NO: 456722 - protein, 9 aa, Homo Sapiens
RKRMPRLEE

SEQ ID NO: 456723 - protein, 9 aa, Homo Sapiens
DVSHQDPEV

SEQ ID NO: 456724 - protein, 9 aa, Homo Sapiens
VFVRAQELH

SEQ ID NO: 456725 - protein, 9 aa, Homo Sapiens
HFSVMFPLF

SEQ ID NO: 456726 - protein, 9 aa, Homo Sapiens
GIPVPTIPG

SEQ ID NO: 456727 - protein, 9 aa, Homo Sapiens
AVRALLSLS

SEQ ID NO: 456728 - protein, 9 aa, Homo Sapiens
WQFPLELLT

SEQ ID NO: 456729 - protein, 9 aa, Homo Sapiens
FPGSPQSPP

SEQ ID NO: 456730 - protein, 9 aa, Homo Sapiens
DEGSKFYEE

SEQ ID NO: 456731 - protein, 9 aa, Homo Sapiens
NALSQFIES

SEQ ID NO: 456732 - protein, 9 aa, Homo Sapiens
RDVSSEGTE

SEQ ID NO: 456733 - protein, 9 aa, Homo Sapiens
KHILMENAE

SEQ ID NO: 456734 - protein, 9 aa, Homo Sapiens
KSSEREGTR

SEQ ID NO: 456735 - protein, 9 aa, Homo Sapiens
RELEEGFYS

SEQ ID NO: 456736 - protein, 9 aa, Homo Sapiens
QDPEVKFNW

SEQ ID NO: 456737 - protein, 9 aa, Homo Sapiens
KAESRGSSV

SEQ ID NO: 456738 - protein, 9 aa, Homo Sapiens
KQRKMGLND

SEQ ID NO: 456739 - protein, 9 aa, Homo Sapiens
GSSVHATVL

SEQ ID NO: 456740 - protein, 9 aa, Homo Sapiens
SLPPFSTPL

SEQ ID NO: 456741 - protein, 9 aa, Homo Sapiens
KGGHMDQQR

SEQ ID NO: 456742 - protein, 9 aa, Homo Sapiens
RLQTLMSVN

SEQ ID NO: 456743 - protein, 9 aa, Homo Sapiens
TGTLTANDM

SEQ ID NO: 456744 - protein, 9 aa, Homo Sapiens
RVMYCVLRE

SEQ ID NO: 456745 - protein, 9 aa, Homo Sapiens
PGASGAEGR

SEQ ID NO: 456746 - protein, 9 aa, Homo Sapiens
VARIFNTFR

SEQ ID NO: 456747 - protein, 9 aa, Homo Sapiens
MAVTVTYDG

SEQ ID NO: 456748 - protein, 9 aa, Homo Sapiens
FPVAASSAL

SEQ ID NO: 456749 - protein, 9 aa, Homo Sapiens
FAKIEKKGV

SEQ ID NO: 456750 - protein, 9 aa, Homo Sapiens
PVPEYIKGL

SEQ ID NO: 456751 - protein, 9 aa, Homo Sapiens
TWRTSQRDT

SEQ ID NO: 456752 - protein, 9 aa, Homo Sapiens
GIHRLRKFY

SEQ ID NO: 456753 - protein, 9 aa, Homo Sapiens
EQSSLHLIQ

SEQ ID NO: 456754 - protein, 9 aa, Homo Sapiens
ANFASIVTG

SEQ ID NO: 456755 - protein, 9 aa, Homo Sapiens
NAGFFHTLL

SEQ ID NO: 456756 - protein, 9 aa, Homo Sapiens
LLCGMREMR

SEQ ID NO: 456757 - protein, 9 aa, Homo Sapiens
MPPGVGPYQ

SEQ ID NO: 456758 - protein, 9 aa, Homo Sapiens
HQDPEVKFN

SEQ ID NO: 456759 - protein, 9 aa, Homo Sapiens
IIRLNMNTE

SEQ ID NO: 456760 - protein, 9 aa, Homo Sapiens
EAKQEVSSW

SEQ ID NO: 456761 - protein, 9 aa, Homo Sapiens
ALLVIYLIT

SEQ ID NO: 456762 - protein, 9 aa, Homo Sapiens
QHSDWFFGD

SEQ ID NO: 456763 - protein, 9 aa, Homo Sapiens
PGPGHRMRL

SEQ ID NO: 456764 - protein, 9 aa, Homo Sapiens
DTVNATCQN

SEQ ID NO: 456765 - protein, 9 aa, Homo Sapiens
RMDVSIESV

SEQ ID NO: 456766 - protein, 9 aa, Homo Sapiens
SVALAVRAL

SEQ ID NO: 456767 - protein, 9 aa, Homo Sapiens
IRRDVSSEG

SEQ ID NO: 456768 - protein, 9 aa, Homo Sapiens
TPTPNVHMV

SEQ ID NO: 456769 - protein, 9 aa, Homo Sapiens
RKIIRRDVS

SEQ ID NO: 456770 - protein, 9 aa, Homo Sapiens
AMALVSEGL

SEQ ID NO: 456771 - protein, 9 aa, Homo Sapiens
ATQLASLFQ

SEQ ID NO: 456772 - protein, 9 aa, Homo Sapiens
TFSSVARTW

SEQ ID NO: 456773 - protein, 9 aa, Homo Sapiens
LVVSEETYH

SEQ ID NO: 456774 - protein, 9 aa, Homo Sapiens
NTEHQSAVW

SEQ ID NO: 456775 - protein, 9 aa, Homo Sapiens
LTEGAALNV

SEQ ID NO: 456776 - protein, 9 aa, Homo Sapiens
CLPPGPAPH

SEQ ID NO: 456777 - protein, 9 aa, Homo Sapiens
LLQNHRLWD

SEQ ID NO: 456778 - protein, 9 aa, Homo Sapiens
KKWRKTTDG

SEQ ID NO: 456779 - protein, 9 aa, Homo Sapiens
WDHNIRPGE

SEQ ID NO: 456780 - protein, 9 aa, Homo Sapiens
SSWLENMAY

SEQ ID NO: 456781 - protein, 9 aa, Homo Sapiens
GPPGASGAE

SEQ ID NO: 456782 - protein, 9 aa, Homo Sapiens
PLIILTRDD

SEQ ID NO: 456783 - protein, 9 aa, Homo Sapiens
SCIQKPQGL

SEQ ID NO: 456784 - protein, 9 aa, Homo Sapiens
GPVPQPACL

SEQ ID NO: 456785 - protein, 9 aa, Homo Sapiens
WMPPGVGPY

SEQ ID NO: 456786 - protein, 9 aa, Homo Sapiens
LRELEEGFY

SEQ ID NO: 456787 - protein, 9 aa, Homo Sapiens
VPQPLQQVG

SEQ ID NO: 456788 - protein, 9 aa, Homo Sapiens
NMAVTVTYD

SEQ ID NO: 456789 - protein, 9 aa, Homo Sapiens
HRLWDHNIR

SEQ ID NO: 456790 - protein, 9 aa, Homo Sapiens
WSLICKTCP

SEQ ID NO: 456791 - protein, 9 aa, Homo Sapiens
GLGWSPALS

SEQ ID NO: 456792 - protein, 9 aa, Homo Sapiens
PHPMDHPPA

SEQ ID NO: 456793 - protein, 9 aa, Homo Sapiens
AESRGSSVH

SEQ ID NO: 456794 - protein, 9 aa, Homo Sapiens
GLQKLLSKQ

SEQ ID NO: 456795 - protein, 9 aa, Homo Sapiens
HSDWFFGDE

SEQ ID NO: 456796 - protein, 9 aa, Homo Sapiens
AIGMFSGGN

SEQ ID NO: 456797 - protein, 9 aa, Homo Sapiens
LRTRVKATG

SEQ ID NO: 456798 - protein, 9 aa, Homo Sapiens
IPVPTIPGL

SEQ ID NO: 456799 - protein, 9 aa, Homo Sapiens
GRPLHLLMQ

SEQ ID NO: 456800 - protein, 9 aa, Homo Sapiens
LALLVIYLI

SEQ ID NO: 456801 - protein, 9 aa, Homo Sapiens
QLASLFQEI

SEQ ID NO: 456802 - protein, 9 aa, Homo Sapiens
LEQLQSAGG

SEQ ID NO: 456803 - protein, 9 aa, Homo Sapiens
SPVSTYHVQ

SEQ ID NO: 456804 - protein, 9 aa, Homo Sapiens
FSTPLQVGP

SEQ ID NO: 456805 - protein, 9 aa, Homo Sapiens
QGEAERAEA

SEQ ID NO: 456806 - protein, 9 aa, Homo Sapiens
PKEEEKWSL

SEQ ID NO: 456807 - protein, 9 aa, Homo Sapiens
CTPGKAESR

SEQ ID NO: 456808 - protein, 9 aa, Homo Sapiens
SSVHATVLL

SEQ ID NO: 456809 - protein, 9 aa, Homo Sapiens
NDMTVTQLV

SEQ ID NO: 456810 - protein, 9 aa, Homo Sapiens
SKIGLKEDG

SEQ ID NO: 456811 - protein, 9 aa, Homo Sapiens
QPFPTVCTP

SEQ ID NO: 456812 - protein, 9 aa, Homo Sapiens
SLVAAVVPS

SEQ ID NO: 456813 - protein, 9 aa, Homo Sapiens
LSQRQRSTP

SEQ ID NO: 456814 - protein, 9 aa, Homo Sapiens
SREDSSFFA

SEQ ID NO: 456815 - protein, 9 aa, Homo Sapiens
VMFPLFLLF

SEQ ID NO: 456816 - protein, 9 aa, Homo Sapiens
PVSTYHVQS

SEQ ID NO: 456817 - protein, 9 aa, Homo Sapiens
DVSCIQKPQ

SEQ ID NO: 456818 - protein, 9 aa, Homo Sapiens
EATQLASLF

SEQ ID NO: 456819 - protein, 9 aa, Homo Sapiens
KTGTLTAND

SEQ ID NO: 456820 - protein, 9 aa, Homo Sapiens
LASLFQEIS

SEQ ID NO: 456821 - protein, 9 aa, Homo Sapiens
RSMKRKEII

SEQ ID NO: 456822 - protein, 9 aa, Homo Sapiens
SADLRKRMP

SEQ ID NO: 456823 - protein, 9 aa, Homo Sapiens
QPAAYYVAQ

SEQ ID NO: 456824 - protein, 9 aa, Homo Sapiens
AHRAFPAPS

SEQ ID NO: 456825 - protein, 9 aa, Homo Sapiens
RNYSLDKEK

SEQ ID NO: 456826 - protein, 9 aa, Homo Sapiens
KALRESWKT

SEQ ID NO: 456827 - protein, 9 aa, Homo Sapiens
PLFLLFHAP

SEQ ID NO: 456828 - protein, 9 aa, Homo Sapiens
LLPGFQRTL

SEQ ID NO: 456829 - protein, 9 aa, Homo Sapiens
TRELQSLVA

SEQ ID NO: 456830 - protein, 9 aa, Homo Sapiens
QFGVIGPQR

SEQ ID NO: 456831 - protein, 9 aa, Homo Sapiens
LNMNTEHQS

SEQ ID NO: 456832 - protein, 9 aa, Homo Sapiens
LQTLMSVND

SEQ ID NO: 456833 - protein, 9 aa, Homo Sapiens
MKRKEIIGW

SEQ ID NO: 456834 - protein, 9 aa, Homo Sapiens
TRVMYCVLR

SEQ ID NO: 456835 - protein, 9 aa, Homo Sapiens
NVASETKED

SEQ ID NO: 456836 - protein, 9 aa, Homo Sapiens
CRGGATCIL

SEQ ID NO: 456837 - protein, 9 aa, Homo Sapiens
ETAQMYLRP

SEQ ID NO: 456838 - protein, 9 aa, Homo Sapiens
GFKQHVISI

SEQ ID NO: 456839 - protein, 9 aa, Homo Sapiens
SGSLPPFST

SEQ ID NO: 456840 - protein, 9 aa, Homo Sapiens
TTLFCLLQF

SEQ ID NO: 456841 - protein, 9 aa, Homo Sapiens
PQPLQQVGL

SEQ ID NO: 456842 - protein, 9 aa, Homo Sapiens
IDGTYFKIR

SEQ ID NO: 456843 - protein, 9 aa, Homo Sapiens
VLLQNHRLW

SEQ ID NO: 456844 - protein, 9 aa, Homo Sapiens
TLGIADSNY

SEQ ID NO: 456845 - protein, 9 aa, Homo Sapiens
EGFYSLVRV

SEQ ID NO: 456846 - protein, 9 aa, Homo Sapiens
QDLTEGAAL

SEQ ID NO: 456847 - protein, 9 aa, Homo Sapiens
PCRGGATCI

SEQ ID NO: 456848 - protein, 9 aa, Homo Sapiens
KLEQLQSAG

SEQ ID NO: 456849 - protein, 9 aa, Homo Sapiens
NLHLMHIII

SEQ ID NO: 456850 - protein, 9 aa, Homo Sapiens
YIKGLQKLL

SEQ ID NO: 456851 - protein, 9 aa, Homo Sapiens
EMLFLLGPF

SEQ ID NO: 456852 - protein, 9 aa, Homo Sapiens
HQDLTEGAA

SEQ ID NO: 456853 - protein, 9 aa, Homo Sapiens
FTNYWIHWV

SEQ ID NO: 456854 - protein, 9 aa, Homo Sapiens
MFPLFLLFH

SEQ ID NO: 456855 - protein, 9 aa, Homo Sapiens
KMGLNDFIQ

SEQ ID NO: 456856 - protein, 9 aa, Homo Sapiens
RKKQQGEAE

SEQ ID NO: 456857 - protein, 9 aa, Homo Sapiens
RPNEKNPGD

SEQ ID NO: 456858 - protein, 9 aa, Homo Sapiens
PLFLALLVI

SEQ ID NO: 456859 - protein, 9 aa, Homo Sapiens
PGSPQSPPE

SEQ ID NO: 456860 - protein, 9 aa, Homo Sapiens
VAQRKWKQY

SEQ ID NO: 456861 - protein, 9 aa, Homo Sapiens
THQDLTEGA

SEQ ID NO: 456862 - protein, 9 aa, Homo Sapiens
ALAVRALLS

SEQ ID NO: 456863 - protein, 9 aa, Homo Sapiens
HGGMAINRF

SEQ ID NO: 456864 - protein, 9 aa, Homo Sapiens
LSQFIESKI

SEQ ID NO: 456865 - protein, 9 aa, Homo Sapiens
ASGAEGRQG

SEQ ID NO: 456866 - protein, 9 aa, Homo Sapiens
KNEQSSLHL

SEQ ID NO: 456867 - protein, 9 aa, Homo Sapiens
RHHRSHRRR

SEQ ID NO: 456868 - protein, 9 aa, Homo Sapiens
MREMRAGGC

SEQ ID NO: 456869 - protein, 9 aa, Homo Sapiens
MTQPFPTVC

SEQ ID NO: 456870 - protein, 9 aa, Homo Sapiens
QNSNVASET

SEQ ID NO: 456871 - protein, 9 aa, Homo Sapiens
PEYIKGLQK

SEQ ID NO: 456872 - protein, 9 aa, Homo Sapiens
AKLEQLQSA

SEQ ID NO: 456873 - protein, 9 aa, Homo Sapiens
RIASRPQKE

SEQ ID NO: 456874 - protein, 9 aa, Homo Sapiens
LQFGVIGPQ

SEQ ID NO: 456875 - protein, 9 aa, Homo Sapiens
LFLLFHAPM

SEQ ID NO: 456876 - protein, 9 aa, Homo Sapiens
KIPLFLALL

SEQ ID NO: 456877 - protein, 9 aa, Homo Sapiens
DVLRTRVKA

SEQ ID NO: 456878 - protein, 9 aa, Homo Sapiens
FHAPMLTST

SEQ ID NO: 456879 - protein, 9 aa, Homo Sapiens
MILLDANFA

SEQ ID NO: 456880 - protein, 9 aa, Homo Sapiens
GITRYQEAF

SEQ ID NO: 456881 - protein, 9 aa, Homo Sapiens
ESRGSSVHA

SEQ ID NO: 456882 - protein, 9 aa, Homo Sapiens
GEAERAEAE

SEQ ID NO: 456883 - protein, 9 aa, Homo Sapiens
AAMALVSEG

SEQ ID NO: 456884 - protein, 9 aa, Homo Sapiens
VVSEETYHG

SEQ ID NO: 456885 - protein, 9 aa, Homo Sapiens
SNSINHFSV

SEQ ID NO: 456886 - protein, 9 aa, Homo Sapiens
RLYSPSVFF

SEQ ID NO: 456887 - protein, 9 aa, Homo Sapiens
QSFPGSPQS

SEQ ID NO: 456888 - protein, 9 aa, Homo Sapiens
VMYCVLREL

SEQ ID NO: 456889 - protein, 9 aa, Homo Sapiens
VTVTYDGDP

SEQ ID NO: 456890 - protein, 9 aa, Homo Sapiens
GLKTEMLFL

SEQ ID NO: 456891 - protein, 9 aa, Homo Sapiens
ADLRKRMPR

SEQ ID NO: 456892 - protein, 9 aa, Homo Sapiens
RIDPDGIHR

SEQ ID NO: 456893 - protein, 9 aa, Homo Sapiens
VQRMDVSIE

SEQ ID NO: 456894 - protein, 9 aa, Homo Sapiens
PLSLLMHLI

SEQ ID NO: 456895 - protein, 9 aa, Homo Sapiens
LPPFSTPLQ

SEQ ID NO: 456896 - protein, 9 aa, Homo Sapiens
PVPTIPGLK

SEQ ID NO: 456897 - protein, 9 aa, Homo Sapiens
GVPKDRDCE

SEQ ID NO: 456898 - protein, 9 aa, Homo Sapiens
LFLLGPFKR

SEQ ID NO: 456899 - protein, 9 aa, Homo Sapiens
QPQNSNVAS

SEQ ID NO: 456900 - protein, 9 aa, Homo Sapiens
AVNGGITRY

SEQ ID NO: 456901 - protein, 9 aa, Homo Sapiens
PLELLTDKS

SEQ ID NO: 456902 - protein, 9 aa, Homo Sapiens
SNVASETKE

SEQ ID NO: 456903 - protein, 9 aa, Homo Sapiens
PLLWHQHIR

SEQ ID NO: 456904 - protein, 9 aa, Homo Sapiens
RPRMHMNDG

SEQ ID NO: 456905 - protein, 9 aa, Homo Sapiens
AVDVSCIQK

SEQ ID NO: 456906 - protein, 9 aa, Homo Sapiens
HQRASCGIA

SEQ ID NO: 456907 - protein, 9 aa, Homo Sapiens
ARIFNTFRP

SEQ ID NO: 456908 - protein, 9 aa, Homo Sapiens
LMHLILLGP

SEQ ID NO: 456909 - protein, 9 aa, Homo Sapiens
EGSKSSERE

SEQ ID NO: 456910 - protein, 9 aa, Homo Sapiens
VAAVVPSAQ

SEQ ID NO: 456911 - protein, 9 aa, Homo Sapiens
PEIMFRRMP

SEQ ID NO: 456912 - protein, 9 aa, Homo Sapiens
ETIEQENQA

SEQ ID NO: 456913 - protein, 9 aa, Homo Sapiens
LMSVNDSVE

SEQ ID NO: 456914 - protein, 9 aa, Homo Sapiens
MHIIIRLNM

SEQ ID NO: 456915 - protein, 9 aa, Homo Sapiens
VFFLILGVL

SEQ ID NO: 456916 - protein, 9 aa, Homo Sapiens
VDVSCIQKP

SEQ ID NO: 456917 - protein, 9 aa, Homo Sapiens
EAGRPLHLL

SEQ ID NO: 456918 - protein, 9 aa, Homo Sapiens
GYSFTNYWI

SEQ ID NO: 456919 - protein, 9 aa, Homo Sapiens
TYHGGMAIN

SEQ ID NO: 456920 - protein, 9 aa, Homo Sapiens
KLRELEEGF

SEQ ID NO: 456921 - protein, 9 aa, Homo Sapiens
RDKDTEHGI

SEQ ID NO: 456922 - protein, 9 aa, Homo Sapiens
VVDVSHQDP

SEQ ID NO: 456923 - protein, 9 aa, Homo Sapiens
CGCSPGHFR

SEQ ID NO: 456924 - protein, 9 aa, Homo Sapiens
VAASSALAS

SEQ ID NO: 456925 - protein, 9 aa, Homo Sapiens
KTEMLFLLG

SEQ ID NO: 456926 - protein, 9 aa, Homo Sapiens
RTFSSVART

SEQ ID NO: 456927 - protein, 9 aa, Homo Sapiens
TRFHPNRQG

SEQ ID NO: 456928 - protein, 9 aa, Homo Sapiens
TFRPRMHMN

SEQ ID NO: 456929 - protein, 9 aa, Homo Sapiens
MRAGGCCHA

SEQ ID NO: 456930 - protein, 9 aa, Homo Sapiens
FKPSPSKNT

SEQ ID NO: 456931 - protein, 9 aa, Homo Sapiens
MALVSEGLD

SEQ ID NO: 456932 - protein, 9 aa, Homo Sapiens
KQEVSSWLE

SEQ ID NO: 456933 - protein, 9 aa, Homo Sapiens
GSLPPFSTP

SEQ ID NO: 456934 - protein, 9 aa, Homo Sapiens
RTLGIADSN

SEQ ID NO: 456935 - protein, 9 aa, Homo Sapiens
PGHRMRLPV

SEQ ID NO: 456936 - protein, 9 aa, Homo Sapiens
VKFNKALRE

SEQ ID NO: 456937 - protein, 9 aa, Homo Sapiens
GLCQKNSFK

SEQ ID NO: 456938 - protein, 9 aa, Homo Sapiens
RASNPQKLG

SEQ ID NO: 456939 - protein, 9 aa, Homo Sapiens
YDGDPVPKS

SEQ ID NO: 456940 - protein, 9 aa, Homo Sapiens
HLMHIIIRL

SEQ ID NO: 456941 - protein, 9 aa, Homo Sapiens
YSFTNYWIH

SEQ ID NO: 456942 - protein, 9 aa, Homo Sapiens
YRQKHILME

SEQ ID NO: 456943 - protein, 9 aa, Homo Sapiens
CWMPPGVGP

SEQ ID NO: 456944 - protein, 9 aa, Homo Sapiens
AAVNGGITR

SEQ ID NO: 456945 - protein, 9 aa, Homo Sapiens
LVPQPLQQV

SEQ ID NO: 456946 - protein, 9 aa, Homo Sapiens
SRSVALAVR

SEQ ID NO: 456947 - protein, 9 aa, Homo Sapiens
SLPQSFPGS

SEQ ID NO: 456948 - protein, 9 aa, Homo Sapiens
RELQSLVAA

SEQ ID NO: 456949 - protein, 9 aa, Homo Sapiens
EYRQKHILM

SEQ ID NO: 456950 - protein, 9 aa, Homo Sapiens
DYGLIVSGP

SEQ ID NO: 456951 - protein, 9 aa, Homo Sapiens
EQENQAGES

SEQ ID NO: 456952 - protein, 9 aa, Homo Sapiens
ASPVSTYHV

SEQ ID NO: 456953 - protein, 9 aa, Homo Sapiens
MPRLEEELD

SEQ ID NO: 456954 - protein, 9 aa, Homo Sapiens
TQLASLFQE

SEQ ID NO: 456955 - protein, 9 aa, Homo Sapiens
PGFQRTLGI

SEQ ID NO: 456956 - protein, 9 aa, Homo Sapiens
IGMFSGGNI

SEQ ID NO: 456957 - protein, 9 aa, Homo Sapiens
IGLCQKNSF

SEQ ID NO: 456958 - protein, 9 aa, Homo Sapiens
FFHTLLGEC

SEQ ID NO: 456959 - protein, 9 aa, Homo Sapiens
GDLAQHKED

SEQ ID NO: 456960 - protein, 9 aa, Homo Sapiens
ASGFKQHVI

SEQ ID NO: 456961 - protein, 9 aa, Homo Sapiens
SKETIEQEN

SEQ ID NO: 456962 - protein, 9 aa, Homo Sapiens
FHPNRQGSM

SEQ ID NO: 456963 - protein, 9 aa, Homo Sapiens
LYSPSVFFL

SEQ ID NO: 456964 - protein, 9 aa, Homo Sapiens
VSCIQKPQG

SEQ ID NO: 456965 - protein, 9 aa, Homo Sapiens
LGWSPALSS

SEQ ID NO: 456966 - protein, 9 aa, Homo Sapiens
AATGPMATP

SEQ ID NO: 456967 - protein, 9 aa, Homo Sapiens
KIIRRDVSS

SEQ ID NO: 456968 - protein, 9 aa, Homo Sapiens
CIQKPQGLT

SEQ ID NO: 456969 - protein, 9 aa, Homo Sapiens
QFIESKIGL

SEQ ID NO: 456970 - protein, 9 aa, Homo Sapiens
SVFFLILGV

SEQ ID NO: 456971 - protein, 9 aa, Homo Sapiens
YFKIRAIYD

SEQ ID NO: 456972 - protein, 9 aa, Homo Sapiens
KRGPPGASG

SEQ ID NO: 456973 - protein, 9 aa, Homo Sapiens
AQRKWKQYW

SEQ ID NO: 456974 - protein, 9 aa, Homo Sapiens
RPLHLLMQI

SEQ ID NO: 456975 - protein, 9 aa, Homo Sapiens
SSLHLIQTT

SEQ ID NO: 456976 - protein, 9 aa, Homo Sapiens
NIIKKFKLS

SEQ ID NO: 456977 - protein, 9 aa, Homo Sapiens
SCYLLSLWD

SEQ ID NO: 456978 - protein, 9 aa, Homo Sapiens
PRQDYGLIV

SEQ ID NO: 456979 - protein, 9 aa, Homo Sapiens
RQDYGLIVS

SEQ ID NO: 456980 - protein, 9 aa, Homo Sapiens
YSSQPAAYY

SEQ ID NO: 456981 - protein, 9 aa, Homo Sapiens
MLFLLGPFK

SEQ ID NO: 456982 - protein, 9 aa, Homo Sapiens
SGAEGRQGE

SEQ ID NO: 456983 - protein, 9 aa, Homo Sapiens
ICKTCPLLW

SEQ ID NO: 456984 - protein, 9 aa, Homo Sapiens
YCVLRELEK

SEQ ID NO: 456985 - protein, 9 aa, Homo Sapiens
PGHFRIVQD

SEQ ID NO: 456986 - protein, 9 aa, Homo Sapiens
GNIIKKFKL

SEQ ID NO: 456987 - protein, 9 aa, Homo Sapiens
LRKRMPRLE

SEQ ID NO: 456988 - protein, 9 aa, Homo Sapiens
CYLLSLWDL

SEQ ID NO: 456989 - protein, 9 aa, Homo Sapiens
KRPRVAVTM

SEQ ID NO: 456990 - protein, 9 aa, Homo Sapiens
LKTEMLFLL

SEQ ID NO: 456991 - protein, 9 aa, Homo Sapiens
YSLDKEKKE

SEQ ID NO: 456992 - protein, 9 aa, Homo Sapiens
LQQVGLQDL

SEQ ID NO: 456993 - protein, 9 aa, Homo Sapiens
MFRRMPVPQ

SEQ ID NO: 456994 - protein, 9 aa, Homo Sapiens
PQPACLPPG

SEQ ID NO: 456995 - protein, 9 aa, Homo Sapiens
QMYLRPNMN

SEQ ID NO: 456996 - protein, 9 aa, Homo Sapiens
RVKATGIVE

SEQ ID NO: 456997 - protein, 9 aa, Homo Sapiens
RELEKTFGW

SEQ ID NO: 456998 - protein, 9 aa, Homo Sapiens
TNYWIHWVR

SEQ ID NO: 456999 - protein, 9 aa, Homo Sapiens
RQGSMYTVT

SEQ ID NO: 457000 - protein, 9 aa, Homo Sapiens
EDTTDFPDD

SEQ ID NO: 457001 - protein, 9 aa, Homo Sapiens
LRKAGTQTL

SEQ ID NO: 457002 - protein, 9 aa, Homo Sapiens
SGFKQHVIS

SEQ ID NO: 457003 - protein, 9 aa, Homo Sapiens
RSVALAVRA

SEQ ID NO: 457004 - protein, 9 aa, Homo Sapiens
GKAESRGSS

SEQ ID NO: 457005 - protein, 9 aa, Homo Sapiens
VTQLSHQRA

SEQ ID NO: 457006 - protein, 9 aa, Homo Sapiens
RKRLEALLT

SEQ ID NO: 457007 - protein, 9 aa, Homo Sapiens
RMPRLEEEL

SEQ ID NO: 457008 - protein, 9 aa, Homo Sapiens
DMILLDANF

SEQ ID NO: 457009 - protein, 9 aa, Homo Sapiens
PCSRFPVAA

SEQ ID NO: 457010 - protein, 9 aa, Homo Sapiens
EAHRAFPAP

SEQ ID NO: 457011 - protein, 9 aa, Homo Sapiens
GDEEDKGER

SEQ ID NO: 457012 - protein, 9 aa, Homo Sapiens
RIFNTFRPR

SEQ ID NO: 457013 - protein, 9 aa, Homo Sapiens
SIESVDDLA

SEQ ID NO: 457014 - protein, 9 aa, Homo Sapiens
DYEYRQKHI

SEQ ID NO: 457015 - protein, 9 aa, Homo Sapiens
MFSGGNIIK

SEQ ID NO: 457016 - protein, 9 aa, Homo Sapiens
IQHSDWFFG

SEQ ID NO: 457017 - protein, 9 aa, Homo Sapiens
PRIDPDGIH

SEQ ID NO: 457018 - protein, 9 aa, Homo Sapiens
LQSLVAAVV

SEQ ID NO: 457019 - protein, 9 aa, Homo Sapiens
EETYHGGMA

SEQ ID NO: 457020 - protein, 9 aa, Homo Sapiens
IRIASRPQK

SEQ ID NO: 457021 - protein, 9 aa, Homo Sapiens
QQRRDFLRE

SEQ ID NO: 457022 - protein, 9 aa, Homo Sapiens
PALSSMLCV

SEQ ID NO: 457023 - protein, 9 aa, Homo Sapiens
QQGEAERAE

SEQ ID NO: 457024 - protein, 9 aa, Homo Sapiens
QEVSSWLEN

SEQ ID NO: 457025 - protein, 9 aa, Homo Sapiens
TQPFPTVCT

SEQ ID NO: 457026 - protein, 9 aa, Homo Sapiens
PQNSNVASE

SEQ ID NO: 457027 - protein, 9 aa, Homo Sapiens
EVSSWLENM

SEQ ID NO: 457028 - protein, 9 aa, Homo Sapiens
FPAPSTPPW

SEQ ID NO: 457029 - protein, 9 aa, Homo Sapiens
SLGRIKEKK

SEQ ID NO: 457030 - protein, 9 aa, Homo Sapiens
LKGGHMDQQ

SEQ ID NO: 457031 - protein, 9 aa, Homo Sapiens
SSEREGTRA

SEQ ID NO: 457032 - protein, 9 aa, Homo Sapiens
QHYSIGLCQ

SEQ ID NO: 457033 - protein, 9 aa, Homo Sapiens
LWDHNIRPG

SEQ ID NO: 457034 - protein, 9 aa, Homo Sapiens
VSHQDPEVK

SEQ ID NO: 457035 - protein, 9 aa, Homo Sapiens
DTEHGIADA

SEQ ID NO: 457036 - protein, 9 aa, Homo Sapiens
TYDGDPVPK

SEQ ID NO: 457037 - protein, 9 aa, Homo Sapiens
RLGRDTVNA

SEQ ID NO: 457038 - protein, 9 aa, Homo Sapiens
RQRSTPTPN

SEQ ID NO: 457039 - protein, 9 aa, Homo Sapiens
HVQSTSWMP

SEQ ID NO: 457040 - protein, 9 aa, Homo Sapiens
SSVARTWRT

SEQ ID NO: 457041 - protein, 9 aa, Homo Sapiens
AGFFHTLLG

SEQ ID NO: 457042 - protein, 9 aa, Homo Sapiens
SEGSKSSER

SEQ ID NO: 457043 - protein, 9 aa, Homo Sapiens
ESKIGLKED

SEQ ID NO: 457044 - protein, 9 aa, Homo Sapiens
ALSQFIESK

SEQ ID NO: 457045 - protein, 9 aa, Homo Sapiens
GSKSSEREG

SEQ ID NO: 457046 - protein, 9 aa, Homo Sapiens
VPQPACLPP

SEQ ID NO: 457047 - protein, 9 aa, Homo Sapiens
VRASNPQKL

SEQ ID NO: 457048 - protein, 9 aa, Homo Sapiens
GGITRYQEA

SEQ ID NO: 457049 - protein, 9 aa, Homo Sapiens
DAAVNGGIT

SEQ ID NO: 457050 - protein, 9 aa, Homo Sapiens
TAATGPMAT

SEQ ID NO: 457051 - protein, 9 aa, Homo Sapiens
TSGYSFTNY

SEQ ID NO: 457052 - protein, 9 aa, Homo Sapiens
NTGMFPGFK

SEQ ID NO: 457053 - protein, 9 aa, Homo Sapiens
KDKPLSLLM

SEQ ID NO: 457054 - protein, 9 aa, Homo Sapiens
KHFRVKFNK

SEQ ID NO: 457055 - protein, 9 aa, Homo Sapiens
KFNKALRES

SEQ ID NO: 457056 - protein, 9 aa, Homo Sapiens
KRKEIIGWI

SEQ ID NO: 457057 - protein, 9 aa, Homo Sapiens
HFRIVQDGD

SEQ ID NO: 457058 - protein, 9 aa, Homo Sapiens
SMTSVTFCF

SEQ ID NO: 457059 - protein, 9 aa, Homo Sapiens
SQPAAYYVA

SEQ ID NO: 457060 - protein, 9 aa, Homo Sapiens
SINHFSVMF

SEQ ID NO: 457061 - protein, 9 aa, Homo Sapiens
FKIRAIYDK

SEQ ID NO: 457062 - protein, 9 aa, Homo Sapiens
DQPQNSNVA

SEQ ID NO: 457063 - protein, 9 aa, Homo Sapiens
QSSLHLIQT

SEQ ID NO: 457064 - protein, 9 aa, Homo Sapiens
QVFVRAQEL

SEQ ID NO: 457065 - protein, 9 aa, Homo Sapiens
HEAGRPLHL

SEQ ID NO: 457066 - protein, 9 aa, Homo Sapiens
MISMTSVTF

SEQ ID NO: 457067 - protein, 9 aa, Homo Sapiens
IFLLFFPPF

SEQ ID NO: 457068 - protein, 9 aa, Homo Sapiens
EIIGWISLG

SEQ ID NO: 457069 - protein, 9 aa, Homo Sapiens
SLVPTKKKW

SEQ ID NO: 457070 - protein, 9 aa, Homo Sapiens
LVPTKKKWR

SEQ ID NO: 457071 - protein, 9 aa, Homo Sapiens
WFFGDEEDK

SEQ ID NO: 457072 - protein, 9 aa, Homo Sapiens
KQTYGLCRK

SEQ ID NO: 457073 - protein, 9 aa, Homo Sapiens
GLCRKQRHY

SEQ ID NO: 457074 - protein, 9 aa, Homo Sapiens
VVVDVSHQD

SEQ ID NO: 457075 - protein, 9 aa, Homo Sapiens
AQMYLRPNM

SEQ ID NO: 457076 - protein, 9 aa, Homo Sapiens
PPGASGAEG

SEQ ID NO: 457077 - protein, 9 aa, Homo Sapiens
FIFLLFFPP

SEQ ID NO: 457078 - protein, 9 aa, Homo Sapiens
SRFPVAASS

SEQ ID NO: 457079 - protein, 9 aa, Homo Sapiens
VKATGIVET

SEQ ID NO: 457080 - protein, 9 aa, Homo Sapiens
FQRTLGIAD

SEQ ID NO: 457081 - protein, 9 aa, Homo Sapiens
DFPDDLDTS

SEQ ID NO: 457082 - protein, 9 aa, Homo Sapiens
TEGAALNVT

SEQ ID NO: 457083 - protein, 9 aa, Homo Sapiens
PPGVGPYQH

SEQ ID NO: 457084 - protein, 9 aa, Homo Sapiens
GFFHTLLGE

SEQ ID NO: 457085 - protein, 9 aa, Homo Sapiens
VLRTRVKAT

SEQ ID NO: 457086 - protein, 9 aa, Homo Sapiens
SLDKEKKEE

SEQ ID NO: 457087 - protein, 9 aa, Homo Sapiens
SVARTWRTS

SEQ ID NO: 457088 - protein, 9 aa, Homo Sapiens
LVAQRKWKQ

SEQ ID NO: 457089 - protein, 9 aa, Homo Sapiens
LQNHRLWDH

SEQ ID NO: 457090 - protein, 9 aa, Homo Sapiens
PCICTWRNW

SEQ ID NO: 457091 - protein, 9 aa, Homo Sapiens
KGVPKDRDC

SEQ ID NO: 457092 - protein, 9 aa, Homo Sapiens
ELQSLVAAV

SEQ ID NO: 457093 - protein, 9 aa, Homo Sapiens
ADMILLDAN

SEQ ID NO: 457094 - protein, 9 aa, Homo Sapiens
EGAALNVTL

SEQ ID NO: 457095 - protein, 9 aa, Homo Sapiens
TKKKWRKTT

SEQ ID NO: 457096 - protein, 9 aa, Homo Sapiens
SYIASTRDL

SEQ ID NO: 457097 - protein, 9 aa, Homo Sapiens
RKMGLNDFI

SEQ ID NO: 457098 - protein, 9 aa, Homo Sapiens
ELQRKKQQG

SEQ ID NO: 457099 - protein, 9 aa, Homo Sapiens
EALLTQKQK

SEQ ID NO: 457100 - protein, 9 aa, Homo Sapiens
PSAAMALVS

SEQ ID NO: 457101 - protein, 9 aa, Homo Sapiens
FFGDEEDKG

SEQ ID NO: 457102 - protein, 9 aa, Homo Sapiens
QTYGLCRKQ

SEQ ID NO: 457103 - protein, 9 aa, Homo Sapiens
PAFMKQRKM

SEQ ID NO: 457104 - protein, 9 aa, Homo Sapiens
DGDPVPKSP

SEQ ID NO: 457105 - protein, 9 aa, Homo Sapiens
SEREGTRAG

SEQ ID NO: 457106 - protein, 9 aa, Homo Sapiens
FQEISTQMD

SEQ ID NO: 457107 - protein, 9 aa, Homo Sapiens
CSRFPVAAS

SEQ ID NO: 457108 - protein, 9 aa, Homo Sapiens
TRYQEAFFD

SEQ ID NO: 457109 - protein, 9 aa, Homo Sapiens
KDTEHGIAD

SEQ ID NO: 457110 - protein, 9 aa, Homo Sapiens
LGRIKEKKC

SEQ ID NO: 457111 - protein, 9 aa, Homo Sapiens
IESKIGLKE

SEQ ID NO: 457112 - protein, 9 aa, Homo Sapiens
WETAQMYLR

SEQ ID NO: 457113 - protein, 9 aa, Homo Sapiens
LWETAQMYL

SEQ ID NO: 457114 - protein, 9 aa, Homo Sapiens
TLFCLLQFG

SEQ ID NO: 457115 - protein, 9 aa, Homo Sapiens
SPSVFFLIL

SEQ ID NO: 457116 - protein, 9 aa, Homo Sapiens
DKEKKEEET

SEQ ID NO: 457117 - protein, 9 aa, Homo Sapiens
LPGFQRTLG

SEQ ID NO: 457118 - protein, 9 aa, Homo Sapiens
ELVAQRKWK

SEQ ID NO: 457119 - protein, 9 aa, Homo Sapiens
LSLLMHLIL

SEQ ID NO: 457120 - protein, 9 aa, Homo Sapiens
PFSTPLQVG

SEQ ID NO: 457121 - protein, 9 aa, Homo Sapiens
PGVGPYQHP

SEQ ID NO: 457122 - protein, 9 aa, Homo Sapiens
KLELVAQRK

SEQ ID NO: 457123 - protein, 9 aa, Homo Sapiens
QLSHQRASC

SEQ ID NO: 457124 - protein, 9 aa, Homo Sapiens
LLFHAPMLT

SEQ ID NO: 457125 - protein, 9 aa, Homo Sapiens
WRKTTDGFQ

SEQ ID NO: 457126 - protein, 9 aa, Homo Sapiens
HHRSHRRRP

SEQ ID NO: 457127 - protein, 9 aa, Homo Sapiens
VPTIPGLKT

SEQ ID NO: 457128 - protein, 9 aa, Homo Sapiens
FHTLLGECV

SEQ ID NO: 457129 - protein, 9 aa, Homo Sapiens
NSINHFSVM

SEQ ID NO: 457130 - protein, 9 aa, Homo Sapiens
VSEETYHGG

SEQ ID NO: 457131 - protein, 9 aa, Homo Sapiens
LLMHLILLG

SEQ ID NO: 457132 - protein, 9 aa, Homo Sapiens
FRPRMHMND

SEQ ID NO: 457133 - protein, 9 aa, Homo Sapiens
RKEIIGWIS

SEQ ID NO: 457134 - protein, 9 aa, Homo Sapiens
VGSYIASTR

SEQ ID NO: 457135 - protein, 9 aa, Homo Sapiens
IPGLKTEML

SEQ ID NO: 457136 - protein, 9 aa, Homo Sapiens
EAKLEQLQS

SEQ ID NO: 457137 - protein, 9 aa, Homo Sapiens
GPGPGHRMR

SEQ ID NO: 457138 - protein, 9 aa, Homo Sapiens
RMPVPQQRI

SEQ ID NO: 457139 - protein, 9 aa, Homo Sapiens
LICKTCPLL

SEQ ID NO: 457140 - protein, 9 aa, Homo Sapiens
GMFSGGNII

SEQ ID NO: 457141 - protein, 9 aa, Homo Sapiens
LWQFPLELL

SEQ ID NO: 457142 - protein, 9 aa, Homo Sapiens
EHGIADAVI

SEQ ID NO: 457143 - protein, 9 aa, Homo Sapiens
LDANFASIV

SEQ ID NO: 457144 - protein, 9 aa, Homo Sapiens
DLRKRMPRL

SEQ ID NO: 457145 - protein, 9 aa, Homo Sapiens
RTWRTSQRD

SEQ ID NO: 457146 - protein, 9 aa, Homo Sapiens
FSVMFPLFL

SEQ ID NO: 457147 - protein, 9 aa, Homo Sapiens
CILGPHGKN

SEQ ID NO: 457148 - protein, 9 aa, Homo Sapiens
FPLFLLFHA

SEQ ID NO: 457149 - protein, 9 aa, Homo Sapiens
THPLIRIAS

SEQ ID NO: 457150 - protein, 9 aa, Homo Sapiens
GSMYTVTRM

SEQ ID NO: 457151 - protein, 9 aa, Homo Sapiens
EKNPGDLAQ

SEQ ID NO: 457152 - protein, 9 aa, Homo Sapiens
FLLGPFKRV

SEQ ID NO: 457153 - protein, 9 aa, Homo Sapiens
MATPSSTPG

SEQ ID NO: 457154 - protein, 9 aa, Homo Sapiens
SRGSSVHAT

SEQ ID NO: 457155 - protein, 9 aa, Homo Sapiens
GTLTANDMT

SEQ ID NO: 457156 - protein, 9 aa, Homo Sapiens
MDVSIESVD

SEQ ID NO: 457157 - protein, 9 aa, Homo Sapiens
TPHPMDHPP

SEQ ID NO: 457158 - protein, 9 aa, Homo Sapiens
EDDEGSKFY

SEQ ID NO: 457159 - protein, 9 aa, Homo Sapiens
FKQHVISIH

SEQ ID NO: 457160 - protein, 9 aa, Homo Sapiens
GPGPGPGHR

SEQ ID NO: 457161 - protein, 9 aa, Homo Sapiens
PVAASSALA

SEQ ID NO: 457162 - protein, 9 aa, Homo Sapiens
STYHVQSTS

SEQ ID NO: 457163 - protein, 9 aa, Homo Sapiens
PFTGVLCTL

SEQ ID NO: 457164 - protein, 9 aa, Homo Sapiens
KWSLICKTC

SEQ ID NO: 457165 - protein, 9 aa, Homo Sapiens
PFPTVCTPG

SEQ ID NO: 457166 - protein, 9 aa, Homo Sapiens
GHMDQQRRD

SEQ ID NO: 457167 - protein, 9 aa, Homo Sapiens
NPGDLAQHK

SEQ ID NO: 457168 - protein, 9 aa, Homo Sapiens
ATCILGPHG

SEQ ID NO: 457169 - protein, 9 aa, Homo Sapiens
SQFIESKIG

SEQ ID NO: 457170 - protein, 9 aa, Homo Sapiens
MQVFVRAQE

SEQ ID NO: 457171 - protein, 9 aa, Homo Sapiens
SPSKNTGMF

SEQ ID NO: 457172 - protein, 9 aa, Homo Sapiens
NTFRPRMHM

SEQ ID NO: 457173 - protein, 9 aa, Homo Sapiens
GKAFGCVGS

SEQ ID NO: 457174 - protein, 9 aa, Homo Sapiens
PIQLWQFPL

SEQ ID NO: 457175 - protein, 9 aa, Homo Sapiens
LRLCSVKNL

SEQ ID NO: 457176 - protein, 9 aa, Homo Sapiens
LRPNMNLGY

SEQ ID NO: 457177 - protein, 9 aa, Homo Sapiens
ALLCGMREM

SEQ ID NO: 457178 - protein, 9 aa, Homo Sapiens
WSPALSSML

SEQ ID NO: 457179 - protein, 9 aa, Homo Sapiens
AIGLGWSPA

SEQ ID NO: 457180 - protein, 9 aa, Homo Sapiens
LMHIIIRLN

SEQ ID NO: 457181 - protein, 9 aa, Homo Sapiens
GCVGSYIAS

SEQ ID NO: 457182 - protein, 9 aa, Homo Sapiens
KQQGEAERA

SEQ ID NO: 457183 - protein, 9 aa, Homo Sapiens
SPSAAMALV

SEQ ID NO: 457184 - protein, 9 aa, Homo Sapiens
TIEQENQAG

SEQ ID NO: 457185 - protein, 9 aa, Homo Sapiens
LTANDMTVT

SEQ ID NO: 457186 - protein, 9 aa, Homo Sapiens
LWHQHIRNL

SEQ ID NO: 457187 - protein, 9 aa, Homo Sapiens
SAAMALVSE

SEQ ID NO: 457188 - protein, 9 aa, Homo Sapiens
KEIIGWISL

SEQ ID NO: 457189 - protein, 9 aa, Homo Sapiens
VDVSHQDPE

SEQ ID NO: 457190 - protein, 9 aa, Homo Sapiens
LHLLMQINP

SEQ ID NO: 457191 - protein, 9 aa, Homo Sapiens
QNHRLWDHN

SEQ ID NO: 457192 - protein, 9 aa, Homo Sapiens
QRTLGIADS

SEQ ID NO: 457193 - protein, 9 aa, Homo Sapiens
KIEKKGVPK

SEQ ID NO: 457194 - protein, 9 aa, Homo Sapiens
PTKKKWRKT

SEQ ID NO: 457195 - protein, 9 aa, Homo Sapiens
NCWMPPGVG

SEQ ID NO: 457196 - protein, 9 aa, Homo Sapiens
PQSFPGSPQ

SEQ ID NO: 457197 - protein, 9 aa, Homo Sapiens
VVRDKDTEH

SEQ ID NO: 457198 - protein, 9 aa, Homo Sapiens
LVAAVVPSA

SEQ ID NO: 457199 - protein, 9 aa, Homo Sapiens
QWLLRKAGT

SEQ ID NO: 457200 - protein, 9 aa, Homo Sapiens
ERKQTYGLC

SEQ ID NO: 457201 - protein, 9 aa, Homo Sapiens
RVAVTMTRR

SEQ ID NO: 457202 - protein, 9 aa, Homo Sapiens
QTLMSVNDS

SEQ ID NO: 457203 - protein, 9 aa, Homo Sapiens
GSKFYEEDI

SEQ ID NO: 457204 - protein, 9 aa, Homo Sapiens
PSKNTGMFP

SEQ ID NO: 457205 - protein, 9 aa, Homo Sapiens
FCLLQFGVI

SEQ ID NO: 457206 - protein, 9 aa, Homo Sapiens
QLWQFPLEL

SEQ ID NO: 457207 - protein, 9 aa, Homo Sapiens
IIRRDVSSE

SEQ ID NO: 457208 - protein, 9 aa, Homo Sapiens
GSYIASTRD

SEQ ID NO: 457209 - protein, 9 aa, Homo Sapiens
RKQTYGLCR

SEQ ID NO: 457210 - protein, 9 aa, Homo Sapiens
LHLMHIIIR

SEQ ID NO: 457211 - protein, 9 aa, Homo Sapiens
WLLRKAGTQ

SEQ ID NO: 457212 - protein, 9 aa, Homo Sapiens
MDHPPAFYS

SEQ ID NO: 457213 - protein, 9 aa, Homo Sapiens
DQQRRDFLR

SEQ ID NO: 457214 - protein, 9 aa, Homo Sapiens
KATGIVETH

SEQ ID NO: 457215 - protein, 9 aa, Homo Sapiens
AKIEKKGVP

SEQ ID NO: 457216 - protein, 9 aa, Homo Sapiens
HFRVKFNKA

SEQ ID NO: 457217 - protein, 9 aa, Homo Sapiens
HLLMQINPL

SEQ ID NO: 457218 - protein, 9 aa, Homo Sapiens
IQKPQGLTL

SEQ ID NO: 457219 - protein, 9 aa, Homo Sapiens
VSEGLDEVP

SEQ ID NO: 457220 - protein, 9 aa, Homo Sapiens
PRLEEELDQ

SEQ ID NO: 457221 - protein, 9 aa, Homo Sapiens
GATCILGPH

SEQ ID NO: 457222 - protein, 9 aa, Homo Sapiens
TYGLCRKQR

SEQ ID NO: 457223 - protein, 9 aa, Homo Sapiens
KKGVPKDRD

SEQ ID NO: 457224 - protein, 9 aa, Homo Sapiens
ELEEGFYSL

SEQ ID NO: 457225 - protein, 9 aa, Homo Sapiens
QQVGLQDLL

SEQ ID NO: 457226 - protein, 9 aa, Homo Sapiens
LFQEISTQM

SEQ ID NO: 457227 - protein, 9 aa, Homo Sapiens
FPPFTGVLC

SEQ ID NO: 457228 - protein, 9 aa, Homo Sapiens
PTVCTPGKA

SEQ ID NO: 457229 - protein, 9 aa, Homo Sapiens
PLHLLMQIN

SEQ ID NO: 457230 - protein, 9 aa, Homo Sapiens
ARTWRTSQR

SEQ ID NO: 457231 - protein, 9 aa, Homo Sapiens
LFCLLQFGV

SEQ ID NO: 457232 - protein, 9 aa, Homo Sapiens
PVPQPACLP

SEQ ID NO: 457233 - protein, 9 aa, Homo Sapiens
DGTYFKIRA

SEQ ID NO: 457234 - protein, 9 aa, Homo Sapiens
VRALLSLSG

SEQ ID NO: 457235 - protein, 9 aa, Homo Sapiens
EIMFRRMPV

SEQ ID NO: 457236 - protein, 9 aa, Homo Sapiens
YHGGMAINR

SEQ ID NO: 457237 - protein, 9 aa, Homo Sapiens
IIIRLNMNT

SEQ ID NO: 457238 - protein, 9 aa, Homo Sapiens
TGPMATPSS

SEQ ID NO: 457239 - protein, 9 aa, Homo Sapiens
KRMPRLEEE

SEQ ID NO: 457240 - protein, 9 aa, Homo Sapiens
NRQGSMYTV

SEQ ID NO: 457241 - protein, 9 aa, Homo Sapiens
IFNTFRPRM

SEQ ID NO: 457242 - protein, 9 aa, Homo Sapiens
CVGSYIAST

SEQ ID NO: 457243 - protein, 9 aa, Homo Sapiens
NHRLWDHNI

SEQ ID NO: 457244 - protein, 9 aa, Homo Sapiens
GASGAEGRQ

SEQ ID NO: 457245 - protein, 9 aa, Homo Sapiens
TIPGLKTEM

SEQ ID NO: 457246 - protein, 9 aa, Homo Sapiens
FRIVQDGDH

SEQ ID NO: 457247 - protein, 9 aa, Homo Sapiens
SEAHRAFPA

SEQ ID NO: 457248 - protein, 9 aa, Homo Sapiens
AAYYVAQPA

SEQ ID NO: 457249 - protein, 9 aa, Homo Sapiens
VTYDGDPVP

SEQ ID NO: 457250 - protein, 9 aa, Homo Sapiens
FIESKIGLK

SEQ ID NO: 457251 - protein, 9 aa, Homo Sapiens
DDEGSKFYE

SEQ ID NO: 457252 - protein, 9 aa, Homo Sapiens
TQLSHQRAS

SEQ ID NO: 457253 - protein, 9 aa, Homo Sapiens
SPGHFRIVQ

SEQ ID NO: 457254 - protein, 9 aa, Homo Sapiens
GPIQLWQFP

SEQ ID NO: 457255 - protein, 9 aa, Homo Sapiens
FPTVCTPGK

SEQ ID NO: 457256 - protein, 9 aa, Homo Sapiens
QRKKQQGEA

SEQ ID NO: 457257 - protein, 9 aa, Homo Sapiens
AYYVAQPAT

SEQ ID NO: 457258 - protein, 9 aa, Homo Sapiens
DPKEEEKWS

SEQ ID NO: 457259 - protein, 9 aa, Homo Sapiens
FMKQRKMGL

SEQ ID NO: 457260 - protein, 9 aa, Homo Sapiens
HPNRQGSMY

SEQ ID NO: 457261 - protein, 9 aa, Homo Sapiens
TPRQDYGLI

SEQ ID NO: 457262 - protein, 9 aa, Homo Sapiens
FSSVARTWR

SEQ ID NO: 457263 - protein, 9 aa, Homo Sapiens
SFFAKIEKK

SEQ ID NO: 457264 - protein, 9 aa, Homo Sapiens
YHVQSTSWM

SEQ ID NO: 457265 - protein, 9 aa, Homo Sapiens
SVMFPLFLL

SEQ ID NO: 457266 - protein, 9 aa, Homo Sapiens
DGIHRLRKF

SEQ ID NO: 457267 - protein, 9 aa, Homo Sapiens
TASLVPDFW

SEQ ID NO: 457268 - protein, 9 aa, Homo Sapiens
CKTCPLLWH

SEQ ID NO: 457269 - protein, 9 aa, Homo Sapiens
CLVTQLSHQ

SEQ ID NO: 457270 - protein, 9 aa, Homo Sapiens
KKQQGEAER

SEQ ID NO: 457271 - protein, 9 aa, Homo Sapiens
TTDFPDDLD

SEQ ID NO: 457272 - protein, 9 aa, Homo Sapiens
HTLLGECVP

SEQ ID NO: 457273 - protein, 9 aa, Homo Sapiens
HAPMLTSTS

SEQ ID NO: 457274 - protein, 9 aa, Homo Sapiens
LLQFGVIGP

SEQ ID NO: 457275 - protein, 9 aa, Homo Sapiens
AFMKQRKMG

SEQ ID NO: 457276 - protein, 9 aa, Homo Sapiens
PMLTSTSCY

SEQ ID NO: 457277 - protein, 9 aa, Homo Sapiens
HIIIRLNMN

SEQ ID NO: 457278 - protein, 9 aa, Homo Sapiens
CCAQWLLRK

SEQ ID NO: 457279 - protein, 9 aa, Homo Sapiens
MPCICTWRN

SEQ ID NO: 457280 - protein, 9 aa, Homo Sapiens
RLTHPLIRI

SEQ ID NO: 457281 - protein, 9 aa, Homo Sapiens
HMDQQRRDF

SEQ ID NO: 457282 - protein, 9 aa, Homo Sapiens
LRELEKTFG

SEQ ID NO: 457283 - protein, 9 aa, Homo Sapiens
GGNIIKKFK

SEQ ID NO: 457284 - protein, 9 aa, Homo Sapiens
RLCSVKNLY

SEQ ID NO: 457285 - protein, 9 aa, Homo Sapiens
LHLIQTTWT

SEQ ID NO: 457286 - protein, 9 aa, Homo Sapiens
IMFRRMPVP

SEQ ID NO: 457287 - protein, 9 aa, Homo Sapiens
LQSAGGDAE

SEQ ID NO: 457288 - protein, 9 aa, Homo Sapiens
DASGFKQHV

SEQ ID NO: 457289 - protein, 9 aa, Homo Sapiens
DWFFGDEED

SEQ ID NO: 457290 - protein, 9 aa, Homo Sapiens
SPEIMFRRM

SEQ ID NO: 457291 - protein, 9 aa, Homo Sapiens
DKPLSLLMH

SEQ ID NO: 457292 - protein, 9 aa, Homo Sapiens
VERKQTYGL

SEQ ID NO: 457293 - protein, 9 aa, Homo Sapiens
RRDVSSEGT

SEQ ID NO: 457294 - protein, 9 aa, Homo Sapiens
SKSSEREGT

SEQ ID NO: 457295 - protein, 9 aa, Homo Sapiens
ETRELQSLV

SEQ ID NO: 457296 - protein, 9 aa, Homo Sapiens
DDPKEEEKW

SEQ ID NO: 457297 - protein, 9 aa, Homo Sapiens
TVCTPGKAE

SEQ ID NO: 457298 - protein, 9 aa, Homo Sapiens
IRLYSPSVF

SEQ ID NO: 457299 - protein, 9 aa, Homo Sapiens
SSLGRIKEK

SEQ ID NO: 457300 - protein, 9 aa, Homo Sapiens
IEQENQAGE

SEQ ID NO: 457301 - protein, 9 aa, Homo Sapiens
TRVKATGIV

SEQ ID NO: 457302 - protein, 9 aa, Homo Sapiens
VARTWRTSQ

SEQ ID NO: 457303 - protein, 9 aa, Homo Sapiens
ASSALASSE

SEQ ID NO: 457304 - protein, 9 aa, Homo Sapiens
TLTANDMTV

SEQ ID NO: 457305 - protein, 9 aa, Homo Sapiens
MYCVLRELE

SEQ ID NO: 457306 - protein, 9 aa, Homo Sapiens
EGSKFYEED

SEQ ID NO: 457307 - protein, 9 aa, Homo Sapiens
VNGGITRYQ

SEQ ID NO: 457308 - protein, 9 aa, Homo Sapiens
QKLRELEEG

SEQ ID NO: 457309 - protein, 9 aa, Homo Sapiens
CVVVDVSHQ

SEQ ID NO: 457310 - protein, 9 aa, Homo Sapiens
PAAYYVAQP

SEQ ID NO: 457311 - protein, 9 aa, Homo Sapiens
CSPGHFRIV

SEQ ID NO: 457312 - protein, 9 aa, Homo Sapiens
KAFGCVGSY

SEQ ID NO: 457313 - protein, 9 aa, Homo Sapiens
TEHQSAVWV

SEQ ID NO: 457314 - protein, 9 aa, Homo Sapiens
FLALLVIYL

SEQ ID NO: 457315 - protein, 9 aa, Homo Sapiens
QKHILMENA

SEQ ID NO: 457316 - protein, 9 aa, Homo Sapiens
RGSSVHATV

SEQ ID NO: 457317 - protein, 9 aa, Homo Sapiens
GFQRTLGIA

SEQ ID NO: 457318 - protein, 9 aa, Homo Sapiens
QLQSAGGDA

SEQ ID NO: 457319 - protein, 9 aa, Homo Sapiens
DDLDTSFFA

SEQ ID NO: 457320 - protein, 9 aa, Homo Sapiens
VLRELEKTF

SEQ ID NO: 457321 - protein, 9 aa, Homo Sapiens
LVSEGLDEV

SEQ ID NO: 457322 - protein, 9 aa, Homo Sapiens
TSCYLLSLW

SEQ ID NO: 457323 - protein, 9 aa, Homo Sapiens
LEALLTQKQ

SEQ ID NO: 457324 - protein, 9 aa, Homo Sapiens
SDQPQNSNV

SEQ ID NO: 457325 - protein, 9 aa, Homo Sapiens
STPLQVGPV

SEQ ID NO: 457326 - protein, 9 aa, Homo Sapiens
VALAVRALL

SEQ ID NO: 457327 - protein, 9 aa, Homo Sapiens
RPRVAVTMT

SEQ ID NO: 457328 - protein, 9 aa, Homo Sapiens
TGIPVPTIP

SEQ ID NO: 457329 - protein, 9 aa, Homo Sapiens
FSSLGRIKE

SEQ ID NO: 457330 - protein, 9 aa, Homo Sapiens
LGIADSNYN

SEQ ID NO: 457331 - protein, 9 aa, Homo Sapiens
RMTQPFPTV

SEQ ID NO: 457332 - protein, 9 aa, Homo Sapiens
SGGNIIKKF

SEQ ID NO: 457333 - protein, 9 aa, Homo Sapiens
FRVKFNKAL

SEQ ID NO: 457334 - protein, 9 aa, Homo Sapiens
DLAQHKEDS

SEQ ID NO: 457335 - protein, 9 aa, Homo Sapiens
SHQDPEVKF

SEQ ID NO: 457336 - protein, 9 aa, Homo Sapiens
KPSPSKNTG

SEQ ID NO: 457337 - protein, 9 aa, Homo Sapiens
KSNSINHFS

SEQ ID NO: 457338 - protein, 9 aa, Homo Sapiens
VTRKIIRRD

SEQ ID NO: 457339 - protein, 9 aa, Homo Sapiens
SFTNYWIHW

SEQ ID NO: 457340 - protein, 9 aa, Homo Sapiens
RGPPGASGA

SEQ ID NO: 457341 - protein, 9 aa, Homo Sapiens
RKLELVAQR

SEQ ID NO: 457342 - protein, 9 aa, Homo Sapiens
ANDMTVTQL

SEQ ID NO: 457343 - protein, 9 aa, Homo Sapiens
LCQKNSFKQ

SEQ ID NO: 457344 - protein, 9 aa, Homo Sapiens
AKQEVSSWL

SEQ ID NO: 457345 - protein, 9 aa, Homo Sapiens
HILMENAEL

SEQ ID NO: 457346 - protein, 9 aa, Homo Sapiens
PNEKNPGDL

SEQ ID NO: 457347 - protein, 9 aa, Homo Sapiens
LGECVPCDC

SEQ ID NO: 457348 - protein, 9 aa, Homo Sapiens
LFFPPFTGV

SEQ ID NO: 457349 - protein, 9 aa, Homo Sapiens
SDWFFGDEE

SEQ ID NO: 457350 - protein, 9 aa, Homo Sapiens
FRNYSLDKE

SEQ ID NO: 457351 - protein, 9 aa, Homo Sapiens
YGLCRKQRH

SEQ ID NO: 457352 - protein, 9 aa, Homo Sapiens
QRQRSTPTP

SEQ ID NO: 457353 - protein, 9 aa, Homo Sapiens
CICTWRNWR

SEQ ID NO: 457354 - protein, 9 aa, Homo Sapiens
RTRVKATGI

SEQ ID NO: 457355 - protein, 9 aa, Homo Sapiens
RMRLPVPQG

SEQ ID NO: 457356 - protein, 9 aa, Homo Sapiens
LVEAKQEVS

SEQ ID NO: 457357 - protein, 9 aa, Homo Sapiens
SLVPDFWID

SEQ ID NO: 457358 - protein, 9 aa, Homo Sapiens
KTCPLLWHQ

SEQ ID NO: 457359 - protein, 9 aa, Homo Sapiens
KTSGYSFTN

SEQ ID NO: 457360 - protein, 9 aa, Homo Sapiens
EEKWSLICK

SEQ ID NO: 457361 - protein, 9 aa, Homo Sapiens
APSTPPWEL

SEQ ID NO: 457362 - protein, 9 aa, Homo Sapiens
QVGLQDLLR

SEQ ID NO: 457363 - protein, 9 aa, Homo Sapiens
KRLEALLTQ

SEQ ID NO: 457364 - protein, 9 aa, Homo Sapiens
HPPAFYSPP

SEQ ID NO: 457365 - protein, 9 aa, Homo Sapiens
ATGIVETHF

SEQ ID NO: 457366 - protein, 9 aa, Homo Sapiens
HYSIGLCQK

SEQ ID NO: 457367 - protein, 9 aa, Homo Sapiens
QPLQQVGLQ

SEQ ID NO: 457368 - protein, 9 aa, Homo Sapiens
QPACLPPGP

SEQ ID NO: 457369 - protein, 9 aa, Homo Sapiens
QRKMGLNDF

SEQ ID NO: 457370 - protein, 9 aa, Homo Sapiens
ELEAKLEQL

SEQ ID NO: 457371 - protein, 9 aa, Homo Sapiens
PNRQGSMYT

SEQ ID NO: 457372 - protein, 9 aa, Homo Sapiens
DVSSEGTEK

SEQ ID NO: 457373 - protein, 9 aa, Homo Sapiens
RFPVAASSA

SEQ ID NO: 457374 - protein, 9 aa, Homo Sapiens
LQKLLSKQK

SEQ ID NO: 457375 - protein, 9 aa, Homo Sapiens
SKNTGMFPG

SEQ ID NO: 457376 - protein, 9 aa, Homo Sapiens
FSGGNIIKK

SEQ ID NO: 457377 - protein, 9 aa, Homo Sapiens
PAPSTPPWE

SEQ ID NO: 457378 - protein, 9 aa, Homo Sapiens
KIRLYSPSV

SEQ ID NO: 457379 - protein, 9 aa, Homo Sapiens
MPVPQQRIL

SEQ ID NO: 457380 - protein, 9 aa, Homo Sapiens
LLDANFASI

SEQ ID NO: 457381 - protein, 9 aa, Homo Sapiens
DVSIESVDD

SEQ ID NO: 457382 - protein, 9 aa, Homo Sapiens
MTRRGKGVF

SEQ ID NO: 457383 - protein, 9 aa, Homo Sapiens
LPPGPAPHP

SEQ ID NO: 457384 - protein, 9 aa, Homo Sapiens
PPFSTPLQV

SEQ ID NO: 457385 - protein, 9 aa, Homo Sapiens
IIGWISLGL

SEQ ID NO: 457386 - protein, 9 aa, Homo Sapiens
DMTVTQLVT

SEQ ID NO: 457387 - protein, 9 aa, Homo Sapiens
SLICKTCPL

SEQ ID NO: 457388 - protein, 9 aa, Homo Sapiens
GSPQSPPEG

SEQ ID NO: 457389 - protein, 9 aa, Homo Sapiens
LTVQRMDVS

SEQ ID NO: 457390 - protein, 9 aa, Homo Sapiens
NYSLDKEKK

SEQ ID NO: 457391 - protein, 9 aa, Homo Sapiens
LEEGFYSLV

SEQ ID NO: 457392 - protein, 9 aa, Homo Sapiens
HPMDHPPAF

SEQ ID NO: 457393 - protein, 9 aa, Homo Sapiens
QQRKRLEAL

SEQ ID NO: 457394 - protein, 9 aa, Homo Sapiens
ICTWRNWRQ

SEQ ID NO: 457395 - protein, 9 aa, Homo Sapiens
STSCYLLSL

SEQ ID NO: 457396 - protein, 9 aa, Homo Sapiens
GAALNVTLQ

SEQ ID NO: 457397 - protein, 9 aa, Homo Sapiens
TCILGPHGK

SEQ ID NO: 457398 - protein, 9 aa, Homo Sapiens
LSHQRASCG

SEQ ID NO: 457399 - protein, 9 aa, Homo Sapiens
RLNMNTEHQ

SEQ ID NO: 457400 - protein, 9 aa, Homo Sapiens
MNTEHQSAV

SEQ ID NO: 457401 - protein, 9 aa, Homo Sapiens
PPAFYSPPH

SEQ ID NO: 457402 - protein, 9 aa, Homo Sapiens
SGYSFTNYW

SEQ ID NO: 457403 - protein, 9 aa, Homo Sapiens
SVNDSVERL

SEQ ID NO: 457404 - protein, 9 aa, Homo Sapiens
KPLSLLMHL

SEQ ID NO: 457405 - protein, 9 aa, Homo Sapiens
YSIGLCQKN

SEQ ID NO: 457406 - protein, 9 aa, Homo Sapiens
PGLKTEMLF

SEQ ID NO: 457407 - protein, 9 aa, Homo Sapiens
IRLNMNTEH

SEQ ID NO: 457408 - protein, 9 aa, Homo Sapiens
ERKLELVAQ

SEQ ID NO: 457409 - protein, 9 aa, Homo Sapiens
LELVAQRKW

SEQ ID NO: 457410 - protein, 9 aa, Homo Sapiens
DHPPAFYSP

SEQ ID NO: 457411 - protein, 9 aa, Homo Sapiens
IGLGWSPAL

SEQ ID NO: 457412 - protein, 9 aa, Homo Sapiens
FFAKIEKKG

SEQ ID NO: 457413 - protein, 9 aa, Homo Sapiens
LGRDTVNAT

SEQ ID NO: 457414 - protein, 9 aa, Homo Sapiens
ISMTSVTFC

SEQ ID NO: 457415 - protein, 9 aa, Homo Sapiens
NHFSVMFPL

SEQ ID NO: 457416 - protein, 9 aa, Homo Sapiens
CQKNSFKQS

SEQ ID NO: 457417 - protein, 9 aa, Homo Sapiens
PGDLAQHKE

SEQ ID NO: 457418 - protein, 9 aa, Homo Sapiens
HGIADAVIA

SEQ ID NO: 457419 - protein, 9 aa, Homo Sapiens
TFRNYSLDK

SEQ ID NO: 457420 - protein, 9 aa, Homo Sapiens
LLVIYLITI

SEQ ID NO: 457421 - protein, 9 aa, Homo Sapiens
KQHVISIHT

SEQ ID NO: 457422 - protein, 9 aa, Homo Sapiens
CKIPLFLAL

SEQ ID NO: 457423 - protein, 9 aa, Homo Sapiens
NDSVERLYN

SEQ ID NO: 457424 - protein, 9 aa, Homo Sapiens
GKRGPPGAS

SEQ ID NO: 457425 - protein, 9 aa, Homo Sapiens
LTHPLIRIA

SEQ ID NO: 457426 - protein, 9 aa, Homo Sapiens
AFGCVGSYI

SEQ ID NO: 457427 - protein, 9 aa, Homo Sapiens
APMLTSTSC

SEQ ID NO: 457428 - protein, 9 aa, Homo Sapiens
PTIPGLKTE

SEQ ID NO: 457429 - protein, 9 aa, Homo Sapiens
NKALRESWK

SEQ ID NO: 457430 - protein, 9 aa, Homo Sapiens
PMDHPPAFY

SEQ ID NO: 457431 - protein, 9 aa, Homo Sapiens
TDASGFKQH

SEQ ID NO: 457432 - protein, 9 aa, Homo Sapiens
EREGTRAGE

SEQ ID NO: 457433 - protein, 9 aa, Homo Sapiens
DSSFFAKIE

SEQ ID NO: 457434 - protein, 9 aa, Homo Sapiens
PSVFFLILG

SEQ ID NO: 457435 - protein, 9 aa, Homo Sapiens
NDYEYRQKH

SEQ ID NO: 457436 - protein, 9 aa, Homo Sapiens
DLDTSFFAR

SEQ ID NO: 457437 - protein, 9 aa, Homo Sapiens
YLLSLWDLT

SEQ ID NO: 457438 - protein, 9 aa, Homo Sapiens
PDGIHRLRK

SEQ ID NO: 457439 - protein, 9 aa, Homo Sapiens
VNDSVERLY

SEQ ID NO: 457440 - protein, 9 aa, Homo Sapiens
ASLVPDFWI

SEQ ID NO: 457441 - protein, 9 aa, Homo Sapiens
LLFFPPFTG

SEQ ID NO: 457442 - protein, 9 aa, Homo Sapiens
GGHMDQQRR

SEQ ID NO: 457443 - protein, 9 aa, Homo Sapiens
SLLMHLILL

SEQ ID NO: 457444 - protein, 9 aa, Homo Sapiens
DTTDFPDDL

SEQ ID NO: 457445 - protein, 9 aa, Homo Sapiens
TYFKIRAIY

SEQ ID NO: 457446 - protein, 9 aa, Homo Sapiens
TEMLFLLGP

SEQ ID NO: 457447 - protein, 9 aa, Homo Sapiens
HRHHRSHRR

SEQ ID NO: 457448 - protein, 9 aa, Homo Sapiens
RHEAGRPLH

SEQ ID NO: 457449 - protein, 9 aa, Homo Sapiens
TEHGIADAV

SEQ ID NO: 457450 - protein, 9 aa, Homo Sapiens
RALLSLSGL

SEQ ID NO: 457451 - protein, 9 aa, Homo Sapiens
FPLELLTDK

SEQ ID NO: 457452 - protein, 9 aa, Homo Sapiens
IRNLHLMHI

SEQ ID NO: 457453 - protein, 9 aa, Homo Sapiens
PDDLDTSFF

SEQ ID NO: 457454 - protein, 9 aa, Homo Sapiens
LEAKLEQLQ

SEQ ID NO: 457455 - protein, 9 aa, Homo Sapiens
AKDKPLSLL

SEQ ID NO: 457456 - protein, 9 aa, Homo Sapiens
SEETYHGGM

SEQ ID NO: 457457 - protein, 9 aa, Homo Sapiens
FLLFHAPML

SEQ ID NO: 457458 - protein, 9 aa, Homo Sapiens
EYIKGLQKL

SEQ ID NO: 457459 - protein, 9 aa, Homo Sapiens
QSLVAAVVP

SEQ ID NO: 457460 - protein, 9 aa, Homo Sapiens
KKKWRKTTD

SEQ ID NO: 457461 - protein, 9 aa, Homo Sapiens
KGLQKLLSK

SEQ ID NO: 457462 - protein, 9 aa, Homo Sapiens
LLGECVPCD

SEQ ID NO: 457463 - protein, 9 aa, Homo Sapiens
ITHQDLTEG

SEQ ID NO: 457464 - protein, 9 aa, Homo Sapiens
SMKRKEIIG

SEQ ID NO: 457465 - protein, 9 aa, Homo Sapiens
TLMSVNDSV

SEQ ID NO: 457466 - protein, 9 aa, Homo Sapiens
VEAKQEVSS

SEQ ID NO: 457467 - protein, 9 aa, Homo Sapiens
GVGPYQHPK

SEQ ID NO: 457468 - protein, 9 aa, Homo Sapiens
MSVNDSVER

SEQ ID NO: 457469 - protein, 9 aa, Homo Sapiens
FNKALRESW

SEQ ID NO: 457470 - protein, 9 aa, Homo Sapiens
TVQRMDVSI

SEQ ID NO: 457471 - protein, 9 aa, Homo Sapiens
HPLIRIASR

SEQ ID NO: 457472 - protein, 9 aa, Homo Sapiens
ALVSEGLDE

SEQ ID NO: 457473 - protein, 9 aa, Homo Sapiens
VASETKEDK

SEQ ID NO: 457474 - protein, 9 aa, Homo Sapiens
DFWIDGSNR

SEQ ID NO: 457475 - protein, 9 aa, Homo Sapiens
GRDTVNATC

SEQ ID NO: 457476 - protein, 9 aa, Homo Sapiens
LPQSFPGSP

SEQ ID NO: 457477 - protein, 9 aa, Homo Sapiens
YLRPNMNLG

SEQ ID NO: 457478 - protein, 9 aa, Homo Sapiens
EKWSLICKT

SEQ ID NO: 457479 - protein, 9 aa, Homo Sapiens
SPALSSMLC

SEQ ID NO: 457480 - protein, 9 aa, Homo Sapiens
LDKEKKEEE

SEQ ID NO: 457481 - protein, 9 aa, Homo Sapiens
NEKNPGDLA

SEQ ID NO: 457482 - protein, 9 aa, Homo Sapiens
QHVISIHTK

SEQ ID NO: 457483 - protein, 9 aa, Homo Sapiens
SQRQRSTPT

SEQ ID NO: 457484 - protein, 9 aa, Homo Sapiens
QGSMYTVTR

SEQ ID NO: 457485 - protein, 9 aa, Homo Sapiens
KIRAIYDKP

SEQ ID NO: 457486 - protein, 9 aa, Homo Sapiens
QRKRLEALL

SEQ ID NO: 457487 - protein, 9 aa, Homo Sapiens
VCTPGKAES

SEQ ID NO: 457488 - protein, 9 aa, Homo Sapiens
LCGMREMRA

SEQ ID NO: 457489 - protein, 9 aa, Homo Sapiens
PAFYSPPHN

SEQ ID NO: 457490 - protein, 9 aa, Homo Sapiens
REMRAGGCC

SEQ ID NO: 457491 - protein, 9 aa, Homo Sapiens
NSNVASETK

SEQ ID NO: 457492 - protein, 9 aa, Homo Sapiens
VSSWLENMA

SEQ ID NO: 457493 - protein, 9 aa, Homo Sapiens
NYWIHWVRQ

SEQ ID NO: 457494 - protein, 9 aa, Homo Sapiens
RLEALLTQK

SEQ ID NO: 457495 - protein, 9 aa, Homo Sapiens
IASRPQKEQ

SEQ ID NO: 457496 - protein, 9 aa, Homo Sapiens
HRMRLPVPQ

SEQ ID NO: 457497 - protein, 9 aa, Homo Sapiens
THPRIDPDG

SEQ ID NO: 457498 - protein, 9 aa, Homo Sapiens
ITRYQEAFF

SEQ ID NO: 457499 - protein, 9 aa, Homo Sapiens
ACCAQWLLR

SEQ ID NO: 457500 - protein, 9 aa, Homo Sapiens
QRMDVSIES

SEQ ID NO: 457501 - protein, 9 aa, Homo Sapiens
LLWHQHIRN

SEQ ID NO: 457502 - protein, 9 aa, Homo Sapiens
ILLDANFAS

SEQ ID NO: 457503 - protein, 9 aa, Homo Sapiens
QDYGLIVSG

SEQ ID NO: 457504 - protein, 9 aa, Homo Sapiens
TLKNEQSSL

SEQ ID NO: 457505 - protein, 9 aa, Homo Sapiens
HQHIRNLHL

SEQ ID NO: 457506 - protein, 9 aa, Homo Sapiens
EDSSFFAKI

SEQ ID NO: 457507 - protein, 9 aa, Homo Sapiens
PGKAESRGS

SEQ ID NO: 457508 - protein, 9 aa, Homo Sapiens
FLLFFPPFT

SEQ ID NO: 457509 - protein, 9 aa, Homo Sapiens
LCTPRQDYG

SEQ ID NO: 457510 - protein, 9 aa, Homo Sapiens
LCRKQRHYA

SEQ ID NO: 457511 - protein, 9 aa, Homo Sapiens
VPEYIKGLQ

SEQ ID NO: 457512 - protein, 9 aa, Homo Sapiens
MDQQRRDFL

SEQ ID NO: 457513 - protein, 9 aa, Homo Sapiens
WHQHIRNLH

SEQ ID NO: 457514 - protein, 9 aa, Homo Sapiens
NGGITRYQE

SEQ ID NO: 457515 - protein, 9 aa, Homo Sapiens
QRASCGIAP

SEQ ID NO: 457516 - protein, 9 aa, Homo Sapiens
SKFYEEDID

SEQ ID NO: 457517 - protein, 9 aa, Homo Sapiens
NEQSSLHLI

SEQ ID NO: 457518 - protein, 9 aa, Homo Sapiens
MLTSTSCYL

SEQ ID NO: 457519 - protein, 9 aa, Homo Sapiens
PGPGPGHRM

SEQ ID NO: 457520 - protein, 9 aa, Homo Sapiens
IDPDGIHRL

SEQ ID NO: 457521 - protein, 9 aa, Homo Sapiens
LKNEQSSLH

SEQ ID NO: 457522 - protein, 9 aa, Homo Sapiens
CVLRELEKT

SEQ ID NO: 457523 - protein, 9 aa, Homo Sapiens
TLKGGHMDQ

SEQ ID NO: 457524 - protein, 9 aa, Homo Sapiens
VSIESVDDL

SEQ ID NO: 457525 - protein, 9 aa, Homo Sapiens
CPLLWHQHI

SEQ ID NO: 457526 - protein, 9 aa, Homo Sapiens
FNTFRPRMH

SEQ ID NO: 457527 - protein, 9 aa, Homo Sapiens
FFPPFTGVL

SEQ ID NO: 457528 - protein, 9 aa, Homo Sapiens
CAQWLLRKA

SEQ ID NO: 457529 - protein, 9 aa, Homo Sapiens
KETIEQENQ

SEQ ID NO: 457530 - protein, 9 aa, Homo Sapiens
FPDDLDTSF

SEQ ID NO: 457531 - protein, 9 aa, Homo Sapiens
FGDEEDKGE

SEQ ID NO: 457532 - protein, 9 aa, Homo Sapiens
DANFASIVT

SEQ ID NO: 457533 - protein, 9 aa, Homo Sapiens
GTASLVPDF

SEQ ID NO: 457534 - protein, 9 aa, Homo Sapiens
FWIDGSNRD

SEQ ID NO: 457535 - protein, 9 aa, Homo Sapiens
PMATPSSTP

SEQ ID NO: 457536 - protein, 9 aa, Homo Sapiens
RDTVNATCQ

SEQ ID NO: 457537 - protein, 9 aa, Homo Sapiens
VGPYQHPKS

SEQ ID NO: 457538 - protein, 9 aa, Homo Sapiens
VPDFWIDGS

SEQ ID NO: 457539 - protein, 9 aa, Homo Sapiens
MTSVTFCFP

SEQ ID NO: 457540 - protein, 9 aa, Homo Sapiens
TDFPDDLDT

SEQ ID NO: 457541 - protein, 9 aa, Homo Sapiens
DNCWMPPGV

SEQ ID NO: 457542 - protein, 9 aa, Homo Sapiens
TANDMTVTQ

SEQ ID NO: 457543 - protein, 9 aa, Homo Sapiens
TYHVQSTSW

SEQ ID NO: 457544 - protein, 9 aa, Homo Sapiens
SSQPAAYYV

SEQ ID NO: 457545 - protein, 9 aa, Homo Sapiens
EMRAGGCCH

SEQ ID NO: 457546 - protein, 9 aa, Homo Sapiens
ASREDSSFF

SEQ ID NO: 457547 - protein, 9 aa, Homo Sapiens
SIGLCQKNS

SEQ ID NO: 457548 - protein, 9 aa, Homo Sapiens
TTTAATGPM

SEQ ID NO: 457549 - protein, 9 aa, Homo Sapiens
GWSPALSSM

SEQ ID NO: 457550 - protein, 9 aa, Homo Sapiens
GHFRIVQDG

SEQ ID NO: 457551 - protein, 9 aa, Homo Sapiens
TVTYDGDPV

SEQ ID NO: 457552 - protein, 9 aa, Homo Sapiens
PKDRDCEGS

SEQ ID NO: 457553 - protein, 9 aa, Homo Sapiens
HIRNLHLMH

SEQ ID NO: 457554 - protein, 9 aa, Homo Sapiens
WAIGLGWSP

SEQ ID NO: 457555 - protein, 9 aa, Homo Sapiens
PLIRIASRP

SEQ ID NO: 457556 - protein, 9 aa, Homo Sapiens
ASLFQEIST

SEQ ID NO: 457557 - protein, 9 aa, Homo Sapiens
ETYHGGMAI

SEQ ID NO: 457558 - protein, 9 aa, Homo Sapiens
EEGFYSLVR

SEQ ID NO: 457559 - protein, 9 aa, Homo Sapiens
HRAFPAPST

SEQ ID NO: 457560 - protein, 9 aa, Homo Sapiens
GCSPGHFRI

SEQ ID NO: 457561 - protein, 9 aa, Homo Sapiens
IQLWQFPLE

SEQ ID NO: 457562 - protein, 9 aa, Homo Sapiens
AASPVSTYH

SEQ ID NO: 457563 - protein, 9 aa, Homo Sapiens
LVTQLSHQR

SEQ ID NO: 457564 - protein, 9 aa, Homo Sapiens
LAVRALLSL

SEQ ID NO: 457565 - protein, 9 aa, Homo Sapiens
YSPSVFFLI

SEQ ID NO: 457566 - protein, 9 aa, Homo Sapiens
LLRKAGTQT

SEQ ID NO: 457567 - protein, 9 aa, Homo Sapiens
VPTKKKWRK

SEQ ID NO: 457568 - protein, 9 aa, Homo Sapiens
CGMREMRAG

SEQ ID NO: 457569 - protein, 9 aa, Homo Sapiens
AFPAPSTPP

SEQ ID NO: 457570 - protein, 9 aa, Homo Sapiens
TMTRRGKGV

SEQ ID NO: 457571 - protein, 9 aa, Homo Sapiens
SFPGSPQSP

SEQ ID NO: 457572 - protein, 9 aa, Homo Sapiens
CLLQFGVIG

SEQ ID NO: 457573 - protein, 9 aa, Homo Sapiens
MLLRLCSVK

SEQ ID NO: 457574 - protein, 9 aa, Homo Sapiens
RVKFNKALR

SEQ ID NO: 457575 - protein, 9 aa, Homo Sapiens
EKKGVPKDR

SEQ ID NO: 457576 - protein, 9 aa, Homo Sapiens
QRSTPTPNV

SEQ ID NO: 457577 - protein, 9 aa, Homo Sapiens
VAVTMTRRG

SEQ ID NO: 457578 - protein, 9 aa, Homo Sapiens
QRKWKQYWV

SEQ ID NO: 457579 - protein, 9 aa, Homo Sapiens
VGLQDLLRI

SEQ ID NO: 457580 - protein, 9 aa, Homo Sapiens
ACLPPGPAP

SEQ ID NO: 457581 - protein, 9 aa, Homo Sapiens
RIVQDGDHC

SEQ ID NO: 457582 - protein, 9 aa, Homo Sapiens
LLRLCSVKN

SEQ ID NO: 457583 - protein, 9 aa, Homo Sapiens
KEEEKWSLI

SEQ ID NO: 457584 - protein, 9 aa, Homo Sapiens
MYLRPNMNL

SEQ ID NO: 457585 - protein, 9 aa, Homo Sapiens
PDFWIDGSN

SEQ ID NO: 457586 - protein, 9 aa, Homo Sapiens
MACCAQWLL

SEQ ID NO: 457587 - protein, 9 aa, Homo Sapiens
DLTEGAALN

SEQ ID NO: 457588 - protein, 9 aa, Homo Sapiens
ALLTQKQKV

SEQ ID NO: 457589 - protein, 9 aa, Homo Sapiens
PRVAVTMTR

SEQ ID NO: 457590 - protein, 9 aa, Homo Sapiens
TTAATGPMA

SEQ ID NO: 457591 - protein, 9 aa, Homo Sapiens
TAQMYLRPN

SEQ ID NO: 457592 - protein, 9 aa, Homo Sapiens
RAFPAPSTP

SEQ ID NO: 457593 - protein, 9 aa, Homo Sapiens
RFHPNRQGS

SEQ ID NO: 457594 - protein, 9 aa, Homo Sapiens
KNPGDLAQH

SEQ ID NO: 457595 - protein, 9 aa, Homo Sapiens
IPLFLALLV

SEQ ID NO: 457596 - protein, 9 aa, Homo Sapiens
SAVDVSCIQ

SEQ ID NO: 457597 - protein, 9 aa, Homo Sapiens
AQWLLRKAG

SEQ ID NO: 457598 - protein, 9 aa, Homo Sapiens
VSTYHVQST

SEQ ID NO: 457599 - protein, 9 aa, Homo Sapiens
HPRIDPDGI

SEQ ID NO: 457600 - protein, 9 aa, Homo Sapiens
TLLGECVPC

SEQ ID NO: 457601 - protein, 9 aa, Homo Sapiens
YEYRQKHIL

SEQ ID NO: 457602 - protein, 9 aa, Homo Sapiens
AADMILLDA

SEQ ID NO: 457603 - protein, 9 aa, Homo Sapiens
IEKKGVPKD

SEQ ID NO: 457604 - protein, 9 aa, Homo Sapiens
NMNTEHQSA

SEQ ID NO: 457605 - protein, 9 aa, Homo Sapiens
LSLPQSFPG

SEQ ID NO: 457606 - protein, 9 aa, Homo Sapiens
MPLIILTRD

SEQ ID NO: 457607 - protein, 9 aa, Homo Sapiens
GSAVDVSCI

SEQ ID NO: 457608 - protein, 9 aa, Homo Sapiens
EEEKWSLIC

SEQ ID NO: 457609 - protein, 9 aa, Homo Sapiens
YGLIVSGPS

SEQ ID NO: 457610 - protein, 9 aa, Homo Sapiens
VTMTRRGKG

SEQ ID NO: 457611 - protein, 9 aa, Homo Sapiens
GPGHRMRLP

SEQ ID NO: 457612 - protein, 9 aa, Homo Sapiens
KWRKTTDGF

SEQ ID NO: 457613 - protein, 9 aa, Homo Sapiens
LVPDFWIDG

SEQ ID NO: 457614 - protein, 9 aa, Homo Sapiens
TCPLLWHQH

SEQ ID NO: 457615 - protein, 9 aa, Homo Sapiens
GHRMRLPVP

SEQ ID NO: 457616 - protein, 9 aa, Homo Sapiens
STPTPNVHM

SEQ ID NO: 457617 - protein, 9 aa, Homo Sapiens
MKQRKMGLN

SEQ ID NO: 457618 - protein, 9 aa, Homo Sapiens
PSPSKNTGM

SEQ ID NO: 457619 - protein, 9 aa, Homo Sapiens
RRMPVPQQR

SEQ ID NO: 457620 - protein, 9 aa, Homo Sapiens
LIRIASRPQ

SEQ ID NO: 457621 - protein, 9 aa, Homo Sapiens
KEKKEEETE

SEQ ID NO: 457622 - protein, 9 aa, Homo Sapiens
AVTVTYDGD

SEQ ID NO: 457623 - protein, 9 aa, Homo Sapiens
YLCTPRQDY

SEQ ID NO: 457624 - protein, 9 aa, Homo Sapiens
LLTQKQKVG

SEQ ID NO: 457625 - protein, 9 aa, Homo Sapiens
TSTSCYLLS

SEQ ID NO: 457626 - protein, 9 aa, Homo Sapiens
AASSALASS

SEQ ID NO: 457627 - protein, 9 aa, Homo Sapiens
RQKHILMEN

SEQ ID NO: 457628 - protein, 9 aa, Homo Sapiens
FGCVGSYIA

SEQ ID NO: 457629 - protein, 9 aa, Homo Sapiens
TPGKAESRG

SEQ ID NO: 457630 - protein, 9 aa, Homo Sapiens
TRKIIRRDV

SEQ ID NO: 457631 - protein, 9 aa, Homo Sapiens
IKGLQKLLS

SEQ ID NO: 457632 - protein, 9 aa, Homo Sapiens
WSEGSKSSE

SEQ ID NO: 457633 - protein, 9 aa, Homo Sapiens
CTPRQDYGL

SEQ ID NO: 457634 - protein, 9 aa, Homo Sapiens
LTSTSCYLL

SEQ ID NO: 457635 - protein, 9 aa, Homo Sapiens
GFYSLVRVE

SEQ ID NO: 457636 - protein, 9 aa, Homo Sapiens
INHFSVMFP

SEQ ID NO: 457637 - protein, 9 aa, Homo Sapiens
AGRPLHLLM

SEQ ID NO: 457638 - protein, 9 aa, Homo Sapiens
GGATCILGP

SEQ ID NO: 457639 - protein, 9 aa, Homo Sapiens
YEEDIDQIL

SEQ ID NO: 457640 - protein, 9 aa, Homo Sapiens
PACLPPGPA

SEQ ID NO: 457641 - protein, 9 aa, Homo Sapiens
DPAFMKQRK

SEQ ID NO: 457642 - protein, 9 aa, Homo Sapiens
VRDKDTEHG

SEQ ID NO: 457643 - protein, 9 aa, Homo Sapiens
LFHAPMLTS

SEQ ID NO: 457644 - protein, 9 aa, Homo Sapiens
DKDTEHGIA

SEQ ID NO: 457645 - protein, 9 aa, Homo Sapiens
ILGPHGKNY

SEQ ID NO: 457646 - protein, 9 aa, Homo Sapiens
ATTLFCLLQ

SEQ ID NO: 457647 - protein, 9 aa, Homo Sapiens
SSFFAKIEK

SEQ ID NO: 457648 - protein, 9 aa, Homo Sapiens
GMREMRAGG

SEQ ID NO: 457649 - protein, 9 aa, Homo Sapiens
DPDGIHRLR

SEQ ID NO: 457650 - protein, 9 aa, Homo Sapiens
LFLALLVIY

SEQ ID NO: 457651 - protein, 9 aa, Homo Sapiens
PTPNVHMVS

SEQ ID NO: 457652 - protein, 9 aa, Homo Sapiens
SLFQEISTQ

SEQ ID NO: 457653 - protein, 9 aa, Homo Sapiens
RNLHLMHII

SEQ ID NO: 457654 - protein, 9 aa, Homo Sapiens
TQHYSIGLC

SEQ ID NO: 457655 - protein, 9 aa, Homo Sapiens
RSTPTPNVH

SEQ ID NO: 457656 - protein, 9 aa, Homo Sapiens
QFPLELLTD

SEQ ID NO: 457657 - protein, 9 aa, Homo Sapiens
KRSMKRKEI

SEQ ID NO: 457658 - protein, 9 aa, Homo Sapiens
AVTMTRRGK

SEQ ID NO: 457659 - protein, 9 aa, Homo Sapiens
LQRKKQQGE

SEQ ID NO: 457660 - protein, 9 aa, Homo Sapiens
RGGATCILG

SEQ ID NO: 457661 - protein, 9 aa, Homo Sapiens
EQLQSAGGD

SEQ ID NO: 457662 - protein, 9 aa, Homo Sapiens
KFYEEDIDQ

SEQ ID NO: 457663 - protein, 9 aa, Homo Sapiens
GTYFKIRAI

SEQ ID NO: 457664 - protein, 9 aa, Homo Sapiens
ATGPMATPS

SEQ ID NO: 457665 - protein, 9 aa, Homo Sapiens
SLHLIQTTW

SEQ ID NO: 457666 - protein, 9 aa, Homo Sapiens
QHIRNLHLM

SEQ ID NO: 457667 - protein, 9 aa, Homo Sapiens
RLWDHNIRP

SEQ ID NO: 457668 - protein, 9 aa, Homo Sapiens
AQDIPKYTC

SEQ ID NO: 457669 - protein, 9 aa, Homo Sapiens
LAVLAPLSL

SEQ ID NO: 457670 - protein, 9 aa, Homo Sapiens
DDSLHAAFT

SEQ ID NO: 457671 - protein, 9 aa, Homo Sapiens
FVLLSWLPT

SEQ ID NO: 457672 - protein, 9 aa, Homo Sapiens
DEDKDSEEE

SEQ ID NO: 457673 - protein, 9 aa, Homo Sapiens
ALAVLAPLS

SEQ ID NO: 457674 - protein, 9 aa, Homo Sapiens
RPLLLLLLG

SEQ ID NO: 457675 - protein, 9 aa, Homo Sapiens
SQSKYSETW

SEQ ID NO: 457676 - protein, 9 aa, Homo Sapiens
QDLRAANVL

SEQ ID NO: 457677 - protein, 9 aa, Homo Sapiens
RGRDPGLMH

SEQ ID NO: 457678 - protein, 9 aa, Homo Sapiens
AVSQGLLTF

SEQ ID NO: 457679 - protein, 9 aa, Homo Sapiens
QFKVLSHNL

SEQ ID NO: 457680 - protein, 9 aa, Homo Sapiens
LLWNLLQVD

SEQ ID NO: 457681 - protein, 9 aa, Homo Sapiens
CAVIEDDSL

SEQ ID NO: 457682 - protein, 9 aa, Homo Sapiens
DQEFWHSQG

SEQ ID NO: 457683 - protein, 9 aa, Homo Sapiens
VQRLRRGRD

SEQ ID NO: 457684 - protein, 9 aa, Homo Sapiens
AEQLYHLEM

SEQ ID NO: 457685 - protein, 9 aa, Homo Sapiens
EELKSTDTI

SEQ ID NO: 457686 - protein, 9 aa, Homo Sapiens
IREELKSTD

SEQ ID NO: 457687 - protein, 9 aa, Homo Sapiens
PGPADDQEF

SEQ ID NO: 457688 - protein, 9 aa, Homo Sapiens
CSSNNPLFT

SEQ ID NO: 457689 - protein, 9 aa, Homo Sapiens
ILLKQHART

SEQ ID NO: 457690 - protein, 9 aa, Homo Sapiens
MEMERVFEM

SEQ ID NO: 457691 - protein, 9 aa, Homo Sapiens
SVMPTPMPH

SEQ ID NO: 457692 - protein, 9 aa, Homo Sapiens
SSDDEDKDS

SEQ ID NO: 457693 - protein, 9 aa, Homo Sapiens
GETITDLEN

SEQ ID NO: 457694 - protein, 9 aa, Homo Sapiens
VSRKGTIEE

SEQ ID NO: 457695 - protein, 9 aa, Homo Sapiens
INSIVLEFT

SEQ ID NO: 457696 - protein, 9 aa, Homo Sapiens
MVRDYMRQT

SEQ ID NO: 457697 - protein, 9 aa, Homo Sapiens
LKQHARTQE

SEQ ID NO: 457698 - protein, 9 aa, Homo Sapiens
FVSVMPTPM

SEQ ID NO: 457699 - protein, 9 aa, Homo Sapiens
KLSLPESLK

SEQ ID NO: 457700 - protein, 9 aa, Homo Sapiens
RITTGSTLC

SEQ ID NO: 457701 - protein, 9 aa, Homo Sapiens
FKLVSTYRN

SEQ ID NO: 457702 - protein, 9 aa, Homo Sapiens
REELKSTDT

SEQ ID NO: 457703 - protein, 9 aa, Homo Sapiens
QSVFQASKE

SEQ ID NO: 457704 - protein, 9 aa, Homo Sapiens
CNPNTIFSQ

SEQ ID NO: 457705 - protein, 9 aa, Homo Sapiens
SGMCKVGFA

SEQ ID NO: 457706 - protein, 9 aa, Homo Sapiens
CCQRAPDSC

SEQ ID NO: 457707 - protein, 9 aa, Homo Sapiens
RKGTIEELR

SEQ ID NO: 457708 - protein, 9 aa, Homo Sapiens
LWIWQYQEK

SEQ ID NO: 457709 - protein, 9 aa, Homo Sapiens
VSTYRNYYS

SEQ ID NO: 457710 - protein, 9 aa, Homo Sapiens
IHQDLRAAN

SEQ ID NO: 457711 - protein, 9 aa, Homo Sapiens
SPASFPRPS

SEQ ID NO: 457712 - protein, 9 aa, Homo Sapiens
GLKGQMIYI

SEQ ID NO: 457713 - protein, 9 aa, Homo Sapiens
KSQFKVLSH

SEQ ID NO: 457714 - protein, 9 aa, Homo Sapiens
VKDNLDYEE

SEQ ID NO: 457715 - protein, 9 aa, Homo Sapiens
SFPLTLLIT

SEQ ID NO: 457716 - protein, 9 aa, Homo Sapiens
ELVGPFVSV

SEQ ID NO: 457717 - protein, 9 aa, Homo Sapiens
KFSGCGGRR

SEQ ID NO: 457718 - protein, 9 aa, Homo Sapiens
QLYHLEMEF

SEQ ID NO: 457719 - protein, 9 aa, Homo Sapiens
VLPFKIYYH

SEQ ID NO: 457720 - protein, 9 aa, Homo Sapiens
QPGAVRAQV

SEQ ID NO: 457721 - protein, 9 aa, Homo Sapiens
YMRQTWKLE

SEQ ID NO: 457722 - protein, 9 aa, Homo Sapiens
PLLLLLLGV

SEQ ID NO: 457723 - protein, 9 aa, Homo Sapiens
TKGTGASAS

SEQ ID NO: 457724 - protein, 9 aa, Homo Sapiens
YQLQPHPQP

SEQ ID NO: 457725 - protein, 9 aa, Homo Sapiens
EDLLLDSEA

SEQ ID NO: 457726 - protein, 9 aa, Homo Sapiens
GVPPLRPVP

SEQ ID NO: 457727 - protein, 9 aa, Homo Sapiens
TRIVTTLIN

SEQ ID NO: 457728 - protein, 9 aa, Homo Sapiens
FLSAKKVIS

SEQ ID NO: 457729 - protein, 9 aa, Homo Sapiens
DFEVRSPVG

SEQ ID NO: 457730 - protein, 9 aa, Homo Sapiens
MFRNKKKKR

SEQ ID NO: 457731 - protein, 9 aa, Homo Sapiens
GLWIWQYQE

SEQ ID NO: 457732 - protein, 9 aa, Homo Sapiens
TGTLLMTLE

SEQ ID NO: 457733 - protein, 9 aa, Homo Sapiens
RHAFCTDCA

SEQ ID NO: 457734 - protein, 9 aa, Homo Sapiens
SSNNPLFTA

SEQ ID NO: 457735 - protein, 9 aa, Homo Sapiens
LSAKKVISY

SEQ ID NO: 457736 - protein, 9 aa, Homo Sapiens
LASVLPFKI

SEQ ID NO: 457737 - protein, 9 aa, Homo Sapiens
HFSRGCPQL

SEQ ID NO: 457738 - protein, 9 aa, Homo Sapiens
EKKVTWADL

SEQ ID NO: 457739 - protein, 9 aa, Homo Sapiens
YPGMSIQGE

SEQ ID NO: 457740 - protein, 9 aa, Homo Sapiens
LKYVHPGGG

SEQ ID NO: 457741 - protein, 9 aa, Homo Sapiens
SSCSSRPVS

SEQ ID NO: 457742 - protein, 9 aa, Homo Sapiens
AYLTVRGVP

SEQ ID NO: 457743 - protein, 9 aa, Homo Sapiens
PLSLSGLEA

SEQ ID NO: 457744 - protein, 9 aa, Homo Sapiens
NELTSDLDH

SEQ ID NO: 457745 - protein, 9 aa, Homo Sapiens
RGSHFSRGC

SEQ ID NO: 457746 - protein, 9 aa, Homo Sapiens
VLYFPSVGY

SEQ ID NO: 457747 - protein, 9 aa, Homo Sapiens
SDDNFCKAV

SEQ ID NO: 457748 - protein, 9 aa, Homo Sapiens
GRDPGLMHG

SEQ ID NO: 457749 - protein, 9 aa, Homo Sapiens
SPVGCGHFA

SEQ ID NO: 457750 - protein, 9 aa, Homo Sapiens
LALGSGLYA

SEQ ID NO: 457751 - protein, 9 aa, Homo Sapiens
LQPHPQPPP

SEQ ID NO: 457752 - protein, 9 aa, Homo Sapiens
KTIPLYNFT

SEQ ID NO: 457753 - protein, 9 aa, Homo Sapiens
KDFEVRSPV

SEQ ID NO: 457754 - protein, 9 aa, Homo Sapiens
SGLYAPHKG

SEQ ID NO: 457755 - protein, 9 aa, Homo Sapiens
EDVRYVILG

SEQ ID NO: 457756 - protein, 9 aa, Homo Sapiens
VRNRSGCPT

SEQ ID NO: 457757 - protein, 9 aa, Homo Sapiens
TPENPSKEI

SEQ ID NO: 457758 - protein, 9 aa, Homo Sapiens
ALGSGLYAP

SEQ ID NO: 457759 - protein, 9 aa, Homo Sapiens
GRVEVGIHE

SEQ ID NO: 457760 - protein, 9 aa, Homo Sapiens
YYQVRCPSH

SEQ ID NO: 457761 - protein, 9 aa, Homo Sapiens
MKPSKCFFI

SEQ ID NO: 457762 - protein, 9 aa, Homo Sapiens
NLNFQAGDR

SEQ ID NO: 457763 - protein, 9 aa, Homo Sapiens
LEKPSKGSG

SEQ ID NO: 457764 - protein, 9 aa, Homo Sapiens
FQLHSICYL

SEQ ID NO: 457765 - protein, 9 aa, Homo Sapiens
IMKKKDGNR

SEQ ID NO: 457766 - protein, 9 aa, Homo Sapiens
NEIEMITGL

SEQ ID NO: 457767 - protein, 9 aa, Homo Sapiens
VMPTPMPHN

SEQ ID NO: 457768 - protein, 9 aa, Homo Sapiens
PSWEEHTTC

SEQ ID NO: 457769 - protein, 9 aa, Homo Sapiens
LEAAHPACG

SEQ ID NO: 457770 - protein, 9 aa, Homo Sapiens
KSRTSTLRL

SEQ ID NO: 457771 - protein, 9 aa, Homo Sapiens
IGKALRYLG

SEQ ID NO: 457772 - protein, 9 aa, Homo Sapiens
CWNPPTTAQ

SEQ ID NO: 457773 - protein, 9 aa, Homo Sapiens
PGLKYVHPG

SEQ ID NO: 457774 - protein, 9 aa, Homo Sapiens
LSLHEKDLS

SEQ ID NO: 457775 - protein, 9 aa, Homo Sapiens
DRSVVVPVR

SEQ ID NO: 457776 - protein, 9 aa, Homo Sapiens
MERGSHFSR

SEQ ID NO: 457777 - protein, 9 aa, Homo Sapiens
RFYTRAATM

SEQ ID NO: 457778 - protein, 9 aa, Homo Sapiens
NCWNPPTTA

SEQ ID NO: 457779 - protein, 9 aa, Homo Sapiens
ALSTALSLH

SEQ ID NO: 457780 - protein, 9 aa, Homo Sapiens
SKCFFISPP

SEQ ID NO: 457781 - protein, 9 aa, Homo Sapiens
KKDGNRDSN

SEQ ID NO: 457782 - protein, 9 aa, Homo Sapiens
RDSNGAKKN

SEQ ID NO: 457783 - protein, 9 aa, Homo Sapiens
KSFPHGIPF

SEQ ID NO: 457784 - protein, 9 aa, Homo Sapiens
DYMSHIIER

SEQ ID NO: 457785 - protein, 9 aa, Homo Sapiens
FSGCGGRRL

SEQ ID NO: 457786 - protein, 9 aa, Homo Sapiens
HVYLEGLTD

SEQ ID NO: 457787 - protein, 9 aa, Homo Sapiens
VRGVPEKPQ

SEQ ID NO: 457788 - protein, 9 aa, Homo Sapiens
TQHGKNCTA

SEQ ID NO: 457789 - protein, 9 aa, Homo Sapiens
EVDETRTCY

SEQ ID NO: 457790 - protein, 9 aa, Homo Sapiens
NNPLFTAAL

SEQ ID NO: 457791 - protein, 9 aa, Homo Sapiens
ALEDLLLDS

SEQ ID NO: 457792 - protein, 9 aa, Homo Sapiens
EKIMKLSLP

SEQ ID NO: 457793 - protein, 9 aa, Homo Sapiens
IPLYNFTGL

SEQ ID NO: 457794 - protein, 9 aa, Homo Sapiens
TQIQSVEPF

SEQ ID NO: 457795 - protein, 9 aa, Homo Sapiens
IMYQTQVQD

SEQ ID NO: 457796 - protein, 9 aa, Homo Sapiens
VKAFNRHCN

SEQ ID NO: 457797 - protein, 9 aa, Homo Sapiens
RDPFRKGLN

SEQ ID NO: 457798 - protein, 9 aa, Homo Sapiens
VSVMPTPMP

SEQ ID NO: 457799 - protein, 9 aa, Homo Sapiens
IQKFSGCGG

SEQ ID NO: 457800 - protein, 9 aa, Homo Sapiens
GHGLWIWQY

SEQ ID NO: 457801 - protein, 9 aa, Homo Sapiens
LPINSDDNF

SEQ ID NO: 457802 - protein, 9 aa, Homo Sapiens
HGLWIWQYQ

SEQ ID NO: 457803 - protein, 9 aa, Homo Sapiens
AKIIRNPGS

SEQ ID NO: 457804 - protein, 9 aa, Homo Sapiens
TRTCYRMVG

SEQ ID NO: 457805 - protein, 9 aa, Homo Sapiens
TSATSQVYW

SEQ ID NO: 457806 - protein, 9 aa, Homo Sapiens
FNRHCNMVL

SEQ ID NO: 457807 - protein, 9 aa, Homo Sapiens
GKTCGTGPG

SEQ ID NO: 457808 - protein, 9 aa, Homo Sapiens
RTSTLRLLT

SEQ ID NO: 457809 - protein, 9 aa, Homo Sapiens
NDYYHQRRQ

SEQ ID NO: 457810 - protein, 9 aa, Homo Sapiens
HLEMEFQRC

SEQ ID NO: 457811 - protein, 9 aa, Homo Sapiens
LMPDPKSFP

SEQ ID NO: 457812 - protein, 9 aa, Homo Sapiens
NPGSAKVQS

SEQ ID NO: 457813 - protein, 9 aa, Homo Sapiens
SSTSATSQV

SEQ ID NO: 457814 - protein, 9 aa, Homo Sapiens
LVSTYRNYY

SEQ ID NO: 457815 - protein, 9 aa, Homo Sapiens
FPHQPSALD

SEQ ID NO: 457816 - protein, 9 aa, Homo Sapiens
ETRTCYRMV

SEQ ID NO: 457817 - protein, 9 aa, Homo Sapiens
RRHSVSMRR

SEQ ID NO: 457818 - protein, 9 aa, Homo Sapiens
CSFFVLLSW

SEQ ID NO: 457819 - protein, 9 aa, Homo Sapiens
PNTIFSQSK

SEQ ID NO: 457820 - protein, 9 aa, Homo Sapiens
GASASFKLN

SEQ ID NO: 457821 - protein, 9 aa, Homo Sapiens
ASNARGNAT

SEQ ID NO: 457822 - protein, 9 aa, Homo Sapiens
SIQGEDLYL

SEQ ID NO: 457823 - protein, 9 aa, Homo Sapiens
QEECSSNNP

SEQ ID NO: 457824 - protein, 9 aa, Homo Sapiens
MVNIENLEG

SEQ ID NO: 457825 - protein, 9 aa, Homo Sapiens
GRLMPDPKS

SEQ ID NO: 457826 - protein, 9 aa, Homo Sapiens
RYLGTFGEL

SEQ ID NO: 457827 - protein, 9 aa, Homo Sapiens
CSGRVEVGI

SEQ ID NO: 457828 - protein, 9 aa, Homo Sapiens
ELKSTDTIF

SEQ ID NO: 457829 - protein, 9 aa, Homo Sapiens
SVALAVLAP

SEQ ID NO: 457830 - protein, 9 aa, Homo Sapiens
ITTGSTLCD

SEQ ID NO: 457831 - protein, 9 aa, Homo Sapiens
LLTASLLNC

SEQ ID NO: 457832 - protein, 9 aa, Homo Sapiens
KHHWFLEKP

SEQ ID NO: 457833 - protein, 9 aa, Homo Sapiens
EHTTCLANA

SEQ ID NO: 457834 - protein, 9 aa, Homo Sapiens
RPVPPERVV

SEQ ID NO: 457835 - protein, 9 aa, Homo Sapiens
TLDSYRNEK

SEQ ID NO: 457836 - protein, 9 aa, Homo Sapiens
VPPERVVAV

SEQ ID NO: 457837 - protein, 9 aa, Homo Sapiens
EPQLEAAHP

SEQ ID NO: 457838 - protein, 9 aa, Homo Sapiens
TGPGLAAVF

SEQ ID NO: 457839 - protein, 9 aa, Homo Sapiens
RAMDGPRPL

SEQ ID NO: 457840 - protein, 9 aa, Homo Sapiens
CGTGPGLAA

SEQ ID NO: 457841 - protein, 9 aa, Homo Sapiens
FPLTLLITL

SEQ ID NO: 457842 - protein, 9 aa, Homo Sapiens
ERVFEMKVK

SEQ ID NO: 457843 - protein, 9 aa, Homo Sapiens
AVLAPLSLS

SEQ ID NO: 457844 - protein, 9 aa, Homo Sapiens
AVIEDDSLH

SEQ ID NO: 457845 - protein, 9 aa, Homo Sapiens
MREMRAGGC

SEQ ID NO: 457846 - protein, 9 aa, Homo Sapiens
YAPHKGPLP

SEQ ID NO: 457847 - protein, 9 aa, Homo Sapiens
HSICYLLGQ

SEQ ID NO: 457848 - protein, 9 aa, Homo Sapiens
APDSCESHC

SEQ ID NO: 457849 - protein, 9 aa, Homo Sapiens
RAMRIRAPI

SEQ ID NO: 457850 - protein, 9 aa, Homo Sapiens
RHSVSMRRM

SEQ ID NO: 457851 - protein, 9 aa, Homo Sapiens
VSIREELKS

SEQ ID NO: 457852 - protein, 9 aa, Homo Sapiens
VSSKGEKKV

SEQ ID NO: 457853 - protein, 9 aa, Homo Sapiens
IASNARGNA

SEQ ID NO: 457854 - protein, 9 aa, Homo Sapiens
PDPKSFPHG

SEQ ID NO: 457855 - protein, 9 aa, Homo Sapiens
VEVLLLRAM

SEQ ID NO: 457856 - protein, 9 aa, Homo Sapiens
GIHEQWWTI

SEQ ID NO: 457857 - protein, 9 aa, Homo Sapiens
SRVNLVLRN

SEQ ID NO: 457858 - protein, 9 aa, Homo Sapiens
INSDDNFCK

SEQ ID NO: 457859 - protein, 9 aa, Homo Sapiens
QHGKNCTAG

SEQ ID NO: 457860 - protein, 9 aa, Homo Sapiens
PYHINFIFT

SEQ ID NO: 457861 - protein, 9 aa, Homo Sapiens
TAALSTALS

SEQ ID NO: 457862 - protein, 9 aa, Homo Sapiens
CATGFCCHC

SEQ ID NO: 457863 - protein, 9 aa, Homo Sapiens
RRHAEHHAR

SEQ ID NO: 457864 - protein, 9 aa, Homo Sapiens
LLLRAMRIR

SEQ ID NO: 457865 - protein, 9 aa, Homo Sapiens
VGIHEQWWT

SEQ ID NO: 457866 - protein, 9 aa, Homo Sapiens
TYKHRMNTV

SEQ ID NO: 457867 - protein, 9 aa, Homo Sapiens
HCSSSCGRG

SEQ ID NO: 457868 - protein, 9 aa, Homo Sapiens
KEVDETRTC

SEQ ID NO: 457869 - protein, 9 aa, Homo Sapiens
SQEECSSNN

SEQ ID NO: 457870 - protein, 9 aa, Homo Sapiens
SNEYFNFDW

SEQ ID NO: 457871 - protein, 9 aa, Homo Sapiens
IFSQSKYSE

SEQ ID NO: 457872 - protein, 9 aa, Homo Sapiens
SFFVLLSWL

SEQ ID NO: 457873 - protein, 9 aa, Homo Sapiens
VTTLINSIV

SEQ ID NO: 457874 - protein, 9 aa, Homo Sapiens
PKAVGRQLY

SEQ ID NO: 457875 - protein, 9 aa, Homo Sapiens
GAVRAQVLK

SEQ ID NO: 457876 - protein, 9 aa, Homo Sapiens
EKAYLNKLQ

SEQ ID NO: 457877 - protein, 9 aa, Homo Sapiens
TIPLYNFTG

SEQ ID NO: 457878 - protein, 9 aa, Homo Sapiens
PSALDYSPS

SEQ ID NO: 457879 - protein, 9 aa, Homo Sapiens
MERVFEMKV

SEQ ID NO: 457880 - protein, 9 aa, Homo Sapiens
NIENLEGIP

SEQ ID NO: 457881 - protein, 9 aa, Homo Sapiens
DNGQKYRII

SEQ ID NO: 457882 - protein, 9 aa, Homo Sapiens
SIHPGWADT

SEQ ID NO: 457883 - protein, 9 aa, Homo Sapiens
KDGNRDSNG

SEQ ID NO: 457884 - protein, 9 aa, Homo Sapiens
KCFFISPPS

SEQ ID NO: 457885 - protein, 9 aa, Homo Sapiens
VGHGLWIWQ

SEQ ID NO: 457886 - protein, 9 aa, Homo Sapiens
PGAVRAQVL

SEQ ID NO: 457887 - protein, 9 aa, Homo Sapiens
PSYFIMYQT

SEQ ID NO: 457888 - protein, 9 aa, Homo Sapiens
IEKPKAVGR

SEQ ID NO: 457889 - protein, 9 aa, Homo Sapiens
LRRGRDPGL

SEQ ID NO: 457890 - protein, 9 aa, Homo Sapiens
MHRFYTRAA

SEQ ID NO: 457891 - protein, 9 aa, Homo Sapiens
ITPENPSKE

SEQ ID NO: 457892 - protein, 9 aa, Homo Sapiens
VSNLQSVFQ

SEQ ID NO: 457893 - protein, 9 aa, Homo Sapiens
GKVSKSQFK

SEQ ID NO: 457894 - protein, 9 aa, Homo Sapiens
FLEKPSKGS

SEQ ID NO: 457895 - protein, 9 aa, Homo Sapiens
LTLLITLLS

SEQ ID NO: 457896 - protein, 9 aa, Homo Sapiens
VRKPPPGSL

SEQ ID NO: 457897 - protein, 9 aa, Homo Sapiens
YVNGGNLMY

SEQ ID NO: 457898 - protein, 9 aa, Homo Sapiens
LAPLSLSGL

SEQ ID NO: 457899 - protein, 9 aa, Homo Sapiens
WTPWVSWTH

SEQ ID NO: 457900 - protein, 9 aa, Homo Sapiens
KKDDFTMQI

SEQ ID NO: 457901 - protein, 9 aa, Homo Sapiens
PKSFPHGIP

SEQ ID NO: 457902 - protein, 9 aa, Homo Sapiens
RDYMRQTWK

SEQ ID NO: 457903 - protein, 9 aa, Homo Sapiens
LLMTLEDVN

SEQ ID NO: 457904 - protein, 9 aa, Homo Sapiens
GQKYRIIMN

SEQ ID NO: 457905 - protein, 9 aa, Homo Sapiens
IPKYTCPDL

SEQ ID NO: 457906 - protein, 9 aa, Homo Sapiens
AMDGPRPLL

SEQ ID NO: 457907 - protein, 9 aa, Homo Sapiens
SRTSTLRLL

SEQ ID NO: 457908 - protein, 9 aa, Homo Sapiens
FSSIHPGWA

SEQ ID NO: 457909 - protein, 9 aa, Homo Sapiens
PLRPVPPER

SEQ ID NO: 457910 - protein, 9 aa, Homo Sapiens
AHPACGACG

SEQ ID NO: 457911 - protein, 9 aa, Homo Sapiens
TCYRMVGGV

SEQ ID NO: 457912 - protein, 9 aa, Homo Sapiens
LINSIVLEF

SEQ ID NO: 457913 - protein, 9 aa, Homo Sapiens
DNLDYEENG

SEQ ID NO: 457914 - protein, 9 aa, Homo Sapiens
SVEPFTKQQ

SEQ ID NO: 457915 - protein, 9 aa, Homo Sapiens
SLHAAFTVA

SEQ ID NO: 457916 - protein, 9 aa, Homo Sapiens
DYQKKKDDF

SEQ ID NO: 457917 - protein, 9 aa, Homo Sapiens
VPPLRPVPP

SEQ ID NO: 457918 - protein, 9 aa, Homo Sapiens
IQGEDLYLV

SEQ ID NO: 457919 - protein, 9 aa, Homo Sapiens
MRAGGCCHA

SEQ ID NO: 457920 - protein, 9 aa, Homo Sapiens
FNLGKIGRE

SEQ ID NO: 457921 - protein, 9 aa, Homo Sapiens
QTKGTGASA

SEQ ID NO: 457922 - protein, 9 aa, Homo Sapiens
PADDQEFWH

SEQ ID NO: 457923 - protein, 9 aa, Homo Sapiens
NVVDFTTHY

SEQ ID NO: 457924 - protein, 9 aa, Homo Sapiens
HHWFLEKPS

SEQ ID NO: 457925 - protein, 9 aa, Homo Sapiens
TLLMTLEDV

SEQ ID NO: 457926 - protein, 9 aa, Homo Sapiens
QVLKGASRA

SEQ ID NO: 457927 - protein, 9 aa, Homo Sapiens
ITKSEKLVR

SEQ ID NO: 457928 - protein, 9 aa, Homo Sapiens
TCPDLVTRP

SEQ ID NO: 457929 - protein, 9 aa, Homo Sapiens
EVRRLFRTN

SEQ ID NO: 457930 - protein, 9 aa, Homo Sapiens
SFPHGIPFL

SEQ ID NO: 457931 - protein, 9 aa, Homo Sapiens
ALSLHEKDL

SEQ ID NO: 457932 - protein, 9 aa, Homo Sapiens
QPSALDYSP

SEQ ID NO: 457933 - protein, 9 aa, Homo Sapiens
REEEERRRH

SEQ ID NO: 457934 - protein, 9 aa, Homo Sapiens
SGKVSKSQF

SEQ ID NO: 457935 - protein, 9 aa, Homo Sapiens
HSVSMRRMV

SEQ ID NO: 457936 - protein, 9 aa, Homo Sapiens
VLLLRAMRI

SEQ ID NO: 457937 - protein, 9 aa, Homo Sapiens
ILCLSNNEI

SEQ ID NO: 457938 - protein, 9 aa, Homo Sapiens
MKTIPLYNF

SEQ ID NO: 457939 - protein, 9 aa, Homo Sapiens
YIHQDLRAA

SEQ ID NO: 457940 - protein, 9 aa, Homo Sapiens
NGQKYRIIM

SEQ ID NO: 457941 - protein, 9 aa, Homo Sapiens
CATPGPADD

SEQ ID NO: 457942 - protein, 9 aa, Homo Sapiens
WTHCSSSCG

SEQ ID NO: 457943 - protein, 9 aa, Homo Sapiens
CQRAPDSCE

SEQ ID NO: 457944 - protein, 9 aa, Homo Sapiens
KIQKFSGCG

SEQ ID NO: 457945 - protein, 9 aa, Homo Sapiens
RGRAKIIRN

SEQ ID NO: 457946 - protein, 9 aa, Homo Sapiens
TDLENRFLS

SEQ ID NO: 457947 - protein, 9 aa, Homo Sapiens
EERRRHAEH

SEQ ID NO: 457948 - protein, 9 aa, Homo Sapiens
KYTCPDLVT

SEQ ID NO: 457949 - protein, 9 aa, Homo Sapiens
LEGIPVKQD

SEQ ID NO: 457950 - protein, 9 aa, Homo Sapiens
HSKSRTSTL

SEQ ID NO: 457951 - protein, 9 aa, Homo Sapiens
VRRLFRTNM

SEQ ID NO: 457952 - protein, 9 aa, Homo Sapiens
TVMVNIENL

SEQ ID NO: 457953 - protein, 9 aa, Homo Sapiens
ETSNEYFNF

SEQ ID NO: 457954 - protein, 9 aa, Homo Sapiens
TSKAYLTVR

SEQ ID NO: 457955 - protein, 9 aa, Homo Sapiens
QASKELKQR

SEQ ID NO: 457956 - protein, 9 aa, Homo Sapiens
LSRITTGST

SEQ ID NO: 457957 - protein, 9 aa, Homo Sapiens
YYHQRRQKT

SEQ ID NO: 457958 - protein, 9 aa, Homo Sapiens
LHSICYLLG

SEQ ID NO: 457959 - protein, 9 aa, Homo Sapiens
DHSSTSATS

SEQ ID NO: 457960 - protein, 9 aa, Homo Sapiens
FIMYQTQVQ

SEQ ID NO: 457961 - protein, 9 aa, Homo Sapiens
GRQLYYKSR

SEQ ID NO: 457962 - protein, 9 aa, Homo Sapiens
TPWVSWTHC

SEQ ID NO: 457963 - protein, 9 aa, Homo Sapiens
VIGKALRYL

SEQ ID NO: 457964 - protein, 9 aa, Homo Sapiens
AVYQLQPHP

SEQ ID NO: 457965 - protein, 9 aa, Homo Sapiens
LLCGMREMR

SEQ ID NO: 457966 - protein, 9 aa, Homo Sapiens
KAYLTVRGV

SEQ ID NO: 457967 - protein, 9 aa, Homo Sapiens
NEYFNFDWV

SEQ ID NO: 457968 - protein, 9 aa, Homo Sapiens
KVSKSQFKV

SEQ ID NO: 457969 - protein, 9 aa, Homo Sapiens
IDSALNMVQ

SEQ ID NO: 457970 - protein, 9 aa, Homo Sapiens
SMRRMVALY

SEQ ID NO: 457971 - protein, 9 aa, Homo Sapiens
RNRSGCPTV

SEQ ID NO: 457972 - protein, 9 aa, Homo Sapiens
QSVEPFTKQ

SEQ ID NO: 457973 - protein, 9 aa, Homo Sapiens
LYNFTGLSV

SEQ ID NO: 457974 - protein, 9 aa, Homo Sapiens
KEAITKSEK

SEQ ID NO: 457975 - protein, 9 aa, Homo Sapiens
DVSRKGTIE

SEQ ID NO: 457976 - protein, 9 aa, Homo Sapiens
TLLSSPLYS

SEQ ID NO: 457977 - protein, 9 aa, Homo Sapiens
LLEVVEPED

SEQ ID NO: 457978 - protein, 9 aa, Homo Sapiens
KIMKLSLPE

SEQ ID NO: 457979 - protein, 9 aa, Homo Sapiens
GSHFSRGCP

SEQ ID NO: 457980 - protein, 9 aa, Homo Sapiens
ESEKLHRQK

SEQ ID NO: 457981 - protein, 9 aa, Homo Sapiens
MSIQGEDLY

SEQ ID NO: 457982 - protein, 9 aa, Homo Sapiens
SFPRPSATP

SEQ ID NO: 457983 - protein, 9 aa, Homo Sapiens
KGTGASASF

SEQ ID NO: 457984 - protein, 9 aa, Homo Sapiens
GKALRYLGT

SEQ ID NO: 457985 - protein, 9 aa, Homo Sapiens
LQSVFQASK

SEQ ID NO: 457986 - protein, 9 aa, Homo Sapiens
PRPSATPPA

SEQ ID NO: 457987 - protein, 9 aa, Homo Sapiens
SVSMRRMVA

SEQ ID NO: 457988 - protein, 9 aa, Homo Sapiens
VRAQVLKGA

SEQ ID NO: 457989 - protein, 9 aa, Homo Sapiens
RAQVLKGAS

SEQ ID NO: 457990 - protein, 9 aa, Homo Sapiens
SKEIIGGTS

SEQ ID NO: 457991 - protein, 9 aa, Homo Sapiens
LHDNGQKYR

SEQ ID NO: 457992 - protein, 9 aa, Homo Sapiens
GMSIQGEDL

SEQ ID NO: 457993 - protein, 9 aa, Homo Sapiens
RSPVGCGHF

SEQ ID NO: 457994 - protein, 9 aa, Homo Sapiens
IGREVNGCS

SEQ ID NO: 457995 - protein, 9 aa, Homo Sapiens
ESSDDEDKD

SEQ ID NO: 457996 - protein, 9 aa, Homo Sapiens
PALEDLLLD

SEQ ID NO: 457997 - protein, 9 aa, Homo Sapiens
KLHRQKDSD

SEQ ID NO: 457998 - protein, 9 aa, Homo Sapiens
EGATGGLLR

SEQ ID NO: 457999 - protein, 9 aa, Homo Sapiens
SDLDHSGIP

SEQ ID NO: 458000 - protein, 9 aa, Homo Sapiens
SEKLHRQKD

SEQ ID NO: 458001 - protein, 9 aa, Homo Sapiens
NHSKSRTST

SEQ ID NO: 458002 - protein, 9 aa, Homo Sapiens
TPGPADDQE

SEQ ID NO: 458003 - protein, 9 aa, Homo Sapiens
KMEMEMERV

SEQ ID NO: 458004 - protein, 9 aa, Homo Sapiens
EEERRRHAE

SEQ ID NO: 458005 - protein, 9 aa, Homo Sapiens
MGLKGQMIY

SEQ ID NO: 458006 - protein, 9 aa, Homo Sapiens
ASFKLNKKA

SEQ ID NO: 458007 - protein, 9 aa, Homo Sapiens
VKKSSRVMG

SEQ ID NO: 458008 - protein, 9 aa, Homo Sapiens
VSQGLLTFR

SEQ ID NO: 458009 - protein, 9 aa, Homo Sapiens
NKKKKRPEI

SEQ ID NO: 458010 - protein, 9 aa, Homo Sapiens
SQFKVLSHN

SEQ ID NO: 458011 - protein, 9 aa, Homo Sapiens
VGPFVSVMP

SEQ ID NO: 458012 - protein, 9 aa, Homo Sapiens
SCSSRPVSS

SEQ ID NO: 458013 - protein, 9 aa, Homo Sapiens
GLYAPHKGP

SEQ ID NO: 458014 - protein, 9 aa, Homo Sapiens
DFTTHYMDY

SEQ ID NO: 458015 - protein, 9 aa, Homo Sapiens
STALSLHEK

SEQ ID NO: 458016 - protein, 9 aa, Homo Sapiens
ANDYYHQRR

SEQ ID NO: 458017 - protein, 9 aa, Homo Sapiens
GDLLPINSD

SEQ ID NO: 458018 - protein, 9 aa, Homo Sapiens
RVKDNLDYE

SEQ ID NO: 458019 - protein, 9 aa, Homo Sapiens
DYSPSLRIL

SEQ ID NO: 458020 - protein, 9 aa, Homo Sapiens
TAEQLYHLE

SEQ ID NO: 458021 - protein, 9 aa, Homo Sapiens
LDYSPSLRI

SEQ ID NO: 458022 - protein, 9 aa, Homo Sapiens
QDIPKYTCP

SEQ ID NO: 458023 - protein, 9 aa, Homo Sapiens
PVSSPSAPS

SEQ ID NO: 458024 - protein, 9 aa, Homo Sapiens
ATPGPADDQ

SEQ ID NO: 458025 - protein, 9 aa, Homo Sapiens
DYMRQTWKL

SEQ ID NO: 458026 - protein, 9 aa, Homo Sapiens
TALSLHEKD

SEQ ID NO: 458027 - protein, 9 aa, Homo Sapiens
PLALGSGLY

SEQ ID NO: 458028 - protein, 9 aa, Homo Sapiens
GTLLMTLED

SEQ ID NO: 458029 - protein, 9 aa, Homo Sapiens
NLGKIGREV

SEQ ID NO: 458030 - protein, 9 aa, Homo Sapiens
DETRTCYRM

SEQ ID NO: 458031 - protein, 9 aa, Homo Sapiens
SDLKDLLWN

SEQ ID NO: 458032 - protein, 9 aa, Homo Sapiens
AFNRHCNMV

SEQ ID NO: 458033 - protein, 9 aa, Homo Sapiens
TGLIRVKDN

SEQ ID NO: 458034 - protein, 9 aa, Homo Sapiens
MAVSQGLLT

SEQ ID NO: 458035 - protein, 9 aa, Homo Sapiens
GRRHSVSMR

SEQ ID NO: 458036 - protein, 9 aa, Homo Sapiens
EGTKAVTEY

SEQ ID NO: 458037 - protein, 9 aa, Homo Sapiens
PHQPSALDY

SEQ ID NO: 458038 - protein, 9 aa, Homo Sapiens
ALRYLGTFG

SEQ ID NO: 458039 - protein, 9 aa, Homo Sapiens
KSSRVMGLK

SEQ ID NO: 458040 - protein, 9 aa, Homo Sapiens
STYRNYYSL

SEQ ID NO: 458041 - protein, 9 aa, Homo Sapiens
EEVRRLFRT

SEQ ID NO: 458042 - protein, 9 aa, Homo Sapiens
MKNNHSKSR

SEQ ID NO: 458043 - protein, 9 aa, Homo Sapiens
PLTLLITLL

SEQ ID NO: 458044 - protein, 9 aa, Homo Sapiens
ITDLENRFL

SEQ ID NO: 458045 - protein, 9 aa, Homo Sapiens
DHSGIPYLD

SEQ ID NO: 458046 - protein, 9 aa, Homo Sapiens
QQPGNLNFQ

SEQ ID NO: 458047 - protein, 9 aa, Homo Sapiens
PDSCESHCA

SEQ ID NO: 458048 - protein, 9 aa, Homo Sapiens
ALDYSPSLR

SEQ ID NO: 458049 - protein, 9 aa, Homo Sapiens
PINSDDNFC

SEQ ID NO: 458050 - protein, 9 aa, Homo Sapiens
HTTCLANAE

SEQ ID NO: 458051 - protein, 9 aa, Homo Sapiens
SALNMVQTL

SEQ ID NO: 458052 - protein, 9 aa, Homo Sapiens
RSVVVPVRK

SEQ ID NO: 458053 - protein, 9 aa, Homo Sapiens
RVEVGIHEQ

SEQ ID NO: 458054 - protein, 9 aa, Homo Sapiens
EEHTTCLAN

SEQ ID NO: 458055 - protein, 9 aa, Homo Sapiens
ADDQEFWHS

SEQ ID NO: 458056 - protein, 9 aa, Homo Sapiens
TTHYMDYSV

SEQ ID NO: 458057 - protein, 9 aa, Homo Sapiens
LTDASIFVH

SEQ ID NO: 458058 - protein, 9 aa, Homo Sapiens
KIGREVNGC

SEQ ID NO: 458059 - protein, 9 aa, Homo Sapiens
GSGLYAPHK

SEQ ID NO: 458060 - protein, 9 aa, Homo Sapiens
LLPINSDDN

SEQ ID NO: 458061 - protein, 9 aa, Homo Sapiens
APLSLSGLE

SEQ ID NO: 458062 - protein, 9 aa, Homo Sapiens
NTIFSQSKY

SEQ ID NO: 458063 - protein, 9 aa, Homo Sapiens
QHAWLPLII

SEQ ID NO: 458064 - protein, 9 aa, Homo Sapiens
VVRNRSGCP

SEQ ID NO: 458065 - protein, 9 aa, Homo Sapiens
IEDDSLHAA

SEQ ID NO: 458066 - protein, 9 aa, Homo Sapiens
IQERAKEAI

SEQ ID NO: 458067 - protein, 9 aa, Homo Sapiens
TAQYPGMSI

SEQ ID NO: 458068 - protein, 9 aa, Homo Sapiens
VYQLQPHPQ

SEQ ID NO: 458069 - protein, 9 aa, Homo Sapiens
YRNEKAYLN

SEQ ID NO: 458070 - protein, 9 aa, Homo Sapiens
GYYQVRCPS

SEQ ID NO: 458071 - protein, 9 aa, Homo Sapiens
ENVVDFTTH

SEQ ID NO: 458072 - protein, 9 aa, Homo Sapiens
LRPVPPERV

SEQ ID NO: 458073 - protein, 9 aa, Homo Sapiens
ERKNYIHQD

SEQ ID NO: 458074 - protein, 9 aa, Homo Sapiens
KAVGRQLYY

SEQ ID NO: 458075 - protein, 9 aa, Homo Sapiens
MTLEDVNDN

SEQ ID NO: 458076 - protein, 9 aa, Homo Sapiens
NMVQTLKNE

SEQ ID NO: 458077 - protein, 9 aa, Homo Sapiens
AIHFSSIHP

SEQ ID NO: 458078 - protein, 9 aa, Homo Sapiens
SALDYSPSL

SEQ ID NO: 458079 - protein, 9 aa, Homo Sapiens
SGRVEVGIH

SEQ ID NO: 458080 - protein, 9 aa, Homo Sapiens
EDVSRKGTI

SEQ ID NO: 458081 - protein, 9 aa, Homo Sapiens
VAERVLYFP

SEQ ID NO: 458082 - protein, 9 aa, Homo Sapiens
RIASNARGN

SEQ ID NO: 458083 - protein, 9 aa, Homo Sapiens
RAPDSCESH

SEQ ID NO: 458084 - protein, 9 aa, Homo Sapiens
LTSDLDHSG

SEQ ID NO: 458085 - protein, 9 aa, Homo Sapiens
CFQLHSICY

SEQ ID NO: 458086 - protein, 9 aa, Homo Sapiens
VLAPLSLSG

SEQ ID NO: 458087 - protein, 9 aa, Homo Sapiens
KLVSTYRNY

SEQ ID NO: 458088 - protein, 9 aa, Homo Sapiens
AQVLKGASR

SEQ ID NO: 458089 - protein, 9 aa, Homo Sapiens
QGYYQVRCP

SEQ ID NO: 458090 - protein, 9 aa, Homo Sapiens
DVRAAVYQL

SEQ ID NO: 458091 - protein, 9 aa, Homo Sapiens
LGKIGREVN

SEQ ID NO: 458092 - protein, 9 aa, Homo Sapiens
LLITLLSSP

SEQ ID NO: 458093 - protein, 9 aa, Homo Sapiens
WFLEKPSKG

SEQ ID NO: 458094 - protein, 9 aa, Homo Sapiens
DTSRVNLVL

SEQ ID NO: 458095 - protein, 9 aa, Homo Sapiens
DLDHSGIPY

SEQ ID NO: 458096 - protein, 9 aa, Homo Sapiens
HAFCTDCAT

SEQ ID NO: 458097 - protein, 9 aa, Homo Sapiens
SSIHPGWAD

SEQ ID NO: 458098 - protein, 9 aa, Homo Sapiens
RTQEDKIKR

SEQ ID NO: 458099 - protein, 9 aa, Homo Sapiens
ALNMVQTLK

SEQ ID NO: 458100 - protein, 9 aa, Homo Sapiens
EYVNGGNLM

SEQ ID NO: 458101 - protein, 9 aa, Homo Sapiens
VGRQLYYKS

SEQ ID NO: 458102 - protein, 9 aa, Homo Sapiens
VSWTHCSSS

SEQ ID NO: 458103 - protein, 9 aa, Homo Sapiens
VILGDDHLS

SEQ ID NO: 458104 - protein, 9 aa, Homo Sapiens
EPFTKQQLN

SEQ ID NO: 458105 - protein, 9 aa, Homo Sapiens
KYRIIMNPG

SEQ ID NO: 458106 - protein, 9 aa, Homo Sapiens
LADPCFQLH

SEQ ID NO: 458107 - protein, 9 aa, Homo Sapiens
MRRMVALYD

SEQ ID NO: 458108 - protein, 9 aa, Homo Sapiens
IEGATGGLL

SEQ ID NO: 458109 - protein, 9 aa, Homo Sapiens
ELTSDLDHS

SEQ ID NO: 458110 - protein, 9 aa, Homo Sapiens
SLLKIQKFS

SEQ ID NO: 458111 - protein, 9 aa, Homo Sapiens
SVFSSRSLC

SEQ ID NO: 458112 - protein, 9 aa, Homo Sapiens
PGAANDYYH

SEQ ID NO: 458113 - protein, 9 aa, Homo Sapiens
LITLLSSPL

SEQ ID NO: 458114 - protein, 9 aa, Homo Sapiens
ERVLYFPSV

SEQ ID NO: 458115 - protein, 9 aa, Homo Sapiens
SYRNEKAYL

SEQ ID NO: 458116 - protein, 9 aa, Homo Sapiens
KKKDDFTMQ

SEQ ID NO: 458117 - protein, 9 aa, Homo Sapiens
SKGEKKVTW

SEQ ID NO: 458118 - protein, 9 aa, Homo Sapiens
AANDYYHQR

SEQ ID NO: 458119 - protein, 9 aa, Homo Sapiens
TIEDVSRKG

SEQ ID NO: 458120 - protein, 9 aa, Homo Sapiens
YFPSVGYCV

SEQ ID NO: 458121 - protein, 9 aa, Homo Sapiens
LYFPSVGYC

SEQ ID NO: 458122 - protein, 9 aa, Homo Sapiens
RNKKKKRPE

SEQ ID NO: 458123 - protein, 9 aa, Homo Sapiens
QKYRIIMNP

SEQ ID NO: 458124 - protein, 9 aa, Homo Sapiens
LLKQHARTQ

SEQ ID NO: 458125 - protein, 9 aa, Homo Sapiens
KQHARTQED

SEQ ID NO: 458126 - protein, 9 aa, Homo Sapiens
KKSSRVMGL

SEQ ID NO: 458127 - protein, 9 aa, Homo Sapiens
LFLWIETSN

SEQ ID NO: 458128 - protein, 9 aa, Homo Sapiens
CGMREMRAG

SEQ ID NO: 458129 - protein, 9 aa, Homo Sapiens
GQQPGNLNF

SEQ ID NO: 458130 - protein, 9 aa, Homo Sapiens
LPFKIYYHC

SEQ ID NO: 458131 - protein, 9 aa, Homo Sapiens
KVGETITDL

SEQ ID NO: 458132 - protein, 9 aa, Homo Sapiens
YVILGDDHL

SEQ ID NO: 458133 - protein, 9 aa, Homo Sapiens
HSSTSATSQ

SEQ ID NO: 458134 - protein, 9 aa, Homo Sapiens
GNRDSNGAK

SEQ ID NO: 458135 - protein, 9 aa, Homo Sapiens
FCTDCATGF

SEQ ID NO: 458136 - protein, 9 aa, Homo Sapiens
TLGKDCETY

SEQ ID NO: 458137 - protein, 9 aa, Homo Sapiens
DDFTMQISF

SEQ ID NO: 458138 - protein, 9 aa, Homo Sapiens
APSWEEHTT

SEQ ID NO: 458139 - protein, 9 aa, Homo Sapiens
EKDHSSTSA

SEQ ID NO: 458140 - protein, 9 aa, Homo Sapiens
CLSNNEIEM

SEQ ID NO: 458141 - protein, 9 aa, Homo Sapiens
PSKEIIGGT

SEQ ID NO: 458142 - protein, 9 aa, Homo Sapiens
VDFLSAKKV

SEQ ID NO: 458143 - protein, 9 aa, Homo Sapiens
RRGRDPGLM

SEQ ID NO: 458144 - protein, 9 aa, Homo Sapiens
FEVRSPVGC

SEQ ID NO: 458145 - protein, 9 aa, Homo Sapiens
PASFPRPSA

SEQ ID NO: 458146 - protein, 9 aa, Homo Sapiens
KIYYHCNRH

SEQ ID NO: 458147 - protein, 9 aa, Homo Sapiens
SRKGTIEEL

SEQ ID NO: 458148 - protein, 9 aa, Homo Sapiens
ASASFKLNK

SEQ ID NO: 458149 - protein, 9 aa, Homo Sapiens
CFFISPPSS

SEQ ID NO: 458150 - protein, 9 aa, Homo Sapiens
MEIDSALNM

SEQ ID NO: 458151 - protein, 9 aa, Homo Sapiens
SSDLKDLLW

SEQ ID NO: 458152 - protein, 9 aa, Homo Sapiens
PLIIEIKDR

SEQ ID NO: 458153 - protein, 9 aa, Homo Sapiens
VNIENLEGI

SEQ ID NO: 458154 - protein, 9 aa, Homo Sapiens
VDETRTCYR

SEQ ID NO: 458155 - protein, 9 aa, Homo Sapiens
ACSFFVLLS

SEQ ID NO: 458156 - protein, 9 aa, Homo Sapiens
TEIEEEVRR

SEQ ID NO: 458157 - protein, 9 aa, Homo Sapiens
TGGLLRSTS

SEQ ID NO: 458158 - protein, 9 aa, Homo Sapiens
IETSNEYFN

SEQ ID NO: 458159 - protein, 9 aa, Homo Sapiens
RVNLVLRNC

SEQ ID NO: 458160 - protein, 9 aa, Homo Sapiens
CPSHEGYLA

SEQ ID NO: 458161 - protein, 9 aa, Homo Sapiens
CKVGFAGDD

SEQ ID NO: 458162 - protein, 9 aa, Homo Sapiens
LSTALSLHE

SEQ ID NO: 458163 - protein, 9 aa, Homo Sapiens
KKKDGNRDS

SEQ ID NO: 458164 - protein, 9 aa, Homo Sapiens
GLKYVHPGG

SEQ ID NO: 458165 - protein, 9 aa, Homo Sapiens
SKSQFKVLS

SEQ ID NO: 458166 - protein, 9 aa, Homo Sapiens
LPGLKYVHP

SEQ ID NO: 458167 - protein, 9 aa, Homo Sapiens
YQKKKDDFT

SEQ ID NO: 458168 - protein, 9 aa, Homo Sapiens
RAAVYQLQP

SEQ ID NO: 458169 - protein, 9 aa, Homo Sapiens
EEEVRRLFR

SEQ ID NO: 458170 - protein, 9 aa, Homo Sapiens
GMCKVGFAG

SEQ ID NO: 458171 - protein, 9 aa, Homo Sapiens
SNNPLFTAA

SEQ ID NO: 458172 - protein, 9 aa, Homo Sapiens
LQGYYQVRC

SEQ ID NO: 458173 - protein, 9 aa, Homo Sapiens
ALLCGMREM

SEQ ID NO: 458174 - protein, 9 aa, Homo Sapiens
TLINSIVLE

SEQ ID NO: 458175 - protein, 9 aa, Homo Sapiens
QVRCPSHEG

SEQ ID NO: 458176 - protein, 9 aa, Homo Sapiens
KYVHPGGGF

SEQ ID NO: 458177 - protein, 9 aa, Homo Sapiens
KVVRNRSGC

SEQ ID NO: 458178 - protein, 9 aa, Homo Sapiens
PWVSWTHCS

SEQ ID NO: 458179 - protein, 9 aa, Homo Sapiens
NNEIEMITG

SEQ ID NO: 458180 - protein, 9 aa, Homo Sapiens
ASSCSSRPV

SEQ ID NO: 458181 - protein, 9 aa, Homo Sapiens
TGTGTLLMT

SEQ ID NO: 458182 - protein, 9 aa, Homo Sapiens
LEDLLLDSE

SEQ ID NO: 458183 - protein, 9 aa, Homo Sapiens
LEGLTDASI

SEQ ID NO: 458184 - protein, 9 aa, Homo Sapiens
GCCQRAPDS

SEQ ID NO: 458185 - protein, 9 aa, Homo Sapiens
RLMPDPKSF

SEQ ID NO: 458186 - protein, 9 aa, Homo Sapiens
HARTQEDKI

SEQ ID NO: 458187 - protein, 9 aa, Homo Sapiens
QLHSICYLL

SEQ ID NO: 458188 - protein, 9 aa, Homo Sapiens
HAWLPLIIE

SEQ ID NO: 458189 - protein, 9 aa, Homo Sapiens
PFTKQQLNN

SEQ ID NO: 458190 - protein, 9 aa, Homo Sapiens
STLGKDCET

SEQ ID NO: 458191 - protein, 9 aa, Homo Sapiens
NASDSESEK

SEQ ID NO: 458192 - protein, 9 aa, Homo Sapiens
LIIEIKDRL

SEQ ID NO: 458193 - protein, 9 aa, Homo Sapiens
GTPSYFIMY

SEQ ID NO: 458194 - protein, 9 aa, Homo Sapiens
SAKKVISYR

SEQ ID NO: 458195 - protein, 9 aa, Homo Sapiens
GGNLMYHIQ

SEQ ID NO: 458196 - protein, 9 aa, Homo Sapiens
FKVLSHNLC

SEQ ID NO: 458197 - protein, 9 aa, Homo Sapiens
ILGDDHLSA

SEQ ID NO: 458198 - protein, 9 aa, Homo Sapiens
CTDCATGFC

SEQ ID NO: 458199 - protein, 9 aa, Homo Sapiens
HQDLRAANV

SEQ ID NO: 458200 - protein, 9 aa, Homo Sapiens
FTKQQLNNM

SEQ ID NO: 458201 - protein, 9 aa, Homo Sapiens
PLYNFTGLS

SEQ ID NO: 458202 - protein, 9 aa, Homo Sapiens
YQVRCPSHE

SEQ ID NO: 458203 - protein, 9 aa, Homo Sapiens
FLWIETSNE

SEQ ID NO: 458204 - protein, 9 aa, Homo Sapiens
LVGPFVSVM

SEQ ID NO: 458205 - protein, 9 aa, Homo Sapiens
VRAAVYQLQ

SEQ ID NO: 458206 - protein, 9 aa, Homo Sapiens
VGETITDLE

SEQ ID NO: 458207 - protein, 9 aa, Homo Sapiens
IEDVSRKGT

SEQ ID NO: 458208 - protein, 9 aa, Homo Sapiens
VNGGNLMYH

SEQ ID NO: 458209 - protein, 9 aa, Homo Sapiens
TIFSQSKYS

SEQ ID NO: 458210 - protein, 9 aa, Homo Sapiens
GGVPPLRPV

SEQ ID NO: 458211 - protein, 9 aa, Homo Sapiens
TSRVNLVLR

SEQ ID NO: 458212 - protein, 9 aa, Homo Sapiens
LSQEECSSN

SEQ ID NO: 458213 - protein, 9 aa, Homo Sapiens
EVLLLRAMR

SEQ ID NO: 458214 - protein, 9 aa, Homo Sapiens
KGEKKVTWA

SEQ ID NO: 458215 - protein, 9 aa, Homo Sapiens
FPSVGYCVL

SEQ ID NO: 458216 - protein, 9 aa, Homo Sapiens
NARGNATKA

SEQ ID NO: 458217 - protein, 9 aa, Homo Sapiens
DIPKYTCPD

SEQ ID NO: 458218 - protein, 9 aa, Homo Sapiens
CGTPSYFIM

SEQ ID NO: 458219 - protein, 9 aa, Homo Sapiens
YLEGLTDAS

SEQ ID NO: 458220 - protein, 9 aa, Homo Sapiens
AAHPACGAC

SEQ ID NO: 458221 - protein, 9 aa, Homo Sapiens
KVSSKGEKK

SEQ ID NO: 458222 - protein, 9 aa, Homo Sapiens
SKSRTSTLR

SEQ ID NO: 458223 - protein, 9 aa, Homo Sapiens
FLSKINSLA

SEQ ID NO: 458224 - protein, 9 aa, Homo Sapiens
ASFPRPSAT

SEQ ID NO: 458225 - protein, 9 aa, Homo Sapiens
DSCESHCAE

SEQ ID NO: 458226 - protein, 9 aa, Homo Sapiens
LGDDHLSAP

SEQ ID NO: 458227 - protein, 9 aa, Homo Sapiens
DSESEKLHR

SEQ ID NO: 458228 - protein, 9 aa, Homo Sapiens
LRYLGTFGE

SEQ ID NO: 458229 - protein, 9 aa, Homo Sapiens
RCPSHEGYL

SEQ ID NO: 458230 - protein, 9 aa, Homo Sapiens
LPPRIASNA

SEQ ID NO: 458231 - protein, 9 aa, Homo Sapiens
RKNYIHQDL

SEQ ID NO: 458232 - protein, 9 aa, Homo Sapiens
SCESHCAEK

SEQ ID NO: 458233 - protein, 9 aa, Homo Sapiens
PVPPERVVA

SEQ ID NO: 458234 - protein, 9 aa, Homo Sapiens
KFNLGKIGR

SEQ ID NO: 458235 - protein, 9 aa, Homo Sapiens
LNCWNPPTT

SEQ ID NO: 458236 - protein, 9 aa, Homo Sapiens
PAIHFSSIH

SEQ ID NO: 458237 - protein, 9 aa, Homo Sapiens
MRQTWKLEG

SEQ ID NO: 458238 - protein, 9 aa, Homo Sapiens
YHINFIFTP

SEQ ID NO: 458239 - protein, 9 aa, Homo Sapiens
QRAPDSCES

SEQ ID NO: 458240 - protein, 9 aa, Homo Sapiens
KILCLSNNE

SEQ ID NO: 458241 - protein, 9 aa, Homo Sapiens
DLLPINSDD

SEQ ID NO: 458242 - protein, 9 aa, Homo Sapiens
SVLPFKIYY

SEQ ID NO: 458243 - protein, 9 aa, Homo Sapiens
EIMKKVVRN

SEQ ID NO: 458244 - protein, 9 aa, Homo Sapiens
IENLEGIPV

SEQ ID NO: 458245 - protein, 9 aa, Homo Sapiens
SRITTGSTL

SEQ ID NO: 458246 - protein, 9 aa, Homo Sapiens
REKIMKLSL

SEQ ID NO: 458247 - protein, 9 aa, Homo Sapiens
VEVGIHEQW

SEQ ID NO: 458248 - protein, 9 aa, Homo Sapiens
NFTGLSVSN

SEQ ID NO: 458249 - protein, 9 aa, Homo Sapiens
YHLEMEFQR

SEQ ID NO: 458250 - protein, 9 aa, Homo Sapiens
RNPGSAKVQ

SEQ ID NO: 458251 - protein, 9 aa, Homo Sapiens
SEGTKAVTE

SEQ ID NO: 458252 - protein, 9 aa, Homo Sapiens
PKYTCPDLV

SEQ ID NO: 458253 - protein, 9 aa, Homo Sapiens
PFKIYYHCN

SEQ ID NO: 458254 - protein, 9 aa, Homo Sapiens
MKKKDGNRD

SEQ ID NO: 458255 - protein, 9 aa, Homo Sapiens
RYVILGDDH

SEQ ID NO: 458256 - protein, 9 aa, Homo Sapiens
HYKHHWFLE

SEQ ID NO: 458257 - protein, 9 aa, Homo Sapiens
RLRRGRDPG

SEQ ID NO: 458258 - protein, 9 aa, Homo Sapiens
RVLYFPSVG

SEQ ID NO: 458259 - protein, 9 aa, Homo Sapiens
GKDCETYKH

SEQ ID NO: 458260 - protein, 9 aa, Homo Sapiens
YKHHWFLEK

SEQ ID NO: 458261 - protein, 9 aa, Homo Sapiens
LLLDSEANL

SEQ ID NO: 458262 - protein, 9 aa, Homo Sapiens
DNGSGMCKV

SEQ ID NO: 458263 - protein, 9 aa, Homo Sapiens
LTRIVTTLI

SEQ ID NO: 458264 - protein, 9 aa, Homo Sapiens
NPSKEIIGG

SEQ ID NO: 458265 - protein, 9 aa, Homo Sapiens
IEEEVRRLF

SEQ ID NO: 458266 - protein, 9 aa, Homo Sapiens
VSPGAANDY

SEQ ID NO: 458267 - protein, 9 aa, Homo Sapiens
MKLSLPESL

SEQ ID NO: 458268 - protein, 9 aa, Homo Sapiens
SPLEIEGAT

SEQ ID NO: 458269 - protein, 9 aa, Homo Sapiens
SRVMGLKGQ

SEQ ID NO: 458270 - protein, 9 aa, Homo Sapiens
ARTQEDKIK

SEQ ID NO: 458271 - protein, 9 aa, Homo Sapiens
SHFSRGCPQ

SEQ ID NO: 458272 - protein, 9 aa, Homo Sapiens
VGFAGDDAP

SEQ ID NO: 458273 - protein, 9 aa, Homo Sapiens
RPSATPPAT

SEQ ID NO: 458274 - protein, 9 aa, Homo Sapiens
DSALNMVQT

SEQ ID NO: 458275 - protein, 9 aa, Homo Sapiens
TKAVTEYTS

SEQ ID NO: 458276 - protein, 9 aa, Homo Sapiens
ASDSESEKL

SEQ ID NO: 458277 - protein, 9 aa, Homo Sapiens
SRGCPQLGY

SEQ ID NO: 458278 - protein, 9 aa, Homo Sapiens
QRLRRGRDP

SEQ ID NO: 458279 - protein, 9 aa, Homo Sapiens
VRCPSHEGY

SEQ ID NO: 458280 - protein, 9 aa, Homo Sapiens
SYFIMYQTQ

SEQ ID NO: 458281 - protein, 9 aa, Homo Sapiens
LMTLEDVND

SEQ ID NO: 458282 - protein, 9 aa, Homo Sapiens
GTGASASFK

SEQ ID NO: 458283 - protein, 9 aa, Homo Sapiens
DPCFQLHSI

SEQ ID NO: 458284 - protein, 9 aa, Homo Sapiens
REMRAGGCC

SEQ ID NO: 458285 - protein, 9 aa, Homo Sapiens
SLPESLKAY

SEQ ID NO: 458286 - protein, 9 aa, Homo Sapiens
TTLINSIVL

SEQ ID NO: 458287 - protein, 9 aa, Homo Sapiens
GPFVSVMPT

SEQ ID NO: 458288 - protein, 9 aa, Homo Sapiens
DDQEFWHSQ

SEQ ID NO: 458289 - protein, 9 aa, Homo Sapiens
DFLSAKKVI

SEQ ID NO: 458290 - protein, 9 aa, Homo Sapiens
EKPKAVGRQ

SEQ ID NO: 458291 - protein, 9 aa, Homo Sapiens
FQASKELKQ

SEQ ID NO: 458292 - protein, 9 aa, Homo Sapiens
KDDFTMQIS

SEQ ID NO: 458293 - protein, 9 aa, Homo Sapiens
YMSHIIERW

SEQ ID NO: 458294 - protein, 9 aa, Homo Sapiens
ETYKHRMNT

SEQ ID NO: 458295 - protein, 9 aa, Homo Sapiens
FKIYYHCNR

SEQ ID NO: 458296 - protein, 9 aa, Homo Sapiens
WIWQYQEKK

SEQ ID NO: 458297 - protein, 9 aa, Homo Sapiens
SSRPVSSPS

SEQ ID NO: 458298 - protein, 9 aa, Homo Sapiens
LWIETSNEY

SEQ ID NO: 458299 - protein, 9 aa, Homo Sapiens
EIDSALNMV

SEQ ID NO: 458300 - protein, 9 aa, Homo Sapiens
SEDVRYVIL

SEQ ID NO: 458301 - protein, 9 aa, Homo Sapiens
VSSPSAPST

SEQ ID NO: 458302 - protein, 9 aa, Homo Sapiens
ECSSNNPLF

SEQ ID NO: 458303 - protein, 9 aa, Homo Sapiens
FSQSKYSET

SEQ ID NO: 458304 - protein, 9 aa, Homo Sapiens
SPGAANDYY

SEQ ID NO: 458305 - protein, 9 aa, Homo Sapiens
VALAVLAPL

SEQ ID NO: 458306 - protein, 9 aa, Homo Sapiens
IERKNYIHQ

SEQ ID NO: 458307 - protein, 9 aa, Homo Sapiens
DEKVGETIT

SEQ ID NO: 458308 - protein, 9 aa, Homo Sapiens
KKMEMEMER

SEQ ID NO: 458309 - protein, 9 aa, Homo Sapiens
VLLSWLPTF

SEQ ID NO: 458310 - protein, 9 aa, Homo Sapiens
GTGPGLAAV

SEQ ID NO: 458311 - protein, 9 aa, Homo Sapiens
GPADDQEFW

SEQ ID NO: 458312 - protein, 9 aa, Homo Sapiens
SAQDIPKYT

SEQ ID NO: 458313 - protein, 9 aa, Homo Sapiens
RDPGLMHGK

SEQ ID NO: 458314 - protein, 9 aa, Homo Sapiens
DCETYKHRM

SEQ ID NO: 458315 - protein, 9 aa, Homo Sapiens
PGNLNFQAG

SEQ ID NO: 458316 - protein, 9 aa, Homo Sapiens
DVIGKALRY

SEQ ID NO: 458317 - protein, 9 aa, Homo Sapiens
IIEIKDRLQ

SEQ ID NO: 458318 - protein, 9 aa, Homo Sapiens
LGRVKAFNR

SEQ ID NO: 458319 - protein, 9 aa, Homo Sapiens
YRIIMNPGI

SEQ ID NO: 458320 - protein, 9 aa, Homo Sapiens
GATGGLLRS

SEQ ID NO: 458321 - protein, 9 aa, Homo Sapiens
PITPENPSK

SEQ ID NO: 458322 - protein, 9 aa, Homo Sapiens
KDCETYKHR

SEQ ID NO: 458323 - protein, 9 aa, Homo Sapiens
NGAGPLQNG

SEQ ID NO: 458324 - protein, 9 aa, Homo Sapiens
RVMGLKGQM

SEQ ID NO: 458325 - protein, 9 aa, Homo Sapiens
AMVRDYMRQ

SEQ ID NO: 458326 - protein, 9 aa, Homo Sapiens
TITDLENRF

SEQ ID NO: 458327 - protein, 9 aa, Homo Sapiens
VEPFTKQQL

SEQ ID NO: 458328 - protein, 9 aa, Homo Sapiens
SPEKDHSST

SEQ ID NO: 458329 - protein, 9 aa, Homo Sapiens
KAVTEYTSS

SEQ ID NO: 458330 - protein, 9 aa, Homo Sapiens
TSNEYFNFD

SEQ ID NO: 458331 - protein, 9 aa, Homo Sapiens
LKEVDETRT

SEQ ID NO: 458332 - protein, 9 aa, Homo Sapiens
WNLLQVDLT

SEQ ID NO: 458333 - protein, 9 aa, Homo Sapiens
LEVVEPEDL

SEQ ID NO: 458334 - protein, 9 aa, Homo Sapiens
RQLYYKSRD

SEQ ID NO: 458335 - protein, 9 aa, Homo Sapiens
WQYQEKKSL

SEQ ID NO: 458336 - protein, 9 aa, Homo Sapiens
PQLEAAHPA

SEQ ID NO: 458337 - protein, 9 aa, Homo Sapiens
EQLYHLEME

SEQ ID NO: 458338 - protein, 9 aa, Homo Sapiens
EAAHPACGA

SEQ ID NO: 458339 - protein, 9 aa, Homo Sapiens
VNLVLRNCY

SEQ ID NO: 458340 - protein, 9 aa, Homo Sapiens
TASLLNCWN

SEQ ID NO: 458341 - protein, 9 aa, Homo Sapiens
GNLMYHIQQ

SEQ ID NO: 458342 - protein, 9 aa, Homo Sapiens
AVGRQLYYK

SEQ ID NO: 458343 - protein, 9 aa, Homo Sapiens
HINFIFTPW

SEQ ID NO: 458344 - protein, 9 aa, Homo Sapiens
RGVPEKPQI

SEQ ID NO: 458345 - protein, 9 aa, Homo Sapiens
KPKAVGRQL

SEQ ID NO: 458346 - protein, 9 aa, Homo Sapiens
DPKSFPHGI

SEQ ID NO: 458347 - protein, 9 aa, Homo Sapiens
TLLITLLSS

SEQ ID NO: 458348 - protein, 9 aa, Homo Sapiens
VMEYVNGGN

SEQ ID NO: 458349 - protein, 9 aa, Homo Sapiens
PVRKPPPGS

SEQ ID NO: 458350 - protein, 9 aa, Homo Sapiens
KDSEEEPPK

SEQ ID NO: 458351 - protein, 9 aa, Homo Sapiens
EECSSNNPL

SEQ ID NO: 458352 - protein, 9 aa, Homo Sapiens
MDGPRPLLL

SEQ ID NO: 458353 - protein, 9 aa, Homo Sapiens
AVRAQVLKG

SEQ ID NO: 458354 - protein, 9 aa, Homo Sapiens
GLAAVFEDD

SEQ ID NO: 458355 - protein, 9 aa, Homo Sapiens
SDSESEKLH

SEQ ID NO: 458356 - protein, 9 aa, Homo Sapiens
MEYVNGGNL

SEQ ID NO: 458357 - protein, 9 aa, Homo Sapiens
KPSKCFFIS

SEQ ID NO: 458358 - protein, 9 aa, Homo Sapiens
LGSGLYAPH

SEQ ID NO: 458359 - protein, 9 aa, Homo Sapiens
AVTEYTSSK

SEQ ID NO: 458360 - protein, 9 aa, Homo Sapiens
ERRRHAEHH

SEQ ID NO: 458361 - protein, 9 aa, Homo Sapiens
QSKYSETWL

SEQ ID NO: 458362 - protein, 9 aa, Homo Sapiens
TSDLDHSGI

SEQ ID NO: 458363 - protein, 9 aa, Homo Sapiens
YTCPDLVTR

SEQ ID NO: 458364 - protein, 9 aa, Homo Sapiens
FTTHYMDYS

SEQ ID NO: 458365 - protein, 9 aa, Homo Sapiens
RVFEMKVKE

SEQ ID NO: 458366 - protein, 9 aa, Homo Sapiens
VSMRRMVAL

SEQ ID NO: 458367 - protein, 9 aa, Homo Sapiens
PEKDHSSTS

SEQ ID NO: 458368 - protein, 9 aa, Homo Sapiens
ADPCFQLHS

SEQ ID NO: 458369 - protein, 9 aa, Homo Sapiens
QYQEKKSLF

SEQ ID NO: 458370 - protein, 9 aa, Homo Sapiens
HSLSRITTG

SEQ ID NO: 458371 - protein, 9 aa, Homo Sapiens
IWQYQEKKS

SEQ ID NO: 458372 - protein, 9 aa, Homo Sapiens
SVFQASKEL

SEQ ID NO: 458373 - protein, 9 aa, Homo Sapiens
AQYPGMSIQ

SEQ ID NO: 458374 - protein, 9 aa, Homo Sapiens
LPLIIEIKD

SEQ ID NO: 458375 - protein, 9 aa, Homo Sapiens
FTAEQLYHL

SEQ ID NO: 458376 - protein, 9 aa, Homo Sapiens
DGNRDSNGA

SEQ ID NO: 458377 - protein, 9 aa, Homo Sapiens
SGRRHSVSM

SEQ ID NO: 458378 - protein, 9 aa, Homo Sapiens
LKDLLWNLL

SEQ ID NO: 458379 - protein, 9 aa, Homo Sapiens
KIIRNPGSA

SEQ ID NO: 458380 - protein, 9 aa, Homo Sapiens
KGTIEELRE

SEQ ID NO: 458381 - protein, 9 aa, Homo Sapiens
YFIMYQTQV

SEQ ID NO: 458382 - protein, 9 aa, Homo Sapiens
ATGGLLRST

SEQ ID NO: 458383 - protein, 9 aa, Homo Sapiens
KAFNRHCNM

SEQ ID NO: 458384 - protein, 9 aa, Homo Sapiens
SVVVPVRKP

SEQ ID NO: 458385 - protein, 9 aa, Homo Sapiens
HPGGGFVPS

SEQ ID NO: 458386 - protein, 9 aa, Homo Sapiens
WLPLIIEIK

SEQ ID NO: 458387 - protein, 9 aa, Homo Sapiens
MYQTQVQDN

SEQ ID NO: 458388 - protein, 9 aa, Homo Sapiens
SWTHCSSSC

SEQ ID NO: 458389 - protein, 9 aa, Homo Sapiens
SRHAFCTDC

SEQ ID NO: 458390 - protein, 9 aa, Homo Sapiens
GAANDYYHQ

SEQ ID NO: 458391 - protein, 9 aa, Homo Sapiens
EVRSPVGCG

SEQ ID NO: 458392 - protein, 9 aa, Homo Sapiens
MKKVVRNRS

SEQ ID NO: 458393 - protein, 9 aa, Homo Sapiens
SESEKLHRQ

SEQ ID NO: 458394 - protein, 9 aa, Homo Sapiens
TQEDKIKRM

SEQ ID NO: 458395 - protein, 9 aa, Homo Sapiens
SAACSFFVL

SEQ ID NO: 458396 - protein, 9 aa, Homo Sapiens
NEKAYLNKL

SEQ ID NO: 458397 - protein, 9 aa, Homo Sapiens
QLEAAHPAC

SEQ ID NO: 458398 - protein, 9 aa, Homo Sapiens
ERGSHFSRG

SEQ ID NO: 458399 - protein, 9 aa, Homo Sapiens
FFVLLSWLP

SEQ ID NO: 458400 - protein, 9 aa, Homo Sapiens
NLEGIPVKQ

SEQ ID NO: 458401 - protein, 9 aa, Homo Sapiens
DASIFVHIT

SEQ ID NO: 458402 - protein, 9 aa, Homo Sapiens
TPSYFIMYQ

SEQ ID NO: 458403 - protein, 9 aa, Homo Sapiens
IMKKVVRNR

SEQ ID NO: 458404 - protein, 9 aa, Homo Sapiens
SLSRITTGS

SEQ ID NO: 458405 - protein, 9 aa, Homo Sapiens
TDCATGFCC

SEQ ID NO: 458406 - protein, 9 aa, Homo Sapiens
LDHSGIPYL

SEQ ID NO: 458407 - protein, 9 aa, Homo Sapiens
QERAKEAIT

SEQ ID NO: 458408 - protein, 9 aa, Homo Sapiens
EIEMITGLE

SEQ ID NO: 458409 - protein, 9 aa, Homo Sapiens
HPACGACGA

SEQ ID NO: 458410 - protein, 9 aa, Homo Sapiens
GPRPLLLLL

SEQ ID NO: 458411 - protein, 9 aa, Homo Sapiens
NSDDNFCKA

SEQ ID NO: 458412 - protein, 9 aa, Homo Sapiens
TCGTGPGLA

SEQ ID NO: 458413 - protein, 9 aa, Homo Sapiens
KTGLIRVKD

SEQ ID NO: 458414 - protein, 9 aa, Homo Sapiens
LLKIQKFSG

SEQ ID NO: 458415 - protein, 9 aa, Homo Sapiens
LSAACSFFV

SEQ ID NO: 458416 - protein, 9 aa, Homo Sapiens
IMKLSLPES

SEQ ID NO: 458417 - protein, 9 aa, Homo Sapiens
SATPPATPG

SEQ ID NO: 458418 - protein, 9 aa, Homo Sapiens
NNHSKSRTS

SEQ ID NO: 458419 - protein, 9 aa, Homo Sapiens
IHFSSIHPG

SEQ ID NO: 458420 - protein, 9 aa, Homo Sapiens
LYAPHKGPL

SEQ ID NO: 458421 - protein, 9 aa, Homo Sapiens
VFQASKELK

SEQ ID NO: 458422 - protein, 9 aa, Homo Sapiens
LEDYQKKKD

SEQ ID NO: 458423 - protein, 9 aa, Homo Sapiens
VRYVILGDD

SEQ ID NO: 458424 - protein, 9 aa, Homo Sapiens
RIIMNPGIS

SEQ ID NO: 458425 - protein, 9 aa, Homo Sapiens
LDSYRNEKA

SEQ ID NO: 458426 - protein, 9 aa, Homo Sapiens
LAPSWEEHT

SEQ ID NO: 458427 - protein, 9 aa, Homo Sapiens
EMEMERVFE

SEQ ID NO: 458428 - protein, 9 aa, Homo Sapiens
SNARGNATK

SEQ ID NO: 458429 - protein, 9 aa, Homo Sapiens
IVTTLINSI

SEQ ID NO: 458430 - protein, 9 aa, Homo Sapiens
KDHSSTSAT

SEQ ID NO: 458431 - protein, 9 aa, Homo Sapiens
IRNPGSAKV

SEQ ID NO: 458432 - protein, 9 aa, Homo Sapiens
YLTVRGVPE

SEQ ID NO: 458433 - protein, 9 aa, Homo Sapiens
LLNCWNPPT

SEQ ID NO: 458434 - protein, 9 aa, Homo Sapiens
RRLFRTNMF

SEQ ID NO: 458435 - protein, 9 aa, Homo Sapiens
GEKKVTWAD

SEQ ID NO: 458436 - protein, 9 aa, Homo Sapiens
SLLNCWNPP

SEQ ID NO: 458437 - protein, 9 aa, Homo Sapiens
LTEIEEEVR

SEQ ID NO: 458438 - protein, 9 aa, Homo Sapiens
EGQQPGNLN

SEQ ID NO: 458439 - protein, 9 aa, Homo Sapiens
RVKAFNRHC

SEQ ID NO: 458440 - protein, 9 aa, Homo Sapiens
VMVNIENLE

SEQ ID NO: 458441 - protein, 9 aa, Homo Sapiens
GDTSRVNLV

SEQ ID NO: 458442 - protein, 9 aa, Homo Sapiens
RGCPQLGYA

SEQ ID NO: 458443 - protein, 9 aa, Homo Sapiens
IQSVEPFTK

SEQ ID NO: 458444 - protein, 9 aa, Homo Sapiens
MEMEMERVF

SEQ ID NO: 458445 - protein, 9 aa, Homo Sapiens
FPRPSATPP

SEQ ID NO: 458446 - protein, 9 aa, Homo Sapiens
KDNLDYEEN

SEQ ID NO: 458447 - protein, 9 aa, Homo Sapiens
DVRYVILGD

SEQ ID NO: 458448 - protein, 9 aa, Homo Sapiens
TDASIFVHI

SEQ ID NO: 458449 - protein, 9 aa, Homo Sapiens
MFLSKINSL

SEQ ID NO: 458450 - protein, 9 aa, Homo Sapiens
IIRNPGSAK

SEQ ID NO: 458451 - protein, 9 aa, Homo Sapiens
SASFKLNKK

SEQ ID NO: 458452 - protein, 9 aa, Homo Sapiens
HDNGQKYRI

SEQ ID NO: 458453 - protein, 9 aa, Homo Sapiens
LREKIMKLS

SEQ ID NO: 458454 - protein, 9 aa, Homo Sapiens
SNLQSVFQA

SEQ ID NO: 458455 - protein, 9 aa, Homo Sapiens
SDDEDKDSE

SEQ ID NO: 458456 - protein, 9 aa, Homo Sapiens
QKFSGCGGR

SEQ ID NO: 458457 - protein, 9 aa, Homo Sapiens
GRAKIIRNP

SEQ ID NO: 458458 - protein, 9 aa, Homo Sapiens
KSTDTIFWP

SEQ ID NO: 458459 - protein, 9 aa, Homo Sapiens
MTQHGKNCT

SEQ ID NO: 458460 - protein, 9 aa, Homo Sapiens
VSKSQFKVL

SEQ ID NO: 458461 - protein, 9 aa, Homo Sapiens
LCLSNNEIE

SEQ ID NO: 458462 - protein, 9 aa, Homo Sapiens
DSLHAAFTV

SEQ ID NO: 458463 - protein, 9 aa, Homo Sapiens
QPGNLNFQA

SEQ ID NO: 458464 - protein, 9 aa, Homo Sapiens
PRIASNARG

SEQ ID NO: 458465 - protein, 9 aa, Homo Sapiens
GTAALSTAL

SEQ ID NO: 458466 - protein, 9 aa, Homo Sapiens
GLTDASIFV

SEQ ID NO: 458467 - protein, 9 aa, Homo Sapiens
MRIRAPIMR

SEQ ID NO: 458468 - protein, 9 aa, Homo Sapiens
AERVLYFPS

SEQ ID NO: 458469 - protein, 9 aa, Homo Sapiens
VRDYMRQTW

SEQ ID NO: 458470 - protein, 9 aa, Homo Sapiens
WIETSNEYF

SEQ ID NO: 458471 - protein, 9 aa, Homo Sapiens
LIRVKDNLD

SEQ ID NO: 458472 - protein, 9 aa, Homo Sapiens
GSGMCKVGF

SEQ ID NO: 458473 - protein, 9 aa, Homo Sapiens
VVVPVRKPP

SEQ ID NO: 458474 - protein, 9 aa, Homo Sapiens
EMRAGGCCH

SEQ ID NO: 458475 - protein, 9 aa, Homo Sapiens
PFKLVSTYR

SEQ ID NO: 458476 - protein, 9 aa, Homo Sapiens
QGDTSRVNL

SEQ ID NO: 458477 - protein, 9 aa, Homo Sapiens
SKAYLTVRG

SEQ ID NO: 458478 - protein, 9 aa, Homo Sapiens
VVAERVLYF

SEQ ID NO: 458479 - protein, 9 aa, Homo Sapiens
AKDFEVRSP

SEQ ID NO: 458480 - protein, 9 aa, Homo Sapiens
ENLEGIPVK

SEQ ID NO: 458481 - protein, 9 aa, Homo Sapiens
VYLEGLTDA

SEQ ID NO: 458482 - protein, 9 aa, Homo Sapiens
CSSRPVSSP

SEQ ID NO: 458483 - protein, 9 aa, Homo Sapiens
EEEERRRHA

SEQ ID NO: 458484 - protein, 9 aa, Homo Sapiens
TVRGVPEKP

SEQ ID NO: 458485 - protein, 9 aa, Homo Sapiens
LSLPESLKA

SEQ ID NO: 458486 - protein, 9 aa, Homo Sapiens
VDFTTHYMD

SEQ ID NO: 458487 - protein, 9 aa, Homo Sapiens
VVPVRKPPP

SEQ ID NO: 458488 - protein, 9 aa, Homo Sapiens
KKVVRNRSG

SEQ ID NO: 458489 - protein, 9 aa, Homo Sapiens
EMERVFEMK

SEQ ID NO: 458490 - protein, 9 aa, Homo Sapiens
LNMVQTLKN

SEQ ID NO: 458491 - protein, 9 aa, Homo Sapiens
SSKGEKKVT

SEQ ID NO: 458492 - protein, 9 aa, Homo Sapiens
IRVKDNLDY

SEQ ID NO: 458493 - protein, 9 aa, Homo Sapiens
KDVIGKALR

SEQ ID NO: 458494 - protein, 9 aa, Homo Sapiens
PFVSVMPTP

SEQ ID NO: 458495 - protein, 9 aa, Homo Sapiens
LCGMREMRA

SEQ ID NO: 458496 - protein, 9 aa, Homo Sapiens
RTCYRMVGG

SEQ ID NO: 458497 - protein, 9 aa, Homo Sapiens
FRNKKKKRP

SEQ ID NO: 458498 - protein, 9 aa, Homo Sapiens
HSGIPYLDY

SEQ ID NO: 458499 - protein, 9 aa, Homo Sapiens
ILPGLKYVH

SEQ ID NO: 458500 - protein, 9 aa, Homo Sapiens
KTCGTGPGL

SEQ ID NO: 458501 - protein, 9 aa, Homo Sapiens
EKVGETITD

SEQ ID NO: 458502 - protein, 9 aa, Homo Sapiens
NYIHQDLRA

SEQ ID NO: 458503 - protein, 9 aa, Homo Sapiens
MLPPRIASN

SEQ ID NO: 458504 - protein, 9 aa, Homo Sapiens
HWFLEKPSK

SEQ ID NO: 458505 - protein, 9 aa, Homo Sapiens
GPGLAAVFE

SEQ ID NO: 458506 - protein, 9 aa, Homo Sapiens
EDYQKKKDD

SEQ ID NO: 458507 - protein, 9 aa, Homo Sapiens
RVQRLRRGR

SEQ ID NO: 458508 - protein, 9 aa, Homo Sapiens
LLGRVKAFN

SEQ ID NO: 458509 - protein, 9 aa, Homo Sapiens
GNLNFQAGD

SEQ ID NO: 458510 - protein, 9 aa, Homo Sapiens
PSATPPATP

SEQ ID NO: 458511 - protein, 9 aa, Homo Sapiens
SFEGQQPGN

SEQ ID NO: 458512 - protein, 9 aa, Homo Sapiens
DLKDLLWNL

SEQ ID NO: 458513 - protein, 9 aa, Homo Sapiens
SSRVMGLKG

SEQ ID NO: 458514 - protein, 9 aa, Homo Sapiens
AAVYQLQPH

SEQ ID NO: 458515 - protein, 9 aa, Homo Sapiens
SCAVIEDDS

SEQ ID NO: 458516 - protein, 9 aa, Homo Sapiens
ATGTGTLLM

SEQ ID NO: 458517 - protein, 9 aa, Homo Sapiens
TTCLANAEE

SEQ ID NO: 458518 - protein, 9 aa, Homo Sapiens
RDAMVRDYM

SEQ ID NO: 458519 - protein, 9 aa, Homo Sapiens
ERAKEAITK

SEQ ID NO: 458520 - protein, 9 aa, Homo Sapiens
VHPGGGFVP

SEQ ID NO: 458521 - protein, 9 aa, Homo Sapiens
AALSTALSL

SEQ ID NO: 458522 - protein, 9 aa, Homo Sapiens
GRVKAFNRH

SEQ ID NO: 458523 - protein, 9 aa, Homo Sapiens
LKFNLGKIG

SEQ ID NO: 458524 - protein, 9 aa, Homo Sapiens
RRDPFRKGL

SEQ ID NO: 458525 - protein, 9 aa, Homo Sapiens
MCKVGFAGD

SEQ ID NO: 458526 - protein, 9 aa, Homo Sapiens
LYHLEMEFQ

SEQ ID NO: 458527 - protein, 9 aa, Homo Sapiens
KALRYLGTF

SEQ ID NO: 458528 - protein, 9 aa, Homo Sapiens
LTVRGVPEK

SEQ ID NO: 458529 - protein, 9 aa, Homo Sapiens
EDDSLHAAF

SEQ ID NO: 458530 - protein, 9 aa, Homo Sapiens
CETYKHRMN

SEQ ID NO: 458531 - protein, 9 aa, Homo Sapiens
NCSGRVEVG

SEQ ID NO: 458532 - protein, 9 aa, Homo Sapiens
DSEANLTCT

SEQ ID NO: 458533 - protein, 9 aa, Homo Sapiens
HFSSIHPGW

SEQ ID NO: 458534 - protein, 9 aa, Homo Sapiens
DLLLDSEAN

SEQ ID NO: 458535 - protein, 9 aa, Homo Sapiens
AMRIRAPIM

SEQ ID NO: 458536 - protein, 9 aa, Homo Sapiens
LEQGDTSRV

SEQ ID NO: 458537 - protein, 9 aa, Homo Sapiens
IHPGWADTP

SEQ ID NO: 458538 - protein, 9 aa, Homo Sapiens
QYPGMSIQG

SEQ ID NO: 458539 - protein, 9 aa, Homo Sapiens
EVGIHEQWW

SEQ ID NO: 458540 - protein, 9 aa, Homo Sapiens
KAYLNKLQQ

SEQ ID NO: 458541 - protein, 9 aa, Homo Sapiens
PGMSIQGED

SEQ ID NO: 458542 - protein, 9 aa, Homo Sapiens
LWNLLQVDL

SEQ ID NO: 458543 - protein, 9 aa, Homo Sapiens
EHYKHHWFL

SEQ ID NO: 458544 - protein, 9 aa, Homo Sapiens
KQHAWLPLI

SEQ ID NO: 458545 - protein, 9 aa, Homo Sapiens
NGGNLMYHI

SEQ ID NO: 458546 - protein, 9 aa, Homo Sapiens
STSATSQVY

SEQ ID NO: 458547 - protein, 9 aa, Homo Sapiens
VFSSRSLCG

SEQ ID NO: 458548 - protein, 9 aa, Homo Sapiens
HQPSALDYS

SEQ ID NO: 458549 - protein, 9 aa, Homo Sapiens
QKKKDDFTM

SEQ ID NO: 458550 - protein, 9 aa, Homo Sapiens
WVSWTHCSS

SEQ ID NO: 458551 - protein, 9 aa, Homo Sapiens
KKVSSKGEK

SEQ ID NO: 458552 - protein, 9 aa, Homo Sapiens
GTGTLLMTL

SEQ ID NO: 458553 - protein, 9 aa, Homo Sapiens
VIEDDSLHA

SEQ ID NO: 458554 - protein, 9 aa, Homo Sapiens
LKSTDTIFW

SEQ ID NO: 458555 - protein, 9 aa, Homo Sapiens
TKKVSSKGE

SEQ ID NO: 458556 - protein, 9 aa, Homo Sapiens
RKPPPGSLA

SEQ ID NO: 458557 - protein, 9 aa, Homo Sapiens
PPRIASNAR

SEQ ID NO: 458558 - protein, 9 aa, Homo Sapiens
EDKDSEEEP

SEQ ID NO: 458559 - protein, 9 aa, Homo Sapiens
YRNYYSLVL

SEQ ID NO: 458560 - protein, 9 aa, Homo Sapiens
LKIQKFSGC

SEQ ID NO: 458561 - protein, 9 aa, Homo Sapiens
DSYRNEKAY

SEQ ID NO: 458562 - protein, 9 aa, Homo Sapiens
DQPGAVRAQ

SEQ ID NO: 458563 - protein, 9 aa, Homo Sapiens
LLRAMRIRA

SEQ ID NO: 458564 - protein, 9 aa, Homo Sapiens
GLIRVKDNL

SEQ ID NO: 458565 - protein, 9 aa, Homo Sapiens
KNNHSKSRT

SEQ ID NO: 458566 - protein, 9 aa, Homo Sapiens
FTGLSVSNG

SEQ ID NO: 458567 - protein, 9 aa, Homo Sapiens
EGLTDASIF

SEQ ID NO: 458568 - protein, 9 aa, Homo Sapiens
THCSSSCGR

SEQ ID NO: 458569 - protein, 9 aa, Homo Sapiens
HRFYTRAAT

SEQ ID NO: 458570 - protein, 9 aa, Homo Sapiens
MVQTLKNEL

SEQ ID NO: 458571 - protein, 9 aa, Homo Sapiens
ETITDLENR

SEQ ID NO: 458572 - protein, 9 aa, Homo Sapiens
PGLAAVFED

SEQ ID NO: 458573 - protein, 9 aa, Homo Sapiens
EIEEEVRRL

SEQ ID NO: 458574 - protein, 9 aa, Homo Sapiens
SNNEIEMIT

SEQ ID NO: 458575 - protein, 9 aa, Homo Sapiens
LDSEANLTC

SEQ ID NO: 458576 - protein, 9 aa, Homo Sapiens
WEEHTTCLA

SEQ ID NO: 458577 - protein, 9 aa, Homo Sapiens
VPVRKPPPG

SEQ ID NO: 458578 - protein, 9 aa, Homo Sapiens
EAITKSEKL

SEQ ID NO: 458579 - protein, 9 aa, Homo Sapiens
RNYYSLVLD

SEQ ID NO: 458580 - protein, 9 aa, Homo Sapiens
EIEGATGGL

SEQ ID NO: 458581 - protein, 9 aa, Homo Sapiens
ENPSKEIIG

SEQ ID NO: 458582 - protein, 9 aa, Homo Sapiens
DAMVRDYMR

SEQ ID NO: 458583 - protein, 9 aa, Homo Sapiens
NLMYHIQQV

SEQ ID NO: 458584 - protein, 9 aa, Homo Sapiens
AACSFFVLL

SEQ ID NO: 458585 - protein, 9 aa, Homo Sapiens
DPFRKGLNY

SEQ ID NO: 458586 - protein, 9 aa, Homo Sapiens
PSKCFFISP

SEQ ID NO: 458587 - protein, 9 aa, Homo Sapiens
RAKIIRNPG

SEQ ID NO: 458588 - protein, 9 aa, Homo Sapiens
YNFTGLSVS

SEQ ID NO: 458589 - protein, 9 aa, Homo Sapiens
GTKAVTEYT

SEQ ID NO: 458590 - protein, 9 aa, Homo Sapiens
DKDSEEEPP

SEQ ID NO: 458591 - protein, 9 aa, Homo Sapiens
RAKEAITKS

SEQ ID NO: 458592 - protein, 9 aa, Homo Sapiens
SHSLSRITT

SEQ ID NO: 458593 - protein, 9 aa, Homo Sapiens
YVHPGGGFV

SEQ ID NO: 458594 - protein, 9 aa, Homo Sapiens
ASVLPFKIY

SEQ ID NO: 458595 - protein, 9 aa, Homo Sapiens
DDEDKDSEE

SEQ ID NO: 458596 - protein, 9 aa, Homo Sapiens
RLKFNLGKI

SEQ ID NO: 458597 - protein, 9 aa, Homo Sapiens
EQGDTSRVN

SEQ ID NO: 458598 - protein, 9 aa, Homo Sapiens
SSHSLSRIT

SEQ ID NO: 458599 - protein, 9 aa, Homo Sapiens
DCATGFCCH

SEQ ID NO: 458600 - protein, 9 aa, Homo Sapiens
KNYIHQDLR

SEQ ID NO: 458601 - protein, 9 aa, Homo Sapiens
MLASVLPFK

SEQ ID NO: 458602 - protein, 9 aa, Homo Sapiens
KVGFAGDDA

SEQ ID NO: 458603 - protein, 9 aa, Homo Sapiens
QHARTQEDK

SEQ ID NO: 458604 - protein, 9 aa, Homo Sapiens
AKEAITKSE

SEQ ID NO: 458605 - protein, 9 aa, Homo Sapiens
HPAIHFSSI

SEQ ID NO: 458606 - protein, 9 aa, Homo Sapiens
FSRGCPQLG

SEQ ID NO: 458607 - protein, 9 aa, Homo Sapiens
LLDSEANLT

SEQ ID NO: 458608 - protein, 9 aa, Homo Sapiens
PCFQLHSIC

SEQ ID NO: 458609 - protein, 9 aa, Homo Sapiens
PPLRPVPPE

SEQ ID NO: 458610 - protein, 9 aa, Homo Sapiens
AWLPLIIEI

SEQ ID NO: 458611 - protein, 9 aa, Homo Sapiens
QIQSVEPFT

SEQ ID NO: 458612 - protein, 9 aa, Homo Sapiens
GTIEELRER

SEQ ID NO: 458613 - protein, 9 aa, Homo Sapiens
SIREELKST

SEQ ID NO: 458614 - protein, 9 aa, Homo Sapiens
DSEEEPPKK

SEQ ID NO: 458615 - protein, 9 aa, Homo Sapiens
RIVTTLINS

SEQ ID NO: 458616 - protein, 9 aa, Homo Sapiens
ITLLSSPLY

SEQ ID NO: 458617 - protein, 9 aa, Homo Sapiens
RPVSSPSAP

SEQ ID NO: 458618 - protein, 9 aa, Homo Sapiens
DGPRPLLLL

SEQ ID NO: 458619 - protein, 9 aa, Homo Sapiens
ASLLNCWNP

SEQ ID NO: 458620 - protein, 9 aa, Homo Sapiens
HSSHSLSRI

SEQ ID NO: 458621 - protein, 9 aa, Homo Sapiens
SWEEHTTCL

SEQ ID NO: 458622 - protein, 9 aa, Homo Sapiens
NPNTIFSQS

SEQ ID NO: 458623 - protein, 9 aa, Homo Sapiens
VMGLKGQMI

SEQ ID NO: 458624 - protein, 9 aa, Homo Sapiens
LSNNEIEMI

SEQ ID NO: 458625 - protein, 9 aa, Homo Sapiens
NRHCNMVLE

SEQ ID NO: 458626 - protein, 9 aa, Homo Sapiens
NRDSNGAKK

SEQ ID NO: 458627 - protein, 9 aa, Homo Sapiens
LEIEGATGG

SEQ ID NO: 458628 - protein, 9 aa, Homo Sapiens
GKIGREVNG

SEQ ID NO: 458629 - protein, 9 aa, Homo Sapiens
RRRHAEHHA

SEQ ID NO: 458630 - protein, 9 aa, Homo Sapiens
THYMDYSVG

SEQ ID NO: 458631 - protein, 9 aa, Homo Sapiens
SRPVSSPSA

SEQ ID NO: 458632 - protein, 9 aa, Homo Sapiens
TYRNYYSLV

SEQ ID NO: 458633 - protein, 9 aa, Homo Sapiens
MPDPKSFPH

SEQ ID NO: 458634 - protein, 9 aa, Homo Sapiens
RNEKAYLNK

SEQ ID NO: 458635 - protein, 9 aa, Homo Sapiens
STDTIFWPG

SEQ ID NO: 458636 - protein, 9 aa, Homo Sapiens
SFTAEQLYH

SEQ ID NO: 458637 - protein, 9 aa, Homo Sapiens
PLEIEGATG

SEQ ID NO: 458638 - protein, 9 aa, Homo Sapiens
HYMDYSVGV

SEQ ID NO: 458639 - protein, 9 aa, Homo Sapiens
AITKSEKLV

SEQ ID NO: 458640 - protein, 9 aa, Homo Sapiens
AKKVISYRG

SEQ ID NO: 458641 - protein, 9 aa, Homo Sapiens
VVDFTTHYM

SEQ ID NO: 458642 - protein, 9 aa, Homo Sapiens
VPITPENPS

SEQ ID NO: 458643 - protein, 9 aa, Homo Sapiens
NGSGMCKVG

SEQ ID NO: 458644 - protein, 9 aa, Homo Sapiens
KEIMKKVVR

SEQ ID NO: 458645 - protein, 9 aa, Homo Sapiens
LTASLLNCW

SEQ ID NO: 458646 - protein, 9 aa, Homo Sapiens
FEGQQPGNL

SEQ ID NO: 458647 - protein, 9 aa, Homo Sapiens
DLLWNLLQV

SEQ ID NO: 458648 - protein, 9 aa, Homo Sapiens
GMREMRAGG

SEQ ID NO: 458649 - protein, 9 aa, Homo Sapiens
PENPSKEII

SEQ ID NO: 458650 - protein, 9 aa, Homo Sapiens
DYYHQRRQK

SEQ ID NO: 458651 - protein, 9 aa, Homo Sapiens
HGDLLPINS

SEQ ID NO: 458652 - protein, 9 aa, Homo Sapiens
AFCTDCATG

SEQ ID NO: 458653 - protein, 9 aa, Homo Sapiens
TGASASFKL

SEQ ID NO: 458654 - protein, 9 aa, Homo Sapiens
QLQPHPQPP

SEQ ID NO: 458655 - protein, 9 aa, Homo Sapiens
EKLHRQKDS

SEQ ID NO: 458656 - protein, 9 aa, Homo Sapiens
PVGCGHFAE

SEQ ID NO: 458657 - protein, 9 aa, Homo Sapiens
LGKDCETYK

SEQ ID NO: 458658 - protein, 9 aa, Homo Sapiens
LRAMRIRAP

SEQ ID NO: 458659 - protein, 9 aa, Homo Sapiens
KDLLWNLLQ

SEQ ID NO: 458660 - protein, 9 aa, Homo Sapiens
VRSPVGCGH

SEQ ID NO: 458661 - protein, 9 aa, Homo Sapiens
LEPQLEAAH

SEQ ID NO: 458662 - protein, 9 aa, Homo Sapiens
NLQSVFQAS

SEQ ID NO: 458663 - protein, 9 aa, Homo Sapiens
GRAMDGPRP

SEQ ID NO: 458664 - protein, 9 aa, Homo Sapiens
TSAHTVSSA

SEQ ID NO: 458665 - protein, 9 aa, Homo Sapiens
METKRNKEH

SEQ ID NO: 458666 - protein, 9 aa, Homo Sapiens
KVEVMSRAE

SEQ ID NO: 458667 - protein, 9 aa, Homo Sapiens
PPGCYHYAE

SEQ ID NO: 458668 - protein, 9 aa, Homo Sapiens
PAGPTGIMG

SEQ ID NO: 458669 - protein, 9 aa, Homo Sapiens
AFISSYIRY

SEQ ID NO: 458670 - protein, 9 aa, Homo Sapiens
GRLLALVES

SEQ ID NO: 458671 - protein, 9 aa, Homo Sapiens
ERRRQTGAQ

SEQ ID NO: 458672 - protein, 9 aa, Homo Sapiens
GPRSLLAVA

SEQ ID NO: 458673 - protein, 9 aa, Homo Sapiens
QYAIPHPDE

SEQ ID NO: 458674 - protein, 9 aa, Homo Sapiens
APSASPSYE

SEQ ID NO: 458675 - protein, 9 aa, Homo Sapiens
CSGTCVLGL

SEQ ID NO: 458676 - protein, 9 aa, Homo Sapiens
EELAKAVAL

SEQ ID NO: 458677 - protein, 9 aa, Homo Sapiens
PSLKMPKVE

SEQ ID NO: 458678 - protein, 9 aa, Homo Sapiens
NATLQMLWN

SEQ ID NO: 458679 - protein, 9 aa, Homo Sapiens
AWALRPVPS

SEQ ID NO: 458680 - protein, 9 aa, Homo Sapiens
EFMETKRNK

SEQ ID NO: 458681 - protein, 9 aa, Homo Sapiens
IVSFYRLNE

SEQ ID NO: 458682 - protein, 9 aa, Homo Sapiens
LCGMREMRA

SEQ ID NO: 458683 - protein, 9 aa, Homo Sapiens
IMERPPPAM

SEQ ID NO: 458684 - protein, 9 aa, Homo Sapiens
VGGLPGGTG

SEQ ID NO: 458685 - protein, 9 aa, Homo Sapiens
HCGKAFISS

SEQ ID NO: 458686 - protein, 9 aa, Homo Sapiens
PWILLLAMF

SEQ ID NO: 458687 - protein, 9 aa, Homo Sapiens
QWATVATFL

SEQ ID NO: 458688 - protein, 9 aa, Homo Sapiens
WLTIYNANI

SEQ ID NO: 458689 - protein, 9 aa, Homo Sapiens
KIVKGDRDM

SEQ ID NO: 458690 - protein, 9 aa, Homo Sapiens
DQNFGNRPM

SEQ ID NO: 458691 - protein, 9 aa, Homo Sapiens
ETKRNKEHE

SEQ ID NO: 458692 - protein, 9 aa, Homo Sapiens
ELTKLHQLA

SEQ ID NO: 458693 - protein, 9 aa, Homo Sapiens
PISESMLER

SEQ ID NO: 458694 - protein, 9 aa, Homo Sapiens
AMVNGRHNY

SEQ ID NO: 458695 - protein, 9 aa, Homo Sapiens
SYETLKQRG

SEQ ID NO: 458696 - protein, 9 aa, Homo Sapiens
ERGGGAPPP

SEQ ID NO: 458697 - protein, 9 aa, Homo Sapiens
VRSWLTIYN

SEQ ID NO: 458698 - protein, 9 aa, Homo Sapiens
KKGREDVDE

SEQ ID NO: 458699 - protein, 9 aa, Homo Sapiens
YKVEVMSRA

SEQ ID NO: 458700 - protein, 9 aa, Homo Sapiens
RSWLTIYNA

SEQ ID NO: 458701 - protein, 9 aa, Homo Sapiens
YIIHDKKDQ

SEQ ID NO: 458702 - protein, 9 aa, Homo Sapiens
WASPPGHWL

SEQ ID NO: 458703 - protein, 9 aa, Homo Sapiens
SGCRLLFLF

SEQ ID NO: 458704 - protein, 9 aa, Homo Sapiens
QGFERRFRA

SEQ ID NO: 458705 - protein, 9 aa, Homo Sapiens
MENEHHNLE

SEQ ID NO: 458706 - protein, 9 aa, Homo Sapiens
ELKGPQVEV

SEQ ID NO: 458707 - protein, 9 aa, Homo Sapiens
CLPDSRDSP

SEQ ID NO: 458708 - protein, 9 aa, Homo Sapiens
HMAKVHPDP

SEQ ID NO: 458709 - protein, 9 aa, Homo Sapiens
RAVRTLRSF

SEQ ID NO: 458710 - protein, 9 aa, Homo Sapiens
RNGDPKMRR

SEQ ID NO: 458711 - protein, 9 aa, Homo Sapiens
KLFSLQLEL

SEQ ID NO: 458712 - protein, 9 aa, Homo Sapiens
TCSGTCVLG

SEQ ID NO: 458713 - protein, 9 aa, Homo Sapiens
SLRISCRTS

SEQ ID NO: 458714 - protein, 9 aa, Homo Sapiens
LKMPKVELK

SEQ ID NO: 458715 - protein, 9 aa, Homo Sapiens
ESNLDFTRK

SEQ ID NO: 458716 - protein, 9 aa, Homo Sapiens
KSMEVLSVM

SEQ ID NO: 458717 - protein, 9 aa, Homo Sapiens
GRLIATTFS

SEQ ID NO: 458718 - protein, 9 aa, Homo Sapiens
FSVSDVGSH

SEQ ID NO: 458719 - protein, 9 aa, Homo Sapiens
LLAMFISGV

SEQ ID NO: 458720 - protein, 9 aa, Homo Sapiens
GGPRSLLAV

SEQ ID NO: 458721 - protein, 9 aa, Homo Sapiens
KGREDVDEA

SEQ ID NO: 458722 - protein, 9 aa, Homo Sapiens
GQLHTWVAV

SEQ ID NO: 458723 - protein, 9 aa, Homo Sapiens
DAREWERIH

SEQ ID NO: 458724 - protein, 9 aa, Homo Sapiens
RERRRQTGA

SEQ ID NO: 458725 - protein, 9 aa, Homo Sapiens
SKVRSVLHP

SEQ ID NO: 458726 - protein, 9 aa, Homo Sapiens
NGDPKMRRA

SEQ ID NO: 458727 - protein, 9 aa, Homo Sapiens
YHMAKVHPD

SEQ ID NO: 458728 - protein, 9 aa, Homo Sapiens
WLLFYAIAQ

SEQ ID NO: 458729 - protein, 9 aa, Homo Sapiens
KRCFLREGN

SEQ ID NO: 458730 - protein, 9 aa, Homo Sapiens
GNRPMTPMR

SEQ ID NO: 458731 - protein, 9 aa, Homo Sapiens
SGAGFSVSD

SEQ ID NO: 458732 - protein, 9 aa, Homo Sapiens
LLFYAIAQA

SEQ ID NO: 458733 - protein, 9 aa, Homo Sapiens
SESMLERLS

SEQ ID NO: 458734 - protein, 9 aa, Homo Sapiens
SCRTSGYSF

SEQ ID NO: 458735 - protein, 9 aa, Homo Sapiens
ESMLERLSK

SEQ ID NO: 458736 - protein, 9 aa, Homo Sapiens
MELTHPSNM

SEQ ID NO: 458737 - protein, 9 aa, Homo Sapiens
MLWNPAIAV

SEQ ID NO: 458738 - protein, 9 aa, Homo Sapiens
DCEYMVNNF

SEQ ID NO: 458739 - protein, 9 aa, Homo Sapiens
LRISCRTSG

SEQ ID NO: 458740 - protein, 9 aa, Homo Sapiens
KFAAVSSGR

SEQ ID NO: 458741 - protein, 9 aa, Homo Sapiens
TKKGREDVD

SEQ ID NO: 458742 - protein, 9 aa, Homo Sapiens
KQGAGCGRM

SEQ ID NO: 458743 - protein, 9 aa, Homo Sapiens
LHPSQFGGQ

SEQ ID NO: 458744 - protein, 9 aa, Homo Sapiens
AAVSSGRPS

SEQ ID NO: 458745 - protein, 9 aa, Homo Sapiens
GAQKQGAGC

SEQ ID NO: 458746 - protein, 9 aa, Homo Sapiens
QEELEEPVH

SEQ ID NO: 458747 - protein, 9 aa, Homo Sapiens
IDLAQVLDL

SEQ ID NO: 458748 - protein, 9 aa, Homo Sapiens
KAVALLSQR

SEQ ID NO: 458749 - protein, 9 aa, Homo Sapiens
SGGKRERGG

SEQ ID NO: 458750 - protein, 9 aa, Homo Sapiens
RRRQTGAQK

SEQ ID NO: 458751 - protein, 9 aa, Homo Sapiens
DNATLQMLW

SEQ ID NO: 458752 - protein, 9 aa, Homo Sapiens
KVHYSSNPS

SEQ ID NO: 458753 - protein, 9 aa, Homo Sapiens
LLLAMFISG

SEQ ID NO: 458754 - protein, 9 aa, Homo Sapiens
KDGRSRESN

SEQ ID NO: 458755 - protein, 9 aa, Homo Sapiens
PGKKKGSRR

SEQ ID NO: 458756 - protein, 9 aa, Homo Sapiens
RSRESNLDF

SEQ ID NO: 458757 - protein, 9 aa, Homo Sapiens
ITHSGHFMV

SEQ ID NO: 458758 - protein, 9 aa, Homo Sapiens
SHLCPEPSE

SEQ ID NO: 458759 - protein, 9 aa, Homo Sapiens
AGPTGIMGP

SEQ ID NO: 458760 - protein, 9 aa, Homo Sapiens
HLCPEPSET

SEQ ID NO: 458761 - protein, 9 aa, Homo Sapiens
PGHWLQARA

SEQ ID NO: 458762 - protein, 9 aa, Homo Sapiens
VSHLCPEPS

SEQ ID NO: 458763 - protein, 9 aa, Homo Sapiens
VLFRGGPRS

SEQ ID NO: 458764 - protein, 9 aa, Homo Sapiens
VHYSSNPSG

SEQ ID NO: 458765 - protein, 9 aa, Homo Sapiens
RRIEKKVSD

SEQ ID NO: 458766 - protein, 9 aa, Homo Sapiens
ATVATFLYA

SEQ ID NO: 458767 - protein, 9 aa, Homo Sapiens
RLKDGASPR

SEQ ID NO: 458768 - protein, 9 aa, Homo Sapiens
LRLKYIIHD

SEQ ID NO: 458769 - protein, 9 aa, Homo Sapiens
MMRTAWALR

SEQ ID NO: 458770 - protein, 9 aa, Homo Sapiens
MKPWILLLA

SEQ ID NO: 458771 - protein, 9 aa, Homo Sapiens
GPLLLWLLF

SEQ ID NO: 458772 - protein, 9 aa, Homo Sapiens
PTGIMGPPG

SEQ ID NO: 458773 - protein, 9 aa, Homo Sapiens
REAPSRHSR

SEQ ID NO: 458774 - protein, 9 aa, Homo Sapiens
DELTKLHQL

SEQ ID NO: 458775 - protein, 9 aa, Homo Sapiens
HEMEEELAK

SEQ ID NO: 458776 - protein, 9 aa, Homo Sapiens
PTKKGREDV

SEQ ID NO: 458777 - protein, 9 aa, Homo Sapiens
ELEEPVHEE

SEQ ID NO: 458778 - protein, 9 aa, Homo Sapiens
EELEEPVHE

SEQ ID NO: 458779 - protein, 9 aa, Homo Sapiens
HRTKGRLLA

SEQ ID NO: 458780 - protein, 9 aa, Homo Sapiens
VTCPEPDKY

SEQ ID NO: 458781 - protein, 9 aa, Homo Sapiens
QITHSGHFM

SEQ ID NO: 458782 - protein, 9 aa, Homo Sapiens
ISESMLERL

SEQ ID NO: 458783 - protein, 9 aa, Homo Sapiens
RLLFLFLSP

SEQ ID NO: 458784 - protein, 9 aa, Homo Sapiens
RSLLAVAQD

SEQ ID NO: 458785 - protein, 9 aa, Homo Sapiens
GDHLLMADP

SEQ ID NO: 458786 - protein, 9 aa, Homo Sapiens
GSGFGGGFG

SEQ ID NO: 458787 - protein, 9 aa, Homo Sapiens
PVHEEPVYE

SEQ ID NO: 458788 - protein, 9 aa, Homo Sapiens
KDGYWKFQP

SEQ ID NO: 458789 - protein, 9 aa, Homo Sapiens
SGFGGGFGG

SEQ ID NO: 458790 - protein, 9 aa, Homo Sapiens
TSAAGTRTS

SEQ ID NO: 458791 - protein, 9 aa, Homo Sapiens
AAAFKVHYS

SEQ ID NO: 458792 - protein, 9 aa, Homo Sapiens
WVAVVNDVN

SEQ ID NO: 458793 - protein, 9 aa, Homo Sapiens
ITMELTHPS

SEQ ID NO: 458794 - protein, 9 aa, Homo Sapiens
GHPEPRHGA

SEQ ID NO: 458795 - protein, 9 aa, Homo Sapiens
PGDHLLMAD

SEQ ID NO: 458796 - protein, 9 aa, Homo Sapiens
APSRHSRSP

SEQ ID NO: 458797 - protein, 9 aa, Homo Sapiens
PSYETLKQR

SEQ ID NO: 458798 - protein, 9 aa, Homo Sapiens
FISSYIRYH

SEQ ID NO: 458799 - protein, 9 aa, Homo Sapiens
HHNLEARIK

SEQ ID NO: 458800 - protein, 9 aa, Homo Sapiens
MREMRAGGC

SEQ ID NO: 458801 - protein, 9 aa, Homo Sapiens
VQLVPYIID

SEQ ID NO: 458802 - protein, 9 aa, Homo Sapiens
GLDLDDFAG

SEQ ID NO: 458803 - protein, 9 aa, Homo Sapiens
LFRGGPRSL

SEQ ID NO: 458804 - protein, 9 aa, Homo Sapiens
CQILVVNGP

SEQ ID NO: 458805 - protein, 9 aa, Homo Sapiens
GFERRFRAV

SEQ ID NO: 458806 - protein, 9 aa, Homo Sapiens
GFSVSDVGS

SEQ ID NO: 458807 - protein, 9 aa, Homo Sapiens
TPCSITCRT

SEQ ID NO: 458808 - protein, 9 aa, Homo Sapiens
EFLRLAMAQ

SEQ ID NO: 458809 - protein, 9 aa, Homo Sapiens
LQVGVLYKV

SEQ ID NO: 458810 - protein, 9 aa, Homo Sapiens
ALGIPLTPK

SEQ ID NO: 458811 - protein, 9 aa, Homo Sapiens
ITLRLKYII

SEQ ID NO: 458812 - protein, 9 aa, Homo Sapiens
RIEEMENEH

SEQ ID NO: 458813 - protein, 9 aa, Homo Sapiens
CGRMMRTAW

SEQ ID NO: 458814 - protein, 9 aa, Homo Sapiens
YMVNNFRCI

SEQ ID NO: 458815 - protein, 9 aa, Homo Sapiens
LWNPAIAVA

SEQ ID NO: 458816 - protein, 9 aa, Homo Sapiens
ERRFRAVRT

SEQ ID NO: 458817 - protein, 9 aa, Homo Sapiens
RNDLLLRVW

SEQ ID NO: 458818 - protein, 9 aa, Homo Sapiens
PPCHRGVNN

SEQ ID NO: 458819 - protein, 9 aa, Homo Sapiens
KEGVRSWLT

SEQ ID NO: 458820 - protein, 9 aa, Homo Sapiens
ATLQMLWNP

SEQ ID NO: 458821 - protein, 9 aa, Homo Sapiens
ASGAGFSVS

SEQ ID NO: 458822 - protein, 9 aa, Homo Sapiens
PEPRHGALI

SEQ ID NO: 458823 - protein, 9 aa, Homo Sapiens
GPELEVRDR

SEQ ID NO: 458824 - protein, 9 aa, Homo Sapiens
VNGPELEVR

SEQ ID NO: 458825 - protein, 9 aa, Homo Sapiens
RRQRQEEKH

SEQ ID NO: 458826 - protein, 9 aa, Homo Sapiens
TCPEPDKYR

SEQ ID NO: 458827 - protein, 9 aa, Homo Sapiens
ELAKAVALL

SEQ ID NO: 458828 - protein, 9 aa, Homo Sapiens
ALRPVPSTT

SEQ ID NO: 458829 - protein, 9 aa, Homo Sapiens
LAMFISGVV

SEQ ID NO: 458830 - protein, 9 aa, Homo Sapiens
MERPPPAMV

SEQ ID NO: 458831 - protein, 9 aa, Homo Sapiens
PGCYHYAED

SEQ ID NO: 458832 - protein, 9 aa, Homo Sapiens
HPSQFGGQP

SEQ ID NO: 458833 - protein, 9 aa, Homo Sapiens
LFSLQLELS

SEQ ID NO: 458834 - protein, 9 aa, Homo Sapiens
SETRVSHLR

SEQ ID NO: 458835 - protein, 9 aa, Homo Sapiens
KMPKVELKG

SEQ ID NO: 458836 - protein, 9 aa, Homo Sapiens
LWASPPGHW

SEQ ID NO: 458837 - protein, 9 aa, Homo Sapiens
QSKVRSVLH

SEQ ID NO: 458838 - protein, 9 aa, Homo Sapiens
KEHEGKVDS

SEQ ID NO: 458839 - protein, 9 aa, Homo Sapiens
RLNEVQRFE

SEQ ID NO: 458840 - protein, 9 aa, Homo Sapiens
TDSMETDGI

SEQ ID NO: 458841 - protein, 9 aa, Homo Sapiens
MRRAVLLSR

SEQ ID NO: 458842 - protein, 9 aa, Homo Sapiens
SHRRIEKKV

SEQ ID NO: 458843 - protein, 9 aa, Homo Sapiens
VAVVNDVNP

SEQ ID NO: 458844 - protein, 9 aa, Homo Sapiens
VHPDPGTWD

SEQ ID NO: 458845 - protein, 9 aa, Homo Sapiens
GAGFSVSDV

SEQ ID NO: 458846 - protein, 9 aa, Homo Sapiens
PHPDELTKL

SEQ ID NO: 458847 - protein, 9 aa, Homo Sapiens
EYMVNNFRC

SEQ ID NO: 458848 - protein, 9 aa, Homo Sapiens
NYQGLHFSG

SEQ ID NO: 458849 - protein, 9 aa, Homo Sapiens
KGSRRKSTE

SEQ ID NO: 458850 - protein, 9 aa, Homo Sapiens
PSLSITMEL

SEQ ID NO: 458851 - protein, 9 aa, Homo Sapiens
QRQEEKHKK

SEQ ID NO: 458852 - protein, 9 aa, Homo Sapiens
CLRRRQRQE

SEQ ID NO: 458853 - protein, 9 aa, Homo Sapiens
EHHNLEARI

SEQ ID NO: 458854 - protein, 9 aa, Homo Sapiens
HYVAAAFKV

SEQ ID NO: 458855 - protein, 9 aa, Homo Sapiens
PYQGKDGYW

SEQ ID NO: 458856 - protein, 9 aa, Homo Sapiens
QSTMRQRSR

SEQ ID NO: 458857 - protein, 9 aa, Homo Sapiens
KEFVKEKEK

SEQ ID NO: 458858 - protein, 9 aa, Homo Sapiens
GRSRESNLD

SEQ ID NO: 458859 - protein, 9 aa, Homo Sapiens
SFNRLSHLT

SEQ ID NO: 458860 - protein, 9 aa, Homo Sapiens
VALKEAIKG

SEQ ID NO: 458861 - protein, 9 aa, Homo Sapiens
TQRQQKLFS

SEQ ID NO: 458862 - protein, 9 aa, Homo Sapiens
LLWLLFYAI

SEQ ID NO: 458863 - protein, 9 aa, Homo Sapiens
DGRSRESNL

SEQ ID NO: 458864 - protein, 9 aa, Homo Sapiens
EPVHEEPVY

SEQ ID NO: 458865 - protein, 9 aa, Homo Sapiens
RGGGAPPPL

SEQ ID NO: 458866 - protein, 9 aa, Homo Sapiens
HRGVNNISV

SEQ ID NO: 458867 - protein, 9 aa, Homo Sapiens
KSFNRLSHL

SEQ ID NO: 458868 - protein, 9 aa, Homo Sapiens
YYCLRRRQR

SEQ ID NO: 458869 - protein, 9 aa, Homo Sapiens
VSSGRPSSQ

SEQ ID NO: 458870 - protein, 9 aa, Homo Sapiens
RRERRRQTG

SEQ ID NO: 458871 - protein, 9 aa, Homo Sapiens
SLSITMELT

SEQ ID NO: 458872 - protein, 9 aa, Homo Sapiens
LFPSLSITM

SEQ ID NO: 458873 - protein, 9 aa, Homo Sapiens
WLNVSQDDV

SEQ ID NO: 458874 - protein, 9 aa, Homo Sapiens
FPSLSITME

SEQ ID NO: 458875 - protein, 9 aa, Homo Sapiens
PRSLLAVAQ

SEQ ID NO: 458876 - protein, 9 aa, Homo Sapiens
FRGGPRSLL

SEQ ID NO: 458877 - protein, 9 aa, Homo Sapiens
VIEKRCFLR

SEQ ID NO: 458878 - protein, 9 aa, Homo Sapiens
GKDGYWKFQ

SEQ ID NO: 458879 - protein, 9 aa, Homo Sapiens
VDAREWERI

SEQ ID NO: 458880 - protein, 9 aa, Homo Sapiens
LWLLFYAIA

SEQ ID NO: 458881 - protein, 9 aa, Homo Sapiens
LRVWLNVSQ

SEQ ID NO: 458882 - protein, 9 aa, Homo Sapiens
DGIIPILEK

SEQ ID NO: 458883 - protein, 9 aa, Homo Sapiens
NEVEDLYEL

SEQ ID NO: 458884 - protein, 9 aa, Homo Sapiens
RQQITHSGH

SEQ ID NO: 458885 - protein, 9 aa, Homo Sapiens
HPDPGTWDS

SEQ ID NO: 458886 - protein, 9 aa, Homo Sapiens
RQTGAQKQG

SEQ ID NO: 458887 - protein, 9 aa, Homo Sapiens
LHTWVAVVN

SEQ ID NO: 458888 - protein, 9 aa, Homo Sapiens
FSLQLELSK

SEQ ID NO: 458889 - protein, 9 aa, Homo Sapiens
KGQLHTWVA

SEQ ID NO: 458890 - protein, 9 aa, Homo Sapiens
AGTRTSSLP

SEQ ID NO: 458891 - protein, 9 aa, Homo Sapiens
FYRLNEVQR

SEQ ID NO: 458892 - protein, 9 aa, Homo Sapiens
AHTVSSALP

SEQ ID NO: 458893 - protein, 9 aa, Homo Sapiens
AIMERPPPA

SEQ ID NO: 458894 - protein, 9 aa, Homo Sapiens
PGSVGGLPG

SEQ ID NO: 458895 - protein, 9 aa, Homo Sapiens
IATTFSLIG

SEQ ID NO: 458896 - protein, 9 aa, Homo Sapiens
QGLHFSGVN

SEQ ID NO: 458897 - protein, 9 aa, Homo Sapiens
GLGGAMVWG

SEQ ID NO: 458898 - protein, 9 aa, Homo Sapiens
GHLSGCRLL

SEQ ID NO: 458899 - protein, 9 aa, Homo Sapiens
GNEVEDLYE

SEQ ID NO: 458900 - protein, 9 aa, Homo Sapiens
RQGQLVEIE

SEQ ID NO: 458901 - protein, 9 aa, Homo Sapiens
WTCSGTCVL

SEQ ID NO: 458902 - protein, 9 aa, Homo Sapiens
GQLVEIERT

SEQ ID NO: 458903 - protein, 9 aa, Homo Sapiens
SLLAVAQDL

SEQ ID NO: 458904 - protein, 9 aa, Homo Sapiens
EVLSVMDGG

SEQ ID NO: 458905 - protein, 9 aa, Homo Sapiens
KYIIHDKKD

SEQ ID NO: 458906 - protein, 9 aa, Homo Sapiens
IHDKKDQQN

SEQ ID NO: 458907 - protein, 9 aa, Homo Sapiens
AKVHPDPGT

SEQ ID NO: 458908 - protein, 9 aa, Homo Sapiens
AHTSQPTNY

SEQ ID NO: 458909 - protein, 9 aa, Homo Sapiens
RRQQITHSG

SEQ ID NO: 458910 - protein, 9 aa, Homo Sapiens
SASPSYEET

SEQ ID NO: 458911 - protein, 9 aa, Homo Sapiens
VDVQLVPYI

SEQ ID NO: 458912 - protein, 9 aa, Homo Sapiens
GREAPSRHS

SEQ ID NO: 458913 - protein, 9 aa, Homo Sapiens
GPTGIMGPP

SEQ ID NO: 458914 - protein, 9 aa, Homo Sapiens
TTSAAGTRT

SEQ ID NO: 458915 - protein, 9 aa, Homo Sapiens
NPQQAQALG

SEQ ID NO: 458916 - protein, 9 aa, Homo Sapiens
QMLWNPAIA

SEQ ID NO: 458917 - protein, 9 aa, Homo Sapiens
LNPQQAQAL

SEQ ID NO: 458918 - protein, 9 aa, Homo Sapiens
GKRERGGGA

SEQ ID NO: 458919 - protein, 9 aa, Homo Sapiens
TRKTWERET

SEQ ID NO: 458920 - protein, 9 aa, Homo Sapiens
ASQNKEFVK

SEQ ID NO: 458921 - protein, 9 aa, Homo Sapiens
NGPELEVRD

SEQ ID NO: 458922 - protein, 9 aa, Homo Sapiens
VWGLDLDDF

SEQ ID NO: 458923 - protein, 9 aa, Homo Sapiens
RKTWERETA

SEQ ID NO: 458924 - protein, 9 aa, Homo Sapiens
AGCGRMMRT

SEQ ID NO: 458925 - protein, 9 aa, Homo Sapiens
LLALVESPE

SEQ ID NO: 458926 - protein, 9 aa, Homo Sapiens
PLLLWLLFY

SEQ ID NO: 458927 - protein, 9 aa, Homo Sapiens
EKRCFLREG

SEQ ID NO: 458928 - protein, 9 aa, Homo Sapiens
STTSAAGTR

SEQ ID NO: 458929 - protein, 9 aa, Homo Sapiens
GLPGGTGSG

SEQ ID NO: 458930 - protein, 9 aa, Homo Sapiens
SVGGLPGGT

SEQ ID NO: 458931 - protein, 9 aa, Homo Sapiens
ALVSPISES

SEQ ID NO: 458932 - protein, 9 aa, Homo Sapiens
VLGQVDVQL

SEQ ID NO: 458933 - protein, 9 aa, Homo Sapiens
CEGNEVEDL

SEQ ID NO: 458934 - protein, 9 aa, Homo Sapiens
GSRRKSTEF

SEQ ID NO: 458935 - protein, 9 aa, Homo Sapiens
QTYTAHTSQ

SEQ ID NO: 458936 - protein, 9 aa, Homo Sapiens
FLRLAMAQP

SEQ ID NO: 458937 - protein, 9 aa, Homo Sapiens
LKDGASPRS

SEQ ID NO: 458938 - protein, 9 aa, Homo Sapiens
SRHSRSPRT

SEQ ID NO: 458939 - protein, 9 aa, Homo Sapiens
REWERIHAK

SEQ ID NO: 458940 - protein, 9 aa, Homo Sapiens
EKKVSDKRT

SEQ ID NO: 458941 - protein, 9 aa, Homo Sapiens
HWLQARAEL

SEQ ID NO: 458942 - protein, 9 aa, Homo Sapiens
GQVDVQLVP

SEQ ID NO: 458943 - protein, 9 aa, Homo Sapiens
NKEFVKEKE

SEQ ID NO: 458944 - protein, 9 aa, Homo Sapiens
GGKRERGGG

SEQ ID NO: 458945 - protein, 9 aa, Homo Sapiens
AMVWGLDLD

SEQ ID NO: 458946 - protein, 9 aa, Homo Sapiens
LGGAMVWGL

SEQ ID NO: 458947 - protein, 9 aa, Homo Sapiens
RLAMAQPVN

SEQ ID NO: 458948 - protein, 9 aa, Homo Sapiens
ENEHHNLEA

SEQ ID NO: 458949 - protein, 9 aa, Homo Sapiens
STMRQRSRS

SEQ ID NO: 458950 - protein, 9 aa, Homo Sapiens
ASLQERVLV

SEQ ID NO: 458951 - protein, 9 aa, Homo Sapiens
TWEGRLIAT

SEQ ID NO: 458952 - protein, 9 aa, Homo Sapiens
PSETRVSHL

SEQ ID NO: 458953 - protein, 9 aa, Homo Sapiens
GTQRQQKLF

SEQ ID NO: 458954 - protein, 9 aa, Homo Sapiens
FRAVRTLRS

SEQ ID NO: 458955 - protein, 9 aa, Homo Sapiens
SRRKSTEFY

SEQ ID NO: 458956 - protein, 9 aa, Homo Sapiens
LHFSGVNDT

SEQ ID NO: 458957 - protein, 9 aa, Homo Sapiens
HTVSSALPS

SEQ ID NO: 458958 - protein, 9 aa, Homo Sapiens
PELEVRDRD

SEQ ID NO: 458959 - protein, 9 aa, Homo Sapiens
NEFLRLAMA

SEQ ID NO: 458960 - protein, 9 aa, Homo Sapiens
TAAVSPVQR

SEQ ID NO: 458961 - protein, 9 aa, Homo Sapiens
CGKAFISSY

SEQ ID NO: 458962 - protein, 9 aa, Homo Sapiens
GTSAHTVSS

SEQ ID NO: 458963 - protein, 9 aa, Homo Sapiens
HPEPRHGAL

SEQ ID NO: 458964 - protein, 9 aa, Homo Sapiens
RRFRAVRTL

SEQ ID NO: 458965 - protein, 9 aa, Homo Sapiens
DLLLRVWLN

SEQ ID NO: 458966 - protein, 9 aa, Homo Sapiens
SPISESMLE

SEQ ID NO: 458967 - protein, 9 aa, Homo Sapiens
RTSSLPWKD

SEQ ID NO: 458968 - protein, 9 aa, Homo Sapiens
SYIRYHERT

SEQ ID NO: 458969 - protein, 9 aa, Homo Sapiens
PSASPSYEE

SEQ ID NO: 458970 - protein, 9 aa, Homo Sapiens
AMAQPVNPQ

SEQ ID NO: 458971 - protein, 9 aa, Homo Sapiens
MAQPVNPQL

SEQ ID NO: 458972 - protein, 9 aa, Homo Sapiens
RTSGYSFTS

SEQ ID NO: 458973 - protein, 9 aa, Homo Sapiens
SNLDFTRKT

SEQ ID NO: 458974 - protein, 9 aa, Homo Sapiens
SPQSTMRQR

SEQ ID NO: 458975 - protein, 9 aa, Homo Sapiens
VMDGGSPVP

SEQ ID NO: 458976 - protein, 9 aa, Homo Sapiens
VSFYRLNEV

SEQ ID NO: 458977 - protein, 9 aa, Homo Sapiens
WGLDLDDFA

SEQ ID NO: 458978 - protein, 9 aa, Homo Sapiens
LQMLWNPAI

SEQ ID NO: 458979 - protein, 9 aa, Homo Sapiens
FKVHYSSNP

SEQ ID NO: 458980 - protein, 9 aa, Homo Sapiens
EDVDEAHYA

SEQ ID NO: 458981 - protein, 9 aa, Homo Sapiens
TGIMGPPGL

SEQ ID NO: 458982 - protein, 9 aa, Homo Sapiens
LPGGTGSGD

SEQ ID NO: 458983 - protein, 9 aa, Homo Sapiens
FRNGDPKMR

SEQ ID NO: 458984 - protein, 9 aa, Homo Sapiens
ASRRYHAKR

SEQ ID NO: 458985 - protein, 9 aa, Homo Sapiens
CRTSGYSFT

SEQ ID NO: 458986 - protein, 9 aa, Homo Sapiens
GIIPILEKL

SEQ ID NO: 458987 - protein, 9 aa, Homo Sapiens
VVNGPELEV

SEQ ID NO: 458988 - protein, 9 aa, Homo Sapiens
SQPKIVKGD

SEQ ID NO: 458989 - protein, 9 aa, Homo Sapiens
AMFISGVVM

SEQ ID NO: 458990 - protein, 9 aa, Homo Sapiens
LSITMELTH

SEQ ID NO: 458991 - protein, 9 aa, Homo Sapiens
QDYGDCEYM

SEQ ID NO: 458992 - protein, 9 aa, Homo Sapiens
RQRQEEKHK

SEQ ID NO: 458993 - protein, 9 aa, Homo Sapiens
WILLLAMFI

SEQ ID NO: 458994 - protein, 9 aa, Homo Sapiens
KKGSRRKST

SEQ ID NO: 458995 - protein, 9 aa, Homo Sapiens
LAKAVALLS

SEQ ID NO: 458996 - protein, 9 aa, Homo Sapiens
ANPGDHLLM

SEQ ID NO: 458997 - protein, 9 aa, Homo Sapiens
RIEKKVSDK

SEQ ID NO: 458998 - protein, 9 aa, Homo Sapiens
LAMAQPVNP

SEQ ID NO: 458999 - protein, 9 aa, Homo Sapiens
PKIVKGDRD

SEQ ID NO: 459000 - protein, 9 aa, Homo Sapiens
AIPHPDELT

SEQ ID NO: 459001 - protein, 9 aa, Homo Sapiens
QPSYETLKQ

SEQ ID NO: 459002 - protein, 9 aa, Homo Sapiens
LVEIERTAF

SEQ ID NO: 459003 - protein, 9 aa, Homo Sapiens
WKDGRSRES

SEQ ID NO: 459004 - protein, 9 aa, Homo Sapiens
RVLVQLRAA

SEQ ID NO: 459005 - protein, 9 aa, Homo Sapiens
KKVSDKRTT

SEQ ID NO: 459006 - protein, 9 aa, Homo Sapiens
HYAEDKFNE

SEQ ID NO: 459007 - protein, 9 aa, Homo Sapiens
QIVSFYRLN

SEQ ID NO: 459008 - protein, 9 aa, Homo Sapiens
LSVMDGGSP

SEQ ID NO: 459009 - protein, 9 aa, Homo Sapiens
LRLAMAQPV

SEQ ID NO: 459010 - protein, 9 aa, Homo Sapiens
LFYAIAQAE

SEQ ID NO: 459011 - protein, 9 aa, Homo Sapiens
HGALIPVEG

SEQ ID NO: 459012 - protein, 9 aa, Homo Sapiens
TAWALRPVP

SEQ ID NO: 459013 - protein, 9 aa, Homo Sapiens
AQKQGAGCG

SEQ ID NO: 459014 - protein, 9 aa, Homo Sapiens
FVDAREWER

SEQ ID NO: 459015 - protein, 9 aa, Homo Sapiens
MADPTDAHN

SEQ ID NO: 459016 - protein, 9 aa, Homo Sapiens
EFVKEKEKL

SEQ ID NO: 459017 - protein, 9 aa, Homo Sapiens
LQWATVATF

SEQ ID NO: 459018 - protein, 9 aa, Homo Sapiens
KTWERETAA

SEQ ID NO: 459019 - protein, 9 aa, Homo Sapiens
ETAAVSPVQ

SEQ ID NO: 459020 - protein, 9 aa, Homo Sapiens
WPINYQGLH

SEQ ID NO: 459021 - protein, 9 aa, Homo Sapiens
RRYHAKRRE

SEQ ID NO: 459022 - protein, 9 aa, Homo Sapiens
SLKMPKVEL

SEQ ID NO: 459023 - protein, 9 aa, Homo Sapiens
AVSSGRPSS

SEQ ID NO: 459024 - protein, 9 aa, Homo Sapiens
PAQTYTAHT

SEQ ID NO: 459025 - protein, 9 aa, Homo Sapiens
HAKRRERRR

SEQ ID NO: 459026 - protein, 9 aa, Homo Sapiens
PAIDLAQVL

SEQ ID NO: 459027 - protein, 9 aa, Homo Sapiens
SFYRLNEVQ

SEQ ID NO: 459028 - protein, 9 aa, Homo Sapiens
TGAQKQGAG

SEQ ID NO: 459029 - protein, 9 aa, Homo Sapiens
KEFVDAREW

SEQ ID NO: 459030 - protein, 9 aa, Homo Sapiens
YAIPHPDEL

SEQ ID NO: 459031 - protein, 9 aa, Homo Sapiens
RHSRSPRTS

SEQ ID NO: 459032 - protein, 9 aa, Homo Sapiens
ERLKDGASP

SEQ ID NO: 459033 - protein, 9 aa, Homo Sapiens
QKEGVRSWL

SEQ ID NO: 459034 - protein, 9 aa, Homo Sapiens
HLSGCRLLF

SEQ ID NO: 459035 - protein, 9 aa, Homo Sapiens
YWKFQPGKA

SEQ ID NO: 459036 - protein, 9 aa, Homo Sapiens
PDELTKLHQ

SEQ ID NO: 459037 - protein, 9 aa, Homo Sapiens
GREDVDEAH

SEQ ID NO: 459038 - protein, 9 aa, Homo Sapiens
KAFISSYIR

SEQ ID NO: 459039 - protein, 9 aa, Homo Sapiens
ETDGIIPIL

SEQ ID NO: 459040 - protein, 9 aa, Homo Sapiens
CNLCLPDSR

SEQ ID NO: 459041 - protein, 9 aa, Homo Sapiens
METDGIIPI

SEQ ID NO: 459042 - protein, 9 aa, Homo Sapiens
GYWKFQPGK

SEQ ID NO: 459043 - protein, 9 aa, Homo Sapiens
FGGGSGFGG

SEQ ID NO: 459044 - protein, 9 aa, Homo Sapiens
ATTFSLIGV

SEQ ID NO: 459045 - protein, 9 aa, Homo Sapiens
VPSTTSAAG

SEQ ID NO: 459046 - protein, 9 aa, Homo Sapiens
KERLKDGAS

SEQ ID NO: 459047 - protein, 9 aa, Homo Sapiens
NKEHEGKVD

SEQ ID NO: 459048 - protein, 9 aa, Homo Sapiens
TDGIIPILE

SEQ ID NO: 459049 - protein, 9 aa, Homo Sapiens
PEPSETRVS

SEQ ID NO: 459050 - protein, 9 aa, Homo Sapiens
GRRKFAAVS

SEQ ID NO: 459051 - protein, 9 aa, Homo Sapiens
KVSDKRTTV

SEQ ID NO: 459052 - protein, 9 aa, Homo Sapiens
TKGRLLALV

SEQ ID NO: 459053 - protein, 9 aa, Homo Sapiens
SLQERVLVQ

SEQ ID NO: 459054 - protein, 9 aa, Homo Sapiens
VVLGQVDVQ

SEQ ID NO: 459055 - protein, 9 aa, Homo Sapiens
GKAFISSYI

SEQ ID NO: 459056 - protein, 9 aa, Homo Sapiens
GESLRISCR

SEQ ID NO: 459057 - protein, 9 aa, Homo Sapiens
SFGGGSGFG

SEQ ID NO: 459058 - protein, 9 aa, Homo Sapiens
LQPSYETLK

SEQ ID NO: 459059 - protein, 9 aa, Homo Sapiens
MPPCHRGVN

SEQ ID NO: 459060 - protein, 9 aa, Homo Sapiens
SITMELTHP

SEQ ID NO: 459061 - protein, 9 aa, Homo Sapiens
YDRQGQLVE

SEQ ID NO: 459062 - protein, 9 aa, Homo Sapiens
FTRKTWERE

SEQ ID NO: 459063 - protein, 9 aa, Homo Sapiens
QNFGNRPMT

SEQ ID NO: 459064 - protein, 9 aa, Homo Sapiens
YGDCEYMVN

SEQ ID NO: 459065 - protein, 9 aa, Homo Sapiens
TLQMLWNPA

SEQ ID NO: 459066 - protein, 9 aa, Homo Sapiens
SAHTVSSAL

SEQ ID NO: 459067 - protein, 9 aa, Homo Sapiens
LLCGMREMR

SEQ ID NO: 459068 - protein, 9 aa, Homo Sapiens
QGKDGYWKF

SEQ ID NO: 459069 - protein, 9 aa, Homo Sapiens
FVKEKEKLE

SEQ ID NO: 459070 - protein, 9 aa, Homo Sapiens
DPGTWDSFL

SEQ ID NO: 459071 - protein, 9 aa, Homo Sapiens
RKSTEFYSE

SEQ ID NO: 459072 - protein, 9 aa, Homo Sapiens
AAGTRTSSL

SEQ ID NO: 459073 - protein, 9 aa, Homo Sapiens
KRERGGGAP

SEQ ID NO: 459074 - protein, 9 aa, Homo Sapiens
KLQPSYETL

SEQ ID NO: 459075 - protein, 9 aa, Homo Sapiens
VLYKVEVMS

SEQ ID NO: 459076 - protein, 9 aa, Homo Sapiens
TLRLKYIIH

SEQ ID NO: 459077 - protein, 9 aa, Homo Sapiens
VAAAFKVHY

SEQ ID NO: 459078 - protein, 9 aa, Homo Sapiens
PSRHSRSPR

SEQ ID NO: 459079 - protein, 9 aa, Homo Sapiens
ISCRTSGYS

SEQ ID NO: 459080 - protein, 9 aa, Homo Sapiens
DGASPRSVP

SEQ ID NO: 459081 - protein, 9 aa, Homo Sapiens
TRTSSLPWK

SEQ ID NO: 459082 - protein, 9 aa, Homo Sapiens
HEEPVYEEV

SEQ ID NO: 459083 - protein, 9 aa, Homo Sapiens
RGREAPSRH

SEQ ID NO: 459084 - protein, 9 aa, Homo Sapiens
NRPMTPMRE

SEQ ID NO: 459085 - protein, 9 aa, Homo Sapiens
ALLCGMREM

SEQ ID NO: 459086 - protein, 9 aa, Homo Sapiens
FGGGFGGGG

SEQ ID NO: 459087 - protein, 9 aa, Homo Sapiens
QVYTKCEGN

SEQ ID NO: 459088 - protein, 9 aa, Homo Sapiens
LPSVGTSAH

SEQ ID NO: 459089 - protein, 9 aa, Homo Sapiens
EWERIHAKG

SEQ ID NO: 459090 - protein, 9 aa, Homo Sapiens
YPAQTYTAH

SEQ ID NO: 459091 - protein, 9 aa, Homo Sapiens
VGVTCPEPD

SEQ ID NO: 459092 - protein, 9 aa, Homo Sapiens
GKSFNRLSH

SEQ ID NO: 459093 - protein, 9 aa, Homo Sapiens
RLLALVESP

SEQ ID NO: 459094 - protein, 9 aa, Homo Sapiens
GGGSGFGGG

SEQ ID NO: 459095 - protein, 9 aa, Homo Sapiens
VLHPSQFGG

SEQ ID NO: 459096 - protein, 9 aa, Homo Sapiens
KPWILLLAM

SEQ ID NO: 459097 - protein, 9 aa, Homo Sapiens
PPGHWLQAR

SEQ ID NO: 459098 - protein, 9 aa, Homo Sapiens
PKMRRAVLL

SEQ ID NO: 459099 - protein, 9 aa, Homo Sapiens
GDPKMRRAV

SEQ ID NO: 459100 - protein, 9 aa, Homo Sapiens
TENPPGCYH

SEQ ID NO: 459101 - protein, 9 aa, Homo Sapiens
QGAGCGRMM

SEQ ID NO: 459102 - protein, 9 aa, Homo Sapiens
ESLRISCRT

SEQ ID NO: 459103 - protein, 9 aa, Homo Sapiens
QGQLVEIER

SEQ ID NO: 459104 - protein, 9 aa, Homo Sapiens
RMMRTAWAL

SEQ ID NO: 459105 - protein, 9 aa, Homo Sapiens
GKEEPLHIA

SEQ ID NO: 459106 - protein, 9 aa, Homo Sapiens
EGVRSWLTI

SEQ ID NO: 459107 - protein, 9 aa, Homo Sapiens
CEYMVNNFR

SEQ ID NO: 459108 - protein, 9 aa, Homo Sapiens
KRRERRRQT

SEQ ID NO: 459109 - protein, 9 aa, Homo Sapiens
GVLYKVEVM

SEQ ID NO: 459110 - protein, 9 aa, Homo Sapiens
RVWLNVSQD

SEQ ID NO: 459111 - protein, 9 aa, Homo Sapiens
EMPPCHRGV

SEQ ID NO: 459112 - protein, 9 aa, Homo Sapiens
MEEELAKAV

SEQ ID NO: 459113 - protein, 9 aa, Homo Sapiens
MRAGGCCHA

SEQ ID NO: 459114 - protein, 9 aa, Homo Sapiens
VLSVMDGGS

SEQ ID NO: 459115 - protein, 9 aa, Homo Sapiens
GTCVLGLHS

SEQ ID NO: 459116 - protein, 9 aa, Homo Sapiens
SGTCVLGLH

SEQ ID NO: 459117 - protein, 9 aa, Homo Sapiens
LRRRQRQEE

SEQ ID NO: 459118 - protein, 9 aa, Homo Sapiens
RKFAAVSSG

SEQ ID NO: 459119 - protein, 9 aa, Homo Sapiens
NPPGCYHYA

SEQ ID NO: 459120 - protein, 9 aa, Homo Sapiens
RTAWALRPV

SEQ ID NO: 459121 - protein, 9 aa, Homo Sapiens
QVGVLYKVE

SEQ ID NO: 459122 - protein, 9 aa, Homo Sapiens
YCLRRRQRQ

SEQ ID NO: 459123 - protein, 9 aa, Homo Sapiens
TPTKKGRED

SEQ ID NO: 459124 - protein, 9 aa, Homo Sapiens
GGLPGGTGS

SEQ ID NO: 459125 - protein, 9 aa, Homo Sapiens
WEGRLIATT

SEQ ID NO: 459126 - protein, 9 aa, Homo Sapiens
SSYIRYHER

SEQ ID NO: 459127 - protein, 9 aa, Homo Sapiens
GVPGSVGGL

SEQ ID NO: 459128 - protein, 9 aa, Homo Sapiens
GVRSWLTIY

SEQ ID NO: 459129 - protein, 9 aa, Homo Sapiens
KRNKEHEGK

SEQ ID NO: 459130 - protein, 9 aa, Homo Sapiens
AIDLAQVLD

SEQ ID NO: 459131 - protein, 9 aa, Homo Sapiens
ISSYIRYHE

SEQ ID NO: 459132 - protein, 9 aa, Homo Sapiens
QVLDLGPIT

SEQ ID NO: 459133 - protein, 9 aa, Homo Sapiens
CGQPTPCSI

SEQ ID NO: 459134 - protein, 9 aa, Homo Sapiens
YASQNKEFV

SEQ ID NO: 459135 - protein, 9 aa, Homo Sapiens
PPPAMVNGR

SEQ ID NO: 459136 - protein, 9 aa, Homo Sapiens
VGVLYKVEV

SEQ ID NO: 459137 - protein, 9 aa, Homo Sapiens
AQPVNPQLS

SEQ ID NO: 459138 - protein, 9 aa, Homo Sapiens
TGKERLKDG

SEQ ID NO: 459139 - protein, 9 aa, Homo Sapiens
LCLPDSRDS

SEQ ID NO: 459140 - protein, 9 aa, Homo Sapiens
FDKVIEKRC

SEQ ID NO: 459141 - protein, 9 aa, Homo Sapiens
RPPPAMVNG

SEQ ID NO: 459142 - protein, 9 aa, Homo Sapiens
NFGNRPMTP

SEQ ID NO: 459143 - protein, 9 aa, Homo Sapiens
AQTYTAHTS

SEQ ID NO: 459144 - protein, 9 aa, Homo Sapiens
PPEMPPCHR

SEQ ID NO: 459145 - protein, 9 aa, Homo Sapiens
KVIEKRCFL

SEQ ID NO: 459146 - protein, 9 aa, Homo Sapiens
DYGDCEYMV

SEQ ID NO: 459147 - protein, 9 aa, Homo Sapiens
QRQQKLFSL

SEQ ID NO: 459148 - protein, 9 aa, Homo Sapiens
DVQLVPYII

SEQ ID NO: 459149 - protein, 9 aa, Homo Sapiens
PRHGALIPV

SEQ ID NO: 459150 - protein, 9 aa, Homo Sapiens
RRKFAAVSS

SEQ ID NO: 459151 - protein, 9 aa, Homo Sapiens
HTWVAVVND

SEQ ID NO: 459152 - protein, 9 aa, Homo Sapiens
GAGCGRMMR

SEQ ID NO: 459153 - protein, 9 aa, Homo Sapiens
MRTAWALRP

SEQ ID NO: 459154 - protein, 9 aa, Homo Sapiens
EGRLIATTF

SEQ ID NO: 459155 - protein, 9 aa, Homo Sapiens
VWLNVSQDD

SEQ ID NO: 459156 - protein, 9 aa, Homo Sapiens
DHLLMADPT

SEQ ID NO: 459157 - protein, 9 aa, Homo Sapiens
PPAMVNGRH

SEQ ID NO: 459158 - protein, 9 aa, Homo Sapiens
REMRAGGCC

SEQ ID NO: 459159 - protein, 9 aa, Homo Sapiens
IPHPDELTK

SEQ ID NO: 459160 - protein, 9 aa, Homo Sapiens
NQTSPQSTM

SEQ ID NO: 459161 - protein, 9 aa, Homo Sapiens
EMRAGGCCH

SEQ ID NO: 459162 - protein, 9 aa, Homo Sapiens
GALIPVEGY

SEQ ID NO: 459163 - protein, 9 aa, Homo Sapiens
MPKVELKGP

SEQ ID NO: 459164 - protein, 9 aa, Homo Sapiens
WERETAAVS

SEQ ID NO: 459165 - protein, 9 aa, Homo Sapiens
RERGGGAPP

SEQ ID NO: 459166 - protein, 9 aa, Homo Sapiens
RPMTPMREH

SEQ ID NO: 459167 - protein, 9 aa, Homo Sapiens
HLLMADPTD

SEQ ID NO: 459168 - protein, 9 aa, Homo Sapiens
AVSPVQRRQ

SEQ ID NO: 459169 - protein, 9 aa, Homo Sapiens
AAFKVHYSS

SEQ ID NO: 459170 - protein, 9 aa, Homo Sapiens
CHRGVNNIS

SEQ ID NO: 459171 - protein, 9 aa, Homo Sapiens
IIHDKKDQQ

SEQ ID NO: 459172 - protein, 9 aa, Homo Sapiens
RRKSTEFYS

SEQ ID NO: 459173 - protein, 9 aa, Homo Sapiens
SRRYHAKRR

SEQ ID NO: 459174 - protein, 9 aa, Homo Sapiens
RFRAVRTLR

SEQ ID NO: 459175 - protein, 9 aa, Homo Sapiens
QVDVQLVPY

SEQ ID NO: 459176 - protein, 9 aa, Homo Sapiens
SLPWKDGRS

SEQ ID NO: 459177 - protein, 9 aa, Homo Sapiens
CYHYAEDKF

SEQ ID NO: 459178 - protein, 9 aa, Homo Sapiens
PEMPPCHRG

SEQ ID NO: 459179 - protein, 9 aa, Homo Sapiens
ENPPGCYHY

SEQ ID NO: 459180 - protein, 9 aa, Homo Sapiens
VPGSVGGLP

SEQ ID NO: 459181 - protein, 9 aa, Homo Sapiens
WALRPVPST

SEQ ID NO: 459182 - protein, 9 aa, Homo Sapiens
PSTTSAAGT

SEQ ID NO: 459183 - protein, 9 aa, Homo Sapiens
QILVVNGPE

SEQ ID NO: 459184 - protein, 9 aa, Homo Sapiens
RRRQRQEEK

SEQ ID NO: 459185 - protein, 9 aa, Homo Sapiens
DLAQVLDLG

SEQ ID NO: 459186 - protein, 9 aa, Homo Sapiens
NPGDHLLMA

SEQ ID NO: 459187 - protein, 9 aa, Homo Sapiens
EEELAKAVA

SEQ ID NO: 459188 - protein, 9 aa, Homo Sapiens
QTSPQSTMR

SEQ ID NO: 459189 - protein, 9 aa, Homo Sapiens
QPKIVKGDR

SEQ ID NO: 459190 - protein, 9 aa, Homo Sapiens
LLRVWLNVS

SEQ ID NO: 459191 - protein, 9 aa, Homo Sapiens
KVELKGPQV

SEQ ID NO: 459192 - protein, 9 aa, Homo Sapiens
LYDRQGQLV

SEQ ID NO: 459193 - protein, 9 aa, Homo Sapiens
LMADPTDAH

SEQ ID NO: 459194 - protein, 9 aa, Homo Sapiens
ALYDRQGQL

SEQ ID NO: 459195 - protein, 9 aa, Homo Sapiens
QQKLFSLQL

SEQ ID NO: 459196 - protein, 9 aa, Homo Sapiens
QLHTWVAVV

SEQ ID NO: 459197 - protein, 9 aa, Homo Sapiens
RLKYIIHDK

SEQ ID NO: 459198 - protein, 9 aa, Homo Sapiens
CSITCRTSS

SEQ ID NO: 459199 - protein, 9 aa, Homo Sapiens
LLMADPTDA

SEQ ID NO: 459200 - protein, 9 aa, Homo Sapiens
RISCRTSGY

SEQ ID NO: 459201 - protein, 9 aa, Homo Sapiens
PCHRGVNNI

SEQ ID NO: 459202 - protein, 9 aa, Homo Sapiens
VQKEGVRSW

SEQ ID NO: 459203 - protein, 9 aa, Homo Sapiens
PAMVNGRHN

SEQ ID NO: 459204 - protein, 9 aa, Homo Sapiens
GVTCPEPDK

SEQ ID NO: 459205 - protein, 9 aa, Homo Sapiens
SVSDVGSHL

SEQ ID NO: 459206 - protein, 9 aa, Homo Sapiens
GPAGPTGIM

SEQ ID NO: 459207 - protein, 9 aa, Homo Sapiens
ERETAAVSP

SEQ ID NO: 459208 - protein, 9 aa, Homo Sapiens
ASPSYEETV

SEQ ID NO: 459209 - protein, 9 aa, Homo Sapiens
PKVELKGPQ

SEQ ID NO: 459210 - protein, 9 aa, Homo Sapiens
LGQVDVQLV

SEQ ID NO: 459211 - protein, 9 aa, Homo Sapiens
GCGRMMRTA

SEQ ID NO: 459212 - protein, 9 aa, Homo Sapiens
LKEAIKGKE

SEQ ID NO: 459213 - protein, 9 aa, Homo Sapiens
ERPPPAMVN

SEQ ID NO: 459214 - protein, 9 aa, Homo Sapiens
PLNPQQAQA

SEQ ID NO: 459215 - protein, 9 aa, Homo Sapiens
QKLFSLQLE

SEQ ID NO: 459216 - protein, 9 aa, Homo Sapiens
QTGAQKQGA

SEQ ID NO: 459217 - protein, 9 aa, Homo Sapiens
EQIVSFYRL

SEQ ID NO: 459218 - protein, 9 aa, Homo Sapiens
GDCEYMVNN

SEQ ID NO: 459219 - protein, 9 aa, Homo Sapiens
TWVAVVNDV

SEQ ID NO: 459220 - protein, 9 aa, Homo Sapiens
VPAIDLAQV

SEQ ID NO: 459221 - protein, 9 aa, Homo Sapiens
SWTCSGTCV

SEQ ID NO: 459222 - protein, 9 aa, Homo Sapiens
KDGASPRSV

SEQ ID NO: 459223 - protein, 9 aa, Homo Sapiens
FMETKRNKE

SEQ ID NO: 459224 - protein, 9 aa, Homo Sapiens
VLASGAGFS

SEQ ID NO: 459225 - protein, 9 aa, Homo Sapiens
EPRHGALIP

SEQ ID NO: 459226 - protein, 9 aa, Homo Sapiens
YVAAAFKVH

SEQ ID NO: 459227 - protein, 9 aa, Homo Sapiens
TKCEGNEVE

SEQ ID NO: 459228 - protein, 9 aa, Homo Sapiens
IEKRCFLRE

SEQ ID NO: 459229 - protein, 9 aa, Homo Sapiens
EEPVHEEPV

SEQ ID NO: 459230 - protein, 9 aa, Homo Sapiens
CQDYGDCEY

SEQ ID NO: 459231 - protein, 9 aa, Homo Sapiens
VQLRAALYG

SEQ ID NO: 459232 - protein, 9 aa, Homo Sapiens
EKLQPSYET

SEQ ID NO: 459233 - protein, 9 aa, Homo Sapiens
MAKVHPDPG

SEQ ID NO: 459234 - protein, 9 aa, Homo Sapiens
TTFSLIGVS

SEQ ID NO: 459235 - protein, 9 aa, Homo Sapiens
SAAGTRTSS

SEQ ID NO: 459236 - protein, 9 aa, Homo Sapiens
YRLNEVQRF

SEQ ID NO: 459237 - protein, 9 aa, Homo Sapiens
AREWERIHA

SEQ ID NO: 459238 - protein, 9 aa, Homo Sapiens
ILVVNGPEL

SEQ ID NO: 459239 - protein, 9 aa, Homo Sapiens
YQGLHFSGV

SEQ ID NO: 459240 - protein, 9 aa, Homo Sapiens
CPEPDKYRT

SEQ ID NO: 459241 - protein, 9 aa, Homo Sapiens
EPDKYRTIT

SEQ ID NO: 459242 - protein, 9 aa, Homo Sapiens
LPWKDGRSR

SEQ ID NO: 459243 - protein, 9 aa, Homo Sapiens
TKRNKEHEG

SEQ ID NO: 459244 - protein, 9 aa, Homo Sapiens
LVSPISESM

SEQ ID NO: 459245 - protein, 9 aa, Homo Sapiens
RSVLHPSQF

SEQ ID NO: 459246 - protein, 9 aa, Homo Sapiens
PVPSTTSAA

SEQ ID NO: 459247 - protein, 9 aa, Homo Sapiens
DFTRKTWER

SEQ ID NO: 459248 - protein, 9 aa, Homo Sapiens
TLQWATVAT

SEQ ID NO: 459249 - protein, 9 aa, Homo Sapiens
RNKEHEGKV

SEQ ID NO: 459250 - protein, 9 aa, Homo Sapiens
KGKEEPLHI

SEQ ID NO: 459251 - protein, 9 aa, Homo Sapiens
EPPRRQQIT

SEQ ID NO: 459252 - protein, 9 aa, Homo Sapiens
RTKGRLLAL

SEQ ID NO: 459253 - protein, 9 aa, Homo Sapiens
MTLQWATVA

SEQ ID NO: 459254 - protein, 9 aa, Homo Sapiens
EVPAIDLAQ

SEQ ID NO: 459255 - protein, 9 aa, Homo Sapiens
ITPTKKGRE

SEQ ID NO: 459256 - protein, 9 aa, Homo Sapiens
GGAPPPLST

SEQ ID NO: 459257 - protein, 9 aa, Homo Sapiens
PRRQQITHS

SEQ ID NO: 459258 - protein, 9 aa, Homo Sapiens
LSQPKIVKG

SEQ ID NO: 459259 - protein, 9 aa, Homo Sapiens
DVGVTCPEP

SEQ ID NO: 459260 - protein, 9 aa, Homo Sapiens
DMEKLQPSY

SEQ ID NO: 459261 - protein, 9 aa, Homo Sapiens
ILLLAMFIS

SEQ ID NO: 459262 - protein, 9 aa, Homo Sapiens
SQNKEFVKE

SEQ ID NO: 459263 - protein, 9 aa, Homo Sapiens
EPSETRVSH

SEQ ID NO: 459264 - protein, 9 aa, Homo Sapiens
DKVIEKRCF

SEQ ID NO: 459265 - protein, 9 aa, Homo Sapiens
FAAVSSGRP

SEQ ID NO: 459266 - protein, 9 aa, Homo Sapiens
WATVATFLY

SEQ ID NO: 459267 - protein, 9 aa, Homo Sapiens
LSGCRLLFL

SEQ ID NO: 459268 - protein, 9 aa, Homo Sapiens
VKEKEKLEM

SEQ ID NO: 459269 - protein, 9 aa, Homo Sapiens
MDGGSPVPA

SEQ ID NO: 459270 - protein, 9 aa, Homo Sapiens
FGNRPMTPM

SEQ ID NO: 459271 - protein, 9 aa, Homo Sapiens
LQERVLVQL

SEQ ID NO: 459272 - protein, 9 aa, Homo Sapiens
MEKLQPSYE

SEQ ID NO: 459273 - protein, 9 aa, Homo Sapiens
SVLHPSQFG

SEQ ID NO: 459274 - protein, 9 aa, Homo Sapiens
LASGAGFSV

SEQ ID NO: 459275 - protein, 9 aa, Homo Sapiens
HRRIEKKVS

SEQ ID NO: 459276 - protein, 9 aa, Homo Sapiens
PDPGTWDSF

SEQ ID NO: 459277 - protein, 9 aa, Homo Sapiens
SMETDGIIP

SEQ ID NO: 459278 - protein, 9 aa, Homo Sapiens
HSRSPRTSI

SEQ ID NO: 459279 - protein, 9 aa, Homo Sapiens
VFRNGDPKM

SEQ ID NO: 459280 - protein, 9 aa, Homo Sapiens
IEKKVSDKR

SEQ ID NO: 459281 - protein, 9 aa, Homo Sapiens
ALHRTKGRL

SEQ ID NO: 459282 - protein, 9 aa, Homo Sapiens
LLWASPPGH

SEQ ID NO: 459283 - protein, 9 aa, Homo Sapiens
LIATTFSLI

SEQ ID NO: 459284 - protein, 9 aa, Homo Sapiens
QPTPCSITC

SEQ ID NO: 459285 - protein, 9 aa, Homo Sapiens
KGRLLALVE

SEQ ID NO: 459286 - protein, 9 aa, Homo Sapiens
SSLPWKDGR

SEQ ID NO: 459287 - protein, 9 aa, Homo Sapiens
GHWLQARAE

SEQ ID NO: 459288 - protein, 9 aa, Homo Sapiens
GTRTSSLPW

SEQ ID NO: 459289 - protein, 9 aa, Homo Sapiens
SITCRTSSC

SEQ ID NO: 459290 - protein, 9 aa, Homo Sapiens
VSPISESML

SEQ ID NO: 459291 - protein, 9 aa, Homo Sapiens
SWLTIYNAN

SEQ ID NO: 459292 - protein, 9 aa, Homo Sapiens
RHGALIPVE

SEQ ID NO: 459293 - protein, 9 aa, Homo Sapiens
HTSQPTNYT

SEQ ID NO: 459294 - protein, 9 aa, Homo Sapiens
LNQTSPQST

SEQ ID NO: 459295 - protein, 9 aa, Homo Sapiens
RCFLREGNQ

SEQ ID NO: 459296 - protein, 9 aa, Homo Sapiens
LQGFERRFR

SEQ ID NO: 459297 - protein, 9 aa, Homo Sapiens
IKGKEEPLH

SEQ ID NO: 459298 - protein, 9 aa, Homo Sapiens
LHRTKGRLL

SEQ ID NO: 459299 - protein, 9 aa, Homo Sapiens
TCVLGLHSL

SEQ ID NO: 459300 - protein, 9 aa, Homo Sapiens
PSVGTSAHT

SEQ ID NO: 459301 - protein, 9 aa, Homo Sapiens
GSVGGLPGG

SEQ ID NO: 459302 - protein, 9 aa, Homo Sapiens
VELKGPQVE

SEQ ID NO: 459303 - protein, 9 aa, Homo Sapiens
NDLLLRVWL

SEQ ID NO: 459304 - protein, 9 aa, Homo Sapiens
AQVLDLGPI

SEQ ID NO: 459305 - protein, 9 aa, Homo Sapiens
MVWGLDLDD

SEQ ID NO: 459306 - protein, 9 aa, Homo Sapiens
PEPDKYRTI

SEQ ID NO: 459307 - protein, 9 aa, Homo Sapiens
LRPVPSTTS

SEQ ID NO: 459308 - protein, 9 aa, Homo Sapiens
LDFTRKTWE

SEQ ID NO: 459309 - protein, 9 aa, Homo Sapiens
QQITHSGHF

SEQ ID NO: 459310 - protein, 9 aa, Homo Sapiens
TAHTSQPTN

SEQ ID NO: 459311 - protein, 9 aa, Homo Sapiens
NLCLPDSRD

SEQ ID NO: 459312 - protein, 9 aa, Homo Sapiens
AAVSPVQRR

SEQ ID NO: 459313 - protein, 9 aa, Homo Sapiens
LLLRVWLNV

SEQ ID NO: 459314 - protein, 9 aa, Homo Sapiens
PMTPMREHI

SEQ ID NO: 459315 - protein, 9 aa, Homo Sapiens
GTGKERLKD

SEQ ID NO: 459316 - protein, 9 aa, Homo Sapiens
LNEVQRFEY

SEQ ID NO: 459317 - protein, 9 aa, Homo Sapiens
WERIHAKGS

SEQ ID NO: 459318 - protein, 9 aa, Homo Sapiens
VGTSAHTVS

SEQ ID NO: 459319 - protein, 9 aa, Homo Sapiens
ASPPGHWLQ

SEQ ID NO: 459320 - protein, 9 aa, Homo Sapiens
TYTAHTSQP

SEQ ID NO: 459321 - protein, 9 aa, Homo Sapiens
CRLLFLFLS

SEQ ID NO: 459322 - protein, 9 aa, Homo Sapiens
LLLWLLFYA

SEQ ID NO: 459323 - protein, 9 aa, Homo Sapiens
EMENEHHNL

SEQ ID NO: 459324 - protein, 9 aa, Homo Sapiens
CGKSFNRLS

SEQ ID NO: 459325 - protein, 9 aa, Homo Sapiens
PINYQGLHF

SEQ ID NO: 459326 - protein, 9 aa, Homo Sapiens
ECGKSFNRL

SEQ ID NO: 459327 - protein, 9 aa, Homo Sapiens
KKKGSRRKS

SEQ ID NO: 459328 - protein, 9 aa, Homo Sapiens
KMRRAVLLS

SEQ ID NO: 459329 - protein, 9 aa, Homo Sapiens
QQQQQQQGE

SEQ ID NO: 459330 - protein, 9 aa, Homo Sapiens
QKQGAGCGR

SEQ ID NO: 459331 - protein, 9 aa, Homo Sapiens
AALVSPISE

SEQ ID NO: 459332 - protein, 9 aa, Homo Sapiens
VSDKRTTVT

SEQ ID NO: 459333 - protein, 9 aa, Homo Sapiens
SGHPEPRHG

SEQ ID NO: 459334 - protein, 9 aa, Homo Sapiens
GRMMRTAWA

SEQ ID NO: 459335 - protein, 9 aa, Homo Sapiens
PCSITCRTS

SEQ ID NO: 459336 - protein, 9 aa, Homo Sapiens
LEEPVHEEP

SEQ ID NO: 459337 - protein, 9 aa, Homo Sapiens
SSAPSASPS

SEQ ID NO: 459338 - protein, 9 aa, Homo Sapiens
LVQLRAALY

SEQ ID NO: 459339 - protein, 9 aa, Homo Sapiens
TSSLPWKDG

SEQ ID NO: 459340 - protein, 9 aa, Homo Sapiens
DGYWKFQPG

SEQ ID NO: 459341 - protein, 9 aa, Homo Sapiens
KCEGNEVED

SEQ ID NO: 459342 - protein, 9 aa, Homo Sapiens
SAPSASPSY

SEQ ID NO: 459343 - protein, 9 aa, Homo Sapiens
DPKMRRAVL

SEQ ID NO: 459344 - protein, 9 aa, Homo Sapiens
AFKVHYSSN

SEQ ID NO: 459345 - protein, 9 aa, Homo Sapiens
AVVNDVNPC

SEQ ID NO: 459346 - protein, 9 aa, Homo Sapiens
GLHFSGVND

SEQ ID NO: 459347 - protein, 9 aa, Homo Sapiens
PGPAGPTGI

SEQ ID NO: 459348 - protein, 9 aa, Homo Sapiens
LKYIIHDKK

SEQ ID NO: 459349 - protein, 9 aa, Homo Sapiens
SVVLGQVDV

SEQ ID NO: 459350 - protein, 9 aa, Homo Sapiens
GKERLKDGA

SEQ ID NO: 459351 - protein, 9 aa, Homo Sapiens
KVHPDPGTW

SEQ ID NO: 459352 - protein, 9 aa, Homo Sapiens
VYYCLRRRQ

SEQ ID NO: 459353 - protein, 9 aa, Homo Sapiens
GQPTPCSIT

SEQ ID NO: 459354 - protein, 9 aa, Homo Sapiens
VDMEKLQPS

SEQ ID NO: 459355 - protein, 9 aa, Homo Sapiens
GKKKGSRRK

SEQ ID NO: 459356 - protein, 9 aa, Homo Sapiens
YTKCEGNEV

SEQ ID NO: 459357 - protein, 9 aa, Homo Sapiens
LCPEPSETR

SEQ ID NO: 459358 - protein, 9 aa, Homo Sapiens
PQSTMRQRS

SEQ ID NO: 459359 - protein, 9 aa, Homo Sapiens
YQGKDGYWK

SEQ ID NO: 459360 - protein, 9 aa, Homo Sapiens
KVRSVLHPS

SEQ ID NO: 459361 - protein, 9 aa, Homo Sapiens
LAQVLDLGP

SEQ ID NO: 459362 - protein, 9 aa, Homo Sapiens
VLVQLRAAL

SEQ ID NO: 459363 - protein, 9 aa, Homo Sapiens
AKAVALLSQ

SEQ ID NO: 459364 - protein, 9 aa, Homo Sapiens
QNKEFVKEK

SEQ ID NO: 459365 - protein, 9 aa, Homo Sapiens
EFVDAREWE

SEQ ID NO: 459366 - protein, 9 aa, Homo Sapiens
IEEMENEHH

SEQ ID NO: 459367 - protein, 9 aa, Homo Sapiens
AGFSVSDVG

SEQ ID NO: 459368 - protein, 9 aa, Homo Sapiens
REDVDEAHY

SEQ ID NO: 459369 - protein, 9 aa, Homo Sapiens
INYQGLHFS

SEQ ID NO: 459370 - protein, 9 aa, Homo Sapiens
TSPQSTMRQ

SEQ ID NO: 459371 - protein, 9 aa, Homo Sapiens
HFSGVNDTD

SEQ ID NO: 459372 - protein, 9 aa, Homo Sapiens
DSMETDGII

SEQ ID NO: 459373 - protein, 9 aa, Homo Sapiens
GPSSAPSAS

SEQ ID NO: 459374 - protein, 9 aa, Homo Sapiens
GGAMVWGLD

SEQ ID NO: 459375 - protein, 9 aa, Homo Sapiens
SRESNLDFT

SEQ ID NO: 459376 - protein, 9 aa, Homo Sapiens
CGMREMRAG

SEQ ID NO: 459377 - protein, 9 aa, Homo Sapiens
QERVLVQLR

SEQ ID NO: 459378 - protein, 9 aa, Homo Sapiens
VRSVLHPSQ

SEQ ID NO: 459379 - protein, 9 aa, Homo Sapiens
FERRFRAVR

SEQ ID NO: 459380 - protein, 9 aa, Homo Sapiens
AKRRERRRQ

SEQ ID NO: 459381 - protein, 9 aa, Homo Sapiens
PTPCSITCR

SEQ ID NO: 459382 - protein, 9 aa, Homo Sapiens
WNPAIAVAL

SEQ ID NO: 459383 - protein, 9 aa, Homo Sapiens
CFLREGNQI

SEQ ID NO: 459384 - protein, 9 aa, Homo Sapiens
SMEVLSVMD

SEQ ID NO: 459385 - protein, 9 aa, Homo Sapiens
NEHHNLEAR

SEQ ID NO: 459386 - protein, 9 aa, Homo Sapiens
EPPEMPPCH

SEQ ID NO: 459387 - protein, 9 aa, Homo Sapiens
LVVNGPELE

SEQ ID NO: 459388 - protein, 9 aa, Homo Sapiens
ALKEAIKGK

SEQ ID NO: 459389 - protein, 9 aa, Homo Sapiens
TMELTHPSN

SEQ ID NO: 459390 - protein, 9 aa, Homo Sapiens
SVMDGGSPV

SEQ ID NO: 459391 - protein, 9 aa, Homo Sapiens
PDKYRTITG

SEQ ID NO: 459392 - protein, 9 aa, Homo Sapiens
RQQKLFSLQ

SEQ ID NO: 459393 - protein, 9 aa, Homo Sapiens
RRQTGAQKQ

SEQ ID NO: 459394 - protein, 9 aa, Homo Sapiens
GGSGFGGGF

SEQ ID NO: 459395 - protein, 9 aa, Homo Sapiens
VEVMSRAEF

SEQ ID NO: 459396 - protein, 9 aa, Homo Sapiens
EMEEELAKA

SEQ ID NO: 459397 - protein, 9 aa, Homo Sapiens
HPDELTKLH

SEQ ID NO: 459398 - protein, 9 aa, Homo Sapiens
EGNEVEDLY

SEQ ID NO: 459399 - protein, 9 aa, Homo Sapiens
MEVLSVMDG

SEQ ID NO: 459400 - protein, 9 aa, Homo Sapiens
RESNLDFTR

SEQ ID NO: 459401 - protein, 9 aa, Homo Sapiens
KEAIKGKEE

SEQ ID NO: 459402 - protein, 9 aa, Homo Sapiens
RGGPRSLLA

SEQ ID NO: 459403 - protein, 9 aa, Homo Sapiens
SVGTSAHTV

SEQ ID NO: 459404 - protein, 9 aa, Homo Sapiens
YHAKRRERR

SEQ ID NO: 459405 - protein, 9 aa, Homo Sapiens
RPVPSTTSA

SEQ ID NO: 459406 - protein, 9 aa, Homo Sapiens
MTPMREHIF

SEQ ID NO: 459407 - protein, 9 aa, Homo Sapiens
GCYHYAEDK

SEQ ID NO: 459408 - protein, 9 aa, Homo Sapiens
NLDFTRKTW

SEQ ID NO: 459409 - protein, 9 aa, Homo Sapiens
GAMVWGLDL

SEQ ID NO: 459410 - protein, 9 aa, Homo Sapiens
YLNQTSPQS

SEQ ID NO: 459411 - protein, 9 aa, Homo Sapiens
TWERETAAV

SEQ ID NO: 459412 - protein, 9 aa, Homo Sapiens
EAIKGKEEP

SEQ ID NO: 459413 - protein, 9 aa, Homo Sapiens
WKFQPGKAI

SEQ ID NO: 459414 - protein, 9 aa, Homo Sapiens
ERVLVQLRA

SEQ ID NO: 459415 - protein, 9 aa, Homo Sapiens
EEMENEHHN

SEQ ID NO: 459416 - protein, 9 aa, Homo Sapiens
SPPGHWLQA

SEQ ID NO: 459417 - protein, 9 aa, Homo Sapiens
THSGHFMVS

SEQ ID NO: 459418 - protein, 9 aa, Homo Sapiens
SPSYEETVA

SEQ ID NO: 459419 - protein, 9 aa, Homo Sapiens
RYHAKRRER

SEQ ID NO: 459420 - protein, 9 aa, Homo Sapiens
DRQGQLVEI

SEQ ID NO: 459421 - protein, 9 aa, Homo Sapiens
PPRRQQITH

SEQ ID NO: 459422 - protein, 9 aa, Homo Sapiens
LYKVEVMSR

SEQ ID NO: 459423 - protein, 9 aa, Homo Sapiens
VHEEPVYEE

SEQ ID NO: 459424 - protein, 9 aa, Homo Sapiens
VYTKCEGNE

SEQ ID NO: 459425 - protein, 9 aa, Homo Sapiens
GCRLLFLFL

SEQ ID NO: 459426 - protein, 9 aa, Homo Sapiens
QLVEIERTA

SEQ ID NO: 459427 - protein, 9 aa, Homo Sapiens
RLIATTFSL

SEQ ID NO: 459428 - protein, 9 aa, Homo Sapiens
YTAHTSQPT

SEQ ID NO: 459429 - protein, 9 aa, Homo Sapiens
YHYAEDKFN

SEQ ID NO: 459430 - protein, 9 aa, Homo Sapiens
RETAAVSPV

SEQ ID NO: 459431 - protein, 9 aa, Homo Sapiens
CPEPSETRV

SEQ ID NO: 459432 - protein, 9 aa, Homo Sapiens
GMREMRAGG

SEQ ID NO: 459433 - protein, 9 aa, Homo Sapiens
TVATFLYAE

SEQ ID NO: 459434 - protein, 9 aa, Homo Sapiens
AIKGKEEPL

SEQ ID NO: 459435 - protein, 9 aa, Homo Sapiens
LGRRKFAAV

SEQ ID NO: 459436 - protein, 9 aa, Homo Sapiens
EAPSRHSRS

SEQ ID NO: 459437 - protein, 9 aa, Homo Sapiens
NTDSMETDG

SEQ ID NO: 459438 - protein, 9 aa, Homo Sapiens
PWKDGRSRE

SEQ ID NO: 459439 - protein, 9 aa, Homo Sapiens
LAIPGSVLR

SEQ ID NO: 459440 - protein, 9 aa, Homo Sapiens
CHTAPCPPA

SEQ ID NO: 459441 - protein, 9 aa, Homo Sapiens
PDTRNIASD

SEQ ID NO: 459442 - protein, 9 aa, Homo Sapiens
FYFASREFQ

SEQ ID NO: 459443 - protein, 9 aa, Homo Sapiens
GTTHQCRKV

SEQ ID NO: 459444 - protein, 9 aa, Homo Sapiens
PASHDAAHG

SEQ ID NO: 459445 - protein, 9 aa, Homo Sapiens
VGGLHRVYT

SEQ ID NO: 459446 - protein, 9 aa, Homo Sapiens
LPPASRCVC

SEQ ID NO: 459447 - protein, 9 aa, Homo Sapiens
NFCYRASKF

SEQ ID NO: 459448 - protein, 9 aa, Homo Sapiens
DAVDCQEGE

SEQ ID NO: 459449 - protein, 9 aa, Homo Sapiens
LLKKLHQQF

SEQ ID NO: 459450 - protein, 9 aa, Homo Sapiens
CPHASEQPT

SEQ ID NO: 459451 - protein, 9 aa, Homo Sapiens
QRNSQIYRA

SEQ ID NO: 459452 - protein, 9 aa, Homo Sapiens
LETSICPRT

SEQ ID NO: 459453 - protein, 9 aa, Homo Sapiens
QFASRYVFY

SEQ ID NO: 459454 - protein, 9 aa, Homo Sapiens
PPPKTSASS

SEQ ID NO: 459455 - protein, 9 aa, Homo Sapiens
MEELSFTSA

SEQ ID NO: 459456 - protein, 9 aa, Homo Sapiens
THIQRLSPT

SEQ ID NO: 459457 - protein, 9 aa, Homo Sapiens
KYQRHLHES

SEQ ID NO: 459458 - protein, 9 aa, Homo Sapiens
GPDRHAALS

SEQ ID NO: 459459 - protein, 9 aa, Homo Sapiens
IYVRTHTGE

SEQ ID NO: 459460 - protein, 9 aa, Homo Sapiens
SLFQIYVRT

SEQ ID NO: 459461 - protein, 9 aa, Homo Sapiens
FQFSPSEYF

SEQ ID NO: 459462 - protein, 9 aa, Homo Sapiens
VNDAAIVLG

SEQ ID NO: 459463 - protein, 9 aa, Homo Sapiens
AANPAAAVA

SEQ ID NO: 459464 - protein, 9 aa, Homo Sapiens
SAVPRPASH

SEQ ID NO: 459465 - protein, 9 aa, Homo Sapiens
LEAADLSKE

SEQ ID NO: 459466 - protein, 9 aa, Homo Sapiens
GLRRELDEL

SEQ ID NO: 459467 - protein, 9 aa, Homo Sapiens
ERVYEVVWP

SEQ ID NO: 459468 - protein, 9 aa, Homo Sapiens
HGTTHQCRK

SEQ ID NO: 459469 - protein, 9 aa, Homo Sapiens
LTAFLGYKT

SEQ ID NO: 459470 - protein, 9 aa, Homo Sapiens
VSDIPKGVL

SEQ ID NO: 459471 - protein, 9 aa, Homo Sapiens
PAPSPWGSP

SEQ ID NO: 459472 - protein, 9 aa, Homo Sapiens
SQFASRYVF

SEQ ID NO: 459473 - protein, 9 aa, Homo Sapiens
TSLTWVPTN

SEQ ID NO: 459474 - protein, 9 aa, Homo Sapiens
APPVALGKP

SEQ ID NO: 459475 - protein, 9 aa, Homo Sapiens
EKHSSQSVH

SEQ ID NO: 459476 - protein, 9 aa, Homo Sapiens
LLFQKQCQD

SEQ ID NO: 459477 - protein, 9 aa, Homo Sapiens
LSPSTDFYH

SEQ ID NO: 459478 - protein, 9 aa, Homo Sapiens
RRAVLSLGS

SEQ ID NO: 459479 - protein, 9 aa, Homo Sapiens
DGFQGCGPD

SEQ ID NO: 459480 - protein, 9 aa, Homo Sapiens
FPVSYKCKC

SEQ ID NO: 459481 - protein, 9 aa, Homo Sapiens
AEEYSLRNG

SEQ ID NO: 459482 - protein, 9 aa, Homo Sapiens
YINSLFYSR

SEQ ID NO: 459483 - protein, 9 aa, Homo Sapiens
VFGIWSEGV

SEQ ID NO: 459484 - protein, 9 aa, Homo Sapiens
KDAGTIMGL

SEQ ID NO: 459485 - protein, 9 aa, Homo Sapiens
IDYEAIQDF

SEQ ID NO: 459486 - protein, 9 aa, Homo Sapiens
MDIEGTSDP

SEQ ID NO: 459487 - protein, 9 aa, Homo Sapiens
VATEGLSGP

SEQ ID NO: 459488 - protein, 9 aa, Homo Sapiens
PTPCHTAPC

SEQ ID NO: 459489 - protein, 9 aa, Homo Sapiens
LRTIDYEAI

SEQ ID NO: 459490 - protein, 9 aa, Homo Sapiens
WEKRTVLQG

SEQ ID NO: 459491 - protein, 9 aa, Homo Sapiens
DSALSKPTL

SEQ ID NO: 459492 - protein, 9 aa, Homo Sapiens
AGTKTTSTT

SEQ ID NO: 459493 - protein, 9 aa, Homo Sapiens
PCHTAPCPP

SEQ ID NO: 459494 - protein, 9 aa, Homo Sapiens
LNSTVPTPA

SEQ ID NO: 459495 - protein, 9 aa, Homo Sapiens
PLCHCSPVL

SEQ ID NO: 459496 - protein, 9 aa, Homo Sapiens
HSSQSVHML

SEQ ID NO: 459497 - protein, 9 aa, Homo Sapiens
PISSVDPQF

SEQ ID NO: 459498 - protein, 9 aa, Homo Sapiens
NSQPEKTSQ

SEQ ID NO: 459499 - protein, 9 aa, Homo Sapiens
KHVSGQMMY

SEQ ID NO: 459500 - protein, 9 aa, Homo Sapiens
NLKAMDIEG

SEQ ID NO: 459501 - protein, 9 aa, Homo Sapiens
KSLETSICP

SEQ ID NO: 459502 - protein, 9 aa, Homo Sapiens
PNNSLYIEN

SEQ ID NO: 459503 - protein, 9 aa, Homo Sapiens
IHKTFNIKN

SEQ ID NO: 459504 - protein, 9 aa, Homo Sapiens
WQLDKAELD

SEQ ID NO: 459505 - protein, 9 aa, Homo Sapiens
VDCQEGEEI

SEQ ID NO: 459506 - protein, 9 aa, Homo Sapiens
RHAALSATG

SEQ ID NO: 459507 - protein, 9 aa, Homo Sapiens
QVSVSDIPK

SEQ ID NO: 459508 - protein, 9 aa, Homo Sapiens
TKTTSTTLR

SEQ ID NO: 459509 - protein, 9 aa, Homo Sapiens
TLGQWTATA

SEQ ID NO: 459510 - protein, 9 aa, Homo Sapiens
LLLGGIILS

SEQ ID NO: 459511 - protein, 9 aa, Homo Sapiens
QSVHMLAKT

SEQ ID NO: 459512 - protein, 9 aa, Homo Sapiens
IPALRDFSI

SEQ ID NO: 459513 - protein, 9 aa, Homo Sapiens
LLEVVRQRI

SEQ ID NO: 459514 - protein, 9 aa, Homo Sapiens
HDRKHHPWQ

SEQ ID NO: 459515 - protein, 9 aa, Homo Sapiens
QAVPQLVLF

SEQ ID NO: 459516 - protein, 9 aa, Homo Sapiens
THVIQQRME

SEQ ID NO: 459517 - protein, 9 aa, Homo Sapiens
YQRHLHESC

SEQ ID NO: 459518 - protein, 9 aa, Homo Sapiens
VSESSASSD

SEQ ID NO: 459519 - protein, 9 aa, Homo Sapiens
DSSAIVVKR

SEQ ID NO: 459520 - protein, 9 aa, Homo Sapiens
NGSGMCKAD

SEQ ID NO: 459521 - protein, 9 aa, Homo Sapiens
CCATPAHAL

SEQ ID NO: 459522 - protein, 9 aa, Homo Sapiens
HTVDGHWVV

SEQ ID NO: 459523 - protein, 9 aa, Homo Sapiens
VLSLGSVFS

SEQ ID NO: 459524 - protein, 9 aa, Homo Sapiens
PTHADVGQP

SEQ ID NO: 459525 - protein, 9 aa, Homo Sapiens
TRNIASDDS

SEQ ID NO: 459526 - protein, 9 aa, Homo Sapiens
PSHSSLSVG

SEQ ID NO: 459527 - protein, 9 aa, Homo Sapiens
PTYPETPWY

SEQ ID NO: 459528 - protein, 9 aa, Homo Sapiens
GLHRVYTKL

SEQ ID NO: 459529 - protein, 9 aa, Homo Sapiens
LAPPVALGK

SEQ ID NO: 459530 - protein, 9 aa, Homo Sapiens
EHLLFARRR

SEQ ID NO: 459531 - protein, 9 aa, Homo Sapiens
ACGQEITKQ

SEQ ID NO: 459532 - protein, 9 aa, Homo Sapiens
EPCVTEHRM

SEQ ID NO: 459533 - protein, 9 aa, Homo Sapiens
CMESFLEAV

SEQ ID NO: 459534 - protein, 9 aa, Homo Sapiens
MPLPEAGAL

SEQ ID NO: 459535 - protein, 9 aa, Homo Sapiens
ERFKEYSKT

SEQ ID NO: 459536 - protein, 9 aa, Homo Sapiens
GAGPTLGQW

SEQ ID NO: 459537 - protein, 9 aa, Homo Sapiens
ILYPSVPFC

SEQ ID NO: 459538 - protein, 9 aa, Homo Sapiens
AAEAHTQQL

SEQ ID NO: 459539 - protein, 9 aa, Homo Sapiens
CKADFAGDD

SEQ ID NO: 459540 - protein, 9 aa, Homo Sapiens
LFLAWRLSS

SEQ ID NO: 459541 - protein, 9 aa, Homo Sapiens
NIYFQQATH

SEQ ID NO: 459542 - protein, 9 aa, Homo Sapiens
PKSKSVQSS

SEQ ID NO: 459543 - protein, 9 aa, Homo Sapiens
MEVWGKGTT

SEQ ID NO: 459544 - protein, 9 aa, Homo Sapiens
APEWGACTL

SEQ ID NO: 459545 - protein, 9 aa, Homo Sapiens
TAPCPPAAA

SEQ ID NO: 459546 - protein, 9 aa, Homo Sapiens
GAPEWGACT

SEQ ID NO: 459547 - protein, 9 aa, Homo Sapiens
GVLGLTKRC

SEQ ID NO: 459548 - protein, 9 aa, Homo Sapiens
SVLRPPISV

SEQ ID NO: 459549 - protein, 9 aa, Homo Sapiens
ENSQPEKTS

SEQ ID NO: 459550 - protein, 9 aa, Homo Sapiens
KYWSKTCTQ

SEQ ID NO: 459551 - protein, 9 aa, Homo Sapiens
SDIPKGVLG

SEQ ID NO: 459552 - protein, 9 aa, Homo Sapiens
AARLGYPTL

SEQ ID NO: 459553 - protein, 9 aa, Homo Sapiens
VRWEERVFL

SEQ ID NO: 459554 - protein, 9 aa, Homo Sapiens
IMYDQNHFL

SEQ ID NO: 459555 - protein, 9 aa, Homo Sapiens
LARNTPLHW

SEQ ID NO: 459556 - protein, 9 aa, Homo Sapiens
ATIPSLAAP

SEQ ID NO: 459557 - protein, 9 aa, Homo Sapiens
EITKQMLPI

SEQ ID NO: 459558 - protein, 9 aa, Homo Sapiens
TTSLTWVPT

SEQ ID NO: 459559 - protein, 9 aa, Homo Sapiens
HQPAAGRRG

SEQ ID NO: 459560 - protein, 9 aa, Homo Sapiens
KPDKYQRHL

SEQ ID NO: 459561 - protein, 9 aa, Homo Sapiens
RDGLPLSPS

SEQ ID NO: 459562 - protein, 9 aa, Homo Sapiens
KEEEELNQQ

SEQ ID NO: 459563 - protein, 9 aa, Homo Sapiens
GYKTGMTHI

SEQ ID NO: 459564 - protein, 9 aa, Homo Sapiens
LCCSNFVDF

SEQ ID NO: 459565 - protein, 9 aa, Homo Sapiens
FLGYKTGMT

SEQ ID NO: 459566 - protein, 9 aa, Homo Sapiens
GQRDKCWCV

SEQ ID NO: 459567 - protein, 9 aa, Homo Sapiens
LGLTKRCLR

SEQ ID NO: 459568 - protein, 9 aa, Homo Sapiens
LGGIILSFA

SEQ ID NO: 459569 - protein, 9 aa, Homo Sapiens
MALAKQEIA

SEQ ID NO: 459570 - protein, 9 aa, Homo Sapiens
GLLKYWSKT

SEQ ID NO: 459571 - protein, 9 aa, Homo Sapiens
EEKQQRKKA

SEQ ID NO: 459572 - protein, 9 aa, Homo Sapiens
GSGMCKADF

SEQ ID NO: 459573 - protein, 9 aa, Homo Sapiens
VDGHWVVPV

SEQ ID NO: 459574 - protein, 9 aa, Homo Sapiens
DEMRSEMVR

SEQ ID NO: 459575 - protein, 9 aa, Homo Sapiens
LEASIETGD

SEQ ID NO: 459576 - protein, 9 aa, Homo Sapiens
VITPSRVSE

SEQ ID NO: 459577 - protein, 9 aa, Homo Sapiens
CATPAHALQ

SEQ ID NO: 459578 - protein, 9 aa, Homo Sapiens
IDAIFLTTR

SEQ ID NO: 459579 - protein, 9 aa, Homo Sapiens
NRISSNMLR

SEQ ID NO: 459580 - protein, 9 aa, Homo Sapiens
PLTDQCWLT

SEQ ID NO: 459581 - protein, 9 aa, Homo Sapiens
SLFYSRGPR

SEQ ID NO: 459582 - protein, 9 aa, Homo Sapiens
RNGLGPGLL

SEQ ID NO: 459583 - protein, 9 aa, Homo Sapiens
LMHIEFKKI

SEQ ID NO: 459584 - protein, 9 aa, Homo Sapiens
SPQVKAGPV

SEQ ID NO: 459585 - protein, 9 aa, Homo Sapiens
NELKVVIPV

SEQ ID NO: 459586 - protein, 9 aa, Homo Sapiens
SRPSSHVVN

SEQ ID NO: 459587 - protein, 9 aa, Homo Sapiens
KIDSSAIVV

SEQ ID NO: 459588 - protein, 9 aa, Homo Sapiens
ATEGLSGPP

SEQ ID NO: 459589 - protein, 9 aa, Homo Sapiens
ASHDAAHGP

SEQ ID NO: 459590 - protein, 9 aa, Homo Sapiens
NTPLHLAAR

SEQ ID NO: 459591 - protein, 9 aa, Homo Sapiens
WLWNKLLEA

SEQ ID NO: 459592 - protein, 9 aa, Homo Sapiens
QQMVLRCWS

SEQ ID NO: 459593 - protein, 9 aa, Homo Sapiens
IMVGGPSIS

SEQ ID NO: 459594 - protein, 9 aa, Homo Sapiens
RSGISLAAL

SEQ ID NO: 459595 - protein, 9 aa, Homo Sapiens
MDVMDGFQF

SEQ ID NO: 459596 - protein, 9 aa, Homo Sapiens
PTLGQWTAT

SEQ ID NO: 459597 - protein, 9 aa, Homo Sapiens
RPCLRSLHP

SEQ ID NO: 459598 - protein, 9 aa, Homo Sapiens
FCPVPSEQL

SEQ ID NO: 459599 - protein, 9 aa, Homo Sapiens
LSKPTLSIQ

SEQ ID NO: 459600 - protein, 9 aa, Homo Sapiens
SALSKPTLS

SEQ ID NO: 459601 - protein, 9 aa, Homo Sapiens
FLYIHQLAI

SEQ ID NO: 459602 - protein, 9 aa, Homo Sapiens
RAPWRTPAV

SEQ ID NO: 459603 - protein, 9 aa, Homo Sapiens
ICFYLEAAD

SEQ ID NO: 459604 - protein, 9 aa, Homo Sapiens
LDGQRDKCW

SEQ ID NO: 459605 - protein, 9 aa, Homo Sapiens
PCPPAAAGY

SEQ ID NO: 459606 - protein, 9 aa, Homo Sapiens
LQRFRFTHV

SEQ ID NO: 459607 - protein, 9 aa, Homo Sapiens
LGKPQLDLF

SEQ ID NO: 459608 - protein, 9 aa, Homo Sapiens
IYFQQATHQ

SEQ ID NO: 459609 - protein, 9 aa, Homo Sapiens
IKRDACFIS

SEQ ID NO: 459610 - protein, 9 aa, Homo Sapiens
LHPLQPSAV

SEQ ID NO: 459611 - protein, 9 aa, Homo Sapiens
DKYQRHLHE

SEQ ID NO: 459612 - protein, 9 aa, Homo Sapiens
EWGACTLSF

SEQ ID NO: 459613 - protein, 9 aa, Homo Sapiens
EEISKVEKR

SEQ ID NO: 459614 - protein, 9 aa, Homo Sapiens
MGIEDSELR

SEQ ID NO: 459615 - protein, 9 aa, Homo Sapiens
NCLTKPLPC

SEQ ID NO: 459616 - protein, 9 aa, Homo Sapiens
AKSGSPGEK

SEQ ID NO: 459617 - protein, 9 aa, Homo Sapiens
PNHVSLSSL

SEQ ID NO: 459618 - protein, 9 aa, Homo Sapiens
LPLHRTPPR

SEQ ID NO: 459619 - protein, 9 aa, Homo Sapiens
MVAKVQDLS

SEQ ID NO: 459620 - protein, 9 aa, Homo Sapiens
LYIHQLAIH

SEQ ID NO: 459621 - protein, 9 aa, Homo Sapiens
SLSVGRRHP

SEQ ID NO: 459622 - protein, 9 aa, Homo Sapiens
DCQDFPVSY

SEQ ID NO: 459623 - protein, 9 aa, Homo Sapiens
RIGSLEFLD

SEQ ID NO: 459624 - protein, 9 aa, Homo Sapiens
SEMVRREAC

SEQ ID NO: 459625 - protein, 9 aa, Homo Sapiens
ETMNAEEYS

SEQ ID NO: 459626 - protein, 9 aa, Homo Sapiens
IGSLEFLDE

SEQ ID NO: 459627 - protein, 9 aa, Homo Sapiens
SFEEIKMAM

SEQ ID NO: 459628 - protein, 9 aa, Homo Sapiens
PSPWGSPPA

SEQ ID NO: 459629 - protein, 9 aa, Homo Sapiens
WNEVQIKHE

SEQ ID NO: 459630 - protein, 9 aa, Homo Sapiens
APGDAAAPT

SEQ ID NO: 459631 - protein, 9 aa, Homo Sapiens
LAARLGYPT

SEQ ID NO: 459632 - protein, 9 aa, Homo Sapiens
NLIDLYIYV

SEQ ID NO: 459633 - protein, 9 aa, Homo Sapiens
VQAVPQLVL

SEQ ID NO: 459634 - protein, 9 aa, Homo Sapiens
QVIRMPVSH

SEQ ID NO: 459635 - protein, 9 aa, Homo Sapiens
HALFFLHPL

SEQ ID NO: 459636 - protein, 9 aa, Homo Sapiens
PPLSIQTSS

SEQ ID NO: 459637 - protein, 9 aa, Homo Sapiens
EAERGSLSA

SEQ ID NO: 459638 - protein, 9 aa, Homo Sapiens
DPRFMALAK

SEQ ID NO: 459639 - protein, 9 aa, Homo Sapiens
RVWLRVTTV

SEQ ID NO: 459640 - protein, 9 aa, Homo Sapiens
AWRLSSVLQ

SEQ ID NO: 459641 - protein, 9 aa, Homo Sapiens
PVLPTPCHT

SEQ ID NO: 459642 - protein, 9 aa, Homo Sapiens
WKNCLTKPL

SEQ ID NO: 459643 - protein, 9 aa, Homo Sapiens
IPKGVLGFP

SEQ ID NO: 459644 - protein, 9 aa, Homo Sapiens
RVYTKLKRL

SEQ ID NO: 459645 - protein, 9 aa, Homo Sapiens
AGSCRLELF

SEQ ID NO: 459646 - protein, 9 aa, Homo Sapiens
TVDGHWVVP

SEQ ID NO: 459647 - protein, 9 aa, Homo Sapiens
GYYRLEVNA

SEQ ID NO: 459648 - protein, 9 aa, Homo Sapiens
TAQGYDEVC

SEQ ID NO: 459649 - protein, 9 aa, Homo Sapiens
PFRSACAAS

SEQ ID NO: 459650 - protein, 9 aa, Homo Sapiens
AVPRPASHD

SEQ ID NO: 459651 - protein, 9 aa, Homo Sapiens
VAAVAAAAA

SEQ ID NO: 459652 - protein, 9 aa, Homo Sapiens
CLTKPLPCF

SEQ ID NO: 459653 - protein, 9 aa, Homo Sapiens
HTAQGYDEV

SEQ ID NO: 459654 - protein, 9 aa, Homo Sapiens
QCQDHVETG

SEQ ID NO: 459655 - protein, 9 aa, Homo Sapiens
EGVDGTDIN

SEQ ID NO: 459656 - protein, 9 aa, Homo Sapiens
TLLFQKQCQ

SEQ ID NO: 459657 - protein, 9 aa, Homo Sapiens
LLVQAVPQL

SEQ ID NO: 459658 - protein, 9 aa, Homo Sapiens
HVMLNRISS

SEQ ID NO: 459659 - protein, 9 aa, Homo Sapiens
WGAPPRRGA

SEQ ID NO: 459660 - protein, 9 aa, Homo Sapiens
SVPFCRAAY

SEQ ID NO: 459661 - protein, 9 aa, Homo Sapiens
GQEITKQML

SEQ ID NO: 459662 - protein, 9 aa, Homo Sapiens
ADLLGAGTK

SEQ ID NO: 459663 - protein, 9 aa, Homo Sapiens
PVITPSRVS

SEQ ID NO: 459664 - protein, 9 aa, Homo Sapiens
GQWTATAES

SEQ ID NO: 459665 - protein, 9 aa, Homo Sapiens
SCPASGGAG

SEQ ID NO: 459666 - protein, 9 aa, Homo Sapiens
LLLLVQAVP

SEQ ID NO: 459667 - protein, 9 aa, Homo Sapiens
AAVAAVAAA

SEQ ID NO: 459668 - protein, 9 aa, Homo Sapiens
GLTKRCLRS

SEQ ID NO: 459669 - protein, 9 aa, Homo Sapiens
PLPKEAPAS

SEQ ID NO: 459670 - protein, 9 aa, Homo Sapiens
QRIHTGKRP

SEQ ID NO: 459671 - protein, 9 aa, Homo Sapiens
QVKAGPVKF

SEQ ID NO: 459672 - protein, 9 aa, Homo Sapiens
QQLVEKSVE

SEQ ID NO: 459673 - protein, 9 aa, Homo Sapiens
SRVSESSAS

SEQ ID NO: 459674 - protein, 9 aa, Homo Sapiens
GYFTAIYAD

SEQ ID NO: 459675 - protein, 9 aa, Homo Sapiens
RCVNDAAIV

SEQ ID NO: 459676 - protein, 9 aa, Homo Sapiens
LVEAAEAHT

SEQ ID NO: 459677 - protein, 9 aa, Homo Sapiens
RSAPTDPQG

SEQ ID NO: 459678 - protein, 9 aa, Homo Sapiens
PHTPAASDY

SEQ ID NO: 459679 - protein, 9 aa, Homo Sapiens
HPWQLDKAE

SEQ ID NO: 459680 - protein, 9 aa, Homo Sapiens
KQISWYKPW

SEQ ID NO: 459681 - protein, 9 aa, Homo Sapiens
SEQLPPASR

SEQ ID NO: 459682 - protein, 9 aa, Homo Sapiens
LAWRLSSVL

SEQ ID NO: 459683 - protein, 9 aa, Homo Sapiens
SPAPSPWGS

SEQ ID NO: 459684 - protein, 9 aa, Homo Sapiens
AKDQEPCVT

SEQ ID NO: 459685 - protein, 9 aa, Homo Sapiens
RTTSLTWVP

SEQ ID NO: 459686 - protein, 9 aa, Homo Sapiens
LWLCCATPA

SEQ ID NO: 459687 - protein, 9 aa, Homo Sapiens
FAAVDGQEK

SEQ ID NO: 459688 - protein, 9 aa, Homo Sapiens
AVDCQEGEE

SEQ ID NO: 459689 - protein, 9 aa, Homo Sapiens
SSHVVNGED

SEQ ID NO: 459690 - protein, 9 aa, Homo Sapiens
PLPEAGALA

SEQ ID NO: 459691 - protein, 9 aa, Homo Sapiens
PLHWLWAAS

SEQ ID NO: 459692 - protein, 9 aa, Homo Sapiens
WVPTNSPRP

SEQ ID NO: 459693 - protein, 9 aa, Homo Sapiens
PWRTPAVPR

SEQ ID NO: 459694 - protein, 9 aa, Homo Sapiens
FCSNFCYRA

SEQ ID NO: 459695 - protein, 9 aa, Homo Sapiens
FINRQFRNC

SEQ ID NO: 459696 - protein, 9 aa, Homo Sapiens
CSNFCYRAS

SEQ ID NO: 459697 - protein, 9 aa, Homo Sapiens
DAATIPSLA

SEQ ID NO: 459698 - protein, 9 aa, Homo Sapiens
GAPSVATEG

SEQ ID NO: 459699 - protein, 9 aa, Homo Sapiens
SGISLAALK

SEQ ID NO: 459700 - protein, 9 aa, Homo Sapiens
FDGVLGLTK

SEQ ID NO: 459701 - protein, 9 aa, Homo Sapiens
TVSATPPLS

SEQ ID NO: 459702 - protein, 9 aa, Homo Sapiens
SVATEGLSG

SEQ ID NO: 459703 - protein, 9 aa, Homo Sapiens
QHAEVYYKP

SEQ ID NO: 459704 - protein, 9 aa, Homo Sapiens
GPSISPALP

SEQ ID NO: 459705 - protein, 9 aa, Homo Sapiens
DKGSLSSGT

SEQ ID NO: 459706 - protein, 9 aa, Homo Sapiens
SVDAQEEIS

SEQ ID NO: 459707 - protein, 9 aa, Homo Sapiens
GSVLRPPIS

SEQ ID NO: 459708 - protein, 9 aa, Homo Sapiens
CRYGPLCPS

SEQ ID NO: 459709 - protein, 9 aa, Homo Sapiens
PCVTEHRMG

SEQ ID NO: 459710 - protein, 9 aa, Homo Sapiens
AEAHTQQLG

SEQ ID NO: 459711 - protein, 9 aa, Homo Sapiens
LEYVYINSL

SEQ ID NO: 459712 - protein, 9 aa, Homo Sapiens
PSGAVELLC

SEQ ID NO: 459713 - protein, 9 aa, Homo Sapiens
KRPYECNYC

SEQ ID NO: 459714 - protein, 9 aa, Homo Sapiens
IDSSAIVVK

SEQ ID NO: 459715 - protein, 9 aa, Homo Sapiens
PGIMVGGPS

SEQ ID NO: 459716 - protein, 9 aa, Homo Sapiens
TPSRVSESS

SEQ ID NO: 459717 - protein, 9 aa, Homo Sapiens
FLAWRLSSV

SEQ ID NO: 459718 - protein, 9 aa, Homo Sapiens
MKCTARVWL

SEQ ID NO: 459719 - protein, 9 aa, Homo Sapiens
YWKPAAVPA

SEQ ID NO: 459720 - protein, 9 aa, Homo Sapiens
CKIDSSAIV

SEQ ID NO: 459721 - protein, 9 aa, Homo Sapiens
TPNNSLYIE

SEQ ID NO: 459722 - protein, 9 aa, Homo Sapiens
HLLFARRRN

SEQ ID NO: 459723 - protein, 9 aa, Homo Sapiens
GIILSFAKF

SEQ ID NO: 459724 - protein, 9 aa, Homo Sapiens
AGPTLGQWT

SEQ ID NO: 459725 - protein, 9 aa, Homo Sapiens
KERSGISLA

SEQ ID NO: 459726 - protein, 9 aa, Homo Sapiens
YDEVCRVTE

SEQ ID NO: 459727 - protein, 9 aa, Homo Sapiens
ENLIDLYIY

SEQ ID NO: 459728 - protein, 9 aa, Homo Sapiens
LPMAESTRN

SEQ ID NO: 459729 - protein, 9 aa, Homo Sapiens
ITPLTDQCW

SEQ ID NO: 459730 - protein, 9 aa, Homo Sapiens
GERVYEVVW

SEQ ID NO: 459731 - protein, 9 aa, Homo Sapiens
LTKPLPCFL

SEQ ID NO: 459732 - protein, 9 aa, Homo Sapiens
ALSATGTFC

SEQ ID NO: 459733 - protein, 9 aa, Homo Sapiens
VIPVCRPAA

SEQ ID NO: 459734 - protein, 9 aa, Homo Sapiens
VCPHASEQP

SEQ ID NO: 459735 - protein, 9 aa, Homo Sapiens
AAGRRGCWP

SEQ ID NO: 459736 - protein, 9 aa, Homo Sapiens
RVYEVVWPL

SEQ ID NO: 459737 - protein, 9 aa, Homo Sapiens
CTSRNDCTI

SEQ ID NO: 459738 - protein, 9 aa, Homo Sapiens
ILTRCVNDA

SEQ ID NO: 459739 - protein, 9 aa, Homo Sapiens
NHSSPAPSP

SEQ ID NO: 459740 - protein, 9 aa, Homo Sapiens
LFQKQCQDH

SEQ ID NO: 459741 - protein, 9 aa, Homo Sapiens
ISGGLAGDL

SEQ ID NO: 459742 - protein, 9 aa, Homo Sapiens
MMPLPEAGA

SEQ ID NO: 459743 - protein, 9 aa, Homo Sapiens
FISLMNTLM

SEQ ID NO: 459744 - protein, 9 aa, Homo Sapiens
VDRLWNEVQ

SEQ ID NO: 459745 - protein, 9 aa, Homo Sapiens
GRSSSSSGS

SEQ ID NO: 459746 - protein, 9 aa, Homo Sapiens
PVPSEQLPP

SEQ ID NO: 459747 - protein, 9 aa, Homo Sapiens
YSLRNGGEE

SEQ ID NO: 459748 - protein, 9 aa, Homo Sapiens
QKAIRDRNE

SEQ ID NO: 459749 - protein, 9 aa, Homo Sapiens
HADVGQPSP

SEQ ID NO: 459750 - protein, 9 aa, Homo Sapiens
PSLNSTVPT

SEQ ID NO: 459751 - protein, 9 aa, Homo Sapiens
WHEGSFARQ

SEQ ID NO: 459752 - protein, 9 aa, Homo Sapiens
CLRSLHPCS

SEQ ID NO: 459753 - protein, 9 aa, Homo Sapiens
SATGTFCPV

SEQ ID NO: 459754 - protein, 9 aa, Homo Sapiens
KGSLSSGTQ

SEQ ID NO: 459755 - protein, 9 aa, Homo Sapiens
IKRPNNPPG

SEQ ID NO: 459756 - protein, 9 aa, Homo Sapiens
GTFCPVPSE

SEQ ID NO: 459757 - protein, 9 aa, Homo Sapiens
AALSATGTF

SEQ ID NO: 459758 - protein, 9 aa, Homo Sapiens
TLPLHRTPP

SEQ ID NO: 459759 - protein, 9 aa, Homo Sapiens
LCPHTPAAS

SEQ ID NO: 459760 - protein, 9 aa, Homo Sapiens
GFQFSPSEY

SEQ ID NO: 459761 - protein, 9 aa, Homo Sapiens
PMAESTRNG

SEQ ID NO: 459762 - protein, 9 aa, Homo Sapiens
AAHGPLPLT

SEQ ID NO: 459763 - protein, 9 aa, Homo Sapiens
KQKYLCTSR

SEQ ID NO: 459764 - protein, 9 aa, Homo Sapiens
KSVELLALQ

SEQ ID NO: 459765 - protein, 9 aa, Homo Sapiens
NNSLYIENN

SEQ ID NO: 459766 - protein, 9 aa, Homo Sapiens
TPCHTAPCP

SEQ ID NO: 459767 - protein, 9 aa, Homo Sapiens
NLNQLIAID

SEQ ID NO: 459768 - protein, 9 aa, Homo Sapiens
PLPLTAGVC

SEQ ID NO: 459769 - protein, 9 aa, Homo Sapiens
DAGTIMGLN

SEQ ID NO: 459770 - protein, 9 aa, Homo Sapiens
QNTLNIYFQ

SEQ ID NO: 459771 - protein, 9 aa, Homo Sapiens
VSKMVAKVQ

SEQ ID NO: 459772 - protein, 9 aa, Homo Sapiens
AHTQQLGQL

SEQ ID NO: 459773 - protein, 9 aa, Homo Sapiens
YRASKFFEA

SEQ ID NO: 459774 - protein, 8 aa, Homo Sapiens
PEEGSGCS

SEQ ID NO: 459775 - protein, 9 aa, Homo Sapiens
TPLHWLWAA

SEQ ID NO: 459776 - protein, 9 aa, Homo Sapiens
SAQVSVSDI

SEQ ID NO: 459777 - protein, 9 aa, Homo Sapiens
REHLLFARR

SEQ ID NO: 459778 - protein, 9 aa, Homo Sapiens
HKTFNIKND

SEQ ID NO: 459779 - protein, 9 aa, Homo Sapiens
VTKPDKYQR

SEQ ID NO: 459780 - protein, 9 aa, Homo Sapiens
KQCQDHVET

SEQ ID NO: 459781 - protein, 9 aa, Homo Sapiens
GELMDQNAS

SEQ ID NO: 459782 - protein, 9 aa, Homo Sapiens
TFPSPVWIL

SEQ ID NO: 459783 - protein, 9 aa, Homo Sapiens
HPLPKEAPA

SEQ ID NO: 459784 - protein, 9 aa, Homo Sapiens
TLYISALRK

SEQ ID NO: 459785 - protein, 9 aa, Homo Sapiens
SVHMLAKTH

SEQ ID NO: 459786 - protein, 9 aa, Homo Sapiens
TQQLGQLAL

SEQ ID NO: 459787 - protein, 9 aa, Homo Sapiens
AIVVKRFQE

SEQ ID NO: 459788 - protein, 9 aa, Homo Sapiens
LPTPCHTAP

SEQ ID NO: 459789 - protein, 9 aa, Homo Sapiens
RLEVNAKDT

SEQ ID NO: 459790 - protein, 9 aa, Homo Sapiens
VEKSVELLA

SEQ ID NO: 459791 - protein, 9 aa, Homo Sapiens
EQNTLNIYF

SEQ ID NO: 459792 - protein, 9 aa, Homo Sapiens
YIENNSLSD

SEQ ID NO: 459793 - protein, 9 aa, Homo Sapiens
PLALLSCIV

SEQ ID NO: 459794 - protein, 9 aa, Homo Sapiens
SHVVNGEDA

SEQ ID NO: 459795 - protein, 9 aa, Homo Sapiens
DQNHFLGRA

SEQ ID NO: 459796 - protein, 9 aa, Homo Sapiens
HDAAHGPLP

SEQ ID NO: 459797 - protein, 9 aa, Homo Sapiens
WQWFDGVLG

SEQ ID NO: 459798 - protein, 9 aa, Homo Sapiens
GQPSPGHRV

SEQ ID NO: 459799 - protein, 9 aa, Homo Sapiens
KLQTCQRNS

SEQ ID NO: 459800 - protein, 9 aa, Homo Sapiens
KAMDIEGTS

SEQ ID NO: 459801 - protein, 9 aa, Homo Sapiens
KGKTPEEIH

SEQ ID NO: 459802 - protein, 9 aa, Homo Sapiens
SMWKARLTK

SEQ ID NO: 459803 - protein, 9 aa, Homo Sapiens
SWHEGSFAR

SEQ ID NO: 459804 - protein, 9 aa, Homo Sapiens
MTRTDQESV

SEQ ID NO: 459805 - protein, 9 aa, Homo Sapiens
ALFFLHPLQ

SEQ ID NO: 459806 - protein, 9 aa, Homo Sapiens
RAEVSRIGS

SEQ ID NO: 459807 - protein, 9 aa, Homo Sapiens
SVLRPLALL

SEQ ID NO: 459808 - protein, 9 aa, Homo Sapiens
LPDTRNIAS

SEQ ID NO: 459809 - protein, 9 aa, Homo Sapiens
TTRLQNISE

SEQ ID NO: 459810 - protein, 9 aa, Homo Sapiens
DLAAQTMLN

SEQ ID NO: 459811 - protein, 9 aa, Homo Sapiens
DRKHHPWQL

SEQ ID NO: 459812 - protein, 9 aa, Homo Sapiens
YHAYWKPAA

SEQ ID NO: 459813 - protein, 9 aa, Homo Sapiens
AEVSRIGSL

SEQ ID NO: 459814 - protein, 9 aa, Homo Sapiens
SIPQDAATI

SEQ ID NO: 459815 - protein, 9 aa, Homo Sapiens
DIYTVKMEE

SEQ ID NO: 459816 - protein, 9 aa, Homo Sapiens
AESVPPRGP

SEQ ID NO: 459817 - protein, 9 aa, Homo Sapiens
IHGQAGSQH

SEQ ID NO: 459818 - protein, 9 aa, Homo Sapiens
FTAIYADEH

SEQ ID NO: 459819 - protein, 9 aa, Homo Sapiens
IENNSLSDF

SEQ ID NO: 459820 - protein, 9 aa, Homo Sapiens
ITKQMLPIV

SEQ ID NO: 459821 - protein, 9 aa, Homo Sapiens
ASGGAGPTL

SEQ ID NO: 459822 - protein, 9 aa, Homo Sapiens
SWLWNKLLE

SEQ ID NO: 459823 - protein, 9 aa, Homo Sapiens
EMRSEMVRR

SEQ ID NO: 459824 - protein, 9 aa, Homo Sapiens
SRVGDSNFR

SEQ ID NO: 459825 - protein, 9 aa, Homo Sapiens
KRDACFISL

SEQ ID NO: 459826 - protein, 9 aa, Homo Sapiens
ARGQLMHIE

SEQ ID NO: 459827 - protein, 9 aa, Homo Sapiens
GSSRVGDSN

SEQ ID NO: 459828 - protein, 9 aa, Homo Sapiens
PDKYQRHLH

SEQ ID NO: 459829 - protein, 9 aa, Homo Sapiens
GWDHGTTHQ

SEQ ID NO: 459830 - protein, 9 aa, Homo Sapiens
GSLSAGSLC

SEQ ID NO: 459831 - protein, 9 aa, Homo Sapiens
HTPAASDYE

SEQ ID NO: 459832 - protein, 9 aa, Homo Sapiens
PFVFYFASR

SEQ ID NO: 459833 - protein, 9 aa, Homo Sapiens
YPGPCPNWN

SEQ ID NO: 459834 - protein, 9 aa, Homo Sapiens
YDQNHFLGR

SEQ ID NO: 459835 - protein, 9 aa, Homo Sapiens
MAMGIEDSE

SEQ ID NO: 459836 - protein, 9 aa, Homo Sapiens
EEIHKTFNI

SEQ ID NO: 459837 - protein, 9 aa, Homo Sapiens
KLGGYFTAI

SEQ ID NO: 459838 - protein, 9 aa, Homo Sapiens
HVPEVPTYP

SEQ ID NO: 459839 - protein, 9 aa, Homo Sapiens
RSACAASKH

SEQ ID NO: 459840 - protein, 9 aa, Homo Sapiens
GQLMHIEFK

SEQ ID NO: 459841 - protein, 9 aa, Homo Sapiens
LLEYVYINS

SEQ ID NO: 459842 - protein, 9 aa, Homo Sapiens
YTLKKNVDY

SEQ ID NO: 459843 - protein, 9 aa, Homo Sapiens
ISLMNTLMT

SEQ ID NO: 459844 - protein, 9 aa, Homo Sapiens
LNIYFQQAT

SEQ ID NO: 459845 - protein, 9 aa, Homo Sapiens
LTTRLQNIS

SEQ ID NO: 459846 - protein, 9 aa, Homo Sapiens
HGPLPLTAG

SEQ ID NO: 459847 - protein, 9 aa, Homo Sapiens
QTCQRNSQI

SEQ ID NO: 459848 - protein, 9 aa, Homo Sapiens
PRLHQHGPC

SEQ ID NO: 459849 - protein, 9 aa, Homo Sapiens
LSSMTRTDQ

SEQ ID NO: 459850 - protein, 9 aa, Homo Sapiens
QDFPVSYKC

SEQ ID NO: 459851 - protein, 9 aa, Homo Sapiens
LLDSDKGSL

SEQ ID NO: 459852 - protein, 9 aa, Homo Sapiens
SSAIVVKRF

SEQ ID NO: 459853 - protein, 9 aa, Homo Sapiens
KAELDLWSK

SEQ ID NO: 459854 - protein, 9 aa, Homo Sapiens
ELKVVIPVC

SEQ ID NO: 459855 - protein, 9 aa, Homo Sapiens
VERFKEYSK

SEQ ID NO: 459856 - protein, 9 aa, Homo Sapiens
WFDGVLGLT

SEQ ID NO: 459857 - protein, 9 aa, Homo Sapiens
YHTLYISAL

SEQ ID NO: 459858 - protein, 9 aa, Homo Sapiens
GAGTKTTST

SEQ ID NO: 459859 - protein, 9 aa, Homo Sapiens
EELNQQRVF

SEQ ID NO: 459860 - protein, 9 aa, Homo Sapiens
SLLLGGIIL

SEQ ID NO: 459861 - protein, 9 aa, Homo Sapiens
LSATGTFCP

SEQ ID NO: 459862 - protein, 9 aa, Homo Sapiens
RDPRFMALA

SEQ ID NO: 459863 - protein, 9 aa, Homo Sapiens
SRYVFYWRD

SEQ ID NO: 459864 - protein, 9 aa, Homo Sapiens
ESKEDRHPL

SEQ ID NO: 459865 - protein, 9 aa, Homo Sapiens
DPKSKSVQS

SEQ ID NO: 459866 - protein, 9 aa, Homo Sapiens
QKQCQDHVE

SEQ ID NO: 459867 - protein, 9 aa, Homo Sapiens
VAANPAAAV

SEQ ID NO: 459868 - protein, 9 aa, Homo Sapiens
RGAPEWGAC

SEQ ID NO: 459869 - protein, 9 aa, Homo Sapiens
GKQKYLCTS

SEQ ID NO: 459870 - protein, 9 aa, Homo Sapiens
SPVLPTPCH

SEQ ID NO: 459871 - protein, 9 aa, Homo Sapiens
DFAGDDAPR

SEQ ID NO: 459872 - protein, 9 aa, Homo Sapiens
LQPSAVPRP

SEQ ID NO: 459873 - protein, 9 aa, Homo Sapiens
TPPLSIQTS

SEQ ID NO: 459874 - protein, 9 aa, Homo Sapiens
KPISSVDPQ

SEQ ID NO: 459875 - protein, 9 aa, Homo Sapiens
KRPNNPPGV

SEQ ID NO: 459876 - protein, 9 aa, Homo Sapiens
RYGPLCPSG

SEQ ID NO: 459877 - protein, 9 aa, Homo Sapiens
VEAAEAHTQ

SEQ ID NO: 459878 - protein, 9 aa, Homo Sapiens
FEEIKMAMG

SEQ ID NO: 459879 - protein, 9 aa, Homo Sapiens
HVASQFASR

SEQ ID NO: 459880 - protein, 9 aa, Homo Sapiens
ERFWGKAAK

SEQ ID NO: 459881 - protein, 9 aa, Homo Sapiens
PSGYTLKKN

SEQ ID NO: 459882 - protein, 9 aa, Homo Sapiens
HLLLLLLVQ

SEQ ID NO: 459883 - protein, 9 aa, Homo Sapiens
LIAIDNQLL

SEQ ID NO: 459884 - protein, 9 aa, Homo Sapiens
IDGSSRVGD

SEQ ID NO: 459885 - protein, 9 aa, Homo Sapiens
CPRTTSLTW

SEQ ID NO: 459886 - protein, 9 aa, Homo Sapiens
PPAAAGYHA

SEQ ID NO: 459887 - protein, 9 aa, Homo Sapiens
CRAAYPPSP

SEQ ID NO: 459888 - protein, 9 aa, Homo Sapiens
HRVYTKLKR

SEQ ID NO: 459889 - protein, 9 aa, Homo Sapiens
SVPPRGPDR

SEQ ID NO: 459890 - protein, 9 aa, Homo Sapiens
KQKPVSKMV

SEQ ID NO: 459891 - protein, 9 aa, Homo Sapiens
CLDPFVFYF

SEQ ID NO: 459892 - protein, 9 aa, Homo Sapiens
ALWLCCATP

SEQ ID NO: 459893 - protein, 9 aa, Homo Sapiens
VFINRQFRN

SEQ ID NO: 459894 - protein, 9 aa, Homo Sapiens
VHVPEVPTY

SEQ ID NO: 459895 - protein, 9 aa, Homo Sapiens
RCVCHPPPA

SEQ ID NO: 459896 - protein, 9 aa, Homo Sapiens
PPASRCVCH

SEQ ID NO: 459897 - protein, 9 aa, Homo Sapiens
VKDSSHHVI

SEQ ID NO: 459898 - protein, 9 aa, Homo Sapiens
LKYWSKTCT

SEQ ID NO: 459899 - protein, 9 aa, Homo Sapiens
LGGYFTAIY

SEQ ID NO: 459900 - protein, 9 aa, Homo Sapiens
NIVAVERFK

SEQ ID NO: 459901 - protein, 9 aa, Homo Sapiens
CKDPNHVSL

SEQ ID NO: 459902 - protein, 9 aa, Homo Sapiens
TLSFHTLTL

SEQ ID NO: 459903 - protein, 9 aa, Homo Sapiens
QIYVRTHTG

SEQ ID NO: 459904 - protein, 9 aa, Homo Sapiens
SQDCQDFPV

SEQ ID NO: 459905 - protein, 9 aa, Homo Sapiens
APSPWGSPP

SEQ ID NO: 459906 - protein, 9 aa, Homo Sapiens
PLTAGVCPH

SEQ ID NO: 459907 - protein, 9 aa, Homo Sapiens
EEEKEQSLL

SEQ ID NO: 459908 - protein, 9 aa, Homo Sapiens
AIDNQLLHV

SEQ ID NO: 459909 - protein, 9 aa, Homo Sapiens
PDLAAQTML

SEQ ID NO: 459910 - protein, 9 aa, Homo Sapiens
VRDGLPLSP

SEQ ID NO: 459911 - protein, 9 aa, Homo Sapiens
RGPDRHAAL

SEQ ID NO: 459912 - protein, 9 aa, Homo Sapiens
KPTLSIQHP

SEQ ID NO: 459913 - protein, 9 aa, Homo Sapiens
GKAAKQISW

SEQ ID NO: 459914 - protein, 9 aa, Homo Sapiens
GHWVVPVPR

SEQ ID NO: 459915 - protein, 9 aa, Homo Sapiens
GRPLLEVVR

SEQ ID NO: 459916 - protein, 9 aa, Homo Sapiens
RAVLSLGSV

SEQ ID NO: 459917 - protein, 9 aa, Homo Sapiens
ACFISLMNT

SEQ ID NO: 459918 - protein, 9 aa, Homo Sapiens
RMPVSHLST

SEQ ID NO: 459919 - protein, 9 aa, Homo Sapiens
APWRTPAVP

SEQ ID NO: 459920 - protein, 9 aa, Homo Sapiens
LWVLTDSHT

SEQ ID NO: 459921 - protein, 9 aa, Homo Sapiens
EEKEQSLLK

SEQ ID NO: 459922 - protein, 9 aa, Homo Sapiens
AGYHAYWKP

SEQ ID NO: 459923 - protein, 9 aa, Homo Sapiens
AMDIEGTSD

SEQ ID NO: 459924 - protein, 9 aa, Homo Sapiens
FVNGRPLLE

SEQ ID NO: 459925 - protein, 9 aa, Homo Sapiens
ACAASKHAT

SEQ ID NO: 459926 - protein, 9 aa, Homo Sapiens
PPAAAPRLH

SEQ ID NO: 459927 - protein, 9 aa, Homo Sapiens
HTQQLGQLA

SEQ ID NO: 459928 - protein, 9 aa, Homo Sapiens
KEEEKEQSL

SEQ ID NO: 459929 - protein, 9 aa, Homo Sapiens
QMVLRCWSL

SEQ ID NO: 459930 - protein, 9 aa, Homo Sapiens
SQSVHMLAK

SEQ ID NO: 459931 - protein, 9 aa, Homo Sapiens
CSQDCQDFP

SEQ ID NO: 459932 - protein, 9 aa, Homo Sapiens
VSLMSQVSY

SEQ ID NO: 459933 - protein, 9 aa, Homo Sapiens
AVLSLGSVF

SEQ ID NO: 459934 - protein, 9 aa, Homo Sapiens
SSLLLGGII

SEQ ID NO: 459935 - protein, 9 aa, Homo Sapiens
LETMNAEEY

SEQ ID NO: 459936 - protein, 9 aa, Homo Sapiens
HAFLYIHQL

SEQ ID NO: 459937 - protein, 9 aa, Homo Sapiens
PLQPSAVPR

SEQ ID NO: 459938 - protein, 9 aa, Homo Sapiens
LCLLYSSIC

SEQ ID NO: 459939 - protein, 9 aa, Homo Sapiens
LLFARRRNP

SEQ ID NO: 459940 - protein, 9 aa, Homo Sapiens
ARVWLRVTT

SEQ ID NO: 459941 - protein, 9 aa, Homo Sapiens
PPRRAVLSL

SEQ ID NO: 459942 - protein, 9 aa, Homo Sapiens
PPVALGKPQ

SEQ ID NO: 459943 - protein, 9 aa, Homo Sapiens
CPHTPAASD

SEQ ID NO: 459944 - protein, 9 aa, Homo Sapiens
NKVENLIDL

SEQ ID NO: 459945 - protein, 9 aa, Homo Sapiens
KMVAKVQDL

SEQ ID NO: 459946 - protein, 9 aa, Homo Sapiens
HAYWKPAAV

SEQ ID NO: 459947 - protein, 9 aa, Homo Sapiens
LTDSHTAQG

SEQ ID NO: 459948 - protein, 9 aa, Homo Sapiens
VHMLAKTHP

SEQ ID NO: 459949 - protein, 9 aa, Homo Sapiens
MSMWKARLT

SEQ ID NO: 459950 - protein, 9 aa, Homo Sapiens
QWFDGVLGL

SEQ ID NO: 459951 - protein, 9 aa, Homo Sapiens
MMYFAPDLI

SEQ ID NO: 459952 - protein, 9 aa, Homo Sapiens
EKQQRKKAK

SEQ ID NO: 459953 - protein, 9 aa, Homo Sapiens
HRVILYPSV

SEQ ID NO: 459954 - protein, 9 aa, Homo Sapiens
GCGPDLCSE

SEQ ID NO: 459955 - protein, 9 aa, Homo Sapiens
APSVATEGL

SEQ ID NO: 459956 - protein, 9 aa, Homo Sapiens
AVPQLVLFH

SEQ ID NO: 459957 - protein, 9 aa, Homo Sapiens
TTHQCRKVG

SEQ ID NO: 459958 - protein, 9 aa, Homo Sapiens
LWNEVQIKH

SEQ ID NO: 459959 - protein, 9 aa, Homo Sapiens
VENLIDLYI

SEQ ID NO: 459960 - protein, 9 aa, Homo Sapiens
EAAEAHTQQ

SEQ ID NO: 459961 - protein, 9 aa, Homo Sapiens
DAAHGPLPL

SEQ ID NO: 459962 - protein, 9 aa, Homo Sapiens
YGKLQTCQR

SEQ ID NO: 459963 - protein, 9 aa, Homo Sapiens
SPSTDFYHT

SEQ ID NO: 459964 - protein, 9 aa, Homo Sapiens
ASQFASRYV

SEQ ID NO: 459965 - protein, 9 aa, Homo Sapiens
SRCVCHPPP

SEQ ID NO: 459966 - protein, 9 aa, Homo Sapiens
GCSQDCQDF

SEQ ID NO: 459967 - protein, 9 aa, Homo Sapiens
ICTSTNSQV

SEQ ID NO: 459968 - protein, 9 aa, Homo Sapiens
CGPQSCPAS

SEQ ID NO: 459969 - protein, 9 aa, Homo Sapiens
EVPTYPETP

SEQ ID NO: 459970 - protein, 9 aa, Homo Sapiens
ASRYVFYWR

SEQ ID NO: 459971 - protein, 9 aa, Homo Sapiens
AVAAVAAAA

SEQ ID NO: 459972 - protein, 9 aa, Homo Sapiens
NSLFYSRGP

SEQ ID NO: 459973 - protein, 9 aa, Homo Sapiens
ADVGQPSPG

SEQ ID NO: 459974 - protein, 9 aa, Homo Sapiens
LLYSSICTS

SEQ ID NO: 459975 - protein, 9 aa, Homo Sapiens
ASEQPTHAD

SEQ ID NO: 459976 - protein, 9 aa, Homo Sapiens
IPSLAAPQA

SEQ ID NO: 459977 - protein, 9 aa, Homo Sapiens
SAREHLLFA

SEQ ID NO: 459978 - protein, 9 aa, Homo Sapiens
IAIDNQLLH

SEQ ID NO: 459979 - protein, 9 aa, Homo Sapiens
PWGSPPAPG

SEQ ID NO: 459980 - protein, 9 aa, Homo Sapiens
LNRISSNML

SEQ ID NO: 459981 - protein, 9 aa, Homo Sapiens
WLCCATPAH

SEQ ID NO: 459982 - protein, 9 aa, Homo Sapiens
IHQLAIHLH

SEQ ID NO: 459983 - protein, 9 aa, Homo Sapiens
PINYMEVIV

SEQ ID NO: 459984 - protein, 9 aa, Homo Sapiens
GCKDPNHVS

SEQ ID NO: 459985 - protein, 9 aa, Homo Sapiens
DIPKGVLGF

SEQ ID NO: 459986 - protein, 9 aa, Homo Sapiens
EVWGKGTTV

SEQ ID NO: 459987 - protein, 9 aa, Homo Sapiens
QRKKAKSGS

SEQ ID NO: 459988 - protein, 9 aa, Homo Sapiens
SSVLQRFRF

SEQ ID NO: 459989 - protein, 9 aa, Homo Sapiens
HVVHGEDAV

SEQ ID NO: 459990 - protein, 9 aa, Homo Sapiens
HHVILGTQQ

SEQ ID NO: 459991 - protein, 9 aa, Homo Sapiens
KSDPKSKSV

SEQ ID NO: 459992 - protein, 9 aa, Homo Sapiens
VLRPLALLS

SEQ ID NO: 459993 - protein, 9 aa, Homo Sapiens
NGLRRELDE

SEQ ID NO: 459994 - protein, 9 aa, Homo Sapiens
AAKQISWYK

SEQ ID NO: 459995 - protein, 9 aa, Homo Sapiens
TTVTVAVST

SEQ ID NO: 459996 - protein, 9 aa, Homo Sapiens
VNGRPLLEV

SEQ ID NO: 459997 - protein, 9 aa, Homo Sapiens
LALWLCCAT

SEQ ID NO: 459998 - protein, 9 aa, Homo Sapiens
STVPTPACP

SEQ ID NO: 459999 - protein, 9 aa, Homo Sapiens
HFLGRACFC

SEQ ID NO: 460000 - protein, 9 aa, Homo Sapiens
MESFLEAVS

SEQ ID NO: 460001 - protein, 9 aa, Homo Sapiens
AQAGSCRLE

SEQ ID NO: 460002 - protein, 9 aa, Homo Sapiens
PPSSHSSSH

SEQ ID NO: 460003 - protein, 9 aa, Homo Sapiens
APRLHQHGP

SEQ ID NO: 460004 - protein, 9 aa, Homo Sapiens
SCRLELFLF

SEQ ID NO: 460005 - protein, 9 aa, Homo Sapiens
EACGQEITK

SEQ ID NO: 460006 - protein, 9 aa, Homo Sapiens
KTGMTHIVR

SEQ ID NO: 460007 - protein, 9 aa, Homo Sapiens
GSSSGSGRS

SEQ ID NO: 460008 - protein, 9 aa, Homo Sapiens
MDAVDCQEG

SEQ ID NO: 460009 - protein, 9 aa, Homo Sapiens
ALDGQRDKC

SEQ ID NO: 460010 - protein, 9 aa, Homo Sapiens
TMNAEEYSL

SEQ ID NO: 460011 - protein, 9 aa, Homo Sapiens
PCLRSLHPC

SEQ ID NO: 460012 - protein, 9 aa, Homo Sapiens
DRHPLPKEA

SEQ ID NO: 460013 - protein, 9 aa, Homo Sapiens
SLQQMVLRC

SEQ ID NO: 460014 - protein, 9 aa, Homo Sapiens
WPASGGCHA

SEQ ID NO: 460015 - protein, 9 aa, Homo Sapiens
VAVSTSSQW

SEQ ID NO: 460016 - protein, 9 aa, Homo Sapiens
KNCLTKPLP

SEQ ID NO: 460017 - protein, 9 aa, Homo Sapiens
LNQLIAIDN

SEQ ID NO: 460018 - protein, 9 aa, Homo Sapiens
GSLEFLDEM

SEQ ID NO: 460019 - protein, 9 aa, Homo Sapiens
DFSISEVNQ

SEQ ID NO: 460020 - protein, 9 aa, Homo Sapiens
SGRSSSSSG

SEQ ID NO: 460021 - protein, 9 aa, Homo Sapiens
QNASSLTQK

SEQ ID NO: 460022 - protein, 9 aa, Homo Sapiens
FSSLPDTRN

SEQ ID NO: 460023 - protein, 9 aa, Homo Sapiens
SWGAPPRRG

SEQ ID NO: 460024 - protein, 9 aa, Homo Sapiens
MNGNKVENL

SEQ ID NO: 460025 - protein, 9 aa, Homo Sapiens
ENLNQLIAI

SEQ ID NO: 460026 - protein, 9 aa, Homo Sapiens
GTKTTSTTL

SEQ ID NO: 460027 - protein, 9 aa, Homo Sapiens
PCIELIKRP

SEQ ID NO: 460028 - protein, 9 aa, Homo Sapiens
SAIVVKRFQ

SEQ ID NO: 460029 - protein, 9 aa, Homo Sapiens
LEVVRQRIV

SEQ ID NO: 460030 - protein, 9 aa, Homo Sapiens
VDGTDINAV

SEQ ID NO: 460031 - protein, 9 aa, Homo Sapiens
FHTLTLPLH

SEQ ID NO: 460032 - protein, 9 aa, Homo Sapiens
TDSHTAQGY

SEQ ID NO: 460033 - protein, 9 aa, Homo Sapiens
VLTDSHTAQ

SEQ ID NO: 460034 - protein, 9 aa, Homo Sapiens
RYHVKDSSH

SEQ ID NO: 460035 - protein, 9 aa, Homo Sapiens
DKYHTLYIS

SEQ ID NO: 460036 - protein, 9 aa, Homo Sapiens
QCWLTLMEA

SEQ ID NO: 460037 - protein, 9 aa, Homo Sapiens
GGCHALFFL

SEQ ID NO: 460038 - protein, 9 aa, Homo Sapiens
PASGGAGPT

SEQ ID NO: 460039 - protein, 9 aa, Homo Sapiens
AQVSVSDIP

SEQ ID NO: 460040 - protein, 9 aa, Homo Sapiens
MVLRCWSLK

SEQ ID NO: 460041 - protein, 9 aa, Homo Sapiens
FQGCGPDLC

SEQ ID NO: 460042 - protein, 9 aa, Homo Sapiens
LTLPLHRTP

SEQ ID NO: 460043 - protein, 9 aa, Homo Sapiens
ISLAALKKA

SEQ ID NO: 460044 - protein, 9 aa, Homo Sapiens
LCTSRNDCT

SEQ ID NO: 460045 - protein, 9 aa, Homo Sapiens
KKAKSGSPG

SEQ ID NO: 460046 - protein, 9 aa, Homo Sapiens
NCLDPFVFY

SEQ ID NO: 460047 - protein, 9 aa, Homo Sapiens
VPKPVFAAV

SEQ ID NO: 460048 - protein, 9 aa, Homo Sapiens
LLLLLLVQA

SEQ ID NO: 460049 - protein, 9 aa, Homo Sapiens
DQEPCVTEH

SEQ ID NO: 460050 - protein, 9 aa, Homo Sapiens
AAYPPSPLC

SEQ ID NO: 460051 - protein, 9 aa, Homo Sapiens
GRRGCWPAS

SEQ ID NO: 460052 - protein, 9 aa, Homo Sapiens
SPRNSWHEG

SEQ ID NO: 460053 - protein, 9 aa, Homo Sapiens
FVDFYTFNS

SEQ ID NO: 460054 - protein, 9 aa, Homo Sapiens
WSEGVDGTD

SEQ ID NO: 460055 - protein, 9 aa, Homo Sapiens
DQNASSLTQ

SEQ ID NO: 460056 - protein, 9 aa, Homo Sapiens
PALRDFSIS

SEQ ID NO: 460057 - protein, 9 aa, Homo Sapiens
SSMTRTDQE

SEQ ID NO: 460058 - protein, 9 aa, Homo Sapiens
GPCPNWNHS

SEQ ID NO: 460059 - protein, 9 aa, Homo Sapiens
PPAPGDAAA

SEQ ID NO: 460060 - protein, 9 aa, Homo Sapiens
AYWKPAAVP

SEQ ID NO: 460061 - protein, 9 aa, Homo Sapiens
SEQPTHADV

SEQ ID NO: 460062 - protein, 9 aa, Homo Sapiens
PEAGALAQG

SEQ ID NO: 460063 - protein, 9 aa, Homo Sapiens
SVHVPEVPT

SEQ ID NO: 460064 - protein, 9 aa, Homo Sapiens
VEKAELDLW

SEQ ID NO: 460065 - protein, 9 aa, Homo Sapiens
AKQISWYKP

SEQ ID NO: 460066 - protein, 9 aa, Homo Sapiens
KLLEASIET

SEQ ID NO: 460067 - protein, 9 aa, Homo Sapiens
VITPLTDQC

SEQ ID NO: 460068 - protein, 9 aa, Homo Sapiens
GAPPRRGAP

SEQ ID NO: 460069 - protein, 9 aa, Homo Sapiens
HDVTLEASR

SEQ ID NO: 460070 - protein, 9 aa, Homo Sapiens
AIYADEHEK

SEQ ID NO: 460071 - protein, 9 aa, Homo Sapiens
DGVLGLTKR

SEQ ID NO: 460072 - protein, 9 aa, Homo Sapiens
CGQEITKQM

SEQ ID NO: 460073 - protein, 9 aa, Homo Sapiens
VFYFASREF

SEQ ID NO: 460074 - protein, 9 aa, Homo Sapiens
QTMLNSPLF

SEQ ID NO: 460075 - protein, 9 aa, Homo Sapiens
VLRCWSLKF

SEQ ID NO: 460076 - protein, 9 aa, Homo Sapiens
VLQRFRFTH

SEQ ID NO: 460077 - protein, 9 aa, Homo Sapiens
FLTTRLQNI

SEQ ID NO: 460078 - protein, 9 aa, Homo Sapiens
TVAVSTSSQ

SEQ ID NO: 460079 - protein, 9 aa, Homo Sapiens
SPWGSPPAP

SEQ ID NO: 460080 - protein, 9 aa, Homo Sapiens
LYSSICTST

SEQ ID NO: 460081 - protein, 9 aa, Homo Sapiens
RNSWHEGSF

SEQ ID NO: 460082 - protein, 9 aa, Homo Sapiens
RDRNEAIAK

SEQ ID NO: 460083 - protein, 9 aa, Homo Sapiens
AEKVDRLWN

SEQ ID NO: 460084 - protein, 9 aa, Homo Sapiens
EEIKMAMGI

SEQ ID NO: 460085 - protein, 9 aa, Homo Sapiens
MCKADFAGD

SEQ ID NO: 460086 - protein, 9 aa, Homo Sapiens
TATAESVPP

SEQ ID NO: 460087 - protein, 9 aa, Homo Sapiens
RVSESSASS

SEQ ID NO: 460088 - protein, 9 aa, Homo Sapiens
GCWPASGGC

SEQ ID NO: 460089 - protein, 9 aa, Homo Sapiens
EQPTHADVG

SEQ ID NO: 460090 - protein, 9 aa, Homo Sapiens
TSQEPEINK

SEQ ID NO: 460091 - protein, 9 aa, Homo Sapiens
AIPGSVLRP

SEQ ID NO: 460092 - protein, 9 aa, Homo Sapiens
VALSLFLAW

SEQ ID NO: 460093 - protein, 9 aa, Homo Sapiens
PWQLDKAEL

SEQ ID NO: 460094 - protein, 9 aa, Homo Sapiens
RVILYPSVP

SEQ ID NO: 460095 - protein, 9 aa, Homo Sapiens
HVTSPQVKA

SEQ ID NO: 460096 - protein, 9 aa, Homo Sapiens
NNCLDPFVF

SEQ ID NO: 460097 - protein, 9 aa, Homo Sapiens
SLTWVPTNS

SEQ ID NO: 460098 - protein, 9 aa, Homo Sapiens
HTLYISALR

SEQ ID NO: 460099 - protein, 9 aa, Homo Sapiens
ADFAGDDAP

SEQ ID NO: 460100 - protein, 9 aa, Homo Sapiens
GAYPNTPPG

SEQ ID NO: 460101 - protein, 9 aa, Homo Sapiens
FQKQCQDHV

SEQ ID NO: 460102 - protein, 9 aa, Homo Sapiens
PQSQEQIHG

SEQ ID NO: 460103 - protein, 9 aa, Homo Sapiens
YVFINRQFR

SEQ ID NO: 460104 - protein, 9 aa, Homo Sapiens
IQRLSPTMN

SEQ ID NO: 460105 - protein, 9 aa, Homo Sapiens
SHVVHGEDA

SEQ ID NO: 460106 - protein, 9 aa, Homo Sapiens
HIQRLSPTM

SEQ ID NO: 460107 - protein, 9 aa, Homo Sapiens
DGLPLSPST

SEQ ID NO: 460108 - protein, 9 aa, Homo Sapiens
YPSLFQIYV

SEQ ID NO: 460109 - protein, 9 aa, Homo Sapiens
MWKARLTKR

SEQ ID NO: 460110 - protein, 9 aa, Homo Sapiens
EEKNDEMRS

SEQ ID NO: 460111 - protein, 9 aa, Homo Sapiens
HADTHIQRL

SEQ ID NO: 460112 - protein, 9 aa, Homo Sapiens
SGFFPINYM

SEQ ID NO: 460113 - protein, 9 aa, Homo Sapiens
SVLQRFRFT

SEQ ID NO: 460114 - protein, 9 aa, Homo Sapiens
SLCCSNFVD

SEQ ID NO: 460115 - protein, 9 aa, Homo Sapiens
PCPNWNHSS

SEQ ID NO: 460116 - protein, 9 aa, Homo Sapiens
GGPSHSSLS

SEQ ID NO: 460117 - protein, 9 aa, Homo Sapiens
AVERFKEYS

SEQ ID NO: 460118 - protein, 9 aa, Homo Sapiens
PSLFQIYVR

SEQ ID NO: 460119 - protein, 9 aa, Homo Sapiens
SVELLALQK

SEQ ID NO: 460120 - protein, 9 aa, Homo Sapiens
EVDIYTVKM

SEQ ID NO: 460121 - protein, 9 aa, Homo Sapiens
KPVFAAVDG

SEQ ID NO: 460122 - protein, 9 aa, Homo Sapiens
CCADRCHCC

SEQ ID NO: 460123 - protein, 9 aa, Homo Sapiens
CSNFVDFYT

SEQ ID NO: 460124 - protein, 9 aa, Homo Sapiens
QLKSLETSI

SEQ ID NO: 460125 - protein, 9 aa, Homo Sapiens
LSFHTLTLP

SEQ ID NO: 460126 - protein, 9 aa, Homo Sapiens
SSSGSGRSS

SEQ ID NO: 460127 - protein, 9 aa, Homo Sapiens
AIPALRDFS

SEQ ID NO: 460128 - protein, 9 aa, Homo Sapiens
LNKEEEELN

SEQ ID NO: 460129 - protein, 9 aa, Homo Sapiens
DVGQPSPGH

SEQ ID NO: 460130 - protein, 9 aa, Homo Sapiens
QGVCCADRC

SEQ ID NO: 460131 - protein, 9 aa, Homo Sapiens
MPVSHLSTY

SEQ ID NO: 460132 - protein, 9 aa, Homo Sapiens
TFCPVPSEQ

SEQ ID NO: 460133 - protein, 9 aa, Homo Sapiens
SKTCTQKEV

SEQ ID NO: 460134 - protein, 9 aa, Homo Sapiens
AESTRNGLG

SEQ ID NO: 460135 - protein, 9 aa, Homo Sapiens
LATALCPHT

SEQ ID NO: 460136 - protein, 9 aa, Homo Sapiens
HVKDSSHHV

SEQ ID NO: 460137 - protein, 9 aa, Homo Sapiens
GCSVLRPLA

SEQ ID NO: 460138 - protein, 9 aa, Homo Sapiens
YALRTIDYE

SEQ ID NO: 460139 - protein, 9 aa, Homo Sapiens
GCHALFFLH

SEQ ID NO: 460140 - protein, 9 aa, Homo Sapiens
PAAVPACGP

SEQ ID NO: 460141 - protein, 9 aa, Homo Sapiens
TRNGLGPGL

SEQ ID NO: 460142 - protein, 9 aa, Homo Sapiens
YYKPISSVD

SEQ ID NO: 460143 - protein, 9 aa, Homo Sapiens
NAEEYSLRN

SEQ ID NO: 460144 - protein, 9 aa, Homo Sapiens
NRLAPPVAL

SEQ ID NO: 460145 - protein, 9 aa, Homo Sapiens
TKHDVTLEA

SEQ ID NO: 460146 - protein, 9 aa, Homo Sapiens
RLHQHGPCY

SEQ ID NO: 460147 - protein, 9 aa, Homo Sapiens
RFKEYSKTE

SEQ ID NO: 460148 - protein, 9 aa, Homo Sapiens
IDNQLLHVK

SEQ ID NO: 460149 - protein, 9 aa, Homo Sapiens
LIDLYIYVI

SEQ ID NO: 460150 - protein, 9 aa, Homo Sapiens
GVCPHASEQ

SEQ ID NO: 460151 - protein, 9 aa, Homo Sapiens
DINGLRREL

SEQ ID NO: 460152 - protein, 9 aa, Homo Sapiens
RLGYPTLTR

SEQ ID NO: 460153 - protein, 9 aa, Homo Sapiens
VSATPPLSI

SEQ ID NO: 460154 - protein, 9 aa, Homo Sapiens
EAHTQQLGQ

SEQ ID NO: 460155 - protein, 9 aa, Homo Sapiens
PSSRPSSHV

SEQ ID NO: 460156 - protein, 9 aa, Homo Sapiens
DQCWLTLME

SEQ ID NO: 460157 - protein, 9 aa, Homo Sapiens
ELDELTLTR

SEQ ID NO: 460158 - protein, 9 aa, Homo Sapiens
GPTLGQWTA

SEQ ID NO: 460159 - protein, 9 aa, Homo Sapiens
LKKNVDYSI

SEQ ID NO: 460160 - protein, 9 aa, Homo Sapiens
QCKHDPFAS

SEQ ID NO: 460161 - protein, 9 aa, Homo Sapiens
RTVLQGYEI

SEQ ID NO: 460162 - protein, 9 aa, Homo Sapiens
LQTCQRNSQ

SEQ ID NO: 460163 - protein, 9 aa, Homo Sapiens
EIALGCKDP

SEQ ID NO: 460164 - protein, 9 aa, Homo Sapiens
PSAVPRPAS

SEQ ID NO: 460165 - protein, 9 aa, Homo Sapiens
VSTSSQWSF

SEQ ID NO: 460166 - protein, 9 aa, Homo Sapiens
WKSDPKSKS

SEQ ID NO: 460167 - protein, 9 aa, Homo Sapiens
RRGCWPASG

SEQ ID NO: 460168 - protein, 9 aa, Homo Sapiens
RSEMVRREA

SEQ ID NO: 460169 - protein, 9 aa, Homo Sapiens
SSLSVGRRH

SEQ ID NO: 460170 - protein, 9 aa, Homo Sapiens
LGCKDPNHV

SEQ ID NO: 460171 - protein, 9 aa, Homo Sapiens
PRNSWHEGS

SEQ ID NO: 460172 - protein, 9 aa, Homo Sapiens
SACAASKHA

SEQ ID NO: 460173 - protein, 9 aa, Homo Sapiens
SSPSLNSTV

SEQ ID NO: 460174 - protein, 9 aa, Homo Sapiens
VIRMPVSHL

SEQ ID NO: 460175 - protein, 9 aa, Homo Sapiens
VLRPPISVS

SEQ ID NO: 460176 - protein, 9 aa, Homo Sapiens
VVPVPRLPF

SEQ ID NO: 460177 - protein, 9 aa, Homo Sapiens
SPGHRVILY

SEQ ID NO: 460178 - protein, 9 aa, Homo Sapiens
VPQLVLFHL

SEQ ID NO: 460179 - protein, 9 aa, Homo Sapiens
DRNTKHDVT

SEQ ID NO: 460180 - protein, 9 aa, Homo Sapiens
GSSLQQMVL

SEQ ID NO: 460181 - protein, 9 aa, Homo Sapiens
GFQGCGPDL

SEQ ID NO: 460182 - protein, 9 aa, Homo Sapiens
AAQTMLNSP

SEQ ID NO: 460183 - protein, 9 aa, Homo Sapiens
AVSLMSQVS

SEQ ID NO: 460184 - protein, 9 aa, Homo Sapiens
NPAAAVAAV

SEQ ID NO: 460185 - protein, 9 aa, Homo Sapiens
LRPPISVSF

SEQ ID NO: 460186 - protein, 9 aa, Homo Sapiens
CVNDAAIVL

SEQ ID NO: 460187 - protein, 9 aa, Homo Sapiens
ESWGAPPRR

SEQ ID NO: 460188 - protein, 9 aa, Homo Sapiens
LLGAGTKTT

SEQ ID NO: 460189 - protein, 9 aa, Homo Sapiens
GIWSEGVDG

SEQ ID NO: 460190 - protein, 9 aa, Homo Sapiens
SLLNLSSMT

SEQ ID NO: 460191 - protein, 9 aa, Homo Sapiens
RDACFISLM

SEQ ID NO: 460192 - protein, 9 aa, Homo Sapiens
SFSPRNSWH

SEQ ID NO: 460193 - protein, 9 aa, Homo Sapiens
AQEEISKVE

SEQ ID NO: 460194 - protein, 9 aa, Homo Sapiens
AAAGYHAYW

SEQ ID NO: 460195 - protein, 9 aa, Homo Sapiens
MSRSVALSL

SEQ ID NO: 460196 - protein, 9 aa, Homo Sapiens
RFTHVIQQR

SEQ ID NO: 460197 - protein, 9 aa, Homo Sapiens
SLYIENNSL

SEQ ID NO: 460198 - protein, 9 aa, Homo Sapiens
PPGIMVGGP

SEQ ID NO: 460199 - protein, 9 aa, Homo Sapiens
AVDGQEKFE

SEQ ID NO: 460200 - protein, 9 aa, Homo Sapiens
SHTAQGYDE

SEQ ID NO: 460201 - protein, 9 aa, Homo Sapiens
TPAHALQCR

SEQ ID NO: 460202 - protein, 9 aa, Homo Sapiens
AGDLAAAAT

SEQ ID NO: 460203 - protein, 9 aa, Homo Sapiens
CADRCHCCP

SEQ ID NO: 460204 - protein, 9 aa, Homo Sapiens
QLMHIEFKK

SEQ ID NO: 460205 - protein, 9 aa, Homo Sapiens
YHVKDSSHH

SEQ ID NO: 460206 - protein, 9 aa, Homo Sapiens
SKEDRHPLP

SEQ ID NO: 460207 - protein, 9 aa, Homo Sapiens
SSGSGRSSS

SEQ ID NO: 460208 - protein, 9 aa, Homo Sapiens
PFCRAAYPP

SEQ ID NO: 460209 - protein, 9 aa, Homo Sapiens
SSQSVHMLA

SEQ ID NO: 460210 - protein, 9 aa, Homo Sapiens
ILWEKRTVL

SEQ ID NO: 460211 - protein, 9 aa, Homo Sapiens
EGTSDPYVK

SEQ ID NO: 460212 - protein, 9 aa, Homo Sapiens
VPEVPTYPE

SEQ ID NO: 460213 - protein, 9 aa, Homo Sapiens
LEVNAKDTC

SEQ ID NO: 460214 - protein, 9 aa, Homo Sapiens
LCHCSPVLP

SEQ ID NO: 460215 - protein, 9 aa, Homo Sapiens
DRHAALSAT

SEQ ID NO: 460216 - protein, 9 aa, Homo Sapiens
QGCGPDLCS

SEQ ID NO: 460217 - protein, 9 aa, Homo Sapiens
GGLAGDLAA

SEQ ID NO: 460218 - protein, 9 aa, Homo Sapiens
ARNTPLHWL

SEQ ID NO: 460219 - protein, 9 aa, Homo Sapiens
RPQSQEQIH

SEQ ID NO: 460220 - protein, 9 aa, Homo Sapiens
SGGAGPTLG

SEQ ID NO: 460221 - protein, 9 aa, Homo Sapiens
SHDAAHGPL

SEQ ID NO: 460222 - protein, 9 aa, Homo Sapiens
WKPAAVPAC

SEQ ID NO: 460223 - protein, 9 aa, Homo Sapiens
INYMEVIVP

SEQ ID NO: 460224 - protein, 9 aa, Homo Sapiens
AFVNGRPLL

SEQ ID NO: 460225 - protein, 9 aa, Homo Sapiens
SEHVMLNRI

SEQ ID NO: 460226 - protein, 9 aa, Homo Sapiens
KDQEPCVTE

SEQ ID NO: 460227 - protein, 9 aa, Homo Sapiens
VTVAVSTSS

SEQ ID NO: 460228 - protein, 9 aa, Homo Sapiens
MEVIVPLPQ

SEQ ID NO: 460229 - protein, 9 aa, Homo Sapiens
PSTDFYHTQ

SEQ ID NO: 460230 - protein, 9 aa, Homo Sapiens
LQPCIELIK

SEQ ID NO: 460231 - protein, 9 aa, Homo Sapiens
DDHRSAPTD

SEQ ID NO: 460232 - protein, 9 aa, Homo Sapiens
FLHPLQPSA

SEQ ID NO: 460233 - protein, 9 aa, Homo Sapiens
QKTVDKYHT

SEQ ID NO: 460234 - protein, 9 aa, Homo Sapiens
DHGTTHQCR

SEQ ID NO: 460235 - protein, 9 aa, Homo Sapiens
RLELFLFGH

SEQ ID NO: 460236 - protein, 9 aa, Homo Sapiens
AAVDGQEKF

SEQ ID NO: 460237 - protein, 9 aa, Homo Sapiens
VDKYHTLYI

SEQ ID NO: 460238 - protein, 9 aa, Homo Sapiens
VPVPRLPFE

SEQ ID NO: 460239 - protein, 9 aa, Homo Sapiens
EKAELDLWS

SEQ ID NO: 460240 - protein, 9 aa, Homo Sapiens
NGRPLLEVV

SEQ ID NO: 460241 - protein, 9 aa, Homo Sapiens
SGSSSGSGR

SEQ ID NO: 460242 - protein, 9 aa, Homo Sapiens
AQGYDEVCR

SEQ ID NO: 460243 - protein, 9 aa, Homo Sapiens
THADVGQPS

SEQ ID NO: 460244 - protein, 9 aa, Homo Sapiens
PQVEKAELD

SEQ ID NO: 460245 - protein, 9 aa, Homo Sapiens
ALLSCIVPL

SEQ ID NO: 460246 - protein, 9 aa, Homo Sapiens
KVENLIDLY

SEQ ID NO: 460247 - protein, 9 aa, Homo Sapiens
PRFMALAKQ

SEQ ID NO: 460248 - protein, 9 aa, Homo Sapiens
QNPDLAAQT

SEQ ID NO: 460249 - protein, 9 aa, Homo Sapiens
SLPDTRNIA

SEQ ID NO: 460250 - protein, 9 aa, Homo Sapiens
HQRIHTGKR

SEQ ID NO: 460251 - protein, 9 aa, Homo Sapiens
EVYYKPISS

SEQ ID NO: 460252 - protein, 9 aa, Homo Sapiens
NKLLEASIE

SEQ ID NO: 460253 - protein, 9 aa, Homo Sapiens
LAAQTMLNS

SEQ ID NO: 460254 - protein, 9 aa, Homo Sapiens
PGAYPNTPP

SEQ ID NO: 460255 - protein, 9 aa, Homo Sapiens
RPLALLSCI

SEQ ID NO: 460256 - protein, 9 aa, Homo Sapiens
QHQPAAGRR

SEQ ID NO: 460257 - protein, 9 aa, Homo Sapiens
SDKGSLSSG

SEQ ID NO: 460258 - protein, 9 aa, Homo Sapiens
GDDHRSAPT

SEQ ID NO: 460259 - protein, 9 aa, Homo Sapiens
PTNSPRPCL

SEQ ID NO: 460260 - protein, 9 aa, Homo Sapiens
YPSVPFCRA

SEQ ID NO: 460261 - protein, 9 aa, Homo Sapiens
LTDQCWLTL

SEQ ID NO: 460262 - protein, 9 aa, Homo Sapiens
HHPWQLDKA

SEQ ID NO: 460263 - protein, 9 aa, Homo Sapiens
PGSVLRPPI

SEQ ID NO: 460264 - protein, 9 aa, Homo Sapiens
LPLTAGVCP

SEQ ID NO: 460265 - protein, 9 aa, Homo Sapiens
KDSSHHVIL

SEQ ID NO: 460266 - protein, 9 aa, Homo Sapiens
WVLTDSHTA

SEQ ID NO: 460267 - protein, 9 aa, Homo Sapiens
PLPCFLEHN

SEQ ID NO: 460268 - protein, 9 aa, Homo Sapiens
LNLSSMTRT

SEQ ID NO: 460269 - protein, 9 aa, Homo Sapiens
SHSSLSVGR

SEQ ID NO: 460270 - protein, 9 aa, Homo Sapiens
TARVWLRVT

SEQ ID NO: 460271 - protein, 9 aa, Homo Sapiens
IYTVKMEEL

SEQ ID NO: 460272 - protein, 9 aa, Homo Sapiens
LFARRRNPQ

SEQ ID NO: 460273 - protein, 9 aa, Homo Sapiens
LLLVQAVPQ

SEQ ID NO: 460274 - protein, 9 aa, Homo Sapiens
PVIYVFINR

SEQ ID NO: 460275 - protein, 9 aa, Homo Sapiens
QKYLCTSRN

SEQ ID NO: 460276 - protein, 9 aa, Homo Sapiens
EYSLRNGGE

SEQ ID NO: 460277 - protein, 9 aa, Homo Sapiens
PNWNHSSPA

SEQ ID NO: 460278 - protein, 9 aa, Homo Sapiens
YLEAADLSK

SEQ ID NO: 460279 - protein, 9 aa, Homo Sapiens
DKCWCVDRK

SEQ ID NO: 460280 - protein, 9 aa, Homo Sapiens
YVYINSLFY

SEQ ID NO: 460281 - protein, 9 aa, Homo Sapiens
FVFYFASRE

SEQ ID NO: 460282 - protein, 9 aa, Homo Sapiens
VPRPASHDA

SEQ ID NO: 460283 - protein, 9 aa, Homo Sapiens
PSQGAPSVA

SEQ ID NO: 460284 - protein, 9 aa, Homo Sapiens
CPVPSEQLP

SEQ ID NO: 460285 - protein, 9 aa, Homo Sapiens
TPPGIMVGG

SEQ ID NO: 460286 - protein, 9 aa, Homo Sapiens
QPEKTSQEP

SEQ ID NO: 460287 - protein, 9 aa, Homo Sapiens
TKDAGTIMG

SEQ ID NO: 460288 - protein, 9 aa, Homo Sapiens
IPQDAATIP

SEQ ID NO: 460289 - protein, 9 aa, Homo Sapiens
QSCPASGGA

SEQ ID NO: 460290 - protein, 9 aa, Homo Sapiens
NDEMRSEMV

SEQ ID NO: 460291 - protein, 9 aa, Homo Sapiens
CTARVWLRV

SEQ ID NO: 460292 - protein, 9 aa, Homo Sapiens
ANPAAAVAA

SEQ ID NO: 460293 - protein, 9 aa, Homo Sapiens
CHALFFLHP

SEQ ID NO: 460294 - protein, 9 aa, Homo Sapiens
GISLAALKK

SEQ ID NO: 460295 - protein, 9 aa, Homo Sapiens
AAPTPESWG

SEQ ID NO: 460296 - protein, 9 aa, Homo Sapiens
NPVIYVFIN

SEQ ID NO: 460297 - protein, 9 aa, Homo Sapiens
ARLGYPTLT

SEQ ID NO: 460298 - protein, 9 aa, Homo Sapiens
ENNSLSDFQ

SEQ ID NO: 460299 - protein, 9 aa, Homo Sapiens
DPFVFYFAS

SEQ ID NO: 460300 - protein, 9 aa, Homo Sapiens
NKEEEELNQ

SEQ ID NO: 460301 - protein, 9 aa, Homo Sapiens
DRCHCCPAG

SEQ ID NO: 460302 - protein, 9 aa, Homo Sapiens
CQRNSQIYR

SEQ ID NO: 460303 - protein, 9 aa, Homo Sapiens
CYRASKFFE

SEQ ID NO: 460304 - protein, 9 aa, Homo Sapiens
EVVWPLVRL

SEQ ID NO: 460305 - protein, 9 aa, Homo Sapiens
TWVPTNSPR

SEQ ID NO: 460306 - protein, 9 aa, Homo Sapiens
FPINYMEVI

SEQ ID NO: 460307 - protein, 9 aa, Homo Sapiens
TLARNTPLH

SEQ ID NO: 460308 - protein, 9 aa, Homo Sapiens
GFDGFQGCG

SEQ ID NO: 460309 - protein, 9 aa, Homo Sapiens
FLEAVSLMS

SEQ ID NO: 460310 - protein, 9 aa, Homo Sapiens
TCQRNSQIY

SEQ ID NO: 460311 - protein, 9 aa, Homo Sapiens
ACTLSFHTL

SEQ ID NO: 460312 - protein, 9 aa, Homo Sapiens
INRQFRNCI

SEQ ID NO: 460313 - protein, 9 aa, Homo Sapiens
TSRNDCTID

SEQ ID NO: 460314 - protein, 9 aa, Homo Sapiens
DVCKIDSSA

SEQ ID NO: 460315 - protein, 9 aa, Homo Sapiens
HATDSALSK

SEQ ID NO: 460316 - protein, 9 aa, Homo Sapiens
PKPVFAAVD

SEQ ID NO: 460317 - protein, 9 aa, Homo Sapiens
VVWPLVRLL

SEQ ID NO: 460318 - protein, 9 aa, Homo Sapiens
RFMALAKQE

SEQ ID NO: 460319 - protein, 9 aa, Homo Sapiens
AQARGQLMH

SEQ ID NO: 460320 - protein, 9 aa, Homo Sapiens
AYPNTPPGR

SEQ ID NO: 460321 - protein, 9 aa, Homo Sapiens
GGYFTAIYA

SEQ ID NO: 460322 - protein, 9 aa, Homo Sapiens
TNSPRPCLR

SEQ ID NO: 460323 - protein, 9 aa, Homo Sapiens
RNLKAMDIE

SEQ ID NO: 460324 - protein, 9 aa, Homo Sapiens
CFYLEAADL

SEQ ID NO: 460325 - protein, 9 aa, Homo Sapiens
PAAAPRLHQ

SEQ ID NO: 460326 - protein, 9 aa, Homo Sapiens
VFAAVDGQE

SEQ ID NO: 460327 - protein, 9 aa, Homo Sapiens
QPSPGHRVI

SEQ ID NO: 460328 - protein, 9 aa, Homo Sapiens
GDLAAAATT

SEQ ID NO: 460329 - protein, 9 aa, Homo Sapiens
DHRSAPTDP

SEQ ID NO: 460330 - protein, 9 aa, Homo Sapiens
PSRVSESSA

SEQ ID NO: 460331 - protein, 9 aa, Homo Sapiens
NIASDDSFY

SEQ ID NO: 460332 - protein, 9 aa, Homo Sapiens
TGTFCPVPS

SEQ ID NO: 460333 - protein, 9 aa, Homo Sapiens
TPESWGAPP

SEQ ID NO: 460334 - protein, 9 aa, Homo Sapiens
AASKERSGI

SEQ ID NO: 460335 - protein, 9 aa, Homo Sapiens
LPEAGALAQ

SEQ ID NO: 460336 - protein, 9 aa, Homo Sapiens
SRHRIQSKQ

SEQ ID NO: 460337 - protein, 9 aa, Homo Sapiens
FYLEAADLS

SEQ ID NO: 460338 - protein, 9 aa, Homo Sapiens
KPLPCFLEH

SEQ ID NO: 460339 - protein, 9 aa, Homo Sapiens
FYTVSATPP

SEQ ID NO: 460340 - protein, 9 aa, Homo Sapiens
MGLNVLRII

SEQ ID NO: 460341 - protein, 9 aa, Homo Sapiens
ELIKRPNNP

SEQ ID NO: 460342 - protein, 9 aa, Homo Sapiens
RNIASDDSF

SEQ ID NO: 460343 - protein, 9 aa, Homo Sapiens
QEITKQMLP

SEQ ID NO: 460344 - protein, 9 aa, Homo Sapiens
LSLFLAWRL

SEQ ID NO: 460345 - protein, 9 aa, Homo Sapiens
IHVTSPQVK

SEQ ID NO: 460346 - protein, 9 aa, Homo Sapiens
TGMTHIVRE

SEQ ID NO: 460347 - protein, 9 aa, Homo Sapiens
VVIPVCRPA

SEQ ID NO: 460348 - protein, 9 aa, Homo Sapiens
QLVEKSVEL

SEQ ID NO: 460349 - protein, 9 aa, Homo Sapiens
LPLSPSTDF

SEQ ID NO: 460350 - protein, 9 aa, Homo Sapiens
PAVPRSSRR

SEQ ID NO: 460351 - protein, 9 aa, Homo Sapiens
VAVERFKEY

SEQ ID NO: 460352 - protein, 9 aa, Homo Sapiens
PVWILLCGL

SEQ ID NO: 460353 - protein, 9 aa, Homo Sapiens
RLSSVLQRF

SEQ ID NO: 460354 - protein, 9 aa, Homo Sapiens
FARDPRFMA

SEQ ID NO: 460355 - protein, 9 aa, Homo Sapiens
LALLSCIVP

SEQ ID NO: 460356 - protein, 9 aa, Homo Sapiens
GACTLSFHT

SEQ ID NO: 460357 - protein, 9 aa, Homo Sapiens
RGYYRLEVN

SEQ ID NO: 460358 - protein, 9 aa, Homo Sapiens
AAVPACGPQ

SEQ ID NO: 460359 - protein, 9 aa, Homo Sapiens
LAGDLAAAA

SEQ ID NO: 460360 - protein, 9 aa, Homo Sapiens
EKTSQEPEI

SEQ ID NO: 460361 - protein, 9 aa, Homo Sapiens
GLPLSPSTD

SEQ ID NO: 460362 - protein, 9 aa, Homo Sapiens
TDPQGVESF

SEQ ID NO: 460363 - protein, 9 aa, Homo Sapiens
AMGIEDSEL

SEQ ID NO: 460364 - protein, 9 aa, Homo Sapiens
NGLGPGLLS

SEQ ID NO: 460365 - protein, 9 aa, Homo Sapiens
VPRSSRRRR

SEQ ID NO: 460366 - protein, 9 aa, Homo Sapiens
PRPASHDAA

SEQ ID NO: 460367 - protein, 9 aa, Homo Sapiens
LGQWTATAE

SEQ ID NO: 460368 - protein, 9 aa, Homo Sapiens
KMAMGIEDS

SEQ ID NO: 460369 - protein, 9 aa, Homo Sapiens
DFYTFNSLK

SEQ ID NO: 460370 - protein, 9 aa, Homo Sapiens
LFHLGLELC

SEQ ID NO: 460371 - protein, 9 aa, Homo Sapiens
MNAEEYSLR

SEQ ID NO: 460372 - protein, 9 aa, Homo Sapiens
WNELKVVIP

SEQ ID NO: 460373 - protein, 9 aa, Homo Sapiens
DYPSLFQIY

SEQ ID NO: 460374 - protein, 9 aa, Homo Sapiens
VIHVTSPQV

SEQ ID NO: 460375 - protein, 9 aa, Homo Sapiens
QAGSCRLEL

SEQ ID NO: 460376 - protein, 9 aa, Homo Sapiens
RLWNEVQIK

SEQ ID NO: 460377 - protein, 9 aa, Homo Sapiens
PVFAAVDGQ

SEQ ID NO: 460378 - protein, 9 aa, Homo Sapiens
VNAKDTCDS

SEQ ID NO: 460379 - protein, 9 aa, Homo Sapiens
YRLEVNAKD

SEQ ID NO: 460380 - protein, 9 aa, Homo Sapiens
RTPAVPRSS

SEQ ID NO: 460381 - protein, 9 aa, Homo Sapiens
RVRWEERVF

SEQ ID NO: 460382 - protein, 9 aa, Homo Sapiens
PSEQLPPAS

SEQ ID NO: 460383 - protein, 9 aa, Homo Sapiens
KTSQEPEIN

SEQ ID NO: 460384 - protein, 9 aa, Homo Sapiens
TAGVCPHAS

SEQ ID NO: 460385 - protein, 9 aa, Homo Sapiens
LVQAVPQLV

SEQ ID NO: 460386 - protein, 9 aa, Homo Sapiens
KHLVGGLHR

SEQ ID NO: 460387 - protein, 9 aa, Homo Sapiens
HPALDGQRD

SEQ ID NO: 460388 - protein, 9 aa, Homo Sapiens
QRDKCWCVD

SEQ ID NO: 460389 - protein, 9 aa, Homo Sapiens
CPNWNHSSP

SEQ ID NO: 460390 - protein, 9 aa, Homo Sapiens
PGILTRCVN

SEQ ID NO: 460391 - protein, 9 aa, Homo Sapiens
INSLFYSRG

SEQ ID NO: 460392 - protein, 9 aa, Homo Sapiens
GYDEVCRVT

SEQ ID NO: 460393 - protein, 9 aa, Homo Sapiens
HASEQPTHA

SEQ ID NO: 460394 - protein, 9 aa, Homo Sapiens
MHIEFKKIV

SEQ ID NO: 460395 - protein, 9 aa, Homo Sapiens
ALRDFSISE

SEQ ID NO: 460396 - protein, 9 aa, Homo Sapiens
PRVRWEERV

SEQ ID NO: 460397 - protein, 9 aa, Homo Sapiens
RYVFYWRDY

SEQ ID NO: 460398 - protein, 9 aa, Homo Sapiens
KDPNHVSLS

SEQ ID NO: 460399 - protein, 9 aa, Homo Sapiens
PRGPDRHAA

SEQ ID NO: 460400 - protein, 9 aa, Homo Sapiens
YFTAIYADE

SEQ ID NO: 460401 - protein, 9 aa, Homo Sapiens
NLSSMTRTD

SEQ ID NO: 460402 - protein, 9 aa, Homo Sapiens
IEGTSDPYV

SEQ ID NO: 460403 - protein, 9 aa, Homo Sapiens
ADINGLRRE

SEQ ID NO: 460404 - protein, 9 aa, Homo Sapiens
LDSDKGSLS

SEQ ID NO: 460405 - protein, 9 aa, Homo Sapiens
LHLAARLGY

SEQ ID NO: 460406 - protein, 9 aa, Homo Sapiens
TDSALSKPT

SEQ ID NO: 460407 - protein, 9 aa, Homo Sapiens
VALGKPQLD

SEQ ID NO: 460408 - protein, 9 aa, Homo Sapiens
VLGLTKRCL

SEQ ID NO: 460409 - protein, 9 aa, Homo Sapiens
CHPPPAAAP

SEQ ID NO: 460410 - protein, 9 aa, Homo Sapiens
QLVLFHLGL

SEQ ID NO: 460411 - protein, 9 aa, Homo Sapiens
SGGCHALFF

SEQ ID NO: 460412 - protein, 9 aa, Homo Sapiens
VIYVFINRQ

SEQ ID NO: 460413 - protein, 9 aa, Homo Sapiens
VAQAGSCRL

SEQ ID NO: 460414 - protein, 9 aa, Homo Sapiens
VCKIDSSAI

SEQ ID NO: 460415 - protein, 9 aa, Homo Sapiens
SENSQPEKT

SEQ ID NO: 460416 - protein, 9 aa, Homo Sapiens
LLGGIILSF

SEQ ID NO: 460417 - protein, 9 aa, Homo Sapiens
VDIYTVKME

SEQ ID NO: 460418 - protein, 9 aa, Homo Sapiens
RNTKHDVTL

SEQ ID NO: 460419 - protein, 9 aa, Homo Sapiens
GHRVILYPS

SEQ ID NO: 460420 - protein, 9 aa, Homo Sapiens
IPVCRPAAE

SEQ ID NO: 460421 - protein, 9 aa, Homo Sapiens
LLWVLTDSH

SEQ ID NO: 460422 - protein, 9 aa, Homo Sapiens
PVALGKPQL

SEQ ID NO: 460423 - protein, 9 aa, Homo Sapiens
HWVVPVPRL

SEQ ID NO: 460424 - protein, 9 aa, Homo Sapiens
SAGSLCRRR

SEQ ID NO: 460425 - protein, 9 aa, Homo Sapiens
RKKAKSGSP

SEQ ID NO: 460426 - protein, 9 aa, Homo Sapiens
ALGKPQLDL

SEQ ID NO: 460427 - protein, 9 aa, Homo Sapiens
LLNKEEEEL

SEQ ID NO: 460428 - protein, 9 aa, Homo Sapiens
WGACTLSFH

SEQ ID NO: 460429 - protein, 9 aa, Homo Sapiens
RASKFFEAQ

SEQ ID NO: 460430 - protein, 9 aa, Homo Sapiens
HRPQSQEQI

SEQ ID NO: 460431 - protein, 9 aa, Homo Sapiens
LCPSGAVEL

SEQ ID NO: 460432 - protein, 9 aa, Homo Sapiens
FASRYVFYW

SEQ ID NO: 460433 - protein, 9 aa, Homo Sapiens
FSISEVNQM

SEQ ID NO: 460434 - protein, 9 aa, Homo Sapiens
GVWKSDPKS

SEQ ID NO: 460435 - protein, 9 aa, Homo Sapiens
RGSHADTHI

SEQ ID NO: 460436 - protein, 9 aa, Homo Sapiens
RTIDYEAIQ

SEQ ID NO: 460437 - protein, 9 aa, Homo Sapiens
EQLPPASRC

SEQ ID NO: 460438 - protein, 9 aa, Homo Sapiens
KRTVLQGYE

SEQ ID NO: 460439 - protein, 9 aa, Homo Sapiens
LHQHGPCYP

SEQ ID NO: 460440 - protein, 9 aa, Homo Sapiens
QHGPCYPGP

SEQ ID NO: 460441 - protein, 9 aa, Homo Sapiens
RELDELTLT

SEQ ID NO: 460442 - protein, 9 aa, Homo Sapiens
QEEISKVEK

SEQ ID NO: 460443 - protein, 9 aa, Homo Sapiens
QPSAVPRPA

SEQ ID NO: 460444 - protein, 9 aa, Homo Sapiens
GVCCADRCH

SEQ ID NO: 460445 - protein, 9 aa, Homo Sapiens
SGPRVRWEE

SEQ ID NO: 460446 - protein, 9 aa, Homo Sapiens
QAEKVDRLW

SEQ ID NO: 460447 - protein, 9 aa, Homo Sapiens
CQDFPVSYK

SEQ ID NO: 460448 - protein, 9 aa, Homo Sapiens
SFLEAVSLM

SEQ ID NO: 460449 - protein, 9 aa, Homo Sapiens
NAKDTCDSC

SEQ ID NO: 460450 - protein, 9 aa, Homo Sapiens
VKAGPVKFE

SEQ ID NO: 460451 - protein, 9 aa, Homo Sapiens
LSVGRRHPP

SEQ ID NO: 460452 - protein, 9 aa, Homo Sapiens
WDHGTTHQC

SEQ ID NO: 460453 - protein, 9 aa, Homo Sapiens
GFFPINYME

SEQ ID NO: 460454 - protein, 9 aa, Homo Sapiens
TVDKYHTLY

SEQ ID NO: 460455 - protein, 9 aa, Homo Sapiens
SIPFRSACA

SEQ ID NO: 460456 - protein, 9 aa, Homo Sapiens
RRGAPEWGA

SEQ ID NO: 460457 - protein, 9 aa, Homo Sapiens
FPQVEKAEL

SEQ ID NO: 460458 - protein, 9 aa, Homo Sapiens
RNTPLHWLW

SEQ ID NO: 460459 - protein, 9 aa, Homo Sapiens
VMDGFQFSP

SEQ ID NO: 460460 - protein, 9 aa, Homo Sapiens
QEPCVTEHR

SEQ ID NO: 460461 - protein, 9 aa, Homo Sapiens
PPGRRPYAL

SEQ ID NO: 460462 - protein, 9 aa, Homo Sapiens
PLSPSTDFY

SEQ ID NO: 460463 - protein, 9 aa, Homo Sapiens
TAFLGYKTG

SEQ ID NO: 460464 - protein, 9 aa, Homo Sapiens
ATDSALSKP

SEQ ID NO: 460465 - protein, 9 aa, Homo Sapiens
QKPVSKMVA

SEQ ID NO: 460466 - protein, 9 aa, Homo Sapiens
LSSPSLNST

SEQ ID NO: 460467 - protein, 9 aa, Homo Sapiens
MVTHNQVAA

SEQ ID NO: 460468 - protein, 9 aa, Homo Sapiens
ESTRNGLGP

SEQ ID NO: 460469 - protein, 9 aa, Homo Sapiens
SFCSNFCYR

SEQ ID NO: 460470 - protein, 9 aa, Homo Sapiens
PQSCPASGG

SEQ ID NO: 460471 - protein, 9 aa, Homo Sapiens
TRCVNDAAI

SEQ ID NO: 460472 - protein, 9 aa, Homo Sapiens
GSPPAPGDA

SEQ ID NO: 460473 - protein, 9 aa, Homo Sapiens
ALGCKDPNH

SEQ ID NO: 460474 - protein, 9 aa, Homo Sapiens
PDRHAALSA

SEQ ID NO: 460475 - protein, 9 aa, Homo Sapiens
VTSPQVKAG

SEQ ID NO: 460476 - protein, 9 aa, Homo Sapiens
QRHLHESCV

SEQ ID NO: 460477 - protein, 9 aa, Homo Sapiens
SGQMMYFAP

SEQ ID NO: 460478 - protein, 9 aa, Homo Sapiens
HQHGPCYPG

SEQ ID NO: 460479 - protein, 9 aa, Homo Sapiens
EKVDRLWNE

SEQ ID NO: 460480 - protein, 9 aa, Homo Sapiens
ERGSLSAGS

SEQ ID NO: 460481 - protein, 9 aa, Homo Sapiens
FWGKAAKQI

SEQ ID NO: 460482 - protein, 9 aa, Homo Sapiens
EAESMPPPK

SEQ ID NO: 460483 - protein, 9 aa, Homo Sapiens
GPQSCPASG

SEQ ID NO: 460484 - protein, 9 aa, Homo Sapiens
GVPKPVFAA

SEQ ID NO: 460485 - protein, 9 aa, Homo Sapiens
DRLWNEVQI

SEQ ID NO: 460486 - protein, 9 aa, Homo Sapiens
PAAAGYHAY

SEQ ID NO: 460487 - protein, 9 aa, Homo Sapiens
FQIYVRTHT

SEQ ID NO: 460488 - protein, 9 aa, Homo Sapiens
HVSGQMMYF

SEQ ID NO: 460489 - protein, 9 aa, Homo Sapiens
PQLKSLETS

SEQ ID NO: 460490 - protein, 9 aa, Homo Sapiens
DSSHHVILG

SEQ ID NO: 460491 - protein, 9 aa, Homo Sapiens
QVEKAELDL

SEQ ID NO: 460492 - protein, 9 aa, Homo Sapiens
CVCHPPPAA

SEQ ID NO: 460493 - protein, 9 aa, Homo Sapiens
IPFRSACAA

SEQ ID NO: 460494 - protein, 9 aa, Homo Sapiens
AAGYHAYWK

SEQ ID NO: 460495 - protein, 9 aa, Homo Sapiens
LMDQNASSL

SEQ ID NO: 460496 - protein, 9 aa, Homo Sapiens
VDFYTFNSL

SEQ ID NO: 460497 - protein, 9 aa, Homo Sapiens
TSICPRTTS

SEQ ID NO: 460498 - protein, 9 aa, Homo Sapiens
EQSLLKKLH

SEQ ID NO: 460499 - protein, 9 aa, Homo Sapiens
SSLPDTRNI

SEQ ID NO: 460500 - protein, 9 aa, Homo Sapiens
EIKMAMGIE

SEQ ID NO: 460501 - protein, 9 aa, Homo Sapiens
EISKVEKRA

SEQ ID NO: 460502 - protein, 9 aa, Homo Sapiens
MRSEMVRRE

SEQ ID NO: 460503 - protein, 9 aa, Homo Sapiens
KYLCTSRND

SEQ ID NO: 460504 - protein, 9 aa, Homo Sapiens
LNQQRVFTG

SEQ ID NO: 460505 - protein, 9 aa, Homo Sapiens
YPNTPPGRR

SEQ ID NO: 460506 - protein, 9 aa, Homo Sapiens
ARRRNPQMR

SEQ ID NO: 460507 - protein, 9 aa, Homo Sapiens
VSHLSTYSL

SEQ ID NO: 460508 - protein, 9 aa, Homo Sapiens
LIDGSSRVG

SEQ ID NO: 460509 - protein, 9 aa, Homo Sapiens
PRPCLRSLH

SEQ ID NO: 460510 - protein, 9 aa, Homo Sapiens
NYMEVIVPL

SEQ ID NO: 460511 - protein, 9 aa, Homo Sapiens
IALGCKDPN

SEQ ID NO: 460512 - protein, 9 aa, Homo Sapiens
SSLQQMVLR

SEQ ID NO: 460513 - protein, 9 aa, Homo Sapiens
HWKNCLTKP

SEQ ID NO: 460514 - protein, 9 aa, Homo Sapiens
SHSSSHVVH

SEQ ID NO: 460515 - protein, 9 aa, Homo Sapiens
EQIHGQAGS

SEQ ID NO: 460516 - protein, 9 aa, Homo Sapiens
MAESTRNGL

SEQ ID NO: 460517 - protein, 9 aa, Homo Sapiens
SNFCYRASK

SEQ ID NO: 460518 - protein, 9 aa, Homo Sapiens
RGSLSAGSL

SEQ ID NO: 460519 - protein, 9 aa, Homo Sapiens
SMPPPKTSA

SEQ ID NO: 460520 - protein, 9 aa, Homo Sapiens
SICTSTNSQ

SEQ ID NO: 460521 - protein, 9 aa, Homo Sapiens
IELIKRPNN

SEQ ID NO: 460522 - protein, 9 aa, Homo Sapiens
WPLVRLLDT

SEQ ID NO: 460523 - protein, 9 aa, Homo Sapiens
MSIPFRSAC

SEQ ID NO: 460524 - protein, 9 aa, Homo Sapiens
TIMGLNVLR

SEQ ID NO: 460525 - protein, 9 aa, Homo Sapiens
CPPAAAGYH

SEQ ID NO: 460526 - protein, 9 aa, Homo Sapiens
LSAGSLCRR

SEQ ID NO: 460527 - protein, 9 aa, Homo Sapiens
PLCPSGAVE

SEQ ID NO: 460528 - protein, 9 aa, Homo Sapiens
KPAAVPACG

SEQ ID NO: 460529 - protein, 9 aa, Homo Sapiens
RGCWPASGG

SEQ ID NO: 460530 - protein, 9 aa, Homo Sapiens
QEQIHGQAG

SEQ ID NO: 460531 - protein, 9 aa, Homo Sapiens
FRSACAASK

SEQ ID NO: 460532 - protein, 9 aa, Homo Sapiens
LCCATPAHA

SEQ ID NO: 460533 - protein, 9 aa, Homo Sapiens
PPSSRPSSH

SEQ ID NO: 460534 - protein, 9 aa, Homo Sapiens
PPSPLCHCS

SEQ ID NO: 460535 - protein, 9 aa, Homo Sapiens
CLLYSSICT

SEQ ID NO: 460536 - protein, 9 aa, Homo Sapiens
MYFAPDLIL

SEQ ID NO: 460537 - protein, 9 aa, Homo Sapiens
PAAGRRGCW

SEQ ID NO: 460538 - protein, 9 aa, Homo Sapiens
LKSLETSIC

SEQ ID NO: 460539 - protein, 9 aa, Homo Sapiens
NHFLGRACF

SEQ ID NO: 460540 - protein, 9 aa, Homo Sapiens
ESMPPPKTS

SEQ ID NO: 460541 - protein, 9 aa, Homo Sapiens
RKHHPWQLD

SEQ ID NO: 460542 - protein, 9 aa, Homo Sapiens
TIPSLAAPQ

SEQ ID NO: 460543 - protein, 9 aa, Homo Sapiens
HSSPAPSPW

SEQ ID NO: 460544 - protein, 9 aa, Homo Sapiens
LWEKRTVLQ

SEQ ID NO: 460545 - protein, 9 aa, Homo Sapiens
KTSASSVSL

SEQ ID NO: 460546 - protein, 9 aa, Homo Sapiens
RAAYPPSPL

SEQ ID NO: 460547 - protein, 9 aa, Homo Sapiens
QMMYFAPDL

SEQ ID NO: 460548 - protein, 9 aa, Homo Sapiens
NSLYIENNS

SEQ ID NO: 460549 - protein, 9 aa, Homo Sapiens
VICFYLEAA

SEQ ID NO: 460550 - protein, 9 aa, Homo Sapiens
VSVSDIPKG

SEQ ID NO: 460551 - protein, 9 aa, Homo Sapiens
DFPVSYKCK

SEQ ID NO: 460552 - protein, 9 aa, Homo Sapiens
GSHADTHIQ

SEQ ID NO: 460553 - protein, 9 aa, Homo Sapiens
RNSQIYRAM

SEQ ID NO: 460554 - protein, 9 aa, Homo Sapiens
RPLLEVVRQ

SEQ ID NO: 460555 - protein, 9 aa, Homo Sapiens
SVSDIPKGV

SEQ ID NO: 460556 - protein, 9 aa, Homo Sapiens
GGIILSFAK

SEQ ID NO: 460557 - protein, 9 aa, Homo Sapiens
EDRHPLPKE

SEQ ID NO: 460558 - protein, 9 aa, Homo Sapiens
EEELNQQRV

SEQ ID NO: 460559 - protein, 9 aa, Homo Sapiens
PTDPQGVES

SEQ ID NO: 460560 - protein, 9 aa, Homo Sapiens
KEQSLLKKL

SEQ ID NO: 460561 - protein, 9 aa, Homo Sapiens
VWPLVRLLD

SEQ ID NO: 460562 - protein, 9 aa, Homo Sapiens
SLMDAVDCQ

SEQ ID NO: 460563 - protein, 9 aa, Homo Sapiens
SICPRTTSL

SEQ ID NO: 460564 - protein, 9 aa, Homo Sapiens
AGVCPHASE

SEQ ID NO: 460565 - protein, 9 aa, Homo Sapiens
SSHVVHGED

SEQ ID NO: 460566 - protein, 9 aa, Homo Sapiens
PVSHLSTYS

SEQ ID NO: 460567 - protein, 9 aa, Homo Sapiens
TPLHLAARL

SEQ ID NO: 460568 - protein, 9 aa, Homo Sapiens
LTAGVCPHA

SEQ ID NO: 460569 - protein, 9 aa, Homo Sapiens
LYPSVPFCR

SEQ ID NO: 460570 - protein, 9 aa, Homo Sapiens
LYALRTIDY

SEQ ID NO: 460571 - protein, 9 aa, Homo Sapiens
SSRVGDSNF

SEQ ID NO: 460572 - protein, 9 aa, Homo Sapiens
SPPAPGDAA

SEQ ID NO: 460573 - protein, 9 aa, Homo Sapiens
FMALAKQEI

SEQ ID NO: 460574 - protein, 9 aa, Homo Sapiens
ERSGISLAA

SEQ ID NO: 460575 - protein, 9 aa, Homo Sapiens
AATIPSLAA

SEQ ID NO: 460576 - protein, 9 aa, Homo Sapiens
EEYSLRNGG

SEQ ID NO: 460577 - protein, 9 aa, Homo Sapiens
GPSHSSLSV

SEQ ID NO: 460578 - protein, 9 aa, Homo Sapiens
VILYPSVPF

SEQ ID NO: 460579 - protein, 9 aa, Homo Sapiens
YMEVIVPLP

SEQ ID NO: 460580 - protein, 9 aa, Homo Sapiens
EKRTVLQGY

SEQ ID NO: 460581 - protein, 9 aa, Homo Sapiens
YWSKTCTQK

SEQ ID NO: 460582 - protein, 9 aa, Homo Sapiens
KHSSQSVHM

SEQ ID NO: 460583 - protein, 9 aa, Homo Sapiens
MDQNASSLT

SEQ ID NO: 460584 - protein, 9 aa, Homo Sapiens
HTAPCPPAA

SEQ ID NO: 460585 - protein, 9 aa, Homo Sapiens
PKTSASSVS

SEQ ID NO: 460586 - protein, 9 aa, Homo Sapiens
VSRIGSLEF

SEQ ID NO: 460587 - protein, 9 aa, Homo Sapiens
SKPTLSIQH

SEQ ID NO: 460588 - protein, 9 aa, Homo Sapiens
IQCKHDPFA

SEQ ID NO: 460589 - protein, 9 aa, Homo Sapiens
MPPPKTSAS

SEQ ID NO: 460590 - protein, 9 aa, Homo Sapiens
VPACGPQSC

SEQ ID NO: 460591 - protein, 9 aa, Homo Sapiens
ALSLFLAWR

SEQ ID NO: 460592 - protein, 9 aa, Homo Sapiens
IYVFINRQF

SEQ ID NO: 460593 - protein, 9 aa, Homo Sapiens
DAAAPTPES

SEQ ID NO: 460594 - protein, 9 aa, Homo Sapiens
CHCSPVLPT

SEQ ID NO: 460595 - protein, 9 aa, Homo Sapiens
LRPLALLSC

SEQ ID NO: 460596 - protein, 9 aa, Homo Sapiens
TVPTPACPY

SEQ ID NO: 460597 - protein, 9 aa, Homo Sapiens
LIKRPNNPP

SEQ ID NO: 460598 - protein, 9 aa, Homo Sapiens
NEAIAKKNA

SEQ ID NO: 460599 - protein, 9 aa, Homo Sapiens
SLNSTVPTP

SEQ ID NO: 460600 - protein, 9 aa, Homo Sapiens
KKNVDYSIL

SEQ ID NO: 460601 - protein, 9 aa, Homo Sapiens
MYDQNHFLG

SEQ ID NO: 460602 - protein, 9 aa, Homo Sapiens
LRDFSISEV

SEQ ID NO: 460603 - protein, 9 aa, Homo Sapiens
CHCCPAGFR

SEQ ID NO: 460604 - protein, 9 aa, Homo Sapiens
VIQQRMESQ

SEQ ID NO: 460605 - protein, 9 aa, Homo Sapiens
AHGPLPLTA

SEQ ID NO: 460606 - protein, 9 aa, Homo Sapiens
QIHGQAGSQ

SEQ ID NO: 460607 - protein, 9 aa, Homo Sapiens
PSSHSSSHV

SEQ ID NO: 460608 - protein, 9 aa, Homo Sapiens
DAIFLTTRL

SEQ ID NO: 460609 - protein, 9 aa, Homo Sapiens
HCSPVLPTP

SEQ ID NO: 460610 - protein, 9 aa, Homo Sapiens
PFPQVEKAE

SEQ ID NO: 460611 - protein, 9 aa, Homo Sapiens
VPTYPETPW

SEQ ID NO: 460612 - protein, 9 aa, Homo Sapiens
AGRRGCWPA

SEQ ID NO: 460613 - protein, 9 aa, Homo Sapiens
YTVSATPPL

SEQ ID NO: 460614 - protein, 9 aa, Homo Sapiens
DLAAAATTP

SEQ ID NO: 460615 - protein, 9 aa, Homo Sapiens
AIRDRNEAI

SEQ ID NO: 460616 - protein, 9 aa, Homo Sapiens
SHHVILGTQ

SEQ ID NO: 460617 - protein, 9 aa, Homo Sapiens
ATKDAGTIM

SEQ ID NO: 460618 - protein, 9 aa, Homo Sapiens
DSHTAQGYD

SEQ ID NO: 460619 - protein, 9 aa, Homo Sapiens
VYYKPISSV

SEQ ID NO: 460620 - protein, 9 aa, Homo Sapiens
QSLLKKLHQ

SEQ ID NO: 460621 - protein, 9 aa, Homo Sapiens
NTKHDVTLE

SEQ ID NO: 460622 - protein, 9 aa, Homo Sapiens
PVSKMVAKV

SEQ ID NO: 460623 - protein, 9 aa, Homo Sapiens
EKNDEMRSE

SEQ ID NO: 460624 - protein, 9 aa, Homo Sapiens
DYQVIRMPV

SEQ ID NO: 460625 - protein, 9 aa, Homo Sapiens
RLQNISEDV

SEQ ID NO: 460626 - protein, 9 aa, Homo Sapiens
ELMDQNASS

SEQ ID NO: 460627 - protein, 9 aa, Homo Sapiens
PEWGACTLS

SEQ ID NO: 460628 - protein, 9 aa, Homo Sapiens
ADLSKETDL

SEQ ID NO: 460629 - protein, 9 aa, Homo Sapiens
TTLLFQKQC

SEQ ID NO: 460630 - protein, 9 aa, Homo Sapiens
AIFLTTRLQ

SEQ ID NO: 460631 - protein, 9 aa, Homo Sapiens
LSLGSVFSP

SEQ ID NO: 460632 - protein, 9 aa, Homo Sapiens
HPLQPSAVP

SEQ ID NO: 460633 - protein, 9 aa, Homo Sapiens
THNQVAADN

SEQ ID NO: 460634 - protein, 9 aa, Homo Sapiens
QWTATAESV

SEQ ID NO: 460635 - protein, 9 aa, Homo Sapiens
AAAPTPESW

SEQ ID NO: 460636 - protein, 9 aa, Homo Sapiens
ATGTFCPVP

SEQ ID NO: 460637 - protein, 9 aa, Homo Sapiens
PRAEVSRIG

SEQ ID NO: 460638 - protein, 9 aa, Homo Sapiens
FGIWSEGVD

SEQ ID NO: 460639 - protein, 9 aa, Homo Sapiens
KTTSTTLRY

SEQ ID NO: 460640 - protein, 9 aa, Homo Sapiens
YIHQLAIHL

SEQ ID NO: 460641 - protein, 9 aa, Homo Sapiens
LMDAVDCQE

SEQ ID NO: 460642 - protein, 9 aa, Homo Sapiens
EIHKTFNIK

SEQ ID NO: 460643 - protein, 9 aa, Homo Sapiens
TLKKNVDYS

SEQ ID NO: 460644 - protein, 9 aa, Homo Sapiens
QPTHADVGQ

SEQ ID NO: 460645 - protein, 9 aa, Homo Sapiens
ALRTIDYEA

SEQ ID NO: 460646 - protein, 9 aa, Homo Sapiens
FCRAAYPPS

SEQ ID NO: 460647 - protein, 9 aa, Homo Sapiens
EYVYINSLF

SEQ ID NO: 460648 - protein, 9 aa, Homo Sapiens
NGNKVENLI

SEQ ID NO: 460649 - protein, 9 aa, Homo Sapiens
EGKQKYLCT

SEQ ID NO: 460650 - protein, 9 aa, Homo Sapiens
PLLEVVRQR

SEQ ID NO: 460651 - protein, 9 aa, Homo Sapiens
SRIGSLEFL

SEQ ID NO: 460652 - protein, 9 aa, Homo Sapiens
SKERSGISL

SEQ ID NO: 460653 - protein, 9 aa, Homo Sapiens
ATPAHALQC

SEQ ID NO: 460654 - protein, 9 aa, Homo Sapiens
DPNHVSLSS

SEQ ID NO: 460655 - protein, 9 aa, Homo Sapiens
QDAATIPSL

SEQ ID NO: 460656 - protein, 9 aa, Homo Sapiens
TAESVPPRG

SEQ ID NO: 460657 - protein, 9 aa, Homo Sapiens
RDFSISEVN

SEQ ID NO: 460658 - protein, 9 aa, Homo Sapiens
DGSSRVGDS

SEQ ID NO: 460659 - protein, 9 aa, Homo Sapiens
VMLNRISSN

SEQ ID NO: 460660 - protein, 9 aa, Homo Sapiens
MLNRISSNM

SEQ ID NO: 460661 - protein, 9 aa, Homo Sapiens
TMLNSPLFT

SEQ ID NO: 460662 - protein, 9 aa, Homo Sapiens
APTDPQGVE

SEQ ID NO: 460663 - protein, 9 aa, Homo Sapiens
QSQEQIHGQ

SEQ ID NO: 460664 - protein, 9 aa, Homo Sapiens
VPPRGPDRH

SEQ ID NO: 460665 - protein, 9 aa, Homo Sapiens
KIPFPQVEK

SEQ ID NO: 460666 - protein, 9 aa, Homo Sapiens
GQMMYFAPD

SEQ ID NO: 460667 - protein, 9 aa, Homo Sapiens
MVGGPSISP

SEQ ID NO: 460668 - protein, 9 aa, Homo Sapiens
VELLALQKE

SEQ ID NO: 460669 - protein, 9 aa, Homo Sapiens
HLAARLGYP

SEQ ID NO: 460670 - protein, 9 aa, Homo Sapiens
SGGLAGDLA

SEQ ID NO: 460671 - protein, 9 aa, Homo Sapiens
QGYDEVCRV

SEQ ID NO: 460672 - protein, 9 aa, Homo Sapiens
MFDRNTKHD

SEQ ID NO: 460673 - protein, 9 aa, Homo Sapiens
ARDPRFMAL

SEQ ID NO: 460674 - protein, 9 aa, Homo Sapiens
CTLSFHTLT

SEQ ID NO: 460675 - protein, 9 aa, Homo Sapiens
PRRGAPEWG

SEQ ID NO: 460676 - protein, 9 aa, Homo Sapiens
GPRVRWEER

SEQ ID NO: 460677 - protein, 9 aa, Homo Sapiens
LGYKTGMTH

SEQ ID NO: 460678 - protein, 9 aa, Homo Sapiens
AADLSKETD

SEQ ID NO: 460679 - protein, 9 aa, Homo Sapiens
PRRAVLSLG

SEQ ID NO: 460680 - protein, 9 aa, Homo Sapiens
KVVIPVCRP

SEQ ID NO: 460681 - protein, 9 aa, Homo Sapiens
IKMAMGIED

SEQ ID NO: 460682 - protein, 9 aa, Homo Sapiens
TIDYEAIQD

SEQ ID NO: 460683 - protein, 9 aa, Homo Sapiens
ATLARNTPL

SEQ ID NO: 460684 - protein, 9 aa, Homo Sapiens
PSVATEGLS

SEQ ID NO: 460685 - protein, 9 aa, Homo Sapiens
LLKYWSKTC

SEQ ID NO: 460686 - protein, 9 aa, Homo Sapiens
HAEVYYKPI

SEQ ID NO: 460687 - protein, 9 aa, Homo Sapiens
SEGVDGTDI

SEQ ID NO: 460688 - protein, 9 aa, Homo Sapiens
APTPESWGA

SEQ ID NO: 460689 - protein, 9 aa, Homo Sapiens
CFISLMNTL

SEQ ID NO: 460690 - protein, 9 aa, Homo Sapiens
ESFLEAVSL

SEQ ID NO: 460691 - protein, 9 aa, Homo Sapiens
WNHSSPAPS

SEQ ID NO: 460692 - protein, 9 aa, Homo Sapiens
SQEQIHGQA

SEQ ID NO: 460693 - protein, 9 aa, Homo Sapiens
AAAPRLHQH

SEQ ID NO: 460694 - protein, 9 aa, Homo Sapiens
LLEASIETG

SEQ ID NO: 460695 - protein, 9 aa, Homo Sapiens
YGPLCPSGA

SEQ ID NO: 460696 - protein, 9 aa, Homo Sapiens
RHPLPKEAP

SEQ ID NO: 460697 - protein, 9 aa, Homo Sapiens
WNKLLEASI

SEQ ID NO: 460698 - protein, 9 aa, Homo Sapiens
VTHNQVAAD

SEQ ID NO: 460699 - protein, 9 aa, Homo Sapiens
FSPRNSWHE

SEQ ID NO: 460700 - protein, 9 aa, Homo Sapiens
WRLSSVLQR

SEQ ID NO: 460701 - protein, 9 aa, Homo Sapiens
SFHTLTLPL

SEQ ID NO: 460702 - protein, 9 aa, Homo Sapiens
PSVPFCRAA

SEQ ID NO: 460703 - protein, 9 aa, Homo Sapiens
AVPRSSRRR

SEQ ID NO: 460704 - protein, 9 aa, Homo Sapiens
PSPVWILLC

SEQ ID NO: 460705 - protein, 9 aa, Homo Sapiens
SDQHQPAAG

SEQ ID NO: 460706 - protein, 9 aa, Homo Sapiens
PASGGCHAL

SEQ ID NO: 460707 - protein, 9 aa, Homo Sapiens
TKPDKYQRH

SEQ ID NO: 460708 - protein, 9 aa, Homo Sapiens
PTPESWGAP

SEQ ID NO: 460709 - protein, 9 aa, Homo Sapiens
RRELDELTL

SEQ ID NO: 460710 - protein, 9 aa, Homo Sapiens
GPLCPSGAV

SEQ ID NO: 460711 - protein, 9 aa, Homo Sapiens
ISKVEKRAT

SEQ ID NO: 460712 - protein, 9 aa, Homo Sapiens
LHRVYTKLK

SEQ ID NO: 460713 - protein, 9 aa, Homo Sapiens
SPSLNSTVP

SEQ ID NO: 460714 - protein, 9 aa, Homo Sapiens
PPRGPDRHA

SEQ ID NO: 460715 - protein, 9 aa, Homo Sapiens
FTHVIQQRM

SEQ ID NO: 460716 - protein, 9 aa, Homo Sapiens
GTIMGLNVL

SEQ ID NO: 460717 - protein, 9 aa, Homo Sapiens
LVEKSVELL

SEQ ID NO: 460718 - protein, 9 aa, Homo Sapiens
WSKTCTQKE

SEQ ID NO: 460719 - protein, 9 aa, Homo Sapiens
PGDAAAPTP

SEQ ID NO: 460720 - protein, 9 aa, Homo Sapiens
YFQQATHQL

SEQ ID NO: 460721 - protein, 9 aa, Homo Sapiens
SRSVALSLF

SEQ ID NO: 460722 - protein, 9 aa, Homo Sapiens
AGTIMGLNV

SEQ ID NO: 460723 - protein, 9 aa, Homo Sapiens
IIMYDQNHF

SEQ ID NO: 460724 - protein, 9 aa, Homo Sapiens
YSSICTSTN

SEQ ID NO: 460725 - protein, 9 aa, Homo Sapiens
GPLPLTAGV

SEQ ID NO: 460726 - protein, 9 aa, Homo Sapiens
ATAESVPPR

SEQ ID NO: 460727 - protein, 9 aa, Homo Sapiens
VDAQEEISK

SEQ ID NO: 460728 - protein, 9 aa, Homo Sapiens
QQRKKAKSG

SEQ ID NO: 460729 - protein, 9 aa, Homo Sapiens
KTTLLFQKQ

SEQ ID NO: 460730 - protein, 9 aa, Homo Sapiens
TPLTDQCWL

SEQ ID NO: 460731 - protein, 9 aa, Homo Sapiens
AHDRKHHPW

SEQ ID NO: 460732 - protein, 9 aa, Homo Sapiens
TLLDSDKGS

SEQ ID NO: 460733 - protein, 9 aa, Homo Sapiens
PSPLCHCSP

SEQ ID NO: 460734 - protein, 9 aa, Homo Sapiens
ESVPPRGPD

SEQ ID NO: 460735 - protein, 9 aa, Homo Sapiens
AERGSLSAG

SEQ ID NO: 460736 - protein, 9 aa, Homo Sapiens
QLIAIDNQL

SEQ ID NO: 460737 - protein, 9 aa, Homo Sapiens
HTLTLPLHR

SEQ ID NO: 460738 - protein, 9 aa, Homo Sapiens
KCTARVWLR

SEQ ID NO: 460739 - protein, 9 aa, Homo Sapiens
NTPLHWLWA

SEQ ID NO: 460740 - protein, 9 aa, Homo Sapiens
DGFQFSPSE

SEQ ID NO: 460741 - protein, 9 aa, Homo Sapiens
VCHPPPAAA

SEQ ID NO: 460742 - protein, 9 aa, Homo Sapiens
ASRCVCHPP

SEQ ID NO: 460743 - protein, 9 aa, Homo Sapiens
FLGRACFCL

SEQ ID NO: 460744 - protein, 9 aa, Homo Sapiens
TAIYADEHE

SEQ ID NO: 460745 - protein, 9 aa, Homo Sapiens
RSSSSSGST

SEQ ID NO: 460746 - protein, 9 aa, Homo Sapiens
LLSSLLLGG

SEQ ID NO: 460747 - protein, 9 aa, Homo Sapiens
LVITPLTDQ

SEQ ID NO: 460748 - protein, 9 aa, Homo Sapiens
NTLNIYFQQ

SEQ ID NO: 460749 - protein, 9 aa, Homo Sapiens
QNHFLGRAC

SEQ ID NO: 460750 - protein, 9 aa, Homo Sapiens
HPPPAAAPR

SEQ ID NO: 460751 - protein, 9 aa, Homo Sapiens
IQQRMESQI

SEQ ID NO: 460752 - protein, 9 aa, Homo Sapiens
HPVITPSRV

SEQ ID NO: 460753 - protein, 9 aa, Homo Sapiens
PPPAAAPRL

SEQ ID NO: 460754 - protein, 9 aa, Homo Sapiens
STSSQWSFT

SEQ ID NO: 460755 - protein, 9 aa, Homo Sapiens
GKLQTCQRN

SEQ ID NO: 460756 - protein, 9 aa, Homo Sapiens
SPLCHCSPV

SEQ ID NO: 460757 - protein, 9 aa, Homo Sapiens
PPRRGAPEW

SEQ ID NO: 460758 - protein, 9 aa, Homo Sapiens
APCPPAAAG

SEQ ID NO: 460759 - protein, 9 aa, Homo Sapiens
SGMCKADFA

SEQ ID NO: 460760 - protein, 9 aa, Homo Sapiens
PSPGHRVIL

SEQ ID NO: 460761 - protein, 9 aa, Homo Sapiens
DGQRDKCWC

SEQ ID NO: 460762 - protein, 9 aa, Homo Sapiens
DSDKGSLSS

SEQ ID NO: 460763 - protein, 9 aa, Homo Sapiens
KLYALRTID

SEQ ID NO: 460764 - protein, 9 aa, Homo Sapiens
GNKVENLID

SEQ ID NO: 460765 - protein, 9 aa, Homo Sapiens
FKEYSKTET

SEQ ID NO: 460766 - protein, 9 aa, Homo Sapiens
LGAGTKTTS

SEQ ID NO: 460767 - protein, 9 aa, Homo Sapiens
VPFCRAAYP

SEQ ID NO: 460768 - protein, 9 aa, Homo Sapiens
AEVYYKPIS

SEQ ID NO: 460769 - protein, 9 aa, Homo Sapiens
FARRRNPQM

SEQ ID NO: 460770 - protein, 9 aa, Homo Sapiens
LELFLFGHL

SEQ ID NO: 460771 - protein, 9 aa, Homo Sapiens
ADRCHCCPA

SEQ ID NO: 460772 - protein, 9 aa, Homo Sapiens
VPTNSPRPC

SEQ ID NO: 460773 - protein, 9 aa, Homo Sapiens
KTVDKYHTL

SEQ ID NO: 460774 - protein, 9 aa, Homo Sapiens
CIELIKRPN

SEQ ID NO: 460775 - protein, 9 aa, Homo Sapiens
AATLARNTP

SEQ ID NO: 460776 - protein, 9 aa, Homo Sapiens
YEVVWPLVR

SEQ ID NO: 460777 - protein, 9 aa, Homo Sapiens
LYIENNSLS

SEQ ID NO: 460778 - protein, 9 aa, Homo Sapiens
SSGPRVRWE

SEQ ID NO: 460779 - protein, 9 aa, Homo Sapiens
RWEERVFLV

SEQ ID NO: 460780 - protein, 9 aa, Homo Sapiens
SLETSICPR

SEQ ID NO: 460781 - protein, 9 aa, Homo Sapiens
EAKDQEPCV

SEQ ID NO: 460782 - protein, 9 aa, Homo Sapiens
GVDGTDINA

SEQ ID NO: 460783 - protein, 9 aa, Homo Sapiens
FFPINYMEV

SEQ ID NO: 460784 - protein, 9 aa, Homo Sapiens
TDQCWLTLM

SEQ ID NO: 460785 - protein, 9 aa, Homo Sapiens
LSSVLQRFR

SEQ ID NO: 460786 - protein, 9 aa, Homo Sapiens
RSVALSLFL

SEQ ID NO: 460787 - protein, 9 aa, Homo Sapiens
KAKSGSPGE

SEQ ID NO: 460788 - protein, 9 aa, Homo Sapiens
RDKCWCVDR

SEQ ID NO: 460789 - protein, 9 aa, Homo Sapiens
WGKAAKQIS

SEQ ID NO: 460790 - protein, 9 aa, Homo Sapiens
IWSEGVDGT

SEQ ID NO: 460791 - protein, 9 aa, Homo Sapiens
QQRMESQIS

SEQ ID NO: 460792 - protein, 9 aa, Homo Sapiens
STRNGLGPG

SEQ ID NO: 460793 - protein, 9 aa, Homo Sapiens
LPKEAPASC

SEQ ID NO: 460794 - protein, 9 aa, Homo Sapiens
SGYTLKKNV

SEQ ID NO: 460795 - protein, 9 aa, Homo Sapiens
HSSLSVGRR

SEQ ID NO: 460796 - protein, 9 aa, Homo Sapiens
YNPVIYVFI

SEQ ID NO: 460797 - protein, 9 aa, Homo Sapiens
YKTGMTHIV

SEQ ID NO: 460798 - protein, 9 aa, Homo Sapiens
VYINSLFYS

SEQ ID NO: 460799 - protein, 9 aa, Homo Sapiens
PLHLAARLG

SEQ ID NO: 460800 - protein, 9 aa, Homo Sapiens
LTRCVNDAA

SEQ ID NO: 460801 - protein, 9 aa, Homo Sapiens
CKQKPVSKM

SEQ ID NO: 460802 - protein, 9 aa, Homo Sapiens
LSSLLLGGI

SEQ ID NO: 460803 - protein, 9 aa, Homo Sapiens
SHADTHIQR

SEQ ID NO: 460804 - protein, 9 aa, Homo Sapiens
LKAMDIEGT

SEQ ID NO: 460805 - protein, 9 aa, Homo Sapiens
ADTHIQRLS

SEQ ID NO: 460806 - protein, 9 aa, Homo Sapiens
EAVSLMSQV

SEQ ID NO: 460807 - protein, 9 aa, Homo Sapiens
EKSVELLAL

SEQ ID NO: 460808 - protein, 9 aa, Homo Sapiens
EEEELNQQR

SEQ ID NO: 460809 - protein, 9 aa, Homo Sapiens
EEQNTLNIY

SEQ ID NO: 460810 - protein, 9 aa, Homo Sapiens
IRGLLKYWS

SEQ ID NO: 460811 - protein, 9 aa, Homo Sapiens
SKMVAKVQD

SEQ ID NO: 460812 - protein, 9 aa, Homo Sapiens
SKSVQSSNS

SEQ ID NO: 460813 - protein, 9 aa, Homo Sapiens
TVKMEELSF

SEQ ID NO: 460814 - protein, 9 aa, Homo Sapiens
RGLLKYWSK

SEQ ID NO: 460815 - protein, 9 aa, Homo Sapiens
IPGSVLRPP

SEQ ID NO: 460816 - protein, 9 aa, Homo Sapiens
GILTRCVND

SEQ ID NO: 460817 - protein, 9 aa, Homo Sapiens
LVLFHLGLE

SEQ ID NO: 460818 - protein, 9 aa, Homo Sapiens
CVTEHRMGP

SEQ ID NO: 460819 - protein, 9 aa, Homo Sapiens
VLPTPCHTA

SEQ ID NO: 460820 - protein, 9 aa, Homo Sapiens
NSTVPTPAC

SEQ ID NO: 460821 - protein, 9 aa, Homo Sapiens
GSSGPRVRW

SEQ ID NO: 460822 - protein, 9 aa, Homo Sapiens
SSHHVILGT

SEQ ID NO: 460823 - protein, 9 aa, Homo Sapiens
QGAPSVATE

SEQ ID NO: 460824 - protein, 9 aa, Homo Sapiens
SLLKKLHQQ

SEQ ID NO: 460825 - protein, 9 aa, Homo Sapiens
ACGPQSCPA

SEQ ID NO: 460826 - protein, 9 aa, Homo Sapiens
YQVIRMPVS

SEQ ID NO: 460827 - protein, 9 aa, Homo Sapiens
KADFAGDDA

SEQ ID NO: 460828 - protein, 9 aa, Homo Sapiens
YTVKMEELS

SEQ ID NO: 460829 - protein, 9 aa, Homo Sapiens
PAAAVAAVA

SEQ ID NO: 460830 - protein, 9 aa, Homo Sapiens
LFQIYVRTH

SEQ ID NO: 460831 - protein, 9 aa, Homo Sapiens
PQLVLFHLG

SEQ ID NO: 460832 - protein, 9 aa, Homo Sapiens
VGGPSISPA

SEQ ID NO: 460833 - protein, 9 aa, Homo Sapiens
PQVKAGPVK

SEQ ID NO: 460834 - protein, 9 aa, Homo Sapiens
VKMEELSFT

SEQ ID NO: 460835 - protein, 9 aa, Homo Sapiens
ATALCPHTP

SEQ ID NO: 460836 - protein, 9 aa, Homo Sapiens
PEVPTYPET

SEQ ID NO: 460837 - protein, 9 aa, Homo Sapiens
KAAKQISWY

SEQ ID NO: 460838 - protein, 9 aa, Homo Sapiens
VSGQMMYFA

SEQ ID NO: 460839 - protein, 9 aa, Homo Sapiens
RGQLMHIEF

SEQ ID NO: 460840 - protein, 9 aa, Homo Sapiens
VPSEQLPPA

SEQ ID NO: 460841 - protein, 9 aa, Homo Sapiens
DTRNIASDD

SEQ ID NO: 460842 - protein, 9 aa, Homo Sapiens
HMLAKTHPY

SEQ ID NO: 460843 - protein, 9 aa, Homo Sapiens
SGAVELLCP

SEQ ID NO: 460844 - protein, 9 aa, Homo Sapiens
CPSGAVELL

SEQ ID NO: 460845 - protein, 9 aa, Homo Sapiens
KVDRLWNEV

SEQ ID NO: 460846 - protein, 9 aa, Homo Sapiens
FLIDGSSRV

SEQ ID NO: 460847 - protein, 9 aa, Homo Sapiens
ITPSRVSES

SEQ ID NO: 460848 - protein, 9 aa, Homo Sapiens
TSSQWSFTS

SEQ ID NO: 460849 - protein, 9 aa, Homo Sapiens
EVSRIGSLE

SEQ ID NO: 460850 - protein, 9 aa, Homo Sapiens
EQQLVEKSV

SEQ ID NO: 460851 - protein, 9 aa, Homo Sapiens
CAASKHATQ

SEQ ID NO: 460852 - protein, 9 aa, Homo Sapiens
DCQEGEEIV

SEQ ID NO: 460853 - protein, 9 aa, Homo Sapiens
MEIQCKHDP

SEQ ID NO: 460854 - protein, 9 aa, Homo Sapiens
SDPKSKSVQ

SEQ ID NO: 460855 - protein, 9 aa, Homo Sapiens
VLFHLGLEL

SEQ ID NO: 460856 - protein, 9 aa, Homo Sapiens
PNTPPGRRP

SEQ ID NO: 460857 - protein, 9 aa, Homo Sapiens
CTSTNSQVD

SEQ ID NO: 460858 - protein, 9 aa, Homo Sapiens
IPFPQVEKA

SEQ ID NO: 460859 - protein, 9 aa, Homo Sapiens
TALCPHTPA

SEQ ID NO: 460860 - protein, 9 aa, Homo Sapiens
KMEELSFTS

SEQ ID NO: 460861 - protein, 9 aa, Homo Sapiens
SSICTSTNS

SEQ ID NO: 460862 - protein, 9 aa, Homo Sapiens
TGKRPYECN

SEQ ID NO: 460863 - protein, 9 aa, Homo Sapiens
HVVNGEDAV

SEQ ID NO: 460864 - protein, 9 aa, Homo Sapiens
GDAAAPTPE

SEQ ID NO: 460865 - protein, 9 aa, Homo Sapiens
ASGGCHALF

SEQ ID NO: 460866 - protein, 9 aa, Homo Sapiens
CWPASGGCH

SEQ ID NO: 460867 - protein, 9 aa, Homo Sapiens
DLLGAGTKT

SEQ ID NO: 460868 - protein, 9 aa, Homo Sapiens
VYEVVWPLV

SEQ ID NO: 460869 - protein, 9 aa, Homo Sapiens
KPVSKMVAK

SEQ ID NO: 460870 - protein, 9 aa, Homo Sapiens
DIEGTSDPY

SEQ ID NO: 460871 - protein, 9 aa, Homo Sapiens
VASQFASRY

SEQ ID NO: 460872 - protein, 9 aa, Homo Sapiens
GIMVGGPSI

SEQ ID NO: 460873 - protein, 9 aa, Homo Sapiens
EEAERGSLS

SEQ ID NO: 460874 - protein, 9 aa, Homo Sapiens
RNEAIAKKN

SEQ ID NO: 460875 - protein, 9 aa, Homo Sapiens
RHLHESCVL

SEQ ID NO: 460876 - protein, 9 aa, Homo Sapiens
PAPGDAAAP

SEQ ID NO: 460877 - protein, 9 aa, Homo Sapiens
PLSIQTSSS

SEQ ID NO: 460878 - protein, 9 aa, Homo Sapiens
RVGDSNFRL

SEQ ID NO: 460879 - protein, 9 aa, Homo Sapiens
YKPISSVDP

SEQ ID NO: 460880 - protein, 9 aa, Homo Sapiens
DVMDGFQFS

SEQ ID NO: 460881 - protein, 9 aa, Homo Sapiens
RSDQHQPAA

SEQ ID NO: 460882 - protein, 9 aa, Homo Sapiens
LILWEKRTV

SEQ ID NO: 460883 - protein, 9 aa, Homo Sapiens
AFLYIHQLA

SEQ ID NO: 460884 - protein, 9 aa, Homo Sapiens
TSPQVKAGP

SEQ ID NO: 460885 - protein, 9 aa, Homo Sapiens
ATPPLSIQT

SEQ ID NO: 460886 - protein, 9 aa, Homo Sapiens
LKVVIPVCR

SEQ ID NO: 460887 - protein, 9 aa, Homo Sapiens
SSRPSSHVV

SEQ ID NO: 460888 - protein, 9 aa, Homo Sapiens
CCSNFVDFY

SEQ ID NO: 460889 - protein, 9 aa, Homo Sapiens
SGSSLQQMV

SEQ ID NO: 460890 - protein, 9 aa, Homo Sapiens
VCCADRCHC

SEQ ID NO: 460891 - protein, 9 aa, Homo Sapiens
HLVGGLHRV

SEQ ID NO: 460892 - protein, 9 aa, Homo Sapiens
SSSHVVHGE

SEQ ID NO: 460893 - protein, 9 aa, Homo Sapiens
WGSPPAPGD

SEQ ID NO: 460894 - protein, 9 aa, Homo Sapiens
APPRRGAPE

SEQ ID NO: 460895 - protein, 9 aa, Homo Sapiens
GGAGPTLGQ

SEQ ID NO: 460896 - protein, 9 aa, Homo Sapiens
HGPCYPGPC

SEQ ID NO: 460897 - protein, 9 aa, Homo Sapiens
VPGAYPNTP

SEQ ID NO: 460898 - protein, 9 aa, Homo Sapiens
EIQCKHDPF

SEQ ID NO: 460899 - protein, 9 aa, Homo Sapiens
LGSVFSPGR

SEQ ID NO: 460900 - protein, 9 aa, Homo Sapiens
GYTLKKNVD

SEQ ID NO: 460901 - protein, 9 aa, Homo Sapiens
AVPACGPQS

SEQ ID NO: 460902 - protein, 9 aa, Homo Sapiens
GKRPYECNY

SEQ ID NO: 460903 - protein, 9 aa, Homo Sapiens
GSCRLELFL

SEQ ID NO: 460904 - protein, 9 aa, Homo Sapiens
FDRNTKHDV

SEQ ID NO: 460905 - protein, 9 aa, Homo Sapiens
RLAPPVALG

SEQ ID NO: 460906 - protein, 9 aa, Homo Sapiens
DRNEAIAKK

SEQ ID NO: 460907 - protein, 9 aa, Homo Sapiens
CSFSPRNSW

SEQ ID NO: 460908 - protein, 9 aa, Homo Sapiens
CGPDLCSEA

SEQ ID NO: 460909 - protein, 9 aa, Homo Sapiens
YQHAFLYIH

SEQ ID NO: 460910 - protein, 9 aa, Homo Sapiens
CYPGPCPNW

SEQ ID NO: 460911 - protein, 9 aa, Homo Sapiens
WEERVFLVG

SEQ ID NO: 460912 - protein, 9 aa, Homo Sapiens
SQPEKTSQE

SEQ ID NO: 460913 - protein, 9 aa, Homo Sapiens
TEAKDQEPC

SEQ ID NO: 460914 - protein, 9 aa, Homo Sapiens
DTHIQRLSP

SEQ ID NO: 460915 - protein, 9 aa, Homo Sapiens
RFRFTHVIQ

SEQ ID NO: 460916 - protein, 9 aa, Homo Sapiens
FCYRASKFF

SEQ ID NO: 460917 - protein, 9 aa, Homo Sapiens
AVSTSSQWS

SEQ ID NO: 460918 - protein, 9 aa, Homo Sapiens
HRSAPTDPQ

SEQ ID NO: 460919 - protein, 9 aa, Homo Sapiens
GGLHRVYTK

SEQ ID NO: 460920 - protein, 9 aa, Homo Sapiens
NSPRPCLRS

SEQ ID NO: 460921 - protein, 9 aa, Homo Sapiens
RCHCCPAGF

SEQ ID NO: 460922 - protein, 9 aa, Homo Sapiens
LLLLLVQAV

SEQ ID NO: 460923 - protein, 9 aa, Homo Sapiens
SLSAGSLCR

SEQ ID NO: 460924 - protein, 9 aa, Homo Sapiens
LFFLHPLQP

SEQ ID NO: 460925 - protein, 9 aa, Homo Sapiens
ASKERSGIS

SEQ ID NO: 460926 - protein, 9 aa, Homo Sapiens
NWNHSSPAP

SEQ ID NO: 460927 - protein, 9 aa, Homo Sapiens
NQLIAIDNQ

SEQ ID NO: 460928 - protein, 9 aa, Homo Sapiens
FRFTHVIQQ

SEQ ID NO: 460929 - protein, 9 aa, Homo Sapiens
DAQEEISKV

SEQ ID NO: 460930 - protein, 9 aa, Homo Sapiens
TLTLPLHRT

SEQ ID NO: 460931 - protein, 9 aa, Homo Sapiens
IISGGLAGD

SEQ ID NO: 460932 - protein, 9 aa, Homo Sapiens
CSVLRPLAL

SEQ ID NO: 460933 - protein, 9 aa, Homo Sapiens
IRMPVSHLS

SEQ ID NO: 460934 - protein, 9 aa, Homo Sapiens
LWNKLLEAS

SEQ ID NO: 460935 - protein, 9 aa, Homo Sapiens
SPVWILLCG

SEQ ID NO: 460936 - protein, 9 aa, Homo Sapiens
IYADEHEKP

SEQ ID NO: 460937 - protein, 9 aa, Homo Sapiens
GSGRSSSSS

SEQ ID NO: 460938 - protein, 9 aa, Homo Sapiens
SVALSLFLA

SEQ ID NO: 460939 - protein, 9 aa, Homo Sapiens
ICPRTTSLT

SEQ ID NO: 460940 - protein, 9 aa, Homo Sapiens
WRTPAVPRS

SEQ ID NO: 460941 - protein, 9 aa, Homo Sapiens
KNDEMRSEM

SEQ ID NO: 460942 - protein, 9 aa, Homo Sapiens
PSSHVVNGE

SEQ ID NO: 460943 - protein, 9 aa, Homo Sapiens
NDAAIVLGA

SEQ ID NO: 460944 - protein, 9 aa, Homo Sapiens
NFVDFYTFN

SEQ ID NO: 460945 - protein, 9 aa, Homo Sapiens
LTWVPTNSP

SEQ ID NO: 460946 - protein, 9 aa, Homo Sapiens
GPCYPGPCP

SEQ ID NO: 460947 - protein, 9 aa, Homo Sapiens
LEAVSLMSQ

SEQ ID NO: 460948 - protein, 9 aa, Homo Sapiens
LSLMDAVDC

SEQ ID NO: 460949 - protein, 9 aa, Homo Sapiens
LRRELDELT

SEQ ID NO: 460950 - protein, 9 aa, Homo Sapiens
EHQRIHTGK

SEQ ID NO: 460951 - protein, 9 aa, Homo Sapiens
YLAIPGSVL

SEQ ID NO: 460952 - protein, 9 aa, Homo Sapiens
KGTLLDSDK

SEQ ID NO: 460953 - protein, 9 aa, Homo Sapiens
QRFRFTHVI

SEQ ID NO: 460954 - protein, 9 aa, Homo Sapiens
EKEQSLLKK

SEQ ID NO: 460955 - protein, 9 aa, Homo Sapiens
EAIPALRDF

SEQ ID NO: 460956 - protein, 9 aa, Homo Sapiens
FFLHPLQPS

SEQ ID NO: 460957 - protein, 9 aa, Homo Sapiens
AFLIDGSSR

SEQ ID NO: 460958 - protein, 9 aa, Homo Sapiens
IMGLNVLRI

SEQ ID NO: 460959 - protein, 9 aa, Homo Sapiens
SNIVAVERF

SEQ ID NO: 460960 - protein, 9 aa, Homo Sapiens
PEKTSQEPE

SEQ ID NO: 460961 - protein, 9 aa, Homo Sapiens
PESWGAPPR

SEQ ID NO: 460962 - protein, 9 aa, Homo Sapiens
VWKSDPKSK

SEQ ID NO: 460963 - protein, 9 aa, Homo Sapiens
NTPPGRRPY

SEQ ID NO: 460964 - protein, 9 aa, Homo Sapiens
GLAGDLAAA

SEQ ID NO: 460965 - protein, 9 aa, Homo Sapiens
DACFISLMN

SEQ ID NO: 460966 - protein, 9 aa, Homo Sapiens
YLCTSRNDC

SEQ ID NO: 460967 - protein, 9 aa, Homo Sapiens
VWLRVTTVL

SEQ ID NO: 460968 - protein, 9 aa, Homo Sapiens
NPDLAAQTM

SEQ ID NO: 460969 - protein, 9 aa, Homo Sapiens
PRTTSLTWV

SEQ ID NO: 460970 - protein, 9 aa, Homo Sapiens
VGQPSPGHR

SEQ ID NO: 460971 - protein, 9 aa, Homo Sapiens
DQHQPAAGR

SEQ ID NO: 460972 - protein, 9 aa, Homo Sapiens
PHASEQPTH

SEQ ID NO: 460973 - protein, 9 aa, Homo Sapiens
PASRCVCHP

SEQ ID NO: 460974 - protein, 9 aa, Homo Sapiens
ALCPHTPAA

SEQ ID NO: 460975 - protein, 9 aa, Homo Sapiens
HIEFKKIVE

SEQ ID NO: 460976 - protein, 9 aa, Homo Sapiens
SNFVDFYTF

SEQ ID NO: 460977 - protein, 9 aa, Homo Sapiens
YKHVSGQMM

SEQ ID NO: 460978 - protein, 9 aa, Homo Sapiens
KHHPWQLDK

SEQ ID NO: 460979 - protein, 9 aa, Homo Sapiens
SSPAPSPWG

SEQ ID NO: 460980 - protein, 9 aa, Homo Sapiens
AQTMLNSPL

SEQ ID NO: 460981 - protein, 9 aa, Homo Sapiens
KQQRKKAKS

SEQ ID NO: 460982 - protein, 9 aa, Homo Sapiens
TPAVPRSSR

SEQ ID NO: 460983 - protein, 9 aa, Homo Sapiens
YPPSPLCHC

SEQ ID NO: 460984 - protein, 9 aa, Homo Sapiens
TKPLPCFLE

SEQ ID NO: 460985 - protein, 9 aa, Homo Sapiens
PACGPQSCP

SEQ ID NO: 460986 - protein, 9 aa, Homo Sapiens
AFLGYKTGM

SEQ ID NO: 460987 - protein, 9 aa, Homo Sapiens
AYPPSPLCH

SEQ ID NO: 460988 - protein, 9 aa, Homo Sapiens
PALDGQRDK

SEQ ID NO: 460989 - protein, 9 aa, Homo Sapiens
SATPPLSIQ

SEQ ID NO: 460990 - protein, 9 aa, Homo Sapiens
HAALSATGT

SEQ ID NO: 460991 - protein, 9 aa, Homo Sapiens
LQQMVLRCW

SEQ ID NO: 460992 - protein, 9 aa, Homo Sapiens
SLFLAWRLS

SEQ ID NO: 460993 - protein, 9 aa, Homo Sapiens
RMFDRNTKH

SEQ ID NO: 460994 - protein, 9 aa, Homo Sapiens
SSWLWNKLL

SEQ ID NO: 460995 - protein, 9 aa, Homo Sapiens
IRDRNEAIA

SEQ ID NO: 460996 - protein, 9 aa, Homo Sapiens
ETSICPRTT

SEQ ID NO: 460997 - protein, 9 aa, Homo Sapiens
GTLLDSDKG

SEQ ID NO: 460998 - protein, 9 aa, Homo Sapiens
TPAASDYEL

SEQ ID NO: 460999 - protein, 9 aa, Homo Sapiens
RPSSHVVNG

SEQ ID NO: 461000 - protein, 9 aa, Homo Sapiens
LQKAIRDRN

SEQ ID NO: 461001 - protein, 9 aa, Homo Sapiens
CRLELFLFG

SEQ ID NO: 461002 - protein, 9 aa, Homo Sapiens
AESMPPPKT

SEQ ID NO: 461003 - protein, 9 aa, Homo Sapiens
SMTRTDQES

SEQ ID NO: 461004 - protein, 9 aa, Homo Sapiens
QDCQDFPVS

SEQ ID NO: 461005 - protein, 9 aa, Homo Sapiens
CQEGEEIVI

SEQ ID NO: 461006 - protein, 9 aa, Homo Sapiens
LDPFVFYFA

SEQ ID NO: 461007 - protein, 9 aa, Homo Sapiens
ISSNMLRTN

SEQ ID NO: 461008 - protein, 9 aa, Homo Sapiens
KSKSVQSSN

SEQ ID NO: 461009 - protein, 9 aa, Homo Sapiens
IFLTTRLQN

SEQ ID NO: 461010 - protein, 9 aa, Homo Sapiens
HSSSHVVHG

SEQ ID NO: 461011 - protein, 9 aa, Homo Sapiens
PGPCPNWNH

SEQ ID NO: 461012 - protein, 9 aa, Homo Sapiens
GGPSISPAL

SEQ ID NO: 461013 - protein, 9 aa, Homo Sapiens
EHVMLNRIS

SEQ ID NO: 461014 - protein, 9 aa, Homo Sapiens
ELNQQRVFT

SEQ ID NO: 461015 - protein, 9 aa, Homo Sapiens
RFWGKAAKQ

SEQ ID NO: 461016 - protein, 9 aa, Homo Sapiens
DGHWVVPVP

SEQ ID NO: 461017 - protein, 9 aa, Homo Sapiens
SLGSVFSPG

SEQ ID NO: 461018 - protein, 9 aa, Homo Sapiens
PPKTSASSV

SEQ ID NO: 461019 - protein, 9 aa, Homo Sapiens
PCYPGPCPN

SEQ ID NO: 461020 - protein, 9 aa, Homo Sapiens
HQLAIHLHN

SEQ ID NO: 461021 - protein, 9 aa, Homo Sapiens
IVAVERFKE

SEQ ID NO: 461022 - protein, 9 aa, Homo Sapiens
SSHSSSHVV

SEQ ID NO: 461023 - protein, 9 aa, Homo Sapiens
FPSPVWILL

SEQ ID NO: 461024 - protein, 9 aa, Homo Sapiens
LIKRDACFI

SEQ ID NO: 461025 - protein, 9 aa, Homo Sapiens
WTATAESVP

SEQ ID NO: 461026 - protein, 9 aa, Homo Sapiens
KHDVTLEAS

SEQ ID NO: 461027 - protein, 9 aa, Homo Sapiens
TLNIYFQQA

SEQ ID NO: 461028 - protein, 9 aa, Homo Sapiens
LRSLHPCSG

SEQ ID NO: 461029 - protein, 9 aa, Homo Sapiens
TPPGRRPYA

SEQ ID NO: 461030 - protein, 9 aa, Homo Sapiens
RPASHDAAH

SEQ ID NO: 461031 - protein, 9 aa, Homo Sapiens
GYHAYWKPA

SEQ ID NO: 461032 - protein, 9 aa, Homo Sapiens
AREHLLFAR

SEQ ID NO: 461033 - protein, 9 aa, Homo Sapiens
RISSNMLRT

SEQ ID NO: 461034 - protein, 9 aa, Homo Sapiens
WVVPVPRLP

SEQ ID NO: 461035 - protein, 9 aa, Homo Sapiens
HVIQQRMES

SEQ ID NO: 461036 - protein, 9 aa, Homo Sapiens
LFARDPRFM

SEQ ID NO: 461037 - protein, 9 aa, Homo Sapiens
KYHTLYISA

SEQ ID NO: 461038 - protein, 9 aa, Homo Sapiens
CPASGGAGP

SEQ ID NO: 461039 - protein, 9 aa, Homo Sapiens
LLNLSSMTR

SEQ ID NO: 461040 - protein, 9 aa, Homo Sapiens
FDGFQGCGP

SEQ ID NO: 461041 - protein, 9 aa, Homo Sapiens
GMCKADFAG

SEQ ID NO: 461042 - protein, 9 aa, Homo Sapiens
QPCIELIKR

SEQ ID NO: 461043 - protein, 9 aa, Homo Sapiens
EVNAKDTCD

SEQ ID NO: 461044 - protein, 9 aa, Homo Sapiens
QPAAGRRGC

SEQ ID NO: 461045 - protein, 9 aa, Homo Sapiens
AWNELKVVI

SEQ ID NO: 461046 - protein, 9 aa, Homo Sapiens
EAADLSKET

SEQ ID NO: 461047 - protein, 9 aa, Homo Sapiens
ALSKPTLSI

SEQ ID NO: 461048 - protein, 9 aa, Homo Sapiens
KEDRHPLPK

SEQ ID NO: 461049 - protein, 9 aa, Homo Sapiens
SQGAPSVAT

SEQ ID NO: 461050 - protein, 9 aa, Homo Sapiens
NSWHEGSFA

SEQ ID NO: 461051 - protein, 9 aa, Homo Sapiens
TVTVAVSTS

SEQ ID NO: 461052 - protein, 9 aa, Homo Sapiens
INGLRRELD

SEQ ID NO: 461053 - protein, 9 aa, Homo Sapiens
TRLQNISED

SEQ ID NO: 461054 - protein, 9 aa, Homo Sapiens
YYRLEVNAK

SEQ ID NO: 461055 - protein, 9 aa, Homo Sapiens
GKTPEEIHK

SEQ ID NO: 461056 - protein, 9 aa, Homo Sapiens
SPRPCLRSL

SEQ ID NO: 461057 - protein, 9 aa, Homo Sapiens
QHAFLYIHQ

SEQ ID NO: 461058 - protein, 9 aa, Homo Sapiens
YVRTHTGEK

SEQ ID NO: 461059 - protein, 9 aa, Homo Sapiens
KAIRDRNEA

SEQ ID NO: 461060 - protein, 9 aa, Homo Sapiens
GKLYALRTI

SEQ ID NO: 461061 - protein, 9 aa, Homo Sapiens
CSPVLPTPC

SEQ ID NO: 461062 - protein, 9 aa, Homo Sapiens
LVGGLHRVY

SEQ ID NO: 461063 - protein, 9 aa, Homo Sapiens
GPDLCSEAP

SEQ ID NO: 461064 - protein, 9 aa, Homo Sapiens
QARGQLMHI

SEQ ID NO: 461065 - protein, 9 aa, Homo Sapiens
SVGRRHPPV

SEQ ID NO: 461066 - protein, 9 aa, Homo Sapiens
MDGFQFSPS

SEQ ID NO: 461067 - protein, 9 aa, Homo Sapiens
PGHRVILYP

SEQ ID NO: 461068 - protein, 9 aa, Homo Sapiens
SKVEKRATY

SEQ ID NO: 461069 - protein, 9 aa, Homo Sapiens
TYPETPWYP

SEQ ID NO: 461070 - protein, 9 aa, Homo Sapiens
AAPRLHQHG

SEQ ID NO: 461071 - protein, 9 aa, Homo Sapiens
MHLGMSQLE

SEQ ID NO: 461072 - protein, 9 aa, Homo Sapiens
PKEIIFANS

SEQ ID NO: 461073 - protein, 9 aa, Homo Sapiens
ETLVRTEGG

SEQ ID NO: 461074 - protein, 9 aa, Homo Sapiens
RTLWDSVQK

SEQ ID NO: 461075 - protein, 9 aa, Homo Sapiens
CDKAFNQSS

SEQ ID NO: 461076 - protein, 9 aa, Homo Sapiens
QEYEDPPSE

SEQ ID NO: 461077 - protein, 9 aa, Homo Sapiens
ETKVYVGYL

SEQ ID NO: 461078 - protein, 9 aa, Homo Sapiens
LLGESPPNP

SEQ ID NO: 461079 - protein, 9 aa, Homo Sapiens
NRYTGDWSV

SEQ ID NO: 461080 - protein, 9 aa, Homo Sapiens
RLYRKTRVP

SEQ ID NO: 461081 - protein, 9 aa, Homo Sapiens
LAVQAPQAF

SEQ ID NO: 461082 - protein, 9 aa, Homo Sapiens
TLRPGTRAA

SEQ ID NO: 461083 - protein, 9 aa, Homo Sapiens
FRCEECDKA

SEQ ID NO: 461084 - protein, 9 aa, Homo Sapiens
SAVCVHQLP

SEQ ID NO: 461085 - protein, 9 aa, Homo Sapiens
YRKTRVPEP

SEQ ID NO: 461086 - protein, 9 aa, Homo Sapiens
QETLVRTEG

SEQ ID NO: 461087 - protein, 9 aa, Homo Sapiens
ALRRLKFAV

SEQ ID NO: 461088 - protein, 9 aa, Homo Sapiens
TGCRPIPIM

SEQ ID NO: 461089 - protein, 9 aa, Homo Sapiens
RCQVYAQSS

SEQ ID NO: 461090 - protein, 9 aa, Homo Sapiens
MAILAHSST

SEQ ID NO: 461091 - protein, 9 aa, Homo Sapiens
TFTSLRART

SEQ ID NO: 461092 - protein, 9 aa, Homo Sapiens
RALHAIRYP

SEQ ID NO: 461093 - protein, 9 aa, Homo Sapiens
TCVYDLPAK

SEQ ID NO: 461094 - protein, 9 aa, Homo Sapiens
HAKITCVYD

SEQ ID NO: 461095 - protein, 9 aa, Homo Sapiens
HVSTHHHNY

SEQ ID NO: 461096 - protein, 9 aa, Homo Sapiens
ENVSVHVHP

SEQ ID NO: 461097 - protein, 9 aa, Homo Sapiens
HHHNYAAPP

SEQ ID NO: 461098 - protein, 9 aa, Homo Sapiens
PGSAVCVHQ

SEQ ID NO: 461099 - protein, 9 aa, Homo Sapiens
LGAPHKVDE

SEQ ID NO: 461100 - protein, 9 aa, Homo Sapiens
SEELNGENA

SEQ ID NO: 461101 - protein, 9 aa, Homo Sapiens
HAIRYPMIP

SEQ ID NO: 461102 - protein, 9 aa, Homo Sapiens
LLCCEFCAK

SEQ ID NO: 461103 - protein, 9 aa, Homo Sapiens
KAAQEYEDP

SEQ ID NO: 461104 - protein, 9 aa, Homo Sapiens
GVRAPGGPG

SEQ ID NO: 461105 - protein, 9 aa, Homo Sapiens
AAGWLFQQS

SEQ ID NO: 461106 - protein, 9 aa, Homo Sapiens
PCHHCARQR

SEQ ID NO: 461107 - protein, 9 aa, Homo Sapiens
SRLETGNSM

SEQ ID NO: 461108 - protein, 9 aa, Homo Sapiens
ENRKLLGTA

SEQ ID NO: 461109 - protein, 9 aa, Homo Sapiens
KDNSGENVS

SEQ ID NO: 461110 - protein, 9 aa, Homo Sapiens
VAFSNADSG

SEQ ID NO: 461111 - protein, 9 aa, Homo Sapiens
HSSTCTATT

SEQ ID NO: 461112 - protein, 9 aa, Homo Sapiens
HLKERSQET

SEQ ID NO: 461113 - protein, 9 aa, Homo Sapiens
AGSGGVRAP

SEQ ID NO: 461114 - protein, 9 aa, Homo Sapiens
GVGDRHGNS

SEQ ID NO: 461115 - protein, 9 aa, Homo Sapiens
QELAVQAPQ

SEQ ID NO: 461116 - protein, 9 aa, Homo Sapiens
QSSNQNSCL

SEQ ID NO: 461117 - protein, 9 aa, Homo Sapiens
WGYCLIINN

SEQ ID NO: 461118 - protein, 9 aa, Homo Sapiens
LREPLRNAS

SEQ ID NO: 461119 - protein, 9 aa, Homo Sapiens
YTVTIDYWS

SEQ ID NO: 461120 - protein, 9 aa, Homo Sapiens
FSFDVFRFV

SEQ ID NO: 461121 - protein, 9 aa, Homo Sapiens
TCTATTSAP

SEQ ID NO: 461122 - protein, 9 aa, Homo Sapiens
FTFTSLRAR

SEQ ID NO: 461123 - protein, 9 aa, Homo Sapiens
TKLTDQESM

SEQ ID NO: 461124 - protein, 9 aa, Homo Sapiens
TWQEQEAPQ

SEQ ID NO: 461125 - protein, 9 aa, Homo Sapiens
AQSSNQNSC

SEQ ID NO: 461126 - protein, 9 aa, Homo Sapiens
TRVPEPSRR

SEQ ID NO: 461127 - protein, 9 aa, Homo Sapiens
QMAILAHSS

SEQ ID NO: 461128 - protein, 9 aa, Homo Sapiens
KSKPWGYCL

SEQ ID NO: 461129 - protein, 9 aa, Homo Sapiens
ESPSHLLGE

SEQ ID NO: 461130 - protein, 9 aa, Homo Sapiens
LLFMQQPCH

SEQ ID NO: 461131 - protein, 9 aa, Homo Sapiens
TAKDNSGEN

SEQ ID NO: 461132 - protein, 9 aa, Homo Sapiens
LHLKVLHGL

SEQ ID NO: 461133 - protein, 9 aa, Homo Sapiens
MKSKPWGYC

SEQ ID NO: 461134 - protein, 9 aa, Homo Sapiens
FSLSVEFGN

SEQ ID NO: 461135 - protein, 9 aa, Homo Sapiens
VEFGNDVQH

SEQ ID NO: 461136 - protein, 9 aa, Homo Sapiens
PVKAAQEYE

SEQ ID NO: 461137 - protein, 9 aa, Homo Sapiens
CLLLRAMAG

SEQ ID NO: 461138 - protein, 9 aa, Homo Sapiens
LFMQQPCHH

SEQ ID NO: 461139 - protein, 9 aa, Homo Sapiens
GGVRAPGGP

SEQ ID NO: 461140 - protein, 9 aa, Homo Sapiens
TPLPKASCH

SEQ ID NO: 461141 - protein, 9 aa, Homo Sapiens
QVYAQSSNQ

SEQ ID NO: 461142 - protein, 9 aa, Homo Sapiens
KITCVYDLP

SEQ ID NO: 461143 - protein, 9 aa, Homo Sapiens
PSNRYTGDW

SEQ ID NO: 461144 - protein, 9 aa, Homo Sapiens
LATQENANA

SEQ ID NO: 461145 - protein, 9 aa, Homo Sapiens
ILAHSSTCT

SEQ ID NO: 461146 - protein, 9 aa, Homo Sapiens
STKLTDQES

SEQ ID NO: 461147 - protein, 9 aa, Homo Sapiens
PSSLATQEN

SEQ ID NO: 461148 - protein, 9 aa, Homo Sapiens
PGFTFTSLR

SEQ ID NO: 461149 - protein, 9 aa, Homo Sapiens
PTPTPTSTQ

SEQ ID NO: 461150 - protein, 9 aa, Homo Sapiens
SSPVKAAQE

SEQ ID NO: 461151 - protein, 9 aa, Homo Sapiens
GYLGTGAGK

SEQ ID NO: 461152 - protein, 9 aa, Homo Sapiens
AAGQPSASA

SEQ ID NO: 461153 - protein, 9 aa, Homo Sapiens
TTDDVAFSN

SEQ ID NO: 461154 - protein, 9 aa, Homo Sapiens
KIQQETGVS

SEQ ID NO: 461155 - protein, 9 aa, Homo Sapiens
VQAPQAFCY

SEQ ID NO: 461156 - protein, 9 aa, Homo Sapiens
ILKHWTGGC

SEQ ID NO: 461157 - protein, 9 aa, Homo Sapiens
TDALSEDLP

SEQ ID NO: 461158 - protein, 9 aa, Homo Sapiens
ALHAIRYPM

SEQ ID NO: 461159 - protein, 9 aa, Homo Sapiens
GGPGSAVCV

SEQ ID NO: 461160 - protein, 9 aa, Homo Sapiens
LRAMAGPVP

SEQ ID NO: 461161 - protein, 9 aa, Homo Sapiens
ESPPSNRYT

SEQ ID NO: 461162 - protein, 9 aa, Homo Sapiens
IIFANSMGK

SEQ ID NO: 461163 - protein, 9 aa, Homo Sapiens
VGDRHGNSI

SEQ ID NO: 461164 - protein, 9 aa, Homo Sapiens
QAPQAFCYM

SEQ ID NO: 461165 - protein, 9 aa, Homo Sapiens
CPSSLATQE

SEQ ID NO: 461166 - protein, 9 aa, Homo Sapiens
KRCHVSTHH

SEQ ID NO: 461167 - protein, 9 aa, Homo Sapiens
SCHFSPEEL

SEQ ID NO: 461168 - protein, 9 aa, Homo Sapiens
QALEQLVKS

SEQ ID NO: 461169 - protein, 9 aa, Homo Sapiens
RLKFAVEKS

SEQ ID NO: 461170 - protein, 9 aa, Homo Sapiens
RAPGGPGSA

SEQ ID NO: 461171 - protein, 9 aa, Homo Sapiens
VQKSPHKTS

SEQ ID NO: 461172 - protein, 9 aa, Homo Sapiens
TGDWSVCGR

SEQ ID NO: 461173 - protein, 9 aa, Homo Sapiens
YQHIKSRLE

SEQ ID NO: 461174 - protein, 9 aa, Homo Sapiens
APQRDTPTE

SEQ ID NO: 461175 - protein, 9 aa, Homo Sapiens
KLLCCEFCA

SEQ ID NO: 461176 - protein, 9 aa, Homo Sapiens
SHLPKEIIF

SEQ ID NO: 461177 - protein, 9 aa, Homo Sapiens
RLKKLLCCE

SEQ ID NO: 461178 - protein, 9 aa, Homo Sapiens
SSSPVKAAQ

SEQ ID NO: 461179 - protein, 9 aa, Homo Sapiens
DISSGFGLN

SEQ ID NO: 461180 - protein, 9 aa, Homo Sapiens
RCEECDKAF

SEQ ID NO: 461181 - protein, 9 aa, Homo Sapiens
STCTATTSA

SEQ ID NO: 461182 - protein, 9 aa, Homo Sapiens
RAMAGPVPS

SEQ ID NO: 461183 - protein, 9 aa, Homo Sapiens
NRTLWDSVQ

SEQ ID NO: 461184 - protein, 9 aa, Homo Sapiens
STHHHNYAA

SEQ ID NO: 461185 - protein, 9 aa, Homo Sapiens
WTGGCPFRE

SEQ ID NO: 461186 - protein, 9 aa, Homo Sapiens
AGWLFQQSC

SEQ ID NO: 461187 - protein, 9 aa, Homo Sapiens
IVPSYNSAT

SEQ ID NO: 461188 - protein, 9 aa, Homo Sapiens
CLREPLRNA

SEQ ID NO: 461189 - protein, 9 aa, Homo Sapiens
LCCEFCAKV

SEQ ID NO: 461190 - protein, 9 aa, Homo Sapiens
AVQAPQAFC

SEQ ID NO: 461191 - protein, 9 aa, Homo Sapiens
GTAIQYGNV

SEQ ID NO: 461192 - protein, 9 aa, Homo Sapiens
NVSVHVHPA

SEQ ID NO: 461193 - protein, 9 aa, Homo Sapiens
PGDFSLSVE

SEQ ID NO: 461194 - protein, 9 aa, Homo Sapiens
LAHSSTCTA

SEQ ID NO: 461195 - protein, 9 aa, Homo Sapiens
LLRAMAGPV

SEQ ID NO: 461196 - protein, 9 aa, Homo Sapiens
LGESPPNPC

SEQ ID NO: 461197 - protein, 9 aa, Homo Sapiens
SYPTILQLA

SEQ ID NO: 461198 - protein, 9 aa, Homo Sapiens
TLGAPHKVD

SEQ ID NO: 461199 - protein, 9 aa, Homo Sapiens
TRAAFCYQI

SEQ ID NO: 461200 - protein, 9 aa, Homo Sapiens
REPLRNASA

SEQ ID NO: 461201 - protein, 9 aa, Homo Sapiens
FCLLLRAMA

SEQ ID NO: 461202 - protein, 9 aa, Homo Sapiens
LGMSQLETD

SEQ ID NO: 461203 - protein, 9 aa, Homo Sapiens
VKAAQEYED

SEQ ID NO: 461204 - protein, 9 aa, Homo Sapiens
PQAFCYMPA

SEQ ID NO: 461205 - protein, 9 aa, Homo Sapiens
LNQALKGVG

SEQ ID NO: 461206 - protein, 9 aa, Homo Sapiens
KIVPSYNSA

SEQ ID NO: 461207 - protein, 9 aa, Homo Sapiens
ASCHFSPEE

SEQ ID NO: 461208 - protein, 9 aa, Homo Sapiens
RKLLGTAIQ

SEQ ID NO: 461209 - protein, 9 aa, Homo Sapiens
LHAIRYPMI

SEQ ID NO: 461210 - protein, 9 aa, Homo Sapiens
YQMKSKPWG

SEQ ID NO: 461211 - protein, 9 aa, Homo Sapiens
SPPSNRYTG

SEQ ID NO: 461212 - protein, 9 aa, Homo Sapiens
SQIDISSGF

SEQ ID NO: 461213 - protein, 9 aa, Homo Sapiens
CQVYAQSSN

SEQ ID NO: 461214 - protein, 9 aa, Homo Sapiens
GQPSASAAA

SEQ ID NO: 461215 - protein, 9 aa, Homo Sapiens
ETGVSVDIL

SEQ ID NO: 461216 - protein, 9 aa, Homo Sapiens
KLLGTAIQY

SEQ ID NO: 461217 - protein, 9 aa, Homo Sapiens
TGGCPFREG

SEQ ID NO: 461218 - protein, 9 aa, Homo Sapiens
YSCAAGWLF

SEQ ID NO: 461219 - protein, 9 aa, Homo Sapiens
LKKLLCCEF

SEQ ID NO: 461220 - protein, 9 aa, Homo Sapiens
FGLNDGQWH

SEQ ID NO: 461221 - protein, 9 aa, Homo Sapiens
SDRQETLVR

SEQ ID NO: 461222 - protein, 9 aa, Homo Sapiens
RKTRVPEPS

SEQ ID NO: 461223 - protein, 9 aa, Homo Sapiens
IKSRLETGN

SEQ ID NO: 461224 - protein, 9 aa, Homo Sapiens
VCVHQLPPG

SEQ ID NO: 461225 - protein, 9 aa, Homo Sapiens
GFTFTSLRA

SEQ ID NO: 461226 - protein, 9 aa, Homo Sapiens
LEQLVKSEE

SEQ ID NO: 461227 - protein, 9 aa, Homo Sapiens
CRPIPIMKL

SEQ ID NO: 461228 - protein, 9 aa, Homo Sapiens
ENRLKKLLC

SEQ ID NO: 461229 - protein, 9 aa, Homo Sapiens
DVFRFVKHK

SEQ ID NO: 461230 - protein, 9 aa, Homo Sapiens
SCAAGWLFQ

SEQ ID NO: 461231 - protein, 9 aa, Homo Sapiens
SQETQSKHL

SEQ ID NO: 461232 - protein, 9 aa, Homo Sapiens
PDAAAGQPS

SEQ ID NO: 461233 - protein, 9 aa, Homo Sapiens
GRFSFDVFR

SEQ ID NO: 461234 - protein, 9 aa, Homo Sapiens
EPLRNASAC

SEQ ID NO: 461235 - protein, 9 aa, Homo Sapiens
AERALHAIR

SEQ ID NO: 461236 - protein, 9 aa, Homo Sapiens
QIDISSGFG

SEQ ID NO: 461237 - protein, 9 aa, Homo Sapiens
ELAVQAPQA

SEQ ID NO: 461238 - protein, 9 aa, Homo Sapiens
LLAGSGGVR

SEQ ID NO: 461239 - protein, 9 aa, Homo Sapiens
TLVRTEGGP

SEQ ID NO: 461240 - protein, 9 aa, Homo Sapiens
FQNALRRLK

SEQ ID NO: 461241 - protein, 9 aa, Homo Sapiens
LKHWTGGCP

SEQ ID NO: 461242 - protein, 9 aa, Homo Sapiens
YTGDWSVCG

SEQ ID NO: 461243 - protein, 9 aa, Homo Sapiens
LLLAGSGGV

SEQ ID NO: 461244 - protein, 9 aa, Homo Sapiens
RSRLYRKTR

SEQ ID NO: 461245 - protein, 9 aa, Homo Sapiens
NASACSTYA

SEQ ID NO: 461246 - protein, 9 aa, Homo Sapiens
LVKSEELNG

SEQ ID NO: 461247 - protein, 9 aa, Homo Sapiens
DKAFNQSSN

SEQ ID NO: 461248 - protein, 9 aa, Homo Sapiens
SRLYRKTRV

SEQ ID NO: 461249 - protein, 9 aa, Homo Sapiens
AAAGQPSAS

SEQ ID NO: 461250 - protein, 9 aa, Homo Sapiens
PAVAERALH

SEQ ID NO: 461251 - protein, 9 aa, Homo Sapiens
LYRCQVYAQ

SEQ ID NO: 461252 - protein, 9 aa, Homo Sapiens
LTDQESMNT

SEQ ID NO: 461253 - protein, 9 aa, Homo Sapiens
NADSGFADA

SEQ ID NO: 461254 - protein, 9 aa, Homo Sapiens
VYDLPAKYV

SEQ ID NO: 461255 - protein, 9 aa, Homo Sapiens
ERSQETQSK

SEQ ID NO: 461256 - protein, 9 aa, Homo Sapiens
NMHLGMSQL

SEQ ID NO: 461257 - protein, 9 aa, Homo Sapiens
GWLFQQSCP

SEQ ID NO: 461258 - protein, 9 aa, Homo Sapiens
QLVKSEELN

SEQ ID NO: 461259 - protein, 9 aa, Homo Sapiens
SSTCTATTS

SEQ ID NO: 461260 - protein, 9 aa, Homo Sapiens
SLSVEFGND

SEQ ID NO: 461261 - protein, 9 aa, Homo Sapiens
RNASACSTY

SEQ ID NO: 461262 - protein, 9 aa, Homo Sapiens
GENRLKKLL

SEQ ID NO: 461263 - protein, 9 aa, Homo Sapiens
FTSLRARTC

SEQ ID NO: 461264 - protein, 9 aa, Homo Sapiens
TQENANALA

SEQ ID NO: 461265 - protein, 9 aa, Homo Sapiens
YVGYLGTGA

SEQ ID NO: 461266 - protein, 9 aa, Homo Sapiens
KSRLETGNS

SEQ ID NO: 461267 - protein, 9 aa, Homo Sapiens
CHVSTHHHN

SEQ ID NO: 461268 - protein, 9 aa, Homo Sapiens
AIQYGNVIQ

SEQ ID NO: 461269 - protein, 9 aa, Homo Sapiens
DNSGENVSV

SEQ ID NO: 461270 - protein, 9 aa, Homo Sapiens
HLLGESPPN

SEQ ID NO: 461271 - protein, 9 aa, Homo Sapiens
ANPDAAAGQ

SEQ ID NO: 461272 - protein, 9 aa, Homo Sapiens
PGGPGSAVC

SEQ ID NO: 461273 - protein, 9 aa, Homo Sapiens
TPTPTSTQT

SEQ ID NO: 461274 - protein, 9 aa, Homo Sapiens
TATTSAPCL

SEQ ID NO: 461275 - protein, 9 aa, Homo Sapiens
EIIFANSMG

SEQ ID NO: 461276 - protein, 9 aa, Homo Sapiens
RPGTRAAFC

SEQ ID NO: 461277 - protein, 9 aa, Homo Sapiens
PIMKLEWGS

SEQ ID NO: 461278 - protein, 9 aa, Homo Sapiens
KHWTGGCPF

SEQ ID NO: 461279 - protein, 9 aa, Homo Sapiens
LWDSVQKSP

SEQ ID NO: 461280 - protein, 9 aa, Homo Sapiens
QQPCHHCAR

SEQ ID NO: 461281 - protein, 9 aa, Homo Sapiens
VYVGYLGTG

SEQ ID NO: 461282 - protein, 9 aa, Homo Sapiens
SFDVFRFVK

SEQ ID NO: 461283 - protein, 9 aa, Homo Sapiens
HKVDEGPSP

SEQ ID NO: 461284 - protein, 9 aa, Homo Sapiens
QALKGVGDR

SEQ ID NO: 461285 - protein, 9 aa, Homo Sapiens
KASCHFSPE

SEQ ID NO: 461286 - protein, 9 aa, Homo Sapiens
TSLRARTCH

SEQ ID NO: 461287 - protein, 9 aa, Homo Sapiens
QAFCYMPAG

SEQ ID NO: 461288 - protein, 9 aa, Homo Sapiens
ALEQLVKSE

SEQ ID NO: 461289 - protein, 9 aa, Homo Sapiens
RTSYPTILQ

SEQ ID NO: 461290 - protein, 9 aa, Homo Sapiens
TSYPTILQL

SEQ ID NO: 461291 - protein, 9 aa, Homo Sapiens
WDSVQKSPH

SEQ ID NO: 461292 - protein, 9 aa, Homo Sapiens
QMKSKPWGY

SEQ ID NO: 461293 - protein, 9 aa, Homo Sapiens
PSIIANMSG

SEQ ID NO: 461294 - protein, 9 aa, Homo Sapiens
ITCVYDLPA

SEQ ID NO: 461295 - protein, 9 aa, Homo Sapiens
QQKYTVTID

SEQ ID NO: 461296 - protein, 9 aa, Homo Sapiens
WLFQQSCPT

SEQ ID NO: 461297 - protein, 9 aa, Homo Sapiens
HHNYAAPPS

SEQ ID NO: 461298 - protein, 9 aa, Homo Sapiens
GSGGVRAPG

SEQ ID NO: 461299 - protein, 9 aa, Homo Sapiens
TPFRCEECD

SEQ ID NO: 461300 - protein, 9 aa, Homo Sapiens
VPSYNSATF

SEQ ID NO: 461301 - protein, 9 aa, Homo Sapiens
KEIIFANSM

SEQ ID NO: 461302 - protein, 9 aa, Homo Sapiens
TLSDRQETL

SEQ ID NO: 461303 - protein, 9 aa, Homo Sapiens
PWGYCLIIN

SEQ ID NO: 461304 - protein, 9 aa, Homo Sapiens
NLSSTKLTD

SEQ ID NO: 461305 - protein, 9 aa, Homo Sapiens
NPDAAAGQP

SEQ ID NO: 461306 - protein, 9 aa, Homo Sapiens
KVDEGPSPP

SEQ ID NO: 461307 - protein, 9 aa, Homo Sapiens
SGFGLNDGQ

SEQ ID NO: 461308 - protein, 9 aa, Homo Sapiens
TPTSTQTPT

SEQ ID NO: 461309 - protein, 9 aa, Homo Sapiens
QETQSKHLW

SEQ ID NO: 461310 - protein, 9 aa, Homo Sapiens
DVAFSNADS

SEQ ID NO: 461311 - protein, 9 aa, Homo Sapiens
EAPQRDTPT

SEQ ID NO: 461312 - protein, 9 aa, Homo Sapiens
IPIMKLEWG

SEQ ID NO: 461313 - protein, 9 aa, Homo Sapiens
QKCMAHRTS

SEQ ID NO: 461314 - protein, 9 aa, Homo Sapiens
KKLLCCEFC

SEQ ID NO: 461315 - protein, 9 aa, Homo Sapiens
PSHLLGESP

SEQ ID NO: 461316 - protein, 9 aa, Homo Sapiens
TGVSVDILP

SEQ ID NO: 461317 - protein, 9 aa, Homo Sapiens
PTSTQTPTT

SEQ ID NO: 461318 - protein, 9 aa, Homo Sapiens
LLNLSSTKL

SEQ ID NO: 461319 - protein, 9 aa, Homo Sapiens
SSGFGLNDG

SEQ ID NO: 461320 - protein, 9 aa, Homo Sapiens
SVEFGNDVQ

SEQ ID NO: 461321 - protein, 9 aa, Homo Sapiens
ETQSKHLWE

SEQ ID NO: 461322 - protein, 9 aa, Homo Sapiens
THHHNYAAP

SEQ ID NO: 461323 - protein, 9 aa, Homo Sapiens
VKSEELNGE

SEQ ID NO: 461324 - protein, 9 aa, Homo Sapiens
RFSFDVFRF

SEQ ID NO: 461325 - protein, 9 aa, Homo Sapiens
ETGNSMTKY

SEQ ID NO: 461326 - protein, 9 aa, Homo Sapiens
CHHCARQRL

SEQ ID NO: 461327 - protein, 9 aa, Homo Sapiens
HRTSYPTIL

SEQ ID NO: 461328 - protein, 9 aa, Homo Sapiens
LKIQQETGV

SEQ ID NO: 461329 - protein, 9 aa, Homo Sapiens
SSTKLTDQE

SEQ ID NO: 461330 - protein, 9 aa, Homo Sapiens
QESPSHLLG

SEQ ID NO: 461331 - protein, 9 aa, Homo Sapiens
HLPKEIIFA

SEQ ID NO: 461332 - protein, 9 aa, Homo Sapiens
AQEYEDPPS

SEQ ID NO: 461333 - protein, 9 aa, Homo Sapiens
IDISSGFGL

SEQ ID NO: 461334 - protein, 9 aa, Homo Sapiens
CVYDLPAKY

SEQ ID NO: 461335 - protein, 9 aa, Homo Sapiens
SPSHLLGES

SEQ ID NO: 461336 - protein, 9 aa, Homo Sapiens
DRQETLVRT

SEQ ID NO: 461337 - protein, 9 aa, Homo Sapiens
ALLFMQQPC

SEQ ID NO: 461338 - protein, 9 aa, Homo Sapiens
PIPIMKLEW

SEQ ID NO: 461339 - protein, 9 aa, Homo Sapiens
RRLKFAVEK

SEQ ID NO: 461340 - protein, 9 aa, Homo Sapiens
LPKEIIFAN

SEQ ID NO: 461341 - protein, 9 aa, Homo Sapiens
KTRVPEPSR

SEQ ID NO: 461342 - protein, 9 aa, Homo Sapiens
WQEQEAPQR

SEQ ID NO: 461343 - protein, 9 aa, Homo Sapiens
SGENVSVHV

SEQ ID NO: 461344 - protein, 9 aa, Homo Sapiens
SSLATQENA

SEQ ID NO: 461345 - protein, 9 aa, Homo Sapiens
SNADSGFAD

SEQ ID NO: 461346 - protein, 9 aa, Homo Sapiens
ECLREPLRN

SEQ ID NO: 461347 - protein, 9 aa, Homo Sapiens
HIKSRLETG

SEQ ID NO: 461348 - protein, 9 aa, Homo Sapiens
SLATQENAN

SEQ ID NO: 461349 - protein, 9 aa, Homo Sapiens
LRNASACST

SEQ ID NO: 461350 - protein, 9 aa, Homo Sapiens
GSAVCVHQL

SEQ ID NO: 461351 - protein, 9 aa, Homo Sapiens
EDLPSIIAN

SEQ ID NO: 461352 - protein, 9 aa, Homo Sapiens
PSHLPKEII

SEQ ID NO: 461353 - protein, 9 aa, Homo Sapiens
QQETGVSVD

SEQ ID NO: 461354 - protein, 9 aa, Homo Sapiens
VSTHHHNYA

SEQ ID NO: 461355 - protein, 9 aa, Homo Sapiens
GKIVPSYNS

SEQ ID NO: 461356 - protein, 9 aa, Homo Sapiens
APGGPGSAV

SEQ ID NO: 461357 - protein, 9 aa, Homo Sapiens
YLGTGAGKG

SEQ ID NO: 461358 - protein, 9 aa, Homo Sapiens
LKGVGDRHG

SEQ ID NO: 461359 - protein, 9 aa, Homo Sapiens
QPCHHCARQ

SEQ ID NO: 461360 - protein, 9 aa, Homo Sapiens
PLPKASCHF

SEQ ID NO: 461361 - protein, 9 aa, Homo Sapiens
QPSASAAAV

SEQ ID NO: 461362 - protein, 9 aa, Homo Sapiens
CVHQLPPGQ

SEQ ID NO: 461363 - protein, 9 aa, Homo Sapiens
MKLEWGSPW

SEQ ID NO: 461364 - protein, 9 aa, Homo Sapiens
FDVFRFVKH

SEQ ID NO: 461365 - protein, 9 aa, Homo Sapiens
HLKVLHGLT

SEQ ID NO: 461366 - protein, 9 aa, Homo Sapiens
TSTQTPTTV

SEQ ID NO: 461367 - protein, 9 aa, Homo Sapiens
IMKLEWGSP

SEQ ID NO: 461368 - protein, 9 aa, Homo Sapiens
TQSKHLWEV

SEQ ID NO: 461369 - protein, 9 aa, Homo Sapiens
LKVLHGLTS

SEQ ID NO: 461370 - protein, 9 aa, Homo Sapiens
LKERSQETQ

SEQ ID NO: 461371 - protein, 9 aa, Homo Sapiens
LSEDLPSII

SEQ ID NO: 461372 - protein, 9 aa, Homo Sapiens
VSVDILPLY

SEQ ID NO: 461373 - protein, 9 aa, Homo Sapiens
KSEELNGEN

SEQ ID NO: 461374 - protein, 9 aa, Homo Sapiens
VYAQSSNQN

SEQ ID NO: 461375 - protein, 9 aa, Homo Sapiens
FTLGAPHKV

SEQ ID NO: 461376 - protein, 9 aa, Homo Sapiens
VSQMAILAH

SEQ ID NO: 461377 - protein, 9 aa, Homo Sapiens
FTLRPGTRA

SEQ ID NO: 461378 - protein, 9 aa, Homo Sapiens
GESPPNPCS

SEQ ID NO: 461379 - protein, 9 aa, Homo Sapiens
AVAERALHA

SEQ ID NO: 461380 - protein, 9 aa, Homo Sapiens
QHIKSRLET

SEQ ID NO: 461381 - protein, 9 aa, Homo Sapiens
KFAVEKSIN

SEQ ID NO: 461382 - protein, 9 aa, Homo Sapiens
RSQETQSKH

SEQ ID NO: 461383 - protein, 9 aa, Homo Sapiens
VTIDYWSFG

SEQ ID NO: 461384 - protein, 9 aa, Homo Sapiens
EGKIVPSYN

SEQ ID NO: 461385 - protein, 9 aa, Homo Sapiens
EQEAPQRDT

SEQ ID NO: 461386 - protein, 9 aa, Homo Sapiens
RCHVSTHHH

SEQ ID NO: 461387 - protein, 9 aa, Homo Sapiens
AMAGPVPSP

SEQ ID NO: 461388 - protein, 9 aa, Homo Sapiens
GGCPFREGV

SEQ ID NO: 461389 - protein, 9 aa, Homo Sapiens
SQRGRFSFD

SEQ ID NO: 461390 - protein, 9 aa, Homo Sapiens
EQLVKSEEL

SEQ ID NO: 461391 - protein, 9 aa, Homo Sapiens
AAQEYEDPP

SEQ ID NO: 461392 - protein, 9 aa, Homo Sapiens
DSVQKSPHK

SEQ ID NO: 461393 - protein, 9 aa, Homo Sapiens
DLPSIIANM

SEQ ID NO: 461394 - protein, 9 aa, Homo Sapiens
AHSSTCTAT

SEQ ID NO: 461395 - protein, 9 aa, Homo Sapiens
SPVKAAQEY

SEQ ID NO: 461396 - protein, 9 aa, Homo Sapiens
GCRPIPIMK

SEQ ID NO: 461397 - protein, 9 aa, Homo Sapiens
VGYLGTGAG

SEQ ID NO: 461398 - protein, 9 aa, Homo Sapiens
ISSGFGLND

SEQ ID NO: 461399 - protein, 9 aa, Homo Sapiens
KPWGYCLII

SEQ ID NO: 461400 - protein, 9 aa, Homo Sapiens
GTRAAFCYQ

SEQ ID NO: 461401 - protein, 9 aa, Homo Sapiens
SHLLGESPP

SEQ ID NO: 461402 - protein, 9 aa, Homo Sapiens
RLETGNSMT

SEQ ID NO: 461403 - protein, 9 aa, Homo Sapiens
VKILKHWTG

SEQ ID NO: 461404 - protein, 9 aa, Homo Sapiens
LNLSSTKLT

SEQ ID NO: 461405 - protein, 9 aa, Homo Sapiens
SQMAILAHS

SEQ ID NO: 461406 - protein, 9 aa, Homo Sapiens
PRPGFTFTS

SEQ ID NO: 461407 - protein, 9 aa, Homo Sapiens
DAAAGQPSA

SEQ ID NO: 461408 - protein, 9 aa, Homo Sapiens
AVCVHQLPP

SEQ ID NO: 461409 - protein, 9 aa, Homo Sapiens
NRLKKLLCC

SEQ ID NO: 461410 - protein, 9 aa, Homo Sapiens
LETGNSMTK

SEQ ID NO: 461411 - protein, 9 aa, Homo Sapiens
QEAPQRDTP

SEQ ID NO: 461412 - protein, 9 aa, Homo Sapiens
VAERALHAI

SEQ ID NO: 461413 - protein, 9 aa, Homo Sapiens
QETGVSVDI

SEQ ID NO: 461414 - protein, 9 aa, Homo Sapiens
PLRNASACS

SEQ ID NO: 461415 - protein, 9 aa, Homo Sapiens
KERSQETQS

SEQ ID NO: 461416 - protein, 9 aa, Homo Sapiens
RPIPIMKLE

SEQ ID NO: 461417 - protein, 9 aa, Homo Sapiens
AKITCVYDL

SEQ ID NO: 461418 - protein, 9 aa, Homo Sapiens
KILKHWTGG

SEQ ID NO: 461419 - protein, 9 aa, Homo Sapiens
AFCLLLRAM

SEQ ID NO: 461420 - protein, 9 aa, Homo Sapiens
DDVAFSNAD

SEQ ID NO: 461421 - protein, 9 aa, Homo Sapiens
ALSEDLPSI

SEQ ID NO: 461422 - protein, 9 aa, Homo Sapiens
EFGNDVQHF

SEQ ID NO: 461423 - protein, 9 aa, Homo Sapiens
QKSPHKTST

SEQ ID NO: 461424 - protein, 9 aa, Homo Sapiens
PTPTSTQTP

SEQ ID NO: 461425 - protein, 9 aa, Homo Sapiens
KVYVGYLGT

SEQ ID NO: 461426 - protein, 9 aa, Homo Sapiens
GPRPGFTFT

SEQ ID NO: 461427 - protein, 9 aa, Homo Sapiens
IDYWSFGTL

SEQ ID NO: 461428 - protein, 9 aa, Homo Sapiens
LPKASCHFS

SEQ ID NO: 461429 - protein, 9 aa, Homo Sapiens
SGGVRAPGG

SEQ ID NO: 461430 - protein, 9 aa, Homo Sapiens
GFGLNDGQW

SEQ ID NO: 461431 - protein, 9 aa, Homo Sapiens
LPSIIANMS

SEQ ID NO: 461432 - protein, 9 aa, Homo Sapiens
CMAHRTSYP

SEQ ID NO: 461433 - protein, 9 aa, Homo Sapiens
TGHAKITCV

SEQ ID NO: 461434 - protein, 9 aa, Homo Sapiens
HWTGGCPFR

SEQ ID NO: 461435 - protein, 9 aa, Homo Sapiens
GAPHKVDEG

SEQ ID NO: 461436 - protein, 9 aa, Homo Sapiens
SKPWGYCLI

SEQ ID NO: 461437 - protein, 9 aa, Homo Sapiens
LSVEFGNDV

SEQ ID NO: 461438 - protein, 9 aa, Homo Sapiens
ALKGVGDRH

SEQ ID NO: 461439 - protein, 9 aa, Homo Sapiens
AKDNSGENV

SEQ ID NO: 461440 - protein, 9 aa, Homo Sapiens
YAQSSNQNS

SEQ ID NO: 461441 - protein, 9 aa, Homo Sapiens
GHAKITCVY

SEQ ID NO: 461442 - protein, 9 aa, Homo Sapiens
TAIQYGNVI

SEQ ID NO: 461443 - protein, 9 aa, Homo Sapiens
FMQQPCHHC

SEQ ID NO: 461444 - protein, 9 aa, Homo Sapiens
PQRDTPTES

SEQ ID NO: 461445 - protein, 9 aa, Homo Sapiens
LLGTAIQYG

SEQ ID NO: 461446 - protein, 9 aa, Homo Sapiens
AHRTSYPTI

SEQ ID NO: 461447 - protein, 9 aa, Homo Sapiens
VRAPGGPGS

SEQ ID NO: 461448 - protein, 9 aa, Homo Sapiens
PFRCEECDK

SEQ ID NO: 461449 - protein, 9 aa, Homo Sapiens
LYRKTRVPE

SEQ ID NO: 461450 - protein, 9 aa, Homo Sapiens
TDDVAFSNA

SEQ ID NO: 461451 - protein, 9 aa, Homo Sapiens
KYTVTIDYW

SEQ ID NO: 461452 - protein, 9 aa, Homo Sapiens
LRPGTRAAF

SEQ ID NO: 461453 - protein, 9 aa, Homo Sapiens
QCPSSLATQ

SEQ ID NO: 461454 - protein, 9 aa, Homo Sapiens
GVSVDILPL

SEQ ID NO: 461455 - protein, 9 aa, Homo Sapiens
QRGRFSFDV

SEQ ID NO: 461456 - protein, 9 aa, Homo Sapiens
KLTDQESMN

SEQ ID NO: 461457 - protein, 9 aa, Homo Sapiens
CHFSPEELD

SEQ ID NO: 461458 - protein, 9 aa, Homo Sapiens
PHKVDEGPS

SEQ ID NO: 461459 - protein, 9 aa, Homo Sapiens
CTATTSAPC

SEQ ID NO: 461460 - protein, 9 aa, Homo Sapiens
LSSTKLTDQ

SEQ ID NO: 461461 - protein, 9 aa, Homo Sapiens
GPGSAVCVH

SEQ ID NO: 461462 - protein, 9 aa, Homo Sapiens
TKVYVGYLG

SEQ ID NO: 461463 - protein, 9 aa, Homo Sapiens
GMSQLETDG

SEQ ID NO: 461464 - protein, 9 aa, Homo Sapiens
LAGSGGVRA

SEQ ID NO: 461465 - protein, 9 aa, Homo Sapiens
KVLHGLTSG

SEQ ID NO: 461466 - protein, 9 aa, Homo Sapiens
NQALKGVGD

SEQ ID NO: 461467 - protein, 9 aa, Homo Sapiens
ATQENANAL

SEQ ID NO: 461468 - protein, 9 aa, Homo Sapiens
GENVSVHVH

SEQ ID NO: 461469 - protein, 9 aa, Homo Sapiens
APQAFCYMP

SEQ ID NO: 461470 - protein, 9 aa, Homo Sapiens
QEQEAPQRD

SEQ ID NO: 461471 - protein, 9 aa, Homo Sapiens
HQLPPGQLH

SEQ ID NO: 461472 - protein, 9 aa, Homo Sapiens
FSNADSGFA

SEQ ID NO: 461473 - protein, 9 aa, Homo Sapiens
TLWDSVQKS

SEQ ID NO: 461474 - protein, 9 aa, Homo Sapiens
MAHRTSYPT

SEQ ID NO: 461475 - protein, 9 aa, Homo Sapiens
QNALRRLKF

SEQ ID NO: 461476 - protein, 9 aa, Homo Sapiens
YRCQVYAQS

SEQ ID NO: 461477 - protein, 9 aa, Homo Sapiens
LRRLKFAVE

SEQ ID NO: 461478 - protein, 9 aa, Homo Sapiens
TIDYWSFGT

SEQ ID NO: 461479 - protein, 9 aa, Homo Sapiens
MAGPVPSPL

SEQ ID NO: 461480 - protein, 9 aa, Homo Sapiens
LSDRQETLV

SEQ ID NO: 461481 - protein, 9 aa, Homo Sapiens
NRKLLGTAI

SEQ ID NO: 461482 - protein, 9 aa, Homo Sapiens
GTPLPKASC

SEQ ID NO: 461483 - protein, 9 aa, Homo Sapiens
SNRYTGDWS

SEQ ID NO: 461484 - protein, 9 aa, Homo Sapiens
SEDLPSIIA

SEQ ID NO: 461485 - protein, 9 aa, Homo Sapiens
VTPTPTPTS

SEQ ID NO: 461486 - protein, 9 aa, Homo Sapiens
STQTPTTVL

SEQ ID NO: 461487 - protein, 9 aa, Homo Sapiens
LLLRAMAGP

SEQ ID NO: 461488 - protein, 9 aa, Homo Sapiens
VNMHLGMSQ

SEQ ID NO: 461489 - protein, 9 aa, Homo Sapiens
SQLETDGDG

SEQ ID NO: 461490 - protein, 9 aa, Homo Sapiens
VHQLPPGQL

SEQ ID NO: 461491 - protein, 9 aa, Homo Sapiens
AGQPSASAA

SEQ ID NO: 461492 - protein, 9 aa, Homo Sapiens
LVRTEGGPQ

SEQ ID NO: 461493 - protein, 9 aa, Homo Sapiens
SRSRLYRKT

SEQ ID NO: 461494 - protein, 9 aa, Homo Sapiens
PGTRAAFCY

SEQ ID NO: 461495 - protein, 9 aa, Homo Sapiens
NALRRLKFA

SEQ ID NO: 461496 - protein, 9 aa, Homo Sapiens
PSYNSATFP

SEQ ID NO: 461497 - protein, 9 aa, Homo Sapiens
RYTGDWSVC

SEQ ID NO: 461498 - protein, 9 aa, Homo Sapiens
KGVGDRHGN

SEQ ID NO: 461499 - protein, 9 aa, Homo Sapiens
RPGFTFTSL

SEQ ID NO: 461500 - protein, 9 aa, Homo Sapiens
GDRHGNSIE

SEQ ID NO: 461501 - protein, 9 aa, Homo Sapiens
DALSEDLPS

SEQ ID NO: 461502 - protein, 9 aa, Homo Sapiens
RQETLVRTE

SEQ ID NO: 461503 - protein, 9 aa, Homo Sapiens
EQQKYTVTI

SEQ ID NO: 461504 - protein, 9 aa, Homo Sapiens
MSQLETDGD

SEQ ID NO: 461505 - protein, 9 aa, Homo Sapiens
QLPPGQLHV

SEQ ID NO: 461506 - protein, 9 aa, Homo Sapiens
VYQMKSKPW

SEQ ID NO: 461507 - protein, 9 aa, Homo Sapiens
LGTAIQYGN

SEQ ID NO: 461508 - protein, 9 aa, Homo Sapiens
IQQETGVSV

SEQ ID NO: 461509 - protein, 9 aa, Homo Sapiens
CAAGWLFQQ

SEQ ID NO: 461510 - protein, 9 aa, Homo Sapiens
QLETDGDGG

SEQ ID NO: 461511 - protein, 9 aa, Homo Sapiens
NSGENVSVH

SEQ ID NO: 461512 - protein, 9 aa, Homo Sapiens
PKASCHFSP

SEQ ID NO: 461513 - protein, 9 aa, Homo Sapiens
QRDTPTESS

SEQ ID NO: 461514 - protein, 9 aa, Homo Sapiens
GDFSLSVEF

SEQ ID NO: 461515 - protein, 9 aa, Homo Sapiens
APHKVDEGP

SEQ ID NO: 461516 - protein, 9 aa, Homo Sapiens
SFYSCAAGW

SEQ ID NO: 461517 - protein, 9 aa, Homo Sapiens
IFANSMGKG

SEQ ID NO: 461518 - protein, 9 aa, Homo Sapiens
GETKVYVGY

SEQ ID NO: 461519 - protein, 9 aa, Homo Sapiens
HLGMSQLET

SEQ ID NO: 461520 - protein, 9 aa, Homo Sapiens
DFSLSVEFG

SEQ ID NO: 461521 - protein, 9 aa, Homo Sapiens
SVQKSPHKT

SEQ ID NO: 461522 - protein, 9 aa, Homo Sapiens
LKFAVEKSI

SEQ ID NO: 461523 - protein, 9 aa, Homo Sapiens
AILAHSSTC

SEQ ID NO: 461524 - protein, 9 aa, Homo Sapiens
QKYTVTIDY

SEQ ID NO: 461525 - protein, 9 aa, Homo Sapiens
RGRFSFDVF

SEQ ID NO: 461526 - protein, 9 aa, Homo Sapiens
PPSNRYTGD

SEQ ID NO: 461527 - protein, 9 aa, Homo Sapiens
MQQPCHHCA

SEQ ID NO: 461528 - protein, 9 aa, Homo Sapiens
FYSCAAGWL

SEQ ID NO: 461529 - protein, 9 aa, Homo Sapiens
DQCPSSLAT

SEQ ID NO: 461530 - protein, 9 aa, Homo Sapiens
ERALHAIRY

SEQ ID NO: 461531 - protein, 9 aa, Homo Sapiens
TVTIDYWSF

SEQ ID NO: 461532 - protein, 9 aa, Homo Sapiens
KCMAHRTSY

SEQ ID NO: 461533 - protein, 9 aa, Homo Sapiens
RTALLLLAT

SEQ ID NO: 461534 - protein, 9 aa, Homo Sapiens
RRTDKSHSE

SEQ ID NO: 461535 - protein, 9 aa, Homo Sapiens
EAERAKEVW

SEQ ID NO: 461536 - protein, 9 aa, Homo Sapiens
RHLAQDPQH

SEQ ID NO: 461537 - protein, 9 aa, Homo Sapiens
LATLAVATG

SEQ ID NO: 461538 - protein, 9 aa, Homo Sapiens
SLVDSAFSS

SEQ ID NO: 461539 - protein, 9 aa, Homo Sapiens
ERRTDKSHS

SEQ ID NO: 461540 - protein, 9 aa, Homo Sapiens
NKARFEREQ

SEQ ID NO: 461541 - protein, 9 aa, Homo Sapiens
GKAVPHQQS

SEQ ID NO: 461542 - protein, 9 aa, Homo Sapiens
SVSAQGKAV

SEQ ID NO: 461543 - protein, 9 aa, Homo Sapiens
QGKAVPHQQ

SEQ ID NO: 461544 - protein, 9 aa, Homo Sapiens
TEEMQLDKN

SEQ ID NO: 461545 - protein, 9 aa, Homo Sapiens
DGCCWGWGQ

SEQ ID NO: 461546 - protein, 9 aa, Homo Sapiens
DHLAVILPR

SEQ ID NO: 461547 - protein, 9 aa, Homo Sapiens
KHRHLAQDP

SEQ ID NO: 461548 - protein, 9 aa, Homo Sapiens
AVPHQQSHK

SEQ ID NO: 461549 - protein, 9 aa, Homo Sapiens
GRLDGCCWG

SEQ ID NO: 461550 - protein, 9 aa, Homo Sapiens
LDGCCWGWG

SEQ ID NO: 461551 - protein, 9 aa, Homo Sapiens
TLAVATGPA

SEQ ID NO: 461552 - protein, 9 aa, Homo Sapiens
VSKKHRHLA

SEQ ID NO: 461553 - protein, 9 aa, Homo Sapiens
SKKHRHLAQ

SEQ ID NO: 461554 - protein, 9 aa, Homo Sapiens
SHSEKFQGV

SEQ ID NO: 461555 - protein, 9 aa, Homo Sapiens
HLAQDPQHE

SEQ ID NO: 461556 - protein, 9 aa, Homo Sapiens
TDKSHSEKF

SEQ ID NO: 461557 - protein, 9 aa, Homo Sapiens
SGVSLVDSA

SEQ ID NO: 461558 - protein, 9 aa, Homo Sapiens
ATLAVATGP

SEQ ID NO: 461559 - protein, 9 aa, Homo Sapiens
RAKEVWGSG

SEQ ID NO: 461560 - protein, 9 aa, Homo Sapiens
GERRTDKSH

SEQ ID NO: 461561 - protein, 9 aa, Homo Sapiens
GDHLAVILP

SEQ ID NO: 461562 - protein, 9 aa, Homo Sapiens
KRLSGVSLV

SEQ ID NO: 461563 - protein, 9 aa, Homo Sapiens
APVLAGRLD

SEQ ID NO: 461564 - protein, 9 aa, Homo Sapiens
KAVPHQQSH

SEQ ID NO: 461565 - protein, 9 aa, Homo Sapiens
EMQLDKNKA

SEQ ID NO: 461566 - protein, 9 aa, Homo Sapiens
QLDKNKARF

SEQ ID NO: 461567 - protein, 9 aa, Homo Sapiens
VPHQQSHKE

SEQ ID NO: 461568 - protein, 9 aa, Homo Sapiens
LSGVSLVDS

SEQ ID NO: 461569 - protein, 9 aa, Homo Sapiens
GLQRGDHLA

SEQ ID NO: 461570 - protein, 9 aa, Homo Sapiens
LVDSAFSSR

SEQ ID NO: 461571 - protein, 9 aa, Homo Sapiens
LAGRLDGCC

SEQ ID NO: 461572 - protein, 9 aa, Homo Sapiens
AGRLDGCCW

SEQ ID NO: 461573 - protein, 9 aa, Homo Sapiens
DKSHSEKFQ

SEQ ID NO: 461574 - protein, 9 aa, Homo Sapiens
KSHSEKFQG

SEQ ID NO: 461575 - protein, 9 aa, Homo Sapiens
LLATLAVAT

SEQ ID NO: 461576 - protein, 9 aa, Homo Sapiens
VLAGRLDGC

SEQ ID NO: 461577 - protein, 9 aa, Homo Sapiens
ERAKEVWGS

SEQ ID NO: 461578 - protein, 9 aa, Homo Sapiens
VWGSGSYEY

SEQ ID NO: 461579 - protein, 9 aa, Homo Sapiens
EVWGSGSYE

SEQ ID NO: 461580 - protein, 9 aa, Homo Sapiens
PCGLQRGDH

SEQ ID NO: 461581 - protein, 9 aa, Homo Sapiens
VSAQGKAVP

SEQ ID NO: 461582 - protein, 9 aa, Homo Sapiens
RLDGCCWGW

SEQ ID NO: 461583 - protein, 9 aa, Homo Sapiens
FGERRTDKS

SEQ ID NO: 461584 - protein, 9 aa, Homo Sapiens
RVSKKHRHL

SEQ ID NO: 461585 - protein, 9 aa, Homo Sapiens
GVSLVDSAF

SEQ ID NO: 461586 - protein, 9 aa, Homo Sapiens
AQGKAVPHQ

SEQ ID NO: 461587 - protein, 9 aa, Homo Sapiens
DKNKARFER

SEQ ID NO: 461588 - protein, 9 aa, Homo Sapiens
WGSGSYEYP

SEQ ID NO: 461589 - protein, 9 aa, Homo Sapiens
HLAVILPRI

SEQ ID NO: 461590 - protein, 9 aa, Homo Sapiens
LQRGDHLAV

SEQ ID NO: 461591 - protein, 9 aa, Homo Sapiens
AERAKEVWG

SEQ ID NO: 461592 - protein, 9 aa, Homo Sapiens
EEMQLDKNK

SEQ ID NO: 461593 - protein, 9 aa, Homo Sapiens
RGDHLAVIL

SEQ ID NO: 461594 - protein, 9 aa, Homo Sapiens
RTDKSHSEK

SEQ ID NO: 461595 - protein, 9 aa, Homo Sapiens
KEVWGSGSY

SEQ ID NO: 461596 - protein, 9 aa, Homo Sapiens
QRGDHLAVI

SEQ ID NO: 461597 - protein, 9 aa, Homo Sapiens
GKRLSGVSL

SEQ ID NO: 461598 - protein, 9 aa, Homo Sapiens
ALLLLATLA

SEQ ID NO: 461599 - protein, 9 aa, Homo Sapiens
HRHLAQDPQ

SEQ ID NO: 461600 - protein, 9 aa, Homo Sapiens
KNKARFERE

SEQ ID NO: 461601 - protein, 9 aa, Homo Sapiens
CGLQRGDHL

SEQ ID NO: 461602 - protein, 9 aa, Homo Sapiens
KKHRHLAQD

SEQ ID NO: 461603 - protein, 9 aa, Homo Sapiens
VSLVDSAFS

SEQ ID NO: 461604 - protein, 9 aa, Homo Sapiens
SAQGKAVPH

SEQ ID NO: 461605 - protein, 9 aa, Homo Sapiens
MQLDKNKAR

SEQ ID NO: 461606 - protein, 9 aa, Homo Sapiens
PVLAGRLDG

SEQ ID NO: 461607 - protein, 9 aa, Homo Sapiens
LDKNKARFE

SEQ ID NO: 461608 - protein, 9 aa, Homo Sapiens
RLSGVSLVD

SEQ ID NO: 461609 - protein, 9 aa, Homo Sapiens
AKEVWGSGS

SEQ ID NO: 461610 - protein, 9 aa, Homo Sapiens
QRVSKKHRH

SEQ ID NO: 461611 - protein, 9 aa, Homo Sapiens
DFFSIIARH

SEQ ID NO: 461612 - protein, 9 aa, Homo Sapiens
KIFLEGSVF

SEQ ID NO: 461613 - protein, 9 aa, Homo Sapiens
FDENVITCF

SEQ ID NO: 461614 - protein, 9 aa, Homo Sapiens
GILQGFRDI

SEQ ID NO: 461615 - protein, 9 aa, Homo Sapiens
QGFRDIYWA

SEQ ID NO: 461616 - protein, 9 aa, Homo Sapiens
ENVITCFAN

SEQ ID NO: 461617 - protein, 9 aa, Homo Sapiens
ARHQWQKAK

SEQ ID NO: 461618 - protein, 9 aa, Homo Sapiens
NVITCFANF

SEQ ID NO: 461619 - protein, 9 aa, Homo Sapiens
WTSSVHQKI

SEQ ID NO: 461620 - protein, 9 aa, Homo Sapiens
EKFDENVIT

SEQ ID NO: 461621 - protein, 9 aa, Homo Sapiens
GFRDIYWAN

SEQ ID NO: 461622 - protein, 9 aa, Homo Sapiens
FRDIYWANL

SEQ ID NO: 461623 - protein, 9 aa, Homo Sapiens
LEEWTSSVH

SEQ ID NO: 461624 - protein, 9 aa, Homo Sapiens
TSSVHQKIY

SEQ ID NO: 461625 - protein, 9 aa, Homo Sapiens
GSVFDRGRT

SEQ ID NO: 461626 - protein, 9 aa, Homo Sapiens
SIIARHQWQ

SEQ ID NO: 461627 - protein, 9 aa, Homo Sapiens
LQGFRDIYW

SEQ ID NO: 461628 - protein, 9 aa, Homo Sapiens
YGEKFDENV

SEQ ID NO: 461629 - protein, 9 aa, Homo Sapiens
RHQWQKAKE

SEQ ID NO: 461630 - protein, 9 aa, Homo Sapiens
FRQVQGLEI

SEQ ID NO: 461631 - protein, 9 aa, Homo Sapiens
LEGSVFDRG

SEQ ID NO: 461632 - protein, 9 aa, Homo Sapiens
ILQGFRDIY

SEQ ID NO: 461633 - protein, 9 aa, Homo Sapiens
CLEEWTSSV

SEQ ID NO: 461634 - protein, 9 aa, Homo Sapiens
AAFRQVQGL

SEQ ID NO: 461635 - protein, 9 aa, Homo Sapiens
VQGLEISSI

SEQ ID NO: 461636 - protein, 9 aa, Homo Sapiens
LEISSIDEF

SEQ ID NO: 461637 - protein, 9 aa, Homo Sapiens
EEWTSSVHQ

SEQ ID NO: 461638 - protein, 9 aa, Homo Sapiens
QGLEISSID

SEQ ID NO: 461639 - protein, 9 aa, Homo Sapiens
FFSIIARHQ

SEQ ID NO: 461640 - protein, 9 aa, Homo Sapiens
FLEGSVFDR

SEQ ID NO: 461641 - protein, 9 aa, Homo Sapiens
NAIHYIESL

SEQ ID NO: 461642 - protein, 9 aa, Homo Sapiens
EILRNAIHY

SEQ ID NO: 461643 - protein, 9 aa, Homo Sapiens
HYIESLQEL

SEQ ID NO: 461644 - protein, 9 aa, Homo Sapiens
ILRNAIHYI

SEQ ID NO: 461645 - protein, 9 aa, Homo Sapiens
RQVQGLEIS

SEQ ID NO: 461646 - protein, 9 aa, Homo Sapiens
IARHQWQKA

SEQ ID NO: 461647 - protein, 9 aa, Homo Sapiens
GKIFLEGSV

SEQ ID NO: 461648 - protein, 9 aa, Homo Sapiens
RNAIHYIES

SEQ ID NO: 461649 - protein, 9 aa, Homo Sapiens
HQWQKAKEW

SEQ ID NO: 461650 - protein, 9 aa, Homo Sapiens
IFLEGSVFD

SEQ ID NO: 461651 - protein, 9 aa, Homo Sapiens
IHYIESLQE

SEQ ID NO: 461652 - protein, 9 aa, Homo Sapiens
KFDENVITC

SEQ ID NO: 461653 - protein, 9 aa, Homo Sapiens
DENVITCFA

SEQ ID NO: 461654 - protein, 9 aa, Homo Sapiens
SVHQKIYTT

SEQ ID NO: 461655 - protein, 9 aa, Homo Sapiens
CCLEEWTSS

SEQ ID NO: 461656 - protein, 9 aa, Homo Sapiens
IIARHQWQK

SEQ ID NO: 461657 - protein, 9 aa, Homo Sapiens
QVQGLEISS

SEQ ID NO: 461658 - protein, 9 aa, Homo Sapiens
VEILRNAIH

SEQ ID NO: 461659 - protein, 9 aa, Homo Sapiens
EGSVFDRGR

SEQ ID NO: 461660 - protein, 9 aa, Homo Sapiens
SSVHQKIYT

SEQ ID NO: 461661 - protein, 9 aa, Homo Sapiens
GEKFDENVI

SEQ ID NO: 461662 - protein, 9 aa, Homo Sapiens
RDIYWANLM

SEQ ID NO: 461663 - protein, 9 aa, Homo Sapiens
LRNAIHYIE

SEQ ID NO: 461664 - protein, 9 aa, Homo Sapiens
FSIIARHQW

SEQ ID NO: 461665 - protein, 9 aa, Homo Sapiens
NGILQGFRD

SEQ ID NO: 461666 - protein, 9 aa, Homo Sapiens
AIHYIESLQ

SEQ ID NO: 461667 - protein, 9 aa, Homo Sapiens
GLEISSIDE

SEQ ID NO: 461668 - protein, 9 aa, Homo Sapiens
AFRQVQGLE

SEQ ID NO: 461669 - protein, 9 aa, Homo Sapiens
DIYWANLMD

SEQ ID NO: 461670 - protein, 9 aa, Homo Sapiens
SVFDRGRTD

SEQ ID NO: 461671 - protein, 9 aa, Homo Sapiens
SGKIFLEGS

SEQ ID NO: 461672 - protein, 9 aa, Homo Sapiens
EWTSSVHQK

SEQ ID NO: 461673 - protein, 9 aa, Homo Sapiens
GIMLVCTIL

SEQ ID NO: 461674 - protein, 9 aa, Homo Sapiens
IMLVCTILH

SEQ ID NO: 461675 - protein, 9 aa, Homo Sapiens
VSHRARPLS

SEQ ID NO: 461676 - protein, 9 aa, Homo Sapiens
ANRRLFRLK

SEQ ID NO: 461677 - protein, 9 aa, Homo Sapiens
AGIMLVCTI

SEQ ID NO: 461678 - protein, 9 aa, Homo Sapiens
VCTILHTFF

SEQ ID NO: 461679 - protein, 9 aa, Homo Sapiens
RSSANRRLF

SEQ ID NO: 461680 - protein, 9 aa, Homo Sapiens
VSSCSQTNL

SEQ ID NO: 461681 - protein, 9 aa, Homo Sapiens
GRSSANRRL

SEQ ID NO: 461682 - protein, 9 aa, Homo Sapiens
HRARPLSFL

SEQ ID NO: 461683 - protein, 9 aa, Homo Sapiens
SQTNLSFDS

SEQ ID NO: 461684 - protein, 9 aa, Homo Sapiens
GVSHRARPL

SEQ ID NO: 461685 - protein, 9 aa, Homo Sapiens
SVSSCSQTN

SEQ ID NO: 461686 - protein, 9 aa, Homo Sapiens
SCSQTNLSF

SEQ ID NO: 461687 - protein, 9 aa, Homo Sapiens
MLVCTILHT

SEQ ID NO: 461688 - protein, 9 aa, Homo Sapiens
NRRLFRLKD

SEQ ID NO: 461689 - protein, 9 aa, Homo Sapiens
CSQTNLSFD

SEQ ID NO: 461690 - protein, 9 aa, Homo Sapiens
TNLSFDSQV

SEQ ID NO: 461691 - protein, 9 aa, Homo Sapiens
ARPLSFLIW

SEQ ID NO: 461692 - protein, 9 aa, Homo Sapiens
WYVGRSSAN

SEQ ID NO: 461693 - protein, 9 aa, Homo Sapiens
VGRSSANRR

SEQ ID NO: 461694 - protein, 9 aa, Homo Sapiens
LVCTILHTF

SEQ ID NO: 461695 - protein, 9 aa, Homo Sapiens
SANRRLFRL

SEQ ID NO: 461696 - protein, 9 aa, Homo Sapiens
RPLSFLIWS

SEQ ID NO: 461697 - protein, 9 aa, Homo Sapiens
RARPLSFLI

SEQ ID NO: 461698 - protein, 9 aa, Homo Sapiens
SHRARPLSF

SEQ ID NO: 461699 - protein, 9 aa, Homo Sapiens
QTNLSFDSQ

SEQ ID NO: 461700 - protein, 9 aa, Homo Sapiens
SSANRRLFR

SEQ ID NO: 461701 - protein, 9 aa, Homo Sapiens
SSCSQTNLS

SEQ ID NO: 461702 - protein, 9 aa, Homo Sapiens
NLSFDSQVS

SEQ ID NO: 461703 - protein, 9 aa, Homo Sapiens
YVGRSSANR

SEQ ID NO: 461704 - protein, 9 aa, Homo Sapiens
WKKAWTKLK

SEQ ID NO: 461705 - protein, 9 aa, Homo Sapiens
IRPMNKTVL

SEQ ID NO: 461706 - protein, 9 aa, Homo Sapiens
VCIQEMFRF

SEQ ID NO: 461707 - protein, 9 aa, Homo Sapiens
GAGEHSGCY

SEQ ID NO: 461708 - protein, 9 aa, Homo Sapiens
ETRGIAHVS

SEQ ID NO: 461709 - protein, 9 aa, Homo Sapiens
AAMAPEHKI

SEQ ID NO: 461710 - protein, 9 aa, Homo Sapiens
NPKEFFWNI

SEQ ID NO: 461711 - protein, 9 aa, Homo Sapiens
QKPIPQPLN

SEQ ID NO: 461712 - protein, 9 aa, Homo Sapiens
HWPESPKAQ

SEQ ID NO: 461713 - protein, 9 aa, Homo Sapiens
KKAWTKLKL

SEQ ID NO: 461714 - protein, 9 aa, Homo Sapiens
SSASSDGLH

SEQ ID NO: 461715 - protein, 9 aa, Homo Sapiens
HSGCYEELA

SEQ ID NO: 461716 - protein, 9 aa, Homo Sapiens
FTIKVHDMN

SEQ ID NO: 461717 - protein, 9 aa, Homo Sapiens
NIEEDFKPA

SEQ ID NO: 461718 - protein, 9 aa, Homo Sapiens
IKESKKEQL

SEQ ID NO: 461719 - protein, 9 aa, Homo Sapiens
VNNFRRRGL

SEQ ID NO: 461720 - protein, 9 aa, Homo Sapiens
KPQKPIPQP

SEQ ID NO: 461721 - protein, 9 aa, Homo Sapiens
QWKIQVELD

SEQ ID NO: 461722 - protein, 9 aa, Homo Sapiens
MTMPQKLFI

SEQ ID NO: 461723 - protein, 9 aa, Homo Sapiens
MKLRKLRES

SEQ ID NO: 461724 - protein, 9 aa, Homo Sapiens
CKKDGDPDS

SEQ ID NO: 461725 - protein, 9 aa, Homo Sapiens
VSVCIQEMF

SEQ ID NO: 461726 - protein, 9 aa, Homo Sapiens
RSHSRSFSR

SEQ ID NO: 461727 - protein, 9 aa, Homo Sapiens
STFMKLRKL

SEQ ID NO: 461728 - protein, 9 aa, Homo Sapiens
CAQKSRPGV

SEQ ID NO: 461729 - protein, 9 aa, Homo Sapiens
MSKLVTYQQ

SEQ ID NO: 461730 - protein, 9 aa, Homo Sapiens
LDQHISGST

SEQ ID NO: 461731 - protein, 9 aa, Homo Sapiens
QEQIKESKK

SEQ ID NO: 461732 - protein, 9 aa, Homo Sapiens
QIWKKAWTK

SEQ ID NO: 461733 - protein, 9 aa, Homo Sapiens
IPRQIWKKA

SEQ ID NO: 461734 - protein, 9 aa, Homo Sapiens
CLPLQPEEG

SEQ ID NO: 461735 - protein, 9 aa, Homo Sapiens
ESKKEQLSG

SEQ ID NO: 461736 - protein, 9 aa, Homo Sapiens
TFMKLRKLR

SEQ ID NO: 461737 - protein, 9 aa, Homo Sapiens
TRGIAHVSL

SEQ ID NO: 461738 - protein, 9 aa, Homo Sapiens
IDYKFGECK

SEQ ID NO: 461739 - protein, 9 aa, Homo Sapiens
GRTFMTMPQ

SEQ ID NO: 461740 - protein, 9 aa, Homo Sapiens
LIFEPADLK

SEQ ID NO: 461741 - protein, 9 aa, Homo Sapiens
SKFQWKIQV

SEQ ID NO: 461742 - protein, 9 aa, Homo Sapiens
QVELDWRRK

SEQ ID NO: 461743 - protein, 9 aa, Homo Sapiens
DYKFGECKK

SEQ ID NO: 461744 - protein, 9 aa, Homo Sapiens
SKLVTYQQT

SEQ ID NO: 461745 - protein, 9 aa, Homo Sapiens
TQPVPSPLP

SEQ ID NO: 461746 - protein, 9 aa, Homo Sapiens
PADLKQASP

SEQ ID NO: 461747 - protein, 9 aa, Homo Sapiens
KLSTFMKLR

SEQ ID NO: 461748 - protein, 9 aa, Homo Sapiens
IPQPLNKYQ

SEQ ID NO: 461749 - protein, 9 aa, Homo Sapiens
AKYACNDIQ

SEQ ID NO: 461750 - protein, 9 aa, Homo Sapiens
PQKPIPQPL

SEQ ID NO: 461751 - protein, 9 aa, Homo Sapiens
KSKKEIFHW

SEQ ID NO: 461752 - protein, 9 aa, Homo Sapiens
TYQQTTCCI

SEQ ID NO: 461753 - protein, 9 aa, Homo Sapiens
KAWTKLKLS

SEQ ID NO: 461754 - protein, 9 aa, Homo Sapiens
ESSASSDGL

SEQ ID NO: 461755 - protein, 9 aa, Homo Sapiens
SVCIQEMFR

SEQ ID NO: 461756 - protein, 9 aa, Homo Sapiens
QRMRSHSRS

SEQ ID NO: 461757 - protein, 9 aa, Homo Sapiens
ALRKSWTTK

SEQ ID NO: 461758 - protein, 9 aa, Homo Sapiens
ERPEPVQDF

SEQ ID NO: 461759 - protein, 9 aa, Homo Sapiens
NGQRQGLRE

SEQ ID NO: 461760 - protein, 9 aa, Homo Sapiens
ECKKDGDPD

SEQ ID NO: 461761 - protein, 9 aa, Homo Sapiens
FIDGFFLIM

SEQ ID NO: 461762 - protein, 9 aa, Homo Sapiens
EIFHWPESP

SEQ ID NO: 461763 - protein, 9 aa, Homo Sapiens
ASSDGLHPV

SEQ ID NO: 461764 - protein, 9 aa, Homo Sapiens
DGLHPVITP

SEQ ID NO: 461765 - protein, 9 aa, Homo Sapiens
TINLGVVAP

SEQ ID NO: 461766 - protein, 9 aa, Homo Sapiens
RPEPVQDFF

SEQ ID NO: 461767 - protein, 9 aa, Homo Sapiens
SKKEIFHWP

SEQ ID NO: 461768 - protein, 9 aa, Homo Sapiens
IMSKLVTYQ

SEQ ID NO: 461769 - protein, 9 aa, Homo Sapiens
MNKTVLFTD

SEQ ID NO: 461770 - protein, 9 aa, Homo Sapiens
AWTKLKLST

SEQ ID NO: 461771 - protein, 9 aa, Homo Sapiens
AVVSLLACL

SEQ ID NO: 461772 - protein, 9 aa, Homo Sapiens
LKQASPATV

SEQ ID NO: 461773 - protein, 9 aa, Homo Sapiens
KIPKIGWYS

SEQ ID NO: 461774 - protein, 9 aa, Homo Sapiens
SIGEDVYDK

SEQ ID NO: 461775 - protein, 9 aa, Homo Sapiens
KSWTTKVNW

SEQ ID NO: 461776 - protein, 9 aa, Homo Sapiens
ICNTINLGV

SEQ ID NO: 461777 - protein, 9 aa, Homo Sapiens
IKVHDMNDN

SEQ ID NO: 461778 - protein, 9 aa, Homo Sapiens
KLVTYQQTT

SEQ ID NO: 461779 - protein, 9 aa, Homo Sapiens
NEIAIRPMN

SEQ ID NO: 461780 - protein, 9 aa, Homo Sapiens
LACLPLQPE

SEQ ID NO: 461781 - protein, 9 aa, Homo Sapiens
KSIGEDVYD

SEQ ID NO: 461782 - protein, 9 aa, Homo Sapiens
TKLKLSTFM

SEQ ID NO: 461783 - protein, 9 aa, Homo Sapiens
PMNKTVLFT

SEQ ID NO: 461784 - protein, 9 aa, Homo Sapiens
ACLPLQPEE

SEQ ID NO: 461785 - protein, 9 aa, Homo Sapiens
VVSLLACLP

SEQ ID NO: 461786 - protein, 9 aa, Homo Sapiens
DMNDNWPVF

SEQ ID NO: 461787 - protein, 9 aa, Homo Sapiens
LFIDGFFLI

SEQ ID NO: 461788 - protein, 9 aa, Homo Sapiens
CIQEMFRFA

SEQ ID NO: 461789 - protein, 9 aa, Homo Sapiens
MRSHSRSFS

SEQ ID NO: 461790 - protein, 9 aa, Homo Sapiens
SKKEQLSGS

SEQ ID NO: 461791 - protein, 9 aa, Homo Sapiens
FEPADLKQA

SEQ ID NO: 461792 - protein, 9 aa, Homo Sapiens
EDVYDKPIS

SEQ ID NO: 461793 - protein, 9 aa, Homo Sapiens
GLDQHISGS

SEQ ID NO: 461794 - protein, 9 aa, Homo Sapiens
AFQIFLKSE

SEQ ID NO: 461795 - protein, 9 aa, Homo Sapiens
QTTCCIPRQ

SEQ ID NO: 461796 - protein, 9 aa, Homo Sapiens
HDMNDNWPV

SEQ ID NO: 461797 - protein, 9 aa, Homo Sapiens
CNDIQINIW

SEQ ID NO: 461798 - protein, 9 aa, Homo Sapiens
VSLFTPKNF

SEQ ID NO: 461799 - protein, 9 aa, Homo Sapiens
RRRGLDQHI

SEQ ID NO: 461800 - protein, 9 aa, Homo Sapiens
ACNDIQINI

SEQ ID NO: 461801 - protein, 9 aa, Homo Sapiens
ADLKQASPA

SEQ ID NO: 461802 - protein, 9 aa, Homo Sapiens
VPSPLPCYQ

SEQ ID NO: 461803 - protein, 9 aa, Homo Sapiens
PTQPVPSPL

SEQ ID NO: 461804 - protein, 9 aa, Homo Sapiens
ESSFGVTMQ

SEQ ID NO: 461805 - protein, 9 aa, Homo Sapiens
RKSWTTKVN

SEQ ID NO: 461806 - protein, 9 aa, Homo Sapiens
DFFDFITER

SEQ ID NO: 461807 - protein, 9 aa, Homo Sapiens
KLRESSFGV

SEQ ID NO: 461808 - protein, 9 aa, Homo Sapiens
PLPTQPVPS

SEQ ID NO: 461809 - protein, 9 aa, Homo Sapiens
FVSVCIQEM

SEQ ID NO: 461810 - protein, 9 aa, Homo Sapiens
EALRKSWTT

SEQ ID NO: 461811 - protein, 9 aa, Homo Sapiens
VHDMNDNWP

SEQ ID NO: 461812 - protein, 9 aa, Homo Sapiens
EPVQDFFDF

SEQ ID NO: 461813 - protein, 9 aa, Homo Sapiens
QPLNKYQGF

SEQ ID NO: 461814 - protein, 9 aa, Homo Sapiens
KESKKEQLS

SEQ ID NO: 461815 - protein, 9 aa, Homo Sapiens
IQINIWYGF

SEQ ID NO: 461816 - protein, 9 aa, Homo Sapiens
KWYTLLANE

SEQ ID NO: 461817 - protein, 9 aa, Homo Sapiens
SGCYEELAR

SEQ ID NO: 461818 - protein, 9 aa, Homo Sapiens
NFRRRGLDQ

SEQ ID NO: 461819 - protein, 9 aa, Homo Sapiens
YACNDIQIN

SEQ ID NO: 461820 - protein, 9 aa, Homo Sapiens
KEIFHWPES

SEQ ID NO: 461821 - protein, 9 aa, Homo Sapiens
NDIQINIWY

SEQ ID NO: 461822 - protein, 9 aa, Homo Sapiens
SDGLHPVIT

SEQ ID NO: 461823 - protein, 9 aa, Homo Sapiens
GFFLIMSKL

SEQ ID NO: 461824 - protein, 9 aa, Homo Sapiens
LSTFMKLRK

SEQ ID NO: 461825 - protein, 9 aa, Homo Sapiens
IGEDVYDKP

SEQ ID NO: 461826 - protein, 9 aa, Homo Sapiens
APEHKIPKI

SEQ ID NO: 461827 - protein, 9 aa, Homo Sapiens
DAFQIFLKS

SEQ ID NO: 461828 - protein, 9 aa, Homo Sapiens
EAVVSLLAC

SEQ ID NO: 461829 - protein, 9 aa, Homo Sapiens
SSFGVTMQV

SEQ ID NO: 461830 - protein, 9 aa, Homo Sapiens
RQGLREALL

SEQ ID NO: 461831 - protein, 9 aa, Homo Sapiens
FFLIMSKLV

SEQ ID NO: 461832 - protein, 9 aa, Homo Sapiens
CIPRQIWKK

SEQ ID NO: 461833 - protein, 9 aa, Homo Sapiens
KFDEALRKS

SEQ ID NO: 461834 - protein, 9 aa, Homo Sapiens
SASSDGLHP

SEQ ID NO: 461835 - protein, 9 aa, Homo Sapiens
KGRTFMTMP

SEQ ID NO: 461836 - protein, 9 aa, Homo Sapiens
SFTIKVHDM

SEQ ID NO: 461837 - protein, 9 aa, Homo Sapiens
FLIMSKLVT

SEQ ID NO: 461838 - protein, 9 aa, Homo Sapiens
TFMTMPQKL

SEQ ID NO: 461839 - protein, 9 aa, Homo Sapiens
PRQIWKKAW

SEQ ID NO: 461840 - protein, 9 aa, Homo Sapiens
PVPSPLPCY

SEQ ID NO: 461841 - protein, 9 aa, Homo Sapiens
QKSRPGVYT

SEQ ID NO: 461842 - protein, 9 aa, Homo Sapiens
LLACLPLQP

SEQ ID NO: 461843 - protein, 9 aa, Homo Sapiens
IAIRPMNKT

SEQ ID NO: 461844 - protein, 9 aa, Homo Sapiens
ECIVRTCEK

SEQ ID NO: 461845 - protein, 9 aa, Homo Sapiens
QKFDEALRK

SEQ ID NO: 461846 - protein, 9 aa, Homo Sapiens
FGVTMQVTS

SEQ ID NO: 461847 - protein, 9 aa, Homo Sapiens
NKTVLFTDN

SEQ ID NO: 461848 - protein, 9 aa, Homo Sapiens
IEEDFKPAP

SEQ ID NO: 461849 - protein, 9 aa, Homo Sapiens
YQQTTCCIP

SEQ ID NO: 461850 - protein, 9 aa, Homo Sapiens
DLSVNGQRQ

SEQ ID NO: 461851 - protein, 9 aa, Homo Sapiens
RKWYTLLAN

SEQ ID NO: 461852 - protein, 9 aa, Homo Sapiens
KLRKLRESS

SEQ ID NO: 461853 - protein, 9 aa, Homo Sapiens
KLFIDGFFL

SEQ ID NO: 461854 - protein, 9 aa, Homo Sapiens
LQSVYECIV

SEQ ID NO: 461855 - protein, 9 aa, Homo Sapiens
EHKIPKIGW

SEQ ID NO: 461856 - protein, 9 aa, Homo Sapiens
FMKLRKLRE

SEQ ID NO: 461857 - protein, 9 aa, Homo Sapiens
LPTQPVPSP

SEQ ID NO: 461858 - protein, 9 aa, Homo Sapiens
VSLLACLPL

SEQ ID NO: 461859 - protein, 9 aa, Homo Sapiens
GQRQGLREA

SEQ ID NO: 461860 - protein, 9 aa, Homo Sapiens
AYPLPTQPV

SEQ ID NO: 461861 - protein, 9 aa, Homo Sapiens
LLANEKAPV

SEQ ID NO: 461862 - protein, 9 aa, Homo Sapiens
AHVSLFTPK

SEQ ID NO: 461863 - protein, 9 aa, Homo Sapiens
DKPISELDR

SEQ ID NO: 461864 - protein, 9 aa, Homo Sapiens
WNIEEDFKP

SEQ ID NO: 461865 - protein, 9 aa, Homo Sapiens
SFGVTMQVT

SEQ ID NO: 461866 - protein, 9 aa, Homo Sapiens
TLLANEKAP

SEQ ID NO: 461867 - protein, 9 aa, Homo Sapiens
RKLRESSFG

SEQ ID NO: 461868 - protein, 9 aa, Homo Sapiens
FDEALRKSW

SEQ ID NO: 461869 - protein, 9 aa, Homo Sapiens
KKEIFHWPE

SEQ ID NO: 461870 - protein, 9 aa, Homo Sapiens
RQIWKKAWT

SEQ ID NO: 461871 - protein, 9 aa, Homo Sapiens
IPQEQIKES

SEQ ID NO: 461872 - protein, 9 aa, Homo Sapiens
HKIPKIGWY

SEQ ID NO: 461873 - protein, 9 aa, Homo Sapiens
YAQRKWYTL

SEQ ID NO: 461874 - protein, 9 aa, Homo Sapiens
DGFFLIMSK

SEQ ID NO: 461875 - protein, 9 aa, Homo Sapiens
FGECKKDGD

SEQ ID NO: 461876 - protein, 9 aa, Homo Sapiens
YGCAQKSRP

SEQ ID NO: 461877 - protein, 9 aa, Homo Sapiens
RTFMTMPQK

SEQ ID NO: 461878 - protein, 9 aa, Homo Sapiens
IDGFFLIMS

SEQ ID NO: 461879 - protein, 9 aa, Homo Sapiens
CCIPRQIWK

SEQ ID NO: 461880 - protein, 9 aa, Homo Sapiens
KLKLSTFMK

SEQ ID NO: 461881 - protein, 9 aa, Homo Sapiens
GLDAFQIFL

SEQ ID NO: 461882 - protein, 9 aa, Homo Sapiens
QDFFDFITE

SEQ ID NO: 461883 - protein, 9 aa, Homo Sapiens
GEDVYDKPI

SEQ ID NO: 461884 - protein, 9 aa, Homo Sapiens
FRRRGLDQH

SEQ ID NO: 461885 - protein, 9 aa, Homo Sapiens
RESSFGVTM

SEQ ID NO: 461886 - protein, 9 aa, Homo Sapiens
CNTINLGVV

SEQ ID NO: 461887 - protein, 9 aa, Homo Sapiens
NQAGLDAFQ

SEQ ID NO: 461888 - protein, 9 aa, Homo Sapiens
EVYLICNTI

SEQ ID NO: 461889 - protein, 9 aa, Homo Sapiens
LKLSTFMKL

SEQ ID NO: 461890 - protein, 9 aa, Homo Sapiens
MAPEHKIPK

SEQ ID NO: 461891 - protein, 9 aa, Homo Sapiens
FQWKIQVEL

SEQ ID NO: 461892 - protein, 9 aa, Homo Sapiens
PQPLNKYQG

SEQ ID NO: 461893 - protein, 9 aa, Homo Sapiens
INLGVVAPL

SEQ ID NO: 461894 - protein, 9 aa, Homo Sapiens
WTKLKLSTF

SEQ ID NO: 461895 - protein, 9 aa, Homo Sapiens
CIVRTCEKL

SEQ ID NO: 461896 - protein, 9 aa, Homo Sapiens
FGAFVSVCI

SEQ ID NO: 461897 - protein, 9 aa, Homo Sapiens
FFWNIEEDF

SEQ ID NO: 461898 - protein, 9 aa, Homo Sapiens
IFGAFVSVC

SEQ ID NO: 461899 - protein, 9 aa, Homo Sapiens
GLHPVITPS

SEQ ID NO: 461900 - protein, 9 aa, Homo Sapiens
IWKKAWTKL

SEQ ID NO: 461901 - protein, 9 aa, Homo Sapiens
KVHDMNDNW

SEQ ID NO: 461902 - protein, 9 aa, Homo Sapiens
RRGLDQHIS

SEQ ID NO: 461903 - protein, 9 aa, Homo Sapiens
FWNIEEDFK

SEQ ID NO: 461904 - protein, 9 aa, Homo Sapiens
CYEELARML

SEQ ID NO: 461905 - protein, 9 aa, Homo Sapiens
VYLICNTIN

SEQ ID NO: 461906 - protein, 9 aa, Homo Sapiens
KIQVELDWR

SEQ ID NO: 461907 - protein, 9 aa, Homo Sapiens
LRKLRESSF

SEQ ID NO: 461908 - protein, 9 aa, Homo Sapiens
SLLACLPLQ

SEQ ID NO: 461909 - protein, 9 aa, Homo Sapiens
VQDFFDFIT

SEQ ID NO: 461910 - protein, 9 aa, Homo Sapiens
AQRKWYTLL

SEQ ID NO: 461911 - protein, 9 aa, Homo Sapiens
IFEPADLKQ

SEQ ID NO: 461912 - protein, 9 aa, Homo Sapiens
LRESSFGVT

SEQ ID NO: 461913 - protein, 9 aa, Homo Sapiens
AMAPEHKIP

SEQ ID NO: 461914 - protein, 9 aa, Homo Sapiens
HGAGEHSGC

SEQ ID NO: 461915 - protein, 9 aa, Homo Sapiens
QQTTCCIPR

SEQ ID NO: 461916 - protein, 9 aa, Homo Sapiens
QSVYECIVR

SEQ ID NO: 461917 - protein, 9 aa, Homo Sapiens
LAAMAPEHK

SEQ ID NO: 461918 - protein, 9 aa, Homo Sapiens
FKGRTFMTM

SEQ ID NO: 461919 - protein, 9 aa, Homo Sapiens
FFDFITERG

SEQ ID NO: 461920 - protein, 9 aa, Homo Sapiens
IQVELDWRR

SEQ ID NO: 461921 - protein, 9 aa, Homo Sapiens
TTCCIPRQI

SEQ ID NO: 461922 - protein, 9 aa, Homo Sapiens
QAGLDAFQI

SEQ ID NO: 461923 - protein, 9 aa, Homo Sapiens
FMTMPQKLF

SEQ ID NO: 461924 - protein, 9 aa, Homo Sapiens
VYDKPISEL

SEQ ID NO: 461925 - protein, 9 aa, Homo Sapiens
VNGQRQGLR

SEQ ID NO: 461926 - protein, 9 aa, Homo Sapiens
AGEHSGCYE

SEQ ID NO: 461927 - protein, 9 aa, Homo Sapiens
QKLFIDGFF

SEQ ID NO: 461928 - protein, 9 aa, Homo Sapiens
LSVNGQRQG

SEQ ID NO: 461929 - protein, 9 aa, Homo Sapiens
KQASPATVS

SEQ ID NO: 461930 - protein, 9 aa, Homo Sapiens
YPLPTQPVP

SEQ ID NO: 461931 - protein, 9 aa, Homo Sapiens
KFGECKKDG

SEQ ID NO: 461932 - protein, 9 aa, Homo Sapiens
TIKVHDMND

SEQ ID NO: 461933 - protein, 9 aa, Homo Sapiens
QINIWYGFS

SEQ ID NO: 461934 - protein, 9 aa, Homo Sapiens
WYTLLANEK

SEQ ID NO: 461935 - protein, 9 aa, Homo Sapiens
LIMSKLVTY

SEQ ID NO: 461936 - protein, 9 aa, Homo Sapiens
LVTYQQTTC

SEQ ID NO: 461937 - protein, 9 aa, Homo Sapiens
YKFGECKKD

SEQ ID NO: 461938 - protein, 9 aa, Homo Sapiens
QIKESKKEQ

SEQ ID NO: 461939 - protein, 9 aa, Homo Sapiens
GCAQKSRPG

SEQ ID NO: 461940 - protein, 9 aa, Homo Sapiens
SHSRSFSRH

SEQ ID NO: 461941 - protein, 9 aa, Homo Sapiens
YTLLANEKA

SEQ ID NO: 461942 - protein, 9 aa, Homo Sapiens
SKSKKEIFH

SEQ ID NO: 461943 - protein, 9 aa, Homo Sapiens
SRPGVYTKV

SEQ ID NO: 461944 - protein, 9 aa, Homo Sapiens
SVNGQRQGL

SEQ ID NO: 461945 - protein, 9 aa, Homo Sapiens
DVYDKPISE

SEQ ID NO: 461946 - protein, 9 aa, Homo Sapiens
QPVPSPLPC

SEQ ID NO: 461947 - protein, 9 aa, Homo Sapiens
NTINLGVVA

SEQ ID NO: 461948 - protein, 9 aa, Homo Sapiens
EHSGCYEEL

SEQ ID NO: 461949 - protein, 9 aa, Homo Sapiens
GEHSGCYEE

SEQ ID NO: 461950 - protein, 9 aa, Homo Sapiens
EFFWNIEED

SEQ ID NO: 461951 - protein, 9 aa, Homo Sapiens
RMRSHSRSF

SEQ ID NO: 461952 - protein, 9 aa, Homo Sapiens
PIPQPLNKY

SEQ ID NO: 461953 - protein, 9 aa, Homo Sapiens
RPQRMRSHS

SEQ ID NO: 461954 - protein, 9 aa, Homo Sapiens
DLKQASPAT

SEQ ID NO: 461955 - protein, 9 aa, Homo Sapiens
MNDNWPVFT

SEQ ID NO: 461956 - protein, 9 aa, Homo Sapiens
HSRSFSRHR

SEQ ID NO: 461957 - protein, 9 aa, Homo Sapiens
IFHWPESPK

SEQ ID NO: 461958 - protein, 9 aa, Homo Sapiens
RPMNKTVLF

SEQ ID NO: 461959 - protein, 9 aa, Homo Sapiens
GIAHVSLFT

SEQ ID NO: 461960 - protein, 9 aa, Homo Sapiens
PQEQIKESK

SEQ ID NO: 461961 - protein, 9 aa, Homo Sapiens
RGIAHVSLF

SEQ ID NO: 461962 - protein, 9 aa, Homo Sapiens
LICNTINLG

SEQ ID NO: 461963 - protein, 9 aa, Homo Sapiens
FHWPESPKA

SEQ ID NO: 461964 - protein, 9 aa, Homo Sapiens
MPQKLFIDG

SEQ ID NO: 461965 - protein, 9 aa, Homo Sapiens
QGLREALLT

SEQ ID NO: 461966 - protein, 9 aa, Homo Sapiens
GCYEELARM

SEQ ID NO: 461967 - protein, 9 aa, Homo Sapiens
VRTCEKLDE

SEQ ID NO: 461968 - protein, 9 aa, Homo Sapiens
KYACNDIQI

SEQ ID NO: 461969 - protein, 9 aa, Homo Sapiens
LDAFQIFLK

SEQ ID NO: 461970 - protein, 9 aa, Homo Sapiens
IVRTCEKLD

SEQ ID NO: 461971 - protein, 9 aa, Homo Sapiens
QIFLKSEFS

SEQ ID NO: 461972 - protein, 9 aa, Homo Sapiens
PEHKIPKIG

SEQ ID NO: 461973 - protein, 9 aa, Homo Sapiens
IAHVSLFTP

SEQ ID NO: 461974 - protein, 9 aa, Homo Sapiens
KSRPGVYTK

SEQ ID NO: 461975 - protein, 9 aa, Homo Sapiens
KPIPQPLNK

SEQ ID NO: 461976 - protein, 9 aa, Homo Sapiens
GAFVSVCIQ

SEQ ID NO: 461977 - protein, 9 aa, Homo Sapiens
SVYECIVRT

SEQ ID NO: 461978 - protein, 9 aa, Homo Sapiens
SLFTPKNFP

SEQ ID NO: 461979 - protein, 9 aa, Homo Sapiens
PVQDFFDFI

SEQ ID NO: 461980 - protein, 9 aa, Homo Sapiens
DEALRKSWT

SEQ ID NO: 461981 - protein, 9 aa, Homo Sapiens
GECKKDGDP

SEQ ID NO: 461982 - protein, 9 aa, Homo Sapiens
LRKSWTTKV

SEQ ID NO: 461983 - protein, 9 aa, Homo Sapiens
NNFRRRGLD

SEQ ID NO: 461984 - protein, 9 aa, Homo Sapiens
RGLDQHISG

SEQ ID NO: 461985 - protein, 9 aa, Homo Sapiens
AFVSVCIQE

SEQ ID NO: 461986 - protein, 9 aa, Homo Sapiens
LIDYKFGEC

SEQ ID NO: 461987 - protein, 9 aa, Homo Sapiens
KFQWKIQVE

SEQ ID NO: 461988 - protein, 9 aa, Homo Sapiens
QRQGLREAL

SEQ ID NO: 461989 - protein, 9 aa, Homo Sapiens
HVSLFTPKN

SEQ ID NO: 461990 - protein, 9 aa, Homo Sapiens
YLICNTINL

SEQ ID NO: 461991 - protein, 9 aa, Homo Sapiens
AGLDAFQIF

SEQ ID NO: 461992 - protein, 9 aa, Homo Sapiens
PQKLFIDGF

SEQ ID NO: 461993 - protein, 9 aa, Homo Sapiens
EPADLKQAS

SEQ ID NO: 461994 - protein, 9 aa, Homo Sapiens
VYECIVRTC

SEQ ID NO: 461995 - protein, 9 aa, Homo Sapiens
TCCIPRQIW

SEQ ID NO: 461996 - protein, 9 aa, Homo Sapiens
YECIVRTCE

SEQ ID NO: 461997 - protein, 9 aa, Homo Sapiens
KKPQKPIPQ

SEQ ID NO: 461998 - protein, 9 aa, Homo Sapiens
FQIFLKSEF

SEQ ID NO: 461999 - protein, 9 aa, Homo Sapiens
GYGCAQKSR

SEQ ID NO: 462000 - protein, 9 aa, Homo Sapiens
PQRMRSHSR

SEQ ID NO: 462001 - protein, 9 aa, Homo Sapiens
WKIQVELDW

SEQ ID NO: 462002 - protein, 9 aa, Homo Sapiens
PEPVQDFFD

SEQ ID NO: 462003 - protein, 9 aa, Homo Sapiens
AQKSRPGVY

SEQ ID NO: 462004 - protein, 9 aa, Homo Sapiens
VTYQQTTCC

SEQ ID NO: 462005 - protein, 9 aa, Homo Sapiens
EIAIRPMNK

SEQ ID NO: 462006 - protein, 9 aa, Homo Sapiens
PKEFFWNIE

SEQ ID NO: 462007 - protein, 9 aa, Homo Sapiens
SSDGLHPVI

SEQ ID NO: 462008 - protein, 9 aa, Homo Sapiens
DIQINIWYG

SEQ ID NO: 462009 - protein, 9 aa, Homo Sapiens
EQIKESKKE

SEQ ID NO: 462010 - protein, 9 aa, Homo Sapiens
KEFFWNIEE

SEQ ID NO: 462011 - protein, 9 aa, Homo Sapiens
LHPVITPSR

SEQ ID NO: 462012 - protein, 9 aa, Homo Sapiens
QRPQRMRSH

SEQ ID NO: 462013 - protein, 9 aa, Homo Sapiens
QRKWYTLLA

SEQ ID NO: 462014 - protein, 9 aa, Homo Sapiens
TMPQKLFID

SEQ ID NO: 462015 - protein, 9 aa, Homo Sapiens
WGYGCAQKS

SEQ ID NO: 462016 - protein, 9 aa, Homo Sapiens
VELDWRRKH

SEQ ID NO: 462017 - protein, 9 aa, Homo Sapiens
YDKPISELD

SEQ ID NO: 462018 - protein, 9 aa, Homo Sapiens
AIRPMNKTV

SEQ ID NO: 462019 - protein, 9 aa, Homo Sapiens
VLHRWLQQT

SEQ ID NO: 462020 - protein, 9 aa, Homo Sapiens
CREAVLHRW

SEQ ID NO: 462021 - protein, 9 aa, Homo Sapiens
LHRWLQQTI

SEQ ID NO: 462022 - protein, 9 aa, Homo Sapiens
HRWLQQTIK

SEQ ID NO: 462023 - protein, 9 aa, Homo Sapiens
EAVLHRWLQ

SEQ ID NO: 462024 - protein, 9 aa, Homo Sapiens
AVLHRWLQQ

SEQ ID NO: 462025 - protein, 9 aa, Homo Sapiens
REAVLHRWL

SEQ ID NO: 462026 - protein, 9 aa, Homo Sapiens
KKFIYIHCV

SEQ ID NO: 462027 - protein, 9 aa, Homo Sapiens
GYDNELRPD

SEQ ID NO: 462028 - protein, 9 aa, Homo Sapiens
YSSSNRGAP

SEQ ID NO: 462029 - protein, 9 aa, Homo Sapiens
IFKIKKKKF

SEQ ID NO: 462030 - protein, 9 aa, Homo Sapiens
KKKFIYIHC

SEQ ID NO: 462031 - protein, 9 aa, Homo Sapiens
NELRPDIGV

SEQ ID NO: 462032 - protein, 9 aa, Homo Sapiens
ETWGFEQNN

SEQ ID NO: 462033 - protein, 9 aa, Homo Sapiens
YCQGSPDFY

SEQ ID NO: 462034 - protein, 9 aa, Homo Sapiens
KVMYKQFKQ

SEQ ID NO: 462035 - protein, 9 aa, Homo Sapiens
KCVECGKIF

SEQ ID NO: 462036 - protein, 9 aa, Homo Sapiens
ALPVTLGTS

SEQ ID NO: 462037 - protein, 9 aa, Homo Sapiens
LEGERDLKI

SEQ ID NO: 462038 - protein, 9 aa, Homo Sapiens
IYKIIHTGE

SEQ ID NO: 462039 - protein, 9 aa, Homo Sapiens
PDANTYHQR

SEQ ID NO: 462040 - protein, 9 aa, Homo Sapiens
FIYIHCVDR

SEQ ID NO: 462041 - protein, 9 aa, Homo Sapiens
QAERAVVLE

SEQ ID NO: 462042 - protein, 9 aa, Homo Sapiens
CVECGKIFS

SEQ ID NO: 462043 - protein, 9 aa, Homo Sapiens
DNELRPDIG

SEQ ID NO: 462044 - protein, 9 aa, Homo Sapiens
INKKMLQLI

SEQ ID NO: 462045 - protein, 9 aa, Homo Sapiens
TPVRNLPGL

SEQ ID NO: 462046 - protein, 9 aa, Homo Sapiens
VNITCSTSW

SEQ ID NO: 462047 - protein, 9 aa, Homo Sapiens
LMLELKIMS

SEQ ID NO: 462048 - protein, 9 aa, Homo Sapiens
AAGSWKWLV

SEQ ID NO: 462049 - protein, 9 aa, Homo Sapiens
LIINSGKID

SEQ ID NO: 462050 - protein, 9 aa, Homo Sapiens
PLTNCLIIN

SEQ ID NO: 462051 - protein, 9 aa, Homo Sapiens
VLAHVLRTL

SEQ ID NO: 462052 - protein, 9 aa, Homo Sapiens
LELKIMSHL

SEQ ID NO: 462053 - protein, 9 aa, Homo Sapiens
STLSIYKII

SEQ ID NO: 462054 - protein, 9 aa, Homo Sapiens
ASGQKNQPR

SEQ ID NO: 462055 - protein, 9 aa, Homo Sapiens
RTLAPRLGI

SEQ ID NO: 462056 - protein, 9 aa, Homo Sapiens
VKGNLQTIG

SEQ ID NO: 462057 - protein, 9 aa, Homo Sapiens
TRIVCGSGA

SEQ ID NO: 462058 - protein, 9 aa, Homo Sapiens
YIEKHIEHG

SEQ ID NO: 462059 - protein, 9 aa, Homo Sapiens
CQGSPDFYG

SEQ ID NO: 462060 - protein, 9 aa, Homo Sapiens
NLQTIGLSA

SEQ ID NO: 462061 - protein, 9 aa, Homo Sapiens
CPSPILIDC

SEQ ID NO: 462062 - protein, 9 aa, Homo Sapiens
NNTWRQYNE

SEQ ID NO: 462063 - protein, 9 aa, Homo Sapiens
QPREERDLP

SEQ ID NO: 462064 - protein, 9 aa, Homo Sapiens
GYTVLLGVA

SEQ ID NO: 462065 - protein, 9 aa, Homo Sapiens
KGNLQTIGL

SEQ ID NO: 462066 - protein, 9 aa, Homo Sapiens
RCAWAAPLW

SEQ ID NO: 462067 - protein, 9 aa, Homo Sapiens
GREFQGCPF

SEQ ID NO: 462068 - protein, 9 aa, Homo Sapiens
SPDANTYHQ

SEQ ID NO: 462069 - protein, 9 aa, Homo Sapiens
VLRDGLNST

SEQ ID NO: 462070 - protein, 9 aa, Homo Sapiens
MNETSAVIT

SEQ ID NO: 462071 - protein, 9 aa, Homo Sapiens
YHQRLPAFT

SEQ ID NO: 462072 - protein, 9 aa, Homo Sapiens
GPLYSGCKL

SEQ ID NO: 462073 - protein, 9 aa, Homo Sapiens
TLSIYKIIH

SEQ ID NO: 462074 - protein, 9 aa, Homo Sapiens
DSYSSSNRG

SEQ ID NO: 462075 - protein, 9 aa, Homo Sapiens
VMYKQFKQI

SEQ ID NO: 462076 - protein, 9 aa, Homo Sapiens
SSNRGAPRG

SEQ ID NO: 462077 - protein, 9 aa, Homo Sapiens
PILIDCPHP

SEQ ID NO: 462078 - protein, 9 aa, Homo Sapiens
TGTRIVCGS

SEQ ID NO: 462079 - protein, 9 aa, Homo Sapiens
GTRIVCGSG

SEQ ID NO: 462080 - protein, 9 aa, Homo Sapiens
GDPDTEADV

SEQ ID NO: 462081 - protein, 9 aa, Homo Sapiens
LYCQGSPDF

SEQ ID NO: 462082 - protein, 9 aa, Homo Sapiens
SEYIEKHIE

SEQ ID NO: 462083 - protein, 9 aa, Homo Sapiens
SRIRTALGN

SEQ ID NO: 462084 - protein, 9 aa, Homo Sapiens
HSSLAQPLL

SEQ ID NO: 462085 - protein, 9 aa, Homo Sapiens
PFCGPNTIL

SEQ ID NO: 462086 - protein, 9 aa, Homo Sapiens
ALMLELKIM

SEQ ID NO: 462087 - protein, 9 aa, Homo Sapiens
FEQNNTWRQ

SEQ ID NO: 462088 - protein, 9 aa, Homo Sapiens
APQAERAVV

SEQ ID NO: 462089 - protein, 9 aa, Homo Sapiens
KYMKSLQKR

SEQ ID NO: 462090 - protein, 9 aa, Homo Sapiens
LVPGTGTRI

SEQ ID NO: 462091 - protein, 9 aa, Homo Sapiens
YTVLLGVAG

SEQ ID NO: 462092 - protein, 9 aa, Homo Sapiens
PLYSGCKLT

SEQ ID NO: 462093 - protein, 9 aa, Homo Sapiens
YLCGVKGNL

SEQ ID NO: 462094 - protein, 9 aa, Homo Sapiens
IRGFDVDIS

SEQ ID NO: 462095 - protein, 9 aa, Homo Sapiens
SSSNRGAPR

SEQ ID NO: 462096 - protein, 9 aa, Homo Sapiens
IFSYSSHYI

SEQ ID NO: 462097 - protein, 9 aa, Homo Sapiens
PVRNLPGLC

SEQ ID NO: 462098 - protein, 9 aa, Homo Sapiens
HRDRILDFR

SEQ ID NO: 462099 - protein, 9 aa, Homo Sapiens
DRNCPSPIL

SEQ ID NO: 462100 - protein, 9 aa, Homo Sapiens
NITCSTSWG

SEQ ID NO: 462101 - protein, 9 aa, Homo Sapiens
SLAQPLLVP

SEQ ID NO: 462102 - protein, 9 aa, Homo Sapiens
NTYHQRLPA

SEQ ID NO: 462103 - protein, 9 aa, Homo Sapiens
KKMLQLIGI

SEQ ID NO: 462104 - protein, 9 aa, Homo Sapiens
KSLQKRAKI

SEQ ID NO: 462105 - protein, 9 aa, Homo Sapiens
TWRQYNETS

SEQ ID NO: 462106 - protein, 9 aa, Homo Sapiens
LNSTNHAII

SEQ ID NO: 462107 - protein, 9 aa, Homo Sapiens
NETSAVITA

SEQ ID NO: 462108 - protein, 9 aa, Homo Sapiens
LAPQAERAV

SEQ ID NO: 462109 - protein, 9 aa, Homo Sapiens
TELSLCRIM

SEQ ID NO: 462110 - protein, 9 aa, Homo Sapiens
LQKRAKIMV

SEQ ID NO: 462111 - protein, 9 aa, Homo Sapiens
IKKKKFIYI

SEQ ID NO: 462112 - protein, 9 aa, Homo Sapiens
IEKHIEHGG

SEQ ID NO: 462113 - protein, 9 aa, Homo Sapiens
EALPVTLGT

SEQ ID NO: 462114 - protein, 9 aa, Homo Sapiens
SGCKLTLLR

SEQ ID NO: 462115 - protein, 9 aa, Homo Sapiens
QNNTWRQYN

SEQ ID NO: 462116 - protein, 9 aa, Homo Sapiens
AFGEIIEPY

SEQ ID NO: 462117 - protein, 9 aa, Homo Sapiens
NPGDPDTEA

SEQ ID NO: 462118 - protein, 9 aa, Homo Sapiens
DRGLLFPET

SEQ ID NO: 462119 - protein, 9 aa, Homo Sapiens
STSWGLRGI

SEQ ID NO: 462120 - protein, 9 aa, Homo Sapiens
LRTLAPRLG

SEQ ID NO: 462121 - protein, 9 aa, Homo Sapiens
KKKKFIYIH

SEQ ID NO: 462122 - protein, 9 aa, Homo Sapiens
WRQYNETSF

SEQ ID NO: 462123 - protein, 9 aa, Homo Sapiens
IYTLRNKEI

SEQ ID NO: 462124 - protein, 9 aa, Homo Sapiens
NQPREERDL

SEQ ID NO: 462125 - protein, 9 aa, Homo Sapiens
HLEGERDLK

SEQ ID NO: 462126 - protein, 9 aa, Homo Sapiens
SRDSYSSSN

SEQ ID NO: 462127 - protein, 9 aa, Homo Sapiens
LVGYTVLLG

SEQ ID NO: 462128 - protein, 9 aa, Homo Sapiens
PSRIRTALG

SEQ ID NO: 462129 - protein, 9 aa, Homo Sapiens
FKIKKKKFI

SEQ ID NO: 462130 - protein, 9 aa, Homo Sapiens
NTILQFFCE

SEQ ID NO: 462131 - protein, 9 aa, Homo Sapiens
LSIYKIIHT

SEQ ID NO: 462132 - protein, 9 aa, Homo Sapiens
GCPFNSKPE

SEQ ID NO: 462133 - protein, 9 aa, Homo Sapiens
KLWGRKVFL

SEQ ID NO: 462134 - protein, 9 aa, Homo Sapiens
ECGKIFSYS

SEQ ID NO: 462135 - protein, 9 aa, Homo Sapiens
VLRTLAPRL

SEQ ID NO: 462136 - protein, 9 aa, Homo Sapiens
SPILIDCPH

SEQ ID NO: 462137 - protein, 9 aa, Homo Sapiens
LTQKDINKK

SEQ ID NO: 462138 - protein, 9 aa, Homo Sapiens
RDRILDFRR

SEQ ID NO: 462139 - protein, 9 aa, Homo Sapiens
NLLEGYDNE

SEQ ID NO: 462140 - protein, 9 aa, Homo Sapiens
LQFFCEIQP

SEQ ID NO: 462141 - protein, 9 aa, Homo Sapiens
IIAFGEIIE

SEQ ID NO: 462142 - protein, 9 aa, Homo Sapiens
NSTNHAIIQ

SEQ ID NO: 462143 - protein, 9 aa, Homo Sapiens
QTPVRNLPG

SEQ ID NO: 462144 - protein, 9 aa, Homo Sapiens
SSEKQALML

SEQ ID NO: 462145 - protein, 9 aa, Homo Sapiens
PVTLGTSSR

SEQ ID NO: 462146 - protein, 9 aa, Homo Sapiens
SDQVGKVMY

SEQ ID NO: 462147 - protein, 9 aa, Homo Sapiens
DISYFTGDY

SEQ ID NO: 462148 - protein, 9 aa, Homo Sapiens
YIHCVDRGL

SEQ ID NO: 462149 - protein, 9 aa, Homo Sapiens
TLAPRLGIS

SEQ ID NO: 462150 - protein, 9 aa, Homo Sapiens
NPSRIRTAL

SEQ ID NO: 462151 - protein, 9 aa, Homo Sapiens
AVVLELAKQ

SEQ ID NO: 462152 - protein, 9 aa, Homo Sapiens
AQPLLVPWE

SEQ ID NO: 462153 - protein, 9 aa, Homo Sapiens
RGLLFPETW

SEQ ID NO: 462154 - protein, 9 aa, Homo Sapiens
EGYDNELRP

SEQ ID NO: 462155 - protein, 9 aa, Homo Sapiens
GQKNQPREE

SEQ ID NO: 462156 - protein, 9 aa, Homo Sapiens
VGPLYSGCK

SEQ ID NO: 462157 - protein, 9 aa, Homo Sapiens
AEIAAFHRD

SEQ ID NO: 462158 - protein, 9 aa, Homo Sapiens
TAAPQNFTP

SEQ ID NO: 462159 - protein, 9 aa, Homo Sapiens
DSPDANTYH

SEQ ID NO: 462160 - protein, 9 aa, Homo Sapiens
CKLTLLRSE

SEQ ID NO: 462161 - protein, 9 aa, Homo Sapiens
KKENIIAFG

SEQ ID NO: 462162 - protein, 9 aa, Homo Sapiens
WLVYIRAAV

SEQ ID NO: 462163 - protein, 9 aa, Homo Sapiens
SIFKIKKKK

SEQ ID NO: 462164 - protein, 9 aa, Homo Sapiens
LLFPETWGF

SEQ ID NO: 462165 - protein, 9 aa, Homo Sapiens
KNQPREERD

SEQ ID NO: 462166 - protein, 9 aa, Homo Sapiens
PQAERAVVL

SEQ ID NO: 462167 - protein, 9 aa, Homo Sapiens
HCVDRGLLF

SEQ ID NO: 462168 - protein, 9 aa, Homo Sapiens
WTRFQWRRC

SEQ ID NO: 462169 - protein, 9 aa, Homo Sapiens
LAQPLLVPW

SEQ ID NO: 462170 - protein, 9 aa, Homo Sapiens
YMKSLQKRA

SEQ ID NO: 462171 - protein, 9 aa, Homo Sapiens
HDRPLTNCL

SEQ ID NO: 462172 - protein, 9 aa, Homo Sapiens
SWKWLVYIR

SEQ ID NO: 462173 - protein, 9 aa, Homo Sapiens
DGLNSTNHA

SEQ ID NO: 462174 - protein, 9 aa, Homo Sapiens
GVKGNLQTI

SEQ ID NO: 462175 - protein, 9 aa, Homo Sapiens
SGQKNQPRE

SEQ ID NO: 462176 - protein, 9 aa, Homo Sapiens
TVLAHVLRT

SEQ ID NO: 462177 - protein, 9 aa, Homo Sapiens
KHIEHGGKT

SEQ ID NO: 462178 - protein, 9 aa, Homo Sapiens
NCLIINSGK

SEQ ID NO: 462179 - protein, 9 aa, Homo Sapiens
LGVAGWRAL

SEQ ID NO: 462180 - protein, 9 aa, Homo Sapiens
MEALPVTLG

SEQ ID NO: 462181 - protein, 9 aa, Homo Sapiens
YDNELRPDI

SEQ ID NO: 462182 - protein, 9 aa, Homo Sapiens
AAFHRDRIL

SEQ ID NO: 462183 - protein, 9 aa, Homo Sapiens
MKKLWGRKV

SEQ ID NO: 462184 - protein, 9 aa, Homo Sapiens
LAHVLRTLA

SEQ ID NO: 462185 - protein, 9 aa, Homo Sapiens
FPETWGFEQ

SEQ ID NO: 462186 - protein, 9 aa, Homo Sapiens
TNHAIIQNL

SEQ ID NO: 462187 - protein, 9 aa, Homo Sapiens
PSPILIDCP

SEQ ID NO: 462188 - protein, 9 aa, Homo Sapiens
TRFQWRRCA

SEQ ID NO: 462189 - protein, 9 aa, Homo Sapiens
DSASGQKNQ

SEQ ID NO: 462190 - protein, 9 aa, Homo Sapiens
CSTSWGLRG

SEQ ID NO: 462191 - protein, 9 aa, Homo Sapiens
CGVKGNLQT

SEQ ID NO: 462192 - protein, 9 aa, Homo Sapiens
ELRPDIGVK

SEQ ID NO: 462193 - protein, 9 aa, Homo Sapiens
FKCVECGKI

SEQ ID NO: 462194 - protein, 9 aa, Homo Sapiens
VGYTVLLGV

SEQ ID NO: 462195 - protein, 9 aa, Homo Sapiens
ILQFFCEIQ

SEQ ID NO: 462196 - protein, 9 aa, Homo Sapiens
RTALGNEAS

SEQ ID NO: 462197 - protein, 9 aa, Homo Sapiens
DKVMLVNPG

SEQ ID NO: 462198 - protein, 9 aa, Homo Sapiens
KMLQLIGIT

SEQ ID NO: 462199 - protein, 9 aa, Homo Sapiens
AENTQTPVR

SEQ ID NO: 462200 - protein, 9 aa, Homo Sapiens
KTNPSRIRT

SEQ ID NO: 462201 - protein, 9 aa, Homo Sapiens
TSAVITAAP

SEQ ID NO: 462202 - protein, 9 aa, Homo Sapiens
AVITAAPQN

SEQ ID NO: 462203 - protein, 9 aa, Homo Sapiens
FQGCPFNSK

SEQ ID NO: 462204 - protein, 9 aa, Homo Sapiens
SWGLRGIYL

SEQ ID NO: 462205 - protein, 9 aa, Homo Sapiens
EQNNTWRQY

SEQ ID NO: 462206 - protein, 9 aa, Homo Sapiens
EKLEPSDKC

SEQ ID NO: 462207 - protein, 9 aa, Homo Sapiens
GERDLKITD

SEQ ID NO: 462208 - protein, 9 aa, Homo Sapiens
ANTYHQRLP

SEQ ID NO: 462209 - protein, 9 aa, Homo Sapiens
KDINKKMLQ

SEQ ID NO: 462210 - protein, 9 aa, Homo Sapiens
QSSTLSIYK

SEQ ID NO: 462211 - protein, 9 aa, Homo Sapiens
RQYNETSFL

SEQ ID NO: 462212 - protein, 9 aa, Homo Sapiens
IMGMKEMLR

SEQ ID NO: 462213 - protein, 9 aa, Homo Sapiens
VPGTGTRIV

SEQ ID NO: 462214 - protein, 9 aa, Homo Sapiens
IAFGEIIEP

SEQ ID NO: 462215 - protein, 9 aa, Homo Sapiens
HVLRTLAPR

SEQ ID NO: 462216 - protein, 9 aa, Homo Sapiens
FHRDRILDF

SEQ ID NO: 462217 - protein, 9 aa, Homo Sapiens
MLELKIMSH

SEQ ID NO: 462218 - protein, 9 aa, Homo Sapiens
REFQGCPFN

SEQ ID NO: 462219 - protein, 9 aa, Homo Sapiens
HQRLPAFTM

SEQ ID NO: 462220 - protein, 9 aa, Homo Sapiens
LRDGLNSTN

SEQ ID NO: 462221 - protein, 9 aa, Homo Sapiens
PSDQVGKVM

SEQ ID NO: 462222 - protein, 9 aa, Homo Sapiens
RFQWRRCAW

SEQ ID NO: 462223 - protein, 9 aa, Homo Sapiens
PNTILQFFC

SEQ ID NO: 462224 - protein, 9 aa, Homo Sapiens
WGREFQGCP

SEQ ID NO: 462225 - protein, 9 aa, Homo Sapiens
ETSAVITAA

SEQ ID NO: 462226 - protein, 9 aa, Homo Sapiens
LVNPGDPDT

SEQ ID NO: 462227 - protein, 9 aa, Homo Sapiens
KWLVYIRAA

SEQ ID NO: 462228 - protein, 9 aa, Homo Sapiens
SPDFYGSSV

SEQ ID NO: 462229 - protein, 9 aa, Homo Sapiens
RDSYSSSNR

SEQ ID NO: 462230 - protein, 9 aa, Homo Sapiens
AMKKLWGRK

SEQ ID NO: 462231 - protein, 9 aa, Homo Sapiens
CLIINSGKI

SEQ ID NO: 462232 - protein, 9 aa, Homo Sapiens
ISYFTGDYA

SEQ ID NO: 462233 - protein, 9 aa, Homo Sapiens
VWGREFQGC

SEQ ID NO: 462234 - protein, 9 aa, Homo Sapiens
RIMGMKEML

SEQ ID NO: 462235 - protein, 9 aa, Homo Sapiens
LAAGSWKWL

SEQ ID NO: 462236 - protein, 9 aa, Homo Sapiens
VVLELAKQQ

SEQ ID NO: 462237 - protein, 9 aa, Homo Sapiens
TNCLIINSG

SEQ ID NO: 462238 - protein, 9 aa, Homo Sapiens
QPLLVPWEA

SEQ ID NO: 462239 - protein, 9 aa, Homo Sapiens
RAKIMVHSP

SEQ ID NO: 462240 - protein, 9 aa, Homo Sapiens
CPFNSKPEL

SEQ ID NO: 462241 - protein, 9 aa, Homo Sapiens
LDRNCPSPI

SEQ ID NO: 462242 - protein, 9 aa, Homo Sapiens
LLEGYDNEL

SEQ ID NO: 462243 - protein, 9 aa, Homo Sapiens
FQWRRCAWA

SEQ ID NO: 462244 - protein, 9 aa, Homo Sapiens
TQTPVRNLP

SEQ ID NO: 462245 - protein, 9 aa, Homo Sapiens
LFPETWGFE

SEQ ID NO: 462246 - protein, 9 aa, Homo Sapiens
RLVPGTGTR

SEQ ID NO: 462247 - protein, 9 aa, Homo Sapiens
ENTQTPVRN

SEQ ID NO: 462248 - protein, 9 aa, Homo Sapiens
NTQTPVRNL

SEQ ID NO: 462249 - protein, 9 aa, Homo Sapiens
LLSSEYIEK

SEQ ID NO: 462250 - protein, 9 aa, Homo Sapiens
ITCSTSWGL

SEQ ID NO: 462251 - protein, 9 aa, Homo Sapiens
CVDRGLLFP

SEQ ID NO: 462252 - protein, 9 aa, Homo Sapiens
RIRTALGNE

SEQ ID NO: 462253 - protein, 9 aa, Homo Sapiens
AMEALPVTL

SEQ ID NO: 462254 - protein, 9 aa, Homo Sapiens
LEPSDKCEI

SEQ ID NO: 462255 - protein, 9 aa, Homo Sapiens
YKIIHTGEK

SEQ ID NO: 462256 - protein, 9 aa, Homo Sapiens
AERAVVLEL

SEQ ID NO: 462257 - protein, 9 aa, Homo Sapiens
TNPSRIRTA

SEQ ID NO: 462258 - protein, 9 aa, Homo Sapiens
FGEIIEPYR

SEQ ID NO: 462259 - protein, 9 aa, Homo Sapiens
TCSTSWGLR

SEQ ID NO: 462260 - protein, 9 aa, Homo Sapiens
NTWRQYNET

SEQ ID NO: 462261 - protein, 9 aa, Homo Sapiens
TVLLGVAGW

SEQ ID NO: 462262 - protein, 9 aa, Homo Sapiens
LWGRKVFLE

SEQ ID NO: 462263 - protein, 9 aa, Homo Sapiens
FDVDISYFT

SEQ ID NO: 462264 - protein, 9 aa, Homo Sapiens
KRAKIMVHS

SEQ ID NO: 462265 - protein, 9 aa, Homo Sapiens
SEKQALMLE

SEQ ID NO: 462266 - protein, 9 aa, Homo Sapiens
MKSLQKRAK

SEQ ID NO: 462267 - protein, 9 aa, Homo Sapiens
AHLEGERDL

SEQ ID NO: 462268 - protein, 9 aa, Homo Sapiens
WKWLVYIRA

SEQ ID NO: 462269 - protein, 9 aa, Homo Sapiens
DANTYHQRL

SEQ ID NO: 462270 - protein, 9 aa, Homo Sapiens
TQKDINKKM

SEQ ID NO: 462271 - protein, 9 aa, Homo Sapiens
TALGNEAST

SEQ ID NO: 462272 - protein, 9 aa, Homo Sapiens
TGVLAHLEG

SEQ ID NO: 462273 - protein, 9 aa, Homo Sapiens
QGCPFNSKP

SEQ ID NO: 462274 - protein, 9 aa, Homo Sapiens
ILIDCPHPN

SEQ ID NO: 462275 - protein, 9 aa, Homo Sapiens
KVFLEAKGK

SEQ ID NO: 462276 - protein, 9 aa, Homo Sapiens
GVLAHLEGE

SEQ ID NO: 462277 - protein, 9 aa, Homo Sapiens
EIAAFHRDR

SEQ ID NO: 462278 - protein, 9 aa, Homo Sapiens
IRTALGNEA

SEQ ID NO: 462279 - protein, 9 aa, Homo Sapiens
TSWGLRGIY

SEQ ID NO: 462280 - protein, 9 aa, Homo Sapiens
EPSDKCEIS

SEQ ID NO: 462281 - protein, 9 aa, Homo Sapiens
LVYIRAAVR

SEQ ID NO: 462282 - protein, 9 aa, Homo Sapiens
LGTSSRDED

SEQ ID NO: 462283 - protein, 9 aa, Homo Sapiens
EKQALMLEL

SEQ ID NO: 462284 - protein, 9 aa, Homo Sapiens
QKDINKKML

SEQ ID NO: 462285 - protein, 9 aa, Homo Sapiens
KLTLLRSEK

SEQ ID NO: 462286 - protein, 9 aa, Homo Sapiens
SLCRIMGMK

SEQ ID NO: 462287 - protein, 9 aa, Homo Sapiens
PETWGFEQN

SEQ ID NO: 462288 - protein, 9 aa, Homo Sapiens
DINKKMLQL

SEQ ID NO: 462289 - protein, 9 aa, Homo Sapiens
RAVVLELAK

SEQ ID NO: 462290 - protein, 9 aa, Homo Sapiens
RPLTNCLII

SEQ ID NO: 462291 - protein, 9 aa, Homo Sapiens
PSDKCEISI

SEQ ID NO: 462292 - protein, 9 aa, Homo Sapiens
CEISIDGDR

SEQ ID NO: 462293 - protein, 9 aa, Homo Sapiens
STNHAIIQN

SEQ ID NO: 462294 - protein, 9 aa, Homo Sapiens
QALMLELKI

SEQ ID NO: 462295 - protein, 9 aa, Homo Sapiens
GFEQNNTWR

SEQ ID NO: 462296 - protein, 9 aa, Homo Sapiens
GRKVFLEAK

SEQ ID NO: 462297 - protein, 9 aa, Homo Sapiens
KIFSYSSHY

SEQ ID NO: 462298 - protein, 9 aa, Homo Sapiens
VDISYFTGD

SEQ ID NO: 462299 - protein, 9 aa, Homo Sapiens
CGPNTILQF

SEQ ID NO: 462300 - protein, 9 aa, Homo Sapiens
AFHRDRILD

SEQ ID NO: 462301 - protein, 9 aa, Homo Sapiens
KCEISIDGD

SEQ ID NO: 462302 - protein, 9 aa, Homo Sapiens
GKVMYKQFK

SEQ ID NO: 462303 - protein, 9 aa, Homo Sapiens
ENIIAFGEI

SEQ ID NO: 462304 - protein, 9 aa, Homo Sapiens
SASGQKNQP

SEQ ID NO: 462305 - protein, 9 aa, Homo Sapiens
KVMLVNPGD

SEQ ID NO: 462306 - protein, 9 aa, Homo Sapiens
SYSSSNRGA

SEQ ID NO: 462307 - protein, 9 aa, Homo Sapiens
SSTLSIYKI

SEQ ID NO: 462308 - protein, 9 aa, Homo Sapiens
QKRAKIMVH

SEQ ID NO: 462309 - protein, 9 aa, Homo Sapiens
RKVFLEAKG

SEQ ID NO: 462310 - protein, 9 aa, Homo Sapiens
WGLRGIYLR

SEQ ID NO: 462311 - protein, 9 aa, Homo Sapiens
TWGFEQNNT

SEQ ID NO: 462312 - protein, 9 aa, Homo Sapiens
EGERDLKIT

SEQ ID NO: 462313 - protein, 9 aa, Homo Sapiens
QVGKVMYKQ

SEQ ID NO: 462314 - protein, 9 aa, Homo Sapiens
TILQFFCEI

SEQ ID NO: 462315 - protein, 9 aa, Homo Sapiens
NQSSTLSIY

SEQ ID NO: 462316 - protein, 9 aa, Homo Sapiens
PGTGTRIVC

SEQ ID NO: 462317 - protein, 9 aa, Homo Sapiens
WGFEQNNTW

SEQ ID NO: 462318 - protein, 9 aa, Homo Sapiens
EKHIEHGGK

SEQ ID NO: 462319 - protein, 9 aa, Homo Sapiens
KENIIAFGE

SEQ ID NO: 462320 - protein, 9 aa, Homo Sapiens
VIRGFDVDI

SEQ ID NO: 462321 - protein, 9 aa, Homo Sapiens
MLVNPGDPD

SEQ ID NO: 462322 - protein, 9 aa, Homo Sapiens
VMLVNPGDP

SEQ ID NO: 462323 - protein, 9 aa, Homo Sapiens
ITAAPQNFT

SEQ ID NO: 462324 - protein, 9 aa, Homo Sapiens
VDRGLLFPE

SEQ ID NO: 462325 - protein, 9 aa, Homo Sapiens
GFDVDISYF

SEQ ID NO: 462326 - protein, 9 aa, Homo Sapiens
IHCVDRGLL

SEQ ID NO: 462327 - protein, 9 aa, Homo Sapiens
ERAVVLELA

SEQ ID NO: 462328 - protein, 9 aa, Homo Sapiens
SNRGAPRGA

SEQ ID NO: 462329 - protein, 9 aa, Homo Sapiens
GLLFPETWG

SEQ ID NO: 462330 - protein, 9 aa, Homo Sapiens
RDGLNSTNH

SEQ ID NO: 462331 - protein, 9 aa, Homo Sapiens
VTLGTSSRD

SEQ ID NO: 462332 - protein, 9 aa, Homo Sapiens
QKNQPREER

SEQ ID NO: 462333 - protein, 9 aa, Homo Sapiens
GPNTILQFF

SEQ ID NO: 462334 - protein, 9 aa, Homo Sapiens
DVDISYFTG

SEQ ID NO: 462335 - protein, 9 aa, Homo Sapiens
VECGKIFSY

SEQ ID NO: 462336 - protein, 9 aa, Homo Sapiens
NAEIAAFHR

SEQ ID NO: 462337 - protein, 9 aa, Homo Sapiens
CRIMGMKEM

SEQ ID NO: 462338 - protein, 9 aa, Homo Sapiens
VGKVMYKQF

SEQ ID NO: 462339 - protein, 9 aa, Homo Sapiens
GNLQTIGLS

SEQ ID NO: 462340 - protein, 9 aa, Homo Sapiens
LLGVAGWRA

SEQ ID NO: 462341 - protein, 9 aa, Homo Sapiens
LCRIMGMKE

SEQ ID NO: 462342 - protein, 9 aa, Homo Sapiens
SLQKRAKIM

SEQ ID NO: 462343 - protein, 9 aa, Homo Sapiens
VLLGVAGWR

SEQ ID NO: 462344 - protein, 9 aa, Homo Sapiens
MGMKEMLRK

SEQ ID NO: 462345 - protein, 9 aa, Homo Sapiens
TYHQRLPAF

SEQ ID NO: 462346 - protein, 9 aa, Homo Sapiens
MYKQFKQIR

SEQ ID NO: 462347 - protein, 9 aa, Homo Sapiens
LTNCLIINS

SEQ ID NO: 462348 - protein, 9 aa, Homo Sapiens
LEGYDNELR

SEQ ID NO: 462349 - protein, 9 aa, Homo Sapiens
AHVLRTLAP

SEQ ID NO: 462350 - protein, 9 aa, Homo Sapiens
VNPGDPDTE

SEQ ID NO: 462351 - protein, 9 aa, Homo Sapiens
PGDPDTEAD

SEQ ID NO: 462352 - protein, 9 aa, Homo Sapiens
EFQGCPFNS

SEQ ID NO: 462353 - protein, 9 aa, Homo Sapiens
IAAFHRDRI

SEQ ID NO: 462354 - protein, 9 aa, Homo Sapiens
RIVCGSGAR

SEQ ID NO: 462355 - protein, 9 aa, Homo Sapiens
QWRRCAWAA

SEQ ID NO: 462356 - protein, 9 aa, Homo Sapiens
DRPLTNCLI

SEQ ID NO: 462357 - protein, 9 aa, Homo Sapiens
QGSPDFYGS

SEQ ID NO: 462358 - protein, 9 aa, Homo Sapiens
LSSEYIEKH

SEQ ID NO: 462359 - protein, 9 aa, Homo Sapiens
GEIIEPYRL

SEQ ID NO: 462360 - protein, 9 aa, Homo Sapiens
GSWKWLVYI

SEQ ID NO: 462361 - protein, 9 aa, Homo Sapiens
GTGTRIVCG

SEQ ID NO: 462362 - protein, 9 aa, Homo Sapiens
NRGAPRGAG

SEQ ID NO: 462363 - protein, 9 aa, Homo Sapiens
SDKCEISID

SEQ ID NO: 462364 - protein, 9 aa, Homo Sapiens
TLGTSSRDE

SEQ ID NO: 462365 - protein, 9 aa, Homo Sapiens
VLAHLEGER

SEQ ID NO: 462366 - protein, 9 aa, Homo Sapiens
DAENTQTPV

SEQ ID NO: 462367 - protein, 9 aa, Homo Sapiens
LCGVKGNLQ

SEQ ID NO: 462368 - protein, 9 aa, Homo Sapiens
GLNSTNHAI

SEQ ID NO: 462369 - protein, 9 aa, Homo Sapiens
NCPSPILID

SEQ ID NO: 462370 - protein, 9 aa, Homo Sapiens
EYIEKHIEH

SEQ ID NO: 462371 - protein, 9 aa, Homo Sapiens
DQVGKVMYK

SEQ ID NO: 462372 - protein, 9 aa, Homo Sapiens
GKIFSYSSH

SEQ ID NO: 462373 - protein, 9 aa, Homo Sapiens
ELSLCRIMG

SEQ ID NO: 462374 - protein, 9 aa, Homo Sapiens
SIYKIIHTG

SEQ ID NO: 462375 - protein, 9 aa, Homo Sapiens
CGKIFSYSS

SEQ ID NO: 462376 - protein, 9 aa, Homo Sapiens
VRNLPGLCS

SEQ ID NO: 462377 - protein, 9 aa, Homo Sapiens
ALVGYTVLL

SEQ ID NO: 462378 - protein, 9 aa, Homo Sapiens
VITAAPQNF

SEQ ID NO: 462379 - protein, 9 aa, Homo Sapiens
RGFDVDISY

SEQ ID NO: 462380 - protein, 9 aa, Homo Sapiens
HKGLYCQGS

SEQ ID NO: 462381 - protein, 9 aa, Homo Sapiens
CAWAAPLWP

SEQ ID NO: 462382 - protein, 9 aa, Homo Sapiens
LPVTLGTSS

SEQ ID NO: 462383 - protein, 9 aa, Homo Sapiens
LQTIGLSAA

SEQ ID NO: 462384 - protein, 9 aa, Homo Sapiens
FCGPNTILQ

SEQ ID NO: 462385 - protein, 9 aa, Homo Sapiens
KLEPSDKCE

SEQ ID NO: 462386 - protein, 9 aa, Homo Sapiens
RRCAWAAPL

SEQ ID NO: 462387 - protein, 9 aa, Homo Sapiens
KFIYIHCVD

SEQ ID NO: 462388 - protein, 9 aa, Homo Sapiens
LAHLEGERD

SEQ ID NO: 462389 - protein, 9 aa, Homo Sapiens
SSEYIEKHI

SEQ ID NO: 462390 - protein, 9 aa, Homo Sapiens
GLYCQGSPD

SEQ ID NO: 462391 - protein, 9 aa, Homo Sapiens
AGSWKWLVY

SEQ ID NO: 462392 - protein, 9 aa, Homo Sapiens
GCKLTLLRS

SEQ ID NO: 462393 - protein, 9 aa, Homo Sapiens
KKLWGRKVF

SEQ ID NO: 462394 - protein, 9 aa, Homo Sapiens
WGRKVFLEA

SEQ ID NO: 462395 - protein, 9 aa, Homo Sapiens
YSGCKLTLL

SEQ ID NO: 462396 - protein, 9 aa, Homo Sapiens
NKKMLQLIG

SEQ ID NO: 462397 - protein, 9 aa, Homo Sapiens
LSLCRIMGM

SEQ ID NO: 462398 - protein, 9 aa, Homo Sapiens
WRRCAWAAP

SEQ ID NO: 462399 - protein, 9 aa, Homo Sapiens
NIIAFGEII

SEQ ID NO: 462400 - protein, 9 aa, Homo Sapiens
KGLYCQGSP

SEQ ID NO: 462401 - protein, 9 aa, Homo Sapiens
IYIHCVDRG

SEQ ID NO: 462402 - protein, 9 aa, Homo Sapiens
SAVITAAPQ

SEQ ID NO: 462403 - protein, 9 aa, Homo Sapiens
KIKKKKFIY

SEQ ID NO: 462404 - protein, 9 aa, Homo Sapiens
RNCPSPILI

SEQ ID NO: 462405 - protein, 9 aa, Homo Sapiens
SSLAQPLLV

SEQ ID NO: 462406 - protein, 9 aa, Homo Sapiens
PLLVPWEAS

SEQ ID NO: 462407 - protein, 9 aa, Homo Sapiens
LYSGCKLTL

SEQ ID NO: 462408 - protein, 9 aa, Homo Sapiens
KQALMLELK

SEQ ID NO: 462409 - protein, 9 aa, Homo Sapiens
DKCEISIDG

SEQ ID NO: 462410 - protein, 9 aa, Homo Sapiens
GSPDFYGSS

SEQ ID NO: 462411 - protein, 9 aa, Homo Sapiens
SPSKDTLEP

SEQ ID NO: 462412 - protein, 9 aa, Homo Sapiens
IPELRVQAS

SEQ ID NO: 462413 - protein, 9 aa, Homo Sapiens
VEFAISWVQ

SEQ ID NO: 462414 - protein, 9 aa, Homo Sapiens
KFKMPSLRV

SEQ ID NO: 462415 - protein, 9 aa, Homo Sapiens
VWKSVVAIR

SEQ ID NO: 462416 - protein, 9 aa, Homo Sapiens
KSPSKDTLE

SEQ ID NO: 462417 - protein, 9 aa, Homo Sapiens
MPKFKMPSL

SEQ ID NO: 462418 - protein, 9 aa, Homo Sapiens
LLIILTSYE

SEQ ID NO: 462419 - protein, 9 aa, Homo Sapiens
ANWLCAFNK

SEQ ID NO: 462420 - protein, 9 aa, Homo Sapiens
KASQTLASR

SEQ ID NO: 462421 - protein, 9 aa, Homo Sapiens
HCFVILCGM

SEQ ID NO: 462422 - protein, 9 aa, Homo Sapiens
IPSAATLIL

SEQ ID NO: 462423 - protein, 9 aa, Homo Sapiens
KQQQPPTIY

SEQ ID NO: 462424 - protein, 9 aa, Homo Sapiens
EVKAMREQE

SEQ ID NO: 462425 - protein, 9 aa, Homo Sapiens
HQNLAALVS

SEQ ID NO: 462426 - protein, 9 aa, Homo Sapiens
RSHPGKARR

SEQ ID NO: 462427 - protein, 9 aa, Homo Sapiens
LCGMEFRLK

SEQ ID NO: 462428 - protein, 9 aa, Homo Sapiens
LRVSAPGKS

SEQ ID NO: 462429 - protein, 9 aa, Homo Sapiens
ETFIVWKSV

SEQ ID NO: 462430 - protein, 9 aa, Homo Sapiens
QQQPPTIYL

SEQ ID NO: 462431 - protein, 9 aa, Homo Sapiens
GSDTFNCCT

SEQ ID NO: 462432 - protein, 9 aa, Homo Sapiens
YVELASTKV

SEQ ID NO: 462433 - protein, 9 aa, Homo Sapiens
ILVNYIFFK

SEQ ID NO: 462434 - protein, 9 aa, Homo Sapiens
KDEANARPR

SEQ ID NO: 462435 - protein, 9 aa, Homo Sapiens
NWLCAFNKV

SEQ ID NO: 462436 - protein, 9 aa, Homo Sapiens
SDTFNCCTF

SEQ ID NO: 462437 - protein, 9 aa, Homo Sapiens
ILCGMEFRL

SEQ ID NO: 462438 - protein, 9 aa, Homo Sapiens
KAHPGEMCG

SEQ ID NO: 462439 - protein, 9 aa, Homo Sapiens
SQTLASRGA

SEQ ID NO: 462440 - protein, 9 aa, Homo Sapiens
CAFNKVRMQ

SEQ ID NO: 462441 - protein, 9 aa, Homo Sapiens
CVQGLLSTA

SEQ ID NO: 462442 - protein, 9 aa, Homo Sapiens
PELRVQASI

SEQ ID NO: 462443 - protein, 9 aa, Homo Sapiens
LNLSGNKTK

SEQ ID NO: 462444 - protein, 9 aa, Homo Sapiens
LILRNARKH

SEQ ID NO: 462445 - protein, 9 aa, Homo Sapiens
SQIKHQNLA

SEQ ID NO: 462446 - protein, 9 aa, Homo Sapiens
ASCSDPVTL

SEQ ID NO: 462447 - protein, 9 aa, Homo Sapiens
SLKDEANAR

SEQ ID NO: 462448 - protein, 9 aa, Homo Sapiens
TKDLSTVEA

SEQ ID NO: 462449 - protein, 9 aa, Homo Sapiens
TSYEFIIVT

SEQ ID NO: 462450 - protein, 9 aa, Homo Sapiens
SSGLGGLFS

SEQ ID NO: 462451 - protein, 9 aa, Homo Sapiens
FLFIGSDTF

SEQ ID NO: 462452 - protein, 9 aa, Homo Sapiens
NAGKLICVH

SEQ ID NO: 462453 - protein, 9 aa, Homo Sapiens
ELASTKVRP

SEQ ID NO: 462454 - protein, 9 aa, Homo Sapiens
PKKAHPGEM

SEQ ID NO: 462455 - protein, 9 aa, Homo Sapiens
KAMREQERN

SEQ ID NO: 462456 - protein, 9 aa, Homo Sapiens
QSSETCVQG

SEQ ID NO: 462457 - protein, 9 aa, Homo Sapiens
ELRVQASIL

SEQ ID NO: 462458 - protein, 9 aa, Homo Sapiens
LIRSHFLIQ

SEQ ID NO: 462459 - protein, 9 aa, Homo Sapiens
VPDSLKDEA

SEQ ID NO: 462460 - protein, 9 aa, Homo Sapiens
LCAFNKVRM

SEQ ID NO: 462461 - protein, 9 aa, Homo Sapiens
ALIGVYGWK

SEQ ID NO: 462462 - protein, 9 aa, Homo Sapiens
AKANWLCAF

SEQ ID NO: 462463 - protein, 9 aa, Homo Sapiens
GGLFSRTFG

SEQ ID NO: 462464 - protein, 9 aa, Homo Sapiens
VAIREQGKE

SEQ ID NO: 462465 - protein, 9 aa, Homo Sapiens
LIGVYGWKG

SEQ ID NO: 462466 - protein, 9 aa, Homo Sapiens
VILCGMEFR

SEQ ID NO: 462467 - protein, 9 aa, Homo Sapiens
IVWKSVVAI

SEQ ID NO: 462468 - protein, 9 aa, Homo Sapiens
DFQGLLQAF

SEQ ID NO: 462469 - protein, 9 aa, Homo Sapiens
EVERPKPMA

SEQ ID NO: 462470 - protein, 9 aa, Homo Sapiens
PTIYLLHYR

SEQ ID NO: 462471 - protein, 9 aa, Homo Sapiens
MSCHAQPPC

SEQ ID NO: 462472 - protein, 9 aa, Homo Sapiens
TSTILVVSH

SEQ ID NO: 462473 - protein, 9 aa, Homo Sapiens
WTSTILVVS

SEQ ID NO: 462474 - protein, 9 aa, Homo Sapiens
STKVRPQAN

SEQ ID NO: 462475 - protein, 9 aa, Homo Sapiens
HPGEMCGLI

SEQ ID NO: 462476 - protein, 9 aa, Homo Sapiens
GLDSPAILI

SEQ ID NO: 462477 - protein, 9 aa, Homo Sapiens
LICVHYFQT

SEQ ID NO: 462478 - protein, 9 aa, Homo Sapiens
KSHSQIKHQ

SEQ ID NO: 462479 - protein, 9 aa, Homo Sapiens
LILVNYIFF

SEQ ID NO: 462480 - protein, 9 aa, Homo Sapiens
AISWVQMNF

SEQ ID NO: 462481 - protein, 9 aa, Homo Sapiens
SETCVQGLL

SEQ ID NO: 462482 - protein, 9 aa, Homo Sapiens
SGLGGLFSR

SEQ ID NO: 462483 - protein, 9 aa, Homo Sapiens
SYEFIIVTT

SEQ ID NO: 462484 - protein, 9 aa, Homo Sapiens
TRVQHRSNK

SEQ ID NO: 462485 - protein, 9 aa, Homo Sapiens
VADIKASQT

SEQ ID NO: 462486 - protein, 9 aa, Homo Sapiens
CKIPELRVQ

SEQ ID NO: 462487 - protein, 9 aa, Homo Sapiens
GLGGLFSRT

SEQ ID NO: 462488 - protein, 9 aa, Homo Sapiens
YSPNNAKSL

SEQ ID NO: 462489 - protein, 9 aa, Homo Sapiens
TTKSPSKDT

SEQ ID NO: 462490 - protein, 9 aa, Homo Sapiens
TWTSTILVV

SEQ ID NO: 462491 - protein, 9 aa, Homo Sapiens
DIKASQTLA

SEQ ID NO: 462492 - protein, 9 aa, Homo Sapiens
VMLRSHPGK

SEQ ID NO: 462493 - protein, 9 aa, Homo Sapiens
LEKHLRYLN

SEQ ID NO: 462494 - protein, 9 aa, Homo Sapiens
QHLPLRSYS

SEQ ID NO: 462495 - protein, 9 aa, Homo Sapiens
DLIRSHFLI

SEQ ID NO: 462496 - protein, 9 aa, Homo Sapiens
ADIKASQTL

SEQ ID NO: 462497 - protein, 9 aa, Homo Sapiens
IGVYGWKGL

SEQ ID NO: 462498 - protein, 9 aa, Homo Sapiens
GITDFQGLL

SEQ ID NO: 462499 - protein, 9 aa, Homo Sapiens
SKILEKHLR

SEQ ID NO: 462500 - protein, 9 aa, Homo Sapiens
FSRTFGPSG

SEQ ID NO: 462501 - protein, 9 aa, Homo Sapiens
TCVQGLLST

SEQ ID NO: 462502 - protein, 9 aa, Homo Sapiens
AIREQGKEL

SEQ ID NO: 462503 - protein, 9 aa, Homo Sapiens
FFGLKCKNC

SEQ ID NO: 462504 - protein, 9 aa, Homo Sapiens
ELVWKQHLP

SEQ ID NO: 462505 - protein, 9 aa, Homo Sapiens
TDFQGLLQA

SEQ ID NO: 462506 - protein, 9 aa, Homo Sapiens
MLRSHPGKA

SEQ ID NO: 462507 - protein, 9 aa, Homo Sapiens
IKASQTLAS

SEQ ID NO: 462508 - protein, 9 aa, Homo Sapiens
AGFQMTRTV

SEQ ID NO: 462509 - protein, 9 aa, Homo Sapiens
LENYLQTWT

SEQ ID NO: 462510 - protein, 9 aa, Homo Sapiens
DTFNCCTFL

SEQ ID NO: 462511 - protein, 9 aa, Homo Sapiens
RSYSPNNAK

SEQ ID NO: 462512 - protein, 9 aa, Homo Sapiens
QQPPTIYLL

SEQ ID NO: 462513 - protein, 9 aa, Homo Sapiens
THDGHDDDV

SEQ ID NO: 462514 - protein, 9 aa, Homo Sapiens
PLRSYSPNN

SEQ ID NO: 462515 - protein, 9 aa, Homo Sapiens
QTWTSTILV

SEQ ID NO: 462516 - protein, 9 aa, Homo Sapiens
MPSLRVSAP

SEQ ID NO: 462517 - protein, 9 aa, Homo Sapiens
WLCAFNKVR

SEQ ID NO: 462518 - protein, 9 aa, Homo Sapiens
SRAKANWLC

SEQ ID NO: 462519 - protein, 9 aa, Homo Sapiens
VVAIREQGK

SEQ ID NO: 462520 - protein, 9 aa, Homo Sapiens
KHLRYLNDH

SEQ ID NO: 462521 - protein, 9 aa, Homo Sapiens
QMTRTVTTI

SEQ ID NO: 462522 - protein, 9 aa, Homo Sapiens
NKSKILEKH

SEQ ID NO: 462523 - protein, 9 aa, Homo Sapiens
AIVETHDGH

SEQ ID NO: 462524 - protein, 9 aa, Homo Sapiens
SHCFVILCG

SEQ ID NO: 462525 - protein, 9 aa, Homo Sapiens
VWKQHLPLR

SEQ ID NO: 462526 - protein, 9 aa, Homo Sapiens
YGITDFQGL

SEQ ID NO: 462527 - protein, 9 aa, Homo Sapiens
ITDFQGLLQ

SEQ ID NO: 462528 - protein, 9 aa, Homo Sapiens
HLRYLNDHF

SEQ ID NO: 462529 - protein, 9 aa, Homo Sapiens
KTEVKAMRE

SEQ ID NO: 462530 - protein, 9 aa, Homo Sapiens
SKVEFAISW

SEQ ID NO: 462531 - protein, 9 aa, Homo Sapiens
PMADGGWAP

SEQ ID NO: 462532 - protein, 9 aa, Homo Sapiens
NLQSSETCV

SEQ ID NO: 462533 - protein, 9 aa, Homo Sapiens
KLICVHYFQ

SEQ ID NO: 462534 - protein, 9 aa, Homo Sapiens
GASCSDPVT

SEQ ID NO: 462535 - protein, 9 aa, Homo Sapiens
VELEWEEST

SEQ ID NO: 462536 - protein, 9 aa, Homo Sapiens
AATLILRNA

SEQ ID NO: 462537 - protein, 9 aa, Homo Sapiens
MYGITDFQG

SEQ ID NO: 462538 - protein, 9 aa, Homo Sapiens
RVQHRSNKR

SEQ ID NO: 462539 - protein, 9 aa, Homo Sapiens
LVIWVAGFQ

SEQ ID NO: 462540 - protein, 9 aa, Homo Sapiens
LFSRTFGPS

SEQ ID NO: 462541 - protein, 9 aa, Homo Sapiens
IYIPLYTGH

SEQ ID NO: 462542 - protein, 9 aa, Homo Sapiens
FQMTRTVTT

SEQ ID NO: 462543 - protein, 9 aa, Homo Sapiens
KIPELRVQA

SEQ ID NO: 462544 - protein, 9 aa, Homo Sapiens
WVAGFQMTR

SEQ ID NO: 462545 - protein, 9 aa, Homo Sapiens
GKGMFFGLK

SEQ ID NO: 462546 - protein, 9 aa, Homo Sapiens
TKSPSKDTL

SEQ ID NO: 462547 - protein, 9 aa, Homo Sapiens
QNPVGASCS

SEQ ID NO: 462548 - protein, 9 aa, Homo Sapiens
CFVILCGME

SEQ ID NO: 462549 - protein, 9 aa, Homo Sapiens
KMPSLRVSA

SEQ ID NO: 462550 - protein, 9 aa, Homo Sapiens
LDSPAILIL

SEQ ID NO: 462551 - protein, 9 aa, Homo Sapiens
GWKGLPPSH

SEQ ID NO: 462552 - protein, 9 aa, Homo Sapiens
WKGLPPSHT

SEQ ID NO: 462553 - protein, 9 aa, Homo Sapiens
LQTWTSTIL

SEQ ID NO: 462554 - protein, 9 aa, Homo Sapiens
VLGTAIVET

SEQ ID NO: 462555 - protein, 9 aa, Homo Sapiens
NLSGNKTKD

SEQ ID NO: 462556 - protein, 9 aa, Homo Sapiens
PSAATLILR

SEQ ID NO: 462557 - protein, 9 aa, Homo Sapiens
FQGLLQAFE

SEQ ID NO: 462558 - protein, 9 aa, Homo Sapiens
PAILILVNY

SEQ ID NO: 462559 - protein, 9 aa, Homo Sapiens
YLQTWTSTI

SEQ ID NO: 462560 - protein, 9 aa, Homo Sapiens
KQHLPLRSY

SEQ ID NO: 462561 - protein, 9 aa, Homo Sapiens
SCSDPVTLN

SEQ ID NO: 462562 - protein, 9 aa, Homo Sapiens
LRNARKHFE

SEQ ID NO: 462563 - protein, 9 aa, Homo Sapiens
GKLICVHYF

SEQ ID NO: 462564 - protein, 9 aa, Homo Sapiens
KKAHPGEMC

SEQ ID NO: 462565 - protein, 9 aa, Homo Sapiens
SSSRSIYIP

SEQ ID NO: 462566 - protein, 9 aa, Homo Sapiens
SGNKTKDLS

SEQ ID NO: 462567 - protein, 9 aa, Homo Sapiens
RSNKRRDHR

SEQ ID NO: 462568 - protein, 9 aa, Homo Sapiens
GMSCHAQPP

SEQ ID NO: 462569 - protein, 9 aa, Homo Sapiens
MADSETFIV

SEQ ID NO: 462570 - protein, 9 aa, Homo Sapiens
DALIGVYGW

SEQ ID NO: 462571 - protein, 9 aa, Homo Sapiens
EKQQQPPTI

SEQ ID NO: 462572 - protein, 9 aa, Homo Sapiens
SWVQMNFLH

SEQ ID NO: 462573 - protein, 9 aa, Homo Sapiens
ICVHYFQTC

SEQ ID NO: 462574 - protein, 9 aa, Homo Sapiens
AMREQERNR

SEQ ID NO: 462575 - protein, 9 aa, Homo Sapiens
MADGGWAPW

SEQ ID NO: 462576 - protein, 9 aa, Homo Sapiens
WVQMNFLHL

SEQ ID NO: 462577 - protein, 9 aa, Homo Sapiens
VIWVAGFQM

SEQ ID NO: 462578 - protein, 9 aa, Homo Sapiens
ADSETFIVW

SEQ ID NO: 462579 - protein, 9 aa, Homo Sapiens
EFIIVTTLK

SEQ ID NO: 462580 - protein, 9 aa, Homo Sapiens
LASTKVRPQ

SEQ ID NO: 462581 - protein, 9 aa, Homo Sapiens
GKELVWKQH

SEQ ID NO: 462582 - protein, 9 aa, Homo Sapiens
WKQHLPLRS

SEQ ID NO: 462583 - protein, 9 aa, Homo Sapiens
NPVGASCSD

SEQ ID NO: 462584 - protein, 9 aa, Homo Sapiens
LTSYEFIIV

SEQ ID NO: 462585 - protein, 9 aa, Homo Sapiens
RVQASILFE

SEQ ID NO: 462586 - protein, 9 aa, Homo Sapiens
TLEPEAELA

SEQ ID NO: 462587 - protein, 9 aa, Homo Sapiens
VELASTKVR

SEQ ID NO: 462588 - protein, 9 aa, Homo Sapiens
FVILCGMEF

SEQ ID NO: 462589 - protein, 9 aa, Homo Sapiens
KPMADGGWA

SEQ ID NO: 462590 - protein, 9 aa, Homo Sapiens
IQNPVGASC

SEQ ID NO: 462591 - protein, 9 aa, Homo Sapiens
SAGITGMSC

SEQ ID NO: 462592 - protein, 9 aa, Homo Sapiens
VSPKKAHPG

SEQ ID NO: 462593 - protein, 9 aa, Homo Sapiens
PNNAKSLGL

SEQ ID NO: 462594 - protein, 9 aa, Homo Sapiens
PKPMADGGW

SEQ ID NO: 462595 - protein, 9 aa, Homo Sapiens
SHPGKARRK

SEQ ID NO: 462596 - protein, 9 aa, Homo Sapiens
PKFKMPSLR

SEQ ID NO: 462597 - protein, 9 aa, Homo Sapiens
AHPGEMCGL

SEQ ID NO: 462598 - protein, 9 aa, Homo Sapiens
FKMPSLRVS

SEQ ID NO: 462599 - protein, 9 aa, Homo Sapiens
KDTLEPEAE

SEQ ID NO: 462600 - protein, 9 aa, Homo Sapiens
RSHFLIQSV

SEQ ID NO: 462601 - protein, 9 aa, Homo Sapiens
QHCKIPELR

SEQ ID NO: 462602 - protein, 9 aa, Homo Sapiens
KKTEVKAMR

SEQ ID NO: 462603 - protein, 9 aa, Homo Sapiens
TAIVETHDG

SEQ ID NO: 462604 - protein, 9 aa, Homo Sapiens
VAGFQMTRT

SEQ ID NO: 462605 - protein, 9 aa, Homo Sapiens
ANARPRSCL

SEQ ID NO: 462606 - protein, 9 aa, Homo Sapiens
KKDLIRSHF

SEQ ID NO: 462607 - protein, 9 aa, Homo Sapiens
HSQIKHQNL

SEQ ID NO: 462608 - protein, 9 aa, Homo Sapiens
IILTSYEFI

SEQ ID NO: 462609 - protein, 9 aa, Homo Sapiens
WKSVVAIRE

SEQ ID NO: 462610 - protein, 9 aa, Homo Sapiens
LGGLFSRTF

SEQ ID NO: 462611 - protein, 9 aa, Homo Sapiens
LKKDLIRSH

SEQ ID NO: 462612 - protein, 9 aa, Homo Sapiens
EKHLRYLND

SEQ ID NO: 462613 - protein, 9 aa, Homo Sapiens
DVELEWEES

SEQ ID NO: 462614 - protein, 9 aa, Homo Sapiens
SLRVSAPGK

SEQ ID NO: 462615 - protein, 9 aa, Homo Sapiens
SIYIPLYTG

SEQ ID NO: 462616 - protein, 9 aa, Homo Sapiens
GLFSRTFGP

SEQ ID NO: 462617 - protein, 9 aa, Homo Sapiens
CSDPVTLNV

SEQ ID NO: 462618 - protein, 9 aa, Homo Sapiens
ILTSYEFII

SEQ ID NO: 462619 - protein, 9 aa, Homo Sapiens
YLNLSGNKT

SEQ ID NO: 462620 - protein, 9 aa, Homo Sapiens
LRVQASILF

SEQ ID NO: 462621 - protein, 9 aa, Homo Sapiens
SSSSRSIYI

SEQ ID NO: 462622 - protein, 9 aa, Homo Sapiens
LRSHPGKAR

SEQ ID NO: 462623 - protein, 9 aa, Homo Sapiens
IYLLHYRQA

SEQ ID NO: 462624 - protein, 9 aa, Homo Sapiens
KANWLCAFN

SEQ ID NO: 462625 - protein, 9 aa, Homo Sapiens
MREQERNRP

SEQ ID NO: 462626 - protein, 9 aa, Homo Sapiens
VETHDGHDD

SEQ ID NO: 462627 - protein, 9 aa, Homo Sapiens
SPKKAHPGE

SEQ ID NO: 462628 - protein, 9 aa, Homo Sapiens
VYGWKGLPP

SEQ ID NO: 462629 - protein, 9 aa, Homo Sapiens
IREQGKELV

SEQ ID NO: 462630 - protein, 9 aa, Homo Sapiens
LIILTSYEF

SEQ ID NO: 462631 - protein, 9 aa, Homo Sapiens
QPPTIYLLH

SEQ ID NO: 462632 - protein, 9 aa, Homo Sapiens
VQHRSNKRR

SEQ ID NO: 462633 - protein, 9 aa, Homo Sapiens
TFIVWKSVV

SEQ ID NO: 462634 - protein, 9 aa, Homo Sapiens
ETHDGHDDD

SEQ ID NO: 462635 - protein, 9 aa, Homo Sapiens
RSIYIPLYT

SEQ ID NO: 462636 - protein, 9 aa, Homo Sapiens
CHAQPPCCF

SEQ ID NO: 462637 - protein, 9 aa, Homo Sapiens
LPLRSYSPN

SEQ ID NO: 462638 - protein, 9 aa, Homo Sapiens
LSGNKTKDL

SEQ ID NO: 462639 - protein, 9 aa, Homo Sapiens
AVRTRVQHR

SEQ ID NO: 462640 - protein, 9 aa, Homo Sapiens
REQGKELVW

SEQ ID NO: 462641 - protein, 9 aa, Homo Sapiens
SPNNAKSLG

SEQ ID NO: 462642 - protein, 9 aa, Homo Sapiens
ILILVNYIF

SEQ ID NO: 462643 - protein, 9 aa, Homo Sapiens
NYLQTWTST

SEQ ID NO: 462644 - protein, 9 aa, Homo Sapiens
FIGSDTFNC

SEQ ID NO: 462645 - protein, 9 aa, Homo Sapiens
EANARPRSC

SEQ ID NO: 462646 - protein, 9 aa, Homo Sapiens
ASQTLASRG

SEQ ID NO: 462647 - protein, 9 aa, Homo Sapiens
SYSPNNAKS

SEQ ID NO: 462648 - protein, 9 aa, Homo Sapiens
NKTKDLSTV

SEQ ID NO: 462649 - protein, 9 aa, Homo Sapiens
SPAILILVN

SEQ ID NO: 462650 - protein, 9 aa, Homo Sapiens
SRSIYIPLY

SEQ ID NO: 462651 - protein, 9 aa, Homo Sapiens
IKHQNLAAL

SEQ ID NO: 462652 - protein, 9 aa, Homo Sapiens
AILILVNYI

SEQ ID NO: 462653 - protein, 9 aa, Homo Sapiens
TIYLLHYRQ

SEQ ID NO: 462654 - protein, 9 aa, Homo Sapiens
ELEWEESTM

SEQ ID NO: 462655 - protein, 9 aa, Homo Sapiens
SHSQIKHQN

SEQ ID NO: 462656 - protein, 9 aa, Homo Sapiens
ILEKHLRYL

SEQ ID NO: 462657 - protein, 9 aa, Homo Sapiens
DSPAILILV

SEQ ID NO: 462658 - protein, 9 aa, Homo Sapiens
YGWKGLPPS

SEQ ID NO: 462659 - protein, 9 aa, Homo Sapiens
EQGKELVWK

SEQ ID NO: 462660 - protein, 9 aa, Homo Sapiens
CTVCGKGMF

SEQ ID NO: 462661 - protein, 9 aa, Homo Sapiens
TVCGKGMFF

SEQ ID NO: 462662 - protein, 9 aa, Homo Sapiens
IVETHDGHD

SEQ ID NO: 462663 - protein, 9 aa, Homo Sapiens
SSETCVQGL

SEQ ID NO: 462664 - protein, 9 aa, Homo Sapiens
VSSSSRSIY

SEQ ID NO: 462665 - protein, 9 aa, Homo Sapiens
VKAMREQER

SEQ ID NO: 462666 - protein, 9 aa, Homo Sapiens
PSKDTLEPE

SEQ ID NO: 462667 - protein, 9 aa, Homo Sapiens
HLPLRSYSP

SEQ ID NO: 462668 - protein, 9 aa, Homo Sapiens
KVEFAISWV

SEQ ID NO: 462669 - protein, 9 aa, Homo Sapiens
VCGKGMFFG

SEQ ID NO: 462670 - protein, 9 aa, Homo Sapiens
HRSNKRRDH

SEQ ID NO: 462671 - protein, 9 aa, Homo Sapiens
DEANARPRS

SEQ ID NO: 462672 - protein, 9 aa, Homo Sapiens
KSVVAIREQ

SEQ ID NO: 462673 - protein, 9 aa, Homo Sapiens
EFAISWVQM

SEQ ID NO: 462674 - protein, 9 aa, Homo Sapiens
TEVKAMREQ

SEQ ID NO: 462675 - protein, 9 aa, Homo Sapiens
EEVERPKPM

SEQ ID NO: 462676 - protein, 9 aa, Homo Sapiens
KHQNLAALV

SEQ ID NO: 462677 - protein, 9 aa, Homo Sapiens
HFLIQSVKI

SEQ ID NO: 462678 - protein, 9 aa, Homo Sapiens
RAKANWLCA

SEQ ID NO: 462679 - protein, 9 aa, Homo Sapiens
KTKDLSTVE

SEQ ID NO: 462680 - protein, 9 aa, Homo Sapiens
ILRNARKHF

SEQ ID NO: 462681 - protein, 9 aa, Homo Sapiens
LFIGSDTFN

SEQ ID NO: 462682 - protein, 9 aa, Homo Sapiens
ATLILRNAR

SEQ ID NO: 462683 - protein, 9 aa, Homo Sapiens
AGKLICVHY

SEQ ID NO: 462684 - protein, 9 aa, Homo Sapiens
GKKTEVKAM

SEQ ID NO: 462685 - protein, 9 aa, Homo Sapiens
SCHAQPPCC

SEQ ID NO: 462686 - protein, 9 aa, Homo Sapiens
VHYFQTCGN

SEQ ID NO: 462687 - protein, 9 aa, Homo Sapiens
AGITGMSCH

SEQ ID NO: 462688 - protein, 9 aa, Homo Sapiens
GVYGWKGLP

SEQ ID NO: 462689 - protein, 9 aa, Homo Sapiens
ENYLQTWTS

SEQ ID NO: 462690 - protein, 9 aa, Homo Sapiens
KSKILEKHL

SEQ ID NO: 462691 - protein, 9 aa, Homo Sapiens
QIKHQNLAA

SEQ ID NO: 462692 - protein, 9 aa, Homo Sapiens
CVHYFQTCG

SEQ ID NO: 462693 - protein, 9 aa, Homo Sapiens
QNLQSSETC

SEQ ID NO: 462694 - protein, 9 aa, Homo Sapiens
LKDEANARP

SEQ ID NO: 462695 - protein, 9 aa, Homo Sapiens
FIVWKSVVA

SEQ ID NO: 462696 - protein, 9 aa, Homo Sapiens
IRSHFLIQS

SEQ ID NO: 462697 - protein, 9 aa, Homo Sapiens
KGMFFGLKC

SEQ ID NO: 462698 - protein, 9 aa, Homo Sapiens
DSYVELAST

SEQ ID NO: 462699 - protein, 9 aa, Homo Sapiens
PVGASCSDP

SEQ ID NO: 462700 - protein, 9 aa, Homo Sapiens
KELVWKQHL

SEQ ID NO: 462701 - protein, 9 aa, Homo Sapiens
SAATLILRN

SEQ ID NO: 462702 - protein, 9 aa, Homo Sapiens
HCKIPELRV

SEQ ID NO: 462703 - protein, 9 aa, Homo Sapiens
PGKARRKAA

SEQ ID NO: 462704 - protein, 9 aa, Homo Sapiens
SSRSIYIPL

SEQ ID NO: 462705 - protein, 9 aa, Homo Sapiens
TLASRGAEL

SEQ ID NO: 462706 - protein, 9 aa, Homo Sapiens
HPGKARRKA

SEQ ID NO: 462707 - protein, 9 aa, Homo Sapiens
VERPKPMAD

SEQ ID NO: 462708 - protein, 9 aa, Homo Sapiens
ASTKVRPQA

SEQ ID NO: 462709 - protein, 9 aa, Homo Sapiens
CGMEFRLKT

SEQ ID NO: 462710 - protein, 9 aa, Homo Sapiens
TGMSCHAQP
